United States Patent 7,888,497 (BIOINFORMATICALLY DETECTABLE GROUP OF NOVEL REGULATORY OLIGONUCLEOTIDES AND USES THEREOF) - sequence listing, part 53

SEQ ID NO: 2223644 - DNA, 12 bp, Homo sapiens
tcttgctctgct

SEQ ID NO: 2223645 - DNA, 13 bp, Homo sapiens
tcttgctctgctg

SEQ ID NO: 2223646 - DNA, 15 bp, Homo sapiens
tcttgctctgctgac

SEQ ID NO: 2223647 - DNA, 17 bp, Homo sapiens
tcttggtcagatttgaa

SEQ ID NO: 2223648 - DNA, 19 bp, Homo sapiens
tcttggtcctgctgcagtt

SEQ ID NO: 2223649 - DNA, 13 bp, Homo sapiens
tcttgtgtgttta

SEQ ID NO: 2223650 - DNA, 19 bp, Homo sapiens
tctttaatgtcacaggcag

SEQ ID NO: 2223651 - DNA, 20 bp, Homo sapiens
tctttaatgtcacaggcagg

SEQ ID NO: 2223652 - DNA, 15 bp, Homo sapiens
tctttacttcatgga

SEQ ID NO: 2223653 - DNA, 13 bp, Homo sapiens
tctttccaaagta

SEQ ID NO: 2223654 - DNA, 23 bp, Homo sapiens
tctttccaaagtacactgtttca

SEQ ID NO: 2223655 - DNA, 23 bp, Homo sapiens
tctttccctcccttcctctttcc

SEQ ID NO: 2223656 - DNA, 19 bp, Homo sapiens
tctttctggctatgcattt

SEQ ID NO: 2223657 - DNA, 17 bp, Homo sapiens
tctttggaccctgaggc

SEQ ID NO: 2223658 - DNA, 22 bp, Homo sapiens
tctttggtctacactgtgctga

SEQ ID NO: 2223659 - DNA, 20 bp, Homo sapiens
tctttgtacagacaacaaac

SEQ ID NO: 2223660 - DNA, 20 bp, Homo sapiens
tgaaaaaaaaaaacacaaaa

SEQ ID NO: 2223661 - DNA, 23 bp, Homo sapiens
tgaaaaaaaaaaacacaaaaaaa

SEQ ID NO: 2223662 - DNA, 14 bp, Homo sapiens
tgaaaaaaaaaggg

SEQ ID NO: 2223663 - DNA, 20 bp, Homo sapiens
tgaaaaaggaggaagagaaa

SEQ ID NO: 2223664 - DNA, 13 bp, Homo sapiens
tgaaaacacattt

SEQ ID NO: 2223665 - DNA, 15 bp, Homo sapiens
tgaaaacacattttt

SEQ ID NO: 2223666 - DNA, 20 bp, Homo sapiens
tgaaaacactgttctctgcc

SEQ ID NO: 2223667 - DNA, 21 bp, Homo sapiens
tgaaaacactgttctctgccc

SEQ ID NO: 2223668 - DNA, 15 bp, Homo sapiens
tgaaaagaaaaatga

SEQ ID NO: 2223669 - DNA, 22 bp, Homo sapiens
tgaaaagaaaaatgagcctggc

SEQ ID NO: 2223670 - DNA, 16 bp, Homo sapiens
tgaaaatcgtgacaac

SEQ ID NO: 2223671 - DNA, 21 bp, Homo sapiens
tgaaaattttgatgttttaag

SEQ ID NO: 2223672 - DNA, 15 bp, Homo sapiens
tgaaagactgtacaa

SEQ ID NO: 2223673 - DNA, 16 bp, Homo sapiens
tgaaagggcccagaga

SEQ ID NO: 2223674 - DNA, 17 bp, Homo sapiens
tgaaagggcccagagag

SEQ ID NO: 2223675 - DNA, 19 bp, Homo sapiens
tgaaatgaggtcagagcct

SEQ ID NO: 2223676 - DNA, 22 bp, Homo sapiens
tgaaatgaggtcagagcctgca

SEQ ID NO: 2223677 - DNA, 22 bp, Homo sapiens
tgaaccaagaactttccaggaa

SEQ ID NO: 2223678 - DNA, 20 bp, Homo sapiens
tgaaccacatcttgctctgc

SEQ ID NO: 2223679 - DNA, 14 bp, Homo sapiens
tgaactcctggcct

SEQ ID NO: 2223680 - DNA, 15 bp, Homo sapiens
tgaactcctggcctc

SEQ ID NO: 2223681 - DNA, 16 bp, Homo sapiens
tgaactcctggcctca

SEQ ID NO: 2223682 - DNA, 14 bp, Homo sapiens
tgaacttggcgctg

SEQ ID NO: 2223683 - DNA, 11 bp, Homo sapiens
tgaactttgac

SEQ ID NO: 2223684 - DNA, 17 bp, Homo sapiens
tgaactttgacctctgc

SEQ ID NO: 2223685 - DNA, 19 bp, Homo sapiens
tgaactttgacctctgcag

SEQ ID NO: 2223686 - DNA, 17 bp, Homo sapiens
tgaagacaatgacttac

SEQ ID NO: 2223687 - DNA, 23 bp, Homo sapiens
tgaagacaatgacttactgtaca

SEQ ID NO: 2223688 - DNA, 13 bp, Homo sapiens
tgaagacagagct

SEQ ID NO: 2223689 - DNA, 16 bp, Homo sapiens
tgaagacagagctaca

SEQ ID NO: 2223690 - DNA, 19 bp, Homo sapiens
tgaagactcattcttctgt

SEQ ID NO: 2223691 - DNA, 20 bp, Homo sapiens
tgaagactcattcttctgta

SEQ ID NO: 2223692 - DNA, 20 bp, Homo sapiens
tgaaggacattgcggacagc

SEQ ID NO: 2223693 - DNA, 17 bp, Homo sapiens
tgaaggccccgcccagg

SEQ ID NO: 2223694 - DNA, 20 bp, Homo sapiens
tgaaggctcgagcatgcctg

SEQ ID NO: 2223695 - DNA, 22 bp, Homo sapiens
tgaagtaatatgcacacatttt

SEQ ID NO: 2223696 - DNA, 13 bp, Homo sapiens
tgaagtcacacag

SEQ ID NO: 2223697 - DNA, 17 bp, Homo sapiens
tgaagtctttgtacaga

SEQ ID NO: 2223698 - DNA, 23 bp, Homo sapiens
tgaatgatgatcctaggcatttg

SEQ ID NO: 2223699 - DNA, 20 bp, Homo sapiens
tgaatggttttcaaaataaa

SEQ ID NO: 2223700 - DNA, 14 bp, Homo sapiens
tgaatgtcagtgtg

SEQ ID NO: 2223701 - DNA, 23 bp, Homo sapiens
tgaatttcttttgccgttattaa

SEQ ID NO: 2223702 - DNA, 13 bp, Homo sapiens
tgacaacactcat

SEQ ID NO: 2223703 - DNA, 23 bp, Homo sapiens
tgacaaggattgctactgtccta

SEQ ID NO: 2223704 - DNA, 18 bp, Homo sapiens
tgacacacagctctgtcc

SEQ ID NO: 2223705 - DNA, 21 bp, Homo sapiens
tgacacacagctctgtcctgg

SEQ ID NO: 2223706 - DNA, 16 bp, Homo sapiens
tgacacgaatattgct

SEQ ID NO: 2223707 - DNA, 19 bp, Homo sapiens
tgacacgaatattgctgat

SEQ ID NO: 2223708 - DNA, 14 bp, Homo sapiens
tgacagacacaggc

SEQ ID NO: 2223709 - DNA, 16 bp, Homo sapiens
tgacagacacaggccc

SEQ ID NO: 2223710 - DNA, 18 bp, Homo sapiens
tgacagaggcagccccat

SEQ ID NO: 2223711 - DNA, 23 bp, Homo sapiens
tgacagaggcagccccattctgc

SEQ ID NO: 2223712 - DNA, 17 bp, Homo sapiens
tgacaggcaatgctggc

SEQ ID NO: 2223713 - DNA, 20 bp, Homo sapiens
tgacaggcaatgctggctgt

SEQ ID NO: 2223714 - DNA, 21 bp, Homo sapiens
tgacagggcacaccgggcact

SEQ ID NO: 2223715 - DNA, 20 bp, Homo sapiens
tgacattgttggccaaagcc

SEQ ID NO: 2223716 - DNA, 20 bp, Homo sapiens
tgaccagcaccatctctcct

SEQ ID NO: 2223717 - DNA, 18 bp, Homo sapiens
tgaccattctccacctgc

SEQ ID NO: 2223718 - DNA, 18 bp, Homo sapiens
tgacctctgcagcaataa

SEQ ID NO: 2223719 - DNA, 21 bp, Homo sapiens
tgacctctgcagcaataaagc

SEQ ID NO: 2223720 - DNA, 23 bp, Homo sapiens
tgacctctgcagcaataaagcag

SEQ ID NO: 2223721 - DNA, 14 bp, Homo sapiens
tgacctgaggccct

SEQ ID NO: 2223722 - DNA, 19 bp, Homo sapiens
tgacctgaggcccttctct

SEQ ID NO: 2223723 - DNA, 16 bp, Homo sapiens
tgggggagtggccaca

SEQ ID NO: 2223724 - DNA, 20 bp, Homo sapiens
tgggggatcacagcctctga

SEQ ID NO: 2223725 - DNA, 21 bp, Homo sapiens
tgggggatcacagcctctgaa

SEQ ID NO: 2223726 - DNA, 16 bp, Homo sapiens
tgggggcctcagtgcc

SEQ ID NO: 2223727 - DNA, 19 bp, Homo sapiens
tgggggctgggcagaggaa

SEQ ID NO: 2223728 - DNA, 19 bp, Homo sapiens
tggggggctgaggtgggag

SEQ ID NO: 2223729 - DNA, 14 bp, Homo sapiens
tggggtacccactg

SEQ ID NO: 2223730 - DNA, 17 bp, Homo sapiens
tggggtaggaggaacag

SEQ ID NO: 2223731 - DNA, 15 bp, Homo sapiens
tggggtatgggagag

SEQ ID NO: 2223732 - DNA, 13 bp, Homo sapiens
tggggtcactctg

SEQ ID NO: 2223733 - DNA, 19 bp, Homo sapiens
tgggtgcttggaggaagga

SEQ ID NO: 2223734 - DNA, 20 bp, Homo sapiens
tgggtggcaccagcagcctg

SEQ ID NO: 2223735 - DNA, 21 bp, Homo sapiens
tgggtgtcaagagggtctgag

SEQ ID NO: 2223736 - DNA, 16 bp, Homo sapiens
tgggttcactgcaacc

SEQ ID NO: 2223737 - DNA, 18 bp, Homo sapiens
tgggtttctaaagctgcc

SEQ ID NO: 2223738 - DNA, 20 bp, Homo sapiens
tggtagagtgtgcctgaagt

SEQ ID NO: 2223739 - DNA, 18 bp, Homo sapiens
tggtcaccaaatcagctg

SEQ ID NO: 2223740 - DNA, 15 bp, Homo sapiens
tggtcccaccccaca

SEQ ID NO: 2223741 - DNA, 16 bp, Homo sapiens
tggtcccccttccatg

SEQ ID NO: 2223742 - DNA, 18 bp, Homo sapiens
tggtcccccttccatgga

SEQ ID NO: 2223743 - DNA, 23 bp, Homo sapiens
tggtcccccttccatggactttg

SEQ ID NO: 2223744 - DNA, 14 bp, Homo sapiens
tggtcggaaaacat

SEQ ID NO: 2223745 - DNA, 16 bp, Homo sapiens
tggtctacactgtgct

SEQ ID NO: 2223746 - DNA, 18 bp, Homo sapiens
tggtctgacccactgctt

SEQ ID NO: 2223747 - DNA, 16 bp, Homo sapiens
tggtgacctctgcctg

SEQ ID NO: 2223748 - DNA, 22 bp, Homo sapiens
tggtgacctctgcctgaagtca

SEQ ID NO: 2223749 - DNA, 17 bp, Homo sapiens
tggtgcgatctgggttc

SEQ ID NO: 2223750 - DNA, 12 bp, Homo sapiens
tggtggcagctc

SEQ ID NO: 2223751 - DNA, 16 bp, Homo sapiens
tggtggcagctcacct

SEQ ID NO: 2223752 - DNA, 19 bp, Homo sapiens
tggtggcagctcacctctc

SEQ ID NO: 2223753 - DNA, 15 bp, Homo sapiens
tggtggcagctgcgg

SEQ ID NO: 2223754 - DNA, 18 bp, Homo sapiens
tggtggtttcagaaatgt

SEQ ID NO: 2223755 - DNA, 19 bp, Homo sapiens
tggtggttttctgttcttt

SEQ ID NO: 2223756 - DNA, 19 bp, Homo sapiens
tggtgtcgggcatgacacg

SEQ ID NO: 2223757 - DNA, 17 bp, Homo sapiens
tggtgtttcctggcact

SEQ ID NO: 2223758 - DNA, 14 bp, Homo sapiens
tggttatggagagg

SEQ ID NO: 2223759 - DNA, 15 bp, Homo sapiens
tggtttcagaaatgt

SEQ ID NO: 2223760 - DNA, 14 bp, Homo sapiens
tggttttcaaaata

SEQ ID NO: 2223761 - DNA, 16 bp, Homo sapiens
tggttttctgttcttt

SEQ ID NO: 2223762 - DNA, 21 bp, Homo sapiens
tggtttttaaaaaactgctga

SEQ ID NO: 2223763 - DNA, 14 bp, Homo sapiens
tgtaaaaagggaaa

SEQ ID NO: 2223764 - DNA, 13 bp, Homo sapiens
tgtaaattaactt

SEQ ID NO: 2223765 - DNA, 14 bp, Homo sapiens
tgtaaattaacttt

SEQ ID NO: 2223766 - DNA, 15 bp, Homo sapiens
tgtaaattaactttt

SEQ ID NO: 2223767 - DNA, 17 bp, Homo sapiens
tgtaacaagccacccca

SEQ ID NO: 2223768 - DNA, 14 bp, Homo sapiens
tgtaatttgtgata

SEQ ID NO: 2223769 - DNA, 17 bp, Homo sapiens
tgtaatttgtgatacaa

SEQ ID NO: 2223770 - DNA, 23 bp, Homo sapiens
tgtacaaagtagaagtcttagat

SEQ ID NO: 2223771 - DNA, 23 bp, Homo sapiens
tgtacagcaaggagatttacaac

SEQ ID NO: 2223772 - DNA, 20 bp, Homo sapiens
tgtacataatgcgtgcatac

SEQ ID NO: 2223773 - DNA, 14 bp, Homo sapiens
tgtacctcttgagc

SEQ ID NO: 2223774 - DNA, 22 bp, Homo sapiens
tgtacctcttgagccttgaact

SEQ ID NO: 2223775 - DNA, 23 bp, Homo sapiens
tgtacctcttgagccttgaactt

SEQ ID NO: 2223776 - DNA, 19 bp, Homo sapiens
tgtactgcatatgaaagga

SEQ ID NO: 2223777 - DNA, 12 bp, Homo sapiens
tgtagagccagg

SEQ ID NO: 2223778 - DNA, 18 bp, Homo sapiens
tgtagagccagggtctca

SEQ ID NO: 2223779 - DNA, 18 bp, Homo sapiens
tgtaggaaggttaatgtt

SEQ ID NO: 2223780 - DNA, 20 bp, Homo sapiens
tgtaggaaggttaatgttca

SEQ ID NO: 2223781 - DNA, 17 bp, Homo sapiens
tgtaggcataaagtcag

SEQ ID NO: 2223782 - DNA, 16 bp, Homo sapiens
tgtagggttataataa

SEQ ID NO: 2223783 - DNA, 17 bp, Homo sapiens
tgtatcaatgagtaaca

SEQ ID NO: 2223784 - DNA, 23 bp, Homo sapiens
tgtatcccatgagcctcagcatc

SEQ ID NO: 2223785 - DNA, 13 bp, Homo sapiens
tgtatctgagcag

SEQ ID NO: 2223786 - DNA, 22 bp, Homo sapiens
tgtattctctcctgtacctctt

SEQ ID NO: 2223787 - DNA, 14 bp, Homo sapiens
tgtatttttttact

SEQ ID NO: 2223788 - DNA, 16 bp, Homo sapiens
tgtcaaagtggtgaga

SEQ ID NO: 2223789 - DNA, 13 bp, Homo sapiens
tgtcacacacttt

SEQ ID NO: 2223790 - DNA, 12 bp, Homo sapiens
tgtcacaggcag

SEQ ID NO: 2223791 - DNA, 14 bp, Homo sapiens
tgtcacaggcaggt

SEQ ID NO: 2223792 - DNA, 16 bp, Homo sapiens
tgtcagctgaacctgg

SEQ ID NO: 2223793 - DNA, 16 bp, Homo sapiens
tgtcagtgtgactgat

SEQ ID NO: 2223794 - DNA, 19 bp, Homo sapiens
tgtcagtgtgactgatctc

SEQ ID NO: 2223795 - DNA, 16 bp, Homo sapiens
tgtccaagaagcccag

SEQ ID NO: 2223796 - DNA, 18 bp, Homo sapiens
tgtccaagaagcccagga

SEQ ID NO: 2223797 - DNA, 22 bp, Homo sapiens
tgtccaagaagcccaggaaagg

SEQ ID NO: 2223798 - DNA, 23 bp, Homo sapiens
tgtcccaaaaagaaaggagggga

SEQ ID NO: 2223799 - DNA, 13 bp, Homo sapiens
tgtccccaccgca

SEQ ID NO: 2223800 - DNA, 16 bp, Homo sapiens
tgtccccgacccttgc

SEQ ID NO: 2223801 - DNA, 17 bp, Homo sapiens
tgtccccgcactgggct

SEQ ID NO: 2223802 - DNA, 20 bp, Homo sapiens
tgtccctgcacttgcagact

SEQ ID NO: 2223803 - DNA, 19 bp, Homo sapiens
tgtcccttacgtgagtcct

SEQ ID NO: 2223804 - DNA, 14 bp, Homo sapiens
tgtccgagctttga

SEQ ID NO: 2223805 - DNA, 19 bp, Homo sapiens
tgtcctgggagtgagctgg

SEQ ID NO: 2223806 - DNA, 20 bp, Homo sapiens
tgtcctgggagtgagctggt

SEQ ID NO: 2223807 - DNA, 23 bp, Homo sapiens
tgtctagttgtttgattcagaca

SEQ ID NO: 2223808 - DNA, 20 bp, Homo sapiens
tgtctcttggtcctgctgca

SEQ ID NO: 2223809 - DNA, 21 bp, Homo sapiens
tgtctcttggtcctgctgcag

SEQ ID NO: 2223810 - DNA, 20 bp, Homo sapiens
tgtcttgcaatggcagcctt

SEQ ID NO: 2223811 - DNA, 16 bp, Homo sapiens
tgtcttttcttgcatg

SEQ ID NO: 2223812 - DNA, 16 bp, Homo sapiens
tgtcttttttcactac

SEQ ID NO: 2223813 - DNA, 13 bp, Homo sapiens
tgtgaaaggaaag

SEQ ID NO: 2223814 - DNA, 19 bp, Homo sapiens
tgtgaaccaccacacccag

SEQ ID NO: 2223815 - DNA, 21 bp, Homo sapiens
tgtgaaccaccacacccagcc

SEQ ID NO: 2223816 - DNA, 15 bp, Homo sapiens
tgtgactgaatttct

SEQ ID NO: 2223817 - DNA, 16 bp, Homo sapiens
tgtgactgatctctcg

SEQ ID NO: 2223818 - DNA, 11 bp, Homo sapiens
tgtgaggaagc

SEQ ID NO: 2223819 - DNA, 13 bp, Homo sapiens
tgtgaggaagccg

SEQ ID NO: 2223820 - DNA, 18 bp, Homo sapiens
tgtgagtactacagtcct

SEQ ID NO: 2223821 - DNA, 19 bp, Homo sapiens
tgtgagtactacagtcctc

SEQ ID NO: 2223822 - DNA, 15 bp, Homo sapiens
tgtgagtcaccaagc

SEQ ID NO: 2223823 - DNA, 21 bp, Homo sapiens
tgtgagtcaccaagcccagtt

SEQ ID NO: 2223824 - DNA, 18 bp, Homo sapiens
tgtgatgagaggaaatca

SEQ ID NO: 2223825 - DNA, 22 bp, Homo sapiens
tgtgatgatgaaatgaggtcag

SEQ ID NO: 2223826 - DNA, 18 bp, Homo sapiens
tgtgatggggccctgcct

SEQ ID NO: 2223827 - DNA, 19 bp, Homo sapiens
tgtgatggggccctgcctc

SEQ ID NO: 2223828 - DNA, 19 bp, Homo sapiens
tgtgcattatctagatact

SEQ ID NO: 2223829 - DNA, 21 bp, Homo sapiens
tgtgcccccatgtaagcaccc

SEQ ID NO: 2223830 - DNA, 21 bp, Homo sapiens
tgtgccctaaagtgtattttt

SEQ ID NO: 2223831 - DNA, 22 bp, Homo sapiens
tgtgctctgatcatccactgtg

SEQ ID NO: 2223832 - DNA, 23 bp, Homo sapiens
tgtgctctgatcatccactgtgc

SEQ ID NO: 2223833 - DNA, 16 bp, Homo sapiens
tgtgctctggacaggc

SEQ ID NO: 2223834 - DNA, 18 bp, Homo sapiens
tgtgctctggacaggcat

SEQ ID NO: 2223835 - DNA, 15 bp, Homo sapiens
tgtgctgccctgccc

SEQ ID NO: 2223836 - DNA, 14 bp, Homo sapiens
tgtggacacagctc

SEQ ID NO: 2223837 - DNA, 22 bp, Homo sapiens
tgtggatttaacagaaatgtac

SEQ ID NO: 2223838 - DNA, 22 bp, Homo sapiens
tgtgggctagttgggcttcctc

SEQ ID NO: 2223839 - DNA, 20 bp, Homo sapiens
tgtggtgtttcctggcactg

SEQ ID NO: 2223840 - DNA, 16 bp, Homo sapiens
tgtgtagggcgggagg

SEQ ID NO: 2223841 - DNA, 19 bp, Homo sapiens
tgtgtcaggtggggcagct

SEQ ID NO: 2223842 - DNA, 17 bp, Homo sapiens
tgtgtctcttggtcctg

SEQ ID NO: 2223843 - DNA, 20 bp, Homo sapiens
tgtgtcttgcaatggcagcc

SEQ ID NO: 2223844 - DNA, 22 bp, Homo sapiens
tgtgttatcacccagaagaaaa

SEQ ID NO: 2223845 - DNA, 21 bp, Homo sapiens
tgttaacatggacatgatctt

SEQ ID NO: 2223846 - DNA, 13 bp, Homo sapiens
agaagacactgat

SEQ ID NO: 2223847 - DNA, 21 bp, Homo sapiens
agaagacactgatgggcaacc

SEQ ID NO: 2223848 - DNA, 21 bp, Homo sapiens
agaagagattgtggtttcatt

SEQ ID NO: 2223849 - DNA, 16 bp, Homo sapiens
agaagcccaggaaagg

SEQ ID NO: 2223850 - DNA, 22 bp, Homo sapiens
agaagcccaggaaaggctccag

SEQ ID NO: 2223851 - DNA, 16 bp, Homo sapiens
agaagcggctggcagc

SEQ ID NO: 2223852 - DNA, 20 bp, Homo sapiens
agaaggggcccaagagagac

SEQ ID NO: 2223853 - DNA, 14 bp, Homo sapiens
agaagtcacacagt

SEQ ID NO: 2223854 - DNA, 22 bp, Homo sapiens
agaagtttgagatcagcctggg

SEQ ID NO: 2223855 - DNA, 17 bp, Homo sapiens
agaatctcaaataacta

SEQ ID NO: 2223856 - DNA, 16 bp, Homo sapiens
agaatgaaagggccca

SEQ ID NO: 2223857 - DNA, 12 bp, Homo sapiens
agaatgcagaga

SEQ ID NO: 2223858 - DNA, 14 bp, Homo sapiens
agaatgcagagatg

SEQ ID NO: 2223859 - DNA, 18 bp, Homo sapiens
agaatgctctttacttca

SEQ ID NO: 2223860 - DNA, 19 bp, Homo sapiens
agaattctctagtttgatt

SEQ ID NO: 2223861 - DNA, 23 bp, Homo sapiens
agaatttcccaaagcagtgcatg

SEQ ID NO: 2223862 - DNA, 20 bp, Homo sapiens
agacaatgacttactgtaca

SEQ ID NO: 2223863 - DNA, 22 bp, Homo sapiens
agacaatgacttactgtacatg

SEQ ID NO: 2223864 - DNA, 20 bp, Homo sapiens
agacaatgtgaaaagaaaaa

SEQ ID NO: 2223865 - DNA, 14 bp, Homo sapiens
agacaatttattat

SEQ ID NO: 2223866 - DNA, 13 bp, Homo sapiens
agacacaggcccg

SEQ ID NO: 2223867 - DNA, 17 bp, Homo sapiens
agacacaggcccggctc

SEQ ID NO: 2223868 - DNA, 19 bp, Homo sapiens
agacacaggcccggctcca

SEQ ID NO: 2223869 - DNA, 21 bp, Homo sapiens
agacacaggcccggctccagg

SEQ ID NO: 2223870 - DNA, 23 bp, Homo sapiens
agacacaggcccggctccaggct

SEQ ID NO: 2223871 - DNA, 20 bp, Homo sapiens
agacacatgtccaagaagcc

SEQ ID NO: 2223872 - DNA, 11 bp, Homo sapiens
agacagagtct

SEQ ID NO: 2223873 - DNA, 19 bp, Homo sapiens
agacagagtctcactgttg

SEQ ID NO: 2223874 - DNA, 20 bp, Homo sapiens
agacagagtctcactgttgc

SEQ ID NO: 2223875 - DNA, 21 bp, Homo sapiens
agacagagtctcactgttgcc

SEQ ID NO: 2223876 - DNA, 13 bp, Homo sapiens
agacagcacaggc

SEQ ID NO: 2223877 - DNA, 16 bp, Homo sapiens
agacagcacaggcagc

SEQ ID NO: 2223878 - DNA, 20 bp, Homo sapiens
agacagcccgggctctgcct

SEQ ID NO: 2223879 - DNA, 15 bp, Homo sapiens
agacagctgcctggg

SEQ ID NO: 2223880 - DNA, 16 bp, Homo sapiens
agacagctgcctggga

SEQ ID NO: 2223881 - DNA, 17 bp, Homo sapiens
agacagtccctgccaat

SEQ ID NO: 2223882 - DNA, 19 bp, Homo sapiens
agacagtccctgccaatgg

SEQ ID NO: 2223883 - DNA, 19 bp, Homo sapiens
agacatactaaccagcaga

SEQ ID NO: 2223884 - DNA, 20 bp, Homo sapiens
agacccttgtggtcccaccc

SEQ ID NO: 2223885 - DNA, 23 bp, Homo sapiens
agacccttgtggtcccaccccac

SEQ ID NO: 2223886 - DNA, 16 bp, Homo sapiens
agacgctgtgctgccc

SEQ ID NO: 2223887 - DNA, 18 bp, Homo sapiens
agacgctgtgctgccctg

SEQ ID NO: 2223888 - DNA, 22 bp, Homo sapiens
agacgctgtgctgccctgccca

SEQ ID NO: 2223889 - DNA, 18 bp, Homo sapiens
agacgggggcagagaggg

SEQ ID NO: 2223890 - DNA, 18 bp, Homo sapiens
agactatctaaatgttga

SEQ ID NO: 2223891 - DNA, 19 bp, Homo sapiens
agactatctaaatgttgaa

SEQ ID NO: 2223892 - DNA, 14 bp, Homo sapiens
agactcctgcaggc

SEQ ID NO: 2223893 - DNA, 17 bp, Homo sapiens
agactcctgcaggcagc

SEQ ID NO: 2223894 - DNA, 19 bp, Homo sapiens
agactcctgcaggcagcca

SEQ ID NO: 2223895 - DNA, 23 bp, Homo sapiens
agactcctgcaggcagccaggcc

SEQ ID NO: 2223896 - DNA, 18 bp, Homo sapiens
agactcgcgacaatgcaa

SEQ ID NO: 2223897 - DNA, 20 bp, Homo sapiens
agactcgcgacaatgcaaac

SEQ ID NO: 2223898 - DNA, 16 bp, Homo sapiens
agactctttggacact

SEQ ID NO: 2223899 - DNA, 17 bp, Homo sapiens
agacttcatccctctgg

SEQ ID NO: 2223900 - DNA, 15 bp, Homo sapiens
agagaaagagagaga

SEQ ID NO: 2223901 - DNA, 21 bp, Homo sapiens
agagaagagattgtggtttca

SEQ ID NO: 2223902 - DNA, 16 bp, Homo sapiens
agagacagcacaggca

SEQ ID NO: 2223903 - DNA, 17 bp, Homo sapiens
agagacagcacaggcag

SEQ ID NO: 2223904 - DNA, 13 bp, Homo sapiens
agagaccatccct

SEQ ID NO: 2223905 - DNA, 21 bp, Homo sapiens
agagaccatccctgaaggccc

SEQ ID NO: 2223906 - DNA, 11 bp, Homo sapiens
agagactcctg

SEQ ID NO: 2223907 - DNA, 12 bp, Homo sapiens
agagactcctgc

SEQ ID NO: 2223908 - DNA, 21 bp, Homo sapiens
agagactcctgcaggcagcca

SEQ ID NO: 2223909 - DNA, 16 bp, Homo sapiens
agagagacagcacagg

SEQ ID NO: 2223910 - DNA, 17 bp, Homo sapiens
agagagacagcacaggc

SEQ ID NO: 2223911 - DNA, 14 bp, Homo sapiens
agagagagaaagag

SEQ ID NO: 2223912 - DNA, 11 bp, Homo sapiens
agagagagaag

SEQ ID NO: 2223913 - DNA, 14 bp, Homo sapiens
agagagagaagggg

SEQ ID NO: 2223914 - DNA, 12 bp, Homo sapiens
agagagagagaa

SEQ ID NO: 2223915 - DNA, 13 bp, Homo sapiens
agagagagagaaa

SEQ ID NO: 2223916 - DNA, 13 bp, Homo sapiens
agagagagagaga

SEQ ID NO: 2223917 - DNA, 15 bp, Homo sapiens
agagagagagagaaa

SEQ ID NO: 2223918 - DNA, 19 bp, Homo sapiens
agagagcaagacgctgtgc

SEQ ID NO: 2223919 - DNA, 21 bp, Homo sapiens
agagagggtggtgacctctgc

SEQ ID NO: 2223920 - DNA, 19 bp, Homo sapiens
agagatgtgcccccacccc

SEQ ID NO: 2223921 - DNA, 19 bp, Homo sapiens
agagcaagacgctgtgctg

SEQ ID NO: 2223922 - DNA, 21 bp, Homo sapiens
agagcaccttagacagtccct

SEQ ID NO: 2223923 - DNA, 23 bp, Homo sapiens
agagcaccttagacagtccctgc

SEQ ID NO: 2223924 - DNA, 18 bp, Homo sapiens
agagcccacgcccccact

SEQ ID NO: 2223925 - DNA, 14 bp, Homo sapiens
agagcccaggcctc

SEQ ID NO: 2223926 - DNA, 15 bp, Homo sapiens
agagcccaggcctcc

SEQ ID NO: 2223927 - DNA, 21 bp, Homo sapiens
agagccttgcggaaggttcta

SEQ ID NO: 2223928 - DNA, 16 bp, Homo sapiens
agaggaaagcaaagga

SEQ ID NO: 2223929 - DNA, 18 bp, Homo sapiens
agaggaaagcaaaggaga

SEQ ID NO: 2223930 - DNA, 11 bp, Homo sapiens
agaggaaatca

SEQ ID NO: 2223931 - DNA, 14 bp, Homo sapiens
agaggacttttctt

SEQ ID NO: 2223932 - DNA, 22 bp, Homo sapiens
agaggacttttctttgtggctt

SEQ ID NO: 2223933 - DNA, 22 bp, Homo sapiens
agaggctgcctctcccatcact

SEQ ID NO: 2223934 - DNA, 19 bp, Homo sapiens
agagggggtggcctcccaa

SEQ ID NO: 2223935 - DNA, 20 bp, Homo sapiens
agagggtctgaggaatccag

SEQ ID NO: 2223936 - DNA, 19 bp, Homo sapiens
agccttgcggaaggttcta

SEQ ID NO: 2223937 - DNA, 17 bp, Homo sapiens
agcgaaccgtgaggagg

SEQ ID NO: 2223938 - DNA, 13 bp, Homo sapiens
agcgagccctggt

SEQ ID NO: 2223939 - DNA, 19 bp, Homo sapiens
agcgagccctggtggcagt

SEQ ID NO: 2223940 - DNA, 19 bp, Homo sapiens
agcgattcttctgcttcag

SEQ ID NO: 2223941 - DNA, 14 bp, Homo sapiens
agcgcccagttggg

SEQ ID NO: 2223942 - DNA, 16 bp, Homo sapiens
agcggagaaaggaagg

SEQ ID NO: 2223943 - DNA, 17 bp, Homo sapiens
agcggggacagctcctt

SEQ ID NO: 2223944 - DNA, 19 bp, Homo sapiens
agcggggacagctccttct

SEQ ID NO: 2223945 - DNA, 20 bp, Homo sapiens
agcggggacagctccttctg

SEQ ID NO: 2223946 - DNA, 13 bp, Homo sapiens
agcgtgagccact

SEQ ID NO: 2223947 - DNA, 15 bp, Homo sapiens
agcgtgcataagtta

SEQ ID NO: 2223948 - DNA, 19 bp, Homo sapiens
agctaacatggaagtacta

SEQ ID NO: 2223949 - DNA, 20 bp, Homo sapiens
agctaacatggaagtactat

SEQ ID NO: 2223950 - DNA, 14 bp, Homo sapiens
agctaatgggacac

SEQ ID NO: 2223951 - DNA, 15 bp, Homo sapiens
agctaatgggacact

SEQ ID NO: 2223952 - DNA, 12 bp, Homo sapiens
agctaggcctgg

SEQ ID NO: 2223953 - DNA, 19 bp, Homo sapiens
agctattcagtaataactc

SEQ ID NO: 2223954 - DNA, 19 bp, Homo sapiens
agctcaccagccccagtgc

SEQ ID NO: 2223955 - DNA, 12 bp, Homo sapiens
agctcagagagg

SEQ ID NO: 2223956 - DNA, 15 bp, Homo sapiens
agctcagggcctggc

SEQ ID NO: 2223957 - DNA, 19 bp, Homo sapiens
agctcagggcctggctcag

SEQ ID NO: 2223958 - DNA, 20 bp, Homo sapiens
agctcattctccttgtgtta

SEQ ID NO: 2223959 - DNA, 15 bp, Homo sapiens
agctccaagctccca

SEQ ID NO: 2223960 - DNA, 13 bp, Homo sapiens
agctccagctcac

SEQ ID NO: 2223961 - DNA, 18 bp, Homo sapiens
agctccagctcaccagcc

SEQ ID NO: 2223962 - DNA, 21 bp, Homo sapiens
agctccgctttctacccagcg

SEQ ID NO: 2223963 - DNA, 23 bp, Homo sapiens
agctccgctttctacccagcgag

SEQ ID NO: 2223964 - DNA, 22 bp, Homo sapiens
agctccttctgtcctactctgt

SEQ ID NO: 2223965 - DNA, 22 bp, Homo sapiens
agctctgctcctctccccagca

SEQ ID NO: 2223966 - DNA, 17 bp, Homo sapiens
agctctggtccatagag

SEQ ID NO: 2223967 - DNA, 15 bp, Homo sapiens
agctcttctccaggc

SEQ ID NO: 2223968 - DNA, 13 bp, Homo sapiens
agctgcaccctca

SEQ ID NO: 2223969 - DNA, 20 bp, Homo sapiens
agctgcaccctcaggcaggt

SEQ ID NO: 2223970 - DNA, 20 bp, Homo sapiens
agctgccagccgagatagcc

SEQ ID NO: 2223971 - DNA, 19 bp, Homo sapiens
agctgcctgggatccctca

SEQ ID NO: 2223972 - DNA, 16 bp, Homo sapiens
agctgcctgttcagct

SEQ ID NO: 2223973 - DNA, 21 bp, Homo sapiens
agctgcctgttcagctccagc

SEQ ID NO: 2223974 - DNA, 17 bp, Homo sapiens
agctgcggtccacccag

SEQ ID NO: 2223975 - DNA, 12 bp, Homo sapiens
agctgctgacag

SEQ ID NO: 2223976 - DNA, 14 bp, Homo sapiens
agctgctgacagtg

SEQ ID NO: 2223977 - DNA, 16 bp, Homo sapiens
agctgcttgggcttca

SEQ ID NO: 2223978 - DNA, 23 bp, Homo sapiens
agctgcttttgtctatgggactc

SEQ ID NO: 2223979 - DNA, 24 bp, Homo sapiens
agctgcttttgtctatgggactca

SEQ ID NO: 2223980 - DNA, 14 bp, Homo sapiens
agctgggcaggttg

SEQ ID NO: 2223981 - DNA, 23 bp, Homo sapiens
agctggggtggggacctcaggcc

SEQ ID NO: 2223982 - DNA, 17 bp, Homo sapiens
agctgtgctctggacag

SEQ ID NO: 2223983 - DNA, 12 bp, Homo sapiens
agcttatctcag

SEQ ID NO: 2223984 - DNA, 18 bp, Homo sapiens
agcttcatttcctgtgtc

SEQ ID NO: 2223985 - DNA, 19 bp, Homo sapiens
agcttgaccgtgaggccag

SEQ ID NO: 2223986 - DNA, 20 bp, Homo sapiens
agcttgaccgtgaggccaga

SEQ ID NO: 2223987 - DNA, 19 bp, Homo sapiens
agcttgtaaatagctcagg

SEQ ID NO: 2223988 - DNA, 18 bp, Homo sapiens
agctttgaaaattcagtg

SEQ ID NO: 2223989 - DNA, 16 bp, Homo sapiens
aggaaaagctgctgac

SEQ ID NO: 2223990 - DNA, 13 bp, Homo sapiens
aggaaaggctcca

SEQ ID NO: 2223991 - DNA, 16 bp, Homo sapiens
aggaaaggctccagga

SEQ ID NO: 2223992 - DNA, 20 bp, Homo sapiens
aggaaaggctccaggagcag

SEQ ID NO: 2223993 - DNA, 22 bp, Homo sapiens
aggaaaggctccaggagcagcc

SEQ ID NO: 2223994 - DNA, 15 bp, Homo sapiens
aggaaatcaccgaaa

SEQ ID NO: 2223995 - DNA, 12 bp, Homo sapiens
aggaacaaggca

SEQ ID NO: 2223996 - DNA, 16 bp, Homo sapiens
aggaacaaggcaaggc

SEQ ID NO: 2223997 - DNA, 17 bp, Homo sapiens
aggaacaaggcaaggct

SEQ ID NO: 2223998 - DNA, 20 bp, Homo sapiens
aggaacaaggcaaggctgtc

SEQ ID NO: 2223999 - DNA, 12 bp, Homo sapiens
aggaacactcct

SEQ ID NO: 2224000 - DNA, 15 bp, Homo sapiens
aggaacactccttca

SEQ ID NO: 2224001 - DNA, 17 bp, Homo sapiens
aggaagcacatgcctct

SEQ ID NO: 2224002 - DNA, 23 bp, Homo sapiens
aggaagcacatgcctctctcagg

SEQ ID NO: 2224003 - DNA, 14 bp, Homo sapiens
aggaagccagcagg

SEQ ID NO: 2224004 - DNA, 18 bp, Homo sapiens
aggaagccagcaggctct

SEQ ID NO: 2224005 - DNA, 22 bp, Homo sapiens
aggaagccagcaggctctcagg

SEQ ID NO: 2224006 - DNA, 18 bp, Homo sapiens
aggaagccgctggggcca

SEQ ID NO: 2224007 - DNA, 20 bp, Homo sapiens
aggaagccgctggggccagt

SEQ ID NO: 2224008 - DNA, 12 bp, Homo sapiens
aggaagctcagg

SEQ ID NO: 2224009 - DNA, 14 bp, Homo sapiens
aggaagctcagggc

SEQ ID NO: 2224010 - DNA, 15 bp, Homo sapiens
aggaagctcagggcc

SEQ ID NO: 2224011 - DNA, 18 bp, Homo sapiens
aggaagctcagggcctgg

SEQ ID NO: 2224012 - DNA, 20 bp, Homo sapiens
aggaaggaaacccagctctg

SEQ ID NO: 2224013 - DNA, 23 bp, Homo sapiens
aggaaggaaacccagctctggtc

SEQ ID NO: 2224014 - DNA, 11 bp, Homo sapiens
aggaagtactg

SEQ ID NO: 2224015 - DNA, 15 bp, Homo sapiens
aggaagtactggaga

SEQ ID NO: 2224016 - DNA, 18 bp, Homo sapiens
aggaatacctgtccccct

SEQ ID NO: 2224017 - DNA, 20 bp, Homo sapiens
aggaatccagacccggctgc

SEQ ID NO: 2224018 - DNA, 23 bp, Homo sapiens
aggacactaaccacgctggacct

SEQ ID NO: 2224019 - DNA, 15 bp, Homo sapiens
aggacattgcggaca

SEQ ID NO: 2224020 - DNA, 23 bp, Homo sapiens
aggacattgcggacagccacggc

SEQ ID NO: 2224021 - DNA, 14 bp, Homo sapiens
aggacctcaggtga

SEQ ID NO: 2224022 - DNA, 17 bp, Homo sapiens
aggacttttctttgtgg

SEQ ID NO: 2224023 - DNA, 19 bp, Homo sapiens
aggacttttctttgtggct

SEQ ID NO: 2224024 - DNA, 16 bp, Homo sapiens
aggagaggggcacagg

SEQ ID NO: 2224025 - DNA, 12 bp, Homo sapiens
aggagcagccac

SEQ ID NO: 2224026 - DNA, 14 bp, Homo sapiens
aggagcagccacat

SEQ ID NO: 2224027 - DNA, 12 bp, Homo sapiens
aggaggaacagg

SEQ ID NO: 2224028 - DNA, 17 bp, Homo sapiens
aggaggggatagagaga

SEQ ID NO: 2224029 - DNA, 13 bp, Homo sapiens
aggaggggtgtgg

SEQ ID NO: 2224030 - DNA, 15 bp, Homo sapiens
aggaggtctctaaga

SEQ ID NO: 2224031 - DNA, 15 bp, Homo sapiens
aggatcctgagccag

SEQ ID NO: 2224032 - DNA, 21 bp, Homo sapiens
aggatctcttgagcctgggag

SEQ ID NO: 2224033 - DNA, 17 bp, Homo sapiens
aggatgatctaggaaga

SEQ ID NO: 2224034 - DNA, 20 bp, Homo sapiens
aggatgatctaggaagactt

SEQ ID NO: 2224035 - DNA, 22 bp, Homo sapiens
aggatgcacagagttgttacat

SEQ ID NO: 2224036 - DNA, 16 bp, Homo sapiens
aggatgcttgtacata

SEQ ID NO: 2224037 - DNA, 16 bp, Homo sapiens
aggattcttcctccct

SEQ ID NO: 2224038 - DNA, 18 bp, Homo sapiens
aggcaagcacctcctgcc

SEQ ID NO: 2224039 - DNA, 19 bp, Homo sapiens
aggcaagcacctcctgcct

SEQ ID NO: 2224040 - DNA, 14 bp, Homo sapiens
aggcaatgctggct

SEQ ID NO: 2224041 - DNA, 16 bp, Homo sapiens
aggcaatgctggctgt

SEQ ID NO: 2224042 - DNA, 20 bp, Homo sapiens
aggcacccaccatcatgtct

SEQ ID NO: 2224043 - DNA, 14 bp, Homo sapiens
aggcagccaggcca

SEQ ID NO: 2224044 - DNA, 16 bp, Homo sapiens
aggcagccaggccaca

SEQ ID NO: 2224045 - DNA, 21 bp, Homo sapiens
aggcagccccattctgcctgc

SEQ ID NO: 2224046 - DNA, 22 bp, Homo sapiens
aggcagccccattctgcctgcc

SEQ ID NO: 2224047 - DNA, 17 bp, Homo sapiens
aggcaggtgggatggat

SEQ ID NO: 2224048 - DNA, 21 bp, Homo sapiens
aggcagtggggctggaagcag

SEQ ID NO: 2224049 - DNA, 22 bp, Homo sapiens
aggcataaagtcaggggttccc

SEQ ID NO: 2224050 - DNA, 21 bp, Homo sapiens
aggcatgtgatgagaggaaat

SEQ ID NO: 2224051 - DNA, 24 bp, Homo sapiens
aggcatgtgatgagaggaaatcac

SEQ ID NO: 2224052 - DNA, 19 bp, Homo sapiens
aggcatgttctctgaggac

SEQ ID NO: 2224053 - DNA, 17 bp, Homo sapiens
aggcattccccaggagg

SEQ ID NO: 2224054 - DNA, 20 bp, Homo sapiens
aggccaaactcacctgcccc

SEQ ID NO: 2224055 - DNA, 15 bp, Homo sapiens
aggccaaaggaagca

SEQ ID NO: 2224056 - DNA, 20 bp, Homo sapiens
aggccaaaggaagcacatgc

SEQ ID NO: 2224057 - DNA, 15 bp, Homo sapiens
aggccacaagaccct

SEQ ID NO: 2224058 - DNA, 16 bp, Homo sapiens
aggccacaagaccctt

SEQ ID NO: 2224059 - DNA, 18 bp, Homo sapiens
aggccacaagacccttgt

SEQ ID NO: 2224060 - DNA, 20 bp, Homo sapiens
aagcgtgagccactgcaccg

SEQ ID NO: 2224061 - DNA, 12 bp, Homo sapiens
aagcgtggtgga

SEQ ID NO: 2224062 - DNA, 22 bp, Homo sapiens
aagctagacgagcaggcttctt

SEQ ID NO: 2224063 - DNA, 16 bp, Homo sapiens
aagctaggcctggcca

SEQ ID NO: 2224064 - DNA, 16 bp, Homo sapiens
acagtttgttagtatg

SEQ ID NO: 2224065 - DNA, 20 bp, Homo sapiens
acagtttgttagtatgaggc

SEQ ID NO: 2224066 - DNA, 15 bp, Homo sapiens
acataagataaatgt

SEQ ID NO: 2224067 - DNA, 16 bp, Homo sapiens
acataagataaatgtg

SEQ ID NO: 2224068 - DNA, 16 bp, Homo sapiens
acatacaattccaaac

SEQ ID NO: 2224069 - DNA, 21 bp, Homo sapiens
acatactaaccagcagaaatg

SEQ ID NO: 2224070 - DNA, 22 bp, Homo sapiens
acatattgatttccgttaaaat

SEQ ID NO: 2224071 - DNA, 18 bp, Homo sapiens
acatcagcacgatttctg

SEQ ID NO: 2224072 - DNA, 19 bp, Homo sapiens
acatcttgctctgctgaca

SEQ ID NO: 2224073 - DNA, 18 bp, Homo sapiens
acatgaaaacacattttt

SEQ ID NO: 2224074 - DNA, 23 bp, Homo sapiens
acatgaaaacacatttttcttag

SEQ ID NO: 2224075 - DNA, 19 bp, Homo sapiens
acatgagcatcaggccagg

SEQ ID NO: 2224076 - DNA, 17 bp, Homo sapiens
acatgatcttctttata

SEQ ID NO: 2224077 - DNA, 18 bp, Homo sapiens
acatgcaaggtcattttt

SEQ ID NO: 2224078 - DNA, 23 bp, Homo sapiens
acatgcacagctaacatggaagt

SEQ ID NO: 2224079 - DNA, 13 bp, Homo sapiens
acatgcacgtgtg

SEQ ID NO: 2224080 - DNA, 20 bp, Homo sapiens
acatgcctctctcaggccaa

SEQ ID NO: 2224081 - DNA, 15 bp, Homo sapiens
acatggagtatatgt

SEQ ID NO: 2224082 - DNA, 19 bp, Homo sapiens
acatgtccaagaagcccag

SEQ ID NO: 2224083 - DNA, 23 bp, Homo sapiens
acatgtcttttcttgcatgaggc

SEQ ID NO: 2224084 - DNA, 14 bp, Homo sapiens
acattttattttat

SEQ ID NO: 2224085 - DNA, 18 bp, Homo sapiens
acattttattttattatg

SEQ ID NO: 2224086 - DNA, 20 bp, Homo sapiens
acattttattttattatgca

SEQ ID NO: 2224087 - DNA, 15 bp, Homo sapiens
acatttttaagtgct

SEQ ID NO: 2224088 - DNA, 18 bp, Homo sapiens
acatttttaagtgctgca

SEQ ID NO: 2224089 - DNA, 19 bp, Homo sapiens
acatttttaagtgctgcat

SEQ ID NO: 2224090 - DNA, 22 bp, Homo sapiens
accaacatactcccatctgtga

SEQ ID NO: 2224091 - DNA, 17 bp, Homo sapiens
accacacagaggctgcc

SEQ ID NO: 2224092 - DNA, 16 bp, Homo sapiens
accacacccagcccac

SEQ ID NO: 2224093 - DNA, 21 bp, Homo sapiens
accacacccagcccacttctg

SEQ ID NO: 2224094 - DNA, 14 bp, Homo sapiens
accacatcttgctc

SEQ ID NO: 2224095 - DNA, 21 bp, Homo sapiens
accacatcttgctctgctgac

SEQ ID NO: 2224096 - DNA, 15 bp, Homo sapiens
accaccacacccagc

SEQ ID NO: 2224097 - DNA, 20 bp, Homo sapiens
accaccacacccagcccact

SEQ ID NO: 2224098 - DNA, 18 bp, Homo sapiens
accacgctggaccttgaa

SEQ ID NO: 2224099 - DNA, 14 bp, Homo sapiens
accactacattctg

SEQ ID NO: 2224100 - DNA, 12 bp, Homo sapiens
accacttttgtt

SEQ ID NO: 2224101 - DNA, 16 bp, Homo sapiens
accacttttgttcttg

SEQ ID NO: 2224102 - DNA, 22 bp, Homo sapiens
accacttttgttcttggtttgt

SEQ ID NO: 2224103 - DNA, 11 bp, Homo sapiens
accagacaggt

SEQ ID NO: 2224104 - DNA, 19 bp, Homo sapiens
accagagcccaccttggct

SEQ ID NO: 2224105 - DNA, 14 bp, Homo sapiens
accagcagaaatgc

SEQ ID NO: 2224106 - DNA, 18 bp, Homo sapiens
accagccccagtgcccac

SEQ ID NO: 2224107 - DNA, 17 bp, Homo sapiens
accagtgttgtggattt

SEQ ID NO: 2224108 - DNA, 14 bp, Homo sapiens
accatcaagccacc

SEQ ID NO: 2224109 - DNA, 22 bp, Homo sapiens
accatccctgaaggccccgccc

SEQ ID NO: 2224110 - DNA, 22 bp, Homo sapiens
accatgattaaccacttcagct

SEQ ID NO: 2224111 - DNA, 22 bp, Homo sapiens
accattttggggtacccactgc

SEQ ID NO: 2224112 - DNA, 16 bp, Homo sapiens
acccaagggcctggcc

SEQ ID NO: 2224113 - DNA, 18 bp, Homo sapiens
acccaagggcctggcctg

SEQ ID NO: 2224114 - DNA, 15 bp, Homo sapiens
acccacccccaccca

SEQ ID NO: 2224115 - DNA, 16 bp, Homo sapiens
acccacctcagcctcc

SEQ ID NO: 2224116 - DNA, 10 bp, Homo sapiens
acccactgct

SEQ ID NO: 2224117 - DNA, 18 bp, Homo sapiens
acccagcccacttctgcc

SEQ ID NO: 2224118 - DNA, 17 bp, Homo sapiens
acccagcgagccctggt

SEQ ID NO: 2224119 - DNA, 23 bp, Homo sapiens
acccaggtgctaggaacactcct

SEQ ID NO: 2224120 - DNA, 13 bp, Homo sapiens
acccatgctgccc

SEQ ID NO: 2224121 - DNA, 15 bp, Homo sapiens
acccatgctgccctg

SEQ ID NO: 2224122 - DNA, 17 bp, Homo sapiens
accccacacacgccaga

SEQ ID NO: 2224123 - DNA, 22 bp, Homo sapiens
accccagccccaaaactctcct

SEQ ID NO: 2224124 - DNA, 15 bp, Homo sapiens
accccaggctgggct

SEQ ID NO: 2224125 - DNA, 14 bp, Homo sapiens
acccccagcctgct

SEQ ID NO: 2224126 - DNA, 12 bp, Homo sapiens
accccctccccg

SEQ ID NO: 2224127 - DNA, 17 bp, Homo sapiens
acccccttgcccaggcc

SEQ ID NO: 2224128 - DNA, 18 bp, Homo sapiens
acccccttgcccaggcct

SEQ ID NO: 2224129 - DNA, 12 bp, Homo sapiens
acccgggaaggg

SEQ ID NO: 2224130 - DNA, 13 bp, Homo sapiens
accctattgctgc

SEQ ID NO: 2224131 - DNA, 14 bp, Homo sapiens
accctattgctgct

SEQ ID NO: 2224132 - DNA, 14 bp, Homo sapiens
accctcgaccaccc

SEQ ID NO: 2224133 - DNA, 12 bp, Homo sapiens
accctgccctgt

SEQ ID NO: 2224134 - DNA, 20 bp, Homo sapiens
accctgtgatggggccctgc

SEQ ID NO: 2224135 - DNA, 20 bp, Homo sapiens
acccttgccgtctacctgag

SEQ ID NO: 2224136 - DNA, 17 bp, Homo sapiens
acccttgtggtcccacc

SEQ ID NO: 2224137 - DNA, 15 bp, Homo sapiens
accgaaaacgtggct

SEQ ID NO: 2224138 - DNA, 17 bp, Homo sapiens
accgaaaacgtggctgc

SEQ ID NO: 2224139 - DNA, 17 bp, Homo sapiens
accgccaaggctggggg

SEQ ID NO: 2224140 - DNA, 20 bp, Homo sapiens
accgggcactcagaagacac

SEQ ID NO: 2224141 - DNA, 16 bp, Homo sapiens
accgtgaggccagaga

SEQ ID NO: 2224142 - DNA, 17 bp, Homo sapiens
accgtgaggccagagac

SEQ ID NO: 2224143 - DNA, 18 bp, Homo sapiens
accgtgaggccagagaca

SEQ ID NO: 2224144 - DNA, 13 bp, Homo sapiens
acctagccttaga

SEQ ID NO: 2224145 - DNA, 20 bp, Homo sapiens
acctaggtggggcctggggt

SEQ ID NO: 2224146 - DNA, 11 bp, Homo sapiens
acctcaggcct

SEQ ID NO: 2224147 - DNA, 20 bp, Homo sapiens
acctccgcctcttgggttca

SEQ ID NO: 2224148 - DNA, 23 bp, Homo sapiens
acctcctgcctcgaactggctgc

SEQ ID NO: 2224149 - DNA, 17 bp, Homo sapiens
acctcggtgccttcctc

SEQ ID NO: 2224150 - DNA, 20 bp, Homo sapiens
acctctgcctgaagtcacac

SEQ ID NO: 2224151 - DNA, 23 bp, Homo sapiens
acctctgcctgaagtcacacagt

SEQ ID NO: 2224152 - DNA, 17 bp, Homo sapiens
acctcttgagccttgaa

SEQ ID NO: 2224153 - DNA, 21 bp, Homo sapiens
acctcttgagccttgaacttt

SEQ ID NO: 2224154 - DNA, 15 bp, Homo sapiens
acctgaagtctttgt

SEQ ID NO: 2224155 - DNA, 21 bp, Homo sapiens
acctgaggcccttctctccag

SEQ ID NO: 2224156 - DNA, 14 bp, Homo sapiens
acctgaggggcctc

SEQ ID NO: 2224157 - DNA, 16 bp, Homo sapiens
acctgaggggcctctt

SEQ ID NO: 2224158 - DNA, 15 bp, Homo sapiens
acctgccaggaagcc

SEQ ID NO: 2224159 - DNA, 11 bp, Homo sapiens
acctgccaggg

SEQ ID NO: 2224160 - DNA, 15 bp, Homo sapiens
acctgcccctcaact

SEQ ID NO: 2224161 - DNA, 16 bp, Homo sapiens
acctgcggtgctatct

SEQ ID NO: 2224162 - DNA, 18 bp, Homo sapiens
acctgcggtgctatctcc

SEQ ID NO: 2224163 - DNA, 22 bp, Homo sapiens
acctgcggtgctatctccccca

SEQ ID NO: 2224164 - DNA, 23 bp, Homo sapiens
acctgcggtgctatctcccccag

SEQ ID NO: 2224165 - DNA, 17 bp, Homo sapiens
acctggaatatataacc

SEQ ID NO: 2224166 - DNA, 20 bp, Homo sapiens
acctggcctctgcactcccc

SEQ ID NO: 2224167 - DNA, 19 bp, Homo sapiens
accttagacagtccctgcc

SEQ ID NO: 2224168 - DNA, 15 bp, Homo sapiens
cttgaacttgaaaaa

SEQ ID NO: 2224169 - DNA, 17 bp, Homo sapiens
cttgaactttgacctct

SEQ ID NO: 2224170 - DNA, 20 bp, Homo sapiens
cttgaatgatgccatgagga

SEQ ID NO: 2224171 - DNA, 23 bp, Homo sapiens
cttgaatgatgccatgaggaaca

SEQ ID NO: 2224172 - DNA, 18 bp, Homo sapiens
cttgaattgtaaggaatg

SEQ ID NO: 2224173 - DNA, 13 bp, Homo sapiens
cttgacagggcac

SEQ ID NO: 2224174 - DNA, 17 bp, Homo sapiens
cttgaccattctccacc

SEQ ID NO: 2224175 - DNA, 22 bp, Homo sapiens
cttgaccattctccacctgcca

SEQ ID NO: 2224176 - DNA, 21 bp, Homo sapiens
cttgaccgtgaggccagagac

SEQ ID NO: 2224177 - DNA, 15 bp, Homo sapiens
cttgagcctgggagg

SEQ ID NO: 2224178 - DNA, 18 bp, Homo sapiens
cttgagccttgaactttg

SEQ ID NO: 2224179 - DNA, 20 bp, Homo sapiens
cttgagccttgaactttgac

SEQ ID NO: 2224180 - DNA, 22 bp, Homo sapiens
cttgagccttgaactttgacct

SEQ ID NO: 2224181 - DNA, 13 bp, Homo sapiens
cttgagctcagga

SEQ ID NO: 2224182 - DNA, 17 bp, Homo sapiens
cttgagggttgggctgg

SEQ ID NO: 2224183 - DNA, 21 bp, Homo sapiens
cttgagggttgggctggtgtc

SEQ ID NO: 2224184 - DNA, 15 bp, Homo sapiens
cttgatgtgttatct

SEQ ID NO: 2224185 - DNA, 18 bp, Homo sapiens
cttgatgtgttatctctt

SEQ ID NO: 2224186 - DNA, 22 bp, Homo sapiens
cttgcaaagtatccctactgta

SEQ ID NO: 2224187 - DNA, 15 bp, Homo sapiens
cttgcaatggcagcc

SEQ ID NO: 2224188 - DNA, 16 bp, Homo sapiens
cttgcaatggcagcct

SEQ ID NO: 2224189 - DNA, 18 bp, Homo sapiens
cttgcaatggcagccttg

SEQ ID NO: 2224190 - DNA, 21 bp, Homo sapiens
cttgcagactctacagaggcc

SEQ ID NO: 2224191 - DNA, 18 bp, Homo sapiens
cttgccgtctacctgagg

SEQ ID NO: 2224192 - DNA, 12 bp, Homo sapiens
cttgctctgctg

SEQ ID NO: 2224193 - DNA, 14 bp, Homo sapiens
cttgctctgctgac

SEQ ID NO: 2224194 - DNA, 17 bp, Homo sapiens
cttgctctgctgacaga

SEQ ID NO: 2224195 - DNA, 20 bp, Homo sapiens
cttgcttcaaccccatgaga

SEQ ID NO: 2224196 - DNA, 20 bp, Homo sapiens
cttggaagctccgctttcta

SEQ ID NO: 2224197 - DNA, 20 bp, Homo sapiens
gaaggggcccaagagagaca

SEQ ID NO: 2224198 - DNA, 19 bp, Homo sapiens
gaagtaatatgcacacatt

SEQ ID NO: 2224199 - DNA, 21 bp, Homo sapiens
gaagtaatatgcacacatttt

SEQ ID NO: 2224200 - DNA, 16 bp, Homo sapiens
gaagtctttgtacaga

SEQ ID NO: 2224201 - DNA, 18 bp, Homo sapiens
gaagtctttgtacagaca

SEQ ID NO: 2224202 - DNA, 20 bp, Homo sapiens
gaagtttctgccgcagccct

SEQ ID NO: 2224203 - DNA, 17 bp, Homo sapiens
gaataatacagtatctc

SEQ ID NO: 2224204 - DNA, 22 bp, Homo sapiens
gaatagctgggactacaggtgt

SEQ ID NO: 2224205 - DNA, 15 bp, Homo sapiens
gaatatataaccagt

SEQ ID NO: 2224206 - DNA, 14 bp, Homo sapiens
gaatgaatgtcagt

SEQ ID NO: 2224207 - DNA, 14 bp, Homo sapiens
gaatgatgccatga

SEQ ID NO: 2224208 - DNA, 20 bp, Homo sapiens
gaatgcacaaacagaggccg

SEQ ID NO: 2224209 - DNA, 21 bp, Homo sapiens
gaatgcacaaacagaggccgc

SEQ ID NO: 2224210 - DNA, 17 bp, Homo sapiens
gaatgcgggggagcagg

SEQ ID NO: 2224211 - DNA, 20 bp, Homo sapiens
gaatgtcagtgtgactgatc

SEQ ID NO: 2224212 - DNA, 16 bp, Homo sapiens
gaatgtttgcctctgc

SEQ ID NO: 2224213 - DNA, 17 bp, Homo sapiens
gaatgtttgcctctgcc

SEQ ID NO: 2224214 - DNA, 19 bp, Homo sapiens
gaattttggctgtgtctcc

SEQ ID NO: 2224215 - DNA, 17 bp, Homo sapiens
gaatttttactggggat

SEQ ID NO: 2224216 - DNA, 21 bp, Homo sapiens
gaatttttactggggattctt

SEQ ID NO: 2224217 - DNA, 22 bp, Homo sapiens
gacaacactcattgacctgagg

SEQ ID NO: 2224218 - DNA, 19 bp, Homo sapiens
gacaaggattgctactgtc

SEQ ID NO: 2224219 - DNA, 21 bp, Homo sapiens
gacaaggattgctactgtcct

SEQ ID NO: 2224220 - DNA, 22 bp, Homo sapiens
gacaaggattgctactgtccta

SEQ ID NO: 2224221 - DNA, 16 bp, Homo sapiens
gacaatgacccagtgg

SEQ ID NO: 2224222 - DNA, 17 bp, Homo sapiens
gacaatgacttactgta

SEQ ID NO: 2224223 - DNA, 12 bp, Homo sapiens
gacaatgcaaac

SEQ ID NO: 2224224 - DNA, 18 bp, Homo sapiens
gacaatgtgaaaagaaaa

SEQ ID NO: 2224225 - DNA, 20 bp, Homo sapiens
gacaatgtgaaaagaaaaat

SEQ ID NO: 2224226 - DNA, 16 bp, Homo sapiens
gacacaagccttcggc

SEQ ID NO: 2224227 - DNA, 14 bp, Homo sapiens
gacacacagctctg

SEQ ID NO: 2224228 - DNA, 17 bp, Homo sapiens
gacacacagctctgtcc

SEQ ID NO: 2224229 - DNA, 18 bp, Homo sapiens
gacacacagctctgtcct

SEQ ID NO: 2224230 - DNA, 19 bp, Homo sapiens
gacacacagctctgtcctg

SEQ ID NO: 2224231 - DNA, 12 bp, Homo sapiens
gacacagctctt

SEQ ID NO: 2224232 - DNA, 14 bp, Homo sapiens
gacacagctcttct

SEQ ID NO: 2224233 - DNA, 19 bp, Homo sapiens
gacacagctcttctccagg

SEQ ID NO: 2224234 - DNA, 20 bp, Homo sapiens
gacacagctcttctccaggc

SEQ ID NO: 2224235 - DNA, 17 bp, Homo sapiens
gacactaaccacgctgg

SEQ ID NO: 2224236 - DNA, 21 bp, Homo sapiens
gacactaaccacgctggacct

SEQ ID NO: 2224237 - DNA, 16 bp, Homo sapiens
gacactagaagatttt

SEQ ID NO: 2224238 - DNA, 15 bp, Homo sapiens
gacagacacaggccc

SEQ ID NO: 2224239 - DNA, 20 bp, Homo sapiens
gacagagctacacaggggaa

SEQ ID NO: 2224240 - DNA, 12 bp, Homo sapiens
gacagaggcagc

SEQ ID NO: 2224241 - DNA, 14 bp, Homo sapiens
gacagaggcagccc

SEQ ID NO: 2224242 - DNA, 21 bp, Homo sapiens
gacagagtctcactgttgccc

SEQ ID NO: 2224243 - DNA, 14 bp, Homo sapiens
gacagcccgggctc

SEQ ID NO: 2224244 - DNA, 20 bp, Homo sapiens
gacagcccgggctctgcctc

SEQ ID NO: 2224245 - DNA, 11 bp, Homo sapiens
gacagctcctt

SEQ ID NO: 2224246 - DNA, 19 bp, Homo sapiens
gacagctccttctgtccta

SEQ ID NO: 2224247 - DNA, 14 bp, Homo sapiens
gacagctgcctggg

SEQ ID NO: 2224248 - DNA, 16 bp, Homo sapiens
gacagctgcctgggat

SEQ ID NO: 2224249 - DNA, 17 bp, Homo sapiens
gacagctgcctgggatc

SEQ ID NO: 2224250 - DNA, 18 bp, Homo sapiens
gacagctgcctgggatcc

SEQ ID NO: 2224251 - DNA, 21 bp, Homo sapiens
gacaggcatgttctctgagga

SEQ ID NO: 2224252 - DNA, 16 bp, Homo sapiens
gacagggaggtgaccc

SEQ ID NO: 2224253 - DNA, 14 bp, Homo sapiens
gacagtccctgcca

SEQ ID NO: 2224254 - DNA, 16 bp, Homo sapiens
gacagtccctgccaat

SEQ ID NO: 2224255 - DNA, 23 bp, Homo sapiens
gacatactaaccagcagaaatgc

SEQ ID NO: 2224256 - DNA, 17 bp, Homo sapiens
gacatgtcttttcttgc

SEQ ID NO: 2224257 - DNA, 23 bp, Homo sapiens
gacattgcggacagccacggcca

SEQ ID NO: 2224258 - DNA, 19 bp, Homo sapiens
gacattgttggccaaagcc

SEQ ID NO: 2224259 - DNA, 18 bp, Homo sapiens
gaccacaaaacttttcta

SEQ ID NO: 2224260 - DNA, 10 bp, Homo sapiens
gaccaccccc

SEQ ID NO: 2224261 - DNA, 24 bp, Homo sapiens
gaccagacaccttgacagggcaca

SEQ ID NO: 2224262 - DNA, 16 bp, Homo sapiens
gaccatccctgaaggc

SEQ ID NO: 2224263 - DNA, 18 bp, Homo sapiens
gaccatccctgaaggccc

SEQ ID NO: 2224264 - DNA, 19 bp, Homo sapiens
gaccatccctgaaggcccc

SEQ ID NO: 2224265 - DNA, 16 bp, Homo sapiens
gaccattctccacctg

SEQ ID NO: 2224266 - DNA, 11 bp, Homo sapiens
gacccactgct

SEQ ID NO: 2224267 - DNA, 13 bp, Homo sapiens
gacccatgctgcc

SEQ ID NO: 2224268 - DNA, 14 bp, Homo sapiens
gacccatgctgccc

SEQ ID NO: 2224269 - DNA, 18 bp, Homo sapiens
gacccccttgcccaggcc

SEQ ID NO: 2224270 - DNA, 19 bp, Homo sapiens
gacccccttgcccaggcct

SEQ ID NO: 2224271 - DNA, 21 bp, Homo sapiens
gacccccttgcccaggcctcc

SEQ ID NO: 2224272 - DNA, 20 bp, Homo sapiens
gaccctgaggcccagagggc

SEQ ID NO: 2224273 - DNA, 21 bp, Homo sapiens
gaccctgaggcccagagggcc

SEQ ID NO: 2224274 - DNA, 22 bp, Homo sapiens
gaccctgaggcccagagggcct

SEQ ID NO: 2224275 - DNA, 23 bp, Homo sapiens
gaccctgaggcccagagggcctg

SEQ ID NO: 2224276 - DNA, 15 bp, Homo sapiens
gaccctgccctgtgg

SEQ ID NO: 2224277 - DNA, 16 bp, Homo sapiens
gaccctgccctgtggg

SEQ ID NO: 2224278 - DNA, 17 bp, Homo sapiens
gaccctgccctgtgggc

SEQ ID NO: 2224279 - DNA, 15 bp, Homo sapiens
gaccgtgaggccaga

SEQ ID NO: 2224280 - DNA, 13 bp, Homo sapiens
gacctcaggcctg

SEQ ID NO: 2224281 - DNA, 14 bp, Homo sapiens
gacctcaggcctgg

SEQ ID NO: 2224282 - DNA, 19 bp, Homo sapiens
gacctcaggtgagaagcag

SEQ ID NO: 2224283 - DNA, 20 bp, Homo sapiens
gacctcaggtgatccaccca

SEQ ID NO: 2224284 - DNA, 15 bp, Homo sapiens
gaccttctccttcac

SEQ ID NO: 2224285 - DNA, 23 bp, Homo sapiens
gaccttgaactgggtacttgtgg

SEQ ID NO: 2224286 - DNA, 16 bp, Homo sapiens
gacgctacccgggaag

SEQ ID NO: 2224287 - DNA, 19 bp, Homo sapiens
gacgctacccgggaagggg

SEQ ID NO: 2224288 - DNA, 23 bp, Homo sapiens
gacgctacccgggaagggggctg

SEQ ID NO: 2224289 - DNA, 16 bp, Homo sapiens
gacgctgtgctgccct

SEQ ID NO: 2224290 - DNA, 17 bp, Homo sapiens
gacgctgtgctgccctg

SEQ ID NO: 2224291 - DNA, 13 bp, Homo sapiens
gacggagtcccac

SEQ ID NO: 2224292 - DNA, 14 bp, Homo sapiens
gacggagtcccacc

SEQ ID NO: 2224293 - DNA, 21 bp, Homo sapiens
gacggagtcccaccttggctg

SEQ ID NO: 2224294 - DNA, 12 bp, Homo sapiens
gactacaggcac

SEQ ID NO: 2224295 - DNA, 13 bp, Homo sapiens
gactcctgcaggc

SEQ ID NO: 2224296 - DNA, 15 bp, Homo sapiens
gactcctgcaggcag

SEQ ID NO: 2224297 - DNA, 20 bp, Homo sapiens
gactcctgcaggcagccagg

SEQ ID NO: 2224298 - DNA, 16 bp, Homo sapiens
acgctgtgctgccctg

SEQ ID NO: 2224299 - DNA, 17 bp, Homo sapiens
acgctgtgctgccctgc

SEQ ID NO: 2224300 - DNA, 19 bp, Homo sapiens
acgctgtgctgccctgccc

SEQ ID NO: 2224301 - DNA, 15 bp, Homo sapiens
acggaatagttggct

SEQ ID NO: 2224302 - DNA, 19 bp, Homo sapiens
acggaatagttggctagga

SEQ ID NO: 2224303 - DNA, 19 bp, Homo sapiens
acggagtcccaccttggct

SEQ ID NO: 2224304 - DNA, 17 bp, Homo sapiens
acggctcactgcagcct

SEQ ID NO: 2224305 - DNA, 17 bp, Homo sapiens
acgtggctgcttcaagg

SEQ ID NO: 2224306 - DNA, 14 bp, Homo sapiens
acgttgtgcatttg

SEQ ID NO: 2224307 - DNA, 14 bp, Homo sapiens
acgtttctaaaggc

SEQ ID NO: 2224308 - DNA, 16 bp, Homo sapiens
acgtttctaaaggcta

SEQ ID NO: 2224309 - DNA, 11 bp, Homo sapiens
actacaggcac

SEQ ID NO: 2224310 - DNA, 14 bp, Homo sapiens
actacagtttgtta

SEQ ID NO: 2224311 - DNA, 11 bp, Homo sapiens
actacattctg

SEQ ID NO: 2224312 - DNA, 18 bp, Homo sapiens
actacggaatagttggct

SEQ ID NO: 2224313 - DNA, 17 bp, Homo sapiens
actactcccccaggtgg

SEQ ID NO: 2224314 - DNA, 15 bp, Homo sapiens
actatgttgcccagg

SEQ ID NO: 2224315 - DNA, 17 bp, Homo sapiens
actatgttgcccaggca

SEQ ID NO: 2224316 - DNA, 21 bp, Homo sapiens
actcacatttattctgctcac

SEQ ID NO: 2224317 - DNA, 12 bp, Homo sapiens
actcaccccagc

SEQ ID NO: 2224318 - DNA, 13 bp, Homo sapiens
actcaccccagcc

SEQ ID NO: 2224319 - DNA, 14 bp, Homo sapiens
actcaccccagccc

SEQ ID NO: 2224320 - DNA, 15 bp, Homo sapiens
actcagaagacactg

SEQ ID NO: 2224321 - DNA, 21 bp, Homo sapiens
actcagaattctctagtttga

SEQ ID NO: 2224322 - DNA, 22 bp, Homo sapiens
actcagaattctctagtttgat

SEQ ID NO: 2224323 - DNA, 19 bp, Homo sapiens
actcagtccatagcagaga

SEQ ID NO: 2224324 - DNA, 15 bp, Homo sapiens
actcattgacctgag

SEQ ID NO: 2224325 - DNA, 18 bp, Homo sapiens
actcattgacctgaggcc

SEQ ID NO: 2224326 - DNA, 22 bp, Homo sapiens
actcattgacctgaggcccttc

SEQ ID NO: 2224327 - DNA, 15 bp, Homo sapiens
actccagaatttccc

SEQ ID NO: 2224328 - DNA, 12 bp, Homo sapiens
actccagcctgg

SEQ ID NO: 2224329 - DNA, 22 bp, Homo sapiens
actcccatctgtgaaaggaaag

SEQ ID NO: 2224330 - DNA, 15 bp, Homo sapiens
actcctgcaggcagc

SEQ ID NO: 2224331 - DNA, 16 bp, Homo sapiens
actcctgcaggcagcc

SEQ ID NO: 2224332 - DNA, 14 bp, Homo sapiens
actcctggcctcaa

SEQ ID NO: 2224333 - DNA, 15 bp, Homo sapiens
actcgcgacaatgca

SEQ ID NO: 2224334 - DNA, 16 bp, Homo sapiens
actcgcgacaatgcaa

SEQ ID NO: 2224335 - DNA, 18 bp, Homo sapiens
actcgcgacaatgcaaac

SEQ ID NO: 2224336 - DNA, 20 bp, Homo sapiens
actcgcgacaatgcaaacca

SEQ ID NO: 2224337 - DNA, 13 bp, Homo sapiens
actctaccctctt

SEQ ID NO: 2224338 - DNA, 18 bp, Homo sapiens
actctaccctcttagaaa

SEQ ID NO: 2224339 - DNA, 21 bp, Homo sapiens
actctatcaagtattatacct

SEQ ID NO: 2224340 - DNA, 21 bp, Homo sapiens
actctatttttgtaaaaaggg

SEQ ID NO: 2224341 - DNA, 16 bp, Homo sapiens
actctcctctgctgct

SEQ ID NO: 2224342 - DNA, 19 bp, Homo sapiens
actctcctctgctgctggc

SEQ ID NO: 2224343 - DNA, 11 bp, Homo sapiens
actctgagact

SEQ ID NO: 2224344 - DNA, 22 bp, Homo sapiens
actctgagactcgcgacaatgc

SEQ ID NO: 2224345 - DNA, 16 bp, Homo sapiens
actctggcagctcaga

SEQ ID NO: 2224346 - DNA, 19 bp, Homo sapiens
actctgtcgcccagtctgg

SEQ ID NO: 2224347 - DNA, 19 bp, Homo sapiens
actctgtgtcaggtggggc

SEQ ID NO: 2224348 - DNA, 11 bp, Homo sapiens
actcttaaaac

SEQ ID NO: 2224349 - DNA, 14 bp, Homo sapiens
actcttgacctcag

SEQ ID NO: 2224350 - DNA, 16 bp, Homo sapiens
actcttgacctcaggt

SEQ ID NO: 2224351 - DNA, 12 bp, Homo sapiens
actgaatttctt

SEQ ID NO: 2224352 - DNA, 15 bp, Homo sapiens
actgagacagcccgg

SEQ ID NO: 2224353 - DNA, 22 bp, Homo sapiens
actgagacagcccgggctctgc

SEQ ID NO: 2224354 - DNA, 22 bp, Homo sapiens
actgagtacgttgtgcatttgg

SEQ ID NO: 2224355 - DNA, 21 bp, Homo sapiens
actgataaagatgagtgagca

SEQ ID NO: 2224356 - DNA, 22 bp, Homo sapiens
actgatggctaatgtactgcat

SEQ ID NO: 2224357 - DNA, 21 bp, Homo sapiens
actgatttttttttccttcag

SEQ ID NO: 2224358 - DNA, 22 bp, Homo sapiens
actgcaacctccgcctcttggg

SEQ ID NO: 2224359 - DNA, 14 bp, Homo sapiens
actgcactccagcc

SEQ ID NO: 2224360 - DNA, 13 bp, Homo sapiens
actgcactgtttt

SEQ ID NO: 2224361 - DNA, 19 bp, Homo sapiens
actgcagcctcaacctcct

SEQ ID NO: 2224362 - DNA, 21 bp, Homo sapiens
actgcagcctcaacctcctgg

SEQ ID NO: 2224363 - DNA, 22 bp, Homo sapiens
actgcatcaagatgtgacatgt

SEQ ID NO: 2224364 - DNA, 15 bp, Homo sapiens
actgcatgtttgtga

SEQ ID NO: 2224365 - DNA, 18 bp, Homo sapiens
actgcttaacttcacata

SEQ ID NO: 2224366 - DNA, 22 bp, Homo sapiens
actgcttccagtgaggctctgc

SEQ ID NO: 2224367 - DNA, 20 bp, Homo sapiens
actgcttttggtctgtgtga

SEQ ID NO: 2224368 - DNA, 16 bp, Homo sapiens
actggaagcacagctt

SEQ ID NO: 2224369 - DNA, 17 bp, Homo sapiens
actggaagcacagcttc

SEQ ID NO: 2224370 - DNA, 17 bp, Homo sapiens
actgggtacttgtggac

SEQ ID NO: 2224371 - DNA, 19 bp, Homo sapiens
actgggtacttgtggacac

SEQ ID NO: 2224372 - DNA, 23 bp, Homo sapiens
actgggtacttgtggacacagct

SEQ ID NO: 2224373 - DNA, 16 bp, Homo sapiens
actgtacaaagtagaa

SEQ ID NO: 2224374 - DNA, 14 bp, Homo sapiens
actgtacatgaaaa

SEQ ID NO: 2224375 - DNA, 16 bp, Homo sapiens
actgtacatgaaaaca

SEQ ID NO: 2224376 - DNA, 12 bp, Homo sapiens
actgtcttcagt

SEQ ID NO: 2224377 - DNA, 22 bp, Homo sapiens
actgtgctgagtctgaaggctg

SEQ ID NO: 2224378 - DNA, 14 bp, Homo sapiens
actgttctctgccc

SEQ ID NO: 2224379 - DNA, 15 bp, Homo sapiens
actgttctctgccct

SEQ ID NO: 2224380 - DNA, 19 bp, Homo sapiens
actgttctctgccctccaa

SEQ ID NO: 2224381 - DNA, 20 bp, Homo sapiens
actgttctctgccctccaag

SEQ ID NO: 2224382 - DNA, 12 bp, Homo sapiens
actgttgcccag

SEQ ID NO: 2224383 - DNA, 14 bp, Homo sapiens
actgttgcccaggc

SEQ ID NO: 2224384 - DNA, 19 bp, Homo sapiens
actgtttcaaactttacta

SEQ ID NO: 2224385 - DNA, 18 bp, Homo sapiens
acttaaataatgtgaaac

SEQ ID NO: 2224386 - DNA, 15 bp, Homo sapiens
acttaatctaaatgg

SEQ ID NO: 2224387 - DNA, 17 bp, Homo sapiens
acttaatctaaatggaa

SEQ ID NO: 2224388 - DNA, 15 bp, Homo sapiens
acttactgtacatga

SEQ ID NO: 2224389 - DNA, 21 bp, Homo sapiens
acttactgtacatgaaaacac

SEQ ID NO: 2224390 - DNA, 15 bp, Homo sapiens
acttaggtgtggggg

SEQ ID NO: 2224391 - DNA, 23 bp, Homo sapiens
acttcacatattgatttccgtta

SEQ ID NO: 2224392 - DNA, 15 bp, Homo sapiens
acttctccaccctgc

SEQ ID NO: 2224393 - DNA, 16 bp, Homo sapiens
acttctccaccctgct

SEQ ID NO: 2224394 - DNA, 19 bp, Homo sapiens
acttgagaattaccctttt

SEQ ID NO: 2224395 - DNA, 19 bp, Homo sapiens
acttgcagactctacagag

SEQ ID NO: 2224396 - DNA, 15 bp, Homo sapiens
ctgcaggcagccagg

SEQ ID NO: 2224397 - DNA, 22 bp, Homo sapiens
ctgcagttgccagtcaccccgg

SEQ ID NO: 2224398 - DNA, 20 bp, Homo sapiens
ctgcatcaagatgtgacatg

SEQ ID NO: 2224399 - DNA, 18 bp, Homo sapiens
ctgcatgcgggcttcctc

SEQ ID NO: 2224400 - DNA, 22 bp, Homo sapiens
ctgcatgcgggcttcctcctgg

SEQ ID NO: 2224401 - DNA, 13 bp, Homo sapiens
ctgcatgttacat

SEQ ID NO: 2224402 - DNA, 17 bp, Homo sapiens
ctgcatttaaaagatac

SEQ ID NO: 2224403 - DNA, 20 bp, Homo sapiens
ctgcatttaaaagatacagt

SEQ ID NO: 2224404 - DNA, 17 bp, Homo sapiens
ctgccaatgggagctca

SEQ ID NO: 2224405 - DNA, 12 bp, Homo sapiens
ctgccaccctgg

SEQ ID NO: 2224406 - DNA, 19 bp, Homo sapiens
ctgccagccgagatagcca

SEQ ID NO: 2224407 - DNA, 16 bp, Homo sapiens
ctgccaggaagccagc

SEQ ID NO: 2224408 - DNA, 18 bp, Homo sapiens
ctgccaggaagccagcag

SEQ ID NO: 2224409 - DNA, 21 bp, Homo sapiens
ctgccaggaagccagcaggct

SEQ ID NO: 2224410 - DNA, 19 bp, Homo sapiens
ctgccatccaggttcagct

SEQ ID NO: 2224411 - DNA, 15 bp, Homo sapiens
ctgccatgccagctt

SEQ ID NO: 2224412 - DNA, 13 bp, Homo sapiens
ctgcccacctggc

SEQ ID NO: 2224413 - DNA, 14 bp, Homo sapiens
ctgcccacctggcc

SEQ ID NO: 2224414 - DNA, 17 bp, Homo sapiens
ctgcccacctggcctct

SEQ ID NO: 2224415 - DNA, 19 bp, Homo sapiens
ctgcccacctggcctctgc

SEQ ID NO: 2224416 - DNA, 16 bp, Homo sapiens
ctgcccactccctgca

SEQ ID NO: 2224417 - DNA, 19 bp, Homo sapiens
ctgcccaggcccctgccac

SEQ ID NO: 2224418 - DNA, 13 bp, Homo sapiens
ctgcccccacccc

SEQ ID NO: 2224419 - DNA, 15 bp, Homo sapiens
ctgcccccaccccag

SEQ ID NO: 2224420 - DNA, 17 bp, Homo sapiens
ctgcccccaccccaggc

SEQ ID NO: 2224421 - DNA, 14 bp, Homo sapiens
ctgcccctggcagc

SEQ ID NO: 2224422 - DNA, 15 bp, Homo sapiens
ctgcccctggcagcc

SEQ ID NO: 2224423 - DNA, 15 bp, Homo sapiens
ctgcccggctgcgga

SEQ ID NO: 2224424 - DNA, 13 bp, Homo sapiens
ctgccctgcccac

SEQ ID NO: 2224425 - DNA, 24 bp, Homo sapiens
ctgccctgtgagtactacagtcct

SEQ ID NO: 2224426 - DNA, 14 bp, Homo sapiens
ctgccctgtgggcc

SEQ ID NO: 2224427 - DNA, 15 bp, Homo sapiens
ctgccctgtgggccc

SEQ ID NO: 2224428 - DNA, 18 bp, Homo sapiens
ctgccctgtgggccccca

SEQ ID NO: 2224429 - DNA, 12 bp, Homo sapiens
ctgccgcagccc

SEQ ID NO: 2224430 - DNA, 20 bp, Homo sapiens
ctgccgcagccctgcagagg

SEQ ID NO: 2224431 - DNA, 14 bp, Homo sapiens
ctgcctcagcctcc

SEQ ID NO: 2224432 - DNA, 11 bp, Homo sapiens
ctgcctcccat

SEQ ID NO: 2224433 - DNA, 19 bp, Homo sapiens
ctgcctcccatcacccgct

SEQ ID NO: 2224434 - DNA, 17 bp, Homo sapiens
ctgcctcgaactggctg

SEQ ID NO: 2224435 - DNA, 15 bp, Homo sapiens
ctgcctctgacacac

SEQ ID NO: 2224436 - DNA, 23 bp, Homo sapiens
ctgcctctgacacacagctctgt

SEQ ID NO: 2224437 - DNA, 14 bp, Homo sapiens
ctgcctgcccaggc

SEQ ID NO: 2224438 - DNA, 15 bp, Homo sapiens
ctgcctgttcagctc

SEQ ID NO: 2224439 - DNA, 19 bp, Homo sapiens
ctgcctgttcagctccagc

SEQ ID NO: 2224440 - DNA, 14 bp, Homo sapiens
ctgcctgttgggcc

SEQ ID NO: 2224441 - DNA, 16 bp, Homo sapiens
ctgcctgttgggccag

SEQ ID NO: 2224442 - DNA, 19 bp, Homo sapiens
ctgcctgttgggccaggag

SEQ ID NO: 2224443 - DNA, 19 bp, Homo sapiens
ctgcgaccacaagaaggat

SEQ ID NO: 2224444 - DNA, 16 bp, Homo sapiens
ctgcggaagccacagg

SEQ ID NO: 2224445 - DNA, 18 bp, Homo sapiens
ctgcggaagccacagggt

SEQ ID NO: 2224446 - DNA, 22 bp, Homo sapiens
ctgcggaagccacagggtgagc

SEQ ID NO: 2224447 - DNA, 21 bp, Homo sapiens
ctgcggaatgaaccacatctt

SEQ ID NO: 2224448 - DNA, 21 bp, Homo sapiens
ctgcggtgctatctcccccag

SEQ ID NO: 2224449 - DNA, 22 bp, Homo sapiens
ctgcggtgctatctcccccagc

SEQ ID NO: 2224450 - DNA, 23 bp, Homo sapiens
ctgcggtgctatctcccccagcc

SEQ ID NO: 2224451 - DNA, 15 bp, Homo sapiens
ctgctacagagcaga

SEQ ID NO: 2224452 - DNA, 14 bp, Homo sapiens
ctgctcacatatct

SEQ ID NO: 2224453 - DNA, 16 bp, Homo sapiens
ctgctcctctccccag

SEQ ID NO: 2224454 - DNA, 23 bp, Homo sapiens
ctgctcctctccccagcaagtga

SEQ ID NO: 2224455 - DNA, 12 bp, Homo sapiens
ctgctctggtta

SEQ ID NO: 2224456 - DNA, 18 bp, Homo sapiens
ctgctgacagacacaggc

SEQ ID NO: 2224457 - DNA, 12 bp, Homo sapiens
ctgctgacagtg

SEQ ID NO: 2224458 - DNA, 13 bp, Homo sapiens
ctgctgctggctg

SEQ ID NO: 2224459 - DNA, 14 bp, Homo sapiens
cccaggaggccagc

SEQ ID NO: 2224460 - DNA, 23 bp, Homo sapiens
cccaggcattccccaggaggcca

SEQ ID NO: 2224461 - DNA, 13 bp, Homo sapiens
cccaggctggcgt

SEQ ID NO: 2224462 - DNA, 17 bp, Homo sapiens
cccaggctggcgtgcag

SEQ ID NO: 2224463 - DNA, 20 bp, Homo sapiens
cccaggcttagtcactgaga

SEQ ID NO: 2224464 - DNA, 15 bp, Homo sapiens
cccagtgccccctgg

SEQ ID NO: 2224465 - DNA, 20 bp, Homo sapiens
cccagtggttcctaatcctc

SEQ ID NO: 2224466 - DNA, 13 bp, Homo sapiens
cccatcctctgta

SEQ ID NO: 2224467 - DNA, 15 bp, Homo sapiens
cccatcctctgtaca

SEQ ID NO: 2224468 - DNA, 19 bp, Homo sapiens
cccatcctctgtacagagc

SEQ ID NO: 2224469 - DNA, 22 bp, Homo sapiens
cccatcctctgtacagagccca

SEQ ID NO: 2224470 - DNA, 20 bp, Homo sapiens
cccatctgtgaaaggaaaga

SEQ ID NO: 2224471 - DNA, 20 bp, Homo sapiens
cccatgagcctcagcatcct

SEQ ID NO: 2224472 - DNA, 13 bp, Homo sapiens
cccatgctgccct

SEQ ID NO: 2224473 - DNA, 19 bp, Homo sapiens
cccattctgcctgcccagg

SEQ ID NO: 2224474 - DNA, 23 bp, Homo sapiens
cccattctgcctgcccaggcccc

SEQ ID NO: 2224475 - DNA, 15 bp, Homo sapiens
cccatttgctccttt

SEQ ID NO: 2224476 - DNA, 21 bp, Homo sapiens
ccccaaaactctcctctgctg

SEQ ID NO: 2224477 - DNA, 21 bp, Homo sapiens
ccccacccaagggcctggcct

SEQ ID NO: 2224478 - DNA, 17 bp, Homo sapiens
ccccaccccaggctggg

SEQ ID NO: 2224479 - DNA, 12 bp, Homo sapiens
ccccacccccac

SEQ ID NO: 2224480 - DNA, 13 bp, Homo sapiens
ccccaccctcgac

SEQ ID NO: 2224481 - DNA, 16 bp, Homo sapiens
ccccaccctcgaccac

SEQ ID NO: 2224482 - DNA, 12 bp, Homo sapiens
ccccactggtga

SEQ ID NO: 2224483 - DNA, 15 bp, Homo sapiens
ccccagattgcaaca

SEQ ID NO: 2224484 - DNA, 22 bp, Homo sapiens
ccccagattgcaacaggctggg

SEQ ID NO: 2224485 - DNA, 23 bp, Homo sapiens
ccccagattgcaacaggctgggc

SEQ ID NO: 2224486 - DNA, 17 bp, Homo sapiens
ccccagcaagtgagagc

SEQ ID NO: 2224487 - DNA, 13 bp, Homo sapiens
ccccagcacctag

SEQ ID NO: 2224488 - DNA, 23 bp, Homo sapiens
ccccagcacctaggtggggcctg

SEQ ID NO: 2224489 - DNA, 21 bp, Homo sapiens
ccccaggaggccagccttgac

SEQ ID NO: 2224490 - DNA, 22 bp, Homo sapiens
ccccaggaggccagccttgacc

SEQ ID NO: 2224491 - DNA, 17 bp, Homo sapiens
ccccatcctctgtacag

SEQ ID NO: 2224492 - DNA, 22 bp, Homo sapiens
ccccatcctctgtacagagccc

SEQ ID NO: 2224493 - DNA, 15 bp, Homo sapiens
cccccactggtgaca

SEQ ID NO: 2224494 - DNA, 12 bp, Homo sapiens
cccccagcccca

SEQ ID NO: 2224495 - DNA, 20 bp, Homo sapiens
cccccggcccagtgccccct

SEQ ID NO: 2224496 - DNA, 17 bp, Homo sapiens
ccccctccccgggcagc

SEQ ID NO: 2224497 - DNA, 15 bp, Homo sapiens
cccccttgcccaggc

SEQ ID NO: 2224498 - DNA, 12 bp, Homo sapiens
ccccgcccaggc

SEQ ID NO: 2224499 - DNA, 18 bp, Homo sapiens
ccccgcctgccctcccac

SEQ ID NO: 2224500 - DNA, 18 bp, Homo sapiens
ccccggccacctgcggtg

SEQ ID NO: 2224501 - DNA, 18 bp, Homo sapiens
ccccgggcagcagagaga

SEQ ID NO: 2224502 - DNA, 16 bp, Homo sapiens
cccctcagggtccctg

SEQ ID NO: 2224503 - DNA, 17 bp, Homo sapiens
cccctcagggtccctgg

SEQ ID NO: 2224504 - DNA, 16 bp, Homo sapiens
cccctgccaccctggg

SEQ ID NO: 2224505 - DNA, 15 bp, Homo sapiens
cccctggcagcccct

SEQ ID NO: 2224506 - DNA, 22 bp, Homo sapiens
cccctggtggaatgcgggggag

SEQ ID NO: 2224507 - DNA, 22 bp, Homo sapiens
cccctgtccccgcactgggctt

SEQ ID NO: 2224508 - DNA, 13 bp, Homo sapiens
ccccttccatgga

SEQ ID NO: 2224509 - DNA, 20 bp, Homo sapiens
ccccttccatggactttgtt

SEQ ID NO: 2224510 - DNA, 13 bp, Homo sapiens
ccccttctgaccc

SEQ ID NO: 2224511 - DNA, 13 bp, Homo sapiens
ccccttgcccagg

SEQ ID NO: 2224512 - DNA, 19 bp, Homo sapiens
ccccttgcccaggcctccc

SEQ ID NO: 2224513 - DNA, 18 bp, Homo sapiens
cccgaatagctgggacta

SEQ ID NO: 2224514 - DNA, 14 bp, Homo sapiens
cccgagtagctggg

SEQ ID NO: 2224515 - DNA, 18 bp, Homo sapiens
cccgagtagctgggacta

SEQ ID NO: 2224516 - DNA, 22 bp, Homo sapiens
cccgagtagctgggactacagg

SEQ ID NO: 2224517 - DNA, 23 bp, Homo sapiens
cccgctaagagggagggagggct

SEQ ID NO: 2224518 - DNA, 16 bp, Homo sapiens
cccggcagggtcctag

SEQ ID NO: 2224519 - DNA, 13 bp, Homo sapiens
cccggcccagtgc

SEQ ID NO: 2224520 - DNA, 12 bp, Homo sapiens
cccggctccagg

SEQ ID NO: 2224521 - DNA, 16 bp, Homo sapiens
cccggctccaggctcc

SEQ ID NO: 2224522 - DNA, 12 bp, Homo sapiens
cccggctgcgga

SEQ ID NO: 2224523 - DNA, 21 bp, Homo sapiens
cccgggaagggggctgggaca

SEQ ID NO: 2224524 - DNA, 22 bp, Homo sapiens
ccctaaagtgtatttttttact

SEQ ID NO: 2224525 - DNA, 20 bp, Homo sapiens
ccctacagttgaaaaacagc

SEQ ID NO: 2224526 - DNA, 16 bp, Homo sapiens
ccctcaacacctctgc

SEQ ID NO: 2224527 - DNA, 21 bp, Homo sapiens
ccctcagggtccctggtggca

SEQ ID NO: 2224528 - DNA, 17 bp, Homo sapiens
ccctcatcctcataccc

SEQ ID NO: 2224529 - DNA, 20 bp, Homo sapiens
ccctccccgggcagcagaga

SEQ ID NO: 2224530 - DNA, 22 bp, Homo sapiens
ccctccccgggcagcagagaga

SEQ ID NO: 2224531 - DNA, 13 bp, Homo sapiens
ccctccctctttc

SEQ ID NO: 2224532 - DNA, 23 bp, Homo sapiens
ccctccctctttccctcccttcc

SEQ ID NO: 2224533 - DNA, 11 bp, Homo sapiens
ccctctgccca

SEQ ID NO: 2224534 - DNA, 19 bp, Homo sapiens
ccctctgcccactccctgc

SEQ ID NO: 2224535 - DNA, 17 bp, Homo sapiens
ccctctttccctccctt

SEQ ID NO: 2224536 - DNA, 15 bp, Homo sapiens
ccctgaaagccctga

SEQ ID NO: 2224537 - DNA, 16 bp, Homo sapiens
ccctgaaagccctgag

SEQ ID NO: 2224538 - DNA, 20 bp, Homo sapiens
ccctgaaggccccgcccagg

SEQ ID NO: 2224539 - DNA, 16 bp, Homo sapiens
ccctgacaacactcat

SEQ ID NO: 2224540 - DNA, 16 bp, Homo sapiens
ccctgagctttctgct

SEQ ID NO: 2224541 - DNA, 15 bp, Homo sapiens
ccctgaggcccagag

SEQ ID NO: 2224542 - DNA, 16 bp, Homo sapiens
ccctgcaacctgattg

SEQ ID NO: 2224543 - DNA, 12 bp, Homo sapiens
ccctgcagaggg

SEQ ID NO: 2224544 - DNA, 12 bp, Homo sapiens
ccctgccaccct

SEQ ID NO: 2224545 - DNA, 14 bp, Homo sapiens
ccctgccaccctgg

SEQ ID NO: 2224546 - DNA, 13 bp, Homo sapiens
ccctgcccacctg

SEQ ID NO: 2224547 - DNA, 12 bp, Homo sapiens
ccctgccctgtg

SEQ ID NO: 2224548 - DNA, 13 bp, Homo sapiens
ccctgccctgtgg

SEQ ID NO: 2224549 - DNA, 15 bp, Homo sapiens
ccctgccctgtgggc

SEQ ID NO: 2224550 - DNA, 20 bp, Homo sapiens
ccctgccctgtgggccccca

SEQ ID NO: 2224551 - DNA, 21 bp, Homo sapiens
ccctgccctgtgggcccccaa

SEQ ID NO: 2224552 - DNA, 16 bp, Homo sapiens
ccctgcctcctttgtg

SEQ ID NO: 2224553 - DNA, 22 bp, Homo sapiens
ccctgctctccgaccagacacc

SEQ ID NO: 2224554 - DNA, 21 bp, Homo sapiens
ccctgctgggtgtggcgcagc

SEQ ID NO: 2224555 - DNA, 17 bp, Homo sapiens
ccctggatgcagcctca

SEQ ID NO: 2224556 - DNA, 21 bp, Homo sapiens
ccctggtggcagctcacctct

SEQ ID NO: 2224557 - DNA, 22 bp, Homo sapiens
ccttggtgtcgggcatgacacg

SEQ ID NO: 2224558 - DNA, 21 bp, Homo sapiens
ccttggttaggcattgtggga

SEQ ID NO: 2224559 - DNA, 17 bp, Homo sapiens
cctttcaataggaaaaa

SEQ ID NO: 2224560 - DNA, 18 bp, Homo sapiens
cctttcaataggaaaaac

SEQ ID NO: 2224561 - DNA, 22 bp, Homo sapiens
cctttgacgccatcccagcccc

SEQ ID NO: 2224562 - DNA, 22 bp, Homo sapiens
cctttgtattctctcctgtacc

SEQ ID NO: 2224563 - DNA, 23 bp, Homo sapiens
cctttgtgaggaagccgctgggg

SEQ ID NO: 2224564 - DNA, 17 bp, Homo sapiens
ccttttttatacataaa

SEQ ID NO: 2224565 - DNA, 15 bp, Homo sapiens
ccttttttggctgct

SEQ ID NO: 2224566 - DNA, 18 bp, Homo sapiens
ccttttttggctgctgaa

SEQ ID NO: 2224567 - DNA, 20 bp, Homo sapiens
cgaaaacgtggctgcttcaa

SEQ ID NO: 2224568 - DNA, 22 bp, Homo sapiens
cgaaagggacttggaagctccg

SEQ ID NO: 2224569 - DNA, 23 bp, Homo sapiens
cgaacatgtttttcttctccctc

SEQ ID NO: 2224570 - DNA, 11 bp, Homo sapiens
cgaatattgct

SEQ ID NO: 2224571 - DNA, 15 bp, Homo sapiens
cgaatattgctgatg

SEQ ID NO: 2224572 - DNA, 13 bp, Homo sapiens
cgacaatgcaaac

SEQ ID NO: 2224573 - DNA, 20 bp, Homo sapiens
cgagatcacgccactgcact

SEQ ID NO: 2224574 - DNA, 14 bp, Homo sapiens
cgagcatgcctgga

SEQ ID NO: 2224575 - DNA, 16 bp, Homo sapiens
cgagcatgcctggatg

SEQ ID NO: 2224576 - DNA, 12 bp, Homo sapiens
cgaggacaggga

SEQ ID NO: 2224577 - DNA, 16 bp, Homo sapiens
cgaggacagggaggtg

SEQ ID NO: 2224578 - DNA, 13 bp, Homo sapiens
cgagtagctggga

SEQ ID NO: 2224579 - DNA, 15 bp, Homo sapiens
cgagtagctgggact

SEQ ID NO: 2224580 - DNA, 16 bp, Homo sapiens
cgagtagctgggacta

SEQ ID NO: 2224581 - DNA, 13 bp, Homo sapiens
cgattcttctgct

SEQ ID NO: 2224582 - DNA, 19 bp, Homo sapiens
cgattcttctgcttcagcc

SEQ ID NO: 2224583 - DNA, 17 bp, Homo sapiens
cgcactgggcttgggga

SEQ ID NO: 2224584 - DNA, 23 bp, Homo sapiens
cgcacttcgggaggtcgaggcag

SEQ ID NO: 2224585 - DNA, 16 bp, Homo sapiens
cgcagacaggaccagg

SEQ ID NO: 2224586 - DNA, 17 bp, Homo sapiens
cgcagccctgcagaggg

SEQ ID NO: 2224587 - DNA, 13 bp, Homo sapiens
cgccaaggctggg

SEQ ID NO: 2224588 - DNA, 16 bp, Homo sapiens
cgccaaggctggggga

SEQ ID NO: 2224589 - DNA, 20 bp, Homo sapiens
cgccagattctttcctgagg

SEQ ID NO: 2224590 - DNA, 22 bp, Homo sapiens
cgccagattctttcctgaggct

SEQ ID NO: 2224591 - DNA, 14 bp, Homo sapiens
cgccatcccagccc

SEQ ID NO: 2224592 - DNA, 20 bp, Homo sapiens
cgccatcccagccccaatga

SEQ ID NO: 2224593 - DNA, 17 bp, Homo sapiens
cgccatgctcctggccc

SEQ ID NO: 2224594 - DNA, 23 bp, Homo sapiens
cgcccagttgggtggatgcctgg

SEQ ID NO: 2224595 - DNA, 16 bp, Homo sapiens
cgccttaaggatgttc

SEQ ID NO: 2224596 - DNA, 15 bp, Homo sapiens
cgcgacaatgcaaac

SEQ ID NO: 2224597 - DNA, 16 bp, Homo sapiens
cgcgacaatgcaaacc

SEQ ID NO: 2224598 - DNA, 16 bp, Homo sapiens
cgcgtgcacacaccag

SEQ ID NO: 2224599 - DNA, 17 bp, Homo sapiens
cgctgcccctggcagcc

SEQ ID NO: 2224600 - DNA, 19 bp, Homo sapiens
cgctggaccttgaactggg

SEQ ID NO: 2224601 - DNA, 17 bp, Homo sapiens
cgctggagtgcagtgag

SEQ ID NO: 2224602 - DNA, 11 bp, Homo sapiens
cgctgtgctgc

SEQ ID NO: 2224603 - DNA, 13 bp, Homo sapiens
cgctgtgctgccc

SEQ ID NO: 2224604 - DNA, 15 bp, Homo sapiens
cgctgtgctgccctg

SEQ ID NO: 2224605 - DNA, 17 bp, Homo sapiens
cgctgtgctgccctgcc

SEQ ID NO: 2224606 - DNA, 18 bp, Homo sapiens
cgctgtgctgccctgccc

SEQ ID NO: 2224607 - DNA, 20 bp, Homo sapiens
cggaaaacatgctacacact

SEQ ID NO: 2224608 - DNA, 20 bp, Homo sapiens
cggaatgaaccacatcttgc

SEQ ID NO: 2224609 - DNA, 21 bp, Homo sapiens
cggacagccacggccaggcca

SEQ ID NO: 2224610 - DNA, 23 bp, Homo sapiens
cggacgacgcgagggccccacgt

SEQ ID NO: 2224611 - DNA, 14 bp, Homo sapiens
cggagtcccacctt

SEQ ID NO: 2224612 - DNA, 11 bp, Homo sapiens
cggccacctgc

SEQ ID NO: 2224613 - DNA, 20 bp, Homo sapiens
cggccaggccagagggagtg

SEQ ID NO: 2224614 - DNA, 18 bp, Homo sapiens
cggcccagtgccccctgg

SEQ ID NO: 2224615 - DNA, 19 bp, Homo sapiens
cggcccctgctggttcagg

SEQ ID NO: 2224616 - DNA, 22 bp, Homo sapiens
cggctaaaaagaatgcagagat

SEQ ID NO: 2224617 - DNA, 15 bp, Homo sapiens
cggctcactgcagcc

SEQ ID NO: 2224618 - DNA, 19 bp, Homo sapiens
cggctcactgcagcctcaa

SEQ ID NO: 2224619 - DNA, 12 bp, Homo sapiens
cggctccaggct

SEQ ID NO: 2224620 - DNA, 13 bp, Homo sapiens
cggctccaggctc

SEQ ID NO: 2224621 - DNA, 14 bp, Homo sapiens
cggctccaggctcc

SEQ ID NO: 2224622 - DNA, 15 bp, Homo sapiens
cggctccaggctcct

SEQ ID NO: 2224623 - DNA, 14 bp, Homo sapiens
cggctggcagccca

SEQ ID NO: 2224624 - DNA, 23 bp, Homo sapiens
cggctggcagcccacccctcaac

SEQ ID NO: 2224625 - DNA, 15 bp, Homo sapiens
cggctggcctggccc

SEQ ID NO: 2224626 - DNA, 16 bp, Homo sapiens
cggctggcctggcccc

SEQ ID NO: 2224627 - DNA, 19 bp, Homo sapiens
cggctggcctggcccctca

SEQ ID NO: 2224628 - DNA, 23 bp, Homo sapiens
cggctggcctggcccctcagggt

SEQ ID NO: 2224629 - DNA, 16 bp, Homo sapiens
cgggaagggggctggg

SEQ ID NO: 2224630 - DNA, 20 bp, Homo sapiens
cgggaggatgttctgggaca

SEQ ID NO: 2224631 - DNA, 23 bp, Homo sapiens
cgggaggatgttctgggacacag

SEQ ID NO: 2224632 - DNA, 16 bp, Homo sapiens
cgggaggtcgaggcag

SEQ ID NO: 2224633 - DNA, 22 bp, Homo sapiens
cgggcactcagaagacactgat

SEQ ID NO: 2224634 - DNA, 12 bp, Homo sapiens
cgggcagcagag

SEQ ID NO: 2224635 - DNA, 14 bp, Homo sapiens
cgggcagcagagag

SEQ ID NO: 2224636 - DNA, 15 bp, Homo sapiens
cgggcagcagagaga

SEQ ID NO: 2224637 - DNA, 19 bp, Homo sapiens
cgggctcagcaaaagatgc

SEQ ID NO: 2224638 - DNA, 13 bp, Homo sapiens
cgggctctgcctc

SEQ ID NO: 2224639 - DNA, 14 bp, Homo sapiens
cgggctctgcctcc

SEQ ID NO: 2224640 - DNA, 23 bp, Homo sapiens
cggggacagctccttctgtccta

SEQ ID NO: 2224641 - DNA, 21 bp, Homo sapiens
cggggatcccccgccccatcc

SEQ ID NO: 2224642 - DNA, 23 bp, Homo sapiens
cgggggagcaggcagtggggctg

SEQ ID NO: 2224643 - DNA, 15 bp, Homo sapiens
cgggggcagagaggg

SEQ ID NO: 2224644 - DNA, 16 bp, Homo sapiens
cggtccacccaggagc

SEQ ID NO: 2224645 - DNA, 20 bp, Homo sapiens
cggtccacccaggagccccg

SEQ ID NO: 2224646 - DNA, 20 bp, Homo sapiens
cggtggctcacgcctgtaat

SEQ ID NO: 2224647 - DNA, 22 bp, Homo sapiens
cgtacacattttattttattat

SEQ ID NO: 2224648 - DNA, 20 bp, Homo sapiens
cgtccctgcggaagccacag

SEQ ID NO: 2224649 - DNA, 14 bp, Homo sapiens
cgtctacctgaggg

SEQ ID NO: 2224650 - DNA, 14 bp, Homo sapiens
cgtctgacaggcaa

SEQ ID NO: 2224651 - DNA, 14 bp, Homo sapiens
cgtgacaacacttg

SEQ ID NO: 2224652 - DNA, 15 bp, Homo sapiens
cgtgacaacacttgt

SEQ ID NO: 2224653 - DNA, 20 bp, Homo sapiens
cgtgagccactgcaccgggc

SEQ ID NO: 2224654 - DNA, 17 bp, Homo sapiens
cgtgaggccagagacac

SEQ ID NO: 2224655 - DNA, 17 bp, Homo sapiens
cgtgagtcctggcatgg

SEQ ID NO: 2224656 - DNA, 19 bp, Homo sapiens
cgtgcacacaccagagccc

SEQ ID NO: 2224657 - DNA, 21 bp, Homo sapiens
cgtgcagtggtgcgatctggg

SEQ ID NO: 2224658 - DNA, 22 bp, Homo sapiens
cgtgcagtggtgcgatctgggt

SEQ ID NO: 2224659 - DNA, 23 bp, Homo sapiens
cgtggagaatttttactggggat

SEQ ID NO: 2224660 - DNA, 20 bp, Homo sapiens
cgtttctatgacacatgcaa

SEQ ID NO: 2224661 - DNA, 10 bp, Homo sapiens
ctaaaaagaa

SEQ ID NO: 2224662 - DNA, 11 bp, Homo sapiens
ctaaaaagaat

SEQ ID NO: 2224663 - DNA, 19 bp, Homo sapiens
ctaaaaagaatgcagagat

SEQ ID NO: 2224664 - DNA, 23 bp, Homo sapiens
ctaaaaggtatgcaatcaaatct

SEQ ID NO: 2224665 - DNA, 19 bp, Homo sapiens
ctaaaggctacctttgtat

SEQ ID NO: 2224666 - DNA, 20 bp, Homo sapiens
ctaaatctccaaaataaaac

SEQ ID NO: 2224667 - DNA, 16 bp, Homo sapiens
ctaaatggaaccactc

SEQ ID NO: 2224668 - DNA, 17 bp, Homo sapiens
ctaaatggaaccactct

SEQ ID NO: 2224669 - DNA, 18 bp, Homo sapiens
ctaaatggaaccactcta

SEQ ID NO: 2224670 - DNA, 17 bp, Homo sapiens
ctaaccagcagaaatgc

SEQ ID NO: 2224671 - DNA, 14 bp, Homo sapiens
ctaacttgtctttg

SEQ ID NO: 2224672 - DNA, 22 bp, Homo sapiens
ctaacttgtctttggaccctga

SEQ ID NO: 2224673 - DNA, 16 bp, Homo sapiens
ctaactttccttcatt

SEQ ID NO: 2224674 - DNA, 20 bp, Homo sapiens
ctaagtgatcctcccacctc

SEQ ID NO: 2224675 - DNA, 22 bp, Homo sapiens
ctaagtgatcctcccacctcag

SEQ ID NO: 2224676 - DNA, 14 bp, Homo sapiens
ctaagtttttatgg

SEQ ID NO: 2224677 - DNA, 20 bp, Homo sapiens
ctaataaaatttaaaagtct

SEQ ID NO: 2224678 - DNA, 21 bp, Homo sapiens
ctacacactgcatgtttgtga

SEQ ID NO: 2224679 - DNA, 23 bp, Homo sapiens
ctacagcttgaccgtgaggccag

SEQ ID NO: 2224680 - DNA, 21 bp, Homo sapiens
ctcccaaggggcccaaattct

SEQ ID NO: 2224681 - DNA, 15 bp, Homo sapiens
ctcccaccccctccc

SEQ ID NO: 2224682 - DNA, 12 bp, Homo sapiens
ctcccacctcag

SEQ ID NO: 2224683 - DNA, 17 bp, Homo sapiens
ctcccacctcagcctcc

SEQ ID NO: 2224684 - DNA, 16 bp, Homo sapiens
ctcccagacccccttg

SEQ ID NO: 2224685 - DNA, 18 bp, Homo sapiens
ctcccagacccccttgcc

SEQ ID NO: 2224686 - DNA, 22 bp, Homo sapiens
ctcccaggcattccccaggagg

SEQ ID NO: 2224687 - DNA, 20 bp, Homo sapiens
ctccccagcaagtgagagct

SEQ ID NO: 2224688 - DNA, 21 bp, Homo sapiens
ctccccagcaagtgagagctg

SEQ ID NO: 2224689 - DNA, 22 bp, Homo sapiens
ctccccagcaagtgagagctgg

SEQ ID NO: 2224690 - DNA, 22 bp, Homo sapiens
ctccccgggcagcagagagaga

SEQ ID NO: 2224691 - DNA, 13 bp, Homo sapiens
ctcccctgctggg

SEQ ID NO: 2224692 - DNA, 16 bp, Homo sapiens
ctcccgaatagctggg

SEQ ID NO: 2224693 - DNA, 18 bp, Homo sapiens
ctcccgaatagctgggac

SEQ ID NO: 2224694 - DNA, 23 bp, Homo sapiens
ctcccgaatagctgggactacag

SEQ ID NO: 2224695 - DNA, 15 bp, Homo sapiens
ctcccgagtagctgg

SEQ ID NO: 2224696 - DNA, 18 bp, Homo sapiens
ctcccgagtagctgggac

SEQ ID NO: 2224697 - DNA, 20 bp, Homo sapiens
ctccctctttccctcccttc

SEQ ID NO: 2224698 - DNA, 15 bp, Homo sapiens
ctcccttcccacctc

SEQ ID NO: 2224699 - DNA, 16 bp, Homo sapiens
ctcccttcccacctct

SEQ ID NO: 2224700 - DNA, 20 bp, Homo sapiens
ctcccttggattgtccccga

SEQ ID NO: 2224701 - DNA, 22 bp, Homo sapiens
ctccgctttctacccagcgagc

SEQ ID NO: 2224702 - DNA, 22 bp, Homo sapiens
ctcctagcctgtgcctctggga

SEQ ID NO: 2224703 - DNA, 22 bp, Homo sapiens
ctcctccagccgccatgctcct

SEQ ID NO: 2224704 - DNA, 12 bp, Homo sapiens
ctcctgcaggca

SEQ ID NO: 2224705 - DNA, 17 bp, Homo sapiens
ctcctgcaggcagccag

SEQ ID NO: 2224706 - DNA, 18 bp, Homo sapiens
ctcctgcaggcagccagg

SEQ ID NO: 2224707 - DNA, 21 bp, Homo sapiens
ctcctgcaggcagccaggcca

SEQ ID NO: 2224708 - DNA, 15 bp, Homo sapiens
ctcctgcccccaccc

SEQ ID NO: 2224709 - DNA, 16 bp, Homo sapiens
ctcctgcccccacccc

SEQ ID NO: 2224710 - DNA, 18 bp, Homo sapiens
ctcctgcccccaccccag

SEQ ID NO: 2224711 - DNA, 19 bp, Homo sapiens
ctcctgcccccaccccagg

SEQ ID NO: 2224712 - DNA, 11 bp, Homo sapiens
ctcctgccctt

SEQ ID NO: 2224713 - DNA, 12 bp, Homo sapiens
ctcctgcctcag

SEQ ID NO: 2224714 - DNA, 14 bp, Homo sapiens
ctcctgcctcagcc

SEQ ID NO: 2224715 - DNA, 21 bp, Homo sapiens
ctcctgcctcgaactggctgc

SEQ ID NO: 2224716 - DNA, 19 bp, Homo sapiens
ctcctggcccactgcatcg

SEQ ID NO: 2224717 - DNA, 11 bp, Homo sapiens
ctcctgtgtgt

SEQ ID NO: 2224718 - DNA, 14 bp, Homo sapiens
ctccttctgtccta

SEQ ID NO: 2224719 - DNA, 15 bp, Homo sapiens
ctccttctgtcctac

SEQ ID NO: 2224720 - DNA, 20 bp, Homo sapiens
ctccttctgtcctactctgt

SEQ ID NO: 2224721 - DNA, 23 bp, Homo sapiens
ctccttggtgtcgggcatgacac

SEQ ID NO: 2224722 - DNA, 24 bp, Homo sapiens
ctccttttcacagttctctccttc

SEQ ID NO: 2224723 - DNA, 16 bp, Homo sapiens
ctcgaactggctgcaa

SEQ ID NO: 2224724 - DNA, 22 bp, Homo sapiens
ctcgagcatgcctggatggggc

SEQ ID NO: 2224725 - DNA, 20 bp, Homo sapiens
ctcgagttacagacaaagcg

SEQ ID NO: 2224726 - DNA, 23 bp, Homo sapiens
ctcggtgtggagaagcggctggc

SEQ ID NO: 2224727 - DNA, 16 bp, Homo sapiens
ctctacagaggccatg

SEQ ID NO: 2224728 - DNA, 21 bp, Homo sapiens
ctctagtttgattaaattctt

SEQ ID NO: 2224729 - DNA, 17 bp, Homo sapiens
ctgaaggctgggttctg

SEQ ID NO: 2224730 - DNA, 16 bp, Homo sapiens
ctgaagtcacacagtg

SEQ ID NO: 2224731 - DNA, 19 bp, Homo sapiens
ctgaagtcacacagtgagt

SEQ ID NO: 2224732 - DNA, 20 bp, Homo sapiens
ctgaagtctttgtacagaca

SEQ ID NO: 2224733 - DNA, 24 bp, Homo sapiens
ctgaagtctttgtacagacaacaa

SEQ ID NO: 2224734 - DNA, 18 bp, Homo sapiens
ctgacacacagctctgtc

SEQ ID NO: 2224735 - DNA, 12 bp, Homo sapiens
ctgacagacaca

SEQ ID NO: 2224736 - DNA, 15 bp, Homo sapiens
ctgacagacacaggc

SEQ ID NO: 2224737 - DNA, 21 bp, Homo sapiens
ctgacagacacaggcccggct

SEQ ID NO: 2224738 - DNA, 18 bp, Homo sapiens
ctgacaggcaatgctggc

SEQ ID NO: 2224739 - DNA, 11 bp, Homo sapiens
ctgacccactg

SEQ ID NO: 2224740 - DNA, 15 bp, Homo sapiens
ctgacccatgctgcc

SEQ ID NO: 2224741 - DNA, 22 bp, Homo sapiens
ctgacccatgctgccctgtgag

SEQ ID NO: 2224742 - DNA, 16 bp, Homo sapiens
ctgagacagcccgggc

SEQ ID NO: 2224743 - DNA, 21 bp, Homo sapiens
ctgagacagcccgggctctgc

SEQ ID NO: 2224744 - DNA, 17 bp, Homo sapiens
ctgagactcgcgacaat

SEQ ID NO: 2224745 - DNA, 20 bp, Homo sapiens
ctgagactcgcgacaatgca

SEQ ID NO: 2224746 - DNA, 15 bp, Homo sapiens
ctgagctttctgcta

SEQ ID NO: 2224747 - DNA, 17 bp, Homo sapiens
ctgaggaatccagaccc

SEQ ID NO: 2224748 - DNA, 14 bp, Homo sapiens
ctgaggcccagagg

SEQ ID NO: 2224749 - DNA, 14 bp, Homo sapiens
ctgaggcccttctc

SEQ ID NO: 2224750 - DNA, 18 bp, Homo sapiens
ctgaggcccttctctcca

SEQ ID NO: 2224751 - DNA, 15 bp, Homo sapiens
ctgaggctgggctcc

SEQ ID NO: 2224752 - DNA, 22 bp, Homo sapiens
ctgaggctgggctcccttccca

SEQ ID NO: 2224753 - DNA, 13 bp, Homo sapiens
ctgagtctgaagg

SEQ ID NO: 2224754 - DNA, 16 bp, Homo sapiens
ctgagtctgaaggctg

SEQ ID NO: 2224755 - DNA, 21 bp, Homo sapiens
ctgatcctagttccaccatca

SEQ ID NO: 2224756 - DNA, 17 bp, Homo sapiens
ctgatctctcgtgattg

SEQ ID NO: 2224757 - DNA, 23 bp, Homo sapiens
ctgatgggcaacccccagcctgc

SEQ ID NO: 2224758 - DNA, 16 bp, Homo sapiens
ctgatggtgcaatgac

SEQ ID NO: 2224759 - DNA, 19 bp, Homo sapiens
ctgatggtgcaatgacctt

SEQ ID NO: 2224760 - DNA, 20 bp, Homo sapiens
ctgatggtgcaatgaccttt

SEQ ID NO: 2224761 - DNA, 20 bp, Homo sapiens
ctgattcccaagctctgctc

SEQ ID NO: 2224762 - DNA, 21 bp, Homo sapiens
ctgatttttttttccttcagt

SEQ ID NO: 2224763 - DNA, 20 bp, Homo sapiens
ctgcaacctccgcctcttgg

SEQ ID NO: 2224764 - DNA, 18 bp, Homo sapiens
ctgcaagaattgaagcag

SEQ ID NO: 2224765 - DNA, 16 bp, Homo sapiens
ctgcacaagctgcacc

SEQ ID NO: 2224766 - DNA, 17 bp, Homo sapiens
ctgcaccctcaggcagg

SEQ ID NO: 2224767 - DNA, 18 bp, Homo sapiens
ctgcaccctcaggcaggt

SEQ ID NO: 2224768 - DNA, 18 bp, Homo sapiens
ctgcaccggctggcctgg

SEQ ID NO: 2224769 - DNA, 18 bp, Homo sapiens
ctgcaccgggccacagag

SEQ ID NO: 2224770 - DNA, 18 bp, Homo sapiens
ctgcactatagcctaggt

SEQ ID NO: 2224771 - DNA, 20 bp, Homo sapiens
ctgcactatagcctaggtga

SEQ ID NO: 2224772 - DNA, 22 bp, Homo sapiens
ctgcactatagcctaggtgaca

SEQ ID NO: 2224773 - DNA, 23 bp, Homo sapiens
ctgcactatagcctaggtgacag

SEQ ID NO: 2224774 - DNA, 16 bp, Homo sapiens
ctgcactccagcctgg

SEQ ID NO: 2224775 - DNA, 18 bp, Homo sapiens
ctgcactccagcctgggt

SEQ ID NO: 2224776 - DNA, 19 bp, Homo sapiens
ctgcactccagcctgggtg

SEQ ID NO: 2224777 - DNA, 18 bp, Homo sapiens
ctgcactcccctgctggg

SEQ ID NO: 2224778 - DNA, 17 bp, Homo sapiens
ctgcacttgcagactct

SEQ ID NO: 2224779 - DNA, 18 bp, Homo sapiens
ctgcacttgcagactcta

SEQ ID NO: 2224780 - DNA, 23 bp, Homo sapiens
ctgcacttgcagactctacagag

SEQ ID NO: 2224781 - DNA, 17 bp, Homo sapiens
ctgcagcaataaagcag

SEQ ID NO: 2224782 - DNA, 20 bp, Homo sapiens
ctgcagcctcaacctcctgg

SEQ ID NO: 2224783 - DNA, 13 bp, Homo sapiens
caagagcccaggc

SEQ ID NO: 2224784 - DNA, 14 bp, Homo sapiens
caagagcccaggcc

SEQ ID NO: 2224785 - DNA, 15 bp, Homo sapiens
caagagcccaggcct

SEQ ID NO: 2224786 - DNA, 16 bp, Homo sapiens
caagagggtctgagga

SEQ ID NO: 2224787 - DNA, 13 bp, Homo sapiens
caagcacctcctg

SEQ ID NO: 2224788 - DNA, 15 bp, Homo sapiens
caagcacctcctgcc

SEQ ID NO: 2224789 - DNA, 15 bp, Homo sapiens
caagcgattcttctg

SEQ ID NO: 2224790 - DNA, 18 bp, Homo sapiens
caagcgattcttctgctt

SEQ ID NO: 2224791 - DNA, 22 bp, Homo sapiens
caagcgattcttctgcttcagc

SEQ ID NO: 2224792 - DNA, 17 bp, Homo sapiens
caagcgtgagccactgc

SEQ ID NO: 2224793 - DNA, 18 bp, Homo sapiens
caagctccaagctcccag

SEQ ID NO: 2224794 - DNA, 21 bp, Homo sapiens
caagctccaagctcccaggca

SEQ ID NO: 2224795 - DNA, 17 bp, Homo sapiens
caagctcccaggcattc

SEQ ID NO: 2224796 - DNA, 20 bp, Homo sapiens
caagctgcaccctcaggcag

SEQ ID NO: 2224797 - DNA, 22 bp, Homo sapiens
caagctgcaccctcaggcaggt

SEQ ID NO: 2224798 - DNA, 22 bp, Homo sapiens
caagctggtcccactcagtcca

SEQ ID NO: 2224799 - DNA, 23 bp, Homo sapiens
caagctggtcccactcagtccat

SEQ ID NO: 2224800 - DNA, 20 bp, Homo sapiens
caaggatcctgagccagatt

SEQ ID NO: 2224801 - DNA, 19 bp, Homo sapiens
caaggattgctactgtcct

SEQ ID NO: 2224802 - DNA, 20 bp, Homo sapiens
caaggattgctactgtccta

SEQ ID NO: 2224803 - DNA, 18 bp, Homo sapiens
caaggcaaggctgtcaat

SEQ ID NO: 2224804 - DNA, 17 bp, Homo sapiens
caaggccaaaggaagca

SEQ ID NO: 2224805 - DNA, 20 bp, Homo sapiens
caaggccaaaggaagcacat

SEQ ID NO: 2224806 - DNA, 18 bp, Homo sapiens
caaggctgggggaagaag

SEQ ID NO: 2224807 - DNA, 13 bp, Homo sapiens
caagggcctggcc

SEQ ID NO: 2224808 - DNA, 16 bp, Homo sapiens
caagggcctggcctga

SEQ ID NO: 2224809 - DNA, 23 bp, Homo sapiens
caaggtgggaggattgcttgagc

SEQ ID NO: 2224810 - DNA, 15 bp, Homo sapiens
caagtgagagctggg

SEQ ID NO: 2224811 - DNA, 17 bp, Homo sapiens
caagtgagagctgggtg

SEQ ID NO: 2224812 - DNA, 16 bp, Homo sapiens
caagtgattctcctgc

SEQ ID NO: 2224813 - DNA, 20 bp, Homo sapiens
caagtgattctcctgcctca

SEQ ID NO: 2224814 - DNA, 14 bp, Homo sapiens
caagttaaataaat

SEQ ID NO: 2224815 - DNA, 21 bp, Homo sapiens
caatgacctttcaataggaaa

SEQ ID NO: 2224816 - DNA, 18 bp, Homo sapiens
caatgacttactgtacat

SEQ ID NO: 2224817 - DNA, 22 bp, Homo sapiens
caatgcaaaccatcattgaaat

SEQ ID NO: 2224818 - DNA, 14 bp, Homo sapiens
caatgcactgacat

SEQ ID NO: 2224819 - DNA, 13 bp, Homo sapiens
caatgctggctgt

SEQ ID NO: 2224820 - DNA, 20 bp, Homo sapiens
caatgctggctgttggctgg

SEQ ID NO: 2224821 - DNA, 23 bp, Homo sapiens
caatgctggctgttggctggggg

SEQ ID NO: 2224822 - DNA, 22 bp, Homo sapiens
caatgctgtgccctaaagtgta

SEQ ID NO: 2224823 - DNA, 14 bp, Homo sapiens
caatggcagccttg

SEQ ID NO: 2224824 - DNA, 15 bp, Homo sapiens
caatgtgataaaacc

SEQ ID NO: 2224825 - DNA, 17 bp, Homo sapiens
caatgtgataaaacccc

SEQ ID NO: 2224826 - DNA, 17 bp, Homo sapiens
caattacaggaagtact

SEQ ID NO: 2224827 - DNA, 18 bp, Homo sapiens
caattacaggaagtactg

SEQ ID NO: 2224828 - DNA, 23 bp, Homo sapiens
caattctcatttgtcacacactt

SEQ ID NO: 2224829 - DNA, 16 bp, Homo sapiens
cacaaaagtttctctt

SEQ ID NO: 2224830 - DNA, 15 bp, Homo sapiens
cacaaacagaggccg

SEQ ID NO: 2224831 - DNA, 13 bp, Homo sapiens
cacaaaggagagc

SEQ ID NO: 2224832 - DNA, 17 bp, Homo sapiens
cacaagagcccaggcct

SEQ ID NO: 2224833 - DNA, 19 bp, Homo sapiens
cacaagagcccaggcctcc

SEQ ID NO: 2224834 - DNA, 14 bp, Homo sapiens
cacaagccttcggc

SEQ ID NO: 2224835 - DNA, 14 bp, Homo sapiens
cacaagctccaagc

SEQ ID NO: 2224836 - DNA, 15 bp, Homo sapiens
cacaagctccaagct

SEQ ID NO: 2224837 - DNA, 19 bp, Homo sapiens
cacaagctccaagctccca

SEQ ID NO: 2224838 - DNA, 23 bp, Homo sapiens
cacaagctgcaccctcaggcagg

SEQ ID NO: 2224839 - DNA, 15 bp, Homo sapiens
cacacaccagagccc

SEQ ID NO: 2224840 - DNA, 12 bp, Homo sapiens
cacacagctctg

SEQ ID NO: 2224841 - DNA, 14 bp, Homo sapiens
cacacagctctgtc

SEQ ID NO: 2224842 - DNA, 23 bp, Homo sapiens
cacacagtgagtcgaggacaggg

SEQ ID NO: 2224843 - DNA, 15 bp, Homo sapiens
cacacatacacacac

SEQ ID NO: 2224844 - DNA, 10 bp, Homo sapiens
cacacatttt

SEQ ID NO: 2224845 - DNA, 12 bp, Homo sapiens
cacacatttttt

SEQ ID NO: 2224846 - DNA, 15 bp, Homo sapiens
cacaccagagcccac

SEQ ID NO: 2224847 - DNA, 20 bp, Homo sapiens
cacacccagcccacttctgc

SEQ ID NO: 2224848 - DNA, 17 bp, Homo sapiens
cacaccgggcactcaga

SEQ ID NO: 2224849 - DNA, 18 bp, Homo sapiens
cacagaaaatggaagaca

SEQ ID NO: 2224850 - DNA, 19 bp, Homo sapiens
cacagaaaatggaagacag

SEQ ID NO: 2224851 - DNA, 19 bp, Homo sapiens
cacagaccctgccctgtgg

SEQ ID NO: 2224852 - DNA, 21 bp, Homo sapiens
cacagaccctgccctgtgggc

SEQ ID NO: 2224853 - DNA, 12 bp, Homo sapiens
cacagagaaagt

SEQ ID NO: 2224854 - DNA, 21 bp, Homo sapiens
cacagagaaagtacttctcca

SEQ ID NO: 2224855 - DNA, 22 bp, Homo sapiens
cacagagttgttacatttttaa

SEQ ID NO: 2224856 - DNA, 14 bp, Homo sapiens
cacagatgggtgct

SEQ ID NO: 2224857 - DNA, 23 bp, Homo sapiens
cacagatgggtgcttggaggaag

SEQ ID NO: 2224858 - DNA, 15 bp, Homo sapiens
cacagctaacatgga

SEQ ID NO: 2224859 - DNA, 16 bp, Homo sapiens
cacagctaacatggaa

SEQ ID NO: 2224860 - DNA, 11 bp, Homo sapiens
cacagctctgt

SEQ ID NO: 2224861 - DNA, 15 bp, Homo sapiens
cacagctctgtcctg

SEQ ID NO: 2224862 - DNA, 20 bp, Homo sapiens
cacagctctgtcctgggagt

SEQ ID NO: 2224863 - DNA, 10 bp, Homo sapiens
cacagctctt

SEQ ID NO: 2224864 - DNA, 15 bp, Homo sapiens
cacagctcttctcca

SEQ ID NO: 2224865 - DNA, 18 bp, Homo sapiens
cacagctcttctccaggc

SEQ ID NO: 2224866 - DNA, 21 bp, Homo sapiens
cacagcttcatttcctgtgtc

SEQ ID NO: 2224867 - DNA, 19 bp, Homo sapiens
cacaggcaggtccagggtt

SEQ ID NO: 2224868 - DNA, 20 bp, Homo sapiens
cacaggcccggctccaggct

SEQ ID NO: 2224869 - DNA, 18 bp, Homo sapiens
cacaggggaaaagaggag

SEQ ID NO: 2224870 - DNA, 14 bp, Homo sapiens
cacagggtgagcac

SEQ ID NO: 2224871 - DNA, 19 bp, Homo sapiens
cacagggtgagcactctgg

SEQ ID NO: 2224872 - DNA, 15 bp, Homo sapiens
attctcttatccaac

SEQ ID NO: 2224873 - DNA, 14 bp, Homo sapiens
attctgcctgccca

SEQ ID NO: 2224874 - DNA, 17 bp, Homo sapiens
attctgcctgcccaggc

SEQ ID NO: 2224875 - DNA, 18 bp, Homo sapiens
attctgcctgcccaggcc

SEQ ID NO: 2224876 - DNA, 19 bp, Homo sapiens
attctgcctgcccaggccc

SEQ ID NO: 2224877 - DNA, 21 bp, Homo sapiens
attctgctcacatatctgtca

SEQ ID NO: 2224878 - DNA, 22 bp, Homo sapiens
attctgctcacatatctgtcat

SEQ ID NO: 2224879 - DNA, 22 bp, Homo sapiens
attcttcctccctccctctttc

SEQ ID NO: 2224880 - DNA, 13 bp, Homo sapiens
attcttctccact

SEQ ID NO: 2224881 - DNA, 11 bp, Homo sapiens
attcttctgct

SEQ ID NO: 2224882 - DNA, 18 bp, Homo sapiens
attcttgaacttgaaaaa

SEQ ID NO: 2224883 - DNA, 14 bp, Homo sapiens
attcttgcaaagta

SEQ ID NO: 2224884 - DNA, 16 bp, Homo sapiens
attcttgcaaagtatc

SEQ ID NO: 2224885 - DNA, 22 bp, Homo sapiens
attctttcctgaggctgggctc

SEQ ID NO: 2224886 - DNA, 12 bp, Homo sapiens
attgaaatcttt

SEQ ID NO: 2224887 - DNA, 12 bp, Homo sapiens
attgcaccactg

SEQ ID NO: 2224888 - DNA, 23 bp, Homo sapiens
attgccatttcttccacaagagc

SEQ ID NO: 2224889 - DNA, 19 bp, Homo sapiens
attgcggacagccacggcc

SEQ ID NO: 2224890 - DNA, 23 bp, Homo sapiens
attgctgatggtgcaatgacctt

SEQ ID NO: 2224891 - DNA, 20 bp, Homo sapiens
attggctagaggttcaaaga

SEQ ID NO: 2224892 - DNA, 15 bp, Homo sapiens
attgtaaggaatgat

SEQ ID NO: 2224893 - DNA, 19 bp, Homo sapiens
attgtccccgacccttgcc

SEQ ID NO: 2224894 - DNA, 14 bp, Homo sapiens
attgtgtctcttgg

SEQ ID NO: 2224895 - DNA, 18 bp, Homo sapiens
attgttttcagtgtacat

SEQ ID NO: 2224896 - DNA, 13 bp, Homo sapiens
atttaaaagatac

SEQ ID NO: 2224897 - DNA, 12 bp, Homo sapiens
atttaacagaaa

SEQ ID NO: 2224898 - DNA, 14 bp, Homo sapiens
atttaacagaaatg

SEQ ID NO: 2224899 - DNA, 15 bp, Homo sapiens
atttaacagaaatgt

SEQ ID NO: 2224900 - DNA, 14 bp, Homo sapiens
atttaatgaaagac

SEQ ID NO: 2224901 - DNA, 19 bp, Homo sapiens
atttaatttttttgagaca

SEQ ID NO: 2224902 - DNA, 23 bp, Homo sapiens
atttaatttttttgagacagagt

SEQ ID NO: 2224903 - DNA, 22 bp, Homo sapiens
atttacaactgggggagggtga

SEQ ID NO: 2224904 - DNA, 22 bp, Homo sapiens
atttattaaatgcccagcccct

SEQ ID NO: 2224905 - DNA, 14 bp, Homo sapiens
atttattctgctca

SEQ ID NO: 2224906 - DNA, 17 bp, Homo sapiens
atttccagccaaagcct

SEQ ID NO: 2224907 - DNA, 16 bp, Homo sapiens
atttctgtttagataa

SEQ ID NO: 2224908 - DNA, 20 bp, Homo sapiens
atttctgtttagataataca

SEQ ID NO: 2224909 - DNA, 21 bp, Homo sapiens
atttctgtttagataatacac

SEQ ID NO: 2224910 - DNA, 23 bp, Homo sapiens
atttcttccacaagagcccaggc

SEQ ID NO: 2224911 - DNA, 20 bp, Homo sapiens
atttcttttgccgttattaa

SEQ ID NO: 2224912 - DNA, 14 bp, Homo sapiens
atttgaaaattttg

SEQ ID NO: 2224913 - DNA, 18 bp, Homo sapiens
atttgaggtctgttcttt

SEQ ID NO: 2224914 - DNA, 21 bp, Homo sapiens
atttggtggtttcagaaatgt

SEQ ID NO: 2224915 - DNA, 20 bp, Homo sapiens
atttgtgatacaatgctgtg

SEQ ID NO: 2224916 - DNA, 13 bp, Homo sapiens
atttgtttgaact

SEQ ID NO: 2224917 - DNA, 16 bp, Homo sapiens
atttgtttgaactgat

SEQ ID NO: 2224918 - DNA, 22 bp, Homo sapiens
atttgtttgaactgataaagat

SEQ ID NO: 2224919 - DNA, 14 bp, Homo sapiens
attttattatgcat

SEQ ID NO: 2224920 - DNA, 19 bp, Homo sapiens
attttccctattagagaag

SEQ ID NO: 2224921 - DNA, 16 bp, Homo sapiens
attttcctgccaggca

SEQ ID NO: 2224922 - DNA, 18 bp, Homo sapiens
attttgatccaagctggt

SEQ ID NO: 2224923 - DNA, 21 bp, Homo sapiens
attttgctgtcccttttcctt

SEQ ID NO: 2224924 - DNA, 12 bp, Homo sapiens
attttgctttgt

SEQ ID NO: 2224925 - DNA, 14 bp, Homo sapiens
attttggaaaataa

SEQ ID NO: 2224926 - DNA, 20 bp, Homo sapiens
attttggaaaataaattatt

SEQ ID NO: 2224927 - DNA, 23 bp, Homo sapiens
attttgtcatataagattcatat

SEQ ID NO: 2224928 - DNA, 19 bp, Homo sapiens
attttgtgcccccatgtaa

SEQ ID NO: 2224929 - DNA, 19 bp, Homo sapiens
atttttaagtgctgcattt

SEQ ID NO: 2224930 - DNA, 21 bp, Homo sapiens
atttttcttagggaaggatac

SEQ ID NO: 2224931 - DNA, 14 bp, Homo sapiens
atttttgtaaaaag

SEQ ID NO: 2224932 - DNA, 18 bp, Homo sapiens
atttttttactaatagac

SEQ ID NO: 2224933 - DNA, 20 bp, Homo sapiens
atttttttttccttcagtgc

SEQ ID NO: 2224934 - DNA, 23 bp, Homo sapiens
atttttttttccttcagtgcctt

SEQ ID NO: 2224935 - DNA, 16 bp, Homo sapiens
caaaactctcctctgc

SEQ ID NO: 2224936 - DNA, 20 bp, Homo sapiens
caaaactctcctctgctgct

SEQ ID NO: 2224937 - DNA, 21 bp, Homo sapiens
caaaactctcctctgctgctg

SEQ ID NO: 2224938 - DNA, 22 bp, Homo sapiens
caaaactctcctctgctgctgg

SEQ ID NO: 2224939 - DNA, 15 bp, Homo sapiens
caaaagctgggcagg

SEQ ID NO: 2224940 - DNA, 20 bp, Homo sapiens
caaaaggttaataaagtaat

SEQ ID NO: 2224941 - DNA, 14 bp, Homo sapiens
caaaagtttctctt

SEQ ID NO: 2224942 - DNA, 16 bp, Homo sapiens
caaaataaaacttttt

SEQ ID NO: 2224943 - DNA, 18 bp, Homo sapiens
caaaatgaaaaaaaaagg

SEQ ID NO: 2224944 - DNA, 19 bp, Homo sapiens
caaaatgaaaaaaaaaggg

SEQ ID NO: 2224945 - DNA, 11 bp, Homo sapiens
caaaatgaaac

SEQ ID NO: 2224946 - DNA, 22 bp, Homo sapiens
caaaatgaaacgcaaccaccac

SEQ ID NO: 2224947 - DNA, 15 bp, Homo sapiens
caaacacatacagga

SEQ ID NO: 2224948 - DNA, 15 bp, Homo sapiens
caaacagaggccgcc

SEQ ID NO: 2224949 - DNA, 16 bp, Homo sapiens
caaaccatcattgaaa

SEQ ID NO: 2224950 - DNA, 20 bp, Homo sapiens
caaacccttcagtgccaaaa

SEQ ID NO: 2224951 - DNA, 14 bp, Homo sapiens
caaagaggttttaa

SEQ ID NO: 2224952 - DNA, 22 bp, Homo sapiens
caaagatattttgctttgtgat

SEQ ID NO: 2224953 - DNA, 17 bp, Homo sapiens
caaagcagtgcatgctg

SEQ ID NO: 2224954 - DNA, 23 bp, Homo sapiens
cagacacaggcccggctccaggc

SEQ ID NO: 2224955 - DNA, 22 bp, Homo sapiens
cagacaccttgacagggcacac

SEQ ID NO: 2224956 - DNA, 20 bp, Homo sapiens
cagacaggcaagcacctcct

SEQ ID NO: 2224957 - DNA, 21 bp, Homo sapiens
cagacaggcaagcacctcctg

SEQ ID NO: 2224958 - DNA, 22 bp, Homo sapiens
cagacaggcaagcacctcctgc

SEQ ID NO: 2224959 - DNA, 20 bp, Homo sapiens
cagaccacaaaacttttcta

SEQ ID NO: 2224960 - DNA, 17 bp, Homo sapiens
cagactctacagaggcc

SEQ ID NO: 2224961 - DNA, 20 bp, Homo sapiens
cagactctacagaggccatg

SEQ ID NO: 2224962 - DNA, 17 bp, Homo sapiens
cagactggaagcacagc

SEQ ID NO: 2224963 - DNA, 18 bp, Homo sapiens
cagactggaagcacagct

SEQ ID NO: 2224964 - DNA, 21 bp, Homo sapiens
cagactggaagcacagcttca

SEQ ID NO: 2224965 - DNA, 19 bp, Homo sapiens
cagagaaagtacttctcca

SEQ ID NO: 2224966 - DNA, 13 bp, Homo sapiens
cagagaccatccc

SEQ ID NO: 2224967 - DNA, 14 bp, Homo sapiens
cagagaccatccct

SEQ ID NO: 2224968 - DNA, 16 bp, Homo sapiens
cagagaccatccctga

SEQ ID NO: 2224969 - DNA, 18 bp, Homo sapiens
cagagaccatccctgaag

SEQ ID NO: 2224970 - DNA, 16 bp, Homo sapiens
cagagactcctgcagg

SEQ ID NO: 2224971 - DNA, 18 bp, Homo sapiens
cagagactcctgcaggca

SEQ ID NO: 2224972 - DNA, 22 bp, Homo sapiens
cagagactcctgcaggcagcca

SEQ ID NO: 2224973 - DNA, 14 bp, Homo sapiens
cagagagagagaga

SEQ ID NO: 2224974 - DNA, 12 bp, Homo sapiens
cagagagggtgg

SEQ ID NO: 2224975 - DNA, 20 bp, Homo sapiens
cagagagggtgggagtgggc

SEQ ID NO: 2224976 - DNA, 22 bp, Homo sapiens
cagagagggtgggagtgggccc

SEQ ID NO: 2224977 - DNA, 23 bp, Homo sapiens
cagagagggtgggagtgggccca

SEQ ID NO: 2224978 - DNA, 17 bp, Homo sapiens
cagagagggtggtgacc

SEQ ID NO: 2224979 - DNA, 20 bp, Homo sapiens
cagagagggtggtgacctct

SEQ ID NO: 2224980 - DNA, 17 bp, Homo sapiens
cagagatgtgcccccac

SEQ ID NO: 2224981 - DNA, 16 bp, Homo sapiens
cagagcaccttagaca

SEQ ID NO: 2224982 - DNA, 19 bp, Homo sapiens
cagagcaccttagacagtc

SEQ ID NO: 2224983 - DNA, 22 bp, Homo sapiens
cagagcaccttagacagtccct

SEQ ID NO: 2224984 - DNA, 14 bp, Homo sapiens
cagagcagagacca

SEQ ID NO: 2224985 - DNA, 15 bp, Homo sapiens
cagagcagagaccat

SEQ ID NO: 2224986 - DNA, 19 bp, Homo sapiens
cagagcagagaccatccct

SEQ ID NO: 2224987 - DNA, 17 bp, Homo sapiens
cagagcccaccttggct

SEQ ID NO: 2224988 - DNA, 20 bp, Homo sapiens
cagagcccaccttggctcaa

SEQ ID NO: 2224989 - DNA, 23 bp, Homo sapiens
cagagcccacgcccccactggtg

SEQ ID NO: 2224990 - DNA, 12 bp, Homo sapiens
cagagcctgcag

SEQ ID NO: 2224991 - DNA, 13 bp, Homo sapiens
cagagcctgcagt

SEQ ID NO: 2224992 - DNA, 17 bp, Homo sapiens
cagagctacacagggga

SEQ ID NO: 2224993 - DNA, 20 bp, Homo sapiens
cagaggaaagcaaaggagat

SEQ ID NO: 2224994 - DNA, 13 bp, Homo sapiens
cagaggaaggaga

SEQ ID NO: 2224995 - DNA, 13 bp, Homo sapiens
cagaggagagagg

SEQ ID NO: 2224996 - DNA, 18 bp, Homo sapiens
cagaggcagccccattct

SEQ ID NO: 2224997 - DNA, 22 bp, Homo sapiens
cagaggcagccccattctgcct

SEQ ID NO: 2224998 - DNA, 23 bp, Homo sapiens
cagaggcagccccattctgcctg

SEQ ID NO: 2224999 - DNA, 19 bp, Homo sapiens
cagaggccatgggcctcct

SEQ ID NO: 2225000 - DNA, 14 bp, Homo sapiens
cagagggagtgaca

SEQ ID NO: 2225001 - DNA, 19 bp, Homo sapiens
cagagggagtgacagaggc

SEQ ID NO: 2225002 - DNA, 22 bp, Homo sapiens
cagagggggtggcctcccaact

SEQ ID NO: 2225003 - DNA, 22 bp, Homo sapiens
cagagtctcactgttgcccagg

SEQ ID NO: 2225004 - DNA, 23 bp, Homo sapiens
cagagtctcactgttgcccaggc

SEQ ID NO: 2225005 - DNA, 20 bp, Homo sapiens
cagagtgagactctgtctca

SEQ ID NO: 2225006 - DNA, 14 bp, Homo sapiens
cagagttgttacat

SEQ ID NO: 2225007 - DNA, 18 bp, Homo sapiens
cagagttgttacattttt

SEQ ID NO: 2225008 - DNA, 20 bp, Homo sapiens
cagatacaggaaaagctgct

SEQ ID NO: 2225009 - DNA, 19 bp, Homo sapiens
cagatagatatatgctctg

SEQ ID NO: 2225010 - DNA, 14 bp, Homo sapiens
cagatgcaccagcc

SEQ ID NO: 2225011 - DNA, 22 bp, Homo sapiens
cagatgcaccagcccttagcag

SEQ ID NO: 2225012 - DNA, 19 bp, Homo sapiens
cagattctttcctgaggct

SEQ ID NO: 2225013 - DNA, 19 bp, Homo sapiens
cagattgcaacaggctggg

SEQ ID NO: 2225014 - DNA, 19 bp, Homo sapiens
cagatttcactctccttgg

SEQ ID NO: 2225015 - DNA, 19 bp, Homo sapiens
cagcaagtgagagctgggt

SEQ ID NO: 2225016 - DNA, 13 bp, Homo sapiens
cagcaataaagca

SEQ ID NO: 2225017 - DNA, 19 bp, Homo sapiens
cagcacaggcagccccacg

SEQ ID NO: 2225018 - DNA, 15 bp, Homo sapiens
cagcacgatttctgt

SEQ ID NO: 2225019 - DNA, 19 bp, Homo sapiens
cagcacgatttctgtttag

SEQ ID NO: 2225020 - DNA, 20 bp, Homo sapiens
cagcacgatttctgtttaga

SEQ ID NO: 2225021 - DNA, 19 bp, Homo sapiens
cagcagaaatgccttaccc

SEQ ID NO: 2225022 - DNA, 13 bp, Homo sapiens
cagcagagcacct

SEQ ID NO: 2225023 - DNA, 19 bp, Homo sapiens
cagcagcctggaccctgtg

SEQ ID NO: 2225024 - DNA, 22 bp, Homo sapiens
cagcagcctggaccctgtggat

SEQ ID NO: 2225025 - DNA, 16 bp, Homo sapiens
cagcaggctctcaggc

SEQ ID NO: 2225026 - DNA, 17 bp, Homo sapiens
cagcaggctctcaggcc

SEQ ID NO: 2225027 - DNA, 18 bp, Homo sapiens
cagcagggagggcttctg

SEQ ID NO: 2225028 - DNA, 19 bp, Homo sapiens
cagcatattcaggaagctc

SEQ ID NO: 2225029 - DNA, 16 bp, Homo sapiens
cagcatcctggcaccc

SEQ ID NO: 2225030 - DNA, 17 bp, Homo sapiens
cagcatcctggcacccg

SEQ ID NO: 2225031 - DNA, 18 bp, Homo sapiens
cagccaaagcctcctcca

SEQ ID NO: 2225032 - DNA, 14 bp, Homo sapiens
cagccacattcctg

SEQ ID NO: 2225033 - DNA, 14 bp, Homo sapiens
cagccacggccagg

SEQ ID NO: 2225034 - DNA, 19 bp, Homo sapiens
cagccacggccaggccaga

SEQ ID NO: 2225035 - DNA, 23 bp, Homo sapiens
cagccacggccaggccagaggga

SEQ ID NO: 2225036 - DNA, 15 bp, Homo sapiens
cagcccacttctgcc

SEQ ID NO: 2225037 - DNA, 22 bp, Homo sapiens
cagccccaaaactctcctctgc

SEQ ID NO: 2225038 - DNA, 11 bp, Homo sapiens
cagccccatcc

SEQ ID NO: 2225039 - DNA, 16 bp, Homo sapiens
cagccccattctgcct

SEQ ID NO: 2225040 - DNA, 18 bp, Homo sapiens
cagccccattctgcctgc

SEQ ID NO: 2225041 - DNA, 19 bp, Homo sapiens
cagccccattctgcctgcc

SEQ ID NO: 2225042 - DNA, 20 bp, Homo sapiens
cagccccattctgcctgccc

SEQ ID NO: 2225043 - DNA, 18 bp, Homo sapiens
cagcccctggatgcagcc

SEQ ID NO: 2225044 - DNA, 19 bp, Homo sapiens
cagcccctggatgcagcct

SEQ ID NO: 2225045 - DNA, 22 bp, Homo sapiens
cagcccctggatgcagcctcac

SEQ ID NO: 2225046 - DNA, 20 bp, Homo sapiens
cagcccctgttctggcagag

SEQ ID NO: 2225047 - DNA, 21 bp, Homo sapiens
cagccccttctgacccatgct

SEQ ID NO: 2225048 - DNA, 13 bp, Homo sapiens
cagcccgggctct

SEQ ID NO: 2225049 - DNA, 14 bp, Homo sapiens
cagcccgggctctg

SEQ ID NO: 2225050 - DNA, 14 bp, Homo sapiens
cagccctgcagagg

SEQ ID NO: 2225051 - DNA, 16 bp, Homo sapiens
cagccctgcagagggc

SEQ ID NO: 2225052 - DNA, 20 bp, Homo sapiens
cagccctgcagagggcacag

SEQ ID NO: 2225053 - DNA, 21 bp, Homo sapiens
cagcccttagcagggaaacag

SEQ ID NO: 2225054 - DNA, 20 bp, Homo sapiens
cagccgagatagccaaggcc

SEQ ID NO: 2225055 - DNA, 23 bp, Homo sapiens
cagccgccatgctcctggcccac

SEQ ID NO: 2225056 - DNA, 17 bp, Homo sapiens
cagcctcaacctcctgg

SEQ ID NO: 2225057 - DNA, 19 bp, Homo sapiens
cagcctcaacctcctgggc

SEQ ID NO: 2225058 - DNA, 20 bp, Homo sapiens
cagcctcaacctcctgggct

SEQ ID NO: 2225059 - DNA, 21 bp, Homo sapiens
cagcctcaacctcctgggcta

SEQ ID NO: 2225060 - DNA, 15 bp, Homo sapiens
cagcctcacagtcct

SEQ ID NO: 2225061 - DNA, 23 bp, Homo sapiens
cagcctcccaaagtgctgggatt

SEQ ID NO: 2225062 - DNA, 17 bp, Homo sapiens
caccactacattctgtt

SEQ ID NO: 2225063 - DNA, 18 bp, Homo sapiens
caccactacattctgtta

SEQ ID NO: 2225064 - DNA, 19 bp, Homo sapiens
caccactacattctgttaa

SEQ ID NO: 2225065 - DNA, 17 bp, Homo sapiens
caccagagcccaccttg

SEQ ID NO: 2225066 - DNA, 16 bp, Homo sapiens
caccagccccagtgcc

SEQ ID NO: 2225067 - DNA, 17 bp, Homo sapiens
caccagccccagtgccc

SEQ ID NO: 2225068 - DNA, 22 bp, Homo sapiens
caccagccccagtgcccacagg

SEQ ID NO: 2225069 - DNA, 21 bp, Homo sapiens
caccatattaccacagacata

SEQ ID NO: 2225070 - DNA, 15 bp, Homo sapiens
caccatcatgtctgg

SEQ ID NO: 2225071 - DNA, 13 bp, Homo sapiens
cacccaagggcct

SEQ ID NO: 2225072 - DNA, 16 bp, Homo sapiens
cacccaagggcctggc

SEQ ID NO: 2225073 - DNA, 21 bp, Homo sapiens
cacccaagggcctggcctgag

SEQ ID NO: 2225074 - DNA, 20 bp, Homo sapiens
cacccaccatcatgtctggc

SEQ ID NO: 2225075 - DNA, 16 bp, Homo sapiens
cacccaggagccccga

SEQ ID NO: 2225076 - DNA, 23 bp, Homo sapiens
cacccaggagccccgaggccttc

SEQ ID NO: 2225077 - DNA, 24 bp, Homo sapiens
cacccaggagccccgaggccttct

SEQ ID NO: 2225078 - DNA, 11 bp, Homo sapiens
caccccaggct

SEQ ID NO: 2225079 - DNA, 18 bp, Homo sapiens
cacccccaccctcgacca

SEQ ID NO: 2225080 - DNA, 19 bp, Homo sapiens
caccccgcctgccctccca

SEQ ID NO: 2225081 - DNA, 14 bp, Homo sapiens
caccccggccacct

SEQ ID NO: 2225082 - DNA, 15 bp, Homo sapiens
caccccggccacctg

SEQ ID NO: 2225083 - DNA, 16 bp, Homo sapiens
caccccggccacctgc

SEQ ID NO: 2225084 - DNA, 12 bp, Homo sapiens
cacccggcccct

SEQ ID NO: 2225085 - DNA, 14 bp, Homo sapiens
cacccggcccctgc

SEQ ID NO: 2225086 - DNA, 16 bp, Homo sapiens
cacccggcccctgctg

SEQ ID NO: 2225087 - DNA, 15 bp, Homo sapiens
caccctggggagaaa

SEQ ID NO: 2225088 - DNA, 15 bp, Homo sapiens
caccctgtgatgggg

SEQ ID NO: 2225089 - DNA, 14 bp, Homo sapiens
caccggctggcctg

SEQ ID NO: 2225090 - DNA, 15 bp, Homo sapiens
caccggctggcctgg

SEQ ID NO: 2225091 - DNA, 20 bp, Homo sapiens
caccggctggcctggcccct

SEQ ID NO: 2225092 - DNA, 14 bp, Homo sapiens
caccgggcactcag

SEQ ID NO: 2225093 - DNA, 15 bp, Homo sapiens
caccgggcactcaga

SEQ ID NO: 2225094 - DNA, 15 bp, Homo sapiens
caccgggccacagag

SEQ ID NO: 2225095 - DNA, 14 bp, Homo sapiens
cacctcagcctccc

SEQ ID NO: 2225096 - DNA, 11 bp, Homo sapiens
cacctcctgcc

SEQ ID NO: 2225097 - DNA, 14 bp, Homo sapiens
cacctcctgcctcg

SEQ ID NO: 2225098 - DNA, 11 bp, Homo sapiens
cacctgccagg

SEQ ID NO: 2225099 - DNA, 13 bp, Homo sapiens
cacctgccaggga

SEQ ID NO: 2225100 - DNA, 16 bp, Homo sapiens
cacctgccagggacag

SEQ ID NO: 2225101 - DNA, 21 bp, Homo sapiens
cacctgcccctcaactctcct

SEQ ID NO: 2225102 - DNA, 18 bp, Homo sapiens
caccttagacagtccctg

SEQ ID NO: 2225103 - DNA, 23 bp, Homo sapiens
caccttagacagtccctgccaat

SEQ ID NO: 2225104 - DNA, 13 bp, Homo sapiens
caccttgacaggg

SEQ ID NO: 2225105 - DNA, 16 bp, Homo sapiens
caccttgacagggcac

SEQ ID NO: 2225106 - DNA, 13 bp, Homo sapiens
caccttggctcaa

SEQ ID NO: 2225107 - DNA, 15 bp, Homo sapiens
caccttggctcaagt

SEQ ID NO: 2225108 - DNA, 13 bp, Homo sapiens
caccttggctgca

SEQ ID NO: 2225109 - DNA, 18 bp, Homo sapiens
caccttggctgcagggag

SEQ ID NO: 2225110 - DNA, 14 bp, Homo sapiens
cacctttcccatct

SEQ ID NO: 2225111 - DNA, 16 bp, Homo sapiens
cacgaatattgctgat

SEQ ID NO: 2225112 - DNA, 22 bp, Homo sapiens
cacgaatattgctgatggtgca

SEQ ID NO: 2225113 - DNA, 16 bp, Homo sapiens
cacgactgcccggcag

SEQ ID NO: 2225114 - DNA, 12 bp, Homo sapiens
cacgatttctgt

SEQ ID NO: 2225115 - DNA, 13 bp, Homo sapiens
cacgcccccactg

SEQ ID NO: 2225116 - DNA, 18 bp, Homo sapiens
cacgcccccactggtgac

SEQ ID NO: 2225117 - DNA, 16 bp, Homo sapiens
cacgctggagtgcagt

SEQ ID NO: 2225118 - DNA, 18 bp, Homo sapiens
cacgctggagtgcagtga

SEQ ID NO: 2225119 - DNA, 21 bp, Homo sapiens
cacgctggagtgcagtgagcc

SEQ ID NO: 2225120 - DNA, 14 bp, Homo sapiens
cacggccaggccag

SEQ ID NO: 2225121 - DNA, 19 bp, Homo sapiens
cacgtacacacacatacac

SEQ ID NO: 2225122 - DNA, 12 bp, Homo sapiens
cacgtttctaaa

SEQ ID NO: 2225123 - DNA, 16 bp, Homo sapiens
cactacattctgttaa

SEQ ID NO: 2225124 - DNA, 21 bp, Homo sapiens
cactacattctgttaatcatt

SEQ ID NO: 2225125 - DNA, 14 bp, Homo sapiens
cactatagcctagg

SEQ ID NO: 2225126 - DNA, 21 bp, Homo sapiens
cactatagcctaggtgacaga

SEQ ID NO: 2225127 - DNA, 20 bp, Homo sapiens
cactatgttgcccaggcagg

SEQ ID NO: 2225128 - DNA, 19 bp, Homo sapiens
cactcacatttattctgct

SEQ ID NO: 2225129 - DNA, 20 bp, Homo sapiens
cactcacatttattctgctc

SEQ ID NO: 2225130 - DNA, 17 bp, Homo sapiens
cactcagaagacactga

SEQ ID NO: 2225131 - DNA, 16 bp, Homo sapiens
cactcagtccatagca

SEQ ID NO: 2225132 - DNA, 22 bp, Homo sapiens
cactcattgacctgaggccctt

SEQ ID NO: 2225133 - DNA, 13 bp, Homo sapiens
cactccagcctgg

SEQ ID NO: 2225134 - DNA, 12 bp, Homo sapiens
cactcccctgct

SEQ ID NO: 2225135 - DNA, 14 bp, Homo sapiens
cactcccctgctgg

SEQ ID NO: 2225136 - DNA, 14 bp, Homo sapiens
cactccttcacaga

SEQ ID NO: 2225137 - DNA, 12 bp, Homo sapiens
cactctccttgg

SEQ ID NO: 2225138 - DNA, 23 bp, Homo sapiens
cactctgagactcgcgacaatgc

SEQ ID NO: 2225139 - DNA, 12 bp, Homo sapiens
cactctggcagc

SEQ ID NO: 2225140 - DNA, 13 bp, Homo sapiens
cactctggcagct

SEQ ID NO: 2225141 - DNA, 14 bp, Homo sapiens
cactctggcagctc

SEQ ID NO: 2225142 - DNA, 16 bp, Homo sapiens
cactctggcagctcag

SEQ ID NO: 2225143 - DNA, 17 bp, Homo sapiens
cactctggggtgggagg

SEQ ID NO: 2225144 - DNA, 15 bp, Homo sapiens
cactctgtcgcccag

SEQ ID NO: 2225145 - DNA, 17 bp, Homo sapiens
cactcttattgcccacg

SEQ ID NO: 2225146 - DNA, 19 bp, Homo sapiens
cactcttattgcccacgct

SEQ ID NO: 2225147 - DNA, 23 bp, Homo sapiens
cactgacattgttggccaaagcc

SEQ ID NO: 2225148 - DNA, 14 bp, Homo sapiens
cactgagacagccc

SEQ ID NO: 2225149 - DNA, 13 bp, Homo sapiens
cactgcaacctcc

SEQ ID NO: 2225150 - DNA, 23 bp, Homo sapiens
cactgcaacctccgcctcttggg

SEQ ID NO: 2225151 - DNA, 19 bp, Homo sapiens
cactgcactccagcctggg

SEQ ID NO: 2225152 - DNA, 23 bp, Homo sapiens
cactgcagcctcaacctcctggg

SEQ ID NO: 2225153 - DNA, 17 bp, Homo sapiens
cactgccatgccagctt

SEQ ID NO: 2225154 - DNA, 12 bp, Homo sapiens
cactgctctggt

SEQ ID NO: 2225155 - DNA, 15 bp, Homo sapiens
cactgcttccagtga

SEQ ID NO: 2225156 - DNA, 21 bp, Homo sapiens
cactgcttccagtgaggctct

SEQ ID NO: 2225157 - DNA, 20 bp, Homo sapiens
cactgcttttggtctgtgtg

SEQ ID NO: 2225158 - DNA, 23 bp, Homo sapiens
cactgggcttggggaccagagct

SEQ ID NO: 2225159 - DNA, 17 bp, Homo sapiens
cactggtgacatgtctt

SEQ ID NO: 2225160 - DNA, 13 bp, Homo sapiens
cactgtgctgagt

SEQ ID NO: 2225161 - DNA, 15 bp, Homo sapiens
cactgtgctgagtct

SEQ ID NO: 2225162 - DNA, 17 bp, Homo sapiens
cactgtgctgagtctga

SEQ ID NO: 2225163 - DNA, 21 bp, Homo sapiens
cactgttctctgccctccaag

SEQ ID NO: 2225164 - DNA, 22 bp, Homo sapiens
cactgttctctgccctccaaga

SEQ ID NO: 2225165 - DNA, 14 bp, Homo sapiens
cactgttgcccagg

SEQ ID NO: 2225166 - DNA, 16 bp, Homo sapiens
cccaccttggctgcag

SEQ ID NO: 2225167 - DNA, 19 bp, Homo sapiens
cccaccttggctgcaggga

SEQ ID NO: 2225168 - DNA, 20 bp, Homo sapiens
cccaccttggctgcagggag

SEQ ID NO: 2225169 - DNA, 19 bp, Homo sapiens
cccacgcccccactggtga

SEQ ID NO: 2225170 - DNA, 19 bp, Homo sapiens
cccacgctggagtgcagtg

SEQ ID NO: 2225171 - DNA, 13 bp, Homo sapiens
cccacgtccctgc

SEQ ID NO: 2225172 - DNA, 14 bp, Homo sapiens
cccacgtccctgcg

SEQ ID NO: 2225173 - DNA, 19 bp, Homo sapiens
cccactgcttttggtctgt

SEQ ID NO: 2225174 - DNA, 23 bp, Homo sapiens
cccacttgagaattacccttttg

SEQ ID NO: 2225175 - DNA, 22 bp, Homo sapiens
cccagacccccttgcccaggcc

SEQ ID NO: 2225176 - DNA, 18 bp, Homo sapiens
cccagagggcctgcaagg

SEQ ID NO: 2225177 - DNA, 18 bp, Homo sapiens
cccagcaagtgagagctg

SEQ ID NO: 2225178 - DNA, 19 bp, Homo sapiens
cccagcaagtgagagctgg

SEQ ID NO: 2225179 - DNA, 23 bp, Homo sapiens
cccagcaagtgagagctgggtgt

SEQ ID NO: 2225180 - DNA, 13 bp, Homo sapiens
cccagccccaatg

SEQ ID NO: 2225181 - DNA, 17 bp, Homo sapiens
cccagccccaatgaaca

SEQ ID NO: 2225182 - DNA, 19 bp, Homo sapiens
cccagccccatcctctgta

SEQ ID NO: 2225183 - DNA, 18 bp, Homo sapiens
cccagcgagccctggtgg

SEQ ID NO: 2225184 - DNA, 12 bp, Homo sapiens
cccagctctggt

SEQ ID NO: 2225185 - DNA, 15 bp, Homo sapiens
cccagctctggtcca

SEQ ID NO: 2225186 - DNA, 23 bp, Homo sapiens
cccagctctggtccatagagagc

SEQ ID NO: 2225187 - DNA, 16 bp, Homo sapiens
ccagattgcaacaggc

SEQ ID NO: 2225188 - DNA, 21 bp, Homo sapiens
ccagattgcaacaggctgggc

SEQ ID NO: 2225189 - DNA, 19 bp, Homo sapiens
ccagatttcactctccttg

SEQ ID NO: 2225190 - DNA, 19 bp, Homo sapiens
ccagcaagtgagagctggg

SEQ ID NO: 2225191 - DNA, 21 bp, Homo sapiens
ccagcaagtgagagctgggtg

SEQ ID NO: 2225192 - DNA, 22 bp, Homo sapiens
ccagcaagtgagagctgggtgt

SEQ ID NO: 2225193 - DNA, 16 bp, Homo sapiens
ccagcacctaggtggg

SEQ ID NO: 2225194 - DNA, 22 bp, Homo sapiens
ccagcacctaggtggggcctgg

SEQ ID NO: 2225195 - DNA, 13 bp, Homo sapiens
ccagcagagcacc

SEQ ID NO: 2225196 - DNA, 11 bp, Homo sapiens
ccagcagcctg

SEQ ID NO: 2225197 - DNA, 19 bp, Homo sapiens
ccagcagcctggaccctgt

SEQ ID NO: 2225198 - DNA, 15 bp, Homo sapiens
ccagcaggctctcag

SEQ ID NO: 2225199 - DNA, 16 bp, Homo sapiens
ccagcaggctctcagg

SEQ ID NO: 2225200 - DNA, 20 bp, Homo sapiens
ccagcaggctctcaggccag

SEQ ID NO: 2225201 - DNA, 20 bp, Homo sapiens
cagcctcccgaatagctggg

SEQ ID NO: 2225202 - DNA, 19 bp, Homo sapiens
cagcctcccgagtagctgg

SEQ ID NO: 2225203 - DNA, 20 bp, Homo sapiens
cagcctgctccagctgttca

SEQ ID NO: 2225204 - DNA, 15 bp, Homo sapiens
cagcctggaccctgt

SEQ ID NO: 2225205 - DNA, 24 bp, Homo sapiens
cagccttgaccattctccacctgc

SEQ ID NO: 2225206 - DNA, 16 bp, Homo sapiens
cagcgagccctggtgg

SEQ ID NO: 2225207 - DNA, 19 bp, Homo sapiens
cagcgagccctggtggcag

SEQ ID NO: 2225208 - DNA, 21 bp, Homo sapiens
cagcgagccctggtggcagtg

SEQ ID NO: 2225209 - DNA, 14 bp, Homo sapiens
cagcggggacagct

SEQ ID NO: 2225210 - DNA, 16 bp, Homo sapiens
cagcggggacagctcc

SEQ ID NO: 2225211 - DNA, 20 bp, Homo sapiens
cagtaaatgggggtgcattt

SEQ ID NO: 2225212 - DNA, 13 bp, Homo sapiens
cagtaataactct

SEQ ID NO: 2225213 - DNA, 15 bp, Homo sapiens
cagtatctcagggcc

SEQ ID NO: 2225214 - DNA, 18 bp, Homo sapiens
cagtatcttgaagacttt

SEQ ID NO: 2225215 - DNA, 16 bp, Homo sapiens
cagtattacttctgct

SEQ ID NO: 2225216 - DNA, 19 bp, Homo sapiens
cagtattacttctgctaca

SEQ ID NO: 2225217 - DNA, 22 bp, Homo sapiens
cagtcaccccggccacctgcgg

SEQ ID NO: 2225218 - DNA, 16 bp, Homo sapiens
cagtccatagcagaga

SEQ ID NO: 2225219 - DNA, 13 bp, Homo sapiens
cagtccctgccaa

SEQ ID NO: 2225220 - DNA, 14 bp, Homo sapiens
cagtccctgccaat

SEQ ID NO: 2225221 - DNA, 16 bp, Homo sapiens
cagtcctcccatctca

SEQ ID NO: 2225222 - DNA, 17 bp, Homo sapiens
cagtcctcccatctcac

SEQ ID NO: 2225223 - DNA, 22 bp, Homo sapiens
cagtctgattcccaagctctgc

SEQ ID NO: 2225224 - DNA, 24 bp, Homo sapiens
cagtgagccgagattgcaccactg

SEQ ID NO: 2225225 - DNA, 12 bp, Homo sapiens
cagtgaggctct

SEQ ID NO: 2225226 - DNA, 14 bp, Homo sapiens
cagtgaggctctgc

SEQ ID NO: 2225227 - DNA, 16 bp, Homo sapiens
cagtgaggctctgccc

SEQ ID NO: 2225228 - DNA, 17 bp, Homo sapiens
cagtgaggctctgccct

SEQ ID NO: 2225229 - DNA, 18 bp, Homo sapiens
cagtgaggctctgccctt

SEQ ID NO: 2225230 - DNA, 18 bp, Homo sapiens
cagtgagtcgaggacagg

SEQ ID NO: 2225231 - DNA, 20 bp, Homo sapiens
cagtgagtcgaggacaggga

SEQ ID NO: 2225232 - DNA, 19 bp, Homo sapiens
cagtgcatgctgtccctta

SEQ ID NO: 2225233 - DNA, 23 bp, Homo sapiens
cagtgcatgctgtcccttacgtg

SEQ ID NO: 2225234 - DNA, 17 bp, Homo sapiens
cagtgcccacaggatca

SEQ ID NO: 2225235 - DNA, 15 bp, Homo sapiens
cagtgccttatggaa

SEQ ID NO: 2225236 - DNA, 17 bp, Homo sapiens
cagtgccttatggaaca

SEQ ID NO: 2225237 - DNA, 15 bp, Homo sapiens
cagtggcagctgctt

SEQ ID NO: 2225238 - DNA, 16 bp, Homo sapiens
cagtgggagctgcctg

SEQ ID NO: 2225239 - DNA, 17 bp, Homo sapiens
cagtgggagctgcctgt

SEQ ID NO: 2225240 - DNA, 20 bp, Homo sapiens
cagtgggagctgcctgttca

SEQ ID NO: 2225241 - DNA, 23 bp, Homo sapiens
cagtgggagctgcctgttcagct

SEQ ID NO: 2225242 - DNA, 13 bp, Homo sapiens
cagtggggctgga

SEQ ID NO: 2225243 - DNA, 19 bp, Homo sapiens
cagtggggctggaagcaga

SEQ ID NO: 2225244 - DNA, 21 bp, Homo sapiens
cagtggggctggaagcagaaa

SEQ ID NO: 2225245 - DNA, 18 bp, Homo sapiens
cagtggtggttttctgtt

SEQ ID NO: 2225246 - DNA, 16 bp, Homo sapiens
cagtgtacatggaata

SEQ ID NO: 2225247 - DNA, 23 bp, Homo sapiens
cagtgtacatggaataacatgta

SEQ ID NO: 2225248 - DNA, 14 bp, Homo sapiens
cagtgtgacaagga

SEQ ID NO: 2225249 - DNA, 13 bp, Homo sapiens
cagttctctcctt

SEQ ID NO: 2225250 - DNA, 18 bp, Homo sapiens
cagttgaaaaacagctga

SEQ ID NO: 2225251 - DNA, 16 bp, Homo sapiens
cagttgggtggatgcc

SEQ ID NO: 2225252 - DNA, 19 bp, Homo sapiens
cagttgggtggatgcctgg

SEQ ID NO: 2225253 - DNA, 18 bp, Homo sapiens
cagttgttagtgtgtctt

SEQ ID NO: 2225254 - DNA, 22 bp, Homo sapiens
cataaacaagaccacgtttcta

SEQ ID NO: 2225255 - DNA, 17 bp, Homo sapiens
catacgtacacatttta

SEQ ID NO: 2225256 - DNA, 20 bp, Homo sapiens
catactcccatctgtgaaag

SEQ ID NO: 2225257 - DNA, 11 bp, Homo sapiens
catactctgct

SEQ ID NO: 2225258 - DNA, 15 bp, Homo sapiens
catagtatggtggct

SEQ ID NO: 2225259 - DNA, 17 bp, Homo sapiens
catagtatggtggctgg

SEQ ID NO: 2225260 - DNA, 23 bp, Homo sapiens
catatatatgttttaagaggcag

SEQ ID NO: 2225261 - DNA, 20 bp, Homo sapiens
catatgcctgggcagaagga

SEQ ID NO: 2225262 - DNA, 22 bp, Homo sapiens
catattaccacagacatactaa

SEQ ID NO: 2225263 - DNA, 15 bp, Homo sapiens
catattcaggaagct

SEQ ID NO: 2225264 - DNA, 21 bp, Homo sapiens
catattgatttccgttaaaat

SEQ ID NO: 2225265 - DNA, 14 bp, Homo sapiens
catatttacttctt

SEQ ID NO: 2225266 - DNA, 16 bp, Homo sapiens
catatttacttcttat

SEQ ID NO: 2225267 - DNA, 12 bp, Homo sapiens
catcacttccct

SEQ ID NO: 2225268 - DNA, 17 bp, Homo sapiens
catcagcacgatttctg

SEQ ID NO: 2225269 - DNA, 19 bp, Homo sapiens
catcaggccaggccctctg

SEQ ID NO: 2225270 - DNA, 20 bp, Homo sapiens
catcaggccaggccctctgc

SEQ ID NO: 2225271 - DNA, 21 bp, Homo sapiens
catcaggccaggccctctgcc

SEQ ID NO: 2225272 - DNA, 14 bp, Homo sapiens
catcatgtctggct

SEQ ID NO: 2225273 - DNA, 20 bp, Homo sapiens
catcattgaaatctttttgc

SEQ ID NO: 2225274 - DNA, 13 bp, Homo sapiens
catcccagcccca

SEQ ID NO: 2225275 - DNA, 14 bp, Homo sapiens
catcccagccccaa

SEQ ID NO: 2225276 - DNA, 14 bp, Homo sapiens
catcccctgtagag

SEQ ID NO: 2225277 - DNA, 13 bp, Homo sapiens
catccctgaaggc

SEQ ID NO: 2225278 - DNA, 18 bp, Homo sapiens
catccctgaaggccccgc

SEQ ID NO: 2225279 - DNA, 18 bp, Homo sapiens
catcctcatacccacccc

SEQ ID NO: 2225280 - DNA, 22 bp, Homo sapiens
catcctcatacccacccccacc

SEQ ID NO: 2225281 - DNA, 12 bp, Homo sapiens
catcctcctcag

SEQ ID NO: 2225282 - DNA, 18 bp, Homo sapiens
catcctcctcagatcttc

SEQ ID NO: 2225283 - DNA, 19 bp, Homo sapiens
catcctcctgcccccaccc

SEQ ID NO: 2225284 - DNA, 22 bp, Homo sapiens
catcctcctgcccccaccccag

SEQ ID NO: 2225285 - DNA, 15 bp, Homo sapiens
catctctcctccttt

SEQ ID NO: 2225286 - DNA, 19 bp, Homo sapiens
catctgtgaaaggaaagag

SEQ ID NO: 2225287 - DNA, 21 bp, Homo sapiens
catcttaggttggcaaaaagg

SEQ ID NO: 2225288 - DNA, 21 bp, Homo sapiens
catcttgaattgtaaggaatg

SEQ ID NO: 2225289 - DNA, 14 bp, Homo sapiens
catcttgctctgct

SEQ ID NO: 2225290 - DNA, 14 bp, Homo sapiens
catgaaaacacatt

SEQ ID NO: 2225291 - DNA, 15 bp, Homo sapiens
catgaaaacacattt

SEQ ID NO: 2225292 - DNA, 16 bp, Homo sapiens
catgaaaacacatttt

SEQ ID NO: 2225293 - DNA, 17 bp, Homo sapiens
catgaaaacacattttt

SEQ ID NO: 2225294 - DNA, 23 bp, Homo sapiens
catgaagtaatatgcacacattt

SEQ ID NO: 2225295 - DNA, 13 bp, Homo sapiens
catgacaaagact

SEQ ID NO: 2225296 - DNA, 21 bp, Homo sapiens
catgacacgaatattgctgat

SEQ ID NO: 2225297 - DNA, 23 bp, Homo sapiens
catgacacgaatattgctgatgg

SEQ ID NO: 2225298 - DNA, 20 bp, Homo sapiens
catgagcatcaggccaggcc

SEQ ID NO: 2225299 - DNA, 17 bp, Homo sapiens
catgagcctcagcatcc

SEQ ID NO: 2225300 - DNA, 18 bp, Homo sapiens
catgagcctcagcatcct

SEQ ID NO: 2225301 - DNA, 19 bp, Homo sapiens
catgagcctcagcatcctg

SEQ ID NO: 2225302 - DNA, 22 bp, Homo sapiens
catgagcctcagcatcctggca

SEQ ID NO: 2225303 - DNA, 16 bp, Homo sapiens
catgaggaacaaggca

SEQ ID NO: 2225304 - DNA, 23 bp, Homo sapiens
catgaggaacaaggcaaggctgt

SEQ ID NO: 2225305 - DNA, 15 bp, Homo sapiens
catgagtcccctgtt

SEQ ID NO: 2225306 - DNA, 13 bp, Homo sapiens
catgatgttttcc

SEQ ID NO: 2225307 - DNA, 24 bp, Homo sapiens
catgattaaccacttcagctgact

SEQ ID NO: 2225308 - DNA, 15 bp, Homo sapiens
catgcaaggtcattt

SEQ ID NO: 2225309 - DNA, 19 bp, Homo sapiens
catgcctctctcaggccaa

SEQ ID NO: 2225310 - DNA, 18 bp, Homo sapiens
catgcctggatggggctg

SEQ ID NO: 2225311 - DNA, 14 bp, Homo sapiens
catgctacacactg

SEQ ID NO: 2225312 - DNA, 13 bp, Homo sapiens
catgctcctggcc

SEQ ID NO: 2225313 - DNA, 17 bp, Homo sapiens
catgctcctggcccact

SEQ ID NO: 2225314 - DNA, 15 bp, Homo sapiens
catgctgccctgtga

SEQ ID NO: 2225315 - DNA, 16 bp, Homo sapiens
catgctgccctgtgag

SEQ ID NO: 2225316 - DNA, 11 bp, Homo sapiens
catggactttg

SEQ ID NO: 2225317 - DNA, 16 bp, Homo sapiens
catggagtatatgtca

SEQ ID NO: 2225318 - DNA, 18 bp, Homo sapiens
catgggaaaggggaagtt

SEQ ID NO: 2225319 - DNA, 14 bp, Homo sapiens
catgggaatgaatg

SEQ ID NO: 2225320 - DNA, 22 bp, Homo sapiens
catgggaatgaatgtcagtgtg

SEQ ID NO: 2225321 - DNA, 23 bp, Homo sapiens
catggtcggaaaacatgctacac

SEQ ID NO: 2225322 - DNA, 23 bp, Homo sapiens
catggtgaaggtttttgtttctt

SEQ ID NO: 2225323 - DNA, 16 bp, Homo sapiens
catgtccaagaagccc

SEQ ID NO: 2225324 - DNA, 16 bp, Homo sapiens
catgtgatgagaggaa

SEQ ID NO: 2225325 - DNA, 18 bp, Homo sapiens
catgtgatgagaggaaat

SEQ ID NO: 2225326 - DNA, 21 bp, Homo sapiens
catgttacataagataaatgt

SEQ ID NO: 2225327 - DNA, 15 bp, Homo sapiens
catgttctctgagga

SEQ ID NO: 2225328 - DNA, 13 bp, Homo sapiens
catgttcttaatt

SEQ ID NO: 2225329 - DNA, 16 bp, Homo sapiens
catgttcttaattctt

SEQ ID NO: 2225330 - DNA, 12 bp, Homo sapiens
catgttggccag

SEQ ID NO: 2225331 - DNA, 15 bp, Homo sapiens
catgttggccaggct

SEQ ID NO: 2225332 - DNA, 17 bp, Homo sapiens
catgttggccaggctgg

SEQ ID NO: 2225333 - DNA, 18 bp, Homo sapiens
catgtttttcttctccct

SEQ ID NO: 2225334 - DNA, 12 bp, Homo sapiens
cattatctagat

SEQ ID NO: 2225335 - DNA, 17 bp, Homo sapiens
cattatctagatactgt

SEQ ID NO: 2225336 - DNA, 18 bp, Homo sapiens
cattatctagatactgta

SEQ ID NO: 2225337 - DNA, 23 bp, Homo sapiens
cattatctagatactgtatcatg

SEQ ID NO: 2225338 - DNA, 14 bp, Homo sapiens
tcatccttctggaa

SEQ ID NO: 2225339 - DNA, 22 bp, Homo sapiens
tcatggtgaaggtttttgtttc

SEQ ID NO: 2225340 - DNA, 13 bp, Homo sapiens
tcatgtctggcta

SEQ ID NO: 2225341 - DNA, 11 bp, Homo sapiens
tcatgttctta

SEQ ID NO: 2225342 - DNA, 21 bp, Homo sapiens
tcattaggtgtgactgaattt

SEQ ID NO: 2225343 - DNA, 22 bp, Homo sapiens
tcattaggtgtgactgaatttc

SEQ ID NO: 2225344 - DNA, 13 bp, Homo sapiens
tcattgaaatctt

SEQ ID NO: 2225345 - DNA, 16 bp, Homo sapiens
tcatttcctgtgtctt

SEQ ID NO: 2225346 - DNA, 19 bp, Homo sapiens
tcatttgagcagggctcag

SEQ ID NO: 2225347 - DNA, 14 bp, Homo sapiens
tccaaagtacactg

SEQ ID NO: 2225348 - DNA, 14 bp, Homo sapiens
tccaaccctcatca

SEQ ID NO: 2225349 - DNA, 23 bp, Homo sapiens
tccaaccctcatcaccaacgtct

SEQ ID NO: 2225350 - DNA, 15 bp, Homo sapiens
tccaagaagcccagg

SEQ ID NO: 2225351 - DNA, 19 bp, Homo sapiens
tccaagaccttctccttca

SEQ ID NO: 2225352 - DNA, 22 bp, Homo sapiens
tccaagcaggacatggacaagg

SEQ ID NO: 2225353 - DNA, 16 bp, Homo sapiens
tccaagctggtcccac

SEQ ID NO: 2225354 - DNA, 15 bp, Homo sapiens
tccacaagagcccag

SEQ ID NO: 2225355 - DNA, 19 bp, Homo sapiens
tccacaagagcccaggcct

SEQ ID NO: 2225356 - DNA, 21 bp, Homo sapiens
tccacaagagcccaggcctcc

SEQ ID NO: 2225357 - DNA, 21 bp, Homo sapiens
tccaccctgctctccgaccag

SEQ ID NO: 2225358 - DNA, 17 bp, Homo sapiens
tccacctgccagggaca

SEQ ID NO: 2225359 - DNA, 22 bp, Homo sapiens
tccactgtgccatgtgccaggt

SEQ ID NO: 2225360 - DNA, 21 bp, Homo sapiens
tccactttctagccagaggag

SEQ ID NO: 2225361 - DNA, 17 bp, Homo sapiens
tccagcccctggatgca

SEQ ID NO: 2225362 - DNA, 21 bp, Homo sapiens
tccagcccctggatgcagcct

SEQ ID NO: 2225363 - DNA, 22 bp, Homo sapiens
tccagcccctggatgcagcctc

SEQ ID NO: 2225364 - DNA, 16 bp, Homo sapiens
tccagctcaccagccc

SEQ ID NO: 2225365 - DNA, 18 bp, Homo sapiens
tccagctcaccagcccca

SEQ ID NO: 2225366 - DNA, 15 bp, Homo sapiens
tccaggagcagccac

SEQ ID NO: 2225367 - DNA, 18 bp, Homo sapiens
tccaggagcagccacatt

SEQ ID NO: 2225368 - DNA, 21 bp, Homo sapiens
tccaggctgggagagccttcc

SEQ ID NO: 2225369 - DNA, 23 bp, Homo sapiens
tccaggctgggagagccttccag

SEQ ID NO: 2225370 - DNA, 22 bp, Homo sapiens
tccaggggtgggacaccctgtg

SEQ ID NO: 2225371 - DNA, 18 bp, Homo sapiens
tccaggtttaagctgtta

SEQ ID NO: 2225372 - DNA, 18 bp, Homo sapiens
tccagtatcttgaagact

SEQ ID NO: 2225373 - DNA, 18 bp, Homo sapiens
tccagtgaggctctgccc

SEQ ID NO: 2225374 - DNA, 20 bp, Homo sapiens
tccagtgaggctctgccctt

SEQ ID NO: 2225375 - DNA, 15 bp, Homo sapiens
tccatgagtcccctg

SEQ ID NO: 2225376 - DNA, 17 bp, Homo sapiens
tccatgagtcccctgtt

SEQ ID NO: 2225377 - DNA, 14 bp, Homo sapiens
tccatggactttgt

SEQ ID NO: 2225378 - DNA, 17 bp, Homo sapiens
tcccaaagcagtgcatg

SEQ ID NO: 2225379 - DNA, 13 bp, Homo sapiens
tcccaaagtgctg

SEQ ID NO: 2225380 - DNA, 15 bp, Homo sapiens
tcccaaagtgctggg

SEQ ID NO: 2225381 - DNA, 16 bp, Homo sapiens
tcccaactcaccccag

SEQ ID NO: 2225382 - DNA, 21 bp, Homo sapiens
tcccaactcaccccagcccca

SEQ ID NO: 2225383 - DNA, 14 bp, Homo sapiens
tcccacaaaggaga

SEQ ID NO: 2225384 - DNA, 15 bp, Homo sapiens
tcccaccccacacac

SEQ ID NO: 2225385 - DNA, 12 bp, Homo sapiens
tcccaccccctc

SEQ ID NO: 2225386 - DNA, 14 bp, Homo sapiens
tcccaccccctccc

SEQ ID NO: 2225387 - DNA, 21 bp, Homo sapiens
tcccaccccctccccgggcag

SEQ ID NO: 2225388 - DNA, 22 bp, Homo sapiens
tcccaccccctccccgggcagc

SEQ ID NO: 2225389 - DNA, 14 bp, Homo sapiens
tcccacctcagcct

SEQ ID NO: 2225390 - DNA, 18 bp, Homo sapiens
tcccacctctctcactcc

SEQ ID NO: 2225391 - DNA, 13 bp, Homo sapiens
tcccaccttggct

SEQ ID NO: 2225392 - DNA, 16 bp, Homo sapiens
tcccagatacttgggg

SEQ ID NO: 2225393 - DNA, 20 bp, Homo sapiens
tcccagctgtgctctggaca

SEQ ID NO: 2225394 - DNA, 22 bp, Homo sapiens
tcccagctgtgctctggacagg

SEQ ID NO: 2225395 - DNA, 23 bp, Homo sapiens
tcccaggcattccccaggaggcc

SEQ ID NO: 2225396 - DNA, 22 bp, Homo sapiens
tcccagtgccgagaaggaagcc

SEQ ID NO: 2225397 - DNA, 14 bp, Homo sapiens
tcccatctcacaca

SEQ ID NO: 2225398 - DNA, 15 bp, Homo sapiens
tcccatcttccaagg

SEQ ID NO: 2225399 - DNA, 16 bp, Homo sapiens
tccccaccgcagacag

SEQ ID NO: 2225400 - DNA, 24 bp, Homo sapiens
tccccaccgcagacaggaccaggg

SEQ ID NO: 2225401 - DNA, 18 bp, Homo sapiens
tccccagattgcaacagg

SEQ ID NO: 2225402 - DNA, 19 bp, Homo sapiens
tccccagattgcaacaggc

SEQ ID NO: 2225403 - DNA, 22 bp, Homo sapiens
tccccagattgcaacaggctgg

SEQ ID NO: 2225404 - DNA, 23 bp, Homo sapiens
tccccagattgcaacaggctggg

SEQ ID NO: 2225405 - DNA, 22 bp, Homo sapiens
tccccagcaagtgagagctggg

SEQ ID NO: 2225406 - DNA, 21 bp, Homo sapiens
tcaagtgattctcctgcctca

SEQ ID NO: 2225407 - DNA, 14 bp, Homo sapiens
tcaataggaaaaac

SEQ ID NO: 2225408 - DNA, 17 bp, Homo sapiens
tcaataggaaaaactga

SEQ ID NO: 2225409 - DNA, 22 bp, Homo sapiens
tcaataggaaaaactgattttt

SEQ ID NO: 2225410 - DNA, 14 bp, Homo sapiens
tcaatgcactgaca

SEQ ID NO: 2225411 - DNA, 15 bp, Homo sapiens
tcacacactttggct

SEQ ID NO: 2225412 - DNA, 21 bp, Homo sapiens
tcacacatgagcatcaggcca

SEQ ID NO: 2225413 - DNA, 22 bp, Homo sapiens
tcacacatgagcatcaggccag

SEQ ID NO: 2225414 - DNA, 15 bp, Homo sapiens
tcacagatgggtgct

SEQ ID NO: 2225415 - DNA, 13 bp, Homo sapiens
tcacagcctctga

SEQ ID NO: 2225416 - DNA, 19 bp, Homo sapiens
tcacagtccttaccagcag

SEQ ID NO: 2225417 - DNA, 18 bp, Homo sapiens
tcacatattgatttccgt

SEQ ID NO: 2225418 - DNA, 18 bp, Homo sapiens
tcacatttattctgctca

SEQ ID NO: 2225419 - DNA, 19 bp, Homo sapiens
tcacatttattctgctcac

SEQ ID NO: 2225420 - DNA, 20 bp, Homo sapiens
tcaccaaatcagctgctact

SEQ ID NO: 2225421 - DNA, 16 bp, Homo sapiens
tcaccacatgtgcaca

SEQ ID NO: 2225422 - DNA, 20 bp, Homo sapiens
tcaccccagccccaaaactc

SEQ ID NO: 2225423 - DNA, 15 bp, Homo sapiens
tcaccccggccacct

SEQ ID NO: 2225424 - DNA, 19 bp, Homo sapiens
tcacccgctaagagggagg

SEQ ID NO: 2225425 - DNA, 15 bp, Homo sapiens
tcaccgaaaacgtgg

SEQ ID NO: 2225426 - DNA, 21 bp, Homo sapiens
tcaccgaaaacgtggctgctt

SEQ ID NO: 2225427 - DNA, 22 bp, Homo sapiens
tcaccgaaaacgtggctgcttc

SEQ ID NO: 2225428 - DNA, 23 bp, Homo sapiens
tcaccgaaaacgtggctgcttca

SEQ ID NO: 2225429 - DNA, 23 bp, Homo sapiens
tcacctgaagactcattcttctg

SEQ ID NO: 2225430 - DNA, 13 bp, Homo sapiens
tcacctgcccctc

SEQ ID NO: 2225431 - DNA, 12 bp, Homo sapiens
tcacctttgtcc

SEQ ID NO: 2225432 - DNA, 14 bp, Homo sapiens
tcacctttgtcccc

SEQ ID NO: 2225433 - DNA, 15 bp, Homo sapiens
tcacctttgtcccca

SEQ ID NO: 2225434 - DNA, 14 bp, Homo sapiens
tcacgccactgcac

SEQ ID NO: 2225435 - DNA, 16 bp, Homo sapiens
tcacgccactgcacta

SEQ ID NO: 2225436 - DNA, 19 bp, Homo sapiens
tcacgcctgtaatcctagc

SEQ ID NO: 2225437 - DNA, 20 bp, Homo sapiens
tcacgcctgtaatcctagca

SEQ ID NO: 2225438 - DNA, 14 bp, Homo sapiens
tcacggaagagcct

SEQ ID NO: 2225439 - DNA, 15 bp, Homo sapiens
tcacggctcactgca

SEQ ID NO: 2225440 - DNA, 20 bp, Homo sapiens
tcacggctcactgcagcctc

SEQ ID NO: 2225441 - DNA, 13 bp, Homo sapiens
tcactccttgaaa

SEQ ID NO: 2225442 - DNA, 12 bp, Homo sapiens
tcactctccttg

SEQ ID NO: 2225443 - DNA, 16 bp, Homo sapiens
tcactctggcagctca

SEQ ID NO: 2225444 - DNA, 20 bp, Homo sapiens
tcactctggcagctcagaga

SEQ ID NO: 2225445 - DNA, 22 bp, Homo sapiens
tcactctggcagctcagagagg

SEQ ID NO: 2225446 - DNA, 16 bp, Homo sapiens
tcactctgtcgcccag

SEQ ID NO: 2225447 - DNA, 17 bp, Homo sapiens
tcactcttattgcccac

SEQ ID NO: 2225448 - DNA, 20 bp, Homo sapiens
tcactcttattgcccacgct

SEQ ID NO: 2225449 - DNA, 21 bp, Homo sapiens
tcactcttattgcccacgctg

SEQ ID NO: 2225450 - DNA, 23 bp, Homo sapiens
tcactcttattgcccacgctgga

SEQ ID NO: 2225451 - DNA, 15 bp, Homo sapiens
tcactgagacagccc

SEQ ID NO: 2225452 - DNA, 23 bp, Homo sapiens
tcactgagacagcccgggctctg

SEQ ID NO: 2225453 - DNA, 15 bp, Homo sapiens
tcactgcagcctcaa

SEQ ID NO: 2225454 - DNA, 18 bp, Homo sapiens
tcactgccatgccagctt

SEQ ID NO: 2225455 - DNA, 15 bp, Homo sapiens
tcactgcttaacttc

SEQ ID NO: 2225456 - DNA, 17 bp, Homo sapiens
tcactgcttaacttcac

SEQ ID NO: 2225457 - DNA, 14 bp, Homo sapiens
tcactgttgcccag

SEQ ID NO: 2225458 - DNA, 16 bp, Homo sapiens
tcactgttgcccaggc

SEQ ID NO: 2225459 - DNA, 19 bp, Homo sapiens
tcactgttgcccaggctgg

SEQ ID NO: 2225460 - DNA, 10 bp, Homo sapiens
tcacttgagt

SEQ ID NO: 2225461 - DNA, 13 bp, Homo sapiens
tcagaagacactg

SEQ ID NO: 2225462 - DNA, 19 bp, Homo sapiens
tcagaagtttctgccgcag

SEQ ID NO: 2225463 - DNA, 23 bp, Homo sapiens
tcagaagtttctgccgcagccct

SEQ ID NO: 2225464 - DNA, 12 bp, Homo sapiens
tcagaattctca

SEQ ID NO: 2225465 - DNA, 17 bp, Homo sapiens
tcagacagctgcctggg

SEQ ID NO: 2225466 - DNA, 20 bp, Homo sapiens
tcagacagctgcctgggatc

SEQ ID NO: 2225467 - DNA, 16 bp, Homo sapiens
tcagagagggtgggag

SEQ ID NO: 2225468 - DNA, 21 bp, Homo sapiens
tcagagagggtgggagtgggc

SEQ ID NO: 2225469 - DNA, 14 bp, Homo sapiens
tcagagcctgcagt

SEQ ID NO: 2225470 - DNA, 16 bp, Homo sapiens
tcagatctctaacttc

SEQ ID NO: 2225471 - DNA, 15 bp, Homo sapiens
tcagcatcctggcac

SEQ ID NO: 2225472 - DNA, 16 bp, Homo sapiens
tcagcatcctggcacc

SEQ ID NO: 2225473 - DNA, 23 bp, Homo sapiens
tcagccgtgtaaccatggaccca

SEQ ID NO: 2225474 - DNA, 18 bp, Homo sapiens
tcagcctcccgagtagct

SEQ ID NO: 2225475 - DNA, 16 bp, Homo sapiens
tcagcctgctccagct

SEQ ID NO: 2225476 - DNA, 12 bp, Homo sapiens
tcagcctgggca

SEQ ID NO: 2225477 - DNA, 14 bp, Homo sapiens
tcagcggggacagc

SEQ ID NO: 2225478 - DNA, 18 bp, Homo sapiens
tcagcggggacagctcct

SEQ ID NO: 2225479 - DNA, 13 bp, Homo sapiens
tcctctgtacaga

SEQ ID NO: 2225480 - DNA, 16 bp, Homo sapiens
tcctctgtacagagcc

SEQ ID NO: 2225481 - DNA, 17 bp, Homo sapiens
tcctctgtacagagccc

SEQ ID NO: 2225482 - DNA, 11 bp, Homo sapiens
tcctctttcca

SEQ ID NO: 2225483 - DNA, 21 bp, Homo sapiens
tcctctttggtctacactgtg

SEQ ID NO: 2225484 - DNA, 13 bp, Homo sapiens
tcctgagccagat

SEQ ID NO: 2225485 - DNA, 15 bp, Homo sapiens
tcctgaggctgggct

SEQ ID NO: 2225486 - DNA, 12 bp, Homo sapiens
tcctgcaggcag

SEQ ID NO: 2225487 - DNA, 20 bp, Homo sapiens
tcctgcaggcagccaggcca

SEQ ID NO: 2225488 - DNA, 14 bp, Homo sapiens
tcctgcccccaccc

SEQ ID NO: 2225489 - DNA, 19 bp, Homo sapiens
tcctgcccccaccccaggc

SEQ ID NO: 2225490 - DNA, 14 bp, Homo sapiens
tcctgcctcagcct

SEQ ID NO: 2225491 - DNA, 15 bp, Homo sapiens
tcctgcctcagcctc

SEQ ID NO: 2225492 - DNA, 16 bp, Homo sapiens
tcctgcctcagcctcc

SEQ ID NO: 2225493 - DNA, 19 bp, Homo sapiens
tcctgcctcagcctcccaa

SEQ ID NO: 2225494 - DNA, 19 bp, Homo sapiens
tcctggcacccggcccctg

SEQ ID NO: 2225495 - DNA, 20 bp, Homo sapiens
tcctggcacccggcccctgc

SEQ ID NO: 2225496 - DNA, 18 bp, Homo sapiens
tcctggcactgcttccag

SEQ ID NO: 2225497 - DNA, 22 bp, Homo sapiens
tcctggcatgggaatgaatgtc

SEQ ID NO: 2225498 - DNA, 17 bp, Homo sapiens
tcctggcccactgcatc

SEQ ID NO: 2225499 - DNA, 20 bp, Homo sapiens
tcctgtacctcttgagcctt

SEQ ID NO: 2225500 - DNA, 23 bp, Homo sapiens
tcctgtgtcttgcaatggcagcc

SEQ ID NO: 2225501 - DNA, 16 bp, Homo sapiens
tccttaccagcagagc

SEQ ID NO: 2225502 - DNA, 18 bp, Homo sapiens
tccttcacagatgggtgc

SEQ ID NO: 2225503 - DNA, 21 bp, Homo sapiens
tccttcacctttgtccccacc

SEQ ID NO: 2225504 - DNA, 12 bp, Homo sapiens
tccttcagtgcc

SEQ ID NO: 2225505 - DNA, 14 bp, Homo sapiens
tccttcagtgcctt

SEQ ID NO: 2225506 - DNA, 16 bp, Homo sapiens
tccttcagtgccttat

SEQ ID NO: 2225507 - DNA, 17 bp, Homo sapiens
tccttcagtgccttatg

SEQ ID NO: 2225508 - DNA, 18 bp, Homo sapiens
tccttggtgtcgggcatg

SEQ ID NO: 2225509 - DNA, 23 bp, Homo sapiens
tccttgtgttactaagtttttat

SEQ ID NO: 2225510 - DNA, 22 bp, Homo sapiens
tcctttagcgcccagttgggtg

SEQ ID NO: 2225511 - DNA, 22 bp, Homo sapiens
tcctttgtgaggaagccgctgg

SEQ ID NO: 2225512 - DNA, 15 bp, Homo sapiens
tcgagcatgcctgga

SEQ ID NO: 2225513 - DNA, 21 bp, Homo sapiens
tcgcaggattcttcctccctc

SEQ ID NO: 2225514 - DNA, 18 bp, Homo sapiens
tcggaaaacatgctacac

SEQ ID NO: 2225515 - DNA, 18 bp, Homo sapiens
tctaaaggctacctttgt

SEQ ID NO: 2225516 - DNA, 15 bp, Homo sapiens
tctaacttcaccata

SEQ ID NO: 2225517 - DNA, 12 bp, Homo sapiens
tctacactgtgc

SEQ ID NO: 2225518 - DNA, 14 bp, Homo sapiens
tctacactgtgctg

SEQ ID NO: 2225519 - DNA, 21 bp, Homo sapiens
tctacagaggccatgggcctc

SEQ ID NO: 2225520 - DNA, 21 bp, Homo sapiens
tctaccctcttagaaaaacca

SEQ ID NO: 2225521 - DNA, 14 bp, Homo sapiens
tctaccctggcact

SEQ ID NO: 2225522 - DNA, 18 bp, Homo sapiens
tctactctagggaaaaac

SEQ ID NO: 2225523 - DNA, 24 bp, Homo sapiens
tctagatactgtatcatgacaaag

SEQ ID NO: 2225524 - DNA, 22 bp, Homo sapiens
tctagttgtttgattcagacag

SEQ ID NO: 2225525 - DNA, 22 bp, Homo sapiens
tctagtttgattaaattcttgc

SEQ ID NO: 2225526 - DNA, 21 bp, Homo sapiens
tctatcaagtattataccttt

SEQ ID NO: 2225527 - DNA, 23 bp, Homo sapiens
tctatgggactcaatgcactgac

SEQ ID NO: 2225528 - DNA, 16 bp, Homo sapiens
tctattgtttctttca

SEQ ID NO: 2225529 - DNA, 15 bp, Homo sapiens
tctatttttgtaaaa

SEQ ID NO: 2225530 - DNA, 13 bp, Homo sapiens
tctcaaactcttg

SEQ ID NO: 2225531 - DNA, 21 bp, Homo sapiens
tctcaaactcttgacctcagg

SEQ ID NO: 2225532 - DNA, 13 bp, Homo sapiens
tctcaaatttcta

SEQ ID NO: 2225533 - DNA, 16 bp, Homo sapiens
tctcactatgttgccc

SEQ ID NO: 2225534 - DNA, 21 bp, Homo sapiens
tctcactatgttgcccaggca

SEQ ID NO: 2225535 - DNA, 23 bp, Homo sapiens
tctcactctgtcgcccagtctgg

SEQ ID NO: 2225536 - DNA, 20 bp, Homo sapiens
tctcactgccatgccagctt

SEQ ID NO: 2225537 - DNA, 15 bp, Homo sapiens
tctcactgttgccca

SEQ ID NO: 2225538 - DNA, 17 bp, Homo sapiens
tctcactgttgcccagg

SEQ ID NO: 2225539 - DNA, 21 bp, Homo sapiens
tctcaggccagctgcttgggc

SEQ ID NO: 2225540 - DNA, 14 bp, Homo sapiens
tctcagggcctggt

SEQ ID NO: 2225541 - DNA, 15 bp, Homo sapiens
tctcagggcctggtc

SEQ ID NO: 2225542 - DNA, 15 bp, Homo sapiens
tctccacctgccagg

SEQ ID NO: 2225543 - DNA, 13 bp, Homo sapiens
tctcccccagccc

SEQ ID NO: 2225544 - DNA, 14 bp, Homo sapiens
tctcccccagcccc

SEQ ID NO: 2225545 - DNA, 15 bp, Homo sapiens
tctcccccagcccca

SEQ ID NO: 2225546 - DNA, 17 bp, Homo sapiens
tctcccccagccccatc

SEQ ID NO: 2225547 - DNA, 20 bp, Homo sapiens
tctcccccagccccatcctc

SEQ ID NO: 2225548 - DNA, 18 bp, Homo sapiens
tctccctcagtctggccc

SEQ ID NO: 2225549 - DNA, 18 bp, Homo sapiens
tctcccttggattgtccc

SEQ ID NO: 2225550 - DNA, 15 bp, Homo sapiens
tctcctccagagtca

SEQ ID NO: 2225551 - DNA, 13 bp, Homo sapiens
tctcctctgctgc

SEQ ID NO: 2225552 - DNA, 17 bp, Homo sapiens
tctcctgcctcagcctc

SEQ ID NO: 2225553 - DNA, 16 bp, Homo sapiens
tctcctgtacctcttg

SEQ ID NO: 2225554 - DNA, 14 bp, Homo sapiens
tctccttcaccttt

SEQ ID NO: 2225555 - DNA, 21 bp, Homo sapiens
tctccttggtgtcgggcatga

SEQ ID NO: 2225556 - DNA, 21 bp, Homo sapiens
tctcgtcttggtttggttcat

SEQ ID NO: 2225557 - DNA, 13 bp, Homo sapiens
tctctcactcctt

SEQ ID NO: 2225558 - DNA, 21 bp, Homo sapiens
tctctcaggccaaactcacct

SEQ ID NO: 2225559 - DNA, 14 bp, Homo sapiens
tctctccagcccct

SEQ ID NO: 2225560 - DNA, 19 bp, Homo sapiens
tctctccagcccctggatg

SEQ ID NO: 2225561 - DNA, 16 bp, Homo sapiens
tctctcctgtacctct

SEQ ID NO: 2225562 - DNA, 17 bp, Homo sapiens
tctctcctgtacctctt

SEQ ID NO: 2225563 - DNA, 20 bp, Homo sapiens
tctctcctgtacctcttgag

SEQ ID NO: 2225564 - DNA, 11 bp, Homo sapiens
tctctgccctc

SEQ ID NO: 2225565 - DNA, 14 bp, Homo sapiens
tctcttgagagggt

SEQ ID NO: 2225566 - DNA, 14 bp, Homo sapiens
tctcttgagcctgg

SEQ ID NO: 2225567 - DNA, 15 bp, Homo sapiens
tctcttgagcctggg

SEQ ID NO: 2225568 - DNA, 17 bp, Homo sapiens
tctcttgagcctgggag

SEQ ID NO: 2225569 - DNA, 18 bp, Homo sapiens
tctcttgagcctgggagg

SEQ ID NO: 2225570 - DNA, 17 bp, Homo sapiens
tctcttggtcctgctgc

SEQ ID NO: 2225571 - DNA, 23 bp, Homo sapiens
tctgaaaatgtatgtgtaagtat

SEQ ID NO: 2225572 - DNA, 21 bp, Homo sapiens
tctgaaggacattgcggacag

SEQ ID NO: 2225573 - DNA, 17 bp, Homo sapiens
tctgacacacagctctg

SEQ ID NO: 2225574 - DNA, 13 bp, Homo sapiens
tctgacccactgc

SEQ ID NO: 2225575 - DNA, 17 bp, Homo sapiens
tctgacccatgctgccc

SEQ ID NO: 2225576 - DNA, 19 bp, Homo sapiens
tctgacccatgctgccctg

SEQ ID NO: 2225577 - DNA, 21 bp, Homo sapiens
tctgagactcgcgacaatgca

SEQ ID NO: 2225578 - DNA, 21 bp, Homo sapiens
tctgaggaatccagacccggc

SEQ ID NO: 2225579 - DNA, 23 bp, Homo sapiens
tctgaggaatccagacccggctg

SEQ ID NO: 2225580 - DNA, 20 bp, Homo sapiens
tctgaggacactaaccacgc

SEQ ID NO: 2225581 - DNA, 20 bp, Homo sapiens
tctgattcccaagctctgct

SEQ ID NO: 2225582 - DNA, 21 bp, Homo sapiens
tctgattcccaagctctgctc

SEQ ID NO: 2225583 - DNA, 20 bp, Homo sapiens
tctgcaagaattgaagcagg

SEQ ID NO: 2225584 - DNA, 19 bp, Homo sapiens
tctgcacaagctgcaccct

SEQ ID NO: 2225585 - DNA, 17 bp, Homo sapiens
tctgcagcaataaagca

SEQ ID NO: 2225586 - DNA, 23 bp, Homo sapiens
tctgcccactccctgcaacctga

SEQ ID NO: 2225587 - DNA, 18 bp, Homo sapiens
tctgccctccaagacctt

SEQ ID NO: 2225588 - DNA, 23 bp, Homo sapiens
tctgccgcagccctgcagagggc

SEQ ID NO: 2225589 - DNA, 13 bp, Homo sapiens
tctgcctcccatc

SEQ ID NO: 2225590 - DNA, 17 bp, Homo sapiens
tctgcctcccatcaccc

SEQ ID NO: 2225591 - DNA, 22 bp, Homo sapiens
tctgcctctgacacacagctct

SEQ ID NO: 2225592 - DNA, 13 bp, Homo sapiens
tctgcctgcccag

SEQ ID NO: 2225593 - DNA, 17 bp, Homo sapiens
tctgcctgcccaggccc

SEQ ID NO: 2225594 - DNA, 18 bp, Homo sapiens
tctgcctgcccaggcccc

SEQ ID NO: 2225595 - DNA, 22 bp, Homo sapiens
tctgcctgcccaggcccctgcc

SEQ ID NO: 2225596 - DNA, 16 bp, Homo sapiens
tctgctcacatatctg

SEQ ID NO: 2225597 - DNA, 17 bp, Homo sapiens
tctgctcacatatctgt

SEQ ID NO: 2225598 - DNA, 19 bp, Homo sapiens
tctgctgacagacacaggc

SEQ ID NO: 2225599 - DNA, 21 bp, Homo sapiens
tctgctgacagacacaggccc

SEQ ID NO: 2225600 - DNA, 14 bp, Homo sapiens
tctgctgctggctg

SEQ ID NO: 2225601 - DNA, 13 bp, Homo sapiens
tctgcttcagcct

SEQ ID NO: 2225602 - DNA, 14 bp, Homo sapiens
tctgcttcagcctc

SEQ ID NO: 2225603 - DNA, 15 bp, Homo sapiens
tctgcttcagcctcc

SEQ ID NO: 2225604 - DNA, 20 bp, Homo sapiens
tctggcagagttgaagacag

SEQ ID NO: 2225605 - DNA, 12 bp, Homo sapiens
aaaaaaaaaggg

SEQ ID NO: 2225606 - DNA, 13 bp, Homo sapiens
aaaaaaacacaaa

SEQ ID NO: 2225607 - DNA, 22 bp, Homo sapiens
aaaaaactgctgactgttttct

SEQ ID NO: 2225608 - DNA, 18 bp, Homo sapiens
aaaaacacaaaaaaagac

SEQ ID NO: 2225609 - DNA, 15 bp, Homo sapiens
aaaaactgatttttt

SEQ ID NO: 2225610 - DNA, 19 bp, Homo sapiens
aaaaagacctcgtggagaa

SEQ ID NO: 2225611 - DNA, 21 bp, Homo sapiens
aaaaaggatgcacagagttgt

SEQ ID NO: 2225612 - DNA, 12 bp, Homo sapiens
aaaaaggcagga

SEQ ID NO: 2225613 - DNA, 21 bp, Homo sapiens
aaaaaggggggtgggagggga

SEQ ID NO: 2225614 - DNA, 19 bp, Homo sapiens
aaaaatctcaaatttctaa

SEQ ID NO: 2225615 - DNA, 21 bp, Homo sapiens
aaaaccaatgttctctcttct

SEQ ID NO: 2225616 - DNA, 18 bp, Homo sapiens
aaaactctcctctgctgc

SEQ ID NO: 2225617 - DNA, 17 bp, Homo sapiens
aaaagaatgcagagatg

SEQ ID NO: 2225618 - DNA, 13 bp, Homo sapiens
aaaaggatgcaca

SEQ ID NO: 2225619 - DNA, 11 bp, Homo sapiens
aaaagggaaaa

SEQ ID NO: 2225620 - DNA, 16 bp, Homo sapiens
aaaaggttaataaagt

SEQ ID NO: 2225621 - DNA, 17 bp, Homo sapiens
aaaaggttaataaagta

SEQ ID NO: 2225622 - DNA, 14 bp, Homo sapiens
aaaataaaactttt

SEQ ID NO: 2225623 - DNA, 15 bp, Homo sapiens
aaaataccagccagt

SEQ ID NO: 2225624 - DNA, 18 bp, Homo sapiens
aaaatagtggtgtgattt

SEQ ID NO: 2225625 - DNA, 15 bp, Homo sapiens
aaaatctcaaatttc

SEQ ID NO: 2225626 - DNA, 18 bp, Homo sapiens
aaaatctcaaatttctaa

SEQ ID NO: 2225627 - DNA, 22 bp, Homo sapiens
aaaatctcaaatttctaaatct

SEQ ID NO: 2225628 - DNA, 18 bp, Homo sapiens
aaacaagaccacgtttct

SEQ ID NO: 2225629 - DNA, 11 bp, Homo sapiens
aaacacatttt

SEQ ID NO: 2225630 - DNA, 18 bp, Homo sapiens
aaacactgttctctgccc

SEQ ID NO: 2225631 - DNA, 12 bp, Homo sapiens
aaacccagctct

SEQ ID NO: 2225632 - DNA, 16 bp, Homo sapiens
aaaccgccaaggctgg

SEQ ID NO: 2225633 - DNA, 23 bp, Homo sapiens
aaactctatttttgtaaaaaggg

SEQ ID NO: 2225634 - DNA, 13 bp, Homo sapiens
aaactctcctctg

SEQ ID NO: 2225635 - DNA, 18 bp, Homo sapiens
aaactctcctctgctgct

SEQ ID NO: 2225636 - DNA, 17 bp, Homo sapiens
aaactcttgacctcagg

SEQ ID NO: 2225637 - DNA, 19 bp, Homo sapiens
aaactgatttttttttcct

SEQ ID NO: 2225638 - DNA, 19 bp, Homo sapiens
aaactgttaatagttcagg

SEQ ID NO: 2225639 - DNA, 14 bp, Homo sapiens
aaacttaatctaaa

SEQ ID NO: 2225640 - DNA, 19 bp, Homo sapiens
aaacttaatctaaatggaa

SEQ ID NO: 2225641 - DNA, 18 bp, Homo sapiens
aaactttactatggccct

SEQ ID NO: 2225642 - DNA, 14 bp, Homo sapiens
aaagactgtacaaa

SEQ ID NO: 2225643 - DNA, 19 bp, Homo sapiens
aaagacttttccaaccctc

SEQ ID NO: 2225644 - DNA, 13 bp, Homo sapiens
aaagagagagaga

SEQ ID NO: 2225645 - DNA, 13 bp, Homo sapiens
aaagaggctatgt

SEQ ID NO: 2225646 - DNA, 18 bp, Homo sapiens
aaagaggctatgtgagca

SEQ ID NO: 2225647 - DNA, 11 bp, Homo sapiens
aaagaggtttt

SEQ ID NO: 2225648 - DNA, 14 bp, Homo sapiens
aaagagtaggaaga

SEQ ID NO: 2225649 - DNA, 15 bp, Homo sapiens
aaagatgagtgagca

SEQ ID NO: 2225650 - DNA, 19 bp, Homo sapiens
aacactgttctctgccctc

SEQ ID NO: 2225651 - DNA, 20 bp, Homo sapiens
aacactgttctctgccctcc

SEQ ID NO: 2225652 - DNA, 14 bp, Homo sapiens
aacatactcccatc

SEQ ID NO: 2225653 - DNA, 14 bp, Homo sapiens
aacatcaacatctt

SEQ ID NO: 2225654 - DNA, 14 bp, Homo sapiens
aacatgtaattaag

SEQ ID NO: 2225655 - DNA, 16 bp, Homo sapiens
aacattttgtcatata

SEQ ID NO: 2225656 - DNA, 20 bp, Homo sapiens
aaccacatcttgctctgctg

SEQ ID NO: 2225657 - DNA, 22 bp, Homo sapiens
aaccactctatcaagtattata

SEQ ID NO: 2225658 - DNA, 20 bp, Homo sapiens
aaccatcattgaaatctttt

SEQ ID NO: 2225659 - DNA, 21 bp, Homo sapiens
aaccatcattgaaatcttttt

SEQ ID NO: 2225660 - DNA, 23 bp, Homo sapiens
aaccatcattgaaatctttttgc

SEQ ID NO: 2225661 - DNA, 23 bp, Homo sapiens
aaccattttgctgtcccttttcc

SEQ ID NO: 2225662 - DNA, 13 bp, Homo sapiens
aacccagctctgg

SEQ ID NO: 2225663 - DNA, 17 bp, Homo sapiens
aacctccgcctcttggg

SEQ ID NO: 2225664 - DNA, 18 bp, Homo sapiens
aacctgattgtgtctctt

SEQ ID NO: 2225665 - DNA, 23 bp, Homo sapiens
aaccttttgagtgccttacacaa

SEQ ID NO: 2225666 - DNA, 15 bp, Homo sapiens
aacgtggctgcttca

SEQ ID NO: 2225667 - DNA, 19 bp, Homo sapiens
aacgtggctgcttcaagga

SEQ ID NO: 2225668 - DNA, 22 bp, Homo sapiens
aacgtggctgcttcaaggatcc

SEQ ID NO: 2225669 - DNA, 17 bp, Homo sapiens
aactagggaagataata

SEQ ID NO: 2225670 - DNA, 17 bp, Homo sapiens
aactcaccccagcccca

SEQ ID NO: 2225671 - DNA, 16 bp, Homo sapiens
aactctcctctgctgc

SEQ ID NO: 2225672 - DNA, 17 bp, Homo sapiens
aactctcctctgctgct

SEQ ID NO: 2225673 - DNA, 21 bp, Homo sapiens
aactctcctctgctgctggct

SEQ ID NO: 2225674 - DNA, 22 bp, Homo sapiens
aactctcctctgctgctggctg

SEQ ID NO: 2225675 - DNA, 17 bp, Homo sapiens
aactgatttttttttcc

SEQ ID NO: 2225676 - DNA, 23 bp, Homo sapiens
aactgatttttttttccttcagt

SEQ ID NO: 2225677 - DNA, 15 bp, Homo sapiens
aactgctgactgttt

SEQ ID NO: 2225678 - DNA, 11 bp, Homo sapiens
aactggctgca

SEQ ID NO: 2225679 - DNA, 18 bp, Homo sapiens
aacttaatctaaatggaa

SEQ ID NO: 2225680 - DNA, 21 bp, Homo sapiens
aactttaccttttttatacat

SEQ ID NO: 2225681 - DNA, 23 bp, Homo sapiens
aactttaccttttttatacataa

SEQ ID NO: 2225682 - DNA, 13 bp, Homo sapiens
aactttgacctct

SEQ ID NO: 2225683 - DNA, 19 bp, Homo sapiens
aactttgacctctgcagca

SEQ ID NO: 2225684 - DNA, 20 bp, Homo sapiens
aactttgacctctgcagcaa

SEQ ID NO: 2225685 - DNA, 13 bp, Homo sapiens
aagaaaaagaaaa

SEQ ID NO: 2225686 - DNA, 18 bp, Homo sapiens
aagaaaaagaaaaagaaa

SEQ ID NO: 2225687 - DNA, 19 bp, Homo sapiens
aagaaaaaggatgcacaga

SEQ ID NO: 2225688 - DNA, 16 bp, Homo sapiens
aagaagcccaggaaag

SEQ ID NO: 2225689 - DNA, 17 bp, Homo sapiens
aagaagcccaggaaagg

SEQ ID NO: 2225690 - DNA, 14 bp, Homo sapiens
aagaagctctctcc

SEQ ID NO: 2225691 - DNA, 22 bp, Homo sapiens
aagacaatgacttactgtacat

SEQ ID NO: 2225692 - DNA, 19 bp, Homo sapiens
aagacaatgtgaaaagaaa

SEQ ID NO: 2225693 - DNA, 20 bp, Homo sapiens
aagacaatgtgaaaagaaaa

SEQ ID NO: 2225694 - DNA, 18 bp, Homo sapiens
aagacccttgtggtccca

SEQ ID NO: 2225695 - DNA, 13 bp, Homo sapiens
aagacgctgtgct

SEQ ID NO: 2225696 - DNA, 18 bp, Homo sapiens
aagacgctgtgctgccct

SEQ ID NO: 2225697 - DNA, 19 bp, Homo sapiens
aagacgctgtgctgccctg

SEQ ID NO: 2225698 - DNA, 21 bp, Homo sapiens
aagacgctgtgctgccctgcc

SEQ ID NO: 2225699 - DNA, 18 bp, Homo sapiens
aagactatctaaatgttg

SEQ ID NO: 2225700 - DNA, 17 bp, Homo sapiens
aagactcattcttctgt

SEQ ID NO: 2225701 - DNA, 21 bp, Homo sapiens
aagactgagtacgttgtgcat

SEQ ID NO: 2225702 - DNA, 17 bp, Homo sapiens
aagactgtacaaagtag

SEQ ID NO: 2225703 - DNA, 21 bp, Homo sapiens
aagacttttccaaccctcatc

SEQ ID NO: 2225704 - DNA, 9 bp, Homo sapiens
aagagagag

SEQ ID NO: 2225705 - DNA, 16 bp, Homo sapiens
aagagcccaggcctcc

SEQ ID NO: 2225706 - DNA, 21 bp, Homo sapiens
aagagggagggagggctccag

SEQ ID NO: 2225707 - DNA, 18 bp, Homo sapiens
aagaggttttaaaaaaat

SEQ ID NO: 2225708 - DNA, 13 bp, Homo sapiens
aagagtaggaaga

SEQ ID NO: 2225709 - DNA, 17 bp, Homo sapiens
aagatattttgctttgt

SEQ ID NO: 2225710 - DNA, 23 bp, Homo sapiens
aagatcaaaaggttaataaagta

SEQ ID NO: 2225711 - DNA, 16 bp, Homo sapiens
aagcacacttgacatc

SEQ ID NO: 2225712 - DNA, 19 bp, Homo sapiens
aagcacatgcctctctcag

SEQ ID NO: 2225713 - DNA, 13 bp, Homo sapiens
aagcacctcctgc

SEQ ID NO: 2225714 - DNA, 15 bp, Homo sapiens
aagcacctcctgcct

SEQ ID NO: 2225715 - DNA, 16 bp, Homo sapiens
aagcacctcctgcctc

SEQ ID NO: 2225716 - DNA, 14 bp, Homo sapiens
aagcagaggaagga

SEQ ID NO: 2225717 - DNA, 15 bp, Homo sapiens
aagcagtgcatgctg

SEQ ID NO: 2225718 - DNA, 20 bp, Homo sapiens
aagcagtgcatgctgtccct

SEQ ID NO: 2225719 - DNA, 20 bp, Homo sapiens
aagccaaagctaggcctggc

SEQ ID NO: 2225720 - DNA, 22 bp, Homo sapiens
aagccaaagctaggcctggcca

SEQ ID NO: 2225721 - DNA, 19 bp, Homo sapiens
aagccaccaacatactccc

SEQ ID NO: 2225722 - DNA, 15 bp, Homo sapiens
aagccagcaggctct

SEQ ID NO: 2225723 - DNA, 15 bp, Homo sapiens
aattctctagtttga

SEQ ID NO: 2225724 - DNA, 15 bp, Homo sapiens
aattctcttatccaa

SEQ ID NO: 2225725 - DNA, 12 bp, Homo sapiens
aattgtaaggaa

SEQ ID NO: 2225726 - DNA, 16 bp, Homo sapiens
aattgtaaggaatgat

SEQ ID NO: 2225727 - DNA, 15 bp, Homo sapiens
aatttacctgaagtc

SEQ ID NO: 2225728 - DNA, 17 bp, Homo sapiens
aatttagaaatataatt

SEQ ID NO: 2225729 - DNA, 14 bp, Homo sapiens
aatttgtgatacaa

SEQ ID NO: 2225730 - DNA, 17 bp, Homo sapiens
aatttttattaaattat

SEQ ID NO: 2225731 - DNA, 18 bp, Homo sapiens
aatttttattaaattatg

SEQ ID NO: 2225732 - DNA, 14 bp, Homo sapiens
acaaaacttttcta

SEQ ID NO: 2225733 - DNA, 22 bp, Homo sapiens
acaaaagcatgtgagactggtt

SEQ ID NO: 2225734 - DNA, 21 bp, Homo sapiens
acaacactcattgacctgagg

SEQ ID NO: 2225735 - DNA, 19 bp, Homo sapiens
acaagacccttgtggtccc

SEQ ID NO: 2225736 - DNA, 20 bp, Homo sapiens
acaagcgtgagccactgcac

SEQ ID NO: 2225737 - DNA, 21 bp, Homo sapiens
acaagcgtgagccactgcacc

SEQ ID NO: 2225738 - DNA, 22 bp, Homo sapiens
acaagctccaagctcccaggca

SEQ ID NO: 2225739 - DNA, 19 bp, Homo sapiens
acaagctgcaccctcaggc

SEQ ID NO: 2225740 - DNA, 21 bp, Homo sapiens
acaagctgcaccctcaggcag

SEQ ID NO: 2225741 - DNA, 22 bp, Homo sapiens
acaagctgcaccctcaggcagg

SEQ ID NO: 2225742 - DNA, 20 bp, Homo sapiens
acaaggatgatctaggaaga

SEQ ID NO: 2225743 - DNA, 20 bp, Homo sapiens
acaaggcaaggctgtcaatt

SEQ ID NO: 2225744 - DNA, 19 bp, Homo sapiens
acaatgacttactgtacat

SEQ ID NO: 2225745 - DNA, 18 bp, Homo sapiens
acaatgcaaaccatcatt

SEQ ID NO: 2225746 - DNA, 22 bp, Homo sapiens
acaatgctgtgccctaaagtgt

SEQ ID NO: 2225747 - DNA, 14 bp, Homo sapiens
acacacacatacac

SEQ ID NO: 2225748 - DNA, 22 bp, Homo sapiens
acacacacgcgtgcacacacca

SEQ ID NO: 2225749 - DNA, 19 bp, Homo sapiens
acacagaggctgcctctcc

SEQ ID NO: 2225750 - DNA, 11 bp, Homo sapiens
acacagctctg

SEQ ID NO: 2225751 - DNA, 14 bp, Homo sapiens
acacagctctgtcc

SEQ ID NO: 2225752 - DNA, 11 bp, Homo sapiens
acacagctctt

SEQ ID NO: 2225753 - DNA, 16 bp, Homo sapiens
acacaggcccggctcc

SEQ ID NO: 2225754 - DNA, 17 bp, Homo sapiens
acacaggcccggctcca

SEQ ID NO: 2225755 - DNA, 18 bp, Homo sapiens
acacaggcccggctccag

SEQ ID NO: 2225756 - DNA, 21 bp, Homo sapiens
acacaggcccggctccaggct

SEQ ID NO: 2225757 - DNA, 16 bp, Homo sapiens
acacagtattacttct

SEQ ID NO: 2225758 - DNA, 18 bp, Homo sapiens
acacagtattacttctgc

SEQ ID NO: 2225759 - DNA, 21 bp, Homo sapiens
acacatgagcatcaggccagg

SEQ ID NO: 2225760 - DNA, 18 bp, Homo sapiens
acacatgcaaggtcattt

SEQ ID NO: 2225761 - DNA, 20 bp, Homo sapiens
acacatgcaaggtcattttt

SEQ ID NO: 2225762 - DNA, 21 bp, Homo sapiens
acacatgcaaggtcatttttt

SEQ ID NO: 2225763 - DNA, 20 bp, Homo sapiens
acacattttattttattatg

SEQ ID NO: 2225764 - DNA, 22 bp, Homo sapiens
acacattttattttattatgca

SEQ ID NO: 2225765 - DNA, 14 bp, Homo sapiens
acacattttttaaa

SEQ ID NO: 2225766 - DNA, 16 bp, Homo sapiens
acacattttttaaatg

SEQ ID NO: 2225767 - DNA, 20 bp, Homo sapiens
acacattttttaaatgcacc

SEQ ID NO: 2225768 - DNA, 17 bp, Homo sapiens
acaccactacattctgt

SEQ ID NO: 2225769 - DNA, 20 bp, Homo sapiens
acaccactacattctgttaa

SEQ ID NO: 2225770 - DNA, 21 bp, Homo sapiens
acaccactacattctgttaat

SEQ ID NO: 2225771 - DNA, 12 bp, Homo sapiens
acacccagccca

SEQ ID NO: 2225772 - DNA, 21 bp, Homo sapiens
acacccagcccacttctgcca

SEQ ID NO: 2225773 - DNA, 16 bp, Homo sapiens
acaccgggcactcaga

SEQ ID NO: 2225774 - DNA, 21 bp, Homo sapiens
acacctctgcacaagctgcac

SEQ ID NO: 2225775 - DNA, 16 bp, Homo sapiens
acaccttgacagggca

SEQ ID NO: 2225776 - DNA, 19 bp, Homo sapiens
acactaaccacgctggacc

SEQ ID NO: 2225777 - DNA, 20 bp, Homo sapiens
acactaaccacgctggacct

SEQ ID NO: 2225778 - DNA, 22 bp, Homo sapiens
acactaatgaggaaactgcact

SEQ ID NO: 2225779 - DNA, 20 bp, Homo sapiens
acactcacatttattctgct

SEQ ID NO: 2225780 - DNA, 13 bp, Homo sapiens
acactccttcaca

SEQ ID NO: 2225781 - DNA, 14 bp, Homo sapiens
acactgcatgtttg

SEQ ID NO: 2225782 - DNA, 22 bp, Homo sapiens
acactgtgctgagtctgaaggc

SEQ ID NO: 2225783 - DNA, 14 bp, Homo sapiens
acagtcctcccatc

SEQ ID NO: 2225784 - DNA, 22 bp, Homo sapiens
acagtccttaccagcagagcac

SEQ ID NO: 2225785 - DNA, 22 bp, Homo sapiens
acagtgagtcgaggacagggag

SEQ ID NO: 2225786 - DNA, 17 bp, Homo sapiens
acagttctctccttctt

SEQ ID NO: 2225787 - DNA, 20 bp, Homo sapiens
acagttgaaaaacagctgag

SEQ ID NO: 2225788 - DNA, 22 bp, Homo sapiens
acataatgcgtgcataccactt

SEQ ID NO: 2225789 - DNA, 20 bp, Homo sapiens
acatacaggaaggtagaaat

SEQ ID NO: 2225790 - DNA, 22 bp, Homo sapiens
acatactaaccagcagaaatgc

SEQ ID NO: 2225791 - DNA, 14 bp, Homo sapiens
acatactctgctta

SEQ ID NO: 2225792 - DNA, 16 bp, Homo sapiens
acatattgatttccgt

SEQ ID NO: 2225793 - DNA, 23 bp, Homo sapiens
acatattgatttccgttaaaata

SEQ ID NO: 2225794 - DNA, 19 bp, Homo sapiens
acatcagcacgatttctgt

SEQ ID NO: 2225795 - DNA, 22 bp, Homo sapiens
acatcagcacgatttctgttta

SEQ ID NO: 2225796 - DNA, 15 bp, Homo sapiens
acatcttgctctgct

SEQ ID NO: 2225797 - DNA, 17 bp, Homo sapiens
acatcttgctctgctga

SEQ ID NO: 2225798 - DNA, 18 bp, Homo sapiens
acatcttgctctgctgac

SEQ ID NO: 2225799 - DNA, 21 bp, Homo sapiens
acatcttgctctgctgacaga

SEQ ID NO: 2225800 - DNA, 22 bp, Homo sapiens
acatcttgctctgctgacagac

SEQ ID NO: 2225801 - DNA, 19 bp, Homo sapiens
acatgaaaacacatttttc

SEQ ID NO: 2225802 - DNA, 13 bp, Homo sapiens
acatgagcatcag

SEQ ID NO: 2225803 - DNA, 17 bp, Homo sapiens
acatgagcatcaggcca

SEQ ID NO: 2225804 - DNA, 18 bp, Homo sapiens
acatgagcatcaggccag

SEQ ID NO: 2225805 - DNA, 23 bp, Homo sapiens
acatgagcatcaggccaggccct

SEQ ID NO: 2225806 - DNA, 15 bp, Homo sapiens
acatgatcttcttta

SEQ ID NO: 2225807 - DNA, 19 bp, Homo sapiens
acatgatcttctttataat

SEQ ID NO: 2225808 - DNA, 16 bp, Homo sapiens
acatgcaaggtcattt

SEQ ID NO: 2225809 - DNA, 18 bp, Homo sapiens
acatgcctctctcaggcc

SEQ ID NO: 2225810 - DNA, 19 bp, Homo sapiens
acatgcctctctcaggcca

SEQ ID NO: 2225811 - DNA, 21 bp, Homo sapiens
acatgctacacactgcatgtt

SEQ ID NO: 2225812 - DNA, 22 bp, Homo sapiens
acatgctacacactgcatgttt

SEQ ID NO: 2225813 - DNA, 14 bp, Homo sapiens
acatggaagtacta

SEQ ID NO: 2225814 - DNA, 18 bp, Homo sapiens
acatggaataacatgtaa

SEQ ID NO: 2225815 - DNA, 20 bp, Homo sapiens
acatggaataacatgtaatt

SEQ ID NO: 2225816 - DNA, 15 bp, Homo sapiens
acatgtaattaagta

SEQ ID NO: 2225817 - DNA, 19 bp, Homo sapiens
acatgtaattaagtactat

SEQ ID NO: 2225818 - DNA, 21 bp, Homo sapiens
acatgtaattaagtactatgt

SEQ ID NO: 2225819 - DNA, 22 bp, Homo sapiens
acatgtaattaagtactatgta

SEQ ID NO: 2225820 - DNA, 23 bp, Homo sapiens
acatgtaattaagtactatgtat

SEQ ID NO: 2225821 - DNA, 15 bp, Homo sapiens
acatgtccaagaagc

SEQ ID NO: 2225822 - DNA, 21 bp, Homo sapiens
acatgtccaagaagcccagga

SEQ ID NO: 2225823 - DNA, 21 bp, Homo sapiens
acatgtcttttcttgcatgag

SEQ ID NO: 2225824 - DNA, 19 bp, Homo sapiens
acatgtttttcttctccct

SEQ ID NO: 2225825 - DNA, 14 bp, Homo sapiens
acattttttaaatg

SEQ ID NO: 2225826 - DNA, 16 bp, Homo sapiens
acattttttaaatgca

SEQ ID NO: 2225827 - DNA, 17 bp, Homo sapiens
acattttttaaatgcac

SEQ ID NO: 2225828 - DNA, 16 bp, Homo sapiens
accaaatcagctgcta

SEQ ID NO: 2225829 - DNA, 19 bp, Homo sapiens
accaacatactcccatctg

SEQ ID NO: 2225830 - DNA, 21 bp, Homo sapiens
accaacatactcccatctgtg

SEQ ID NO: 2225831 - DNA, 14 bp, Homo sapiens
accaacgtctgtgc

SEQ ID NO: 2225832 - DNA, 17 bp, Homo sapiens
accaacgtctgtgccat

SEQ ID NO: 2225833 - DNA, 12 bp, Homo sapiens
accaagcccagt

SEQ ID NO: 2225834 - DNA, 15 bp, Homo sapiens
accaatgttctctct

SEQ ID NO: 2225835 - DNA, 15 bp, Homo sapiens
accacacccagccca

SEQ ID NO: 2225836 - DNA, 22 bp, Homo sapiens
accacagacatactaaccagca

SEQ ID NO: 2225837 - DNA, 14 bp, Homo sapiens
accacgctggacct

SEQ ID NO: 2225838 - DNA, 13 bp, Homo sapiens
accacgtttctaa

SEQ ID NO: 2225839 - DNA, 15 bp, Homo sapiens
accactacattctgt

SEQ ID NO: 2225840 - DNA, 17 bp, Homo sapiens
accactacattctgtta

SEQ ID NO: 2225841 - DNA, 20 bp, Homo sapiens
accactgcactccagcctgg

SEQ ID NO: 2225842 - DNA, 21 bp, Homo sapiens
accactgcactccagcctggg

SEQ ID NO: 2225843 - DNA, 13 bp, Homo sapiens
accacttcagctg

SEQ ID NO: 2225844 - DNA, 14 bp, Homo sapiens
accacttcagctga

SEQ ID NO: 2225845 - DNA, 15 bp, Homo sapiens
accacttttgttctt

SEQ ID NO: 2225846 - DNA, 14 bp, Homo sapiens
accagacaccttga

SEQ ID NO: 2225847 - DNA, 17 bp, Homo sapiens
accagacaccttgacag

SEQ ID NO: 2225848 - DNA, 23 bp, Homo sapiens
accagacaccttgacagggcaca

SEQ ID NO: 2225849 - DNA, 14 bp, Homo sapiens
accagagcccacct

SEQ ID NO: 2225850 - DNA, 16 bp, Homo sapiens
accagagcccaccttg

SEQ ID NO: 2225851 - DNA, 17 bp, Homo sapiens
cccttacgtgagtcctg

SEQ ID NO: 2225852 - DNA, 12 bp, Homo sapiens
cccttccatgga

SEQ ID NO: 2225853 - DNA, 12 bp, Homo sapiens
cccttcccacct

SEQ ID NO: 2225854 - DNA, 15 bp, Homo sapiens
cccttcctctttcca

SEQ ID NO: 2225855 - DNA, 16 bp, Homo sapiens
cccttcgctcctgtgt

SEQ ID NO: 2225856 - DNA, 16 bp, Homo sapiens
cccttctaccttcctg

SEQ ID NO: 2225857 - DNA, 21 bp, Homo sapiens
cccttctgacccatgctgccc

SEQ ID NO: 2225858 - DNA, 14 bp, Homo sapiens
cccttgtggtccca

SEQ ID NO: 2225859 - DNA, 11 bp, Homo sapiens
cccttttcctt

SEQ ID NO: 2225860 - DNA, 18 bp, Homo sapiens
cccttttttggctgctga

SEQ ID NO: 2225861 - DNA, 22 bp, Homo sapiens
cccttttttggctgctgaaggc

SEQ ID NO: 2225862 - DNA, 19 bp, Homo sapiens
ccgaaagggacttggaagc

SEQ ID NO: 2225863 - DNA, 13 bp, Homo sapiens
ccgaccagacacc

SEQ ID NO: 2225864 - DNA, 17 bp, Homo sapiens
ccgagaaggaagcctcc

SEQ ID NO: 2225865 - DNA, 18 bp, Homo sapiens
ccgagatagccaaggcca

SEQ ID NO: 2225866 - DNA, 19 bp, Homo sapiens
ccgagatagccaaggccaa

SEQ ID NO: 2225867 - DNA, 21 bp, Homo sapiens
ccgagattgcaccactgcact

SEQ ID NO: 2225868 - DNA, 19 bp, Homo sapiens
ccgagctttgaaaattcag

SEQ ID NO: 2225869 - DNA, 19 bp, Homo sapiens
ccgcactgggcttggggac

SEQ ID NO: 2225870 - DNA, 23 bp, Homo sapiens
ccgcactgggcttggggaccaga

SEQ ID NO: 2225871 - DNA, 17 bp, Homo sapiens
ccgcagacaggaccagg

SEQ ID NO: 2225872 - DNA, 23 bp, Homo sapiens
ccgcagccctgcagagggcacag

SEQ ID NO: 2225873 - DNA, 17 bp, Homo sapiens
ccgccaaggctggggga

SEQ ID NO: 2225874 - DNA, 12 bp, Homo sapiens
ccgctttctacc

SEQ ID NO: 2225875 - DNA, 16 bp, Homo sapiens
ccggccacctgcggtg

SEQ ID NO: 2225876 - DNA, 17 bp, Homo sapiens
ccggccacctgcggtgc

SEQ ID NO: 2225877 - DNA, 15 bp, Homo sapiens
ccggcccctgctggt

SEQ ID NO: 2225878 - DNA, 12 bp, Homo sapiens
ccggctccaggc

SEQ ID NO: 2225879 - DNA, 21 bp, Homo sapiens
ccggctccaggctcctttagc

SEQ ID NO: 2225880 - DNA, 13 bp, Homo sapiens
ccggctggcctgg

SEQ ID NO: 2225881 - DNA, 15 bp, Homo sapiens
ccggctggcctggcc

SEQ ID NO: 2225882 - DNA, 17 bp, Homo sapiens
ccggctggcctggcccc

SEQ ID NO: 2225883 - DNA, 17 bp, Homo sapiens
ccgggaagggggctggg

SEQ ID NO: 2225884 - DNA, 15 bp, Homo sapiens
ccgggcactcagaag

SEQ ID NO: 2225885 - DNA, 20 bp, Homo sapiens
ccgggcactcagaagacact

SEQ ID NO: 2225886 - DNA, 17 bp, Homo sapiens
ccgggcagcagagagag

SEQ ID NO: 2225887 - DNA, 22 bp, Homo sapiens
ccgggctctgcctcccatcacc

SEQ ID NO: 2225888 - DNA, 14 bp, Homo sapiens
ccgtctacctgagg

SEQ ID NO: 2225889 - DNA, 18 bp, Homo sapiens
ccgtgaggccagagacac

SEQ ID NO: 2225890 - DNA, 18 bp, Homo sapiens
cctacccaccctcctttc

SEQ ID NO: 2225891 - DNA, 17 bp, Homo sapiens
cctagcactttgggagg

SEQ ID NO: 2225892 - DNA, 22 bp, Homo sapiens
cctagccttagaagtcacacag

SEQ ID NO: 2225893 - DNA, 13 bp, Homo sapiens
cctaggtgacaga

SEQ ID NO: 2225894 - DNA, 15 bp, Homo sapiens
cctaggtgacagagt

SEQ ID NO: 2225895 - DNA, 16 bp, Homo sapiens
cctaggtggggcctgg

SEQ ID NO: 2225896 - DNA, 22 bp, Homo sapiens
cctaggtggggcctggggtagg

SEQ ID NO: 2225897 - DNA, 18 bp, Homo sapiens
cctatattgttttcagtg

SEQ ID NO: 2225898 - DNA, 16 bp, Homo sapiens
cctcaacacctctgca

SEQ ID NO: 2225899 - DNA, 17 bp, Homo sapiens
cctcacagtccttacca

SEQ ID NO: 2225900 - DNA, 20 bp, Homo sapiens
cctcacagtccttaccagca

SEQ ID NO: 2225901 - DNA, 15 bp, Homo sapiens
cctcaccccactgtg

SEQ ID NO: 2225902 - DNA, 16 bp, Homo sapiens
cctcagatcttctgtg

SEQ ID NO: 2225903 - DNA, 22 bp, Homo sapiens
cctcagcctcccaaagtgctgg

SEQ ID NO: 2225904 - DNA, 23 bp, Homo sapiens
cctcagcctcccaaagtgctggg

SEQ ID NO: 2225905 - DNA, 22 bp, Homo sapiens
cctcagcctcccgaatagctgg

SEQ ID NO: 2225906 - DNA, 11 bp, Homo sapiens
cctcaggcagg

SEQ ID NO: 2225907 - DNA, 21 bp, Homo sapiens
cctcaggcctgggggctgggc

SEQ ID NO: 2225908 - DNA, 16 bp, Homo sapiens
cctcagggtccctggt

SEQ ID NO: 2225909 - DNA, 17 bp, Homo sapiens
cctcagggtccctggtg

SEQ ID NO: 2225910 - DNA, 20 bp, Homo sapiens
cctcagggtccctggtggca

SEQ ID NO: 2225911 - DNA, 18 bp, Homo sapiens
cctcaggtgagaagcaga

SEQ ID NO: 2225912 - DNA, 20 bp, Homo sapiens
cctcaggtgagaagcagagg

SEQ ID NO: 2225913 - DNA, 20 bp, Homo sapiens
cctcagtctggcccttcctt

SEQ ID NO: 2225914 - DNA, 12 bp, Homo sapiens
cctcatacccac

SEQ ID NO: 2225915 - DNA, 13 bp, Homo sapiens
cctcatacccacc

SEQ ID NO: 2225916 - DNA, 13 bp, Homo sapiens
cctcatcctcata

SEQ ID NO: 2225917 - DNA, 13 bp, Homo sapiens
cctcatgttctta

SEQ ID NO: 2225918 - DNA, 16 bp, Homo sapiens
cctccaagaccttctc

SEQ ID NO: 2225919 - DNA, 17 bp, Homo sapiens
cctccaagaccttctcc

SEQ ID NO: 2225920 - DNA, 19 bp, Homo sapiens
cctccaggtgcacaagctc

SEQ ID NO: 2225921 - DNA, 21 bp, Homo sapiens
cctccaggtgcacaagctcca

SEQ ID NO: 2225922 - DNA, 22 bp, Homo sapiens
cctcccaaggggcccaaattct

SEQ ID NO: 2225923 - DNA, 22 bp, Homo sapiens
cctcccagacccccttgcccag

SEQ ID NO: 2225924 - DNA, 12 bp, Homo sapiens
cctcccatcacc

SEQ ID NO: 2225925 - DNA, 13 bp, Homo sapiens
cctcccatctcac

SEQ ID NO: 2225926 - DNA, 13 bp, Homo sapiens
cctccccgggcag

SEQ ID NO: 2225927 - DNA, 16 bp, Homo sapiens
cctccccgggcagcag

SEQ ID NO: 2225928 - DNA, 18 bp, Homo sapiens
cctccccgggcagcagag

SEQ ID NO: 2225929 - DNA, 20 bp, Homo sapiens
cctcccgaatagctgggact

SEQ ID NO: 2225930 - DNA, 20 bp, Homo sapiens
cctcccgagtagctgggact

SEQ ID NO: 2225931 - DNA, 13 bp, Homo sapiens
cctccctctttcc

SEQ ID NO: 2225932 - DNA, 20 bp, Homo sapiens
cattccccaggaggccagcc

SEQ ID NO: 2225933 - DNA, 16 bp, Homo sapiens
cattcctgatgcttct

SEQ ID NO: 2225934 - DNA, 19 bp, Homo sapiens
cattcctgatgcttcttca

SEQ ID NO: 2225935 - DNA, 22 bp, Homo sapiens
cattcctgatgcttcttcagag

SEQ ID NO: 2225936 - DNA, 23 bp, Homo sapiens
cattcctgatgcttcttcagaga

SEQ ID NO: 2225937 - DNA, 17 bp, Homo sapiens
cattctccacctgccag

SEQ ID NO: 2225938 - DNA, 18 bp, Homo sapiens
cattctccacctgccagg

SEQ ID NO: 2225939 - DNA, 18 bp, Homo sapiens
cattctgcctgcccaggc

SEQ ID NO: 2225940 - DNA, 19 bp, Homo sapiens
cattctgcctgcccaggcc

SEQ ID NO: 2225941 - DNA, 14 bp, Homo sapiens
cattgacctgaggc

SEQ ID NO: 2225942 - DNA, 17 bp, Homo sapiens
cattgcggacagccacg

SEQ ID NO: 2225943 - DNA, 18 bp, Homo sapiens
cattgttggccaaagcca

SEQ ID NO: 2225944 - DNA, 21 bp, Homo sapiens
catttactttgtgttcacctt

SEQ ID NO: 2225945 - DNA, 13 bp, Homo sapiens
catttcctgtgtc

SEQ ID NO: 2225946 - DNA, 23 bp, Homo sapiens
catttcttccacaagagcccagg

SEQ ID NO: 2225947 - DNA, 16 bp, Homo sapiens
catttgagcagggctc

SEQ ID NO: 2225948 - DNA, 18 bp, Homo sapiens
catttgagcagggctcag

SEQ ID NO: 2225949 - DNA, 20 bp, Homo sapiens
catttgagcagggctcagcg

SEQ ID NO: 2225950 - DNA, 17 bp, Homo sapiens
catttgaggtctgttct

SEQ ID NO: 2225951 - DNA, 13 bp, Homo sapiens
catttgctccttt

SEQ ID NO: 2225952 - DNA, 14 bp, Homo sapiens
catttgctcctttc

SEQ ID NO: 2225953 - DNA, 13 bp, Homo sapiens
catttgctgaata

SEQ ID NO: 2225954 - DNA, 17 bp, Homo sapiens
catttgtttgaactgat

SEQ ID NO: 2225955 - DNA, 24 bp, Homo sapiens
cattttgctaaatgtgaatgatga

SEQ ID NO: 2225956 - DNA, 20 bp, Homo sapiens
cattttggggtacccactgc

SEQ ID NO: 2225957 - DNA, 21 bp, Homo sapiens
catttttaagtgctgcattta

SEQ ID NO: 2225958 - DNA, 17 bp, Homo sapiens
catttttagtagagaca

SEQ ID NO: 2225959 - DNA, 23 bp, Homo sapiens
catttttcttagggaaggataca

SEQ ID NO: 2225960 - DNA, 16 bp, Homo sapiens
cattttttaaatgcac

SEQ ID NO: 2225961 - DNA, 13 bp, Homo sapiens
ccaaaaaagcgaa

SEQ ID NO: 2225962 - DNA, 20 bp, Homo sapiens
ccaaaactctcctctgctgc

SEQ ID NO: 2225963 - DNA, 21 bp, Homo sapiens
ccaaaactctcctctgctgct

SEQ ID NO: 2225964 - DNA, 16 bp, Homo sapiens
ccaaacccttcagtgc

SEQ ID NO: 2225965 - DNA, 13 bp, Homo sapiens
ccaaagatgcagc

SEQ ID NO: 2225966 - DNA, 19 bp, Homo sapiens
ccaaagcagtgcatgctgt

SEQ ID NO: 2225967 - DNA, 19 bp, Homo sapiens
ccaaagccaaagctaggcc

SEQ ID NO: 2225968 - DNA, 17 bp, Homo sapiens
ccaaagctaggcctggc

SEQ ID NO: 2225969 - DNA, 15 bp, Homo sapiens
ccaaagtacactgtt

SEQ ID NO: 2225970 - DNA, 18 bp, Homo sapiens
ccaaagtacactgtttca

SEQ ID NO: 2225971 - DNA, 14 bp, Homo sapiens
ccaaagtgctggga

SEQ ID NO: 2225972 - DNA, 16 bp, Homo sapiens
ccaaatcatagtggct

SEQ ID NO: 2225973 - DNA, 15 bp, Homo sapiens
ccaaattctttcagt

SEQ ID NO: 2225974 - DNA, 12 bp, Homo sapiens
ccaaccctcatc

SEQ ID NO: 2225975 - DNA, 15 bp, Homo sapiens
ccaaccctcatcacc

SEQ ID NO: 2225976 - DNA, 17 bp, Homo sapiens
ccaactcaccccagccc

SEQ ID NO: 2225977 - DNA, 18 bp, Homo sapiens
ccaactcaccccagcccc

SEQ ID NO: 2225978 - DNA, 15 bp, Homo sapiens
ccaagaagcccagga

SEQ ID NO: 2225979 - DNA, 11 bp, Homo sapiens
ccaagagagac

SEQ ID NO: 2225980 - DNA, 13 bp, Homo sapiens
ccaagagagacag

SEQ ID NO: 2225981 - DNA, 14 bp, Homo sapiens
ccaagcaggacatg

SEQ ID NO: 2225982 - DNA, 14 bp, Homo sapiens
ccaaggctggggga

SEQ ID NO: 2225983 - DNA, 16 bp, Homo sapiens
ccaagggcctggcctg

SEQ ID NO: 2225984 - DNA, 13 bp, Homo sapiens
ccaaggtgggagg

SEQ ID NO: 2225985 - DNA, 18 bp, Homo sapiens
ccaaggtgggaggattgc

SEQ ID NO: 2225986 - DNA, 23 bp, Homo sapiens
ccaatgcactttgttctggctct

SEQ ID NO: 2225987 - DNA, 17 bp, Homo sapiens
ccaatgggagctcatgg

SEQ ID NO: 2225988 - DNA, 13 bp, Homo sapiens
ccacaagagccca

SEQ ID NO: 2225989 - DNA, 18 bp, Homo sapiens
ccacaagagcccaggcct

SEQ ID NO: 2225990 - DNA, 20 bp, Homo sapiens
ccacaagagcccaggcctcc

SEQ ID NO: 2225991 - DNA, 13 bp, Homo sapiens
ccacacccagccc

SEQ ID NO: 2225992 - DNA, 21 bp, Homo sapiens
ccacacccagcccacttctgc

SEQ ID NO: 2225993 - DNA, 16 bp, Homo sapiens
ccacatcttgctctgc

SEQ ID NO: 2225994 - DNA, 16 bp, Homo sapiens
ccacattcctgatgct

SEQ ID NO: 2225995 - DNA, 14 bp, Homo sapiens
ccaccaacatactc

SEQ ID NO: 2225996 - DNA, 18 bp, Homo sapiens
ccaccaacatactcccat

SEQ ID NO: 2225997 - DNA, 14 bp, Homo sapiens
ccaccacacccagc

SEQ ID NO: 2225998 - DNA, 15 bp, Homo sapiens
ccaccatcaagccac

SEQ ID NO: 2225999 - DNA, 18 bp, Homo sapiens
ccaccatcatgtctggct

SEQ ID NO: 2226000 - DNA, 16 bp, Homo sapiens
ccacccaagggcctgg

SEQ ID NO: 2226001 - DNA, 12 bp, Homo sapiens
ccacccaggagc

SEQ ID NO: 2226002 - DNA, 14 bp, Homo sapiens
ccaccccaggctgg

SEQ ID NO: 2226003 - DNA, 18 bp, Homo sapiens
ccaccccctccccgggca

SEQ ID NO: 2226004 - DNA, 19 bp, Homo sapiens
ccacccctcaacacctctg

SEQ ID NO: 2226005 - DNA, 16 bp, Homo sapiens
ccaccctgaaagccct

SEQ ID NO: 2226006 - DNA, 14 bp, Homo sapiens
ccaccgcagacagg

SEQ ID NO: 2226007 - DNA, 13 bp, Homo sapiens
ccacctgccaggg

SEQ ID NO: 2226008 - DNA, 15 bp, Homo sapiens
ccacctgccagggac

SEQ ID NO: 2226009 - DNA, 22 bp, Homo sapiens
ccacctgcggtgctatctcccc

SEQ ID NO: 2226010 - DNA, 13 bp, Homo sapiens
ccacctggcctct

SEQ ID NO: 2226011 - DNA, 15 bp, Homo sapiens
ccacctggcctctgc

SEQ ID NO: 2226012 - DNA, 17 bp, Homo sapiens
ccacctggcctctgcac

SEQ ID NO: 2226013 - DNA, 18 bp, Homo sapiens
ccacctggcctctgcact

SEQ ID NO: 2226014 - DNA, 13 bp, Homo sapiens
ccaccttggctca

SEQ ID NO: 2226015 - DNA, 15 bp, Homo sapiens
ccaccttggctgcag

SEQ ID NO: 2226016 - DNA, 16 bp, Homo sapiens
ccaccttggctgcagg

SEQ ID NO: 2226017 - DNA, 16 bp, Homo sapiens
ccacgcccccactggt

SEQ ID NO: 2226018 - DNA, 19 bp, Homo sapiens
ccacgcccccactggtgac

SEQ ID NO: 2226019 - DNA, 13 bp, Homo sapiens
ccacggccaggcc

SEQ ID NO: 2226020 - DNA, 16 bp, Homo sapiens
ccacggccaggccaga

SEQ ID NO: 2226021 - DNA, 18 bp, Homo sapiens
ccacgtccctgcggaagc

SEQ ID NO: 2226022 - DNA, 13 bp, Homo sapiens
ccacgtttctaaa

SEQ ID NO: 2226023 - DNA, 17 bp, Homo sapiens
ccactacattctgttaa

SEQ ID NO: 2226024 - DNA, 22 bp, Homo sapiens
ccactacggaatagttggctag

SEQ ID NO: 2226025 - DNA, 15 bp, Homo sapiens
ccactccctgcaacc

SEQ ID NO: 2226026 - DNA, 14 bp, Homo sapiens
ccactgcaccgggc

SEQ ID NO: 2226027 - DNA, 19 bp, Homo sapiens
ccactgcaccgggccacag

SEQ ID NO: 2226028 - DNA, 19 bp, Homo sapiens
ccactgcactatagcctag

SEQ ID NO: 2226029 - DNA, 23 bp, Homo sapiens
ccactgcactccagcctgggtga

SEQ ID NO: 2226030 - DNA, 23 bp, Homo sapiens
ccactgcatcgtttcatcttcca

SEQ ID NO: 2226031 - DNA, 12 bp, Homo sapiens
ccactgctctgg

SEQ ID NO: 2226032 - DNA, 22 bp, Homo sapiens
ccactgcttttggtctgtgtga

SEQ ID NO: 2226033 - DNA, 16 bp, Homo sapiens
ccactgtgccatgtgc

SEQ ID NO: 2226034 - DNA, 13 bp, Homo sapiens
ccacttcagctga

SEQ ID NO: 2226035 - DNA, 18 bp, Homo sapiens
ccactttctagccagagg

SEQ ID NO: 2226036 - DNA, 18 bp, Homo sapiens
ccagaatttcccaaagca

SEQ ID NO: 2226037 - DNA, 12 bp, Homo sapiens
cccaagggcctg

SEQ ID NO: 2226038 - DNA, 19 bp, Homo sapiens
cccaagggcctggcctgag

SEQ ID NO: 2226039 - DNA, 16 bp, Homo sapiens
cccaatgcactttgtt

SEQ ID NO: 2226040 - DNA, 20 bp, Homo sapiens
cccaatgcactttgttctgg

SEQ ID NO: 2226041 - DNA, 21 bp, Homo sapiens
cccacaaaggagagctagcag

SEQ ID NO: 2226042 - DNA, 18 bp, Homo sapiens
cccacccaagggcctggc

SEQ ID NO: 2226043 - DNA, 22 bp, Homo sapiens
cccacccaagggcctggcctga

SEQ ID NO: 2226044 - DNA, 14 bp, Homo sapiens
cccacccccaccct

SEQ ID NO: 2226045 - DNA, 18 bp, Homo sapiens
cccaccctgaaagccctg

SEQ ID NO: 2226046 - DNA, 15 bp, Homo sapiens
cccacctcagcctcc

SEQ ID NO: 2226047 - DNA, 13 bp, Homo sapiens
cccacctctctca

SEQ ID NO: 2226048 - DNA, 17 bp, Homo sapiens
cccacctctctcactcc

SEQ ID NO: 2226049 - DNA, 12 bp, Homo sapiens
cccacctggcct

SEQ ID NO: 2226050 - DNA, 15 bp, Homo sapiens
cccacctggcctctg

SEQ ID NO: 2226051 - DNA, 16 bp, Homo sapiens
cccacctggcctctgc

SEQ ID NO: 2226052 - DNA, 17 bp, Homo sapiens
cccacctggcctctgca

SEQ ID NO: 2226053 - DNA, 21 bp, Homo sapiens
cccacctggcctctgcactcc

SEQ ID NO: 2226054 - DNA, 15 bp, Homo sapiens
cccaccttggctgca

SEQ ID NO: 2226055 - DNA, 21 bp, Homo sapiens
cccacgactgcccggcagggt

SEQ ID NO: 2226056 - DNA, 14 bp, Homo sapiens
cccacgcccccact

SEQ ID NO: 2226057 - DNA, 20 bp, Homo sapiens
cccacgctggagtgcagtga

SEQ ID NO: 2226058 - DNA, 21 bp, Homo sapiens
cccacgctggagtgcagtgag

SEQ ID NO: 2226059 - DNA, 17 bp, Homo sapiens
cccagacccccttgccc

SEQ ID NO: 2226060 - DNA, 15 bp, Homo sapiens
cccagagggcctgca

SEQ ID NO: 2226061 - DNA, 20 bp, Homo sapiens
cccagattgcaacaggctgg

SEQ ID NO: 2226062 - DNA, 21 bp, Homo sapiens
cccagattgcaacaggctggg

SEQ ID NO: 2226063 - DNA, 23 bp, Homo sapiens
cccagattgcaacaggctgggct

SEQ ID NO: 2226064 - DNA, 16 bp, Homo sapiens
cccagcaagtgagagc

SEQ ID NO: 2226065 - DNA, 13 bp, Homo sapiens
cccagcacctagg

SEQ ID NO: 2226066 - DNA, 23 bp, Homo sapiens
cccagccccaaaactctcctctg

SEQ ID NO: 2226067 - DNA, 12 bp, Homo sapiens
cgaactggctgc

SEQ ID NO: 2226068 - DNA, 13 bp, Homo sapiens
cgaatagctggga

SEQ ID NO: 2226069 - DNA, 14 bp, Homo sapiens
cgaatagctgggac

SEQ ID NO: 2226070 - DNA, 16 bp, Homo sapiens
cgaatagctgggacta

SEQ ID NO: 2226071 - DNA, 12 bp, Homo sapiens
cgacaatgcaaa

SEQ ID NO: 2226072 - DNA, 20 bp, Homo sapiens
cgacccttgccgtctacctg

SEQ ID NO: 2226073 - DNA, 20 bp, Homo sapiens
cgagattgcaccactgcact

SEQ ID NO: 2226074 - DNA, 20 bp, Homo sapiens
cgagcaggcttcttcccccc

SEQ ID NO: 2226075 - DNA, 13 bp, Homo sapiens
cgaggacagggag

SEQ ID NO: 2226076 - DNA, 18 bp, Homo sapiens
cgaggccttctctgaagg

SEQ ID NO: 2226077 - DNA, 19 bp, Homo sapiens
cgaggccttctctgaagga

SEQ ID NO: 2226078 - DNA, 15 bp, Homo sapiens
cgagggccccacgtc

SEQ ID NO: 2226079 - DNA, 17 bp, Homo sapiens
cgagggccccacgtccc

SEQ ID NO: 2226080 - DNA, 14 bp, Homo sapiens
cgagtagctgggac

SEQ ID NO: 2226081 - DNA, 17 bp, Homo sapiens
cgagttacagacaaagc

SEQ ID NO: 2226082 - DNA, 18 bp, Homo sapiens
cgagttacagacaaagcg

SEQ ID NO: 2226083 - DNA, 19 bp, Homo sapiens
cgatctgggttcactgcaa

SEQ ID NO: 2226084 - DNA, 13 bp, Homo sapiens
cgcactgggcttg

SEQ ID NO: 2226085 - DNA, 14 bp, Homo sapiens
cgcagacaggacca

SEQ ID NO: 2226086 - DNA, 19 bp, Homo sapiens
cgcagcatattcaggaagc

SEQ ID NO: 2226087 - DNA, 20 bp, Homo sapiens
cgcagcatattcaggaagct

SEQ ID NO: 2226088 - DNA, 14 bp, Homo sapiens
cgcagccctgcaga

SEQ ID NO: 2226089 - DNA, 19 bp, Homo sapiens
cgcagccctgcagagggca

SEQ ID NO: 2226090 - DNA, 12 bp, Homo sapiens
cgccaaggctgg

SEQ ID NO: 2226091 - DNA, 21 bp, Homo sapiens
cgccagattctttcctgaggc

SEQ ID NO: 2226092 - DNA, 19 bp, Homo sapiens
cgcccagtctggaatgcag

SEQ ID NO: 2226093 - DNA, 12 bp, Homo sapiens
cgccccatcctc

SEQ ID NO: 2226094 - DNA, 15 bp, Homo sapiens
cgcccccactggtga

SEQ ID NO: 2226095 - DNA, 14 bp, Homo sapiens
cgcctgccctccca

SEQ ID NO: 2226096 - DNA, 17 bp, Homo sapiens
cgcgacaatgcaaacca

SEQ ID NO: 2226097 - DNA, 19 bp, Homo sapiens
cgcggtggctcacgcctgt

SEQ ID NO: 2226098 - DNA, 21 bp, Homo sapiens
cgctacccgggaagggggctg

SEQ ID NO: 2226099 - DNA, 24 bp, Homo sapiens
cgctacccgggaagggggctggga

SEQ ID NO: 2226100 - DNA, 13 bp, Homo sapiens
cgctgcccctggc

SEQ ID NO: 2226101 - DNA, 16 bp, Homo sapiens
cgctgcccctggcagc

SEQ ID NO: 2226102 - DNA, 18 bp, Homo sapiens
cgctgcccctggcagccc

SEQ ID NO: 2226103 - DNA, 19 bp, Homo sapiens
cgctgcccctggcagcccc

SEQ ID NO: 2226104 - DNA, 20 bp, Homo sapiens
cgctgcccctggcagcccct

SEQ ID NO: 2226105 - DNA, 17 bp, Homo sapiens
cgctggggccagttggt

SEQ ID NO: 2226106 - DNA, 16 bp, Homo sapiens
cgctgtgctgccctgc

SEQ ID NO: 2226107 - DNA, 23 bp, Homo sapiens
cgctgtgctgccctgcccacctg

SEQ ID NO: 2226108 - DNA, 14 bp, Homo sapiens
cgctttctacccag

SEQ ID NO: 2226109 - DNA, 16 bp, Homo sapiens
cggaatagttggctag

SEQ ID NO: 2226110 - DNA, 17 bp, Homo sapiens
cggaatagttggctagg

SEQ ID NO: 2226111 - DNA, 15 bp, Homo sapiens
cggacagccacggcc

SEQ ID NO: 2226112 - DNA, 15 bp, Homo sapiens
cggagaaaggaaggg

SEQ ID NO: 2226113 - DNA, 20 bp, Homo sapiens
cggagtcccaccttggctgc

SEQ ID NO: 2226114 - DNA, 21 bp, Homo sapiens
cggagtcccaccttggctgca

SEQ ID NO: 2226115 - DNA, 22 bp, Homo sapiens
cggagtcccaccttggctgcag

SEQ ID NO: 2226116 - DNA, 15 bp, Homo sapiens
cggccacctgcggtg

SEQ ID NO: 2226117 - DNA, 12 bp, Homo sapiens
cggccaggccag

SEQ ID NO: 2226118 - DNA, 16 bp, Homo sapiens
cggctcactgcagcct

SEQ ID NO: 2226119 - DNA, 14 bp, Homo sapiens
cggctggcctggcc

SEQ ID NO: 2226120 - DNA, 22 bp, Homo sapiens
cggctggcctggcccctcaggg

SEQ ID NO: 2226121 - DNA, 19 bp, Homo sapiens
cgggaagggggctgggaca

SEQ ID NO: 2226122 - DNA, 20 bp, Homo sapiens
cgggaagggggctgggacat

SEQ ID NO: 2226123 - DNA, 17 bp, Homo sapiens
cgggaggtcgaggcagg

SEQ ID NO: 2226124 - DNA, 18 bp, Homo sapiens
cgggaggtcgaggcagga

SEQ ID NO: 2226125 - DNA, 20 bp, Homo sapiens
cgggaggtcgaggcaggagg

SEQ ID NO: 2226126 - DNA, 17 bp, Homo sapiens
cgggccacagagaaagt

SEQ ID NO: 2226127 - DNA, 15 bp, Homo sapiens
cgggctcagcaaaag

SEQ ID NO: 2226128 - DNA, 12 bp, Homo sapiens
cgggctctgcct

SEQ ID NO: 2226129 - DNA, 16 bp, Homo sapiens
cgggctctgcctccca

SEQ ID NO: 2226130 - DNA, 17 bp, Homo sapiens
cgggctctgcctcccat

SEQ ID NO: 2226131 - DNA, 14 bp, Homo sapiens
cggggacagctcct

SEQ ID NO: 2226132 - DNA, 11 bp, Homo sapiens
ctccttcttcc

SEQ ID NO: 2226133 - DNA, 17 bp, Homo sapiens
ctcctttagcgcccagt

SEQ ID NO: 2226134 - DNA, 17 bp, Homo sapiens
ctcctttgtgaggaagc

SEQ ID NO: 2226135 - DNA, 19 bp, Homo sapiens
ctcgagcatgcctggatgg

SEQ ID NO: 2226136 - DNA, 13 bp, Homo sapiens
ctctacagaggcc

SEQ ID NO: 2226137 - DNA, 23 bp, Homo sapiens
ctctagggaaaaaccagcgtgtg

SEQ ID NO: 2226138 - DNA, 20 bp, Homo sapiens
ctctagtttgattaaattct

SEQ ID NO: 2226139 - DNA, 10 bp, Homo sapiens
ctctattttt

SEQ ID NO: 2226140 - DNA, 12 bp, Homo sapiens
ctctatttttgt

SEQ ID NO: 2226141 - DNA, 22 bp, Homo sapiens
ctctatttttgtaaaaagggaa

SEQ ID NO: 2226142 - DNA, 21 bp, Homo sapiens
ctctcaggccaaactcacctg

SEQ ID NO: 2226143 - DNA, 13 bp, Homo sapiens
ctctcaggccagc

SEQ ID NO: 2226144 - DNA, 15 bp, Homo sapiens
ctctcaggccagctg

SEQ ID NO: 2226145 - DNA, 17 bp, Homo sapiens
ctctcaggccagctgct

SEQ ID NO: 2226146 - DNA, 12 bp, Homo sapiens
ctctccagcccc

SEQ ID NO: 2226147 - DNA, 16 bp, Homo sapiens
ctctccagcccctgga

SEQ ID NO: 2226148 - DNA, 18 bp, Homo sapiens
ctctccagcccctggatg

SEQ ID NO: 2226149 - DNA, 22 bp, Homo sapiens
ctctccccagcaagtgagagct

SEQ ID NO: 2226150 - DNA, 24 bp, Homo sapiens
ctctccccagcaagtgagagctgg

SEQ ID NO: 2226151 - DNA, 21 bp, Homo sapiens
ctctccgaccagacaccttga

SEQ ID NO: 2226152 - DNA, 12 bp, Homo sapiens
ctctcctccaga

SEQ ID NO: 2226153 - DNA, 14 bp, Homo sapiens
ctctgacacacagc

SEQ ID NO: 2226154 - DNA, 18 bp, Homo sapiens
ctctgacacacagctctg

SEQ ID NO: 2226155 - DNA, 23 bp, Homo sapiens
ctctgagactcgcgacaatgcaa

SEQ ID NO: 2226156 - DNA, 19 bp, Homo sapiens
ctctgcacaagctgcaccc

SEQ ID NO: 2226157 - DNA, 20 bp, Homo sapiens
ctctgcacaagctgcaccct

SEQ ID NO: 2226158 - DNA, 16 bp, Homo sapiens
ctctgcactcccctgc

SEQ ID NO: 2226159 - DNA, 18 bp, Homo sapiens
ctctgcagcaataaagca

SEQ ID NO: 2226160 - DNA, 13 bp, Homo sapiens
ctctgcccactcc

SEQ ID NO: 2226161 - DNA, 16 bp, Homo sapiens
ctctgcccactccctg

SEQ ID NO: 2226162 - DNA, 20 bp, Homo sapiens
ctctgcccactccctgcaac

SEQ ID NO: 2226163 - DNA, 20 bp, Homo sapiens
ctctgcctctgacacacagc

SEQ ID NO: 2226164 - DNA, 13 bp, Homo sapiens
ctctgctcctctc

SEQ ID NO: 2226165 - DNA, 14 bp, Homo sapiens
ctctgctgacagac

SEQ ID NO: 2226166 - DNA, 21 bp, Homo sapiens
ctctgctgacagacacaggcc

SEQ ID NO: 2226167 - DNA, 15 bp, Homo sapiens
ctctgctgctggctg

SEQ ID NO: 2226168 - DNA, 14 bp, Homo sapiens
ctctggacaggcat

SEQ ID NO: 2226169 - DNA, 23 bp, Homo sapiens
ctctggcagctcagagagggtgg

SEQ ID NO: 2226170 - DNA, 12 bp, Homo sapiens
ctctggggtggg

SEQ ID NO: 2226171 - DNA, 13 bp, Homo sapiens
ctctggggtggga

SEQ ID NO: 2226172 - DNA, 17 bp, Homo sapiens
ctctggggtgggagggt

SEQ ID NO: 2226173 - DNA, 14 bp, Homo sapiens
ctctggtccataga

SEQ ID NO: 2226174 - DNA, 16 bp, Homo sapiens
ctctggtccatagaga

SEQ ID NO: 2226175 - DNA, 13 bp, Homo sapiens
ctctgtacagagc

SEQ ID NO: 2226176 - DNA, 14 bp, Homo sapiens
ctctgtacagagcc

SEQ ID NO: 2226177 - DNA, 17 bp, Homo sapiens
ctctgtacagagcccac

SEQ ID NO: 2226178 - DNA, 22 bp, Homo sapiens
ctctgtcctgggagtgagctgg

SEQ ID NO: 2226179 - DNA, 13 bp, Homo sapiens
ctctgtcgcccag

SEQ ID NO: 2226180 - DNA, 20 bp, Homo sapiens
ctctgtgtcaggtggggcag

SEQ ID NO: 2226181 - DNA, 13 bp, Homo sapiens
ctcttagaaaaac

SEQ ID NO: 2226182 - DNA, 15 bp, Homo sapiens
ctcttagaaaaacca

SEQ ID NO: 2226183 - DNA, 15 bp, Homo sapiens
ctcttattgcccacg

SEQ ID NO: 2226184 - DNA, 15 bp, Homo sapiens
ctcttgacctcaggt

SEQ ID NO: 2226185 - DNA, 16 bp, Homo sapiens
ctcttgagccttgaac

SEQ ID NO: 2226186 - DNA, 16 bp, Homo sapiens
ctcttggtcctgctgc

SEQ ID NO: 2226187 - DNA, 18 bp, Homo sapiens
ctctttaatgtcacaggc

SEQ ID NO: 2226188 - DNA, 22 bp, Homo sapiens
ctctttaatgtcacaggcaggt

SEQ ID NO: 2226189 - DNA, 23 bp, Homo sapiens
ctctttaatgtcacaggcaggtc

SEQ ID NO: 2226190 - DNA, 17 bp, Homo sapiens
ctctttccatctaccct

SEQ ID NO: 2226191 - DNA, 18 bp, Homo sapiens
ctctttgggcctggctcc

SEQ ID NO: 2226192 - DNA, 21 bp, Homo sapiens
ctctttggtctacactgtgct

SEQ ID NO: 2226193 - DNA, 17 bp, Homo sapiens
ctgaaagccctgagctt

SEQ ID NO: 2226194 - DNA, 15 bp, Homo sapiens
ctgaacttggcgctg

SEQ ID NO: 2226195 - DNA, 19 bp, Homo sapiens
ctgaagaattgaaaaacca

SEQ ID NO: 2226196 - DNA, 23 bp, Homo sapiens
ctgaaggacattgcggacagcca

SEQ ID NO: 2226197 - DNA, 14 bp, Homo sapiens
ctgaaggccccgcc

SEQ ID NO: 2226198 - DNA, 16 bp, Homo sapiens
ctgaatacagaggcaa

SEQ ID NO: 2226199 - DNA, 19 bp, Homo sapiens
ctgaatggttttcaaaata

SEQ ID NO: 2226200 - DNA, 20 bp, Homo sapiens
ctgaatggttttcaaaataa

SEQ ID NO: 2226201 - DNA, 23 bp, Homo sapiens
ctgacaacactcattgacctgag

SEQ ID NO: 2226202 - DNA, 19 bp, Homo sapiens
ctgacacacagctctgtcc

SEQ ID NO: 2226203 - DNA, 21 bp, Homo sapiens
ctgacacacagctctgtcctg

SEQ ID NO: 2226204 - DNA, 14 bp, Homo sapiens
ctgacagacacagg

SEQ ID NO: 2226205 - DNA, 16 bp, Homo sapiens
ctgacagacacaggcc

SEQ ID NO: 2226206 - DNA, 18 bp, Homo sapiens
ctgacagacacaggcccg

SEQ ID NO: 2226207 - DNA, 19 bp, Homo sapiens
ctgacagacacaggcccgg

SEQ ID NO: 2226208 - DNA, 19 bp, Homo sapiens
ctgacaggcaatgctggct

SEQ ID NO: 2226209 - DNA, 20 bp, Homo sapiens
ctgacaggcaatgctggctg

SEQ ID NO: 2226210 - DNA, 13 bp, Homo sapiens
ctgacccactgct

SEQ ID NO: 2226211 - DNA, 17 bp, Homo sapiens
ctgcaccggctggcctg

SEQ ID NO: 2226212 - DNA, 19 bp, Homo sapiens
ctgcaccggctggcctggc

SEQ ID NO: 2226213 - DNA, 14 bp, Homo sapiens
ctgcaccgggccac

SEQ ID NO: 2226214 - DNA, 17 bp, Homo sapiens
ctgcactatagcctagg

SEQ ID NO: 2226215 - DNA, 17 bp, Homo sapiens
ctgcactccagcctggg

SEQ ID NO: 2226216 - DNA, 14 bp, Homo sapiens
ctgcactcccctgc

SEQ ID NO: 2226217 - DNA, 15 bp, Homo sapiens
ctgcactcccctgct

SEQ ID NO: 2226218 - DNA, 16 bp, Homo sapiens
ctgcactcccctgctg

SEQ ID NO: 2226219 - DNA, 21 bp, Homo sapiens
ctgcactcccctgctgggtgt

SEQ ID NO: 2226220 - DNA, 16 bp, Homo sapiens
ctgcagcaataaagca

SEQ ID NO: 2226221 - DNA, 11 bp, Homo sapiens
ctgcagcctca

SEQ ID NO: 2226222 - DNA, 19 bp, Homo sapiens
ctgcagcctcaacctcctg

SEQ ID NO: 2226223 - DNA, 12 bp, Homo sapiens
ctgcagctttgt

SEQ ID NO: 2226224 - DNA, 13 bp, Homo sapiens
ctgcaggcagcca

SEQ ID NO: 2226225 - DNA, 14 bp, Homo sapiens
ctgcaggcagccag

SEQ ID NO: 2226226 - DNA, 17 bp, Homo sapiens
ctgcagttgccagtcac

SEQ ID NO: 2226227 - DNA, 21 bp, Homo sapiens
ctgcagttgccagtcaccccg

SEQ ID NO: 2226228 - DNA, 13 bp, Homo sapiens
ctgcattggcttt

SEQ ID NO: 2226229 - DNA, 14 bp, Homo sapiens
ctgcatttaaaaga

SEQ ID NO: 2226230 - DNA, 18 bp, Homo sapiens
ctgccaatgggagctcat

SEQ ID NO: 2226231 - DNA, 21 bp, Homo sapiens
ctgccaccctggggagaaagt

SEQ ID NO: 2226232 - DNA, 14 bp, Homo sapiens
ctgccaggaagcca

SEQ ID NO: 2226233 - DNA, 20 bp, Homo sapiens
ctgccaggaagccagcaggc

SEQ ID NO: 2226234 - DNA, 15 bp, Homo sapiens
ctgccagggacagag

SEQ ID NO: 2226235 - DNA, 20 bp, Homo sapiens
ctgccagggacagagggggt

SEQ ID NO: 2226236 - DNA, 22 bp, Homo sapiens
ctgccagggacagagggggtgg

SEQ ID NO: 2226237 - DNA, 20 bp, Homo sapiens
ctgccatattctgttggcca

SEQ ID NO: 2226238 - DNA, 21 bp, Homo sapiens
ctgccatattctgttggccag

SEQ ID NO: 2226239 - DNA, 22 bp, Homo sapiens
ctgccatattctgttggccagt

SEQ ID NO: 2226240 - DNA, 12 bp, Homo sapiens
ctgccatccagg

SEQ ID NO: 2226241 - DNA, 18 bp, Homo sapiens
ctgccatccaggttcagc

SEQ ID NO: 2226242 - DNA, 19 bp, Homo sapiens
ctgccatgccagcttatct

SEQ ID NO: 2226243 - DNA, 12 bp, Homo sapiens
ctgcccacctgg

SEQ ID NO: 2226244 - DNA, 14 bp, Homo sapiens
ctgcccactccctg

SEQ ID NO: 2226245 - DNA, 13 bp, Homo sapiens
ctgcccaggcccc

SEQ ID NO: 2226246 - DNA, 16 bp, Homo sapiens
ctgcccaggcccctgc

SEQ ID NO: 2226247 - DNA, 18 bp, Homo sapiens
ctgcccaggcccctgcca

SEQ ID NO: 2226248 - DNA, 20 bp, Homo sapiens
ctgcccaggcccctgccacc

SEQ ID NO: 2226249 - DNA, 12 bp, Homo sapiens
ctgcccccaccc

SEQ ID NO: 2226250 - DNA, 20 bp, Homo sapiens
ctgcccccaccccaggctgg

SEQ ID NO: 2226251 - DNA, 14 bp, Homo sapiens
ctgcccctcaactc

SEQ ID NO: 2226252 - DNA, 17 bp, Homo sapiens
ctgcccctggcagcccc

SEQ ID NO: 2226253 - DNA, 13 bp, Homo sapiens
ctgcccggcaggg

SEQ ID NO: 2226254 - DNA, 14 bp, Homo sapiens
ctgccctcccaccc

SEQ ID NO: 2226255 - DNA, 17 bp, Homo sapiens
ctgccctgcccacctgg

SEQ ID NO: 2226256 - DNA, 16 bp, Homo sapiens
ctgccctgtgggcccc

SEQ ID NO: 2226257 - DNA, 17 bp, Homo sapiens
ctgcccttacctgccag

SEQ ID NO: 2226258 - DNA, 19 bp, Homo sapiens
ctgcccttacctgccagga

SEQ ID NO: 2226259 - DNA, 15 bp, Homo sapiens
ctgccgcagccctgc

SEQ ID NO: 2226260 - DNA, 17 bp, Homo sapiens
ctgccgcagccctgcag

SEQ ID NO: 2226261 - DNA, 19 bp, Homo sapiens
ctgccgcagccctgcagag

SEQ ID NO: 2226262 - DNA, 22 bp, Homo sapiens
ctgccgcagccctgcagagggc

SEQ ID NO: 2226263 - DNA, 23 bp, Homo sapiens
ctgccgcagccctgcagagggca

SEQ ID NO: 2226264 - DNA, 15 bp, Homo sapiens
ctgcctcagcctccc

SEQ ID NO: 2226265 - DNA, 14 bp, Homo sapiens
ctgcctcctttgtg

SEQ ID NO: 2226266 - DNA, 17 bp, Homo sapiens
ctgcctcctttgtgagg

SEQ ID NO: 2226267 - DNA, 23 bp, Homo sapiens
ctgcctcctttgtgaggaagccg

SEQ ID NO: 2226268 - DNA, 18 bp, Homo sapiens
ctgcctcgaactggctgc

SEQ ID NO: 2226269 - DNA, 15 bp, Homo sapiens
ctgcctctcccatca

SEQ ID NO: 2226270 - DNA, 23 bp, Homo sapiens
ctgcctctcccatcacttcccta

SEQ ID NO: 2226271 - DNA, 21 bp, Homo sapiens
ctgcctctgacacacagctct

SEQ ID NO: 2226272 - DNA, 22 bp, Homo sapiens
ctgcctctgacacacagctctg

SEQ ID NO: 2226273 - DNA, 15 bp, Homo sapiens
ctgcctgaagtcaca

SEQ ID NO: 2226274 - DNA, 23 bp, Homo sapiens
ctgcctgaagtcacacagtgagt

SEQ ID NO: 2226275 - DNA, 15 bp, Homo sapiens
ctgcctgcccaggcc

SEQ ID NO: 2226276 - DNA, 17 bp, Homo sapiens
ctgcctgcccaggcccc

SEQ ID NO: 2226277 - DNA, 22 bp, Homo sapiens
ctgcctgggatccctcatcctc

SEQ ID NO: 2226278 - DNA, 23 bp, Homo sapiens
ctgcctgggatccctcatcctca

SEQ ID NO: 2226279 - DNA, 14 bp, Homo sapiens
ctgcctgttcagct

SEQ ID NO: 2226280 - DNA, 17 bp, Homo sapiens
ctgcctgttcagctcca

SEQ ID NO: 2226281 - DNA, 18 bp, Homo sapiens
ctgcctgttgggccagga

SEQ ID NO: 2226282 - DNA, 20 bp, Homo sapiens
ctgcctgttgggccaggagc

SEQ ID NO: 2226283 - DNA, 21 bp, Homo sapiens
ctgcctgttgggccaggagcc

SEQ ID NO: 2226284 - DNA, 20 bp, Homo sapiens
ctgcggaatgaaccacatct

SEQ ID NO: 2226285 - DNA, 19 bp, Homo sapiens
ctgcggtccacccaggagc

SEQ ID NO: 2226286 - DNA, 20 bp, Homo sapiens
ctgcggtgctatctccccca

SEQ ID NO: 2226287 - DNA, 16 bp, Homo sapiens
ctgctaattccccaga

SEQ ID NO: 2226288 - DNA, 16 bp, Homo sapiens
ctgctcacatatctgt

SEQ ID NO: 2226289 - DNA, 17 bp, Homo sapiens
ctgctcctctccccagc

SEQ ID NO: 2226290 - DNA, 18 bp, Homo sapiens
ctgctcctctccccagca

SEQ ID NO: 2226291 - DNA, 15 bp, Homo sapiens
ctgctctccgaccag

SEQ ID NO: 2226292 - DNA, 13 bp, Homo sapiens
ctgctgaaggctc

SEQ ID NO: 2226293 - DNA, 14 bp, Homo sapiens
ctgctgaaggctcg

SEQ ID NO: 2226294 - DNA, 15 bp, Homo sapiens
ctgctgaaggctcga

SEQ ID NO: 2226295 - DNA, 18 bp, Homo sapiens
ctgctgaaggctcgagca

SEQ ID NO: 2226296 - DNA, 23 bp, Homo sapiens
ctgctgaaggctcgagcatgcct

SEQ ID NO: 2226297 - DNA, 20 bp, Homo sapiens
ctgctgacagacacaggccc

SEQ ID NO: 2226298 - DNA, 15 bp, Homo sapiens
ctgttctctgccctc

SEQ ID NO: 2226299 - DNA, 20 bp, Homo sapiens
ctgttctctgccctccaaga

SEQ ID NO: 2226300 - DNA, 19 bp, Homo sapiens
ctgttctttccaaagtaca

SEQ ID NO: 2226301 - DNA, 21 bp, Homo sapiens
ctgttctttctggctatgcat

SEQ ID NO: 2226302 - DNA, 23 bp, Homo sapiens
ctgttctttctggctatgcattt

SEQ ID NO: 2226303 - DNA, 12 bp, Homo sapiens
ctgttgcccagg

SEQ ID NO: 2226304 - DNA, 14 bp, Homo sapiens
ctgttgcccaggct

SEQ ID NO: 2226305 - DNA, 18 bp, Homo sapiens
ctgttgcccaggctggcg

SEQ ID NO: 2226306 - DNA, 19 bp, Homo sapiens
ctgttggctgggggcctca

SEQ ID NO: 2226307 - DNA, 15 bp, Homo sapiens
ctgtttcaaacttta

SEQ ID NO: 2226308 - DNA, 13 bp, Homo sapiens
cttaaataatgtg

SEQ ID NO: 2226309 - DNA, 12 bp, Homo sapiens
cttaacttcaca

SEQ ID NO: 2226310 - DNA, 14 bp, Homo sapiens
cttaacttcacata

SEQ ID NO: 2226311 - DNA, 16 bp, Homo sapiens
cttaacttcacatatt

SEQ ID NO: 2226312 - DNA, 17 bp, Homo sapiens
cttaacttcacatattg

SEQ ID NO: 2226313 - DNA, 20 bp, Homo sapiens
cttaattcttagctcattct

SEQ ID NO: 2226314 - DNA, 13 bp, Homo sapiens
cttacacaatggt

SEQ ID NO: 2226315 - DNA, 17 bp, Homo sapiens
cttaccctcatgttctt

SEQ ID NO: 2226316 - DNA, 13 bp, Homo sapiens
cttacctcggtgc

SEQ ID NO: 2226317 - DNA, 19 bp, Homo sapiens
cttacctcggtgccttcct

SEQ ID NO: 2226318 - DNA, 11 bp, Homo sapiens
cttagacagtc

SEQ ID NO: 2226319 - DNA, 19 bp, Homo sapiens
cttagatgtatatatttcc

SEQ ID NO: 2226320 - DNA, 18 bp, Homo sapiens
cttagcagggaaacagct

SEQ ID NO: 2226321 - DNA, 20 bp, Homo sapiens
cttagtcactgagacagccc

SEQ ID NO: 2226322 - DNA, 21 bp, Homo sapiens
cttagtcactgagacagcccg

SEQ ID NO: 2226323 - DNA, 15 bp, Homo sapiens
cttatacatttgata

SEQ ID NO: 2226324 - DNA, 16 bp, Homo sapiens
cttatggaacactctg

SEQ ID NO: 2226325 - DNA, 21 bp, Homo sapiens
cttatggaacactctgagact

SEQ ID NO: 2226326 - DNA, 17 bp, Homo sapiens
cttatttaatgaaagac

SEQ ID NO: 2226327 - DNA, 15 bp, Homo sapiens
cttcaaatatttccc

SEQ ID NO: 2226328 - DNA, 21 bp, Homo sapiens
cttcaaggatcctgagccaga

SEQ ID NO: 2226329 - DNA, 23 bp, Homo sapiens
cttcacagatgggtgcttggagg

SEQ ID NO: 2226330 - DNA, 21 bp, Homo sapiens
cttcacctttgtccccaccgc

SEQ ID NO: 2226331 - DNA, 24 bp, Homo sapiens
cttcagagactcctgcaggcagcc

SEQ ID NO: 2226332 - DNA, 16 bp, Homo sapiens
cttcagcctcccgagt

SEQ ID NO: 2226333 - DNA, 15 bp, Homo sapiens
cttcagctgactttt

SEQ ID NO: 2226334 - DNA, 16 bp, Homo sapiens
cttcagtaagccgtga

SEQ ID NO: 2226335 - DNA, 12 bp, Homo sapiens
cttcagtgcctt

SEQ ID NO: 2226336 - DNA, 13 bp, Homo sapiens
cttcagtgcctta

SEQ ID NO: 2226337 - DNA, 15 bp, Homo sapiens
cttcagtggcagctg

SEQ ID NO: 2226338 - DNA, 13 bp, Homo sapiens
cttcatccctctg

SEQ ID NO: 2226339 - DNA, 15 bp, Homo sapiens
cttccacaagagccc

SEQ ID NO: 2226340 - DNA, 17 bp, Homo sapiens
cttccacaagagcccag

SEQ ID NO: 2226341 - DNA, 21 bp, Homo sapiens
cttccacaagagcccaggcct

SEQ ID NO: 2226342 - DNA, 14 bp, Homo sapiens
cttccaggggtggg

SEQ ID NO: 2226343 - DNA, 24 bp, Homo sapiens
cttccaggggtgggacaccctgtg

SEQ ID NO: 2226344 - DNA, 14 bp, Homo sapiens
cttccagtgaggct

SEQ ID NO: 2226345 - DNA, 17 bp, Homo sapiens
cttccagtgaggctctg

SEQ ID NO: 2226346 - DNA, 18 bp, Homo sapiens
cttccagtgaggctctgc

SEQ ID NO: 2226347 - DNA, 19 bp, Homo sapiens
cttccagtgaggctctgcc

SEQ ID NO: 2226348 - DNA, 22 bp, Homo sapiens
cttccagtgaggctctgccctt

SEQ ID NO: 2226349 - DNA, 23 bp, Homo sapiens
cttccagtgaggctctgcccttg

SEQ ID NO: 2226350 - DNA, 23 bp, Homo sapiens
cttcccacctctctcactccttg

SEQ ID NO: 2226351 - DNA, 13 bp, Homo sapiens
cttcctcctggtg

SEQ ID NO: 2226352 - DNA, 13 bp, Homo sapiens
cttcgctcctgtg

SEQ ID NO: 2226353 - DNA, 15 bp, Homo sapiens
cttcgctcctgtgtc

SEQ ID NO: 2226354 - DNA, 20 bp, Homo sapiens
cttcgggaggtcgaggcagg

SEQ ID NO: 2226355 - DNA, 21 bp, Homo sapiens
cttcgggaggtcgaggcagga

SEQ ID NO: 2226356 - DNA, 16 bp, Homo sapiens
cttctcactgccatgc

SEQ ID NO: 2226357 - DNA, 15 bp, Homo sapiens
cttctccaccctgct

SEQ ID NO: 2226358 - DNA, 17 bp, Homo sapiens
cttctccaccctgctct

SEQ ID NO: 2226359 - DNA, 12 bp, Homo sapiens
cttctccaggct

SEQ ID NO: 2226360 - DNA, 12 bp, Homo sapiens
cttctctccagc

SEQ ID NO: 2226361 - DNA, 13 bp, Homo sapiens
cttctctccagcc

SEQ ID NO: 2226362 - DNA, 15 bp, Homo sapiens
cttctctccagcccc

SEQ ID NO: 2226363 - DNA, 17 bp, Homo sapiens
cttctctccagcccctg

SEQ ID NO: 2226364 - DNA, 15 bp, Homo sapiens
cttctgacccatgct

SEQ ID NO: 2226365 - DNA, 17 bp, Homo sapiens
cttctgacccatgctgc

SEQ ID NO: 2226366 - DNA, 21 bp, Homo sapiens
cttctgccatattctgttggc

SEQ ID NO: 2226367 - DNA, 17 bp, Homo sapiens
cttctgcttcagcctcc

SEQ ID NO: 2226368 - DNA, 15 bp, Homo sapiens
cttctgtacgtctga

SEQ ID NO: 2226369 - DNA, 21 bp, Homo sapiens
cttctgtgggtttctaaagct

SEQ ID NO: 2226370 - DNA, 13 bp, Homo sapiens
cttcttatacatt

SEQ ID NO: 2226371 - DNA, 13 bp, Homo sapiens
cttcttcagagac

SEQ ID NO: 2226372 - DNA, 20 bp, Homo sapiens
cttcttcagagactcctgca

SEQ ID NO: 2226373 - DNA, 22 bp, Homo sapiens
cttcttcagagactcctgcagg

SEQ ID NO: 2226374 - DNA, 14 bp, Homo sapiens
cttgaaaacactgt

SEQ ID NO: 2226375 - DNA, 16 bp, Homo sapiens
cttgaactgggtactt

SEQ ID NO: 2226376 - DNA, 18 bp, Homo sapiens
cttgaactgggtacttgt

SEQ ID NO: 2226377 - DNA, 15 bp, Homo sapiens
cttgaactttgacct

SEQ ID NO: 2226378 - DNA, 21 bp, Homo sapiens
cttgaactttgacctctgcag

SEQ ID NO: 2226379 - DNA, 16 bp, Homo sapiens
cttgaagacttttctt

SEQ ID NO: 2226380 - DNA, 19 bp, Homo sapiens
cttgaattgtaaggaatga

SEQ ID NO: 2226381 - DNA, 16 bp, Homo sapiens
cttgacatcaactgca

SEQ ID NO: 2226382 - DNA, 20 bp, Homo sapiens
cttgaccattctccacctgc

SEQ ID NO: 2226383 - DNA, 17 bp, Homo sapiens
cttgaccgtgaggccag

SEQ ID NO: 2226384 - DNA, 18 bp, Homo sapiens
cttgaccgtgaggccaga

SEQ ID NO: 2226385 - DNA, 13 bp, Homo sapiens
cttgacctcaggt

SEQ ID NO: 2226386 - DNA, 14 bp, Homo sapiens
cttgagagggtgga

SEQ ID NO: 2226387 - DNA, 12 bp, Homo sapiens
cttgagcctggg

SEQ ID NO: 2226388 - DNA, 20 bp, Homo sapiens
cttgagggttgggctggtgt

SEQ ID NO: 2226389 - DNA, 12 bp, Homo sapiens
cttgcaaagtat

SEQ ID NO: 2226390 - DNA, 14 bp, Homo sapiens
cttgcaatggcagc

SEQ ID NO: 2226391 - DNA, 18 bp, Homo sapiens
cttgcagactctacagag

SEQ ID NO: 2226392 - DNA, 13 bp, Homo sapiens
cttgcatgaggct

SEQ ID NO: 2226393 - DNA, 17 bp, Homo sapiens
cttgcatgaggctagtg

SEQ ID NO: 2226394 - DNA, 21 bp, Homo sapiens
cttgcatgaggctagtgtggt

SEQ ID NO: 2226395 - DNA, 18 bp, Homo sapiens
cttgcccaggcctcccca

SEQ ID NO: 2226396 - DNA, 19 bp, Homo sapiens
cttgccgtctacctgaggg

SEQ ID NO: 2226397 - DNA, 23 bp, Homo sapiens
cttgccgtctacctgaggggcct

SEQ ID NO: 2226398 - DNA, 14 bp, Homo sapiens
cttggaagctccgc

SEQ ID NO: 2226399 - DNA, 13 bp, Homo sapiens
cttggaggaagga

SEQ ID NO: 2226400 - DNA, 22 bp, Homo sapiens
cttggaggaaggaaacccagct

SEQ ID NO: 2226401 - DNA, 14 bp, Homo sapiens
cttggattgtcccc

SEQ ID NO: 2226402 - DNA, 16 bp, Homo sapiens
acggctcactgcagcc

SEQ ID NO: 2226403 - DNA, 15 bp, Homo sapiens
acggttttactgcag

SEQ ID NO: 2226404 - DNA, 17 bp, Homo sapiens
acggttttactgcagct

SEQ ID NO: 2226405 - DNA, 23 bp, Homo sapiens
acgtctgacaggcaatgctggct

SEQ ID NO: 2226406 - DNA, 18 bp, Homo sapiens
acgtggctgcttcaagga

SEQ ID NO: 2226407 - DNA, 12 bp, Homo sapiens
acgtttctaaag

SEQ ID NO: 2226408 - DNA, 22 bp, Homo sapiens
acgtttctaaaggctacctttg

SEQ ID NO: 2226409 - DNA, 15 bp, Homo sapiens
actaagtttttatgg

SEQ ID NO: 2226410 - DNA, 23 bp, Homo sapiens
actacaggtgtgagtcaccaagc

SEQ ID NO: 2226411 - DNA, 15 bp, Homo sapiens
actacagtcctccca

SEQ ID NO: 2226412 - DNA, 17 bp, Homo sapiens
actacagtcctcccatc

SEQ ID NO: 2226413 - DNA, 13 bp, Homo sapiens
actacagtttgtt

SEQ ID NO: 2226414 - DNA, 12 bp, Homo sapiens
actacattctgt

SEQ ID NO: 2226415 - DNA, 18 bp, Homo sapiens
actatagcctaggtgaca

SEQ ID NO: 2226416 - DNA, 22 bp, Homo sapiens
actatggccctggcctagcata

SEQ ID NO: 2226417 - DNA, 14 bp, Homo sapiens
actatgttgcccag

SEQ ID NO: 2226418 - DNA, 13 bp, Homo sapiens
actcaaaagctgg

SEQ ID NO: 2226419 - DNA, 17 bp, Homo sapiens
actcaaactcttaaaac

SEQ ID NO: 2226420 - DNA, 14 bp, Homo sapiens
actcaatgcactga

SEQ ID NO: 2226421 - DNA, 16 bp, Homo sapiens
actcaccccagcccca

SEQ ID NO: 2226422 - DNA, 14 bp, Homo sapiens
actcacctgcccct

SEQ ID NO: 2226423 - DNA, 19 bp, Homo sapiens
actcacctgcccctcaact

SEQ ID NO: 2226424 - DNA, 12 bp, Homo sapiens
actcatcttagg

SEQ ID NO: 2226425 - DNA, 14 bp, Homo sapiens
actcattgacctga

SEQ ID NO: 2226426 - DNA, 17 bp, Homo sapiens
actccagaatttcccaa

SEQ ID NO: 2226427 - DNA, 17 bp, Homo sapiens
actcctgcaggcagcca

SEQ ID NO: 2226428 - DNA, 21 bp, Homo sapiens
actctaccctcttagaaaaac

SEQ ID NO: 2226429 - DNA, 16 bp, Homo sapiens
actctatcaagtatta

SEQ ID NO: 2226430 - DNA, 14 bp, Homo sapiens
actctcctccagag

SEQ ID NO: 2226431 - DNA, 12 bp, Homo sapiens
actctcctctgc

SEQ ID NO: 2226432 - DNA, 13 bp, Homo sapiens
actctcctctgct

SEQ ID NO: 2226433 - DNA, 14 bp, Homo sapiens
actctcctctgctg

SEQ ID NO: 2226434 - DNA, 16 bp, Homo sapiens
actctccttggtgtcg

SEQ ID NO: 2226435 - DNA, 18 bp, Homo sapiens
actctggggtgggagggt

SEQ ID NO: 2226436 - DNA, 15 bp, Homo sapiens
actcttgacctcagg

SEQ ID NO: 2226437 - DNA, 17 bp, Homo sapiens
actgacattgttggcca

SEQ ID NO: 2226438 - DNA, 22 bp, Homo sapiens
actgacattgttggccaaagcc

SEQ ID NO: 2226439 - DNA, 23 bp, Homo sapiens
actgacattgttggccaaagcca

SEQ ID NO: 2226440 - DNA, 23 bp, Homo sapiens
actgatgggcaacccccagcctg

SEQ ID NO: 2226441 - DNA, 17 bp, Homo sapiens
actgatttttttttcct

SEQ ID NO: 2226442 - DNA, 18 bp, Homo sapiens
actgatttttttttcctt

SEQ ID NO: 2226443 - DNA, 19 bp, Homo sapiens
actgatttttttttccttc

SEQ ID NO: 2226444 - DNA, 20 bp, Homo sapiens
actgatttttttttccttca

SEQ ID NO: 2226445 - DNA, 22 bp, Homo sapiens
actgatttttttttccttcagt

SEQ ID NO: 2226446 - DNA, 16 bp, Homo sapiens
actgcaacctccgcct

SEQ ID NO: 2226447 - DNA, 21 bp, Homo sapiens
actgcactatagcctaggtga

SEQ ID NO: 2226448 - DNA, 17 bp, Homo sapiens
actgcactccagcctgg

SEQ ID NO: 2226449 - DNA, 22 bp, Homo sapiens
actgcccggcagggtcctagaa

SEQ ID NO: 2226450 - DNA, 17 bp, Homo sapiens
actgcttccagtgaggc

SEQ ID NO: 2226451 - DNA, 18 bp, Homo sapiens
actgcttccagtgaggct

SEQ ID NO: 2226452 - DNA, 23 bp, Homo sapiens
actgcttccagtgaggctctgcc

SEQ ID NO: 2226453 - DNA, 21 bp, Homo sapiens
actgcttgtgaaaggaaagag

SEQ ID NO: 2226454 - DNA, 16 bp, Homo sapiens
actgcttttggtctgt

SEQ ID NO: 2226455 - DNA, 14 bp, Homo sapiens
actggaagcacagc

SEQ ID NO: 2226456 - DNA, 14 bp, Homo sapiens
actggagaaaatgg

SEQ ID NO: 2226457 - DNA, 15 bp, Homo sapiens
actggagaaaatgga

SEQ ID NO: 2226458 - DNA, 15 bp, Homo sapiens
actggattaaactta

SEQ ID NO: 2226459 - DNA, 22 bp, Homo sapiens
actggattaaacttaatctaaa

SEQ ID NO: 2226460 - DNA, 22 bp, Homo sapiens
actggctgcaaagggtatcagg

SEQ ID NO: 2226461 - DNA, 22 bp, Homo sapiens
actggggattcttgaacttgaa

SEQ ID NO: 2226462 - DNA, 14 bp, Homo sapiens
actgtacaaagtag

SEQ ID NO: 2226463 - DNA, 20 bp, Homo sapiens
actgtacatgaaaacacatt

SEQ ID NO: 2226464 - DNA, 23 bp, Homo sapiens
actgtacatgaaaacacattttt

SEQ ID NO: 2226465 - DNA, 17 bp, Homo sapiens
actgtcctacccaccct

SEQ ID NO: 2226466 - DNA, 16 bp, Homo sapiens
actgtgccatgtgcca

SEQ ID NO: 2226467 - DNA, 17 bp, Homo sapiens
actgtgccatgtgccag

SEQ ID NO: 2226468 - DNA, 17 bp, Homo sapiens
actgttaatagttcagg

SEQ ID NO: 2226469 - DNA, 16 bp, Homo sapiens
actgttctctgccctc

SEQ ID NO: 2226470 - DNA, 17 bp, Homo sapiens
actgttctctgccctcc

SEQ ID NO: 2226471 - DNA, 18 bp, Homo sapiens
actgttctctgccctcca

SEQ ID NO: 2226472 - DNA, 21 bp, Homo sapiens
actgttctctgccctccaaga

SEQ ID NO: 2226473 - DNA, 13 bp, Homo sapiens
actgttgcccagg

SEQ ID NO: 2226474 - DNA, 17 bp, Homo sapiens
actgttgcccaggctgg

SEQ ID NO: 2226475 - DNA, 18 bp, Homo sapiens
actgttgcccaggctggc

SEQ ID NO: 2226476 - DNA, 15 bp, Homo sapiens
actgtttcaaacttt

SEQ ID NO: 2226477 - DNA, 14 bp, Homo sapiens
acttaaataatgtg

SEQ ID NO: 2226478 - DNA, 22 bp, Homo sapiens
acttaatctaaatggaaccact

SEQ ID NO: 2226479 - DNA, 16 bp, Homo sapiens
acttacactttatgca

SEQ ID NO: 2226480 - DNA, 13 bp, Homo sapiens
acttactgtacat

SEQ ID NO: 2226481 - DNA, 19 bp, Homo sapiens
acttcacatattgatttcc

SEQ ID NO: 2226482 - DNA, 16 bp, Homo sapiens
acttcatccctctggg

SEQ ID NO: 2226483 - DNA, 18 bp, Homo sapiens
acttccaatttacatact

SEQ ID NO: 2226484 - DNA, 20 bp, Homo sapiens
acttcgggaggtcgaggcag

SEQ ID NO: 2226485 - DNA, 20 bp, Homo sapiens
acttctgccatattctgttg

SEQ ID NO: 2226486 - DNA, 17 bp, Homo sapiens
acttcttatacatttga

SEQ ID NO: 2226487 - DNA, 18 bp, Homo sapiens
acttcttatacatttgat

SEQ ID NO: 2226488 - DNA, 22 bp, Homo sapiens
acttgcagactctacagaggcc

SEQ ID NO: 2226489 - DNA, 16 bp, Homo sapiens
acttggtttttaaaaa

SEQ ID NO: 2226490 - DNA, 20 bp, Homo sapiens
acttgtctttggaccctgag

SEQ ID NO: 2226491 - DNA, 17 bp, Homo sapiens
acttgtggacacagctc

SEQ ID NO: 2226492 - DNA, 19 bp, Homo sapiens
actttaccttttttataca

SEQ ID NO: 2226493 - DNA, 22 bp, Homo sapiens
actttaccttttttatacataa

SEQ ID NO: 2226494 - DNA, 23 bp, Homo sapiens
actttccttcattcaacccacct

SEQ ID NO: 2226495 - DNA, 13 bp, Homo sapiens
actttggaaagac

SEQ ID NO: 2226496 - DNA, 14 bp, Homo sapiens
actttggaaagact

SEQ ID NO: 2226497 - DNA, 21 bp, Homo sapiens
actttgttagtttctccaagc

SEQ ID NO: 2226498 - DNA, 16 bp, Homo sapiens
actttgttctggctct

SEQ ID NO: 2226499 - DNA, 13 bp, Homo sapiens
acttttataaact

SEQ ID NO: 2226500 - DNA, 19 bp, Homo sapiens
acttttataaactttacct

SEQ ID NO: 2226501 - DNA, 20 bp, Homo sapiens
acttttcataacctagcctt

SEQ ID NO: 2226502 - DNA, 16 bp, Homo sapiens
acttttctttcagcca

SEQ ID NO: 2226503 - DNA, 13 bp, Homo sapiens
acttttgttcttg

SEQ ID NO: 2226504 - DNA, 17 bp, Homo sapiens
agaaaaaatattttcct

SEQ ID NO: 2226505 - DNA, 23 bp, Homo sapiens
agaaaaaatattttcctgccagg

SEQ ID NO: 2226506 - DNA, 17 bp, Homo sapiens
agaaaaatgagcctggc

SEQ ID NO: 2226507 - DNA, 19 bp, Homo sapiens
agaaaatagtggtgtgatt

SEQ ID NO: 2226508 - DNA, 23 bp, Homo sapiens
agaaaatggaagacagctcttat

SEQ ID NO: 2226509 - DNA, 20 bp, Homo sapiens
agaaaatggacgtgttatga

SEQ ID NO: 2226510 - DNA, 17 bp, Homo sapiens
agaaacaaaatgaaaaa

SEQ ID NO: 2226511 - DNA, 23 bp, Homo sapiens
agaaacaaaatgaaaaaaaaagg

SEQ ID NO: 2226512 - DNA, 23 bp, Homo sapiens
agaaagtacttctccaccctgct

SEQ ID NO: 2226513 - DNA, 14 bp, Homo sapiens
agaaatataattga

SEQ ID NO: 2226514 - DNA, 15 bp, Homo sapiens
agaaatgccttaccc

SEQ ID NO: 2226515 - DNA, 15 bp, Homo sapiens
agaaatgtacagcaa

SEQ ID NO: 2226516 - DNA, 16 bp, Homo sapiens
agaaatgtacagcaag

SEQ ID NO: 2226517 - DNA, 18 bp, Homo sapiens
agaaccaaaaagaggcta

SEQ ID NO: 2226518 - DNA, 19 bp, Homo sapiens
agaaccttttgagtgcctt

SEQ ID NO: 2226519 - DNA, 18 bp, Homo sapiens
agaagattttgaaatttt

SEQ ID NO: 2226520 - DNA, 18 bp, Homo sapiens
agaagcccaggaaaggct

SEQ ID NO: 2226521 - DNA, 20 bp, Homo sapiens
agaagcccaggaaaggctcc

SEQ ID NO: 2226522 - DNA, 23 bp, Homo sapiens
agaagcccaggaaaggctccagg

SEQ ID NO: 2226523 - DNA, 18 bp, Homo sapiens
agaatgaaagggcccaga

SEQ ID NO: 2226524 - DNA, 19 bp, Homo sapiens
agaatgcacaaacagaggc

SEQ ID NO: 2226525 - DNA, 22 bp, Homo sapiens
agaatgcacaaacagaggccgc

SEQ ID NO: 2226526 - DNA, 15 bp, Homo sapiens
agaatgcagagatgt

SEQ ID NO: 2226527 - DNA, 18 bp, Homo sapiens
agaattctctagtttgat

SEQ ID NO: 2226528 - DNA, 12 bp, Homo sapiens
agggaaaaagac

SEQ ID NO: 2226529 - DNA, 12 bp, Homo sapiens
agggacagaggg

SEQ ID NO: 2226530 - DNA, 14 bp, Homo sapiens
agggagggctccag

SEQ ID NO: 2226531 - DNA, 17 bp, Homo sapiens
agggagggctccagaca

SEQ ID NO: 2226532 - DNA, 20 bp, Homo sapiens
agggagtgacagaggcagcc

SEQ ID NO: 2226533 - DNA, 20 bp, Homo sapiens
agggagtgagttgatagcac

SEQ ID NO: 2226534 - DNA, 16 bp, Homo sapiens
agggatacccatccca

SEQ ID NO: 2226535 - DNA, 17 bp, Homo sapiens
agggcacaccgggcact

SEQ ID NO: 2226536 - DNA, 21 bp, Homo sapiens
agggcacaccgggcactcaga

SEQ ID NO: 2226537 - DNA, 13 bp, Homo sapiens
agggcccagagag

SEQ ID NO: 2226538 - DNA, 23 bp, Homo sapiens
agggcccagagagggtggtgacc

SEQ ID NO: 2226539 - DNA, 15 bp, Homo sapiens
agggcctggcctgag

SEQ ID NO: 2226540 - DNA, 17 bp, Homo sapiens
agggcctggcctgagct

SEQ ID NO: 2226541 - DNA, 18 bp, Homo sapiens
agggcctggcctgagctg

SEQ ID NO: 2226542 - DNA, 15 bp, Homo sapiens
agggctccagacaca

SEQ ID NO: 2226543 - DNA, 20 bp, Homo sapiens
agggctccagacacatgtcc

SEQ ID NO: 2226544 - DNA, 23 bp, Homo sapiens
agggcttctgccatttctgagat

SEQ ID NO: 2226545 - DNA, 18 bp, Homo sapiens
aggggaaaatcagcctgc

SEQ ID NO: 2226546 - DNA, 22 bp, Homo sapiens
aggggaaaatcagcctgctcca

SEQ ID NO: 2226547 - DNA, 20 bp, Homo sapiens
aggggaatgtttgcctctgc

SEQ ID NO: 2226548 - DNA, 23 bp, Homo sapiens
agtgtacatggaataacatgtaa

SEQ ID NO: 2226549 - DNA, 23 bp, Homo sapiens
agtgtgacaaggattgctactgt

SEQ ID NO: 2226550 - DNA, 20 bp, Homo sapiens
agtgtgactgatctctcgtg

SEQ ID NO: 2226551 - DNA, 16 bp, Homo sapiens
agtgtggtgtttcctg

SEQ ID NO: 2226552 - DNA, 17 bp, Homo sapiens
agtgtggtgtttcctgg

SEQ ID NO: 2226553 - DNA, 16 bp, Homo sapiens
agtgttgtggatttaa

SEQ ID NO: 2226554 - DNA, 19 bp, Homo sapiens
agtgttgtggatttaacag

SEQ ID NO: 2226555 - DNA, 14 bp, Homo sapiens
agttacagacaaag

SEQ ID NO: 2226556 - DNA, 21 bp, Homo sapiens
agttatttttatttatttaaa

SEQ ID NO: 2226557 - DNA, 14 bp, Homo sapiens
agttcataccctgt

SEQ ID NO: 2226558 - DNA, 13 bp, Homo sapiens
agttcatcttgaa

SEQ ID NO: 2226559 - DNA, 22 bp, Homo sapiens
agttcatcttgaattgtaagga

SEQ ID NO: 2226560 - DNA, 18 bp, Homo sapiens
agttccaccatcaagcca

SEQ ID NO: 2226561 - DNA, 23 bp, Homo sapiens
agttcctcattagcattttgcta

SEQ ID NO: 2226562 - DNA, 12 bp, Homo sapiens
agttctctcctt

SEQ ID NO: 2226563 - DNA, 13 bp, Homo sapiens
agttctctccttc

SEQ ID NO: 2226564 - DNA, 15 bp, Homo sapiens
agttgatagcacaga

SEQ ID NO: 2226565 - DNA, 20 bp, Homo sapiens
agttgatagcacagaccctg

SEQ ID NO: 2226566 - DNA, 13 bp, Homo sapiens
agttgattcagct

SEQ ID NO: 2226567 - DNA, 23 bp, Homo sapiens
agttgattcagctctgcaagaat

SEQ ID NO: 2226568 - DNA, 23 bp, Homo sapiens
agttgccagtcaccccggccacc

SEQ ID NO: 2226569 - DNA, 13 bp, Homo sapiens
agttgggcttcct

SEQ ID NO: 2226570 - DNA, 13 bp, Homo sapiens
agttggtccccct

SEQ ID NO: 2226571 - DNA, 18 bp, Homo sapiens
agtttgagatcagcctgg

SEQ ID NO: 2226572 - DNA, 20 bp, Homo sapiens
agtttgagatcagcctgggc

SEQ ID NO: 2226573 - DNA, 23 bp, Homo sapiens
agtttgattaaattcttgcaaag

SEQ ID NO: 2226574 - DNA, 22 bp, Homo sapiens
ataaacaagaccacgtttctaa

SEQ ID NO: 2226575 - DNA, 21 bp, Homo sapiens
ataaactttaccttttttata

SEQ ID NO: 2226576 - DNA, 20 bp, Homo sapiens
ataaagcagcgtttctatga

SEQ ID NO: 2226577 - DNA, 13 bp, Homo sapiens
ataacatgtaatt

SEQ ID NO: 2226578 - DNA, 18 bp, Homo sapiens
ataacatgtaattaagta

SEQ ID NO: 2226579 - DNA, 20 bp, Homo sapiens
ataaccagtgttgtggattt

SEQ ID NO: 2226580 - DNA, 16 bp, Homo sapiens
ataactaaaaggtatg

SEQ ID NO: 2226581 - DNA, 21 bp, Homo sapiens
ataagattcatatttacttct

SEQ ID NO: 2226582 - DNA, 22 bp, Homo sapiens
ataagttaacttccaatttaca

SEQ ID NO: 2226583 - DNA, 15 bp, Homo sapiens
ataatgaatgaaaca

SEQ ID NO: 2226584 - DNA, 21 bp, Homo sapiens
ataatgcgtgcataccacttt

SEQ ID NO: 2226585 - DNA, 19 bp, Homo sapiens
ataatgtgaaactggatta

SEQ ID NO: 2226586 - DNA, 12 bp, Homo sapiens
ataatgttaaca

SEQ ID NO: 2226587 - DNA, 13 bp, Homo sapiens
atacaaaagcatg

SEQ ID NO: 2226588 - DNA, 17 bp, Homo sapiens
atacaatgctgtgccct

SEQ ID NO: 2226589 - DNA, 20 bp, Homo sapiens
atacaccactacattctgtt

SEQ ID NO: 2226590 - DNA, 22 bp, Homo sapiens
atacacttacactttatgcaca

SEQ ID NO: 2226591 - DNA, 23 bp, Homo sapiens
atacagatagatatatgctctgc

SEQ ID NO: 2226592 - DNA, 14 bp, Homo sapiens
atacaggaaaagct

SEQ ID NO: 2226593 - DNA, 20 bp, Homo sapiens
atacaggaaaagctgctgac

SEQ ID NO: 2226594 - DNA, 18 bp, Homo sapiens
atacagttactcagaatt

SEQ ID NO: 2226595 - DNA, 18 bp, Homo sapiens
ataccacttttgttcttg

SEQ ID NO: 2226596 - DNA, 12 bp, Homo sapiens
atacctgtcccc

SEQ ID NO: 2226597 - DNA, 13 bp, Homo sapiens
atacctgtccccc

SEQ ID NO: 2226598 - DNA, 15 bp, Homo sapiens
atacctgtccccctg

SEQ ID NO: 2226599 - DNA, 16 bp, Homo sapiens
atacctgtccccctga

SEQ ID NO: 2226600 - DNA, 16 bp, Homo sapiens
atacgtacacatttta

SEQ ID NO: 2226601 - DNA, 23 bp, Homo sapiens
atagacaatttattatggcacat

SEQ ID NO: 2226602 - DNA, 14 bp, Homo sapiens
atagcacagaccct

SEQ ID NO: 2226603 - DNA, 15 bp, Homo sapiens
atagccaaggccaaa

SEQ ID NO: 2226604 - DNA, 21 bp, Homo sapiens
atagctcaggtgtccctgcac

SEQ ID NO: 2226605 - DNA, 17 bp, Homo sapiens
atagtggcttaaaacaa

SEQ ID NO: 2226606 - DNA, 15 bp, Homo sapiens
atagtggtgtgattt

SEQ ID NO: 2226607 - DNA, 12 bp, Homo sapiens
atatataaccag

SEQ ID NO: 2226608 - DNA, 16 bp, Homo sapiens
atatgcacacattttt

SEQ ID NO: 2226609 - DNA, 17 bp, Homo sapiens
atatgctctgcatgtta

SEQ ID NO: 2226610 - DNA, 16 bp, Homo sapiens
atattaagaaagacta

SEQ ID NO: 2226611 - DNA, 17 bp, Homo sapiens
atattaagaaagactat

SEQ ID NO: 2226612 - DNA, 19 bp, Homo sapiens
atattaccacagacatact

SEQ ID NO: 2226613 - DNA, 14 bp, Homo sapiens
atattcaggaagct

SEQ ID NO: 2226614 - DNA, 17 bp, Homo sapiens
atattcaggaagctcag

SEQ ID NO: 2226615 - DNA, 19 bp, Homo sapiens
atattcaggaagctcaggg

SEQ ID NO: 2226616 - DNA, 22 bp, Homo sapiens
atctctcgtgattgataagaac

SEQ ID NO: 2226617 - DNA, 15 bp, Homo sapiens
atctcttgagcctgg

SEQ ID NO: 2226618 - DNA, 20 bp, Homo sapiens
atctgaaaatgtatgtgtaa

SEQ ID NO: 2226619 - DNA, 17 bp, Homo sapiens
atctggtgactttcctc

SEQ ID NO: 2226620 - DNA, 22 bp, Homo sapiens
atctgtcatttgagcagggctc

SEQ ID NO: 2226621 - DNA, 18 bp, Homo sapiens
atcttgaagacttttctt

SEQ ID NO: 2226622 - DNA, 17 bp, Homo sapiens
atcttgaattgtaagga

SEQ ID NO: 2226623 - DNA, 18 bp, Homo sapiens
atcttgaattgtaaggaa

SEQ ID NO: 2226624 - DNA, 14 bp, Homo sapiens
atcttgctctgctg

SEQ ID NO: 2226625 - DNA, 20 bp, Homo sapiens
atcttggtcagatttgaact

SEQ ID NO: 2226626 - DNA, 15 bp, Homo sapiens
atgaaaaaaaaaggg

SEQ ID NO: 2226627 - DNA, 22 bp, Homo sapiens
atgaaaaaaaaaggggggtggg

SEQ ID NO: 2226628 - DNA, 14 bp, Homo sapiens
atgaaaacacattt

SEQ ID NO: 2226629 - DNA, 17 bp, Homo sapiens
atgaaagactgtacaaa

SEQ ID NO: 2226630 - DNA, 19 bp, Homo sapiens
atgaaagggcccagagagg

SEQ ID NO: 2226631 - DNA, 14 bp, Homo sapiens
atgaaatgaggtca

SEQ ID NO: 2226632 - DNA, 13 bp, Homo sapiens
atgaaccacatct

SEQ ID NO: 2226633 - DNA, 20 bp, Homo sapiens
atgaaccacatcttgctctg

SEQ ID NO: 2226634 - DNA, 14 bp, Homo sapiens
atgaagtaatatgc

SEQ ID NO: 2226635 - DNA, 21 bp, Homo sapiens
atgaagtaatatgcacacatt

SEQ ID NO: 2226636 - DNA, 23 bp, Homo sapiens
atgaagtaatatgcacacatttt

SEQ ID NO: 2226637 - DNA, 17 bp, Homo sapiens
atgaatgaaacattttg

SEQ ID NO: 2226638 - DNA, 16 bp, Homo sapiens
atgaatgtcagtgtga

SEQ ID NO: 2226639 - DNA, 18 bp, Homo sapiens
atgaatgtcagtgtgact

SEQ ID NO: 2226640 - DNA, 20 bp, Homo sapiens
atgaatgtcagtgtgactga

SEQ ID NO: 2226641 - DNA, 14 bp, Homo sapiens
atgacttactgtac

SEQ ID NO: 2226642 - DNA, 21 bp, Homo sapiens
atgagaaaggttgaagcacca

SEQ ID NO: 2226643 - DNA, 12 bp, Homo sapiens
atgagaggaaat

SEQ ID NO: 2226644 - DNA, 14 bp, Homo sapiens
atgagaggaaatca

SEQ ID NO: 2226645 - DNA, 17 bp, Homo sapiens
atgagcatcaggccagg

SEQ ID NO: 2226646 - DNA, 21 bp, Homo sapiens
atgagcatcaggccaggccct

SEQ ID NO: 2226647 - DNA, 21 bp, Homo sapiens
atgagcctcagcatcctggca

SEQ ID NO: 2226648 - DNA, 11 bp, Homo sapiens
atgagcctggc

SEQ ID NO: 2226649 - DNA, 14 bp, Homo sapiens
atgagcctggcaag

SEQ ID NO: 2226650 - DNA, 15 bp, Homo sapiens
atgaggtcagagcct

SEQ ID NO: 2226651 - DNA, 16 bp, Homo sapiens
atgaggtcagagcctg

SEQ ID NO: 2226652 - DNA, 20 bp, Homo sapiens
atgaggtcagagcctgcagt

SEQ ID NO: 2226653 - DNA, 16 bp, Homo sapiens
atgatcctaggcattt

SEQ ID NO: 2226654 - DNA, 15 bp, Homo sapiens
atgatctaggaagac

SEQ ID NO: 2226655 - DNA, 17 bp, Homo sapiens
atgatctaggaagactt

SEQ ID NO: 2226656 - DNA, 18 bp, Homo sapiens
atgatcttctttataatt

SEQ ID NO: 2226657 - DNA, 19 bp, Homo sapiens
atgatctttgcagacaggc

SEQ ID NO: 2226658 - DNA, 20 bp, Homo sapiens
atgcaaaccatcattgaaat

SEQ ID NO: 2226659 - DNA, 17 bp, Homo sapiens
atgcacaaacagaggcc

SEQ ID NO: 2226660 - DNA, 13 bp, Homo sapiens
atgcacacatttt

SEQ ID NO: 2226661 - DNA, 22 bp, Homo sapiens
atgcacacattttttaaatgca

SEQ ID NO: 2226662 - DNA, 18 bp, Homo sapiens
atgcacagagttgttaca

SEQ ID NO: 2226663 - DNA, 22 bp, Homo sapiens
atgcacagagttgttacatttt

SEQ ID NO: 2226664 - DNA, 16 bp, Homo sapiens
atgcacctggaatata

SEQ ID NO: 2226665 - DNA, 17 bp, Homo sapiens
atgcactttgttctggc

SEQ ID NO: 2226666 - DNA, 19 bp, Homo sapiens
atgcactttgttctggctc

SEQ ID NO: 2226667 - DNA, 20 bp, Homo sapiens
atgcactttgttctggctct

SEQ ID NO: 2226668 - DNA, 21 bp, Homo sapiens
atgcactttgttctggctctt

SEQ ID NO: 2226669 - DNA, 22 bp, Homo sapiens
atgcagagatgtgcccccaccc

SEQ ID NO: 2226670 - DNA, 14 bp, Homo sapiens
atgcagcctcacag

SEQ ID NO: 2226671 - DNA, 18 bp, Homo sapiens
atgcagcctcacagtcct

SEQ ID NO: 2226672 - DNA, 13 bp, Homo sapiens
atgcagtgcttcc

SEQ ID NO: 2226673 - DNA, 12 bp, Homo sapiens
atgcatttgaaa

SEQ ID NO: 2226674 - DNA, 14 bp, Homo sapiens
atgcccagcccctt

SEQ ID NO: 2226675 - DNA, 14 bp, Homo sapiens
atttatttaaattt

SEQ ID NO: 2226676 - DNA, 14 bp, Homo sapiens
atttcactctcctt

SEQ ID NO: 2226677 - DNA, 19 bp, Homo sapiens
atttcccaaagcagtgcat

SEQ ID NO: 2226678 - DNA, 15 bp, Homo sapiens
atttgaaaattttga

SEQ ID NO: 2226679 - DNA, 16 bp, Homo sapiens
atttgaaaattttgat

SEQ ID NO: 2226680 - DNA, 15 bp, Homo sapiens
atttgagcagggctc

SEQ ID NO: 2226681 - DNA, 16 bp, Homo sapiens
atttgagcagggctca

SEQ ID NO: 2226682 - DNA, 17 bp, Homo sapiens
atttgagcagggctcag

SEQ ID NO: 2226683 - DNA, 22 bp, Homo sapiens
atttgaggtctgttctttccaa

SEQ ID NO: 2226684 - DNA, 23 bp, Homo sapiens
atttgaggtctgttctttccaaa

SEQ ID NO: 2226685 - DNA, 13 bp, Homo sapiens
atttgctcctttc

SEQ ID NO: 2226686 - DNA, 14 bp, Homo sapiens
atttgtgatacaat

SEQ ID NO: 2226687 - DNA, 15 bp, Homo sapiens
atttgtgatacaatg

SEQ ID NO: 2226688 - DNA, 14 bp, Homo sapiens
atttgttataatga

SEQ ID NO: 2226689 - DNA, 14 bp, Homo sapiens
atttgtttgaactg

SEQ ID NO: 2226690 - DNA, 23 bp, Homo sapiens
attttggggtacccactgctctg

SEQ ID NO: 2226691 - DNA, 21 bp, Homo sapiens
attttgtttttgtcttaaaaa

SEQ ID NO: 2226692 - DNA, 22 bp, Homo sapiens
attttgtttttgtcttaaaaag

SEQ ID NO: 2226693 - DNA, 15 bp, Homo sapiens
atttttactggggat

SEQ ID NO: 2226694 - DNA, 22 bp, Homo sapiens
atttttcttagggaaggataca

SEQ ID NO: 2226695 - DNA, 13 bp, Homo sapiens
atttttgtaaaaa

SEQ ID NO: 2226696 - DNA, 16 bp, Homo sapiens
atttttgtaaaaaggg

SEQ ID NO: 2226697 - DNA, 22 bp, Homo sapiens
atttttgtaaaaagggaaaaag

SEQ ID NO: 2226698 - DNA, 12 bp, Homo sapiens
atttttgtaatt

SEQ ID NO: 2226699 - DNA, 19 bp, Homo sapiens
atttttgtagagccagggt

SEQ ID NO: 2226700 - DNA, 13 bp, Homo sapiens
attttttaaatgc

SEQ ID NO: 2226701 - DNA, 14 bp, Homo sapiens
attttttaaatgca

SEQ ID NO: 2226702 - DNA, 11 bp, Homo sapiens
caaaaaaagac

SEQ ID NO: 2226703 - DNA, 13 bp, Homo sapiens
caaaaaggcagga

SEQ ID NO: 2226704 - DNA, 15 bp, Homo sapiens
caaaacggttttact

SEQ ID NO: 2226705 - DNA, 15 bp, Homo sapiens
caaaactctcctctg

SEQ ID NO: 2226706 - DNA, 23 bp, Homo sapiens
caaaactctcctctgctgctggc

SEQ ID NO: 2226707 - DNA, 18 bp, Homo sapiens
caaaagatgcttctcact

SEQ ID NO: 2226708 - DNA, 15 bp, Homo sapiens
caaaatgtagggtta

SEQ ID NO: 2226709 - DNA, 14 bp, Homo sapiens
caaacccttcagtg

SEQ ID NO: 2226710 - DNA, 17 bp, Homo sapiens
caaactcacctgcccct

SEQ ID NO: 2226711 - DNA, 17 bp, Homo sapiens
caaactcttgacctcag

SEQ ID NO: 2226712 - DNA, 21 bp, Homo sapiens
caaactcttgacctcaggtga

SEQ ID NO: 2226713 - DNA, 14 bp, Homo sapiens
caaagatattttgc

SEQ ID NO: 2226714 - DNA, 18 bp, Homo sapiens
caaagatattttgctttg

SEQ ID NO: 2226715 - DNA, 23 bp, Homo sapiens
caaagatattttgctttgtgatt

SEQ ID NO: 2226716 - DNA, 17 bp, Homo sapiens
caaagcctcctccagcc

SEQ ID NO: 2226717 - DNA, 14 bp, Homo sapiens
caaagctaggcctg

SEQ ID NO: 2226718 - DNA, 21 bp, Homo sapiens
caaaggatgcccaaagatgca

SEQ ID NO: 2226719 - DNA, 18 bp, Homo sapiens
caaagggtatcaggtgct

SEQ ID NO: 2226720 - DNA, 16 bp, Homo sapiens
caaagtacactgtttc

SEQ ID NO: 2226721 - DNA, 22 bp, Homo sapiens
caaagtacactgtttcaaactt

SEQ ID NO: 2226722 - DNA, 19 bp, Homo sapiens
caaagtgctgggattacaa

SEQ ID NO: 2226723 - DNA, 23 bp, Homo sapiens
caaagtgctgggattacaggtgt

SEQ ID NO: 2226724 - DNA, 17 bp, Homo sapiens
caaagtggtgagaggca

SEQ ID NO: 2226725 - DNA, 21 bp, Homo sapiens
caaatctgctttttaaagaat

SEQ ID NO: 2226726 - DNA, 21 bp, Homo sapiens
caaatggaaatgggcagagca

SEQ ID NO: 2226727 - DNA, 11 bp, Homo sapiens
caaatttctaa

SEQ ID NO: 2226728 - DNA, 15 bp, Homo sapiens
caaatttctaaatct

SEQ ID NO: 2226729 - DNA, 22 bp, Homo sapiens
caaatttctaaatctccaaaat

SEQ ID NO: 2226730 - DNA, 22 bp, Homo sapiens
caacacctctgcacaagctgca

SEQ ID NO: 2226731 - DNA, 18 bp, Homo sapiens
caacagggtttttttcca

SEQ ID NO: 2226732 - DNA, 15 bp, Homo sapiens
caacaggttttcctg

SEQ ID NO: 2226733 - DNA, 18 bp, Homo sapiens
caaccactgcgaccacaa

SEQ ID NO: 2226734 - DNA, 17 bp, Homo sapiens
caaccccttcgctcctg

SEQ ID NO: 2226735 - DNA, 21 bp, Homo sapiens
caaccccttcgctcctgtgtc

SEQ ID NO: 2226736 - DNA, 12 bp, Homo sapiens
caaccctcatca

SEQ ID NO: 2226737 - DNA, 21 bp, Homo sapiens
caacctgattgtgtctcttgg

SEQ ID NO: 2226738 - DNA, 14 bp, Homo sapiens
caacgtctgtgcca

SEQ ID NO: 2226739 - DNA, 20 bp, Homo sapiens
caactgcatcaagatgtgac

SEQ ID NO: 2226740 - DNA, 23 bp, Homo sapiens
caactgcatcaagatgtgacatg

SEQ ID NO: 2226741 - DNA, 14 bp, Homo sapiens
caagaagcccagga

SEQ ID NO: 2226742 - DNA, 18 bp, Homo sapiens
caagaagcccaggaaagg

SEQ ID NO: 2226743 - DNA, 22 bp, Homo sapiens
caagacccttgtggtcccaccc

SEQ ID NO: 2226744 - DNA, 18 bp, Homo sapiens
caagaccttctccttcac

SEQ ID NO: 2226745 - DNA, 18 bp, Homo sapiens
caagactctttggacact

SEQ ID NO: 2226746 - DNA, 10 bp, Homo sapiens
caagagagac

SEQ ID NO: 2226747 - DNA, 17 bp, Homo sapiens
caagagggtctgaggaa

SEQ ID NO: 2226748 - DNA, 14 bp, Homo sapiens
caagcacctcctgc

SEQ ID NO: 2226749 - DNA, 16 bp, Homo sapiens
caagcacctcctgcct

SEQ ID NO: 2226750 - DNA, 14 bp, Homo sapiens
caagcaggacatgg

SEQ ID NO: 2226751 - DNA, 13 bp, Homo sapiens
cacaaacagaggc

SEQ ID NO: 2226752 - DNA, 14 bp, Homo sapiens
cacaaacagaggcc

SEQ ID NO: 2226753 - DNA, 14 bp, Homo sapiens
cacaagacccttgt

SEQ ID NO: 2226754 - DNA, 18 bp, Homo sapiens
cacaagagcccaggcctc

SEQ ID NO: 2226755 - DNA, 20 bp, Homo sapiens
cacaagctccaagctcccag

SEQ ID NO: 2226756 - DNA, 17 bp, Homo sapiens
cacaagctgcaccctca

SEQ ID NO: 2226757 - DNA, 14 bp, Homo sapiens
cacacaccagagcc

SEQ ID NO: 2226758 - DNA, 20 bp, Homo sapiens
cacacaccagagcccacctt

SEQ ID NO: 2226759 - DNA, 17 bp, Homo sapiens
cacacacgcgtgcacac

SEQ ID NO: 2226760 - DNA, 21 bp, Homo sapiens
cacacagaggctgcctctccc

SEQ ID NO: 2226761 - DNA, 13 bp, Homo sapiens
cacacagctctgt

SEQ ID NO: 2226762 - DNA, 17 bp, Homo sapiens
cacacagctctgtcctg

SEQ ID NO: 2226763 - DNA, 20 bp, Homo sapiens
cacacagctctgtcctggga

SEQ ID NO: 2226764 - DNA, 20 bp, Homo sapiens
cacacagtattacttctgct

SEQ ID NO: 2226765 - DNA, 23 bp, Homo sapiens
cacacagtattacttctgctaca

SEQ ID NO: 2226766 - DNA, 18 bp, Homo sapiens
cacacagtgagtcgagga

SEQ ID NO: 2226767 - DNA, 20 bp, Homo sapiens
cacacatgagcatcaggcca

SEQ ID NO: 2226768 - DNA, 11 bp, Homo sapiens
cacacattttt

SEQ ID NO: 2226769 - DNA, 22 bp, Homo sapiens
cacaccagagcccaccttggct

SEQ ID NO: 2226770 - DNA, 14 bp, Homo sapiens
cacacccagcccac

SEQ ID NO: 2226771 - DNA, 21 bp, Homo sapiens
cacacttgacatcaactgcat

SEQ ID NO: 2226772 - DNA, 20 bp, Homo sapiens
cacagaccctgccctgtggg

SEQ ID NO: 2226773 - DNA, 22 bp, Homo sapiens
cacagaccctgccctgtgggcc

SEQ ID NO: 2226774 - DNA, 16 bp, Homo sapiens
cacagagttgttacat

SEQ ID NO: 2226775 - DNA, 20 bp, Homo sapiens
cacagatgggtgcttggagg

SEQ ID NO: 2226776 - DNA, 11 bp, Homo sapiens
cacagcctctg

SEQ ID NO: 2226777 - DNA, 18 bp, Homo sapiens
cacagctctgtcctggga

SEQ ID NO: 2226778 - DNA, 14 bp, Homo sapiens
cacagctcttctcc

SEQ ID NO: 2226779 - DNA, 19 bp, Homo sapiens
cacagctcttctccaggct

SEQ ID NO: 2226780 - DNA, 20 bp, Homo sapiens
cacagctcttctccaggctg

SEQ ID NO: 2226781 - DNA, 21 bp, Homo sapiens
cacagctcttctccaggctgt

SEQ ID NO: 2226782 - DNA, 22 bp, Homo sapiens
cacagcttcatttcctgtgtct

SEQ ID NO: 2226783 - DNA, 14 bp, Homo sapiens
cacaggcaggtcca

SEQ ID NO: 2226784 - DNA, 14 bp, Homo sapiens
cacaggcccggctc

SEQ ID NO: 2226785 - DNA, 16 bp, Homo sapiens
cacaggcccggctcca

SEQ ID NO: 2226786 - DNA, 17 bp, Homo sapiens
cacaggcccggctccag

SEQ ID NO: 2226787 - DNA, 18 bp, Homo sapiens
cacaggcccggctccagg

SEQ ID NO: 2226788 - DNA, 19 bp, Homo sapiens
cacaggggaaaagaggagt

SEQ ID NO: 2226789 - DNA, 23 bp, Homo sapiens
cacagtccttaccagcagagcac

SEQ ID NO: 2226790 - DNA, 18 bp, Homo sapiens
cacagtgagtcgaggaca

SEQ ID NO: 2226791 - DNA, 20 bp, Homo sapiens
cacagtgagtcgaggacagg

SEQ ID NO: 2226792 - DNA, 13 bp, Homo sapiens
cacatattgattt

SEQ ID NO: 2226793 - DNA, 13 bp, Homo sapiens
cacatcttgctct

SEQ ID NO: 2226794 - DNA, 15 bp, Homo sapiens
cacatcttgctctgc

SEQ ID NO: 2226795 - DNA, 16 bp, Homo sapiens
cacatcttgctctgct

SEQ ID NO: 2226796 - DNA, 13 bp, Homo sapiens
cacatgcctctct

SEQ ID NO: 2226797 - DNA, 17 bp, Homo sapiens
cacatgcctctctcagg

SEQ ID NO: 2226798 - DNA, 16 bp, Homo sapiens
cacatgtccaagaagc

SEQ ID NO: 2226799 - DNA, 17 bp, Homo sapiens
cacatgtccaagaagcc

SEQ ID NO: 2226800 - DNA, 21 bp, Homo sapiens
cacatgtccaagaagcccagg

SEQ ID NO: 2226801 - DNA, 23 bp, Homo sapiens
cacatgtccaagaagcccaggaa

SEQ ID NO: 2226802 - DNA, 13 bp, Homo sapiens
cacatttttctta

SEQ ID NO: 2226803 - DNA, 14 bp, Homo sapiens
caccaacgtctgtg

SEQ ID NO: 2226804 - DNA, 16 bp, Homo sapiens
caccaacgtctgtgcc

SEQ ID NO: 2226805 - DNA, 12 bp, Homo sapiens
caccaagcccag

SEQ ID NO: 2226806 - DNA, 13 bp, Homo sapiens
caccaagcccagt

SEQ ID NO: 2226807 - DNA, 16 bp, Homo sapiens
caccactacattctgt

SEQ ID NO: 2226808 - DNA, 15 bp, Homo sapiens
caccagagcccacct

SEQ ID NO: 2226809 - DNA, 15 bp, Homo sapiens
caccagcagcctgga

SEQ ID NO: 2226810 - DNA, 21 bp, Homo sapiens
caccagccccagtgcccacag

SEQ ID NO: 2226811 - DNA, 13 bp, Homo sapiens
caccatcaagcca

SEQ ID NO: 2226812 - DNA, 19 bp, Homo sapiens
caccatcaagccaccaaca

SEQ ID NO: 2226813 - DNA, 17 bp, Homo sapiens
caccatcatgtctggct

SEQ ID NO: 2226814 - DNA, 18 bp, Homo sapiens
caccatcatgtctggcta

SEQ ID NO: 2226815 - DNA, 15 bp, Homo sapiens
cacccaagggcctgg

SEQ ID NO: 2226816 - DNA, 18 bp, Homo sapiens
cacccaagggcctggcct

SEQ ID NO: 2226817 - DNA, 13 bp, Homo sapiens
cacccacctcagc

SEQ ID NO: 2226818 - DNA, 16 bp, Homo sapiens
cacccacctcagcctc

SEQ ID NO: 2226819 - DNA, 17 bp, Homo sapiens
cacccacctcagcctcc

SEQ ID NO: 2226820 - DNA, 12 bp, Homo sapiens
cacccagcccac

SEQ ID NO: 2226821 - DNA, 16 bp, Homo sapiens
cacccagcccacttct

SEQ ID NO: 2226822 - DNA, 17 bp, Homo sapiens
cacccagcccacttctg

SEQ ID NO: 2226823 - DNA, 20 bp, Homo sapiens
cacccaggagccccgaggcc

SEQ ID NO: 2226824 - DNA, 22 bp, Homo sapiens
cacccccacccaagggcctggc

SEQ ID NO: 2226825 - DNA, 22 bp, Homo sapiens
caccccctccccgggcagcaga

SEQ ID NO: 2226826 - DNA, 13 bp, Homo sapiens
cacccggcccctg

SEQ ID NO: 2226827 - DNA, 18 bp, Homo sapiens
cacccggcccctgctggt

SEQ ID NO: 2226828 - DNA, 21 bp, Homo sapiens
cacccggcccctgctggttca

SEQ ID NO: 2226829 - DNA, 16 bp, Homo sapiens
caccctggggagaaag

SEQ ID NO: 2226830 - DNA, 20 bp, Homo sapiens
caccctgtgatggggccctg

SEQ ID NO: 2226831 - DNA, 21 bp, Homo sapiens
caccctgtgatggggccctgc

SEQ ID NO: 2226832 - DNA, 22 bp, Homo sapiens
caccctgtgatggggccctgcc

SEQ ID NO: 2226833 - DNA, 18 bp, Homo sapiens
caccgaaaacgtggctgc

SEQ ID NO: 2226834 - DNA, 19 bp, Homo sapiens
caccgaaaacgtggctgct

SEQ ID NO: 2226835 - DNA, 20 bp, Homo sapiens
tggggtacccactgctctgg

SEQ ID NO: 2226836 - DNA, 19 bp, Homo sapiens
tggggtaggaggaacaggt

SEQ ID NO: 2226837 - DNA, 16 bp, Homo sapiens
tggggtcactctggca

SEQ ID NO: 2226838 - DNA, 22 bp, Homo sapiens
tggggtcactctggcagctcag

SEQ ID NO: 2226839 - DNA, 19 bp, Homo sapiens
tggggtttatcagaattct

SEQ ID NO: 2226840 - DNA, 23 bp, Homo sapiens
tgggtacttgtggacacagctct

SEQ ID NO: 2226841 - DNA, 15 bp, Homo sapiens
tgggtgcttggagga

SEQ ID NO: 2226842 - DNA, 17 bp, Homo sapiens
tgggtggcaccagcagc

SEQ ID NO: 2226843 - DNA, 21 bp, Homo sapiens
tgggtttctaaagctgccagc

SEQ ID NO: 2226844 - DNA, 18 bp, Homo sapiens
tggtatgatcacggctca

SEQ ID NO: 2226845 - DNA, 20 bp, Homo sapiens
tggtcaccaaatcagctgct

SEQ ID NO: 2226846 - DNA, 23 bp, Homo sapiens
tggtcaccaaatcagctgctact

SEQ ID NO: 2226847 - DNA, 16 bp, Homo sapiens
tggtcagatttgaact

SEQ ID NO: 2226848 - DNA, 14 bp, Homo sapiens
tggtcccaccccac

SEQ ID NO: 2226849 - DNA, 14 bp, Homo sapiens
tggtcccccttcca

SEQ ID NO: 2226850 - DNA, 17 bp, Homo sapiens
tggtcctaatcttctga

SEQ ID NO: 2226851 - DNA, 16 bp, Homo sapiens
tggtctgacccactgc

SEQ ID NO: 2226852 - DNA, 17 bp, Homo sapiens
tggtctgacccactgct

SEQ ID NO: 2226853 - DNA, 12 bp, Homo sapiens
tggtctgtgtga

SEQ ID NO: 2226854 - DNA, 15 bp, Homo sapiens
tggtgacctctgcct

SEQ ID NO: 2226855 - DNA, 20 bp, Homo sapiens
tggtgcaatgacctttcaat

SEQ ID NO: 2226856 - DNA, 15 bp, Homo sapiens
tggtggcagagtgga

SEQ ID NO: 2226857 - DNA, 14 bp, Homo sapiens
tggtggcagctgcg

SEQ ID NO: 2226858 - DNA, 13 bp, Homo sapiens
tggtggcagtggg

SEQ ID NO: 2226859 - DNA, 13 bp, Homo sapiens
tggtggctgggtt

SEQ ID NO: 2226860 - DNA, 18 bp, Homo sapiens
tggttaggcattgtggga

SEQ ID NO: 2226861 - DNA, 20 bp, Homo sapiens
tggttaggcattgtgggaag

SEQ ID NO: 2226862 - DNA, 22 bp, Homo sapiens
tggttcagggttggcccctgcc

SEQ ID NO: 2226863 - DNA, 18 bp, Homo sapiens
tggttgatgatctttgca

SEQ ID NO: 2226864 - DNA, 19 bp, Homo sapiens
tggtttggttcatggtgaa

SEQ ID NO: 2226865 - DNA, 15 bp, Homo sapiens
tggtttgtaaattaa

SEQ ID NO: 2226866 - DNA, 17 bp, Homo sapiens
tggttttcaaaataaaa

SEQ ID NO: 2226867 - DNA, 15 bp, Homo sapiens
tggttttctgttctt

SEQ ID NO: 2226868 - DNA, 23 bp, Homo sapiens
tggtttttaaaaaactgctgact

SEQ ID NO: 2226869 - DNA, 17 bp, Homo sapiens
tgtaaaaagggaaaaag

SEQ ID NO: 2226870 - DNA, 15 bp, Homo sapiens
tgtaaatagctcagg

SEQ ID NO: 2226871 - DNA, 18 bp, Homo sapiens
tgtaattaagtactatgt

SEQ ID NO: 2226872 - DNA, 19 bp, Homo sapiens
tgtaattaagtactatgta

SEQ ID NO: 2226873 - DNA, 21 bp, Homo sapiens
tgtaattaagtactatgtatc

SEQ ID NO: 2226874 - DNA, 23 bp, Homo sapiens
tgtaattaagtactatgtatcaa

SEQ ID NO: 2226875 - DNA, 21 bp, Homo sapiens
tgtaatttgtgatacaatgct

SEQ ID NO: 2226876 - DNA, 19 bp, Homo sapiens
tgtacaaagtagaagtctt

SEQ ID NO: 2226877 - DNA, 21 bp, Homo sapiens
tgtacagagcccacgccccca

SEQ ID NO: 2226878 - DNA, 16 bp, Homo sapiens
tgtacatgaaaacaca

SEQ ID NO: 2226879 - DNA, 17 bp, Homo sapiens
tgtacatgaaaacacat

SEQ ID NO: 2226880 - DNA, 20 bp, Homo sapiens
tgtacatgaaaacacatttt

SEQ ID NO: 2226881 - DNA, 21 bp, Homo sapiens
tgtacatggaataacatgtaa

SEQ ID NO: 2226882 - DNA, 15 bp, Homo sapiens
tgtacgtctgacagg

SEQ ID NO: 2226883 - DNA, 16 bp, Homo sapiens
tgtacgtctgacaggc

SEQ ID NO: 2226884 - DNA, 15 bp, Homo sapiens
tgtagagccagggtc

SEQ ID NO: 2226885 - DNA, 23 bp, Homo sapiens
ttaatgaaagactgtacaaagta

SEQ ID NO: 2226886 - DNA, 17 bp, Homo sapiens
ttaatgtcacaggcagg

SEQ ID NO: 2226887 - DNA, 13 bp, Homo sapiens
ttacactttatgc

SEQ ID NO: 2226888 - DNA, 20 bp, Homo sapiens
ttacactttatgcacaaaat

SEQ ID NO: 2226889 - DNA, 16 bp, Homo sapiens
ttacaggaagtactgg

SEQ ID NO: 2226890 - DNA, 18 bp, Homo sapiens
ttacaggaagtactggag

SEQ ID NO: 2226891 - DNA, 22 bp, Homo sapiens
ttacaggaagtactggagaaaa

SEQ ID NO: 2226892 - DNA, 17 bp, Homo sapiens
ttacatttttaagtgct

SEQ ID NO: 2226893 - DNA, 21 bp, Homo sapiens
ttacatttttaagtgctgcat

SEQ ID NO: 2226894 - DNA, 14 bp, Homo sapiens
ttaccacagacata

SEQ ID NO: 2226895 - DNA, 23 bp, Homo sapiens
ttaccattttggggtacccactg

SEQ ID NO: 2226896 - DNA, 19 bp, Homo sapiens
ttaccttttttatacataa

SEQ ID NO: 2226897 - DNA, 20 bp, Homo sapiens
ttacggttttccaggtttaa

SEQ ID NO: 2226898 - DNA, 14 bp, Homo sapiens
ttacgtgagtcctg

SEQ ID NO: 2226899 - DNA, 14 bp, Homo sapiens
ttactaagttttta

SEQ ID NO: 2226900 - DNA, 23 bp, Homo sapiens
ttactcagaattctctagtttga

SEQ ID NO: 2226901 - DNA, 13 bp, Homo sapiens
ttactgtacatga

SEQ ID NO: 2226902 - DNA, 11 bp, Homo sapiens
ttagacagagt

SEQ ID NO: 2226903 - DNA, 14 bp, Homo sapiens
ttagacagtccctg

SEQ ID NO: 2226904 - DNA, 22 bp, Homo sapiens
ttagataatacaccactacatt

SEQ ID NO: 2226905 - DNA, 21 bp, Homo sapiens
ttaggtgtgactgaatttctt

SEQ ID NO: 2226906 - DNA, 19 bp, Homo sapiens
ttaggtgtgggggaagcac

SEQ ID NO: 2226907 - DNA, 18 bp, Homo sapiens
ttaggttggcaaaaaggc

SEQ ID NO: 2226908 - DNA, 14 bp, Homo sapiens
ttagtagagacagg

SEQ ID NO: 2226909 - DNA, 22 bp, Homo sapiens
ttagtttgcagttacactaaaa

SEQ ID NO: 2226910 - DNA, 17 bp, Homo sapiens
ttataaactttaccttt

SEQ ID NO: 2226911 - DNA, 11 bp, Homo sapiens
ttatacataaa

SEQ ID NO: 2226912 - DNA, 17 bp, Homo sapiens
ttatcacccagaagaaa

SEQ ID NO: 2226913 - DNA, 19 bp, Homo sapiens
ttatcacccagaagaaaat

SEQ ID NO: 2226914 - DNA, 14 bp, Homo sapiens
ttatctagatactg

SEQ ID NO: 2226915 - DNA, 16 bp, Homo sapiens
ttatctagatactgta

SEQ ID NO: 2226916 - DNA, 17 bp, Homo sapiens
ttatctagatactgtat

SEQ ID NO: 2226917 - DNA, 16 bp, Homo sapiens
ttatgcatgaagtaat

SEQ ID NO: 2226918 - DNA, 19 bp, Homo sapiens
ttatggcttttgtgcatta

SEQ ID NO: 2226919 - DNA, 13 bp, Homo sapiens
ttatgggctgggt

SEQ ID NO: 2226920 - DNA, 23 bp, Homo sapiens
ttattaaaaatctcaaatttcta

SEQ ID NO: 2226921 - DNA, 19 bp, Homo sapiens
ttattaaatgcccagcccc

SEQ ID NO: 2226922 - DNA, 12 bp, Homo sapiens
ttattatgcatg

SEQ ID NO: 2226923 - DNA, 22 bp, Homo sapiens
ttatttaatgaaagactgtaca

SEQ ID NO: 2226924 - DNA, 17 bp, Homo sapiens
ttattttaattcagttg

SEQ ID NO: 2226925 - DNA, 21 bp, Homo sapiens
ttcaacaggttttcctgaaga

SEQ ID NO: 2226926 - DNA, 16 bp, Homo sapiens
ttcaaggatcctgagc

SEQ ID NO: 2226927 - DNA, 19 bp, Homo sapiens
ttcaaggatcctgagccag

SEQ ID NO: 2226928 - DNA, 13 bp, Homo sapiens
ttcaataggaaaa

SEQ ID NO: 2226929 - DNA, 20 bp, Homo sapiens
ttcaataggaaaaactgatt

SEQ ID NO: 2226930 - DNA, 14 bp, Homo sapiens
ttcacctttgtccc

SEQ ID NO: 2226931 - DNA, 11 bp, Homo sapiens
ttcagaaatgt

SEQ ID NO: 2226932 - DNA, 13 bp, Homo sapiens
ttcagaaatgtgt

SEQ ID NO: 2226933 - DNA, 17 bp, Homo sapiens
ttcagacagctgcctgg

SEQ ID NO: 2226934 - DNA, 19 bp, Homo sapiens
ttcagagactcctgcaggc

SEQ ID NO: 2226935 - DNA, 15 bp, Homo sapiens
ttcagctccagctca

SEQ ID NO: 2226936 - DNA, 17 bp, Homo sapiens
ttcagctctgcaagaat

SEQ ID NO: 2226937 - DNA, 24 bp, Homo sapiens
ttcagctctgcaagaattgaagca

SEQ ID NO: 2226938 - DNA, 11 bp, Homo sapiens
ttcaggaagct

SEQ ID NO: 2226939 - DNA, 15 bp, Homo sapiens
ttcaggaagctcagg

SEQ ID NO: 2226940 - DNA, 19 bp, Homo sapiens
ttcagggttggcccctgcc

SEQ ID NO: 2226941 - DNA, 22 bp, Homo sapiens
ttcagggttggcccctgcccgg

SEQ ID NO: 2226942 - DNA, 16 bp, Homo sapiens
ttcaggtaacaggcag

SEQ ID NO: 2226943 - DNA, 16 bp, Homo sapiens
ttcagtgccaaaaaca

SEQ ID NO: 2226944 - DNA, 12 bp, Homo sapiens
ttcagtgcctta

SEQ ID NO: 2226945 - DNA, 13 bp, Homo sapiens
ttcagtgccttat

SEQ ID NO: 2226946 - DNA, 14 bp, Homo sapiens
ttcagtggcagctg

SEQ ID NO: 2226947 - DNA, 16 bp, Homo sapiens
ttcagtggcagctgct

SEQ ID NO: 2226948 - DNA, 16 bp, Homo sapiens
ttcatatttacttctt

SEQ ID NO: 2226949 - DNA, 20 bp, Homo sapiens
ttcatcttccaactcaaact

SEQ ID NO: 2226950 - DNA, 21 bp, Homo sapiens
ttcatcttgaattgtaaggaa

SEQ ID NO: 2226951 - DNA, 15 bp, Homo sapiens
ttcatttcctgtgtc

SEQ ID NO: 2226952 - DNA, 16 bp, Homo sapiens
ttccaaagtacactgt

SEQ ID NO: 2226953 - DNA, 17 bp, Homo sapiens
ttccaggctgggagagc

SEQ ID NO: 2226954 - DNA, 19 bp, Homo sapiens
ttccagtgaggctctgccc

SEQ ID NO: 2226955 - DNA, 14 bp, Homo sapiens
ttccatggactttg

SEQ ID NO: 2226956 - DNA, 23 bp, Homo sapiens
ttcccaaagcagtgcatgctgtc

SEQ ID NO: 2226957 - DNA, 15 bp, Homo sapiens
ttcccaagctctgct

SEQ ID NO: 2226958 - DNA, 17 bp, Homo sapiens
ttccccaggaggccagc

SEQ ID NO: 2226959 - DNA, 20 bp, Homo sapiens
ttccccaggaggccagcctt

SEQ ID NO: 2226960 - DNA, 20 bp, Homo sapiens
ttccctcccttcctctttcc

SEQ ID NO: 2226961 - DNA, 22 bp, Homo sapiens
ttccctttgacgccatcccagc

SEQ ID NO: 2226962 - DNA, 20 bp, Homo sapiens
ttcccttttttggctgctga

SEQ ID NO: 2226963 - DNA, 18 bp, Homo sapiens
ttcctgaagaattgaaaa

SEQ ID NO: 2226964 - DNA, 23 bp, Homo sapiens
ttcctgatgcttcttcagagact

SEQ ID NO: 2226965 - DNA, 20 bp, Homo sapiens
ttcctggcactgcttccagt

SEQ ID NO: 2226966 - DNA, 22 bp, Homo sapiens
ttcctggcactgcttccagtga

SEQ ID NO: 2226967 - DNA, 17 bp, Homo sapiens
ttcctgttcccatgaga

SEQ ID NO: 2226968 - DNA, 19 bp, Homo sapiens
ttccttcagtgccttatgg

SEQ ID NO: 2226969 - DNA, 18 bp, Homo sapiens
ttctaaaggctacctttg

SEQ ID NO: 2226970 - DNA, 21 bp, Homo sapiens
ttgaaatttttattaaattat

SEQ ID NO: 2226971 - DNA, 18 bp, Homo sapiens
ttgaactgggtacttgtg

SEQ ID NO: 2226972 - DNA, 12 bp, Homo sapiens
ttgaatgatgcc

SEQ ID NO: 2226973 - DNA, 17 bp, Homo sapiens
ttgaccattctccacct

SEQ ID NO: 2226974 - DNA, 21 bp, Homo sapiens
ttgacctcaggtgatccaccc

SEQ ID NO: 2226975 - DNA, 14 bp, Homo sapiens
ttgacgccatccca

SEQ ID NO: 2226976 - DNA, 17 bp, Homo sapiens
ttgacgccatcccagcc

SEQ ID NO: 2226977 - DNA, 20 bp, Homo sapiens
ttgacgccatcccagcccca

SEQ ID NO: 2226978 - DNA, 16 bp, Homo sapiens
ttgagatcagcctggg

SEQ ID NO: 2226979 - DNA, 12 bp, Homo sapiens
ttgagcagggct

SEQ ID NO: 2226980 - DNA, 14 bp, Homo sapiens
ttgagccttgaact

SEQ ID NO: 2226981 - DNA, 15 bp, Homo sapiens
ttgagccttgaactt

SEQ ID NO: 2226982 - DNA, 16 bp, Homo sapiens
ttgagccttgaacttt

SEQ ID NO: 2226983 - DNA, 19 bp, Homo sapiens
ttgagccttgaactttgac

SEQ ID NO: 2226984 - DNA, 13 bp, Homo sapiens
ttgagggttgggc

SEQ ID NO: 2226985 - DNA, 21 bp, Homo sapiens
ttgagtgctgtctccatgttt

SEQ ID NO: 2226986 - DNA, 19 bp, Homo sapiens
ttgatagcacagaccctgc

SEQ ID NO: 2226987 - DNA, 23 bp, Homo sapiens
ttgatatcctctttgagtgaagc

SEQ ID NO: 2226988 - DNA, 21 bp, Homo sapiens
ttgattcagacagctgcctgg

SEQ ID NO: 2226989 - DNA, 17 bp, Homo sapiens
ttgattcataatgactt

SEQ ID NO: 2226990 - DNA, 17 bp, Homo sapiens
ttgcaacaggctgggct

SEQ ID NO: 2226991 - DNA, 14 bp, Homo sapiens
ttgcaatggcagcc

SEQ ID NO: 2226992 - DNA, 17 bp, Homo sapiens
ttgcaatggcagccttg

SEQ ID NO: 2226993 - DNA, 22 bp, Homo sapiens
ttgcagacaggcaagcacctcc

SEQ ID NO: 2226994 - DNA, 16 bp, Homo sapiens
ttgccatgttggccag

SEQ ID NO: 2226995 - DNA, 17 bp, Homo sapiens
ttgccatgttggccagg

SEQ ID NO: 2226996 - DNA, 18 bp, Homo sapiens
ttgccatgttggccaggc

SEQ ID NO: 2226997 - DNA, 11 bp, Homo sapiens
ttgcccaggca

SEQ ID NO: 2226998 - DNA, 13 bp, Homo sapiens
ttgcccaggcagg

SEQ ID NO: 2226999 - DNA, 18 bp, Homo sapiens
ttgcccaggcaggtcttg

SEQ ID NO: 2227000 - DNA, 11 bp, Homo sapiens
ttgcccaggcc

SEQ ID NO: 2227001 - DNA, 15 bp, Homo sapiens
ttgcccaggcctccc

SEQ ID NO: 2227002 - DNA, 12 bp, Homo sapiens
ttgcccaggctg

SEQ ID NO: 2227003 - DNA, 14 bp, Homo sapiens
ttgcccaggctggc

SEQ ID NO: 2227004 - DNA, 18 bp, Homo sapiens
ttgcctctgcctctgaca

SEQ ID NO: 2227005 - DNA, 19 bp, Homo sapiens
ttgctgaatacagaggcaa

SEQ ID NO: 2227006 - DNA, 17 bp, Homo sapiens
ttgctgatggtgcaatg

SEQ ID NO: 2227007 - DNA, 15 bp, Homo sapiens
ttgctttgtgatttt

SEQ ID NO: 2227008 - DNA, 17 bp, Homo sapiens
ttggaaaataaattatt

SEQ ID NO: 2227009 - DNA, 18 bp, Homo sapiens
ttggaaagagtaggaaga

SEQ ID NO: 2227010 - DNA, 19 bp, Homo sapiens
ttggaccctgaggcccaga

SEQ ID NO: 2227011 - DNA, 21 bp, Homo sapiens
ttggaccctgaggcccagagg

SEQ ID NO: 2227012 - DNA, 17 bp, Homo sapiens
ttggcaaaaaggcagga

SEQ ID NO: 2227013 - DNA, 14 bp, Homo sapiens
ttggccaggctggt

SEQ ID NO: 2227014 - DNA, 23 bp, Homo sapiens
ttggcgctgcccctggcagcccc

SEQ ID NO: 2227015 - DNA, 21 bp, Homo sapiens
ttggctagaggttcaaagata

SEQ ID NO: 2227016 - DNA, 22 bp, Homo sapiens
ttggctagaggttcaaagatat

SEQ ID NO: 2227017 - DNA, 15 bp, Homo sapiens
ttggctgctgaaggc

SEQ ID NO: 2227018 - DNA, 16 bp, Homo sapiens
ttgggaggccatttgt

SEQ ID NO: 2227019 - DNA, 12 bp, Homo sapiens
ttggtcctgctg

SEQ ID NO: 2227020 - DNA, 18 bp, Homo sapiens
ttggtggtttcagaaatg

SEQ ID NO: 2227021 - DNA, 18 bp, Homo sapiens
ttggtgtcgggcatgaca

SEQ ID NO: 2227022 - DNA, 19 bp, Homo sapiens
ttggttaggcattgtggga

SEQ ID NO: 2227023 - DNA, 14 bp, Homo sapiens
ttggtttgtaaatt

SEQ ID NO: 2227024 - DNA, 20 bp, Homo sapiens
ttgtaaaaagggaaaaagac

SEQ ID NO: 2227025 - DNA, 23 bp, Homo sapiens
ttgtaaattaacttttataaact

SEQ ID NO: 2227026 - DNA, 13 bp, Homo sapiens
ttgtacagacaac

SEQ ID NO: 2227027 - DNA, 15 bp, Homo sapiens
ttgtagagccagggt

SEQ ID NO: 2227028 - DNA, 21 bp, Homo sapiens
ttgtattctctcctgtacctc

SEQ ID NO: 2227029 - DNA, 20 bp, Homo sapiens
ttgtattttactaataaaat

SEQ ID NO: 2227030 - DNA, 21 bp, Homo sapiens
ttgtgaggaagccgctggggc

SEQ ID NO: 2227031 - DNA, 19 bp, Homo sapiens
ttgtgatacaatgctgtgc

SEQ ID NO: 2227032 - DNA, 12 bp, Homo sapiens
ttgtgatttttg

SEQ ID NO: 2227033 - DNA, 17 bp, Homo sapiens
ttgtgcattatctagat

SEQ ID NO: 2227034 - DNA, 23 bp, Homo sapiens
ttgtggatttaacagaaatgtac

SEQ ID NO: 2227035 - DNA, 13 bp, Homo sapiens
ttgtgttcacctt

SEQ ID NO: 2227036 - DNA, 19 bp, Homo sapiens
ttgttagtatgaggcattt

SEQ ID NO: 2227037 - DNA, 21 bp, Homo sapiens
ttgttagtatgaggcatttgt

SEQ ID NO: 2227038 - DNA, 22 bp, Homo sapiens
ttgttagtatgaggcatttgtt

SEQ ID NO: 2227039 - DNA, 20 bp, Homo sapiens
ttgtttggggatgagaaagg

SEQ ID NO: 2227040 - DNA, 15 bp, Homo sapiens
tttaacagaaatgta

SEQ ID NO: 2227041 - DNA, 22 bp, Homo sapiens
tttaagaaaaaggatgcacaga

SEQ ID NO: 2227042 - DNA, 19 bp, Homo sapiens
tttaaggatgcttgtacat

SEQ ID NO: 2227043 - DNA, 21 bp, Homo sapiens
tttaaggatgcttgtacataa

SEQ ID NO: 2227044 - DNA, 17 bp, Homo sapiens
tttaagtgctgcattta

SEQ ID NO: 2227045 - DNA, 23 bp, Homo sapiens
tttaatgaaagactgtacaaagt

SEQ ID NO: 2227046 - DNA, 22 bp, Homo sapiens
tttacctgaagtctttgtacag

SEQ ID NO: 2227047 - DNA, 16 bp, Homo sapiens
tttactgcagctttgt

SEQ ID NO: 2227048 - DNA, 11 bp, Homo sapiens
tttacttaaac

SEQ ID NO: 2227049 - DNA, 15 bp, Homo sapiens
tttactttgtgttca

SEQ ID NO: 2227050 - DNA, 12 bp, Homo sapiens
tttagacagagt

SEQ ID NO: 2227051 - DNA, 19 bp, Homo sapiens
tttagaccctattgctgct

SEQ ID NO: 2227052 - DNA, 15 bp, Homo sapiens
tttagataatacacc

SEQ ID NO: 2227053 - DNA, 16 bp, Homo sapiens
tttataaactttacct

SEQ ID NO: 2227054 - DNA, 18 bp, Homo sapiens
tttataaactttaccttt

SEQ ID NO: 2227055 - DNA, 24 bp, Homo sapiens
tttatggcttttgtgcattatcta

SEQ ID NO: 2227056 - DNA, 14 bp, Homo sapiens
tttattgtcaaagt

SEQ ID NO: 2227057 - DNA, 12 bp, Homo sapiens
tttcaaacttta

SEQ ID NO: 2227058 - DNA, 16 bp, Homo sapiens
tttcaaactttactat

SEQ ID NO: 2227059 - DNA, 19 bp, Homo sapiens
tttcaataggaaaaactga

SEQ ID NO: 2227060 - DNA, 20 bp, Homo sapiens
tttcaataggaaaaactgat

SEQ ID NO: 2227061 - DNA, 15 bp, Homo sapiens
tttcactctccttgg

SEQ ID NO: 2227062 - DNA, 11 bp, Homo sapiens
tttcagaaatg

SEQ ID NO: 2227063 - DNA, 17 bp, Homo sapiens
tttcagccaagaattct

SEQ ID NO: 2227064 - DNA, 13 bp, Homo sapiens
tttcagtgtacat

SEQ ID NO: 2227065 - DNA, 22 bp, Homo sapiens
tttcattgctgggcttgtctgt

SEQ ID NO: 2227066 - DNA, 14 bp, Homo sapiens
tttcatttaggtga

SEQ ID NO: 2227067 - DNA, 15 bp, Homo sapiens
tttccaaagtacact

SEQ ID NO: 2227068 - DNA, 15 bp, Homo sapiens
tttccgttaaaatac

SEQ ID NO: 2227069 - DNA, 21 bp, Homo sapiens
tttcctctttggtctacactg

SEQ ID NO: 2227070 - DNA, 19 bp, Homo sapiens
tttcctggcactgcttcca

SEQ ID NO: 2227071 - DNA, 11 bp, Homo sapiens
tttccttcagt

SEQ ID NO: 2227072 - DNA, 12 bp, Homo sapiens
tttccttcagtg

SEQ ID NO: 2227073 - DNA, 18 bp, Homo sapiens
tttccttcagtgccttat

SEQ ID NO: 2227074 - DNA, 21 bp, Homo sapiens
tttccttcagtgccttatgga

SEQ ID NO: 2227075 - DNA, 15 bp, Homo sapiens
tttctacccagcgag

SEQ ID NO: 2227076 - DNA, 16 bp, Homo sapiens
tttctgccgcagccct

SEQ ID NO: 2227077 - DNA, 12 bp, Homo sapiens
tttcttctccct

SEQ ID NO: 2227078 - DNA, 22 bp, Homo sapiens
tttgaagatgccgcatttggat

SEQ ID NO: 2227079 - DNA, 14 bp, Homo sapiens
tttgacaaggggca

SEQ ID NO: 2227080 - DNA, 21 bp, Homo sapiens
tttgacctctgcagcaataaa

SEQ ID NO: 2227081 - DNA, 16 bp, Homo sapiens
tttgacgccatcccag

SEQ ID NO: 2227082 - DNA, 17 bp, Homo sapiens
tttgagatcagcctggg

SEQ ID NO: 2227083 - DNA, 15 bp, Homo sapiens
tttgagcagggctca

SEQ ID NO: 2227084 - DNA, 22 bp, Homo sapiens
tttgaggtctgttctttccaaa

SEQ ID NO: 2227085 - DNA, 13 bp, Homo sapiens
tttgagtgcctta

SEQ ID NO: 2227086 - DNA, 22 bp, Homo sapiens
tttgatgttctttcaccctttt

SEQ ID NO: 2227087 - DNA, 13 bp, Homo sapiens
tttgattaaattc

SEQ ID NO: 2227088 - DNA, 24 bp, Homo sapiens
cttggattgtccccgacccttgcc

SEQ ID NO: 2227089 - DNA, 12 bp, Homo sapiens
cttggcgctgcc

SEQ ID NO: 2227090 - DNA, 20 bp, Homo sapiens
cttggcgctgcccctggcag

SEQ ID NO: 2227091 - DNA, 21 bp, Homo sapiens
cttggcgctgcccctggcagc

SEQ ID NO: 2227092 - DNA, 17 bp, Homo sapiens
cttggctgcagggagtc

SEQ ID NO: 2227093 - DNA, 14 bp, Homo sapiens
cttgggccactgtg

SEQ ID NO: 2227094 - DNA, 17 bp, Homo sapiens
cttggggaccagagctg

SEQ ID NO: 2227095 - DNA, 21 bp, Homo sapiens
cttggggaccagagctgccac

SEQ ID NO: 2227096 - DNA, 22 bp, Homo sapiens
cttggggaccagagctgccacc

SEQ ID NO: 2227097 - DNA, 17 bp, Homo sapiens
cttggggggctccaggg

SEQ ID NO: 2227098 - DNA, 23 bp, Homo sapiens
cttggggggctgaggtgggagga

SEQ ID NO: 2227099 - DNA, 16 bp, Homo sapiens
cttggtcctgctgcag

SEQ ID NO: 2227100 - DNA, 17 bp, Homo sapiens
cttggtcctgctgcagt

SEQ ID NO: 2227101 - DNA, 20 bp, Homo sapiens
cttggtcctgctgcagttgc

SEQ ID NO: 2227102 - DNA, 20 bp, Homo sapiens
cttggttcccatttgctcct

SEQ ID NO: 2227103 - DNA, 17 bp, Homo sapiens
gaaggctcgagcatgcc

SEQ ID NO: 2227104 - DNA, 22 bp, Homo sapiens
gaaggctgggttctgatcctag

SEQ ID NO: 2227105 - DNA, 13 bp, Homo sapiens
gaagggggctggg

SEQ ID NO: 2227106 - DNA, 20 bp, Homo sapiens
gaagtaatatgcacacattt

SEQ ID NO: 2227107 - DNA, 22 bp, Homo sapiens
gaagtaatatgcacacattttt

SEQ ID NO: 2227108 - DNA, 15 bp, Homo sapiens
gaagtactggagaaa

SEQ ID NO: 2227109 - DNA, 13 bp, Homo sapiens
gaagtcacacagt

SEQ ID NO: 2227110 - DNA, 15 bp, Homo sapiens
gaagtcttagatgta

SEQ ID NO: 2227111 - DNA, 18 bp, Homo sapiens
gaagtcttagatgtatat

SEQ ID NO: 2227112 - DNA, 14 bp, Homo sapiens
gaagtctttgtaca

SEQ ID NO: 2227113 - DNA, 21 bp, Homo sapiens
gaatacagaggcaactgcatt

SEQ ID NO: 2227114 - DNA, 13 bp, Homo sapiens
gaatacctgtccc

SEQ ID NO: 2227115 - DNA, 15 bp, Homo sapiens
gaatagctgggacta

SEQ ID NO: 2227116 - DNA, 23 bp, Homo sapiens
gaatagctgggactacaggtgtg

SEQ ID NO: 2227117 - DNA, 22 bp, Homo sapiens
gaatattgctgatggtgcaatg

SEQ ID NO: 2227118 - DNA, 18 bp, Homo sapiens
gaatccagacccggctgc

SEQ ID NO: 2227119 - DNA, 20 bp, Homo sapiens
gaatccagacccggctgcgt

SEQ ID NO: 2227120 - DNA, 14 bp, Homo sapiens
gaatgaaagggccc

SEQ ID NO: 2227121 - DNA, 22 bp, Homo sapiens
gaatgaaccacatcttgctctg

SEQ ID NO: 2227122 - DNA, 23 bp, Homo sapiens
gaatgaaccacatcttgctctgc

SEQ ID NO: 2227123 - DNA, 18 bp, Homo sapiens
gaatgaatgtcagtgtga

SEQ ID NO: 2227124 - DNA, 14 bp, Homo sapiens
gaatgattaattaa

SEQ ID NO: 2227125 - DNA, 19 bp, Homo sapiens
gaatgcacaaacagaggcc

SEQ ID NO: 2227126 - DNA, 12 bp, Homo sapiens
gaatgcagagat

SEQ ID NO: 2227127 - DNA, 11 bp, Homo sapiens
gaatgcagtgg

SEQ ID NO: 2227128 - DNA, 20 bp, Homo sapiens
gaatgcgggggagcaggcag

SEQ ID NO: 2227129 - DNA, 14 bp, Homo sapiens
gaatgtcagtgtga

SEQ ID NO: 2227130 - DNA, 18 bp, Homo sapiens
gaatgtttgcctctgcct

SEQ ID NO: 2227131 - DNA, 17 bp, Homo sapiens
gaattctctagtttgat

SEQ ID NO: 2227132 - DNA, 19 bp, Homo sapiens
gaattctctagtttgatta

SEQ ID NO: 2227133 - DNA, 14 bp, Homo sapiens
gaattgaagcagga

SEQ ID NO: 2227134 - DNA, 22 bp, Homo sapiens
gaattgtaaggaatgattaatt

SEQ ID NO: 2227135 - DNA, 23 bp, Homo sapiens
gaattttggctgtgtctcccttc

SEQ ID NO: 2227136 - DNA, 20 bp, Homo sapiens
gacaatgacttactgtacat

SEQ ID NO: 2227137 - DNA, 12 bp, Homo sapiens
gacaatgtgaaa

SEQ ID NO: 2227138 - DNA, 19 bp, Homo sapiens
gacaatgtgaaaagaaaaa

SEQ ID NO: 2227139 - DNA, 13 bp, Homo sapiens
gacaatttattat

SEQ ID NO: 2227140 - DNA, 19 bp, Homo sapiens
gacaatttattatggcaca

SEQ ID NO: 2227141 - DNA, 22 bp, Homo sapiens
gacacaagccttcggcgcctta

SEQ ID NO: 2227142 - DNA, 13 bp, Homo sapiens
gacacacagctct

SEQ ID NO: 2227143 - DNA, 15 bp, Homo sapiens
gacacacagctctgt

SEQ ID NO: 2227144 - DNA, 15 bp, Homo sapiens
gacacaggcccggct

SEQ ID NO: 2227145 - DNA, 17 bp, Homo sapiens
gacacaggcccggctcc

SEQ ID NO: 2227146 - DNA, 18 bp, Homo sapiens
gacacaggcccggctcca

SEQ ID NO: 2227147 - DNA, 19 bp, Homo sapiens
gacacaggcccggctccag

SEQ ID NO: 2227148 - DNA, 14 bp, Homo sapiens
gacacatgcaaggt

SEQ ID NO: 2227149 - DNA, 13 bp, Homo sapiens
gacaccctgtgat

SEQ ID NO: 2227150 - DNA, 22 bp, Homo sapiens
gacaccctgtgatggggccctg

SEQ ID NO: 2227151 - DNA, 23 bp, Homo sapiens
gacaccctgtgatggggccctgc

SEQ ID NO: 2227152 - DNA, 17 bp, Homo sapiens
gacaccttgacagggca

SEQ ID NO: 2227153 - DNA, 18 bp, Homo sapiens
gacaccttgacagggcac

SEQ ID NO: 2227154 - DNA, 17 bp, Homo sapiens
gacacgaatattgctga

SEQ ID NO: 2227155 - DNA, 22 bp, Homo sapiens
gacacgaatattgctgatggtg

SEQ ID NO: 2227156 - DNA, 15 bp, Homo sapiens
gacactaaccacgct

SEQ ID NO: 2227157 - DNA, 16 bp, Homo sapiens
gacactaaccacgctg

SEQ ID NO: 2227158 - DNA, 18 bp, Homo sapiens
gacactaaccacgctgga

SEQ ID NO: 2227159 - DNA, 20 bp, Homo sapiens
gacactaaccacgctggacc

SEQ ID NO: 2227160 - DNA, 13 bp, Homo sapiens
gacactgatgggc

SEQ ID NO: 2227161 - DNA, 12 bp, Homo sapiens
gacagacacagg

SEQ ID NO: 2227162 - DNA, 14 bp, Homo sapiens
gacagacacaggcc

SEQ ID NO: 2227163 - DNA, 16 bp, Homo sapiens
gacagacacaggcccg

SEQ ID NO: 2227164 - DNA, 17 bp, Homo sapiens
gacagacacaggcccgg

SEQ ID NO: 2227165 - DNA, 21 bp, Homo sapiens
gacagagcaagtgagaccctg

SEQ ID NO: 2227166 - DNA, 13 bp, Homo sapiens
gacagagggggtg

SEQ ID NO: 2227167 - DNA, 15 bp, Homo sapiens
gacagagggggtggc

SEQ ID NO: 2227168 - DNA, 21 bp, Homo sapiens
gacagagggggtggcctccca

SEQ ID NO: 2227169 - DNA, 23 bp, Homo sapiens
gacagagggggtggcctcccaac

SEQ ID NO: 2227170 - DNA, 20 bp, Homo sapiens
gacagagtgagactctgtct

SEQ ID NO: 2227171 - DNA, 13 bp, Homo sapiens
gacagcacaggca

SEQ ID NO: 2227172 - DNA, 14 bp, Homo sapiens
gacagccacggcca

SEQ ID NO: 2227173 - DNA, 19 bp, Homo sapiens
gacagccacggccaggcca

SEQ ID NO: 2227174 - DNA, 16 bp, Homo sapiens
gacagcccgggctctg

SEQ ID NO: 2227175 - DNA, 22 bp, Homo sapiens
gacagcccgggctctgcctccc

SEQ ID NO: 2227176 - DNA, 23 bp, Homo sapiens
gacagcccgggctctgcctccca

SEQ ID NO: 2227177 - DNA, 13 bp, Homo sapiens
gacagctccttct

SEQ ID NO: 2227178 - DNA, 14 bp, Homo sapiens
gacagctccttctg

SEQ ID NO: 2227179 - DNA, 15 bp, Homo sapiens
gacagctccttctgt

SEQ ID NO: 2227180 - DNA, 16 bp, Homo sapiens
gacagctccttctgtc

SEQ ID NO: 2227181 - DNA, 18 bp, Homo sapiens
gacagctccttctgtcct

SEQ ID NO: 2227182 - DNA, 12 bp, Homo sapiens
gacagctgcctg

SEQ ID NO: 2227183 - DNA, 13 bp, Homo sapiens
gacagctgcctgg

SEQ ID NO: 2227184 - DNA, 14 bp, Homo sapiens
gacaggaccaggga

SEQ ID NO: 2227185 - DNA, 13 bp, Homo sapiens
gacaggcaagcac

SEQ ID NO: 2227186 - DNA, 17 bp, Homo sapiens
gacaggcaagcacctcc

SEQ ID NO: 2227187 - DNA, 18 bp, Homo sapiens
gacaggcaagcacctcct

SEQ ID NO: 2227188 - DNA, 21 bp, Homo sapiens
gacaggcaagcacctcctgcc

SEQ ID NO: 2227189 - DNA, 14 bp, Homo sapiens
gacaggcaatgctg

SEQ ID NO: 2227190 - DNA, 24 bp, Homo sapiens
gacaggcaatgctggctgttggct

SEQ ID NO: 2227191 - DNA, 18 bp, Homo sapiens
gacaggcatgttctctga

SEQ ID NO: 2227192 - DNA, 20 bp, Homo sapiens
gacaggcatgttctctgagg

SEQ ID NO: 2227193 - DNA, 20 bp, Homo sapiens
gacagggttttgccatgttg

SEQ ID NO: 2227194 - DNA, 15 bp, Homo sapiens
gacagtccctgccaa

SEQ ID NO: 2227195 - DNA, 16 bp, Homo sapiens
gacatactaaccagca

SEQ ID NO: 2227196 - DNA, 16 bp, Homo sapiens
gacatcaactgcatca

SEQ ID NO: 2227197 - DNA, 15 bp, Homo sapiens
gacattgcggacagc

SEQ ID NO: 2227198 - DNA, 14 bp, Homo sapiens
gaccacgtttctaa

SEQ ID NO: 2227199 - DNA, 17 bp, Homo sapiens
gaccagagctgccacct

SEQ ID NO: 2227200 - DNA, 18 bp, Homo sapiens
gaccagagctgccacctg

SEQ ID NO: 2227201 - DNA, 19 bp, Homo sapiens
gaccagagctgccacctgc

SEQ ID NO: 2227202 - DNA, 21 bp, Homo sapiens
gaccagcaccatctctcctcc

SEQ ID NO: 2227203 - DNA, 18 bp, Homo sapiens
gaccagggatttccatga

SEQ ID NO: 2227204 - DNA, 13 bp, Homo sapiens
gaccatccctgaa

SEQ ID NO: 2227205 - DNA, 15 bp, Homo sapiens
gaccatccctgaagg

SEQ ID NO: 2227206 - DNA, 20 bp, Homo sapiens
gaccatccctgaaggccccg

SEQ ID NO: 2227207 - DNA, 19 bp, Homo sapiens
gaccattctccacctgcca

SEQ ID NO: 2227208 - DNA, 20 bp, Homo sapiens
gaccattctccacctgccag

SEQ ID NO: 2227209 - DNA, 15 bp, Homo sapiens
gacccatgctgccct

SEQ ID NO: 2227210 - DNA, 19 bp, Homo sapiens
gacccatgctgccctgtga

SEQ ID NO: 2227211 - DNA, 13 bp, Homo sapiens
gacccctccatgt

SEQ ID NO: 2227212 - DNA, 14 bp, Homo sapiens
gacccctccatgtg

SEQ ID NO: 2227213 - DNA, 18 bp, Homo sapiens
gacccctccatgtgggct

SEQ ID NO: 2227214 - DNA, 12 bp, Homo sapiens
gacccggctgcg

SEQ ID NO: 2227215 - DNA, 18 bp, Homo sapiens
gaccctgaggcccagagg

SEQ ID NO: 2227216 - DNA, 12 bp, Homo sapiens
gaccctgccctg

SEQ ID NO: 2227217 - DNA, 12 bp, Homo sapiens
gaccctgtctca

SEQ ID NO: 2227218 - DNA, 15 bp, Homo sapiens
gacccttgtggtccc

SEQ ID NO: 2227219 - DNA, 19 bp, Homo sapiens
gaccgtgaggccagagaca

SEQ ID NO: 2227220 - DNA, 18 bp, Homo sapiens
gacctctgcagcaataaa

SEQ ID NO: 2227221 - DNA, 13 bp, Homo sapiens
gacctctgcctga

SEQ ID NO: 2227222 - DNA, 11 bp, Homo sapiens
gacctgaggcc

SEQ ID NO: 2227223 - DNA, 18 bp, Homo sapiens
gacctgaggcccttctct

SEQ ID NO: 2227224 - DNA, 15 bp, Homo sapiens
gcccctgccaccctg

SEQ ID NO: 2227225 - DNA, 16 bp, Homo sapiens
gcccctgccaccctgg

SEQ ID NO: 2227226 - DNA, 13 bp, Homo sapiens
gcccctgcccggc

SEQ ID NO: 2227227 - DNA, 15 bp, Homo sapiens
gcccctgcccggctg

SEQ ID NO: 2227228 - DNA, 12 bp, Homo sapiens
gcccctgctggt

SEQ ID NO: 2227229 - DNA, 15 bp, Homo sapiens
gcccctgctggttca

SEQ ID NO: 2227230 - DNA, 16 bp, Homo sapiens
gcccctggcagcccct

SEQ ID NO: 2227231 - DNA, 17 bp, Homo sapiens
gcccctgttctggcaga

SEQ ID NO: 2227232 - DNA, 17 bp, Homo sapiens
gcccggctccaggctcc

SEQ ID NO: 2227233 - DNA, 15 bp, Homo sapiens
gcccgggctctgcct

SEQ ID NO: 2227234 - DNA, 11 bp, Homo sapiens
gccctcccacc

SEQ ID NO: 2227235 - DNA, 18 bp, Homo sapiens
gccctcccaccccctccc

SEQ ID NO: 2227236 - DNA, 13 bp, Homo sapiens
gccctgcagaggg

SEQ ID NO: 2227237 - DNA, 16 bp, Homo sapiens
gccctgcagagggcac

SEQ ID NO: 2227238 - DNA, 21 bp, Homo sapiens
gccctgcccacctggcctctg

SEQ ID NO: 2227239 - DNA, 11 bp, Homo sapiens
gccctgcctcc

SEQ ID NO: 2227240 - DNA, 14 bp, Homo sapiens
gccctggtggcagt

SEQ ID NO: 2227241 - DNA, 18 bp, Homo sapiens
gccctggtggcagtggga

SEQ ID NO: 2227242 - DNA, 19 bp, Homo sapiens
gccctggtggcagtgggag

SEQ ID NO: 2227243 - DNA, 17 bp, Homo sapiens
gccctgtgggcccccaa

SEQ ID NO: 2227244 - DNA, 22 bp, Homo sapiens
gcccttagcagggaaacagcta

SEQ ID NO: 2227245 - DNA, 13 bp, Homo sapiens
gcccttctctcca

SEQ ID NO: 2227246 - DNA, 21 bp, Homo sapiens
gccgagatcacgccactgcac

SEQ ID NO: 2227247 - DNA, 15 bp, Homo sapiens
gccgcagccctgcag

SEQ ID NO: 2227248 - DNA, 16 bp, Homo sapiens
gccgccatgctcctgg

SEQ ID NO: 2227249 - DNA, 21 bp, Homo sapiens
gccgggcgcggtggctcacgc

SEQ ID NO: 2227250 - DNA, 18 bp, Homo sapiens
gccgtctacctgaggggc

SEQ ID NO: 2227251 - DNA, 20 bp, Homo sapiens
gccgtctacctgaggggcct

SEQ ID NO: 2227252 - DNA, 20 bp, Homo sapiens
gccgtgtaaccatggaccca

SEQ ID NO: 2227253 - DNA, 14 bp, Homo sapiens
gctaacatggaagt

SEQ ID NO: 2227254 - DNA, 15 bp, Homo sapiens
gctaatgggacacta

SEQ ID NO: 2227255 - DNA, 14 bp, Homo sapiens
gctacacaggggaa

SEQ ID NO: 2227256 - DNA, 14 bp, Homo sapiens
gctacccgggaagg

SEQ ID NO: 2227257 - DNA, 21 bp, Homo sapiens
gctacccgggaagggggctgg

SEQ ID NO: 2227258 - DNA, 19 bp, Homo sapiens
gctagaggttcaaagatat

SEQ ID NO: 2227259 - DNA, 21 bp, Homo sapiens
gctagaggttcaaagatattt

SEQ ID NO: 2227260 - DNA, 18 bp, Homo sapiens
gctaggaacactccttca

SEQ ID NO: 2227261 - DNA, 14 bp, Homo sapiens
gctaggcctggcca

SEQ ID NO: 2227262 - DNA, 15 bp, Homo sapiens
gctaggcctggccag

SEQ ID NO: 2227263 - DNA, 17 bp, Homo sapiens
gctaggcctggccagat

SEQ ID NO: 2227264 - DNA, 21 bp, Homo sapiens
gctagttgggcttcctcatag

SEQ ID NO: 2227265 - DNA, 13 bp, Homo sapiens
gctatctccccca

SEQ ID NO: 2227266 - DNA, 15 bp, Homo sapiens
gctatctcccccagc

SEQ ID NO: 2227267 - DNA, 20 bp, Homo sapiens
gctatctcccccagccccat

SEQ ID NO: 2227268 - DNA, 21 bp, Homo sapiens
gctatctcccccagccccatc

SEQ ID NO: 2227269 - DNA, 18 bp, Homo sapiens
gctattcagtaataactc

SEQ ID NO: 2227270 - DNA, 19 bp, Homo sapiens
gctattcagtaataactct

SEQ ID NO: 2227271 - DNA, 15 bp, Homo sapiens
gctcaccagccccag

SEQ ID NO: 2227272 - DNA, 23 bp, Homo sapiens
gctcaccagccccagtgcccaca

SEQ ID NO: 2227273 - DNA, 17 bp, Homo sapiens
gctcagcggggacagct

SEQ ID NO: 2227274 - DNA, 16 bp, Homo sapiens
gctcagggcctggctc

SEQ ID NO: 2227275 - DNA, 18 bp, Homo sapiens
gctcagggcctggctcag

SEQ ID NO: 2227276 - DNA, 21 bp, Homo sapiens
gctccaagctcccaggcattc

SEQ ID NO: 2227277 - DNA, 13 bp, Homo sapiens
gctccagctcacc

SEQ ID NO: 2227278 - DNA, 20 bp, Homo sapiens
gctccagctcaccagcccca

SEQ ID NO: 2227279 - DNA, 21 bp, Homo sapiens
gctccagctgttcagctggtt

SEQ ID NO: 2227280 - DNA, 11 bp, Homo sapiens
gctccaggagc

SEQ ID NO: 2227281 - DNA, 21 bp, Homo sapiens
gctccagggggtgccctccca

SEQ ID NO: 2227282 - DNA, 23 bp, Homo sapiens
gctccagggggtgccctcccaga

SEQ ID NO: 2227283 - DNA, 21 bp, Homo sapiens
gctcccaggcattccccagga

SEQ ID NO: 2227284 - DNA, 22 bp, Homo sapiens
gctcccaggcattccccaggag

SEQ ID NO: 2227285 - DNA, 15 bp, Homo sapiens
gctcccttcccacct

SEQ ID NO: 2227286 - DNA, 16 bp, Homo sapiens
gctcccttcccacctc

SEQ ID NO: 2227287 - DNA, 19 bp, Homo sapiens
gctcctctccccagcaagt

SEQ ID NO: 2227288 - DNA, 19 bp, Homo sapiens
gctcctggcccactgcatc

SEQ ID NO: 2227289 - DNA, 17 bp, Homo sapiens
gctcgagcatgcctgga

SEQ ID NO: 2227290 - DNA, 19 bp, Homo sapiens
gctcgagcatgcctggatg

SEQ ID NO: 2227291 - DNA, 21 bp, Homo sapiens
gctcgagcatgcctggatggg

SEQ ID NO: 2227292 - DNA, 18 bp, Homo sapiens
gctctcaagttatcaggg

SEQ ID NO: 2227293 - DNA, 17 bp, Homo sapiens
gctctcaggccagctgc

SEQ ID NO: 2227294 - DNA, 15 bp, Homo sapiens
gctctgcctcccatc

SEQ ID NO: 2227295 - DNA, 21 bp, Homo sapiens
gctctggacaggcatgttctc

SEQ ID NO: 2227296 - DNA, 22 bp, Homo sapiens
gctctggacaggcatgttctct

SEQ ID NO: 2227297 - DNA, 15 bp, Homo sapiens
gctctggtccataga

SEQ ID NO: 2227298 - DNA, 14 bp, Homo sapiens
gctctgtcctggga

SEQ ID NO: 2227299 - DNA, 16 bp, Homo sapiens
gctctgtcctgggagt

SEQ ID NO: 2227300 - DNA, 19 bp, Homo sapiens
gctcttccaggctgggaga

SEQ ID NO: 2227301 - DNA, 22 bp, Homo sapiens
gctcttccaggctgggagagcc

SEQ ID NO: 2227302 - DNA, 16 bp, Homo sapiens
gctcttctccaggctg

SEQ ID NO: 2227303 - DNA, 12 bp, Homo sapiens
gctgaaggctcg

SEQ ID NO: 2227304 - DNA, 17 bp, Homo sapiens
gctgaatggttttcaaa

SEQ ID NO: 2227305 - DNA, 13 bp, Homo sapiens
gctgacagacaca

SEQ ID NO: 2227306 - DNA, 18 bp, Homo sapiens
gctgagggtgagtgggtg

SEQ ID NO: 2227307 - DNA, 14 bp, Homo sapiens
gctgaggtgggagg

SEQ ID NO: 2227308 - DNA, 18 bp, Homo sapiens
gctgcaccctcaggcagg

SEQ ID NO: 2227309 - DNA, 17 bp, Homo sapiens
gctgcaccggctggcct

SEQ ID NO: 2227310 - DNA, 18 bp, Homo sapiens
gctgcaccggctggcctg

SEQ ID NO: 2227311 - DNA, 18 bp, Homo sapiens
gctgcagttgccagtcac

SEQ ID NO: 2227312 - DNA, 20 bp, Homo sapiens
gctgcagttgccagtcaccc

SEQ ID NO: 2227313 - DNA, 21 bp, Homo sapiens
gctgcagttgccagtcacccc

SEQ ID NO: 2227314 - DNA, 17 bp, Homo sapiens
gctgcatttaaaagata

SEQ ID NO: 2227315 - DNA, 19 bp, Homo sapiens
gctgcatttaaaagataca

SEQ ID NO: 2227316 - DNA, 15 bp, Homo sapiens
gctgccaatgggagc

SEQ ID NO: 2227317 - DNA, 16 bp, Homo sapiens
gctgccaatgggagct

SEQ ID NO: 2227318 - DNA, 12 bp, Homo sapiens
gctgccacctgc

SEQ ID NO: 2227319 - DNA, 13 bp, Homo sapiens
gctgccacctgcc

SEQ ID NO: 2227320 - DNA, 17 bp, Homo sapiens
gctgccatccaggttca

SEQ ID NO: 2227321 - DNA, 13 bp, Homo sapiens
gctgcccctggca

SEQ ID NO: 2227322 - DNA, 15 bp, Homo sapiens
gctgcccctggcagc

SEQ ID NO: 2227323 - DNA, 16 bp, Homo sapiens
gctgcccctggcagcc

SEQ ID NO: 2227324 - DNA, 12 bp, Homo sapiens
gctgccctgccc

SEQ ID NO: 2227325 - DNA, 18 bp, Homo sapiens
gctgccctgcccacctgg

SEQ ID NO: 2227326 - DNA, 16 bp, Homo sapiens
gctgcctctcccatca

SEQ ID NO: 2227327 - DNA, 18 bp, Homo sapiens
gctgcctgggatccctca

SEQ ID NO: 2227328 - DNA, 19 bp, Homo sapiens
gctgcctgggatccctcat

SEQ ID NO: 2227329 - DNA, 17 bp, Homo sapiens
gctgcctgttcagctcc

SEQ ID NO: 2227330 - DNA, 17 bp, Homo sapiens
gctgcggtccacccagg

SEQ ID NO: 2227331 - DNA, 12 bp, Homo sapiens
gctgctgaaggc

SEQ ID NO: 2227332 - DNA, 12 bp, Homo sapiens
gctgctgacagt

SEQ ID NO: 2227333 - DNA, 21 bp, Homo sapiens
gctgcttcaaggatcctgagc

SEQ ID NO: 2227334 - DNA, 22 bp, Homo sapiens
gctgcttcaaggatcctgagcc

SEQ ID NO: 2227335 - DNA, 16 bp, Homo sapiens
gctggaccttgaactg

SEQ ID NO: 2227336 - DNA, 22 bp, Homo sapiens
gctggaccttgaactgggtact

SEQ ID NO: 2227337 - DNA, 12 bp, Homo sapiens
gctggcctggcc

SEQ ID NO: 2227338 - DNA, 14 bp, Homo sapiens
gctggcctggcccc

SEQ ID NO: 2227339 - DNA, 19 bp, Homo sapiens
gctggcctggcccctcagg

SEQ ID NO: 2227340 - DNA, 17 bp, Homo sapiens
gctggctgttggctggg

SEQ ID NO: 2227341 - DNA, 19 bp, Homo sapiens
gctggctgttggctggggg

SEQ ID NO: 2227342 - DNA, 23 bp, Homo sapiens
gctggctgttggctgggggcctc

SEQ ID NO: 2227343 - DNA, 20 bp, Homo sapiens
gctgggactacaggcaccca

SEQ ID NO: 2227344 - DNA, 13 bp, Homo sapiens
gctgggagagcct

SEQ ID NO: 2227345 - DNA, 19 bp, Homo sapiens
gctgggagagccttccagg

SEQ ID NO: 2227346 - DNA, 16 bp, Homo sapiens
gctgggattacaggtg

SEQ ID NO: 2227347 - DNA, 18 bp, Homo sapiens
gctgggattacaggtgtg

SEQ ID NO: 2227348 - DNA, 19 bp, Homo sapiens
gctgggattacaggtgtga

SEQ ID NO: 2227349 - DNA, 15 bp, Homo sapiens
gctgggcagaggaaa

SEQ ID NO: 2227350 - DNA, 17 bp, Homo sapiens
gctgggcagaggaaagc

SEQ ID NO: 2227351 - DNA, 21 bp, Homo sapiens
gctgggctcccttcccacctc

SEQ ID NO: 2227352 - DNA, 18 bp, Homo sapiens
gctgggggcctcagtgcc

SEQ ID NO: 2227353 - DNA, 17 bp, Homo sapiens
gctggggtggggacctc

SEQ ID NO: 2227354 - DNA, 22 bp, Homo sapiens
gctggggtggggacctcaggcc

SEQ ID NO: 2227355 - DNA, 21 bp, Homo sapiens
gctgggtggcaccagcagcct

SEQ ID NO: 2227356 - DNA, 18 bp, Homo sapiens
gctgggttctacccaggt

SEQ ID NO: 2227357 - DNA, 15 bp, Homo sapiens
gctggtcccactcag

SEQ ID NO: 2227358 - DNA, 18 bp, Homo sapiens
gctggtgtcacctgaaga

SEQ ID NO: 2227359 - DNA, 16 bp, Homo sapiens
gctgtcaattacagga

SEQ ID NO: 2227360 - DNA, 22 bp, Homo sapiens
gctgtcccttacgtgagtcctg

SEQ ID NO: 2227361 - DNA, 17 bp, Homo sapiens
gctgtctccatgtttga

SEQ ID NO: 2227362 - DNA, 18 bp, Homo sapiens
gctgtgctctggacaggc

SEQ ID NO: 2227363 - DNA, 17 bp, Homo sapiens
gctgtgctgccctgccc

SEQ ID NO: 2227364 - DNA, 19 bp, Homo sapiens
gctgtgctgccctgcccac

SEQ ID NO: 2227365 - DNA, 16 bp, Homo sapiens
gctgttggctgggggc

SEQ ID NO: 2227366 - DNA, 21 bp, Homo sapiens
gctgttggctgggggcctcag

SEQ ID NO: 2227367 - DNA, 17 bp, Homo sapiens
gcttaacttcacatatt

SEQ ID NO: 2227368 - DNA, 17 bp, Homo sapiens
gcttagtcactgagaca

SEQ ID NO: 2227369 - DNA, 20 bp, Homo sapiens
gcttagtcactgagacagcc

SEQ ID NO: 2227370 - DNA, 12 bp, Homo sapiens
gcttatacactt

SEQ ID NO: 2227371 - DNA, 20 bp, Homo sapiens
gcttatacacttacacttta

SEQ ID NO: 2227372 - DNA, 19 bp, Homo sapiens
gcttcaaggatcctgagcc

SEQ ID NO: 2227373 - DNA, 15 bp, Homo sapiens
gcttcagtggcagct

SEQ ID NO: 2227374 - DNA, 16 bp, Homo sapiens
gcttcagtggcagctg

SEQ ID NO: 2227375 - DNA, 20 bp, Homo sapiens
gcttcagtggcagctgcttt

SEQ ID NO: 2227376 - DNA, 21 bp, Homo sapiens
gcttcatcctcctcagatctt

SEQ ID NO: 2227377 - DNA, 18 bp, Homo sapiens
gcttccagtgaggctctg

SEQ ID NO: 2227378 - DNA, 20 bp, Homo sapiens
gcttccagtgaggctctgcc

SEQ ID NO: 2227379 - DNA, 21 bp, Homo sapiens
gcttccagtgaggctctgccc

SEQ ID NO: 2227380 - DNA, 22 bp, Homo sapiens
gcttccagtgaggctctgccct

SEQ ID NO: 2227381 - DNA, 23 bp, Homo sapiens
gcttccagtgaggctctgccctt

SEQ ID NO: 2227382 - DNA, 22 bp, Homo sapiens
gcttctcactgccatgccagct

SEQ ID NO: 2227383 - DNA, 19 bp, Homo sapiens
gcttcttcagagactcctg

SEQ ID NO: 2227384 - DNA, 17 bp, Homo sapiens
gcttgaccgtgaggcca

SEQ ID NO: 2227385 - DNA, 19 bp, Homo sapiens
gcttgaccgtgaggccaga

SEQ ID NO: 2227386 - DNA, 15 bp, Homo sapiens
gcttggaggaaggaa

SEQ ID NO: 2227387 - DNA, 20 bp, Homo sapiens
gcttggggggctccaggggg

SEQ ID NO: 2227388 - DNA, 12 bp, Homo sapiens
gcttgtacataa

SEQ ID NO: 2227389 - DNA, 23 bp, Homo sapiens
gctttctacccagcgagccctgg

SEQ ID NO: 2227390 - DNA, 21 bp, Homo sapiens
gctttgtttgttgtcagctga

SEQ ID NO: 2227391 - DNA, 12 bp, Homo sapiens
gcttttgtgcat

SEQ ID NO: 2227392 - DNA, 13 bp, Homo sapiens
gcttttgtgcatt

SEQ ID NO: 2227393 - DNA, 19 bp, Homo sapiens
gcttttgtgcattatctag

SEQ ID NO: 2227394 - DNA, 14 bp, Homo sapiens
ggaaaataaattat

SEQ ID NO: 2227395 - DNA, 23 bp, Homo sapiens
ggaaaatcagcctgctccagctg

SEQ ID NO: 2227396 - DNA, 20 bp, Homo sapiens
ggaaacagctaatgggacac

SEQ ID NO: 2227397 - DNA, 15 bp, Homo sapiens
ggaaacccagctctg

SEQ ID NO: 2227398 - DNA, 16 bp, Homo sapiens
ggaaacccagctctgg

SEQ ID NO: 2227399 - DNA, 16 bp, Homo sapiens
ggaaagagtaggaaga

SEQ ID NO: 2227400 - DNA, 17 bp, Homo sapiens
ggaaagagtaggaagac

SEQ ID NO: 2227401 - DNA, 19 bp, Homo sapiens
ggaaagcaaaggagattgg

SEQ ID NO: 2227402 - DNA, 13 bp, Homo sapiens
ggaaaggctccag

SEQ ID NO: 2227403 - DNA, 14 bp, Homo sapiens
ggaaaggctccagg

SEQ ID NO: 2227404 - DNA, 20 bp, Homo sapiens
ggaaaggctccaggagcagc

SEQ ID NO: 2227405 - DNA, 21 bp, Homo sapiens
ggaaaggctccaggagcagcc

SEQ ID NO: 2227406 - DNA, 14 bp, Homo sapiens
ggaaatgggcagag

SEQ ID NO: 2227407 - DNA, 19 bp, Homo sapiens
ggaacactccttcacagat

SEQ ID NO: 2227408 - DNA, 14 bp, Homo sapiens
ggaacactctgaga

SEQ ID NO: 2227409 - DNA, 13 bp, Homo sapiens
ggaagacagctct

SEQ ID NO: 2227410 - DNA, 20 bp, Homo sapiens
ggaagacttcatccctctgg

SEQ ID NO: 2227411 - DNA, 23 bp, Homo sapiens
ggaagcacatgcctctctcaggc

SEQ ID NO: 2227412 - DNA, 15 bp, Homo sapiens
ggaagcagaaacaaa

SEQ ID NO: 2227413 - DNA, 17 bp, Homo sapiens
ggaagccagcaggctct

SEQ ID NO: 2227414 - DNA, 15 bp, Homo sapiens
ggaagctcagggcct

SEQ ID NO: 2227415 - DNA, 21 bp, Homo sapiens
ggaagctcagggcctggctca

SEQ ID NO: 2227416 - DNA, 20 bp, Homo sapiens
tccaagaagcccaggaaagg

SEQ ID NO: 2227417 - DNA, 22 bp, Homo sapiens
tccaagaagcccaggaaaggct

SEQ ID NO: 2227418 - DNA, 14 bp, Homo sapiens
tccaagcaggacat

SEQ ID NO: 2227419 - DNA, 13 bp, Homo sapiens
tccaagctcccag

SEQ ID NO: 2227420 - DNA, 14 bp, Homo sapiens
tccacaagagccca

SEQ ID NO: 2227421 - DNA, 20 bp, Homo sapiens
tccacaagagcccaggcctc

SEQ ID NO: 2227422 - DNA, 17 bp, Homo sapiens
tccacaagttaaataaa

SEQ ID NO: 2227423 - DNA, 18 bp, Homo sapiens
tccacaagttaaataaat

SEQ ID NO: 2227424 - DNA, 18 bp, Homo sapiens
tccaccatcaagccacca

SEQ ID NO: 2227425 - DNA, 12 bp, Homo sapiens
tccacccacctc

SEQ ID NO: 2227426 - DNA, 13 bp, Homo sapiens
tccacccacctca

SEQ ID NO: 2227427 - DNA, 17 bp, Homo sapiens
tccacccacctcagcct

SEQ ID NO: 2227428 - DNA, 12 bp, Homo sapiens
tccacccaggag

SEQ ID NO: 2227429 - DNA, 14 bp, Homo sapiens
tccacccaggagcc

SEQ ID NO: 2227430 - DNA, 20 bp, Homo sapiens
tccacccaggagccccgagg

SEQ ID NO: 2227431 - DNA, 12 bp, Homo sapiens
tccaccctgctc

SEQ ID NO: 2227432 - DNA, 12 bp, Homo sapiens
tccacctgccag

SEQ ID NO: 2227433 - DNA, 18 bp, Homo sapiens
tccacctgccagggacag

SEQ ID NO: 2227434 - DNA, 21 bp, Homo sapiens
tccactgtgccatgtgccagg

SEQ ID NO: 2227435 - DNA, 14 bp, Homo sapiens
tccactttctagcc

SEQ ID NO: 2227436 - DNA, 19 bp, Homo sapiens
tccactttctagccagagg

SEQ ID NO: 2227437 - DNA, 16 bp, Homo sapiens
tccagaatttcccaaa

SEQ ID NO: 2227438 - DNA, 14 bp, Homo sapiens
tccagacccggctg

SEQ ID NO: 2227439 - DNA, 15 bp, Homo sapiens
tccagacccggctgc

SEQ ID NO: 2227440 - DNA, 19 bp, Homo sapiens
tccagacccggctgcgtgg

SEQ ID NO: 2227441 - DNA, 14 bp, Homo sapiens
tccagcccctggat

SEQ ID NO: 2227442 - DNA, 15 bp, Homo sapiens
tccagctcaccagcc

SEQ ID NO: 2227443 - DNA, 17 bp, Homo sapiens
tccagctcaccagcccc

SEQ ID NO: 2227444 - DNA, 23 bp, Homo sapiens
tccagctcaccagccccagtgcc

SEQ ID NO: 2227445 - DNA, 16 bp, Homo sapiens
tccaggagcagccaca

SEQ ID NO: 2227446 - DNA, 17 bp, Homo sapiens
tccaggagcagccacat

SEQ ID NO: 2227447 - DNA, 10 bp, Homo sapiens
tccaggctcc

SEQ ID NO: 2227448 - DNA, 22 bp, Homo sapiens
tccaggctcctttagcgcccag

SEQ ID NO: 2227449 - DNA, 14 bp, Homo sapiens
tccaggctgtatcc

SEQ ID NO: 2227450 - DNA, 18 bp, Homo sapiens
tccagggggtgccctccc

SEQ ID NO: 2227451 - DNA, 19 bp, Homo sapiens
tccaggggtgggacaccct

SEQ ID NO: 2227452 - DNA, 20 bp, Homo sapiens
tccaggtttaagctgttact

SEQ ID NO: 2227453 - DNA, 16 bp, Homo sapiens
tccagtgaggctctgc

SEQ ID NO: 2227454 - DNA, 23 bp, Homo sapiens
tccagtgaggctctgcccttggt

SEQ ID NO: 2227455 - DNA, 15 bp, Homo sapiens
tccatggactttgtt

SEQ ID NO: 2227456 - DNA, 18 bp, Homo sapiens
tcccaaagcagtgcatgc

SEQ ID NO: 2227457 - DNA, 14 bp, Homo sapiens
tcccaaagtgctgg

SEQ ID NO: 2227458 - DNA, 16 bp, Homo sapiens
tcccaaagtgctggga

SEQ ID NO: 2227459 - DNA, 21 bp, Homo sapiens
tcccaaagtgctgggattaca

SEQ ID NO: 2227460 - DNA, 14 bp, Homo sapiens
tcccaagctctgct

SEQ ID NO: 2227461 - DNA, 16 bp, Homo sapiens
tcccacaaaggagagc

SEQ ID NO: 2227462 - DNA, 15 bp, Homo sapiens
tcccacctcagcctc

SEQ ID NO: 2227463 - DNA, 20 bp, Homo sapiens
tcccacctctctcactcctt

SEQ ID NO: 2227464 - DNA, 21 bp, Homo sapiens
tcccaccttggctgcagggag

SEQ ID NO: 2227465 - DNA, 12 bp, Homo sapiens
tcccagccccaa

SEQ ID NO: 2227466 - DNA, 21 bp, Homo sapiens
tcccagctgtgctctggacag

SEQ ID NO: 2227467 - DNA, 23 bp, Homo sapiens
tcccagctgtgctctggacaggc

SEQ ID NO: 2227468 - DNA, 20 bp, Homo sapiens
tcccaggcattccccaggag

SEQ ID NO: 2227469 - DNA, 24 bp, Homo sapiens
tcccaggcattccccaggaggcca

SEQ ID NO: 2227470 - DNA, 19 bp, Homo sapiens
tcccagtgccgagaaggaa

SEQ ID NO: 2227471 - DNA, 13 bp, Homo sapiens
tcccatctcacac

SEQ ID NO: 2227472 - DNA, 19 bp, Homo sapiens
tcccatctcacacatgagc

SEQ ID NO: 2227473 - DNA, 20 bp, Homo sapiens
tcccatctcacacatgagca

SEQ ID NO: 2227474 - DNA, 15 bp, Homo sapiens
tcccatgagcctcag

SEQ ID NO: 2227475 - DNA, 18 bp, Homo sapiens
tcccatgagcctcagcat

SEQ ID NO: 2227476 - DNA, 20 bp, Homo sapiens
tcccatgagcctcagcatcc

SEQ ID NO: 2227477 - DNA, 12 bp, Homo sapiens
tccccaccctga

SEQ ID NO: 2227478 - DNA, 22 bp, Homo sapiens
tccccacttgagaattaccctt

SEQ ID NO: 2227479 - DNA, 13 bp, Homo sapiens
tccccaggaggcc

SEQ ID NO: 2227480 - DNA, 16 bp, Homo sapiens
tccccaggaggccagc

SEQ ID NO: 2227481 - DNA, 20 bp, Homo sapiens
tccccaggaggccagccttg

SEQ ID NO: 2227482 - DNA, 17 bp, Homo sapiens
tcccccagccccatcct

SEQ ID NO: 2227483 - DNA, 17 bp, Homo sapiens
tcccccgccccatcctc

SEQ ID NO: 2227484 - DNA, 14 bp, Homo sapiens
tcccctgctgggtg

SEQ ID NO: 2227485 - DNA, 20 bp, Homo sapiens
tcccctgctgggtgtggcgc

SEQ ID NO: 2227486 - DNA, 24 bp, Homo sapiens
tcccctgctgggtgtggcgcagca

SEQ ID NO: 2227487 - DNA, 22 bp, Homo sapiens
tcccctgtagagtgggagctga

SEQ ID NO: 2227488 - DNA, 18 bp, Homo sapiens
tcccctgtttgtttctga

SEQ ID NO: 2227489 - DNA, 15 bp, Homo sapiens
tcccgaatagctggg

SEQ ID NO: 2227490 - DNA, 16 bp, Homo sapiens
tccctattagagaaga

SEQ ID NO: 2227491 - DNA, 17 bp, Homo sapiens
tccctccctctttccct

SEQ ID NO: 2227492 - DNA, 14 bp, Homo sapiens
tccctctttccctc

SEQ ID NO: 2227493 - DNA, 20 bp, Homo sapiens
tccctctttccctcccttcc

SEQ ID NO: 2227494 - DNA, 23 bp, Homo sapiens
tccctgaaggccccgcccaggct

SEQ ID NO: 2227495 - DNA, 20 bp, Homo sapiens
tccctgcggaagccacaggg

SEQ ID NO: 2227496 - DNA, 16 bp, Homo sapiens
tccctggtggcagctc

SEQ ID NO: 2227497 - DNA, 20 bp, Homo sapiens
tccctggtggcagctcacct

SEQ ID NO: 2227498 - DNA, 13 bp, Homo sapiens
tcccttcccacct

SEQ ID NO: 2227499 - DNA, 15 bp, Homo sapiens
tcccttcctctttcc

SEQ ID NO: 2227500 - DNA, 20 bp, Homo sapiens
tcccttttttggctgctgaa

SEQ ID NO: 2227501 - DNA, 16 bp, Homo sapiens
tccgctttctacccag

SEQ ID NO: 2227502 - DNA, 16 bp, Homo sapiens
tcctaagctattcagt

SEQ ID NO: 2227503 - DNA, 18 bp, Homo sapiens
tcctaagctattcagtaa

SEQ ID NO: 2227504 - DNA, 20 bp, Homo sapiens
tcctaagctattcagtaata

SEQ ID NO: 2227505 - DNA, 18 bp, Homo sapiens
tcctacccaccctccttt

SEQ ID NO: 2227506 - DNA, 16 bp, Homo sapiens
tcctagaaattcccca

SEQ ID NO: 2227507 - DNA, 13 bp, Homo sapiens
tcctaggcatttg

SEQ ID NO: 2227508 - DNA, 14 bp, Homo sapiens
tcctaggcatttgc

SEQ ID NO: 2227509 - DNA, 12 bp, Homo sapiens
tcctagttccac

SEQ ID NO: 2227510 - DNA, 14 bp, Homo sapiens
tcctagttccacca

SEQ ID NO: 2227511 - DNA, 23 bp, Homo sapiens
tcctatattgttttcagtgtaca

SEQ ID NO: 2227512 - DNA, 20 bp, Homo sapiens
tcctcagatcttctgtgggt

SEQ ID NO: 2227513 - DNA, 18 bp, Homo sapiens
tcctcatacccaccccca

SEQ ID NO: 2227514 - DNA, 22 bp, Homo sapiens
tcctcatacccacccccaccca

SEQ ID NO: 2227515 - DNA, 23 bp, Homo sapiens
tcctcatacccacccccacccaa

SEQ ID NO: 2227516 - DNA, 17 bp, Homo sapiens
tcctcattagcattttg

SEQ ID NO: 2227517 - DNA, 12 bp, Homo sapiens
tcctcccacctc

SEQ ID NO: 2227518 - DNA, 15 bp, Homo sapiens
tcctcccacctcagc

SEQ ID NO: 2227519 - DNA, 21 bp, Homo sapiens
tcctcccacctcagcctcccg

SEQ ID NO: 2227520 - DNA, 11 bp, Homo sapiens
tcctccctccc

SEQ ID NO: 2227521 - DNA, 15 bp, Homo sapiens
tcctccctccctctt

SEQ ID NO: 2227522 - DNA, 14 bp, Homo sapiens
tcctctaggaggtc

SEQ ID NO: 2227523 - DNA, 12 bp, Homo sapiens
tcctctccccag

SEQ ID NO: 2227524 - DNA, 15 bp, Homo sapiens
tcctctgctgctggc

SEQ ID NO: 2227525 - DNA, 15 bp, Homo sapiens
tcctctggcctgtgt

SEQ ID NO: 2227526 - DNA, 21 bp, Homo sapiens
ggcacagaaaatggaagacag

SEQ ID NO: 2227527 - DNA, 15 bp, Homo sapiens
ggcacccggcccctg

SEQ ID NO: 2227528 - DNA, 23 bp, Homo sapiens
ggcactcagaagacactgatggg

SEQ ID NO: 2227529 - DNA, 20 bp, Homo sapiens
ggcactgcttccagtgaggc

SEQ ID NO: 2227530 - DNA, 16 bp, Homo sapiens
ggcagagcagagacca

SEQ ID NO: 2227531 - DNA, 22 bp, Homo sapiens
ggcagagcagagaccatccctg

SEQ ID NO: 2227532 - DNA, 17 bp, Homo sapiens
ggcagaggaaagcaaag

SEQ ID NO: 2227533 - DNA, 23 bp, Homo sapiens
ggcagatacaggaaaagctgctg

SEQ ID NO: 2227534 - DNA, 11 bp, Homo sapiens
ggcagcagaga

SEQ ID NO: 2227535 - DNA, 14 bp, Homo sapiens
ggcagcagagagag

SEQ ID NO: 2227536 - DNA, 15 bp, Homo sapiens
ggcagcagagagaga

SEQ ID NO: 2227537 - DNA, 22 bp, Homo sapiens
ggcagccccattctgcctgccc

SEQ ID NO: 2227538 - DNA, 11 bp, Homo sapiens
ggcagcccctg

SEQ ID NO: 2227539 - DNA, 12 bp, Homo sapiens
ggcagctcacct

SEQ ID NO: 2227540 - DNA, 21 bp, Homo sapiens
ggcagctgcggtccacccagg

SEQ ID NO: 2227541 - DNA, 17 bp, Homo sapiens
ggcagcttgagggttgg

SEQ ID NO: 2227542 - DNA, 15 bp, Homo sapiens
ggcaggttggtgggg

SEQ ID NO: 2227543 - DNA, 14 bp, Homo sapiens
ggcagtgggagctg

SEQ ID NO: 2227544 - DNA, 16 bp, Homo sapiens
ggcagtgggagctgcc

SEQ ID NO: 2227545 - DNA, 17 bp, Homo sapiens
ggcagtgggagctgcct

SEQ ID NO: 2227546 - DNA, 15 bp, Homo sapiens
ggcagtggggctgga

SEQ ID NO: 2227547 - DNA, 21 bp, Homo sapiens
ggcagtggggctggaagcaga

SEQ ID NO: 2227548 - DNA, 12 bp, Homo sapiens
ggcattgtggga

SEQ ID NO: 2227549 - DNA, 12 bp, Homo sapiens
ggccaaaggaag

SEQ ID NO: 2227550 - DNA, 16 bp, Homo sapiens
ggccaaaggaagcaca

SEQ ID NO: 2227551 - DNA, 19 bp, Homo sapiens
ggccaaaggaagcacatgc

SEQ ID NO: 2227552 - DNA, 17 bp, Homo sapiens
ggccacaagacccttgt

SEQ ID NO: 2227553 - DNA, 22 bp, Homo sapiens
ggccacagaaaattcttctcca

SEQ ID NO: 2227554 - DNA, 16 bp, Homo sapiens
ggccacctgcggtgct

SEQ ID NO: 2227555 - DNA, 11 bp, Homo sapiens
ggccactgtga

SEQ ID NO: 2227556 - DNA, 16 bp, Homo sapiens
ggccactgtgaagaga

SEQ ID NO: 2227557 - DNA, 20 bp, Homo sapiens
ggccactgtgaagagaacca

SEQ ID NO: 2227558 - DNA, 16 bp, Homo sapiens
ggccagatgcaccagc

SEQ ID NO: 2227559 - DNA, 23 bp, Homo sapiens
ggccagctgcttgggcttcatcc

SEQ ID NO: 2227560 - DNA, 15 bp, Homo sapiens
ggccaggccctctgc

SEQ ID NO: 2227561 - DNA, 18 bp, Homo sapiens
ggccaggccctctgccca

SEQ ID NO: 2227562 - DNA, 12 bp, Homo sapiens
ggccaggctggt

SEQ ID NO: 2227563 - DNA, 16 bp, Homo sapiens
ggccaggctggtctca

SEQ ID NO: 2227564 - DNA, 16 bp, Homo sapiens
ggccagtgtgacaagg

SEQ ID NO: 2227565 - DNA, 20 bp, Homo sapiens
ggccagtgtgacaaggattg

SEQ ID NO: 2227566 - DNA, 13 bp, Homo sapiens
ggcccaagagaga

SEQ ID NO: 2227567 - DNA, 14 bp, Homo sapiens
ggcccaagagagac

SEQ ID NO: 2227568 - DNA, 16 bp, Homo sapiens
ggcccaagagagacag

SEQ ID NO: 2227569 - DNA, 22 bp, Homo sapiens
ggcccaagagagacagcacagg

SEQ ID NO: 2227570 - DNA, 14 bp, Homo sapiens
ggcccagagggcct

SEQ ID NO: 2227571 - DNA, 20 bp, Homo sapiens
ggcccagagggcctgcaagg

SEQ ID NO: 2227572 - DNA, 19 bp, Homo sapiens
ggcccctcagggtccctgg

SEQ ID NO: 2227573 - DNA, 20 bp, Homo sapiens
ggcccctcagggtccctggt

SEQ ID NO: 2227574 - DNA, 16 bp, Homo sapiens
ggcccctgcccggctg

SEQ ID NO: 2227575 - DNA, 13 bp, Homo sapiens
ggcccggctccag

SEQ ID NO: 2227576 - DNA, 15 bp, Homo sapiens
ggccctctgcccact

SEQ ID NO: 2227577 - DNA, 13 bp, Homo sapiens
ggccctgcctcct

SEQ ID NO: 2227578 - DNA, 14 bp, Homo sapiens
ggccctgcctcctt

SEQ ID NO: 2227579 - DNA, 14 bp, Homo sapiens
tctgccctccaaga

SEQ ID NO: 2227580 - DNA, 19 bp, Homo sapiens
tctgccctccaagaccttc

SEQ ID NO: 2227581 - DNA, 16 bp, Homo sapiens
tgacctctgcagcaat

SEQ ID NO: 2227582 - DNA, 11 bp, Homo sapiens
cagagcagaga

SEQ ID NO: 2227583 - DNA, 17 bp, Homo sapiens
cagagcagagaccatcc

SEQ ID NO: 2227584 - DNA, 16 bp, Homo sapiens
cagagcccacgccccc

SEQ ID NO: 2227585 - DNA, 19 bp, Homo sapiens
cagagcccacgcccccact

SEQ ID NO: 2227586 - DNA, 13 bp, Homo sapiens
cagagctgccacc

SEQ ID NO: 2227587 - DNA, 17 bp, Homo sapiens
cagaggaaagcaaagga

SEQ ID NO: 2227588 - DNA, 11 bp, Homo sapiens
cagaggcagcc

SEQ ID NO: 2227589 - DNA, 11 bp, Homo sapiens
aaaaaaaacac

SEQ ID NO: 2227590 - DNA, 15 bp, Homo sapiens
aaaaaatattttcct

SEQ ID NO: 2227591 - DNA, 14 bp, Homo sapiens
aaaaacacaaaagt

SEQ ID NO: 2227592 - DNA, 15 bp, Homo sapiens
aaaaagaaaggaggg

SEQ ID NO: 2227593 - DNA, 22 bp, Homo sapiens
aaaaagcgaaccgtgaggaggg

SEQ ID NO: 2227594 - DNA, 15 bp, Homo sapiens
aaaaagggaaaaaga

SEQ ID NO: 2227595 - DNA, 17 bp, Homo sapiens
aaaaatccccaaaaaag

SEQ ID NO: 2227596 - DNA, 15 bp, Homo sapiens
aaaacacatttttct

SEQ ID NO: 2227597 - DNA, 17 bp, Homo sapiens
aaaacacatttttctta

SEQ ID NO: 2227598 - DNA, 19 bp, Homo sapiens
aaaacactgttctctgccc

SEQ ID NO: 2227599 - DNA, 14 bp, Homo sapiens
aaaacatgctacac

SEQ ID NO: 2227600 - DNA, 14 bp, Homo sapiens
aaaacgtggctgct

SEQ ID NO: 2227601 - DNA, 16 bp, Homo sapiens
aaaacgtggctgcttc

SEQ ID NO: 2227602 - DNA, 18 bp, Homo sapiens
aaaacgtggctgcttcaa

SEQ ID NO: 2227603 - DNA, 22 bp, Homo sapiens
aaaactgctgactgttttctct

SEQ ID NO: 2227604 - DNA, 23 bp, Homo sapiens
aaaactgctgactgttttctctt

SEQ ID NO: 2227605 - DNA, 22 bp, Homo sapiens
aaaacttgatgtgttatctctt

SEQ ID NO: 2227606 - DNA, 14 bp, Homo sapiens
aaaagctgggcagg

SEQ ID NO: 2227607 - DNA, 19 bp, Homo sapiens
aaaaggatgcacagagttg

SEQ ID NO: 2227608 - DNA, 22 bp, Homo sapiens
aaaaggatgcacagagttgtta

SEQ ID NO: 2227609 - DNA, 16 bp, Homo sapiens
aaaagggaaaaagacc

SEQ ID NO: 2227610 - DNA, 14 bp, Homo sapiens
aaaataccagccag

SEQ ID NO: 2227611 - DNA, 12 bp, Homo sapiens
aaaatagcctgc

SEQ ID NO: 2227612 - DNA, 21 bp, Homo sapiens
aaaatcagcctgctccagctg

SEQ ID NO: 2227613 - DNA, 16 bp, Homo sapiens
aaaatctcaaatttct

SEQ ID NO: 2227614 - DNA, 18 bp, Homo sapiens
aaaatgtatgtgtaagta

SEQ ID NO: 2227615 - DNA, 12 bp, Homo sapiens
aaacaaaatgaa

SEQ ID NO: 2227616 - DNA, 17 bp, Homo sapiens
aaacaaaatgaaaaaaa

SEQ ID NO: 2227617 - DNA, 13 bp, Homo sapiens
aaacacaaaaaaa

SEQ ID NO: 2227618 - DNA, 22 bp, Homo sapiens
aaacactgttctctgccctcca

SEQ ID NO: 2227619 - DNA, 17 bp, Homo sapiens
aaacagctaatgggaca

SEQ ID NO: 2227620 - DNA, 22 bp, Homo sapiens
aaacatgctacacactgcatgt

SEQ ID NO: 2227621 - DNA, 19 bp, Homo sapiens
aaacattttgtcatataag

SEQ ID NO: 2227622 - DNA, 23 bp, Homo sapiens
aaaccaagtcaagtgaaaaagga

SEQ ID NO: 2227623 - DNA, 16 bp, Homo sapiens
aaacccagctctggtc

SEQ ID NO: 2227624 - DNA, 15 bp, Homo sapiens
aaacgggctcagcaa

SEQ ID NO: 2227625 - DNA, 16 bp, Homo sapiens
aaacgtggctgcttca

SEQ ID NO: 2227626 - DNA, 20 bp, Homo sapiens
aaactgatttttttttcctt

SEQ ID NO: 2227627 - DNA, 23 bp, Homo sapiens
aaactgatttttttttccttcag

SEQ ID NO: 2227628 - DNA, 16 bp, Homo sapiens
aaacttaatctaaatg

SEQ ID NO: 2227629 - DNA, 17 bp, Homo sapiens
aaacttaatctaaatgg

SEQ ID NO: 2227630 - DNA, 14 bp, Homo sapiens
aaactttacctttt

SEQ ID NO: 2227631 - DNA, 12 bp, Homo sapiens
aaactttactat

SEQ ID NO: 2227632 - DNA, 15 bp, Homo sapiens
aaagaatgcagagat

SEQ ID NO: 2227633 - DNA, 19 bp, Homo sapiens
aaagacctcgtggagaatt

SEQ ID NO: 2227634 - DNA, 17 bp, Homo sapiens
aaagactatctaaatgt

SEQ ID NO: 2227635 - DNA, 23 bp, Homo sapiens
aaagactgagtacgttgtgcatt

SEQ ID NO: 2227636 - DNA, 10 bp, Homo sapiens
aaagagagag

SEQ ID NO: 2227637 - DNA, 15 bp, Homo sapiens
aaagatacagttact

SEQ ID NO: 2227638 - DNA, 12 bp, Homo sapiens
aaagatattttg

SEQ ID NO: 2227639 - DNA, 20 bp, Homo sapiens
aaagatattttgctttgtga

SEQ ID NO: 2227640 - DNA, 19 bp, Homo sapiens
aaagatgcttctcactgcc

SEQ ID NO: 2227641 - DNA, 17 bp, Homo sapiens
aaagcagtgcatgctgt

SEQ ID NO: 2227642 - DNA, 23 bp, Homo sapiens
aaagcgaaccgtgaggaggggtg

SEQ ID NO: 2227643 - DNA, 16 bp, Homo sapiens
aaagctaggcctggcc

SEQ ID NO: 2227644 - DNA, 17 bp, Homo sapiens
aaagctaggcctggcca

SEQ ID NO: 2227645 - DNA, 22 bp, Homo sapiens
aaagctgccagccgagatagcc

SEQ ID NO: 2227646 - DNA, 15 bp, Homo sapiens
aaagcttgttaagat

SEQ ID NO: 2227647 - DNA, 11 bp, Homo sapiens
aaaggaaagag

SEQ ID NO: 2227648 - DNA, 22 bp, Homo sapiens
aaaggaaagagggaggtaagga

SEQ ID NO: 2227649 - DNA, 17 bp, Homo sapiens
aaaggagattggaagga

SEQ ID NO: 2227650 - DNA, 22 bp, Homo sapiens
aaagggacttggaagctccgct

SEQ ID NO: 2227651 - DNA, 18 bp, Homo sapiens
aaaggggggtgggagggg

SEQ ID NO: 2227652 - DNA, 18 bp, Homo sapiens
aaagtacactgtttcaaa

SEQ ID NO: 2227653 - DNA, 19 bp, Homo sapiens
aaagtacttctccaccctg

SEQ ID NO: 2227654 - DNA, 21 bp, Homo sapiens
aaagtacttctccaccctgct

SEQ ID NO: 2227655 - DNA, 18 bp, Homo sapiens
aaagtatccctactgtaa

SEQ ID NO: 2227656 - DNA, 14 bp, Homo sapiens
aaagtgtatttttt

SEQ ID NO: 2227657 - DNA, 21 bp, Homo sapiens
aaagtgtatttttttactaat

SEQ ID NO: 2227658 - DNA, 23 bp, Homo sapiens
aaagtttctcttttcaaaacatt

SEQ ID NO: 2227659 - DNA, 19 bp, Homo sapiens
aaataaaactttttaaaat

SEQ ID NO: 2227660 - DNA, 11 bp, Homo sapiens
aaataaattat

SEQ ID NO: 2227661 - DNA, 12 bp, Homo sapiens
aaataatgtgaa

SEQ ID NO: 2227662 - DNA, 18 bp, Homo sapiens
aaataccagccagtaaat

SEQ ID NO: 2227663 - DNA, 20 bp, Homo sapiens
aaataccagccagtaaatgg

SEQ ID NO: 2227664 - DNA, 24 bp, Homo sapiens
aaatagctcaggtgtccctgcact

SEQ ID NO: 2227665 - DNA, 19 bp, Homo sapiens
aaatagtggtgtgatttgg

SEQ ID NO: 2227666 - DNA, 14 bp, Homo sapiens
aaatatctgaaaat

SEQ ID NO: 2227667 - DNA, 19 bp, Homo sapiens
aaatatctgaaaatgtatg

SEQ ID NO: 2227668 - DNA, 19 bp, Homo sapiens
aaatcagcctgctccagct

SEQ ID NO: 2227669 - DNA, 16 bp, Homo sapiens
aaatcagctgctacta

SEQ ID NO: 2227670 - DNA, 19 bp, Homo sapiens
aaatccccaaaaaagcgaa

SEQ ID NO: 2227671 - DNA, 18 bp, Homo sapiens
aaatctgctttttaaaga

SEQ ID NO: 2227672 - DNA, 13 bp, Homo sapiens
aaatctttttgct

SEQ ID NO: 2227673 - DNA, 13 bp, Homo sapiens
aaatgagcctggc

SEQ ID NO: 2227674 - DNA, 14 bp, Homo sapiens
aaatgcccagcccc

SEQ ID NO: 2227675 - DNA, 14 bp, Homo sapiens
aaatggacgtgtta

SEQ ID NO: 2227676 - DNA, 20 bp, Homo sapiens
aaatgggcagagcagagacc

SEQ ID NO: 2227677 - DNA, 15 bp, Homo sapiens
aaatgggggtgcatt

SEQ ID NO: 2227678 - DNA, 19 bp, Homo sapiens
aaatgggggtgcatttgag

SEQ ID NO: 2227679 - DNA, 14 bp, Homo sapiens
aaattaacttttat

SEQ ID NO: 2227680 - DNA, 19 bp, Homo sapiens
aaattaacttttataaact

SEQ ID NO: 2227681 - DNA, 21 bp, Homo sapiens
aaattaacttttataaacttt

SEQ ID NO: 2227682 - DNA, 16 bp, Homo sapiens
aaattccccaccctga

SEQ ID NO: 2227683 - DNA, 21 bp, Homo sapiens
aaattcttgcaaagtatccct

SEQ ID NO: 2227684 - DNA, 15 bp, Homo sapiens
aacaaaatgaaaaaa

SEQ ID NO: 2227685 - DNA, 19 bp, Homo sapiens
acatcttggtcagatttga

SEQ ID NO: 2227686 - DNA, 15 bp, Homo sapiens
acatgaaaacacatt

SEQ ID NO: 2227687 - DNA, 17 bp, Homo sapiens
acatgaaaacacatttt

SEQ ID NO: 2227688 - DNA, 20 bp, Homo sapiens
acatgagcatcaggccaggc

SEQ ID NO: 2227689 - DNA, 17 bp, Homo sapiens
acatgcaaggtcatttt

SEQ ID NO: 2227690 - DNA, 19 bp, Homo sapiens
acatgcaaggtcatttttt

SEQ ID NO: 2227691 - DNA, 15 bp, Homo sapiens
acatgctacacactg

SEQ ID NO: 2227692 - DNA, 17 bp, Homo sapiens
acatgtaattaagtact

SEQ ID NO: 2227693 - DNA, 18 bp, Homo sapiens
acatgtgcacatgcacgt

SEQ ID NO: 2227694 - DNA, 14 bp, Homo sapiens
acattcctgatgct

SEQ ID NO: 2227695 - DNA, 15 bp, Homo sapiens
acattctgttaatca

SEQ ID NO: 2227696 - DNA, 21 bp, Homo sapiens
acattgcggacagccacggcc

SEQ ID NO: 2227697 - DNA, 22 bp, Homo sapiens
acattgcggacagccacggcca

SEQ ID NO: 2227698 - DNA, 14 bp, Homo sapiens
acatttattctgct

SEQ ID NO: 2227699 - DNA, 19 bp, Homo sapiens
acattttattttattatgc

SEQ ID NO: 2227700 - DNA, 21 bp, Homo sapiens
acatttttaagtgctgcattt

SEQ ID NO: 2227701 - DNA, 23 bp, Homo sapiens
acatttttcttagggaaggatac

SEQ ID NO: 2227702 - DNA, 21 bp, Homo sapiens
acattttttaaatgcacctgg

SEQ ID NO: 2227703 - DNA, 23 bp, Homo sapiens
accacacccagcccacttctgcc

SEQ ID NO: 2227704 - DNA, 19 bp, Homo sapiens
accacatcttgctctgctg

SEQ ID NO: 2227705 - DNA, 20 bp, Homo sapiens
accacatcttgctctgctga

SEQ ID NO: 2227706 - DNA, 24 bp, Homo sapiens
accacatcttgctctgctgacaga

SEQ ID NO: 2227707 - DNA, 18 bp, Homo sapiens
accacatgtgcacatgca

SEQ ID NO: 2227708 - DNA, 20 bp, Homo sapiens
accacccccgatgggatggc

SEQ ID NO: 2227709 - DNA, 14 bp, Homo sapiens
accacgtttctaaa

SEQ ID NO: 2227710 - DNA, 16 bp, Homo sapiens
accactacattctgtt

SEQ ID NO: 2227711 - DNA, 22 bp, Homo sapiens
accagacaccttgacagggcac

SEQ ID NO: 2227712 - DNA, 12 bp, Homo sapiens
accagagcccac

SEQ ID NO: 2227713 - DNA, 13 bp, Homo sapiens
accagagctgcca

SEQ ID NO: 2227714 - DNA, 16 bp, Homo sapiens
accagagctgccacct

SEQ ID NO: 2227715 - DNA, 13 bp, Homo sapiens
accagcagaaatg

SEQ ID NO: 2227716 - DNA, 17 bp, Homo sapiens
accagcagcctggaccc

SEQ ID NO: 2227717 - DNA, 17 bp, Homo sapiens
accagccagtaaatggg

SEQ ID NO: 2227718 - DNA, 16 bp, Homo sapiens
accagccccagtgccc

SEQ ID NO: 2227719 - DNA, 21 bp, Homo sapiens
accagtgttgtggatttaaca

SEQ ID NO: 2227720 - DNA, 14 bp, Homo sapiens
accatattaccaca

SEQ ID NO: 2227721 - DNA, 16 bp, Homo sapiens
accatattaccacaga

SEQ ID NO: 2227722 - DNA, 17 bp, Homo sapiens
accatcatgtctggcta

SEQ ID NO: 2227723 - DNA, 12 bp, Homo sapiens
accatcattgaa

SEQ ID NO: 2227724 - DNA, 23 bp, Homo sapiens
accatcattgaaatctttttgct

SEQ ID NO: 2227725 - DNA, 21 bp, Homo sapiens
accatccctgaaggccccgcc

SEQ ID NO: 2227726 - DNA, 17 bp, Homo sapiens
acccacccccacccaag

SEQ ID NO: 2227727 - DNA, 15 bp, Homo sapiens
acccaccctcctttc

SEQ ID NO: 2227728 - DNA, 14 bp, Homo sapiens
acccacctcagcct

SEQ ID NO: 2227729 - DNA, 16 bp, Homo sapiens
acccagaagaaaatag

SEQ ID NO: 2227730 - DNA, 17 bp, Homo sapiens
acccagcccacttctgc

SEQ ID NO: 2227731 - DNA, 19 bp, Homo sapiens
acccagcgagccctggtgg

SEQ ID NO: 2227732 - DNA, 13 bp, Homo sapiens
acccagctctggt

SEQ ID NO: 2227733 - DNA, 15 bp, Homo sapiens
acccaggagccccga

SEQ ID NO: 2227734 - DNA, 23 bp, Homo sapiens
acccaggagccccgaggccttct

SEQ ID NO: 2227735 - DNA, 17 bp, Homo sapiens
acccatgctgccctgtg

SEQ ID NO: 2227736 - DNA, 19 bp, Homo sapiens
acccatgctgccctgtgag

SEQ ID NO: 2227737 - DNA, 16 bp, Homo sapiens
accccacacacgccag

SEQ ID NO: 2227738 - DNA, 13 bp, Homo sapiens
accccagccccaa

SEQ ID NO: 2227739 - DNA, 12 bp, Homo sapiens
accccaggctgg

SEQ ID NO: 2227740 - DNA, 18 bp, Homo sapiens
accccatctctacaaaaa

SEQ ID NO: 2227741 - DNA, 12 bp, Homo sapiens
acccccacccaa

SEQ ID NO: 2227742 - DNA, 12 bp, Homo sapiens
acccccagcctg

SEQ ID NO: 2227743 - DNA, 13 bp, Homo sapiens
acccccagcctgc

SEQ ID NO: 2227744 - DNA, 15 bp, Homo sapiens
acccccagcctgcta

SEQ ID NO: 2227745 - DNA, 20 bp, Homo sapiens
accccctccccgggcagcag

SEQ ID NO: 2227746 - DNA, 22 bp, Homo sapiens
accccctccccgggcagcagag

SEQ ID NO: 2227747 - DNA, 11 bp, Homo sapiens
accccctgaat

SEQ ID NO: 2227748 - DNA, 15 bp, Homo sapiens
accccggccacctgc

SEQ ID NO: 2227749 - DNA, 19 bp, Homo sapiens
acccgctaagagggaggga

SEQ ID NO: 2227750 - DNA, 14 bp, Homo sapiens
acccggcccctgct

SEQ ID NO: 2227751 - DNA, 15 bp, Homo sapiens
acccggcccctgctg

SEQ ID NO: 2227752 - DNA, 17 bp, Homo sapiens
acccggcccctgctggt

SEQ ID NO: 2227753 - DNA, 20 bp, Homo sapiens
acccgggaagggggctggga

SEQ ID NO: 2227754 - DNA, 17 bp, Homo sapiens
accctcatgttcttaat

SEQ ID NO: 2227755 - DNA, 15 bp, Homo sapiens
accctgaggcccaga

SEQ ID NO: 2227756 - DNA, 16 bp, Homo sapiens
accctggggagaaagt

SEQ ID NO: 2227757 - DNA, 17 bp, Homo sapiens
accctgtgatggggccc

SEQ ID NO: 2227758 - DNA, 19 bp, Homo sapiens
accctgtgatggggccctg

SEQ ID NO: 2227759 - DNA, 19 bp, Homo sapiens
acccttgtggtcccacccc

SEQ ID NO: 2227760 - DNA, 12 bp, Homo sapiens
accgcagacagg

SEQ ID NO: 2227761 - DNA, 20 bp, Homo sapiens
accgcagacaggaccaggga

SEQ ID NO: 2227762 - DNA, 14 bp, Homo sapiens
accggctggcctgg

SEQ ID NO: 2227763 - DNA, 17 bp, Homo sapiens
accggctggcctggccc

SEQ ID NO: 2227764 - DNA, 19 bp, Homo sapiens
accggctggcctggcccct

SEQ ID NO: 2227765 - DNA, 12 bp, Homo sapiens
accgggcactca

SEQ ID NO: 2227766 - DNA, 14 bp, Homo sapiens
accgggcactcaga

SEQ ID NO: 2227767 - DNA, 19 bp, Homo sapiens
accgggccacagagaaagt

SEQ ID NO: 2227768 - DNA, 20 bp, Homo sapiens
accgggccacagagaaagta

SEQ ID NO: 2227769 - DNA, 15 bp, Homo sapiens
accgtgaggaggggt

SEQ ID NO: 2227770 - DNA, 19 bp, Homo sapiens
accgtgaggaggggtgtgg

SEQ ID NO: 2227771 - DNA, 12 bp, Homo sapiens
acctcagcctcc

SEQ ID NO: 2227772 - DNA, 12 bp, Homo sapiens
acctcaggcctg

SEQ ID NO: 2227773 - DNA, 14 bp, Homo sapiens
acctcaggcctggg

SEQ ID NO: 2227774 - DNA, 20 bp, Homo sapiens
acctcccacaaaggagagct

SEQ ID NO: 2227775 - DNA, 13 bp, Homo sapiens
acctctcccttgg

SEQ ID NO: 2227776 - DNA, 14 bp, Homo sapiens
acctctcccttgga

SEQ ID NO: 2227777 - DNA, 18 bp, Homo sapiens
acctctgcacaagctgca

SEQ ID NO: 2227778 - DNA, 21 bp, Homo sapiens
acctctgcacaagctgcaccc

SEQ ID NO: 2227779 - DNA, 18 bp, Homo sapiens
acctctgcagcaataaag

SEQ ID NO: 2227780 - DNA, 18 bp, Homo sapiens
acctgaagactcattctt

SEQ ID NO: 2227781 - DNA, 22 bp, Homo sapiens
acctgaagtctttgtacagaca

SEQ ID NO: 2227782 - DNA, 19 bp, Homo sapiens
acctgaattttggctgtgt

SEQ ID NO: 2227783 - DNA, 14 bp, Homo sapiens
acctgaggcccttc

SEQ ID NO: 2227784 - DNA, 20 bp, Homo sapiens
acctgaggcccttctctcca

SEQ ID NO: 2227785 - DNA, 23 bp, Homo sapiens
acctgaggcccttctctccagcc

SEQ ID NO: 2227786 - DNA, 15 bp, Homo sapiens
acctgattgtgtctc

SEQ ID NO: 2227787 - DNA, 17 bp, Homo sapiens
acctgattgtgtctctt

SEQ ID NO: 2227788 - DNA, 18 bp, Homo sapiens
acctgattgtgtctcttg

SEQ ID NO: 2227789 - DNA, 18 bp, Homo sapiens
acctgccaggaagccagc

SEQ ID NO: 2227790 - DNA, 21 bp, Homo sapiens
acctgccaggaagccagcagg

SEQ ID NO: 2227791 - DNA, 23 bp, Homo sapiens
acctgccaggaagccagcaggct

SEQ ID NO: 2227792 - DNA, 15 bp, Homo sapiens
acctgccagggacag

SEQ ID NO: 2227793 - DNA, 16 bp, Homo sapiens
acctgccagggacaga

SEQ ID NO: 2227794 - DNA, 12 bp, Homo sapiens
acctgcccctca

SEQ ID NO: 2227795 - DNA, 20 bp, Homo sapiens
acctgcccctcaactctcct

SEQ ID NO: 2227796 - DNA, 23 bp, Homo sapiens
acctgcccctcaactctcctcca

SEQ ID NO: 2227797 - DNA, 19 bp, Homo sapiens
acctgcggtgctatctccc

SEQ ID NO: 2227798 - DNA, 18 bp, Homo sapiens
acctggcctctgcactcc

SEQ ID NO: 2227799 - DNA, 23 bp, Homo sapiens
acctggcctctgcactcccctgc

SEQ ID NO: 2227800 - DNA, 21 bp, Homo sapiens
acctgggtaactagggaagat

SEQ ID NO: 2227801 - DNA, 12 bp, Homo sapiens
acctgtccccct

SEQ ID NO: 2227802 - DNA, 16 bp, Homo sapiens
acctgtccccctgaca

SEQ ID NO: 2227803 - DNA, 14 bp, Homo sapiens
accttgacagggca

SEQ ID NO: 2227804 - DNA, 15 bp, Homo sapiens
accttgacagggcac

SEQ ID NO: 2227805 - DNA, 16 bp, Homo sapiens
accttgacagggcaca

SEQ ID NO: 2227806 - DNA, 14 bp, Homo sapiens
accttggctgcagg

SEQ ID NO: 2227807 - DNA, 18 bp, Homo sapiens
acctttcccatcttccaa

SEQ ID NO: 2227808 - DNA, 15 bp, Homo sapiens
acctttgtattctct

SEQ ID NO: 2227809 - DNA, 19 bp, Homo sapiens
agcgtgagccactgcaccg

SEQ ID NO: 2227810 - DNA, 23 bp, Homo sapiens
agcgtggtggacatgcacagcta

SEQ ID NO: 2227811 - DNA, 18 bp, Homo sapiens
agctagacgagcaggctt

SEQ ID NO: 2227812 - DNA, 16 bp, Homo sapiens
agctaggcctggccag

SEQ ID NO: 2227813 - DNA, 21 bp, Homo sapiens
agctaggcctggccagatgca

SEQ ID NO: 2227814 - DNA, 16 bp, Homo sapiens
agctcaccagccccag

SEQ ID NO: 2227815 - DNA, 21 bp, Homo sapiens
agctcaccagccccagtgccc

SEQ ID NO: 2227816 - DNA, 22 bp, Homo sapiens
agctcaccagccccagtgccca

SEQ ID NO: 2227817 - DNA, 15 bp, Homo sapiens
agctcacctctccct

SEQ ID NO: 2227818 - DNA, 18 bp, Homo sapiens
agctcacctctcccttgg

SEQ ID NO: 2227819 - DNA, 14 bp, Homo sapiens
agctcagagagggt

SEQ ID NO: 2227820 - DNA, 13 bp, Homo sapiens
agctcagggcctg

SEQ ID NO: 2227821 - DNA, 16 bp, Homo sapiens
agctcagggcctggct

SEQ ID NO: 2227822 - DNA, 17 bp, Homo sapiens
agctcagggcctggctc

SEQ ID NO: 2227823 - DNA, 20 bp, Homo sapiens
agctcagggcctggctcagg

SEQ ID NO: 2227824 - DNA, 17 bp, Homo sapiens
agctcaggtgtccctgc

SEQ ID NO: 2227825 - DNA, 22 bp, Homo sapiens
agctcaggtgtccctgcacttg

SEQ ID NO: 2227826 - DNA, 17 bp, Homo sapiens
agctccaagctcccagg

SEQ ID NO: 2227827 - DNA, 17 bp, Homo sapiens
agctccagctcaccagc

SEQ ID NO: 2227828 - DNA, 12 bp, Homo sapiens
agctccttctgt

SEQ ID NO: 2227829 - DNA, 23 bp, Homo sapiens
agctccttctgtcctactctgtg

SEQ ID NO: 2227830 - DNA, 12 bp, Homo sapiens
agctctgctcct

SEQ ID NO: 2227831 - DNA, 12 bp, Homo sapiens
agctctggtcca

SEQ ID NO: 2227832 - DNA, 20 bp, Homo sapiens
agctctggtccatagagagc

SEQ ID NO: 2227833 - DNA, 12 bp, Homo sapiens
agctctgtcctg

SEQ ID NO: 2227834 - DNA, 16 bp, Homo sapiens
agctcttctccaggct

SEQ ID NO: 2227835 - DNA, 17 bp, Homo sapiens
agctgcaccctcaggca

SEQ ID NO: 2227836 - DNA, 10 bp, Homo sapiens
agctgcctgt

SEQ ID NO: 2227837 - DNA, 13 bp, Homo sapiens
agctgcctgttca

SEQ ID NO: 2227838 - DNA, 18 bp, Homo sapiens
agctgcctgttcagctcc

SEQ ID NO: 2227839 - DNA, 22 bp, Homo sapiens
agctgcctgttcagctccagct

SEQ ID NO: 2227840 - DNA, 18 bp, Homo sapiens
agctgcggtccacccagg

SEQ ID NO: 2227841 - DNA, 20 bp, Homo sapiens
agctgcggtccacccaggag

SEQ ID NO: 2227842 - DNA, 21 bp, Homo sapiens
agctgcggtccacccaggagc

SEQ ID NO: 2227843 - DNA, 22 bp, Homo sapiens
agctgcttttgtctatgggact

SEQ ID NO: 2227844 - DNA, 15 bp, Homo sapiens
agctgggactacagg

SEQ ID NO: 2227845 - DNA, 18 bp, Homo sapiens
agctgggactacaggcac

SEQ ID NO: 2227846 - DNA, 19 bp, Homo sapiens
agctgggactacaggcacc

SEQ ID NO: 2227847 - DNA, 20 bp, Homo sapiens
agctgggactacaggcaccc

SEQ ID NO: 2227848 - DNA, 17 bp, Homo sapiens
agctgggactacaggtg

SEQ ID NO: 2227849 - DNA, 20 bp, Homo sapiens
agctggggtggggacctcag

SEQ ID NO: 2227850 - DNA, 16 bp, Homo sapiens
agctggtcccactcag

SEQ ID NO: 2227851 - DNA, 22 bp, Homo sapiens
agctggtttttagcggagacgg

SEQ ID NO: 2227852 - DNA, 18 bp, Homo sapiens
agctgtgctctggacagg

SEQ ID NO: 2227853 - DNA, 14 bp, Homo sapiens
agctgttactgtct

SEQ ID NO: 2227854 - DNA, 18 bp, Homo sapiens
agctgttactgtcttcag

SEQ ID NO: 2227855 - DNA, 19 bp, Homo sapiens
agcttcatttcctgtgtct

SEQ ID NO: 2227856 - DNA, 23 bp, Homo sapiens
agcttgaccgtgaggccagagac

SEQ ID NO: 2227857 - DNA, 23 bp, Homo sapiens
agctttgtttgttgtcagctgaa

SEQ ID NO: 2227858 - DNA, 13 bp, Homo sapiens
aggaaaaactgat

SEQ ID NO: 2227859 - DNA, 14 bp, Homo sapiens
aggaaaagctgctg

SEQ ID NO: 2227860 - DNA, 16 bp, Homo sapiens
aggaaacccagctctg

SEQ ID NO: 2227861 - DNA, 18 bp, Homo sapiens
aggaaacccagctctggt

SEQ ID NO: 2227862 - DNA, 12 bp, Homo sapiens
aggaaagaggct

SEQ ID NO: 2227863 - DNA, 16 bp, Homo sapiens
aggaaagaggctctgg

SEQ ID NO: 2227864 - DNA, 17 bp, Homo sapiens
aggaaagcaaaggagat

SEQ ID NO: 2227865 - DNA, 19 bp, Homo sapiens
aggaaagcaaaggagattg

SEQ ID NO: 2227866 - DNA, 14 bp, Homo sapiens
aggaaaggctccag

SEQ ID NO: 2227867 - DNA, 15 bp, Homo sapiens
aggaaaggctccagg

SEQ ID NO: 2227868 - DNA, 18 bp, Homo sapiens
aggaaaggctccaggagc

SEQ ID NO: 2227869 - DNA, 23 bp, Homo sapiens
aggaaaggctccaggagcagcca

SEQ ID NO: 2227870 - DNA, 15 bp, Homo sapiens
aggaacaggtttaaa

SEQ ID NO: 2227871 - DNA, 21 bp, Homo sapiens
aggaacttaaataatgtgaaa

SEQ ID NO: 2227872 - DNA, 13 bp, Homo sapiens
aggaagactttgg

SEQ ID NO: 2227873 - DNA, 14 bp, Homo sapiens
aggaagagaaaaaa

SEQ ID NO: 2227874 - DNA, 17 bp, Homo sapiens
aggaagccagcaggctc

SEQ ID NO: 2227875 - DNA, 19 bp, Homo sapiens
aggaagccgctggggccag

SEQ ID NO: 2227876 - DNA, 16 bp, Homo sapiens
aggaagctcagggcct

SEQ ID NO: 2227877 - DNA, 22 bp, Homo sapiens
aggaagctcagggcctggctca

SEQ ID NO: 2227878 - DNA, 22 bp, Homo sapiens
aggaaggaaacccagctctggt

SEQ ID NO: 2227879 - DNA, 21 bp, Homo sapiens
aggaatcatgtgccaagcaga

SEQ ID NO: 2227880 - DNA, 18 bp, Homo sapiens
aggacactaaccacgctg

SEQ ID NO: 2227881 - DNA, 22 bp, Homo sapiens
aggacagggaggtgaccccagg

SEQ ID NO: 2227882 - DNA, 22 bp, Homo sapiens
aggacttttctttgtggcttcc

SEQ ID NO: 2227883 - DNA, 15 bp, Homo sapiens
aggagagctagcagc

SEQ ID NO: 2227884 - DNA, 14 bp, Homo sapiens
aggagaggggcaca

SEQ ID NO: 2227885 - DNA, 22 bp, Homo sapiens
aggagccccgaggccttctctg

SEQ ID NO: 2227886 - DNA, 16 bp, Homo sapiens
aggagcctcctgccct

SEQ ID NO: 2227887 - DNA, 17 bp, Homo sapiens
aggagcctcctgccctt

SEQ ID NO: 2227888 - DNA, 20 bp, Homo sapiens
aggaggaacaggtttaaaaa

SEQ ID NO: 2227889 - DNA, 12 bp, Homo sapiens
aggagtgagcac

SEQ ID NO: 2227890 - DNA, 14 bp, Homo sapiens
aggagtgagcacta

SEQ ID NO: 2227891 - DNA, 12 bp, Homo sapiens
aggatcagtctg

SEQ ID NO: 2227892 - DNA, 16 bp, Homo sapiens
aggatcctgagccaga

SEQ ID NO: 2227893 - DNA, 17 bp, Homo sapiens
aggatcctgagccagat

SEQ ID NO: 2227894 - DNA, 17 bp, Homo sapiens
aggatctcttgagcctg

SEQ ID NO: 2227895 - DNA, 18 bp, Homo sapiens
aggatctcttgagcctgg

SEQ ID NO: 2227896 - DNA, 16 bp, Homo sapiens
aggatgatctaggaag

SEQ ID NO: 2227897 - DNA, 22 bp, Homo sapiens
aggatgatctaggaagactttg

SEQ ID NO: 2227898 - DNA, 14 bp, Homo sapiens
aggatgcccaaaga

SEQ ID NO: 2227899 - DNA, 19 bp, Homo sapiens
aggatgcccaaagatgcag

SEQ ID NO: 2227900 - DNA, 15 bp, Homo sapiens
aggatgcttgtacat

SEQ ID NO: 2227901 - DNA, 14 bp, Homo sapiens
aggattattggaaa

SEQ ID NO: 2227902 - DNA, 17 bp, Homo sapiens
aggattcttcctccctc

SEQ ID NO: 2227903 - DNA, 19 bp, Homo sapiens
aggattcttcctccctccc

SEQ ID NO: 2227904 - DNA, 17 bp, Homo sapiens
aggattgctactgtcct

SEQ ID NO: 2227905 - DNA, 18 bp, Homo sapiens
aggattgctactgtccta

SEQ ID NO: 2227906 - DNA, 22 bp, Homo sapiens
aggattgctactgtcctaccca

SEQ ID NO: 2227907 - DNA, 17 bp, Homo sapiens
aggcaagcacctcctgc

SEQ ID NO: 2227908 - DNA, 20 bp, Homo sapiens
aggcaagcacctcctgcctc

SEQ ID NO: 2227909 - DNA, 16 bp, Homo sapiens
aggcaaggctgtcaat

SEQ ID NO: 2227910 - DNA, 21 bp, Homo sapiens
aggcacccaccatcatgtctg

SEQ ID NO: 2227911 - DNA, 17 bp, Homo sapiens
aggcagccccattctgc

SEQ ID NO: 2227912 - DNA, 22 bp, Homo sapiens
aggcagggtctcactctgtcgc

SEQ ID NO: 2227913 - DNA, 22 bp, Homo sapiens
aggcaggtcttgaactcctggc

SEQ ID NO: 2227914 - DNA, 22 bp, Homo sapiens
aggcagtggggctggaagcaga

SEQ ID NO: 2227915 - DNA, 23 bp, Homo sapiens
aggcagtggggctggaagcagaa

SEQ ID NO: 2227916 - DNA, 23 bp, Homo sapiens
aggcatgtgatgagaggaaatca

SEQ ID NO: 2227917 - DNA, 20 bp, Homo sapiens
aggcatgttctctgaggaca

SEQ ID NO: 2227918 - DNA, 20 bp, Homo sapiens
aggcattccccaggaggcca

SEQ ID NO: 2227919 - DNA, 21 bp, Homo sapiens
aggcattccccaggaggccag

SEQ ID NO: 2227920 - DNA, 22 bp, Homo sapiens
aggcattccccaggaggccagc

SEQ ID NO: 2227921 - DNA, 16 bp, Homo sapiens
aggcatttgctgaata

SEQ ID NO: 2227922 - DNA, 16 bp, Homo sapiens
aggccaaggtgggagg

SEQ ID NO: 2227923 - DNA, 20 bp, Homo sapiens
aggccagagggagtgacaga

SEQ ID NO: 2227924 - DNA, 13 bp, Homo sapiens
aggccagccttga

SEQ ID NO: 2227925 - DNA, 15 bp, Homo sapiens
aggccagccttgacc

SEQ ID NO: 2227926 - DNA, 15 bp, Homo sapiens
aggccaggccctctg

SEQ ID NO: 2227927 - DNA, 16 bp, Homo sapiens
aggccaggccctctgc

SEQ ID NO: 2227928 - DNA, 18 bp, Homo sapiens
aggccaggccctctgccc

SEQ ID NO: 2227929 - DNA, 17 bp, Homo sapiens
aggccatgggcctcctg

SEQ ID NO: 2227930 - DNA, 13 bp, Homo sapiens
aggcccagagggc

SEQ ID NO: 2227931 - DNA, 15 bp, Homo sapiens
aggcccagagggcct

SEQ ID NO: 2227932 - DNA, 17 bp, Homo sapiens
agtctcactgttgccca

SEQ ID NO: 2227933 - DNA, 20 bp, Homo sapiens
agtctcactgttgcccaggc

SEQ ID NO: 2227934 - DNA, 18 bp, Homo sapiens
agtctgattcccaagctc

SEQ ID NO: 2227935 - DNA, 20 bp, Homo sapiens
agtctgattcccaagctctg

SEQ ID NO: 2227936 - DNA, 17 bp, Homo sapiens
agtctggaatgcagtgg

SEQ ID NO: 2227937 - DNA, 16 bp, Homo sapiens
agtcttagatgtatat

SEQ ID NO: 2227938 - DNA, 17 bp, Homo sapiens
agtgaaaaaggaggaag

SEQ ID NO: 2227939 - DNA, 23 bp, Homo sapiens
agtgaaaaaggaggaagagaaaa

SEQ ID NO: 2227940 - DNA, 14 bp, Homo sapiens
agtgaagacaatga

SEQ ID NO: 2227941 - DNA, 16 bp, Homo sapiens
agtgaagacaatgact

SEQ ID NO: 2227942 - DNA, 16 bp, Homo sapiens
agtgacagaggcagcc

SEQ ID NO: 2227943 - DNA, 21 bp, Homo sapiens
agtgagaccctgtctcaaaaa

SEQ ID NO: 2227944 - DNA, 13 bp, Homo sapiens
agtgagactctgt

SEQ ID NO: 2227945 - DNA, 16 bp, Homo sapiens
agtgagactctgtctc

SEQ ID NO: 2227946 - DNA, 22 bp, Homo sapiens
agtgagactctgtctcaaaaaa

SEQ ID NO: 2227947 - DNA, 16 bp, Homo sapiens
agtgaggatgaaaaaa

SEQ ID NO: 2227948 - DNA, 15 bp, Homo sapiens
agtgaggctctgccc

SEQ ID NO: 2227949 - DNA, 19 bp, Homo sapiens
agtgaggctctgcccttgg

SEQ ID NO: 2227950 - DNA, 21 bp, Homo sapiens
agtgaggctctgcccttggtt

SEQ ID NO: 2227951 - DNA, 22 bp, Homo sapiens
agtgagttgatagcacagaccc

SEQ ID NO: 2227952 - DNA, 13 bp, Homo sapiens
agtgatcctccca

SEQ ID NO: 2227953 - DNA, 14 bp, Homo sapiens
agtgatcctcccac

SEQ ID NO: 2227954 - DNA, 22 bp, Homo sapiens
agtgatcctcccacctcagcct

SEQ ID NO: 2227955 - DNA, 20 bp, Homo sapiens
agtgattctcctgcctcagc

SEQ ID NO: 2227956 - DNA, 22 bp, Homo sapiens
agtgattctcctgcctcagcct

SEQ ID NO: 2227957 - DNA, 18 bp, Homo sapiens
agtgccttatggaacact

SEQ ID NO: 2227958 - DNA, 19 bp, Homo sapiens
agtgccttatggaacactc

SEQ ID NO: 2227959 - DNA, 21 bp, Homo sapiens
agtgccttatggaacactctg

SEQ ID NO: 2227960 - DNA, 22 bp, Homo sapiens
agtgccttatggaacactctga

SEQ ID NO: 2227961 - DNA, 13 bp, Homo sapiens
agtgctgcattta

SEQ ID NO: 2227962 - DNA, 16 bp, Homo sapiens
agtgctgcatttaaaa

SEQ ID NO: 2227963 - DNA, 19 bp, Homo sapiens
agtgctgcatttaaaagat

SEQ ID NO: 2227964 - DNA, 20 bp, Homo sapiens
agtgctgggattacaagcgt

SEQ ID NO: 2227965 - DNA, 21 bp, Homo sapiens
agtgctgggattacaggtgtg

SEQ ID NO: 2227966 - DNA, 11 bp, Homo sapiens
agtggcagctg

SEQ ID NO: 2227967 - DNA, 12 bp, Homo sapiens
agtggcagctgc

SEQ ID NO: 2227968 - DNA, 14 bp, Homo sapiens
agtggcagctgctt

SEQ ID NO: 2227969 - DNA, 15 bp, Homo sapiens
agtgggagctgcctg

SEQ ID NO: 2227970 - DNA, 20 bp, Homo sapiens
agtgggggagtggccacaga

SEQ ID NO: 2227971 - DNA, 13 bp, Homo sapiens
agtgggtgaataa

SEQ ID NO: 2227972 - DNA, 21 bp, Homo sapiens
agtggtggtgaacagaacaaa

SEQ ID NO: 2227973 - DNA, 17 bp, Homo sapiens
agtgtatttttttacta

SEQ ID NO: 2227974 - DNA, 19 bp, Homo sapiens
agtgtggtgtttcctggca

SEQ ID NO: 2227975 - DNA, 20 bp, Homo sapiens
agtgtgtcttagtgtgtgca

SEQ ID NO: 2227976 - DNA, 20 bp, Homo sapiens
agtgttgtggatttaacaga

SEQ ID NO: 2227977 - DNA, 12 bp, Homo sapiens
agttaaataaat

SEQ ID NO: 2227978 - DNA, 18 bp, Homo sapiens
agttcaggtaacaggcag

SEQ ID NO: 2227979 - DNA, 19 bp, Homo sapiens
agttcaggtaacaggcaga

SEQ ID NO: 2227980 - DNA, 20 bp, Homo sapiens
agttcaggtaacaggcagat

SEQ ID NO: 2227981 - DNA, 21 bp, Homo sapiens
agttccaccatcaagccacca

SEQ ID NO: 2227982 - DNA, 14 bp, Homo sapiens
agttctggttccta

SEQ ID NO: 2227983 - DNA, 17 bp, Homo sapiens
agttgaagacagagcta

SEQ ID NO: 2227984 - DNA, 14 bp, Homo sapiens
agttgattcagctc

SEQ ID NO: 2227985 - DNA, 18 bp, Homo sapiens
agttgattcagctctgca

SEQ ID NO: 2227986 - DNA, 17 bp, Homo sapiens
agttgggtggatgcctg

SEQ ID NO: 2227987 - DNA, 16 bp, Homo sapiens
agttgttacattttta

SEQ ID NO: 2227988 - DNA, 22 bp, Homo sapiens
agttgttacatttttaagtgct

SEQ ID NO: 2227989 - DNA, 21 bp, Homo sapiens
agttgtttgattcagacagct

SEQ ID NO: 2227990 - DNA, 14 bp, Homo sapiens
agtttctcttttca

SEQ ID NO: 2227991 - DNA, 15 bp, Homo sapiens
agtttctgccgcagc

SEQ ID NO: 2227992 - DNA, 14 bp, Homo sapiens
agtttgattaaatt

SEQ ID NO: 2227993 - DNA, 20 bp, Homo sapiens
agtttgattaaattcttgca

SEQ ID NO: 2227994 - DNA, 22 bp, Homo sapiens
agtttgattaaattcttgcaaa

SEQ ID NO: 2227995 - DNA, 11 bp, Homo sapiens
ataaaactttt

SEQ ID NO: 2227996 - DNA, 23 bp, Homo sapiens
ataaacaagaccacgtttctaaa

SEQ ID NO: 2227997 - DNA, 13 bp, Homo sapiens
ataaagcagcgtt

SEQ ID NO: 2227998 - DNA, 18 bp, Homo sapiens
ataaagcagcgtttctat

SEQ ID NO: 2227999 - DNA, 14 bp, Homo sapiens
ataagattcatatt

SEQ ID NO: 2228000 - DNA, 22 bp, Homo sapiens
ataagccaaaaaatgcttgctt

SEQ ID NO: 2228001 - DNA, 23 bp, Homo sapiens
ataatacaccactacattctgtt

SEQ ID NO: 2228002 - DNA, 18 bp, Homo sapiens
ataatttacctgaagtct

SEQ ID NO: 2228003 - DNA, 15 bp, Homo sapiens
atacaccactacatt

SEQ ID NO: 2228004 - DNA, 19 bp, Homo sapiens
atacaggaaaagctgctga

SEQ ID NO: 2228005 - DNA, 16 bp, Homo sapiens
atacatttgataaagt

SEQ ID NO: 2228006 - DNA, 11 bp, Homo sapiens
atacccacccc

SEQ ID NO: 2228007 - DNA, 13 bp, Homo sapiens
atacccaccccca

SEQ ID NO: 2228008 - DNA, 17 bp, Homo sapiens
atacccacccccaccca

SEQ ID NO: 2228009 - DNA, 14 bp, Homo sapiens
ataccttttttaga

SEQ ID NO: 2228010 - DNA, 19 bp, Homo sapiens
atactaaccagcagaaatg

SEQ ID NO: 2228011 - DNA, 20 bp, Homo sapiens
atactacagtttgttagtat

SEQ ID NO: 2228012 - DNA, 16 bp, Homo sapiens
atagacaatttattat

SEQ ID NO: 2228013 - DNA, 22 bp, Homo sapiens
atagacaatttattatggcaca

SEQ ID NO: 2228014 - DNA, 15 bp, Homo sapiens
atagcctaggtgaca

SEQ ID NO: 2228015 - DNA, 19 bp, Homo sapiens
atagctcaggtgtccctgc

SEQ ID NO: 2228016 - DNA, 12 bp, Homo sapiens
atagctgggact

SEQ ID NO: 2228017 - DNA, 17 bp, Homo sapiens
atagctgggactacagg

SEQ ID NO: 2228018 - DNA, 12 bp, Homo sapiens
ataggaaaaact

SEQ ID NO: 2228019 - DNA, 14 bp, Homo sapiens
ataggaaaaactga

SEQ ID NO: 2228020 - DNA, 16 bp, Homo sapiens
atagtatggtggctgg

SEQ ID NO: 2228021 - DNA, 18 bp, Homo sapiens
atagtatggtggctgggt

SEQ ID NO: 2228022 - DNA, 13 bp, Homo sapiens
atatataaccagt

SEQ ID NO: 2228023 - DNA, 21 bp, Homo sapiens
atatatgttttaagaggcagg

SEQ ID NO: 2228024 - DNA, 16 bp, Homo sapiens
atatctgaaaatgtat

SEQ ID NO: 2228025 - DNA, 17 bp, Homo sapiens
atatctgaaaatgtatg

SEQ ID NO: 2228026 - DNA, 22 bp, Homo sapiens
atatctgaaaatgtatgtgtaa

SEQ ID NO: 2228027 - DNA, 13 bp, Homo sapiens
atatgcacacatt

SEQ ID NO: 2228028 - DNA, 14 bp, Homo sapiens
atatgcacacattt

SEQ ID NO: 2228029 - DNA, 15 bp, Homo sapiens
atatgcacacatttt

SEQ ID NO: 2228030 - DNA, 16 bp, Homo sapiens
atatgctctgcatgtt

SEQ ID NO: 2228031 - DNA, 20 bp, Homo sapiens
atatgttttaagaggcaggg

SEQ ID NO: 2228032 - DNA, 16 bp, Homo sapiens
atattctgttggccag

SEQ ID NO: 2228033 - DNA, 17 bp, Homo sapiens
atattgttttcagtgta

SEQ ID NO: 2228034 - DNA, 20 bp, Homo sapiens
atattgttttcagtgtacat

SEQ ID NO: 2228035 - DNA, 19 bp, Homo sapiens
atatttacttcttatacat

SEQ ID NO: 2228036 - DNA, 24 bp, Homo sapiens
atcaaaaggttaataaagtaatta

SEQ ID NO: 2228037 - DNA, 20 bp, Homo sapiens
atcaaagaggttttaaaaaa

SEQ ID NO: 2228038 - DNA, 23 bp, Homo sapiens
atcaaagaggttttaaaaaaatc

SEQ ID NO: 2228039 - DNA, 18 bp, Homo sapiens
atcaagtattataccttt

SEQ ID NO: 2228040 - DNA, 19 bp, Homo sapiens
atcaccaacgtctgtgcca

SEQ ID NO: 2228041 - DNA, 13 bp, Homo sapiens
atcacgccactgc

SEQ ID NO: 2228042 - DNA, 17 bp, Homo sapiens
atcacgccactgcacta

SEQ ID NO: 2228043 - DNA, 16 bp, Homo sapiens
atcagcacgatttctg

SEQ ID NO: 2228044 - DNA, 17 bp, Homo sapiens
atcagcacgatttctgt

SEQ ID NO: 2228045 - DNA, 23 bp, Homo sapiens
atcagcacgatttctgtttagat

SEQ ID NO: 2228046 - DNA, 21 bp, Homo sapiens
atcagcctgggcaatgtgata

SEQ ID NO: 2228047 - DNA, 23 bp, Homo sapiens
atcaggccaggccctctgcccac

SEQ ID NO: 2228048 - DNA, 15 bp, Homo sapiens
atcaggtgctgccat

SEQ ID NO: 2228049 - DNA, 21 bp, Homo sapiens
atcatccactgtgccatgtgc

SEQ ID NO: 2228050 - DNA, 23 bp, Homo sapiens
atcatccactgtgccatgtgcca

SEQ ID NO: 2228051 - DNA, 19 bp, Homo sapiens
atcattgaaatctttttgc

SEQ ID NO: 2228052 - DNA, 13 bp, Homo sapiens
atccacccacctc

SEQ ID NO: 2228053 - DNA, 20 bp, Homo sapiens
atccacccacctcagcctcc

SEQ ID NO: 2228054 - DNA, 16 bp, Homo sapiens
atccaggttcagcttg

SEQ ID NO: 2228055 - DNA, 19 bp, Homo sapiens
cacatgtccaagaagccca

SEQ ID NO: 2228056 - DNA, 22 bp, Homo sapiens
cacatgtccaagaagcccagga

SEQ ID NO: 2228057 - DNA, 14 bp, Homo sapiens
cacatgtgcacatg

SEQ ID NO: 2228058 - DNA, 17 bp, Homo sapiens
cacatgtgcacatgcac

SEQ ID NO: 2228059 - DNA, 16 bp, Homo sapiens
cacattcctgatgctt

SEQ ID NO: 2228060 - DNA, 19 bp, Homo sapiens
cacattttattttattatg

SEQ ID NO: 2228061 - DNA, 14 bp, Homo sapiens
cacatttttcttag

SEQ ID NO: 2228062 - DNA, 13 bp, Homo sapiens
caccacacccagc

SEQ ID NO: 2228063 - DNA, 17 bp, Homo sapiens
caccacacccagcccac

SEQ ID NO: 2228064 - DNA, 19 bp, Homo sapiens
caccacacccagcccactt

SEQ ID NO: 2228065 - DNA, 20 bp, Homo sapiens
caccagagcccaccttggct

SEQ ID NO: 2228066 - DNA, 22 bp, Homo sapiens
caccagagcccaccttggctca

SEQ ID NO: 2228067 - DNA, 14 bp, Homo sapiens
caccagcagcctgg

SEQ ID NO: 2228068 - DNA, 19 bp, Homo sapiens
caccagcccttagcaggga

SEQ ID NO: 2228069 - DNA, 14 bp, Homo sapiens
cacccaagggcctg

SEQ ID NO: 2228070 - DNA, 19 bp, Homo sapiens
cacccaagggcctggcctg

SEQ ID NO: 2228071 - DNA, 12 bp, Homo sapiens
cacccacctcag

SEQ ID NO: 2228072 - DNA, 18 bp, Homo sapiens
cacccacctcagcctccc

SEQ ID NO: 2228073 - DNA, 11 bp, Homo sapiens
caccccagccc

SEQ ID NO: 2228074 - DNA, 13 bp, Homo sapiens
caccccaggctgg

SEQ ID NO: 2228075 - DNA, 13 bp, Homo sapiens
caccccctccccg

SEQ ID NO: 2228076 - DNA, 21 bp, Homo sapiens
caccccctccccgggcagcag

SEQ ID NO: 2228077 - DNA, 20 bp, Homo sapiens
cacccctcaacacctctgca

SEQ ID NO: 2228078 - DNA, 17 bp, Homo sapiens
cacccggcccctgctgg

SEQ ID NO: 2228079 - DNA, 12 bp, Homo sapiens
caccctgtgatg

SEQ ID NO: 2228080 - DNA, 18 bp, Homo sapiens
caccctgtgatggggccc

SEQ ID NO: 2228081 - DNA, 22 bp, Homo sapiens
caccgaaaacgtggctgcttca

SEQ ID NO: 2228082 - DNA, 12 bp, Homo sapiens
caccgcagacag

SEQ ID NO: 2228083 - DNA, 15 bp, Homo sapiens
caccgcagacaggac

SEQ ID NO: 2228084 - DNA, 17 bp, Homo sapiens
caccgcagacaggacca

SEQ ID NO: 2228085 - DNA, 18 bp, Homo sapiens
caccgcagacaggaccag

SEQ ID NO: 2228086 - DNA, 21 bp, Homo sapiens
caccgcagacaggaccaggga

SEQ ID NO: 2228087 - DNA, 17 bp, Homo sapiens
caccggctggcctggcc

SEQ ID NO: 2228088 - DNA, 18 bp, Homo sapiens
caccggctggcctggccc

SEQ ID NO: 2228089 - DNA, 22 bp, Homo sapiens
caccgggcactcagaagacact

SEQ ID NO: 2228090 - DNA, 18 bp, Homo sapiens
caccgggccacagagaaa

SEQ ID NO: 2228091 - DNA, 13 bp, Homo sapiens
cacctcagcctcc

SEQ ID NO: 2228092 - DNA, 13 bp, Homo sapiens
cacctcctgcctc

SEQ ID NO: 2228093 - DNA, 13 bp, Homo sapiens
cacctctcccttg

SEQ ID NO: 2228094 - DNA, 18 bp, Homo sapiens
cacctctgcacaagctgc

SEQ ID NO: 2228095 - DNA, 15 bp, Homo sapiens
cacctgaagactcat

SEQ ID NO: 2228096 - DNA, 14 bp, Homo sapiens
cacctgccagggac

SEQ ID NO: 2228097 - DNA, 15 bp, Homo sapiens
cacctgcccctcaac

SEQ ID NO: 2228098 - DNA, 17 bp, Homo sapiens
cacctgcctgttgggcc

SEQ ID NO: 2228099 - DNA, 16 bp, Homo sapiens
cacctgcggtgctatc

SEQ ID NO: 2228100 - DNA, 17 bp, Homo sapiens
cacctgcggtgctatct

SEQ ID NO: 2228101 - DNA, 23 bp, Homo sapiens
cacctgcggtgctatctccccca

SEQ ID NO: 2228102 - DNA, 20 bp, Homo sapiens
cacctggaatatataaccag

SEQ ID NO: 2228103 - DNA, 14 bp, Homo sapiens
cacctggcctctgc

SEQ ID NO: 2228104 - DNA, 15 bp, Homo sapiens
cacctggcctctgca

SEQ ID NO: 2228105 - DNA, 17 bp, Homo sapiens
cacctggcctctgcact

SEQ ID NO: 2228106 - DNA, 14 bp, Homo sapiens
caccttagacagtc

SEQ ID NO: 2228107 - DNA, 14 bp, Homo sapiens
caccttggctcaag

SEQ ID NO: 2228108 - DNA, 14 bp, Homo sapiens
cacctttgtcccca

SEQ ID NO: 2228109 - DNA, 19 bp, Homo sapiens
cacgaatattgctgatggt

SEQ ID NO: 2228110 - DNA, 14 bp, Homo sapiens
cacgatttctgttt

SEQ ID NO: 2228111 - DNA, 16 bp, Homo sapiens
cacgatttctgtttag

SEQ ID NO: 2228112 - DNA, 15 bp, Homo sapiens
cacgccactgcacta

SEQ ID NO: 2228113 - DNA, 19 bp, Homo sapiens
cacgccagattctttcctg

SEQ ID NO: 2228114 - DNA, 20 bp, Homo sapiens
cacgccagattctttcctga

SEQ ID NO: 2228115 - DNA, 19 bp, Homo sapiens
cacgcctgtaatcctagca

SEQ ID NO: 2228116 - DNA, 15 bp, Homo sapiens
cacgcgtgcacacac

SEQ ID NO: 2228117 - DNA, 16 bp, Homo sapiens
cacgcgtgcacacacc

SEQ ID NO: 2228118 - DNA, 20 bp, Homo sapiens
cacgctggaccttgaactgg

SEQ ID NO: 2228119 - DNA, 15 bp, Homo sapiens
cacgctggagtgcag

SEQ ID NO: 2228120 - DNA, 17 bp, Homo sapiens
cacgctggagtgcagtg

SEQ ID NO: 2228121 - DNA, 20 bp, Homo sapiens
cacgctggagtgcagtgagc

SEQ ID NO: 2228122 - DNA, 20 bp, Homo sapiens
cacggagggtgacgggggtg

SEQ ID NO: 2228123 - DNA, 14 bp, Homo sapiens
cacggctcactgca

SEQ ID NO: 2228124 - DNA, 19 bp, Homo sapiens
cacggctcactgcagcctc

SEQ ID NO: 2228125 - DNA, 14 bp, Homo sapiens
cacgtacacacaca

SEQ ID NO: 2228126 - DNA, 14 bp, Homo sapiens
cacgtttctaaagg

SEQ ID NO: 2228127 - DNA, 18 bp, Homo sapiens
cactaaggtgtgctctga

SEQ ID NO: 2228128 - DNA, 14 bp, Homo sapiens
cactacattctgtt

SEQ ID NO: 2228129 - DNA, 16 bp, Homo sapiens
cactatgttgcccagg

SEQ ID NO: 2228130 - DNA, 20 bp, Homo sapiens
cactcaaaagctgggcaggt

SEQ ID NO: 2228131 - DNA, 12 bp, Homo sapiens
cactcagaagac

SEQ ID NO: 2228132 - DNA, 16 bp, Homo sapiens
cactcagaagacactg

SEQ ID NO: 2228133 - DNA, 18 bp, Homo sapiens
cactcagaagacactgat

SEQ ID NO: 2228134 - DNA, 15 bp, Homo sapiens
cactcattgacctga

SEQ ID NO: 2228135 - DNA, 18 bp, Homo sapiens
cactcattgacctgaggc

SEQ ID NO: 2228136 - DNA, 20 bp, Homo sapiens
cactcattgacctgaggccc

SEQ ID NO: 2228137 - DNA, 16 bp, Homo sapiens
cactccctgcaacctg

SEQ ID NO: 2228138 - DNA, 12 bp, Homo sapiens
cactctgagact

SEQ ID NO: 2228139 - DNA, 17 bp, Homo sapiens
cactctggcagctcaga

SEQ ID NO: 2228140 - DNA, 20 bp, Homo sapiens
cactctggcagctcagagag

SEQ ID NO: 2228141 - DNA, 21 bp, Homo sapiens
cactctggcagctcagagagg

SEQ ID NO: 2228142 - DNA, 23 bp, Homo sapiens
cactctggcagctcagagagggt

SEQ ID NO: 2228143 - DNA, 20 bp, Homo sapiens
cactctgtcgcccagtctgg

SEQ ID NO: 2228144 - DNA, 18 bp, Homo sapiens
cactcttattgcccacgc

SEQ ID NO: 2228145 - DNA, 13 bp, Homo sapiens
cactgagacagcc

SEQ ID NO: 2228146 - DNA, 19 bp, Homo sapiens
cactgagacagcccgggct

SEQ ID NO: 2228147 - DNA, 22 bp, Homo sapiens
cactgagacagcccgggctctg

SEQ ID NO: 2228148 - DNA, 23 bp, Homo sapiens
cactgagacagcccgggctctgc

SEQ ID NO: 2228149 - DNA, 18 bp, Homo sapiens
cactgatgggcaaccccc

SEQ ID NO: 2228150 - DNA, 15 bp, Homo sapiens
cactgcactccagcc

SEQ ID NO: 2228151 - DNA, 16 bp, Homo sapiens
cactgcactccagcct

SEQ ID NO: 2228152 - DNA, 18 bp, Homo sapiens
cactgcactccagcctgg

SEQ ID NO: 2228153 - DNA, 12 bp, Homo sapiens
cactgcagcctc

SEQ ID NO: 2228154 - DNA, 14 bp, Homo sapiens
cactgcagcctcaa

SEQ ID NO: 2228155 - DNA, 16 bp, Homo sapiens
cactgcatgtttgtga

SEQ ID NO: 2228156 - DNA, 19 bp, Homo sapiens
cactgcttccagtgaggct

SEQ ID NO: 2228157 - DNA, 17 bp, Homo sapiens
cactggaacactaatga

SEQ ID NO: 2228158 - DNA, 14 bp, Homo sapiens
cactgtgccatgtg

SEQ ID NO: 2228159 - DNA, 16 bp, Homo sapiens
cactgtgccatgtgcc

SEQ ID NO: 2228160 - DNA, 18 bp, Homo sapiens
cactgtgccatgtgccag

SEQ ID NO: 2228161 - DNA, 21 bp, Homo sapiens
cactgtgctgagtctgaaggc

SEQ ID NO: 2228162 - DNA, 22 bp, Homo sapiens
cactgtgctgagtctgaaggct

SEQ ID NO: 2228163 - DNA, 14 bp, Homo sapiens
cactgttctctgcc

SEQ ID NO: 2228164 - DNA, 15 bp, Homo sapiens
cactgttctctgccc

SEQ ID NO: 2228165 - DNA, 16 bp, Homo sapiens
cactgttctctgccct

SEQ ID NO: 2228166 - DNA, 17 bp, Homo sapiens
cactgttctctgccctc

SEQ ID NO: 2228167 - DNA, 19 bp, Homo sapiens
cactgttgcccaggctggc

SEQ ID NO: 2228168 - DNA, 16 bp, Homo sapiens
cacttccctacatgga

SEQ ID NO: 2228169 - DNA, 21 bp, Homo sapiens
cacttcgggaggtcgaggcag

SEQ ID NO: 2228170 - DNA, 17 bp, Homo sapiens
cacttgagaattaccct

SEQ ID NO: 2228171 - DNA, 20 bp, Homo sapiens
cacttgagaattaccctttt

SEQ ID NO: 2228172 - DNA, 22 bp, Homo sapiens
cacttgcagactctacagaggc

SEQ ID NO: 2228173 - DNA, 22 bp, Homo sapiens
cactttctagccagaggagaga

SEQ ID NO: 2228174 - DNA, 12 bp, Homo sapiens
cactttgggagg

SEQ ID NO: 2228175 - DNA, 14 bp, Homo sapiens
cactttgttctggc

SEQ ID NO: 2228176 - DNA, 22 bp, Homo sapiens
cacttttgttcttggtttgtaa

SEQ ID NO: 2228177 - DNA, 21 bp, Homo sapiens
cagaaaatggaagacagctct

SEQ ID NO: 2228178 - DNA, 15 bp, Homo sapiens
cagaaacaaaatgaa

SEQ ID NO: 2228179 - DNA, 17 bp, Homo sapiens
cagaaatgtgttatcac

SEQ ID NO: 2228180 - DNA, 15 bp, Homo sapiens
catttattctgctca

SEQ ID NO: 2228181 - DNA, 20 bp, Homo sapiens
catttgaaaattttgatgtt

SEQ ID NO: 2228182 - DNA, 22 bp, Homo sapiens
catttgaaaattttgatgtttt

SEQ ID NO: 2228183 - DNA, 14 bp, Homo sapiens
catttgagcagggc

SEQ ID NO: 2228184 - DNA, 22 bp, Homo sapiens
catttgaggtctgttctttcca

SEQ ID NO: 2228185 - DNA, 17 bp, Homo sapiens
catttgtcacacacttt

SEQ ID NO: 2228186 - DNA, 20 bp, Homo sapiens
catttgtttgaactgataaa

SEQ ID NO: 2228187 - DNA, 22 bp, Homo sapiens
catttgtttgaactgataaaga

SEQ ID NO: 2228188 - DNA, 21 bp, Homo sapiens
cattttattttattatgcatg

SEQ ID NO: 2228189 - DNA, 21 bp, Homo sapiens
cattttgctaaatgtgaatga

SEQ ID NO: 2228190 - DNA, 20 bp, Homo sapiens
catttttagtagagacaggg

SEQ ID NO: 2228191 - DNA, 19 bp, Homo sapiens
cattttttaaatgcacctg

SEQ ID NO: 2228192 - DNA, 22 bp, Homo sapiens
cattttttttaagaaaaaggat

SEQ ID NO: 2228193 - DNA, 23 bp, Homo sapiens
cattttttttaagaaaaaggatg

SEQ ID NO: 2228194 - DNA, 10 bp, Homo sapiens
ccaaaaaagc

SEQ ID NO: 2228195 - DNA, 18 bp, Homo sapiens
ccaaaataaaacttttta

SEQ ID NO: 2228196 - DNA, 17 bp, Homo sapiens
ccaaactcacctgcccc

SEQ ID NO: 2228197 - DNA, 20 bp, Homo sapiens
ccaaactcacctgcccctca

SEQ ID NO: 2228198 - DNA, 14 bp, Homo sapiens
ccaaagatgcagcc

SEQ ID NO: 2228199 - DNA, 15 bp, Homo sapiens
ccaaagctaggcctg

SEQ ID NO: 2228200 - DNA, 23 bp, Homo sapiens
ccaaaggaagcacatgcctctct

SEQ ID NO: 2228201 - DNA, 20 bp, Homo sapiens
ccaaagtacactgtttcaaa

SEQ ID NO: 2228202 - DNA, 23 bp, Homo sapiens
ccaaatcagctgctactactcct

SEQ ID NO: 2228203 - DNA, 22 bp, Homo sapiens
ccaaatggaaatgggcagagca

SEQ ID NO: 2228204 - DNA, 23 bp, Homo sapiens
ccaaatggaaatgggcagagcag

SEQ ID NO: 2228205 - DNA, 22 bp, Homo sapiens
ccaaattctttcagtggctacc

SEQ ID NO: 2228206 - DNA, 18 bp, Homo sapiens
ccaacatactcccatctg

SEQ ID NO: 2228207 - DNA, 19 bp, Homo sapiens
ccaacatactcccatctgt

SEQ ID NO: 2228208 - DNA, 13 bp, Homo sapiens
ccaacatcaacat

SEQ ID NO: 2228209 - DNA, 16 bp, Homo sapiens
ccaacgtctgtgccat

SEQ ID NO: 2228210 - DNA, 13 bp, Homo sapiens
ccaactcacccca

SEQ ID NO: 2228211 - DNA, 14 bp, Homo sapiens
ccaagaagcccagg

SEQ ID NO: 2228212 - DNA, 20 bp, Homo sapiens
ccaagaagcccaggaaaggc

SEQ ID NO: 2228213 - DNA, 15 bp, Homo sapiens
ccaagaccttctcct

SEQ ID NO: 2228214 - DNA, 14 bp, Homo sapiens
ccaagagagacagc

SEQ ID NO: 2228215 - DNA, 20 bp, Homo sapiens
ccaagagagacagcacaggc

SEQ ID NO: 2228216 - DNA, 23 bp, Homo sapiens
ccaagagagacagcacaggcagc

SEQ ID NO: 2228217 - DNA, 14 bp, Homo sapiens
ccaagctcccaggc

SEQ ID NO: 2228218 - DNA, 16 bp, Homo sapiens
ccaagctcccaggcat

SEQ ID NO: 2228219 - DNA, 22 bp, Homo sapiens
ccaagctcccaggcattcccca

SEQ ID NO: 2228220 - DNA, 13 bp, Homo sapiens
ccaagctctgctc

SEQ ID NO: 2228221 - DNA, 15 bp, Homo sapiens
ccaagctctgctcct

SEQ ID NO: 2228222 - DNA, 20 bp, Homo sapiens
ccaagctggtcccactcagt

SEQ ID NO: 2228223 - DNA, 20 bp, Homo sapiens
ccaatgcactttgttctggc

SEQ ID NO: 2228224 - DNA, 17 bp, Homo sapiens
ccacaagagcccaggcc

SEQ ID NO: 2228225 - DNA, 14 bp, Homo sapiens
ccacacccagccca

SEQ ID NO: 2228226 - DNA, 22 bp, Homo sapiens
ccacacccagcccacttctgcc

SEQ ID NO: 2228227 - DNA, 20 bp, Homo sapiens
ccacagggtgagcactctgg

SEQ ID NO: 2228228 - DNA, 17 bp, Homo sapiens
ccacatcttgctctgct

SEQ ID NO: 2228229 - DNA, 20 bp, Homo sapiens
ccacatcttgctctgctgac

SEQ ID NO: 2228230 - DNA, 16 bp, Homo sapiens
ccacatgtgcacatgc

SEQ ID NO: 2228231 - DNA, 13 bp, Homo sapiens
ccaccatcaagcc

SEQ ID NO: 2228232 - DNA, 17 bp, Homo sapiens
ccaccatcaagccacca

SEQ ID NO: 2228233 - DNA, 17 bp, Homo sapiens
ccacccaagggcctggc

SEQ ID NO: 2228234 - DNA, 19 bp, Homo sapiens
ccacccaagggcctggcct

SEQ ID NO: 2228235 - DNA, 21 bp, Homo sapiens
ccacccaagggcctggcctga

SEQ ID NO: 2228236 - DNA, 13 bp, Homo sapiens
ccacccacctcag

SEQ ID NO: 2228237 - DNA, 14 bp, Homo sapiens
ccacccacctcagc

SEQ ID NO: 2228238 - DNA, 15 bp, Homo sapiens
ccacccacctcagcc

SEQ ID NO: 2228239 - DNA, 16 bp, Homo sapiens
ccacccacctcagcct

SEQ ID NO: 2228240 - DNA, 12 bp, Homo sapiens
ccaccccaggct

SEQ ID NO: 2228241 - DNA, 15 bp, Homo sapiens
ccacccccacccaag

SEQ ID NO: 2228242 - DNA, 19 bp, Homo sapiens
ccacccccacccaagggcc

SEQ ID NO: 2228243 - DNA, 15 bp, Homo sapiens
ccacccccaccctcg

SEQ ID NO: 2228244 - DNA, 17 bp, Homo sapiens
ccaccctgaaagccctg

SEQ ID NO: 2228245 - DNA, 11 bp, Homo sapiens
ccaccctgctc

SEQ ID NO: 2228246 - DNA, 18 bp, Homo sapiens
ccaccgcagacaggacca

SEQ ID NO: 2228247 - DNA, 14 bp, Homo sapiens
ccacctcagcctcc

SEQ ID NO: 2228248 - DNA, 15 bp, Homo sapiens
ccacctcagcctccc

SEQ ID NO: 2228249 - DNA, 17 bp, Homo sapiens
ccacctcccacaaagga

SEQ ID NO: 2228250 - DNA, 16 bp, Homo sapiens
ccacctctctcactcc

SEQ ID NO: 2228251 - DNA, 12 bp, Homo sapiens
ccacctgccagg

SEQ ID NO: 2228252 - DNA, 14 bp, Homo sapiens
ccacctgccaggga

SEQ ID NO: 2228253 - DNA, 16 bp, Homo sapiens
ccacctgccagggaca

SEQ ID NO: 2228254 - DNA, 16 bp, Homo sapiens
ccaccttggctcaagt

SEQ ID NO: 2228255 - DNA, 18 bp, Homo sapiens
ccacgctggaccttgaac

SEQ ID NO: 2228256 - DNA, 13 bp, Homo sapiens
ccacgctggagtg

SEQ ID NO: 2228257 - DNA, 12 bp, Homo sapiens
ccacggccaggc

SEQ ID NO: 2228258 - DNA, 15 bp, Homo sapiens
ccacggccaggccag

SEQ ID NO: 2228259 - DNA, 23 bp, Homo sapiens
ccacggccaggccagagggagtg

SEQ ID NO: 2228260 - DNA, 23 bp, Homo sapiens
ccactacggaatagttggctagg

SEQ ID NO: 2228261 - DNA, 18 bp, Homo sapiens
ccactcagtccatagcag

SEQ ID NO: 2228262 - DNA, 12 bp, Homo sapiens
ccactccctgca

SEQ ID NO: 2228263 - DNA, 13 bp, Homo sapiens
ccactccctgcaa

SEQ ID NO: 2228264 - DNA, 13 bp, Homo sapiens
ccactgcaccggg

SEQ ID NO: 2228265 - DNA, 17 bp, Homo sapiens
ccactgcaccgggccac

SEQ ID NO: 2228266 - DNA, 18 bp, Homo sapiens
ccactgcactccagcctg

SEQ ID NO: 2228267 - DNA, 20 bp, Homo sapiens
ccactgcactccagcctggg

SEQ ID NO: 2228268 - DNA, 21 bp, Homo sapiens
ccactgcatcgtttcatcttc

SEQ ID NO: 2228269 - DNA, 16 bp, Homo sapiens
ccactgcgaccacaag

SEQ ID NO: 2228270 - DNA, 15 bp, Homo sapiens
ccactgctctggtta

SEQ ID NO: 2228271 - DNA, 14 bp, Homo sapiens
ccactgtgaagaga

SEQ ID NO: 2228272 - DNA, 15 bp, Homo sapiens
ccactgtgccatgtg

SEQ ID NO: 2228273 - DNA, 14 bp, Homo sapiens
ccacttcagctgac

SEQ ID NO: 2228274 - DNA, 19 bp, Homo sapiens
ccactttctagccagagga

SEQ ID NO: 2228275 - DNA, 20 bp, Homo sapiens
ccactttctagccagaggag

SEQ ID NO: 2228276 - DNA, 22 bp, Homo sapiens
ccacttttgttcttggtttgta

SEQ ID NO: 2228277 - DNA, 23 bp, Homo sapiens
ccagaagtttgagatcagcctgg

SEQ ID NO: 2228278 - DNA, 19 bp, Homo sapiens
ccagacaccttgacagggc

SEQ ID NO: 2228279 - DNA, 14 bp, Homo sapiens
ccagacccccttgc

SEQ ID NO: 2228280 - DNA, 14 bp, Homo sapiens
ccagagagggtggt

SEQ ID NO: 2228281 - DNA, 22 bp, Homo sapiens
ccagagcccaccttggctcaag

SEQ ID NO: 2228282 - DNA, 11 bp, Homo sapiens
ccagagctgcc

SEQ ID NO: 2228283 - DNA, 13 bp, Homo sapiens
ccagagctgccac

SEQ ID NO: 2228284 - DNA, 18 bp, Homo sapiens
ccagagggagtgacagag

SEQ ID NO: 2228285 - DNA, 20 bp, Homo sapiens
ccagagggagtgacagaggc

SEQ ID NO: 2228286 - DNA, 23 bp, Homo sapiens
ccagagggagtgacagaggcagc

SEQ ID NO: 2228287 - DNA, 13 bp, Homo sapiens
ccagatgcaccag

SEQ ID NO: 2228288 - DNA, 18 bp, Homo sapiens
ccagattctttcctgagg

SEQ ID NO: 2228289 - DNA, 20 bp, Homo sapiens
ccagattctttcctgaggct

SEQ ID NO: 2228290 - DNA, 21 bp, Homo sapiens
ccagattctttcctgaggctg

SEQ ID NO: 2228291 - DNA, 22 bp, Homo sapiens
ccagattctttcctgaggctgg

SEQ ID NO: 2228292 - DNA, 23 bp, Homo sapiens
ccagattctttcctgaggctggg

SEQ ID NO: 2228293 - DNA, 19 bp, Homo sapiens
ccagattgcaacaggctgg

SEQ ID NO: 2228294 - DNA, 18 bp, Homo sapiens
ccagatttcactctcctt

SEQ ID NO: 2228295 - DNA, 18 bp, Homo sapiens
ccagcaagtgagagctgg

SEQ ID NO: 2228296 - DNA, 20 bp, Homo sapiens
ccagcaagtgagagctgggt

SEQ ID NO: 2228297 - DNA, 17 bp, Homo sapiens
ccagcaccatctctcct

SEQ ID NO: 2228298 - DNA, 22 bp, Homo sapiens
ccagcagaaatgccttaccctc

SEQ ID NO: 2228299 - DNA, 12 bp, Homo sapiens
ccagcagagcac

SEQ ID NO: 2228300 - DNA, 23 bp, Homo sapiens
ccagcagagcaccttagacagtc

SEQ ID NO: 2228301 - DNA, 12 bp, Homo sapiens
ccagcagcctgg

SEQ ID NO: 2228302 - DNA, 13 bp, Homo sapiens
ccagcagcctgga

SEQ ID NO: 2228303 - DNA, 19 bp, Homo sapiens
ccagcaggctctcaggcca

SEQ ID NO: 2228304 - DNA, 21 bp, Homo sapiens
ccctgtgagtactacagtcct

SEQ ID NO: 2228305 - DNA, 23 bp, Homo sapiens
ccctgtgagtactacagtcctcc

SEQ ID NO: 2228306 - DNA, 20 bp, Homo sapiens
ccctgtgatggggccctgcc

SEQ ID NO: 2228307 - DNA, 15 bp, Homo sapiens
ccctgtgggccccca

SEQ ID NO: 2228308 - DNA, 16 bp, Homo sapiens
ccctgtttgtttctga

SEQ ID NO: 2228309 - DNA, 18 bp, Homo sapiens
cccttcgctcctgtgtct

SEQ ID NO: 2228310 - DNA, 14 bp, Homo sapiens
cccttctctccagc

SEQ ID NO: 2228311 - DNA, 21 bp, Homo sapiens
cccttctctccagcccctgga

SEQ ID NO: 2228312 - DNA, 22 bp, Homo sapiens
cccttctctccagcccctggat

SEQ ID NO: 2228313 - DNA, 13 bp, Homo sapiens
cccttgcccaggc

SEQ ID NO: 2228314 - DNA, 18 bp, Homo sapiens
cccttgccgtctacctga

SEQ ID NO: 2228315 - DNA, 22 bp, Homo sapiens
cccttgccgtctacctgagggg

SEQ ID NO: 2228316 - DNA, 20 bp, Homo sapiens
ccctttgacgccatcccagc

SEQ ID NO: 2228317 - DNA, 13 bp, Homo sapiens
cccttttctgttt

SEQ ID NO: 2228318 - DNA, 17 bp, Homo sapiens
cccttttttggctgctg

SEQ ID NO: 2228319 - DNA, 16 bp, Homo sapiens
ccgacccttgccgtct

SEQ ID NO: 2228320 - DNA, 15 bp, Homo sapiens
ccgagattgcaccac

SEQ ID NO: 2228321 - DNA, 14 bp, Homo sapiens
ccgaggccttctct

SEQ ID NO: 2228322 - DNA, 16 bp, Homo sapiens
ccgagtagctgggact

SEQ ID NO: 2228323 - DNA, 14 bp, Homo sapiens
ccgcactgggcttg

SEQ ID NO: 2228324 - DNA, 15 bp, Homo sapiens
ccgcagacaggacca

SEQ ID NO: 2228325 - DNA, 23 bp, Homo sapiens
ccgctaagagggagggagggctc

SEQ ID NO: 2228326 - DNA, 11 bp, Homo sapiens
ccgctggggcc

SEQ ID NO: 2228327 - DNA, 14 bp, Homo sapiens
ccgctggggccagt

SEQ ID NO: 2228328 - DNA, 23 bp, Homo sapiens
ccgctttctacccagcgagccct

SEQ ID NO: 2228329 - DNA, 18 bp, Homo sapiens
ccggcagggtcctagaaa

SEQ ID NO: 2228330 - DNA, 13 bp, Homo sapiens
ccggcccagtgcc

SEQ ID NO: 2228331 - DNA, 14 bp, Homo sapiens
ccggcccagtgccc

SEQ ID NO: 2228332 - DNA, 14 bp, Homo sapiens
ccggcccctgctgg

SEQ ID NO: 2228333 - DNA, 15 bp, Homo sapiens
ccggctccaggctcc

SEQ ID NO: 2228334 - DNA, 20 bp, Homo sapiens
ccgggaagggggctgggaca

SEQ ID NO: 2228335 - DNA, 22 bp, Homo sapiens
ccgggcactcagaagacactga

SEQ ID NO: 2228336 - DNA, 16 bp, Homo sapiens
ccgggcagcagagaga

SEQ ID NO: 2228337 - DNA, 13 bp, Homo sapiens
ccgggctctgcct

SEQ ID NO: 2228338 - DNA, 15 bp, Homo sapiens
ccgggctctgcctcc

SEQ ID NO: 2228339 - DNA, 17 bp, Homo sapiens
ccgtctacctgaggggc

SEQ ID NO: 2228340 - DNA, 14 bp, Homo sapiens
ccgtgaggaggggt

SEQ ID NO: 2228341 - DNA, 14 bp, Homo sapiens
ccgtgaggccagag

SEQ ID NO: 2228342 - DNA, 16 bp, Homo sapiens
ccgtgaggccagagac

SEQ ID NO: 2228343 - DNA, 15 bp, Homo sapiens
cctaaaattcagtgg

SEQ ID NO: 2228344 - DNA, 22 bp, Homo sapiens
cctacagttgaaaaacagctga

SEQ ID NO: 2228345 - DNA, 19 bp, Homo sapiens
cctactgtaatttgtgata

SEQ ID NO: 2228346 - DNA, 21 bp, Homo sapiens
cctagaaattccccaccctga

SEQ ID NO: 2228347 - DNA, 19 bp, Homo sapiens
cctagcatacgtacacatt

SEQ ID NO: 2228348 - DNA, 23 bp, Homo sapiens
cctaggcatttgctgaatacaga

SEQ ID NO: 2228349 - DNA, 17 bp, Homo sapiens
cctattagagaagagat

SEQ ID NO: 2228350 - DNA, 15 bp, Homo sapiens
cctcaactctcctcc

SEQ ID NO: 2228351 - DNA, 21 bp, Homo sapiens
cctcaactctcctccagagtc

SEQ ID NO: 2228352 - DNA, 20 bp, Homo sapiens
cctcaagtgattctcctgcc

SEQ ID NO: 2228353 - DNA, 23 bp, Homo sapiens
cctcaagtgattctcctgcctca

SEQ ID NO: 2228354 - DNA, 22 bp, Homo sapiens
cctcacagtccttaccagcaga

SEQ ID NO: 2228355 - DNA, 24 bp, Homo sapiens
cctcacagtccttaccagcagagc

SEQ ID NO: 2228356 - DNA, 14 bp, Homo sapiens
cctcagcatcctgg

SEQ ID NO: 2228357 - DNA, 18 bp, Homo sapiens
cctcaggcaggtgggatg

SEQ ID NO: 2228358 - DNA, 10 bp, Homo sapiens
cctcaggcct

SEQ ID NO: 2228359 - DNA, 14 bp, Homo sapiens
cctcaggcctgggg

SEQ ID NO: 2228360 - DNA, 19 bp, Homo sapiens
cctcaggtgatccacccac

SEQ ID NO: 2228361 - DNA, 20 bp, Homo sapiens
cctccaagaccttctccttc

SEQ ID NO: 2228362 - DNA, 22 bp, Homo sapiens
cctccaggtgcacaagctccaa

SEQ ID NO: 2228363 - DNA, 20 bp, Homo sapiens
cctcccaactcaccccagcc

SEQ ID NO: 2228364 - DNA, 23 bp, Homo sapiens
cctcccaactcaccccagcccca

SEQ ID NO: 2228365 - DNA, 15 bp, Homo sapiens
cctcccacctcagcc

SEQ ID NO: 2228366 - DNA, 17 bp, Homo sapiens
cctcccatcacccgcta

SEQ ID NO: 2228367 - DNA, 17 bp, Homo sapiens
cctcccgaatagctggg

SEQ ID NO: 2228368 - DNA, 18 bp, Homo sapiens
cctcccgaatagctggga

SEQ ID NO: 2228369 - DNA, 19 bp, Homo sapiens
cctcccgaatagctgggac

SEQ ID NO: 2228370 - DNA, 21 bp, Homo sapiens
cctcccgaatagctgggacta

SEQ ID NO: 2228371 - DNA, 18 bp, Homo sapiens
cctcccgagtagctggga

SEQ ID NO: 2228372 - DNA, 15 bp, Homo sapiens
cctccctccctcttt

SEQ ID NO: 2228373 - DNA, 16 bp, Homo sapiens
cctccctccctctttc

SEQ ID NO: 2228374 - DNA, 16 bp, Homo sapiens
cctcctgcccccaccc

SEQ ID NO: 2228375 - DNA, 22 bp, Homo sapiens
cctcctgtgtgtgcgcctacag

SEQ ID NO: 2228376 - DNA, 15 bp, Homo sapiens
cctctccccagcaag

SEQ ID NO: 2228377 - DNA, 23 bp, Homo sapiens
cctctgaaaaccaatgttctctc

SEQ ID NO: 2228378 - DNA, 13 bp, Homo sapiens
cctctgacacaca

SEQ ID NO: 2228379 - DNA, 14 bp, Homo sapiens
cctctgacacacag

SEQ ID NO: 2228380 - DNA, 15 bp, Homo sapiens
cctctgacacacagc

SEQ ID NO: 2228381 - DNA, 16 bp, Homo sapiens
cctctgacacacagct

SEQ ID NO: 2228382 - DNA, 20 bp, Homo sapiens
cctctgacacacagctctgt

SEQ ID NO: 2228383 - DNA, 15 bp, Homo sapiens
cctctgcacaagctg

SEQ ID NO: 2228384 - DNA, 17 bp, Homo sapiens
cctctgcacaagctgca

SEQ ID NO: 2228385 - DNA, 16 bp, Homo sapiens
cctctgcactcccctg

SEQ ID NO: 2228386 - DNA, 17 bp, Homo sapiens
cctctgcactcccctgc

SEQ ID NO: 2228387 - DNA, 20 bp, Homo sapiens
cctctgcactcccctgctgg

SEQ ID NO: 2228388 - DNA, 21 bp, Homo sapiens
cctctgcactcccctgctggg

SEQ ID NO: 2228389 - DNA, 23 bp, Homo sapiens
cctctgcactcccctgctgggtg

SEQ ID NO: 2228390 - DNA, 14 bp, Homo sapiens
cctctgcagcaata

SEQ ID NO: 2228391 - DNA, 18 bp, Homo sapiens
cctctgcagcaataaagc

SEQ ID NO: 2228392 - DNA, 19 bp, Homo sapiens
cctctgcccactccctgca

SEQ ID NO: 2228393 - DNA, 20 bp, Homo sapiens
cctctgcctctgacacacag

SEQ ID NO: 2228394 - DNA, 21 bp, Homo sapiens
cctctgcctctgacacacagc

SEQ ID NO: 2228395 - DNA, 14 bp, Homo sapiens
cctctgtacagagc

SEQ ID NO: 2228396 - DNA, 16 bp, Homo sapiens
cctctgtacagagccc

SEQ ID NO: 2228397 - DNA, 18 bp, Homo sapiens
cctctgtacagagcccac

SEQ ID NO: 2228398 - DNA, 14 bp, Homo sapiens
cctcttagaaaaac

SEQ ID NO: 2228399 - DNA, 15 bp, Homo sapiens
cctcttatgggctgg

SEQ ID NO: 2228400 - DNA, 17 bp, Homo sapiens
cctcttatgggctgggt

SEQ ID NO: 2228401 - DNA, 13 bp, Homo sapiens
cctctttccctcc

SEQ ID NO: 2228402 - DNA, 14 bp, Homo sapiens
cctgaaagccctga

SEQ ID NO: 2228403 - DNA, 21 bp, Homo sapiens
cctgaagactcattcttctgt

SEQ ID NO: 2228404 - DNA, 19 bp, Homo sapiens
cctgaaggccccgcccagg

SEQ ID NO: 2228405 - DNA, 20 bp, Homo sapiens
cctgaagtcacacagtgagt

SEQ ID NO: 2228406 - DNA, 15 bp, Homo sapiens
cctgacaacactcat

SEQ ID NO: 2228407 - DNA, 23 bp, Homo sapiens
cctgacaacactcattgacctga

SEQ ID NO: 2228408 - DNA, 15 bp, Homo sapiens
cctgagctgggatga

SEQ ID NO: 2228409 - DNA, 16 bp, Homo sapiens
cctgagctttctgcta

SEQ ID NO: 2228410 - DNA, 21 bp, Homo sapiens
cctgaggcccagagggcctgc

SEQ ID NO: 2228411 - DNA, 14 bp, Homo sapiens
cctgaggcccttct

SEQ ID NO: 2228412 - DNA, 20 bp, Homo sapiens
cctgaggcccttctctccag

SEQ ID NO: 2228413 - DNA, 22 bp, Homo sapiens
cctgaggcccttctctccagcc

SEQ ID NO: 2228414 - DNA, 14 bp, Homo sapiens
cctgaggctgggct

SEQ ID NO: 2228415 - DNA, 16 bp, Homo sapiens
cctgaggctgggctcc

SEQ ID NO: 2228416 - DNA, 18 bp, Homo sapiens
cctgatgcttcttcagag

SEQ ID NO: 2228417 - DNA, 19 bp, Homo sapiens
cctgatgcttcttcagaga

SEQ ID NO: 2228418 - DNA, 19 bp, Homo sapiens
cctgcaacaccttgtttcc

SEQ ID NO: 2228419 - DNA, 22 bp, Homo sapiens
cctgcaacctgattgtgtctct

SEQ ID NO: 2228420 - DNA, 14 bp, Homo sapiens
cctgcagagggcac

SEQ ID NO: 2228421 - DNA, 16 bp, Homo sapiens
cctgcaggcagccagg

SEQ ID NO: 2228422 - DNA, 17 bp, Homo sapiens
cctgcaggcagccaggc

SEQ ID NO: 2228423 - DNA, 18 bp, Homo sapiens
cctgcaggcagccaggcc

SEQ ID NO: 2228424 - DNA, 16 bp, Homo sapiens
cctgccaccctgggga

SEQ ID NO: 2228425 - DNA, 19 bp, Homo sapiens
cctgccaggaagccagcag

SEQ ID NO: 2228426 - DNA, 23 bp, Homo sapiens
cctgccaggaagccagcaggctc

SEQ ID NO: 2228427 - DNA, 15 bp, Homo sapiens
ctcgagcatgcctgg

SEQ ID NO: 2228428 - DNA, 16 bp, Homo sapiens
ctcgagcatgcctgga

SEQ ID NO: 2228429 - DNA, 11 bp, Homo sapiens
ctcggtgcctt

SEQ ID NO: 2228430 - DNA, 19 bp, Homo sapiens
ctcgtggagaatttttact

SEQ ID NO: 2228431 - DNA, 14 bp, Homo sapiens
ctctacagaggcca

SEQ ID NO: 2228432 - DNA, 19 bp, Homo sapiens
ctctacagaggccatgggc

SEQ ID NO: 2228433 - DNA, 15 bp, Homo sapiens
ctctagtttgattaa

SEQ ID NO: 2228434 - DNA, 19 bp, Homo sapiens
ctctagtttgattaaattc

SEQ ID NO: 2228435 - DNA, 12 bp, Homo sapiens
ctctcactcctt

SEQ ID NO: 2228436 - DNA, 14 bp, Homo sapiens
ctctcactccttga

SEQ ID NO: 2228437 - DNA, 20 bp, Homo sapiens
ctctcaggccaaactcacct

SEQ ID NO: 2228438 - DNA, 22 bp, Homo sapiens
ctctcaggccaaactcacctgc

SEQ ID NO: 2228439 - DNA, 23 bp, Homo sapiens
ctctcaggccaaactcacctgcc

SEQ ID NO: 2228440 - DNA, 15 bp, Homo sapiens
ctctccagcccctgg

SEQ ID NO: 2228441 - DNA, 19 bp, Homo sapiens
ctctccagcccctggatgc

SEQ ID NO: 2228442 - DNA, 18 bp, Homo sapiens
ctctcccatcacttccct

SEQ ID NO: 2228443 - DNA, 20 bp, Homo sapiens
ctctcccatcacttccctac

SEQ ID NO: 2228444 - DNA, 13 bp, Homo sapiens
ctctcctccagag

SEQ ID NO: 2228445 - DNA, 15 bp, Homo sapiens
ctctcctccagagtc

SEQ ID NO: 2228446 - DNA, 16 bp, Homo sapiens
ctctcctccagagtca

SEQ ID NO: 2228447 - DNA, 18 bp, Homo sapiens
ctctcctctgctgctggc

SEQ ID NO: 2228448 - DNA, 15 bp, Homo sapiens
ctctcctgtacctct

SEQ ID NO: 2228449 - DNA, 13 bp, Homo sapiens
ctctctcaggcca

SEQ ID NO: 2228450 - DNA, 12 bp, Homo sapiens
ctctgaggacac

SEQ ID NO: 2228451 - DNA, 10 bp, Homo sapiens
ctctgcacaa

SEQ ID NO: 2228452 - DNA, 13 bp, Homo sapiens
ctctgcacaagct

SEQ ID NO: 2228453 - DNA, 14 bp, Homo sapiens
ctctgcactcccct

SEQ ID NO: 2228454 - DNA, 19 bp, Homo sapiens
ctctgcagcaataaagcag

SEQ ID NO: 2228455 - DNA, 18 bp, Homo sapiens
ctctgcccactccctgca

SEQ ID NO: 2228456 - DNA, 23 bp, Homo sapiens
ctctgccctccaagaccttctcc

SEQ ID NO: 2228457 - DNA, 12 bp, Homo sapiens
ctctgcccttgg

SEQ ID NO: 2228458 - DNA, 13 bp, Homo sapiens
ctctgcctcccat

SEQ ID NO: 2228459 - DNA, 17 bp, Homo sapiens
ctctgcctcccatcacc

SEQ ID NO: 2228460 - DNA, 10 bp, Homo sapiens
ctctgcctga

SEQ ID NO: 2228461 - DNA, 21 bp, Homo sapiens
ctctgcctgaagtcacacagt

SEQ ID NO: 2228462 - DNA, 22 bp, Homo sapiens
ctctgcctgaagtcacacagtg

SEQ ID NO: 2228463 - DNA, 18 bp, Homo sapiens
ctctgctcctctccccag

SEQ ID NO: 2228464 - DNA, 20 bp, Homo sapiens
ctctgctcctctccccagca

SEQ ID NO: 2228465 - DNA, 20 bp, Homo sapiens
ctctgctgacagacacaggc

SEQ ID NO: 2228466 - DNA, 22 bp, Homo sapiens
ctctgctgacagacacaggccc

SEQ ID NO: 2228467 - DNA, 23 bp, Homo sapiens
ctctgctgacagacacaggcccg

SEQ ID NO: 2228468 - DNA, 14 bp, Homo sapiens
ctctgctgctggct

SEQ ID NO: 2228469 - DNA, 12 bp, Homo sapiens
ctctggcagctc

SEQ ID NO: 2228470 - DNA, 16 bp, Homo sapiens
ctctggcagctcagag

SEQ ID NO: 2228471 - DNA, 17 bp, Homo sapiens
ctctggcagctcagaga

SEQ ID NO: 2228472 - DNA, 18 bp, Homo sapiens
ctctggcagctcagagag

SEQ ID NO: 2228473 - DNA, 19 bp, Homo sapiens
ctctggcagctcagagagg

SEQ ID NO: 2228474 - DNA, 14 bp, Homo sapiens
ctctggggtgggag

SEQ ID NO: 2228475 - DNA, 18 bp, Homo sapiens
ctctggtccatagagagc

SEQ ID NO: 2228476 - DNA, 19 bp, Homo sapiens
ctctggtccatagagagca

SEQ ID NO: 2228477 - DNA, 13 bp, Homo sapiens
ctctgtcctggga

SEQ ID NO: 2228478 - DNA, 18 bp, Homo sapiens
ctctgtcgcccagtctgg

SEQ ID NO: 2228479 - DNA, 23 bp, Homo sapiens
ctctgtgtcaggtggggcagctt

SEQ ID NO: 2228480 - DNA, 13 bp, Homo sapiens
ctcttaaaaccca

SEQ ID NO: 2228481 - DNA, 15 bp, Homo sapiens
ctcttatgggctggg

SEQ ID NO: 2228482 - DNA, 14 bp, Homo sapiens
ctcttattgcccac

SEQ ID NO: 2228483 - DNA, 20 bp, Homo sapiens
ctcttattgcccacgctgga

SEQ ID NO: 2228484 - DNA, 14 bp, Homo sapiens
ctcttcaatctctt

SEQ ID NO: 2228485 - DNA, 21 bp, Homo sapiens
ctcttccaggctgggagagcc

SEQ ID NO: 2228486 - DNA, 22 bp, Homo sapiens
ctcttccaggctgggagagcct

SEQ ID NO: 2228487 - DNA, 12 bp, Homo sapiens
ctcttctccagg

SEQ ID NO: 2228488 - DNA, 22 bp, Homo sapiens
ctcttgaaatataggaacttaa

SEQ ID NO: 2228489 - DNA, 14 bp, Homo sapiens
ctcttgagcctggg

SEQ ID NO: 2228490 - DNA, 16 bp, Homo sapiens
ctcttgagcctgggag

SEQ ID NO: 2228491 - DNA, 17 bp, Homo sapiens
ctcttgagccttgaact

SEQ ID NO: 2228492 - DNA, 23 bp, Homo sapiens
ctcttgagccttgaactttgacc

SEQ ID NO: 2228493 - DNA, 22 bp, Homo sapiens
ctcttgattcataatgacttaa

SEQ ID NO: 2228494 - DNA, 19 bp, Homo sapiens
ctcttgggttcaagcgatt

SEQ ID NO: 2228495 - DNA, 21 bp, Homo sapiens
ctcttgggttcaagcgattct

SEQ ID NO: 2228496 - DNA, 18 bp, Homo sapiens
ctcttggtcctgctgcag

SEQ ID NO: 2228497 - DNA, 13 bp, Homo sapiens
ctctttccctccc

SEQ ID NO: 2228498 - DNA, 17 bp, Homo sapiens
ctctttctattgtttct

SEQ ID NO: 2228499 - DNA, 15 bp, Homo sapiens
ctgaaagccctgagc

SEQ ID NO: 2228500 - DNA, 18 bp, Homo sapiens
ctgaaagccctgagcttt

SEQ ID NO: 2228501 - DNA, 21 bp, Homo sapiens
ctgaacctgggtaactaggga

SEQ ID NO: 2228502 - DNA, 21 bp, Homo sapiens
ctgaacttggcgctgcccctg

SEQ ID NO: 2228503 - DNA, 19 bp, Homo sapiens
ctgaagactcattcttctg

SEQ ID NO: 2228504 - DNA, 20 bp, Homo sapiens
ctgaaggacattgcggacag

SEQ ID NO: 2228505 - DNA, 13 bp, Homo sapiens
ctgaaggccccgc

SEQ ID NO: 2228506 - DNA, 17 bp, Homo sapiens
ctgaaggccccgcccag

SEQ ID NO: 2228507 - DNA, 18 bp, Homo sapiens
ctgaagtcacacagtgag

SEQ ID NO: 2228508 - DNA, 17 bp, Homo sapiens
ctgaagtctttgtacag

SEQ ID NO: 2228509 - DNA, 14 bp, Homo sapiens
ctgaatttcttttg

SEQ ID NO: 2228510 - DNA, 13 bp, Homo sapiens
ctgacacacagct

SEQ ID NO: 2228511 - DNA, 16 bp, Homo sapiens
ctgacacacagctctg

SEQ ID NO: 2228512 - DNA, 20 bp, Homo sapiens
ctgacacacagctctgtcct

SEQ ID NO: 2228513 - DNA, 22 bp, Homo sapiens
ctgacacacagctctgtcctgg

SEQ ID NO: 2228514 - DNA, 23 bp, Homo sapiens
ctgacacacagctctgtcctggg

SEQ ID NO: 2228515 - DNA, 17 bp, Homo sapiens
ctgacagacacaggccc

SEQ ID NO: 2228516 - DNA, 11 bp, Homo sapiens
ctgacaggcaa

SEQ ID NO: 2228517 - DNA, 17 bp, Homo sapiens
ctgacattgttggccaa

SEQ ID NO: 2228518 - DNA, 21 bp, Homo sapiens
ctgacattgttggccaaagcc

SEQ ID NO: 2228519 - DNA, 22 bp, Homo sapiens
ctgacattgttggccaaagcca

SEQ ID NO: 2228520 - DNA, 13 bp, Homo sapiens
ctgacccatgctg

SEQ ID NO: 2228521 - DNA, 16 bp, Homo sapiens
ctgacccatgctgccc

SEQ ID NO: 2228522 - DNA, 23 bp, Homo sapiens
ctgaccctgcttcaaatatttcc

SEQ ID NO: 2228523 - DNA, 14 bp, Homo sapiens
ctgagacagcccgg

SEQ ID NO: 2228524 - DNA, 15 bp, Homo sapiens
ctgagacagcccggg

SEQ ID NO: 2228525 - DNA, 17 bp, Homo sapiens
ctgagacagcccgggct

SEQ ID NO: 2228526 - DNA, 21 bp, Homo sapiens
ctgagaggacttttctttgtg

SEQ ID NO: 2228527 - DNA, 17 bp, Homo sapiens
ctgagccagatttcact

SEQ ID NO: 2228528 - DNA, 13 bp, Homo sapiens
ctgaggcccagag

SEQ ID NO: 2228529 - DNA, 21 bp, Homo sapiens
ctgaggcccagagggcctgca

SEQ ID NO: 2228530 - DNA, 15 bp, Homo sapiens
ctgaggcccttctct

SEQ ID NO: 2228531 - DNA, 20 bp, Homo sapiens
ctgaggcccttctctccagc

SEQ ID NO: 2228532 - DNA, 22 bp, Homo sapiens
ctgaggcccttctctccagccc

SEQ ID NO: 2228533 - DNA, 13 bp, Homo sapiens
ctgaggctgggct

SEQ ID NO: 2228534 - DNA, 14 bp, Homo sapiens
ctgaggggcctctt

SEQ ID NO: 2228535 - DNA, 13 bp, Homo sapiens
ctgaggtgggagg

SEQ ID NO: 2228536 - DNA, 19 bp, Homo sapiens
ctgagtctgaaggctgggt

SEQ ID NO: 2228537 - DNA, 21 bp, Homo sapiens
ctgatgggcaacccccagcct

SEQ ID NO: 2228538 - DNA, 15 bp, Homo sapiens
ctgatggtgcaatga

SEQ ID NO: 2228539 - DNA, 17 bp, Homo sapiens
ctgatggtgcaatgacc

SEQ ID NO: 2228540 - DNA, 15 bp, Homo sapiens
ctgattcccaagctc

SEQ ID NO: 2228541 - DNA, 18 bp, Homo sapiens
ctgattcccaagctctgc

SEQ ID NO: 2228542 - DNA, 19 bp, Homo sapiens
ctgatttttttttccttca

SEQ ID NO: 2228543 - DNA, 20 bp, Homo sapiens
ctgatttttttttccttcag

SEQ ID NO: 2228544 - DNA, 22 bp, Homo sapiens
ctgcaacctccgcctcttgggt

SEQ ID NO: 2228545 - DNA, 14 bp, Homo sapiens
ctgcaacctgattg

SEQ ID NO: 2228546 - DNA, 20 bp, Homo sapiens
ctgcaagaattgaagcagga

SEQ ID NO: 2228547 - DNA, 13 bp, Homo sapiens
ctgcacaagctgc

SEQ ID NO: 2228548 - DNA, 15 bp, Homo sapiens
ctgcacaagctgcac

SEQ ID NO: 2228549 - DNA, 22 bp, Homo sapiens
ctgcacaagctgcaccctcagg

SEQ ID NO: 2228550 - DNA, 13 bp, Homo sapiens
ctgcaccctcagg

SEQ ID NO: 2228551 - DNA, 21 bp, Homo sapiens
cttatgggctgggttctaccc

SEQ ID NO: 2228552 - DNA, 22 bp, Homo sapiens
cttatgggctgggttctaccca

SEQ ID NO: 2228553 - DNA, 23 bp, Homo sapiens
cttatgggctgggttctacccag

SEQ ID NO: 2228554 - DNA, 15 bp, Homo sapiens
cttatttaatgaaag

SEQ ID NO: 2228555 - DNA, 16 bp, Homo sapiens
cttcaaggatcctgag

SEQ ID NO: 2228556 - DNA, 17 bp, Homo sapiens
cttcaaggatcctgagc

SEQ ID NO: 2228557 - DNA, 14 bp, Homo sapiens
cttcacctttgtcc

SEQ ID NO: 2228558 - DNA, 16 bp, Homo sapiens
cttcagagactcctgc

SEQ ID NO: 2228559 - DNA, 14 bp, Homo sapiens
cttcagcctcccga

SEQ ID NO: 2228560 - DNA, 11 bp, Homo sapiens
cttcagctgac

SEQ ID NO: 2228561 - DNA, 11 bp, Homo sapiens
cttcagtgcct

SEQ ID NO: 2228562 - DNA, 22 bp, Homo sapiens
cttcagtgccttatggaacact

SEQ ID NO: 2228563 - DNA, 14 bp, Homo sapiens
cttcagtggcagct

SEQ ID NO: 2228564 - DNA, 15 bp, Homo sapiens
cttcatcctcctcag

SEQ ID NO: 2228565 - DNA, 16 bp, Homo sapiens
cttcatcctcctcaga

SEQ ID NO: 2228566 - DNA, 20 bp, Homo sapiens
cttcattcaacccacctgcg

SEQ ID NO: 2228567 - DNA, 18 bp, Homo sapiens
cttcatttcctgtgtctt

SEQ ID NO: 2228568 - DNA, 13 bp, Homo sapiens
cttccacaagagc

SEQ ID NO: 2228569 - DNA, 16 bp, Homo sapiens
cttccacaagagccca

SEQ ID NO: 2228570 - DNA, 19 bp, Homo sapiens
cttccacaagagcccaggc

SEQ ID NO: 2228571 - DNA, 23 bp, Homo sapiens
cttccacaagagcccaggcctcc

SEQ ID NO: 2228572 - DNA, 14 bp, Homo sapiens
cttccaggctggga

SEQ ID NO: 2228573 - DNA, 21 bp, Homo sapiens
cttccaggggtgggacaccct

SEQ ID NO: 2228574 - DNA, 21 bp, Homo sapiens
cttccagtgaggctctgccct

SEQ ID NO: 2228575 - DNA, 17 bp, Homo sapiens
cttccatggactttgtt

SEQ ID NO: 2228576 - DNA, 22 bp, Homo sapiens
cttcctctttccatctaccctc

SEQ ID NO: 2228577 - DNA, 17 bp, Homo sapiens
cttcctgcaacaccttg

SEQ ID NO: 2228578 - DNA, 19 bp, Homo sapiens
cttcgggaggtcgaggcag

SEQ ID NO: 2228579 - DNA, 14 bp, Homo sapiens
cttctccaccctgc

SEQ ID NO: 2228580 - DNA, 18 bp, Homo sapiens
cttctccaccctgctctc

SEQ ID NO: 2228581 - DNA, 20 bp, Homo sapiens
cttctccactttctagccag

SEQ ID NO: 2228582 - DNA, 13 bp, Homo sapiens
cttctccaggctg

SEQ ID NO: 2228583 - DNA, 22 bp, Homo sapiens
cttctccttcacctttgtcccc

SEQ ID NO: 2228584 - DNA, 22 bp, Homo sapiens
cttctgaacttggcgctgcccc

SEQ ID NO: 2228585 - DNA, 23 bp, Homo sapiens
cttctgaacttggcgctgcccct

SEQ ID NO: 2228586 - DNA, 20 bp, Homo sapiens
cttctgacccatgctgccct

SEQ ID NO: 2228587 - DNA, 15 bp, Homo sapiens
cttctgccatattct

SEQ ID NO: 2228588 - DNA, 16 bp, Homo sapiens
cttctgcttcagcctc

SEQ ID NO: 2228589 - DNA, 18 bp, Homo sapiens
cttctgtacgtctgacag

SEQ ID NO: 2228590 - DNA, 17 bp, Homo sapiens
cttctgtcctactctgt

SEQ ID NO: 2228591 - DNA, 19 bp, Homo sapiens
cttctgtcctactctgtgt

SEQ ID NO: 2228592 - DNA, 21 bp, Homo sapiens
cttctgtcctactctgtgtca

SEQ ID NO: 2228593 - DNA, 13 bp, Homo sapiens
cttctgtgggttt

SEQ ID NO: 2228594 - DNA, 23 bp, Homo sapiens
cttgaaaacactgttctctgccc

SEQ ID NO: 2228595 - DNA, 13 bp, Homo sapiens
cttgaactcctgg

SEQ ID NO: 2228596 - DNA, 17 bp, Homo sapiens
cttgaactcctggcctc

SEQ ID NO: 2228597 - DNA, 18 bp, Homo sapiens
cttgaactcctggcctca

SEQ ID NO: 2228598 - DNA, 19 bp, Homo sapiens
cttgaactcctggcctcaa

SEQ ID NO: 2228599 - DNA, 20 bp, Homo sapiens
cttgaactgggtacttgtgg

SEQ ID NO: 2228600 - DNA, 16 bp, Homo sapiens
cttgaacttgaaaaaa

SEQ ID NO: 2228601 - DNA, 17 bp, Homo sapiens
cttgaacttgaaaaaaa

SEQ ID NO: 2228602 - DNA, 20 bp, Homo sapiens
cttgacagggcacaccgggc

SEQ ID NO: 2228603 - DNA, 21 bp, Homo sapiens
cttgaccattctccacctgcc

SEQ ID NO: 2228604 - DNA, 23 bp, Homo sapiens
cttgaccattctccacctgccag

SEQ ID NO: 2228605 - DNA, 20 bp, Homo sapiens
cttgaccgtgaggccagaga

SEQ ID NO: 2228606 - DNA, 19 bp, Homo sapiens
cttgagggttgggctggtg

SEQ ID NO: 2228607 - DNA, 20 bp, Homo sapiens
cttgagttgattcagctctg

SEQ ID NO: 2228608 - DNA, 21 bp, Homo sapiens
cttgagttgattcagctctgc

SEQ ID NO: 2228609 - DNA, 22 bp, Homo sapiens
cttgatatcctctttgagtgaa

SEQ ID NO: 2228610 - DNA, 12 bp, Homo sapiens
cttgattcataa

SEQ ID NO: 2228611 - DNA, 14 bp, Homo sapiens
cttgcatgaggcta

SEQ ID NO: 2228612 - DNA, 12 bp, Homo sapiens
cttgcccaggcc

SEQ ID NO: 2228613 - DNA, 20 bp, Homo sapiens
cttgccgtctacctgagggg

SEQ ID NO: 2228614 - DNA, 13 bp, Homo sapiens
cttgctctgctga

SEQ ID NO: 2228615 - DNA, 22 bp, Homo sapiens
cttgctctgctgacagacacag

SEQ ID NO: 2228616 - DNA, 13 bp, Homo sapiens
cttggaagctccg

SEQ ID NO: 2228617 - DNA, 15 bp, Homo sapiens
cttggattgtccccg

SEQ ID NO: 2228618 - DNA, 18 bp, Homo sapiens
cttggattgtccccgacc

SEQ ID NO: 2228619 - DNA, 23 bp, Homo sapiens
cttggcgctgcccctggcagccc

SEQ ID NO: 2228620 - DNA, 16 bp, Homo sapiens
cttggctgcagggagt

SEQ ID NO: 2228621 - DNA, 18 bp, Homo sapiens
cttgggccactgtgaaga

SEQ ID NO: 2228622 - DNA, 16 bp, Homo sapiens
cttggggaccagagct

SEQ ID NO: 2228623 - DNA, 18 bp, Homo sapiens
cttggtcctgctgcagtt

SEQ ID NO: 2228624 - DNA, 20 bp, Homo sapiens
cttggtgtcgggcatgacac

SEQ ID NO: 2228625 - DNA, 12 bp, Homo sapiens
cttgtacataat

SEQ ID NO: 2228626 - DNA, 19 bp, Homo sapiens
cttgtacataatgcgtgca

SEQ ID NO: 2228627 - DNA, 13 bp, Homo sapiens
cttgtctgtagat

SEQ ID NO: 2228628 - DNA, 19 bp, Homo sapiens
cttgtctttggaccctgag

SEQ ID NO: 2228629 - DNA, 20 bp, Homo sapiens
cttgtctttggaccctgagg

SEQ ID NO: 2228630 - DNA, 21 bp, Homo sapiens
cttgtggacacagctcttctc

SEQ ID NO: 2228631 - DNA, 15 bp, Homo sapiens
cttgtggtcccaccc

SEQ ID NO: 2228632 - DNA, 18 bp, Homo sapiens
ctttaatgtcacaggcag

SEQ ID NO: 2228633 - DNA, 19 bp, Homo sapiens
ctttaatgtcacaggcagg

SEQ ID NO: 2228634 - DNA, 22 bp, Homo sapiens
ctttaatgtcacaggcaggtcc

SEQ ID NO: 2228635 - DNA, 23 bp, Homo sapiens
ctttaatgtcacaggcaggtcca

SEQ ID NO: 2228636 - DNA, 13 bp, Homo sapiens
ctttactatggcc

SEQ ID NO: 2228637 - DNA, 14 bp, Homo sapiens
ctttagcgcccagt

SEQ ID NO: 2228638 - DNA, 19 bp, Homo sapiens
ctttataattctactttga

SEQ ID NO: 2228639 - DNA, 15 bp, Homo sapiens
ctttatgcacaaaat

SEQ ID NO: 2228640 - DNA, 20 bp, Homo sapiens
ctttcaataggaaaaactga

SEQ ID NO: 2228641 - DNA, 20 bp, Homo sapiens
ctttcacccttttctgtttg

SEQ ID NO: 2228642 - DNA, 22 bp, Homo sapiens
ctttccaaatgcccagcttaaa

SEQ ID NO: 2228643 - DNA, 13 bp, Homo sapiens
ctttcctgaggct

SEQ ID NO: 2228644 - DNA, 17 bp, Homo sapiens
ctttcctgaggctgggc

SEQ ID NO: 2228645 - DNA, 17 bp, Homo sapiens
ctttctacccagcgagc

SEQ ID NO: 2228646 - DNA, 17 bp, Homo sapiens
ctttctggctatgcatt

SEQ ID NO: 2228647 - DNA, 17 bp, Homo sapiens
ctttgacctctgcagca

SEQ ID NO: 2228648 - DNA, 20 bp, Homo sapiens
ctttgacctctgcagcaata

SEQ ID NO: 2228649 - DNA, 20 bp, Homo sapiens
ctttgcagacaggcaagcac

SEQ ID NO: 2228650 - DNA, 19 bp, Homo sapiens
ctttggaaagagtaggaag

SEQ ID NO: 2228651 - DNA, 23 bp, Homo sapiens
ctttggaaagagtaggaagactt

SEQ ID NO: 2228652 - DNA, 16 bp, Homo sapiens
ctttggaccctgaggc

SEQ ID NO: 2228653 - DNA, 17 bp, Homo sapiens
ctttggaccctgaggcc

SEQ ID NO: 2228654 - DNA, 18 bp, Homo sapiens
ctttggaccctgaggccc

SEQ ID NO: 2228655 - DNA, 23 bp, Homo sapiens
ctttgggaggccaaggtgggagg

SEQ ID NO: 2228656 - DNA, 17 bp, Homo sapiens
ctttgggcctggctccc

SEQ ID NO: 2228657 - DNA, 14 bp, Homo sapiens
ctttgtccccaccg

SEQ ID NO: 2228658 - DNA, 15 bp, Homo sapiens
ctttgtgaggaagcc

SEQ ID NO: 2228659 - DNA, 23 bp, Homo sapiens
ctttgtgaggaagccgctggggc

SEQ ID NO: 2228660 - DNA, 14 bp, Homo sapiens
ctttgtgatttttg

SEQ ID NO: 2228661 - DNA, 18 bp, Homo sapiens
ctttgtgatttttgtaat

SEQ ID NO: 2228662 - DNA, 19 bp, Homo sapiens
ctttgtgatttttgtaatt

SEQ ID NO: 2228663 - DNA, 16 bp, Homo sapiens
ctttgttctggctctt

SEQ ID NO: 2228664 - DNA, 20 bp, Homo sapiens
ctttgtttgttgtcagctga

SEQ ID NO: 2228665 - DNA, 16 bp, Homo sapiens
cttttataaactttac

SEQ ID NO: 2228666 - DNA, 19 bp, Homo sapiens
cttttataaactttacctt

SEQ ID NO: 2228667 - DNA, 20 bp, Homo sapiens
cttttcataacctagcctta

SEQ ID NO: 2228668 - DNA, 13 bp, Homo sapiens
cttttccaaccct

SEQ ID NO: 2228669 - DNA, 16 bp, Homo sapiens
cttttctttcagccaa

SEQ ID NO: 2228670 - DNA, 13 bp, Homo sapiens
cttttcttttctt

SEQ ID NO: 2228671 - DNA, 23 bp, Homo sapiens
cttttgcccacacttgggagcaa

SEQ ID NO: 2228672 - DNA, 18 bp, Homo sapiens
cttttgccgttattaaaa

SEQ ID NO: 2228673 - DNA, 15 bp, Homo sapiens
cttttggtctgtgtg

SEQ ID NO: 2228674 - DNA, 19 bp, Homo sapiens
gatcccccgccccatcctc

SEQ ID NO: 2228675 - DNA, 15 bp, Homo sapiens
gatccctcatcctca

SEQ ID NO: 2228676 - DNA, 11 bp, Homo sapiens
gatcctccagg

SEQ ID NO: 2228677 - DNA, 14 bp, Homo sapiens
gatcctccaggtgc

SEQ ID NO: 2228678 - DNA, 17 bp, Homo sapiens
gatcctcccacctcagc

SEQ ID NO: 2228679 - DNA, 18 bp, Homo sapiens
gatcctcccacctcagcc

SEQ ID NO: 2228680 - DNA, 20 bp, Homo sapiens
gatcctcccacctcagcctc

SEQ ID NO: 2228681 - DNA, 13 bp, Homo sapiens
gatctaggaagac

SEQ ID NO: 2228682 - DNA, 14 bp, Homo sapiens
gatctaggaagact

SEQ ID NO: 2228683 - DNA, 18 bp, Homo sapiens
gatctaggaagactttgg

SEQ ID NO: 2228684 - DNA, 20 bp, Homo sapiens
gatctaggaagactttggaa

SEQ ID NO: 2228685 - DNA, 15 bp, Homo sapiens
gatgaaaaaataaca

SEQ ID NO: 2228686 - DNA, 15 bp, Homo sapiens
gatgaaatgaggtca

SEQ ID NO: 2228687 - DNA, 21 bp, Homo sapiens
gatgaaatgaggtcagagcct

SEQ ID NO: 2228688 - DNA, 21 bp, Homo sapiens
gatgatctaggaagactttgg

SEQ ID NO: 2228689 - DNA, 14 bp, Homo sapiens
gatgatctttgcag

SEQ ID NO: 2228690 - DNA, 20 bp, Homo sapiens
gatgatctttgcagacaggc

SEQ ID NO: 2228691 - DNA, 21 bp, Homo sapiens
gatgatctttgcagacaggca

SEQ ID NO: 2228692 - DNA, 22 bp, Homo sapiens
gatgattggaggggggaggtgg

SEQ ID NO: 2228693 - DNA, 15 bp, Homo sapiens
gatgcaccagccctt

SEQ ID NO: 2228694 - DNA, 23 bp, Homo sapiens
gatgcaccagcccttagcaggga

SEQ ID NO: 2228695 - DNA, 19 bp, Homo sapiens
gatgcagcctcacagtcct

SEQ ID NO: 2228696 - DNA, 16 bp, Homo sapiens
gatgcctggtggcagc

SEQ ID NO: 2228697 - DNA, 17 bp, Homo sapiens
gatgcctggtggcagct

SEQ ID NO: 2228698 - DNA, 19 bp, Homo sapiens
gatgcctggtggcagctgc

SEQ ID NO: 2228699 - DNA, 11 bp, Homo sapiens
gatgggatggc

SEQ ID NO: 2228700 - DNA, 20 bp, Homo sapiens
gatgggcaacccccagcctg

SEQ ID NO: 2228701 - DNA, 15 bp, Homo sapiens
gatggggctgcaccg

SEQ ID NO: 2228702 - DNA, 16 bp, Homo sapiens
gatggtgcaatgacct

SEQ ID NO: 2228703 - DNA, 15 bp, Homo sapiens
gatgtgcccccaccc

SEQ ID NO: 2228704 - DNA, 23 bp, Homo sapiens
gatgtgcccccacccccaccctc

SEQ ID NO: 2228705 - DNA, 14 bp, Homo sapiens
gatgttctgggaca

SEQ ID NO: 2228706 - DNA, 16 bp, Homo sapiens
gatgttctgggacaca

SEQ ID NO: 2228707 - DNA, 14 bp, Homo sapiens
gatgttttccatga

SEQ ID NO: 2228708 - DNA, 12 bp, Homo sapiens
gattattggaaa

SEQ ID NO: 2228709 - DNA, 14 bp, Homo sapiens
gattcagacagctg

SEQ ID NO: 2228710 - DNA, 19 bp, Homo sapiens
gattcagacagctgcctgg

SEQ ID NO: 2228711 - DNA, 15 bp, Homo sapiens
gattcccaagctctg

SEQ ID NO: 2228712 - DNA, 18 bp, Homo sapiens
gattcccaagctctgctc

SEQ ID NO: 2228713 - DNA, 19 bp, Homo sapiens
gattcccaagctctgctcc

SEQ ID NO: 2228714 - DNA, 21 bp, Homo sapiens
gattcccaagctctgctcctc

SEQ ID NO: 2228715 - DNA, 18 bp, Homo sapiens
gattctcctgcctcagcc

SEQ ID NO: 2228716 - DNA, 20 bp, Homo sapiens
gattctcctgcctcagcctc

SEQ ID NO: 2228717 - DNA, 17 bp, Homo sapiens
gattcttcctccctccc

SEQ ID NO: 2228718 - DNA, 13 bp, Homo sapiens
gattcttctgctt

SEQ ID NO: 2228719 - DNA, 12 bp, Homo sapiens
gattctttcctg

SEQ ID NO: 2228720 - DNA, 16 bp, Homo sapiens
gattctttcctgaggc

SEQ ID NO: 2228721 - DNA, 17 bp, Homo sapiens
gattctttcctgaggct

SEQ ID NO: 2228722 - DNA, 20 bp, Homo sapiens
gattctttcctgaggctggg

SEQ ID NO: 2228723 - DNA, 18 bp, Homo sapiens
gattgcaacaggctgggc

SEQ ID NO: 2228724 - DNA, 21 bp, Homo sapiens
gattgcaacaggctgggcttc

SEQ ID NO: 2228725 - DNA, 18 bp, Homo sapiens
gattgcttgagctcagga

SEQ ID NO: 2228726 - DNA, 12 bp, Homo sapiens
gatttaaatcag

SEQ ID NO: 2228727 - DNA, 11 bp, Homo sapiens
gatttcactct

SEQ ID NO: 2228728 - DNA, 16 bp, Homo sapiens
gatttcactctccttg

SEQ ID NO: 2228729 - DNA, 15 bp, Homo sapiens
gatttccgttaaaat

SEQ ID NO: 2228730 - DNA, 11 bp, Homo sapiens
gatttctgttt

SEQ ID NO: 2228731 - DNA, 22 bp, Homo sapiens
gatttttttttccttcagtgcc

SEQ ID NO: 2228732 - DNA, 16 bp, Homo sapiens
gcaaaccatcattgaa

SEQ ID NO: 2228733 - DNA, 17 bp, Homo sapiens
gcaaaccatcattgaaa

SEQ ID NO: 2228734 - DNA, 19 bp, Homo sapiens
gcaaaccatcattgaaatc

SEQ ID NO: 2228735 - DNA, 16 bp, Homo sapiens
gcaaagtatccctact

SEQ ID NO: 2228736 - DNA, 16 bp, Homo sapiens
gcaacaggctgggctt

SEQ ID NO: 2228737 - DNA, 19 bp, Homo sapiens
gcaacaggctgggcttcag

SEQ ID NO: 2228738 - DNA, 16 bp, Homo sapiens
gcaaccaccaccaacc

SEQ ID NO: 2228739 - DNA, 15 bp, Homo sapiens
gcaacccccagcctg

SEQ ID NO: 2228740 - DNA, 16 bp, Homo sapiens
gcaacccccagcctgc

SEQ ID NO: 2228741 - DNA, 19 bp, Homo sapiens
gcaacctccgcctcttggg

SEQ ID NO: 2228742 - DNA, 14 bp, Homo sapiens
gcaactcatcttag

SEQ ID NO: 2228743 - DNA, 18 bp, Homo sapiens
gcaaggagatttacaact

SEQ ID NO: 2228744 - DNA, 15 bp, Homo sapiens
gcaagtgagagctgg

SEQ ID NO: 2228745 - DNA, 19 bp, Homo sapiens
gcaagtgagagctgggtgt

SEQ ID NO: 2228746 - DNA, 21 bp, Homo sapiens
gcaataaagcagcgtttctat

SEQ ID NO: 2228747 - DNA, 17 bp, Homo sapiens
gcaatcaaatctgcttt

SEQ ID NO: 2228748 - DNA, 17 bp, Homo sapiens
gcaatcctgcaagaaca

SEQ ID NO: 2228749 - DNA, 12 bp, Homo sapiens
gcaatggcagcc

SEQ ID NO: 2228750 - DNA, 14 bp, Homo sapiens
gcaatggcagcctt

SEQ ID NO: 2228751 - DNA, 15 bp, Homo sapiens
gcaatggcagccttg

SEQ ID NO: 2228752 - DNA, 14 bp, Homo sapiens
gcaatgtgataaaa

SEQ ID NO: 2228753 - DNA, 14 bp, Homo sapiens
gcacaaacagaggc

SEQ ID NO: 2228754 - DNA, 16 bp, Homo sapiens
gcacaaacagaggccg

SEQ ID NO: 2228755 - DNA, 17 bp, Homo sapiens
gcacaagctccaagctc

SEQ ID NO: 2228756 - DNA, 22 bp, Homo sapiens
gcacaagctgcaccctcaggca

SEQ ID NO: 2228757 - DNA, 12 bp, Homo sapiens
gcacacaccaga

SEQ ID NO: 2228758 - DNA, 11 bp, Homo sapiens
gcacacatttt

SEQ ID NO: 2228759 - DNA, 14 bp, Homo sapiens
gcacagaccctgcc

SEQ ID NO: 2228760 - DNA, 18 bp, Homo sapiens
gcacagaccctgccctgt

SEQ ID NO: 2228761 - DNA, 21 bp, Homo sapiens
gcacagaccctgccctgtggg

SEQ ID NO: 2228762 - DNA, 22 bp, Homo sapiens
gcacagaccctgccctgtgggc

SEQ ID NO: 2228763 - DNA, 18 bp, Homo sapiens
gcacagagttgttacatt

SEQ ID NO: 2228764 - DNA, 13 bp, Homo sapiens
gcacatgcctctc

SEQ ID NO: 2228765 - DNA, 18 bp, Homo sapiens
gcacatgcctctctcagg

SEQ ID NO: 2228766 - DNA, 20 bp, Homo sapiens
gcacatgcctctctcaggcc

SEQ ID NO: 2228767 - DNA, 19 bp, Homo sapiens
gcaccactgcactccagcc

SEQ ID NO: 2228768 - DNA, 20 bp, Homo sapiens
gcaccactgcactccagcct

SEQ ID NO: 2228769 - DNA, 16 bp, Homo sapiens
gcaccagcagcctgga

SEQ ID NO: 2228770 - DNA, 17 bp, Homo sapiens
gcaccatctctcctcct

SEQ ID NO: 2228771 - DNA, 15 bp, Homo sapiens
gcacccggcccctgc

SEQ ID NO: 2228772 - DNA, 18 bp, Homo sapiens
gcacccggcccctgctgg

SEQ ID NO: 2228773 - DNA, 17 bp, Homo sapiens
gcaccggctggcctggc

SEQ ID NO: 2228774 - DNA, 19 bp, Homo sapiens
gcaccggctggcctggccc

SEQ ID NO: 2228775 - DNA, 23 bp, Homo sapiens
gcaccgggccacagagaaagtac

SEQ ID NO: 2228776 - DNA, 22 bp, Homo sapiens
gcacctaggtggggcctggggt

SEQ ID NO: 2228777 - DNA, 22 bp, Homo sapiens
gcacctggaatatataaccagt

SEQ ID NO: 2228778 - DNA, 14 bp, Homo sapiens
gcaccttagacagt

SEQ ID NO: 2228779 - DNA, 18 bp, Homo sapiens
gcaccttagacagtccct

SEQ ID NO: 2228780 - DNA, 13 bp, Homo sapiens
gcacgatttctgt

SEQ ID NO: 2228781 - DNA, 18 bp, Homo sapiens
gcactaaggtgtgctctg

SEQ ID NO: 2228782 - DNA, 13 bp, Homo sapiens
gcactcagaagac

SEQ ID NO: 2228783 - DNA, 17 bp, Homo sapiens
gcactcagaagacactg

SEQ ID NO: 2228784 - DNA, 14 bp, Homo sapiens
gcactccagcctgg

SEQ ID NO: 2228785 - DNA, 13 bp, Homo sapiens
gcactcccctgct

SEQ ID NO: 2228786 - DNA, 15 bp, Homo sapiens
gcactcccctgctgg

SEQ ID NO: 2228787 - DNA, 15 bp, Homo sapiens
gcactgcttccagtg

SEQ ID NO: 2228788 - DNA, 20 bp, Homo sapiens
gcactgcttccagtgaggct

SEQ ID NO: 2228789 - DNA, 22 bp, Homo sapiens
gcactgggcttggggaccagag

SEQ ID NO: 2228790 - DNA, 23 bp, Homo sapiens
gcactgggcttggggaccagagc

SEQ ID NO: 2228791 - DNA, 19 bp, Homo sapiens
gcactgttttattttaatt

SEQ ID NO: 2228792 - DNA, 14 bp, Homo sapiens
gcacttgcagactc

SEQ ID NO: 2228793 - DNA, 16 bp, Homo sapiens
gcacttgcagactcta

SEQ ID NO: 2228794 - DNA, 20 bp, Homo sapiens
gcagaaacaaaatgaaaaaa

SEQ ID NO: 2228795 - DNA, 14 bp, Homo sapiens
gcagaaggaagact

SEQ ID NO: 2228796 - DNA, 15 bp, Homo sapiens
gcagacaggaccagg

SEQ ID NO: 2228797 - DNA, 18 bp, Homo sapiens
gcagacaggaccagggat

SEQ ID NO: 2228798 - DNA, 13 bp, Homo sapiens
gcagacaggcaag

SEQ ID NO: 2228799 - DNA, 19 bp, Homo sapiens
gcggagacggagtcccacc

SEQ ID NO: 2228800 - DNA, 12 bp, Homo sapiens
gcggggacagct

SEQ ID NO: 2228801 - DNA, 17 bp, Homo sapiens
gcgggggagcaggcagt

SEQ ID NO: 2228802 - DNA, 13 bp, Homo sapiens
gcggtccacccag

SEQ ID NO: 2228803 - DNA, 19 bp, Homo sapiens
gcggtgagaggggaacaga

SEQ ID NO: 2228804 - DNA, 22 bp, Homo sapiens
gcggtgctatctcccccagccc

SEQ ID NO: 2228805 - DNA, 14 bp, Homo sapiens
gcgtgcacacacca

SEQ ID NO: 2228806 - DNA, 17 bp, Homo sapiens
gcgtttctatgacacat

SEQ ID NO: 2228807 - DNA, 11 bp, Homo sapiens
gctaaaaagaa

SEQ ID NO: 2228808 - DNA, 16 bp, Homo sapiens
gctaaatgtgaatgat

SEQ ID NO: 2228809 - DNA, 17 bp, Homo sapiens
gctaacatggaagtact

SEQ ID NO: 2228810 - DNA, 20 bp, Homo sapiens
gctaagagggagggagggct

SEQ ID NO: 2228811 - DNA, 16 bp, Homo sapiens
gctaatttttcatttt

SEQ ID NO: 2228812 - DNA, 20 bp, Homo sapiens
gctacacactgcatgtttgt

SEQ ID NO: 2228813 - DNA, 19 bp, Homo sapiens
gctactgtcctacccaccc

SEQ ID NO: 2228814 - DNA, 18 bp, Homo sapiens
gctagaggttcaaagata

SEQ ID NO: 2228815 - DNA, 15 bp, Homo sapiens
gctaggaacactcct

SEQ ID NO: 2228816 - DNA, 19 bp, Homo sapiens
gctaggaacactccttcac

SEQ ID NO: 2228817 - DNA, 22 bp, Homo sapiens
gctaggacccctccatgtgggc

SEQ ID NO: 2228818 - DNA, 16 bp, Homo sapiens
gctaggcctggccaga

SEQ ID NO: 2228819 - DNA, 22 bp, Homo sapiens
gctagtgtggtgtttcctggca

SEQ ID NO: 2228820 - DNA, 16 bp, Homo sapiens
gctatctcccccagcc

SEQ ID NO: 2228821 - DNA, 23 bp, Homo sapiens
gctatctcccccagccccatcct

SEQ ID NO: 2228822 - DNA, 12 bp, Homo sapiens
gctatgcatttg

SEQ ID NO: 2228823 - DNA, 18 bp, Homo sapiens
gctcaagtcctcttttct

SEQ ID NO: 2228824 - DNA, 16 bp, Homo sapiens
gctcacatatctgtca

SEQ ID NO: 2228825 - DNA, 18 bp, Homo sapiens
gctcaccagccccagtgc

SEQ ID NO: 2228826 - DNA, 20 bp, Homo sapiens
gctcaccagccccagtgccc

SEQ ID NO: 2228827 - DNA, 18 bp, Homo sapiens
gctcacctctcccttgga

SEQ ID NO: 2228828 - DNA, 14 bp, Homo sapiens
gctcactgcagcct

SEQ ID NO: 2228829 - DNA, 16 bp, Homo sapiens
gctcactgcagcctca

SEQ ID NO: 2228830 - DNA, 17 bp, Homo sapiens
gctcactgcagcctcaa

SEQ ID NO: 2228831 - DNA, 15 bp, Homo sapiens
gctcagagagggtgg

SEQ ID NO: 2228832 - DNA, 16 bp, Homo sapiens
gctcagcggggacagc

SEQ ID NO: 2228833 - DNA, 20 bp, Homo sapiens
gctcagcggggacagctcct

SEQ ID NO: 2228834 - DNA, 23 bp, Homo sapiens
gctcagcggggacagctccttct

SEQ ID NO: 2228835 - DNA, 13 bp, Homo sapiens
gctcaggagtttg

SEQ ID NO: 2228836 - DNA, 12 bp, Homo sapiens
gctcagggcctg

SEQ ID NO: 2228837 - DNA, 20 bp, Homo sapiens
gctcagggcctggctcaggt

SEQ ID NO: 2228838 - DNA, 23 bp, Homo sapiens
gctcaggtggggtcactctggca

SEQ ID NO: 2228839 - DNA, 14 bp, Homo sapiens
gctcaggtgtccct

SEQ ID NO: 2228840 - DNA, 18 bp, Homo sapiens
gctcaggtgtccctgcac

SEQ ID NO: 2228841 - DNA, 13 bp, Homo sapiens
gctccaagctccc

SEQ ID NO: 2228842 - DNA, 16 bp, Homo sapiens
gctccaagctcccagg

SEQ ID NO: 2228843 - DNA, 19 bp, Homo sapiens
gctccaagctcccaggcat

SEQ ID NO: 2228844 - DNA, 12 bp, Homo sapiens
gctccaggagca

SEQ ID NO: 2228845 - DNA, 14 bp, Homo sapiens
gctccaggagcagc

SEQ ID NO: 2228846 - DNA, 16 bp, Homo sapiens
gctccaggagcagcca

SEQ ID NO: 2228847 - DNA, 17 bp, Homo sapiens
gctccaggagcagccac

SEQ ID NO: 2228848 - DNA, 12 bp, Homo sapiens
gctccaggctcc

SEQ ID NO: 2228849 - DNA, 23 bp, Homo sapiens
gctccaggctcctttagcgccca

SEQ ID NO: 2228850 - DNA, 19 bp, Homo sapiens
gctccagggggtgccctcc

SEQ ID NO: 2228851 - DNA, 23 bp, Homo sapiens
gctcccaggcattccccaggagg

SEQ ID NO: 2228852 - DNA, 18 bp, Homo sapiens
gctcccttcccacctctc

SEQ ID NO: 2228853 - DNA, 21 bp, Homo sapiens
gctccgctttctacccagcga

SEQ ID NO: 2228854 - DNA, 18 bp, Homo sapiens
gctcctggcccactgcat

SEQ ID NO: 2228855 - DNA, 20 bp, Homo sapiens
gctcctggcccactgcatcg

SEQ ID NO: 2228856 - DNA, 21 bp, Homo sapiens
gctccttctgtcctactctgt

SEQ ID NO: 2228857 - DNA, 17 bp, Homo sapiens
gctctgatcatccactg

SEQ ID NO: 2228858 - DNA, 20 bp, Homo sapiens
gctctgatcatccactgtgc

SEQ ID NO: 2228859 - DNA, 23 bp, Homo sapiens
gctctgatcatccactgtgccat

SEQ ID NO: 2228860 - DNA, 14 bp, Homo sapiens
gctctgcccttggt

SEQ ID NO: 2228861 - DNA, 23 bp, Homo sapiens
gctctgcccttggttaggcattg

SEQ ID NO: 2228862 - DNA, 19 bp, Homo sapiens
gctctgctcctctccccag

SEQ ID NO: 2228863 - DNA, 13 bp, Homo sapiens
gctctgctgacag

SEQ ID NO: 2228864 - DNA, 14 bp, Homo sapiens
gctctgctgacaga

SEQ ID NO: 2228865 - DNA, 19 bp, Homo sapiens
gctctgctgacagacacag

SEQ ID NO: 2228866 - DNA, 23 bp, Homo sapiens
gctctgctgacagacacaggccc

SEQ ID NO: 2228867 - DNA, 15 bp, Homo sapiens
gctctggacaggcat

SEQ ID NO: 2228868 - DNA, 16 bp, Homo sapiens
gctctggtccatagag

SEQ ID NO: 2228869 - DNA, 18 bp, Homo sapiens
gctcttccaggctgggag

SEQ ID NO: 2228870 - DNA, 14 bp, Homo sapiens
gctcttctccaggc

SEQ ID NO: 2228871 - DNA, 16 bp, Homo sapiens
gctgacagacacaggc

SEQ ID NO: 2228872 - DNA, 18 bp, Homo sapiens
gctgacagacacaggccc

SEQ ID NO: 2228873 - DNA, 20 bp, Homo sapiens
gctgacagacacaggcccgg

SEQ ID NO: 2228874 - DNA, 23 bp, Homo sapiens
gctgagggtgagtgggtgaataa

SEQ ID NO: 2228875 - DNA, 15 bp, Homo sapiens
gctgaggtgggagga

SEQ ID NO: 2228876 - DNA, 16 bp, Homo sapiens
gctgagtctgaaggct

SEQ ID NO: 2228877 - DNA, 22 bp, Homo sapiens
gctgagtgggggatcacagcct

SEQ ID NO: 2228878 - DNA, 15 bp, Homo sapiens
gctgatggtgcaatg

SEQ ID NO: 2228879 - DNA, 21 bp, Homo sapiens
gctgatggtgcaatgaccttt

SEQ ID NO: 2228880 - DNA, 22 bp, Homo sapiens
gctgcaaagggtatcaggtgct

SEQ ID NO: 2228881 - DNA, 13 bp, Homo sapiens
gctgcaccctcag

SEQ ID NO: 2228882 - DNA, 16 bp, Homo sapiens
gctgcaccctcaggca

SEQ ID NO: 2228883 - DNA, 14 bp, Homo sapiens
gctgcaccggctgg

SEQ ID NO: 2228884 - DNA, 19 bp, Homo sapiens
gctgcaccggctggcctgg

SEQ ID NO: 2228885 - DNA, 14 bp, Homo sapiens
gctgcagttgccag

SEQ ID NO: 2228886 - DNA, 18 bp, Homo sapiens
gctgcatttaaaagatac

SEQ ID NO: 2228887 - DNA, 19 bp, Homo sapiens
gctgccagccgagatagcc

SEQ ID NO: 2228888 - DNA, 21 bp, Homo sapiens
gctgccagccgagatagccaa

SEQ ID NO: 2228889 - DNA, 13 bp, Homo sapiens
gctgccatccagg

SEQ ID NO: 2228890 - DNA, 21 bp, Homo sapiens
gctgccatccaggttcagctt

SEQ ID NO: 2228891 - DNA, 17 bp, Homo sapiens
gctgcccctggcagccc

SEQ ID NO: 2228892 - DNA, 18 bp, Homo sapiens
gctgcccctggcagcccc

SEQ ID NO: 2228893 - DNA, 20 bp, Homo sapiens
gctgcccctggcagcccctg

SEQ ID NO: 2228894 - DNA, 13 bp, Homo sapiens
gctgccctgccca

SEQ ID NO: 2228895 - DNA, 16 bp, Homo sapiens
gctgccctgcccacct

SEQ ID NO: 2228896 - DNA, 20 bp, Homo sapiens
gctgccctgcccacctggcc

SEQ ID NO: 2228897 - DNA, 24 bp, Homo sapiens
gctgccctgcccacctggcctctg

SEQ ID NO: 2228898 - DNA, 19 bp, Homo sapiens
gctgcctgttcagctccag

SEQ ID NO: 2228899 - DNA, 22 bp, Homo sapiens
gctgcctgttcagctccagctc

SEQ ID NO: 2228900 - DNA, 16 bp, Homo sapiens
gctgcggtccacccag

SEQ ID NO: 2228901 - DNA, 22 bp, Homo sapiens
gctgcggtccacccaggagccc

SEQ ID NO: 2228902 - DNA, 14 bp, Homo sapiens
gctgctgaaggctc

SEQ ID NO: 2228903 - DNA, 18 bp, Homo sapiens
gctgctgaaggctcgagc

SEQ ID NO: 2228904 - DNA, 13 bp, Homo sapiens
gctgctggctggt

SEQ ID NO: 2228905 - DNA, 13 bp, Homo sapiens
gctgcttcaagga

SEQ ID NO: 2228906 - DNA, 16 bp, Homo sapiens
gctgcttgggcttcat

SEQ ID NO: 2228907 - DNA, 12 bp, Homo sapiens
gctggaagcaga

SEQ ID NO: 2228908 - DNA, 18 bp, Homo sapiens
gctggagtgcagtgagcc

SEQ ID NO: 2228909 - DNA, 15 bp, Homo sapiens
gctggcctggcccct

SEQ ID NO: 2228910 - DNA, 16 bp, Homo sapiens
gctggcctggcccctc

SEQ ID NO: 2228911 - DNA, 18 bp, Homo sapiens
gctggctgttggctgggg

SEQ ID NO: 2228912 - DNA, 13 bp, Homo sapiens
gctgggactacag

SEQ ID NO: 2228913 - DNA, 19 bp, Homo sapiens
gctgggactacaggcaccc

SEQ ID NO: 2228914 - DNA, 18 bp, Homo sapiens
gctgggagagccttccag

SEQ ID NO: 2228915 - DNA, 14 bp, Homo sapiens
gctgggcagaggaa

SEQ ID NO: 2228916 - DNA, 16 bp, Homo sapiens
gctgggcagaggaaag

SEQ ID NO: 2228917 - DNA, 14 bp, Homo sapiens
gctgggcaggttgg

SEQ ID NO: 2228918 - DNA, 12 bp, Homo sapiens
gctgggctccct

SEQ ID NO: 2228919 - DNA, 17 bp, Homo sapiens
gctgggctcccttccca

SEQ ID NO: 2228920 - DNA, 20 bp, Homo sapiens
gctgggcttcagtggcagct

SEQ ID NO: 2228921 - DNA, 15 bp, Homo sapiens
gctgggggcctcagt

SEQ ID NO: 2228922 - DNA, 19 bp, Homo sapiens
gctgggggcctcagtgcca

SEQ ID NO: 2228923 - DNA, 23 bp, Homo sapiens
gtccacccaggagccccgaggcc

SEQ ID NO: 2228924 - DNA, 15 bp, Homo sapiens
gtcccaccccacaca

SEQ ID NO: 2228925 - DNA, 14 bp, Homo sapiens
gtcccaccttggct

SEQ ID NO: 2228926 - DNA, 20 bp, Homo sapiens
gtcccaccttggctgcaggg

SEQ ID NO: 2228927 - DNA, 15 bp, Homo sapiens
gtcccactcagtcca

SEQ ID NO: 2228928 - DNA, 18 bp, Homo sapiens
gtccccaccgcagacagg

SEQ ID NO: 2228929 - DNA, 22 bp, Homo sapiens
gtcccctgtttgtttctgaaag

SEQ ID NO: 2228930 - DNA, 23 bp, Homo sapiens
gtcccctgtttgtttctgaaagg

SEQ ID NO: 2228931 - DNA, 15 bp, Homo sapiens
gtccctgccaatgga

SEQ ID NO: 2228932 - DNA, 20 bp, Homo sapiens
gtccctgcggaagccacagg

SEQ ID NO: 2228933 - DNA, 21 bp, Homo sapiens
gtccctgcggaagccacaggg

SEQ ID NO: 2228934 - DNA, 18 bp, Homo sapiens
gtcccttacgtgagtcct

SEQ ID NO: 2228935 - DNA, 13 bp, Homo sapiens
gtcccttttcctt

SEQ ID NO: 2228936 - DNA, 21 bp, Homo sapiens
gtccgaaagggacttggaagc

SEQ ID NO: 2228937 - DNA, 22 bp, Homo sapiens
gtccgaaagggacttggaagct

SEQ ID NO: 2228938 - DNA, 16 bp, Homo sapiens
gtcctacccaccctcc

SEQ ID NO: 2228939 - DNA, 15 bp, Homo sapiens
gtcctactctgtgtc

SEQ ID NO: 2228940 - DNA, 16 bp, Homo sapiens
gtcctgctgcagttgc

SEQ ID NO: 2228941 - DNA, 19 bp, Homo sapiens
gtcctgctgcagttgccag

SEQ ID NO: 2228942 - DNA, 17 bp, Homo sapiens
gtcctgggagtgagctg

SEQ ID NO: 2228943 - DNA, 16 bp, Homo sapiens
gtccttaccagcagag

SEQ ID NO: 2228944 - DNA, 19 bp, Homo sapiens
gtccttaccagcagagcac

SEQ ID NO: 2228945 - DNA, 14 bp, Homo sapiens
gtcgaggacaggga

SEQ ID NO: 2228946 - DNA, 12 bp, Homo sapiens
gtcgaggcagga

SEQ ID NO: 2228947 - DNA, 13 bp, Homo sapiens
gtcgcccagtctg

SEQ ID NO: 2228948 - DNA, 14 bp, Homo sapiens
gtcgcccagtctgg

SEQ ID NO: 2228949 - DNA, 21 bp, Homo sapiens
gtcggaaaacatgctacacac

SEQ ID NO: 2228950 - DNA, 15 bp, Homo sapiens
gtctacctgaggggc

SEQ ID NO: 2228951 - DNA, 16 bp, Homo sapiens
gtctacctgaggggcc

SEQ ID NO: 2228952 - DNA, 14 bp, Homo sapiens
gtctatgggactca

SEQ ID NO: 2228953 - DNA, 17 bp, Homo sapiens
gtctcaaaaaaagaaaa

SEQ ID NO: 2228954 - DNA, 22 bp, Homo sapiens
gtctcaaactcttgacctcagg

SEQ ID NO: 2228955 - DNA, 11 bp, Homo sapiens
gtctcactctg

SEQ ID NO: 2228956 - DNA, 19 bp, Homo sapiens
gtctcactctgtcgcccag

SEQ ID NO: 2228957 - DNA, 16 bp, Homo sapiens
gtctcactgttgccca

SEQ ID NO: 2228958 - DNA, 18 bp, Homo sapiens
gtctcactgttgcccagg

SEQ ID NO: 2228959 - DNA, 19 bp, Homo sapiens
gtctcactgttgcccaggc

SEQ ID NO: 2228960 - DNA, 22 bp, Homo sapiens
gtctcactgttgcccaggctgg

SEQ ID NO: 2228961 - DNA, 23 bp, Homo sapiens
gtctcactgttgcccaggctggc

SEQ ID NO: 2228962 - DNA, 17 bp, Homo sapiens
gtctcttggtcctgctg

SEQ ID NO: 2228963 - DNA, 20 bp, Homo sapiens
gtctctttaatgtcacaggc

SEQ ID NO: 2228964 - DNA, 14 bp, Homo sapiens
gtctgaaggctggg

SEQ ID NO: 2228965 - DNA, 21 bp, Homo sapiens
gtctgacaggcaatgctggct

SEQ ID NO: 2228966 - DNA, 23 bp, Homo sapiens
gtctgacaggcaatgctggctgt

SEQ ID NO: 2228967 - DNA, 21 bp, Homo sapiens
gtctgaggaatccagacccgg

SEQ ID NO: 2228968 - DNA, 17 bp, Homo sapiens
gtctgattcccaagctc

SEQ ID NO: 2228969 - DNA, 21 bp, Homo sapiens
gtctgattcccaagctctgct

SEQ ID NO: 2228970 - DNA, 16 bp, Homo sapiens
gtctggaatgcagtgg

SEQ ID NO: 2228971 - DNA, 18 bp, Homo sapiens
gtctggaatgcagtggta

SEQ ID NO: 2228972 - DNA, 18 bp, Homo sapiens
gtctgtgccattttgtat

SEQ ID NO: 2228973 - DNA, 17 bp, Homo sapiens
gtctgttctttccaaag

SEQ ID NO: 2228974 - DNA, 15 bp, Homo sapiens
gtcttagatgtatat

SEQ ID NO: 2228975 - DNA, 16 bp, Homo sapiens
gtcttgaactcctggc

SEQ ID NO: 2228976 - DNA, 17 bp, Homo sapiens
gtcttgaactcctggcc

SEQ ID NO: 2228977 - DNA, 21 bp, Homo sapiens
gtcttgaactcctggcctcaa

SEQ ID NO: 2228978 - DNA, 19 bp, Homo sapiens
gtcttgcaatggcagcctt

SEQ ID NO: 2228979 - DNA, 20 bp, Homo sapiens
gtcttgcaatggcagccttg

SEQ ID NO: 2228980 - DNA, 23 bp, Homo sapiens
gtcttgcaatggcagccttggca

SEQ ID NO: 2228981 - DNA, 15 bp, Homo sapiens
gtctttgtacagaca

SEQ ID NO: 2228982 - DNA, 14 bp, Homo sapiens
gtgaaaagaaaaat

SEQ ID NO: 2228983 - DNA, 23 bp, Homo sapiens
gtgaaaagaaaaatgagcctggc

SEQ ID NO: 2228984 - DNA, 12 bp, Homo sapiens
gtgaaactggat

SEQ ID NO: 2228985 - DNA, 21 bp, Homo sapiens
gtgaaccaccacacccagccc

SEQ ID NO: 2228986 - DNA, 23 bp, Homo sapiens
gtgaaccaccacacccagcccac

SEQ ID NO: 2228987 - DNA, 17 bp, Homo sapiens
gtgaacttgggccactg

SEQ ID NO: 2228988 - DNA, 20 bp, Homo sapiens
gtgaaggtttttgtttcttt

SEQ ID NO: 2228989 - DNA, 23 bp, Homo sapiens
gtgaataatacagtatctcaggg

SEQ ID NO: 2228990 - DNA, 19 bp, Homo sapiens
gtgacagaggcagccccat

SEQ ID NO: 2228991 - DNA, 14 bp, Homo sapiens
gtgacatgtctttt

SEQ ID NO: 2228992 - DNA, 16 bp, Homo sapiens
gtgactgaatttcttt

SEQ ID NO: 2228993 - DNA, 22 bp, Homo sapiens
gtgagaccctgtctcaaaaaaa

SEQ ID NO: 2228994 - DNA, 14 bp, Homo sapiens
gtgagactctgtct

SEQ ID NO: 2228995 - DNA, 18 bp, Homo sapiens
gtgagactctgtctcaaa

SEQ ID NO: 2228996 - DNA, 20 bp, Homo sapiens
gtgagcactctggggtggga

SEQ ID NO: 2228997 - DNA, 13 bp, Homo sapiens
gtgagccactgca

SEQ ID NO: 2228998 - DNA, 15 bp, Homo sapiens
gtgagccactgcacc

SEQ ID NO: 2228999 - DNA, 19 bp, Homo sapiens
gtgaggaagccgctggggc

SEQ ID NO: 2229000 - DNA, 17 bp, Homo sapiens
gtgaggccagagacaca

SEQ ID NO: 2229001 - DNA, 22 bp, Homo sapiens
gtgaggccagagacacaagcct

SEQ ID NO: 2229002 - DNA, 16 bp, Homo sapiens
gtgaggctctgccctt

SEQ ID NO: 2229003 - DNA, 21 bp, Homo sapiens
gtgagtactacagtcctccca

SEQ ID NO: 2229004 - DNA, 20 bp, Homo sapiens
gtgagtcctggcatgggaat

SEQ ID NO: 2229005 - DNA, 17 bp, Homo sapiens
gtgatacaatgctgtgc

SEQ ID NO: 2229006 - DNA, 24 bp, Homo sapiens
gtgatccacccacctcagcctccc

SEQ ID NO: 2229007 - DNA, 15 bp, Homo sapiens
gtgatcctcccacct

SEQ ID NO: 2229008 - DNA, 23 bp, Homo sapiens
gtgatcctcccacctcagcctcc

SEQ ID NO: 2229009 - DNA, 17 bp, Homo sapiens
gtgatggggccctgcct

SEQ ID NO: 2229010 - DNA, 17 bp, Homo sapiens
gtgattctcctgcctca

SEQ ID NO: 2229011 - DNA, 12 bp, Homo sapiens
gtgattttcatt

SEQ ID NO: 2229012 - DNA, 22 bp, Homo sapiens
gtgcaatgacctttcaatagga

SEQ ID NO: 2229013 - DNA, 16 bp, Homo sapiens
gtgcacaagctccaag

SEQ ID NO: 2229014 - DNA, 23 bp, Homo sapiens
gtgcacaagctccaagctcccag

SEQ ID NO: 2229015 - DNA, 12 bp, Homo sapiens
gtgcacacacca

SEQ ID NO: 2229016 - DNA, 21 bp, Homo sapiens
gtgcacatgcacgtgtgtgca

SEQ ID NO: 2229017 - DNA, 14 bp, Homo sapiens
gtgcataccacttt

SEQ ID NO: 2229018 - DNA, 19 bp, Homo sapiens
gtgcatgtgtgttcatgca

SEQ ID NO: 2229019 - DNA, 15 bp, Homo sapiens
gtgcattatctagat

SEQ ID NO: 2229020 - DNA, 20 bp, Homo sapiens
gtgcatttgaggtctgttct

SEQ ID NO: 2229021 - DNA, 21 bp, Homo sapiens
gtgcatttgaggtctgttctt

SEQ ID NO: 2229022 - DNA, 22 bp, Homo sapiens
gtgcatttgaggtctgttcttt

SEQ ID NO: 2229023 - DNA, 14 bp, Homo sapiens
gtgccatgtgccag

SEQ ID NO: 2229024 - DNA, 12 bp, Homo sapiens
gtgcccccaccc

SEQ ID NO: 2229025 - DNA, 13 bp, Homo sapiens
gtgcccccacccc

SEQ ID NO: 2229026 - DNA, 15 bp, Homo sapiens
gtgcccccaccccca

SEQ ID NO: 2229027 - DNA, 22 bp, Homo sapiens
gtgccgagaaggaagcctccca

SEQ ID NO: 2229028 - DNA, 12 bp, Homo sapiens
gtgcctctggga

SEQ ID NO: 2229029 - DNA, 21 bp, Homo sapiens
gtgccttggggacaagagcag

SEQ ID NO: 2229030 - DNA, 21 bp, Homo sapiens
gtgcgatctgggttcactgca

SEQ ID NO: 2229031 - DNA, 17 bp, Homo sapiens
gtgctaggaacactcct

SEQ ID NO: 2229032 - DNA, 22 bp, Homo sapiens
gtgctaggaacactccttcaca

SEQ ID NO: 2229033 - DNA, 18 bp, Homo sapiens
gtgctatctcccccagcc

SEQ ID NO: 2229034 - DNA, 16 bp, Homo sapiens
gtgctctgatcatcca

SEQ ID NO: 2229035 - DNA, 16 bp, Homo sapiens
gtgctctggacaggca

SEQ ID NO: 2229036 - DNA, 19 bp, Homo sapiens
gtgctgaatggttttcaaa

SEQ ID NO: 2229037 - DNA, 18 bp, Homo sapiens
gtgctgagtctgaaggct

SEQ ID NO: 2229038 - DNA, 19 bp, Homo sapiens
gtgctgagtctgaaggctg

SEQ ID NO: 2229039 - DNA, 18 bp, Homo sapiens
gtgctgccatccaggttc

SEQ ID NO: 2229040 - DNA, 12 bp, Homo sapiens
gtgctgccctgc

SEQ ID NO: 2229041 - DNA, 20 bp, Homo sapiens
gtgctgccctgcccacctgg

SEQ ID NO: 2229042 - DNA, 22 bp, Homo sapiens
gtgctgggattacaagcgtgag

SEQ ID NO: 2229043 - DNA, 20 bp, Homo sapiens
gtgctgggattacaggtgtg

SEQ ID NO: 2229044 - DNA, 15 bp, Homo sapiens
gtgcttggaggaagg

SEQ ID NO: 2229045 - DNA, 18 bp, Homo sapiens
gtggaaaaatagcctgcc

SEQ ID NO: 2229046 - DNA, 19 bp, Homo sapiens
tcactctggcagctcagag

SEQ ID NO: 2229047 - DNA, 12 bp, Homo sapiens
tcactctgtcgc

SEQ ID NO: 2229048 - DNA, 19 bp, Homo sapiens
tcactctgtcgcccagtct

SEQ ID NO: 2229049 - DNA, 14 bp, Homo sapiens
tcactgagacagcc

SEQ ID NO: 2229050 - DNA, 16 bp, Homo sapiens
tcactgagacagcccg

SEQ ID NO: 2229051 - DNA, 13 bp, Homo sapiens
tcactgcagcctc

SEQ ID NO: 2229052 - DNA, 14 bp, Homo sapiens
tcactgcttaactt

SEQ ID NO: 2229053 - DNA, 20 bp, Homo sapiens
tcactgcttaacttcacata

SEQ ID NO: 2229054 - DNA, 17 bp, Homo sapiens
tcactgttgcccaggct

SEQ ID NO: 2229055 - DNA, 23 bp, Homo sapiens
tcactgttgcccaggctggcgtg

SEQ ID NO: 2229056 - DNA, 10 bp, Homo sapiens
tcagaaatgt

SEQ ID NO: 2229057 - DNA, 14 bp, Homo sapiens
tcagaagacactga

SEQ ID NO: 2229058 - DNA, 23 bp, Homo sapiens
tcagaattctctagtttgattaa

SEQ ID NO: 2229059 - DNA, 18 bp, Homo sapiens
tcagacagctgcctggga

SEQ ID NO: 2229060 - DNA, 19 bp, Homo sapiens
tcagacagctgcctgggat

SEQ ID NO: 2229061 - DNA, 16 bp, Homo sapiens
tcagagactcctgcag

SEQ ID NO: 2229062 - DNA, 22 bp, Homo sapiens
tcagagactcctgcaggcagcc

SEQ ID NO: 2229063 - DNA, 23 bp, Homo sapiens
tcagagactcctgcaggcagcca

SEQ ID NO: 2229064 - DNA, 23 bp, Homo sapiens
tcagagagggtgggagtgggccc

SEQ ID NO: 2229065 - DNA, 12 bp, Homo sapiens
tcagagcctgca

SEQ ID NO: 2229066 - DNA, 13 bp, Homo sapiens
tcagagcctgcag

SEQ ID NO: 2229067 - DNA, 15 bp, Homo sapiens
tcagatctctaactt

SEQ ID NO: 2229068 - DNA, 12 bp, Homo sapiens
tcagatttgaac

SEQ ID NO: 2229069 - DNA, 21 bp, Homo sapiens
tcagatttgaactcttcaatc

SEQ ID NO: 2229070 - DNA, 16 bp, Homo sapiens
tcagcacgatttctgt

SEQ ID NO: 2229071 - DNA, 18 bp, Homo sapiens
tcagcacgatttctgttt

SEQ ID NO: 2229072 - DNA, 17 bp, Homo sapiens
tcagcatcctggcaccc

SEQ ID NO: 2229073 - DNA, 12 bp, Homo sapiens
tcagcctcccaa

SEQ ID NO: 2229074 - DNA, 12 bp, Homo sapiens
tcagcctcccga

SEQ ID NO: 2229075 - DNA, 20 bp, Homo sapiens
tcagcctcccgaatagctgg

SEQ ID NO: 2229076 - DNA, 21 bp, Homo sapiens
tcagcctcccgaatagctggg

SEQ ID NO: 2229077 - DNA, 22 bp, Homo sapiens
tcagcctcccgaatagctggga

SEQ ID NO: 2229078 - DNA, 22 bp, Homo sapiens
tcagcctcccgagtagctggga

SEQ ID NO: 2229079 - DNA, 18 bp, Homo sapiens
tcagcctgctccagctgt

SEQ ID NO: 2229080 - DNA, 10 bp, Homo sapiens
tcagcctggg

SEQ ID NO: 2229081 - DNA, 15 bp, Homo sapiens
tcagcggggacagct

SEQ ID NO: 2229082 - DNA, 17 bp, Homo sapiens
tcagcggggacagctcc

SEQ ID NO: 2229083 - DNA, 12 bp, Homo sapiens
tcagctccagct

SEQ ID NO: 2229084 - DNA, 23 bp, Homo sapiens
tcagctccagctcaccagcccca

SEQ ID NO: 2229085 - DNA, 19 bp, Homo sapiens
tcaggaagctcagggcctg

SEQ ID NO: 2229086 - DNA, 20 bp, Homo sapiens
tcaggaagctcagggcctgg

SEQ ID NO: 2229087 - DNA, 20 bp, Homo sapiens
tcaggccaggccctctgccc

SEQ ID NO: 2229088 - DNA, 23 bp, Homo sapiens
tcaggccaggccctctgcccact

SEQ ID NO: 2229089 - DNA, 21 bp, Homo sapiens
tcaggcctgggggctgggcag

SEQ ID NO: 2229090 - DNA, 14 bp, Homo sapiens
tcagggcctggctc

SEQ ID NO: 2229091 - DNA, 18 bp, Homo sapiens
tcagggtccctggtggca

SEQ ID NO: 2229092 - DNA, 18 bp, Homo sapiens
tcagggttggcccctgcc

SEQ ID NO: 2229093 - DNA, 19 bp, Homo sapiens
tcagggttggcccctgccc

SEQ ID NO: 2229094 - DNA, 23 bp, Homo sapiens
tcagggttggcccctgcccggct

SEQ ID NO: 2229095 - DNA, 13 bp, Homo sapiens
tcaggtaacaggc

SEQ ID NO: 2229096 - DNA, 16 bp, Homo sapiens
tcaggtaacaggcaga

SEQ ID NO: 2229097 - DNA, 21 bp, Homo sapiens
tcaggtaacaggcagatacag

SEQ ID NO: 2229098 - DNA, 16 bp, Homo sapiens
tcaggtgagaagcaga

SEQ ID NO: 2229099 - DNA, 15 bp, Homo sapiens
tcaggtgctgccatc

SEQ ID NO: 2229100 - DNA, 15 bp, Homo sapiens
tcaggtggggcagct

SEQ ID NO: 2229101 - DNA, 20 bp, Homo sapiens
tcaggtggggcagcttgagg

SEQ ID NO: 2229102 - DNA, 20 bp, Homo sapiens
tcaggtggggtcactctggc

SEQ ID NO: 2229103 - DNA, 15 bp, Homo sapiens
tcaggtgtccctgca

SEQ ID NO: 2229104 - DNA, 18 bp, Homo sapiens
tcaggtgtccctgcactt

SEQ ID NO: 2229105 - DNA, 22 bp, Homo sapiens
tcaggtgtccctgcacttgcag

SEQ ID NO: 2229106 - DNA, 13 bp, Homo sapiens
tcagtaagccgtg

SEQ ID NO: 2229107 - DNA, 13 bp, Homo sapiens
tcagtaataactc

SEQ ID NO: 2229108 - DNA, 15 bp, Homo sapiens
tcagtccatagcaga

SEQ ID NO: 2229109 - DNA, 21 bp, Homo sapiens
tcagtctgattcccaagctct

SEQ ID NO: 2229110 - DNA, 15 bp, Homo sapiens
tcagtctggcccttc

SEQ ID NO: 2229111 - DNA, 11 bp, Homo sapiens
tcagtgcctta

SEQ ID NO: 2229112 - DNA, 15 bp, Homo sapiens
tcagtgccttatgga

SEQ ID NO: 2229113 - DNA, 14 bp, Homo sapiens
tcagtggcagctgc

SEQ ID NO: 2229114 - DNA, 15 bp, Homo sapiens
tcagtggcagctgct

SEQ ID NO: 2229115 - DNA, 13 bp, Homo sapiens
tcagtgtgactga

SEQ ID NO: 2229116 - DNA, 17 bp, Homo sapiens
tcagtgtgactgatctc

SEQ ID NO: 2229117 - DNA, 20 bp, Homo sapiens
tcatacccacccccacccaa

SEQ ID NO: 2229118 - DNA, 20 bp, Homo sapiens
tcatcaccaacgtctgtgcc

SEQ ID NO: 2229119 - DNA, 14 bp, Homo sapiens
tcatcatcctaagc

SEQ ID NO: 2229120 - DNA, 17 bp, Homo sapiens
tcatccactgtgccatg

SEQ ID NO: 2229121 - DNA, 18 bp, Homo sapiens
tcatccactgtgccatgt

SEQ ID NO: 2229122 - DNA, 22 bp, Homo sapiens
tcattgaaatctttttgctttg

SEQ ID NO: 2229123 - DNA, 13 bp, Homo sapiens
tcatttcctgtgt

SEQ ID NO: 2229124 - DNA, 21 bp, Homo sapiens
tcatttgagcagggctcagcg

SEQ ID NO: 2229125 - DNA, 17 bp, Homo sapiens
tcattttttttaagaaa

SEQ ID NO: 2229126 - DNA, 18 bp, Homo sapiens
tcattttttttaagaaaa

SEQ ID NO: 2229127 - DNA, 18 bp, Homo sapiens
tccaaaataaaacttttt

SEQ ID NO: 2229128 - DNA, 16 bp, Homo sapiens
tccaaccctcatcacc

SEQ ID NO: 2229129 - DNA, 12 bp, Homo sapiens
tccaagaagccc

SEQ ID NO: 2229130 - DNA, 20 bp, Homo sapiens
tccaagaccttctccttcac

SEQ ID NO: 2229131 - DNA, 16 bp, Homo sapiens
tccaagctcccaggca

SEQ ID NO: 2229132 - DNA, 11 bp, Homo sapiens
tccaagctggt

SEQ ID NO: 2229133 - DNA, 21 bp, Homo sapiens
tccaagctggtcccactcagt

SEQ ID NO: 2229134 - DNA, 17 bp, Homo sapiens
tccaatttacatactct

SEQ ID NO: 2229135 - DNA, 15 bp, Homo sapiens
tccaccatcaagcca

SEQ ID NO: 2229136 - DNA, 15 bp, Homo sapiens
tccacccaggagccc

SEQ ID NO: 2229137 - DNA, 17 bp, Homo sapiens
tccacccaggagccccg

SEQ ID NO: 2229138 - DNA, 15 bp, Homo sapiens
tccacctgccaggga

SEQ ID NO: 2229139 - DNA, 22 bp, Homo sapiens
tccagaagtttgagatcagcct

SEQ ID NO: 2229140 - DNA, 18 bp, Homo sapiens
tccagacccggctgcgtg

SEQ ID NO: 2229141 - DNA, 19 bp, Homo sapiens
tccagcccctggatgcagc

SEQ ID NO: 2229142 - DNA, 14 bp, Homo sapiens
tccagctcaccagc

SEQ ID NO: 2229143 - DNA, 17 bp, Homo sapiens
tccagctgttcagctgg

SEQ ID NO: 2229144 - DNA, 12 bp, Homo sapiens
tccaggagcagc

SEQ ID NO: 2229145 - DNA, 13 bp, Homo sapiens
tccaggagcagcc

SEQ ID NO: 2229146 - DNA, 17 bp, Homo sapiens
tccaggctgggagagcc

SEQ ID NO: 2229147 - DNA, 20 bp, Homo sapiens
tccaggctgggagagccttc

SEQ ID NO: 2229148 - DNA, 20 bp, Homo sapiens
tccagggggtgccctcccag

SEQ ID NO: 2229149 - DNA, 20 bp, Homo sapiens
tccaggggtgggacaccctg

SEQ ID NO: 2229150 - DNA, 23 bp, Homo sapiens
tccaggggtgggacaccctgtga

SEQ ID NO: 2229151 - DNA, 15 bp, Homo sapiens
tccaggtgcacaagc

SEQ ID NO: 2229152 - DNA, 18 bp, Homo sapiens
tccaggtgcacaagctcc

SEQ ID NO: 2229153 - DNA, 21 bp, Homo sapiens
tccaggtgcacaagctccaag

SEQ ID NO: 2229154 - DNA, 22 bp, Homo sapiens
tccaggtgcacaagctccaagc

SEQ ID NO: 2229155 - DNA, 15 bp, Homo sapiens
tccaggttcagcttg

SEQ ID NO: 2229156 - DNA, 16 bp, Homo sapiens
tccaggttcagcttgt

SEQ ID NO: 2229157 - DNA, 17 bp, Homo sapiens
tccaggtttaagctgtt

SEQ ID NO: 2229158 - DNA, 15 bp, Homo sapiens
tccagtatcttgaag

SEQ ID NO: 2229159 - DNA, 16 bp, Homo sapiens
tccagtatcttgaaga

SEQ ID NO: 2229160 - DNA, 15 bp, Homo sapiens
tccagtgaggctctg

SEQ ID NO: 2229161 - DNA, 14 bp, Homo sapiens
tccatagagagcaa

SEQ ID NO: 2229162 - DNA, 15 bp, Homo sapiens
tccatagagagcaag

SEQ ID NO: 2229163 - DNA, 17 bp, Homo sapiens
tccatagagagcaagac

SEQ ID NO: 2229164 - DNA, 20 bp, Homo sapiens
tccatagagagcaagacgct

SEQ ID NO: 2229165 - DNA, 13 bp, Homo sapiens
tccatggactttg

SEQ ID NO: 2229166 - DNA, 16 bp, Homo sapiens
tcccaaagcagtgcat

SEQ ID NO: 2229167 - DNA, 21 bp, Homo sapiens
tcccaaagcagtgcatgctgt

SEQ ID NO: 2229168 - DNA, 18 bp, Homo sapiens
tcccaactcaccccagcc

SEQ ID NO: 2229169 - DNA, 19 bp, Homo sapiens
tcccaactcaccccagccc

SEQ ID NO: 2229170 - DNA, 17 bp, Homo sapiens
tctgtgtcaggtggggc

SEQ ID NO: 2229171 - DNA, 16 bp, Homo sapiens
tctgtttagataatac

SEQ ID NO: 2229172 - DNA, 13 bp, Homo sapiens
tcttaaaaagtgg

SEQ ID NO: 2229173 - DNA, 14 bp, Homo sapiens
tcttagatgtatat

SEQ ID NO: 2229174 - DNA, 15 bp, Homo sapiens
tcttagatgtatata

SEQ ID NO: 2229175 - DNA, 20 bp, Homo sapiens
tcttaggttggcaaaaaggc

SEQ ID NO: 2229176 - DNA, 23 bp, Homo sapiens
tcttaggttggcaaaaaggcagg

SEQ ID NO: 2229177 - DNA, 14 bp, Homo sapiens
tcttagtgtgtgca

SEQ ID NO: 2229178 - DNA, 13 bp, Homo sapiens
tcttatgggctgg

SEQ ID NO: 2229179 - DNA, 20 bp, Homo sapiens
tcttcagagactcctgcagg

SEQ ID NO: 2229180 - DNA, 18 bp, Homo sapiens
tcttcagatctctaactt

SEQ ID NO: 2229181 - DNA, 15 bp, Homo sapiens
tcttcagtaagccgt

SEQ ID NO: 2229182 - DNA, 15 bp, Homo sapiens
tcttccaggctggga

SEQ ID NO: 2229183 - DNA, 20 bp, Homo sapiens
tcttccaggctgggagagcc

SEQ ID NO: 2229184 - DNA, 22 bp, Homo sapiens
tcttccaggctgggagagcctt

SEQ ID NO: 2229185 - DNA, 19 bp, Homo sapiens
tcttccctacagttgaaaa

SEQ ID NO: 2229186 - DNA, 13 bp, Homo sapiens
tcttctccaggct

SEQ ID NO: 2229187 - DNA, 21 bp, Homo sapiens
tcttctgaacttggcgctgcc

SEQ ID NO: 2229188 - DNA, 20 bp, Homo sapiens
tcttctgtgggtttctaaag

SEQ ID NO: 2229189 - DNA, 18 bp, Homo sapiens
tcttgaacttgaaaaaaa

SEQ ID NO: 2229190 - DNA, 22 bp, Homo sapiens
tcttgaagacttttctttcagc

SEQ ID NO: 2229191 - DNA, 17 bp, Homo sapiens
tcttgaattgtaaggaa

SEQ ID NO: 2229192 - DNA, 16 bp, Homo sapiens
tcttgagcctgggagg

SEQ ID NO: 2229193 - DNA, 17 bp, Homo sapiens
tcttgagccttgaactt

SEQ ID NO: 2229194 - DNA, 18 bp, Homo sapiens
tcttgagccttgaacttt

SEQ ID NO: 2229195 - DNA, 13 bp, Homo sapiens
tcttgattcataa

SEQ ID NO: 2229196 - DNA, 18 bp, Homo sapiens
tcttgcaatggcagcctt

SEQ ID NO: 2229197 - DNA, 22 bp, Homo sapiens
tcttgcaatggcagccttggca

SEQ ID NO: 2229198 - DNA, 23 bp, Homo sapiens
tcttgcaatggcagccttggcaa

SEQ ID NO: 2229199 - DNA, 14 bp, Homo sapiens
tcttgctctgctga

SEQ ID NO: 2229200 - DNA, 14 bp, Homo sapiens
tcttggtcctgctg

SEQ ID NO: 2229201 - DNA, 14 bp, Homo sapiens
tcttggtttgtaaa

SEQ ID NO: 2229202 - DNA, 22 bp, Homo sapiens
tctttaatgtcacaggcaggtc

SEQ ID NO: 2229203 - DNA, 23 bp, Homo sapiens
tctttcacccttttctgtttgct

SEQ ID NO: 2229204 - DNA, 20 bp, Homo sapiens
tctttcagccaagaattctt

SEQ ID NO: 2229205 - DNA, 12 bp, Homo sapiens
tctttccctccc

SEQ ID NO: 2229206 - DNA, 12 bp, Homo sapiens
tctttcctgagg

SEQ ID NO: 2229207 - DNA, 14 bp, Homo sapiens
tctttcctgaggct

SEQ ID NO: 2229208 - DNA, 15 bp, Homo sapiens
tctttcctgaggctg

SEQ ID NO: 2229209 - DNA, 18 bp, Homo sapiens
tctttctggctatgcatt

SEQ ID NO: 2229210 - DNA, 20 bp, Homo sapiens
tctttctggctatgcatttg

SEQ ID NO: 2229211 - DNA, 17 bp, Homo sapiens
tctttggacactcacac

SEQ ID NO: 2229212 - DNA, 21 bp, Homo sapiens
tctttggtctacactgtgctg

SEQ ID NO: 2229213 - DNA, 14 bp, Homo sapiens
tctttgtacagaca

SEQ ID NO: 2229214 - DNA, 19 bp, Homo sapiens
tcttttgccgttattaaaa

SEQ ID NO: 2229215 - DNA, 16 bp, Homo sapiens
tctttttgctttgctt

SEQ ID NO: 2229216 - DNA, 21 bp, Homo sapiens
tgaaaaaaaaaaacacaaaaa

SEQ ID NO: 2229217 - DNA, 22 bp, Homo sapiens
tgaaaaaaaaaggggggtggga

SEQ ID NO: 2229218 - DNA, 16 bp, Homo sapiens
tgaaaaaggaggaaga

SEQ ID NO: 2229219 - DNA, 22 bp, Homo sapiens
tgaaaaaggaggaagagaaaaa

SEQ ID NO: 2229220 - DNA, 14 bp, Homo sapiens
tgaaaacacatttt

SEQ ID NO: 2229221 - DNA, 21 bp, Homo sapiens
tgaaaacacatttttcttagg

SEQ ID NO: 2229222 - DNA, 22 bp, Homo sapiens
tgaaaacactgttctctgccct

SEQ ID NO: 2229223 - DNA, 12 bp, Homo sapiens
tgaaaattttga

SEQ ID NO: 2229224 - DNA, 19 bp, Homo sapiens
tgaaaattttgatgtttta

SEQ ID NO: 2229225 - DNA, 13 bp, Homo sapiens
tgaaagactgtac

SEQ ID NO: 2229226 - DNA, 18 bp, Homo sapiens
tgaaagactgtacaaagt

SEQ ID NO: 2229227 - DNA, 18 bp, Homo sapiens
tgaaagccctgagctttc

SEQ ID NO: 2229228 - DNA, 15 bp, Homo sapiens
tgaaagggcccagag

SEQ ID NO: 2229229 - DNA, 18 bp, Homo sapiens
tgaaagggcccagagagg

SEQ ID NO: 2229230 - DNA, 15 bp, Homo sapiens
tgaaatttttattaa

SEQ ID NO: 2229231 - DNA, 21 bp, Homo sapiens
tgaaccacatcttgctctgct

SEQ ID NO: 2229232 - DNA, 17 bp, Homo sapiens
tgaaccaccacacccag

SEQ ID NO: 2229233 - DNA, 22 bp, Homo sapiens
tgaaccaccacacccagcccac

SEQ ID NO: 2229234 - DNA, 12 bp, Homo sapiens
tgaactcctggc

SEQ ID NO: 2229235 - DNA, 15 bp, Homo sapiens
tgaactcttcaatct

SEQ ID NO: 2229236 - DNA, 18 bp, Homo sapiens
tgaactcttcaatctctt

SEQ ID NO: 2229237 - DNA, 15 bp, Homo sapiens
tgaactgataaagat

SEQ ID NO: 2229238 - DNA, 19 bp, Homo sapiens
tgaactgggtacttgtgga

SEQ ID NO: 2229239 - DNA, 13 bp, Homo sapiens
tgaacttgaaaaa

SEQ ID NO: 2229240 - DNA, 11 bp, Homo sapiens
tgaagacaatg

SEQ ID NO: 2229241 - DNA, 22 bp, Homo sapiens
tgaagacaatgacttactgtac

SEQ ID NO: 2229242 - DNA, 14 bp, Homo sapiens
tgaagacttttctt

SEQ ID NO: 2229243 - DNA, 17 bp, Homo sapiens
tgaagacttttctttca

SEQ ID NO: 2229244 - DNA, 22 bp, Homo sapiens
tgaaggacattgcggacagcca

SEQ ID NO: 2229245 - DNA, 18 bp, Homo sapiens
tgaaggccccgcccaggc

SEQ ID NO: 2229246 - DNA, 16 bp, Homo sapiens
tgaaggctgggttctg

SEQ ID NO: 2229247 - DNA, 16 bp, Homo sapiens
tgaagtaatatgcaca

SEQ ID NO: 2229248 - DNA, 22 bp, Homo sapiens
tgaagtctttgtacagacaaca

SEQ ID NO: 2229249 - DNA, 13 bp, Homo sapiens
tgaataatacagt

SEQ ID NO: 2229250 - DNA, 18 bp, Homo sapiens
tgaatgtcagtgtgactg

SEQ ID NO: 2229251 - DNA, 13 bp, Homo sapiens
tgaattgtaagga

SEQ ID NO: 2229252 - DNA, 16 bp, Homo sapiens
tgacacacagctctgt

SEQ ID NO: 2229253 - DNA, 13 bp, Homo sapiens
tgacagacacagg

SEQ ID NO: 2229254 - DNA, 20 bp, Homo sapiens
tgacagacacaggcccggct

SEQ ID NO: 2229255 - DNA, 22 bp, Homo sapiens
tgacagagtgagactctgtctc

SEQ ID NO: 2229256 - DNA, 19 bp, Homo sapiens
tgacaggcaatgctggctg

SEQ ID NO: 2229257 - DNA, 22 bp, Homo sapiens
tgacagggcacaccgggcactc

SEQ ID NO: 2229258 - DNA, 15 bp, Homo sapiens
tgacatgtcttttct

SEQ ID NO: 2229259 - DNA, 21 bp, Homo sapiens
tgacattgttggccaaagcca

SEQ ID NO: 2229260 - DNA, 19 bp, Homo sapiens
tgaccagcaccatctctcc

SEQ ID NO: 2229261 - DNA, 21 bp, Homo sapiens
tgaccattctccacctgccag

SEQ ID NO: 2229262 - DNA, 22 bp, Homo sapiens
tgaccattctccacctgccagg

SEQ ID NO: 2229263 - DNA, 12 bp, Homo sapiens
tgacccactgct

SEQ ID NO: 2229264 - DNA, 12 bp, Homo sapiens
tgacccatgctg

SEQ ID NO: 2229265 - DNA, 16 bp, Homo sapiens
tgacccatgctgccct

SEQ ID NO: 2229266 - DNA, 18 bp, Homo sapiens
tgacccatgctgccctgt

SEQ ID NO: 2229267 - DNA, 19 bp, Homo sapiens
tgacccatgctgccctgtg

SEQ ID NO: 2229268 - DNA, 20 bp, Homo sapiens
tgacccatgctgccctgtga

SEQ ID NO: 2229269 - DNA, 13 bp, Homo sapiens
tgaccgtgaggcc

SEQ ID NO: 2229270 - DNA, 16 bp, Homo sapiens
tgaccgtgaggccaga

SEQ ID NO: 2229271 - DNA, 21 bp, Homo sapiens
tgacctcaggtgatccaccca

SEQ ID NO: 2229272 - DNA, 22 bp, Homo sapiens
tgacctcaggtgatccacccac

SEQ ID NO: 2229273 - DNA, 13 bp, Homo sapiens
tgacctctgcagc

SEQ ID NO: 2229274 - DNA, 18 bp, Homo sapiens
tgacctgaggcccttctc

SEQ ID NO: 2229275 - DNA, 12 bp, Homo sapiens
tgacctttcaat

SEQ ID NO: 2229276 - DNA, 15 bp, Homo sapiens
tgacctttcaatagg

SEQ ID NO: 2229277 - DNA, 16 bp, Homo sapiens
tgacctttcaatagga

SEQ ID NO: 2229278 - DNA, 13 bp, Homo sapiens
tgacgccatccca

SEQ ID NO: 2229279 - DNA, 15 bp, Homo sapiens
tgacgccatcccagc

SEQ ID NO: 2229280 - DNA, 18 bp, Homo sapiens
tgacgccatcccagcccc

SEQ ID NO: 2229281 - DNA, 19 bp, Homo sapiens
tgactccagaatttcccaa

SEQ ID NO: 2229282 - DNA, 13 bp, Homo sapiens
tgactgaatttct

SEQ ID NO: 2229283 - DNA, 14 bp, Homo sapiens
tgactgaatttctt

SEQ ID NO: 2229284 - DNA, 19 bp, Homo sapiens
tgacttactgtacatgaaa

SEQ ID NO: 2229285 - DNA, 20 bp, Homo sapiens
tgagaagcagaggaaggaga

SEQ ID NO: 2229286 - DNA, 12 bp, Homo sapiens
tgagaattaccc

SEQ ID NO: 2229287 - DNA, 13 bp, Homo sapiens
tgagacagcccgg

SEQ ID NO: 2229288 - DNA, 17 bp, Homo sapiens
tgagacagcccgggctc

SEQ ID NO: 2229289 - DNA, 20 bp, Homo sapiens
tgagactcgcgacaatgcaa

SEQ ID NO: 2229290 - DNA, 23 bp, Homo sapiens
tgagactcgcgacaatgcaaacc

SEQ ID NO: 2229291 - DNA, 12 bp, Homo sapiens
tgagaggaaatc

SEQ ID NO: 2229292 - DNA, 22 bp, Homo sapiens
tgagaggcatccagtatcttga

SEQ ID NO: 2229293 - DNA, 19 bp, Homo sapiens
tgagaggggaacagactgg

SEQ ID NO: 2229294 - DNA, 14 bp, Homo sapiens
tgggtggatgcctg

SEQ ID NO: 2229295 - DNA, 23 bp, Homo sapiens
tgggtggatgcctggtggcagct

SEQ ID NO: 2229296 - DNA, 21 bp, Homo sapiens
tgggtggcaccagcagcctgg

SEQ ID NO: 2229297 - DNA, 22 bp, Homo sapiens
tgggtggcaccagcagcctgga

SEQ ID NO: 2229298 - DNA, 23 bp, Homo sapiens
tgggtgtcaagagggtctgagga

SEQ ID NO: 2229299 - DNA, 17 bp, Homo sapiens
tgggtttctaaagctgc

SEQ ID NO: 2229300 - DNA, 23 bp, Homo sapiens
tggtattggctagaggttcaaag

SEQ ID NO: 2229301 - DNA, 15 bp, Homo sapiens
tggtccatagagagc

SEQ ID NO: 2229302 - DNA, 19 bp, Homo sapiens
tggtccatagagagcaaga

SEQ ID NO: 2229303 - DNA, 13 bp, Homo sapiens
tggtcccacccca

SEQ ID NO: 2229304 - DNA, 16 bp, Homo sapiens
tggtcccaccccacac

SEQ ID NO: 2229305 - DNA, 13 bp, Homo sapiens
tggtcccactcag

SEQ ID NO: 2229306 - DNA, 19 bp, Homo sapiens
tggtcctaatcttctgaac

SEQ ID NO: 2229307 - DNA, 13 bp, Homo sapiens
tggtcctgctgca

SEQ ID NO: 2229308 - DNA, 17 bp, Homo sapiens
tggtcggaaaacatgct

SEQ ID NO: 2229309 - DNA, 15 bp, Homo sapiens
tggtctacactgtgc

SEQ ID NO: 2229310 - DNA, 18 bp, Homo sapiens
tggtctacactgtgctga

SEQ ID NO: 2229311 - DNA, 19 bp, Homo sapiens
tggtctacactgtgctgag

SEQ ID NO: 2229312 - DNA, 16 bp, Homo sapiens
tggtctcaaactcttg

SEQ ID NO: 2229313 - DNA, 17 bp, Homo sapiens
tggtctcaaactcttga

SEQ ID NO: 2229314 - DNA, 23 bp, Homo sapiens
tggtctcaaactcttgacctcag

SEQ ID NO: 2229315 - DNA, 19 bp, Homo sapiens
tggtgaacagaacaaaagg

SEQ ID NO: 2229316 - DNA, 13 bp, Homo sapiens
tggtgacctctgc

SEQ ID NO: 2229317 - DNA, 19 bp, Homo sapiens
tggtgactttcctctttgg

SEQ ID NO: 2229318 - DNA, 14 bp, Homo sapiens
tggtgcaatgacct

SEQ ID NO: 2229319 - DNA, 19 bp, Homo sapiens
tggtgcaatgacctttcaa

SEQ ID NO: 2229320 - DNA, 23 bp, Homo sapiens
tggtggcagctcacctctccctt

SEQ ID NO: 2229321 - DNA, 12 bp, Homo sapiens
tggtggcagctg

SEQ ID NO: 2229322 - DNA, 18 bp, Homo sapiens
tggtggcagtgggagctg

SEQ ID NO: 2229323 - DNA, 20 bp, Homo sapiens
tggtggcagtgggagctgcc

SEQ ID NO: 2229324 - DNA, 16 bp, Homo sapiens
tggtgggggcctcggt

SEQ ID NO: 2229325 - DNA, 17 bp, Homo sapiens
tggtggtttcagaaatg

SEQ ID NO: 2229326 - DNA, 16 bp, Homo sapiens
tggtgtcacctgaaga

SEQ ID NO: 2229327 - DNA, 20 bp, Homo sapiens
tggttcagggttggcccctg

SEQ ID NO: 2229328 - DNA, 23 bp, Homo sapiens
tggttcagggttggcccctgccc

SEQ ID NO: 2229329 - DNA, 15 bp, Homo sapiens
tggttttcaaaataa

SEQ ID NO: 2229330 - DNA, 19 bp, Homo sapiens
tgtaaaaagggaaaaagac

SEQ ID NO: 2229331 - DNA, 13 bp, Homo sapiens
tgtaaggaatgat

SEQ ID NO: 2229332 - DNA, 15 bp, Homo sapiens
tgtaaggaatgatta

SEQ ID NO: 2229333 - DNA, 18 bp, Homo sapiens
tgtaaggaatgattaatt

SEQ ID NO: 2229334 - DNA, 17 bp, Homo sapiens
tgtaattaagtactatg

SEQ ID NO: 2229335 - DNA, 16 bp, Homo sapiens
tgtaatttgtgataca

SEQ ID NO: 2229336 - DNA, 11 bp, Homo sapiens
tgtacagagcc

SEQ ID NO: 2229337 - DNA, 12 bp, Homo sapiens
tgtacagagccc

SEQ ID NO: 2229338 - DNA, 13 bp, Homo sapiens
tgtacagagccca

SEQ ID NO: 2229339 - DNA, 16 bp, Homo sapiens
tgtacagagcccacgc

SEQ ID NO: 2229340 - DNA, 19 bp, Homo sapiens
tgtacataatgcgtgcata

SEQ ID NO: 2229341 - DNA, 14 bp, Homo sapiens
tgtacatgaaaaca

SEQ ID NO: 2229342 - DNA, 19 bp, Homo sapiens
tgtacatgaaaacacattt

SEQ ID NO: 2229343 - DNA, 17 bp, Homo sapiens
tgtacgtctgacaggca

SEQ ID NO: 2229344 - DNA, 16 bp, Homo sapiens
tgtagagccagggtct

SEQ ID NO: 2229345 - DNA, 14 bp, Homo sapiens
tgtagagtgggagc

SEQ ID NO: 2229346 - DNA, 20 bp, Homo sapiens
tgtaggcataaagtcagggg

SEQ ID NO: 2229347 - DNA, 17 bp, Homo sapiens
tgtagggttataataat

SEQ ID NO: 2229348 - DNA, 16 bp, Homo sapiens
tgtatcccatgagcct

SEQ ID NO: 2229349 - DNA, 15 bp, Homo sapiens
tgtcaattacaggaa

SEQ ID NO: 2229350 - DNA, 19 bp, Homo sapiens
tgtcaattacaggaagtac

SEQ ID NO: 2229351 - DNA, 13 bp, Homo sapiens
tgtcacaggcagg

SEQ ID NO: 2229352 - DNA, 16 bp, Homo sapiens
tgtcacaggcaggtcc

SEQ ID NO: 2229353 - DNA, 15 bp, Homo sapiens
tgtcagcatagaagt

SEQ ID NO: 2229354 - DNA, 20 bp, Homo sapiens
tgtcaggtggggcagcttga

SEQ ID NO: 2229355 - DNA, 12 bp, Homo sapiens
tgtcagtgtgac

SEQ ID NO: 2229356 - DNA, 14 bp, Homo sapiens
tgtcagtgtgactg

SEQ ID NO: 2229357 - DNA, 15 bp, Homo sapiens
tgtcagtgtgactga

SEQ ID NO: 2229358 - DNA, 20 bp, Homo sapiens
tgtcagtgtgactgatctct

SEQ ID NO: 2229359 - DNA, 17 bp, Homo sapiens
tgtccaagaagcccagg

SEQ ID NO: 2229360 - DNA, 19 bp, Homo sapiens
tgtccccaccgcagacagg

SEQ ID NO: 2229361 - DNA, 23 bp, Homo sapiens
tgtccctgcacttgcagactcta

SEQ ID NO: 2229362 - DNA, 12 bp, Homo sapiens
tgtcccttttcc

SEQ ID NO: 2229363 - DNA, 17 bp, Homo sapiens
tgtcctactctgtgtca

SEQ ID NO: 2229364 - DNA, 14 bp, Homo sapiens
tgtcgcccagtctg

SEQ ID NO: 2229365 - DNA, 15 bp, Homo sapiens
tgtcgcccagtctgg

SEQ ID NO: 2229366 - DNA, 12 bp, Homo sapiens
tgtcgggcatga

SEQ ID NO: 2229367 - DNA, 15 bp, Homo sapiens
tgtcgggcatgacac

SEQ ID NO: 2229368 - DNA, 15 bp, Homo sapiens
tgtctatgggactca

SEQ ID NO: 2229369 - DNA, 21 bp, Homo sapiens
tgtctcaaaaaaagaaaaaga

SEQ ID NO: 2229370 - DNA, 19 bp, Homo sapiens
tgtctcttggtcctgctgc

SEQ ID NO: 2229371 - DNA, 22 bp, Homo sapiens
tgtctctttaatgtcacaggca

SEQ ID NO: 2229372 - DNA, 17 bp, Homo sapiens
tgtcttgcaatggcagc

SEQ ID NO: 2229373 - DNA, 18 bp, Homo sapiens
tgtcttgcaatggcagcc

SEQ ID NO: 2229374 - DNA, 14 bp, Homo sapiens
tgtctttggaccct

SEQ ID NO: 2229375 - DNA, 16 bp, Homo sapiens
tgtctttggaccctga

SEQ ID NO: 2229376 - DNA, 13 bp, Homo sapiens
tgtgaaaagaaaa

SEQ ID NO: 2229377 - DNA, 15 bp, Homo sapiens
tgtgaaaagaaaaat

SEQ ID NO: 2229378 - DNA, 17 bp, Homo sapiens
tgtgaaaagaaaaatga

SEQ ID NO: 2229379 - DNA, 15 bp, Homo sapiens
tgtgaaaggaaagag

SEQ ID NO: 2229380 - DNA, 18 bp, Homo sapiens
tgtgaaaggaaagaggct

SEQ ID NO: 2229381 - DNA, 20 bp, Homo sapiens
tgtgaaccaccacacccagc

SEQ ID NO: 2229382 - DNA, 22 bp, Homo sapiens
tgtgaaccaccacacccagccc

SEQ ID NO: 2229383 - DNA, 14 bp, Homo sapiens
tgtgaagagaacca

SEQ ID NO: 2229384 - DNA, 21 bp, Homo sapiens
tgtgacaaggattgctactgt

SEQ ID NO: 2229385 - DNA, 16 bp, Homo sapiens
tgtgactgaatttctt

SEQ ID NO: 2229386 - DNA, 17 bp, Homo sapiens
tgtgatggggccctgcc

SEQ ID NO: 2229387 - DNA, 22 bp, Homo sapiens
tgtgcacatgcacgtgtgtgca

SEQ ID NO: 2229388 - DNA, 14 bp, Homo sapiens
tgtgcacgtacaca

SEQ ID NO: 2229389 - DNA, 21 bp, Homo sapiens
tgtgcattatctagatactgt

SEQ ID NO: 2229390 - DNA, 23 bp, Homo sapiens
tgtgcatttggtggtttcagaaa

SEQ ID NO: 2229391 - DNA, 13 bp, Homo sapiens
tgtgcccccaccc

SEQ ID NO: 2229392 - DNA, 14 bp, Homo sapiens
tgtgcccccacccc

SEQ ID NO: 2229393 - DNA, 22 bp, Homo sapiens
tgtgcccccacccccaccctcg

SEQ ID NO: 2229394 - DNA, 20 bp, Homo sapiens
tgtgccctaaagtgtatttt

SEQ ID NO: 2229395 - DNA, 16 bp, Homo sapiens
tgtgcctctgggactg

SEQ ID NO: 2229396 - DNA, 19 bp, Homo sapiens
tgtgcgcctacaggagtga

SEQ ID NO: 2229397 - DNA, 20 bp, Homo sapiens
tgtgcgtgcatgtgtgttca

SEQ ID NO: 2229398 - DNA, 19 bp, Homo sapiens
tgtgctctggacaggcatg

SEQ ID NO: 2229399 - DNA, 18 bp, Homo sapiens
tgtgctgagtctgaaggc

SEQ ID NO: 2229400 - DNA, 13 bp, Homo sapiens
tgtgctgccctgc

SEQ ID NO: 2229401 - DNA, 20 bp, Homo sapiens
tgtgctgccctgcccacctg

SEQ ID NO: 2229402 - DNA, 18 bp, Homo sapiens
tgtggacacagctcttct

SEQ ID NO: 2229403 - DNA, 12 bp, Homo sapiens
tgtggagaagcg

SEQ ID NO: 2229404 - DNA, 14 bp, Homo sapiens
tgtggatgataaaa

SEQ ID NO: 2229405 - DNA, 20 bp, Homo sapiens
tgtggatttaacagaaatgt

SEQ ID NO: 2229406 - DNA, 12 bp, Homo sapiens
tgtgggaagggg

SEQ ID NO: 2229407 - DNA, 15 bp, Homo sapiens
tgtggtcccacccca

SEQ ID NO: 2229408 - DNA, 16 bp, Homo sapiens
tgtggtcccaccccac

SEQ ID NO: 2229409 - DNA, 16 bp, Homo sapiens
tgtggtgtttcctggc

SEQ ID NO: 2229410 - DNA, 12 bp, Homo sapiens
tgtggtttcatt

SEQ ID NO: 2229411 - DNA, 17 bp, Homo sapiens
tgtgtcaggtggggcag

SEQ ID NO: 2229412 - DNA, 13 bp, Homo sapiens
tgtgtctcttggt

SEQ ID NO: 2229413 - DNA, 16 bp, Homo sapiens
tgtgtctcttggtcct

SEQ ID NO: 2229414 - DNA, 21 bp, Homo sapiens
tgtgtctcttggtcctgctgc

SEQ ID NO: 2229415 - DNA, 22 bp, Homo sapiens
tgtgtctcttggtcctgctgca

SEQ ID NO: 2229416 - DNA, 21 bp, Homo sapiens
tgtgtcttgcaatggcagcct

SEQ ID NO: 2229417 - DNA, 19 bp, Homo sapiens
tgtgtgtttattgtcaaag

SEQ ID NO: 2229418 - DNA, 13 bp, Homo sapiens
aaaaaaaaacaca

SEQ ID NO: 2229419 - DNA, 9 bp, Homo sapiens
aaaaaaaga

SEQ ID NO: 2229420 - DNA, 9 bp, Homo sapiens
aaaaaagac

SEQ ID NO: 2229421 - DNA, 13 bp, Homo sapiens
aaaaacacaaaaa

SEQ ID NO: 2229422 - DNA, 17 bp, Homo sapiens
aaaaacacaaaaaaaga

SEQ ID NO: 2229423 - DNA, 16 bp, Homo sapiens
aaaaactctatttttg

SEQ ID NO: 2229424 - DNA, 14 bp, Homo sapiens
aaaaatctcaaatt

SEQ ID NO: 2229425 - DNA, 17 bp, Homo sapiens
aaaaatctcaaatttct

SEQ ID NO: 2229426 - DNA, 12 bp, Homo sapiens
aaaacacatttt

SEQ ID NO: 2229427 - DNA, 13 bp, Homo sapiens
aaaacatgctaca

SEQ ID NO: 2229428 - DNA, 15 bp, Homo sapiens
aaaaccaatgttctc

SEQ ID NO: 2229429 - DNA, 12 bp, Homo sapiens
aaaacccaagtg

SEQ ID NO: 2229430 - DNA, 19 bp, Homo sapiens
aaaactctatttttgtaaa

SEQ ID NO: 2229431 - DNA, 18 bp, Homo sapiens
aaaactgatttttttttc

SEQ ID NO: 2229432 - DNA, 19 bp, Homo sapiens
aaaaggggggtgggagggg

SEQ ID NO: 2229433 - DNA, 12 bp, Homo sapiens
aaaataaattat

SEQ ID NO: 2229434 - DNA, 16 bp, Homo sapiens
aaaatattttcctgcc

SEQ ID NO: 2229435 - DNA, 13 bp, Homo sapiens
aaaatcagcctgc

SEQ ID NO: 2229436 - DNA, 22 bp, Homo sapiens
aaaatcccttacctcggtgcct

SEQ ID NO: 2229437 - DNA, 19 bp, Homo sapiens
aaaatctcaaatttctaaa

SEQ ID NO: 2229438 - DNA, 14 bp, Homo sapiens
aaaatgagcctggc

SEQ ID NO: 2229439 - DNA, 21 bp, Homo sapiens
aaaatgagcctggcaagaatg

SEQ ID NO: 2229440 - DNA, 20 bp, Homo sapiens
aaaatggaagacagctctta

SEQ ID NO: 2229441 - DNA, 21 bp, Homo sapiens
aaaatggacgtgttatgactc

SEQ ID NO: 2229442 - DNA, 21 bp, Homo sapiens
aaaatgtagggttataataat

SEQ ID NO: 2229443 - DNA, 15 bp, Homo sapiens
aaaattagccaagtg

SEQ ID NO: 2229444 - DNA, 15 bp, Homo sapiens
aaacaaaatgaaaaa

SEQ ID NO: 2229445 - DNA, 20 bp, Homo sapiens
aaacaagaccacgtttctaa

SEQ ID NO: 2229446 - DNA, 12 bp, Homo sapiens
aaacacaaaaaa

SEQ ID NO: 2229447 - DNA, 16 bp, Homo sapiens
aaacactgttctctgc

SEQ ID NO: 2229448 - DNA, 19 bp, Homo sapiens
aaacactgttctctgccct

SEQ ID NO: 2229449 - DNA, 18 bp, Homo sapiens
aaaccatcattgaaatct

SEQ ID NO: 2229450 - DNA, 18 bp, Homo sapiens
aaacccagctctggtcca

SEQ ID NO: 2229451 - DNA, 15 bp, Homo sapiens
aaaccgccaaggctg

SEQ ID NO: 2229452 - DNA, 22 bp, Homo sapiens
aaacctgtgtctctgagagtag

SEQ ID NO: 2229453 - DNA, 16 bp, Homo sapiens
aaactggattaaactt

SEQ ID NO: 2229454 - DNA, 22 bp, Homo sapiens
aaacttgatgtgttatctctta

SEQ ID NO: 2229455 - DNA, 17 bp, Homo sapiens
aaactttacctttttta

SEQ ID NO: 2229456 - DNA, 14 bp, Homo sapiens
aaagaatgcagaga

SEQ ID NO: 2229457 - DNA, 16 bp, Homo sapiens
aaagaatgcagagatg

SEQ ID NO: 2229458 - DNA, 22 bp, Homo sapiens
aaagacctcgtggagaattttt

SEQ ID NO: 2229459 - DNA, 13 bp, Homo sapiens
aaagactgtacaa

SEQ ID NO: 2229460 - DNA, 15 bp, Homo sapiens
aaagactgtacaaag

SEQ ID NO: 2229461 - DNA, 12 bp, Homo sapiens
aaagagagagag

SEQ ID NO: 2229462 - DNA, 17 bp, Homo sapiens
aaagatgcttctcactg

SEQ ID NO: 2229463 - DNA, 15 bp, Homo sapiens
aaagcagcgtttcta

SEQ ID NO: 2229464 - DNA, 13 bp, Homo sapiens
aaagcagtgcatg

SEQ ID NO: 2229465 - DNA, 16 bp, Homo sapiens
aaagcagtgcatgctg

SEQ ID NO: 2229466 - DNA, 21 bp, Homo sapiens
aaagcagtgcatgctgtccct

SEQ ID NO: 2229467 - DNA, 22 bp, Homo sapiens
aaagcagtgcatgctgtccctt

SEQ ID NO: 2229468 - DNA, 16 bp, Homo sapiens
aaagcctcctccagcc

SEQ ID NO: 2229469 - DNA, 20 bp, Homo sapiens
aaagcgaaccgtgaggaggg

SEQ ID NO: 2229470 - DNA, 14 bp, Homo sapiens
aaagctaggcctgg

SEQ ID NO: 2229471 - DNA, 13 bp, Homo sapiens
aaagctgctgaca

SEQ ID NO: 2229472 - DNA, 14 bp, Homo sapiens
aaaggctacctttg

SEQ ID NO: 2229473 - DNA, 21 bp, Homo sapiens
aaaggctccaggagcagccac

SEQ ID NO: 2229474 - DNA, 22 bp, Homo sapiens
aaaggctccaggagcagccaca

SEQ ID NO: 2229475 - DNA, 13 bp, Homo sapiens
aaagggaaaaaga

SEQ ID NO: 2229476 - DNA, 20 bp, Homo sapiens
aaagggcccagagagggtgg

SEQ ID NO: 2229477 - DNA, 13 bp, Homo sapiens
aaaggggggtggg

SEQ ID NO: 2229478 - DNA, 20 bp, Homo sapiens
aaaggggggtgggaggggaa

SEQ ID NO: 2229479 - DNA, 19 bp, Homo sapiens
aaagtacactgtttcaaac

SEQ ID NO: 2229480 - DNA, 20 bp, Homo sapiens
aaagtacactgtttcaaact

SEQ ID NO: 2229481 - DNA, 20 bp, Homo sapiens
aaagtacttctccaccctgc

SEQ ID NO: 2229482 - DNA, 23 bp, Homo sapiens
aaagtacttctccaccctgctct

SEQ ID NO: 2229483 - DNA, 20 bp, Homo sapiens
aaagtagaagtcttagatgt

SEQ ID NO: 2229484 - DNA, 21 bp, Homo sapiens
aaagtatccctactgtaattt

SEQ ID NO: 2229485 - DNA, 16 bp, Homo sapiens
aaataaaactttttaa

SEQ ID NO: 2229486 - DNA, 14 bp, Homo sapiens
aaataatgtgaaac

SEQ ID NO: 2229487 - DNA, 15 bp, Homo sapiens
aaatataggaactta

SEQ ID NO: 2229488 - DNA, 12 bp, Homo sapiens
aaatatctgaaa

SEQ ID NO: 2229489 - DNA, 23 bp, Homo sapiens
aaatatctgaaaatgtatgtgta

SEQ ID NO: 2229490 - DNA, 19 bp, Homo sapiens
aaatattaagaaagactat

SEQ ID NO: 2229491 - DNA, 19 bp, Homo sapiens
aaatcagccgtgtaaccat

SEQ ID NO: 2229492 - DNA, 21 bp, Homo sapiens
aaatcagcctgctccagctgt

SEQ ID NO: 2229493 - DNA, 23 bp, Homo sapiens
aaatcagcctgctccagctgttc

SEQ ID NO: 2229494 - DNA, 15 bp, Homo sapiens
aaatcccatttaaaa

SEQ ID NO: 2229495 - DNA, 16 bp, Homo sapiens
aaatccccaaaaaagc

SEQ ID NO: 2229496 - DNA, 15 bp, Homo sapiens
aaatctcaaatttct

SEQ ID NO: 2229497 - DNA, 16 bp, Homo sapiens
aaatctcaaatttcta

SEQ ID NO: 2229498 - DNA, 19 bp, Homo sapiens
aaatctcaaatttctaaat

SEQ ID NO: 2229499 - DNA, 15 bp, Homo sapiens
aaatgaaaaaaaaag

SEQ ID NO: 2229500 - DNA, 17 bp, Homo sapiens
aaatgaaaatcgtgaca

SEQ ID NO: 2229501 - DNA, 23 bp, Homo sapiens
aaatgaggtactctcctggaaat

SEQ ID NO: 2229502 - DNA, 19 bp, Homo sapiens
aaatgaggtcagagcctgc

SEQ ID NO: 2229503 - DNA, 14 bp, Homo sapiens
aaatgcacctggaa

SEQ ID NO: 2229504 - DNA, 13 bp, Homo sapiens
aaatgcccagctt

SEQ ID NO: 2229505 - DNA, 23 bp, Homo sapiens
aaatgccttaccctcatgttctt

SEQ ID NO: 2229506 - DNA, 15 bp, Homo sapiens
accacttcagctgac

SEQ ID NO: 2229507 - DNA, 21 bp, Homo sapiens
accacttttgttcttggtttg

SEQ ID NO: 2229508 - DNA, 17 bp, Homo sapiens
accagagcccaccttgg

SEQ ID NO: 2229509 - DNA, 12 bp, Homo sapiens
accagagctgcc

SEQ ID NO: 2229510 - DNA, 12 bp, Homo sapiens
accagcagagca

SEQ ID NO: 2229511 - DNA, 13 bp, Homo sapiens
accagcagcctgg

SEQ ID NO: 2229512 - DNA, 14 bp, Homo sapiens
accagcagcctgga

SEQ ID NO: 2229513 - DNA, 17 bp, Homo sapiens
accagccccagtgccca

SEQ ID NO: 2229514 - DNA, 19 bp, Homo sapiens
accagccccagtgcccaca

SEQ ID NO: 2229515 - DNA, 18 bp, Homo sapiens
accagtgttgtggattta

SEQ ID NO: 2229516 - DNA, 20 bp, Homo sapiens
accatattaccacagacata

SEQ ID NO: 2229517 - DNA, 15 bp, Homo sapiens
accatcaagccacca

SEQ ID NO: 2229518 - DNA, 16 bp, Homo sapiens
accatcatgtctggct

SEQ ID NO: 2229519 - DNA, 15 bp, Homo sapiens
accatcattgaaatc

SEQ ID NO: 2229520 - DNA, 16 bp, Homo sapiens
accatccctgaaggcc

SEQ ID NO: 2229521 - DNA, 20 bp, Homo sapiens
accattctccacctgccagg

SEQ ID NO: 2229522 - DNA, 22 bp, Homo sapiens
acccaagggcctggcctgagct

SEQ ID NO: 2229523 - DNA, 13 bp, Homo sapiens
acccacctcagcc

SEQ ID NO: 2229524 - DNA, 11 bp, Homo sapiens
acccactgctt

SEQ ID NO: 2229525 - DNA, 16 bp, Homo sapiens
acccagcccacttctg

SEQ ID NO: 2229526 - DNA, 16 bp, Homo sapiens
acccagcgagccctgg

SEQ ID NO: 2229527 - DNA, 23 bp, Homo sapiens
acccagcgagccctggtggcagt

SEQ ID NO: 2229528 - DNA, 19 bp, Homo sapiens
acccaggagccccgaggcc

SEQ ID NO: 2229529 - DNA, 11 bp, Homo sapiens
acccaggtgct

SEQ ID NO: 2229530 - DNA, 14 bp, Homo sapiens
acccatgctgccct

SEQ ID NO: 2229531 - DNA, 16 bp, Homo sapiens
acccatgctgccctgt

SEQ ID NO: 2229532 - DNA, 12 bp, Homo sapiens
acccccaccctc

SEQ ID NO: 2229533 - DNA, 16 bp, Homo sapiens
acccccggcccagtgc

SEQ ID NO: 2229534 - DNA, 21 bp, Homo sapiens
accccctccccgggcagcaga

SEQ ID NO: 2229535 - DNA, 23 bp, Homo sapiens
accccctccccgggcagcagaga

SEQ ID NO: 2229536 - DNA, 21 bp, Homo sapiens
acccccttgcccaggcctccc

SEQ ID NO: 2229537 - DNA, 17 bp, Homo sapiens
accccgcctgccctccc

SEQ ID NO: 2229538 - DNA, 19 bp, Homo sapiens
acccctccatgtgggctag

SEQ ID NO: 2229539 - DNA, 16 bp, Homo sapiens
acccggcccctgctgg

SEQ ID NO: 2229540 - DNA, 22 bp, Homo sapiens
acccggcccctgctggttcagg

SEQ ID NO: 2229541 - DNA, 19 bp, Homo sapiens
acccgggaagggggctggg

SEQ ID NO: 2229542 - DNA, 22 bp, Homo sapiens
acccgggaagggggctgggaca

SEQ ID NO: 2229543 - DNA, 13 bp, Homo sapiens
accctcaggcagg

SEQ ID NO: 2229544 - DNA, 14 bp, Homo sapiens
accctcaggcaggt

SEQ ID NO: 2229545 - DNA, 15 bp, Homo sapiens
accctcaggcaggtg

SEQ ID NO: 2229546 - DNA, 16 bp, Homo sapiens
accctcaggcaggtgg

SEQ ID NO: 2229547 - DNA, 13 bp, Homo sapiens
accctcatcacca

SEQ ID NO: 2229548 - DNA, 23 bp, Homo sapiens
accctcatcaccaacgtctgtgc

SEQ ID NO: 2229549 - DNA, 14 bp, Homo sapiens
accctcatgttctt

SEQ ID NO: 2229550 - DNA, 21 bp, Homo sapiens
accctcctttcaccacatgtg

SEQ ID NO: 2229551 - DNA, 16 bp, Homo sapiens
accctcgaccaccccc

SEQ ID NO: 2229552 - DNA, 14 bp, Homo sapiens
accctcttagaaaa

SEQ ID NO: 2229553 - DNA, 11 bp, Homo sapiens
accctgaggcc

SEQ ID NO: 2229554 - DNA, 13 bp, Homo sapiens
accctgaggccca

SEQ ID NO: 2229555 - DNA, 14 bp, Homo sapiens
accctgaggcccag

SEQ ID NO: 2229556 - DNA, 16 bp, Homo sapiens
accctgaggcccagag

SEQ ID NO: 2229557 - DNA, 21 bp, Homo sapiens
accctgaggcccagagggcct

SEQ ID NO: 2229558 - DNA, 15 bp, Homo sapiens
accctgccctgtggg

SEQ ID NO: 2229559 - DNA, 22 bp, Homo sapiens
accctgccctgtgggcccccaa

SEQ ID NO: 2229560 - DNA, 23 bp, Homo sapiens
accctggcactataatgtaagct

SEQ ID NO: 2229561 - DNA, 10 bp, Homo sapiens
acccttttct

SEQ ID NO: 2229562 - DNA, 19 bp, Homo sapiens
accgaaaacgtggctgctt

SEQ ID NO: 2229563 - DNA, 22 bp, Homo sapiens
accgaaaacgtggctgcttcaa

SEQ ID NO: 2229564 - DNA, 16 bp, Homo sapiens
accgcagacaggacca

SEQ ID NO: 2229565 - DNA, 17 bp, Homo sapiens
accgcagacaggaccag

SEQ ID NO: 2229566 - DNA, 15 bp, Homo sapiens
accggctggcctggc

SEQ ID NO: 2229567 - DNA, 18 bp, Homo sapiens
accggctggcctggcccc

SEQ ID NO: 2229568 - DNA, 15 bp, Homo sapiens
accgggccacagaga

SEQ ID NO: 2229569 - DNA, 14 bp, Homo sapiens
accgtgaggccaga

SEQ ID NO: 2229570 - DNA, 23 bp, Homo sapiens
accgtgaggccagagacacaagc

SEQ ID NO: 2229571 - DNA, 11 bp, Homo sapiens
acctcagcctc

SEQ ID NO: 2229572 - DNA, 18 bp, Homo sapiens
acctcaggtgagaagcag

SEQ ID NO: 2229573 - DNA, 20 bp, Homo sapiens
acctcaggtgatccacccac

SEQ ID NO: 2229574 - DNA, 21 bp, Homo sapiens
acctcaggtgatccacccacc

SEQ ID NO: 2229575 - DNA, 13 bp, Homo sapiens
acctcctgcctcg

SEQ ID NO: 2229576 - DNA, 19 bp, Homo sapiens
acctcgtggagaattttta

SEQ ID NO: 2229577 - DNA, 19 bp, Homo sapiens
acctctctcactccttgaa

SEQ ID NO: 2229578 - DNA, 12 bp, Homo sapiens
acctctgcacaa

SEQ ID NO: 2229579 - DNA, 16 bp, Homo sapiens
acctctgcacaagctg

SEQ ID NO: 2229580 - DNA, 20 bp, Homo sapiens
acctctgcagcaataaagca

SEQ ID NO: 2229581 - DNA, 21 bp, Homo sapiens
acctctgcagcaataaagcag

SEQ ID NO: 2229582 - DNA, 12 bp, Homo sapiens
acctctgcctga

SEQ ID NO: 2229583 - DNA, 15 bp, Homo sapiens
acctgaggcccttct

SEQ ID NO: 2229584 - DNA, 12 bp, Homo sapiens
acctgccaggaa

SEQ ID NO: 2229585 - DNA, 16 bp, Homo sapiens
acctgccaggaagcca

SEQ ID NO: 2229586 - DNA, 17 bp, Homo sapiens
acctgccaggaagccag

SEQ ID NO: 2229587 - DNA, 22 bp, Homo sapiens
acctgccaggaagccagcaggc

SEQ ID NO: 2229588 - DNA, 12 bp, Homo sapiens
acctgccaggga

SEQ ID NO: 2229589 - DNA, 21 bp, Homo sapiens
acctgcgtctcatactcacct

SEQ ID NO: 2229590 - DNA, 20 bp, Homo sapiens
acctggaatatataaccagt

SEQ ID NO: 2229591 - DNA, 12 bp, Homo sapiens
acctggcctctg

SEQ ID NO: 2229592 - DNA, 13 bp, Homo sapiens
acctggcctctgc

SEQ ID NO: 2229593 - DNA, 16 bp, Homo sapiens
acctggcctctgcact

SEQ ID NO: 2229594 - DNA, 17 bp, Homo sapiens
acctggcctctgcactc

SEQ ID NO: 2229595 - DNA, 11 bp, Homo sapiens
acctgtgtctc

SEQ ID NO: 2229596 - DNA, 19 bp, Homo sapiens
acctgtttctgcagccact

SEQ ID NO: 2229597 - DNA, 18 bp, Homo sapiens
accttagacagtccctgc

SEQ ID NO: 2229598 - DNA, 20 bp, Homo sapiens
accttgaactgggtacttgt

SEQ ID NO: 2229599 - DNA, 14 bp, Homo sapiens
accttggctcaagt

SEQ ID NO: 2229600 - DNA, 16 bp, Homo sapiens
acctttcaataggaaa

SEQ ID NO: 2229601 - DNA, 17 bp, Homo sapiens
acctttcaataggaaaa

SEQ ID NO: 2229602 - DNA, 13 bp, Homo sapiens
acctttcccatct

SEQ ID NO: 2229603 - DNA, 19 bp, Homo sapiens
acctttgtattctctcctg

SEQ ID NO: 2229604 - DNA, 14 bp, Homo sapiens
accttttgagtgcc

SEQ ID NO: 2229605 - DNA, 19 bp, Homo sapiens
accttttttatacataaac

SEQ ID NO: 2229606 - DNA, 12 bp, Homo sapiens
acgatttctgtt

SEQ ID NO: 2229607 - DNA, 13 bp, Homo sapiens
acgatttctgttt

SEQ ID NO: 2229608 - DNA, 14 bp, Homo sapiens
acgatttctgttta

SEQ ID NO: 2229609 - DNA, 19 bp, Homo sapiens
acgatttctgtttagataa

SEQ ID NO: 2229610 - DNA, 23 bp, Homo sapiens
acgccagattctttcctgaggct

SEQ ID NO: 2229611 - DNA, 16 bp, Homo sapiens
acgccatcccagcccc

SEQ ID NO: 2229612 - DNA, 17 bp, Homo sapiens
acgccatcccagcccca

SEQ ID NO: 2229613 - DNA, 17 bp, Homo sapiens
acgctacccgggaaggg

SEQ ID NO: 2229614 - DNA, 16 bp, Homo sapiens
acgctggagtgcagtg

SEQ ID NO: 2229615 - DNA, 11 bp, Homo sapiens
acgctgtgctg

SEQ ID NO: 2229616 - DNA, 14 bp, Homo sapiens
acgctgtgctgccc

SEQ ID NO: 2229617 - DNA, 17 bp, Homo sapiens
acggacactcaaaagct

SEQ ID NO: 2229618 - DNA, 21 bp, Homo sapiens
acggagtcccaccttggctgc

SEQ ID NO: 2229619 - DNA, 23 bp, Homo sapiens
acggagtcccaccttggctgcag

SEQ ID NO: 2229620 - DNA, 14 bp, Homo sapiens
acggctcactgcag

SEQ ID NO: 2229621 - DNA, 18 bp, Homo sapiens
acggctcactgcagcctc

SEQ ID NO: 2229622 - DNA, 13 bp, Homo sapiens
acgtacacatttt

SEQ ID NO: 2229623 - DNA, 14 bp, Homo sapiens
acgtacacatttta

SEQ ID NO: 2229624 - DNA, 23 bp, Homo sapiens
acgtccctgcggaagccacaggg

SEQ ID NO: 2229625 - DNA, 13 bp, Homo sapiens
acgtctgacaggc

SEQ ID NO: 2229626 - DNA, 13 bp, Homo sapiens
acgtctgtgccat

SEQ ID NO: 2229627 - DNA, 11 bp, Homo sapiens
acgtggctgct

SEQ ID NO: 2229628 - DNA, 13 bp, Homo sapiens
acgtggctgcttc

SEQ ID NO: 2229629 - DNA, 14 bp, Homo sapiens
acgtggctgcttca

SEQ ID NO: 2229630 - DNA, 15 bp, Homo sapiens
acgtggctgcttcaa

SEQ ID NO: 2229631 - DNA, 21 bp, Homo sapiens
acgtggctgcttcaaggatcc

SEQ ID NO: 2229632 - DNA, 13 bp, Homo sapiens
agctgctgacagt

SEQ ID NO: 2229633 - DNA, 21 bp, Homo sapiens
agctgcttgggcttcatcctc

SEQ ID NO: 2229634 - DNA, 21 bp, Homo sapiens
agctgcttttgtctatgggac

SEQ ID NO: 2229635 - DNA, 23 bp, Homo sapiens
agctgggactacaggcacccacc

SEQ ID NO: 2229636 - DNA, 16 bp, Homo sapiens
agctgggactacaggt

SEQ ID NO: 2229637 - DNA, 23 bp, Homo sapiens
agctgggatgattggagggggga

SEQ ID NO: 2229638 - DNA, 22 bp, Homo sapiens
agctgggtgtcaagagggtctg

SEQ ID NO: 2229639 - DNA, 17 bp, Homo sapiens
agctggtcccactcagt

SEQ ID NO: 2229640 - DNA, 18 bp, Homo sapiens
agctggtcccactcagtc

SEQ ID NO: 2229641 - DNA, 16 bp, Homo sapiens
agctggttgaggtttc

SEQ ID NO: 2229642 - DNA, 14 bp, Homo sapiens
agctgttcagctgg

SEQ ID NO: 2229643 - DNA, 20 bp, Homo sapiens
agcttaaaggggctagagtg

SEQ ID NO: 2229644 - DNA, 14 bp, Homo sapiens
agcttatctcaggg

SEQ ID NO: 2229645 - DNA, 22 bp, Homo sapiens
agcttgaccgtgaggccagaga

SEQ ID NO: 2229646 - DNA, 14 bp, Homo sapiens
agcttgagggttgg

SEQ ID NO: 2229647 - DNA, 18 bp, Homo sapiens
agcttgagggttgggctg

SEQ ID NO: 2229648 - DNA, 22 bp, Homo sapiens
agcttgagggttgggctggtgt

SEQ ID NO: 2229649 - DNA, 18 bp, Homo sapiens
agcttgtaaatagctcag

SEQ ID NO: 2229650 - DNA, 20 bp, Homo sapiens
agcttgtaaatagctcaggt

SEQ ID NO: 2229651 - DNA, 21 bp, Homo sapiens
agcttgtaaatagctcaggtg

SEQ ID NO: 2229652 - DNA, 12 bp, Homo sapiens
agctttgaaaat

SEQ ID NO: 2229653 - DNA, 15 bp, Homo sapiens
aggaaaaactgattt

SEQ ID NO: 2229654 - DNA, 21 bp, Homo sapiens
aggaaacccagctctggtcca

SEQ ID NO: 2229655 - DNA, 17 bp, Homo sapiens
aggaacaggtttaaaaa

SEQ ID NO: 2229656 - DNA, 19 bp, Homo sapiens
aggaacaggtttaaaaatc

SEQ ID NO: 2229657 - DNA, 23 bp, Homo sapiens
aggaacttaaataatgtgaaact

SEQ ID NO: 2229658 - DNA, 13 bp, Homo sapiens
aggaagacttcat

SEQ ID NO: 2229659 - DNA, 19 bp, Homo sapiens
aggaagacttcatccctct

SEQ ID NO: 2229660 - DNA, 11 bp, Homo sapiens
aggaagcacat

SEQ ID NO: 2229661 - DNA, 24 bp, Homo sapiens
aggaagcacatgcctctctcaggc

SEQ ID NO: 2229662 - DNA, 15 bp, Homo sapiens
aggaagccagcaggc

SEQ ID NO: 2229663 - DNA, 21 bp, Homo sapiens
aggaagccagcaggctctcag

SEQ ID NO: 2229664 - DNA, 17 bp, Homo sapiens
aggaagctcagggcctg

SEQ ID NO: 2229665 - DNA, 18 bp, Homo sapiens
aggaaggaaacccagctc

SEQ ID NO: 2229666 - DNA, 19 bp, Homo sapiens
aggaaggaaacccagctct

SEQ ID NO: 2229667 - DNA, 15 bp, Homo sapiens
aggaaggagaggaga

SEQ ID NO: 2229668 - DNA, 14 bp, Homo sapiens
aggaaggtagaaat

SEQ ID NO: 2229669 - DNA, 19 bp, Homo sapiens
aggaagtactggagaaaat

SEQ ID NO: 2229670 - DNA, 22 bp, Homo sapiens
aggaatacctgtccccctgaca

SEQ ID NO: 2229671 - DNA, 23 bp, Homo sapiens
aggaatccagacccggctgcgtg

SEQ ID NO: 2229672 - DNA, 19 bp, Homo sapiens
aggacactaaccacgctgg

SEQ ID NO: 2229673 - DNA, 17 bp, Homo sapiens
aggacattgcggacagc

SEQ ID NO: 2229674 - DNA, 19 bp, Homo sapiens
aggacattgcggacagcca

SEQ ID NO: 2229675 - DNA, 15 bp, Homo sapiens
aggagaggagagggg

SEQ ID NO: 2229676 - DNA, 18 bp, Homo sapiens
aggagaggggcacagggt

SEQ ID NO: 2229677 - DNA, 15 bp, Homo sapiens
aggaggccagccttg

SEQ ID NO: 2229678 - DNA, 21 bp, Homo sapiens
aggatacaaaagcatgtgaga

SEQ ID NO: 2229679 - DNA, 22 bp, Homo sapiens
aggatctcttgagcctgggagg

SEQ ID NO: 2229680 - DNA, 18 bp, Homo sapiens
aggatgcttgtacataat

SEQ ID NO: 2229681 - DNA, 23 bp, Homo sapiens
aggatgcttgtacataatgcgtg

SEQ ID NO: 2229682 - DNA, 15 bp, Homo sapiens
aggatgttctgggac

SEQ ID NO: 2229683 - DNA, 17 bp, Homo sapiens
aggcaactcatcttagg

SEQ ID NO: 2229684 - DNA, 19 bp, Homo sapiens
aggcaactgcattggcttt

SEQ ID NO: 2229685 - DNA, 14 bp, Homo sapiens
aggcaagcacctcc

SEQ ID NO: 2229686 - DNA, 17 bp, Homo sapiens
aggcaaggctgtcaatt

SEQ ID NO: 2229687 - DNA, 22 bp, Homo sapiens
aggcacccaccatcatgtctgg

SEQ ID NO: 2229688 - DNA, 18 bp, Homo sapiens
aggcagccaggccacaag

SEQ ID NO: 2229689 - DNA, 16 bp, Homo sapiens
aggcagccccattctg

SEQ ID NO: 2229690 - DNA, 19 bp, Homo sapiens
aggcagccccattctgcct

SEQ ID NO: 2229691 - DNA, 20 bp, Homo sapiens
aggcagccccattctgcctg

SEQ ID NO: 2229692 - DNA, 18 bp, Homo sapiens
aggcagggtctcactctg

SEQ ID NO: 2229693 - DNA, 19 bp, Homo sapiens
aggcagggtctcactctgt

SEQ ID NO: 2229694 - DNA, 21 bp, Homo sapiens
aggcaggtcttgaactcctgg

SEQ ID NO: 2229695 - DNA, 13 bp, Homo sapiens
aggcagtggggct

SEQ ID NO: 2229696 - DNA, 20 bp, Homo sapiens
aggcagtggggctggaagca

SEQ ID NO: 2229697 - DNA, 15 bp, Homo sapiens
aggcataaagtcagg

SEQ ID NO: 2229698 - DNA, 15 bp, Homo sapiens
aggcatggtggccca

SEQ ID NO: 2229699 - DNA, 20 bp, Homo sapiens
aggcatgtgatgagaggaaa

SEQ ID NO: 2229700 - DNA, 22 bp, Homo sapiens
aggcatgttctctgaggacact

SEQ ID NO: 2229701 - DNA, 18 bp, Homo sapiens
aggcattccccaggaggc

SEQ ID NO: 2229702 - DNA, 19 bp, Homo sapiens
aggcattccccaggaggcc

SEQ ID NO: 2229703 - DNA, 16 bp, Homo sapiens
aggccaaactcacctg

SEQ ID NO: 2229704 - DNA, 14 bp, Homo sapiens
aggccaaaggaagc

SEQ ID NO: 2229705 - DNA, 16 bp, Homo sapiens
aggccaaaggaagcac

SEQ ID NO: 2229706 - DNA, 19 bp, Homo sapiens
aggccaaaggaagcacatg

SEQ ID NO: 2229707 - DNA, 18 bp, Homo sapiens
aggccaaggtgggaggat

SEQ ID NO: 2229708 - DNA, 19 bp, Homo sapiens
aggccacaagacccttgtg

SEQ ID NO: 2229709 - DNA, 13 bp, Homo sapiens
aggccagagacac

SEQ ID NO: 2229710 - DNA, 18 bp, Homo sapiens
aggccagagacacaagcc

SEQ ID NO: 2229711 - DNA, 12 bp, Homo sapiens
aggccagctgct

SEQ ID NO: 2229712 - DNA, 16 bp, Homo sapiens
aggccagctgcttggg

SEQ ID NO: 2229713 - DNA, 23 bp, Homo sapiens
aggccagctgcttgggcttcatc

SEQ ID NO: 2229714 - DNA, 14 bp, Homo sapiens
aggccatgggcctc

SEQ ID NO: 2229715 - DNA, 17 bp, Homo sapiens
aggccccgcccaggctt

SEQ ID NO: 2229716 - DNA, 15 bp, Homo sapiens
aggcccctgccaccc

SEQ ID NO: 2229717 - DNA, 20 bp, Homo sapiens
aggcccggctccaggctcct

SEQ ID NO: 2229718 - DNA, 13 bp, Homo sapiens
aggccctctgccc

SEQ ID NO: 2229719 - DNA, 21 bp, Homo sapiens
aggcccttctctccagcccct

SEQ ID NO: 2229720 - DNA, 22 bp, Homo sapiens
aggcccttctctccagcccctg

SEQ ID NO: 2229721 - DNA, 18 bp, Homo sapiens
aggcctccccagcaccta

SEQ ID NO: 2229722 - DNA, 13 bp, Homo sapiens
aggctacctttgt

SEQ ID NO: 2229723 - DNA, 14 bp, Homo sapiens
aggctacctttgta

SEQ ID NO: 2229724 - DNA, 15 bp, Homo sapiens
aggctacctttgtat

SEQ ID NO: 2229725 - DNA, 17 bp, Homo sapiens
aggctccaggagcagcc

SEQ ID NO: 2229726 - DNA, 11 bp, Homo sapiens
aggctctcagg

SEQ ID NO: 2229727 - DNA, 14 bp, Homo sapiens
aggctctcaggcca

SEQ ID NO: 2229728 - DNA, 15 bp, Homo sapiens
aggctctcaggccag

SEQ ID NO: 2229729 - DNA, 20 bp, Homo sapiens
aggctctcaggccagctgct

SEQ ID NO: 2229730 - DNA, 21 bp, Homo sapiens
aggctctcaggccagctgctt

SEQ ID NO: 2229731 - DNA, 11 bp, Homo sapiens
aggctctgccc

SEQ ID NO: 2229732 - DNA, 12 bp, Homo sapiens
aggctctgccct

SEQ ID NO: 2229733 - DNA, 16 bp, Homo sapiens
aggctctgcccttggt

SEQ ID NO: 2229734 - DNA, 17 bp, Homo sapiens
aggctgcagtgagccga

SEQ ID NO: 2229735 - DNA, 19 bp, Homo sapiens
aggctgggagagccttcca

SEQ ID NO: 2229736 - DNA, 18 bp, Homo sapiens
aggctgggctcccttccc

SEQ ID NO: 2229737 - DNA, 21 bp, Homo sapiens
aggctgggctcccttcccacc

SEQ ID NO: 2229738 - DNA, 19 bp, Homo sapiens
aggctgggcttcagtggca

SEQ ID NO: 2229739 - DNA, 21 bp, Homo sapiens
aggctgggcttcagtggcagc

SEQ ID NO: 2229740 - DNA, 14 bp, Homo sapiens
aggctgggttctga

SEQ ID NO: 2229741 - DNA, 13 bp, Homo sapiens
aggctgtatccca

SEQ ID NO: 2229742 - DNA, 23 bp, Homo sapiens
aggctgtatcccatgagcctcag

SEQ ID NO: 2229743 - DNA, 22 bp, Homo sapiens
agggaaggatacaaaagcatgt

SEQ ID NO: 2229744 - DNA, 13 bp, Homo sapiens
agggaattggggg

SEQ ID NO: 2229745 - DNA, 13 bp, Homo sapiens
agggacagagggg

SEQ ID NO: 2229746 - DNA, 22 bp, Homo sapiens
agggacagagggggtggcctcc

SEQ ID NO: 2229747 - DNA, 19 bp, Homo sapiens
agggacttggaagctccgc

SEQ ID NO: 2229748 - DNA, 17 bp, Homo sapiens
agggagggagggctcca

SEQ ID NO: 2229749 - DNA, 13 bp, Homo sapiens
agggagggctcca

SEQ ID NO: 2229750 - DNA, 20 bp, Homo sapiens
agggagtccgaaagggactt

SEQ ID NO: 2229751 - DNA, 12 bp, Homo sapiens
agggcctggcct

SEQ ID NO: 2229752 - DNA, 16 bp, Homo sapiens
agggcctggcctgagc

SEQ ID NO: 2229753 - DNA, 13 bp, Homo sapiens
agggcctggctca

SEQ ID NO: 2229754 - DNA, 18 bp, Homo sapiens
agggcctggctcaggtgg

SEQ ID NO: 2229755 - DNA, 22 bp, Homo sapiens
attccccaggaggccagccttg

SEQ ID NO: 2229756 - DNA, 20 bp, Homo sapiens
attctcagaatctcaaataa

SEQ ID NO: 2229757 - DNA, 16 bp, Homo sapiens
attctccacctgccag

SEQ ID NO: 2229758 - DNA, 21 bp, Homo sapiens
attctccacctgccagggaca

SEQ ID NO: 2229759 - DNA, 17 bp, Homo sapiens
attctccttgtgttact

SEQ ID NO: 2229760 - DNA, 18 bp, Homo sapiens
attctccttgtgttacta

SEQ ID NO: 2229761 - DNA, 21 bp, Homo sapiens
attctccttgtgttactaagt

SEQ ID NO: 2229762 - DNA, 22 bp, Homo sapiens
attctccttgtgttactaagtt

SEQ ID NO: 2229763 - DNA, 17 bp, Homo sapiens
attctctagtttgatta

SEQ ID NO: 2229764 - DNA, 20 bp, Homo sapiens
attctctagtttgattaaat

SEQ ID NO: 2229765 - DNA, 16 bp, Homo sapiens
attctctcctgtacct

SEQ ID NO: 2229766 - DNA, 15 bp, Homo sapiens
attctgcctgcccag

SEQ ID NO: 2229767 - DNA, 20 bp, Homo sapiens
attctgcctgcccaggcccc

SEQ ID NO: 2229768 - DNA, 19 bp, Homo sapiens
attctgctcacatatctgt

SEQ ID NO: 2229769 - DNA, 21 bp, Homo sapiens
attctgttggccagtgtgaca

SEQ ID NO: 2229770 - DNA, 13 bp, Homo sapiens
attcttatttaat

SEQ ID NO: 2229771 - DNA, 14 bp, Homo sapiens
attcttatttaatg

SEQ ID NO: 2229772 - DNA, 13 bp, Homo sapiens
attcttcctccct

SEQ ID NO: 2229773 - DNA, 19 bp, Homo sapiens
attcttctgcttcagcctc

SEQ ID NO: 2229774 - DNA, 22 bp, Homo sapiens
attcttctgtacgtctgacagg

SEQ ID NO: 2229775 - DNA, 19 bp, Homo sapiens
attcttgaacttgaaaaaa

SEQ ID NO: 2229776 - DNA, 11 bp, Homo sapiens
attctttcctg

SEQ ID NO: 2229777 - DNA, 13 bp, Homo sapiens
attctttcctgag

SEQ ID NO: 2229778 - DNA, 18 bp, Homo sapiens
attgaaatctttttgctt

SEQ ID NO: 2229779 - DNA, 20 bp, Homo sapiens
attgaaatctttttgctttg

SEQ ID NO: 2229780 - DNA, 17 bp, Homo sapiens
attgacctgaggccctt

SEQ ID NO: 2229781 - DNA, 17 bp, Homo sapiens
attgatatgcttataca

SEQ ID NO: 2229782 - DNA, 21 bp, Homo sapiens
attgatttccgttaaaatacc

SEQ ID NO: 2229783 - DNA, 17 bp, Homo sapiens
attgcaacaggctgggc

SEQ ID NO: 2229784 - DNA, 14 bp, Homo sapiens
attgctactgtcct

SEQ ID NO: 2229785 - DNA, 20 bp, Homo sapiens
attgctactgtcctacccac

SEQ ID NO: 2229786 - DNA, 22 bp, Homo sapiens
attgctactgtcctacccaccc

SEQ ID NO: 2229787 - DNA, 15 bp, Homo sapiens
attgctgatggtgca

SEQ ID NO: 2229788 - DNA, 19 bp, Homo sapiens
attgctgatggtgcaatga

SEQ ID NO: 2229789 - DNA, 18 bp, Homo sapiens
attgcttgagctcaggag

SEQ ID NO: 2229790 - DNA, 23 bp, Homo sapiens
attggctagaggttcaaagatat

SEQ ID NO: 2229791 - DNA, 16 bp, Homo sapiens
attgtaaggaatgatt

SEQ ID NO: 2229792 - DNA, 16 bp, Homo sapiens
attgtcaaagtggtga

SEQ ID NO: 2229793 - DNA, 17 bp, Homo sapiens
attgtccccgacccttg

SEQ ID NO: 2229794 - DNA, 14 bp, Homo sapiens
attgtgggaagggg

SEQ ID NO: 2229795 - DNA, 18 bp, Homo sapiens
attgtgtctcttggtcct

SEQ ID NO: 2229796 - DNA, 19 bp, Homo sapiens
attgttcttagtttgcagt

SEQ ID NO: 2229797 - DNA, 19 bp, Homo sapiens
attgttttcagtgtacatg

SEQ ID NO: 2229798 - DNA, 14 bp, Homo sapiens
atttaaaaaaaatc

SEQ ID NO: 2229799 - DNA, 14 bp, Homo sapiens
atttaaaagataca

SEQ ID NO: 2229800 - DNA, 16 bp, Homo sapiens
atttaacagaaatgta

SEQ ID NO: 2229801 - DNA, 16 bp, Homo sapiens
atttaatgaaagactg

SEQ ID NO: 2229802 - DNA, 16 bp, Homo sapiens
atttacttcttataca

SEQ ID NO: 2229803 - DNA, 17 bp, Homo sapiens
atttacttcttatacat

SEQ ID NO: 2229804 - DNA, 20 bp, Homo sapiens
atttacttcttatacatttg

SEQ ID NO: 2229805 - DNA, 12 bp, Homo sapiens
atttatttaaat

SEQ ID NO: 2229806 - DNA, 15 bp, Homo sapiens
atttccgttaaaata

SEQ ID NO: 2229807 - DNA, 14 bp, Homo sapiens
atttcctgtgtctt

SEQ ID NO: 2229808 - DNA, 12 bp, Homo sapiens
atttctaaatct

SEQ ID NO: 2229809 - DNA, 13 bp, Homo sapiens
atttctaaatctc

SEQ ID NO: 2229810 - DNA, 21 bp, Homo sapiens
atttctaaatctccaaaataa

SEQ ID NO: 2229811 - DNA, 12 bp, Homo sapiens
atttctgtttag

SEQ ID NO: 2229812 - DNA, 14 bp, Homo sapiens
atttctgtttagat

SEQ ID NO: 2229813 - DNA, 20 bp, Homo sapiens
atttcttccacaagagccca

SEQ ID NO: 2229814 - DNA, 15 bp, Homo sapiens
atttgaggtctgttc

SEQ ID NO: 2229815 - DNA, 17 bp, Homo sapiens
atttgaggtctgttctt

SEQ ID NO: 2229816 - DNA, 17 bp, Homo sapiens
atttggtggtttcagaa

SEQ ID NO: 2229817 - DNA, 20 bp, Homo sapiens
atttggtggtttcagaaatg

SEQ ID NO: 2229818 - DNA, 20 bp, Homo sapiens
atttgtttgaactgataaag

SEQ ID NO: 2229819 - DNA, 23 bp, Homo sapiens
atttgtttgaactgataaagatg

SEQ ID NO: 2229820 - DNA, 13 bp, Homo sapiens
attttattatgca

SEQ ID NO: 2229821 - DNA, 15 bp, Homo sapiens
attttattatgcatg

SEQ ID NO: 2229822 - DNA, 18 bp, Homo sapiens
attttattttattatgca

SEQ ID NO: 2229823 - DNA, 17 bp, Homo sapiens
attttgatgttttaagg

SEQ ID NO: 2229824 - DNA, 18 bp, Homo sapiens
attttgctttgtgatttt

SEQ ID NO: 2229825 - DNA, 20 bp, Homo sapiens
attttgctttgtgatttttg

SEQ ID NO: 2229826 - DNA, 19 bp, Homo sapiens
attttggaaaataaattat

SEQ ID NO: 2229827 - DNA, 21 bp, Homo sapiens
attttggggtacccactgctc

SEQ ID NO: 2229828 - DNA, 22 bp, Homo sapiens
attttggggtacccactgctct

SEQ ID NO: 2229829 - DNA, 13 bp, Homo sapiens
atttttaagtgct

SEQ ID NO: 2229830 - DNA, 18 bp, Homo sapiens
atttttaagtgctgcatt

SEQ ID NO: 2229831 - DNA, 14 bp, Homo sapiens
atttttagacagag

SEQ ID NO: 2229832 - DNA, 16 bp, Homo sapiens
atttttattaaattat

SEQ ID NO: 2229833 - DNA, 16 bp, Homo sapiens
atttttttgagacaga

SEQ ID NO: 2229834 - DNA, 12 bp, Homo sapiens
atttttttttcc

SEQ ID NO: 2229835 - DNA, 17 bp, Homo sapiens
atttttttttccttcag

SEQ ID NO: 2229836 - DNA, 22 bp, Homo sapiens
atttttttttccttcagtgcct

SEQ ID NO: 2229837 - DNA, 21 bp, Homo sapiens
caaaacggttttactgcagct

SEQ ID NO: 2229838 - DNA, 13 bp, Homo sapiens
caaaagcatgtga

SEQ ID NO: 2229839 - DNA, 17 bp, Homo sapiens
caaaataaaaatgaggt

SEQ ID NO: 2229840 - DNA, 20 bp, Homo sapiens
caaaataaaactttttaaaa

SEQ ID NO: 2229841 - DNA, 21 bp, Homo sapiens
caaaatcgatgcagtgcttcc

SEQ ID NO: 2229842 - DNA, 13 bp, Homo sapiens
caaacagaggccg

SEQ ID NO: 2229843 - DNA, 14 bp, Homo sapiens
caaaccatcattga

SEQ ID NO: 2229844 - DNA, 21 bp, Homo sapiens
caaaccatcattgaaatcttt

SEQ ID NO: 2229845 - DNA, 19 bp, Homo sapiens
caaactcttgacctcaggt

SEQ ID NO: 2229846 - DNA, 21 bp, Homo sapiens
caaagaggttttaaaaaaatc

SEQ ID NO: 2229847 - DNA, 16 bp, Homo sapiens
caaagatattttgctt

SEQ ID NO: 2229848 - DNA, 13 bp, Homo sapiens
caaagatgcagcc

SEQ ID NO: 2229849 - DNA, 15 bp, Homo sapiens
caaagcagtgcatgc

SEQ ID NO: 2229850 - DNA, 18 bp, Homo sapiens
caaagcagtgcatgctgt

SEQ ID NO: 2229851 - DNA, 20 bp, Homo sapiens
caaagccaaagctaggcctg

SEQ ID NO: 2229852 - DNA, 18 bp, Homo sapiens
caaagcctcctccagccg

SEQ ID NO: 2229853 - DNA, 14 bp, Homo sapiens
caaaggagattgga

SEQ ID NO: 2229854 - DNA, 19 bp, Homo sapiens
caaagggtatcaggtgctg

SEQ ID NO: 2229855 - DNA, 21 bp, Homo sapiens
caaagggtatcaggtgctgcc

SEQ ID NO: 2229856 - DNA, 21 bp, Homo sapiens
caaagtacactgtttcaaact

SEQ ID NO: 2229857 - DNA, 14 bp, Homo sapiens
caaagtagaagtct

SEQ ID NO: 2229858 - DNA, 21 bp, Homo sapiens
caaagtagaagtcttagatgt

SEQ ID NO: 2229859 - DNA, 19 bp, Homo sapiens
caaagtatccctactgtaa

SEQ ID NO: 2229860 - DNA, 13 bp, Homo sapiens
caaagtgctggga

SEQ ID NO: 2229861 - DNA, 16 bp, Homo sapiens
caaatcagctgctact

SEQ ID NO: 2229862 - DNA, 17 bp, Homo sapiens
caaatcagctgctacta

SEQ ID NO: 2229863 - DNA, 20 bp, Homo sapiens
caaatggaaatgggcagagc

SEQ ID NO: 2229864 - DNA, 14 bp, Homo sapiens
caaatttctaaatc

SEQ ID NO: 2229865 - DNA, 23 bp, Homo sapiens
caacaaacctgtttctgcagcca

SEQ ID NO: 2229866 - DNA, 22 bp, Homo sapiens
caacactcacatttattctgct

SEQ ID NO: 2229867 - DNA, 20 bp, Homo sapiens
caacactcattgacctgagg

SEQ ID NO: 2229868 - DNA, 14 bp, Homo sapiens
caacaggctgggct

SEQ ID NO: 2229869 - DNA, 20 bp, Homo sapiens
caacaggctgggcttcagtg

SEQ ID NO: 2229870 - DNA, 24 bp, Homo sapiens
caacaggctgggcttcagtggcag

SEQ ID NO: 2229871 - DNA, 19 bp, Homo sapiens
caacaggttttcctgaaga

SEQ ID NO: 2229872 - DNA, 15 bp, Homo sapiens
caacatactcccatc

SEQ ID NO: 2229873 - DNA, 17 bp, Homo sapiens
caacatactcccatctg

SEQ ID NO: 2229874 - DNA, 14 bp, Homo sapiens
caacccccagcctg

SEQ ID NO: 2229875 - DNA, 16 bp, Homo sapiens
caacccccagcctgct

SEQ ID NO: 2229876 - DNA, 17 bp, Homo sapiens
caacccccagcctgcta

SEQ ID NO: 2229877 - DNA, 18 bp, Homo sapiens
caaccccttcgctcctgt

SEQ ID NO: 2229878 - DNA, 19 bp, Homo sapiens
caaccccttcgctcctgtg

SEQ ID NO: 2229879 - DNA, 23 bp, Homo sapiens
cagctgcggtccacccaggagcc

SEQ ID NO: 2229880 - DNA, 17 bp, Homo sapiens
cagctgctactactcct

SEQ ID NO: 2229881 - DNA, 16 bp, Homo sapiens
cagctgcttgggcttc

SEQ ID NO: 2229882 - DNA, 19 bp, Homo sapiens
cagctgcttgggcttcatc

SEQ ID NO: 2229883 - DNA, 22 bp, Homo sapiens
cagctgcttgggcttcatcctc

SEQ ID NO: 2229884 - DNA, 18 bp, Homo sapiens
cagctggttgaggtttca

SEQ ID NO: 2229885 - DNA, 20 bp, Homo sapiens
cagcttcatttcctgtgtct

SEQ ID NO: 2229886 - DNA, 21 bp, Homo sapiens
cagcttgaccgtgaggccaga

SEQ ID NO: 2229887 - DNA, 21 bp, Homo sapiens
cagcttgagggttgggctggt

SEQ ID NO: 2229888 - DNA, 19 bp, Homo sapiens
cagcttgtaaatagctcag

SEQ ID NO: 2229889 - DNA, 21 bp, Homo sapiens
cagctttgtttgttgtcagct

SEQ ID NO: 2229890 - DNA, 20 bp, Homo sapiens
caggaaaagctgctgacagt

SEQ ID NO: 2229891 - DNA, 17 bp, Homo sapiens
caggaaaggctccagga

SEQ ID NO: 2229892 - DNA, 21 bp, Homo sapiens
caggaaaggctccaggagcag

SEQ ID NO: 2229893 - DNA, 22 bp, Homo sapiens
caggaaaggctccaggagcagc

SEQ ID NO: 2229894 - DNA, 16 bp, Homo sapiens
caggaagccagcaggc

SEQ ID NO: 2229895 - DNA, 19 bp, Homo sapiens
caggaagccagcaggctct

SEQ ID NO: 2229896 - DNA, 15 bp, Homo sapiens
caggaaggctaaagg

SEQ ID NO: 2229897 - DNA, 14 bp, Homo sapiens
caggaagtactgga

SEQ ID NO: 2229898 - DNA, 13 bp, Homo sapiens
caggacctcaggt

SEQ ID NO: 2229899 - DNA, 23 bp, Homo sapiens
caggacctcaggtgagaagcaga

SEQ ID NO: 2229900 - DNA, 12 bp, Homo sapiens
caggagcagcca

SEQ ID NO: 2229901 - DNA, 23 bp, Homo sapiens
caggagccccgaggccttctctg

SEQ ID NO: 2229902 - DNA, 19 bp, Homo sapiens
caggaggatcacttgagtc

SEQ ID NO: 2229903 - DNA, 15 bp, Homo sapiens
caggaggccagcctt

SEQ ID NO: 2229904 - DNA, 20 bp, Homo sapiens
caggattcttcctccctccc

SEQ ID NO: 2229905 - DNA, 16 bp, Homo sapiens
caggcaagcacctcct

SEQ ID NO: 2229906 - DNA, 19 bp, Homo sapiens
caggcaatgctggctgttg

SEQ ID NO: 2229907 - DNA, 15 bp, Homo sapiens
caggcagccaggcca

SEQ ID NO: 2229908 - DNA, 12 bp, Homo sapiens
caggcagcccca

SEQ ID NO: 2229909 - DNA, 13 bp, Homo sapiens
caggcaggtccag

SEQ ID NO: 2229910 - DNA, 14 bp, Homo sapiens
caggcaggtccagg

SEQ ID NO: 2229911 - DNA, 15 bp, Homo sapiens
caggcaggtccaggg

SEQ ID NO: 2229912 - DNA, 15 bp, Homo sapiens
caggcaggtgggatg

SEQ ID NO: 2229913 - DNA, 23 bp, Homo sapiens
caggcagtggggctggaagcaga

SEQ ID NO: 2229914 - DNA, 19 bp, Homo sapiens
caggcatgttctctgagga

SEQ ID NO: 2229915 - DNA, 16 bp, Homo sapiens
caggcattccccagga

SEQ ID NO: 2229916 - DNA, 18 bp, Homo sapiens
caggcattccccaggagg

SEQ ID NO: 2229917 - DNA, 18 bp, Homo sapiens
caggccaaactcacctgc

SEQ ID NO: 2229918 - DNA, 13 bp, Homo sapiens
caggccacaagac

SEQ ID NO: 2229919 - DNA, 15 bp, Homo sapiens
caggccagagggagt

SEQ ID NO: 2229920 - DNA, 16 bp, Homo sapiens
caggccagagggagtg

SEQ ID NO: 2229921 - DNA, 19 bp, Homo sapiens
caggccagagggagtgaca

SEQ ID NO: 2229922 - DNA, 13 bp, Homo sapiens
caggccagctgct

SEQ ID NO: 2229923 - DNA, 21 bp, Homo sapiens
caggccagctgcttgggcttc

SEQ ID NO: 2229924 - DNA, 23 bp, Homo sapiens
caggccagctgcttgggcttcat

SEQ ID NO: 2229925 - DNA, 12 bp, Homo sapiens
caggccaggccc

SEQ ID NO: 2229926 - DNA, 21 bp, Homo sapiens
caggccaggccctctgcccac

SEQ ID NO: 2229927 - DNA, 15 bp, Homo sapiens
caggcccctgccacc

SEQ ID NO: 2229928 - DNA, 17 bp, Homo sapiens
caggcccctgccaccct

SEQ ID NO: 2229929 - DNA, 17 bp, Homo sapiens
caggcccggctccaggc

SEQ ID NO: 2229930 - DNA, 19 bp, Homo sapiens
caggcccggctccaggctc

SEQ ID NO: 2229931 - DNA, 14 bp, Homo sapiens
caggccctctgccc

SEQ ID NO: 2229932 - DNA, 16 bp, Homo sapiens
caggccctctgcccac

SEQ ID NO: 2229933 - DNA, 14 bp, Homo sapiens
caggcctccccagc

SEQ ID NO: 2229934 - DNA, 20 bp, Homo sapiens
caggcctgggggctgggcag

SEQ ID NO: 2229935 - DNA, 22 bp, Homo sapiens
caggcctgggggctgggcagag

SEQ ID NO: 2229936 - DNA, 23 bp, Homo sapiens
caggcctgggggctgggcagagg

SEQ ID NO: 2229937 - DNA, 19 bp, Homo sapiens
caggctcctttagcgccca

SEQ ID NO: 2229938 - DNA, 20 bp, Homo sapiens
caggctcctttagcgcccag

SEQ ID NO: 2229939 - DNA, 16 bp, Homo sapiens
caggctctcaggccag

SEQ ID NO: 2229940 - DNA, 17 bp, Homo sapiens
caggctctcaggccagc

SEQ ID NO: 2229941 - DNA, 19 bp, Homo sapiens
caggctctcaggccagctg

SEQ ID NO: 2229942 - DNA, 18 bp, Homo sapiens
caggctgggagagccttc

SEQ ID NO: 2229943 - DNA, 14 bp, Homo sapiens
caggctgggcttca

SEQ ID NO: 2229944 - DNA, 17 bp, Homo sapiens
caggctgggcttcagtg

SEQ ID NO: 2229945 - DNA, 22 bp, Homo sapiens
caggctgggcttcagtggcagc

SEQ ID NO: 2229946 - DNA, 23 bp, Homo sapiens
caggctgggcttcagtggcagct

SEQ ID NO: 2229947 - DNA, 12 bp, Homo sapiens
caggctggtctc

SEQ ID NO: 2229948 - DNA, 21 bp, Homo sapiens
caggctgtatcccatgagcct

SEQ ID NO: 2229949 - DNA, 21 bp, Homo sapiens
caggcttagtcactgagacag

SEQ ID NO: 2229950 - DNA, 22 bp, Homo sapiens
cagggaaacagctaatgggaca

SEQ ID NO: 2229951 - DNA, 22 bp, Homo sapiens
cagggagtccgaaagggacttg

SEQ ID NO: 2229952 - DNA, 13 bp, Homo sapiens
cagggcctggctc

SEQ ID NO: 2229953 - DNA, 14 bp, Homo sapiens
cagggcctggctca

SEQ ID NO: 2229954 - DNA, 16 bp, Homo sapiens
cagggcctggctcagg

SEQ ID NO: 2229955 - DNA, 23 bp, Homo sapiens
cagggctcagcggggacagctcc

SEQ ID NO: 2229956 - DNA, 19 bp, Homo sapiens
caggggagggtagagcgga

SEQ ID NO: 2229957 - DNA, 16 bp, Homo sapiens
cagggggtgccctccc

SEQ ID NO: 2229958 - DNA, 20 bp, Homo sapiens
caggggtgggacaccctgtg

SEQ ID NO: 2229959 - DNA, 20 bp, Homo sapiens
cagggtattccagagtgggg

SEQ ID NO: 2229960 - DNA, 14 bp, Homo sapiens
cagggtccctggtg

SEQ ID NO: 2229961 - DNA, 18 bp, Homo sapiens
cagggtcctgtagcccta

SEQ ID NO: 2229962 - DNA, 23 bp, Homo sapiens
cagggtctcactctgtcgcccag

SEQ ID NO: 2229963 - DNA, 21 bp, Homo sapiens
cagggtctctaccatcccctg

SEQ ID NO: 2229964 - DNA, 23 bp, Homo sapiens
cagggtgagcactctggggtggg

SEQ ID NO: 2229965 - DNA, 12 bp, Homo sapiens
cagggttggccc

SEQ ID NO: 2229966 - DNA, 16 bp, Homo sapiens
cagggttggcccctgc

SEQ ID NO: 2229967 - DNA, 17 bp, Homo sapiens
cagggttggcccctgcc

SEQ ID NO: 2229968 - DNA, 15 bp, Homo sapiens
caggtaacaggcaga

SEQ ID NO: 2229969 - DNA, 20 bp, Homo sapiens
caggtcttgaactcctggcc

SEQ ID NO: 2229970 - DNA, 22 bp, Homo sapiens
caggtcttgaactcctggcctc

SEQ ID NO: 2229971 - DNA, 20 bp, Homo sapiens
caggtgatccacccacctca

SEQ ID NO: 2229972 - DNA, 14 bp, Homo sapiens
caggtgcgaaagga

SEQ ID NO: 2229973 - DNA, 18 bp, Homo sapiens
caggtgctaggaacactc

SEQ ID NO: 2229974 - DNA, 16 bp, Homo sapiens
caggtggggcagcttg

SEQ ID NO: 2229975 - DNA, 18 bp, Homo sapiens
caggtggggtcactctgg

SEQ ID NO: 2229976 - DNA, 21 bp, Homo sapiens
caggtggggtcactctggcag

SEQ ID NO: 2229977 - DNA, 23 bp, Homo sapiens
caggtggggtcactctggcagct

SEQ ID NO: 2229978 - DNA, 15 bp, Homo sapiens
caggtgtccctgcac

SEQ ID NO: 2229979 - DNA, 16 bp, Homo sapiens
caggtgtgaaccacca

SEQ ID NO: 2229980 - DNA, 22 bp, Homo sapiens
caggtgtgaaccaccacaccca

SEQ ID NO: 2229981 - DNA, 23 bp, Homo sapiens
caggtgtgaaccaccacacccag

SEQ ID NO: 2229982 - DNA, 16 bp, Homo sapiens
caggtgtgagtcacca

SEQ ID NO: 2229983 - DNA, 14 bp, Homo sapiens
caggttggtggggg

SEQ ID NO: 2229984 - DNA, 14 bp, Homo sapiens
caggtttaagctgt

SEQ ID NO: 2229985 - DNA, 18 bp, Homo sapiens
caggtttaagctgttact

SEQ ID NO: 2229986 - DNA, 12 bp, Homo sapiens
cagtaataactc

SEQ ID NO: 2229987 - DNA, 13 bp, Homo sapiens
cagtatctcaggg

SEQ ID NO: 2229988 - DNA, 12 bp, Homo sapiens
cagtatcttgaa

SEQ ID NO: 2229989 - DNA, 18 bp, Homo sapiens
cagtattacttctgctac

SEQ ID NO: 2229990 - DNA, 17 bp, Homo sapiens
cagtcaccccggccacc

SEQ ID NO: 2229991 - DNA, 18 bp, Homo sapiens
cagtcaccccggccacct

SEQ ID NO: 2229992 - DNA, 16 bp, Homo sapiens
cagtccctgccaatgg

SEQ ID NO: 2229993 - DNA, 12 bp, Homo sapiens
cagtcctcccat

SEQ ID NO: 2229994 - DNA, 14 bp, Homo sapiens
cagtcctcccatct

SEQ ID NO: 2229995 - DNA, 15 bp, Homo sapiens
cagtccttaccagca

SEQ ID NO: 2229996 - DNA, 18 bp, Homo sapiens
cagtccttaccagcagag

SEQ ID NO: 2229997 - DNA, 19 bp, Homo sapiens
cagtccttaccagcagagc

SEQ ID NO: 2229998 - DNA, 21 bp, Homo sapiens
cagtccttaccagcagagcac

SEQ ID NO: 2229999 - DNA, 19 bp, Homo sapiens
cagtctgattcccaagctc

SEQ ID NO: 2230000 - DNA, 13 bp, Homo sapiens
cagtgaggctctg

SEQ ID NO: 2230001 - DNA, 15 bp, Homo sapiens
cagtgaggctctgcc

SEQ ID NO: 2230002 - DNA, 19 bp, Homo sapiens
cccagcccacttctgccat

SEQ ID NO: 2230003 - DNA, 21 bp, Homo sapiens
cccagccccaaaactctcctc

SEQ ID NO: 2230004 - DNA, 13 bp, Homo sapiens
cccagccccatcc

SEQ ID NO: 2230005 - DNA, 14 bp, Homo sapiens
cccagccccatccc

SEQ ID NO: 2230006 - DNA, 15 bp, Homo sapiens
cccagccccatcctc

SEQ ID NO: 2230007 - DNA, 18 bp, Homo sapiens
cccagccccatcctctgt

SEQ ID NO: 2230008 - DNA, 11 bp, Homo sapiens
cccagcccctt

SEQ ID NO: 2230009 - DNA, 17 bp, Homo sapiens
cccagcgagccctggtg

SEQ ID NO: 2230010 - DNA, 19 bp, Homo sapiens
cccagcgagccctggtggc

SEQ ID NO: 2230011 - DNA, 23 bp, Homo sapiens
cccagcgagccctggtggcagtg

SEQ ID NO: 2230012 - DNA, 16 bp, Homo sapiens
cccagctctggtccat

SEQ ID NO: 2230013 - DNA, 21 bp, Homo sapiens
cccagctgtgctctggacagg

SEQ ID NO: 2230014 - DNA, 22 bp, Homo sapiens
cccagcttaaaggggctagagt

SEQ ID NO: 2230015 - DNA, 15 bp, Homo sapiens
cccaggaaaggctcc

SEQ ID NO: 2230016 - DNA, 16 bp, Homo sapiens
cccaggaaaggctcca

SEQ ID NO: 2230017 - DNA, 22 bp, Homo sapiens
cccaggaaaggctccaggagca

SEQ ID NO: 2230018 - DNA, 21 bp, Homo sapiens
cccaggagccccgaggccttc

SEQ ID NO: 2230019 - DNA, 15 bp, Homo sapiens
cccaggaggccagcc

SEQ ID NO: 2230020 - DNA, 22 bp, Homo sapiens
cccaggaggccagccttgacca

SEQ ID NO: 2230021 - DNA, 13 bp, Homo sapiens
cccaggcaggtct

SEQ ID NO: 2230022 - DNA, 23 bp, Homo sapiens
cccaggcaggtcttgaactcctg

SEQ ID NO: 2230023 - DNA, 17 bp, Homo sapiens
cccaggcattccccagg

SEQ ID NO: 2230024 - DNA, 18 bp, Homo sapiens
cccaggcattccccagga

SEQ ID NO: 2230025 - DNA, 21 bp, Homo sapiens
cccaggcccctgccaccctgg

SEQ ID NO: 2230026 - DNA, 22 bp, Homo sapiens
cccaggcccctgccaccctggg

SEQ ID NO: 2230027 - DNA, 17 bp, Homo sapiens
cccaggcctcctacagc

SEQ ID NO: 2230028 - DNA, 19 bp, Homo sapiens
cccaggctggcgtgcagtg

SEQ ID NO: 2230029 - DNA, 22 bp, Homo sapiens
cccaggcttagtcactgagaca

SEQ ID NO: 2230030 - DNA, 23 bp, Homo sapiens
cccaggtgctaggaacactcctt

SEQ ID NO: 2230031 - DNA, 19 bp, Homo sapiens
cccagtctggaatgcagtg

SEQ ID NO: 2230032 - DNA, 21 bp, Homo sapiens
cccagtgcccacaggatcagt

SEQ ID NO: 2230033 - DNA, 12 bp, Homo sapiens
cccagtgccccc

SEQ ID NO: 2230034 - DNA, 12 bp, Homo sapiens
cccatctgtgaa

SEQ ID NO: 2230035 - DNA, 14 bp, Homo sapiens
cccatgagcctcag

SEQ ID NO: 2230036 - DNA, 16 bp, Homo sapiens
cccatgagcctcagca

SEQ ID NO: 2230037 - DNA, 17 bp, Homo sapiens
cccatgctgccctgtga

SEQ ID NO: 2230038 - DNA, 18 bp, Homo sapiens
cccatgctgccctgtgag

SEQ ID NO: 2230039 - DNA, 13 bp, Homo sapiens
cccattctgcctg

SEQ ID NO: 2230040 - DNA, 14 bp, Homo sapiens
cccattctgcctgc

SEQ ID NO: 2230041 - DNA, 22 bp, Homo sapiens
cccattctgcctgcccaggccc

SEQ ID NO: 2230042 - DNA, 22 bp, Homo sapiens
ccccaaatggaaatgggcagag

SEQ ID NO: 2230043 - DNA, 13 bp, Homo sapiens
ccccaccccaggc

SEQ ID NO: 2230044 - DNA, 16 bp, Homo sapiens
ccccaccccaggctgg

SEQ ID NO: 2230045 - DNA, 15 bp, Homo sapiens
ccccaccgcagacag

SEQ ID NO: 2230046 - DNA, 19 bp, Homo sapiens
ccccaccgcagacaggacc

SEQ ID NO: 2230047 - DNA, 21 bp, Homo sapiens
ccccacggacgacgcgagggc

SEQ ID NO: 2230048 - DNA, 22 bp, Homo sapiens
ccccagcaagtgagagctgggt

SEQ ID NO: 2230049 - DNA, 10 bp, Homo sapiens
ccccagcccc

SEQ ID NO: 2230050 - DNA, 14 bp, Homo sapiens
ccccagccccaaaa

SEQ ID NO: 2230051 - DNA, 16 bp, Homo sapiens
ccccagccccatccca

SEQ ID NO: 2230052 - DNA, 17 bp, Homo sapiens
ccccaggaggccagcct

SEQ ID NO: 2230053 - DNA, 14 bp, Homo sapiens
ccccagtgcccaca

SEQ ID NO: 2230054 - DNA, 15 bp, Homo sapiens
ccccagtgcccacag

SEQ ID NO: 2230055 - DNA, 20 bp, Homo sapiens
ccccagtgcccacaggatca

SEQ ID NO: 2230056 - DNA, 14 bp, Homo sapiens
ccccatcctcctgc

SEQ ID NO: 2230057 - DNA, 14 bp, Homo sapiens
ccccatcctctgta

SEQ ID NO: 2230058 - DNA, 14 bp, Homo sapiens
ccccattctgcctg

SEQ ID NO: 2230059 - DNA, 22 bp, Homo sapiens
cccccaaatggaaatgggcaga

SEQ ID NO: 2230060 - DNA, 13 bp, Homo sapiens
cccccacccaagg

SEQ ID NO: 2230061 - DNA, 13 bp, Homo sapiens
cccccaccccagg

SEQ ID NO: 2230062 - DNA, 11 bp, Homo sapiens
cccccactggt

SEQ ID NO: 2230063 - DNA, 17 bp, Homo sapiens
cccccggcccagtgccc

SEQ ID NO: 2230064 - DNA, 19 bp, Homo sapiens
ccccctgacaacactcatt

SEQ ID NO: 2230065 - DNA, 14 bp, Homo sapiens
cccccttccatgga

SEQ ID NO: 2230066 - DNA, 14 bp, Homo sapiens
cccccttgcccagg

SEQ ID NO: 2230067 - DNA, 23 bp, Homo sapiens
ccccgaggccttctctgaaggac

SEQ ID NO: 2230068 - DNA, 15 bp, Homo sapiens
ccccgatgggatggc

SEQ ID NO: 2230069 - DNA, 14 bp, Homo sapiens
ccccggccacctgc

SEQ ID NO: 2230070 - DNA, 19 bp, Homo sapiens
ccccgggcagcagagagag

SEQ ID NO: 2230071 - DNA, 15 bp, Homo sapiens
cccctcaacacctct

SEQ ID NO: 2230072 - DNA, 16 bp, Homo sapiens
cccctcaacacctctg

SEQ ID NO: 2230073 - DNA, 23 bp, Homo sapiens
cccctcaactctcctccagagtc

SEQ ID NO: 2230074 - DNA, 18 bp, Homo sapiens
cccctcagggtccctggt

SEQ ID NO: 2230075 - DNA, 20 bp, Homo sapiens
cccctcagggtccctggtgg

SEQ ID NO: 2230076 - DNA, 12 bp, Homo sapiens
cccctccatgtg

SEQ ID NO: 2230077 - DNA, 15 bp, Homo sapiens
cccctccccgggcag

SEQ ID NO: 2230078 - DNA, 19 bp, Homo sapiens
cccctgcccggctgcggaa

SEQ ID NO: 2230079 - DNA, 14 bp, Homo sapiens
cccctgctgggtgt

SEQ ID NO: 2230080 - DNA, 15 bp, Homo sapiens
cccctgctggttcag

SEQ ID NO: 2230081 - DNA, 12 bp, Homo sapiens
cccctggcagcc

SEQ ID NO: 2230082 - DNA, 14 bp, Homo sapiens
cccctggcagcccc

SEQ ID NO: 2230083 - DNA, 15 bp, Homo sapiens
ccccttcgctcctgt

SEQ ID NO: 2230084 - DNA, 17 bp, Homo sapiens
ccccttcgctcctgtgt

SEQ ID NO: 2230085 - DNA, 14 bp, Homo sapiens
ccccttgcccaggc

SEQ ID NO: 2230086 - DNA, 15 bp, Homo sapiens
ccccttgcccaggcc

SEQ ID NO: 2230087 - DNA, 16 bp, Homo sapiens
ccccttgcccaggcct

SEQ ID NO: 2230088 - DNA, 22 bp, Homo sapiens
ccccttgcccaggcctccccag

SEQ ID NO: 2230089 - DNA, 15 bp, Homo sapiens
cccgaggccttctct

SEQ ID NO: 2230090 - DNA, 20 bp, Homo sapiens
cccgaggccttctctgaagg

SEQ ID NO: 2230091 - DNA, 13 bp, Homo sapiens
cccgagtagctgg

SEQ ID NO: 2230092 - DNA, 17 bp, Homo sapiens
cccgagtagctgggact

SEQ ID NO: 2230093 - DNA, 21 bp, Homo sapiens
cccgagtagctgggactacag

SEQ ID NO: 2230094 - DNA, 22 bp, Homo sapiens
cccgcccaggcttagtcactga

SEQ ID NO: 2230095 - DNA, 15 bp, Homo sapiens
cccgcctgccctccc

SEQ ID NO: 2230096 - DNA, 20 bp, Homo sapiens
cccgcctgccctcccacccc

SEQ ID NO: 2230097 - DNA, 13 bp, Homo sapiens
cccggccacctgc

SEQ ID NO: 2230098 - DNA, 17 bp, Homo sapiens
cccggccacctgcggtg

SEQ ID NO: 2230099 - DNA, 14 bp, Homo sapiens
cccgggcagcagag

SEQ ID NO: 2230100 - DNA, 16 bp, Homo sapiens
cccgggcagcagagag

SEQ ID NO: 2230101 - DNA, 16 bp, Homo sapiens
cccgggctctgcctcc

SEQ ID NO: 2230102 - DNA, 18 bp, Homo sapiens
ccctattagagaagagat

SEQ ID NO: 2230103 - DNA, 16 bp, Homo sapiens
ccctcaactctcctcc

SEQ ID NO: 2230104 - DNA, 16 bp, Homo sapiens
ccctcagggtccctgg

SEQ ID NO: 2230105 - DNA, 14 bp, Homo sapiens
ccctccccgggcag

SEQ ID NO: 2230106 - DNA, 15 bp, Homo sapiens
ccctccccgggcagc

SEQ ID NO: 2230107 - DNA, 15 bp, Homo sapiens
ccctctgcccactcc

SEQ ID NO: 2230108 - DNA, 12 bp, Homo sapiens
ccctctggggct

SEQ ID NO: 2230109 - DNA, 16 bp, Homo sapiens
ccctctggggctgttc

SEQ ID NO: 2230110 - DNA, 12 bp, Homo sapiens
ccctgaaggccc

SEQ ID NO: 2230111 - DNA, 22 bp, Homo sapiens
ccctgaaggccccgcccaggct

SEQ ID NO: 2230112 - DNA, 14 bp, Homo sapiens
ccctgacaacactc

SEQ ID NO: 2230113 - DNA, 22 bp, Homo sapiens
ccctgacaacactcattgacct

SEQ ID NO: 2230114 - DNA, 12 bp, Homo sapiens
ccctgaggccca

SEQ ID NO: 2230115 - DNA, 13 bp, Homo sapiens
ccctgaggcccag

SEQ ID NO: 2230116 - DNA, 20 bp, Homo sapiens
ccctgcagagggcacagaaa

SEQ ID NO: 2230117 - DNA, 14 bp, Homo sapiens
ccctgcccacctgg

SEQ ID NO: 2230118 - DNA, 17 bp, Homo sapiens
ccctgcccacctggcct

SEQ ID NO: 2230119 - DNA, 20 bp, Homo sapiens
ccctgcccacctggcctctg

SEQ ID NO: 2230120 - DNA, 17 bp, Homo sapiens
ccctgcccggctgcgga

SEQ ID NO: 2230121 - DNA, 16 bp, Homo sapiens
ccctgccctgtgggcc

SEQ ID NO: 2230122 - DNA, 17 bp, Homo sapiens
ccctgcggaagccacag

SEQ ID NO: 2230123 - DNA, 21 bp, Homo sapiens
ccctgcggaagccacagggtg

SEQ ID NO: 2230124 - DNA, 22 bp, Homo sapiens
ccctgcggaagccacagggtga

SEQ ID NO: 2230125 - DNA, 13 bp, Homo sapiens
ccctgctggttca

SEQ ID NO: 2230126 - DNA, 19 bp, Homo sapiens
ccctgctggttcagggttg

SEQ ID NO: 2230127 - DNA, 20 bp, Homo sapiens
ctatctcccccagccccatc

SEQ ID NO: 2230128 - DNA, 14 bp, Homo sapiens
ctatgacacatgca

SEQ ID NO: 2230129 - DNA, 11 bp, Homo sapiens
ctatgcatttg

SEQ ID NO: 2230130 - DNA, 14 bp, Homo sapiens
ctatgcatttgaaa

SEQ ID NO: 2230131 - DNA, 18 bp, Homo sapiens
ctatgggactcaatgcac

SEQ ID NO: 2230132 - DNA, 14 bp, Homo sapiens
ctatgtgagaccat

SEQ ID NO: 2230133 - DNA, 22 bp, Homo sapiens
ctatgtgtagggcgggaggatg

SEQ ID NO: 2230134 - DNA, 18 bp, Homo sapiens
ctatgttgcccaggcagg

SEQ ID NO: 2230135 - DNA, 22 bp, Homo sapiens
ctatgttgcccaggcaggtctt

SEQ ID NO: 2230136 - DNA, 23 bp, Homo sapiens
ctattcagtaataactctaccct

SEQ ID NO: 2230137 - DNA, 16 bp, Homo sapiens
ctattgctgcttgagg

SEQ ID NO: 2230138 - DNA, 18 bp, Homo sapiens
ctcaaaagctgggcaggt

SEQ ID NO: 2230139 - DNA, 12 bp, Homo sapiens
ctcaaataacta

SEQ ID NO: 2230140 - DNA, 21 bp, Homo sapiens
ctcaacacctctgcacaagct

SEQ ID NO: 2230141 - DNA, 13 bp, Homo sapiens
ctcaacctcctgg

SEQ ID NO: 2230142 - DNA, 21 bp, Homo sapiens
ctcaagtcctcttttctgaga

SEQ ID NO: 2230143 - DNA, 24 bp, Homo sapiens
ctcacacatgagcatcaggccagg

SEQ ID NO: 2230144 - DNA, 19 bp, Homo sapiens
ctcacagtccttaccagca

SEQ ID NO: 2230145 - DNA, 19 bp, Homo sapiens
ctcacatttattctgctca

SEQ ID NO: 2230146 - DNA, 14 bp, Homo sapiens
ctcaccccagcccc

SEQ ID NO: 2230147 - DNA, 16 bp, Homo sapiens
ctcacctgcccctcaa

SEQ ID NO: 2230148 - DNA, 16 bp, Homo sapiens
ctcactatgttgccca

SEQ ID NO: 2230149 - DNA, 17 bp, Homo sapiens
ctcactatgttgcccag

SEQ ID NO: 2230150 - DNA, 13 bp, Homo sapiens
ctcactccttgaa

SEQ ID NO: 2230151 - DNA, 13 bp, Homo sapiens
ctcactctgtcgc

SEQ ID NO: 2230152 - DNA, 19 bp, Homo sapiens
ctcactgccatgccagctt

SEQ ID NO: 2230153 - DNA, 22 bp, Homo sapiens
ctcactgccatgccagcttatc

SEQ ID NO: 2230154 - DNA, 14 bp, Homo sapiens
ctcactgttgccca

SEQ ID NO: 2230155 - DNA, 18 bp, Homo sapiens
ctcactgttgcccaggct

SEQ ID NO: 2230156 - DNA, 13 bp, Homo sapiens
ctcagaagacact

SEQ ID NO: 2230157 - DNA, 23 bp, Homo sapiens
ctcagaagacactgatgggcaac

SEQ ID NO: 2230158 - DNA, 16 bp, Homo sapiens
ctcagaatctcaaata

SEQ ID NO: 2230159 - DNA, 18 bp, Homo sapiens
ctcagagagggtgggagt

SEQ ID NO: 2230160 - DNA, 19 bp, Homo sapiens
ctcagagagggtgggagtg

SEQ ID NO: 2230161 - DNA, 19 bp, Homo sapiens
ctcagcaaaagatgcttct

SEQ ID NO: 2230162 - DNA, 14 bp, Homo sapiens
ctcagcctcccaaa

SEQ ID NO: 2230163 - DNA, 16 bp, Homo sapiens
ctcagcctcccaaagt

SEQ ID NO: 2230164 - DNA, 15 bp, Homo sapiens
ctcagcggggacagc

SEQ ID NO: 2230165 - DNA, 20 bp, Homo sapiens
ctcagcggggacagctcctt

SEQ ID NO: 2230166 - DNA, 18 bp, Homo sapiens
ctcaggcaggtgggatgg

SEQ ID NO: 2230167 - DNA, 19 bp, Homo sapiens
ctcaggccaaactcacctg

SEQ ID NO: 2230168 - DNA, 18 bp, Homo sapiens
ctcaggccagctgcttgg

SEQ ID NO: 2230169 - DNA, 22 bp, Homo sapiens
ctcaggccagctgcttgggctt

SEQ ID NO: 2230170 - DNA, 11 bp, Homo sapiens
ctcaggcctgg

SEQ ID NO: 2230171 - DNA, 13 bp, Homo sapiens
ctcaggcctgggg

SEQ ID NO: 2230172 - DNA, 13 bp, Homo sapiens
ctcagggcctggc

SEQ ID NO: 2230173 - DNA, 14 bp, Homo sapiens
ctcagggcctggct

SEQ ID NO: 2230174 - DNA, 17 bp, Homo sapiens
ctcagggtccctggtgg

SEQ ID NO: 2230175 - DNA, 24 bp, Homo sapiens
ctcagggtccctggtggcagctca

SEQ ID NO: 2230176 - DNA, 21 bp, Homo sapiens
ctcaggtggggtcactctggc

SEQ ID NO: 2230177 - DNA, 16 bp, Homo sapiens
ctcaggtgtccctgca

SEQ ID NO: 2230178 - DNA, 18 bp, Homo sapiens
ctcaggtgtccctgcact

SEQ ID NO: 2230179 - DNA, 23 bp, Homo sapiens
ctcaggtgtccctgcacttgcag

SEQ ID NO: 2230180 - DNA, 17 bp, Homo sapiens
ctcagtctggcccttcc

SEQ ID NO: 2230181 - DNA, 13 bp, Homo sapiens
ctcagtgccacta

SEQ ID NO: 2230182 - DNA, 15 bp, Homo sapiens
ctcatacccaccccc

SEQ ID NO: 2230183 - DNA, 21 bp, Homo sapiens
ctcatacccacccccacccaa

SEQ ID NO: 2230184 - DNA, 22 bp, Homo sapiens
ctcatactcacctcaccccact

SEQ ID NO: 2230185 - DNA, 18 bp, Homo sapiens
ctcatagtatggtggctg

SEQ ID NO: 2230186 - DNA, 19 bp, Homo sapiens
ctcatagtatggtggctgg

SEQ ID NO: 2230187 - DNA, 21 bp, Homo sapiens
ctcatagtatggtggctgggt

SEQ ID NO: 2230188 - DNA, 15 bp, Homo sapiens
ctccaaaataaaact

SEQ ID NO: 2230189 - DNA, 16 bp, Homo sapiens
ctccaagaccttctcc

SEQ ID NO: 2230190 - DNA, 17 bp, Homo sapiens
ctccaagaccttctcct

SEQ ID NO: 2230191 - DNA, 13 bp, Homo sapiens
ctccaagcaggac

SEQ ID NO: 2230192 - DNA, 16 bp, Homo sapiens
ctccaagctcccaggc

SEQ ID NO: 2230193 - DNA, 17 bp, Homo sapiens
ctccaagctcccaggca

SEQ ID NO: 2230194 - DNA, 11 bp, Homo sapiens
ctccaccctgc

SEQ ID NO: 2230195 - DNA, 14 bp, Homo sapiens
ctccacctgccagg

SEQ ID NO: 2230196 - DNA, 17 bp, Homo sapiens
ctccacctgccagggac

SEQ ID NO: 2230197 - DNA, 20 bp, Homo sapiens
ctccactttctagccagagg

SEQ ID NO: 2230198 - DNA, 21 bp, Homo sapiens
ctccagaatttcccaaagcag

SEQ ID NO: 2230199 - DNA, 17 bp, Homo sapiens
ctccagacacatgtcca

SEQ ID NO: 2230200 - DNA, 16 bp, Homo sapiens
ctccagagtcagaagt

SEQ ID NO: 2230201 - DNA, 13 bp, Homo sapiens
ctccagcccctgg

SEQ ID NO: 2230202 - DNA, 20 bp, Homo sapiens
ctccagctcaccagccccag

SEQ ID NO: 2230203 - DNA, 19 bp, Homo sapiens
ctccagctgttcagctggt

SEQ ID NO: 2230204 - DNA, 13 bp, Homo sapiens
ctccaggagcagc

SEQ ID NO: 2230205 - DNA, 17 bp, Homo sapiens
ctccaggagcagccaca

SEQ ID NO: 2230206 - DNA, 23 bp, Homo sapiens
ctccaggagcagccacattcctg

SEQ ID NO: 2230207 - DNA, 23 bp, Homo sapiens
ctccaggctcctttagcgcccag

SEQ ID NO: 2230208 - DNA, 20 bp, Homo sapiens
ctccaggctgtatcccatga

SEQ ID NO: 2230209 - DNA, 20 bp, Homo sapiens
ctccaggtgcacaagctcca

SEQ ID NO: 2230210 - DNA, 23 bp, Homo sapiens
ctccaggtgcacaagctccaagc

SEQ ID NO: 2230211 - DNA, 17 bp, Homo sapiens
ctcccaaagtgctggga

SEQ ID NO: 2230212 - DNA, 23 bp, Homo sapiens
ctcccaaagtgctgggattacag

SEQ ID NO: 2230213 - DNA, 17 bp, Homo sapiens
ctcccaactcaccccag

SEQ ID NO: 2230214 - DNA, 22 bp, Homo sapiens
ctcccaactcaccccagcccca

SEQ ID NO: 2230215 - DNA, 15 bp, Homo sapiens
ctcccacaaaggaga

SEQ ID NO: 2230216 - DNA, 14 bp, Homo sapiens
ctcccacctcagcc

SEQ ID NO: 2230217 - DNA, 17 bp, Homo sapiens
ctcccagacccccttgc

SEQ ID NO: 2230218 - DNA, 17 bp, Homo sapiens
ctcccaggcattcccca

SEQ ID NO: 2230219 - DNA, 19 bp, Homo sapiens
ctcccaggcattccccagg

SEQ ID NO: 2230220 - DNA, 20 bp, Homo sapiens
ctcccaggcattccccagga

SEQ ID NO: 2230221 - DNA, 14 bp, Homo sapiens
ctcccatctgtgaa

SEQ ID NO: 2230222 - DNA, 15 bp, Homo sapiens
ctcccatctgtgaaa

SEQ ID NO: 2230223 - DNA, 12 bp, Homo sapiens
ctcccctgctgg

SEQ ID NO: 2230224 - DNA, 19 bp, Homo sapiens
ctcccgaatagctgggact

SEQ ID NO: 2230225 - DNA, 19 bp, Homo sapiens
ctcccgagtagctgggact

SEQ ID NO: 2230226 - DNA, 18 bp, Homo sapiens
ctccctcagtctggccct

SEQ ID NO: 2230227 - DNA, 16 bp, Homo sapiens
ctccctccctctttcc

SEQ ID NO: 2230228 - DNA, 15 bp, Homo sapiens
ctcccttcatccttc

SEQ ID NO: 2230229 - DNA, 10 bp, Homo sapiens
ctcccttcct

SEQ ID NO: 2230230 - DNA, 17 bp, Homo sapiens
ctcccttggattgtccc

SEQ ID NO: 2230231 - DNA, 15 bp, Homo sapiens
ctccgaccagacacc

SEQ ID NO: 2230232 - DNA, 19 bp, Homo sapiens
ctccgctttctacccagcg

SEQ ID NO: 2230233 - DNA, 18 bp, Homo sapiens
ctcctcagatcttctgtg

SEQ ID NO: 2230234 - DNA, 22 bp, Homo sapiens
ctcctctccccagcaagtgaga

SEQ ID NO: 2230235 - DNA, 13 bp, Homo sapiens
ctcctctgctgct

SEQ ID NO: 2230236 - DNA, 14 bp, Homo sapiens
ctcctctgctgctg

SEQ ID NO: 2230237 - DNA, 15 bp, Homo sapiens
ctcctctgctgctgg

SEQ ID NO: 2230238 - DNA, 18 bp, Homo sapiens
ctcctctgctgctggctg

SEQ ID NO: 2230239 - DNA, 11 bp, Homo sapiens
ctcctgcaggc

SEQ ID NO: 2230240 - DNA, 13 bp, Homo sapiens
ctcctgcaggcag

SEQ ID NO: 2230241 - DNA, 15 bp, Homo sapiens
ctcctgcaggcagcc

SEQ ID NO: 2230242 - DNA, 13 bp, Homo sapiens
ctcctgcccccac

SEQ ID NO: 2230243 - DNA, 23 bp, Homo sapiens
ctcctgcccccaccccaggctgg

SEQ ID NO: 2230244 - DNA, 13 bp, Homo sapiens
ctcctgcctcagc

SEQ ID NO: 2230245 - DNA, 18 bp, Homo sapiens
ctcctgcctcgaactggc

SEQ ID NO: 2230246 - DNA, 20 bp, Homo sapiens
ctcctgcctcgaactggctg

SEQ ID NO: 2230247 - DNA, 18 bp, Homo sapiens
ctcctggcccactgcatc

SEQ ID NO: 2230248 - DNA, 16 bp, Homo sapiens
ctcctgtacctcttga

SEQ ID NO: 2230249 - DNA, 20 bp, Homo sapiens
ctcctgtgtgtgcgcctaca

SEQ ID NO: 2230250 - DNA, 24 bp, Homo sapiens
ctcctgtgtgtgcgcctacaggag

SEQ ID NO: 2230251 - DNA, 20 bp, Homo sapiens
ctgttgggccaggagcctcc

SEQ ID NO: 2230252 - DNA, 17 bp, Homo sapiens
ctgtttagataatacac

SEQ ID NO: 2230253 - DNA, 21 bp, Homo sapiens
ctgttttattttaattcagtt

SEQ ID NO: 2230254 - DNA, 16 bp, Homo sapiens
cttaaaaagtggaaaa

SEQ ID NO: 2230255 - DNA, 16 bp, Homo sapiens
cttaaataatgtgaaa

SEQ ID NO: 2230256 - DNA, 19 bp, Homo sapiens
cttaaataatgtgaaactg

SEQ ID NO: 2230257 - DNA, 14 bp, Homo sapiens
cttaatctaaatgg

SEQ ID NO: 2230258 - DNA, 16 bp, Homo sapiens
cttaatctaaatggaa

SEQ ID NO: 2230259 - DNA, 15 bp, Homo sapiens
cttaccagcagagca

SEQ ID NO: 2230260 - DNA, 18 bp, Homo sapiens
cttaccctcatgttctta

SEQ ID NO: 2230261 - DNA, 15 bp, Homo sapiens
cttacgtgagtcctg

SEQ ID NO: 2230262 - DNA, 16 bp, Homo sapiens
cttactgtacatgaaa

SEQ ID NO: 2230263 - DNA, 20 bp, Homo sapiens
cttagaaaaaccaccaccat

SEQ ID NO: 2230264 - DNA, 19 bp, Homo sapiens
cttagacagtccctgccaa

SEQ ID NO: 2230265 - DNA, 23 bp, Homo sapiens
cttagctcattctccttgtgtta

SEQ ID NO: 2230266 - DNA, 21 bp, Homo sapiens
cttagggaaggatacaaaagc

SEQ ID NO: 2230267 - DNA, 17 bp, Homo sapiens
cttaggttggcaaaaag

SEQ ID NO: 2230268 - DNA, 14 bp, Homo sapiens
cttagtcactgaga

SEQ ID NO: 2230269 - DNA, 14 bp, Homo sapiens
cttatgggctgggt

SEQ ID NO: 2230270 - DNA, 18 bp, Homo sapiens
cttattgcccacgctgga

SEQ ID NO: 2230271 - DNA, 13 bp, Homo sapiens
cttcaaggatcct

SEQ ID NO: 2230272 - DNA, 18 bp, Homo sapiens
cttcaaggatcctgagcc

SEQ ID NO: 2230273 - DNA, 19 bp, Homo sapiens
cttcaaggatcctgagcca

SEQ ID NO: 2230274 - DNA, 22 bp, Homo sapiens
cttcaaggatcctgagccagat

SEQ ID NO: 2230275 - DNA, 23 bp, Homo sapiens
cttcaaggatcctgagccagatt

SEQ ID NO: 2230276 - DNA, 14 bp, Homo sapiens
cttcacatattgat

SEQ ID NO: 2230277 - DNA, 23 bp, Homo sapiens
cttcacatattgatttccgttaa

SEQ ID NO: 2230278 - DNA, 17 bp, Homo sapiens
cttcacctttgtcccca

SEQ ID NO: 2230279 - DNA, 20 bp, Homo sapiens
cttcacctttgtccccaccg

SEQ ID NO: 2230280 - DNA, 22 bp, Homo sapiens
cttcacctttgtccccaccgca

SEQ ID NO: 2230281 - DNA, 15 bp, Homo sapiens
cttcacggaagagcc

SEQ ID NO: 2230282 - DNA, 19 bp, Homo sapiens
cttcacggaagagccttgc

SEQ ID NO: 2230283 - DNA, 17 bp, Homo sapiens
cttcagagactcctgca

SEQ ID NO: 2230284 - DNA, 20 bp, Homo sapiens
cttcagagactcctgcaggc

SEQ ID NO: 2230285 - DNA, 23 bp, Homo sapiens
cttcagagactcctgcaggcagc

SEQ ID NO: 2230286 - DNA, 20 bp, Homo sapiens
cttcagcctcccgagtagct

SEQ ID NO: 2230287 - DNA, 19 bp, Homo sapiens
cttcagctgacttttctgt

SEQ ID NO: 2230288 - DNA, 15 bp, Homo sapiens
cttcagtaagccgtg

SEQ ID NO: 2230289 - DNA, 23 bp, Homo sapiens
cttcagtaagccgtgattttcat

SEQ ID NO: 2230290 - DNA, 14 bp, Homo sapiens
cttcagtgccaaaa

SEQ ID NO: 2230291 - DNA, 14 bp, Homo sapiens
cttcagtgccttat

SEQ ID NO: 2230292 - DNA, 18 bp, Homo sapiens
cttcagtgccttatggaa

SEQ ID NO: 2230293 - DNA, 17 bp, Homo sapiens
cttcagtggcagctgct

SEQ ID NO: 2230294 - DNA, 14 bp, Homo sapiens
cttccacaagagcc

SEQ ID NO: 2230295 - DNA, 15 bp, Homo sapiens
cttccaggctgggag

SEQ ID NO: 2230296 - DNA, 19 bp, Homo sapiens
cttccaggctgggagagcc

SEQ ID NO: 2230297 - DNA, 15 bp, Homo sapiens
cttccaggggtggga

SEQ ID NO: 2230298 - DNA, 17 bp, Homo sapiens
cttccaggggtgggaca

SEQ ID NO: 2230299 - DNA, 15 bp, Homo sapiens
cttccagtgaggctc

SEQ ID NO: 2230300 - DNA, 20 bp, Homo sapiens
cttccagtgaggctctgccc

SEQ ID NO: 2230301 - DNA, 17 bp, Homo sapiens
cttccctacagttgaaa

SEQ ID NO: 2230302 - DNA, 12 bp, Homo sapiens
cttcctccctcc

SEQ ID NO: 2230303 - DNA, 14 bp, Homo sapiens
cttcctccctccct

SEQ ID NO: 2230304 - DNA, 14 bp, Homo sapiens
cttcgctcctgtgt

SEQ ID NO: 2230305 - DNA, 17 bp, Homo sapiens
cttcgctcctgtgtctt

SEQ ID NO: 2230306 - DNA, 21 bp, Homo sapiens
cttctcactgccatgccagct

SEQ ID NO: 2230307 - DNA, 16 bp, Homo sapiens
cttctccaccctgctc

SEQ ID NO: 2230308 - DNA, 21 bp, Homo sapiens
cttctccaccctgctctccga

SEQ ID NO: 2230309 - DNA, 14 bp, Homo sapiens
cttctccaggctgt

SEQ ID NO: 2230310 - DNA, 17 bp, Homo sapiens
cttctccaggctgtatc

SEQ ID NO: 2230311 - DNA, 19 bp, Homo sapiens
cttctccttcacctttgtc

SEQ ID NO: 2230312 - DNA, 19 bp, Homo sapiens
cttctctccagcccctgga

SEQ ID NO: 2230313 - DNA, 13 bp, Homo sapiens
cttctctgaagga

SEQ ID NO: 2230314 - DNA, 19 bp, Homo sapiens
cttctgaacttggcgctgc

SEQ ID NO: 2230315 - DNA, 16 bp, Homo sapiens
cttctgacccatgctg

SEQ ID NO: 2230316 - DNA, 18 bp, Homo sapiens
cttctgacccatgctgcc

SEQ ID NO: 2230317 - DNA, 21 bp, Homo sapiens
cttctgacccatgctgccctg

SEQ ID NO: 2230318 - DNA, 17 bp, Homo sapiens
cttctgccatattctgt

SEQ ID NO: 2230319 - DNA, 20 bp, Homo sapiens
cttctgccatttctgagatc

SEQ ID NO: 2230320 - DNA, 13 bp, Homo sapiens
cttctgcttcagc

SEQ ID NO: 2230321 - DNA, 18 bp, Homo sapiens
cttctgcttcagcctccc

SEQ ID NO: 2230322 - DNA, 14 bp, Homo sapiens
cttctgtacgtctg

SEQ ID NO: 2230323 - DNA, 21 bp, Homo sapiens
cttctgtacgtctgacaggca

SEQ ID NO: 2230324 - DNA, 16 bp, Homo sapiens
cttctgtcctactctg

SEQ ID NO: 2230325 - DNA, 21 bp, Homo sapiens
cttcttcagagactcctgcag

SEQ ID NO: 2230326 - DNA, 19 bp, Homo sapiens
cttgaaaaaaaaaaacaca

SEQ ID NO: 2230327 - DNA, 23 bp, Homo sapiens
cttgaaaaaaaaaaacacaaaaa

SEQ ID NO: 2230328 - DNA, 14 bp, Homo sapiens
cttgaactcctggc

SEQ ID NO: 2230329 - DNA, 12 bp, Homo sapiens
cttgacagggca

SEQ ID NO: 2230330 - DNA, 14 bp, Homo sapiens
cttgacagggcaca

SEQ ID NO: 2230331 - DNA, 15 bp, Homo sapiens
cttgacagggcacac

SEQ ID NO: 2230332 - DNA, 16 bp, Homo sapiens
cttgagcctgggaggt

SEQ ID NO: 2230333 - DNA, 15 bp, Homo sapiens
cttgagccttgaact

SEQ ID NO: 2230334 - DNA, 17 bp, Homo sapiens
cttgagccttgaacttt

SEQ ID NO: 2230335 - DNA, 19 bp, Homo sapiens
cttgagccttgaactttga

SEQ ID NO: 2230336 - DNA, 15 bp, Homo sapiens
cttgagggttgggct

SEQ ID NO: 2230337 - DNA, 18 bp, Homo sapiens
cttgagttgattcagctc

SEQ ID NO: 2230338 - DNA, 19 bp, Homo sapiens
cttgagttgattcagctct

SEQ ID NO: 2230339 - DNA, 17 bp, Homo sapiens
cttgatatcctctttga

SEQ ID NO: 2230340 - DNA, 19 bp, Homo sapiens
cttgattcataatgactta

SEQ ID NO: 2230341 - DNA, 17 bp, Homo sapiens
cttgcaatggcagcctt

SEQ ID NO: 2230342 - DNA, 20 bp, Homo sapiens
cttgcagactctacagaggc

SEQ ID NO: 2230343 - DNA, 16 bp, Homo sapiens
cttgctctgctgacag

SEQ ID NO: 2230344 - DNA, 13 bp, Homo sapiens
cttgcttgctttt

SEQ ID NO: 2230345 - DNA, 16 bp, Homo sapiens
cttggaaatgggagac

SEQ ID NO: 2230346 - DNA, 20 bp, Homo sapiens
cttggattgtccccgaccct

SEQ ID NO: 2230347 - DNA, 22 bp, Homo sapiens
cttggattgtccccgacccttg

SEQ ID NO: 2230348 - DNA, 23 bp, Homo sapiens
cttggattgtccccgacccttgc

SEQ ID NO: 2230349 - DNA, 17 bp, Homo sapiens
cttggcgctgcccctgg

SEQ ID NO: 2230350 - DNA, 22 bp, Homo sapiens
cttggcgctgcccctggcagcc

SEQ ID NO: 2230351 - DNA, 20 bp, Homo sapiens
cttgggccactgtgaagaga

SEQ ID NO: 2230352 - DNA, 18 bp, Homo sapiens
cttggggaccagagctgc

SEQ ID NO: 2230353 - DNA, 15 bp, Homo sapiens
cttggggggctgagg

SEQ ID NO: 2230354 - DNA, 22 bp, Homo sapiens
cttggggggctgaggtgggagg

SEQ ID NO: 2230355 - DNA, 14 bp, Homo sapiens
cttggtcctgctgc

SEQ ID NO: 2230356 - DNA, 19 bp, Homo sapiens
cttggtgtcgggcatgaca

SEQ ID NO: 2230357 - DNA, 20 bp, Homo sapiens
cttggtttgtaaattaactt

SEQ ID NO: 2230358 - DNA, 15 bp, Homo sapiens
cttgtacataatgcg

SEQ ID NO: 2230359 - DNA, 13 bp, Homo sapiens
cttgtctttggac

SEQ ID NO: 2230360 - DNA, 18 bp, Homo sapiens
cttgtctttggaccctga

SEQ ID NO: 2230361 - DNA, 13 bp, Homo sapiens
cttgtggacacag

SEQ ID NO: 2230362 - DNA, 18 bp, Homo sapiens
cttgtggacacagctctt

SEQ ID NO: 2230363 - DNA, 16 bp, Homo sapiens
cttgtggtcccacccc

SEQ ID NO: 2230364 - DNA, 19 bp, Homo sapiens
cttgtggtcccaccccaca

SEQ ID NO: 2230365 - DNA, 20 bp, Homo sapiens
cttgtgtgtttattgtcaaa

SEQ ID NO: 2230366 - DNA, 21 bp, Homo sapiens
cttgtgtgtttattgtcaaag

SEQ ID NO: 2230367 - DNA, 16 bp, Homo sapiens
cttgttaagatagtta

SEQ ID NO: 2230368 - DNA, 19 bp, Homo sapiens
ctttaccttttttatacat

SEQ ID NO: 2230369 - DNA, 22 bp, Homo sapiens
ctttaccttttttatacataaa

SEQ ID NO: 2230370 - DNA, 14 bp, Homo sapiens
ctttcaataggaaa

SEQ ID NO: 2230371 - DNA, 14 bp, Homo sapiens
ctttcacccttttc

SEQ ID NO: 2230372 - DNA, 23 bp, Homo sapiens
ctttcagccaagaattcttaaat

SEQ ID NO: 2230373 - DNA, 18 bp, Homo sapiens
ctttccaaatgcccagct

SEQ ID NO: 2230374 - DNA, 22 bp, Homo sapiens
gatcaaccccttcgctcctgtg

SEQ ID NO: 2230375 - DNA, 14 bp, Homo sapiens
gatcacagcctctg

SEQ ID NO: 2230376 - DNA, 13 bp, Homo sapiens
gatcacgccactg

SEQ ID NO: 2230377 - DNA, 15 bp, Homo sapiens
gatcacgccactgca

SEQ ID NO: 2230378 - DNA, 16 bp, Homo sapiens
gatcacgccactgcac

SEQ ID NO: 2230379 - DNA, 16 bp, Homo sapiens
gatcacggctcactgc

SEQ ID NO: 2230380 - DNA, 16 bp, Homo sapiens
gatcatccactgtgcc

SEQ ID NO: 2230381 - DNA, 17 bp, Homo sapiens
gatcatccactgtgcca

SEQ ID NO: 2230382 - DNA, 19 bp, Homo sapiens
gatcatccactgtgccatg

SEQ ID NO: 2230383 - DNA, 21 bp, Homo sapiens
gatcatccactgtgccatgtg

SEQ ID NO: 2230384 - DNA, 16 bp, Homo sapiens
gatccaagctggtccc

SEQ ID NO: 2230385 - DNA, 18 bp, Homo sapiens
gatccacccacctcagcc

SEQ ID NO: 2230386 - DNA, 18 bp, Homo sapiens
gatcctagttccaccatc

SEQ ID NO: 2230387 - DNA, 19 bp, Homo sapiens
gatcctcccacctcagcct

SEQ ID NO: 2230388 - DNA, 21 bp, Homo sapiens
gatcctcccacctcagcctcc

SEQ ID NO: 2230389 - DNA, 13 bp, Homo sapiens
gatcctgagccag

SEQ ID NO: 2230390 - DNA, 14 bp, Homo sapiens
gatcctgagccaga

SEQ ID NO: 2230391 - DNA, 21 bp, Homo sapiens
gatcctgagccagatttcact

SEQ ID NO: 2230392 - DNA, 18 bp, Homo sapiens
gatctgggttcactgcaa

SEQ ID NO: 2230393 - DNA, 19 bp, Homo sapiens
gatcttctttataattcta

SEQ ID NO: 2230394 - DNA, 16 bp, Homo sapiens
gatctttgcagacagg

SEQ ID NO: 2230395 - DNA, 18 bp, Homo sapiens
gatctttgcagacaggca

SEQ ID NO: 2230396 - DNA, 23 bp, Homo sapiens
gatgagaaataaagtttctgttg

SEQ ID NO: 2230397 - DNA, 16 bp, Homo sapiens
gatgagaggaaatcac

SEQ ID NO: 2230398 - DNA, 13 bp, Homo sapiens
gatgcaccagccc

SEQ ID NO: 2230399 - DNA, 14 bp, Homo sapiens
gatgcaccagccct

SEQ ID NO: 2230400 - DNA, 12 bp, Homo sapiens
gatgcagcctca

SEQ ID NO: 2230401 - DNA, 14 bp, Homo sapiens
gatgcagcctcaca

SEQ ID NO: 2230402 - DNA, 18 bp, Homo sapiens
gatgcctggtggcagctg

SEQ ID NO: 2230403 - DNA, 20 bp, Homo sapiens
gatgcctggtggcagctgcg

SEQ ID NO: 2230404 - DNA, 20 bp, Homo sapiens
gatgcttcttcagagactcc

SEQ ID NO: 2230405 - DNA, 23 bp, Homo sapiens
gatggggctgcaccggctggcct

SEQ ID NO: 2230406 - DNA, 19 bp, Homo sapiens
gatgggtgcttggaggaag

SEQ ID NO: 2230407 - DNA, 18 bp, Homo sapiens
gatgttctagcatggctg

SEQ ID NO: 2230408 - DNA, 21 bp, Homo sapiens
gatgttctttcacccttttct

SEQ ID NO: 2230409 - DNA, 15 bp, Homo sapiens
gattaaacttaatct

SEQ ID NO: 2230410 - DNA, 12 bp, Homo sapiens
gattaaattctt

SEQ ID NO: 2230411 - DNA, 21 bp, Homo sapiens
gattaaccacttcagctgact

SEQ ID NO: 2230412 - DNA, 23 bp, Homo sapiens
gattacaagcgtgagccactgca

SEQ ID NO: 2230413 - DNA, 19 bp, Homo sapiens
gattcaacaggttttcctg

SEQ ID NO: 2230414 - DNA, 12 bp, Homo sapiens
gattcagacagc

SEQ ID NO: 2230415 - DNA, 17 bp, Homo sapiens
gattcagacagctgcct

SEQ ID NO: 2230416 - DNA, 16 bp, Homo sapiens
gattcccaagctctgc

SEQ ID NO: 2230417 - DNA, 17 bp, Homo sapiens
gattcccaagctctgct

SEQ ID NO: 2230418 - DNA, 20 bp, Homo sapiens
gattcccaagctctgctcct

SEQ ID NO: 2230419 - DNA, 22 bp, Homo sapiens
gattcccaagctctgctcctct

SEQ ID NO: 2230420 - DNA, 17 bp, Homo sapiens
gattctcctgcctcagc

SEQ ID NO: 2230421 - DNA, 21 bp, Homo sapiens
gattctcctgcctcagcctcc

SEQ ID NO: 2230422 - DNA, 18 bp, Homo sapiens
gattcttcctccctccct

SEQ ID NO: 2230423 - DNA, 20 bp, Homo sapiens
gattcttctgcttcagcctc

SEQ ID NO: 2230424 - DNA, 21 bp, Homo sapiens
gattcttctgcttcagcctcc

SEQ ID NO: 2230425 - DNA, 19 bp, Homo sapiens
gattctttcctgaggctgg

SEQ ID NO: 2230426 - DNA, 20 bp, Homo sapiens
gattgtgtctcttggtcctg

SEQ ID NO: 2230427 - DNA, 14 bp, Homo sapiens
gatttaacagaaat

SEQ ID NO: 2230428 - DNA, 15 bp, Homo sapiens
gatttaacagaaatg

SEQ ID NO: 2230429 - DNA, 17 bp, Homo sapiens
gatttaacagaaatgta

SEQ ID NO: 2230430 - DNA, 23 bp, Homo sapiens
gatttaacagaaatgtacagcaa

SEQ ID NO: 2230431 - DNA, 17 bp, Homo sapiens
gatttcactctccttgg

SEQ ID NO: 2230432 - DNA, 18 bp, Homo sapiens
gatttccgttaaaatacc

SEQ ID NO: 2230433 - DNA, 22 bp, Homo sapiens
gatttccgttaaaataccagcc

SEQ ID NO: 2230434 - DNA, 19 bp, Homo sapiens
gatttctgtttagataata

SEQ ID NO: 2230435 - DNA, 21 bp, Homo sapiens
gatttctgtttagataataca

SEQ ID NO: 2230436 - DNA, 19 bp, Homo sapiens
gatttgttaatgatagcta

SEQ ID NO: 2230437 - DNA, 17 bp, Homo sapiens
gatttttttttccttca

SEQ ID NO: 2230438 - DNA, 18 bp, Homo sapiens
gatttttttttccttcag

SEQ ID NO: 2230439 - DNA, 21 bp, Homo sapiens
gatttttttttccttcagtgc

SEQ ID NO: 2230440 - DNA, 16 bp, Homo sapiens
gcaaaagatgcttctc

SEQ ID NO: 2230441 - DNA, 17 bp, Homo sapiens
gcaaaagatgcttctca

SEQ ID NO: 2230442 - DNA, 15 bp, Homo sapiens
gcaaaccatcattga

SEQ ID NO: 2230443 - DNA, 20 bp, Homo sapiens
gcaaaccatcattgaaatct

SEQ ID NO: 2230444 - DNA, 13 bp, Homo sapiens
gcaaccaccacca

SEQ ID NO: 2230445 - DNA, 14 bp, Homo sapiens
gcaacccccagcct

SEQ ID NO: 2230446 - DNA, 22 bp, Homo sapiens
gcaaccctggtgaccagcacca

SEQ ID NO: 2230447 - DNA, 16 bp, Homo sapiens
gcaagcacctcctgcc

SEQ ID NO: 2230448 - DNA, 20 bp, Homo sapiens
gcaagcacctcctgcctcga

SEQ ID NO: 2230449 - DNA, 18 bp, Homo sapiens
gcaaggctgtcaattaca

SEQ ID NO: 2230450 - DNA, 11 bp, Homo sapiens
gcaataaagca

SEQ ID NO: 2230451 - DNA, 23 bp, Homo sapiens
gcaataaggggagagtaaccctg

SEQ ID NO: 2230452 - DNA, 13 bp, Homo sapiens
gcaatgacctttc

SEQ ID NO: 2230453 - DNA, 14 bp, Homo sapiens
gcaatgacctttca

SEQ ID NO: 2230454 - DNA, 20 bp, Homo sapiens
gcaatgacctttcaatagga

SEQ ID NO: 2230455 - DNA, 23 bp, Homo sapiens
gcaatgacctttcaataggaaaa

SEQ ID NO: 2230456 - DNA, 13 bp, Homo sapiens
gcaatggcagcct

SEQ ID NO: 2230457 - DNA, 21 bp, Homo sapiens
gcacaagctccaagctcccag

SEQ ID NO: 2230458 - DNA, 22 bp, Homo sapiens
gcacaagctccaagctcccagg

SEQ ID NO: 2230459 - DNA, 23 bp, Homo sapiens
gcacaagctccaagctcccaggc

SEQ ID NO: 2230460 - DNA, 14 bp, Homo sapiens
gcacacaccagagc

SEQ ID NO: 2230461 - DNA, 15 bp, Homo sapiens
gcacacaccagagcc

SEQ ID NO: 2230462 - DNA, 16 bp, Homo sapiens
gcacacaccagagccc

SEQ ID NO: 2230463 - DNA, 20 bp, Homo sapiens
gcacaccgggcactcagaag

SEQ ID NO: 2230464 - DNA, 21 bp, Homo sapiens
gcacagaaaatggaagacagc

SEQ ID NO: 2230465 - DNA, 22 bp, Homo sapiens
gcacagaaaatggaagacagct

SEQ ID NO: 2230466 - DNA, 20 bp, Homo sapiens
gcacagaccctgccctgtgg

SEQ ID NO: 2230467 - DNA, 16 bp, Homo sapiens
gcacagcttcatttcc

SEQ ID NO: 2230468 - DNA, 23 bp, Homo sapiens
gcacagcttcatttcctgtgtct

SEQ ID NO: 2230469 - DNA, 19 bp, Homo sapiens
gcacatcagcacgatttct

SEQ ID NO: 2230470 - DNA, 20 bp, Homo sapiens
gcacatcagcacgatttctg

SEQ ID NO: 2230471 - DNA, 21 bp, Homo sapiens
gcacatcagcacgatttctgt

SEQ ID NO: 2230472 - DNA, 17 bp, Homo sapiens
gcacatgcctctctcag

SEQ ID NO: 2230473 - DNA, 19 bp, Homo sapiens
gcacatgcctctctcaggc

SEQ ID NO: 2230474 - DNA, 21 bp, Homo sapiens
gcacatgcctctctcaggcca

SEQ ID NO: 2230475 - DNA, 13 bp, Homo sapiens
gcaccagcagcct

SEQ ID NO: 2230476 - DNA, 12 bp, Homo sapiens
gcaccataactt

SEQ ID NO: 2230477 - DNA, 14 bp, Homo sapiens
gcaccatctctcct

SEQ ID NO: 2230478 - DNA, 18 bp, Homo sapiens
gcacccccggcccagtgc

SEQ ID NO: 2230479 - DNA, 17 bp, Homo sapiens
gcacccggcccctgctg

SEQ ID NO: 2230480 - DNA, 19 bp, Homo sapiens
gcacccggcccctgctggt

SEQ ID NO: 2230481 - DNA, 18 bp, Homo sapiens
gcaccggctggcctggcc

SEQ ID NO: 2230482 - DNA, 23 bp, Homo sapiens
gcaccggctggcctggcccctca

SEQ ID NO: 2230483 - DNA, 14 bp, Homo sapiens
gcaccgggccacag

SEQ ID NO: 2230484 - DNA, 19 bp, Homo sapiens
gcacctaggtggggcctgg

SEQ ID NO: 2230485 - DNA, 21 bp, Homo sapiens
gcacctggaatatataaccag

SEQ ID NO: 2230486 - DNA, 17 bp, Homo sapiens
gcaccttagacagtccc

SEQ ID NO: 2230487 - DNA, 12 bp, Homo sapiens
gcacgatttctg

SEQ ID NO: 2230488 - DNA, 14 bp, Homo sapiens
gcactataatgtaa

SEQ ID NO: 2230489 - DNA, 20 bp, Homo sapiens
gcactataatgtaagctcta

SEQ ID NO: 2230490 - DNA, 22 bp, Homo sapiens
gcactataatgtaagctctact

SEQ ID NO: 2230491 - DNA, 17 bp, Homo sapiens
gcactccagcctgggtg

SEQ ID NO: 2230492 - DNA, 12 bp, Homo sapiens
gcactctggggt

SEQ ID NO: 2230493 - DNA, 14 bp, Homo sapiens
gcactgcttccagt

SEQ ID NO: 2230494 - DNA, 16 bp, Homo sapiens
gcactgcttccagtga

SEQ ID NO: 2230495 - DNA, 18 bp, Homo sapiens
gcactgcttccagtgagg

SEQ ID NO: 2230496 - DNA, 14 bp, Homo sapiens
gcactgggcttggg

SEQ ID NO: 2230497 - DNA, 13 bp, Homo sapiens
gctgcctgggatc

SEQ ID NO: 2230498 - DNA, 16 bp, Homo sapiens
gctgcctgggatccct

SEQ ID NO: 2230499 - DNA, 20 bp, Homo sapiens
gctgcctgggatccctcatc

SEQ ID NO: 2230500 - DNA, 21 bp, Homo sapiens
gctgcctgggatccctcatcc

SEQ ID NO: 2230501 - DNA, 13 bp, Homo sapiens
gctgcctgttcag

SEQ ID NO: 2230502 - DNA, 18 bp, Homo sapiens
gctgcctgttcagctcca

SEQ ID NO: 2230503 - DNA, 14 bp, Homo sapiens
gctgcggtccaccc

SEQ ID NO: 2230504 - DNA, 18 bp, Homo sapiens
gctgcggtccacccagga

SEQ ID NO: 2230505 - DNA, 15 bp, Homo sapiens
gctgctgaaggctcg

SEQ ID NO: 2230506 - DNA, 22 bp, Homo sapiens
gctgcttttgtctatgggactc

SEQ ID NO: 2230507 - DNA, 14 bp, Homo sapiens
gctggaagcagaaa

SEQ ID NO: 2230508 - DNA, 18 bp, Homo sapiens
gctggaccttgaactggg

SEQ ID NO: 2230509 - DNA, 21 bp, Homo sapiens
gctggaccttgaactgggtac

SEQ ID NO: 2230510 - DNA, 12 bp, Homo sapiens
gctggagtgcag

SEQ ID NO: 2230511 - DNA, 17 bp, Homo sapiens
gctggagtgcagtgagc

SEQ ID NO: 2230512 - DNA, 22 bp, Homo sapiens
gctggagtgcagtgagccgaga

SEQ ID NO: 2230513 - DNA, 13 bp, Homo sapiens
gctggcctggccc

SEQ ID NO: 2230514 - DNA, 17 bp, Homo sapiens
gctggcctggcccctca

SEQ ID NO: 2230515 - DNA, 18 bp, Homo sapiens
gctggcctggcccctcag

SEQ ID NO: 2230516 - DNA, 20 bp, Homo sapiens
gctggcctggcccctcaggg

SEQ ID NO: 2230517 - DNA, 14 bp, Homo sapiens
gctggcgtgcagtg

SEQ ID NO: 2230518 - DNA, 15 bp, Homo sapiens
gctggcgtgcagtgg

SEQ ID NO: 2230519 - DNA, 20 bp, Homo sapiens
gctggctgttggctgggggc

SEQ ID NO: 2230520 - DNA, 18 bp, Homo sapiens
gctgggactacaggcacc

SEQ ID NO: 2230521 - DNA, 12 bp, Homo sapiens
gctgggagagcc

SEQ ID NO: 2230522 - DNA, 19 bp, Homo sapiens
gctgggcagaggaaagcaa

SEQ ID NO: 2230523 - DNA, 16 bp, Homo sapiens
gctgggctcccttccc

SEQ ID NO: 2230524 - DNA, 20 bp, Homo sapiens
gctgggctcccttcccacct

SEQ ID NO: 2230525 - DNA, 18 bp, Homo sapiens
gctgggctgttcactctc

SEQ ID NO: 2230526 - DNA, 17 bp, Homo sapiens
gctgggcttcagtggca

SEQ ID NO: 2230527 - DNA, 18 bp, Homo sapiens
gctgggcttcagtggcag

SEQ ID NO: 2230528 - DNA, 21 bp, Homo sapiens
gctgggcttcagtggcagctg

SEQ ID NO: 2230529 - DNA, 22 bp, Homo sapiens
gctgggcttcagtggcagctgc

SEQ ID NO: 2230530 - DNA, 23 bp, Homo sapiens
gctgggggaagaagctctctcct

SEQ ID NO: 2230531 - DNA, 14 bp, Homo sapiens
gctgggggcctcag

SEQ ID NO: 2230532 - DNA, 19 bp, Homo sapiens
gctggggtggggacctcag

SEQ ID NO: 2230533 - DNA, 17 bp, Homo sapiens
gctgggttctacccagg

SEQ ID NO: 2230534 - DNA, 15 bp, Homo sapiens
gctgggttctgatcc

SEQ ID NO: 2230535 - DNA, 14 bp, Homo sapiens
gctgggttggaggg

SEQ ID NO: 2230536 - DNA, 21 bp, Homo sapiens
gctgggttggagggtgtccca

SEQ ID NO: 2230537 - DNA, 19 bp, Homo sapiens
gctggtcccactcagtcca

SEQ ID NO: 2230538 - DNA, 20 bp, Homo sapiens
gctggtcccactcagtccat

SEQ ID NO: 2230539 - DNA, 21 bp, Homo sapiens
gctggttagaggttccctttg

SEQ ID NO: 2230540 - DNA, 22 bp, Homo sapiens
gctggttcagggttggcccctg

SEQ ID NO: 2230541 - DNA, 23 bp, Homo sapiens
gctggttcagggttggcccctgc

SEQ ID NO: 2230542 - DNA, 20 bp, Homo sapiens
gctgtatcccatgagcctca

SEQ ID NO: 2230543 - DNA, 23 bp, Homo sapiens
gctgtatcccatgagcctcagca

SEQ ID NO: 2230544 - DNA, 19 bp, Homo sapiens
gctgtcaattacaggaagt

SEQ ID NO: 2230545 - DNA, 19 bp, Homo sapiens
gctgtcccttacgtgagtc

SEQ ID NO: 2230546 - DNA, 16 bp, Homo sapiens
gctgtcccttttcctt

SEQ ID NO: 2230547 - DNA, 13 bp, Homo sapiens
gctgtgctctgga

SEQ ID NO: 2230548 - DNA, 15 bp, Homo sapiens
gctgtgctctggaca

SEQ ID NO: 2230549 - DNA, 21 bp, Homo sapiens
gctgtgctctggacaggcatg

SEQ ID NO: 2230550 - DNA, 12 bp, Homo sapiens
gctgtgctgccc

SEQ ID NO: 2230551 - DNA, 13 bp, Homo sapiens
gctgtgctgccct

SEQ ID NO: 2230552 - DNA, 22 bp, Homo sapiens
gctgtgctgccctgcccacctg

SEQ ID NO: 2230553 - DNA, 13 bp, Homo sapiens
gctgttcagctgg

SEQ ID NO: 2230554 - DNA, 14 bp, Homo sapiens
gctgttcagctggt

SEQ ID NO: 2230555 - DNA, 13 bp, Homo sapiens
gctgttggctggg

SEQ ID NO: 2230556 - DNA, 15 bp, Homo sapiens
gctgttggctggggg

SEQ ID NO: 2230557 - DNA, 14 bp, Homo sapiens
gcttaacttcacat

SEQ ID NO: 2230558 - DNA, 16 bp, Homo sapiens
gcttaacttcacatat

SEQ ID NO: 2230559 - DNA, 21 bp, Homo sapiens
gcttagtcactgagacagccc

SEQ ID NO: 2230560 - DNA, 19 bp, Homo sapiens
gcttatctcaggggtgtgc

SEQ ID NO: 2230561 - DNA, 21 bp, Homo sapiens
gcttcaaggatcctgagccag

SEQ ID NO: 2230562 - DNA, 22 bp, Homo sapiens
gcttcaaggatcctgagccaga

SEQ ID NO: 2230563 - DNA, 14 bp, Homo sapiens
gcttcagtggcagc

SEQ ID NO: 2230564 - DNA, 18 bp, Homo sapiens
gcttcagtggcagctgct

SEQ ID NO: 2230565 - DNA, 15 bp, Homo sapiens
gcttcatcctcctca

SEQ ID NO: 2230566 - DNA, 13 bp, Homo sapiens
gcttcatttcctg

SEQ ID NO: 2230567 - DNA, 18 bp, Homo sapiens
gcttcatttcctgtgtct

SEQ ID NO: 2230568 - DNA, 22 bp, Homo sapiens
gcttcctcatagtatggtggct

SEQ ID NO: 2230569 - DNA, 12 bp, Homo sapiens
gcttcttcagag

SEQ ID NO: 2230570 - DNA, 15 bp, Homo sapiens
gcttcttcagagact

SEQ ID NO: 2230571 - DNA, 23 bp, Homo sapiens
gcttgaccgtgaggccagagaca

SEQ ID NO: 2230572 - DNA, 18 bp, Homo sapiens
gcttgacctttaagagaa

SEQ ID NO: 2230573 - DNA, 22 bp, Homo sapiens
gcttgacctttaagagaaatga

SEQ ID NO: 2230574 - DNA, 14 bp, Homo sapiens
gcttgagctcagga

SEQ ID NO: 2230575 - DNA, 16 bp, Homo sapiens
gcttgagggttgggct

SEQ ID NO: 2230576 - DNA, 22 bp, Homo sapiens
gcttgagggttgggctggtgtc

SEQ ID NO: 2230577 - DNA, 19 bp, Homo sapiens
gcttgggcttcatcctcct

SEQ ID NO: 2230578 - DNA, 20 bp, Homo sapiens
gcttggggaccagagctgcc

SEQ ID NO: 2230579 - DNA, 15 bp, Homo sapiens
gctttgtgatttttg

SEQ ID NO: 2230580 - DNA, 18 bp, Homo sapiens
gcttttgtctatgggact

SEQ ID NO: 2230581 - DNA, 21 bp, Homo sapiens
ggaaaaagacctcgtggagaa

SEQ ID NO: 2230582 - DNA, 15 bp, Homo sapiens
ggaaaatcagcctgc

SEQ ID NO: 2230583 - DNA, 19 bp, Homo sapiens
ggaaaatcagcctgctcca

SEQ ID NO: 2230584 - DNA, 20 bp, Homo sapiens
ggaaagacttttccaaccct

SEQ ID NO: 2230585 - DNA, 17 bp, Homo sapiens
ggaaaggctccaggagc

SEQ ID NO: 2230586 - DNA, 22 bp, Homo sapiens
ggaaaggctccaggagcagcca

SEQ ID NO: 2230587 - DNA, 23 bp, Homo sapiens
ggaaatcaccgaaaacgtggctg

SEQ ID NO: 2230588 - DNA, 16 bp, Homo sapiens
ggaaatgggcagagca

SEQ ID NO: 2230589 - DNA, 22 bp, Homo sapiens
ggaaatgggcagagcagagacc

SEQ ID NO: 2230590 - DNA, 21 bp, Homo sapiens
ggaacaaggcaaggctgtcaa

SEQ ID NO: 2230591 - DNA, 23 bp, Homo sapiens
ggaacaaggcaaggctgtcaatt

SEQ ID NO: 2230592 - DNA, 15 bp, Homo sapiens
ggaacactccttcac

SEQ ID NO: 2230593 - DNA, 19 bp, Homo sapiens
ggaacagactggaagcaca

SEQ ID NO: 2230594 - DNA, 16 bp, Homo sapiens
ggaagacaatgtgaaa

SEQ ID NO: 2230595 - DNA, 22 bp, Homo sapiens
ggaagacaatgtgaaaagaaaa

SEQ ID NO: 2230596 - DNA, 17 bp, Homo sapiens
ggaagactttggaaaga

SEQ ID NO: 2230597 - DNA, 15 bp, Homo sapiens
ggaagagaaaaaata

SEQ ID NO: 2230598 - DNA, 15 bp, Homo sapiens
ggaagccacagggtg

SEQ ID NO: 2230599 - DNA, 15 bp, Homo sapiens
ggaagccagcaggct

SEQ ID NO: 2230600 - DNA, 23 bp, Homo sapiens
ggaagccagcaggctctcaggcc

SEQ ID NO: 2230601 - DNA, 15 bp, Homo sapiens
ggaagccgctggggc

SEQ ID NO: 2230602 - DNA, 18 bp, Homo sapiens
ggaagccgctggggccag

SEQ ID NO: 2230603 - DNA, 16 bp, Homo sapiens
ggaagctcagggcctg

SEQ ID NO: 2230604 - DNA, 23 bp, Homo sapiens
ggaaggggagataagggtatctg

SEQ ID NO: 2230605 - DNA, 18 bp, Homo sapiens
ggaataacatgtaattaa

SEQ ID NO: 2230606 - DNA, 16 bp, Homo sapiens
ggaatatataaccagt

SEQ ID NO: 2230607 - DNA, 19 bp, Homo sapiens
ggaatgaatgtcagtgtga

SEQ ID NO: 2230608 - DNA, 22 bp, Homo sapiens
ggacaaggatgatctaggaaga

SEQ ID NO: 2230609 - DNA, 23 bp, Homo sapiens
ggacaaggatgatctaggaagac

SEQ ID NO: 2230610 - DNA, 12 bp, Homo sapiens
ggacaccctgtg

SEQ ID NO: 2230611 - DNA, 17 bp, Homo sapiens
ggacactcaaaagctgg

SEQ ID NO: 2230612 - DNA, 15 bp, Homo sapiens
ggacagccacggcca

SEQ ID NO: 2230613 - DNA, 20 bp, Homo sapiens
ggacagctccttctgtccta

SEQ ID NO: 2230614 - DNA, 23 bp, Homo sapiens
ggacaggcatgttctctgaggac

SEQ ID NO: 2230615 - DNA, 17 bp, Homo sapiens
ggacagggaggtgaccc

SEQ ID NO: 2230616 - DNA, 14 bp, Homo sapiens
ggaccagagctgcc

SEQ ID NO: 2230617 - DNA, 13 bp, Homo sapiens
ggaccctgaggcc

SEQ ID NO: 2230618 - DNA, 14 bp, Homo sapiens
ggaccctgaggccc

SEQ ID NO: 2230619 - DNA, 15 bp, Homo sapiens
ggaccctgaggccca

SEQ ID NO: 2230620 - DNA, 20 bp, Homo sapiens
gtgacagagtgagactctgt

SEQ ID NO: 2230621 - DNA, 22 bp, Homo sapiens
gtgacagagtgagactctgtct

SEQ ID NO: 2230622 - DNA, 17 bp, Homo sapiens
gtgaccaatgatggtca

SEQ ID NO: 2230623 - DNA, 21 bp, Homo sapiens
gtgaccagcaccatctctcct

SEQ ID NO: 2230624 - DNA, 12 bp, Homo sapiens
gtgaccccaggt

SEQ ID NO: 2230625 - DNA, 14 bp, Homo sapiens
gtgacctctgcctg

SEQ ID NO: 2230626 - DNA, 18 bp, Homo sapiens
gtgactgaatttcttttg

SEQ ID NO: 2230627 - DNA, 16 bp, Homo sapiens
gtgagactctgtctca

SEQ ID NO: 2230628 - DNA, 16 bp, Homo sapiens
gtgagcactctggggt

SEQ ID NO: 2230629 - DNA, 13 bp, Homo sapiens
gtgaggccagaga

SEQ ID NO: 2230630 - DNA, 14 bp, Homo sapiens
gtgaggctctgccc

SEQ ID NO: 2230631 - DNA, 19 bp, Homo sapiens
gtgagtactacagtcctcc

SEQ ID NO: 2230632 - DNA, 23 bp, Homo sapiens
gtgagtactacagtcctcccatc

SEQ ID NO: 2230633 - DNA, 22 bp, Homo sapiens
gtgagtcgaggacagggaggtg

SEQ ID NO: 2230634 - DNA, 15 bp, Homo sapiens
gtgatccacccacct

SEQ ID NO: 2230635 - DNA, 20 bp, Homo sapiens
gtgatccacccacctcagcc

SEQ ID NO: 2230636 - DNA, 20 bp, Homo sapiens
gtgatcctcccacctcagcc

SEQ ID NO: 2230637 - DNA, 22 bp, Homo sapiens
gtgatcctcccacctcagcctc

SEQ ID NO: 2230638 - DNA, 18 bp, Homo sapiens
gtgatggggccctgcctc

SEQ ID NO: 2230639 - DNA, 14 bp, Homo sapiens
gtgattctcctgcc

SEQ ID NO: 2230640 - DNA, 16 bp, Homo sapiens
gtgattctcctgcctc

SEQ ID NO: 2230641 - DNA, 18 bp, Homo sapiens
gtgattctcctgcctcag

SEQ ID NO: 2230642 - DNA, 23 bp, Homo sapiens
gtgattctcctgcctcagcctcc

SEQ ID NO: 2230643 - DNA, 13 bp, Homo sapiens
gtgatttttgtaa

SEQ ID NO: 2230644 - DNA, 13 bp, Homo sapiens
gtgcacaagctcc

SEQ ID NO: 2230645 - DNA, 14 bp, Homo sapiens
gtgcacacaccaga

SEQ ID NO: 2230646 - DNA, 17 bp, Homo sapiens
gtgcacacaccagagcc

SEQ ID NO: 2230647 - DNA, 13 bp, Homo sapiens
gtgcataccactt

SEQ ID NO: 2230648 - DNA, 21 bp, Homo sapiens
gtgcataccacttttgttctt

SEQ ID NO: 2230649 - DNA, 22 bp, Homo sapiens
gtgcatgctgtcccttacgtga

SEQ ID NO: 2230650 - DNA, 23 bp, Homo sapiens
gtgcattatctagatactgtatc

SEQ ID NO: 2230651 - DNA, 15 bp, Homo sapiens
gtgccccctggtgga

SEQ ID NO: 2230652 - DNA, 14 bp, Homo sapiens
gtgcctctgggact

SEQ ID NO: 2230653 - DNA, 23 bp, Homo sapiens
gtgccttatggaacactctgaga

SEQ ID NO: 2230654 - DNA, 14 bp, Homo sapiens
gtgcgcctacagga

SEQ ID NO: 2230655 - DNA, 19 bp, Homo sapiens
gtgctatctcccccagccc

SEQ ID NO: 2230656 - DNA, 22 bp, Homo sapiens
gtgctatctcccccagccccat

SEQ ID NO: 2230657 - DNA, 17 bp, Homo sapiens
gtgctctggacaggcat

SEQ ID NO: 2230658 - DNA, 18 bp, Homo sapiens
gtgctctggacaggcatg

SEQ ID NO: 2230659 - DNA, 12 bp, Homo sapiens
gtgctgagtctg

SEQ ID NO: 2230660 - DNA, 17 bp, Homo sapiens
gtgctgagtctgaaggc

SEQ ID NO: 2230661 - DNA, 12 bp, Homo sapiens
gtgctgcattta

SEQ ID NO: 2230662 - DNA, 13 bp, Homo sapiens
gtgctgccctgcc

SEQ ID NO: 2230663 - DNA, 18 bp, Homo sapiens
gtgctgccctgcccacct

SEQ ID NO: 2230664 - DNA, 12 bp, Homo sapiens
gtgcttggagga

SEQ ID NO: 2230665 - DNA, 23 bp, Homo sapiens
gtggaatgcgggggagcaggcag

SEQ ID NO: 2230666 - DNA, 23 bp, Homo sapiens
gtggacacagctcttctccaggc

SEQ ID NO: 2230667 - DNA, 24 bp, Homo sapiens
gtggacacagctcttctccaggct

SEQ ID NO: 2230668 - DNA, 20 bp, Homo sapiens
gtggagaagcggctggcagc

SEQ ID NO: 2230669 - DNA, 21 bp, Homo sapiens
gtggagaatttttactgggga

SEQ ID NO: 2230670 - DNA, 23 bp, Homo sapiens
gtggagaatttttactggggatt

SEQ ID NO: 2230671 - DNA, 17 bp, Homo sapiens
gtggagttcatcttgaa

SEQ ID NO: 2230672 - DNA, 20 bp, Homo sapiens
gtggatgcctggtggcagct

SEQ ID NO: 2230673 - DNA, 21 bp, Homo sapiens
gtggatgcctggtggcagctg

SEQ ID NO: 2230674 - DNA, 20 bp, Homo sapiens
gtggatttaacagaaatgta

SEQ ID NO: 2230675 - DNA, 13 bp, Homo sapiens
gtggcaccagcag

SEQ ID NO: 2230676 - DNA, 18 bp, Homo sapiens
gtggcaccagcagcctgg

SEQ ID NO: 2230677 - DNA, 14 bp, Homo sapiens
gtggcagctcacct

SEQ ID NO: 2230678 - DNA, 14 bp, Homo sapiens
gtggcagctgcggt

SEQ ID NO: 2230679 - DNA, 21 bp, Homo sapiens
gtggcagctgcggtccaccca

SEQ ID NO: 2230680 - DNA, 12 bp, Homo sapiens
gtggcagctgct

SEQ ID NO: 2230681 - DNA, 17 bp, Homo sapiens
gtggcagtgggagctgc

SEQ ID NO: 2230682 - DNA, 14 bp, Homo sapiens
gtggcctcccaact

SEQ ID NO: 2230683 - DNA, 22 bp, Homo sapiens
gtggcctcccaactcaccccag

SEQ ID NO: 2230684 - DNA, 22 bp, Homo sapiens
gtggcgcagcatattcaggaag

SEQ ID NO: 2230685 - DNA, 16 bp, Homo sapiens
gtggctgcttcaagga

SEQ ID NO: 2230686 - DNA, 19 bp, Homo sapiens
gtggctgggttggagggtg

SEQ ID NO: 2230687 - DNA, 22 bp, Homo sapiens
gtgggacaccctgtgatggggc

SEQ ID NO: 2230688 - DNA, 12 bp, Homo sapiens
gtgggagctgag

SEQ ID NO: 2230689 - DNA, 11 bp, Homo sapiens
gtgggagggga

SEQ ID NO: 2230690 - DNA, 19 bp, Homo sapiens
gtgggaggggaagaaaaac

SEQ ID NO: 2230691 - DNA, 23 bp, Homo sapiens
gtgggaggggaagaaaaactcta

SEQ ID NO: 2230692 - DNA, 14 bp, Homo sapiens
gtgggagtgggccc

SEQ ID NO: 2230693 - DNA, 13 bp, Homo sapiens
gtgggatcctcca

SEQ ID NO: 2230694 - DNA, 17 bp, Homo sapiens
gtgggcccaatgcactt

SEQ ID NO: 2230695 - DNA, 20 bp, Homo sapiens
gtggggtcactctggcagct

SEQ ID NO: 2230696 - DNA, 19 bp, Homo sapiens
gtggtatgatcacggctca

SEQ ID NO: 2230697 - DNA, 16 bp, Homo sapiens
gtggtcccaccccaca

SEQ ID NO: 2230698 - DNA, 20 bp, Homo sapiens
gtggtggttttctgttcttt

SEQ ID NO: 2230699 - DNA, 16 bp, Homo sapiens
gtggtgtttcctggca

SEQ ID NO: 2230700 - DNA, 18 bp, Homo sapiens
gtggttatggagagggtg

SEQ ID NO: 2230701 - DNA, 16 bp, Homo sapiens
gtggtttcagaaatgt

SEQ ID NO: 2230702 - DNA, 14 bp, Homo sapiens
gtgtcacctgaaga

SEQ ID NO: 2230703 - DNA, 22 bp, Homo sapiens
gtgtcacctgaagactcattct

SEQ ID NO: 2230704 - DNA, 16 bp, Homo sapiens
gtgtcagcatagaagt

SEQ ID NO: 2230705 - DNA, 18 bp, Homo sapiens
gtgtcaggtggggcagct

SEQ ID NO: 2230706 - DNA, 20 bp, Homo sapiens
gtgtcaggtggggcagcttg

SEQ ID NO: 2230707 - DNA, 15 bp, Homo sapiens
gtgtcgggcatgaca

SEQ ID NO: 2230708 - DNA, 17 bp, Homo sapiens
gtgtctcccttcatcct

SEQ ID NO: 2230709 - DNA, 14 bp, Homo sapiens
gtgtctcttggtcc

SEQ ID NO: 2230710 - DNA, 21 bp, Homo sapiens
gtgtcttgcaatggcagcctt

SEQ ID NO: 2230711 - DNA, 13 bp, Homo sapiens
gtgtgagtcacca

SEQ ID NO: 2230712 - DNA, 13 bp, Homo sapiens
gtgtggagaagcg

SEQ ID NO: 2230713 - DNA, 15 bp, Homo sapiens
gtgtggtgtttcctg

SEQ ID NO: 2230714 - DNA, 23 bp, Homo sapiens
gtgtttcctggcactgcttccag

SEQ ID NO: 2230715 - DNA, 22 bp, Homo sapiens
gttaaaataccagccagtaaat

SEQ ID NO: 2230716 - DNA, 11 bp, Homo sapiens
gttaagagaaa

SEQ ID NO: 2230717 - DNA, 18 bp, Homo sapiens
gttaatgatagctactgt

SEQ ID NO: 2230718 - DNA, 15 bp, Homo sapiens
gttacagacaaagcg

SEQ ID NO: 2230719 - DNA, 17 bp, Homo sapiens
gttacagacaaagcgtg

SEQ ID NO: 2230720 - DNA, 23 bp, Homo sapiens
gttaccattttggggtacccact

SEQ ID NO: 2230721 - DNA, 19 bp, Homo sapiens
gttagtttctccaagcagg

SEQ ID NO: 2230722 - DNA, 21 bp, Homo sapiens
gttatgactccagaatttccc

SEQ ID NO: 2230723 - DNA, 18 bp, Homo sapiens
gttcaagcgattcttctg

SEQ ID NO: 2230724 - DNA, 23 bp, Homo sapiens
gttcaattctcatttgtcacaca

SEQ ID NO: 2230725 - DNA, 17 bp, Homo sapiens
gttcagggttggcccct

SEQ ID NO: 2230726 - DNA, 19 bp, Homo sapiens
gttcagggttggcccctgc

SEQ ID NO: 2230727 - DNA, 12 bp, Homo sapiens
gttcatcttgaa

SEQ ID NO: 2230728 - DNA, 20 bp, Homo sapiens
gttcccatttgctcctttct

SEQ ID NO: 2230729 - DNA, 20 bp, Homo sapiens
gttccctttgacgccatccc

SEQ ID NO: 2230730 - DNA, 15 bp, Homo sapiens
gttctctcttctcca

SEQ ID NO: 2230731 - DNA, 16 bp, Homo sapiens
gttctctgaggacact

SEQ ID NO: 2230732 - DNA, 11 bp, Homo sapiens
gttctctgccc

SEQ ID NO: 2230733 - DNA, 19 bp, Homo sapiens
gttctgatcctagttccac

SEQ ID NO: 2230734 - DNA, 23 bp, Homo sapiens
gttctggcagagttgaagacaga

SEQ ID NO: 2230735 - DNA, 15 bp, Homo sapiens
gttctgggacacagt

SEQ ID NO: 2230736 - DNA, 17 bp, Homo sapiens
gttcttaattcttagct

SEQ ID NO: 2230737 - DNA, 17 bp, Homo sapiens
gttcttagtttgcagtt

SEQ ID NO: 2230738 - DNA, 14 bp, Homo sapiens
gttctttccaaagt

SEQ ID NO: 2230739 - DNA, 17 bp, Homo sapiens
gttgaaaaacagctgag

SEQ ID NO: 2230740 - DNA, 16 bp, Homo sapiens
gttgaagacagagcta

SEQ ID NO: 2230741 - DNA, 19 bp, Homo sapiens
gttgatagcacagaccctg

SEQ ID NO: 2230742 - DNA, 22 bp, Homo sapiens
gttgatagcacagaccctgccc

SEQ ID NO: 2230743 - DNA, 14 bp, Homo sapiens
tccaagaagcccag

SEQ ID NO: 2230744 - DNA, 19 bp, Homo sapiens
tccaagaagcccaggaaag

SEQ ID NO: 2230745 - DNA, 12 bp, Homo sapiens
tccaagctccca

SEQ ID NO: 2230746 - DNA, 14 bp, Homo sapiens
tccaagctcccagg

SEQ ID NO: 2230747 - DNA, 15 bp, Homo sapiens
tccaagctcccaggc

SEQ ID NO: 2230748 - DNA, 20 bp, Homo sapiens
tccaagctggtcccactcag

SEQ ID NO: 2230749 - DNA, 18 bp, Homo sapiens
tccaagggtactaaggaa

SEQ ID NO: 2230750 - DNA, 18 bp, Homo sapiens
tccaatttacatactctg

SEQ ID NO: 2230751 - DNA, 16 bp, Homo sapiens
tccacaagagcccagg

SEQ ID NO: 2230752 - DNA, 17 bp, Homo sapiens
tccacaagagcccaggc

SEQ ID NO: 2230753 - DNA, 18 bp, Homo sapiens
tccacaagagcccaggcc

SEQ ID NO: 2230754 - DNA, 18 bp, Homo sapiens
tccacccacctcagcctc

SEQ ID NO: 2230755 - DNA, 13 bp, Homo sapiens
tccaccctgctct

SEQ ID NO: 2230756 - DNA, 14 bp, Homo sapiens
tccaccctgctctc

SEQ ID NO: 2230757 - DNA, 13 bp, Homo sapiens
tccacctgccagg

SEQ ID NO: 2230758 - DNA, 21 bp, Homo sapiens
tccacctgccagggacagagg

SEQ ID NO: 2230759 - DNA, 20 bp, Homo sapiens
tccactttctagccagagga

SEQ ID NO: 2230760 - DNA, 14 bp, Homo sapiens
tccagaatttccca

SEQ ID NO: 2230761 - DNA, 15 bp, Homo sapiens
tccagaatttcccaa

SEQ ID NO: 2230762 - DNA, 20 bp, Homo sapiens
tccagaatttcccaaagcag

SEQ ID NO: 2230763 - DNA, 22 bp, Homo sapiens
tccagaatttcccaaagcagtg

SEQ ID NO: 2230764 - DNA, 13 bp, Homo sapiens
tccagacacatgt

SEQ ID NO: 2230765 - DNA, 23 bp, Homo sapiens
tccagccaaagcctcctccagcc

SEQ ID NO: 2230766 - DNA, 12 bp, Homo sapiens
tccagcccctgg

SEQ ID NO: 2230767 - DNA, 13 bp, Homo sapiens
tccagcccctgga

SEQ ID NO: 2230768 - DNA, 15 bp, Homo sapiens
tccagcccctggatg

SEQ ID NO: 2230769 - DNA, 16 bp, Homo sapiens
tccagcccctggatgc

SEQ ID NO: 2230770 - DNA, 11 bp, Homo sapiens
tccagcctggg

SEQ ID NO: 2230771 - DNA, 13 bp, Homo sapiens
tccagcctgggtg

SEQ ID NO: 2230772 - DNA, 24 bp, Homo sapiens
tccagcctgggtgacagagcaagt

SEQ ID NO: 2230773 - DNA, 14 bp, Homo sapiens
tccaggagcagcca

SEQ ID NO: 2230774 - DNA, 22 bp, Homo sapiens
tccaggagcagccacattcctg

SEQ ID NO: 2230775 - DNA, 12 bp, Homo sapiens
tccaggctcctt

SEQ ID NO: 2230776 - DNA, 14 bp, Homo sapiens
tccaggctgggaga

SEQ ID NO: 2230777 - DNA, 18 bp, Homo sapiens
tccaggctgggagagcct

SEQ ID NO: 2230778 - DNA, 21 bp, Homo sapiens
tccaggctgtatcccatgagc

SEQ ID NO: 2230779 - DNA, 20 bp, Homo sapiens
tccaggtgcacaagctccaa

SEQ ID NO: 2230780 - DNA, 14 bp, Homo sapiens
tccagtatcttgaa

SEQ ID NO: 2230781 - DNA, 17 bp, Homo sapiens
tccagtgaggctctgcc

SEQ ID NO: 2230782 - DNA, 19 bp, Homo sapiens
tccagtgaggctctgccct

SEQ ID NO: 2230783 - DNA, 16 bp, Homo sapiens
tccatgagtcccctgt

SEQ ID NO: 2230784 - DNA, 20 bp, Homo sapiens
tccatgtgggctagttgggc

SEQ ID NO: 2230785 - DNA, 18 bp, Homo sapiens
tcccaaacccttcagtgc

SEQ ID NO: 2230786 - DNA, 13 bp, Homo sapiens
tcccaactcaccc

SEQ ID NO: 2230787 - DNA, 14 bp, Homo sapiens
tcccaactcacccc

SEQ ID NO: 2230788 - DNA, 15 bp, Homo sapiens
tcccaactcacccca

SEQ ID NO: 2230789 - DNA, 17 bp, Homo sapiens
tcccaactcaccccagc

SEQ ID NO: 2230790 - DNA, 12 bp, Homo sapiens
tcccaagctctg

SEQ ID NO: 2230791 - DNA, 15 bp, Homo sapiens
tcccaagctctgctc

SEQ ID NO: 2230792 - DNA, 11 bp, Homo sapiens
tcccaccccac

SEQ ID NO: 2230793 - DNA, 14 bp, Homo sapiens
tcccaccccacaca

SEQ ID NO: 2230794 - DNA, 16 bp, Homo sapiens
tcccaccccctccccg

SEQ ID NO: 2230795 - DNA, 20 bp, Homo sapiens
tcccaccccctccccgggca

SEQ ID NO: 2230796 - DNA, 22 bp, Homo sapiens
tcccacctctctcactccttga

SEQ ID NO: 2230797 - DNA, 16 bp, Homo sapiens
tcccaccttggctgca

SEQ ID NO: 2230798 - DNA, 18 bp, Homo sapiens
tcccaccttggctgcagg

SEQ ID NO: 2230799 - DNA, 14 bp, Homo sapiens
tcccactcagtcca

SEQ ID NO: 2230800 - DNA, 22 bp, Homo sapiens
tcccagacccccttgcccaggc

SEQ ID NO: 2230801 - DNA, 23 bp, Homo sapiens
tcccagacccccttgcccaggcc

SEQ ID NO: 2230802 - DNA, 18 bp, Homo sapiens
tcccagatacttgggggg

SEQ ID NO: 2230803 - DNA, 17 bp, Homo sapiens
tcccaggcattccccag

SEQ ID NO: 2230804 - DNA, 21 bp, Homo sapiens
tcccaggcattccccaggagg

SEQ ID NO: 2230805 - DNA, 15 bp, Homo sapiens
tcccatatgcctggg

SEQ ID NO: 2230806 - DNA, 22 bp, Homo sapiens
tcccatatgcctgggcagaagg

SEQ ID NO: 2230807 - DNA, 21 bp, Homo sapiens
tcccatctgtgaaaggaaaga

SEQ ID NO: 2230808 - DNA, 22 bp, Homo sapiens
tcccatgagcctcagcatcctg

SEQ ID NO: 2230809 - DNA, 23 bp, Homo sapiens
tccccaccctgaaagccctgagc

SEQ ID NO: 2230810 - DNA, 15 bp, Homo sapiens
tccccaccgcagaca

SEQ ID NO: 2230811 - DNA, 17 bp, Homo sapiens
tccccaccgcagacagg

SEQ ID NO: 2230812 - DNA, 18 bp, Homo sapiens
tccccaccgcagacagga

SEQ ID NO: 2230813 - DNA, 20 bp, Homo sapiens
tccccagattgcaacaggct

SEQ ID NO: 2230814 - DNA, 20 bp, Homo sapiens
tccccagcaagtgagagctg

SEQ ID NO: 2230815 - DNA, 21 bp, Homo sapiens
tccccagcaagtgagagctgg

SEQ ID NO: 2230816 - DNA, 15 bp, Homo sapiens
tcccccagccccatc

SEQ ID NO: 2230817 - DNA, 21 bp, Homo sapiens
tcccccttccatggactttgt

SEQ ID NO: 2230818 - DNA, 15 bp, Homo sapiens
tccccgggcagcaga

SEQ ID NO: 2230819 - DNA, 19 bp, Homo sapiens
tcccctgtagagtgggagc

SEQ ID NO: 2230820 - DNA, 21 bp, Homo sapiens
tcccctgtttgtttctgaaag

SEQ ID NO: 2230821 - DNA, 16 bp, Homo sapiens
tcccgagtagctggga

SEQ ID NO: 2230822 - DNA, 20 bp, Homo sapiens
tcccgagtagctgggactac

SEQ ID NO: 2230823 - DNA, 21 bp, Homo sapiens
tccctcagtctggcccttcct

SEQ ID NO: 2230824 - DNA, 18 bp, Homo sapiens
tccctcccttcctctttc

SEQ ID NO: 2230825 - DNA, 17 bp, Homo sapiens
tccctctggggctgttc

SEQ ID NO: 2230826 - DNA, 18 bp, Homo sapiens
tccctctttccctccctt

SEQ ID NO: 2230827 - DNA, 11 bp, Homo sapiens
tccctgaaggc

SEQ ID NO: 2230828 - DNA, 16 bp, Homo sapiens
tccctgccaatggact

SEQ ID NO: 2230829 - DNA, 18 bp, Homo sapiens
tccctgcggaagccacag

SEQ ID NO: 2230830 - DNA, 21 bp, Homo sapiens
tccctgcggaagccacagggt

SEQ ID NO: 2230831 - DNA, 22 bp, Homo sapiens
tccctggtggcagctcacctct

SEQ ID NO: 2230832 - DNA, 16 bp, Homo sapiens
tcccttcccacctctc

SEQ ID NO: 2230833 - DNA, 17 bp, Homo sapiens
tcccttcccacctctct

SEQ ID NO: 2230834 - DNA, 16 bp, Homo sapiens
tcccttcctctttcca

SEQ ID NO: 2230835 - DNA, 20 bp, Homo sapiens
tcccttggattgtccccgac

SEQ ID NO: 2230836 - DNA, 22 bp, Homo sapiens
tccctttccaaatgcccagctt

SEQ ID NO: 2230837 - DNA, 21 bp, Homo sapiens
tccctttgacgccatcccagc

SEQ ID NO: 2230838 - DNA, 22 bp, Homo sapiens
tccctttgacgccatcccagcc

SEQ ID NO: 2230839 - DNA, 22 bp, Homo sapiens
tcccttttttggctgctgaagg

SEQ ID NO: 2230840 - DNA, 23 bp, Homo sapiens
tcccttttttggctgctgaaggc

SEQ ID NO: 2230841 - DNA, 13 bp, Homo sapiens
tccgaccagacac

SEQ ID NO: 2230842 - DNA, 21 bp, Homo sapiens
tccgctttctacccagcgagc

SEQ ID NO: 2230843 - DNA, 21 bp, Homo sapiens
tcctaagctattcagtaataa

SEQ ID NO: 2230844 - DNA, 16 bp, Homo sapiens
tcctaatcttctgaac

SEQ ID NO: 2230845 - DNA, 14 bp, Homo sapiens
tcctactctgtgtc

SEQ ID NO: 2230846 - DNA, 21 bp, Homo sapiens
tcctagaaattccccaccctg

SEQ ID NO: 2230847 - DNA, 21 bp, Homo sapiens
tcctagcctgtgcctctggga

SEQ ID NO: 2230848 - DNA, 21 bp, Homo sapiens
tcctagttccaccatcaagcc

SEQ ID NO: 2230849 - DNA, 10 bp, Homo sapiens
tcctccaggt

SEQ ID NO: 2230850 - DNA, 18 bp, Homo sapiens
tcctccaggtgcacaagc

SEQ ID NO: 2230851 - DNA, 22 bp, Homo sapiens
tcctccaggtgcacaagctcca

SEQ ID NO: 2230852 - DNA, 18 bp, Homo sapiens
tcctcccacctcagcctc

SEQ ID NO: 2230853 - DNA, 20 bp, Homo sapiens
tcctcccacctcagcctccc

SEQ ID NO: 2230854 - DNA, 19 bp, Homo sapiens
tcctccctccctctttccc

SEQ ID NO: 2230855 - DNA, 21 bp, Homo sapiens
tcctcctgcccccaccccagg

SEQ ID NO: 2230856 - DNA, 23 bp, Homo sapiens
tcctcctgcccccaccccaggct

SEQ ID NO: 2230857 - DNA, 19 bp, Homo sapiens
tcctccttttcacagttct

SEQ ID NO: 2230858 - DNA, 15 bp, Homo sapiens
tcctctccccagcaa

SEQ ID NO: 2230859 - DNA, 12 bp, Homo sapiens
tcctctgctgct

SEQ ID NO: 2230860 - DNA, 14 bp, Homo sapiens
tcctctgctgctgg

SEQ ID NO: 2230861 - DNA, 16 bp, Homo sapiens
tcctctgctgctggct

SEQ ID NO: 2230862 - DNA, 12 bp, Homo sapiens
tcctctttccat

SEQ ID NO: 2230863 - DNA, 15 bp, Homo sapiens
tcctgaagaattgaa

SEQ ID NO: 2230864 - DNA, 21 bp, Homo sapiens
tcctgagccagatttcactct

SEQ ID NO: 2230865 - DNA, 17 bp, Homo sapiens
tcctgaggctgggctcc

SEQ ID NO: 2230866 - DNA, 15 bp, Homo sapiens
tcctgcaggcagcca

SEQ ID NO: 2230867 - DNA, 12 bp, Homo sapiens
tgctgaaggctc

SEQ ID NO: 2230868 - DNA, 16 bp, Homo sapiens
tgctgacagacacagg

SEQ ID NO: 2230869 - DNA, 19 bp, Homo sapiens
tgctgacagacacaggccc

SEQ ID NO: 2230870 - DNA, 23 bp, Homo sapiens
tgctgacagacacaggcccggct

SEQ ID NO: 2230871 - DNA, 21 bp, Homo sapiens
tgctgagtctgaaggctgggt

SEQ ID NO: 2230872 - DNA, 23 bp, Homo sapiens
tgctgagtctgaaggctgggttc

SEQ ID NO: 2230873 - DNA, 20 bp, Homo sapiens
tgctgatggtgcaatgacct

SEQ ID NO: 2230874 - DNA, 17 bp, Homo sapiens
tgctgcatttaaaagat

SEQ ID NO: 2230875 - DNA, 23 bp, Homo sapiens
tgctgcatttaaaagatacagtt

SEQ ID NO: 2230876 - DNA, 14 bp, Homo sapiens
tgctgccatccagg

SEQ ID NO: 2230877 - DNA, 21 bp, Homo sapiens
tgctgccatccaggttcagct

SEQ ID NO: 2230878 - DNA, 13 bp, Homo sapiens
tgctgccctgccc

SEQ ID NO: 2230879 - DNA, 18 bp, Homo sapiens
tgctgccctgcccacctg

SEQ ID NO: 2230880 - DNA, 21 bp, Homo sapiens
tgctgccctgcccacctggcc

SEQ ID NO: 2230881 - DNA, 14 bp, Homo sapiens
tgctgccctgtgag

SEQ ID NO: 2230882 - DNA, 15 bp, Homo sapiens
tgctgccctgtgagt

SEQ ID NO: 2230883 - DNA, 19 bp, Homo sapiens
tgctgcttgaggcaactca

SEQ ID NO: 2230884 - DNA, 19 bp, Homo sapiens
tgctggctgttggctgggg

SEQ ID NO: 2230885 - DNA, 17 bp, Homo sapiens
tgcttaacttcacatat

SEQ ID NO: 2230886 - DNA, 12 bp, Homo sapiens
tgcttcaaggat

SEQ ID NO: 2230887 - DNA, 20 bp, Homo sapiens
tgcttcaaggatcctgagcc

SEQ ID NO: 2230888 - DNA, 13 bp, Homo sapiens
tgcttcagcctcc

SEQ ID NO: 2230889 - DNA, 13 bp, Homo sapiens
tgcttcttcagag

SEQ ID NO: 2230890 - DNA, 14 bp, Homo sapiens
tgcttggaggaagg

SEQ ID NO: 2230891 - DNA, 19 bp, Homo sapiens
tgcttgggcttcatcctcc

SEQ ID NO: 2230892 - DNA, 16 bp, Homo sapiens
tgcttgtacataatgc

SEQ ID NO: 2230893 - DNA, 12 bp, Homo sapiens
tgctttgtgatt

SEQ ID NO: 2230894 - DNA, 14 bp, Homo sapiens
tgctttgtgatttt

SEQ ID NO: 2230895 - DNA, 22 bp, Homo sapiens
tgctttgtgatttttgtaattt

SEQ ID NO: 2230896 - DNA, 17 bp, Homo sapiens
tgcttttggtctgtgtg

SEQ ID NO: 2230897 - DNA, 18 bp, Homo sapiens
tgcttttggtctgtgtga

SEQ ID NO: 2230898 - DNA, 15 bp, Homo sapiens
tggaaaataaattat

SEQ ID NO: 2230899 - DNA, 20 bp, Homo sapiens
tggaaagagtaggaagactt

SEQ ID NO: 2230900 - DNA, 15 bp, Homo sapiens
tggaaatattaagaa

SEQ ID NO: 2230901 - DNA, 17 bp, Homo sapiens
tggaaatgggcagagca

SEQ ID NO: 2230902 - DNA, 14 bp, Homo sapiens
tggaacactctgag

SEQ ID NO: 2230903 - DNA, 15 bp, Homo sapiens
tggaagcagaaacaa

SEQ ID NO: 2230904 - DNA, 13 bp, Homo sapiens
tggaagctccgct

SEQ ID NO: 2230905 - DNA, 20 bp, Homo sapiens
tggaagtactataatttacc

SEQ ID NO: 2230906 - DNA, 15 bp, Homo sapiens
tggaatatataacca

SEQ ID NO: 2230907 - DNA, 14 bp, Homo sapiens
tggaatgcggggga

SEQ ID NO: 2230908 - DNA, 22 bp, Homo sapiens
tggaatgcgggggagcaggcag

SEQ ID NO: 2230909 - DNA, 14 bp, Homo sapiens
tggacacagctctt

SEQ ID NO: 2230910 - DNA, 15 bp, Homo sapiens
tggacacagctcttc

SEQ ID NO: 2230911 - DNA, 21 bp, Homo sapiens
tggacacagctcttctccagg

SEQ ID NO: 2230912 - DNA, 18 bp, Homo sapiens
tggacaggcatgttctct

SEQ ID NO: 2230913 - DNA, 14 bp, Homo sapiens
tggaccctgaggcc

SEQ ID NO: 2230914 - DNA, 16 bp, Homo sapiens
tggaccctgaggccca

SEQ ID NO: 2230915 - DNA, 18 bp, Homo sapiens
tggaccctgaggcccaga

SEQ ID NO: 2230916 - DNA, 19 bp, Homo sapiens
tggaccctgaggcccagag

SEQ ID NO: 2230917 - DNA, 20 bp, Homo sapiens
tggaccttgaactgggtact

SEQ ID NO: 2230918 - DNA, 23 bp, Homo sapiens
tggacgtgttatgactccagaat

SEQ ID NO: 2230919 - DNA, 19 bp, Homo sapiens
tggactaacttgtctttgg

SEQ ID NO: 2230920 - DNA, 22 bp, Homo sapiens
tggactttgttagtttctccaa

SEQ ID NO: 2230921 - DNA, 14 bp, Homo sapiens
tggagaaaatggac

SEQ ID NO: 2230922 - DNA, 22 bp, Homo sapiens
tggagaagcggctggcagccca

SEQ ID NO: 2230923 - DNA, 20 bp, Homo sapiens
tggaggaaggaaacccagct

SEQ ID NO: 2230924 - DNA, 22 bp, Homo sapiens
tggaggcatgtgatgagaggaa

SEQ ID NO: 2230925 - DNA, 23 bp, Homo sapiens
tggaggggggaggtgggatcctc

SEQ ID NO: 2230926 - DNA, 14 bp, Homo sapiens
tggagtgcagtgag

SEQ ID NO: 2230927 - DNA, 16 bp, Homo sapiens
tggagttcatcttgaa

SEQ ID NO: 2230928 - DNA, 20 bp, Homo sapiens
tggagttcatcttgaattgt

SEQ ID NO: 2230929 - DNA, 21 bp, Homo sapiens
tggatgcagcctcacagtcct

SEQ ID NO: 2230930 - DNA, 21 bp, Homo sapiens
tggattgtccccgacccttgc

SEQ ID NO: 2230931 - DNA, 21 bp, Homo sapiens
tggcacatcagcacgatttct

SEQ ID NO: 2230932 - DNA, 18 bp, Homo sapiens
tggcacccggcccctgct

SEQ ID NO: 2230933 - DNA, 19 bp, Homo sapiens
tggcacccggcccctgctg

SEQ ID NO: 2230934 - DNA, 14 bp, Homo sapiens
tggcactgcttcca

SEQ ID NO: 2230935 - DNA, 16 bp, Homo sapiens
tggcactgcttccagt

SEQ ID NO: 2230936 - DNA, 22 bp, Homo sapiens
tggcactgcttccagtgaggct

SEQ ID NO: 2230937 - DNA, 21 bp, Homo sapiens
tggcagagttgaagacagagc

SEQ ID NO: 2230938 - DNA, 16 bp, Homo sapiens
tggcagctcagagagg

SEQ ID NO: 2230939 - DNA, 18 bp, Homo sapiens
tggcagctcagagagggt

SEQ ID NO: 2230940 - DNA, 19 bp, Homo sapiens
tggcagctgcggtccaccc

SEQ ID NO: 2230941 - DNA, 14 bp, Homo sapiens
tggcagtgggagct

SEQ ID NO: 2230942 - DNA, 13 bp, Homo sapiens
tggcccactgcat

SEQ ID NO: 2230943 - DNA, 14 bp, Homo sapiens
tggcccactgcatc

SEQ ID NO: 2230944 - DNA, 22 bp, Homo sapiens
tggcccctcagggtccctggtg

SEQ ID NO: 2230945 - DNA, 14 bp, Homo sapiens
tggcccctgcccgg

SEQ ID NO: 2230946 - DNA, 20 bp, Homo sapiens
tggcctagcatacgtacaca

SEQ ID NO: 2230947 - DNA, 23 bp, Homo sapiens
tggcctagcatacgtacacattt

SEQ ID NO: 2230948 - DNA, 14 bp, Homo sapiens
tggcctcccaactc

SEQ ID NO: 2230949 - DNA, 13 bp, Homo sapiens
tggcctcttcaga

SEQ ID NO: 2230950 - DNA, 12 bp, Homo sapiens
tggcctggcccc

SEQ ID NO: 2230951 - DNA, 21 bp, Homo sapiens
tggcctggcccctcagggtcc

SEQ ID NO: 2230952 - DNA, 22 bp, Homo sapiens
tggcgcagcatattcaggaagc

SEQ ID NO: 2230953 - DNA, 23 bp, Homo sapiens
tggcgctgcccctggcagcccct

SEQ ID NO: 2230954 - DNA, 17 bp, Homo sapiens
tggctaatgtactgcat

SEQ ID NO: 2230955 - DNA, 22 bp, Homo sapiens
tggctagaggttcaaagatatt

SEQ ID NO: 2230956 - DNA, 22 bp, Homo sapiens
tggctattagagatcaacccct

SEQ ID NO: 2230957 - DNA, 20 bp, Homo sapiens
tggctcttccaggctgggag

SEQ ID NO: 2230958 - DNA, 20 bp, Homo sapiens
tggctgccaatgggagctca

SEQ ID NO: 2230959 - DNA, 15 bp, Homo sapiens
tggctgttggctggg

SEQ ID NO: 2230960 - DNA, 17 bp, Homo sapiens
tggcttcacggaagagc

SEQ ID NO: 2230961 - DNA, 20 bp, Homo sapiens
tggcttcacggaagagcctt

SEQ ID NO: 2230962 - DNA, 16 bp, Homo sapiens
tggcttttgtgcatta

SEQ ID NO: 2230963 - DNA, 16 bp, Homo sapiens
tgggacatgggaaagg

SEQ ID NO: 2230964 - DNA, 14 bp, Homo sapiens
tgggactacaggca

SEQ ID NO: 2230965 - DNA, 16 bp, Homo sapiens
tgggactacaggtgtg

SEQ ID NO: 2230966 - DNA, 16 bp, Homo sapiens
tgggagagccttccag

SEQ ID NO: 2230967 - DNA, 18 bp, Homo sapiens
tgggaggattgcttgagc

SEQ ID NO: 2230968 - DNA, 22 bp, Homo sapiens
tgggaggattgcttgagctcag

SEQ ID NO: 2230969 - DNA, 17 bp, Homo sapiens
tgggaggtcaaggctgc

SEQ ID NO: 2230970 - DNA, 19 bp, Homo sapiens
tgggaggtcaaggctgcag

SEQ ID NO: 2230971 - DNA, 23 bp, Homo sapiens
tgggaggtcaaggctgcagtgag

SEQ ID NO: 2230972 - DNA, 15 bp, Homo sapiens
tgggagtgagctggt

SEQ ID NO: 2230973 - DNA, 15 bp, Homo sapiens
tgggatcctccaggt

SEQ ID NO: 2230974 - DNA, 16 bp, Homo sapiens
tgggcaacccccagcc

SEQ ID NO: 2230975 - DNA, 21 bp, Homo sapiens
tgggcaacccccagcctgcta

SEQ ID NO: 2230976 - DNA, 16 bp, Homo sapiens
tgggcagaaggaagac

SEQ ID NO: 2230977 - DNA, 11 bp, Homo sapiens
tgggcagagca

SEQ ID NO: 2230978 - DNA, 15 bp, Homo sapiens
tgggcagagcagaga

SEQ ID NO: 2230979 - DNA, 23 bp, Homo sapiens
tgggcagagcagagaccatccct

SEQ ID NO: 2230980 - DNA, 23 bp, Homo sapiens
tgggctgggttctacccaggtgc

SEQ ID NO: 2230981 - DNA, 19 bp, Homo sapiens
tgggcttcagtggcagctg

SEQ ID NO: 2230982 - DNA, 21 bp, Homo sapiens
tgggcttggggaccagagctg

SEQ ID NO: 2230983 - DNA, 14 bp, Homo sapiens
tggggaccagagct

SEQ ID NO: 2230984 - DNA, 15 bp, Homo sapiens
tggggaccagagctg

SEQ ID NO: 2230985 - DNA, 17 bp, Homo sapiens
tggggaccagagctgcc

SEQ ID NO: 2230986 - DNA, 13 bp, Homo sapiens
tggggacctcagg

SEQ ID NO: 2230987 - DNA, 14 bp, Homo sapiens
tggggacctcaggc

SEQ ID NO: 2230988 - DNA, 15 bp, Homo sapiens
tggggatgagaaagg

SEQ ID NO: 2230989 - DNA, 16 bp, Homo sapiens
tggggccctgcctcct

SEQ ID NO: 2230990 - DNA, 18 bp, Homo sapiens
tttaacagaaatgtacag

SEQ ID NO: 2230991 - DNA, 18 bp, Homo sapiens
tttaagaaaaaggatgca

SEQ ID NO: 2230992 - DNA, 14 bp, Homo sapiens
tttaagaggcaggg

SEQ ID NO: 2230993 - DNA, 20 bp, Homo sapiens
tttaaggatgcttgtacata

SEQ ID NO: 2230994 - DNA, 19 bp, Homo sapiens
tttaccttttttatacata

SEQ ID NO: 2230995 - DNA, 17 bp, Homo sapiens
tttactaatagacaatt

SEQ ID NO: 2230996 - DNA, 13 bp, Homo sapiens
tttacttcttata

SEQ ID NO: 2230997 - DNA, 22 bp, Homo sapiens
tttagaccctattgctgcttga

SEQ ID NO: 2230998 - DNA, 18 bp, Homo sapiens
tttagagttgatactaca

SEQ ID NO: 2230999 - DNA, 15 bp, Homo sapiens
tttagtagagacagg

SEQ ID NO: 2231000 - DNA, 14 bp, Homo sapiens
tttatcagaattct

SEQ ID NO: 2231001 - DNA, 21 bp, Homo sapiens
tttatcgtcactgcttaactt

SEQ ID NO: 2231002 - DNA, 14 bp, Homo sapiens
tttatggcttttgt

SEQ ID NO: 2231003 - DNA, 16 bp, Homo sapiens
tttatggcttttgtgc

SEQ ID NO: 2231004 - DNA, 19 bp, Homo sapiens
tttattaaatgcccagccc

SEQ ID NO: 2231005 - DNA, 19 bp, Homo sapiens
tttatttagttccttgagt

SEQ ID NO: 2231006 - DNA, 24 bp, Homo sapiens
tttcactcttattgcccacgctgg

SEQ ID NO: 2231007 - DNA, 15 bp, Homo sapiens
tttcagccaagaatt

SEQ ID NO: 2231008 - DNA, 16 bp, Homo sapiens
tttcagccaagaattc

SEQ ID NO: 2231009 - DNA, 14 bp, Homo sapiens
tttcagtgtacatg

SEQ ID NO: 2231010 - DNA, 23 bp, Homo sapiens
tttccctcccttcctctttccat

SEQ ID NO: 2231011 - DNA, 17 bp, Homo sapiens
tttccgttaaaatacca

SEQ ID NO: 2231012 - DNA, 16 bp, Homo sapiens
tttcctgaggctgggc

SEQ ID NO: 2231013 - DNA, 12 bp, Homo sapiens
tttcctgtgtct

SEQ ID NO: 2231014 - DNA, 14 bp, Homo sapiens
tttctaaagctgcc

SEQ ID NO: 2231015 - DNA, 17 bp, Homo sapiens
tttctaaagctgccagc

SEQ ID NO: 2231016 - DNA, 14 bp, Homo sapiens
tttctaaaggctac

SEQ ID NO: 2231017 - DNA, 18 bp, Homo sapiens
tttctaaaggctaccttt

SEQ ID NO: 2231018 - DNA, 20 bp, Homo sapiens
tttctaaaggctacctttgt

SEQ ID NO: 2231019 - DNA, 15 bp, Homo sapiens
tttctagccagagga

SEQ ID NO: 2231020 - DNA, 21 bp, Homo sapiens
tttctatgacacatgcaaggt

SEQ ID NO: 2231021 - DNA, 19 bp, Homo sapiens
tttctgcagccactattgt

SEQ ID NO: 2231022 - DNA, 14 bp, Homo sapiens
tttctgccgcagcc

SEQ ID NO: 2231023 - DNA, 19 bp, Homo sapiens
tttctggctatgcatttga

SEQ ID NO: 2231024 - DNA, 23 bp, Homo sapiens
tttcttagggaaggatacaaaag

SEQ ID NO: 2231025 - DNA, 19 bp, Homo sapiens
tttcttgtgtgtttattgt

SEQ ID NO: 2231026 - DNA, 19 bp, Homo sapiens
tttgacgccatcccagccc

SEQ ID NO: 2231027 - DNA, 13 bp, Homo sapiens
tttgagacagagt

SEQ ID NO: 2231028 - DNA, 17 bp, Homo sapiens
tttgaggtctgttcttt

SEQ ID NO: 2231029 - DNA, 21 bp, Homo sapiens
tttgagtgccttacacaatgg

SEQ ID NO: 2231030 - DNA, 14 bp, Homo sapiens
tttgatccaagctg

SEQ ID NO: 2231031 - DNA, 18 bp, Homo sapiens
tttgattaaattcttgca

SEQ ID NO: 2231032 - DNA, 21 bp, Homo sapiens
tttgattaaattcttgcaaag

SEQ ID NO: 2231033 - DNA, 22 bp, Homo sapiens
tttgccatgttggccaggctgg

SEQ ID NO: 2231034 - DNA, 13 bp, Homo sapiens
tttgcctctgcct

SEQ ID NO: 2231035 - DNA, 14 bp, Homo sapiens
tttggaattttgtg

SEQ ID NO: 2231036 - DNA, 21 bp, Homo sapiens
tttggaattttgtgcccccat

SEQ ID NO: 2231037 - DNA, 12 bp, Homo sapiens
tttggctgctga

SEQ ID NO: 2231038 - DNA, 22 bp, Homo sapiens
tttgggaggccaaggtgggagg

SEQ ID NO: 2231039 - DNA, 21 bp, Homo sapiens
tttggggtacccactgctctg

SEQ ID NO: 2231040 - DNA, 15 bp, Homo sapiens
tttgtaaattaactt

SEQ ID NO: 2231041 - DNA, 15 bp, Homo sapiens
tttgtattctctcct

SEQ ID NO: 2231042 - DNA, 15 bp, Homo sapiens
tttgtgatacaatgc

SEQ ID NO: 2231043 - DNA, 16 bp, Homo sapiens
tttgtgatacaatgct

SEQ ID NO: 2231044 - DNA, 22 bp, Homo sapiens
tttgtgatacaatgctgtgccc

SEQ ID NO: 2231045 - DNA, 21 bp, Homo sapiens
tttgttctggctcttccaggc

SEQ ID NO: 2231046 - DNA, 14 bp, Homo sapiens
tttgtttctgaaag

SEQ ID NO: 2231047 - DNA, 13 bp, Homo sapiens
tttgtttgaactg

SEQ ID NO: 2231048 - DNA, 18 bp, Homo sapiens
tttgtttgaactgataaa

SEQ ID NO: 2231049 - DNA, 21 bp, Homo sapiens
ttttaaaaaactgctgactgt

SEQ ID NO: 2231050 - DNA, 11 bp, Homo sapiens
ttttaaatgca

SEQ ID NO: 2231051 - DNA, 15 bp, Homo sapiens
ttttaagaggcaggg

SEQ ID NO: 2231052 - DNA, 17 bp, Homo sapiens
ttttaagtgctgcattt

SEQ ID NO: 2231053 - DNA, 17 bp, Homo sapiens
ttttataaactttacct

SEQ ID NO: 2231054 - DNA, 19 bp, Homo sapiens
ttttataaactttaccttt

SEQ ID NO: 2231055 - DNA, 21 bp, Homo sapiens
ttttatacataaacaagacca

SEQ ID NO: 2231056 - DNA, 19 bp, Homo sapiens
ttttatcgtcactgcttaa

SEQ ID NO: 2231057 - DNA, 12 bp, Homo sapiens
ttttattaaatt

SEQ ID NO: 2231058 - DNA, 13 bp, Homo sapiens
ttttattatgcat

SEQ ID NO: 2231059 - DNA, 11 bp, Homo sapiens
ttttattttat

SEQ ID NO: 2231060 - DNA, 18 bp, Homo sapiens
ttttatttttagacagag

SEQ ID NO: 2231061 - DNA, 18 bp, Homo sapiens
ttttccatgagtcccctg

SEQ ID NO: 2231062 - DNA, 14 bp, Homo sapiens
ttttcggctaaaaa

SEQ ID NO: 2231063 - DNA, 22 bp, Homo sapiens
ttttctactcgagttacagaca

SEQ ID NO: 2231064 - DNA, 23 bp, Homo sapiens
ttttctactcgagttacagacaa

SEQ ID NO: 2231065 - DNA, 13 bp, Homo sapiens
ttttctgttcttt

SEQ ID NO: 2231066 - DNA, 16 bp, Homo sapiens
ttttctttcagccaag

SEQ ID NO: 2231067 - DNA, 14 bp, Homo sapiens
ttttggctgctgaa

SEQ ID NO: 2231068 - DNA, 21 bp, Homo sapiens
ttttgtaaaaagggaaaaaga

SEQ ID NO: 2231069 - DNA, 23 bp, Homo sapiens
ttttgtgcattatctagatactg

SEQ ID NO: 2231070 - DNA, 16 bp, Homo sapiens
ttttgtttttgtctta

SEQ ID NO: 2231071 - DNA, 11 bp, Homo sapiens
tttttaaatgc

SEQ ID NO: 2231072 - DNA, 23 bp, Homo sapiens
tttttaagaaaaaggatgcacag

SEQ ID NO: 2231073 - DNA, 16 bp, Homo sapiens
tttttaagtgctgcat

SEQ ID NO: 2231074 - DNA, 19 bp, Homo sapiens
tttttaagtgctgcattta

SEQ ID NO: 2231075 - DNA, 23 bp, Homo sapiens
tttttaagtgctgcatttaaaag

SEQ ID NO: 2231076 - DNA, 12 bp, Homo sapiens
tttttatggctt

SEQ ID NO: 2231077 - DNA, 11 bp, Homo sapiens
tttttccttca

SEQ ID NO: 2231078 - DNA, 22 bp, Homo sapiens
tttttgtaaaaagggaaaaaga

SEQ ID NO: 2231079 - DNA, 17 bp, Homo sapiens
ttttttccttcagtgcc

SEQ ID NO: 2231080 - DNA, 14 bp, Homo sapiens
atgttcttaattct

SEQ ID NO: 2231081 - DNA, 12 bp, Homo sapiens
atgttgaaagat

SEQ ID NO: 2231082 - DNA, 13 bp, Homo sapiens
atgttgcccaggc

SEQ ID NO: 2231083 - DNA, 14 bp, Homo sapiens
atgttggccaggct

SEQ ID NO: 2231084 - DNA, 18 bp, Homo sapiens
atgtttgcctctgcctct

SEQ ID NO: 2231085 - DNA, 19 bp, Homo sapiens
atgtttgcctctgcctctg

SEQ ID NO: 2231086 - DNA, 22 bp, Homo sapiens
atgtttgcctctgcctctgaca

SEQ ID NO: 2231087 - DNA, 18 bp, Homo sapiens
atgtttttcttctccctc

SEQ ID NO: 2231088 - DNA, 20 bp, Homo sapiens
attaaaaatctcaaatttct

SEQ ID NO: 2231089 - DNA, 14 bp, Homo sapiens
attaaatgcccagc

SEQ ID NO: 2231090 - DNA, 11 bp, Homo sapiens
attaaattatg

SEQ ID NO: 2231091 - DNA, 13 bp, Homo sapiens
attaaattcttgc

SEQ ID NO: 2231092 - DNA, 20 bp, Homo sapiens
attaaattcttgcaaagtat

SEQ ID NO: 2231093 - DNA, 16 bp, Homo sapiens
attaagtactatgtat

SEQ ID NO: 2231094 - DNA, 19 bp, Homo sapiens
attaagtactatgtatcaa

SEQ ID NO: 2231095 - DNA, 22 bp, Homo sapiens
attacaagcgtgagccactgca

SEQ ID NO: 2231096 - DNA, 17 bp, Homo sapiens
attacaggaagtactgg

SEQ ID NO: 2231097 - DNA, 17 bp, Homo sapiens
attcagacagctgcctg

SEQ ID NO: 2231098 - DNA, 19 bp, Homo sapiens
attcagacagctgcctggg

SEQ ID NO: 2231099 - DNA, 14 bp, Homo sapiens
attcagctctgcaa

SEQ ID NO: 2231100 - DNA, 20 bp, Homo sapiens
attcaggaagctcagggcct

SEQ ID NO: 2231101 - DNA, 21 bp, Homo sapiens
attcaggaagctcagggcctg

SEQ ID NO: 2231102 - DNA, 16 bp, Homo sapiens
attcagttgttagtgt

SEQ ID NO: 2231103 - DNA, 21 bp, Homo sapiens
attcagttgttagtgtgtctt

SEQ ID NO: 2231104 - DNA, 14 bp, Homo sapiens
attcataatgactt

SEQ ID NO: 2231105 - DNA, 15 bp, Homo sapiens
attcataatgactta

SEQ ID NO: 2231106 - DNA, 14 bp, Homo sapiens
attcccaagctctg

SEQ ID NO: 2231107 - DNA, 15 bp, Homo sapiens
attcccaagctctgc

SEQ ID NO: 2231108 - DNA, 20 bp, Homo sapiens
attccccagattgcaacagg

SEQ ID NO: 2231109 - DNA, 21 bp, Homo sapiens
attcctgatgcttcttcagag

SEQ ID NO: 2231110 - DNA, 16 bp, Homo sapiens
attctactttgagtgc

SEQ ID NO: 2231111 - DNA, 14 bp, Homo sapiens
attctcagaatctc

SEQ ID NO: 2231112 - DNA, 18 bp, Homo sapiens
attctcagaatctcaaat

SEQ ID NO: 2231113 - DNA, 17 bp, Homo sapiens
attctcatttgtcacac

SEQ ID NO: 2231114 - DNA, 17 bp, Homo sapiens
attctccacctgccagg

SEQ ID NO: 2231115 - DNA, 18 bp, Homo sapiens
attctccacctgccaggg

SEQ ID NO: 2231116 - DNA, 14 bp, Homo sapiens
attctcctgcctca

SEQ ID NO: 2231117 - DNA, 15 bp, Homo sapiens
attctcctgcctcag

SEQ ID NO: 2231118 - DNA, 17 bp, Homo sapiens
attctcctgcctcagcc

SEQ ID NO: 2231119 - DNA, 19 bp, Homo sapiens
attctccttgtgttactaa

SEQ ID NO: 2231120 - DNA, 23 bp, Homo sapiens
attctctagtttgattaaattct

SEQ ID NO: 2231121 - DNA, 19 bp, Homo sapiens
attctctcctgtacctctt

SEQ ID NO: 2231122 - DNA, 21 bp, Homo sapiens
attctctcctgtacctcttga

SEQ ID NO: 2231123 - DNA, 12 bp, Homo sapiens
attctcttatcc

SEQ ID NO: 2231124 - DNA, 14 bp, Homo sapiens
attctcttatccaa

SEQ ID NO: 2231125 - DNA, 15 bp, Homo sapiens
aggtttttgtttctt

SEQ ID NO: 2231126 - DNA, 18 bp, Homo sapiens
agtaatatgcacacattt

SEQ ID NO: 2231127 - DNA, 19 bp, Homo sapiens
agtaatatgcacacatttt

SEQ ID NO: 2231128 - DNA, 20 bp, Homo sapiens
agtaatatgcacacattttt

SEQ ID NO: 2231129 - DNA, 16 bp, Homo sapiens
agtacactgtttcaaa

SEQ ID NO: 2231130 - DNA, 23 bp, Homo sapiens
agtacactgtttcaaactttact

SEQ ID NO: 2231131 - DNA, 19 bp, Homo sapiens
agtactacagtcctcccat

SEQ ID NO: 2231132 - DNA, 20 bp, Homo sapiens
agtacttctccaccctgctc

SEQ ID NO: 2231133 - DNA, 19 bp, Homo sapiens
agtagaagtcttagatgta

SEQ ID NO: 2231134 - DNA, 13 bp, Homo sapiens
agtagctgggact

SEQ ID NO: 2231135 - DNA, 14 bp, Homo sapiens
agtagctgggacta

SEQ ID NO: 2231136 - DNA, 21 bp, Homo sapiens
agtagctgggactacaggcac

SEQ ID NO: 2231137 - DNA, 14 bp, Homo sapiens
agtatggtggctgg

SEQ ID NO: 2231138 - DNA, 14 bp, Homo sapiens
agtattataccttt

SEQ ID NO: 2231139 - DNA, 19 bp, Homo sapiens
agtattcttatttaatgaa

SEQ ID NO: 2231140 - DNA, 16 bp, Homo sapiens
agtcaagtgaaaaagg

SEQ ID NO: 2231141 - DNA, 23 bp, Homo sapiens
agtcacacagtgagtcgaggaca

SEQ ID NO: 2231142 - DNA, 13 bp, Homo sapiens
agtcaccaagccc

SEQ ID NO: 2231143 - DNA, 15 bp, Homo sapiens
agtcactgagacagc

SEQ ID NO: 2231144 - DNA, 16 bp, Homo sapiens
agtcactgagacagcc

SEQ ID NO: 2231145 - DNA, 15 bp, Homo sapiens
agtcccaccttggct

SEQ ID NO: 2231146 - DNA, 16 bp, Homo sapiens
agtcccaccttggctg

SEQ ID NO: 2231147 - DNA, 23 bp, Homo sapiens
agtcccaccttggctgcagggag

SEQ ID NO: 2231148 - DNA, 23 bp, Homo sapiens
agtcccctgtttgtttctgaaag

SEQ ID NO: 2231149 - DNA, 13 bp, Homo sapiens
agtccctgccaat

SEQ ID NO: 2231150 - DNA, 23 bp, Homo sapiens
agtccgaaagggacttggaagct

SEQ ID NO: 2231151 - DNA, 22 bp, Homo sapiens
agtcctggcatgggaatgaatg

SEQ ID NO: 2231152 - DNA, 19 bp, Homo sapiens
agtccttaccagcagagca

SEQ ID NO: 2231153 - DNA, 19 bp, Homo sapiens
agtctcactgttgcccagg

SEQ ID NO: 2231154 - DNA, 23 bp, Homo sapiens
agtctcactgttgcccaggctgg

SEQ ID NO: 2231155 - DNA, 12 bp, Homo sapiens
agtctgaaggct

SEQ ID NO: 2231156 - DNA, 13 bp, Homo sapiens
agtctgaaggctg

SEQ ID NO: 2231157 - DNA, 16 bp, Homo sapiens
agtctgattcccaagc

SEQ ID NO: 2231158 - DNA, 22 bp, Homo sapiens
agtctgattcccaagctctgct

SEQ ID NO: 2231159 - DNA, 18 bp, Homo sapiens
agtctggaatgcagtggt

SEQ ID NO: 2231160 - DNA, 23 bp, Homo sapiens
agtcttagatgtatatatttcct

SEQ ID NO: 2231161 - DNA, 14 bp, Homo sapiens
agtgacagaggcag

SEQ ID NO: 2231162 - DNA, 14 bp, Homo sapiens
agtgaggctctgcc

SEQ ID NO: 2231163 - DNA, 20 bp, Homo sapiens
agtgaggctctgcccttggt

SEQ ID NO: 2231164 - DNA, 15 bp, Homo sapiens
agtgagtcgaggaca

SEQ ID NO: 2231165 - DNA, 19 bp, Homo sapiens
agtgatcctcccacctcag

SEQ ID NO: 2231166 - DNA, 23 bp, Homo sapiens
agtgatcctcccacctcagcctc

SEQ ID NO: 2231167 - DNA, 24 bp, Homo sapiens
agtgatcctcccacctcagcctcc

SEQ ID NO: 2231168 - DNA, 14 bp, Homo sapiens
agtgattctcctgc

SEQ ID NO: 2231169 - DNA, 17 bp, Homo sapiens
agtgattctcctgcctc

SEQ ID NO: 2231170 - DNA, 19 bp, Homo sapiens
agtgattctcctgcctcag

SEQ ID NO: 2231171 - DNA, 24 bp, Homo sapiens
agtgattctcctgcctcagcctcc

SEQ ID NO: 2231172 - DNA, 14 bp, Homo sapiens
agtgcccacaggat

SEQ ID NO: 2231173 - DNA, 17 bp, Homo sapiens
agtgccttacacaatgg

SEQ ID NO: 2231174 - DNA, 20 bp, Homo sapiens
agtgccttatggaacactct

SEQ ID NO: 2231175 - DNA, 12 bp, Homo sapiens
agtgctgcattt

SEQ ID NO: 2231176 - DNA, 20 bp, Homo sapiens
agtgctgcatttaaaagata

SEQ ID NO: 2231177 - DNA, 22 bp, Homo sapiens
agtgctgcatttaaaagataca

SEQ ID NO: 2231178 - DNA, 20 bp, Homo sapiens
agtggcagctgcttttgtct

SEQ ID NO: 2231179 - DNA, 14 bp, Homo sapiens
agtgggagctgcct

SEQ ID NO: 2231180 - DNA, 22 bp, Homo sapiens
agtgggcccaatgcactttgtt

SEQ ID NO: 2231181 - DNA, 16 bp, Homo sapiens
agtggggctggaagca

SEQ ID NO: 2231182 - DNA, 19 bp, Homo sapiens
agtggggctggaagcagaa

SEQ ID NO: 2231183 - DNA, 19 bp, Homo sapiens
agtgggggagtggccacag

SEQ ID NO: 2231184 - DNA, 18 bp, Homo sapiens
agtgggggatcacagcct

SEQ ID NO: 2231185 - DNA, 21 bp, Homo sapiens
caaagccaaagctaggcctgg

SEQ ID NO: 2231186 - DNA, 13 bp, Homo sapiens
caaagctaggcct

SEQ ID NO: 2231187 - DNA, 16 bp, Homo sapiens
caaagctaggcctggc

SEQ ID NO: 2231188 - DNA, 17 bp, Homo sapiens
caaagctaggcctggcc

SEQ ID NO: 2231189 - DNA, 16 bp, Homo sapiens
caaagcttgttaagat

SEQ ID NO: 2231190 - DNA, 13 bp, Homo sapiens
caaaggaagcaca

SEQ ID NO: 2231191 - DNA, 20 bp, Homo sapiens
caaaggagattggaaggaac

SEQ ID NO: 2231192 - DNA, 23 bp, Homo sapiens
caaagggtatcaggtgctgccat

SEQ ID NO: 2231193 - DNA, 22 bp, Homo sapiens
caaagtagaagtcttagatgta

SEQ ID NO: 2231194 - DNA, 13 bp, Homo sapiens
caaatcagctgct

SEQ ID NO: 2231195 - DNA, 23 bp, Homo sapiens
caaatggaaatgggcagagcaga

SEQ ID NO: 2231196 - DNA, 20 bp, Homo sapiens
caacacctctgcacaagctg

SEQ ID NO: 2231197 - DNA, 20 bp, Homo sapiens
caacaccttgtttccctctc

SEQ ID NO: 2231198 - DNA, 18 bp, Homo sapiens
caacactcattgacctga

SEQ ID NO: 2231199 - DNA, 13 bp, Homo sapiens
caacaggctgggc

SEQ ID NO: 2231200 - DNA, 14 bp, Homo sapiens
caacatactcccat

SEQ ID NO: 2231201 - DNA, 16 bp, Homo sapiens
caacatactcccatct

SEQ ID NO: 2231202 - DNA, 19 bp, Homo sapiens
caacatactcccatctgtg

SEQ ID NO: 2231203 - DNA, 20 bp, Homo sapiens
caacatactcccatctgtga

SEQ ID NO: 2231204 - DNA, 15 bp, Homo sapiens
caacccccagcctgc

SEQ ID NO: 2231205 - DNA, 14 bp, Homo sapiens
caaccccttcgctc

SEQ ID NO: 2231206 - DNA, 14 bp, Homo sapiens
caacctcctgggct

SEQ ID NO: 2231207 - DNA, 17 bp, Homo sapiens
caacctgattgtgtctc

SEQ ID NO: 2231208 - DNA, 19 bp, Homo sapiens
caacctgattgtgtctctt

SEQ ID NO: 2231209 - DNA, 13 bp, Homo sapiens
caactcaccccag

SEQ ID NO: 2231210 - DNA, 18 bp, Homo sapiens
caactcaccccagcccca

SEQ ID NO: 2231211 - DNA, 20 bp, Homo sapiens
caagaactttccaggaaggc

SEQ ID NO: 2231212 - DNA, 13 bp, Homo sapiens
caagaagcccagg

SEQ ID NO: 2231213 - DNA, 19 bp, Homo sapiens
caagacccttgtggtccca

SEQ ID NO: 2231214 - DNA, 23 bp, Homo sapiens
caagacccttgtggtcccacccc

SEQ ID NO: 2231215 - DNA, 13 bp, Homo sapiens
caagaccttctcc

SEQ ID NO: 2231216 - DNA, 14 bp, Homo sapiens
caagaccttctcct

SEQ ID NO: 2231217 - DNA, 16 bp, Homo sapiens
caagaccttctccttc

SEQ ID NO: 2231218 - DNA, 23 bp, Homo sapiens
caagaccttctccttcacctttg

SEQ ID NO: 2231219 - DNA, 13 bp, Homo sapiens
caagacgctgtgc

SEQ ID NO: 2231220 - DNA, 22 bp, Homo sapiens
caagacgctgtgctgccctgcc

SEQ ID NO: 2231221 - DNA, 23 bp, Homo sapiens
caagacgctgtgctgccctgccc

SEQ ID NO: 2231222 - DNA, 20 bp, Homo sapiens
caagagagacagcacaggca

SEQ ID NO: 2231223 - DNA, 16 bp, Homo sapiens
cacagtattacttctg

SEQ ID NO: 2231224 - DNA, 21 bp, Homo sapiens
cacagtattacttctgctaca

SEQ ID NO: 2231225 - DNA, 15 bp, Homo sapiens
cacagtccttaccag

SEQ ID NO: 2231226 - DNA, 21 bp, Homo sapiens
cacagtccttaccagcagagc

SEQ ID NO: 2231227 - DNA, 21 bp, Homo sapiens
cacagtgagtcgaggacaggg

SEQ ID NO: 2231228 - DNA, 22 bp, Homo sapiens
cacagtgagtcgaggacaggga

SEQ ID NO: 2231229 - DNA, 14 bp, Homo sapiens
cacatatctgtcat

SEQ ID NO: 2231230 - DNA, 22 bp, Homo sapiens
cacatcagcacgatttctgttt

SEQ ID NO: 2231231 - DNA, 18 bp, Homo sapiens
cacatcttgctctgctga

SEQ ID NO: 2231232 - DNA, 18 bp, Homo sapiens
cacatgagcatcaggcca

SEQ ID NO: 2231233 - DNA, 17 bp, Homo sapiens
cacatgcaaggtcattt

SEQ ID NO: 2231234 - DNA, 18 bp, Homo sapiens
cacatgcacgtgtgtgca

SEQ ID NO: 2231235 - DNA, 18 bp, Homo sapiens
cacatgcctctctcaggc

SEQ ID NO: 2231236 - DNA, 20 bp, Homo sapiens
cacatgcctctctcaggcca

SEQ ID NO: 2231237 - DNA, 18 bp, Homo sapiens
cacatgtccaagaagccc

SEQ ID NO: 2231238 - DNA, 17 bp, Homo sapiens
cacatttattctgctca

SEQ ID NO: 2231239 - DNA, 15 bp, Homo sapiens
cacattttattttat

SEQ ID NO: 2231240 - DNA, 17 bp, Homo sapiens
cacattttattttatta

SEQ ID NO: 2231241 - DNA, 20 bp, Homo sapiens
cacattttattttattatgc

SEQ ID NO: 2231242 - DNA, 21 bp, Homo sapiens
cacattttattttattatgca

SEQ ID NO: 2231243 - DNA, 17 bp, Homo sapiens
cacattttttaaatgca

SEQ ID NO: 2231244 - DNA, 17 bp, Homo sapiens
caccaacatactcccat

SEQ ID NO: 2231245 - DNA, 17 bp, Homo sapiens
caccaacgtctgtgcca

SEQ ID NO: 2231246 - DNA, 15 bp, Homo sapiens
caccaagcccagtta

SEQ ID NO: 2231247 - DNA, 23 bp, Homo sapiens
cactgttgcccaggctggcgtgc

SEQ ID NO: 2231248 - DNA, 16 bp, Homo sapiens
cacttacactttatgc

SEQ ID NO: 2231249 - DNA, 12 bp, Homo sapiens
cacttcagctga

SEQ ID NO: 2231250 - DNA, 21 bp, Homo sapiens
cacttcagctgacttttctgt

SEQ ID NO: 2231251 - DNA, 14 bp, Homo sapiens
cacttgcagactct

SEQ ID NO: 2231252 - DNA, 17 bp, Homo sapiens
cactttctagccagagg

SEQ ID NO: 2231253 - DNA, 19 bp, Homo sapiens
cactttctagccagaggag

SEQ ID NO: 2231254 - DNA, 23 bp, Homo sapiens
cactttgttctggctcttccagg

SEQ ID NO: 2231255 - DNA, 16 bp, Homo sapiens
cagaaatgtacagcaa

SEQ ID NO: 2231256 - DNA, 21 bp, Homo sapiens
cagaagacactgatgggcaac

SEQ ID NO: 2231257 - DNA, 18 bp, Homo sapiens
cagaaggaagacttcatc

SEQ ID NO: 2231258 - DNA, 19 bp, Homo sapiens
cagaaggaagacttcatcc

SEQ ID NO: 2231259 - DNA, 21 bp, Homo sapiens
cagaagtttctgccgcagccc

SEQ ID NO: 2231260 - DNA, 22 bp, Homo sapiens
cagaagtttgagatcagcctgg

SEQ ID NO: 2231261 - DNA, 15 bp, Homo sapiens
cagaattctctagtt

SEQ ID NO: 2231262 - DNA, 16 bp, Homo sapiens
cagacaacaaacctgt

SEQ ID NO: 2231263 - DNA, 15 bp, Homo sapiens
cagacacaggcccgg

SEQ ID NO: 2231264 - DNA, 21 bp, Homo sapiens
cagcggggacagctccttctg

SEQ ID NO: 2231265 - DNA, 15 bp, Homo sapiens
cagctaacatggaag

SEQ ID NO: 2231266 - DNA, 15 bp, Homo sapiens
cagctcaccagcccc

SEQ ID NO: 2231267 - DNA, 16 bp, Homo sapiens
cagctcaccagcccca

SEQ ID NO: 2231268 - DNA, 19 bp, Homo sapiens
cagctcaccagccccagtg

SEQ ID NO: 2231269 - DNA, 21 bp, Homo sapiens
cagctcaccagccccagtgcc

SEQ ID NO: 2231270 - DNA, 16 bp, Homo sapiens
cagctcacctctccct

SEQ ID NO: 2231271 - DNA, 19 bp, Homo sapiens
cagctcacctctcccttgg

SEQ ID NO: 2231272 - DNA, 17 bp, Homo sapiens
cagctcagagagggtgg

SEQ ID NO: 2231273 - DNA, 19 bp, Homo sapiens
cagctcagagagggtggga

SEQ ID NO: 2231274 - DNA, 13 bp, Homo sapiens
cagctccagctca

SEQ ID NO: 2231275 - DNA, 17 bp, Homo sapiens
cagctccttctgtccta

SEQ ID NO: 2231276 - DNA, 15 bp, Homo sapiens
cagctctgcaagaat

SEQ ID NO: 2231277 - DNA, 10 bp, Homo sapiens
cagctctggt

SEQ ID NO: 2231278 - DNA, 16 bp, Homo sapiens
cagctctggtccatag

SEQ ID NO: 2231279 - DNA, 12 bp, Homo sapiens
cagctctgtcct

SEQ ID NO: 2231280 - DNA, 18 bp, Homo sapiens
cagctctgtcctgggagt

SEQ ID NO: 2231281 - DNA, 15 bp, Homo sapiens
cagctcttctccagg

SEQ ID NO: 2231282 - DNA, 18 bp, Homo sapiens
cagctcttctccaggctg

SEQ ID NO: 2231283 - DNA, 19 bp, Homo sapiens
cagctcttctccaggctgt

SEQ ID NO: 2231284 - DNA, 23 bp, Homo sapiens
cagctcttctccaggctgtatcc

SEQ ID NO: 2231285 - DNA, 19 bp, Homo sapiens
cagctgagggtgagtgggt

SEQ ID NO: 2231286 - DNA, 15 bp, Homo sapiens
cagctgcctgggatc

SEQ ID NO: 2231287 - DNA, 18 bp, Homo sapiens
cagctgcggtccacccag

SEQ ID NO: 2231288 - DNA, 24 bp, Homo sapiens
cagctgcggtccacccaggagccc

SEQ ID NO: 2231289 - DNA, 22 bp, Homo sapiens
cagctggggtggggacctcagg

SEQ ID NO: 2231290 - DNA, 23 bp, Homo sapiens
cagctggggtggggacctcaggc

SEQ ID NO: 2231291 - DNA, 18 bp, Homo sapiens
cagctgtgctctggacag

SEQ ID NO: 2231292 - DNA, 20 bp, Homo sapiens
cagctgtgctctggacaggc

SEQ ID NO: 2231293 - DNA, 19 bp, Homo sapiens
cagctgttcagctggttga

SEQ ID NO: 2231294 - DNA, 19 bp, Homo sapiens
cagcttgagggttgggctg

SEQ ID NO: 2231295 - DNA, 18 bp, Homo sapiens
cagcttgtaaatagctca

SEQ ID NO: 2231296 - DNA, 21 bp, Homo sapiens
cagcttgtaaatagctcaggt

SEQ ID NO: 2231297 - DNA, 12 bp, Homo sapiens
cagctttgtttg

SEQ ID NO: 2231298 - DNA, 23 bp, Homo sapiens
cagctttgtttgttgtcagctga

SEQ ID NO: 2231299 - DNA, 15 bp, Homo sapiens
caggaaaagctgctg

SEQ ID NO: 2231300 - DNA, 18 bp, Homo sapiens
caggaaaagctgctgaca

SEQ ID NO: 2231301 - DNA, 16 bp, Homo sapiens
caggaaaggctccagg

SEQ ID NO: 2231302 - DNA, 14 bp, Homo sapiens
caggaagccagcag

SEQ ID NO: 2231303 - DNA, 17 bp, Homo sapiens
caggaagccagcaggct

SEQ ID NO: 2231304 - DNA, 21 bp, Homo sapiens
caggaagccagcaggctctca

SEQ ID NO: 2231305 - DNA, 22 bp, Homo sapiens
caggaagccagcaggctctcag

SEQ ID NO: 2231306 - DNA, 20 bp, Homo sapiens
caggaagctcagggcctggc

SEQ ID NO: 2231307 - DNA, 18 bp, Homo sapiens
caggaagtactggagaaa

SEQ ID NO: 2231308 - DNA, 14 bp, Homo sapiens
caggagcagccaca

SEQ ID NO: 2231309 - DNA, 14 bp, Homo sapiens
caggaggccagcct

SEQ ID NO: 2231310 - DNA, 19 bp, Homo sapiens
caggaggccagccttgacc

SEQ ID NO: 2231311 - DNA, 22 bp, Homo sapiens
caggagtttgagaccaacctgg

SEQ ID NO: 2231312 - DNA, 23 bp, Homo sapiens
caggagtttgagaccaacctggg

SEQ ID NO: 2231313 - DNA, 20 bp, Homo sapiens
caggcaatgctggctgttgg

SEQ ID NO: 2231314 - DNA, 21 bp, Homo sapiens
caggcaatgctggctgttggc

SEQ ID NO: 2231315 - DNA, 14 bp, Homo sapiens
caggcagccaggcc

SEQ ID NO: 2231316 - DNA, 13 bp, Homo sapiens
caggcaggtcttg

SEQ ID NO: 2231317 - DNA, 22 bp, Homo sapiens
caggcaggtcttgaactcctgg

SEQ ID NO: 2231318 - DNA, 16 bp, Homo sapiens
caggcagtggggctgg

SEQ ID NO: 2231319 - DNA, 15 bp, Homo sapiens
caggcatgttctctg

SEQ ID NO: 2231320 - DNA, 18 bp, Homo sapiens
caggccacaagacccttg

SEQ ID NO: 2231321 - DNA, 15 bp, Homo sapiens
caggccagctgcttg

SEQ ID NO: 2231322 - DNA, 17 bp, Homo sapiens
caggccagctgcttggg

SEQ ID NO: 2231323 - DNA, 11 bp, Homo sapiens
caggccaggcc

SEQ ID NO: 2231324 - DNA, 13 bp, Homo sapiens
caggccaggccct

SEQ ID NO: 2231325 - DNA, 16 bp, Homo sapiens
caggccaggccctctg

SEQ ID NO: 2231326 - DNA, 19 bp, Homo sapiens
caggccaggccctctgccc

SEQ ID NO: 2231327 - DNA, 22 bp, Homo sapiens
caggccaggccctctgcccact

SEQ ID NO: 2231328 - DNA, 13 bp, Homo sapiens
caggcccctgcca

SEQ ID NO: 2231329 - DNA, 22 bp, Homo sapiens
caggcccggctccaggctcctt

SEQ ID NO: 2231330 - DNA, 19 bp, Homo sapiens
caggccctctgcccactcc

SEQ ID NO: 2231331 - DNA, 13 bp, Homo sapiens
caggcctccccag

SEQ ID NO: 2231332 - DNA, 18 bp, Homo sapiens
caggcctccccagcacct

SEQ ID NO: 2231333 - DNA, 14 bp, Homo sapiens
caggctctcaggcc

SEQ ID NO: 2231334 - DNA, 18 bp, Homo sapiens
caggctctcaggccagct

SEQ ID NO: 2231335 - DNA, 20 bp, Homo sapiens
caggctctcaggccagctgc

SEQ ID NO: 2231336 - DNA, 17 bp, Homo sapiens
caggctggcgtgcagtg

SEQ ID NO: 2231337 - DNA, 18 bp, Homo sapiens
caggctggcgtgcagtgg

SEQ ID NO: 2231338 - DNA, 12 bp, Homo sapiens
caggctgggaga

SEQ ID NO: 2231339 - DNA, 20 bp, Homo sapiens
caggctgggcttcagtggca

SEQ ID NO: 2231340 - DNA, 19 bp, Homo sapiens
caggctggtctcaaactct

SEQ ID NO: 2231341 - DNA, 14 bp, Homo sapiens
caggctgtatccca

SEQ ID NO: 2231342 - DNA, 22 bp, Homo sapiens
caggctgtatcccatgagcctc

SEQ ID NO: 2231343 - DNA, 16 bp, Homo sapiens
caggcttagtcactga

SEQ ID NO: 2231344 - DNA, 20 bp, Homo sapiens
caggcttagtcactgagaca

SEQ ID NO: 2231345 - DNA, 16 bp, Homo sapiens
cagggaaacagctaat

SEQ ID NO: 2231346 - DNA, 13 bp, Homo sapiens
cagggacagaggg

SEQ ID NO: 2231347 - DNA, 23 bp, Homo sapiens
cagggacagagggggtggcctcc

SEQ ID NO: 2231348 - DNA, 16 bp, Homo sapiens
cagggagggcttctgc

SEQ ID NO: 2231349 - DNA, 21 bp, Homo sapiens
cagggcacaccgggcactcag

SEQ ID NO: 2231350 - DNA, 22 bp, Homo sapiens
cagggcacaccgggcactcaga

SEQ ID NO: 2231351 - DNA, 17 bp, Homo sapiens
caggggaaaatcagcct

SEQ ID NO: 2231352 - DNA, 14 bp, Homo sapiens
caggggtgggacac

SEQ ID NO: 2231353 - DNA, 21 bp, Homo sapiens
caggggtgggacaccctgtga

SEQ ID NO: 2231354 - DNA, 12 bp, Homo sapiens
cagggtccctgg

SEQ ID NO: 2231355 - DNA, 15 bp, Homo sapiens
cagggtccctggtgg

SEQ ID NO: 2231356 - DNA, 22 bp, Homo sapiens
cagggtccctggtggcagctca

SEQ ID NO: 2231357 - DNA, 21 bp, Homo sapiens
cagggtctcactatgttgccc

SEQ ID NO: 2231358 - DNA, 22 bp, Homo sapiens
cagggtctcactatgttgccca

SEQ ID NO: 2231359 - DNA, 23 bp, Homo sapiens
cagggtctcactatgttgcccag

SEQ ID NO: 2231360 - DNA, 15 bp, Homo sapiens
cagggtctcactctg

SEQ ID NO: 2231361 - DNA, 17 bp, Homo sapiens
cagggtgagcactctgg

SEQ ID NO: 2231362 - DNA, 14 bp, Homo sapiens
cagggttggcccct

SEQ ID NO: 2231363 - DNA, 16 bp, Homo sapiens
cagggttttgccatgt

SEQ ID NO: 2231364 - DNA, 14 bp, Homo sapiens
caggtaacaggcag

SEQ ID NO: 2231365 - DNA, 16 bp, Homo sapiens
caggtaacaggcagat

SEQ ID NO: 2231366 - DNA, 17 bp, Homo sapiens
caggtaacaggcagata

SEQ ID NO: 2231367 - DNA, 21 bp, Homo sapiens
caggtaacaggcagatacagg

SEQ ID NO: 2231368 - DNA, 13 bp, Homo sapiens
caggtgagaagca

SEQ ID NO: 2231369 - DNA, 20 bp, Homo sapiens
caggtgagaagcagaggaag

SEQ ID NO: 2231370 - DNA, 15 bp, Homo sapiens
caggtgcacaagctc

SEQ ID NO: 2231371 - DNA, 13 bp, Homo sapiens
caggtgctgccat

SEQ ID NO: 2231372 - DNA, 13 bp, Homo sapiens
caggtggggcagc

SEQ ID NO: 2231373 - DNA, 15 bp, Homo sapiens
caggtggggcagctt

SEQ ID NO: 2231374 - DNA, 17 bp, Homo sapiens
caggtggggcagcttga

SEQ ID NO: 2231375 - DNA, 16 bp, Homo sapiens
caggtgtccctgcact

SEQ ID NO: 2231376 - DNA, 20 bp, Homo sapiens
caggtgtgagtcaccaagcc

SEQ ID NO: 2231377 - DNA, 23 bp, Homo sapiens
caggtgtgagtcaccaagcccag

SEQ ID NO: 2231378 - DNA, 12 bp, Homo sapiens
caggttcagctt

SEQ ID NO: 2231379 - DNA, 13 bp, Homo sapiens
caggttcagcttg

SEQ ID NO: 2231380 - DNA, 19 bp, Homo sapiens
cagtaaatgggggtgcatt

SEQ ID NO: 2231381 - DNA, 18 bp, Homo sapiens
cattccccaggaggccag

SEQ ID NO: 2231382 - DNA, 19 bp, Homo sapiens
cattccccaggaggccagc

SEQ ID NO: 2231383 - DNA, 14 bp, Homo sapiens
cattcctgatgctt

SEQ ID NO: 2231384 - DNA, 16 bp, Homo sapiens
cattctccttgtgtta

SEQ ID NO: 2231385 - DNA, 12 bp, Homo sapiens
cattctgcctgc

SEQ ID NO: 2231386 - DNA, 17 bp, Homo sapiens
cattctgttaatcatta

SEQ ID NO: 2231387 - DNA, 19 bp, Homo sapiens
cattgaaatctttttgctt

SEQ ID NO: 2231388 - DNA, 15 bp, Homo sapiens
cattgacctgaggcc

SEQ ID NO: 2231389 - DNA, 15 bp, Homo sapiens
cattgcggacagcca

SEQ ID NO: 2231390 - DNA, 21 bp, Homo sapiens
cattgcggacagccacggcca

SEQ ID NO: 2231391 - DNA, 17 bp, Homo sapiens
catttactttgtgttca

SEQ ID NO: 2231392 - DNA, 16 bp, Homo sapiens
catttattctgctcac

SEQ ID NO: 2231393 - DNA, 12 bp, Homo sapiens
catttcctgtgt

SEQ ID NO: 2231394 - DNA, 17 bp, Homo sapiens
catttgaaaattttgat

SEQ ID NO: 2231395 - DNA, 19 bp, Homo sapiens
catttgaaaattttgatgt

SEQ ID NO: 2231396 - DNA, 19 bp, Homo sapiens
catttgaggtctgttcttt

SEQ ID NO: 2231397 - DNA, 15 bp, Homo sapiens
catttggattggatg

SEQ ID NO: 2231398 - DNA, 19 bp, Homo sapiens
cattttattttattatgca

SEQ ID NO: 2231399 - DNA, 23 bp, Homo sapiens
cattttattttattatgcatgaa

SEQ ID NO: 2231400 - DNA, 22 bp, Homo sapiens
cattttggggtacccactgctc

SEQ ID NO: 2231401 - DNA, 15 bp, Homo sapiens
catttttaagtgctg

SEQ ID NO: 2231402 - DNA, 18 bp, Homo sapiens
catttttagtagagacag

SEQ ID NO: 2231403 - DNA, 19 bp, Homo sapiens
catttttagtagagacagg

SEQ ID NO: 2231404 - DNA, 15 bp, Homo sapiens
cattttttaaatgca

SEQ ID NO: 2231405 - DNA, 17 bp, Homo sapiens
ccaaagcctcctccagc

SEQ ID NO: 2231406 - DNA, 22 bp, Homo sapiens
ccaaagcctcctccagccgcca

SEQ ID NO: 2231407 - DNA, 16 bp, Homo sapiens
ccaaagctaggcctgg

SEQ ID NO: 2231408 - DNA, 22 bp, Homo sapiens
ccaaagtacactgtttcaaact

SEQ ID NO: 2231409 - DNA, 15 bp, Homo sapiens
ccaaatcagctgcta

SEQ ID NO: 2231410 - DNA, 21 bp, Homo sapiens
ccaacatactcccatctgtga

SEQ ID NO: 2231411 - DNA, 22 bp, Homo sapiens
ccaacatactcccatctgtgaa

SEQ ID NO: 2231412 - DNA, 16 bp, Homo sapiens
ccaacatcaacatctt

SEQ ID NO: 2231413 - DNA, 13 bp, Homo sapiens
ccaaccctcatca

SEQ ID NO: 2231414 - DNA, 13 bp, Homo sapiens
ccaacgtctgtgc

SEQ ID NO: 2231415 - DNA, 15 bp, Homo sapiens
ccaacgtctgtgcca

SEQ ID NO: 2231416 - DNA, 14 bp, Homo sapiens
ccaactcaccccag

SEQ ID NO: 2231417 - DNA, 19 bp, Homo sapiens
ccaagaagcccaggaaagg

SEQ ID NO: 2231418 - DNA, 21 bp, Homo sapiens
ccaagagagacagcacaggca

SEQ ID NO: 2231419 - DNA, 12 bp, Homo sapiens
ccaagctcccag

SEQ ID NO: 2231420 - DNA, 15 bp, Homo sapiens
ccaagctcccaggca

SEQ ID NO: 2231421 - DNA, 12 bp, Homo sapiens
ccaagctctgct

SEQ ID NO: 2231422 - DNA, 14 bp, Homo sapiens
ccaagctctgctcc

SEQ ID NO: 2231423 - DNA, 16 bp, Homo sapiens
ccaagctctgctcctc

SEQ ID NO: 2231424 - DNA, 12 bp, Homo sapiens
ccaagctggtcc

SEQ ID NO: 2231425 - DNA, 16 bp, Homo sapiens
ccaaggccaaaggaag

SEQ ID NO: 2231426 - DNA, 18 bp, Homo sapiens
ccaaggccaaaggaagca

SEQ ID NO: 2231427 - DNA, 18 bp, Homo sapiens
ccaagggcctggcctgag

SEQ ID NO: 2231428 - DNA, 23 bp, Homo sapiens
ccaaggtttggggaagaacgaag

SEQ ID NO: 2231429 - DNA, 20 bp, Homo sapiens
ccaagtcaagtgaaaaagga

SEQ ID NO: 2231430 - DNA, 17 bp, Homo sapiens
ccaatatttaccagacc

SEQ ID NO: 2231431 - DNA, 15 bp, Homo sapiens
ccaatgatggtcacc

SEQ ID NO: 2231432 - DNA, 14 bp, Homo sapiens
ccaatgcactttgt

SEQ ID NO: 2231433 - DNA, 23 bp, Homo sapiens
ccaatggactaacttgtctttgg

SEQ ID NO: 2231434 - DNA, 16 bp, Homo sapiens
ccacaagacccttgtg

SEQ ID NO: 2231435 - DNA, 16 bp, Homo sapiens
ccacaagagcccaggc

SEQ ID NO: 2231436 - DNA, 19 bp, Homo sapiens
ccacaagagcccaggcctc

SEQ ID NO: 2231437 - DNA, 21 bp, Homo sapiens
ccacaagagcccaggcctcct

SEQ ID NO: 2231438 - DNA, 20 bp, Homo sapiens
ccacaagttaaataaatcat

SEQ ID NO: 2231439 - DNA, 12 bp, Homo sapiens
ccacacccagcc

SEQ ID NO: 2231440 - DNA, 20 bp, Homo sapiens
ccacacccagcccacttctg

SEQ ID NO: 2231441 - DNA, 14 bp, Homo sapiens
ccacatcttgctct

SEQ ID NO: 2231442 - DNA, 23 bp, Homo sapiens
ccacatcttgctctgctgacaga

SEQ ID NO: 2231443 - DNA, 17 bp, Homo sapiens
ccaccacacccagccca

SEQ ID NO: 2231444 - DNA, 14 bp, Homo sapiens
ccaccatcaagcca

SEQ ID NO: 2231445 - DNA, 18 bp, Homo sapiens
ccaccatcaccagacagg

SEQ ID NO: 2231446 - DNA, 19 bp, Homo sapiens
ccaccatcatgtctggcta

SEQ ID NO: 2231447 - DNA, 14 bp, Homo sapiens
ccacccaggagccc

SEQ ID NO: 2231448 - DNA, 21 bp, Homo sapiens
ccacccaggagccccgaggcc

SEQ ID NO: 2231449 - DNA, 23 bp, Homo sapiens
ccacccaggagccccgaggcctt

SEQ ID NO: 2231450 - DNA, 11 bp, Homo sapiens
ccaccccaggc

SEQ ID NO: 2231451 - DNA, 17 bp, Homo sapiens
ccacccccacccaaggg

SEQ ID NO: 2231452 - DNA, 18 bp, Homo sapiens
ccaccctgaaagccctga

SEQ ID NO: 2231453 - DNA, 12 bp, Homo sapiens
ccaccctgctct

SEQ ID NO: 2231454 - DNA, 13 bp, Homo sapiens
ccacctcagcctc

SEQ ID NO: 2231455 - DNA, 19 bp, Homo sapiens
ccacctctctcactccttg

SEQ ID NO: 2231456 - DNA, 20 bp, Homo sapiens
ccacctctctcactccttga

SEQ ID NO: 2231457 - DNA, 17 bp, Homo sapiens
ccacctgcctgttgggc

SEQ ID NO: 2231458 - DNA, 20 bp, Homo sapiens
ccacctgcctgttgggccag

SEQ ID NO: 2231459 - DNA, 14 bp, Homo sapiens
ccacctggcctctg

SEQ ID NO: 2231460 - DNA, 16 bp, Homo sapiens
ccacctggcctctgca

SEQ ID NO: 2231461 - DNA, 20 bp, Homo sapiens
ccacctggcctctgcactcc

SEQ ID NO: 2231462 - DNA, 12 bp, Homo sapiens
ccaccttggctg

SEQ ID NO: 2231463 - DNA, 13 bp, Homo sapiens
ccacgcccccact

SEQ ID NO: 2231464 - DNA, 16 bp, Homo sapiens
ccacgctggagtgcag

SEQ ID NO: 2231465 - DNA, 18 bp, Homo sapiens
ccacggccaggccagagg

SEQ ID NO: 2231466 - DNA, 19 bp, Homo sapiens
ccacgtccctgcggaagcc

SEQ ID NO: 2231467 - DNA, 14 bp, Homo sapiens
ccactacattctgt

SEQ ID NO: 2231468 - DNA, 18 bp, Homo sapiens
ccactacattctgttaat

SEQ ID NO: 2231469 - DNA, 17 bp, Homo sapiens
ccactccctgcaacctg

SEQ ID NO: 2231470 - DNA, 19 bp, Homo sapiens
ccactgcactccagcctgg

SEQ ID NO: 2231471 - DNA, 11 bp, Homo sapiens
ccactgctctg

SEQ ID NO: 2231472 - DNA, 15 bp, Homo sapiens
ccactgtgaagagaa

SEQ ID NO: 2231473 - DNA, 19 bp, Homo sapiens
ccactgtgccatgtgccag

SEQ ID NO: 2231474 - DNA, 13 bp, Homo sapiens
ccactttctagcc

SEQ ID NO: 2231475 - DNA, 22 bp, Homo sapiens
ccagaagtttgagatcagcctg

SEQ ID NO: 2231476 - DNA, 17 bp, Homo sapiens
ccagacaccttgacagg

SEQ ID NO: 2231477 - DNA, 20 bp, Homo sapiens
ccagacaccttgacagggca

SEQ ID NO: 2231478 - DNA, 15 bp, Homo sapiens
ccagacccccttgcc

SEQ ID NO: 2231479 - DNA, 13 bp, Homo sapiens
ccagagagggtgg

SEQ ID NO: 2231480 - DNA, 16 bp, Homo sapiens
ccagagctgccacctg

SEQ ID NO: 2231481 - DNA, 19 bp, Homo sapiens
ccagagctgccacctgcct

SEQ ID NO: 2231482 - DNA, 22 bp, Homo sapiens
ccagaggagagaggaccccctg

SEQ ID NO: 2231483 - DNA, 17 bp, Homo sapiens
ccagagggagtgacaga

SEQ ID NO: 2231484 - DNA, 15 bp, Homo sapiens
ccagagggcctgcaa

SEQ ID NO: 2231485 - DNA, 16 bp, Homo sapiens
ccagagggcctgcaag

SEQ ID NO: 2231486 - DNA, 17 bp, Homo sapiens
ccagagggcctgcaagg

SEQ ID NO: 2231487 - DNA, 18 bp, Homo sapiens
ccagagggcctgcaaggg

SEQ ID NO: 2231488 - DNA, 20 bp, Homo sapiens
ccagagggcctgcaagggag

SEQ ID NO: 2231489 - DNA, 14 bp, Homo sapiens
ccagatgcaccagc

SEQ ID NO: 2231490 - DNA, 17 bp, Homo sapiens
ccagatgcaccagccct

SEQ ID NO: 2231491 - DNA, 18 bp, Homo sapiens
ccagatgcaccagccctt

SEQ ID NO: 2231492 - DNA, 19 bp, Homo sapiens
ccagattctttcctgaggc

SEQ ID NO: 2231493 - DNA, 14 bp, Homo sapiens
ccagattgcaacag

SEQ ID NO: 2231494 - DNA, 11 bp, Homo sapiens
atcccccgccc

SEQ ID NO: 2231495 - DNA, 16 bp, Homo sapiens
atcccccgccccatcc

SEQ ID NO: 2231496 - DNA, 13 bp, Homo sapiens
atccctcatcctc

SEQ ID NO: 2231497 - DNA, 14 bp, Homo sapiens
atccctcatcctca

SEQ ID NO: 2231498 - DNA, 17 bp, Homo sapiens
atccctgaaggccccgc

SEQ ID NO: 2231499 - DNA, 16 bp, Homo sapiens
atcctaggcatttgct

SEQ ID NO: 2231500 - DNA, 19 bp, Homo sapiens
atcctcatacccaccccca

SEQ ID NO: 2231501 - DNA, 23 bp, Homo sapiens
atcctcatacccacccccaccca

SEQ ID NO: 2231502 - DNA, 22 bp, Homo sapiens
atcctccaggtgcacaagctcc

SEQ ID NO: 2231503 - DNA, 16 bp, Homo sapiens
atcctcctcagatctt

SEQ ID NO: 2231504 - DNA, 22 bp, Homo sapiens
atcctcctgcccccaccccagg

SEQ ID NO: 2231505 - DNA, 18 bp, Homo sapiens
atcctctgtacagagccc

SEQ ID NO: 2231506 - DNA, 14 bp, Homo sapiens
atcgtcactgctta

SEQ ID NO: 2231507 - DNA, 14 bp, Homo sapiens
atcgtgacaacact

SEQ ID NO: 2231508 - DNA, 13 bp, Homo sapiens
atctaaatggaac

SEQ ID NO: 2231509 - DNA, 18 bp, Homo sapiens
atctagatactgtatcat

SEQ ID NO: 2231510 - DNA, 19 bp, Homo sapiens
atctagatactgtatcatg

SEQ ID NO: 2231511 - DNA, 21 bp, Homo sapiens
atctcaaataactaaaaggta

SEQ ID NO: 2231512 - DNA, 23 bp, Homo sapiens
atctcaaataactaaaaggtatg

SEQ ID NO: 2231513 - DNA, 14 bp, Homo sapiens
atctcaaatttcta

SEQ ID NO: 2231514 - DNA, 16 bp, Homo sapiens
atctcaaatttctaaa

SEQ ID NO: 2231515 - DNA, 23 bp, Homo sapiens
atctcacacatgagcatcaggcc

SEQ ID NO: 2231516 - DNA, 14 bp, Homo sapiens
atctcagggcctgg

SEQ ID NO: 2231517 - DNA, 17 bp, Homo sapiens
atctccaaaataaaact

SEQ ID NO: 2231518 - DNA, 21 bp, Homo sapiens
atctccaaaataaaacttttt

SEQ ID NO: 2231519 - DNA, 16 bp, Homo sapiens
atctcccccagcccca

SEQ ID NO: 2231520 - DNA, 18 bp, Homo sapiens
atctcttgagcctgggag

SEQ ID NO: 2231521 - DNA, 14 bp, Homo sapiens
atctgaaaatgtat

SEQ ID NO: 2231522 - DNA, 16 bp, Homo sapiens
atctgaaaatgtatgt

SEQ ID NO: 2231523 - DNA, 17 bp, Homo sapiens
atctgtgaaaggaaaga

SEQ ID NO: 2231524 - DNA, 23 bp, Homo sapiens
atctgtgaaaggaaagagggagg

SEQ ID NO: 2231525 - DNA, 17 bp, Homo sapiens
atcttgaagacttttct

SEQ ID NO: 2231526 - DNA, 15 bp, Homo sapiens
atcttgctctgctga

SEQ ID NO: 2231527 - DNA, 18 bp, Homo sapiens
atctttgcagacaggcaa

SEQ ID NO: 2231528 - DNA, 12 bp, Homo sapiens
atgaaagactgt

SEQ ID NO: 2231529 - DNA, 16 bp, Homo sapiens
atgaaagactgtacaa

SEQ ID NO: 2231530 - DNA, 19 bp, Homo sapiens
atgaaagactgtacaaagt

SEQ ID NO: 2231531 - DNA, 20 bp, Homo sapiens
atgaaagactgtacaaagta

SEQ ID NO: 2231532 - DNA, 18 bp, Homo sapiens
atgaaagggcccagagag

SEQ ID NO: 2231533 - DNA, 23 bp, Homo sapiens
atgaaccacatcttgctctgctg

SEQ ID NO: 2231534 - DNA, 14 bp, Homo sapiens
atgacacatgcaag

SEQ ID NO: 2231535 - DNA, 18 bp, Homo sapiens
atgacacgaatattgctg

SEQ ID NO: 2231536 - DNA, 20 bp, Homo sapiens
atgacacgaatattgctgat

SEQ ID NO: 2231537 - DNA, 13 bp, Homo sapiens
atgacctttcaat

SEQ ID NO: 2231538 - DNA, 22 bp, Homo sapiens
atgacctttcaataggaaaaac

SEQ ID NO: 2231539 - DNA, 23 bp, Homo sapiens
atgacctttcaataggaaaaact

SEQ ID NO: 2231540 - DNA, 16 bp, Homo sapiens
atgactccagaatttc

SEQ ID NO: 2231541 - DNA, 22 bp, Homo sapiens
atgacttaagcacacttgacat

SEQ ID NO: 2231542 - DNA, 16 bp, Homo sapiens
atgacttactgtacat

SEQ ID NO: 2231543 - DNA, 20 bp, Homo sapiens
atgagcatcaggccaggccc

SEQ ID NO: 2231544 - DNA, 22 bp, Homo sapiens
atgagcatcaggccaggccctc

SEQ ID NO: 2231545 - DNA, 12 bp, Homo sapiens
atgagcctcagc

SEQ ID NO: 2231546 - DNA, 18 bp, Homo sapiens
atgagcctcagcatcctg

SEQ ID NO: 2231547 - DNA, 19 bp, Homo sapiens
atgagcctcagcatcctgg

SEQ ID NO: 2231548 - DNA, 12 bp, Homo sapiens
atgagcctggca

SEQ ID NO: 2231549 - DNA, 22 bp, Homo sapiens
atgaggcatttgtttgaactga

SEQ ID NO: 2231550 - DNA, 18 bp, Homo sapiens
atgaggtcagagcctgca

SEQ ID NO: 2231551 - DNA, 19 bp, Homo sapiens
atgaggtcagagcctgcag

SEQ ID NO: 2231552 - DNA, 13 bp, Homo sapiens
atgagtcccctgt

SEQ ID NO: 2231553 - DNA, 18 bp, Homo sapiens
atgatcacggctcactgc

SEQ ID NO: 2231554 - DNA, 14 bp, Homo sapiens
atgatcttctttat

SEQ ID NO: 2231555 - DNA, 17 bp, Homo sapiens
atgatctttgcagacag

SEQ ID NO: 2231556 - DNA, 23 bp, Homo sapiens
atgatgaaatgaggtcagagcct

SEQ ID NO: 2231557 - DNA, 17 bp, Homo sapiens
atgatgccatgaggaac

SEQ ID NO: 2231558 - DNA, 24 bp, Homo sapiens
atgatgttttccatgagtcccctg

SEQ ID NO: 2231559 - DNA, 20 bp, Homo sapiens
atgattaaccacttcagctg

SEQ ID NO: 2231560 - DNA, 21 bp, Homo sapiens
atgattcaacaggttttcctg

SEQ ID NO: 2231561 - DNA, 18 bp, Homo sapiens
atgcaaaccatcattgaa

SEQ ID NO: 2231562 - DNA, 21 bp, Homo sapiens
atgcaaaccatcattgaaatc

SEQ ID NO: 2231563 - DNA, 22 bp, Homo sapiens
atgcaaaccatcattgaaatct

SEQ ID NO: 2231564 - DNA, 18 bp, Homo sapiens
atgcacaaacagaggccg

SEQ ID NO: 2231565 - DNA, 14 bp, Homo sapiens
atgcacacattttt

SEQ ID NO: 2231566 - DNA, 23 bp, Homo sapiens
atgcacagagttgttacattttt

SEQ ID NO: 2231567 - DNA, 14 bp, Homo sapiens
atgcaccagccctt

SEQ ID NO: 2231568 - DNA, 22 bp, Homo sapiens
atgcaccagcccttagcaggga

SEQ ID NO: 2231569 - DNA, 12 bp, Homo sapiens
atgcactttgtt

SEQ ID NO: 2231570 - DNA, 10 bp, Homo sapiens
atgcagagat

SEQ ID NO: 2231571 - DNA, 15 bp, Homo sapiens
atgcagcctcacagt

SEQ ID NO: 2231572 - DNA, 16 bp, Homo sapiens
atgcatgaagtaatat

SEQ ID NO: 2231573 - DNA, 20 bp, Homo sapiens
atgcatgaagtaatatgcac

SEQ ID NO: 2231574 - DNA, 21 bp, Homo sapiens
atgccatgaggaacaaggcaa

SEQ ID NO: 2231575 - DNA, 12 bp, Homo sapiens
atgcccagcccc

SEQ ID NO: 2231576 - DNA, 19 bp, Homo sapiens
atgcctctctcaggccaaa

SEQ ID NO: 2231577 - DNA, 23 bp, Homo sapiens
atgcctggatggggctgcaccgg

SEQ ID NO: 2231578 - DNA, 14 bp, Homo sapiens
atgcctggtggcag

SEQ ID NO: 2231579 - DNA, 18 bp, Homo sapiens
atgcctggtggcagctgc

SEQ ID NO: 2231580 - DNA, 17 bp, Homo sapiens
atgcgggggagcaggca

SEQ ID NO: 2231581 - DNA, 15 bp, Homo sapiens
atgctctgcatgtta

SEQ ID NO: 2231582 - DNA, 11 bp, Homo sapiens
atgctgccctg

SEQ ID NO: 2231583 - DNA, 20 bp, Homo sapiens
atgctggctgttggctgggg

SEQ ID NO: 2231584 - DNA, 22 bp, Homo sapiens
atgctggctgttggctgggggc

SEQ ID NO: 2231585 - DNA, 23 bp, Homo sapiens
atgctgtcccttacgtgagtcct

SEQ ID NO: 2231586 - DNA, 16 bp, Homo sapiens
atgcttctcactgcca

SEQ ID NO: 2231587 - DNA, 20 bp, Homo sapiens
atgcttctcactgccatgcc

SEQ ID NO: 2231588 - DNA, 12 bp, Homo sapiens
atgcttgtacat

SEQ ID NO: 2231589 - DNA, 16 bp, Homo sapiens
atgcttgtacataatg

SEQ ID NO: 2231590 - DNA, 20 bp, Homo sapiens
atggaaatgggcagagcaga

SEQ ID NO: 2231591 - DNA, 14 bp, Homo sapiens
atggaacactctga

SEQ ID NO: 2231592 - DNA, 18 bp, Homo sapiens
atggaacactctgagact

SEQ ID NO: 2231593 - DNA, 16 bp, Homo sapiens
atggaagacagctctt

SEQ ID NO: 2231594 - DNA, 17 bp, Homo sapiens
atggaagacagctctta

SEQ ID NO: 2231595 - DNA, 18 bp, Homo sapiens
atggaagacagctcttat

SEQ ID NO: 2231596 - DNA, 18 bp, Homo sapiens
atggatttccagccaaag

SEQ ID NO: 2231597 - DNA, 18 bp, Homo sapiens
atggctaatgtactgcat

SEQ ID NO: 2231598 - DNA, 23 bp, Homo sapiens
atggctgccaatgggagctcatg

SEQ ID NO: 2231599 - DNA, 16 bp, Homo sapiens
atggcttttgtgcatt

SEQ ID NO: 2231600 - DNA, 17 bp, Homo sapiens
atggcttttgtgcatta

SEQ ID NO: 2231601 - DNA, 13 bp, Homo sapiens
atgggagctcatg

SEQ ID NO: 2231602 - DNA, 15 bp, Homo sapiens
atgggcagagcagag

SEQ ID NO: 2231603 - DNA, 17 bp, Homo sapiens
atgggcctcctgtgtgt

SEQ ID NO: 2231604 - DNA, 20 bp, Homo sapiens
atgggctgggttctacccag

SEQ ID NO: 2231605 - DNA, 20 bp, Homo sapiens
atgggtgcttggaggaagga

SEQ ID NO: 2231606 - DNA, 12 bp, Homo sapiens
atggtggctggg

SEQ ID NO: 2231607 - DNA, 17 bp, Homo sapiens
atggtggctgggttgga

SEQ ID NO: 2231608 - DNA, 15 bp, Homo sapiens
atggttttcaaaata

SEQ ID NO: 2231609 - DNA, 15 bp, Homo sapiens
atgtaattaagtact

SEQ ID NO: 2231610 - DNA, 15 bp, Homo sapiens
atgtatgtgtaagta

SEQ ID NO: 2231611 - DNA, 14 bp, Homo sapiens
atgtcacaggcagg

SEQ ID NO: 2231612 - DNA, 23 bp, Homo sapiens
atgtctctttaatgtcacaggca

SEQ ID NO: 2231613 - DNA, 17 bp, Homo sapiens
atgtgatgagaggaaat

SEQ ID NO: 2231614 - DNA, 23 bp, Homo sapiens
atgtgcacatgcacgtgtgtgca

SEQ ID NO: 2231615 - DNA, 15 bp, Homo sapiens
atgtgcccccacccc

SEQ ID NO: 2231616 - DNA, 16 bp, Homo sapiens
atgtgcccccaccccc

SEQ ID NO: 2231617 - DNA, 17 bp, Homo sapiens
atgttctctcttctcca

SEQ ID NO: 2231618 - DNA, 13 bp, Homo sapiens
atgttctctgagg

SEQ ID NO: 2231619 - DNA, 17 bp, Homo sapiens
atgttctctgaggacac

SEQ ID NO: 2231620 - DNA, 15 bp, Homo sapiens
atgttctgggacaca

SEQ ID NO: 2231621 - DNA, 18 bp, Homo sapiens
agtgggtgaataatacag

SEQ ID NO: 2231622 - DNA, 19 bp, Homo sapiens
agtgggtgaataatacagt

SEQ ID NO: 2231623 - DNA, 16 bp, Homo sapiens
agtggtgcgatctggg

SEQ ID NO: 2231624 - DNA, 17 bp, Homo sapiens
agtggtgcgatctgggt

SEQ ID NO: 2231625 - DNA, 17 bp, Homo sapiens
agtggtggttttctgtt

SEQ ID NO: 2231626 - DNA, 19 bp, Homo sapiens
agtggtggttttctgttct

SEQ ID NO: 2231627 - DNA, 23 bp, Homo sapiens
agtggtggttttctgttctttct

SEQ ID NO: 2231628 - DNA, 21 bp, Homo sapiens
agtggttcctaatcctctagg

SEQ ID NO: 2231629 - DNA, 20 bp, Homo sapiens
agtgtgcctgaagtcccaga

SEQ ID NO: 2231630 - DNA, 21 bp, Homo sapiens
agtgtgcctgaagtcccagat

SEQ ID NO: 2231631 - DNA, 20 bp, Homo sapiens
agtgtggtgtttcctggcac

SEQ ID NO: 2231632 - DNA, 16 bp, Homo sapiens
agttacagacaaagcg

SEQ ID NO: 2231633 - DNA, 16 bp, Homo sapiens
agttcaattctcattt

SEQ ID NO: 2231634 - DNA, 15 bp, Homo sapiens
agttcatcttgaatt

SEQ ID NO: 2231635 - DNA, 16 bp, Homo sapiens
agttctctccttcttc

SEQ ID NO: 2231636 - DNA, 17 bp, Homo sapiens
agttgaaaaacagctga

SEQ ID NO: 2231637 - DNA, 16 bp, Homo sapiens
agttgaagacagagct

SEQ ID NO: 2231638 - DNA, 14 bp, Homo sapiens
agttgatagcacag

SEQ ID NO: 2231639 - DNA, 19 bp, Homo sapiens
agttgatagcacagaccct

SEQ ID NO: 2231640 - DNA, 23 bp, Homo sapiens
agttgatagcacagaccctgccc

SEQ ID NO: 2231641 - DNA, 17 bp, Homo sapiens
agttgattcagctctgc

SEQ ID NO: 2231642 - DNA, 21 bp, Homo sapiens
agttgggtggatgcctggtgg

SEQ ID NO: 2231643 - DNA, 11 bp, Homo sapiens
agttggtcccc

SEQ ID NO: 2231644 - DNA, 18 bp, Homo sapiens
agttggtcccccttccat

SEQ ID NO: 2231645 - DNA, 13 bp, Homo sapiens
agttgttacattt

SEQ ID NO: 2231646 - DNA, 15 bp, Homo sapiens
agttgttacattttt

SEQ ID NO: 2231647 - DNA, 19 bp, Homo sapiens
agttgttacatttttaagt

SEQ ID NO: 2231648 - DNA, 17 bp, Homo sapiens
agttgttagtgtgtctt

SEQ ID NO: 2231649 - DNA, 19 bp, Homo sapiens
agtttctgccgcagccctg

SEQ ID NO: 2231650 - DNA, 19 bp, Homo sapiens
agtttgagatcagcctggg

SEQ ID NO: 2231651 - DNA, 17 bp, Homo sapiens
agtttgattaaattctt

SEQ ID NO: 2231652 - DNA, 11 bp, Homo sapiens
agtttgcagtt

SEQ ID NO: 2231653 - DNA, 22 bp, Homo sapiens
agtttgttagtatgaggcattt

SEQ ID NO: 2231654 - DNA, 13 bp, Homo sapiens
ataaactttacct

SEQ ID NO: 2231655 - DNA, 15 bp, Homo sapiens
ataaactttaccttt

SEQ ID NO: 2231656 - DNA, 16 bp, Homo sapiens
ataaactttacctttt

SEQ ID NO: 2231657 - DNA, 24 bp, Homo sapiens
ataaactttaccttttttatacat

SEQ ID NO: 2231658 - DNA, 21 bp, Homo sapiens
ataaagatgagtgagcatgcc

SEQ ID NO: 2231659 - DNA, 11 bp, Homo sapiens
ataaattattt

SEQ ID NO: 2231660 - DNA, 22 bp, Homo sapiens
ataagaaccttttgagtgcctt

SEQ ID NO: 2231661 - DNA, 23 bp, Homo sapiens
ataagaaccttttgagtgcctta

SEQ ID NO: 2231662 - DNA, 17 bp, Homo sapiens
ataagataaatgtgctg

SEQ ID NO: 2231663 - DNA, 17 bp, Homo sapiens
ataagttaacttccaat

SEQ ID NO: 2231664 - DNA, 12 bp, Homo sapiens
ataatacaccac

SEQ ID NO: 2231665 - DNA, 18 bp, Homo sapiens
ataatacaccactacatt

SEQ ID NO: 2231666 - DNA, 21 bp, Homo sapiens
ataatacaccactacattctg

SEQ ID NO: 2231667 - DNA, 18 bp, Homo sapiens
ataatgtgaaactggatt

SEQ ID NO: 2231668 - DNA, 14 bp, Homo sapiens
ataattctactttg

SEQ ID NO: 2231669 - DNA, 12 bp, Homo sapiens
atacaaaagcat

SEQ ID NO: 2231670 - DNA, 15 bp, Homo sapiens
atacaaaagcatgtg

SEQ ID NO: 2231671 - DNA, 17 bp, Homo sapiens
atacaccactacattct

SEQ ID NO: 2231672 - DNA, 13 bp, Homo sapiens
atacacttacact

SEQ ID NO: 2231673 - DNA, 17 bp, Homo sapiens
atacagaggcaactgca

SEQ ID NO: 2231674 - DNA, 23 bp, Homo sapiens
atacaggaaaagctgctgacagt

SEQ ID NO: 2231675 - DNA, 20 bp, Homo sapiens
atacagttactcagaattct

SEQ ID NO: 2231676 - DNA, 17 bp, Homo sapiens
ataccacttttgttctt

SEQ ID NO: 2231677 - DNA, 19 bp, Homo sapiens
ataccagccagtaaatggg

SEQ ID NO: 2231678 - DNA, 14 bp, Homo sapiens
atacccacccccac

SEQ ID NO: 2231679 - DNA, 16 bp, Homo sapiens
atacccacccccaccc

SEQ ID NO: 2231680 - DNA, 17 bp, Homo sapiens
atacctgtccccctgac

SEQ ID NO: 2231681 - DNA, 15 bp, Homo sapiens
atacgtacacatttt

SEQ ID NO: 2231682 - DNA, 20 bp, Homo sapiens
atactaaccagcagaaatgc

SEQ ID NO: 2231683 - DNA, 15 bp, Homo sapiens
atactacagtttgtt

SEQ ID NO: 2231684 - DNA, 16 bp, Homo sapiens
atactacagtttgtta

SEQ ID NO: 2231685 - DNA, 11 bp, Homo sapiens
atactcccatc

SEQ ID NO: 2231686 - DNA, 14 bp, Homo sapiens
atactcccatctgt

SEQ ID NO: 2231687 - DNA, 16 bp, Homo sapiens
atactctgcttagaat

SEQ ID NO: 2231688 - DNA, 14 bp, Homo sapiens
atagagagagacca

SEQ ID NO: 2231689 - DNA, 18 bp, Homo sapiens
atagcacagaccctgccc

SEQ ID NO: 2231690 - DNA, 21 bp, Homo sapiens
atagccaaggccaaaggaagc

SEQ ID NO: 2231691 - DNA, 18 bp, Homo sapiens
atagcctgcctcttctct

SEQ ID NO: 2231692 - DNA, 22 bp, Homo sapiens
atagctcaggtgtccctgcact

SEQ ID NO: 2231693 - DNA, 16 bp, Homo sapiens
ataggaaaaactgatt

SEQ ID NO: 2231694 - DNA, 17 bp, Homo sapiens
ataggaaaaactgattt

SEQ ID NO: 2231695 - DNA, 17 bp, Homo sapiens
atagtatggtggctggg

SEQ ID NO: 2231696 - DNA, 22 bp, Homo sapiens
atagttggctaggacccctcca

SEQ ID NO: 2231697 - DNA, 16 bp, Homo sapiens
atataggaacttaaat

SEQ ID NO: 2231698 - DNA, 22 bp, Homo sapiens
atatatgttttaagaggcaggg

SEQ ID NO: 2231699 - DNA, 22 bp, Homo sapiens
atatgcacacattttttaaatg

SEQ ID NO: 2231700 - DNA, 22 bp, Homo sapiens
atatgcctgggcagaaggaaga

SEQ ID NO: 2231701 - DNA, 14 bp, Homo sapiens
atatgcttatacac

SEQ ID NO: 2231702 - DNA, 16 bp, Homo sapiens
atatgcttatacactt

SEQ ID NO: 2231703 - DNA, 19 bp, Homo sapiens
atatgcttatacacttaca

SEQ ID NO: 2231704 - DNA, 17 bp, Homo sapiens
atatgtaacaagccacc

SEQ ID NO: 2231705 - DNA, 15 bp, Homo sapiens
atatgtggagttcat

SEQ ID NO: 2231706 - DNA, 20 bp, Homo sapiens
atatgtggagttcatcttga

SEQ ID NO: 2231707 - DNA, 18 bp, Homo sapiens
atatgttttaagaggcag

SEQ ID NO: 2231708 - DNA, 22 bp, Homo sapiens
atattaagaaagactatctaaa

SEQ ID NO: 2231709 - DNA, 22 bp, Homo sapiens
atattaccacagacatactaac

SEQ ID NO: 2231710 - DNA, 13 bp, Homo sapiens
atattcaggaagc

SEQ ID NO: 2231711 - DNA, 17 bp, Homo sapiens
atattgctgatggtgca

SEQ ID NO: 2231712 - DNA, 21 bp, Homo sapiens
atattgctgatggtgcaatga

SEQ ID NO: 2231713 - DNA, 20 bp, Homo sapiens
atcaaaaggttaataaagta

SEQ ID NO: 2231714 - DNA, 21 bp, Homo sapiens
atcaagatgtgacatgtttta

SEQ ID NO: 2231715 - DNA, 18 bp, Homo sapiens
atcaccaacgtctgtgcc

SEQ ID NO: 2231716 - DNA, 19 bp, Homo sapiens
atcaccgaaaacgtggctg

SEQ ID NO: 2231717 - DNA, 21 bp, Homo sapiens
atcaccgaaaacgtggctgct

SEQ ID NO: 2231718 - DNA, 14 bp, Homo sapiens
atcacgccactgca

SEQ ID NO: 2231719 - DNA, 15 bp, Homo sapiens
atcacggctcactgc

SEQ ID NO: 2231720 - DNA, 19 bp, Homo sapiens
atcacggctcactgcagcc

SEQ ID NO: 2231721 - DNA, 22 bp, Homo sapiens
atcacggctcactgcagcctca

SEQ ID NO: 2231722 - DNA, 11 bp, Homo sapiens
atcagaattct

SEQ ID NO: 2231723 - DNA, 12 bp, Homo sapiens
atcagaattctc

SEQ ID NO: 2231724 - DNA, 18 bp, Homo sapiens
atcagcacgatttctgtt

SEQ ID NO: 2231725 - DNA, 19 bp, Homo sapiens
atcagcacgatttctgttt

SEQ ID NO: 2231726 - DNA, 19 bp, Homo sapiens
atcagcctgctccagctgt

SEQ ID NO: 2231727 - DNA, 20 bp, Homo sapiens
atcagcctgctccagctgtt

SEQ ID NO: 2231728 - DNA, 20 bp, Homo sapiens
atcagcctgggcaatgtgat

SEQ ID NO: 2231729 - DNA, 13 bp, Homo sapiens
atcagctgctact

SEQ ID NO: 2231730 - DNA, 23 bp, Homo sapiens
atcagctgctactactcctgtag

SEQ ID NO: 2231731 - DNA, 16 bp, Homo sapiens
atcaggccaggccctc

SEQ ID NO: 2231732 - DNA, 14 bp, Homo sapiens
atcaggtgctgcca

SEQ ID NO: 2231733 - DNA, 19 bp, Homo sapiens
atcaggtgctgccatccag

SEQ ID NO: 2231734 - DNA, 19 bp, Homo sapiens
atcagtctgattcccaagc

SEQ ID NO: 2231735 - DNA, 15 bp, Homo sapiens
atcataaaacttgat

SEQ ID NO: 2231736 - DNA, 23 bp, Homo sapiens
atcatagtggcttaaaacaacac

SEQ ID NO: 2231737 - DNA, 19 bp, Homo sapiens
atcatggaggtttgaagat

SEQ ID NO: 2231738 - DNA, 16 bp, Homo sapiens
atcattaggtgtgact

SEQ ID NO: 2231739 - DNA, 18 bp, Homo sapiens
atccaagctggtcccact

SEQ ID NO: 2231740 - DNA, 21 bp, Homo sapiens
atccaagctggtcccactcag

SEQ ID NO: 2231741 - DNA, 16 bp, Homo sapiens
atccacccacctcagc

SEQ ID NO: 2231742 - DNA, 17 bp, Homo sapiens
atccaggttcagcttgt

SEQ ID NO: 2231743 - DNA, 21 bp, Homo sapiens
atccagtatcttgaagacttt

SEQ ID NO: 2231744 - DNA, 12 bp, Homo sapiens
atcccagcccca

SEQ ID NO: 2231745 - DNA, 24 bp, Homo sapiens
atcccatatgcctgggcagaagga

SEQ ID NO: 2231746 - DNA, 13 bp, Homo sapiens
atcccatgagcct

SEQ ID NO: 2231747 - DNA, 20 bp, Homo sapiens
aggccacaagacccttgtgg

SEQ ID NO: 2231748 - DNA, 23 bp, Homo sapiens
aggccagagacacaagccttcgg

SEQ ID NO: 2231749 - DNA, 13 bp, Homo sapiens
aggccagctgctt

SEQ ID NO: 2231750 - DNA, 13 bp, Homo sapiens
aggccaggccctc

SEQ ID NO: 2231751 - DNA, 14 bp, Homo sapiens
aggccaggccctct

SEQ ID NO: 2231752 - DNA, 17 bp, Homo sapiens
aggccaggccctctgcc

SEQ ID NO: 2231753 - DNA, 19 bp, Homo sapiens
aggccaggccctctgccca

SEQ ID NO: 2231754 - DNA, 23 bp, Homo sapiens
aggccaggccctctgcccactcc

SEQ ID NO: 2231755 - DNA, 16 bp, Homo sapiens
aggccatgggcctcct

SEQ ID NO: 2231756 - DNA, 18 bp, Homo sapiens
aggccatgggcctcctgt

SEQ ID NO: 2231757 - DNA, 19 bp, Homo sapiens
aggcccagagggcctgcaa

SEQ ID NO: 2231758 - DNA, 14 bp, Homo sapiens
aggccccgcccagg

SEQ ID NO: 2231759 - DNA, 16 bp, Homo sapiens
aggccccgcccaggct

SEQ ID NO: 2231760 - DNA, 18 bp, Homo sapiens
aggcccctgccaccctgg

SEQ ID NO: 2231761 - DNA, 15 bp, Homo sapiens
aggcccggctccagg

SEQ ID NO: 2231762 - DNA, 16 bp, Homo sapiens
aggcccggctccaggc

SEQ ID NO: 2231763 - DNA, 18 bp, Homo sapiens
aggcccggctccaggctc

SEQ ID NO: 2231764 - DNA, 14 bp, Homo sapiens
aggccctctgccca

SEQ ID NO: 2231765 - DNA, 17 bp, Homo sapiens
aggccctctgcccactc

SEQ ID NO: 2231766 - DNA, 19 bp, Homo sapiens
aggccctctgcccactccc

SEQ ID NO: 2231767 - DNA, 23 bp, Homo sapiens
aggccctctgcccactccctgca

SEQ ID NO: 2231768 - DNA, 11 bp, Homo sapiens
aggcctcccca

SEQ ID NO: 2231769 - DNA, 12 bp, Homo sapiens
aggcctggccag

SEQ ID NO: 2231770 - DNA, 17 bp, Homo sapiens
aggcctggccagatgca

SEQ ID NO: 2231771 - DNA, 21 bp, Homo sapiens
aggcctggccagatgcaccag

SEQ ID NO: 2231772 - DNA, 12 bp, Homo sapiens
aggcctggggac

SEQ ID NO: 2231773 - DNA, 18 bp, Homo sapiens
aggcctgggggctgggca

SEQ ID NO: 2231774 - DNA, 17 bp, Homo sapiens
aggccttctctgaagga

SEQ ID NO: 2231775 - DNA, 23 bp, Homo sapiens
aggctagtgtggtgtttcctggc

SEQ ID NO: 2231776 - DNA, 13 bp, Homo sapiens
aggctccaggagc

SEQ ID NO: 2231777 - DNA, 14 bp, Homo sapiens
aggctccaggagca

SEQ ID NO: 2231778 - DNA, 18 bp, Homo sapiens
aggctccaggagcagcca

SEQ ID NO: 2231779 - DNA, 19 bp, Homo sapiens
aggctccaggagcagccac

SEQ ID NO: 2231780 - DNA, 23 bp, Homo sapiens
aggctccaggagcagccacattc

SEQ ID NO: 2231781 - DNA, 19 bp, Homo sapiens
aggctcctttagcgcccag

SEQ ID NO: 2231782 - DNA, 17 bp, Homo sapiens
aggctcgagcatgcctg

SEQ ID NO: 2231783 - DNA, 12 bp, Homo sapiens
aggctctcaggc

SEQ ID NO: 2231784 - DNA, 13 bp, Homo sapiens
aggctctgccctt

SEQ ID NO: 2231785 - DNA, 14 bp, Homo sapiens
aggctctgcccttg

SEQ ID NO: 2231786 - DNA, 13 bp, Homo sapiens
aggctggcgtgca

SEQ ID NO: 2231787 - DNA, 17 bp, Homo sapiens
aggctggcgtgcagtgg

SEQ ID NO: 2231788 - DNA, 21 bp, Homo sapiens
aggctgggagagccttccagg

SEQ ID NO: 2231789 - DNA, 22 bp, Homo sapiens
aggctgggagagccttccaggg

SEQ ID NO: 2231790 - DNA, 14 bp, Homo sapiens
aggctgggctccct

SEQ ID NO: 2231791 - DNA, 20 bp, Homo sapiens
aggctgggcttcagtggcag

SEQ ID NO: 2231792 - DNA, 17 bp, Homo sapiens
aggctgggggaagaagc

SEQ ID NO: 2231793 - DNA, 18 bp, Homo sapiens
aggctgggttctgatcct

SEQ ID NO: 2231794 - DNA, 18 bp, Homo sapiens
aggctgtatcccatgagc

SEQ ID NO: 2231795 - DNA, 21 bp, Homo sapiens
aggctgtatcccatgagcctc

SEQ ID NO: 2231796 - DNA, 22 bp, Homo sapiens
aggctgtatcccatgagcctca

SEQ ID NO: 2231797 - DNA, 20 bp, Homo sapiens
aggctgtcaattacaggaag

SEQ ID NO: 2231798 - DNA, 23 bp, Homo sapiens
acttgcagactctacagaggcca

SEQ ID NO: 2231799 - DNA, 23 bp, Homo sapiens
acttggggggctgaggtgggagg

SEQ ID NO: 2231800 - DNA, 19 bp, Homo sapiens
acttgtggacacagctctt

SEQ ID NO: 2231801 - DNA, 12 bp, Homo sapiens
actttacctttt

SEQ ID NO: 2231802 - DNA, 13 bp, Homo sapiens
actttgacctctg

SEQ ID NO: 2231803 - DNA, 15 bp, Homo sapiens
actttgacctctgca

SEQ ID NO: 2231804 - DNA, 19 bp, Homo sapiens
actttgacctctgcagcaa

SEQ ID NO: 2231805 - DNA, 23 bp, Homo sapiens
actttgacctctgcagcaataaa

SEQ ID NO: 2231806 - DNA, 17 bp, Homo sapiens
actttggaaagactttt

SEQ ID NO: 2231807 - DNA, 23 bp, Homo sapiens
actttggaaagacttttccaacc

SEQ ID NO: 2231808 - DNA, 13 bp, Homo sapiens
actttggaaagag

SEQ ID NO: 2231809 - DNA, 14 bp, Homo sapiens
actttggaaagagt

SEQ ID NO: 2231810 - DNA, 16 bp, Homo sapiens
actttgtgttcacctt

SEQ ID NO: 2231811 - DNA, 17 bp, Homo sapiens
actttgttctggctctt

SEQ ID NO: 2231812 - DNA, 20 bp, Homo sapiens
actttgttctggctcttcca

SEQ ID NO: 2231813 - DNA, 23 bp, Homo sapiens
actttgttctggctcttccaggc

SEQ ID NO: 2231814 - DNA, 15 bp, Homo sapiens
acttttgttcttggt

SEQ ID NO: 2231815 - DNA, 23 bp, Homo sapiens
acttttgttcttggtttgtaaat

SEQ ID NO: 2231816 - DNA, 17 bp, Homo sapiens
agaaaaaggatgcacag

SEQ ID NO: 2231817 - DNA, 18 bp, Homo sapiens
agaaaaatgagcctggca

SEQ ID NO: 2231818 - DNA, 22 bp, Homo sapiens
agaaaatggacgtgttatgact

SEQ ID NO: 2231819 - DNA, 20 bp, Homo sapiens
agaaagactatctaaatgtt

SEQ ID NO: 2231820 - DNA, 11 bp, Homo sapiens
agaaagagaga

SEQ ID NO: 2231821 - DNA, 12 bp, Homo sapiens
agaaagagagag

SEQ ID NO: 2231822 - DNA, 13 bp, Homo sapiens
agaaagagagaga

SEQ ID NO: 2231823 - DNA, 20 bp, Homo sapiens
agaaaggaggggatagagag

SEQ ID NO: 2231824 - DNA, 23 bp, Homo sapiens
agaaaggaggggatagagagaga

SEQ ID NO: 2231825 - DNA, 14 bp, Homo sapiens
agaaatgtacagca

SEQ ID NO: 2231826 - DNA, 23 bp, Homo sapiens
agaaccttttgagtgccttacac

SEQ ID NO: 2231827 - DNA, 21 bp, Homo sapiens
ttcttccacaagagcccaggc

SEQ ID NO: 2231828 - DNA, 14 bp, Homo sapiens
ttcttctccctcag

SEQ ID NO: 2231829 - DNA, 15 bp, Homo sapiens
ttcttctgcttcagc

SEQ ID NO: 2231830 - DNA, 13 bp, Homo sapiens
ttcttggtttgta

SEQ ID NO: 2231831 - DNA, 16 bp, Homo sapiens
ttcttggtttgtaaat

SEQ ID NO: 2231832 - DNA, 14 bp, Homo sapiens
ttcttgtgtgttta

SEQ ID NO: 2231833 - DNA, 21 bp, Homo sapiens
ttctttccaaagtacactgtt

SEQ ID NO: 2231834 - DNA, 17 bp, Homo sapiens
ttctttctggctatgca

SEQ ID NO: 2231835 - DNA, 22 bp, Homo sapiens
ttctttctggctatgcatttga

SEQ ID NO: 2231836 - DNA, 21 bp, Homo sapiens
ttgaaaacactgttctctgcc

SEQ ID NO: 2231837 - DNA, 19 bp, Homo sapiens
ttgaactcttcaatctctt

SEQ ID NO: 2231838 - DNA, 15 bp, Homo sapiens
ttgaacttgaaaaaa

SEQ ID NO: 2231839 - DNA, 15 bp, Homo sapiens
ttgaactttgacctc

SEQ ID NO: 2231840 - DNA, 20 bp, Homo sapiens
ttgaactttgacctctgcag

SEQ ID NO: 2231841 - DNA, 10 bp, Homo sapiens
ttgacagggc

SEQ ID NO: 2231842 - DNA, 12 bp, Homo sapiens
ttgacagggcac

SEQ ID NO: 2231843 - DNA, 19 bp, Homo sapiens
ttgacagggcacaccgggc

SEQ ID NO: 2231844 - DNA, 17 bp, Homo sapiens
ttgaccgtgaggccaga

SEQ ID NO: 2231845 - DNA, 20 bp, Homo sapiens
ttgaccgtgaggccagagac

SEQ ID NO: 2231846 - DNA, 15 bp, Homo sapiens
ttgacgccatcccag

SEQ ID NO: 2231847 - DNA, 18 bp, Homo sapiens
ttgacgccatcccagccc

SEQ ID NO: 2231848 - DNA, 11 bp, Homo sapiens
ttgagacagag

SEQ ID NO: 2231849 - DNA, 11 bp, Homo sapiens
ttgagcctggg

SEQ ID NO: 2231850 - DNA, 15 bp, Homo sapiens
ttgaggtctgttctt

SEQ ID NO: 2231851 - DNA, 11 bp, Homo sapiens
ttgagtgcctt

SEQ ID NO: 2231852 - DNA, 15 bp, Homo sapiens
ttgatactacagttt

SEQ ID NO: 2231853 - DNA, 13 bp, Homo sapiens
ttgattaaattct

SEQ ID NO: 2231854 - DNA, 15 bp, Homo sapiens
ttgattaaattcttg

SEQ ID NO: 2231855 - DNA, 16 bp, Homo sapiens
ttgattcagacagctg

SEQ ID NO: 2231856 - DNA, 17 bp, Homo sapiens
ttgattcagacagctgc

SEQ ID NO: 2231857 - DNA, 13 bp, Homo sapiens
ttgattcataatg

SEQ ID NO: 2231858 - DNA, 18 bp, Homo sapiens
ttgatttccgttaaaata

SEQ ID NO: 2231859 - DNA, 15 bp, Homo sapiens
ttgcaccactgcact

SEQ ID NO: 2231860 - DNA, 16 bp, Homo sapiens
ttgcaccactgcactc

SEQ ID NO: 2231861 - DNA, 18 bp, Homo sapiens
ttgcaccactgcactcca

SEQ ID NO: 2231862 - DNA, 16 bp, Homo sapiens
ttgcagacaggcaagc

SEQ ID NO: 2231863 - DNA, 14 bp, Homo sapiens
ttgcatgaggctag

SEQ ID NO: 2231864 - DNA, 13 bp, Homo sapiens
ttgccagtcaccc

SEQ ID NO: 2231865 - DNA, 18 bp, Homo sapiens
ttgccagtcaccccggcc

SEQ ID NO: 2231866 - DNA, 19 bp, Homo sapiens
ttgccatgttggccaggct

SEQ ID NO: 2231867 - DNA, 16 bp, Homo sapiens
ttgcccaggcaggtct

SEQ ID NO: 2231868 - DNA, 17 bp, Homo sapiens
ttgcccaggcctcccca

SEQ ID NO: 2231869 - DNA, 13 bp, Homo sapiens
ttgccgtctacct

SEQ ID NO: 2231870 - DNA, 18 bp, Homo sapiens
ttgccgtctacctgaggg

SEQ ID NO: 2231871 - DNA, 22 bp, Homo sapiens
ttgctgatggtgcaatgacctt

SEQ ID NO: 2231872 - DNA, 14 bp, Homo sapiens
ttgctgcttgaggc

SEQ ID NO: 2231873 - DNA, 16 bp, Homo sapiens
ttgctgtcccttttcc

SEQ ID NO: 2231874 - DNA, 18 bp, Homo sapiens
ttgctgtcccttttcctt

SEQ ID NO: 2231875 - DNA, 23 bp, Homo sapiens
ttggaaagagtaggaagactttg

SEQ ID NO: 2231876 - DNA, 18 bp, Homo sapiens
ttggaccctgaggcccag

SEQ ID NO: 2231877 - DNA, 16 bp, Homo sapiens
ttggagggtgtcccaa

SEQ ID NO: 2231878 - DNA, 14 bp, Homo sapiens
ttggattgtccccg

SEQ ID NO: 2231879 - DNA, 18 bp, Homo sapiens
ttggcccctgcccggctg

SEQ ID NO: 2231880 - DNA, 23 bp, Homo sapiens
ttggctattagagatcaacccct

SEQ ID NO: 2231881 - DNA, 11 bp, Homo sapiens
ttggctgctga

SEQ ID NO: 2231882 - DNA, 22 bp, Homo sapiens
ttggggtacccactgctctggt

SEQ ID NO: 2231883 - DNA, 20 bp, Homo sapiens
ttggtctgacccactgcttt

SEQ ID NO: 2231884 - DNA, 19 bp, Homo sapiens
ttggtgtcgggcatgacac

SEQ ID NO: 2231885 - DNA, 12 bp, Homo sapiens
ttgtaaaaaggg

SEQ ID NO: 2231886 - DNA, 15 bp, Homo sapiens
ttgtaaattaacttt

SEQ ID NO: 2231887 - DNA, 16 bp, Homo sapiens
ttgtaaattaactttt

SEQ ID NO: 2231888 - DNA, 18 bp, Homo sapiens
ttgtaaattaacttttat

SEQ ID NO: 2231889 - DNA, 20 bp, Homo sapiens
ttgtaaggaatgattaatta

SEQ ID NO: 2231890 - DNA, 12 bp, Homo sapiens
ttgtacagacaa

SEQ ID NO: 2231891 - DNA, 14 bp, Homo sapiens
ttgtagagccaggg

SEQ ID NO: 2231892 - DNA, 15 bp, Homo sapiens
ttgtattctctcctg

SEQ ID NO: 2231893 - DNA, 16 bp, Homo sapiens
ttgtattctctcctgt

SEQ ID NO: 2231894 - DNA, 22 bp, Homo sapiens
ttgtcaaagtggtgagaggcat

SEQ ID NO: 2231895 - DNA, 20 bp, Homo sapiens
ttgtccccaccgcagacagg

SEQ ID NO: 2231896 - DNA, 20 bp, Homo sapiens
ttgtctatgggactcaatgc

SEQ ID NO: 2231897 - DNA, 15 bp, Homo sapiens
ttgtctttggaccct

SEQ ID NO: 2231898 - DNA, 20 bp, Homo sapiens
ttgtgaaaggaaagaggctc

SEQ ID NO: 2231899 - DNA, 13 bp, Homo sapiens
ttgtgaggaagcc

SEQ ID NO: 2231900 - DNA, 20 bp, Homo sapiens
ttgtgatacaatgctgtgcc

SEQ ID NO: 2231901 - DNA, 20 bp, Homo sapiens
ttgtggatttaacagaaatg

SEQ ID NO: 2231902 - DNA, 22 bp, Homo sapiens
ttgtggatttaacagaaatgta

SEQ ID NO: 2231903 - DNA, 13 bp, Homo sapiens
ttgtggttaatct

SEQ ID NO: 2231904 - DNA, 15 bp, Homo sapiens
ttgtgttactaagtt

SEQ ID NO: 2231905 - DNA, 21 bp, Homo sapiens
ttgttccacaagttaaataaa

SEQ ID NO: 2231906 - DNA, 19 bp, Homo sapiens
ttgttcttggtttgtaaat

SEQ ID NO: 2231907 - DNA, 20 bp, Homo sapiens
ttgttcttggtttgtaaatt

SEQ ID NO: 2231908 - DNA, 14 bp, Homo sapiens
ttgtttcttttttc

SEQ ID NO: 2231909 - DNA, 16 bp, Homo sapiens
ttgttttcagtgtaca

SEQ ID NO: 2231910 - DNA, 20 bp, Homo sapiens
tttaaaaatccccaaaaaag

SEQ ID NO: 2231911 - DNA, 12 bp, Homo sapiens
tttaagagaaat

SEQ ID NO: 2231912 - DNA, 16 bp, Homo sapiens
tttaagtgctgcattt

SEQ ID NO: 2231913 - DNA, 16 bp, Homo sapiens
tttaatgaaagactgt

SEQ ID NO: 2231914 - DNA, 21 bp, Homo sapiens
tttaatgaaagactgtacaaa

SEQ ID NO: 2231915 - DNA, 19 bp, Homo sapiens
tttaatttttttgagacag

SEQ ID NO: 2231916 - DNA, 20 bp, Homo sapiens
tttaccttttttatacataa

SEQ ID NO: 2231917 - DNA, 14 bp, Homo sapiens
tttactaatagaca

SEQ ID NO: 2231918 - DNA, 18 bp, Homo sapiens
tttactaatagacaattt

SEQ ID NO: 2231919 - DNA, 15 bp, Homo sapiens
tttacttcttataca

SEQ ID NO: 2231920 - DNA, 22 bp, Homo sapiens
tttacttcttatacatttgata

SEQ ID NO: 2231921 - DNA, 14 bp, Homo sapiens
tttagaaatataat

SEQ ID NO: 2231922 - DNA, 13 bp, Homo sapiens
tttagataataca

SEQ ID NO: 2231923 - DNA, 14 bp, Homo sapiens
tttataaactttac

SEQ ID NO: 2231924 - DNA, 20 bp, Homo sapiens
tttatacataaacaagacca

SEQ ID NO: 2231925 - DNA, 16 bp, Homo sapiens
tttatcgtcactgctt

SEQ ID NO: 2231926 - DNA, 20 bp, Homo sapiens
tttatggcttttgtgcatta

SEQ ID NO: 2231927 - DNA, 22 bp, Homo sapiens
gtgatgcgcatgtcacggaggg

SEQ ID NO: 2231928 - DNA, 14 bp, Homo sapiens
gtgatggggccctg

SEQ ID NO: 2231929 - DNA, 16 bp, Homo sapiens
gtgatggggccctgcc

SEQ ID NO: 2231930 - DNA, 20 bp, Homo sapiens
gtgattctcctgcctcagcc

SEQ ID NO: 2231931 - DNA, 22 bp, Homo sapiens
gtgattctcctgcctcagcctc

SEQ ID NO: 2231932 - DNA, 18 bp, Homo sapiens
gtgatttttgtaattttt

SEQ ID NO: 2231933 - DNA, 21 bp, Homo sapiens
gtgcacaagctccaagctccc

SEQ ID NO: 2231934 - DNA, 20 bp, Homo sapiens
gtgcagtggtgcgatctggg

SEQ ID NO: 2231935 - DNA, 19 bp, Homo sapiens
gtgcataagttaacttcca

SEQ ID NO: 2231936 - DNA, 19 bp, Homo sapiens
gtgcattatctagatactg

SEQ ID NO: 2231937 - DNA, 19 bp, Homo sapiens
gtgcatttgaggtctgttc

SEQ ID NO: 2231938 - DNA, 15 bp, Homo sapiens
gtgcatttggtggtt

SEQ ID NO: 2231939 - DNA, 21 bp, Homo sapiens
gtgcatttggtggtttcagaa

SEQ ID NO: 2231940 - DNA, 14 bp, Homo sapiens
gtgccaagcagagg

SEQ ID NO: 2231941 - DNA, 20 bp, Homo sapiens
gtgccaggtttttggtctga

SEQ ID NO: 2231942 - DNA, 16 bp, Homo sapiens
gtgccatgtgccaggt

SEQ ID NO: 2231943 - DNA, 20 bp, Homo sapiens
gtgcccacaggatcagtctg

SEQ ID NO: 2231944 - DNA, 21 bp, Homo sapiens
gtgcccccacccccaccctcg

SEQ ID NO: 2231945 - DNA, 18 bp, Homo sapiens
gtgcccggggatcccccg

SEQ ID NO: 2231946 - DNA, 21 bp, Homo sapiens
gtgcccggggatcccccgccc

SEQ ID NO: 2231947 - DNA, 11 bp, Homo sapiens
gtgccttatgg

SEQ ID NO: 2231948 - DNA, 14 bp, Homo sapiens
gtgccttatggaac

SEQ ID NO: 2231949 - DNA, 21 bp, Homo sapiens
gtgctatctcccccagcccca

SEQ ID NO: 2231950 - DNA, 12 bp, Homo sapiens
gtgctatgttct

SEQ ID NO: 2231951 - DNA, 13 bp, Homo sapiens
gtgctctggacag

SEQ ID NO: 2231952 - DNA, 14 bp, Homo sapiens
gtgctctggacagg

SEQ ID NO: 2231953 - DNA, 15 bp, Homo sapiens
gtgctctggacaggc

SEQ ID NO: 2231954 - DNA, 19 bp, Homo sapiens
gtgctgccatccaggttca

SEQ ID NO: 2231955 - DNA, 14 bp, Homo sapiens
gtgctgccctgccc

SEQ ID NO: 2231956 - DNA, 15 bp, Homo sapiens
gtgctgccctgccca

SEQ ID NO: 2231957 - DNA, 19 bp, Homo sapiens
gtgctgccctgcccacctg

SEQ ID NO: 2231958 - DNA, 21 bp, Homo sapiens
gtgctgggattacaagcgtga

SEQ ID NO: 2231959 - DNA, 13 bp, Homo sapiens
gtgcttggaggaa

SEQ ID NO: 2231960 - DNA, 14 bp, Homo sapiens
gtggacacagctct

SEQ ID NO: 2231961 - DNA, 15 bp, Homo sapiens
gtggacacagctctt

SEQ ID NO: 2231962 - DNA, 18 bp, Homo sapiens
gtggatgcctggtggcag

SEQ ID NO: 2231963 - DNA, 19 bp, Homo sapiens
gtggcaccagcagcctgga

SEQ ID NO: 2231964 - DNA, 16 bp, Homo sapiens
gtggcagctcacctct

SEQ ID NO: 2231965 - DNA, 22 bp, Homo sapiens
gtggcagctcacctctcccttg

SEQ ID NO: 2231966 - DNA, 17 bp, Homo sapiens
gtggcagctgcggtcca

SEQ ID NO: 2231967 - DNA, 22 bp, Homo sapiens
gtggcagctgcggtccacccag

SEQ ID NO: 2231968 - DNA, 23 bp, Homo sapiens
gtggcagctgcggtccacccagg

SEQ ID NO: 2231969 - DNA, 19 bp, Homo sapiens
gtggcagtgggagctgcct

SEQ ID NO: 2231970 - DNA, 15 bp, Homo sapiens
gtggcctcccaactc

SEQ ID NO: 2231971 - DNA, 23 bp, Homo sapiens
gtggcgcagcatattcaggaagc

SEQ ID NO: 2231972 - DNA, 12 bp, Homo sapiens
gtggctgcttca

SEQ ID NO: 2231973 - DNA, 15 bp, Homo sapiens
gtggctgcttcaagg

SEQ ID NO: 2231974 - DNA, 19 bp, Homo sapiens
gtggctgcttcaaggatcc

SEQ ID NO: 2231975 - DNA, 22 bp, Homo sapiens
gtggctgcttcaaggatcctga

SEQ ID NO: 2231976 - DNA, 15 bp, Homo sapiens
gtgggacaccctgtg

SEQ ID NO: 2231977 - DNA, 14 bp, Homo sapiens
gtgggagctgcctg

SEQ ID NO: 2231978 - DNA, 23 bp, Homo sapiens
gtgggaggatctcttgagcctgg

SEQ ID NO: 2231979 - DNA, 13 bp, Homo sapiens
gtgggaggggaag

SEQ ID NO: 2231980 - DNA, 19 bp, Homo sapiens
gtgggagggtctgcaggga

SEQ ID NO: 2231981 - DNA, 18 bp, Homo sapiens
gtgggatcctccaggtgc

SEQ ID NO: 2231982 - DNA, 13 bp, Homo sapiens
gtgggcacccccg

SEQ ID NO: 2231983 - DNA, 15 bp, Homo sapiens
gtgggctagttgggc

SEQ ID NO: 2231984 - DNA, 17 bp, Homo sapiens
gtggggcagcttgaggg

SEQ ID NO: 2231985 - DNA, 19 bp, Homo sapiens
gtggggcctggggtaggag

SEQ ID NO: 2231986 - DNA, 22 bp, Homo sapiens
gtggggcctggggtaggaggaa

SEQ ID NO: 2231987 - DNA, 18 bp, Homo sapiens
gtggggctggaagcagaa

SEQ ID NO: 2231988 - DNA, 20 bp, Homo sapiens
gtgggggatcacagcctctg

SEQ ID NO: 2231989 - DNA, 22 bp, Homo sapiens
gtggggtcactctggcagctca

SEQ ID NO: 2231990 - DNA, 17 bp, Homo sapiens
gtggtagagtgtgcctg

SEQ ID NO: 2231991 - DNA, 14 bp, Homo sapiens
gtggtcccacccca

SEQ ID NO: 2231992 - DNA, 15 bp, Homo sapiens
gtggtcccaccccac

SEQ ID NO: 2231993 - DNA, 18 bp, Homo sapiens
gtggtcctaatcttctga

SEQ ID NO: 2231994 - DNA, 15 bp, Homo sapiens
gtggtgtttcctggc

SEQ ID NO: 2231995 - DNA, 17 bp, Homo sapiens
gtgtatttttttactaa

SEQ ID NO: 2231996 - DNA, 23 bp, Homo sapiens
gtgtatttttttactaatagaca

SEQ ID NO: 2231997 - DNA, 20 bp, Homo sapiens
gtgtcaagagggtctgagga

SEQ ID NO: 2231998 - DNA, 14 bp, Homo sapiens
gtgtcaggtggggc

SEQ ID NO: 2231999 - DNA, 23 bp, Homo sapiens
gtgtccctgcacttgcagactct

SEQ ID NO: 2232000 - DNA, 17 bp, Homo sapiens
gtgtcttgcaatggcag

SEQ ID NO: 2232001 - DNA, 18 bp, Homo sapiens
gtgtcttgcaatggcagc

SEQ ID NO: 2232002 - DNA, 22 bp, Homo sapiens
gtgtgacaaggattgctactgt

SEQ ID NO: 2232003 - DNA, 19 bp, Homo sapiens
gtgtggtgtttcctggcac

SEQ ID NO: 2232004 - DNA, 21 bp, Homo sapiens
gtgtgtgcgcctacaggagtg

SEQ ID NO: 2232005 - DNA, 14 bp, Homo sapiens
gtgttactaagttt

SEQ ID NO: 2232006 - DNA, 18 bp, Homo sapiens
gttaatcattaggtgtga

SEQ ID NO: 2232007 - DNA, 16 bp, Homo sapiens
gttacactaaaaggtg

SEQ ID NO: 2232008 - DNA, 19 bp, Homo sapiens
gttacataagataaatgtg

SEQ ID NO: 2232009 - DNA, 15 bp, Homo sapiens
gttactcagaattct

SEQ ID NO: 2232010 - DNA, 19 bp, Homo sapiens
gttagaggttccctttgac

SEQ ID NO: 2232011 - DNA, 17 bp, Homo sapiens
gttagtatgaggcattt

SEQ ID NO: 2232012 - DNA, 22 bp, Homo sapiens
gttagtttctccaagcaggaca

SEQ ID NO: 2232013 - DNA, 19 bp, Homo sapiens
gttattaaaaatctcaaat

SEQ ID NO: 2232014 - DNA, 23 bp, Homo sapiens
gttatttttatttatttaaattt

SEQ ID NO: 2232015 - DNA, 22 bp, Homo sapiens
gttcaaagatattttgctttgt

SEQ ID NO: 2232016 - DNA, 19 bp, Homo sapiens
gttcaagcgattcttctgc

SEQ ID NO: 2232017 - DNA, 20 bp, Homo sapiens
gttcaagcgattcttctgct

SEQ ID NO: 2232018 - DNA, 16 bp, Homo sapiens
gttcagctccagctca

SEQ ID NO: 2232019 - DNA, 18 bp, Homo sapiens
gttcaggtaacaggcaga

SEQ ID NO: 2232020 - DNA, 13 bp, Homo sapiens
gttcatcttgaat

SEQ ID NO: 2232021 - DNA, 21 bp, Homo sapiens
gttcatggtgaaggtttttgt

SEQ ID NO: 2232022 - DNA, 20 bp, Homo sapiens
gttccaccatcaagccacca

SEQ ID NO: 2232023 - DNA, 14 bp, Homo sapiens
gttcctaatcctct

SEQ ID NO: 2232024 - DNA, 22 bp, Homo sapiens
gttcctcattagcattttgcta

SEQ ID NO: 2232025 - DNA, 14 bp, Homo sapiens
gttctctgaggaca

SEQ ID NO: 2232026 - DNA, 17 bp, Homo sapiens
gttctctgccctccaag

SEQ ID NO: 2232027 - DNA, 18 bp, Homo sapiens
gttctctgccctccaaga

SEQ ID NO: 2232028 - DNA, 18 bp, Homo sapiens
gttctttcacccttttct

SEQ ID NO: 2232029 - DNA, 18 bp, Homo sapiens
gttctttccaaagtacac

SEQ ID NO: 2232030 - DNA, 17 bp, Homo sapiens
gttgccagtcaccccgg

SEQ ID NO: 2232031 - DNA, 12 bp, Homo sapiens
gttgcccaggca

SEQ ID NO: 2232032 - DNA, 23 bp, Homo sapiens
gttgcccaggcaggtcttgaact

SEQ ID NO: 2232033 - DNA, 13 bp, Homo sapiens
gttgcccaggctg

SEQ ID NO: 2232034 - DNA, 16 bp, Homo sapiens
gttgcccaggctggcg

SEQ ID NO: 2232035 - DNA, 21 bp, Homo sapiens
gttgcccaggctggcgtgcag

SEQ ID NO: 2232036 - DNA, 15 bp, Homo sapiens
gttggccaggctggt

SEQ ID NO: 2232037 - DNA, 13 bp, Homo sapiens
gttggcccctgcc

SEQ ID NO: 2232038 - DNA, 15 bp, Homo sapiens
gttgggctggtgtca

SEQ ID NO: 2232039 - DNA, 12 bp, Homo sapiens
gttgtcagctga

SEQ ID NO: 2232040 - DNA, 22 bp, Homo sapiens
gttgtggatttaacagaaatgt

SEQ ID NO: 2232041 - DNA, 14 bp, Homo sapiens
gttgtggttaatct

SEQ ID NO: 2232042 - DNA, 23 bp, Homo sapiens
gttgtttgattcagacagctgcc

SEQ ID NO: 2232043 - DNA, 16 bp, Homo sapiens
gtttaaaaatccccaa

SEQ ID NO: 2232044 - DNA, 22 bp, Homo sapiens
gtttaaaaatccccaaaaaagc

SEQ ID NO: 2232045 - DNA, 14 bp, Homo sapiens
gtttcaaactttac

SEQ ID NO: 2232046 - DNA, 16 bp, Homo sapiens
gtttcaaactttacta

SEQ ID NO: 2232047 - DNA, 17 bp, Homo sapiens
gtttcaaactttactat

SEQ ID NO: 2232048 - DNA, 11 bp, Homo sapiens
gtttcagaaat

SEQ ID NO: 2232049 - DNA, 13 bp, Homo sapiens
gtttcagaaatgt

SEQ ID NO: 2232050 - DNA, 14 bp, Homo sapiens
gtttcagaaatgtg

SEQ ID NO: 2232051 - DNA, 16 bp, Homo sapiens
gtttcctggcactgct

SEQ ID NO: 2232052 - DNA, 14 bp, Homo sapiens
gtttctgccgcagc

SEQ ID NO: 2232053 - DNA, 21 bp, Homo sapiens
gtacctcttgagccttgaact

SEQ ID NO: 2232054 - DNA, 22 bp, Homo sapiens
gtacctcttgagccttgaactt

SEQ ID NO: 2232055 - DNA, 15 bp, Homo sapiens
gtacgtctgacaggc

SEQ ID NO: 2232056 - DNA, 17 bp, Homo sapiens
gtacgtctgacaggcaa

SEQ ID NO: 2232057 - DNA, 15 bp, Homo sapiens
gtacgttgtgcattt

SEQ ID NO: 2232058 - DNA, 16 bp, Homo sapiens
gtactggagaaaatgg

SEQ ID NO: 2232059 - DNA, 15 bp, Homo sapiens
gtacttctccaccct

SEQ ID NO: 2232060 - DNA, 17 bp, Homo sapiens
gtacttctccaccctgc

SEQ ID NO: 2232061 - DNA, 18 bp, Homo sapiens
gtacttctccaccctgct

SEQ ID NO: 2232062 - DNA, 20 bp, Homo sapiens
gtagaaatatctgaaaatgt

SEQ ID NO: 2232063 - DNA, 12 bp, Homo sapiens
gtagagacaggg

SEQ ID NO: 2232064 - DNA, 13 bp, Homo sapiens
gtagagacagggt

SEQ ID NO: 2232065 - DNA, 10 bp, Homo sapiens
gtagagccag

SEQ ID NO: 2232066 - DNA, 15 bp, Homo sapiens
gtagagccagggtct

SEQ ID NO: 2232067 - DNA, 15 bp, Homo sapiens
gtagagtgggagctg

SEQ ID NO: 2232068 - DNA, 15 bp, Homo sapiens
gtagagtgtgcctga

SEQ ID NO: 2232069 - DNA, 22 bp, Homo sapiens
gtagctctaggagggctggcaa

SEQ ID NO: 2232070 - DNA, 12 bp, Homo sapiens
gtagctgggact

SEQ ID NO: 2232071 - DNA, 15 bp, Homo sapiens
gtaggaagactttgg

SEQ ID NO: 2232072 - DNA, 13 bp, Homo sapiens
gtaggaggaacag

SEQ ID NO: 2232073 - DNA, 16 bp, Homo sapiens
gtagggttataataat

SEQ ID NO: 2232074 - DNA, 22 bp, Homo sapiens
gtatatgtcaagccataattgt

SEQ ID NO: 2232075 - DNA, 21 bp, Homo sapiens
gtatcccatgagcctcagcat

SEQ ID NO: 2232076 - DNA, 12 bp, Homo sapiens
gtatctgagcag

SEQ ID NO: 2232077 - DNA, 20 bp, Homo sapiens
gtatgaggcatttgtttgaa

SEQ ID NO: 2232078 - DNA, 21 bp, Homo sapiens
gtatgatcacggctcactgca

SEQ ID NO: 2232079 - DNA, 22 bp, Homo sapiens
gtatgatcacggctcactgcag

SEQ ID NO: 2232080 - DNA, 15 bp, Homo sapiens
gtatggtggctgggt

SEQ ID NO: 2232081 - DNA, 14 bp, Homo sapiens
gtattacttctgct

SEQ ID NO: 2232082 - DNA, 15 bp, Homo sapiens
gtattacttctgcta

SEQ ID NO: 2232083 - DNA, 21 bp, Homo sapiens
gtattctctcctgtacctctt

SEQ ID NO: 2232084 - DNA, 22 bp, Homo sapiens
gtattggctagaggttcaaaga

SEQ ID NO: 2232085 - DNA, 22 bp, Homo sapiens
gtcaattacaggaagtactgga

SEQ ID NO: 2232086 - DNA, 20 bp, Homo sapiens
gtcacacagtattacttctg

SEQ ID NO: 2232087 - DNA, 22 bp, Homo sapiens
gtcacacagtattacttctgct

SEQ ID NO: 2232088 - DNA, 17 bp, Homo sapiens
gtcaccccggccacctg

SEQ ID NO: 2232089 - DNA, 20 bp, Homo sapiens
gtcacctgaagactcattct

SEQ ID NO: 2232090 - DNA, 13 bp, Homo sapiens
gtcactctggcag

SEQ ID NO: 2232091 - DNA, 14 bp, Homo sapiens
gtcactctggcagc

SEQ ID NO: 2232092 - DNA, 17 bp, Homo sapiens
gtcactctggcagctca

SEQ ID NO: 2232093 - DNA, 22 bp, Homo sapiens
gtcactctggcagctcagagag

SEQ ID NO: 2232094 - DNA, 23 bp, Homo sapiens
gtcactctggcagctcagagagg

SEQ ID NO: 2232095 - DNA, 21 bp, Homo sapiens
gtcactgcttaacttcacata

SEQ ID NO: 2232096 - DNA, 16 bp, Homo sapiens
gtcagagcctgcagtt

SEQ ID NO: 2232097 - DNA, 15 bp, Homo sapiens
gtcagtgtgactgat

SEQ ID NO: 2232098 - DNA, 21 bp, Homo sapiens
gtcatataagattcatattta

SEQ ID NO: 2232099 - DNA, 19 bp, Homo sapiens
gtcatttgagcagggctca

SEQ ID NO: 2232100 - DNA, 13 bp, Homo sapiens
gtccaagaagccc

SEQ ID NO: 2232101 - DNA, 17 bp, Homo sapiens
gtccaagaagcccagga

SEQ ID NO: 2232102 - DNA, 20 bp, Homo sapiens
gtccaagaagcccaggaaag

SEQ ID NO: 2232103 - DNA, 14 bp, Homo sapiens
gtccacccaggagc

SEQ ID NO: 2232104 - DNA, 20 bp, Homo sapiens
gtcccaccccacacacgcca

SEQ ID NO: 2232105 - DNA, 18 bp, Homo sapiens
gtcccaccttggctgcag

SEQ ID NO: 2232106 - DNA, 12 bp, Homo sapiens
gtcccagtgccg

SEQ ID NO: 2232107 - DNA, 17 bp, Homo sapiens
gtccccaccgcagacag

SEQ ID NO: 2232108 - DNA, 14 bp, Homo sapiens
gtcccccttccatg

SEQ ID NO: 2232109 - DNA, 16 bp, Homo sapiens
gtcccccttccatgga

SEQ ID NO: 2232110 - DNA, 18 bp, Homo sapiens
gtcccccttccatggact

SEQ ID NO: 2232111 - DNA, 16 bp, Homo sapiens
gtccccgcactgggct

SEQ ID NO: 2232112 - DNA, 18 bp, Homo sapiens
gtcccctgtttgtttctg

SEQ ID NO: 2232113 - DNA, 21 bp, Homo sapiens
gtccctgcacttgcagactct

SEQ ID NO: 2232114 - DNA, 11 bp, Homo sapiens
gtccctgccaa

SEQ ID NO: 2232115 - DNA, 16 bp, Homo sapiens
gtccctggtggcagct

SEQ ID NO: 2232116 - DNA, 18 bp, Homo sapiens
gtccctggtggcagctca

SEQ ID NO: 2232117 - DNA, 19 bp, Homo sapiens
gtcccttacgtgagtcctg

SEQ ID NO: 2232118 - DNA, 13 bp, Homo sapiens
gtccgagctttga

SEQ ID NO: 2232119 - DNA, 15 bp, Homo sapiens
gtcctacccaccctc

SEQ ID NO: 2232120 - DNA, 12 bp, Homo sapiens
gtcctcccatct

SEQ ID NO: 2232121 - DNA, 13 bp, Homo sapiens
gtcctcccatctc

SEQ ID NO: 2232122 - DNA, 14 bp, Homo sapiens
gtcctcttttctga

SEQ ID NO: 2232123 - DNA, 13 bp, Homo sapiens
gtcctgctgcagt

SEQ ID NO: 2232124 - DNA, 16 bp, Homo sapiens
gtcctgggagtgagct

SEQ ID NO: 2232125 - DNA, 19 bp, Homo sapiens
gtcctgggagtgagctggt

SEQ ID NO: 2232126 - DNA, 17 bp, Homo sapiens
gtccttaccagcagagc

SEQ ID NO: 2232127 - DNA, 15 bp, Homo sapiens
gtctacactgtgctg

SEQ ID NO: 2232128 - DNA, 13 bp, Homo sapiens
gtctacctgaggg

SEQ ID NO: 2232129 - DNA, 14 bp, Homo sapiens
gtctacctgagggg

SEQ ID NO: 2232130 - DNA, 18 bp, Homo sapiens
gtctcactctgtcgccca

SEQ ID NO: 2232131 - DNA, 13 bp, Homo sapiens
gtctcactgttgc

SEQ ID NO: 2232132 - DNA, 20 bp, Homo sapiens
gtctcactgttgcccaggct

SEQ ID NO: 2232133 - DNA, 20 bp, Homo sapiens
gtctcttggtcctgctgcag

SEQ ID NO: 2232134 - DNA, 18 bp, Homo sapiens
gtctctttaatgtcacag

SEQ ID NO: 2232135 - DNA, 22 bp, Homo sapiens
gtctctttaatgtcacaggcag

SEQ ID NO: 2232136 - DNA, 12 bp, Homo sapiens
gtctgacaggca

SEQ ID NO: 2232137 - DNA, 13 bp, Homo sapiens
gtctgacaggcaa

SEQ ID NO: 2232138 - DNA, 18 bp, Homo sapiens
gtctgacaggcaatgctg

SEQ ID NO: 2232139 - DNA, 20 bp, Homo sapiens
gtctgacaggcaatgctggc

SEQ ID NO: 2232140 - DNA, 14 bp, Homo sapiens
gtctggcccttcct

SEQ ID NO: 2232141 - DNA, 16 bp, Homo sapiens
gtcttcagtaagccgt

SEQ ID NO: 2232142 - DNA, 20 bp, Homo sapiens
gtcttgaactcctggcctca

SEQ ID NO: 2232143 - DNA, 21 bp, Homo sapiens
gtcttggtttggttcatggtg

SEQ ID NO: 2232144 - DNA, 17 bp, Homo sapiens
gtctttggaccctgagg

SEQ ID NO: 2232145 - DNA, 16 bp, Homo sapiens
gtctttgtacagacaa

SEQ ID NO: 2232146 - DNA, 14 bp, Homo sapiens
gtcttttcttgcat

SEQ ID NO: 2232147 - DNA, 24 bp, Homo sapiens
gtcttttcttgcatgaggctagtg

SEQ ID NO: 2232148 - DNA, 19 bp, Homo sapiens
gtgaaaggaaagagggagg

SEQ ID NO: 2232149 - DNA, 19 bp, Homo sapiens
gtgaaccaccacacccagc

SEQ ID NO: 2232150 - DNA, 19 bp, Homo sapiens
gtgaacttgggccactgtg

SEQ ID NO: 2232151 - DNA, 14 bp, Homo sapiens
gtgaagtgaagaca

SEQ ID NO: 2232152 - DNA, 21 bp, Homo sapiens
gtgaatgatgatcctaggcat

SEQ ID NO: 2232153 - DNA, 20 bp, Homo sapiens
gtgacaaggattgctactgt

SEQ ID NO: 2232154 - DNA, 15 bp, Homo sapiens
gtgacagaggcagcc

SEQ ID NO: 2232155 - DNA, 19 bp, Homo sapiens
gtgacatgtcttttcttgc

SEQ ID NO: 2232156 - DNA, 18 bp, Homo sapiens
gtgaccagcaccatctct

SEQ ID NO: 2232157 - DNA, 18 bp, Homo sapiens
gtgaccatgttttgttta

SEQ ID NO: 2232158 - DNA, 13 bp, Homo sapiens
gtgacctctgcct

SEQ ID NO: 2232159 - DNA, 15 bp, Homo sapiens
gtgacctctgcctga

SEQ ID NO: 2232160 - DNA, 15 bp, Homo sapiens
gtgactgaatttctt

SEQ ID NO: 2232161 - DNA, 12 bp, Homo sapiens
gtgagagctggg

SEQ ID NO: 2232162 - DNA, 16 bp, Homo sapiens
gtgagaggggaacaga

SEQ ID NO: 2232163 - DNA, 15 bp, Homo sapiens
gtgagcaatcctgca

SEQ ID NO: 2232164 - DNA, 17 bp, Homo sapiens
gtgagcactctggggtg

SEQ ID NO: 2232165 - DNA, 19 bp, Homo sapiens
gtgagcactctggggtggg

SEQ ID NO: 2232166 - DNA, 22 bp, Homo sapiens
gtgagcactctggggtgggagg

SEQ ID NO: 2232167 - DNA, 14 bp, Homo sapiens
gtgagccactgcac

SEQ ID NO: 2232168 - DNA, 20 bp, Homo sapiens
gtgagccactgcaccgggcc

SEQ ID NO: 2232169 - DNA, 19 bp, Homo sapiens
gtgagccgagatcacgcca

SEQ ID NO: 2232170 - DNA, 17 bp, Homo sapiens
gtgaggatgaaaaaata

SEQ ID NO: 2232171 - DNA, 11 bp, Homo sapiens
gtgaggccaga

SEQ ID NO: 2232172 - DNA, 15 bp, Homo sapiens
gtgaggctctgccct

SEQ ID NO: 2232173 - DNA, 17 bp, Homo sapiens
gtgagtactacagtcct

SEQ ID NO: 2232174 - DNA, 17 bp, Homo sapiens
gtgagtcctggcatggg

SEQ ID NO: 2232175 - DNA, 15 bp, Homo sapiens
gtgatacaatgctgt

SEQ ID NO: 2232176 - DNA, 18 bp, Homo sapiens
gtgatccacccacctcag

SEQ ID NO: 2232177 - DNA, 23 bp, Homo sapiens
gtgatccacccacctcagcctcc

SEQ ID NO: 2232178 - DNA, 14 bp, Homo sapiens
gtgatcctcccacc

SEQ ID NO: 2232179 - DNA, 18 bp, Homo sapiens
gtgatcctcccacctcag

SEQ ID NO: 2232180 - DNA, 16 bp, Homo sapiens
gtgatgagaggaaatc

SEQ ID NO: 2232181 - DNA, 15 bp, Homo sapiens
tactaatagacaatt

SEQ ID NO: 2232182 - DNA, 20 bp, Homo sapiens
tactaatagacaatttatta

SEQ ID NO: 2232183 - DNA, 17 bp, Homo sapiens
tactacagtcctcccat

SEQ ID NO: 2232184 - DNA, 20 bp, Homo sapiens
tactacagtcctcccatctc

SEQ ID NO: 2232185 - DNA, 14 bp, Homo sapiens
tactatgtatcaat

SEQ ID NO: 2232186 - DNA, 12 bp, Homo sapiens
tactcacctcac

SEQ ID NO: 2232187 - DNA, 16 bp, Homo sapiens
tactcagaattctcta

SEQ ID NO: 2232188 - DNA, 22 bp, Homo sapiens
tactcagaattctctagtttga

SEQ ID NO: 2232189 - DNA, 16 bp, Homo sapiens
tactcccatctgtgaa

SEQ ID NO: 2232190 - DNA, 18 bp, Homo sapiens
tactcgagttacagacaa

SEQ ID NO: 2232191 - DNA, 22 bp, Homo sapiens
tactctaccctcttagaaaaac

SEQ ID NO: 2232192 - DNA, 15 bp, Homo sapiens
tactgaggtgctatg

SEQ ID NO: 2232193 - DNA, 17 bp, Homo sapiens
tactgcatatgaaagga

SEQ ID NO: 2232194 - DNA, 17 bp, Homo sapiens
tactgtaatttgtgata

SEQ ID NO: 2232195 - DNA, 18 bp, Homo sapiens
tactgtaatttgtgatac

SEQ ID NO: 2232196 - DNA, 20 bp, Homo sapiens
tactgtaatttgtgatacaa

SEQ ID NO: 2232197 - DNA, 23 bp, Homo sapiens
tactgtaatttgtgatacaatgc

SEQ ID NO: 2232198 - DNA, 22 bp, Homo sapiens
tactgtacatgaaaacacattt

SEQ ID NO: 2232199 - DNA, 21 bp, Homo sapiens
tactgtatcatgacaaagact

SEQ ID NO: 2232200 - DNA, 16 bp, Homo sapiens
tactgtcctacccacc

SEQ ID NO: 2232201 - DNA, 21 bp, Homo sapiens
tactgtcttcagtaagccgtg

SEQ ID NO: 2232202 - DNA, 18 bp, Homo sapiens
tacttgtggacacagctc

SEQ ID NO: 2232203 - DNA, 19 bp, Homo sapiens
tacttgtggacacagctct

SEQ ID NO: 2232204 - DNA, 21 bp, Homo sapiens
tagaaatatctgaaaatgtat

SEQ ID NO: 2232205 - DNA, 23 bp, Homo sapiens
tagaaatatctgaaaatgtatgt

SEQ ID NO: 2232206 - DNA, 20 bp, Homo sapiens
tagaagtcttagatgtatat

SEQ ID NO: 2232207 - DNA, 10 bp, Homo sapiens
tagacagagt

SEQ ID NO: 2232208 - DNA, 17 bp, Homo sapiens
tagacagtccctgccaa

SEQ ID NO: 2232209 - DNA, 21 bp, Homo sapiens
tagacagtccctgccaatgga

SEQ ID NO: 2232210 - DNA, 11 bp, Homo sapiens
tagagacaggg

SEQ ID NO: 2232211 - DNA, 16 bp, Homo sapiens
tagagagagaccactt

SEQ ID NO: 2232212 - DNA, 15 bp, Homo sapiens
tagaggttcaaagat

SEQ ID NO: 2232213 - DNA, 21 bp, Homo sapiens
tagaggttcaaagatattttg

SEQ ID NO: 2232214 - DNA, 15 bp, Homo sapiens
tagatatatgctctg

SEQ ID NO: 2232215 - DNA, 18 bp, Homo sapiens
tagcacagaccctgccct

SEQ ID NO: 2232216 - DNA, 19 bp, Homo sapiens
tagcagagaatgaaagggc

SEQ ID NO: 2232217 - DNA, 22 bp, Homo sapiens
tagcattttgctaaatgtgaat

SEQ ID NO: 2232218 - DNA, 14 bp, Homo sapiens
tagccaaggccaaa

SEQ ID NO: 2232219 - DNA, 11 bp, Homo sapiens
tagccagagga

SEQ ID NO: 2232220 - DNA, 16 bp, Homo sapiens
tagcctaggtgacaga

SEQ ID NO: 2232221 - DNA, 17 bp, Homo sapiens
tagcctgcctcttctct

SEQ ID NO: 2232222 - DNA, 14 bp, Homo sapiens
tagcgcccagttgg

SEQ ID NO: 2232223 - DNA, 17 bp, Homo sapiens
tagcgcccagttgggtg

SEQ ID NO: 2232224 - DNA, 21 bp, Homo sapiens
tagctcaggtgtccctgcact

SEQ ID NO: 2232225 - DNA, 17 bp, Homo sapiens
tagctgggactacaggc

SEQ ID NO: 2232226 - DNA, 13 bp, Homo sapiens
taggaaaaactga

SEQ ID NO: 2232227 - DNA, 13 bp, Homo sapiens
taggaacactcct

SEQ ID NO: 2232228 - DNA, 14 bp, Homo sapiens
taggaacactcctt

SEQ ID NO: 2232229 - DNA, 17 bp, Homo sapiens
taggaacactccttcac

SEQ ID NO: 2232230 - DNA, 14 bp, Homo sapiens
taggaggaacaggt

SEQ ID NO: 2232231 - DNA, 13 bp, Homo sapiens
taggcctggccag

SEQ ID NO: 2232232 - DNA, 14 bp, Homo sapiens
taggcctggccaga

SEQ ID NO: 2232233 - DNA, 18 bp, Homo sapiens
taggcctggccagatgca

SEQ ID NO: 2232234 - DNA, 21 bp, Homo sapiens
tagggaaggatacaaaagcat

SEQ ID NO: 2232235 - DNA, 19 bp, Homo sapiens
tagggtaagtgagagaggg

SEQ ID NO: 2232236 - DNA, 19 bp, Homo sapiens
taggtgtgactgaatttct

SEQ ID NO: 2232237 - DNA, 21 bp, Homo sapiens
taggttggcaaaaaggcagga

SEQ ID NO: 2232238 - DNA, 20 bp, Homo sapiens
tagtggcttaaaacaacact

SEQ ID NO: 2232239 - DNA, 20 bp, Homo sapiens
tagttccaccatcaagccac

SEQ ID NO: 2232240 - DNA, 21 bp, Homo sapiens
tagttgtttgattcagacagc

SEQ ID NO: 2232241 - DNA, 12 bp, Homo sapiens
tagtttgcagtt

SEQ ID NO: 2232242 - DNA, 14 bp, Homo sapiens
tataaactttacct

SEQ ID NO: 2232243 - DNA, 15 bp, Homo sapiens
tataaactttacctt

SEQ ID NO: 2232244 - DNA, 20 bp, Homo sapiens
tataaccagtgttgtggatt

SEQ ID NO: 2232245 - DNA, 22 bp, Homo sapiens
tataaccagtgttgtggattta

SEQ ID NO: 2232246 - DNA, 18 bp, Homo sapiens
tataatgaatgaaacatt

SEQ ID NO: 2232247 - DNA, 19 bp, Homo sapiens
tataatgtaagctctactg

SEQ ID NO: 2232248 - DNA, 21 bp, Homo sapiens
tatacacttacactttatgca

SEQ ID NO: 2232249 - DNA, 14 bp, Homo sapiens
tatacataaacaag

SEQ ID NO: 2232250 - DNA, 18 bp, Homo sapiens
tatagcctaggtgacaga

SEQ ID NO: 2232251 - DNA, 20 bp, Homo sapiens
tatatgctctgcatgttaca

SEQ ID NO: 2232252 - DNA, 19 bp, Homo sapiens
tatcacccagaagaaaata

SEQ ID NO: 2232253 - DNA, 22 bp, Homo sapiens
tatcacccagaagaaaatagtg

SEQ ID NO: 2232254 - DNA, 10 bp, Homo sapiens
tatcagaatt

SEQ ID NO: 2232255 - DNA, 21 bp, Homo sapiens
tatctaatatgtaacaagcca

SEQ ID NO: 2232256 - DNA, 16 bp, Homo sapiens
tatctcccccagcccc

SEQ ID NO: 2232257 - DNA, 14 bp, Homo sapiens
tatctgaaaatgta

SEQ ID NO: 2232258 - DNA, 20 bp, Homo sapiens
tatctgaaaatgtatgtgta

SEQ ID NO: 2232259 - DNA, 20 bp, Homo sapiens
tcttttttcggctaaaaaga

SEQ ID NO: 2232260 - DNA, 12 bp, Homo sapiens
tgaaaacacatt

SEQ ID NO: 2232261 - DNA, 19 bp, Homo sapiens
tgaaaacacatttttctta

SEQ ID NO: 2232262 - DNA, 20 bp, Homo sapiens
tgaaaacacatttttcttag

SEQ ID NO: 2232263 - DNA, 23 bp, Homo sapiens
tgaaaacactgttctctgccctc

SEQ ID NO: 2232264 - DNA, 20 bp, Homo sapiens
tgaaaagaaaaatgagcctg

SEQ ID NO: 2232265 - DNA, 19 bp, Homo sapiens
tgaaaatcgtgacaacact

SEQ ID NO: 2232266 - DNA, 17 bp, Homo sapiens
tgaaaatgtatgtgtaa

SEQ ID NO: 2232267 - DNA, 14 bp, Homo sapiens
tgaaaattcagtgg

SEQ ID NO: 2232268 - DNA, 17 bp, Homo sapiens
tgaaactggattaaact

SEQ ID NO: 2232269 - DNA, 19 bp, Homo sapiens
tgaaagactgtacaaagta

SEQ ID NO: 2232270 - DNA, 22 bp, Homo sapiens
tgaaagactgtacaaagtagaa

SEQ ID NO: 2232271 - DNA, 13 bp, Homo sapiens
tgaaagggcccag

SEQ ID NO: 2232272 - DNA, 20 bp, Homo sapiens
tgaaatgaggtcagagcctg

SEQ ID NO: 2232273 - DNA, 19 bp, Homo sapiens
tgaaatttttattaaatta

SEQ ID NO: 2232274 - DNA, 22 bp, Homo sapiens
tgaaccacatcttgctctgctg

SEQ ID NO: 2232275 - DNA, 20 bp, Homo sapiens
tgaaccaccacacccagccc

SEQ ID NO: 2232276 - DNA, 21 bp, Homo sapiens
tgaaccaccacacccagccca

SEQ ID NO: 2232277 - DNA, 11 bp, Homo sapiens
tgaactcctgg

SEQ ID NO: 2232278 - DNA, 17 bp, Homo sapiens
tgaactcctggcctcaa

SEQ ID NO: 2232279 - DNA, 14 bp, Homo sapiens
tgaacttgaaaaaa

SEQ ID NO: 2232280 - DNA, 20 bp, Homo sapiens
tgaacttgaaaaaaaaaaac

SEQ ID NO: 2232281 - DNA, 12 bp, Homo sapiens
tgaacttggttc

SEQ ID NO: 2232282 - DNA, 16 bp, Homo sapiens
tgaactttgacctctg

SEQ ID NO: 2232283 - DNA, 13 bp, Homo sapiens
tgaagacaatgac

SEQ ID NO: 2232284 - DNA, 19 bp, Homo sapiens
tgaaggacattgcggacag

SEQ ID NO: 2232285 - DNA, 19 bp, Homo sapiens
tgaaggccccgcccaggct

SEQ ID NO: 2232286 - DNA, 20 bp, Homo sapiens
tgaaggccccgcccaggctt

SEQ ID NO: 2232287 - DNA, 21 bp, Homo sapiens
tgaaggctcgagcatgcctgg

SEQ ID NO: 2232288 - DNA, 20 bp, Homo sapiens
tgaaggctgggttctgatcc

SEQ ID NO: 2232289 - DNA, 20 bp, Homo sapiens
tgaagtaatatgcacacatt

SEQ ID NO: 2232290 - DNA, 18 bp, Homo sapiens
tgacaaggattgctactg

SEQ ID NO: 2232291 - DNA, 14 bp, Homo sapiens
tgacacacagctct

SEQ ID NO: 2232292 - DNA, 15 bp, Homo sapiens
tgacacacagctctg

SEQ ID NO: 2232293 - DNA, 19 bp, Homo sapiens
tgacacacagctctgtcct

SEQ ID NO: 2232294 - DNA, 12 bp, Homo sapiens
tgacacatgcaa

SEQ ID NO: 2232295 - DNA, 20 bp, Homo sapiens
tgacacatgcaaggtcattt

SEQ ID NO: 2232296 - DNA, 22 bp, Homo sapiens
tgacagagcaagtgagaccctg

SEQ ID NO: 2232297 - DNA, 14 bp, Homo sapiens
tgacagaggcagcc

SEQ ID NO: 2232298 - DNA, 15 bp, Homo sapiens
tgacagaggcagccc

SEQ ID NO: 2232299 - DNA, 16 bp, Homo sapiens
tgacagaggcagcccc

SEQ ID NO: 2232300 - DNA, 17 bp, Homo sapiens
tgacagaggcagcccca

SEQ ID NO: 2232301 - DNA, 14 bp, Homo sapiens
tgacagagtgagac

SEQ ID NO: 2232302 - DNA, 17 bp, Homo sapiens
tgacagagtgagactct

SEQ ID NO: 2232303 - DNA, 19 bp, Homo sapiens
tgacagagtgagactctgt

SEQ ID NO: 2232304 - DNA, 11 bp, Homo sapiens
tgacagggcac

SEQ ID NO: 2232305 - DNA, 16 bp, Homo sapiens
tgacagggcacaccgg

SEQ ID NO: 2232306 - DNA, 13 bp, Homo sapiens
tgacatgtctttt

SEQ ID NO: 2232307 - DNA, 13 bp, Homo sapiens
tgacatgttttat

SEQ ID NO: 2232308 - DNA, 18 bp, Homo sapiens
tgaccaatgatggtcacc

SEQ ID NO: 2232309 - DNA, 13 bp, Homo sapiens
tgaccattctcca

SEQ ID NO: 2232310 - DNA, 14 bp, Homo sapiens
tgaccattctccac

SEQ ID NO: 2232311 - DNA, 19 bp, Homo sapiens
tgaccattctccacctgcc

SEQ ID NO: 2232312 - DNA, 20 bp, Homo sapiens
tgaccattctccacctgcca

SEQ ID NO: 2232313 - DNA, 15 bp, Homo sapiens
tgacccatgctgccc

SEQ ID NO: 2232314 - DNA, 17 bp, Homo sapiens
tgacccatgctgccctg

SEQ ID NO: 2232315 - DNA, 21 bp, Homo sapiens
tgacccatgctgccctgtgag

SEQ ID NO: 2232316 - DNA, 14 bp, Homo sapiens
tgaccgtgaggcca

SEQ ID NO: 2232317 - DNA, 20 bp, Homo sapiens
tgaccgtgaggccagagaca

SEQ ID NO: 2232318 - DNA, 20 bp, Homo sapiens
tgacctcaggtgatccaccc

SEQ ID NO: 2232319 - DNA, 17 bp, Homo sapiens
tgacctgaggcccttct

SEQ ID NO: 2232320 - DNA, 18 bp, Homo sapiens
tgacctttcaataggaaa

SEQ ID NO: 2232321 - DNA, 19 bp, Homo sapiens
tgacgccatcccagcccca

SEQ ID NO: 2232322 - DNA, 17 bp, Homo sapiens
tgactccagaatttccc

SEQ ID NO: 2232323 - DNA, 15 bp, Homo sapiens
tgagaaataaagttt

SEQ ID NO: 2232324 - DNA, 18 bp, Homo sapiens
tgagacagcccgggctct

SEQ ID NO: 2232325 - DNA, 20 bp, Homo sapiens
tgagacagcccgggctctgc

SEQ ID NO: 2232326 - DNA, 22 bp, Homo sapiens
tgagactcgcgacaatgcaaac

SEQ ID NO: 2232327 - DNA, 13 bp, Homo sapiens
tgagactctgtct

SEQ ID NO: 2232328 - DNA, 20 bp, Homo sapiens
tgggtacttgtggacacagc

SEQ ID NO: 2232329 - DNA, 22 bp, Homo sapiens
tgggtgcttggaggaaggaaac

SEQ ID NO: 2232330 - DNA, 14 bp, Homo sapiens
tgggtgtggcgcag

SEQ ID NO: 2232331 - DNA, 23 bp, Homo sapiens
tgggttcaagcgattcttctgct

SEQ ID NO: 2232332 - DNA, 15 bp, Homo sapiens
tgggttctacccagg

SEQ ID NO: 2232333 - DNA, 16 bp, Homo sapiens
tgggttctacccaggt

SEQ ID NO: 2232334 - DNA, 22 bp, Homo sapiens
tgggttctacccaggtgctagg

SEQ ID NO: 2232335 - DNA, 16 bp, Homo sapiens
tggtactaactttcct

SEQ ID NO: 2232336 - DNA, 21 bp, Homo sapiens
tggtcaccaaatcagctgcta

SEQ ID NO: 2232337 - DNA, 15 bp, Homo sapiens
tggtcagatttgaac

SEQ ID NO: 2232338 - DNA, 22 bp, Homo sapiens
tggtcagatttgaactcttcaa

SEQ ID NO: 2232339 - DNA, 16 bp, Homo sapiens
tggtccatagagagca

SEQ ID NO: 2232340 - DNA, 15 bp, Homo sapiens
tggtcccccttccat

SEQ ID NO: 2232341 - DNA, 15 bp, Homo sapiens
tggtcctgctgcagt

SEQ ID NO: 2232342 - DNA, 23 bp, Homo sapiens
tggtcctgctgcagttgccagtc

SEQ ID NO: 2232343 - DNA, 17 bp, Homo sapiens
tggtctacactgtgctg

SEQ ID NO: 2232344 - DNA, 22 bp, Homo sapiens
tggtgaaggtttttgtttcttt

SEQ ID NO: 2232345 - DNA, 17 bp, Homo sapiens
tggtgacctctgcctga

SEQ ID NO: 2232346 - DNA, 14 bp, Homo sapiens
tggtgagaggcatc

SEQ ID NO: 2232347 - DNA, 21 bp, Homo sapiens
tggtgcaatgacctttcaata

SEQ ID NO: 2232348 - DNA, 16 bp, Homo sapiens
tggtgcgatctgggtt

SEQ ID NO: 2232349 - DNA, 21 bp, Homo sapiens
tggtggaatgcgggggagcag

SEQ ID NO: 2232350 - DNA, 13 bp, Homo sapiens
tggtggcagctgc

SEQ ID NO: 2232351 - DNA, 12 bp, Homo sapiens
tggtggcagtgg

SEQ ID NO: 2232352 - DNA, 18 bp, Homo sapiens
tggtgggggcctcggtgt

SEQ ID NO: 2232353 - DNA, 15 bp, Homo sapiens
tggtgtcgggcatga

SEQ ID NO: 2232354 - DNA, 18 bp, Homo sapiens
tggtgtcgggcatgacac

SEQ ID NO: 2232355 - DNA, 15 bp, Homo sapiens
tggtgtttcctggca

SEQ ID NO: 2232356 - DNA, 14 bp, Homo sapiens
tggtttcagaaatg

SEQ ID NO: 2232357 - DNA, 21 bp, Homo sapiens
tggtttgtaaattaactttta

SEQ ID NO: 2232358 - DNA, 12 bp, Homo sapiens
tggttttctgtt

SEQ ID NO: 2232359 - DNA, 13 bp, Homo sapiens
tggttttctgttc

SEQ ID NO: 2232360 - DNA, 19 bp, Homo sapiens
tggttttcttgtgtgttta

SEQ ID NO: 2232361 - DNA, 12 bp, Homo sapiens
tgtaaaaaggga

SEQ ID NO: 2232362 - DNA, 16 bp, Homo sapiens
tgtaaaaagggaaaaa

SEQ ID NO: 2232363 - DNA, 16 bp, Homo sapiens
tgtaaatagctcaggt

SEQ ID NO: 2232364 - DNA, 16 bp, Homo sapiens
tgtaaattaactttta

SEQ ID NO: 2232365 - DNA, 17 bp, Homo sapiens
tgtaaattaacttttat

SEQ ID NO: 2232366 - DNA, 14 bp, Homo sapiens
tgtaacaagccacc

SEQ ID NO: 2232367 - DNA, 22 bp, Homo sapiens
tgtaagctctactgaggtgcta

SEQ ID NO: 2232368 - DNA, 14 bp, Homo sapiens
tgtaaggaatgatt

SEQ ID NO: 2232369 - DNA, 20 bp, Homo sapiens
tgtaatttttttatcgtcac

SEQ ID NO: 2232370 - DNA, 14 bp, Homo sapiens
tgtacagacaacaa

SEQ ID NO: 2232371 - DNA, 17 bp, Homo sapiens
tgtacagagcccacgcc

SEQ ID NO: 2232372 - DNA, 18 bp, Homo sapiens
tgtacagagcccacgccc

SEQ ID NO: 2232373 - DNA, 22 bp, Homo sapiens
tgtacagcaaggagatttacaa

SEQ ID NO: 2232374 - DNA, 18 bp, Homo sapiens
tgtacatgaaaacacatt

SEQ ID NO: 2232375 - DNA, 18 bp, Homo sapiens
tgtatatatttcctatat

SEQ ID NO: 2232376 - DNA, 22 bp, Homo sapiens
tgtatatatttcctatattgtt

SEQ ID NO: 2232377 - DNA, 15 bp, Homo sapiens
tgtatcccatgagcc

SEQ ID NO: 2232378 - DNA, 19 bp, Homo sapiens
tgtatcccatgagcctcag

SEQ ID NO: 2232379 - DNA, 14 bp, Homo sapiens
tgtatgtgtaagta

SEQ ID NO: 2232380 - DNA, 19 bp, Homo sapiens
tgtattctctcctgtacct

SEQ ID NO: 2232381 - DNA, 16 bp, Homo sapiens
tgtatttttttactaa

SEQ ID NO: 2232382 - DNA, 19 bp, Homo sapiens
tgtcaaagtggtgagaggc

SEQ ID NO: 2232383 - DNA, 15 bp, Homo sapiens
tgtcaagccataatt

SEQ ID NO: 2232384 - DNA, 14 bp, Homo sapiens
tgtcaattacagga

SEQ ID NO: 2232385 - DNA, 17 bp, Homo sapiens
tgtcaattacaggaagt

SEQ ID NO: 2232386 - DNA, 17 bp, Homo sapiens
tgtcacacactttggct

SEQ ID NO: 2232387 - DNA, 15 bp, Homo sapiens
tgtcacaggcaggtc

SEQ ID NO: 2232388 - DNA, 17 bp, Homo sapiens
tgtcacaggcaggtcca

SEQ ID NO: 2232389 - DNA, 16 bp, Homo sapiens
tgtcagccattcctgt

SEQ ID NO: 2232390 - DNA, 19 bp, Homo sapiens
tgtcagctgaacctgggta

SEQ ID NO: 2232391 - DNA, 16 bp, Homo sapiens
tgtcaggtggggcagc

SEQ ID NO: 2232392 - DNA, 17 bp, Homo sapiens
tgtcaggtggggcagct

SEQ ID NO: 2232393 - DNA, 16 bp, Homo sapiens
tgtcatttgagcaggg

SEQ ID NO: 2232394 - DNA, 19 bp, Homo sapiens
tgtcatttgagcagggctc

SEQ ID NO: 2232395 - DNA, 22 bp, Homo sapiens
tgtcatttgagcagggctcagc

SEQ ID NO: 2232396 - DNA, 14 bp, Homo sapiens
tgtccaagaagccc

SEQ ID NO: 2232397 - DNA, 15 bp, Homo sapiens
tgtccaagaagccca

SEQ ID NO: 2232398 - DNA, 19 bp, Homo sapiens
tgtccccgcactgggcttg

SEQ ID NO: 2232399 - DNA, 22 bp, Homo sapiens
tgtccctgcacttgcagactct

SEQ ID NO: 2232400 - DNA, 23 bp, Homo sapiens
tgtcccttacgtgagtcctggca

SEQ ID NO: 2232401 - DNA, 13 bp, Homo sapiens
tgtccgagctttg

SEQ ID NO: 2232402 - DNA, 20 bp, Homo sapiens
tgtcctacccaccctccttt

SEQ ID NO: 2232403 - DNA, 14 bp, Homo sapiens
tgtctaatgaaacc

SEQ ID NO: 2232404 - DNA, 15 bp, Homo sapiens
tgtctagttgtttga

SEQ ID NO: 2232405 - DNA, 16 bp, Homo sapiens
tgtctatgggactcaa

SEQ ID NO: 2232406 - DNA, 22 bp, Homo sapiens
tgtctcttggtcctgctgcagt

SEQ ID NO: 2232407 - DNA, 21 bp, Homo sapiens
tgtcttgcaatggcagccttg

SEQ ID NO: 2232408 - DNA, 17 bp, Homo sapiens
tgtctttggaccctgag

SEQ ID NO: 2232409 - DNA, 19 bp, Homo sapiens
tgtctttggaccctgaggc

SEQ ID NO: 2232410 - DNA, 23 bp, Homo sapiens
tgtctttggaccctgaggcccag

SEQ ID NO: 2232411 - DNA, 14 bp, Homo sapiens
tgtgaaaggaaaga

SEQ ID NO: 2232412 - DNA, 21 bp, Homo sapiens
tgtgaaaggaaagagggaggt

SEQ ID NO: 2232413 - DNA, 16 bp, Homo sapiens
tgtgaaccaccacacc

SEQ ID NO: 2232414 - DNA, 23 bp, Homo sapiens
tgtgaaccaccacacccagccca

SEQ ID NO: 2232415 - DNA, 15 bp, Homo sapiens
tgtgacatgttttat

SEQ ID NO: 2232416 - DNA, 19 bp, Homo sapiens
tgtgagcacaaaggtagct

SEQ ID NO: 2232417 - DNA, 18 bp, Homo sapiens
tgtgaggaagccgctggg

SEQ ID NO: 2232418 - DNA, 20 bp, Homo sapiens
tgtgaggaagccgctggggc

SEQ ID NO: 2232419 - DNA, 21 bp, Homo sapiens
tgtgatacaatgctgtgccct

SEQ ID NO: 2232420 - DNA, 19 bp, Homo sapiens
tgtgatgagaggaaatcac

SEQ ID NO: 2232421 - DNA, 15 bp, Homo sapiens
tgtgatggggccctg

SEQ ID NO: 2232422 - DNA, 16 bp, Homo sapiens
tgtgatggggccctgc

SEQ ID NO: 2232423 - DNA, 20 bp, Homo sapiens
tgtgatggggccctgcctcc

SEQ ID NO: 2232424 - DNA, 16 bp, Homo sapiens
tgtgcacatgcacgtg

SEQ ID NO: 2232425 - DNA, 16 bp, Homo sapiens
tgtgcattatctagat

SEQ ID NO: 2232426 - DNA, 20 bp, Homo sapiens
tgtgccaggtttttggtctg

SEQ ID NO: 2232427 - DNA, 12 bp, Homo sapiens
tgtgccatgtgc

SEQ ID NO: 2232428 - DNA, 13 bp, Homo sapiens
tgtgcctctggga

SEQ ID NO: 2232429 - DNA, 15 bp, Homo sapiens
tgtgcctctgggact

SEQ ID NO: 2232430 - DNA, 17 bp, Homo sapiens
tgtgcctctgggactgg

SEQ ID NO: 2232431 - DNA, 14 bp, Homo sapiens
tgtgcgcctacagg

SEQ ID NO: 2232432 - DNA, 15 bp, Homo sapiens
tgtgctctggacagg

SEQ ID NO: 2232433 - DNA, 12 bp, Homo sapiens
tgtgctgccctg

SEQ ID NO: 2232434 - DNA, 14 bp, Homo sapiens
tgtgctgccctgcc

SEQ ID NO: 2232435 - DNA, 19 bp, Homo sapiens
tgtgctgccctgcccacct

SEQ ID NO: 2232436 - DNA, 21 bp, Homo sapiens
tgtgctgccctgcccacctgg

SEQ ID NO: 2232437 - DNA, 15 bp, Homo sapiens
tgtggacacagctct

SEQ ID NO: 2232438 - DNA, 19 bp, Homo sapiens
tgtggatttaacagaaatg

SEQ ID NO: 2232439 - DNA, 13 bp, Homo sapiens
tgtgggcaccccc

SEQ ID NO: 2232440 - DNA, 14 bp, Homo sapiens
tgtgggcacccccg

SEQ ID NO: 2232441 - DNA, 23 bp, Homo sapiens
tgtgggtttctaaagctgccagc

SEQ ID NO: 2232442 - DNA, 13 bp, Homo sapiens
tgtggtcccaccc

SEQ ID NO: 2232443 - DNA, 14 bp, Homo sapiens
tgtggtgtttcctg

SEQ ID NO: 2232444 - DNA, 19 bp, Homo sapiens
tgtgtcagcatagaagtaa

SEQ ID NO: 2232445 - DNA, 20 bp, Homo sapiens
tgtgtcaggtggggcagctt

SEQ ID NO: 2232446 - DNA, 15 bp, Homo sapiens
tgttactgtcttcag

SEQ ID NO: 2232447 - DNA, 19 bp, Homo sapiens
tgttagtatgaggcatttg

SEQ ID NO: 2232448 - DNA, 19 bp, Homo sapiens
tgttcatcatcctaagcta

SEQ ID NO: 2232449 - DNA, 12 bp, Homo sapiens
tgttctctgccc

SEQ ID NO: 2232450 - DNA, 16 bp, Homo sapiens
tgttctctgccctcca

SEQ ID NO: 2232451 - DNA, 19 bp, Homo sapiens
tgttctctgccctccaaga

SEQ ID NO: 2232452 - DNA, 16 bp, Homo sapiens
tgttctggctcttcca

SEQ ID NO: 2232453 - DNA, 17 bp, Homo sapiens
tgttctggctcttccag

SEQ ID NO: 2232454 - DNA, 15 bp, Homo sapiens
tgttctgggacacag

SEQ ID NO: 2232455 - DNA, 18 bp, Homo sapiens
tgttctttccaaagtaca

SEQ ID NO: 2232456 - DNA, 20 bp, Homo sapiens
tgttctttccaaagtacact

SEQ ID NO: 2232457 - DNA, 18 bp, Homo sapiens
tgttgcccaggcaggtct

SEQ ID NO: 2232458 - DNA, 13 bp, Homo sapiens
tgttgcccaggct

SEQ ID NO: 2232459 - DNA, 23 bp, Homo sapiens
tgttgcccaggctggcgtgcagt

SEQ ID NO: 2232460 - DNA, 13 bp, Homo sapiens
tgttgtcagctga

SEQ ID NO: 2232461 - DNA, 14 bp, Homo sapiens
tgttgtcagctgaa

SEQ ID NO: 2232462 - DNA, 16 bp, Homo sapiens
tgtttagataatacac

SEQ ID NO: 2232463 - DNA, 20 bp, Homo sapiens
tgtttagataatacaccact

SEQ ID NO: 2232464 - DNA, 17 bp, Homo sapiens
tgtttgttgtcagctga

SEQ ID NO: 2232465 - DNA, 22 bp, Homo sapiens
tgttttaaggatgcttgtacat

SEQ ID NO: 2232466 - DNA, 19 bp, Homo sapiens
ttaaaaatctcaaatttct

SEQ ID NO: 2232467 - DNA, 17 bp, Homo sapiens
ttaaaagatacagttac

SEQ ID NO: 2232468 - DNA, 13 bp, Homo sapiens
ttaaataaatcat

SEQ ID NO: 2232469 - DNA, 15 bp, Homo sapiens
ttaaataaatcataa

SEQ ID NO: 2232470 - DNA, 18 bp, Homo sapiens
ttaaataatgtgaaactg

SEQ ID NO: 2232471 - DNA, 19 bp, Homo sapiens
ttaaataatgtgaaactgg

SEQ ID NO: 2232472 - DNA, 20 bp, Homo sapiens
ttaaataatgtgaaactgga

SEQ ID NO: 2232473 - DNA, 11 bp, Homo sapiens
ttaaatgcacc

SEQ ID NO: 2232474 - DNA, 14 bp, Homo sapiens
ttaaatgcccagcc

SEQ ID NO: 2232475 - DNA, 16 bp, Homo sapiens
ttaaatgcccagcccc

SEQ ID NO: 2232476 - DNA, 17 bp, Homo sapiens
ttaaatgcccagcccct

SEQ ID NO: 2232477 - DNA, 19 bp, Homo sapiens
ttaacagaaatgtacagca

SEQ ID NO: 2232478 - DNA, 17 bp, Homo sapiens
ttaaccacttcagctga

SEQ ID NO: 2232479 - DNA, 16 bp, Homo sapiens
ttaacttcacatattg

SEQ ID NO: 2232480 - DNA, 17 bp, Homo sapiens
ttaacttttataaactt

SEQ ID NO: 2232481 - DNA, 23 bp, Homo sapiens
ttaacttttataaactttacctt

SEQ ID NO: 2232482 - DNA, 20 bp, Homo sapiens
ttaagaaaaaggatgcacag

SEQ ID NO: 2232483 - DNA, 13 bp, Homo sapiens
ttaagaggcaggg

SEQ ID NO: 2232484 - DNA, 22 bp, Homo sapiens
ttaaggatgcttgtacataatg

SEQ ID NO: 2232485 - DNA, 9 bp, Homo sapiens
ttaaggtgg

SEQ ID NO: 2232486 - DNA, 17 bp, Homo sapiens
ttaagtactatgtatca

SEQ ID NO: 2232487 - DNA, 15 bp, Homo sapiens
ttaagtgctgcattt

SEQ ID NO: 2232488 - DNA, 19 bp, Homo sapiens
ttaagtgctgcatttaaaa

SEQ ID NO: 2232489 - DNA, 22 bp, Homo sapiens
ttaagtgctgcatttaaaagat

SEQ ID NO: 2232490 - DNA, 22 bp, Homo sapiens
ttaatattgatatgcttataca

SEQ ID NO: 2232491 - DNA, 13 bp, Homo sapiens
ttaatcattaggt

SEQ ID NO: 2232492 - DNA, 22 bp, Homo sapiens
ttaatcattaggtgtgactgaa

SEQ ID NO: 2232493 - DNA, 23 bp, Homo sapiens
ttaatcattaggtgtgactgaat

SEQ ID NO: 2232494 - DNA, 18 bp, Homo sapiens
ttaatgtcacaggcaggt

SEQ ID NO: 2232495 - DNA, 15 bp, Homo sapiens
ttaattcttagctca

SEQ ID NO: 2232496 - DNA, 20 bp, Homo sapiens
ttacaagcgtgagccactgc

SEQ ID NO: 2232497 - DNA, 21 bp, Homo sapiens
ttacaagcgtgagccactgca

SEQ ID NO: 2232498 - DNA, 20 bp, Homo sapiens
ttacataagataaatgtgct

SEQ ID NO: 2232499 - DNA, 12 bp, Homo sapiens
ttacatttttaa

SEQ ID NO: 2232500 - DNA, 20 bp, Homo sapiens
ttacatttttaagtgctgca

SEQ ID NO: 2232501 - DNA, 22 bp, Homo sapiens
ttacatttttaagtgctgcatt

SEQ ID NO: 2232502 - DNA, 14 bp, Homo sapiens
ttaccagcagagca

SEQ ID NO: 2232503 - DNA, 13 bp, Homo sapiens
ttactaagttttt

SEQ ID NO: 2232504 - DNA, 18 bp, Homo sapiens
ttactcagaattctctag

SEQ ID NO: 2232505 - DNA, 18 bp, Homo sapiens
ttacttaggtgtggggga

SEQ ID NO: 2232506 - DNA, 12 bp, Homo sapiens
ttacttctgcta

SEQ ID NO: 2232507 - DNA, 23 bp, Homo sapiens
ttacttcttatacatttgataaa

SEQ ID NO: 2232508 - DNA, 17 bp, Homo sapiens
ttactttaaaaggagcc

SEQ ID NO: 2232509 - DNA, 13 bp, Homo sapiens
ttagacagagtct

SEQ ID NO: 2232510 - DNA, 17 bp, Homo sapiens
ttagacagtccctgcca

SEQ ID NO: 2232511 - DNA, 14 bp, Homo sapiens
ttagagttgatact

SEQ ID NO: 2232512 - DNA, 18 bp, Homo sapiens
ttagcaaattctgttttt

SEQ ID NO: 2232513 - DNA, 16 bp, Homo sapiens
ttaggtgtgactgaat

SEQ ID NO: 2232514 - DNA, 17 bp, Homo sapiens
ttagtagagacagggtt

SEQ ID NO: 2232515 - DNA, 16 bp, Homo sapiens
ttagttcctcattagc

SEQ ID NO: 2232516 - DNA, 15 bp, Homo sapiens
ttagtttctccaagc

SEQ ID NO: 2232517 - DNA, 15 bp, Homo sapiens
ttataatgaatgaaa

SEQ ID NO: 2232518 - DNA, 13 bp, Homo sapiens
ttatacataaaca

SEQ ID NO: 2232519 - DNA, 11 bp, Homo sapiens
ttatgactcca

SEQ ID NO: 2232520 - DNA, 22 bp, Homo sapiens
ttatgggctgggttctacccag

SEQ ID NO: 2232521 - DNA, 11 bp, Homo sapiens
ttattctgctc

SEQ ID NO: 2232522 - DNA, 18 bp, Homo sapiens
ttatttaatgaaagactg

SEQ ID NO: 2232523 - DNA, 16 bp, Homo sapiens
ttatttagttccttga

SEQ ID NO: 2232524 - DNA, 18 bp, Homo sapiens
ttattttattatgcatga

SEQ ID NO: 2232525 - DNA, 15 bp, Homo sapiens
ttcaaggatcctgag

SEQ ID NO: 2232526 - DNA, 18 bp, Homo sapiens
ttcaaggatcctgagcca

SEQ ID NO: 2232527 - DNA, 15 bp, Homo sapiens
ttcaataggaaaaac

SEQ ID NO: 2232528 - DNA, 18 bp, Homo sapiens
ttcaataggaaaaactga

SEQ ID NO: 2232529 - DNA, 22 bp, Homo sapiens
ttcaataggaaaaactgatttt

SEQ ID NO: 2232530 - DNA, 18 bp, Homo sapiens
ttcaattctcatttgtca

SEQ ID NO: 2232531 - DNA, 20 bp, Homo sapiens
ttcacagatgggtgcttgga

SEQ ID NO: 2232532 - DNA, 22 bp, Homo sapiens
ttcaccacatgtgcacatgcac

SEQ ID NO: 2232533 - DNA, 19 bp, Homo sapiens
ttcacctttgtccccaccg

SEQ ID NO: 2232534 - DNA, 13 bp, Homo sapiens
ttcactctccttg

SEQ ID NO: 2232535 - DNA, 14 bp, Homo sapiens
ttcactctccttgg

SEQ ID NO: 2232536 - DNA, 15 bp, Homo sapiens
ttcagagactcctgc

SEQ ID NO: 2232537 - DNA, 12 bp, Homo sapiens
ttcagctccagc

SEQ ID NO: 2232538 - DNA, 22 bp, Homo sapiens
ttcagctccagctcaccagccc

SEQ ID NO: 2232539 - DNA, 15 bp, Homo sapiens
ttcaggtaacaggca

SEQ ID NO: 2232540 - DNA, 17 bp, Homo sapiens
ttcaggtaacaggcaga

SEQ ID NO: 2232541 - DNA, 14 bp, Homo sapiens
ttcagtaataactc

SEQ ID NO: 2232542 - DNA, 19 bp, Homo sapiens
ttcagtgccttatggaaca

SEQ ID NO: 2232543 - DNA, 13 bp, Homo sapiens
ttcagtggcagct

SEQ ID NO: 2232544 - DNA, 17 bp, Homo sapiens
ttcagtggcagctgctt

SEQ ID NO: 2232545 - DNA, 23 bp, Homo sapiens
ttcataatgacttaagcacactt

SEQ ID NO: 2232546 - DNA, 21 bp, Homo sapiens
ttcatatttacttcttataca

SEQ ID NO: 2232547 - DNA, 17 bp, Homo sapiens
ttcatccctctggggct

SEQ ID NO: 2232548 - DNA, 15 bp, Homo sapiens
ttcatcctcctcaga

SEQ ID NO: 2232549 - DNA, 19 bp, Homo sapiens
ttcatcctcctcagatctt

SEQ ID NO: 2232550 - DNA, 17 bp, Homo sapiens
ttcatcttgaattgtaa

SEQ ID NO: 2232551 - DNA, 18 bp, Homo sapiens
ttcatttaggtgaggaag

SEQ ID NO: 2232552 - DNA, 13 bp, Homo sapiens
ttccaaagtacac

SEQ ID NO: 2232553 - DNA, 22 bp, Homo sapiens
ttccaatttacatactctgctt

SEQ ID NO: 2232554 - DNA, 22 bp, Homo sapiens
ttccacaagagcccaggcctcc

SEQ ID NO: 2232555 - DNA, 21 bp, Homo sapiens
ttccaggggtgggacaccctg

SEQ ID NO: 2232556 - DNA, 17 bp, Homo sapiens
ttccaggtttaagctgt

SEQ ID NO: 2232557 - DNA, 16 bp, Homo sapiens
ttccagtgaggctctg

SEQ ID NO: 2232558 - DNA, 17 bp, Homo sapiens
ttccagtgaggctctgc

SEQ ID NO: 2232559 - DNA, 16 bp, Homo sapiens
ttcccaagctctgctc

SEQ ID NO: 2232560 - DNA, 12 bp, Homo sapiens
ttcccacctctc

SEQ ID NO: 2232561 - DNA, 16 bp, Homo sapiens
ttcccatttgctcctt

SEQ ID NO: 2232562 - DNA, 15 bp, Homo sapiens
ttccccaggaggcca

SEQ ID NO: 2232563 - DNA, 21 bp, Homo sapiens
ttccccaggaggccagccttg

SEQ ID NO: 2232564 - DNA, 20 bp, Homo sapiens
ttccctcacctttcccatct

SEQ ID NO: 2232565 - DNA, 21 bp, Homo sapiens
ttccctttgacgccatcccag

SEQ ID NO: 2232566 - DNA, 18 bp, Homo sapiens
ttcccttttttggctgct

SEQ ID NO: 2232567 - DNA, 19 bp, Homo sapiens
ttcccttttttggctgctg

SEQ ID NO: 2232568 - DNA, 13 bp, Homo sapiens
ttcctcattagca

SEQ ID NO: 2232569 - DNA, 12 bp, Homo sapiens
ttcctccctccc

SEQ ID NO: 2232570 - DNA, 21 bp, Homo sapiens
ttcctccctccctctttccct

SEQ ID NO: 2232571 - DNA, 22 bp, Homo sapiens
ttcctccctccctctttccctc

SEQ ID NO: 2232572 - DNA, 17 bp, Homo sapiens
ttcctctttccatctac

SEQ ID NO: 2232573 - DNA, 14 bp, Homo sapiens
ttcctgaaccgatg

SEQ ID NO: 2232574 - DNA, 15 bp, Homo sapiens
ttcctgaggctgggc

SEQ ID NO: 2232575 - DNA, 18 bp, Homo sapiens
ttcctgatgcttcttcag

SEQ ID NO: 2232576 - DNA, 19 bp, Homo sapiens
ttcctgatgcttcttcaga

SEQ ID NO: 2232577 - DNA, 19 bp, Homo sapiens
ttcctggcactgcttccag

SEQ ID NO: 2232578 - DNA, 23 bp, Homo sapiens
ttccttcagtgccttatggaaca

SEQ ID NO: 2232579 - DNA, 19 bp, Homo sapiens
ttccttcattcaacccacc

SEQ ID NO: 2232580 - DNA, 20 bp, Homo sapiens
ttccttgagttgattcagct

SEQ ID NO: 2232581 - DNA, 13 bp, Homo sapiens
ttcgctcctgtgt

SEQ ID NO: 2232582 - DNA, 18 bp, Homo sapiens
tggccagatgcaccagcc

SEQ ID NO: 2232583 - DNA, 15 bp, Homo sapiens
tggccaggctggtct

SEQ ID NO: 2232584 - DNA, 17 bp, Homo sapiens
tggccaggctggtctca

SEQ ID NO: 2232585 - DNA, 23 bp, Homo sapiens
tggccagtgtgacaaggattgct

SEQ ID NO: 2232586 - DNA, 13 bp, Homo sapiens
tggcccacgcact

SEQ ID NO: 2232587 - DNA, 21 bp, Homo sapiens
tggcccctcagggtccctggt

SEQ ID NO: 2232588 - DNA, 20 bp, Homo sapiens
tggcccctgcccggctgcgg

SEQ ID NO: 2232589 - DNA, 23 bp, Homo sapiens
tggccgggcgcggtggctcacgc

SEQ ID NO: 2232590 - DNA, 20 bp, Homo sapiens
tggcctcccaactcacccca

SEQ ID NO: 2232591 - DNA, 23 bp, Homo sapiens
tggcctcccaactcaccccagcc

SEQ ID NO: 2232592 - DNA, 13 bp, Homo sapiens
tggcctctgcact

SEQ ID NO: 2232593 - DNA, 18 bp, Homo sapiens
tggcctggcccctcaggg

SEQ ID NO: 2232594 - DNA, 23 bp, Homo sapiens
tggcgcagcatattcaggaagct

SEQ ID NO: 2232595 - DNA, 14 bp, Homo sapiens
tggcgctgcccctg

SEQ ID NO: 2232596 - DNA, 15 bp, Homo sapiens
tggcgctgcccctgg

SEQ ID NO: 2232597 - DNA, 16 bp, Homo sapiens
tggcgctgcccctggc

SEQ ID NO: 2232598 - DNA, 19 bp, Homo sapiens
tggctaatgtactgcatat

SEQ ID NO: 2232599 - DNA, 20 bp, Homo sapiens
tggctcaggtggggtcactc

SEQ ID NO: 2232600 - DNA, 13 bp, Homo sapiens
tggctgcagggag

SEQ ID NO: 2232601 - DNA, 16 bp, Homo sapiens
tggctgggggcctcag

SEQ ID NO: 2232602 - DNA, 17 bp, Homo sapiens
tggctgggggcctcagt

SEQ ID NO: 2232603 - DNA, 20 bp, Homo sapiens
tggctgggggcctcagtgcc

SEQ ID NO: 2232604 - DNA, 22 bp, Homo sapiens
tggctggttagaggttcccttt

SEQ ID NO: 2232605 - DNA, 14 bp, Homo sapiens
tggctgtgtctccc

SEQ ID NO: 2232606 - DNA, 13 bp, Homo sapiens
tggctgttggctg

SEQ ID NO: 2232607 - DNA, 18 bp, Homo sapiens
tggctgttggctgggggc

SEQ ID NO: 2232608 - DNA, 15 bp, Homo sapiens
tggcttggggggctc

SEQ ID NO: 2232609 - DNA, 14 bp, Homo sapiens
tggcttttgtgcat

SEQ ID NO: 2232610 - DNA, 22 bp, Homo sapiens
tgggaatgaatgtcagtgtgac

SEQ ID NO: 2232611 - DNA, 15 bp, Homo sapiens
tgggacaccctgtga

SEQ ID NO: 2232612 - DNA, 18 bp, Homo sapiens
tgggactacaggcaccca

SEQ ID NO: 2232613 - DNA, 18 bp, Homo sapiens
tgggactcaatgcactga

SEQ ID NO: 2232614 - DNA, 21 bp, Homo sapiens
tgggagaaccaaaaagaggct

SEQ ID NO: 2232615 - DNA, 13 bp, Homo sapiens
tgggagcaaaaga

SEQ ID NO: 2232616 - DNA, 22 bp, Homo sapiens
tgggagctgcctgttcagctcc

SEQ ID NO: 2232617 - DNA, 22 bp, Homo sapiens
tgggaggatctcttgagcctgg

SEQ ID NO: 2232618 - DNA, 21 bp, Homo sapiens
tgggaggattgcttgagctca

SEQ ID NO: 2232619 - DNA, 15 bp, Homo sapiens
tgggaggggaagaaa

SEQ ID NO: 2232620 - DNA, 18 bp, Homo sapiens
tgggaggggaagaaaaac

SEQ ID NO: 2232621 - DNA, 18 bp, Homo sapiens
tgggagggtctgcaggga

SEQ ID NO: 2232622 - DNA, 19 bp, Homo sapiens
tgggagggtctgcagggaa

SEQ ID NO: 2232623 - DNA, 18 bp, Homo sapiens
tgggaggtcaaggctgca

SEQ ID NO: 2232624 - DNA, 18 bp, Homo sapiens
tgggatgattggaggggg

SEQ ID NO: 2232625 - DNA, 22 bp, Homo sapiens
tgggattacaagcgtgagccac

SEQ ID NO: 2232626 - DNA, 13 bp, Homo sapiens
tgggcagaaggaa

SEQ ID NO: 2232627 - DNA, 23 bp, Homo sapiens
tgggcagaaggaagacttcatcc

SEQ ID NO: 2232628 - DNA, 14 bp, Homo sapiens
tgggcagagcagag

SEQ ID NO: 2232629 - DNA, 18 bp, Homo sapiens
tgggcagagcagagacca

SEQ ID NO: 2232630 - DNA, 13 bp, Homo sapiens
tgggccaggagcc

SEQ ID NO: 2232631 - DNA, 14 bp, Homo sapiens
tgggccaggagcct

SEQ ID NO: 2232632 - DNA, 16 bp, Homo sapiens
tgggccaggagcctcc

SEQ ID NO: 2232633 - DNA, 18 bp, Homo sapiens
tgggccaggagcctcctg

SEQ ID NO: 2232634 - DNA, 20 bp, Homo sapiens
tgggcccaatgcactttgtt

SEQ ID NO: 2232635 - DNA, 21 bp, Homo sapiens
tgggcccccaaatggaaatgg

SEQ ID NO: 2232636 - DNA, 16 bp, Homo sapiens
tgggctagttgggctt

SEQ ID NO: 2232637 - DNA, 20 bp, Homo sapiens
tgggctcccttcccacctct

SEQ ID NO: 2232638 - DNA, 21 bp, Homo sapiens
tgggctcccttcccacctctc

SEQ ID NO: 2232639 - DNA, 18 bp, Homo sapiens
tgggctgggttctaccca

SEQ ID NO: 2232640 - DNA, 17 bp, Homo sapiens
tgggctggtgtcacctg

SEQ ID NO: 2232641 - DNA, 15 bp, Homo sapiens
tgggcttcagtggca

SEQ ID NO: 2232642 - DNA, 22 bp, Homo sapiens
tgggcttcagtggcagctgctt

SEQ ID NO: 2232643 - DNA, 15 bp, Homo sapiens
tgggcttcatcctcc

SEQ ID NO: 2232644 - DNA, 23 bp, Homo sapiens
tgggcttggggaccagagctgcc

SEQ ID NO: 2232645 - DNA, 17 bp, Homo sapiens
tgggcttgtctgtagat

SEQ ID NO: 2232646 - DNA, 21 bp, Homo sapiens
tgggcttgtctgtagatttta

SEQ ID NO: 2232647 - DNA, 17 bp, Homo sapiens
tggggacctcaggcctg

SEQ ID NO: 2232648 - DNA, 12 bp, Homo sapiens
tggggagaaagt

SEQ ID NO: 2232649 - DNA, 23 bp, Homo sapiens
tggggatgagaaaggttgaagca

SEQ ID NO: 2232650 - DNA, 13 bp, Homo sapiens
tggggcagcttga

SEQ ID NO: 2232651 - DNA, 12 bp, Homo sapiens
tggggccctgcc

SEQ ID NO: 2232652 - DNA, 15 bp, Homo sapiens
tggggccctgcctcc

SEQ ID NO: 2232653 - DNA, 20 bp, Homo sapiens
tggggctgcaccggctggcc

SEQ ID NO: 2232654 - DNA, 23 bp, Homo sapiens
tggggctgcaccggctggcctgg

SEQ ID NO: 2232655 - DNA, 17 bp, Homo sapiens
tggggctggaagcagaa

SEQ ID NO: 2232656 - DNA, 18 bp, Homo sapiens
tgggggctgggcagagga

SEQ ID NO: 2232657 - DNA, 18 bp, Homo sapiens
tggggtacccactgctct

SEQ ID NO: 2232658 - DNA, 19 bp, Homo sapiens
tggggtacccactgctctg

SEQ ID NO: 2232659 - DNA, 14 bp, Homo sapiens
tggggtcactctgg

SEQ ID NO: 2232660 - DNA, 18 bp, Homo sapiens
tggggtcactctggcagc

SEQ ID NO: 2232661 - DNA, 19 bp, Homo sapiens
tggggtcactctggcagct

SEQ ID NO: 2232662 - DNA, 20 bp, Homo sapiens
tggggtcactctggcagctc

SEQ ID NO: 2232663 - DNA, 16 bp, Homo sapiens
tgggtaactagggaag

SEQ ID NO: 2232664 - DNA, 17 bp, Homo sapiens
tgggtacttgtggacac

SEQ ID NO: 2232665 - DNA, 18 bp, Homo sapiens
tgggtacttgtggacaca

SEQ ID NO: 2232666 - DNA, 12 bp, Homo sapiens
tgccgcagccct

SEQ ID NO: 2232667 - DNA, 16 bp, Homo sapiens
tgccgtctacctgagg

SEQ ID NO: 2232668 - DNA, 12 bp, Homo sapiens
tgcctcagcctc

SEQ ID NO: 2232669 - DNA, 22 bp, Homo sapiens
tgcctcccatcacccgctaaga

SEQ ID NO: 2232670 - DNA, 18 bp, Homo sapiens
tgcctcgaactggctgca

SEQ ID NO: 2232671 - DNA, 13 bp, Homo sapiens
tgcctctctcagg

SEQ ID NO: 2232672 - DNA, 15 bp, Homo sapiens
tgcctctctcaggcc

SEQ ID NO: 2232673 - DNA, 22 bp, Homo sapiens
tgcctctgacacacagctctgt

SEQ ID NO: 2232674 - DNA, 17 bp, Homo sapiens
tgcctctgcctctgaca

SEQ ID NO: 2232675 - DNA, 13 bp, Homo sapiens
tgcctctgggact

SEQ ID NO: 2232676 - DNA, 14 bp, Homo sapiens
tgcctctgggactg

SEQ ID NO: 2232677 - DNA, 18 bp, Homo sapiens
tgcctgaagtcacacagt

SEQ ID NO: 2232678 - DNA, 15 bp, Homo sapiens
tgcctgcccaggccc

SEQ ID NO: 2232679 - DNA, 15 bp, Homo sapiens
tgcctggatggggct

SEQ ID NO: 2232680 - DNA, 20 bp, Homo sapiens
tgcctggatggggctgcacc

SEQ ID NO: 2232681 - DNA, 21 bp, Homo sapiens
tgcctgggatccctcatcctc

SEQ ID NO: 2232682 - DNA, 18 bp, Homo sapiens
tgcctgggcagaaggaag

SEQ ID NO: 2232683 - DNA, 18 bp, Homo sapiens
tgcctggtggcagctgcg

SEQ ID NO: 2232684 - DNA, 20 bp, Homo sapiens
tgccttatggaacactctga

SEQ ID NO: 2232685 - DNA, 22 bp, Homo sapiens
tgccttatggaacactctgaga

SEQ ID NO: 2232686 - DNA, 19 bp, Homo sapiens
tgcgaaaggatgaaagtga

SEQ ID NO: 2232687 - DNA, 20 bp, Homo sapiens
tgcgatctgggttcactgca

SEQ ID NO: 2232688 - DNA, 16 bp, Homo sapiens
tgcgcctacaggagtg

SEQ ID NO: 2232689 - DNA, 17 bp, Homo sapiens
tgcggaagccacagggt

SEQ ID NO: 2232690 - DNA, 20 bp, Homo sapiens
tgcggaagccacagggtgag

SEQ ID NO: 2232691 - DNA, 17 bp, Homo sapiens
tgcggacagccacggcc

SEQ ID NO: 2232692 - DNA, 18 bp, Homo sapiens
tgcggacagccacggcca

SEQ ID NO: 2232693 - DNA, 20 bp, Homo sapiens
tgcggacagccacggccagg

SEQ ID NO: 2232694 - DNA, 20 bp, Homo sapiens
tgcgggcttcctcctggtgt

SEQ ID NO: 2232695 - DNA, 15 bp, Homo sapiens
tgcggtccacccagg

SEQ ID NO: 2232696 - DNA, 17 bp, Homo sapiens
tgcggtgctatctcccc

SEQ ID NO: 2232697 - DNA, 11 bp, Homo sapiens
tgctacacact

SEQ ID NO: 2232698 - DNA, 21 bp, Homo sapiens
tgctactgtcctacccaccct

SEQ ID NO: 2232699 - DNA, 22 bp, Homo sapiens
tgctactgtcctacccaccctc

SEQ ID NO: 2232700 - DNA, 16 bp, Homo sapiens
tgctaggaacactcct

SEQ ID NO: 2232701 - DNA, 17 bp, Homo sapiens
tgctaggaacactcctt

SEQ ID NO: 2232702 - DNA, 17 bp, Homo sapiens
tgctatctcccccagcc

SEQ ID NO: 2232703 - DNA, 19 bp, Homo sapiens
tgctatctcccccagcccc

SEQ ID NO: 2232704 - DNA, 20 bp, Homo sapiens
tgctatctcccccagcccca

SEQ ID NO: 2232705 - DNA, 16 bp, Homo sapiens
tgctcacatatctgtc

SEQ ID NO: 2232706 - DNA, 20 bp, Homo sapiens
tgctccagctgttcagctgg

SEQ ID NO: 2232707 - DNA, 22 bp, Homo sapiens
tgctctgatcatccactgtgcc

SEQ ID NO: 2232708 - DNA, 15 bp, Homo sapiens
tgctctgctgacaga

SEQ ID NO: 2232709 - DNA, 14 bp, Homo sapiens
tgctctggacaggc

SEQ ID NO: 2232710 - DNA, 13 bp, Homo sapiens
tgctgaaggctcg

SEQ ID NO: 2232711 - DNA, 17 bp, Homo sapiens
tgctgaatggttttcaa

SEQ ID NO: 2232712 - DNA, 22 bp, Homo sapiens
tgctgaatggttttcaaaataa

SEQ ID NO: 2232713 - DNA, 21 bp, Homo sapiens
tgctgactgttttctcttgag

SEQ ID NO: 2232714 - DNA, 24 bp, Homo sapiens
tgctgactgttttctcttgagagg

SEQ ID NO: 2232715 - DNA, 15 bp, Homo sapiens
tgctgagtctgaagg

SEQ ID NO: 2232716 - DNA, 13 bp, Homo sapiens
tgctgatggtgca

SEQ ID NO: 2232717 - DNA, 15 bp, Homo sapiens
tgctgatggtgcaat

SEQ ID NO: 2232718 - DNA, 18 bp, Homo sapiens
tgctgcatttaaaagata

SEQ ID NO: 2232719 - DNA, 11 bp, Homo sapiens
tgctgccatcc

SEQ ID NO: 2232720 - DNA, 12 bp, Homo sapiens
tgctgccatcca

SEQ ID NO: 2232721 - DNA, 17 bp, Homo sapiens
tgctgccctgcccacct

SEQ ID NO: 2232722 - DNA, 13 bp, Homo sapiens
tgctgctggctgg

SEQ ID NO: 2232723 - DNA, 12 bp, Homo sapiens
tgctgcttgagg

SEQ ID NO: 2232724 - DNA, 16 bp, Homo sapiens
tgctggctggttagag

SEQ ID NO: 2232725 - DNA, 19 bp, Homo sapiens
tgctgggattacaagcgtg

SEQ ID NO: 2232726 - DNA, 21 bp, Homo sapiens
tgctgggattacaagcgtgag

SEQ ID NO: 2232727 - DNA, 17 bp, Homo sapiens
tgctgggattacaggtg

SEQ ID NO: 2232728 - DNA, 17 bp, Homo sapiens
tgctgggcttgtctgta

SEQ ID NO: 2232729 - DNA, 17 bp, Homo sapiens
tgctgtcccttacgtga

SEQ ID NO: 2232730 - DNA, 17 bp, Homo sapiens
tgctgtcccttttcctt

SEQ ID NO: 2232731 - DNA, 13 bp, Homo sapiens
tgcttaacttcac

SEQ ID NO: 2232732 - DNA, 14 bp, Homo sapiens
tgcttaacttcaca

SEQ ID NO: 2232733 - DNA, 16 bp, Homo sapiens
tgcttccagtgaggct

SEQ ID NO: 2232734 - DNA, 18 bp, Homo sapiens
tgcttccagtgaggctct

SEQ ID NO: 2232735 - DNA, 20 bp, Homo sapiens
tgcttccagtgaggctctgc

SEQ ID NO: 2232736 - DNA, 12 bp, Homo sapiens
tgcttctcactg

SEQ ID NO: 2232737 - DNA, 21 bp, Homo sapiens
tgcttgaggcaactcatctta

SEQ ID NO: 2232738 - DNA, 14 bp, Homo sapiens
tgcttgtacataat

SEQ ID NO: 2232739 - DNA, 22 bp, Homo sapiens
tgcttgtacataatgcgtgcat

SEQ ID NO: 2232740 - DNA, 14 bp, Homo sapiens
tgcttttggtctgt

SEQ ID NO: 2232741 - DNA, 16 bp, Homo sapiens
tggaaaataaattatt

SEQ ID NO: 2232742 - DNA, 20 bp, Homo sapiens
tggaaatattaagaaagact

SEQ ID NO: 2232743 - DNA, 23 bp, Homo sapiens
tggaaatgggcagagcagagacc

SEQ ID NO: 2232744 - DNA, 21 bp, Homo sapiens
tggaaatttgttataatgaat

SEQ ID NO: 2232745 - DNA, 18 bp, Homo sapiens
gggcctggggtaggagga

SEQ ID NO: 2232746 - DNA, 22 bp, Homo sapiens
gggctcagcaaaagatgcttct

SEQ ID NO: 2232747 - DNA, 17 bp, Homo sapiens
gggctcagcggggacag

SEQ ID NO: 2232748 - DNA, 19 bp, Homo sapiens
gggctcagcggggacagct

SEQ ID NO: 2232749 - DNA, 13 bp, Homo sapiens
gggctccagacac

SEQ ID NO: 2232750 - DNA, 14 bp, Homo sapiens
gggctcccttccca

SEQ ID NO: 2232751 - DNA, 18 bp, Homo sapiens
gggctcccttcccacctc

SEQ ID NO: 2232752 - DNA, 13 bp, Homo sapiens
gggctctgcctcc

SEQ ID NO: 2232753 - DNA, 16 bp, Homo sapiens
gggctgaggtgggagg

SEQ ID NO: 2232754 - DNA, 21 bp, Homo sapiens
gggctgcaccggctggcctgg

SEQ ID NO: 2232755 - DNA, 22 bp, Homo sapiens
gggctgcaccggctggcctggc

SEQ ID NO: 2232756 - DNA, 12 bp, Homo sapiens
gggctgggcaga

SEQ ID NO: 2232757 - DNA, 22 bp, Homo sapiens
gggctgggttctacccaggtgc

SEQ ID NO: 2232758 - DNA, 14 bp, Homo sapiens
gggcttcagtggca

SEQ ID NO: 2232759 - DNA, 15 bp, Homo sapiens
gggcttcagtggcag

SEQ ID NO: 2232760 - DNA, 17 bp, Homo sapiens
ggggaaaatcagcctgc

SEQ ID NO: 2232761 - DNA, 19 bp, Homo sapiens
ggggaaaatcagcctgctc

SEQ ID NO: 2232762 - DNA, 12 bp, Homo sapiens
ggggaagaaaaa

SEQ ID NO: 2232763 - DNA, 14 bp, Homo sapiens
ggggaccagagctg

SEQ ID NO: 2232764 - DNA, 13 bp, Homo sapiens
ggggacctcaggc

SEQ ID NO: 2232765 - DNA, 20 bp, Homo sapiens
ggggatcccccgccccatcc

SEQ ID NO: 2232766 - DNA, 16 bp, Homo sapiens
ggggcaaccctggtga

SEQ ID NO: 2232767 - DNA, 18 bp, Homo sapiens
ggggcccaagagagacag

SEQ ID NO: 2232768 - DNA, 15 bp, Homo sapiens
ggggccctgcctcct

SEQ ID NO: 2232769 - DNA, 12 bp, Homo sapiens
ggggctgcaccg

SEQ ID NO: 2232770 - DNA, 14 bp, Homo sapiens
ggggctggaagcag

SEQ ID NO: 2232771 - DNA, 15 bp, Homo sapiens
ggggctggaagcaga

SEQ ID NO: 2232772 - DNA, 17 bp, Homo sapiens
ggggctgggcagaggaa

SEQ ID NO: 2232773 - DNA, 17 bp, Homo sapiens
gggggatcacagcctct

SEQ ID NO: 2232774 - DNA, 17 bp, Homo sapiens
gggggcctcagtgccac

SEQ ID NO: 2232775 - DNA, 12 bp, Homo sapiens
gggggggtgccc

SEQ ID NO: 2232776 - DNA, 18 bp, Homo sapiens
ggggtgccctcccagacc

SEQ ID NO: 2232777 - DNA, 12 bp, Homo sapiens
ggggtgggaggg

SEQ ID NO: 2232778 - DNA, 19 bp, Homo sapiens
gggtacttgtggacacagc

SEQ ID NO: 2232779 - DNA, 23 bp, Homo sapiens
gggtacttgtggacacagctctt

SEQ ID NO: 2232780 - DNA, 14 bp, Homo sapiens
gggtaggaggaaca

SEQ ID NO: 2232781 - DNA, 22 bp, Homo sapiens
gggtcactctggcagctcagag

SEQ ID NO: 2232782 - DNA, 22 bp, Homo sapiens
gggtctcactatgttgcccagg

SEQ ID NO: 2232783 - DNA, 12 bp, Homo sapiens
gggtgccctccc

SEQ ID NO: 2232784 - DNA, 19 bp, Homo sapiens
gggtggcaccagcagcctg

SEQ ID NO: 2232785 - DNA, 14 bp, Homo sapiens
gggtggcctcccaa

SEQ ID NO: 2232786 - DNA, 19 bp, Homo sapiens
gggtgggacaccctgtgat

SEQ ID NO: 2232787 - DNA, 15 bp, Homo sapiens
gggtgggaggggaag

SEQ ID NO: 2232788 - DNA, 17 bp, Homo sapiens
gggtgtggcgcagcata

SEQ ID NO: 2232789 - DNA, 23 bp, Homo sapiens
gggttcaagcgattcttctgctt

SEQ ID NO: 2232790 - DNA, 12 bp, Homo sapiens
gggttctaccca

SEQ ID NO: 2232791 - DNA, 17 bp, Homo sapiens
gggttctacccaggtgc

SEQ ID NO: 2232792 - DNA, 19 bp, Homo sapiens
gggttggcccctgcccggc

SEQ ID NO: 2232793 - DNA, 20 bp, Homo sapiens
gggttttgccatgttggcca

SEQ ID NO: 2232794 - DNA, 13 bp, Homo sapiens
ggtacccactgct

SEQ ID NO: 2232795 - DNA, 16 bp, Homo sapiens
ggtacccactgctctg

SEQ ID NO: 2232796 - DNA, 16 bp, Homo sapiens
ggtacttgtggacaca

SEQ ID NO: 2232797 - DNA, 21 bp, Homo sapiens
ggtacttgtggacacagctct

SEQ ID NO: 2232798 - DNA, 22 bp, Homo sapiens
ggtacttgtggacacagctctt

SEQ ID NO: 2232799 - DNA, 22 bp, Homo sapiens
ggtagaagcccttctaccttcc

SEQ ID NO: 2232800 - DNA, 20 bp, Homo sapiens
ggtagggtaagtgagagagg

SEQ ID NO: 2232801 - DNA, 23 bp, Homo sapiens
ggtattggctagaggttcaaaga

SEQ ID NO: 2232802 - DNA, 20 bp, Homo sapiens
ggtcactctggcagctcaga

SEQ ID NO: 2232803 - DNA, 13 bp, Homo sapiens
ggtcagagcctgc

SEQ ID NO: 2232804 - DNA, 14 bp, Homo sapiens
ggtcagagcctgca

SEQ ID NO: 2232805 - DNA, 13 bp, Homo sapiens
ggtccacccagga

SEQ ID NO: 2232806 - DNA, 17 bp, Homo sapiens
ggtccacccaggagccc

SEQ ID NO: 2232807 - DNA, 15 bp, Homo sapiens
ggtcccaccccacac

SEQ ID NO: 2232808 - DNA, 14 bp, Homo sapiens
ggtccctggtggca

SEQ ID NO: 2232809 - DNA, 21 bp, Homo sapiens
ggtcctgctgcagttgccagt

SEQ ID NO: 2232810 - DNA, 13 bp, Homo sapiens
ggtcgaggcagga

SEQ ID NO: 2232811 - DNA, 14 bp, Homo sapiens
ggtcggaaaacatg

SEQ ID NO: 2232812 - DNA, 22 bp, Homo sapiens
ggtctcactctgtcgcccagtc

SEQ ID NO: 2232813 - DNA, 12 bp, Homo sapiens
ggtctgttcttt

SEQ ID NO: 2232814 - DNA, 16 bp, Homo sapiens
ggtgaacttggttccc

SEQ ID NO: 2232815 - DNA, 18 bp, Homo sapiens
ggtgaagtgaagacaatg

SEQ ID NO: 2232816 - DNA, 21 bp, Homo sapiens
ggtgagcactctggggtggga

SEQ ID NO: 2232817 - DNA, 13 bp, Homo sapiens
ggtgcaatgacct

SEQ ID NO: 2232818 - DNA, 20 bp, Homo sapiens
ggtgcaatgacctttcaata

SEQ ID NO: 2232819 - DNA, 16 bp, Homo sapiens
ggtgcacaagctccaa

SEQ ID NO: 2232820 - DNA, 16 bp, Homo sapiens
ggtgctatctccccca

SEQ ID NO: 2232821 - DNA, 20 bp, Homo sapiens
ggtgctatctcccccagccc

SEQ ID NO: 2232822 - DNA, 18 bp, Homo sapiens
ggtggaatgcgggggagc

SEQ ID NO: 2232823 - DNA, 19 bp, Homo sapiens
ggtggaatgcgggggagca

SEQ ID NO: 2232824 - DNA, 20 bp, Homo sapiens
ggtggaatgcgggggagcag

SEQ ID NO: 2232825 - DNA, 21 bp, Homo sapiens
ggtggaatgcgggggagcagg

SEQ ID NO: 2232826 - DNA, 22 bp, Homo sapiens
ggtggaatgcgggggagcaggc

SEQ ID NO: 2232827 - DNA, 20 bp, Homo sapiens
ggtggcaccagcagcctgga

SEQ ID NO: 2232828 - DNA, 12 bp, Homo sapiens
ggtggcagctgc

SEQ ID NO: 2232829 - DNA, 15 bp, Homo sapiens
ggtggcagctgcggt

SEQ ID NO: 2232830 - DNA, 23 bp, Homo sapiens
ggtggcagctgcggtccacccag

SEQ ID NO: 2232831 - DNA, 18 bp, Homo sapiens
ggtggctgggttggaggg

SEQ ID NO: 2232832 - DNA, 16 bp, Homo sapiens
ggtgggaggggaagaa

SEQ ID NO: 2232833 - DNA, 19 bp, Homo sapiens
ggtgggatcctccaggtgc

SEQ ID NO: 2232834 - DNA, 19 bp, Homo sapiens
ggtggggacctcaggcctg

SEQ ID NO: 2232835 - DNA, 15 bp, Homo sapiens
ggtggggcctggggt

SEQ ID NO: 2232836 - DNA, 15 bp, Homo sapiens
ggtggggtcactctg

SEQ ID NO: 2232837 - DNA, 15 bp, Homo sapiens
ggtggtgacctctgc

SEQ ID NO: 2232838 - DNA, 15 bp, Homo sapiens
ggtggttttctgttc

SEQ ID NO: 2232839 - DNA, 18 bp, Homo sapiens
ggtgtgagtcaccaagcc

SEQ ID NO: 2232840 - DNA, 23 bp, Homo sapiens
ggtgtggagaagcggctggcagc

SEQ ID NO: 2232841 - DNA, 17 bp, Homo sapiens
ggtgtttcctggcactg

SEQ ID NO: 2232842 - DNA, 21 bp, Homo sapiens
ggttacccagttagctctcaa

SEQ ID NO: 2232843 - DNA, 13 bp, Homo sapiens
ggttatggagagg

SEQ ID NO: 2232844 - DNA, 12 bp, Homo sapiens
ggttcagcttgt

SEQ ID NO: 2232845 - DNA, 18 bp, Homo sapiens
ggttcagggttggcccct

SEQ ID NO: 2232846 - DNA, 17 bp, Homo sapiens
ggttcccatttgctcct

SEQ ID NO: 2232847 - DNA, 21 bp, Homo sapiens
ggttccctttgacgccatccc

SEQ ID NO: 2232848 - DNA, 23 bp, Homo sapiens
ggttccctttgacgccatcccag

SEQ ID NO: 2232849 - DNA, 18 bp, Homo sapiens
ggttggcaaaaaggcagg

SEQ ID NO: 2232850 - DNA, 21 bp, Homo sapiens
ggttggcccctgcccggctgc

SEQ ID NO: 2232851 - DNA, 13 bp, Homo sapiens
ggttggtgggggc

SEQ ID NO: 2232852 - DNA, 23 bp, Homo sapiens
ggtttaaaaatccccaaaaaagc

SEQ ID NO: 2232853 - DNA, 12 bp, Homo sapiens
ggtttcagaaat

SEQ ID NO: 2232854 - DNA, 22 bp, Homo sapiens
ggtttctaaagctgccagccga

SEQ ID NO: 2232855 - DNA, 15 bp, Homo sapiens
ggttttctgttcttt

SEQ ID NO: 2232856 - DNA, 15 bp, Homo sapiens
gtaaattaactttta

SEQ ID NO: 2232857 - DNA, 22 bp, Homo sapiens
gtaaattaacttttataaactt

SEQ ID NO: 2232858 - DNA, 23 bp, Homo sapiens
gtaaattaacttttataaacttt

SEQ ID NO: 2232859 - DNA, 20 bp, Homo sapiens
gtaacaggaaaattttaaaa

SEQ ID NO: 2232860 - DNA, 12 bp, Homo sapiens
gtaacaggcaga

SEQ ID NO: 2232861 - DNA, 16 bp, Homo sapiens
gtaatatgcacacatt

SEQ ID NO: 2232862 - DNA, 17 bp, Homo sapiens
gtaattaagtactatgt

SEQ ID NO: 2232863 - DNA, 20 bp, Homo sapiens
gtaattaagtactatgtatc

SEQ ID NO: 2232864 - DNA, 20 bp, Homo sapiens
gtaatttgtgatacaatgct

SEQ ID NO: 2232865 - DNA, 16 bp, Homo sapiens
gtacacacacatacac

SEQ ID NO: 2232866 - DNA, 20 bp, Homo sapiens
gtacactgtttcaaacttta

SEQ ID NO: 2232867 - DNA, 18 bp, Homo sapiens
gtacagagcccacgcccc

SEQ ID NO: 2232868 - DNA, 16 bp, Homo sapiens
gtacatgaaaacacat

SEQ ID NO: 2232869 - DNA, 17 bp, Homo sapiens
gtacatgaaaacacatt

SEQ ID NO: 2232870 - DNA, 18 bp, Homo sapiens
gtacatgaaaacacattt

SEQ ID NO: 2232871 - DNA, 14 bp, Homo sapiens
gtacccactgctct

SEQ ID NO: 2232872 - DNA, 21 bp, Homo sapiens
ggcccaagagagacagcacag

SEQ ID NO: 2232873 - DNA, 11 bp, Homo sapiens
ggcccagagag

SEQ ID NO: 2232874 - DNA, 14 bp, Homo sapiens
ggcccagtgccccc

SEQ ID NO: 2232875 - DNA, 16 bp, Homo sapiens
ggcccagtgccccctg

SEQ ID NO: 2232876 - DNA, 15 bp, Homo sapiens
ggccccacgtccctg

SEQ ID NO: 2232877 - DNA, 18 bp, Homo sapiens
ggcccctgccaccctggg

SEQ ID NO: 2232878 - DNA, 13 bp, Homo sapiens
ggcccctgcccgg

SEQ ID NO: 2232879 - DNA, 14 bp, Homo sapiens
ggcccctgctggtt

SEQ ID NO: 2232880 - DNA, 15 bp, Homo sapiens
ggcccggctccaggc

SEQ ID NO: 2232881 - DNA, 21 bp, Homo sapiens
ggccctctgcccactccctgc

SEQ ID NO: 2232882 - DNA, 15 bp, Homo sapiens
ggccctgcctccttt

SEQ ID NO: 2232883 - DNA, 14 bp, Homo sapiens
ggcccttccttttc

SEQ ID NO: 2232884 - DNA, 16 bp, Homo sapiens
ggcccttctctccagc

SEQ ID NO: 2232885 - DNA, 21 bp, Homo sapiens
ggcccttctctccagcccctg

SEQ ID NO: 2232886 - DNA, 14 bp, Homo sapiens
ggcctcaagtgatt

SEQ ID NO: 2232887 - DNA, 17 bp, Homo sapiens
ggcctcccaactcaccc

SEQ ID NO: 2232888 - DNA, 18 bp, Homo sapiens
ggcctcccaactcacccc

SEQ ID NO: 2232889 - DNA, 23 bp, Homo sapiens
ggcctcccaactcaccccagccc

SEQ ID NO: 2232890 - DNA, 15 bp, Homo sapiens
ggcctctgcactccc

SEQ ID NO: 2232891 - DNA, 16 bp, Homo sapiens
ggcctctgcactcccc

SEQ ID NO: 2232892 - DNA, 18 bp, Homo sapiens
ggcctcttatgggctggg

SEQ ID NO: 2232893 - DNA, 12 bp, Homo sapiens
ggcctgagctgg

SEQ ID NO: 2232894 - DNA, 15 bp, Homo sapiens
ggcctgagctgggat

SEQ ID NO: 2232895 - DNA, 16 bp, Homo sapiens
ggcctggccagatgca

SEQ ID NO: 2232896 - DNA, 21 bp, Homo sapiens
ggcctggccagatgcaccagc

SEQ ID NO: 2232897 - DNA, 17 bp, Homo sapiens
ggcctggcccctcaggg

SEQ ID NO: 2232898 - DNA, 16 bp, Homo sapiens
ggcctggcctgagctg

SEQ ID NO: 2232899 - DNA, 23 bp, Homo sapiens
ggcctgggggctgggcagaggaa

SEQ ID NO: 2232900 - DNA, 21 bp, Homo sapiens
ggcctgtgtctagttgtttga

SEQ ID NO: 2232901 - DNA, 16 bp, Homo sapiens
ggccttctctgaagga

SEQ ID NO: 2232902 - DNA, 19 bp, Homo sapiens
ggcgctgcccctggcagcc

SEQ ID NO: 2232903 - DNA, 14 bp, Homo sapiens
ggcgtgcagtggtg

SEQ ID NO: 2232904 - DNA, 18 bp, Homo sapiens
ggctaaaaagaatgcaga

SEQ ID NO: 2232905 - DNA, 21 bp, Homo sapiens
ggctaaaaagaatgcagagat

SEQ ID NO: 2232906 - DNA, 20 bp, Homo sapiens
ggctaagtgatcctcccacc

SEQ ID NO: 2232907 - DNA, 14 bp, Homo sapiens
ggctacctttgtat

SEQ ID NO: 2232908 - DNA, 16 bp, Homo sapiens
ggctaggacccctcca

SEQ ID NO: 2232909 - DNA, 16 bp, Homo sapiens
ggctagttgggcttcc

SEQ ID NO: 2232910 - DNA, 14 bp, Homo sapiens
ggctatgcatttga

SEQ ID NO: 2232911 - DNA, 18 bp, Homo sapiens
ggctcagcggggacagct

SEQ ID NO: 2232912 - DNA, 19 bp, Homo sapiens
ggctcagcggggacagctc

SEQ ID NO: 2232913 - DNA, 20 bp, Homo sapiens
ggctcagcggggacagctcc

SEQ ID NO: 2232914 - DNA, 21 bp, Homo sapiens
ggctcagcggggacagctcct

SEQ ID NO: 2232915 - DNA, 20 bp, Homo sapiens
ggctcaggtggggtcactct

SEQ ID NO: 2232916 - DNA, 13 bp, Homo sapiens
ggctccaggagca

SEQ ID NO: 2232917 - DNA, 18 bp, Homo sapiens
ggctccaggagcagccac

SEQ ID NO: 2232918 - DNA, 13 bp, Homo sapiens
ggctccaggctcc

SEQ ID NO: 2232919 - DNA, 17 bp, Homo sapiens
ggctcccttcccacctc

SEQ ID NO: 2232920 - DNA, 18 bp, Homo sapiens
ggctcgagcatgcctgga

SEQ ID NO: 2232921 - DNA, 13 bp, Homo sapiens
ggctctcaggcca

SEQ ID NO: 2232922 - DNA, 19 bp, Homo sapiens
ggctctcaggccagctgct

SEQ ID NO: 2232923 - DNA, 20 bp, Homo sapiens
ggctctcaggccagctgctt

SEQ ID NO: 2232924 - DNA, 12 bp, Homo sapiens
ggctctgccctt

SEQ ID NO: 2232925 - DNA, 14 bp, Homo sapiens
ggctctgcccttgg

SEQ ID NO: 2232926 - DNA, 15 bp, Homo sapiens
ggctctgcccttggt

SEQ ID NO: 2232927 - DNA, 13 bp, Homo sapiens
ggctctgcctccc

SEQ ID NO: 2232928 - DNA, 18 bp, Homo sapiens
ggctgcaccggctggcct

SEQ ID NO: 2232929 - DNA, 12 bp, Homo sapiens
ggctgcagggag

SEQ ID NO: 2232930 - DNA, 21 bp, Homo sapiens
ggctgccaatgggagctcatg

SEQ ID NO: 2232931 - DNA, 11 bp, Homo sapiens
ggctgcttcaa

SEQ ID NO: 2232932 - DNA, 14 bp, Homo sapiens
ggctgcttcaagga

SEQ ID NO: 2232933 - DNA, 15 bp, Homo sapiens
ggctgcttcaaggat

SEQ ID NO: 2232934 - DNA, 15 bp, Homo sapiens
ggctggaagcagaaa

SEQ ID NO: 2232935 - DNA, 20 bp, Homo sapiens
ggctggcgtgcagtggtgcg

SEQ ID NO: 2232936 - DNA, 18 bp, Homo sapiens
ggctgggctcccttccca

SEQ ID NO: 2232937 - DNA, 11 bp, Homo sapiens
ggctgggcttc

SEQ ID NO: 2232938 - DNA, 12 bp, Homo sapiens
ggctgggcttca

SEQ ID NO: 2232939 - DNA, 13 bp, Homo sapiens
ggctgggcttcag

SEQ ID NO: 2232940 - DNA, 17 bp, Homo sapiens
ggctgggcttcagtggc

SEQ ID NO: 2232941 - DNA, 18 bp, Homo sapiens
ggctgggcttcagtggca

SEQ ID NO: 2232942 - DNA, 16 bp, Homo sapiens
ggctgggggaagaagc

SEQ ID NO: 2232943 - DNA, 19 bp, Homo sapiens
ggctgggggcctcagtgcc

SEQ ID NO: 2232944 - DNA, 14 bp, Homo sapiens
ggctgggttggagg

SEQ ID NO: 2232945 - DNA, 19 bp, Homo sapiens
ggctgtatcccatgagcct

SEQ ID NO: 2232946 - DNA, 14 bp, Homo sapiens
ggctgttggctggg

SEQ ID NO: 2232947 - DNA, 20 bp, Homo sapiens
ggctgttggctgggggcctc

SEQ ID NO: 2232948 - DNA, 15 bp, Homo sapiens
ggcttcagtggcagc

SEQ ID NO: 2232949 - DNA, 18 bp, Homo sapiens
ggcttcagtggcagctgc

SEQ ID NO: 2232950 - DNA, 18 bp, Homo sapiens
ggcttcatcctcctcaga

SEQ ID NO: 2232951 - DNA, 16 bp, Homo sapiens
ggcttcctcatagtat

SEQ ID NO: 2232952 - DNA, 17 bp, Homo sapiens
ggcttggggaccagagc

SEQ ID NO: 2232953 - DNA, 10 bp, Homo sapiens
ggcttttgtg

SEQ ID NO: 2232954 - DNA, 14 bp, Homo sapiens
gggaacagactgga

SEQ ID NO: 2232955 - DNA, 22 bp, Homo sapiens
gggaacagactggaagcacagc

SEQ ID NO: 2232956 - DNA, 13 bp, Homo sapiens
gggaagagacttg

SEQ ID NO: 2232957 - DNA, 14 bp, Homo sapiens
gggacaccctgtga

SEQ ID NO: 2232958 - DNA, 14 bp, Homo sapiens
gggaccagagctgc

SEQ ID NO: 2232959 - DNA, 20 bp, Homo sapiens
gggaccagagctgccacctg

SEQ ID NO: 2232960 - DNA, 15 bp, Homo sapiens
gggacctcaggcctg

SEQ ID NO: 2232961 - DNA, 23 bp, Homo sapiens
gggactcaatgcactgacattgt

SEQ ID NO: 2232962 - DNA, 21 bp, Homo sapiens
gggagaaccaaaaagaggcta

SEQ ID NO: 2232963 - DNA, 12 bp, Homo sapiens
gggagcaggcag

SEQ ID NO: 2232964 - DNA, 13 bp, Homo sapiens
gggagcaggcagt

SEQ ID NO: 2232965 - DNA, 17 bp, Homo sapiens
gggagcaggcagtgggg

SEQ ID NO: 2232966 - DNA, 23 bp, Homo sapiens
gggagcaggctcgggctccccag

SEQ ID NO: 2232967 - DNA, 23 bp, Homo sapiens
gggaggattgcttgagctcagga

SEQ ID NO: 2232968 - DNA, 15 bp, Homo sapiens
gggagggagggctcc

SEQ ID NO: 2232969 - DNA, 11 bp, Homo sapiens
gggagggctcc

SEQ ID NO: 2232970 - DNA, 13 bp, Homo sapiens
gggagggctccag

SEQ ID NO: 2232971 - DNA, 16 bp, Homo sapiens
gggagggtctgcaggg

SEQ ID NO: 2232972 - DNA, 18 bp, Homo sapiens
gggaggtcaaggctgcag

SEQ ID NO: 2232973 - DNA, 18 bp, Homo sapiens
gggagtgacagaggcagc

SEQ ID NO: 2232974 - DNA, 14 bp, Homo sapiens
gggagtgagctggt

SEQ ID NO: 2232975 - DNA, 15 bp, Homo sapiens
gggagtggccacaga

SEQ ID NO: 2232976 - DNA, 21 bp, Homo sapiens
gggatcccccgccccatcctc

SEQ ID NO: 2232977 - DNA, 15 bp, Homo sapiens
gggatcctccaggtg

SEQ ID NO: 2232978 - DNA, 16 bp, Homo sapiens
gggcaacccccagcct

SEQ ID NO: 2232979 - DNA, 18 bp, Homo sapiens
gggcaaccctggtgacca

SEQ ID NO: 2232980 - DNA, 23 bp, Homo sapiens
gggcacaccgggcactcagaaga

SEQ ID NO: 2232981 - DNA, 18 bp, Homo sapiens
gggcacagaaaatggaag

SEQ ID NO: 2232982 - DNA, 20 bp, Homo sapiens
gggcacagaaaatggaagac

SEQ ID NO: 2232983 - DNA, 23 bp, Homo sapiens
gggcacccccggcccagtgcccc

SEQ ID NO: 2232984 - DNA, 20 bp, Homo sapiens
gggcactcagaagacactga

SEQ ID NO: 2232985 - DNA, 18 bp, Homo sapiens
gggcagaaggaagacttc

SEQ ID NO: 2232986 - DNA, 16 bp, Homo sapiens
gggcagagcagagacc

SEQ ID NO: 2232987 - DNA, 16 bp, Homo sapiens
gggcagcagagagaga

SEQ ID NO: 2232988 - DNA, 12 bp, Homo sapiens
gggccaggagcc

SEQ ID NO: 2232989 - DNA, 13 bp, Homo sapiens
gggccaggagcct

SEQ ID NO: 2232990 - DNA, 22 bp, Homo sapiens
gggccagttggtcccccttcca

SEQ ID NO: 2232991 - DNA, 17 bp, Homo sapiens
gggcccagagagggtgg

SEQ ID NO: 2232992 - DNA, 14 bp, Homo sapiens
gggccccacgtccc

SEQ ID NO: 2232993 - DNA, 13 bp, Homo sapiens
gggccctgcctcc

SEQ ID NO: 2232994 - DNA, 14 bp, Homo sapiens
gggcctcagtgcca

SEQ ID NO: 2232995 - DNA, 15 bp, Homo sapiens
gggcctcagtgccac

SEQ ID NO: 2232996 - DNA, 13 bp, Homo sapiens
gggcctcctgtgt

SEQ ID NO: 2232997 - DNA, 15 bp, Homo sapiens
gggcctcctgtgtgt

SEQ ID NO: 2232998 - DNA, 20 bp, Homo sapiens
gggcctcttatgggctgggt

SEQ ID NO: 2232999 - DNA, 12 bp, Homo sapiens
gggcctggcctg

SEQ ID NO: 2233000 - DNA, 13 bp, Homo sapiens
gggcctggctccc

SEQ ID NO: 2233001 - DNA, 21 bp, Homo sapiens
gcacccccggcccagtgcccc

SEQ ID NO: 2233002 - DNA, 16 bp, Homo sapiens
gcaccctcaggcaggt

SEQ ID NO: 2233003 - DNA, 14 bp, Homo sapiens
gcacctaggtgggg

SEQ ID NO: 2233004 - DNA, 24 bp, Homo sapiens
gcacctaggtggggcctggggtag

SEQ ID NO: 2233005 - DNA, 14 bp, Homo sapiens
gcacctcctgcctc

SEQ ID NO: 2233006 - DNA, 19 bp, Homo sapiens
gcaccttagacagtccctg

SEQ ID NO: 2233007 - DNA, 20 bp, Homo sapiens
gcaccttagacagtccctgc

SEQ ID NO: 2233008 - DNA, 15 bp, Homo sapiens
gcacgatttctgttt

SEQ ID NO: 2233009 - DNA, 14 bp, Homo sapiens
gcacgtgtgtgcac

SEQ ID NO: 2233010 - DNA, 19 bp, Homo sapiens
gcactaaggtgtgctctga

SEQ ID NO: 2233011 - DNA, 20 bp, Homo sapiens
gcactcagaagacactgatg

SEQ ID NO: 2233012 - DNA, 15 bp, Homo sapiens
gcactccagcctggg

SEQ ID NO: 2233013 - DNA, 12 bp, Homo sapiens
gcactcccctgc

SEQ ID NO: 2233014 - DNA, 17 bp, Homo sapiens
gcactcccctgctgggt

SEQ ID NO: 2233015 - DNA, 22 bp, Homo sapiens
gcactcccctgctgggtgtggc

SEQ ID NO: 2233016 - DNA, 21 bp, Homo sapiens
gcactctggggtgggagggtc

SEQ ID NO: 2233017 - DNA, 12 bp, Homo sapiens
gcactgacattg

SEQ ID NO: 2233018 - DNA, 12 bp, Homo sapiens
gcactgcttcca

SEQ ID NO: 2233019 - DNA, 13 bp, Homo sapiens
gcactgcttccag

SEQ ID NO: 2233020 - DNA, 23 bp, Homo sapiens
gcactgcttccagtgaggctctg

SEQ ID NO: 2233021 - DNA, 18 bp, Homo sapiens
gcactttgttctggctct

SEQ ID NO: 2233022 - DNA, 19 bp, Homo sapiens
gcactttgttctggctctt

SEQ ID NO: 2233023 - DNA, 22 bp, Homo sapiens
gcactttgttctggctcttcca

SEQ ID NO: 2233024 - DNA, 21 bp, Homo sapiens
gcagaaacaaaatgaaaaaaa

SEQ ID NO: 2233025 - DNA, 12 bp, Homo sapiens
gcagacaggacc

SEQ ID NO: 2233026 - DNA, 14 bp, Homo sapiens
gcagacaggcaagc

SEQ ID NO: 2233027 - DNA, 17 bp, Homo sapiens
gcagactctacagaggc

SEQ ID NO: 2233028 - DNA, 23 bp, Homo sapiens
gcagagaatgaaagggcccagag

SEQ ID NO: 2233029 - DNA, 21 bp, Homo sapiens
gcagagaattctcttatccaa

SEQ ID NO: 2233030 - DNA, 14 bp, Homo sapiens
gcagagaccatccc

SEQ ID NO: 2233031 - DNA, 21 bp, Homo sapiens
gcagagaccatccctgaaggc

SEQ ID NO: 2233032 - DNA, 21 bp, Homo sapiens
gcagagagagagagagagaaa

SEQ ID NO: 2233033 - DNA, 16 bp, Homo sapiens
gcagagatgtgccccc

SEQ ID NO: 2233034 - DNA, 21 bp, Homo sapiens
gcagagatgtgcccccacccc

SEQ ID NO: 2233035 - DNA, 22 bp, Homo sapiens
gcagagatgtgcccccaccccc

SEQ ID NO: 2233036 - DNA, 19 bp, Homo sapiens
gcagagcaccttagacagt

SEQ ID NO: 2233037 - DNA, 22 bp, Homo sapiens
gcagagcaccttagacagtccc

SEQ ID NO: 2233038 - DNA, 23 bp, Homo sapiens
gcagagcaccttagacagtccct

SEQ ID NO: 2233039 - DNA, 14 bp, Homo sapiens
gcagagcagagacc

SEQ ID NO: 2233040 - DNA, 14 bp, Homo sapiens
gcagaggaaagcaa

SEQ ID NO: 2233041 - DNA, 15 bp, Homo sapiens
gcagagttgaagaca

SEQ ID NO: 2233042 - DNA, 12 bp, Homo sapiens
gcagcaataaag

SEQ ID NO: 2233043 - DNA, 11 bp, Homo sapiens
gcagcagagag

SEQ ID NO: 2233044 - DNA, 12 bp, Homo sapiens
gcagcagagaga

SEQ ID NO: 2233045 - DNA, 13 bp, Homo sapiens
gcagcagagagag

SEQ ID NO: 2233046 - DNA, 16 bp, Homo sapiens
gcagccacattcctga

SEQ ID NO: 2233047 - DNA, 20 bp, Homo sapiens
gcagcctcaacctcctgggc

SEQ ID NO: 2233048 - DNA, 17 bp, Homo sapiens
gcagcctcacagtcctt

SEQ ID NO: 2233049 - DNA, 15 bp, Homo sapiens
gcagccttggcaaac

SEQ ID NO: 2233050 - DNA, 14 bp, Homo sapiens
gcagctcacctctc

SEQ ID NO: 2233051 - DNA, 21 bp, Homo sapiens
gcagctcacctctcccttgga

SEQ ID NO: 2233052 - DNA, 14 bp, Homo sapiens
gcagctcagagagg

SEQ ID NO: 2233053 - DNA, 20 bp, Homo sapiens
gcaggattcttcctccctcc

SEQ ID NO: 2233054 - DNA, 23 bp, Homo sapiens
gcaggcagtggggctggaagcag

SEQ ID NO: 2233055 - DNA, 22 bp, Homo sapiens
gcaggctcgggctccccagccc

SEQ ID NO: 2233056 - DNA, 16 bp, Homo sapiens
gcaggctctcaggcca

SEQ ID NO: 2233057 - DNA, 13 bp, Homo sapiens
gcagggaaacagc

SEQ ID NO: 2233058 - DNA, 14 bp, Homo sapiens
gcagggctcagcgg

SEQ ID NO: 2233059 - DNA, 15 bp, Homo sapiens
gcagtgggagctgcc

SEQ ID NO: 2233060 - DNA, 17 bp, Homo sapiens
gcagtgggagctgcctg

SEQ ID NO: 2233061 - DNA, 18 bp, Homo sapiens
gcagtgggagctgcctgt

SEQ ID NO: 2233062 - DNA, 22 bp, Homo sapiens
gcagtggggctggaagcagaaa

SEQ ID NO: 2233063 - DNA, 18 bp, Homo sapiens
gcagtggtgcgatctggg

SEQ ID NO: 2233064 - DNA, 19 bp, Homo sapiens
gcagtggtggttttctgtt

SEQ ID NO: 2233065 - DNA, 23 bp, Homo sapiens
gcagttgccagtcaccccggcca

SEQ ID NO: 2233066 - DNA, 15 bp, Homo sapiens
gcataccacttttgt

SEQ ID NO: 2233067 - DNA, 16 bp, Homo sapiens
gcataccacttttgtt

SEQ ID NO: 2233068 - DNA, 14 bp, Homo sapiens
gcatacgtacacat

SEQ ID NO: 2233069 - DNA, 19 bp, Homo sapiens
gcatacgtacacattttat

SEQ ID NO: 2233070 - DNA, 17 bp, Homo sapiens
gcatcaggccaggccct

SEQ ID NO: 2233071 - DNA, 18 bp, Homo sapiens
gcatcaggccaggccctc

SEQ ID NO: 2233072 - DNA, 23 bp, Homo sapiens
gcatcaggccaggccctctgccc

SEQ ID NO: 2233073 - DNA, 13 bp, Homo sapiens
gcatcctggcacc

SEQ ID NO: 2233074 - DNA, 17 bp, Homo sapiens
gcatcctggcacccggc

SEQ ID NO: 2233075 - DNA, 23 bp, Homo sapiens
gcatcctggcacccggcccctgc

SEQ ID NO: 2233076 - DNA, 22 bp, Homo sapiens
gcatgaagtaatatgcacacat

SEQ ID NO: 2233077 - DNA, 15 bp, Homo sapiens
gcatgcctggatggg

SEQ ID NO: 2233078 - DNA, 22 bp, Homo sapiens
gcatgcctggatggggctgcac

SEQ ID NO: 2233079 - DNA, 13 bp, Homo sapiens
gcatgggaatgaa

SEQ ID NO: 2233080 - DNA, 22 bp, Homo sapiens
gcatgttctctgaggacactaa

SEQ ID NO: 2233081 - DNA, 17 bp, Homo sapiens
gcattatctagatactg

SEQ ID NO: 2233082 - DNA, 18 bp, Homo sapiens
gcattccccaggaggcca

SEQ ID NO: 2233083 - DNA, 21 bp, Homo sapiens
gcattccccaggaggccagcc

SEQ ID NO: 2233084 - DNA, 16 bp, Homo sapiens
gcatttaaaagataca

SEQ ID NO: 2233085 - DNA, 18 bp, Homo sapiens
gcatttactttgtgttca

SEQ ID NO: 2233086 - DNA, 19 bp, Homo sapiens
gcatttgaggtctgttctt

SEQ ID NO: 2233087 - DNA, 21 bp, Homo sapiens
gcatttgaggtctgttctttc

SEQ ID NO: 2233088 - DNA, 17 bp, Homo sapiens
gcatttgctgaatacag

SEQ ID NO: 2233089 - DNA, 23 bp, Homo sapiens
gcatttgctgaatacagaggcaa

SEQ ID NO: 2233090 - DNA, 22 bp, Homo sapiens
gcattttgctaaatgtgaatga

SEQ ID NO: 2233091 - DNA, 19 bp, Homo sapiens
gccaaactcacctgcccct

SEQ ID NO: 2233092 - DNA, 14 bp, Homo sapiens
gccaaaggaagcac

SEQ ID NO: 2233093 - DNA, 19 bp, Homo sapiens
gccaaggccaaaggaagca

SEQ ID NO: 2233094 - DNA, 24 bp, Homo sapiens
gccaaggccaaaggaagcacatgc

SEQ ID NO: 2233095 - DNA, 14 bp, Homo sapiens
gccaaggtgggagg

SEQ ID NO: 2233096 - DNA, 13 bp, Homo sapiens
gccacagggtgag

SEQ ID NO: 2233097 - DNA, 20 bp, Homo sapiens
gccaccaacatactcccatc

SEQ ID NO: 2233098 - DNA, 13 bp, Homo sapiens
gccaccctgggga

SEQ ID NO: 2233099 - DNA, 16 bp, Homo sapiens
gccacggccaggccag

SEQ ID NO: 2233100 - DNA, 20 bp, Homo sapiens
gccactattgttagtctctt

SEQ ID NO: 2233101 - DNA, 21 bp, Homo sapiens
gccactattgttagtctcttg

SEQ ID NO: 2233102 - DNA, 20 bp, Homo sapiens
gccactgcaccgggccacag

SEQ ID NO: 2233103 - DNA, 18 bp, Homo sapiens
gccactgtgaagagaacc

SEQ ID NO: 2233104 - DNA, 12 bp, Homo sapiens
gccagagacaca

SEQ ID NO: 2233105 - DNA, 10 bp, Homo sapiens
gccagaggag

SEQ ID NO: 2233106 - DNA, 19 bp, Homo sapiens
gccagaggagagaggaccc

SEQ ID NO: 2233107 - DNA, 17 bp, Homo sapiens
gccagagggagtgacag

SEQ ID NO: 2233108 - DNA, 19 bp, Homo sapiens
gccagagggagtgacagag

SEQ ID NO: 2233109 - DNA, 22 bp, Homo sapiens
gccagagggagtgacagaggca

SEQ ID NO: 2233110 - DNA, 23 bp, Homo sapiens
gccagagggagtgacagaggcag

SEQ ID NO: 2233111 - DNA, 18 bp, Homo sapiens
gccagatgcaccagccct

SEQ ID NO: 2233112 - DNA, 16 bp, Homo sapiens
gccagattctttcctg

SEQ ID NO: 2233113 - DNA, 20 bp, Homo sapiens
gccagattctttcctgaggc

SEQ ID NO: 2233114 - DNA, 16 bp, Homo sapiens
gccagatttcactctc

SEQ ID NO: 2233115 - DNA, 18 bp, Homo sapiens
gccagatttcactctcct

SEQ ID NO: 2233116 - DNA, 21 bp, Homo sapiens
gccagatttcactctccttgg

SEQ ID NO: 2233117 - DNA, 20 bp, Homo sapiens
gccagccgagatagccaagg

SEQ ID NO: 2233118 - DNA, 21 bp, Homo sapiens
gccagccgagatagccaaggc

SEQ ID NO: 2233119 - DNA, 20 bp, Homo sapiens
gccagccttgaccattctcc

SEQ ID NO: 2233120 - DNA, 17 bp, Homo sapiens
gccagctgcttgggctt

SEQ ID NO: 2233121 - DNA, 19 bp, Homo sapiens
gctcaggtgtccctgcact

SEQ ID NO: 2233122 - DNA, 14 bp, Homo sapiens
gctccaagctccca

SEQ ID NO: 2233123 - DNA, 15 bp, Homo sapiens
gctccaagctcccag

SEQ ID NO: 2233124 - DNA, 9 bp, Homo sapiens
gctccagac

SEQ ID NO: 2233125 - DNA, 21 bp, Homo sapiens
gctccagacacatgtccaaga

SEQ ID NO: 2233126 - DNA, 17 bp, Homo sapiens
gctccagctcaccagcc

SEQ ID NO: 2233127 - DNA, 14 bp, Homo sapiens
gcttgtacataatg

SEQ ID NO: 2233128 - DNA, 16 bp, Homo sapiens
gcttgtacataatgcg

SEQ ID NO: 2233129 - DNA, 19 bp, Homo sapiens
gcttgtacataatgcgtgc

SEQ ID NO: 2233130 - DNA, 13 bp, Homo sapiens
gctttctacccag

SEQ ID NO: 2233131 - DNA, 19 bp, Homo sapiens
gctttctacccagcgagcc

SEQ ID NO: 2233132 - DNA, 14 bp, Homo sapiens
gctttgatcccttc

SEQ ID NO: 2233133 - DNA, 17 bp, Homo sapiens
gctttgatcccttctta

SEQ ID NO: 2233134 - DNA, 15 bp, Homo sapiens
gcttttggtctgtgt

SEQ ID NO: 2233135 - DNA, 15 bp, Homo sapiens
gctttttaatattga

SEQ ID NO: 2233136 - DNA, 13 bp, Homo sapiens
ggaaaaatagcct

SEQ ID NO: 2233137 - DNA, 15 bp, Homo sapiens
ggaaaaatagcctgc

SEQ ID NO: 2233138 - DNA, 18 bp, Homo sapiens
ggaaaacatgctacacac

SEQ ID NO: 2233139 - DNA, 18 bp, Homo sapiens
ggaaaattttaaaaatac

SEQ ID NO: 2233140 - DNA, 19 bp, Homo sapiens
ggaaaggctccaggagcag

SEQ ID NO: 2233141 - DNA, 16 bp, Homo sapiens
gagtcgaggacaggga

SEQ ID NO: 2233142 - DNA, 23 bp, Homo sapiens
gagtctcactgttgcccaggctg

SEQ ID NO: 2233143 - DNA, 14 bp, Homo sapiens
gagtctgaaggctg

SEQ ID NO: 2233144 - DNA, 18 bp, Homo sapiens
gagtgagactctgtctca

SEQ ID NO: 2233145 - DNA, 12 bp, Homo sapiens
gagtgagctggt

SEQ ID NO: 2233146 - DNA, 13 bp, Homo sapiens
gagtgcagtgagc

SEQ ID NO: 2233147 - DNA, 18 bp, Homo sapiens
gagtgcagtgagccgaga

SEQ ID NO: 2233148 - DNA, 18 bp, Homo sapiens
gagtgccttacacaatgg

SEQ ID NO: 2233149 - DNA, 20 bp, Homo sapiens
gagtgtgcctgaagtcccag

SEQ ID NO: 2233150 - DNA, 13 bp, Homo sapiens
gagttctggttcc

SEQ ID NO: 2233151 - DNA, 15 bp, Homo sapiens
gagttgaagacagag

SEQ ID NO: 2233152 - DNA, 17 bp, Homo sapiens
gagttgaagacagagct

SEQ ID NO: 2233153 - DNA, 21 bp, Homo sapiens
gagttgaagacagagctacac

SEQ ID NO: 2233154 - DNA, 19 bp, Homo sapiens
gagttgatactacagtttg

SEQ ID NO: 2233155 - DNA, 21 bp, Homo sapiens
gagttgatagcacagaccctg

SEQ ID NO: 2233156 - DNA, 17 bp, Homo sapiens
gagttgattcagctctg

SEQ ID NO: 2233157 - DNA, 18 bp, Homo sapiens
gagttgattcagctctgc

SEQ ID NO: 2233158 - DNA, 14 bp, Homo sapiens
gataatacaccact

SEQ ID NO: 2233159 - DNA, 18 bp, Homo sapiens
gataatacaccactacat

SEQ ID NO: 2233160 - DNA, 24 bp, Homo sapiens
gataatacaccactacattctgtt

SEQ ID NO: 2233161 - DNA, 21 bp, Homo sapiens
gatacaggaaaagctgctgac

SEQ ID NO: 2233162 - DNA, 16 bp, Homo sapiens
gatacagttactcaga

SEQ ID NO: 2233163 - DNA, 21 bp, Homo sapiens
gatactgtatcatgacaaaga

SEQ ID NO: 2233164 - DNA, 22 bp, Homo sapiens
gatagcacagaccctgccctgt

SEQ ID NO: 2233165 - DNA, 18 bp, Homo sapiens
gatatatgctctgcatgt

SEQ ID NO: 2233166 - DNA, 23 bp, Homo sapiens
gatatatgctctgcatgttacat

SEQ ID NO: 2233167 - DNA, 15 bp, Homo sapiens
gatatttttttcttt

SEQ ID NO: 2233168 - DNA, 17 bp, Homo sapiens
gatatttttttcttttc

SEQ ID NO: 2233169 - DNA, 20 bp, Homo sapiens
gatcaaaaggttaataaagt

SEQ ID NO: 2233170 - DNA, 23 bp, Homo sapiens
gatcaaaaggttaataaagtaat

SEQ ID NO: 2233171 - DNA, 21 bp, Homo sapiens
gatcaaccccttcgctcctgt

SEQ ID NO: 2233172 - DNA, 18 bp, Homo sapiens
gatcacgccactgcacta

SEQ ID NO: 2233173 - DNA, 18 bp, Homo sapiens
gatcacggctcactgcag

SEQ ID NO: 2233174 - DNA, 12 bp, Homo sapiens
gatcagcctggg

SEQ ID NO: 2233175 - DNA, 15 bp, Homo sapiens
gatcagcctgggcaa

SEQ ID NO: 2233176 - DNA, 22 bp, Homo sapiens
gatcagtctgattcccaagctc

SEQ ID NO: 2233177 - DNA, 17 bp, Homo sapiens
gatccaagctggtccca

SEQ ID NO: 2233178 - DNA, 21 bp, Homo sapiens
gatccacccacctcagcctcc

SEQ ID NO: 2233179 - DNA, 20 bp, Homo sapiens
gatcccccgccccatcctcc

SEQ ID NO: 2233180 - DNA, 16 bp, Homo sapiens
gatccctcatcctcat

SEQ ID NO: 2233181 - DNA, 18 bp, Homo sapiens
gatcctaggcatttgctg

SEQ ID NO: 2233182 - DNA, 12 bp, Homo sapiens
gatcctccaggt

SEQ ID NO: 2233183 - DNA, 16 bp, Homo sapiens
gatcctcccacctcag

SEQ ID NO: 2233184 - DNA, 22 bp, Homo sapiens
gatcctgagccagatttcactc

SEQ ID NO: 2233185 - DNA, 12 bp, Homo sapiens
gatctcttgagc

SEQ ID NO: 2233186 - DNA, 18 bp, Homo sapiens
gatctcttgagcctggga

SEQ ID NO: 2233187 - DNA, 19 bp, Homo sapiens
gatctcttgagcctgggag

SEQ ID NO: 2233188 - DNA, 20 bp, Homo sapiens
gatgaccttgaatgatgcca

SEQ ID NO: 2233189 - DNA, 22 bp, Homo sapiens
gatgagaaaggttgaagcacca

SEQ ID NO: 2233190 - DNA, 16 bp, Homo sapiens
gatgagtgagcatgcc

SEQ ID NO: 2233191 - DNA, 13 bp, Homo sapiens
gatgatcctaggc

SEQ ID NO: 2233192 - DNA, 15 bp, Homo sapiens
gatgatctaggaaga

SEQ ID NO: 2233193 - DNA, 21 bp, Homo sapiens
gatgcacagagttgttacatt

SEQ ID NO: 2233194 - DNA, 14 bp, Homo sapiens
gatgcagtgcttcc

SEQ ID NO: 2233195 - DNA, 14 bp, Homo sapiens
gatgcctggtggca

SEQ ID NO: 2233196 - DNA, 15 bp, Homo sapiens
gatgcctggtggcag

SEQ ID NO: 2233197 - DNA, 23 bp, Homo sapiens
gatgcttctcactgccatgccag

SEQ ID NO: 2233198 - DNA, 17 bp, Homo sapiens
gatgcttcttcagagac

SEQ ID NO: 2233199 - DNA, 21 bp, Homo sapiens
gatgcttcttcagagactcct

SEQ ID NO: 2233200 - DNA, 14 bp, Homo sapiens
gatgcttgtacata

SEQ ID NO: 2233201 - DNA, 16 bp, Homo sapiens
gatgcttgtacataat

SEQ ID NO: 2233202 - DNA, 22 bp, Homo sapiens
gatgggcaacccccagcctgct

SEQ ID NO: 2233203 - DNA, 13 bp, Homo sapiens
gatggggccctgc

SEQ ID NO: 2233204 - DNA, 13 bp, Homo sapiens
gatggggctgcac

SEQ ID NO: 2233205 - DNA, 14 bp, Homo sapiens
gatggtgcaatgac

SEQ ID NO: 2233206 - DNA, 17 bp, Homo sapiens
gatggtgcaatgacctt

SEQ ID NO: 2233207 - DNA, 20 bp, Homo sapiens
gatggtgcaatgacctttca

SEQ ID NO: 2233208 - DNA, 17 bp, Homo sapiens
gatgtgcccccaccccc

SEQ ID NO: 2233209 - DNA, 15 bp, Homo sapiens
gatgttttccatgag

SEQ ID NO: 2233210 - DNA, 19 bp, Homo sapiens
gattaaattcttgcaaagt

SEQ ID NO: 2233211 - DNA, 18 bp, Homo sapiens
gattaaccacttcagctg

SEQ ID NO: 2233212 - DNA, 19 bp, Homo sapiens
gattaaccacttcagctga

SEQ ID NO: 2233213 - DNA, 22 bp, Homo sapiens
gattacaagcgtgagccactgc

SEQ ID NO: 2233214 - DNA, 13 bp, Homo sapiens
gattcagacagct

SEQ ID NO: 2233215 - DNA, 13 bp, Homo sapiens
gattcagctctgc

SEQ ID NO: 2233216 - DNA, 18 bp, Homo sapiens
gattcatatttacttctt

SEQ ID NO: 2233217 - DNA, 14 bp, Homo sapiens
gattctcctgcctc

SEQ ID NO: 2233218 - DNA, 15 bp, Homo sapiens
gattctcctgcctca

SEQ ID NO: 2233219 - DNA, 23 bp, Homo sapiens
gattcttatggacaatgacccag

SEQ ID NO: 2233220 - DNA, 15 bp, Homo sapiens
gattcttctgcttca

SEQ ID NO: 2233221 - DNA, 17 bp, Homo sapiens
gattgcaacaggctggg

SEQ ID NO: 2233222 - DNA, 18 bp, Homo sapiens
gatttaacagaaatgtac

SEQ ID NO: 2233223 - DNA, 19 bp, Homo sapiens
gatttaacagaaatgtaca

SEQ ID NO: 2233224 - DNA, 21 bp, Homo sapiens
gattttgaaatttttattaaa

SEQ ID NO: 2233225 - DNA, 19 bp, Homo sapiens
gattttgatccaagctggt

SEQ ID NO: 2233226 - DNA, 16 bp, Homo sapiens
gatttttttttccttc

SEQ ID NO: 2233227 - DNA, 23 bp, Homo sapiens
gatttttttttccttcagtgcct

SEQ ID NO: 2233228 - DNA, 14 bp, Homo sapiens
gcaaaaaggcagga

SEQ ID NO: 2233229 - DNA, 15 bp, Homo sapiens
gcaaaagatgcttct

SEQ ID NO: 2233230 - DNA, 13 bp, Homo sapiens
gcaacaggctggg

SEQ ID NO: 2233231 - DNA, 17 bp, Homo sapiens
gcaacccccagcctgct

SEQ ID NO: 2233232 - DNA, 18 bp, Homo sapiens
gcaacccccagcctgcta

SEQ ID NO: 2233233 - DNA, 20 bp, Homo sapiens
gcaacctccgcctcttgggt

SEQ ID NO: 2233234 - DNA, 18 bp, Homo sapiens
gcaactgcattggctttg

SEQ ID NO: 2233235 - DNA, 17 bp, Homo sapiens
gcaagaattgaagcagg

SEQ ID NO: 2233236 - DNA, 14 bp, Homo sapiens
gcaagacgctgtgc

SEQ ID NO: 2233237 - DNA, 21 bp, Homo sapiens
gcaagacgctgtgctgccctg

SEQ ID NO: 2233238 - DNA, 23 bp, Homo sapiens
gcaagacgctgtgctgccctgcc

SEQ ID NO: 2233239 - DNA, 15 bp, Homo sapiens
gcaagcacctcctgc

SEQ ID NO: 2233240 - DNA, 11 bp, Homo sapiens
gcaaggctgtc

SEQ ID NO: 2233241 - DNA, 14 bp, Homo sapiens
gcaaggctgtcaat

SEQ ID NO: 2233242 - DNA, 14 bp, Homo sapiens
gcaaggtcattttt

SEQ ID NO: 2233243 - DNA, 18 bp, Homo sapiens
gcaagtgagagctgggtg

SEQ ID NO: 2233244 - DNA, 15 bp, Homo sapiens
gcaatgacctttcaa

SEQ ID NO: 2233245 - DNA, 22 bp, Homo sapiens
gcaatgacctttcaataggaaa

SEQ ID NO: 2233246 - DNA, 15 bp, Homo sapiens
gcacaaacagaggcc

SEQ ID NO: 2233247 - DNA, 14 bp, Homo sapiens
gcacaagctgcacc

SEQ ID NO: 2233248 - DNA, 18 bp, Homo sapiens
gcacacaccagagcccac

SEQ ID NO: 2233249 - DNA, 20 bp, Homo sapiens
gcacacaccagagcccacct

SEQ ID NO: 2233250 - DNA, 14 bp, Homo sapiens
gcacaccgggcact

SEQ ID NO: 2233251 - DNA, 23 bp, Homo sapiens
gcacagaaaatggaagacagctc

SEQ ID NO: 2233252 - DNA, 17 bp, Homo sapiens
gcacagaccctgccctg

SEQ ID NO: 2233253 - DNA, 21 bp, Homo sapiens
gcacagagttgttacattttt

SEQ ID NO: 2233254 - DNA, 22 bp, Homo sapiens
gcacagagttgttacattttta

SEQ ID NO: 2233255 - DNA, 19 bp, Homo sapiens
gcacagctaacatggaagt

SEQ ID NO: 2233256 - DNA, 21 bp, Homo sapiens
gcacagcttcatttcctgtgt

SEQ ID NO: 2233257 - DNA, 15 bp, Homo sapiens
gaagacttcatccct

SEQ ID NO: 2233258 - DNA, 11 bp, Homo sapiens
gaagactttgg

SEQ ID NO: 2233259 - DNA, 23 bp, Homo sapiens
gaagattttgaaatttttattaa

SEQ ID NO: 2233260 - DNA, 14 bp, Homo sapiens
gaagcacagcttca

SEQ ID NO: 2233261 - DNA, 22 bp, Homo sapiens
gaagcacatgcctctctcaggc

SEQ ID NO: 2233262 - DNA, 16 bp, Homo sapiens
gaagcaccataacttt

SEQ ID NO: 2233263 - DNA, 16 bp, Homo sapiens
gaagccagcaggctct

SEQ ID NO: 2233264 - DNA, 19 bp, Homo sapiens
gaagccagcaggctctcag

SEQ ID NO: 2233265 - DNA, 23 bp, Homo sapiens
gaagccagcaggctctcaggcca

SEQ ID NO: 2233266 - DNA, 13 bp, Homo sapiens
gaagcccaggaaa

SEQ ID NO: 2233267 - DNA, 21 bp, Homo sapiens
gaagcccaggaaaggctccag

SEQ ID NO: 2233268 - DNA, 22 bp, Homo sapiens
gaagcccaggaaaggctccagg

SEQ ID NO: 2233269 - DNA, 23 bp, Homo sapiens
gaagcccttctaccttcctgcaa

SEQ ID NO: 2233270 - DNA, 14 bp, Homo sapiens
gaagccgctggggc

SEQ ID NO: 2233271 - DNA, 18 bp, Homo sapiens
gaagccgctggggccagt

SEQ ID NO: 2233272 - DNA, 18 bp, Homo sapiens
gaagctcagggcctggct

SEQ ID NO: 2233273 - DNA, 19 bp, Homo sapiens
gaagctcagggcctggctc

SEQ ID NO: 2233274 - DNA, 20 bp, Homo sapiens
gaagctcagggcctggctca

SEQ ID NO: 2233275 - DNA, 22 bp, Homo sapiens
gaagctccgctttctacccagc

SEQ ID NO: 2233276 - DNA, 20 bp, Homo sapiens
gaaggaaacccagctctggt

SEQ ID NO: 2233277 - DNA, 19 bp, Homo sapiens
gaaggacattgcggacagc

SEQ ID NO: 2233278 - DNA, 15 bp, Homo sapiens
gaaggccccgcccag

SEQ ID NO: 2233279 - DNA, 18 bp, Homo sapiens
gaaggccccgcccaggct

SEQ ID NO: 2233280 - DNA, 21 bp, Homo sapiens
gaaggctcgagcatgcctgga

SEQ ID NO: 2233281 - DNA, 22 bp, Homo sapiens
gaaggggagataagggtatctg

SEQ ID NO: 2233282 - DNA, 17 bp, Homo sapiens
ccagccccagtgcccac

SEQ ID NO: 2233283 - DNA, 17 bp, Homo sapiens
ccagccccatcctctgt

SEQ ID NO: 2233284 - DNA, 23 bp, Homo sapiens
ccagccccatcctctgtacagag

SEQ ID NO: 2233285 - DNA, 21 bp, Homo sapiens
ccagcccctggatgcagcctc

SEQ ID NO: 2233286 - DNA, 17 bp, Homo sapiens
ccagccccttctgaccc

SEQ ID NO: 2233287 - DNA, 18 bp, Homo sapiens
ccagccccttctgaccca

SEQ ID NO: 2233288 - DNA, 23 bp, Homo sapiens
ccagccccttctgacccatgctg

SEQ ID NO: 2233289 - DNA, 24 bp, Homo sapiens
ccagccccttctgacccatgctgc

SEQ ID NO: 2233290 - DNA, 23 bp, Homo sapiens
ccagccgagatagccaaggccaa

SEQ ID NO: 2233291 - DNA, 19 bp, Homo sapiens
ccagccttgaccattctcc

SEQ ID NO: 2233292 - DNA, 22 bp, Homo sapiens
ccagccttgaccattctccacc

SEQ ID NO: 2233293 - DNA, 14 bp, Homo sapiens
ccagcgagccctgg

SEQ ID NO: 2233294 - DNA, 16 bp, Homo sapiens
ccagcgagccctggtg

SEQ ID NO: 2233295 - DNA, 15 bp, Homo sapiens
ccagctcaccagccc

SEQ ID NO: 2233296 - DNA, 16 bp, Homo sapiens
ccagctgcttgggctt

SEQ ID NO: 2233297 - DNA, 21 bp, Homo sapiens
ccagctgtgctctggacaggc

SEQ ID NO: 2233298 - DNA, 23 bp, Homo sapiens
ccagctgtgctctggacaggcat

SEQ ID NO: 2233299 - DNA, 16 bp, Homo sapiens
ccagcttatctcaggg

SEQ ID NO: 2233300 - DNA, 14 bp, Homo sapiens
ccaggaaaggctcc

SEQ ID NO: 2233301 - DNA, 16 bp, Homo sapiens
ccaggaaaggctccag

SEQ ID NO: 2233302 - DNA, 20 bp, Homo sapiens
ccaggaaaggctccaggagc

SEQ ID NO: 2233303 - DNA, 21 bp, Homo sapiens
ccaggaaaggctccaggagca

SEQ ID NO: 2233304 - DNA, 13 bp, Homo sapiens
ccaggagcagcca

SEQ ID NO: 2233305 - DNA, 15 bp, Homo sapiens
ccaggagccccgagg

SEQ ID NO: 2233306 - DNA, 19 bp, Homo sapiens
ccaggagccccgaggcctt

SEQ ID NO: 2233307 - DNA, 18 bp, Homo sapiens
ccaggagcctcctgccct

SEQ ID NO: 2233308 - DNA, 19 bp, Homo sapiens
ccaggagcctcctgccctt

SEQ ID NO: 2233309 - DNA, 14 bp, Homo sapiens
ccaggaggccagcc

SEQ ID NO: 2233310 - DNA, 15 bp, Homo sapiens
ccaggaggccagcct

SEQ ID NO: 2233311 - DNA, 18 bp, Homo sapiens
ccaggaggccagccttga

SEQ ID NO: 2233312 - DNA, 12 bp, Homo sapiens
ccaggcaggtct

SEQ ID NO: 2233313 - DNA, 19 bp, Homo sapiens
ccaggcattccccaggagg

SEQ ID NO: 2233314 - DNA, 24 bp, Homo sapiens
ccaggcattccccaggaggccagc

SEQ ID NO: 2233315 - DNA, 14 bp, Homo sapiens
ccaggccagaggga

SEQ ID NO: 2233316 - DNA, 23 bp, Homo sapiens
ccaggcccctgccaccctgggga

SEQ ID NO: 2233317 - DNA, 13 bp, Homo sapiens
ccaggctgggaga

SEQ ID NO: 2233318 - DNA, 17 bp, Homo sapiens
ccaggctgggagagcct

SEQ ID NO: 2233319 - DNA, 21 bp, Homo sapiens
ccaggctgggagagccttcca

SEQ ID NO: 2233320 - DNA, 23 bp, Homo sapiens
ccaggctgggagagccttccagg

SEQ ID NO: 2233321 - DNA, 19 bp, Homo sapiens
ccaggctggtctcaaactc

SEQ ID NO: 2233322 - DNA, 24 bp, Homo sapiens
ccaggctgtatcccatgagcctca

SEQ ID NO: 2233323 - DNA, 15 bp, Homo sapiens
ccagggacagagggg

SEQ ID NO: 2233324 - DNA, 20 bp, Homo sapiens
ccaggggaaaatcagcctgc

SEQ ID NO: 2233325 - DNA, 21 bp, Homo sapiens
ccaggggtgggacaccctgtg

SEQ ID NO: 2233326 - DNA, 22 bp, Homo sapiens
ccaggggtgggacaccctgtga

SEQ ID NO: 2233327 - DNA, 18 bp, Homo sapiens
ccaggtgcacaagctcca

SEQ ID NO: 2233328 - DNA, 19 bp, Homo sapiens
ccaggtgcacaagctccaa

SEQ ID NO: 2233329 - DNA, 20 bp, Homo sapiens
ccaggtgcacaagctccaag

SEQ ID NO: 2233330 - DNA, 14 bp, Homo sapiens
ccaggttcagcttg

SEQ ID NO: 2233331 - DNA, 13 bp, Homo sapiens
ccaggtttaagct

SEQ ID NO: 2233332 - DNA, 17 bp, Homo sapiens
ccaggtttttggtctga

SEQ ID NO: 2233333 - DNA, 21 bp, Homo sapiens
ccagtaaatgggggtgcattt

SEQ ID NO: 2233334 - DNA, 13 bp, Homo sapiens
ccagtcaccccgg

SEQ ID NO: 2233335 - DNA, 21 bp, Homo sapiens
ccagtcaccccggccacctgc

SEQ ID NO: 2233336 - DNA, 18 bp, Homo sapiens
ccagtctggaatgcagtg

SEQ ID NO: 2233337 - DNA, 19 bp, Homo sapiens
ccagtctggaatgcagtgg

SEQ ID NO: 2233338 - DNA, 13 bp, Homo sapiens
ccagtgaggctct

SEQ ID NO: 2233339 - DNA, 14 bp, Homo sapiens
ccagtgaggctctg

SEQ ID NO: 2233340 - DNA, 20 bp, Homo sapiens
ccagtgaggctctgcccttg

SEQ ID NO: 2233341 - DNA, 13 bp, Homo sapiens
ccagtgccccctg

SEQ ID NO: 2233342 - DNA, 22 bp, Homo sapiens
ccagtgttgtggatttaacaga

SEQ ID NO: 2233343 - DNA, 15 bp, Homo sapiens
ccatatgcctgggca

SEQ ID NO: 2233344 - DNA, 19 bp, Homo sapiens
ccatattctgttggccagt

SEQ ID NO: 2233345 - DNA, 13 bp, Homo sapiens
ccatcaagccacc

SEQ ID NO: 2233346 - DNA, 13 bp, Homo sapiens
ccatcaccagaca

SEQ ID NO: 2233347 - DNA, 12 bp, Homo sapiens
ccatcatgtctg

SEQ ID NO: 2233348 - DNA, 12 bp, Homo sapiens
ccatcattgaaa

SEQ ID NO: 2233349 - DNA, 18 bp, Homo sapiens
ccatccaggttcagcttg

SEQ ID NO: 2233350 - DNA, 23 bp, Homo sapiens
ccatcccaaacccttcagtgcca

SEQ ID NO: 2233351 - DNA, 12 bp, Homo sapiens
ccatcccagccc

SEQ ID NO: 2233352 - DNA, 13 bp, Homo sapiens
ccatcccagcccc

SEQ ID NO: 2233353 - DNA, 14 bp, Homo sapiens
ccatcccagcccca

SEQ ID NO: 2233354 - DNA, 19 bp, Homo sapiens
ccatcccatatgcctgggc

SEQ ID NO: 2233355 - DNA, 16 bp, Homo sapiens
ccatcccctgtagagt

SEQ ID NO: 2233356 - DNA, 14 bp, Homo sapiens
ccatccctgaaggc

SEQ ID NO: 2233357 - DNA, 15 bp, Homo sapiens
ccatccctgaaggcc

SEQ ID NO: 2233358 - DNA, 20 bp, Homo sapiens
ccatccctgaaggccccgcc

SEQ ID NO: 2233359 - DNA, 19 bp, Homo sapiens
ccatcctctgtacagagcc

SEQ ID NO: 2233360 - DNA, 15 bp, Homo sapiens
ccatctcacacatga

SEQ ID NO: 2233361 - DNA, 15 bp, Homo sapiens
ccatctctcctcctt

SEQ ID NO: 2233362 - DNA, 15 bp, Homo sapiens
ccatgagtcccctgt

SEQ ID NO: 2233363 - DNA, 15 bp, Homo sapiens
ccatgctcctggccc

SEQ ID NO: 2233364 - DNA, 18 bp, Homo sapiens
ccatgctcctggcccact

SEQ ID NO: 2233365 - DNA, 11 bp, Homo sapiens
ccatgctgccc

SEQ ID NO: 2233366 - DNA, 13 bp, Homo sapiens
ccatgggcctcct

SEQ ID NO: 2233367 - DNA, 13 bp, Homo sapiens
ccatgttggccag

SEQ ID NO: 2233368 - DNA, 18 bp, Homo sapiens
ccatgttggccaggctgg

SEQ ID NO: 2233369 - DNA, 19 bp, Homo sapiens
ccattctccacctgccagg

SEQ ID NO: 2233370 - DNA, 19 bp, Homo sapiens
ccattctgcctgcccaggc

SEQ ID NO: 2233371 - DNA, 13 bp, Homo sapiens
ccatttgctcctt

SEQ ID NO: 2233372 - DNA, 11 bp, Homo sapiens
cccaaaaaagc

SEQ ID NO: 2233373 - DNA, 14 bp, Homo sapiens
cccaaaaaagcgaa

SEQ ID NO: 2233374 - DNA, 16 bp, Homo sapiens
cccaaaactctcctct

SEQ ID NO: 2233375 - DNA, 20 bp, Homo sapiens
cccaaaactctcctctgctg

SEQ ID NO: 2233376 - DNA, 22 bp, Homo sapiens
cccaaatggaaatgggcagagc

SEQ ID NO: 2233377 - DNA, 11 bp, Homo sapiens
cccaagagaga

SEQ ID NO: 2233378 - DNA, 12 bp, Homo sapiens
cccaagctctgc

SEQ ID NO: 2233379 - DNA, 15 bp, Homo sapiens
cccacccaagggcct

SEQ ID NO: 2233380 - DNA, 20 bp, Homo sapiens
cccacccaagggcctggcct

SEQ ID NO: 2233381 - DNA, 13 bp, Homo sapiens
cccaccccaggct

SEQ ID NO: 2233382 - DNA, 14 bp, Homo sapiens
cccaccccaggctg

SEQ ID NO: 2233383 - DNA, 19 bp, Homo sapiens
cccaccccaggctgggctg

SEQ ID NO: 2233384 - DNA, 17 bp, Homo sapiens
cccaccccctccccggg

SEQ ID NO: 2233385 - DNA, 20 bp, Homo sapiens
cccaccgcagacaggaccag

SEQ ID NO: 2233386 - DNA, 19 bp, Homo sapiens
cccacctggcctctgcact

SEQ ID NO: 2233387 - DNA, 15 bp, Homo sapiens
cccaccttggctcaa

SEQ ID NO: 2233388 - DNA, 19 bp, Homo sapiens
ggcttggggaccagagctg

SEQ ID NO: 2233389 - DNA, 21 bp, Homo sapiens
ggcttggggaccagagctgcc

SEQ ID NO: 2233390 - DNA, 13 bp, Homo sapiens
gggaaaatcagcc

SEQ ID NO: 2233391 - DNA, 21 bp, Homo sapiens
gggaaggatacaaaagcatgt

SEQ ID NO: 2233392 - DNA, 23 bp, Homo sapiens
gggaaggatacaaaagcatgtga

SEQ ID NO: 2233393 - DNA, 14 bp, Homo sapiens
gggaagggggctgg

SEQ ID NO: 2233394 - DNA, 13 bp, Homo sapiens
gggaattgggggg

SEQ ID NO: 2233395 - DNA, 22 bp, Homo sapiens
gggacagagggggtggcctccc

SEQ ID NO: 2233396 - DNA, 16 bp, Homo sapiens
gggacagctccttctg

SEQ ID NO: 2233397 - DNA, 21 bp, Homo sapiens
gggacagctccttctgtccta

SEQ ID NO: 2233398 - DNA, 17 bp, Homo sapiens
gggactacaggcaccca

SEQ ID NO: 2233399 - DNA, 16 bp, Homo sapiens
gggactcaatgcactg

SEQ ID NO: 2233400 - DNA, 17 bp, Homo sapiens
gggactcaatgcactga

SEQ ID NO: 2233401 - DNA, 21 bp, Homo sapiens
gggagctgcctgttcagctcc

SEQ ID NO: 2233402 - DNA, 23 bp, Homo sapiens
gggaggatctcttgagcctggga

SEQ ID NO: 2233403 - DNA, 22 bp, Homo sapiens
gggaggatgttctgggacacag

SEQ ID NO: 2233404 - DNA, 16 bp, Homo sapiens
gggagggagggctcca

SEQ ID NO: 2233405 - DNA, 15 bp, Homo sapiens
gggagggctccagac

SEQ ID NO: 2233406 - DNA, 15 bp, Homo sapiens
gggaggtcgaggcag

SEQ ID NO: 2233407 - DNA, 17 bp, Homo sapiens
gggaggtcgaggcagga

SEQ ID NO: 2233408 - DNA, 18 bp, Homo sapiens
gggaggtcgaggcaggag

SEQ ID NO: 2233409 - DNA, 13 bp, Homo sapiens
gggagtggccaca

SEQ ID NO: 2233410 - DNA, 16 bp, Homo sapiens
gggatcctccaggtgc

SEQ ID NO: 2233411 - DNA, 13 bp, Homo sapiens
gggatgagaaagg

SEQ ID NO: 2233412 - DNA, 15 bp, Homo sapiens
gggatggcttggggg

SEQ ID NO: 2233413 - DNA, 15 bp, Homo sapiens
gggatttccatgatg

SEQ ID NO: 2233414 - DNA, 16 bp, Homo sapiens
gggcacagggtctcta

SEQ ID NO: 2233415 - DNA, 15 bp, Homo sapiens
gggcacccccggccc

SEQ ID NO: 2233416 - DNA, 16 bp, Homo sapiens
gggcactcagaagaca

SEQ ID NO: 2233417 - DNA, 11 bp, Homo sapiens
gggcagagcag

SEQ ID NO: 2233418 - DNA, 10 bp, Homo sapiens
gggcagcaga

SEQ ID NO: 2233419 - DNA, 11 bp, Homo sapiens
gggcagcagag

SEQ ID NO: 2233420 - DNA, 17 bp, Homo sapiens
gggcaggttggtggggg

SEQ ID NO: 2233421 - DNA, 23 bp, Homo sapiens
gggccacagagaaagtacttctc

SEQ ID NO: 2233422 - DNA, 18 bp, Homo sapiens
gggccagttggtccccct

SEQ ID NO: 2233423 - DNA, 17 bp, Homo sapiens
gggccccacgtccctgc

SEQ ID NO: 2233424 - DNA, 22 bp, Homo sapiens
gggccccacgtccctgcggaag

SEQ ID NO: 2233425 - DNA, 13 bp, Homo sapiens
gggcctggcctga

SEQ ID NO: 2233426 - DNA, 14 bp, Homo sapiens
gggcctggcctgag

SEQ ID NO: 2233427 - DNA, 18 bp, Homo sapiens
gggcctggcctgagctgg

SEQ ID NO: 2233428 - DNA, 21 bp, Homo sapiens
gggcggtgagaggggaacaga

SEQ ID NO: 2233429 - DNA, 18 bp, Homo sapiens
gggctcagcaaaagatgc

SEQ ID NO: 2233430 - DNA, 15 bp, Homo sapiens
gggctctgcctccca

SEQ ID NO: 2233431 - DNA, 20 bp, Homo sapiens
gggctctgcctcccatcacc

SEQ ID NO: 2233432 - DNA, 14 bp, Homo sapiens
gggctgcaccggct

SEQ ID NO: 2233433 - DNA, 17 bp, Homo sapiens
gggctgcaccggctggc

SEQ ID NO: 2233434 - DNA, 14 bp, Homo sapiens
gggctggaagcaga

SEQ ID NO: 2233435 - DNA, 15 bp, Homo sapiens
gggctggaagcagaa

SEQ ID NO: 2233436 - DNA, 22 bp, Homo sapiens
gggctggaagcagaaacaaaat

SEQ ID NO: 2233437 - DNA, 16 bp, Homo sapiens
gggcttcagtggcagc

SEQ ID NO: 2233438 - DNA, 20 bp, Homo sapiens
gggcttcatcctcctcagat

SEQ ID NO: 2233439 - DNA, 21 bp, Homo sapiens
gggcttggggaccagagctgc

SEQ ID NO: 2233440 - DNA, 22 bp, Homo sapiens
ggggaatgtttgcctctgcctc

SEQ ID NO: 2233441 - DNA, 20 bp, Homo sapiens
ggggacagctccttctgtcc

SEQ ID NO: 2233442 - DNA, 15 bp, Homo sapiens
ggggaccagagctgc

SEQ ID NO: 2233443 - DNA, 15 bp, Homo sapiens
ggggacctcaggcct

SEQ ID NO: 2233444 - DNA, 16 bp, Homo sapiens
ggggacctcaggcctg

SEQ ID NO: 2233445 - DNA, 11 bp, Homo sapiens
ggggagaaagt

SEQ ID NO: 2233446 - DNA, 16 bp, Homo sapiens
ggggcccaagagagac

SEQ ID NO: 2233447 - DNA, 15 bp, Homo sapiens
ggggcctcagtgcca

SEQ ID NO: 2233448 - DNA, 17 bp, Homo sapiens
ggggctgaggtgggagg

SEQ ID NO: 2233449 - DNA, 21 bp, Homo sapiens
ggggctgcaccggctggcctg

SEQ ID NO: 2233450 - DNA, 16 bp, Homo sapiens
gtcaggtggggcagct

SEQ ID NO: 2233451 - DNA, 18 bp, Homo sapiens
gtcaggtggggcagcttg

SEQ ID NO: 2233452 - DNA, 17 bp, Homo sapiens
gtcatttgagcagggct

SEQ ID NO: 2233453 - DNA, 21 bp, Homo sapiens
gtcatttgagcagggctcagc

SEQ ID NO: 2233454 - DNA, 21 bp, Homo sapiens
gtcattttttttaagaaaaag

SEQ ID NO: 2233455 - DNA, 16 bp, Homo sapiens
gtccacccaggagccc

SEQ ID NO: 2233456 - DNA, 17 bp, Homo sapiens
gtcccaccttggctgca

SEQ ID NO: 2233457 - DNA, 19 bp, Homo sapiens
gtcccaccttggctgcagg

SEQ ID NO: 2233458 - DNA, 14 bp, Homo sapiens
gtcccactcagtcc

SEQ ID NO: 2233459 - DNA, 17 bp, Homo sapiens
gtcccagatacttgggg

SEQ ID NO: 2233460 - DNA, 22 bp, Homo sapiens
gtccccaccgcagacaggacca

SEQ ID NO: 2233461 - DNA, 13 bp, Homo sapiens
gtccccctgacaa

SEQ ID NO: 2233462 - DNA, 15 bp, Homo sapiens
gtccccgcactgggc

SEQ ID NO: 2233463 - DNA, 16 bp, Homo sapiens
gtccctgcacttgcag

SEQ ID NO: 2233464 - DNA, 19 bp, Homo sapiens
gtccctgcacttgcagact

SEQ ID NO: 2233465 - DNA, 14 bp, Homo sapiens
gtccctgccaatgg

SEQ ID NO: 2233466 - DNA, 17 bp, Homo sapiens
gtccctggtggcagctc

SEQ ID NO: 2233467 - DNA, 13 bp, Homo sapiens
gtcctacccaccc

SEQ ID NO: 2233468 - DNA, 13 bp, Homo sapiens
gtcctactctgtg

SEQ ID NO: 2233469 - DNA, 23 bp, Homo sapiens
gtcctactctgtgtcaggtgggg

SEQ ID NO: 2233470 - DNA, 16 bp, Homo sapiens
gtcctggcatgggaat

SEQ ID NO: 2233471 - DNA, 17 bp, Homo sapiens
gtcctggcatgggaatg

SEQ ID NO: 2233472 - DNA, 15 bp, Homo sapiens
gtcctgggagtgagc

SEQ ID NO: 2233473 - DNA, 18 bp, Homo sapiens
gtcctgggagtgagctgg

SEQ ID NO: 2233474 - DNA, 15 bp, Homo sapiens
gtccttaccagcaga

SEQ ID NO: 2233475 - DNA, 21 bp, Homo sapiens
gtccttaccagcagagcacct

SEQ ID NO: 2233476 - DNA, 16 bp, Homo sapiens
gtcgaggacagggagg

SEQ ID NO: 2233477 - DNA, 16 bp, Homo sapiens
gtcgggcatgacacga

SEQ ID NO: 2233478 - DNA, 22 bp, Homo sapiens
gtctatgggactcaatgcactg

SEQ ID NO: 2233479 - DNA, 14 bp, Homo sapiens
gtctcaaaaaaaca

SEQ ID NO: 2233480 - DNA, 18 bp, Homo sapiens
gtctcactatgttgccca

SEQ ID NO: 2233481 - DNA, 19 bp, Homo sapiens
gtctcactatgttgcccag

SEQ ID NO: 2233482 - DNA, 21 bp, Homo sapiens
gtctcactatgttgcccaggc

SEQ ID NO: 2233483 - DNA, 22 bp, Homo sapiens
gtctcactctgtcgcccagtct

SEQ ID NO: 2233484 - DNA, 17 bp, Homo sapiens
gtctcactgttgcccag

SEQ ID NO: 2233485 - DNA, 21 bp, Homo sapiens
gtctcactgttgcccaggctg

SEQ ID NO: 2233486 - DNA, 23 bp, Homo sapiens
gtctctttaatgtcacaggcagg

SEQ ID NO: 2233487 - DNA, 19 bp, Homo sapiens
gtctgaaggctgggttctg

SEQ ID NO: 2233488 - DNA, 14 bp, Homo sapiens
gtctgacaggcaat

SEQ ID NO: 2233489 - DNA, 14 bp, Homo sapiens
gtctgacccactgc

SEQ ID NO: 2233490 - DNA, 18 bp, Homo sapiens
gtctgaggaatccagacc

SEQ ID NO: 2233491 - DNA, 19 bp, Homo sapiens
gtctgattcccaagctctg

SEQ ID NO: 2233492 - DNA, 20 bp, Homo sapiens
gtctgattcccaagctctgc

SEQ ID NO: 2233493 - DNA, 21 bp, Homo sapiens
gtcttaaaaagtggaaaaata

SEQ ID NO: 2233494 - DNA, 17 bp, Homo sapiens
gtcttgcaatggcagcc

SEQ ID NO: 2233495 - DNA, 18 bp, Homo sapiens
gtcttgcaatggcagcct

SEQ ID NO: 2233496 - DNA, 16 bp, Homo sapiens
gtcttggtttggttca

SEQ ID NO: 2233497 - DNA, 14 bp, Homo sapiens
gtctttggaccctg

SEQ ID NO: 2233498 - DNA, 18 bp, Homo sapiens
gtctttggaccctgaggc

SEQ ID NO: 2233499 - DNA, 14 bp, Homo sapiens
tccccagcacctag

SEQ ID NO: 2233500 - DNA, 15 bp, Homo sapiens
tccccagcacctagg

SEQ ID NO: 2233501 - DNA, 14 bp, Homo sapiens
tccccaggaggcca

SEQ ID NO: 2233502 - DNA, 17 bp, Homo sapiens
tccccaggaggccagcc

SEQ ID NO: 2233503 - DNA, 13 bp, Homo sapiens
tcccccagcccca

SEQ ID NO: 2233504 - DNA, 15 bp, Homo sapiens
tcccccgccccatcc

SEQ ID NO: 2233505 - DNA, 20 bp, Homo sapiens
tccccgcactgggcttgggg

SEQ ID NO: 2233506 - DNA, 21 bp, Homo sapiens
tccccgggcagcagagagaga

SEQ ID NO: 2233507 - DNA, 21 bp, Homo sapiens
tcccctgctgggtgtggcgca

SEQ ID NO: 2233508 - DNA, 16 bp, Homo sapiens
tcccgaatagctggga

SEQ ID NO: 2233509 - DNA, 20 bp, Homo sapiens
tcccgaatagctgggactac

SEQ ID NO: 2233510 - DNA, 15 bp, Homo sapiens
tcccgagtagctggg

SEQ ID NO: 2233511 - DNA, 17 bp, Homo sapiens
tcccgagtagctgggac

SEQ ID NO: 2233512 - DNA, 18 bp, Homo sapiens
tcccgagtagctgggact

SEQ ID NO: 2233513 - DNA, 20 bp, Homo sapiens
tccctcagtctggcccttcc

SEQ ID NO: 2233514 - DNA, 10 bp, Homo sapiens
tccctccctt

SEQ ID NO: 2233515 - DNA, 13 bp, Homo sapiens
tccctctggggct

SEQ ID NO: 2233516 - DNA, 11 bp, Homo sapiens
tccctctttcc

SEQ ID NO: 2233517 - DNA, 13 bp, Homo sapiens
tccctctttccct

SEQ ID NO: 2233518 - DNA, 21 bp, Homo sapiens
tccctctttccctcccttcct

SEQ ID NO: 2233519 - DNA, 15 bp, Homo sapiens
tccctgaaggccccg

SEQ ID NO: 2233520 - DNA, 17 bp, Homo sapiens
tccctgaaggccccgcc

SEQ ID NO: 2233521 - DNA, 18 bp, Homo sapiens
tccctgaaggccccgccc

SEQ ID NO: 2233522 - DNA, 22 bp, Homo sapiens
tccctgaaggccccgcccaggc

SEQ ID NO: 2233523 - DNA, 14 bp, Homo sapiens
tccctgccaatgga

SEQ ID NO: 2233524 - DNA, 22 bp, Homo sapiens
tccctgcggaagccacagggtg

SEQ ID NO: 2233525 - DNA, 23 bp, Homo sapiens
tccctgcggaagccacagggtga

SEQ ID NO: 2233526 - DNA, 17 bp, Homo sapiens
tccctggtggcagctca

SEQ ID NO: 2233527 - DNA, 21 bp, Homo sapiens
tccctggtggcagctcacctc

SEQ ID NO: 2233528 - DNA, 23 bp, Homo sapiens
tccctggtggcagctcacctctc

SEQ ID NO: 2233529 - DNA, 22 bp, Homo sapiens
tcccttacgtgagtcctggcat

SEQ ID NO: 2233530 - DNA, 14 bp, Homo sapiens
tcccttcccacctc

SEQ ID NO: 2233531 - DNA, 21 bp, Homo sapiens
tcccttcccactggaggcatg

SEQ ID NO: 2233532 - DNA, 18 bp, Homo sapiens
tccctttgacgccatccc

SEQ ID NO: 2233533 - DNA, 12 bp, Homo sapiens
tcccttttcctt

SEQ ID NO: 2233534 - DNA, 17 bp, Homo sapiens
tcccttttttggctgct

SEQ ID NO: 2233535 - DNA, 21 bp, Homo sapiens
tccgaaagggacttggaagct

SEQ ID NO: 2233536 - DNA, 17 bp, Homo sapiens
tccgaccagacaccttg

SEQ ID NO: 2233537 - DNA, 18 bp, Homo sapiens
tccgctttctacccagcg

SEQ ID NO: 2233538 - DNA, 20 bp, Homo sapiens
tccgctttctacccagcgag

SEQ ID NO: 2233539 - DNA, 15 bp, Homo sapiens
tccgttaaaatacca

SEQ ID NO: 2233540 - DNA, 12 bp, Homo sapiens
tcctactctgtg

SEQ ID NO: 2233541 - DNA, 20 bp, Homo sapiens
tcctagcactttgggaggcc

SEQ ID NO: 2233542 - DNA, 19 bp, Homo sapiens
tcctaggcatttgctgaat

SEQ ID NO: 2233543 - DNA, 17 bp, Homo sapiens
tcctagttccaccatca

SEQ ID NO: 2233544 - DNA, 22 bp, Homo sapiens
tcctagttccaccatcaagcca

SEQ ID NO: 2233545 - DNA, 18 bp, Homo sapiens
tcctatattgttttcagt

SEQ ID NO: 2233546 - DNA, 22 bp, Homo sapiens
tcctcatagtatggtggctggg

SEQ ID NO: 2233547 - DNA, 12 bp, Homo sapiens
tcctccaggtgc

SEQ ID NO: 2233548 - DNA, 20 bp, Homo sapiens
tcctccaggtgcacaagctc

SEQ ID NO: 2233549 - DNA, 13 bp, Homo sapiens
tcctcccacctca

SEQ ID NO: 2233550 - DNA, 14 bp, Homo sapiens
tcctcccacctcag

SEQ ID NO: 2233551 - DNA, 16 bp, Homo sapiens
tcctcccacctcagcc

SEQ ID NO: 2233552 - DNA, 17 bp, Homo sapiens
tcctccctccctctttc

SEQ ID NO: 2233553 - DNA, 12 bp, Homo sapiens
tcctcctcagat

SEQ ID NO: 2233554 - DNA, 21 bp, Homo sapiens
tcctccttttcacagttctct

SEQ ID NO: 2233555 - DNA, 17 bp, Homo sapiens
tcctctaggaggtctct

SEQ ID NO: 2233556 - DNA, 17 bp, Homo sapiens
tcctctgctgctggctg

SEQ ID NO: 2233557 - DNA, 21 bp, Homo sapiens
tatctgtcatttgagcagggc

SEQ ID NO: 2233558 - DNA, 16 bp, Homo sapiens
tatgactccagaattt

SEQ ID NO: 2233559 - DNA, 13 bp, Homo sapiens
tatgcacacattt

SEQ ID NO: 2233560 - DNA, 13 bp, Homo sapiens
tatgcatgaagta

SEQ ID NO: 2233561 - DNA, 22 bp, Homo sapiens
tatgcatgaagtaatatgcaca

SEQ ID NO: 2233562 - DNA, 24 bp, Homo sapiens
tatgcatttgaaaattttgatgtt

SEQ ID NO: 2233563 - DNA, 14 bp, Homo sapiens
tatgctctgcatgt

SEQ ID NO: 2233564 - DNA, 19 bp, Homo sapiens
tatgctctgcatgttacat

SEQ ID NO: 2233565 - DNA, 21 bp, Homo sapiens
tatggccctggcctagcatac

SEQ ID NO: 2233566 - DNA, 22 bp, Homo sapiens
tatggccctggcctagcatacg

SEQ ID NO: 2233567 - DNA, 18 bp, Homo sapiens
tatggcttttgtgcatta

SEQ ID NO: 2233568 - DNA, 21 bp, Homo sapiens
tatggcttttgtgcattatct

SEQ ID NO: 2233569 - DNA, 10 bp, Homo sapiens
tatgggagag

SEQ ID NO: 2233570 - DNA, 16 bp, Homo sapiens
tatgttgcccaggcag

SEQ ID NO: 2233571 - DNA, 20 bp, Homo sapiens
tatgttgcccaggcaggtct

SEQ ID NO: 2233572 - DNA, 17 bp, Homo sapiens
tatgttttaagaggcag

SEQ ID NO: 2233573 - DNA, 18 bp, Homo sapiens
tattaaaaatctcaaatt

SEQ ID NO: 2233574 - DNA, 22 bp, Homo sapiens
tattaaaaatctcaaatttcta

SEQ ID NO: 2233575 - DNA, 24 bp, Homo sapiens
tattaagaaagactatctaaatgt

SEQ ID NO: 2233576 - DNA, 13 bp, Homo sapiens
tattacttctgct

SEQ ID NO: 2233577 - DNA, 12 bp, Homo sapiens
tattataccttt

SEQ ID NO: 2233578 - DNA, 20 bp, Homo sapiens
tattcagtaataactctacc

SEQ ID NO: 2233579 - DNA, 16 bp, Homo sapiens
tattctgttggccagt

SEQ ID NO: 2233580 - DNA, 15 bp, Homo sapiens
tattcttatttaatg

SEQ ID NO: 2233581 - DNA, 13 bp, Homo sapiens
tattgcccacgct

SEQ ID NO: 2233582 - DNA, 17 bp, Homo sapiens
tattgctgatggtgcaa

SEQ ID NO: 2233583 - DNA, 13 bp, Homo sapiens
tattgtcaaagtg

SEQ ID NO: 2233584 - DNA, 20 bp, Homo sapiens
tattgttttcagtgtacatg

SEQ ID NO: 2233585 - DNA, 15 bp, Homo sapiens
tatttaatgaaagac

SEQ ID NO: 2233586 - DNA, 18 bp, Homo sapiens
tatttacttcttatacat

SEQ ID NO: 2233587 - DNA, 14 bp, Homo sapiens
tatttatttaaatt

SEQ ID NO: 2233588 - DNA, 17 bp, Homo sapiens
tatttttgtaaaaaggg

SEQ ID NO: 2233589 - DNA, 14 bp, Homo sapiens
tatttttttactaa

SEQ ID NO: 2233590 - DNA, 15 bp, Homo sapiens
tatttttttactaat

SEQ ID NO: 2233591 - DNA, 14 bp, Homo sapiens
tcaaaaaaagaaaa

SEQ ID NO: 2233592 - DNA, 22 bp, Homo sapiens
tcaaactcttgacctcaggtga

SEQ ID NO: 2233593 - DNA, 14 bp, Homo sapiens
tcaaatttctaaat

SEQ ID NO: 2233594 - DNA, 16 bp, Homo sapiens
tcaacaggttttcctg

SEQ ID NO: 2233595 - DNA, 14 bp, Homo sapiens
tcaaccagcagatg

SEQ ID NO: 2233596 - DNA, 19 bp, Homo sapiens
tcaaccccttcgctcctgt

SEQ ID NO: 2233597 - DNA, 20 bp, Homo sapiens
tcaaccccttcgctcctgtg

SEQ ID NO: 2233598 - DNA, 14 bp, Homo sapiens
tcaacctcctgggc

SEQ ID NO: 2233599 - DNA, 17 bp, Homo sapiens
tcaaggatcctgagcca

SEQ ID NO: 2233600 - DNA, 23 bp, Homo sapiens
tcaaggatcctgagccagatttc

SEQ ID NO: 2233601 - DNA, 15 bp, Homo sapiens
tcaagtattatacct

SEQ ID NO: 2233602 - DNA, 16 bp, Homo sapiens
tcaagtattatacctt

SEQ ID NO: 2233603 - DNA, 23 bp, Homo sapiens
tcaagtattataccttttttaga

SEQ ID NO: 2233604 - DNA, 15 bp, Homo sapiens
tcaagtgaaaaagga

SEQ ID NO: 2233605 - DNA, 16 bp, Homo sapiens
tcaagtgattctcctg

SEQ ID NO: 2233606 - DNA, 19 bp, Homo sapiens
tcagcggggacagctcctt

SEQ ID NO: 2233607 - DNA, 21 bp, Homo sapiens
tcagcggggacagctccttct

SEQ ID NO: 2233608 - DNA, 21 bp, Homo sapiens
tcagctccagctcaccagccc

SEQ ID NO: 2233609 - DNA, 24 bp, Homo sapiens
tcagctccagctcaccagccccag

SEQ ID NO: 2233610 - DNA, 15 bp, Homo sapiens
tcagctgaacctggg

SEQ ID NO: 2233611 - DNA, 16 bp, Homo sapiens
tcaggaagctcagggc

SEQ ID NO: 2233612 - DNA, 17 bp, Homo sapiens
tcaggaagctcagggcc

SEQ ID NO: 2233613 - DNA, 23 bp, Homo sapiens
tcaggaagctcagggcctggctc

SEQ ID NO: 2233614 - DNA, 17 bp, Homo sapiens
tcaggcaggtgggatgg

SEQ ID NO: 2233615 - DNA, 20 bp, Homo sapiens
tcaggccagctgcttgggct

SEQ ID NO: 2233616 - DNA, 11 bp, Homo sapiens
tcaggccaggc

SEQ ID NO: 2233617 - DNA, 12 bp, Homo sapiens
tcaggccaggcc

SEQ ID NO: 2233618 - DNA, 14 bp, Homo sapiens
tcaggccaggccct

SEQ ID NO: 2233619 - DNA, 15 bp, Homo sapiens
tcaggccaggccctc

SEQ ID NO: 2233620 - DNA, 19 bp, Homo sapiens
tcaggccaggccctctgcc

SEQ ID NO: 2233621 - DNA, 21 bp, Homo sapiens
tcaggccaggccctctgccca

SEQ ID NO: 2233622 - DNA, 19 bp, Homo sapiens
tcagggtccctggtggcag

SEQ ID NO: 2233623 - DNA, 15 bp, Homo sapiens
tcaggtaacaggcag

SEQ ID NO: 2233624 - DNA, 22 bp, Homo sapiens
tcaggtaacaggcagatacagg

SEQ ID NO: 2233625 - DNA, 23 bp, Homo sapiens
tcaggtaacaggcagatacagga

SEQ ID NO: 2233626 - DNA, 15 bp, Homo sapiens
tcaggtgagaagcag

SEQ ID NO: 2233627 - DNA, 23 bp, Homo sapiens
tcaggtgatccacccacctcagc

SEQ ID NO: 2233628 - DNA, 23 bp, Homo sapiens
tcaggtgcctcaagagaaggcaa

SEQ ID NO: 2233629 - DNA, 18 bp, Homo sapiens
tcaggtggggcagcttga

SEQ ID NO: 2233630 - DNA, 21 bp, Homo sapiens
tcaggtggggcagcttgaggg

SEQ ID NO: 2233631 - DNA, 22 bp, Homo sapiens
tcaggtggggtcactctggcag

SEQ ID NO: 2233632 - DNA, 17 bp, Homo sapiens
tcaggtgtccctgcact

SEQ ID NO: 2233633 - DNA, 17 bp, Homo sapiens
tcagtctgattcccaag

SEQ ID NO: 2233634 - DNA, 22 bp, Homo sapiens
tcagtctgattcccaagctctg

SEQ ID NO: 2233635 - DNA, 9 bp, Homo sapiens
tcagtgcct

SEQ ID NO: 2233636 - DNA, 12 bp, Homo sapiens
tcagtgccttat

SEQ ID NO: 2233637 - DNA, 19 bp, Homo sapiens
tcagtgccttatggaacac

SEQ ID NO: 2233638 - DNA, 20 bp, Homo sapiens
tcagtgccttatggaacact

SEQ ID NO: 2233639 - DNA, 22 bp, Homo sapiens
tcagtgccttatggaacactct

SEQ ID NO: 2233640 - DNA, 13 bp, Homo sapiens
tcagtggcagctg

SEQ ID NO: 2233641 - DNA, 23 bp, Homo sapiens
tcagtggttggcaattgtttcaa

SEQ ID NO: 2233642 - DNA, 18 bp, Homo sapiens
tcagtgtgactgatctct

SEQ ID NO: 2233643 - DNA, 13 bp, Homo sapiens
tcataatgactta

SEQ ID NO: 2233644 - DNA, 13 bp, Homo sapiens
tcatacccacccc

SEQ ID NO: 2233645 - DNA, 14 bp, Homo sapiens
tcatacccaccccc

SEQ ID NO: 2233646 - DNA, 21 bp, Homo sapiens
tcatacccacccccacccaag

SEQ ID NO: 2233647 - DNA, 15 bp, Homo sapiens
tcatactcacctcac

SEQ ID NO: 2233648 - DNA, 18 bp, Homo sapiens
tcatagtatggtggctgg

SEQ ID NO: 2233649 - DNA, 15 bp, Homo sapiens
tcatatttacttctt

SEQ ID NO: 2233650 - DNA, 20 bp, Homo sapiens
tcatatttacttcttataca

SEQ ID NO: 2233651 - DNA, 21 bp, Homo sapiens
tcatatttacttcttatacat

SEQ ID NO: 2233652 - DNA, 22 bp, Homo sapiens
tcatatttacttcttatacatt

SEQ ID NO: 2233653 - DNA, 19 bp, Homo sapiens
tcatcaccaacgtctgtgc

SEQ ID NO: 2233654 - DNA, 21 bp, Homo sapiens
tcatcaccaacgtctgtgcca

SEQ ID NO: 2233655 - DNA, 19 bp, Homo sapiens
tcatccactgtgccatgtg

SEQ ID NO: 2233656 - DNA, 21 bp, Homo sapiens
tcatccactgtgccatgtgcc

SEQ ID NO: 2233657 - DNA, 13 bp, Homo sapiens
tcatcctcctcag

SEQ ID NO: 2233658 - DNA, 19 bp, Homo sapiens
tcatcctcctcagatcttc

SEQ ID NO: 2233659 - DNA, 19 bp, Homo sapiens
tctggctatgcatttgaaa

SEQ ID NO: 2233660 - DNA, 18 bp, Homo sapiens
tctggctcttccaggctg

SEQ ID NO: 2233661 - DNA, 23 bp, Homo sapiens
tctggctcttccaggctgggaga

SEQ ID NO: 2233662 - DNA, 23 bp, Homo sapiens
tctgtacagagcccacgccccca

SEQ ID NO: 2233663 - DNA, 17 bp, Homo sapiens
tctgtacgtctgacagg

SEQ ID NO: 2233664 - DNA, 15 bp, Homo sapiens
tctgtcctactctgt

SEQ ID NO: 2233665 - DNA, 19 bp, Homo sapiens
tctgtcctactctgtgtca

SEQ ID NO: 2233666 - DNA, 12 bp, Homo sapiens
tctgtcctggga

SEQ ID NO: 2233667 - DNA, 22 bp, Homo sapiens
tctgtgggtttctaaagctgcc

SEQ ID NO: 2233668 - DNA, 20 bp, Homo sapiens
tctgtgtcaggtggggcagc

SEQ ID NO: 2233669 - DNA, 22 bp, Homo sapiens
tctgtgtcaggtggggcagctt

SEQ ID NO: 2233670 - DNA, 12 bp, Homo sapiens
tctgttggccag

SEQ ID NO: 2233671 - DNA, 18 bp, Homo sapiens
tctgttggccagtgtgac

SEQ ID NO: 2233672 - DNA, 19 bp, Homo sapiens
tctgttggccagtgtgaca

SEQ ID NO: 2233673 - DNA, 20 bp, Homo sapiens
tctgttggccagtgtgacaa

SEQ ID NO: 2233674 - DNA, 18 bp, Homo sapiens
tcttaaaaagtggaaaaa

SEQ ID NO: 2233675 - DNA, 14 bp, Homo sapiens
tcttatacatttga

SEQ ID NO: 2233676 - DNA, 15 bp, Homo sapiens
tcttatacatttgat

SEQ ID NO: 2233677 - DNA, 22 bp, Homo sapiens
tcttatccaacatcaacatctt

SEQ ID NO: 2233678 - DNA, 16 bp, Homo sapiens
tcttatgggctgggtt

SEQ ID NO: 2233679 - DNA, 18 bp, Homo sapiens
tcttatgggctgggttct

SEQ ID NO: 2233680 - DNA, 14 bp, Homo sapiens
tcttattgcccacg

SEQ ID NO: 2233681 - DNA, 17 bp, Homo sapiens
tcttcagagactcctgc

SEQ ID NO: 2233682 - DNA, 18 bp, Homo sapiens
tcttcagagactcctgca

SEQ ID NO: 2233683 - DNA, 23 bp, Homo sapiens
tcttcagatctctaacttcacca

SEQ ID NO: 2233684 - DNA, 14 bp, Homo sapiens
tcttcctccctccc

SEQ ID NO: 2233685 - DNA, 21 bp, Homo sapiens
tcttctccactttctagccag

SEQ ID NO: 2233686 - DNA, 12 bp, Homo sapiens
tcttctccaggc

SEQ ID NO: 2233687 - DNA, 12 bp, Homo sapiens
tcttctgcttca

SEQ ID NO: 2233688 - DNA, 15 bp, Homo sapiens
tcttctgtacgtctg

SEQ ID NO: 2233689 - DNA, 20 bp, Homo sapiens
tcttgaaatataggaactta

SEQ ID NO: 2233690 - DNA, 15 bp, Homo sapiens
tcttgaactcctggc

SEQ ID NO: 2233691 - DNA, 13 bp, Homo sapiens
tcttgaagacttt

SEQ ID NO: 2233692 - DNA, 19 bp, Homo sapiens
tcttgagccttgaactttg

SEQ ID NO: 2233693 - DNA, 15 bp, Homo sapiens
tcttgcatgaggcta

SEQ ID NO: 2233694 - DNA, 23 bp, Homo sapiens
tcttgctctgctgacagacacag

SEQ ID NO: 2233695 - DNA, 21 bp, Homo sapiens
tcttggtttggttcatggtga

SEQ ID NO: 2233696 - DNA, 16 bp, Homo sapiens
tcttggtttgtaaatt

SEQ ID NO: 2233697 - DNA, 16 bp, Homo sapiens
tcttgtgtgtttattg

SEQ ID NO: 2233698 - DNA, 21 bp, Homo sapiens
tcttgtgtgtttattgtcaaa

SEQ ID NO: 2233699 - DNA, 16 bp, Homo sapiens
tctttcagccaagaat

SEQ ID NO: 2233700 - DNA, 19 bp, Homo sapiens
tctttcagccaagaattct

SEQ ID NO: 2233701 - DNA, 21 bp, Homo sapiens
tctttcagccaagaattctta

SEQ ID NO: 2233702 - DNA, 17 bp, Homo sapiens
tctttccaaagtacact

SEQ ID NO: 2233703 - DNA, 13 bp, Homo sapiens
tctttccctccct

SEQ ID NO: 2233704 - DNA, 13 bp, Homo sapiens
tctttcctgaggc

SEQ ID NO: 2233705 - DNA, 23 bp, Homo sapiens
tctttgagtgaagctgggagaac

SEQ ID NO: 2233706 - DNA, 13 bp, Homo sapiens
tctttgcagacag

SEQ ID NO: 2233707 - DNA, 14 bp, Homo sapiens
tctttgcagacagg

SEQ ID NO: 2233708 - DNA, 17 bp, Homo sapiens
tctttgcagacaggcaa

SEQ ID NO: 2233709 - DNA, 13 bp, Homo sapiens
tctttggaccctg

SEQ ID NO: 2233710 - DNA, 14 bp, Homo sapiens
tctttggaccctga

SEQ ID NO: 2233711 - DNA, 15 bp, Homo sapiens
tctttggaccctgag

SEQ ID NO: 2233712 - DNA, 21 bp, Homo sapiens
tctttggaccctgaggcccag

SEQ ID NO: 2233713 - DNA, 14 bp, Homo sapiens
tctttggtctacac

SEQ ID NO: 2233714 - DNA, 14 bp, Homo sapiens
tctttgtggcttcc

SEQ ID NO: 2233715 - DNA, 17 bp, Homo sapiens
tcttttgccgttattaa

SEQ ID NO: 2233716 - DNA, 18 bp, Homo sapiens
tcttttttcggctaaaaa

SEQ ID NO: 2233717 - DNA, 17 bp, Homo sapiens
agaattctcttatccaa

SEQ ID NO: 2233718 - DNA, 17 bp, Homo sapiens
agaatttcccaaagcag

SEQ ID NO: 2233719 - DNA, 18 bp, Homo sapiens
agaatttcccaaagcagt

SEQ ID NO: 2233720 - DNA, 19 bp, Homo sapiens
agacaatgacttactgtac

SEQ ID NO: 2233721 - DNA, 22 bp, Homo sapiens
agacacaggcccggctccaggc

SEQ ID NO: 2233722 - DNA, 16 bp, Homo sapiens
agacacatgtccaaga

SEQ ID NO: 2233723 - DNA, 22 bp, Homo sapiens
agacacatgtccaagaagccca

SEQ ID NO: 2233724 - DNA, 24 bp, Homo sapiens
agacacatgtccaagaagcccagg

SEQ ID NO: 2233725 - DNA, 18 bp, Homo sapiens
agacaccttgacagggca

SEQ ID NO: 2233726 - DNA, 23 bp, Homo sapiens
agacagagtctcactgttgccca

SEQ ID NO: 2233727 - DNA, 14 bp, Homo sapiens
agacagcacaggca

SEQ ID NO: 2233728 - DNA, 18 bp, Homo sapiens
agacagcccgggctctgc

SEQ ID NO: 2233729 - DNA, 11 bp, Homo sapiens
agacagctctt

SEQ ID NO: 2233730 - DNA, 13 bp, Homo sapiens
agacagctgcctg

SEQ ID NO: 2233731 - DNA, 14 bp, Homo sapiens
agacagctgcctgg

SEQ ID NO: 2233732 - DNA, 16 bp, Homo sapiens
agacaggaccagggat

SEQ ID NO: 2233733 - DNA, 20 bp, Homo sapiens
agacaggcaagcacctcctg

SEQ ID NO: 2233734 - DNA, 14 bp, Homo sapiens
agacagtccctgcc

SEQ ID NO: 2233735 - DNA, 14 bp, Homo sapiens
agaccacgtttcta

SEQ ID NO: 2233736 - DNA, 13 bp, Homo sapiens
agaccatccctga

SEQ ID NO: 2233737 - DNA, 19 bp, Homo sapiens
agacccccttgcccaggcc

SEQ ID NO: 2233738 - DNA, 12 bp, Homo sapiens
agaccctgccct

SEQ ID NO: 2233739 - DNA, 13 bp, Homo sapiens
agaccctgccctg

SEQ ID NO: 2233740 - DNA, 14 bp, Homo sapiens
agaccctgccctgt

SEQ ID NO: 2233741 - DNA, 15 bp, Homo sapiens
agacccttgtggtcc

SEQ ID NO: 2233742 - DNA, 15 bp, Homo sapiens
agaccttctccttca

SEQ ID NO: 2233743 - DNA, 23 bp, Homo sapiens
agaccttctccttcacctttgtc

SEQ ID NO: 2233744 - DNA, 21 bp, Homo sapiens
agacgctgtgctgccctgccc

SEQ ID NO: 2233745 - DNA, 17 bp, Homo sapiens
agactatctaaatgttg

SEQ ID NO: 2233746 - DNA, 15 bp, Homo sapiens
agactcattcttctg

SEQ ID NO: 2233747 - DNA, 15 bp, Homo sapiens
agactcctgcaggca

SEQ ID NO: 2233748 - DNA, 20 bp, Homo sapiens
agactcctgcaggcagccag

SEQ ID NO: 2233749 - DNA, 17 bp, Homo sapiens
agactcgcgacaatgca

SEQ ID NO: 2233750 - DNA, 23 bp, Homo sapiens
agactgagtacgttgtgcatttg

SEQ ID NO: 2233751 - DNA, 14 bp, Homo sapiens
agactgtacaaagt

SEQ ID NO: 2233752 - DNA, 16 bp, Homo sapiens
agactgtacaaagtag

SEQ ID NO: 2233753 - DNA, 14 bp, Homo sapiens
agacttcatccctc

SEQ ID NO: 2233754 - DNA, 17 bp, Homo sapiens
agactttggaaagactt

SEQ ID NO: 2233755 - DNA, 15 bp, Homo sapiens
agactttggaaagag

SEQ ID NO: 2233756 - DNA, 19 bp, Homo sapiens
agactttggaaagagtagg

SEQ ID NO: 2233757 - DNA, 19 bp, Homo sapiens
agacttttctttcagccaa

SEQ ID NO: 2233758 - DNA, 22 bp, Homo sapiens
agagaaaaaatattttcctgcc

SEQ ID NO: 2233759 - DNA, 12 bp, Homo sapiens
agagaaagagag

SEQ ID NO: 2233760 - DNA, 14 bp, Homo sapiens
agagaaagagagag

SEQ ID NO: 2233761 - DNA, 10 bp, Homo sapiens
agagaagaga

SEQ ID NO: 2233762 - DNA, 21 bp, Homo sapiens
agagaaggggcccaagagaga

SEQ ID NO: 2233763 - DNA, 18 bp, Homo sapiens
agagaatgaaagggccca

SEQ ID NO: 2233764 - DNA, 15 bp, Homo sapiens
agagacacaagcctt

SEQ ID NO: 2233765 - DNA, 19 bp, Homo sapiens
agagacacaagccttcggc

SEQ ID NO: 2233766 - DNA, 15 bp, Homo sapiens
agagacagcacaggc

SEQ ID NO: 2233767 - DNA, 14 bp, Homo sapiens
agagaccatccctg

SEQ ID NO: 2233768 - DNA, 22 bp, Homo sapiens
agagaccatccctgaaggcccc

SEQ ID NO: 2233769 - DNA, 13 bp, Homo sapiens
agagagaaagaga

SEQ ID NO: 2233770 - DNA, 14 bp, Homo sapiens
agagagaaagagag

SEQ ID NO: 2233771 - DNA, 9 bp, Homo sapiens
agagagaag

SEQ ID NO: 2233772 - DNA, 13 bp, Homo sapiens
agagagacagcac

SEQ ID NO: 2233773 - DNA, 13 bp, Homo sapiens
agagagagagaag

SEQ ID NO: 2233774 - DNA, 15 bp, Homo sapiens
agagagagagagaga

SEQ ID NO: 2233775 - DNA, 11 bp, Homo sapiens
agagagcaaga

SEQ ID NO: 2233776 - DNA, 17 bp, Homo sapiens
agagatgtgcccccacc

SEQ ID NO: 2233777 - DNA, 18 bp, Homo sapiens
agagatgtgcccccaccc

SEQ ID NO: 2233778 - DNA, 20 bp, Homo sapiens
agagatgtgcccccaccccc

SEQ ID NO: 2233779 - DNA, 22 bp, Homo sapiens
agagcaccttagacagtccctg

SEQ ID NO: 2233780 - DNA, 20 bp, Homo sapiens
agagcagagaccatccctga

SEQ ID NO: 2233781 - DNA, 13 bp, Homo sapiens
agagcccaccttg

SEQ ID NO: 2233782 - DNA, 16 bp, Homo sapiens
agagcccacgccccca

SEQ ID NO: 2233783 - DNA, 13 bp, Homo sapiens
agagccttccagg

SEQ ID NO: 2233784 - DNA, 15 bp, Homo sapiens
agagccttccagggg

SEQ ID NO: 2233785 - DNA, 11 bp, Homo sapiens
agagccttgcg

SEQ ID NO: 2233786 - DNA, 14 bp, Homo sapiens
agagctgccacctg

SEQ ID NO: 2233787 - DNA, 18 bp, Homo sapiens
agagctgccacctgcctg

SEQ ID NO: 2233788 - DNA, 19 bp, Homo sapiens
agagctgggtgtcaagagg

SEQ ID NO: 2233789 - DNA, 12 bp, Homo sapiens
agaggaaagcaa

SEQ ID NO: 2233790 - DNA, 12 bp, Homo sapiens
agaggaaatcac

SEQ ID NO: 2233791 - DNA, 16 bp, Homo sapiens
agaggagagaggaccc

SEQ ID NO: 2233792 - DNA, 13 bp, Homo sapiens
agaggagaggggc

SEQ ID NO: 2233793 - DNA, 22 bp, Homo sapiens
agaggcagccccattctgcctg

SEQ ID NO: 2233794 - DNA, 10 bp, Homo sapiens
agaggcaggg

SEQ ID NO: 2233795 - DNA, 19 bp, Homo sapiens
agaggccatgggcctcctg

SEQ ID NO: 2233796 - DNA, 20 bp, Homo sapiens
agagggagggagggctccag

SEQ ID NO: 2233797 - DNA, 21 bp, Homo sapiens
agagggagggagggctccaga

SEQ ID NO: 2233798 - DNA, 22 bp, Homo sapiens
agagggtggtgacctctgcctg

SEQ ID NO: 2233799 - DNA, 16 bp, Homo sapiens
agaggtggggagcaga

SEQ ID NO: 2233800 - DNA, 16 bp, Homo sapiens
agaggttcaaagatat

SEQ ID NO: 2233801 - DNA, 19 bp, Homo sapiens
agaggttcaaagatatttt

SEQ ID NO: 2233802 - DNA, 13 bp, Homo sapiens
agagttgaagaca

SEQ ID NO: 2233803 - DNA, 20 bp, Homo sapiens
agagttgatactacagtttg

SEQ ID NO: 2233804 - DNA, 12 bp, Homo sapiens
agataaatgtgc

SEQ ID NO: 2233805 - DNA, 22 bp, Homo sapiens
agataatattaaggaagacaat

SEQ ID NO: 2233806 - DNA, 20 bp, Homo sapiens
agatacaggaaaagctgctg

SEQ ID NO: 2233807 - DNA, 13 bp, Homo sapiens
agatagccaaggc

SEQ ID NO: 2233808 - DNA, 19 bp, Homo sapiens
agatcaaccccttcgctcc

SEQ ID NO: 2233809 - DNA, 14 bp, Homo sapiens
agatcacgccactg

SEQ ID NO: 2233810 - DNA, 15 bp, Homo sapiens
agatcacgccactgc

SEQ ID NO: 2233811 - DNA, 18 bp, Homo sapiens
agatcacgccactgcact

SEQ ID NO: 2233812 - DNA, 18 bp, Homo sapiens
agatctctaacttcacca

SEQ ID NO: 2233813 - DNA, 18 bp, Homo sapiens
agatgacatctgtctagg

SEQ ID NO: 2233814 - DNA, 17 bp, Homo sapiens
agatgtgcccccacccc

SEQ ID NO: 2233815 - DNA, 19 bp, Homo sapiens
agattctttcctgaggctg

SEQ ID NO: 2233816 - DNA, 23 bp, Homo sapiens
agattgcaacaggctgggcttca

SEQ ID NO: 2233817 - DNA, 13 bp, Homo sapiens
agatttcactctc

SEQ ID NO: 2233818 - DNA, 17 bp, Homo sapiens
agatttcactctccttg

SEQ ID NO: 2233819 - DNA, 20 bp, Homo sapiens
agcaagacgctgtgctgccc

SEQ ID NO: 2233820 - DNA, 23 bp, Homo sapiens
agcaagacgctgtgctgccctgc

SEQ ID NO: 2233821 - DNA, 14 bp, Homo sapiens
agcaagtgagagct

SEQ ID NO: 2233822 - DNA, 15 bp, Homo sapiens
agcaagtgagagctg

SEQ ID NO: 2233823 - DNA, 23 bp, Homo sapiens
agcacacttgacatcaactgcat

SEQ ID NO: 2233824 - DNA, 14 bp, Homo sapiens
agcacagaccctgc

SEQ ID NO: 2233825 - DNA, 15 bp, Homo sapiens
agcacagaccctgcc

SEQ ID NO: 2233826 - DNA, 17 bp, Homo sapiens
agcacagaccctgccct

SEQ ID NO: 2233827 - DNA, 20 bp, Homo sapiens
agcacagaccctgccctgtg

SEQ ID NO: 2233828 - DNA, 12 bp, Homo sapiens
agcacaggcagc

SEQ ID NO: 2233829 - DNA, 16 bp, Homo sapiens
agcacatgcctctctc

SEQ ID NO: 2233830 - DNA, 14 bp, Homo sapiens
agcacctaggtggg

SEQ ID NO: 2233831 - DNA, 16 bp, Homo sapiens
agcacctaggtggggc

SEQ ID NO: 2233832 - DNA, 16 bp, Homo sapiens
agcacctcctgcctcg

SEQ ID NO: 2233833 - DNA, 20 bp, Homo sapiens
agcaccttagacagtccctg

SEQ ID NO: 2233834 - DNA, 21 bp, Homo sapiens
agcaccttagacagtccctgc

SEQ ID NO: 2233835 - DNA, 13 bp, Homo sapiens
agcacgatttctg

SEQ ID NO: 2233836 - DNA, 19 bp, Homo sapiens
agcactaaggtgtgctctg

SEQ ID NO: 2233837 - DNA, 12 bp, Homo sapiens
agcagaaatgcc

SEQ ID NO: 2233838 - DNA, 21 bp, Homo sapiens
agcagagaatgaaagggccca

SEQ ID NO: 2233839 - DNA, 14 bp, Homo sapiens
agcagagaattctc

SEQ ID NO: 2233840 - DNA, 14 bp, Homo sapiens
agcagagagagaga

SEQ ID NO: 2233841 - DNA, 22 bp, Homo sapiens
agcagagagagagagagagaaa

SEQ ID NO: 2233842 - DNA, 20 bp, Homo sapiens
agcagagcaccttagacagt

SEQ ID NO: 2233843 - DNA, 15 bp, Homo sapiens
agcagccacattcct

SEQ ID NO: 2233844 - DNA, 13 bp, Homo sapiens
agcaggacatgga

SEQ ID NO: 2233845 - DNA, 20 bp, Homo sapiens
agctgtgctctggacaggca

SEQ ID NO: 2233846 - DNA, 21 bp, Homo sapiens
agctgtgctctggacaggcat

SEQ ID NO: 2233847 - DNA, 23 bp, Homo sapiens
agctgtgctctggacaggcatgt

SEQ ID NO: 2233848 - DNA, 19 bp, Homo sapiens
agctgttactgtcttcagt

SEQ ID NO: 2233849 - DNA, 13 bp, Homo sapiens
agctgttcagctg

SEQ ID NO: 2233850 - DNA, 15 bp, Homo sapiens
agcttatctcagggg

SEQ ID NO: 2233851 - DNA, 16 bp, Homo sapiens
agctttgaaaattcag

SEQ ID NO: 2233852 - DNA, 19 bp, Homo sapiens
agctttgaaaattcagtgg

SEQ ID NO: 2233853 - DNA, 21 bp, Homo sapiens
agctttgtttgttgtcagctg

SEQ ID NO: 2233854 - DNA, 22 bp, Homo sapiens
agctttgtttgttgtcagctga

SEQ ID NO: 2233855 - DNA, 15 bp, Homo sapiens
aggaaacccagctct

SEQ ID NO: 2233856 - DNA, 17 bp, Homo sapiens
aggaaacccagctctgg

SEQ ID NO: 2233857 - DNA, 20 bp, Homo sapiens
aggaaacccagctctggtcc

SEQ ID NO: 2233858 - DNA, 13 bp, Homo sapiens
aggaaagaggctc

SEQ ID NO: 2233859 - DNA, 19 bp, Homo sapiens
aggaaatcaccgaaaacgt

SEQ ID NO: 2233860 - DNA, 13 bp, Homo sapiens
aggaacaaggcaa

SEQ ID NO: 2233861 - DNA, 19 bp, Homo sapiens
aggaacaaggcaaggctgt

SEQ ID NO: 2233862 - DNA, 23 bp, Homo sapiens
aggaacaaggcaaggctgtcaat

SEQ ID NO: 2233863 - DNA, 14 bp, Homo sapiens
aggaagactttgga

SEQ ID NO: 2233864 - DNA, 15 bp, Homo sapiens
aggaagactttggaa

SEQ ID NO: 2233865 - DNA, 16 bp, Homo sapiens
aggaagcacatgcctc

SEQ ID NO: 2233866 - DNA, 22 bp, Homo sapiens
aggaagcacatgcctctctcag

SEQ ID NO: 2233867 - DNA, 13 bp, Homo sapiens
aggaagccagcag

SEQ ID NO: 2233868 - DNA, 23 bp, Homo sapiens
aggaagccagcaggctctcaggc

SEQ ID NO: 2233869 - DNA, 13 bp, Homo sapiens
aggaagctcaggg

SEQ ID NO: 2233870 - DNA, 15 bp, Homo sapiens
aggaatacctgtccc

SEQ ID NO: 2233871 - DNA, 18 bp, Homo sapiens
aggacattgcggacagcc

SEQ ID NO: 2233872 - DNA, 20 bp, Homo sapiens
aggacccctccatgtgggct

SEQ ID NO: 2233873 - DNA, 13 bp, Homo sapiens
aggacctcaggtg

SEQ ID NO: 2233874 - DNA, 20 bp, Homo sapiens
aggacctcaggtgagaagca

SEQ ID NO: 2233875 - DNA, 23 bp, Homo sapiens
aggacttttctttgtggcttcct

SEQ ID NO: 2233876 - DNA, 17 bp, Homo sapiens
aggagattggaaggaac

SEQ ID NO: 2233877 - DNA, 13 bp, Homo sapiens
aggagcagccaca

SEQ ID NO: 2233878 - DNA, 17 bp, Homo sapiens
aggagccccgaggcctt

SEQ ID NO: 2233879 - DNA, 13 bp, Homo sapiens
aggaggaacaggt

SEQ ID NO: 2233880 - DNA, 14 bp, Homo sapiens
aggaggtctctaag

SEQ ID NO: 2233881 - DNA, 21 bp, Homo sapiens
aggagtttgagaccaacctgg

SEQ ID NO: 2233882 - DNA, 13 bp, Homo sapiens
aggatcagtctga

SEQ ID NO: 2233883 - DNA, 13 bp, Homo sapiens
aggatcctgagcc

SEQ ID NO: 2233884 - DNA, 14 bp, Homo sapiens
aggatcctgagcca

SEQ ID NO: 2233885 - DNA, 18 bp, Homo sapiens
aggatcctgagccagatt

SEQ ID NO: 2233886 - DNA, 12 bp, Homo sapiens
aggatctcttga

SEQ ID NO: 2233887 - DNA, 19 bp, Homo sapiens
aggatctcttgagcctggg

SEQ ID NO: 2233888 - DNA, 23 bp, Homo sapiens
aggatgatctaggaagactttgg

SEQ ID NO: 2233889 - DNA, 21 bp, Homo sapiens
aggatgcttgtacataatgcg

SEQ ID NO: 2233890 - DNA, 22 bp, Homo sapiens
aggatgttctagcatggctgcc

SEQ ID NO: 2233891 - DNA, 16 bp, Homo sapiens
aggatgttctgggaca

SEQ ID NO: 2233892 - DNA, 18 bp, Homo sapiens
aggatgttctgggacaca

SEQ ID NO: 2233893 - DNA, 20 bp, Homo sapiens
aggatgttctgggacacagt

SEQ ID NO: 2233894 - DNA, 12 bp, Homo sapiens
aggattcttcct

SEQ ID NO: 2233895 - DNA, 15 bp, Homo sapiens
aggattgctactgtc

SEQ ID NO: 2233896 - DNA, 19 bp, Homo sapiens
aggattttgatccaagctg

SEQ ID NO: 2233897 - DNA, 15 bp, Homo sapiens
aggcaatgctggctg

SEQ ID NO: 2233898 - DNA, 15 bp, Homo sapiens
aggcacccaccatca

SEQ ID NO: 2233899 - DNA, 13 bp, Homo sapiens
aggcagatacagg

SEQ ID NO: 2233900 - DNA, 15 bp, Homo sapiens
aggcagccaggccac

SEQ ID NO: 2233901 - DNA, 12 bp, Homo sapiens
aggcaggatggc

SEQ ID NO: 2233902 - DNA, 12 bp, Homo sapiens
aggcagggtctc

SEQ ID NO: 2233903 - DNA, 20 bp, Homo sapiens
aggcagggtctcactctgtc

SEQ ID NO: 2233904 - DNA, 21 bp, Homo sapiens
aggcagggtctcactctgtcg

SEQ ID NO: 2233905 - DNA, 14 bp, Homo sapiens
aggcaggtccaggg

SEQ ID NO: 2233906 - DNA, 24 bp, Homo sapiens
aggcagtggggctggaagcagaaa

SEQ ID NO: 2233907 - DNA, 17 bp, Homo sapiens
aggcatgtgatgagagg

SEQ ID NO: 2233908 - DNA, 19 bp, Homo sapiens
aggcatgtgatgagaggaa

SEQ ID NO: 2233909 - DNA, 12 bp, Homo sapiens
aggcatgttctc

SEQ ID NO: 2233910 - DNA, 17 bp, Homo sapiens
aggcatgttctctgagg

SEQ ID NO: 2233911 - DNA, 18 bp, Homo sapiens
aggcatgttctctgagga

SEQ ID NO: 2233912 - DNA, 23 bp, Homo sapiens
aggcattccccaggaggccagcc

SEQ ID NO: 2233913 - DNA, 18 bp, Homo sapiens
aggcattgtgggaagggg

SEQ ID NO: 2233914 - DNA, 20 bp, Homo sapiens
aggcatttgctgaatacaga

SEQ ID NO: 2233915 - DNA, 18 bp, Homo sapiens
aggcatttgtttgaactg

SEQ ID NO: 2233916 - DNA, 18 bp, Homo sapiens
aggccaaaggaagcacat

SEQ ID NO: 2233917 - DNA, 23 bp, Homo sapiens
aggccaaaggaagcacatgcctc

SEQ ID NO: 2233918 - DNA, 17 bp, Homo sapiens
aggccacaagacccttg

SEQ ID NO: 2233919 - DNA, 12 bp, Homo sapiens
aggccagagaca

SEQ ID NO: 2233920 - DNA, 14 bp, Homo sapiens
aggccagagggagt

SEQ ID NO: 2233921 - DNA, 14 bp, Homo sapiens
aggccagctgcttg

SEQ ID NO: 2233922 - DNA, 20 bp, Homo sapiens
aggcccagagggcctgcaag

SEQ ID NO: 2233923 - DNA, 12 bp, Homo sapiens
aggcccctgcca

SEQ ID NO: 2233924 - DNA, 17 bp, Homo sapiens
aggcccctgccaccctg

SEQ ID NO: 2233925 - DNA, 20 bp, Homo sapiens
aggccctctgcccactccct

SEQ ID NO: 2233926 - DNA, 21 bp, Homo sapiens
aggccctctgcccactccctg

SEQ ID NO: 2233927 - DNA, 15 bp, Homo sapiens
aggcccttctctcca

SEQ ID NO: 2233928 - DNA, 19 bp, Homo sapiens
aggcccttctctccagccc

SEQ ID NO: 2233929 - DNA, 20 bp, Homo sapiens
aggcccttctctccagcccc

SEQ ID NO: 2233930 - DNA, 23 bp, Homo sapiens
aggcccttctctccagcccctgg

SEQ ID NO: 2233931 - DNA, 12 bp, Homo sapiens
aggcctccccag

SEQ ID NO: 2233932 - DNA, 13 bp, Homo sapiens
aggcctccccagc

SEQ ID NO: 2233933 - DNA, 13 bp, Homo sapiens
aggcctggccaga

SEQ ID NO: 2233934 - DNA, 23 bp, Homo sapiens
aggcctggccagatgcaccagcc

SEQ ID NO: 2233935 - DNA, 20 bp, Homo sapiens
aggcctgggggctgggcaga

SEQ ID NO: 2233936 - DNA, 23 bp, Homo sapiens
aggcctgggggctgggcagagga

SEQ ID NO: 2233937 - DNA, 16 bp, Homo sapiens
aggctccaggagcagc

SEQ ID NO: 2233938 - DNA, 12 bp, Homo sapiens
aggctcgagcat

SEQ ID NO: 2233939 - DNA, 15 bp, Homo sapiens
aggctcgagcatgcc

SEQ ID NO: 2233940 - DNA, 19 bp, Homo sapiens
aggctctcaggccagctgc

SEQ ID NO: 2233941 - DNA, 15 bp, Homo sapiens
aggctctgcccttgg

SEQ ID NO: 2233942 - DNA, 18 bp, Homo sapiens
aggctggcgtgcagtggt

SEQ ID NO: 2233943 - DNA, 20 bp, Homo sapiens
aggctggcgtgcagtggtgc

SEQ ID NO: 2233944 - DNA, 13 bp, Homo sapiens
aggctgggctccc

SEQ ID NO: 2233945 - DNA, 14 bp, Homo sapiens
aggctgggcttcag

SEQ ID NO: 2233946 - DNA, 18 bp, Homo sapiens
aggctgggcttcagtggc

SEQ ID NO: 2233947 - DNA, 22 bp, Homo sapiens
aggctgggcttcagtggcagct

SEQ ID NO: 2233948 - DNA, 22 bp, Homo sapiens
aggctgggggaagaagctctct

SEQ ID NO: 2233949 - DNA, 17 bp, Homo sapiens
aggcttagtcactgaga

SEQ ID NO: 2233950 - DNA, 18 bp, Homo sapiens
aggcttagtcactgagac

SEQ ID NO: 2233951 - DNA, 21 bp, Homo sapiens
aggcttagtcactgagacagc

SEQ ID NO: 2233952 - DNA, 13 bp, Homo sapiens
agtgaggctctgc

SEQ ID NO: 2233953 - DNA, 16 bp, Homo sapiens
agtgaggctctgccct

SEQ ID NO: 2233954 - DNA, 17 bp, Homo sapiens
agtgaggctctgccctt

SEQ ID NO: 2233955 - DNA, 21 bp, Homo sapiens
agtgagttgatagcacagacc

SEQ ID NO: 2233956 - DNA, 23 bp, Homo sapiens
agtgagttgatagcacagaccct

SEQ ID NO: 2233957 - DNA, 20 bp, Homo sapiens
agtgatcctcccacctcagc

SEQ ID NO: 2233958 - DNA, 15 bp, Homo sapiens
agtgattctcctgcc

SEQ ID NO: 2233959 - DNA, 18 bp, Homo sapiens
agtgattctcctgcctca

SEQ ID NO: 2233960 - DNA, 14 bp, Homo sapiens
agtgcatgctgtcc

SEQ ID NO: 2233961 - DNA, 16 bp, Homo sapiens
agtgcatgctgtccct

SEQ ID NO: 2233962 - DNA, 14 bp, Homo sapiens
agtgccaaaaacaa

SEQ ID NO: 2233963 - DNA, 16 bp, Homo sapiens
agtgccaaaaacaaca

SEQ ID NO: 2233964 - DNA, 15 bp, Homo sapiens
agtgccttacacaat

SEQ ID NO: 2233965 - DNA, 10 bp, Homo sapiens
agtgccttat

SEQ ID NO: 2233966 - DNA, 13 bp, Homo sapiens
agtgccttatgga

SEQ ID NO: 2233967 - DNA, 16 bp, Homo sapiens
agtgccttatggaaca

SEQ ID NO: 2233968 - DNA, 17 bp, Homo sapiens
agtgctgcatttaaaag

SEQ ID NO: 2233969 - DNA, 16 bp, Homo sapiens
agtgcttccaaggatg

SEQ ID NO: 2233970 - DNA, 11 bp, Homo sapiens
agtggaaaaat

SEQ ID NO: 2233971 - DNA, 18 bp, Homo sapiens
agtggaaaaatagcctgc

SEQ ID NO: 2233972 - DNA, 19 bp, Homo sapiens
agtggaaaaatagcctgcc

SEQ ID NO: 2233973 - DNA, 13 bp, Homo sapiens
agtggcagctgct

SEQ ID NO: 2233974 - DNA, 23 bp, Homo sapiens
agtggcttaaaacaacactcaca

SEQ ID NO: 2233975 - DNA, 16 bp, Homo sapiens
agtgggagctgcctgt

SEQ ID NO: 2233976 - DNA, 18 bp, Homo sapiens
agtggggctggaagcaga

SEQ ID NO: 2233977 - DNA, 22 bp, Homo sapiens
agtggggctggaagcagaaaca

SEQ ID NO: 2233978 - DNA, 18 bp, Homo sapiens
agtggtggttttctgttc

SEQ ID NO: 2233979 - DNA, 22 bp, Homo sapiens
agtgtacatggaataacatgta

SEQ ID NO: 2233980 - DNA, 17 bp, Homo sapiens
agcaggctcgggctccc

SEQ ID NO: 2233981 - DNA, 13 bp, Homo sapiens
agcaggctctcag

SEQ ID NO: 2233982 - DNA, 15 bp, Homo sapiens
agcaggctctcaggc

SEQ ID NO: 2233983 - DNA, 13 bp, Homo sapiens
agcagggaaacag

SEQ ID NO: 2233984 - DNA, 14 bp, Homo sapiens
agcagggaaacagc

SEQ ID NO: 2233985 - DNA, 14 bp, Homo sapiens
agcagggctcagcg

SEQ ID NO: 2233986 - DNA, 13 bp, Homo sapiens
agcagtgcatgct

SEQ ID NO: 2233987 - DNA, 17 bp, Homo sapiens
agcagtgcatgctgtcc

SEQ ID NO: 2233988 - DNA, 18 bp, Homo sapiens
agcagtgcatgctgtccc

SEQ ID NO: 2233989 - DNA, 15 bp, Homo sapiens
agcatacgtacacat

SEQ ID NO: 2233990 - DNA, 19 bp, Homo sapiens
agcatacgtacacatttta

SEQ ID NO: 2233991 - DNA, 14 bp, Homo sapiens
agcatattcaggaa

SEQ ID NO: 2233992 - DNA, 16 bp, Homo sapiens
agcatattcaggaagc

SEQ ID NO: 2233993 - DNA, 21 bp, Homo sapiens
agcatattcaggaagctcagg

SEQ ID NO: 2233994 - DNA, 14 bp, Homo sapiens
agcatcaggccagg

SEQ ID NO: 2233995 - DNA, 16 bp, Homo sapiens
agcatcaggccaggcc

SEQ ID NO: 2233996 - DNA, 12 bp, Homo sapiens
agcatgcctgga

SEQ ID NO: 2233997 - DNA, 15 bp, Homo sapiens
agcattttgctaaat

SEQ ID NO: 2233998 - DNA, 23 bp, Homo sapiens
agccaaggccaaaggaagcacat

SEQ ID NO: 2233999 - DNA, 14 bp, Homo sapiens
agccacagggtgag

SEQ ID NO: 2234000 - DNA, 16 bp, Homo sapiens
agccacagggtgagca

SEQ ID NO: 2234001 - DNA, 22 bp, Homo sapiens
agccacagggtgagcactctgg

SEQ ID NO: 2234002 - DNA, 18 bp, Homo sapiens
agccacattcctgatgct

SEQ ID NO: 2234003 - DNA, 19 bp, Homo sapiens
agccaccaacatactccca

SEQ ID NO: 2234004 - DNA, 23 bp, Homo sapiens
agccaccaacatactcccatctg

SEQ ID NO: 2234005 - DNA, 18 bp, Homo sapiens
agccacggccaggccaga

SEQ ID NO: 2234006 - DNA, 16 bp, Homo sapiens
agccactgcaccgggc

SEQ ID NO: 2234007 - DNA, 18 bp, Homo sapiens
agccagaggagagaggac

SEQ ID NO: 2234008 - DNA, 16 bp, Homo sapiens
agccagcaggctctca

SEQ ID NO: 2234009 - DNA, 18 bp, Homo sapiens
agccagcaggctctcagg

SEQ ID NO: 2234010 - DNA, 21 bp, Homo sapiens
agccagcaggctctcaggcca

SEQ ID NO: 2234011 - DNA, 23 bp, Homo sapiens
agccagcaggctctcaggccagc

SEQ ID NO: 2234012 - DNA, 23 bp, Homo sapiens
agccagtaaatgggggtgcattt

SEQ ID NO: 2234013 - DNA, 23 bp, Homo sapiens
agcccacccctcaacacctctgc

SEQ ID NO: 2234014 - DNA, 17 bp, Homo sapiens
agcccacgcccccactg

SEQ ID NO: 2234015 - DNA, 18 bp, Homo sapiens
agcccacgcccccactgg

SEQ ID NO: 2234016 - DNA, 18 bp, Homo sapiens
agcccaggaaaggctcca

SEQ ID NO: 2234017 - DNA, 20 bp, Homo sapiens
agccccaaaactctcctctg

SEQ ID NO: 2234018 - DNA, 21 bp, Homo sapiens
agccccaaaactctcctctgc

SEQ ID NO: 2234019 - DNA, 14 bp, Homo sapiens
agccccagtgccca

SEQ ID NO: 2234020 - DNA, 15 bp, Homo sapiens
agccccagtgcccac

SEQ ID NO: 2234021 - DNA, 11 bp, Homo sapiens
agccccatcct

SEQ ID NO: 2234022 - DNA, 16 bp, Homo sapiens
agccccattctgcctg

SEQ ID NO: 2234023 - DNA, 21 bp, Homo sapiens
agccccattctgcctgcccag

SEQ ID NO: 2234024 - DNA, 22 bp, Homo sapiens
agccccattctgcctgcccagg

SEQ ID NO: 2234025 - DNA, 14 bp, Homo sapiens
agccccgaggcctt

SEQ ID NO: 2234026 - DNA, 22 bp, Homo sapiens
agcccctggatgcagcctcaca

SEQ ID NO: 2234027 - DNA, 13 bp, Homo sapiens
agcccgggctctg

SEQ ID NO: 2234028 - DNA, 15 bp, Homo sapiens
agcccgggctctgcc

SEQ ID NO: 2234029 - DNA, 16 bp, Homo sapiens
agcccgggctctgcct

SEQ ID NO: 2234030 - DNA, 20 bp, Homo sapiens
agcccgggctctgcctccca

SEQ ID NO: 2234031 - DNA, 15 bp, Homo sapiens
agccctgagctttct

SEQ ID NO: 2234032 - DNA, 14 bp, Homo sapiens
agccctgcagaggg

SEQ ID NO: 2234033 - DNA, 22 bp, Homo sapiens
agccctggtggcagtgggagct

SEQ ID NO: 2234034 - DNA, 23 bp, Homo sapiens
agccctggtggcagtgggagctg

SEQ ID NO: 2234035 - DNA, 16 bp, Homo sapiens
agcccttagcagggaa

SEQ ID NO: 2234036 - DNA, 20 bp, Homo sapiens
agccgagatagccaaggcca

SEQ ID NO: 2234037 - DNA, 21 bp, Homo sapiens
agccgagatagccaaggccaa

SEQ ID NO: 2234038 - DNA, 19 bp, Homo sapiens
agccgagatcacgccactg

SEQ ID NO: 2234039 - DNA, 14 bp, Homo sapiens
agccgctggggcca

SEQ ID NO: 2234040 - DNA, 20 bp, Homo sapiens
agcctcaacctcctgggcta

SEQ ID NO: 2234041 - DNA, 14 bp, Homo sapiens
agcctcagcatcct

SEQ ID NO: 2234042 - DNA, 16 bp, Homo sapiens
agcctcagcatcctgg

SEQ ID NO: 2234043 - DNA, 17 bp, Homo sapiens
agcctcagcatcctggc

SEQ ID NO: 2234044 - DNA, 20 bp, Homo sapiens
agcctcagcatcctggcacc

SEQ ID NO: 2234045 - DNA, 23 bp, Homo sapiens
agcctcagcatcctggcacccgg

SEQ ID NO: 2234046 - DNA, 17 bp, Homo sapiens
agcctcccaaagtgctg

SEQ ID NO: 2234047 - DNA, 20 bp, Homo sapiens
agcctcccgaatagctggga

SEQ ID NO: 2234048 - DNA, 20 bp, Homo sapiens
agcctcccgagtagctggga

SEQ ID NO: 2234049 - DNA, 14 bp, Homo sapiens
agcctcctgccctt

SEQ ID NO: 2234050 - DNA, 16 bp, Homo sapiens
agcctgcctcttctct

SEQ ID NO: 2234051 - DNA, 19 bp, Homo sapiens
agcctgcctcttctctact

SEQ ID NO: 2234052 - DNA, 17 bp, Homo sapiens
agcctgctccagctgtt

SEQ ID NO: 2234053 - DNA, 18 bp, Homo sapiens
agcctgggcaatgtgata

SEQ ID NO: 2234054 - DNA, 22 bp, Homo sapiens
agcctgggtgacagagcaagtg

SEQ ID NO: 2234055 - DNA, 17 bp, Homo sapiens
agcctgtgcctctggga

SEQ ID NO: 2234056 - DNA, 18 bp, Homo sapiens
agcctgtgcctctgggac

SEQ ID NO: 2234057 - DNA, 19 bp, Homo sapiens
agcctgtgcctctgggact

SEQ ID NO: 2234058 - DNA, 22 bp, Homo sapiens
agccttagaagtcacacagtat

SEQ ID NO: 2234059 - DNA, 11 bp, Homo sapiens
agccttccagg

SEQ ID NO: 2234060 - DNA, 14 bp, Homo sapiens
agccttccaggggt

SEQ ID NO: 2234061 - DNA, 17 bp, Homo sapiens
agcgattcttctgcttc

SEQ ID NO: 2234062 - DNA, 22 bp, Homo sapiens
agcgattcttctgcttcagcct

SEQ ID NO: 2234063 - DNA, 22 bp, Homo sapiens
agcgcccagttgggtggatgcc

SEQ ID NO: 2234064 - DNA, 23 bp, Homo sapiens
agcggctggcagcccacccctca

SEQ ID NO: 2234065 - DNA, 17 bp, Homo sapiens
agcgtgagccactgcac

SEQ ID NO: 2234066 - DNA, 20 bp, Homo sapiens
agcgtggtggacatgcacag

SEQ ID NO: 2234067 - DNA, 13 bp, Homo sapiens
agctaatgggaca

SEQ ID NO: 2234068 - DNA, 14 bp, Homo sapiens
agctaggcctggcc

SEQ ID NO: 2234069 - DNA, 13 bp, Homo sapiens
agctcaccagccc

SEQ ID NO: 2234070 - DNA, 14 bp, Homo sapiens
agctcaccagcccc

SEQ ID NO: 2234071 - DNA, 15 bp, Homo sapiens
agctcaccagcccca

SEQ ID NO: 2234072 - DNA, 20 bp, Homo sapiens
agctcaccagccccagtgcc

SEQ ID NO: 2234073 - DNA, 12 bp, Homo sapiens
agctcacctctc

SEQ ID NO: 2234074 - DNA, 19 bp, Homo sapiens
agctcacctctcccttgga

SEQ ID NO: 2234075 - DNA, 12 bp, Homo sapiens
agctcagggcct

SEQ ID NO: 2234076 - DNA, 18 bp, Homo sapiens
agctcagggcctggctca

SEQ ID NO: 2234077 - DNA, 20 bp, Homo sapiens
agctcaggtgtccctgcact

SEQ ID NO: 2234078 - DNA, 21 bp, Homo sapiens
agctcaggtgtccctgcactt

SEQ ID NO: 2234079 - DNA, 21 bp, Homo sapiens
agctcattctccttgtgttac

SEQ ID NO: 2234080 - DNA, 19 bp, Homo sapiens
agctccaagctcccaggca

SEQ ID NO: 2234081 - DNA, 21 bp, Homo sapiens
agctccagctcaccagcccca

SEQ ID NO: 2234082 - DNA, 23 bp, Homo sapiens
agctcccaggcattccccaggag

SEQ ID NO: 2234083 - DNA, 13 bp, Homo sapiens
agctccttctgtc

SEQ ID NO: 2234084 - DNA, 21 bp, Homo sapiens
agctccttctgtcctactctg

SEQ ID NO: 2234085 - DNA, 16 bp, Homo sapiens
agctctctcctccctt

SEQ ID NO: 2234086 - DNA, 21 bp, Homo sapiens
agctctgtcctgggagtgagc

SEQ ID NO: 2234087 - DNA, 23 bp, Homo sapiens
agctctgtcctgggagtgagctg

SEQ ID NO: 2234088 - DNA, 17 bp, Homo sapiens
agctcttctccaggctg

SEQ ID NO: 2234089 - DNA, 18 bp, Homo sapiens
agctcttctccaggctgt

SEQ ID NO: 2234090 - DNA, 15 bp, Homo sapiens
agctgaacctgggta

SEQ ID NO: 2234091 - DNA, 21 bp, Homo sapiens
agctgacttttctgtccgagc

SEQ ID NO: 2234092 - DNA, 18 bp, Homo sapiens
agctgcaccctcaggcag

SEQ ID NO: 2234093 - DNA, 21 bp, Homo sapiens
agctgcctgggatccctcatc

SEQ ID NO: 2234094 - DNA, 14 bp, Homo sapiens
agctgcctgttcag

SEQ ID NO: 2234095 - DNA, 19 bp, Homo sapiens
agctgcctgttcagctcca

SEQ ID NO: 2234096 - DNA, 23 bp, Homo sapiens
agctgcggtccacccaggagccc

SEQ ID NO: 2234097 - DNA, 20 bp, Homo sapiens
agctgcttgggcttcatcct

SEQ ID NO: 2234098 - DNA, 16 bp, Homo sapiens
agctgggactacaggc

SEQ ID NO: 2234099 - DNA, 19 bp, Homo sapiens
agctgggactacaggtgtg

SEQ ID NO: 2234100 - DNA, 22 bp, Homo sapiens
agctggggtggggacctcaggc

SEQ ID NO: 2234101 - DNA, 17 bp, Homo sapiens
agctgggtgtcaagagg

SEQ ID NO: 2234102 - DNA, 15 bp, Homo sapiens
agctggtcccactca

SEQ ID NO: 2234103 - DNA, 19 bp, Homo sapiens
agctggtcccactcagtcc

SEQ ID NO: 2234104 - DNA, 21 bp, Homo sapiens
agctggtcccactcagtccat

SEQ ID NO: 2234105 - DNA, 19 bp, Homo sapiens
agctgtgctctggacaggc

SEQ ID NO: 2234106 - DNA, 19 bp, Homo sapiens
cagcttgaccgtgaggcca

SEQ ID NO: 2234107 - DNA, 20 bp, Homo sapiens
cagcttgaccgtgaggccag

SEQ ID NO: 2234108 - DNA, 14 bp, Homo sapiens
cagcttgagggttg

SEQ ID NO: 2234109 - DNA, 15 bp, Homo sapiens
cagcttgagggttgg

SEQ ID NO: 2234110 - DNA, 20 bp, Homo sapiens
cagcttgtaaatagctcagg

SEQ ID NO: 2234111 - DNA, 19 bp, Homo sapiens
caggaaaagctgctgacag

SEQ ID NO: 2234112 - DNA, 14 bp, Homo sapiens
caggaaaggctcca

SEQ ID NO: 2234113 - DNA, 15 bp, Homo sapiens
caggaaaggctccag

SEQ ID NO: 2234114 - DNA, 19 bp, Homo sapiens
caggaaaggctccaggagc

SEQ ID NO: 2234115 - DNA, 20 bp, Homo sapiens
caggaaaggctccaggagca

SEQ ID NO: 2234116 - DNA, 18 bp, Homo sapiens
caggaagccagcaggctc

SEQ ID NO: 2234117 - DNA, 14 bp, Homo sapiens
caggaagctcaggg

SEQ ID NO: 2234118 - DNA, 16 bp, Homo sapiens
caggaagctcagggcc

SEQ ID NO: 2234119 - DNA, 17 bp, Homo sapiens
caggaagctcagggcct

SEQ ID NO: 2234120 - DNA, 22 bp, Homo sapiens
caggaagctcagggcctggctc

SEQ ID NO: 2234121 - DNA, 23 bp, Homo sapiens
caggaagctcagggcctggctca

SEQ ID NO: 2234122 - DNA, 17 bp, Homo sapiens
caggaagtactggagaa

SEQ ID NO: 2234123 - DNA, 20 bp, Homo sapiens
caggaagtactggagaaaat

SEQ ID NO: 2234124 - DNA, 13 bp, Homo sapiens
caggaccagggat

SEQ ID NO: 2234125 - DNA, 13 bp, Homo sapiens
caggagcagccac

SEQ ID NO: 2234126 - DNA, 15 bp, Homo sapiens
caggagccccgaggc

SEQ ID NO: 2234127 - DNA, 20 bp, Homo sapiens
caggagccccgaggccttct

SEQ ID NO: 2234128 - DNA, 22 bp, Homo sapiens
caggagccccgaggccttctct

SEQ ID NO: 2234129 - DNA, 17 bp, Homo sapiens
caggagcctcctgccct

SEQ ID NO: 2234130 - DNA, 20 bp, Homo sapiens
caggagcctcctgcccttac

SEQ ID NO: 2234131 - DNA, 13 bp, Homo sapiens
caggaggccagcc

SEQ ID NO: 2234132 - DNA, 17 bp, Homo sapiens
caggaggccagccttga

SEQ ID NO: 2234133 - DNA, 13 bp, Homo sapiens
caggatcagtctg

SEQ ID NO: 2234134 - DNA, 14 bp, Homo sapiens
caggatcagtctga

SEQ ID NO: 2234135 - DNA, 18 bp, Homo sapiens
caggattcttcctccctc

SEQ ID NO: 2234136 - DNA, 14 bp, Homo sapiens
caggcaagcacctc

SEQ ID NO: 2234137 - DNA, 21 bp, Homo sapiens
caggcaagcacctcctgcctc

SEQ ID NO: 2234138 - DNA, 14 bp, Homo sapiens
caggcaatgctggc

SEQ ID NO: 2234139 - DNA, 16 bp, Homo sapiens
caggcaatgctggctg

SEQ ID NO: 2234140 - DNA, 17 bp, Homo sapiens
caggcaatgctggctgt

SEQ ID NO: 2234141 - DNA, 18 bp, Homo sapiens
caggcacccaccatcatg

SEQ ID NO: 2234142 - DNA, 22 bp, Homo sapiens
caggcacccaccatcatgtctg

SEQ ID NO: 2234143 - DNA, 18 bp, Homo sapiens
caggcagatacaggaaaa

SEQ ID NO: 2234144 - DNA, 16 bp, Homo sapiens
caggcagccaggccac

SEQ ID NO: 2234145 - DNA, 17 bp, Homo sapiens
caggcagccaggccaca

SEQ ID NO: 2234146 - DNA, 19 bp, Homo sapiens
caggcaggtccagggtttg

SEQ ID NO: 2234147 - DNA, 23 bp, Homo sapiens
caggcaggtcttgaactcctggc

SEQ ID NO: 2234148 - DNA, 22 bp, Homo sapiens
caggcagtggggctggaagcag

SEQ ID NO: 2234149 - DNA, 20 bp, Homo sapiens
caggcatgttctctgaggac

SEQ ID NO: 2234150 - DNA, 13 bp, Homo sapiens
caggcattcccca

SEQ ID NO: 2234151 - DNA, 20 bp, Homo sapiens
caggcattccccaggaggcc

SEQ ID NO: 2234152 - DNA, 21 bp, Homo sapiens
caggcattccccaggaggcca

SEQ ID NO: 2234153 - DNA, 22 bp, Homo sapiens
caggcattccccaggaggccag

SEQ ID NO: 2234154 - DNA, 23 bp, Homo sapiens
caggcattccccaggaggccagc

SEQ ID NO: 2234155 - DNA, 24 bp, Homo sapiens
caggcattccccaggaggccagcc

SEQ ID NO: 2234156 - DNA, 23 bp, Homo sapiens
caggccaaactcacctgcccctc

SEQ ID NO: 2234157 - DNA, 20 bp, Homo sapiens
caggccacaagacccttgtg

SEQ ID NO: 2234158 - DNA, 13 bp, Homo sapiens
caggccagaggga

SEQ ID NO: 2234159 - DNA, 23 bp, Homo sapiens
caggccagagggagtgacagagg

SEQ ID NO: 2234160 - DNA, 15 bp, Homo sapiens
caggccaggccctct

SEQ ID NO: 2234161 - DNA, 17 bp, Homo sapiens
caggccaggccctctgc

SEQ ID NO: 2234162 - DNA, 18 bp, Homo sapiens
caggccaggccctctgcc

SEQ ID NO: 2234163 - DNA, 19 bp, Homo sapiens
caggcccctgccaccctgg

SEQ ID NO: 2234164 - DNA, 14 bp, Homo sapiens
caggcccggctcca

SEQ ID NO: 2234165 - DNA, 15 bp, Homo sapiens
caggcccggctccag

SEQ ID NO: 2234166 - DNA, 17 bp, Homo sapiens
caggccctctgcccact

SEQ ID NO: 2234167 - DNA, 21 bp, Homo sapiens
caggccctctgcccactccct

SEQ ID NO: 2234168 - DNA, 14 bp, Homo sapiens
caggcctcctacag

SEQ ID NO: 2234169 - DNA, 21 bp, Homo sapiens
caggctcctttagcgcccagt

SEQ ID NO: 2234170 - DNA, 20 bp, Homo sapiens
caggctcgggctccccagcc

SEQ ID NO: 2234171 - DNA, 13 bp, Homo sapiens
caggctctcaggc

SEQ ID NO: 2234172 - DNA, 15 bp, Homo sapiens
caggctggcgtgcag

SEQ ID NO: 2234173 - DNA, 15 bp, Homo sapiens
caggctgggagagcc

SEQ ID NO: 2234174 - DNA, 16 bp, Homo sapiens
caggctgggagagcct

SEQ ID NO: 2234175 - DNA, 19 bp, Homo sapiens
caggctgggagagccttcc

SEQ ID NO: 2234176 - DNA, 20 bp, Homo sapiens
caggctgggagagccttcca

SEQ ID NO: 2234177 - DNA, 22 bp, Homo sapiens
caggctgggagagccttccagg

SEQ ID NO: 2234178 - DNA, 23 bp, Homo sapiens
caggctgggagagccttccaggg

SEQ ID NO: 2234179 - DNA, 21 bp, Homo sapiens
caggctgggctgttcactctc

SEQ ID NO: 2234180 - DNA, 15 bp, Homo sapiens
caggctgggcttcag

SEQ ID NO: 2234181 - DNA, 16 bp, Homo sapiens
caggctgggcttcagt

SEQ ID NO: 2234182 - DNA, 17 bp, Homo sapiens
caggcttagtcactgag

SEQ ID NO: 2234183 - DNA, 20 bp, Homo sapiens
cagggacagagggggtggcc

SEQ ID NO: 2234184 - DNA, 18 bp, Homo sapiens
cagggaggtgaccccagg

SEQ ID NO: 2234185 - DNA, 17 bp, Homo sapiens
cagggcacaccgggcac

SEQ ID NO: 2234186 - DNA, 19 bp, Homo sapiens
cagggcctggctcaggtgg

SEQ ID NO: 2234187 - DNA, 20 bp, Homo sapiens
cagggctcagcggggacagc

SEQ ID NO: 2234188 - DNA, 17 bp, Homo sapiens
cagggggtgccctccca

SEQ ID NO: 2234189 - DNA, 22 bp, Homo sapiens
cagggggtgccctcccagaccc

SEQ ID NO: 2234190 - DNA, 15 bp, Homo sapiens
caggggtgggacacc

SEQ ID NO: 2234191 - DNA, 21 bp, Homo sapiens
cagggtattccagagtgggga

SEQ ID NO: 2234192 - DNA, 18 bp, Homo sapiens
cagggtccctggtggcag

SEQ ID NO: 2234193 - DNA, 19 bp, Homo sapiens
cagggtccctggtggcagc

SEQ ID NO: 2234194 - DNA, 23 bp, Homo sapiens
cagggtccctggtggcagctcac

SEQ ID NO: 2234195 - DNA, 16 bp, Homo sapiens
cagggtctcactctgt

SEQ ID NO: 2234196 - DNA, 17 bp, Homo sapiens
cagggtctcactctgtc

SEQ ID NO: 2234197 - DNA, 21 bp, Homo sapiens
cagggtctcactctgtcgccc

SEQ ID NO: 2234198 - DNA, 15 bp, Homo sapiens
cagggttggcccctg

SEQ ID NO: 2234199 - DNA, 21 bp, Homo sapiens
cagggttggcccctgcccggc

SEQ ID NO: 2234200 - DNA, 21 bp, Homo sapiens
caggtcttgaactcctggcct

SEQ ID NO: 2234201 - DNA, 23 bp, Homo sapiens
caggtcttgaactcctggcctca

SEQ ID NO: 2234202 - DNA, 21 bp, Homo sapiens
caggtgagaagcagaggaagg

SEQ ID NO: 2234203 - DNA, 16 bp, Homo sapiens
caggtgatccacccac

SEQ ID NO: 2234204 - DNA, 17 bp, Homo sapiens
caggtgatccacccacc

SEQ ID NO: 2234205 - DNA, 23 bp, Homo sapiens
caggtgatccacccacctcagcc

SEQ ID NO: 2234206 - DNA, 17 bp, Homo sapiens
caggtgcacaagctcca

SEQ ID NO: 2234207 - DNA, 18 bp, Homo sapiens
caggtgcacaagctccaa

SEQ ID NO: 2234208 - DNA, 19 bp, Homo sapiens
caggtgcacaagctccaag

SEQ ID NO: 2234209 - DNA, 20 bp, Homo sapiens
caggtgcacaagctccaagc

SEQ ID NO: 2234210 - DNA, 20 bp, Homo sapiens
caggtgctaggaacactcct

SEQ ID NO: 2234211 - DNA, 14 bp, Homo sapiens
caggtgctgccatc

SEQ ID NO: 2234212 - DNA, 14 bp, Homo sapiens
caggtggggcagct

SEQ ID NO: 2234213 - DNA, 20 bp, Homo sapiens
caggtggggtcactctggca

SEQ ID NO: 2234214 - DNA, 22 bp, Homo sapiens
caggtggggtcactctggcagc

SEQ ID NO: 2234215 - DNA, 18 bp, Homo sapiens
caggtggttatggagagg

SEQ ID NO: 2234216 - DNA, 20 bp, Homo sapiens
caggtggttatggagagggt

SEQ ID NO: 2234217 - DNA, 19 bp, Homo sapiens
caggtgtgaaccaccacac

SEQ ID NO: 2234218 - DNA, 21 bp, Homo sapiens
caggtgtgagtcaccaagccc

SEQ ID NO: 2234219 - DNA, 22 bp, Homo sapiens
caggtgtgagtcaccaagccca

SEQ ID NO: 2234220 - DNA, 15 bp, Homo sapiens
caggtttaaaaatcc

SEQ ID NO: 2234221 - DNA, 23 bp, Homo sapiens
caggtttttggtctgacccactg

SEQ ID NO: 2234222 - DNA, 18 bp, Homo sapiens
cagtaaatgggggtgcat

SEQ ID NO: 2234223 - DNA, 20 bp, Homo sapiens
cagtcaccccggccacctgc

SEQ ID NO: 2234224 - DNA, 12 bp, Homo sapiens
cagtccctgcca

SEQ ID NO: 2234225 - DNA, 15 bp, Homo sapiens
cagtccctgccaatg

SEQ ID NO: 2234226 - DNA, 18 bp, Homo sapiens
caagcaggacatggacaa

SEQ ID NO: 2234227 - DNA, 17 bp, Homo sapiens
caagcgattcttctgct

SEQ ID NO: 2234228 - DNA, 20 bp, Homo sapiens
caagcgattcttctgcttca

SEQ ID NO: 2234229 - DNA, 16 bp, Homo sapiens
caagcgtgagccactg

SEQ ID NO: 2234230 - DNA, 13 bp, Homo sapiens
caagctctgctcc

SEQ ID NO: 2234231 - DNA, 14 bp, Homo sapiens
caagctctgctcct

SEQ ID NO: 2234232 - DNA, 15 bp, Homo sapiens
caagctctgctcctc

SEQ ID NO: 2234233 - DNA, 18 bp, Homo sapiens
caagctgcaccctcaggc

SEQ ID NO: 2234234 - DNA, 17 bp, Homo sapiens
caagctggtcccactca

SEQ ID NO: 2234235 - DNA, 19 bp, Homo sapiens
caagctggtcccactcagt

SEQ ID NO: 2234236 - DNA, 21 bp, Homo sapiens
caagctggtcccactcagtcc

SEQ ID NO: 2234237 - DNA, 14 bp, Homo sapiens
caaggatcctgagc

SEQ ID NO: 2234238 - DNA, 14 bp, Homo sapiens
caaggcaaggctgt

SEQ ID NO: 2234239 - DNA, 16 bp, Homo sapiens
caaggccaaaggaagc

SEQ ID NO: 2234240 - DNA, 15 bp, Homo sapiens
caaggctgcagtgag

SEQ ID NO: 2234241 - DNA, 15 bp, Homo sapiens
caagggcctggcctg

SEQ ID NO: 2234242 - DNA, 19 bp, Homo sapiens
caagggcctggcctgagct

SEQ ID NO: 2234243 - DNA, 23 bp, Homo sapiens
caaggggaatgtttgcctctgcc

SEQ ID NO: 2234244 - DNA, 13 bp, Homo sapiens
caaggtcattttt

SEQ ID NO: 2234245 - DNA, 20 bp, Homo sapiens
caaggtcattttttttaaga

SEQ ID NO: 2234246 - DNA, 12 bp, Homo sapiens
caaggtgggagg

SEQ ID NO: 2234247 - DNA, 17 bp, Homo sapiens
caagtattatacctttt

SEQ ID NO: 2234248 - DNA, 17 bp, Homo sapiens
caagtcaagtgaaaaag

SEQ ID NO: 2234249 - DNA, 19 bp, Homo sapiens
caagtgaaaaaggaggaag

SEQ ID NO: 2234250 - DNA, 14 bp, Homo sapiens
caagtgagagctgg

SEQ ID NO: 2234251 - DNA, 22 bp, Homo sapiens
caagtgattctcctgcctcagc

SEQ ID NO: 2234252 - DNA, 19 bp, Homo sapiens
caataaagcagcgtttcta

SEQ ID NO: 2234253 - DNA, 14 bp, Homo sapiens
caataggaaaaact

SEQ ID NO: 2234254 - DNA, 18 bp, Homo sapiens
caataggaaaaactgatt

SEQ ID NO: 2234255 - DNA, 15 bp, Homo sapiens
caatgacctttcaat

SEQ ID NO: 2234256 - DNA, 15 bp, Homo sapiens
caatgacttactgta

SEQ ID NO: 2234257 - DNA, 14 bp, Homo sapiens
caatgatggtcacc

SEQ ID NO: 2234258 - DNA, 14 bp, Homo sapiens
caatgcaaaccatc

SEQ ID NO: 2234259 - DNA, 17 bp, Homo sapiens
caatgcaaaccatcatt

SEQ ID NO: 2234260 - DNA, 18 bp, Homo sapiens
caatgcaaaccatcattg

SEQ ID NO: 2234261 - DNA, 19 bp, Homo sapiens
caatgcaaaccatcattga

SEQ ID NO: 2234262 - DNA, 21 bp, Homo sapiens
caatgcaaaccatcattgaaa

SEQ ID NO: 2234263 - DNA, 20 bp, Homo sapiens
caatgcactttgttctggct

SEQ ID NO: 2234264 - DNA, 12 bp, Homo sapiens
caatgctggctg

SEQ ID NO: 2234265 - DNA, 13 bp, Homo sapiens
caatggcagcctt

SEQ ID NO: 2234266 - DNA, 15 bp, Homo sapiens
caatggcagccttgg

SEQ ID NO: 2234267 - DNA, 15 bp, Homo sapiens
caatgggagctcatg

SEQ ID NO: 2234268 - DNA, 18 bp, Homo sapiens
caatggttttcttgtgtg

SEQ ID NO: 2234269 - DNA, 16 bp, Homo sapiens
caattacaggaagtac

SEQ ID NO: 2234270 - DNA, 17 bp, Homo sapiens
cagtgagtcgaggacag

SEQ ID NO: 2234271 - DNA, 22 bp, Homo sapiens
cagtgagtcgaggacagggagg

SEQ ID NO: 2234272 - DNA, 13 bp, Homo sapiens
cagtgcatgctgt

SEQ ID NO: 2234273 - DNA, 14 bp, Homo sapiens
cagtgcatgctgtc

SEQ ID NO: 2234274 - DNA, 15 bp, Homo sapiens
cagtgccaaaaacaa

SEQ ID NO: 2234275 - DNA, 12 bp, Homo sapiens
cagtgcccacag

SEQ ID NO: 2234276 - DNA, 18 bp, Homo sapiens
cagtgcccacaggatcag

SEQ ID NO: 2234277 - DNA, 22 bp, Homo sapiens
cagtgcccacaggatcagtctg

SEQ ID NO: 2234278 - DNA, 15 bp, Homo sapiens
cagtgccgagaagga

SEQ ID NO: 2234279 - DNA, 19 bp, Homo sapiens
cagtgccttatggaacact

SEQ ID NO: 2234280 - DNA, 23 bp, Homo sapiens
cagtgccttatggaacactctga

SEQ ID NO: 2234281 - DNA, 12 bp, Homo sapiens
cagtggcagctg

SEQ ID NO: 2234282 - DNA, 17 bp, Homo sapiens
cagtggggctggaagca

SEQ ID NO: 2234283 - DNA, 21 bp, Homo sapiens
cagtggtgcgatctgggttca

SEQ ID NO: 2234284 - DNA, 19 bp, Homo sapiens
cagtggtggttttctgttc

SEQ ID NO: 2234285 - DNA, 20 bp, Homo sapiens
cagtgtacatggaataacat

SEQ ID NO: 2234286 - DNA, 19 bp, Homo sapiens
cagtgttgtggatttaaca

SEQ ID NO: 2234287 - DNA, 13 bp, Homo sapiens
cagttaagagaaa

SEQ ID NO: 2234288 - DNA, 20 bp, Homo sapiens
cagttactcagaattctcta

SEQ ID NO: 2234289 - DNA, 14 bp, Homo sapiens
cagttctctccttc

SEQ ID NO: 2234290 - DNA, 22 bp, Homo sapiens
cagttctctccttcttcccccc

SEQ ID NO: 2234291 - DNA, 12 bp, Homo sapiens
cagttgaaaaac

SEQ ID NO: 2234292 - DNA, 23 bp, Homo sapiens
cagttgccagtcaccccggccac

SEQ ID NO: 2234293 - DNA, 19 bp, Homo sapiens
cagttggtcccccttccat

SEQ ID NO: 2234294 - DNA, 17 bp, Homo sapiens
cagttgttagtgtgtct

SEQ ID NO: 2234295 - DNA, 22 bp, Homo sapiens
cagttgttagtgtgtcttagtg

SEQ ID NO: 2234296 - DNA, 21 bp, Homo sapiens
cagtttgttagtatgaggcat

SEQ ID NO: 2234297 - DNA, 20 bp, Homo sapiens
cataaacaagaccacgtttc

SEQ ID NO: 2234298 - DNA, 21 bp, Homo sapiens
cataaacaagaccacgtttct

SEQ ID NO: 2234299 - DNA, 16 bp, Homo sapiens
cataacctagccttag

SEQ ID NO: 2234300 - DNA, 17 bp, Homo sapiens
cataatgcgtgcatacc

SEQ ID NO: 2234301 - DNA, 15 bp, Homo sapiens
catacaattccaaac

SEQ ID NO: 2234302 - DNA, 13 bp, Homo sapiens
cataccacttttg

SEQ ID NO: 2234303 - DNA, 18 bp, Homo sapiens
cataccacttttgttctt

SEQ ID NO: 2234304 - DNA, 11 bp, Homo sapiens
catacccaccc

SEQ ID NO: 2234305 - DNA, 17 bp, Homo sapiens
catacccacccccaccc

SEQ ID NO: 2234306 - DNA, 13 bp, Homo sapiens
catacgtacacat

SEQ ID NO: 2234307 - DNA, 15 bp, Homo sapiens
catacgtacacattt

SEQ ID NO: 2234308 - DNA, 16 bp, Homo sapiens
catacgtacacatttt

SEQ ID NO: 2234309 - DNA, 18 bp, Homo sapiens
catacgtacacattttat

SEQ ID NO: 2234310 - DNA, 15 bp, Homo sapiens
catactcccatctgt

SEQ ID NO: 2234311 - DNA, 21 bp, Homo sapiens
catagagagcaagacgctgtg

SEQ ID NO: 2234312 - DNA, 23 bp, Homo sapiens
catataagattcatatttacttc

SEQ ID NO: 2234313 - DNA, 22 bp, Homo sapiens
catatatatgttttaagaggca

SEQ ID NO: 2234314 - DNA, 13 bp, Homo sapiens
catatgcctgggc

SEQ ID NO: 2234315 - DNA, 17 bp, Homo sapiens
catattaccacagacat

SEQ ID NO: 2234316 - DNA, 21 bp, Homo sapiens
catattaccacagacatacta

SEQ ID NO: 2234317 - DNA, 14 bp, Homo sapiens
catattcaggaagc

SEQ ID NO: 2234318 - DNA, 22 bp, Homo sapiens
catattcaggaagctcagggcc

SEQ ID NO: 2234319 - DNA, 17 bp, Homo sapiens
catattctgttggccag

SEQ ID NO: 2234320 - DNA, 20 bp, Homo sapiens
catatttacttcttatacat

SEQ ID NO: 2234321 - DNA, 14 bp, Homo sapiens
catcaagatgtgac

SEQ ID NO: 2234322 - DNA, 15 bp, Homo sapiens
catcaccaacgtctg

SEQ ID NO: 2234323 - DNA, 14 bp, Homo sapiens
catcacttccctac

SEQ ID NO: 2234324 - DNA, 19 bp, Homo sapiens
catcagcacgatttctgtt

SEQ ID NO: 2234325 - DNA, 15 bp, Homo sapiens
catcaggccaggccc

SEQ ID NO: 2234326 - DNA, 16 bp, Homo sapiens
catcaggccaggccct

SEQ ID NO: 2234327 - DNA, 22 bp, Homo sapiens
catcaggccaggccctctgccc

SEQ ID NO: 2234328 - DNA, 16 bp, Homo sapiens
catcatcctaagctat

SEQ ID NO: 2234329 - DNA, 15 bp, Homo sapiens
catcatgtctggcta

SEQ ID NO: 2234330 - DNA, 15 bp, Homo sapiens
catcattgaaatctt

SEQ ID NO: 2234331 - DNA, 14 bp, Homo sapiens
catccactgtgcca

SEQ ID NO: 2234332 - DNA, 17 bp, Homo sapiens
catccaggttcagcttg

SEQ ID NO: 2234333 - DNA, 11 bp, Homo sapiens
catcccagccc

SEQ ID NO: 2234334 - DNA, 16 bp, Homo sapiens
catcccagccccaatg

SEQ ID NO: 2234335 - DNA, 17 bp, Homo sapiens
catcccagccccaatga

SEQ ID NO: 2234336 - DNA, 19 bp, Homo sapiens
catccctctggggctgttc

SEQ ID NO: 2234337 - DNA, 21 bp, Homo sapiens
catccctgaaggccccgccca

SEQ ID NO: 2234338 - DNA, 17 bp, Homo sapiens
catcctcatacccaccc

SEQ ID NO: 2234339 - DNA, 21 bp, Homo sapiens
catcctcatacccacccccac

SEQ ID NO: 2234340 - DNA, 13 bp, Homo sapiens
catcctcccaagg

SEQ ID NO: 2234341 - DNA, 11 bp, Homo sapiens
catcctcctca

SEQ ID NO: 2234342 - DNA, 19 bp, Homo sapiens
catcctcctcagatcttct

SEQ ID NO: 2234343 - DNA, 21 bp, Homo sapiens
catcctcctgcccccacccca

SEQ ID NO: 2234344 - DNA, 15 bp, Homo sapiens
catcctctgtacaga

SEQ ID NO: 2234345 - DNA, 15 bp, Homo sapiens
catcctggcacccgg

SEQ ID NO: 2234346 - DNA, 17 bp, Homo sapiens
catctcacacatgagca

SEQ ID NO: 2234347 - DNA, 16 bp, Homo sapiens
catcttgaattgtaag

SEQ ID NO: 2234348 - DNA, 17 bp, Homo sapiens
catcttgctctgctgac

SEQ ID NO: 2234349 - DNA, 22 bp, Homo sapiens
catgaagtaatatgcacacatt

SEQ ID NO: 2234350 - DNA, 17 bp, Homo sapiens
catgacacgaatattgc

SEQ ID NO: 2234351 - DNA, 18 bp, Homo sapiens
catgacacgaatattgct

SEQ ID NO: 2234352 - DNA, 15 bp, Homo sapiens
catgagcatcaggcc

SEQ ID NO: 2234353 - DNA, 17 bp, Homo sapiens
catgagcatcaggccag

SEQ ID NO: 2234354 - DNA, 18 bp, Homo sapiens
catgagcatcaggccagg

SEQ ID NO: 2234355 - DNA, 22 bp, Homo sapiens
catgagcatcaggccaggccct

SEQ ID NO: 2234356 - DNA, 23 bp, Homo sapiens
catgagcatcaggccaggccctc

SEQ ID NO: 2234357 - DNA, 12 bp, Homo sapiens
catgagcctcag

SEQ ID NO: 2234358 - DNA, 20 bp, Homo sapiens
catgagcctcagcatcctgg

SEQ ID NO: 2234359 - DNA, 23 bp, Homo sapiens
catgagcctcagcatcctggcac

SEQ ID NO: 2234360 - DNA, 20 bp, Homo sapiens
catgaggaacaaggcaaggc

SEQ ID NO: 2234361 - DNA, 22 bp, Homo sapiens
catgattaaccacttcagctga

SEQ ID NO: 2234362 - DNA, 12 bp, Homo sapiens
catgcaaggtca

SEQ ID NO: 2234363 - DNA, 17 bp, Homo sapiens
catgcaaggtcattttt

SEQ ID NO: 2234364 - DNA, 18 bp, Homo sapiens
catgcaaggtcatttttt

SEQ ID NO: 2234365 - DNA, 19 bp, Homo sapiens
catgccagcttatctcagg

SEQ ID NO: 2234366 - DNA, 20 bp, Homo sapiens
catgccagcttatctcaggg

SEQ ID NO: 2234367 - DNA, 14 bp, Homo sapiens
catgcctctctcag

SEQ ID NO: 2234368 - DNA, 16 bp, Homo sapiens
catgcctctctcaggc

SEQ ID NO: 2234369 - DNA, 17 bp, Homo sapiens
catgcctctctcaggcc

SEQ ID NO: 2234370 - DNA, 18 bp, Homo sapiens
catgcctctctcaggcca

SEQ ID NO: 2234371 - DNA, 13 bp, Homo sapiens
catgcctggatgg

SEQ ID NO: 2234372 - DNA, 20 bp, Homo sapiens
catgctacacactgcatgtt

SEQ ID NO: 2234373 - DNA, 16 bp, Homo sapiens
catgctcctggcccac

SEQ ID NO: 2234374 - DNA, 12 bp, Homo sapiens
catgctgccctg

SEQ ID NO: 2234375 - DNA, 18 bp, Homo sapiens
catgctgccctgtgagta

SEQ ID NO: 2234376 - DNA, 17 bp, Homo sapiens
catgctgtcccttacgt

SEQ ID NO: 2234377 - DNA, 18 bp, Homo sapiens
catggacatgatcttctt

SEQ ID NO: 2234378 - DNA, 13 bp, Homo sapiens
catggactttgtt

SEQ ID NO: 2234379 - DNA, 21 bp, Homo sapiens
catggcctcttcagatctcta

SEQ ID NO: 2234380 - DNA, 22 bp, Homo sapiens
catggctgccaatgggagctca

SEQ ID NO: 2234381 - DNA, 18 bp, Homo sapiens
catgggaatgaatgtcag

SEQ ID NO: 2234382 - DNA, 18 bp, Homo sapiens
catgggcctcctgtgtgt

SEQ ID NO: 2234383 - DNA, 21 bp, Homo sapiens
ccagcaggctctcaggccagc

SEQ ID NO: 2234384 - DNA, 15 bp, Homo sapiens
ccagccaaagcctcc

SEQ ID NO: 2234385 - DNA, 17 bp, Homo sapiens
ccagcccacttctgcca

SEQ ID NO: 2234386 - DNA, 19 bp, Homo sapiens
ccagccccaaaactctcct

SEQ ID NO: 2234387 - DNA, 23 bp, Homo sapiens
ccagccccaaaactctcctctgc

SEQ ID NO: 2234388 - DNA, 15 bp, Homo sapiens
ccagccccagtgccc

SEQ ID NO: 2234389 - DNA, 14 bp, Homo sapiens
ccagcccctggatg

SEQ ID NO: 2234390 - DNA, 15 bp, Homo sapiens
ccagcccctggatgc

SEQ ID NO: 2234391 - DNA, 15 bp, Homo sapiens
ccagccccttctgac

SEQ ID NO: 2234392 - DNA, 14 bp, Homo sapiens
ccagccgccatgct

SEQ ID NO: 2234393 - DNA, 19 bp, Homo sapiens
ccagccgccatgctcctgg

SEQ ID NO: 2234394 - DNA, 23 bp, Homo sapiens
ccagccttgaccattctccacct

SEQ ID NO: 2234395 - DNA, 16 bp, Homo sapiens
ccagctcaccagcccc

SEQ ID NO: 2234396 - DNA, 14 bp, Homo sapiens
ccagctctggtcca

SEQ ID NO: 2234397 - DNA, 20 bp, Homo sapiens
ccagctgcttgggcttcatc

SEQ ID NO: 2234398 - DNA, 22 bp, Homo sapiens
ccagctgtgctctggacaggca

SEQ ID NO: 2234399 - DNA, 16 bp, Homo sapiens
ccagctgttcagctgg

SEQ ID NO: 2234400 - DNA, 19 bp, Homo sapiens
ccagcttaaaggggctaga

SEQ ID NO: 2234401 - DNA, 23 bp, Homo sapiens
ccaggaaaggctccaggagcagc

SEQ ID NO: 2234402 - DNA, 17 bp, Homo sapiens
ccaggaagccagcaggc

SEQ ID NO: 2234403 - DNA, 20 bp, Homo sapiens
ccaggaagccagcaggctct

SEQ ID NO: 2234404 - DNA, 22 bp, Homo sapiens
ccaggaagccagcaggctctca

SEQ ID NO: 2234405 - DNA, 16 bp, Homo sapiens
ccaggagccccgaggc

SEQ ID NO: 2234406 - DNA, 14 bp, Homo sapiens
ccaggcaggtcttg

SEQ ID NO: 2234407 - DNA, 23 bp, Homo sapiens
ccaggcaggtcttgaactcctgg

SEQ ID NO: 2234408 - DNA, 22 bp, Homo sapiens
ccaggcattccccaggaggcca

SEQ ID NO: 2234409 - DNA, 21 bp, Homo sapiens
ccaggccacaagacccttgtg

SEQ ID NO: 2234410 - DNA, 21 bp, Homo sapiens
ccaggccagagggagtgacag

SEQ ID NO: 2234411 - DNA, 15 bp, Homo sapiens
ccaggcccctgccac

SEQ ID NO: 2234412 - DNA, 15 bp, Homo sapiens
ccaggccctctgccc

SEQ ID NO: 2234413 - DNA, 17 bp, Homo sapiens
ccaggccctctgcccac

SEQ ID NO: 2234414 - DNA, 19 bp, Homo sapiens
ccaggccctctgcccactc

SEQ ID NO: 2234415 - DNA, 23 bp, Homo sapiens
ccaggccctctgcccactccctg

SEQ ID NO: 2234416 - DNA, 16 bp, Homo sapiens
ccaggcctccccagca

SEQ ID NO: 2234417 - DNA, 17 bp, Homo sapiens
ccaggcctccccagcac

SEQ ID NO: 2234418 - DNA, 13 bp, Homo sapiens
ccaggcctcctac

SEQ ID NO: 2234419 - DNA, 18 bp, Homo sapiens
ccaggcctcctacagctt

SEQ ID NO: 2234420 - DNA, 20 bp, Homo sapiens
ccaggctcctttagcgccca

SEQ ID NO: 2234421 - DNA, 16 bp, Homo sapiens
ccaggctggcgtgcag

SEQ ID NO: 2234422 - DNA, 17 bp, Homo sapiens
ccaggctggcgtgcagt

SEQ ID NO: 2234423 - DNA, 18 bp, Homo sapiens
ccaggctggcgtgcagtg

SEQ ID NO: 2234424 - DNA, 18 bp, Homo sapiens
ccaggctgggagagcctt

SEQ ID NO: 2234425 - DNA, 20 bp, Homo sapiens
ccaggcttagtcactgagac

SEQ ID NO: 2234426 - DNA, 23 bp, Homo sapiens
ccaggcttagtcactgagacagc

SEQ ID NO: 2234427 - DNA, 21 bp, Homo sapiens
ccagggacagagggggtggcc

SEQ ID NO: 2234428 - DNA, 22 bp, Homo sapiens
ccagggacagagggggtggcct

SEQ ID NO: 2234429 - DNA, 13 bp, Homo sapiens
ccaggggtgggac

SEQ ID NO: 2234430 - DNA, 14 bp, Homo sapiens
ccaggggtgggaca

SEQ ID NO: 2234431 - DNA, 17 bp, Homo sapiens
ccaggggtgggacaccc

SEQ ID NO: 2234432 - DNA, 21 bp, Homo sapiens
ccaggtgctaggaacactcct

SEQ ID NO: 2234433 - DNA, 19 bp, Homo sapiens
ccagtatcttgaagacttt

SEQ ID NO: 2234434 - DNA, 17 bp, Homo sapiens
ccagtcaccccggccac

SEQ ID NO: 2234435 - DNA, 20 bp, Homo sapiens
ccagtcaccccggccacctg

SEQ ID NO: 2234436 - DNA, 17 bp, Homo sapiens
ccagtgaggctctgccc

SEQ ID NO: 2234437 - DNA, 14 bp, Homo sapiens
ccagtgccccctgg

SEQ ID NO: 2234438 - DNA, 20 bp, Homo sapiens
ccagtgccgagaaggaagcc

SEQ ID NO: 2234439 - DNA, 22 bp, Homo sapiens
ccagtggttcctaatcctctag

SEQ ID NO: 2234440 - DNA, 19 bp, Homo sapiens
ccagttgggtggatgcctg

SEQ ID NO: 2234441 - DNA, 13 bp, Homo sapiens
ccatatgcctggg

SEQ ID NO: 2234442 - DNA, 12 bp, Homo sapiens
ccatcaagccac

SEQ ID NO: 2234443 - DNA, 12 bp, Homo sapiens
ccatcacccgct

SEQ ID NO: 2234444 - DNA, 16 bp, Homo sapiens
ccatcatgtctggcta

SEQ ID NO: 2234445 - DNA, 14 bp, Homo sapiens
ccatcattgaaatc

SEQ ID NO: 2234446 - DNA, 16 bp, Homo sapiens
ccatcattgaaatctt

SEQ ID NO: 2234447 - DNA, 17 bp, Homo sapiens
ccatcattgaaatcttt

SEQ ID NO: 2234448 - DNA, 19 bp, Homo sapiens
ccatccaggttcagcttgt

SEQ ID NO: 2234449 - DNA, 20 bp, Homo sapiens
ccatcccaaacccttcagtg

SEQ ID NO: 2234450 - DNA, 20 bp, Homo sapiens
ccatcccatatgcctgggca

SEQ ID NO: 2234451 - DNA, 21 bp, Homo sapiens
ccatcccatatgcctgggcag

SEQ ID NO: 2234452 - DNA, 17 bp, Homo sapiens
ccatccctgaaggcccc

SEQ ID NO: 2234453 - DNA, 20 bp, Homo sapiens
ccatcctctgtacagagccc

SEQ ID NO: 2234454 - DNA, 14 bp, Homo sapiens
ccatctcacacatg

SEQ ID NO: 2234455 - DNA, 17 bp, Homo sapiens
ccatctcacacatgagc

SEQ ID NO: 2234456 - DNA, 18 bp, Homo sapiens
ccatctcacacatgagca

SEQ ID NO: 2234457 - DNA, 13 bp, Homo sapiens
ccatgagcctcag

SEQ ID NO: 2234458 - DNA, 14 bp, Homo sapiens
ccatgagcctcagc

SEQ ID NO: 2234459 - DNA, 18 bp, Homo sapiens
ccatgaggaacaaggcaa

SEQ ID NO: 2234460 - DNA, 13 bp, Homo sapiens
ccatgctgccctg

SEQ ID NO: 2234461 - DNA, 14 bp, Homo sapiens
ccatgctgccctgt

SEQ ID NO: 2234462 - DNA, 13 bp, Homo sapiens
ccatggactttgt

SEQ ID NO: 2234463 - DNA, 14 bp, Homo sapiens
ccatggactttgtt

SEQ ID NO: 2234464 - DNA, 17 bp, Homo sapiens
ccatgggcctcctgtgt

SEQ ID NO: 2234465 - DNA, 16 bp, Homo sapiens
ccatgttggccaggct

SEQ ID NO: 2234466 - DNA, 19 bp, Homo sapiens
ccatgttggccaggctggt

SEQ ID NO: 2234467 - DNA, 18 bp, Homo sapiens
ccatgttttgtttacggt

SEQ ID NO: 2234468 - DNA, 18 bp, Homo sapiens
ccattctccacctgccag

SEQ ID NO: 2234469 - DNA, 21 bp, Homo sapiens
ccattctgcctgcccaggccc

SEQ ID NO: 2234470 - DNA, 20 bp, Homo sapiens
ccattttgctgtcccttttc

SEQ ID NO: 2234471 - DNA, 23 bp, Homo sapiens
ccattttggattcttatggacaa

SEQ ID NO: 2234472 - DNA, 12 bp, Homo sapiens
cccaaagatgca

SEQ ID NO: 2234473 - DNA, 16 bp, Homo sapiens
cccaaagcagtgcatg

SEQ ID NO: 2234474 - DNA, 13 bp, Homo sapiens
cccaaagtgctgg

SEQ ID NO: 2234475 - DNA, 18 bp, Homo sapiens
cccaaatggaaatgggca

SEQ ID NO: 2234476 - DNA, 17 bp, Homo sapiens
cccaactcaccccagcc

SEQ ID NO: 2234477 - DNA, 20 bp, Homo sapiens
cccaagagagacagcacagg

SEQ ID NO: 2234478 - DNA, 13 bp, Homo sapiens
cccaagctctgct

SEQ ID NO: 2234479 - DNA, 19 bp, Homo sapiens
ccctcagggtccctggtgg

SEQ ID NO: 2234480 - DNA, 20 bp, Homo sapiens
ccctcatcctcatacccacc

SEQ ID NO: 2234481 - DNA, 18 bp, Homo sapiens
ccctcccagacccccttg

SEQ ID NO: 2234482 - DNA, 18 bp, Homo sapiens
ccctccccgggcagcaga

SEQ ID NO: 2234483 - DNA, 21 bp, Homo sapiens
ccctccccgggcagcagagag

SEQ ID NO: 2234484 - DNA, 18 bp, Homo sapiens
ccctctgcccactccctg

SEQ ID NO: 2234485 - DNA, 18 bp, Homo sapiens
ccctgaaagccctgagct

SEQ ID NO: 2234486 - DNA, 13 bp, Homo sapiens
ccctgaaggcccc

SEQ ID NO: 2234487 - DNA, 19 bp, Homo sapiens
ccctgaaggccccgcccag

SEQ ID NO: 2234488 - DNA, 18 bp, Homo sapiens
ccctgaggcccagagggc

SEQ ID NO: 2234489 - DNA, 19 bp, Homo sapiens
ccctgaggcccagagggcc

SEQ ID NO: 2234490 - DNA, 20 bp, Homo sapiens
ccctgaggcccagagggcct

SEQ ID NO: 2234491 - DNA, 23 bp, Homo sapiens
ccctgaggcccagagggcctgca

SEQ ID NO: 2234492 - DNA, 12 bp, Homo sapiens
ccctgcacttgc

SEQ ID NO: 2234493 - DNA, 19 bp, Homo sapiens
ccctgcacttgcagactct

SEQ ID NO: 2234494 - DNA, 22 bp, Homo sapiens
ccctgcacttgcagactctaca

SEQ ID NO: 2234495 - DNA, 17 bp, Homo sapiens
ccctgccaccctgggga

SEQ ID NO: 2234496 - DNA, 18 bp, Homo sapiens
ccctgccaccctggggag

SEQ ID NO: 2234497 - DNA, 18 bp, Homo sapiens
ccctgcccacctggcctc

SEQ ID NO: 2234498 - DNA, 14 bp, Homo sapiens
ccctgccctgtggg

SEQ ID NO: 2234499 - DNA, 11 bp, Homo sapiens
ccctgcctcct

SEQ ID NO: 2234500 - DNA, 23 bp, Homo sapiens
ccctgcctcctttgtgaggaagc

SEQ ID NO: 2234501 - DNA, 21 bp, Homo sapiens
ccctgctctccgaccagacac

SEQ ID NO: 2234502 - DNA, 16 bp, Homo sapiens
ccctgctgggtgtggc

SEQ ID NO: 2234503 - DNA, 13 bp, Homo sapiens
ccctggatgcagc

SEQ ID NO: 2234504 - DNA, 21 bp, Homo sapiens
ccctggatgcagcctcacagt

SEQ ID NO: 2234505 - DNA, 14 bp, Homo sapiens
ccctggcagcccct

SEQ ID NO: 2234506 - DNA, 17 bp, Homo sapiens
ccctggtggcagctcac

SEQ ID NO: 2234507 - DNA, 14 bp, Homo sapiens
ccctggtggcagtg

SEQ ID NO: 2234508 - DNA, 21 bp, Homo sapiens
ccctggtggcagtgggagctg

SEQ ID NO: 2234509 - DNA, 21 bp, Homo sapiens
ccctgtagagtgggagctgag

SEQ ID NO: 2234510 - DNA, 20 bp, Homo sapiens
ccctgtctcaaaaaaagaaa

SEQ ID NO: 2234511 - DNA, 22 bp, Homo sapiens
ccctgtgatggggccctgcctc

SEQ ID NO: 2234512 - DNA, 19 bp, Homo sapiens
ccctgtttgtttctgaaag

SEQ ID NO: 2234513 - DNA, 19 bp, Homo sapiens
cccttacctcggtgccttc

SEQ ID NO: 2234514 - DNA, 23 bp, Homo sapiens
cccttacctgccaggaagccagc

SEQ ID NO: 2234515 - DNA, 15 bp, Homo sapiens
cccttacgtgagtcc

SEQ ID NO: 2234516 - DNA, 17 bp, Homo sapiens
cctgttctggcagagtt

SEQ ID NO: 2234517 - DNA, 14 bp, Homo sapiens
ccttacacaatggt

SEQ ID NO: 2234518 - DNA, 20 bp, Homo sapiens
ccttacacaatggttttctt

SEQ ID NO: 2234519 - DNA, 17 bp, Homo sapiens
ccttaccagcagagcac

SEQ ID NO: 2234520 - DNA, 15 bp, Homo sapiens
ccttaccctcatgtt

SEQ ID NO: 2234521 - DNA, 19 bp, Homo sapiens
ccttaccctcatgttctta

SEQ ID NO: 2234522 - DNA, 19 bp, Homo sapiens
ccttacctgccaggaagcc

SEQ ID NO: 2234523 - DNA, 18 bp, Homo sapiens
ccttagaagtcacacagt

SEQ ID NO: 2234524 - DNA, 14 bp, Homo sapiens
ccttagacagtccc

SEQ ID NO: 2234525 - DNA, 21 bp, Homo sapiens
ccttagacagtccctgccaat

SEQ ID NO: 2234526 - DNA, 16 bp, Homo sapiens
ccttagcaaattctgt

SEQ ID NO: 2234527 - DNA, 19 bp, Homo sapiens
ccttatggaacactctgag

SEQ ID NO: 2234528 - DNA, 17 bp, Homo sapiens
ccttcacagatgggtgc

SEQ ID NO: 2234529 - DNA, 14 bp, Homo sapiens
ccttcagtgccaaa

SEQ ID NO: 2234530 - DNA, 14 bp, Homo sapiens
ccttcagtgcctta

SEQ ID NO: 2234531 - DNA, 15 bp, Homo sapiens
ccttcagtgccttat

SEQ ID NO: 2234532 - DNA, 22 bp, Homo sapiens
ccttccaggggtgggacaccct

SEQ ID NO: 2234533 - DNA, 19 bp, Homo sapiens
ccttcccacctctctcact

SEQ ID NO: 2234534 - DNA, 15 bp, Homo sapiens
ccttcgctcctgtgt

SEQ ID NO: 2234535 - DNA, 16 bp, Homo sapiens
ccttctctccagcccc

SEQ ID NO: 2234536 - DNA, 20 bp, Homo sapiens
ccttctctccagcccctgga

SEQ ID NO: 2234537 - DNA, 21 bp, Homo sapiens
ccttctctccagcccctggat

SEQ ID NO: 2234538 - DNA, 16 bp, Homo sapiens
ccttctgacccatgct

SEQ ID NO: 2234539 - DNA, 20 bp, Homo sapiens
ccttctgacccatgctgccc

SEQ ID NO: 2234540 - DNA, 21 bp, Homo sapiens
ccttctgacccatgctgccct

SEQ ID NO: 2234541 - DNA, 22 bp, Homo sapiens
ccttctggaataaggagaatga

SEQ ID NO: 2234542 - DNA, 22 bp, Homo sapiens
ccttctgtcctactctgtgtca

SEQ ID NO: 2234543 - DNA, 21 bp, Homo sapiens
ccttgaaaacactgttctctg

SEQ ID NO: 2234544 - DNA, 22 bp, Homo sapiens
ccttgaaaacactgttctctgc

SEQ ID NO: 2234545 - DNA, 17 bp, Homo sapiens
ccttgaatgatgccatg

SEQ ID NO: 2234546 - DNA, 15 bp, Homo sapiens
ccttgacagggcaca

SEQ ID NO: 2234547 - DNA, 17 bp, Homo sapiens
ccttgacagggcacacc

SEQ ID NO: 2234548 - DNA, 21 bp, Homo sapiens
ccttgacagggcacaccgggc

SEQ ID NO: 2234549 - DNA, 21 bp, Homo sapiens
ccttgaccattctccacctgc

SEQ ID NO: 2234550 - DNA, 23 bp, Homo sapiens
ccttgagttgattcagctctgca

SEQ ID NO: 2234551 - DNA, 13 bp, Homo sapiens
ccttgcccaggcc

SEQ ID NO: 2234552 - DNA, 15 bp, Homo sapiens
ccttggattgtcccc

SEQ ID NO: 2234553 - DNA, 19 bp, Homo sapiens
ccttggattgtccccgacc

SEQ ID NO: 2234554 - DNA, 14 bp, Homo sapiens
ccttggctgcaggg

SEQ ID NO: 2234555 - DNA, 14 bp, Homo sapiens
ccttggggagcagg

SEQ ID NO: 2234556 - DNA, 20 bp, Homo sapiens
ccttggtgtcgggcatgaca

SEQ ID NO: 2234557 - DNA, 23 bp, Homo sapiens
cctttgacgccatcccagcccca

SEQ ID NO: 2234558 - DNA, 11 bp, Homo sapiens
cctttggcttc

SEQ ID NO: 2234559 - DNA, 18 bp, Homo sapiens
cctttgtattctctcctg

SEQ ID NO: 2234560 - DNA, 23 bp, Homo sapiens
cctttgtattctctcctgtacct

SEQ ID NO: 2234561 - DNA, 14 bp, Homo sapiens
cctttgtccccacc

SEQ ID NO: 2234562 - DNA, 17 bp, Homo sapiens
cctttgtgaggaagccg

SEQ ID NO: 2234563 - DNA, 17 bp, Homo sapiens
ccttttgagtgccttac

SEQ ID NO: 2234564 - DNA, 21 bp, Homo sapiens
ccttttttagagttgatacta

SEQ ID NO: 2234565 - DNA, 20 bp, Homo sapiens
ccttttttggctgctgaagg

SEQ ID NO: 2234566 - DNA, 18 bp, Homo sapiens
cgaaaacgtggctgcttc

SEQ ID NO: 2234567 - DNA, 19 bp, Homo sapiens
cgaaaacgtggctgcttca

SEQ ID NO: 2234568 - DNA, 20 bp, Homo sapiens
cgaaaggatgaaagtgacca

SEQ ID NO: 2234569 - DNA, 21 bp, Homo sapiens
cgaacatgtttttcttctccc

SEQ ID NO: 2234570 - DNA, 16 bp, Homo sapiens
ctactctgtgtcaggt

SEQ ID NO: 2234571 - DNA, 17 bp, Homo sapiens
ctactgtaatttgtgat

SEQ ID NO: 2234572 - DNA, 20 bp, Homo sapiens
ctagacgagcaggcttcttc

SEQ ID NO: 2234573 - DNA, 21 bp, Homo sapiens
ctagacgagcaggcttcttcc

SEQ ID NO: 2234574 - DNA, 21 bp, Homo sapiens
ctagaggttcaaagatatttt

SEQ ID NO: 2234575 - DNA, 24 bp, Homo sapiens
ctagatactgtatcatgacaaaga

SEQ ID NO: 2234576 - DNA, 18 bp, Homo sapiens
ctagcatacgtacacatt

SEQ ID NO: 2234577 - DNA, 23 bp, Homo sapiens
ctagcatacgtacacattttatt

SEQ ID NO: 2234578 - DNA, 17 bp, Homo sapiens
ctagccagaggagagag

SEQ ID NO: 2234579 - DNA, 22 bp, Homo sapiens
ctagcctgtgcctctgggactg

SEQ ID NO: 2234580 - DNA, 21 bp, Homo sapiens
ctagccttagaagtcacacag

SEQ ID NO: 2234581 - DNA, 23 bp, Homo sapiens
ctagccttagaagtcacacagta

SEQ ID NO: 2234582 - DNA, 21 bp, Homo sapiens
ctaggcatttgctgaatacag

SEQ ID NO: 2234583 - DNA, 14 bp, Homo sapiens
ctaggcctggccag

SEQ ID NO: 2234584 - DNA, 12 bp, Homo sapiens
ctaggcctgggg

SEQ ID NO: 2234585 - DNA, 14 bp, Homo sapiens
ctagggaagataat

SEQ ID NO: 2234586 - DNA, 24 bp, Homo sapiens
ctaggtgacagagtgagactctgt

SEQ ID NO: 2234587 - DNA, 22 bp, Homo sapiens
ctagtgtggtgtttcctggcac

SEQ ID NO: 2234588 - DNA, 21 bp, Homo sapiens
ctataatgtaagctctactga

SEQ ID NO: 2234589 - DNA, 17 bp, Homo sapiens
ctatagcctaggtgaca

SEQ ID NO: 2234590 - DNA, 18 bp, Homo sapiens
ctatagcctaggtgacag

SEQ ID NO: 2234591 - DNA, 20 bp, Homo sapiens
ctatagcctaggtgacagag

SEQ ID NO: 2234592 - DNA, 22 bp, Homo sapiens
ctatattgttttcagtgtacat

SEQ ID NO: 2234593 - DNA, 15 bp, Homo sapiens
ctatctcccccagcc

SEQ ID NO: 2234594 - DNA, 12 bp, Homo sapiens
ctatgcatttga

SEQ ID NO: 2234595 - DNA, 22 bp, Homo sapiens
ctatgggactcaatgcactgac

SEQ ID NO: 2234596 - DNA, 16 bp, Homo sapiens
ctatgtatcaatgagt

SEQ ID NO: 2234597 - DNA, 15 bp, Homo sapiens
ctatgttgcccaggc

SEQ ID NO: 2234598 - DNA, 17 bp, Homo sapiens
ctatgttgcccaggcag

SEQ ID NO: 2234599 - DNA, 19 bp, Homo sapiens
ctatgttgcccaggcaggt

SEQ ID NO: 2234600 - DNA, 21 bp, Homo sapiens
ctatgttgcccaggcaggtct

SEQ ID NO: 2234601 - DNA, 17 bp, Homo sapiens
ctattcagtaataactc

SEQ ID NO: 2234602 - DNA, 18 bp, Homo sapiens
ctattgttagtctcttga

SEQ ID NO: 2234603 - DNA, 20 bp, Homo sapiens
ctcaaactcttgacctcagg

SEQ ID NO: 2234604 - DNA, 13 bp, Homo sapiens
ctcaaatttctaa

SEQ ID NO: 2234605 - DNA, 15 bp, Homo sapiens
ctcaaatttctaaat

SEQ ID NO: 2234606 - DNA, 17 bp, Homo sapiens
ctcaaatttctaaatct

SEQ ID NO: 2234607 - DNA, 17 bp, Homo sapiens
ctcaagtgattctcctg

SEQ ID NO: 2234608 - DNA, 20 bp, Homo sapiens
ctcaagtgattctcctgcct

SEQ ID NO: 2234609 - DNA, 21 bp, Homo sapiens
ctcacacatgagcatcaggcc

SEQ ID NO: 2234610 - DNA, 22 bp, Homo sapiens
ctcacagtccttaccagcagag

SEQ ID NO: 2234611 - DNA, 13 bp, Homo sapiens
ctcaccagcccca

SEQ ID NO: 2234612 - DNA, 15 bp, Homo sapiens
ctcaccagccccagt

SEQ ID NO: 2234613 - DNA, 17 bp, Homo sapiens
ctcaccagccccagtgc

SEQ ID NO: 2234614 - DNA, 18 bp, Homo sapiens
ctcaccagccccagtgcc

SEQ ID NO: 2234615 - DNA, 15 bp, Homo sapiens
ctcacctctcccttg

SEQ ID NO: 2234616 - DNA, 14 bp, Homo sapiens
ctcacctgcccctc

SEQ ID NO: 2234617 - DNA, 17 bp, Homo sapiens
ctcacctttcccatctt

SEQ ID NO: 2234618 - DNA, 19 bp, Homo sapiens
ctcactatgttgcccaggc

SEQ ID NO: 2234619 - DNA, 20 bp, Homo sapiens
ctcactatgttgcccaggca

SEQ ID NO: 2234620 - DNA, 11 bp, Homo sapiens
ctcactctgtc

SEQ ID NO: 2234621 - DNA, 15 bp, Homo sapiens
ctcactgcagcctca

SEQ ID NO: 2234622 - DNA, 16 bp, Homo sapiens
ctcactgcagcctcaa

SEQ ID NO: 2234623 - DNA, 15 bp, Homo sapiens
ctcactgttgcccag

SEQ ID NO: 2234624 - DNA, 17 bp, Homo sapiens
ctcactgttgcccaggc

SEQ ID NO: 2234625 - DNA, 21 bp, Homo sapiens
ctcactgttgcccaggctggc

SEQ ID NO: 2234626 - DNA, 22 bp, Homo sapiens
taatagacaatttattatggca

SEQ ID NO: 2234627 - DNA, 15 bp, Homo sapiens
taatatgcacacatt

SEQ ID NO: 2234628 - DNA, 19 bp, Homo sapiens
taatatgcacacatttttt

SEQ ID NO: 2234629 - DNA, 20 bp, Homo sapiens
taatcctctaggaggtctct

SEQ ID NO: 2234630 - DNA, 18 bp, Homo sapiens
taatgaaagactgtacaa

SEQ ID NO: 2234631 - DNA, 19 bp, Homo sapiens
taatgaaagactgtacaaa

SEQ ID NO: 2234632 - DNA, 14 bp, Homo sapiens
taatgcgtgcatac

SEQ ID NO: 2234633 - DNA, 22 bp, Homo sapiens
taatgcgtgcataccacttttg

SEQ ID NO: 2234634 - DNA, 13 bp, Homo sapiens
taatgtactgcat

SEQ ID NO: 2234635 - DNA, 15 bp, Homo sapiens
taatgtcacaggcag

SEQ ID NO: 2234636 - DNA, 23 bp, Homo sapiens
taattagttcctcattagcattt

SEQ ID NO: 2234637 - DNA, 20 bp, Homo sapiens
taattgacaggattattgga

SEQ ID NO: 2234638 - DNA, 19 bp, Homo sapiens
taatttgtgatacaatgct

SEQ ID NO: 2234639 - DNA, 15 bp, Homo sapiens
tacaaaagcatgtga

SEQ ID NO: 2234640 - DNA, 14 bp, Homo sapiens
tacaaagtagaagt

SEQ ID NO: 2234641 - DNA, 16 bp, Homo sapiens
tacaagcgtgagccac

SEQ ID NO: 2234642 - DNA, 18 bp, Homo sapiens
tacaagcgtgagccactg

SEQ ID NO: 2234643 - DNA, 20 bp, Homo sapiens
tacaagcgtgagccactgca

SEQ ID NO: 2234644 - DNA, 14 bp, Homo sapiens
tacaatgctgtgcc

SEQ ID NO: 2234645 - DNA, 21 bp, Homo sapiens
tacaatgctgtgccctaaagt

SEQ ID NO: 2234646 - DNA, 23 bp, Homo sapiens
tacacaatggttttcttgtgtgt

SEQ ID NO: 2234647 - DNA, 11 bp, Homo sapiens
tacacacacac

SEQ ID NO: 2234648 - DNA, 19 bp, Homo sapiens
tacacattttattttatta

SEQ ID NO: 2234649 - DNA, 22 bp, Homo sapiens
tacacattttattttattatgc

SEQ ID NO: 2234650 - DNA, 18 bp, Homo sapiens
tacaccactacattctgt

SEQ ID NO: 2234651 - DNA, 19 bp, Homo sapiens
tacaccactacattctgtt

SEQ ID NO: 2234652 - DNA, 15 bp, Homo sapiens
tacactaaaaggtga

SEQ ID NO: 2234653 - DNA, 21 bp, Homo sapiens
tacactgtgctgagtctgaag

SEQ ID NO: 2234654 - DNA, 18 bp, Homo sapiens
tacactgtttcaaacttt

SEQ ID NO: 2234655 - DNA, 19 bp, Homo sapiens
tacactgtttcaaacttta

SEQ ID NO: 2234656 - DNA, 20 bp, Homo sapiens
tacactgtttcaaactttac

SEQ ID NO: 2234657 - DNA, 16 bp, Homo sapiens
tacacttacactttat

SEQ ID NO: 2234658 - DNA, 23 bp, Homo sapiens
tatttcctatattgttttcagtg

SEQ ID NO: 2234659 - DNA, 15 bp, Homo sapiens
tattttgctttgtga

SEQ ID NO: 2234660 - DNA, 15 bp, Homo sapiens
tcaaaaaaagaaaaa

SEQ ID NO: 2234661 - DNA, 16 bp, Homo sapiens
tcaaaagctgggcagg

SEQ ID NO: 2234662 - DNA, 14 bp, Homo sapiens
tcaaactcttaaaa

SEQ ID NO: 2234663 - DNA, 13 bp, Homo sapiens
tcaaactttacta

SEQ ID NO: 2234664 - DNA, 15 bp, Homo sapiens
tcaaactttactatg

SEQ ID NO: 2234665 - DNA, 16 bp, Homo sapiens
tcaaactttactatgg

SEQ ID NO: 2234666 - DNA, 13 bp, Homo sapiens
tcaaagatatttt

SEQ ID NO: 2234667 - DNA, 20 bp, Homo sapiens
tcaaagatattttgctttgt

SEQ ID NO: 2234668 - DNA, 18 bp, Homo sapiens
tcaaataactaaaaggta

SEQ ID NO: 2234669 - DNA, 15 bp, Homo sapiens
tcaaatttctaaatc

SEQ ID NO: 2234670 - DNA, 23 bp, Homo sapiens
tcaaccccttcgctcctgtgtct

SEQ ID NO: 2234671 - DNA, 13 bp, Homo sapiens
tcaacctcctggg

SEQ ID NO: 2234672 - DNA, 16 bp, Homo sapiens
tcaacctcctgggcta

SEQ ID NO: 2234673 - DNA, 20 bp, Homo sapiens
tcaactgcatcaagatgtga

SEQ ID NO: 2234674 - DNA, 20 bp, Homo sapiens
tcaagccaccaacatactcc

SEQ ID NO: 2234675 - DNA, 18 bp, Homo sapiens
tcaagcgattcttctgct

SEQ ID NO: 2234676 - DNA, 15 bp, Homo sapiens
tcaaggatcctgagc

SEQ ID NO: 2234677 - DNA, 19 bp, Homo sapiens
tcaaggatcctgagccaga

SEQ ID NO: 2234678 - DNA, 17 bp, Homo sapiens
tcaagtgattctcctgc

SEQ ID NO: 2234679 - DNA, 13 bp, Homo sapiens
tcaattacaggaa

SEQ ID NO: 2234680 - DNA, 19 bp, Homo sapiens
tcaattacaggaagtactg

SEQ ID NO: 2234681 - DNA, 17 bp, Homo sapiens
tcacaaaggatgcccaa

SEQ ID NO: 2234682 - DNA, 21 bp, Homo sapiens
tcacacagtattacttctgct

SEQ ID NO: 2234683 - DNA, 13 bp, Homo sapiens
tcacacagtgagt

SEQ ID NO: 2234684 - DNA, 14 bp, Homo sapiens
tcacagatgggtgc

SEQ ID NO: 2234685 - DNA, 11 bp, Homo sapiens
tcacaggcagg

SEQ ID NO: 2234686 - DNA, 12 bp, Homo sapiens
tcacaggcaggt

SEQ ID NO: 2234687 - DNA, 15 bp, Homo sapiens
tcacaggcaggtcca

SEQ ID NO: 2234688 - DNA, 18 bp, Homo sapiens
tcacaggcaggtccaggg

SEQ ID NO: 2234689 - DNA, 23 bp, Homo sapiens
tcacagtccttaccagcagagca

SEQ ID NO: 2234690 - DNA, 15 bp, Homo sapiens
tcacagttctctcct

SEQ ID NO: 2234691 - DNA, 16 bp, Homo sapiens
tcacagttctctcctt

SEQ ID NO: 2234692 - DNA, 12 bp, Homo sapiens
tcacatatctgt

SEQ ID NO: 2234693 - DNA, 17 bp, Homo sapiens
tcaccaacgtctgtgcc

SEQ ID NO: 2234694 - DNA, 18 bp, Homo sapiens
tcaccaacgtctgtgcca

SEQ ID NO: 2234695 - DNA, 13 bp, Homo sapiens
tcaccaagcccag

SEQ ID NO: 2234696 - DNA, 22 bp, Homo sapiens
tcaccccggccacctgcggtgc

SEQ ID NO: 2234697 - DNA, 12 bp, Homo sapiens
tcacccttttct

SEQ ID NO: 2234698 - DNA, 19 bp, Homo sapiens
tcaccgaaaacgtggctgc

SEQ ID NO: 2234699 - DNA, 14 bp, Homo sapiens
tcacctttcccatc

SEQ ID NO: 2234700 - DNA, 22 bp, Homo sapiens
tcacctttgtccccaccgcaga

SEQ ID NO: 2234701 - DNA, 17 bp, Homo sapiens
tcactatgttgcccagg

SEQ ID NO: 2234702 - DNA, 21 bp, Homo sapiens
tcactatgttgcccaggcagg

SEQ ID NO: 2234703 - DNA, 14 bp, Homo sapiens
tcactctccttggt

SEQ ID NO: 2234704 - DNA, 12 bp, Homo sapiens
tcactctggcag

SEQ ID NO: 2234705 - DNA, 15 bp, Homo sapiens
tcactctggcagctc

SEQ ID NO: 2234706 - DNA, 18 bp, Homo sapiens
tcactctggcagctcaga

SEQ ID NO: 2234707 - DNA, 22 bp, Homo sapiens
tcactctgtcgcccagtctgga

SEQ ID NO: 2234708 - DNA, 13 bp, Homo sapiens
tcactgagacagc

SEQ ID NO: 2234709 - DNA, 17 bp, Homo sapiens
tcactgagacagcccgg

SEQ ID NO: 2234710 - DNA, 18 bp, Homo sapiens
tcactgcttaacttcaca

SEQ ID NO: 2234711 - DNA, 15 bp, Homo sapiens
tcagaaatgtgttat

SEQ ID NO: 2234712 - DNA, 22 bp, Homo sapiens
tcagaagtttctgccgcagccc

SEQ ID NO: 2234713 - DNA, 18 bp, Homo sapiens
tcagaatctcaaataact

SEQ ID NO: 2234714 - DNA, 10 bp, Homo sapiens
tcagaattct

SEQ ID NO: 2234715 - DNA, 13 bp, Homo sapiens
tcagacagctgcc

SEQ ID NO: 2234716 - DNA, 14 bp, Homo sapiens
tcagacagctgcct

SEQ ID NO: 2234717 - DNA, 16 bp, Homo sapiens
tcagacagctgcctgg

SEQ ID NO: 2234718 - DNA, 17 bp, Homo sapiens
tcagagactcctgcagg

SEQ ID NO: 2234719 - DNA, 21 bp, Homo sapiens
tcagagactcctgcaggcagc

SEQ ID NO: 2234720 - DNA, 15 bp, Homo sapiens
tcagagcctgcagtt

SEQ ID NO: 2234721 - DNA, 18 bp, Homo sapiens
tcagagcctgcagttatt

SEQ ID NO: 2234722 - DNA, 15 bp, Homo sapiens
tcagcacgatttctg

SEQ ID NO: 2234723 - DNA, 17 bp, Homo sapiens
tcagcacgatttctgtt

SEQ ID NO: 2234724 - DNA, 19 bp, Homo sapiens
tcagcacgatttctgttta

SEQ ID NO: 2234725 - DNA, 18 bp, Homo sapiens
tcagcatcctggcacccg

SEQ ID NO: 2234726 - DNA, 22 bp, Homo sapiens
tcagccaagaattcttaaatat

SEQ ID NO: 2234727 - DNA, 14 bp, Homo sapiens
tcagcctcccaaag

SEQ ID NO: 2234728 - DNA, 19 bp, Homo sapiens
tcagcctcccaaagtgctg

SEQ ID NO: 2234729 - DNA, 22 bp, Homo sapiens
tcagcctcccaaagtgctggga

SEQ ID NO: 2234730 - DNA, 20 bp, Homo sapiens
tcagcctcccgagtagctgg

SEQ ID NO: 2234731 - DNA, 19 bp, Homo sapiens
tcagcctgctccagctgtt

SEQ ID NO: 2234732 - DNA, 16 bp, Homo sapiens
tcagcggggacagctc

SEQ ID NO: 2234733 - DNA, 23 bp, Homo sapiens
tcagcggggacagctccttctgt

SEQ ID NO: 2234734 - DNA, 14 bp, Homo sapiens
tcagctccagctca

SEQ ID NO: 2234735 - DNA, 18 bp, Homo sapiens
tcagctccagctcaccag

SEQ ID NO: 2234736 - DNA, 16 bp, Homo sapiens
tcagctgaacctgggt

SEQ ID NO: 2234737 - DNA, 20 bp, Homo sapiens
tcagcttgtaaatagctcag

SEQ ID NO: 2234738 - DNA, 22 bp, Homo sapiens
tcagcttgtaaatagctcaggt

SEQ ID NO: 2234739 - DNA, 13 bp, Homo sapiens
tcaggaagctcag

SEQ ID NO: 2234740 - DNA, 14 bp, Homo sapiens
tcaggaagctcagg

SEQ ID NO: 2234741 - DNA, 13 bp, Homo sapiens
tcaggccagctgc

SEQ ID NO: 2234742 - DNA, 15 bp, Homo sapiens
tcaggccagctgctt

SEQ ID NO: 2234743 - DNA, 17 bp, Homo sapiens
tcaggccaggccctctg

SEQ ID NO: 2234744 - DNA, 18 bp, Homo sapiens
tcaggccaggccctctgc

SEQ ID NO: 2234745 - DNA, 19 bp, Homo sapiens
tcaggggtgtgcggccttt

SEQ ID NO: 2234746 - DNA, 13 bp, Homo sapiens
tcagggtccctgg

SEQ ID NO: 2234747 - DNA, 16 bp, Homo sapiens
tcagggttggcccctg

SEQ ID NO: 2234748 - DNA, 18 bp, Homo sapiens
tcaggtgctgccatccag

SEQ ID NO: 2234749 - DNA, 14 bp, Homo sapiens
tcaggtggggcagc

SEQ ID NO: 2234750 - DNA, 19 bp, Homo sapiens
tcaggtggggcagcttgag

SEQ ID NO: 2234751 - DNA, 21 bp, Homo sapiens
tcaggtggggtcactctggca

SEQ ID NO: 2234752 - DNA, 23 bp, Homo sapiens
tcagtctgattcccaagctctgc

SEQ ID NO: 2234753 - DNA, 16 bp, Homo sapiens
tcagtgccaaaaacaa

SEQ ID NO: 2234754 - DNA, 10 bp, Homo sapiens
tcagtgcctt

SEQ ID NO: 2234755 - DNA, 14 bp, Homo sapiens
tcagtgccttatgg

SEQ ID NO: 2234756 - DNA, 23 bp, Homo sapiens
tcagtgccttatggaacactctg

SEQ ID NO: 2234757 - DNA, 11 bp, Homo sapiens
tcagtggcagc

SEQ ID NO: 2234758 - DNA, 16 bp, Homo sapiens
tcagtggcagctgctt

SEQ ID NO: 2234759 - DNA, 15 bp, Homo sapiens
tcatacccaccccca

SEQ ID NO: 2234760 - DNA, 19 bp, Homo sapiens
tcatagtatggtggctggg

SEQ ID NO: 2234761 - DNA, 18 bp, Homo sapiens
tgcagcctcacagtcctt

SEQ ID NO: 2234762 - DNA, 14 bp, Homo sapiens
tgcaggacctcagg

SEQ ID NO: 2234763 - DNA, 16 bp, Homo sapiens
tgcaggacctcaggtg

SEQ ID NO: 2234764 - DNA, 18 bp, Homo sapiens
tgcaggacctcaggtgag

SEQ ID NO: 2234765 - DNA, 13 bp, Homo sapiens
tgcaggcagccag

SEQ ID NO: 2234766 - DNA, 16 bp, Homo sapiens
tgcagtgcttccaagg

SEQ ID NO: 2234767 - DNA, 20 bp, Homo sapiens
tgcagtggtgcgatctgggt

SEQ ID NO: 2234768 - DNA, 13 bp, Homo sapiens
tgcagttgccagt

SEQ ID NO: 2234769 - DNA, 12 bp, Homo sapiens
tgcataccactt

SEQ ID NO: 2234770 - DNA, 16 bp, Homo sapiens
tgcataccacttttgt

SEQ ID NO: 2234771 - DNA, 22 bp, Homo sapiens
tgcataccacttttgttcttgg

SEQ ID NO: 2234772 - DNA, 19 bp, Homo sapiens
tgcatcaagatgtgacatg

SEQ ID NO: 2234773 - DNA, 17 bp, Homo sapiens
tgcatcgtttcatcttc

SEQ ID NO: 2234774 - DNA, 21 bp, Homo sapiens
tgcatgctgtcccttacgtga

SEQ ID NO: 2234775 - DNA, 19 bp, Homo sapiens
tgcatgttacataagataa

SEQ ID NO: 2234776 - DNA, 21 bp, Homo sapiens
tgcattatctagatactgtat

SEQ ID NO: 2234777 - DNA, 22 bp, Homo sapiens
tgcattatctagatactgtatc

SEQ ID NO: 2234778 - DNA, 19 bp, Homo sapiens
tgcatttgaaaattttgat

SEQ ID NO: 2234779 - DNA, 21 bp, Homo sapiens
tgcatttgaggtctgttcttt

SEQ ID NO: 2234780 - DNA, 22 bp, Homo sapiens
tgccactacggaatagttggct

SEQ ID NO: 2234781 - DNA, 17 bp, Homo sapiens
tgccagccgagatagcc

SEQ ID NO: 2234782 - DNA, 12 bp, Homo sapiens
tgccaggaagcc

SEQ ID NO: 2234783 - DNA, 18 bp, Homo sapiens
tgccaggaagccagcagg

SEQ ID NO: 2234784 - DNA, 18 bp, Homo sapiens
tgccaggtttttggtctg

SEQ ID NO: 2234785 - DNA, 16 bp, Homo sapiens
tgccagtcaccccggc

SEQ ID NO: 2234786 - DNA, 20 bp, Homo sapiens
tgccagtcaccccggccacc

SEQ ID NO: 2234787 - DNA, 20 bp, Homo sapiens
tgccatattctgttggccag

SEQ ID NO: 2234788 - DNA, 23 bp, Homo sapiens
tgccatgaggaacaaggcaaggc

SEQ ID NO: 2234789 - DNA, 17 bp, Homo sapiens
tgcccaaagatgcagcc

SEQ ID NO: 2234790 - DNA, 20 bp, Homo sapiens
tgcccaaagatgcagccggt

SEQ ID NO: 2234791 - DNA, 14 bp, Homo sapiens
tgcccacaggatca

SEQ ID NO: 2234792 - DNA, 19 bp, Homo sapiens
tgcccacaggatcagtctg

SEQ ID NO: 2234793 - DNA, 14 bp, Homo sapiens
tgcccacctggcct

SEQ ID NO: 2234794 - DNA, 13 bp, Homo sapiens
tgcccactccctg

SEQ ID NO: 2234795 - DNA, 14 bp, Homo sapiens
tgcccactccctgc

SEQ ID NO: 2234796 - DNA, 10 bp, Homo sapiens
tgcccagccc

SEQ ID NO: 2234797 - DNA, 12 bp, Homo sapiens
tgcccagcccct

SEQ ID NO: 2234798 - DNA, 16 bp, Homo sapiens
tgcccagccccttctg

SEQ ID NO: 2234799 - DNA, 14 bp, Homo sapiens
tgcccaggcaggtc

SEQ ID NO: 2234800 - DNA, 16 bp, Homo sapiens
tgcccaggcaggtctt

SEQ ID NO: 2234801 - DNA, 12 bp, Homo sapiens
tgcccaggcccc

SEQ ID NO: 2234802 - DNA, 15 bp, Homo sapiens
tgcccaggcccctgc

SEQ ID NO: 2234803 - DNA, 15 bp, Homo sapiens
tgcccaggcctcccc

SEQ ID NO: 2234804 - DNA, 16 bp, Homo sapiens
tgcccaggcctcccca

SEQ ID NO: 2234805 - DNA, 18 bp, Homo sapiens
tgcccaggctggcgtgca

SEQ ID NO: 2234806 - DNA, 19 bp, Homo sapiens
tgcccaggctggcgtgcag

SEQ ID NO: 2234807 - DNA, 12 bp, Homo sapiens
tgcccccacccc

SEQ ID NO: 2234808 - DNA, 12 bp, Homo sapiens
tgcccggctgcg

SEQ ID NO: 2234809 - DNA, 14 bp, Homo sapiens
tgcccggctgcgga

SEQ ID NO: 2234810 - DNA, 16 bp, Homo sapiens
tgcccggggatccccc

SEQ ID NO: 2234811 - DNA, 19 bp, Homo sapiens
tgccctccaagaccttctc

SEQ ID NO: 2234812 - DNA, 20 bp, Homo sapiens
tgccctccaagaccttctcc

SEQ ID NO: 2234813 - DNA, 15 bp, Homo sapiens
tgccctcccaccccc

SEQ ID NO: 2234814 - DNA, 21 bp, Homo sapiens
tgccctgcccacctggcctct

SEQ ID NO: 2234815 - DNA, 23 bp, Homo sapiens
tgccctgtgagtactacagtcct

SEQ ID NO: 2234816 - DNA, 18 bp, Homo sapiens
tgccctgtgggcccccaa

SEQ ID NO: 2234817 - DNA, 13 bp, Homo sapiens
tgcctcccatcac

SEQ ID NO: 2234818 - DNA, 18 bp, Homo sapiens
tgcctcctttgtgaggaa

SEQ ID NO: 2234819 - DNA, 21 bp, Homo sapiens
tgcctcctttgtgaggaagcc

SEQ ID NO: 2234820 - DNA, 19 bp, Homo sapiens
tgcctcgaactggctgcaa

SEQ ID NO: 2234821 - DNA, 20 bp, Homo sapiens
tgcctcgaactggctgcaaa

SEQ ID NO: 2234822 - DNA, 14 bp, Homo sapiens
tgcctctgacacac

SEQ ID NO: 2234823 - DNA, 20 bp, Homo sapiens
tgcctctgacacacagctct

SEQ ID NO: 2234824 - DNA, 12 bp, Homo sapiens
tgcctctgcctc

SEQ ID NO: 2234825 - DNA, 13 bp, Homo sapiens
tgcctctgcctct

SEQ ID NO: 2234826 - DNA, 14 bp, Homo sapiens
tgcctctgcctctg

SEQ ID NO: 2234827 - DNA, 19 bp, Homo sapiens
tgcctgcccaggcccctgc

SEQ ID NO: 2234828 - DNA, 24 bp, Homo sapiens
tgcctgcccaggcccctgccaccc

SEQ ID NO: 2234829 - DNA, 15 bp, Homo sapiens
tgcctggtggcagct

SEQ ID NO: 2234830 - DNA, 17 bp, Homo sapiens
tgcctggtggcagctgc

SEQ ID NO: 2234831 - DNA, 15 bp, Homo sapiens
tgcctgttcagctcc

SEQ ID NO: 2234832 - DNA, 20 bp, Homo sapiens
tgcctgttcagctccagctc

SEQ ID NO: 2234833 - DNA, 21 bp, Homo sapiens
tgcctgttcagctccagctca

SEQ ID NO: 2234834 - DNA, 20 bp, Homo sapiens
tgcctgttgggccaggagcc

SEQ ID NO: 2234835 - DNA, 20 bp, Homo sapiens
tgccttaccctcatgttctt

SEQ ID NO: 2234836 - DNA, 21 bp, Homo sapiens
tgccttaccctcatgttctta

SEQ ID NO: 2234837 - DNA, 15 bp, Homo sapiens
tgccttatggaacac

SEQ ID NO: 2234838 - DNA, 21 bp, Homo sapiens
tgccttatggaacactctgag

SEQ ID NO: 2234839 - DNA, 19 bp, Homo sapiens
tgcgatctgggttcactgc

SEQ ID NO: 2234840 - DNA, 21 bp, Homo sapiens
tgcgatctgggttcactgcaa

SEQ ID NO: 2234841 - DNA, 22 bp, Homo sapiens
tgcggacagccacggccaggcc

SEQ ID NO: 2234842 - DNA, 23 bp, Homo sapiens
tgcggacagccacggccaggcca

SEQ ID NO: 2234843 - DNA, 16 bp, Homo sapiens
tgcgggggagcaggca

SEQ ID NO: 2234844 - DNA, 17 bp, Homo sapiens
tgcggtccacccaggag

SEQ ID NO: 2234845 - DNA, 18 bp, Homo sapiens
tgcggtccacccaggagc

SEQ ID NO: 2234846 - DNA, 21 bp, Homo sapiens
tgcggtgctatctcccccagc

SEQ ID NO: 2234847 - DNA, 23 bp, Homo sapiens
tgcggtgctatctcccccagccc

SEQ ID NO: 2234848 - DNA, 15 bp, Homo sapiens
tgctaaatgtgaatg

SEQ ID NO: 2234849 - DNA, 20 bp, Homo sapiens
tgctaggaacactccttcac

SEQ ID NO: 2234850 - DNA, 22 bp, Homo sapiens
tgctaggaacactccttcacag

SEQ ID NO: 2234851 - DNA, 15 bp, Homo sapiens
tgctcacatatctgt

SEQ ID NO: 2234852 - DNA, 19 bp, Homo sapiens
tgctccagctgttcagctg

SEQ ID NO: 2234853 - DNA, 17 bp, Homo sapiens
tgctcctctccccagca

SEQ ID NO: 2234854 - DNA, 19 bp, Homo sapiens
tgctcctctccccagcaag

SEQ ID NO: 2234855 - DNA, 18 bp, Homo sapiens
tgctcctttcttgtttta

SEQ ID NO: 2234856 - DNA, 23 bp, Homo sapiens
tgctctccgaccagacaccttga

SEQ ID NO: 2234857 - DNA, 18 bp, Homo sapiens
tgctctgcatgttacata

SEQ ID NO: 2234858 - DNA, 22 bp, Homo sapiens
tgctctgctgacagacacaggc

SEQ ID NO: 2234859 - DNA, 21 bp, Homo sapiens
tgctgaaggctcgagcatgcc

SEQ ID NO: 2234860 - DNA, 22 bp, Homo sapiens
tgctgacagacacaggcccggc

SEQ ID NO: 2234861 - DNA, 19 bp, Homo sapiens
gcctagcatacgtacacat

SEQ ID NO: 2234862 - DNA, 22 bp, Homo sapiens
gcctagcatacgtacacatttt

SEQ ID NO: 2234863 - DNA, 15 bp, Homo sapiens
gcctaggtgacagag

SEQ ID NO: 2234864 - DNA, 14 bp, Homo sapiens
gcctcaacctcctg

SEQ ID NO: 2234865 - DNA, 18 bp, Homo sapiens
gcctcaacctcctgggct

SEQ ID NO: 2234866 - DNA, 24 bp, Homo sapiens
gcctcaagtgattctcctgcctca

SEQ ID NO: 2234867 - DNA, 13 bp, Homo sapiens
gcctcacagtcct

SEQ ID NO: 2234868 - DNA, 14 bp, Homo sapiens
gcctcagtgccact

SEQ ID NO: 2234869 - DNA, 15 bp, Homo sapiens
gcctcagtgccacta

SEQ ID NO: 2234870 - DNA, 17 bp, Homo sapiens
gcctcccaaagtgctgg

SEQ ID NO: 2234871 - DNA, 19 bp, Homo sapiens
gcctcccaactcaccccag

SEQ ID NO: 2234872 - DNA, 14 bp, Homo sapiens
gcctcccacgactg

SEQ ID NO: 2234873 - DNA, 21 bp, Homo sapiens
gcctcccacgactgcccggca

SEQ ID NO: 2234874 - DNA, 14 bp, Homo sapiens
gcctcccatcaccc

SEQ ID NO: 2234875 - DNA, 16 bp, Homo sapiens
gcctcccatcacccgc

SEQ ID NO: 2234876 - DNA, 20 bp, Homo sapiens
gcctcccgaatagctgggac

SEQ ID NO: 2234877 - DNA, 21 bp, Homo sapiens
gcctcccgagtagctgggact

SEQ ID NO: 2234878 - DNA, 23 bp, Homo sapiens
gcctcccgagtagctgggactac

SEQ ID NO: 2234879 - DNA, 13 bp, Homo sapiens
gcctcctccagcc

SEQ ID NO: 2234880 - DNA, 20 bp, Homo sapiens
gcctcctttgtgaggaagcc

SEQ ID NO: 2234881 - DNA, 13 bp, Homo sapiens
gcctcgaactggc

SEQ ID NO: 2234882 - DNA, 16 bp, Homo sapiens
gcctctgcactcccct

SEQ ID NO: 2234883 - DNA, 13 bp, Homo sapiens
gcctctgcctctg

SEQ ID NO: 2234884 - DNA, 14 bp, Homo sapiens
gcctctgggactgg

SEQ ID NO: 2234885 - DNA, 12 bp, Homo sapiens
gcctcttctcta

SEQ ID NO: 2234886 - DNA, 12 bp, Homo sapiens
gcctgagctggg

SEQ ID NO: 2234887 - DNA, 13 bp, Homo sapiens
gcctgcccaggcc

SEQ ID NO: 2234888 - DNA, 19 bp, Homo sapiens
gcctgcccaggcccctgcc

SEQ ID NO: 2234889 - DNA, 18 bp, Homo sapiens
gcctgccctcccaccccc

SEQ ID NO: 2234890 - DNA, 15 bp, Homo sapiens
gcctggatggggctg

SEQ ID NO: 2234891 - DNA, 16 bp, Homo sapiens
gcctggatggggctgc

SEQ ID NO: 2234892 - DNA, 20 bp, Homo sapiens
gcctggccagatgcaccagc

SEQ ID NO: 2234893 - DNA, 21 bp, Homo sapiens
gcctggccagatgcaccagcc

SEQ ID NO: 2234894 - DNA, 22 bp, Homo sapiens
gcctggccagatgcaccagccc

SEQ ID NO: 2234895 - DNA, 16 bp, Homo sapiens
gcctggcccctcaggg

SEQ ID NO: 2234896 - DNA, 10 bp, Homo sapiens
gcctggcctg

SEQ ID NO: 2234897 - DNA, 18 bp, Homo sapiens
gcctggcctgagctggga

SEQ ID NO: 2234898 - DNA, 20 bp, Homo sapiens
gcctggcctgagctgggatg

SEQ ID NO: 2234899 - DNA, 21 bp, Homo sapiens
gcctgggaggtcaaggctgca

SEQ ID NO: 2234900 - DNA, 22 bp, Homo sapiens
gcctgggaggtcaaggctgcag

SEQ ID NO: 2234901 - DNA, 23 bp, Homo sapiens
gcctgggatccctcatcctcata

SEQ ID NO: 2234902 - DNA, 16 bp, Homo sapiens
gcctgggcagaaggaa

SEQ ID NO: 2234903 - DNA, 17 bp, Homo sapiens
gcctgggcagaaggaag

SEQ ID NO: 2234904 - DNA, 21 bp, Homo sapiens
gcctgggggctgggcagagga

SEQ ID NO: 2234905 - DNA, 16 bp, Homo sapiens
gcctggggtaggagga

SEQ ID NO: 2234906 - DNA, 17 bp, Homo sapiens
gcctggggtaggaggaa

SEQ ID NO: 2234907 - DNA, 21 bp, Homo sapiens
gcctggggtaggaggaacagg

SEQ ID NO: 2234908 - DNA, 22 bp, Homo sapiens
gcctggggtaggaggaacaggt

SEQ ID NO: 2234909 - DNA, 14 bp, Homo sapiens
gcctggtggcagct

SEQ ID NO: 2234910 - DNA, 16 bp, Homo sapiens
gcctggtggcagctgc

SEQ ID NO: 2234911 - DNA, 18 bp, Homo sapiens
gcctggtggcagctgcgg

SEQ ID NO: 2234912 - DNA, 19 bp, Homo sapiens
gcctggtggcagctgcggt

SEQ ID NO: 2234913 - DNA, 20 bp, Homo sapiens
gcctgtaatcctagcacttt

SEQ ID NO: 2234914 - DNA, 16 bp, Homo sapiens
gcctgtgcctctggga

SEQ ID NO: 2234915 - DNA, 17 bp, Homo sapiens
gcctgtgcctctgggac

SEQ ID NO: 2234916 - DNA, 20 bp, Homo sapiens
gcctgttgggccaggagcct

SEQ ID NO: 2234917 - DNA, 18 bp, Homo sapiens
gccttaccctcatgttct

SEQ ID NO: 2234918 - DNA, 20 bp, Homo sapiens
gccttagaagtcacacagta

SEQ ID NO: 2234919 - DNA, 14 bp, Homo sapiens
gccttatggaacac

SEQ ID NO: 2234920 - DNA, 16 bp, Homo sapiens
gccttatggaacactc

SEQ ID NO: 2234921 - DNA, 19 bp, Homo sapiens
gccttatggaacactctga

SEQ ID NO: 2234922 - DNA, 21 bp, Homo sapiens
gccttatggaacactctgaga

SEQ ID NO: 2234923 - DNA, 23 bp, Homo sapiens
gccttatggaacactctgagact

SEQ ID NO: 2234924 - DNA, 16 bp, Homo sapiens
gccttccaggggtggg

SEQ ID NO: 2234925 - DNA, 15 bp, Homo sapiens
gccttctctgaagga

SEQ ID NO: 2234926 - DNA, 14 bp, Homo sapiens
gccttgaactttga

SEQ ID NO: 2234927 - DNA, 23 bp, Homo sapiens
gccttgaactttgacctctgcag

SEQ ID NO: 2234928 - DNA, 16 bp, Homo sapiens
gccttgaccattctcc

SEQ ID NO: 2234929 - DNA, 15 bp, Homo sapiens
gcgaaccgtgaggag

SEQ ID NO: 2234930 - DNA, 13 bp, Homo sapiens
gcgacaatgcaaa

SEQ ID NO: 2234931 - DNA, 23 bp, Homo sapiens
gcgacaatgcaaaccatcattga

SEQ ID NO: 2234932 - DNA, 23 bp, Homo sapiens
gcgattcttctgcttcagcctcc

SEQ ID NO: 2234933 - DNA, 20 bp, Homo sapiens
gcgcagcatattcaggaagc

SEQ ID NO: 2234934 - DNA, 21 bp, Homo sapiens
gcgcagcatattcaggaagct

SEQ ID NO: 2234935 - DNA, 15 bp, Homo sapiens
gcgcctacaggagtg

SEQ ID NO: 2234936 - DNA, 14 bp, Homo sapiens
gcgctgcccctggc

SEQ ID NO: 2234937 - DNA, 17 bp, Homo sapiens
gcgctgcccctggcagc

SEQ ID NO: 2234938 - DNA, 19 bp, Homo sapiens
gcggacagccacggccagg

SEQ ID NO: 2234939 - DNA, 21 bp, Homo sapiens
gcgggaggatgttctgggaca

SEQ ID NO: 2234940 - DNA, 15 bp, Homo sapiens
gcgggcttcctcctg

SEQ ID NO: 2234941 - DNA, 13 bp, Homo sapiens
gcggggacagctc

SEQ ID NO: 2234942 - DNA, 19 bp, Homo sapiens
gcggggacagctccttctg

SEQ ID NO: 2234943 - DNA, 19 bp, Homo sapiens
gcggtccacccaggagccc

SEQ ID NO: 2234944 - DNA, 19 bp, Homo sapiens
gcgtctcatactcacctca

SEQ ID NO: 2234945 - DNA, 14 bp, Homo sapiens
gcgtgagccactgc

SEQ ID NO: 2234946 - DNA, 15 bp, Homo sapiens
gcgtgagccactgca

SEQ ID NO: 2234947 - DNA, 16 bp, Homo sapiens
gcgtgagccactgcac

SEQ ID NO: 2234948 - DNA, 23 bp, Homo sapiens
gcgtgagccactgcaccgggcca

SEQ ID NO: 2234949 - DNA, 19 bp, Homo sapiens
gcgtgcacacaccagagcc

SEQ ID NO: 2234950 - DNA, 13 bp, Homo sapiens
gctaaatgtgaat

SEQ ID NO: 2234951 - DNA, 16 bp, Homo sapiens
ggaaggaaacccagct

SEQ ID NO: 2234952 - DNA, 20 bp, Homo sapiens
ggaaggaaacccagctctgg

SEQ ID NO: 2234953 - DNA, 12 bp, Homo sapiens
ggaagtactgga

SEQ ID NO: 2234954 - DNA, 15 bp, Homo sapiens
ggaatacctgtcccc

SEQ ID NO: 2234955 - DNA, 16 bp, Homo sapiens
ggaatccagacccggc

SEQ ID NO: 2234956 - DNA, 16 bp, Homo sapiens
ggaatgcgggggagca

SEQ ID NO: 2234957 - DNA, 20 bp, Homo sapiens
ggaatgcgggggagcaggca

SEQ ID NO: 2234958 - DNA, 12 bp, Homo sapiens
ggacacagctct

SEQ ID NO: 2234959 - DNA, 14 bp, Homo sapiens
ggacacagctcttc

SEQ ID NO: 2234960 - DNA, 22 bp, Homo sapiens
ggacactcaaaagctgggcagg

SEQ ID NO: 2234961 - DNA, 20 bp, Homo sapiens
ggacagccacggccaggcca

SEQ ID NO: 2234962 - DNA, 16 bp, Homo sapiens
ggacagctccttctgt

SEQ ID NO: 2234963 - DNA, 19 bp, Homo sapiens
ggaccagagctgccacctg

SEQ ID NO: 2234964 - DNA, 15 bp, Homo sapiens
ggacctcaggcctgg

SEQ ID NO: 2234965 - DNA, 20 bp, Homo sapiens
ggacctcaggcctgggggct

SEQ ID NO: 2234966 - DNA, 18 bp, Homo sapiens
ggaccttgaactgggtac

SEQ ID NO: 2234967 - DNA, 20 bp, Homo sapiens
ggacgtgttatgactccaga

SEQ ID NO: 2234968 - DNA, 20 bp, Homo sapiens
ggactaacttgtctttggac

SEQ ID NO: 2234969 - DNA, 14 bp, Homo sapiens
ggactacaggtgtg

SEQ ID NO: 2234970 - DNA, 15 bp, Homo sapiens
ggacttggaagctcc

SEQ ID NO: 2234971 - DNA, 16 bp, Homo sapiens
ggagaaaggaagggct

SEQ ID NO: 2234972 - DNA, 22 bp, Homo sapiens
ggagaaccaaaaagaggctatg

SEQ ID NO: 2234973 - DNA, 19 bp, Homo sapiens
ggagaatttttactgggga

SEQ ID NO: 2234974 - DNA, 16 bp, Homo sapiens
ggagagccttccaggg

SEQ ID NO: 2234975 - DNA, 15 bp, Homo sapiens
ggagaggggcacagg

SEQ ID NO: 2234976 - DNA, 13 bp, Homo sapiens
ggagcagccacat

SEQ ID NO: 2234977 - DNA, 11 bp, Homo sapiens
ggagcaggcag

SEQ ID NO: 2234978 - DNA, 22 bp, Homo sapiens
ggagccccgaggccttctctga

SEQ ID NO: 2234979 - DNA, 15 bp, Homo sapiens
ggagcctcctgccct

SEQ ID NO: 2234980 - DNA, 19 bp, Homo sapiens
ggaggaaggaaacccagct

SEQ ID NO: 2234981 - DNA, 11 bp, Homo sapiens
ggaggccagcc

SEQ ID NO: 2234982 - DNA, 12 bp, Homo sapiens
ggaggccagcct

SEQ ID NO: 2234983 - DNA, 12 bp, Homo sapiens
ggagggagggct

SEQ ID NO: 2234984 - DNA, 14 bp, Homo sapiens
ggaggggaagaaaa

SEQ ID NO: 2234985 - DNA, 16 bp, Homo sapiens
ggaggggtgtgggcac

SEQ ID NO: 2234986 - DNA, 22 bp, Homo sapiens
ggaggtaaggaatacctgtccc

SEQ ID NO: 2234987 - DNA, 16 bp, Homo sapiens
ggaggtcgaggcagga

SEQ ID NO: 2234988 - DNA, 22 bp, Homo sapiens
ggaggtgggatcctccaggtgc

SEQ ID NO: 2234989 - DNA, 20 bp, Homo sapiens
ggagtcccaccttggctgca

SEQ ID NO: 2234990 - DNA, 16 bp, Homo sapiens
ggagtgacagaggcag

SEQ ID NO: 2234991 - DNA, 18 bp, Homo sapiens
ggagtgacagaggcagcc

SEQ ID NO: 2234992 - DNA, 12 bp, Homo sapiens
ggagtgagctgg

SEQ ID NO: 2234993 - DNA, 21 bp, Homo sapiens
ggagtgagttgatagcacaga

SEQ ID NO: 2234994 - DNA, 23 bp, Homo sapiens
ggagtgagttgatagcacagacc

SEQ ID NO: 2234995 - DNA, 14 bp, Homo sapiens
ggagtggccacaga

SEQ ID NO: 2234996 - DNA, 15 bp, Homo sapiens
ggagtggccacagaa

SEQ ID NO: 2234997 - DNA, 22 bp, Homo sapiens
ggagtgggcccaatgcactttg

SEQ ID NO: 2234998 - DNA, 18 bp, Homo sapiens
ggatacaaaagcatgtga

SEQ ID NO: 2234999 - DNA, 13 bp, Homo sapiens
ggatccctcatcc

SEQ ID NO: 2235000 - DNA, 17 bp, Homo sapiens
ggatccctcatcctcat

SEQ ID NO: 2235001 - DNA, 14 bp, Homo sapiens
ggatcctccaggtg

SEQ ID NO: 2235002 - DNA, 23 bp, Homo sapiens
ggatcctgagccagatttcactc

SEQ ID NO: 2235003 - DNA, 14 bp, Homo sapiens
ggatgaaaaaataa

SEQ ID NO: 2235004 - DNA, 12 bp, Homo sapiens
ggatgagaaagg

SEQ ID NO: 2235005 - DNA, 16 bp, Homo sapiens
ggatgatctaggaaga

SEQ ID NO: 2235006 - DNA, 17 bp, Homo sapiens
ggatgcagcctcacagt

SEQ ID NO: 2235007 - DNA, 13 bp, Homo sapiens
ggatgcctggtgg

SEQ ID NO: 2235008 - DNA, 19 bp, Homo sapiens
ggatgcctggtggcagctg

SEQ ID NO: 2235009 - DNA, 18 bp, Homo sapiens
ggatggatttccagccaa

SEQ ID NO: 2235010 - DNA, 16 bp, Homo sapiens
ggatggggctgcaccg

SEQ ID NO: 2235011 - DNA, 13 bp, Homo sapiens
ggatgttctggga

SEQ ID NO: 2235012 - DNA, 15 bp, Homo sapiens
ggatgttctgggaca

SEQ ID NO: 2235013 - DNA, 16 bp, Homo sapiens
ggattcttatggacaa

SEQ ID NO: 2235014 - DNA, 16 bp, Homo sapiens
ggattcttcctccctc

SEQ ID NO: 2235015 - DNA, 21 bp, Homo sapiens
ggattcttcctccctccctct

SEQ ID NO: 2235016 - DNA, 13 bp, Homo sapiens
ggattgtccccga

SEQ ID NO: 2235017 - DNA, 16 bp, Homo sapiens
ggattgtccccgaccc

SEQ ID NO: 2235018 - DNA, 20 bp, Homo sapiens
ggattgtccccgacccttgc

SEQ ID NO: 2235019 - DNA, 22 bp, Homo sapiens
ggatttaacagaaatgtacagc

SEQ ID NO: 2235020 - DNA, 15 bp, Homo sapiens
ggcaaaaaggcagga

SEQ ID NO: 2235021 - DNA, 16 bp, Homo sapiens
ggcaacccccagcctg

SEQ ID NO: 2235022 - DNA, 17 bp, Homo sapiens
ggcaagcacctcctgcc

SEQ ID NO: 2235023 - DNA, 16 bp, Homo sapiens
ggcaaggctgtcaatt

SEQ ID NO: 2235024 - DNA, 15 bp, Homo sapiens
ggcaatgctggctgt

SEQ ID NO: 2235025 - DNA, 19 bp, Homo sapiens
ggcacagaaaatggaagac

SEQ ID NO: 2235026 - DNA, 12 bp, Homo sapiens
tctgcccttggt

SEQ ID NO: 2235027 - DNA, 12 bp, Homo sapiens
tctgcctcccat

SEQ ID NO: 2235028 - DNA, 20 bp, Homo sapiens
tctgcctcccatcacccgct

SEQ ID NO: 2235029 - DNA, 21 bp, Homo sapiens
tctgcctctgacacacagctc

SEQ ID NO: 2235030 - DNA, 19 bp, Homo sapiens
tctgcctgaagtcacacag

SEQ ID NO: 2235031 - DNA, 15 bp, Homo sapiens
tctgcctgcccaggc

SEQ ID NO: 2235032 - DNA, 20 bp, Homo sapiens
tctgcctgcccaggcccctg

SEQ ID NO: 2235033 - DNA, 19 bp, Homo sapiens
tctgctcacatatctgtca

SEQ ID NO: 2235034 - DNA, 18 bp, Homo sapiens
tctgctcctctccccagc

SEQ ID NO: 2235035 - DNA, 18 bp, Homo sapiens
tctgctgacagacacagg

SEQ ID NO: 2235036 - DNA, 20 bp, Homo sapiens
tctgctgacagacacaggcc

SEQ ID NO: 2235037 - DNA, 22 bp, Homo sapiens
tctgctgacagacacaggcccg

SEQ ID NO: 2235038 - DNA, 17 bp, Homo sapiens
tctgctgctggctggtt

SEQ ID NO: 2235039 - DNA, 14 bp, Homo sapiens
tctggacaggcatg

SEQ ID NO: 2235040 - DNA, 23 bp, Homo sapiens
tctggcagagttgaagacagagc

SEQ ID NO: 2235041 - DNA, 14 bp, Homo sapiens
tctggcagctcaga

SEQ ID NO: 2235042 - DNA, 16 bp, Homo sapiens
tctggcagctcagaga

SEQ ID NO: 2235043 - DNA, 14 bp, Homo sapiens
tctggctatgcatt

SEQ ID NO: 2235044 - DNA, 15 bp, Homo sapiens
tctggctcttccagg

SEQ ID NO: 2235045 - DNA, 13 bp, Homo sapiens
tctgggacacagt

SEQ ID NO: 2235046 - DNA, 14 bp, Homo sapiens
tctgggacacagtt

SEQ ID NO: 2235047 - DNA, 11 bp, Homo sapiens
tctggggctgt

SEQ ID NO: 2235048 - DNA, 18 bp, Homo sapiens
tctggtccatagagagca

SEQ ID NO: 2235049 - DNA, 23 bp, Homo sapiens
tctggtgactttcctctttggtc

SEQ ID NO: 2235050 - DNA, 15 bp, Homo sapiens
tctgtcatttgagca

SEQ ID NO: 2235051 - DNA, 14 bp, Homo sapiens
tctgtcctactctg

SEQ ID NO: 2235052 - DNA, 20 bp, Homo sapiens
tctgtcctactctgtgtcag

SEQ ID NO: 2235053 - DNA, 14 bp, Homo sapiens
tctgtcgcccagtc

SEQ ID NO: 2235054 - DNA, 13 bp, Homo sapiens
tctgtctaggaat

SEQ ID NO: 2235055 - DNA, 23 bp, Homo sapiens
tctgtgggtttctaaagctgcca

SEQ ID NO: 2235056 - DNA, 13 bp, Homo sapiens
tctgttctttcca

SEQ ID NO: 2235057 - DNA, 22 bp, Homo sapiens
tctgttctttccaaagtacact

SEQ ID NO: 2235058 - DNA, 13 bp, Homo sapiens
tctgtttagataa

SEQ ID NO: 2235059 - DNA, 19 bp, Homo sapiens
tctgtttagataatacacc

SEQ ID NO: 2235060 - DNA, 23 bp, Homo sapiens
tctgtttagataatacaccacta

SEQ ID NO: 2235061 - DNA, 14 bp, Homo sapiens
tcttatgggctggg

SEQ ID NO: 2235062 - DNA, 18 bp, Homo sapiens
tcttattgcccacgctgg

SEQ ID NO: 2235063 - DNA, 17 bp, Homo sapiens
tcttatttaatgaaaga

SEQ ID NO: 2235064 - DNA, 12 bp, Homo sapiens
tcttcagagact

SEQ ID NO: 2235065 - DNA, 21 bp, Homo sapiens
tcttcagagactcctgcaggc

SEQ ID NO: 2235066 - DNA, 16 bp, Homo sapiens
tcttcagtaagccgtg

SEQ ID NO: 2235067 - DNA, 14 bp, Homo sapiens
tcttccaggctggg

SEQ ID NO: 2235068 - DNA, 21 bp, Homo sapiens
tcttccaggctgggagagcct

SEQ ID NO: 2235069 - DNA, 22 bp, Homo sapiens
tcttccctacagttgaaaaaca

SEQ ID NO: 2235070 - DNA, 19 bp, Homo sapiens
tcttctgcttcagcctccc

SEQ ID NO: 2235071 - DNA, 22 bp, Homo sapiens
tcttctgcttcagcctcccgag

SEQ ID NO: 2235072 - DNA, 20 bp, Homo sapiens
tcttctgtacgtctgacagg

SEQ ID NO: 2235073 - DNA, 21 bp, Homo sapiens
tcttctgtacgtctgacaggc

SEQ ID NO: 2235074 - DNA, 22 bp, Homo sapiens
tcttctgtacgtctgacaggca

SEQ ID NO: 2235075 - DNA, 23 bp, Homo sapiens
tcttctgtacgtctgacaggcaa

SEQ ID NO: 2235076 - DNA, 21 bp, Homo sapiens
tcttgaaatataggaacttaa

SEQ ID NO: 2235077 - DNA, 16 bp, Homo sapiens
tcttgaactcctggcc

SEQ ID NO: 2235078 - DNA, 18 bp, Homo sapiens
tcttgaactcctggcctc

SEQ ID NO: 2235079 - DNA, 15 bp, Homo sapiens
tcttgaacttgaaaa

SEQ ID NO: 2235080 - DNA, 23 bp, Homo sapiens
tcttgaacttgaaaaaaaaaaac

SEQ ID NO: 2235081 - DNA, 13 bp, Homo sapiens
tcttgagcctggg

SEQ ID NO: 2235082 - DNA, 16 bp, Homo sapiens
tcttgagccttgaact

SEQ ID NO: 2235083 - DNA, 16 bp, Homo sapiens
tcttgcaatggcagcc

SEQ ID NO: 2235084 - DNA, 17 bp, Homo sapiens
tcttgcaatggcagcct

SEQ ID NO: 2235085 - DNA, 19 bp, Homo sapiens
tcttgcaatggcagccttg

SEQ ID NO: 2235086 - DNA, 15 bp, Homo sapiens
tcttggtcctgctgc

SEQ ID NO: 2235087 - DNA, 17 bp, Homo sapiens
tcttggtcctgctgcag

SEQ ID NO: 2235088 - DNA, 15 bp, Homo sapiens
tctttaatgtcacag

SEQ ID NO: 2235089 - DNA, 18 bp, Homo sapiens
tctttaatgtcacaggca

SEQ ID NO: 2235090 - DNA, 20 bp, Homo sapiens
tctttataattctactttga

SEQ ID NO: 2235091 - DNA, 14 bp, Homo sapiens
tctttccaaagtac

SEQ ID NO: 2235092 - DNA, 16 bp, Homo sapiens
tctttcctgaggctgg

SEQ ID NO: 2235093 - DNA, 17 bp, Homo sapiens
tctttcctgaggctggg

SEQ ID NO: 2235094 - DNA, 13 bp, Homo sapiens
tctttctgctttg

SEQ ID NO: 2235095 - DNA, 21 bp, Homo sapiens
tctttctggctatgcatttga

SEQ ID NO: 2235096 - DNA, 16 bp, Homo sapiens
tctttggaccctgagg

SEQ ID NO: 2235097 - DNA, 15 bp, Homo sapiens
tctttgtacagacaa

SEQ ID NO: 2235098 - DNA, 13 bp, Homo sapiens
tgaaaaaaaaagg

SEQ ID NO: 2235099 - DNA, 15 bp, Homo sapiens
tgaaaaaaaaagggg

SEQ ID NO: 2235100 - DNA, 17 bp, Homo sapiens
tgaaaacacatttttct

SEQ ID NO: 2235101 - DNA, 17 bp, Homo sapiens
tgaaaacactgttctct

SEQ ID NO: 2235102 - DNA, 19 bp, Homo sapiens
tgaaaagaaaaatgagcct

SEQ ID NO: 2235103 - DNA, 13 bp, Homo sapiens
tgaaaattttgat

SEQ ID NO: 2235104 - DNA, 14 bp, Homo sapiens
tgaaacattttgtc

SEQ ID NO: 2235105 - DNA, 18 bp, Homo sapiens
tgaaactggattaaactt

SEQ ID NO: 2235106 - DNA, 16 bp, Homo sapiens
tgaaagactgtacaaa

SEQ ID NO: 2235107 - DNA, 12 bp, Homo sapiens
tgaaaggaaaga

SEQ ID NO: 2235108 - DNA, 17 bp, Homo sapiens
tgaaaggaaagaggctc

SEQ ID NO: 2235109 - DNA, 17 bp, Homo sapiens
tgaaatctttttgcttt

SEQ ID NO: 2235110 - DNA, 21 bp, Homo sapiens
tgaaatgaggtcagagcctgc

SEQ ID NO: 2235111 - DNA, 23 bp, Homo sapiens
tgaaatgaggtcagagcctgcag

SEQ ID NO: 2235112 - DNA, 20 bp, Homo sapiens
tgaaatttttattaaattat

SEQ ID NO: 2235113 - DNA, 19 bp, Homo sapiens
tgaaccacatcttgctctg

SEQ ID NO: 2235114 - DNA, 23 bp, Homo sapiens
tgaaccacatcttgctctgctga

SEQ ID NO: 2235115 - DNA, 22 bp, Homo sapiens
tgaaccgatgagaaataaagtt

SEQ ID NO: 2235116 - DNA, 13 bp, Homo sapiens
tgaactgataaag

SEQ ID NO: 2235117 - DNA, 23 bp, Homo sapiens
tgaactgggtacttgtggacaca

SEQ ID NO: 2235118 - DNA, 20 bp, Homo sapiens
tgaactttgacctctgcagc

SEQ ID NO: 2235119 - DNA, 22 bp, Homo sapiens
tgaactttgacctctgcagcaa

SEQ ID NO: 2235120 - DNA, 21 bp, Homo sapiens
tgaagacaatgacttactgta

SEQ ID NO: 2235121 - DNA, 14 bp, Homo sapiens
tgaagacagagcta

SEQ ID NO: 2235122 - DNA, 22 bp, Homo sapiens
tgaagacttttctttcagccaa

SEQ ID NO: 2235123 - DNA, 15 bp, Homo sapiens
tgaaggccccgccca

SEQ ID NO: 2235124 - DNA, 16 bp, Homo sapiens
tgaaggccccgcccag

SEQ ID NO: 2235125 - DNA, 21 bp, Homo sapiens
tgaaggctgggttctgatcct

SEQ ID NO: 2235126 - DNA, 15 bp, Homo sapiens
tgaagtaatatgcac

SEQ ID NO: 2235127 - DNA, 21 bp, Homo sapiens
tgaagtaatatgcacacattt

SEQ ID NO: 2235128 - DNA, 14 bp, Homo sapiens
tgaagtcacacagt

SEQ ID NO: 2235129 - DNA, 20 bp, Homo sapiens
tgaagtctttgtacagacaa

SEQ ID NO: 2235130 - DNA, 12 bp, Homo sapiens
tgaataatacag

SEQ ID NO: 2235131 - DNA, 15 bp, Homo sapiens
tgaatgtcagtgtga

SEQ ID NO: 2235132 - DNA, 19 bp, Homo sapiens
tgaatgtcagtgtgactga

SEQ ID NO: 2235133 - DNA, 21 bp, Homo sapiens
tgaattgtaaggaatgattaa

SEQ ID NO: 2235134 - DNA, 15 bp, Homo sapiens
tgaatttcttttgcc

SEQ ID NO: 2235135 - DNA, 19 bp, Homo sapiens
tgacaaagactgagtacgt

SEQ ID NO: 2235136 - DNA, 23 bp, Homo sapiens
tgacaacactcattgacctgagg

SEQ ID NO: 2235137 - DNA, 20 bp, Homo sapiens
tgacacacagctctgtcctg

SEQ ID NO: 2235138 - DNA, 17 bp, Homo sapiens
tgacagacacaggcccg

SEQ ID NO: 2235139 - DNA, 18 bp, Homo sapiens
tgacagacacaggcccgg

SEQ ID NO: 2235140 - DNA, 23 bp, Homo sapiens
tgacagacacaggcccggctcca

SEQ ID NO: 2235141 - DNA, 13 bp, Homo sapiens
tgacagaggcagc

SEQ ID NO: 2235142 - DNA, 20 bp, Homo sapiens
tgacagggcacaccgggcac

SEQ ID NO: 2235143 - DNA, 23 bp, Homo sapiens
tgacatcaactgcatcaagatgt

SEQ ID NO: 2235144 - DNA, 16 bp, Homo sapiens
tgaccattctccacct

SEQ ID NO: 2235145 - DNA, 17 bp, Homo sapiens
tgaccattctccacctg

SEQ ID NO: 2235146 - DNA, 23 bp, Homo sapiens
tgaccattctccacctgccaggg

SEQ ID NO: 2235147 - DNA, 13 bp, Homo sapiens
tgacccactgctt

SEQ ID NO: 2235148 - DNA, 14 bp, Homo sapiens
tgacccatgctgcc

SEQ ID NO: 2235149 - DNA, 15 bp, Homo sapiens
tgcactttgttctgg

SEQ ID NO: 2235150 - DNA, 18 bp, Homo sapiens
tgcactttgttctggctc

SEQ ID NO: 2235151 - DNA, 21 bp, Homo sapiens
tgcagacaggcaagcacctcc

SEQ ID NO: 2235152 - DNA, 16 bp, Homo sapiens
tgcagactctacagag

SEQ ID NO: 2235153 - DNA, 19 bp, Homo sapiens
tgcagactctacagaggcc

SEQ ID NO: 2235154 - DNA, 20 bp, Homo sapiens
tgcagagatgtgcccccacc

SEQ ID NO: 2235155 - DNA, 15 bp, Homo sapiens
tgcagcaataaagca

SEQ ID NO: 2235156 - DNA, 23 bp, Homo sapiens
tgcagcaataaagcagcgtttct

SEQ ID NO: 2235157 - DNA, 22 bp, Homo sapiens
tgcagcctcaacctcctgggct

SEQ ID NO: 2235158 - DNA, 21 bp, Homo sapiens
gacctgaggcccttctctcca

SEQ ID NO: 2235159 - DNA, 16 bp, Homo sapiens
gaccttctccttcacc

SEQ ID NO: 2235160 - DNA, 21 bp, Homo sapiens
gaccttctccttcacctttgt

SEQ ID NO: 2235161 - DNA, 11 bp, Homo sapiens
gacctttcaat

SEQ ID NO: 2235162 - DNA, 21 bp, Homo sapiens
gacctttcaataggaaaaact

SEQ ID NO: 2235163 - DNA, 19 bp, Homo sapiens
gacgacgcgagggccccac

SEQ ID NO: 2235164 - DNA, 12 bp, Homo sapiens
gacgccatccca

SEQ ID NO: 2235165 - DNA, 18 bp, Homo sapiens
gacgctacccgggaaggg

SEQ ID NO: 2235166 - DNA, 22 bp, Homo sapiens
gacgctacccgggaagggggct

SEQ ID NO: 2235167 - DNA, 13 bp, Homo sapiens
gacgctgtgctgc

SEQ ID NO: 2235168 - DNA, 15 bp, Homo sapiens
gacgctgtgctgccc

SEQ ID NO: 2235169 - DNA, 18 bp, Homo sapiens
gacggagtcccaccttgg

SEQ ID NO: 2235170 - DNA, 15 bp, Homo sapiens
gacgtgttatgactc

SEQ ID NO: 2235171 - DNA, 20 bp, Homo sapiens
gacgtgttatgactccagaa

SEQ ID NO: 2235172 - DNA, 22 bp, Homo sapiens
gacgtgttatgactccagaatt

SEQ ID NO: 2235173 - DNA, 15 bp, Homo sapiens
gactacaggcaccca

SEQ ID NO: 2235174 - DNA, 22 bp, Homo sapiens
gactatctaaatgttgaaagat

SEQ ID NO: 2235175 - DNA, 14 bp, Homo sapiens
gactcctgcaggca

SEQ ID NO: 2235176 - DNA, 17 bp, Homo sapiens
gactcctgcaggcagcc

SEQ ID NO: 2235177 - DNA, 18 bp, Homo sapiens
gactcctgcaggcagcca

SEQ ID NO: 2235178 - DNA, 15 bp, Homo sapiens
gactgcccggcaggg

SEQ ID NO: 2235179 - DNA, 18 bp, Homo sapiens
gactgttttctcttgaga

SEQ ID NO: 2235180 - DNA, 23 bp, Homo sapiens
gacttactgtacatgaaaacaca

SEQ ID NO: 2235181 - DNA, 20 bp, Homo sapiens
gacttcatccctctggggct

SEQ ID NO: 2235182 - DNA, 13 bp, Homo sapiens
gacttggaagctc

SEQ ID NO: 2235183 - DNA, 14 bp, Homo sapiens
gactttggaaagag

SEQ ID NO: 2235184 - DNA, 14 bp, Homo sapiens
gacttttccaaccc

SEQ ID NO: 2235185 - DNA, 20 bp, Homo sapiens
gacttttccaaccctcatca

SEQ ID NO: 2235186 - DNA, 21 bp, Homo sapiens
gacttttctttgtggcttcct

SEQ ID NO: 2235187 - DNA, 11 bp, Homo sapiens
gagaaagagag

SEQ ID NO: 2235188 - DNA, 13 bp, Homo sapiens
gagaaagagagag

SEQ ID NO: 2235189 - DNA, 16 bp, Homo sapiens
gagaaaggttgaagca

SEQ ID NO: 2235190 - DNA, 23 bp, Homo sapiens
gagaaagtacttctccaccctgc

SEQ ID NO: 2235191 - DNA, 16 bp, Homo sapiens
gagaagagaatgcaca

SEQ ID NO: 2235192 - DNA, 16 bp, Homo sapiens
gagaagcagaggaagg

SEQ ID NO: 2235193 - DNA, 13 bp, Homo sapiens
gagaagcggctgg

SEQ ID NO: 2235194 - DNA, 19 bp, Homo sapiens
gagaaggggcccaagagag

SEQ ID NO: 2235195 - DNA, 21 bp, Homo sapiens
gagaaggggcccaagagagac

SEQ ID NO: 2235196 - DNA, 23 bp, Homo sapiens
gagaatgaaagggcccagagagg

SEQ ID NO: 2235197 - DNA, 21 bp, Homo sapiens
gagaatgcacaaacagaggcc

SEQ ID NO: 2235198 - DNA, 15 bp, Homo sapiens
gagacacaagccttc

SEQ ID NO: 2235199 - DNA, 12 bp, Homo sapiens
gagacagcccgg

SEQ ID NO: 2235200 - DNA, 21 bp, Homo sapiens
gagacagcccgggctctgcct

SEQ ID NO: 2235201 - DNA, 22 bp, Homo sapiens
gagacagggttttgccatgttg

SEQ ID NO: 2235202 - DNA, 14 bp, Homo sapiens
gagacggagtccca

SEQ ID NO: 2235203 - DNA, 18 bp, Homo sapiens
gagacgggggcagagagg

SEQ ID NO: 2235204 - DNA, 17 bp, Homo sapiens
gagactcctgcaggcag

SEQ ID NO: 2235205 - DNA, 20 bp, Homo sapiens
gagactcctgcaggcagcca

SEQ ID NO: 2235206 - DNA, 18 bp, Homo sapiens
gagactcgcgacaatgca

SEQ ID NO: 2235207 - DNA, 14 bp, Homo sapiens
gagagaaagagaga

SEQ ID NO: 2235208 - DNA, 14 bp, Homo sapiens
gagagaaggggccc

SEQ ID NO: 2235209 - DNA, 13 bp, Homo sapiens
gagagagaaagag

SEQ ID NO: 2235210 - DNA, 15 bp, Homo sapiens
gagagagagaaagag

SEQ ID NO: 2235211 - DNA, 15 bp, Homo sapiens
gagagagagaagggg

SEQ ID NO: 2235212 - DNA, 13 bp, Homo sapiens
gagagagagagaa

SEQ ID NO: 2235213 - DNA, 15 bp, Homo sapiens
gagagagagagaagg

SEQ ID NO: 2235214 - DNA, 16 bp, Homo sapiens
gagagccttccagggg

SEQ ID NO: 2235215 - DNA, 13 bp, Homo sapiens
gagagctgggtgt

SEQ ID NO: 2235216 - DNA, 15 bp, Homo sapiens
gagaggaccccctga

SEQ ID NO: 2235217 - DNA, 22 bp, Homo sapiens
gagaggcatccagtatcttgaa

SEQ ID NO: 2235218 - DNA, 19 bp, Homo sapiens
gagaggggaacagactgga

SEQ ID NO: 2235219 - DNA, 14 bp, Homo sapiens
gagagggtgggagt

SEQ ID NO: 2235220 - DNA, 16 bp, Homo sapiens
gagagggtgggagtgg

SEQ ID NO: 2235221 - DNA, 14 bp, Homo sapiens
gagatagccaaggc

SEQ ID NO: 2235222 - DNA, 21 bp, Homo sapiens
gagatagccaaggccaaagga

SEQ ID NO: 2235223 - DNA, 23 bp, Homo sapiens
gagatcaaccccttcgctcctgt

SEQ ID NO: 2235224 - DNA, 19 bp, Homo sapiens
gagatcacgccactgcact

SEQ ID NO: 2235225 - DNA, 14 bp, Homo sapiens
gagatcagcctggg

SEQ ID NO: 2235226 - DNA, 21 bp, Homo sapiens
gagatgatgccatgggccctc

SEQ ID NO: 2235227 - DNA, 21 bp, Homo sapiens
gagattgcaccactgcactcc

SEQ ID NO: 2235228 - DNA, 18 bp, Homo sapiens
gagcaagacgctgtgctg

SEQ ID NO: 2235229 - DNA, 23 bp, Homo sapiens
gagcaagacgctgtgctgccctg

SEQ ID NO: 2235230 - DNA, 18 bp, Homo sapiens
gagcactctggggtggga

SEQ ID NO: 2235231 - DNA, 19 bp, Homo sapiens
gagcagagaccatccctga

SEQ ID NO: 2235232 - DNA, 22 bp, Homo sapiens
gagcagccacattcctgatgct

SEQ ID NO: 2235233 - DNA, 17 bp, Homo sapiens
gagcatcaggccaggcc

SEQ ID NO: 2235234 - DNA, 11 bp, Homo sapiens
gagcccacgcc

SEQ ID NO: 2235235 - DNA, 12 bp, Homo sapiens
gagcccacgccc

SEQ ID NO: 2235236 - DNA, 18 bp, Homo sapiens
gagcccacgcccccactg

SEQ ID NO: 2235237 - DNA, 12 bp, Homo sapiens
gagcccaggcct

SEQ ID NO: 2235238 - DNA, 22 bp, Homo sapiens
gagccgagatcacgccactgca

SEQ ID NO: 2235239 - DNA, 19 bp, Homo sapiens
gagcctcagcatcctggca

SEQ ID NO: 2235240 - DNA, 20 bp, Homo sapiens
gagcctcagcatcctggcac

SEQ ID NO: 2235241 - DNA, 15 bp, Homo sapiens
gagcctgcagttatt

SEQ ID NO: 2235242 - DNA, 10 bp, Homo sapiens
gagcctggca

SEQ ID NO: 2235243 - DNA, 13 bp, Homo sapiens
gagcctgggaggt

SEQ ID NO: 2235244 - DNA, 12 bp, Homo sapiens
gagccttccagg

SEQ ID NO: 2235245 - DNA, 17 bp, Homo sapiens
gagccttccaggggtgg

SEQ ID NO: 2235246 - DNA, 23 bp, Homo sapiens
gagccttccaggggtgggacacc

SEQ ID NO: 2235247 - DNA, 17 bp, Homo sapiens
gagcggagaaaggaagg

SEQ ID NO: 2235248 - DNA, 21 bp, Homo sapiens
gagcggagaaaggaagggctg

SEQ ID NO: 2235249 - DNA, 15 bp, Homo sapiens
gagctagcagcaggg

SEQ ID NO: 2235250 - DNA, 15 bp, Homo sapiens
gagctgagtggggga

SEQ ID NO: 2235251 - DNA, 21 bp, Homo sapiens
gagctgcctgttcagctccag

SEQ ID NO: 2235252 - DNA, 22 bp, Homo sapiens
gagctgcctgttcagctccagc

SEQ ID NO: 2235253 - DNA, 16 bp, Homo sapiens
gaggaaagcaaaggag

SEQ ID NO: 2235254 - DNA, 14 bp, Homo sapiens
gaggaacaaggcaa

SEQ ID NO: 2235255 - DNA, 17 bp, Homo sapiens
gaggaagccgctggggc

SEQ ID NO: 2235256 - DNA, 19 bp, Homo sapiens
gaggaaggaaacccagctc

SEQ ID NO: 2235257 - DNA, 22 bp, Homo sapiens
gaggaaggaaacccagctctgg

SEQ ID NO: 2235258 - DNA, 14 bp, Homo sapiens
gaggaatccagacc

SEQ ID NO: 2235259 - DNA, 23 bp, Homo sapiens
gaggacagggaggtgaccccagg

SEQ ID NO: 2235260 - DNA, 23 bp, Homo sapiens
gaggacttttctttgtggcttcc

SEQ ID NO: 2235261 - DNA, 12 bp, Homo sapiens
gaggagagagga

SEQ ID NO: 2235262 - DNA, 16 bp, Homo sapiens
gaggatctcttgagcc

SEQ ID NO: 2235263 - DNA, 19 bp, Homo sapiens
gaggatctcttgagcctgg

SEQ ID NO: 2235264 - DNA, 12 bp, Homo sapiens
gaggatgttctg

SEQ ID NO: 2235265 - DNA, 13 bp, Homo sapiens
gaggcagccccat

SEQ ID NO: 2235266 - DNA, 20 bp, Homo sapiens
gaggcagccccattctgcct

SEQ ID NO: 2235267 - DNA, 9 bp, Homo sapiens
gaggcaggg

SEQ ID NO: 2235268 - DNA, 19 bp, Homo sapiens
gaggcagggtctcactctg

SEQ ID NO: 2235269 - DNA, 20 bp, Homo sapiens
gaggcatgtgatgagaggaa

SEQ ID NO: 2235270 - DNA, 21 bp, Homo sapiens
gaggcatgtgatgagaggaaa

SEQ ID NO: 2235271 - DNA, 17 bp, Homo sapiens
gaggccaaggtgggagg

SEQ ID NO: 2235272 - DNA, 12 bp, Homo sapiens
gaggccagcctt

SEQ ID NO: 2235273 - DNA, 21 bp, Homo sapiens
gaggccatgggcctcctgtgt

SEQ ID NO: 2235274 - DNA, 20 bp, Homo sapiens
gaggcccttctctccagccc

SEQ ID NO: 2235275 - DNA, 23 bp, Homo sapiens
gaggcccttctctccagcccctg

SEQ ID NO: 2235276 - DNA, 24 bp, Homo sapiens
gaggcccttctctccagcccctgg

SEQ ID NO: 2235277 - DNA, 14 bp, Homo sapiens
gaggccttctctga

SEQ ID NO: 2235278 - DNA, 17 bp, Homo sapiens
gaggctctgcccttggt

SEQ ID NO: 2235279 - DNA, 13 bp, Homo sapiens
gaggctgggctcc

SEQ ID NO: 2235280 - DNA, 20 bp, Homo sapiens
gaggctgggctcccttccca

SEQ ID NO: 2235281 - DNA, 15 bp, Homo sapiens
gagggagggagggct

SEQ ID NO: 2235282 - DNA, 16 bp, Homo sapiens
gagggagggctccaga

SEQ ID NO: 2235283 - DNA, 20 bp, Homo sapiens
gagggagggctccagacaca

SEQ ID NO: 2235284 - DNA, 13 bp, Homo sapiens
gagggagtgacag

SEQ ID NO: 2235285 - DNA, 14 bp, Homo sapiens
gagggagtgacaga

SEQ ID NO: 2235286 - DNA, 22 bp, Homo sapiens
gagggagtgacagaggcagccc

SEQ ID NO: 2235287 - DNA, 22 bp, Homo sapiens
gagggcacagaaaatggaagac

SEQ ID NO: 2235288 - DNA, 23 bp, Homo sapiens
gagggcacagaaaatggaagaca

SEQ ID NO: 2235289 - DNA, 14 bp, Homo sapiens
gagggcctgcaagg

SEQ ID NO: 2235290 - DNA, 15 bp, Homo sapiens
gagggctccagacac

SEQ ID NO: 2235291 - DNA, 12 bp, Homo sapiens
gaggggaacaga

SEQ ID NO: 2235292 - DNA, 13 bp, Homo sapiens
gaggggaagaaaa

SEQ ID NO: 2235293 - DNA, 22 bp, Homo sapiens
gaggggggaggtgggatcctcc

SEQ ID NO: 2235294 - DNA, 14 bp, Homo sapiens
gagggtctgaggaa

SEQ ID NO: 2235295 - DNA, 17 bp, Homo sapiens
gagggtctgcagggaat

SEQ ID NO: 2235296 - DNA, 14 bp, Homo sapiens
gagggtggtgacct

SEQ ID NO: 2235297 - DNA, 22 bp, Homo sapiens
gagggtgtcccaaaaagaaagg

SEQ ID NO: 2235298 - DNA, 14 bp, Homo sapiens
gagggttgggctgg

SEQ ID NO: 2235299 - DNA, 15 bp, Homo sapiens
gaggtcgaggcagga

SEQ ID NO: 2235300 - DNA, 13 bp, Homo sapiens
gaggtgggatcct

SEQ ID NO: 2235301 - DNA, 15 bp, Homo sapiens
gaggtgggatcctcc

SEQ ID NO: 2235302 - DNA, 19 bp, Homo sapiens
gaggttcaaagatattttg

SEQ ID NO: 2235303 - DNA, 18 bp, Homo sapiens
gagtacgttgtgcatttg

SEQ ID NO: 2235304 - DNA, 18 bp, Homo sapiens
gagtactacagtcctccc

SEQ ID NO: 2235305 - DNA, 23 bp, Homo sapiens
gagtactacagtcctcccatctc

SEQ ID NO: 2235306 - DNA, 14 bp, Homo sapiens
gagtagctgggact

SEQ ID NO: 2235307 - DNA, 19 bp, Homo sapiens
gagtagctgggactacagg

SEQ ID NO: 2235308 - DNA, 22 bp, Homo sapiens
gagtagctgggactacaggcac

SEQ ID NO: 2235309 - DNA, 12 bp, Homo sapiens
gagtaggaagac

SEQ ID NO: 2235310 - DNA, 17 bp, Homo sapiens
gagtaggaagactttgg

SEQ ID NO: 2235311 - DNA, 15 bp, Homo sapiens
gagtcaccaagccca

SEQ ID NO: 2235312 - DNA, 16 bp, Homo sapiens
gagtcaccaagcccag

SEQ ID NO: 2235313 - DNA, 14 bp, Homo sapiens
gagtcactggaaca

SEQ ID NO: 2235314 - DNA, 21 bp, Homo sapiens
gagtcactggaacactaatga

SEQ ID NO: 2235315 - DNA, 18 bp, Homo sapiens
gagtcagaagtttctgcc

SEQ ID NO: 2235316 - DNA, 16 bp, Homo sapiens
gagtcccaccttggct

SEQ ID NO: 2235317 - DNA, 14 bp, Homo sapiens
gagtcccctgtttg

SEQ ID NO: 2235318 - DNA, 15 bp, Homo sapiens
gagtcgaggacaggg

SEQ ID NO: 2235319 - DNA, 20 bp, Homo sapiens
gagtctcactgttgcccagg

SEQ ID NO: 2235320 - DNA, 21 bp, Homo sapiens
gagtctcactgttgcccaggc

SEQ ID NO: 2235321 - DNA, 12 bp, Homo sapiens
gagtctgaaggc

SEQ ID NO: 2235322 - DNA, 14 bp, Homo sapiens
gagtgacagaggca

SEQ ID NO: 2235323 - DNA, 15 bp, Homo sapiens
gagtgacagaggcag

SEQ ID NO: 2235324 - DNA, 17 bp, Homo sapiens
gagtgacagaggcagcc

SEQ ID NO: 2235325 - DNA, 20 bp, Homo sapiens
gagtgacagaggcagcccca

SEQ ID NO: 2235326 - DNA, 14 bp, Homo sapiens
gagtgagactctgt

SEQ ID NO: 2235327 - DNA, 11 bp, Homo sapiens
gagtgcagtga

SEQ ID NO: 2235328 - DNA, 12 bp, Homo sapiens
gagtgcagtgag

SEQ ID NO: 2235329 - DNA, 13 bp, Homo sapiens
gagtgggtgaata

SEQ ID NO: 2235330 - DNA, 17 bp, Homo sapiens
gagtgtgcctgaagtcc

SEQ ID NO: 2235331 - DNA, 22 bp, Homo sapiens
gagttgatactacagtttgtta

SEQ ID NO: 2235332 - DNA, 22 bp, Homo sapiens
gagttgatagcacagaccctgc

SEQ ID NO: 2235333 - DNA, 20 bp, Homo sapiens
gagttgttacatttttaagt

SEQ ID NO: 2235334 - DNA, 20 bp, Homo sapiens
gagtttggggtatgggagag

SEQ ID NO: 2235335 - DNA, 12 bp, Homo sapiens
gataatacacca

SEQ ID NO: 2235336 - DNA, 21 bp, Homo sapiens
gataatacaccactacattct

SEQ ID NO: 2235337 - DNA, 22 bp, Homo sapiens
gataatacaccactacattctg

SEQ ID NO: 2235338 - DNA, 23 bp, Homo sapiens
gataatacaccactacattctgt

SEQ ID NO: 2235339 - DNA, 17 bp, Homo sapiens
gatacaaaagcatgtga

SEQ ID NO: 2235340 - DNA, 13 bp, Homo sapiens
gatacaatgctgt

SEQ ID NO: 2235341 - DNA, 18 bp, Homo sapiens
gatacaatgctgtgccct

SEQ ID NO: 2235342 - DNA, 19 bp, Homo sapiens
gatacagttactcagaatt

SEQ ID NO: 2235343 - DNA, 23 bp, Homo sapiens
gatacagttactcagaattctct

SEQ ID NO: 2235344 - DNA, 14 bp, Homo sapiens
gatacccatcccat

SEQ ID NO: 2235345 - DNA, 16 bp, Homo sapiens
gatactacagtttgtt

SEQ ID NO: 2235346 - DNA, 21 bp, Homo sapiens
gatagcacagaccctgccctg

SEQ ID NO: 2235347 - DNA, 14 bp, Homo sapiens
gatagccaaggcca

SEQ ID NO: 2235348 - DNA, 15 bp, Homo sapiens
gatattttgctttgt

SEQ ID NO: 2235349 - DNA, 12 bp, Homo sapiens
gatcacggctca

SEQ ID NO: 2235350 - DNA, 15 bp, Homo sapiens
gatcacggctcactg

SEQ ID NO: 2235351 - DNA, 23 bp, Homo sapiens
gatcacggctcactgcagcctca

SEQ ID NO: 2235352 - DNA, 13 bp, Homo sapiens
gatcatccactgt

SEQ ID NO: 2235353 - DNA, 12 bp, Homo sapiens
gatccaagctgg

SEQ ID NO: 2235354 - DNA, 21 bp, Homo sapiens
gatccaagctggtcccactca

SEQ ID NO: 2235355 - DNA, 19 bp, Homo sapiens
gatccacccacctcagcct

SEQ ID NO: 2235356 - DNA, 18 bp, Homo sapiens
gatcccccgccccatcct

SEQ ID NO: 2235357 - DNA, 12 bp, Homo sapiens
gatcctgagcca

SEQ ID NO: 2235358 - DNA, 15 bp, Homo sapiens
gatcctgagccagat

SEQ ID NO: 2235359 - DNA, 19 bp, Homo sapiens
gatcctgagccagatttca

SEQ ID NO: 2235360 - DNA, 15 bp, Homo sapiens
gatctctaacttcac

SEQ ID NO: 2235361 - DNA, 16 bp, Homo sapiens
gatctcttgagcctgg

SEQ ID NO: 2235362 - DNA, 17 bp, Homo sapiens
gatctcttgagcctggg

SEQ ID NO: 2235363 - DNA, 20 bp, Homo sapiens
gatctgggttcactgcaacc

SEQ ID NO: 2235364 - DNA, 22 bp, Homo sapiens
gatcttctgtgggtttctaaag

SEQ ID NO: 2235365 - DNA, 17 bp, Homo sapiens
gatctttgcagacaggc

SEQ ID NO: 2235366 - DNA, 18 bp, Homo sapiens
gatgaccttgaatgatgc

SEQ ID NO: 2235367 - DNA, 11 bp, Homo sapiens
gatgagaaagg

SEQ ID NO: 2235368 - DNA, 14 bp, Homo sapiens
gatgagaggaaatc

SEQ ID NO: 2235369 - DNA, 14 bp, Homo sapiens
gatgatcctaggca

SEQ ID NO: 2235370 - DNA, 21 bp, Homo sapiens
gatgatgaaatgaggtcagag

SEQ ID NO: 2235371 - DNA, 22 bp, Homo sapiens
gatgcacagagttgttacattt

SEQ ID NO: 2235372 - DNA, 19 bp, Homo sapiens
gatgcccaaagatgcagcc

SEQ ID NO: 2235373 - DNA, 20 bp, Homo sapiens
gatgcccaaagatgcagccg

SEQ ID NO: 2235374 - DNA, 22 bp, Homo sapiens
gatggatttccagccaaagcct

SEQ ID NO: 2235375 - DNA, 22 bp, Homo sapiens
gatggccgggcgcggtggctca

SEQ ID NO: 2235376 - DNA, 21 bp, Homo sapiens
gatgggcaacccccagcctgc

SEQ ID NO: 2235377 - DNA, 14 bp, Homo sapiens
gatggggccctgcc

SEQ ID NO: 2235378 - DNA, 22 bp, Homo sapiens
gatggggccctgcctcctttgt

SEQ ID NO: 2235379 - DNA, 24 bp, Homo sapiens
gatggggccctgcctcctttgtga

SEQ ID NO: 2235380 - DNA, 19 bp, Homo sapiens
gatggggctgcaccggctg

SEQ ID NO: 2235381 - DNA, 12 bp, Homo sapiens
gatggtgcaatg

SEQ ID NO: 2235382 - DNA, 15 bp, Homo sapiens
gatggtgcaatgacc

SEQ ID NO: 2235383 - DNA, 23 bp, Homo sapiens
gatggtgcaatgacctttcaata

SEQ ID NO: 2235384 - DNA, 21 bp, Homo sapiens
gatgttttaaggatgcttgta

SEQ ID NO: 2235385 - DNA, 23 bp, Homo sapiens
gatgttttccatgagtcccctgt

SEQ ID NO: 2235386 - DNA, 13 bp, Homo sapiens
gattacaagcgtg

SEQ ID NO: 2235387 - DNA, 21 bp, Homo sapiens
gattacaagcgtgagccactg

SEQ ID NO: 2235388 - DNA, 20 bp, Homo sapiens
gattacaggtgtgaaccacc

SEQ ID NO: 2235389 - DNA, 18 bp, Homo sapiens
gattcagacagctgcctg

SEQ ID NO: 2235390 - DNA, 15 bp, Homo sapiens
gattcagctctgcaa

SEQ ID NO: 2235391 - DNA, 17 bp, Homo sapiens
gattcatatttacttct

SEQ ID NO: 2235392 - DNA, 19 bp, Homo sapiens
gattcatatttacttctta

SEQ ID NO: 2235393 - DNA, 19 bp, Homo sapiens
gattctcctgcctcagcct

SEQ ID NO: 2235394 - DNA, 12 bp, Homo sapiens
gattcttctgct

SEQ ID NO: 2235395 - DNA, 18 bp, Homo sapiens
gattctttcctgaggctg

SEQ ID NO: 2235396 - DNA, 22 bp, Homo sapiens
gattctttcctgaggctgggct

SEQ ID NO: 2235397 - DNA, 23 bp, Homo sapiens
gattgacgggactgttggtattg

SEQ ID NO: 2235398 - DNA, 15 bp, Homo sapiens
gattgcaacaggctg

SEQ ID NO: 2235399 - DNA, 16 bp, Homo sapiens
gattgcaacaggctgg

SEQ ID NO: 2235400 - DNA, 20 bp, Homo sapiens
gattgcaacaggctgggctt

SEQ ID NO: 2235401 - DNA, 16 bp, Homo sapiens
gattgcaccactgcac

SEQ ID NO: 2235402 - DNA, 23 bp, Homo sapiens
gattgcaccactgcactccagcc

SEQ ID NO: 2235403 - DNA, 15 bp, Homo sapiens
gattgtccccgaccc

SEQ ID NO: 2235404 - DNA, 20 bp, Homo sapiens
gattgtccccgacccttgcc

SEQ ID NO: 2235405 - DNA, 13 bp, Homo sapiens
gatttaacagaaa

SEQ ID NO: 2235406 - DNA, 16 bp, Homo sapiens
gatttaacagaaatgt

SEQ ID NO: 2235407 - DNA, 20 bp, Homo sapiens
gatttaacagaaatgtacag

SEQ ID NO: 2235408 - DNA, 12 bp, Homo sapiens
gatttcactctc

SEQ ID NO: 2235409 - DNA, 13 bp, Homo sapiens
gatttcactctcc

SEQ ID NO: 2235410 - DNA, 18 bp, Homo sapiens
gatttcactctccttggt

SEQ ID NO: 2235411 - DNA, 22 bp, Homo sapiens
gatttctgtttagataatacac

SEQ ID NO: 2235412 - DNA, 22 bp, Homo sapiens
gcaaaagatgcttctcactgcc

SEQ ID NO: 2235413 - DNA, 12 bp, Homo sapiens
gcaaaccatcat

SEQ ID NO: 2235414 - DNA, 21 bp, Homo sapiens
gcaaaccatcattgaaatctt

SEQ ID NO: 2235415 - DNA, 14 bp, Homo sapiens
gcaacaggctgggc

SEQ ID NO: 2235416 - DNA, 15 bp, Homo sapiens
gcaacaggctgggct

SEQ ID NO: 2235417 - DNA, 18 bp, Homo sapiens
gcaaccaccaccaaccac

SEQ ID NO: 2235418 - DNA, 18 bp, Homo sapiens
gcaacctccgcctcttgg

SEQ ID NO: 2235419 - DNA, 20 bp, Homo sapiens
gcaagacgctgtgctgccct

SEQ ID NO: 2235420 - DNA, 22 bp, Homo sapiens
gcaagacgctgtgctgccctgc

SEQ ID NO: 2235421 - DNA, 18 bp, Homo sapiens
gcaagcacctcctgcctc

SEQ ID NO: 2235422 - DNA, 13 bp, Homo sapiens
gcaaggctgtcaa

SEQ ID NO: 2235423 - DNA, 13 bp, Homo sapiens
gcaagtgagagct

SEQ ID NO: 2235424 - DNA, 16 bp, Homo sapiens
gcaagtgagagctggg

SEQ ID NO: 2235425 - DNA, 15 bp, Homo sapiens
gcaatcaaatctgct

SEQ ID NO: 2235426 - DNA, 17 bp, Homo sapiens
gcaatgacctttcaata

SEQ ID NO: 2235427 - DNA, 13 bp, Homo sapiens
gcaatgctggctg

SEQ ID NO: 2235428 - DNA, 14 bp, Homo sapiens
gcaatgctggctgt

SEQ ID NO: 2235429 - DNA, 22 bp, Homo sapiens
gcaatgctggctgttggctggg

SEQ ID NO: 2235430 - DNA, 23 bp, Homo sapiens
gcaatgctggctgttggctgggg

SEQ ID NO: 2235431 - DNA, 15 bp, Homo sapiens
gcacaagctccaagc

SEQ ID NO: 2235432 - DNA, 18 bp, Homo sapiens
gcacaagctccaagctcc

SEQ ID NO: 2235433 - DNA, 17 bp, Homo sapiens
gcacacaccagagccca

SEQ ID NO: 2235434 - DNA, 19 bp, Homo sapiens
gcacacaccagagcccacc

SEQ ID NO: 2235435 - DNA, 12 bp, Homo sapiens
gcacacattttt

SEQ ID NO: 2235436 - DNA, 14 bp, Homo sapiens
gcacacatttttta

SEQ ID NO: 2235437 - DNA, 20 bp, Homo sapiens
gcacagaaaatggaagacag

SEQ ID NO: 2235438 - DNA, 15 bp, Homo sapiens
gcacagaccctgccc

SEQ ID NO: 2235439 - DNA, 16 bp, Homo sapiens
gcacagaccctgccct

SEQ ID NO: 2235440 - DNA, 19 bp, Homo sapiens
gcacagaccctgccctgtg

SEQ ID NO: 2235441 - DNA, 16 bp, Homo sapiens
gcacagagttgttaca

SEQ ID NO: 2235442 - DNA, 19 bp, Homo sapiens
gcacagagttgttacattt

SEQ ID NO: 2235443 - DNA, 23 bp, Homo sapiens
gcacatcagcacgatttctgttt

SEQ ID NO: 2235444 - DNA, 14 bp, Homo sapiens
gcacatgcctctct

SEQ ID NO: 2235445 - DNA, 21 bp, Homo sapiens
gcaccactgcactccagcctg

SEQ ID NO: 2235446 - DNA, 22 bp, Homo sapiens
gcaccactgcactccagcctgg

SEQ ID NO: 2235447 - DNA, 14 bp, Homo sapiens
gcaccagcagcctg

SEQ ID NO: 2235448 - DNA, 15 bp, Homo sapiens
gcaccagcagcctgg

SEQ ID NO: 2235449 - DNA, 14 bp, Homo sapiens
gcacccggcccctg

SEQ ID NO: 2235450 - DNA, 15 bp, Homo sapiens
gcaccctcaggcagg

SEQ ID NO: 2235451 - DNA, 19 bp, Homo sapiens
gcaccctcaggcaggtggg

SEQ ID NO: 2235452 - DNA, 15 bp, Homo sapiens
gcaccggctggcctg

SEQ ID NO: 2235453 - DNA, 16 bp, Homo sapiens
gcaccggctggcctgg

SEQ ID NO: 2235454 - DNA, 21 bp, Homo sapiens
gcaccggctggcctggcccct

SEQ ID NO: 2235455 - DNA, 12 bp, Homo sapiens
gcacctcctgcc

SEQ ID NO: 2235456 - DNA, 15 bp, Homo sapiens
gcacctcctgcctcg

SEQ ID NO: 2235457 - DNA, 18 bp, Homo sapiens
gcacctggaatatataac

SEQ ID NO: 2235458 - DNA, 21 bp, Homo sapiens
gcaccttagacagtccctgcc

SEQ ID NO: 2235459 - DNA, 16 bp, Homo sapiens
gcacgatttctgttta

SEQ ID NO: 2235460 - DNA, 17 bp, Homo sapiens
gcactaaggtgtgctct

SEQ ID NO: 2235461 - DNA, 20 bp, Homo sapiens
gcactaaggtgtgctctgat

SEQ ID NO: 2235462 - DNA, 15 bp, Homo sapiens
gcactataatgtaag

SEQ ID NO: 2235463 - DNA, 22 bp, Homo sapiens
gcactatagcctaggtgacaga

SEQ ID NO: 2235464 - DNA, 16 bp, Homo sapiens
gcactcagaagacact

SEQ ID NO: 2235465 - DNA, 14 bp, Homo sapiens
gcactcccctgctg

SEQ ID NO: 2235466 - DNA, 16 bp, Homo sapiens
gcactcccctgctggg

SEQ ID NO: 2235467 - DNA, 22 bp, Homo sapiens
gcactgcttccagtgaggctct

SEQ ID NO: 2235468 - DNA, 12 bp, Homo sapiens
gcactgggcttg

SEQ ID NO: 2235469 - DNA, 22 bp, Homo sapiens
gcacttcgggaggtcgaggcag

SEQ ID NO: 2235470 - DNA, 16 bp, Homo sapiens
gcactttgttctggct

SEQ ID NO: 2235471 - DNA, 15 bp, Homo sapiens
gcagaaacaaaatga

SEQ ID NO: 2235472 - DNA, 13 bp, Homo sapiens
gcagaaggaagac

SEQ ID NO: 2235473 - DNA, 18 bp, Homo sapiens
gcagaaggaagacttcat

SEQ ID NO: 2235474 - DNA, 13 bp, Homo sapiens
gcagacaggacca

SEQ ID NO: 2235475 - DNA, 18 bp, Homo sapiens
gcagactctacagaggcc

SEQ ID NO: 2235476 - DNA, 20 bp, Homo sapiens
gcagagaatgaaagggccca

SEQ ID NO: 2235477 - DNA, 15 bp, Homo sapiens
gcagagaccatccct

SEQ ID NO: 2235478 - DNA, 17 bp, Homo sapiens
gcagagaccatccctga

SEQ ID NO: 2235479 - DNA, 19 bp, Homo sapiens
gcagagatgtgcccccacc

SEQ ID NO: 2235480 - DNA, 15 bp, Homo sapiens
gcagagcagagacca

SEQ ID NO: 2235481 - DNA, 20 bp, Homo sapiens
gcagagcagagaccatccct

SEQ ID NO: 2235482 - DNA, 13 bp, Homo sapiens
gcagaggaaagca

SEQ ID NO: 2235483 - DNA, 16 bp, Homo sapiens
gcagagttgaagacag

SEQ ID NO: 2235484 - DNA, 17 bp, Homo sapiens
gcagagttgaagacaga

SEQ ID NO: 2235485 - DNA, 18 bp, Homo sapiens
gcagatggagaccccttg

SEQ ID NO: 2235486 - DNA, 16 bp, Homo sapiens
gcagcaataaagcagc

SEQ ID NO: 2235487 - DNA, 23 bp, Homo sapiens
gcagcagagagagagagagagaa

SEQ ID NO: 2235488 - DNA, 18 bp, Homo sapiens
gcagcagggagggcttct

SEQ ID NO: 2235489 - DNA, 20 bp, Homo sapiens
gcagcagggagggcttctgc

SEQ ID NO: 2235490 - DNA, 23 bp, Homo sapiens
gcagcatattcaggaagctcagg

SEQ ID NO: 2235491 - DNA, 12 bp, Homo sapiens
gcagccaggcca

SEQ ID NO: 2235492 - DNA, 13 bp, Homo sapiens
gcagccaggccac

SEQ ID NO: 2235493 - DNA, 21 bp, Homo sapiens
gcagccccacggacgacgcga

SEQ ID NO: 2235494 - DNA, 18 bp, Homo sapiens
gcagccccattctgcctg

SEQ ID NO: 2235495 - DNA, 19 bp, Homo sapiens
gcagccccattctgcctgc

SEQ ID NO: 2235496 - DNA, 13 bp, Homo sapiens
gcagccctgcaga

SEQ ID NO: 2235497 - DNA, 14 bp, Homo sapiens
gcagccctgcagag

SEQ ID NO: 2235498 - DNA, 16 bp, Homo sapiens
gcagccctgcagaggg

SEQ ID NO: 2235499 - DNA, 19 bp, Homo sapiens
gcagcctcaacctcctggg

SEQ ID NO: 2235500 - DNA, 19 bp, Homo sapiens
gcagcctcacagtccttac

SEQ ID NO: 2235501 - DNA, 20 bp, Homo sapiens
gcagctcacctctcccttgg

SEQ ID NO: 2235502 - DNA, 18 bp, Homo sapiens
gcagctcagagagggtgg

SEQ ID NO: 2235503 - DNA, 19 bp, Homo sapiens
gcagctcagagagggtggg

SEQ ID NO: 2235504 - DNA, 23 bp, Homo sapiens
gcagctgcggtccacccaggagc

SEQ ID NO: 2235505 - DNA, 20 bp, Homo sapiens
gcagctgcttttgtctatgg

SEQ ID NO: 2235506 - DNA, 16 bp, Homo sapiens
gcagcttgagggttgg

SEQ ID NO: 2235507 - DNA, 21 bp, Homo sapiens
gcagcttgagggttgggctgg

SEQ ID NO: 2235508 - DNA, 12 bp, Homo sapiens
gcaggcagccag

SEQ ID NO: 2235509 - DNA, 14 bp, Homo sapiens
gcaggcagccaggc

SEQ ID NO: 2235510 - DNA, 18 bp, Homo sapiens
gcaggcagccaggccaca

SEQ ID NO: 2235511 - DNA, 22 bp, Homo sapiens
gcaggctctcaggccagctgct

SEQ ID NO: 2235512 - DNA, 19 bp, Homo sapiens
gcagggaattgggggggtg

SEQ ID NO: 2235513 - DNA, 19 bp, Homo sapiens
gcagggtcctagaaattcc

SEQ ID NO: 2235514 - DNA, 16 bp, Homo sapiens
gcagggtctcactctg

SEQ ID NO: 2235515 - DNA, 17 bp, Homo sapiens
gcagggtctcactctgt

SEQ ID NO: 2235516 - DNA, 18 bp, Homo sapiens
gcagggtctcactctgtc

SEQ ID NO: 2235517 - DNA, 22 bp, Homo sapiens
gcaggtccagggtttgagttca

SEQ ID NO: 2235518 - DNA, 14 bp, Homo sapiens
gcagtgggagctgc

SEQ ID NO: 2235519 - DNA, 21 bp, Homo sapiens
gcagtggggctggaagcagaa

SEQ ID NO: 2235520 - DNA, 19 bp, Homo sapiens
gcagtggtgcgatctgggt

SEQ ID NO: 2235521 - DNA, 20 bp, Homo sapiens
gcagtggtggttttctgttc

SEQ ID NO: 2235522 - DNA, 21 bp, Homo sapiens
gcagtggtggttttctgttct

SEQ ID NO: 2235523 - DNA, 17 bp, Homo sapiens
gcagttattaacactaa

SEQ ID NO: 2235524 - DNA, 15 bp, Homo sapiens
gcataaaaattagcc

SEQ ID NO: 2235525 - DNA, 16 bp, Homo sapiens
gcatacgtacacattt

SEQ ID NO: 2235526 - DNA, 18 bp, Homo sapiens
gcatacgtacacatttta

SEQ ID NO: 2235527 - DNA, 21 bp, Homo sapiens
gcatcaagatgtgacatgttt

SEQ ID NO: 2235528 - DNA, 12 bp, Homo sapiens
gcatcaggccag

SEQ ID NO: 2235529 - DNA, 13 bp, Homo sapiens
gcatcaggccagg

SEQ ID NO: 2235530 - DNA, 14 bp, Homo sapiens
gcatccagtatctt

SEQ ID NO: 2235531 - DNA, 18 bp, Homo sapiens
gcatccagtatcttgaag

SEQ ID NO: 2235532 - DNA, 21 bp, Homo sapiens
gcatcctggcacccggcccct

SEQ ID NO: 2235533 - DNA, 21 bp, Homo sapiens
gcatgaagtaatatgcacaca

SEQ ID NO: 2235534 - DNA, 18 bp, Homo sapiens
gcatgcgggcttcctcct

SEQ ID NO: 2235535 - DNA, 19 bp, Homo sapiens
gcatgggaatgaatgtcag

SEQ ID NO: 2235536 - DNA, 18 bp, Homo sapiens
gcatgtgatgagaggaaa

SEQ ID NO: 2235537 - DNA, 22 bp, Homo sapiens
gcattatctagatactgtatca

SEQ ID NO: 2235538 - DNA, 12 bp, Homo sapiens
gcattccccact

SEQ ID NO: 2235539 - DNA, 14 bp, Homo sapiens
ctgacccactgctt

SEQ ID NO: 2235540 - DNA, 20 bp, Homo sapiens
ctgacccatgctgccctgtg

SEQ ID NO: 2235541 - DNA, 19 bp, Homo sapiens
ctgaccctgcttcaaatat

SEQ ID NO: 2235542 - DNA, 18 bp, Homo sapiens
ctgactgttttctcttga

SEQ ID NO: 2235543 - DNA, 22 bp, Homo sapiens
ctgagacagcccgggctctgcc

SEQ ID NO: 2235544 - DNA, 23 bp, Homo sapiens
ctgagacagcccgggctctgcct

SEQ ID NO: 2235545 - DNA, 21 bp, Homo sapiens
ctgagactcgcgacaatgcaa

SEQ ID NO: 2235546 - DNA, 22 bp, Homo sapiens
ctgagactcgcgacaatgcaaa

SEQ ID NO: 2235547 - DNA, 15 bp, Homo sapiens
ctgagccagatttca

SEQ ID NO: 2235548 - DNA, 21 bp, Homo sapiens
ctgagccagatttcactctcc

SEQ ID NO: 2235549 - DNA, 21 bp, Homo sapiens
ctgaggaatccagacccggct

SEQ ID NO: 2235550 - DNA, 20 bp, Homo sapiens
ctgaggacactaaccacgct

SEQ ID NO: 2235551 - DNA, 23 bp, Homo sapiens
ctgaggacactaaccacgctgga

SEQ ID NO: 2235552 - DNA, 15 bp, Homo sapiens
ctgaggcccagaggg

SEQ ID NO: 2235553 - DNA, 18 bp, Homo sapiens
ctgaggcccagagggcct

SEQ ID NO: 2235554 - DNA, 19 bp, Homo sapiens
ctgaggcccagagggcctg

SEQ ID NO: 2235555 - DNA, 16 bp, Homo sapiens
ctgaggctgggctccc

SEQ ID NO: 2235556 - DNA, 17 bp, Homo sapiens
ctgaggctgggctccct

SEQ ID NO: 2235557 - DNA, 22 bp, Homo sapiens
ctgaggtgggaggatctcttga

SEQ ID NO: 2235558 - DNA, 18 bp, Homo sapiens
ctgagtacgttgtgcatt

SEQ ID NO: 2235559 - DNA, 14 bp, Homo sapiens
ctgagtctgaaggc

SEQ ID NO: 2235560 - DNA, 15 bp, Homo sapiens
ctgagtctgaaggct

SEQ ID NO: 2235561 - DNA, 17 bp, Homo sapiens
ctgagtctgaaggctgg

SEQ ID NO: 2235562 - DNA, 18 bp, Homo sapiens
ctgagtctgaaggctggg

SEQ ID NO: 2235563 - DNA, 20 bp, Homo sapiens
ctgatcctagttccaccatc

SEQ ID NO: 2235564 - DNA, 14 bp, Homo sapiens
ctgatctctcgtga

SEQ ID NO: 2235565 - DNA, 17 bp, Homo sapiens
ctgatgcttcttcagag

SEQ ID NO: 2235566 - DNA, 18 bp, Homo sapiens
ctgatgcttcttcagaga

SEQ ID NO: 2235567 - DNA, 19 bp, Homo sapiens
ctgatgcttcttcagagac

SEQ ID NO: 2235568 - DNA, 24 bp, Homo sapiens
ctgatgggcaacccccagcctgct

SEQ ID NO: 2235569 - DNA, 14 bp, Homo sapiens
ctgatggtgcaatg

SEQ ID NO: 2235570 - DNA, 21 bp, Homo sapiens
ctgatggtgcaatgacctttc

SEQ ID NO: 2235571 - DNA, 17 bp, Homo sapiens
ctgattcccaagctctg

SEQ ID NO: 2235572 - DNA, 19 bp, Homo sapiens
ctgattcccaagctctgct

SEQ ID NO: 2235573 - DNA, 17 bp, Homo sapiens
ctgattgtgtctcttgg

SEQ ID NO: 2235574 - DNA, 18 bp, Homo sapiens
ctgatttttttttccttc

SEQ ID NO: 2235575 - DNA, 18 bp, Homo sapiens
ctgcaataaggggagagt

SEQ ID NO: 2235576 - DNA, 14 bp, Homo sapiens
ctgcaccctcaggc

SEQ ID NO: 2235577 - DNA, 16 bp, Homo sapiens
ctgcaccctcaggcag

SEQ ID NO: 2235578 - DNA, 17 bp, Homo sapiens
ctggcactgcttccagt

SEQ ID NO: 2235579 - DNA, 17 bp, Homo sapiens
ctggcagagttgaagac

SEQ ID NO: 2235580 - DNA, 19 bp, Homo sapiens
ctggcagagttgaagacag

SEQ ID NO: 2235581 - DNA, 20 bp, Homo sapiens
ctggcagagttgaagacaga

SEQ ID NO: 2235582 - DNA, 12 bp, Homo sapiens
ctggcagcccct

SEQ ID NO: 2235583 - DNA, 14 bp, Homo sapiens
ctggcagctcagag

SEQ ID NO: 2235584 - DNA, 15 bp, Homo sapiens
ctggcagctcagaga

SEQ ID NO: 2235585 - DNA, 16 bp, Homo sapiens
ctggcatgggaatgaa

SEQ ID NO: 2235586 - DNA, 18 bp, Homo sapiens
ctggcatgggaatgaatg

SEQ ID NO: 2235587 - DNA, 19 bp, Homo sapiens
ctggcatgggaatgaatgt

SEQ ID NO: 2235588 - DNA, 14 bp, Homo sapiens
ctggccagatgcac

SEQ ID NO: 2235589 - DNA, 18 bp, Homo sapiens
ctggccagatgcaccagc

SEQ ID NO: 2235590 - DNA, 21 bp, Homo sapiens
ctggccagatgcaccagccct

SEQ ID NO: 2235591 - DNA, 13 bp, Homo sapiens
ctggcccactgca

SEQ ID NO: 2235592 - DNA, 15 bp, Homo sapiens
ctggcccactgcatc

SEQ ID NO: 2235593 - DNA, 13 bp, Homo sapiens
ctggcccctcagg

SEQ ID NO: 2235594 - DNA, 17 bp, Homo sapiens
ctggcccctcagggtcc

SEQ ID NO: 2235595 - DNA, 20 bp, Homo sapiens
ctggcccctcagggtccctg

SEQ ID NO: 2235596 - DNA, 21 bp, Homo sapiens
ctggcccctcagggtccctgg

SEQ ID NO: 2235597 - DNA, 17 bp, Homo sapiens
ctggcctagcatacgta

SEQ ID NO: 2235598 - DNA, 22 bp, Homo sapiens
ctggcctcaagtgattctcctg

SEQ ID NO: 2235599 - DNA, 12 bp, Homo sapiens
ctggcctctgca

SEQ ID NO: 2235600 - DNA, 14 bp, Homo sapiens
ctggcctctgcact

SEQ ID NO: 2235601 - DNA, 20 bp, Homo sapiens
ctggcctctgcactcccctg

SEQ ID NO: 2235602 - DNA, 13 bp, Homo sapiens
ctggcctgagctg

SEQ ID NO: 2235603 - DNA, 24 bp, Homo sapiens
ctggcctggcccctcagggtccct

SEQ ID NO: 2235604 - DNA, 15 bp, Homo sapiens
ctggcgtgcagtggt

SEQ ID NO: 2235605 - DNA, 13 bp, Homo sapiens
ctggctcttccag

SEQ ID NO: 2235606 - DNA, 22 bp, Homo sapiens
ctggctcttccaggctgggaga

SEQ ID NO: 2235607 - DNA, 13 bp, Homo sapiens
ctgggacacagtt

SEQ ID NO: 2235608 - DNA, 13 bp, Homo sapiens
ctgggactacagg

SEQ ID NO: 2235609 - DNA, 17 bp, Homo sapiens
ctgggactacaggcacc

SEQ ID NO: 2235610 - DNA, 17 bp, Homo sapiens
ctgggactacaggtgtg

SEQ ID NO: 2235611 - DNA, 18 bp, Homo sapiens
ctgggagagccttccagg

SEQ ID NO: 2235612 - DNA, 21 bp, Homo sapiens
ctgggagagccttccaggggt

SEQ ID NO: 2235613 - DNA, 13 bp, Homo sapiens
ctgggagtgagct

SEQ ID NO: 2235614 - DNA, 20 bp, Homo sapiens
ctgggatccctcatcctcat

SEQ ID NO: 2235615 - DNA, 16 bp, Homo sapiens
ctgggcagaaggaaga

SEQ ID NO: 2235616 - DNA, 18 bp, Homo sapiens
ctgggcagaaggaagact

SEQ ID NO: 2235617 - DNA, 12 bp, Homo sapiens
ctgggcagagga

SEQ ID NO: 2235618 - DNA, 16 bp, Homo sapiens
ctgggcagaggaaagc

SEQ ID NO: 2235619 - DNA, 19 bp, Homo sapiens
ctgggcttcagtggcagct

SEQ ID NO: 2235620 - DNA, 21 bp, Homo sapiens
ctgggcttcagtggcagctgc

SEQ ID NO: 2235621 - DNA, 23 bp, Homo sapiens
ctgggcttcagtggcagctgctt

SEQ ID NO: 2235622 - DNA, 13 bp, Homo sapiens
ctggggagaaagt

SEQ ID NO: 2235623 - DNA, 14 bp, Homo sapiens
ctggggagaaagta

SEQ ID NO: 2235624 - DNA, 23 bp, Homo sapiens
ctggggattcttgaacttgaaaa

SEQ ID NO: 2235625 - DNA, 13 bp, Homo sapiens
ctgggggaagaag

SEQ ID NO: 2235626 - DNA, 23 bp, Homo sapiens
ctggggtgggagggtctgcaggg

SEQ ID NO: 2235627 - DNA, 19 bp, Homo sapiens
ctggggtggggacctcagg

SEQ ID NO: 2235628 - DNA, 22 bp, Homo sapiens
ctggggtggggacctcaggcct

SEQ ID NO: 2235629 - DNA, 20 bp, Homo sapiens
ctgggtaactagggaagata

SEQ ID NO: 2235630 - DNA, 22 bp, Homo sapiens
ctgggtaactagggaagataat

SEQ ID NO: 2235631 - DNA, 14 bp, Homo sapiens
ctgggtacttgtgg

SEQ ID NO: 2235632 - DNA, 18 bp, Homo sapiens
ctgggtacttgtggacac

SEQ ID NO: 2235633 - DNA, 20 bp, Homo sapiens
ctgggtacttgtggacacag

SEQ ID NO: 2235634 - DNA, 18 bp, Homo sapiens
ctgggttcactgcaacct

SEQ ID NO: 2235635 - DNA, 14 bp, Homo sapiens
ctgggttctaccca

SEQ ID NO: 2235636 - DNA, 17 bp, Homo sapiens
ctgggttctacccaggt

SEQ ID NO: 2235637 - DNA, 20 bp, Homo sapiens
ctggtggcagctcacctctc

SEQ ID NO: 2235638 - DNA, 21 bp, Homo sapiens
ctggtggcagctcacctctcc

SEQ ID NO: 2235639 - DNA, 23 bp, Homo sapiens
ctggtggcagctcacctctccct

SEQ ID NO: 2235640 - DNA, 14 bp, Homo sapiens
ctggtggcagtggg

SEQ ID NO: 2235641 - DNA, 18 bp, Homo sapiens
ctggtggcagtgggagct

SEQ ID NO: 2235642 - DNA, 19 bp, Homo sapiens
ctggtggcagtgggagctg

SEQ ID NO: 2235643 - DNA, 23 bp, Homo sapiens
ctggtggcagtgggagctgcctg

SEQ ID NO: 2235644 - DNA, 20 bp, Homo sapiens
ctggttcagggttggcccct

SEQ ID NO: 2235645 - DNA, 16 bp, Homo sapiens
ctggttccatggcctc

SEQ ID NO: 2235646 - DNA, 13 bp, Homo sapiens
ctgtacagagccc

SEQ ID NO: 2235647 - DNA, 22 bp, Homo sapiens
ctgtacagagcccacgccccca

SEQ ID NO: 2235648 - DNA, 23 bp, Homo sapiens
ctgtacagagcccacgcccccac

SEQ ID NO: 2235649 - DNA, 21 bp, Homo sapiens
ctgtacatgaaaacacatttt

SEQ ID NO: 2235650 - DNA, 22 bp, Homo sapiens
ctgtacctcttgagccttgaac

SEQ ID NO: 2235651 - DNA, 14 bp, Homo sapiens
ctgtacgtctgaca

SEQ ID NO: 2235652 - DNA, 16 bp, Homo sapiens
ctgtacgtctgacagg

SEQ ID NO: 2235653 - DNA, 18 bp, Homo sapiens
ctgtacgtctgacaggca

SEQ ID NO: 2235654 - DNA, 19 bp, Homo sapiens
ctgtacgtctgacaggcaa

SEQ ID NO: 2235655 - DNA, 21 bp, Homo sapiens
ctgtaggaaggttaatgttca

SEQ ID NO: 2235656 - DNA, 15 bp, Homo sapiens
ctgtatcccatgagc

SEQ ID NO: 2235657 - DNA, 18 bp, Homo sapiens
ctgtatcccatgagcctc

SEQ ID NO: 2235658 - DNA, 20 bp, Homo sapiens
ctgtatcccatgagcctcag

SEQ ID NO: 2235659 - DNA, 20 bp, Homo sapiens
ctgtattttgtttttgtctt

SEQ ID NO: 2235660 - DNA, 19 bp, Homo sapiens
ctgtcaattacaggaagta

SEQ ID NO: 2235661 - DNA, 21 bp, Homo sapiens
ctgtcatttgagcagggctca

SEQ ID NO: 2235662 - DNA, 22 bp, Homo sapiens
ctgtcccagtgccgagaaggaa

SEQ ID NO: 2235663 - DNA, 22 bp, Homo sapiens
ctgtccccgcactgggcttggg

SEQ ID NO: 2235664 - DNA, 15 bp, Homo sapiens
ctgtccgagctttga

SEQ ID NO: 2235665 - DNA, 18 bp, Homo sapiens
ctgtcctactctgtgtca

SEQ ID NO: 2235666 - DNA, 21 bp, Homo sapiens
ctgtcctactctgtgtcaggt

SEQ ID NO: 2235667 - DNA, 13 bp, Homo sapiens
ctgtcctgggagt

SEQ ID NO: 2235668 - DNA, 20 bp, Homo sapiens
ctgtcctgggagtgagctgg

SEQ ID NO: 2235669 - DNA, 15 bp, Homo sapiens
ctgtcgcccagtctg

SEQ ID NO: 2235670 - DNA, 23 bp, Homo sapiens
ctgtctcaaaaaaacacaaaagt

SEQ ID NO: 2235671 - DNA, 16 bp, Homo sapiens
ctgtctcaaaaaaaga

SEQ ID NO: 2235672 - DNA, 14 bp, Homo sapiens
gcattccccaggag

SEQ ID NO: 2235673 - DNA, 16 bp, Homo sapiens
gcattccccaggaggc

SEQ ID NO: 2235674 - DNA, 20 bp, Homo sapiens
gcattccccaggaggccagc

SEQ ID NO: 2235675 - DNA, 18 bp, Homo sapiens
gcattgtgggaaggggag

SEQ ID NO: 2235676 - DNA, 15 bp, Homo sapiens
gcatttaaaagatac

SEQ ID NO: 2235677 - DNA, 14 bp, Homo sapiens
gcatttgaaaattt

SEQ ID NO: 2235678 - DNA, 18 bp, Homo sapiens
gcatttgaggtctgttct

SEQ ID NO: 2235679 - DNA, 20 bp, Homo sapiens
gcatttgaggtctgttcttt

SEQ ID NO: 2235680 - DNA, 18 bp, Homo sapiens
gcatttgtttgaactgat

SEQ ID NO: 2235681 - DNA, 14 bp, Homo sapiens
gccaaactcacctg

SEQ ID NO: 2235682 - DNA, 20 bp, Homo sapiens
gccaaagccaaagctaggcc

SEQ ID NO: 2235683 - DNA, 19 bp, Homo sapiens
gccaaagcctcctccagcc

SEQ ID NO: 2235684 - DNA, 22 bp, Homo sapiens
gccaaagctaggcctggccaga

SEQ ID NO: 2235685 - DNA, 12 bp, Homo sapiens
gccaaaggaagc

SEQ ID NO: 2235686 - DNA, 20 bp, Homo sapiens
gccaaaggaagcacatgcct

SEQ ID NO: 2235687 - DNA, 14 bp, Homo sapiens
gccaagaattctta

SEQ ID NO: 2235688 - DNA, 17 bp, Homo sapiens
gccaaggccaaaggaag

SEQ ID NO: 2235689 - DNA, 23 bp, Homo sapiens
gccaaggtgggaggattgcttga

SEQ ID NO: 2235690 - DNA, 20 bp, Homo sapiens
gccacagagaaagtacttct

SEQ ID NO: 2235691 - DNA, 21 bp, Homo sapiens
gccacagggtgagcactctgg

SEQ ID NO: 2235692 - DNA, 22 bp, Homo sapiens
gccaccaacatactcccatctg

SEQ ID NO: 2235693 - DNA, 20 bp, Homo sapiens
gccacctgcggtgctatctc

SEQ ID NO: 2235694 - DNA, 21 bp, Homo sapiens
gccactgcaccgggccacaga

SEQ ID NO: 2235695 - DNA, 19 bp, Homo sapiens
gccactgtgaagagaacca

SEQ ID NO: 2235696 - DNA, 15 bp, Homo sapiens
gccagagacacaagc

SEQ ID NO: 2235697 - DNA, 22 bp, Homo sapiens
gccagagacacaagccttcggc

SEQ ID NO: 2235698 - DNA, 13 bp, Homo sapiens
gccagaggagaga

SEQ ID NO: 2235699 - DNA, 21 bp, Homo sapiens
gccagagggagtgacagaggc

SEQ ID NO: 2235700 - DNA, 16 bp, Homo sapiens
gccagatgcaccagcc

SEQ ID NO: 2235701 - DNA, 17 bp, Homo sapiens
gccagattctttcctga

SEQ ID NO: 2235702 - DNA, 24 bp, Homo sapiens
gccagattctttcctgaggctggg

SEQ ID NO: 2235703 - DNA, 16 bp, Homo sapiens
gccagcaggctctcag

SEQ ID NO: 2235704 - DNA, 17 bp, Homo sapiens
gccagcaggctctcagg

SEQ ID NO: 2235705 - DNA, 14 bp, Homo sapiens
gccagccttgacca

SEQ ID NO: 2235706 - DNA, 15 bp, Homo sapiens
gccagctgcttgggc

SEQ ID NO: 2235707 - DNA, 11 bp, Homo sapiens
gccaggaagcc

SEQ ID NO: 2235708 - DNA, 13 bp, Homo sapiens
gccaggaagccag

SEQ ID NO: 2235709 - DNA, 19 bp, Homo sapiens
gccaggaagccagcaggct

SEQ ID NO: 2235710 - DNA, 20 bp, Homo sapiens
gccaggaagccagcaggctc

SEQ ID NO: 2235711 - DNA, 16 bp, Homo sapiens
gccaggagcctcctgc

SEQ ID NO: 2235712 - DNA, 13 bp, Homo sapiens
gccaggccacaag

SEQ ID NO: 2235713 - DNA, 18 bp, Homo sapiens
gccaggccacaagaccct

SEQ ID NO: 2235714 - DNA, 23 bp, Homo sapiens
gccaggccacaagacccttgtgg

SEQ ID NO: 2235715 - DNA, 12 bp, Homo sapiens
gccaggccagag

SEQ ID NO: 2235716 - DNA, 15 bp, Homo sapiens
gccaggccctctgcc

SEQ ID NO: 2235717 - DNA, 16 bp, Homo sapiens
gccaggccctctgccc

SEQ ID NO: 2235718 - DNA, 17 bp, Homo sapiens
gccaggccctctgccca

SEQ ID NO: 2235719 - DNA, 17 bp, Homo sapiens
gccagtcaccccggcca

SEQ ID NO: 2235720 - DNA, 13 bp, Homo sapiens
gccagttggtccc

SEQ ID NO: 2235721 - DNA, 18 bp, Homo sapiens
gccagttggtcccccttc

SEQ ID NO: 2235722 - DNA, 20 bp, Homo sapiens
gccagttggtcccccttcca

SEQ ID NO: 2235723 - DNA, 21 bp, Homo sapiens
gccagttggtcccccttccat

SEQ ID NO: 2235724 - DNA, 19 bp, Homo sapiens
gccatccaggttcagcttg

SEQ ID NO: 2235725 - DNA, 20 bp, Homo sapiens
gccatccaggttcagcttgt

SEQ ID NO: 2235726 - DNA, 16 bp, Homo sapiens
gccatcccagccccaa

SEQ ID NO: 2235727 - DNA, 17 bp, Homo sapiens
gccatcccagccccaat

SEQ ID NO: 2235728 - DNA, 18 bp, Homo sapiens
gccatgccagcttatctc

SEQ ID NO: 2235729 - DNA, 14 bp, Homo sapiens
gccatgttggccag

SEQ ID NO: 2235730 - DNA, 20 bp, Homo sapiens
gccatgttggccaggctggt

SEQ ID NO: 2235731 - DNA, 15 bp, Homo sapiens
gcccaaagatgcagc

SEQ ID NO: 2235732 - DNA, 16 bp, Homo sapiens
gcccaaagatgcagcc

SEQ ID NO: 2235733 - DNA, 16 bp, Homo sapiens
gcccaagagagacagc

SEQ ID NO: 2235734 - DNA, 20 bp, Homo sapiens
gcccaagagagacagcacag

SEQ ID NO: 2235735 - DNA, 22 bp, Homo sapiens
gcccaagagagacagcacaggc

SEQ ID NO: 2235736 - DNA, 23 bp, Homo sapiens
gcccaagagagacagcacaggca

SEQ ID NO: 2235737 - DNA, 18 bp, Homo sapiens
gcccacaggatcagtctg

SEQ ID NO: 2235738 - DNA, 21 bp, Homo sapiens
gcccaccccgcctgccctccc

SEQ ID NO: 2235739 - DNA, 16 bp, Homo sapiens
gcccacctggcctctg

SEQ ID NO: 2235740 - DNA, 24 bp, Homo sapiens
gcccacctggcctctgcactcccc

SEQ ID NO: 2235741 - DNA, 13 bp, Homo sapiens
gcccacgccccca

SEQ ID NO: 2235742 - DNA, 16 bp, Homo sapiens
gcccacgcccccactg

SEQ ID NO: 2235743 - DNA, 16 bp, Homo sapiens
gcccacgctggagtgc

SEQ ID NO: 2235744 - DNA, 23 bp, Homo sapiens
gcccacgctggagtgcagtgagc

SEQ ID NO: 2235745 - DNA, 13 bp, Homo sapiens
gcccactccctgc

SEQ ID NO: 2235746 - DNA, 15 bp, Homo sapiens
gcccactccctgcaa

SEQ ID NO: 2235747 - DNA, 19 bp, Homo sapiens
gcccactccctgcaacctg

SEQ ID NO: 2235748 - DNA, 12 bp, Homo sapiens
gcccagagggcc

SEQ ID NO: 2235749 - DNA, 18 bp, Homo sapiens
gcccagagggcctgcaag

SEQ ID NO: 2235750 - DNA, 21 bp, Homo sapiens
gcccagagggcctgcaaggga

SEQ ID NO: 2235751 - DNA, 9 bp, Homo sapiens
gcccagccc

SEQ ID NO: 2235752 - DNA, 15 bp, Homo sapiens
gcccaggaaaggctc

SEQ ID NO: 2235753 - DNA, 13 bp, Homo sapiens
gcccaggcaggtc

SEQ ID NO: 2235754 - DNA, 22 bp, Homo sapiens
gcccaggcccctgccaccctgg

SEQ ID NO: 2235755 - DNA, 14 bp, Homo sapiens
gcccaggcctcccc

SEQ ID NO: 2235756 - DNA, 13 bp, Homo sapiens
gcccaggcctcct

SEQ ID NO: 2235757 - DNA, 16 bp, Homo sapiens
gcccaggctggcgtgc

SEQ ID NO: 2235758 - DNA, 22 bp, Homo sapiens
gcccaggctggcgtgcagtggt

SEQ ID NO: 2235759 - DNA, 19 bp, Homo sapiens
gcccagttgggtggatgcc

SEQ ID NO: 2235760 - DNA, 15 bp, Homo sapiens
gccccagtgcccaca

SEQ ID NO: 2235761 - DNA, 13 bp, Homo sapiens
gccccatcctctg

SEQ ID NO: 2235762 - DNA, 14 bp, Homo sapiens
gccccatcctctgt

SEQ ID NO: 2235763 - DNA, 23 bp, Homo sapiens
gccccattctgcctgcccaggcc

SEQ ID NO: 2235764 - DNA, 9 bp, Homo sapiens
gcccccacc

SEQ ID NO: 2235765 - DNA, 11 bp, Homo sapiens
gcccccacccc

SEQ ID NO: 2235766 - DNA, 17 bp, Homo sapiens
gcccccaccccaggctg

SEQ ID NO: 2235767 - DNA, 20 bp, Homo sapiens
gcccccaccccaggctgggc

SEQ ID NO: 2235768 - DNA, 19 bp, Homo sapiens
gcccctcagggtccctggt

SEQ ID NO: 2235769 - DNA, 21 bp, Homo sapiens
gcccctcagggtccctggtgg

SEQ ID NO: 2235770 - DNA, 15 bp, Homo sapiens
tgcttgagctcagga

SEQ ID NO: 2235771 - DNA, 21 bp, Homo sapiens
tgcttggaggaaggaaaccca

SEQ ID NO: 2235772 - DNA, 16 bp, Homo sapiens
tgcttgggcttcatcc

SEQ ID NO: 2235773 - DNA, 12 bp, Homo sapiens
tgcttgtacata

SEQ ID NO: 2235774 - DNA, 13 bp, Homo sapiens
tgcttgtacataa

SEQ ID NO: 2235775 - DNA, 18 bp, Homo sapiens
tgcttgtgaaaggaaaga

SEQ ID NO: 2235776 - DNA, 16 bp, Homo sapiens
tgctttgtgatttttg

SEQ ID NO: 2235777 - DNA, 17 bp, Homo sapiens
tgctttgtgatttttgt

SEQ ID NO: 2235778 - DNA, 20 bp, Homo sapiens
tggaaaaatagcctgcctct

SEQ ID NO: 2235779 - DNA, 21 bp, Homo sapiens
tggaaagacttttccaaccct

SEQ ID NO: 2235780 - DNA, 18 bp, Homo sapiens
tggaaatgggcagagcag

SEQ ID NO: 2235781 - DNA, 12 bp, Homo sapiens
tggaacactctg

SEQ ID NO: 2235782 - DNA, 16 bp, Homo sapiens
tggaagcacagcttca

SEQ ID NO: 2235783 - DNA, 19 bp, Homo sapiens
tggaataacatgtaattaa

SEQ ID NO: 2235784 - DNA, 20 bp, Homo sapiens
tggaatgcgggggagcaggc

SEQ ID NO: 2235785 - DNA, 23 bp, Homo sapiens
tggaatgcgggggagcaggcagt

SEQ ID NO: 2235786 - DNA, 13 bp, Homo sapiens
tggacacagctct

SEQ ID NO: 2235787 - DNA, 22 bp, Homo sapiens
tggacaggcatgttctctgagg

SEQ ID NO: 2235788 - DNA, 23 bp, Homo sapiens
tggacaggcatgttctctgagga

SEQ ID NO: 2235789 - DNA, 13 bp, Homo sapiens
tggacatgcacag

SEQ ID NO: 2235790 - DNA, 12 bp, Homo sapiens
tggaccctgagg

SEQ ID NO: 2235791 - DNA, 15 bp, Homo sapiens
tggaccctgaggccc

SEQ ID NO: 2235792 - DNA, 23 bp, Homo sapiens
tggaccctgtggatgataaaaca

SEQ ID NO: 2235793 - DNA, 19 bp, Homo sapiens
tggacgtgttatgactcca

SEQ ID NO: 2235794 - DNA, 24 bp, Homo sapiens
tggactttgttagtttctccaagc

SEQ ID NO: 2235795 - DNA, 18 bp, Homo sapiens
tggaggaaggaaacccag

SEQ ID NO: 2235796 - DNA, 21 bp, Homo sapiens
tggaggaaggaaacccagctc

SEQ ID NO: 2235797 - DNA, 20 bp, Homo sapiens
tggaggtacgaaaagagggg

SEQ ID NO: 2235798 - DNA, 13 bp, Homo sapiens
tggatgcagcctc

SEQ ID NO: 2235799 - DNA, 14 bp, Homo sapiens
tggatgcctggtgg

SEQ ID NO: 2235800 - DNA, 21 bp, Homo sapiens
tggatgcctggtggcagctgc

SEQ ID NO: 2235801 - DNA, 22 bp, Homo sapiens
tggattaaacttaatctaaatg

SEQ ID NO: 2235802 - DNA, 13 bp, Homo sapiens
tggattgtccccg

SEQ ID NO: 2235803 - DNA, 24 bp, Homo sapiens
tggatttaacagaaatgtacagca

SEQ ID NO: 2235804 - DNA, 23 bp, Homo sapiens
tggcacatcagcacgatttctgt

SEQ ID NO: 2235805 - DNA, 16 bp, Homo sapiens
tggcaccagcagcctg

SEQ ID NO: 2235806 - DNA, 15 bp, Homo sapiens
tggcacccggcccct

SEQ ID NO: 2235807 - DNA, 16 bp, Homo sapiens
tggcactataatgtaa

SEQ ID NO: 2235808 - DNA, 21 bp, Homo sapiens
tggcactataatgtaagctct

SEQ ID NO: 2235809 - DNA, 19 bp, Homo sapiens
tggcactgcttccagtgag

SEQ ID NO: 2235810 - DNA, 19 bp, Homo sapiens
tggcagctcacctctccct

SEQ ID NO: 2235811 - DNA, 21 bp, Homo sapiens
tggcagctcacctctcccttg

SEQ ID NO: 2235812 - DNA, 13 bp, Homo sapiens
tggcagctcagag

SEQ ID NO: 2235813 - DNA, 21 bp, Homo sapiens
tggcagctgcggtccacccag

SEQ ID NO: 2235814 - DNA, 19 bp, Homo sapiens
tggcagtgggagctgcctg

SEQ ID NO: 2235815 - DNA, 15 bp, Homo sapiens
tggcatgggaatgaa

SEQ ID NO: 2235816 - DNA, 21 bp, Homo sapiens
tggccaaagccaaagctaggc

SEQ ID NO: 2235817 - DNA, 23 bp, Homo sapiens
tggccaaagccaaagctaggcct

SEQ ID NO: 2235818 - DNA, 19 bp, Homo sapiens
tggccagatgcaccagccc

SEQ ID NO: 2235819 - DNA, 20 bp, Homo sapiens
tggccagatgcaccagccct

SEQ ID NO: 2235820 - DNA, 21 bp, Homo sapiens
tggccagatgcaccagccctt

SEQ ID NO: 2235821 - DNA, 13 bp, Homo sapiens
tggccaggctggt

SEQ ID NO: 2235822 - DNA, 19 bp, Homo sapiens
tggcccacgcacttcggga

SEQ ID NO: 2235823 - DNA, 15 bp, Homo sapiens
tggcccctgcccggc

SEQ ID NO: 2235824 - DNA, 21 bp, Homo sapiens
tggcccctgcccggctgcgga

SEQ ID NO: 2235825 - DNA, 18 bp, Homo sapiens
tggcctcaagtgattctc

SEQ ID NO: 2235826 - DNA, 23 bp, Homo sapiens
tggcctcaagtgattctcctgcc

SEQ ID NO: 2235827 - DNA, 13 bp, Homo sapiens
tgtagagtgggag

SEQ ID NO: 2235828 - DNA, 20 bp, Homo sapiens
tgtattctctcctgtacctc

SEQ ID NO: 2235829 - DNA, 19 bp, Homo sapiens
tgtattttactaataaaat

SEQ ID NO: 2235830 - DNA, 14 bp, Homo sapiens
tgtcaaagtggtga

SEQ ID NO: 2235831 - DNA, 15 bp, Homo sapiens
tgtcaaagtggtgag

SEQ ID NO: 2235832 - DNA, 19 bp, Homo sapiens
tgtcaagagggtctgagga

SEQ ID NO: 2235833 - DNA, 21 bp, Homo sapiens
tgtcaattacaggaagtactg

SEQ ID NO: 2235834 - DNA, 21 bp, Homo sapiens
tgtcacaggcaggtccagggt

SEQ ID NO: 2235835 - DNA, 13 bp, Homo sapiens
tgtcacctgaaga

SEQ ID NO: 2235836 - DNA, 18 bp, Homo sapiens
tgtcaggtggggcagctt

SEQ ID NO: 2235837 - DNA, 20 bp, Homo sapiens
tgtcatttgagcagggctca

SEQ ID NO: 2235838 - DNA, 21 bp, Homo sapiens
tgtcatttgagcagggctcag

SEQ ID NO: 2235839 - DNA, 18 bp, Homo sapiens
tgtccccaccgcagacag

SEQ ID NO: 2235840 - DNA, 22 bp, Homo sapiens
tgtccccaccgcagacaggacc

SEQ ID NO: 2235841 - DNA, 14 bp, Homo sapiens
tgtccctgcacttg

SEQ ID NO: 2235842 - DNA, 17 bp, Homo sapiens
tgtcccttttccttttt

SEQ ID NO: 2235843 - DNA, 16 bp, Homo sapiens
tgtcctacccaccctc

SEQ ID NO: 2235844 - DNA, 12 bp, Homo sapiens
tgtcctactctg

SEQ ID NO: 2235845 - DNA, 12 bp, Homo sapiens
tgtcctgggagt

SEQ ID NO: 2235846 - DNA, 14 bp, Homo sapiens
tgtcgggcatgaca

SEQ ID NO: 2235847 - DNA, 14 bp, Homo sapiens
tgtctatgggactc

SEQ ID NO: 2235848 - DNA, 13 bp, Homo sapiens
tgtctctgagagt

SEQ ID NO: 2235849 - DNA, 18 bp, Homo sapiens
tgtctcttggtcctgctg

SEQ ID NO: 2235850 - DNA, 21 bp, Homo sapiens
tgtctctttaatgtcacaggc

SEQ ID NO: 2235851 - DNA, 15 bp, Homo sapiens
tgtcttgcaatggca

SEQ ID NO: 2235852 - DNA, 18 bp, Homo sapiens
tgtctttggaccctgagg

SEQ ID NO: 2235853 - DNA, 22 bp, Homo sapiens
tgtctttggaccctgaggccca

SEQ ID NO: 2235854 - DNA, 21 bp, Homo sapiens
tgtcttttcttgcatgaggct

SEQ ID NO: 2235855 - DNA, 23 bp, Homo sapiens
tgtcttttcttgcatgaggctag

SEQ ID NO: 2235856 - DNA, 21 bp, Homo sapiens
tgtgaaaagaaaaatgagcct

SEQ ID NO: 2235857 - DNA, 23 bp, Homo sapiens
tgtgaaaagaaaaatgagcctgg

SEQ ID NO: 2235858 - DNA, 15 bp, Homo sapiens
tgtgaaccaccacac

SEQ ID NO: 2235859 - DNA, 17 bp, Homo sapiens
tgtgaaccaccacaccc

SEQ ID NO: 2235860 - DNA, 12 bp, Homo sapiens
tgtgaggaagcc

SEQ ID NO: 2235861 - DNA, 20 bp, Homo sapiens
tgtgagtactacagtcctcc

SEQ ID NO: 2235862 - DNA, 23 bp, Homo sapiens
tgtgagtactacagtcctcccat

SEQ ID NO: 2235863 - DNA, 17 bp, Homo sapiens
tgtgagtcaccaagccc

SEQ ID NO: 2235864 - DNA, 19 bp, Homo sapiens
tgtgagtcaccaagcccag

SEQ ID NO: 2235865 - DNA, 14 bp, Homo sapiens
tgtgcattatctag

SEQ ID NO: 2235866 - DNA, 20 bp, Homo sapiens
tgtgcattatctagatactg

SEQ ID NO: 2235867 - DNA, 23 bp, Homo sapiens
tgtgcattatctagatactgtat

SEQ ID NO: 2235868 - DNA, 16 bp, Homo sapiens
tgtgccatgtgccagg

SEQ ID NO: 2235869 - DNA, 16 bp, Homo sapiens
tgtgcccccaccccca

SEQ ID NO: 2235870 - DNA, 17 bp, Homo sapiens
tgtgcccccacccccac

SEQ ID NO: 2235871 - DNA, 12 bp, Homo sapiens
tgtgctctgatc

SEQ ID NO: 2235872 - DNA, 19 bp, Homo sapiens
tgtgctgagtctgaaggct

SEQ ID NO: 2235873 - DNA, 18 bp, Homo sapiens
tgtgctgccctgcccacc

SEQ ID NO: 2235874 - DNA, 13 bp, Homo sapiens
tgtggacacagct

SEQ ID NO: 2235875 - DNA, 16 bp, Homo sapiens
tgtggacacagctctt

SEQ ID NO: 2235876 - DNA, 19 bp, Homo sapiens
tgtggacacagctcttctc

SEQ ID NO: 2235877 - DNA, 21 bp, Homo sapiens
tgtggagaagcggctggcagc

SEQ ID NO: 2235878 - DNA, 17 bp, Homo sapiens
tgtggagttcatcttga

SEQ ID NO: 2235879 - DNA, 21 bp, Homo sapiens
tgtggagttcatcttgaattg

SEQ ID NO: 2235880 - DNA, 23 bp, Homo sapiens
tgtggcgcagcatattcaggaag

SEQ ID NO: 2235881 - DNA, 21 bp, Homo sapiens
tgtgggtttctaaagctgcca

SEQ ID NO: 2235882 - DNA, 12 bp, Homo sapiens
tgtgtagggcgg

SEQ ID NO: 2235883 - DNA, 20 bp, Homo sapiens
tgtgtctcttggtcctgctg

SEQ ID NO: 2235884 - DNA, 19 bp, Homo sapiens
tgtgtgcacgtacacacac

SEQ ID NO: 2235885 - DNA, 11 bp, Homo sapiens
tgtgtgtttat

SEQ ID NO: 2235886 - DNA, 13 bp, Homo sapiens
tgtgtttattgtc

SEQ ID NO: 2235887 - DNA, 16 bp, Homo sapiens
tgtgtttattgtcaaa

SEQ ID NO: 2235888 - DNA, 13 bp, Homo sapiens
tgttacattttta

SEQ ID NO: 2235889 - DNA, 14 bp, Homo sapiens
tgttactaagtttt

SEQ ID NO: 2235890 - DNA, 20 bp, Homo sapiens
tgttagtatgaggcatttgt

SEQ ID NO: 2235891 - DNA, 17 bp, Homo sapiens
tgttatgactccagaat

SEQ ID NO: 2235892 - DNA, 14 bp, Homo sapiens
tgttcagctccagc

SEQ ID NO: 2235893 - DNA, 21 bp, Homo sapiens
tgttcagctccagctcaccag

SEQ ID NO: 2235894 - DNA, 16 bp, Homo sapiens
tgttctctgaggacac

SEQ ID NO: 2235895 - DNA, 18 bp, Homo sapiens
tgttctctgaggacacta

SEQ ID NO: 2235896 - DNA, 13 bp, Homo sapiens
tgttctctgccct

SEQ ID NO: 2235897 - DNA, 13 bp, Homo sapiens
tgttctggctctt

SEQ ID NO: 2235898 - DNA, 16 bp, Homo sapiens
tgttctgggacacagt

SEQ ID NO: 2235899 - DNA, 14 bp, Homo sapiens
tgttcttaattctt

SEQ ID NO: 2235900 - DNA, 18 bp, Homo sapiens
tgttcttggtttgtaaat

SEQ ID NO: 2235901 - DNA, 14 bp, Homo sapiens
tgttctttccaaag

SEQ ID NO: 2235902 - DNA, 14 bp, Homo sapiens
tgttctttctggct

SEQ ID NO: 2235903 - DNA, 20 bp, Homo sapiens
tgttctttctggctatgcat

SEQ ID NO: 2235904 - DNA, 14 bp, Homo sapiens
tcctgcaggcagcc

SEQ ID NO: 2235905 - DNA, 16 bp, Homo sapiens
tcctgcaggcagccag

SEQ ID NO: 2235906 - DNA, 17 bp, Homo sapiens
tcctgcaggcagccagg

SEQ ID NO: 2235907 - DNA, 13 bp, Homo sapiens
tcctgccaggcat

SEQ ID NO: 2235908 - DNA, 18 bp, Homo sapiens
tcctgcccccaccccagg

SEQ ID NO: 2235909 - DNA, 22 bp, Homo sapiens
tcctgcccccaccccaggctgg

SEQ ID NO: 2235910 - DNA, 20 bp, Homo sapiens
tcctgcccttacctgccagg

SEQ ID NO: 2235911 - DNA, 17 bp, Homo sapiens
tcctgcctcagcctccc

SEQ ID NO: 2235912 - DNA, 13 bp, Homo sapiens
tcctgctgcagtt

SEQ ID NO: 2235913 - DNA, 15 bp, Homo sapiens
tcctggaaatattaa

SEQ ID NO: 2235914 - DNA, 14 bp, Homo sapiens
tcctggcacccggc

SEQ ID NO: 2235915 - DNA, 17 bp, Homo sapiens
tcctggcactgcttcca

SEQ ID NO: 2235916 - DNA, 12 bp, Homo sapiens
tcctgggagtga

SEQ ID NO: 2235917 - DNA, 17 bp, Homo sapiens
tcctgggagtgagctgg

SEQ ID NO: 2235918 - DNA, 13 bp, Homo sapiens
tcctgtagcccta

SEQ ID NO: 2235919 - DNA, 19 bp, Homo sapiens
tcctgttcccatgagatga

SEQ ID NO: 2235920 - DNA, 18 bp, Homo sapiens
tccttcacctttgtcccc

SEQ ID NO: 2235921 - DNA, 22 bp, Homo sapiens
tccttcacctttgtccccaccg

SEQ ID NO: 2235922 - DNA, 22 bp, Homo sapiens
tccttgaaaacactgttctctg

SEQ ID NO: 2235923 - DNA, 21 bp, Homo sapiens
tccttggtgtcgggcatgaca

SEQ ID NO: 2235924 - DNA, 22 bp, Homo sapiens
tccttggtgtcgggcatgacac

SEQ ID NO: 2235925 - DNA, 18 bp, Homo sapiens
tcctttgtgaggaagccg

SEQ ID NO: 2235926 - DNA, 23 bp, Homo sapiens
tccttttcacagttctctccttc

SEQ ID NO: 2235927 - DNA, 18 bp, Homo sapiens
tccttttcgcaggattct

SEQ ID NO: 2235928 - DNA, 13 bp, Homo sapiens
tcgaactggctgc

SEQ ID NO: 2235929 - DNA, 14 bp, Homo sapiens
tcgaactggctgca

SEQ ID NO: 2235930 - DNA, 13 bp, Homo sapiens
tcgaggacaggga

SEQ ID NO: 2235931 - DNA, 23 bp, Homo sapiens
tcgcaggattcttcctccctccc

SEQ ID NO: 2235932 - DNA, 19 bp, Homo sapiens
tcgcccagtctggaatgca

SEQ ID NO: 2235933 - DNA, 23 bp, Homo sapiens
tcgcccagtctggaatgcagtgg

SEQ ID NO: 2235934 - DNA, 14 bp, Homo sapiens
tcgcgacaatgcaa

SEQ ID NO: 2235935 - DNA, 16 bp, Homo sapiens
tcgcgacaatgcaaac

SEQ ID NO: 2235936 - DNA, 12 bp, Homo sapiens
tcgctcctgtgt

SEQ ID NO: 2235937 - DNA, 14 bp, Homo sapiens
tcgctcctgtgtct

SEQ ID NO: 2235938 - DNA, 23 bp, Homo sapiens
tcggctaaaaagaatgcagagat

SEQ ID NO: 2235939 - DNA, 21 bp, Homo sapiens
tcgggaggtcgaggcaggagg

SEQ ID NO: 2235940 - DNA, 11 bp, Homo sapiens
tcgggcatgac

SEQ ID NO: 2235941 - DNA, 13 bp, Homo sapiens
tctaaagctgcca

SEQ ID NO: 2235942 - DNA, 17 bp, Homo sapiens
tctaaagctgccagccg

SEQ ID NO: 2235943 - DNA, 13 bp, Homo sapiens
tctaaaggctacc

SEQ ID NO: 2235944 - DNA, 17 bp, Homo sapiens
tctaaaggctacctttg

SEQ ID NO: 2235945 - DNA, 20 bp, Homo sapiens
tctaaaggctacctttgtat

SEQ ID NO: 2235946 - DNA, 21 bp, Homo sapiens
tctaaatctccaaaataaaac

SEQ ID NO: 2235947 - DNA, 16 bp, Homo sapiens
tctaacttcaccatat

SEQ ID NO: 2235948 - DNA, 14 bp, Homo sapiens
tctaatatgtaaca

SEQ ID NO: 2235949 - DNA, 21 bp, Homo sapiens
tctacactgtgctgagtctga

SEQ ID NO: 2235950 - DNA, 12 bp, Homo sapiens
tctagggaaaaa

SEQ ID NO: 2235951 - DNA, 19 bp, Homo sapiens
tctagggaaaaaccagcgt

SEQ ID NO: 2235952 - DNA, 15 bp, Homo sapiens
tctatcaagtattat

SEQ ID NO: 2235953 - DNA, 18 bp, Homo sapiens
tctatttttgtaaaaagg

SEQ ID NO: 2235954 - DNA, 16 bp, Homo sapiens
tctcaaaaaaagaaaa

SEQ ID NO: 2235955 - DNA, 22 bp, Homo sapiens
tctcaaactcttgacctcaggt

SEQ ID NO: 2235956 - DNA, 16 bp, Homo sapiens
tctcacacatgagcat

SEQ ID NO: 2235957 - DNA, 23 bp, Homo sapiens
tctcacacatgagcatcaggcca

SEQ ID NO: 2235958 - DNA, 13 bp, Homo sapiens
tctcactccttga

SEQ ID NO: 2235959 - DNA, 18 bp, Homo sapiens
tctcactgttgcccaggc

SEQ ID NO: 2235960 - DNA, 19 bp, Homo sapiens
tctcactgttgcccaggct

SEQ ID NO: 2235961 - DNA, 21 bp, Homo sapiens
tctcagaatctcaaataacta

SEQ ID NO: 2235962 - DNA, 12 bp, Homo sapiens
tctcaggccagc

SEQ ID NO: 2235963 - DNA, 18 bp, Homo sapiens
tctcaggccagctgcttg

SEQ ID NO: 2235964 - DNA, 18 bp, Homo sapiens
tctcatactcacctcacc

SEQ ID NO: 2235965 - DNA, 17 bp, Homo sapiens
tctccaaaataaaactt

SEQ ID NO: 2235966 - DNA, 16 bp, Homo sapiens
tctccaagcaggacat

SEQ ID NO: 2235967 - DNA, 14 bp, Homo sapiens
tctccaccctgctc

SEQ ID NO: 2235968 - DNA, 16 bp, Homo sapiens
tctccacctgccaggg

SEQ ID NO: 2235969 - DNA, 17 bp, Homo sapiens
tctccacctgccaggga

SEQ ID NO: 2235970 - DNA, 22 bp, Homo sapiens
tctccacctgccagggacagag

SEQ ID NO: 2235971 - DNA, 15 bp, Homo sapiens
tctccagcccctgga

SEQ ID NO: 2235972 - DNA, 18 bp, Homo sapiens
tctccagcccctggatgc

SEQ ID NO: 2235973 - DNA, 22 bp, Homo sapiens
tctccagcccctggatgcagcc

SEQ ID NO: 2235974 - DNA, 16 bp, Homo sapiens
tctccaggctgtatcc

SEQ ID NO: 2235975 - DNA, 23 bp, Homo sapiens
tctccccagcaagtgagagctgg

SEQ ID NO: 2235976 - DNA, 23 bp, Homo sapiens
tctccctcagtctggcccttcct

SEQ ID NO: 2235977 - DNA, 16 bp, Homo sapiens
tctcccttcatccttc

SEQ ID NO: 2235978 - DNA, 19 bp, Homo sapiens
tctcccttggattgtcccc

SEQ ID NO: 2235979 - DNA, 21 bp, Homo sapiens
tctcccttggattgtccccga

SEQ ID NO: 2235980 - DNA, 23 bp, Homo sapiens
tctccgaccagacaccttgacag

SEQ ID NO: 2235981 - DNA, 21 bp, Homo sapiens
tctcctccttttcacagttct

SEQ ID NO: 2235982 - DNA, 12 bp, Homo sapiens
tctcctctgctg

SEQ ID NO: 2235983 - DNA, 17 bp, Homo sapiens
tctcctctgctgctggc

SEQ ID NO: 2235984 - DNA, 18 bp, Homo sapiens
tctcctctgctgctggct

SEQ ID NO: 2235985 - DNA, 19 bp, Homo sapiens
tctcctgcctcagcctccc

SEQ ID NO: 2235986 - DNA, 19 bp, Homo sapiens
tctcctgtacctcttgagc

SEQ ID NO: 2235987 - DNA, 20 bp, Homo sapiens
tctccttcacctttgtcccc

SEQ ID NO: 2235988 - DNA, 22 bp, Homo sapiens
tctcgtgattgataagaacctt

SEQ ID NO: 2235989 - DNA, 12 bp, Homo sapiens
tctctaacttca

SEQ ID NO: 2235990 - DNA, 18 bp, Homo sapiens
tctctagtttgattaaat

SEQ ID NO: 2235991 - DNA, 13 bp, Homo sapiens
tctctccagcccc

SEQ ID NO: 2235992 - DNA, 17 bp, Homo sapiens
tctctccagcccctgga

SEQ ID NO: 2235993 - DNA, 14 bp, Homo sapiens
tctctgaggacact

SEQ ID NO: 2235994 - DNA, 16 bp, Homo sapiens
tctcttgattcataat

SEQ ID NO: 2235995 - DNA, 16 bp, Homo sapiens
tctcttggtcctgctg

SEQ ID NO: 2235996 - DNA, 20 bp, Homo sapiens
tctctttaatgtcacaggca

SEQ ID NO: 2235997 - DNA, 14 bp, Homo sapiens
tctgaaaatgtatg

SEQ ID NO: 2235998 - DNA, 21 bp, Homo sapiens
tctgaacttggcgctgcccct

SEQ ID NO: 2235999 - DNA, 13 bp, Homo sapiens
tctgacacacagc

SEQ ID NO: 2236000 - DNA, 14 bp, Homo sapiens
tctgacacacagct

SEQ ID NO: 2236001 - DNA, 15 bp, Homo sapiens
tctgacccatgctgc

SEQ ID NO: 2236002 - DNA, 19 bp, Homo sapiens
tctgaccctgcttcaaata

SEQ ID NO: 2236003 - DNA, 18 bp, Homo sapiens
tctgagaggacttttctt

SEQ ID NO: 2236004 - DNA, 24 bp, Homo sapiens
tctgagatcaaaacggttttactg

SEQ ID NO: 2236005 - DNA, 16 bp, Homo sapiens
tctgaggaatccagac

SEQ ID NO: 2236006 - DNA, 17 bp, Homo sapiens
tctgaggaatccagacc

SEQ ID NO: 2236007 - DNA, 18 bp, Homo sapiens
tctgattcccaagctctg

SEQ ID NO: 2236008 - DNA, 19 bp, Homo sapiens
tctgattcccaagctctgc

SEQ ID NO: 2236009 - DNA, 23 bp, Homo sapiens
tctgattcccaagctctgctcct

SEQ ID NO: 2236010 - DNA, 21 bp, Homo sapiens
tctgcaagaattgaagcagga

SEQ ID NO: 2236011 - DNA, 13 bp, Homo sapiens
tctgcactcccct

SEQ ID NO: 2236012 - DNA, 15 bp, Homo sapiens
tctgcactcccctgc

SEQ ID NO: 2236013 - DNA, 17 bp, Homo sapiens
tctgcactcccctgctg

SEQ ID NO: 2236014 - DNA, 18 bp, Homo sapiens
tctgcactcccctgctgg

SEQ ID NO: 2236015 - DNA, 19 bp, Homo sapiens
tctgcactcccctgctggg

SEQ ID NO: 2236016 - DNA, 18 bp, Homo sapiens
tctgcagcaataaagcag

SEQ ID NO: 2236017 - DNA, 12 bp, Homo sapiens
tctgcagggaat

SEQ ID NO: 2236018 - DNA, 22 bp, Homo sapiens
tctgccatattctgttggccag

SEQ ID NO: 2236019 - DNA, 18 bp, Homo sapiens
tctgcccactccctgcaa

SEQ ID NO: 2236020 - DNA, 21 bp, Homo sapiens
tctgcccactccctgcaacct

SEQ ID NO: 2236021 - DNA, 21 bp, Homo sapiens
gcctcccaactcaccccagcc

SEQ ID NO: 2236022 - DNA, 17 bp, Homo sapiens
acagtattacttctgct

SEQ ID NO: 2236023 - DNA, 17 bp, Homo sapiens
acagtcctcccatctca

SEQ ID NO: 2236024 - DNA, 20 bp, Homo sapiens
acagtccttaccagcagagc

SEQ ID NO: 2236025 - DNA, 20 bp, Homo sapiens
acagttcaattctcatttgt

SEQ ID NO: 2236026 - DNA, 15 bp, Homo sapiens
acagttgaaaaacag

SEQ ID NO: 2236027 - DNA, 16 bp, Homo sapiens
acagttgaaaaacagc

SEQ ID NO: 2236028 - DNA, 22 bp, Homo sapiens
acaaaatgaaacgcaaccacca

SEQ ID NO: 2236029 - DNA, 21 bp, Homo sapiens
acaaacctgtttctgcagcca

SEQ ID NO: 2236030 - DNA, 13 bp, Homo sapiens
acaaagactgagt

SEQ ID NO: 2236031 - DNA, 21 bp, Homo sapiens
acaaagcgtggtggacatgca

SEQ ID NO: 2236032 - DNA, 17 bp, Homo sapiens
acaacatctttttctac

SEQ ID NO: 2236033 - DNA, 17 bp, Homo sapiens
acaagagcccaggcctc

SEQ ID NO: 2236034 - DNA, 22 bp, Homo sapiens
acaagagcccaggcctcctaca

SEQ ID NO: 2236035 - DNA, 12 bp, Homo sapiens
acaagccacccc

SEQ ID NO: 2236036 - DNA, 17 bp, Homo sapiens
acaagcgtgagccactg

SEQ ID NO: 2236037 - DNA, 17 bp, Homo sapiens
acaagctccaagctccc

SEQ ID NO: 2236038 - DNA, 13 bp, Homo sapiens
acaagctgcaccc

SEQ ID NO: 2236039 - DNA, 17 bp, Homo sapiens
acaaggattgctactgt

SEQ ID NO: 2236040 - DNA, 14 bp, Homo sapiens
acaaggcaaggctg

SEQ ID NO: 2236041 - DNA, 15 bp, Homo sapiens
acaaggcaaggctgt

SEQ ID NO: 2236042 - DNA, 17 bp, Homo sapiens
acaaggcaaggctgtca

SEQ ID NO: 2236043 - DNA, 19 bp, Homo sapiens
acaaggcaaggctgtcaat

SEQ ID NO: 2236044 - DNA, 15 bp, Homo sapiens
acaagttaaataaat

SEQ ID NO: 2236045 - DNA, 12 bp, Homo sapiens
acaatgacttac

SEQ ID NO: 2236046 - DNA, 17 bp, Homo sapiens
acaatgacttactgtac

SEQ ID NO: 2236047 - DNA, 22 bp, Homo sapiens
acaatgacttactgtacatgaa

SEQ ID NO: 2236048 - DNA, 19 bp, Homo sapiens
acaatgcaaaccatcattg

SEQ ID NO: 2236049 - DNA, 21 bp, Homo sapiens
acaatgcaaaccatcattgaa

SEQ ID NO: 2236050 - DNA, 23 bp, Homo sapiens
acaatgctgtgccctaaagtgta

SEQ ID NO: 2236051 - DNA, 24 bp, Homo sapiens
acaatgctgtgccctaaagtgtat

SEQ ID NO: 2236052 - DNA, 21 bp, Homo sapiens
acaatggttttcttgtgtgtt

SEQ ID NO: 2236053 - DNA, 13 bp, Homo sapiens
acacaaaaaaaga

SEQ ID NO: 2236054 - DNA, 19 bp, Homo sapiens
acacaaaagtttctctttt

SEQ ID NO: 2236055 - DNA, 12 bp, Homo sapiens
acacacagctct

SEQ ID NO: 2236056 - DNA, 13 bp, Homo sapiens
acacacagctctg

SEQ ID NO: 2236057 - DNA, 14 bp, Homo sapiens
acacacagctctgt

SEQ ID NO: 2236058 - DNA, 19 bp, Homo sapiens
acacacagctctgtcctgg

SEQ ID NO: 2236059 - DNA, 14 bp, Homo sapiens
acacaccagagccc

SEQ ID NO: 2236060 - DNA, 15 bp, Homo sapiens
acacaccagagccca

SEQ ID NO: 2236061 - DNA, 21 bp, Homo sapiens
acacacgcgtgcacacaccag

SEQ ID NO: 2236062 - DNA, 12 bp, Homo sapiens
acacagctctgt

SEQ ID NO: 2236063 - DNA, 14 bp, Homo sapiens
acacagctcttctc

SEQ ID NO: 2236064 - DNA, 18 bp, Homo sapiens
acacagctcttctccagg

SEQ ID NO: 2236065 - DNA, 22 bp, Homo sapiens
acacagctcttctccaggctgt

SEQ ID NO: 2236066 - DNA, 23 bp, Homo sapiens
acacaggcccggctccaggctcc

SEQ ID NO: 2236067 - DNA, 11 bp, Homo sapiens
acacagtgagt

SEQ ID NO: 2236068 - DNA, 13 bp, Homo sapiens
acacagtgagtcg

SEQ ID NO: 2236069 - DNA, 13 bp, Homo sapiens
acacatgtccaag

SEQ ID NO: 2236070 - DNA, 18 bp, Homo sapiens
acacatgtccaagaagcc

SEQ ID NO: 2236071 - DNA, 22 bp, Homo sapiens
acacatgtccaagaagcccagg

SEQ ID NO: 2236072 - DNA, 13 bp, Homo sapiens
acacattttattt

SEQ ID NO: 2236073 - DNA, 19 bp, Homo sapiens
acacattttattttattat

SEQ ID NO: 2236074 - DNA, 21 bp, Homo sapiens
acacattttattttattatgc

SEQ ID NO: 2236075 - DNA, 12 bp, Homo sapiens
acacatttttct

SEQ ID NO: 2236076 - DNA, 13 bp, Homo sapiens
acaccagagccca

SEQ ID NO: 2236077 - DNA, 18 bp, Homo sapiens
acaccagagcccaccttg

SEQ ID NO: 2236078 - DNA, 13 bp, Homo sapiens
acacccagcccac

SEQ ID NO: 2236079 - DNA, 19 bp, Homo sapiens
acacccagcccacttctgc

SEQ ID NO: 2236080 - DNA, 20 bp, Homo sapiens
acacccagcccacttctgcc

SEQ ID NO: 2236081 - DNA, 12 bp, Homo sapiens
acaccctgtgat

SEQ ID NO: 2236082 - DNA, 19 bp, Homo sapiens
acaccctgtgatggggccc

SEQ ID NO: 2236083 - DNA, 18 bp, Homo sapiens
acacctctgcacaagctg

SEQ ID NO: 2236084 - DNA, 12 bp, Homo sapiens
acacgaatattg

SEQ ID NO: 2236085 - DNA, 15 bp, Homo sapiens
acacgaatattgctg

SEQ ID NO: 2236086 - DNA, 15 bp, Homo sapiens
acacggacactcaaa

SEQ ID NO: 2236087 - DNA, 15 bp, Homo sapiens
acactaaccacgctg

SEQ ID NO: 2236088 - DNA, 19 bp, Homo sapiens
acactcattgacctgaggc

SEQ ID NO: 2236089 - DNA, 21 bp, Homo sapiens
acactcattgacctgaggccc

SEQ ID NO: 2236090 - DNA, 11 bp, Homo sapiens
acactctgaga

SEQ ID NO: 2236091 - DNA, 14 bp, Homo sapiens
acactgttctctgc

SEQ ID NO: 2236092 - DNA, 16 bp, Homo sapiens
acactgttctctgccc

SEQ ID NO: 2236093 - DNA, 18 bp, Homo sapiens
acactgttctctgccctc

SEQ ID NO: 2236094 - DNA, 16 bp, Homo sapiens
acacttacactttatg

SEQ ID NO: 2236095 - DNA, 14 bp, Homo sapiens
acagaaatgtacag

SEQ ID NO: 2236096 - DNA, 14 bp, Homo sapiens
acagacaaagcgtg

SEQ ID NO: 2236097 - DNA, 15 bp, Homo sapiens
acagacacaggcccg

SEQ ID NO: 2236098 - DNA, 22 bp, Homo sapiens
acagacacaggcccggctccag

SEQ ID NO: 2236099 - DNA, 23 bp, Homo sapiens
acagacacaggcccggctccagg

SEQ ID NO: 2236100 - DNA, 19 bp, Homo sapiens
acagactggaagcacagct

SEQ ID NO: 2236101 - DNA, 11 bp, Homo sapiens
acagagaaagt

SEQ ID NO: 2236102 - DNA, 15 bp, Homo sapiens
acagagcccacgccc

SEQ ID NO: 2236103 - DNA, 20 bp, Homo sapiens
acagagcccacgcccccact

SEQ ID NO: 2236104 - DNA, 19 bp, Homo sapiens
acagaggcagccccattct

SEQ ID NO: 2236105 - DNA, 17 bp, Homo sapiens
acagagggggtggcctc

SEQ ID NO: 2236106 - DNA, 19 bp, Homo sapiens
acagagggggtggcctccc

SEQ ID NO: 2236107 - DNA, 17 bp, Homo sapiens
acagagtctcactgttg

SEQ ID NO: 2236108 - DNA, 23 bp, Homo sapiens
acagagtctcactgttgcccagg

SEQ ID NO: 2236109 - DNA, 17 bp, Homo sapiens
acagagttgttacattt

SEQ ID NO: 2236110 - DNA, 20 bp, Homo sapiens
acagagttgttacattttta

SEQ ID NO: 2236111 - DNA, 20 bp, Homo sapiens
acagagttttcactcttatt

SEQ ID NO: 2236112 - DNA, 23 bp, Homo sapiens
acagatgggtgcttggaggaagg

SEQ ID NO: 2236113 - DNA, 16 bp, Homo sapiens
acagcaaggagattta

SEQ ID NO: 2236114 - DNA, 17 bp, Homo sapiens
acagcaaggagatttac

SEQ ID NO: 2236115 - DNA, 11 bp, Homo sapiens
acagcacaggc

SEQ ID NO: 2236116 - DNA, 19 bp, Homo sapiens
acagcacaggcagccccac

SEQ ID NO: 2236117 - DNA, 17 bp, Homo sapiens
acagccacggccaggcc

SEQ ID NO: 2236118 - DNA, 15 bp, Homo sapiens
acagctaacatggaa

SEQ ID NO: 2236119 - DNA, 17 bp, Homo sapiens
acagctaatgggacact

SEQ ID NO: 2236120 - DNA, 19 bp, Homo sapiens
acagctaatgggacactaa

SEQ ID NO: 2236121 - DNA, 13 bp, Homo sapiens
acagctctgtcct

SEQ ID NO: 2236122 - DNA, 19 bp, Homo sapiens
acagcttcatttcctgtgt

SEQ ID NO: 2236123 - DNA, 21 bp, Homo sapiens
acagcttcatttcctgtgtct

SEQ ID NO: 2236124 - DNA, 21 bp, Homo sapiens
acagcttgaccgtgaggccag

SEQ ID NO: 2236125 - DNA, 17 bp, Homo sapiens
acaggaaaagctgctga

SEQ ID NO: 2236126 - DNA, 18 bp, Homo sapiens
acaggaaaagctgctgac

SEQ ID NO: 2236127 - DNA, 19 bp, Homo sapiens
acaggaaaagctgctgaca

SEQ ID NO: 2236128 - DNA, 21 bp, Homo sapiens
acaggaaaagctgctgacagt

SEQ ID NO: 2236129 - DNA, 23 bp, Homo sapiens
acaggaccagggatttccatgat

SEQ ID NO: 2236130 - DNA, 15 bp, Homo sapiens
acaggcaagcacctc

SEQ ID NO: 2236131 - DNA, 18 bp, Homo sapiens
acaggcaagcacctcctg

SEQ ID NO: 2236132 - DNA, 19 bp, Homo sapiens
acaggcaagcacctcctgc

SEQ ID NO: 2236133 - DNA, 14 bp, Homo sapiens
acaggcaatgctgg

SEQ ID NO: 2236134 - DNA, 18 bp, Homo sapiens
acaggcaatgctggctgt

SEQ ID NO: 2236135 - DNA, 18 bp, Homo sapiens
acaggcatgttctctgag

SEQ ID NO: 2236136 - DNA, 22 bp, Homo sapiens
acaggcatgttctctgaggaca

SEQ ID NO: 2236137 - DNA, 21 bp, Homo sapiens
acaggctgggcttcagtggca

SEQ ID NO: 2236138 - DNA, 22 bp, Homo sapiens
acagggcacaccgggcactcag

SEQ ID NO: 2236139 - DNA, 23 bp, Homo sapiens
acaggtgtgagtcaccaagccca

SEQ ID NO: 2236140 - DNA, 14 bp, Homo sapiens
acaggtttaaaaat

SEQ ID NO: 2236141 - DNA, 15 bp, Homo sapiens
acagtattacttctg

SEQ ID NO: 2236142 - DNA, 12 bp, Homo sapiens
acagtccctgcc

SEQ ID NO: 2236143 - DNA, 15 bp, Homo sapiens
acagtcctcccatct

SEQ ID NO: 2236144 - DNA, 21 bp, Homo sapiens
acagtccttaccagcagagca

SEQ ID NO: 2236145 - DNA, 15 bp, Homo sapiens
acagttaagagaaat

SEQ ID NO: 2236146 - DNA, 23 bp, Homo sapiens
acataaacaagaccacgtttcta

SEQ ID NO: 2236147 - DNA, 23 bp, Homo sapiens
acataatgcgtgcataccacttt

SEQ ID NO: 2236148 - DNA, 17 bp, Homo sapiens
acatactcccatctgtg

SEQ ID NO: 2236149 - DNA, 18 bp, Homo sapiens
acatattgatttccgtta

SEQ ID NO: 2236150 - DNA, 18 bp, Homo sapiens
acatcaacatcttggtca

SEQ ID NO: 2236151 - DNA, 20 bp, Homo sapiens
acatcagcacgatttctgtt

SEQ ID NO: 2236152 - DNA, 21 bp, Homo sapiens
actttcctctttggtctacac

SEQ ID NO: 2236153 - DNA, 16 bp, Homo sapiens
actttctagccagagg

SEQ ID NO: 2236154 - DNA, 17 bp, Homo sapiens
actttctagccagagga

SEQ ID NO: 2236155 - DNA, 14 bp, Homo sapiens
actttgacctctgc

SEQ ID NO: 2236156 - DNA, 18 bp, Homo sapiens
actttgacctctgcagca

SEQ ID NO: 2236157 - DNA, 12 bp, Homo sapiens
actttggaaaga

SEQ ID NO: 2236158 - DNA, 23 bp, Homo sapiens
actttggaaagagtaggaagact

SEQ ID NO: 2236159 - DNA, 20 bp, Homo sapiens
actttgttagtttctccaag

SEQ ID NO: 2236160 - DNA, 14 bp, Homo sapiens
actttgttctggct

SEQ ID NO: 2236161 - DNA, 19 bp, Homo sapiens
actttgttctggctcttcc

SEQ ID NO: 2236162 - DNA, 15 bp, Homo sapiens
acttttataaacttt

SEQ ID NO: 2236163 - DNA, 22 bp, Homo sapiens
acttttataaactttacctttt

SEQ ID NO: 2236164 - DNA, 14 bp, Homo sapiens
acttttctttgtgg

SEQ ID NO: 2236165 - DNA, 12 bp, Homo sapiens
acttttgttctt

SEQ ID NO: 2236166 - DNA, 13 bp, Homo sapiens
agaaaaagaaaaa

SEQ ID NO: 2236167 - DNA, 22 bp, Homo sapiens
agaaagactatctaaatgttga

SEQ ID NO: 2236168 - DNA, 15 bp, Homo sapiens
agaaataaagtttct

SEQ ID NO: 2236169 - DNA, 18 bp, Homo sapiens
agaaataaagtttctgtt

SEQ ID NO: 2236170 - DNA, 20 bp, Homo sapiens
agaaatatctgaaaatgtat

SEQ ID NO: 2236171 - DNA, 17 bp, Homo sapiens
agaaatgtacagcaagg

SEQ ID NO: 2236172 - DNA, 11 bp, Homo sapiens
agaaatgtgtt

SEQ ID NO: 2236173 - DNA, 17 bp, Homo sapiens
agaaccaaaaagaggct

SEQ ID NO: 2236174 - DNA, 21 bp, Homo sapiens
agaaccaaaaagaggctatgt

SEQ ID NO: 2236175 - DNA, 23 bp, Homo sapiens
agaaccccagggtcctgtagccc

SEQ ID NO: 2236176 - DNA, 15 bp, Homo sapiens
agaagagaatgcaca

SEQ ID NO: 2236177 - DNA, 12 bp, Homo sapiens
agaagcccagga

SEQ ID NO: 2236178 - DNA, 17 bp, Homo sapiens
agaaggggcccaagaga

SEQ ID NO: 2236179 - DNA, 19 bp, Homo sapiens
agaaggggcccaagagaga

SEQ ID NO: 2236180 - DNA, 17 bp, Homo sapiens
agaagtcttagatgtat

SEQ ID NO: 2236181 - DNA, 21 bp, Homo sapiens
agaagtttctgccgcagccct

SEQ ID NO: 2236182 - DNA, 23 bp, Homo sapiens
agaatgcagagatgtgcccccac

SEQ ID NO: 2236183 - DNA, 20 bp, Homo sapiens
agaattctcagaatctcaaa

SEQ ID NO: 2236184 - DNA, 13 bp, Homo sapiens
agacaatgactta

SEQ ID NO: 2236185 - DNA, 21 bp, Homo sapiens
agacaatgacttactgtacat

SEQ ID NO: 2236186 - DNA, 23 bp, Homo sapiens
agacaatgacttactgtacatga

SEQ ID NO: 2236187 - DNA, 15 bp, Homo sapiens
agacaatttattatg

SEQ ID NO: 2236188 - DNA, 21 bp, Homo sapiens
agacaatttattatggcacat

SEQ ID NO: 2236189 - DNA, 16 bp, Homo sapiens
agacacaggcccggct

SEQ ID NO: 2236190 - DNA, 20 bp, Homo sapiens
agacacaggcccggctccag

SEQ ID NO: 2236191 - DNA, 19 bp, Homo sapiens
agacaccttgacagggcac

SEQ ID NO: 2236192 - DNA, 22 bp, Homo sapiens
agacaccttgacagggcacacc

SEQ ID NO: 2236193 - DNA, 13 bp, Homo sapiens
agacagagctaca

SEQ ID NO: 2236194 - DNA, 15 bp, Homo sapiens
agacagagctacaca

SEQ ID NO: 2236195 - DNA, 21 bp, Homo sapiens
agacagcacaggcagccccac

SEQ ID NO: 2236196 - DNA, 14 bp, Homo sapiens
agacagcccgggct

SEQ ID NO: 2236197 - DNA, 15 bp, Homo sapiens
agacagcccgggctc

SEQ ID NO: 2236198 - DNA, 17 bp, Homo sapiens
agacagcccgggctctg

SEQ ID NO: 2236199 - DNA, 21 bp, Homo sapiens
agacagcccgggctctgcctc

SEQ ID NO: 2236200 - DNA, 22 bp, Homo sapiens
agacagcccgggctctgcctcc

SEQ ID NO: 2236201 - DNA, 12 bp, Homo sapiens
agacagctgcct

SEQ ID NO: 2236202 - DNA, 23 bp, Homo sapiens
agacaggcaagcacctcctgcct

SEQ ID NO: 2236203 - DNA, 13 bp, Homo sapiens
agacagtccctgc

SEQ ID NO: 2236204 - DNA, 15 bp, Homo sapiens
agacagtccctgcca

SEQ ID NO: 2236205 - DNA, 16 bp, Homo sapiens
agacagtccctgccaa

SEQ ID NO: 2236206 - DNA, 14 bp, Homo sapiens
agaccatccctgaa

SEQ ID NO: 2236207 - DNA, 23 bp, Homo sapiens
agaccatccctgaaggccccgcc

SEQ ID NO: 2236208 - DNA, 14 bp, Homo sapiens
agacccggctgcgt

SEQ ID NO: 2236209 - DNA, 19 bp, Homo sapiens
agaccctgccctgtgggcc

SEQ ID NO: 2236210 - DNA, 23 bp, Homo sapiens
agaccctgccctgtgggccccca

SEQ ID NO: 2236211 - DNA, 13 bp, Homo sapiens
agacccttgtggt

SEQ ID NO: 2236212 - DNA, 11 bp, Homo sapiens
agaccttctcc

SEQ ID NO: 2236213 - DNA, 19 bp, Homo sapiens
agacggagtcccaccttgg

SEQ ID NO: 2236214 - DNA, 15 bp, Homo sapiens
agactatctaaatgt

SEQ ID NO: 2236215 - DNA, 17 bp, Homo sapiens
agactcattcttctgta

SEQ ID NO: 2236216 - DNA, 18 bp, Homo sapiens
agactcattcttctgtac

SEQ ID NO: 2236217 - DNA, 13 bp, Homo sapiens
agactcctgcagg

SEQ ID NO: 2236218 - DNA, 16 bp, Homo sapiens
agactcctgcaggcag

SEQ ID NO: 2236219 - DNA, 18 bp, Homo sapiens
agactcctgcaggcagcc

SEQ ID NO: 2236220 - DNA, 21 bp, Homo sapiens
agactcgcgacaatgcaaacc

SEQ ID NO: 2236221 - DNA, 17 bp, Homo sapiens
agactctacagaggcca

SEQ ID NO: 2236222 - DNA, 19 bp, Homo sapiens
agactctacagaggccatg

SEQ ID NO: 2236223 - DNA, 20 bp, Homo sapiens
agactgagtacgttgtgcat

SEQ ID NO: 2236224 - DNA, 19 bp, Homo sapiens
agactggaagcacagcttc

SEQ ID NO: 2236225 - DNA, 20 bp, Homo sapiens
agactggttccatggcctct

SEQ ID NO: 2236226 - DNA, 12 bp, Homo sapiens
agactttggaaa

SEQ ID NO: 2236227 - DNA, 14 bp, Homo sapiens
agactttggaaaga

SEQ ID NO: 2236228 - DNA, 15 bp, Homo sapiens
agactttggaaagac

SEQ ID NO: 2236229 - DNA, 18 bp, Homo sapiens
agagaaagtacttctcca

SEQ ID NO: 2236230 - DNA, 19 bp, Homo sapiens
agagaaggggcccaagaga

SEQ ID NO: 2236231 - DNA, 23 bp, Homo sapiens
agagaaggggcccaagagagaca

SEQ ID NO: 2236232 - DNA, 14 bp, Homo sapiens
agagacagcacagg

SEQ ID NO: 2236233 - DNA, 15 bp, Homo sapiens
agagaccatccctga

SEQ ID NO: 2236234 - DNA, 18 bp, Homo sapiens
agagaccatccctgaagg

SEQ ID NO: 2236235 - DNA, 19 bp, Homo sapiens
agagaccatccctgaaggc

SEQ ID NO: 2236236 - DNA, 13 bp, Homo sapiens
agagactcctgca

SEQ ID NO: 2236237 - DNA, 14 bp, Homo sapiens
agagactcctgcag

SEQ ID NO: 2236238 - DNA, 15 bp, Homo sapiens
agagactcctgcagg

SEQ ID NO: 2236239 - DNA, 18 bp, Homo sapiens
agagactcctgcaggcag

SEQ ID NO: 2236240 - DNA, 19 bp, Homo sapiens
agagactcctgcaggcagc

SEQ ID NO: 2236241 - DNA, 23 bp, Homo sapiens
agagactcctgcaggcagccagg

SEQ ID NO: 2236242 - DNA, 23 bp, Homo sapiens
agagagaaggggcccaagagaga

SEQ ID NO: 2236243 - DNA, 12 bp, Homo sapiens
agagagagagag

SEQ ID NO: 2236244 - DNA, 14 bp, Homo sapiens
agagagagagagag

SEQ ID NO: 2236245 - DNA, 23 bp, Homo sapiens
agagagcaagacgctgtgctgcc

SEQ ID NO: 2236246 - DNA, 22 bp, Homo sapiens
agagagggtggtgacctctgcc

SEQ ID NO: 2236247 - DNA, 22 bp, Homo sapiens
agagatcaaccccttcgctcct

SEQ ID NO: 2236248 - DNA, 16 bp, Homo sapiens
agagattgtggtttca

SEQ ID NO: 2236249 - DNA, 17 bp, Homo sapiens
agagcagagaccatccc

SEQ ID NO: 2236250 - DNA, 19 bp, Homo sapiens
agagcccaccttggctcaa

SEQ ID NO: 2236251 - DNA, 17 bp, Homo sapiens
agagcccacgcccccac

SEQ ID NO: 2236252 - DNA, 20 bp, Homo sapiens
agagctagcagcagggaggg

SEQ ID NO: 2236253 - DNA, 21 bp, Homo sapiens
agaggaaatcaccgaaaacgt

SEQ ID NO: 2236254 - DNA, 21 bp, Homo sapiens
agaggacttttctttgtggct

SEQ ID NO: 2236255 - DNA, 18 bp, Homo sapiens
agaggcaactgcattggc

SEQ ID NO: 2236256 - DNA, 13 bp, Homo sapiens
agaggcagcccca

SEQ ID NO: 2236257 - DNA, 21 bp, Homo sapiens
agaggcagccccattctgcct

SEQ ID NO: 2236258 - DNA, 24 bp, Homo sapiens
agaggcagccccattctgcctgcc

SEQ ID NO: 2236259 - DNA, 13 bp, Homo sapiens
agaggcagggtct

SEQ ID NO: 2236260 - DNA, 21 bp, Homo sapiens
agaggcagggtctcactctgt

SEQ ID NO: 2236261 - DNA, 20 bp, Homo sapiens
agagggagtgacagaggcag

SEQ ID NO: 2236262 - DNA, 13 bp, Homo sapiens
agagggcctgcaa

SEQ ID NO: 2236263 - DNA, 16 bp, Homo sapiens
agagggcctgcaaggg

SEQ ID NO: 2236264 - DNA, 17 bp, Homo sapiens
agagggggtggcctccc

SEQ ID NO: 2236265 - DNA, 23 bp, Homo sapiens
agagggggtggcctcccaactca

SEQ ID NO: 2236266 - DNA, 19 bp, Homo sapiens
agagggtggtgacctctgc

SEQ ID NO: 2236267 - DNA, 13 bp, Homo sapiens
agaggttcaaaga

SEQ ID NO: 2236268 - DNA, 22 bp, Homo sapiens
agagtctcactgttgcccaggc

SEQ ID NO: 2236269 - DNA, 15 bp, Homo sapiens
agagtgagactctgt

SEQ ID NO: 2236270 - DNA, 19 bp, Homo sapiens
agagtgagactctgtctca

SEQ ID NO: 2236271 - DNA, 11 bp, Homo sapiens
agagtgggagc

SEQ ID NO: 2236272 - DNA, 19 bp, Homo sapiens
agagtggggatatgattta

SEQ ID NO: 2236273 - DNA, 14 bp, Homo sapiens
agagtgtgcctgaa

SEQ ID NO: 2236274 - DNA, 18 bp, Homo sapiens
agataatacaccactaca

SEQ ID NO: 2236275 - DNA, 16 bp, Homo sapiens
aggcccagagggcctg

SEQ ID NO: 2236276 - DNA, 21 bp, Homo sapiens
aggcccagagggcctgcaagg

SEQ ID NO: 2236277 - DNA, 13 bp, Homo sapiens
aggcccctgccac

SEQ ID NO: 2236278 - DNA, 21 bp, Homo sapiens
aggcccctgccaccctgggga

SEQ ID NO: 2236279 - DNA, 13 bp, Homo sapiens
aggcccggctcca

SEQ ID NO: 2236280 - DNA, 14 bp, Homo sapiens
aggcccggctccag

SEQ ID NO: 2236281 - DNA, 17 bp, Homo sapiens
aggcccggctccaggct

SEQ ID NO: 2236282 - DNA, 21 bp, Homo sapiens
aggcccggctccaggctcctt

SEQ ID NO: 2236283 - DNA, 15 bp, Homo sapiens
aggccctctgcccac

SEQ ID NO: 2236284 - DNA, 22 bp, Homo sapiens
aggccctctgcccactccctgc

SEQ ID NO: 2236285 - DNA, 12 bp, Homo sapiens
aggcccttctct

SEQ ID NO: 2236286 - DNA, 15 bp, Homo sapiens
aggcctggccagatg

SEQ ID NO: 2236287 - DNA, 16 bp, Homo sapiens
aggcctggccagatgc

SEQ ID NO: 2236288 - DNA, 22 bp, Homo sapiens
aggcctggccagatgcaccagc

SEQ ID NO: 2236289 - DNA, 18 bp, Homo sapiens
aggccttctctgaaggac

SEQ ID NO: 2236290 - DNA, 18 bp, Homo sapiens
aggctcgagcatgcctgg

SEQ ID NO: 2236291 - DNA, 19 bp, Homo sapiens
aggctcgagcatgcctgga

SEQ ID NO: 2236292 - DNA, 21 bp, Homo sapiens
aggctcgagcatgcctggatg

SEQ ID NO: 2236293 - DNA, 16 bp, Homo sapiens
aggctctcaggccagc

SEQ ID NO: 2236294 - DNA, 18 bp, Homo sapiens
aggctctcaggccagctg

SEQ ID NO: 2236295 - DNA, 19 bp, Homo sapiens
aggctgcagtgagccgaga

SEQ ID NO: 2236296 - DNA, 18 bp, Homo sapiens
aggctgcctctcccatca

SEQ ID NO: 2236297 - DNA, 14 bp, Homo sapiens
aggctgggagagcc

SEQ ID NO: 2236298 - DNA, 16 bp, Homo sapiens
aggctgggagagcctt

SEQ ID NO: 2236299 - DNA, 20 bp, Homo sapiens
aggctgggagagccttccag

SEQ ID NO: 2236300 - DNA, 23 bp, Homo sapiens
aggctgggctcccttcccacctc

SEQ ID NO: 2236301 - DNA, 23 bp, Homo sapiens
aggctgggcttcagtggcagctg

SEQ ID NO: 2236302 - DNA, 17 bp, Homo sapiens
aggctgggttctgatcc

SEQ ID NO: 2236303 - DNA, 20 bp, Homo sapiens
aggctgtatcccatgagcct

SEQ ID NO: 2236304 - DNA, 24 bp, Homo sapiens
aggctgtatcccatgagcctcagc

SEQ ID NO: 2236305 - DNA, 12 bp, Homo sapiens
aggctgtcaatt

SEQ ID NO: 2236306 - DNA, 19 bp, Homo sapiens
aggctgtcaattacaggaa

SEQ ID NO: 2236307 - DNA, 21 bp, Homo sapiens
aggctgtcaattacaggaagt

SEQ ID NO: 2236308 - DNA, 22 bp, Homo sapiens
aggcttagtcactgagacagcc

SEQ ID NO: 2236309 - DNA, 17 bp, Homo sapiens
agggaattgggggggtg

SEQ ID NO: 2236310 - DNA, 20 bp, Homo sapiens
agggacagagggggtggcct

SEQ ID NO: 2236311 - DNA, 23 bp, Homo sapiens
agggacagagggggtggcctccc

SEQ ID NO: 2236312 - DNA, 15 bp, Homo sapiens
agggaccctccacca

SEQ ID NO: 2236313 - DNA, 17 bp, Homo sapiens
agggacgctacccggga

SEQ ID NO: 2236314 - DNA, 15 bp, Homo sapiens
agggagggagggctc

SEQ ID NO: 2236315 - DNA, 12 bp, Homo sapiens
agggagggctcc

SEQ ID NO: 2236316 - DNA, 16 bp, Homo sapiens
agggagggctccagac

SEQ ID NO: 2236317 - DNA, 19 bp, Homo sapiens
agggagggctccagacaca

SEQ ID NO: 2236318 - DNA, 22 bp, Homo sapiens
agggagggctccagacacatgt

SEQ ID NO: 2236319 - DNA, 15 bp, Homo sapiens
agggagggcttctgc

SEQ ID NO: 2236320 - DNA, 17 bp, Homo sapiens
agggagtgacagaggca

SEQ ID NO: 2236321 - DNA, 18 bp, Homo sapiens
agggagtgacagaggcag

SEQ ID NO: 2236322 - DNA, 12 bp, Homo sapiens
agggcccagaga

SEQ ID NO: 2236323 - DNA, 13 bp, Homo sapiens
agggccccacgtc

SEQ ID NO: 2236324 - DNA, 14 bp, Homo sapiens
agggccccacgtcc

SEQ ID NO: 2236325 - DNA, 14 bp, Homo sapiens
agggcctgcaaggg

SEQ ID NO: 2236326 - DNA, 14 bp, Homo sapiens
agggcctggcctga

SEQ ID NO: 2236327 - DNA, 19 bp, Homo sapiens
agggctcagcggggacagc

SEQ ID NO: 2236328 - DNA, 20 bp, Homo sapiens
agggctcagcggggacagct

SEQ ID NO: 2236329 - DNA, 22 bp, Homo sapiens
agggctcagcggggacagctcc

SEQ ID NO: 2236330 - DNA, 12 bp, Homo sapiens
aggggaagaaaa

SEQ ID NO: 2236331 - DNA, 13 bp, Homo sapiens
aggggaagaaaaa

SEQ ID NO: 2236332 - DNA, 14 bp, Homo sapiens
aggggaagaaaaac

SEQ ID NO: 2236333 - DNA, 13 bp, Homo sapiens
aggggaatgtttg

SEQ ID NO: 2236334 - DNA, 19 bp, Homo sapiens
aggggaatgtttgcctctg

SEQ ID NO: 2236335 - DNA, 13 bp, Homo sapiens
agggggctgggac

SEQ ID NO: 2236336 - DNA, 16 bp, Homo sapiens
aggggggtgggagggg

SEQ ID NO: 2236337 - DNA, 15 bp, Homo sapiens
agggggtggcctccc

SEQ ID NO: 2236338 - DNA, 20 bp, Homo sapiens
agggggtggcctcccaactc

SEQ ID NO: 2236339 - DNA, 15 bp, Homo sapiens
agggtaaggctgtgg

SEQ ID NO: 2236340 - DNA, 11 bp, Homo sapiens
agggtccctgg

SEQ ID NO: 2236341 - DNA, 16 bp, Homo sapiens
agggtctgcagggaat

SEQ ID NO: 2236342 - DNA, 17 bp, Homo sapiens
agggtctgcagggaatt

SEQ ID NO: 2236343 - DNA, 15 bp, Homo sapiens
agggtgggagtgggc

SEQ ID NO: 2236344 - DNA, 13 bp, Homo sapiens
agggttggcccct

SEQ ID NO: 2236345 - DNA, 14 bp, Homo sapiens
aggtaacaggcaga

SEQ ID NO: 2236346 - DNA, 16 bp, Homo sapiens
aggtaacaggcagata

SEQ ID NO: 2236347 - DNA, 22 bp, Homo sapiens
aggtacgaaaagaggggaagag

SEQ ID NO: 2236348 - DNA, 23 bp, Homo sapiens
aggtctgttctttccaaagtaca

SEQ ID NO: 2236349 - DNA, 16 bp, Homo sapiens
aggtcttgaactcctg

SEQ ID NO: 2236350 - DNA, 21 bp, Homo sapiens
aggtcttgaactcctggcctc

SEQ ID NO: 2236351 - DNA, 22 bp, Homo sapiens
aggtgacagagtgagactctgt

SEQ ID NO: 2236352 - DNA, 13 bp, Homo sapiens
aggtgaccccagg

SEQ ID NO: 2236353 - DNA, 21 bp, Homo sapiens
aggtgatccacccacctcagc

SEQ ID NO: 2236354 - DNA, 23 bp, Homo sapiens
aggtgatccacccacctcagcct

SEQ ID NO: 2236355 - DNA, 16 bp, Homo sapiens
aggtgcacaagctcca

SEQ ID NO: 2236356 - DNA, 20 bp, Homo sapiens
aggtgcacaagctccaagct

SEQ ID NO: 2236357 - DNA, 17 bp, Homo sapiens
aggtgctgccatccagg

SEQ ID NO: 2236358 - DNA, 16 bp, Homo sapiens
aggtggggcagcttga

SEQ ID NO: 2236359 - DNA, 23 bp, Homo sapiens
aggtggggtcactctggcagctc

SEQ ID NO: 2236360 - DNA, 17 bp, Homo sapiens
aggtggttatggagagg

SEQ ID NO: 2236361 - DNA, 20 bp, Homo sapiens
aggtgtccctgcacttgcag

SEQ ID NO: 2236362 - DNA, 22 bp, Homo sapiens
aggtgtgaaccaccacacccag

SEQ ID NO: 2236363 - DNA, 18 bp, Homo sapiens
aggtgtgactgaatttct

SEQ ID NO: 2236364 - DNA, 14 bp, Homo sapiens
aggtgtgagtcacc

SEQ ID NO: 2236365 - DNA, 13 bp, Homo sapiens
aggttcagcttgt

SEQ ID NO: 2236366 - DNA, 20 bp, Homo sapiens
aggttggcaaaaaggcagga

SEQ ID NO: 2236367 - DNA, 14 bp, Homo sapiens
aggtttaagctgtt

SEQ ID NO: 2236368 - DNA, 18 bp, Homo sapiens
agtaaatgggggtgcatt

SEQ ID NO: 2236369 - DNA, 20 bp, Homo sapiens
agtaaatgggggtgcatttg

SEQ ID NO: 2236370 - DNA, 17 bp, Homo sapiens
agtaacttacttaggtg

SEQ ID NO: 2236371 - DNA, 20 bp, Homo sapiens
agtaagccgtgattttcatt

SEQ ID NO: 2236372 - DNA, 14 bp, Homo sapiens
agtaatatgcacac

SEQ ID NO: 2236373 - DNA, 14 bp, Homo sapiens
agtacgttgtgcat

SEQ ID NO: 2236374 - DNA, 15 bp, Homo sapiens
agtacgttgtgcatt

SEQ ID NO: 2236375 - DNA, 16 bp, Homo sapiens
agtacgttgtgcattt

SEQ ID NO: 2236376 - DNA, 18 bp, Homo sapiens
agtacgttgtgcatttgg

SEQ ID NO: 2236377 - DNA, 14 bp, Homo sapiens
agtactataattta

SEQ ID NO: 2236378 - DNA, 15 bp, Homo sapiens
agtactggagaaaat

SEQ ID NO: 2236379 - DNA, 19 bp, Homo sapiens
agtacttctccaccctgct

SEQ ID NO: 2236380 - DNA, 22 bp, Homo sapiens
agtacttctccaccctgctctc

SEQ ID NO: 2236381 - DNA, 12 bp, Homo sapiens
agtagagacagg

SEQ ID NO: 2236382 - DNA, 18 bp, Homo sapiens
agtaggaagactttggaa

SEQ ID NO: 2236383 - DNA, 19 bp, Homo sapiens
agtaggaagactttggaaa

SEQ ID NO: 2236384 - DNA, 15 bp, Homo sapiens
agtatctcagggcct

SEQ ID NO: 2236385 - DNA, 16 bp, Homo sapiens
agtatgaggcatttgt

SEQ ID NO: 2236386 - DNA, 17 bp, Homo sapiens
agtatgaggcatttgtt

SEQ ID NO: 2236387 - DNA, 23 bp, Homo sapiens
agtatgaggcatttgtttgaact

SEQ ID NO: 2236388 - DNA, 15 bp, Homo sapiens
agtatggtggctggg

SEQ ID NO: 2236389 - DNA, 15 bp, Homo sapiens
agtattacttctgct

SEQ ID NO: 2236390 - DNA, 22 bp, Homo sapiens
agtcacacagtattacttctgc

SEQ ID NO: 2236391 - DNA, 22 bp, Homo sapiens
agtcagaagtttctgccgcagc

SEQ ID NO: 2236392 - DNA, 21 bp, Homo sapiens
agtcccaccttggctgcaggg

SEQ ID NO: 2236393 - DNA, 19 bp, Homo sapiens
agtcccctgtttgtttctg

SEQ ID NO: 2236394 - DNA, 16 bp, Homo sapiens
agtcctcccatctcac

SEQ ID NO: 2236395 - DNA, 19 bp, Homo sapiens
agtcctcttttctgagagg

SEQ ID NO: 2236396 - DNA, 16 bp, Homo sapiens
agtccttaccagcaga

SEQ ID NO: 2236397 - DNA, 18 bp, Homo sapiens
agtccttaccagcagagc

SEQ ID NO: 2236398 - DNA, 16 bp, Homo sapiens
agtcgaggacagggag

SEQ ID NO: 2236399 - DNA, 19 bp, Homo sapiens
caaagtgctgggattacag

SEQ ID NO: 2236400 - DNA, 16 bp, Homo sapiens
caaagtggtgagaggc

SEQ ID NO: 2236401 - DNA, 19 bp, Homo sapiens
caaagtggtgagaggcatc

SEQ ID NO: 2236402 - DNA, 22 bp, Homo sapiens
caaatggaaatgggcagagcag

SEQ ID NO: 2236403 - DNA, 22 bp, Homo sapiens
caaattctgcttgcttgctttt

SEQ ID NO: 2236404 - DNA, 12 bp, Homo sapiens
caaatttctaaa

SEQ ID NO: 2236405 - DNA, 22 bp, Homo sapiens
caacactcattgacctgaggcc

SEQ ID NO: 2236406 - DNA, 12 bp, Homo sapiens
caacaggctggg

SEQ ID NO: 2236407 - DNA, 17 bp, Homo sapiens
caacaggctgggcttca

SEQ ID NO: 2236408 - DNA, 23 bp, Homo sapiens
caacaggctgggcttcagtggca

SEQ ID NO: 2236409 - DNA, 22 bp, Homo sapiens
caacatcttggtcagatttgaa

SEQ ID NO: 2236410 - DNA, 16 bp, Homo sapiens
caaccccttcgctcct

SEQ ID NO: 2236411 - DNA, 15 bp, Homo sapiens
caaccctcatcacca

SEQ ID NO: 2236412 - DNA, 15 bp, Homo sapiens
caacctcctgggcta

SEQ ID NO: 2236413 - DNA, 16 bp, Homo sapiens
caacctgattgtgtct

SEQ ID NO: 2236414 - DNA, 15 bp, Homo sapiens
caactcaccccagcc

SEQ ID NO: 2236415 - DNA, 17 bp, Homo sapiens
caactcaccccagcccc

SEQ ID NO: 2236416 - DNA, 15 bp, Homo sapiens
caagaagcccaggaa

SEQ ID NO: 2236417 - DNA, 22 bp, Homo sapiens
caagaattgaagcaggactaaa

SEQ ID NO: 2236418 - DNA, 14 bp, Homo sapiens
caagaccacgtttc

SEQ ID NO: 2236419 - DNA, 16 bp, Homo sapiens
caagaccacgtttcta

SEQ ID NO: 2236420 - DNA, 18 bp, Homo sapiens
caagacccttgtggtccc

SEQ ID NO: 2236421 - DNA, 17 bp, Homo sapiens
caagaccttctccttca

SEQ ID NO: 2236422 - DNA, 21 bp, Homo sapiens
caagaccttctccttcacctt

SEQ ID NO: 2236423 - DNA, 17 bp, Homo sapiens
caagacgctgtgctgcc

SEQ ID NO: 2236424 - DNA, 19 bp, Homo sapiens
caagacgctgtgctgccct

SEQ ID NO: 2236425 - DNA, 20 bp, Homo sapiens
caagacgctgtgctgccctg

SEQ ID NO: 2236426 - DNA, 21 bp, Homo sapiens
caagacgctgtgctgccctgc

SEQ ID NO: 2236427 - DNA, 13 bp, Homo sapiens
caagagagacagc

SEQ ID NO: 2236428 - DNA, 21 bp, Homo sapiens
caagagagacagcacaggcag

SEQ ID NO: 2236429 - DNA, 17 bp, Homo sapiens
caagagcccaggcctcc

SEQ ID NO: 2236430 - DNA, 12 bp, Homo sapiens
caagagggtctg

SEQ ID NO: 2236431 - DNA, 17 bp, Homo sapiens
caagcacctcctgcctc

SEQ ID NO: 2236432 - DNA, 21 bp, Homo sapiens
caagccaccaacatactccca

SEQ ID NO: 2236433 - DNA, 19 bp, Homo sapiens
caagcgattcttctgcttc

SEQ ID NO: 2236434 - DNA, 19 bp, Homo sapiens
caagctccaagctcccagg

SEQ ID NO: 2236435 - DNA, 16 bp, Homo sapiens
caagctctgctcctct

SEQ ID NO: 2236436 - DNA, 13 bp, Homo sapiens
caaggatcctgag

SEQ ID NO: 2236437 - DNA, 16 bp, Homo sapiens
caaggatcctgagcca

SEQ ID NO: 2236438 - DNA, 17 bp, Homo sapiens
caaggatcctgagccag

SEQ ID NO: 2236439 - DNA, 18 bp, Homo sapiens
caaggatcctgagccaga

SEQ ID NO: 2236440 - DNA, 19 bp, Homo sapiens
caaggatcctgagccagat

SEQ ID NO: 2236441 - DNA, 21 bp, Homo sapiens
caaggatgatctaggaagact

SEQ ID NO: 2236442 - DNA, 15 bp, Homo sapiens
caaggattgctactg

SEQ ID NO: 2236443 - DNA, 16 bp, Homo sapiens
caaggcaaggctgtca

SEQ ID NO: 2236444 - DNA, 17 bp, Homo sapiens
caaggcaaggctgtcaa

SEQ ID NO: 2236445 - DNA, 15 bp, Homo sapiens
caaggccaaaggaag

SEQ ID NO: 2236446 - DNA, 12 bp, Homo sapiens
caaggctgcagt

SEQ ID NO: 2236447 - DNA, 17 bp, Homo sapiens
caaggctgcagtgagcc

SEQ ID NO: 2236448 - DNA, 22 bp, Homo sapiens
caaggctgcagtgagccgagat

SEQ ID NO: 2236449 - DNA, 13 bp, Homo sapiens
caaggctgtcaat

SEQ ID NO: 2236450 - DNA, 21 bp, Homo sapiens
caaggggaatgtttgcctctg

SEQ ID NO: 2236451 - DNA, 18 bp, Homo sapiens
caaggggcccaaattctt

SEQ ID NO: 2236452 - DNA, 21 bp, Homo sapiens
caagtcctcttttctgagagg

SEQ ID NO: 2236453 - DNA, 22 bp, Homo sapiens
caagtgaaaaaggaggaagaga

SEQ ID NO: 2236454 - DNA, 23 bp, Homo sapiens
caagtgaaaaaggaggaagagaa

SEQ ID NO: 2236455 - DNA, 14 bp, Homo sapiens
caagtgagaccctg

SEQ ID NO: 2236456 - DNA, 19 bp, Homo sapiens
caagtgagaccctgtctca

SEQ ID NO: 2236457 - DNA, 17 bp, Homo sapiens
caagtgattctcctgcc

SEQ ID NO: 2236458 - DNA, 22 bp, Homo sapiens
caagtgtggtagagtgtgcctg

SEQ ID NO: 2236459 - DNA, 16 bp, Homo sapiens
caataggaaaaactga

SEQ ID NO: 2236460 - DNA, 21 bp, Homo sapiens
caataggaaaaactgattttt

SEQ ID NO: 2236461 - DNA, 17 bp, Homo sapiens
caatattcgctgtgtca

SEQ ID NO: 2236462 - DNA, 14 bp, Homo sapiens
caatgacctttcaa

SEQ ID NO: 2236463 - DNA, 13 bp, Homo sapiens
caatgatggtcac

SEQ ID NO: 2236464 - DNA, 23 bp, Homo sapiens
caatgcaaaccatcattgaaatc

SEQ ID NO: 2236465 - DNA, 14 bp, Homo sapiens
caatgcactttgtt

SEQ ID NO: 2236466 - DNA, 17 bp, Homo sapiens
caatgcactttgttctg

SEQ ID NO: 2236467 - DNA, 21 bp, Homo sapiens
caatgcactttgttctggctc

SEQ ID NO: 2236468 - DNA, 22 bp, Homo sapiens
caatgcactttgttctggctct

SEQ ID NO: 2236469 - DNA, 11 bp, Homo sapiens
caatggcagcc

SEQ ID NO: 2236470 - DNA, 12 bp, Homo sapiens
caatggcagcct

SEQ ID NO: 2236471 - DNA, 19 bp, Homo sapiens
caatgtgaaaagaaaaatg

SEQ ID NO: 2236472 - DNA, 22 bp, Homo sapiens
caatgtgaaaagaaaaatgagc

SEQ ID NO: 2236473 - DNA, 13 bp, Homo sapiens
caatttattatgg

SEQ ID NO: 2236474 - DNA, 12 bp, Homo sapiens
cacaaaaaaaga

SEQ ID NO: 2236475 - DNA, 13 bp, Homo sapiens
cacaaaaaaagac

SEQ ID NO: 2236476 - DNA, 18 bp, Homo sapiens
cacaaaagtttctctttt

SEQ ID NO: 2236477 - DNA, 17 bp, Homo sapiens
cacaaacgggctcagca

SEQ ID NO: 2236478 - DNA, 14 bp, Homo sapiens
cacaagagcccagg

SEQ ID NO: 2236479 - DNA, 13 bp, Homo sapiens
cacaagctccaag

SEQ ID NO: 2236480 - DNA, 17 bp, Homo sapiens
cacaagctccaagctcc

SEQ ID NO: 2236481 - DNA, 21 bp, Homo sapiens
cacaagctccaagctcccagg

SEQ ID NO: 2236482 - DNA, 22 bp, Homo sapiens
cacacatgagcatcaggccagg

SEQ ID NO: 2236483 - DNA, 20 bp, Homo sapiens
cacacattttttaaatgcac

SEQ ID NO: 2236484 - DNA, 13 bp, Homo sapiens
cacaccagagccc

SEQ ID NO: 2236485 - DNA, 21 bp, Homo sapiens
cacaccagagcccaccttggc

SEQ ID NO: 2236486 - DNA, 13 bp, Homo sapiens
cacacccagccca

SEQ ID NO: 2236487 - DNA, 22 bp, Homo sapiens
cacacggacactcaaaagctgg

SEQ ID NO: 2236488 - DNA, 20 bp, Homo sapiens
cacagaaaatggaagacagc

SEQ ID NO: 2236489 - DNA, 23 bp, Homo sapiens
cacagaaaatggaagacagctct

SEQ ID NO: 2236490 - DNA, 19 bp, Homo sapiens
cacagaaaattcttctcca

SEQ ID NO: 2236491 - DNA, 19 bp, Homo sapiens
cacagacatactaaccagc

SEQ ID NO: 2236492 - DNA, 21 bp, Homo sapiens
cacagacatactaaccagcag

SEQ ID NO: 2236493 - DNA, 14 bp, Homo sapiens
cacagaccctgccc

SEQ ID NO: 2236494 - DNA, 16 bp, Homo sapiens
cacagaccctgccctg

SEQ ID NO: 2236495 - DNA, 17 bp, Homo sapiens
cacagaccctgccctgt

SEQ ID NO: 2236496 - DNA, 19 bp, Homo sapiens
cacagagaaagtacttctc

SEQ ID NO: 2236497 - DNA, 13 bp, Homo sapiens
cacagaggctgcc

SEQ ID NO: 2236498 - DNA, 17 bp, Homo sapiens
cacagagttgttacatt

SEQ ID NO: 2236499 - DNA, 21 bp, Homo sapiens
cacagagttgttacattttta

SEQ ID NO: 2236500 - DNA, 18 bp, Homo sapiens
cacagatgggtgcttgga

SEQ ID NO: 2236501 - DNA, 22 bp, Homo sapiens
cacagctaacatggaagtacta

SEQ ID NO: 2236502 - DNA, 16 bp, Homo sapiens
cacagctctgtcctgg

SEQ ID NO: 2236503 - DNA, 19 bp, Homo sapiens
cacagctctgtcctgggag

SEQ ID NO: 2236504 - DNA, 23 bp, Homo sapiens
cacagctctgtcctgggagtgag

SEQ ID NO: 2236505 - DNA, 12 bp, Homo sapiens
cacaggatcagt

SEQ ID NO: 2236506 - DNA, 11 bp, Homo sapiens
cacaggcaggt

SEQ ID NO: 2236507 - DNA, 23 bp, Homo sapiens
cacaggcccggctccaggctcct

SEQ ID NO: 2236508 - DNA, 17 bp, Homo sapiens
cacaggggaaaagagga

SEQ ID NO: 2236509 - DNA, 13 bp, Homo sapiens
cacagtccttacc

SEQ ID NO: 2236510 - DNA, 12 bp, Homo sapiens
cacatatctgtc

SEQ ID NO: 2236511 - DNA, 20 bp, Homo sapiens
cacatattgatttccgttaa

SEQ ID NO: 2236512 - DNA, 14 bp, Homo sapiens
cacatcttgctctg

SEQ ID NO: 2236513 - DNA, 17 bp, Homo sapiens
cacatcttgctctgctg

SEQ ID NO: 2236514 - DNA, 20 bp, Homo sapiens
cacatcttgctctgctgaca

SEQ ID NO: 2236515 - DNA, 22 bp, Homo sapiens
cacatcttgctctgctgacaga

SEQ ID NO: 2236516 - DNA, 23 bp, Homo sapiens
cacatcttgctctgctgacagac

SEQ ID NO: 2236517 - DNA, 19 bp, Homo sapiens
cacatgagcatcaggccag

SEQ ID NO: 2236518 - DNA, 20 bp, Homo sapiens
cacatgagcatcaggccagg

SEQ ID NO: 2236519 - DNA, 21 bp, Homo sapiens
cacatgagcatcaggccaggc

SEQ ID NO: 2236520 - DNA, 19 bp, Homo sapiens
cacatgcaaggtcattttt

SEQ ID NO: 2236521 - DNA, 19 bp, Homo sapiens
cacatgcctctctcaggcc

SEQ ID NO: 2236522 - DNA, 17 bp, Homo sapiens
cagcgagccctggtggc

SEQ ID NO: 2236523 - DNA, 20 bp, Homo sapiens
cagcgagccctggtggcagt

SEQ ID NO: 2236524 - DNA, 15 bp, Homo sapiens
cagcggggacagctc

SEQ ID NO: 2236525 - DNA, 19 bp, Homo sapiens
cagcggggacagctccttc

SEQ ID NO: 2236526 - DNA, 19 bp, Homo sapiens
cagctaacatggaagtact

SEQ ID NO: 2236527 - DNA, 15 bp, Homo sapiens
cagctaatgggacac

SEQ ID NO: 2236528 - DNA, 16 bp, Homo sapiens
cagctaatgggacact

SEQ ID NO: 2236529 - DNA, 22 bp, Homo sapiens
cagctcaccagccccagtgccc

SEQ ID NO: 2236530 - DNA, 13 bp, Homo sapiens
cagctcacctctc

SEQ ID NO: 2236531 - DNA, 20 bp, Homo sapiens
cagctcacctctcccttgga

SEQ ID NO: 2236532 - DNA, 12 bp, Homo sapiens
cagctcagagag

SEQ ID NO: 2236533 - DNA, 20 bp, Homo sapiens
cagctcagagagggtgggag

SEQ ID NO: 2236534 - DNA, 15 bp, Homo sapiens
cagctccagctcacc

SEQ ID NO: 2236535 - DNA, 17 bp, Homo sapiens
cagctccagctcaccag

SEQ ID NO: 2236536 - DNA, 18 bp, Homo sapiens
cagctccagctcaccagc

SEQ ID NO: 2236537 - DNA, 13 bp, Homo sapiens
cagctctggtcca

SEQ ID NO: 2236538 - DNA, 23 bp, Homo sapiens
cagctctggtccatagagagcaa

SEQ ID NO: 2236539 - DNA, 17 bp, Homo sapiens
cagctctgtcctgggag

SEQ ID NO: 2236540 - DNA, 23 bp, Homo sapiens
cagctctgtcctgggagtgagct

SEQ ID NO: 2236541 - DNA, 21 bp, Homo sapiens
cagctcttatattgccatttc

SEQ ID NO: 2236542 - DNA, 16 bp, Homo sapiens
cagctcttctccaggc

SEQ ID NO: 2236543 - DNA, 13 bp, Homo sapiens
cagctgcctggga

SEQ ID NO: 2236544 - DNA, 20 bp, Homo sapiens
cagctgcggtccacccagga

SEQ ID NO: 2236545 - DNA, 15 bp, Homo sapiens
cagctgcttgggctt

SEQ ID NO: 2236546 - DNA, 21 bp, Homo sapiens
cagctgcttgggcttcatcct

SEQ ID NO: 2236547 - DNA, 23 bp, Homo sapiens
cagctgcttttgtctatgggact

SEQ ID NO: 2236548 - DNA, 21 bp, Homo sapiens
cagctggggtggggacctcag

SEQ ID NO: 2236549 - DNA, 21 bp, Homo sapiens
cagcttcatttcctgtgtctt

SEQ ID NO: 2236550 - DNA, 18 bp, Homo sapiens
cagcttgagggttgggct

SEQ ID NO: 2236551 - DNA, 20 bp, Homo sapiens
cagcttgagggttgggctgg

SEQ ID NO: 2236552 - DNA, 22 bp, Homo sapiens
cagcttgtaaatagctcaggtg

SEQ ID NO: 2236553 - DNA, 22 bp, Homo sapiens
cagctttgtttgttgtcagctg

SEQ ID NO: 2236554 - DNA, 16 bp, Homo sapiens
caggaaaagctgctga

SEQ ID NO: 2236555 - DNA, 23 bp, Homo sapiens
caggaaaggctccaggagcagcc

SEQ ID NO: 2236556 - DNA, 13 bp, Homo sapiens
caggaagctcagg

SEQ ID NO: 2236557 - DNA, 15 bp, Homo sapiens
caggaagctcagggc

SEQ ID NO: 2236558 - DNA, 18 bp, Homo sapiens
caggaagctcagggcctg

SEQ ID NO: 2236559 - DNA, 19 bp, Homo sapiens
caggaagctcagggcctgg

SEQ ID NO: 2236560 - DNA, 21 bp, Homo sapiens
caggaagctcagggcctggct

SEQ ID NO: 2236561 - DNA, 12 bp, Homo sapiens
caggaagtactg

SEQ ID NO: 2236562 - DNA, 16 bp, Homo sapiens
caggaagtactggaga

SEQ ID NO: 2236563 - DNA, 21 bp, Homo sapiens
caggaccagggatttccatga

SEQ ID NO: 2236564 - DNA, 16 bp, Homo sapiens
caggacctcaggtgag

SEQ ID NO: 2236565 - DNA, 19 bp, Homo sapiens
caggagcagccacattcct

SEQ ID NO: 2236566 - DNA, 16 bp, Homo sapiens
caggagccccgaggcc

SEQ ID NO: 2236567 - DNA, 18 bp, Homo sapiens
caggagccccgaggcctt

SEQ ID NO: 2236568 - DNA, 14 bp, Homo sapiens
caggagcctcctgc

SEQ ID NO: 2236569 - DNA, 12 bp, Homo sapiens
caggaggccagc

SEQ ID NO: 2236570 - DNA, 16 bp, Homo sapiens
caggaggccagccttg

SEQ ID NO: 2236571 - DNA, 18 bp, Homo sapiens
caggaggccagccttgac

SEQ ID NO: 2236572 - DNA, 22 bp, Homo sapiens
caggaggccagccttgaccatt

SEQ ID NO: 2236573 - DNA, 12 bp, Homo sapiens
caggagtgagca

SEQ ID NO: 2236574 - DNA, 21 bp, Homo sapiens
caggagtttgagaccaacctg

SEQ ID NO: 2236575 - DNA, 23 bp, Homo sapiens
caggatggccgggcgcggtggct

SEQ ID NO: 2236576 - DNA, 17 bp, Homo sapiens
caggattcttcctccct

SEQ ID NO: 2236577 - DNA, 15 bp, Homo sapiens
caggcaagcacctcc

SEQ ID NO: 2236578 - DNA, 15 bp, Homo sapiens
caggcaatgctggct

SEQ ID NO: 2236579 - DNA, 23 bp, Homo sapiens
caggcacccaccatcatgtctgg

SEQ ID NO: 2236580 - DNA, 12 bp, Homo sapiens
caggcaggtctt

SEQ ID NO: 2236581 - DNA, 17 bp, Homo sapiens
caggcatggtggcccac

SEQ ID NO: 2236582 - DNA, 18 bp, Homo sapiens
caggcatgttctctgagg

SEQ ID NO: 2236583 - DNA, 15 bp, Homo sapiens
caggcattccccagg

SEQ ID NO: 2236584 - DNA, 17 bp, Homo sapiens
caggcattccccaggag

SEQ ID NO: 2236585 - DNA, 19 bp, Homo sapiens
caggcattccccaggaggc

SEQ ID NO: 2236586 - DNA, 17 bp, Homo sapiens
caggccacaagaccctt

SEQ ID NO: 2236587 - DNA, 21 bp, Homo sapiens
caggccagagggagtgacaga

SEQ ID NO: 2236588 - DNA, 19 bp, Homo sapiens
caggccagctgcttgggct

SEQ ID NO: 2236589 - DNA, 14 bp, Homo sapiens
caggccaggccctc

SEQ ID NO: 2236590 - DNA, 20 bp, Homo sapiens
caggccaggccctctgccca

SEQ ID NO: 2236591 - DNA, 20 bp, Homo sapiens
caggcccctgccaccctggg

SEQ ID NO: 2236592 - DNA, 13 bp, Homo sapiens
caggcccggctcc

SEQ ID NO: 2236593 - DNA, 16 bp, Homo sapiens
caggcccggctccagg

SEQ ID NO: 2236594 - DNA, 18 bp, Homo sapiens
caggcccggctccaggct

SEQ ID NO: 2236595 - DNA, 20 bp, Homo sapiens
caggcccggctccaggctcc

SEQ ID NO: 2236596 - DNA, 21 bp, Homo sapiens
caggcccggctccaggctcct

SEQ ID NO: 2236597 - DNA, 13 bp, Homo sapiens
caggccctctgcc

SEQ ID NO: 2236598 - DNA, 15 bp, Homo sapiens
caggccctctgccca

SEQ ID NO: 2236599 - DNA, 20 bp, Homo sapiens
caggccctctgcccactccc

SEQ ID NO: 2236600 - DNA, 22 bp, Homo sapiens
caggccctctgcccactccctg

SEQ ID NO: 2236601 - DNA, 12 bp, Homo sapiens
caggcctcccca

SEQ ID NO: 2236602 - DNA, 12 bp, Homo sapiens
caggcctcctac

SEQ ID NO: 2236603 - DNA, 14 bp, Homo sapiens
caggctcctttagc

SEQ ID NO: 2236604 - DNA, 12 bp, Homo sapiens
caggctctcagg

SEQ ID NO: 2236605 - DNA, 15 bp, Homo sapiens
caggctctcaggcca

SEQ ID NO: 2236606 - DNA, 21 bp, Homo sapiens
caggctctcaggccagctgct

SEQ ID NO: 2236607 - DNA, 23 bp, Homo sapiens
caggctctcaggccagctgcttg

SEQ ID NO: 2236608 - DNA, 19 bp, Homo sapiens
caggctggcgtgcagtggt

SEQ ID NO: 2236609 - DNA, 14 bp, Homo sapiens
caggctgggagagc

SEQ ID NO: 2236610 - DNA, 21 bp, Homo sapiens
caggctgggagagccttccag

SEQ ID NO: 2236611 - DNA, 19 bp, Homo sapiens
caggctgggcttcagtggc

SEQ ID NO: 2236612 - DNA, 21 bp, Homo sapiens
caggctgggcttcagtggcag

SEQ ID NO: 2236613 - DNA, 20 bp, Homo sapiens
caggctgtatcccatgagcc

SEQ ID NO: 2236614 - DNA, 23 bp, Homo sapiens
caggctgtatcccatgagcctca

SEQ ID NO: 2236615 - DNA, 22 bp, Homo sapiens
caggcttagtcactgagacagc

SEQ ID NO: 2236616 - DNA, 23 bp, Homo sapiens
caggcttagtcactgagacagcc

SEQ ID NO: 2236617 - DNA, 17 bp, Homo sapiens
cagggaattgggggggt

SEQ ID NO: 2236618 - DNA, 14 bp, Homo sapiens
cagggacagagggg

SEQ ID NO: 2236619 - DNA, 14 bp, Homo sapiens
cagggcacaccggg

SEQ ID NO: 2236620 - DNA, 15 bp, Homo sapiens
cagggcacaccgggc

SEQ ID NO: 2236621 - DNA, 19 bp, Homo sapiens
cagggcacaccgggcactc

SEQ ID NO: 2236622 - DNA, 23 bp, Homo sapiens
cagggcacaccgggcactcagaa

SEQ ID NO: 2236623 - DNA, 15 bp, Homo sapiens
cagggcctggctcag

SEQ ID NO: 2236624 - DNA, 12 bp, Homo sapiens
cagggctcagcg

SEQ ID NO: 2236625 - DNA, 21 bp, Homo sapiens
cagggctcagcggggacagct

SEQ ID NO: 2236626 - DNA, 14 bp, Homo sapiens
caggggaaaagagg

SEQ ID NO: 2236627 - DNA, 16 bp, Homo sapiens
caggggaaaagaggag

SEQ ID NO: 2236628 - DNA, 19 bp, Homo sapiens
caggggaaaatcagcctgc

SEQ ID NO: 2236629 - DNA, 20 bp, Homo sapiens
caggggaaaatcagcctgct

SEQ ID NO: 2236630 - DNA, 23 bp, Homo sapiens
cagggggtgccctcccagacccc

SEQ ID NO: 2236631 - DNA, 18 bp, Homo sapiens
cagggtctcactctgtcg

SEQ ID NO: 2236632 - DNA, 22 bp, Homo sapiens
cagggtctcactctgtcgccca

SEQ ID NO: 2236633 - DNA, 21 bp, Homo sapiens
cagggtgagcactctggggtg

SEQ ID NO: 2236634 - DNA, 20 bp, Homo sapiens
caggtaacaggcagatacag

SEQ ID NO: 2236635 - DNA, 18 bp, Homo sapiens
caggtcttgaactcctgg

SEQ ID NO: 2236636 - DNA, 19 bp, Homo sapiens
caggtcttgaactcctggc

SEQ ID NO: 2236637 - DNA, 21 bp, Homo sapiens
caggtgatccacccacctcag

SEQ ID NO: 2236638 - DNA, 22 bp, Homo sapiens
caggtgatccacccacctcagc

SEQ ID NO: 2236639 - DNA, 21 bp, Homo sapiens
caggtgcacaagctccaagct

SEQ ID NO: 2236640 - DNA, 22 bp, Homo sapiens
caggtgcacaagctccaagctc

SEQ ID NO: 2236641 - DNA, 19 bp, Homo sapiens
caggtggggtcactctggc

SEQ ID NO: 2236642 - DNA, 11 bp, Homo sapiens
caggtgtccct

SEQ ID NO: 2236643 - DNA, 14 bp, Homo sapiens
caggtgtccctgca

SEQ ID NO: 2236644 - DNA, 18 bp, Homo sapiens
caggtgtccctgcacttg

SEQ ID NO: 2236645 - DNA, 13 bp, Homo sapiens
cccactgctctgg

SEQ ID NO: 2236646 - DNA, 22 bp, Homo sapiens
cccactgcttttggtctgtgtg

SEQ ID NO: 2236647 - DNA, 23 bp, Homo sapiens
cccactgcttttggtctgtgtga

SEQ ID NO: 2236648 - DNA, 12 bp, Homo sapiens
cccacttctgcc

SEQ ID NO: 2236649 - DNA, 11 bp, Homo sapiens
cccagaccccc

SEQ ID NO: 2236650 - DNA, 23 bp, Homo sapiens
cccagacccccttgcccaggcct

SEQ ID NO: 2236651 - DNA, 14 bp, Homo sapiens
cccagagggcctgc

SEQ ID NO: 2236652 - DNA, 20 bp, Homo sapiens
cccagcaagtgagagctggg

SEQ ID NO: 2236653 - DNA, 21 bp, Homo sapiens
cccagcaagtgagagctgggt

SEQ ID NO: 2236654 - DNA, 11 bp, Homo sapiens
cccagccccat

SEQ ID NO: 2236655 - DNA, 12 bp, Homo sapiens
cccagcctgcta

SEQ ID NO: 2236656 - DNA, 14 bp, Homo sapiens
cccagcgagccctg

SEQ ID NO: 2236657 - DNA, 13 bp, Homo sapiens
cccagctctggtc

SEQ ID NO: 2236658 - DNA, 14 bp, Homo sapiens
cccagctctggtcc

SEQ ID NO: 2236659 - DNA, 18 bp, Homo sapiens
cccagctctggtccatag

SEQ ID NO: 2236660 - DNA, 17 bp, Homo sapiens
cccaggaaaggctccag

SEQ ID NO: 2236661 - DNA, 13 bp, Homo sapiens
cccaggaggccag

SEQ ID NO: 2236662 - DNA, 11 bp, Homo sapiens
cccaggcaggt

SEQ ID NO: 2236663 - DNA, 20 bp, Homo sapiens
cccaggcattccccaggagg

SEQ ID NO: 2236664 - DNA, 11 bp, Homo sapiens
cccaggcccct

SEQ ID NO: 2236665 - DNA, 12 bp, Homo sapiens
cccaggcctccc

SEQ ID NO: 2236666 - DNA, 18 bp, Homo sapiens
cccaggctggcgtgcagt

SEQ ID NO: 2236667 - DNA, 18 bp, Homo sapiens
cccagtctggaatgcagt

SEQ ID NO: 2236668 - DNA, 20 bp, Homo sapiens
cccagtctggaatgcagtgg

SEQ ID NO: 2236669 - DNA, 13 bp, Homo sapiens
cccagtgcccaca

SEQ ID NO: 2236670 - DNA, 20 bp, Homo sapiens
cccagtgcccacaggatcag

SEQ ID NO: 2236671 - DNA, 17 bp, Homo sapiens
cccagtgccgagaagga

SEQ ID NO: 2236672 - DNA, 18 bp, Homo sapiens
cccagtgccgagaaggaa

SEQ ID NO: 2236673 - DNA, 15 bp, Homo sapiens
cccatcctcctgccc

SEQ ID NO: 2236674 - DNA, 14 bp, Homo sapiens
cccatcctctgtac

SEQ ID NO: 2236675 - DNA, 20 bp, Homo sapiens
cccatcctctgtacagagcc

SEQ ID NO: 2236676 - DNA, 18 bp, Homo sapiens
cccatctcacacatgagc

SEQ ID NO: 2236677 - DNA, 14 bp, Homo sapiens
cccatgctgccctg

SEQ ID NO: 2236678 - DNA, 15 bp, Homo sapiens
cccatgctgccctgt

SEQ ID NO: 2236679 - DNA, 16 bp, Homo sapiens
cccatgctgccctgtg

SEQ ID NO: 2236680 - DNA, 20 bp, Homo sapiens
cccattctgcctgcccaggc

SEQ ID NO: 2236681 - DNA, 21 bp, Homo sapiens
cccattctgcctgcccaggcc

SEQ ID NO: 2236682 - DNA, 20 bp, Homo sapiens
ccccaaaactctcctctgct

SEQ ID NO: 2236683 - DNA, 22 bp, Homo sapiens
ccccaaaactctcctctgctgc

SEQ ID NO: 2236684 - DNA, 23 bp, Homo sapiens
ccccaaaactctcctctgctgct

SEQ ID NO: 2236685 - DNA, 21 bp, Homo sapiens
ccccaaatggaaatgggcaga

SEQ ID NO: 2236686 - DNA, 14 bp, Homo sapiens
ccccacccaagggc

SEQ ID NO: 2236687 - DNA, 20 bp, Homo sapiens
ccccacccaagggcctggcc

SEQ ID NO: 2236688 - DNA, 20 bp, Homo sapiens
ccccaccccaggctgggctg

SEQ ID NO: 2236689 - DNA, 13 bp, Homo sapiens
ccccacgtccctg

SEQ ID NO: 2236690 - DNA, 19 bp, Homo sapiens
ccccagcaagtgagagctg

SEQ ID NO: 2236691 - DNA, 20 bp, Homo sapiens
ccccagcaagtgagagctgg

SEQ ID NO: 2236692 - DNA, 21 bp, Homo sapiens
ccccagcaagtgagagctggg

SEQ ID NO: 2236693 - DNA, 12 bp, Homo sapiens
ccccagccccaa

SEQ ID NO: 2236694 - DNA, 14 bp, Homo sapiens
ccccagccccatcc

SEQ ID NO: 2236695 - DNA, 12 bp, Homo sapiens
ccccaggaggcc

SEQ ID NO: 2236696 - DNA, 14 bp, Homo sapiens
ccccaggaggccag

SEQ ID NO: 2236697 - DNA, 18 bp, Homo sapiens
ccccatcctcctgccccc

SEQ ID NO: 2236698 - DNA, 21 bp, Homo sapiens
ccccatcctctgtacagagcc

SEQ ID NO: 2236699 - DNA, 15 bp, Homo sapiens
ccccattctgcctgc

SEQ ID NO: 2236700 - DNA, 14 bp, Homo sapiens
cccccaccccaggc

SEQ ID NO: 2236701 - DNA, 12 bp, Homo sapiens
cccccagcctgc

SEQ ID NO: 2236702 - DNA, 15 bp, Homo sapiens
cccccgccccatcct

SEQ ID NO: 2236703 - DNA, 21 bp, Homo sapiens
cccccgctgtcagccattcct

SEQ ID NO: 2236704 - DNA, 15 bp, Homo sapiens
cccccggcccagtgc

SEQ ID NO: 2236705 - DNA, 23 bp, Homo sapiens
ccccctggtggaatgcgggggag

SEQ ID NO: 2236706 - DNA, 14 bp, Homo sapiens
ccccgcccaggctt

SEQ ID NO: 2236707 - DNA, 14 bp, Homo sapiens
ccccgccccatcct

SEQ ID NO: 2236708 - DNA, 13 bp, Homo sapiens
ccccggccacctg

SEQ ID NO: 2236709 - DNA, 13 bp, Homo sapiens
ccccggcccagtg

SEQ ID NO: 2236710 - DNA, 14 bp, Homo sapiens
ccccggcccagtgc

SEQ ID NO: 2236711 - DNA, 20 bp, Homo sapiens
ccccgggcagcagagagaga

SEQ ID NO: 2236712 - DNA, 22 bp, Homo sapiens
cccctcagggtccctggtggca

SEQ ID NO: 2236713 - DNA, 14 bp, Homo sapiens
cccctgccaccctg

SEQ ID NO: 2236714 - DNA, 17 bp, Homo sapiens
cccctgctgggtgtggc

SEQ ID NO: 2236715 - DNA, 11 bp, Homo sapiens
cccctgctggt

SEQ ID NO: 2236716 - DNA, 20 bp, Homo sapiens
cccctgctggttcagggttg

SEQ ID NO: 2236717 - DNA, 15 bp, Homo sapiens
cccctggatgcagcc

SEQ ID NO: 2236718 - DNA, 16 bp, Homo sapiens
ccccttctgacccatg

SEQ ID NO: 2236719 - DNA, 22 bp, Homo sapiens
cccgaatagctgggactacagg

SEQ ID NO: 2236720 - DNA, 15 bp, Homo sapiens
cccgagtagctggga

SEQ ID NO: 2236721 - DNA, 22 bp, Homo sapiens
cccgctaagagggagggagggc

SEQ ID NO: 2236722 - DNA, 19 bp, Homo sapiens
cccgctgtcagccattcct

SEQ ID NO: 2236723 - DNA, 20 bp, Homo sapiens
cccgctgtcagccattcctg

SEQ ID NO: 2236724 - DNA, 14 bp, Homo sapiens
cccggccacctgcg

SEQ ID NO: 2236725 - DNA, 15 bp, Homo sapiens
cccggcccctgctgg

SEQ ID NO: 2236726 - DNA, 11 bp, Homo sapiens
cccggctccag

SEQ ID NO: 2236727 - DNA, 14 bp, Homo sapiens
cccggctccaggct

SEQ ID NO: 2236728 - DNA, 15 bp, Homo sapiens
cccgggaagggggct

SEQ ID NO: 2236729 - DNA, 18 bp, Homo sapiens
cccgggaagggggctggg

SEQ ID NO: 2236730 - DNA, 15 bp, Homo sapiens
cccgggcagcagaga

SEQ ID NO: 2236731 - DNA, 12 bp, Homo sapiens
cccgggctctgc

SEQ ID NO: 2236732 - DNA, 14 bp, Homo sapiens
cccgggctctgcct

SEQ ID NO: 2236733 - DNA, 15 bp, Homo sapiens
cccgggctctgcctc

SEQ ID NO: 2236734 - DNA, 18 bp, Homo sapiens
cccggggatcccccgccc

SEQ ID NO: 2236735 - DNA, 20 bp, Homo sapiens
ccctcaactctcctccagag

SEQ ID NO: 2236736 - DNA, 15 bp, Homo sapiens
ccctcagggtccctg

SEQ ID NO: 2236737 - DNA, 17 bp, Homo sapiens
ccctcagggtccctggt

SEQ ID NO: 2236738 - DNA, 22 bp, Homo sapiens
ccctcatcaccaacgtctgtgc

SEQ ID NO: 2236739 - DNA, 22 bp, Homo sapiens
ccctcatcctcatacccacccc

SEQ ID NO: 2236740 - DNA, 21 bp, Homo sapiens
ccctccaagaccttctccttc

SEQ ID NO: 2236741 - DNA, 17 bp, Homo sapiens
ccctccatgtgggctag

SEQ ID NO: 2236742 - DNA, 13 bp, Homo sapiens
ccctccccgggca

SEQ ID NO: 2236743 - DNA, 19 bp, Homo sapiens
ccctccccgggcagcagag

SEQ ID NO: 2236744 - DNA, 14 bp, Homo sapiens
ccctcctttcacca

SEQ ID NO: 2236745 - DNA, 12 bp, Homo sapiens
ccctctttccct

SEQ ID NO: 2236746 - DNA, 20 bp, Homo sapiens
ccctctttccctcccttcct

SEQ ID NO: 2236747 - DNA, 14 bp, Homo sapiens
ccctgaaggccccg

SEQ ID NO: 2236748 - DNA, 16 bp, Homo sapiens
ccctgaaggccccgcc

SEQ ID NO: 2236749 - DNA, 14 bp, Homo sapiens
ccctgaggcccaga

SEQ ID NO: 2236750 - DNA, 16 bp, Homo sapiens
ccctgaggcccagagg

SEQ ID NO: 2236751 - DNA, 17 bp, Homo sapiens
ccctgaggcccagaggg

SEQ ID NO: 2236752 - DNA, 22 bp, Homo sapiens
ccctgcaacctgattgtgtctc

SEQ ID NO: 2236753 - DNA, 18 bp, Homo sapiens
ccctgcagagggcacaga

SEQ ID NO: 2236754 - DNA, 15 bp, Homo sapiens
ccctgccaccctggg

SEQ ID NO: 2236755 - DNA, 22 bp, Homo sapiens
ccctgcccacctggcctctgca

SEQ ID NO: 2236756 - DNA, 14 bp, Homo sapiens
ccctgcccggctgc

SEQ ID NO: 2236757 - DNA, 11 bp, Homo sapiens
ccctgccctgt

SEQ ID NO: 2236758 - DNA, 14 bp, Homo sapiens
ccctgcctcctttg

SEQ ID NO: 2236759 - DNA, 18 bp, Homo sapiens
ccctgcggaagccacagg

SEQ ID NO: 2236760 - DNA, 19 bp, Homo sapiens
ccctgcggaagccacaggg

SEQ ID NO: 2236761 - DNA, 22 bp, Homo sapiens
ccctgctgggtgtggcgcagca

SEQ ID NO: 2236762 - DNA, 12 bp, Homo sapiens
ccctggcagccc

SEQ ID NO: 2236763 - DNA, 16 bp, Homo sapiens
ccctggcagcccctgt

SEQ ID NO: 2236764 - DNA, 21 bp, Homo sapiens
ccctggtgaccagcaccatct

SEQ ID NO: 2236765 - DNA, 15 bp, Homo sapiens
ccctggtggcagctc

SEQ ID NO: 2236766 - DNA, 16 bp, Homo sapiens
ccctggtggcagctca

SEQ ID NO: 2236767 - DNA, 16 bp, Homo sapiens
ccctggtggcagtggg

SEQ ID NO: 2236768 - DNA, 19 bp, Homo sapiens
ccctggtggcagtgggagc

SEQ ID NO: 2236769 - DNA, 16 bp, Homo sapiens
ccctgtctaatgaaac

SEQ ID NO: 2236770 - DNA, 19 bp, Homo sapiens
ctcaactctcctccagagt

SEQ ID NO: 2236771 - DNA, 20 bp, Homo sapiens
ctcaactctcctccagagtc

SEQ ID NO: 2236772 - DNA, 21 bp, Homo sapiens
ctcaactctcctccagagtca

SEQ ID NO: 2236773 - DNA, 14 bp, Homo sapiens
ctcaagtcctcttt

SEQ ID NO: 2236774 - DNA, 21 bp, Homo sapiens
ctcaagtgattctcctgcctc

SEQ ID NO: 2236775 - DNA, 15 bp, Homo sapiens
ctcaatgcactgaca

SEQ ID NO: 2236776 - DNA, 23 bp, Homo sapiens
ctcacacggacactcaaaagctg

SEQ ID NO: 2236777 - DNA, 15 bp, Homo sapiens
ctcacatttattctg

SEQ ID NO: 2236778 - DNA, 22 bp, Homo sapiens
ctcacatttattctgctcacat

SEQ ID NO: 2236779 - DNA, 19 bp, Homo sapiens
ctcaccagccccagtgccc

SEQ ID NO: 2236780 - DNA, 20 bp, Homo sapiens
ctcaccagccccagtgccca

SEQ ID NO: 2236781 - DNA, 21 bp, Homo sapiens
ctcaccagccccagtgcccac

SEQ ID NO: 2236782 - DNA, 13 bp, Homo sapiens
ctcaccccagccc

SEQ ID NO: 2236783 - DNA, 13 bp, Homo sapiens
ctcacctctccct

SEQ ID NO: 2236784 - DNA, 16 bp, Homo sapiens
ctcacctctcccttgg

SEQ ID NO: 2236785 - DNA, 17 bp, Homo sapiens
ctcacctctcccttgga

SEQ ID NO: 2236786 - DNA, 18 bp, Homo sapiens
ctcactatgttgcccagg

SEQ ID NO: 2236787 - DNA, 21 bp, Homo sapiens
ctcactatgttgcccaggcag

SEQ ID NO: 2236788 - DNA, 22 bp, Homo sapiens
ctcactatgttgcccaggcagg

SEQ ID NO: 2236789 - DNA, 23 bp, Homo sapiens
ctcactatgttgcccaggcaggt

SEQ ID NO: 2236790 - DNA, 12 bp, Homo sapiens
ctcactctgtcg

SEQ ID NO: 2236791 - DNA, 22 bp, Homo sapiens
ctcactctgtcgcccagtctgg

SEQ ID NO: 2236792 - DNA, 12 bp, Homo sapiens
ctcactgcagcc

SEQ ID NO: 2236793 - DNA, 13 bp, Homo sapiens
ctcactgcagcct

SEQ ID NO: 2236794 - DNA, 14 bp, Homo sapiens
ctcactgcagcctc

SEQ ID NO: 2236795 - DNA, 16 bp, Homo sapiens
ctcactgttgcccagg

SEQ ID NO: 2236796 - DNA, 19 bp, Homo sapiens
ctcactgttgcccaggctg

SEQ ID NO: 2236797 - DNA, 20 bp, Homo sapiens
ctcactgttgcccaggctgg

SEQ ID NO: 2236798 - DNA, 16 bp, Homo sapiens
ctcagcaggggagggt

SEQ ID NO: 2236799 - DNA, 16 bp, Homo sapiens
ctcagcatcctggcac

SEQ ID NO: 2236800 - DNA, 17 bp, Homo sapiens
ctcagcatcctggcacc

SEQ ID NO: 2236801 - DNA, 22 bp, Homo sapiens
ctcagcctcccaaagtgctggg

SEQ ID NO: 2236802 - DNA, 19 bp, Homo sapiens
ctcagcctcccgaatagct

SEQ ID NO: 2236803 - DNA, 21 bp, Homo sapiens
ctcagcctcccgaatagctgg

SEQ ID NO: 2236804 - DNA, 23 bp, Homo sapiens
ctcagcctcccgaatagctggga

SEQ ID NO: 2236805 - DNA, 21 bp, Homo sapiens
ctcagcggggacagctccttc

SEQ ID NO: 2236806 - DNA, 15 bp, Homo sapiens
ctcaggcaggtggga

SEQ ID NO: 2236807 - DNA, 15 bp, Homo sapiens
ctcaggccagctgct

SEQ ID NO: 2236808 - DNA, 20 bp, Homo sapiens
ctcaggcctgggggctgggc

SEQ ID NO: 2236809 - DNA, 21 bp, Homo sapiens
ctcaggcctgggggctgggca

SEQ ID NO: 2236810 - DNA, 15 bp, Homo sapiens
ctcagggcctggctc

SEQ ID NO: 2236811 - DNA, 18 bp, Homo sapiens
ctcagggcctggctcagg

SEQ ID NO: 2236812 - DNA, 16 bp, Homo sapiens
ctcagggtccctggtg

SEQ ID NO: 2236813 - DNA, 18 bp, Homo sapiens
ctcagggtccctggtggc

SEQ ID NO: 2236814 - DNA, 21 bp, Homo sapiens
ctcagggtccctggtggcagc

SEQ ID NO: 2236815 - DNA, 14 bp, Homo sapiens
ctcaggtgagaagc

SEQ ID NO: 2236816 - DNA, 19 bp, Homo sapiens
ctcaggtgagaagcagagg

SEQ ID NO: 2236817 - DNA, 20 bp, Homo sapiens
ctcaggtgatccacccacct

SEQ ID NO: 2236818 - DNA, 23 bp, Homo sapiens
ctcaggtgatccacccacctcag

SEQ ID NO: 2236819 - DNA, 15 bp, Homo sapiens
ctcaggtgtccctgc

SEQ ID NO: 2236820 - DNA, 17 bp, Homo sapiens
ctcaggtgtccctgcac

SEQ ID NO: 2236821 - DNA, 22 bp, Homo sapiens
ctcagtctggcccttccttttc

SEQ ID NO: 2236822 - DNA, 14 bp, Homo sapiens
ctcatgttcttaat

SEQ ID NO: 2236823 - DNA, 18 bp, Homo sapiens
ctcatgttcttaattctt

SEQ ID NO: 2236824 - DNA, 16 bp, Homo sapiens
ctcattgacctgaggc

SEQ ID NO: 2236825 - DNA, 19 bp, Homo sapiens
ctcattgacctgaggccct

SEQ ID NO: 2236826 - DNA, 21 bp, Homo sapiens
ctcattgacctgaggcccttc

SEQ ID NO: 2236827 - DNA, 17 bp, Homo sapiens
ctcatttgtcacacact

SEQ ID NO: 2236828 - DNA, 18 bp, Homo sapiens
ctcatttgtcacacactt

SEQ ID NO: 2236829 - DNA, 21 bp, Homo sapiens
ctccaagaccttctccttcac

SEQ ID NO: 2236830 - DNA, 22 bp, Homo sapiens
ctccaagaccttctccttcacc

SEQ ID NO: 2236831 - DNA, 24 bp, Homo sapiens
ctccaagcaggacatggacaagga

SEQ ID NO: 2236832 - DNA, 14 bp, Homo sapiens
ctccaagctcccag

SEQ ID NO: 2236833 - DNA, 15 bp, Homo sapiens
ctccagaatttccca

SEQ ID NO: 2236834 - DNA, 18 bp, Homo sapiens
ctccagaatttcccaaag

SEQ ID NO: 2236835 - DNA, 22 bp, Homo sapiens
ctccagaatttcccaaagcagt

SEQ ID NO: 2236836 - DNA, 11 bp, Homo sapiens
ctccagcccct

SEQ ID NO: 2236837 - DNA, 15 bp, Homo sapiens
ctccagcccctggat

SEQ ID NO: 2236838 - DNA, 16 bp, Homo sapiens
ctccagcccctggatg

SEQ ID NO: 2236839 - DNA, 17 bp, Homo sapiens
ctccagcccctggatgc

SEQ ID NO: 2236840 - DNA, 14 bp, Homo sapiens
ctccagctcaccag

SEQ ID NO: 2236841 - DNA, 11 bp, Homo sapiens
ctccaggagca

SEQ ID NO: 2236842 - DNA, 16 bp, Homo sapiens
ctccaggagcagccac

SEQ ID NO: 2236843 - DNA, 18 bp, Homo sapiens
ctccaggagcagccacat

SEQ ID NO: 2236844 - DNA, 11 bp, Homo sapiens
ctccaggctcc

SEQ ID NO: 2236845 - DNA, 15 bp, Homo sapiens
ctccaggctccttta

SEQ ID NO: 2236846 - DNA, 22 bp, Homo sapiens
ctccaggctgtatcccatgagc

SEQ ID NO: 2236847 - DNA, 20 bp, Homo sapiens
ctccagggggtgccctccca

SEQ ID NO: 2236848 - DNA, 14 bp, Homo sapiens
ctccatgtgggcta

SEQ ID NO: 2236849 - DNA, 14 bp, Homo sapiens
ctcccaactcaccc

SEQ ID NO: 2236850 - DNA, 16 bp, Homo sapiens
ctcccaactcacccca

SEQ ID NO: 2236851 - DNA, 22 bp, Homo sapiens
ctcccaaggggcccaaattctt

SEQ ID NO: 2236852 - DNA, 11 bp, Homo sapiens
ctcccaccccc

SEQ ID NO: 2236853 - DNA, 13 bp, Homo sapiens
ctcccacctcagc

SEQ ID NO: 2236854 - DNA, 21 bp, Homo sapiens
ctcccaggcattccccaggag

SEQ ID NO: 2236855 - DNA, 14 bp, Homo sapiens
ctcccatcacccgc

SEQ ID NO: 2236856 - DNA, 15 bp, Homo sapiens
ctcccatctcacaca

SEQ ID NO: 2236857 - DNA, 12 bp, Homo sapiens
ctccccagcaag

SEQ ID NO: 2236858 - DNA, 22 bp, Homo sapiens
ctcccccagccccatcctctgt

SEQ ID NO: 2236859 - DNA, 16 bp, Homo sapiens
ctccccgggcagcaga

SEQ ID NO: 2236860 - DNA, 18 bp, Homo sapiens
ctccccgggcagcagaga

SEQ ID NO: 2236861 - DNA, 14 bp, Homo sapiens
ctcccctgctgggt

SEQ ID NO: 2236862 - DNA, 21 bp, Homo sapiens
ctcccctgctgggtgtggcgc

SEQ ID NO: 2236863 - DNA, 20 bp, Homo sapiens
ctcccgaatagctgggacta

SEQ ID NO: 2236864 - DNA, 16 bp, Homo sapiens
ctcccgagtagctggg

SEQ ID NO: 2236865 - DNA, 17 bp, Homo sapiens
ctcccgagtagctggga

SEQ ID NO: 2236866 - DNA, 20 bp, Homo sapiens
ctcccgagtagctgggacta

SEQ ID NO: 2236867 - DNA, 15 bp, Homo sapiens
ctccctctttccctc

SEQ ID NO: 2236868 - DNA, 19 bp, Homo sapiens
ctccctctttccctccctt

SEQ ID NO: 2236869 - DNA, 14 bp, Homo sapiens
ctcccttcccacct

SEQ ID NO: 2236870 - DNA, 17 bp, Homo sapiens
ctcccttcccacctctc

SEQ ID NO: 2236871 - DNA, 21 bp, Homo sapiens
ctccgctttctacccagcgag

SEQ ID NO: 2236872 - DNA, 12 bp, Homo sapiens
ctcctcagatct

SEQ ID NO: 2236873 - DNA, 14 bp, Homo sapiens
ctcctcagatcttc

SEQ ID NO: 2236874 - DNA, 15 bp, Homo sapiens
ctcctccagagtcag

SEQ ID NO: 2236875 - DNA, 15 bp, Homo sapiens
ctcctccagccgcca

SEQ ID NO: 2236876 - DNA, 15 bp, Homo sapiens
ctcctctccccagca

SEQ ID NO: 2236877 - DNA, 16 bp, Homo sapiens
ctcctgcaggcagcca

SEQ ID NO: 2236878 - DNA, 22 bp, Homo sapiens
ctcctgcaggcagccaggccac

SEQ ID NO: 2236879 - DNA, 17 bp, Homo sapiens
ctcctgcccccacccca

SEQ ID NO: 2236880 - DNA, 21 bp, Homo sapiens
ctcctgcccccaccccaggct

SEQ ID NO: 2236881 - DNA, 22 bp, Homo sapiens
ctcctgcccccaccccaggctg

SEQ ID NO: 2236882 - DNA, 15 bp, Homo sapiens
ctcctgcctcagcct

SEQ ID NO: 2236883 - DNA, 16 bp, Homo sapiens
ctcctgcctcagcctc

SEQ ID NO: 2236884 - DNA, 16 bp, Homo sapiens
ctcctggcccactgca

SEQ ID NO: 2236885 - DNA, 18 bp, Homo sapiens
ctcctgggctaagtgatc

SEQ ID NO: 2236886 - DNA, 21 bp, Homo sapiens
ctcctgtgtgtgcgcctacag

SEQ ID NO: 2236887 - DNA, 14 bp, Homo sapiens
ctccttcacctttg

SEQ ID NO: 2236888 - DNA, 15 bp, Homo sapiens
ctcctttcaccacat

SEQ ID NO: 2236889 - DNA, 18 bp, Homo sapiens
ctcctttgtgaggaagcc

SEQ ID NO: 2236890 - DNA, 23 bp, Homo sapiens
ctcctttgtgaggaagccgctgg

SEQ ID NO: 2236891 - DNA, 13 bp, Homo sapiens
ctcgaactggctg

SEQ ID NO: 2236892 - DNA, 14 bp, Homo sapiens
ctcgaactggctgc

SEQ ID NO: 2236893 - DNA, 13 bp, Homo sapiens
ctcgaccaccccc

SEQ ID NO: 2236894 - DNA, 23 bp, Homo sapiens
ctggcctagcatacgtacacatt

SEQ ID NO: 2236895 - DNA, 18 bp, Homo sapiens
ctggcctctgcactcccc

SEQ ID NO: 2236896 - DNA, 21 bp, Homo sapiens
ctggcctctgcactcccctgc

SEQ ID NO: 2236897 - DNA, 15 bp, Homo sapiens
ctggcctgagctggg

SEQ ID NO: 2236898 - DNA, 14 bp, Homo sapiens
ctggcgtgcagtgg

SEQ ID NO: 2236899 - DNA, 22 bp, Homo sapiens
ctggctatgcatttgaaaattt

SEQ ID NO: 2236900 - DNA, 20 bp, Homo sapiens
ctggctggttagaggttccc

SEQ ID NO: 2236901 - DNA, 16 bp, Homo sapiens
ctggctgttggctggg

SEQ ID NO: 2236902 - DNA, 17 bp, Homo sapiens
ctggctgttggctgggg

SEQ ID NO: 2236903 - DNA, 19 bp, Homo sapiens
ctggctgttggctgggggc

SEQ ID NO: 2236904 - DNA, 12 bp, Homo sapiens
ctgggacacagt

SEQ ID NO: 2236905 - DNA, 14 bp, Homo sapiens
ctgggacatgggaa

SEQ ID NO: 2236906 - DNA, 21 bp, Homo sapiens
ctgggactacaggcacccacc

SEQ ID NO: 2236907 - DNA, 17 bp, Homo sapiens
ctgggagagccttccag

SEQ ID NO: 2236908 - DNA, 20 bp, Homo sapiens
ctgggagagccttccagggg

SEQ ID NO: 2236909 - DNA, 21 bp, Homo sapiens
ctgggaggtcaaggctgcagt

SEQ ID NO: 2236910 - DNA, 16 bp, Homo sapiens
ctgggagtgagctggt

SEQ ID NO: 2236911 - DNA, 20 bp, Homo sapiens
ctgggattacaggtgtgaac

SEQ ID NO: 2236912 - DNA, 17 bp, Homo sapiens
ctgggcagaaggaagac

SEQ ID NO: 2236913 - DNA, 18 bp, Homo sapiens
ctgggcttcagtggcagc

SEQ ID NO: 2236914 - DNA, 22 bp, Homo sapiens
ctgggcttcagtggcagctgct

SEQ ID NO: 2236915 - DNA, 24 bp, Homo sapiens
ctgggcttcagtggcagctgcttt

SEQ ID NO: 2236916 - DNA, 17 bp, Homo sapiens
ctgggcttggggaccag

SEQ ID NO: 2236917 - DNA, 22 bp, Homo sapiens
ctgggcttggggaccagagctg

SEQ ID NO: 2236918 - DNA, 13 bp, Homo sapiens
ctggggattcttg

SEQ ID NO: 2236919 - DNA, 13 bp, Homo sapiens
ctgggggcctcag

SEQ ID NO: 2236920 - DNA, 18 bp, Homo sapiens
ctgggggcctcagtgcca

SEQ ID NO: 2236921 - DNA, 14 bp, Homo sapiens
ctggggtgggaggg

SEQ ID NO: 2236922 - DNA, 15 bp, Homo sapiens
ctggggtgggagggt

SEQ ID NO: 2236923 - DNA, 22 bp, Homo sapiens
ctggggtgggagggtctgcagg

SEQ ID NO: 2236924 - DNA, 24 bp, Homo sapiens
ctggggtgggagggtctgcaggga

SEQ ID NO: 2236925 - DNA, 17 bp, Homo sapiens
ctggggtggggacctca

SEQ ID NO: 2236926 - DNA, 18 bp, Homo sapiens
ctggggtggggacctcag

SEQ ID NO: 2236927 - DNA, 23 bp, Homo sapiens
ctggggtggggacctcaggcctg

SEQ ID NO: 2236928 - DNA, 16 bp, Homo sapiens
ctgggtacttgtggac

SEQ ID NO: 2236929 - DNA, 19 bp, Homo sapiens
ctgggtacttgtggacaca

SEQ ID NO: 2236930 - DNA, 21 bp, Homo sapiens
ctgggtggcaccagcagcctg

SEQ ID NO: 2236931 - DNA, 22 bp, Homo sapiens
ctgggtggcaccagcagcctgg

SEQ ID NO: 2236932 - DNA, 14 bp, Homo sapiens
ctgggtgtggcgca

SEQ ID NO: 2236933 - DNA, 15 bp, Homo sapiens
ctgggtgtggcgcag

SEQ ID NO: 2236934 - DNA, 17 bp, Homo sapiens
ctgggtgtggcgcagca

SEQ ID NO: 2236935 - DNA, 20 bp, Homo sapiens
ctgggttcactgcaacctcc

SEQ ID NO: 2236936 - DNA, 16 bp, Homo sapiens
ctgggttctacccagg

SEQ ID NO: 2236937 - DNA, 19 bp, Homo sapiens
ctgggttctacccaggtgc

SEQ ID NO: 2236938 - DNA, 13 bp, Homo sapiens
ctgggttggaggg

SEQ ID NO: 2236939 - DNA, 17 bp, Homo sapiens
ctggtccatagagagca

SEQ ID NO: 2236940 - DNA, 23 bp, Homo sapiens
ctggtctcaaactcttgacctca

SEQ ID NO: 2236941 - DNA, 16 bp, Homo sapiens
ctggtggcagctcacc

SEQ ID NO: 2236942 - DNA, 18 bp, Homo sapiens
ctggtggcagctcacctc

SEQ ID NO: 2236943 - DNA, 20 bp, Homo sapiens
ctgtaatcctagcactttgg

SEQ ID NO: 2236944 - DNA, 14 bp, Homo sapiens
ctgtaatttgtgat

SEQ ID NO: 2236945 - DNA, 15 bp, Homo sapiens
ctgtaatttgtgata

SEQ ID NO: 2236946 - DNA, 18 bp, Homo sapiens
ctgtaatttgtgatacaa

SEQ ID NO: 2236947 - DNA, 22 bp, Homo sapiens
ctgtaatttgtgatacaatgct

SEQ ID NO: 2236948 - DNA, 14 bp, Homo sapiens
ctgtacagagccca

SEQ ID NO: 2236949 - DNA, 23 bp, Homo sapiens
ctgtacatgaaaacacatttttc

SEQ ID NO: 2236950 - DNA, 20 bp, Homo sapiens
ctgtacgtctgacaggcaat

SEQ ID NO: 2236951 - DNA, 21 bp, Homo sapiens
ctgtatcccatgagcctcagc

SEQ ID NO: 2236952 - DNA, 13 bp, Homo sapiens
ctgtcaattacag

SEQ ID NO: 2236953 - DNA, 18 bp, Homo sapiens
ctgtcagccattcctgtt

SEQ ID NO: 2236954 - DNA, 17 bp, Homo sapiens
ctgtcatttgagcaggg

SEQ ID NO: 2236955 - DNA, 20 bp, Homo sapiens
ctgtcatttgagcagggctc

SEQ ID NO: 2236956 - DNA, 22 bp, Homo sapiens
ctgtcatttgagcagggctcag

SEQ ID NO: 2236957 - DNA, 14 bp, Homo sapiens
ctgtccccctgaca

SEQ ID NO: 2236958 - DNA, 17 bp, Homo sapiens
ctgtccccgcactgggc

SEQ ID NO: 2236959 - DNA, 18 bp, Homo sapiens
ctgtccccgcactgggct

SEQ ID NO: 2236960 - DNA, 19 bp, Homo sapiens
ctgtccccgcactgggctt

SEQ ID NO: 2236961 - DNA, 22 bp, Homo sapiens
ctgtcccttacgtgagtcctgg

SEQ ID NO: 2236962 - DNA, 14 bp, Homo sapiens
ctgtcctacccacc

SEQ ID NO: 2236963 - DNA, 17 bp, Homo sapiens
ctgtcctactctgtgtc

SEQ ID NO: 2236964 - DNA, 20 bp, Homo sapiens
ctgtcctactctgtgtcagg

SEQ ID NO: 2236965 - DNA, 14 bp, Homo sapiens
ctgtcctgggagtg

SEQ ID NO: 2236966 - DNA, 13 bp, Homo sapiens
ctgtcgcccagtc

SEQ ID NO: 2236967 - DNA, 18 bp, Homo sapiens
ctgtctccatgtttgatg

SEQ ID NO: 2236968 - DNA, 15 bp, Homo sapiens
ctgtgaaaggaaaga

SEQ ID NO: 2236969 - DNA, 16 bp, Homo sapiens
ctgtgatggggccctg

SEQ ID NO: 2236970 - DNA, 16 bp, Homo sapiens
ctgtgccatgtgccag

SEQ ID NO: 2236971 - DNA, 19 bp, Homo sapiens
ctgtgctctggacaggcat

SEQ ID NO: 2236972 - DNA, 12 bp, Homo sapiens
ctgtgctgccct

SEQ ID NO: 2236973 - DNA, 19 bp, Homo sapiens
ctgtgctgccctgcccacc

SEQ ID NO: 2236974 - DNA, 22 bp, Homo sapiens
ctgtgggtttctaaagctgcca

SEQ ID NO: 2236975 - DNA, 20 bp, Homo sapiens
ctgtgtcagcatagaagtaa

SEQ ID NO: 2236976 - DNA, 19 bp, Homo sapiens
ctgtgtcaggtggggcagc

SEQ ID NO: 2236977 - DNA, 19 bp, Homo sapiens
ctgtgtcttgcaatggcag

SEQ ID NO: 2236978 - DNA, 18 bp, Homo sapiens
ctgtgtgtgcgcctacag

SEQ ID NO: 2236979 - DNA, 13 bp, Homo sapiens
ctgttactgtctt

SEQ ID NO: 2236980 - DNA, 17 bp, Homo sapiens
ctgttactgtcttcagt

SEQ ID NO: 2236981 - DNA, 14 bp, Homo sapiens
ctgttcagctccag

SEQ ID NO: 2236982 - DNA, 18 bp, Homo sapiens
ctgttcagctggttgagg

SEQ ID NO: 2236983 - DNA, 19 bp, Homo sapiens
ctgttcagctggttgaggt

SEQ ID NO: 2236984 - DNA, 14 bp, Homo sapiens
ctgttctctgccct

SEQ ID NO: 2236985 - DNA, 17 bp, Homo sapiens
ctgttctctgccctcca

SEQ ID NO: 2236986 - DNA, 16 bp, Homo sapiens
ctgttctggcagagtt

SEQ ID NO: 2236987 - DNA, 13 bp, Homo sapiens
ctgttctttctgg

SEQ ID NO: 2236988 - DNA, 14 bp, Homo sapiens
ctgttctttctggc

SEQ ID NO: 2236989 - DNA, 12 bp, Homo sapiens
ctgttggccagt

SEQ ID NO: 2236990 - DNA, 12 bp, Homo sapiens
ctgtttagataa

SEQ ID NO: 2236991 - DNA, 14 bp, Homo sapiens
ctgtttagataata

SEQ ID NO: 2236992 - DNA, 18 bp, Homo sapiens
ctgtttagataatacacc

SEQ ID NO: 2236993 - DNA, 17 bp, Homo sapiens
ctgtttcaaactttact

SEQ ID NO: 2236994 - DNA, 19 bp, Homo sapiens
ctgtttgctaagtgaggat

SEQ ID NO: 2236995 - DNA, 18 bp, Homo sapiens
ctgtttgtttctgaaagg

SEQ ID NO: 2236996 - DNA, 23 bp, Homo sapiens
ctgtttgtttctgaaagggacgc

SEQ ID NO: 2236997 - DNA, 13 bp, Homo sapiens
ctgttttctcttg

SEQ ID NO: 2236998 - DNA, 14 bp, Homo sapiens
ctgttttctcttga

SEQ ID NO: 2236999 - DNA, 17 bp, Homo sapiens
ctgttttctcttgagag

SEQ ID NO: 2237000 - DNA, 15 bp, Homo sapiens
cttaacttcacatat

SEQ ID NO: 2237001 - DNA, 22 bp, Homo sapiens
cttaacttcacatattgatttc

SEQ ID NO: 2237002 - DNA, 19 bp, Homo sapiens
cttaccctcatgttcttaa

SEQ ID NO: 2237003 - DNA, 21 bp, Homo sapiens
cttacctcggtgccttcctct

SEQ ID NO: 2237004 - DNA, 13 bp, Homo sapiens
cttacctgccagg

SEQ ID NO: 2237005 - DNA, 20 bp, Homo sapiens
cttacctgccaggaagccag

SEQ ID NO: 2237006 - DNA, 13 bp, Homo sapiens
cttactgtacatg

SEQ ID NO: 2237007 - DNA, 17 bp, Homo sapiens
cttagaagtcacacagt

SEQ ID NO: 2237008 - DNA, 20 bp, Homo sapiens
cttagaagtcacacagtatt

SEQ ID NO: 2237009 - DNA, 14 bp, Homo sapiens
cttagacagtccct

SEQ ID NO: 2237010 - DNA, 15 bp, Homo sapiens
cttagacagtccctg

SEQ ID NO: 2237011 - DNA, 13 bp, Homo sapiens
cttagatgtatat

SEQ ID NO: 2237012 - DNA, 21 bp, Homo sapiens
cttagcagggaaacagctaat

SEQ ID NO: 2237013 - DNA, 19 bp, Homo sapiens
cttagggaaggatacaaaa

SEQ ID NO: 2237014 - DNA, 18 bp, Homo sapiens
cttagtcactgagacagc

SEQ ID NO: 2237015 - DNA, 22 bp, Homo sapiens
cttagtcactgagacagcccgg

SEQ ID NO: 2237016 - DNA, 13 bp, Homo sapiens
cttatggaacact

SEQ ID NO: 2237017 - DNA, 19 bp, Homo sapiens
cttatggaacactctgaga

SEQ ID NO: 2237018 - DNA, 20 bp, Homo sapiens
gagatagccaaggccaaagg

SEQ ID NO: 2237019 - DNA, 18 bp, Homo sapiens
gagatcacgccactgcac

SEQ ID NO: 2237020 - DNA, 17 bp, Homo sapiens
gagatgtgcccccaccc

SEQ ID NO: 2237021 - DNA, 14 bp, Homo sapiens
gagattggaaggaa

SEQ ID NO: 2237022 - DNA, 21 bp, Homo sapiens
gagcaagacgctgtgctgccc

SEQ ID NO: 2237023 - DNA, 19 bp, Homo sapiens
gagcactctggggtgggag

SEQ ID NO: 2237024 - DNA, 22 bp, Homo sapiens
gagcactctggggtgggagggt

SEQ ID NO: 2237025 - DNA, 12 bp, Homo sapiens
gagcagagacca

SEQ ID NO: 2237026 - DNA, 17 bp, Homo sapiens
gagcagagaccatccct

SEQ ID NO: 2237027 - DNA, 21 bp, Homo sapiens
gagcagagaccatccctgaag

SEQ ID NO: 2237028 - DNA, 11 bp, Homo sapiens
gagcaggcagt

SEQ ID NO: 2237029 - DNA, 21 bp, Homo sapiens
gagcagggctcagcggggaca

SEQ ID NO: 2237030 - DNA, 15 bp, Homo sapiens
gagcatcaggccagg

SEQ ID NO: 2237031 - DNA, 16 bp, Homo sapiens
gagcatcaggccaggc

SEQ ID NO: 2237032 - DNA, 20 bp, Homo sapiens
gagcatcaggccaggccctc

SEQ ID NO: 2237033 - DNA, 22 bp, Homo sapiens
gagcatcaggccaggccctctg

SEQ ID NO: 2237034 - DNA, 22 bp, Homo sapiens
gagcatgcctggatggggctgc

SEQ ID NO: 2237035 - DNA, 19 bp, Homo sapiens
gagccactgcaccgggcca

SEQ ID NO: 2237036 - DNA, 15 bp, Homo sapiens
gagccagatttcact

SEQ ID NO: 2237037 - DNA, 18 bp, Homo sapiens
gagccagatttcactctc

SEQ ID NO: 2237038 - DNA, 19 bp, Homo sapiens
gagccagatttcactctcc

SEQ ID NO: 2237039 - DNA, 20 bp, Homo sapiens
gagccagatttcactctcct

SEQ ID NO: 2237040 - DNA, 23 bp, Homo sapiens
gagccagatttcactctccttgg

SEQ ID NO: 2237041 - DNA, 14 bp, Homo sapiens
gagccagggtctca

SEQ ID NO: 2237042 - DNA, 19 bp, Homo sapiens
gagccagggtctcactatg

SEQ ID NO: 2237043 - DNA, 13 bp, Homo sapiens
gagcccaccttgg

SEQ ID NO: 2237044 - DNA, 14 bp, Homo sapiens
gagccccgaggcct

SEQ ID NO: 2237045 - DNA, 17 bp, Homo sapiens
gagccccgaggccttct

SEQ ID NO: 2237046 - DNA, 13 bp, Homo sapiens
gagccctggtggc

SEQ ID NO: 2237047 - DNA, 21 bp, Homo sapiens
gagccgagatcacgccactgc

SEQ ID NO: 2237048 - DNA, 14 bp, Homo sapiens
gagcctcagcatcc

SEQ ID NO: 2237049 - DNA, 21 bp, Homo sapiens
gagcctcagcatcctggcacc

SEQ ID NO: 2237050 - DNA, 14 bp, Homo sapiens
gagcctcctgccct

SEQ ID NO: 2237051 - DNA, 21 bp, Homo sapiens
gagcctgggaggtcaaggctg

SEQ ID NO: 2237052 - DNA, 13 bp, Homo sapiens
gagccttccaggg

SEQ ID NO: 2237053 - DNA, 16 bp, Homo sapiens
gagccttccaggggtg

SEQ ID NO: 2237054 - DNA, 20 bp, Homo sapiens
gagccttccaggggtgggac

SEQ ID NO: 2237055 - DNA, 13 bp, Homo sapiens
gagccttgaactt

SEQ ID NO: 2237056 - DNA, 19 bp, Homo sapiens
gagccttgaactttgacct

SEQ ID NO: 2237057 - DNA, 15 bp, Homo sapiens
gagctgcctgttcag

SEQ ID NO: 2237058 - DNA, 18 bp, Homo sapiens
gagctgggtgtcaagagg

SEQ ID NO: 2237059 - DNA, 17 bp, Homo sapiens
gaggaagagaaaaaata

SEQ ID NO: 2237060 - DNA, 18 bp, Homo sapiens
gaggaagccgctggggcc

SEQ ID NO: 2237061 - DNA, 15 bp, Homo sapiens
gaggaatccagaccc

SEQ ID NO: 2237062 - DNA, 13 bp, Homo sapiens
gaggacagggagg

SEQ ID NO: 2237063 - DNA, 22 bp, Homo sapiens
gaggacagggaggtgaccccag

SEQ ID NO: 2237064 - DNA, 16 bp, Homo sapiens
gaggacttttctttgt

SEQ ID NO: 2237065 - DNA, 20 bp, Homo sapiens
gaggacttttctttgtggct

SEQ ID NO: 2237066 - DNA, 14 bp, Homo sapiens
gaggagagaggacc

SEQ ID NO: 2237067 - DNA, 22 bp, Homo sapiens
gaggaggggtgtgggcaccccc

SEQ ID NO: 2237068 - DNA, 16 bp, Homo sapiens
gaggattgcttgagct

SEQ ID NO: 2237069 - DNA, 18 bp, Homo sapiens
gaggcagccccattctgc

SEQ ID NO: 2237070 - DNA, 21 bp, Homo sapiens
gaggcagccccattctgcctg

SEQ ID NO: 2237071 - DNA, 22 bp, Homo sapiens
gaggcagccccattctgcctgc

SEQ ID NO: 2237072 - DNA, 21 bp, Homo sapiens
gaggcatttgtttgaactgat

SEQ ID NO: 2237073 - DNA, 13 bp, Homo sapiens
gaggccagagaca

SEQ ID NO: 2237074 - DNA, 20 bp, Homo sapiens
gaggccagagacacaagcct

SEQ ID NO: 2237075 - DNA, 20 bp, Homo sapiens
gaggccatgggcctcctgtg

SEQ ID NO: 2237076 - DNA, 23 bp, Homo sapiens
gaggccatgggcctcctgtgtgt

SEQ ID NO: 2237077 - DNA, 15 bp, Homo sapiens
gaggcccagagggcc

SEQ ID NO: 2237078 - DNA, 21 bp, Homo sapiens
gaggcccttctctccagcccc

SEQ ID NO: 2237079 - DNA, 22 bp, Homo sapiens
gaggcccttctctccagcccct

SEQ ID NO: 2237080 - DNA, 16 bp, Homo sapiens
gaggccttctctgaag

SEQ ID NO: 2237081 - DNA, 22 bp, Homo sapiens
gaggctagtgtggtgtttcctg

SEQ ID NO: 2237082 - DNA, 15 bp, Homo sapiens
gaggctctgcccttg

SEQ ID NO: 2237083 - DNA, 15 bp, Homo sapiens
gagggagggctccag

SEQ ID NO: 2237084 - DNA, 19 bp, Homo sapiens
gagggagggctccagacac

SEQ ID NO: 2237085 - DNA, 18 bp, Homo sapiens
gagggagtgacagaggca

SEQ ID NO: 2237086 - DNA, 21 bp, Homo sapiens
gagggagtgacagaggcagcc

SEQ ID NO: 2237087 - DNA, 21 bp, Homo sapiens
gagggcctgcaagggagtgag

SEQ ID NO: 2237088 - DNA, 13 bp, Homo sapiens
gagggctccagac

SEQ ID NO: 2237089 - DNA, 12 bp, Homo sapiens
gaggggaagaaa

SEQ ID NO: 2237090 - DNA, 15 bp, Homo sapiens
gagggggtggcctcc

SEQ ID NO: 2237091 - DNA, 15 bp, Homo sapiens
gaggggtgtgggcac

SEQ ID NO: 2237092 - DNA, 13 bp, Homo sapiens
gagggtaaggctg

SEQ ID NO: 2237093 - DNA, 13 bp, Homo sapiens
gagggtctgagga

SEQ ID NO: 2237094 - DNA, 21 bp, Homo sapiens
gaggtaaggaatacctgtccc

SEQ ID NO: 2237095 - DNA, 17 bp, Homo sapiens
gaggtcaaggctgcagt

SEQ ID NO: 2237096 - DNA, 13 bp, Homo sapiens
gaggtcagagcct

SEQ ID NO: 2237097 - DNA, 17 bp, Homo sapiens
gaggtcagagcctgcag

SEQ ID NO: 2237098 - DNA, 20 bp, Homo sapiens
gaggtcagagcctgcagtta

SEQ ID NO: 2237099 - DNA, 14 bp, Homo sapiens
gaggtctgttcttt

SEQ ID NO: 2237100 - DNA, 23 bp, Homo sapiens
gaggtgaccccaggtttctatgt

SEQ ID NO: 2237101 - DNA, 11 bp, Homo sapiens
gaggtgggagg

SEQ ID NO: 2237102 - DNA, 17 bp, Homo sapiens
gaggtgggatcctccag

SEQ ID NO: 2237103 - DNA, 18 bp, Homo sapiens
gaggtgggatcctccagg

SEQ ID NO: 2237104 - DNA, 21 bp, Homo sapiens
gaggtgggatcctccaggtgc

SEQ ID NO: 2237105 - DNA, 17 bp, Homo sapiens
gagtacgttgtgcattt

SEQ ID NO: 2237106 - DNA, 12 bp, Homo sapiens
gagtagctggga

SEQ ID NO: 2237107 - DNA, 18 bp, Homo sapiens
gagtaggaagactttgga

SEQ ID NO: 2237108 - DNA, 22 bp, Homo sapiens
gagtcagaagtttctgccgcag

SEQ ID NO: 2237109 - DNA, 19 bp, Homo sapiens
gagtccgaaagggacttgg

SEQ ID NO: 2237110 - DNA, 14 bp, Homo sapiens
gagtcgaggacagg

SEQ ID NO: 2237111 - DNA, 13 bp, Homo sapiens
gagtctgaaggct

SEQ ID NO: 2237112 - DNA, 15 bp, Homo sapiens
gagtctgaaggctgg

SEQ ID NO: 2237113 - DNA, 17 bp, Homo sapiens
gagtgaagctgggagaa

SEQ ID NO: 2237114 - DNA, 18 bp, Homo sapiens
gagtgacagaggcagccc

SEQ ID NO: 2237115 - DNA, 24 bp, Homo sapiens
gagtgagcactaaggtgtgctctg

SEQ ID NO: 2237116 - DNA, 23 bp, Homo sapiens
gagtgggggatcacagcctctga

SEQ ID NO: 2237117 - DNA, 13 bp, Homo sapiens
gagttacagacaa

SEQ ID NO: 2237118 - DNA, 15 bp, Homo sapiens
gagttacagacaaag

SEQ ID NO: 2237119 - DNA, 20 bp, Homo sapiens
gagttcatcttgaattgtaa

SEQ ID NO: 2237120 - DNA, 23 bp, Homo sapiens
gagttcatcttgaattgtaagga

SEQ ID NO: 2237121 - DNA, 14 bp, Homo sapiens
gagttgaagacaga

SEQ ID NO: 2237122 - DNA, 16 bp, Homo sapiens
gagttgattcagctct

SEQ ID NO: 2237123 - DNA, 16 bp, Homo sapiens
gagttgttacattttt

SEQ ID NO: 2237124 - DNA, 22 bp, Homo sapiens
gagttgttacatttttaagtgc

SEQ ID NO: 2237125 - DNA, 19 bp, Homo sapiens
gatacaggaaaagctgctg

SEQ ID NO: 2237126 - DNA, 23 bp, Homo sapiens
gatacaggaaaagctgctgacag

SEQ ID NO: 2237127 - DNA, 11 bp, Homo sapiens
gatactacagt

SEQ ID NO: 2237128 - DNA, 15 bp, Homo sapiens
gatagcacagaccct

SEQ ID NO: 2237129 - DNA, 17 bp, Homo sapiens
gatagcacagaccctgc

SEQ ID NO: 2237130 - DNA, 19 bp, Homo sapiens
gatagcacagaccctgccc

SEQ ID NO: 2237131 - DNA, 12 bp, Homo sapiens
gatagccaaggc

SEQ ID NO: 2237132 - DNA, 13 bp, Homo sapiens
gatagccaaggcc

SEQ ID NO: 2237133 - DNA, 22 bp, Homo sapiens
gatagccaaggccaaaggaagc

SEQ ID NO: 2237134 - DNA, 23 bp, Homo sapiens
gatcaaccccttcgctcctgtgt

SEQ ID NO: 2237135 - DNA, 14 bp, Homo sapiens
gatcacgccactgc

SEQ ID NO: 2237136 - DNA, 20 bp, Homo sapiens
gatcacggctcactgcagcc

SEQ ID NO: 2237137 - DNA, 19 bp, Homo sapiens
gatccaagctggtcccact

SEQ ID NO: 2237138 - DNA, 20 bp, Homo sapiens
gatccacccacctcagcctc

SEQ ID NO: 2237139 - DNA, 22 bp, Homo sapiens
gatccacccacctcagcctccc

SEQ ID NO: 2237140 - DNA, 17 bp, Homo sapiens
gatcccccgccccatcc

SEQ ID NO: 2237141 - DNA, 17 bp, Homo sapiens
ggagtgacagaggcagc

SEQ ID NO: 2237142 - DNA, 14 bp, Homo sapiens
ggagtgagctggtt

SEQ ID NO: 2237143 - DNA, 12 bp, Homo sapiens
ggagtgcagtga

SEQ ID NO: 2237144 - DNA, 14 bp, Homo sapiens
ggagtgcagtgagc

SEQ ID NO: 2237145 - DNA, 15 bp, Homo sapiens
ggagtgcagtgagcc

SEQ ID NO: 2237146 - DNA, 12 bp, Homo sapiens
ggagtgggccca

SEQ ID NO: 2237147 - DNA, 13 bp, Homo sapiens
ggatcccccgccc

SEQ ID NO: 2237148 - DNA, 12 bp, Homo sapiens
ggatcctccagg

SEQ ID NO: 2237149 - DNA, 13 bp, Homo sapiens
ggatcctccaggt

SEQ ID NO: 2237150 - DNA, 13 bp, Homo sapiens
ggatcctgagcca

SEQ ID NO: 2237151 - DNA, 19 bp, Homo sapiens
ggatcctgagccagatttc

SEQ ID NO: 2237152 - DNA, 20 bp, Homo sapiens
ggatcctgagccagatttca

SEQ ID NO: 2237153 - DNA, 22 bp, Homo sapiens
ggatgatctaggaagactttgg

SEQ ID NO: 2237154 - DNA, 21 bp, Homo sapiens
ggatgattggaggggggaggt

SEQ ID NO: 2237155 - DNA, 23 bp, Homo sapiens
ggatgcacagagttgttacattt

SEQ ID NO: 2237156 - DNA, 18 bp, Homo sapiens
ggatgcccaaagatgcag

SEQ ID NO: 2237157 - DNA, 18 bp, Homo sapiens
ggatgcctggtggcagct

SEQ ID NO: 2237158 - DNA, 15 bp, Homo sapiens
ggatgcttgtacata

SEQ ID NO: 2237159 - DNA, 23 bp, Homo sapiens
ggattaaacttaatctaaatgga

SEQ ID NO: 2237160 - DNA, 17 bp, Homo sapiens
ggattgctactgtccta

SEQ ID NO: 2237161 - DNA, 18 bp, Homo sapiens
ggcaactgcattggcttt

SEQ ID NO: 2237162 - DNA, 18 bp, Homo sapiens
ggcaagcacctcctgcct

SEQ ID NO: 2237163 - DNA, 20 bp, Homo sapiens
ggcacagaaaatggaagaca

SEQ ID NO: 2237164 - DNA, 13 bp, Homo sapiens
ggcacatcagcac

SEQ ID NO: 2237165 - DNA, 16 bp, Homo sapiens
ggcaccagcagcctgg

SEQ ID NO: 2237166 - DNA, 23 bp, Homo sapiens
ggcacccaccatcatgtctggct

SEQ ID NO: 2237167 - DNA, 23 bp, Homo sapiens
ggcacccccggcccagtgccccc

SEQ ID NO: 2237168 - DNA, 20 bp, Homo sapiens
ggcacccggcccctgctggt

SEQ ID NO: 2237169 - DNA, 18 bp, Homo sapiens
ggcactcagaagacactg

SEQ ID NO: 2237170 - DNA, 24 bp, Homo sapiens
ggcactgcttccagtgaggctctg

SEQ ID NO: 2237171 - DNA, 10 bp, Homo sapiens
ggcagagcag

SEQ ID NO: 2237172 - DNA, 15 bp, Homo sapiens
ggcagagcagagacc

SEQ ID NO: 2237173 - DNA, 17 bp, Homo sapiens
ggcagagttgaagacag

SEQ ID NO: 2237174 - DNA, 17 bp, Homo sapiens
ggcagccaggccacaag

SEQ ID NO: 2237175 - DNA, 20 bp, Homo sapiens
ggcagccccattctgcctgc

SEQ ID NO: 2237176 - DNA, 21 bp, Homo sapiens
ggcagccccattctgcctgcc

SEQ ID NO: 2237177 - DNA, 23 bp, Homo sapiens
ggcagccccattctgcctgccca

SEQ ID NO: 2237178 - DNA, 18 bp, Homo sapiens
ggcagctcacctctccct

SEQ ID NO: 2237179 - DNA, 22 bp, Homo sapiens
ggcagctcacctctcccttgga

SEQ ID NO: 2237180 - DNA, 21 bp, Homo sapiens
ggcagctcagagagggtggga

SEQ ID NO: 2237181 - DNA, 23 bp, Homo sapiens
ggcagctgcggtccacccaggag

SEQ ID NO: 2237182 - DNA, 18 bp, Homo sapiens
ggcagggtctcactctgt

SEQ ID NO: 2237183 - DNA, 13 bp, Homo sapiens
ggcaggtccaggg

SEQ ID NO: 2237184 - DNA, 19 bp, Homo sapiens
ggcagtgggagctgcctgt

SEQ ID NO: 2237185 - DNA, 20 bp, Homo sapiens
ggcagtggggctggaagcag

SEQ ID NO: 2237186 - DNA, 18 bp, Homo sapiens
ggcatgacacgaatattg

SEQ ID NO: 2237187 - DNA, 18 bp, Homo sapiens
ggcatgggaatgaatgtc

SEQ ID NO: 2237188 - DNA, 22 bp, Homo sapiens
ggcatgggaatgaatgtcagtg

SEQ ID NO: 2237189 - DNA, 18 bp, Homo sapiens
ggcatgtgatgagaggaa

SEQ ID NO: 2237190 - DNA, 23 bp, Homo sapiens
ggcatgtgatgagaggaaatcac

SEQ ID NO: 2237191 - DNA, 17 bp, Homo sapiens
ggcattccccaggaggc

SEQ ID NO: 2237192 - DNA, 18 bp, Homo sapiens
ggcattccccaggaggcc

SEQ ID NO: 2237193 - DNA, 14 bp, Homo sapiens
ggcatttgctgaat

SEQ ID NO: 2237194 - DNA, 17 bp, Homo sapiens
ggccaaactcacctgcc

SEQ ID NO: 2237195 - DNA, 16 bp, Homo sapiens
ggccacaagacccttg

SEQ ID NO: 2237196 - DNA, 17 bp, Homo sapiens
ggccagagacacaagcc

SEQ ID NO: 2237197 - DNA, 19 bp, Homo sapiens
ggccagatgcaccagccct

SEQ ID NO: 2237198 - DNA, 20 bp, Homo sapiens
ggccagatgcaccagccctt

SEQ ID NO: 2237199 - DNA, 20 bp, Homo sapiens
ggccagccttgaccattctc

SEQ ID NO: 2237200 - DNA, 17 bp, Homo sapiens
ggccaggccctctgccc

SEQ ID NO: 2237201 - DNA, 14 bp, Homo sapiens
ggccaggctggtct

SEQ ID NO: 2237202 - DNA, 18 bp, Homo sapiens
ggccaggctggtctcaaa

SEQ ID NO: 2237203 - DNA, 17 bp, Homo sapiens
ggccagttggtccccct

SEQ ID NO: 2237204 - DNA, 13 bp, Homo sapiens
ggccatgggcctc

SEQ ID NO: 2237205 - DNA, 17 bp, Homo sapiens
ggcccagagggcctgca

SEQ ID NO: 2237206 - DNA, 19 bp, Homo sapiens
ggcccagagggcctgcaag

SEQ ID NO: 2237207 - DNA, 21 bp, Homo sapiens
ggcccctcagggtccctggtg

SEQ ID NO: 2237208 - DNA, 12 bp, Homo sapiens
ggcccctgccac

SEQ ID NO: 2237209 - DNA, 13 bp, Homo sapiens
ggcccctgccacc

SEQ ID NO: 2237210 - DNA, 16 bp, Homo sapiens
ggcccctgccaccctg

SEQ ID NO: 2237211 - DNA, 17 bp, Homo sapiens
ggcccctgcccggctgc

SEQ ID NO: 2237212 - DNA, 20 bp, Homo sapiens
ggcccctgcccggctgcgga

SEQ ID NO: 2237213 - DNA, 23 bp, Homo sapiens
ggcccctgctggttcagggttgg

SEQ ID NO: 2237214 - DNA, 17 bp, Homo sapiens
ggccctctgcccactcc

SEQ ID NO: 2237215 - DNA, 19 bp, Homo sapiens
ggccctctgcccactccct

SEQ ID NO: 2237216 - DNA, 23 bp, Homo sapiens
ggcctcaagtgattctcctgcct

SEQ ID NO: 2237217 - DNA, 13 bp, Homo sapiens
ggcctcagtgcca

SEQ ID NO: 2237218 - DNA, 19 bp, Homo sapiens
ggcctcccaactcacccca

SEQ ID NO: 2237219 - DNA, 22 bp, Homo sapiens
ggcctcccaactcaccccagcc

SEQ ID NO: 2237220 - DNA, 10 bp, Homo sapiens
ggcctcccca

SEQ ID NO: 2237221 - DNA, 20 bp, Homo sapiens
ggcctcggtgtggagaagcg

SEQ ID NO: 2237222 - DNA, 14 bp, Homo sapiens
ggcctctgcactcc

SEQ ID NO: 2237223 - DNA, 19 bp, Homo sapiens
ggcctctgcactcccctgc

SEQ ID NO: 2237224 - DNA, 18 bp, Homo sapiens
ggcctggcccctcagggt

SEQ ID NO: 2237225 - DNA, 14 bp, Homo sapiens
ggcctggcctgagc

SEQ ID NO: 2237226 - DNA, 14 bp, Homo sapiens
ggcctgggggctgg

SEQ ID NO: 2237227 - DNA, 20 bp, Homo sapiens
ggcctgggggctgggcagag

SEQ ID NO: 2237228 - DNA, 21 bp, Homo sapiens
ggcctggggtaggaggaacag

SEQ ID NO: 2237229 - DNA, 23 bp, Homo sapiens
ggcctggggtaggaggaacaggt

SEQ ID NO: 2237230 - DNA, 24 bp, Homo sapiens
ggcgcagcatattcaggaagctca

SEQ ID NO: 2237231 - DNA, 17 bp, Homo sapiens
ggcgctgcccctggcag

SEQ ID NO: 2237232 - DNA, 18 bp, Homo sapiens
ggcgctgcccctggcagc

SEQ ID NO: 2237233 - DNA, 21 bp, Homo sapiens
ggcgctgcccctggcagcccc

SEQ ID NO: 2237234 - DNA, 19 bp, Homo sapiens
ggcgtgcagtggtgcgatc

SEQ ID NO: 2237235 - DNA, 12 bp, Homo sapiens
ggctaaaaagaa

SEQ ID NO: 2237236 - DNA, 17 bp, Homo sapiens
ggctaaaaagaatgcag

SEQ ID NO: 2237237 - DNA, 13 bp, Homo sapiens
ggctacctttgta

SEQ ID NO: 2237238 - DNA, 22 bp, Homo sapiens
ggctagaggttcaaagatattt

SEQ ID NO: 2237239 - DNA, 23 bp, Homo sapiens
ggctagtgtggtgtttcctggca

SEQ ID NO: 2237240 - DNA, 15 bp, Homo sapiens
ggctagttgggcttc

SEQ ID NO: 2237241 - DNA, 13 bp, Homo sapiens
ggctatgcatttg

SEQ ID NO: 2237242 - DNA, 15 bp, Homo sapiens
ggctcaagtcctctt

SEQ ID NO: 2237243 - DNA, 13 bp, Homo sapiens
ggctcactgcagc

SEQ ID NO: 2237244 - DNA, 17 bp, Homo sapiens
ggctcactgcagcctca

SEQ ID NO: 2237245 - DNA, 23 bp, Homo sapiens
ggctcagcaaaagatgcttctca

SEQ ID NO: 2237246 - DNA, 23 bp, Homo sapiens
ggctcagcggggacagctccttc

SEQ ID NO: 2237247 - DNA, 9 bp, Homo sapiens
ggctccaga

SEQ ID NO: 2237248 - DNA, 12 bp, Homo sapiens
ggctccaggagc

SEQ ID NO: 2237249 - DNA, 12 bp, Homo sapiens
ggctccaggctc

SEQ ID NO: 2237250 - DNA, 14 bp, Homo sapiens
ggctccaggctcct

SEQ ID NO: 2237251 - DNA, 13 bp, Homo sapiens
ggctcccttccca

SEQ ID NO: 2237252 - DNA, 22 bp, Homo sapiens
ggctcccttcccacctctctca

SEQ ID NO: 2237253 - DNA, 17 bp, Homo sapiens
ggctctcaggccagctg

SEQ ID NO: 2237254 - DNA, 15 bp, Homo sapiens
ggctctgcctcccat

SEQ ID NO: 2237255 - DNA, 16 bp, Homo sapiens
ggctctgcctcccatc

SEQ ID NO: 2237256 - DNA, 17 bp, Homo sapiens
ggctctgcctcccatca

SEQ ID NO: 2237257 - DNA, 15 bp, Homo sapiens
ggctcttccaggctg

SEQ ID NO: 2237258 - DNA, 17 bp, Homo sapiens
ggctcttccaggctggg

SEQ ID NO: 2237259 - DNA, 18 bp, Homo sapiens
ggctcttccaggctggga

SEQ ID NO: 2237260 - DNA, 23 bp, Homo sapiens
ggctcttccaggctgggagagcc

SEQ ID NO: 2237261 - DNA, 22 bp, Homo sapiens
ggctgcaaagggtatcaggtgc

SEQ ID NO: 2237262 - DNA, 13 bp, Homo sapiens
ggctgcagggagt

SEQ ID NO: 2237263 - DNA, 17 bp, Homo sapiens
ggctgcagggagtccga

SEQ ID NO: 2237264 - DNA, 17 bp, Homo sapiens
gtggacacagctcttct

SEQ ID NO: 2237265 - DNA, 22 bp, Homo sapiens
gtggacacagctcttctccagg

SEQ ID NO: 2237266 - DNA, 22 bp, Homo sapiens
gtggagaatttttactggggat

SEQ ID NO: 2237267 - DNA, 16 bp, Homo sapiens
gtggatgcctggtggc

SEQ ID NO: 2237268 - DNA, 18 bp, Homo sapiens
gtggatttaacagaaatg

SEQ ID NO: 2237269 - DNA, 21 bp, Homo sapiens
gtggatttaacagaaatgtac

SEQ ID NO: 2237270 - DNA, 23 bp, Homo sapiens
gtggatttaacagaaatgtacag

SEQ ID NO: 2237271 - DNA, 14 bp, Homo sapiens
gtggcaccagcagc

SEQ ID NO: 2237272 - DNA, 20 bp, Homo sapiens
gtggcagctcacctctccct

SEQ ID NO: 2237273 - DNA, 19 bp, Homo sapiens
gtggcagctgcttttgtct

SEQ ID NO: 2237274 - DNA, 15 bp, Homo sapiens
gtggcagtgggagct

SEQ ID NO: 2237275 - DNA, 13 bp, Homo sapiens
gtggcctcccaac

SEQ ID NO: 2237276 - DNA, 22 bp, Homo sapiens
gtggcttaaaacaacactcaca

SEQ ID NO: 2237277 - DNA, 13 bp, Homo sapiens
gtgggacaccctg

SEQ ID NO: 2237278 - DNA, 18 bp, Homo sapiens
gtgggagctgcctgttca

SEQ ID NO: 2237279 - DNA, 12 bp, Homo sapiens
gtgggaggggaa

SEQ ID NO: 2237280 - DNA, 14 bp, Homo sapiens
gtgggaggggaaga

SEQ ID NO: 2237281 - DNA, 15 bp, Homo sapiens
gtgggatcctccagg

SEQ ID NO: 2237282 - DNA, 15 bp, Homo sapiens
gtggggacctcaggc

SEQ ID NO: 2237283 - DNA, 18 bp, Homo sapiens
gtggggacctcaggcctg

SEQ ID NO: 2237284 - DNA, 14 bp, Homo sapiens
gtggggcctggggt

SEQ ID NO: 2237285 - DNA, 15 bp, Homo sapiens
gtggggtcactctgg

SEQ ID NO: 2237286 - DNA, 21 bp, Homo sapiens
gtggggtcactctggcagctc

SEQ ID NO: 2237287 - DNA, 17 bp, Homo sapiens
gtggtcccaccccacac

SEQ ID NO: 2237288 - DNA, 14 bp, Homo sapiens
gtggtgacctctgc

SEQ ID NO: 2237289 - DNA, 17 bp, Homo sapiens
gtggtgacctctgcctg

SEQ ID NO: 2237290 - DNA, 19 bp, Homo sapiens
gtggtgcgatctgggttca

SEQ ID NO: 2237291 - DNA, 19 bp, Homo sapiens
gtggtgtttcctggcactg

SEQ ID NO: 2237292 - DNA, 15 bp, Homo sapiens
gtggtttcagaaatg

SEQ ID NO: 2237293 - DNA, 17 bp, Homo sapiens
gtggttttctgttcttt

SEQ ID NO: 2237294 - DNA, 22 bp, Homo sapiens
gtgtacatggaataacatgtaa

SEQ ID NO: 2237295 - DNA, 20 bp, Homo sapiens
gtgtcccaaaaagaaaggag

SEQ ID NO: 2237296 - DNA, 18 bp, Homo sapiens
gtgtccctgcacttgcag

SEQ ID NO: 2237297 - DNA, 18 bp, Homo sapiens
gtgtctcttggtcctgct

SEQ ID NO: 2237298 - DNA, 19 bp, Homo sapiens
gtgtctcttggtcctgctg

SEQ ID NO: 2237299 - DNA, 19 bp, Homo sapiens
gtgtcttgcaatggcagcc

SEQ ID NO: 2237300 - DNA, 23 bp, Homo sapiens
gtgtgaaccaccacacccagccc

SEQ ID NO: 2237301 - DNA, 17 bp, Homo sapiens
gtgtgactactccccca

SEQ ID NO: 2237302 - DNA, 18 bp, Homo sapiens
gtgtgagtcaccaagccc

SEQ ID NO: 2237303 - DNA, 12 bp, Homo sapiens
gtgtgctctgat

SEQ ID NO: 2237304 - DNA, 15 bp, Homo sapiens
gtgtgctctgatcat

SEQ ID NO: 2237305 - DNA, 22 bp, Homo sapiens
gtgtgctctgatcatccactgt

SEQ ID NO: 2237306 - DNA, 16 bp, Homo sapiens
gtgtggtagagtgtgc

SEQ ID NO: 2237307 - DNA, 12 bp, Homo sapiens
gtgttactaagt

SEQ ID NO: 2237308 - DNA, 18 bp, Homo sapiens
gttaagagaaatgagctt

SEQ ID NO: 2237309 - DNA, 15 bp, Homo sapiens
gttacactaaaaggt

SEQ ID NO: 2237310 - DNA, 13 bp, Homo sapiens
gttacagacaaag

SEQ ID NO: 2237311 - DNA, 18 bp, Homo sapiens
gttacataagataaatgt

SEQ ID NO: 2237312 - DNA, 21 bp, Homo sapiens
gttacatttttaagtgctgca

SEQ ID NO: 2237313 - DNA, 22 bp, Homo sapiens
gttactaagtttttatggcttt

SEQ ID NO: 2237314 - DNA, 19 bp, Homo sapiens
gttaggcattgtgggaagg

SEQ ID NO: 2237315 - DNA, 20 bp, Homo sapiens
gttaggcattgtgggaaggg

SEQ ID NO: 2237316 - DNA, 21 bp, Homo sapiens
gttcaaagatattttgctttg

SEQ ID NO: 2237317 - DNA, 15 bp, Homo sapiens
gttcagctccagctc

SEQ ID NO: 2237318 - DNA, 17 bp, Homo sapiens
gttcagctccagctcac

SEQ ID NO: 2237319 - DNA, 18 bp, Homo sapiens
gttcagctccagctcacc

SEQ ID NO: 2237320 - DNA, 23 bp, Homo sapiens
gttcagcttgtaaatagctcagg

SEQ ID NO: 2237321 - DNA, 18 bp, Homo sapiens
gttcagggttggcccctg

SEQ ID NO: 2237322 - DNA, 21 bp, Homo sapiens
gttcagggttggcccctgccc

SEQ ID NO: 2237323 - DNA, 17 bp, Homo sapiens
gttcaggtaacaggcag

SEQ ID NO: 2237324 - DNA, 17 bp, Homo sapiens
gttcatcatcctaagct

SEQ ID NO: 2237325 - DNA, 18 bp, Homo sapiens
gttcatcttgaattgtaa

SEQ ID NO: 2237326 - DNA, 20 bp, Homo sapiens
gttccatggcctcttcagat

SEQ ID NO: 2237327 - DNA, 21 bp, Homo sapiens
gttcccttttttggctgctga

SEQ ID NO: 2237328 - DNA, 22 bp, Homo sapiens
gttcccttttttggctgctgaa

SEQ ID NO: 2237329 - DNA, 13 bp, Homo sapiens
gttctctccttct

SEQ ID NO: 2237330 - DNA, 12 bp, Homo sapiens
gttctctgagga

SEQ ID NO: 2237331 - DNA, 13 bp, Homo sapiens
gttctctgccctc

SEQ ID NO: 2237332 - DNA, 15 bp, Homo sapiens
gttctctgccctcca

SEQ ID NO: 2237333 - DNA, 16 bp, Homo sapiens
gttctggctcttccag

SEQ ID NO: 2237334 - DNA, 20 bp, Homo sapiens
gttctggctcttccaggctg

SEQ ID NO: 2237335 - DNA, 11 bp, Homo sapiens
gttctgggaca

SEQ ID NO: 2237336 - DNA, 12 bp, Homo sapiens
gttctgggacac

SEQ ID NO: 2237337 - DNA, 14 bp, Homo sapiens
gttctgggacacag

SEQ ID NO: 2237338 - DNA, 16 bp, Homo sapiens
gttctgggacacagtt

SEQ ID NO: 2237339 - DNA, 23 bp, Homo sapiens
gttctgggacacagttcaattct

SEQ ID NO: 2237340 - DNA, 13 bp, Homo sapiens
gttcttaattctt

SEQ ID NO: 2237341 - DNA, 14 bp, Homo sapiens
gttcttggtttgta

SEQ ID NO: 2237342 - DNA, 18 bp, Homo sapiens
gttcttggtttgtaaatt

SEQ ID NO: 2237343 - DNA, 21 bp, Homo sapiens
gttcttggtttgtaaattaac

SEQ ID NO: 2237344 - DNA, 13 bp, Homo sapiens
gttctttccaaag

SEQ ID NO: 2237345 - DNA, 20 bp, Homo sapiens
gttctttccaaagtacactg

SEQ ID NO: 2237346 - DNA, 22 bp, Homo sapiens
gttgatgatctttgcagacagg

SEQ ID NO: 2237347 - DNA, 13 bp, Homo sapiens
gttgccagtcacc

SEQ ID NO: 2237348 - DNA, 14 bp, Homo sapiens
gttgccagtcaccc

SEQ ID NO: 2237349 - DNA, 15 bp, Homo sapiens
gttgcccaggcaggt

SEQ ID NO: 2237350 - DNA, 18 bp, Homo sapiens
gttgcccaggcaggtctt

SEQ ID NO: 2237351 - DNA, 14 bp, Homo sapiens
gttgcccaggctgg

SEQ ID NO: 2237352 - DNA, 15 bp, Homo sapiens
gttgcccaggctggc

SEQ ID NO: 2237353 - DNA, 17 bp, Homo sapiens
gttgcccaggctggcgt

SEQ ID NO: 2237354 - DNA, 20 bp, Homo sapiens
gttggcccctgcccggctgc

SEQ ID NO: 2237355 - DNA, 17 bp, Homo sapiens
gttgggccaggagcctc

SEQ ID NO: 2237356 - DNA, 13 bp, Homo sapiens
gttgggctggtgt

SEQ ID NO: 2237357 - DNA, 14 bp, Homo sapiens
gttgttacattttt

SEQ ID NO: 2237358 - DNA, 21 bp, Homo sapiens
gtttaagtgactgatggctaa

SEQ ID NO: 2237359 - DNA, 13 bp, Homo sapiens
gtttattgtcaaa

SEQ ID NO: 2237360 - DNA, 20 bp, Homo sapiens
gtttcctggcactgcttcca

SEQ ID NO: 2237361 - DNA, 15 bp, Homo sapiens
gtttctaaagctgcc

SEQ ID NO: 2237362 - DNA, 16 bp, Homo sapiens
gtttctaaagctgcca

SEQ ID NO: 2237363 - DNA, 19 bp, Homo sapiens
gtttctatgtgtagggcgg

SEQ ID NO: 2237364 - DNA, 22 bp, Homo sapiens
gtttctgccgcagccctgcaga

SEQ ID NO: 2237365 - DNA, 17 bp, Homo sapiens
gtttgagatcagcctgg

SEQ ID NO: 2237366 - DNA, 22 bp, Homo sapiens
gtttgattaaattcttgcaaag

SEQ ID NO: 2237367 - DNA, 16 bp, Homo sapiens
gtttgcctctgcctct

SEQ ID NO: 2237368 - DNA, 20 bp, Homo sapiens
gtttgtttctgaaagggacg

SEQ ID NO: 2237369 - DNA, 22 bp, Homo sapiens
gttttaaggatgcttgtacata

SEQ ID NO: 2237370 - DNA, 12 bp, Homo sapiens
gttttcactctt

SEQ ID NO: 2237371 - DNA, 12 bp, Homo sapiens
gttttctcttga

SEQ ID NO: 2237372 - DNA, 16 bp, Homo sapiens
gttttgccatgttggc

SEQ ID NO: 2237373 - DNA, 21 bp, Homo sapiens
gttttgccatgttggccaggc

SEQ ID NO: 2237374 - DNA, 15 bp, Homo sapiens
gtttttcttctccct

SEQ ID NO: 2237375 - DNA, 17 bp, Homo sapiens
taaaaagggaaaaagac

SEQ ID NO: 2237376 - DNA, 15 bp, Homo sapiens
taaaaatctcaaatt

SEQ ID NO: 2237377 - DNA, 23 bp, Homo sapiens
taaaaatctcaaatttctaaatc

SEQ ID NO: 2237378 - DNA, 15 bp, Homo sapiens
taaaaatgaggtact

SEQ ID NO: 2237379 - DNA, 15 bp, Homo sapiens
taaaacaacactcac

SEQ ID NO: 2237380 - DNA, 22 bp, Homo sapiens
taaaacttgatgtgttatctct

SEQ ID NO: 2237381 - DNA, 14 bp, Homo sapiens
taaaagatacagtt

SEQ ID NO: 2237382 - DNA, 17 bp, Homo sapiens
taaaagatacagttact

SEQ ID NO: 2237383 - DNA, 18 bp, Homo sapiens
taaacaagaccacgtttc

SEQ ID NO: 2237384 - DNA, 21 bp, Homo sapiens
taaacaagaccacgtttctaa

SEQ ID NO: 2237385 - DNA, 18 bp, Homo sapiens
taaaccgccaaggctggg

SEQ ID NO: 2237386 - DNA, 13 bp, Homo sapiens
taaacttaatcta

SEQ ID NO: 2237387 - DNA, 14 bp, Homo sapiens
taaacttaatctaa

SEQ ID NO: 2237388 - DNA, 13 bp, Homo sapiens
tcccaagctctgc

SEQ ID NO: 2237389 - DNA, 17 bp, Homo sapiens
tcccaagctctgctcct

SEQ ID NO: 2237390 - DNA, 20 bp, Homo sapiens
tcccaccccacacacgccag

SEQ ID NO: 2237391 - DNA, 23 bp, Homo sapiens
tcccaccccctccccgggcagca

SEQ ID NO: 2237392 - DNA, 13 bp, Homo sapiens
tcccacctcagcc

SEQ ID NO: 2237393 - DNA, 18 bp, Homo sapiens
tcccacctcagcctcccg

SEQ ID NO: 2237394 - DNA, 14 bp, Homo sapiens
tcccacctctctca

SEQ ID NO: 2237395 - DNA, 17 bp, Homo sapiens
tcccacctctctcactc

SEQ ID NO: 2237396 - DNA, 17 bp, Homo sapiens
tcccaccttggctgcag

SEQ ID NO: 2237397 - DNA, 19 bp, Homo sapiens
tcccaccttggctgcaggg

SEQ ID NO: 2237398 - DNA, 13 bp, Homo sapiens
tcccagaccccct

SEQ ID NO: 2237399 - DNA, 16 bp, Homo sapiens
tcccagacccccttgc

SEQ ID NO: 2237400 - DNA, 17 bp, Homo sapiens
tcccagctgtgctctgg

SEQ ID NO: 2237401 - DNA, 18 bp, Homo sapiens
tcccaggcattccccagg

SEQ ID NO: 2237402 - DNA, 19 bp, Homo sapiens
tcccaggcattccccagga

SEQ ID NO: 2237403 - DNA, 22 bp, Homo sapiens
tcccaggcattccccaggaggc

SEQ ID NO: 2237404 - DNA, 16 bp, Homo sapiens
tcccatatgcctgggc

SEQ ID NO: 2237405 - DNA, 15 bp, Homo sapiens
tcccatcacccgcta

SEQ ID NO: 2237406 - DNA, 23 bp, Homo sapiens
tcccatctcacacatgagcatca

SEQ ID NO: 2237407 - DNA, 16 bp, Homo sapiens
tcccatgagcctcagc

SEQ ID NO: 2237408 - DNA, 17 bp, Homo sapiens
tcccatgagcctcagca

SEQ ID NO: 2237409 - DNA, 19 bp, Homo sapiens
tcccatgagcctcagcatc

SEQ ID NO: 2237410 - DNA, 21 bp, Homo sapiens
tccccaccgcagacaggacca

SEQ ID NO: 2237411 - DNA, 22 bp, Homo sapiens
tccccaccgcagacaggaccag

SEQ ID NO: 2237412 - DNA, 13 bp, Homo sapiens
tccccagattgca

SEQ ID NO: 2237413 - DNA, 15 bp, Homo sapiens
tccccaggaggccag

SEQ ID NO: 2237414 - DNA, 18 bp, Homo sapiens
tccccaggaggccagcct

SEQ ID NO: 2237415 - DNA, 21 bp, Homo sapiens
tccccaggaggccagccttga

SEQ ID NO: 2237416 - DNA, 23 bp, Homo sapiens
tccccaggaggccagccttgacc

SEQ ID NO: 2237417 - DNA, 11 bp, Homo sapiens
tcccccagccc

SEQ ID NO: 2237418 - DNA, 16 bp, Homo sapiens
tcccccagccccatcc

SEQ ID NO: 2237419 - DNA, 20 bp, Homo sapiens
tcccccagccccatcctctg

SEQ ID NO: 2237420 - DNA, 21 bp, Homo sapiens
tcccccagccccatcctctgt

SEQ ID NO: 2237421 - DNA, 22 bp, Homo sapiens
tcccccagccccatcctctgta

SEQ ID NO: 2237422 - DNA, 15 bp, Homo sapiens
tcccccttccatgga

SEQ ID NO: 2237423 - DNA, 13 bp, Homo sapiens
tccccgggcagca

SEQ ID NO: 2237424 - DNA, 14 bp, Homo sapiens
tccccgggcagcag

SEQ ID NO: 2237425 - DNA, 18 bp, Homo sapiens
tccccgggcagcagagag

SEQ ID NO: 2237426 - DNA, 20 bp, Homo sapiens
tccccgggcagcagagagag

SEQ ID NO: 2237427 - DNA, 15 bp, Homo sapiens
tcccctgctgggtgt

SEQ ID NO: 2237428 - DNA, 23 bp, Homo sapiens
tcccctgtccccgcactgggctt

SEQ ID NO: 2237429 - DNA, 20 bp, Homo sapiens
tcccctgtttgtttctgaaa

SEQ ID NO: 2237430 - DNA, 18 bp, Homo sapiens
tcccgaatagctgggact

SEQ ID NO: 2237431 - DNA, 15 bp, Homo sapiens
tccctactgtaattt

SEQ ID NO: 2237432 - DNA, 18 bp, Homo sapiens
tccctattagagaagaga

SEQ ID NO: 2237433 - DNA, 18 bp, Homo sapiens
tccctcagtctggccctt

SEQ ID NO: 2237434 - DNA, 22 bp, Homo sapiens
tccctcatcctcatacccaccc

SEQ ID NO: 2237435 - DNA, 15 bp, Homo sapiens
tccctccctctttcc

SEQ ID NO: 2237436 - DNA, 16 bp, Homo sapiens
tccctgaaggccccgc

SEQ ID NO: 2237437 - DNA, 21 bp, Homo sapiens
tccctgaaggccccgcccagg

SEQ ID NO: 2237438 - DNA, 13 bp, Homo sapiens
tccctgcacttgc

SEQ ID NO: 2237439 - DNA, 14 bp, Homo sapiens
tccctgcacttgca

SEQ ID NO: 2237440 - DNA, 20 bp, Homo sapiens
tccctgcacttgcagactct

SEQ ID NO: 2237441 - DNA, 19 bp, Homo sapiens
tccctgcggaagccacagg

SEQ ID NO: 2237442 - DNA, 15 bp, Homo sapiens
tccctggtggcagct

SEQ ID NO: 2237443 - DNA, 18 bp, Homo sapiens
tccctggtggcagctcac

SEQ ID NO: 2237444 - DNA, 19 bp, Homo sapiens
tccctggtggcagctcacc

SEQ ID NO: 2237445 - DNA, 12 bp, Homo sapiens
tccctgtcccag

SEQ ID NO: 2237446 - DNA, 17 bp, Homo sapiens
tcccttacgtgagtcct

SEQ ID NO: 2237447 - DNA, 18 bp, Homo sapiens
tcccttacgtgagtcctg

SEQ ID NO: 2237448 - DNA, 19 bp, Homo sapiens
tcccttggattgtccccga

SEQ ID NO: 2237449 - DNA, 16 bp, Homo sapiens
tccctttgacgccatc

SEQ ID NO: 2237450 - DNA, 19 bp, Homo sapiens
tccctttgacgccatccca

SEQ ID NO: 2237451 - DNA, 23 bp, Homo sapiens
tccctttgacgccatcccagccc

SEQ ID NO: 2237452 - DNA, 19 bp, Homo sapiens
tcccttttttggctgctga

SEQ ID NO: 2237453 - DNA, 22 bp, Homo sapiens
tccgaaagggacttggaagctc

SEQ ID NO: 2237454 - DNA, 14 bp, Homo sapiens
tccgcctcttgggt

SEQ ID NO: 2237455 - DNA, 17 bp, Homo sapiens
tccggtccctgtcccag

SEQ ID NO: 2237456 - DNA, 13 bp, Homo sapiens
tccgttaaaatac

SEQ ID NO: 2237457 - DNA, 13 bp, Homo sapiens
tcctactctgtgt

SEQ ID NO: 2237458 - DNA, 15 bp, Homo sapiens
tcctactctgtgtca

SEQ ID NO: 2237459 - DNA, 22 bp, Homo sapiens
tcctagaaattccccaccctga

SEQ ID NO: 2237460 - DNA, 21 bp, Homo sapiens
tcctatattgttttcagtgta

SEQ ID NO: 2237461 - DNA, 14 bp, Homo sapiens
tcctcatacccacc

SEQ ID NO: 2237462 - DNA, 18 bp, Homo sapiens
tcctcattagcattttgc

SEQ ID NO: 2237463 - DNA, 13 bp, Homo sapiens
tcctccaggtgca

SEQ ID NO: 2237464 - DNA, 14 bp, Homo sapiens
tcctccaggtgcac

SEQ ID NO: 2237465 - DNA, 19 bp, Homo sapiens
tcctcctgcccccacccca

SEQ ID NO: 2237466 - DNA, 20 bp, Homo sapiens
tcctcctgcccccaccccag

SEQ ID NO: 2237467 - DNA, 21 bp, Homo sapiens
tcctctaggaggtctctaaga

SEQ ID NO: 2237468 - DNA, 15 bp, Homo sapiens
tcctctgtacagagc

SEQ ID NO: 2237469 - DNA, 23 bp, Homo sapiens
tcctctgtacagagcccacgccc

SEQ ID NO: 2237470 - DNA, 22 bp, Homo sapiens
tcctctttggtctacactgtgc

SEQ ID NO: 2237471 - DNA, 23 bp, Homo sapiens
tcctctttggtctacactgtgct

SEQ ID NO: 2237472 - DNA, 19 bp, Homo sapiens
tcctgagccagatttcact

SEQ ID NO: 2237473 - DNA, 12 bp, Homo sapiens
tcctgaggctgg

SEQ ID NO: 2237474 - DNA, 16 bp, Homo sapiens
tcctgaggctgggctc

SEQ ID NO: 2237475 - DNA, 19 bp, Homo sapiens
tcctgatgcttcttcagag

SEQ ID NO: 2237476 - DNA, 13 bp, Homo sapiens
tcctgcaggcagc

SEQ ID NO: 2237477 - DNA, 22 bp, Homo sapiens
tcctgcaggcagccaggccaca

SEQ ID NO: 2237478 - DNA, 15 bp, Homo sapiens
tcctgcccccacccc

SEQ ID NO: 2237479 - DNA, 17 bp, Homo sapiens
tcctgcccttacctgcc

SEQ ID NO: 2237480 - DNA, 21 bp, Homo sapiens
tcctgcctcgaactggctgca

SEQ ID NO: 2237481 - DNA, 21 bp, Homo sapiens
tcctgctgcagttgccagtca

SEQ ID NO: 2237482 - DNA, 14 bp, Homo sapiens
tcctggagttctgg

SEQ ID NO: 2237483 - DNA, 16 bp, Homo sapiens
tcctggcacccggccc

SEQ ID NO: 2237484 - DNA, 22 bp, Homo sapiens
tcctggcacccggcccctgctg

SEQ ID NO: 2237485 - DNA, 23 bp, Homo sapiens
tcctggcacccggcccctgctgg

SEQ ID NO: 2237486 - DNA, 22 bp, Homo sapiens
tcctggcactgcttccagtgag

SEQ ID NO: 2237487 - DNA, 14 bp, Homo sapiens
tcctgggagtgagc

SEQ ID NO: 2237488 - DNA, 15 bp, Homo sapiens
tcctggtgtggaaga

SEQ ID NO: 2237489 - DNA, 22 bp, Homo sapiens
tcctgtacctcttgagccttga

SEQ ID NO: 2237490 - DNA, 24 bp, Homo sapiens
tcctgtgtcttgcaatggcagcct

SEQ ID NO: 2237491 - DNA, 13 bp, Homo sapiens
tcctgtgtgtgcg

SEQ ID NO: 2237492 - DNA, 14 bp, Homo sapiens
tccttaccagcaga

SEQ ID NO: 2237493 - DNA, 18 bp, Homo sapiens
tccttaccagcagagcac

SEQ ID NO: 2237494 - DNA, 21 bp, Homo sapiens
tccttaccagcagagcacctt

SEQ ID NO: 2237495 - DNA, 20 bp, Homo sapiens
tccttcacctttgtccccac

SEQ ID NO: 2237496 - DNA, 11 bp, Homo sapiens
tccttcagtgc

SEQ ID NO: 2237497 - DNA, 15 bp, Homo sapiens
tccttcagtgcctta

SEQ ID NO: 2237498 - DNA, 20 bp, Homo sapiens
tccttcagtgccttatggaa

SEQ ID NO: 2237499 - DNA, 22 bp, Homo sapiens
tccttcagtgccttatggaaca

SEQ ID NO: 2237500 - DNA, 12 bp, Homo sapiens
tccttctgtcct

SEQ ID NO: 2237501 - DNA, 19 bp, Homo sapiens
tccttctgtcctactctgt

SEQ ID NO: 2237502 - DNA, 19 bp, Homo sapiens
tcctttagcgcccagttgg

SEQ ID NO: 2237503 - DNA, 15 bp, Homo sapiens
tcctttcaccacatg

SEQ ID NO: 2237504 - DNA, 17 bp, Homo sapiens
tcctttgtgaggaagcc

SEQ ID NO: 2237505 - DNA, 22 bp, Homo sapiens
tccttttcgcaggattcttcct

SEQ ID NO: 2237506 - DNA, 15 bp, Homo sapiens
tcgaactggctgcaa

SEQ ID NO: 2237507 - DNA, 16 bp, Homo sapiens
tcgagcatgcctggat

SEQ ID NO: 2237508 - DNA, 14 bp, Homo sapiens
tcgaggacagggag

SEQ ID NO: 2237509 - DNA, 17 bp, Homo sapiens
tcgaggacagggaggtg

SEQ ID NO: 2237510 - DNA, 17 bp, Homo sapiens
tcgagttacagacaaag

SEQ ID NO: 2237511 - DNA, 14 bp, Homo sapiens
tgcactccagcctg

SEQ ID NO: 2237512 - DNA, 12 bp, Homo sapiens
tgcactcccctg

SEQ ID NO: 2237513 - DNA, 21 bp, Homo sapiens
tgcactgacattgttggccaa

SEQ ID NO: 2237514 - DNA, 12 bp, Homo sapiens
tgcactttgttc

SEQ ID NO: 2237515 - DNA, 19 bp, Homo sapiens
tgcactttgttctggctct

SEQ ID NO: 2237516 - DNA, 12 bp, Homo sapiens
tgcagacaggca

SEQ ID NO: 2237517 - DNA, 18 bp, Homo sapiens
tgcagagatgtgccccca

SEQ ID NO: 2237518 - DNA, 20 bp, Homo sapiens
tgcagcaataaagcagcgtt

SEQ ID NO: 2237519 - DNA, 18 bp, Homo sapiens
tgcagcctcaacctcctg

SEQ ID NO: 2237520 - DNA, 19 bp, Homo sapiens
tgcagcctcaacctcctgg

SEQ ID NO: 2237521 - DNA, 15 bp, Homo sapiens
tgcagcctcacagtc

SEQ ID NO: 2237522 - DNA, 17 bp, Homo sapiens
tgcagcctcacagtcct

SEQ ID NO: 2237523 - DNA, 17 bp, Homo sapiens
tgcaggcagccaggcca

SEQ ID NO: 2237524 - DNA, 18 bp, Homo sapiens
tgcaggcagccaggccac

SEQ ID NO: 2237525 - DNA, 14 bp, Homo sapiens
tgcagtgagccgag

SEQ ID NO: 2237526 - DNA, 20 bp, Homo sapiens
tgcataccacttttgttctt

SEQ ID NO: 2237527 - DNA, 21 bp, Homo sapiens
tgcataccacttttgttcttg

SEQ ID NO: 2237528 - DNA, 22 bp, Homo sapiens
tgcatgaagtaatatgcacaca

SEQ ID NO: 2237529 - DNA, 21 bp, Homo sapiens
tgcatgaggctagtgtggtgt

SEQ ID NO: 2237530 - DNA, 13 bp, Homo sapiens
tgcatgctgtccc

SEQ ID NO: 2237531 - DNA, 14 bp, Homo sapiens
tgcatgctgtccct

SEQ ID NO: 2237532 - DNA, 19 bp, Homo sapiens
tgcatgctgtcccttacgt

SEQ ID NO: 2237533 - DNA, 17 bp, Homo sapiens
tgcattatctagatact

SEQ ID NO: 2237534 - DNA, 16 bp, Homo sapiens
tgcatttaaaagatac

SEQ ID NO: 2237535 - DNA, 23 bp, Homo sapiens
tgcatttgaaaattttgatgttt

SEQ ID NO: 2237536 - DNA, 18 bp, Homo sapiens
tgcatttgaggtctgttc

SEQ ID NO: 2237537 - DNA, 19 bp, Homo sapiens
tgcatttgaggtctgttct

SEQ ID NO: 2237538 - DNA, 21 bp, Homo sapiens
tgcatttggtggtttcagaaa

SEQ ID NO: 2237539 - DNA, 13 bp, Homo sapiens
tgccaatggacta

SEQ ID NO: 2237540 - DNA, 20 bp, Homo sapiens
tgccaccctggggagaaagt

SEQ ID NO: 2237541 - DNA, 22 bp, Homo sapiens
tgccagccgagatagccaaggc

SEQ ID NO: 2237542 - DNA, 16 bp, Homo sapiens
tgccaggaagccagca

SEQ ID NO: 2237543 - DNA, 17 bp, Homo sapiens
tgccaggtttttggtct

SEQ ID NO: 2237544 - DNA, 18 bp, Homo sapiens
tgccagtcaccccggcca

SEQ ID NO: 2237545 - DNA, 16 bp, Homo sapiens
tgccatattctgttgg

SEQ ID NO: 2237546 - DNA, 21 bp, Homo sapiens
tgccatccaggttcagcttgt

SEQ ID NO: 2237547 - DNA, 15 bp, Homo sapiens
tgccatgtgccaggt

SEQ ID NO: 2237548 - DNA, 17 bp, Homo sapiens
tgccatgttggccaggc

SEQ ID NO: 2237549 - DNA, 19 bp, Homo sapiens
tgccatgttggccaggctg

SEQ ID NO: 2237550 - DNA, 18 bp, Homo sapiens
tgcccacgctggagtgca

SEQ ID NO: 2237551 - DNA, 15 bp, Homo sapiens
tgcccactccctgca

SEQ ID NO: 2237552 - DNA, 21 bp, Homo sapiens
tgcccactccctgcaacctga

SEQ ID NO: 2237553 - DNA, 11 bp, Homo sapiens
tgcccagcccc

SEQ ID NO: 2237554 - DNA, 12 bp, Homo sapiens
tgcccaggcagg

SEQ ID NO: 2237555 - DNA, 13 bp, Homo sapiens
tgcccaggcaggt

SEQ ID NO: 2237556 - DNA, 15 bp, Homo sapiens
tgcccaggcaggtct

SEQ ID NO: 2237557 - DNA, 17 bp, Homo sapiens
tgcccaggcaggtcttg

SEQ ID NO: 2237558 - DNA, 10 bp, Homo sapiens
tgcccaggcc

SEQ ID NO: 2237559 - DNA, 17 bp, Homo sapiens
tgcccaggcccctgcca

SEQ ID NO: 2237560 - DNA, 20 bp, Homo sapiens
tgcccaggcccctgccaccc

SEQ ID NO: 2237561 - DNA, 11 bp, Homo sapiens
tgcccaggctg

SEQ ID NO: 2237562 - DNA, 13 bp, Homo sapiens
tgcccaggctggc

SEQ ID NO: 2237563 - DNA, 20 bp, Homo sapiens
tgcccaggctggcgtgcagt

SEQ ID NO: 2237564 - DNA, 11 bp, Homo sapiens
tgcccccaccc

SEQ ID NO: 2237565 - DNA, 13 bp, Homo sapiens
tgcccccacccca

SEQ ID NO: 2237566 - DNA, 16 bp, Homo sapiens
tgcccccaccccaggc

SEQ ID NO: 2237567 - DNA, 19 bp, Homo sapiens
tgcccccaccccaggctgg

SEQ ID NO: 2237568 - DNA, 15 bp, Homo sapiens
tgcccccacccccac

SEQ ID NO: 2237569 - DNA, 19 bp, Homo sapiens
tgcccctcaactctcctcc

SEQ ID NO: 2237570 - DNA, 16 bp, Homo sapiens
tgcccctggcagcccc

SEQ ID NO: 2237571 - DNA, 17 bp, Homo sapiens
tgccctaaagtgtattt

SEQ ID NO: 2237572 - DNA, 20 bp, Homo sapiens
tgccctaaagtgtatttttt

SEQ ID NO: 2237573 - DNA, 14 bp, Homo sapiens
tgccctcccacccc

SEQ ID NO: 2237574 - DNA, 17 bp, Homo sapiens
tgccctcccaccccctc

SEQ ID NO: 2237575 - DNA, 21 bp, Homo sapiens
tgccctcccaccccctccccg

SEQ ID NO: 2237576 - DNA, 17 bp, Homo sapiens
tgccctcccagaccccc

SEQ ID NO: 2237577 - DNA, 19 bp, Homo sapiens
tgccctcccagaccccctt

SEQ ID NO: 2237578 - DNA, 16 bp, Homo sapiens
tgccctgcccacctgg

SEQ ID NO: 2237579 - DNA, 23 bp, Homo sapiens
tgccctgcccacctggcctctgc

SEQ ID NO: 2237580 - DNA, 19 bp, Homo sapiens
tgcccttacctgccaggaa

SEQ ID NO: 2237581 - DNA, 22 bp, Homo sapiens
tgcccttacctgccaggaagcc

SEQ ID NO: 2237582 - DNA, 20 bp, Homo sapiens
tgccgcagccctgcagaggg

SEQ ID NO: 2237583 - DNA, 15 bp, Homo sapiens
tgccgtctacctgag

SEQ ID NO: 2237584 - DNA, 19 bp, Homo sapiens
tgccgtctacctgaggggc

SEQ ID NO: 2237585 - DNA, 15 bp, Homo sapiens
tgcctcaagagaagg

SEQ ID NO: 2237586 - DNA, 16 bp, Homo sapiens
tgcctcctttgtgagg

SEQ ID NO: 2237587 - DNA, 17 bp, Homo sapiens
tgcctcctttgtgagga

SEQ ID NO: 2237588 - DNA, 16 bp, Homo sapiens
tgcctctctcaggcca

SEQ ID NO: 2237589 - DNA, 21 bp, Homo sapiens
tgcctctgacacacagctctg

SEQ ID NO: 2237590 - DNA, 11 bp, Homo sapiens
tgcctctgcct

SEQ ID NO: 2237591 - DNA, 15 bp, Homo sapiens
tgcctctgcctctga

SEQ ID NO: 2237592 - DNA, 17 bp, Homo sapiens
tgcctgaagtcacacag

SEQ ID NO: 2237593 - DNA, 14 bp, Homo sapiens
tgcctgcccaggcc

SEQ ID NO: 2237594 - DNA, 16 bp, Homo sapiens
tgcctgcccaggcccc

SEQ ID NO: 2237595 - DNA, 17 bp, Homo sapiens
tgcctgcccaggcccct

SEQ ID NO: 2237596 - DNA, 20 bp, Homo sapiens
tgcctgcccaggcccctgcc

SEQ ID NO: 2237597 - DNA, 14 bp, Homo sapiens
tgcctggatggggc

SEQ ID NO: 2237598 - DNA, 17 bp, Homo sapiens
tgcctggatggggctgc

SEQ ID NO: 2237599 - DNA, 21 bp, Homo sapiens
tgcctggatggggctgcaccg

SEQ ID NO: 2237600 - DNA, 14 bp, Homo sapiens
tgcctggtggcagc

SEQ ID NO: 2237601 - DNA, 19 bp, Homo sapiens
tgcctggtggcagctgcgg

SEQ ID NO: 2237602 - DNA, 17 bp, Homo sapiens
tgcctgttgggccagga

SEQ ID NO: 2237603 - DNA, 16 bp, Homo sapiens
tgccttggggacaaga

SEQ ID NO: 2237604 - DNA, 13 bp, Homo sapiens
tgcgaaaggatga

SEQ ID NO: 2237605 - DNA, 14 bp, Homo sapiens
tgcgatctgggttc

SEQ ID NO: 2237606 - DNA, 13 bp, Homo sapiens
tgcgcctacagga

SEQ ID NO: 2237607 - DNA, 15 bp, Homo sapiens
tgcggaagccacagg

SEQ ID NO: 2237608 - DNA, 17 bp, Homo sapiens
tgcgggggagcaggcag

SEQ ID NO: 2237609 - DNA, 14 bp, Homo sapiens
tgcggtccacccag

SEQ ID NO: 2237610 - DNA, 13 bp, Homo sapiens
tgctatctccccc

SEQ ID NO: 2237611 - DNA, 14 bp, Homo sapiens
tgctatctccccca

SEQ ID NO: 2237612 - DNA, 16 bp, Homo sapiens
tgctccagctgttcag

SEQ ID NO: 2237613 - DNA, 21 bp, Homo sapiens
tgctccagctgttcagctggt

SEQ ID NO: 2237614 - DNA, 18 bp, Homo sapiens
tgctcctctccccagcaa

SEQ ID NO: 2237615 - DNA, 14 bp, Homo sapiens
tgctctgctgacag

SEQ ID NO: 2237616 - DNA, 18 bp, Homo sapiens
tgctgaatacagaggcaa

SEQ ID NO: 2237617 - DNA, 23 bp, Homo sapiens
tgctgaatacagaggcaactgca

SEQ ID NO: 2237618 - DNA, 18 bp, Homo sapiens
tgctgaatggttttcaaa

SEQ ID NO: 2237619 - DNA, 15 bp, Homo sapiens
tgctgacagacacag

SEQ ID NO: 2237620 - DNA, 16 bp, Homo sapiens
tgctgactgttttctc

SEQ ID NO: 2237621 - DNA, 17 bp, Homo sapiens
tgctgactgttttctct

SEQ ID NO: 2237622 - DNA, 16 bp, Homo sapiens
tgctgagtctgaaggc

SEQ ID NO: 2237623 - DNA, 18 bp, Homo sapiens
tgctgagtctgaaggctg

SEQ ID NO: 2237624 - DNA, 22 bp, Homo sapiens
tgctgagtctgaaggctgggtt

SEQ ID NO: 2237625 - DNA, 17 bp, Homo sapiens
tgctgatggtgcaatga

SEQ ID NO: 2237626 - DNA, 23 bp, Homo sapiens
tgctgatggtgcaatgacctttc

SEQ ID NO: 2237627 - DNA, 15 bp, Homo sapiens
tgctgccatccaggt

SEQ ID NO: 2237628 - DNA, 10 bp, Homo sapiens
tgctgccctg

SEQ ID NO: 2237629 - DNA, 19 bp, Homo sapiens
tgctgccctgcccacctgg

SEQ ID NO: 2237630 - DNA, 12 bp, Homo sapiens
tgctgccctgtg

SEQ ID NO: 2237631 - DNA, 13 bp, Homo sapiens
tgctgccctgtga

SEQ ID NO: 2237632 - DNA, 20 bp, Homo sapiens
tgctgggattacaggtgtga

SEQ ID NO: 2237633 - DNA, 19 bp, Homo sapiens
tgctgtcccttacgtgagt

SEQ ID NO: 2237634 - DNA, 15 bp, Homo sapiens
tgctgtcccttttcc

SEQ ID NO: 2237635 - DNA, 13 bp, Homo sapiens
tgcttatacactt

SEQ ID NO: 2237636 - DNA, 14 bp, Homo sapiens
ttcccaagctctgc

SEQ ID NO: 2237637 - DNA, 18 bp, Homo sapiens
ttcccaagctctgctcct

SEQ ID NO: 2237638 - DNA, 16 bp, Homo sapiens
ttccccaggaggccag

SEQ ID NO: 2237639 - DNA, 15 bp, Homo sapiens
ttccctattagagaa

SEQ ID NO: 2237640 - DNA, 11 bp, Homo sapiens
ttccctccctt

SEQ ID NO: 2237641 - DNA, 14 bp, Homo sapiens
ttccgttaaaatac

SEQ ID NO: 2237642 - DNA, 15 bp, Homo sapiens
ttcctaatcctctag

SEQ ID NO: 2237643 - DNA, 17 bp, Homo sapiens
ttcctaatcctctagga

SEQ ID NO: 2237644 - DNA, 23 bp, Homo sapiens
ttcctcatagtatggtggctggg

SEQ ID NO: 2237645 - DNA, 19 bp, Homo sapiens
ttcctccctccctctttcc

SEQ ID NO: 2237646 - DNA, 13 bp, Homo sapiens
ttcctctttccat

SEQ ID NO: 2237647 - DNA, 22 bp, Homo sapiens
ttcctctttccatctaccctcc

SEQ ID NO: 2237648 - DNA, 22 bp, Homo sapiens
ttcctctttttatttagttcct

SEQ ID NO: 2237649 - DNA, 20 bp, Homo sapiens
ttcctgaggctgggctccct

SEQ ID NO: 2237650 - DNA, 11 bp, Homo sapiens
ttcctgtgtct

SEQ ID NO: 2237651 - DNA, 11 bp, Homo sapiens
ttccttcagtg

SEQ ID NO: 2237652 - DNA, 14 bp, Homo sapiens
ttccttcagtgcct

SEQ ID NO: 2237653 - DNA, 15 bp, Homo sapiens
ttccttcagtgcctt

SEQ ID NO: 2237654 - DNA, 21 bp, Homo sapiens
ttcgcaggattcttcctccct

SEQ ID NO: 2237655 - DNA, 15 bp, Homo sapiens
ttcgctcctgtgtct

SEQ ID NO: 2237656 - DNA, 19 bp, Homo sapiens
ttcgctcctgtgtcttgca

SEQ ID NO: 2237657 - DNA, 20 bp, Homo sapiens
ttcgggaggtcgaggcagga

SEQ ID NO: 2237658 - DNA, 16 bp, Homo sapiens
ttctaaaggctacctt

SEQ ID NO: 2237659 - DNA, 19 bp, Homo sapiens
ttctaaaggctacctttgt

SEQ ID NO: 2237660 - DNA, 20 bp, Homo sapiens
ttctaaaggctacctttgta

SEQ ID NO: 2237661 - DNA, 21 bp, Homo sapiens
ttctaaatctccaaaataaaa

SEQ ID NO: 2237662 - DNA, 14 bp, Homo sapiens
ttctacccaggtgc

SEQ ID NO: 2237663 - DNA, 22 bp, Homo sapiens
ttctactcgagttacagacaaa

SEQ ID NO: 2237664 - DNA, 21 bp, Homo sapiens
ttctcactgccatgccagctt

SEQ ID NO: 2237665 - DNA, 13 bp, Homo sapiens
ttctcagaatctc

SEQ ID NO: 2237666 - DNA, 19 bp, Homo sapiens
ttctcagaatctcaaataa

SEQ ID NO: 2237667 - DNA, 22 bp, Homo sapiens
ttctcagaatctcaaataacta

SEQ ID NO: 2237668 - DNA, 23 bp, Homo sapiens
ttctcagaatctcaaataactaa

SEQ ID NO: 2237669 - DNA, 16 bp, Homo sapiens
ttctccaagcaggaca

SEQ ID NO: 2237670 - DNA, 13 bp, Homo sapiens
ttctccaccctgc

SEQ ID NO: 2237671 - DNA, 16 bp, Homo sapiens
ttctccaccctgctct

SEQ ID NO: 2237672 - DNA, 12 bp, Homo sapiens
ttctccacctgc

SEQ ID NO: 2237673 - DNA, 21 bp, Homo sapiens
ttctccttgtgttactaagtt

SEQ ID NO: 2237674 - DNA, 17 bp, Homo sapiens
ttctctactctagggaa

SEQ ID NO: 2237675 - DNA, 13 bp, Homo sapiens
ttctctccagccc

SEQ ID NO: 2237676 - DNA, 15 bp, Homo sapiens
ttctctccagcccct

SEQ ID NO: 2237677 - DNA, 14 bp, Homo sapiens
ttctctcctgtacc

SEQ ID NO: 2237678 - DNA, 22 bp, Homo sapiens
ttctctcctgtacctcttgagc

SEQ ID NO: 2237679 - DNA, 14 bp, Homo sapiens
ttctctgaggacac

SEQ ID NO: 2237680 - DNA, 22 bp, Homo sapiens
ttctgaacttggcgctgcccct

SEQ ID NO: 2237681 - DNA, 16 bp, Homo sapiens
ttctgacccatgctgc

SEQ ID NO: 2237682 - DNA, 19 bp, Homo sapiens
ttctgcagccactattgtt

SEQ ID NO: 2237683 - DNA, 13 bp, Homo sapiens
ttctgccgcagcc

SEQ ID NO: 2237684 - DNA, 23 bp, Homo sapiens
ttctgccgcagccctgcagaggg

SEQ ID NO: 2237685 - DNA, 16 bp, Homo sapiens
ttctgcctgcccaggc

SEQ ID NO: 2237686 - DNA, 20 bp, Homo sapiens
ttctggcagagttgaagaca

SEQ ID NO: 2237687 - DNA, 10 bp, Homo sapiens
ttctgggaca

SEQ ID NO: 2237688 - DNA, 11 bp, Homo sapiens
ttctgggacac

SEQ ID NO: 2237689 - DNA, 18 bp, Homo sapiens
ttctgtattttgtttttg

SEQ ID NO: 2237690 - DNA, 13 bp, Homo sapiens
ttctgtttagata

SEQ ID NO: 2237691 - DNA, 20 bp, Homo sapiens
ttctgtttttctaggcctgg

SEQ ID NO: 2237692 - DNA, 13 bp, Homo sapiens
ttcttaattctta

SEQ ID NO: 2237693 - DNA, 19 bp, Homo sapiens
ttcttatttaatgaaagac

SEQ ID NO: 2237694 - DNA, 11 bp, Homo sapiens
ttcttctccct

SEQ ID NO: 2237695 - DNA, 20 bp, Homo sapiens
ttcttctgcttcagcctccc

SEQ ID NO: 2237696 - DNA, 16 bp, Homo sapiens
ttcttgaacttgaaaa

SEQ ID NO: 2237697 - DNA, 13 bp, Homo sapiens
ttcttgcaaagta

SEQ ID NO: 2237698 - DNA, 17 bp, Homo sapiens
ttcttggtttgtaaatt

SEQ ID NO: 2237699 - DNA, 18 bp, Homo sapiens
ttcttggtttgtaaatta

SEQ ID NO: 2237700 - DNA, 21 bp, Homo sapiens
ttcttgtgtgtttattgtcaa

SEQ ID NO: 2237701 - DNA, 12 bp, Homo sapiens
ttctttcagcca

SEQ ID NO: 2237702 - DNA, 20 bp, Homo sapiens
ttctttctggctatgcattt

SEQ ID NO: 2237703 - DNA, 22 bp, Homo sapiens
ttgaaaaaaaaaaacacaaaaa

SEQ ID NO: 2237704 - DNA, 19 bp, Homo sapiens
ttgaaaacactgttctctg

SEQ ID NO: 2237705 - DNA, 20 bp, Homo sapiens
ttgaaatataggaacttaaa

SEQ ID NO: 2237706 - DNA, 15 bp, Homo sapiens
ttgaactcctggcct

SEQ ID NO: 2237707 - DNA, 16 bp, Homo sapiens
ttgaactgataaagat

SEQ ID NO: 2237708 - DNA, 22 bp, Homo sapiens
ttgaactttgacctctgcagca

SEQ ID NO: 2237709 - DNA, 17 bp, Homo sapiens
ttgaagacagagctaca

SEQ ID NO: 2237710 - DNA, 19 bp, Homo sapiens
ttgaagacttttctttcag

SEQ ID NO: 2237711 - DNA, 14 bp, Homo sapiens
ttgaattgtaagga

SEQ ID NO: 2237712 - DNA, 19 bp, Homo sapiens
ttgacaggattattggaaa

SEQ ID NO: 2237713 - DNA, 13 bp, Homo sapiens
ttgacatcaactg

SEQ ID NO: 2237714 - DNA, 16 bp, Homo sapiens
ttgacatcaactgcat

SEQ ID NO: 2237715 - DNA, 18 bp, Homo sapiens
ttgaccattctccacctg

SEQ ID NO: 2237716 - DNA, 24 bp, Homo sapiens
ttgaccattctccacctgccaggg

SEQ ID NO: 2237717 - DNA, 16 bp, Homo sapiens
ttgacctctgcagcaa

SEQ ID NO: 2237718 - DNA, 22 bp, Homo sapiens
ttgacgccatcccagccccaat

SEQ ID NO: 2237719 - DNA, 16 bp, Homo sapiens
ttgagcagggctcagc

SEQ ID NO: 2237720 - DNA, 14 bp, Homo sapiens
ttgagcctgggagg

SEQ ID NO: 2237721 - DNA, 16 bp, Homo sapiens
ttgagggttgggctgg

SEQ ID NO: 2237722 - DNA, 16 bp, Homo sapiens
ttgaggtctgttcttt

SEQ ID NO: 2237723 - DNA, 20 bp, Homo sapiens
ttgagtgaagctgggagaac

SEQ ID NO: 2237724 - DNA, 20 bp, Homo sapiens
ttgagttgattcagctctgc

SEQ ID NO: 2237725 - DNA, 12 bp, Homo sapiens
ttgataaagtaa

SEQ ID NO: 2237726 - DNA, 21 bp, Homo sapiens
ttgatagcacagaccctgccc

SEQ ID NO: 2237727 - DNA, 23 bp, Homo sapiens
ttgatagcacagaccctgccctg

SEQ ID NO: 2237728 - DNA, 16 bp, Homo sapiens
ttgatatgcttataca

SEQ ID NO: 2237729 - DNA, 14 bp, Homo sapiens
ttgattaaattctt

SEQ ID NO: 2237730 - DNA, 20 bp, Homo sapiens
ttgattaaattcttgcaaag

SEQ ID NO: 2237731 - DNA, 15 bp, Homo sapiens
ttgattcagacagct

SEQ ID NO: 2237732 - DNA, 14 bp, Homo sapiens
ttgcaacaggctgg

SEQ ID NO: 2237733 - DNA, 16 bp, Homo sapiens
ttgcaatggcagcctt

SEQ ID NO: 2237734 - DNA, 19 bp, Homo sapiens
ttgcaatggcagccttggc

SEQ ID NO: 2237735 - DNA, 21 bp, Homo sapiens
ttgcaccactgcactccagcc

SEQ ID NO: 2237736 - DNA, 23 bp, Homo sapiens
ttgcagacaggcaagcacctcct

SEQ ID NO: 2237737 - DNA, 20 bp, Homo sapiens
ttgccatgttggccaggctg

SEQ ID NO: 2237738 - DNA, 14 bp, Homo sapiens
ttgcctctgcctct

SEQ ID NO: 2237739 - DNA, 16 bp, Homo sapiens
ttgcctctgcctctga

SEQ ID NO: 2237740 - DNA, 20 bp, Homo sapiens
ttgctaagtgaggatgaaaa

SEQ ID NO: 2237741 - DNA, 19 bp, Homo sapiens
ttgctgatggtgcaatgac

SEQ ID NO: 2237742 - DNA, 20 bp, Homo sapiens
ttgctgatggtgcaatgacc

SEQ ID NO: 2237743 - DNA, 16 bp, Homo sapiens
ttgctgcttgaggcaa

SEQ ID NO: 2237744 - DNA, 20 bp, Homo sapiens
ttgctttgtgatttttgtaa

SEQ ID NO: 2237745 - DNA, 17 bp, Homo sapiens
ttggaaagagtaggaag

SEQ ID NO: 2237746 - DNA, 19 bp, Homo sapiens
ttggaagctccgctttcta

SEQ ID NO: 2237747 - DNA, 11 bp, Homo sapiens
ttggaaggaac

SEQ ID NO: 2237748 - DNA, 19 bp, Homo sapiens
ttggaaggaacgtcccctg

SEQ ID NO: 2237749 - DNA, 15 bp, Homo sapiens
ttggaccctgaggcc

SEQ ID NO: 2237750 - DNA, 13 bp, Homo sapiens
ttggcattcccca

SEQ ID NO: 2237751 - DNA, 24 bp, Homo sapiens
ttggccaaagccaaagctaggcct

SEQ ID NO: 2237752 - DNA, 18 bp, Homo sapiens
ttggctagaggttcaaag

SEQ ID NO: 2237753 - DNA, 13 bp, Homo sapiens
ttggctgcaggga

SEQ ID NO: 2237754 - DNA, 16 bp, Homo sapiens
ttggctgctgaaggct

SEQ ID NO: 2237755 - DNA, 21 bp, Homo sapiens
ttggctgggggcctcagtgcc

SEQ ID NO: 2237756 - DNA, 18 bp, Homo sapiens
ttggggaccagagctgcc

SEQ ID NO: 2237757 - DNA, 14 bp, Homo sapiens
ttggggatattttt

SEQ ID NO: 2237758 - DNA, 16 bp, Homo sapiens
ttgggtggatgcctgg

SEQ ID NO: 2237759 - DNA, 16 bp, Homo sapiens
ttggtcccccttccat

SEQ ID NO: 2237760 - DNA, 13 bp, Homo sapiens
acacagctcttct

SEQ ID NO: 2237761 - DNA, 19 bp, Homo sapiens
acacaggcccggctccagg

SEQ ID NO: 2237762 - DNA, 22 bp, Homo sapiens
acacaggcccggctccaggctc

SEQ ID NO: 2237763 - DNA, 22 bp, Homo sapiens
acacagtattacttctgctaca

SEQ ID NO: 2237764 - DNA, 19 bp, Homo sapiens
acacatgtccaagaagccc

SEQ ID NO: 2237765 - DNA, 21 bp, Homo sapiens
acacatgtccaagaagcccag

SEQ ID NO: 2237766 - DNA, 22 bp, Homo sapiens
acacattttttaaatgcacctg

SEQ ID NO: 2237767 - DNA, 14 bp, Homo sapiens
acaccactacattc

SEQ ID NO: 2237768 - DNA, 12 bp, Homo sapiens
acaccagagccc

SEQ ID NO: 2237769 - DNA, 23 bp, Homo sapiens
acaccagagcccaccttggctca

SEQ ID NO: 2237770 - DNA, 11 bp, Homo sapiens
acaccctgtga

SEQ ID NO: 2237771 - DNA, 18 bp, Homo sapiens
acaccctgtgatggggcc

SEQ ID NO: 2237772 - DNA, 14 bp, Homo sapiens
acacgaatattgct

SEQ ID NO: 2237773 - DNA, 17 bp, Homo sapiens
acacgcgtgcacacacc

SEQ ID NO: 2237774 - DNA, 17 bp, Homo sapiens
acactaaccacgctgga

SEQ ID NO: 2237775 - DNA, 15 bp, Homo sapiens
acactcaaaagctgg

SEQ ID NO: 2237776 - DNA, 21 bp, Homo sapiens
acactcaaaagctgggcaggt

SEQ ID NO: 2237777 - DNA, 16 bp, Homo sapiens
acactcattgacctga

SEQ ID NO: 2237778 - DNA, 11 bp, Homo sapiens
acactccttca

SEQ ID NO: 2237779 - DNA, 15 bp, Homo sapiens
acactgcatgtttgt

SEQ ID NO: 2237780 - DNA, 15 bp, Homo sapiens
acactgtactgcaat

SEQ ID NO: 2237781 - DNA, 17 bp, Homo sapiens
acactgtgctgagtctg

SEQ ID NO: 2237782 - DNA, 20 bp, Homo sapiens
acactgttctctgccctcca

SEQ ID NO: 2237783 - DNA, 18 bp, Homo sapiens
acacttacactttatgca

SEQ ID NO: 2237784 - DNA, 20 bp, Homo sapiens
acagaaaatggaagacagct

SEQ ID NO: 2237785 - DNA, 18 bp, Homo sapiens
acagaaaattcttctcca

SEQ ID NO: 2237786 - DNA, 13 bp, Homo sapiens
acagaaatgtaca

SEQ ID NO: 2237787 - DNA, 18 bp, Homo sapiens
acagacatactaaccagc

SEQ ID NO: 2237788 - DNA, 19 bp, Homo sapiens
acagacatactaaccagca

SEQ ID NO: 2237789 - DNA, 13 bp, Homo sapiens
acagaccctgccc

SEQ ID NO: 2237790 - DNA, 17 bp, Homo sapiens
acagaccctgccctgtg

SEQ ID NO: 2237791 - DNA, 20 bp, Homo sapiens
acagaccctgccctgtgggc

SEQ ID NO: 2237792 - DNA, 18 bp, Homo sapiens
acagagaaagtacttctc

SEQ ID NO: 2237793 - DNA, 14 bp, Homo sapiens
acagagcccacgcc

SEQ ID NO: 2237794 - DNA, 18 bp, Homo sapiens
acagagcccacgccccca

SEQ ID NO: 2237795 - DNA, 16 bp, Homo sapiens
acagagctacacaggg

SEQ ID NO: 2237796 - DNA, 18 bp, Homo sapiens
acagagctacacagggga

SEQ ID NO: 2237797 - DNA, 15 bp, Homo sapiens
acagagtgagactct

SEQ ID NO: 2237798 - DNA, 21 bp, Homo sapiens
acagagtgagactctgtctca

SEQ ID NO: 2237799 - DNA, 16 bp, Homo sapiens
acagagttgttacatt

SEQ ID NO: 2237800 - DNA, 18 bp, Homo sapiens
acagagttgttacatttt

SEQ ID NO: 2237801 - DNA, 21 bp, Homo sapiens
acagagttgttacatttttaa

SEQ ID NO: 2237802 - DNA, 22 bp, Homo sapiens
acagagttgttacatttttaag

SEQ ID NO: 2237803 - DNA, 18 bp, Homo sapiens
acagagttttcactctta

SEQ ID NO: 2237804 - DNA, 20 bp, Homo sapiens
acagatagatatatgctctg

SEQ ID NO: 2237805 - DNA, 21 bp, Homo sapiens
acagcaaggagatttacaact

SEQ ID NO: 2237806 - DNA, 21 bp, Homo sapiens
acagcacaggcagccccacgg

SEQ ID NO: 2237807 - DNA, 18 bp, Homo sapiens
acagccacggccaggcca

SEQ ID NO: 2237808 - DNA, 18 bp, Homo sapiens
acagcccgggctctgcct

SEQ ID NO: 2237809 - DNA, 22 bp, Homo sapiens
acagcccgggctctgcctccca

SEQ ID NO: 2237810 - DNA, 14 bp, Homo sapiens
acagctaacatgga

SEQ ID NO: 2237811 - DNA, 17 bp, Homo sapiens
acagctaacatggaagt

SEQ ID NO: 2237812 - DNA, 15 bp, Homo sapiens
acagctaatgggaca

SEQ ID NO: 2237813 - DNA, 12 bp, Homo sapiens
acagctccttct

SEQ ID NO: 2237814 - DNA, 14 bp, Homo sapiens
acagctccttctgt

SEQ ID NO: 2237815 - DNA, 16 bp, Homo sapiens
acagctccttctgtcc

SEQ ID NO: 2237816 - DNA, 17 bp, Homo sapiens
acagctcttctccaggc

SEQ ID NO: 2237817 - DNA, 20 bp, Homo sapiens
acagcttgaccgtgaggcca

SEQ ID NO: 2237818 - DNA, 23 bp, Homo sapiens
acagcttgaccgtgaggccagag

SEQ ID NO: 2237819 - DNA, 15 bp, Homo sapiens
acaggaaaagctgct

SEQ ID NO: 2237820 - DNA, 15 bp, Homo sapiens
acaggatcagtctga

SEQ ID NO: 2237821 - DNA, 12 bp, Homo sapiens
acaggcaagcac

SEQ ID NO: 2237822 - DNA, 20 bp, Homo sapiens
acaggcaagcacctcctgcc

SEQ ID NO: 2237823 - DNA, 23 bp, Homo sapiens
acaggcaagcacctcctgcctcg

SEQ ID NO: 2237824 - DNA, 16 bp, Homo sapiens
acaggcaatgctggct

SEQ ID NO: 2237825 - DNA, 17 bp, Homo sapiens
acaggcaatgctggctg

SEQ ID NO: 2237826 - DNA, 15 bp, Homo sapiens
acaggcatgttctct

SEQ ID NO: 2237827 - DNA, 20 bp, Homo sapiens
acaggcatgttctctgagga

SEQ ID NO: 2237828 - DNA, 16 bp, Homo sapiens
acaggcccggctccag

SEQ ID NO: 2237829 - DNA, 18 bp, Homo sapiens
acaggcccggctccaggc

SEQ ID NO: 2237830 - DNA, 12 bp, Homo sapiens
acaggctgggct

SEQ ID NO: 2237831 - DNA, 14 bp, Homo sapiens
acaggctgggcttc

SEQ ID NO: 2237832 - DNA, 22 bp, Homo sapiens
acaggctgggcttcagtggcag

SEQ ID NO: 2237833 - DNA, 19 bp, Homo sapiens
acaggtgtgaaccaccaca

SEQ ID NO: 2237834 - DNA, 20 bp, Homo sapiens
acaggtgtgaaccaccacac

SEQ ID NO: 2237835 - DNA, 22 bp, Homo sapiens
acaggtgtgagtcaccaagccc

SEQ ID NO: 2237836 - DNA, 13 bp, Homo sapiens
acaggtttaaaaa

SEQ ID NO: 2237837 - DNA, 16 bp, Homo sapiens
acagtattacttctgc

SEQ ID NO: 2237838 - DNA, 13 bp, Homo sapiens
acagtcctcccat

SEQ ID NO: 2237839 - DNA, 18 bp, Homo sapiens
acagtccttaccagcaga

SEQ ID NO: 2237840 - DNA, 23 bp, Homo sapiens
acagtgagtcgaggacagggagg

SEQ ID NO: 2237841 - DNA, 13 bp, Homo sapiens
acagttactcaga

SEQ ID NO: 2237842 - DNA, 20 bp, Homo sapiens
acagttactcagaattctct

SEQ ID NO: 2237843 - DNA, 16 bp, Homo sapiens
acagttctctccttct

SEQ ID NO: 2237844 - DNA, 21 bp, Homo sapiens
acataatgcgtgcataccact

SEQ ID NO: 2237845 - DNA, 13 bp, Homo sapiens
acatactaaccag

SEQ ID NO: 2237846 - DNA, 13 bp, Homo sapiens
acatactcccatc

SEQ ID NO: 2237847 - DNA, 14 bp, Homo sapiens
acatattgatttcc

SEQ ID NO: 2237848 - DNA, 16 bp, Homo sapiens
acatcaacatcttggt

SEQ ID NO: 2237849 - DNA, 15 bp, Homo sapiens
acatcagcacgattt

SEQ ID NO: 2237850 - DNA, 17 bp, Homo sapiens
acatcagcacgatttct

SEQ ID NO: 2237851 - DNA, 21 bp, Homo sapiens
acatcagcacgatttctgttt

SEQ ID NO: 2237852 - DNA, 13 bp, Homo sapiens
acatcttgctctg

SEQ ID NO: 2237853 - DNA, 14 bp, Homo sapiens
acatcttgctctgc

SEQ ID NO: 2237854 - DNA, 16 bp, Homo sapiens
acatcttgctctgctg

SEQ ID NO: 2237855 - DNA, 16 bp, Homo sapiens
acatgaaaacacattt

SEQ ID NO: 2237856 - DNA, 22 bp, Homo sapiens
acatgaaaacacatttttctta

SEQ ID NO: 2237857 - DNA, 20 bp, Homo sapiens
acatgcacagctaacatgga

SEQ ID NO: 2237858 - DNA, 15 bp, Homo sapiens
acatgcctctctcag

SEQ ID NO: 2237859 - DNA, 16 bp, Homo sapiens
acatgcctctctcagg

SEQ ID NO: 2237860 - DNA, 17 bp, Homo sapiens
acatgcctctctcaggc

SEQ ID NO: 2237861 - DNA, 19 bp, Homo sapiens
acatggagtatatgtcaag

SEQ ID NO: 2237862 - DNA, 16 bp, Homo sapiens
acatgtgcacatgcac

SEQ ID NO: 2237863 - DNA, 21 bp, Homo sapiens
acatgtttttcttctccctca

SEQ ID NO: 2237864 - DNA, 12 bp, Homo sapiens
acattctgttaa

SEQ ID NO: 2237865 - DNA, 15 bp, Homo sapiens
acatttattctgctc

SEQ ID NO: 2237866 - DNA, 22 bp, Homo sapiens
acatttttaagtgctgcattta

SEQ ID NO: 2237867 - DNA, 23 bp, Homo sapiens
acatttttaagtgctgcatttaa

SEQ ID NO: 2237868 - DNA, 13 bp, Homo sapiens
acatttttcttag

SEQ ID NO: 2237869 - DNA, 19 bp, Homo sapiens
accaaatcagctgctacta

SEQ ID NO: 2237870 - DNA, 16 bp, Homo sapiens
accaacatactcccat

SEQ ID NO: 2237871 - DNA, 17 bp, Homo sapiens
accaacatactcccatc

SEQ ID NO: 2237872 - DNA, 20 bp, Homo sapiens
accaaccactgcgaccacaa

SEQ ID NO: 2237873 - DNA, 21 bp, Homo sapiens
accaacgtctgtgccattttg

SEQ ID NO: 2237874 - DNA, 20 bp, Homo sapiens
accacacccagcccacttct

SEQ ID NO: 2237875 - DNA, 21 bp, Homo sapiens
accacagacatactaaccagc

SEQ ID NO: 2237876 - DNA, 16 bp, Homo sapiens
accacatcttgctctg

SEQ ID NO: 2237877 - DNA, 17 bp, Homo sapiens
accacatcttgctctgc

SEQ ID NO: 2237878 - DNA, 18 bp, Homo sapiens
accacatcttgctctgct

SEQ ID NO: 2237879 - DNA, 16 bp, Homo sapiens
accacgctggaccttg

SEQ ID NO: 2237880 - DNA, 15 bp, Homo sapiens
accacgtttctaaag

SEQ ID NO: 2237881 - DNA, 19 bp, Homo sapiens
accacgtttctaaaggcta

SEQ ID NO: 2237882 - DNA, 20 bp, Homo sapiens
accactctatcaagtattat

SEQ ID NO: 2237883 - DNA, 17 bp, Homo sapiens
accactgcactccagcc

SEQ ID NO: 2237884 - DNA, 21 bp, Homo sapiens
agcacgatttctgtttagata

SEQ ID NO: 2237885 - DNA, 20 bp, Homo sapiens
agcactaaggtgtgctctga

SEQ ID NO: 2237886 - DNA, 13 bp, Homo sapiens
agcagaaacaaaa

SEQ ID NO: 2237887 - DNA, 14 bp, Homo sapiens
agcagaaacaaaat

SEQ ID NO: 2237888 - DNA, 15 bp, Homo sapiens
agcagaaacaaaatg

SEQ ID NO: 2237889 - DNA, 19 bp, Homo sapiens
agcagagaccatccctgaa

SEQ ID NO: 2237890 - DNA, 13 bp, Homo sapiens
agcagagagagag

SEQ ID NO: 2237891 - DNA, 23 bp, Homo sapiens
agcagagagagagagagagaaag

SEQ ID NO: 2237892 - DNA, 11 bp, Homo sapiens
agcagccacat

SEQ ID NO: 2237893 - DNA, 18 bp, Homo sapiens
agcagcgtttctatgaca

SEQ ID NO: 2237894 - DNA, 19 bp, Homo sapiens
agcagcgtttctatgacac

SEQ ID NO: 2237895 - DNA, 22 bp, Homo sapiens
agcaggcagtggggctggaagc

SEQ ID NO: 2237896 - DNA, 16 bp, Homo sapiens
agcaggctctcaggcc

SEQ ID NO: 2237897 - DNA, 17 bp, Homo sapiens
agcaggctctcaggcca

SEQ ID NO: 2237898 - DNA, 20 bp, Homo sapiens
agcagggagggcttctgcca

SEQ ID NO: 2237899 - DNA, 13 bp, Homo sapiens
agcagggctcagc

SEQ ID NO: 2237900 - DNA, 19 bp, Homo sapiens
agcataaaaattagccaag

SEQ ID NO: 2237901 - DNA, 23 bp, Homo sapiens
agcataaaaattagccaagtgtg

SEQ ID NO: 2237902 - DNA, 16 bp, Homo sapiens
agcatacgtacacatt

SEQ ID NO: 2237903 - DNA, 18 bp, Homo sapiens
agcatacgtacacatttt

SEQ ID NO: 2237904 - DNA, 21 bp, Homo sapiens
agcatacgtacacattttatt

SEQ ID NO: 2237905 - DNA, 22 bp, Homo sapiens
agcatattcaggaagctcaggg

SEQ ID NO: 2237906 - DNA, 12 bp, Homo sapiens
agcatcaggcca

SEQ ID NO: 2237907 - DNA, 17 bp, Homo sapiens
agcatcaggccaggccc

SEQ ID NO: 2237908 - DNA, 18 bp, Homo sapiens
agcatcaggccaggccct

SEQ ID NO: 2237909 - DNA, 21 bp, Homo sapiens
agcatcaggccaggccctctg

SEQ ID NO: 2237910 - DNA, 17 bp, Homo sapiens
agcatcctggcacccgg

SEQ ID NO: 2237911 - DNA, 19 bp, Homo sapiens
agccaaagctaggcctggc

SEQ ID NO: 2237912 - DNA, 20 bp, Homo sapiens
agccaaggccaaaggaagca

SEQ ID NO: 2237913 - DNA, 11 bp, Homo sapiens
agccacagggt

SEQ ID NO: 2237914 - DNA, 14 bp, Homo sapiens
agccacattcctga

SEQ ID NO: 2237915 - DNA, 16 bp, Homo sapiens
agccacggccaggcca

SEQ ID NO: 2237916 - DNA, 19 bp, Homo sapiens
agccactgcaccgggccac

SEQ ID NO: 2237917 - DNA, 22 bp, Homo sapiens
agccactgcaccgggccacaga

SEQ ID NO: 2237918 - DNA, 11 bp, Homo sapiens
agccagaggag

SEQ ID NO: 2237919 - DNA, 14 bp, Homo sapiens
agccagatttcact

SEQ ID NO: 2237920 - DNA, 22 bp, Homo sapiens
agccagatttcactctccttgg

SEQ ID NO: 2237921 - DNA, 14 bp, Homo sapiens
agccagcaggctct

SEQ ID NO: 2237922 - DNA, 17 bp, Homo sapiens
agccagcaggctctcag

SEQ ID NO: 2237923 - DNA, 20 bp, Homo sapiens
agccagcaggctctcaggcc

SEQ ID NO: 2237924 - DNA, 12 bp, Homo sapiens
agccaggccaca

SEQ ID NO: 2237925 - DNA, 13 bp, Homo sapiens
agccagtaaatgg

SEQ ID NO: 2237926 - DNA, 15 bp, Homo sapiens
agcccacccctcaac

SEQ ID NO: 2237927 - DNA, 14 bp, Homo sapiens
agcccaccttggct

SEQ ID NO: 2237928 - DNA, 14 bp, Homo sapiens
agcccacgccccca

SEQ ID NO: 2237929 - DNA, 19 bp, Homo sapiens
agcccacgcccccactggt

SEQ ID NO: 2237930 - DNA, 23 bp, Homo sapiens
agcccacgcccccactggtgaca

SEQ ID NO: 2237931 - DNA, 13 bp, Homo sapiens
agcccacttctgc

SEQ ID NO: 2237932 - DNA, 22 bp, Homo sapiens
agcccacttctgccatattctg

SEQ ID NO: 2237933 - DNA, 20 bp, Homo sapiens
agcccaggaaaggctccagg

SEQ ID NO: 2237934 - DNA, 22 bp, Homo sapiens
agcccaggaaaggctccaggag

SEQ ID NO: 2237935 - DNA, 16 bp, Homo sapiens
agccccaaaactctcc

SEQ ID NO: 2237936 - DNA, 13 bp, Homo sapiens
agccccagtgccc

SEQ ID NO: 2237937 - DNA, 15 bp, Homo sapiens
agccccatcctctgt

SEQ ID NO: 2237938 - DNA, 17 bp, Homo sapiens
agccccatcctctgtac

SEQ ID NO: 2237939 - DNA, 13 bp, Homo sapiens
agccccattctgc

SEQ ID NO: 2237940 - DNA, 18 bp, Homo sapiens
agccccattctgcctgcc

SEQ ID NO: 2237941 - DNA, 23 bp, Homo sapiens
agccccattctgcctgcccaggc

SEQ ID NO: 2237942 - DNA, 16 bp, Homo sapiens
agccccgaggccttct

SEQ ID NO: 2237943 - DNA, 17 bp, Homo sapiens
agccccgaggccttctc

SEQ ID NO: 2237944 - DNA, 22 bp, Homo sapiens
agccccgaggccttctctgaag

SEQ ID NO: 2237945 - DNA, 17 bp, Homo sapiens
agcccctggatgcagcc

SEQ ID NO: 2237946 - DNA, 18 bp, Homo sapiens
agcccctggatgcagcct

SEQ ID NO: 2237947 - DNA, 19 bp, Homo sapiens
agcccctggatgcagcctc

SEQ ID NO: 2237948 - DNA, 14 bp, Homo sapiens
agccccttctgacc

SEQ ID NO: 2237949 - DNA, 16 bp, Homo sapiens
agccccttctgaccca

SEQ ID NO: 2237950 - DNA, 19 bp, Homo sapiens
agccccttctgacccatgc

SEQ ID NO: 2237951 - DNA, 20 bp, Homo sapiens
agccccttctgacccatgct

SEQ ID NO: 2237952 - DNA, 18 bp, Homo sapiens
agcccgggctctgcctcc

SEQ ID NO: 2237953 - DNA, 21 bp, Homo sapiens
agcccgggctctgcctcccat

SEQ ID NO: 2237954 - DNA, 16 bp, Homo sapiens
agccctgcagagggca

SEQ ID NO: 2237955 - DNA, 15 bp, Homo sapiens
agccctggtggcagt

SEQ ID NO: 2237956 - DNA, 21 bp, Homo sapiens
agccctggtggcagtgggagc

SEQ ID NO: 2237957 - DNA, 21 bp, Homo sapiens
agcccttagcagggaaacagc

SEQ ID NO: 2237958 - DNA, 17 bp, Homo sapiens
agccgagatcacgccac

SEQ ID NO: 2237959 - DNA, 19 bp, Homo sapiens
agccgagattgcaccactg

SEQ ID NO: 2237960 - DNA, 17 bp, Homo sapiens
agcctaggtgacagagt

SEQ ID NO: 2237961 - DNA, 17 bp, Homo sapiens
agcctcacagtccttac

SEQ ID NO: 2237962 - DNA, 18 bp, Homo sapiens
agcctcacagtccttacc

SEQ ID NO: 2237963 - DNA, 15 bp, Homo sapiens
agcctcagcatcctg

SEQ ID NO: 2237964 - DNA, 21 bp, Homo sapiens
agcctcagcatcctggcaccc

SEQ ID NO: 2237965 - DNA, 18 bp, Homo sapiens
agcctcccaaagtgctgg

SEQ ID NO: 2237966 - DNA, 18 bp, Homo sapiens
agcctcccgagtagctgg

SEQ ID NO: 2237967 - DNA, 22 bp, Homo sapiens
agcctcccgagtagctgggact

SEQ ID NO: 2237968 - DNA, 18 bp, Homo sapiens
agcctcctgcccttacct

SEQ ID NO: 2237969 - DNA, 22 bp, Homo sapiens
agcctgctccagctgttcagct

SEQ ID NO: 2237970 - DNA, 12 bp, Homo sapiens
agcctgggaggt

SEQ ID NO: 2237971 - DNA, 20 bp, Homo sapiens
agcctgggaggtcaaggctg

SEQ ID NO: 2237972 - DNA, 16 bp, Homo sapiens
agccttccaggggtgg

SEQ ID NO: 2237973 - DNA, 17 bp, Homo sapiens
agccttccaggggtggg

SEQ ID NO: 2237974 - DNA, 18 bp, Homo sapiens
agccttccaggggtggga

SEQ ID NO: 2237975 - DNA, 13 bp, Homo sapiens
agccttgaacttt

SEQ ID NO: 2237976 - DNA, 18 bp, Homo sapiens
agccttgaccattctcca

SEQ ID NO: 2237977 - DNA, 21 bp, Homo sapiens
agccttgaccattctccacct

SEQ ID NO: 2237978 - DNA, 16 bp, Homo sapiens
agcgaaccgtgaggag

SEQ ID NO: 2237979 - DNA, 18 bp, Homo sapiens
agcggagacggagtccca

SEQ ID NO: 2237980 - DNA, 13 bp, Homo sapiens
agcggctggcagc

SEQ ID NO: 2237981 - DNA, 22 bp, Homo sapiens
agcggggacagctccttctgtc

SEQ ID NO: 2237982 - DNA, 15 bp, Homo sapiens
agcgtgagccactgc

SEQ ID NO: 2237983 - DNA, 22 bp, Homo sapiens
agcgtgagccactgcaccgggc

SEQ ID NO: 2237984 - DNA, 15 bp, Homo sapiens
agctaggcctggcca

SEQ ID NO: 2237985 - DNA, 23 bp, Homo sapiens
agctcaccagccccagtgcccac

SEQ ID NO: 2237986 - DNA, 18 bp, Homo sapiens
agctcagagagggtggga

SEQ ID NO: 2237987 - DNA, 14 bp, Homo sapiens
agctcagggcctgg

SEQ ID NO: 2237988 - DNA, 18 bp, Homo sapiens
agctcaggtgtccctgca

SEQ ID NO: 2237989 - DNA, 16 bp, Homo sapiens
agctccaagctcccag

SEQ ID NO: 2237990 - DNA, 18 bp, Homo sapiens
agctccaagctcccaggc

SEQ ID NO: 2237991 - DNA, 19 bp, Homo sapiens
agctccagctcaccagccc

SEQ ID NO: 2237992 - DNA, 13 bp, Homo sapiens
agctcccaggcat

SEQ ID NO: 2237993 - DNA, 20 bp, Homo sapiens
agctccgctttctacccagc

SEQ ID NO: 2237994 - DNA, 15 bp, Homo sapiens
agctccttctgtcct

SEQ ID NO: 2237995 - DNA, 16 bp, Homo sapiens
agctccttctgtccta

SEQ ID NO: 2237996 - DNA, 14 bp, Homo sapiens
agctctgtcctggg

SEQ ID NO: 2237997 - DNA, 16 bp, Homo sapiens
agctctgtcctgggag

SEQ ID NO: 2237998 - DNA, 15 bp, Homo sapiens
agctgacttttctgt

SEQ ID NO: 2237999 - DNA, 19 bp, Homo sapiens
agctgcaccctcaggcagg

SEQ ID NO: 2238000 - DNA, 22 bp, Homo sapiens
agctgcaccctcaggcaggtgg

SEQ ID NO: 2238001 - DNA, 13 bp, Homo sapiens
agctgccacctgc

SEQ ID NO: 2238002 - DNA, 14 bp, Homo sapiens
agctgccagccgag

SEQ ID NO: 2238003 - DNA, 13 bp, Homo sapiens
agctgcctgggat

SEQ ID NO: 2238004 - DNA, 20 bp, Homo sapiens
agctgcctgttcagctccag

SEQ ID NO: 2238005 - DNA, 13 bp, Homo sapiens
agctgcggtccac

SEQ ID NO: 2238006 - DNA, 16 bp, Homo sapiens
agctgcggtccaccca

SEQ ID NO: 2238007 - DNA, 19 bp, Homo sapiens
agctgcggtccacccagga

SEQ ID NO: 2238008 - DNA, 21 bp, Homo sapiens
atgacctttcaataggaaaaa

SEQ ID NO: 2238009 - DNA, 17 bp, Homo sapiens
atgactccagaatttcc

SEQ ID NO: 2238010 - DNA, 17 bp, Homo sapiens
atgacttactgtacatg

SEQ ID NO: 2238011 - DNA, 15 bp, Homo sapiens
atgagcatcaggcca

SEQ ID NO: 2238012 - DNA, 16 bp, Homo sapiens
atgagcatcaggccag

SEQ ID NO: 2238013 - DNA, 18 bp, Homo sapiens
atgagcatcaggccaggc

SEQ ID NO: 2238014 - DNA, 19 bp, Homo sapiens
atgagcatcaggccaggcc

SEQ ID NO: 2238015 - DNA, 15 bp, Homo sapiens
atgagcctcagcatc

SEQ ID NO: 2238016 - DNA, 17 bp, Homo sapiens
atgagcctcagcatcct

SEQ ID NO: 2238017 - DNA, 22 bp, Homo sapiens
atgaggtcagagcctgcagtta

SEQ ID NO: 2238018 - DNA, 15 bp, Homo sapiens
atgatcacggctcac

SEQ ID NO: 2238019 - DNA, 20 bp, Homo sapiens
atgatctaggaagactttgg

SEQ ID NO: 2238020 - DNA, 21 bp, Homo sapiens
atgatctttgcagacaggcaa

SEQ ID NO: 2238021 - DNA, 19 bp, Homo sapiens
atgcaaaccatcattgaaa

SEQ ID NO: 2238022 - DNA, 14 bp, Homo sapiens
atgcaaggtcattt

SEQ ID NO: 2238023 - DNA, 15 bp, Homo sapiens
atgcacacatttttt

SEQ ID NO: 2238024 - DNA, 17 bp, Homo sapiens
atgcacacattttttaa

SEQ ID NO: 2238025 - DNA, 19 bp, Homo sapiens
atgcacacattttttaaat

SEQ ID NO: 2238026 - DNA, 23 bp, Homo sapiens
atgcacacattttttaaatgcac

SEQ ID NO: 2238027 - DNA, 16 bp, Homo sapiens
atgcacagagttgtta

SEQ ID NO: 2238028 - DNA, 17 bp, Homo sapiens
atgcacagagttgttac

SEQ ID NO: 2238029 - DNA, 19 bp, Homo sapiens
atgcacagagttgttacat

SEQ ID NO: 2238030 - DNA, 21 bp, Homo sapiens
atgcacagagttgttacattt

SEQ ID NO: 2238031 - DNA, 14 bp, Homo sapiens
atgcacagctaaca

SEQ ID NO: 2238032 - DNA, 19 bp, Homo sapiens
atgcacctggaatatataa

SEQ ID NO: 2238033 - DNA, 15 bp, Homo sapiens
atgcactttgttctg

SEQ ID NO: 2238034 - DNA, 13 bp, Homo sapiens
atgcagcctcaca

SEQ ID NO: 2238035 - DNA, 23 bp, Homo sapiens
atgcagtggtatgatcacggctc

SEQ ID NO: 2238036 - DNA, 23 bp, Homo sapiens
atgcatgaagtaatatgcacaca

SEQ ID NO: 2238037 - DNA, 18 bp, Homo sapiens
atgcatttgaaaattttg

SEQ ID NO: 2238038 - DNA, 11 bp, Homo sapiens
atgcccagccc

SEQ ID NO: 2238039 - DNA, 16 bp, Homo sapiens
atgcccagccccttct

SEQ ID NO: 2238040 - DNA, 20 bp, Homo sapiens
atgcctggatggggctgcac

SEQ ID NO: 2238041 - DNA, 21 bp, Homo sapiens
atgcctggatggggctgcacc

SEQ ID NO: 2238042 - DNA, 17 bp, Homo sapiens
atgcctgggcagaagga

SEQ ID NO: 2238043 - DNA, 15 bp, Homo sapiens
atgcctggtggcagc

SEQ ID NO: 2238044 - DNA, 17 bp, Homo sapiens
atgcctggtggcagctg

SEQ ID NO: 2238045 - DNA, 14 bp, Homo sapiens
atgcgggggagcag

SEQ ID NO: 2238046 - DNA, 17 bp, Homo sapiens
atgctacacactgcatg

SEQ ID NO: 2238047 - DNA, 18 bp, Homo sapiens
atgctctgcatgttacat

SEQ ID NO: 2238048 - DNA, 19 bp, Homo sapiens
atgctctgcatgttacata

SEQ ID NO: 2238049 - DNA, 16 bp, Homo sapiens
atgctctttacttcat

SEQ ID NO: 2238050 - DNA, 18 bp, Homo sapiens
atgctggctgttggctgg

SEQ ID NO: 2238051 - DNA, 19 bp, Homo sapiens
atgctggctgttggctggg

SEQ ID NO: 2238052 - DNA, 19 bp, Homo sapiens
atgctgtcccttacgtgag

SEQ ID NO: 2238053 - DNA, 19 bp, Homo sapiens
atgctgtgccctaaagtgt

SEQ ID NO: 2238054 - DNA, 17 bp, Homo sapiens
atgcttcttcagagact

SEQ ID NO: 2238055 - DNA, 14 bp, Homo sapiens
atgcttgtacataa

SEQ ID NO: 2238056 - DNA, 15 bp, Homo sapiens
atgcttgtacataat

SEQ ID NO: 2238057 - DNA, 16 bp, Homo sapiens
atggaacactctgaga

SEQ ID NO: 2238058 - DNA, 14 bp, Homo sapiens
atggacatgatctt

SEQ ID NO: 2238059 - DNA, 21 bp, Homo sapiens
atggacccaatatttaccaga

SEQ ID NO: 2238060 - DNA, 20 bp, Homo sapiens
atggacgtgttatgactcca

SEQ ID NO: 2238061 - DNA, 15 bp, Homo sapiens
atggatttccagcca

SEQ ID NO: 2238062 - DNA, 17 bp, Homo sapiens
atggcacatcagcacga

SEQ ID NO: 2238063 - DNA, 15 bp, Homo sapiens
atgggaatgaatgtc

SEQ ID NO: 2238064 - DNA, 15 bp, Homo sapiens
atgggatcctggagt

SEQ ID NO: 2238065 - DNA, 14 bp, Homo sapiens
atgggcagagcaga

SEQ ID NO: 2238066 - DNA, 15 bp, Homo sapiens
atgggcctcctgtgt

SEQ ID NO: 2238067 - DNA, 18 bp, Homo sapiens
atgggcctcctgtgtgtg

SEQ ID NO: 2238068 - DNA, 14 bp, Homo sapiens
atggggccctgcct

SEQ ID NO: 2238069 - DNA, 20 bp, Homo sapiens
atggggccctgcctcctttg

SEQ ID NO: 2238070 - DNA, 12 bp, Homo sapiens
atggggctgcac

SEQ ID NO: 2238071 - DNA, 21 bp, Homo sapiens
atgggtgcttggaggaaggaa

SEQ ID NO: 2238072 - DNA, 23 bp, Homo sapiens
atgggtgcttggaggaaggaaac

SEQ ID NO: 2238073 - DNA, 15 bp, Homo sapiens
atggtcggaaaacat

SEQ ID NO: 2238074 - DNA, 13 bp, Homo sapiens
atggtgcaatgac

SEQ ID NO: 2238075 - DNA, 15 bp, Homo sapiens
atggtgcaatgacct

SEQ ID NO: 2238076 - DNA, 16 bp, Homo sapiens
atggtgcaatgacctt

SEQ ID NO: 2238077 - DNA, 17 bp, Homo sapiens
atgtaattaagtactat

SEQ ID NO: 2238078 - DNA, 12 bp, Homo sapiens
atgtatcaatga

SEQ ID NO: 2238079 - DNA, 13 bp, Homo sapiens
atgtcacaggcag

SEQ ID NO: 2238080 - DNA, 12 bp, Homo sapiens
atgtcagtgtga

SEQ ID NO: 2238081 - DNA, 16 bp, Homo sapiens
atgtcagtgtgactga

SEQ ID NO: 2238082 - DNA, 21 bp, Homo sapiens
atgtcagtgtgactgatctct

SEQ ID NO: 2238083 - DNA, 19 bp, Homo sapiens
atgtccaagaagcccagga

SEQ ID NO: 2238084 - DNA, 23 bp, Homo sapiens
atgtccaagaagcccaggaaagg

SEQ ID NO: 2238085 - DNA, 22 bp, Homo sapiens
atgtgaaactggattaaactta

SEQ ID NO: 2238086 - DNA, 21 bp, Homo sapiens
atgtgccaggtttttggtctg

SEQ ID NO: 2238087 - DNA, 22 bp, Homo sapiens
atgtgccaggtttttggtctga

SEQ ID NO: 2238088 - DNA, 14 bp, Homo sapiens
atgtgcccccaccc

SEQ ID NO: 2238089 - DNA, 20 bp, Homo sapiens
atgtggagttcatcttgaat

SEQ ID NO: 2238090 - DNA, 24 bp, Homo sapiens
atgtggagttcatcttgaattgta

SEQ ID NO: 2238091 - DNA, 19 bp, Homo sapiens
atgttacataagataaatg

SEQ ID NO: 2238092 - DNA, 20 bp, Homo sapiens
atgttacataagataaatgt

SEQ ID NO: 2238093 - DNA, 21 bp, Homo sapiens
atgttcatcatcctaagctat

SEQ ID NO: 2238094 - DNA, 18 bp, Homo sapiens
atgttctctgaggacact

SEQ ID NO: 2238095 - DNA, 12 bp, Homo sapiens
atgttctgggac

SEQ ID NO: 2238096 - DNA, 20 bp, Homo sapiens
atgttcttagtggatgttct

SEQ ID NO: 2238097 - DNA, 16 bp, Homo sapiens
atgttgcccaggcagg

SEQ ID NO: 2238098 - DNA, 17 bp, Homo sapiens
atgttggccaggctggt

SEQ ID NO: 2238099 - DNA, 14 bp, Homo sapiens
atgttttccatgag

SEQ ID NO: 2238100 - DNA, 22 bp, Homo sapiens
attaaaaatctcaaatttctaa

SEQ ID NO: 2238101 - DNA, 17 bp, Homo sapiens
attaaacttaatctaaa

SEQ ID NO: 2238102 - DNA, 19 bp, Homo sapiens
attaaacttaatctaaatg

SEQ ID NO: 2238103 - DNA, 21 bp, Homo sapiens
attaaacttaatctaaatgga

SEQ ID NO: 2238104 - DNA, 16 bp, Homo sapiens
attaaatgcccagccc

SEQ ID NO: 2238105 - DNA, 14 bp, Homo sapiens
attaaattcttgca

SEQ ID NO: 2238106 - DNA, 18 bp, Homo sapiens
attaaattcttgcaaagt

SEQ ID NO: 2238107 - DNA, 12 bp, Homo sapiens
attaacttttat

SEQ ID NO: 2238108 - DNA, 16 bp, Homo sapiens
attaacttttataaac

SEQ ID NO: 2238109 - DNA, 20 bp, Homo sapiens
attaacttttataaacttta

SEQ ID NO: 2238110 - DNA, 14 bp, Homo sapiens
attaagaaagacta

SEQ ID NO: 2238111 - DNA, 13 bp, Homo sapiens
attaaggaagaca

SEQ ID NO: 2238112 - DNA, 16 bp, Homo sapiens
attacaggtgtgaacc

SEQ ID NO: 2238113 - DNA, 14 bp, Homo sapiens
attacttctgctac

SEQ ID NO: 2238114 - DNA, 13 bp, Homo sapiens
attagagaagaga

SEQ ID NO: 2238115 - DNA, 14 bp, Homo sapiens
attatctagatact

SEQ ID NO: 2238116 - DNA, 18 bp, Homo sapiens
attatctagatactgtat

SEQ ID NO: 2238117 - DNA, 23 bp, Homo sapiens
attatgcatgaagtaatatgcac

SEQ ID NO: 2238118 - DNA, 23 bp, Homo sapiens
attatttattaaatgcccagccc

SEQ ID NO: 2238119 - DNA, 11 bp, Homo sapiens
attcagacagc

SEQ ID NO: 2238120 - DNA, 14 bp, Homo sapiens
attcagacagctgc

SEQ ID NO: 2238121 - DNA, 12 bp, Homo sapiens
attcaggaagct

SEQ ID NO: 2238122 - DNA, 13 bp, Homo sapiens
attcaggaagctc

SEQ ID NO: 2238123 - DNA, 19 bp, Homo sapiens
attcataatgacttaagca

SEQ ID NO: 2238124 - DNA, 18 bp, Homo sapiens
attcatatttacttctta

SEQ ID NO: 2238125 - DNA, 19 bp, Homo sapiens
attcatatttacttcttat

SEQ ID NO: 2238126 - DNA, 20 bp, Homo sapiens
attcatatttacttcttata

SEQ ID NO: 2238127 - DNA, 16 bp, Homo sapiens
attcccaagctctgct

SEQ ID NO: 2238128 - DNA, 17 bp, Homo sapiens
attcccaagctctgctc

SEQ ID NO: 2238129 - DNA, 19 bp, Homo sapiens
attcccaagctctgctcct

SEQ ID NO: 2238130 - DNA, 19 bp, Homo sapiens
attccccaggaggccagcc

SEQ ID NO: 2238131 - DNA, 20 bp, Homo sapiens
attccccaggaggccagcct

SEQ ID NO: 2238132 - DNA, 19 bp, Homo sapiens
cagaatttcccaaagcagt

SEQ ID NO: 2238133 - DNA, 20 bp, Homo sapiens
cagaatttcccaaagcagtg

SEQ ID NO: 2238134 - DNA, 14 bp, Homo sapiens
cagacacaggcccg

SEQ ID NO: 2238135 - DNA, 18 bp, Homo sapiens
cagacacaggcccggctc

SEQ ID NO: 2238136 - DNA, 17 bp, Homo sapiens
cagacacatgtccaaga

SEQ ID NO: 2238137 - DNA, 22 bp, Homo sapiens
cagacacatgtccaagaagccc

SEQ ID NO: 2238138 - DNA, 23 bp, Homo sapiens
cagacacatgtccaagaagccca

SEQ ID NO: 2238139 - DNA, 15 bp, Homo sapiens
cagacaggaccaggg

SEQ ID NO: 2238140 - DNA, 16 bp, Homo sapiens
cagacaggaccaggga

SEQ ID NO: 2238141 - DNA, 17 bp, Homo sapiens
cagacaggaccagggat

SEQ ID NO: 2238142 - DNA, 11 bp, Homo sapiens
cagacaggcaa

SEQ ID NO: 2238143 - DNA, 20 bp, Homo sapiens
cagacagttaagagaaatga

SEQ ID NO: 2238144 - DNA, 19 bp, Homo sapiens
cagacatactaaccagcag

SEQ ID NO: 2238145 - DNA, 14 bp, Homo sapiens
cagaccacaaaact

SEQ ID NO: 2238146 - DNA, 17 bp, Homo sapiens
cagacccccttgcccag

SEQ ID NO: 2238147 - DNA, 20 bp, Homo sapiens
cagacccccttgcccaggcc

SEQ ID NO: 2238148 - DNA, 12 bp, Homo sapiens
cagaccctgccc

SEQ ID NO: 2238149 - DNA, 15 bp, Homo sapiens
cagaccctgccctgt

SEQ ID NO: 2238150 - DNA, 16 bp, Homo sapiens
cagaccctgccctgtg

SEQ ID NO: 2238151 - DNA, 17 bp, Homo sapiens
cagaccctgccctgtgg

SEQ ID NO: 2238152 - DNA, 21 bp, Homo sapiens
cagaccctgccctgtgggccc

SEQ ID NO: 2238153 - DNA, 22 bp, Homo sapiens
cagaccctgccctgtgggcccc

SEQ ID NO: 2238154 - DNA, 13 bp, Homo sapiens
cagactggaagca

SEQ ID NO: 2238155 - DNA, 20 bp, Homo sapiens
cagactggaagcacagcttc

SEQ ID NO: 2238156 - DNA, 17 bp, Homo sapiens
cagagaccatccctgaa

SEQ ID NO: 2238157 - DNA, 19 bp, Homo sapiens
cagagaccatccctgaagg

SEQ ID NO: 2238158 - DNA, 20 bp, Homo sapiens
cagagaccatccctgaaggc

SEQ ID NO: 2238159 - DNA, 17 bp, Homo sapiens
cagagactcctgcaggc

SEQ ID NO: 2238160 - DNA, 19 bp, Homo sapiens
cagagactcctgcaggcag

SEQ ID NO: 2238161 - DNA, 21 bp, Homo sapiens
cagagagagagagagagaaag

SEQ ID NO: 2238162 - DNA, 16 bp, Homo sapiens
cagagagggtgggagt

SEQ ID NO: 2238163 - DNA, 20 bp, Homo sapiens
cagagatgtgcccccacccc

SEQ ID NO: 2238164 - DNA, 18 bp, Homo sapiens
cagagcaccttagacagt

SEQ ID NO: 2238165 - DNA, 21 bp, Homo sapiens
cagagcaccttagacagtccc

SEQ ID NO: 2238166 - DNA, 18 bp, Homo sapiens
cagagcagagaccatccc

SEQ ID NO: 2238167 - DNA, 15 bp, Homo sapiens
cagagcccaccttgg

SEQ ID NO: 2238168 - DNA, 17 bp, Homo sapiens
cagagcccacgccccca

SEQ ID NO: 2238169 - DNA, 20 bp, Homo sapiens
cagagcccacgcccccactg

SEQ ID NO: 2238170 - DNA, 21 bp, Homo sapiens
cagagcccacgcccccactgg

SEQ ID NO: 2238171 - DNA, 22 bp, Homo sapiens
cagagctacacaggggaaaaga

SEQ ID NO: 2238172 - DNA, 18 bp, Homo sapiens
cagagctgccacctgcct

SEQ ID NO: 2238173 - DNA, 19 bp, Homo sapiens
cagaggaaagcaaaggaga

SEQ ID NO: 2238174 - DNA, 15 bp, Homo sapiens
cagaggagagaggac

SEQ ID NO: 2238175 - DNA, 19 bp, Homo sapiens
cagaggagagaggaccccc

SEQ ID NO: 2238176 - DNA, 20 bp, Homo sapiens
cagaggccatgggcctcctg

SEQ ID NO: 2238177 - DNA, 20 bp, Homo sapiens
cagagggagtgacagaggca

SEQ ID NO: 2238178 - DNA, 23 bp, Homo sapiens
cagagggggtggcctcccaactc

SEQ ID NO: 2238179 - DNA, 20 bp, Homo sapiens
cagagtcagaagtttctgcc

SEQ ID NO: 2238180 - DNA, 13 bp, Homo sapiens
cagagtctcactg

SEQ ID NO: 2238181 - DNA, 16 bp, Homo sapiens
cagagtgagactctgt

SEQ ID NO: 2238182 - DNA, 17 bp, Homo sapiens
cagagttgaagacagag

SEQ ID NO: 2238183 - DNA, 17 bp, Homo sapiens
cagatgcaccagccctt

SEQ ID NO: 2238184 - DNA, 14 bp, Homo sapiens
cagattctttcctg

SEQ ID NO: 2238185 - DNA, 15 bp, Homo sapiens
cagattctttcctga

SEQ ID NO: 2238186 - DNA, 17 bp, Homo sapiens
cagattgcaacaggctg

SEQ ID NO: 2238187 - DNA, 20 bp, Homo sapiens
cagattgcaacaggctgggc

SEQ ID NO: 2238188 - DNA, 21 bp, Homo sapiens
cagattgcaacaggctgggct

SEQ ID NO: 2238189 - DNA, 16 bp, Homo sapiens
cagatttcactctcct

SEQ ID NO: 2238190 - DNA, 20 bp, Homo sapiens
cagatttcactctccttggt

SEQ ID NO: 2238191 - DNA, 19 bp, Homo sapiens
cagatttgaactcttcaat

SEQ ID NO: 2238192 - DNA, 18 bp, Homo sapiens
cagcaaaagatgcttctc

SEQ ID NO: 2238193 - DNA, 12 bp, Homo sapiens
cagcaagtgaga

SEQ ID NO: 2238194 - DNA, 14 bp, Homo sapiens
cagcaagtgagagc

SEQ ID NO: 2238195 - DNA, 15 bp, Homo sapiens
cagcaagtgagagct

SEQ ID NO: 2238196 - DNA, 18 bp, Homo sapiens
cagcacaggcagccccac

SEQ ID NO: 2238197 - DNA, 21 bp, Homo sapiens
cagcacaggcagccccacgga

SEQ ID NO: 2238198 - DNA, 21 bp, Homo sapiens
cagcacctaggtggggcctgg

SEQ ID NO: 2238199 - DNA, 14 bp, Homo sapiens
cagcacgatttctg

SEQ ID NO: 2238200 - DNA, 22 bp, Homo sapiens
cagcagaaatgccttaccctca

SEQ ID NO: 2238201 - DNA, 12 bp, Homo sapiens
cagcagagagag

SEQ ID NO: 2238202 - DNA, 15 bp, Homo sapiens
cagcagagagagaga

SEQ ID NO: 2238203 - DNA, 14 bp, Homo sapiens
cagcagcctggacc

SEQ ID NO: 2238204 - DNA, 18 bp, Homo sapiens
cagcaggctctcaggcca

SEQ ID NO: 2238205 - DNA, 22 bp, Homo sapiens
cagcaggctctcaggccagctg

SEQ ID NO: 2238206 - DNA, 20 bp, Homo sapiens
cagcagggagggcttctgcc

SEQ ID NO: 2238207 - DNA, 23 bp, Homo sapiens
cagcatattcaggaagctcaggg

SEQ ID NO: 2238208 - DNA, 20 bp, Homo sapiens
cagcatcatggaggtttgaa

SEQ ID NO: 2238209 - DNA, 16 bp, Homo sapiens
cagccaaagcctcctc

SEQ ID NO: 2238210 - DNA, 15 bp, Homo sapiens
cagccacattcctga

SEQ ID NO: 2238211 - DNA, 12 bp, Homo sapiens
cagccaggccac

SEQ ID NO: 2238212 - DNA, 13 bp, Homo sapiens
cagccaggccaca

SEQ ID NO: 2238213 - DNA, 22 bp, Homo sapiens
cagccagtaaatgggggtgcat

SEQ ID NO: 2238214 - DNA, 13 bp, Homo sapiens
cagccccagtgcc

SEQ ID NO: 2238215 - DNA, 14 bp, Homo sapiens
cagccccagtgccc

SEQ ID NO: 2238216 - DNA, 22 bp, Homo sapiens
cagccccatcccaaacccttca

SEQ ID NO: 2238217 - DNA, 12 bp, Homo sapiens
cagccccatcct

SEQ ID NO: 2238218 - DNA, 13 bp, Homo sapiens
cagccccatcctc

SEQ ID NO: 2238219 - DNA, 22 bp, Homo sapiens
cagccccatcctctgtacagag

SEQ ID NO: 2238220 - DNA, 23 bp, Homo sapiens
cagccccattctgcctgcccagg

SEQ ID NO: 2238221 - DNA, 24 bp, Homo sapiens
cagccccattctgcctgcccaggc

SEQ ID NO: 2238222 - DNA, 14 bp, Homo sapiens
cagcccctggatgc

SEQ ID NO: 2238223 - DNA, 21 bp, Homo sapiens
cagcccctggatgcagcctca

SEQ ID NO: 2238224 - DNA, 23 bp, Homo sapiens
cagcccctggatgcagcctcaca

SEQ ID NO: 2238225 - DNA, 19 bp, Homo sapiens
cagccccttctgacccatg

SEQ ID NO: 2238226 - DNA, 15 bp, Homo sapiens
cagcccgggctctgc

SEQ ID NO: 2238227 - DNA, 13 bp, Homo sapiens
cagccctgcagag

SEQ ID NO: 2238228 - DNA, 15 bp, Homo sapiens
cagcccttagcaggg

SEQ ID NO: 2238229 - DNA, 19 bp, Homo sapiens
cagccgagatagccaaggc

SEQ ID NO: 2238230 - DNA, 20 bp, Homo sapiens
cagcctcacagtccttacca

SEQ ID NO: 2238231 - DNA, 22 bp, Homo sapiens
cagcctcccgaatagctgggac

SEQ ID NO: 2238232 - DNA, 12 bp, Homo sapiens
cagcctgctcca

SEQ ID NO: 2238233 - DNA, 17 bp, Homo sapiens
cagccttgaccattctc

SEQ ID NO: 2238234 - DNA, 13 bp, Homo sapiens
cagcgagccctgg

SEQ ID NO: 2238235 - DNA, 17 bp, Homo sapiens
cagcggggacagctcct

SEQ ID NO: 2238236 - DNA, 20 bp, Homo sapiens
cagctaacatggaagtacta

SEQ ID NO: 2238237 - DNA, 14 bp, Homo sapiens
cagctcaccagccc

SEQ ID NO: 2238238 - DNA, 20 bp, Homo sapiens
cagctcaccagccccagtgc

SEQ ID NO: 2238239 - DNA, 15 bp, Homo sapiens
cagctcacctctccc

SEQ ID NO: 2238240 - DNA, 14 bp, Homo sapiens
cagctccagctcac

SEQ ID NO: 2238241 - DNA, 22 bp, Homo sapiens
cagctccagctcaccagcccca

SEQ ID NO: 2238242 - DNA, 16 bp, Homo sapiens
cagctccttctgtcct

SEQ ID NO: 2238243 - DNA, 21 bp, Homo sapiens
cagctccttctgtcctactct

SEQ ID NO: 2238244 - DNA, 13 bp, Homo sapiens
cagctctgtcctg

SEQ ID NO: 2238245 - DNA, 14 bp, Homo sapiens
cagctctgtcctgg

SEQ ID NO: 2238246 - DNA, 16 bp, Homo sapiens
cagctctgtcctggga

SEQ ID NO: 2238247 - DNA, 10 bp, Homo sapiens
cagctcttat

SEQ ID NO: 2238248 - DNA, 14 bp, Homo sapiens
cagctcttctccag

SEQ ID NO: 2238249 - DNA, 21 bp, Homo sapiens
cagctgacttttctgtccgag

SEQ ID NO: 2238250 - DNA, 12 bp, Homo sapiens
cagctgcctggg

SEQ ID NO: 2238251 - DNA, 14 bp, Homo sapiens
cagctgcctgggat

SEQ ID NO: 2238252 - DNA, 18 bp, Homo sapiens
cagctgcctgggatccct

SEQ ID NO: 2238253 - DNA, 19 bp, Homo sapiens
cagctgcggtccacccagg

SEQ ID NO: 2238254 - DNA, 21 bp, Homo sapiens
cagctgcggtccacccaggag

SEQ ID NO: 2238255 - DNA, 22 bp, Homo sapiens
cagctgcggtccacccaggagc

SEQ ID NO: 2238256 - DNA, 16 bp, Homo sapiens
cattctgcctgcccag

SEQ ID NO: 2238257 - DNA, 20 bp, Homo sapiens
cattctgcctgcccaggccc

SEQ ID NO: 2238258 - DNA, 13 bp, Homo sapiens
cattgacctgagg

SEQ ID NO: 2238259 - DNA, 22 bp, Homo sapiens
cattgacctgaggcccttctct

SEQ ID NO: 2238260 - DNA, 12 bp, Homo sapiens
catttaaaagat

SEQ ID NO: 2238261 - DNA, 15 bp, Homo sapiens
catttaaaagataca

SEQ ID NO: 2238262 - DNA, 16 bp, Homo sapiens
catttaaaagatacag

SEQ ID NO: 2238263 - DNA, 16 bp, Homo sapiens
catttaggtgaggaag

SEQ ID NO: 2238264 - DNA, 21 bp, Homo sapiens
catttcttccacaagagccca

SEQ ID NO: 2238265 - DNA, 17 bp, Homo sapiens
catttgagcagggctca

SEQ ID NO: 2238266 - DNA, 18 bp, Homo sapiens
catttgaggtctgttctt

SEQ ID NO: 2238267 - DNA, 21 bp, Homo sapiens
catttggtggtttcagaaatg

SEQ ID NO: 2238268 - DNA, 22 bp, Homo sapiens
catttggtggtttcagaaatgt

SEQ ID NO: 2238269 - DNA, 23 bp, Homo sapiens
catttggtggtttcagaaatgtg

SEQ ID NO: 2238270 - DNA, 22 bp, Homo sapiens
cattttattttattatgcatga

SEQ ID NO: 2238271 - DNA, 18 bp, Homo sapiens
cattttgctaaatgtgaa

SEQ ID NO: 2238272 - DNA, 21 bp, Homo sapiens
cattttggggtacccactgct

SEQ ID NO: 2238273 - DNA, 20 bp, Homo sapiens
catttttaagtgctgcattt

SEQ ID NO: 2238274 - DNA, 17 bp, Homo sapiens
ccaaaactctcctctgc

SEQ ID NO: 2238275 - DNA, 21 bp, Homo sapiens
ccaaaataaaactttttaaaa

SEQ ID NO: 2238276 - DNA, 23 bp, Homo sapiens
ccaaagcagtgcatgctgtccct

SEQ ID NO: 2238277 - DNA, 21 bp, Homo sapiens
ccaaagctaggcctggccaga

SEQ ID NO: 2238278 - DNA, 15 bp, Homo sapiens
ccaaaggaagcacat

SEQ ID NO: 2238279 - DNA, 14 bp, Homo sapiens
ccaacatactccca

SEQ ID NO: 2238280 - DNA, 16 bp, Homo sapiens
ccaacatactcccatc

SEQ ID NO: 2238281 - DNA, 17 bp, Homo sapiens
ccaacatactcccatct

SEQ ID NO: 2238282 - DNA, 20 bp, Homo sapiens
ccaacatactcccatctgtg

SEQ ID NO: 2238283 - DNA, 16 bp, Homo sapiens
ccaactcaccccagcc

SEQ ID NO: 2238284 - DNA, 21 bp, Homo sapiens
ccaactcaccccagccccaaa

SEQ ID NO: 2238285 - DNA, 13 bp, Homo sapiens
ccaagaagcccag

SEQ ID NO: 2238286 - DNA, 18 bp, Homo sapiens
ccaagagagacagcacag

SEQ ID NO: 2238287 - DNA, 19 bp, Homo sapiens
ccaagagagacagcacagg

SEQ ID NO: 2238288 - DNA, 23 bp, Homo sapiens
ccaagcagaggttgggaggccat

SEQ ID NO: 2238289 - DNA, 13 bp, Homo sapiens
ccaagctcccagg

SEQ ID NO: 2238290 - DNA, 17 bp, Homo sapiens
ccaagctctgctcctct

SEQ ID NO: 2238291 - DNA, 18 bp, Homo sapiens
ccaagctctgctcctctc

SEQ ID NO: 2238292 - DNA, 15 bp, Homo sapiens
ccaaggccaaaggaa

SEQ ID NO: 2238293 - DNA, 17 bp, Homo sapiens
ccaaggccaaaggaagc

SEQ ID NO: 2238294 - DNA, 21 bp, Homo sapiens
ccaaggccaaaggaagcacat

SEQ ID NO: 2238295 - DNA, 15 bp, Homo sapiens
ccaagggcctggcct

SEQ ID NO: 2238296 - DNA, 19 bp, Homo sapiens
ccaagggcctggcctgagc

SEQ ID NO: 2238297 - DNA, 22 bp, Homo sapiens
ccaaggggaatgtttgcctctg

SEQ ID NO: 2238298 - DNA, 22 bp, Homo sapiens
ccaatgcactttgttctggctc

SEQ ID NO: 2238299 - DNA, 14 bp, Homo sapiens
ccaatgggagctca

SEQ ID NO: 2238300 - DNA, 20 bp, Homo sapiens
ccaatgttctctcttctcca

SEQ ID NO: 2238301 - DNA, 18 bp, Homo sapiens
ccacaaaggagagctagc

SEQ ID NO: 2238302 - DNA, 15 bp, Homo sapiens
ccacaagttaaataa

SEQ ID NO: 2238303 - DNA, 15 bp, Homo sapiens
ccacacccagcccac

SEQ ID NO: 2238304 - DNA, 22 bp, Homo sapiens
ccacagagaaagtacttctcca

SEQ ID NO: 2238305 - DNA, 16 bp, Homo sapiens
ccacaggatcagtctg

SEQ ID NO: 2238306 - DNA, 18 bp, Homo sapiens
ccacatcttgctctgctg

SEQ ID NO: 2238307 - DNA, 19 bp, Homo sapiens
ccacatcttgctctgctga

SEQ ID NO: 2238308 - DNA, 22 bp, Homo sapiens
ccacatcttgctctgctgacag

SEQ ID NO: 2238309 - DNA, 20 bp, Homo sapiens
ccaccaacatactcccatct

SEQ ID NO: 2238310 - DNA, 21 bp, Homo sapiens
ccaccaacatactcccatctg

SEQ ID NO: 2238311 - DNA, 16 bp, Homo sapiens
ccaccacacccagccc

SEQ ID NO: 2238312 - DNA, 16 bp, Homo sapiens
ccaccatcaagccacc

SEQ ID NO: 2238313 - DNA, 20 bp, Homo sapiens
ccaccatcaagccaccaaca

SEQ ID NO: 2238314 - DNA, 20 bp, Homo sapiens
ccacccaagggcctggcctg

SEQ ID NO: 2238315 - DNA, 22 bp, Homo sapiens
ccacccaagggcctggcctgag

SEQ ID NO: 2238316 - DNA, 15 bp, Homo sapiens
ccaccccacacacgc

SEQ ID NO: 2238317 - DNA, 14 bp, Homo sapiens
ccaccctcctttca

SEQ ID NO: 2238318 - DNA, 13 bp, Homo sapiens
ccaccctgctctc

SEQ ID NO: 2238319 - DNA, 13 bp, Homo sapiens
ccaccgcagacag

SEQ ID NO: 2238320 - DNA, 17 bp, Homo sapiens
ccaccgcagacaggacc

SEQ ID NO: 2238321 - DNA, 19 bp, Homo sapiens
ccaccgcagacaggaccag

SEQ ID NO: 2238322 - DNA, 22 bp, Homo sapiens
ccaccgcagacaggaccaggga

SEQ ID NO: 2238323 - DNA, 12 bp, Homo sapiens
ccacctcagcct

SEQ ID NO: 2238324 - DNA, 14 bp, Homo sapiens
ccacctctctcact

SEQ ID NO: 2238325 - DNA, 14 bp, Homo sapiens
ccaccttggctcaa

SEQ ID NO: 2238326 - DNA, 15 bp, Homo sapiens
ccaccttggctcaag

SEQ ID NO: 2238327 - DNA, 14 bp, Homo sapiens
ccaccttggctgca

SEQ ID NO: 2238328 - DNA, 18 bp, Homo sapiens
ccaccttggctgcaggga

SEQ ID NO: 2238329 - DNA, 19 bp, Homo sapiens
ccaccttggctgcagggag

SEQ ID NO: 2238330 - DNA, 21 bp, Homo sapiens
ccacctttgaagaagtaagga

SEQ ID NO: 2238331 - DNA, 17 bp, Homo sapiens
ccacgcccccactggtg

SEQ ID NO: 2238332 - DNA, 18 bp, Homo sapiens
ccacgcccccactggtga

SEQ ID NO: 2238333 - DNA, 18 bp, Homo sapiens
ccacgctggagtgcagtg

SEQ ID NO: 2238334 - DNA, 19 bp, Homo sapiens
ccacgctggagtgcagtga

SEQ ID NO: 2238335 - DNA, 14 bp, Homo sapiens
ccacggccaggcca

SEQ ID NO: 2238336 - DNA, 11 bp, Homo sapiens
ccactacattc

SEQ ID NO: 2238337 - DNA, 15 bp, Homo sapiens
ccactacattctgtt

SEQ ID NO: 2238338 - DNA, 16 bp, Homo sapiens
ccactacattctgtta

SEQ ID NO: 2238339 - DNA, 20 bp, Homo sapiens
ccactgcactatagcctagg

SEQ ID NO: 2238340 - DNA, 13 bp, Homo sapiens
ccactgctctggt

SEQ ID NO: 2238341 - DNA, 20 bp, Homo sapiens
ccactgcttttggtctgtgt

SEQ ID NO: 2238342 - DNA, 23 bp, Homo sapiens
ccactggtgacatgtcttttctt

SEQ ID NO: 2238343 - DNA, 14 bp, Homo sapiens
ccacttttgttctt

SEQ ID NO: 2238344 - DNA, 15 bp, Homo sapiens
ccacttttgttcttg

SEQ ID NO: 2238345 - DNA, 21 bp, Homo sapiens
ccacttttgttcttggtttgt

SEQ ID NO: 2238346 - DNA, 22 bp, Homo sapiens
ccagaagaaaatagtggtgtga

SEQ ID NO: 2238347 - DNA, 12 bp, Homo sapiens
ccagaatttccc

SEQ ID NO: 2238348 - DNA, 19 bp, Homo sapiens
ccagaatttcccaaagcag

SEQ ID NO: 2238349 - DNA, 21 bp, Homo sapiens
ccagaatttcccaaagcagtg

SEQ ID NO: 2238350 - DNA, 17 bp, Homo sapiens
ccagacacatgtccaag

SEQ ID NO: 2238351 - DNA, 20 bp, Homo sapiens
ccagacacatgtccaagaag

SEQ ID NO: 2238352 - DNA, 22 bp, Homo sapiens
ccagacacatgtccaagaagcc

SEQ ID NO: 2238353 - DNA, 17 bp, Homo sapiens
ccagacccccttgccca

SEQ ID NO: 2238354 - DNA, 16 bp, Homo sapiens
ccagacccggctgcgt

SEQ ID NO: 2238355 - DNA, 17 bp, Homo sapiens
ccagacccggctgcgtg

SEQ ID NO: 2238356 - DNA, 23 bp, Homo sapiens
ccagagagggtggtgacctctgc

SEQ ID NO: 2238357 - DNA, 14 bp, Homo sapiens
ccagagcccacctt

SEQ ID NO: 2238358 - DNA, 16 bp, Homo sapiens
ccagagcccaccttgg

SEQ ID NO: 2238359 - DNA, 12 bp, Homo sapiens
ccagagctgcca

SEQ ID NO: 2238360 - DNA, 21 bp, Homo sapiens
ccagagggagtgacagaggca

SEQ ID NO: 2238361 - DNA, 22 bp, Homo sapiens
ccagagggagtgacagaggcag

SEQ ID NO: 2238362 - DNA, 13 bp, Homo sapiens
ccagagggcctgc

SEQ ID NO: 2238363 - DNA, 23 bp, Homo sapiens
ccagatgcaccagcccttagcag

SEQ ID NO: 2238364 - DNA, 18 bp, Homo sapiens
ccagattgcaacaggctg

SEQ ID NO: 2238365 - DNA, 20 bp, Homo sapiens
ccagattgcaacaggctggg

SEQ ID NO: 2238366 - DNA, 22 bp, Homo sapiens
ccagattgcaacaggctgggct

SEQ ID NO: 2238367 - DNA, 23 bp, Homo sapiens
ccagattgcaacaggctgggctt

SEQ ID NO: 2238368 - DNA, 12 bp, Homo sapiens
ccagatttcact

SEQ ID NO: 2238369 - DNA, 15 bp, Homo sapiens
ccagatttcactctc

SEQ ID NO: 2238370 - DNA, 16 bp, Homo sapiens
ccagcaagtgagagct

SEQ ID NO: 2238371 - DNA, 17 bp, Homo sapiens
ccagcaagtgagagctg

SEQ ID NO: 2238372 - DNA, 18 bp, Homo sapiens
ccagcaccatctctcctc

SEQ ID NO: 2238373 - DNA, 12 bp, Homo sapiens
ccagcagaaatg

SEQ ID NO: 2238374 - DNA, 17 bp, Homo sapiens
ccagcagaaatgcctta

SEQ ID NO: 2238375 - DNA, 19 bp, Homo sapiens
ccagcagagcaccttagac

SEQ ID NO: 2238376 - DNA, 15 bp, Homo sapiens
ccagcagcctggacc

SEQ ID NO: 2238377 - DNA, 17 bp, Homo sapiens
ccagcaggctctcaggc

SEQ ID NO: 2238378 - DNA, 18 bp, Homo sapiens
ccagccaaagcctcctcc

SEQ ID NO: 2238379 - DNA, 20 bp, Homo sapiens
ccctgctggttcagggttgg

SEQ ID NO: 2238380 - DNA, 13 bp, Homo sapiens
ccctggcagcccc

SEQ ID NO: 2238381 - DNA, 14 bp, Homo sapiens
ccctggtggcagct

SEQ ID NO: 2238382 - DNA, 20 bp, Homo sapiens
ccctggtggcagctcacctc

SEQ ID NO: 2238383 - DNA, 15 bp, Homo sapiens
ccctggtggcagtgg

SEQ ID NO: 2238384 - DNA, 19 bp, Homo sapiens
ccctgtgatggggccctgc

SEQ ID NO: 2238385 - DNA, 23 bp, Homo sapiens
ccctgtgatggggccctgcctcc

SEQ ID NO: 2238386 - DNA, 16 bp, Homo sapiens
ccctgtgggcccccaa

SEQ ID NO: 2238387 - DNA, 18 bp, Homo sapiens
ccctgtgggcccccaaat

SEQ ID NO: 2238388 - DNA, 14 bp, Homo sapiens
ccctgttctggcag

SEQ ID NO: 2238389 - DNA, 17 bp, Homo sapiens
cccttacctgccaggaa

SEQ ID NO: 2238390 - DNA, 14 bp, Homo sapiens
cccttcgctcctgt

SEQ ID NO: 2238391 - DNA, 15 bp, Homo sapiens
cccttcgctcctgtg

SEQ ID NO: 2238392 - DNA, 19 bp, Homo sapiens
cccttctctccagcccctg

SEQ ID NO: 2238393 - DNA, 22 bp, Homo sapiens
cccttctgacccatgctgccct

SEQ ID NO: 2238394 - DNA, 23 bp, Homo sapiens
cccttctgacccatgctgccctg

SEQ ID NO: 2238395 - DNA, 17 bp, Homo sapiens
cccttggattgtccccg

SEQ ID NO: 2238396 - DNA, 18 bp, Homo sapiens
cccttggggagcaggctc

SEQ ID NO: 2238397 - DNA, 22 bp, Homo sapiens
cccttggttaggcattgtggga

SEQ ID NO: 2238398 - DNA, 16 bp, Homo sapiens
cccttgtggtcccacc

SEQ ID NO: 2238399 - DNA, 20 bp, Homo sapiens
cccttgtggtcccaccccac

SEQ ID NO: 2238400 - DNA, 22 bp, Homo sapiens
cccttgtggtcccaccccacac

SEQ ID NO: 2238401 - DNA, 19 bp, Homo sapiens
cccttttttggctgctgaa

SEQ ID NO: 2238402 - DNA, 21 bp, Homo sapiens
cccttttttggctgctgaagg

SEQ ID NO: 2238403 - DNA, 17 bp, Homo sapiens
ccgaaaacgtggctgct

SEQ ID NO: 2238404 - DNA, 17 bp, Homo sapiens
ccgaatagctgggacta

SEQ ID NO: 2238405 - DNA, 17 bp, Homo sapiens
ccgaggccttctctgaa

SEQ ID NO: 2238406 - DNA, 14 bp, Homo sapiens
ccgagtagctggga

SEQ ID NO: 2238407 - DNA, 17 bp, Homo sapiens
ccgagtagctgggacta

SEQ ID NO: 2238408 - DNA, 20 bp, Homo sapiens
ccgagtagctgggactacag

SEQ ID NO: 2238409 - DNA, 16 bp, Homo sapiens
ccgcagacaggaccag

SEQ ID NO: 2238410 - DNA, 14 bp, Homo sapiens
ccgcagccctgcag

SEQ ID NO: 2238411 - DNA, 18 bp, Homo sapiens
ccgcagccctgcagaggg

SEQ ID NO: 2238412 - DNA, 12 bp, Homo sapiens
ccgcccaggctt

SEQ ID NO: 2238413 - DNA, 20 bp, Homo sapiens
ccgcccaggcttagtcactg

SEQ ID NO: 2238414 - DNA, 21 bp, Homo sapiens
ccgctaagagggagggagggc

SEQ ID NO: 2238415 - DNA, 19 bp, Homo sapiens
ccgctttctacccagcgag

SEQ ID NO: 2238416 - DNA, 18 bp, Homo sapiens
ccggccacctgcggtgct

SEQ ID NO: 2238417 - DNA, 18 bp, Homo sapiens
ccggcccagtgccccctg

SEQ ID NO: 2238418 - DNA, 13 bp, Homo sapiens
ccggctccaggct

SEQ ID NO: 2238419 - DNA, 12 bp, Homo sapiens
ccggctggcctg

SEQ ID NO: 2238420 - DNA, 18 bp, Homo sapiens
ccggctggcctggcccct

SEQ ID NO: 2238421 - DNA, 15 bp, Homo sapiens
ccgggcagcagagag

SEQ ID NO: 2238422 - DNA, 14 bp, Homo sapiens
ccgggctctgcctc

SEQ ID NO: 2238423 - DNA, 15 bp, Homo sapiens
ccgtctacctgaggg

SEQ ID NO: 2238424 - DNA, 13 bp, Homo sapiens
ccgtgaggccaga

SEQ ID NO: 2238425 - DNA, 16 bp, Homo sapiens
cctaaaattcagtgga

SEQ ID NO: 2238426 - DNA, 18 bp, Homo sapiens
cctacaggagtgagcact

SEQ ID NO: 2238427 - DNA, 21 bp, Homo sapiens
cctacagttgaaaaacagctg

SEQ ID NO: 2238428 - DNA, 13 bp, Homo sapiens
cctacccaccctc

SEQ ID NO: 2238429 - DNA, 19 bp, Homo sapiens
cctagccttagaagtcaca

SEQ ID NO: 2238430 - DNA, 23 bp, Homo sapiens
cctagttccaccatcaagccacc

SEQ ID NO: 2238431 - DNA, 22 bp, Homo sapiens
cctatattgttttcagtgtaca

SEQ ID NO: 2238432 - DNA, 15 bp, Homo sapiens
cctcaacctcctggg

SEQ ID NO: 2238433 - DNA, 19 bp, Homo sapiens
cctcaactctcctccagag

SEQ ID NO: 2238434 - DNA, 12 bp, Homo sapiens
cctcaccccact

SEQ ID NO: 2238435 - DNA, 11 bp, Homo sapiens
cctcaggcctg

SEQ ID NO: 2238436 - DNA, 23 bp, Homo sapiens
cctcaggcctgggggctgggcag

SEQ ID NO: 2238437 - DNA, 14 bp, Homo sapiens
cctcagggtccctg

SEQ ID NO: 2238438 - DNA, 15 bp, Homo sapiens
cctcagggtccctgg

SEQ ID NO: 2238439 - DNA, 17 bp, Homo sapiens
cctcaggtgagaagcag

SEQ ID NO: 2238440 - DNA, 17 bp, Homo sapiens
cctcaggtgatccaccc

SEQ ID NO: 2238441 - DNA, 15 bp, Homo sapiens
cctcagtctggccct

SEQ ID NO: 2238442 - DNA, 11 bp, Homo sapiens
cctcagtgcca

SEQ ID NO: 2238443 - DNA, 21 bp, Homo sapiens
cctcatagtatggtggctggg

SEQ ID NO: 2238444 - DNA, 14 bp, Homo sapiens
cctcatcaccaacg

SEQ ID NO: 2238445 - DNA, 19 bp, Homo sapiens
cctcatgttcttaattctt

SEQ ID NO: 2238446 - DNA, 18 bp, Homo sapiens
cctcattagcattttgct

SEQ ID NO: 2238447 - DNA, 12 bp, Homo sapiens
cctccaggtgca

SEQ ID NO: 2238448 - DNA, 17 bp, Homo sapiens
cctccaggtgcacaagc

SEQ ID NO: 2238449 - DNA, 23 bp, Homo sapiens
cctccatgtgggctagttgggct

SEQ ID NO: 2238450 - DNA, 16 bp, Homo sapiens
cctcccaaagtgctgg

SEQ ID NO: 2238451 - DNA, 14 bp, Homo sapiens
cctcccaactcacc

SEQ ID NO: 2238452 - DNA, 12 bp, Homo sapiens
cctcccaccccc

SEQ ID NO: 2238453 - DNA, 20 bp, Homo sapiens
cctcccaccccctccccggg

SEQ ID NO: 2238454 - DNA, 21 bp, Homo sapiens
cctcccaccccctccccgggc

SEQ ID NO: 2238455 - DNA, 17 bp, Homo sapiens
cctcccacctcagcctc

SEQ ID NO: 2238456 - DNA, 16 bp, Homo sapiens
cctcccatctcacaca

SEQ ID NO: 2238457 - DNA, 19 bp, Homo sapiens
cctccccgggcagcagaga

SEQ ID NO: 2238458 - DNA, 17 bp, Homo sapiens
cctcccgagtagctggg

SEQ ID NO: 2238459 - DNA, 10 bp, Homo sapiens
cctccctccc

SEQ ID NO: 2238460 - DNA, 13 bp, Homo sapiens
cctccgcctcttg

SEQ ID NO: 2238461 - DNA, 12 bp, Homo sapiens
cctcctccagcc

SEQ ID NO: 2238462 - DNA, 13 bp, Homo sapiens
cctcctgcctcga

SEQ ID NO: 2238463 - DNA, 13 bp, Homo sapiens
cctcctgtgtgtg

SEQ ID NO: 2238464 - DNA, 15 bp, Homo sapiens
cctcctgtgtgtgcg

SEQ ID NO: 2238465 - DNA, 15 bp, Homo sapiens
cctcgaactggctgc

SEQ ID NO: 2238466 - DNA, 16 bp, Homo sapiens
cctcgaactggctgca

SEQ ID NO: 2238467 - DNA, 14 bp, Homo sapiens
cctcgaccaccccc

SEQ ID NO: 2238468 - DNA, 16 bp, Homo sapiens
cctcggtgccttcctc

SEQ ID NO: 2238469 - DNA, 16 bp, Homo sapiens
cctctaggaggtctct

SEQ ID NO: 2238470 - DNA, 20 bp, Homo sapiens
cctctccccagcaagtgaga

SEQ ID NO: 2238471 - DNA, 13 bp, Homo sapiens
cctctcccttgga

SEQ ID NO: 2238472 - DNA, 18 bp, Homo sapiens
cctctgacacacagctct

SEQ ID NO: 2238473 - DNA, 11 bp, Homo sapiens
cctctgcacaa

SEQ ID NO: 2238474 - DNA, 20 bp, Homo sapiens
cctctgcacaagctgcaccc

SEQ ID NO: 2238475 - DNA, 22 bp, Homo sapiens
cctctgcactcccctgctgggt

SEQ ID NO: 2238476 - DNA, 19 bp, Homo sapiens
cctctgcagcaataaagca

SEQ ID NO: 2238477 - DNA, 21 bp, Homo sapiens
cctctgcctgaagtcacacag

SEQ ID NO: 2238478 - DNA, 22 bp, Homo sapiens
cctctgcctgaagtcacacagt

SEQ ID NO: 2238479 - DNA, 13 bp, Homo sapiens
cctctgctgctgg

SEQ ID NO: 2238480 - DNA, 14 bp, Homo sapiens
cctctgctgctggc

SEQ ID NO: 2238481 - DNA, 15 bp, Homo sapiens
cctctgtacagagcc

SEQ ID NO: 2238482 - DNA, 13 bp, Homo sapiens
cctcttgggttca

SEQ ID NO: 2238483 - DNA, 18 bp, Homo sapiens
cctgaaggccccgcccag

SEQ ID NO: 2238484 - DNA, 22 bp, Homo sapiens
cctgaaggccccgcccaggctt

SEQ ID NO: 2238485 - DNA, 16 bp, Homo sapiens
cctgaagtcacacagt

SEQ ID NO: 2238486 - DNA, 17 bp, Homo sapiens
cctgaagtcacacagtg

SEQ ID NO: 2238487 - DNA, 19 bp, Homo sapiens
cctgaagtcacacagtgag

SEQ ID NO: 2238488 - DNA, 12 bp, Homo sapiens
cctgacaacact

SEQ ID NO: 2238489 - DNA, 14 bp, Homo sapiens
cctgacaacactca

SEQ ID NO: 2238490 - DNA, 18 bp, Homo sapiens
cctgagccagatttcact

SEQ ID NO: 2238491 - DNA, 12 bp, Homo sapiens
cctgagctggga

SEQ ID NO: 2238492 - DNA, 12 bp, Homo sapiens
cctgaggcccag

SEQ ID NO: 2238493 - DNA, 13 bp, Homo sapiens
cctgaggcccaga

SEQ ID NO: 2238494 - DNA, 19 bp, Homo sapiens
cctgaggcccttctctcca

SEQ ID NO: 2238495 - DNA, 21 bp, Homo sapiens
cctgaggcccttctctccagc

SEQ ID NO: 2238496 - DNA, 19 bp, Homo sapiens
cctgaggctgggctccctt

SEQ ID NO: 2238497 - DNA, 20 bp, Homo sapiens
cctgatgcttcttcagagac

SEQ ID NO: 2238498 - DNA, 21 bp, Homo sapiens
cctgatgcttcttcagagact

SEQ ID NO: 2238499 - DNA, 21 bp, Homo sapiens
cctgcaacctgattgtgtctc

SEQ ID NO: 2238500 - DNA, 12 bp, Homo sapiens
cctgcagagggc

SEQ ID NO: 2238501 - DNA, 21 bp, Homo sapiens
cctgcaggcagccaggccaca

SEQ ID NO: 2238502 - DNA, 19 bp, Homo sapiens
cctgccaatggactaactt

SEQ ID NO: 2238503 - DNA, 14 bp, Homo sapiens
cctgccaggaagcc

SEQ ID NO: 2238504 - DNA, 17 bp, Homo sapiens
ctccttcacagatgggt

SEQ ID NO: 2238505 - DNA, 13 bp, Homo sapiens
ctccttcaccttt

SEQ ID NO: 2238506 - DNA, 16 bp, Homo sapiens
ctccttcacctttgtc

SEQ ID NO: 2238507 - DNA, 21 bp, Homo sapiens
ctccttgaaaacactgttctc

SEQ ID NO: 2238508 - DNA, 14 bp, Homo sapiens
ctccttgtgttact

SEQ ID NO: 2238509 - DNA, 16 bp, Homo sapiens
ctcctttagcgcccag

SEQ ID NO: 2238510 - DNA, 22 bp, Homo sapiens
ctcctttagcgcccagttgggt

SEQ ID NO: 2238511 - DNA, 15 bp, Homo sapiens
ctcgaactggctgca

SEQ ID NO: 2238512 - DNA, 16 bp, Homo sapiens
ctcgagttacagacaa

SEQ ID NO: 2238513 - DNA, 13 bp, Homo sapiens
ctcgcgacaatgc

SEQ ID NO: 2238514 - DNA, 15 bp, Homo sapiens
ctcgcgacaatgcaa

SEQ ID NO: 2238515 - DNA, 16 bp, Homo sapiens
ctcggtgtggagaagc

SEQ ID NO: 2238516 - DNA, 17 bp, Homo sapiens
ctcggtgtggagaagcg

SEQ ID NO: 2238517 - DNA, 18 bp, Homo sapiens
ctcgtggagaatttttac

SEQ ID NO: 2238518 - DNA, 13 bp, Homo sapiens
ctctacaaaaagc

SEQ ID NO: 2238519 - DNA, 20 bp, Homo sapiens
ctctaccatcccctgtagag

SEQ ID NO: 2238520 - DNA, 13 bp, Homo sapiens
ctctaccctggca

SEQ ID NO: 2238521 - DNA, 18 bp, Homo sapiens
ctctatttttgtaaaaag

SEQ ID NO: 2238522 - DNA, 19 bp, Homo sapiens
ctctcagattgtaccattg

SEQ ID NO: 2238523 - DNA, 18 bp, Homo sapiens
ctctcaggccagctgctt

SEQ ID NO: 2238524 - DNA, 21 bp, Homo sapiens
ctctcaggccagctgcttggg

SEQ ID NO: 2238525 - DNA, 22 bp, Homo sapiens
ctctcaggccagctgcttgggc

SEQ ID NO: 2238526 - DNA, 23 bp, Homo sapiens
ctctcaggccagctgcttgggct

SEQ ID NO: 2238527 - DNA, 13 bp, Homo sapiens
ctctccagcccct

SEQ ID NO: 2238528 - DNA, 13 bp, Homo sapiens
ctctcccatcact

SEQ ID NO: 2238529 - DNA, 14 bp, Homo sapiens
ctctcccatcactt

SEQ ID NO: 2238530 - DNA, 14 bp, Homo sapiens
ctctccccagcaag

SEQ ID NO: 2238531 - DNA, 13 bp, Homo sapiens
ctctcccttggat

SEQ ID NO: 2238532 - DNA, 20 bp, Homo sapiens
ctctcctccttttcacagtt

SEQ ID NO: 2238533 - DNA, 10 bp, Homo sapiens
ctctcctctg

SEQ ID NO: 2238534 - DNA, 12 bp, Homo sapiens
ctctcctctgct

SEQ ID NO: 2238535 - DNA, 14 bp, Homo sapiens
ctctcctgtacctc

SEQ ID NO: 2238536 - DNA, 17 bp, Homo sapiens
ctctcctgtacctcttg

SEQ ID NO: 2238537 - DNA, 18 bp, Homo sapiens
ctctcctgtacctcttga

SEQ ID NO: 2238538 - DNA, 12 bp, Homo sapiens
ctctctcactcc

SEQ ID NO: 2238539 - DNA, 16 bp, Homo sapiens
ctctctcactccttga

SEQ ID NO: 2238540 - DNA, 12 bp, Homo sapiens
ctctctcaggcc

SEQ ID NO: 2238541 - DNA, 13 bp, Homo sapiens
ctctctcctccct

SEQ ID NO: 2238542 - DNA, 22 bp, Homo sapiens
ctctgaaggacattgcggacag

SEQ ID NO: 2238543 - DNA, 16 bp, Homo sapiens
ctctgacacacagctc

SEQ ID NO: 2238544 - DNA, 20 bp, Homo sapiens
ctctgagactcgcgacaatg

SEQ ID NO: 2238545 - DNA, 21 bp, Homo sapiens
ctctgagactcgcgacaatgc

SEQ ID NO: 2238546 - DNA, 16 bp, Homo sapiens
ctctgaggacactaac

SEQ ID NO: 2238547 - DNA, 15 bp, Homo sapiens
ctctgcacaagctgc

SEQ ID NO: 2238548 - DNA, 17 bp, Homo sapiens
ctctgcacaagctgcac

SEQ ID NO: 2238549 - DNA, 18 bp, Homo sapiens
ctctgcacaagctgcacc

SEQ ID NO: 2238550 - DNA, 21 bp, Homo sapiens
ctctgcacaagctgcaccctc

SEQ ID NO: 2238551 - DNA, 15 bp, Homo sapiens
ctctgcactcccctg

SEQ ID NO: 2238552 - DNA, 20 bp, Homo sapiens
ctctgcactcccctgctggg

SEQ ID NO: 2238553 - DNA, 21 bp, Homo sapiens
ctctgcactcccctgctgggt

SEQ ID NO: 2238554 - DNA, 13 bp, Homo sapiens
ctctgcagcaata

SEQ ID NO: 2238555 - DNA, 15 bp, Homo sapiens
ctctgccctccaaga

SEQ ID NO: 2238556 - DNA, 16 bp, Homo sapiens
ctctgccctccaagac

SEQ ID NO: 2238557 - DNA, 16 bp, Homo sapiens
ctctgcctcccatcac

SEQ ID NO: 2238558 - DNA, 14 bp, Homo sapiens
ctctgcctctgaca

SEQ ID NO: 2238559 - DNA, 21 bp, Homo sapiens
ctctgctcctctccccagcaa

SEQ ID NO: 2238560 - DNA, 13 bp, Homo sapiens
ctctgctgacaga

SEQ ID NO: 2238561 - DNA, 16 bp, Homo sapiens
ctctgctgacagacac

SEQ ID NO: 2238562 - DNA, 18 bp, Homo sapiens
ctctgctgacagacacag

SEQ ID NO: 2238563 - DNA, 13 bp, Homo sapiens
ctctgctgctggc

SEQ ID NO: 2238564 - DNA, 15 bp, Homo sapiens
ctctggacaggcatg

SEQ ID NO: 2238565 - DNA, 22 bp, Homo sapiens
ctctggacaggcatgttctctg

SEQ ID NO: 2238566 - DNA, 15 bp, Homo sapiens
ctctggcagctcaga

SEQ ID NO: 2238567 - DNA, 15 bp, Homo sapiens
ctctggtccatagag

SEQ ID NO: 2238568 - DNA, 14 bp, Homo sapiens
ctctgtcctgggag

SEQ ID NO: 2238569 - DNA, 15 bp, Homo sapiens
ctctgtcctgggagt

SEQ ID NO: 2238570 - DNA, 19 bp, Homo sapiens
ctctgtgtcaggtggggca

SEQ ID NO: 2238571 - DNA, 21 bp, Homo sapiens
ctctgtgtcaggtggggcagc

SEQ ID NO: 2238572 - DNA, 24 bp, Homo sapiens
ctcttaaaacccaagtgccttagc

SEQ ID NO: 2238573 - DNA, 19 bp, Homo sapiens
ctcttattgcccacgctgg

SEQ ID NO: 2238574 - DNA, 13 bp, Homo sapiens
ctcttccaggctg

SEQ ID NO: 2238575 - DNA, 15 bp, Homo sapiens
ctcttccaggctggg

SEQ ID NO: 2238576 - DNA, 23 bp, Homo sapiens
ctcttccaggctgggagagcctt

SEQ ID NO: 2238577 - DNA, 16 bp, Homo sapiens
ctcttctccaggctgt

SEQ ID NO: 2238578 - DNA, 13 bp, Homo sapiens
ctcttgacctcag

SEQ ID NO: 2238579 - DNA, 18 bp, Homo sapiens
ctcttgagccttgaactt

SEQ ID NO: 2238580 - DNA, 17 bp, Homo sapiens
ctcttggtcctgctgca

SEQ ID NO: 2238581 - DNA, 21 bp, Homo sapiens
ctctttaatgtcacaggcagg

SEQ ID NO: 2238582 - DNA, 17 bp, Homo sapiens
ctctttccctcccttcc

SEQ ID NO: 2238583 - DNA, 18 bp, Homo sapiens
ctctttggacactcacac

SEQ ID NO: 2238584 - DNA, 22 bp, Homo sapiens
ctctttggtctacactgtgctg

SEQ ID NO: 2238585 - DNA, 16 bp, Homo sapiens
ctgaaaatgtatgtgt

SEQ ID NO: 2238586 - DNA, 16 bp, Homo sapiens
ctgaaagccctgagct

SEQ ID NO: 2238587 - DNA, 16 bp, Homo sapiens
ctgaacttggcgctgc

SEQ ID NO: 2238588 - DNA, 21 bp, Homo sapiens
ctgaagactcattcttctgta

SEQ ID NO: 2238589 - DNA, 21 bp, Homo sapiens
ctgaaggacattgcggacagc

SEQ ID NO: 2238590 - DNA, 18 bp, Homo sapiens
ctgaaggccccgcccagg

SEQ ID NO: 2238591 - DNA, 19 bp, Homo sapiens
ctgaaggccccgcccaggc

SEQ ID NO: 2238592 - DNA, 21 bp, Homo sapiens
ctgaaggccccgcccaggctt

SEQ ID NO: 2238593 - DNA, 14 bp, Homo sapiens
ctgaagtcacacag

SEQ ID NO: 2238594 - DNA, 15 bp, Homo sapiens
ctgaagtcacacagt

SEQ ID NO: 2238595 - DNA, 17 bp, Homo sapiens
ctgaagtcacacagtga

SEQ ID NO: 2238596 - DNA, 21 bp, Homo sapiens
ctgaagtcacacagtgagtcg

SEQ ID NO: 2238597 - DNA, 22 bp, Homo sapiens
ctgaagtcccagatacttgggg

SEQ ID NO: 2238598 - DNA, 12 bp, Homo sapiens
ctgaatttcttt

SEQ ID NO: 2238599 - DNA, 22 bp, Homo sapiens
ctgacaacactcattgacctga

SEQ ID NO: 2238600 - DNA, 15 bp, Homo sapiens
ctgacacacagctct

SEQ ID NO: 2238601 - DNA, 17 bp, Homo sapiens
ctgacacacagctctgt

SEQ ID NO: 2238602 - DNA, 16 bp, Homo sapiens
ctgacaggcaatgctg

SEQ ID NO: 2238603 - DNA, 17 bp, Homo sapiens
ctgacaggcaatgctgg

SEQ ID NO: 2238604 - DNA, 21 bp, Homo sapiens
ctgacaggcaatgctggctgt

SEQ ID NO: 2238605 - DNA, 12 bp, Homo sapiens
ctgacccactgc

SEQ ID NO: 2238606 - DNA, 14 bp, Homo sapiens
ctgacccatgctgc

SEQ ID NO: 2238607 - DNA, 17 bp, Homo sapiens
ctgacccatgctgccct

SEQ ID NO: 2238608 - DNA, 18 bp, Homo sapiens
ctgacccatgctgccctg

SEQ ID NO: 2238609 - DNA, 19 bp, Homo sapiens
ctgacccatgctgccctgt

SEQ ID NO: 2238610 - DNA, 21 bp, Homo sapiens
ctgacccatgctgccctgtga

SEQ ID NO: 2238611 - DNA, 16 bp, Homo sapiens
ctgactgttttctctt

SEQ ID NO: 2238612 - DNA, 18 bp, Homo sapiens
ctgagacagcccgggctc

SEQ ID NO: 2238613 - DNA, 19 bp, Homo sapiens
ctgagacagcccgggctct

SEQ ID NO: 2238614 - DNA, 20 bp, Homo sapiens
ctgagacagcccgggctctg

SEQ ID NO: 2238615 - DNA, 19 bp, Homo sapiens
ctgagactcgcgacaatgc

SEQ ID NO: 2238616 - DNA, 22 bp, Homo sapiens
ctgagaggacttttctttgtgg

SEQ ID NO: 2238617 - DNA, 17 bp, Homo sapiens
ctgagagtagagtcact

SEQ ID NO: 2238618 - DNA, 21 bp, Homo sapiens
ctgagatcaaaacggttttac

SEQ ID NO: 2238619 - DNA, 13 bp, Homo sapiens
ctgagccagattt

SEQ ID NO: 2238620 - DNA, 14 bp, Homo sapiens
ctgagccagatttc

SEQ ID NO: 2238621 - DNA, 18 bp, Homo sapiens
ctgagccagatttcactc

SEQ ID NO: 2238622 - DNA, 19 bp, Homo sapiens
ctgagccagatttcactct

SEQ ID NO: 2238623 - DNA, 20 bp, Homo sapiens
ctgagccagatttcactctc

SEQ ID NO: 2238624 - DNA, 12 bp, Homo sapiens
ctgagctgggat

SEQ ID NO: 2238625 - DNA, 22 bp, Homo sapiens
ctgagctgggatgattggaggg

SEQ ID NO: 2238626 - DNA, 14 bp, Homo sapiens
ctgagctttctgct

SEQ ID NO: 2238627 - DNA, 14 bp, Homo sapiens
ctgaggaatccaga

SEQ ID NO: 2238628 - DNA, 20 bp, Homo sapiens
ctgaggaatccagacccggc

SEQ ID NO: 2238629 - DNA, 19 bp, Homo sapiens
gagacagagttttcactct

SEQ ID NO: 2238630 - DNA, 14 bp, Homo sapiens
gagacagcacaggc

SEQ ID NO: 2238631 - DNA, 15 bp, Homo sapiens
gagacagcacaggca

SEQ ID NO: 2238632 - DNA, 22 bp, Homo sapiens
gagacagcccgggctctgcctc

SEQ ID NO: 2238633 - DNA, 23 bp, Homo sapiens
gagacagcccgggctctgcctcc

SEQ ID NO: 2238634 - DNA, 14 bp, Homo sapiens
gagaccatccctga

SEQ ID NO: 2238635 - DNA, 18 bp, Homo sapiens
gagaccatccctgaaggc

SEQ ID NO: 2238636 - DNA, 21 bp, Homo sapiens
gagaccctgtctcaaaaaaag

SEQ ID NO: 2238637 - DNA, 16 bp, Homo sapiens
gagacggagtcccacc

SEQ ID NO: 2238638 - DNA, 18 bp, Homo sapiens
gagactcctgcaggcagc

SEQ ID NO: 2238639 - DNA, 22 bp, Homo sapiens
gagactcctgcaggcagccagg

SEQ ID NO: 2238640 - DNA, 22 bp, Homo sapiens
gagagaaggggcccaagagaga

SEQ ID NO: 2238641 - DNA, 19 bp, Homo sapiens
gagagacagcacaggcagc

SEQ ID NO: 2238642 - DNA, 15 bp, Homo sapiens
gagagagaaagagag

SEQ ID NO: 2238643 - DNA, 11 bp, Homo sapiens
gagagagaagg

SEQ ID NO: 2238644 - DNA, 14 bp, Homo sapiens
gagagagagaaggg

SEQ ID NO: 2238645 - DNA, 14 bp, Homo sapiens
gagagagagagaag

SEQ ID NO: 2238646 - DNA, 16 bp, Homo sapiens
gagagagagagaaggg

SEQ ID NO: 2238647 - DNA, 16 bp, Homo sapiens
gagagagagagagaag

SEQ ID NO: 2238648 - DNA, 20 bp, Homo sapiens
gagagccttccaggggtggg

SEQ ID NO: 2238649 - DNA, 21 bp, Homo sapiens
gagagctagcagcagggaggg

SEQ ID NO: 2238650 - DNA, 13 bp, Homo sapiens
gagaggggaacag

SEQ ID NO: 2238651 - DNA, 13 bp, Homo sapiens
gagaggggcacag

SEQ ID NO: 2238652 - DNA, 21 bp, Homo sapiens
gagagggtgggagtgggccca

SEQ ID NO: 2238653 - DNA, 16 bp, Homo sapiens
gagatagccaaggcca

SEQ ID NO: 2238654 - DNA, 19 bp, Homo sapiens
gagatagccaaggccaaag

SEQ ID NO: 2238655 - DNA, 15 bp, Homo sapiens
gagatgtgcccccac

SEQ ID NO: 2238656 - DNA, 19 bp, Homo sapiens
gagatgtgcccccaccccc

SEQ ID NO: 2238657 - DNA, 19 bp, Homo sapiens
gagcaaaatcgatgcagtg

SEQ ID NO: 2238658 - DNA, 22 bp, Homo sapiens
gagcaagacgctgtgctgccct

SEQ ID NO: 2238659 - DNA, 17 bp, Homo sapiens
gagcaccttagacagtc

SEQ ID NO: 2238660 - DNA, 20 bp, Homo sapiens
gagcactctggggtgggagg

SEQ ID NO: 2238661 - DNA, 18 bp, Homo sapiens
gagcagagaccatccctg

SEQ ID NO: 2238662 - DNA, 18 bp, Homo sapiens
gagcagccacattcctga

SEQ ID NO: 2238663 - DNA, 16 bp, Homo sapiens
gagcaggcagtggggc

SEQ ID NO: 2238664 - DNA, 14 bp, Homo sapiens
gagcatcaggccag

SEQ ID NO: 2238665 - DNA, 13 bp, Homo sapiens
gagcatgcctgga

SEQ ID NO: 2238666 - DNA, 21 bp, Homo sapiens
gagcatgcctggatggggctg

SEQ ID NO: 2238667 - DNA, 19 bp, Homo sapiens
gagccaatttaaagaaaac

SEQ ID NO: 2238668 - DNA, 13 bp, Homo sapiens
gagccactgcacc

SEQ ID NO: 2238669 - DNA, 18 bp, Homo sapiens
gagccactgcaccgggcc

SEQ ID NO: 2238670 - DNA, 16 bp, Homo sapiens
gagcccacgcccccac

SEQ ID NO: 2238671 - DNA, 14 bp, Homo sapiens
gagcccaggcctcc

SEQ ID NO: 2238672 - DNA, 14 bp, Homo sapiens
gagccctggtggca

SEQ ID NO: 2238673 - DNA, 17 bp, Homo sapiens
gagccctggtggcagtg

SEQ ID NO: 2238674 - DNA, 12 bp, Homo sapiens
gagcctgcagtt

SEQ ID NO: 2238675 - DNA, 14 bp, Homo sapiens
gagccttccagggg

SEQ ID NO: 2238676 - DNA, 23 bp, Homo sapiens
gagctacacaggggaaaagagga

SEQ ID NO: 2238677 - DNA, 17 bp, Homo sapiens
gagctagcagcagggag

SEQ ID NO: 2238678 - DNA, 13 bp, Homo sapiens
gagctgccacctg

SEQ ID NO: 2238679 - DNA, 15 bp, Homo sapiens
gagctgccacctgcc

SEQ ID NO: 2238680 - DNA, 16 bp, Homo sapiens
gagctgccacctgcct

SEQ ID NO: 2238681 - DNA, 16 bp, Homo sapiens
gagctgcctgttcagc

SEQ ID NO: 2238682 - DNA, 19 bp, Homo sapiens
gagctgcctgttcagctcc

SEQ ID NO: 2238683 - DNA, 22 bp, Homo sapiens
gagctttctgctatcaaagagg

SEQ ID NO: 2238684 - DNA, 17 bp, Homo sapiens
gaggaaagcaaaggaga

SEQ ID NO: 2238685 - DNA, 13 bp, Homo sapiens
gaggaaggaaacc

SEQ ID NO: 2238686 - DNA, 21 bp, Homo sapiens
gaggaaggaaacccagctctg

SEQ ID NO: 2238687 - DNA, 15 bp, Homo sapiens
gaggagagaggaccc

SEQ ID NO: 2238688 - DNA, 15 bp, Homo sapiens
gaggaggggtgtggg

SEQ ID NO: 2238689 - DNA, 22 bp, Homo sapiens
gaggatctcttgagcctgggag

SEQ ID NO: 2238690 - DNA, 17 bp, Homo sapiens
gaggatgttctgggaca

SEQ ID NO: 2238691 - DNA, 23 bp, Homo sapiens
gaggcagccccattctgcctgcc

SEQ ID NO: 2238692 - DNA, 14 bp, Homo sapiens
gaggcagggtctca

SEQ ID NO: 2238693 - DNA, 15 bp, Homo sapiens
gaggcagggtctcac

SEQ ID NO: 2238694 - DNA, 22 bp, Homo sapiens
gaggcagggtctcactctgtcg

SEQ ID NO: 2238695 - DNA, 22 bp, Homo sapiens
gaggcatgtgatgagaggaaat

SEQ ID NO: 2238696 - DNA, 13 bp, Homo sapiens
gaggccagccttg

SEQ ID NO: 2238697 - DNA, 14 bp, Homo sapiens
gaggccatgggcct

SEQ ID NO: 2238698 - DNA, 17 bp, Homo sapiens
gaggccatgggcctcct

SEQ ID NO: 2238699 - DNA, 11 bp, Homo sapiens
gaggcccagag

SEQ ID NO: 2238700 - DNA, 13 bp, Homo sapiens
gaggcccagaggg

SEQ ID NO: 2238701 - DNA, 19 bp, Homo sapiens
gaggcccagagggcctgca

SEQ ID NO: 2238702 - DNA, 12 bp, Homo sapiens
gaggctctgccc

SEQ ID NO: 2238703 - DNA, 13 bp, Homo sapiens
gaggctctgccct

SEQ ID NO: 2238704 - DNA, 14 bp, Homo sapiens
gaggctctgccctt

SEQ ID NO: 2238705 - DNA, 14 bp, Homo sapiens
gaggctgcctctcc

SEQ ID NO: 2238706 - DNA, 14 bp, Homo sapiens
gagggagggagggc

SEQ ID NO: 2238707 - DNA, 14 bp, Homo sapiens
gagggaggtaagga

SEQ ID NO: 2238708 - DNA, 14 bp, Homo sapiens
gagggcacagaaaa

SEQ ID NO: 2238709 - DNA, 17 bp, Homo sapiens
gagggcctgcaagggag

SEQ ID NO: 2238710 - DNA, 12 bp, Homo sapiens
gagggctccaga

SEQ ID NO: 2238711 - DNA, 15 bp, Homo sapiens
gaggggaagaaaaac

SEQ ID NO: 2238712 - DNA, 22 bp, Homo sapiens
gaggggcctcttatgggctggg

SEQ ID NO: 2238713 - DNA, 15 bp, Homo sapiens
gaggggggaggtggg

SEQ ID NO: 2238714 - DNA, 17 bp, Homo sapiens
gagggggtggcctccca

SEQ ID NO: 2238715 - DNA, 15 bp, Homo sapiens
gagggtctgcaggga

SEQ ID NO: 2238716 - DNA, 16 bp, Homo sapiens
gagggtctgcagggaa

SEQ ID NO: 2238717 - DNA, 19 bp, Homo sapiens
gagggtctgcagggaattg

SEQ ID NO: 2238718 - DNA, 21 bp, Homo sapiens
gagggtggtgacctctgcctg

SEQ ID NO: 2238719 - DNA, 16 bp, Homo sapiens
gaggtgggatcctcca

SEQ ID NO: 2238720 - DNA, 22 bp, Homo sapiens
gaggtgggatcctccaggtgca

SEQ ID NO: 2238721 - DNA, 15 bp, Homo sapiens
gaggttgggaggcca

SEQ ID NO: 2238722 - DNA, 17 bp, Homo sapiens
gaggttgggaggccatt

SEQ ID NO: 2238723 - DNA, 16 bp, Homo sapiens
gagtacgttgtgcatt

SEQ ID NO: 2238724 - DNA, 20 bp, Homo sapiens
gagtacgttgtgcatttggt

SEQ ID NO: 2238725 - DNA, 20 bp, Homo sapiens
gagtactacagtcctcccat

SEQ ID NO: 2238726 - DNA, 13 bp, Homo sapiens
gagtcaccaagcc

SEQ ID NO: 2238727 - DNA, 14 bp, Homo sapiens
gagtcaccaagccc

SEQ ID NO: 2238728 - DNA, 13 bp, Homo sapiens
gagtcccaccttg

SEQ ID NO: 2238729 - DNA, 21 bp, Homo sapiens
gagtcccaccttggctgcagg

SEQ ID NO: 2238730 - DNA, 12 bp, Homo sapiens
gagtcccctgtt

SEQ ID NO: 2238731 - DNA, 23 bp, Homo sapiens
gagtcccctgtttgtttctgaaa

SEQ ID NO: 2238732 - DNA, 17 bp, Homo sapiens
gagtcgaggacagggag

SEQ ID NO: 2238733 - DNA, 19 bp, Homo sapiens
gagtctcactgttgcccag

SEQ ID NO: 2238734 - DNA, 22 bp, Homo sapiens
gagtctcactgttgcccaggct

SEQ ID NO: 2238735 - DNA, 21 bp, Homo sapiens
gagtctgaaggctgggttctg

SEQ ID NO: 2238736 - DNA, 16 bp, Homo sapiens
gagtgacagaggcagc

SEQ ID NO: 2238737 - DNA, 12 bp, Homo sapiens
gagtgggcccaa

SEQ ID NO: 2238738 - DNA, 12 bp, Homo sapiens
gagttacagaca

SEQ ID NO: 2238739 - DNA, 20 bp, Homo sapiens
gagttcataccctgttacca

SEQ ID NO: 2238740 - DNA, 14 bp, Homo sapiens
gagttcatcttgaa

SEQ ID NO: 2238741 - DNA, 19 bp, Homo sapiens
gagttcatcttgaattgta

SEQ ID NO: 2238742 - DNA, 15 bp, Homo sapiens
gagttgattcagctc

SEQ ID NO: 2238743 - DNA, 22 bp, Homo sapiens
gataagaaccttttgagtgcct

SEQ ID NO: 2238744 - DNA, 16 bp, Homo sapiens
gatacaaaagcatgtg

SEQ ID NO: 2238745 - DNA, 18 bp, Homo sapiens
gatacaggaaaagctgct

SEQ ID NO: 2238746 - DNA, 20 bp, Homo sapiens
gatacaggaaaagctgctga

SEQ ID NO: 2238747 - DNA, 13 bp, Homo sapiens
gatacccatccca

SEQ ID NO: 2238748 - DNA, 17 bp, Homo sapiens
gatactgtatcatgaca

SEQ ID NO: 2238749 - DNA, 16 bp, Homo sapiens
gatagcacagaccctg

SEQ ID NO: 2238750 - DNA, 18 bp, Homo sapiens
gatagcacagaccctgcc

SEQ ID NO: 2238751 - DNA, 20 bp, Homo sapiens
gatagcacagaccctgccct

SEQ ID NO: 2238752 - DNA, 20 bp, Homo sapiens
gatagtgtcccacggtgcct

SEQ ID NO: 2238753 - DNA, 16 bp, Homo sapiens
gatattttgctttgtg

SEQ ID NO: 2238754 - DNA, 15 bp, Homo sapiens
gcctgctccagctgt

SEQ ID NO: 2238755 - DNA, 14 bp, Homo sapiens
gcctggatggggct

SEQ ID NO: 2238756 - DNA, 14 bp, Homo sapiens
gcctggccagatgc

SEQ ID NO: 2238757 - DNA, 15 bp, Homo sapiens
gcctggccagatgca

SEQ ID NO: 2238758 - DNA, 13 bp, Homo sapiens
gcctggcccctca

SEQ ID NO: 2238759 - DNA, 14 bp, Homo sapiens
gcctggcccctcag

SEQ ID NO: 2238760 - DNA, 17 bp, Homo sapiens
gcctggcccctcagggt

SEQ ID NO: 2238761 - DNA, 20 bp, Homo sapiens
gcctggcccctcagggtccc

SEQ ID NO: 2238762 - DNA, 17 bp, Homo sapiens
gcctggtggcagctgcg

SEQ ID NO: 2238763 - DNA, 15 bp, Homo sapiens
gcctgtaatcctagc

SEQ ID NO: 2238764 - DNA, 18 bp, Homo sapiens
gcctgtgcctctgggact

SEQ ID NO: 2238765 - DNA, 14 bp, Homo sapiens
gcctgttcagctcc

SEQ ID NO: 2238766 - DNA, 15 bp, Homo sapiens
gcctgttcagctcca

SEQ ID NO: 2238767 - DNA, 16 bp, Homo sapiens
gcctgttcagctccag

SEQ ID NO: 2238768 - DNA, 14 bp, Homo sapiens
gcctgttgggccag

SEQ ID NO: 2238769 - DNA, 15 bp, Homo sapiens
gcctgttgggccagg

SEQ ID NO: 2238770 - DNA, 15 bp, Homo sapiens
gccttacacaatggt

SEQ ID NO: 2238771 - DNA, 16 bp, Homo sapiens
gccttacacaatggtt

SEQ ID NO: 2238772 - DNA, 19 bp, Homo sapiens
gccttagaagtcacacagt

SEQ ID NO: 2238773 - DNA, 18 bp, Homo sapiens
gccttatggaacactctg

SEQ ID NO: 2238774 - DNA, 20 bp, Homo sapiens
gccttatggaacactctgag

SEQ ID NO: 2238775 - DNA, 16 bp, Homo sapiens
gccttctctgaaggac

SEQ ID NO: 2238776 - DNA, 17 bp, Homo sapiens
gccttgaccattctcca

SEQ ID NO: 2238777 - DNA, 19 bp, Homo sapiens
gccttgaccattctccacc

SEQ ID NO: 2238778 - DNA, 21 bp, Homo sapiens
gccttgaccattctccacctg

SEQ ID NO: 2238779 - DNA, 22 bp, Homo sapiens
gccttgaccattctccacctgc

SEQ ID NO: 2238780 - DNA, 15 bp, Homo sapiens
gcgagccctggtggc

SEQ ID NO: 2238781 - DNA, 15 bp, Homo sapiens
gcgagggccccacgt

SEQ ID NO: 2238782 - DNA, 22 bp, Homo sapiens
gcgatctgggttcactgcaacc

SEQ ID NO: 2238783 - DNA, 17 bp, Homo sapiens
gcgattcttctgcttca

SEQ ID NO: 2238784 - DNA, 18 bp, Homo sapiens
gcgcctacaggagtgagc

SEQ ID NO: 2238785 - DNA, 20 bp, Homo sapiens
gcgcctacaggagtgagcac

SEQ ID NO: 2238786 - DNA, 15 bp, Homo sapiens
gcggacagccacggc

SEQ ID NO: 2238787 - DNA, 16 bp, Homo sapiens
gcggcctttggcttca

SEQ ID NO: 2238788 - DNA, 15 bp, Homo sapiens
gcggctggcagccca

SEQ ID NO: 2238789 - DNA, 15 bp, Homo sapiens
gcggggacagctcct

SEQ ID NO: 2238790 - DNA, 18 bp, Homo sapiens
gcggggacagctccttct

SEQ ID NO: 2238791 - DNA, 20 bp, Homo sapiens
gcggtccacccaggagcccc

SEQ ID NO: 2238792 - DNA, 19 bp, Homo sapiens
gcggtgctatctcccccag

SEQ ID NO: 2238793 - DNA, 18 bp, Homo sapiens
gcgtttctatgacacatg

SEQ ID NO: 2238794 - DNA, 17 bp, Homo sapiens
gctaaaaagaatgcaga

SEQ ID NO: 2238795 - DNA, 19 bp, Homo sapiens
gctaaaaagaatgcagaga

SEQ ID NO: 2238796 - DNA, 13 bp, Homo sapiens
gctaagagggagg

SEQ ID NO: 2238797 - DNA, 22 bp, Homo sapiens
gctaagagggagggagggctcc

SEQ ID NO: 2238798 - DNA, 23 bp, Homo sapiens
gctaagagggagggagggctcca

SEQ ID NO: 2238799 - DNA, 22 bp, Homo sapiens
gctaagtgatcctcccacctca

SEQ ID NO: 2238800 - DNA, 13 bp, Homo sapiens
gctaatgggacac

SEQ ID NO: 2238801 - DNA, 15 bp, Homo sapiens
gctacccgggaaggg

SEQ ID NO: 2238802 - DNA, 16 bp, Homo sapiens
gctacctttgtattct

SEQ ID NO: 2238803 - DNA, 16 bp, Homo sapiens
gctaggaacactcctt

SEQ ID NO: 2238804 - DNA, 20 bp, Homo sapiens
gctaggacccctccatgtgg

SEQ ID NO: 2238805 - DNA, 14 bp, Homo sapiens
gctatctcccccag

SEQ ID NO: 2238806 - DNA, 17 bp, Homo sapiens
gctatctcccccagccc

SEQ ID NO: 2238807 - DNA, 18 bp, Homo sapiens
gctatctcccccagcccc

SEQ ID NO: 2238808 - DNA, 19 bp, Homo sapiens
gctatctcccccagcccca

SEQ ID NO: 2238809 - DNA, 22 bp, Homo sapiens
gctatctcccccagccccatcc

SEQ ID NO: 2238810 - DNA, 13 bp, Homo sapiens
gctatgcatttga

SEQ ID NO: 2238811 - DNA, 14 bp, Homo sapiens
gctcaccagcccca

SEQ ID NO: 2238812 - DNA, 12 bp, Homo sapiens
gctcactgcagc

SEQ ID NO: 2238813 - DNA, 15 bp, Homo sapiens
gctcactgcagcctc

SEQ ID NO: 2238814 - DNA, 13 bp, Homo sapiens
gctcagagagggt

SEQ ID NO: 2238815 - DNA, 18 bp, Homo sapiens
gctcagagagggtgggag

SEQ ID NO: 2238816 - DNA, 20 bp, Homo sapiens
gctcagagagggtgggagtg

SEQ ID NO: 2238817 - DNA, 22 bp, Homo sapiens
gctcagagagggtgggagtggg

SEQ ID NO: 2238818 - DNA, 17 bp, Homo sapiens
gctcagcaaaagatgct

SEQ ID NO: 2238819 - DNA, 22 bp, Homo sapiens
gctcagcaaaagatgcttctca

SEQ ID NO: 2238820 - DNA, 23 bp, Homo sapiens
gctcagcaaaagatgcttctcac

SEQ ID NO: 2238821 - DNA, 18 bp, Homo sapiens
gctcagcggggacagctc

SEQ ID NO: 2238822 - DNA, 19 bp, Homo sapiens
gctcagcggggacagctcc

SEQ ID NO: 2238823 - DNA, 21 bp, Homo sapiens
gctcaggtggggtcactctgg

SEQ ID NO: 2238824 - DNA, 22 bp, Homo sapiens
gctcaggtggggtcactctggc

SEQ ID NO: 2238825 - DNA, 17 bp, Homo sapiens
gctcaggtgtccctgca

SEQ ID NO: 2238826 - DNA, 17 bp, Homo sapiens
gctccaagctcccaggc

SEQ ID NO: 2238827 - DNA, 18 bp, Homo sapiens
gctccaagctcccaggca

SEQ ID NO: 2238828 - DNA, 18 bp, Homo sapiens
gctccagacacatgtcca

SEQ ID NO: 2238829 - DNA, 23 bp, Homo sapiens
gctccagacacatgtccaagaag

SEQ ID NO: 2238830 - DNA, 14 bp, Homo sapiens
gctccagctcacca

SEQ ID NO: 2238831 - DNA, 11 bp, Homo sapiens
gctccagctgt

SEQ ID NO: 2238832 - DNA, 20 bp, Homo sapiens
gctccagctgttcagctggt

SEQ ID NO: 2238833 - DNA, 18 bp, Homo sapiens
gctccaggagcagccaca

SEQ ID NO: 2238834 - DNA, 24 bp, Homo sapiens
gctccaggctcctttagcgcccag

SEQ ID NO: 2238835 - DNA, 20 bp, Homo sapiens
gctccagggggtgccctccc

SEQ ID NO: 2238836 - DNA, 20 bp, Homo sapiens
gctcccaggcattccccagg

SEQ ID NO: 2238837 - DNA, 14 bp, Homo sapiens
gctccccagcccca

SEQ ID NO: 2238838 - DNA, 19 bp, Homo sapiens
gctcccttcccacctctct

SEQ ID NO: 2238839 - DNA, 20 bp, Homo sapiens
gctcccttcccacctctctc

SEQ ID NO: 2238840 - DNA, 23 bp, Homo sapiens
gctccgctttctacccagcgagc

SEQ ID NO: 2238841 - DNA, 15 bp, Homo sapiens
gctcctctccccagc

SEQ ID NO: 2238842 - DNA, 16 bp, Homo sapiens
gctcctctccccagca

SEQ ID NO: 2238843 - DNA, 15 bp, Homo sapiens
gctcctggcccactg

SEQ ID NO: 2238844 - DNA, 15 bp, Homo sapiens
gctccttctgtccta

SEQ ID NO: 2238845 - DNA, 19 bp, Homo sapiens
gctctactgaggtgctatg

SEQ ID NO: 2238846 - DNA, 13 bp, Homo sapiens
gctctcaggccag

SEQ ID NO: 2238847 - DNA, 15 bp, Homo sapiens
gctctcaggccagct

SEQ ID NO: 2238848 - DNA, 18 bp, Homo sapiens
gctctcaggccagctgct

SEQ ID NO: 2238849 - DNA, 19 bp, Homo sapiens
gctctccgaccagacacct

SEQ ID NO: 2238850 - DNA, 11 bp, Homo sapiens
gctctgcctcc

SEQ ID NO: 2238851 - DNA, 22 bp, Homo sapiens
gctctgcctcccatcacccgct

SEQ ID NO: 2238852 - DNA, 14 bp, Homo sapiens
gctctgctcctctc

SEQ ID NO: 2238853 - DNA, 21 bp, Homo sapiens
gctctgctcctctccccagca

SEQ ID NO: 2238854 - DNA, 20 bp, Homo sapiens
gctctgctgacagacacagg

SEQ ID NO: 2238855 - DNA, 14 bp, Homo sapiens
gctctggacaggca

SEQ ID NO: 2238856 - DNA, 16 bp, Homo sapiens
gctctggacaggcatg

SEQ ID NO: 2238857 - DNA, 23 bp, Homo sapiens
gctctggtccatagagagcaaga

SEQ ID NO: 2238858 - DNA, 15 bp, Homo sapiens
gctcttccaggctgg

SEQ ID NO: 2238859 - DNA, 12 bp, Homo sapiens
gctcttctccag

SEQ ID NO: 2238860 - DNA, 20 bp, Homo sapiens
gctgaaggctcgagcatgcc

SEQ ID NO: 2238861 - DNA, 17 bp, Homo sapiens
gctgaatacagaggcaa

SEQ ID NO: 2238862 - DNA, 14 bp, Homo sapiens
gctgacagacacag

SEQ ID NO: 2238863 - DNA, 17 bp, Homo sapiens
gctgacagacacaggcc

SEQ ID NO: 2238864 - DNA, 19 bp, Homo sapiens
gctgacagacacaggcccg

SEQ ID NO: 2238865 - DNA, 21 bp, Homo sapiens
gctgacagacacaggcccggc

SEQ ID NO: 2238866 - DNA, 18 bp, Homo sapiens
gctgagtctgaaggctgg

SEQ ID NO: 2238867 - DNA, 16 bp, Homo sapiens
gctgatggtgcaatga

SEQ ID NO: 2238868 - DNA, 23 bp, Homo sapiens
gctgcaaagggtatcaggtgctg

SEQ ID NO: 2238869 - DNA, 15 bp, Homo sapiens
gctgcaccctcaggc

SEQ ID NO: 2238870 - DNA, 19 bp, Homo sapiens
gctgcaccctcaggcaggt

SEQ ID NO: 2238871 - DNA, 13 bp, Homo sapiens
gctgcaccggctg

SEQ ID NO: 2238872 - DNA, 16 bp, Homo sapiens
gctgcaccggctggcc

SEQ ID NO: 2238873 - DNA, 19 bp, Homo sapiens
gctgccaatgggagctcat

SEQ ID NO: 2238874 - DNA, 19 bp, Homo sapiens
gctgcccctggcagcccct

SEQ ID NO: 2238875 - DNA, 14 bp, Homo sapiens
gctgccctgcccac

SEQ ID NO: 2238876 - DNA, 23 bp, Homo sapiens
gctgccctgcccacctggcctct

SEQ ID NO: 2238877 - DNA, 11 bp, Homo sapiens
gctgccctgtg

SEQ ID NO: 2238878 - DNA, 23 bp, Homo sapiens
ggtgctatctcccccagccccat

SEQ ID NO: 2238879 - DNA, 21 bp, Homo sapiens
ggtgctgccatccaggttcag

SEQ ID NO: 2238880 - DNA, 13 bp, Homo sapiens
ggtgggacaccct

SEQ ID NO: 2238881 - DNA, 16 bp, Homo sapiens
ggtgggacaccctgtg

SEQ ID NO: 2238882 - DNA, 17 bp, Homo sapiens
ggtgggacaccctgtga

SEQ ID NO: 2238883 - DNA, 10 bp, Homo sapiens
ggtgggaggg

SEQ ID NO: 2238884 - DNA, 16 bp, Homo sapiens
ggtggtgacctctgcc

SEQ ID NO: 2238885 - DNA, 21 bp, Homo sapiens
ggtggttatggagagggtgtc

SEQ ID NO: 2238886 - DNA, 17 bp, Homo sapiens
ggtggtttcagaaatgt

SEQ ID NO: 2238887 - DNA, 21 bp, Homo sapiens
ggtgtgcggcctttggcttca

SEQ ID NO: 2238888 - DNA, 13 bp, Homo sapiens
ggtgtgctctgat

SEQ ID NO: 2238889 - DNA, 13 bp, Homo sapiens
ggttcaaagatat

SEQ ID NO: 2238890 - DNA, 21 bp, Homo sapiens
ggttcaaagatattttgcttt

SEQ ID NO: 2238891 - DNA, 21 bp, Homo sapiens
ggttcaagcgattcttctgct

SEQ ID NO: 2238892 - DNA, 21 bp, Homo sapiens
ggttcagggttggcccctgcc

SEQ ID NO: 2238893 - DNA, 22 bp, Homo sapiens
ggttcagggttggcccctgccc

SEQ ID NO: 2238894 - DNA, 22 bp, Homo sapiens
ggttccctttgacgccatccca

SEQ ID NO: 2238895 - DNA, 14 bp, Homo sapiens
ggttgggctggtgt

SEQ ID NO: 2238896 - DNA, 13 bp, Homo sapiens
ggtttaagctgtt

SEQ ID NO: 2238897 - DNA, 23 bp, Homo sapiens
ggttttgccatgttggccaggct

SEQ ID NO: 2238898 - DNA, 17 bp, Homo sapiens
gtaaaaagggaaaaaga

SEQ ID NO: 2238899 - DNA, 18 bp, Homo sapiens
gtaaaaagggaaaaagac

SEQ ID NO: 2238900 - DNA, 17 bp, Homo sapiens
gtaaattaacttttata

SEQ ID NO: 2238901 - DNA, 19 bp, Homo sapiens
gtaacaggaaaattttaaa

SEQ ID NO: 2238902 - DNA, 20 bp, Homo sapiens
gtaaggaatacctgtccccc

SEQ ID NO: 2238903 - DNA, 23 bp, Homo sapiens
gtaaggaatacctgtccccctga

SEQ ID NO: 2238904 - DNA, 23 bp, Homo sapiens
gtaatcctagcactttgggaggc

SEQ ID NO: 2238905 - DNA, 17 bp, Homo sapiens
gtaatttgtgatacaat

SEQ ID NO: 2238906 - DNA, 22 bp, Homo sapiens
gtaatttgtgatacaatgctgt

SEQ ID NO: 2238907 - DNA, 21 bp, Homo sapiens
gtaatttttttatcgtcactg

SEQ ID NO: 2238908 - DNA, 21 bp, Homo sapiens
gtacactgtttcaaactttac

SEQ ID NO: 2238909 - DNA, 12 bp, Homo sapiens
gtacagagccca

SEQ ID NO: 2238910 - DNA, 20 bp, Homo sapiens
gtacagcaaggagatttaca

SEQ ID NO: 2238911 - DNA, 14 bp, Homo sapiens
gtacatgaaaacac

SEQ ID NO: 2238912 - DNA, 12 bp, Homo sapiens
gtacccactgct

SEQ ID NO: 2238913 - DNA, 16 bp, Homo sapiens
gtacgttgtgcatttg

SEQ ID NO: 2238914 - DNA, 15 bp, Homo sapiens
gtactaaggaatctt

SEQ ID NO: 2238915 - DNA, 23 bp, Homo sapiens
gtactaaggaatctttctgcttt

SEQ ID NO: 2238916 - DNA, 13 bp, Homo sapiens
gtactatgtatca

SEQ ID NO: 2238917 - DNA, 14 bp, Homo sapiens
gtacttctccaccc

SEQ ID NO: 2238918 - DNA, 16 bp, Homo sapiens
gtacttgtggacacag

SEQ ID NO: 2238919 - DNA, 21 bp, Homo sapiens
gtacttgtggacacagctctt

SEQ ID NO: 2238920 - DNA, 21 bp, Homo sapiens
gtagaaatatctgaaaatgta

SEQ ID NO: 2238921 - DNA, 11 bp, Homo sapiens
gtagagccagg

SEQ ID NO: 2238922 - DNA, 18 bp, Homo sapiens
gtagagccagggtctcac

SEQ ID NO: 2238923 - DNA, 13 bp, Homo sapiens
gtagagtgggagc

SEQ ID NO: 2238924 - DNA, 21 bp, Homo sapiens
gtagctgggactacaggcacc

SEQ ID NO: 2238925 - DNA, 22 bp, Homo sapiens
gtagggcgggaggatgttctgg

SEQ ID NO: 2238926 - DNA, 16 bp, Homo sapiens
gtatcaggtgctgcca

SEQ ID NO: 2238927 - DNA, 12 bp, Homo sapiens
gtatctggtgac

SEQ ID NO: 2238928 - DNA, 17 bp, Homo sapiens
gtatgaggcatttgttt

SEQ ID NO: 2238929 - DNA, 14 bp, Homo sapiens
gtatgggagagaag

SEQ ID NO: 2238930 - DNA, 14 bp, Homo sapiens
gtatggtggctggg

SEQ ID NO: 2238931 - DNA, 14 bp, Homo sapiens
gtattatacctttt

SEQ ID NO: 2238932 - DNA, 14 bp, Homo sapiens
gtattttactaata

SEQ ID NO: 2238933 - DNA, 14 bp, Homo sapiens
gtatttttttacta

SEQ ID NO: 2238934 - DNA, 15 bp, Homo sapiens
gtatttttttactaa

SEQ ID NO: 2238935 - DNA, 21 bp, Homo sapiens
gtatttttttactaatagaca

SEQ ID NO: 2238936 - DNA, 15 bp, Homo sapiens
gtcaagtgaaaaagg

SEQ ID NO: 2238937 - DNA, 16 bp, Homo sapiens
gtcaagtgaaaaagga

SEQ ID NO: 2238938 - DNA, 19 bp, Homo sapiens
gtcaagtgaaaaaggagga

SEQ ID NO: 2238939 - DNA, 13 bp, Homo sapiens
gtcaattacagga

SEQ ID NO: 2238940 - DNA, 15 bp, Homo sapiens
gtcaattacaggaag

SEQ ID NO: 2238941 - DNA, 13 bp, Homo sapiens
gtcacaggcaggt

SEQ ID NO: 2238942 - DNA, 15 bp, Homo sapiens
gtcaccaagcccagt

SEQ ID NO: 2238943 - DNA, 15 bp, Homo sapiens
gtcaccccggccacc

SEQ ID NO: 2238944 - DNA, 18 bp, Homo sapiens
gtcaccccggccacctgc

SEQ ID NO: 2238945 - DNA, 12 bp, Homo sapiens
gtcactctggca

SEQ ID NO: 2238946 - DNA, 14 bp, Homo sapiens
gtcactgagacagc

SEQ ID NO: 2238947 - DNA, 15 bp, Homo sapiens
gtcactgagacagcc

SEQ ID NO: 2238948 - DNA, 17 bp, Homo sapiens
gtcactgagacagcccg

SEQ ID NO: 2238949 - DNA, 10 bp, Homo sapiens
gtcactgctt

SEQ ID NO: 2238950 - DNA, 14 bp, Homo sapiens
gtcagagcctgcag

SEQ ID NO: 2238951 - DNA, 22 bp, Homo sapiens
gtcaggtggggcagcttgaggg

SEQ ID NO: 2238952 - DNA, 22 bp, Homo sapiens
gtcatttgagcagggctcagcg

SEQ ID NO: 2238953 - DNA, 19 bp, Homo sapiens
gtcattttttttaagaaaa

SEQ ID NO: 2238954 - DNA, 16 bp, Homo sapiens
gtccaagaagcccagg

SEQ ID NO: 2238955 - DNA, 15 bp, Homo sapiens
gtccacccaggagcc

SEQ ID NO: 2238956 - DNA, 13 bp, Homo sapiens
gtccatagagagc

SEQ ID NO: 2238957 - DNA, 14 bp, Homo sapiens
gtccatagagagca

SEQ ID NO: 2238958 - DNA, 21 bp, Homo sapiens
gtcccaccccacacacgccag

SEQ ID NO: 2238959 - DNA, 15 bp, Homo sapiens
gtcccaccttggctg

SEQ ID NO: 2238960 - DNA, 16 bp, Homo sapiens
gtcccaccttggctgc

SEQ ID NO: 2238961 - DNA, 21 bp, Homo sapiens
gtcccaccttggctgcaggga

SEQ ID NO: 2238962 - DNA, 23 bp, Homo sapiens
gtcccaccttggctgcagggagt

SEQ ID NO: 2238963 - DNA, 18 bp, Homo sapiens
gtccccctgacaacactc

SEQ ID NO: 2238964 - DNA, 19 bp, Homo sapiens
gtccctggtggcagctcac

SEQ ID NO: 2238965 - DNA, 21 bp, Homo sapiens
gtccggtccctgtcccagtgc

SEQ ID NO: 2238966 - DNA, 12 bp, Homo sapiens
gtcctactctgt

SEQ ID NO: 2238967 - DNA, 23 bp, Homo sapiens
gtcctagaaattccccaccctga

SEQ ID NO: 2238968 - DNA, 14 bp, Homo sapiens
gtcctcccatctca

SEQ ID NO: 2238969 - DNA, 23 bp, Homo sapiens
gtcctcccatctcacacatgagc

SEQ ID NO: 2238970 - DNA, 17 bp, Homo sapiens
gtcctgctgcagttgcc

SEQ ID NO: 2238971 - DNA, 18 bp, Homo sapiens
gtccttaccagcagagca

SEQ ID NO: 2238972 - DNA, 23 bp, Homo sapiens
gtcgcccagtctggaatgcagtg

SEQ ID NO: 2238973 - DNA, 20 bp, Homo sapiens
gtctacctgaggggcctctt

SEQ ID NO: 2238974 - DNA, 15 bp, Homo sapiens
gtctatgggactcaa

SEQ ID NO: 2238975 - DNA, 19 bp, Homo sapiens
gtctcaaaaaaagaaaaag

SEQ ID NO: 2238976 - DNA, 20 bp, Homo sapiens
gtctcactatgttgcccagg

SEQ ID NO: 2238977 - DNA, 23 bp, Homo sapiens
gtctcactatgttgcccaggcag

SEQ ID NO: 2238978 - DNA, 15 bp, Homo sapiens
gtctcactctgtcgc

SEQ ID NO: 2238979 - DNA, 16 bp, Homo sapiens
gtctcactctgtcgcc

SEQ ID NO: 2238980 - DNA, 13 bp, Homo sapiens
gtctccatgtttg

SEQ ID NO: 2238981 - DNA, 13 bp, Homo sapiens
gtctcttggtcct

SEQ ID NO: 2238982 - DNA, 18 bp, Homo sapiens
gtctcttggtcctgctgc

SEQ ID NO: 2238983 - DNA, 19 bp, Homo sapiens
gtctcttggtcctgctgca

SEQ ID NO: 2238984 - DNA, 19 bp, Homo sapiens
gtctctttaatgtcacagg

SEQ ID NO: 2238985 - DNA, 15 bp, Homo sapiens
gtctgacaggcaatg

SEQ ID NO: 2238986 - DNA, 22 bp, Homo sapiens
gtctgacaggcaatgctggctg

SEQ ID NO: 2238987 - DNA, 13 bp, Homo sapiens
gtctgacccactg

SEQ ID NO: 2238988 - DNA, 15 bp, Homo sapiens
gtctgacccactgct

SEQ ID NO: 2238989 - DNA, 19 bp, Homo sapiens
gtctgaggaatccagaccc

SEQ ID NO: 2238990 - DNA, 18 bp, Homo sapiens
gtctgattcccaagctct

SEQ ID NO: 2238991 - DNA, 15 bp, Homo sapiens
gtctggaatgcagtg

SEQ ID NO: 2238992 - DNA, 14 bp, Homo sapiens
gtctgttctttcca

SEQ ID NO: 2238993 - DNA, 18 bp, Homo sapiens
gtcttgaactcctggcct

SEQ ID NO: 2238994 - DNA, 16 bp, Homo sapiens
gtcttgcaatggcagc

SEQ ID NO: 2238995 - DNA, 21 bp, Homo sapiens
gtcttgcaatggcagccttgg

SEQ ID NO: 2238996 - DNA, 14 bp, Homo sapiens
gtcttggtttggtt

SEQ ID NO: 2238997 - DNA, 15 bp, Homo sapiens
gtctttggaccctga

SEQ ID NO: 2238998 - DNA, 22 bp, Homo sapiens
gtgaaccaccacacccagccca

SEQ ID NO: 2238999 - DNA, 14 bp, Homo sapiens
gtgacagaggcagc

SEQ ID NO: 2239000 - DNA, 18 bp, Homo sapiens
gtgacagaggcagcccca

SEQ ID NO: 2239001 - DNA, 23 bp, Homo sapiens
gtgacagaggcagccccattctg

SEQ ID NO: 2239002 - DNA, 14 bp, Homo sapiens
tattttattatgca

SEQ ID NO: 2239003 - DNA, 17 bp, Homo sapiens
tattttattatgcatga

SEQ ID NO: 2239004 - DNA, 22 bp, Homo sapiens
tattttccctattagagaagag

SEQ ID NO: 2239005 - DNA, 20 bp, Homo sapiens
tattttgctttgtgattttt

SEQ ID NO: 2239006 - DNA, 16 bp, Homo sapiens
tatttttgtaaaaagg

SEQ ID NO: 2239007 - DNA, 17 bp, Homo sapiens
tatttttgtagagccag

SEQ ID NO: 2239008 - DNA, 17 bp, Homo sapiens
tatttttttcttttctt

SEQ ID NO: 2239009 - DNA, 22 bp, Homo sapiens
tcaaaacggttttactgcagct

SEQ ID NO: 2239010 - DNA, 13 bp, Homo sapiens
tcaaatttctaaa

SEQ ID NO: 2239011 - DNA, 16 bp, Homo sapiens
tcaaatttctaaatct

SEQ ID NO: 2239012 - DNA, 17 bp, Homo sapiens
tcaaatttctaaatctc

SEQ ID NO: 2239013 - DNA, 12 bp, Homo sapiens
tcaagccaccaa

SEQ ID NO: 2239014 - DNA, 16 bp, Homo sapiens
tcaagcgattcttctg

SEQ ID NO: 2239015 - DNA, 17 bp, Homo sapiens
tcaagcgattcttctgc

SEQ ID NO: 2239016 - DNA, 14 bp, Homo sapiens
tcaaggatcctgag

SEQ ID NO: 2239017 - DNA, 18 bp, Homo sapiens
tcaaggatcctgagccag

SEQ ID NO: 2239018 - DNA, 20 bp, Homo sapiens
tcaaggatcctgagccagat

SEQ ID NO: 2239019 - DNA, 11 bp, Homo sapiens
tcaagtattat

SEQ ID NO: 2239020 - DNA, 23 bp, Homo sapiens
tcaagtgaaaaaggaggaagaga

SEQ ID NO: 2239021 - DNA, 22 bp, Homo sapiens
tcaagtgattctcctgcctcag

SEQ ID NO: 2239022 - DNA, 13 bp, Homo sapiens
tcaataggaaaaa

SEQ ID NO: 2239023 - DNA, 18 bp, Homo sapiens
tcaatgcactgacattgt

SEQ ID NO: 2239024 - DNA, 18 bp, Homo sapiens
tcaattacaggaagtact

SEQ ID NO: 2239025 - DNA, 23 bp, Homo sapiens
tcaattacaggaagtactggaga

SEQ ID NO: 2239026 - DNA, 22 bp, Homo sapiens
tcacacagtattacttctgcta

SEQ ID NO: 2239027 - DNA, 22 bp, Homo sapiens
tcacacagtgagtcgaggacag

SEQ ID NO: 2239028 - DNA, 23 bp, Homo sapiens
tcacacatgagcatcaggccagg

SEQ ID NO: 2239029 - DNA, 22 bp, Homo sapiens
tcacagtccttaccagcagagc

SEQ ID NO: 2239030 - DNA, 20 bp, Homo sapiens
tcacagttctctccttcttc

SEQ ID NO: 2239031 - DNA, 16 bp, Homo sapiens
tcacatattgatttcc

SEQ ID NO: 2239032 - DNA, 14 bp, Homo sapiens
tcacatttattctg

SEQ ID NO: 2239033 - DNA, 17 bp, Homo sapiens
tcacatttattctgctc

SEQ ID NO: 2239034 - DNA, 13 bp, Homo sapiens
tcaccagccccag

SEQ ID NO: 2239035 - DNA, 13 bp, Homo sapiens
tcaccccagcccc

SEQ ID NO: 2239036 - DNA, 15 bp, Homo sapiens
tcacctctcccttgg

SEQ ID NO: 2239037 - DNA, 16 bp, Homo sapiens
tcacctgaagactcat

SEQ ID NO: 2239038 - DNA, 19 bp, Homo sapiens
tcacctgaagactcattct

SEQ ID NO: 2239039 - DNA, 15 bp, Homo sapiens
tcacctgcccctcaa

SEQ ID NO: 2239040 - DNA, 16 bp, Homo sapiens
tcacctgcccctcaac

SEQ ID NO: 2239041 - DNA, 18 bp, Homo sapiens
tcacctttgtccccaccg

SEQ ID NO: 2239042 - DNA, 16 bp, Homo sapiens
tcacggaagagccttg

SEQ ID NO: 2239043 - DNA, 17 bp, Homo sapiens
tcacggaagagccttgc

SEQ ID NO: 2239044 - DNA, 18 bp, Homo sapiens
tcactatgttgcccaggc

SEQ ID NO: 2239045 - DNA, 19 bp, Homo sapiens
tcactatgttgcccaggca

SEQ ID NO: 2239046 - DNA, 13 bp, Homo sapiens
tcactctggcagc

SEQ ID NO: 2239047 - DNA, 14 bp, Homo sapiens
tcactctggcagct

SEQ ID NO: 2239048 - DNA, 21 bp, Homo sapiens
tcactgagacagcccgggctc

SEQ ID NO: 2239049 - DNA, 22 bp, Homo sapiens
tcactgagacagcccgggctct

SEQ ID NO: 2239050 - DNA, 18 bp, Homo sapiens
tcactgcaacctccgcct

SEQ ID NO: 2239051 - DNA, 12 bp, Homo sapiens
tcactgcagcct

SEQ ID NO: 2239052 - DNA, 14 bp, Homo sapiens
tcactgcagcctca

SEQ ID NO: 2239053 - DNA, 15 bp, Homo sapiens
tcactgttgcccagg

SEQ ID NO: 2239054 - DNA, 18 bp, Homo sapiens
tcactgttgcccaggctg

SEQ ID NO: 2239055 - DNA, 19 bp, Homo sapiens
tcagaatctcaaataacta

SEQ ID NO: 2239056 - DNA, 20 bp, Homo sapiens
tcagaattctcagaatctca

SEQ ID NO: 2239057 - DNA, 16 bp, Homo sapiens
tcagaattctctagtt

SEQ ID NO: 2239058 - DNA, 15 bp, Homo sapiens
tcagacagctgcctg

SEQ ID NO: 2239059 - DNA, 20 bp, Homo sapiens
tcagagactcctgcaggcag

SEQ ID NO: 2239060 - DNA, 13 bp, Homo sapiens
tcagatcttctgt

SEQ ID NO: 2239061 - DNA, 15 bp, Homo sapiens
tcagcaaaagatgct

SEQ ID NO: 2239062 - DNA, 13 bp, Homo sapiens
tcagcctcccaaa

SEQ ID NO: 2239063 - DNA, 21 bp, Homo sapiens
tcagcctcccaaagtgctggg

SEQ ID NO: 2239064 - DNA, 21 bp, Homo sapiens
tcagcctcccgagtagctggg

SEQ ID NO: 2239065 - DNA, 20 bp, Homo sapiens
tcagcggggacagctccttc

SEQ ID NO: 2239066 - DNA, 15 bp, Homo sapiens
tcagctccagctcac

SEQ ID NO: 2239067 - DNA, 22 bp, Homo sapiens
tcagctccagctcaccagcccc

SEQ ID NO: 2239068 - DNA, 23 bp, Homo sapiens
tcagctctgcaagaattgaagca

SEQ ID NO: 2239069 - DNA, 15 bp, Homo sapiens
tcagctgctactact

SEQ ID NO: 2239070 - DNA, 21 bp, Homo sapiens
tcagcttgtaaatagctcagg

SEQ ID NO: 2239071 - DNA, 12 bp, Homo sapiens
tcaggaagctca

SEQ ID NO: 2239072 - DNA, 15 bp, Homo sapiens
tcaggaagctcaggg

SEQ ID NO: 2239073 - DNA, 18 bp, Homo sapiens
tcaggcaggtgggatgga

SEQ ID NO: 2239074 - DNA, 20 bp, Homo sapiens
tcaggccaaactcacctgcc

SEQ ID NO: 2239075 - DNA, 23 bp, Homo sapiens
tcaggccaaactcacctgcccct

SEQ ID NO: 2239076 - DNA, 14 bp, Homo sapiens
tcaggccagctgct

SEQ ID NO: 2239077 - DNA, 13 bp, Homo sapiens
tcaggccaggccc

SEQ ID NO: 2239078 - DNA, 16 bp, Homo sapiens
tcaggccaggccctct

SEQ ID NO: 2239079 - DNA, 22 bp, Homo sapiens
tcaggccaggccctctgcccac

SEQ ID NO: 2239080 - DNA, 16 bp, Homo sapiens
tcagggcctggctcag

SEQ ID NO: 2239081 - DNA, 12 bp, Homo sapiens
tcaggggtgtgc

SEQ ID NO: 2239082 - DNA, 23 bp, Homo sapiens
tcaggggtgtgcggcctttggct

SEQ ID NO: 2239083 - DNA, 14 bp, Homo sapiens
tcagggtccctggt

SEQ ID NO: 2239084 - DNA, 17 bp, Homo sapiens
tcagggttggcccctgc

SEQ ID NO: 2239085 - DNA, 21 bp, Homo sapiens
tcaggtgagaagcagaggaag

SEQ ID NO: 2239086 - DNA, 23 bp, Homo sapiens
tcaggtgagaagcagaggaagga

SEQ ID NO: 2239087 - DNA, 16 bp, Homo sapiens
tcaggtgatccaccca

SEQ ID NO: 2239088 - DNA, 13 bp, Homo sapiens
tcaggtgctgcca

SEQ ID NO: 2239089 - DNA, 14 bp, Homo sapiens
tcaggtgctgccat

SEQ ID NO: 2239090 - DNA, 20 bp, Homo sapiens
tcaggtgctgccatccaggt

SEQ ID NO: 2239091 - DNA, 16 bp, Homo sapiens
tcaggtggggcagctt

SEQ ID NO: 2239092 - DNA, 17 bp, Homo sapiens
tcaggtggggcagcttg

SEQ ID NO: 2239093 - DNA, 17 bp, Homo sapiens
tcaggtggggtcactct

SEQ ID NO: 2239094 - DNA, 23 bp, Homo sapiens
tcaggtggggtcactctggcagc

SEQ ID NO: 2239095 - DNA, 19 bp, Homo sapiens
tcagtctgattcccaagct

SEQ ID NO: 2239096 - DNA, 24 bp, Homo sapiens
tcagtctgattcccaagctctgct

SEQ ID NO: 2239097 - DNA, 12 bp, Homo sapiens
tcagtgccacta

SEQ ID NO: 2239098 - DNA, 16 bp, Homo sapiens
tcagtgccttatggaa

SEQ ID NO: 2239099 - DNA, 18 bp, Homo sapiens
tcagtgccttatggaaca

SEQ ID NO: 2239100 - DNA, 12 bp, Homo sapiens
tcagtggcagct

SEQ ID NO: 2239101 - DNA, 11 bp, Homo sapiens
tcagtgtacat

SEQ ID NO: 2239102 - DNA, 20 bp, Homo sapiens
tcagtgtacatggaataaca

SEQ ID NO: 2239103 - DNA, 17 bp, Homo sapiens
tcagttgttagtgtgtc

SEQ ID NO: 2239104 - DNA, 19 bp, Homo sapiens
tcagttgttagtgtgtctt

SEQ ID NO: 2239105 - DNA, 14 bp, Homo sapiens
tcataacctagcct

SEQ ID NO: 2239106 - DNA, 12 bp, Homo sapiens
tcataatgactt

SEQ ID NO: 2239107 - DNA, 15 bp, Homo sapiens
tcatagtatggtggc

SEQ ID NO: 2239108 - DNA, 21 bp, Homo sapiens
tcatagtatggtggctgggtt

SEQ ID NO: 2239109 - DNA, 16 bp, Homo sapiens
tcatatttacttctta

SEQ ID NO: 2239110 - DNA, 19 bp, Homo sapiens
tcatgacaaagactgagta

SEQ ID NO: 2239111 - DNA, 16 bp, Homo sapiens
tcattaggtgtgactg

SEQ ID NO: 2239112 - DNA, 18 bp, Homo sapiens
tcattaggtgtgactgaa

SEQ ID NO: 2239113 - DNA, 12 bp, Homo sapiens
tcattgacctga

SEQ ID NO: 2239114 - DNA, 14 bp, Homo sapiens
tcattgacctgagg

SEQ ID NO: 2239115 - DNA, 15 bp, Homo sapiens
tcattgacctgaggc

SEQ ID NO: 2239116 - DNA, 19 bp, Homo sapiens
tcattgacctgaggccctt

SEQ ID NO: 2239117 - DNA, 22 bp, Homo sapiens
tcattgacctgaggcccttctc

SEQ ID NO: 2239118 - DNA, 14 bp, Homo sapiens
tcatttgtcacaca

SEQ ID NO: 2239119 - DNA, 16 bp, Homo sapiens
tcatttgtcacacact

SEQ ID NO: 2239120 - DNA, 19 bp, Homo sapiens
tcatttttagtagagacag

SEQ ID NO: 2239121 - DNA, 13 bp, Homo sapiens
tcattttttttaa

SEQ ID NO: 2239122 - DNA, 16 bp, Homo sapiens
tccaaaataaaacttt

SEQ ID NO: 2239123 - DNA, 17 bp, Homo sapiens
tccaaaataaaactttt

SEQ ID NO: 2239124 - DNA, 20 bp, Homo sapiens
tccaaaataaaactttttaa

SEQ ID NO: 2239125 - DNA, 13 bp, Homo sapiens
tccaaagtacact

SEQ ID NO: 2239126 - DNA, 19 bp, Homo sapiens
tcctgcaggcagccaggcc

SEQ ID NO: 2239127 - DNA, 14 bp, Homo sapiens
tcctgccaggcatg

SEQ ID NO: 2239128 - DNA, 16 bp, Homo sapiens
tcctgcccccacccca

SEQ ID NO: 2239129 - DNA, 17 bp, Homo sapiens
tcctgcccccaccccag

SEQ ID NO: 2239130 - DNA, 20 bp, Homo sapiens
tcctgcccccaccccaggct

SEQ ID NO: 2239131 - DNA, 13 bp, Homo sapiens
tcctgcctcagcc

SEQ ID NO: 2239132 - DNA, 20 bp, Homo sapiens
tcctgcctcgaactggctgc

SEQ ID NO: 2239133 - DNA, 21 bp, Homo sapiens
tcctggcacccggcccctgct

SEQ ID NO: 2239134 - DNA, 13 bp, Homo sapiens
tcctggcactgct

SEQ ID NO: 2239135 - DNA, 16 bp, Homo sapiens
tcctggcactgcttcc

SEQ ID NO: 2239136 - DNA, 12 bp, Homo sapiens
tcctggcctcaa

SEQ ID NO: 2239137 - DNA, 18 bp, Homo sapiens
tcctgggagtgagctggt

SEQ ID NO: 2239138 - DNA, 11 bp, Homo sapiens
tcctgtagccc

SEQ ID NO: 2239139 - DNA, 14 bp, Homo sapiens
tcctgtgtgtgcgc

SEQ ID NO: 2239140 - DNA, 18 bp, Homo sapiens
tcctgtgtgtgcgcctac

SEQ ID NO: 2239141 - DNA, 17 bp, Homo sapiens
tccttaccagcagagca

SEQ ID NO: 2239142 - DNA, 20 bp, Homo sapiens
tccttaccagcagagcacct

SEQ ID NO: 2239143 - DNA, 19 bp, Homo sapiens
tccttcacagatgggtgct

SEQ ID NO: 2239144 - DNA, 13 bp, Homo sapiens
tccttcagtgcct

SEQ ID NO: 2239145 - DNA, 23 bp, Homo sapiens
tccttgaaaacactgttctctgc

SEQ ID NO: 2239146 - DNA, 14 bp, Homo sapiens
tccttgtgttacta

SEQ ID NO: 2239147 - DNA, 15 bp, Homo sapiens
tcctttagcgcccag

SEQ ID NO: 2239148 - DNA, 23 bp, Homo sapiens
tcctttagcgcccagttgggtgg

SEQ ID NO: 2239149 - DNA, 14 bp, Homo sapiens
tcgagcatgcctgg

SEQ ID NO: 2239150 - DNA, 18 bp, Homo sapiens
tcgagcatgcctggatgg

SEQ ID NO: 2239151 - DNA, 15 bp, Homo sapiens
tcgagttacagacaa

SEQ ID NO: 2239152 - DNA, 13 bp, Homo sapiens
tcgctcctgtgtc

SEQ ID NO: 2239153 - DNA, 19 bp, Homo sapiens
tcgggaggtcgaggcagga

SEQ ID NO: 2239154 - DNA, 19 bp, Homo sapiens
tcgtcttggtttggttcat

SEQ ID NO: 2239155 - DNA, 14 bp, Homo sapiens
tctaaagctgccag

SEQ ID NO: 2239156 - DNA, 15 bp, Homo sapiens
tctaaagctgccagc

SEQ ID NO: 2239157 - DNA, 16 bp, Homo sapiens
tctaaagctgccagcc

SEQ ID NO: 2239158 - DNA, 16 bp, Homo sapiens
tctaaaggctaccttt

SEQ ID NO: 2239159 - DNA, 19 bp, Homo sapiens
tctaaaggctacctttgta

SEQ ID NO: 2239160 - DNA, 22 bp, Homo sapiens
tctaacttcaccatattaccac

SEQ ID NO: 2239161 - DNA, 15 bp, Homo sapiens
tctacactgtgctga

SEQ ID NO: 2239162 - DNA, 16 bp, Homo sapiens
tctacagaggccatgg

SEQ ID NO: 2239163 - DNA, 21 bp, Homo sapiens
tctaccctggcactataatgt

SEQ ID NO: 2239164 - DNA, 12 bp, Homo sapiens
tctacctgaggg

SEQ ID NO: 2239165 - DNA, 19 bp, Homo sapiens
tctacctgaggggcctctt

SEQ ID NO: 2239166 - DNA, 14 bp, Homo sapiens
tctaccttcctgca

SEQ ID NO: 2239167 - DNA, 21 bp, Homo sapiens
tctactcgagttacagacaaa

SEQ ID NO: 2239168 - DNA, 19 bp, Homo sapiens
tctactgaggtgctatgtt

SEQ ID NO: 2239169 - DNA, 12 bp, Homo sapiens
tctaggaagact

SEQ ID NO: 2239170 - DNA, 16 bp, Homo sapiens
tctaggaagactttgg

SEQ ID NO: 2239171 - DNA, 19 bp, Homo sapiens
tctaggaagactttggaaa

SEQ ID NO: 2239172 - DNA, 23 bp, Homo sapiens
tctagttgtttgattcagacagc

SEQ ID NO: 2239173 - DNA, 21 bp, Homo sapiens
tctagtttgattaaattcttg

SEQ ID NO: 2239174 - DNA, 23 bp, Homo sapiens
tctagtttgattaaattcttgca

SEQ ID NO: 2239175 - DNA, 17 bp, Homo sapiens
tctatgacacatgcaag

SEQ ID NO: 2239176 - DNA, 13 bp, Homo sapiens
tctatgggactca

SEQ ID NO: 2239177 - DNA, 19 bp, Homo sapiens
tctatgggactcaatgcac

SEQ ID NO: 2239178 - DNA, 17 bp, Homo sapiens
tctcaaataactaaaag

SEQ ID NO: 2239179 - DNA, 16 bp, Homo sapiens
tctcaaatttctaaat

SEQ ID NO: 2239180 - DNA, 21 bp, Homo sapiens
tctcacacatgagcatcaggc

SEQ ID NO: 2239181 - DNA, 17 bp, Homo sapiens
tctcactatgttgccca

SEQ ID NO: 2239182 - DNA, 19 bp, Homo sapiens
tctcactatgttgcccagg

SEQ ID NO: 2239183 - DNA, 23 bp, Homo sapiens
tctcactatgttgcccaggcagg

SEQ ID NO: 2239184 - DNA, 11 bp, Homo sapiens
tctcactcctt

SEQ ID NO: 2239185 - DNA, 12 bp, Homo sapiens
tctcactctgtc

SEQ ID NO: 2239186 - DNA, 18 bp, Homo sapiens
tctcactctgtcgcccag

SEQ ID NO: 2239187 - DNA, 22 bp, Homo sapiens
tctcactctgtcgcccagtctg

SEQ ID NO: 2239188 - DNA, 20 bp, Homo sapiens
tctcactgttgcccaggctg

SEQ ID NO: 2239189 - DNA, 17 bp, Homo sapiens
tctcagaatctcaaata

SEQ ID NO: 2239190 - DNA, 10 bp, Homo sapiens
tctcaggcca

SEQ ID NO: 2239191 - DNA, 12 bp, Homo sapiens
tctcagggcctg

SEQ ID NO: 2239192 - DNA, 13 bp, Homo sapiens
tctcagggcctgg

SEQ ID NO: 2239193 - DNA, 15 bp, Homo sapiens
tctccaagcaggaca

SEQ ID NO: 2239194 - DNA, 18 bp, Homo sapiens
tctccaagcaggacatgg

SEQ ID NO: 2239195 - DNA, 12 bp, Homo sapiens
tctccaccctgc

SEQ ID NO: 2239196 - DNA, 16 bp, Homo sapiens
tctccaccctgctctc

SEQ ID NO: 2239197 - DNA, 14 bp, Homo sapiens
tctccacctgccag

SEQ ID NO: 2239198 - DNA, 12 bp, Homo sapiens
tctccagcccct

SEQ ID NO: 2239199 - DNA, 13 bp, Homo sapiens
tctccagcccctg

SEQ ID NO: 2239200 - DNA, 11 bp, Homo sapiens
tctccaggctg

SEQ ID NO: 2239201 - DNA, 12 bp, Homo sapiens
tctcccccagcc

SEQ ID NO: 2239202 - DNA, 11 bp, Homo sapiens
tctcccttgga

SEQ ID NO: 2239203 - DNA, 17 bp, Homo sapiens
tctccgaccagacacct

SEQ ID NO: 2239204 - DNA, 15 bp, Homo sapiens
tctcctctgctgctg

SEQ ID NO: 2239205 - DNA, 16 bp, Homo sapiens
tctcctctgctgctgg

SEQ ID NO: 2239206 - DNA, 20 bp, Homo sapiens
tctcctctgctgctggctgg

SEQ ID NO: 2239207 - DNA, 22 bp, Homo sapiens
tctcctgcctcagcctcccaaa

SEQ ID NO: 2239208 - DNA, 13 bp, Homo sapiens
tctcctgtacctc

SEQ ID NO: 2239209 - DNA, 15 bp, Homo sapiens
tctcctgtacctctt

SEQ ID NO: 2239210 - DNA, 17 bp, Homo sapiens
tctcctgtacctcttga

SEQ ID NO: 2239211 - DNA, 16 bp, Homo sapiens
tctccttcacctttgt

SEQ ID NO: 2239212 - DNA, 23 bp, Homo sapiens
tctccttggtgtcgggcatgaca

SEQ ID NO: 2239213 - DNA, 13 bp, Homo sapiens
tctccttgtgtta

SEQ ID NO: 2239214 - DNA, 19 bp, Homo sapiens
tctctaacttcaccatatt

SEQ ID NO: 2239215 - DNA, 15 bp, Homo sapiens
tctctacaaaaagca

SEQ ID NO: 2239216 - DNA, 16 bp, Homo sapiens
tctctagtttgattaa

SEQ ID NO: 2239217 - DNA, 19 bp, Homo sapiens
tctctagtttgattaaatt

SEQ ID NO: 2239218 - DNA, 15 bp, Homo sapiens
tctctcactccttga

SEQ ID NO: 2239219 - DNA, 12 bp, Homo sapiens
tctctcaggcca

SEQ ID NO: 2239220 - DNA, 16 bp, Homo sapiens
tctctccagcccctgg

SEQ ID NO: 2239221 - DNA, 18 bp, Homo sapiens
tctctccagcccctggat

SEQ ID NO: 2239222 - DNA, 14 bp, Homo sapiens
tctctcctgtacct

SEQ ID NO: 2239223 - DNA, 22 bp, Homo sapiens
tctctcctgtacctcttgagcc

SEQ ID NO: 2239224 - DNA, 13 bp, Homo sapiens
tctctgaggacac

SEQ ID NO: 2239225 - DNA, 17 bp, Homo sapiens
tctctgaggacactaac

SEQ ID NO: 2239226 - DNA, 16 bp, Homo sapiens
tctctgccctccaaga

SEQ ID NO: 2239227 - DNA, 17 bp, Homo sapiens
tctctgccctccaagac

SEQ ID NO: 2239228 - DNA, 13 bp, Homo sapiens
tctcttgagcctg

SEQ ID NO: 2239229 - DNA, 18 bp, Homo sapiens
tctcttggtcctgctgca

SEQ ID NO: 2239230 - DNA, 22 bp, Homo sapiens
tctctttaatgtcacaggcagg

SEQ ID NO: 2239231 - DNA, 16 bp, Homo sapiens
tctcttttcaaaacat

SEQ ID NO: 2239232 - DNA, 13 bp, Homo sapiens
tctgaaaatgtat

SEQ ID NO: 2239233 - DNA, 16 bp, Homo sapiens
tctgaaaatgtatgtg

SEQ ID NO: 2239234 - DNA, 20 bp, Homo sapiens
tctgaacttggcgctgcccc

SEQ ID NO: 2239235 - DNA, 22 bp, Homo sapiens
tctgaaggacattgcggacagc

SEQ ID NO: 2239236 - DNA, 18 bp, Homo sapiens
tctgaaggctgggttctg

SEQ ID NO: 2239237 - DNA, 12 bp, Homo sapiens
tctgacacacag

SEQ ID NO: 2239238 - DNA, 15 bp, Homo sapiens
tctgacacacagctc

SEQ ID NO: 2239239 - DNA, 16 bp, Homo sapiens
tctgacacacagctct

SEQ ID NO: 2239240 - DNA, 19 bp, Homo sapiens
tctgacacacagctctgtc

SEQ ID NO: 2239241 - DNA, 12 bp, Homo sapiens
tctgacaggcaa

SEQ ID NO: 2239242 - DNA, 14 bp, Homo sapiens
tctgacccatgctg

SEQ ID NO: 2239243 - DNA, 18 bp, Homo sapiens
tctgacccatgctgccct

SEQ ID NO: 2239244 - DNA, 23 bp, Homo sapiens
tctgacccatgctgccctgtgag

SEQ ID NO: 2239245 - DNA, 23 bp, Homo sapiens
tctgagactcgcgacaatgcaaa

SEQ ID NO: 2239246 - DNA, 18 bp, Homo sapiens
tctgaggaatccagaccc

SEQ ID NO: 2239247 - DNA, 23 bp, Homo sapiens
tctgaggacactaaccacgctgg

SEQ ID NO: 2239248 - DNA, 17 bp, Homo sapiens
tctgatcatccactgtg

SEQ ID NO: 2239249 - DNA, 21 bp, Homo sapiens
tctgatcatccactgtgccat

SEQ ID NO: 2239250 - DNA, 20 bp, Homo sapiens
tctgcactcccctgctgggt

SEQ ID NO: 2239251 - DNA, 20 bp, Homo sapiens
tgcacagagttgttacattt

SEQ ID NO: 2239252 - DNA, 18 bp, Homo sapiens
tgcacagctaacatggaa

SEQ ID NO: 2239253 - DNA, 15 bp, Homo sapiens
tgcaccactgcactc

SEQ ID NO: 2239254 - DNA, 13 bp, Homo sapiens
tgcaccagccctt

SEQ ID NO: 2239255 - DNA, 16 bp, Homo sapiens
tgcaccctcaggcagg

SEQ ID NO: 2239256 - DNA, 17 bp, Homo sapiens
tgcaccctcaggcaggt

SEQ ID NO: 2239257 - DNA, 14 bp, Homo sapiens
tgcaccggctggcc

SEQ ID NO: 2239258 - DNA, 15 bp, Homo sapiens
tgcaccggctggcct

SEQ ID NO: 2239259 - DNA, 16 bp, Homo sapiens
tgcaccggctggcctg

SEQ ID NO: 2239260 - DNA, 20 bp, Homo sapiens
tgcaccggctggcctggccc

SEQ ID NO: 2239261 - DNA, 17 bp, Homo sapiens
tgcaccgggccacagag

SEQ ID NO: 2239262 - DNA, 16 bp, Homo sapiens
tgcacgtacacacaca

SEQ ID NO: 2239263 - DNA, 14 bp, Homo sapiens
tgcacgtgtgtgca

SEQ ID NO: 2239264 - DNA, 15 bp, Homo sapiens
tgcacgtgtgtgcac

SEQ ID NO: 2239265 - DNA, 22 bp, Homo sapiens
tgcactatagcctaggtgacag

SEQ ID NO: 2239266 - DNA, 23 bp, Homo sapiens
tgcactatagcctaggtgacaga

SEQ ID NO: 2239267 - DNA, 13 bp, Homo sapiens
tgcactcccctgc

SEQ ID NO: 2239268 - DNA, 16 bp, Homo sapiens
tgcactcccctgctgg

SEQ ID NO: 2239269 - DNA, 18 bp, Homo sapiens
tgcactgacattgttggc

SEQ ID NO: 2239270 - DNA, 16 bp, Homo sapiens
tgcacttgcagactct

SEQ ID NO: 2239271 - DNA, 20 bp, Homo sapiens
tgcactttgttctggctctt

SEQ ID NO: 2239272 - DNA, 13 bp, Homo sapiens
tgcagacaggcaa

SEQ ID NO: 2239273 - DNA, 17 bp, Homo sapiens
tgcagactctacagagg

SEQ ID NO: 2239274 - DNA, 14 bp, Homo sapiens
tgcagcaataaagc

SEQ ID NO: 2239275 - DNA, 16 bp, Homo sapiens
tgcagcaataaagcag

SEQ ID NO: 2239276 - DNA, 21 bp, Homo sapiens
tgcagcctcacagtccttacc

SEQ ID NO: 2239277 - DNA, 15 bp, Homo sapiens
tgcaggacctcaggt

SEQ ID NO: 2239278 - DNA, 14 bp, Homo sapiens
tgcaggcagccagg

SEQ ID NO: 2239279 - DNA, 15 bp, Homo sapiens
tgcaggcagccaggc

SEQ ID NO: 2239280 - DNA, 21 bp, Homo sapiens
tgcagtggtgcgatctgggtt

SEQ ID NO: 2239281 - DNA, 14 bp, Homo sapiens
tgcagttgccagtc

SEQ ID NO: 2239282 - DNA, 15 bp, Homo sapiens
tgcagttgccagtca

SEQ ID NO: 2239283 - DNA, 15 bp, Homo sapiens
tgcatcgtttcatct

SEQ ID NO: 2239284 - DNA, 20 bp, Homo sapiens
tgcatgaagtaatatgcaca

SEQ ID NO: 2239285 - DNA, 15 bp, Homo sapiens
tgcatgctgtccctt

SEQ ID NO: 2239286 - DNA, 18 bp, Homo sapiens
tgcatgctgtcccttacg

SEQ ID NO: 2239287 - DNA, 15 bp, Homo sapiens
tgcatgtttgtgatt

SEQ ID NO: 2239288 - DNA, 20 bp, Homo sapiens
tgcatttaaaagatacagtt

SEQ ID NO: 2239289 - DNA, 14 bp, Homo sapiens
tgccaggcatggtg

SEQ ID NO: 2239290 - DNA, 22 bp, Homo sapiens
tgccaggtttttggtctgaccc

SEQ ID NO: 2239291 - DNA, 15 bp, Homo sapiens
tgccagtcaccccgg

SEQ ID NO: 2239292 - DNA, 22 bp, Homo sapiens
tgccagtcaccccggccacctg

SEQ ID NO: 2239293 - DNA, 23 bp, Homo sapiens
tgccagtcaccccggccacctgc

SEQ ID NO: 2239294 - DNA, 15 bp, Homo sapiens
tgccatattctgttg

SEQ ID NO: 2239295 - DNA, 17 bp, Homo sapiens
tgccatattctgttggc

SEQ ID NO: 2239296 - DNA, 21 bp, Homo sapiens
tgccatattctgttggccagt

SEQ ID NO: 2239297 - DNA, 12 bp, Homo sapiens
tgccatccaggt

SEQ ID NO: 2239298 - DNA, 15 bp, Homo sapiens
tgccatccaggttca

SEQ ID NO: 2239299 - DNA, 20 bp, Homo sapiens
tgccatccaggttcagcttg

SEQ ID NO: 2239300 - DNA, 16 bp, Homo sapiens
tgccatgttggccagg

SEQ ID NO: 2239301 - DNA, 18 bp, Homo sapiens
tgccatgttggccaggct

SEQ ID NO: 2239302 - DNA, 20 bp, Homo sapiens
tgccatgttggccaggctgg

SEQ ID NO: 2239303 - DNA, 20 bp, Homo sapiens
tgcccacaggatcagtctga

SEQ ID NO: 2239304 - DNA, 13 bp, Homo sapiens
tgcccacctggcc

SEQ ID NO: 2239305 - DNA, 17 bp, Homo sapiens
tgcccacctggcctctg

SEQ ID NO: 2239306 - DNA, 18 bp, Homo sapiens
tgcccacctggcctctgc

SEQ ID NO: 2239307 - DNA, 20 bp, Homo sapiens
tgcccacctggcctctgcac

SEQ ID NO: 2239308 - DNA, 16 bp, Homo sapiens
tgcccactccctgcaa

SEQ ID NO: 2239309 - DNA, 21 bp, Homo sapiens
tgcccagccccttctgaccca

SEQ ID NO: 2239310 - DNA, 18 bp, Homo sapiens
tgcccaggcccctgccac

SEQ ID NO: 2239311 - DNA, 22 bp, Homo sapiens
tgcccaggcccctgccaccctg

SEQ ID NO: 2239312 - DNA, 14 bp, Homo sapiens
tgcccaggcctccc

SEQ ID NO: 2239313 - DNA, 17 bp, Homo sapiens
tgcccccaccccaggct

SEQ ID NO: 2239314 - DNA, 14 bp, Homo sapiens
tgcccccaccccca

SEQ ID NO: 2239315 - DNA, 19 bp, Homo sapiens
tgcccccacccccaccctc

SEQ ID NO: 2239316 - DNA, 20 bp, Homo sapiens
tgcccccacccccaccctcg

SEQ ID NO: 2239317 - DNA, 23 bp, Homo sapiens
tgcccctcaactctcctccagag

SEQ ID NO: 2239318 - DNA, 18 bp, Homo sapiens
tgcccctggcagcccctg

SEQ ID NO: 2239319 - DNA, 19 bp, Homo sapiens
tgccctaaagtgtattttt

SEQ ID NO: 2239320 - DNA, 14 bp, Homo sapiens
tgccctcccagacc

SEQ ID NO: 2239321 - DNA, 15 bp, Homo sapiens
tgccctcccagaccc

SEQ ID NO: 2239322 - DNA, 14 bp, Homo sapiens
tgccctgcccacct

SEQ ID NO: 2239323 - DNA, 20 bp, Homo sapiens
tgccctgcccacctggcctc

SEQ ID NO: 2239324 - DNA, 14 bp, Homo sapiens
tgccgcagccctgc

SEQ ID NO: 2239325 - DNA, 17 bp, Homo sapiens
tgccgtctacctgaggg

SEQ ID NO: 2239326 - DNA, 14 bp, Homo sapiens
tgcctcaagagaag

SEQ ID NO: 2239327 - DNA, 13 bp, Homo sapiens
tgcctcagcctcc

SEQ ID NO: 2239328 - DNA, 14 bp, Homo sapiens
tgcctcagcctccc

SEQ ID NO: 2239329 - DNA, 14 bp, Homo sapiens
tgcctcccatcacc

SEQ ID NO: 2239330 - DNA, 19 bp, Homo sapiens
tgcctcccatcacccgcta

SEQ ID NO: 2239331 - DNA, 20 bp, Homo sapiens
tgcctcctttgtgaggaagc

SEQ ID NO: 2239332 - DNA, 22 bp, Homo sapiens
tgcctcctttgtgaggaagccg

SEQ ID NO: 2239333 - DNA, 14 bp, Homo sapiens
tgcctctctcaggc

SEQ ID NO: 2239334 - DNA, 17 bp, Homo sapiens
tgcctctctcaggccaa

SEQ ID NO: 2239335 - DNA, 16 bp, Homo sapiens
tgcctctgacacacag

SEQ ID NO: 2239336 - DNA, 18 bp, Homo sapiens
tgcctctgcctctgacac

SEQ ID NO: 2239337 - DNA, 20 bp, Homo sapiens
tgcctctgcctctgacacac

SEQ ID NO: 2239338 - DNA, 21 bp, Homo sapiens
tgcctcttctctactctaggg

SEQ ID NO: 2239339 - DNA, 22 bp, Homo sapiens
tgcctgaagtcacacagtgagt

SEQ ID NO: 2239340 - DNA, 13 bp, Homo sapiens
tgcctgcccaggc

SEQ ID NO: 2239341 - DNA, 18 bp, Homo sapiens
tgcctgcccaggcccctg

SEQ ID NO: 2239342 - DNA, 22 bp, Homo sapiens
tgcctgcccaggcccctgccac

SEQ ID NO: 2239343 - DNA, 23 bp, Homo sapiens
tgcctgcccaggcccctgccacc

SEQ ID NO: 2239344 - DNA, 16 bp, Homo sapiens
tgcctggatggggctg

SEQ ID NO: 2239345 - DNA, 16 bp, Homo sapiens
tgcctggtggcagctg

SEQ ID NO: 2239346 - DNA, 16 bp, Homo sapiens
tgcctgttcagctcca

SEQ ID NO: 2239347 - DNA, 17 bp, Homo sapiens
tgcctgttcagctccag

SEQ ID NO: 2239348 - DNA, 18 bp, Homo sapiens
tgcctgttcagctccagc

SEQ ID NO: 2239349 - DNA, 16 bp, Homo sapiens
tgcctgttgggccagg

SEQ ID NO: 2239350 - DNA, 19 bp, Homo sapiens
tgcctgttgggccaggagc

SEQ ID NO: 2239351 - DNA, 16 bp, Homo sapiens
tgccttatggaacact

SEQ ID NO: 2239352 - DNA, 18 bp, Homo sapiens
tgccttatggaacactct

SEQ ID NO: 2239353 - DNA, 15 bp, Homo sapiens
tgcgatctgggttca

SEQ ID NO: 2239354 - DNA, 14 bp, Homo sapiens
tgcgcctacaggag

SEQ ID NO: 2239355 - DNA, 22 bp, Homo sapiens
tgcgcctacaggagtgagcact

SEQ ID NO: 2239356 - DNA, 21 bp, Homo sapiens
tgcggacagccacggccaggc

SEQ ID NO: 2239357 - DNA, 17 bp, Homo sapiens
tgcggcctttggcttca

SEQ ID NO: 2239358 - DNA, 19 bp, Homo sapiens
tgcggcctttggcttcacg

SEQ ID NO: 2239359 - DNA, 15 bp, Homo sapiens
tgcgggggagcaggc

SEQ ID NO: 2239360 - DNA, 18 bp, Homo sapiens
tgcgggggagcaggcagt

SEQ ID NO: 2239361 - DNA, 15 bp, Homo sapiens
tgcgtgcataccact

SEQ ID NO: 2239362 - DNA, 19 bp, Homo sapiens
tgctaggaacactccttca

SEQ ID NO: 2239363 - DNA, 21 bp, Homo sapiens
tgctaggaacactccttcaca

SEQ ID NO: 2239364 - DNA, 18 bp, Homo sapiens
tgctatctcccccagccc

SEQ ID NO: 2239365 - DNA, 17 bp, Homo sapiens
tgctcacatatctgtca

SEQ ID NO: 2239366 - DNA, 14 bp, Homo sapiens
tgctcctctcccca

SEQ ID NO: 2239367 - DNA, 19 bp, Homo sapiens
tgctcctggcccactgcat

SEQ ID NO: 2239368 - DNA, 19 bp, Homo sapiens
tgctctgatcatccactgt

SEQ ID NO: 2239369 - DNA, 15 bp, Homo sapiens
tgctctgcatgttac

SEQ ID NO: 2239370 - DNA, 16 bp, Homo sapiens
tgctctgctgacagac

SEQ ID NO: 2239371 - DNA, 21 bp, Homo sapiens
tgctctgctgacagacacagg

SEQ ID NO: 2239372 - DNA, 15 bp, Homo sapiens
tgctctggacaggca

SEQ ID NO: 2239373 - DNA, 16 bp, Homo sapiens
tgctctggacaggcat

SEQ ID NO: 2239374 - DNA, 17 bp, Homo sapiens
tgctctggacaggcatg

SEQ ID NO: 2239375 - DNA, 19 bp, Homo sapiens
tgttacataagataaatgt

SEQ ID NO: 2239376 - DNA, 22 bp, Homo sapiens
tgttacatttttaagtgctgca

SEQ ID NO: 2239377 - DNA, 16 bp, Homo sapiens
tgttactgtcttcagt

SEQ ID NO: 2239378 - DNA, 17 bp, Homo sapiens
tgttagtatgaggcatt

SEQ ID NO: 2239379 - DNA, 13 bp, Homo sapiens
tgttatgactcca

SEQ ID NO: 2239380 - DNA, 16 bp, Homo sapiens
tgttcagctccagctc

SEQ ID NO: 2239381 - DNA, 20 bp, Homo sapiens
tgttcagctccagctcacca

SEQ ID NO: 2239382 - DNA, 19 bp, Homo sapiens
tgttccacaagttaaataa

SEQ ID NO: 2239383 - DNA, 18 bp, Homo sapiens
tgttctagcatggctgcc

SEQ ID NO: 2239384 - DNA, 16 bp, Homo sapiens
tgttctctcttctcca

SEQ ID NO: 2239385 - DNA, 14 bp, Homo sapiens
tgttctctgccctc

SEQ ID NO: 2239386 - DNA, 15 bp, Homo sapiens
tgttctgaccctgct

SEQ ID NO: 2239387 - DNA, 12 bp, Homo sapiens
tgttctggctct

SEQ ID NO: 2239388 - DNA, 20 bp, Homo sapiens
tgttctggctcttccaggct

SEQ ID NO: 2239389 - DNA, 21 bp, Homo sapiens
tgttctggctcttccaggctg

SEQ ID NO: 2239390 - DNA, 12 bp, Homo sapiens
tgttctgggaca

SEQ ID NO: 2239391 - DNA, 14 bp, Homo sapiens
tgttctgggacaca

SEQ ID NO: 2239392 - DNA, 18 bp, Homo sapiens
tgttcttagtttgcagtt

SEQ ID NO: 2239393 - DNA, 23 bp, Homo sapiens
tgttctttctggctatgcatttg

SEQ ID NO: 2239394 - DNA, 12 bp, Homo sapiens
tgttgcccaggc

SEQ ID NO: 2239395 - DNA, 15 bp, Homo sapiens
tgttgcccaggcagg

SEQ ID NO: 2239396 - DNA, 16 bp, Homo sapiens
tgttgcccaggcaggt

SEQ ID NO: 2239397 - DNA, 14 bp, Homo sapiens
tgttggccaggctg

SEQ ID NO: 2239398 - DNA, 13 bp, Homo sapiens
tgttgggccagga

SEQ ID NO: 2239399 - DNA, 15 bp, Homo sapiens
tgtttcctggcactg

SEQ ID NO: 2239400 - DNA, 21 bp, Homo sapiens
tgtttcctggcactgcttcca

SEQ ID NO: 2239401 - DNA, 15 bp, Homo sapiens
tgtttggggatgaga

SEQ ID NO: 2239402 - DNA, 19 bp, Homo sapiens
tgtttggggatgagaaagg

SEQ ID NO: 2239403 - DNA, 17 bp, Homo sapiens
tgttttaagaggcaggg

SEQ ID NO: 2239404 - DNA, 20 bp, Homo sapiens
tgttttaagaggcagggtct

SEQ ID NO: 2239405 - DNA, 22 bp, Homo sapiens
tgttttaagaggcagggtctca

SEQ ID NO: 2239406 - DNA, 15 bp, Homo sapiens
tgttttcagtgtaca

SEQ ID NO: 2239407 - DNA, 15 bp, Homo sapiens
tgttttctcttgaga

SEQ ID NO: 2239408 - DNA, 16 bp, Homo sapiens
ttaaaaatctcaaatt

SEQ ID NO: 2239409 - DNA, 14 bp, Homo sapiens
ttaaaacccaagtg

SEQ ID NO: 2239410 - DNA, 14 bp, Homo sapiens
ttaaaagatacagt

SEQ ID NO: 2239411 - DNA, 18 bp, Homo sapiens
ttaaacttaatctaaatg

SEQ ID NO: 2239412 - DNA, 16 bp, Homo sapiens
ttaaataatgtgaaac

SEQ ID NO: 2239413 - DNA, 22 bp, Homo sapiens
ttaaataatgtgaaactggatt

SEQ ID NO: 2239414 - DNA, 16 bp, Homo sapiens
ttaaatgcacctggaa

SEQ ID NO: 2239415 - DNA, 17 bp, Homo sapiens
ttaaatgcacctggaat

SEQ ID NO: 2239416 - DNA, 13 bp, Homo sapiens
ttaacagaaatgt

SEQ ID NO: 2239417 - DNA, 20 bp, Homo sapiens
ttaacagaaatgtacagcaa

SEQ ID NO: 2239418 - DNA, 13 bp, Homo sapiens
ttaacttttataa

SEQ ID NO: 2239419 - DNA, 21 bp, Homo sapiens
ttaagaaaaaggatgcacaga

SEQ ID NO: 2239420 - DNA, 22 bp, Homo sapiens
ttaagaaagactatctaaatgt

SEQ ID NO: 2239421 - DNA, 16 bp, Homo sapiens
ttaagaggcagggtct

SEQ ID NO: 2239422 - DNA, 17 bp, Homo sapiens
ttaaggatgcttgtaca

SEQ ID NO: 2239423 - DNA, 19 bp, Homo sapiens
ttaaggatgcttgtacata

SEQ ID NO: 2239424 - DNA, 22 bp, Homo sapiens
ttaattaaaacacaacatcttt

SEQ ID NO: 2239425 - DNA, 14 bp, Homo sapiens
ttacaggaagtact

SEQ ID NO: 2239426 - DNA, 23 bp, Homo sapiens
ttacatttttaagtgctgcattt

SEQ ID NO: 2239427 - DNA, 19 bp, Homo sapiens
ttaccagcagagcacctta

SEQ ID NO: 2239428 - DNA, 20 bp, Homo sapiens
ttaccttttttatacataaa

SEQ ID NO: 2239429 - DNA, 22 bp, Homo sapiens
ttaccttttttatacataaaca

SEQ ID NO: 2239430 - DNA, 13 bp, Homo sapiens
ttacgtgagtcct

SEQ ID NO: 2239431 - DNA, 19 bp, Homo sapiens
ttactatggccctggccta

SEQ ID NO: 2239432 - DNA, 15 bp, Homo sapiens
ttactgcagctttgt

SEQ ID NO: 2239433 - DNA, 14 bp, Homo sapiens
ttactgtacatgaa

SEQ ID NO: 2239434 - DNA, 11 bp, Homo sapiens
ttacttctgct

SEQ ID NO: 2239435 - DNA, 18 bp, Homo sapiens
ttactttaaaaggagcca

SEQ ID NO: 2239436 - DNA, 11 bp, Homo sapiens
ttagaaatata

SEQ ID NO: 2239437 - DNA, 16 bp, Homo sapiens
ttagaagtcacacagt

SEQ ID NO: 2239438 - DNA, 18 bp, Homo sapiens
ttagacagtccctgccaa

SEQ ID NO: 2239439 - DNA, 20 bp, Homo sapiens
ttagggaaggatacaaaagc

SEQ ID NO: 2239440 - DNA, 15 bp, Homo sapiens
ttaggtgaggaagca

SEQ ID NO: 2239441 - DNA, 13 bp, Homo sapiens
ttagtagagacag

SEQ ID NO: 2239442 - DNA, 16 bp, Homo sapiens
ttagtatgaggcattt

SEQ ID NO: 2239443 - DNA, 13 bp, Homo sapiens
ttataaactttac

SEQ ID NO: 2239444 - DNA, 21 bp, Homo sapiens
ttatcacccagaagaaaatag

SEQ ID NO: 2239445 - DNA, 22 bp, Homo sapiens
ttatgcatgaagtaatatgcac

SEQ ID NO: 2239446 - DNA, 16 bp, Homo sapiens
ttatggaacactctga

SEQ ID NO: 2239447 - DNA, 17 bp, Homo sapiens
ttatggaacactctgag

SEQ ID NO: 2239448 - DNA, 18 bp, Homo sapiens
ttatggaacactctgaga

SEQ ID NO: 2239449 - DNA, 17 bp, Homo sapiens
ttatggcttttgtgcat

SEQ ID NO: 2239450 - DNA, 21 bp, Homo sapiens
ttattaaatgcccagcccctt

SEQ ID NO: 2239451 - DNA, 13 bp, Homo sapiens
ttattatgcatga

SEQ ID NO: 2239452 - DNA, 15 bp, Homo sapiens
ttattgcccacgctg

SEQ ID NO: 2239453 - DNA, 14 bp, Homo sapiens
ttatttaaatttta

SEQ ID NO: 2239454 - DNA, 22 bp, Homo sapiens
ttattttggaaaataaattatt

SEQ ID NO: 2239455 - DNA, 18 bp, Homo sapiens
ttatttttagacagagtc

SEQ ID NO: 2239456 - DNA, 17 bp, Homo sapiens
ttcaaaataaaaatgag

SEQ ID NO: 2239457 - DNA, 21 bp, Homo sapiens
ttcaataggaaaaactgattt

SEQ ID NO: 2239458 - DNA, 15 bp, Homo sapiens
ttcacagttctctcc

SEQ ID NO: 2239459 - DNA, 20 bp, Homo sapiens
ttcacagttctctccttctt

SEQ ID NO: 2239460 - DNA, 17 bp, Homo sapiens
ttcacatattgatttcc

SEQ ID NO: 2239461 - DNA, 13 bp, Homo sapiens
ttcacccttttct

SEQ ID NO: 2239462 - DNA, 17 bp, Homo sapiens
ttcacggaagagccttg

SEQ ID NO: 2239463 - DNA, 15 bp, Homo sapiens
ttcacgtggtcctaa

SEQ ID NO: 2239464 - DNA, 16 bp, Homo sapiens
ttcagacagctgcctg

SEQ ID NO: 2239465 - DNA, 21 bp, Homo sapiens
ttcagacagctgcctgggatc

SEQ ID NO: 2239466 - DNA, 17 bp, Homo sapiens
ttcagatctctaacttc

SEQ ID NO: 2239467 - DNA, 14 bp, Homo sapiens
ttcagccaagaatt

SEQ ID NO: 2239468 - DNA, 19 bp, Homo sapiens
ttcagccaagaattcttaa

SEQ ID NO: 2239469 - DNA, 17 bp, Homo sapiens
ttcagctgacttttctg

SEQ ID NO: 2239470 - DNA, 21 bp, Homo sapiens
ttcagctggttgaggtttcaa

SEQ ID NO: 2239471 - DNA, 22 bp, Homo sapiens
ttcagcttgtaaatagctcagg

SEQ ID NO: 2239472 - DNA, 13 bp, Homo sapiens
ttcaggaagctca

SEQ ID NO: 2239473 - DNA, 16 bp, Homo sapiens
ttcaggaagctcaggg

SEQ ID NO: 2239474 - DNA, 19 bp, Homo sapiens
ttcaggaagctcagggcct

SEQ ID NO: 2239475 - DNA, 20 bp, Homo sapiens
ttcaggaagctcagggcctg

SEQ ID NO: 2239476 - DNA, 14 bp, Homo sapiens
ttcagggttggccc

SEQ ID NO: 2239477 - DNA, 14 bp, Homo sapiens
ttcagtaagccgtg

SEQ ID NO: 2239478 - DNA, 18 bp, Homo sapiens
ttcagtgccttatggaac

SEQ ID NO: 2239479 - DNA, 21 bp, Homo sapiens
ttcagtgccttatggaacact

SEQ ID NO: 2239480 - DNA, 12 bp, Homo sapiens
ttcagtgtacat

SEQ ID NO: 2239481 - DNA, 13 bp, Homo sapiens
ttcagtgtacatg

SEQ ID NO: 2239482 - DNA, 15 bp, Homo sapiens
ttcataacctagcct

SEQ ID NO: 2239483 - DNA, 18 bp, Homo sapiens
ttcatcatcctaagctat

SEQ ID NO: 2239484 - DNA, 11 bp, Homo sapiens
ttcatcttgaa

SEQ ID NO: 2239485 - DNA, 19 bp, Homo sapiens
ttcatttaggtgaggaagc

SEQ ID NO: 2239486 - DNA, 16 bp, Homo sapiens
ttcatttcctgtgtct

SEQ ID NO: 2239487 - DNA, 15 bp, Homo sapiens
ttccaaattctgctt

SEQ ID NO: 2239488 - DNA, 15 bp, Homo sapiens
ttccaagggtactaa

SEQ ID NO: 2239489 - DNA, 21 bp, Homo sapiens
ttccacaagagcccaggcctc

SEQ ID NO: 2239490 - DNA, 19 bp, Homo sapiens
ttccaccatcaagccacca

SEQ ID NO: 2239491 - DNA, 13 bp, Homo sapiens
ttccaggctggga

SEQ ID NO: 2239492 - DNA, 21 bp, Homo sapiens
ttccagtgaggctctgccctt

SEQ ID NO: 2239493 - DNA, 17 bp, Homo sapiens
ttccatgagtcccctgt

SEQ ID NO: 2239494 - DNA, 22 bp, Homo sapiens
ttcccacctctctcactccttg

SEQ ID NO: 2239495 - DNA, 22 bp, Homo sapiens
ttccccacttgagaattaccct

SEQ ID NO: 2239496 - DNA, 18 bp, Homo sapiens
ttccccaggaggccagcc

SEQ ID NO: 2239497 - DNA, 19 bp, Homo sapiens
ttccccaggaggccagcct

SEQ ID NO: 2239498 - DNA, 17 bp, Homo sapiens
ttccctcccttcctctt

SEQ ID NO: 2239499 - DNA, 16 bp, Homo sapiens
agaataagttattgca

SEQ ID NO: 2239500 - DNA, 20 bp, Homo sapiens
agaataagttattgcagttt

SEQ ID NO: 2239501 - DNA, 15 bp, Homo sapiens
agaatacattgtact

SEQ ID NO: 2239502 - DNA, 21 bp, Homo sapiens
agaatatcctttaaaatttaa

SEQ ID NO: 2239503 - DNA, 21 bp, Homo sapiens
agaatccaaacttggattttt

SEQ ID NO: 2239504 - DNA, 14 bp, Homo sapiens
agaatgtgtctcag

SEQ ID NO: 2239505 - DNA, 11 bp, Homo sapiens
agaattattta

SEQ ID NO: 2239506 - DNA, 23 bp, Homo sapiens
agacaacaggtaaaacagggcca

SEQ ID NO: 2239507 - DNA, 22 bp, Homo sapiens
agacaataaaccctcagagcct

SEQ ID NO: 2239508 - DNA, 22 bp, Homo sapiens
agacacagcccaggtccctccg

SEQ ID NO: 2239509 - DNA, 19 bp, Homo sapiens
agacaccctcaacctcttc

SEQ ID NO: 2239510 - DNA, 21 bp, Homo sapiens
agacacggagcccagccctcc

SEQ ID NO: 2239511 - DNA, 20 bp, Homo sapiens
agacactgcagtgaccactt

SEQ ID NO: 2239512 - DNA, 11 bp, Homo sapiens
agacacttact

SEQ ID NO: 2239513 - DNA, 23 bp, Homo sapiens
agacagcccaggatactggcaca

SEQ ID NO: 2239514 - DNA, 12 bp, Homo sapiens
agacagtcttgc

SEQ ID NO: 2239515 - DNA, 18 bp, Homo sapiens
agacatgttttccgtgaa

SEQ ID NO: 2239516 - DNA, 17 bp, Homo sapiens
agacatttgatagaaag

SEQ ID NO: 2239517 - DNA, 22 bp, Homo sapiens
agacatttgatagaaaggaaca

SEQ ID NO: 2239518 - DNA, 15 bp, Homo sapiens
agaccagggagcctt

SEQ ID NO: 2239519 - DNA, 17 bp, Homo sapiens
agaccccacgctgacca

SEQ ID NO: 2239520 - DNA, 15 bp, Homo sapiens
agacccccatccagc

SEQ ID NO: 2239521 - DNA, 17 bp, Homo sapiens
agacccccatccagcct

SEQ ID NO: 2239522 - DNA, 22 bp, Homo sapiens
agacccccatccagcctccagg

SEQ ID NO: 2239523 - DNA, 22 bp, Homo sapiens
agacccttattgctgtcctgga

SEQ ID NO: 2239524 - DNA, 15 bp, Homo sapiens
agaccgatcggcggc

SEQ ID NO: 2239525 - DNA, 17 bp, Homo sapiens
agacctgaataccactt

SEQ ID NO: 2239526 - DNA, 16 bp, Homo sapiens
agacgctgccgctgcc

SEQ ID NO: 2239527 - DNA, 13 bp, Homo sapiens
agacggaggaggg

SEQ ID NO: 2239528 - DNA, 21 bp, Homo sapiens
agacgtttttgtgctgtgggc

SEQ ID NO: 2239529 - DNA, 15 bp, Homo sapiens
agactctttgaaatg

SEQ ID NO: 2239530 - DNA, 17 bp, Homo sapiens
agactgaactcgcaggg

SEQ ID NO: 2239531 - DNA, 12 bp, Homo sapiens
agactgattacc

SEQ ID NO: 2239532 - DNA, 23 bp, Homo sapiens
agactggcttttattaatgcact

SEQ ID NO: 2239533 - DNA, 14 bp, Homo sapiens
agacttccttgaga

SEQ ID NO: 2239534 - DNA, 16 bp, Homo sapiens
agacttccttgagaca

SEQ ID NO: 2239535 - DNA, 14 bp, Homo sapiens
agagaaatatggaa

SEQ ID NO: 2239536 - DNA, 15 bp, Homo sapiens
agagaagccacgctg

SEQ ID NO: 2239537 - DNA, 17 bp, Homo sapiens
agagaagccacgctgtc

SEQ ID NO: 2239538 - DNA, 15 bp, Homo sapiens
agagatgacaaacca

SEQ ID NO: 2239539 - DNA, 14 bp, Homo sapiens
agagcatgcacatg

SEQ ID NO: 2239540 - DNA, 17 bp, Homo sapiens
agagcatttaaggaaac

SEQ ID NO: 2239541 - DNA, 13 bp, Homo sapiens
agagccaagacgg

SEQ ID NO: 2239542 - DNA, 17 bp, Homo sapiens
agagccaagacggagga

SEQ ID NO: 2239543 - DNA, 13 bp, Homo sapiens
agagccagcctgg

SEQ ID NO: 2239544 - DNA, 24 bp, Homo sapiens
agagccgggaggaaaaggcccctg

SEQ ID NO: 2239545 - DNA, 21 bp, Homo sapiens
agagcgaggaaaggattttac

SEQ ID NO: 2239546 - DNA, 18 bp, Homo sapiens
agaggaattacgtgctct

SEQ ID NO: 2239547 - DNA, 20 bp, Homo sapiens
agaggcccagatattagaaa

SEQ ID NO: 2239548 - DNA, 12 bp, Homo sapiens
agaggcggcctc

SEQ ID NO: 2239549 - DNA, 18 bp, Homo sapiens
agaggctcagattgtaat

SEQ ID NO: 2239550 - DNA, 19 bp, Homo sapiens
agaggctgcccctctcacc

SEQ ID NO: 2239551 - DNA, 21 bp, Homo sapiens
agaggtaactatcaatattta

SEQ ID NO: 2239552 - DNA, 12 bp, Homo sapiens
agagtctgtctc

SEQ ID NO: 2239553 - DNA, 14 bp, Homo sapiens
agagtgaagggaag

SEQ ID NO: 2239554 - DNA, 22 bp, Homo sapiens
agagtgaagggaagagacagcc

SEQ ID NO: 2239555 - DNA, 23 bp, Homo sapiens
agagtttttatgcctttctctcc

SEQ ID NO: 2239556 - DNA, 21 bp, Homo sapiens
agataaggactagatactact

SEQ ID NO: 2239557 - DNA, 16 bp, Homo sapiens
agataatctcagtgct

SEQ ID NO: 2239558 - DNA, 17 bp, Homo sapiens
agatactactttctctt

SEQ ID NO: 2239559 - DNA, 23 bp, Homo sapiens
agatactgctactgtaattttat

SEQ ID NO: 2239560 - DNA, 18 bp, Homo sapiens
agatatttgcagtttttc

SEQ ID NO: 2239561 - DNA, 16 bp, Homo sapiens
agatatttttcataaa

SEQ ID NO: 2239562 - DNA, 14 bp, Homo sapiens
agatatttttgtac

SEQ ID NO: 2239563 - DNA, 15 bp, Homo sapiens
agatcagtaaagaac

SEQ ID NO: 2239564 - DNA, 14 bp, Homo sapiens
agatcgctcactgt

SEQ ID NO: 2239565 - DNA, 15 bp, Homo sapiens
agatcgctcactgtt

SEQ ID NO: 2239566 - DNA, 16 bp, Homo sapiens
agatctcggtttgcca

SEQ ID NO: 2239567 - DNA, 14 bp, Homo sapiens
agatgatctctcca

SEQ ID NO: 2239568 - DNA, 14 bp, Homo sapiens
agatgcaacctcac

SEQ ID NO: 2239569 - DNA, 16 bp, Homo sapiens
agatgcaacctcacta

SEQ ID NO: 2239570 - DNA, 19 bp, Homo sapiens
agatgtaattttgtgtaag

SEQ ID NO: 2239571 - DNA, 18 bp, Homo sapiens
agatgttaaaataaatgg

SEQ ID NO: 2239572 - DNA, 10 bp, Homo sapiens
agcttagaac

SEQ ID NO: 2239573 - DNA, 22 bp, Homo sapiens
agcttattgtttctctgaaagt

SEQ ID NO: 2239574 - DNA, 22 bp, Homo sapiens
agcttctctgctagatttctac

SEQ ID NO: 2239575 - DNA, 23 bp, Homo sapiens
agcttctctgctagatttctaca

SEQ ID NO: 2239576 - DNA, 16 bp, Homo sapiens
agcttgtcttttctgc

SEQ ID NO: 2239577 - DNA, 13 bp, Homo sapiens
agcttgtggccaa

SEQ ID NO: 2239578 - DNA, 22 bp, Homo sapiens
agcttgttgtctccacttgtat

SEQ ID NO: 2239579 - DNA, 21 bp, Homo sapiens
agctttaatgatatgcttgta

SEQ ID NO: 2239580 - DNA, 14 bp, Homo sapiens
agctttatttctag

SEQ ID NO: 2239581 - DNA, 23 bp, Homo sapiens
agctttcctgttgaatgacaaag

SEQ ID NO: 2239582 - DNA, 21 bp, Homo sapiens
agctttgtaggtgagatgcaa

SEQ ID NO: 2239583 - DNA, 19 bp, Homo sapiens
agctttgtcgtatttggca

SEQ ID NO: 2239584 - DNA, 16 bp, Homo sapiens
aggaaaacagctagta

SEQ ID NO: 2239585 - DNA, 22 bp, Homo sapiens
aggaaaaggcccctgcaatgtg

SEQ ID NO: 2239586 - DNA, 19 bp, Homo sapiens
aggaaaagtgcaatgcgtg

SEQ ID NO: 2239587 - DNA, 13 bp, Homo sapiens
aggaaagccctcc

SEQ ID NO: 2239588 - DNA, 23 bp, Homo sapiens
aggaaagccctcccccttcccct

SEQ ID NO: 2239589 - DNA, 19 bp, Homo sapiens
aggaaaggattttaccaaa

SEQ ID NO: 2239590 - DNA, 13 bp, Homo sapiens
aggaaatcaaatg

SEQ ID NO: 2239591 - DNA, 23 bp, Homo sapiens
aggaactagaaagaaggacccag

SEQ ID NO: 2239592 - DNA, 20 bp, Homo sapiens
aggaactgcaataatatcaa

SEQ ID NO: 2239593 - DNA, 15 bp, Homo sapiens
aggaaggaacaaaga

SEQ ID NO: 2239594 - DNA, 13 bp, Homo sapiens
aggacaacacttc

SEQ ID NO: 2239595 - DNA, 18 bp, Homo sapiens
aggacaacacttcatttt

SEQ ID NO: 2239596 - DNA, 19 bp, Homo sapiens
aggacgagacccccatcca

SEQ ID NO: 2239597 - DNA, 20 bp, Homo sapiens
aggacgagacccccatccag

SEQ ID NO: 2239598 - DNA, 19 bp, Homo sapiens
aggacgccactcatttcat

SEQ ID NO: 2239599 - DNA, 16 bp, Homo sapiens
aggactatattaatca

SEQ ID NO: 2239600 - DNA, 21 bp, Homo sapiens
aggactatattaatcaccttc

SEQ ID NO: 2239601 - DNA, 22 bp, Homo sapiens
aggactgattgaattacggaaa

SEQ ID NO: 2239602 - DNA, 17 bp, Homo sapiens
aggactgttctttgctg

SEQ ID NO: 2239603 - DNA, 20 bp, Homo sapiens
aggagagggcgctcctctct

SEQ ID NO: 2239604 - DNA, 19 bp, Homo sapiens
aggagctgccttggctcag

SEQ ID NO: 2239605 - DNA, 22 bp, Homo sapiens
aggagctgccttggctcagaca

SEQ ID NO: 2239606 - DNA, 14 bp, Homo sapiens
aggaggggaagggg

SEQ ID NO: 2239607 - DNA, 15 bp, Homo sapiens
aggaggggaaggggc

SEQ ID NO: 2239608 - DNA, 20 bp, Homo sapiens
aggaggggaaggggctgagg

SEQ ID NO: 2239609 - DNA, 20 bp, Homo sapiens
aggagtaaataattggaaaa

SEQ ID NO: 2239610 - DNA, 18 bp, Homo sapiens
aggagtgtgtgatttttt

SEQ ID NO: 2239611 - DNA, 18 bp, Homo sapiens
aggatactggcacagagg

SEQ ID NO: 2239612 - DNA, 12 bp, Homo sapiens
atacagaggaga

SEQ ID NO: 2239613 - DNA, 18 bp, Homo sapiens
atacagttataaaattaa

SEQ ID NO: 2239614 - DNA, 20 bp, Homo sapiens
atacagttgaaaacttgtaa

SEQ ID NO: 2239615 - DNA, 15 bp, Homo sapiens
atacatagtgaaaat

SEQ ID NO: 2239616 - DNA, 16 bp, Homo sapiens
atacatagtgaaaatt

SEQ ID NO: 2239617 - DNA, 14 bp, Homo sapiens
atacatatctttat

SEQ ID NO: 2239618 - DNA, 17 bp, Homo sapiens
atacatatctttattaa

SEQ ID NO: 2239619 - DNA, 23 bp, Homo sapiens
atacatgtcacatttagctgtgc

SEQ ID NO: 2239620 - DNA, 21 bp, Homo sapiens
ataccactctttacctttatt

SEQ ID NO: 2239621 - DNA, 16 bp, Homo sapiens
ataccacttacctcaa

SEQ ID NO: 2239622 - DNA, 18 bp, Homo sapiens
ataccttatatatgcact

SEQ ID NO: 2239623 - DNA, 13 bp, Homo sapiens
atacgatttaagg

SEQ ID NO: 2239624 - DNA, 17 bp, Homo sapiens
atacgatttaaggtatt

SEQ ID NO: 2239625 - DNA, 11 bp, Homo sapiens
atactacctct

SEQ ID NO: 2239626 - DNA, 19 bp, Homo sapiens
atactactttctctttttc

SEQ ID NO: 2239627 - DNA, 21 bp, Homo sapiens
atactatttaaagcctcctca

SEQ ID NO: 2239628 - DNA, 13 bp, Homo sapiens
atactatttaaga

SEQ ID NO: 2239629 - DNA, 18 bp, Homo sapiens
atactatttaagatgtga

SEQ ID NO: 2239630 - DNA, 20 bp, Homo sapiens
atactatttaagatgtgaaa

SEQ ID NO: 2239631 - DNA, 19 bp, Homo sapiens
atactatttatatacaagt

SEQ ID NO: 2239632 - DNA, 14 bp, Homo sapiens
atactgcaagaaaa

SEQ ID NO: 2239633 - DNA, 19 bp, Homo sapiens
atactgctactgtaatttt

SEQ ID NO: 2239634 - DNA, 14 bp, Homo sapiens
atactggcctggac

SEQ ID NO: 2239635 - DNA, 14 bp, Homo sapiens
atacttgttctgta

SEQ ID NO: 2239636 - DNA, 16 bp, Homo sapiens
atacttgttctgtatt

SEQ ID NO: 2239637 - DNA, 12 bp, Homo sapiens
atacttgtttca

SEQ ID NO: 2239638 - DNA, 16 bp, Homo sapiens
atactttgagttttga

SEQ ID NO: 2239639 - DNA, 14 bp, Homo sapiens
atactttgtaaata

SEQ ID NO: 2239640 - DNA, 11 bp, Homo sapiens
atacttttgca

SEQ ID NO: 2239641 - DNA, 12 bp, Homo sapiens
atagaaaggaac

SEQ ID NO: 2239642 - DNA, 12 bp, Homo sapiens
atagaaatggaa

SEQ ID NO: 2239643 - DNA, 20 bp, Homo sapiens
atagagatatttttgtacgt

SEQ ID NO: 2239644 - DNA, 20 bp, Homo sapiens
atagatataatgaacaaaat

SEQ ID NO: 2239645 - DNA, 23 bp, Homo sapiens
atagatataatgaacaaaattat

SEQ ID NO: 2239646 - DNA, 11 bp, Homo sapiens
atagcactttc

SEQ ID NO: 2239647 - DNA, 18 bp, Homo sapiens
atagcattaataaaactg

SEQ ID NO: 2239648 - DNA, 20 bp, Homo sapiens
atagcattaataaaactgtg

SEQ ID NO: 2239649 - DNA, 14 bp, Homo sapiens
ataggcagggggcc

SEQ ID NO: 2239650 - DNA, 22 bp, Homo sapiens
ataggcagggggccctgcccca

SEQ ID NO: 2239651 - DNA, 15 bp, Homo sapiens
ataggctttttaatc

SEQ ID NO: 2239652 - DNA, 21 bp, Homo sapiens
atagtaccatttatacaaatt

SEQ ID NO: 2239653 - DNA, 23 bp, Homo sapiens
atagtcttgaaatgaaagggaaa

SEQ ID NO: 2239654 - DNA, 16 bp, Homo sapiens
atagtctttggagaaa

SEQ ID NO: 2239655 - DNA, 15 bp, Homo sapiens
atagtgatcaagaag

SEQ ID NO: 2239656 - DNA, 20 bp, Homo sapiens
atagtgatcaagaagacttt

SEQ ID NO: 2239657 - DNA, 22 bp, Homo sapiens
atagtgttctgcaaaaatattt

SEQ ID NO: 2239658 - DNA, 12 bp, Homo sapiens
atagttactgtg

SEQ ID NO: 2239659 - DNA, 17 bp, Homo sapiens
atagttactgtgtaaac

SEQ ID NO: 2239660 - DNA, 20 bp, Homo sapiens
atagttactgtgtaaactca

SEQ ID NO: 2239661 - DNA, 15 bp, Homo sapiens
atagtttatttttgt

SEQ ID NO: 2239662 - DNA, 18 bp, Homo sapiens
atagtttggcatttgcac

SEQ ID NO: 2239663 - DNA, 17 bp, Homo sapiens
atataaagtattctttt

SEQ ID NO: 2239664 - DNA, 14 bp, Homo sapiens
atataattctggag

SEQ ID NO: 2239665 - DNA, 20 bp, Homo sapiens
atatagcattaataaaactg

SEQ ID NO: 2239666 - DNA, 16 bp, Homo sapiens
atgtaagcatactttg

SEQ ID NO: 2239667 - DNA, 14 bp, Homo sapiens
atgtagcagtgagt

SEQ ID NO: 2239668 - DNA, 14 bp, Homo sapiens
atgtatataaaaat

SEQ ID NO: 2239669 - DNA, 12 bp, Homo sapiens
atgtattttaca

SEQ ID NO: 2239670 - DNA, 14 bp, Homo sapiens
atgtattttacaca

SEQ ID NO: 2239671 - DNA, 14 bp, Homo sapiens
atgtatttttctat

SEQ ID NO: 2239672 - DNA, 12 bp, Homo sapiens
atgtcaaattga

SEQ ID NO: 2239673 - DNA, 20 bp, Homo sapiens
atgtcagggtacctggggcc

SEQ ID NO: 2239674 - DNA, 18 bp, Homo sapiens
atgtccaaagaggctgcc

SEQ ID NO: 2239675 - DNA, 14 bp, Homo sapiens
atgtccagccaccc

SEQ ID NO: 2239676 - DNA, 20 bp, Homo sapiens
atgtctcaaggcagttaatt

SEQ ID NO: 2239677 - DNA, 14 bp, Homo sapiens
atgtctctgcaaac

SEQ ID NO: 2239678 - DNA, 16 bp, Homo sapiens
atgtctgagtgaacct

SEQ ID NO: 2239679 - DNA, 22 bp, Homo sapiens
atgtctgagtgaacctgtataa

SEQ ID NO: 2239680 - DNA, 18 bp, Homo sapiens
atgtgaatttttattgtt

SEQ ID NO: 2239681 - DNA, 11 bp, Homo sapiens
atgtgattttt

SEQ ID NO: 2239682 - DNA, 21 bp, Homo sapiens
atgtgccttatgttgaaaaaa

SEQ ID NO: 2239683 - DNA, 14 bp, Homo sapiens
atgtgctttgagaa

SEQ ID NO: 2239684 - DNA, 19 bp, Homo sapiens
atgtggtgacacctccccc

SEQ ID NO: 2239685 - DNA, 14 bp, Homo sapiens
atgtgtataaattg

SEQ ID NO: 2239686 - DNA, 20 bp, Homo sapiens
atgtgtcattggaagccatc

SEQ ID NO: 2239687 - DNA, 13 bp, Homo sapiens
atgtgtcccctca

SEQ ID NO: 2239688 - DNA, 14 bp, Homo sapiens
atgttaaaataaat

SEQ ID NO: 2239689 - DNA, 18 bp, Homo sapiens
atgttaaaataaatggtt

SEQ ID NO: 2239690 - DNA, 15 bp, Homo sapiens
atgttgcaatgtgaa

SEQ ID NO: 2239691 - DNA, 19 bp, Homo sapiens
atgttgcaatgtgaaaaat

SEQ ID NO: 2239692 - DNA, 23 bp, Homo sapiens
atgttgggaggatacagaggaga

SEQ ID NO: 2239693 - DNA, 18 bp, Homo sapiens
atgttgtagtgtccccca

SEQ ID NO: 2239694 - DNA, 19 bp, Homo sapiens
atgttgttcaaatgcattt

SEQ ID NO: 2239695 - DNA, 20 bp, Homo sapiens
atgtttataaatcttatgct

SEQ ID NO: 2239696 - DNA, 21 bp, Homo sapiens
atgtttcgagtaaacttgaaa

SEQ ID NO: 2239697 - DNA, 17 bp, Homo sapiens
atgtttggcatgtaaat

SEQ ID NO: 2239698 - DNA, 12 bp, Homo sapiens
atgttttaaaga

SEQ ID NO: 2239699 - DNA, 22 bp, Homo sapiens
atgttttaaagaatatgacttt

SEQ ID NO: 2239700 - DNA, 14 bp, Homo sapiens
attaaaactcaaca

SEQ ID NO: 2239701 - DNA, 19 bp, Homo sapiens
attaaaactcaacattact

SEQ ID NO: 2239702 - DNA, 16 bp, Homo sapiens
attaaagttgtttccc

SEQ ID NO: 2239703 - DNA, 16 bp, Homo sapiens
attaaatacaaaactt

SEQ ID NO: 2239704 - DNA, 17 bp, Homo sapiens
attaaccttactaatta

SEQ ID NO: 2239705 - DNA, 11 bp, Homo sapiens
attaagaaata

SEQ ID NO: 2239706 - DNA, 21 bp, Homo sapiens
attaagacaatagcacttaaa

SEQ ID NO: 2239707 - DNA, 12 bp, Homo sapiens
attaataaaaag

SEQ ID NO: 2239708 - DNA, 21 bp, Homo sapiens
attcttctcttccttttatca

SEQ ID NO: 2239709 - DNA, 18 bp, Homo sapiens
attcttggcttaatcatt

SEQ ID NO: 2239710 - DNA, 21 bp, Homo sapiens
attctttccttctctgaaagt

SEQ ID NO: 2239711 - DNA, 18 bp, Homo sapiens
attcttttaaattagaaa

SEQ ID NO: 2239712 - DNA, 13 bp, Homo sapiens
attgaatcagtat

SEQ ID NO: 2239713 - DNA, 18 bp, Homo sapiens
attgaattaataataaag

SEQ ID NO: 2239714 - DNA, 22 bp, Homo sapiens
attgaggggattaatatgaaaa

SEQ ID NO: 2239715 - DNA, 20 bp, Homo sapiens
attgatgcatgctattcaca

SEQ ID NO: 2239716 - DNA, 21 bp, Homo sapiens
attgatttaagctttcctgtt

SEQ ID NO: 2239717 - DNA, 14 bp, Homo sapiens
attgcagtttatca

SEQ ID NO: 2239718 - DNA, 12 bp, Homo sapiens
attgctcagccc

SEQ ID NO: 2239719 - DNA, 13 bp, Homo sapiens
attgctcagcccg

SEQ ID NO: 2239720 - DNA, 14 bp, Homo sapiens
attgctcagcccgc

SEQ ID NO: 2239721 - DNA, 21 bp, Homo sapiens
attgctgagagaaatatggaa

SEQ ID NO: 2239722 - DNA, 22 bp, Homo sapiens
attgctgagagaaatatggaac

SEQ ID NO: 2239723 - DNA, 16 bp, Homo sapiens
attgctgagcctctgc

SEQ ID NO: 2239724 - DNA, 17 bp, Homo sapiens
attgggggaggaaaagt

SEQ ID NO: 2239725 - DNA, 21 bp, Homo sapiens
attgtaaaagcattttgtaat

SEQ ID NO: 2239726 - DNA, 23 bp, Homo sapiens
attgtaaaagcattttgtaataa

SEQ ID NO: 2239727 - DNA, 17 bp, Homo sapiens
attgtaaattgaatcag

SEQ ID NO: 2239728 - DNA, 19 bp, Homo sapiens
attgtagtggcctgtgctt

SEQ ID NO: 2239729 - DNA, 17 bp, Homo sapiens
attgtatattacaatga

SEQ ID NO: 2239730 - DNA, 18 bp, Homo sapiens
attgtatattacaatgat

SEQ ID NO: 2239731 - DNA, 20 bp, Homo sapiens
attgtctcctatatatttct

SEQ ID NO: 2239732 - DNA, 23 bp, Homo sapiens
attgtctcctatatatttctatt

SEQ ID NO: 2239733 - DNA, 16 bp, Homo sapiens
attgtgtatcagtttc

SEQ ID NO: 2239734 - DNA, 18 bp, Homo sapiens
attgtgtatcagtttcca

SEQ ID NO: 2239735 - DNA, 19 bp, Homo sapiens
attgtgtattatgttgttc

SEQ ID NO: 2239736 - DNA, 14 bp, Homo sapiens
attgttaatacaag

SEQ ID NO: 2239737 - DNA, 23 bp, Homo sapiens
attgttaatacaaggtataataa

SEQ ID NO: 2239738 - DNA, 21 bp, Homo sapiens
attgttccttggagaaatgaa

SEQ ID NO: 2239739 - DNA, 15 bp, Homo sapiens
attgttttacaatag

SEQ ID NO: 2239740 - DNA, 17 bp, Homo sapiens
attgttttacaatagtt

SEQ ID NO: 2239741 - DNA, 18 bp, Homo sapiens
attgttttacaatagttc

SEQ ID NO: 2239742 - DNA, 21 bp, Homo sapiens
cacaccctgtactgttctgtg

SEQ ID NO: 2239743 - DNA, 22 bp, Homo sapiens
cacacctactagtcaccagaga

SEQ ID NO: 2239744 - DNA, 17 bp, Homo sapiens
cacactactacctctta

SEQ ID NO: 2239745 - DNA, 10 bp, Homo sapiens
cacagagagg

SEQ ID NO: 2239746 - DNA, 19 bp, Homo sapiens
cacagagaggaggggacca

SEQ ID NO: 2239747 - DNA, 11 bp, Homo sapiens
cacagcagccc

SEQ ID NO: 2239748 - DNA, 15 bp, Homo sapiens
cacagcagcccccca

SEQ ID NO: 2239749 - DNA, 18 bp, Homo sapiens
cacagcagccccccagca

SEQ ID NO: 2239750 - DNA, 10 bp, Homo sapiens
cacagctcct

SEQ ID NO: 2239751 - DNA, 18 bp, Homo sapiens
cacagcttaacaatgcaa

SEQ ID NO: 2239752 - DNA, 22 bp, Homo sapiens
cacaggaagcctgcagtcctgg

SEQ ID NO: 2239753 - DNA, 12 bp, Homo sapiens
cacaggagggcc

SEQ ID NO: 2239754 - DNA, 14 bp, Homo sapiens
cacagtaaaaataa

SEQ ID NO: 2239755 - DNA, 16 bp, Homo sapiens
cacagtaaaaataaaa

SEQ ID NO: 2239756 - DNA, 18 bp, Homo sapiens
cacagttcttggtgactg

SEQ ID NO: 2239757 - DNA, 22 bp, Homo sapiens
cacagttcttggtgactgtccc

SEQ ID NO: 2239758 - DNA, 14 bp, Homo sapiens
cacatacctctctg

SEQ ID NO: 2239759 - DNA, 17 bp, Homo sapiens
cacatatttcagtgagg

SEQ ID NO: 2239760 - DNA, 18 bp, Homo sapiens
cacattaatcagattagc

SEQ ID NO: 2239761 - DNA, 18 bp, Homo sapiens
caccaactactacctgta

SEQ ID NO: 2239762 - DNA, 16 bp, Homo sapiens
caccacggcgtttttt

SEQ ID NO: 2239763 - DNA, 20 bp, Homo sapiens
caccacggcgtttttttaca

SEQ ID NO: 2239764 - DNA, 18 bp, Homo sapiens
caccactaccagccagcc

SEQ ID NO: 2239765 - DNA, 16 bp, Homo sapiens
cagagagaccctgcaa

SEQ ID NO: 2239766 - DNA, 16 bp, Homo sapiens
cagagagcacagtgat

SEQ ID NO: 2239767 - DNA, 13 bp, Homo sapiens
cagagaggagggg

SEQ ID NO: 2239768 - DNA, 18 bp, Homo sapiens
cagagcatttaaggaaac

SEQ ID NO: 2239769 - DNA, 15 bp, Homo sapiens
cagagcgcacaggga

SEQ ID NO: 2239770 - DNA, 15 bp, Homo sapiens
cagaggacacagaga

SEQ ID NO: 2239771 - DNA, 22 bp, Homo sapiens
cagaggagatgccacttctcac

SEQ ID NO: 2239772 - DNA, 17 bp, Homo sapiens
cagaggagcaaggttta

SEQ ID NO: 2239773 - DNA, 22 bp, Homo sapiens
cagaggtaactatcaatattta

SEQ ID NO: 2239774 - DNA, 13 bp, Homo sapiens
cagagtcctggag

SEQ ID NO: 2239775 - DNA, 13 bp, Homo sapiens
cagagtctgtctc

SEQ ID NO: 2239776 - DNA, 15 bp, Homo sapiens
cagagtctgtctctt

SEQ ID NO: 2239777 - DNA, 20 bp, Homo sapiens
cagatatactggaacccttt

SEQ ID NO: 2239778 - DNA, 21 bp, Homo sapiens
cagatatagcattaataaaac

SEQ ID NO: 2239779 - DNA, 16 bp, Homo sapiens
cagatcagtaaagaac

SEQ ID NO: 2239780 - DNA, 16 bp, Homo sapiens
cagatcgctcactgtt

SEQ ID NO: 2239781 - DNA, 19 bp, Homo sapiens
cagatgcaacctcactatg

SEQ ID NO: 2239782 - DNA, 20 bp, Homo sapiens
catgtagccccctggcctct

SEQ ID NO: 2239783 - DNA, 16 bp, Homo sapiens
catgtattttacacaa

SEQ ID NO: 2239784 - DNA, 13 bp, Homo sapiens
catgtccaaagag

SEQ ID NO: 2239785 - DNA, 15 bp, Homo sapiens
catgtccaaagaggc

SEQ ID NO: 2239786 - DNA, 17 bp, Homo sapiens
catgtccaaagaggctg

SEQ ID NO: 2239787 - DNA, 18 bp, Homo sapiens
catgtccaaagaggctgc

SEQ ID NO: 2239788 - DNA, 22 bp, Homo sapiens
catgtgctaataagtttgaaat

SEQ ID NO: 2239789 - DNA, 22 bp, Homo sapiens
catgtggtggcacaggccccct

SEQ ID NO: 2239790 - DNA, 14 bp, Homo sapiens
catgtgtcccctca

SEQ ID NO: 2239791 - DNA, 15 bp, Homo sapiens
catgtgtcccctcac

SEQ ID NO: 2239792 - DNA, 21 bp, Homo sapiens
catgttactggataaattgtt

SEQ ID NO: 2239793 - DNA, 12 bp, Homo sapiens
catgtttataaa

SEQ ID NO: 2239794 - DNA, 23 bp, Homo sapiens
catgtttataaatcttatgctct

SEQ ID NO: 2239795 - DNA, 14 bp, Homo sapiens
catgttttccgtga

SEQ ID NO: 2239796 - DNA, 19 bp, Homo sapiens
cattaaaggaaacgtggca

SEQ ID NO: 2239797 - DNA, 22 bp, Homo sapiens
cattaaaggaaacgtggcagga

SEQ ID NO: 2239798 - DNA, 16 bp, Homo sapiens
cattaataaaactgtg

SEQ ID NO: 2239799 - DNA, 17 bp, Homo sapiens
cattaataaaactgtgc

SEQ ID NO: 2239800 - DNA, 17 bp, Homo sapiens
cattaattatatgtata

SEQ ID NO: 2239801 - DNA, 16 bp, Homo sapiens
cattactgttaactgt

SEQ ID NO: 2239802 - DNA, 19 bp, Homo sapiens
cattagccagatttgtctt

SEQ ID NO: 2239803 - DNA, 12 bp, Homo sapiens
cattagttttaa

SEQ ID NO: 2239804 - DNA, 21 bp, Homo sapiens
cattatttttgttagcaaaga

SEQ ID NO: 2239805 - DNA, 19 bp, Homo sapiens
cattcaaactgcactttta

SEQ ID NO: 2239806 - DNA, 20 bp, Homo sapiens
cattcaaactgcacttttag

SEQ ID NO: 2239807 - DNA, 19 bp, Homo sapiens
cattcaagtgtaaaatatt

SEQ ID NO: 2239808 - DNA, 20 bp, Homo sapiens
cattcaagtgtaaaatattt

SEQ ID NO: 2239809 - DNA, 22 bp, Homo sapiens
cattcctaaagaaaaatatctt

SEQ ID NO: 2239810 - DNA, 16 bp, Homo sapiens
cattccttgaggacag

SEQ ID NO: 2239811 - DNA, 16 bp, Homo sapiens
cattcggtgtggtgca

SEQ ID NO: 2239812 - DNA, 17 bp, Homo sapiens
cattctaggctcactgc

SEQ ID NO: 2239813 - DNA, 15 bp, Homo sapiens
cattctgggctggga

SEQ ID NO: 2239814 - DNA, 19 bp, Homo sapiens
cattgagcttgcatgcttg

SEQ ID NO: 2239815 - DNA, 13 bp, Homo sapiens
cattgctcagccc

SEQ ID NO: 2239816 - DNA, 17 bp, Homo sapiens
cattgctcagcccgctt

SEQ ID NO: 2239817 - DNA, 21 bp, Homo sapiens
cattgctcagcccgcttggcc

SEQ ID NO: 2239818 - DNA, 15 bp, Homo sapiens
cattgctgagcctct

SEQ ID NO: 2239819 - DNA, 18 bp, Homo sapiens
cattgctgagcctctgct

SEQ ID NO: 2239820 - DNA, 13 bp, Homo sapiens
cattggaagccat

SEQ ID NO: 2239821 - DNA, 20 bp, Homo sapiens
cattgtaaaagcattttgta

SEQ ID NO: 2239822 - DNA, 21 bp, Homo sapiens
cattgtaaaagcattttgtaa

SEQ ID NO: 2239823 - DNA, 20 bp, Homo sapiens
cattgtatagatataatgaa

SEQ ID NO: 2239824 - DNA, 21 bp, Homo sapiens
cattgtctcctatatatttct

SEQ ID NO: 2239825 - DNA, 16 bp, Homo sapiens
cattgttcaattagaa

SEQ ID NO: 2239826 - DNA, 18 bp, Homo sapiens
cattgttcaattagaata

SEQ ID NO: 2239827 - DNA, 22 bp, Homo sapiens
cattgttgttttaacctcccct

SEQ ID NO: 2239828 - DNA, 20 bp, Homo sapiens
catttaaaacattaaaatat

SEQ ID NO: 2239829 - DNA, 17 bp, Homo sapiens
catttaacttttctacc

SEQ ID NO: 2239830 - DNA, 14 bp, Homo sapiens
catttaagggaaaa

SEQ ID NO: 2239831 - DNA, 16 bp, Homo sapiens
catttaagggaaaaat

SEQ ID NO: 2239832 - DNA, 19 bp, Homo sapiens
catttaagggaaaaatata

SEQ ID NO: 2239833 - DNA, 18 bp, Homo sapiens
catttagcaataaataac

SEQ ID NO: 2239834 - DNA, 12 bp, Homo sapiens
catttatacaaa

SEQ ID NO: 2239835 - DNA, 15 bp, Homo sapiens
catttatacaaatta

SEQ ID NO: 2239836 - DNA, 19 bp, Homo sapiens
catttatacaaattagaaa

SEQ ID NO: 2239837 - DNA, 20 bp, Homo sapiens
catttatacaaattagaaaa

SEQ ID NO: 2239838 - DNA, 18 bp, Homo sapiens
catttcaatgtgtataaa

SEQ ID NO: 2239839 - DNA, 16 bp, Homo sapiens
catttcacattattct

SEQ ID NO: 2239840 - DNA, 23 bp, Homo sapiens
catttcatacaacagaaaccaga

SEQ ID NO: 2239841 - DNA, 16 bp, Homo sapiens
catttcatctcattta

SEQ ID NO: 2239842 - DNA, 13 bp, Homo sapiens
catttctaattaa

SEQ ID NO: 2239843 - DNA, 23 bp, Homo sapiens
catttgagagaagccacgctgtc

SEQ ID NO: 2239844 - DNA, 17 bp, Homo sapiens
catttgatgcatgtctt

SEQ ID NO: 2239845 - DNA, 19 bp, Homo sapiens
catttgatgcatgtctttt

SEQ ID NO: 2239846 - DNA, 22 bp, Homo sapiens
catttggtgagagtcaaagctg

SEQ ID NO: 2239847 - DNA, 21 bp, Homo sapiens
catttgtgctagaaattttca

SEQ ID NO: 2239848 - DNA, 20 bp, Homo sapiens
catttgtttacatttgatgc

SEQ ID NO: 2239849 - DNA, 20 bp, Homo sapiens
cattttaaaagcaattatat

SEQ ID NO: 2239850 - DNA, 20 bp, Homo sapiens
cattttgaaattgttccttg

SEQ ID NO: 2239851 - DNA, 20 bp, Homo sapiens
cattttgggggtttttaatc

SEQ ID NO: 2239852 - DNA, 12 bp, Homo sapiens
cattttgtaata

SEQ ID NO: 2239853 - DNA, 16 bp, Homo sapiens
cattttgtaataataa

SEQ ID NO: 2239854 - DNA, 16 bp, Homo sapiens
catttttcatactgaa

SEQ ID NO: 2239855 - DNA, 16 bp, Homo sapiens
catttttttctaccta

SEQ ID NO: 2239856 - DNA, 22 bp, Homo sapiens
ccaaacaccttccagctcctgt

SEQ ID NO: 2239857 - DNA, 11 bp, Homo sapiens
ccaaacatggt

SEQ ID NO: 2239858 - DNA, 16 bp, Homo sapiens
ccaaagaggctgcccc

SEQ ID NO: 2239859 - DNA, 23 bp, Homo sapiens
ccaaagaggctgcccctctcacc

SEQ ID NO: 2239860 - DNA, 20 bp, Homo sapiens
ccaaatattaggcttaaaaa

SEQ ID NO: 2239861 - DNA, 18 bp, Homo sapiens
ccaacctttccctcaccc

SEQ ID NO: 2239862 - DNA, 23 bp, Homo sapiens
ccaacctttccctcaccccctcc

SEQ ID NO: 2239863 - DNA, 23 bp, Homo sapiens
ccaacgttcgatttctacctcag

SEQ ID NO: 2239864 - DNA, 13 bp, Homo sapiens
ccaagagaactcg

SEQ ID NO: 2239865 - DNA, 16 bp, Homo sapiens
ccaaggaatcagcagg

SEQ ID NO: 2239866 - DNA, 17 bp, Homo sapiens
ccaaggaatcagcagga

SEQ ID NO: 2239867 - DNA, 13 bp, Homo sapiens
ccaagggcagagg

SEQ ID NO: 2239868 - DNA, 22 bp, Homo sapiens
ccaaggggatttttatgtctgg

SEQ ID NO: 2239869 - DNA, 20 bp, Homo sapiens
ccaagttgtgcttgagccag

SEQ ID NO: 2239870 - DNA, 15 bp, Homo sapiens
ccaataaagtgatct

SEQ ID NO: 2239871 - DNA, 16 bp, Homo sapiens
ccaataggcaaattaa

SEQ ID NO: 2239872 - DNA, 18 bp, Homo sapiens
ccaataggcaaattaatc

SEQ ID NO: 2239873 - DNA, 17 bp, Homo sapiens
ccaatgacacccatgcc

SEQ ID NO: 2239874 - DNA, 23 bp, Homo sapiens
ccaattttttaagtgaaaatata

SEQ ID NO: 2239875 - DNA, 20 bp, Homo sapiens
ccacacccaatgctgctcca

SEQ ID NO: 2239876 - DNA, 19 bp, Homo sapiens
ccacaggaagcctgcagtc

SEQ ID NO: 2239877 - DNA, 15 bp, Homo sapiens
ccacaggcagcccag

SEQ ID NO: 2239878 - DNA, 12 bp, Homo sapiens
ccacatccccaa

SEQ ID NO: 2239879 - DNA, 13 bp, Homo sapiens
ccacatccccaat

SEQ ID NO: 2239880 - DNA, 22 bp, Homo sapiens
ccacatgttactggataaattg

SEQ ID NO: 2239881 - DNA, 15 bp, Homo sapiens
ccaccacctttggct

SEQ ID NO: 2239882 - DNA, 17 bp, Homo sapiens
ccaccccaagagaactc

SEQ ID NO: 2239883 - DNA, 13 bp, Homo sapiens
ccaccccaggacg

SEQ ID NO: 2239884 - DNA, 18 bp, Homo sapiens
ccaccccatccagccaga

SEQ ID NO: 2239885 - DNA, 13 bp, Homo sapiens
ccacccccagctc

SEQ ID NO: 2239886 - DNA, 16 bp, Homo sapiens
ccaccccgcctgccct

SEQ ID NO: 2239887 - DNA, 14 bp, Homo sapiens
ccaccgggagcctc

SEQ ID NO: 2239888 - DNA, 22 bp, Homo sapiens
ccaccgggagcctccccctcag

SEQ ID NO: 2239889 - DNA, 19 bp, Homo sapiens
ccacctcacctagcctgat

SEQ ID NO: 2239890 - DNA, 18 bp, Homo sapiens
ccacgcagctggcagaga

SEQ ID NO: 2239891 - DNA, 18 bp, Homo sapiens
ccacgcctcctggccaga

SEQ ID NO: 2239892 - DNA, 13 bp, Homo sapiens
ccacgctgtcctc

SEQ ID NO: 2239893 - DNA, 14 bp, Homo sapiens
ccacgctgtcctct

SEQ ID NO: 2239894 - DNA, 21 bp, Homo sapiens
ccactaagaattcaaactggg

SEQ ID NO: 2239895 - DNA, 20 bp, Homo sapiens
ccactaccagccagcctcag

SEQ ID NO: 2239896 - DNA, 13 bp, Homo sapiens
ccactccccagcc

SEQ ID NO: 2239897 - DNA, 22 bp, Homo sapiens
ccactccccagccccagcccct

SEQ ID NO: 2239898 - DNA, 18 bp, Homo sapiens
ccactcccttgctggccc

SEQ ID NO: 2239899 - DNA, 16 bp, Homo sapiens
ccactggctgctaaca

SEQ ID NO: 2239900 - DNA, 17 bp, Homo sapiens
ccactgggtgagagagg

SEQ ID NO: 2239901 - DNA, 13 bp, Homo sapiens
ccacttacctcaa

SEQ ID NO: 2239902 - DNA, 21 bp, Homo sapiens
ccacttgtatatatggatcag

SEQ ID NO: 2239903 - DNA, 21 bp, Homo sapiens
ccactttcatctggggtgggg

SEQ ID NO: 2239904 - DNA, 21 bp, Homo sapiens
ccagaaaacctctcctgaccc

SEQ ID NO: 2239905 - DNA, 19 bp, Homo sapiens
ccagaataagttattgcag

SEQ ID NO: 2239906 - DNA, 14 bp, Homo sapiens
ccagacacagccca

SEQ ID NO: 2239907 - DNA, 15 bp, Homo sapiens
ccagaccccacgctg

SEQ ID NO: 2239908 - DNA, 15 bp, Homo sapiens
ccagacttccttgag

SEQ ID NO: 2239909 - DNA, 18 bp, Homo sapiens
ccagagaacattggaaga

SEQ ID NO: 2239910 - DNA, 16 bp, Homo sapiens
ccagagcgaggaaagg

SEQ ID NO: 2239911 - DNA, 19 bp, Homo sapiens
ccagaggtctagattaata

SEQ ID NO: 2239912 - DNA, 15 bp, Homo sapiens
ccagattaaacttca

SEQ ID NO: 2239913 - DNA, 15 bp, Homo sapiens
ccagatttgtctttt

SEQ ID NO: 2239914 - DNA, 16 bp, Homo sapiens
ccagcaccctctcctg

SEQ ID NO: 2239915 - DNA, 18 bp, Homo sapiens
ccagcaccctctcctggg

SEQ ID NO: 2239916 - DNA, 23 bp, Homo sapiens
ccagcaccctctcctgggggtgg

SEQ ID NO: 2239917 - DNA, 22 bp, Homo sapiens
ccagcactaaggccgtgtctct

SEQ ID NO: 2239918 - DNA, 15 bp, Homo sapiens
ccagcagttttcaag

SEQ ID NO: 2239919 - DNA, 17 bp, Homo sapiens
ccagccacccccaggca

SEQ ID NO: 2239920 - DNA, 12 bp, Homo sapiens
ccagccagcgcc

SEQ ID NO: 2239921 - DNA, 13 bp, Homo sapiens
ccagccagcgcct

SEQ ID NO: 2239922 - DNA, 20 bp, Homo sapiens
ccagccagcgcctccctcca

SEQ ID NO: 2239923 - DNA, 22 bp, Homo sapiens
ccagccagcgcctccctccacc

SEQ ID NO: 2239924 - DNA, 16 bp, Homo sapiens
ccagccccgactccag

SEQ ID NO: 2239925 - DNA, 17 bp, Homo sapiens
ccagccccgactccagc

SEQ ID NO: 2239926 - DNA, 12 bp, Homo sapiens
ccagccctgctg

SEQ ID NO: 2239927 - DNA, 20 bp, Homo sapiens
ccagccctgctggggatccc

SEQ ID NO: 2239928 - DNA, 20 bp, Homo sapiens
ccagcctcagaaggccccag

SEQ ID NO: 2239929 - DNA, 15 bp, Homo sapiens
ccagcctccagggca

SEQ ID NO: 2239930 - DNA, 15 bp, Homo sapiens
ccagcctctggcatt

SEQ ID NO: 2239931 - DNA, 21 bp, Homo sapiens
ccagcctggggctgaggctga

SEQ ID NO: 2239932 - DNA, 15 bp, Homo sapiens
ccagcgcctccctcc

SEQ ID NO: 2239933 - DNA, 18 bp, Homo sapiens
ccagcgcctccctccacc

SEQ ID NO: 2239934 - DNA, 20 bp, Homo sapiens
ccagcgcctccctccacccc

SEQ ID NO: 2239935 - DNA, 16 bp, Homo sapiens
ccagctaccctttttc

SEQ ID NO: 2239936 - DNA, 21 bp, Homo sapiens
ccagctaccctttttctccag

SEQ ID NO: 2239937 - DNA, 21 bp, Homo sapiens
ccagctatctgtcatctctct

SEQ ID NO: 2239938 - DNA, 19 bp, Homo sapiens
ccagctcataaaatggaag

SEQ ID NO: 2239939 - DNA, 18 bp, Homo sapiens
ccagctgggctctgcaat

SEQ ID NO: 2239940 - DNA, 19 bp, Homo sapiens
ccaggaccaagggcagagg

SEQ ID NO: 2239941 - DNA, 14 bp, Homo sapiens
ccaggacgccactc

SEQ ID NO: 2239942 - DNA, 16 bp, Homo sapiens
ccaggaggtagtttct

SEQ ID NO: 2239943 - DNA, 20 bp, Homo sapiens
ccaggatactggcacagagg

SEQ ID NO: 2239944 - DNA, 21 bp, Homo sapiens
ccaggcatccatcttggaaga

SEQ ID NO: 2239945 - DNA, 22 bp, Homo sapiens
ccaggcatctgttagcagagtc

SEQ ID NO: 2239946 - DNA, 23 bp, Homo sapiens
ccaggcatctgttagcagagtct

SEQ ID NO: 2239947 - DNA, 24 bp, Homo sapiens
ccaggcatctgttagcagagtctg

SEQ ID NO: 2239948 - DNA, 14 bp, Homo sapiens
ccaggccctccctg

SEQ ID NO: 2239949 - DNA, 22 bp, Homo sapiens
ccaggctatgtataaaatacat

SEQ ID NO: 2239950 - DNA, 22 bp, Homo sapiens
ccagggaccactgggtgagaga

SEQ ID NO: 2239951 - DNA, 14 bp, Homo sapiens
ccagggagcctttg

SEQ ID NO: 2239952 - DNA, 18 bp, Homo sapiens
ccagggagcctttggttc

SEQ ID NO: 2239953 - DNA, 22 bp, Homo sapiens
ccagggagcctttggttctggc

SEQ ID NO: 2239954 - DNA, 15 bp, Homo sapiens
ccagggcattgctca

SEQ ID NO: 2239955 - DNA, 16 bp, Homo sapiens
ccagggcattgctcag

SEQ ID NO: 2239956 - DNA, 18 bp, Homo sapiens
ccagggcattgctcagcc

SEQ ID NO: 2239957 - DNA, 20 bp, Homo sapiens
ccagggcattgctcagcccg

SEQ ID NO: 2239958 - DNA, 21 bp, Homo sapiens
ccagggcattgctcagcccgc

SEQ ID NO: 2239959 - DNA, 23 bp, Homo sapiens
ccagggcattgctcagcccgctt

SEQ ID NO: 2239960 - DNA, 22 bp, Homo sapiens
ccaggtatccaaaaatgtgtaa

SEQ ID NO: 2239961 - DNA, 15 bp, Homo sapiens
ccaggttccacagag

SEQ ID NO: 2239962 - DNA, 22 bp, Homo sapiens
ccaggtttagtgaaaaactgct

SEQ ID NO: 2239963 - DNA, 20 bp, Homo sapiens
ccagtaggactcaaggtgga

SEQ ID NO: 2239964 - DNA, 17 bp, Homo sapiens
ccagtatacctcatttt

SEQ ID NO: 2239965 - DNA, 14 bp, Homo sapiens
ccagtgacaacatc

SEQ ID NO: 2239966 - DNA, 16 bp, Homo sapiens
ccagtgtccttagaac

SEQ ID NO: 2239967 - DNA, 15 bp, Homo sapiens
ccatacttgttctgt

SEQ ID NO: 2239968 - DNA, 15 bp, Homo sapiens
ccatagtaccattta

SEQ ID NO: 2239969 - DNA, 19 bp, Homo sapiens
ccatagtaccatttataca

SEQ ID NO: 2239970 - DNA, 18 bp, Homo sapiens
ccatagtttggcatttgc

SEQ ID NO: 2239971 - DNA, 12 bp, Homo sapiens
ccatccagccag

SEQ ID NO: 2239972 - DNA, 12 bp, Homo sapiens
ccatccagcctc

SEQ ID NO: 2239973 - DNA, 13 bp, Homo sapiens
ccatccagcctcc

SEQ ID NO: 2239974 - DNA, 16 bp, Homo sapiens
ccatccagcctccagg

SEQ ID NO: 2239975 - DNA, 16 bp, Homo sapiens
ccatccctccccagtt

SEQ ID NO: 2239976 - DNA, 12 bp, Homo sapiens
ccatccctgggc

SEQ ID NO: 2239977 - DNA, 14 bp, Homo sapiens
ccatccctgggccc

SEQ ID NO: 2239978 - DNA, 16 bp, Homo sapiens
ccatccctgggcccct

SEQ ID NO: 2239979 - DNA, 18 bp, Homo sapiens
ccatccctgggcccctcc

SEQ ID NO: 2239980 - DNA, 16 bp, Homo sapiens
ccatcttgagccacag

SEQ ID NO: 2239981 - DNA, 19 bp, Homo sapiens
ccatgcttacgtgatcctc

SEQ ID NO: 2239982 - DNA, 22 bp, Homo sapiens
ccatggagccagctccctctat

SEQ ID NO: 2239983 - DNA, 19 bp, Homo sapiens
ccatggtactgtagcaggg

SEQ ID NO: 2239984 - DNA, 16 bp, Homo sapiens
ccatgtgtcccctcac

SEQ ID NO: 2239985 - DNA, 17 bp, Homo sapiens
ccatgtgtcctggttcc

SEQ ID NO: 2239986 - DNA, 19 bp, Homo sapiens
ccatgttggccaggctggt

SEQ ID NO: 2239987 - DNA, 16 bp, Homo sapiens
cccaaacaccttccag

SEQ ID NO: 2239988 - DNA, 18 bp, Homo sapiens
gagtaaataattggaaaa

SEQ ID NO: 2239989 - DNA, 14 bp, Homo sapiens
gagtcaaagctgac

SEQ ID NO: 2239990 - DNA, 18 bp, Homo sapiens
gagtcccctcacctcctc

SEQ ID NO: 2239991 - DNA, 19 bp, Homo sapiens
gagtcccctcacctcctct

SEQ ID NO: 2239992 - DNA, 20 bp, Homo sapiens
gagtcttactctgccgccca

SEQ ID NO: 2239993 - DNA, 14 bp, Homo sapiens
gagtgagacagact

SEQ ID NO: 2239994 - DNA, 17 bp, Homo sapiens
gagtgatttccatctct

SEQ ID NO: 2239995 - DNA, 22 bp, Homo sapiens
gagtgtgtttgtgtgcatgaaa

SEQ ID NO: 2239996 - DNA, 21 bp, Homo sapiens
gagttctgtgtattttcagtc

SEQ ID NO: 2239997 - DNA, 18 bp, Homo sapiens
gataatacagatttgtaa

SEQ ID NO: 2239998 - DNA, 16 bp, Homo sapiens
gataatatattgtgtt

SEQ ID NO: 2239999 - DNA, 15 bp, Homo sapiens
gatactactttctct

SEQ ID NO: 2240000 - DNA, 19 bp, Homo sapiens
gatagctaactgtaaatca

SEQ ID NO: 2240001 - DNA, 20 bp, Homo sapiens
gatagctaactgtaaatcat

SEQ ID NO: 2240002 - DNA, 14 bp, Homo sapiens
gatataaattttta

SEQ ID NO: 2240003 - DNA, 21 bp, Homo sapiens
gatataaatttttaagagaaa

SEQ ID NO: 2240004 - DNA, 18 bp, Homo sapiens
gatataatgaacaaaatt

SEQ ID NO: 2240005 - DNA, 15 bp, Homo sapiens
gatatatttaaaaat

SEQ ID NO: 2240006 - DNA, 19 bp, Homo sapiens
gatatatttaaaaatattt

SEQ ID NO: 2240007 - DNA, 23 bp, Homo sapiens
gatatctataaaatagatataaa

SEQ ID NO: 2240008 - DNA, 12 bp, Homo sapiens
gatatgcttgta

SEQ ID NO: 2240009 - DNA, 22 bp, Homo sapiens
gatatttttgtacgttatatat

SEQ ID NO: 2240010 - DNA, 17 bp, Homo sapiens
gatcaacaatacctttt

SEQ ID NO: 2240011 - DNA, 18 bp, Homo sapiens
gatcaaccagctaagaaa

SEQ ID NO: 2240012 - DNA, 19 bp, Homo sapiens
gatccatcttgagccacag

SEQ ID NO: 2240013 - DNA, 15 bp, Homo sapiens
gatcccaccccctcc

SEQ ID NO: 2240014 - DNA, 21 bp, Homo sapiens
gatcccaccccctcctccccc

SEQ ID NO: 2240015 - DNA, 15 bp, Homo sapiens
gatccccgcctggcc

SEQ ID NO: 2240016 - DNA, 16 bp, Homo sapiens
gatccccgcctggcca

SEQ ID NO: 2240017 - DNA, 17 bp, Homo sapiens
gatccccgcctggccag

SEQ ID NO: 2240018 - DNA, 14 bp, Homo sapiens
gatcctccacagag

SEQ ID NO: 2240019 - DNA, 17 bp, Homo sapiens
gatcctccacagagagg

SEQ ID NO: 2240020 - DNA, 13 bp, Homo sapiens
gatctgagggaga

SEQ ID NO: 2240021 - DNA, 15 bp, Homo sapiens
gatcttcccacagga

SEQ ID NO: 2240022 - DNA, 16 bp, Homo sapiens
gatcttttgaagggag

SEQ ID NO: 2240023 - DNA, 15 bp, Homo sapiens
gatgaatgcagatta

SEQ ID NO: 2240024 - DNA, 14 bp, Homo sapiens
gatgaatttgtcca

SEQ ID NO: 2240025 - DNA, 16 bp, Homo sapiens
gatgagatttttaaaa

SEQ ID NO: 2240026 - DNA, 14 bp, Homo sapiens
gatgatgatgaaaa

SEQ ID NO: 2240027 - DNA, 17 bp, Homo sapiens
gatgcaggctcccctga

SEQ ID NO: 2240028 - DNA, 22 bp, Homo sapiens
gatgcatgtcttttaaaatgca

SEQ ID NO: 2240029 - DNA, 20 bp, Homo sapiens
gatgctgggctctgttcttg

SEQ ID NO: 2240030 - DNA, 16 bp, Homo sapiens
gatgggggatgggcca

SEQ ID NO: 2240031 - DNA, 17 bp, Homo sapiens
gatgggggatgggccag

SEQ ID NO: 2240032 - DNA, 12 bp, Homo sapiens
gatgtaaagatg

SEQ ID NO: 2240033 - DNA, 13 bp, Homo sapiens
gatgtaattttgt

SEQ ID NO: 2240034 - DNA, 18 bp, Homo sapiens
gatgtgccctagatcaac

SEQ ID NO: 2240035 - DNA, 17 bp, Homo sapiens
gatgttaaaataaatgg

SEQ ID NO: 2240036 - DNA, 18 bp, Homo sapiens
gattaatatgaaaactta

SEQ ID NO: 2240037 - DNA, 20 bp, Homo sapiens
gattacctcctgtgtggaag

SEQ ID NO: 2240038 - DNA, 20 bp, Homo sapiens
gattaggtttcagcagagct

SEQ ID NO: 2240039 - DNA, 17 bp, Homo sapiens
gattatggaaaaataaa

SEQ ID NO: 2240040 - DNA, 12 bp, Homo sapiens
gattcagcaaaa

SEQ ID NO: 2240041 - DNA, 20 bp, Homo sapiens
gattcagtggaggctggcag

SEQ ID NO: 2240042 - DNA, 18 bp, Homo sapiens
gattctatttaattgaaa

SEQ ID NO: 2240043 - DNA, 21 bp, Homo sapiens
gattctgaccttaaatgcaac

SEQ ID NO: 2240044 - DNA, 19 bp, Homo sapiens
gattcttttaaattagaaa

SEQ ID NO: 2240045 - DNA, 16 bp, Homo sapiens
gattgaattacggaaa

SEQ ID NO: 2240046 - DNA, 13 bp, Homo sapiens
gattgctgggagg

SEQ ID NO: 2240047 - DNA, 15 bp, Homo sapiens
gatttatgtcagcac

SEQ ID NO: 2240048 - DNA, 17 bp, Homo sapiens
gatttctacattaactt

SEQ ID NO: 2240049 - DNA, 15 bp, Homo sapiens
gatttctacctcagc

SEQ ID NO: 2240050 - DNA, 22 bp, Homo sapiens
gatttctttctttgcaccaaag

SEQ ID NO: 2240051 - DNA, 23 bp, Homo sapiens
gatttctttctttgcaccaaaga

SEQ ID NO: 2240052 - DNA, 14 bp, Homo sapiens
gatttgtaacatta

SEQ ID NO: 2240053 - DNA, 17 bp, Homo sapiens
gattttaatcaagttga

SEQ ID NO: 2240054 - DNA, 18 bp, Homo sapiens
gattttaatcaagttgaa

SEQ ID NO: 2240055 - DNA, 15 bp, Homo sapiens
gattttaccaaagca

SEQ ID NO: 2240056 - DNA, 16 bp, Homo sapiens
gattttaccaaagcat

SEQ ID NO: 2240057 - DNA, 18 bp, Homo sapiens
gattttgctgtatatttg

SEQ ID NO: 2240058 - DNA, 17 bp, Homo sapiens
gatttttaaaaaatatt

SEQ ID NO: 2240059 - DNA, 16 bp, Homo sapiens
gatttttaacttttta

SEQ ID NO: 2240060 - DNA, 15 bp, Homo sapiens
gatttttatgtctgg

SEQ ID NO: 2240061 - DNA, 22 bp, Homo sapiens
gcaaaaatgtccagccaccccc

SEQ ID NO: 2240062 - DNA, 16 bp, Homo sapiens
gcaaagacctacctcc

SEQ ID NO: 2240063 - DNA, 21 bp, Homo sapiens
gcaaagcacccatttcaatgt

SEQ ID NO: 2240064 - DNA, 20 bp, Homo sapiens
gcaaataatgatcgaaaaaa

SEQ ID NO: 2240065 - DNA, 12 bp, Homo sapiens
gcaacaacagaa

SEQ ID NO: 2240066 - DNA, 22 bp, Homo sapiens
gcaacaagaccaccacttcgaa

SEQ ID NO: 2240067 - DNA, 14 bp, Homo sapiens
gcaaccatttgaaa

SEQ ID NO: 2240068 - DNA, 15 bp, Homo sapiens
gcaacctcactatgg

SEQ ID NO: 2240069 - DNA, 17 bp, Homo sapiens
gcaacgtagcctgggct

SEQ ID NO: 2240070 - DNA, 18 bp, Homo sapiens
gcaagaccacggagggag

SEQ ID NO: 2240071 - DNA, 23 bp, Homo sapiens
gcaagaccacggagggagcgaca

SEQ ID NO: 2240072 - DNA, 15 bp, Homo sapiens
gcaagaccagttgaa

SEQ ID NO: 2240073 - DNA, 20 bp, Homo sapiens
gcaagtcagattgctgggag

SEQ ID NO: 2240074 - DNA, 19 bp, Homo sapiens
gcaataatatcaaaacaag

SEQ ID NO: 2240075 - DNA, 16 bp, Homo sapiens
gcaatagttttttact

SEQ ID NO: 2240076 - DNA, 23 bp, Homo sapiens
gcaatcaaaaatatgtgttttta

SEQ ID NO: 2240077 - DNA, 22 bp, Homo sapiens
gcaatctccttactgtgtttca

SEQ ID NO: 2240078 - DNA, 14 bp, Homo sapiens
cttatgttgaaaaa

SEQ ID NO: 2240079 - DNA, 17 bp, Homo sapiens
cttatgttgaaaaaatt

SEQ ID NO: 2240080 - DNA, 17 bp, Homo sapiens
cttattagggagaaaat

SEQ ID NO: 2240081 - DNA, 18 bp, Homo sapiens
cttattgtttctctgaaa

SEQ ID NO: 2240082 - DNA, 16 bp, Homo sapiens
cttcaaatatagagat

SEQ ID NO: 2240083 - DNA, 24 bp, Homo sapiens
cttcaaatgggagactctttgaaa

SEQ ID NO: 2240084 - DNA, 17 bp, Homo sapiens
cttcaagtaatacgttt

SEQ ID NO: 2240085 - DNA, 15 bp, Homo sapiens
cttcacagtcccagg

SEQ ID NO: 2240086 - DNA, 20 bp, Homo sapiens
cttcagcaagttagaactag

SEQ ID NO: 2240087 - DNA, 15 bp, Homo sapiens
cttcatgccagctac

SEQ ID NO: 2240088 - DNA, 16 bp, Homo sapiens
cttcatgccagctact

SEQ ID NO: 2240089 - DNA, 13 bp, Homo sapiens
cttcatgctggcc

SEQ ID NO: 2240090 - DNA, 20 bp, Homo sapiens
cttcattttcaggaaatcta

SEQ ID NO: 2240091 - DNA, 13 bp, Homo sapiens
cttccagctcctg

SEQ ID NO: 2240092 - DNA, 14 bp, Homo sapiens
cttccagctcctgt

SEQ ID NO: 2240093 - DNA, 21 bp, Homo sapiens
cttccatctgtgccatacttg

SEQ ID NO: 2240094 - DNA, 22 bp, Homo sapiens
cttccatggtactgtagcaggg

SEQ ID NO: 2240095 - DNA, 14 bp, Homo sapiens
cttccccttctgtg

SEQ ID NO: 2240096 - DNA, 17 bp, Homo sapiens
cttcctcctccccactt

SEQ ID NO: 2240097 - DNA, 15 bp, Homo sapiens
cttcgaaacctggga

SEQ ID NO: 2240098 - DNA, 21 bp, Homo sapiens
cttctattctagcctgcattg

SEQ ID NO: 2240099 - DNA, 14 bp, Homo sapiens
cttctattggtctc

SEQ ID NO: 2240100 - DNA, 15 bp, Homo sapiens
cttctcaagatactg

SEQ ID NO: 2240101 - DNA, 15 bp, Homo sapiens
cttctcactcaccac

SEQ ID NO: 2240102 - DNA, 23 bp, Homo sapiens
cttctctgctagatttctacatt

SEQ ID NO: 2240103 - DNA, 14 bp, Homo sapiens
cttctctgtgagaa

SEQ ID NO: 2240104 - DNA, 14 bp, Homo sapiens
cttctgcagcagga

SEQ ID NO: 2240105 - DNA, 22 bp, Homo sapiens
cttctgcagcaggaactctgga

SEQ ID NO: 2240106 - DNA, 21 bp, Homo sapiens
cttctgccttagtctcagttt

SEQ ID NO: 2240107 - DNA, 13 bp, Homo sapiens
cttctggccttgt

SEQ ID NO: 2240108 - DNA, 12 bp, Homo sapiens
cttctggctcaa

SEQ ID NO: 2240109 - DNA, 14 bp, Homo sapiens
cttctggggcaggc

SEQ ID NO: 2240110 - DNA, 19 bp, Homo sapiens
cttctggggcaggctgggc

SEQ ID NO: 2240111 - DNA, 18 bp, Homo sapiens
cttctgtactaaagtatt

SEQ ID NO: 2240112 - DNA, 13 bp, Homo sapiens
cttctgtgtcaca

SEQ ID NO: 2240113 - DNA, 23 bp, Homo sapiens
cttctttgtaatcccttcacagt

SEQ ID NO: 2240114 - DNA, 13 bp, Homo sapiens
cttcttttgatta

SEQ ID NO: 2240115 - DNA, 16 bp, Homo sapiens
cttgaaatgaaaggga

SEQ ID NO: 2240116 - DNA, 19 bp, Homo sapiens
cttttagaaatactgcaag

SEQ ID NO: 2240117 - DNA, 21 bp, Homo sapiens
cttttcacatgctaatgtgca

SEQ ID NO: 2240118 - DNA, 15 bp, Homo sapiens
cttttcattgtgtat

SEQ ID NO: 2240119 - DNA, 19 bp, Homo sapiens
cttttccactccattgtcg

SEQ ID NO: 2240120 - DNA, 22 bp, Homo sapiens
cttttccctctttggctcccct

SEQ ID NO: 2240121 - DNA, 16 bp, Homo sapiens
cttttcctctctcccg

SEQ ID NO: 2240122 - DNA, 15 bp, Homo sapiens
cttttctaaactgca

SEQ ID NO: 2240123 - DNA, 21 bp, Homo sapiens
cttttgaagggagaagacact

SEQ ID NO: 2240124 - DNA, 12 bp, Homo sapiens
cttttgcaaaat

SEQ ID NO: 2240125 - DNA, 22 bp, Homo sapiens
cttttgcaaaataagtaaataa

SEQ ID NO: 2240126 - DNA, 21 bp, Homo sapiens
cttttggttatgaatactttg

SEQ ID NO: 2240127 - DNA, 13 bp, Homo sapiens
ctttttataaaaa

SEQ ID NO: 2240128 - DNA, 19 bp, Homo sapiens
ctttttataaaaagataat

SEQ ID NO: 2240129 - DNA, 19 bp, Homo sapiens
ctttttcgtataatcttgt

SEQ ID NO: 2240130 - DNA, 21 bp, Homo sapiens
ctttttctccagctgggctct

SEQ ID NO: 2240131 - DNA, 14 bp, Homo sapiens
cttttttaaattaa

SEQ ID NO: 2240132 - DNA, 18 bp, Homo sapiens
cttttttccttaatccag

SEQ ID NO: 2240133 - DNA, 20 bp, Homo sapiens
cttttttgagacatgggatc

SEQ ID NO: 2240134 - DNA, 18 bp, Homo sapiens
gaaaaaaaaattcacatg

SEQ ID NO: 2240135 - DNA, 14 bp, Homo sapiens
gaaaaaaatactat

SEQ ID NO: 2240136 - DNA, 15 bp, Homo sapiens
gaaaaaaatactatt

SEQ ID NO: 2240137 - DNA, 20 bp, Homo sapiens
gaaaaaaatactatttaaga

SEQ ID NO: 2240138 - DNA, 16 bp, Homo sapiens
gaaaaaataattattt

SEQ ID NO: 2240139 - DNA, 9 bp, Homo sapiens
gaaaaagaa

SEQ ID NO: 2240140 - DNA, 17 bp, Homo sapiens
gaaaaataaacactaca

SEQ ID NO: 2240141 - DNA, 16 bp, Homo sapiens
gaaaaatatcttggcc

SEQ ID NO: 2240142 - DNA, 13 bp, Homo sapiens
gaaaacggagctg

SEQ ID NO: 2240143 - DNA, 23 bp, Homo sapiens
gaaaacttatgacctcttccttt

SEQ ID NO: 2240144 - DNA, 12 bp, Homo sapiens
gaaaagaaaaag

SEQ ID NO: 2240145 - DNA, 19 bp, Homo sapiens
gaaaagatgaatttgtcca

SEQ ID NO: 2240146 - DNA, 16 bp, Homo sapiens
gaaaagcaacattcat

SEQ ID NO: 2240147 - DNA, 20 bp, Homo sapiens
gacattttaaaaaatggtca

SEQ ID NO: 2240148 - DNA, 15 bp, Homo sapiens
gaccaagggcagagg

SEQ ID NO: 2240149 - DNA, 16 bp, Homo sapiens
gaccacaccctgtact

SEQ ID NO: 2240150 - DNA, 19 bp, Homo sapiens
gaccaccccgcctgccctc

SEQ ID NO: 2240151 - DNA, 15 bp, Homo sapiens
gacccccatccagcc

SEQ ID NO: 2240152 - DNA, 16 bp, Homo sapiens
gacccccatccagcct

SEQ ID NO: 2240153 - DNA, 20 bp, Homo sapiens
gacccccatccagcctccag

SEQ ID NO: 2240154 - DNA, 21 bp, Homo sapiens
gacccccatccagcctccagg

SEQ ID NO: 2240155 - DNA, 20 bp, Homo sapiens
gaccctatgggtctaggaca

SEQ ID NO: 2240156 - DNA, 15 bp, Homo sapiens
gaccctgcaagacca

SEQ ID NO: 2240157 - DNA, 15 bp, Homo sapiens
gacccttataaaatc

SEQ ID NO: 2240158 - DNA, 20 bp, Homo sapiens
gacccttattgctgtcctgg

SEQ ID NO: 2240159 - DNA, 15 bp, Homo sapiens
gaccgccccctcctc

SEQ ID NO: 2240160 - DNA, 17 bp, Homo sapiens
gaccgggctctgacagc

SEQ ID NO: 2240161 - DNA, 18 bp, Homo sapiens
gaccgtttccaagctgcg

SEQ ID NO: 2240162 - DNA, 20 bp, Homo sapiens
gaccgtttccaagctgcggg

SEQ ID NO: 2240163 - DNA, 21 bp, Homo sapiens
gacctacctccagacttcaaa

SEQ ID NO: 2240164 - DNA, 19 bp, Homo sapiens
gacctccgtcctctcccca

SEQ ID NO: 2240165 - DNA, 20 bp, Homo sapiens
gacctgcactggggagcccg

SEQ ID NO: 2240166 - DNA, 21 bp, Homo sapiens
gacctggtaccctcctggctc

SEQ ID NO: 2240167 - DNA, 13 bp, Homo sapiens
gaccttaggcctt

SEQ ID NO: 2240168 - DNA, 16 bp, Homo sapiens
gaccttaggccttcct

SEQ ID NO: 2240169 - DNA, 18 bp, Homo sapiens
gaccttaggccttcctct

SEQ ID NO: 2240170 - DNA, 21 bp, Homo sapiens
gacgaacatccaaccttccca

SEQ ID NO: 2240171 - DNA, 21 bp, Homo sapiens
gacgaagcggagagagccaag

SEQ ID NO: 2240172 - DNA, 15 bp, Homo sapiens
gacgagggccaggca

SEQ ID NO: 2240173 - DNA, 16 bp, Homo sapiens
gacgagggccaggcac

SEQ ID NO: 2240174 - DNA, 21 bp, Homo sapiens
gacgatatactccctgccctt

SEQ ID NO: 2240175 - DNA, 16 bp, Homo sapiens
gacgccactcatttca

SEQ ID NO: 2240176 - DNA, 17 bp, Homo sapiens
gacgccactcatttcat

SEQ ID NO: 2240177 - DNA, 21 bp, Homo sapiens
gacgctgccgctgccgctgca

SEQ ID NO: 2240178 - DNA, 22 bp, Homo sapiens
gacggagatgaagaacatctgg

SEQ ID NO: 2240179 - DNA, 23 bp, Homo sapiens
gacggtgttttgccatgttggcc

SEQ ID NO: 2240180 - DNA, 20 bp, Homo sapiens
gacgtactccaacagaagaa

SEQ ID NO: 2240181 - DNA, 22 bp, Homo sapiens
gacgtcatcggaggctgggccc

SEQ ID NO: 2240182 - DNA, 18 bp, Homo sapiens
gacgtgaatgtctcagcg

SEQ ID NO: 2240183 - DNA, 17 bp, Homo sapiens
gacgtttttgtgctgtg

SEQ ID NO: 2240184 - DNA, 19 bp, Homo sapiens
gacgtttttgtgctgtggg

SEQ ID NO: 2240185 - DNA, 15 bp, Homo sapiens
gactaattttacatg

SEQ ID NO: 2240186 - DNA, 19 bp, Homo sapiens
gactagatactactttctc

SEQ ID NO: 2240187 - DNA, 17 bp, Homo sapiens
gactatgtatttttcta

SEQ ID NO: 2240188 - DNA, 12 bp, Homo sapiens
gactccagccag

SEQ ID NO: 2240189 - DNA, 13 bp, Homo sapiens
gactccctgtggg

SEQ ID NO: 2240190 - DNA, 15 bp, Homo sapiens
gactctaaagtctgt

SEQ ID NO: 2240191 - DNA, 13 bp, Homo sapiens
gactgattttaat

SEQ ID NO: 2240192 - DNA, 19 bp, Homo sapiens
gactgtcccaccgggagcc

SEQ ID NO: 2240193 - DNA, 14 bp, Homo sapiens
gacttccttgagac

SEQ ID NO: 2240194 - DNA, 20 bp, Homo sapiens
gacttccttgagacacggag

SEQ ID NO: 2240195 - DNA, 12 bp, Homo sapiens
gacttgcaaaga

SEQ ID NO: 2240196 - DNA, 13 bp, Homo sapiens
gactttttataaa

SEQ ID NO: 2240197 - DNA, 22 bp, Homo sapiens
gagaaactgagaaatgaatgct

SEQ ID NO: 2240198 - DNA, 15 bp, Homo sapiens
gagaaagactgatta

SEQ ID NO: 2240199 - DNA, 19 bp, Homo sapiens
gagaaatgaatgctgagac

SEQ ID NO: 2240200 - DNA, 14 bp, Homo sapiens
gagaagccacgctg

SEQ ID NO: 2240201 - DNA, 13 bp, Homo sapiens
gagaagctctgaa

SEQ ID NO: 2240202 - DNA, 16 bp, Homo sapiens
gagaaggtttattgtt

SEQ ID NO: 2240203 - DNA, 13 bp, Homo sapiens
gagaatgaattca

SEQ ID NO: 2240204 - DNA, 17 bp, Homo sapiens
gagacactggcccctca

SEQ ID NO: 2240205 - DNA, 17 bp, Homo sapiens
gagacagactagaagtt

SEQ ID NO: 2240206 - DNA, 14 bp, Homo sapiens
gagaccctgcaaga

SEQ ID NO: 2240207 - DNA, 22 bp, Homo sapiens
gagactctgtttgcttgtgttt

SEQ ID NO: 2240208 - DNA, 16 bp, Homo sapiens
gagagaagccacgctg

SEQ ID NO: 2240209 - DNA, 12 bp, Homo sapiens
gagagagccaag

SEQ ID NO: 2240210 - DNA, 13 bp, Homo sapiens
gagagccaagacg

SEQ ID NO: 2240211 - DNA, 15 bp, Homo sapiens
gagaggcggcctcgt

SEQ ID NO: 2240212 - DNA, 16 bp, Homo sapiens
gagaggcggcctcgtg

SEQ ID NO: 2240213 - DNA, 14 bp, Homo sapiens
gagagtcaaagctg

SEQ ID NO: 2240214 - DNA, 16 bp, Homo sapiens
gagagtcaaagctgac

SEQ ID NO: 2240215 - DNA, 14 bp, Homo sapiens
gagataaattttat

SEQ ID NO: 2240216 - DNA, 19 bp, Homo sapiens
gagcagcccccgggccgct

SEQ ID NO: 2240217 - DNA, 15 bp, Homo sapiens
gagcatttctcatca

SEQ ID NO: 2240218 - DNA, 20 bp, Homo sapiens
gagcatttctcatcagtagt

SEQ ID NO: 2240219 - DNA, 13 bp, Homo sapiens
gagccagcctggc

SEQ ID NO: 2240220 - DNA, 14 bp, Homo sapiens
gagccagcctggct

SEQ ID NO: 2240221 - DNA, 15 bp, Homo sapiens
gagcccagccctccc

SEQ ID NO: 2240222 - DNA, 12 bp, Homo sapiens
gagcctcccacc

SEQ ID NO: 2240223 - DNA, 13 bp, Homo sapiens
gagcctcccacca

SEQ ID NO: 2240224 - DNA, 18 bp, Homo sapiens
gagcctcccaccagagcc

SEQ ID NO: 2240225 - DNA, 13 bp, Homo sapiens
gagcctccccctc

SEQ ID NO: 2240226 - DNA, 23 bp, Homo sapiens
gagcctttggttctggccagaat

SEQ ID NO: 2240227 - DNA, 21 bp, Homo sapiens
gagcgaagccttctgcagcag

SEQ ID NO: 2240228 - DNA, 20 bp, Homo sapiens
gagctatggagagaattaaa

SEQ ID NO: 2240229 - DNA, 18 bp, Homo sapiens
gagctgccttggctcaga

SEQ ID NO: 2240230 - DNA, 16 bp, Homo sapiens
gaggaaaagtgcaatg

SEQ ID NO: 2240231 - DNA, 13 bp, Homo sapiens
gaggaaaggattt

SEQ ID NO: 2240232 - DNA, 13 bp, Homo sapiens
ctccttcactgtt

SEQ ID NO: 2240233 - DNA, 19 bp, Homo sapiens
ctccttcagacaccctcaa

SEQ ID NO: 2240234 - DNA, 17 bp, Homo sapiens
ctccttcccatcgctgt

SEQ ID NO: 2240235 - DNA, 14 bp, Homo sapiens
ctccttggccacag

SEQ ID NO: 2240236 - DNA, 20 bp, Homo sapiens
ctcgccgtgtctcagcctct

SEQ ID NO: 2240237 - DNA, 21 bp, Homo sapiens
ctcgccgtgtctcagcctctg

SEQ ID NO: 2240238 - DNA, 22 bp, Homo sapiens
ctcgccgtgtctcagcctctgc

SEQ ID NO: 2240239 - DNA, 16 bp, Homo sapiens
ctcgcgctcagtaaac

SEQ ID NO: 2240240 - DNA, 19 bp, Homo sapiens
ctcggctccccatgtgtcc

SEQ ID NO: 2240241 - DNA, 22 bp, Homo sapiens
ctcggtttgccaaaattcattt

SEQ ID NO: 2240242 - DNA, 14 bp, Homo sapiens
ctcgtgtgtttcta

SEQ ID NO: 2240243 - DNA, 18 bp, Homo sapiens
ctctacatcttctgcctt

SEQ ID NO: 2240244 - DNA, 17 bp, Homo sapiens
ctctactgaatgtcatt

SEQ ID NO: 2240245 - DNA, 20 bp, Homo sapiens
ctctactgaatgtcattgaa

SEQ ID NO: 2240246 - DNA, 16 bp, Homo sapiens
ctctatttatgtttgc

SEQ ID NO: 2240247 - DNA, 13 bp, Homo sapiens
ctctcacctcagc

SEQ ID NO: 2240248 - DNA, 15 bp, Homo sapiens
ctctcagagccctca

SEQ ID NO: 2240249 - DNA, 12 bp, Homo sapiens
ctctcagctcca

SEQ ID NO: 2240250 - DNA, 13 bp, Homo sapiens
ctctccacggtag

SEQ ID NO: 2240251 - DNA, 13 bp, Homo sapiens
ctctccccagcct

SEQ ID NO: 2240252 - DNA, 17 bp, Homo sapiens
ctctccctctctctttt

SEQ ID NO: 2240253 - DNA, 13 bp, Homo sapiens
ctctcctgacccc

SEQ ID NO: 2240254 - DNA, 16 bp, Homo sapiens
ctctcctgacccctgc

SEQ ID NO: 2240255 - DNA, 20 bp, Homo sapiens
ctctcctgggggtggcaggc

SEQ ID NO: 2240256 - DNA, 23 bp, Homo sapiens
ctctcctgggggtggcaggcaca

SEQ ID NO: 2240257 - DNA, 16 bp, Homo sapiens
ctctccttggccacag

SEQ ID NO: 2240258 - DNA, 15 bp, Homo sapiens
ctctcggctccccat

SEQ ID NO: 2240259 - DNA, 24 bp, Homo sapiens
ctctcggtgacctccgtcctctcc

SEQ ID NO: 2240260 - DNA, 14 bp, Homo sapiens
ctctctccagatgt

SEQ ID NO: 2240261 - DNA, 11 bp, Homo sapiens
ctctctctctc

SEQ ID NO: 2240262 - DNA, 13 bp, Homo sapiens
ctctctctgtgtc

SEQ ID NO: 2240263 - DNA, 9 bp, Homo sapiens
ctctctctt

SEQ ID NO: 2240264 - DNA, 14 bp, Homo sapiens
ctctctcttttcat

SEQ ID NO: 2240265 - DNA, 15 bp, Homo sapiens
ctctctcttttcatt

SEQ ID NO: 2240266 - DNA, 16 bp, Homo sapiens
ctctctgcctgtaaat

SEQ ID NO: 2240267 - DNA, 18 bp, Homo sapiens
ctctgacagtccacaggg

SEQ ID NO: 2240268 - DNA, 16 bp, Homo sapiens
ctctgagaagctctga

SEQ ID NO: 2240269 - DNA, 15 bp, Homo sapiens
ctctgcaattcccct

SEQ ID NO: 2240270 - DNA, 22 bp, Homo sapiens
ctctgcacaccctccagagaca

SEQ ID NO: 2240271 - DNA, 17 bp, Homo sapiens
ctctgccccctccccca

SEQ ID NO: 2240272 - DNA, 18 bp, Homo sapiens
ctctgccccctcccccat

SEQ ID NO: 2240273 - DNA, 14 bp, Homo sapiens
ctctgctagatttc

SEQ ID NO: 2240274 - DNA, 12 bp, Homo sapiens
ctctgctctcct

SEQ ID NO: 2240275 - DNA, 20 bp, Homo sapiens
ctctggacccctgggcctca

SEQ ID NO: 2240276 - DNA, 20 bp, Homo sapiens
ctctggcattagaattattt

SEQ ID NO: 2240277 - DNA, 23 bp, Homo sapiens
ctctggcattagaattatttaaa

SEQ ID NO: 2240278 - DNA, 14 bp, Homo sapiens
ctctggggccctgg

SEQ ID NO: 2240279 - DNA, 15 bp, Homo sapiens
ctctggggccctggg

SEQ ID NO: 2240280 - DNA, 16 bp, Homo sapiens
ctctggggccctgggc

SEQ ID NO: 2240281 - DNA, 22 bp, Homo sapiens
ctctggggccctgggcctcagt

SEQ ID NO: 2240282 - DNA, 20 bp, Homo sapiens
ctctgtacttttcattctct

SEQ ID NO: 2240283 - DNA, 22 bp, Homo sapiens
ctctgtacttttcattctcttt

SEQ ID NO: 2240284 - DNA, 20 bp, Homo sapiens
ctctgtctacctggtctggt

SEQ ID NO: 2240285 - DNA, 11 bp, Homo sapiens
ctctgtgagaa

SEQ ID NO: 2240286 - DNA, 16 bp, Homo sapiens
ctctgtgccttctttt

SEQ ID NO: 2240287 - DNA, 16 bp, Homo sapiens
ctctgtgtctttctct

SEQ ID NO: 2240288 - DNA, 13 bp, Homo sapiens
ctctgtttgcttg

SEQ ID NO: 2240289 - DNA, 16 bp, Homo sapiens
ctcttccttttatcag

SEQ ID NO: 2240290 - DNA, 15 bp, Homo sapiens
ctctttcttcccatg

SEQ ID NO: 2240291 - DNA, 20 bp, Homo sapiens
ctctttgtaatttaatgaaa

SEQ ID NO: 2240292 - DNA, 16 bp, Homo sapiens
ccctcatggcccctct

SEQ ID NO: 2240293 - DNA, 21 bp, Homo sapiens
ccctcatggcccctctgacct

SEQ ID NO: 2240294 - DNA, 14 bp, Homo sapiens
ccctccaccccagg

SEQ ID NO: 2240295 - DNA, 21 bp, Homo sapiens
ccctccacgcctcctggccag

SEQ ID NO: 2240296 - DNA, 15 bp, Homo sapiens
tttaaggaaactaga

SEQ ID NO: 2240297 - DNA, 17 bp, Homo sapiens
tttaagtgtctcactaa

SEQ ID NO: 2240298 - DNA, 14 bp, Homo sapiens
tttaatttatttca

SEQ ID NO: 2240299 - DNA, 16 bp, Homo sapiens
tttacacaaatgtgat

SEQ ID NO: 2240300 - DNA, 17 bp, Homo sapiens
tttacagatgaatgtat

SEQ ID NO: 2240301 - DNA, 14 bp, Homo sapiens
tttaccatgtgcta

SEQ ID NO: 2240302 - DNA, 18 bp, Homo sapiens
tttaccttcaaactttag

SEQ ID NO: 2240303 - DNA, 19 bp, Homo sapiens
tttactcacagcacttgtt

SEQ ID NO: 2240304 - DNA, 22 bp, Homo sapiens
tttactcacagcacttgttttc

SEQ ID NO: 2240305 - DNA, 21 bp, Homo sapiens
tttactcatcctccaggaact

SEQ ID NO: 2240306 - DNA, 21 bp, Homo sapiens
ttttaatttatttcatccagt

SEQ ID NO: 2240307 - DNA, 12 bp, Homo sapiens
ttttaccaaagc

SEQ ID NO: 2240308 - DNA, 14 bp, Homo sapiens
ttttaccaaagcat

SEQ ID NO: 2240309 - DNA, 15 bp, Homo sapiens
ttttaccaaagcatc

SEQ ID NO: 2240310 - DNA, 16 bp, Homo sapiens
ttttaggaaacttgta

SEQ ID NO: 2240311 - DNA, 22 bp, Homo sapiens
ttttaggaaacttgtagaaacg

SEQ ID NO: 2240312 - DNA, 12 bp, Homo sapiens
ttttatcagtag

SEQ ID NO: 2240313 - DNA, 13 bp, Homo sapiens
ttttattgttgta

SEQ ID NO: 2240314 - DNA, 22 bp, Homo sapiens
ttttccctctttggctcccctg

SEQ ID NO: 2240315 - DNA, 14 bp, Homo sapiens
ttttccttttctta

SEQ ID NO: 2240316 - DNA, 16 bp, Homo sapiens
ttttctttaatgcttt

SEQ ID NO: 2240317 - DNA, 23 bp, Homo sapiens
ttttcttttttaaattaatatct

SEQ ID NO: 2240318 - DNA, 13 bp, Homo sapiens
ttttgaatcaata

SEQ ID NO: 2240319 - DNA, 21 bp, Homo sapiens
ttttgactctggcaaagcttt

SEQ ID NO: 2240320 - DNA, 12 bp, Homo sapiens
ttttgattatgt

SEQ ID NO: 2240321 - DNA, 21 bp, Homo sapiens
ttttgcaaaataagtaaataa

SEQ ID NO: 2240322 - DNA, 13 bp, Homo sapiens
ttttgctgtatat

SEQ ID NO: 2240323 - DNA, 19 bp, Homo sapiens
ttttggtaaagactggctt

SEQ ID NO: 2240324 - DNA, 11 bp, Homo sapiens
ttttgtaactt

SEQ ID NO: 2240325 - DNA, 17 bp, Homo sapiens
ttttgtaataataaaga

SEQ ID NO: 2240326 - DNA, 20 bp, Homo sapiens
ttttgtacgttatatattgt

SEQ ID NO: 2240327 - DNA, 18 bp, Homo sapiens
tttttaaaaaatattttc

SEQ ID NO: 2240328 - DNA, 16 bp, Homo sapiens
tttttaaataaaagca

SEQ ID NO: 2240329 - DNA, 19 bp, Homo sapiens
tttttaaataaaagcacaa

SEQ ID NO: 2240330 - DNA, 13 bp, Homo sapiens
tttttaagtgaaa

SEQ ID NO: 2240331 - DNA, 18 bp, Homo sapiens
tttttatctatataaaat

SEQ ID NO: 2240332 - DNA, 14 bp, Homo sapiens
tttttcaagagatc

SEQ ID NO: 2240333 - DNA, 13 bp, Homo sapiens
tttttcataaaca

SEQ ID NO: 2240334 - DNA, 15 bp, Homo sapiens
tttttggaagtgaaa

SEQ ID NO: 2240335 - DNA, 19 bp, Homo sapiens
tttttggaagtgaaaactt

SEQ ID NO: 2240336 - DNA, 16 bp, Homo sapiens
tttttgtaacttcaaa

SEQ ID NO: 2240337 - DNA, 21 bp, Homo sapiens
tttttgtgtccgctaaatatt

SEQ ID NO: 2240338 - DNA, 15 bp, Homo sapiens
ttttttctacctata

SEQ ID NO: 2240339 - DNA, 17 bp, Homo sapiens
ttttttgagagagagtc

SEQ ID NO: 2240340 - DNA, 13 bp, Homo sapiens
tttttttcctttt

SEQ ID NO: 2240341 - DNA, 19 bp, Homo sapiens
tgcctcacatttttttcta

SEQ ID NO: 2240342 - DNA, 15 bp, Homo sapiens
tgcctcactaatttt

SEQ ID NO: 2240343 - DNA, 18 bp, Homo sapiens
tgcctcactaatttttgt

SEQ ID NO: 2240344 - DNA, 23 bp, Homo sapiens
tgcctcagccacttgcctgtgct

SEQ ID NO: 2240345 - DNA, 19 bp, Homo sapiens
tgcctctgacagtccacag

SEQ ID NO: 2240346 - DNA, 21 bp, Homo sapiens
tgcctctgacagtccacaggg

SEQ ID NO: 2240347 - DNA, 22 bp, Homo sapiens
tgcctgcccctaccctggactt

SEQ ID NO: 2240348 - DNA, 22 bp, Homo sapiens
tgcctgtccccaaacaggacag

SEQ ID NO: 2240349 - DNA, 19 bp, Homo sapiens
tgcctgtgctacaattcat

SEQ ID NO: 2240350 - DNA, 15 bp, Homo sapiens
tgccttagtctcagt

SEQ ID NO: 2240351 - DNA, 17 bp, Homo sapiens
tgccttatgttgaaaaa

SEQ ID NO: 2240352 - DNA, 19 bp, Homo sapiens
tgccttggctcagacatgt

SEQ ID NO: 2240353 - DNA, 16 bp, Homo sapiens
tgccttttaattttta

SEQ ID NO: 2240354 - DNA, 15 bp, Homo sapiens
tgcgtaatttaatgg

SEQ ID NO: 2240355 - DNA, 17 bp, Homo sapiens
tgcgttaaataagcaaa

SEQ ID NO: 2240356 - DNA, 13 bp, Homo sapiens
tgctagatttcta

SEQ ID NO: 2240357 - DNA, 22 bp, Homo sapiens
tgctatacacaagcaatgcaag

SEQ ID NO: 2240358 - DNA, 20 bp, Homo sapiens
tgctatttgaacaagtgggc

SEQ ID NO: 2240359 - DNA, 21 bp, Homo sapiens
tgctcaataaatgattcttag

SEQ ID NO: 2240360 - DNA, 14 bp, Homo sapiens
tgctcagaagggct

SEQ ID NO: 2240361 - DNA, 13 bp, Homo sapiens
tgctcagcccgct

SEQ ID NO: 2240362 - DNA, 21 bp, Homo sapiens
tgctcagcccgcttggccacc

SEQ ID NO: 2240363 - DNA, 20 bp, Homo sapiens
tgctcagtgtttttgtgaat

SEQ ID NO: 2240364 - DNA, 21 bp, Homo sapiens
tgctcctgttcacaccagaga

SEQ ID NO: 2240365 - DNA, 20 bp, Homo sapiens
tgctgaatgttgggactgct

SEQ ID NO: 2240366 - DNA, 16 bp, Homo sapiens
tgctgctccaccctcc

SEQ ID NO: 2240367 - DNA, 17 bp, Homo sapiens
tgctgctccaccctccc

SEQ ID NO: 2240368 - DNA, 21 bp, Homo sapiens
tgctgctccaccctcccccag

SEQ ID NO: 2240369 - DNA, 15 bp, Homo sapiens
tgctggccagcaccc

SEQ ID NO: 2240370 - DNA, 16 bp, Homo sapiens
tgctggccccagccct

SEQ ID NO: 2240371 - DNA, 21 bp, Homo sapiens
tgctggccccagccctgctgg

SEQ ID NO: 2240372 - DNA, 18 bp, Homo sapiens
tgctgggaggactggacc

SEQ ID NO: 2240373 - DNA, 16 bp, Homo sapiens
tgctgtccctccccct

SEQ ID NO: 2240374 - DNA, 17 bp, Homo sapiens
tgctgtccctccccctt

SEQ ID NO: 2240375 - DNA, 16 bp, Homo sapiens
tgctgtgggcagcacc

SEQ ID NO: 2240376 - DNA, 17 bp, Homo sapiens
tgctgtgggcagcaccc

SEQ ID NO: 2240377 - DNA, 18 bp, Homo sapiens
tgctgtgggcagcaccct

SEQ ID NO: 2240378 - DNA, 19 bp, Homo sapiens
tgctgtgggcagcaccctc

SEQ ID NO: 2240379 - DNA, 21 bp, Homo sapiens
tgctgtgggcagcaccctccc

SEQ ID NO: 2240380 - DNA, 21 bp, Homo sapiens
tgcttctcagatttctgagga

SEQ ID NO: 2240381 - DNA, 21 bp, Homo sapiens
tgcttgacaaatattttcatg

SEQ ID NO: 2240382 - DNA, 17 bp, Homo sapiens
tgctttcctgcatctct

SEQ ID NO: 2240383 - DNA, 18 bp, Homo sapiens
tgcttttgcataatgcaa

SEQ ID NO: 2240384 - DNA, 17 bp, Homo sapiens
tggaaaaataaaactgt

SEQ ID NO: 2240385 - DNA, 16 bp, Homo sapiens
tggaaaaataaacact

SEQ ID NO: 2240386 - DNA, 21 bp, Homo sapiens
tggaaactatgtgtttttctc

SEQ ID NO: 2240387 - DNA, 22 bp, Homo sapiens
tggaaagacgtttttgtgctgt

SEQ ID NO: 2240388 - DNA, 17 bp, Homo sapiens
tggaaccttccctccaa

SEQ ID NO: 2240389 - DNA, 21 bp, Homo sapiens
tggaagattctatttaattga

SEQ ID NO: 2240390 - DNA, 18 bp, Homo sapiens
tggaagcaattgctcatg

SEQ ID NO: 2240391 - DNA, 16 bp, Homo sapiens
tggacactcagacctg

SEQ ID NO: 2240392 - DNA, 22 bp, Homo sapiens
tggacagtacctgattgtattt

SEQ ID NO: 2240393 - DNA, 15 bp, Homo sapiens
tggaccttaggcctt

SEQ ID NO: 2240394 - DNA, 16 bp, Homo sapiens
tggaccttaggccttc

SEQ ID NO: 2240395 - DNA, 19 bp, Homo sapiens
tggaccttaggccttcctc

SEQ ID NO: 2240396 - DNA, 14 bp, Homo sapiens
tggactatgcacac

SEQ ID NO: 2240397 - DNA, 14 bp, Homo sapiens
tggactggaagggg

SEQ ID NO: 2240398 - DNA, 17 bp, Homo sapiens
tggactgttttctctcg

SEQ ID NO: 2240399 - DNA, 14 bp, Homo sapiens
tggacttgcctctg

SEQ ID NO: 2240400 - DNA, 14 bp, Homo sapiens
tggagaagatttat

SEQ ID NO: 2240401 - DNA, 15 bp, Homo sapiens
tggagaggcggcctc

SEQ ID NO: 2240402 - DNA, 15 bp, Homo sapiens
tggagattataataa

SEQ ID NO: 2240403 - DNA, 13 bp, Homo sapiens
tggagccagctcc

SEQ ID NO: 2240404 - DNA, 20 bp, Homo sapiens
tggagcgaagccttctgcag

SEQ ID NO: 2240405 - DNA, 23 bp, Homo sapiens
tggagcgaagccttctgcagcag

SEQ ID NO: 2240406 - DNA, 20 bp, Homo sapiens
tggaggaacaatcggctgca

SEQ ID NO: 2240407 - DNA, 19 bp, Homo sapiens
tggaggaacacttgatgga

SEQ ID NO: 2240408 - DNA, 13 bp, Homo sapiens
tggaggggtgtgg

SEQ ID NO: 2240409 - DNA, 23 bp, Homo sapiens
tggaggggtgtggctccttccca

SEQ ID NO: 2240410 - DNA, 15 bp, Homo sapiens
tggagtcccctcacc

SEQ ID NO: 2240411 - DNA, 15 bp, Homo sapiens
tggagtgtgagccac

SEQ ID NO: 2240412 - DNA, 17 bp, Homo sapiens
tggataaattgtttagt

SEQ ID NO: 2240413 - DNA, 13 bp, Homo sapiens
tggataccattat

SEQ ID NO: 2240414 - DNA, 21 bp, Homo sapiens
tggatccatcttgagccacag

SEQ ID NO: 2240415 - DNA, 16 bp, Homo sapiens
tggcacaggccccctt

SEQ ID NO: 2240416 - DNA, 16 bp, Homo sapiens
tggcacaggccgaggc

SEQ ID NO: 2240417 - DNA, 20 bp, Homo sapiens
gccaggaccaagggcagagg

SEQ ID NO: 2240418 - DNA, 13 bp, Homo sapiens
gtgatatatttaa

SEQ ID NO: 2240419 - DNA, 14 bp, Homo sapiens
gtgatttttgtaat

SEQ ID NO: 2240420 - DNA, 21 bp, Homo sapiens
gtgcaatgtctgagtgaacct

SEQ ID NO: 2240421 - DNA, 23 bp, Homo sapiens
gtgcagtctttgagataatttgt

SEQ ID NO: 2240422 - DNA, 16 bp, Homo sapiens
gtgccaccatgcctca

SEQ ID NO: 2240423 - DNA, 13 bp, Homo sapiens
gtgcccccctcct

SEQ ID NO: 2240424 - DNA, 14 bp, Homo sapiens
gtgcccccctcctc

SEQ ID NO: 2240425 - DNA, 16 bp, Homo sapiens
gtgctcagaagggcta

SEQ ID NO: 2240426 - DNA, 18 bp, Homo sapiens
gtgctcgcccacaaactg

SEQ ID NO: 2240427 - DNA, 14 bp, Homo sapiens
gtgctggtgcatca

SEQ ID NO: 2240428 - DNA, 15 bp, Homo sapiens
gtgctgtgggcagca

SEQ ID NO: 2240429 - DNA, 19 bp, Homo sapiens
gtgctgtgggcagcaccct

SEQ ID NO: 2240430 - DNA, 18 bp, Homo sapiens
gtgctttttataaaaaga

SEQ ID NO: 2240431 - DNA, 13 bp, Homo sapiens
gtggaagcaacca

SEQ ID NO: 2240432 - DNA, 14 bp, Homo sapiens
gtggactgcgctgg

SEQ ID NO: 2240433 - DNA, 15 bp, Homo sapiens
gtggaggaggacact

SEQ ID NO: 2240434 - DNA, 14 bp, Homo sapiens
gtggaggcacttta

SEQ ID NO: 2240435 - DNA, 13 bp, Homo sapiens
gtggaggctggca

SEQ ID NO: 2240436 - DNA, 12 bp, Homo sapiens
gtggcacaggcc

SEQ ID NO: 2240437 - DNA, 14 bp, Homo sapiens
gtggccatccctgg

SEQ ID NO: 2240438 - DNA, 13 bp, Homo sapiens
gtggcctcagccc

SEQ ID NO: 2240439 - DNA, 14 bp, Homo sapiens
gtggcctcagccct

SEQ ID NO: 2240440 - DNA, 17 bp, Homo sapiens
gtggcctcagccctcag

SEQ ID NO: 2240441 - DNA, 14 bp, Homo sapiens
gtgggccaggatcc

SEQ ID NO: 2240442 - DNA, 12 bp, Homo sapiens
gtggggcccact

SEQ ID NO: 2240443 - DNA, 12 bp, Homo sapiens
gtgggggtggcc

SEQ ID NO: 2240444 - DNA, 10 bp, Homo sapiens
gtggggtggg

SEQ ID NO: 2240445 - DNA, 16 bp, Homo sapiens
gtggggtggggagaaa

SEQ ID NO: 2240446 - DNA, 14 bp, Homo sapiens
gtggtaccctctgg

SEQ ID NO: 2240447 - DNA, 17 bp, Homo sapiens
gtgtaaaatattttgaa

SEQ ID NO: 2240448 - DNA, 19 bp, Homo sapiens
gtgtaacactgtgtacacc

SEQ ID NO: 2240449 - DNA, 21 bp, Homo sapiens
gtgtcccctcactctgtcagc

SEQ ID NO: 2240450 - DNA, 12 bp, Homo sapiens
gtgtctcagcct

SEQ ID NO: 2240451 - DNA, 20 bp, Homo sapiens
gtgtctcagcctctgccagc

SEQ ID NO: 2240452 - DNA, 19 bp, Homo sapiens
gtgtctcaggaaaacagct

SEQ ID NO: 2240453 - DNA, 23 bp, Homo sapiens
gtttgttctccgggtgtggcctc

SEQ ID NO: 2240454 - DNA, 11 bp, Homo sapiens
gttttacaata

SEQ ID NO: 2240455 - DNA, 20 bp, Homo sapiens
gttttaggaaacttgtagaa

SEQ ID NO: 2240456 - DNA, 12 bp, Homo sapiens
gttttcaacagt

SEQ ID NO: 2240457 - DNA, 18 bp, Homo sapiens
gttttcaagtcaaattaa

SEQ ID NO: 2240458 - DNA, 18 bp, Homo sapiens
gttttcagaagaaataaa

SEQ ID NO: 2240459 - DNA, 16 bp, Homo sapiens
gttttgacataagatg

SEQ ID NO: 2240460 - DNA, 13 bp, Homo sapiens
gttttgttctgta

SEQ ID NO: 2240461 - DNA, 13 bp, Homo sapiens
gttttgttgtttg

SEQ ID NO: 2240462 - DNA, 20 bp, Homo sapiens
gtttttaatctttgtgacag

SEQ ID NO: 2240463 - DNA, 18 bp, Homo sapiens
gtttttatgcctttctct

SEQ ID NO: 2240464 - DNA, 13 bp, Homo sapiens
gtttttttaatga

SEQ ID NO: 2240465 - DNA, 17 bp, Homo sapiens
taaaaaggagtatacaa

SEQ ID NO: 2240466 - DNA, 18 bp, Homo sapiens
taaaaaggagtatacaaa

SEQ ID NO: 2240467 - DNA, 22 bp, Homo sapiens
taaaaatctaagcagcttattg

SEQ ID NO: 2240468 - DNA, 15 bp, Homo sapiens
taaaaatctcttttc

SEQ ID NO: 2240469 - DNA, 23 bp, Homo sapiens
taaaaatggaaaaataaacacta

SEQ ID NO: 2240470 - DNA, 17 bp, Homo sapiens
taaaacaaaatttgact

SEQ ID NO: 2240471 - DNA, 15 bp, Homo sapiens
taaaacattaaaata

SEQ ID NO: 2240472 - DNA, 16 bp, Homo sapiens
taaaactgtcactgtt

SEQ ID NO: 2240473 - DNA, 20 bp, Homo sapiens
taaaacttctcaagatactg

SEQ ID NO: 2240474 - DNA, 20 bp, Homo sapiens
taaaagacatttgatagaaa

SEQ ID NO: 2240475 - DNA, 20 bp, Homo sapiens
taaaagcacaagtacttttg

SEQ ID NO: 2240476 - DNA, 16 bp, Homo sapiens
taaaagcattttgtaa

SEQ ID NO: 2240477 - DNA, 14 bp, Homo sapiens
taaaaggatggcaa

SEQ ID NO: 2240478 - DNA, 19 bp, Homo sapiens
taaaagtattcttgttaga

SEQ ID NO: 2240479 - DNA, 16 bp, Homo sapiens
taaaataactaaaatg

SEQ ID NO: 2240480 - DNA, 15 bp, Homo sapiens
taaaatagatataaa

SEQ ID NO: 2240481 - DNA, 16 bp, Homo sapiens
taaaatagatataaat

SEQ ID NO: 2240482 - DNA, 20 bp, Homo sapiens
taaaatattttgaatcaata

SEQ ID NO: 2240483 - DNA, 15 bp, Homo sapiens
taaaatcacgttaaa

SEQ ID NO: 2240484 - DNA, 18 bp, Homo sapiens
taaaatggctgtaatcat

SEQ ID NO: 2240485 - DNA, 22 bp, Homo sapiens
taaaatgtatctaagaataata

SEQ ID NO: 2240486 - DNA, 15 bp, Homo sapiens
taaaatgtctttcca

SEQ ID NO: 2240487 - DNA, 16 bp, Homo sapiens
taaaatgtctttccaa

SEQ ID NO: 2240488 - DNA, 14 bp, Homo sapiens
taaaatgttaaaac

SEQ ID NO: 2240489 - DNA, 14 bp, Homo sapiens
taaacaaagttact

SEQ ID NO: 2240490 - DNA, 22 bp, Homo sapiens
taaacaagttcgagtcaaagtt

SEQ ID NO: 2240491 - DNA, 17 bp, Homo sapiens
taagcatactttgtaaa

SEQ ID NO: 2240492 - DNA, 20 bp, Homo sapiens
taagcatatgtgttacttca

SEQ ID NO: 2240493 - DNA, 16 bp, Homo sapiens
taaggccgtgtctctg

SEQ ID NO: 2240494 - DNA, 18 bp, Homo sapiens
taaggtgatatatttaaa

SEQ ID NO: 2240495 - DNA, 21 bp, Homo sapiens
taagtcccagtatacctcatt

SEQ ID NO: 2240496 - DNA, 20 bp, Homo sapiens
taagtcttacataaaccatt

SEQ ID NO: 2240497 - DNA, 17 bp, Homo sapiens
taagtgatgtcatttga

SEQ ID NO: 2240498 - DNA, 15 bp, Homo sapiens
taagtggaggcactt

SEQ ID NO: 2240499 - DNA, 17 bp, Homo sapiens
taagtggaggcacttta

SEQ ID NO: 2240500 - DNA, 20 bp, Homo sapiens
taagttaatgtatataaaaa

SEQ ID NO: 2240501 - DNA, 17 bp, Homo sapiens
taagttagttccactga

SEQ ID NO: 2240502 - DNA, 20 bp, Homo sapiens
taagttagttccactgagac

SEQ ID NO: 2240503 - DNA, 12 bp, Homo sapiens
taagttattgca

SEQ ID NO: 2240504 - DNA, 15 bp, Homo sapiens
taagttattgcagtt

SEQ ID NO: 2240505 - DNA, 20 bp, Homo sapiens
taagttattgcagtttatca

SEQ ID NO: 2240506 - DNA, 21 bp, Homo sapiens
taagttttagaatcttttaaa

SEQ ID NO: 2240507 - DNA, 15 bp, Homo sapiens
taataaaaagacaac

SEQ ID NO: 2240508 - DNA, 23 bp, Homo sapiens
taataaaaaggagtatacaaaca

SEQ ID NO: 2240509 - DNA, 14 bp, Homo sapiens
taataaaactgtgc

SEQ ID NO: 2240510 - DNA, 22 bp, Homo sapiens
taataagaacattaattatatg

SEQ ID NO: 2240511 - DNA, 20 bp, Homo sapiens
taataatcttattagggaga

SEQ ID NO: 2240512 - DNA, 14 bp, Homo sapiens
taatacaaactaat

SEQ ID NO: 2240513 - DNA, 14 bp, Homo sapiens
taatacaaggtata

SEQ ID NO: 2240514 - DNA, 18 bp, Homo sapiens
taatagggaaaattctaa

SEQ ID NO: 2240515 - DNA, 14 bp, Homo sapiens
taatagggaatata

SEQ ID NO: 2240516 - DNA, 19 bp, Homo sapiens
taatagtgccaagcaggcc

SEQ ID NO: 2240517 - DNA, 18 bp, Homo sapiens
taatatggaaccttccct

SEQ ID NO: 2240518 - DNA, 14 bp, Homo sapiens
taatattaactttt

SEQ ID NO: 2240519 - DNA, 19 bp, Homo sapiens
taatcagcatatgtgtaaa

SEQ ID NO: 2240520 - DNA, 17 bp, Homo sapiens
taatcatagttactgtg

SEQ ID NO: 2240521 - DNA, 23 bp, Homo sapiens
taatcatagttactgtgtaaact

SEQ ID NO: 2240522 - DNA, 18 bp, Homo sapiens
taatcatcaagtaataca

SEQ ID NO: 2240523 - DNA, 13 bp, Homo sapiens
taatcatgaatat

SEQ ID NO: 2240524 - DNA, 21 bp, Homo sapiens
taatcatttgtttacatttga

SEQ ID NO: 2240525 - DNA, 12 bp, Homo sapiens
taatcattttca

SEQ ID NO: 2240526 - DNA, 18 bp, Homo sapiens
taatcattttcattccta

SEQ ID NO: 2240527 - DNA, 14 bp, Homo sapiens
taatctctaggaag

SEQ ID NO: 2240528 - DNA, 17 bp, Homo sapiens
taatgaacaaaattatt

SEQ ID NO: 2240529 - DNA, 22 bp, Homo sapiens
taatgatgacaaaaaatgtttt

SEQ ID NO: 2240530 - DNA, 22 bp, Homo sapiens
taatgcatctagattatggagc

SEQ ID NO: 2240531 - DNA, 14 bp, Homo sapiens
taatggtttttatt

SEQ ID NO: 2240532 - DNA, 14 bp, Homo sapiens
taatgtatataaaa

SEQ ID NO: 2240533 - DNA, 19 bp, Homo sapiens
taattaaccttactaatta

SEQ ID NO: 2240534 - DNA, 15 bp, Homo sapiens
taattattataaaaa

SEQ ID NO: 2240535 - DNA, 19 bp, Homo sapiens
taattattataaaaatatt

SEQ ID NO: 2240536 - DNA, 19 bp, Homo sapiens
taattcatcccaactgtct

SEQ ID NO: 2240537 - DNA, 15 bp, Homo sapiens
taattctatgcctgt

SEQ ID NO: 2240538 - DNA, 20 bp, Homo sapiens
taattgacttgcaaagacct

SEQ ID NO: 2240539 - DNA, 17 bp, Homo sapiens
taatttaaacacctcct

SEQ ID NO: 2240540 - DNA, 19 bp, Homo sapiens
taatttaaacacctcctca

SEQ ID NO: 2240541 - DNA, 14 bp, Homo sapiens
taatttaatgaaaa

SEQ ID NO: 2240542 - DNA, 11 bp, Homo sapiens
taatttaatgg

SEQ ID NO: 2240543 - DNA, 21 bp, Homo sapiens
taatttaatggggtctgtaaa

SEQ ID NO: 2240544 - DNA, 13 bp, Homo sapiens
taatttatttaat

SEQ ID NO: 2240545 - DNA, 12 bp, Homo sapiens
taatttgtttcc

SEQ ID NO: 2240546 - DNA, 16 bp, Homo sapiens
taattttcaccgagca

SEQ ID NO: 2240547 - DNA, 12 bp, Homo sapiens
taattttgtcag

SEQ ID NO: 2240548 - DNA, 13 bp, Homo sapiens
taattttgtgtaa

SEQ ID NO: 2240549 - DNA, 20 bp, Homo sapiens
taattttgtgtaagaaatac

SEQ ID NO: 2240550 - DNA, 18 bp, Homo sapiens
taatttttgcttttagaa

SEQ ID NO: 2240551 - DNA, 17 bp, Homo sapiens
taatttttgtattattt

SEQ ID NO: 2240552 - DNA, 22 bp, Homo sapiens
tacaaaaataaactataaaaca

SEQ ID NO: 2240553 - DNA, 16 bp, Homo sapiens
tacaaacatttaagct

SEQ ID NO: 2240554 - DNA, 14 bp, Homo sapiens
tacaaattagaaaa

SEQ ID NO: 2240555 - DNA, 21 bp, Homo sapiens
tacaacagaaaccagaaaagc

SEQ ID NO: 2240556 - DNA, 17 bp, Homo sapiens
tacaacattcaacttta

SEQ ID NO: 2240557 - DNA, 23 bp, Homo sapiens
tacaagagaaaaagcagaggcca

SEQ ID NO: 2240558 - DNA, 19 bp, Homo sapiens
tacaaggtataataaaatt

SEQ ID NO: 2240559 - DNA, 22 bp, Homo sapiens
tacacaaatgtgatttttgtaa

SEQ ID NO: 2240560 - DNA, 17 bp, Homo sapiens
tacacaagcaatgcaag

SEQ ID NO: 2240561 - DNA, 21 bp, Homo sapiens
tacacatcacacaagatttga

SEQ ID NO: 2240562 - DNA, 22 bp, Homo sapiens
tacagatgaatgtatttatttg

SEQ ID NO: 2240563 - DNA, 18 bp, Homo sapiens
tacagatttgtaacatta

SEQ ID NO: 2240564 - DNA, 20 bp, Homo sapiens
tacaggggtagtttgtttta

SEQ ID NO: 2240565 - DNA, 13 bp, Homo sapiens
tacagtgtgtgtg

SEQ ID NO: 2240566 - DNA, 14 bp, Homo sapiens
tacagttataaaat

SEQ ID NO: 2240567 - DNA, 13 bp, Homo sapiens
tacatacagaggt

SEQ ID NO: 2240568 - DNA, 16 bp, Homo sapiens
tacatacttttgcaaa

SEQ ID NO: 2240569 - DNA, 12 bp, Homo sapiens
tacatatcttta

SEQ ID NO: 2240570 - DNA, 21 bp, Homo sapiens
tacatcaatttaaaaagcaaa

SEQ ID NO: 2240571 - DNA, 24 bp, Homo sapiens
tacatgctgctatacacaagcaat

SEQ ID NO: 2240572 - DNA, 14 bp, Homo sapiens
tacatgtaatttga

SEQ ID NO: 2240573 - DNA, 15 bp, Homo sapiens
tacatgtatgcctgc

SEQ ID NO: 2240574 - DNA, 14 bp, Homo sapiens
tacattgttcaatt

SEQ ID NO: 2240575 - DNA, 15 bp, Homo sapiens
tacattgttcaatta

SEQ ID NO: 2240576 - DNA, 15 bp, Homo sapiens
tacatttaaaacatt

SEQ ID NO: 2240577 - DNA, 16 bp, Homo sapiens
tacatttaaaacatta

SEQ ID NO: 2240578 - DNA, 19 bp, Homo sapiens
tacatttaaaacattaaaa

SEQ ID NO: 2240579 - DNA, 17 bp, Homo sapiens
tacatttatttatccag

SEQ ID NO: 2240580 - DNA, 18 bp, Homo sapiens
tacatttcacattattct

SEQ ID NO: 2240581 - DNA, 18 bp, Homo sapiens
tacatttcatacaacaga

SEQ ID NO: 2240582 - DNA, 19 bp, Homo sapiens
tacatttgatgcatgtctt

SEQ ID NO: 2240583 - DNA, 12 bp, Homo sapiens
taccaactttac

SEQ ID NO: 2240584 - DNA, 14 bp, Homo sapiens
taccaactttactg

SEQ ID NO: 2240585 - DNA, 20 bp, Homo sapiens
taccatagtaccatttatac

SEQ ID NO: 2240586 - DNA, 17 bp, Homo sapiens
taccatttatacaaatt

SEQ ID NO: 2240587 - DNA, 15 bp, Homo sapiens
tacccccctctgtct

SEQ ID NO: 2240588 - DNA, 13 bp, Homo sapiens
taccctctcagct

SEQ ID NO: 2240589 - DNA, 17 bp, Homo sapiens
taccctctcagctccag

SEQ ID NO: 2240590 - DNA, 21 bp, Homo sapiens
taccctctcagctccaggtgg

SEQ ID NO: 2240591 - DNA, 19 bp, Homo sapiens
taccctttttctccagctg

SEQ ID NO: 2240592 - DNA, 16 bp, Homo sapiens
tacctcaggcagctca

SEQ ID NO: 2240593 - DNA, 18 bp, Homo sapiens
tacctcaggcagctcaag

SEQ ID NO: 2240594 - DNA, 23 bp, Homo sapiens
tacctcatttttcatactgaaaa

SEQ ID NO: 2240595 - DNA, 17 bp, Homo sapiens
tacctgattgtattttt

SEQ ID NO: 2240596 - DNA, 19 bp, Homo sapiens
tacctgtagattcaggtaa

SEQ ID NO: 2240597 - DNA, 14 bp, Homo sapiens
taccttcaaacttt

SEQ ID NO: 2240598 - DNA, 16 bp, Homo sapiens
taccttcaaactttag

SEQ ID NO: 2240599 - DNA, 11 bp, Homo sapiens
taccttgaaaa

SEQ ID NO: 2240600 - DNA, 20 bp, Homo sapiens
tacgatttaaggtatttaaa

SEQ ID NO: 2240601 - DNA, 21 bp, Homo sapiens
tacgggggcacttggaggacc

SEQ ID NO: 2240602 - DNA, 17 bp, Homo sapiens
tactacagtcaagatag

SEQ ID NO: 2240603 - DNA, 21 bp, Homo sapiens
tactacagtcaagatagaaag

SEQ ID NO: 2240604 - DNA, 13 bp, Homo sapiens
tactacctcttaa

SEQ ID NO: 2240605 - DNA, 14 bp, Homo sapiens
tactacctgtaatg

SEQ ID NO: 2240606 - DNA, 23 bp, Homo sapiens
tactactttgttaggattttcac

SEQ ID NO: 2240607 - DNA, 15 bp, Homo sapiens
tactaggtaacttca

SEQ ID NO: 2240608 - DNA, 21 bp, Homo sapiens
tactagtcaccagagacttta

SEQ ID NO: 2240609 - DNA, 22 bp, Homo sapiens
tactagtcaccagagactttag

SEQ ID NO: 2240610 - DNA, 22 bp, Homo sapiens
tactattcagtggcgagaaata

SEQ ID NO: 2240611 - DNA, 11 bp, Homo sapiens
tactatttaaa

SEQ ID NO: 2240612 - DNA, 21 bp, Homo sapiens
tactatttaaagcctcctcat

SEQ ID NO: 2240613 - DNA, 22 bp, Homo sapiens
tactatttaaagcctcctcatc

SEQ ID NO: 2240614 - DNA, 17 bp, Homo sapiens
tactatttaagatgtga

SEQ ID NO: 2240615 - DNA, 13 bp, Homo sapiens
tactcaatactac

SEQ ID NO: 2240616 - DNA, 20 bp, Homo sapiens
tactgaaaaaaaaagcttgt

SEQ ID NO: 2240617 - DNA, 18 bp, Homo sapiens
tactgaagccaaatgaaa

SEQ ID NO: 2240618 - DNA, 18 bp, Homo sapiens
tactgaagctttatttgc

SEQ ID NO: 2240619 - DNA, 19 bp, Homo sapiens
tactgaatgtcattgaaaa

SEQ ID NO: 2240620 - DNA, 14 bp, Homo sapiens
tactgacagggagc

SEQ ID NO: 2240621 - DNA, 15 bp, Homo sapiens
tactgcaagaaaatg

SEQ ID NO: 2240622 - DNA, 15 bp, Homo sapiens
tactgctactgtaat

SEQ ID NO: 2240623 - DNA, 15 bp, Homo sapiens
tactggttgactttc

SEQ ID NO: 2240624 - DNA, 12 bp, Homo sapiens
tactgtaatttt

SEQ ID NO: 2240625 - DNA, 15 bp, Homo sapiens
tactgtgtaaactca

SEQ ID NO: 2240626 - DNA, 17 bp, Homo sapiens
tactgtgtttcagcatg

SEQ ID NO: 2240627 - DNA, 15 bp, Homo sapiens
tacttatacacctta

SEQ ID NO: 2240628 - DNA, 20 bp, Homo sapiens
tacttattacatgctgctat

SEQ ID NO: 2240629 - DNA, 17 bp, Homo sapiens
tacttcaaaagtttgtt

SEQ ID NO: 2240630 - DNA, 19 bp, Homo sapiens
tacttcaagtaatacgttt

SEQ ID NO: 2240631 - DNA, 22 bp, Homo sapiens
tacttgcagcattcatttgttt

SEQ ID NO: 2240632 - DNA, 15 bp, Homo sapiens
tactttctctttttc

SEQ ID NO: 2240633 - DNA, 23 bp, Homo sapiens
tactttgtaaataggatttttag

SEQ ID NO: 2240634 - DNA, 19 bp, Homo sapiens
tactttgttaggattttca

SEQ ID NO: 2240635 - DNA, 18 bp, Homo sapiens
tacttttaaaaacataac

SEQ ID NO: 2240636 - DNA, 18 bp, Homo sapiens
tacttttttaaatatttt

SEQ ID NO: 2240637 - DNA, 20 bp, Homo sapiens
tacttttttaaatattttct

SEQ ID NO: 2240638 - DNA, 21 bp, Homo sapiens
tacttttttaaatattttcta

SEQ ID NO: 2240639 - DNA, 22 bp, Homo sapiens
tacttttttaaatattttctat

SEQ ID NO: 2240640 - DNA, 23 bp, Homo sapiens
tacttttttaaatattttctatt

SEQ ID NO: 2240641 - DNA, 19 bp, Homo sapiens
tccacgcagctggcagaga

SEQ ID NO: 2240642 - DNA, 18 bp, Homo sapiens
tccacgcctcctggccag

SEQ ID NO: 2240643 - DNA, 14 bp, Homo sapiens
tccactcgtgtgtt

SEQ ID NO: 2240644 - DNA, 15 bp, Homo sapiens
tccactcgtgtgttt

SEQ ID NO: 2240645 - DNA, 21 bp, Homo sapiens
tccactttcatctggggtggg

SEQ ID NO: 2240646 - DNA, 18 bp, Homo sapiens
tccagaaaacctctcctg

SEQ ID NO: 2240647 - DNA, 23 bp, Homo sapiens
tccagaaaacctctcctgacccc

SEQ ID NO: 2240648 - DNA, 15 bp, Homo sapiens
tccagaaaactgtga

SEQ ID NO: 2240649 - DNA, 14 bp, Homo sapiens
tccagacttcaaaa

SEQ ID NO: 2240650 - DNA, 17 bp, Homo sapiens
tccagacttcaaaagga

SEQ ID NO: 2240651 - DNA, 18 bp, Homo sapiens
tccagccacccccaggca

SEQ ID NO: 2240652 - DNA, 10 bp, Homo sapiens
tccagccagc

SEQ ID NO: 2240653 - DNA, 12 bp, Homo sapiens
tccagccagcgc

SEQ ID NO: 2240654 - DNA, 14 bp, Homo sapiens
tccagcctccaggg

SEQ ID NO: 2240655 - DNA, 17 bp, Homo sapiens
tccagcctccagggcat

SEQ ID NO: 2240656 - DNA, 13 bp, Homo sapiens
tccaggcaccagg

SEQ ID NO: 2240657 - DNA, 19 bp, Homo sapiens
tccaggctatgtataaaat

SEQ ID NO: 2240658 - DNA, 23 bp, Homo sapiens
tccagggcattgctcagcccgct

SEQ ID NO: 2240659 - DNA, 17 bp, Homo sapiens
tccagtgtccttagaac

SEQ ID NO: 2240660 - DNA, 13 bp, Homo sapiens
tccataaagaccc

SEQ ID NO: 2240661 - DNA, 16 bp, Homo sapiens
tccatagtttggcatt

SEQ ID NO: 2240662 - DNA, 14 bp, Homo sapiens
tccatctctggtaa

SEQ ID NO: 2240663 - DNA, 18 bp, Homo sapiens
tccatcttgagccacagt

SEQ ID NO: 2240664 - DNA, 16 bp, Homo sapiens
tccatgatgatagttg

SEQ ID NO: 2240665 - DNA, 16 bp, Homo sapiens
tcccaagttgtgcttg

SEQ ID NO: 2240666 - DNA, 13 bp, Homo sapiens
tcccacaggaggg

SEQ ID NO: 2240667 - DNA, 14 bp, Homo sapiens
tcccacaggagggc

SEQ ID NO: 2240668 - DNA, 14 bp, Homo sapiens
tcccaccccctcct

SEQ ID NO: 2240669 - DNA, 15 bp, Homo sapiens
tcccaccccctcctc

SEQ ID NO: 2240670 - DNA, 21 bp, Homo sapiens
tcccaccccctcctcccccag

SEQ ID NO: 2240671 - DNA, 16 bp, Homo sapiens
tcccaggaagcccagg

SEQ ID NO: 2240672 - DNA, 18 bp, Homo sapiens
tcccaggtttagtgaaaa

SEQ ID NO: 2240673 - DNA, 22 bp, Homo sapiens
tcccatgtagccccctggcctc

SEQ ID NO: 2240674 - DNA, 11 bp, Homo sapiens
tccccatgaca

SEQ ID NO: 2240675 - DNA, 13 bp, Homo sapiens
tccccatggagcc

SEQ ID NO: 2240676 - DNA, 19 bp, Homo sapiens
tccccccccaacctttccc

SEQ ID NO: 2240677 - DNA, 22 bp, Homo sapiens
tccccctcagatgatctctcca

SEQ ID NO: 2240678 - DNA, 15 bp, Homo sapiens
tccccctccttgtgc

SEQ ID NO: 2240679 - DNA, 18 bp, Homo sapiens
tccccctccttgtgcctt

SEQ ID NO: 2240680 - DNA, 20 bp, Homo sapiens
tccccctgcaaaaagaaaaa

SEQ ID NO: 2240681 - DNA, 14 bp, Homo sapiens
tccccgcctggcca

SEQ ID NO: 2240682 - DNA, 19 bp, Homo sapiens
tccccgcctggccaggagc

SEQ ID NO: 2240683 - DNA, 20 bp, Homo sapiens
tccccgcgccccagtcactt

SEQ ID NO: 2240684 - DNA, 22 bp, Homo sapiens
tccccgcgccccagtcacttcc

SEQ ID NO: 2240685 - DNA, 15 bp, Homo sapiens
tcccctaaagcctca

SEQ ID NO: 2240686 - DNA, 22 bp, Homo sapiens
tcccctaaagcctcaaaacaaa

SEQ ID NO: 2240687 - DNA, 15 bp, Homo sapiens
tcccctcacctcctc

SEQ ID NO: 2240688 - DNA, 14 bp, Homo sapiens
tcccctcactctgt

SEQ ID NO: 2240689 - DNA, 18 bp, Homo sapiens
tcccggaggttgggtggg

SEQ ID NO: 2240690 - DNA, 16 bp, Homo sapiens
tcccgttttccccatg

SEQ ID NO: 2240691 - DNA, 19 bp, Homo sapiens
tcccgttttccccatgaca

SEQ ID NO: 2240692 - DNA, 12 bp, Homo sapiens
tccctcaccccc

SEQ ID NO: 2240693 - DNA, 21 bp, Homo sapiens
tccctcagatcccagttcctt

SEQ ID NO: 2240694 - DNA, 13 bp, Homo sapiens
tccctccacccca

SEQ ID NO: 2240695 - DNA, 12 bp, Homo sapiens
tccctccccctc

SEQ ID NO: 2240696 - DNA, 14 bp, Homo sapiens
tccctccccctcct

SEQ ID NO: 2240697 - DNA, 17 bp, Homo sapiens
tccctccccctccttgt

SEQ ID NO: 2240698 - DNA, 14 bp, Homo sapiens
tccctcttctgccc

SEQ ID NO: 2240699 - DNA, 16 bp, Homo sapiens
tccctgactccctgtg

SEQ ID NO: 2240700 - DNA, 15 bp, Homo sapiens
tccctgatcccaccc

SEQ ID NO: 2240701 - DNA, 16 bp, Homo sapiens
tccctgggccaacaga

SEQ ID NO: 2240702 - DNA, 15 bp, Homo sapiens
tccctgggcccctcc

SEQ ID NO: 2240703 - DNA, 12 bp, Homo sapiens
tccctgtggggg

SEQ ID NO: 2240704 - DNA, 19 bp, Homo sapiens
tccctgtgggggtggccat

SEQ ID NO: 2240705 - DNA, 20 bp, Homo sapiens
tccctgtgggggtggccatc

SEQ ID NO: 2240706 - DNA, 21 bp, Homo sapiens
tccctgtgggggtggccatcc

SEQ ID NO: 2240707 - DNA, 18 bp, Homo sapiens
tcccttcagtaccctctc

SEQ ID NO: 2240708 - DNA, 21 bp, Homo sapiens
tcccttcagtaccctctcagc

SEQ ID NO: 2240709 - DNA, 16 bp, Homo sapiens
tcccttgctggcccca

SEQ ID NO: 2240710 - DNA, 17 bp, Homo sapiens
tcccttgctggccccag

SEQ ID NO: 2240711 - DNA, 21 bp, Homo sapiens
tccgcccacaggaagcctgca

SEQ ID NO: 2240712 - DNA, 14 bp, Homo sapiens
tccgcggctggagc

SEQ ID NO: 2240713 - DNA, 16 bp, Homo sapiens
tccgctgtcgccccag

SEQ ID NO: 2240714 - DNA, 18 bp, Homo sapiens
tccgctgtcgccccaggc

SEQ ID NO: 2240715 - DNA, 21 bp, Homo sapiens
tccgctgtcgccccaggccct

SEQ ID NO: 2240716 - DNA, 15 bp, Homo sapiens
tccgggtgtggcctc

SEQ ID NO: 2240717 - DNA, 17 bp, Homo sapiens
tccgggtgtggcctcag

SEQ ID NO: 2240718 - DNA, 18 bp, Homo sapiens
tccgggtgtggcctcagc

SEQ ID NO: 2240719 - DNA, 22 bp, Homo sapiens
tccgggtgtggcctcagccctc

SEQ ID NO: 2240720 - DNA, 17 bp, Homo sapiens
tcctaaaacacctggta

SEQ ID NO: 2240721 - DNA, 21 bp, Homo sapiens
tcctacagagccaaaatgcca

SEQ ID NO: 2240722 - DNA, 23 bp, Homo sapiens
tcctagtgagtgtgctgactttt

SEQ ID NO: 2240723 - DNA, 14 bp, Homo sapiens
tcctatatatttct

SEQ ID NO: 2240724 - DNA, 16 bp, Homo sapiens
tcctatatatttctat

SEQ ID NO: 2240725 - DNA, 17 bp, Homo sapiens
tcctatatatttctatt

SEQ ID NO: 2240726 - DNA, 15 bp, Homo sapiens
tcctcaacagtgttt

SEQ ID NO: 2240727 - DNA, 23 bp, Homo sapiens
tcctcataaaaagcaaaacaaaa

SEQ ID NO: 2240728 - DNA, 14 bp, Homo sapiens
tcctcatcccgtgt

SEQ ID NO: 2240729 - DNA, 23 bp, Homo sapiens
tcctcatgtcttctcacaagcca

SEQ ID NO: 2240730 - DNA, 11 bp, Homo sapiens
tcctccacaga

SEQ ID NO: 2240731 - DNA, 13 bp, Homo sapiens
tcctccacagaga

SEQ ID NO: 2240732 - DNA, 15 bp, Homo sapiens
tcctccttcactgtt

SEQ ID NO: 2240733 - DNA, 15 bp, Homo sapiens
tcctctagctgtggg

SEQ ID NO: 2240734 - DNA, 20 bp, Homo sapiens
tcctctccctctctcttttc

SEQ ID NO: 2240735 - DNA, 13 bp, Homo sapiens
tcctctcgagccc

SEQ ID NO: 2240736 - DNA, 16 bp, Homo sapiens
tcctctcgagcccaga

SEQ ID NO: 2240737 - DNA, 17 bp, Homo sapiens
tcctctcgagcccagat

SEQ ID NO: 2240738 - DNA, 14 bp, Homo sapiens
tcctctctccagat

SEQ ID NO: 2240739 - DNA, 19 bp, Homo sapiens
tcctctctccagatgtttc

SEQ ID NO: 2240740 - DNA, 21 bp, Homo sapiens
tcctctgtttagaacaccaaa

SEQ ID NO: 2240741 - DNA, 12 bp, Homo sapiens
tcctctttgtaa

SEQ ID NO: 2240742 - DNA, 14 bp, Homo sapiens
tcctgacattgtct

SEQ ID NO: 2240743 - DNA, 15 bp, Homo sapiens
tcctgacccctgcct

SEQ ID NO: 2240744 - DNA, 17 bp, Homo sapiens
tcctgcaggcaggaaca

SEQ ID NO: 2240745 - DNA, 13 bp, Homo sapiens
tcctgcccatgtg

SEQ ID NO: 2240746 - DNA, 13 bp, Homo sapiens
tcctgcctaaggt

SEQ ID NO: 2240747 - DNA, 14 bp, Homo sapiens
tcctgcgggtttta

SEQ ID NO: 2240748 - DNA, 18 bp, Homo sapiens
tcctggagcagaccaccc

SEQ ID NO: 2240749 - DNA, 19 bp, Homo sapiens
tcctggaggggctggggac

SEQ ID NO: 2240750 - DNA, 13 bp, Homo sapiens
tcctgggggtggc

SEQ ID NO: 2240751 - DNA, 18 bp, Homo sapiens
tcctgggggtggcaggca

SEQ ID NO: 2240752 - DNA, 15 bp, Homo sapiens
tagaaaaataaaaat

SEQ ID NO: 2240753 - DNA, 13 bp, Homo sapiens
tagaaaatattct

SEQ ID NO: 2240754 - DNA, 16 bp, Homo sapiens
tagaaaatattctcta

SEQ ID NO: 2240755 - DNA, 18 bp, Homo sapiens
tagaaaatattctctatt

SEQ ID NO: 2240756 - DNA, 17 bp, Homo sapiens
tagaaagaccaggccaa

SEQ ID NO: 2240757 - DNA, 13 bp, Homo sapiens
tagaaagcagtta

SEQ ID NO: 2240758 - DNA, 16 bp, Homo sapiens
tagaaatggaaatttt

SEQ ID NO: 2240759 - DNA, 17 bp, Homo sapiens
tagaaatggaaattttg

SEQ ID NO: 2240760 - DNA, 23 bp, Homo sapiens
tagaacaccaaagataaggacta

SEQ ID NO: 2240761 - DNA, 16 bp, Homo sapiens
tagaagtttggctgct

SEQ ID NO: 2240762 - DNA, 21 bp, Homo sapiens
tagaagtttggctgctgtcat

SEQ ID NO: 2240763 - DNA, 23 bp, Homo sapiens
tagaatagtgttctgcaaaaata

SEQ ID NO: 2240764 - DNA, 14 bp, Homo sapiens
tagaatcaatttaa

SEQ ID NO: 2240765 - DNA, 23 bp, Homo sapiens
tagaatccaaacttggatttttg

SEQ ID NO: 2240766 - DNA, 15 bp, Homo sapiens
tagaattatttaaac

SEQ ID NO: 2240767 - DNA, 16 bp, Homo sapiens
tagaattatttaaaca

SEQ ID NO: 2240768 - DNA, 21 bp, Homo sapiens
tagacctataatccttgataa

SEQ ID NO: 2240769 - DNA, 14 bp, Homo sapiens
tagactataaatgt

SEQ ID NO: 2240770 - DNA, 22 bp, Homo sapiens
tagactataaatgttgctatgt

SEQ ID NO: 2240771 - DNA, 22 bp, Homo sapiens
tagactctgtctacctggtctg

SEQ ID NO: 2240772 - DNA, 23 bp, Homo sapiens
tagagagcatctgcaacaaaaag

SEQ ID NO: 2240773 - DNA, 13 bp, Homo sapiens
tagatactacttt

SEQ ID NO: 2240774 - DNA, 17 bp, Homo sapiens
tagatactactttctct

SEQ ID NO: 2240775 - DNA, 20 bp, Homo sapiens
tagatactactttctctttt

SEQ ID NO: 2240776 - DNA, 13 bp, Homo sapiens
tagatataatgaa

SEQ ID NO: 2240777 - DNA, 20 bp, Homo sapiens
tagatataatgaacaaaatt

SEQ ID NO: 2240778 - DNA, 17 bp, Homo sapiens
tagattatggagctttt

SEQ ID NO: 2240779 - DNA, 12 bp, Homo sapiens
tagatttctaca

SEQ ID NO: 2240780 - DNA, 14 bp, Homo sapiens
tagcaacaacagaa

SEQ ID NO: 2240781 - DNA, 11 bp, Homo sapiens
tagcagagtct

SEQ ID NO: 2240782 - DNA, 14 bp, Homo sapiens
tagcagagtctgtc

SEQ ID NO: 2240783 - DNA, 15 bp, Homo sapiens
tagctacactgagca

SEQ ID NO: 2240784 - DNA, 22 bp, Homo sapiens
tagctggctctgtgagggtgct

SEQ ID NO: 2240785 - DNA, 20 bp, Homo sapiens
tagctttttaattaagcaaa

SEQ ID NO: 2240786 - DNA, 14 bp, Homo sapiens
taggactgttcttt

SEQ ID NO: 2240787 - DNA, 14 bp, Homo sapiens
taggagggagacac

SEQ ID NO: 2240788 - DNA, 18 bp, Homo sapiens
taggatagctaactgtaa

SEQ ID NO: 2240789 - DNA, 19 bp, Homo sapiens
taggatgtatattttatat

SEQ ID NO: 2240790 - DNA, 23 bp, Homo sapiens
taggatgtatattttatataaag

SEQ ID NO: 2240791 - DNA, 13 bp, Homo sapiens
taggatttttaga

SEQ ID NO: 2240792 - DNA, 16 bp, Homo sapiens
taggcagggggccctg

SEQ ID NO: 2240793 - DNA, 23 bp, Homo sapiens
tagggatcaaccagctaagaaaa

SEQ ID NO: 2240794 - DNA, 11 bp, Homo sapiens
taggtattttg

SEQ ID NO: 2240795 - DNA, 12 bp, Homo sapiens
taggtgattcta

SEQ ID NO: 2240796 - DNA, 15 bp, Homo sapiens
tagtaagttaatgta

SEQ ID NO: 2240797 - DNA, 20 bp, Homo sapiens
tagtaccatttatacaaatt

SEQ ID NO: 2240798 - DNA, 14 bp, Homo sapiens
tagtacttattaca

SEQ ID NO: 2240799 - DNA, 22 bp, Homo sapiens
tagtcaaaactatttttgtaaa

SEQ ID NO: 2240800 - DNA, 13 bp, Homo sapiens
tagtcaaacaaaa

SEQ ID NO: 2240801 - DNA, 15 bp, Homo sapiens
tagtcaatcactgca

SEQ ID NO: 2240802 - DNA, 23 bp, Homo sapiens
tagtcattgttgttttaacctcc

SEQ ID NO: 2240803 - DNA, 19 bp, Homo sapiens
tagtctcactgcttgaact

SEQ ID NO: 2240804 - DNA, 21 bp, Homo sapiens
tagtctcttgtattaaactct

SEQ ID NO: 2240805 - DNA, 22 bp, Homo sapiens
tagtcttgaaatgaaagggaaa

SEQ ID NO: 2240806 - DNA, 18 bp, Homo sapiens
tagtctttgccagtcatt

SEQ ID NO: 2240807 - DNA, 20 bp, Homo sapiens
tagtgaaaattgtttagtga

SEQ ID NO: 2240808 - DNA, 17 bp, Homo sapiens
tagtgatcaagaagact

SEQ ID NO: 2240809 - DNA, 16 bp, Homo sapiens
tagtggaaaataggct

SEQ ID NO: 2240810 - DNA, 19 bp, Homo sapiens
tagtgtattatcactgtct

SEQ ID NO: 2240811 - DNA, 17 bp, Homo sapiens
tagttactgtgtaaact

SEQ ID NO: 2240812 - DNA, 21 bp, Homo sapiens
tagttactgtgtaaactcatc

SEQ ID NO: 2240813 - DNA, 21 bp, Homo sapiens
tagttccagaaaacctctcct

SEQ ID NO: 2240814 - DNA, 22 bp, Homo sapiens
tattttgaatcaataatatatt

SEQ ID NO: 2240815 - DNA, 23 bp, Homo sapiens
tattttgaatcaataatatattt

SEQ ID NO: 2240816 - DNA, 17 bp, Homo sapiens
tattttgatgtaaagat

SEQ ID NO: 2240817 - DNA, 18 bp, Homo sapiens
tatttttcaataaagcat

SEQ ID NO: 2240818 - DNA, 14 bp, Homo sapiens
tatttttgtacgtt

SEQ ID NO: 2240819 - DNA, 19 bp, Homo sapiens
tcaaaacacactactacct

SEQ ID NO: 2240820 - DNA, 21 bp, Homo sapiens
tcaaaacacactactacctct

SEQ ID NO: 2240821 - DNA, 23 bp, Homo sapiens
tcaaaacacactactacctctta

SEQ ID NO: 2240822 - DNA, 14 bp, Homo sapiens
tcaaaagtttgttt

SEQ ID NO: 2240823 - DNA, 13 bp, Homo sapiens
tcaaaattacata

SEQ ID NO: 2240824 - DNA, 14 bp, Homo sapiens
tcaaactggggcct

SEQ ID NO: 2240825 - DNA, 23 bp, Homo sapiens
tcaaactggggcctccagaactc

SEQ ID NO: 2240826 - DNA, 16 bp, Homo sapiens
tcaaagaaacttgaag

SEQ ID NO: 2240827 - DNA, 15 bp, Homo sapiens
tcaaagaagtcggaa

SEQ ID NO: 2240828 - DNA, 14 bp, Homo sapiens
tcaaagatttttat

SEQ ID NO: 2240829 - DNA, 17 bp, Homo sapiens
tcaaagggataaagaaa

SEQ ID NO: 2240830 - DNA, 14 bp, Homo sapiens
tcaaagttgaaaat

SEQ ID NO: 2240831 - DNA, 21 bp, Homo sapiens
tcaaatacatttaaaacatta

SEQ ID NO: 2240832 - DNA, 22 bp, Homo sapiens
tcaaattaataatcttattagg

SEQ ID NO: 2240833 - DNA, 17 bp, Homo sapiens
tcaacaataaaattttt

SEQ ID NO: 2240834 - DNA, 21 bp, Homo sapiens
tcaacagtcttgctgaattaa

SEQ ID NO: 2240835 - DNA, 19 bp, Homo sapiens
tcaacctcttctggctcaa

SEQ ID NO: 2240836 - DNA, 19 bp, Homo sapiens
tcaacctggtggcaccaga

SEQ ID NO: 2240837 - DNA, 13 bp, Homo sapiens
tcaactattctgt

SEQ ID NO: 2240838 - DNA, 19 bp, Homo sapiens
tcaagatactgctactgta

SEQ ID NO: 2240839 - DNA, 21 bp, Homo sapiens
tcaagatactgctactgtaat

SEQ ID NO: 2240840 - DNA, 22 bp, Homo sapiens
tcaagatactgctactgtaatt

SEQ ID NO: 2240841 - DNA, 13 bp, Homo sapiens
tcaagatagaaag

SEQ ID NO: 2240842 - DNA, 20 bp, Homo sapiens
tcaagattttttttgtaact

SEQ ID NO: 2240843 - DNA, 21 bp, Homo sapiens
tcaagcagcgaccgccccctc

SEQ ID NO: 2240844 - DNA, 11 bp, Homo sapiens
tcaaggctcag

SEQ ID NO: 2240845 - DNA, 15 bp, Homo sapiens
tcaagtgattctctt

SEQ ID NO: 2240846 - DNA, 15 bp, Homo sapiens
tcaataaagcattta

SEQ ID NO: 2240847 - DNA, 17 bp, Homo sapiens
tcaataacctttcactt

SEQ ID NO: 2240848 - DNA, 15 bp, Homo sapiens
tcaataatatatttt

SEQ ID NO: 2240849 - DNA, 18 bp, Homo sapiens
tcaataatatattttctg

SEQ ID NO: 2240850 - DNA, 17 bp, Homo sapiens
tcaatactacctctgaa

SEQ ID NO: 2240851 - DNA, 12 bp, Homo sapiens
tcaatatttaag

SEQ ID NO: 2240852 - DNA, 17 bp, Homo sapiens
tcaatatttaagtttgt

SEQ ID NO: 2240853 - DNA, 16 bp, Homo sapiens
tcaatgtgtataaatt

SEQ ID NO: 2240854 - DNA, 22 bp, Homo sapiens
tcaatgtgtataaattgtcttt

SEQ ID NO: 2240855 - DNA, 16 bp, Homo sapiens
tcaatgtgtctttcta

SEQ ID NO: 2240856 - DNA, 23 bp, Homo sapiens
tcaatgtttgaaatagttcaaac

SEQ ID NO: 2240857 - DNA, 13 bp, Homo sapiens
tcaattgtaaatt

SEQ ID NO: 2240858 - DNA, 14 bp, Homo sapiens
tcaattgtaaattg

SEQ ID NO: 2240859 - DNA, 18 bp, Homo sapiens
tcaattgtaaattgaatc

SEQ ID NO: 2240860 - DNA, 17 bp, Homo sapiens
tcaatttaaaaagcaaa

SEQ ID NO: 2240861 - DNA, 20 bp, Homo sapiens
tcaatttaaaaagcaaaaaa

SEQ ID NO: 2240862 - DNA, 23 bp, Homo sapiens
tcacaacaactcatttttacaga

SEQ ID NO: 2240863 - DNA, 14 bp, Homo sapiens
tcacacaagatttg

SEQ ID NO: 2240864 - DNA, 18 bp, Homo sapiens
tctgcaattcccctctgc

SEQ ID NO: 2240865 - DNA, 21 bp, Homo sapiens
tctgcaattcccctctgctgc

SEQ ID NO: 2240866 - DNA, 15 bp, Homo sapiens
tctgccccctccccc

SEQ ID NO: 2240867 - DNA, 13 bp, Homo sapiens
tctgctgtagaaa

SEQ ID NO: 2240868 - DNA, 22 bp, Homo sapiens
tctgctgtctcatcacataaaa

SEQ ID NO: 2240869 - DNA, 13 bp, Homo sapiens
tctgctgttaact

SEQ ID NO: 2240870 - DNA, 13 bp, Homo sapiens
tctgcttttatct

SEQ ID NO: 2240871 - DNA, 18 bp, Homo sapiens
tctggacccttataaaat

SEQ ID NO: 2240872 - DNA, 15 bp, Homo sapiens
tctggagaccaggga

SEQ ID NO: 2240873 - DNA, 15 bp, Homo sapiens
tctggagcatttctc

SEQ ID NO: 2240874 - DNA, 21 bp, Homo sapiens
tctggccctggggatcttccc

SEQ ID NO: 2240875 - DNA, 18 bp, Homo sapiens
tctggggcaggctgggcc

SEQ ID NO: 2240876 - DNA, 21 bp, Homo sapiens
tctggggcaggctgggccatg

SEQ ID NO: 2240877 - DNA, 13 bp, Homo sapiens
tctggggccctgg

SEQ ID NO: 2240878 - DNA, 15 bp, Homo sapiens
tctggggccctgggc

SEQ ID NO: 2240879 - DNA, 21 bp, Homo sapiens
tctggtaaagttacactttta

SEQ ID NO: 2240880 - DNA, 12 bp, Homo sapiens
tctgtacctcaa

SEQ ID NO: 2240881 - DNA, 13 bp, Homo sapiens
tctgtacctcaaa

SEQ ID NO: 2240882 - DNA, 20 bp, Homo sapiens
tctgtacttttcattctctt

SEQ ID NO: 2240883 - DNA, 17 bp, Homo sapiens
tctgtataatctattta

SEQ ID NO: 2240884 - DNA, 20 bp, Homo sapiens
tctgtatttaatggttttta

SEQ ID NO: 2240885 - DNA, 18 bp, Homo sapiens
tctgtcacagtaaaaata

SEQ ID NO: 2240886 - DNA, 19 bp, Homo sapiens
tctgtcacagtaaaaataa

SEQ ID NO: 2240887 - DNA, 20 bp, Homo sapiens
tctgtcacagtaaaaataaa

SEQ ID NO: 2240888 - DNA, 17 bp, Homo sapiens
tctgtcagccagccgcc

SEQ ID NO: 2240889 - DNA, 22 bp, Homo sapiens
tctgtcagccagccgccctggg

SEQ ID NO: 2240890 - DNA, 17 bp, Homo sapiens
tctgtcatctctctggg

SEQ ID NO: 2240891 - DNA, 22 bp, Homo sapiens
tctgtcatctctctggggccct

SEQ ID NO: 2240892 - DNA, 22 bp, Homo sapiens
tctgtgccttcttttgattatg

SEQ ID NO: 2240893 - DNA, 19 bp, Homo sapiens
tctgtggaggtggaaaagc

SEQ ID NO: 2240894 - DNA, 15 bp, Homo sapiens
tctgtgtctttctct

SEQ ID NO: 2240895 - DNA, 19 bp, Homo sapiens
tctgttacactttttggaa

SEQ ID NO: 2240896 - DNA, 16 bp, Homo sapiens
tctgttagcagagtct

SEQ ID NO: 2240897 - DNA, 20 bp, Homo sapiens
tctgtttcctgacattgtct

SEQ ID NO: 2240898 - DNA, 13 bp, Homo sapiens
tcttaagtcccag

SEQ ID NO: 2240899 - DNA, 23 bp, Homo sapiens
tcttaagtcccagtatacctcat

SEQ ID NO: 2240900 - DNA, 14 bp, Homo sapiens
tcttaattattata

SEQ ID NO: 2240901 - DNA, 19 bp, Homo sapiens
tcttaattattataaaaat

SEQ ID NO: 2240902 - DNA, 20 bp, Homo sapiens
tcttaattattataaaaata

SEQ ID NO: 2240903 - DNA, 22 bp, Homo sapiens
tcttaattattataaaaatatt

SEQ ID NO: 2240904 - DNA, 20 bp, Homo sapiens
tcttaattattatttgtgtt

SEQ ID NO: 2240905 - DNA, 18 bp, Homo sapiens
tcttagctatccttggct

SEQ ID NO: 2240906 - DNA, 21 bp, Homo sapiens
tcttatgctctcactgtttgt

SEQ ID NO: 2240907 - DNA, 17 bp, Homo sapiens
tcttatgtagagttttt

SEQ ID NO: 2240908 - DNA, 21 bp, Homo sapiens
tcttcaaatgggagactcttt

SEQ ID NO: 2240909 - DNA, 20 bp, Homo sapiens
tcttccagctgcttcaggga

SEQ ID NO: 2240910 - DNA, 14 bp, Homo sapiens
tcttcccacaggag

SEQ ID NO: 2240911 - DNA, 18 bp, Homo sapiens
tcttctctgtgagaaggt

SEQ ID NO: 2240912 - DNA, 19 bp, Homo sapiens
tcttctcttccttttatca

SEQ ID NO: 2240913 - DNA, 12 bp, Homo sapiens
tcttctggctca

SEQ ID NO: 2240914 - DNA, 21 bp, Homo sapiens
tcttctggggcaggctgggcc

SEQ ID NO: 2240915 - DNA, 19 bp, Homo sapiens
tcttgctgaattaagcaga

SEQ ID NO: 2240916 - DNA, 15 bp, Homo sapiens
tcttggcttaatcat

SEQ ID NO: 2240917 - DNA, 16 bp, Homo sapiens
tcttggtgactgtccc

SEQ ID NO: 2240918 - DNA, 15 bp, Homo sapiens
tctttaataaataac

SEQ ID NO: 2240919 - DNA, 19 bp, Homo sapiens
tctttattttcttctccag

SEQ ID NO: 2240920 - DNA, 14 bp, Homo sapiens
tctttcacagctcc

SEQ ID NO: 2240921 - DNA, 19 bp, Homo sapiens
tctttcacagctcctccca

SEQ ID NO: 2240922 - DNA, 22 bp, Homo sapiens
tctttcaggaatacttggacct

SEQ ID NO: 2240923 - DNA, 21 bp, Homo sapiens
tctttcagtacttttttaaat

SEQ ID NO: 2240924 - DNA, 18 bp, Homo sapiens
tctttccaaattatttct

SEQ ID NO: 2240925 - DNA, 20 bp, Homo sapiens
tctttccaaattatttctta

SEQ ID NO: 2240926 - DNA, 23 bp, Homo sapiens
tctttccaggctatgtataaaat

SEQ ID NO: 2240927 - DNA, 15 bp, Homo sapiens
tctttctcaaagaaa

SEQ ID NO: 2240928 - DNA, 15 bp, Homo sapiens
tctttctctctctct

SEQ ID NO: 2240929 - DNA, 18 bp, Homo sapiens
tctttctttccaaaacat

SEQ ID NO: 2240930 - DNA, 17 bp, Homo sapiens
tctttgatccagaggtg

SEQ ID NO: 2240931 - DNA, 15 bp, Homo sapiens
tctttgcaccaaaga

SEQ ID NO: 2240932 - DNA, 22 bp, Homo sapiens
tctttggctcccctgtaccttt

SEQ ID NO: 2240933 - DNA, 23 bp, Homo sapiens
tctttgtgacaggaaagccctcc

SEQ ID NO: 2240934 - DNA, 21 bp, Homo sapiens
tcttttaatgaggaccaatgt

SEQ ID NO: 2240935 - DNA, 12 bp, Homo sapiens
tcttttattctt

SEQ ID NO: 2240936 - DNA, 23 bp, Homo sapiens
tcttttgaagggagaagacactg

SEQ ID NO: 2240937 - DNA, 16 bp, Homo sapiens
tcttttgattatgttt

SEQ ID NO: 2240938 - DNA, 22 bp, Homo sapiens
tcttttggtaaagactggcttt

SEQ ID NO: 2240939 - DNA, 20 bp, Homo sapiens
tgaaaaaatttaaaagtaaa

SEQ ID NO: 2240940 - DNA, 16 bp, Homo sapiens
tgaaaaactgctgtaa

SEQ ID NO: 2240941 - DNA, 19 bp, Homo sapiens
tgaaaaactgctgtaaaca

SEQ ID NO: 2240942 - DNA, 19 bp, Homo sapiens
tgaaaacagtgtgtaaaca

SEQ ID NO: 2240943 - DNA, 16 bp, Homo sapiens
tgaaaactaaggattt

SEQ ID NO: 2240944 - DNA, 17 bp, Homo sapiens
tgaaaactaaggatttt

SEQ ID NO: 2240945 - DNA, 18 bp, Homo sapiens
tgaaaaggtacaacagaa

SEQ ID NO: 2240946 - DNA, 16 bp, Homo sapiens
tgaaaatattgtttta

SEQ ID NO: 2240947 - DNA, 20 bp, Homo sapiens
tgaaaatattgttttacaat

SEQ ID NO: 2240948 - DNA, 15 bp, Homo sapiens
tgaaaatatttctct

SEQ ID NO: 2240949 - DNA, 16 bp, Homo sapiens
tgaaaatatttctcta

SEQ ID NO: 2240950 - DNA, 23 bp, Homo sapiens
tgaaaccccaaacagtgactgta

SEQ ID NO: 2240951 - DNA, 18 bp, Homo sapiens
tgaaactcatagacactg

SEQ ID NO: 2240952 - DNA, 17 bp, Homo sapiens
tgaaactccagatgcca

SEQ ID NO: 2240953 - DNA, 14 bp, Homo sapiens
tgaaagacctgaat

SEQ ID NO: 2240954 - DNA, 12 bp, Homo sapiens
tgaaagggaaac

SEQ ID NO: 2240955 - DNA, 16 bp, Homo sapiens
tgaaagggaaactggg

SEQ ID NO: 2240956 - DNA, 20 bp, Homo sapiens
tgaaagggaaactgggaaac

SEQ ID NO: 2240957 - DNA, 20 bp, Homo sapiens
tgaaagttaactcttcaaat

SEQ ID NO: 2240958 - DNA, 18 bp, Homo sapiens
tgaaatatattatttcct

SEQ ID NO: 2240959 - DNA, 14 bp, Homo sapiens
tgaaatgaaaggga

SEQ ID NO: 2240960 - DNA, 15 bp, Homo sapiens
tgaaatgaaagggaa

SEQ ID NO: 2240961 - DNA, 16 bp, Homo sapiens
tgaaatgaaagggaaa

SEQ ID NO: 2240962 - DNA, 20 bp, Homo sapiens
tgaaatgtgaatttttattg

SEQ ID NO: 2240963 - DNA, 13 bp, Homo sapiens
tgaaatgttacaa

SEQ ID NO: 2240964 - DNA, 20 bp, Homo sapiens
tgaacattggttctttcatt

SEQ ID NO: 2240965 - DNA, 19 bp, Homo sapiens
tgaaccctaaggtgagtgt

SEQ ID NO: 2240966 - DNA, 17 bp, Homo sapiens
tgaactaggctgagcaa

SEQ ID NO: 2240967 - DNA, 17 bp, Homo sapiens
tgaactttccaaaacct

SEQ ID NO: 2240968 - DNA, 16 bp, Homo sapiens
tgaagaacatctggag

SEQ ID NO: 2240969 - DNA, 23 bp, Homo sapiens
tgaagataagtgtatttttcaat

SEQ ID NO: 2240970 - DNA, 17 bp, Homo sapiens
tgaagatccagctgcct

SEQ ID NO: 2240971 - DNA, 16 bp, Homo sapiens
tgaagccaaatgaaac

SEQ ID NO: 2240972 - DNA, 19 bp, Homo sapiens
tgaagccaaatgaaactca

SEQ ID NO: 2240973 - DNA, 21 bp, Homo sapiens
agaactcgcgctcagtaaacg

SEQ ID NO: 2240974 - DNA, 20 bp, Homo sapiens
agaagaactgtgtttcaagt

SEQ ID NO: 2240975 - DNA, 13 bp, Homo sapiens
agaagacactgca

SEQ ID NO: 2240976 - DNA, 14 bp, Homo sapiens
agaagacactgcag

SEQ ID NO: 2240977 - DNA, 14 bp, Homo sapiens
agaaggtttattgt

SEQ ID NO: 2240978 - DNA, 16 bp, Homo sapiens
agaatcaatttaagtg

SEQ ID NO: 2240979 - DNA, 12 bp, Homo sapiens
agaatccaaact

SEQ ID NO: 2240980 - DNA, 19 bp, Homo sapiens
agaatgtgtctcaggaaaa

SEQ ID NO: 2240981 - DNA, 21 bp, Homo sapiens
agaattaaaactcaacattac

SEQ ID NO: 2240982 - DNA, 20 bp, Homo sapiens
agaattcaaactggggcctc

SEQ ID NO: 2240983 - DNA, 14 bp, Homo sapiens
agaatttagtatta

SEQ ID NO: 2240984 - DNA, 16 bp, Homo sapiens
agaatttagtattatc

SEQ ID NO: 2240985 - DNA, 19 bp, Homo sapiens
agaatttagtattatcaaa

SEQ ID NO: 2240986 - DNA, 21 bp, Homo sapiens
agacacatacatgtcacattt

SEQ ID NO: 2240987 - DNA, 22 bp, Homo sapiens
agacagcccaggatactggcac

SEQ ID NO: 2240988 - DNA, 14 bp, Homo sapiens
agacatcagtctcc

SEQ ID NO: 2240989 - DNA, 23 bp, Homo sapiens
agacatcagtctccaacatgttt

SEQ ID NO: 2240990 - DNA, 20 bp, Homo sapiens
agacatgaattttaaataat

SEQ ID NO: 2240991 - DNA, 22 bp, Homo sapiens
agacattttaaaaaatggtcac

SEQ ID NO: 2240992 - DNA, 14 bp, Homo sapiens
agaccaccccgcct

SEQ ID NO: 2240993 - DNA, 16 bp, Homo sapiens
agaccaccccgcctgc

SEQ ID NO: 2240994 - DNA, 21 bp, Homo sapiens
agacccttattgctgtcctgg

SEQ ID NO: 2240995 - DNA, 19 bp, Homo sapiens
agacctacctccagacttc

SEQ ID NO: 2240996 - DNA, 16 bp, Homo sapiens
agacggtgttttgcca

SEQ ID NO: 2240997 - DNA, 21 bp, Homo sapiens
agacggtgttttgccatgttg

SEQ ID NO: 2240998 - DNA, 15 bp, Homo sapiens
agacgtttaactgca

SEQ ID NO: 2240999 - DNA, 15 bp, Homo sapiens
agactccagctgtga

SEQ ID NO: 2241000 - DNA, 20 bp, Homo sapiens
agagaagccacgctgtcctc

SEQ ID NO: 2241001 - DNA, 14 bp, Homo sapiens
agagacagcccagg

SEQ ID NO: 2241002 - DNA, 18 bp, Homo sapiens
agagacagcccaggatac

SEQ ID NO: 2241003 - DNA, 13 bp, Homo sapiens
agagagccaagac

SEQ ID NO: 2241004 - DNA, 15 bp, Homo sapiens
agagccagcctggct

SEQ ID NO: 2241005 - DNA, 20 bp, Homo sapiens
agagccagcctggctctgcc

SEQ ID NO: 2241006 - DNA, 22 bp, Homo sapiens
agagccagcctggctctgcccc

SEQ ID NO: 2241007 - DNA, 23 bp, Homo sapiens
agagccagcctggctctgccccc

SEQ ID NO: 2241008 - DNA, 18 bp, Homo sapiens
agagccctgaggcctaga

SEQ ID NO: 2241009 - DNA, 23 bp, Homo sapiens
agagccgggaggaaaaggcccct

SEQ ID NO: 2241010 - DNA, 21 bp, Homo sapiens
agaggagtaaataattggaaa

SEQ ID NO: 2241011 - DNA, 16 bp, Homo sapiens
agaggcggcctcgtgc

SEQ ID NO: 2241012 - DNA, 12 bp, Homo sapiens
agaggctgcccc

SEQ ID NO: 2241013 - DNA, 21 bp, Homo sapiens
agagtctaatagtctttgcca

SEQ ID NO: 2241014 - DNA, 13 bp, Homo sapiens
agagtctgtctct

SEQ ID NO: 2241015 - DNA, 21 bp, Homo sapiens
agagtttttatgcctttctct

SEQ ID NO: 2241016 - DNA, 22 bp, Homo sapiens
agataaggactagatactactt

SEQ ID NO: 2241017 - DNA, 16 bp, Homo sapiens
agataagtgtattttt

SEQ ID NO: 2241018 - DNA, 18 bp, Homo sapiens
agatactactttctcttt

SEQ ID NO: 2241019 - DNA, 19 bp, Homo sapiens
agatactactttctctttt

SEQ ID NO: 2241020 - DNA, 19 bp, Homo sapiens
agatactgctactgtaatt

SEQ ID NO: 2241021 - DNA, 20 bp, Homo sapiens
agatagaaagggtgctgcca

SEQ ID NO: 2241022 - DNA, 16 bp, Homo sapiens
agatataatgaacaaa

SEQ ID NO: 2241023 - DNA, 19 bp, Homo sapiens
agatataatgaacaaaatt

SEQ ID NO: 2241024 - DNA, 21 bp, Homo sapiens
agatataatgaacaaaattat

SEQ ID NO: 2241025 - DNA, 11 bp, Homo sapiens
agatatactgg

SEQ ID NO: 2241026 - DNA, 19 bp, Homo sapiens
agatatactggaacccttt

SEQ ID NO: 2241027 - DNA, 12 bp, Homo sapiens
agatatttttgt

SEQ ID NO: 2241028 - DNA, 17 bp, Homo sapiens
agatatttttgtacgtt

SEQ ID NO: 2241029 - DNA, 23 bp, Homo sapiens
agatatttttgtacgttatatat

SEQ ID NO: 2241030 - DNA, 18 bp, Homo sapiens
agatcgctcactgttgtg

SEQ ID NO: 2241031 - DNA, 22 bp, Homo sapiens
agatctcggtttgccaaaattc

SEQ ID NO: 2241032 - DNA, 20 bp, Homo sapiens
agatctttctttccaaaaca

SEQ ID NO: 2241033 - DNA, 21 bp, Homo sapiens
agatctttctttccaaaacat

SEQ ID NO: 2241034 - DNA, 17 bp, Homo sapiens
agatgacaaaccataac

SEQ ID NO: 2241035 - DNA, 22 bp, Homo sapiens
agatgatctctccacggtagca

SEQ ID NO: 2241036 - DNA, 19 bp, Homo sapiens
agatgcacgtggggcccac

SEQ ID NO: 2241037 - DNA, 22 bp, Homo sapiens
agatgcacgtggggcccactgc

SEQ ID NO: 2241038 - DNA, 14 bp, Homo sapiens
agatggcactttga

SEQ ID NO: 2241039 - DNA, 14 bp, Homo sapiens
agatgtaattttgt

SEQ ID NO: 2241040 - DNA, 15 bp, Homo sapiens
agatgttaaaataaa

SEQ ID NO: 2241041 - DNA, 17 bp, Homo sapiens
agatgttaaaataaatg

SEQ ID NO: 2241042 - DNA, 21 bp, Homo sapiens
agatgtttccagacttccttg

SEQ ID NO: 2241043 - DNA, 23 bp, Homo sapiens
agatgtttccagacttccttgag

SEQ ID NO: 2241044 - DNA, 18 bp, Homo sapiens
agattaaatgtgtcattg

SEQ ID NO: 2241045 - DNA, 17 bp, Homo sapiens
agattaatactctattt

SEQ ID NO: 2241046 - DNA, 13 bp, Homo sapiens
agattataataaa

SEQ ID NO: 2241047 - DNA, 20 bp, Homo sapiens
agattatggagcttttttcc

SEQ ID NO: 2241048 - DNA, 21 bp, Homo sapiens
agattctatttaattgaaact

SEQ ID NO: 2241049 - DNA, 20 bp, Homo sapiens
agattcttttaaattagaaa

SEQ ID NO: 2241050 - DNA, 18 bp, Homo sapiens
agattgatatctataaaa

SEQ ID NO: 2241051 - DNA, 14 bp, Homo sapiens
agatttatacagtt

SEQ ID NO: 2241052 - DNA, 22 bp, Homo sapiens
agatttgtaacattagttttaa

SEQ ID NO: 2241053 - DNA, 17 bp, Homo sapiens
agattttatttatgcgt

SEQ ID NO: 2241054 - DNA, 13 bp, Homo sapiens
agcaaaaatctcc

SEQ ID NO: 2241055 - DNA, 12 bp, Homo sapiens
agcaaaacaaaa

SEQ ID NO: 2241056 - DNA, 12 bp, Homo sapiens
agcaaacaaata

SEQ ID NO: 2241057 - DNA, 21 bp, Homo sapiens
agcaaagattaaatgtgtcat

SEQ ID NO: 2241058 - DNA, 15 bp, Homo sapiens
agcaaatggcctcat

SEQ ID NO: 2241059 - DNA, 15 bp, Homo sapiens
agcaaattttcagca

SEQ ID NO: 2241060 - DNA, 19 bp, Homo sapiens
agcaacaacagaagggaaa

SEQ ID NO: 2241061 - DNA, 15 bp, Homo sapiens
agcaacattcatagt

SEQ ID NO: 2241062 - DNA, 22 bp, Homo sapiens
agcaactggttaggtagcaaca

SEQ ID NO: 2241063 - DNA, 19 bp, Homo sapiens
agcaataaataacacttgt

SEQ ID NO: 2241064 - DNA, 23 bp, Homo sapiens
agcaatctccttactgtgtttca

SEQ ID NO: 2241065 - DNA, 15 bp, Homo sapiens
agcaatgcaagaaaa

SEQ ID NO: 2241066 - DNA, 15 bp, Homo sapiens
agcaattatattgtc

SEQ ID NO: 2241067 - DNA, 22 bp, Homo sapiens
agcaattgctcatgttggccaa

SEQ ID NO: 2241068 - DNA, 12 bp, Homo sapiens
agcacagcctag

SEQ ID NO: 2241069 - DNA, 14 bp, Homo sapiens
agcacccatttcaa

SEQ ID NO: 2241070 - DNA, 15 bp, Homo sapiens
agcaccctctcctgg

SEQ ID NO: 2241071 - DNA, 23 bp, Homo sapiens
agcacttgaccttttcgacgctt

SEQ ID NO: 2241072 - DNA, 18 bp, Homo sapiens
agcagaaaagatgaattt

SEQ ID NO: 2241073 - DNA, 17 bp, Homo sapiens
agcagagtctgtctctt

SEQ ID NO: 2241074 - DNA, 19 bp, Homo sapiens
agcagcagcctttaatgca

SEQ ID NO: 2241075 - DNA, 13 bp, Homo sapiens
agcagcaggctca

SEQ ID NO: 2241076 - DNA, 22 bp, Homo sapiens
agcagcagttggatcttttgaa

SEQ ID NO: 2241077 - DNA, 22 bp, Homo sapiens
agcagcccccgggccgctggct

SEQ ID NO: 2241078 - DNA, 14 bp, Homo sapiens
ataaagcatttata

SEQ ID NO: 2241079 - DNA, 14 bp, Homo sapiens
ataaagtattcttt

SEQ ID NO: 2241080 - DNA, 17 bp, Homo sapiens
ataaataacacttgtca

SEQ ID NO: 2241081 - DNA, 18 bp, Homo sapiens
ataaatgattcttagtga

SEQ ID NO: 2241082 - DNA, 20 bp, Homo sapiens
ataaatggtttggtgctttt

SEQ ID NO: 2241083 - DNA, 21 bp, Homo sapiens
ataaattgcacaccttggaat

SEQ ID NO: 2241084 - DNA, 16 bp, Homo sapiens
agcagcctttaatgca

SEQ ID NO: 2241085 - DNA, 18 bp, Homo sapiens
agcagcctttaatgcatc

SEQ ID NO: 2241086 - DNA, 18 bp, Homo sapiens
agcagcgaccgccccctc

SEQ ID NO: 2241087 - DNA, 14 bp, Homo sapiens
agcagcttattgtt

SEQ ID NO: 2241088 - DNA, 16 bp, Homo sapiens
agcaggctcaggcaca

SEQ ID NO: 2241089 - DNA, 21 bp, Homo sapiens
agcagggagaccatgcctccc

SEQ ID NO: 2241090 - DNA, 21 bp, Homo sapiens
agcaggggaattccctccccc

SEQ ID NO: 2241091 - DNA, 22 bp, Homo sapiens
agcaggggaattccctccccct

SEQ ID NO: 2241092 - DNA, 21 bp, Homo sapiens
agcagttttcaagtcaaatta

SEQ ID NO: 2241093 - DNA, 13 bp, Homo sapiens
agcatactttgta

SEQ ID NO: 2241094 - DNA, 15 bp, Homo sapiens
agcatatgtgttact

SEQ ID NO: 2241095 - DNA, 14 bp, Homo sapiens
agcatgaaatgtga

SEQ ID NO: 2241096 - DNA, 15 bp, Homo sapiens
agcatgaaatgtgaa

SEQ ID NO: 2241097 - DNA, 23 bp, Homo sapiens
agcatgactatgtatttttctat

SEQ ID NO: 2241098 - DNA, 18 bp, Homo sapiens
agcatgaggtatctaagg

SEQ ID NO: 2241099 - DNA, 15 bp, Homo sapiens
agcattaataaaact

SEQ ID NO: 2241100 - DNA, 16 bp, Homo sapiens
agcattaataaaactg

SEQ ID NO: 2241101 - DNA, 20 bp, Homo sapiens
agcattcatttgttttttca

SEQ ID NO: 2241102 - DNA, 14 bp, Homo sapiens
agcatttaaggaaa

SEQ ID NO: 2241103 - DNA, 14 bp, Homo sapiens
agcatttataaatt

SEQ ID NO: 2241104 - DNA, 14 bp, Homo sapiens
agcatttctcatca

SEQ ID NO: 2241105 - DNA, 21 bp, Homo sapiens
agcatttgacccttgctgtga

SEQ ID NO: 2241106 - DNA, 13 bp, Homo sapiens
agcattttgtaat

SEQ ID NO: 2241107 - DNA, 14 bp, Homo sapiens
agccaaatgaaact

SEQ ID NO: 2241108 - DNA, 16 bp, Homo sapiens
agccaaccttcaaaga

SEQ ID NO: 2241109 - DNA, 17 bp, Homo sapiens
agccacagtcactggat

SEQ ID NO: 2241110 - DNA, 22 bp, Homo sapiens
agccacccccaggcatctgtta

SEQ ID NO: 2241111 - DNA, 20 bp, Homo sapiens
agccacgctgtcctctcgag

SEQ ID NO: 2241112 - DNA, 19 bp, Homo sapiens
agccacttgcctgtgctac

SEQ ID NO: 2241113 - DNA, 22 bp, Homo sapiens
agccacttgcctgtgctacaat

SEQ ID NO: 2241114 - DNA, 15 bp, Homo sapiens
agccagaccagcagg

SEQ ID NO: 2241115 - DNA, 21 bp, Homo sapiens
agccagaccccacgctgacca

SEQ ID NO: 2241116 - DNA, 16 bp, Homo sapiens
agccagagatgcaata

SEQ ID NO: 2241117 - DNA, 18 bp, Homo sapiens
agccagatttgtcttttt

SEQ ID NO: 2241118 - DNA, 14 bp, Homo sapiens
agccagccgccctg

SEQ ID NO: 2241119 - DNA, 22 bp, Homo sapiens
agccagccgccctgggctgtct

SEQ ID NO: 2241120 - DNA, 16 bp, Homo sapiens
agccagcctcagaagg

SEQ ID NO: 2241121 - DNA, 17 bp, Homo sapiens
agccagcctcagaaggc

SEQ ID NO: 2241122 - DNA, 22 bp, Homo sapiens
agccagcctcagaaggccccag

SEQ ID NO: 2241123 - DNA, 21 bp, Homo sapiens
agccagcctggctctgccccc

SEQ ID NO: 2241124 - DNA, 15 bp, Homo sapiens
agccagcgcctccct

SEQ ID NO: 2241125 - DNA, 18 bp, Homo sapiens
agccagcgcctccctcca

SEQ ID NO: 2241126 - DNA, 14 bp, Homo sapiens
agccaggaggcctg

SEQ ID NO: 2241127 - DNA, 20 bp, Homo sapiens
agccatccctttttttacat

SEQ ID NO: 2241128 - DNA, 12 bp, Homo sapiens
agcccaggagcc

SEQ ID NO: 2241129 - DNA, 16 bp, Homo sapiens
agcccaggagcctcac

SEQ ID NO: 2241130 - DNA, 14 bp, Homo sapiens
agccccccagcact

SEQ ID NO: 2241131 - DNA, 17 bp, Homo sapiens
agccccgactccagcca

SEQ ID NO: 2241132 - DNA, 21 bp, Homo sapiens
agccccgactccagccagcgc

SEQ ID NO: 2241133 - DNA, 19 bp, Homo sapiens
agccccgccacgcttgtgt

SEQ ID NO: 2241134 - DNA, 18 bp, Homo sapiens
agcccctcagcgccccca

SEQ ID NO: 2241135 - DNA, 13 bp, Homo sapiens
agcccgcttggcc

SEQ ID NO: 2241136 - DNA, 14 bp, Homo sapiens
agcccgcttggcca

SEQ ID NO: 2241137 - DNA, 15 bp, Homo sapiens
agcccgtctcagtgt

SEQ ID NO: 2241138 - DNA, 21 bp, Homo sapiens
agccctcaaagaagtcggaat

SEQ ID NO: 2241139 - DNA, 21 bp, Homo sapiens
agccctccccatggagccagc

SEQ ID NO: 2241140 - DNA, 12 bp, Homo sapiens
agccctccccct

SEQ ID NO: 2241141 - DNA, 16 bp, Homo sapiens
agccctcccccttccc

SEQ ID NO: 2241142 - DNA, 20 bp, Homo sapiens
agccctcccccttccccttc

SEQ ID NO: 2241143 - DNA, 22 bp, Homo sapiens
agccctgcttttgcataatgca

SEQ ID NO: 2241144 - DNA, 20 bp, Homo sapiens
agcctcaaaacaaaggccta

SEQ ID NO: 2241145 - DNA, 18 bp, Homo sapiens
agcctcactattacttga

SEQ ID NO: 2241146 - DNA, 22 bp, Homo sapiens
agcctcactattacttgaactt

SEQ ID NO: 2241147 - DNA, 17 bp, Homo sapiens
agcctcagaaggcccca

SEQ ID NO: 2241148 - DNA, 20 bp, Homo sapiens
agcctcagaaggccccagag

SEQ ID NO: 2241149 - DNA, 23 bp, Homo sapiens
agcctcagagcatttaaggaaac

SEQ ID NO: 2241150 - DNA, 14 bp, Homo sapiens
agcctccaattttt

SEQ ID NO: 2241151 - DNA, 13 bp, Homo sapiens
agcctccagggca

SEQ ID NO: 2241152 - DNA, 21 bp, Homo sapiens
agcctccagggcattgctcag

SEQ ID NO: 2241153 - DNA, 22 bp, Homo sapiens
agcctccagggcattgctcagc

SEQ ID NO: 2241154 - DNA, 21 bp, Homo sapiens
agcctcccaccagagccggga

SEQ ID NO: 2241155 - DNA, 22 bp, Homo sapiens
agcctctggcattagaattatt

SEQ ID NO: 2241156 - DNA, 19 bp, Homo sapiens
agcctgatgagatttttaa

SEQ ID NO: 2241157 - DNA, 23 bp, Homo sapiens
agcctgcattgagcttgcatgct

SEQ ID NO: 2241158 - DNA, 21 bp, Homo sapiens
agcctggcacaggccgaggca

SEQ ID NO: 2241159 - DNA, 11 bp, Homo sapiens
agcctgggctc

SEQ ID NO: 2241160 - DNA, 15 bp, Homo sapiens
agcctgggctcactg

SEQ ID NO: 2241161 - DNA, 20 bp, Homo sapiens
agcctgggctcactgtgctg

SEQ ID NO: 2241162 - DNA, 13 bp, Homo sapiens
agccttctgcagc

SEQ ID NO: 2241163 - DNA, 12 bp, Homo sapiens
agccttgctcag

SEQ ID NO: 2241164 - DNA, 15 bp, Homo sapiens
agcctttaatgcatc

SEQ ID NO: 2241165 - DNA, 18 bp, Homo sapiens
agccttttccctctttgg

SEQ ID NO: 2241166 - DNA, 22 bp, Homo sapiens
agcgaaccctttatttgaacaa

SEQ ID NO: 2241167 - DNA, 14 bp, Homo sapiens
agcgaccgccccct

SEQ ID NO: 2241168 - DNA, 15 bp, Homo sapiens
agcgaccgccccctc

SEQ ID NO: 2241169 - DNA, 16 bp, Homo sapiens
agcgaccgccccctcc

SEQ ID NO: 2241170 - DNA, 22 bp, Homo sapiens
agcgaccttcctcatccacccc

SEQ ID NO: 2241171 - DNA, 13 bp, Homo sapiens
agcgcctccctcc

SEQ ID NO: 2241172 - DNA, 14 bp, Homo sapiens
agcgcctccctcca

SEQ ID NO: 2241173 - DNA, 23 bp, Homo sapiens
agcgcctccctccaccccaggac

SEQ ID NO: 2241174 - DNA, 17 bp, Homo sapiens
agcggaacaaggagtca

SEQ ID NO: 2241175 - DNA, 15 bp, Homo sapiens
agctacactgagcag

SEQ ID NO: 2241176 - DNA, 16 bp, Homo sapiens
agctacttcctcctcc

SEQ ID NO: 2241177 - DNA, 14 bp, Homo sapiens
agctcaatggactg

SEQ ID NO: 2241178 - DNA, 21 bp, Homo sapiens
agctctgaagaactctctgga

SEQ ID NO: 2241179 - DNA, 22 bp, Homo sapiens
agctctgaagaactctctggaa

SEQ ID NO: 2241180 - DNA, 18 bp, Homo sapiens
agctcttcttaaagtatt

SEQ ID NO: 2241181 - DNA, 16 bp, Homo sapiens
agctgccttggctcag

SEQ ID NO: 2241182 - DNA, 19 bp, Homo sapiens
agctgccttggctcagaca

SEQ ID NO: 2241183 - DNA, 18 bp, Homo sapiens
agctggctctgtgagggt

SEQ ID NO: 2241184 - DNA, 23 bp, Homo sapiens
agctgtataattaattgtcatta

SEQ ID NO: 2241185 - DNA, 13 bp, Homo sapiens
agcttaacaatgc

SEQ ID NO: 2241186 - DNA, 13 bp, Homo sapiens
agcttcttcagag

SEQ ID NO: 2241187 - DNA, 18 bp, Homo sapiens
agcttgtcttttctgctg

SEQ ID NO: 2241188 - DNA, 20 bp, Homo sapiens
agcttgtcttttctgctgag

SEQ ID NO: 2241189 - DNA, 23 bp, Homo sapiens
agcttgtcttttctgctgaggag

SEQ ID NO: 2241190 - DNA, 20 bp, Homo sapiens
agctttatttgcatatttat

SEQ ID NO: 2241191 - DNA, 19 bp, Homo sapiens
agctttgcaaaatgagact

SEQ ID NO: 2241192 - DNA, 13 bp, Homo sapiens
aggttatgttcat

SEQ ID NO: 2241193 - DNA, 21 bp, Homo sapiens
aggttatgttcatttttcaaa

SEQ ID NO: 2241194 - DNA, 18 bp, Homo sapiens
aggttccacagaggacac

SEQ ID NO: 2241195 - DNA, 17 bp, Homo sapiens
ataaattgtctttaaaa

SEQ ID NO: 2241196 - DNA, 14 bp, Homo sapiens
ataaattgtttagt

SEQ ID NO: 2241197 - DNA, 22 bp, Homo sapiens
ataaattgtttagtggaaaata

SEQ ID NO: 2241198 - DNA, 19 bp, Homo sapiens
ataacatgtgaaaagaata

SEQ ID NO: 2241199 - DNA, 20 bp, Homo sapiens
ataactgtaaatgtgacatt

SEQ ID NO: 2241200 - DNA, 17 bp, Homo sapiens
ataagatgactgtgttg

SEQ ID NO: 2241201 - DNA, 23 bp, Homo sapiens
ataaggcccagagcgaggaaagg

SEQ ID NO: 2241202 - DNA, 19 bp, Homo sapiens
ataagtggaggcactttag

SEQ ID NO: 2241203 - DNA, 16 bp, Homo sapiens
ataagtgtatttttca

SEQ ID NO: 2241204 - DNA, 21 bp, Homo sapiens
ataagttattgcagtttatca

SEQ ID NO: 2241205 - DNA, 13 bp, Homo sapiens
ataataaaatcac

SEQ ID NO: 2241206 - DNA, 14 bp, Homo sapiens
ataataaagaatag

SEQ ID NO: 2241207 - DNA, 18 bp, Homo sapiens
ataatacagatttgtaac

SEQ ID NO: 2241208 - DNA, 17 bp, Homo sapiens
ataatatattgtgttga

SEQ ID NO: 2241209 - DNA, 13 bp, Homo sapiens
ataatatattttc

SEQ ID NO: 2241210 - DNA, 15 bp, Homo sapiens
ataatatattttctg

SEQ ID NO: 2241211 - DNA, 15 bp, Homo sapiens
ataatatcaaaacaa

SEQ ID NO: 2241212 - DNA, 16 bp, Homo sapiens
ataatattaatttatt

SEQ ID NO: 2241213 - DNA, 21 bp, Homo sapiens
ataatattaatttatttaatt

SEQ ID NO: 2241214 - DNA, 10 bp, Homo sapiens
ataatgcaat

SEQ ID NO: 2241215 - DNA, 17 bp, Homo sapiens
ataatgcaatcaaaaat

SEQ ID NO: 2241216 - DNA, 15 bp, Homo sapiens
ataattgttgtgtgt

SEQ ID NO: 2241217 - DNA, 14 bp, Homo sapiens
ataatttagatggt

SEQ ID NO: 2241218 - DNA, 20 bp, Homo sapiens
ataatttagttgtttctaga

SEQ ID NO: 2241219 - DNA, 23 bp, Homo sapiens
ataattttgtaatgtatcaaata

SEQ ID NO: 2241220 - DNA, 15 bp, Homo sapiens
atacaaattagaaaa

SEQ ID NO: 2241221 - DNA, 18 bp, Homo sapiens
atacaatttttatttctt

SEQ ID NO: 2241222 - DNA, 19 bp, Homo sapiens
atacacaagcaatgcaaga

SEQ ID NO: 2241223 - DNA, 18 bp, Homo sapiens
atacagaggtaactatca

SEQ ID NO: 2241224 - DNA, 16 bp, Homo sapiens
atacagatttgtaaca

SEQ ID NO: 2241225 - DNA, 20 bp, Homo sapiens
atacatatctttattaatca

SEQ ID NO: 2241226 - DNA, 21 bp, Homo sapiens
atacatatctttattaatcac

SEQ ID NO: 2241227 - DNA, 17 bp, Homo sapiens
atacatcaatttaaaaa

SEQ ID NO: 2241228 - DNA, 17 bp, Homo sapiens
ataccactctttacctt

SEQ ID NO: 2241229 - DNA, 14 bp, Homo sapiens
ataccacttacctc

SEQ ID NO: 2241230 - DNA, 12 bp, Homo sapiens
atacctcatttt

SEQ ID NO: 2241231 - DNA, 16 bp, Homo sapiens
atacctcatttttcat

SEQ ID NO: 2241232 - DNA, 19 bp, Homo sapiens
atacctcatttttcatact

SEQ ID NO: 2241233 - DNA, 15 bp, Homo sapiens
atactacctctgaat

SEQ ID NO: 2241234 - DNA, 22 bp, Homo sapiens
atactatttaaagcctcctcat

SEQ ID NO: 2241235 - DNA, 19 bp, Homo sapiens
atactatttaagatgtgaa

SEQ ID NO: 2241236 - DNA, 21 bp, Homo sapiens
atactatttaagatgtgaaaa

SEQ ID NO: 2241237 - DNA, 22 bp, Homo sapiens
atactatttaagatgtgaaaat

SEQ ID NO: 2241238 - DNA, 15 bp, Homo sapiens
atactggaggaacac

SEQ ID NO: 2241239 - DNA, 15 bp, Homo sapiens
atactggcacagagg

SEQ ID NO: 2241240 - DNA, 15 bp, Homo sapiens
atacttgttctgtat

SEQ ID NO: 2241241 - DNA, 15 bp, Homo sapiens
atactttatcaatgt

SEQ ID NO: 2241242 - DNA, 15 bp, Homo sapiens
atagacagcatgaga

SEQ ID NO: 2241243 - DNA, 13 bp, Homo sapiens
atagatataatga

SEQ ID NO: 2241244 - DNA, 15 bp, Homo sapiens
atagattttataaga

SEQ ID NO: 2241245 - DNA, 21 bp, Homo sapiens
atagcatctggaagatcattt

SEQ ID NO: 2241246 - DNA, 14 bp, Homo sapiens
atagcattaataaa

SEQ ID NO: 2241247 - DNA, 15 bp, Homo sapiens
atagcattaataaaa

SEQ ID NO: 2241248 - DNA, 19 bp, Homo sapiens
atagcattaataaaactgt

SEQ ID NO: 2241249 - DNA, 15 bp, Homo sapiens
atagcattgtaaaag

SEQ ID NO: 2241250 - DNA, 16 bp, Homo sapiens
atagctaactgtaaat

SEQ ID NO: 2241251 - DNA, 15 bp, Homo sapiens
ataggcaccttttac

SEQ ID NO: 2241252 - DNA, 19 bp, Homo sapiens
ataggcaccttttactgtg

SEQ ID NO: 2241253 - DNA, 16 bp, Homo sapiens
ataggcagggggccct

SEQ ID NO: 2241254 - DNA, 22 bp, Homo sapiens
atagggaaaattctaacccagg

SEQ ID NO: 2241255 - DNA, 13 bp, Homo sapiens
atagtaagattga

SEQ ID NO: 2241256 - DNA, 15 bp, Homo sapiens
atagtcttgaaatga

SEQ ID NO: 2241257 - DNA, 17 bp, Homo sapiens
atagtgttaactgtcag

SEQ ID NO: 2241258 - DNA, 19 bp, Homo sapiens
atagttctgagctgccagt

SEQ ID NO: 2241259 - DNA, 12 bp, Homo sapiens
atagtttggcat

SEQ ID NO: 2241260 - DNA, 14 bp, Homo sapiens
atagtttggcattt

SEQ ID NO: 2241261 - DNA, 19 bp, Homo sapiens
atagttttttacttctctt

SEQ ID NO: 2241262 - DNA, 12 bp, Homo sapiens
atataaaataac

SEQ ID NO: 2241263 - DNA, 16 bp, Homo sapiens
atataataatgatgat

SEQ ID NO: 2241264 - DNA, 17 bp, Homo sapiens
atataatcatcaagtaa

SEQ ID NO: 2241265 - DNA, 11 bp, Homo sapiens
atataatgaac

SEQ ID NO: 2241266 - DNA, 15 bp, Homo sapiens
atatacaaaacttta

SEQ ID NO: 2241267 - DNA, 16 bp, Homo sapiens
atatacaaaactttat

SEQ ID NO: 2241268 - DNA, 22 bp, Homo sapiens
atataccactctttacctttat

SEQ ID NO: 2241269 - DNA, 19 bp, Homo sapiens
atatagcattaataaaact

SEQ ID NO: 2241270 - DNA, 21 bp, Homo sapiens
atatatatctatctatttgag

SEQ ID NO: 2241271 - DNA, 16 bp, Homo sapiens
atatatctctatttga

SEQ ID NO: 2241272 - DNA, 17 bp, Homo sapiens
atatatctctatttgag

SEQ ID NO: 2241273 - DNA, 12 bp, Homo sapiens
atatatttctat

SEQ ID NO: 2241274 - DNA, 14 bp, Homo sapiens
atatctataaaata

SEQ ID NO: 2241275 - DNA, 15 bp, Homo sapiens
atatctataaaatag

SEQ ID NO: 2241276 - DNA, 22 bp, Homo sapiens
atatctataaaatagatataaa

SEQ ID NO: 2241277 - DNA, 13 bp, Homo sapiens
atatctatctatt

SEQ ID NO: 2241278 - DNA, 13 bp, Homo sapiens
atatctctatttg

SEQ ID NO: 2241279 - DNA, 14 bp, Homo sapiens
atatctctatttga

SEQ ID NO: 2241280 - DNA, 16 bp, Homo sapiens
atatctctatttgaga

SEQ ID NO: 2241281 - DNA, 13 bp, Homo sapiens
atatggaaccttc

SEQ ID NO: 2241282 - DNA, 22 bp, Homo sapiens
atatgtaaatggtatgtcattc

SEQ ID NO: 2241283 - DNA, 13 bp, Homo sapiens
atattacaatgat

SEQ ID NO: 2241284 - DNA, 15 bp, Homo sapiens
atattacaatgatca

SEQ ID NO: 2241285 - DNA, 15 bp, Homo sapiens
atattagaaaggctc

SEQ ID NO: 2241286 - DNA, 14 bp, Homo sapiens
atattattaatata

SEQ ID NO: 2241287 - DNA, 17 bp, Homo sapiens
atattatttcctttatt

SEQ ID NO: 2241288 - DNA, 22 bp, Homo sapiens
atattgataagctattgtctgt

SEQ ID NO: 2241289 - DNA, 22 bp, Homo sapiens
atattgctgagagaaatatgga

SEQ ID NO: 2241290 - DNA, 16 bp, Homo sapiens
atattgtattaagggc

SEQ ID NO: 2241291 - DNA, 23 bp, Homo sapiens
atatttaacaatttattctgata

SEQ ID NO: 2241292 - DNA, 14 bp, Homo sapiens
atatttaagtttgt

SEQ ID NO: 2241293 - DNA, 22 bp, Homo sapiens
atatttagatgtaattttgtgt

SEQ ID NO: 2241294 - DNA, 14 bp, Homo sapiens
atatttgaagggtc

SEQ ID NO: 2241295 - DNA, 16 bp, Homo sapiens
atgactatgtattttt

SEQ ID NO: 2241296 - DNA, 14 bp, Homo sapiens
atgactgtgttgta

SEQ ID NO: 2241297 - DNA, 15 bp, Homo sapiens
atgagacgaaatgct

SEQ ID NO: 2241298 - DNA, 17 bp, Homo sapiens
atgatatgcttgtaact

SEQ ID NO: 2241299 - DNA, 23 bp, Homo sapiens
atgatatgcttgtaactaaaata

SEQ ID NO: 2241300 - DNA, 18 bp, Homo sapiens
atgatcaccgactgaaaa

SEQ ID NO: 2241301 - DNA, 23 bp, Homo sapiens
atgatctctccacggtagcactt

SEQ ID NO: 2241302 - DNA, 15 bp, Homo sapiens
atgatctgtctgtgg

SEQ ID NO: 2241303 - DNA, 19 bp, Homo sapiens
atgatgtgtacccaaacgt

SEQ ID NO: 2241304 - DNA, 15 bp, Homo sapiens
atgattgtactttga

SEQ ID NO: 2241305 - DNA, 18 bp, Homo sapiens
atgatttttaacttttta

SEQ ID NO: 2241306 - DNA, 21 bp, Homo sapiens
atgcaaacaagaaacgtgtca

SEQ ID NO: 2241307 - DNA, 13 bp, Homo sapiens
atgcaacttttaa

SEQ ID NO: 2241308 - DNA, 20 bp, Homo sapiens
atgcaacttttaattactgt

SEQ ID NO: 2241309 - DNA, 16 bp, Homo sapiens
caagtgtaaaatattt

SEQ ID NO: 2241310 - DNA, 23 bp, Homo sapiens
caagtgtaaaatattttgaatca

SEQ ID NO: 2241311 - DNA, 16 bp, Homo sapiens
caagttgtcaggttat

SEQ ID NO: 2241312 - DNA, 18 bp, Homo sapiens
caagttgtgcttgagcca

SEQ ID NO: 2241313 - DNA, 20 bp, Homo sapiens
caataaaatttttttaaagt

SEQ ID NO: 2241314 - DNA, 16 bp, Homo sapiens
caataaagcatttata

SEQ ID NO: 2241315 - DNA, 14 bp, Homo sapiens
caataaagtgatct

SEQ ID NO: 2241316 - DNA, 19 bp, Homo sapiens
caataaagtgatctgtgtt

SEQ ID NO: 2241317 - DNA, 18 bp, Homo sapiens
caataaataacacttgtc

SEQ ID NO: 2241318 - DNA, 17 bp, Homo sapiens
caataatatattttctg

SEQ ID NO: 2241319 - DNA, 17 bp, Homo sapiens
caataccttttttttca

SEQ ID NO: 2241320 - DNA, 15 bp, Homo sapiens
caataggcaaattaa

SEQ ID NO: 2241321 - DNA, 15 bp, Homo sapiens
caataggctgttccc

SEQ ID NO: 2241322 - DNA, 21 bp, Homo sapiens
caatagttttttacttctctt

SEQ ID NO: 2241323 - DNA, 19 bp, Homo sapiens
caatattgtatatttttat

SEQ ID NO: 2241324 - DNA, 11 bp, Homo sapiens
caatcaagttt

SEQ ID NO: 2241325 - DNA, 18 bp, Homo sapiens
caatcacactacacatca

SEQ ID NO: 2241326 - DNA, 19 bp, Homo sapiens
caatcacactacacatcac

SEQ ID NO: 2241327 - DNA, 20 bp, Homo sapiens
caatgacacccatgccagag

SEQ ID NO: 2241328 - DNA, 19 bp, Homo sapiens
caatgctgctccaccctcc

SEQ ID NO: 2241329 - DNA, 16 bp, Homo sapiens
caatgtctgagtgaac

SEQ ID NO: 2241330 - DNA, 21 bp, Homo sapiens
caatgtggtgacacctccccc

SEQ ID NO: 2241331 - DNA, 22 bp, Homo sapiens
caatgtggtgacacctccccct

SEQ ID NO: 2241332 - DNA, 14 bp, Homo sapiens
caatgttgtagtgt

SEQ ID NO: 2241333 - DNA, 23 bp, Homo sapiens
caattctgtttttaatgctattt

SEQ ID NO: 2241334 - DNA, 13 bp, Homo sapiens
caatttattctga

SEQ ID NO: 2241335 - DNA, 15 bp, Homo sapiens
caattttatctgttt

SEQ ID NO: 2241336 - DNA, 13 bp, Homo sapiens
caatttttatttc

SEQ ID NO: 2241337 - DNA, 23 bp, Homo sapiens
cacaaatattatttgtgtttcct

SEQ ID NO: 2241338 - DNA, 20 bp, Homo sapiens
cacaaatgtgatttttgtaa

SEQ ID NO: 2241339 - DNA, 16 bp, Homo sapiens
cacaagcaatgcaaga

SEQ ID NO: 2241340 - DNA, 18 bp, Homo sapiens
cacacaagaagaagggca

SEQ ID NO: 2241341 - DNA, 14 bp, Homo sapiens
cacacagcagcccc

SEQ ID NO: 2241342 - DNA, 13 bp, Homo sapiens
cacaccaccctcc

SEQ ID NO: 2241343 - DNA, 19 bp, Homo sapiens
cacacccaatgctgctcca

SEQ ID NO: 2241344 - DNA, 15 bp, Homo sapiens
cacactactacctct

SEQ ID NO: 2241345 - DNA, 23 bp, Homo sapiens
cacagactgaactcgcagggaat

SEQ ID NO: 2241346 - DNA, 16 bp, Homo sapiens
cacagagaggagggga

SEQ ID NO: 2241347 - DNA, 19 bp, Homo sapiens
cacagaggacacagagaag

SEQ ID NO: 2241348 - DNA, 17 bp, Homo sapiens
cacagcttaacaatgca

SEQ ID NO: 2241349 - DNA, 22 bp, Homo sapiens
cacagcttaacaatgcaacttt

SEQ ID NO: 2241350 - DNA, 13 bp, Homo sapiens
cacaggagggcca

SEQ ID NO: 2241351 - DNA, 14 bp, Homo sapiens
cacaggagggccag

SEQ ID NO: 2241352 - DNA, 15 bp, Homo sapiens
cacaggagggccagc

SEQ ID NO: 2241353 - DNA, 16 bp, Homo sapiens
cacaggggccaccacc

SEQ ID NO: 2241354 - DNA, 14 bp, Homo sapiens
cacagtcactggat

SEQ ID NO: 2241355 - DNA, 11 bp, Homo sapiens
cacagtcccag

SEQ ID NO: 2241356 - DNA, 19 bp, Homo sapiens
cacatatccaggcaccagg

SEQ ID NO: 2241357 - DNA, 16 bp, Homo sapiens
cacatatttgaagggt

SEQ ID NO: 2241358 - DNA, 17 bp, Homo sapiens
cacatgctgtctggccc

SEQ ID NO: 2241359 - DNA, 16 bp, Homo sapiens
caccaagctaggtgct

SEQ ID NO: 2241360 - DNA, 13 bp, Homo sapiens
caccagagccggg

SEQ ID NO: 2241361 - DNA, 15 bp, Homo sapiens
cacccaatgctgctc

SEQ ID NO: 2241362 - DNA, 18 bp, Homo sapiens
cacccaatgctgctccac

SEQ ID NO: 2241363 - DNA, 16 bp, Homo sapiens
cacccatgccagagag

SEQ ID NO: 2241364 - DNA, 12 bp, Homo sapiens
caccccaagaga

SEQ ID NO: 2241365 - DNA, 11 bp, Homo sapiens
caccccaggac

SEQ ID NO: 2241366 - DNA, 17 bp, Homo sapiens
caccccaggacgccact

SEQ ID NO: 2241367 - DNA, 12 bp, Homo sapiens
caccccatccag

SEQ ID NO: 2241368 - DNA, 16 bp, Homo sapiens
caccccctcccacccc

SEQ ID NO: 2241369 - DNA, 16 bp, Homo sapiens
caccccgcctgccctc

SEQ ID NO: 2241370 - DNA, 15 bp, Homo sapiens
caccgggagcctccc

SEQ ID NO: 2241371 - DNA, 17 bp, Homo sapiens
caccgggagcctccccc

SEQ ID NO: 2241372 - DNA, 17 bp, Homo sapiens
cacctcctctgtgattt

SEQ ID NO: 2241373 - DNA, 18 bp, Homo sapiens
caccttccagctcctgta

SEQ ID NO: 2241374 - DNA, 14 bp, Homo sapiens
caccttctttgtaa

SEQ ID NO: 2241375 - DNA, 12 bp, Homo sapiens
cacgagccacct

SEQ ID NO: 2241376 - DNA, 14 bp, Homo sapiens
cacgcagctggcag

SEQ ID NO: 2241377 - DNA, 16 bp, Homo sapiens
cacgcagctggcagag

SEQ ID NO: 2241378 - DNA, 17 bp, Homo sapiens
cacgcagctggcagaga

SEQ ID NO: 2241379 - DNA, 18 bp, Homo sapiens
cacgcctcctggccagac

SEQ ID NO: 2241380 - DNA, 23 bp, Homo sapiens
cacgctgtcctctcgagcccaga

SEQ ID NO: 2241381 - DNA, 16 bp, Homo sapiens
cacggatggtgcatgg

SEQ ID NO: 2241382 - DNA, 18 bp, Homo sapiens
cacggcgggatcctccac

SEQ ID NO: 2241383 - DNA, 19 bp, Homo sapiens
cacggcgggatcctccaca

SEQ ID NO: 2241384 - DNA, 20 bp, Homo sapiens
cacggcgggatcctccacag

SEQ ID NO: 2241385 - DNA, 14 bp, Homo sapiens
cacgggtggtcccc

SEQ ID NO: 2241386 - DNA, 16 bp, Homo sapiens
cacgtgggctcatatg

SEQ ID NO: 2241387 - DNA, 22 bp, Homo sapiens
cactaaagcatgaaatgtgaat

SEQ ID NO: 2241388 - DNA, 20 bp, Homo sapiens
cactaacgttgagcccctgg

SEQ ID NO: 2241389 - DNA, 23 bp, Homo sapiens
cactaaggccgtgtctctgagga

SEQ ID NO: 2241390 - DNA, 23 bp, Homo sapiens
cactaattggtacttttaaaaac

SEQ ID NO: 2241391 - DNA, 15 bp, Homo sapiens
cactaatttttgtat

SEQ ID NO: 2241392 - DNA, 21 bp, Homo sapiens
cactatggtatgctggccagc

SEQ ID NO: 2241393 - DNA, 22 bp, Homo sapiens
cactatggtatgctggccagca

SEQ ID NO: 2241394 - DNA, 17 bp, Homo sapiens
cactattacttgaactt

SEQ ID NO: 2241395 - DNA, 18 bp, Homo sapiens
cactcaccactaccagcc

SEQ ID NO: 2241396 - DNA, 19 bp, Homo sapiens
cactcattgctgagcctct

SEQ ID NO: 2241397 - DNA, 16 bp, Homo sapiens
cactcatttcatctca

SEQ ID NO: 2241398 - DNA, 19 bp, Homo sapiens
cactcatttcatctcattt

SEQ ID NO: 2241399 - DNA, 16 bp, Homo sapiens
cactccccagccccag

SEQ ID NO: 2241400 - DNA, 18 bp, Homo sapiens
cactcccttgctggcccc

SEQ ID NO: 2241401 - DNA, 15 bp, Homo sapiens
cactcgtgtgtttct

SEQ ID NO: 2241402 - DNA, 14 bp, Homo sapiens
cactctgtcagcca

SEQ ID NO: 2241403 - DNA, 18 bp, Homo sapiens
cactctgtcagccagccg

SEQ ID NO: 2241404 - DNA, 22 bp, Homo sapiens
cactctgtcagccagccgccct

SEQ ID NO: 2241405 - DNA, 17 bp, Homo sapiens
cactgcattcctgtgcc

SEQ ID NO: 2241406 - DNA, 22 bp, Homo sapiens
cactgcattcctgtgccctaga

SEQ ID NO: 2241407 - DNA, 17 bp, Homo sapiens
cactgcttgaactaggc

SEQ ID NO: 2241408 - DNA, 13 bp, Homo sapiens
cactggcgaggag

SEQ ID NO: 2241409 - DNA, 23 bp, Homo sapiens
cactgggaacctagctacactga

SEQ ID NO: 2241410 - DNA, 17 bp, Homo sapiens
cactgtgtacacctcaa

SEQ ID NO: 2241411 - DNA, 21 bp, Homo sapiens
cacttaattacagttaaagaa

SEQ ID NO: 2241412 - DNA, 20 bp, Homo sapiens
cacttgatgtgatgtggcag

SEQ ID NO: 2241413 - DNA, 16 bp, Homo sapiens
cacttgccaaaatcca

SEQ ID NO: 2241414 - DNA, 19 bp, Homo sapiens
cacttgtatatatggatca

SEQ ID NO: 2241415 - DNA, 17 bp, Homo sapiens
cactttagggctgtaaa

SEQ ID NO: 2241416 - DNA, 19 bp, Homo sapiens
cactttcatctggggtggg

SEQ ID NO: 2241417 - DNA, 19 bp, Homo sapiens
cactttctacaatgtgaac

SEQ ID NO: 2241418 - DNA, 14 bp, Homo sapiens
cacttttagccaga

SEQ ID NO: 2241419 - DNA, 21 bp, Homo sapiens
cacttttagccagagatgcaa

SEQ ID NO: 2241420 - DNA, 17 bp, Homo sapiens
cagaaaagatgaatttg

SEQ ID NO: 2241421 - DNA, 17 bp, Homo sapiens
cagaagaaataaatata

SEQ ID NO: 2241422 - DNA, 14 bp, Homo sapiens
cagaaggccccaga

SEQ ID NO: 2241423 - DNA, 19 bp, Homo sapiens
cagaataagttattgcagt

SEQ ID NO: 2241424 - DNA, 17 bp, Homo sapiens
cagaatgtgtctcagga

SEQ ID NO: 2241425 - DNA, 13 bp, Homo sapiens
cagacaaccttgt

SEQ ID NO: 2241426 - DNA, 17 bp, Homo sapiens
cagacaaccttgtccca

SEQ ID NO: 2241427 - DNA, 18 bp, Homo sapiens
cagacaaccttgtcccaa

SEQ ID NO: 2241428 - DNA, 22 bp, Homo sapiens
cagacaataaaccctcagagcc

SEQ ID NO: 2241429 - DNA, 13 bp, Homo sapiens
cagacacagccca

SEQ ID NO: 2241430 - DNA, 19 bp, Homo sapiens
cagacacgagccacctcac

SEQ ID NO: 2241431 - DNA, 21 bp, Homo sapiens
cagacagatgttgggaggata

SEQ ID NO: 2241432 - DNA, 12 bp, Homo sapiens
cagacatgtttt

SEQ ID NO: 2241433 - DNA, 18 bp, Homo sapiens
cagaccccacgctgacca

SEQ ID NO: 2241434 - DNA, 20 bp, Homo sapiens
cagactaagaaggaaaagaa

SEQ ID NO: 2241435 - DNA, 17 bp, Homo sapiens
cagactgaactcgcagg

SEQ ID NO: 2241436 - DNA, 17 bp, Homo sapiens
cagacttcaaaaggaat

SEQ ID NO: 2241437 - DNA, 24 bp, Homo sapiens
cagacttccttgagacacggagcc

SEQ ID NO: 2241438 - DNA, 17 bp, Homo sapiens
cagagagaccctgcaag

SEQ ID NO: 2241439 - DNA, 19 bp, Homo sapiens
cagagcatttaaggaaact

SEQ ID NO: 2241440 - DNA, 13 bp, Homo sapiens
cagagccagcctg

SEQ ID NO: 2241441 - DNA, 15 bp, Homo sapiens
cagagccagcctggc

SEQ ID NO: 2241442 - DNA, 14 bp, Homo sapiens
cagagccgggagga

SEQ ID NO: 2241443 - DNA, 22 bp, Homo sapiens
cagagccgggaggaaaaggccc

SEQ ID NO: 2241444 - DNA, 13 bp, Homo sapiens
cagagcgcacagg

SEQ ID NO: 2241445 - DNA, 17 bp, Homo sapiens
cagaggtctagattaat

SEQ ID NO: 2241446 - DNA, 17 bp, Homo sapiens
cagatcctttgaaaaga

SEQ ID NO: 2241447 - DNA, 21 bp, Homo sapiens
cagatcgctcactgttgtgaa

SEQ ID NO: 2241448 - DNA, 19 bp, Homo sapiens
cagatgaatgtatttattt

SEQ ID NO: 2241449 - DNA, 23 bp, Homo sapiens
cagatgaatgtatttatttggga

SEQ ID NO: 2241450 - DNA, 16 bp, Homo sapiens
cagatgcaacctcact

SEQ ID NO: 2241451 - DNA, 21 bp, Homo sapiens
cagatggaaagacgtttttgt

SEQ ID NO: 2241452 - DNA, 20 bp, Homo sapiens
cagatgttaaaataaatggt

SEQ ID NO: 2241453 - DNA, 15 bp, Homo sapiens
cagatgttgggagga

SEQ ID NO: 2241454 - DNA, 14 bp, Homo sapiens
cagatgtttccaga

SEQ ID NO: 2241455 - DNA, 18 bp, Homo sapiens
cagatgtttccagacttc

SEQ ID NO: 2241456 - DNA, 23 bp, Homo sapiens
cagatgtttccagacttccttga

SEQ ID NO: 2241457 - DNA, 14 bp, Homo sapiens
cagatttgtctttt

SEQ ID NO: 2241458 - DNA, 17 bp, Homo sapiens
cagattttgctgtatat

SEQ ID NO: 2241459 - DNA, 14 bp, Homo sapiens
cagcaatatttaac

SEQ ID NO: 2241460 - DNA, 17 bp, Homo sapiens
cagcaccctctcctggg

SEQ ID NO: 2241461 - DNA, 16 bp, Homo sapiens
cagcactaaggccgtg

SEQ ID NO: 2241462 - DNA, 22 bp, Homo sapiens
cagcagaggcccagatattaga

SEQ ID NO: 2241463 - DNA, 14 bp, Homo sapiens
cagcagccccccag

SEQ ID NO: 2241464 - DNA, 16 bp, Homo sapiens
cagcagccccccagca

SEQ ID NO: 2241465 - DNA, 18 bp, Homo sapiens
cagcagccccccagcact

SEQ ID NO: 2241466 - DNA, 21 bp, Homo sapiens
cagcagccccccagcactaag

SEQ ID NO: 2241467 - DNA, 15 bp, Homo sapiens
cagcaggctcaggca

SEQ ID NO: 2241468 - DNA, 20 bp, Homo sapiens
cagcagttttcaagtcaaat

SEQ ID NO: 2241469 - DNA, 15 bp, Homo sapiens
cagcatgactatgta

SEQ ID NO: 2241470 - DNA, 21 bp, Homo sapiens
cagcattcatttgttttttca

SEQ ID NO: 2241471 - DNA, 23 bp, Homo sapiens
cagccagaccagattaaacttca

SEQ ID NO: 2241472 - DNA, 18 bp, Homo sapiens
cagccagaccccacgctg

SEQ ID NO: 2241473 - DNA, 21 bp, Homo sapiens
cagccagcgcctccctccacc

SEQ ID NO: 2241474 - DNA, 15 bp, Homo sapiens
cagccccgactccag

SEQ ID NO: 2241475 - DNA, 16 bp, Homo sapiens
cagccccgactccagc

SEQ ID NO: 2241476 - DNA, 17 bp, Homo sapiens
cagccccgactccagcc

SEQ ID NO: 2241477 - DNA, 17 bp, Homo sapiens
cagcccgcttggccacc

SEQ ID NO: 2241478 - DNA, 13 bp, Homo sapiens
cagccctgctggg

SEQ ID NO: 2241479 - DNA, 14 bp, Homo sapiens
cagccgccctgggc

SEQ ID NO: 2241480 - DNA, 15 bp, Homo sapiens
cagccgccctgggct

SEQ ID NO: 2241481 - DNA, 16 bp, Homo sapiens
cagccgccctgggctg

SEQ ID NO: 2241482 - DNA, 21 bp, Homo sapiens
cagcctagggctgagctgggg

SEQ ID NO: 2241483 - DNA, 21 bp, Homo sapiens
cagcctcagaaggccccagag

SEQ ID NO: 2241484 - DNA, 22 bp, Homo sapiens
cagcctcagaaggccccagaga

SEQ ID NO: 2241485 - DNA, 24 bp, Homo sapiens
cagcctccagggcattgctcagcc

SEQ ID NO: 2241486 - DNA, 11 bp, Homo sapiens
cagcctctgcc

SEQ ID NO: 2241487 - DNA, 10 bp, Homo sapiens
cagcctggca

SEQ ID NO: 2241488 - DNA, 18 bp, Homo sapiens
cagcgaccgccccctcct

SEQ ID NO: 2241489 - DNA, 20 bp, Homo sapiens
cagcgcctccctccacccca

SEQ ID NO: 2241490 - DNA, 22 bp, Homo sapiens
cagcgcctccctccaccccagg

SEQ ID NO: 2241491 - DNA, 12 bp, Homo sapiens
cagctaagaaaa

SEQ ID NO: 2241492 - DNA, 23 bp, Homo sapiens
cagctaagaaaagattttaatca

SEQ ID NO: 2241493 - DNA, 21 bp, Homo sapiens
cagctacttcctcctccccac

SEQ ID NO: 2241494 - DNA, 14 bp, Homo sapiens
cagctatctgtcat

SEQ ID NO: 2241495 - DNA, 20 bp, Homo sapiens
cagctcaatggactggaagg

SEQ ID NO: 2241496 - DNA, 23 bp, Homo sapiens
cagctcataaaatggaagcaatt

SEQ ID NO: 2241497 - DNA, 17 bp, Homo sapiens
cagctccaggtggctct

SEQ ID NO: 2241498 - DNA, 23 bp, Homo sapiens
cagctgaagttgcagatgttaga

SEQ ID NO: 2241499 - DNA, 15 bp, Homo sapiens
cagctgggctctgca

SEQ ID NO: 2241500 - DNA, 17 bp, Homo sapiens
cagcttaacaatgcaac

SEQ ID NO: 2241501 - DNA, 13 bp, Homo sapiens
cagcttcagtgat

SEQ ID NO: 2241502 - DNA, 16 bp, Homo sapiens
cagctttgatccctga

SEQ ID NO: 2241503 - DNA, 17 bp, Homo sapiens
cagctttgatccctgac

SEQ ID NO: 2241504 - DNA, 18 bp, Homo sapiens
caggaagcccaggagcct

SEQ ID NO: 2241505 - DNA, 19 bp, Homo sapiens
caggaagcccaggagcctc

SEQ ID NO: 2241506 - DNA, 21 bp, Homo sapiens
caggaagcctgcagtcctgga

SEQ ID NO: 2241507 - DNA, 12 bp, Homo sapiens
caggaaggaaca

SEQ ID NO: 2241508 - DNA, 16 bp, Homo sapiens
caggaatgtgtggcct

SEQ ID NO: 2241509 - DNA, 15 bp, Homo sapiens
caggacaacacttca

SEQ ID NO: 2241510 - DNA, 19 bp, Homo sapiens
caggacaacacttcatttt

SEQ ID NO: 2241511 - DNA, 16 bp, Homo sapiens
caggacgccactcatt

SEQ ID NO: 2241512 - DNA, 21 bp, Homo sapiens
caggactgcaaaaatccttct

SEQ ID NO: 2241513 - DNA, 15 bp, Homo sapiens
caggacttccatctg

SEQ ID NO: 2241514 - DNA, 16 bp, Homo sapiens
caggagcctcactggg

SEQ ID NO: 2241515 - DNA, 13 bp, Homo sapiens
caggagggccagc

SEQ ID NO: 2241516 - DNA, 22 bp, Homo sapiens
caggagggccagcgctgtggac

SEQ ID NO: 2241517 - DNA, 17 bp, Homo sapiens
caggatactggcacaga

SEQ ID NO: 2241518 - DNA, 14 bp, Homo sapiens
caggatccccctct

SEQ ID NO: 2241519 - DNA, 14 bp, Homo sapiens
caggatgctgagct

SEQ ID NO: 2241520 - DNA, 20 bp, Homo sapiens
caggattactagtcaaacaa

SEQ ID NO: 2241521 - DNA, 17 bp, Homo sapiens
caggcacacagcagccc

SEQ ID NO: 2241522 - DNA, 21 bp, Homo sapiens
caggcacacagcagcccccca

SEQ ID NO: 2241523 - DNA, 18 bp, Homo sapiens
caggcacgggtggtcccc

SEQ ID NO: 2241524 - DNA, 20 bp, Homo sapiens
caggcacgggtggtccccgt

SEQ ID NO: 2241525 - DNA, 23 bp, Homo sapiens
caggcacgggtggtccccgttcc

SEQ ID NO: 2241526 - DNA, 17 bp, Homo sapiens
caggcagacaaccttgt

SEQ ID NO: 2241527 - DNA, 19 bp, Homo sapiens
caggcagacaaccttgtcc

SEQ ID NO: 2241528 - DNA, 13 bp, Homo sapiens
caggcaggaacaa

SEQ ID NO: 2241529 - DNA, 20 bp, Homo sapiens
caggcaggaacaaacagggc

SEQ ID NO: 2241530 - DNA, 19 bp, Homo sapiens
caggcatctgttagcagag

SEQ ID NO: 2241531 - DNA, 12 bp, Homo sapiens
caggcccactcc

SEQ ID NO: 2241532 - DNA, 15 bp, Homo sapiens
caggcccactcccca

SEQ ID NO: 2241533 - DNA, 22 bp, Homo sapiens
caggccctccctgactccctgt

SEQ ID NO: 2241534 - DNA, 14 bp, Homo sapiens
caggccgaggcagg

SEQ ID NO: 2241535 - DNA, 23 bp, Homo sapiens
caggctaaacatccaatattttc

SEQ ID NO: 2241536 - DNA, 15 bp, Homo sapiens
caggctcccctgagg

SEQ ID NO: 2241537 - DNA, 13 bp, Homo sapiens
caggctgggccat

SEQ ID NO: 2241538 - DNA, 20 bp, Homo sapiens
caggctgggccatgtccaaa

SEQ ID NO: 2241539 - DNA, 22 bp, Homo sapiens
caggctgggccatgtccaaaga

SEQ ID NO: 2241540 - DNA, 23 bp, Homo sapiens
caggctgggccatgtccaaagag

SEQ ID NO: 2241541 - DNA, 18 bp, Homo sapiens
cagggaccactgggtgag

SEQ ID NO: 2241542 - DNA, 24 bp, Homo sapiens
cagggaccactgggtgagagagga

SEQ ID NO: 2241543 - DNA, 17 bp, Homo sapiens
cagggatgggggatggg

SEQ ID NO: 2241544 - DNA, 15 bp, Homo sapiens
cagggcatgccacgt

SEQ ID NO: 2241545 - DNA, 14 bp, Homo sapiens
cagggcattgctca

SEQ ID NO: 2241546 - DNA, 18 bp, Homo sapiens
cagggcattgctcagccc

SEQ ID NO: 2241547 - DNA, 13 bp, Homo sapiens
cagggcgcaagcc

SEQ ID NO: 2241548 - DNA, 19 bp, Homo sapiens
cagggggaaggtggggtcc

SEQ ID NO: 2241549 - DNA, 15 bp, Homo sapiens
cagggggcaagagga

SEQ ID NO: 2241550 - DNA, 20 bp, Homo sapiens
cagggggccctgccccaccc

SEQ ID NO: 2241551 - DNA, 13 bp, Homo sapiens
caggggtctgagc

SEQ ID NO: 2241552 - DNA, 14 bp, Homo sapiens
caggggtctgagcc

SEQ ID NO: 2241553 - DNA, 12 bp, Homo sapiens
cagggtccctcc

SEQ ID NO: 2241554 - DNA, 17 bp, Homo sapiens
cagggtttacccagtgg

SEQ ID NO: 2241555 - DNA, 15 bp, Homo sapiens
caggtatccaaaaat

SEQ ID NO: 2241556 - DNA, 13 bp, Homo sapiens
caggtcctgccca

SEQ ID NO: 2241557 - DNA, 21 bp, Homo sapiens
caggtcctgcccatgtgtccc

SEQ ID NO: 2241558 - DNA, 22 bp, Homo sapiens
caggtcctgcccatgtgtcccc

SEQ ID NO: 2241559 - DNA, 21 bp, Homo sapiens
cagtaaacgggaacatgcccc

SEQ ID NO: 2241560 - DNA, 24 bp, Homo sapiens
cagtaccctctcagctccaggtgg

SEQ ID NO: 2241561 - DNA, 23 bp, Homo sapiens
cagtagaggctatggacagggca

SEQ ID NO: 2241562 - DNA, 22 bp, Homo sapiens
cagtagttcacatacaaatcat

SEQ ID NO: 2241563 - DNA, 14 bp, Homo sapiens
cagtataaacaaag

SEQ ID NO: 2241564 - DNA, 13 bp, Homo sapiens
cagtatacctcat

SEQ ID NO: 2241565 - DNA, 18 bp, Homo sapiens
cagtatacctcatttttc

SEQ ID NO: 2241566 - DNA, 20 bp, Homo sapiens
cagtatacctcatttttcat

SEQ ID NO: 2241567 - DNA, 21 bp, Homo sapiens
cagtatacctcatttttcata

SEQ ID NO: 2241568 - DNA, 13 bp, Homo sapiens
cagtccacagggg

SEQ ID NO: 2241569 - DNA, 14 bp, Homo sapiens
cagtccacaggggc

SEQ ID NO: 2241570 - DNA, 15 bp, Homo sapiens
cagtccacaggggcc

SEQ ID NO: 2241571 - DNA, 19 bp, Homo sapiens
cagtctagtacttattaca

SEQ ID NO: 2241572 - DNA, 21 bp, Homo sapiens
cagtgaatttgcactgtttaa

SEQ ID NO: 2241573 - DNA, 13 bp, Homo sapiens
cagtgacaacatc

SEQ ID NO: 2241574 - DNA, 23 bp, Homo sapiens
cagtgagggtaagtattttcctg

SEQ ID NO: 2241575 - DNA, 22 bp, Homo sapiens
cagtggaccgcccttttcccct

SEQ ID NO: 2241576 - DNA, 21 bp, Homo sapiens
cagtggaggctggcagggtcc

SEQ ID NO: 2241577 - DNA, 21 bp, Homo sapiens
cagtggcccatggcattttat

SEQ ID NO: 2241578 - DNA, 17 bp, Homo sapiens
cagtggctcataaaaat

SEQ ID NO: 2241579 - DNA, 14 bp, Homo sapiens
cagtgggttaacat

SEQ ID NO: 2241580 - DNA, 16 bp, Homo sapiens
cagtggtcattgggca

SEQ ID NO: 2241581 - DNA, 19 bp, Homo sapiens
cagtggtggagctggacct

SEQ ID NO: 2241582 - DNA, 13 bp, Homo sapiens
cagtgtgtaaaca

SEQ ID NO: 2241583 - DNA, 19 bp, Homo sapiens
cagtgttttcagaagaaat

SEQ ID NO: 2241584 - DNA, 23 bp, Homo sapiens
cagtgttttcagaagaaataaat

SEQ ID NO: 2241585 - DNA, 22 bp, Homo sapiens
cagttcaacctggtggcaccag

SEQ ID NO: 2241586 - DNA, 22 bp, Homo sapiens
cagttcctttagaaagcagtta

SEQ ID NO: 2241587 - DNA, 23 bp, Homo sapiens
cagttcttggtgactgtcccacc

SEQ ID NO: 2241588 - DNA, 16 bp, Homo sapiens
cagttctttttgtaca

SEQ ID NO: 2241589 - DNA, 20 bp, Homo sapiens
cagttctttttgtacactta

SEQ ID NO: 2241590 - DNA, 17 bp, Homo sapiens
cagttgaaaacttgtaa

SEQ ID NO: 2241591 - DNA, 16 bp, Homo sapiens
cagtttaaaaaaattg

SEQ ID NO: 2241592 - DNA, 14 bp, Homo sapiens
cagtttatcattca

SEQ ID NO: 2241593 - DNA, 23 bp, Homo sapiens
cagtttgtgtgtcttaattatta

SEQ ID NO: 2241594 - DNA, 16 bp, Homo sapiens
cagtttgttctccggg

SEQ ID NO: 2241595 - DNA, 23 bp, Homo sapiens
cagttttcaagtcaaattaataa

SEQ ID NO: 2241596 - DNA, 23 bp, Homo sapiens
cataaaaagcaaaacaaaaatta

SEQ ID NO: 2241597 - DNA, 23 bp, Homo sapiens
cataaaaggcttcacttttgact

SEQ ID NO: 2241598 - DNA, 20 bp, Homo sapiens
cataaaccatttttgttact

SEQ ID NO: 2241599 - DNA, 21 bp, Homo sapiens
cataaaccatttttgttactc

SEQ ID NO: 2241600 - DNA, 12 bp, Homo sapiens
cataaatttttt

SEQ ID NO: 2241601 - DNA, 22 bp, Homo sapiens
cataaattttttgaagtcttta

SEQ ID NO: 2241602 - DNA, 17 bp, Homo sapiens
cataacagcctctgtga

SEQ ID NO: 2241603 - DNA, 19 bp, Homo sapiens
cataaccttaaaaaggact

SEQ ID NO: 2241604 - DNA, 16 bp, Homo sapiens
cataatgcaatcaaaa

SEQ ID NO: 2241605 - DNA, 14 bp, Homo sapiens
cataattgaagtgt

SEQ ID NO: 2241606 - DNA, 19 bp, Homo sapiens
cataatttagttgtttcta

SEQ ID NO: 2241607 - DNA, 16 bp, Homo sapiens
cataatttgtttccag

SEQ ID NO: 2241608 - DNA, 18 bp, Homo sapiens
cataatttgtttccagca

SEQ ID NO: 2241609 - DNA, 17 bp, Homo sapiens
catacaacagaaaccag

SEQ ID NO: 2241610 - DNA, 22 bp, Homo sapiens
catacaacagaaaccagaaaag

SEQ ID NO: 2241611 - DNA, 17 bp, Homo sapiens
catacagaggtaactat

SEQ ID NO: 2241612 - DNA, 22 bp, Homo sapiens
catactggcctggactgttttc

SEQ ID NO: 2241613 - DNA, 14 bp, Homo sapiens
catacttgttctgt

SEQ ID NO: 2241614 - DNA, 22 bp, Homo sapiens
catactttgtaaataggatttt

SEQ ID NO: 2241615 - DNA, 12 bp, Homo sapiens
catacttttgca

SEQ ID NO: 2241616 - DNA, 13 bp, Homo sapiens
catacttttgcaa

SEQ ID NO: 2241617 - DNA, 19 bp, Homo sapiens
catagtaccatttatacaa

SEQ ID NO: 2241618 - DNA, 19 bp, Homo sapiens
catagtcttgaaatgaaag

SEQ ID NO: 2241619 - DNA, 20 bp, Homo sapiens
catagtcttgaaatgaaagg

SEQ ID NO: 2241620 - DNA, 21 bp, Homo sapiens
catagtcttgaaatgaaaggg

SEQ ID NO: 2241621 - DNA, 23 bp, Homo sapiens
catagtcttgaaatgaaagggaa

SEQ ID NO: 2241622 - DNA, 14 bp, Homo sapiens
catagttactgtgt

SEQ ID NO: 2241623 - DNA, 18 bp, Homo sapiens
catagttactgtgtaaac

SEQ ID NO: 2241624 - DNA, 19 bp, Homo sapiens
catagttactgtgtaaact

SEQ ID NO: 2241625 - DNA, 13 bp, Homo sapiens
catagtttggcat

SEQ ID NO: 2241626 - DNA, 14 bp, Homo sapiens
catagtttggcatt

SEQ ID NO: 2241627 - DNA, 18 bp, Homo sapiens
catagtttggcatttgca

SEQ ID NO: 2241628 - DNA, 16 bp, Homo sapiens
catatctttattaatc

SEQ ID NO: 2241629 - DNA, 20 bp, Homo sapiens
catcacagcaatatttaaca

SEQ ID NO: 2241630 - DNA, 21 bp, Homo sapiens
catcacggatggtgcatgggc

SEQ ID NO: 2241631 - DNA, 23 bp, Homo sapiens
catcacggatggtgcatgggctc

SEQ ID NO: 2241632 - DNA, 17 bp, Homo sapiens
catcagtctccaacatg

SEQ ID NO: 2241633 - DNA, 23 bp, Homo sapiens
catcattaaaggaaacgtggcag

SEQ ID NO: 2241634 - DNA, 14 bp, Homo sapiens
catccaccccatcc

SEQ ID NO: 2241635 - DNA, 11 bp, Homo sapiens
catccagcctc

SEQ ID NO: 2241636 - DNA, 18 bp, Homo sapiens
attagggccctgtgtctg

SEQ ID NO: 2241637 - DNA, 13 bp, Homo sapiens
attaggtattttg

SEQ ID NO: 2241638 - DNA, 18 bp, Homo sapiens
attaggtttcagcagagc

SEQ ID NO: 2241639 - DNA, 22 bp, Homo sapiens
attagtaccatagtaccattta

SEQ ID NO: 2241640 - DNA, 14 bp, Homo sapiens
attataaaaatatt

SEQ ID NO: 2241641 - DNA, 15 bp, Homo sapiens
attataagtcttaca

SEQ ID NO: 2241642 - DNA, 19 bp, Homo sapiens
attataagtcttacataaa

SEQ ID NO: 2241643 - DNA, 19 bp, Homo sapiens
attataataaatatataca

SEQ ID NO: 2241644 - DNA, 14 bp, Homo sapiens
attatatatttaca

SEQ ID NO: 2241645 - DNA, 19 bp, Homo sapiens
attatctatacatatcttt

SEQ ID NO: 2241646 - DNA, 22 bp, Homo sapiens
attatctatacatatctttatt

SEQ ID NO: 2241647 - DNA, 15 bp, Homo sapiens
attatggaaaaataa

SEQ ID NO: 2241648 - DNA, 19 bp, Homo sapiens
attatggaaaaataaaact

SEQ ID NO: 2241649 - DNA, 16 bp, Homo sapiens
attattataaaaatat

SEQ ID NO: 2241650 - DNA, 15 bp, Homo sapiens
attattatttgtgtt

SEQ ID NO: 2241651 - DNA, 11 bp, Homo sapiens
attatttaaac

SEQ ID NO: 2241652 - DNA, 17 bp, Homo sapiens
attatttgtttagatgt

SEQ ID NO: 2241653 - DNA, 13 bp, Homo sapiens
attattttttaat

SEQ ID NO: 2241654 - DNA, 17 bp, Homo sapiens
attcaaactggggcctc

SEQ ID NO: 2241655 - DNA, 20 bp, Homo sapiens
attcaagtgtaaaatatttt

SEQ ID NO: 2241656 - DNA, 13 bp, Homo sapiens
attcaattgtaaa

SEQ ID NO: 2241657 - DNA, 14 bp, Homo sapiens
attcaattgtaaat

SEQ ID NO: 2241658 - DNA, 21 bp, Homo sapiens
attcaattgtaaattgaatca

SEQ ID NO: 2241659 - DNA, 18 bp, Homo sapiens
attcagcagcaaattttc

SEQ ID NO: 2241660 - DNA, 15 bp, Homo sapiens
attcaggtaatacaa

SEQ ID NO: 2241661 - DNA, 16 bp, Homo sapiens
attcaggtaatacaaa

SEQ ID NO: 2241662 - DNA, 18 bp, Homo sapiens
attcagtggaggctggca

SEQ ID NO: 2241663 - DNA, 19 bp, Homo sapiens
attcagtggcgagaaataa

SEQ ID NO: 2241664 - DNA, 18 bp, Homo sapiens
attcatttgttttttcaa

SEQ ID NO: 2241665 - DNA, 18 bp, Homo sapiens
attccaaaccaaatttta

SEQ ID NO: 2241666 - DNA, 17 bp, Homo sapiens
attccatatctttggat

SEQ ID NO: 2241667 - DNA, 17 bp, Homo sapiens
attccctccccctcctt

SEQ ID NO: 2241668 - DNA, 17 bp, Homo sapiens
attccttgaggacagac

SEQ ID NO: 2241669 - DNA, 13 bp, Homo sapiens
attctatttaatt

SEQ ID NO: 2241670 - DNA, 18 bp, Homo sapiens
attctatttaattgaaac

SEQ ID NO: 2241671 - DNA, 14 bp, Homo sapiens
attctgaccttaaa

SEQ ID NO: 2241672 - DNA, 18 bp, Homo sapiens
attctgaccttaaatgca

SEQ ID NO: 2241673 - DNA, 17 bp, Homo sapiens
attctgagcctgatatt

SEQ ID NO: 2241674 - DNA, 17 bp, Homo sapiens
attcttcagatatactg

SEQ ID NO: 2241675 - DNA, 19 bp, Homo sapiens
attctttcccagtctgtcg

SEQ ID NO: 2241676 - DNA, 22 bp, Homo sapiens
attctttccttctctgaaagtg

SEQ ID NO: 2241677 - DNA, 18 bp, Homo sapiens
attgacacagtaccattt

SEQ ID NO: 2241678 - DNA, 17 bp, Homo sapiens
attgcagtttatcattc

SEQ ID NO: 2241679 - DNA, 19 bp, Homo sapiens
attgcagtttatcattcaa

SEQ ID NO: 2241680 - DNA, 23 bp, Homo sapiens
attgcagtttatcattcaagtgt

SEQ ID NO: 2241681 - DNA, 18 bp, Homo sapiens
attgctcagcccgcttgg

SEQ ID NO: 2241682 - DNA, 23 bp, Homo sapiens
attgctgagagaaatatggaact

SEQ ID NO: 2241683 - DNA, 19 bp, Homo sapiens
attgctgtctatgattgta

SEQ ID NO: 2241684 - DNA, 13 bp, Homo sapiens
attgtaaaagcat

SEQ ID NO: 2241685 - DNA, 20 bp, Homo sapiens
attgtaaaagcattttgtaa

SEQ ID NO: 2241686 - DNA, 16 bp, Homo sapiens
attgtaaattgaatca

SEQ ID NO: 2241687 - DNA, 23 bp, Homo sapiens
attgtaaattgaatcagtataaa

SEQ ID NO: 2241688 - DNA, 15 bp, Homo sapiens
attgtatgtggtcat

SEQ ID NO: 2241689 - DNA, 22 bp, Homo sapiens
attgtctcctatatatttctat

SEQ ID NO: 2241690 - DNA, 20 bp, Homo sapiens
attgtgttacctgtagattc

SEQ ID NO: 2241691 - DNA, 22 bp, Homo sapiens
attgtgttgactttataaattt

SEQ ID NO: 2241692 - DNA, 20 bp, Homo sapiens
attgttgttttaacctcccc

SEQ ID NO: 2241693 - DNA, 16 bp, Homo sapiens
attgtttagtggaaaa

SEQ ID NO: 2241694 - DNA, 13 bp, Homo sapiens
attgttttacaat

SEQ ID NO: 2241695 - DNA, 14 bp, Homo sapiens
attgttttacaata

SEQ ID NO: 2241696 - DNA, 18 bp, Homo sapiens
atttaaaaatatttttgg

SEQ ID NO: 2241697 - DNA, 19 bp, Homo sapiens
atttaaaacattaaaatat

SEQ ID NO: 2241698 - DNA, 21 bp, Homo sapiens
atttaaaacattaaaatataa

SEQ ID NO: 2241699 - DNA, 20 bp, Homo sapiens
atttaaaccttttattataa

SEQ ID NO: 2241700 - DNA, 22 bp, Homo sapiens
atttaaatattaccctccaagt

SEQ ID NO: 2241701 - DNA, 15 bp, Homo sapiens
atttaacagctgaat

SEQ ID NO: 2241702 - DNA, 16 bp, Homo sapiens
atttaacttttctacc

SEQ ID NO: 2241703 - DNA, 13 bp, Homo sapiens
atttaagatgtga

SEQ ID NO: 2241704 - DNA, 12 bp, Homo sapiens
atttaaggtatt

SEQ ID NO: 2241705 - DNA, 17 bp, Homo sapiens
atttagttgtttctaga

SEQ ID NO: 2241706 - DNA, 14 bp, Homo sapiens
atttatacaaatta

SEQ ID NO: 2241707 - DNA, 15 bp, Homo sapiens
atttatacagttgaa

SEQ ID NO: 2241708 - DNA, 22 bp, Homo sapiens
atttatccagaaaactgtgatt

SEQ ID NO: 2241709 - DNA, 13 bp, Homo sapiens
atttatgtttgca

SEQ ID NO: 2241710 - DNA, 12 bp, Homo sapiens
atttattacata

SEQ ID NO: 2241711 - DNA, 11 bp, Homo sapiens
atttattattt

SEQ ID NO: 2241712 - DNA, 19 bp, Homo sapiens
atttattatttatttatta

SEQ ID NO: 2241713 - DNA, 15 bp, Homo sapiens
atttatttatccaga

SEQ ID NO: 2241714 - DNA, 17 bp, Homo sapiens
atttattttaaacgctt

SEQ ID NO: 2241715 - DNA, 20 bp, Homo sapiens
atttcaatgtgtataaattg

SEQ ID NO: 2241716 - DNA, 16 bp, Homo sapiens
atttcataatttgttt

SEQ ID NO: 2241717 - DNA, 23 bp, Homo sapiens
atttcataatttgtttccagcat

SEQ ID NO: 2241718 - DNA, 19 bp, Homo sapiens
atttcatccagtttgttct

SEQ ID NO: 2241719 - DNA, 14 bp, Homo sapiens
atttcatctcattt

SEQ ID NO: 2241720 - DNA, 22 bp, Homo sapiens
atttcatctcatttaagggaaa

SEQ ID NO: 2241721 - DNA, 18 bp, Homo sapiens
atttcccaacacaaagat

SEQ ID NO: 2241722 - DNA, 16 bp, Homo sapiens
atttctagctttttaa

SEQ ID NO: 2241723 - DNA, 22 bp, Homo sapiens
atttctattattaattgcaaaa

SEQ ID NO: 2241724 - DNA, 19 bp, Homo sapiens
atttctgggggaggatgta

SEQ ID NO: 2241725 - DNA, 19 bp, Homo sapiens
atttctgtcacagtaaaaa

SEQ ID NO: 2241726 - DNA, 21 bp, Homo sapiens
atttctgtcacagtaaaaata

SEQ ID NO: 2241727 - DNA, 22 bp, Homo sapiens
atttcttaattattataaaaat

SEQ ID NO: 2241728 - DNA, 21 bp, Homo sapiens
atttctttattttcttctcca

SEQ ID NO: 2241729 - DNA, 21 bp, Homo sapiens
atttctttctttgcaccaaag

SEQ ID NO: 2241730 - DNA, 22 bp, Homo sapiens
atttctttctttgcaccaaaga

SEQ ID NO: 2241731 - DNA, 19 bp, Homo sapiens
atttgaacaatgaagttga

SEQ ID NO: 2241732 - DNA, 14 bp, Homo sapiens
atttgaagggtctt

SEQ ID NO: 2241733 - DNA, 17 bp, Homo sapiens
atttgaattatttctgt

SEQ ID NO: 2241734 - DNA, 14 bp, Homo sapiens
atttgactaatttt

SEQ ID NO: 2241735 - DNA, 14 bp, Homo sapiens
atttgagagaagcc

SEQ ID NO: 2241736 - DNA, 23 bp, Homo sapiens
atttgaggagtgttaagattgca

SEQ ID NO: 2241737 - DNA, 23 bp, Homo sapiens
atttgctaaatgctgttcttaca

SEQ ID NO: 2241738 - DNA, 21 bp, Homo sapiens
atttgtctgaaacatttcata

SEQ ID NO: 2241739 - DNA, 21 bp, Homo sapiens
atttgtctttttgttgtaaaa

SEQ ID NO: 2241740 - DNA, 22 bp, Homo sapiens
atttgtctttttgttgtaaaac

SEQ ID NO: 2241741 - DNA, 18 bp, Homo sapiens
atttgtgatagcactttc

SEQ ID NO: 2241742 - DNA, 21 bp, Homo sapiens
attttaaaagcaattatattg

SEQ ID NO: 2241743 - DNA, 21 bp, Homo sapiens
attttaaataatgtatttact

SEQ ID NO: 2241744 - DNA, 12 bp, Homo sapiens
attttaccaaag

SEQ ID NO: 2241745 - DNA, 13 bp, Homo sapiens
attttaccaaagc

SEQ ID NO: 2241746 - DNA, 15 bp, Homo sapiens
attttaccaaagcat

SEQ ID NO: 2241747 - DNA, 22 bp, Homo sapiens
attttaccaaagcatcaataca

SEQ ID NO: 2241748 - DNA, 15 bp, Homo sapiens
attttatataaagta

SEQ ID NO: 2241749 - DNA, 22 bp, Homo sapiens
attttatctgtttcctgacatt

SEQ ID NO: 2241750 - DNA, 19 bp, Homo sapiens
attttcacattcttggctt

SEQ ID NO: 2241751 - DNA, 20 bp, Homo sapiens
attttcacattcttggctta

SEQ ID NO: 2241752 - DNA, 14 bp, Homo sapiens
attttcaccgagca

SEQ ID NO: 2241753 - DNA, 12 bp, Homo sapiens
attttgaatcaa

SEQ ID NO: 2241754 - DNA, 15 bp, Homo sapiens
attttgaatcaataa

SEQ ID NO: 2241755 - DNA, 19 bp, Homo sapiens
attttgagatgtaaaaaga

SEQ ID NO: 2241756 - DNA, 19 bp, Homo sapiens
attttggagattataataa

SEQ ID NO: 2241757 - DNA, 20 bp, Homo sapiens
attttggagattataataaa

SEQ ID NO: 2241758 - DNA, 15 bp, Homo sapiens
attttggtgagaaat

SEQ ID NO: 2241759 - DNA, 19 bp, Homo sapiens
attttgtaataataaagaa

SEQ ID NO: 2241760 - DNA, 22 bp, Homo sapiens
attttgttaccttttacagaat

SEQ ID NO: 2241761 - DNA, 14 bp, Homo sapiens
atttttaaaaaata

SEQ ID NO: 2241762 - DNA, 19 bp, Homo sapiens
atttttaaaaaatattttc

SEQ ID NO: 2241763 - DNA, 22 bp, Homo sapiens
atttttaactttttatttctaa

SEQ ID NO: 2241764 - DNA, 21 bp, Homo sapiens
atttttacatttaaacctttt

SEQ ID NO: 2241765 - DNA, 15 bp, Homo sapiens
atttttatactgaca

SEQ ID NO: 2241766 - DNA, 15 bp, Homo sapiens
atttttgcttttaga

SEQ ID NO: 2241767 - DNA, 16 bp, Homo sapiens
atttttgttagcaaag

SEQ ID NO: 2241768 - DNA, 15 bp, Homo sapiens
atttttttctaccta

SEQ ID NO: 2241769 - DNA, 16 bp, Homo sapiens
atttttttctacctat

SEQ ID NO: 2241770 - DNA, 15 bp, Homo sapiens
attttttttgtaact

SEQ ID NO: 2241771 - DNA, 16 bp, Homo sapiens
attttttttgtaactt

SEQ ID NO: 2241772 - DNA, 20 bp, Homo sapiens
caaaaaagaaaagtagaaag

SEQ ID NO: 2241773 - DNA, 15 bp, Homo sapiens
caaaaaatgttttaa

SEQ ID NO: 2241774 - DNA, 16 bp, Homo sapiens
caaaaagaaaaaaaga

SEQ ID NO: 2241775 - DNA, 23 bp, Homo sapiens
caaaaataaactataaaacaaaa

SEQ ID NO: 2241776 - DNA, 14 bp, Homo sapiens
caaaaatatttata

SEQ ID NO: 2241777 - DNA, 19 bp, Homo sapiens
caaaaatgtccagccaccc

SEQ ID NO: 2241778 - DNA, 11 bp, Homo sapiens
caaaaattagg

SEQ ID NO: 2241779 - DNA, 18 bp, Homo sapiens
caaaacaaaaattaggta

SEQ ID NO: 2241780 - DNA, 12 bp, Homo sapiens
caaaacaaaggc

SEQ ID NO: 2241781 - DNA, 15 bp, Homo sapiens
caaaacaaaggccta

SEQ ID NO: 2241782 - DNA, 21 bp, Homo sapiens
caaaacatttctggacagtac

SEQ ID NO: 2241783 - DNA, 15 bp, Homo sapiens
caaaactatttttgt

SEQ ID NO: 2241784 - DNA, 23 bp, Homo sapiens
caaaactatttttgtaaaagaca

SEQ ID NO: 2241785 - DNA, 14 bp, Homo sapiens
caaaagacactgca

SEQ ID NO: 2241786 - DNA, 14 bp, Homo sapiens
caaaatatacaaaa

SEQ ID NO: 2241787 - DNA, 15 bp, Homo sapiens
caaacaaaaaagaaa

SEQ ID NO: 2241788 - DNA, 23 bp, Homo sapiens
caaacaagaaacgtgtcacactt

SEQ ID NO: 2241789 - DNA, 12 bp, Homo sapiens
caaacaccttcc

SEQ ID NO: 2241790 - DNA, 14 bp, Homo sapiens
caaacaccttccag

SEQ ID NO: 2241791 - DNA, 17 bp, Homo sapiens
caaaccaaattttaatt

SEQ ID NO: 2241792 - DNA, 21 bp, Homo sapiens
caaacccacctgctagtgtga

SEQ ID NO: 2241793 - DNA, 17 bp, Homo sapiens
caaacgcctcccctgcc

SEQ ID NO: 2241794 - DNA, 20 bp, Homo sapiens
caaacggcaacgtagcctgg

SEQ ID NO: 2241795 - DNA, 16 bp, Homo sapiens
caaactgatttctcac

SEQ ID NO: 2241796 - DNA, 15 bp, Homo sapiens
caaactggggcctcc

SEQ ID NO: 2241797 - DNA, 23 bp, Homo sapiens
caaactttaggtttttttaatga

SEQ ID NO: 2241798 - DNA, 14 bp, Homo sapiens
caaagacaggcaaa

SEQ ID NO: 2241799 - DNA, 13 bp, Homo sapiens
caaagacatcagt

SEQ ID NO: 2241800 - DNA, 17 bp, Homo sapiens
caaagacctacctccag

SEQ ID NO: 2241801 - DNA, 12 bp, Homo sapiens
caaagaggctgc

SEQ ID NO: 2241802 - DNA, 16 bp, Homo sapiens
caaagattaaatgtgt

SEQ ID NO: 2241803 - DNA, 16 bp, Homo sapiens
caaagcttttagaaat

SEQ ID NO: 2241804 - DNA, 20 bp, Homo sapiens
caaagcttttagaaatactg

SEQ ID NO: 2241805 - DNA, 19 bp, Homo sapiens
caaaggccacatacctctc

SEQ ID NO: 2241806 - DNA, 23 bp, Homo sapiens
caaaggcctaattctatgcctgt

SEQ ID NO: 2241807 - DNA, 16 bp, Homo sapiens
caaagttactaggtaa

SEQ ID NO: 2241808 - DNA, 21 bp, Homo sapiens
caaagttactaggtaacttca

SEQ ID NO: 2241809 - DNA, 22 bp, Homo sapiens
caaataatgatcgaaaaaataa

SEQ ID NO: 2241810 - DNA, 12 bp, Homo sapiens
caaatattattt

SEQ ID NO: 2241811 - DNA, 13 bp, Homo sapiens
caaatattgccaa

SEQ ID NO: 2241812 - DNA, 21 bp, Homo sapiens
caaatattgccaactcttcta

SEQ ID NO: 2241813 - DNA, 22 bp, Homo sapiens
caaatatttagatgtaattttg

SEQ ID NO: 2241814 - DNA, 23 bp, Homo sapiens
caaatatttagatgtaattttgt

SEQ ID NO: 2241815 - DNA, 13 bp, Homo sapiens
caaatattttcat

SEQ ID NO: 2241816 - DNA, 23 bp, Homo sapiens
caaatgggagactctttgaaatg

SEQ ID NO: 2241817 - DNA, 24 bp, Homo sapiens
caaatgggagactctttgaaatga

SEQ ID NO: 2241818 - DNA, 14 bp, Homo sapiens
caaatgtgattttt

SEQ ID NO: 2241819 - DNA, 16 bp, Homo sapiens
caaatgtgatttttgt

SEQ ID NO: 2241820 - DNA, 14 bp, Homo sapiens
caaatgtgctttga

SEQ ID NO: 2241821 - DNA, 15 bp, Homo sapiens
caaattaataatctt

SEQ ID NO: 2241822 - DNA, 15 bp, Homo sapiens
caacaataaaatttt

SEQ ID NO: 2241823 - DNA, 13 bp, Homo sapiens
caacagaaacatt

SEQ ID NO: 2241824 - DNA, 16 bp, Homo sapiens
caacagcaaaggaact

SEQ ID NO: 2241825 - DNA, 23 bp, Homo sapiens
caacaggtaaaacagggccacat

SEQ ID NO: 2241826 - DNA, 21 bp, Homo sapiens
caaccactaagaattcaaact

SEQ ID NO: 2241827 - DNA, 17 bp, Homo sapiens
caaccttcaaagaaact

SEQ ID NO: 2241828 - DNA, 21 bp, Homo sapiens
caaccttcaaagaaacttgaa

SEQ ID NO: 2241829 - DNA, 15 bp, Homo sapiens
caacgaatttacagt

SEQ ID NO: 2241830 - DNA, 14 bp, Homo sapiens
caacgtagcctggg

SEQ ID NO: 2241831 - DNA, 19 bp, Homo sapiens
caactactacctgtaatga

SEQ ID NO: 2241832 - DNA, 16 bp, Homo sapiens
caactgggccaggagg

SEQ ID NO: 2241833 - DNA, 18 bp, Homo sapiens
caacttgtatccaggcct

SEQ ID NO: 2241834 - DNA, 12 bp, Homo sapiens
caactttactgt

SEQ ID NO: 2241835 - DNA, 21 bp, Homo sapiens
caacttttaattactgttttc

SEQ ID NO: 2241836 - DNA, 19 bp, Homo sapiens
caactttttccctcactaa

SEQ ID NO: 2241837 - DNA, 23 bp, Homo sapiens
caagaaacgtgtcacacttgtga

SEQ ID NO: 2241838 - DNA, 22 bp, Homo sapiens
caagaccacggagggagcgaca

SEQ ID NO: 2241839 - DNA, 23 bp, Homo sapiens
caagatgaatgcagattacactg

SEQ ID NO: 2241840 - DNA, 22 bp, Homo sapiens
caagcagcgaccgccccctcct

SEQ ID NO: 2241841 - DNA, 15 bp, Homo sapiens
caagccaaagagcct

SEQ ID NO: 2241842 - DNA, 18 bp, Homo sapiens
caagcctaagggatcctg

SEQ ID NO: 2241843 - DNA, 18 bp, Homo sapiens
caagcctcactattactt

SEQ ID NO: 2241844 - DNA, 12 bp, Homo sapiens
caagctgcgggc

SEQ ID NO: 2241845 - DNA, 16 bp, Homo sapiens
caaggagtcagacatt

SEQ ID NO: 2241846 - DNA, 14 bp, Homo sapiens
caaggtataataaa

SEQ ID NO: 2241847 - DNA, 17 bp, Homo sapiens
caaggtataataaaatt

SEQ ID NO: 2241848 - DNA, 19 bp, Homo sapiens
caagtactggttgactttc

SEQ ID NO: 2241849 - DNA, 17 bp, Homo sapiens
caagtcccatcatagaa

SEQ ID NO: 2241850 - DNA, 16 bp, Homo sapiens
caagtctgtacctcaa

SEQ ID NO: 2241851 - DNA, 21 bp, Homo sapiens
caagtctgtacctcaaatgaa

SEQ ID NO: 2241852 - DNA, 20 bp, Homo sapiens
caagtgaaattattttggag

SEQ ID NO: 2241853 - DNA, 15 bp, Homo sapiens
caagtgtaaaatatt

SEQ ID NO: 2241854 - DNA, 19 bp, Homo sapiens
ccaccccaagagaactcgc

SEQ ID NO: 2241855 - DNA, 14 bp, Homo sapiens
ccacccccagcccc

SEQ ID NO: 2241856 - DNA, 13 bp, Homo sapiens
ccaccccccaggc

SEQ ID NO: 2241857 - DNA, 21 bp, Homo sapiens
ccacctagactgtaaacctct

SEQ ID NO: 2241858 - DNA, 14 bp, Homo sapiens
ccacgcctcctggc

SEQ ID NO: 2241859 - DNA, 16 bp, Homo sapiens
ccacgcctcctggcca

SEQ ID NO: 2241860 - DNA, 11 bp, Homo sapiens
ccacgctgtcc

SEQ ID NO: 2241861 - DNA, 21 bp, Homo sapiens
ccacgctgtcctctcgagccc

SEQ ID NO: 2241862 - DNA, 18 bp, Homo sapiens
ccactaccagccagcctc

SEQ ID NO: 2241863 - DNA, 21 bp, Homo sapiens
ccactactcaatactacctct

SEQ ID NO: 2241864 - DNA, 18 bp, Homo sapiens
ccactatgacagaggatt

SEQ ID NO: 2241865 - DNA, 14 bp, Homo sapiens
ccactcattccttc

SEQ ID NO: 2241866 - DNA, 15 bp, Homo sapiens
ccactcatttcatct

SEQ ID NO: 2241867 - DNA, 23 bp, Homo sapiens
ccactctggagcatttctcatca

SEQ ID NO: 2241868 - DNA, 13 bp, Homo sapiens
ccactgacagcta

SEQ ID NO: 2241869 - DNA, 21 bp, Homo sapiens
ccactgctcgtggactgtgct

SEQ ID NO: 2241870 - DNA, 14 bp, Homo sapiens
ccacttacctcaaa

SEQ ID NO: 2241871 - DNA, 19 bp, Homo sapiens
ccacttacctcaaattaag

SEQ ID NO: 2241872 - DNA, 15 bp, Homo sapiens
ccacttgtccgctgg

SEQ ID NO: 2241873 - DNA, 21 bp, Homo sapiens
ccagaataagttattgcagtt

SEQ ID NO: 2241874 - DNA, 24 bp, Homo sapiens
ccagacgctgccgctgccgctgca

SEQ ID NO: 2241875 - DNA, 13 bp, Homo sapiens
ccagacttccttg

SEQ ID NO: 2241876 - DNA, 14 bp, Homo sapiens
ccagagactttagg

SEQ ID NO: 2241877 - DNA, 14 bp, Homo sapiens
ccagagatgcaata

SEQ ID NO: 2241878 - DNA, 20 bp, Homo sapiens
ccagagcccgtcagcgtggg

SEQ ID NO: 2241879 - DNA, 23 bp, Homo sapiens
ccagagcgaggaaaggattttac

SEQ ID NO: 2241880 - DNA, 14 bp, Homo sapiens
ccagatgcaacctc

SEQ ID NO: 2241881 - DNA, 17 bp, Homo sapiens
ccagatgtttccagact

SEQ ID NO: 2241882 - DNA, 18 bp, Homo sapiens
ccagattttgctgtatat

SEQ ID NO: 2241883 - DNA, 12 bp, Homo sapiens
ccagcaccctct

SEQ ID NO: 2241884 - DNA, 22 bp, Homo sapiens
ccagcagttttcaagtcaaatt

SEQ ID NO: 2241885 - DNA, 19 bp, Homo sapiens
ccagccagcctcagaaggc

SEQ ID NO: 2241886 - DNA, 15 bp, Homo sapiens
ccagccccgactcca

SEQ ID NO: 2241887 - DNA, 18 bp, Homo sapiens
ccagccccgactccagcc

SEQ ID NO: 2241888 - DNA, 21 bp, Homo sapiens
ccagccccgactccagccagc

SEQ ID NO: 2241889 - DNA, 14 bp, Homo sapiens
ccagccctccccat

SEQ ID NO: 2241890 - DNA, 21 bp, Homo sapiens
ccagccctccccatggagcca

SEQ ID NO: 2241891 - DNA, 15 bp, Homo sapiens
ccagccgccctgggc

SEQ ID NO: 2241892 - DNA, 15 bp, Homo sapiens
ccagcctcagaaggc

SEQ ID NO: 2241893 - DNA, 12 bp, Homo sapiens
ccagcctccagg

SEQ ID NO: 2241894 - DNA, 14 bp, Homo sapiens
ccagcctggcacag

SEQ ID NO: 2241895 - DNA, 15 bp, Homo sapiens
ccagcctggctctgc

SEQ ID NO: 2241896 - DNA, 14 bp, Homo sapiens
ccagcgcctccctc

SEQ ID NO: 2241897 - DNA, 16 bp, Homo sapiens
ccagcgcctccctcca

SEQ ID NO: 2241898 - DNA, 17 bp, Homo sapiens
ccagcgcctccctccac

SEQ ID NO: 2241899 - DNA, 22 bp, Homo sapiens
ccagcgcctccctccaccccag

SEQ ID NO: 2241900 - DNA, 23 bp, Homo sapiens
ccagcgcctccctccaccccagg

SEQ ID NO: 2241901 - DNA, 22 bp, Homo sapiens
ccagctcaatggactggaaggg

SEQ ID NO: 2241902 - DNA, 14 bp, Homo sapiens
ccagctccctctat

SEQ ID NO: 2241903 - DNA, 16 bp, Homo sapiens
ccagctccctctattt

SEQ ID NO: 2241904 - DNA, 19 bp, Homo sapiens
ccagctgggctctgcaatt

SEQ ID NO: 2241905 - DNA, 15 bp, Homo sapiens
ccaggaagcccagga

SEQ ID NO: 2241906 - DNA, 16 bp, Homo sapiens
ccaggacgccactcat

SEQ ID NO: 2241907 - DNA, 21 bp, Homo sapiens
ccaggacgccactcatttcat

SEQ ID NO: 2241908 - DNA, 22 bp, Homo sapiens
ccaggacgccactcatttcatc

SEQ ID NO: 2241909 - DNA, 23 bp, Homo sapiens
ccaggacgccactcatttcatct

SEQ ID NO: 2241910 - DNA, 15 bp, Homo sapiens
ccaggatactggcac

SEQ ID NO: 2241911 - DNA, 17 bp, Homo sapiens
ccaggatactggcacag

SEQ ID NO: 2241912 - DNA, 17 bp, Homo sapiens
ccaggcaccaggactag

SEQ ID NO: 2241913 - DNA, 17 bp, Homo sapiens
ccaggcacccacatccc

SEQ ID NO: 2241914 - DNA, 19 bp, Homo sapiens
ccaggcacccacatcccca

SEQ ID NO: 2241915 - DNA, 18 bp, Homo sapiens
ccaggcagacaaccttgt

SEQ ID NO: 2241916 - DNA, 21 bp, Homo sapiens
ccaggcatctgttagcagagt

SEQ ID NO: 2241917 - DNA, 17 bp, Homo sapiens
ccaggccctccctgact

SEQ ID NO: 2241918 - DNA, 17 bp, Homo sapiens
ccagggatgggggatgg

SEQ ID NO: 2241919 - DNA, 21 bp, Homo sapiens
ccagggatgggggatgggcca

SEQ ID NO: 2241920 - DNA, 22 bp, Homo sapiens
ccagggatgggggatgggccag

SEQ ID NO: 2241921 - DNA, 17 bp, Homo sapiens
ccagggcattgctcagc

SEQ ID NO: 2241922 - DNA, 21 bp, Homo sapiens
ccaggtccctccgcggctgga

SEQ ID NO: 2241923 - DNA, 15 bp, Homo sapiens
ccagtatacctcatt

SEQ ID NO: 2241924 - DNA, 21 bp, Homo sapiens
ccagtatacctcatttttcat

SEQ ID NO: 2241925 - DNA, 12 bp, Homo sapiens
ccagtgggacag

SEQ ID NO: 2241926 - DNA, 17 bp, Homo sapiens
ccagtgggacagaggag

SEQ ID NO: 2241927 - DNA, 18 bp, Homo sapiens
ccagttttactgtgattc

SEQ ID NO: 2241928 - DNA, 14 bp, Homo sapiens
ccatccagccagac

SEQ ID NO: 2241929 - DNA, 20 bp, Homo sapiens
ccatccagccagaccccacg

SEQ ID NO: 2241930 - DNA, 15 bp, Homo sapiens
ccatccagcctccag

SEQ ID NO: 2241931 - DNA, 18 bp, Homo sapiens
ccatccagcctccagggc

SEQ ID NO: 2241932 - DNA, 19 bp, Homo sapiens
ccatccagcctccagggca

SEQ ID NO: 2241933 - DNA, 19 bp, Homo sapiens
ccatccctgggcccctcca

SEQ ID NO: 2241934 - DNA, 20 bp, Homo sapiens
ccatccctgggcccctccac

SEQ ID NO: 2241935 - DNA, 14 bp, Homo sapiens
ccatctttgtatat

SEQ ID NO: 2241936 - DNA, 17 bp, Homo sapiens
ccatctttgtatattta

SEQ ID NO: 2241937 - DNA, 16 bp, Homo sapiens
ccatcttttattcttt

SEQ ID NO: 2241938 - DNA, 14 bp, Homo sapiens
ccatgccagagagg

SEQ ID NO: 2241939 - DNA, 20 bp, Homo sapiens
ccatggtactgtagcagggg

SEQ ID NO: 2241940 - DNA, 22 bp, Homo sapiens
ccatggtactgtagcaggggaa

SEQ ID NO: 2241941 - DNA, 16 bp, Homo sapiens
ccatggtctttccact

SEQ ID NO: 2241942 - DNA, 20 bp, Homo sapiens
ccatggtctttccactttca

SEQ ID NO: 2241943 - DNA, 14 bp, Homo sapiens
ccatgtagccccct

SEQ ID NO: 2241944 - DNA, 22 bp, Homo sapiens
ccatgtagccccctggcctctg

SEQ ID NO: 2241945 - DNA, 13 bp, Homo sapiens
ccatgtccaaaga

SEQ ID NO: 2241946 - DNA, 19 bp, Homo sapiens
ccatgtccaaagaggctgc

SEQ ID NO: 2241947 - DNA, 18 bp, Homo sapiens
ccatgtggtggcacaggc

SEQ ID NO: 2241948 - DNA, 14 bp, Homo sapiens
ccatgtgtcccctc

SEQ ID NO: 2241949 - DNA, 20 bp, Homo sapiens
ccatttaatggggaggacaa

SEQ ID NO: 2241950 - DNA, 16 bp, Homo sapiens
cccaaacaggacagca

SEQ ID NO: 2241951 - DNA, 16 bp, Homo sapiens
cccaacctttccctca

SEQ ID NO: 2241952 - DNA, 11 bp, Homo sapiens
cccaactgtct

SEQ ID NO: 2241953 - DNA, 17 bp, Homo sapiens
cccaaggaatcagcagg

SEQ ID NO: 2241954 - DNA, 22 bp, Homo sapiens
cccacacacttagccattgaaa

SEQ ID NO: 2241955 - DNA, 20 bp, Homo sapiens
cccacaggaagcctgcagtc

SEQ ID NO: 2241956 - DNA, 17 bp, Homo sapiens
cccacaggagggccagc

SEQ ID NO: 2241957 - DNA, 21 bp, Homo sapiens
cccacaggagggccagcgctg

SEQ ID NO: 2241958 - DNA, 15 bp, Homo sapiens
cccaccagagccggg

SEQ ID NO: 2241959 - DNA, 18 bp, Homo sapiens
cccacccccagccccgac

SEQ ID NO: 2241960 - DNA, 21 bp, Homo sapiens
cccaccgggagcctccccctc

SEQ ID NO: 2241961 - DNA, 24 bp, Homo sapiens
cccacgctgaccatgcgtcagggg

SEQ ID NO: 2241962 - DNA, 14 bp, Homo sapiens
cccactccccagcc

SEQ ID NO: 2241963 - DNA, 13 bp, Homo sapiens
catccagcctcca

SEQ ID NO: 2241964 - DNA, 23 bp, Homo sapiens
catccagcctccagggcattgct

SEQ ID NO: 2241965 - DNA, 22 bp, Homo sapiens
catccctgggcccctccacgcc

SEQ ID NO: 2241966 - DNA, 21 bp, Homo sapiens
catcctacaactcacattaga

SEQ ID NO: 2241967 - DNA, 20 bp, Homo sapiens
catcggaggctgggcccctg

SEQ ID NO: 2241968 - DNA, 16 bp, Homo sapiens
catctgcaacaaaaag

SEQ ID NO: 2241969 - DNA, 19 bp, Homo sapiens
catctgcaacaaaaagtca

SEQ ID NO: 2241970 - DNA, 21 bp, Homo sapiens
catctggaagatcattttgaa

SEQ ID NO: 2241971 - DNA, 22 bp, Homo sapiens
catctgttagcagagtctgtct

SEQ ID NO: 2241972 - DNA, 13 bp, Homo sapiens
catcttctgcctt

SEQ ID NO: 2241973 - DNA, 21 bp, Homo sapiens
catcttgagccacagtcactg

SEQ ID NO: 2241974 - DNA, 17 bp, Homo sapiens
catctttgtatatttac

SEQ ID NO: 2241975 - DNA, 19 bp, Homo sapiens
catgaaagagaaagactga

SEQ ID NO: 2241976 - DNA, 13 bp, Homo sapiens
catgaaatgtgaa

SEQ ID NO: 2241977 - DNA, 16 bp, Homo sapiens
catgaattttaaataa

SEQ ID NO: 2241978 - DNA, 16 bp, Homo sapiens
catgacaatgttgtag

SEQ ID NO: 2241979 - DNA, 14 bp, Homo sapiens
catgaggtatctaa

SEQ ID NO: 2241980 - DNA, 23 bp, Homo sapiens
catgatctgtatttaatggtttt

SEQ ID NO: 2241981 - DNA, 16 bp, Homo sapiens
catgcaaacaagaaac

SEQ ID NO: 2241982 - DNA, 18 bp, Homo sapiens
catgccaataaagtgatc

SEQ ID NO: 2241983 - DNA, 17 bp, Homo sapiens
catgccctgtgtggctg

SEQ ID NO: 2241984 - DNA, 18 bp, Homo sapiens
catgcctcactaattttt

SEQ ID NO: 2241985 - DNA, 23 bp, Homo sapiens
catgctgctatacacaagcaatg

SEQ ID NO: 2241986 - DNA, 19 bp, Homo sapiens
catgctgtctggccctggg

SEQ ID NO: 2241987 - DNA, 10 bp, Homo sapiens
catggagcca

SEQ ID NO: 2241988 - DNA, 17 bp, Homo sapiens
catggagccagctccct

SEQ ID NO: 2241989 - DNA, 20 bp, Homo sapiens
catggtctttccactttcat

SEQ ID NO: 2241990 - DNA, 17 bp, Homo sapiens
catgtaaagtgtcagaa

SEQ ID NO: 2241991 - DNA, 13 bp, Homo sapiens
catgtagccccct

SEQ ID NO: 2241992 - DNA, 18 bp, Homo sapiens
catgtagccccctggcct

SEQ ID NO: 2241993 - DNA, 21 bp, Homo sapiens
catgtagccccctggcctctg

SEQ ID NO: 2241994 - DNA, 14 bp, Homo sapiens
catgtatgcctgcc

SEQ ID NO: 2241995 - DNA, 13 bp, Homo sapiens
catgtattttaca

SEQ ID NO: 2241996 - DNA, 12 bp, Homo sapiens
catgtccaaaga

SEQ ID NO: 2241997 - DNA, 19 bp, Homo sapiens
catgtccaaagaggctgcc

SEQ ID NO: 2241998 - DNA, 21 bp, Homo sapiens
catgtccaaagaggctgcccc

SEQ ID NO: 2241999 - DNA, 12 bp, Homo sapiens
catgttggccaa

SEQ ID NO: 2242000 - DNA, 21 bp, Homo sapiens
catgttggccaggctggtctt

SEQ ID NO: 2242001 - DNA, 13 bp, Homo sapiens
catgtttataaat

SEQ ID NO: 2242002 - DNA, 14 bp, Homo sapiens
cattaaaatataat

SEQ ID NO: 2242003 - DNA, 12 bp, Homo sapiens
cattaataaaac

SEQ ID NO: 2242004 - DNA, 13 bp, Homo sapiens
cattaataaaact

SEQ ID NO: 2242005 - DNA, 15 bp, Homo sapiens
cattaatactcttta

SEQ ID NO: 2242006 - DNA, 18 bp, Homo sapiens
cattaattatatgtatat

SEQ ID NO: 2242007 - DNA, 14 bp, Homo sapiens
cattagaattattt

SEQ ID NO: 2242008 - DNA, 19 bp, Homo sapiens
cattagagaacatcctggc

SEQ ID NO: 2242009 - DNA, 18 bp, Homo sapiens
cattagccagatttgtct

SEQ ID NO: 2242010 - DNA, 24 bp, Homo sapiens
cattatctagttcattgaatcatt

SEQ ID NO: 2242011 - DNA, 20 bp, Homo sapiens
cattatttttgttagcaaag

SEQ ID NO: 2242012 - DNA, 22 bp, Homo sapiens
cattcaactttagtatttttac

SEQ ID NO: 2242013 - DNA, 21 bp, Homo sapiens
cattcaagtgtaaaatatttt

SEQ ID NO: 2242014 - DNA, 22 bp, Homo sapiens
cattcaagtgtaaaatattttg

SEQ ID NO: 2242015 - DNA, 15 bp, Homo sapiens
cattcagctaacaaa

SEQ ID NO: 2242016 - DNA, 19 bp, Homo sapiens
cattcagtgattactgtca

SEQ ID NO: 2242017 - DNA, 23 bp, Homo sapiens
cattcatttgttttttcaatgtt

SEQ ID NO: 2242018 - DNA, 13 bp, Homo sapiens
cattctcttttaa

SEQ ID NO: 2242019 - DNA, 14 bp, Homo sapiens
cattctcttttaat

SEQ ID NO: 2242020 - DNA, 16 bp, Homo sapiens
cattctgggctgggaa

SEQ ID NO: 2242021 - DNA, 19 bp, Homo sapiens
cattcttggcttaatcatt

SEQ ID NO: 2242022 - DNA, 10 bp, Homo sapiens
cattctttcc

SEQ ID NO: 2242023 - DNA, 22 bp, Homo sapiens
cattgctcagcccgcttggcca

SEQ ID NO: 2242024 - DNA, 20 bp, Homo sapiens
cattggccagctcataaaat

SEQ ID NO: 2242025 - DNA, 15 bp, Homo sapiens
cattgtatgtggtca

SEQ ID NO: 2242026 - DNA, 22 bp, Homo sapiens
cattgtcgtataggcatgtaaa

SEQ ID NO: 2242027 - DNA, 19 bp, Homo sapiens
cattgtctcctatatattt

SEQ ID NO: 2242028 - DNA, 14 bp, Homo sapiens
cattgtgttacctg

SEQ ID NO: 2242029 - DNA, 20 bp, Homo sapiens
cattgttgttttaacctccc

SEQ ID NO: 2242030 - DNA, 19 bp, Homo sapiens
catttaaaacattaaaata

SEQ ID NO: 2242031 - DNA, 17 bp, Homo sapiens
catttaagggaaaaata

SEQ ID NO: 2242032 - DNA, 15 bp, Homo sapiens
catttagcaataaat

SEQ ID NO: 2242033 - DNA, 20 bp, Homo sapiens
catttagcaataaataacac

SEQ ID NO: 2242034 - DNA, 23 bp, Homo sapiens
catttatttatccagaaaactgt

SEQ ID NO: 2242035 - DNA, 14 bp, Homo sapiens
catttcaatgtgta

SEQ ID NO: 2242036 - DNA, 20 bp, Homo sapiens
catttcaatgtgtataaatt

SEQ ID NO: 2242037 - DNA, 23 bp, Homo sapiens
catttctaattaaccttactaat

SEQ ID NO: 2242038 - DNA, 17 bp, Homo sapiens
catttctatgcaggcag

SEQ ID NO: 2242039 - DNA, 16 bp, Homo sapiens
catttgtgctagaaat

SEQ ID NO: 2242040 - DNA, 20 bp, Homo sapiens
catttgtgctagaaattttc

SEQ ID NO: 2242041 - DNA, 22 bp, Homo sapiens
catttgtttctttctctgagga

SEQ ID NO: 2242042 - DNA, 23 bp, Homo sapiens
catttgtttctttctctgaggac

SEQ ID NO: 2242043 - DNA, 22 bp, Homo sapiens
cattttaaaagcaattatattg

SEQ ID NO: 2242044 - DNA, 14 bp, Homo sapiens
cattttcattccta

SEQ ID NO: 2242045 - DNA, 11 bp, Homo sapiens
catttttcata

SEQ ID NO: 2242046 - DNA, 19 bp, Homo sapiens
ccaaaaatgtgtaagaaca

SEQ ID NO: 2242047 - DNA, 13 bp, Homo sapiens
ccaaaacatttct

SEQ ID NO: 2242048 - DNA, 18 bp, Homo sapiens
ccaaaacatttctggaca

SEQ ID NO: 2242049 - DNA, 15 bp, Homo sapiens
ccaaacaccttccag

SEQ ID NO: 2242050 - DNA, 16 bp, Homo sapiens
ccaaacttggattttt

SEQ ID NO: 2242051 - DNA, 18 bp, Homo sapiens
ccaaacttggatttttga

SEQ ID NO: 2242052 - DNA, 16 bp, Homo sapiens
ccaaatgaaactcaaa

SEQ ID NO: 2242053 - DNA, 16 bp, Homo sapiens
ccaacctttccctcac

SEQ ID NO: 2242054 - DNA, 17 bp, Homo sapiens
ccaacctttccctcacc

SEQ ID NO: 2242055 - DNA, 19 bp, Homo sapiens
ccaacctttccctcacccc

SEQ ID NO: 2242056 - DNA, 21 bp, Homo sapiens
ccaagacggaggaggggaagg

SEQ ID NO: 2242057 - DNA, 12 bp, Homo sapiens
ccaagctgcggg

SEQ ID NO: 2242058 - DNA, 18 bp, Homo sapiens
ccaagtctgtacctcaaa

SEQ ID NO: 2242059 - DNA, 16 bp, Homo sapiens
ccaataaacagctccc

SEQ ID NO: 2242060 - DNA, 19 bp, Homo sapiens
ccaataggcaaattaatca

SEQ ID NO: 2242061 - DNA, 15 bp, Homo sapiens
ccaatgctgctccac

SEQ ID NO: 2242062 - DNA, 15 bp, Homo sapiens
ccaatgtaggagctg

SEQ ID NO: 2242063 - DNA, 17 bp, Homo sapiens
ccaatgtaggagctgcc

SEQ ID NO: 2242064 - DNA, 20 bp, Homo sapiens
ccaatgtaggagctgccttg

SEQ ID NO: 2242065 - DNA, 18 bp, Homo sapiens
ccaattctggacagacag

SEQ ID NO: 2242066 - DNA, 23 bp, Homo sapiens
ccacacacttagccattgaaatg

SEQ ID NO: 2242067 - DNA, 16 bp, Homo sapiens
ccacaccctgtactgt

SEQ ID NO: 2242068 - DNA, 13 bp, Homo sapiens
ccacagaggacac

SEQ ID NO: 2242069 - DNA, 19 bp, Homo sapiens
ccacaggagggccagcgct

SEQ ID NO: 2242070 - DNA, 15 bp, Homo sapiens
ccaccagagccggga

SEQ ID NO: 2242071 - DNA, 15 bp, Homo sapiens
ccaccccaagagaac

SEQ ID NO: 2242072 - DNA, 15 bp, Homo sapiens
cccagagagaccctg

SEQ ID NO: 2242073 - DNA, 20 bp, Homo sapiens
cccagagcgaggaaaggatt

SEQ ID NO: 2242074 - DNA, 18 bp, Homo sapiens
cccagattttgctgtata

SEQ ID NO: 2242075 - DNA, 21 bp, Homo sapiens
cccagcactaaggccgtgtct

SEQ ID NO: 2242076 - DNA, 15 bp, Homo sapiens
cccagccccagcccc

SEQ ID NO: 2242077 - DNA, 16 bp, Homo sapiens
cccagccccagcccct

SEQ ID NO: 2242078 - DNA, 18 bp, Homo sapiens
cccagccccgactccagc

SEQ ID NO: 2242079 - DNA, 19 bp, Homo sapiens
cccagccccgactccagcc

SEQ ID NO: 2242080 - DNA, 23 bp, Homo sapiens
cccagccccgactccagccagcg

SEQ ID NO: 2242081 - DNA, 17 bp, Homo sapiens
cccagccctgctgggga

SEQ ID NO: 2242082 - DNA, 11 bp, Homo sapiens
cccagcctggc

SEQ ID NO: 2242083 - DNA, 15 bp, Homo sapiens
cccagccttagatgc

SEQ ID NO: 2242084 - DNA, 22 bp, Homo sapiens
cccaggacgccactcatttcat

SEQ ID NO: 2242085 - DNA, 21 bp, Homo sapiens
cccaggcatctgttagcagag

SEQ ID NO: 2242086 - DNA, 22 bp, Homo sapiens
cccaggcatctgttagcagagt

SEQ ID NO: 2242087 - DNA, 17 bp, Homo sapiens
cccaggccctccctgac

SEQ ID NO: 2242088 - DNA, 21 bp, Homo sapiens
cccagtatacctcatttttca

SEQ ID NO: 2242089 - DNA, 13 bp, Homo sapiens
cccagtcacttcc

SEQ ID NO: 2242090 - DNA, 15 bp, Homo sapiens
cccagtgacaacatc

SEQ ID NO: 2242091 - DNA, 12 bp, Homo sapiens
cccatccagcct

SEQ ID NO: 2242092 - DNA, 23 bp, Homo sapiens
cccatgacaatgttgtagtgtcc

SEQ ID NO: 2242093 - DNA, 19 bp, Homo sapiens
cccatggagccagctccct

SEQ ID NO: 2242094 - DNA, 23 bp, Homo sapiens
cccatgggctgtgtcctaaggcc

SEQ ID NO: 2242095 - DNA, 14 bp, Homo sapiens
cccatgtagccccc

SEQ ID NO: 2242096 - DNA, 22 bp, Homo sapiens
cccatgtgtcccctcactctgt

SEQ ID NO: 2242097 - DNA, 21 bp, Homo sapiens
cccatgtgtcctggttcccgt

SEQ ID NO: 2242098 - DNA, 18 bp, Homo sapiens
ccccaaacaccttccagc

SEQ ID NO: 2242099 - DNA, 13 bp, Homo sapiens
ccccaaacagtga

SEQ ID NO: 2242100 - DNA, 15 bp, Homo sapiens
ccccaacctttccct

SEQ ID NO: 2242101 - DNA, 17 bp, Homo sapiens
ccccaccccccaggcct

SEQ ID NO: 2242102 - DNA, 23 bp, Homo sapiens
ccccactcccttgctggccccag

SEQ ID NO: 2242103 - DNA, 17 bp, Homo sapiens
ccccagccatccagggg

SEQ ID NO: 2242104 - DNA, 13 bp, Homo sapiens
ccccagccctgct

SEQ ID NO: 2242105 - DNA, 17 bp, Homo sapiens
ccccagccctgctgggg

SEQ ID NO: 2242106 - DNA, 14 bp, Homo sapiens
ccccagcctctggc

SEQ ID NO: 2242107 - DNA, 16 bp, Homo sapiens
ccccaggccctccctg

SEQ ID NO: 2242108 - DNA, 16 bp, Homo sapiens
ccccagtcacttcctg

SEQ ID NO: 2242109 - DNA, 13 bp, Homo sapiens
ccccatccagcct

SEQ ID NO: 2242110 - DNA, 15 bp, Homo sapiens
ccccatccagcctcc

SEQ ID NO: 2242111 - DNA, 16 bp, Homo sapiens
ccccatccagcctcca

SEQ ID NO: 2242112 - DNA, 23 bp, Homo sapiens
ccccatgggctgtgtcctaaggc

SEQ ID NO: 2242113 - DNA, 14 bp, Homo sapiens
ccccatgtgtcctg

SEQ ID NO: 2242114 - DNA, 23 bp, Homo sapiens
ccccatgtgtcctggttcccgtt

SEQ ID NO: 2242115 - DNA, 19 bp, Homo sapiens
ccccattctttccttctct

SEQ ID NO: 2242116 - DNA, 17 bp, Homo sapiens
cccccacccccagctca

SEQ ID NO: 2242117 - DNA, 18 bp, Homo sapiens
cccccagacacagcccag

SEQ ID NO: 2242118 - DNA, 14 bp, Homo sapiens
cccccatccagcct

SEQ ID NO: 2242119 - DNA, 16 bp, Homo sapiens
ccccctgccccccagc

SEQ ID NO: 2242120 - DNA, 22 bp, Homo sapiens
ccccctgccccccagcctctgg

SEQ ID NO: 2242121 - DNA, 19 bp, Homo sapiens
ccccctggcctctgtgcct

SEQ ID NO: 2242122 - DNA, 15 bp, Homo sapiens
ccccctttcacactg

SEQ ID NO: 2242123 - DNA, 20 bp, Homo sapiens
ccccctttcctggacactca

SEQ ID NO: 2242124 - DNA, 16 bp, Homo sapiens
ccccgactccagccag

SEQ ID NO: 2242125 - DNA, 18 bp, Homo sapiens
ccccgactccagccagcg

SEQ ID NO: 2242126 - DNA, 18 bp, Homo sapiens
ccccgcctgccctcatgg

SEQ ID NO: 2242127 - DNA, 16 bp, Homo sapiens
ccccgcctggccagga

SEQ ID NO: 2242128 - DNA, 13 bp, Homo sapiens
ccccgcgccccag

SEQ ID NO: 2242129 - DNA, 18 bp, Homo sapiens
cccctcaaatcgtccagc

SEQ ID NO: 2242130 - DNA, 23 bp, Homo sapiens
cccctcagatgatctctccacgg

SEQ ID NO: 2242131 - DNA, 18 bp, Homo sapiens
cccctcccccatgggctg

SEQ ID NO: 2242132 - DNA, 19 bp, Homo sapiens
cccctcctctagctgtggg

SEQ ID NO: 2242133 - DNA, 18 bp, Homo sapiens
cccctctgacctgcactg

SEQ ID NO: 2242134 - DNA, 16 bp, Homo sapiens
cccctctgctgctgtc

SEQ ID NO: 2242135 - DNA, 21 bp, Homo sapiens
cccctctttgcacagcatgag

SEQ ID NO: 2242136 - DNA, 15 bp, Homo sapiens
cccctgcaaaaagaa

SEQ ID NO: 2242137 - DNA, 17 bp, Homo sapiens
cccctgcaaaaagaaaa

SEQ ID NO: 2242138 - DNA, 20 bp, Homo sapiens
cccctggaggcactgaagtg

SEQ ID NO: 2242139 - DNA, 12 bp, Homo sapiens
cccctggcctct

SEQ ID NO: 2242140 - DNA, 16 bp, Homo sapiens
ccccttccccttctgt

SEQ ID NO: 2242141 - DNA, 17 bp, Homo sapiens
ccccttctgtgtcacag

SEQ ID NO: 2242142 - DNA, 23 bp, Homo sapiens
cccctttcctggacactcagacc

SEQ ID NO: 2242143 - DNA, 20 bp, Homo sapiens
cccgactccagccagcgcct

SEQ ID NO: 2242144 - DNA, 12 bp, Homo sapiens
cccgcctgccct

SEQ ID NO: 2242145 - DNA, 14 bp, Homo sapiens
cccgcctgccctca

SEQ ID NO: 2242146 - DNA, 17 bp, Homo sapiens
cccgcctgccctcatgg

SEQ ID NO: 2242147 - DNA, 21 bp, Homo sapiens
cccgcctggccaggagcaggc

SEQ ID NO: 2242148 - DNA, 20 bp, Homo sapiens
cccgtgtgcacaccaccctc

SEQ ID NO: 2242149 - DNA, 18 bp, Homo sapiens
cccgttccaccccaagag

SEQ ID NO: 2242150 - DNA, 13 bp, Homo sapiens
ccctaaagcctca

SEQ ID NO: 2242151 - DNA, 20 bp, Homo sapiens
ccctagtcaaaactattttt

SEQ ID NO: 2242152 - DNA, 22 bp, Homo sapiens
ccctcaaagaagtcggaatgtc

SEQ ID NO: 2242153 - DNA, 17 bp, Homo sapiens
ccctcactctgtcagcc

SEQ ID NO: 2242154 - DNA, 22 bp, Homo sapiens
ccctcagatgatctctccacgg

SEQ ID NO: 2242155 - DNA, 18 bp, Homo sapiens
ccctcagcgcccccagag

SEQ ID NO: 2242156 - DNA, 20 bp, Homo sapiens
ccctccacgcctcctggcca

SEQ ID NO: 2242157 - DNA, 15 bp, Homo sapiens
ccctcccccttgtcc

SEQ ID NO: 2242158 - DNA, 14 bp, Homo sapiens
ccctcctccccgcg

SEQ ID NO: 2242159 - DNA, 12 bp, Homo sapiens
ccctccttcaga

SEQ ID NO: 2242160 - DNA, 13 bp, Homo sapiens
ccctctcagctcc

SEQ ID NO: 2242161 - DNA, 15 bp, Homo sapiens
ccctctccccgggac

SEQ ID NO: 2242162 - DNA, 10 bp, Homo sapiens
ccctctctct

SEQ ID NO: 2242163 - DNA, 14 bp, Homo sapiens
ccctctgacctgca

SEQ ID NO: 2242164 - DNA, 22 bp, Homo sapiens
ccctctggaggggtgtggctcc

SEQ ID NO: 2242165 - DNA, 19 bp, Homo sapiens
ccctctttgcacagcatga

SEQ ID NO: 2242166 - DNA, 20 bp, Homo sapiens
ccctctttgcacagcatgag

SEQ ID NO: 2242167 - DNA, 17 bp, Homo sapiens
ccctctttggctcccct

SEQ ID NO: 2242168 - DNA, 19 bp, Homo sapiens
ccctctttggctcccctgt

SEQ ID NO: 2242169 - DNA, 21 bp, Homo sapiens
ccctctttggctcccctgtac

SEQ ID NO: 2242170 - DNA, 16 bp, Homo sapiens
ccctgactccctgtgg

SEQ ID NO: 2242171 - DNA, 18 bp, Homo sapiens
ccctgactccctgtgggg

SEQ ID NO: 2242172 - DNA, 12 bp, Homo sapiens
ccctgaggccta

SEQ ID NO: 2242173 - DNA, 12 bp, Homo sapiens
ccctgcccccca

SEQ ID NO: 2242174 - DNA, 15 bp, Homo sapiens
ccctgccccccagcc

SEQ ID NO: 2242175 - DNA, 16 bp, Homo sapiens
ccctgccccccagcct

SEQ ID NO: 2242176 - DNA, 21 bp, Homo sapiens
ccctgccccccagcctctggc

SEQ ID NO: 2242177 - DNA, 15 bp, Homo sapiens
ccctggccgccccct

SEQ ID NO: 2242178 - DNA, 19 bp, Homo sapiens
ccctgggatgggaccaggg

SEQ ID NO: 2242179 - DNA, 15 bp, Homo sapiens
ccctgggcccctcca

SEQ ID NO: 2242180 - DNA, 18 bp, Homo sapiens
ccctgggctgtctgtcac

SEQ ID NO: 2242181 - DNA, 16 bp, Homo sapiens
cgccgtgtctcagcct

SEQ ID NO: 2242182 - DNA, 13 bp, Homo sapiens
cgcctccctccac

SEQ ID NO: 2242183 - DNA, 15 bp, Homo sapiens
cgcctccctccaccc

SEQ ID NO: 2242184 - DNA, 14 bp, Homo sapiens
cgcctcctggccag

SEQ ID NO: 2242185 - DNA, 17 bp, Homo sapiens
cgcctgccctcatggcc

SEQ ID NO: 2242186 - DNA, 22 bp, Homo sapiens
cgcctgccctcatggcccctct

SEQ ID NO: 2242187 - DNA, 13 bp, Homo sapiens
cgcggctggagcg

SEQ ID NO: 2242188 - DNA, 22 bp, Homo sapiens
cgctagggctccgaggagctgg

SEQ ID NO: 2242189 - DNA, 16 bp, Homo sapiens
cgctgtcctctcgagc

SEQ ID NO: 2242190 - DNA, 22 bp, Homo sapiens
cgcttcttatgtagagttttta

SEQ ID NO: 2242191 - DNA, 13 bp, Homo sapiens
cggacaaaatatc

SEQ ID NO: 2242192 - DNA, 16 bp, Homo sapiens
cggagagagccaagac

SEQ ID NO: 2242193 - DNA, 13 bp, Homo sapiens
cggaggaggggaa

SEQ ID NO: 2242194 - DNA, 22 bp, Homo sapiens
cggaggaggggaaggggctgag

SEQ ID NO: 2242195 - DNA, 18 bp, Homo sapiens
cggaggctgggcccctgg

SEQ ID NO: 2242196 - DNA, 19 bp, Homo sapiens
cggaggctgggcccctggg

SEQ ID NO: 2242197 - DNA, 22 bp, Homo sapiens
cggaggctgggcccctgggatg

SEQ ID NO: 2242198 - DNA, 15 bp, Homo sapiens
cggctccccatgtgt

SEQ ID NO: 2242199 - DNA, 17 bp, Homo sapiens
cgggaacatgccccctg

SEQ ID NO: 2242200 - DNA, 14 bp, Homo sapiens
cgggagcctccccc

SEQ ID NO: 2242201 - DNA, 18 bp, Homo sapiens
cgggagcctccccctcag

SEQ ID NO: 2242202 - DNA, 16 bp, Homo sapiens
cgggctaggaggaggg

SEQ ID NO: 2242203 - DNA, 17 bp, Homo sapiens
cgggctccctggcagga

SEQ ID NO: 2242204 - DNA, 20 bp, Homo sapiens
cgggctccctggcaggatgc

SEQ ID NO: 2242205 - DNA, 21 bp, Homo sapiens
cgggctccctggcaggatgct

SEQ ID NO: 2242206 - DNA, 22 bp, Homo sapiens
cgggtgtgcaatgtctgagtga

SEQ ID NO: 2242207 - DNA, 14 bp, Homo sapiens
cgggtgtggcctca

SEQ ID NO: 2242208 - DNA, 19 bp, Homo sapiens
cgggtgtggcctcagccct

SEQ ID NO: 2242209 - DNA, 18 bp, Homo sapiens
cggtgtggtgcagtgtga

SEQ ID NO: 2242210 - DNA, 18 bp, Homo sapiens
cggtgtgtaacactgtgt

SEQ ID NO: 2242211 - DNA, 22 bp, Homo sapiens
cggtttcgaagtcattaaactg

SEQ ID NO: 2242212 - DNA, 13 bp, Homo sapiens
cgtaatttaatgg

SEQ ID NO: 2242213 - DNA, 15 bp, Homo sapiens
cgtataggcatgtaa

SEQ ID NO: 2242214 - DNA, 16 bp, Homo sapiens
cgtataggcatgtaaa

SEQ ID NO: 2242215 - DNA, 22 bp, Homo sapiens
cgtccccccccaacctttccct

SEQ ID NO: 2242216 - DNA, 21 bp, Homo sapiens
cgtcctccctgatcccacccc

SEQ ID NO: 2242217 - DNA, 19 bp, Homo sapiens
cgtctacatttcacattat

SEQ ID NO: 2242218 - DNA, 15 bp, Homo sapiens
cgtgaatgtctcagc

SEQ ID NO: 2242219 - DNA, 16 bp, Homo sapiens
cgtgtctcagcctctg

SEQ ID NO: 2242220 - DNA, 14 bp, Homo sapiens
cgttatatattgta

SEQ ID NO: 2242221 - DNA, 13 bp, Homo sapiens
cgttcgatttcta

SEQ ID NO: 2242222 - DNA, 14 bp, Homo sapiens
cgttcgatttctac

SEQ ID NO: 2242223 - DNA, 15 bp, Homo sapiens
cgttcgatttctacc

SEQ ID NO: 2242224 - DNA, 18 bp, Homo sapiens
cgttcgatttctacctca

SEQ ID NO: 2242225 - DNA, 14 bp, Homo sapiens
cgtttaactgcagt

SEQ ID NO: 2242226 - DNA, 22 bp, Homo sapiens
cgtttctccacctagactgtaa

SEQ ID NO: 2242227 - DNA, 18 bp, Homo sapiens
cgtttggtgcttctcaga

SEQ ID NO: 2242228 - DNA, 16 bp, Homo sapiens
cgttttccccatgaca

SEQ ID NO: 2242229 - DNA, 13 bp, Homo sapiens
cgtttttgtgctg

SEQ ID NO: 2242230 - DNA, 22 bp, Homo sapiens
cgtttttgtgctgtgggcagca

SEQ ID NO: 2242231 - DNA, 19 bp, Homo sapiens
ctaaacaatgctgatttgg

SEQ ID NO: 2242232 - DNA, 16 bp, Homo sapiens
ctaaactagtttttcc

SEQ ID NO: 2242233 - DNA, 20 bp, Homo sapiens
ctaaagcatgaaatgtgaat

SEQ ID NO: 2242234 - DNA, 19 bp, Homo sapiens
ctaaaggaaatcaaatgaa

SEQ ID NO: 2242235 - DNA, 19 bp, Homo sapiens
ctaaatgctgttcttacac

SEQ ID NO: 2242236 - DNA, 21 bp, Homo sapiens
ctaaatgtttggcatgtaaat

SEQ ID NO: 2242237 - DNA, 17 bp, Homo sapiens
ctaaatttcttttgcta

SEQ ID NO: 2242238 - DNA, 20 bp, Homo sapiens
ctaacaacattgtagcctca

SEQ ID NO: 2242239 - DNA, 19 bp, Homo sapiens
ctaacccaggtatccaaaa

SEQ ID NO: 2242240 - DNA, 13 bp, Homo sapiens
ctaactttattct

SEQ ID NO: 2242241 - DNA, 22 bp, Homo sapiens
ctaagagtgctgggcattttta

SEQ ID NO: 2242242 - DNA, 17 bp, Homo sapiens
ctaataacatgtgaaaa

SEQ ID NO: 2242243 - DNA, 23 bp, Homo sapiens
ctaatagtgatcaagaagacttt

SEQ ID NO: 2242244 - DNA, 17 bp, Homo sapiens
ctaattaaccttactaa

SEQ ID NO: 2242245 - DNA, 18 bp, Homo sapiens
ctaattatactactttgt

SEQ ID NO: 2242246 - DNA, 21 bp, Homo sapiens
ctaattatactactttgttag

SEQ ID NO: 2242247 - DNA, 21 bp, Homo sapiens
ctaattgacttgcaaagacct

SEQ ID NO: 2242248 - DNA, 19 bp, Homo sapiens
ctaattggtacttttaaaa

SEQ ID NO: 2242249 - DNA, 20 bp, Homo sapiens
ctaattttacatgtttataa

SEQ ID NO: 2242250 - DNA, 17 bp, Homo sapiens
ctacaatgtgaacttta

SEQ ID NO: 2242251 - DNA, 16 bp, Homo sapiens
ctacaattcattgtgt

SEQ ID NO: 2242252 - DNA, 18 bp, Homo sapiens
ctacagtcaagatagaaa

SEQ ID NO: 2242253 - DNA, 16 bp, Homo sapiens
ctacatatgatctgtc

SEQ ID NO: 2242254 - DNA, 14 bp, Homo sapiens
ctacatcttctgcc

SEQ ID NO: 2242255 - DNA, 16 bp, Homo sapiens
ctacattaacttgaaa

SEQ ID NO: 2242256 - DNA, 13 bp, Homo sapiens
ctaccagccagcc

SEQ ID NO: 2242257 - DNA, 13 bp, Homo sapiens
ctaccattcagtg

SEQ ID NO: 2242258 - DNA, 18 bp, Homo sapiens
ctaccctttttctccagc

SEQ ID NO: 2242259 - DNA, 19 bp, Homo sapiens
ctaccctttttctccagct

SEQ ID NO: 2242260 - DNA, 17 bp, Homo sapiens
ctacctcaggcagctca

SEQ ID NO: 2242261 - DNA, 15 bp, Homo sapiens
ctactaatagtttgt

SEQ ID NO: 2242262 - DNA, 12 bp, Homo sapiens
ctactacctctt

SEQ ID NO: 2242263 - DNA, 15 bp, Homo sapiens
ctactgacagggagc

SEQ ID NO: 2242264 - DNA, 16 bp, Homo sapiens
ctactggattcttatt

SEQ ID NO: 2242265 - DNA, 13 bp, Homo sapiens
ctacttcctcctc

SEQ ID NO: 2242266 - DNA, 16 bp, Homo sapiens
ctacttgttcatttgg

SEQ ID NO: 2242267 - DNA, 14 bp, Homo sapiens
ctactttctctttt

SEQ ID NO: 2242268 - DNA, 16 bp, Homo sapiens
ctagaaattgacacaa

SEQ ID NO: 2242269 - DNA, 14 bp, Homo sapiens
ctagactataaatg

SEQ ID NO: 2242270 - DNA, 16 bp, Homo sapiens
ctagactataaatgtt

SEQ ID NO: 2242271 - DNA, 17 bp, Homo sapiens
ctagatactactttctc

SEQ ID NO: 2242272 - DNA, 16 bp, Homo sapiens
ctagccaaaccaggac

SEQ ID NO: 2242273 - DNA, 20 bp, Homo sapiens
ctagcctgatgagattttta

SEQ ID NO: 2242274 - DNA, 13 bp, Homo sapiens
ctagctacactga

SEQ ID NO: 2242275 - DNA, 13 bp, Homo sapiens
ctagctggctctg

SEQ ID NO: 2242276 - DNA, 14 bp, Homo sapiens
ctagctggctctgt

SEQ ID NO: 2242277 - DNA, 23 bp, Homo sapiens
ctaggatgtatattttatataaa

SEQ ID NO: 2242278 - DNA, 23 bp, Homo sapiens
ctagggctccgaggagctggggc

SEQ ID NO: 2242279 - DNA, 19 bp, Homo sapiens
ctagggttaggaggtcctt

SEQ ID NO: 2242280 - DNA, 18 bp, Homo sapiens
ctaggtgctatttgtcat

SEQ ID NO: 2242281 - DNA, 20 bp, Homo sapiens
ctagtcaaaactatttttgt

SEQ ID NO: 2242282 - DNA, 13 bp, Homo sapiens
ctataaaatagat

SEQ ID NO: 2242283 - DNA, 15 bp, Homo sapiens
ctatacacaagcaat

SEQ ID NO: 2242284 - DNA, 22 bp, Homo sapiens
ctatacacaagcaatgcaagaa

SEQ ID NO: 2242285 - DNA, 17 bp, Homo sapiens
ctatacatatctttatt

SEQ ID NO: 2242286 - DNA, 13 bp, Homo sapiens
ctatatatttcta

SEQ ID NO: 2242287 - DNA, 16 bp, Homo sapiens
ctatatatttctatta

SEQ ID NO: 2242288 - DNA, 13 bp, Homo sapiens
ctatattaatcac

SEQ ID NO: 2242289 - DNA, 18 bp, Homo sapiens
ctatattaatcaccttct

SEQ ID NO: 2242290 - DNA, 19 bp, Homo sapiens
ctatcaacaataaaatttt

SEQ ID NO: 2242291 - DNA, 14 bp, Homo sapiens
ctatcaatatttaa

SEQ ID NO: 2242292 - DNA, 22 bp, Homo sapiens
ctatccttggctttcagagcca

SEQ ID NO: 2242293 - DNA, 14 bp, Homo sapiens
ctatctatttgagg

SEQ ID NO: 2242294 - DNA, 22 bp, Homo sapiens
ctatctgtcatctctctggggc

SEQ ID NO: 2242295 - DNA, 18 bp, Homo sapiens
ctatgaaggatccatctt

SEQ ID NO: 2242296 - DNA, 19 bp, Homo sapiens
ctatgatttaatttgaaat

SEQ ID NO: 2242297 - DNA, 20 bp, Homo sapiens
ctatgatttaatttgaaata

SEQ ID NO: 2242298 - DNA, 19 bp, Homo sapiens
ctatggagagaattaaaac

SEQ ID NO: 2242299 - DNA, 17 bp, Homo sapiens
ctatggtatgctggcca

SEQ ID NO: 2242300 - DNA, 18 bp, Homo sapiens
ctatgtataaaatacata

SEQ ID NO: 2242301 - DNA, 24 bp, Homo sapiens
ctatgtataaaatacatagtgaaa

SEQ ID NO: 2242302 - DNA, 16 bp, Homo sapiens
ctatgtatttttctat

SEQ ID NO: 2242303 - DNA, 19 bp, Homo sapiens
ctatgtgccttatgttgaa

SEQ ID NO: 2242304 - DNA, 22 bp, Homo sapiens
ctatgtgccttatgttgaaaaa

SEQ ID NO: 2242305 - DNA, 21 bp, Homo sapiens
ctatgtttttttaattaaaaa

SEQ ID NO: 2242306 - DNA, 21 bp, Homo sapiens
ctattaaggtgatatatttaa

SEQ ID NO: 2242307 - DNA, 15 bp, Homo sapiens
ctattacttgaactt

SEQ ID NO: 2242308 - DNA, 16 bp, Homo sapiens
ctattacttgaacttt

SEQ ID NO: 2242309 - DNA, 21 bp, Homo sapiens
ctattacttgaactttccaaa

SEQ ID NO: 2242310 - DNA, 12 bp, Homo sapiens
ctattccaataa

SEQ ID NO: 2242311 - DNA, 15 bp, Homo sapiens
ctattccaataaact

SEQ ID NO: 2242312 - DNA, 15 bp, Homo sapiens
ctattctagcctgca

SEQ ID NO: 2242313 - DNA, 18 bp, Homo sapiens
ctattgcttggacttaac

SEQ ID NO: 2242314 - DNA, 13 bp, Homo sapiens
ctatttaattgaa

SEQ ID NO: 2242315 - DNA, 23 bp, Homo sapiens
ctattttaagactgattttaata

SEQ ID NO: 2242316 - DNA, 23 bp, Homo sapiens
ctcaagcagcgaccgccccctcc

SEQ ID NO: 2242317 - DNA, 16 bp, Homo sapiens
ctcaataaatgattct

SEQ ID NO: 2242318 - DNA, 16 bp, Homo sapiens
ctcaatactacctctg

SEQ ID NO: 2242319 - DNA, 14 bp, Homo sapiens
ctcaattagtgtgg

SEQ ID NO: 2242320 - DNA, 15 bp, Homo sapiens
ctcacatttttttct

SEQ ID NO: 2242321 - DNA, 23 bp, Homo sapiens
ctcaccactaccagccagcctca

SEQ ID NO: 2242322 - DNA, 15 bp, Homo sapiens
ctcaccccctcccac

SEQ ID NO: 2242323 - DNA, 21 bp, Homo sapiens
ctcaccccctcccacccccag

SEQ ID NO: 2242324 - DNA, 22 bp, Homo sapiens
ctcaccccctcccacccccagc

SEQ ID NO: 2242325 - DNA, 21 bp, Homo sapiens
ctcacctaattatgaggtggg

SEQ ID NO: 2242326 - DNA, 15 bp, Homo sapiens
ctcacctagcctgat

SEQ ID NO: 2242327 - DNA, 14 bp, Homo sapiens
ctcactaaagcatg

SEQ ID NO: 2242328 - DNA, 20 bp, Homo sapiens
ctcactaaagcatgaaatgt

SEQ ID NO: 2242329 - DNA, 17 bp, Homo sapiens
ctcactaatttttgtat

SEQ ID NO: 2242330 - DNA, 23 bp, Homo sapiens
ctcactatggtatgctggccagc

SEQ ID NO: 2242331 - DNA, 11 bp, Homo sapiens
ctcactctgtc

SEQ ID NO: 2242332 - DNA, 18 bp, Homo sapiens
ctcactctgtcagccagc

SEQ ID NO: 2242333 - DNA, 15 bp, Homo sapiens
ctcactctgtttcct

SEQ ID NO: 2242334 - DNA, 18 bp, Homo sapiens
ctcactgcttgaactagg

SEQ ID NO: 2242335 - DNA, 13 bp, Homo sapiens
ctcactggggcct

SEQ ID NO: 2242336 - DNA, 18 bp, Homo sapiens
ctcactgttgtgaatcac

SEQ ID NO: 2242337 - DNA, 15 bp, Homo sapiens
ctcagaaggccccag

SEQ ID NO: 2242338 - DNA, 20 bp, Homo sapiens
ctcagaaggccccagagaga

SEQ ID NO: 2242339 - DNA, 20 bp, Homo sapiens
ctcagacatgttttccgtga

SEQ ID NO: 2242340 - DNA, 14 bp, Homo sapiens
ctcagacccaacag

SEQ ID NO: 2242341 - DNA, 21 bp, Homo sapiens
ctcagacccaacagcaaagga

SEQ ID NO: 2242342 - DNA, 13 bp, Homo sapiens
ctcagatgatctc

SEQ ID NO: 2242343 - DNA, 17 bp, Homo sapiens
ctcagatgatctctcca

SEQ ID NO: 2242344 - DNA, 13 bp, Homo sapiens
ctcagatgttaaa

SEQ ID NO: 2242345 - DNA, 17 bp, Homo sapiens
ctcagatgttaaaataa

SEQ ID NO: 2242346 - DNA, 22 bp, Homo sapiens
ctcagattgtaatatgtaaatg

SEQ ID NO: 2242347 - DNA, 18 bp, Homo sapiens
ctcagcccgcttggccac

SEQ ID NO: 2242348 - DNA, 12 bp, Homo sapiens
ctcagccctcag

SEQ ID NO: 2242349 - DNA, 12 bp, Homo sapiens
ctcagtaaacgg

SEQ ID NO: 2242350 - DNA, 22 bp, Homo sapiens
ctcagtggcccatggcatttta

SEQ ID NO: 2242351 - DNA, 23 bp, Homo sapiens
ctcagttcaacctggtggcacca

SEQ ID NO: 2242352 - DNA, 22 bp, Homo sapiens
ctcagtttgtgtgtcttaatta

SEQ ID NO: 2242353 - DNA, 14 bp, Homo sapiens
ctcataaaaagcaa

SEQ ID NO: 2242354 - DNA, 16 bp, Homo sapiens
ctcataaaaataaaag

SEQ ID NO: 2242355 - DNA, 19 bp, Homo sapiens
ctcatccaccccatccctc

SEQ ID NO: 2242356 - DNA, 19 bp, Homo sapiens
ctcatcccgtgttctcctt

SEQ ID NO: 2242357 - DNA, 13 bp, Homo sapiens
ctcatgttggcca

SEQ ID NO: 2242358 - DNA, 15 bp, Homo sapiens
ctcattgctgagcct

SEQ ID NO: 2242359 - DNA, 18 bp, Homo sapiens
ctcattgctgagcctctg

SEQ ID NO: 2242360 - DNA, 23 bp, Homo sapiens
ctcattggccagctcataaaatg

SEQ ID NO: 2242361 - DNA, 17 bp, Homo sapiens
ctcatttaagggaaaaa

SEQ ID NO: 2242362 - DNA, 16 bp, Homo sapiens
ctcatttcatctcatt

SEQ ID NO: 2242363 - DNA, 12 bp, Homo sapiens
ctcatttttcat

SEQ ID NO: 2242364 - DNA, 13 bp, Homo sapiens
ctcatttttcata

SEQ ID NO: 2242365 - DNA, 20 bp, Homo sapiens
ctccaagtctgtacctcaaa

SEQ ID NO: 2242366 - DNA, 23 bp, Homo sapiens
ctccaattttttaagtgaaaata

SEQ ID NO: 2242367 - DNA, 20 bp, Homo sapiens
ctccacatatttcagtgagg

SEQ ID NO: 2242368 - DNA, 11 bp, Homo sapiens
ctccaccccag

SEQ ID NO: 2242369 - DNA, 12 bp, Homo sapiens
ctccaccccagg

SEQ ID NO: 2242370 - DNA, 14 bp, Homo sapiens
ctccacgcctcctg

SEQ ID NO: 2242371 - DNA, 18 bp, Homo sapiens
ctccacgcctcctggcca

SEQ ID NO: 2242372 - DNA, 13 bp, Homo sapiens
ctccacttgtata

SEQ ID NO: 2242373 - DNA, 21 bp, Homo sapiens
ctccagccagcgcctccctcc

SEQ ID NO: 2242374 - DNA, 20 bp, Homo sapiens
ctccagggcattgctcagcc

SEQ ID NO: 2242375 - DNA, 14 bp, Homo sapiens
ctccaggtggctct

SEQ ID NO: 2242376 - DNA, 17 bp, Homo sapiens
ctccaggtggctctgag

SEQ ID NO: 2242377 - DNA, 14 bp, Homo sapiens
ctccccatgtgtcc

SEQ ID NO: 2242378 - DNA, 22 bp, Homo sapiens
ctcccccagttcctcccaggaa

SEQ ID NO: 2242379 - DNA, 12 bp, Homo sapiens
ctccccctcaga

SEQ ID NO: 2242380 - DNA, 17 bp, Homo sapiens
ctccccctccttgtgcc

SEQ ID NO: 2242381 - DNA, 19 bp, Homo sapiens
ctcccggaggttgggtggg

SEQ ID NO: 2242382 - DNA, 21 bp, Homo sapiens
ctccctcagatcccagttcct

SEQ ID NO: 2242383 - DNA, 17 bp, Homo sapiens
ctccctccaccccagga

SEQ ID NO: 2242384 - DNA, 14 bp, Homo sapiens
ctccctctatttat

SEQ ID NO: 2242385 - DNA, 15 bp, Homo sapiens
ctccctcttctgccc

SEQ ID NO: 2242386 - DNA, 16 bp, Homo sapiens
ctccctggcaggatgc

SEQ ID NO: 2242387 - DNA, 17 bp, Homo sapiens
ctccctggcaggatgct

SEQ ID NO: 2242388 - DNA, 18 bp, Homo sapiens
ctccctggcaggatgctg

SEQ ID NO: 2242389 - DNA, 20 bp, Homo sapiens
ctccctggcaggatgctgag

SEQ ID NO: 2242390 - DNA, 17 bp, Homo sapiens
ctccctgtgggggtggc

SEQ ID NO: 2242391 - DNA, 22 bp, Homo sapiens
ctccctgtgggggtggccatcc

SEQ ID NO: 2242392 - DNA, 17 bp, Homo sapiens
ctcccttgctggcccca

SEQ ID NO: 2242393 - DNA, 18 bp, Homo sapiens
ctcccttgctggccccag

SEQ ID NO: 2242394 - DNA, 23 bp, Homo sapiens
ctcccttgctggccccagccctg

SEQ ID NO: 2242395 - DNA, 13 bp, Homo sapiens
ctccgcggctgga

SEQ ID NO: 2242396 - DNA, 14 bp, Homo sapiens
ctccgcggctggag

SEQ ID NO: 2242397 - DNA, 16 bp, Homo sapiens
ctccgcggctggagcg

SEQ ID NO: 2242398 - DNA, 16 bp, Homo sapiens
ctccgtcctctcccca

SEQ ID NO: 2242399 - DNA, 14 bp, Homo sapiens
ctcctatatatttc

SEQ ID NO: 2242400 - DNA, 14 bp, Homo sapiens
ccctgtaggcctca

SEQ ID NO: 2242401 - DNA, 22 bp, Homo sapiens
ccctgtgggggtggccatccct

SEQ ID NO: 2242402 - DNA, 23 bp, Homo sapiens
ccctgtgggggtggccatccctg

SEQ ID NO: 2242403 - DNA, 16 bp, Homo sapiens
cccttcacagtcccag

SEQ ID NO: 2242404 - DNA, 21 bp, Homo sapiens
cccttcagtaccctctcagct

SEQ ID NO: 2242405 - DNA, 13 bp, Homo sapiens
cccttccccttct

SEQ ID NO: 2242406 - DNA, 12 bp, Homo sapiens
cccttctgtgtc

SEQ ID NO: 2242407 - DNA, 17 bp, Homo sapiens
cccttctgtgtcacagt

SEQ ID NO: 2242408 - DNA, 16 bp, Homo sapiens
cccttgctggccccag

SEQ ID NO: 2242409 - DNA, 20 bp, Homo sapiens
cccttgctggccccagccct

SEQ ID NO: 2242410 - DNA, 23 bp, Homo sapiens
cccttgctggccccagccctgct

SEQ ID NO: 2242411 - DNA, 24 bp, Homo sapiens
cccttgctggccccagccctgctg

SEQ ID NO: 2242412 - DNA, 15 bp, Homo sapiens
cccttttaaagttga

SEQ ID NO: 2242413 - DNA, 16 bp, Homo sapiens
ccctttttctccagct

SEQ ID NO: 2242414 - DNA, 11 bp, Homo sapiens
ccgactccagc

SEQ ID NO: 2242415 - DNA, 21 bp, Homo sapiens
ccgagtgatttccatctctgg

SEQ ID NO: 2242416 - DNA, 15 bp, Homo sapiens
ccgcctggccaggag

SEQ ID NO: 2242417 - DNA, 16 bp, Homo sapiens
ccgcctggccaggagc

SEQ ID NO: 2242418 - DNA, 15 bp, Homo sapiens
ccgctaaatatttac

SEQ ID NO: 2242419 - DNA, 15 bp, Homo sapiens
ccgctgccgctgcac

SEQ ID NO: 2242420 - DNA, 21 bp, Homo sapiens
ccgctggctggtgggccccca

SEQ ID NO: 2242421 - DNA, 22 bp, Homo sapiens
ccgctggtgcctcccgggacga

SEQ ID NO: 2242422 - DNA, 19 bp, Homo sapiens
ccgctgtcgccccaggccc

SEQ ID NO: 2242423 - DNA, 22 bp, Homo sapiens
ccgctgtcgccccaggccctcc

SEQ ID NO: 2242424 - DNA, 22 bp, Homo sapiens
ccgctgtgcccccctcctcccc

SEQ ID NO: 2242425 - DNA, 20 bp, Homo sapiens
ccggagcaggggtctgagcc

SEQ ID NO: 2242426 - DNA, 15 bp, Homo sapiens
ccgggagcctccccc

SEQ ID NO: 2242427 - DNA, 19 bp, Homo sapiens
ccgggaggaaaaggcccct

SEQ ID NO: 2242428 - DNA, 19 bp, Homo sapiens
ccgggcaggtcctgcccat

SEQ ID NO: 2242429 - DNA, 14 bp, Homo sapiens
ccgggtgtggcctc

SEQ ID NO: 2242430 - DNA, 17 bp, Homo sapiens
ccgggtgtggcctcagc

SEQ ID NO: 2242431 - DNA, 22 bp, Homo sapiens
ccgggtgtggcctcagccctca

SEQ ID NO: 2242432 - DNA, 17 bp, Homo sapiens
ccgtcctctccccagcc

SEQ ID NO: 2242433 - DNA, 14 bp, Homo sapiens
ccgtgtctcagcct

SEQ ID NO: 2242434 - DNA, 20 bp, Homo sapiens
ccgttccaccccaagagaac

SEQ ID NO: 2242435 - DNA, 21 bp, Homo sapiens
cctaacaacattgtagcctca

SEQ ID NO: 2242436 - DNA, 21 bp, Homo sapiens
cctaagatctcggtttgccaa

SEQ ID NO: 2242437 - DNA, 23 bp, Homo sapiens
cctacagactaagaaggaaaaga

SEQ ID NO: 2242438 - DNA, 20 bp, Homo sapiens
cctacagctttgatccctga

SEQ ID NO: 2242439 - DNA, 14 bp, Homo sapiens
cctaccctggactt

SEQ ID NO: 2242440 - DNA, 16 bp, Homo sapiens
cctactagtcaccaga

SEQ ID NO: 2242441 - DNA, 13 bp, Homo sapiens
cctactttcttca

SEQ ID NO: 2242442 - DNA, 16 bp, Homo sapiens
cctagatgcacgtggg

SEQ ID NO: 2242443 - DNA, 21 bp, Homo sapiens
cctagatgcacgtggggccca

SEQ ID NO: 2242444 - DNA, 14 bp, Homo sapiens
cctagctggctctg

SEQ ID NO: 2242445 - DNA, 15 bp, Homo sapiens
cctagctggctctgt

SEQ ID NO: 2242446 - DNA, 22 bp, Homo sapiens
cctagtcaaaactatttttgta

SEQ ID NO: 2242447 - DNA, 18 bp, Homo sapiens
cctattgatttaagcttt

SEQ ID NO: 2242448 - DNA, 20 bp, Homo sapiens
cctcaaagaagtcggaatgt

SEQ ID NO: 2242449 - DNA, 11 bp, Homo sapiens
cctcaaatgaa

SEQ ID NO: 2242450 - DNA, 17 bp, Homo sapiens
cctcaccccctcccacc

SEQ ID NO: 2242451 - DNA, 23 bp, Homo sapiens
cctcactatggtatgctggccag

SEQ ID NO: 2242452 - DNA, 20 bp, Homo sapiens
cctcactctgtcagccagcc

SEQ ID NO: 2242453 - DNA, 22 bp, Homo sapiens
cctcactctgtcagccagccgc

SEQ ID NO: 2242454 - DNA, 18 bp, Homo sapiens
cctcagaaggccccagag

SEQ ID NO: 2242455 - DNA, 19 bp, Homo sapiens
cctcagatgatctctccac

SEQ ID NO: 2242456 - DNA, 18 bp, Homo sapiens
cctcagcgcccccagagc

SEQ ID NO: 2242457 - DNA, 19 bp, Homo sapiens
cctcagcgcccccagagcc

SEQ ID NO: 2242458 - DNA, 13 bp, Homo sapiens
cctcaggcagctc

SEQ ID NO: 2242459 - DNA, 14 bp, Homo sapiens
cctcaggcagctca

SEQ ID NO: 2242460 - DNA, 15 bp, Homo sapiens
cctcaggcagctcaa

SEQ ID NO: 2242461 - DNA, 16 bp, Homo sapiens
cctcagttcaacctgg

SEQ ID NO: 2242462 - DNA, 22 bp, Homo sapiens
cctcatccaccccatccctccc

SEQ ID NO: 2242463 - DNA, 16 bp, Homo sapiens
cctcatggcccctctg

SEQ ID NO: 2242464 - DNA, 18 bp, Homo sapiens
cctcatggcccctctgac

SEQ ID NO: 2242465 - DNA, 21 bp, Homo sapiens
cctcattctactaatgtgatg

SEQ ID NO: 2242466 - DNA, 16 bp, Homo sapiens
cctcatttttcatact

SEQ ID NO: 2242467 - DNA, 21 bp, Homo sapiens
cctccagggcattgctcagcc

SEQ ID NO: 2242468 - DNA, 15 bp, Homo sapiens
cctcccacccccagc

SEQ ID NO: 2242469 - DNA, 16 bp, Homo sapiens
cctcccaggaagccca

SEQ ID NO: 2242470 - DNA, 17 bp, Homo sapiens
cctcccaggaagcccag

SEQ ID NO: 2242471 - DNA, 18 bp, Homo sapiens
cctcccaggaagcccagg

SEQ ID NO: 2242472 - DNA, 21 bp, Homo sapiens
cctcccaggaagcccaggagc

SEQ ID NO: 2242473 - DNA, 12 bp, Homo sapiens
cctccccctcct

SEQ ID NO: 2242474 - DNA, 14 bp, Homo sapiens
cctcccccttcccc

SEQ ID NO: 2242475 - DNA, 19 bp, Homo sapiens
cctccccgcgccccagtca

SEQ ID NO: 2242476 - DNA, 12 bp, Homo sapiens
cctccctccacc

SEQ ID NO: 2242477 - DNA, 16 bp, Homo sapiens
cctccctccaccccag

SEQ ID NO: 2242478 - DNA, 17 bp, Homo sapiens
cctccctccaccccagg

SEQ ID NO: 2242479 - DNA, 19 bp, Homo sapiens
cctccctgactccctgtgg

SEQ ID NO: 2242480 - DNA, 21 bp, Homo sapiens
cctccctgactccctgtgggg

SEQ ID NO: 2242481 - DNA, 16 bp, Homo sapiens
cctccgcggctggagc

SEQ ID NO: 2242482 - DNA, 13 bp, Homo sapiens
cctcctcatcccg

SEQ ID NO: 2242483 - DNA, 13 bp, Homo sapiens
cctcctccccact

SEQ ID NO: 2242484 - DNA, 14 bp, Homo sapiens
cctcctggccagac

SEQ ID NO: 2242485 - DNA, 22 bp, Homo sapiens
cctcctggccagacgctgccgc

SEQ ID NO: 2242486 - DNA, 13 bp, Homo sapiens
cctccttcagaca

SEQ ID NO: 2242487 - DNA, 22 bp, Homo sapiens
cctctagctgtgggggtgaggg

SEQ ID NO: 2242488 - DNA, 17 bp, Homo sapiens
cctctatttatgtttgc

SEQ ID NO: 2242489 - DNA, 14 bp, Homo sapiens
cctctcacctcagc

SEQ ID NO: 2242490 - DNA, 17 bp, Homo sapiens
cctctccccagcctggc

SEQ ID NO: 2242491 - DNA, 16 bp, Homo sapiens
cctctcctgacccctg

SEQ ID NO: 2242492 - DNA, 22 bp, Homo sapiens
cctctcctgggggtggcaggca

SEQ ID NO: 2242493 - DNA, 15 bp, Homo sapiens
cctctcgagcccaga

SEQ ID NO: 2242494 - DNA, 15 bp, Homo sapiens
cctctctccttggcc

SEQ ID NO: 2242495 - DNA, 18 bp, Homo sapiens
cctctctccttggccaca

SEQ ID NO: 2242496 - DNA, 21 bp, Homo sapiens
cctctctccttggccacagac

SEQ ID NO: 2242497 - DNA, 19 bp, Homo sapiens
cctctctgagactggcaga

SEQ ID NO: 2242498 - DNA, 14 bp, Homo sapiens
cctctgaatgttac

SEQ ID NO: 2242499 - DNA, 17 bp, Homo sapiens
cctctgacagtccacag

SEQ ID NO: 2242500 - DNA, 19 bp, Homo sapiens
cctctgacagtccacaggg

SEQ ID NO: 2242501 - DNA, 19 bp, Homo sapiens
cctctgcacaccctccaga

SEQ ID NO: 2242502 - DNA, 19 bp, Homo sapiens
cctctgcccttcctgcagg

SEQ ID NO: 2242503 - DNA, 13 bp, Homo sapiens
cctctgctcccca

SEQ ID NO: 2242504 - DNA, 19 bp, Homo sapiens
cctctgctgctgtccctcc

SEQ ID NO: 2242505 - DNA, 23 bp, Homo sapiens
cctctggcattagaattatttaa

SEQ ID NO: 2242506 - DNA, 22 bp, Homo sapiens
cctctgtcttgtgaaggcaggg

SEQ ID NO: 2242507 - DNA, 14 bp, Homo sapiens
cctctgtgccttct

SEQ ID NO: 2242508 - DNA, 15 bp, Homo sapiens
cctcttcctttagga

SEQ ID NO: 2242509 - DNA, 14 bp, Homo sapiens
cctctttgcacagc

SEQ ID NO: 2242510 - DNA, 19 bp, Homo sapiens
cctctttggctcccctgta

SEQ ID NO: 2242511 - DNA, 12 bp, Homo sapiens
cctgaagtattt

SEQ ID NO: 2242512 - DNA, 20 bp, Homo sapiens
cctgaataccacttacctca

SEQ ID NO: 2242513 - DNA, 21 bp, Homo sapiens
cctgaataccacttacctcaa

SEQ ID NO: 2242514 - DNA, 15 bp, Homo sapiens
cctgaattctttttc

SEQ ID NO: 2242515 - DNA, 21 bp, Homo sapiens
cctgactccctgtgggggtgg

SEQ ID NO: 2242516 - DNA, 18 bp, Homo sapiens
cctgaggcctagactctg

SEQ ID NO: 2242517 - DNA, 19 bp, Homo sapiens
cctgaggcctagactctgt

SEQ ID NO: 2242518 - DNA, 14 bp, Homo sapiens
cctgatcccacccc

SEQ ID NO: 2242519 - DNA, 21 bp, Homo sapiens
cctgatcccaccccctcctcc

SEQ ID NO: 2242520 - DNA, 16 bp, Homo sapiens
cctgatgagattttta

SEQ ID NO: 2242521 - DNA, 22 bp, Homo sapiens
cctgattgtattttttttttaa

SEQ ID NO: 2242522 - DNA, 20 bp, Homo sapiens
cctgcaaaaagaaaaaaaga

SEQ ID NO: 2242523 - DNA, 15 bp, Homo sapiens
cctgcatctctgtga

SEQ ID NO: 2242524 - DNA, 12 bp, Homo sapiens
cctgcccatgtg

SEQ ID NO: 2242525 - DNA, 19 bp, Homo sapiens
cctgcccatgtgtcccctc

SEQ ID NO: 2242526 - DNA, 19 bp, Homo sapiens
cctgccccaccccatccag

SEQ ID NO: 2242527 - DNA, 22 bp, Homo sapiens
cctgccccaccccatccagcca

SEQ ID NO: 2242528 - DNA, 18 bp, Homo sapiens
cctgcctaaggttgtcta

SEQ ID NO: 2242529 - DNA, 19 bp, Homo sapiens
cctgcctgttggcaggccc

SEQ ID NO: 2242530 - DNA, 22 bp, Homo sapiens
cctgcctgttggcaggcccact

SEQ ID NO: 2242531 - DNA, 13 bp, Homo sapiens
cctgctggggatc

SEQ ID NO: 2242532 - DNA, 23 bp, Homo sapiens
cctgctggggatccccgcctggc

SEQ ID NO: 2242533 - DNA, 13 bp, Homo sapiens
cctgcttttgcat

SEQ ID NO: 2242534 - DNA, 22 bp, Homo sapiens
cctggaatttgggcagatatag

SEQ ID NO: 2242535 - DNA, 17 bp, Homo sapiens
cctggacactcagacct

SEQ ID NO: 2242536 - DNA, 14 bp, Homo sapiens
cctggactgttttc

SEQ ID NO: 2242537 - DNA, 14 bp, Homo sapiens
cctggaggcactga

SEQ ID NO: 2242538 - DNA, 18 bp, Homo sapiens
cctggcacaggccgaggc

SEQ ID NO: 2242539 - DNA, 20 bp, Homo sapiens
cctggcacaggccgaggcag

SEQ ID NO: 2242540 - DNA, 13 bp, Homo sapiens
cctggccaggagc

SEQ ID NO: 2242541 - DNA, 19 bp, Homo sapiens
cctggcgtgctcagaccca

SEQ ID NO: 2242542 - DNA, 12 bp, Homo sapiens
cctgggcccctc

SEQ ID NO: 2242543 - DNA, 20 bp, Homo sapiens
cctgggcctcatcacagcaa

SEQ ID NO: 2242544 - DNA, 18 bp, Homo sapiens
cctgggctgtctgtcacc

SEQ ID NO: 2242545 - DNA, 21 bp, Homo sapiens
cctggggatcttcccacagga

SEQ ID NO: 2242546 - DNA, 14 bp, Homo sapiens
cctgggggtggcag

SEQ ID NO: 2242547 - DNA, 15 bp, Homo sapiens
cctgggggtggcagg

SEQ ID NO: 2242548 - DNA, 13 bp, Homo sapiens
cctgggtttcctg

SEQ ID NO: 2242549 - DNA, 14 bp, Homo sapiens
cctggtaccctcct

SEQ ID NO: 2242550 - DNA, 19 bp, Homo sapiens
cctggtaggagtgtgtgat

SEQ ID NO: 2242551 - DNA, 22 bp, Homo sapiens
cctggtctggttgggcagccag

SEQ ID NO: 2242552 - DNA, 13 bp, Homo sapiens
cctggtggcacca

SEQ ID NO: 2242553 - DNA, 14 bp, Homo sapiens
cctggtggcaccag

SEQ ID NO: 2242554 - DNA, 15 bp, Homo sapiens
cctggtggcaccaga

SEQ ID NO: 2242555 - DNA, 18 bp, Homo sapiens
cctggtggcaccagatgc

SEQ ID NO: 2242556 - DNA, 19 bp, Homo sapiens
cctggtttttggattaaat

SEQ ID NO: 2242557 - DNA, 22 bp, Homo sapiens
cctgtagtgaatcctctgttta

SEQ ID NO: 2242558 - DNA, 18 bp, Homo sapiens
cctgtataagtggaggca

SEQ ID NO: 2242559 - DNA, 22 bp, Homo sapiens
cctgtataagtggaggcacttt

SEQ ID NO: 2242560 - DNA, 16 bp, Homo sapiens
cctgtccaatctttga

SEQ ID NO: 2242561 - DNA, 15 bp, Homo sapiens
cctgtcccaccccca

SEQ ID NO: 2242562 - DNA, 17 bp, Homo sapiens
cctgtcccacccccacc

SEQ ID NO: 2242563 - DNA, 22 bp, Homo sapiens
cctgttcctttgagtgtcttct

SEQ ID NO: 2242564 - DNA, 18 bp, Homo sapiens
cctgttggcaggcccact

SEQ ID NO: 2242565 - DNA, 14 bp, Homo sapiens
ccttactaattata

SEQ ID NO: 2242566 - DNA, 20 bp, Homo sapiens
ccttagaacattttaattca

SEQ ID NO: 2242567 - DNA, 10 bp, Homo sapiens
ccttcagaca

SEQ ID NO: 2242568 - DNA, 17 bp, Homo sapiens
ccttcagacaccctcaa

SEQ ID NO: 2242569 - DNA, 23 bp, Homo sapiens
ccttcagtaccctctcagctcca

SEQ ID NO: 2242570 - DNA, 24 bp, Homo sapiens
ccttcagtaccctctcagctccag

SEQ ID NO: 2242571 - DNA, 12 bp, Homo sapiens
ccttccagctcc

SEQ ID NO: 2242572 - DNA, 13 bp, Homo sapiens
ccttccagctcct

SEQ ID NO: 2242573 - DNA, 15 bp, Homo sapiens
ccttccagctcctgt

SEQ ID NO: 2242574 - DNA, 19 bp, Homo sapiens
ccttccatggtactgtagc

SEQ ID NO: 2242575 - DNA, 17 bp, Homo sapiens
ccttccccttctgtgtc

SEQ ID NO: 2242576 - DNA, 12 bp, Homo sapiens
ccttccctccaa

SEQ ID NO: 2242577 - DNA, 13 bp, Homo sapiens
ccttccctccaaa

SEQ ID NO: 2242578 - DNA, 20 bp, Homo sapiens
ccttcctcatccaccccatc

SEQ ID NO: 2242579 - DNA, 20 bp, Homo sapiens
ccttctctacactcttgtaa

SEQ ID NO: 2242580 - DNA, 11 bp, Homo sapiens
ccttctgcagc

SEQ ID NO: 2242581 - DNA, 22 bp, Homo sapiens
ccttgagtggggttatctctgt

SEQ ID NO: 2242582 - DNA, 13 bp, Homo sapiens
ccttgctggcccc

SEQ ID NO: 2242583 - DNA, 18 bp, Homo sapiens
ccttggcaggctgctgga

SEQ ID NO: 2242584 - DNA, 22 bp, Homo sapiens
ccttggctttcagagccagcct

SEQ ID NO: 2242585 - DNA, 21 bp, Homo sapiens
cctttccctcaccccctccca

SEQ ID NO: 2242586 - DNA, 21 bp, Homo sapiens
cctttccgctgtcgccccagg

SEQ ID NO: 2242587 - DNA, 22 bp, Homo sapiens
cctttcctggacactcagacct

SEQ ID NO: 2242588 - DNA, 16 bp, Homo sapiens
cctttggctggtagca

SEQ ID NO: 2242589 - DNA, 23 bp, Homo sapiens
ccttttgaggagccccagctacc

SEQ ID NO: 2242590 - DNA, 14 bp, Homo sapiens
cctttttctccagc

SEQ ID NO: 2242591 - DNA, 16 bp, Homo sapiens
cctttttctccagctg

SEQ ID NO: 2242592 - DNA, 12 bp, Homo sapiens
cgaaatgagctc

SEQ ID NO: 2242593 - DNA, 20 bp, Homo sapiens
cgaagccttctgcagcagga

SEQ ID NO: 2242594 - DNA, 18 bp, Homo sapiens
cgaagcggagagagccaa

SEQ ID NO: 2242595 - DNA, 19 bp, Homo sapiens
cgaagcggagagagccaag

SEQ ID NO: 2242596 - DNA, 11 bp, Homo sapiens
cgactccagcc

SEQ ID NO: 2242597 - DNA, 15 bp, Homo sapiens
cgactccagccagcg

SEQ ID NO: 2242598 - DNA, 17 bp, Homo sapiens
cgactccagccagcgcc

SEQ ID NO: 2242599 - DNA, 14 bp, Homo sapiens
cgagacccccatcc

SEQ ID NO: 2242600 - DNA, 18 bp, Homo sapiens
cgagacccccatccagcc

SEQ ID NO: 2242601 - DNA, 23 bp, Homo sapiens
cgaggaaaggattttaccaaagc

SEQ ID NO: 2242602 - DNA, 16 bp, Homo sapiens
cgaggagctggggcgg

SEQ ID NO: 2242603 - DNA, 18 bp, Homo sapiens
cgaggcaggaggagcccg

SEQ ID NO: 2242604 - DNA, 16 bp, Homo sapiens
cgagtaaacttgaaaa

SEQ ID NO: 2242605 - DNA, 13 bp, Homo sapiens
cgcaatgtggcat

SEQ ID NO: 2242606 - DNA, 14 bp, Homo sapiens
cgcagctggcagag

SEQ ID NO: 2242607 - DNA, 15 bp, Homo sapiens
cgcagctggcagaga

SEQ ID NO: 2242608 - DNA, 12 bp, Homo sapiens
cgccactcattt

SEQ ID NO: 2242609 - DNA, 19 bp, Homo sapiens
cgccactcatttcatctca

SEQ ID NO: 2242610 - DNA, 21 bp, Homo sapiens
cgccactcatttcatctcatt

SEQ ID NO: 2242611 - DNA, 15 bp, Homo sapiens
cgcccacaaactgat

SEQ ID NO: 2242612 - DNA, 20 bp, Homo sapiens
cgcccacaggaagcctgcag

SEQ ID NO: 2242613 - DNA, 22 bp, Homo sapiens
cgcccacaggaagcctgcagtc

SEQ ID NO: 2242614 - DNA, 20 bp, Homo sapiens
cgcccaggctggagtgcagt

SEQ ID NO: 2242615 - DNA, 14 bp, Homo sapiens
cgccccctcctcta

SEQ ID NO: 2242616 - DNA, 14 bp, Homo sapiens
cgcccctggacttc

SEQ ID NO: 2242617 - DNA, 14 bp, Homo sapiens
cgccctgggctgtc

SEQ ID NO: 2242618 - DNA, 14 bp, Homo sapiens
cgcccttttcccct

SEQ ID NO: 2242619 - DNA, 22 bp, Homo sapiens
aaatattttcatgtattttaca

SEQ ID NO: 2242620 - DNA, 12 bp, Homo sapiens
aaatattttcta

SEQ ID NO: 2242621 - DNA, 19 bp, Homo sapiens
aaatattttctattttaag

SEQ ID NO: 2242622 - DNA, 13 bp, Homo sapiens
aaatcaaatgaat

SEQ ID NO: 2242623 - DNA, 23 bp, Homo sapiens
aaatcataggcaccttttactgt

SEQ ID NO: 2242624 - DNA, 20 bp, Homo sapiens
aaatctaaatttcttttgct

SEQ ID NO: 2242625 - DNA, 19 bp, Homo sapiens
aaatctctcagagccctca

SEQ ID NO: 2242626 - DNA, 14 bp, Homo sapiens
aaatgaaagggaaa

SEQ ID NO: 2242627 - DNA, 16 bp, Homo sapiens
aaatgaaagggaaact

SEQ ID NO: 2242628 - DNA, 22 bp, Homo sapiens
aaatgacatgttcctttaaggt

SEQ ID NO: 2242629 - DNA, 18 bp, Homo sapiens
aaatgagacgaaatgctg

SEQ ID NO: 2242630 - DNA, 23 bp, Homo sapiens
aaatgagacgaaatgctgatgta

SEQ ID NO: 2242631 - DNA, 18 bp, Homo sapiens
aaatgcatgattttgtaa

SEQ ID NO: 2242632 - DNA, 19 bp, Homo sapiens
aaatgctgctgtcagacga

SEQ ID NO: 2242633 - DNA, 14 bp, Homo sapiens
aaatggaaattttg

SEQ ID NO: 2242634 - DNA, 19 bp, Homo sapiens
aaatggctgtaatcatttg

SEQ ID NO: 2242635 - DNA, 21 bp, Homo sapiens
aaatggctgtaatcatttgtt

SEQ ID NO: 2242636 - DNA, 17 bp, Homo sapiens
aaatggtatcaaaatta

SEQ ID NO: 2242637 - DNA, 15 bp, Homo sapiens
aaatgttatttaaca

SEQ ID NO: 2242638 - DNA, 10 bp, Homo sapiens
aaatgtttgg

SEQ ID NO: 2242639 - DNA, 22 bp, Homo sapiens
aaatgtttggcatgtaaatgta

SEQ ID NO: 2242640 - DNA, 14 bp, Homo sapiens
aaattaatatcttt

SEQ ID NO: 2242641 - DNA, 14 bp, Homo sapiens
aaattacaatttta

SEQ ID NO: 2242642 - DNA, 15 bp, Homo sapiens
aaattacaattttat

SEQ ID NO: 2242643 - DNA, 14 bp, Homo sapiens
aaattacatatact

SEQ ID NO: 2242644 - DNA, 15 bp, Homo sapiens
aaattcaattgtaaa

SEQ ID NO: 2242645 - DNA, 19 bp, Homo sapiens
aaattcaattgtaaattga

SEQ ID NO: 2242646 - DNA, 13 bp, Homo sapiens
aaattcagcattt

SEQ ID NO: 2242647 - DNA, 16 bp, Homo sapiens
aaattcatttctaatt

SEQ ID NO: 2242648 - DNA, 19 bp, Homo sapiens
aaattcctcaacagtgttt

SEQ ID NO: 2242649 - DNA, 14 bp, Homo sapiens
aaattgtctttaaa

SEQ ID NO: 2242650 - DNA, 22 bp, Homo sapiens
aaattgtctttaaaaactgttt

SEQ ID NO: 2242651 - DNA, 23 bp, Homo sapiens
aaattgtttagtgatattacatt

SEQ ID NO: 2242652 - DNA, 15 bp, Homo sapiens
aaatttcttttgcta

SEQ ID NO: 2242653 - DNA, 16 bp, Homo sapiens
aaatttgtctgaaaca

SEQ ID NO: 2242654 - DNA, 21 bp, Homo sapiens
aaatttgtctgaaacatttca

SEQ ID NO: 2242655 - DNA, 13 bp, Homo sapiens
aaattttcagcat

SEQ ID NO: 2242656 - DNA, 14 bp, Homo sapiens
aacaaaaattaggt

SEQ ID NO: 2242657 - DNA, 20 bp, Homo sapiens
aacaaaatttgactaatttt

SEQ ID NO: 2242658 - DNA, 23 bp, Homo sapiens
aacaaagttactaggtaacttca

SEQ ID NO: 2242659 - DNA, 23 bp, Homo sapiens
aacaaatattgccaactcttcta

SEQ ID NO: 2242660 - DNA, 15 bp, Homo sapiens
aacaaattatttttg

SEQ ID NO: 2242661 - DNA, 22 bp, Homo sapiens
aacaagaccaccacttcgaaac

SEQ ID NO: 2242662 - DNA, 22 bp, Homo sapiens
aacaagccaaagagcctcccac

SEQ ID NO: 2242663 - DNA, 14 bp, Homo sapiens
aacaataaaatttt

SEQ ID NO: 2242664 - DNA, 16 bp, Homo sapiens
aacaataaaatttttt

SEQ ID NO: 2242665 - DNA, 19 bp, Homo sapiens
aacacaggggacacagctt

SEQ ID NO: 2242666 - DNA, 18 bp, Homo sapiens
aacacgtttttacatact

SEQ ID NO: 2242667 - DNA, 24 bp, Homo sapiens
aacactcagtggcccatggcattt

SEQ ID NO: 2242668 - DNA, 22 bp, Homo sapiens
aacactgtgtacacctcaaata

SEQ ID NO: 2242669 - DNA, 17 bp, Homo sapiens
aacagaataatgcatga

SEQ ID NO: 2242670 - DNA, 12 bp, Homo sapiens
aacagaggatat

SEQ ID NO: 2242671 - DNA, 13 bp, Homo sapiens
aacagatttggaa

SEQ ID NO: 2242672 - DNA, 13 bp, Homo sapiens
aacagtgttttca

SEQ ID NO: 2242673 - DNA, 13 bp, Homo sapiens
aacataacataaa

SEQ ID NO: 2242674 - DNA, 16 bp, Homo sapiens
aacatccaaccttccc

SEQ ID NO: 2242675 - DNA, 17 bp, Homo sapiens
aacatccaaccttccca

SEQ ID NO: 2242676 - DNA, 13 bp, Homo sapiens
aacatgccccctg

SEQ ID NO: 2242677 - DNA, 14 bp, Homo sapiens
aacatgccccctgc

SEQ ID NO: 2242678 - DNA, 18 bp, Homo sapiens
aacatgctggtgaatatt

SEQ ID NO: 2242679 - DNA, 20 bp, Homo sapiens
aacatggtttaaaagaaaaa

SEQ ID NO: 2242680 - DNA, 13 bp, Homo sapiens
aacattaaaatat

SEQ ID NO: 2242681 - DNA, 16 bp, Homo sapiens
aacattcatagtcttt

SEQ ID NO: 2242682 - DNA, 14 bp, Homo sapiens
aaccagctaagaaa

SEQ ID NO: 2242683 - DNA, 16 bp, Homo sapiens
aaccagctaagaaaag

SEQ ID NO: 2242684 - DNA, 14 bp, Homo sapiens
aaccaggtgcaatt

SEQ ID NO: 2242685 - DNA, 15 bp, Homo sapiens
aaccatcggtccaca

SEQ ID NO: 2242686 - DNA, 16 bp, Homo sapiens
aaccatctctcttcca

SEQ ID NO: 2242687 - DNA, 22 bp, Homo sapiens
aaccatttttgttactctcttc

SEQ ID NO: 2242688 - DNA, 13 bp, Homo sapiens
aacccagattttg

SEQ ID NO: 2242689 - DNA, 14 bp, Homo sapiens
aaccccaaacagtg

SEQ ID NO: 2242690 - DNA, 15 bp, Homo sapiens
aacccctcctggcct

SEQ ID NO: 2242691 - DNA, 15 bp, Homo sapiens
aacctcattggccag

SEQ ID NO: 2242692 - DNA, 16 bp, Homo sapiens
aacctcccctctcccc

SEQ ID NO: 2242693 - DNA, 15 bp, Homo sapiens
aacctctcctgaccc

SEQ ID NO: 2242694 - DNA, 17 bp, Homo sapiens
aacctgggattcaggaa

SEQ ID NO: 2242695 - DNA, 17 bp, Homo sapiens
aacctgtagaatcaatt

SEQ ID NO: 2242696 - DNA, 16 bp, Homo sapiens
aaccttcaaagaaact

SEQ ID NO: 2242697 - DNA, 11 bp, Homo sapiens
aacctttccct

SEQ ID NO: 2242698 - DNA, 14 bp, Homo sapiens
aacctttccctcac

SEQ ID NO: 2242699 - DNA, 15 bp, Homo sapiens
aacctttccctcacc

SEQ ID NO: 2242700 - DNA, 22 bp, Homo sapiens
aacctttccctcaccccctccc

SEQ ID NO: 2242701 - DNA, 16 bp, Homo sapiens
aacgccgagtgcactg

SEQ ID NO: 2242702 - DNA, 17 bp, Homo sapiens
aacgtgtcacacttgtg

SEQ ID NO: 2242703 - DNA, 15 bp, Homo sapiens
aacgttcgatttcta

SEQ ID NO: 2242704 - DNA, 20 bp, Homo sapiens
aacgttcgatttctacctca

SEQ ID NO: 2242705 - DNA, 15 bp, Homo sapiens
aactaagattctttt

SEQ ID NO: 2242706 - DNA, 17 bp, Homo sapiens
aactaagattcttttaa

SEQ ID NO: 2242707 - DNA, 22 bp, Homo sapiens
aactaagattcttttaaattag

SEQ ID NO: 2242708 - DNA, 20 bp, Homo sapiens
aactactacctgtaatgaca

SEQ ID NO: 2242709 - DNA, 23 bp, Homo sapiens
aactagtttttcctatcatgtta

SEQ ID NO: 2242710 - DNA, 17 bp, Homo sapiens
aactatcaatatttaag

SEQ ID NO: 2242711 - DNA, 19 bp, Homo sapiens
aactatcaatatttaagtt

SEQ ID NO: 2242712 - DNA, 21 bp, Homo sapiens
aactatcctgcgggttttaat

SEQ ID NO: 2242713 - DNA, 19 bp, Homo sapiens
aactatgtgtttttctcat

SEQ ID NO: 2242714 - DNA, 12 bp, Homo sapiens
aactattctgtt

SEQ ID NO: 2242715 - DNA, 17 bp, Homo sapiens
aactcaaaaccatctct

SEQ ID NO: 2242716 - DNA, 18 bp, Homo sapiens
aactcatctgaaatgtta

SEQ ID NO: 2242717 - DNA, 20 bp, Homo sapiens
aactcatctgaaatgttaca

SEQ ID NO: 2242718 - DNA, 15 bp, Homo sapiens
aactcattcatagga

SEQ ID NO: 2242719 - DNA, 16 bp, Homo sapiens
aactcgcgctcagtaa

SEQ ID NO: 2242720 - DNA, 15 bp, Homo sapiens
aactctctgcctgta

SEQ ID NO: 2242721 - DNA, 10 bp, Homo sapiens
aactctctgt

SEQ ID NO: 2242722 - DNA, 23 bp, Homo sapiens
aactctgttacactttttggaag

SEQ ID NO: 2242723 - DNA, 18 bp, Homo sapiens
aactcttcacaaaatctg

SEQ ID NO: 2242724 - DNA, 17 bp, Homo sapiens
aactgagaaatgaatgc

SEQ ID NO: 2242725 - DNA, 14 bp, Homo sapiens
aactgatttctcac

SEQ ID NO: 2242726 - DNA, 13 bp, Homo sapiens
aactgcatctgga

SEQ ID NO: 2242727 - DNA, 18 bp, Homo sapiens
aactgggtttctcattaa

SEQ ID NO: 2242728 - DNA, 15 bp, Homo sapiens
acaggtaaaacaggg

SEQ ID NO: 2242729 - DNA, 16 bp, Homo sapiens
acaggtaaaacagggc

SEQ ID NO: 2242730 - DNA, 22 bp, Homo sapiens
acaggtaaaacagggccacata

SEQ ID NO: 2242731 - DNA, 20 bp, Homo sapiens
acagtaagaacatcataaaa

SEQ ID NO: 2242732 - DNA, 16 bp, Homo sapiens
acagtcaagatagaaa

SEQ ID NO: 2242733 - DNA, 13 bp, Homo sapiens
acagtcactggat

SEQ ID NO: 2242734 - DNA, 16 bp, Homo sapiens
acagtggctcataaaa

SEQ ID NO: 2242735 - DNA, 21 bp, Homo sapiens
acagtggctcataaaaataaa

SEQ ID NO: 2242736 - DNA, 22 bp, Homo sapiens
acagtgtgtgtgggtgaaatgg

SEQ ID NO: 2242737 - DNA, 14 bp, Homo sapiens
acagttatcatgaa

SEQ ID NO: 2242738 - DNA, 13 bp, Homo sapiens
acagttcctggga

SEQ ID NO: 2242739 - DNA, 19 bp, Homo sapiens
acataatttagttgtttct

SEQ ID NO: 2242740 - DNA, 18 bp, Homo sapiens
acatactggcctggactg

SEQ ID NO: 2242741 - DNA, 14 bp, Homo sapiens
acatacttttgcaa

SEQ ID NO: 2242742 - DNA, 20 bp, Homo sapiens
acatagaaatggaaattttg

SEQ ID NO: 2242743 - DNA, 22 bp, Homo sapiens
acatagaaatggaaattttgct

SEQ ID NO: 2242744 - DNA, 13 bp, Homo sapiens
acatagtgaaaat

SEQ ID NO: 2242745 - DNA, 14 bp, Homo sapiens
acatagtgaaaatt

SEQ ID NO: 2242746 - DNA, 18 bp, Homo sapiens
acatagtgaaaattgttt

SEQ ID NO: 2242747 - DNA, 18 bp, Homo sapiens
acatcacacccatttaaa

SEQ ID NO: 2242748 - DNA, 16 bp, Homo sapiens
acatgccctgtgtggc

SEQ ID NO: 2242749 - DNA, 19 bp, Homo sapiens
acatgctgtctggccctgg

SEQ ID NO: 2242750 - DNA, 19 bp, Homo sapiens
acatgttactggataaatt

SEQ ID NO: 2242751 - DNA, 22 bp, Homo sapiens
acatgttactggataaattgtt

SEQ ID NO: 2242752 - DNA, 13 bp, Homo sapiens
acatgtttataaa

SEQ ID NO: 2242753 - DNA, 13 bp, Homo sapiens
acatgtttctgtt

SEQ ID NO: 2242754 - DNA, 16 bp, Homo sapiens
acattaacttgaaaat

SEQ ID NO: 2242755 - DNA, 14 bp, Homo sapiens
acattagagaacat

SEQ ID NO: 2242756 - DNA, 16 bp, Homo sapiens
acattagttttaaaaa

SEQ ID NO: 2242757 - DNA, 12 bp, Homo sapiens
acattattctgg

SEQ ID NO: 2242758 - DNA, 22 bp, Homo sapiens
acattcatagtctttggagaaa

SEQ ID NO: 2242759 - DNA, 22 bp, Homo sapiens
acattggttctttcatttgctt

SEQ ID NO: 2242760 - DNA, 20 bp, Homo sapiens
acattgttcaattagaatag

SEQ ID NO: 2242761 - DNA, 14 bp, Homo sapiens
acatttaaaacatt

SEQ ID NO: 2242762 - DNA, 14 bp, Homo sapiens
acatttaaaccttt

SEQ ID NO: 2242763 - DNA, 20 bp, Homo sapiens
acatttagctgtgctcagaa

SEQ ID NO: 2242764 - DNA, 17 bp, Homo sapiens
accaaagacatcagtct

SEQ ID NO: 2242765 - DNA, 13 bp, Homo sapiens
accaaagcatcaa

SEQ ID NO: 2242766 - DNA, 20 bp, Homo sapiens
accaaatgtgctttgagaag

SEQ ID NO: 2242767 - DNA, 12 bp, Homo sapiens
accaagggcaga

SEQ ID NO: 2242768 - DNA, 17 bp, Homo sapiens
accacaccctgtactgt

SEQ ID NO: 2242769 - DNA, 18 bp, Homo sapiens
accacggagggagcgaca

SEQ ID NO: 2242770 - DNA, 19 bp, Homo sapiens
accacggcgtttttttaca

SEQ ID NO: 2242771 - DNA, 22 bp, Homo sapiens
accacttttctgctgttgcctc

SEQ ID NO: 2242772 - DNA, 15 bp, Homo sapiens
accagatttatttta

SEQ ID NO: 2242773 - DNA, 17 bp, Homo sapiens
accagatttattttaaa

SEQ ID NO: 2242774 - DNA, 15 bp, Homo sapiens
accagccgtatttta

SEQ ID NO: 2242775 - DNA, 21 bp, Homo sapiens
accagctatctgtcatctctc

SEQ ID NO: 2242776 - DNA, 12 bp, Homo sapiens
accaggaccctg

SEQ ID NO: 2242777 - DNA, 22 bp, Homo sapiens
accaggactagggctggagtga

SEQ ID NO: 2242778 - DNA, 14 bp, Homo sapiens
accagggcgcaagc

SEQ ID NO: 2242779 - DNA, 12 bp, Homo sapiens
accagtgcctta

SEQ ID NO: 2242780 - DNA, 12 bp, Homo sapiens
accatctctctt

SEQ ID NO: 2242781 - DNA, 20 bp, Homo sapiens
accatcttttattctttttt

SEQ ID NO: 2242782 - DNA, 19 bp, Homo sapiens
accatgcctcactaatttt

SEQ ID NO: 2242783 - DNA, 20 bp, Homo sapiens
accatgcctcactaattttt

SEQ ID NO: 2242784 - DNA, 22 bp, Homo sapiens
accatgcgtcaggggcctagag

SEQ ID NO: 2242785 - DNA, 14 bp, Homo sapiens
accatggcacttga

SEQ ID NO: 2242786 - DNA, 21 bp, Homo sapiens
accatttatacaaattagaaa

SEQ ID NO: 2242787 - DNA, 22 bp, Homo sapiens
accatttatacaaattagaaaa

SEQ ID NO: 2242788 - DNA, 19 bp, Homo sapiens
accatttatcaagcattta

SEQ ID NO: 2242789 - DNA, 18 bp, Homo sapiens
accccaagagaactcgcg

SEQ ID NO: 2242790 - DNA, 20 bp, Homo sapiens
accccaggacgccactcatt

SEQ ID NO: 2242791 - DNA, 14 bp, Homo sapiens
acccccacccccag

SEQ ID NO: 2242792 - DNA, 15 bp, Homo sapiens
acccccacccccagc

SEQ ID NO: 2242793 - DNA, 11 bp, Homo sapiens
acccccagccc

SEQ ID NO: 2242794 - DNA, 13 bp, Homo sapiens
acccccagccccg

SEQ ID NO: 2242795 - DNA, 21 bp, Homo sapiens
acccccatccagcctccaggg

SEQ ID NO: 2242796 - DNA, 13 bp, Homo sapiens
accccctcccacc

SEQ ID NO: 2242797 - DNA, 18 bp, Homo sapiens
acccctgcctgttggcag

SEQ ID NO: 2242798 - DNA, 23 bp, Homo sapiens
acccctgcctgttggcaggccca

SEQ ID NO: 2242799 - DNA, 21 bp, Homo sapiens
acccctgggcctcatcacagc

SEQ ID NO: 2242800 - DNA, 19 bp, Homo sapiens
accctaccaactttactgt

SEQ ID NO: 2242801 - DNA, 23 bp, Homo sapiens
accctagtcaaaactatttttgt

SEQ ID NO: 2242802 - DNA, 15 bp, Homo sapiens
accctagttctacct

SEQ ID NO: 2242803 - DNA, 21 bp, Homo sapiens
accctagttctacctcaggca

SEQ ID NO: 2242804 - DNA, 23 bp, Homo sapiens
accctatgggtctaggacacagt

SEQ ID NO: 2242805 - DNA, 13 bp, Homo sapiens
accctcagagcct

SEQ ID NO: 2242806 - DNA, 21 bp, Homo sapiens
accctccaagtctgtacctca

SEQ ID NO: 2242807 - DNA, 11 bp, Homo sapiens
accctcctggc

SEQ ID NO: 2242808 - DNA, 15 bp, Homo sapiens
accctctcagctcca

SEQ ID NO: 2242809 - DNA, 21 bp, Homo sapiens
accctctcctgggggtggcag

SEQ ID NO: 2242810 - DNA, 16 bp, Homo sapiens
accctggccgccccct

SEQ ID NO: 2242811 - DNA, 17 bp, Homo sapiens
accctggccgccccctg

SEQ ID NO: 2242812 - DNA, 22 bp, Homo sapiens
accctgtactgttctgtgtctt

SEQ ID NO: 2242813 - DNA, 14 bp, Homo sapiens
acccttataaaatc

SEQ ID NO: 2242814 - DNA, 19 bp, Homo sapiens
acccttattgctgtcctgg

SEQ ID NO: 2242815 - DNA, 20 bp, Homo sapiens
accgagtgatttccatctct

SEQ ID NO: 2242816 - DNA, 15 bp, Homo sapiens
accgtctacatttca

SEQ ID NO: 2242817 - DNA, 16 bp, Homo sapiens
accgtctacatttcac

SEQ ID NO: 2242818 - DNA, 18 bp, Homo sapiens
acctagctggctctgtga

SEQ ID NO: 2242819 - DNA, 15 bp, Homo sapiens
acctcaaaatttaac

SEQ ID NO: 2242820 - DNA, 12 bp, Homo sapiens
acctcaggcagc

SEQ ID NO: 2242821 - DNA, 18 bp, Homo sapiens
acctcagttattacatgt

SEQ ID NO: 2242822 - DNA, 18 bp, Homo sapiens
acctcatttttcatactg

SEQ ID NO: 2242823 - DNA, 21 bp, Homo sapiens
acctccgtcctctccccagcc

SEQ ID NO: 2242824 - DNA, 22 bp, Homo sapiens
acctccgtcctctccccagcct

SEQ ID NO: 2242825 - DNA, 21 bp, Homo sapiens
acctcctctgtgatttctttc

SEQ ID NO: 2242826 - DNA, 19 bp, Homo sapiens
acctcgtcaagagcatgca

SEQ ID NO: 2242827 - DNA, 15 bp, Homo sapiens
acctctgcttttatc

SEQ ID NO: 2242828 - DNA, 18 bp, Homo sapiens
acctgaataccacttacc

SEQ ID NO: 2242829 - DNA, 20 bp, Homo sapiens
acctgaataccacttacctc

SEQ ID NO: 2242830 - DNA, 17 bp, Homo sapiens
acctggcgtgctcagac

SEQ ID NO: 2242831 - DNA, 19 bp, Homo sapiens
acctggtaccctcctggct

SEQ ID NO: 2242832 - DNA, 15 bp, Homo sapiens
acctgtaatgacagg

SEQ ID NO: 2242833 - DNA, 13 bp, Homo sapiens
accttactaatta

SEQ ID NO: 2242834 - DNA, 18 bp, Homo sapiens
accttaggccttcctctc

SEQ ID NO: 2242835 - DNA, 20 bp, Homo sapiens
accttagttgaaatgatagc

SEQ ID NO: 2242836 - DNA, 16 bp, Homo sapiens
agcatttaaggaaact

SEQ ID NO: 2242837 - DNA, 20 bp, Homo sapiens
agccaaccttcaaagaaact

SEQ ID NO: 2242838 - DNA, 15 bp, Homo sapiens
agccacccccaggca

SEQ ID NO: 2242839 - DNA, 22 bp, Homo sapiens
agccaccttttgggaatgtttt

SEQ ID NO: 2242840 - DNA, 23 bp, Homo sapiens
agccacgctgtcctctcgagccc

SEQ ID NO: 2242841 - DNA, 15 bp, Homo sapiens
agccagccgccctgg

SEQ ID NO: 2242842 - DNA, 16 bp, Homo sapiens
agccagcctggctctg

SEQ ID NO: 2242843 - DNA, 17 bp, Homo sapiens
agccagcgcctccctcc

SEQ ID NO: 2242844 - DNA, 23 bp, Homo sapiens
agccagcgcctccctccacccca

SEQ ID NO: 2242845 - DNA, 16 bp, Homo sapiens
agccaggaggcctgct

SEQ ID NO: 2242846 - DNA, 13 bp, Homo sapiens
agcccagccctcc

SEQ ID NO: 2242847 - DNA, 19 bp, Homo sapiens
agcccaggatactggcaca

SEQ ID NO: 2242848 - DNA, 20 bp, Homo sapiens
agcccccgggccgctggctg

SEQ ID NO: 2242849 - DNA, 15 bp, Homo sapiens
agccccctggcctct

SEQ ID NO: 2242850 - DNA, 16 bp, Homo sapiens
agccccctggcctctg

SEQ ID NO: 2242851 - DNA, 17 bp, Homo sapiens
agccccctggcctctgt

SEQ ID NO: 2242852 - DNA, 19 bp, Homo sapiens
agccccctggcctctgtgc

SEQ ID NO: 2242853 - DNA, 16 bp, Homo sapiens
agccccgactccagcc

SEQ ID NO: 2242854 - DNA, 18 bp, Homo sapiens
agccccgactccagccag

SEQ ID NO: 2242855 - DNA, 19 bp, Homo sapiens
agccccgactccagccagc

SEQ ID NO: 2242856 - DNA, 22 bp, Homo sapiens
agccccgactccagccagcgcc

SEQ ID NO: 2242857 - DNA, 23 bp, Homo sapiens
agccccgactccagccagcgcct

SEQ ID NO: 2242858 - DNA, 13 bp, Homo sapiens
agccctcagaaca

SEQ ID NO: 2242859 - DNA, 21 bp, Homo sapiens
agccctcccccttccccttct

SEQ ID NO: 2242860 - DNA, 14 bp, Homo sapiens
agccctcgtctccc

SEQ ID NO: 2242861 - DNA, 19 bp, Homo sapiens
agccctgctggggatcccc

SEQ ID NO: 2242862 - DNA, 16 bp, Homo sapiens
agccctgcttttgcat

SEQ ID NO: 2242863 - DNA, 23 bp, Homo sapiens
agccctgcttttgcataatgcaa

SEQ ID NO: 2242864 - DNA, 15 bp, Homo sapiens
agccgcacatctggt

SEQ ID NO: 2242865 - DNA, 12 bp, Homo sapiens
agccgccctggg

SEQ ID NO: 2242866 - DNA, 13 bp, Homo sapiens
agccgccctgggc

SEQ ID NO: 2242867 - DNA, 22 bp, Homo sapiens
agccgccctgggctgtctgtca

SEQ ID NO: 2242868 - DNA, 15 bp, Homo sapiens
agccgtattttacat

SEQ ID NO: 2242869 - DNA, 18 bp, Homo sapiens
agccgtattttacatgaa

SEQ ID NO: 2242870 - DNA, 23 bp, Homo sapiens
agccgtgctcgcccacaaactga

SEQ ID NO: 2242871 - DNA, 18 bp, Homo sapiens
agcctcaaaacaaaggcc

SEQ ID NO: 2242872 - DNA, 23 bp, Homo sapiens
agcctcactattacttgaacttt

SEQ ID NO: 2242873 - DNA, 22 bp, Homo sapiens
agcctcatacctacatcagaca

SEQ ID NO: 2242874 - DNA, 12 bp, Homo sapiens
agcctccagggc

SEQ ID NO: 2242875 - DNA, 14 bp, Homo sapiens
agcctccccctcag

SEQ ID NO: 2242876 - DNA, 22 bp, Homo sapiens
agcctctctccttggccacaga

SEQ ID NO: 2242877 - DNA, 23 bp, Homo sapiens
agcctctctccttggccacagac

SEQ ID NO: 2242878 - DNA, 13 bp, Homo sapiens
agcctctgctccc

SEQ ID NO: 2242879 - DNA, 23 bp, Homo sapiens
agcctctggcattagaattattt

SEQ ID NO: 2242880 - DNA, 16 bp, Homo sapiens
agcctgatattgatat

SEQ ID NO: 2242881 - DNA, 18 bp, Homo sapiens
agcctgatgagattttta

SEQ ID NO: 2242882 - DNA, 22 bp, Homo sapiens
agcctgcattgagcttgcatgc

SEQ ID NO: 2242883 - DNA, 17 bp, Homo sapiens
agcctggctctgccccc

SEQ ID NO: 2242884 - DNA, 18 bp, Homo sapiens
agcctgggctcactgtgc

SEQ ID NO: 2242885 - DNA, 19 bp, Homo sapiens
agcctgggctcactgtgct

SEQ ID NO: 2242886 - DNA, 22 bp, Homo sapiens
agcctgggctcactgtgctggg

SEQ ID NO: 2242887 - DNA, 20 bp, Homo sapiens
agcctgttcttttaccactg

SEQ ID NO: 2242888 - DNA, 18 bp, Homo sapiens
agcctttggttctggcca

SEQ ID NO: 2242889 - DNA, 17 bp, Homo sapiens
agcgacacttgaatgta

SEQ ID NO: 2242890 - DNA, 18 bp, Homo sapiens
agcgcctccctccacccc

SEQ ID NO: 2242891 - DNA, 14 bp, Homo sapiens
agcggagagagcca

SEQ ID NO: 2242892 - DNA, 17 bp, Homo sapiens
agcggagagagccaaga

SEQ ID NO: 2242893 - DNA, 13 bp, Homo sapiens
agctaaccctagt

SEQ ID NO: 2242894 - DNA, 18 bp, Homo sapiens
agctaataacatgtgaaa

SEQ ID NO: 2242895 - DNA, 14 bp, Homo sapiens
agctacactgagca

SEQ ID NO: 2242896 - DNA, 20 bp, Homo sapiens
agctaccctttttctccagc

SEQ ID NO: 2242897 - DNA, 15 bp, Homo sapiens
agctacttcctcctc

SEQ ID NO: 2242898 - DNA, 21 bp, Homo sapiens
agctacttcctcctccccact

SEQ ID NO: 2242899 - DNA, 17 bp, Homo sapiens
agctatgcgcaatgtgg

SEQ ID NO: 2242900 - DNA, 20 bp, Homo sapiens
agctatggagagaattaaaa

SEQ ID NO: 2242901 - DNA, 22 bp, Homo sapiens
agctatggagagaattaaaact

SEQ ID NO: 2242902 - DNA, 17 bp, Homo sapiens
agctcataaaatggaag

SEQ ID NO: 2242903 - DNA, 14 bp, Homo sapiens
agctgccaagagtg

SEQ ID NO: 2242904 - DNA, 11 bp, Homo sapiens
agctgccagtg

SEQ ID NO: 2242905 - DNA, 14 bp, Homo sapiens
agctgccttggctc

SEQ ID NO: 2242906 - DNA, 20 bp, Homo sapiens
agctgccttggctcagacat

SEQ ID NO: 2242907 - DNA, 12 bp, Homo sapiens
agctggcagaga

SEQ ID NO: 2242908 - DNA, 14 bp, Homo sapiens
agctggcagagagc

SEQ ID NO: 2242909 - DNA, 20 bp, Homo sapiens
agctggctctgtgagggtgc

SEQ ID NO: 2242910 - DNA, 22 bp, Homo sapiens
agctggctctgtgagggtgctg

SEQ ID NO: 2242911 - DNA, 16 bp, Homo sapiens
agctggtggcagagtc

SEQ ID NO: 2242912 - DNA, 21 bp, Homo sapiens
agctgtataattaattgtcat

SEQ ID NO: 2242913 - DNA, 16 bp, Homo sapiens
agctgtcaaggctcag

SEQ ID NO: 2242914 - DNA, 15 bp, Homo sapiens
agctgtgaagagact

SEQ ID NO: 2242915 - DNA, 15 bp, Homo sapiens
agcttaaaaaaatta

SEQ ID NO: 2242916 - DNA, 18 bp, Homo sapiens
agcttaaaaaaattactg

SEQ ID NO: 2242917 - DNA, 21 bp, Homo sapiens
agcttaacaatgcaactttta

SEQ ID NO: 2242918 - DNA, 17 bp, Homo sapiens
agcttgtcttttctgct

SEQ ID NO: 2242919 - DNA, 15 bp, Homo sapiens
agcttgttgtctcca

SEQ ID NO: 2242920 - DNA, 14 bp, Homo sapiens
agctttatttgcat

SEQ ID NO: 2242921 - DNA, 21 bp, Homo sapiens
agctttattttgagatgtaaa

SEQ ID NO: 2242922 - DNA, 17 bp, Homo sapiens
aggaaaaggcccctgca

SEQ ID NO: 2242923 - DNA, 18 bp, Homo sapiens
aggaaaagtgcaatgcgt

SEQ ID NO: 2242924 - DNA, 21 bp, Homo sapiens
aggaaaggattttaccaaagc

SEQ ID NO: 2242925 - DNA, 15 bp, Homo sapiens
aggaacaaagacagg

SEQ ID NO: 2242926 - DNA, 16 bp, Homo sapiens
aggaactagaaagaag

SEQ ID NO: 2242927 - DNA, 14 bp, Homo sapiens
aggaactctggacc

SEQ ID NO: 2242928 - DNA, 15 bp, Homo sapiens
aggaactgcaataat

SEQ ID NO: 2242929 - DNA, 20 bp, Homo sapiens
aggaagaacgcggtgtgtaa

SEQ ID NO: 2242930 - DNA, 20 bp, Homo sapiens
aggaagcccaggagcctcac

SEQ ID NO: 2242931 - DNA, 20 bp, Homo sapiens
aggaagcctgcagtcctgga

SEQ ID NO: 2242932 - DNA, 16 bp, Homo sapiens
aggaaggaacaaagac

SEQ ID NO: 2242933 - DNA, 15 bp, Homo sapiens
aggacacagttcctg

SEQ ID NO: 2242934 - DNA, 16 bp, Homo sapiens
aggacacagttcctgg

SEQ ID NO: 2242935 - DNA, 18 bp, Homo sapiens
aggacacagttcctggga

SEQ ID NO: 2242936 - DNA, 21 bp, Homo sapiens
aggacacagttcctgggaaca

SEQ ID NO: 2242937 - DNA, 16 bp, Homo sapiens
aggaccaagggcagag

SEQ ID NO: 2242938 - DNA, 16 bp, Homo sapiens
aggacgagacccccat

SEQ ID NO: 2242939 - DNA, 17 bp, Homo sapiens
aggacgagacccccatc

SEQ ID NO: 2242940 - DNA, 21 bp, Homo sapiens
aggacgagacccccatccagc

SEQ ID NO: 2242941 - DNA, 18 bp, Homo sapiens
aggacgccactcatttca

SEQ ID NO: 2242942 - DNA, 20 bp, Homo sapiens
aggacgccactcatttcatc

SEQ ID NO: 2242943 - DNA, 23 bp, Homo sapiens
aggacgccactcatttcatctca

SEQ ID NO: 2242944 - DNA, 18 bp, Homo sapiens
atcatgtactttttagta

SEQ ID NO: 2242945 - DNA, 19 bp, Homo sapiens
atcatgttgatcatgtact

SEQ ID NO: 2242946 - DNA, 13 bp, Homo sapiens
atcattgtatgtg

SEQ ID NO: 2242947 - DNA, 20 bp, Homo sapiens
atccaaacttggatttttga

SEQ ID NO: 2242948 - DNA, 17 bp, Homo sapiens
atccaaccattttcatt

SEQ ID NO: 2242949 - DNA, 14 bp, Homo sapiens
atccagccagaccc

SEQ ID NO: 2242950 - DNA, 13 bp, Homo sapiens
atccagcctccag

SEQ ID NO: 2242951 - DNA, 15 bp, Homo sapiens
atccagcctccaggg

SEQ ID NO: 2242952 - DNA, 18 bp, Homo sapiens
atccagcctccagggcat

SEQ ID NO: 2242953 - DNA, 14 bp, Homo sapiens
atccatcttgagcc

SEQ ID NO: 2242954 - DNA, 15 bp, Homo sapiens
atcccaactgtcttt

SEQ ID NO: 2242955 - DNA, 20 bp, Homo sapiens
atcccaccccctcctccccc

SEQ ID NO: 2242956 - DNA, 17 bp, Homo sapiens
atccccgcctggccagg

SEQ ID NO: 2242957 - DNA, 21 bp, Homo sapiens
atccccgcctggccaggagca

SEQ ID NO: 2242958 - DNA, 15 bp, Homo sapiens
atcccgttttcccca

SEQ ID NO: 2242959 - DNA, 20 bp, Homo sapiens
atcccgttttccccatgaca

SEQ ID NO: 2242960 - DNA, 11 bp, Homo sapiens
atccctgggcc

SEQ ID NO: 2242961 - DNA, 16 bp, Homo sapiens
atccctttttttacat

SEQ ID NO: 2242962 - DNA, 12 bp, Homo sapiens
atcctccacaga

SEQ ID NO: 2242963 - DNA, 13 bp, Homo sapiens
atcctccacagag

SEQ ID NO: 2242964 - DNA, 14 bp, Homo sapiens
atcctccacagaga

SEQ ID NO: 2242965 - DNA, 20 bp, Homo sapiens
atcctctgtaaactttttgt

SEQ ID NO: 2242966 - DNA, 14 bp, Homo sapiens
atcctctttgtaat

SEQ ID NO: 2242967 - DNA, 22 bp, Homo sapiens
atcctctttgtaatttaatgaa

SEQ ID NO: 2242968 - DNA, 21 bp, Homo sapiens
atcctgggggacccaatgtag

SEQ ID NO: 2242969 - DNA, 22 bp, Homo sapiens
atccttgccaatagtgtcatcc

SEQ ID NO: 2242970 - DNA, 19 bp, Homo sapiens
atccttggctttcagagcc

SEQ ID NO: 2242971 - DNA, 17 bp, Homo sapiens
atcctttaaaatttaaa

SEQ ID NO: 2242972 - DNA, 21 bp, Homo sapiens
atcggaggctgggcccctggg

SEQ ID NO: 2242973 - DNA, 19 bp, Homo sapiens
atcgtccagcgaccttcct

SEQ ID NO: 2242974 - DNA, 14 bp, Homo sapiens
atctaaatttcttt

SEQ ID NO: 2242975 - DNA, 19 bp, Homo sapiens
atctaaatttcttttgcta

SEQ ID NO: 2242976 - DNA, 12 bp, Homo sapiens
atctaagaataa

SEQ ID NO: 2242977 - DNA, 12 bp, Homo sapiens
atctataaaata

SEQ ID NO: 2242978 - DNA, 11 bp, Homo sapiens
atctatataaa

SEQ ID NO: 2242979 - DNA, 13 bp, Homo sapiens
atctatataaaat

SEQ ID NO: 2242980 - DNA, 13 bp, Homo sapiens
atctcatttaagg

SEQ ID NO: 2242981 - DNA, 17 bp, Homo sapiens
atctcatttaagggaaa

SEQ ID NO: 2242982 - DNA, 23 bp, Homo sapiens
atctcatttaagggaaaaatata

SEQ ID NO: 2242983 - DNA, 19 bp, Homo sapiens
atctcctaactttggacct

SEQ ID NO: 2242984 - DNA, 22 bp, Homo sapiens
atctcgcagtgtttctgtgaat

SEQ ID NO: 2242985 - DNA, 14 bp, Homo sapiens
atctctctctgtgt

SEQ ID NO: 2242986 - DNA, 22 bp, Homo sapiens
atctctctggggccctgggcct

SEQ ID NO: 2242987 - DNA, 10 bp, Homo sapiens
atctcttttc

SEQ ID NO: 2242988 - DNA, 22 bp, Homo sapiens
atctggagaccagggagccttt

SEQ ID NO: 2242989 - DNA, 13 bp, Homo sapiens
atctggggtgggg

SEQ ID NO: 2242990 - DNA, 17 bp, Homo sapiens
atctggggtggggtggg

SEQ ID NO: 2242991 - DNA, 22 bp, Homo sapiens
atctgtatttaatggtttttat

SEQ ID NO: 2242992 - DNA, 16 bp, Homo sapiens
atctgtcatctctctg

SEQ ID NO: 2242993 - DNA, 19 bp, Homo sapiens
atctgtcatctctctgggg

SEQ ID NO: 2242994 - DNA, 15 bp, Homo sapiens
atctgtctgtggcaa

SEQ ID NO: 2242995 - DNA, 18 bp, Homo sapiens
atctgtgccatacttgtt

SEQ ID NO: 2242996 - DNA, 14 bp, Homo sapiens
atcttaatatattt

SEQ ID NO: 2242997 - DNA, 23 bp, Homo sapiens
atcttaatatatttctaaatgtt

SEQ ID NO: 2242998 - DNA, 14 bp, Homo sapiens
atcttccctctccc

SEQ ID NO: 2242999 - DNA, 15 bp, Homo sapiens
atcttgagaaccttt

SEQ ID NO: 2243000 - DNA, 17 bp, Homo sapiens
atcttgctactaccgtt

SEQ ID NO: 2243001 - DNA, 14 bp, Homo sapiens
atcttgtagacact

SEQ ID NO: 2243002 - DNA, 14 bp, Homo sapiens
atctttattaatca

SEQ ID NO: 2243003 - DNA, 15 bp, Homo sapiens
atctttctttccaaa

SEQ ID NO: 2243004 - DNA, 20 bp, Homo sapiens
atctttctttccaaaacatt

SEQ ID NO: 2243005 - DNA, 21 bp, Homo sapiens
atcttttgaagggagaagaca

SEQ ID NO: 2243006 - DNA, 23 bp, Homo sapiens
atcttttgaagggagaagacact

SEQ ID NO: 2243007 - DNA, 17 bp, Homo sapiens
atgaaaacagtgtgtaa

SEQ ID NO: 2243008 - DNA, 17 bp, Homo sapiens
atgaaaactaaggattt

SEQ ID NO: 2243009 - DNA, 12 bp, Homo sapiens
atgaaaacttat

SEQ ID NO: 2243010 - DNA, 17 bp, Homo sapiens
atgaaagggaaactggg

SEQ ID NO: 2243011 - DNA, 13 bp, Homo sapiens
atgaaatgtgaat

SEQ ID NO: 2243012 - DNA, 22 bp, Homo sapiens
atgaaatgtgaatttttattgt

SEQ ID NO: 2243013 - DNA, 15 bp, Homo sapiens
atgaacaaaattatt

SEQ ID NO: 2243014 - DNA, 14 bp, Homo sapiens
atgaacttgttact

SEQ ID NO: 2243015 - DNA, 15 bp, Homo sapiens
atgaagaacatctgg

SEQ ID NO: 2243016 - DNA, 22 bp, Homo sapiens
atgaaggatccatctttgtata

SEQ ID NO: 2243017 - DNA, 14 bp, Homo sapiens
atgaatatgatgac

SEQ ID NO: 2243018 - DNA, 15 bp, Homo sapiens
atgaatgtatttatt

SEQ ID NO: 2243019 - DNA, 13 bp, Homo sapiens
atgaatttgtcca

SEQ ID NO: 2243020 - DNA, 16 bp, Homo sapiens
atgaattttaaataat

SEQ ID NO: 2243021 - DNA, 17 bp, Homo sapiens
atgacaaaaaatgtttt

SEQ ID NO: 2243022 - DNA, 16 bp, Homo sapiens
atgacaccatctttta

SEQ ID NO: 2243023 - DNA, 16 bp, Homo sapiens
atgacacccatgccag

SEQ ID NO: 2243024 - DNA, 18 bp, Homo sapiens
atgactttttataaaatg

SEQ ID NO: 2243025 - DNA, 21 bp, Homo sapiens
atgagctttgtctacttcaaa

SEQ ID NO: 2243026 - DNA, 15 bp, Homo sapiens
atgatagttgaatgt

SEQ ID NO: 2243027 - DNA, 22 bp, Homo sapiens
atgatcgaaaaaataattattt

SEQ ID NO: 2243028 - DNA, 15 bp, Homo sapiens
atgatgaactcacct

SEQ ID NO: 2243029 - DNA, 17 bp, Homo sapiens
atgatgacaaaaaatgt

SEQ ID NO: 2243030 - DNA, 16 bp, Homo sapiens
atgattgtactttgaa

SEQ ID NO: 2243031 - DNA, 16 bp, Homo sapiens
atgcaaacaagaaacg

SEQ ID NO: 2243032 - DNA, 14 bp, Homo sapiens
atgcaacttttaat

SEQ ID NO: 2243033 - DNA, 16 bp, Homo sapiens
atgcaagaaaaaaact

SEQ ID NO: 2243034 - DNA, 20 bp, Homo sapiens
atgcaagaaaaaaacttact

SEQ ID NO: 2243035 - DNA, 19 bp, Homo sapiens
atgcacatgctgtctggcc

SEQ ID NO: 2243036 - DNA, 18 bp, Homo sapiens
atgcacgtggggcccact

SEQ ID NO: 2243037 - DNA, 20 bp, Homo sapiens
atgcacttcaaattcaaata

SEQ ID NO: 2243038 - DNA, 17 bp, Homo sapiens
atgcagattacactgat

SEQ ID NO: 2243039 - DNA, 15 bp, Homo sapiens
atgcaggctcccctg

SEQ ID NO: 2243040 - DNA, 16 bp, Homo sapiens
atgcaggctcccctga

SEQ ID NO: 2243041 - DNA, 16 bp, Homo sapiens
atgccactatgagctt

SEQ ID NO: 2243042 - DNA, 12 bp, Homo sapiens
atgccagagagg

SEQ ID NO: 2243043 - DNA, 15 bp, Homo sapiens
atgcctcactaattt

SEQ ID NO: 2243044 - DNA, 16 bp, Homo sapiens
atgcctcactaatttt

SEQ ID NO: 2243045 - DNA, 16 bp, Homo sapiens
atgcctttctctccta

SEQ ID NO: 2243046 - DNA, 15 bp, Homo sapiens
atgcgcaatgtggca

SEQ ID NO: 2243047 - DNA, 15 bp, Homo sapiens
atgcgtaatttaatg

SEQ ID NO: 2243048 - DNA, 16 bp, Homo sapiens
atgcgtaatttaatgg

SEQ ID NO: 2243049 - DNA, 17 bp, Homo sapiens
atgcgtaatttaatggg

SEQ ID NO: 2243050 - DNA, 22 bp, Homo sapiens
atgctgagcttgtcttttctgc

SEQ ID NO: 2243051 - DNA, 15 bp, Homo sapiens
atgctgctatacaca

SEQ ID NO: 2243052 - DNA, 13 bp, Homo sapiens
atgctggccagca

SEQ ID NO: 2243053 - DNA, 16 bp, Homo sapiens
caatagttttttactt

SEQ ID NO: 2243054 - DNA, 20 bp, Homo sapiens
caatatagaaaaataaaaat

SEQ ID NO: 2243055 - DNA, 24 bp, Homo sapiens
caatatttaacaatttattctgat

SEQ ID NO: 2243056 - DNA, 20 bp, Homo sapiens
caatatttaagtttgttgct

SEQ ID NO: 2243057 - DNA, 16 bp, Homo sapiens
caatattttctttaat

SEQ ID NO: 2243058 - DNA, 20 bp, Homo sapiens
caatattttctttaatgctt

SEQ ID NO: 2243059 - DNA, 13 bp, Homo sapiens
caatgaagttgaa

SEQ ID NO: 2243060 - DNA, 21 bp, Homo sapiens
caatgaagttgaaaatcatag

SEQ ID NO: 2243061 - DNA, 14 bp, Homo sapiens
caatgcgtgttgta

SEQ ID NO: 2243062 - DNA, 15 bp, Homo sapiens
caatgtctgagtgaa

SEQ ID NO: 2243063 - DNA, 15 bp, Homo sapiens
caatgtgaactttat

SEQ ID NO: 2243064 - DNA, 19 bp, Homo sapiens
caatgtgaactttattaaa

SEQ ID NO: 2243065 - DNA, 15 bp, Homo sapiens
caatgtgtataaatt

SEQ ID NO: 2243066 - DNA, 16 bp, Homo sapiens
caatgtgtataaattg

SEQ ID NO: 2243067 - DNA, 17 bp, Homo sapiens
caatgtgtataaattgt

SEQ ID NO: 2243068 - DNA, 15 bp, Homo sapiens
caatgtgtctttcta

SEQ ID NO: 2243069 - DNA, 22 bp, Homo sapiens
caatgtgtctttctaagaaatc

SEQ ID NO: 2243070 - DNA, 12 bp, Homo sapiens
caattatattgt

SEQ ID NO: 2243071 - DNA, 13 bp, Homo sapiens
caattatattgtc

SEQ ID NO: 2243072 - DNA, 11 bp, Homo sapiens
caattcccctc

SEQ ID NO: 2243073 - DNA, 13 bp, Homo sapiens
caattcccctctg

SEQ ID NO: 2243074 - DNA, 17 bp, Homo sapiens
caattcccctctgctgc

SEQ ID NO: 2243075 - DNA, 22 bp, Homo sapiens
caattgacataggcaataataa

SEQ ID NO: 2243076 - DNA, 17 bp, Homo sapiens
caattgggagctgccaa

SEQ ID NO: 2243077 - DNA, 20 bp, Homo sapiens
caattttttaagtgaaaata

SEQ ID NO: 2243078 - DNA, 18 bp, Homo sapiens
cacaacttgatggctgcg

SEQ ID NO: 2243079 - DNA, 15 bp, Homo sapiens
cacaagcaatgcaag

SEQ ID NO: 2243080 - DNA, 22 bp, Homo sapiens
cacaagcaatgcaagaaaaaaa

SEQ ID NO: 2243081 - DNA, 23 bp, Homo sapiens
cacaagcaatgcaagaaaaaaac

SEQ ID NO: 2243082 - DNA, 23 bp, Homo sapiens
cacacacttagccattgaaatgt

SEQ ID NO: 2243083 - DNA, 20 bp, Homo sapiens
cacacagcagccccccagca

SEQ ID NO: 2243084 - DNA, 18 bp, Homo sapiens
cacactactacctcttaa

SEQ ID NO: 2243085 - DNA, 14 bp, Homo sapiens
cacactctaaaccc

SEQ ID NO: 2243086 - DNA, 16 bp, Homo sapiens
cacactctaaaccccg

SEQ ID NO: 2243087 - DNA, 16 bp, Homo sapiens
cacagcaatatttaac

SEQ ID NO: 2243088 - DNA, 21 bp, Homo sapiens
cacagcatgaggcaaaaatgt

SEQ ID NO: 2243089 - DNA, 12 bp, Homo sapiens
cacaggccccct

SEQ ID NO: 2243090 - DNA, 20 bp, Homo sapiens
cacagggagtgcacatatcc

SEQ ID NO: 2243091 - DNA, 16 bp, Homo sapiens
cacaggggacacagct

SEQ ID NO: 2243092 - DNA, 17 bp, Homo sapiens
cacagtaaaaataaaat

SEQ ID NO: 2243093 - DNA, 23 bp, Homo sapiens
cacagtcccaggtttagtgaaaa

SEQ ID NO: 2243094 - DNA, 15 bp, Homo sapiens
cacagtgaagtgctg

SEQ ID NO: 2243095 - DNA, 14 bp, Homo sapiens
cacagttcctggga

SEQ ID NO: 2243096 - DNA, 17 bp, Homo sapiens
cacataaccttaaaaag

SEQ ID NO: 2243097 - DNA, 18 bp, Homo sapiens
cacatatccaggcaccag

SEQ ID NO: 2243098 - DNA, 23 bp, Homo sapiens
cacatatttgaagggtctttctc

SEQ ID NO: 2243099 - DNA, 18 bp, Homo sapiens
cacatcacacaagatttg

SEQ ID NO: 2243100 - DNA, 21 bp, Homo sapiens
cacatcataaggttttattca

SEQ ID NO: 2243101 - DNA, 21 bp, Homo sapiens
cacatgctgtctggccctggg

SEQ ID NO: 2243102 - DNA, 12 bp, Homo sapiens
cacatgttactg

SEQ ID NO: 2243103 - DNA, 13 bp, Homo sapiens
cacattcttggct

SEQ ID NO: 2243104 - DNA, 13 bp, Homo sapiens
caccaaatgtgct

SEQ ID NO: 2243105 - DNA, 12 bp, Homo sapiens
caccacaaaata

SEQ ID NO: 2243106 - DNA, 17 bp, Homo sapiens
caccactaccagccagc

SEQ ID NO: 2243107 - DNA, 23 bp, Homo sapiens
caccagatgcaacctcactatgg

SEQ ID NO: 2243108 - DNA, 14 bp, Homo sapiens
caccagctatctgt

SEQ ID NO: 2243109 - DNA, 16 bp, Homo sapiens
caccaggactagggct

SEQ ID NO: 2243110 - DNA, 11 bp, Homo sapiens
caccatctctt

SEQ ID NO: 2243111 - DNA, 14 bp, Homo sapiens
cacccacatcccca

SEQ ID NO: 2243112 - DNA, 18 bp, Homo sapiens
caccccaggacgccactc

SEQ ID NO: 2243113 - DNA, 20 bp, Homo sapiens
caccccaggacgccactcat

SEQ ID NO: 2243114 - DNA, 11 bp, Homo sapiens
cacccccaccc

SEQ ID NO: 2243115 - DNA, 19 bp, Homo sapiens
cacccccagccccgactcc

SEQ ID NO: 2243116 - DNA, 23 bp, Homo sapiens
cacccccagccccgactccagcc

SEQ ID NO: 2243117 - DNA, 14 bp, Homo sapiens
cacccccagctcaa

SEQ ID NO: 2243118 - DNA, 15 bp, Homo sapiens
caccccctcccaccc

SEQ ID NO: 2243119 - DNA, 18 bp, Homo sapiens
caccccctcctcccccag

SEQ ID NO: 2243120 - DNA, 16 bp, Homo sapiens
caccctccagagacaa

SEQ ID NO: 2243121 - DNA, 20 bp, Homo sapiens
caccctcccccagacacagc

SEQ ID NO: 2243122 - DNA, 15 bp, Homo sapiens
caccctctcctgggg

SEQ ID NO: 2243123 - DNA, 13 bp, Homo sapiens
caccgagcagagg

SEQ ID NO: 2243124 - DNA, 19 bp, Homo sapiens
caccgagtgatttccatct

SEQ ID NO: 2243125 - DNA, 21 bp, Homo sapiens
caccgagtgatttccatctct

SEQ ID NO: 2243126 - DNA, 12 bp, Homo sapiens
caccgagtgggg

SEQ ID NO: 2243127 - DNA, 20 bp, Homo sapiens
cacctccccctttcacactg

SEQ ID NO: 2243128 - DNA, 14 bp, Homo sapiens
caccttttactgtg

SEQ ID NO: 2243129 - DNA, 14 bp, Homo sapiens
cacgctgtcctctc

SEQ ID NO: 2243130 - DNA, 17 bp, Homo sapiens
cacggatggtgcatggg

SEQ ID NO: 2243131 - DNA, 18 bp, Homo sapiens
cacggatggtgcatgggc

SEQ ID NO: 2243132 - DNA, 20 bp, Homo sapiens
cacggatggtgcatgggctc

SEQ ID NO: 2243133 - DNA, 13 bp, Homo sapiens
cacgtggggccca

SEQ ID NO: 2243134 - DNA, 14 bp, Homo sapiens
cacgtggggcccac

SEQ ID NO: 2243135 - DNA, 15 bp, Homo sapiens
cacgtggggcccact

SEQ ID NO: 2243136 - DNA, 20 bp, Homo sapiens
cacgtggggcccactgctcg

SEQ ID NO: 2243137 - DNA, 16 bp, Homo sapiens
cacgtttttacatact

SEQ ID NO: 2243138 - DNA, 22 bp, Homo sapiens
cacgtttttacatacttttgca

SEQ ID NO: 2243139 - DNA, 19 bp, Homo sapiens
cactaatttttgtattatt

SEQ ID NO: 2243140 - DNA, 15 bp, Homo sapiens
cactaccagccagcc

SEQ ID NO: 2243141 - DNA, 13 bp, Homo sapiens
cactactacctct

SEQ ID NO: 2243142 - DNA, 20 bp, Homo sapiens
cactatggtatgctggccag

SEQ ID NO: 2243143 - DNA, 23 bp, Homo sapiens
cactcattgctgagcctctgctc

SEQ ID NO: 2243144 - DNA, 12 bp, Homo sapiens
cactcatttcat

SEQ ID NO: 2243145 - DNA, 13 bp, Homo sapiens
cactcatttcatc

SEQ ID NO: 2243146 - DNA, 14 bp, Homo sapiens
cactcatttcatct

SEQ ID NO: 2243147 - DNA, 19 bp, Homo sapiens
cactccacgcagctggcag

SEQ ID NO: 2243148 - DNA, 15 bp, Homo sapiens
cactccccagcccca

SEQ ID NO: 2243149 - DNA, 20 bp, Homo sapiens
cactcccttgctggccccag

SEQ ID NO: 2243150 - DNA, 16 bp, Homo sapiens
cactcgtgtgtttcta

SEQ ID NO: 2243151 - DNA, 20 bp, Homo sapiens
cactctcgcacacacagtga

SEQ ID NO: 2243152 - DNA, 12 bp, Homo sapiens
cactctgtcagc

SEQ ID NO: 2243153 - DNA, 17 bp, Homo sapiens
cactctgtcagccagcc

SEQ ID NO: 2243154 - DNA, 19 bp, Homo sapiens
cactctttacctttattga

SEQ ID NO: 2243155 - DNA, 23 bp, Homo sapiens
cactgagaccccaggctgttagg

SEQ ID NO: 2243156 - DNA, 16 bp, Homo sapiens
cactgcactgcatgca

SEQ ID NO: 2243157 - DNA, 13 bp, Homo sapiens
cactgcatgcaaa

SEQ ID NO: 2243158 - DNA, 16 bp, Homo sapiens
cactgcattcctgtgc

SEQ ID NO: 2243159 - DNA, 19 bp, Homo sapiens
cactgctcgtggactgtgc

SEQ ID NO: 2243160 - DNA, 20 bp, Homo sapiens
cactgctcgtggactgtgct

SEQ ID NO: 2243161 - DNA, 21 bp, Homo sapiens
cactggattgactttgctgtc

SEQ ID NO: 2243162 - DNA, 16 bp, Homo sapiens
cattttggatgtcatt

SEQ ID NO: 2243163 - DNA, 15 bp, Homo sapiens
cattttggtgagaaa

SEQ ID NO: 2243164 - DNA, 13 bp, Homo sapiens
cattttgtaataa

SEQ ID NO: 2243165 - DNA, 20 bp, Homo sapiens
ccaaacaccttccagctcct

SEQ ID NO: 2243166 - DNA, 13 bp, Homo sapiens
ccaaacgcctccc

SEQ ID NO: 2243167 - DNA, 13 bp, Homo sapiens
ccaaagaggctgc

SEQ ID NO: 2243168 - DNA, 14 bp, Homo sapiens
ccaaagaggctgcc

SEQ ID NO: 2243169 - DNA, 20 bp, Homo sapiens
ccaaagaggctgcccctctc

SEQ ID NO: 2243170 - DNA, 15 bp, Homo sapiens
ccaaagataaggact

SEQ ID NO: 2243171 - DNA, 17 bp, Homo sapiens
ccaacagcaaaggaact

SEQ ID NO: 2243172 - DNA, 12 bp, Homo sapiens
ccaaccttccca

SEQ ID NO: 2243173 - DNA, 19 bp, Homo sapiens
ccaacgttcgatttctacc

SEQ ID NO: 2243174 - DNA, 16 bp, Homo sapiens
ccaagacggaggaggg

SEQ ID NO: 2243175 - DNA, 23 bp, Homo sapiens
ccaagagaactcgcgctcagtaa

SEQ ID NO: 2243176 - DNA, 23 bp, Homo sapiens
ccaagtctaggaactccctcaga

SEQ ID NO: 2243177 - DNA, 17 bp, Homo sapiens
ccaagttgtgcttgagc

SEQ ID NO: 2243178 - DNA, 22 bp, Homo sapiens
ccaagttgtgcttgagccagga

SEQ ID NO: 2243179 - DNA, 18 bp, Homo sapiens
ccaattgtgtagacgata

SEQ ID NO: 2243180 - DNA, 12 bp, Homo sapiens
ccacaaaatata

SEQ ID NO: 2243181 - DNA, 16 bp, Homo sapiens
ccacaaactgatttct

SEQ ID NO: 2243182 - DNA, 22 bp, Homo sapiens
ccacacacttagccattgaaat

SEQ ID NO: 2243183 - DNA, 11 bp, Homo sapiens
ccacagactga

SEQ ID NO: 2243184 - DNA, 17 bp, Homo sapiens
ccacagagaggagggga

SEQ ID NO: 2243185 - DNA, 22 bp, Homo sapiens
ccacaggaagcctgcagtcctg

SEQ ID NO: 2243186 - DNA, 23 bp, Homo sapiens
ccacaggaagcctgcagtcctgg

SEQ ID NO: 2243187 - DNA, 16 bp, Homo sapiens
ccacaggggccaccac

SEQ ID NO: 2243188 - DNA, 14 bp, Homo sapiens
ccacagtcactgga

SEQ ID NO: 2243189 - DNA, 15 bp, Homo sapiens
ccacagtcactggat

SEQ ID NO: 2243190 - DNA, 12 bp, Homo sapiens
ccacatacctct

SEQ ID NO: 2243191 - DNA, 15 bp, Homo sapiens
ccacccccaccccca

SEQ ID NO: 2243192 - DNA, 12 bp, Homo sapiens
ccacccccagcc

SEQ ID NO: 2243193 - DNA, 15 bp, Homo sapiens
ccacccccagccccg

SEQ ID NO: 2243194 - DNA, 16 bp, Homo sapiens
ccacccccagccccga

SEQ ID NO: 2243195 - DNA, 12 bp, Homo sapiens
ccacccccaggc

SEQ ID NO: 2243196 - DNA, 15 bp, Homo sapiens
ccaccccccaggcct

SEQ ID NO: 2243197 - DNA, 18 bp, Homo sapiens
ccaccccctcctccccca

SEQ ID NO: 2243198 - DNA, 20 bp, Homo sapiens
ccaccgggagcctccccctc

SEQ ID NO: 2243199 - DNA, 22 bp, Homo sapiens
ccacctgctagtgtgaattaaa

SEQ ID NO: 2243200 - DNA, 21 bp, Homo sapiens
ccacgctgaccatgcgtcagg

SEQ ID NO: 2243201 - DNA, 12 bp, Homo sapiens
ccacgctgtcct

SEQ ID NO: 2243202 - DNA, 14 bp, Homo sapiens
ccactaccagccag

SEQ ID NO: 2243203 - DNA, 15 bp, Homo sapiens
ccactaccagccagc

SEQ ID NO: 2243204 - DNA, 16 bp, Homo sapiens
ccactaccagccagcc

SEQ ID NO: 2243205 - DNA, 19 bp, Homo sapiens
ccactaccagccagcctca

SEQ ID NO: 2243206 - DNA, 22 bp, Homo sapiens
ccactactcaatactacctctg

SEQ ID NO: 2243207 - DNA, 23 bp, Homo sapiens
ccactactcaatactacctctga

SEQ ID NO: 2243208 - DNA, 21 bp, Homo sapiens
ccactatgagctttcagactc

SEQ ID NO: 2243209 - DNA, 14 bp, Homo sapiens
ccactcatttcatc

SEQ ID NO: 2243210 - DNA, 20 bp, Homo sapiens
ccactcccttgctggcccca

SEQ ID NO: 2243211 - DNA, 15 bp, Homo sapiens
ccactgggtgagaga

SEQ ID NO: 2243212 - DNA, 21 bp, Homo sapiens
ccacttgtccgctgggtggta

SEQ ID NO: 2243213 - DNA, 20 bp, Homo sapiens
ccactttcatctggggtggg

SEQ ID NO: 2243214 - DNA, 23 bp, Homo sapiens
ccagaataagttattgcagttta

SEQ ID NO: 2243215 - DNA, 18 bp, Homo sapiens
ccagacgctgccgctgcc

SEQ ID NO: 2243216 - DNA, 18 bp, Homo sapiens
ccagacttcaaaaggaat

SEQ ID NO: 2243217 - DNA, 14 bp, Homo sapiens
ccagacttccttga

SEQ ID NO: 2243218 - DNA, 17 bp, Homo sapiens
ccagagagaccctgcaa

SEQ ID NO: 2243219 - DNA, 14 bp, Homo sapiens
ccagagccgggagg

SEQ ID NO: 2243220 - DNA, 19 bp, Homo sapiens
ccagagcttgttgtctcca

SEQ ID NO: 2243221 - DNA, 17 bp, Homo sapiens
ccagatgcaacctcact

SEQ ID NO: 2243222 - DNA, 12 bp, Homo sapiens
ccagatttgtct

SEQ ID NO: 2243223 - DNA, 23 bp, Homo sapiens
ccagatttgtctttttgttgtaa

SEQ ID NO: 2243224 - DNA, 15 bp, Homo sapiens
ccagattttgctgta

SEQ ID NO: 2243225 - DNA, 20 bp, Homo sapiens
ccagcaccctctcctggggg

SEQ ID NO: 2243226 - DNA, 20 bp, Homo sapiens
ccagcactaaggccgtgtct

SEQ ID NO: 2243227 - DNA, 11 bp, Homo sapiens
ccagccacccc

SEQ ID NO: 2243228 - DNA, 16 bp, Homo sapiens
ccagccacccccaggc

SEQ ID NO: 2243229 - DNA, 14 bp, Homo sapiens
ccagccagacccca

SEQ ID NO: 2243230 - DNA, 14 bp, Homo sapiens
ccagccagcgcctc

SEQ ID NO: 2243231 - DNA, 15 bp, Homo sapiens
ccagccagcgcctcc

SEQ ID NO: 2243232 - DNA, 16 bp, Homo sapiens
ccagccagcgcctccc

SEQ ID NO: 2243233 - DNA, 17 bp, Homo sapiens
ccagccagcgcctccct

SEQ ID NO: 2243234 - DNA, 17 bp, Homo sapiens
ccagccccagccccttc

SEQ ID NO: 2243235 - DNA, 19 bp, Homo sapiens
ccagccccgactccagcca

SEQ ID NO: 2243236 - DNA, 20 bp, Homo sapiens
ccagccccgactccagccag

SEQ ID NO: 2243237 - DNA, 20 bp, Homo sapiens
ccagccctccccatggagcc

SEQ ID NO: 2243238 - DNA, 13 bp, Homo sapiens
ccagccctgctgg

SEQ ID NO: 2243239 - DNA, 16 bp, Homo sapiens
ccagccctgctgggga

SEQ ID NO: 2243240 - DNA, 17 bp, Homo sapiens
ccagccctgctggggat

SEQ ID NO: 2243241 - DNA, 19 bp, Homo sapiens
ccagccctgctggggatcc

SEQ ID NO: 2243242 - DNA, 14 bp, Homo sapiens
ccagccgtatttta

SEQ ID NO: 2243243 - DNA, 14 bp, Homo sapiens
ccagcctccagggc

SEQ ID NO: 2243244 - DNA, 16 bp, Homo sapiens
ccagcctccagggcat

SEQ ID NO: 2243245 - DNA, 13 bp, Homo sapiens
ccagcctggcaca

SEQ ID NO: 2243246 - DNA, 18 bp, Homo sapiens
ccagcctggctctgcccc

SEQ ID NO: 2243247 - DNA, 23 bp, Homo sapiens
ccagcctggctctgccccctccc

SEQ ID NO: 2243248 - DNA, 13 bp, Homo sapiens
ccagcgcctccct

SEQ ID NO: 2243249 - DNA, 14 bp, Homo sapiens
ccagctatctgtca

SEQ ID NO: 2243250 - DNA, 15 bp, Homo sapiens
ccagctgcctattga

SEQ ID NO: 2243251 - DNA, 19 bp, Homo sapiens
ccagctgcttcagggaggt

SEQ ID NO: 2243252 - DNA, 18 bp, Homo sapiens
ccaggaagcccaggagcc

SEQ ID NO: 2243253 - DNA, 17 bp, Homo sapiens
ccaggaccaagggcaga

SEQ ID NO: 2243254 - DNA, 20 bp, Homo sapiens
ccaggacgccactcatttca

SEQ ID NO: 2243255 - DNA, 15 bp, Homo sapiens
ccaggagcaggcacg

SEQ ID NO: 2243256 - DNA, 16 bp, Homo sapiens
ccaggagcaggcacgg

SEQ ID NO: 2243257 - DNA, 16 bp, Homo sapiens
ccaggcacccacatcc

SEQ ID NO: 2243258 - DNA, 20 bp, Homo sapiens
ccaggcatctgttagcagag

SEQ ID NO: 2243259 - DNA, 21 bp, Homo sapiens
ccaggccaggaccaagggcag

SEQ ID NO: 2243260 - DNA, 23 bp, Homo sapiens
ccaggcttaaggagaggagaaac

SEQ ID NO: 2243261 - DNA, 14 bp, Homo sapiens
ccagggaccggcgg

SEQ ID NO: 2243262 - DNA, 12 bp, Homo sapiens
ccagggagcctt

SEQ ID NO: 2243263 - DNA, 13 bp, Homo sapiens
ccagggagccttt

SEQ ID NO: 2243264 - DNA, 16 bp, Homo sapiens
ccaggggagttgtgtc

SEQ ID NO: 2243265 - DNA, 15 bp, Homo sapiens
ccagggggcaagagg

SEQ ID NO: 2243266 - DNA, 18 bp, Homo sapiens
ccagggggccctctgcct

SEQ ID NO: 2243267 - DNA, 17 bp, Homo sapiens
ccagggtttacccagtg

SEQ ID NO: 2243268 - DNA, 19 bp, Homo sapiens
ccaggtatccaaaaatgtg

SEQ ID NO: 2243269 - DNA, 18 bp, Homo sapiens
ccaggttccacagaggac

SEQ ID NO: 2243270 - DNA, 24 bp, Homo sapiens
ccagtatacctcatttttcatact

SEQ ID NO: 2243271 - DNA, 16 bp, Homo sapiens
cctccccatggagcca

SEQ ID NO: 2243272 - DNA, 12 bp, Homo sapiens
cctcccccagtg

SEQ ID NO: 2243273 - DNA, 12 bp, Homo sapiens
cctcccctctcc

SEQ ID NO: 2243274 - DNA, 20 bp, Homo sapiens
cctccctccaccccaggacg

SEQ ID NO: 2243275 - DNA, 17 bp, Homo sapiens
cctccgcggctggagcg

SEQ ID NO: 2243276 - DNA, 20 bp, Homo sapiens
cctccgtcctctccccagcc

SEQ ID NO: 2243277 - DNA, 21 bp, Homo sapiens
cctcctcatgtacataccctg

SEQ ID NO: 2243278 - DNA, 15 bp, Homo sapiens
cctcctccccgcgcc

SEQ ID NO: 2243279 - DNA, 21 bp, Homo sapiens
cctcctccccgcgccccagtc

SEQ ID NO: 2243280 - DNA, 16 bp, Homo sapiens
cctcctggccagacgc

SEQ ID NO: 2243281 - DNA, 22 bp, Homo sapiens
cctcctgtgttgtgctgggagc

SEQ ID NO: 2243282 - DNA, 18 bp, Homo sapiens
cctccttgtgccttcttt

SEQ ID NO: 2243283 - DNA, 18 bp, Homo sapiens
cctcgccggatctgaggg

SEQ ID NO: 2243284 - DNA, 16 bp, Homo sapiens
cctctcagctccaggt

SEQ ID NO: 2243285 - DNA, 12 bp, Homo sapiens
cctctccccagc

SEQ ID NO: 2243286 - DNA, 13 bp, Homo sapiens
cctctccccagcc

SEQ ID NO: 2243287 - DNA, 16 bp, Homo sapiens
cctctccccagcctgg

SEQ ID NO: 2243288 - DNA, 16 bp, Homo sapiens
cctctccctctctctt

SEQ ID NO: 2243289 - DNA, 13 bp, Homo sapiens
cctctcctgaccc

SEQ ID NO: 2243290 - DNA, 16 bp, Homo sapiens
cctctcgagcccagat

SEQ ID NO: 2243291 - DNA, 16 bp, Homo sapiens
cctctcggtgacctcc

SEQ ID NO: 2243292 - DNA, 20 bp, Homo sapiens
cctctgagaagctctgaaga

SEQ ID NO: 2243293 - DNA, 14 bp, Homo sapiens
cctctgctgctgtc

SEQ ID NO: 2243294 - DNA, 20 bp, Homo sapiens
cctctggaggggtgtggctc

SEQ ID NO: 2243295 - DNA, 22 bp, Homo sapiens
cctctggaggggtgtggctcct

SEQ ID NO: 2243296 - DNA, 23 bp, Homo sapiens
cctcttaaggaaaccactgtaca

SEQ ID NO: 2243297 - DNA, 17 bp, Homo sapiens
cctctttcttcccatga

SEQ ID NO: 2243298 - DNA, 20 bp, Homo sapiens
cctctttggctcccctgtac

SEQ ID NO: 2243299 - DNA, 22 bp, Homo sapiens
cctctttgtaatttaatgaaaa

SEQ ID NO: 2243300 - DNA, 18 bp, Homo sapiens
cctgagagatttaacatt

SEQ ID NO: 2243301 - DNA, 17 bp, Homo sapiens
cctgatgagatttttaa

SEQ ID NO: 2243302 - DNA, 22 bp, Homo sapiens
cctgcaggcaggaacaaacagg

SEQ ID NO: 2243303 - DNA, 18 bp, Homo sapiens
cctgcatctctgtgaagc

SEQ ID NO: 2243304 - DNA, 16 bp, Homo sapiens
cctgcccatgtgtccc

SEQ ID NO: 2243305 - DNA, 16 bp, Homo sapiens
cctgccccaccccatc

SEQ ID NO: 2243306 - DNA, 22 bp, Homo sapiens
cctgccccccagcctctggcat

SEQ ID NO: 2243307 - DNA, 21 bp, Homo sapiens
cctgccctcatggcccctctg

SEQ ID NO: 2243308 - DNA, 13 bp, Homo sapiens
cctgcctgctgca

SEQ ID NO: 2243309 - DNA, 20 bp, Homo sapiens
cctgcctgttggcaggccca

SEQ ID NO: 2243310 - DNA, 16 bp, Homo sapiens
cctgcgggttttaatt

SEQ ID NO: 2243311 - DNA, 21 bp, Homo sapiens
cctgctggggatccccgcctg

SEQ ID NO: 2243312 - DNA, 18 bp, Homo sapiens
cctggaatttgggcagat

SEQ ID NO: 2243313 - DNA, 13 bp, Homo sapiens
cctggacttgcct

SEQ ID NO: 2243314 - DNA, 15 bp, Homo sapiens
cctggcaggatgctg

SEQ ID NO: 2243315 - DNA, 18 bp, Homo sapiens
cctggcaggatgctgagc

SEQ ID NO: 2243316 - DNA, 19 bp, Homo sapiens
cctggcaggatgctgagct

SEQ ID NO: 2243317 - DNA, 14 bp, Homo sapiens
cctggccaggagca

SEQ ID NO: 2243318 - DNA, 16 bp, Homo sapiens
cctggcgtgctcagac

SEQ ID NO: 2243319 - DNA, 19 bp, Homo sapiens
cctgggcatttggtgagag

SEQ ID NO: 2243320 - DNA, 15 bp, Homo sapiens
cctgggcccctccac

SEQ ID NO: 2243321 - DNA, 22 bp, Homo sapiens
cctgggcccctccacgcctcct

SEQ ID NO: 2243322 - DNA, 14 bp, Homo sapiens
cctgggcctcagtt

SEQ ID NO: 2243323 - DNA, 16 bp, Homo sapiens
cctgggctcactgtgc

SEQ ID NO: 2243324 - DNA, 18 bp, Homo sapiens
cctgggctcactgtgctg

SEQ ID NO: 2243325 - DNA, 16 bp, Homo sapiens
cctggggatcttccca

SEQ ID NO: 2243326 - DNA, 22 bp, Homo sapiens
cctgggggtggcaggcacacag

SEQ ID NO: 2243327 - DNA, 16 bp, Homo sapiens
cctgggtttcctgcag

SEQ ID NO: 2243328 - DNA, 17 bp, Homo sapiens
cctggtggcaccagatg

SEQ ID NO: 2243329 - DNA, 23 bp, Homo sapiens
cctgtaacatactggcctggact

SEQ ID NO: 2243330 - DNA, 22 bp, Homo sapiens
cctgtaccttttgaggagcccc

SEQ ID NO: 2243331 - DNA, 23 bp, Homo sapiens
cctgtaccttttgaggagcccca

SEQ ID NO: 2243332 - DNA, 18 bp, Homo sapiens
cctgtactgttctgtgtc

SEQ ID NO: 2243333 - DNA, 21 bp, Homo sapiens
cctgtagattcaggtaataca

SEQ ID NO: 2243334 - DNA, 23 bp, Homo sapiens
cctgtataagtggaggcacttta

SEQ ID NO: 2243335 - DNA, 11 bp, Homo sapiens
cctgtcccacc

SEQ ID NO: 2243336 - DNA, 17 bp, Homo sapiens
cctgtggattagaatag

SEQ ID NO: 2243337 - DNA, 14 bp, Homo sapiens
cctgttcacaccag

SEQ ID NO: 2243338 - DNA, 16 bp, Homo sapiens
cctgttggcaggccca

SEQ ID NO: 2243339 - DNA, 22 bp, Homo sapiens
ccttacaacgccgagtgcactg

SEQ ID NO: 2243340 - DNA, 20 bp, Homo sapiens
ccttagtctcagtttgtgtg

SEQ ID NO: 2243341 - DNA, 20 bp, Homo sapiens
ccttatatatgcacttaatt

SEQ ID NO: 2243342 - DNA, 19 bp, Homo sapiens
ccttatggatgatttaagt

SEQ ID NO: 2243343 - DNA, 18 bp, Homo sapiens
ccttattgctgtcctgga

SEQ ID NO: 2243344 - DNA, 19 bp, Homo sapiens
ccttattgctgtcctggag

SEQ ID NO: 2243345 - DNA, 11 bp, Homo sapiens
ccttcagacac

SEQ ID NO: 2243346 - DNA, 19 bp, Homo sapiens
ccttcagtaccctctcagc

SEQ ID NO: 2243347 - DNA, 16 bp, Homo sapiens
ccttccagctcctgta

SEQ ID NO: 2243348 - DNA, 14 bp, Homo sapiens
ccttccccttctgt

SEQ ID NO: 2243349 - DNA, 18 bp, Homo sapiens
ccttccccttctgtgtca

SEQ ID NO: 2243350 - DNA, 21 bp, Homo sapiens
ccttccccttctgtgtcacag

SEQ ID NO: 2243351 - DNA, 16 bp, Homo sapiens
ccttcctcatccaccc

SEQ ID NO: 2243352 - DNA, 18 bp, Homo sapiens
ccttcctcatccacccca

SEQ ID NO: 2243353 - DNA, 16 bp, Homo sapiens
ccttctggccttgtaa

SEQ ID NO: 2243354 - DNA, 12 bp, Homo sapiens
ccttctgtgtca

SEQ ID NO: 2243355 - DNA, 23 bp, Homo sapiens
ccttgagtggggttatctctgtg

SEQ ID NO: 2243356 - DNA, 23 bp, Homo sapiens
ccttgattgttcgggtgtgcaat

SEQ ID NO: 2243357 - DNA, 19 bp, Homo sapiens
ccttggctttcagagccag

SEQ ID NO: 2243358 - DNA, 20 bp, Homo sapiens
ccttggctttcagagccagc

SEQ ID NO: 2243359 - DNA, 21 bp, Homo sapiens
cctttggctggtagcagcagg

SEQ ID NO: 2243360 - DNA, 14 bp, Homo sapiens
cctttggttctggc

SEQ ID NO: 2243361 - DNA, 16 bp, Homo sapiens
ccttttagaaacctca

SEQ ID NO: 2243362 - DNA, 23 bp, Homo sapiens
ccttttattataagtcttacata

SEQ ID NO: 2243363 - DNA, 16 bp, Homo sapiens
ccttttgaggagcccc

SEQ ID NO: 2243364 - DNA, 20 bp, Homo sapiens
ccttttttgttttcaacagt

SEQ ID NO: 2243365 - DNA, 16 bp, Homo sapiens
cgaaatctaaatttct

SEQ ID NO: 2243366 - DNA, 22 bp, Homo sapiens
cgaagcctgctgattgattttt

SEQ ID NO: 2243367 - DNA, 19 bp, Homo sapiens
cgaagccttctgcagcagg

SEQ ID NO: 2243368 - DNA, 19 bp, Homo sapiens
cgaagtcattaaactggtt

SEQ ID NO: 2243369 - DNA, 17 bp, Homo sapiens
cgactgaaaatattgtt

SEQ ID NO: 2243370 - DNA, 12 bp, Homo sapiens
cgagacccccat

SEQ ID NO: 2243371 - DNA, 16 bp, Homo sapiens
cgagacccccatccag

SEQ ID NO: 2243372 - DNA, 12 bp, Homo sapiens
cgagcccagatg

SEQ ID NO: 2243373 - DNA, 15 bp, Homo sapiens
cgaggaaaggatttt

SEQ ID NO: 2243374 - DNA, 21 bp, Homo sapiens
cgaggagctggggcgggctag

SEQ ID NO: 2243375 - DNA, 21 bp, Homo sapiens
cgagggcagggaccacaccct

SEQ ID NO: 2243376 - DNA, 23 bp, Homo sapiens
cgagggccaggcacccacatccc

SEQ ID NO: 2243377 - DNA, 17 bp, Homo sapiens
cgagtaaacttgaaaag

SEQ ID NO: 2243378 - DNA, 14 bp, Homo sapiens
cgatttctacctca

SEQ ID NO: 2243379 - DNA, 14 bp, Homo sapiens
ctgaggctgaggca

SEQ ID NO: 2243380 - DNA, 17 bp, Homo sapiens
ctgagtgaacctgtata

SEQ ID NO: 2243381 - DNA, 20 bp, Homo sapiens
ctgataaaaataatattaat

SEQ ID NO: 2243382 - DNA, 18 bp, Homo sapiens
ctgatcccaccccctcct

SEQ ID NO: 2243383 - DNA, 23 bp, Homo sapiens
ctgatcccaccccctcctccccc

SEQ ID NO: 2243384 - DNA, 17 bp, Homo sapiens
ctgatgagatttttaaa

SEQ ID NO: 2243385 - DNA, 13 bp, Homo sapiens
ctgatgtatcctt

SEQ ID NO: 2243386 - DNA, 14 bp, Homo sapiens
ctgcaaaaagaaaa

SEQ ID NO: 2243387 - DNA, 22 bp, Homo sapiens
ctgcaagaccacggagggagcg

SEQ ID NO: 2243388 - DNA, 17 bp, Homo sapiens
ctgcacttttagccaga

SEQ ID NO: 2243389 - DNA, 22 bp, Homo sapiens
ctgcaggtcaagttgtcaggtt

SEQ ID NO: 2243390 - DNA, 14 bp, Homo sapiens
ctgcagttgacttt

SEQ ID NO: 2243391 - DNA, 21 bp, Homo sapiens
ctgcagttttgctatctgggc

SEQ ID NO: 2243392 - DNA, 13 bp, Homo sapiens
ctgcatccagcct

SEQ ID NO: 2243393 - DNA, 15 bp, Homo sapiens
ctgcattcctgtgcc

SEQ ID NO: 2243394 - DNA, 23 bp, Homo sapiens
ctgcattgagcttgcatgcttgc

SEQ ID NO: 2243395 - DNA, 21 bp, Homo sapiens
ctgccagccccgccacgcttg

SEQ ID NO: 2243396 - DNA, 22 bp, Homo sapiens
ctgccatggccttggcaggctg

SEQ ID NO: 2243397 - DNA, 20 bp, Homo sapiens
ctgcccatgtgtcccctcac

SEQ ID NO: 2243398 - DNA, 22 bp, Homo sapiens
ctgcccatgtgtcccctcactc

SEQ ID NO: 2243399 - DNA, 22 bp, Homo sapiens
ctgccccaccccatccagccag

SEQ ID NO: 2243400 - DNA, 16 bp, Homo sapiens
ctgccccccagcctct

SEQ ID NO: 2243401 - DNA, 15 bp, Homo sapiens
ctgccccctccccca

SEQ ID NO: 2243402 - DNA, 16 bp, Homo sapiens
ctgccccctcccccat

SEQ ID NO: 2243403 - DNA, 21 bp, Homo sapiens
ctgccccctcccccatgggct

SEQ ID NO: 2243404 - DNA, 17 bp, Homo sapiens
ctgcccctctcaccaaa

SEQ ID NO: 2243405 - DNA, 15 bp, Homo sapiens
ctgcccttccccctg

SEQ ID NO: 2243406 - DNA, 18 bp, Homo sapiens
ctgccgctgccgctgcac

SEQ ID NO: 2243407 - DNA, 19 bp, Homo sapiens
ctgccgctgccgctgcacc

SEQ ID NO: 2243408 - DNA, 20 bp, Homo sapiens
ctgccgctgccgctgcacca

SEQ ID NO: 2243409 - DNA, 19 bp, Homo sapiens
ctgcctctcggtgacctcc

SEQ ID NO: 2243410 - DNA, 13 bp, Homo sapiens
ctgcctgctgcag

SEQ ID NO: 2243411 - DNA, 15 bp, Homo sapiens
ctgcctgctgcagtc

SEQ ID NO: 2243412 - DNA, 21 bp, Homo sapiens
ctgcctgtccccaaacaggac

SEQ ID NO: 2243413 - DNA, 20 bp, Homo sapiens
ctgccttagtctcagtttgt

SEQ ID NO: 2243414 - DNA, 18 bp, Homo sapiens
ctgccttctggccttgta

SEQ ID NO: 2243415 - DNA, 14 bp, Homo sapiens
ctgccttggctcag

SEQ ID NO: 2243416 - DNA, 18 bp, Homo sapiens
ctgccttggctcagacat

SEQ ID NO: 2243417 - DNA, 22 bp, Homo sapiens
ctgccttggctcagacatgttt

SEQ ID NO: 2243418 - DNA, 22 bp, Homo sapiens
ctgcgcccttaactgcatccag

SEQ ID NO: 2243419 - DNA, 14 bp, Homo sapiens
ctgcgggttttaat

SEQ ID NO: 2243420 - DNA, 15 bp, Homo sapiens
ctgctagatttctac

SEQ ID NO: 2243421 - DNA, 18 bp, Homo sapiens
ctgctatacacaagcaat

SEQ ID NO: 2243422 - DNA, 22 bp, Homo sapiens
ctgctatacacaagcaatgcaa

SEQ ID NO: 2243423 - DNA, 16 bp, Homo sapiens
ctgctcgtggactgtg

SEQ ID NO: 2243424 - DNA, 17 bp, Homo sapiens
ctgctcgtggactgtgc

SEQ ID NO: 2243425 - DNA, 22 bp, Homo sapiens
ctgctggggatccccgcctggc

SEQ ID NO: 2243426 - DNA, 17 bp, Homo sapiens
ctgctgtccctccccct

SEQ ID NO: 2243427 - DNA, 20 bp, Homo sapiens
ctgctgtccctcccccttgt

SEQ ID NO: 2243428 - DNA, 22 bp, Homo sapiens
ctgcttaaagttggtattaata

SEQ ID NO: 2243429 - DNA, 19 bp, Homo sapiens
ctggaacaaattatttttg

SEQ ID NO: 2243430 - DNA, 17 bp, Homo sapiens
ctggaagcccctgggcc

SEQ ID NO: 2243431 - DNA, 21 bp, Homo sapiens
ctggaagcccctgggcccagt

SEQ ID NO: 2243432 - DNA, 17 bp, Homo sapiens
ctggaatctggagacca

SEQ ID NO: 2243433 - DNA, 16 bp, Homo sapiens
ctggacactcagacct

SEQ ID NO: 2243434 - DNA, 21 bp, Homo sapiens
ctggacccctgggcctcatca

SEQ ID NO: 2243435 - DNA, 21 bp, Homo sapiens
ctggacgatagcttggaggga

SEQ ID NO: 2243436 - DNA, 23 bp, Homo sapiens
ctggactctaaagtctgttgatt

SEQ ID NO: 2243437 - DNA, 15 bp, Homo sapiens
ctggacttgcctctg

SEQ ID NO: 2243438 - DNA, 18 bp, Homo sapiens
ctggagcagaccaccccg

SEQ ID NO: 2243439 - DNA, 14 bp, Homo sapiens
ctggagcatttctc

SEQ ID NO: 2243440 - DNA, 16 bp, Homo sapiens
ctggaggggtgtggct

SEQ ID NO: 2243441 - DNA, 20 bp, Homo sapiens
ctggcaaagcttttagaaat

SEQ ID NO: 2243442 - DNA, 13 bp, Homo sapiens
ctggcacagaggt

SEQ ID NO: 2243443 - DNA, 19 bp, Homo sapiens
ctggcagagagcacagtga

SEQ ID NO: 2243444 - DNA, 15 bp, Homo sapiens
ctggcaggatgctga

SEQ ID NO: 2243445 - DNA, 20 bp, Homo sapiens
ctggcattagaattatttaa

SEQ ID NO: 2243446 - DNA, 13 bp, Homo sapiens
ctggccagacgct

SEQ ID NO: 2243447 - DNA, 15 bp, Homo sapiens
ctggccccagccctg

SEQ ID NO: 2243448 - DNA, 19 bp, Homo sapiens
ctggccccagccctgctgg

SEQ ID NO: 2243449 - DNA, 22 bp, Homo sapiens
ctggccgccccctgccccccag

SEQ ID NO: 2243450 - DNA, 11 bp, Homo sapiens
ctggcctctgt

SEQ ID NO: 2243451 - DNA, 13 bp, Homo sapiens
ctggcctctgtgc

SEQ ID NO: 2243452 - DNA, 14 bp, Homo sapiens
ctggcctctgtgcc

SEQ ID NO: 2243453 - DNA, 15 bp, Homo sapiens
ctggcctctgtgcct

SEQ ID NO: 2243454 - DNA, 21 bp, Homo sapiens
ctggcctggaatttgggcaga

SEQ ID NO: 2243455 - DNA, 23 bp, Homo sapiens
ctggcctggaatttgggcagata

SEQ ID NO: 2243456 - DNA, 22 bp, Homo sapiens
ctggcctggactgttttctctc

SEQ ID NO: 2243457 - DNA, 13 bp, Homo sapiens
ctggcgtgctcag

SEQ ID NO: 2243458 - DNA, 18 bp, Homo sapiens
ctggcgtgctcagaccca

SEQ ID NO: 2243459 - DNA, 18 bp, Homo sapiens
ctggctctgccccctccc

SEQ ID NO: 2243460 - DNA, 21 bp, Homo sapiens
ctggctctgccccctccccca

SEQ ID NO: 2243461 - DNA, 12 bp, Homo sapiens
ctggctctgtga

SEQ ID NO: 2243462 - DNA, 22 bp, Homo sapiens
ctggctcttgatacccccctct

SEQ ID NO: 2243463 - DNA, 18 bp, Homo sapiens
ctggctggtgggccccca

SEQ ID NO: 2243464 - DNA, 22 bp, Homo sapiens
ctggcttttattaatgcacttt

SEQ ID NO: 2243465 - DNA, 23 bp, Homo sapiens
ctggcttttattaatgcactttc

SEQ ID NO: 2243466 - DNA, 23 bp, Homo sapiens
ctgggaacatcacattcctctgc

SEQ ID NO: 2243467 - DNA, 15 bp, Homo sapiens
ctgggaatgggagag

SEQ ID NO: 2243468 - DNA, 15 bp, Homo sapiens
ctgggaggactggac

SEQ ID NO: 2243469 - DNA, 16 bp, Homo sapiens
ctgggaggactggacc

SEQ ID NO: 2243470 - DNA, 16 bp, Homo sapiens
ctgggatgggaccagg

SEQ ID NO: 2243471 - DNA, 22 bp, Homo sapiens
ctgggccatgtccaaagaggct

SEQ ID NO: 2243472 - DNA, 16 bp, Homo sapiens
ctgggcccctccacgc

SEQ ID NO: 2243473 - DNA, 19 bp, Homo sapiens
ctgggcccctccacgcctc

SEQ ID NO: 2243474 - DNA, 21 bp, Homo sapiens
ctgggcccctccacgcctcct

SEQ ID NO: 2243475 - DNA, 14 bp, Homo sapiens
ctgggcccctggga

SEQ ID NO: 2243476 - DNA, 22 bp, Homo sapiens
ctgggctcactgtgctggggca

SEQ ID NO: 2243477 - DNA, 20 bp, Homo sapiens
ctgggctgtctgtcaccagc

SEQ ID NO: 2243478 - DNA, 21 bp, Homo sapiens
ctgggctgtctgtcaccagct

SEQ ID NO: 2243479 - DNA, 18 bp, Homo sapiens
ctggggacttgtgtctgc

SEQ ID NO: 2243480 - DNA, 12 bp, Homo sapiens
ctggggagcccg

SEQ ID NO: 2243481 - DNA, 15 bp, Homo sapiens
ctggggagcccgtct

SEQ ID NO: 2243482 - DNA, 14 bp, Homo sapiens
ctggggatccccgc

SEQ ID NO: 2243483 - DNA, 23 bp, Homo sapiens
ctggggatcttcccacaggaggg

SEQ ID NO: 2243484 - DNA, 12 bp, Homo sapiens
ctggggcaggct

SEQ ID NO: 2243485 - DNA, 14 bp, Homo sapiens
ctggggcaggctgg

SEQ ID NO: 2243486 - DNA, 16 bp, Homo sapiens
gatactggcacagagg

SEQ ID NO: 2243487 - DNA, 14 bp, Homo sapiens
gatagcactttcta

SEQ ID NO: 2243488 - DNA, 21 bp, Homo sapiens
gatatagcattaataaaactg

SEQ ID NO: 2243489 - DNA, 15 bp, Homo sapiens
gatatctataaaata

SEQ ID NO: 2243490 - DNA, 17 bp, Homo sapiens
gatatctataaaataga

SEQ ID NO: 2243491 - DNA, 20 bp, Homo sapiens
gatatttgcagtttttcatt

SEQ ID NO: 2243492 - DNA, 12 bp, Homo sapiens
gatatttttgta

SEQ ID NO: 2243493 - DNA, 23 bp, Homo sapiens
gatcacttagcgaaccctttatt

SEQ ID NO: 2243494 - DNA, 15 bp, Homo sapiens
gatcagaggagtaaa

SEQ ID NO: 2243495 - DNA, 13 bp, Homo sapiens
gatcatgtacttt

SEQ ID NO: 2243496 - DNA, 19 bp, Homo sapiens
gatcatgtactttttagta

SEQ ID NO: 2243497 - DNA, 20 bp, Homo sapiens
gatcatgtactttttagtaa

SEQ ID NO: 2243498 - DNA, 11 bp, Homo sapiens
gatcccacccc

SEQ ID NO: 2243499 - DNA, 13 bp, Homo sapiens
gatcccaccccct

SEQ ID NO: 2243500 - DNA, 20 bp, Homo sapiens
gatcccaccccctcctcccc

SEQ ID NO: 2243501 - DNA, 22 bp, Homo sapiens
gatcccaccccctcctccccca

SEQ ID NO: 2243502 - DNA, 23 bp, Homo sapiens
gatcccaccccctcctcccccag

SEQ ID NO: 2243503 - DNA, 19 bp, Homo sapiens
gatccccctctttgcacag

SEQ ID NO: 2243504 - DNA, 13 bp, Homo sapiens
gatccccgcctgg

SEQ ID NO: 2243505 - DNA, 16 bp, Homo sapiens
gatcccgttttcccca

SEQ ID NO: 2243506 - DNA, 15 bp, Homo sapiens
gatcctctcacctca

SEQ ID NO: 2243507 - DNA, 19 bp, Homo sapiens
gatcctctcacctcagcct

SEQ ID NO: 2243508 - DNA, 13 bp, Homo sapiens
gatctggctgcag

SEQ ID NO: 2243509 - DNA, 16 bp, Homo sapiens
gatgaagaacatctgg

SEQ ID NO: 2243510 - DNA, 14 bp, Homo sapiens
gatgaatgtattta

SEQ ID NO: 2243511 - DNA, 15 bp, Homo sapiens
gatgactgtgttgta

SEQ ID NO: 2243512 - DNA, 13 bp, Homo sapiens
gatgaggcaaccc

SEQ ID NO: 2243513 - DNA, 13 bp, Homo sapiens
gatgatctctcca

SEQ ID NO: 2243514 - DNA, 16 bp, Homo sapiens
gatgatgaaaactaag

SEQ ID NO: 2243515 - DNA, 17 bp, Homo sapiens
gatgatgatgatgatga

SEQ ID NO: 2243516 - DNA, 14 bp, Homo sapiens
gatgatttaagtgt

SEQ ID NO: 2243517 - DNA, 15 bp, Homo sapiens
gatgatttttaactt

SEQ ID NO: 2243518 - DNA, 18 bp, Homo sapiens
gatgatttttaacttttt

SEQ ID NO: 2243519 - DNA, 18 bp, Homo sapiens
gatgcaacctcactatgg

SEQ ID NO: 2243520 - DNA, 19 bp, Homo sapiens
gatgcacgtggggcccact

SEQ ID NO: 2243521 - DNA, 16 bp, Homo sapiens
gatgcatgtcttttaa

SEQ ID NO: 2243522 - DNA, 14 bp, Homo sapiens
gatgctgatggagc

SEQ ID NO: 2243523 - DNA, 15 bp, Homo sapiens
gatggagaggcggcc

SEQ ID NO: 2243524 - DNA, 14 bp, Homo sapiens
gatgggaccaggga

SEQ ID NO: 2243525 - DNA, 22 bp, Homo sapiens
gatgggggacgagggccaggca

SEQ ID NO: 2243526 - DNA, 16 bp, Homo sapiens
gatgtcatttgagcag

SEQ ID NO: 2243527 - DNA, 20 bp, Homo sapiens
gatgttaaaataaatggttt

SEQ ID NO: 2243528 - DNA, 18 bp, Homo sapiens
gatgttctggataccatt

SEQ ID NO: 2243529 - DNA, 13 bp, Homo sapiens
gatgtttccagac

SEQ ID NO: 2243530 - DNA, 21 bp, Homo sapiens
gatgtttcgagtaaacttgaa

SEQ ID NO: 2243531 - DNA, 18 bp, Homo sapiens
gattatggaaaaataaaa

SEQ ID NO: 2243532 - DNA, 21 bp, Homo sapiens
gattctatttaattgaaactc

SEQ ID NO: 2243533 - DNA, 20 bp, Homo sapiens
gattctgaccttaaatgcaa

SEQ ID NO: 2243534 - DNA, 21 bp, Homo sapiens
gattgaattacggaaaatgcc

SEQ ID NO: 2243535 - DNA, 18 bp, Homo sapiens
gatttaacattatctagt

SEQ ID NO: 2243536 - DNA, 13 bp, Homo sapiens
gatttaaggtatt

SEQ ID NO: 2243537 - DNA, 16 bp, Homo sapiens
gatttaatttgaaata

SEQ ID NO: 2243538 - DNA, 16 bp, Homo sapiens
gatttccatctctggt

SEQ ID NO: 2243539 - DNA, 12 bp, Homo sapiens
gattttaccaaa

SEQ ID NO: 2243540 - DNA, 19 bp, Homo sapiens
gattttaccaaagcatcaa

SEQ ID NO: 2243541 - DNA, 21 bp, Homo sapiens
gatttttaaaaaatattttct

SEQ ID NO: 2243542 - DNA, 19 bp, Homo sapiens
gattttttgcattcctgac

SEQ ID NO: 2243543 - DNA, 21 bp, Homo sapiens
gattttttttgtaacttcaaa

SEQ ID NO: 2243544 - DNA, 23 bp, Homo sapiens
gcaaaaatatttataaaacttct

SEQ ID NO: 2243545 - DNA, 14 bp, Homo sapiens
gcaaacaagaaacg

SEQ ID NO: 2243546 - DNA, 22 bp, Homo sapiens
gcaaacggcaacgtagcctggg

SEQ ID NO: 2243547 - DNA, 15 bp, Homo sapiens
gcaacagatcagtaa

SEQ ID NO: 2243548 - DNA, 14 bp, Homo sapiens
gcaacgtagcctgg

SEQ ID NO: 2243549 - DNA, 15 bp, Homo sapiens
gcaacgtagcctggg

SEQ ID NO: 2243550 - DNA, 19 bp, Homo sapiens
gcaagtcagattgctggga

SEQ ID NO: 2243551 - DNA, 21 bp, Homo sapiens
gcaagtcagattgctgggagg

SEQ ID NO: 2243552 - DNA, 21 bp, Homo sapiens
gcaatagttttttacttctct

SEQ ID NO: 2243553 - DNA, 22 bp, Homo sapiens
gcaatattgtatatttttatct

SEQ ID NO: 2243554 - DNA, 22 bp, Homo sapiens
gcaatcaaaaatatgtgttttt

SEQ ID NO: 2243555 - DNA, 18 bp, Homo sapiens
gcaatgcgtgttgtacat

SEQ ID NO: 2243556 - DNA, 19 bp, Homo sapiens
gcaatgtctgagtgaacct

SEQ ID NO: 2243557 - DNA, 14 bp, Homo sapiens
gcaatgtgaaaaat

SEQ ID NO: 2243558 - DNA, 17 bp, Homo sapiens
gcaatgtgaaaaatctg

SEQ ID NO: 2243559 - DNA, 18 bp, Homo sapiens
gcaattcccctctgctgc

SEQ ID NO: 2243560 - DNA, 21 bp, Homo sapiens
gcaattcccctctgctgctgt

SEQ ID NO: 2243561 - DNA, 17 bp, Homo sapiens
gcacacagcagcccccc

SEQ ID NO: 2243562 - DNA, 21 bp, Homo sapiens
gcacacagcagccccccagca

SEQ ID NO: 2243563 - DNA, 14 bp, Homo sapiens
gcacaccaccctcc

SEQ ID NO: 2243564 - DNA, 22 bp, Homo sapiens
gcacagggagtgcacatatcca

SEQ ID NO: 2243565 - DNA, 22 bp, Homo sapiens
gcacatacacctcgtcaagagc

SEQ ID NO: 2243566 - DNA, 23 bp, Homo sapiens
gcacatacacctcgtcaagagca

SEQ ID NO: 2243567 - DNA, 21 bp, Homo sapiens
gcacatgctgtctggccctgg

SEQ ID NO: 2243568 - DNA, 15 bp, Homo sapiens
gcaccacaaaatata

SEQ ID NO: 2243569 - DNA, 20 bp, Homo sapiens
gcaccagatgcaacctcact

SEQ ID NO: 2243570 - DNA, 21 bp, Homo sapiens
gcaccctagttctacctcagg

SEQ ID NO: 2243571 - DNA, 17 bp, Homo sapiens
gcaccctctcctggggg

SEQ ID NO: 2243572 - DNA, 18 bp, Homo sapiens
gcaccctctcctgggggt

SEQ ID NO: 2243573 - DNA, 15 bp, Homo sapiens
gcaccttttactgtg

SEQ ID NO: 2243574 - DNA, 19 bp, Homo sapiens
gcacggcgggatcctccac

SEQ ID NO: 2243575 - DNA, 20 bp, Homo sapiens
gcactaaggccgtgtctctg

SEQ ID NO: 2243576 - DNA, 23 bp, Homo sapiens
gcactaaggccgtgtctctgagg

SEQ ID NO: 2243577 - DNA, 18 bp, Homo sapiens
gcactgcattcctgtgcc

SEQ ID NO: 2243578 - DNA, 18 bp, Homo sapiens
gcactggggagcccgtct

SEQ ID NO: 2243579 - DNA, 18 bp, Homo sapiens
gcacttcaaattcaaata

SEQ ID NO: 2243580 - DNA, 20 bp, Homo sapiens
gcacttgtgattatttatta

SEQ ID NO: 2243581 - DNA, 23 bp, Homo sapiens
gcacttgtgattatttattattt

SEQ ID NO: 2243582 - DNA, 22 bp, Homo sapiens
gcactttctacaatgtgaactt

SEQ ID NO: 2243583 - DNA, 17 bp, Homo sapiens
gcacttttagccagaga

SEQ ID NO: 2243584 - DNA, 22 bp, Homo sapiens
gcacttttagccagagatgcaa

SEQ ID NO: 2243585 - DNA, 14 bp, Homo sapiens
gcagacaaccttgt

SEQ ID NO: 2243586 - DNA, 21 bp, Homo sapiens
gcagacaataaaccctcagag

SEQ ID NO: 2243587 - DNA, 14 bp, Homo sapiens
gcagaggtggaaaa

SEQ ID NO: 2243588 - DNA, 14 bp, Homo sapiens
gcagagtcctggag

SEQ ID NO: 2243589 - DNA, 21 bp, Homo sapiens
gcagatatagcattaataaaa

SEQ ID NO: 2243590 - DNA, 21 bp, Homo sapiens
gcagatttttatgttttgaaa

SEQ ID NO: 2243591 - DNA, 12 bp, Homo sapiens
gcagcaccctcc

SEQ ID NO: 2243592 - DNA, 20 bp, Homo sapiens
gcagcaccctcccccgcagc

SEQ ID NO: 2243593 - DNA, 15 bp, Homo sapiens
gcagcaggctcaggc

SEQ ID NO: 2243594 - DNA, 15 bp, Homo sapiens
ggaggttgggtgggc

SEQ ID NO: 2243595 - DNA, 23 bp, Homo sapiens
ggagtggaaaagcttaaaaaaat

SEQ ID NO: 2243596 - DNA, 17 bp, Homo sapiens
ggatactggcacagagg

SEQ ID NO: 2243597 - DNA, 21 bp, Homo sapiens
ggataggccttcattaacaaa

SEQ ID NO: 2243598 - DNA, 19 bp, Homo sapiens
ggatcagagcgcacaggga

SEQ ID NO: 2243599 - DNA, 15 bp, Homo sapiens
ggatccatctttgta

SEQ ID NO: 2243600 - DNA, 22 bp, Homo sapiens
ggatccccgcctggccaggagc

SEQ ID NO: 2243601 - DNA, 18 bp, Homo sapiens
ggatgcaggctcccctga

SEQ ID NO: 2243602 - DNA, 16 bp, Homo sapiens
ggatggagaggcggcc

SEQ ID NO: 2243603 - DNA, 18 bp, Homo sapiens
ggatggagaggcggcctc

SEQ ID NO: 2243604 - DNA, 14 bp, Homo sapiens
ggattaatatgaaa

SEQ ID NO: 2243605 - DNA, 15 bp, Homo sapiens
ggattaatatgaaaa

SEQ ID NO: 2243606 - DNA, 21 bp, Homo sapiens
ggattattattagtgttttat

SEQ ID NO: 2243607 - DNA, 20 bp, Homo sapiens
ggattcagtggaggctggca

SEQ ID NO: 2243608 - DNA, 15 bp, Homo sapiens
ggattttaccaaagc

SEQ ID NO: 2243609 - DNA, 16 bp, Homo sapiens
ggatttttagaattaa

SEQ ID NO: 2243610 - DNA, 20 bp, Homo sapiens
ggcaacagatcagtaaagaa

SEQ ID NO: 2243611 - DNA, 17 bp, Homo sapiens
ggcaatctctctctgtg

SEQ ID NO: 2243612 - DNA, 17 bp, Homo sapiens
ggcacacagcagccccc

SEQ ID NO: 2243613 - DNA, 19 bp, Homo sapiens
ggcacacagcagcccccca

SEQ ID NO: 2243614 - DNA, 18 bp, Homo sapiens
ggcacaggccgaggcagg

SEQ ID NO: 2243615 - DNA, 20 bp, Homo sapiens
ggcacggcgggatcctccac

SEQ ID NO: 2243616 - DNA, 17 bp, Homo sapiens
ggcacgggtggtccccg

SEQ ID NO: 2243617 - DNA, 21 bp, Homo sapiens
ggcacttcatgtaaagtgtca

SEQ ID NO: 2243618 - DNA, 15 bp, Homo sapiens
ggcagacaaccttgt

SEQ ID NO: 2243619 - DNA, 20 bp, Homo sapiens
ggcagcaccctcccccgcag

SEQ ID NO: 2243620 - DNA, 13 bp, Homo sapiens
ggcagccagacca

SEQ ID NO: 2243621 - DNA, 15 bp, Homo sapiens
ggcagccagaccagc

SEQ ID NO: 2243622 - DNA, 14 bp, Homo sapiens
ggcaggagggcagt

SEQ ID NO: 2243623 - DNA, 11 bp, Homo sapiens
ggcaggcccac

SEQ ID NO: 2243624 - DNA, 12 bp, Homo sapiens
ggcaggcccact

SEQ ID NO: 2243625 - DNA, 15 bp, Homo sapiens
ggcaggcccactccc

SEQ ID NO: 2243626 - DNA, 12 bp, Homo sapiens
ggcaggctgggc

SEQ ID NO: 2243627 - DNA, 13 bp, Homo sapiens
ggcaggctgggcc

SEQ ID NO: 2243628 - DNA, 16 bp, Homo sapiens
ggcaggctgggccatg

SEQ ID NO: 2243629 - DNA, 22 bp, Homo sapiens
ggcaggctgggccatgtccaaa

SEQ ID NO: 2243630 - DNA, 17 bp, Homo sapiens
ggcagggggccctgccc

SEQ ID NO: 2243631 - DNA, 15 bp, Homo sapiens
ggcaggtcctgccca

SEQ ID NO: 2243632 - DNA, 22 bp, Homo sapiens
ggcatctgttagcagagtctgt

SEQ ID NO: 2243633 - DNA, 18 bp, Homo sapiens
ggcatgtaaatgtaaact

SEQ ID NO: 2243634 - DNA, 17 bp, Homo sapiens
ggcattagaattattta

SEQ ID NO: 2243635 - DNA, 19 bp, Homo sapiens
ggcattagaattatttaaa

SEQ ID NO: 2243636 - DNA, 13 bp, Homo sapiens
ggcattgctcagc

SEQ ID NO: 2243637 - DNA, 15 bp, Homo sapiens
ggcattgctcagccc

SEQ ID NO: 2243638 - DNA, 17 bp, Homo sapiens
ggcattgctcagcccgc

SEQ ID NO: 2243639 - DNA, 21 bp, Homo sapiens
ggcattgctcagcccgcttgg

SEQ ID NO: 2243640 - DNA, 23 bp, Homo sapiens
ggcattgctcagcccgcttggcc

SEQ ID NO: 2243641 - DNA, 14 bp, Homo sapiens
ggcatttggtgaga

SEQ ID NO: 2243642 - DNA, 16 bp, Homo sapiens
ggccagcaccctctcc

SEQ ID NO: 2243643 - DNA, 20 bp, Homo sapiens
ggccagcaccctctcctggg

SEQ ID NO: 2243644 - DNA, 21 bp, Homo sapiens
ggccaggagcaggcacgggtg

SEQ ID NO: 2243645 - DNA, 13 bp, Homo sapiens
ggccatccctggg

SEQ ID NO: 2243646 - DNA, 20 bp, Homo sapiens
ggccatccctgggcccctcc

SEQ ID NO: 2243647 - DNA, 21 bp, Homo sapiens
ggccatccctgggcccctcca

SEQ ID NO: 2243648 - DNA, 16 bp, Homo sapiens
ggccatgtccaaagag

SEQ ID NO: 2243649 - DNA, 23 bp, Homo sapiens
ggccatgtccaaagaggctgccc

SEQ ID NO: 2243650 - DNA, 19 bp, Homo sapiens
ggcccactccccagcccca

SEQ ID NO: 2243651 - DNA, 21 bp, Homo sapiens
ggcccaggcagacaaccttgt

SEQ ID NO: 2243652 - DNA, 13 bp, Homo sapiens
ggccccagccctg

SEQ ID NO: 2243653 - DNA, 21 bp, Homo sapiens
ggccccagccctgctggggat

SEQ ID NO: 2243654 - DNA, 12 bp, Homo sapiens
ggcccctccacg

SEQ ID NO: 2243655 - DNA, 13 bp, Homo sapiens
ggcccctccacgc

SEQ ID NO: 2243656 - DNA, 19 bp, Homo sapiens
ggccctccctgactccctg

SEQ ID NO: 2243657 - DNA, 23 bp, Homo sapiens
ggccctccctgactccctgtggg

SEQ ID NO: 2243658 - DNA, 13 bp, Homo sapiens
ggccctgccccac

SEQ ID NO: 2243659 - DNA, 16 bp, Homo sapiens
ggccctgggcctcagt

SEQ ID NO: 2243660 - DNA, 23 bp, Homo sapiens
ggccctggggatcttcccacagg

SEQ ID NO: 2243661 - DNA, 18 bp, Homo sapiens
ggccgccccctgcccccc

SEQ ID NO: 2243662 - DNA, 19 bp, Homo sapiens
ggccgccccctgcccccca

SEQ ID NO: 2243663 - DNA, 22 bp, Homo sapiens
ggccgctggctggtgggccccc

SEQ ID NO: 2243664 - DNA, 22 bp, Homo sapiens
ggccggcttcatgccagctact

SEQ ID NO: 2243665 - DNA, 19 bp, Homo sapiens
ggcctcaaaggcccgctct

SEQ ID NO: 2243666 - DNA, 18 bp, Homo sapiens
ggcctcaccgagtggggg

SEQ ID NO: 2243667 - DNA, 13 bp, Homo sapiens
ggcctcagccctc

SEQ ID NO: 2243668 - DNA, 14 bp, Homo sapiens
ggcctcagccctca

SEQ ID NO: 2243669 - DNA, 16 bp, Homo sapiens
ggcctctgtgccttct

SEQ ID NO: 2243670 - DNA, 13 bp, Homo sapiens
ggccttggcaggc

SEQ ID NO: 2243671 - DNA, 14 bp, Homo sapiens
ggcgtgctcagacc

SEQ ID NO: 2243672 - DNA, 21 bp, Homo sapiens
ggctaaacatccaatattttc

SEQ ID NO: 2243673 - DNA, 13 bp, Homo sapiens
ggctcactgtgct

SEQ ID NO: 2243674 - DNA, 22 bp, Homo sapiens
ggctccccatgtgtcctggttc

SEQ ID NO: 2243675 - DNA, 14 bp, Homo sapiens
ggctccctggcagg

SEQ ID NO: 2243676 - DNA, 15 bp, Homo sapiens
ggctccctggcagga

SEQ ID NO: 2243677 - DNA, 19 bp, Homo sapiens
ggctctgaggtgcctgtcc

SEQ ID NO: 2243678 - DNA, 23 bp, Homo sapiens
ggctctgaggtgcctgtcccacc

SEQ ID NO: 2243679 - DNA, 16 bp, Homo sapiens
ggctctgccccctccc

SEQ ID NO: 2243680 - DNA, 13 bp, Homo sapiens
ggctgacctctca

SEQ ID NO: 2243681 - DNA, 13 bp, Homo sapiens
ggctgcccctctc

SEQ ID NO: 2243682 - DNA, 15 bp, Homo sapiens
ggctgggcccctggg

SEQ ID NO: 2243683 - DNA, 13 bp, Homo sapiens
ggctggtagcagc

SEQ ID NO: 2243684 - DNA, 16 bp, Homo sapiens
ggctggtagcagcagg

SEQ ID NO: 2243685 - DNA, 18 bp, Homo sapiens
ggctggtagcagcaggct

SEQ ID NO: 2243686 - DNA, 22 bp, Homo sapiens
ggctggtagcagcaggctcagg

SEQ ID NO: 2243687 - DNA, 20 bp, Homo sapiens
ggctgtgtcctaaggcccat

SEQ ID NO: 2243688 - DNA, 15 bp, Homo sapiens
ggcttaaggagagga

SEQ ID NO: 2243689 - DNA, 16 bp, Homo sapiens
ggcttcatgccagcta

SEQ ID NO: 2243690 - DNA, 20 bp, Homo sapiens
ggctttacatactttatcaa

SEQ ID NO: 2243691 - DNA, 20 bp, Homo sapiens
ggcttttattaatgcacttt

SEQ ID NO: 2243692 - DNA, 16 bp, Homo sapiens
gggaaactgggaaact

SEQ ID NO: 2243693 - DNA, 14 bp, Homo sapiens
gggaaggggctgag

SEQ ID NO: 2243694 - DNA, 21 bp, Homo sapiens
gggaaggtggggtcctggagc

SEQ ID NO: 2243695 - DNA, 12 bp, Homo sapiens
gggaatgggaga

SEQ ID NO: 2243696 - DNA, 17 bp, Homo sapiens
gggacatgccctgtgtg

SEQ ID NO: 2243697 - DNA, 22 bp, Homo sapiens
gggaccaattctggacagacag

SEQ ID NO: 2243698 - DNA, 19 bp, Homo sapiens
gggaccgcgctagggctcc

SEQ ID NO: 2243699 - DNA, 18 bp, Homo sapiens
gggacctggtaccctcct

SEQ ID NO: 2243700 - DNA, 15 bp, Homo sapiens
gggactgctaaataa

SEQ ID NO: 2243701 - DNA, 16 bp, Homo sapiens
gggactgctaaataaa

SEQ ID NO: 2243702 - DNA, 16 bp, Homo sapiens
gttgtaccaagtgaaa

SEQ ID NO: 2243703 - DNA, 14 bp, Homo sapiens
gttgtcaagaatag

SEQ ID NO: 2243704 - DNA, 18 bp, Homo sapiens
gttgtctacgggggcact

SEQ ID NO: 2243705 - DNA, 21 bp, Homo sapiens
gttgtctccacttgtatatat

SEQ ID NO: 2243706 - DNA, 22 bp, Homo sapiens
gttgtgaatcaccaaaggagct

SEQ ID NO: 2243707 - DNA, 13 bp, Homo sapiens
gttgtgcttgagc

SEQ ID NO: 2243708 - DNA, 23 bp, Homo sapiens
gttgttttaacctcccctctccc

SEQ ID NO: 2243709 - DNA, 23 bp, Homo sapiens
gtttaactgcagttgactttctc

SEQ ID NO: 2243710 - DNA, 20 bp, Homo sapiens
gtttaatcatagttactgtg

SEQ ID NO: 2243711 - DNA, 13 bp, Homo sapiens
gtttataaatctt

SEQ ID NO: 2243712 - DNA, 15 bp, Homo sapiens
gtttatcattcaagt

SEQ ID NO: 2243713 - DNA, 15 bp, Homo sapiens
gtttcctgacattgt

SEQ ID NO: 2243714 - DNA, 17 bp, Homo sapiens
gtttcgagtaaacttga

SEQ ID NO: 2243715 - DNA, 20 bp, Homo sapiens
gtttcgagtaaacttgaaaa

SEQ ID NO: 2243716 - DNA, 16 bp, Homo sapiens
gtttctagactataaa

SEQ ID NO: 2243717 - DNA, 22 bp, Homo sapiens
gtttctgtcgttaaaaacagat

SEQ ID NO: 2243718 - DNA, 20 bp, Homo sapiens
gtttctttctctgaggacaa

SEQ ID NO: 2243719 - DNA, 11 bp, Homo sapiens
gtttgaaaagc

SEQ ID NO: 2243720 - DNA, 18 bp, Homo sapiens
gtttgaaatatattattt

SEQ ID NO: 2243721 - DNA, 12 bp, Homo sapiens
gtttgttctccg

SEQ ID NO: 2243722 - DNA, 15 bp, Homo sapiens
gttttaacctcccct

SEQ ID NO: 2243723 - DNA, 16 bp, Homo sapiens
gttttacaatagttct

SEQ ID NO: 2243724 - DNA, 18 bp, Homo sapiens
gttttagaatcttttaaa

SEQ ID NO: 2243725 - DNA, 16 bp, Homo sapiens
gttttatgcatgtaat

SEQ ID NO: 2243726 - DNA, 15 bp, Homo sapiens
gttttcaagtcaaat

SEQ ID NO: 2243727 - DNA, 19 bp, Homo sapiens
gttttctctcggctcccca

SEQ ID NO: 2243728 - DNA, 21 bp, Homo sapiens
gttttgagctactggattctt

SEQ ID NO: 2243729 - DNA, 22 bp, Homo sapiens
gttttgttctgtatattttgtt

SEQ ID NO: 2243730 - DNA, 14 bp, Homo sapiens
gtttttacatactt

SEQ ID NO: 2243731 - DNA, 20 bp, Homo sapiens
gtttttcctatcatgttaac

SEQ ID NO: 2243732 - DNA, 21 bp, Homo sapiens
gttttttaaaatatttatctg

SEQ ID NO: 2243733 - DNA, 15 bp, Homo sapiens
gttttttcctcagtg

SEQ ID NO: 2243734 - DNA, 18 bp, Homo sapiens
gtttttttacaacattca

SEQ ID NO: 2243735 - DNA, 13 bp, Homo sapiens
taaaaaaattggt

SEQ ID NO: 2243736 - DNA, 18 bp, Homo sapiens
taaaaaagcatacttcta

SEQ ID NO: 2243737 - DNA, 20 bp, Homo sapiens
taaaaacagatttggaaaga

SEQ ID NO: 2243738 - DNA, 22 bp, Homo sapiens
taaaaagggaaagttttgttct

SEQ ID NO: 2243739 - DNA, 22 bp, Homo sapiens
taaaaagtccataccttatata

SEQ ID NO: 2243740 - DNA, 15 bp, Homo sapiens
taaaacaaaatttga

SEQ ID NO: 2243741 - DNA, 21 bp, Homo sapiens
taaaacaaaatttgactaatt

SEQ ID NO: 2243742 - DNA, 16 bp, Homo sapiens
taaaacattaaaatat

SEQ ID NO: 2243743 - DNA, 20 bp, Homo sapiens
taaaagatgtctctgcaaac

SEQ ID NO: 2243744 - DNA, 22 bp, Homo sapiens
taaaagccaaccttcaaagaaa

SEQ ID NO: 2243745 - DNA, 18 bp, Homo sapiens
taaaagtaaaatgtcttt

SEQ ID NO: 2243746 - DNA, 13 bp, Homo sapiens
taaaataattttg

SEQ ID NO: 2243747 - DNA, 16 bp, Homo sapiens
taaaataattttgtaa

SEQ ID NO: 2243748 - DNA, 21 bp, Homo sapiens
taaaataattttgtaatgtat

SEQ ID NO: 2243749 - DNA, 15 bp, Homo sapiens
taaaatatttatctg

SEQ ID NO: 2243750 - DNA, 14 bp, Homo sapiens
taaaatattttgaa

SEQ ID NO: 2243751 - DNA, 16 bp, Homo sapiens
taaaatgcatgatttt

SEQ ID NO: 2243752 - DNA, 17 bp, Homo sapiens
taaaatgtatctaagaa

SEQ ID NO: 2243753 - DNA, 20 bp, Homo sapiens
taaaatgtctttccaaatta

SEQ ID NO: 2243754 - DNA, 15 bp, Homo sapiens
taaaattaaaagttt

SEQ ID NO: 2243755 - DNA, 15 bp, Homo sapiens
taaaatttgttgcat

SEQ ID NO: 2243756 - DNA, 17 bp, Homo sapiens
taaacaaagttactagg

SEQ ID NO: 2243757 - DNA, 21 bp, Homo sapiens
taaacaatgctgatttggtga

SEQ ID NO: 2243758 - DNA, 21 bp, Homo sapiens
taaacataacagcctctgtga

SEQ ID NO: 2243759 - DNA, 20 bp, Homo sapiens
taaacatccaatattttctt

SEQ ID NO: 2243760 - DNA, 19 bp, Homo sapiens
taaaccatttttgttactc

SEQ ID NO: 2243761 - DNA, 18 bp, Homo sapiens
taaactagtttttcctat

SEQ ID NO: 2243762 - DNA, 18 bp, Homo sapiens
taaactcatctgaaatgt

SEQ ID NO: 2243763 - DNA, 22 bp, Homo sapiens
taaactcatctgaaatgttaca

SEQ ID NO: 2243764 - DNA, 15 bp, Homo sapiens
taaagaaaaaaatac

SEQ ID NO: 2243765 - DNA, 20 bp, Homo sapiens
taaagaaaaatatcttggcc

SEQ ID NO: 2243766 - DNA, 16 bp, Homo sapiens
taaagaatatgacttt

SEQ ID NO: 2243767 - DNA, 14 bp, Homo sapiens
taaagactggcttt

SEQ ID NO: 2243768 - DNA, 15 bp, Homo sapiens
taaagactggctttt

SEQ ID NO: 2243769 - DNA, 17 bp, Homo sapiens
taaagcatgaaatgtga

SEQ ID NO: 2243770 - DNA, 13 bp, Homo sapiens
taaagtattcttc

SEQ ID NO: 2243771 - DNA, 18 bp, Homo sapiens
taaagtattcttctcttc

SEQ ID NO: 2243772 - DNA, 15 bp, Homo sapiens
taaagtgatctgtgt

SEQ ID NO: 2243773 - DNA, 19 bp, Homo sapiens
taaagttggtattaataaa

SEQ ID NO: 2243774 - DNA, 22 bp, Homo sapiens
taaagttgttcgccgcgtggaa

SEQ ID NO: 2243775 - DNA, 16 bp, Homo sapiens
taaataaaataaaagc

SEQ ID NO: 2243776 - DNA, 18 bp, Homo sapiens
taaataaaatcatgtagt

SEQ ID NO: 2243777 - DNA, 12 bp, Homo sapiens
taaataagcaaa

SEQ ID NO: 2243778 - DNA, 15 bp, Homo sapiens
taaataatgtattta

SEQ ID NO: 2243779 - DNA, 17 bp, Homo sapiens
taaataatgtatttact

SEQ ID NO: 2243780 - DNA, 15 bp, Homo sapiens
taaataattggaaaa

SEQ ID NO: 2243781 - DNA, 17 bp, Homo sapiens
taaatataccactcttt

SEQ ID NO: 2243782 - DNA, 21 bp, Homo sapiens
taaatataccactctttacct

SEQ ID NO: 2243783 - DNA, 19 bp, Homo sapiens
taaatatttaccttgaaaa

SEQ ID NO: 2243784 - DNA, 21 bp, Homo sapiens
taaatggtttggtgcttttta

SEQ ID NO: 2243785 - DNA, 22 bp, Homo sapiens
taaatgtttggcatgtaaatgt

SEQ ID NO: 2243786 - DNA, 14 bp, Homo sapiens
taaattacaatttt

SEQ ID NO: 2243787 - DNA, 13 bp, Homo sapiens
taaattagaaaat

SEQ ID NO: 2243788 - DNA, 18 bp, Homo sapiens
taaattagaaaatattct

SEQ ID NO: 2243789 - DNA, 19 bp, Homo sapiens
taaattcctcaacagtgtt

SEQ ID NO: 2243790 - DNA, 15 bp, Homo sapiens
taaattgtctttaaa

SEQ ID NO: 2243791 - DNA, 18 bp, Homo sapiens
taaattgtctttaaaaac

SEQ ID NO: 2243792 - DNA, 20 bp, Homo sapiens
taaatttcgcttcttagaac

SEQ ID NO: 2243793 - DNA, 18 bp, Homo sapiens
taacaatgcaacttttaa

SEQ ID NO: 2243794 - DNA, 15 bp, Homo sapiens
taacaatttattctg

SEQ ID NO: 2243795 - DNA, 20 bp, Homo sapiens
taacactgtgtacacctcaa

SEQ ID NO: 2243796 - DNA, 17 bp, Homo sapiens
taacagtggacaaagtt

SEQ ID NO: 2243797 - DNA, 20 bp, Homo sapiens
taacagttttagaatacatt

SEQ ID NO: 2243798 - DNA, 19 bp, Homo sapiens
taacatgtgaaaagaatag

SEQ ID NO: 2243799 - DNA, 22 bp, Homo sapiens
taacattatctagttcattgaa

SEQ ID NO: 2243800 - DNA, 16 bp, Homo sapiens
taacccataattgaag

SEQ ID NO: 2243801 - DNA, 16 bp, Homo sapiens
taacctcccctctccc

SEQ ID NO: 2243802 - DNA, 15 bp, Homo sapiens
taacctctgctttta

SEQ ID NO: 2243803 - DNA, 19 bp, Homo sapiens
taaccttactaattatact

SEQ ID NO: 2243804 - DNA, 18 bp, Homo sapiens
taactaaaataattttgt

SEQ ID NO: 2243805 - DNA, 14 bp, Homo sapiens
taactaaaatgtat

SEQ ID NO: 2243806 - DNA, 16 bp, Homo sapiens
taactgcagttgactt

SEQ ID NO: 2243807 - DNA, 13 bp, Homo sapiens
taactgtaaatca

SEQ ID NO: 2243808 - DNA, 17 bp, Homo sapiens
taacttcaaatatagag

SEQ ID NO: 2243809 - DNA, 15 bp, Homo sapiens
taactttattctttg

SEQ ID NO: 2243810 - DNA, 16 bp, Homo sapiens
tccctgggcccctcca

SEQ ID NO: 2243811 - DNA, 17 bp, Homo sapiens
tccctgggcccctccac

SEQ ID NO: 2243812 - DNA, 20 bp, Homo sapiens
tccctgggcccctccacgcc

SEQ ID NO: 2243813 - DNA, 11 bp, Homo sapiens
tccctgtgggg

SEQ ID NO: 2243814 - DNA, 14 bp, Homo sapiens
tccctgttcctttg

SEQ ID NO: 2243815 - DNA, 16 bp, Homo sapiens
tcccttcagtaccctc

SEQ ID NO: 2243816 - DNA, 19 bp, Homo sapiens
tcccttcagtaccctctca

SEQ ID NO: 2243817 - DNA, 16 bp, Homo sapiens
tccgctaaatatttac

SEQ ID NO: 2243818 - DNA, 20 bp, Homo sapiens
tccgctgtcgccccaggccc

SEQ ID NO: 2243819 - DNA, 19 bp, Homo sapiens
tccgggtgtggcctcagcc

SEQ ID NO: 2243820 - DNA, 17 bp, Homo sapiens
tccgtcctctccccagc

SEQ ID NO: 2243821 - DNA, 18 bp, Homo sapiens
tccgtcctctccccagcc

SEQ ID NO: 2243822 - DNA, 18 bp, Homo sapiens
tccgtgaaaacggagctg

SEQ ID NO: 2243823 - DNA, 17 bp, Homo sapiens
tcctaagagtgctgggc

SEQ ID NO: 2243824 - DNA, 19 bp, Homo sapiens
tcctcagtgcatttgtgct

SEQ ID NO: 2243825 - DNA, 16 bp, Homo sapiens
tcctcataaaaagcaa

SEQ ID NO: 2243826 - DNA, 15 bp, Homo sapiens
tcctcatccacccca

SEQ ID NO: 2243827 - DNA, 17 bp, Homo sapiens
tcctcatccaccccatc

SEQ ID NO: 2243828 - DNA, 20 bp, Homo sapiens
tcctcatgtcttctcacaag

SEQ ID NO: 2243829 - DNA, 14 bp, Homo sapiens
tcctccacagagag

SEQ ID NO: 2243830 - DNA, 19 bp, Homo sapiens
tcctcccaggaagcccagg

SEQ ID NO: 2243831 - DNA, 21 bp, Homo sapiens
tcctccccacttgtccgctgg

SEQ ID NO: 2243832 - DNA, 19 bp, Homo sapiens
tcctccccgcgccccagtc

SEQ ID NO: 2243833 - DNA, 16 bp, Homo sapiens
tcctccttcactgttt

SEQ ID NO: 2243834 - DNA, 21 bp, Homo sapiens
tcctctagctgtgggggtgag

SEQ ID NO: 2243835 - DNA, 17 bp, Homo sapiens
tcctctcacctcagcct

SEQ ID NO: 2243836 - DNA, 13 bp, Homo sapiens
tcctctccccagc

SEQ ID NO: 2243837 - DNA, 19 bp, Homo sapiens
tcctctccccagcctggca

SEQ ID NO: 2243838 - DNA, 15 bp, Homo sapiens
tcctctccctctctc

SEQ ID NO: 2243839 - DNA, 22 bp, Homo sapiens
tcctctcgagcccagatggaaa

SEQ ID NO: 2243840 - DNA, 16 bp, Homo sapiens
tcctgacccctgcctg

SEQ ID NO: 2243841 - DNA, 22 bp, Homo sapiens
tcctgcaggcaggaacaaacag

SEQ ID NO: 2243842 - DNA, 16 bp, Homo sapiens
tcctgcatctctgtga

SEQ ID NO: 2243843 - DNA, 17 bp, Homo sapiens
tcctgcccatgtgtccc

SEQ ID NO: 2243844 - DNA, 16 bp, Homo sapiens
tcctgcgggttttaat

SEQ ID NO: 2243845 - DNA, 11 bp, Homo sapiens
tcctggagggg

SEQ ID NO: 2243846 - DNA, 18 bp, Homo sapiens
tcctgggtttcctgcagg

SEQ ID NO: 2243847 - DNA, 20 bp, Homo sapiens
tcctgggtttcctgcaggca

SEQ ID NO: 2243848 - DNA, 23 bp, Homo sapiens
tcctgtatgttgtacaatcaaaa

SEQ ID NO: 2243849 - DNA, 21 bp, Homo sapiens
tcctgttgaatgacaaagtat

SEQ ID NO: 2243850 - DNA, 16 bp, Homo sapiens
tccttactgtgtttca

SEQ ID NO: 2243851 - DNA, 17 bp, Homo sapiens
tccttactgtgtttcag

SEQ ID NO: 2243852 - DNA, 15 bp, Homo sapiens
tccttagaacatttt

SEQ ID NO: 2243853 - DNA, 20 bp, Homo sapiens
tccttagaacattttaattc

SEQ ID NO: 2243854 - DNA, 17 bp, Homo sapiens
tccttaggcctctgaga

SEQ ID NO: 2243855 - DNA, 15 bp, Homo sapiens
tccttccagtataac

SEQ ID NO: 2243856 - DNA, 21 bp, Homo sapiens
tccttgagacacggagcccag

SEQ ID NO: 2243857 - DNA, 13 bp, Homo sapiens
tccttgaggacag

SEQ ID NO: 2243858 - DNA, 21 bp, Homo sapiens
tccttggagaaatgaaaacag

SEQ ID NO: 2243859 - DNA, 18 bp, Homo sapiens
tcctttcctcagacctgg

SEQ ID NO: 2243860 - DNA, 21 bp, Homo sapiens
tcctttgagtgtcttctaact

SEQ ID NO: 2243861 - DNA, 12 bp, Homo sapiens
tcctttttaagg

SEQ ID NO: 2243862 - DNA, 18 bp, Homo sapiens
tcgaaaaaataattattt

SEQ ID NO: 2243863 - DNA, 19 bp, Homo sapiens
tcgaaacctgggattcagg

SEQ ID NO: 2243864 - DNA, 18 bp, Homo sapiens
tcgaagtcattaaactgg

SEQ ID NO: 2243865 - DNA, 13 bp, Homo sapiens
tcgagcccagatg

SEQ ID NO: 2243866 - DNA, 16 bp, Homo sapiens
tcgagtaaacttgaaa

SEQ ID NO: 2243867 - DNA, 16 bp, Homo sapiens
tcgatttctacctcag

SEQ ID NO: 2243868 - DNA, 14 bp, Homo sapiens
tcgcagctacataa

SEQ ID NO: 2243869 - DNA, 13 bp, Homo sapiens
tcgctcactgttg

SEQ ID NO: 2243870 - DNA, 19 bp, Homo sapiens
tcggaacccaagcttagaa

SEQ ID NO: 2243871 - DNA, 18 bp, Homo sapiens
tcggaggctgggcccctg

SEQ ID NO: 2243872 - DNA, 19 bp, Homo sapiens
tcggaggctgggcccctgg

SEQ ID NO: 2243873 - DNA, 21 bp, Homo sapiens
tcggaggctgggcccctggga

SEQ ID NO: 2243874 - DNA, 22 bp, Homo sapiens
tcggcttgagttcaccatctct

SEQ ID NO: 2243875 - DNA, 12 bp, Homo sapiens
tcggtgaagaaa

SEQ ID NO: 2243876 - DNA, 17 bp, Homo sapiens
tcgtggactgtgctggt

SEQ ID NO: 2243877 - DNA, 20 bp, Homo sapiens
tctaaacaatgctgatttgg

SEQ ID NO: 2243878 - DNA, 14 bp, Homo sapiens
tctaaatcaaacca

SEQ ID NO: 2243879 - DNA, 21 bp, Homo sapiens
tctaaatgtttggcatgtaaa

SEQ ID NO: 2243880 - DNA, 12 bp, Homo sapiens
tctaatagtctt

SEQ ID NO: 2243881 - DNA, 16 bp, Homo sapiens
tctaatcatctgcagt

SEQ ID NO: 2243882 - DNA, 20 bp, Homo sapiens
tctacaatgtgaactttatt

SEQ ID NO: 2243883 - DNA, 19 bp, Homo sapiens
tctacactcttgtaataaa

SEQ ID NO: 2243884 - DNA, 16 bp, Homo sapiens
tctacatatgatctgt

SEQ ID NO: 2243885 - DNA, 15 bp, Homo sapiens
tctacatcttctgcc

SEQ ID NO: 2243886 - DNA, 12 bp, Homo sapiens
tctacatttcac

SEQ ID NO: 2243887 - DNA, 13 bp, Homo sapiens
tctacatttcaca

SEQ ID NO: 2243888 - DNA, 16 bp, Homo sapiens
tctacatttcacatta

SEQ ID NO: 2243889 - DNA, 23 bp, Homo sapiens
tctaggacacagttcctgggaac

SEQ ID NO: 2243890 - DNA, 14 bp, Homo sapiens
tctaggatagctaa

SEQ ID NO: 2243891 - DNA, 17 bp, Homo sapiens
tctataaaatagatata

SEQ ID NO: 2243892 - DNA, 14 bp, Homo sapiens
tctatataaaataa

SEQ ID NO: 2243893 - DNA, 13 bp, Homo sapiens
tctatgcctgtct

SEQ ID NO: 2243894 - DNA, 16 bp, Homo sapiens
tctatttttacattta

SEQ ID NO: 2243895 - DNA, 17 bp, Homo sapiens
tctcaaagaaatattaa

SEQ ID NO: 2243896 - DNA, 14 bp, Homo sapiens
tctcacaagccagc

SEQ ID NO: 2243897 - DNA, 24 bp, Homo sapiens
tctcactcaccactaccagccagc

SEQ ID NO: 2243898 - DNA, 19 bp, Homo sapiens
tctcactgtttgtttttat

SEQ ID NO: 2243899 - DNA, 20 bp, Homo sapiens
tctcagatgttaaaataaat

SEQ ID NO: 2243900 - DNA, 16 bp, Homo sapiens
tctcagtggtgcagga

SEQ ID NO: 2243901 - DNA, 16 bp, Homo sapiens
tctcagtttgtgtgtc

SEQ ID NO: 2243902 - DNA, 23 bp, Homo sapiens
tctcatttaagggaaaaatatat

SEQ ID NO: 2243903 - DNA, 11 bp, Homo sapiens
tctccagctgg

SEQ ID NO: 2243904 - DNA, 15 bp, Homo sapiens
tctccccagcctggc

SEQ ID NO: 2243905 - DNA, 13 bp, Homo sapiens
tctccctctctct

SEQ ID NO: 2243906 - DNA, 16 bp, Homo sapiens
tctccgggtgtggcct

SEQ ID NO: 2243907 - DNA, 23 bp, Homo sapiens
tctccgggtgtggcctcagccct

SEQ ID NO: 2243908 - DNA, 22 bp, Homo sapiens
tctcctatatatttctattatt

SEQ ID NO: 2243909 - DNA, 19 bp, Homo sapiens
tctcctgggggtggcaggc

SEQ ID NO: 2243910 - DNA, 20 bp, Homo sapiens
tctcctgggggtggcaggca

SEQ ID NO: 2243911 - DNA, 14 bp, Homo sapiens
tctccttactgtgt

SEQ ID NO: 2243912 - DNA, 22 bp, Homo sapiens
tctccttccagtataaccagct

SEQ ID NO: 2243913 - DNA, 20 bp, Homo sapiens
tctccttggccacagactga

SEQ ID NO: 2243914 - DNA, 20 bp, Homo sapiens
tctctaacagtggacaaagt

SEQ ID NO: 2243915 - DNA, 16 bp, Homo sapiens
tctctcagagccctca

SEQ ID NO: 2243916 - DNA, 13 bp, Homo sapiens
tctctccagatgt

SEQ ID NO: 2243917 - DNA, 16 bp, Homo sapiens
tctctccagatgtttc

SEQ ID NO: 2243918 - DNA, 14 bp, Homo sapiens
tgtaatcatttgtt

SEQ ID NO: 2243919 - DNA, 12 bp, Homo sapiens
tgtaatgacagg

SEQ ID NO: 2243920 - DNA, 19 bp, Homo sapiens
tgtaatttgatgaggtatt

SEQ ID NO: 2243921 - DNA, 18 bp, Homo sapiens
tgtacatacgatttaagg

SEQ ID NO: 2243922 - DNA, 14 bp, Homo sapiens
tgtaccaagtgaaa

SEQ ID NO: 2243923 - DNA, 16 bp, Homo sapiens
tgtacctcaaatgaat

SEQ ID NO: 2243924 - DNA, 23 bp, Homo sapiens
tgtacgtggccatgtatgaagcc

SEQ ID NO: 2243925 - DNA, 15 bp, Homo sapiens
tgtactgttctgtgt

SEQ ID NO: 2243926 - DNA, 22 bp, Homo sapiens
tgtacttggagtattggggtct

SEQ ID NO: 2243927 - DNA, 12 bp, Homo sapiens
tgtactttgaat

SEQ ID NO: 2243928 - DNA, 12 bp, Homo sapiens
tgtacttttcat

SEQ ID NO: 2243929 - DNA, 17 bp, Homo sapiens
tgtacttttcattctct

SEQ ID NO: 2243930 - DNA, 18 bp, Homo sapiens
tgtagacacttacttgat

SEQ ID NO: 2243931 - DNA, 12 bp, Homo sapiens
tgtagacgatat

SEQ ID NO: 2243932 - DNA, 20 bp, Homo sapiens
tgtagacgatatactccctg

SEQ ID NO: 2243933 - DNA, 22 bp, Homo sapiens
tgtagcaggggaattccctccc

SEQ ID NO: 2243934 - DNA, 19 bp, Homo sapiens
tgtagccccctggcctctg

SEQ ID NO: 2243935 - DNA, 23 bp, Homo sapiens
tgtagcctcaatcgagtgagaca

SEQ ID NO: 2243936 - DNA, 15 bp, Homo sapiens
tgtaggagctgcctt

SEQ ID NO: 2243937 - DNA, 22 bp, Homo sapiens
tgtaggagctgccttggctcag

SEQ ID NO: 2243938 - DNA, 21 bp, Homo sapiens
tgtagtcctcataaaaagcaa

SEQ ID NO: 2243939 - DNA, 22 bp, Homo sapiens
tgtataaaatacatagtgaaaa

SEQ ID NO: 2243940 - DNA, 20 bp, Homo sapiens
tgtataagtggaggcacttt

SEQ ID NO: 2243941 - DNA, 23 bp, Homo sapiens
tgtataagtggaggcactttagg

SEQ ID NO: 2243942 - DNA, 13 bp, Homo sapiens
tgtataatataaa

SEQ ID NO: 2243943 - DNA, 16 bp, Homo sapiens
tgtatataaaaatggc

SEQ ID NO: 2243944 - DNA, 14 bp, Homo sapiens
tgtatattacaatg

SEQ ID NO: 2243945 - DNA, 19 bp, Homo sapiens
tgtatattacaatgatcac

SEQ ID NO: 2243946 - DNA, 13 bp, Homo sapiens
tgtatatttacat

SEQ ID NO: 2243947 - DNA, 23 bp, Homo sapiens
tgtatatttgtgatagcactttc

SEQ ID NO: 2243948 - DNA, 14 bp, Homo sapiens
tgtatattttgtta

SEQ ID NO: 2243949 - DNA, 21 bp, Homo sapiens
tgtatcaaatacatttaaaac

SEQ ID NO: 2243950 - DNA, 15 bp, Homo sapiens
tgtatccaggcctgg

SEQ ID NO: 2243951 - DNA, 12 bp, Homo sapiens
tgtatctaagaa

SEQ ID NO: 2243952 - DNA, 14 bp, Homo sapiens
tgtatgttgtacaa

SEQ ID NO: 2243953 - DNA, 14 bp, Homo sapiens
tgtattatcactgt

SEQ ID NO: 2243954 - DNA, 21 bp, Homo sapiens
tgtattgtatattacaatgat

SEQ ID NO: 2243955 - DNA, 19 bp, Homo sapiens
tgtatttttcaataaagca

SEQ ID NO: 2243956 - DNA, 16 bp, Homo sapiens
tgtcacagtaaaaata

SEQ ID NO: 2243957 - DNA, 17 bp, Homo sapiens
tgtcacagtaaaaataa

SEQ ID NO: 2243958 - DNA, 20 bp, Homo sapiens
tgtcacatttagctgtgctc

SEQ ID NO: 2243959 - DNA, 14 bp, Homo sapiens
tgtcaccagctatc

SEQ ID NO: 2243960 - DNA, 19 bp, Homo sapiens
tgtcaccagctatctgtca

SEQ ID NO: 2243961 - DNA, 23 bp, Homo sapiens
tgtcactcattgctgagcctctg

SEQ ID NO: 2243962 - DNA, 18 bp, Homo sapiens
tgtcacttttccttttct

SEQ ID NO: 2243963 - DNA, 12 bp, Homo sapiens
tgtcagaagtgc

SEQ ID NO: 2243964 - DNA, 17 bp, Homo sapiens
tgtcagaagtgcagaat

SEQ ID NO: 2243965 - DNA, 18 bp, Homo sapiens
tgtcagccagccgccctg

SEQ ID NO: 2243966 - DNA, 21 bp, Homo sapiens
tgtcatagtcttgaaatgaaa

SEQ ID NO: 2243967 - DNA, 14 bp, Homo sapiens
tgtcatcctcacag

SEQ ID NO: 2243968 - DNA, 16 bp, Homo sapiens
tgtcatctctctgggg

SEQ ID NO: 2243969 - DNA, 23 bp, Homo sapiens
tgtcatctctctggggccctggg

SEQ ID NO: 2243970 - DNA, 14 bp, Homo sapiens
tgtcattggaagcc

SEQ ID NO: 2243971 - DNA, 21 bp, Homo sapiens
tgtccaaagaggctgcccctc

SEQ ID NO: 2243972 - DNA, 22 bp, Homo sapiens
tgtccagccacccccaggcatc

SEQ ID NO: 2243973 - DNA, 17 bp, Homo sapiens
tgtcccacccccacccc

SEQ ID NO: 2243974 - DNA, 22 bp, Homo sapiens
tgtcccacccccacccccagct

SEQ ID NO: 2243975 - DNA, 18 bp, Homo sapiens
tgtccccaaacaggacag

SEQ ID NO: 2243976 - DNA, 18 bp, Homo sapiens
tgtcccctcactctgtca

SEQ ID NO: 2243977 - DNA, 23 bp, Homo sapiens
tgtcccctcactctgtcagccag

SEQ ID NO: 2243978 - DNA, 20 bp, Homo sapiens
tgtccgctgggtggtaccct

SEQ ID NO: 2243979 - DNA, 15 bp, Homo sapiens
tgtcctaaggcccat

SEQ ID NO: 2243980 - DNA, 19 bp, Homo sapiens
tgtcctagaagttctttga

SEQ ID NO: 2243981 - DNA, 16 bp, Homo sapiens
tgtcctctcgagccca

SEQ ID NO: 2243982 - DNA, 20 bp, Homo sapiens
tgtcctctcgagcccagatg

SEQ ID NO: 2243983 - DNA, 12 bp, Homo sapiens
tgtccttagaac

SEQ ID NO: 2243984 - DNA, 23 bp, Homo sapiens
tgtcctttcccttcagtaccctc

SEQ ID NO: 2243985 - DNA, 15 bp, Homo sapiens
tgtcgccccaggccc

SEQ ID NO: 2243986 - DNA, 17 bp, Homo sapiens
tgtcgccccaggccctc

SEQ ID NO: 2243987 - DNA, 17 bp, Homo sapiens
tgtcgttaaaaacagat

SEQ ID NO: 2243988 - DNA, 20 bp, Homo sapiens
tgtctaaacaatgctgattt

SEQ ID NO: 2243989 - DNA, 20 bp, Homo sapiens
tgtctcaaccagatttattt

SEQ ID NO: 2243990 - DNA, 22 bp, Homo sapiens
tgtctcctatatatttctatta

SEQ ID NO: 2243991 - DNA, 15 bp, Homo sapiens
tgtctgagtgaacct

SEQ ID NO: 2243992 - DNA, 21 bp, Homo sapiens
tgtctgtcaccagctatctgt

SEQ ID NO: 2243993 - DNA, 14 bp, Homo sapiens
tgtcttaattatta

SEQ ID NO: 2243994 - DNA, 18 bp, Homo sapiens
tgtcttaattttctttca

SEQ ID NO: 2243995 - DNA, 15 bp, Homo sapiens
tgtctttctaagaaa

SEQ ID NO: 2243996 - DNA, 17 bp, Homo sapiens
tgtctttctaagaaatc

SEQ ID NO: 2243997 - DNA, 16 bp, Homo sapiens
tgtcttttaaaatgca

SEQ ID NO: 2243998 - DNA, 15 bp, Homo sapiens
tgtctttttgttgta

SEQ ID NO: 2243999 - DNA, 23 bp, Homo sapiens
tgtgaaggattatggaaaaataa

SEQ ID NO: 2244000 - DNA, 21 bp, Homo sapiens
tgtgacaattctgtttttaat

SEQ ID NO: 2244001 - DNA, 18 bp, Homo sapiens
tgtgacaggaaagccctc

SEQ ID NO: 2244002 - DNA, 23 bp, Homo sapiens
tgtgacaggaaagccctccccct

SEQ ID NO: 2244003 - DNA, 22 bp, Homo sapiens
tgtgagtgtgtttgtgtgcatg

SEQ ID NO: 2244004 - DNA, 17 bp, Homo sapiens
tgtgatagcactttcta

SEQ ID NO: 2244005 - DNA, 19 bp, Homo sapiens
tgtgcccccctcctccccg

SEQ ID NO: 2244006 - DNA, 15 bp, Homo sapiens
tgtgccttatgttga

SEQ ID NO: 2244007 - DNA, 15 bp, Homo sapiens
tgtgctgacttttta

SEQ ID NO: 2244008 - DNA, 16 bp, Homo sapiens
tgtgctgtgggcagca

SEQ ID NO: 2244009 - DNA, 17 bp, Homo sapiens
tgtgctgtgggcagcac

SEQ ID NO: 2244010 - DNA, 22 bp, Homo sapiens
tgtgctgtgggcagcaccctcc

SEQ ID NO: 2244011 - DNA, 15 bp, Homo sapiens
tgtggccaatggaac

SEQ ID NO: 2244012 - DNA, 11 bp, Homo sapiens
tgtggcctcag

SEQ ID NO: 2244013 - DNA, 13 bp, Homo sapiens
tgtggcctcagcc

SEQ ID NO: 2244014 - DNA, 15 bp, Homo sapiens
tgtggcctcagccct

SEQ ID NO: 2244015 - DNA, 13 bp, Homo sapiens
tgtgggcagcacc

SEQ ID NO: 2244016 - DNA, 17 bp, Homo sapiens
tgtgggcagcaccctcc

SEQ ID NO: 2244017 - DNA, 19 bp, Homo sapiens
tgtgggcagcaccctcccc

SEQ ID NO: 2244018 - DNA, 14 bp, Homo sapiens
tgtgggggtggcca

SEQ ID NO: 2244019 - DNA, 16 bp, Homo sapiens
tgtgggggtggccatc

SEQ ID NO: 2244020 - DNA, 17 bp, Homo sapiens
tgtgggggtggccatcc

SEQ ID NO: 2244021 - DNA, 18 bp, Homo sapiens
tgtgggtgaaatggagat

SEQ ID NO: 2244022 - DNA, 16 bp, Homo sapiens
tgtggtcaaggctaca

SEQ ID NO: 2244023 - DNA, 17 bp, Homo sapiens
tgtggtgcagtgtgaaa

SEQ ID NO: 2244024 - DNA, 21 bp, Homo sapiens
tgtgtatcagtttccatgaaa

SEQ ID NO: 2244025 - DNA, 13 bp, Homo sapiens
tgtgtcccctcac

SEQ ID NO: 2244026 - DNA, 23 bp, Homo sapiens
ttggagtcccctcacctcctcta

SEQ ID NO: 2244027 - DNA, 19 bp, Homo sapiens
ttggcaggcccactcccca

SEQ ID NO: 2244028 - DNA, 21 bp, Homo sapiens
ttggcaggcccactccccagc

SEQ ID NO: 2244029 - DNA, 12 bp, Homo sapiens
ttggccacagac

SEQ ID NO: 2244030 - DNA, 19 bp, Homo sapiens
ttggctggtagcagcaggc

SEQ ID NO: 2244031 - DNA, 21 bp, Homo sapiens
ttggctggtagcagcaggctc

SEQ ID NO: 2244032 - DNA, 22 bp, Homo sapiens
ttgggactgctaaataaaattt

SEQ ID NO: 2244033 - DNA, 16 bp, Homo sapiens
ttggtattaataaaaa

SEQ ID NO: 2244034 - DNA, 18 bp, Homo sapiens
ttggtattaataaaaaga

SEQ ID NO: 2244035 - DNA, 17 bp, Homo sapiens
ttggtgctttttataaa

SEQ ID NO: 2244036 - DNA, 18 bp, Homo sapiens
ttgtaaaacaaaatttga

SEQ ID NO: 2244037 - DNA, 16 bp, Homo sapiens
ttgtaacccagatttt

SEQ ID NO: 2244038 - DNA, 14 bp, Homo sapiens
ttgtaataaaatgt

SEQ ID NO: 2244039 - DNA, 17 bp, Homo sapiens
ttgtaatttaatgaaaa

SEQ ID NO: 2244040 - DNA, 17 bp, Homo sapiens
ttgtacaatcaaaacac

SEQ ID NO: 2244041 - DNA, 23 bp, Homo sapiens
ttgtacaatcaaaacacactact

SEQ ID NO: 2244042 - DNA, 22 bp, Homo sapiens
ttgtacatacagaggtaactat

SEQ ID NO: 2244043 - DNA, 23 bp, Homo sapiens
ttgtacatacgatttaaggtatt

SEQ ID NO: 2244044 - DNA, 20 bp, Homo sapiens
ttgtacgttatatattgtat

SEQ ID NO: 2244045 - DNA, 13 bp, Homo sapiens
ttgtattaaactc

SEQ ID NO: 2244046 - DNA, 15 bp, Homo sapiens
ttgtattaaactctt

SEQ ID NO: 2244047 - DNA, 16 bp, Homo sapiens
ttgtcagtatggcttt

SEQ ID NO: 2244048 - DNA, 18 bp, Homo sapiens
ttgtgaaggattatggaa

SEQ ID NO: 2244049 - DNA, 17 bp, Homo sapiens
ttgtgacaggaaagccc

SEQ ID NO: 2244050 - DNA, 21 bp, Homo sapiens
ttgtgacaggaaagccctccc

SEQ ID NO: 2244051 - DNA, 22 bp, Homo sapiens
ttgtgacaggaaagccctcccc

SEQ ID NO: 2244052 - DNA, 16 bp, Homo sapiens
ttgtgctagaaatttt

SEQ ID NO: 2244053 - DNA, 18 bp, Homo sapiens
ttgtgctagaaattttca

SEQ ID NO: 2244054 - DNA, 15 bp, Homo sapiens
ttgtgctgtgggcag

SEQ ID NO: 2244055 - DNA, 13 bp, Homo sapiens
ttgttaatacaag

SEQ ID NO: 2244056 - DNA, 15 bp, Homo sapiens
ttgttacctacctta

SEQ ID NO: 2244057 - DNA, 13 bp, Homo sapiens
ttgttacttgcag

SEQ ID NO: 2244058 - DNA, 13 bp, Homo sapiens
ttgttcaattaga

SEQ ID NO: 2244059 - DNA, 15 bp, Homo sapiens
ttgttcaattagaat

SEQ ID NO: 2244060 - DNA, 11 bp, Homo sapiens
ttgttctgtat

SEQ ID NO: 2244061 - DNA, 12 bp, Homo sapiens
ttgttctgtatt

SEQ ID NO: 2244062 - DNA, 16 bp, Homo sapiens
ttgttggggctttaca

SEQ ID NO: 2244063 - DNA, 21 bp, Homo sapiens
ttgttggtcgcagctacataa

SEQ ID NO: 2244064 - DNA, 21 bp, Homo sapiens
ttgttgtaaaacaaaatttga

SEQ ID NO: 2244065 - DNA, 12 bp, Homo sapiens
ttgttgtctcca

SEQ ID NO: 2244066 - DNA, 19 bp, Homo sapiens
ttgttgtctccacttgtat

SEQ ID NO: 2244067 - DNA, 19 bp, Homo sapiens
ttgttgttttaacctcccc

SEQ ID NO: 2244068 - DNA, 16 bp, Homo sapiens
ttgtttctttctctga

SEQ ID NO: 2244069 - DNA, 17 bp, Homo sapiens
ttgtttgattcagcaaa

SEQ ID NO: 2244070 - DNA, 12 bp, Homo sapiens
ttgttttacaat

SEQ ID NO: 2244071 - DNA, 16 bp, Homo sapiens
tttaaaaaatggtcac

SEQ ID NO: 2244072 - DNA, 13 bp, Homo sapiens
tttaaaaagcaaa

SEQ ID NO: 2244073 - DNA, 14 bp, Homo sapiens
tttaaaaatatttt

SEQ ID NO: 2244074 - DNA, 19 bp, Homo sapiens
tttaaaaatggtatcaaaa

SEQ ID NO: 2244075 - DNA, 13 bp, Homo sapiens
tttaaaagtaaaa

SEQ ID NO: 2244076 - DNA, 16 bp, Homo sapiens
tttaaaatatttatct

SEQ ID NO: 2244077 - DNA, 18 bp, Homo sapiens
tttaaaccttttattata

SEQ ID NO: 2244078 - DNA, 15 bp, Homo sapiens
tttaaagtattttct

SEQ ID NO: 2244079 - DNA, 16 bp, Homo sapiens
tttaaataaaagcaca

SEQ ID NO: 2244080 - DNA, 15 bp, Homo sapiens
tttaaattagaaaat

SEQ ID NO: 2244081 - DNA, 13 bp, Homo sapiens
tttaacctcccct

SEQ ID NO: 2244082 - DNA, 15 bp, Homo sapiens
tttaactttgaaagt

SEQ ID NO: 2244083 - DNA, 18 bp, Homo sapiens
tttaactttttatttcta

SEQ ID NO: 2244084 - DNA, 16 bp, Homo sapiens
tttaagacgtgaatgt

SEQ ID NO: 2244085 - DNA, 14 bp, Homo sapiens
tttaagatgtgaaa

SEQ ID NO: 2244086 - DNA, 20 bp, Homo sapiens
tttaagtttgttgctgtcaa

SEQ ID NO: 2244087 - DNA, 18 bp, Homo sapiens
tttaatggggtctgtaaa

SEQ ID NO: 2244088 - DNA, 17 bp, Homo sapiens
tttacaatagttctgtg

SEQ ID NO: 2244089 - DNA, 17 bp, Homo sapiens
tttacatacttttgcaa

SEQ ID NO: 2244090 - DNA, 11 bp, Homo sapiens
tttaccaaagc

SEQ ID NO: 2244091 - DNA, 14 bp, Homo sapiens
tttaccaaagcatc

SEQ ID NO: 2244092 - DNA, 13 bp, Homo sapiens
tttactcacagca

SEQ ID NO: 2244093 - DNA, 19 bp, Homo sapiens
tttagaaatactgcaagaa

SEQ ID NO: 2244094 - DNA, 20 bp, Homo sapiens
tttagaaatactgcaagaaa

SEQ ID NO: 2244095 - DNA, 13 bp, Homo sapiens
tttagaaccagcc

SEQ ID NO: 2244096 - DNA, 18 bp, Homo sapiens
tttagaatcttttaaata

SEQ ID NO: 2244097 - DNA, 19 bp, Homo sapiens
tttagaatcttttaaatac

SEQ ID NO: 2244098 - DNA, 17 bp, Homo sapiens
tttagatgtaattttgt

SEQ ID NO: 2244099 - DNA, 22 bp, Homo sapiens
tttagcagcagcctttaatgca

SEQ ID NO: 2244100 - DNA, 15 bp, Homo sapiens
tttagtaatttcttt

SEQ ID NO: 2244101 - DNA, 17 bp, Homo sapiens
tttagtcaatcactgca

SEQ ID NO: 2244102 - DNA, 13 bp, Homo sapiens
tttataaaacttc

SEQ ID NO: 2244103 - DNA, 14 bp, Homo sapiens
tttataaaacttct

SEQ ID NO: 2244104 - DNA, 15 bp, Homo sapiens
tttatacaaattaga

SEQ ID NO: 2244105 - DNA, 19 bp, Homo sapiens
tttatcaatgtgtctttct

SEQ ID NO: 2244106 - DNA, 19 bp, Homo sapiens
tttatcagggaaactaaga

SEQ ID NO: 2244107 - DNA, 12 bp, Homo sapiens
tttatctatata

SEQ ID NO: 2244108 - DNA, 15 bp, Homo sapiens
tttatctatataaaa

SEQ ID NO: 2244109 - DNA, 16 bp, Homo sapiens
tttatctcagatgtta

SEQ ID NO: 2244110 - DNA, 14 bp, Homo sapiens
tttatctgtttcct

SEQ ID NO: 2244111 - DNA, 23 bp, Homo sapiens
tttatgtttgcacttgtgattat

SEQ ID NO: 2244112 - DNA, 17 bp, Homo sapiens
tttattaatgcactttc

SEQ ID NO: 2244113 - DNA, 14 bp, Homo sapiens
tttattacataatt

SEQ ID NO: 2244114 - DNA, 12 bp, Homo sapiens
tttattaccccc

SEQ ID NO: 2244115 - DNA, 23 bp, Homo sapiens
tttattaccccctccttcagaca

SEQ ID NO: 2244116 - DNA, 23 bp, Homo sapiens
tttattgccttttaatttttaat

SEQ ID NO: 2244117 - DNA, 20 bp, Homo sapiens
tttatttcctgtatgttgta

SEQ ID NO: 2244118 - DNA, 15 bp, Homo sapiens
tttatttctaaatga

SEQ ID NO: 2244119 - DNA, 20 bp, Homo sapiens
tttatttgaacaatgaagtt

SEQ ID NO: 2244120 - DNA, 22 bp, Homo sapiens
tttcaaacaatcaagttgactc

SEQ ID NO: 2244121 - DNA, 21 bp, Homo sapiens
tttcaagagtctaatagtctt

SEQ ID NO: 2244122 - DNA, 19 bp, Homo sapiens
tttcaatgtgtataaattg

SEQ ID NO: 2244123 - DNA, 17 bp, Homo sapiens
tttcagcttctctgcta

SEQ ID NO: 2244124 - DNA, 17 bp, Homo sapiens
tttcataaacaagttcg

SEQ ID NO: 2244125 - DNA, 12 bp, Homo sapiens
tttcatctcatt

SEQ ID NO: 2244126 - DNA, 21 bp, Homo sapiens
tttcatctcatttaagggaaa

SEQ ID NO: 2244127 - DNA, 23 bp, Homo sapiens
tttcattcagctaacaaactaga

SEQ ID NO: 2244128 - DNA, 16 bp, Homo sapiens
tttccactccattgtc

SEQ ID NO: 2244129 - DNA, 23 bp, Homo sapiens
tttccactttcatctggggtggg

SEQ ID NO: 2244130 - DNA, 18 bp, Homo sapiens
tttccagacttccttgag

SEQ ID NO: 2244131 - DNA, 15 bp, Homo sapiens
tttccatctctggta

SEQ ID NO: 2244132 - DNA, 18 bp, Homo sapiens
tttcccccctccttctgc

SEQ ID NO: 2244133 - DNA, 22 bp, Homo sapiens
tttccgctgtcgccccaggccc

SEQ ID NO: 2244134 - DNA, 12 bp, Homo sapiens
tttcctgcaggc

SEQ ID NO: 2244135 - DNA, 21 bp, Homo sapiens
agcgcctccctccaccccagg

SEQ ID NO: 2244136 - DNA, 19 bp, Homo sapiens
agcggagagagccaagacg

SEQ ID NO: 2244137 - DNA, 15 bp, Homo sapiens
agctaactgtaaatc

SEQ ID NO: 2244138 - DNA, 14 bp, Homo sapiens
agctaagaaaagat

SEQ ID NO: 2244139 - DNA, 19 bp, Homo sapiens
agctaaggtttagataaat

SEQ ID NO: 2244140 - DNA, 14 bp, Homo sapiens
agctacataagact

SEQ ID NO: 2244141 - DNA, 21 bp, Homo sapiens
agctaccctttttctccagct

SEQ ID NO: 2244142 - DNA, 18 bp, Homo sapiens
agctactggattcttatt

SEQ ID NO: 2244143 - DNA, 18 bp, Homo sapiens
agctatctgtcatctctc

SEQ ID NO: 2244144 - DNA, 18 bp, Homo sapiens
agctatgcgcaatgtggc

SEQ ID NO: 2244145 - DNA, 18 bp, Homo sapiens
agctcataaaatggaagc

SEQ ID NO: 2244146 - DNA, 17 bp, Homo sapiens
agctctactgcctcaac

SEQ ID NO: 2244147 - DNA, 21 bp, Homo sapiens
agctgaacaataggctgttcc

SEQ ID NO: 2244148 - DNA, 22 bp, Homo sapiens
agctgaacaataggctgttccc

SEQ ID NO: 2244149 - DNA, 19 bp, Homo sapiens
agctgagactacaagtgtg

SEQ ID NO: 2244150 - DNA, 20 bp, Homo sapiens
agctgcgggctccctggcag

SEQ ID NO: 2244151 - DNA, 22 bp, Homo sapiens
agctgcgggctccctggcagga

SEQ ID NO: 2244152 - DNA, 14 bp, Homo sapiens
agctggctctgtga

SEQ ID NO: 2244153 - DNA, 21 bp, Homo sapiens
agctggctctgtgagggtgct

SEQ ID NO: 2244154 - DNA, 14 bp, Homo sapiens
agctggggacctgg

SEQ ID NO: 2244155 - DNA, 15 bp, Homo sapiens
agctggtggcagagt

SEQ ID NO: 2244156 - DNA, 16 bp, Homo sapiens
agctgttcctgttcag

SEQ ID NO: 2244157 - DNA, 19 bp, Homo sapiens
agctgttcctgttcagtaa

SEQ ID NO: 2244158 - DNA, 12 bp, Homo sapiens
agcttaaaaaaa

SEQ ID NO: 2244159 - DNA, 15 bp, Homo sapiens
agcttctctgctaga

SEQ ID NO: 2244160 - DNA, 21 bp, Homo sapiens
agcttctctgctagatttcta

SEQ ID NO: 2244161 - DNA, 16 bp, Homo sapiens
agcttggagggatgga

SEQ ID NO: 2244162 - DNA, 22 bp, Homo sapiens
agcttgtcttttctgctgagga

SEQ ID NO: 2244163 - DNA, 13 bp, Homo sapiens
agctttatttcta

SEQ ID NO: 2244164 - DNA, 12 bp, Homo sapiens
agctttttaatt

SEQ ID NO: 2244165 - DNA, 16 bp, Homo sapiens
aggaaaagtgcaatgc

SEQ ID NO: 2244166 - DNA, 17 bp, Homo sapiens
aggaaaagtgcaatgcg

SEQ ID NO: 2244167 - DNA, 14 bp, Homo sapiens
aggaaagccctccc

SEQ ID NO: 2244168 - DNA, 17 bp, Homo sapiens
aggaaagccctccccct

SEQ ID NO: 2244169 - DNA, 15 bp, Homo sapiens
aggaaaggattttac

SEQ ID NO: 2244170 - DNA, 22 bp, Homo sapiens
aggaaaggattttaccaaagca

SEQ ID NO: 2244171 - DNA, 22 bp, Homo sapiens
aggaaattctttcccagtctgt

SEQ ID NO: 2244172 - DNA, 13 bp, Homo sapiens
aggaacaaacagg

SEQ ID NO: 2244173 - DNA, 14 bp, Homo sapiens
aggaacaaacaggg

SEQ ID NO: 2244174 - DNA, 17 bp, Homo sapiens
aggaacaatcggctgca

SEQ ID NO: 2244175 - DNA, 13 bp, Homo sapiens
aggaactctggac

SEQ ID NO: 2244176 - DNA, 16 bp, Homo sapiens
aggaagaacgtttttt

SEQ ID NO: 2244177 - DNA, 19 bp, Homo sapiens
aggaagcctgcagtcctgg

SEQ ID NO: 2244178 - DNA, 19 bp, Homo sapiens
aggaataaggcccagagcg

SEQ ID NO: 2244179 - DNA, 14 bp, Homo sapiens
aggaatgaacttgt

SEQ ID NO: 2244180 - DNA, 16 bp, Homo sapiens
aggaatgtgtggcctg

SEQ ID NO: 2244181 - DNA, 21 bp, Homo sapiens
aggaattaccaagaatatcct

SEQ ID NO: 2244182 - DNA, 18 bp, Homo sapiens
aggaattgaattaataat

SEQ ID NO: 2244183 - DNA, 20 bp, Homo sapiens
aggaattgaattaataataa

SEQ ID NO: 2244184 - DNA, 19 bp, Homo sapiens
aggacctggcgtgctcaga

SEQ ID NO: 2244185 - DNA, 23 bp, Homo sapiens
aggacctggcgtgctcagaccca

SEQ ID NO: 2244186 - DNA, 14 bp, Homo sapiens
aggacgagaccccc

SEQ ID NO: 2244187 - DNA, 18 bp, Homo sapiens
aggacgagacccccatcc

SEQ ID NO: 2244188 - DNA, 22 bp, Homo sapiens
aggacgagacccccatccagcc

SEQ ID NO: 2244189 - DNA, 12 bp, Homo sapiens
aggacgccactc

SEQ ID NO: 2244190 - DNA, 16 bp, Homo sapiens
aggacgccactcattt

SEQ ID NO: 2244191 - DNA, 13 bp, Homo sapiens
aggactagatact

SEQ ID NO: 2244192 - DNA, 13 bp, Homo sapiens
aggactgttcttt

SEQ ID NO: 2244193 - DNA, 22 bp, Homo sapiens
aggactgttctttgctgttgtt

SEQ ID NO: 2244194 - DNA, 15 bp, Homo sapiens
aggacttccatctgt

SEQ ID NO: 2244195 - DNA, 14 bp, Homo sapiens
aggagccccagcta

SEQ ID NO: 2244196 - DNA, 14 bp, Homo sapiens
aggagcctcactgg

SEQ ID NO: 2244197 - DNA, 22 bp, Homo sapiens
aggagcctcactggggcagaca

SEQ ID NO: 2244198 - DNA, 12 bp, Homo sapiens
aggagggccagc

SEQ ID NO: 2244199 - DNA, 16 bp, Homo sapiens
aggaggggaaggggct

SEQ ID NO: 2244200 - DNA, 19 bp, Homo sapiens
aggaggggaaggggctgag

SEQ ID NO: 2244201 - DNA, 23 bp, Homo sapiens
aggaggtccttaggcctctgaga

SEQ ID NO: 2244202 - DNA, 15 bp, Homo sapiens
aggatacagaggaga

SEQ ID NO: 2244203 - DNA, 17 bp, Homo sapiens
aggatatcggcatttgt

SEQ ID NO: 2244204 - DNA, 14 bp, Homo sapiens
aggatccccctctt

SEQ ID NO: 2244205 - DNA, 16 bp, Homo sapiens
aggatccccctctttg

SEQ ID NO: 2244206 - DNA, 12 bp, Homo sapiens
aggattatggaa

SEQ ID NO: 2244207 - DNA, 14 bp, Homo sapiens
aggattttaccaaa

SEQ ID NO: 2244208 - DNA, 16 bp, Homo sapiens
aggattttaccaaagc

SEQ ID NO: 2244209 - DNA, 17 bp, Homo sapiens
aggattttaccaaagca

SEQ ID NO: 2244210 - DNA, 23 bp, Homo sapiens
aggcacacagcagccccccagca

SEQ ID NO: 2244211 - DNA, 17 bp, Homo sapiens
aggcactgaagtgctta

SEQ ID NO: 2244212 - DNA, 20 bp, Homo sapiens
aggcactttagggctgtaaa

SEQ ID NO: 2244213 - DNA, 15 bp, Homo sapiens
aggcagcccagccct

SEQ ID NO: 2244214 - DNA, 12 bp, Homo sapiens
aggcatatttta

SEQ ID NO: 2244215 - DNA, 15 bp, Homo sapiens
aggccacatacctct

SEQ ID NO: 2244216 - DNA, 17 bp, Homo sapiens
aggccaggaccaagggc

SEQ ID NO: 2244217 - DNA, 22 bp, Homo sapiens
aggccaggaccaagggcagagg

SEQ ID NO: 2244218 - DNA, 12 bp, Homo sapiens
aggcccactccc

SEQ ID NO: 2244219 - DNA, 15 bp, Homo sapiens
aggcccactccccag

SEQ ID NO: 2244220 - DNA, 21 bp, Homo sapiens
aggcccactccccagccccag

SEQ ID NO: 2244221 - DNA, 19 bp, Homo sapiens
aggcccatttgagaagctg

SEQ ID NO: 2244222 - DNA, 14 bp, Homo sapiens
aggccccagagaga

SEQ ID NO: 2244223 - DNA, 19 bp, Homo sapiens
aggccccagagagaccctg

SEQ ID NO: 2244224 - DNA, 22 bp, Homo sapiens
aggccccagagagaccctgcaa

SEQ ID NO: 2244225 - DNA, 12 bp, Homo sapiens
aggcccctgcaa

SEQ ID NO: 2244226 - DNA, 22 bp, Homo sapiens
aggccctccctgactccctgtg

SEQ ID NO: 2244227 - DNA, 14 bp, Homo sapiens
aggccgtgtctctg

SEQ ID NO: 2244228 - DNA, 16 bp, Homo sapiens
aggcctagactctgtc

SEQ ID NO: 2244229 - DNA, 16 bp, Homo sapiens
aggctatgtataaaat

SEQ ID NO: 2244230 - DNA, 19 bp, Homo sapiens
aggctatgtataaaataca

SEQ ID NO: 2244231 - DNA, 20 bp, Homo sapiens
aggctatgtataaaatacat

SEQ ID NO: 2244232 - DNA, 12 bp, Homo sapiens
aggctgcccctc

SEQ ID NO: 2244233 - DNA, 17 bp, Homo sapiens
aggctgcccctctcacc

SEQ ID NO: 2244234 - DNA, 21 bp, Homo sapiens
aggctggcctatgtggtctaa

SEQ ID NO: 2244235 - DNA, 18 bp, Homo sapiens
aggctgggccatgtccaa

SEQ ID NO: 2244236 - DNA, 15 bp, Homo sapiens
aggctgggcccctgg

SEQ ID NO: 2244237 - DNA, 22 bp, Homo sapiens
agggaaactaagattcttttaa

SEQ ID NO: 2244238 - DNA, 18 bp, Homo sapiens
agggacatgccctgtgtg

SEQ ID NO: 2244239 - DNA, 20 bp, Homo sapiens
agggacatgccctgtgtggc

SEQ ID NO: 2244240 - DNA, 23 bp, Homo sapiens
agggaccactgggtgagagagga

SEQ ID NO: 2244241 - DNA, 15 bp, Homo sapiens
agggaggtagtttca

SEQ ID NO: 2244242 - DNA, 20 bp, Homo sapiens
agggatgggggatgggccag

SEQ ID NO: 2244243 - DNA, 18 bp, Homo sapiens
agggcaacagatcagtaa

SEQ ID NO: 2244244 - DNA, 15 bp, Homo sapiens
atttctacctcagca

SEQ ID NO: 2244245 - DNA, 18 bp, Homo sapiens
atttctcgggtgcatttg

SEQ ID NO: 2244246 - DNA, 19 bp, Homo sapiens
atttcttaattattataaa

SEQ ID NO: 2244247 - DNA, 23 bp, Homo sapiens
atttcttaattattataaaaata

SEQ ID NO: 2244248 - DNA, 16 bp, Homo sapiens
atttctttttttcctt

SEQ ID NO: 2244249 - DNA, 12 bp, Homo sapiens
atttgactaatt

SEQ ID NO: 2244250 - DNA, 17 bp, Homo sapiens
atttgactaattttaca

SEQ ID NO: 2244251 - DNA, 16 bp, Homo sapiens
atttgaggagtgttaa

SEQ ID NO: 2244252 - DNA, 20 bp, Homo sapiens
atttgaggagtgttaagatt

SEQ ID NO: 2244253 - DNA, 19 bp, Homo sapiens
atttgcagaagctgtgagt

SEQ ID NO: 2244254 - DNA, 20 bp, Homo sapiens
atttgcatatttatttcaga

SEQ ID NO: 2244255 - DNA, 21 bp, Homo sapiens
atttgcatatttatttcagat

SEQ ID NO: 2244256 - DNA, 13 bp, Homo sapiens
atttgctttggaa

SEQ ID NO: 2244257 - DNA, 12 bp, Homo sapiens
atttgggcagat

SEQ ID NO: 2244258 - DNA, 23 bp, Homo sapiens
atttgtctttttgttgtaaaaca

SEQ ID NO: 2244259 - DNA, 20 bp, Homo sapiens
atttgtgctagaaattttca

SEQ ID NO: 2244260 - DNA, 13 bp, Homo sapiens
atttgtgttttaa

SEQ ID NO: 2244261 - DNA, 21 bp, Homo sapiens
atttgtgttttaatttaaaca

SEQ ID NO: 2244262 - DNA, 11 bp, Homo sapiens
atttgttgcat

SEQ ID NO: 2244263 - DNA, 16 bp, Homo sapiens
attttaaaaaatggtc

SEQ ID NO: 2244264 - DNA, 23 bp, Homo sapiens
attttaaaaagtccataccttat

SEQ ID NO: 2244265 - DNA, 20 bp, Homo sapiens
attttaaaagcaattatatt

SEQ ID NO: 2244266 - DNA, 21 bp, Homo sapiens
attttaaacgcttcttatgta

SEQ ID NO: 2244267 - DNA, 17 bp, Homo sapiens
attttaagacgtgaatg

SEQ ID NO: 2244268 - DNA, 18 bp, Homo sapiens
attttaagtgatgtcatt

SEQ ID NO: 2244269 - DNA, 20 bp, Homo sapiens
attttaatagggaatatatc

SEQ ID NO: 2244270 - DNA, 20 bp, Homo sapiens
attttaatattaacttttaa

SEQ ID NO: 2244271 - DNA, 18 bp, Homo sapiens
attttaatcaagttgaat

SEQ ID NO: 2244272 - DNA, 12 bp, Homo sapiens
attttaattcat

SEQ ID NO: 2244273 - DNA, 14 bp, Homo sapiens
attttacacaaatg

SEQ ID NO: 2244274 - DNA, 21 bp, Homo sapiens
attttacacaaatgtgatttt

SEQ ID NO: 2244275 - DNA, 14 bp, Homo sapiens
attttaccaaagca

SEQ ID NO: 2244276 - DNA, 17 bp, Homo sapiens
attttaccaaagcatca

SEQ ID NO: 2244277 - DNA, 19 bp, Homo sapiens
attttataggactgttctt

SEQ ID NO: 2244278 - DNA, 20 bp, Homo sapiens
attttataggactgttcttt

SEQ ID NO: 2244279 - DNA, 22 bp, Homo sapiens
attttataggcatacctcctat

SEQ ID NO: 2244280 - DNA, 15 bp, Homo sapiens
attttcacattcttg

SEQ ID NO: 2244281 - DNA, 12 bp, Homo sapiens
attttcagcatt

SEQ ID NO: 2244282 - DNA, 20 bp, Homo sapiens
attttcagcattaagctgtt

SEQ ID NO: 2244283 - DNA, 20 bp, Homo sapiens
attttcaggaaatctacttc

SEQ ID NO: 2244284 - DNA, 20 bp, Homo sapiens
attttcagtcaaaactttaa

SEQ ID NO: 2244285 - DNA, 21 bp, Homo sapiens
attttcctcaatcacactaca

SEQ ID NO: 2244286 - DNA, 16 bp, Homo sapiens
attttctattttaaga

SEQ ID NO: 2244287 - DNA, 14 bp, Homo sapiens
attttctctgtact

SEQ ID NO: 2244288 - DNA, 17 bp, Homo sapiens
attttctctgtactttt

SEQ ID NO: 2244289 - DNA, 18 bp, Homo sapiens
attttcttctctgtgaga

SEQ ID NO: 2244290 - DNA, 12 bp, Homo sapiens
attttctttaat

SEQ ID NO: 2244291 - DNA, 18 bp, Homo sapiens
attttctttaatgctttt

SEQ ID NO: 2244292 - DNA, 17 bp, Homo sapiens
attttgaatcaataata

SEQ ID NO: 2244293 - DNA, 18 bp, Homo sapiens
attttgaatcaataatat

SEQ ID NO: 2244294 - DNA, 12 bp, Homo sapiens
attttgctgtat

SEQ ID NO: 2244295 - DNA, 14 bp, Homo sapiens
attttgctgtatat

SEQ ID NO: 2244296 - DNA, 21 bp, Homo sapiens
attttggagattataataaat

SEQ ID NO: 2244297 - DNA, 16 bp, Homo sapiens
attttggtgagaaatg

SEQ ID NO: 2244298 - DNA, 22 bp, Homo sapiens
attttgtaataataaagaatag

SEQ ID NO: 2244299 - DNA, 20 bp, Homo sapiens
attttgtaatgtatcaaata

SEQ ID NO: 2244300 - DNA, 23 bp, Homo sapiens
atttttaactttttatttctaaa

SEQ ID NO: 2244301 - DNA, 21 bp, Homo sapiens
atttttagaattaaaaaagca

SEQ ID NO: 2244302 - DNA, 19 bp, Homo sapiens
atttttatctatataaaat

SEQ ID NO: 2244303 - DNA, 16 bp, Homo sapiens
atttttcaataaagca

SEQ ID NO: 2244304 - DNA, 17 bp, Homo sapiens
atttttcaataaagcat

SEQ ID NO: 2244305 - DNA, 21 bp, Homo sapiens
atttttcaataaagcatttat

SEQ ID NO: 2244306 - DNA, 15 bp, Homo sapiens
atttttcataaacaa

SEQ ID NO: 2244307 - DNA, 18 bp, Homo sapiens
atttttgcttttagaaaa

SEQ ID NO: 2244308 - DNA, 18 bp, Homo sapiens
atttttttaaaatgttaa

SEQ ID NO: 2244309 - DNA, 22 bp, Homo sapiens
attttttttttaaataaaagca

SEQ ID NO: 2244310 - DNA, 15 bp, Homo sapiens
caaaaaagaaaagta

SEQ ID NO: 2244311 - DNA, 23 bp, Homo sapiens
caaaaactttggagtcccctcac

SEQ ID NO: 2244312 - DNA, 20 bp, Homo sapiens
caaaaatctcccagtgacaa

SEQ ID NO: 2244313 - DNA, 16 bp, Homo sapiens
caaaaattaggtattt

SEQ ID NO: 2244314 - DNA, 18 bp, Homo sapiens
caaaaattaggtattttg

SEQ ID NO: 2244315 - DNA, 17 bp, Homo sapiens
caaaacaaaaattaggt

SEQ ID NO: 2244316 - DNA, 19 bp, Homo sapiens
caaaacacactactacctc

SEQ ID NO: 2244317 - DNA, 12 bp, Homo sapiens
caaaacatttct

SEQ ID NO: 2244318 - DNA, 14 bp, Homo sapiens
caaaaccatctctc

SEQ ID NO: 2244319 - DNA, 17 bp, Homo sapiens
caaaactatttttgtaa

SEQ ID NO: 2244320 - DNA, 15 bp, Homo sapiens
caaaaggaatgaact

SEQ ID NO: 2244321 - DNA, 18 bp, Homo sapiens
caaaagtttgtttgctta

SEQ ID NO: 2244322 - DNA, 18 bp, Homo sapiens
caaaatatacaaaacttt

SEQ ID NO: 2244323 - DNA, 13 bp, Homo sapiens
caaaattatttgt

SEQ ID NO: 2244324 - DNA, 19 bp, Homo sapiens
caaaattcatttctaatta

SEQ ID NO: 2244325 - DNA, 14 bp, Homo sapiens
caaaatttgactaa

SEQ ID NO: 2244326 - DNA, 23 bp, Homo sapiens
caaaatttgactaattttacatg

SEQ ID NO: 2244327 - DNA, 23 bp, Homo sapiens
caaacaaaaaagaaaagtagaaa

SEQ ID NO: 2244328 - DNA, 21 bp, Homo sapiens
caaacaccttccagctcctgt

SEQ ID NO: 2244329 - DNA, 15 bp, Homo sapiens
caaacagtgactgta

SEQ ID NO: 2244330 - DNA, 20 bp, Homo sapiens
caaaccaacaggctaccaac

SEQ ID NO: 2244331 - DNA, 14 bp, Homo sapiens
caaaccaggaccct

SEQ ID NO: 2244332 - DNA, 15 bp, Homo sapiens
caaactgcactttta

SEQ ID NO: 2244333 - DNA, 21 bp, Homo sapiens
caaactttaggtttttttaat

SEQ ID NO: 2244334 - DNA, 12 bp, Homo sapiens
caaagaaatatt

SEQ ID NO: 2244335 - DNA, 20 bp, Homo sapiens
caaagaagtcggaatgtcat

SEQ ID NO: 2244336 - DNA, 13 bp, Homo sapiens
caaagacaggcaa

SEQ ID NO: 2244337 - DNA, 23 bp, Homo sapiens
caaagaggctgcccctctcacca

SEQ ID NO: 2244338 - DNA, 14 bp, Homo sapiens
caaagataaggact

SEQ ID NO: 2244339 - DNA, 15 bp, Homo sapiens
caaagattaaatgtg

SEQ ID NO: 2244340 - DNA, 21 bp, Homo sapiens
caaagcacccatttcaatgtg

SEQ ID NO: 2244341 - DNA, 19 bp, Homo sapiens
caaatacatttaaaacatt

SEQ ID NO: 2244342 - DNA, 22 bp, Homo sapiens
caaatatagagatatttttgta

SEQ ID NO: 2244343 - DNA, 14 bp, Homo sapiens
caaatattttcatg

SEQ ID NO: 2244344 - DNA, 13 bp, Homo sapiens
caaatgtgatttt

SEQ ID NO: 2244345 - DNA, 18 bp, Homo sapiens
caaatgtgctttgagaag

SEQ ID NO: 2244346 - DNA, 16 bp, Homo sapiens
caaattaataatctta

SEQ ID NO: 2244347 - DNA, 11 bp, Homo sapiens
caaattagaaa

SEQ ID NO: 2244348 - DNA, 13 bp, Homo sapiens
caaattagaaaat

SEQ ID NO: 2244349 - DNA, 21 bp, Homo sapiens
caacaagccctgcttttgcat

SEQ ID NO: 2244350 - DNA, 15 bp, Homo sapiens
caacagaagaactgt

SEQ ID NO: 2244351 - DNA, 14 bp, Homo sapiens
caacagaagggaaa

SEQ ID NO: 2244352 - DNA, 18 bp, Homo sapiens
cagttgaaaacttgtaat

SEQ ID NO: 2244353 - DNA, 16 bp, Homo sapiens
cagtttatcattcaag

SEQ ID NO: 2244354 - DNA, 19 bp, Homo sapiens
cagtttatcattcaagtgt

SEQ ID NO: 2244355 - DNA, 15 bp, Homo sapiens
cagtttgtgtgtctt

SEQ ID NO: 2244356 - DNA, 21 bp, Homo sapiens
cagtttgtgtgtcttaattat

SEQ ID NO: 2244357 - DNA, 22 bp, Homo sapiens
cagttttcaagtcaaattaata

SEQ ID NO: 2244358 - DNA, 12 bp, Homo sapiens
cagtttttcatt

SEQ ID NO: 2244359 - DNA, 17 bp, Homo sapiens
cataaggttttattcat

SEQ ID NO: 2244360 - DNA, 18 bp, Homo sapiens
cataatttagttgtttct

SEQ ID NO: 2244361 - DNA, 14 bp, Homo sapiens
cataatttgtttcc

SEQ ID NO: 2244362 - DNA, 16 bp, Homo sapiens
catacaacagaaacca

SEQ ID NO: 2244363 - DNA, 19 bp, Homo sapiens
catacacctcgtcaagagc

SEQ ID NO: 2244364 - DNA, 16 bp, Homo sapiens
catacagaggtaacta

SEQ ID NO: 2244365 - DNA, 21 bp, Homo sapiens
catacctcctatgggttgtca

SEQ ID NO: 2244366 - DNA, 12 bp, Homo sapiens
catacctctctg

SEQ ID NO: 2244367 - DNA, 13 bp, Homo sapiens
catactggcctgg

SEQ ID NO: 2244368 - DNA, 12 bp, Homo sapiens
catactttatca

SEQ ID NO: 2244369 - DNA, 17 bp, Homo sapiens
catactttatcaatgtg

SEQ ID NO: 2244370 - DNA, 22 bp, Homo sapiens
catacttttgcaaaataagtaa

SEQ ID NO: 2244371 - DNA, 23 bp, Homo sapiens
catagaaatggaaattttgctat

SEQ ID NO: 2244372 - DNA, 22 bp, Homo sapiens
catagtaccatttatacaaatt

SEQ ID NO: 2244373 - DNA, 16 bp, Homo sapiens
catagtcttgaaatga

SEQ ID NO: 2244374 - DNA, 19 bp, Homo sapiens
catagttcgtttaccttca

SEQ ID NO: 2244375 - DNA, 20 bp, Homo sapiens
catagttctgagctgccagt

SEQ ID NO: 2244376 - DNA, 15 bp, Homo sapiens
catagtttggcattt

SEQ ID NO: 2244377 - DNA, 14 bp, Homo sapiens
catatagtgtacag

SEQ ID NO: 2244378 - DNA, 17 bp, Homo sapiens
catatctttattaatca

SEQ ID NO: 2244379 - DNA, 15 bp, Homo sapiens
catatgatctgtctg

SEQ ID NO: 2244380 - DNA, 19 bp, Homo sapiens
catatgtgtaaagatttat

SEQ ID NO: 2244381 - DNA, 17 bp, Homo sapiens
catattgctgagagaaa

SEQ ID NO: 2244382 - DNA, 16 bp, Homo sapiens
catatttgaagggtct

SEQ ID NO: 2244383 - DNA, 18 bp, Homo sapiens
catattttaaacagagga

SEQ ID NO: 2244384 - DNA, 19 bp, Homo sapiens
catcaaaatatttcagtga

SEQ ID NO: 2244385 - DNA, 21 bp, Homo sapiens
catcaaaatatttcagtgaat

SEQ ID NO: 2244386 - DNA, 23 bp, Homo sapiens
catcacccgcccctggacttctt

SEQ ID NO: 2244387 - DNA, 15 bp, Homo sapiens
catcagaaagcttta

SEQ ID NO: 2244388 - DNA, 19 bp, Homo sapiens
catcagttttgtttactca

SEQ ID NO: 2244389 - DNA, 16 bp, Homo sapiens
catcataaaattttta

SEQ ID NO: 2244390 - DNA, 16 bp, Homo sapiens
catccaaccttcccaa

SEQ ID NO: 2244391 - DNA, 12 bp, Homo sapiens
catccagcctcc

SEQ ID NO: 2244392 - DNA, 18 bp, Homo sapiens
catccagcctccagggca

SEQ ID NO: 2244393 - DNA, 14 bp, Homo sapiens
catccagtttgttc

SEQ ID NO: 2244394 - DNA, 16 bp, Homo sapiens
catccagtttgttctc

SEQ ID NO: 2244395 - DNA, 14 bp, Homo sapiens
catcccgtgttctc

SEQ ID NO: 2244396 - DNA, 17 bp, Homo sapiens
catcccgtgttctcctt

SEQ ID NO: 2244397 - DNA, 12 bp, Homo sapiens
catccctgggcc

SEQ ID NO: 2244398 - DNA, 13 bp, Homo sapiens
catccctgggccc

SEQ ID NO: 2244399 - DNA, 17 bp, Homo sapiens
catccctgggcccctcc

SEQ ID NO: 2244400 - DNA, 19 bp, Homo sapiens
catccctgggcccctccac

SEQ ID NO: 2244401 - DNA, 18 bp, Homo sapiens
catccctttttttacatt

SEQ ID NO: 2244402 - DNA, 20 bp, Homo sapiens
catcgcaatagttttttact

SEQ ID NO: 2244403 - DNA, 19 bp, Homo sapiens
catcggaggctgggcccct

SEQ ID NO: 2244404 - DNA, 22 bp, Homo sapiens
catcggaggctgggcccctggg

SEQ ID NO: 2244405 - DNA, 19 bp, Homo sapiens
catctcatttaagggaaaa

SEQ ID NO: 2244406 - DNA, 14 bp, Homo sapiens
catctctctggggc

SEQ ID NO: 2244407 - DNA, 19 bp, Homo sapiens
catctctgtgaagcctctc

SEQ ID NO: 2244408 - DNA, 14 bp, Homo sapiens
catctgaaatgtta

SEQ ID NO: 2244409 - DNA, 13 bp, Homo sapiens
catctggggtggg

SEQ ID NO: 2244410 - DNA, 16 bp, Homo sapiens
catctgttagcagagt

SEQ ID NO: 2244411 - DNA, 17 bp, Homo sapiens
catcttctgccttagtc

SEQ ID NO: 2244412 - DNA, 19 bp, Homo sapiens
catctttgtatatttacat

SEQ ID NO: 2244413 - DNA, 15 bp, Homo sapiens
catcttttattcttt

SEQ ID NO: 2244414 - DNA, 21 bp, Homo sapiens
catgacggcttttgtcagtat

SEQ ID NO: 2244415 - DNA, 17 bp, Homo sapiens
catgactatgtattttt

SEQ ID NO: 2244416 - DNA, 12 bp, Homo sapiens
catgatctgtat

SEQ ID NO: 2244417 - DNA, 22 bp, Homo sapiens
catgcacatgctgtctggccct

SEQ ID NO: 2244418 - DNA, 12 bp, Homo sapiens
catgccaataaa

SEQ ID NO: 2244419 - DNA, 11 bp, Homo sapiens
catgccccctg

SEQ ID NO: 2244420 - DNA, 14 bp, Homo sapiens
catgccccctgcag

SEQ ID NO: 2244421 - DNA, 18 bp, Homo sapiens
catgctattcacaattat

SEQ ID NO: 2244422 - DNA, 14 bp, Homo sapiens
catggagccagctc

SEQ ID NO: 2244423 - DNA, 12 bp, Homo sapiens
catggcccctct

SEQ ID NO: 2244424 - DNA, 13 bp, Homo sapiens
catggcccctctg

SEQ ID NO: 2244425 - DNA, 13 bp, Homo sapiens
catgggctgtgtc

SEQ ID NO: 2244426 - DNA, 18 bp, Homo sapiens
catggtttaaaagaaaaa

SEQ ID NO: 2244427 - DNA, 19 bp, Homo sapiens
catggtttaaaagaaaaaa

SEQ ID NO: 2244428 - DNA, 14 bp, Homo sapiens
catggtttgactca

SEQ ID NO: 2244429 - DNA, 15 bp, Homo sapiens
catgtaaatgtaaac

SEQ ID NO: 2244430 - DNA, 16 bp, Homo sapiens
catgtaaatgtaaact

SEQ ID NO: 2244431 - DNA, 22 bp, Homo sapiens
catgtatgtcagaagtgcagaa

SEQ ID NO: 2244432 - DNA, 20 bp, Homo sapiens
catgtccaaagaggctgccc

SEQ ID NO: 2244433 - DNA, 17 bp, Homo sapiens
catgtgctaataagttt

SEQ ID NO: 2244434 - DNA, 16 bp, Homo sapiens
catgtgtcccctcact

SEQ ID NO: 2244435 - DNA, 17 bp, Homo sapiens
catgtgtcccctcactc

SEQ ID NO: 2244436 - DNA, 20 bp, Homo sapiens
catgtgtcccctcactctgt

SEQ ID NO: 2244437 - DNA, 15 bp, Homo sapiens
catgtgtcctggttc

SEQ ID NO: 2244438 - DNA, 21 bp, Homo sapiens
catgtgtcctggttcccgttt

SEQ ID NO: 2244439 - DNA, 17 bp, Homo sapiens
catgttactggataaat

SEQ ID NO: 2244440 - DNA, 17 bp, Homo sapiens
catgttgatcatgtact

SEQ ID NO: 2244441 - DNA, 20 bp, Homo sapiens
catgttgatcatgtactttt

SEQ ID NO: 2244442 - DNA, 21 bp, Homo sapiens
catgttgatcatgtacttttt

SEQ ID NO: 2244443 - DNA, 22 bp, Homo sapiens
cattaagctttttttttttgaa

SEQ ID NO: 2244444 - DNA, 15 bp, Homo sapiens
cattaataaaactgt

SEQ ID NO: 2244445 - DNA, 21 bp, Homo sapiens
cattaattcaggcatatttta

SEQ ID NO: 2244446 - DNA, 13 bp, Homo sapiens
cattcaaactgca

SEQ ID NO: 2244447 - DNA, 20 bp, Homo sapiens
cattcagcagcaaattttca

SEQ ID NO: 2244448 - DNA, 20 bp, Homo sapiens
cattcagctaacaaactaga

SEQ ID NO: 2244449 - DNA, 21 bp, Homo sapiens
cattcagctaacaaactagaa

SEQ ID NO: 2244450 - DNA, 20 bp, Homo sapiens
cattcagtgattactgtcaa

SEQ ID NO: 2244451 - DNA, 21 bp, Homo sapiens
cattcagtgattactgtcaag

SEQ ID NO: 2244452 - DNA, 14 bp, Homo sapiens
cattcctctgccct

SEQ ID NO: 2244453 - DNA, 13 bp, Homo sapiens
cattcctgtgccc

SEQ ID NO: 2244454 - DNA, 17 bp, Homo sapiens
cattcctgtgccctaga

SEQ ID NO: 2244455 - DNA, 22 bp, Homo sapiens
cattcgctactatgatttaatt

SEQ ID NO: 2244456 - DNA, 20 bp, Homo sapiens
cattcttggcttaatcattt

SEQ ID NO: 2244457 - DNA, 14 bp, Homo sapiens
cattgctcagcccg

SEQ ID NO: 2244458 - DNA, 16 bp, Homo sapiens
cattgctcagcccgct

SEQ ID NO: 2244459 - DNA, 14 bp, Homo sapiens
cattgctgagcctc

SEQ ID NO: 2244460 - DNA, 16 bp, Homo sapiens
cattgctgagcctctg

SEQ ID NO: 2244461 - DNA, 16 bp, Homo sapiens
cctggccaggagcagg

SEQ ID NO: 2244462 - DNA, 12 bp, Homo sapiens
cctggccgcccc

SEQ ID NO: 2244463 - DNA, 15 bp, Homo sapiens
cctggccgccccctg

SEQ ID NO: 2244464 - DNA, 21 bp, Homo sapiens
cctggccgccccctgcccccc

SEQ ID NO: 2244465 - DNA, 14 bp, Homo sapiens
cctggcctctgtgc

SEQ ID NO: 2244466 - DNA, 22 bp, Homo sapiens
cctggcctggaatttgggcaga

SEQ ID NO: 2244467 - DNA, 17 bp, Homo sapiens
cctggcgtgctcagacc

SEQ ID NO: 2244468 - DNA, 18 bp, Homo sapiens
cctggctctgccccctcc

SEQ ID NO: 2244469 - DNA, 19 bp, Homo sapiens
cctggctctgccccctccc

SEQ ID NO: 2244470 - DNA, 18 bp, Homo sapiens
cctgggcccctccacgcc

SEQ ID NO: 2244471 - DNA, 21 bp, Homo sapiens
cctgggcccctccacgcctcc

SEQ ID NO: 2244472 - DNA, 23 bp, Homo sapiens
cctgggcccctccacgcctcctg

SEQ ID NO: 2244473 - DNA, 23 bp, Homo sapiens
cctgggctcactgtgctggggca

SEQ ID NO: 2244474 - DNA, 19 bp, Homo sapiens
cctgggctgtctgtcacca

SEQ ID NO: 2244475 - DNA, 15 bp, Homo sapiens
cctggtaccctcctg

SEQ ID NO: 2244476 - DNA, 17 bp, Homo sapiens
cctggtaccctcctggc

SEQ ID NO: 2244477 - DNA, 13 bp, Homo sapiens
cctggttcccgtt

SEQ ID NO: 2244478 - DNA, 22 bp, Homo sapiens
cctggttcccgtttctccacct

SEQ ID NO: 2244479 - DNA, 22 bp, Homo sapiens
cctggtttttggattaaattag

SEQ ID NO: 2244480 - DNA, 19 bp, Homo sapiens
cctgtaacatactggcctg

SEQ ID NO: 2244481 - DNA, 17 bp, Homo sapiens
cctgtactgttctgtgt

SEQ ID NO: 2244482 - DNA, 20 bp, Homo sapiens
cctgtactgttctgtgtctt

SEQ ID NO: 2244483 - DNA, 16 bp, Homo sapiens
cctgtataagtggagg

SEQ ID NO: 2244484 - DNA, 13 bp, Homo sapiens
cctgtcccacccc

SEQ ID NO: 2244485 - DNA, 20 bp, Homo sapiens
cctgtccccaaacaggacag

SEQ ID NO: 2244486 - DNA, 21 bp, Homo sapiens
cctgtgccctagatgcacgtg

SEQ ID NO: 2244487 - DNA, 14 bp, Homo sapiens
cctgtgggggtggc

SEQ ID NO: 2244488 - DNA, 22 bp, Homo sapiens
cctgtgggggtggccatccctg

SEQ ID NO: 2244489 - DNA, 21 bp, Homo sapiens
cctgtgtcggggctgacctct

SEQ ID NO: 2244490 - DNA, 16 bp, Homo sapiens
cctgtgtgatacaaga

SEQ ID NO: 2244491 - DNA, 21 bp, Homo sapiens
cctgtgtggaagaaggaaaca

SEQ ID NO: 2244492 - DNA, 16 bp, Homo sapiens
cctgttgggctgaacc

SEQ ID NO: 2244493 - DNA, 16 bp, Homo sapiens
ccttaactgcatccag

SEQ ID NO: 2244494 - DNA, 14 bp, Homo sapiens
ccttaggcctctga

SEQ ID NO: 2244495 - DNA, 16 bp, Homo sapiens
ccttaggcctctgaga

SEQ ID NO: 2244496 - DNA, 13 bp, Homo sapiens
ccttaggccttcc

SEQ ID NO: 2244497 - DNA, 14 bp, Homo sapiens
ccttaggccttcct

SEQ ID NO: 2244498 - DNA, 15 bp, Homo sapiens
ccttaggccttcctc

SEQ ID NO: 2244499 - DNA, 23 bp, Homo sapiens
ccttaggccttcctctctccaga

SEQ ID NO: 2244500 - DNA, 14 bp, Homo sapiens
ccttagtctcagtt

SEQ ID NO: 2244501 - DNA, 17 bp, Homo sapiens
ccttcaaagaaacttga

SEQ ID NO: 2244502 - DNA, 20 bp, Homo sapiens
ccttcagacaccctcaacct

SEQ ID NO: 2244503 - DNA, 20 bp, Homo sapiens
ccttcagtaccctctcagct

SEQ ID NO: 2244504 - DNA, 17 bp, Homo sapiens
ccttccagctcctgtaa

SEQ ID NO: 2244505 - DNA, 15 bp, Homo sapiens
ccttcccatcgctgt

SEQ ID NO: 2244506 - DNA, 17 bp, Homo sapiens
ccttcctctctccagat

SEQ ID NO: 2244507 - DNA, 15 bp, Homo sapiens
ccttctattctagcc

SEQ ID NO: 2244508 - DNA, 10 bp, Homo sapiens
ccttctggcc

SEQ ID NO: 2244509 - DNA, 13 bp, Homo sapiens
ccttctttgtaat

SEQ ID NO: 2244510 - DNA, 13 bp, Homo sapiens
ccttctttgtata

SEQ ID NO: 2244511 - DNA, 14 bp, Homo sapiens
ccttgagtggggtt

SEQ ID NO: 2244512 - DNA, 16 bp, Homo sapiens
ccttgataatatattg

SEQ ID NO: 2244513 - DNA, 12 bp, Homo sapiens
ccttgctggccc

SEQ ID NO: 2244514 - DNA, 15 bp, Homo sapiens
ccttgctggccccag

SEQ ID NO: 2244515 - DNA, 20 bp, Homo sapiens
ccttgctggccccagccctg

SEQ ID NO: 2244516 - DNA, 22 bp, Homo sapiens
ccttgctggccccagccctgct

SEQ ID NO: 2244517 - DNA, 12 bp, Homo sapiens
ccttgctgtgaa

SEQ ID NO: 2244518 - DNA, 14 bp, Homo sapiens
ccttggccacagac

SEQ ID NO: 2244519 - DNA, 12 bp, Homo sapiens
ccttggctcaga

SEQ ID NO: 2244520 - DNA, 15 bp, Homo sapiens
ccttggctcagacat

SEQ ID NO: 2244521 - DNA, 17 bp, Homo sapiens
ccttggctttcagagcc

SEQ ID NO: 2244522 - DNA, 18 bp, Homo sapiens
ccttggctttcagagcca

SEQ ID NO: 2244523 - DNA, 14 bp, Homo sapiens
ccttgtcctttccc

SEQ ID NO: 2244524 - DNA, 16 bp, Homo sapiens
cctttccctcaccccc

SEQ ID NO: 2244525 - DNA, 17 bp, Homo sapiens
cctttccctcaccccct

SEQ ID NO: 2244526 - DNA, 16 bp, Homo sapiens
cctttcttcctattta

SEQ ID NO: 2244527 - DNA, 21 bp, Homo sapiens
cctttcttcctatttatcata

SEQ ID NO: 2244528 - DNA, 17 bp, Homo sapiens
cctttgagtgtcttcta

SEQ ID NO: 2244529 - DNA, 22 bp, Homo sapiens
cctttggctggtagcagcaggc

SEQ ID NO: 2244530 - DNA, 15 bp, Homo sapiens
cctttggttctggcc

SEQ ID NO: 2244531 - DNA, 20 bp, Homo sapiens
cctttggttctggccagaat

SEQ ID NO: 2244532 - DNA, 13 bp, Homo sapiens
ccttttagaaacc

SEQ ID NO: 2244533 - DNA, 12 bp, Homo sapiens
ccttttcttaaa

SEQ ID NO: 2244534 - DNA, 21 bp, Homo sapiens
ccttttgaggagccccagcta

SEQ ID NO: 2244535 - DNA, 14 bp, Homo sapiens
ccttttttcttttt

SEQ ID NO: 2244536 - DNA, 19 bp, Homo sapiens
cgaaaaaataattatttat

SEQ ID NO: 2244537 - DNA, 18 bp, Homo sapiens
cgaaacctgggattcagg

SEQ ID NO: 2244538 - DNA, 19 bp, Homo sapiens
cgaacatccaaccttccca

SEQ ID NO: 2244539 - DNA, 17 bp, Homo sapiens
cgaagcggagagagcca

SEQ ID NO: 2244540 - DNA, 20 bp, Homo sapiens
cgaagcggagagagccaaga

SEQ ID NO: 2244541 - DNA, 21 bp, Homo sapiens
cgaagcggagagagccaagac

SEQ ID NO: 2244542 - DNA, 22 bp, Homo sapiens
cgaagcggagagagccaagacg

SEQ ID NO: 2244543 - DNA, 16 bp, Homo sapiens
cgaagtcattaaactg

SEQ ID NO: 2244544 - DNA, 12 bp, Homo sapiens
cgactccagcca

SEQ ID NO: 2244545 - DNA, 16 bp, Homo sapiens
cgactccagccagcgc

SEQ ID NO: 2244546 - DNA, 21 bp, Homo sapiens
cgactccagccagcgcctccc

SEQ ID NO: 2244547 - DNA, 20 bp, Homo sapiens
cgagaaataaagtttgctta

SEQ ID NO: 2244548 - DNA, 19 bp, Homo sapiens
cgagacccccatccagcct

SEQ ID NO: 2244549 - DNA, 21 bp, Homo sapiens
cgagacccccatccagcctcc

SEQ ID NO: 2244550 - DNA, 13 bp, Homo sapiens
cgaggaaaggatt

SEQ ID NO: 2244551 - DNA, 18 bp, Homo sapiens
cgaggaaaggattttacc

SEQ ID NO: 2244552 - DNA, 20 bp, Homo sapiens
cgaggcaggaggagcccgga

SEQ ID NO: 2244553 - DNA, 15 bp, Homo sapiens
cgagggccaggcacc

SEQ ID NO: 2244554 - DNA, 14 bp, Homo sapiens
cgagtcaaagttga

SEQ ID NO: 2244555 - DNA, 18 bp, Homo sapiens
cgagtgatttccatctct

SEQ ID NO: 2244556 - DNA, 22 bp, Homo sapiens
cgagtgcactgcattcctgtgc

SEQ ID NO: 2244557 - DNA, 14 bp, Homo sapiens
cgatttaaggtatt

SEQ ID NO: 2244558 - DNA, 15 bp, Homo sapiens
cgatttctacctcag

SEQ ID NO: 2244559 - DNA, 17 bp, Homo sapiens
cgcaatagttttttact

SEQ ID NO: 2244560 - DNA, 16 bp, Homo sapiens
cgccactcatttcatc

SEQ ID NO: 2244561 - DNA, 18 bp, Homo sapiens
cgcccacaggaagcctgc

SEQ ID NO: 2244562 - DNA, 14 bp, Homo sapiens
cgccccaggccctc

SEQ ID NO: 2244563 - DNA, 14 bp, Homo sapiens
cgcccccagagccc

SEQ ID NO: 2244564 - DNA, 15 bp, Homo sapiens
cgccctgggctgtct

SEQ ID NO: 2244565 - DNA, 15 bp, Homo sapiens
cgccctggtttgttt

SEQ ID NO: 2244566 - DNA, 22 bp, Homo sapiens
cgcctcctggccagacgctgcc

SEQ ID NO: 2244567 - DNA, 20 bp, Homo sapiens
cgcctgccctcatggcccct

SEQ ID NO: 2244568 - DNA, 15 bp, Homo sapiens
cgcctggccaggagc

SEQ ID NO: 2244569 - DNA, 18 bp, Homo sapiens
cgcctggccaggagcagg

SEQ ID NO: 2244570 - DNA, 14 bp, Homo sapiens
ctgacctgcactgg

SEQ ID NO: 2244571 - DNA, 15 bp, Homo sapiens
ctgaccttaaatgca

SEQ ID NO: 2244572 - DNA, 23 bp, Homo sapiens
ctgactccctgtgggggtggcca

SEQ ID NO: 2244573 - DNA, 13 bp, Homo sapiens
ctgagaagctctg

SEQ ID NO: 2244574 - DNA, 16 bp, Homo sapiens
ctgagaagctctgaag

SEQ ID NO: 2244575 - DNA, 14 bp, Homo sapiens
ctgagaggctgtct

SEQ ID NO: 2244576 - DNA, 14 bp, Homo sapiens
ctgagcctctgctc

SEQ ID NO: 2244577 - DNA, 21 bp, Homo sapiens
ctgagcttgtcttttctgctg

SEQ ID NO: 2244578 - DNA, 9 bp, Homo sapiens
ctgaggacg

SEQ ID NO: 2244579 - DNA, 20 bp, Homo sapiens
ctgaggacgagacccccatc

SEQ ID NO: 2244580 - DNA, 21 bp, Homo sapiens
ctgagttctgtgtattttcag

SEQ ID NO: 2244581 - DNA, 16 bp, Homo sapiens
ctgatcttatgtgtta

SEQ ID NO: 2244582 - DNA, 12 bp, Homo sapiens
ctgatttctcac

SEQ ID NO: 2244583 - DNA, 21 bp, Homo sapiens
ctgcaaaaatatttataaaac

SEQ ID NO: 2244584 - DNA, 12 bp, Homo sapiens
ctgcaacaaaaa

SEQ ID NO: 2244585 - DNA, 20 bp, Homo sapiens
ctgcaaccttgtttattaaa

SEQ ID NO: 2244586 - DNA, 23 bp, Homo sapiens
ctgcaagtcagattgctgggagg

SEQ ID NO: 2244587 - DNA, 15 bp, Homo sapiens
ctgcaattcccctct

SEQ ID NO: 2244588 - DNA, 21 bp, Homo sapiens
ctgcacaataaacataacagc

SEQ ID NO: 2244589 - DNA, 14 bp, Homo sapiens
ctgcacacaaatat

SEQ ID NO: 2244590 - DNA, 20 bp, Homo sapiens
ctgcacaccctccagagaca

SEQ ID NO: 2244591 - DNA, 18 bp, Homo sapiens
ctgcagcaggaactctgg

SEQ ID NO: 2244592 - DNA, 20 bp, Homo sapiens
ctgcagctatgcgcaatgtg

SEQ ID NO: 2244593 - DNA, 21 bp, Homo sapiens
ctgcagctatgcgcaatgtgg

SEQ ID NO: 2244594 - DNA, 14 bp, Homo sapiens
ctgcaggcaggaac

SEQ ID NO: 2244595 - DNA, 15 bp, Homo sapiens
ctgcaggcaggaaca

SEQ ID NO: 2244596 - DNA, 17 bp, Homo sapiens
ctgcagttctttttgta

SEQ ID NO: 2244597 - DNA, 15 bp, Homo sapiens
ctgcagttttgctat

SEQ ID NO: 2244598 - DNA, 22 bp, Homo sapiens
ctgcagttttgctatctgggct

SEQ ID NO: 2244599 - DNA, 20 bp, Homo sapiens
ctgcatcacccgcccctgga

SEQ ID NO: 2244600 - DNA, 19 bp, Homo sapiens
ctgcatgcaaacaagaaac

SEQ ID NO: 2244601 - DNA, 12 bp, Homo sapiens
ctgccccccagc

SEQ ID NO: 2244602 - DNA, 19 bp, Homo sapiens
ctgccccccagcctctggc

SEQ ID NO: 2244603 - DNA, 12 bp, Homo sapiens
ctgccccctccc

SEQ ID NO: 2244604 - DNA, 20 bp, Homo sapiens
ctgccccctcccccatgggc

SEQ ID NO: 2244605 - DNA, 22 bp, Homo sapiens
ctgccccctcccccatgggctg

SEQ ID NO: 2244606 - DNA, 17 bp, Homo sapiens
ctgcccctaccctggac

SEQ ID NO: 2244607 - DNA, 15 bp, Homo sapiens
ctgcccttcctgcag

SEQ ID NO: 2244608 - DNA, 13 bp, Homo sapiens
ctgccgctgcacc

SEQ ID NO: 2244609 - DNA, 15 bp, Homo sapiens
ctgccgctgcaccac

SEQ ID NO: 2244610 - DNA, 15 bp, Homo sapiens
ctgcctattgattta

SEQ ID NO: 2244611 - DNA, 14 bp, Homo sapiens
ctgcctctcggtga

SEQ ID NO: 2244612 - DNA, 16 bp, Homo sapiens
ctgcctgttggcaggc

SEQ ID NO: 2244613 - DNA, 20 bp, Homo sapiens
ctgcctgttggcaggcccac

SEQ ID NO: 2244614 - DNA, 18 bp, Homo sapiens
ctgcggagaccctgagtc

SEQ ID NO: 2244615 - DNA, 15 bp, Homo sapiens
ctgctaaataaaatt

SEQ ID NO: 2244616 - DNA, 23 bp, Homo sapiens
ctgctaaataaaatttgttgcat

SEQ ID NO: 2244617 - DNA, 13 bp, Homo sapiens
ctgctccaccctc

SEQ ID NO: 2244618 - DNA, 14 bp, Homo sapiens
ctgctgctgtccct

SEQ ID NO: 2244619 - DNA, 14 bp, Homo sapiens
ctgctggggatccc

SEQ ID NO: 2244620 - DNA, 17 bp, Homo sapiens
ctgctggggatccccgc

SEQ ID NO: 2244621 - DNA, 21 bp, Homo sapiens
ctgctggggatccccgcctgg

SEQ ID NO: 2244622 - DNA, 20 bp, Homo sapiens
ctgctgtctcatcacataaa

SEQ ID NO: 2244623 - DNA, 13 bp, Homo sapiens
ctgctgttgcctc

SEQ ID NO: 2244624 - DNA, 20 bp, Homo sapiens
ctgcttagaatccaaacttg

SEQ ID NO: 2244625 - DNA, 15 bp, Homo sapiens
ctgcttttatctcag

SEQ ID NO: 2244626 - DNA, 16 bp, Homo sapiens
ctggaacaaattattt

SEQ ID NO: 2244627 - DNA, 20 bp, Homo sapiens
ctggaacccttttaaagttg

SEQ ID NO: 2244628 - DNA, 18 bp, Homo sapiens
ctggaatctggagaccag

SEQ ID NO: 2244629 - DNA, 16 bp, Homo sapiens
ctggaatttgggcaga

SEQ ID NO: 2244630 - DNA, 17 bp, Homo sapiens
ctggaatttgggcagat

SEQ ID NO: 2244631 - DNA, 12 bp, Homo sapiens
ctggacagacag

SEQ ID NO: 2244632 - DNA, 19 bp, Homo sapiens
ctggacatttaacttttct

SEQ ID NO: 2244633 - DNA, 17 bp, Homo sapiens
ctggacccctgggcctc

SEQ ID NO: 2244634 - DNA, 16 bp, Homo sapiens
ctggacccttataaaa

SEQ ID NO: 2244635 - DNA, 17 bp, Homo sapiens
ctggacccttataaaat

SEQ ID NO: 2244636 - DNA, 15 bp, Homo sapiens
ctggaccgtttccaa

SEQ ID NO: 2244637 - DNA, 19 bp, Homo sapiens
ctggaccgtttccaagctg

SEQ ID NO: 2244638 - DNA, 13 bp, Homo sapiens
ctggacttcttag

SEQ ID NO: 2244639 - DNA, 16 bp, Homo sapiens
ctggacttgcctctgc

SEQ ID NO: 2244640 - DNA, 15 bp, Homo sapiens
ctggagcagaccacc

SEQ ID NO: 2244641 - DNA, 21 bp, Homo sapiens
ctggagcgaagccttctgcag

SEQ ID NO: 2244642 - DNA, 23 bp, Homo sapiens
ctggagcgaagccttctgcagca

SEQ ID NO: 2244643 - DNA, 15 bp, Homo sapiens
ctggagttggagccg

SEQ ID NO: 2244644 - DNA, 19 bp, Homo sapiens
ctggcacaggccgaggcag

SEQ ID NO: 2244645 - DNA, 21 bp, Homo sapiens
ctggcagatcgctcactgttg

SEQ ID NO: 2244646 - DNA, 18 bp, Homo sapiens
ctggcaggatgctgagct

SEQ ID NO: 2244647 - DNA, 17 bp, Homo sapiens
ctggcagggtccctcca

SEQ ID NO: 2244648 - DNA, 15 bp, Homo sapiens
ctggcagtttaaaaa

SEQ ID NO: 2244649 - DNA, 14 bp, Homo sapiens
ctggccagacgctg

SEQ ID NO: 2244650 - DNA, 16 bp, Homo sapiens
ctggccagacgctgcc

SEQ ID NO: 2244651 - DNA, 12 bp, Homo sapiens
ctggccagcacc

SEQ ID NO: 2244652 - DNA, 13 bp, Homo sapiens
ctggccagcaccc

SEQ ID NO: 2244653 - DNA, 15 bp, Homo sapiens
ctggccagcaccctc

SEQ ID NO: 2244654 - DNA, 16 bp, Homo sapiens
ctggccagcaccctct

SEQ ID NO: 2244655 - DNA, 13 bp, Homo sapiens
ctggccaggagca

SEQ ID NO: 2244656 - DNA, 14 bp, Homo sapiens
ctggccaggagcag

SEQ ID NO: 2244657 - DNA, 23 bp, Homo sapiens
ctggccccagccctgctggggat

SEQ ID NO: 2244658 - DNA, 16 bp, Homo sapiens
ctggcctctgtgcctt

SEQ ID NO: 2244659 - DNA, 20 bp, Homo sapiens
ctggcctctgtgccttcttt

SEQ ID NO: 2244660 - DNA, 22 bp, Homo sapiens
ctggcgtgctcagacccaacag

SEQ ID NO: 2244661 - DNA, 14 bp, Homo sapiens
ctggcttttattaa

SEQ ID NO: 2244662 - DNA, 9 bp, Homo sapiens
ctgggaaac

SEQ ID NO: 2244663 - DNA, 21 bp, Homo sapiens
ctgggagtagttgtctttcct

SEQ ID NO: 2244664 - DNA, 18 bp, Homo sapiens
ctgggcaccacaaaatat

SEQ ID NO: 2244665 - DNA, 20 bp, Homo sapiens
ctgggcaccacaaaatatac

SEQ ID NO: 2244666 - DNA, 18 bp, Homo sapiens
ctgggcatttggtgagag

SEQ ID NO: 2244667 - DNA, 23 bp, Homo sapiens
ctgggccatgtccaaagaggctg

SEQ ID NO: 2244668 - DNA, 14 bp, Homo sapiens
ctgggcccctccac

SEQ ID NO: 2244669 - DNA, 15 bp, Homo sapiens
ctgggcccctccacg

SEQ ID NO: 2244670 - DNA, 12 bp, Homo sapiens
ctgggcccctgg

SEQ ID NO: 2244671 - DNA, 17 bp, Homo sapiens
ctgggcccctgggatgg

SEQ ID NO: 2244672 - DNA, 21 bp, Homo sapiens
ctgggcctcagttcaacctgg

SEQ ID NO: 2244673 - DNA, 17 bp, Homo sapiens
ctgggcctcatcacagc

SEQ ID NO: 2244674 - DNA, 22 bp, Homo sapiens
ctgggctctgcaattcccctct

SEQ ID NO: 2244675 - DNA, 13 bp, Homo sapiens
ctgggctgtctgt

SEQ ID NO: 2244676 - DNA, 13 bp, Homo sapiens
ctggggacttgtg

SEQ ID NO: 2244677 - DNA, 17 bp, Homo sapiens
ctggggacttgtgtctg

SEQ ID NO: 2244678 - DNA, 20 bp, Homo sapiens
ctggggatccccgcctggcc

SEQ ID NO: 2244679 - DNA, 22 bp, Homo sapiens
gacacaagtggaccttaggcct

SEQ ID NO: 2244680 - DNA, 14 bp, Homo sapiens
gacacagttcctgg

SEQ ID NO: 2244681 - DNA, 16 bp, Homo sapiens
gacacagttcctggga

SEQ ID NO: 2244682 - DNA, 13 bp, Homo sapiens
gacaccctcaacc

SEQ ID NO: 2244683 - DNA, 11 bp, Homo sapiens
gacactgcagt

SEQ ID NO: 2244684 - DNA, 15 bp, Homo sapiens
gacactggcccctca

SEQ ID NO: 2244685 - DNA, 21 bp, Homo sapiens
gacagcccaggatactggcac

SEQ ID NO: 2244686 - DNA, 22 bp, Homo sapiens
gacagcccaggatactggcaca

SEQ ID NO: 2244687 - DNA, 18 bp, Homo sapiens
gacagccctgcggagacc

SEQ ID NO: 2244688 - DNA, 15 bp, Homo sapiens
gacaggaaagccctc

SEQ ID NO: 2244689 - DNA, 17 bp, Homo sapiens
gacagggagcagccccc

SEQ ID NO: 2244690 - DNA, 13 bp, Homo sapiens
gacagtccacagg

SEQ ID NO: 2244691 - DNA, 14 bp, Homo sapiens
gacatgccctgtgt

SEQ ID NO: 2244692 - DNA, 16 bp, Homo sapiens
gacatgccctgtgtgg

SEQ ID NO: 2244693 - DNA, 17 bp, Homo sapiens
gacatgccctgtgtggc

SEQ ID NO: 2244694 - DNA, 17 bp, Homo sapiens
gacatgttttccgtgaa

SEQ ID NO: 2244695 - DNA, 14 bp, Homo sapiens
gaccaactgtcact

SEQ ID NO: 2244696 - DNA, 13 bp, Homo sapiens
gaccaagggcaga

SEQ ID NO: 2244697 - DNA, 18 bp, Homo sapiens
gaccaccccgcctgccct

SEQ ID NO: 2244698 - DNA, 20 bp, Homo sapiens
gaccaccccgcctgccctca

SEQ ID NO: 2244699 - DNA, 17 bp, Homo sapiens
gaccagcaggctggcct

SEQ ID NO: 2244700 - DNA, 18 bp, Homo sapiens
gacccaatgtaggagctg

SEQ ID NO: 2244701 - DNA, 23 bp, Homo sapiens
gaccccaaacaccttccagctcc

SEQ ID NO: 2244702 - DNA, 17 bp, Homo sapiens
gacccccatccagcctc

SEQ ID NO: 2244703 - DNA, 16 bp, Homo sapiens
gacccctgggcctcat

SEQ ID NO: 2244704 - DNA, 12 bp, Homo sapiens
gaccgccccctc

SEQ ID NO: 2244705 - DNA, 19 bp, Homo sapiens
gaccggcggaccccagcca

SEQ ID NO: 2244706 - DNA, 14 bp, Homo sapiens
gacctggcgtgctc

SEQ ID NO: 2244707 - DNA, 15 bp, Homo sapiens
gaccttaggccttcc

SEQ ID NO: 2244708 - DNA, 12 bp, Homo sapiens
gaccttcctcat

SEQ ID NO: 2244709 - DNA, 14 bp, Homo sapiens
gaccttcctcatcc

SEQ ID NO: 2244710 - DNA, 22 bp, Homo sapiens
gaccttcctcatccaccccatc

SEQ ID NO: 2244711 - DNA, 20 bp, Homo sapiens
gacgaagcggagagagccaa

SEQ ID NO: 2244712 - DNA, 21 bp, Homo sapiens
gacgagacccccatccagcct

SEQ ID NO: 2244713 - DNA, 23 bp, Homo sapiens
gacgagacccccatccagcctcc

SEQ ID NO: 2244714 - DNA, 24 bp, Homo sapiens
gacgagacccccatccagcctcca

SEQ ID NO: 2244715 - DNA, 21 bp, Homo sapiens
gacgccactcatttcatctca

SEQ ID NO: 2244716 - DNA, 23 bp, Homo sapiens
gacgccactcatttcatctcatt

SEQ ID NO: 2244717 - DNA, 19 bp, Homo sapiens
gacgcttaacctttccgct

SEQ ID NO: 2244718 - DNA, 17 bp, Homo sapiens
gacggaggaggggaagg

SEQ ID NO: 2244719 - DNA, 19 bp, Homo sapiens
gacggaggaggggaagggg

SEQ ID NO: 2244720 - DNA, 20 bp, Homo sapiens
gacggaggaggggaaggggc

SEQ ID NO: 2244721 - DNA, 22 bp, Homo sapiens
gacgtttaactgcagttgactt

SEQ ID NO: 2244722 - DNA, 18 bp, Homo sapiens
gactaattttacatgttt

SEQ ID NO: 2244723 - DNA, 23 bp, Homo sapiens
gactaattttacatgtttataaa

SEQ ID NO: 2244724 - DNA, 12 bp, Homo sapiens
gactataaatgt

SEQ ID NO: 2244725 - DNA, 18 bp, Homo sapiens
gactatgtatttttctat

SEQ ID NO: 2244726 - DNA, 9 bp, Homo sapiens
gactccagc

SEQ ID NO: 2244727 - DNA, 14 bp, Homo sapiens
gactccagccagcg

SEQ ID NO: 2244728 - DNA, 20 bp, Homo sapiens
gactccagccagcgcctccc

SEQ ID NO: 2244729 - DNA, 12 bp, Homo sapiens
gactccctgtgg

SEQ ID NO: 2244730 - DNA, 15 bp, Homo sapiens
gactgaaaatattgt

SEQ ID NO: 2244731 - DNA, 22 bp, Homo sapiens
gactggacatttaacttttcta

SEQ ID NO: 2244732 - DNA, 16 bp, Homo sapiens
gactggaccgtttcca

SEQ ID NO: 2244733 - DNA, 20 bp, Homo sapiens
gactggcttttattaatgca

SEQ ID NO: 2244734 - DNA, 22 bp, Homo sapiens
gactggcttttattaatgcact

SEQ ID NO: 2244735 - DNA, 19 bp, Homo sapiens
gactgggaacccctcctgg

SEQ ID NO: 2244736 - DNA, 11 bp, Homo sapiens
gactgtcccac

SEQ ID NO: 2244737 - DNA, 21 bp, Homo sapiens
gactgtgtctgcctgtcccca

SEQ ID NO: 2244738 - DNA, 16 bp, Homo sapiens
gacttaactccttcca

SEQ ID NO: 2244739 - DNA, 20 bp, Homo sapiens
gacttcaaaaggaatgaact

SEQ ID NO: 2244740 - DNA, 13 bp, Homo sapiens
gacttctgcagct

SEQ ID NO: 2244741 - DNA, 12 bp, Homo sapiens
gacttgtgtctg

SEQ ID NO: 2244742 - DNA, 11 bp, Homo sapiens
gagaaactgag

SEQ ID NO: 2244743 - DNA, 15 bp, Homo sapiens
gagaaagaatttagt

SEQ ID NO: 2244744 - DNA, 11 bp, Homo sapiens
gagaaatgaaa

SEQ ID NO: 2244745 - DNA, 13 bp, Homo sapiens
gagaaatgggact

SEQ ID NO: 2244746 - DNA, 22 bp, Homo sapiens
gagaactaaactagtttttcct

SEQ ID NO: 2244747 - DNA, 20 bp, Homo sapiens
gagaagccacgctgtcctct

SEQ ID NO: 2244748 - DNA, 22 bp, Homo sapiens
gagaaggataggccttcattaa

SEQ ID NO: 2244749 - DNA, 13 bp, Homo sapiens
gagaaggtttatt

SEQ ID NO: 2244750 - DNA, 15 bp, Homo sapiens
gagaattaaaactca

SEQ ID NO: 2244751 - DNA, 16 bp, Homo sapiens
gagacacggagcccag

SEQ ID NO: 2244752 - DNA, 15 bp, Homo sapiens
gagacagactagaag

SEQ ID NO: 2244753 - DNA, 16 bp, Homo sapiens
gagaccagggagcctt

SEQ ID NO: 2244754 - DNA, 16 bp, Homo sapiens
gagacccccatccagc

SEQ ID NO: 2244755 - DNA, 19 bp, Homo sapiens
gagacccccatccagcctc

SEQ ID NO: 2244756 - DNA, 21 bp, Homo sapiens
gagacccccatccagcctcca

SEQ ID NO: 2244757 - DNA, 16 bp, Homo sapiens
gagaccctgcaagacc

SEQ ID NO: 2244758 - DNA, 20 bp, Homo sapiens
gagaccggggtatcctgggg

SEQ ID NO: 2244759 - DNA, 13 bp, Homo sapiens
gagagagccaaga

SEQ ID NO: 2244760 - DNA, 14 bp, Homo sapiens
gagagagccaagac

SEQ ID NO: 2244761 - DNA, 19 bp, Homo sapiens
gagagcatctgcaacaaaa

SEQ ID NO: 2244762 - DNA, 16 bp, Homo sapiens
gagagccaagacggag

SEQ ID NO: 2244763 - DNA, 21 bp, Homo sapiens
gagagccaagacggaggaggg

SEQ ID NO: 2244764 - DNA, 14 bp, Homo sapiens
gagagccctgaggc

SEQ ID NO: 2244765 - DNA, 13 bp, Homo sapiens
gagaggcggcctc

SEQ ID NO: 2244766 - DNA, 22 bp, Homo sapiens
gagatctttctttccaaaacat

SEQ ID NO: 2244767 - DNA, 13 bp, Homo sapiens
gagattataataa

SEQ ID NO: 2244768 - DNA, 22 bp, Homo sapiens
gagcagaccaccccgcctgccc

SEQ ID NO: 2244769 - DNA, 21 bp, Homo sapiens
gagcaggcacgggtggtcccc

SEQ ID NO: 2244770 - DNA, 17 bp, Homo sapiens
gagcaggggtctgagcc

SEQ ID NO: 2244771 - DNA, 14 bp, Homo sapiens
gagcatgcacatgc

SEQ ID NO: 2244772 - DNA, 16 bp, Homo sapiens
gagcatgcacatgctg

SEQ ID NO: 2244773 - DNA, 22 bp, Homo sapiens
gagcatggtacttggcctttgg

SEQ ID NO: 2244774 - DNA, 20 bp, Homo sapiens
gagccagcctggctctgccc

SEQ ID NO: 2244775 - DNA, 18 bp, Homo sapiens
gagccagctccctctatt

SEQ ID NO: 2244776 - DNA, 16 bp, Homo sapiens
gagccccagctaccct

SEQ ID NO: 2244777 - DNA, 17 bp, Homo sapiens
gagccctgaggcctaga

SEQ ID NO: 2244778 - DNA, 23 bp, Homo sapiens
gagcctcactggggcagacaata

SEQ ID NO: 2244779 - DNA, 23 bp, Homo sapiens
gagccttttccctctttggctcc

SEQ ID NO: 2244780 - DNA, 13 bp, Homo sapiens
gagcgaggaaagg

SEQ ID NO: 2244781 - DNA, 15 bp, Homo sapiens
gagcgaggaaaggat

SEQ ID NO: 2244782 - DNA, 12 bp, Homo sapiens
gagctgccaaga

SEQ ID NO: 2244783 - DNA, 11 bp, Homo sapiens
gagctgccagt

SEQ ID NO: 2244784 - DNA, 13 bp, Homo sapiens
gagctgccagtgg

SEQ ID NO: 2244785 - DNA, 19 bp, Homo sapiens
gagctggggacctggtacc

SEQ ID NO: 2244786 - DNA, 19 bp, Homo sapiens
gagcttgtcttttctgctg

SEQ ID NO: 2244787 - DNA, 20 bp, Homo sapiens
gagcttgtcttttctgctga

SEQ ID NO: 2244788 - DNA, 13 bp, Homo sapiens
ggaattccctccc

SEQ ID NO: 2244789 - DNA, 12 bp, Homo sapiens
ggacaacacttc

SEQ ID NO: 2244790 - DNA, 23 bp, Homo sapiens
ggacacagcttaacaatgcaact

SEQ ID NO: 2244791 - DNA, 15 bp, Homo sapiens
ggacatgccctgtgt

SEQ ID NO: 2244792 - DNA, 20 bp, Homo sapiens
ggacatttaacttttctacc

SEQ ID NO: 2244793 - DNA, 16 bp, Homo sapiens
ggaccagggatggggg

SEQ ID NO: 2244794 - DNA, 19 bp, Homo sapiens
ggacccaatgtaggagctg

SEQ ID NO: 2244795 - DNA, 17 bp, Homo sapiens
ggaccccagccatccag

SEQ ID NO: 2244796 - DNA, 18 bp, Homo sapiens
ggaccttaggccttcctc

SEQ ID NO: 2244797 - DNA, 22 bp, Homo sapiens
ggacgaagcggagagagccaag

SEQ ID NO: 2244798 - DNA, 14 bp, Homo sapiens
ggacgagaccccca

SEQ ID NO: 2244799 - DNA, 19 bp, Homo sapiens
ggacgagggccaggcaccc

SEQ ID NO: 2244800 - DNA, 21 bp, Homo sapiens
ggactagatactactttctct

SEQ ID NO: 2244801 - DNA, 19 bp, Homo sapiens
ggactcagtgggttaacat

SEQ ID NO: 2244802 - DNA, 16 bp, Homo sapiens
ggactgcgctggacga

SEQ ID NO: 2244803 - DNA, 18 bp, Homo sapiens
ggacttctgcagctatgc

SEQ ID NO: 2244804 - DNA, 15 bp, Homo sapiens
ggagaagacactgca

SEQ ID NO: 2244805 - DNA, 18 bp, Homo sapiens
ggagagaattaaaactca

SEQ ID NO: 2244806 - DNA, 13 bp, Homo sapiens
ggagagagccaag

SEQ ID NO: 2244807 - DNA, 15 bp, Homo sapiens
ggagagagccaagac

SEQ ID NO: 2244808 - DNA, 17 bp, Homo sapiens
ggagatttggaattgaa

SEQ ID NO: 2244809 - DNA, 12 bp, Homo sapiens
ggagcagccccc

SEQ ID NO: 2244810 - DNA, 19 bp, Homo sapiens
ggagcaggggtctgagcca

SEQ ID NO: 2244811 - DNA, 19 bp, Homo sapiens
ggagcccagccctccccat

SEQ ID NO: 2244812 - DNA, 17 bp, Homo sapiens
ggagcctccccctcaga

SEQ ID NO: 2244813 - DNA, 17 bp, Homo sapiens
ggagctgccttggctca

SEQ ID NO: 2244814 - DNA, 21 bp, Homo sapiens
ggagctgccttggctcagaca

SEQ ID NO: 2244815 - DNA, 12 bp, Homo sapiens
ggaggacctggc

SEQ ID NO: 2244816 - DNA, 23 bp, Homo sapiens
ggaggacctggcgtgctcagacc

SEQ ID NO: 2244817 - DNA, 18 bp, Homo sapiens
ggaggctggcagggtccc

SEQ ID NO: 2244818 - DNA, 12 bp, Homo sapiens
ggaggctgggcc

SEQ ID NO: 2244819 - DNA, 19 bp, Homo sapiens
ggaggctgggcccctggga

SEQ ID NO: 2244820 - DNA, 15 bp, Homo sapiens
ggaggggtgtggctc

SEQ ID NO: 2244821 - DNA, 21 bp, Homo sapiens
ggaggttctgtattttaagaa

SEQ ID NO: 2244822 - DNA, 13 bp, Homo sapiens
ggagtcccctcac

SEQ ID NO: 2244823 - DNA, 19 bp, Homo sapiens
ggagtgtgagccacctaag

SEQ ID NO: 2244824 - DNA, 12 bp, Homo sapiens
ggagttatctaa

SEQ ID NO: 2244825 - DNA, 21 bp, Homo sapiens
ggatccaattttaatattaac

SEQ ID NO: 2244826 - DNA, 19 bp, Homo sapiens
ggatccccgcctggccagg

SEQ ID NO: 2244827 - DNA, 21 bp, Homo sapiens
ggatccccgcctggccaggag

SEQ ID NO: 2244828 - DNA, 15 bp, Homo sapiens
ggatcctccacagag

SEQ ID NO: 2244829 - DNA, 16 bp, Homo sapiens
ggatcttcccacagga

SEQ ID NO: 2244830 - DNA, 15 bp, Homo sapiens
ggatgggaccaggga

SEQ ID NO: 2244831 - DNA, 21 bp, Homo sapiens
ggatgggggatgggccagggt

SEQ ID NO: 2244832 - DNA, 21 bp, Homo sapiens
ggattaggtttcagcagagct

SEQ ID NO: 2244833 - DNA, 21 bp, Homo sapiens
ggattcaggaatgtgtggcct

SEQ ID NO: 2244834 - DNA, 17 bp, Homo sapiens
ggattttaccaaagcat

SEQ ID NO: 2244835 - DNA, 16 bp, Homo sapiens
ggcaacgtagcctggg

SEQ ID NO: 2244836 - DNA, 13 bp, Homo sapiens
ggcaatctctctc

SEQ ID NO: 2244837 - DNA, 18 bp, Homo sapiens
ggcacacagcagcccccc

SEQ ID NO: 2244838 - DNA, 22 bp, Homo sapiens
ggcacacagcagccccccagca

SEQ ID NO: 2244839 - DNA, 17 bp, Homo sapiens
ggcaccagatgcaacct

SEQ ID NO: 2244840 - DNA, 18 bp, Homo sapiens
ggcaccagatgcaacctc

SEQ ID NO: 2244841 - DNA, 14 bp, Homo sapiens
ggcacccacatccc

SEQ ID NO: 2244842 - DNA, 14 bp, Homo sapiens
ggcacgggtggtcc

SEQ ID NO: 2244843 - DNA, 13 bp, Homo sapiens
ggcacttggagga

SEQ ID NO: 2244844 - DNA, 19 bp, Homo sapiens
ggcacttggaggacctggc

SEQ ID NO: 2244845 - DNA, 15 bp, Homo sapiens
ggcagagtcctggag

SEQ ID NO: 2244846 - DNA, 23 bp, Homo sapiens
ggcagatatagcattaataaaac

SEQ ID NO: 2244847 - DNA, 16 bp, Homo sapiens
ggcagatcgctcactg

SEQ ID NO: 2244848 - DNA, 12 bp, Homo sapiens
ggcagcaccctc

SEQ ID NO: 2244849 - DNA, 14 bp, Homo sapiens
ggcagcaccctccc

SEQ ID NO: 2244850 - DNA, 14 bp, Homo sapiens
ggcagccagaccag

SEQ ID NO: 2244851 - DNA, 15 bp, Homo sapiens
ggcaggaacaaacag

SEQ ID NO: 2244852 - DNA, 17 bp, Homo sapiens
ggcaggcacacagcagc

SEQ ID NO: 2244853 - DNA, 22 bp, Homo sapiens
ggcaggcacacagcagcccccc

SEQ ID NO: 2244854 - DNA, 14 bp, Homo sapiens
ggcagggaccacac

SEQ ID NO: 2244855 - DNA, 19 bp, Homo sapiens
ggcagggggccctgcccca

SEQ ID NO: 2244856 - DNA, 19 bp, Homo sapiens
ggcaggtcctgcccatgtg

SEQ ID NO: 2244857 - DNA, 14 bp, Homo sapiens
ggcattgctcagcc

SEQ ID NO: 2244858 - DNA, 23 bp, Homo sapiens
ggcatttgtttctttctctgagg

SEQ ID NO: 2244859 - DNA, 16 bp, Homo sapiens
ggccacatagatgctg

SEQ ID NO: 2244860 - DNA, 19 bp, Homo sapiens
ggccaccacctttggctgg

SEQ ID NO: 2244861 - DNA, 14 bp, Homo sapiens
ggccagacgctgcc

SEQ ID NO: 2244862 - DNA, 16 bp, Homo sapiens
ggccagacgctgccgc

SEQ ID NO: 2244863 - DNA, 13 bp, Homo sapiens
ggccagcaccctc

SEQ ID NO: 2244864 - DNA, 22 bp, Homo sapiens
ggccaggatccccctctttgca

SEQ ID NO: 2244865 - DNA, 15 bp, Homo sapiens
ggccatgagtaaaat

SEQ ID NO: 2244866 - DNA, 16 bp, Homo sapiens
ggccatgtatgaagcc

SEQ ID NO: 2244867 - DNA, 14 bp, Homo sapiens
ggcccactccccag

SEQ ID NO: 2244868 - DNA, 17 bp, Homo sapiens
ggcccactccccagccc

SEQ ID NO: 2244869 - DNA, 18 bp, Homo sapiens
ggcccagagcgaggaaag

SEQ ID NO: 2244870 - DNA, 23 bp, Homo sapiens
ggcccaggcagacaaccttgtcc

SEQ ID NO: 2244871 - DNA, 23 bp, Homo sapiens
ggccccactcccttgctggcccc

SEQ ID NO: 2244872 - DNA, 13 bp, Homo sapiens
ggccccagagaga

SEQ ID NO: 2244873 - DNA, 15 bp, Homo sapiens
ggccccagccctgct

SEQ ID NO: 2244874 - DNA, 16 bp, Homo sapiens
ggccccagccctgctg

SEQ ID NO: 2244875 - DNA, 22 bp, Homo sapiens
ggccccagccctgctggggatc

SEQ ID NO: 2244876 - DNA, 22 bp, Homo sapiens
ggcccctgggatgggaccaggg

SEQ ID NO: 2244877 - DNA, 22 bp, Homo sapiens
ggccctccctgactccctgtgg

SEQ ID NO: 2244878 - DNA, 20 bp, Homo sapiens
ggccctgccccaccccatcc

SEQ ID NO: 2244879 - DNA, 19 bp, Homo sapiens
ggccgggcaggtcctgccc

SEQ ID NO: 2244880 - DNA, 20 bp, Homo sapiens
ggcctacagctttgatccct

SEQ ID NO: 2244881 - DNA, 23 bp, Homo sapiens
ggcctacagctttgatccctgac

SEQ ID NO: 2244882 - DNA, 14 bp, Homo sapiens
ggcctatgtggtct

SEQ ID NO: 2244883 - DNA, 10 bp, Homo sapiens
ggcctcagcc

SEQ ID NO: 2244884 - DNA, 14 bp, Homo sapiens
ggcctcgtgccatg

SEQ ID NO: 2244885 - DNA, 20 bp, Homo sapiens
ggccttctggttttaggaaa

SEQ ID NO: 2244886 - DNA, 23 bp, Homo sapiens
ggcgccaacgttcgatttctacc

SEQ ID NO: 2244887 - DNA, 22 bp, Homo sapiens
ggcggatcatgaggtcaggagt

SEQ ID NO: 2244888 - DNA, 22 bp, Homo sapiens
ggcgggatcctccacagagagg

SEQ ID NO: 2244889 - DNA, 17 bp, Homo sapiens
ggctatgtataaaatac

SEQ ID NO: 2244890 - DNA, 12 bp, Homo sapiens
ggctcccctgag

SEQ ID NO: 2244891 - DNA, 13 bp, Homo sapiens
ggctcccctgagg

SEQ ID NO: 2244892 - DNA, 19 bp, Homo sapiens
ggctccgaggagctggggc

SEQ ID NO: 2244893 - DNA, 17 bp, Homo sapiens
ggctcgccgtgtctcag

SEQ ID NO: 2244894 - DNA, 22 bp, Homo sapiens
ggctcgccgtgtctcagcctct

SEQ ID NO: 2244895 - DNA, 23 bp, Homo sapiens
ggctctattccaataaactatga

SEQ ID NO: 2244896 - DNA, 16 bp, Homo sapiens
gtctttcagtactttt

SEQ ID NO: 2244897 - DNA, 18 bp, Homo sapiens
gtctttggagaaatgctt

SEQ ID NO: 2244898 - DNA, 12 bp, Homo sapiens
gtcttttctgct

SEQ ID NO: 2244899 - DNA, 12 bp, Homo sapiens
gtgaaaagaata

SEQ ID NO: 2244900 - DNA, 19 bp, Homo sapiens
gtgaaaagtccttgattgt

SEQ ID NO: 2244901 - DNA, 14 bp, Homo sapiens
gtgaaattattttg

SEQ ID NO: 2244902 - DNA, 15 bp, Homo sapiens
gtgaactttattaaa

SEQ ID NO: 2244903 - DNA, 22 bp, Homo sapiens
gtgaatcctctgtttagaacac

SEQ ID NO: 2244904 - DNA, 16 bp, Homo sapiens
gtgacaattctgtttt

SEQ ID NO: 2244905 - DNA, 15 bp, Homo sapiens
gtgacacctccccct

SEQ ID NO: 2244906 - DNA, 18 bp, Homo sapiens
gtgacaggaaagccctcc

SEQ ID NO: 2244907 - DNA, 20 bp, Homo sapiens
gtgagaaggtttattgttaa

SEQ ID NO: 2244908 - DNA, 16 bp, Homo sapiens
gtgagagtcaaagctg

SEQ ID NO: 2244909 - DNA, 22 bp, Homo sapiens
gtgagctgtgactgctttgctg

SEQ ID NO: 2244910 - DNA, 18 bp, Homo sapiens
gtgagggtaagtattttc

SEQ ID NO: 2244911 - DNA, 14 bp, Homo sapiens
gtgatgtcatttga

SEQ ID NO: 2244912 - DNA, 12 bp, Homo sapiens
gtgcatgggctc

SEQ ID NO: 2244913 - DNA, 24 bp, Homo sapiens
gtgcatttgagagaagccacgctg

SEQ ID NO: 2244914 - DNA, 23 bp, Homo sapiens
gtgcatttgtgctagaaattttc

SEQ ID NO: 2244915 - DNA, 22 bp, Homo sapiens
gtgcctcacatttttttctacc

SEQ ID NO: 2244916 - DNA, 18 bp, Homo sapiens
gtgccttatgttgaaaaa

SEQ ID NO: 2244917 - DNA, 19 bp, Homo sapiens
gtgctgaatgttgggactg

SEQ ID NO: 2244918 - DNA, 16 bp, Homo sapiens
gtgctttttataaaaa

SEQ ID NO: 2244919 - DNA, 17 bp, Homo sapiens
gtggaccttaggccttc

SEQ ID NO: 2244920 - DNA, 21 bp, Homo sapiens
gtggaccttaggccttcctct

SEQ ID NO: 2244921 - DNA, 20 bp, Homo sapiens
gtggaggttctgtattttaa

SEQ ID NO: 2244922 - DNA, 21 bp, Homo sapiens
gtggcattggggggccgggca

SEQ ID NO: 2244923 - DNA, 15 bp, Homo sapiens
gtggccatccctggg

SEQ ID NO: 2244924 - DNA, 17 bp, Homo sapiens
gtggccatccctgggcc

SEQ ID NO: 2244925 - DNA, 19 bp, Homo sapiens
gtggccatccctgggcccc

SEQ ID NO: 2244926 - DNA, 21 bp, Homo sapiens
gtggccatccctgggcccctc

SEQ ID NO: 2244927 - DNA, 12 bp, Homo sapiens
gtggcctcagcc

SEQ ID NO: 2244928 - DNA, 16 bp, Homo sapiens
gtggcctcagccctca

SEQ ID NO: 2244929 - DNA, 19 bp, Homo sapiens
gtggcctcagccctcagaa

SEQ ID NO: 2244930 - DNA, 13 bp, Homo sapiens
gtggcctgtgctt

SEQ ID NO: 2244931 - DNA, 14 bp, Homo sapiens
gtggctcataaaaa

SEQ ID NO: 2244932 - DNA, 17 bp, Homo sapiens
gtgggcagcaccctccc

SEQ ID NO: 2244933 - DNA, 17 bp, Homo sapiens
gtggggcccactgctcg

SEQ ID NO: 2244934 - DNA, 16 bp, Homo sapiens
gtggggtggggtgggg

SEQ ID NO: 2244935 - DNA, 18 bp, Homo sapiens
gtgggtcctgaggcctgc

SEQ ID NO: 2244936 - DNA, 22 bp, Homo sapiens
gtggtcacaacttgatggctgc

SEQ ID NO: 2244937 - DNA, 17 bp, Homo sapiens
gtggtgacacctccccc

SEQ ID NO: 2244938 - DNA, 17 bp, Homo sapiens
gtgtaaagatttataca

SEQ ID NO: 2244939 - DNA, 18 bp, Homo sapiens
gtgtaagaaatacagact

SEQ ID NO: 2244940 - DNA, 21 bp, Homo sapiens
gtgtatctagcttcttcagag

SEQ ID NO: 2244941 - DNA, 13 bp, Homo sapiens
gtgtcacacttgt

SEQ ID NO: 2244942 - DNA, 16 bp, Homo sapiens
gtgtcctaaggcccat

SEQ ID NO: 2244943 - DNA, 16 bp, Homo sapiens
gtgtccttagaacatt

SEQ ID NO: 2244944 - DNA, 18 bp, Homo sapiens
gtgtctcactaaagcatg

SEQ ID NO: 2244945 - DNA, 17 bp, Homo sapiens
gtgtctcagcctctgcc

SEQ ID NO: 2244946 - DNA, 15 bp, Homo sapiens
gtgtctttctaagaa

SEQ ID NO: 2244947 - DNA, 18 bp, Homo sapiens
gtgtgcacaccaccctcc

SEQ ID NO: 2244948 - DNA, 11 bp, Homo sapiens
gtgtggcctca

SEQ ID NO: 2244949 - DNA, 12 bp, Homo sapiens
gtgtggcctcag

SEQ ID NO: 2244950 - DNA, 13 bp, Homo sapiens
gtgtggcctcagc

SEQ ID NO: 2244951 - DNA, 21 bp, Homo sapiens
gtgtggcctcagccctcagaa

SEQ ID NO: 2244952 - DNA, 12 bp, Homo sapiens
gtgttggaaaaa

SEQ ID NO: 2244953 - DNA, 13 bp, Homo sapiens
gtgttttaattta

SEQ ID NO: 2244954 - DNA, 20 bp, Homo sapiens
gttaaataagcaaataaaca

SEQ ID NO: 2244955 - DNA, 15 bp, Homo sapiens
gttaacatcagtttt

SEQ ID NO: 2244956 - DNA, 16 bp, Homo sapiens
gttaatgtatataaaa

SEQ ID NO: 2244957 - DNA, 17 bp, Homo sapiens
gttacaacgaatttaca

SEQ ID NO: 2244958 - DNA, 18 bp, Homo sapiens
gttacactttttggaagt

SEQ ID NO: 2244959 - DNA, 22 bp, Homo sapiens
gttacactttttggaagtgaaa

SEQ ID NO: 2244960 - DNA, 17 bp, Homo sapiens
gttaccttttacagaat

SEQ ID NO: 2244961 - DNA, 19 bp, Homo sapiens
gttactggataaattgttt

SEQ ID NO: 2244962 - DNA, 15 bp, Homo sapiens
gttagcagagtctgt

SEQ ID NO: 2244963 - DNA, 17 bp, Homo sapiens
gttagcagagtctgtct

SEQ ID NO: 2244964 - DNA, 20 bp, Homo sapiens
gttagcagagtctgtctctt

SEQ ID NO: 2244965 - DNA, 21 bp, Homo sapiens
gttagcagagtctgtctcttg

SEQ ID NO: 2244966 - DNA, 22 bp, Homo sapiens
gttagtctcttgtattaaactc

SEQ ID NO: 2244967 - DNA, 16 bp, Homo sapiens
gttagttccactgaga

SEQ ID NO: 2244968 - DNA, 17 bp, Homo sapiens
gttatacagttataaaa

SEQ ID NO: 2244969 - DNA, 18 bp, Homo sapiens
gttatacagttataaaat

SEQ ID NO: 2244970 - DNA, 23 bp, Homo sapiens
gttattgcagtttatcattcaag

SEQ ID NO: 2244971 - DNA, 14 bp, Homo sapiens
gttcaaactgcagc

SEQ ID NO: 2244972 - DNA, 20 bp, Homo sapiens
gttcaacctggtggcaccag

SEQ ID NO: 2244973 - DNA, 16 bp, Homo sapiens
gttcacaccagagaac

SEQ ID NO: 2244974 - DNA, 19 bp, Homo sapiens
gttcccatgtagccccctg

SEQ ID NO: 2244975 - DNA, 15 bp, Homo sapiens
gttccccaaatacaa

SEQ ID NO: 2244976 - DNA, 23 bp, Homo sapiens
gttcctagtgatggcttatgata

SEQ ID NO: 2244977 - DNA, 14 bp, Homo sapiens
gttcctggcagttt

SEQ ID NO: 2244978 - DNA, 19 bp, Homo sapiens
gttctccgggtgtggcctc

SEQ ID NO: 2244979 - DNA, 20 bp, Homo sapiens
gttctccgggtgtggcctca

SEQ ID NO: 2244980 - DNA, 22 bp, Homo sapiens
gttctccgggtgtggcctcagc

SEQ ID NO: 2244981 - DNA, 18 bp, Homo sapiens
gttctccttttcctctct

SEQ ID NO: 2244982 - DNA, 18 bp, Homo sapiens
gttctgagctgccagtgg

SEQ ID NO: 2244983 - DNA, 14 bp, Homo sapiens
gttctgtatatttt

SEQ ID NO: 2244984 - DNA, 18 bp, Homo sapiens
gttctgtgtattttcagt

SEQ ID NO: 2244985 - DNA, 22 bp, Homo sapiens
gttctgtgtctttcacagctcc

SEQ ID NO: 2244986 - DNA, 18 bp, Homo sapiens
gttcttggtgactgtccc

SEQ ID NO: 2244987 - DNA, 16 bp, Homo sapiens
gttctttttgtacact

SEQ ID NO: 2244988 - DNA, 15 bp, Homo sapiens
gttgagcccctggag

SEQ ID NO: 2244989 - DNA, 14 bp, Homo sapiens
gttgagccttttcc

SEQ ID NO: 2244990 - DNA, 16 bp, Homo sapiens
gttgcaatgtgaaaaa

SEQ ID NO: 2244991 - DNA, 16 bp, Homo sapiens
gttggagccgcacatc

SEQ ID NO: 2244992 - DNA, 12 bp, Homo sapiens
gttggcaggccc

SEQ ID NO: 2244993 - DNA, 16 bp, Homo sapiens
gttggcaggcccactc

SEQ ID NO: 2244994 - DNA, 19 bp, Homo sapiens
gttgggcagccagaccagc

SEQ ID NO: 2244995 - DNA, 22 bp, Homo sapiens
gttgtcaagaatagcattgtaa

SEQ ID NO: 2244996 - DNA, 12 bp, Homo sapiens
gtttaaaaatgg

SEQ ID NO: 2244997 - DNA, 14 bp, Homo sapiens
gtttaaaagaaaaa

SEQ ID NO: 2244998 - DNA, 18 bp, Homo sapiens
gtttaaaagaaaaaatga

SEQ ID NO: 2244999 - DNA, 21 bp, Homo sapiens
gtttacatttgatgcatgtct

SEQ ID NO: 2245000 - DNA, 23 bp, Homo sapiens
gtttagcagcagcctttaatgca

SEQ ID NO: 2245001 - DNA, 14 bp, Homo sapiens
gtttccaagctgcg

SEQ ID NO: 2245002 - DNA, 20 bp, Homo sapiens
gtttccagacttccttgaga

SEQ ID NO: 2245003 - DNA, 15 bp, Homo sapiens
gtttcctaaatccaa

SEQ ID NO: 2245004 - DNA, 16 bp, Homo sapiens
tcaaaacaaaggccta

SEQ ID NO: 2245005 - DNA, 20 bp, Homo sapiens
tcaaaacacactactacctc

SEQ ID NO: 2245006 - DNA, 13 bp, Homo sapiens
tcaaaactatttt

SEQ ID NO: 2245007 - DNA, 18 bp, Homo sapiens
tcaaaactatttttgtaa

SEQ ID NO: 2245008 - DNA, 17 bp, Homo sapiens
tcaaaaggaatgaactt

SEQ ID NO: 2245009 - DNA, 21 bp, Homo sapiens
tcaaaaggaatgaacttgtta

SEQ ID NO: 2245010 - DNA, 14 bp, Homo sapiens
tcaaactgcacttt

SEQ ID NO: 2245011 - DNA, 19 bp, Homo sapiens
tcaaactggggcctccaga

SEQ ID NO: 2245012 - DNA, 20 bp, Homo sapiens
tcaaactggggcctccagaa

SEQ ID NO: 2245013 - DNA, 22 bp, Homo sapiens
tcaaactggggcctccagaact

SEQ ID NO: 2245014 - DNA, 18 bp, Homo sapiens
tcaaatgggagactcttt

SEQ ID NO: 2245015 - DNA, 15 bp, Homo sapiens
tcaacaagaaataat

SEQ ID NO: 2245016 - DNA, 18 bp, Homo sapiens
tcaacaagaaataataga

SEQ ID NO: 2245017 - DNA, 14 bp, Homo sapiens
tcaacagtgttttc

SEQ ID NO: 2245018 - DNA, 14 bp, Homo sapiens
tcaacattactgtt

SEQ ID NO: 2245019 - DNA, 18 bp, Homo sapiens
tcaacctcttctggctca

SEQ ID NO: 2245020 - DNA, 16 bp, Homo sapiens
tcaagagatctttctt

SEQ ID NO: 2245021 - DNA, 18 bp, Homo sapiens
tcaagattttttttgtaa

SEQ ID NO: 2245022 - DNA, 22 bp, Homo sapiens
tcaagattttttttgtaacttc

SEQ ID NO: 2245023 - DNA, 18 bp, Homo sapiens
tcaagcagcgaccgcccc

SEQ ID NO: 2245024 - DNA, 22 bp, Homo sapiens
tcaagcagcgaccgccccctcc

SEQ ID NO: 2245025 - DNA, 20 bp, Homo sapiens
tcaaggctacagatgtgctg

SEQ ID NO: 2245026 - DNA, 15 bp, Homo sapiens
tcaagtaatacaaac

SEQ ID NO: 2245027 - DNA, 21 bp, Homo sapiens
tcaagtaatacgttttgacat

SEQ ID NO: 2245028 - DNA, 15 bp, Homo sapiens
tcaagtcaaattaat

SEQ ID NO: 2245029 - DNA, 17 bp, Homo sapiens
tcaagttgtcaggttat

SEQ ID NO: 2245030 - DNA, 12 bp, Homo sapiens
tcaataaagcat

SEQ ID NO: 2245031 - DNA, 20 bp, Homo sapiens
tcaataatatattttctgtt

SEQ ID NO: 2245032 - DNA, 12 bp, Homo sapiens
tcaatactacct

SEQ ID NO: 2245033 - DNA, 18 bp, Homo sapiens
tcaatcactgcactgcat

SEQ ID NO: 2245034 - DNA, 21 bp, Homo sapiens
tcaatcactgcactgcatgca

SEQ ID NO: 2245035 - DNA, 15 bp, Homo sapiens
tcaatcctacctgtt

SEQ ID NO: 2245036 - DNA, 17 bp, Homo sapiens
tcaatgtgtataaattg

SEQ ID NO: 2245037 - DNA, 15 bp, Homo sapiens
tcacactacacatca

SEQ ID NO: 2245038 - DNA, 15 bp, Homo sapiens
tcacagcacttgttt

SEQ ID NO: 2245039 - DNA, 16 bp, Homo sapiens
tcacagctcctcccac

SEQ ID NO: 2245040 - DNA, 16 bp, Homo sapiens
tcacagtgaacactca

SEQ ID NO: 2245041 - DNA, 14 bp, Homo sapiens
tcacattcttggct

SEQ ID NO: 2245042 - DNA, 17 bp, Homo sapiens
tcacatttttttctacc

SEQ ID NO: 2245043 - DNA, 14 bp, Homo sapiens
tcaccagagacttt

SEQ ID NO: 2245044 - DNA, 19 bp, Homo sapiens
tcaccagagactttagggg

SEQ ID NO: 2245045 - DNA, 23 bp, Homo sapiens
tcaccccctcccacccccagccc

SEQ ID NO: 2245046 - DNA, 13 bp, Homo sapiens
tcaccgagcagag

SEQ ID NO: 2245047 - DNA, 14 bp, Homo sapiens
tcaccttctttgta

SEQ ID NO: 2245048 - DNA, 21 bp, Homo sapiens
tcacgtttggtgcttctcaga

SEQ ID NO: 2245049 - DNA, 23 bp, Homo sapiens
tcactaaagcatgaaatgtgaat

SEQ ID NO: 2245050 - DNA, 14 bp, Homo sapiens
tcactacagtatta

SEQ ID NO: 2245051 - DNA, 13 bp, Homo sapiens
tcactatggtatg

SEQ ID NO: 2245052 - DNA, 20 bp, Homo sapiens
tcactatggtatgctggcca

SEQ ID NO: 2245053 - DNA, 21 bp, Homo sapiens
tcactatggtatgctggccag

SEQ ID NO: 2245054 - DNA, 17 bp, Homo sapiens
tcactcattgctgagcc

SEQ ID NO: 2245055 - DNA, 19 bp, Homo sapiens
tcactcattgctgagcctc

SEQ ID NO: 2245056 - DNA, 19 bp, Homo sapiens
tcactccacgcagctggca

SEQ ID NO: 2245057 - DNA, 23 bp, Homo sapiens
tcactctgtcagccagccgccct

SEQ ID NO: 2245058 - DNA, 14 bp, Homo sapiens
tcactgttgtgaat

SEQ ID NO: 2245059 - DNA, 21 bp, Homo sapiens
tcactgttgtgaatcaccaaa

SEQ ID NO: 2245060 - DNA, 16 bp, Homo sapiens
tcactgtttgttttta

SEQ ID NO: 2245061 - DNA, 15 bp, Homo sapiens
tcacttttccttttc

SEQ ID NO: 2245062 - DNA, 16 bp, Homo sapiens
tcacttttccttttct

SEQ ID NO: 2245063 - DNA, 17 bp, Homo sapiens
tcacttttccttttctt

SEQ ID NO: 2245064 - DNA, 20 bp, Homo sapiens
tcacttttccttttcttaaa

SEQ ID NO: 2245065 - DNA, 18 bp, Homo sapiens
tcacttttttctgccttg

SEQ ID NO: 2245066 - DNA, 16 bp, Homo sapiens
tcagaaagctttattt

SEQ ID NO: 2245067 - DNA, 15 bp, Homo sapiens
tcagaaggagctaca

SEQ ID NO: 2245068 - DNA, 19 bp, Homo sapiens
tcagaaggccccagagaga

SEQ ID NO: 2245069 - DNA, 17 bp, Homo sapiens
tcagacaccctcaacct

SEQ ID NO: 2245070 - DNA, 18 bp, Homo sapiens
tcagagcatttaaggaaa

SEQ ID NO: 2245071 - DNA, 15 bp, Homo sapiens
tcagagccagcctgg

SEQ ID NO: 2245072 - DNA, 16 bp, Homo sapiens
tcagatgttaaaataa

SEQ ID NO: 2245073 - DNA, 14 bp, Homo sapiens
tcagattttttcct

SEQ ID NO: 2245074 - DNA, 17 bp, Homo sapiens
tcagcatatgtgtaaag

SEQ ID NO: 2245075 - DNA, 18 bp, Homo sapiens
tcagccagccgccctggg

SEQ ID NO: 2245076 - DNA, 22 bp, Homo sapiens
tcagcgcccccagagcccgtca

SEQ ID NO: 2245077 - DNA, 16 bp, Homo sapiens
tcaggtaatacaaact

SEQ ID NO: 2245078 - DNA, 21 bp, Homo sapiens
tcaggtgaaactccagatgcc

SEQ ID NO: 2245079 - DNA, 20 bp, Homo sapiens
tcaggttatttattttataa

SEQ ID NO: 2245080 - DNA, 17 bp, Homo sapiens
tcagtaccctctcagct

SEQ ID NO: 2245081 - DNA, 23 bp, Homo sapiens
tcagtacttttttaaatattttc

SEQ ID NO: 2245082 - DNA, 13 bp, Homo sapiens
tcagtcaaaactt

SEQ ID NO: 2245083 - DNA, 15 bp, Homo sapiens
tcagtcaaaacttta

SEQ ID NO: 2245084 - DNA, 14 bp, Homo sapiens
tcagtgcatttgtg

SEQ ID NO: 2245085 - DNA, 16 bp, Homo sapiens
tcagtggaggctggca

SEQ ID NO: 2245086 - DNA, 17 bp, Homo sapiens
tcagtggcgagaaataa

SEQ ID NO: 2245087 - DNA, 17 bp, Homo sapiens
tcagtgtttttgtgaat

SEQ ID NO: 2245088 - DNA, 17 bp, Homo sapiens
tcagtttgtgtgtctta

SEQ ID NO: 2245089 - DNA, 20 bp, Homo sapiens
tcataaaaagcaaaacaaaa

SEQ ID NO: 2245090 - DNA, 19 bp, Homo sapiens
tcataacatccagagcttt

SEQ ID NO: 2245091 - DNA, 20 bp, Homo sapiens
tcatatttgaggagtgttaa

SEQ ID NO: 2245092 - DNA, 16 bp, Homo sapiens
tcatccaccccatccc

SEQ ID NO: 2245093 - DNA, 14 bp, Homo sapiens
tcatcggaggctgg

SEQ ID NO: 2245094 - DNA, 16 bp, Homo sapiens
tcatcggaggctgggc

SEQ ID NO: 2245095 - DNA, 23 bp, Homo sapiens
tcatctcatttaagggaaaaata

SEQ ID NO: 2245096 - DNA, 14 bp, Homo sapiens
tcatctctctgggg

SEQ ID NO: 2245097 - DNA, 16 bp, Homo sapiens
tcatctctctggggcc

SEQ ID NO: 2245098 - DNA, 20 bp, Homo sapiens
tcatctctctggggccctgg

SEQ ID NO: 2245099 - DNA, 22 bp, Homo sapiens
tcatctctctggggccctgggc

SEQ ID NO: 2245100 - DNA, 14 bp, Homo sapiens
tcatctgaaatgtt

SEQ ID NO: 2245101 - DNA, 14 bp, Homo sapiens
tcatctggggtggg

SEQ ID NO: 2245102 - DNA, 20 bp, Homo sapiens
tcatctgtctatattttatt

SEQ ID NO: 2245103 - DNA, 14 bp, Homo sapiens
tcatgaatatgatg

SEQ ID NO: 2245104 - DNA, 23 bp, Homo sapiens
tcatgccagctacttcctcctcc

SEQ ID NO: 2245105 - DNA, 13 bp, Homo sapiens
tcatggcccctct

SEQ ID NO: 2245106 - DNA, 18 bp, Homo sapiens
tcatggcccctctgacct

SEQ ID NO: 2245107 - DNA, 14 bp, Homo sapiens
tcatgggctgtgtg

SEQ ID NO: 2245108 - DNA, 17 bp, Homo sapiens
tcatgtattttacacaa

SEQ ID NO: 2245109 - DNA, 23 bp, Homo sapiens
tcatgtcaaatatttagatgtaa

SEQ ID NO: 2245110 - DNA, 16 bp, Homo sapiens
tcatgtcttctcacaa

SEQ ID NO: 2245111 - DNA, 15 bp, Homo sapiens
tcatgttaacctctg

SEQ ID NO: 2245112 - DNA, 20 bp, Homo sapiens
tgaccaaggtgcttttcttc

SEQ ID NO: 2245113 - DNA, 18 bp, Homo sapiens
tgaccacttattctgtat

SEQ ID NO: 2245114 - DNA, 21 bp, Homo sapiens
tgaccccaaacaccttccagc

SEQ ID NO: 2245115 - DNA, 22 bp, Homo sapiens
tgaccccaaacaccttccagct

SEQ ID NO: 2245116 - DNA, 14 bp, Homo sapiens
tgacccctgcctgt

SEQ ID NO: 2245117 - DNA, 15 bp, Homo sapiens
tgacccttgctgtga

SEQ ID NO: 2245118 - DNA, 19 bp, Homo sapiens
tgacctccgtcctctcccc

SEQ ID NO: 2245119 - DNA, 20 bp, Homo sapiens
tgacctccgtcctctcccca

SEQ ID NO: 2245120 - DNA, 15 bp, Homo sapiens
tgactaattttacat

SEQ ID NO: 2245121 - DNA, 21 bp, Homo sapiens
tgactaattttacatgtttat

SEQ ID NO: 2245122 - DNA, 16 bp, Homo sapiens
tgactccctgtggggg

SEQ ID NO: 2245123 - DNA, 17 bp, Homo sapiens
tgactggcttcagcaag

SEQ ID NO: 2245124 - DNA, 22 bp, Homo sapiens
tgactgtcccaccgggagcctc

SEQ ID NO: 2245125 - DNA, 14 bp, Homo sapiens
tgactttttataaa

SEQ ID NO: 2245126 - DNA, 19 bp, Homo sapiens
tgactttttataaaatggc

SEQ ID NO: 2245127 - DNA, 16 bp, Homo sapiens
tgagaaatgaatgctg

SEQ ID NO: 2245128 - DNA, 16 bp, Homo sapiens
tgagaaggtttattgt

SEQ ID NO: 2245129 - DNA, 19 bp, Homo sapiens
tgagaaggtttattgttaa

SEQ ID NO: 2245130 - DNA, 20 bp, Homo sapiens
tgagaaggtttattgttaat

SEQ ID NO: 2245131 - DNA, 22 bp, Homo sapiens
tgagacacggagcccagccctc

SEQ ID NO: 2245132 - DNA, 16 bp, Homo sapiens
tgagagaagccacgct

SEQ ID NO: 2245133 - DNA, 21 bp, Homo sapiens
tgagagaagccacgctgtcct

SEQ ID NO: 2245134 - DNA, 22 bp, Homo sapiens
tgagagaagccacgctgtcctc

SEQ ID NO: 2245135 - DNA, 18 bp, Homo sapiens
tgagagagagtcttactc

SEQ ID NO: 2245136 - DNA, 20 bp, Homo sapiens
tgagagccctgaggcctaga

SEQ ID NO: 2245137 - DNA, 22 bp, Homo sapiens
tgagatttttaaaaaatatttt

SEQ ID NO: 2245138 - DNA, 17 bp, Homo sapiens
tgagcctctgctcccca

SEQ ID NO: 2245139 - DNA, 16 bp, Homo sapiens
tgagccttttccctct

SEQ ID NO: 2245140 - DNA, 21 bp, Homo sapiens
tgagctaaataaagatattgt

SEQ ID NO: 2245141 - DNA, 22 bp, Homo sapiens
tgagctggggacctggtaccct

SEQ ID NO: 2245142 - DNA, 21 bp, Homo sapiens
tgagcttgtcttttctgctga

SEQ ID NO: 2245143 - DNA, 22 bp, Homo sapiens
tgaggacgagacccccatccag

SEQ ID NO: 2245144 - DNA, 16 bp, Homo sapiens
tgaggcctagactctg

SEQ ID NO: 2245145 - DNA, 17 bp, Homo sapiens
tgagggagaacaagacc

SEQ ID NO: 2245146 - DNA, 22 bp, Homo sapiens
tgaggtgagttgggggtatcta

SEQ ID NO: 2245147 - DNA, 18 bp, Homo sapiens
tgagtgtacagattttat

SEQ ID NO: 2245148 - DNA, 15 bp, Homo sapiens
tgagttctgtgtatt

SEQ ID NO: 2245149 - DNA, 18 bp, Homo sapiens
tgatagcaaatggcctca

SEQ ID NO: 2245150 - DNA, 12 bp, Homo sapiens
tgatagcacttt

SEQ ID NO: 2245151 - DNA, 13 bp, Homo sapiens
tgatagcactttc

SEQ ID NO: 2245152 - DNA, 14 bp, Homo sapiens
tgatagcactttct

SEQ ID NO: 2245153 - DNA, 15 bp, Homo sapiens
tgatatctataaaat

SEQ ID NO: 2245154 - DNA, 15 bp, Homo sapiens
tgatcatgtactttt

SEQ ID NO: 2245155 - DNA, 19 bp, Homo sapiens
tgatcccaccccctcctcc

SEQ ID NO: 2245156 - DNA, 17 bp, Homo sapiens
tgatcccgttttcccca

SEQ ID NO: 2245157 - DNA, 20 bp, Homo sapiens
tgatcccgttttccccatga

SEQ ID NO: 2245158 - DNA, 16 bp, Homo sapiens
tgatcgaaaaaataat

SEQ ID NO: 2245159 - DNA, 17 bp, Homo sapiens
tgatcgaaaaaataatt

SEQ ID NO: 2245160 - DNA, 15 bp, Homo sapiens
tgatctgtatttaat

SEQ ID NO: 2245161 - DNA, 18 bp, Homo sapiens
tgatcttgagaacctttt

SEQ ID NO: 2245162 - DNA, 20 bp, Homo sapiens
tgatgacaaaaaatgtttta

SEQ ID NO: 2245163 - DNA, 16 bp, Homo sapiens
tgatgatgatgaaaac

SEQ ID NO: 2245164 - DNA, 16 bp, Homo sapiens
tgatgatgatgatgat

SEQ ID NO: 2245165 - DNA, 20 bp, Homo sapiens
tgatgatttttaacttttta

SEQ ID NO: 2245166 - DNA, 22 bp, Homo sapiens
tgatgcatgctattcacaatta

SEQ ID NO: 2245167 - DNA, 15 bp, Homo sapiens
tgatggagtgtgagc

SEQ ID NO: 2245168 - DNA, 15 bp, Homo sapiens
tgattaaagatgagc

SEQ ID NO: 2245169 - DNA, 20 bp, Homo sapiens
tgattacctcctgtgtggaa

SEQ ID NO: 2245170 - DNA, 20 bp, Homo sapiens
tgattgatttttttctcctt

SEQ ID NO: 2245171 - DNA, 18 bp, Homo sapiens
tgattgttcgggtgtgca

SEQ ID NO: 2245172 - DNA, 15 bp, Homo sapiens
tgatttaatttgaaa

SEQ ID NO: 2245173 - DNA, 17 bp, Homo sapiens
tgatttccatctctggt

SEQ ID NO: 2245174 - DNA, 22 bp, Homo sapiens
tgcaaaaatatttataaaactt

SEQ ID NO: 2245175 - DNA, 16 bp, Homo sapiens
tgcaaagacctacctc

SEQ ID NO: 2245176 - DNA, 20 bp, Homo sapiens
tgcaacaagccctgcttttg

SEQ ID NO: 2245177 - DNA, 13 bp, Homo sapiens
tgcaacctcacta

SEQ ID NO: 2245178 - DNA, 21 bp, Homo sapiens
tgcaacctctacctcctgggt

SEQ ID NO: 2245179 - DNA, 13 bp, Homo sapiens
tgcaagaaaaaaa

SEQ ID NO: 2245180 - DNA, 17 bp, Homo sapiens
tgcaagaaaaaaactta

SEQ ID NO: 2245181 - DNA, 21 bp, Homo sapiens
tgcaagtcagattgctgggag

SEQ ID NO: 2245182 - DNA, 21 bp, Homo sapiens
tgcaataatatcaaaacaagt

SEQ ID NO: 2245183 - DNA, 19 bp, Homo sapiens
tgcaatgtctgagtgaacc

SEQ ID NO: 2245184 - DNA, 22 bp, Homo sapiens
tgcaatgtctgagtgaacctgt

SEQ ID NO: 2245185 - DNA, 21 bp, Homo sapiens
tgcaatgtggtgacacctccc

SEQ ID NO: 2245186 - DNA, 22 bp, Homo sapiens
tgcacatgctgtctggccctgg

SEQ ID NO: 2245187 - DNA, 11 bp, Homo sapiens
tgcaccaaaga

SEQ ID NO: 2245188 - DNA, 14 bp, Homo sapiens
tgcaccaaagacat

SEQ ID NO: 2245189 - DNA, 22 bp, Homo sapiens
tgcacggtttcgaagtcattaa

SEQ ID NO: 2245190 - DNA, 15 bp, Homo sapiens
tgcactgcatgcaaa

SEQ ID NO: 2245191 - DNA, 16 bp, Homo sapiens
tgcactggggagcccg

SEQ ID NO: 2245192 - DNA, 15 bp, Homo sapiens
tgcacttcaaattca

SEQ ID NO: 2245193 - DNA, 20 bp, Homo sapiens
tgcactttctatcctctgta

SEQ ID NO: 2245194 - DNA, 15 bp, Homo sapiens
tgcagattacactga

SEQ ID NO: 2245195 - DNA, 16 bp, Homo sapiens
tgcagattacactgat

SEQ ID NO: 2245196 - DNA, 20 bp, Homo sapiens
tgcagcaggaactctggacc

SEQ ID NO: 2245197 - DNA, 13 bp, Homo sapiens
tgcaggacttgag

SEQ ID NO: 2245198 - DNA, 18 bp, Homo sapiens
tgcaggacttgagaagac

SEQ ID NO: 2245199 - DNA, 16 bp, Homo sapiens
tgcagtacagtgtgtg

SEQ ID NO: 2245200 - DNA, 17 bp, Homo sapiens
tgcagtcacgtgtaaac

SEQ ID NO: 2245201 - DNA, 18 bp, Homo sapiens
tgcagtggcgcattctag

SEQ ID NO: 2245202 - DNA, 14 bp, Homo sapiens
tgcagtgtgaaaag

SEQ ID NO: 2245203 - DNA, 18 bp, Homo sapiens
tgcagttctttttgtaca

SEQ ID NO: 2245204 - DNA, 17 bp, Homo sapiens
tgcagttgactttctcc

SEQ ID NO: 2245205 - DNA, 19 bp, Homo sapiens
tgcagtttatcattcaagt

SEQ ID NO: 2245206 - DNA, 13 bp, Homo sapiens
tgcataatgcaat

SEQ ID NO: 2245207 - DNA, 15 bp, Homo sapiens
tgcataatgcaatca

SEQ ID NO: 2245208 - DNA, 21 bp, Homo sapiens
tgcatccagcctggggctgag

SEQ ID NO: 2245209 - DNA, 18 bp, Homo sapiens
tgcatctagattatggag

SEQ ID NO: 2245210 - DNA, 21 bp, Homo sapiens
tgcatgctattcacaattatt

SEQ ID NO: 2245211 - DNA, 11 bp, Homo sapiens
tgcatgggctc

SEQ ID NO: 2245212 - DNA, 15 bp, Homo sapiens
tgcattcctgtgccc

SEQ ID NO: 2245213 - DNA, 18 bp, Homo sapiens
tgccagagaggtggggat

SEQ ID NO: 2245214 - DNA, 20 bp, Homo sapiens
tgccagccccgccacgcttg

SEQ ID NO: 2245215 - DNA, 17 bp, Homo sapiens
tgccatacttgttctgt

SEQ ID NO: 2245216 - DNA, 15 bp, Homo sapiens
tgccatgatctgtat

SEQ ID NO: 2245217 - DNA, 21 bp, Homo sapiens
tgcccagaataagttattgca

SEQ ID NO: 2245218 - DNA, 19 bp, Homo sapiens
tgcccatgtgtcccctcac

SEQ ID NO: 2245219 - DNA, 13 bp, Homo sapiens
tgccccaccccat

SEQ ID NO: 2245220 - DNA, 13 bp, Homo sapiens
tgtttctctgaaa

SEQ ID NO: 2245221 - DNA, 22 bp, Homo sapiens
tgtttctggacccttataaaat

SEQ ID NO: 2245222 - DNA, 23 bp, Homo sapiens
tgtttctggacccttataaaatc

SEQ ID NO: 2245223 - DNA, 21 bp, Homo sapiens
tgtttctttctctgaggacaa

SEQ ID NO: 2245224 - DNA, 15 bp, Homo sapiens
tgtttgcaggagaaa

SEQ ID NO: 2245225 - DNA, 16 bp, Homo sapiens
tgtttggcatgtaaat

SEQ ID NO: 2245226 - DNA, 20 bp, Homo sapiens
tgtttgtacacaacaatcct

SEQ ID NO: 2245227 - DNA, 14 bp, Homo sapiens
tgtttgtgtgcatg

SEQ ID NO: 2245228 - DNA, 16 bp, Homo sapiens
tgtttgtgtgcatgaa

SEQ ID NO: 2245229 - DNA, 12 bp, Homo sapiens
tgttttaaagaa

SEQ ID NO: 2245230 - DNA, 13 bp, Homo sapiens
tgttttacaatag

SEQ ID NO: 2245231 - DNA, 17 bp, Homo sapiens
tgttttacaatagttct

SEQ ID NO: 2245232 - DNA, 22 bp, Homo sapiens
tgttttacaatagttctgtggg

SEQ ID NO: 2245233 - DNA, 17 bp, Homo sapiens
tgttttcttttggtaaa

SEQ ID NO: 2245234 - DNA, 13 bp, Homo sapiens
tgtttttaatgct

SEQ ID NO: 2245235 - DNA, 19 bp, Homo sapiens
tgtttttaatgctatttga

SEQ ID NO: 2245236 - DNA, 11 bp, Homo sapiens
tgtttttctca

SEQ ID NO: 2245237 - DNA, 15 bp, Homo sapiens
tgtttttttaattaa

SEQ ID NO: 2245238 - DNA, 18 bp, Homo sapiens
ttaaaaaaattactgtga

SEQ ID NO: 2245239 - DNA, 16 bp, Homo sapiens
ttaaaaaatattttct

SEQ ID NO: 2245240 - DNA, 18 bp, Homo sapiens
ttaaaaactgaaaaatct

SEQ ID NO: 2245241 - DNA, 22 bp, Homo sapiens
ttaaaaatggtatcaaaattac

SEQ ID NO: 2245242 - DNA, 24 bp, Homo sapiens
ttaaaaatggtatcaaaattacat

SEQ ID NO: 2245243 - DNA, 15 bp, Homo sapiens
ttaaaacattaaaat

SEQ ID NO: 2245244 - DNA, 22 bp, Homo sapiens
ttaaaagcaattatattgtcct

SEQ ID NO: 2245245 - DNA, 14 bp, Homo sapiens
ttaaaataaatggt

SEQ ID NO: 2245246 - DNA, 21 bp, Homo sapiens
ttaaaatgaacctgctactta

SEQ ID NO: 2245247 - DNA, 13 bp, Homo sapiens
ttaaacagaggat

SEQ ID NO: 2245248 - DNA, 14 bp, Homo sapiens
ttaaagcctcctca

SEQ ID NO: 2245249 - DNA, 21 bp, Homo sapiens
ttaaagttggtattaataaaa

SEQ ID NO: 2245250 - DNA, 16 bp, Homo sapiens
ttaaataaaagcacaa

SEQ ID NO: 2245251 - DNA, 19 bp, Homo sapiens
ttaaataagcaaataaaca

SEQ ID NO: 2245252 - DNA, 16 bp, Homo sapiens
ttaaatacaaaacttc

SEQ ID NO: 2245253 - DNA, 18 bp, Homo sapiens
ttaaatacaaaacttcca

SEQ ID NO: 2245254 - DNA, 18 bp, Homo sapiens
ttaaatattttctatttt

SEQ ID NO: 2245255 - DNA, 16 bp, Homo sapiens
ttaaattacaatttta

SEQ ID NO: 2245256 - DNA, 17 bp, Homo sapiens
ttaaattagtttgtgaa

SEQ ID NO: 2245257 - DNA, 18 bp, Homo sapiens
ttaacaatgcaactttta

SEQ ID NO: 2245258 - DNA, 19 bp, Homo sapiens
ttaacaatgcaacttttaa

SEQ ID NO: 2245259 - DNA, 17 bp, Homo sapiens
ttaacaatttattctga

SEQ ID NO: 2245260 - DNA, 15 bp, Homo sapiens
ttaactccactgctt

SEQ ID NO: 2245261 - DNA, 22 bp, Homo sapiens
ttaactgcagttgactttctcc

SEQ ID NO: 2245262 - DNA, 15 bp, Homo sapiens
ttaagacgtgaatgt

SEQ ID NO: 2245263 - DNA, 19 bp, Homo sapiens
ttaagacgtgaatgtctca

SEQ ID NO: 2245264 - DNA, 14 bp, Homo sapiens
ttaagactgatttt

SEQ ID NO: 2245265 - DNA, 15 bp, Homo sapiens
ttaagatgtgaaaat

SEQ ID NO: 2245266 - DNA, 17 bp, Homo sapiens
ttaagctgtggtcaagg

SEQ ID NO: 2245267 - DNA, 18 bp, Homo sapiens
ttaagtcccagtatacct

SEQ ID NO: 2245268 - DNA, 16 bp, Homo sapiens
ttaagtgatgtcattt

SEQ ID NO: 2245269 - DNA, 18 bp, Homo sapiens
ttaagtgttggaaaaaat

SEQ ID NO: 2245270 - DNA, 14 bp, Homo sapiens
ttaagttatgtgtg

SEQ ID NO: 2245271 - DNA, 13 bp, Homo sapiens
ttaataaaaagac

SEQ ID NO: 2245272 - DNA, 12 bp, Homo sapiens
ttaataaaactg

SEQ ID NO: 2245273 - DNA, 22 bp, Homo sapiens
ttaatacaaggtataataaaat

SEQ ID NO: 2245274 - DNA, 14 bp, Homo sapiens
ttaatactctattt

SEQ ID NO: 2245275 - DNA, 17 bp, Homo sapiens
ttaatagggaatatatc

SEQ ID NO: 2245276 - DNA, 12 bp, Homo sapiens
ttaatatgaaaa

SEQ ID NO: 2245277 - DNA, 17 bp, Homo sapiens
ttaatatgaaaacttat

SEQ ID NO: 2245278 - DNA, 19 bp, Homo sapiens
ttaatattaacttttaatg

SEQ ID NO: 2245279 - DNA, 17 bp, Homo sapiens
ttaatcaccttctttgt

SEQ ID NO: 2245280 - DNA, 18 bp, Homo sapiens
ttaatcaccttctttgta

SEQ ID NO: 2245281 - DNA, 13 bp, Homo sapiens
ttaatcattttca

SEQ ID NO: 2245282 - DNA, 15 bp, Homo sapiens
ttaatgcactttcta

SEQ ID NO: 2245283 - DNA, 20 bp, Homo sapiens
ttaatgctatttgaacaagt

SEQ ID NO: 2245284 - DNA, 16 bp, Homo sapiens
ttaatggggtctgtaa

SEQ ID NO: 2245285 - DNA, 18 bp, Homo sapiens
ttaatggggtctgtaaat

SEQ ID NO: 2245286 - DNA, 19 bp, Homo sapiens
ttaatggggtctgtaaata

SEQ ID NO: 2245287 - DNA, 14 bp, Homo sapiens
ttaatgtatataaa

SEQ ID NO: 2245288 - DNA, 17 bp, Homo sapiens
ttaatgtatataaaaat

SEQ ID NO: 2245289 - DNA, 19 bp, Homo sapiens
ttaattattataaaaatat

SEQ ID NO: 2245290 - DNA, 20 bp, Homo sapiens
ttacaacgccgagtgcactg

SEQ ID NO: 2245291 - DNA, 18 bp, Homo sapiens
ttacagttaaagaagcaa

SEQ ID NO: 2245292 - DNA, 24 bp, Homo sapiens
ttacatactttatcaatgtgtctt

SEQ ID NO: 2245293 - DNA, 15 bp, Homo sapiens
ttacatacttttgca

SEQ ID NO: 2245294 - DNA, 16 bp, Homo sapiens
ttacatacttttgcaa

SEQ ID NO: 2245295 - DNA, 12 bp, Homo sapiens
ttacatgaagct

SEQ ID NO: 2245296 - DNA, 20 bp, Homo sapiens
ttacatgtaatttgatgagg

SEQ ID NO: 2245297 - DNA, 13 bp, Homo sapiens
ttacattgttcaa

SEQ ID NO: 2245298 - DNA, 20 bp, Homo sapiens
ttacatttgatgcatgtctt

SEQ ID NO: 2245299 - DNA, 20 bp, Homo sapiens
ttaccaataggcaaattaat

SEQ ID NO: 2245300 - DNA, 14 bp, Homo sapiens
ttacctcaaattaa

SEQ ID NO: 2245301 - DNA, 12 bp, Homo sapiens
ttaccttgaaaa

SEQ ID NO: 2245302 - DNA, 14 bp, Homo sapiens
ttactaggtaactt

SEQ ID NO: 2245303 - DNA, 19 bp, Homo sapiens
ttactaggtaacttcatat

SEQ ID NO: 2245304 - DNA, 17 bp, Homo sapiens
ttagaatagtgtcagtt

SEQ ID NO: 2245305 - DNA, 18 bp, Homo sapiens
ttagaatccaaacttgga

SEQ ID NO: 2245306 - DNA, 15 bp, Homo sapiens
ttagaattatttaaa

SEQ ID NO: 2245307 - DNA, 21 bp, Homo sapiens
ttagagagcatctgcaacaaa

SEQ ID NO: 2245308 - DNA, 15 bp, Homo sapiens
ttagataaatattga

SEQ ID NO: 2245309 - DNA, 16 bp, Homo sapiens
ttagatgtaattttgt

SEQ ID NO: 2245310 - DNA, 15 bp, Homo sapiens
ttagattaagaaata

SEQ ID NO: 2245311 - DNA, 16 bp, Homo sapiens
ttagcaataaataaca

SEQ ID NO: 2245312 - DNA, 23 bp, Homo sapiens
ttagcaataaataacacttgtca

SEQ ID NO: 2245313 - DNA, 17 bp, Homo sapiens
ttagcagagtctgtctc

SEQ ID NO: 2245314 - DNA, 21 bp, Homo sapiens
ttagcagcagcctttaatgca

SEQ ID NO: 2245315 - DNA, 16 bp, Homo sapiens
ttagccagagatgcaa

SEQ ID NO: 2245316 - DNA, 13 bp, Homo sapiens
ttagccattgaaa

SEQ ID NO: 2245317 - DNA, 17 bp, Homo sapiens
ttagtaatttctttttt

SEQ ID NO: 2245318 - DNA, 23 bp, Homo sapiens
ttagtctcagtttgtgtgtctta

SEQ ID NO: 2245319 - DNA, 22 bp, Homo sapiens
ttagtctcttgtattaaactct

SEQ ID NO: 2245320 - DNA, 19 bp, Homo sapiens
ttagtgaaaaactgctgta

SEQ ID NO: 2245321 - DNA, 14 bp, Homo sapiens
ttataaaattaaaa

SEQ ID NO: 2245322 - DNA, 12 bp, Homo sapiens
ttataaatttcg

SEQ ID NO: 2245323 - DNA, 15 bp, Homo sapiens
ttataataaatatat

SEQ ID NO: 2245324 - DNA, 21 bp, Homo sapiens
ttatactgacaataaaaatgt

SEQ ID NO: 2245325 - DNA, 14 bp, Homo sapiens
ttatataaagtatt

SEQ ID NO: 2245326 - DNA, 22 bp, Homo sapiens
ttatataaagtattctttttct

SEQ ID NO: 2245327 - DNA, 17 bp, Homo sapiens
ttatatagcatctggaa

SEQ ID NO: 2245328 - DNA, 18 bp, Homo sapiens
ttatatattgtattaagg

SEQ ID NO: 2245329 - DNA, 12 bp, Homo sapiens
gcaatctctctc

SEQ ID NO: 2245330 - DNA, 19 bp, Homo sapiens
gcaatgtggtgacacctcc

SEQ ID NO: 2245331 - DNA, 14 bp, Homo sapiens
gcaattcccctctg

SEQ ID NO: 2245332 - DNA, 16 bp, Homo sapiens
gcacaccaccctcccg

SEQ ID NO: 2245333 - DNA, 14 bp, Homo sapiens
gcacagcatgaggc

SEQ ID NO: 2245334 - DNA, 17 bp, Homo sapiens
gcacaggccgaggcagg

SEQ ID NO: 2245335 - DNA, 17 bp, Homo sapiens
gcacagggagtgcacat

SEQ ID NO: 2245336 - DNA, 13 bp, Homo sapiens
gcaccaaagacat

SEQ ID NO: 2245337 - DNA, 14 bp, Homo sapiens
gcaccacaaaatat

SEQ ID NO: 2245338 - DNA, 20 bp, Homo sapiens
gcaccacggcgtttttttac

SEQ ID NO: 2245339 - DNA, 18 bp, Homo sapiens
gcaccgagtgatttccat

SEQ ID NO: 2245340 - DNA, 22 bp, Homo sapiens
gcaccgagtgatttccatctct

SEQ ID NO: 2245341 - DNA, 14 bp, Homo sapiens
gcaccttttactgt

SEQ ID NO: 2245342 - DNA, 23 bp, Homo sapiens
gcaccttttactgtgatgtttgt

SEQ ID NO: 2245343 - DNA, 20 bp, Homo sapiens
aagataaggactagatacta

SEQ ID NO: 2245344 - DNA, 20 bp, Homo sapiens
aagatatttgcagtttttca

SEQ ID NO: 2245345 - DNA, 15 bp, Homo sapiens
aagatggttgaccaa

SEQ ID NO: 2245346 - DNA, 13 bp, Homo sapiens
aagatgtgaaaat

SEQ ID NO: 2245347 - DNA, 15 bp, Homo sapiens
aagatgttctggata

SEQ ID NO: 2245348 - DNA, 18 bp, Homo sapiens
aagattaaatgtgtcatt

SEQ ID NO: 2245349 - DNA, 21 bp, Homo sapiens
aagattctatttaattgaaac

SEQ ID NO: 2245350 - DNA, 16 bp, Homo sapiens
aagattcttttaaatt

SEQ ID NO: 2245351 - DNA, 18 bp, Homo sapiens
aagatttatacagttgaa

SEQ ID NO: 2245352 - DNA, 18 bp, Homo sapiens
aagattttaatcaagttg

SEQ ID NO: 2245353 - DNA, 14 bp, Homo sapiens
aagattttttttgt

SEQ ID NO: 2245354 - DNA, 14 bp, Homo sapiens
aagcaatactgttt

SEQ ID NO: 2245355 - DNA, 16 bp, Homo sapiens
aagcaattatattgtc

SEQ ID NO: 2245356 - DNA, 15 bp, Homo sapiens
aagcacaagtacttt

SEQ ID NO: 2245357 - DNA, 15 bp, Homo sapiens
aagcacccatttcaa

SEQ ID NO: 2245358 - DNA, 16 bp, Homo sapiens
aagcagcttattgttt

SEQ ID NO: 2245359 - DNA, 14 bp, Homo sapiens
aagcatactttgta

SEQ ID NO: 2245360 - DNA, 17 bp, Homo sapiens
aagcatatgtgttactt

SEQ ID NO: 2245361 - DNA, 13 bp, Homo sapiens
aagcatgaaatgt

SEQ ID NO: 2245362 - DNA, 13 bp, Homo sapiens
aagcattttgtaa

SEQ ID NO: 2245363 - DNA, 15 bp, Homo sapiens
aagccaaatgaaact

SEQ ID NO: 2245364 - DNA, 20 bp, Homo sapiens
aagccaaccttcaaagaaac

SEQ ID NO: 2245365 - DNA, 16 bp, Homo sapiens
aagccacgctgtcctc

SEQ ID NO: 2245366 - DNA, 21 bp, Homo sapiens
aagccaggttccacagaggac

SEQ ID NO: 2245367 - DNA, 23 bp, Homo sapiens
aagccaggttccacagaggacac

SEQ ID NO: 2245368 - DNA, 15 bp, Homo sapiens
aagccatgccaataa

SEQ ID NO: 2245369 - DNA, 16 bp, Homo sapiens
aagccctgcttttgca

SEQ ID NO: 2245370 - DNA, 17 bp, Homo sapiens
aagcctaagggatcctg

SEQ ID NO: 2245371 - DNA, 16 bp, Homo sapiens
aagcctcaaaacaaag

SEQ ID NO: 2245372 - DNA, 22 bp, Homo sapiens
aagcctcactattacttgaact

SEQ ID NO: 2245373 - DNA, 23 bp, Homo sapiens
aagcctctctccttggccacaga

SEQ ID NO: 2245374 - DNA, 23 bp, Homo sapiens
aagctaggtgctatttgtcatct

SEQ ID NO: 2245375 - DNA, 13 bp, Homo sapiens
aagctgttcctgt

SEQ ID NO: 2245376 - DNA, 13 bp, Homo sapiens
aagctttatttct

SEQ ID NO: 2245377 - DNA, 13 bp, Homo sapiens
aagcttttagaaa

SEQ ID NO: 2245378 - DNA, 19 bp, Homo sapiens
aaggactatattaatcacc

SEQ ID NO: 2245379 - DNA, 21 bp, Homo sapiens
aaggaggttaggtcttaggaa

SEQ ID NO: 2245380 - DNA, 23 bp, Homo sapiens
aaggatatgattaatattattaa

SEQ ID NO: 2245381 - DNA, 13 bp, Homo sapiens
aaggatccatctt

SEQ ID NO: 2245382 - DNA, 19 bp, Homo sapiens
aaggattatggaaaaataa

SEQ ID NO: 2245383 - DNA, 18 bp, Homo sapiens
aaggcacttcatgtaaag

SEQ ID NO: 2245384 - DNA, 15 bp, Homo sapiens
aaggccccagagaga

SEQ ID NO: 2245385 - DNA, 16 bp, Homo sapiens
aaggccccagagagac

SEQ ID NO: 2245386 - DNA, 15 bp, Homo sapiens
aaggcccctgcaatg

SEQ ID NO: 2245387 - DNA, 17 bp, Homo sapiens
aaggccgtgtctctgag

SEQ ID NO: 2245388 - DNA, 22 bp, Homo sapiens
aaggcctaattctatgcctgtc

SEQ ID NO: 2245389 - DNA, 15 bp, Homo sapiens
aaggctgcttagaat

SEQ ID NO: 2245390 - DNA, 18 bp, Homo sapiens
aagggaaaaatcaagttt

SEQ ID NO: 2245391 - DNA, 17 bp, Homo sapiens
aagggaaactgggaaac

SEQ ID NO: 2245392 - DNA, 15 bp, Homo sapiens
aagggagtttaaaaa

SEQ ID NO: 2245393 - DNA, 13 bp, Homo sapiens
aagggatcctgcc

SEQ ID NO: 2245394 - DNA, 23 bp, Homo sapiens
aagggatgcaggctcccctgagg

SEQ ID NO: 2245395 - DNA, 20 bp, Homo sapiens
aagggcaacagatcagtaaa

SEQ ID NO: 2245396 - DNA, 16 bp, Homo sapiens
aagggcattttaaaag

SEQ ID NO: 2245397 - DNA, 20 bp, Homo sapiens
aaggggatttttatgtctgg

SEQ ID NO: 2245398 - DNA, 22 bp, Homo sapiens
aaggtactttcatattttaaac

SEQ ID NO: 2245399 - DNA, 18 bp, Homo sapiens
aaggtataataaaattat

SEQ ID NO: 2245400 - DNA, 19 bp, Homo sapiens
aaggtatttaaagtatttt

SEQ ID NO: 2245401 - DNA, 19 bp, Homo sapiens
aaggttatgttcatttttc

SEQ ID NO: 2245402 - DNA, 13 bp, Homo sapiens
aaggttctatctg

SEQ ID NO: 2245403 - DNA, 21 bp, Homo sapiens
aaggtttattgttaatacaag

SEQ ID NO: 2245404 - DNA, 20 bp, Homo sapiens
aaggtttctggagcagtgga

SEQ ID NO: 2245405 - DNA, 18 bp, Homo sapiens
aagtatgtggttttgtaa

SEQ ID NO: 2245406 - DNA, 15 bp, Homo sapiens
aagtattttcctgtt

SEQ ID NO: 2245407 - DNA, 15 bp, Homo sapiens
aagtcaaattaataa

SEQ ID NO: 2245408 - DNA, 20 bp, Homo sapiens
aagtcaatatgtggaagcaa

SEQ ID NO: 2245409 - DNA, 22 bp, Homo sapiens
aagtccccgtggaggttctgta

SEQ ID NO: 2245410 - DNA, 14 bp, Homo sapiens
aagtctgtacctca

SEQ ID NO: 2245411 - DNA, 16 bp, Homo sapiens
aagtgatctgtgttca

SEQ ID NO: 2245412 - DNA, 23 bp, Homo sapiens
aagtgctggcaaccactaagaat

SEQ ID NO: 2245413 - DNA, 22 bp, Homo sapiens
aagtggtgctataagttttaga

SEQ ID NO: 2245414 - DNA, 23 bp, Homo sapiens
aagtggtgctataagttttagaa

SEQ ID NO: 2245415 - DNA, 22 bp, Homo sapiens
aagtgtaaaatattttgaatca

SEQ ID NO: 2245416 - DNA, 22 bp, Homo sapiens
aagtgtatttttcaataaagca

SEQ ID NO: 2245417 - DNA, 19 bp, Homo sapiens
aagtgtctcactaaagcat

SEQ ID NO: 2245418 - DNA, 17 bp, Homo sapiens
aagtgtgtatctagctt

SEQ ID NO: 2245419 - DNA, 18 bp, Homo sapiens
aagttactaggtaacttc

SEQ ID NO: 2245420 - DNA, 21 bp, Homo sapiens
aagttactaggtaacttcata

SEQ ID NO: 2245421 - DNA, 21 bp, Homo sapiens
aagttgaaaatcataggcacc

SEQ ID NO: 2245422 - DNA, 14 bp, Homo sapiens
aataaaaagacaac

SEQ ID NO: 2245423 - DNA, 13 bp, Homo sapiens
aataaaagcacaa

SEQ ID NO: 2245424 - DNA, 11 bp, Homo sapiens
aataaaatttg

SEQ ID NO: 2245425 - DNA, 12 bp, Homo sapiens
aataaaatttgt

SEQ ID NO: 2245426 - DNA, 17 bp, Homo sapiens
aataaaatttgttgcat

SEQ ID NO: 2245427 - DNA, 15 bp, Homo sapiens
aataaacactacaga

SEQ ID NO: 2245428 - DNA, 15 bp, Homo sapiens
aataaagtgatctgt

SEQ ID NO: 2245429 - DNA, 15 bp, Homo sapiens
aataaatatatacat

SEQ ID NO: 2245430 - DNA, 22 bp, Homo sapiens
aataaatggtttggtgcttttt

SEQ ID NO: 2245431 - DNA, 20 bp, Homo sapiens
aataactggaacaaattatt

SEQ ID NO: 2245432 - DNA, 13 bp, Homo sapiens
aataagttattgc

SEQ ID NO: 2245433 - DNA, 20 bp, Homo sapiens
aataagtttgaaatatatta

SEQ ID NO: 2245434 - DNA, 20 bp, Homo sapiens
aataataaagaatagcttta

SEQ ID NO: 2245435 - DNA, 19 bp, Homo sapiens
aataataagtgatgtgctg

SEQ ID NO: 2245436 - DNA, 20 bp, Homo sapiens
aataataagtgatgtgctga

SEQ ID NO: 2245437 - DNA, 17 bp, Homo sapiens
aataatattaatttatt

SEQ ID NO: 2245438 - DNA, 13 bp, Homo sapiens
aatacaaaacttc

SEQ ID NO: 2245439 - DNA, 17 bp, Homo sapiens
aatacaaagttagagaa

SEQ ID NO: 2245440 - DNA, 12 bp, Homo sapiens
aatacaaggtat

SEQ ID NO: 2245441 - DNA, 13 bp, Homo sapiens
aatacaaggtata

SEQ ID NO: 2245442 - DNA, 20 bp, Homo sapiens
aatacaaggtataataaaat

SEQ ID NO: 2245443 - DNA, 22 bp, Homo sapiens
aatacaaggtataataaaatta

SEQ ID NO: 2245444 - DNA, 18 bp, Homo sapiens
aatacaatttttatttct

SEQ ID NO: 2245445 - DNA, 22 bp, Homo sapiens
aatacaatttttatttctttta

SEQ ID NO: 2245446 - DNA, 14 bp, Homo sapiens
aatacatagtgaaa

SEQ ID NO: 2245447 - DNA, 21 bp, Homo sapiens
aatacatttaaaacattaaaa

SEQ ID NO: 2245448 - DNA, 22 bp, Homo sapiens
aatactacctctgaatgttaca

SEQ ID NO: 2245449 - DNA, 12 bp, Homo sapiens
aatactctattt

SEQ ID NO: 2245450 - DNA, 17 bp, Homo sapiens
aatactctatttttaca

SEQ ID NO: 2245451 - DNA, 20 bp, Homo sapiens
aatacttttgctttcaggga

SEQ ID NO: 2245452 - DNA, 17 bp, Homo sapiens
ccttggtgcctcttgta

SEQ ID NO: 2245453 - DNA, 15 bp, Homo sapiens
ccttgtgccttcttt

SEQ ID NO: 2245454 - DNA, 18 bp, Homo sapiens
cctttaaggtactgaagc

SEQ ID NO: 2245455 - DNA, 13 bp, Homo sapiens
cctttaatgcatc

SEQ ID NO: 2245456 - DNA, 23 bp, Homo sapiens
cctttattaccccctccttcaga

SEQ ID NO: 2245457 - DNA, 14 bp, Homo sapiens
cctttccgctgtcg

SEQ ID NO: 2245458 - DNA, 16 bp, Homo sapiens
cctttccgctgtcgcc

SEQ ID NO: 2245459 - DNA, 12 bp, Homo sapiens
ccttttactgtg

SEQ ID NO: 2245460 - DNA, 18 bp, Homo sapiens
ccttttagaaacctcatt

SEQ ID NO: 2245461 - DNA, 20 bp, Homo sapiens
ccttttagaaacctcattgg

SEQ ID NO: 2245462 - DNA, 11 bp, Homo sapiens
cctttttaagg

SEQ ID NO: 2245463 - DNA, 13 bp, Homo sapiens
cgaccgccccctc

SEQ ID NO: 2245464 - DNA, 10 bp, Homo sapiens
cgactccagc

SEQ ID NO: 2245465 - DNA, 13 bp, Homo sapiens
cgactccagccag

SEQ ID NO: 2245466 - DNA, 14 bp, Homo sapiens
cgactccagccagc

SEQ ID NO: 2245467 - DNA, 18 bp, Homo sapiens
cgactccagccagcgcct

SEQ ID NO: 2245468 - DNA, 20 bp, Homo sapiens
cgactccagccagcgcctcc

SEQ ID NO: 2245469 - DNA, 18 bp, Homo sapiens
cgactgaaaatattgttt

SEQ ID NO: 2245470 - DNA, 22 bp, Homo sapiens
cgacttttttgagacatgggat

SEQ ID NO: 2245471 - DNA, 13 bp, Homo sapiens
cgagacccccatc

SEQ ID NO: 2245472 - DNA, 15 bp, Homo sapiens
cgagacccccatcca

SEQ ID NO: 2245473 - DNA, 17 bp, Homo sapiens
cgagacccccatccagc

SEQ ID NO: 2245474 - DNA, 20 bp, Homo sapiens
cgagacccccatccagcctc

SEQ ID NO: 2245475 - DNA, 22 bp, Homo sapiens
cgagacccccatccagcctcca

SEQ ID NO: 2245476 - DNA, 23 bp, Homo sapiens
cgagacccccatccagcctccag

SEQ ID NO: 2245477 - DNA, 19 bp, Homo sapiens
cgaggcaggaggagcccgg

SEQ ID NO: 2245478 - DNA, 14 bp, Homo sapiens
cgagggccaggcac

SEQ ID NO: 2245479 - DNA, 21 bp, Homo sapiens
cgagtgatttccatctctggt

SEQ ID NO: 2245480 - DNA, 18 bp, Homo sapiens
cgcaacgtctaactggac

SEQ ID NO: 2245481 - DNA, 18 bp, Homo sapiens
cgcagggaatgcagcagg

SEQ ID NO: 2245482 - DNA, 19 bp, Homo sapiens
cgcagggaatgcagcagga

SEQ ID NO: 2245483 - DNA, 19 bp, Homo sapiens
cgccaacgttcgatttcta

SEQ ID NO: 2245484 - DNA, 20 bp, Homo sapiens
cgccaacgttcgatttctac

SEQ ID NO: 2245485 - DNA, 14 bp, Homo sapiens
cgccactcatttca

SEQ ID NO: 2245486 - DNA, 17 bp, Homo sapiens
cgccactcatttcatct

SEQ ID NO: 2245487 - DNA, 21 bp, Homo sapiens
cgcccacaggaagcctgcagt

SEQ ID NO: 2245488 - DNA, 12 bp, Homo sapiens
cgccccaggccc

SEQ ID NO: 2245489 - DNA, 12 bp, Homo sapiens
cgccctgggctg

SEQ ID NO: 2245490 - DNA, 19 bp, Homo sapiens
cgccctgggctgtctgtca

SEQ ID NO: 2245491 - DNA, 22 bp, Homo sapiens
cgccctgggctgtctgtcacca

SEQ ID NO: 2245492 - DNA, 15 bp, Homo sapiens
cgccggatctgaggg

SEQ ID NO: 2245493 - DNA, 18 bp, Homo sapiens
cgcctccctccaccccag

SEQ ID NO: 2245494 - DNA, 13 bp, Homo sapiens
cgcctcctggcca

SEQ ID NO: 2245495 - DNA, 15 bp, Homo sapiens
cgcctcctggccaga

SEQ ID NO: 2245496 - DNA, 18 bp, Homo sapiens
cgcgccccagtcacttcc

SEQ ID NO: 2245497 - DNA, 20 bp, Homo sapiens
cgctactatgatttaatttg

SEQ ID NO: 2245498 - DNA, 18 bp, Homo sapiens
cgctgccgctgccgctgc

SEQ ID NO: 2245499 - DNA, 22 bp, Homo sapiens
cgctgggtggtaccctctggag

SEQ ID NO: 2245500 - DNA, 23 bp, Homo sapiens
cgctgtcctctcgagcccagatg

SEQ ID NO: 2245501 - DNA, 17 bp, Homo sapiens
cgctgtcgccccaggcc

SEQ ID NO: 2245502 - DNA, 20 bp, Homo sapiens
cgctgtgcccccctcctccc

SEQ ID NO: 2245503 - DNA, 19 bp, Homo sapiens
cggaacccaagcttagaac

SEQ ID NO: 2245504 - DNA, 15 bp, Homo sapiens
cggaccccagccatc

SEQ ID NO: 2245505 - DNA, 14 bp, Homo sapiens
cggagaccctgagt

SEQ ID NO: 2245506 - DNA, 12 bp, Homo sapiens
cggagagagcca

SEQ ID NO: 2245507 - DNA, 20 bp, Homo sapiens
cggaggaggggaaggggctg

SEQ ID NO: 2245508 - DNA, 20 bp, Homo sapiens
cggaggctgggcccctggga

SEQ ID NO: 2245509 - DNA, 17 bp, Homo sapiens
cggcaacgtagcctggg

SEQ ID NO: 2245510 - DNA, 18 bp, Homo sapiens
cggcaacgtagcctgggc

SEQ ID NO: 2245511 - DNA, 23 bp, Homo sapiens
cggcgggatcctccacagagagg

SEQ ID NO: 2245512 - DNA, 21 bp, Homo sapiens
cggcggtggactgcgctggac

SEQ ID NO: 2245513 - DNA, 16 bp, Homo sapiens
cggcttcatgccagct

SEQ ID NO: 2245514 - DNA, 16 bp, Homo sapiens
cgggaacatgccccct

SEQ ID NO: 2245515 - DNA, 23 bp, Homo sapiens
cgggatcctccacagagaggagg

SEQ ID NO: 2245516 - DNA, 23 bp, Homo sapiens
cgggcaggtcctgcccatgtgtc

SEQ ID NO: 2245517 - DNA, 15 bp, Homo sapiens
cgggctctgacagcc

SEQ ID NO: 2245518 - DNA, 20 bp, Homo sapiens
cgggtgtggcctcagccctc

SEQ ID NO: 2245519 - DNA, 13 bp, Homo sapiens
cgtataatcttgt

SEQ ID NO: 2245520 - DNA, 11 bp, Homo sapiens
cgtctcagtgt

SEQ ID NO: 2245521 - DNA, 16 bp, Homo sapiens
cgtgaaaacggagctg

SEQ ID NO: 2245522 - DNA, 14 bp, Homo sapiens
cgtgaatgtctcag

SEQ ID NO: 2245523 - DNA, 16 bp, Homo sapiens
cgtgccatgatctgta

SEQ ID NO: 2245524 - DNA, 21 bp, Homo sapiens
cgtggcctcccaaagtgctgg

SEQ ID NO: 2245525 - DNA, 14 bp, Homo sapiens
cgtgtcacacttgt

SEQ ID NO: 2245526 - DNA, 15 bp, Homo sapiens
cgttaaataagcaaa

SEQ ID NO: 2245527 - DNA, 15 bp, Homo sapiens
cgttatatattgtat

SEQ ID NO: 2245528 - DNA, 21 bp, Homo sapiens
cgttccaccccaagagaactc

SEQ ID NO: 2245529 - DNA, 19 bp, Homo sapiens
cgttgagtgtacagatttt

SEQ ID NO: 2245530 - DNA, 18 bp, Homo sapiens
cgtttctccacctagact

SEQ ID NO: 2245531 - DNA, 14 bp, Homo sapiens
cgttttccccatga

SEQ ID NO: 2245532 - DNA, 12 bp, Homo sapiens
cgtttttacata

SEQ ID NO: 2245533 - DNA, 18 bp, Homo sapiens
cgtttttgtgctgtgggc

SEQ ID NO: 2245534 - DNA, 16 bp, Homo sapiens
catgcgtcaggggcct

SEQ ID NO: 2245535 - DNA, 17 bp, Homo sapiens
catgctgctatacacaa

SEQ ID NO: 2245536 - DNA, 20 bp, Homo sapiens
catgggatccaattttaata

SEQ ID NO: 2245537 - DNA, 20 bp, Homo sapiens
catggtttaaaagaaaaaat

SEQ ID NO: 2245538 - DNA, 22 bp, Homo sapiens
catggtttaaaagaaaaaatga

SEQ ID NO: 2245539 - DNA, 18 bp, Homo sapiens
catgtaaagtgtcagaag

SEQ ID NO: 2245540 - DNA, 15 bp, Homo sapiens
catgtaatggactat

SEQ ID NO: 2245541 - DNA, 22 bp, Homo sapiens
catgtactttttagtaatttct

SEQ ID NO: 2245542 - DNA, 19 bp, Homo sapiens
catgtagcagtgagtcata

SEQ ID NO: 2245543 - DNA, 19 bp, Homo sapiens
ccttacaacgccgagtgca

SEQ ID NO: 2245544 - DNA, 20 bp, Homo sapiens
ccttacaacgccgagtgcac

SEQ ID NO: 2245545 - DNA, 12 bp, Homo sapiens
ccttataaaatc

SEQ ID NO: 2245546 - DNA, 15 bp, Homo sapiens
ccttcaaagaaactt

SEQ ID NO: 2245547 - DNA, 15 bp, Homo sapiens
ccttcacagtcccag

SEQ ID NO: 2245548 - DNA, 16 bp, Homo sapiens
ccttcacagtcccagg

SEQ ID NO: 2245549 - DNA, 22 bp, Homo sapiens
ccttccagtgtccttagaacat

SEQ ID NO: 2245550 - DNA, 14 bp, Homo sapiens
ccttcccatcgctg

SEQ ID NO: 2245551 - DNA, 17 bp, Homo sapiens
ccttcctcatccacccc

SEQ ID NO: 2245552 - DNA, 19 bp, Homo sapiens
ccttcctcatccaccccat

SEQ ID NO: 2245553 - DNA, 15 bp, Homo sapiens
ccttcctctctccag

SEQ ID NO: 2245554 - DNA, 15 bp, Homo sapiens
ccttctattggtctc

SEQ ID NO: 2245555 - DNA, 14 bp, Homo sapiens
ccttctgcagcagg

SEQ ID NO: 2245556 - DNA, 11 bp, Homo sapiens
ccttctgctgt

SEQ ID NO: 2245557 - DNA, 23 bp, Homo sapiens
ccttgataatatattgtgttgac

SEQ ID NO: 2245558 - DNA, 14 bp, Homo sapiens
ccttgctggcccca

SEQ ID NO: 2245559 - DNA, 16 bp, Homo sapiens
ccttgctggccccagc

SEQ ID NO: 2245560 - DNA, 17 bp, Homo sapiens
ccttgctggccccagcc

SEQ ID NO: 2245561 - DNA, 19 bp, Homo sapiens
ccttgctggccccagccct

SEQ ID NO: 2245562 - DNA, 21 bp, Homo sapiens
ccttgctggccccagccctgc

SEQ ID NO: 2245563 - DNA, 15 bp, Homo sapiens
ccttggccacagact

SEQ ID NO: 2245564 - DNA, 17 bp, Homo sapiens
ccttggccacagactga

SEQ ID NO: 2245565 - DNA, 22 bp, Homo sapiens
ctccagccagcgcctccctcca

SEQ ID NO: 2245566 - DNA, 23 bp, Homo sapiens
ctccagccagcgcctccctccac

SEQ ID NO: 2245567 - DNA, 18 bp, Homo sapiens
ctccatagtttggcattt

SEQ ID NO: 2245568 - DNA, 14 bp, Homo sapiens
ctcccaccagagcc

SEQ ID NO: 2245569 - DNA, 11 bp, Homo sapiens
ctcccaccccc

SEQ ID NO: 2245570 - DNA, 21 bp, Homo sapiens
ctcccaggaagcccaggagcc

SEQ ID NO: 2245571 - DNA, 14 bp, Homo sapiens
ctccccagccccag

SEQ ID NO: 2245572 - DNA, 15 bp, Homo sapiens
ctccccagccccagc

SEQ ID NO: 2245573 - DNA, 11 bp, Homo sapiens
ctccccagttc

SEQ ID NO: 2245574 - DNA, 12 bp, Homo sapiens
ctccccatggag

SEQ ID NO: 2245575 - DNA, 17 bp, Homo sapiens
ctccccatggagccagc

SEQ ID NO: 2245576 - DNA, 18 bp, Homo sapiens
ctccccatgtgtcctggt

SEQ ID NO: 2245577 - DNA, 15 bp, Homo sapiens
ctcccccatgggctg

SEQ ID NO: 2245578 - DNA, 16 bp, Homo sapiens
ctccccctccttgtgc

SEQ ID NO: 2245579 - DNA, 18 bp, Homo sapiens
ctccccgcgccccagtca

SEQ ID NO: 2245580 - DNA, 16 bp, Homo sapiens
ctcccctaaagcctca

SEQ ID NO: 2245581 - DNA, 23 bp, Homo sapiens
ctcccctaaagcctcaaaacaaa

SEQ ID NO: 2245582 - DNA, 19 bp, Homo sapiens
ctcccctctccccgggacc

SEQ ID NO: 2245583 - DNA, 11 bp, Homo sapiens
ctcccctgagg

SEQ ID NO: 2245584 - DNA, 12 bp, Homo sapiens
ctcccctgagga

SEQ ID NO: 2245585 - DNA, 13 bp, Homo sapiens
ctcccgtcactcc

SEQ ID NO: 2245586 - DNA, 15 bp, Homo sapiens
ctccctccaccccag

SEQ ID NO: 2245587 - DNA, 19 bp, Homo sapiens
ctccctccaccccaggacg

SEQ ID NO: 2245588 - DNA, 13 bp, Homo sapiens
ctccctctctctt

SEQ ID NO: 2245589 - DNA, 19 bp, Homo sapiens
ctccctgactccctgtggg

SEQ ID NO: 2245590 - DNA, 20 bp, Homo sapiens
ctccctgactccctgtgggg

SEQ ID NO: 2245591 - DNA, 20 bp, Homo sapiens
ctccctgatcccaccccctc

SEQ ID NO: 2245592 - DNA, 14 bp, Homo sapiens
ctccctggcaggat

SEQ ID NO: 2245593 - DNA, 21 bp, Homo sapiens
ctccctgtgggggtggccatc

SEQ ID NO: 2245594 - DNA, 21 bp, Homo sapiens
ctcccttctctacactcttgt

SEQ ID NO: 2245595 - DNA, 22 bp, Homo sapiens
ctcccttgctggccccagccct

SEQ ID NO: 2245596 - DNA, 15 bp, Homo sapiens
ctccgaggagctggg

SEQ ID NO: 2245597 - DNA, 15 bp, Homo sapiens
ctccgcggctggagc

SEQ ID NO: 2245598 - DNA, 16 bp, Homo sapiens
ctccgggtgtggcctc

SEQ ID NO: 2245599 - DNA, 21 bp, Homo sapiens
ctccgggtgtggcctcagccc

SEQ ID NO: 2245600 - DNA, 19 bp, Homo sapiens
ctccgtcctctccccagcc

SEQ ID NO: 2245601 - DNA, 20 bp, Homo sapiens
ctccgtcctctccccagcct

SEQ ID NO: 2245602 - DNA, 18 bp, Homo sapiens
ctcctaggttcttaagga

SEQ ID NO: 2245603 - DNA, 15 bp, Homo sapiens
ctcctatatatttct

SEQ ID NO: 2245604 - DNA, 12 bp, Homo sapiens
ctcctcatcccg

SEQ ID NO: 2245605 - DNA, 12 bp, Homo sapiens
ctcctcccccag

SEQ ID NO: 2245606 - DNA, 20 bp, Homo sapiens
ctcctccccgcgccccagtc

SEQ ID NO: 2245607 - DNA, 22 bp, Homo sapiens
ctcctccccgcgccccagtcac

SEQ ID NO: 2245608 - DNA, 16 bp, Homo sapiens
ctcctgacccctgcct

SEQ ID NO: 2245609 - DNA, 23 bp, Homo sapiens
ctcctggccagacgctgccgctg

SEQ ID NO: 2245610 - DNA, 14 bp, Homo sapiens
ctcctgggggtggc

SEQ ID NO: 2245611 - DNA, 24 bp, Homo sapiens
ctcctgggggtggcaggcacacag

SEQ ID NO: 2245612 - DNA, 22 bp, Homo sapiens
ctcctgtaacatactggcctgg

SEQ ID NO: 2245613 - DNA, 23 bp, Homo sapiens
ctcctgtgtcggggctgacctct

SEQ ID NO: 2245614 - DNA, 20 bp, Homo sapiens
ctcctgtgttgtgctgggag

SEQ ID NO: 2245615 - DNA, 14 bp, Homo sapiens
ctgcaacaaaaagt

SEQ ID NO: 2245616 - DNA, 21 bp, Homo sapiens
ctgcaagaccacggagggagc

SEQ ID NO: 2245617 - DNA, 21 bp, Homo sapiens
ctgcaataatatcaaaacaag

SEQ ID NO: 2245618 - DNA, 16 bp, Homo sapiens
ctgcaattcccctctg

SEQ ID NO: 2245619 - DNA, 18 bp, Homo sapiens
ctgcacaccctccagaga

SEQ ID NO: 2245620 - DNA, 16 bp, Homo sapiens
ctgcactggggagccc

SEQ ID NO: 2245621 - DNA, 22 bp, Homo sapiens
ctgcactggggagcccgtctca

SEQ ID NO: 2245622 - DNA, 20 bp, Homo sapiens
ctgcagaaaccctgagcaga

SEQ ID NO: 2245623 - DNA, 21 bp, Homo sapiens
ctgcagcaggaactctggacc

SEQ ID NO: 2245624 - DNA, 22 bp, Homo sapiens
ctgcagctatgcgcaatgtggc

SEQ ID NO: 2245625 - DNA, 22 bp, Homo sapiens
ctgcaggcaggaacaaacaggg

SEQ ID NO: 2245626 - DNA, 13 bp, Homo sapiens
ctgcagtcctgga

SEQ ID NO: 2245627 - DNA, 15 bp, Homo sapiens
ctgcagtgaccactt

SEQ ID NO: 2245628 - DNA, 16 bp, Homo sapiens
ctgcagttgactttct

SEQ ID NO: 2245629 - DNA, 16 bp, Homo sapiens
ctgcagttttgctatc

SEQ ID NO: 2245630 - DNA, 18 bp, Homo sapiens
ctgcatgcaaacaagaaa

SEQ ID NO: 2245631 - DNA, 17 bp, Homo sapiens
ctgcattgagcttgcat

SEQ ID NO: 2245632 - DNA, 14 bp, Homo sapiens
ctgccccaccccat

SEQ ID NO: 2245633 - DNA, 18 bp, Homo sapiens
ctgccccaccccatccag

SEQ ID NO: 2245634 - DNA, 13 bp, Homo sapiens
ctgcccctctcac

SEQ ID NO: 2245635 - DNA, 19 bp, Homo sapiens
ctgccctcatggcccctct

SEQ ID NO: 2245636 - DNA, 14 bp, Homo sapiens
ctgccgctgcacca

SEQ ID NO: 2245637 - DNA, 13 bp, Homo sapiens
ctgcctgtcccca

SEQ ID NO: 2245638 - DNA, 18 bp, Homo sapiens
ctgcctgttggcaggccc

SEQ ID NO: 2245639 - DNA, 19 bp, Homo sapiens
ctgcctgttggcaggccca

SEQ ID NO: 2245640 - DNA, 21 bp, Homo sapiens
ctgcctgttggcaggcccact

SEQ ID NO: 2245641 - DNA, 16 bp, Homo sapiens
ctgccttagtctcagt

SEQ ID NO: 2245642 - DNA, 15 bp, Homo sapiens
ctgccttggctcaga

SEQ ID NO: 2245643 - DNA, 18 bp, Homo sapiens
ctgcgggctccctggcag

SEQ ID NO: 2245644 - DNA, 12 bp, Homo sapiens
ctgctaaataaa

SEQ ID NO: 2245645 - DNA, 18 bp, Homo sapiens
ctgctactgtaattttat

SEQ ID NO: 2245646 - DNA, 19 bp, Homo sapiens
ctgctccaccctcccccag

SEQ ID NO: 2245647 - DNA, 16 bp, Homo sapiens
ctgctccccaggggag

SEQ ID NO: 2245648 - DNA, 19 bp, Homo sapiens
ctgctcccctaaagcctca

SEQ ID NO: 2245649 - DNA, 18 bp, Homo sapiens
ctgctcgtggactgtgct

SEQ ID NO: 2245650 - DNA, 13 bp, Homo sapiens
ctgctggggatcc

SEQ ID NO: 2245651 - DNA, 17 bp, Homo sapiens
ctgcttttatctcagat

SEQ ID NO: 2245652 - DNA, 12 bp, Homo sapiens
ctgcttttgcat

SEQ ID NO: 2245653 - DNA, 22 bp, Homo sapiens
ctggaaggcagcttgtggaggc

SEQ ID NO: 2245654 - DNA, 19 bp, Homo sapiens
ctggaaggggaagggacac

SEQ ID NO: 2245655 - DNA, 19 bp, Homo sapiens
ctggaatctggagaccagg

SEQ ID NO: 2245656 - DNA, 24 bp, Homo sapiens
ctggaatctggagaccagggagcc

SEQ ID NO: 2245657 - DNA, 15 bp, Homo sapiens
ctggacactcagacc

SEQ ID NO: 2245658 - DNA, 22 bp, Homo sapiens
ctggacatttaacttttctacc

SEQ ID NO: 2245659 - DNA, 22 bp, Homo sapiens
ctggacctgcctgctgcagtca

SEQ ID NO: 2245660 - DNA, 19 bp, Homo sapiens
ctggacgatagcttggagg

SEQ ID NO: 2245661 - DNA, 17 bp, Homo sapiens
ctggagaccagggagcc

SEQ ID NO: 2245662 - DNA, 22 bp, Homo sapiens
ctggagcagaccaccccgcctg

SEQ ID NO: 2245663 - DNA, 18 bp, Homo sapiens
ctggagcgaagccttctg

SEQ ID NO: 2245664 - DNA, 20 bp, Homo sapiens
ctggaggggtgtggctcctt

SEQ ID NO: 2245665 - DNA, 19 bp, Homo sapiens
ctggcaaagcttttagaaa

SEQ ID NO: 2245666 - DNA, 18 bp, Homo sapiens
ctggcattagaattattt

SEQ ID NO: 2245667 - DNA, 19 bp, Homo sapiens
ctggcattagaattattta

SEQ ID NO: 2245668 - DNA, 13 bp, Homo sapiens
ctggccagaatgc

SEQ ID NO: 2245669 - DNA, 22 bp, Homo sapiens
ctggccagcaccctctcctggg

SEQ ID NO: 2245670 - DNA, 12 bp, Homo sapiens
ctggccccagcc

SEQ ID NO: 2245671 - DNA, 14 bp, Homo sapiens
ctggccccagccct

SEQ ID NO: 2245672 - DNA, 13 bp, Homo sapiens
ctggccgccccct

SEQ ID NO: 2245673 - DNA, 14 bp, Homo sapiens
ctggccgccccctg

SEQ ID NO: 2245674 - DNA, 22 bp, Homo sapiens
ctggcctggaatttgggcagat

SEQ ID NO: 2245675 - DNA, 20 bp, Homo sapiens
ctggctctgccccctccccc

SEQ ID NO: 2245676 - DNA, 20 bp, Homo sapiens
ctggctcttgatacccccct

SEQ ID NO: 2245677 - DNA, 21 bp, Homo sapiens
ctggctcttgatacccccctc

SEQ ID NO: 2245678 - DNA, 21 bp, Homo sapiens
ctggctggtgggcccccaatg

SEQ ID NO: 2245679 - DNA, 14 bp, Homo sapiens
ctgggaatgggaga

SEQ ID NO: 2245680 - DNA, 16 bp, Homo sapiens
ctgggaatgggagagg

SEQ ID NO: 2245681 - DNA, 15 bp, Homo sapiens
ctgggatgggaccag

SEQ ID NO: 2245682 - DNA, 21 bp, Homo sapiens
ctgggccaggaggtagtttct

SEQ ID NO: 2245683 - DNA, 18 bp, Homo sapiens
ctgggccatgtccaaaga

SEQ ID NO: 2245684 - DNA, 19 bp, Homo sapiens
ctgggccatgtccaaagag

SEQ ID NO: 2245685 - DNA, 17 bp, Homo sapiens
ctgggcccctccacgcc

SEQ ID NO: 2245686 - DNA, 20 bp, Homo sapiens
ctgggcccctccacgcctcc

SEQ ID NO: 2245687 - DNA, 22 bp, Homo sapiens
ctgggcccctccacgcctcctg

SEQ ID NO: 2245688 - DNA, 20 bp, Homo sapiens
ctgggcctcagttcaacctg

SEQ ID NO: 2245689 - DNA, 18 bp, Homo sapiens
ctgggcctcatcacagca

SEQ ID NO: 2245690 - DNA, 14 bp, Homo sapiens
ctgggctcactgtg

SEQ ID NO: 2245691 - DNA, 23 bp, Homo sapiens
ctgggctctgcaattcccctctg

SEQ ID NO: 2245692 - DNA, 20 bp, Homo sapiens
ctggggacctggtaccctcc

SEQ ID NO: 2245693 - DNA, 20 bp, Homo sapiens
ctggggagcccgtctcagtg

SEQ ID NO: 2245694 - DNA, 22 bp, Homo sapiens
ctggggatccccgcctggccag

SEQ ID NO: 2245695 - DNA, 17 bp, Homo sapiens
ctggggatcttcccaca

SEQ ID NO: 2245696 - DNA, 12 bp, Homo sapiens
ctggggcacggc

SEQ ID NO: 2245697 - DNA, 18 bp, Homo sapiens
ctggggcagacaataaac

SEQ ID NO: 2245698 - DNA, 17 bp, Homo sapiens
ctggggcaggctgggcc

SEQ ID NO: 2245699 - DNA, 13 bp, Homo sapiens
ctggggccctggg

SEQ ID NO: 2245700 - DNA, 14 bp, Homo sapiens
ctggggccctgggc

SEQ ID NO: 2245701 - DNA, 17 bp, Homo sapiens
ctggggccctgggcctc

SEQ ID NO: 2245702 - DNA, 18 bp, Homo sapiens
ctggggccctgggcctca

SEQ ID NO: 2245703 - DNA, 15 bp, Homo sapiens
ctggggcctccagaa

SEQ ID NO: 2245704 - DNA, 17 bp, Homo sapiens
ctggggcctccagaact

SEQ ID NO: 2245705 - DNA, 20 bp, Homo sapiens
ctggggcgggctaggaggag

SEQ ID NO: 2245706 - DNA, 17 bp, Homo sapiens
ctgggggtggcaggcac

SEQ ID NO: 2245707 - DNA, 18 bp, Homo sapiens
ctgggttaattcatttgg

SEQ ID NO: 2245708 - DNA, 14 bp, Homo sapiens
ctgggtttcctgca

SEQ ID NO: 2245709 - DNA, 15 bp, Homo sapiens
ctggtaccctcctgg

SEQ ID NO: 2245710 - DNA, 14 bp, Homo sapiens
ctggtgaatatttt

SEQ ID NO: 2245711 - DNA, 19 bp, Homo sapiens
ctggtggcaccagatgcaa

SEQ ID NO: 2245712 - DNA, 20 bp, Homo sapiens
ctggttcattcttcagatat

SEQ ID NO: 2245713 - DNA, 21 bp, Homo sapiens
ctgtaaagtctgagtaagaaa

SEQ ID NO: 2245714 - DNA, 19 bp, Homo sapiens
ctgtaacatactggcctgg

SEQ ID NO: 2245715 - DNA, 20 bp, Homo sapiens
ctgtaatatttaaatattac

SEQ ID NO: 2245716 - DNA, 20 bp, Homo sapiens
ctgtaatcgccctactattc

SEQ ID NO: 2245717 - DNA, 13 bp, Homo sapiens
ctgtaattttata

SEQ ID NO: 2245718 - DNA, 19 bp, Homo sapiens
ctgtacaaatgacactgca

SEQ ID NO: 2245719 - DNA, 16 bp, Homo sapiens
ctgtacctcaaatgaa

SEQ ID NO: 2245720 - DNA, 20 bp, Homo sapiens
ctgtacctcaaatgaattct

SEQ ID NO: 2245721 - DNA, 20 bp, Homo sapiens
ctgtactgttctgtgtcttt

SEQ ID NO: 2245722 - DNA, 17 bp, Homo sapiens
ctgtactttctatttta

SEQ ID NO: 2245723 - DNA, 17 bp, Homo sapiens
gaaaagggagtttaaaa

SEQ ID NO: 2245724 - DNA, 19 bp, Homo sapiens
gaaaagtgtgtatctagct

SEQ ID NO: 2245725 - DNA, 13 bp, Homo sapiens
gaaaatattctct

SEQ ID NO: 2245726 - DNA, 15 bp, Homo sapiens
gaaaatgttatttaa

SEQ ID NO: 2245727 - DNA, 18 bp, Homo sapiens
gaaaattgaaacacagag

SEQ ID NO: 2245728 - DNA, 11 bp, Homo sapiens
gaaaatttttt

SEQ ID NO: 2245729 - DNA, 19 bp, Homo sapiens
gaaacagtgcgttgagtgt

SEQ ID NO: 2245730 - DNA, 13 bp, Homo sapiens
gaaaccagaaaag

SEQ ID NO: 2245731 - DNA, 16 bp, Homo sapiens
gaaaccagaaaagcaa

SEQ ID NO: 2245732 - DNA, 19 bp, Homo sapiens
gaaacccctgtaggcctca

SEQ ID NO: 2245733 - DNA, 15 bp, Homo sapiens
gaaaccctgagcaga

SEQ ID NO: 2245734 - DNA, 16 bp, Homo sapiens
gaaacgtgtcacactt

SEQ ID NO: 2245735 - DNA, 17 bp, Homo sapiens
gaaactaagattctttt

SEQ ID NO: 2245736 - DNA, 17 bp, Homo sapiens
gaaactatgtgtttttc

SEQ ID NO: 2245737 - DNA, 18 bp, Homo sapiens
gaaactatgtgtttttct

SEQ ID NO: 2245738 - DNA, 21 bp, Homo sapiens
gaaactatgtgtttttctcat

SEQ ID NO: 2245739 - DNA, 16 bp, Homo sapiens
gaaactgggtttctca

SEQ ID NO: 2245740 - DNA, 19 bp, Homo sapiens
gaaactgggtttctcatta

SEQ ID NO: 2245741 - DNA, 20 bp, Homo sapiens
gaaagaacgctgatttaaag

SEQ ID NO: 2245742 - DNA, 20 bp, Homo sapiens
gaaaggattttaccaaagca

SEQ ID NO: 2245743 - DNA, 10 bp, Homo sapiens
gaaagggaaa

SEQ ID NO: 2245744 - DNA, 23 bp, Homo sapiens
gaaagtgtgtgtagttttacttt

SEQ ID NO: 2245745 - DNA, 17 bp, Homo sapiens
gaaatacagactggatg

SEQ ID NO: 2245746 - DNA, 18 bp, Homo sapiens
gaaatagacagcatgaga

SEQ ID NO: 2245747 - DNA, 18 bp, Homo sapiens
gaaatagttcaaactgca

SEQ ID NO: 2245748 - DNA, 22 bp, Homo sapiens
gaaatattaagcatgttttgtt

SEQ ID NO: 2245749 - DNA, 15 bp, Homo sapiens
gaaatctacttccta

SEQ ID NO: 2245750 - DNA, 20 bp, Homo sapiens
gaaatgaaaacagtgtgtaa

SEQ ID NO: 2245751 - DNA, 23 bp, Homo sapiens
gaaatgaaaacagtgtgtaaaca

SEQ ID NO: 2245752 - DNA, 13 bp, Homo sapiens
gaaatgaaaggga

SEQ ID NO: 2245753 - DNA, 19 bp, Homo sapiens
gaaatgggacttaactcct

SEQ ID NO: 2245754 - DNA, 20 bp, Homo sapiens
gaaatgtgaatttttattgt

SEQ ID NO: 2245755 - DNA, 14 bp, Homo sapiens
gaacaaaattattt

SEQ ID NO: 2245756 - DNA, 14 bp, Homo sapiens
gaacaaagacaggc

SEQ ID NO: 2245757 - DNA, 23 bp, Homo sapiens
gaacagccagttttactgtgatt

SEQ ID NO: 2245758 - DNA, 14 bp, Homo sapiens
gaacagtaagaaca

SEQ ID NO: 2245759 - DNA, 19 bp, Homo sapiens
gaacatcataaaattttta

SEQ ID NO: 2245760 - DNA, 14 bp, Homo sapiens
gaacatgccccctg

SEQ ID NO: 2245761 - DNA, 16 bp, Homo sapiens
gaaccagccgtatttt

SEQ ID NO: 2245762 - DNA, 13 bp, Homo sapiens
gaaccctttattt

SEQ ID NO: 2245763 - DNA, 15 bp, Homo sapiens
gaaccttccctccaa

SEQ ID NO: 2245764 - DNA, 14 bp, Homo sapiens
gaactcactggggc

SEQ ID NO: 2245765 - DNA, 16 bp, Homo sapiens
gaactcactggggcct

SEQ ID NO: 2245766 - DNA, 17 bp, Homo sapiens
gaactcgcgctcagtaa

SEQ ID NO: 2245767 - DNA, 22 bp, Homo sapiens
gaactctggacccctgggcctc

SEQ ID NO: 2245768 - DNA, 22 bp, Homo sapiens
gaagaacgcggtgtgtaacact

SEQ ID NO: 2245769 - DNA, 22 bp, Homo sapiens
gaagaacgttttttcctcagtg

SEQ ID NO: 2245770 - DNA, 17 bp, Homo sapiens
gaagaagagatgacaaa

SEQ ID NO: 2245771 - DNA, 15 bp, Homo sapiens
gaagagacagcccag

SEQ ID NO: 2245772 - DNA, 21 bp, Homo sapiens
gaagattctatttaattgaaa

SEQ ID NO: 2245773 - DNA, 22 bp, Homo sapiens
gaagccatccctttttttacat

SEQ ID NO: 2245774 - DNA, 14 bp, Homo sapiens
gaagcccaggagcc

SEQ ID NO: 2245775 - DNA, 19 bp, Homo sapiens
gaagcctctctccttggcc

SEQ ID NO: 2245776 - DNA, 17 bp, Homo sapiens
gaagccttctgcagcag

SEQ ID NO: 2245777 - DNA, 19 bp, Homo sapiens
gaagcggagagagccaaga

SEQ ID NO: 2245778 - DNA, 21 bp, Homo sapiens
gaagcggagagagccaagacg

SEQ ID NO: 2245779 - DNA, 23 bp, Homo sapiens
gaagctttgtaggtgagatgcaa

SEQ ID NO: 2245780 - DNA, 15 bp, Homo sapiens
gaagggaagagacag

SEQ ID NO: 2245781 - DNA, 21 bp, Homo sapiens
gaaggggctgaggacgagacc

SEQ ID NO: 2245782 - DNA, 13 bp, Homo sapiens
gaaggtttattgt

SEQ ID NO: 2245783 - DNA, 17 bp, Homo sapiens
gaagtaagcaaacaaat

SEQ ID NO: 2245784 - DNA, 21 bp, Homo sapiens
gaagtgcttagtgtacttgga

SEQ ID NO: 2245785 - DNA, 14 bp, Homo sapiens
gaagtgtataatat

SEQ ID NO: 2245786 - DNA, 15 bp, Homo sapiens
gaagttctttgatcc

SEQ ID NO: 2245787 - DNA, 18 bp, Homo sapiens
gaataagttattgcagtt

SEQ ID NO: 2245788 - DNA, 22 bp, Homo sapiens
gaataggcagggggccctgccc

SEQ ID NO: 2245789 - DNA, 19 bp, Homo sapiens
gaatattgccattatgctt

SEQ ID NO: 2245790 - DNA, 19 bp, Homo sapiens
gaatcacctcctgtgttgt

SEQ ID NO: 2245791 - DNA, 19 bp, Homo sapiens
gaatctcgcagtgtttctg

SEQ ID NO: 2245792 - DNA, 13 bp, Homo sapiens
gaatgcagcagga

SEQ ID NO: 2245793 - DNA, 13 bp, Homo sapiens
gaatgctgagacc

SEQ ID NO: 2245794 - DNA, 21 bp, Homo sapiens
gaatgctgcaggacttgagaa

SEQ ID NO: 2245795 - DNA, 12 bp, Homo sapiens
gaatgtctcagc

SEQ ID NO: 2245796 - DNA, 23 bp, Homo sapiens
gaatgttgggactgctaaataaa

SEQ ID NO: 2245797 - DNA, 14 bp, Homo sapiens
gaattaaaaaagca

SEQ ID NO: 2245798 - DNA, 15 bp, Homo sapiens
gaattacgtgctctg

SEQ ID NO: 2245799 - DNA, 14 bp, Homo sapiens
gaattatttctgtc

SEQ ID NO: 2245800 - DNA, 12 bp, Homo sapiens
gaattccctccc

SEQ ID NO: 2245801 - DNA, 14 bp, Homo sapiens
gaattccctccccc

SEQ ID NO: 2245802 - DNA, 14 bp, Homo sapiens
gaattgaactctct

SEQ ID NO: 2245803 - DNA, 15 bp, Homo sapiens
gaattttaaataatg

SEQ ID NO: 2245804 - DNA, 23 bp, Homo sapiens
gaattttaaataatgtatttact

SEQ ID NO: 2245805 - DNA, 18 bp, Homo sapiens
gacaaaaaatgttttaaa

SEQ ID NO: 2245806 - DNA, 23 bp, Homo sapiens
gacaacatcgcaatagtttttta

SEQ ID NO: 2245807 - DNA, 13 bp, Homo sapiens
gacaaccttgtcc

SEQ ID NO: 2245808 - DNA, 22 bp, Homo sapiens
gacaataaaccctcagagcctc

SEQ ID NO: 2245809 - DNA, 17 bp, Homo sapiens
gacaatgttgtagtgtc

SEQ ID NO: 2245810 - DNA, 18 bp, Homo sapiens
gacaatgttgtagtgtcc

SEQ ID NO: 2245811 - DNA, 20 bp, Homo sapiens
gacacagcttaacaatgcaa

SEQ ID NO: 2245812 - DNA, 17 bp, Homo sapiens
gacacccatgccagaga

SEQ ID NO: 2245813 - DNA, 19 bp, Homo sapiens
gacacccatgccagagagg

SEQ ID NO: 2245814 - DNA, 12 bp, Homo sapiens
gacacctccccc

SEQ ID NO: 2245815 - DNA, 22 bp, Homo sapiens
gacacctccccctttcacactg

SEQ ID NO: 2245816 - DNA, 23 bp, Homo sapiens
gacacctccccctttcacactgg

SEQ ID NO: 2245817 - DNA, 13 bp, Homo sapiens
gacactggcccct

SEQ ID NO: 2245818 - DNA, 22 bp, Homo sapiens
gacagaatgtgtctcaggaaaa

SEQ ID NO: 2245819 - DNA, 16 bp, Homo sapiens
gacaggaaagccctcc

SEQ ID NO: 2245820 - DNA, 17 bp, Homo sapiens
gacaggaaagccctccc

SEQ ID NO: 2245821 - DNA, 21 bp, Homo sapiens
gacagggacatgccctgtgtg

SEQ ID NO: 2245822 - DNA, 14 bp, Homo sapiens
gacagtccacaggg

SEQ ID NO: 2245823 - DNA, 18 bp, Homo sapiens
gacagtccacaggggcca

SEQ ID NO: 2245824 - DNA, 14 bp, Homo sapiens
gacatctggaatct

SEQ ID NO: 2245825 - DNA, 21 bp, Homo sapiens
gacattgtctcctatatattt

SEQ ID NO: 2245826 - DNA, 17 bp, Homo sapiens
gacatttaacttttcta

SEQ ID NO: 2245827 - DNA, 14 bp, Homo sapiens
gaggaaaggatttt

SEQ ID NO: 2245828 - DNA, 22 bp, Homo sapiens
gaggaaaggattttaccaaagc

SEQ ID NO: 2245829 - DNA, 19 bp, Homo sapiens
gaggaacaatcggctgcat

SEQ ID NO: 2245830 - DNA, 18 bp, Homo sapiens
gaggacaagagaaaaaag

SEQ ID NO: 2245831 - DNA, 17 bp, Homo sapiens
gaggacgagacccccat

SEQ ID NO: 2245832 - DNA, 19 bp, Homo sapiens
gaggacgagacccccatcc

SEQ ID NO: 2245833 - DNA, 12 bp, Homo sapiens
gaggactggacc

SEQ ID NO: 2245834 - DNA, 20 bp, Homo sapiens
gaggaggggaaggggctgag

SEQ ID NO: 2245835 - DNA, 23 bp, Homo sapiens
gaggaggggaaggggctgaggac

SEQ ID NO: 2245836 - DNA, 17 bp, Homo sapiens
gaggatacagaggagat

SEQ ID NO: 2245837 - DNA, 14 bp, Homo sapiens
gaggctcagattgt

SEQ ID NO: 2245838 - DNA, 13 bp, Homo sapiens
gaggctggcaggg

SEQ ID NO: 2245839 - DNA, 14 bp, Homo sapiens
gaggctgggcccct

SEQ ID NO: 2245840 - DNA, 15 bp, Homo sapiens
gaggctgggcccctg

SEQ ID NO: 2245841 - DNA, 17 bp, Homo sapiens
gaggctgggcccctggg

SEQ ID NO: 2245842 - DNA, 19 bp, Homo sapiens
gaggctgggcccctgggat

SEQ ID NO: 2245843 - DNA, 21 bp, Homo sapiens
gagggatggagaggcggcctc

SEQ ID NO: 2245844 - DNA, 21 bp, Homo sapiens
gaggtaactatcaatatttaa

SEQ ID NO: 2245845 - DNA, 14 bp, Homo sapiens
gaggttgggtgggc

SEQ ID NO: 2245846 - DNA, 19 bp, Homo sapiens
agccagcgcctccctccac

SEQ ID NO: 2245847 - DNA, 22 bp, Homo sapiens
agccagcgcctccctccacccc

SEQ ID NO: 2245848 - DNA, 19 bp, Homo sapiens
agccagctccctctattta

SEQ ID NO: 2245849 - DNA, 19 bp, Homo sapiens
agccaggaggcctgctagg

SEQ ID NO: 2245850 - DNA, 18 bp, Homo sapiens
agccaggttccacagagg

SEQ ID NO: 2245851 - DNA, 15 bp, Homo sapiens
agccatgccaataaa

SEQ ID NO: 2245852 - DNA, 16 bp, Homo sapiens
agccatgccaataaag

SEQ ID NO: 2245853 - DNA, 13 bp, Homo sapiens
agccattgaaatg

SEQ ID NO: 2245854 - DNA, 20 bp, Homo sapiens
agcccagatggaaagacgtt

SEQ ID NO: 2245855 - DNA, 15 bp, Homo sapiens
agcccaggagcctca

SEQ ID NO: 2245856 - DNA, 23 bp, Homo sapiens
agcccaggatactggcacagagg

SEQ ID NO: 2245857 - DNA, 13 bp, Homo sapiens
agccccagcccct

SEQ ID NO: 2245858 - DNA, 13 bp, Homo sapiens
agccccccagcac

SEQ ID NO: 2245859 - DNA, 14 bp, Homo sapiens
agccccctggcctc

SEQ ID NO: 2245860 - DNA, 16 bp, Homo sapiens
agcccctgggcccagt

SEQ ID NO: 2245861 - DNA, 14 bp, Homo sapiens
agcccgtctcagtg

SEQ ID NO: 2245862 - DNA, 22 bp, Homo sapiens
agccctcaactattctgttcca

SEQ ID NO: 2245863 - DNA, 12 bp, Homo sapiens
agccctccccat

SEQ ID NO: 2245864 - DNA, 19 bp, Homo sapiens
agccctccccatggagcca

SEQ ID NO: 2245865 - DNA, 20 bp, Homo sapiens
agccctccccatggagccag

SEQ ID NO: 2245866 - DNA, 23 bp, Homo sapiens
agccgcacatctggtctcggagc

SEQ ID NO: 2245867 - DNA, 12 bp, Homo sapiens
agcctaagggat

SEQ ID NO: 2245868 - DNA, 16 bp, Homo sapiens
agcctaagggatcctg

SEQ ID NO: 2245869 - DNA, 23 bp, Homo sapiens
agcctcactggggcagacaataa

SEQ ID NO: 2245870 - DNA, 15 bp, Homo sapiens
agcctcagaaggccc

SEQ ID NO: 2245871 - DNA, 22 bp, Homo sapiens
agcctcagaaggccccagagag

SEQ ID NO: 2245872 - DNA, 14 bp, Homo sapiens
agcctccagggcat

SEQ ID NO: 2245873 - DNA, 16 bp, Homo sapiens
agcctccagggcattg

SEQ ID NO: 2245874 - DNA, 19 bp, Homo sapiens
agcctccagggcattgctc

SEQ ID NO: 2245875 - DNA, 17 bp, Homo sapiens
agcctcccaccagagcc

SEQ ID NO: 2245876 - DNA, 13 bp, Homo sapiens
agcctctctcctt

SEQ ID NO: 2245877 - DNA, 18 bp, Homo sapiens
agcctctctccttggcca

SEQ ID NO: 2245878 - DNA, 21 bp, Homo sapiens
agcctctctccttggccacag

SEQ ID NO: 2245879 - DNA, 16 bp, Homo sapiens
agcctctgctccccag

SEQ ID NO: 2245880 - DNA, 16 bp, Homo sapiens
agcctctttttgatac

SEQ ID NO: 2245881 - DNA, 13 bp, Homo sapiens
agcctggctctgc

SEQ ID NO: 2245882 - DNA, 23 bp, Homo sapiens
agcctggctctgccccctccccc

SEQ ID NO: 2245883 - DNA, 17 bp, Homo sapiens
agcctggggctgaggct

SEQ ID NO: 2245884 - DNA, 12 bp, Homo sapiens
agccttagatgc

SEQ ID NO: 2245885 - DNA, 20 bp, Homo sapiens
agccttcactggttctgcat

SEQ ID NO: 2245886 - DNA, 13 bp, Homo sapiens
agcctttaatgca

SEQ ID NO: 2245887 - DNA, 14 bp, Homo sapiens
agcctttaatgcat

SEQ ID NO: 2245888 - DNA, 19 bp, Homo sapiens
agcctttggttctggccag

SEQ ID NO: 2245889 - DNA, 17 bp, Homo sapiens
agcgaccgccccctcct

SEQ ID NO: 2245890 - DNA, 12 bp, Homo sapiens
agcgcctccctc

SEQ ID NO: 2245891 - DNA, 15 bp, Homo sapiens
agcgcctccctccac

SEQ ID NO: 2245892 - DNA, 19 bp, Homo sapiens
agcgcctccctccacccca

SEQ ID NO: 2245893 - DNA, 20 bp, Homo sapiens
agcgcctccctccaccccag

SEQ ID NO: 2245894 - DNA, 22 bp, Homo sapiens
agcgcctccctccaccccagga

SEQ ID NO: 2245895 - DNA, 22 bp, Homo sapiens
agcggaacaaggagtcagacat

SEQ ID NO: 2245896 - DNA, 16 bp, Homo sapiens
agcggagagagccaag

SEQ ID NO: 2245897 - DNA, 18 bp, Homo sapiens
agcggagagagccaagac

SEQ ID NO: 2245898 - DNA, 16 bp, Homo sapiens
agctaactgtaaatca

SEQ ID NO: 2245899 - DNA, 14 bp, Homo sapiens
agctcataaaatgg

SEQ ID NO: 2245900 - DNA, 12 bp, Homo sapiens
agctcctcccac

SEQ ID NO: 2245901 - DNA, 11 bp, Homo sapiens
agctcctgtaa

SEQ ID NO: 2245902 - DNA, 23 bp, Homo sapiens
agctgaacaataggctgttccca

SEQ ID NO: 2245903 - DNA, 17 bp, Homo sapiens
agctgccttggctcaga

SEQ ID NO: 2245904 - DNA, 19 bp, Homo sapiens
agctgcgggctccctggca

SEQ ID NO: 2245905 - DNA, 17 bp, Homo sapiens
agctggcagagagcaca

SEQ ID NO: 2245906 - DNA, 21 bp, Homo sapiens
agctggcagagagcacagtga

SEQ ID NO: 2245907 - DNA, 22 bp, Homo sapiens
agctggctctataaggcagcct

SEQ ID NO: 2245908 - DNA, 15 bp, Homo sapiens
agctgggctctgcaa

SEQ ID NO: 2245909 - DNA, 15 bp, Homo sapiens
agctgtgctcagaag

SEQ ID NO: 2245910 - DNA, 22 bp, Homo sapiens
agctgtggtcaaggctacagat

SEQ ID NO: 2245911 - DNA, 18 bp, Homo sapiens
agctgttcctgttcagta

SEQ ID NO: 2245912 - DNA, 19 bp, Homo sapiens
agcttaaaaaaattactgt

SEQ ID NO: 2245913 - DNA, 15 bp, Homo sapiens
agcttaacaatgcaa

SEQ ID NO: 2245914 - DNA, 16 bp, Homo sapiens
agcttaacaatgcaac

SEQ ID NO: 2245915 - DNA, 17 bp, Homo sapiens
agttgactttctccctg

SEQ ID NO: 2245916 - DNA, 16 bp, Homo sapiens
agttgcagtattggac

SEQ ID NO: 2245917 - DNA, 14 bp, Homo sapiens
agttggtattaata

SEQ ID NO: 2245918 - DNA, 16 bp, Homo sapiens
agtttatcattcaagt

SEQ ID NO: 2245919 - DNA, 12 bp, Homo sapiens
agtttatttttg

SEQ ID NO: 2245920 - DNA, 22 bp, Homo sapiens
agtttctcatgacggcttttgt

SEQ ID NO: 2245921 - DNA, 17 bp, Homo sapiens
agtttgaaaagcaatat

SEQ ID NO: 2245922 - DNA, 21 bp, Homo sapiens
agtttgaaaagcaatattgta

SEQ ID NO: 2245923 - DNA, 13 bp, Homo sapiens
agtttgcttagaa

SEQ ID NO: 2245924 - DNA, 14 bp, Homo sapiens
agtttgcttagaaa

SEQ ID NO: 2245925 - DNA, 15 bp, Homo sapiens
agtttgtgtgtctta

SEQ ID NO: 2245926 - DNA, 16 bp, Homo sapiens
agtttgtgtgtcttaa

SEQ ID NO: 2245927 - DNA, 22 bp, Homo sapiens
agtttgtgtgtcttaattatta

SEQ ID NO: 2245928 - DNA, 16 bp, Homo sapiens
agtttgtgttattatt

SEQ ID NO: 2245929 - DNA, 15 bp, Homo sapiens
agttttactgtgatt

SEQ ID NO: 2245930 - DNA, 16 bp, Homo sapiens
agttttgttctgtata

SEQ ID NO: 2245931 - DNA, 13 bp, Homo sapiens
ataaaaaatttta

SEQ ID NO: 2245932 - DNA, 19 bp, Homo sapiens
ataaaaagataatctcagt

SEQ ID NO: 2245933 - DNA, 20 bp, Homo sapiens
ataaaagcacaagtactttt

SEQ ID NO: 2245934 - DNA, 19 bp, Homo sapiens
ataaaataactaaaatgta

SEQ ID NO: 2245935 - DNA, 17 bp, Homo sapiens
ataaaatacatagtgaa

SEQ ID NO: 2245936 - DNA, 16 bp, Homo sapiens
ataaaatggctgtaat

SEQ ID NO: 2245937 - DNA, 15 bp, Homo sapiens
ataaaattaaaagtt

SEQ ID NO: 2245938 - DNA, 19 bp, Homo sapiens
ataaagtttgcttagaaaa

SEQ ID NO: 2245939 - DNA, 13 bp, Homo sapiens
ataaattgtcttt

SEQ ID NO: 2245940 - DNA, 21 bp, Homo sapiens
ataacactctaggatgtatat

SEQ ID NO: 2245941 - DNA, 15 bp, Homo sapiens
ataaccttaaaaagg

SEQ ID NO: 2245942 - DNA, 15 bp, Homo sapiens
ataactgacaagaga

SEQ ID NO: 2245943 - DNA, 13 bp, Homo sapiens
ataagttattgca

SEQ ID NO: 2245944 - DNA, 14 bp, Homo sapiens
ataagttattgcag

SEQ ID NO: 2245945 - DNA, 14 bp, Homo sapiens
ataagtttgaaata

SEQ ID NO: 2245946 - DNA, 13 bp, Homo sapiens
ataataaatatat

SEQ ID NO: 2245947 - DNA, 21 bp, Homo sapiens
ataataagtgatgtgctgaat

SEQ ID NO: 2245948 - DNA, 12 bp, Homo sapiens
ataatagaaatg

SEQ ID NO: 2245949 - DNA, 15 bp, Homo sapiens
ataatagaaatgtct

SEQ ID NO: 2245950 - DNA, 19 bp, Homo sapiens
ataatcatcaagtaataca

SEQ ID NO: 2245951 - DNA, 18 bp, Homo sapiens
ataatccttgataatata

SEQ ID NO: 2245952 - DNA, 23 bp, Homo sapiens
ataatcttattagggagaaaatt

SEQ ID NO: 2245953 - DNA, 22 bp, Homo sapiens
ataatcttgtagacacttactt

SEQ ID NO: 2245954 - DNA, 16 bp, Homo sapiens
ataatgaacaaaatta

SEQ ID NO: 2245955 - DNA, 14 bp, Homo sapiens
ataatgcaatcaaa

SEQ ID NO: 2245956 - DNA, 16 bp, Homo sapiens
ataattaattgtcatt

SEQ ID NO: 2245957 - DNA, 15 bp, Homo sapiens
ataattgaagtgtat

SEQ ID NO: 2245958 - DNA, 15 bp, Homo sapiens
ataatttagttgttt

SEQ ID NO: 2245959 - DNA, 14 bp, Homo sapiens
ataatttgtttcca

SEQ ID NO: 2245960 - DNA, 16 bp, Homo sapiens
ataatttgtttccagc

SEQ ID NO: 2245961 - DNA, 12 bp, Homo sapiens
ataattttgtaa

SEQ ID NO: 2245962 - DNA, 14 bp, Homo sapiens
atacaaattagaaa

SEQ ID NO: 2245963 - DNA, 18 bp, Homo sapiens
atacaacagaaaccagaa

SEQ ID NO: 2245964 - DNA, 12 bp, Homo sapiens
atacaaggtata

SEQ ID NO: 2245965 - DNA, 20 bp, Homo sapiens
atacaaggtataataaaatt

SEQ ID NO: 2245966 - DNA, 15 bp, Homo sapiens
aaattgtttagtgat

SEQ ID NO: 2245967 - DNA, 18 bp, Homo sapiens
aaatttaaaagtaaaatg

SEQ ID NO: 2245968 - DNA, 16 bp, Homo sapiens
aaatttgactaatttt

SEQ ID NO: 2245969 - DNA, 19 bp, Homo sapiens
aaatttgtctgaaacattt

SEQ ID NO: 2245970 - DNA, 14 bp, Homo sapiens
aaatttgttgcata

SEQ ID NO: 2245971 - DNA, 22 bp, Homo sapiens
aaattttataggactgttcttt

SEQ ID NO: 2245972 - DNA, 13 bp, Homo sapiens
aacaaaaattagg

SEQ ID NO: 2245973 - DNA, 15 bp, Homo sapiens
aacaaaattatttgt

SEQ ID NO: 2245974 - DNA, 13 bp, Homo sapiens
aacaaagttacta

SEQ ID NO: 2245975 - DNA, 22 bp, Homo sapiens
aatagaagctaaggtttagata

SEQ ID NO: 2245976 - DNA, 15 bp, Homo sapiens
aatagacacatacat

SEQ ID NO: 2245977 - DNA, 16 bp, Homo sapiens
aatagctttaatgata

SEQ ID NO: 2245978 - DNA, 15 bp, Homo sapiens
aataggatttttaga

SEQ ID NO: 2245979 - DNA, 16 bp, Homo sapiens
aataggatttttagaa

SEQ ID NO: 2245980 - DNA, 21 bp, Homo sapiens
aataggcagggggccctgccc

SEQ ID NO: 2245981 - DNA, 17 bp, Homo sapiens
aatagtcggtgaagaaa

SEQ ID NO: 2245982 - DNA, 16 bp, Homo sapiens
aatagttcaaactgca

SEQ ID NO: 2245983 - DNA, 14 bp, Homo sapiens
aatagttttttact

SEQ ID NO: 2245984 - DNA, 16 bp, Homo sapiens
aatataagaaaatgct

SEQ ID NO: 2245985 - DNA, 17 bp, Homo sapiens
aatataataatgatgat

SEQ ID NO: 2245986 - DNA, 14 bp, Homo sapiens
aatatacaaaactt

SEQ ID NO: 2245987 - DNA, 20 bp, Homo sapiens
aatatatatctatctatttg

SEQ ID NO: 2245988 - DNA, 20 bp, Homo sapiens
aatatatccccactactcaa

SEQ ID NO: 2245989 - DNA, 17 bp, Homo sapiens
aatatatttctaaatgt

SEQ ID NO: 2245990 - DNA, 18 bp, Homo sapiens
aatatctctgagttctgt

SEQ ID NO: 2245991 - DNA, 19 bp, Homo sapiens
aatatgactttttataaaa

SEQ ID NO: 2245992 - DNA, 20 bp, Homo sapiens
aatatgactttttataaaat

SEQ ID NO: 2245993 - DNA, 18 bp, Homo sapiens
aatatggaaccttccctc

SEQ ID NO: 2245994 - DNA, 16 bp, Homo sapiens
aatattaacttttaat

SEQ ID NO: 2245995 - DNA, 18 bp, Homo sapiens
aatattaacttttaatgg

SEQ ID NO: 2245996 - DNA, 22 bp, Homo sapiens
aatattaggcttaaaaactgaa

SEQ ID NO: 2245997 - DNA, 19 bp, Homo sapiens
aatattatttgtgtttcct

SEQ ID NO: 2245998 - DNA, 14 bp, Homo sapiens
aatattctctattt

SEQ ID NO: 2245999 - DNA, 17 bp, Homo sapiens
aatattgttttacaata

SEQ ID NO: 2246000 - DNA, 23 bp, Homo sapiens
aatatttaagtttgttgctgtca

SEQ ID NO: 2246001 - DNA, 14 bp, Homo sapiens
aatatttaccttga

SEQ ID NO: 2246002 - DNA, 16 bp, Homo sapiens
aatatttataaaactt

SEQ ID NO: 2246003 - DNA, 12 bp, Homo sapiens
aatattttcaac

SEQ ID NO: 2246004 - DNA, 19 bp, Homo sapiens
aatattttctttaatgctt

SEQ ID NO: 2246005 - DNA, 13 bp, Homo sapiens
aatattttgaatc

SEQ ID NO: 2246006 - DNA, 18 bp, Homo sapiens
aatattttgaatcaataa

SEQ ID NO: 2246007 - DNA, 22 bp, Homo sapiens
aatattttgaatcaataatata

SEQ ID NO: 2246008 - DNA, 11 bp, Homo sapiens
aatcactgcac

SEQ ID NO: 2246009 - DNA, 14 bp, Homo sapiens
aatcagtataaaca

SEQ ID NO: 2246010 - DNA, 15 bp, Homo sapiens
aatcagtataaacaa

SEQ ID NO: 2246011 - DNA, 22 bp, Homo sapiens
aatcagttatacagttataaaa

SEQ ID NO: 2246012 - DNA, 22 bp, Homo sapiens
aatcataggcaccttttactgt

SEQ ID NO: 2246013 - DNA, 23 bp, Homo sapiens
aatcataggcaccttttactgtg

SEQ ID NO: 2246014 - DNA, 16 bp, Homo sapiens
aatcatagttactgtg

SEQ ID NO: 2246015 - DNA, 20 bp, Homo sapiens
aatcatctgcagttcttttt

SEQ ID NO: 2246016 - DNA, 14 bp, Homo sapiens
aatcattgtatgtg

SEQ ID NO: 2246017 - DNA, 14 bp, Homo sapiens
aatcatttgtttac

SEQ ID NO: 2246018 - DNA, 16 bp, Homo sapiens
aatccgagtgtttgcc

SEQ ID NO: 2246019 - DNA, 21 bp, Homo sapiens
aatctaagcagcttattgttt

SEQ ID NO: 2246020 - DNA, 15 bp, Homo sapiens
aatctcagtgctttc

SEQ ID NO: 2246021 - DNA, 15 bp, Homo sapiens
aatctctaggaagtc

SEQ ID NO: 2246022 - DNA, 19 bp, Homo sapiens
aatctctaggaagtcaata

SEQ ID NO: 2246023 - DNA, 21 bp, Homo sapiens
aatctctcagagccctcaact

SEQ ID NO: 2246024 - DNA, 15 bp, Homo sapiens
aatctggagaccagg

SEQ ID NO: 2246025 - DNA, 19 bp, Homo sapiens
aatcttgtagacacttact

SEQ ID NO: 2246026 - DNA, 13 bp, Homo sapiens
aatgaaaacagtg

SEQ ID NO: 2246027 - DNA, 18 bp, Homo sapiens
aatgaaaacagtgtgtaa

SEQ ID NO: 2246028 - DNA, 22 bp, Homo sapiens
aatgaaaacagtgtgtaaacaa

SEQ ID NO: 2246029 - DNA, 23 bp, Homo sapiens
aatgaattctttaaggagatgga

SEQ ID NO: 2246030 - DNA, 15 bp, Homo sapiens
aatgagacgaaatgc

SEQ ID NO: 2246031 - DNA, 17 bp, Homo sapiens
aatgagaggttcctaag

SEQ ID NO: 2246032 - DNA, 23 bp, Homo sapiens
aatgatatactgatcttcattac

SEQ ID NO: 2246033 - DNA, 19 bp, Homo sapiens
aatgatatgcttgtaacta

SEQ ID NO: 2246034 - DNA, 18 bp, Homo sapiens
aatgcaaccatttgaaac

SEQ ID NO: 2246035 - DNA, 22 bp, Homo sapiens
aatgcaacttttaattactgtt

SEQ ID NO: 2246036 - DNA, 18 bp, Homo sapiens
aatgcagattacactgat

SEQ ID NO: 2246037 - DNA, 16 bp, Homo sapiens
aatgcatgattttgta

SEQ ID NO: 2246038 - DNA, 15 bp, Homo sapiens
aatgccatttagcaa

SEQ ID NO: 2246039 - DNA, 18 bp, Homo sapiens
aatgctgctccaccctcc

SEQ ID NO: 2246040 - DNA, 17 bp, Homo sapiens
aatggaaattttgctat

SEQ ID NO: 2246041 - DNA, 13 bp, Homo sapiens
aatgggtgatatg

SEQ ID NO: 2246042 - DNA, 20 bp, Homo sapiens
aatggtactccacatatttc

SEQ ID NO: 2246043 - DNA, 23 bp, Homo sapiens
aatggtcacgtttggtgcttctc

SEQ ID NO: 2246044 - DNA, 18 bp, Homo sapiens
aatggttggtttttgtgt

SEQ ID NO: 2246045 - DNA, 17 bp, Homo sapiens
aatggtttggtgctttt

SEQ ID NO: 2246046 - DNA, 12 bp, Homo sapiens
aatgtatataaa

SEQ ID NO: 2246047 - DNA, 13 bp, Homo sapiens
aatgtatataaaa

SEQ ID NO: 2246048 - DNA, 15 bp, Homo sapiens
aatgtccatatgcta

SEQ ID NO: 2246049 - DNA, 17 bp, Homo sapiens
aatgtctgagtgaacct

SEQ ID NO: 2246050 - DNA, 15 bp, Homo sapiens
aatgtctttccaaat

SEQ ID NO: 2246051 - DNA, 16 bp, Homo sapiens
aatgtgatttttgtaa

SEQ ID NO: 2246052 - DNA, 17 bp, Homo sapiens
aatgtggtgacacctcc

SEQ ID NO: 2246053 - DNA, 13 bp, Homo sapiens
aatgtgtaagaac

SEQ ID NO: 2246054 - DNA, 16 bp, Homo sapiens
aatgtgtataaattgt

SEQ ID NO: 2246055 - DNA, 21 bp, Homo sapiens
aatgttaaggacttctgcagc

SEQ ID NO: 2246056 - DNA, 14 bp, Homo sapiens
aatgttatttaaca

SEQ ID NO: 2246057 - DNA, 21 bp, Homo sapiens
aatgttgggactgctaaataa

SEQ ID NO: 2246058 - DNA, 20 bp, Homo sapiens
aatgtttggcatgtaaatgt

SEQ ID NO: 2246059 - DNA, 13 bp, Homo sapiens
aatgttttaaatt

SEQ ID NO: 2246060 - DNA, 15 bp, Homo sapiens
aattaataatcttat

SEQ ID NO: 2246061 - DNA, 13 bp, Homo sapiens
aattaatatcttt

SEQ ID NO: 2246062 - DNA, 23 bp, Homo sapiens
aattaattcctgtttgtctacat

SEQ ID NO: 2246063 - DNA, 19 bp, Homo sapiens
aattacagtccaaaatact

SEQ ID NO: 2246064 - DNA, 17 bp, Homo sapiens
aattacagttaaagaag

SEQ ID NO: 2246065 - DNA, 14 bp, Homo sapiens
aattactgttttct

SEQ ID NO: 2246066 - DNA, 11 bp, Homo sapiens
aattagaaaat

SEQ ID NO: 2246067 - DNA, 14 bp, Homo sapiens
aattagaaaatatt

SEQ ID NO: 2246068 - DNA, 18 bp, Homo sapiens
aattagaaaatattctct

SEQ ID NO: 2246069 - DNA, 22 bp, Homo sapiens
aattagaaaatgttatttaaca

SEQ ID NO: 2246070 - DNA, 15 bp, Homo sapiens
aattagaatagtgtt

SEQ ID NO: 2246071 - DNA, 16 bp, Homo sapiens
aattatcctctttgta

SEQ ID NO: 2246072 - DNA, 17 bp, Homo sapiens
aattatcctctttgtaa

SEQ ID NO: 2246073 - DNA, 14 bp, Homo sapiens
aattatctatacat

SEQ ID NO: 2246074 - DNA, 15 bp, Homo sapiens
aattattataaaaat

SEQ ID NO: 2246075 - DNA, 17 bp, Homo sapiens
aattattataaaaatat

SEQ ID NO: 2246076 - DNA, 22 bp, Homo sapiens
aattattataaaaatattaaga

SEQ ID NO: 2246077 - DNA, 15 bp, Homo sapiens
aattattatttgtgt

SEQ ID NO: 2246078 - DNA, 18 bp, Homo sapiens
aattattatttgtgtttt

SEQ ID NO: 2246079 - DNA, 22 bp, Homo sapiens
aattatttctgtcacagtaaaa

SEQ ID NO: 2246080 - DNA, 17 bp, Homo sapiens
agaaatattaagcatgt

SEQ ID NO: 2246081 - DNA, 16 bp, Homo sapiens
agaaatgaaaacagtg

SEQ ID NO: 2246082 - DNA, 13 bp, Homo sapiens
agaaatgaatgct

SEQ ID NO: 2246083 - DNA, 16 bp, Homo sapiens
agaaatggaaattttg

SEQ ID NO: 2246084 - DNA, 18 bp, Homo sapiens
agaacagtggaaactatg

SEQ ID NO: 2246085 - DNA, 19 bp, Homo sapiens
agaacatcataaaattttt

SEQ ID NO: 2246086 - DNA, 16 bp, Homo sapiens
agaaccaggctacaag

SEQ ID NO: 2246087 - DNA, 13 bp, Homo sapiens
agaacctaacatg

SEQ ID NO: 2246088 - DNA, 16 bp, Homo sapiens
agaacgcggtgtgtaa

SEQ ID NO: 2246089 - DNA, 18 bp, Homo sapiens
agaacgcggtgtgtaaca

SEQ ID NO: 2246090 - DNA, 14 bp, Homo sapiens
agaacggcttgctt

SEQ ID NO: 2246091 - DNA, 20 bp, Homo sapiens
agaacgttttttcctcagtg

SEQ ID NO: 2246092 - DNA, 19 bp, Homo sapiens
agaactaaactagtttttc

SEQ ID NO: 2246093 - DNA, 17 bp, Homo sapiens
agaactagccaaaccag

SEQ ID NO: 2246094 - DNA, 21 bp, Homo sapiens
agaactagccaaaccaggacc

SEQ ID NO: 2246095 - DNA, 20 bp, Homo sapiens
agaactcgcgctcagtaaac

SEQ ID NO: 2246096 - DNA, 13 bp, Homo sapiens
agaactctctgga

SEQ ID NO: 2246097 - DNA, 16 bp, Homo sapiens
agaactctctggaagc

SEQ ID NO: 2246098 - DNA, 21 bp, Homo sapiens
agaactctctggaagcccctg

SEQ ID NO: 2246099 - DNA, 20 bp, Homo sapiens
agaactgtgtttcaagttca

SEQ ID NO: 2246100 - DNA, 21 bp, Homo sapiens
agaagaactgtgtttcaagtt

SEQ ID NO: 2246101 - DNA, 18 bp, Homo sapiens
agaagccacgctgtcctc

SEQ ID NO: 2246102 - DNA, 20 bp, Homo sapiens
agaagccacgctgtcctctc

SEQ ID NO: 2246103 - DNA, 18 bp, Homo sapiens
agaagctaaggtttagat

SEQ ID NO: 2246104 - DNA, 18 bp, Homo sapiens
agaaggccccagagagac

SEQ ID NO: 2246105 - DNA, 17 bp, Homo sapiens
agaaggtttattgttaa

SEQ ID NO: 2246106 - DNA, 18 bp, Homo sapiens
agaaggtttctggagcag

SEQ ID NO: 2246107 - DNA, 18 bp, Homo sapiens
agaagtcggaatgtcata

SEQ ID NO: 2246108 - DNA, 23 bp, Homo sapiens
agaagtcggaatgtcatagtctt

SEQ ID NO: 2246109 - DNA, 13 bp, Homo sapiens
agaagtttctgtc

SEQ ID NO: 2246110 - DNA, 21 bp, Homo sapiens
agaagtttggctgctgtcata

SEQ ID NO: 2246111 - DNA, 22 bp, Homo sapiens
atccatgagatagctattataa

SEQ ID NO: 2246112 - DNA, 17 bp, Homo sapiens
atcccaactgtcttttt

SEQ ID NO: 2246113 - DNA, 23 bp, Homo sapiens
atcccaactgtctttttttccct

SEQ ID NO: 2246114 - DNA, 14 bp, Homo sapiens
atccccgcctggcc

SEQ ID NO: 2246115 - DNA, 18 bp, Homo sapiens
atcccgttttccccatga

SEQ ID NO: 2246116 - DNA, 16 bp, Homo sapiens
atccctgggcccctcc

SEQ ID NO: 2246117 - DNA, 18 bp, Homo sapiens
atcccttcacagtcccag

SEQ ID NO: 2246118 - DNA, 13 bp, Homo sapiens
atccctttattac

SEQ ID NO: 2246119 - DNA, 22 bp, Homo sapiens
atccctttattaccccctcctt

SEQ ID NO: 2246120 - DNA, 19 bp, Homo sapiens
atccctttttttacatttc

SEQ ID NO: 2246121 - DNA, 22 bp, Homo sapiens
atccgagtgtttgccaggctta

SEQ ID NO: 2246122 - DNA, 15 bp, Homo sapiens
atcctccacagagag

SEQ ID NO: 2246123 - DNA, 12 bp, Homo sapiens
atcctctttgta

SEQ ID NO: 2246124 - DNA, 13 bp, Homo sapiens
atcctctttgtaa

SEQ ID NO: 2246125 - DNA, 14 bp, Homo sapiens
atccttgataatat

SEQ ID NO: 2246126 - DNA, 21 bp, Homo sapiens
atccttggctttcagagccag

SEQ ID NO: 2246127 - DNA, 14 bp, Homo sapiens
atcgaaaaaataat

SEQ ID NO: 2246128 - DNA, 18 bp, Homo sapiens
atctaaatttcttttgct

SEQ ID NO: 2246129 - DNA, 16 bp, Homo sapiens
atctaagaataataaa

SEQ ID NO: 2246130 - DNA, 18 bp, Homo sapiens
atctagcttcttcagaga

SEQ ID NO: 2246131 - DNA, 16 bp, Homo sapiens
atctatacatatcttt

SEQ ID NO: 2246132 - DNA, 17 bp, Homo sapiens
atctatataaaataact

SEQ ID NO: 2246133 - DNA, 15 bp, Homo sapiens
atctatttacataaa

SEQ ID NO: 2246134 - DNA, 12 bp, Homo sapiens
atctatttgagg

SEQ ID NO: 2246135 - DNA, 20 bp, Homo sapiens
atctcagatgttaaaataaa

SEQ ID NO: 2246136 - DNA, 21 bp, Homo sapiens
atctcagatgttaaaataaat

SEQ ID NO: 2246137 - DNA, 21 bp, Homo sapiens
atctcccttttccatgactgt

SEQ ID NO: 2246138 - DNA, 14 bp, Homo sapiens
atctcctaactttg

SEQ ID NO: 2246139 - DNA, 10 bp, Homo sapiens
atctctctct

SEQ ID NO: 2246140 - DNA, 15 bp, Homo sapiens
atctctctctgtgtc

SEQ ID NO: 2246141 - DNA, 20 bp, Homo sapiens
atctctctctgtgtctttct

SEQ ID NO: 2246142 - DNA, 22 bp, Homo sapiens
atctctctctgtgtctttctct

SEQ ID NO: 2246143 - DNA, 13 bp, Homo sapiens
atctctctggggc

SEQ ID NO: 2246144 - DNA, 16 bp, Homo sapiens
atctctctggggccct

SEQ ID NO: 2246145 - DNA, 20 bp, Homo sapiens
atctctctggggccctgggc

SEQ ID NO: 2246146 - DNA, 23 bp, Homo sapiens
atctcttttccactccattgtcg

SEQ ID NO: 2246147 - DNA, 21 bp, Homo sapiens
atctgaccctatgggtctagg

SEQ ID NO: 2246148 - DNA, 17 bp, Homo sapiens
atctgggctgtgggcaa

SEQ ID NO: 2246149 - DNA, 21 bp, Homo sapiens
atctggttcattcttcagata

SEQ ID NO: 2246150 - DNA, 17 bp, Homo sapiens
atctgtcatctctctgg

SEQ ID NO: 2246151 - DNA, 19 bp, Homo sapiens
atctgtctgtggcaaaagt

SEQ ID NO: 2246152 - DNA, 22 bp, Homo sapiens
atctgtctgtggcaaaagttta

SEQ ID NO: 2246153 - DNA, 21 bp, Homo sapiens
atctgttagcagagtctgtct

SEQ ID NO: 2246154 - DNA, 23 bp, Homo sapiens
atctgttagcagagtctgtctct

SEQ ID NO: 2246155 - DNA, 21 bp, Homo sapiens
atcttattagggagaaaattc

SEQ ID NO: 2246156 - DNA, 22 bp, Homo sapiens
atcttattagggagaaaattca

SEQ ID NO: 2246157 - DNA, 15 bp, Homo sapiens
atcttcattaccaat

SEQ ID NO: 2246158 - DNA, 13 bp, Homo sapiens
attaataaaaaga

SEQ ID NO: 2246159 - DNA, 14 bp, Homo sapiens
attaataaaactgt

SEQ ID NO: 2246160 - DNA, 15 bp, Homo sapiens
attaataaaactgtg

SEQ ID NO: 2246161 - DNA, 13 bp, Homo sapiens
attaataatctta

SEQ ID NO: 2246162 - DNA, 16 bp, Homo sapiens
attaataatcttatta

SEQ ID NO: 2246163 - DNA, 21 bp, Homo sapiens
attaatactctatttttacat

SEQ ID NO: 2246164 - DNA, 14 bp, Homo sapiens
attaatatctttct

SEQ ID NO: 2246165 - DNA, 17 bp, Homo sapiens
attaatatctttctgca

SEQ ID NO: 2246166 - DNA, 12 bp, Homo sapiens
attaatatgaaa

SEQ ID NO: 2246167 - DNA, 16 bp, Homo sapiens
attaatcaccttcttt

SEQ ID NO: 2246168 - DNA, 13 bp, Homo sapiens
attaatcactatt

SEQ ID NO: 2246169 - DNA, 16 bp, Homo sapiens
attaatcactattgtt

SEQ ID NO: 2246170 - DNA, 12 bp, Homo sapiens
attaatgcactt

SEQ ID NO: 2246171 - DNA, 20 bp, Homo sapiens
attaattcctgtttgtctac

SEQ ID NO: 2246172 - DNA, 14 bp, Homo sapiens
attaattgtcatta

SEQ ID NO: 2246173 - DNA, 16 bp, Homo sapiens
attaatttatttaatt

SEQ ID NO: 2246174 - DNA, 14 bp, Homo sapiens
attacaattttatc

SEQ ID NO: 2246175 - DNA, 18 bp, Homo sapiens
attaccccctccttcaga

SEQ ID NO: 2246176 - DNA, 19 bp, Homo sapiens
attaccccctccttcagac

SEQ ID NO: 2246177 - DNA, 21 bp, Homo sapiens
attaccccctccttcagacac

SEQ ID NO: 2246178 - DNA, 19 bp, Homo sapiens
attaccttctattggtctc

SEQ ID NO: 2246179 - DNA, 16 bp, Homo sapiens
attacttgaactttcc

SEQ ID NO: 2246180 - DNA, 19 bp, Homo sapiens
attagaaaatgttatttaa

SEQ ID NO: 2246181 - DNA, 22 bp, Homo sapiens
attagaaaatgttatttaacag

SEQ ID NO: 2246182 - DNA, 13 bp, Homo sapiens
attagaatagtgt

SEQ ID NO: 2246183 - DNA, 15 bp, Homo sapiens
attagagaacatcct

SEQ ID NO: 2246184 - DNA, 17 bp, Homo sapiens
attagggagaaaattca

SEQ ID NO: 2246185 - DNA, 18 bp, Homo sapiens
attagggagaaaattcaa

SEQ ID NO: 2246186 - DNA, 23 bp, Homo sapiens
attaggtgatcccgttttcccca

SEQ ID NO: 2246187 - DNA, 19 bp, Homo sapiens
attaggtttcagcagagct

SEQ ID NO: 2246188 - DNA, 13 bp, Homo sapiens
attataaaaatat

SEQ ID NO: 2246189 - DNA, 22 bp, Homo sapiens
attataaaaatattaagacaat

SEQ ID NO: 2246190 - DNA, 17 bp, Homo sapiens
attataagtcttacata

SEQ ID NO: 2246191 - DNA, 20 bp, Homo sapiens
attatctatacatatcttta

SEQ ID NO: 2246192 - DNA, 16 bp, Homo sapiens
attatgttttttaaaa

SEQ ID NO: 2246193 - DNA, 13 bp, Homo sapiens
attattataaaaa

SEQ ID NO: 2246194 - DNA, 17 bp, Homo sapiens
attatttgtaagatatt

SEQ ID NO: 2246195 - DNA, 15 bp, Homo sapiens
attatttgtgtttta

SEQ ID NO: 2246196 - DNA, 14 bp, Homo sapiens
attatttttgtaga

SEQ ID NO: 2246197 - DNA, 20 bp, Homo sapiens
attatttttgttagcaaaga

SEQ ID NO: 2246198 - DNA, 15 bp, Homo sapiens
attattttttaataa

SEQ ID NO: 2246199 - DNA, 19 bp, Homo sapiens
attattttttaataagaac

SEQ ID NO: 2246200 - DNA, 22 bp, Homo sapiens
attcaaactggggcctccagaa

SEQ ID NO: 2246201 - DNA, 20 bp, Homo sapiens
attcaaattatgtataaata

SEQ ID NO: 2246202 - DNA, 21 bp, Homo sapiens
attcaagtgtaaaatattttg

SEQ ID NO: 2246203 - DNA, 16 bp, Homo sapiens
attcaccccctttcct

SEQ ID NO: 2246204 - DNA, 22 bp, Homo sapiens
attcaccccctttcctggacac

SEQ ID NO: 2246205 - DNA, 19 bp, Homo sapiens
attcagcagcaaattttca

SEQ ID NO: 2246206 - DNA, 17 bp, Homo sapiens
attcagtgattactgtc

SEQ ID NO: 2246207 - DNA, 19 bp, Homo sapiens
attcagtgattactgtcaa

SEQ ID NO: 2246208 - DNA, 16 bp, Homo sapiens
attcagtggaggctgg

SEQ ID NO: 2246209 - DNA, 16 bp, Homo sapiens
attcatcccaactgtc

SEQ ID NO: 2246210 - DNA, 13 bp, Homo sapiens
attcatctgtcta

SEQ ID NO: 2246211 - DNA, 18 bp, Homo sapiens
attcatctgtctatattt

SEQ ID NO: 2246212 - DNA, 14 bp, Homo sapiens
attcattgtgttac

SEQ ID NO: 2246213 - DNA, 11 bp, Homo sapiens
attcatttcta

SEQ ID NO: 2246214 - DNA, 12 bp, Homo sapiens
attcatttgttt

SEQ ID NO: 2246215 - DNA, 14 bp, Homo sapiens
attccaaaccaaat

SEQ ID NO: 2246216 - DNA, 21 bp, Homo sapiens
attccaaaccaaattttaatt

SEQ ID NO: 2246217 - DNA, 12 bp, Homo sapiens
attccaataaac

SEQ ID NO: 2246218 - DNA, 16 bp, Homo sapiens
attccctccccctcct

SEQ ID NO: 2246219 - DNA, 22 bp, Homo sapiens
attccctccccctccttgtgcc

SEQ ID NO: 2246220 - DNA, 17 bp, Homo sapiens
attcctaaagaaaaata

SEQ ID NO: 2246221 - DNA, 21 bp, Homo sapiens
attcgctactatgatttaatt

SEQ ID NO: 2246222 - DNA, 14 bp, Homo sapiens
attctaatcatctg

SEQ ID NO: 2246223 - DNA, 20 bp, Homo sapiens
attctctatttgaattattt

SEQ ID NO: 2246224 - DNA, 17 bp, Homo sapiens
attctgaattgtccttt

SEQ ID NO: 2246225 - DNA, 16 bp, Homo sapiens
attctggacagacaga

SEQ ID NO: 2246226 - DNA, 19 bp, Homo sapiens
attctgtttttaatgctat

SEQ ID NO: 2246227 - DNA, 13 bp, Homo sapiens
atttaaaaagcaa

SEQ ID NO: 2246228 - DNA, 14 bp, Homo sapiens
atttaaaaatattt

SEQ ID NO: 2246229 - DNA, 15 bp, Homo sapiens
atttaaagcctcctc

SEQ ID NO: 2246230 - DNA, 16 bp, Homo sapiens
atttaacaatttattc

SEQ ID NO: 2246231 - DNA, 21 bp, Homo sapiens
atttaacagctgaattatcta

SEQ ID NO: 2246232 - DNA, 15 bp, Homo sapiens
atttaagatgtgaaa

SEQ ID NO: 2246233 - DNA, 13 bp, Homo sapiens
atttaagggaaaa

SEQ ID NO: 2246234 - DNA, 15 bp, Homo sapiens
atttaagggaaaaat

SEQ ID NO: 2246235 - DNA, 22 bp, Homo sapiens
atttaagtgttggaaaaaattt

SEQ ID NO: 2246236 - DNA, 22 bp, Homo sapiens
atttaagtttgttgctgtcaag

SEQ ID NO: 2246237 - DNA, 15 bp, Homo sapiens
atttacaatatatga

SEQ ID NO: 2246238 - DNA, 19 bp, Homo sapiens
atttaggtttttattagta

SEQ ID NO: 2246239 - DNA, 16 bp, Homo sapiens
atttagtattatcaaa

SEQ ID NO: 2246240 - DNA, 15 bp, Homo sapiens
atttataaaacttct

SEQ ID NO: 2246241 - DNA, 19 bp, Homo sapiens
atttatgcgtaatttaatg

SEQ ID NO: 2246242 - DNA, 22 bp, Homo sapiens
atttatgtttgcacttgtgatt

SEQ ID NO: 2246243 - DNA, 11 bp, Homo sapiens
atttatttaat

SEQ ID NO: 2246244 - DNA, 13 bp, Homo sapiens
atttatttaatta

SEQ ID NO: 2246245 - DNA, 23 bp, Homo sapiens
atttatttacagatgaatgtatt

SEQ ID NO: 2246246 - DNA, 14 bp, Homo sapiens
atttatttcagatg

SEQ ID NO: 2246247 - DNA, 16 bp, Homo sapiens
atttatttcatccagt

SEQ ID NO: 2246248 - DNA, 15 bp, Homo sapiens
atttcacattattct

SEQ ID NO: 2246249 - DNA, 17 bp, Homo sapiens
atttcacattattctgg

SEQ ID NO: 2246250 - DNA, 19 bp, Homo sapiens
atttcagtaagctgtgtgg

SEQ ID NO: 2246251 - DNA, 22 bp, Homo sapiens
atttcatacaacagaaaccaga

SEQ ID NO: 2246252 - DNA, 15 bp, Homo sapiens
atttcatctcattta

SEQ ID NO: 2246253 - DNA, 13 bp, Homo sapiens
atttctacctcag

SEQ ID NO: 2246254 - DNA, 14 bp, Homo sapiens
atttctacctcagc

SEQ ID NO: 2246255 - DNA, 18 bp, Homo sapiens
atttctagctttttaatt

SEQ ID NO: 2246256 - DNA, 14 bp, Homo sapiens
atttctattattaa

SEQ ID NO: 2246257 - DNA, 23 bp, Homo sapiens
atttctctagtgtattatcactg

SEQ ID NO: 2246258 - DNA, 18 bp, Homo sapiens
atttcttaattattataa

SEQ ID NO: 2246259 - DNA, 13 bp, Homo sapiens
atttgactaattt

SEQ ID NO: 2246260 - DNA, 15 bp, Homo sapiens
atttgactaatttta

SEQ ID NO: 2246261 - DNA, 11 bp, Homo sapiens
atttgactgta

SEQ ID NO: 2246262 - DNA, 14 bp, Homo sapiens
atttgcatatttat

SEQ ID NO: 2246263 - DNA, 18 bp, Homo sapiens
atttgtaagatatttgca

SEQ ID NO: 2246264 - DNA, 17 bp, Homo sapiens
atttgtgatagcacttt

SEQ ID NO: 2246265 - DNA, 20 bp, Homo sapiens
atttgtgttttaatttaaac

SEQ ID NO: 2246266 - DNA, 20 bp, Homo sapiens
atttgttggggctttacata

SEQ ID NO: 2246267 - DNA, 19 bp, Homo sapiens
atttgtttttacctgtatt

SEQ ID NO: 2246268 - DNA, 17 bp, Homo sapiens
attttaaataatgtatt

SEQ ID NO: 2246269 - DNA, 14 bp, Homo sapiens
attttaagaaacag

SEQ ID NO: 2246270 - DNA, 23 bp, Homo sapiens
attttaagacgtgaatgtctcag

SEQ ID NO: 2246271 - DNA, 16 bp, Homo sapiens
attttaagactgattt

SEQ ID NO: 2246272 - DNA, 15 bp, Homo sapiens
attttacacaaatgt

SEQ ID NO: 2246273 - DNA, 18 bp, Homo sapiens
attttaccaaagcatcaa

SEQ ID NO: 2246274 - DNA, 16 bp, Homo sapiens
attttatataaagtat

SEQ ID NO: 2246275 - DNA, 23 bp, Homo sapiens
attttctattttaagactgattt

SEQ ID NO: 2246276 - DNA, 16 bp, Homo sapiens
attttctctgtacttt

SEQ ID NO: 2246277 - DNA, 15 bp, Homo sapiens
attttctttaatgct

SEQ ID NO: 2246278 - DNA, 13 bp, Homo sapiens
attttgaatcaat

SEQ ID NO: 2246279 - DNA, 17 bp, Homo sapiens
attttgatgtaaagatg

SEQ ID NO: 2246280 - DNA, 18 bp, Homo sapiens
attttggagattataata

SEQ ID NO: 2246281 - DNA, 22 bp, Homo sapiens
attttgggggtttttaatcttt

SEQ ID NO: 2246282 - DNA, 14 bp, Homo sapiens
attttggtgagaaa

SEQ ID NO: 2246283 - DNA, 21 bp, Homo sapiens
attttggtgagaaatgggact

SEQ ID NO: 2246284 - DNA, 16 bp, Homo sapiens
attttgtgtaagaaat

SEQ ID NO: 2246285 - DNA, 18 bp, Homo sapiens
attttgtgtaagaaatac

SEQ ID NO: 2246286 - DNA, 20 bp, Homo sapiens
attttgtgtaagaaatacag

SEQ ID NO: 2246287 - DNA, 23 bp, Homo sapiens
atttttaaaaaatattttctctg

SEQ ID NO: 2246288 - DNA, 14 bp, Homo sapiens
atttttacatttaa

SEQ ID NO: 2246289 - DNA, 16 bp, Homo sapiens
atttttatctatataa

SEQ ID NO: 2246290 - DNA, 23 bp, Homo sapiens
atttttatgttttgaaagacaga

SEQ ID NO: 2246291 - DNA, 12 bp, Homo sapiens
atttttatttct

SEQ ID NO: 2246292 - DNA, 18 bp, Homo sapiens
atttttgtaaaagacatt

SEQ ID NO: 2246293 - DNA, 21 bp, Homo sapiens
atttttgtaaaagacatttga

SEQ ID NO: 2246294 - DNA, 20 bp, Homo sapiens
atttttgtacgttatatatt

SEQ ID NO: 2246295 - DNA, 17 bp, Homo sapiens
atttttgttagcaaaga

SEQ ID NO: 2246296 - DNA, 21 bp, Homo sapiens
atttttgttagcaaagattaa

SEQ ID NO: 2246297 - DNA, 21 bp, Homo sapiens
attttttaagtgaaaatatag

SEQ ID NO: 2246298 - DNA, 11 bp, Homo sapiens
attttttcctt

SEQ ID NO: 2246299 - DNA, 12 bp, Homo sapiens
atttttttctac

SEQ ID NO: 2246300 - DNA, 16 bp, Homo sapiens
caaaaaatgttttaaa

SEQ ID NO: 2246301 - DNA, 18 bp, Homo sapiens
caaaaagaaaaaaagaaa

SEQ ID NO: 2246302 - DNA, 22 bp, Homo sapiens
caaaacaaaaattaggtatttt

SEQ ID NO: 2246303 - DNA, 16 bp, Homo sapiens
caaaacaaaggcctaa

SEQ ID NO: 2246304 - DNA, 22 bp, Homo sapiens
caaaacaaaggcctaattctat

SEQ ID NO: 2246305 - DNA, 13 bp, Homo sapiens
caaaaccatctct

SEQ ID NO: 2246306 - DNA, 17 bp, Homo sapiens
caaaaccatctctcttc

SEQ ID NO: 2246307 - DNA, 19 bp, Homo sapiens
caaaactactgacagggag

SEQ ID NO: 2246308 - DNA, 18 bp, Homo sapiens
caaaattcatttctaatt

SEQ ID NO: 2246309 - DNA, 13 bp, Homo sapiens
caaaatttgacta

SEQ ID NO: 2246310 - DNA, 14 bp, Homo sapiens
caaacgcctcccct

SEQ ID NO: 2246311 - DNA, 21 bp, Homo sapiens
caaacggcaacgtagcctggg

SEQ ID NO: 2246312 - DNA, 12 bp, Homo sapiens
caaactgcagct

SEQ ID NO: 2246313 - DNA, 16 bp, Homo sapiens
caaactggggcctcca

SEQ ID NO: 2246314 - DNA, 19 bp, Homo sapiens
caaactggggcctccagaa

SEQ ID NO: 2246315 - DNA, 22 bp, Homo sapiens
caaagaaacttgaagctttgta

SEQ ID NO: 2246316 - DNA, 14 bp, Homo sapiens
caaagaagtcggaa

SEQ ID NO: 2246317 - DNA, 15 bp, Homo sapiens
caaagacctacctcc

SEQ ID NO: 2246318 - DNA, 19 bp, Homo sapiens
caaagagcctcccaccaga

SEQ ID NO: 2246319 - DNA, 15 bp, Homo sapiens
caaagaggctgcccc

SEQ ID NO: 2246320 - DNA, 16 bp, Homo sapiens
caaagaggctgcccct

SEQ ID NO: 2246321 - DNA, 21 bp, Homo sapiens
caaagaggctgcccctctcac

SEQ ID NO: 2246322 - DNA, 14 bp, Homo sapiens
caaagttagagaac

SEQ ID NO: 2246323 - DNA, 17 bp, Homo sapiens
caaagttagagaactaa

SEQ ID NO: 2246324 - DNA, 23 bp, Homo sapiens
caaataatgatcgaaaaaataat

SEQ ID NO: 2246325 - DNA, 15 bp, Homo sapiens
caaatattttcatgt

SEQ ID NO: 2246326 - DNA, 21 bp, Homo sapiens
caaatcgtccagcgaccttcc

SEQ ID NO: 2246327 - DNA, 19 bp, Homo sapiens
caaatgaattctttaagga

SEQ ID NO: 2246328 - DNA, 19 bp, Homo sapiens
caaatgtgatttttgtaat

SEQ ID NO: 2246329 - DNA, 17 bp, Homo sapiens
caaattaataatcttat

SEQ ID NO: 2246330 - DNA, 18 bp, Homo sapiens
caaattagaaaatgttat

SEQ ID NO: 2246331 - DNA, 12 bp, Homo sapiens
cagatggcactt

SEQ ID NO: 2246332 - DNA, 18 bp, Homo sapiens
cagatgttaaaataaatg

SEQ ID NO: 2246333 - DNA, 14 bp, Homo sapiens
cagattaaacttca

SEQ ID NO: 2246334 - DNA, 14 bp, Homo sapiens
cagatttattttaa

SEQ ID NO: 2246335 - DNA, 14 bp, Homo sapiens
cagatttctgagga

SEQ ID NO: 2246336 - DNA, 15 bp, Homo sapiens
cagatttctgaggaa

SEQ ID NO: 2246337 - DNA, 17 bp, Homo sapiens
cagatttctgaggaaat

SEQ ID NO: 2246338 - DNA, 13 bp, Homo sapiens
cagatttggaaag

SEQ ID NO: 2246339 - DNA, 23 bp, Homo sapiens
cagatttgtaacattagttttaa

SEQ ID NO: 2246340 - DNA, 24 bp, Homo sapiens
cagatttgtctttttgttgtaaaa

SEQ ID NO: 2246341 - DNA, 12 bp, Homo sapiens
cagcaccctccc

SEQ ID NO: 2246342 - DNA, 19 bp, Homo sapiens
cagcactaaggccgtgtct

SEQ ID NO: 2246343 - DNA, 16 bp, Homo sapiens
cagcacttgttttcag

SEQ ID NO: 2246344 - DNA, 12 bp, Homo sapiens
cagcagcccccc

SEQ ID NO: 2246345 - DNA, 17 bp, Homo sapiens
cagcagccccccagcac

SEQ ID NO: 2246346 - DNA, 17 bp, Homo sapiens
cagcagcctttaatgca

SEQ ID NO: 2246347 - DNA, 11 bp, Homo sapiens
cagcaggctca

SEQ ID NO: 2246348 - DNA, 16 bp, Homo sapiens
cagcaggctcaggcac

SEQ ID NO: 2246349 - DNA, 14 bp, Homo sapiens
cagcaggctggcct

SEQ ID NO: 2246350 - DNA, 16 bp, Homo sapiens
cagcatcattaaagga

SEQ ID NO: 2246351 - DNA, 14 bp, Homo sapiens
cagccagccgccct

SEQ ID NO: 2246352 - DNA, 19 bp, Homo sapiens
cagccagccgccctgggct

SEQ ID NO: 2246353 - DNA, 19 bp, Homo sapiens
cagccagcctcagaaggcc

SEQ ID NO: 2246354 - DNA, 22 bp, Homo sapiens
cagccagcgcctccctccaccc

SEQ ID NO: 2246355 - DNA, 20 bp, Homo sapiens
cagccagttttactgtgatt

SEQ ID NO: 2246356 - DNA, 14 bp, Homo sapiens
cagccccccagcac

SEQ ID NO: 2246357 - DNA, 16 bp, Homo sapiens
cagccccccagcacta

SEQ ID NO: 2246358 - DNA, 18 bp, Homo sapiens
cagccccgactccagcca

SEQ ID NO: 2246359 - DNA, 20 bp, Homo sapiens
cagccccgactccagccagc

SEQ ID NO: 2246360 - DNA, 12 bp, Homo sapiens
cagcccgcttgg

SEQ ID NO: 2246361 - DNA, 21 bp, Homo sapiens
cagccctccccatggagccag

SEQ ID NO: 2246362 - DNA, 20 bp, Homo sapiens
cagccctgctggggatcccc

SEQ ID NO: 2246363 - DNA, 23 bp, Homo sapiens
cagcctcagagcatttaaggaaa

SEQ ID NO: 2246364 - DNA, 22 bp, Homo sapiens
cagcctccagggcattgctcag

SEQ ID NO: 2246365 - DNA, 23 bp, Homo sapiens
cagcctccagggcattgctcagc

SEQ ID NO: 2246366 - DNA, 12 bp, Homo sapiens
cagcctctgtga

SEQ ID NO: 2246367 - DNA, 16 bp, Homo sapiens
cagcctggcacaggcc

SEQ ID NO: 2246368 - DNA, 17 bp, Homo sapiens
cagcgaccgccccctcc

SEQ ID NO: 2246369 - DNA, 16 bp, Homo sapiens
cagcgcctccctccac

SEQ ID NO: 2246370 - DNA, 21 bp, Homo sapiens
cagcgcctccctccaccccag

SEQ ID NO: 2246371 - DNA, 16 bp, Homo sapiens
cagctaacaaactaga

SEQ ID NO: 2246372 - DNA, 18 bp, Homo sapiens
cagctacataagactgga

SEQ ID NO: 2246373 - DNA, 24 bp, Homo sapiens
cagctaccctttttctccagctgg

SEQ ID NO: 2246374 - DNA, 16 bp, Homo sapiens
cagctcataaaatgga

SEQ ID NO: 2246375 - DNA, 21 bp, Homo sapiens
cagctccaggtggctctgagg

SEQ ID NO: 2246376 - DNA, 14 bp, Homo sapiens
cagctcctcccaca

SEQ ID NO: 2246377 - DNA, 14 bp, Homo sapiens
cagctgagaggctg

SEQ ID NO: 2246378 - DNA, 14 bp, Homo sapiens
cagctgatgagtta

SEQ ID NO: 2246379 - DNA, 20 bp, Homo sapiens
cagctgatgagttacagcct

SEQ ID NO: 2246380 - DNA, 18 bp, Homo sapiens
cagctgcttcagggaggt

SEQ ID NO: 2246381 - DNA, 16 bp, Homo sapiens
cagctgggctctgcaa

SEQ ID NO: 2246382 - DNA, 17 bp, Homo sapiens
cagctgggctctgcaat

SEQ ID NO: 2246383 - DNA, 15 bp, Homo sapiens
cagcttaacaatgca

SEQ ID NO: 2246384 - DNA, 16 bp, Homo sapiens
cagcttaacaatgcaa

SEQ ID NO: 2246385 - DNA, 13 bp, Homo sapiens
cagcttattgttt

SEQ ID NO: 2246386 - DNA, 22 bp, Homo sapiens
cagcttctctgctagatttcta

SEQ ID NO: 2246387 - DNA, 20 bp, Homo sapiens
cagctttgatccctgacatc

SEQ ID NO: 2246388 - DNA, 14 bp, Homo sapiens
caggaaagccctcc

SEQ ID NO: 2246389 - DNA, 17 bp, Homo sapiens
caggaaagccctccccc

SEQ ID NO: 2246390 - DNA, 19 bp, Homo sapiens
caggaaagccctccccctt

SEQ ID NO: 2246391 - DNA, 23 bp, Homo sapiens
caggaaagccctcccccttcccc

SEQ ID NO: 2246392 - DNA, 15 bp, Homo sapiens
caggaactctggacc

SEQ ID NO: 2246393 - DNA, 19 bp, Homo sapiens
caggaagcctgcagtcctg

SEQ ID NO: 2246394 - DNA, 20 bp, Homo sapiens
caggaagggatgcaggctcc

SEQ ID NO: 2246395 - DNA, 17 bp, Homo sapiens
caggaatgtgtggcctg

SEQ ID NO: 2246396 - DNA, 23 bp, Homo sapiens
caggaatgtgtggcctgcacagt

SEQ ID NO: 2246397 - DNA, 17 bp, Homo sapiens
caggaccaagggcagag

SEQ ID NO: 2246398 - DNA, 14 bp, Homo sapiens
caggacgccactca

SEQ ID NO: 2246399 - DNA, 18 bp, Homo sapiens
caggacgccactcatttc

SEQ ID NO: 2246400 - DNA, 19 bp, Homo sapiens
caggacgccactcatttca

SEQ ID NO: 2246401 - DNA, 21 bp, Homo sapiens
caggacgccactcatttcatc

SEQ ID NO: 2246402 - DNA, 17 bp, Homo sapiens
caggagcaggcacgggt

SEQ ID NO: 2246403 - DNA, 18 bp, Homo sapiens
caggatactggcacagag

SEQ ID NO: 2246404 - DNA, 20 bp, Homo sapiens
caggatactggcacagaggt

SEQ ID NO: 2246405 - DNA, 15 bp, Homo sapiens
caggatccccctctt

SEQ ID NO: 2246406 - DNA, 15 bp, Homo sapiens
caggatgctgagctt

SEQ ID NO: 2246407 - DNA, 20 bp, Homo sapiens
caggcaccaggactagggct

SEQ ID NO: 2246408 - DNA, 16 bp, Homo sapiens
caggcacccacatccc

SEQ ID NO: 2246409 - DNA, 16 bp, Homo sapiens
caggcacgggtggtcc

SEQ ID NO: 2246410 - DNA, 17 bp, Homo sapiens
caggcacgggtggtccc

SEQ ID NO: 2246411 - DNA, 19 bp, Homo sapiens
caggcacgggtggtccccg

SEQ ID NO: 2246412 - DNA, 22 bp, Homo sapiens
caggcatctgttagcagagtct

SEQ ID NO: 2246413 - DNA, 23 bp, Homo sapiens
caggcatctgttagcagagtctg

SEQ ID NO: 2246414 - DNA, 24 bp, Homo sapiens
caggcatctgttagcagagtctgt

SEQ ID NO: 2246415 - DNA, 14 bp, Homo sapiens
caggcccactcccc

SEQ ID NO: 2246416 - DNA, 20 bp, Homo sapiens
caggccctccctgactccct

SEQ ID NO: 2246417 - DNA, 15 bp, Homo sapiens
caggcctgtccaaca

SEQ ID NO: 2246418 - DNA, 17 bp, Homo sapiens
caggctatgtataaaat

SEQ ID NO: 2246419 - DNA, 16 bp, Homo sapiens
caggctcccctgagga

SEQ ID NO: 2246420 - DNA, 10 bp, Homo sapiens
caggctgggc

SEQ ID NO: 2246421 - DNA, 11 bp, Homo sapiens
caggctgggcc

SEQ ID NO: 2246422 - DNA, 17 bp, Homo sapiens
caggctgggccatgtcc

SEQ ID NO: 2246423 - DNA, 16 bp, Homo sapiens
cagggaatgcagcagg

SEQ ID NO: 2246424 - DNA, 18 bp, Homo sapiens
cagggaatgcagcaggaa

SEQ ID NO: 2246425 - DNA, 19 bp, Homo sapiens
cagggacatgccctgtgtg

SEQ ID NO: 2246426 - DNA, 22 bp, Homo sapiens
cagggaccactgggtgagagag

SEQ ID NO: 2246427 - DNA, 15 bp, Homo sapiens
cagggagcagccccc

SEQ ID NO: 2246428 - DNA, 21 bp, Homo sapiens
cagggatgggggatgggccag

SEQ ID NO: 2246429 - DNA, 15 bp, Homo sapiens
cagggcattgctcag

SEQ ID NO: 2246430 - DNA, 22 bp, Homo sapiens
cagggcattgctcagcccgctt

SEQ ID NO: 2246431 - DNA, 20 bp, Homo sapiens
caggggaattccctccccct

SEQ ID NO: 2246432 - DNA, 21 bp, Homo sapiens
caggggaattccctccccctc

SEQ ID NO: 2246433 - DNA, 23 bp, Homo sapiens
caggggaattccctccccctcct

SEQ ID NO: 2246434 - DNA, 15 bp, Homo sapiens
cagggggccctgccc

SEQ ID NO: 2246435 - DNA, 15 bp, Homo sapiens
caggggtctgagcca

SEQ ID NO: 2246436 - DNA, 22 bp, Homo sapiens
cagggtttacccagtgggacag

SEQ ID NO: 2246437 - DNA, 15 bp, Homo sapiens
caggtaaaacagggc

SEQ ID NO: 2246438 - DNA, 20 bp, Homo sapiens
caggtaaaacagggccacat

SEQ ID NO: 2246439 - DNA, 23 bp, Homo sapiens
aaaagccaggttccacagaggac

SEQ ID NO: 2246440 - DNA, 23 bp, Homo sapiens
aaaaggggggggcaatctctctc

SEQ ID NO: 2246441 - DNA, 13 bp, Homo sapiens
aaaagtaaaatgt

SEQ ID NO: 2246442 - DNA, 14 bp, Homo sapiens
aaaagtgcaatgcg

SEQ ID NO: 2246443 - DNA, 15 bp, Homo sapiens
aaaataaacactaca

SEQ ID NO: 2246444 - DNA, 14 bp, Homo sapiens
aaaataaactataa

SEQ ID NO: 2246445 - DNA, 21 bp, Homo sapiens
aaaataaactataaaacaaaa

SEQ ID NO: 2246446 - DNA, 13 bp, Homo sapiens
aaaataagtaaat

SEQ ID NO: 2246447 - DNA, 19 bp, Homo sapiens
aaaataattatttattaca

SEQ ID NO: 2246448 - DNA, 16 bp, Homo sapiens
aaaatactatttaaga

SEQ ID NO: 2246449 - DNA, 17 bp, Homo sapiens
aaaatactatttaagat

SEQ ID NO: 2246450 - DNA, 22 bp, Homo sapiens
aaaatactatttaagatgtgaa

SEQ ID NO: 2246451 - DNA, 23 bp, Homo sapiens
aaaatactatttaagatgtgaaa

SEQ ID NO: 2246452 - DNA, 16 bp, Homo sapiens
aaaataggctttttaa

SEQ ID NO: 2246453 - DNA, 21 bp, Homo sapiens
aaaataggctttttaatcatg

SEQ ID NO: 2246454 - DNA, 14 bp, Homo sapiens
aaaatatatatcta

SEQ ID NO: 2246455 - DNA, 12 bp, Homo sapiens
aaaatatcttgg

SEQ ID NO: 2246456 - DNA, 20 bp, Homo sapiens
aaaatattgttttacaatag

SEQ ID NO: 2246457 - DNA, 13 bp, Homo sapiens
aaaatattttctc

SEQ ID NO: 2246458 - DNA, 23 bp, Homo sapiens
aaaatattttctctgtacttttc

SEQ ID NO: 2246459 - DNA, 15 bp, Homo sapiens
aaaatcctgtgcaat

SEQ ID NO: 2246460 - DNA, 15 bp, Homo sapiens
aaaatctgctgttaa

SEQ ID NO: 2246461 - DNA, 17 bp, Homo sapiens
aaaatctgctgttaact

SEQ ID NO: 2246462 - DNA, 19 bp, Homo sapiens
aaaatgacaccatctttta

SEQ ID NO: 2246463 - DNA, 21 bp, Homo sapiens
aaaatgccatttagcaataaa

SEQ ID NO: 2246464 - DNA, 24 bp, Homo sapiens
aaaatggtatcaaaattacatata

SEQ ID NO: 2246465 - DNA, 13 bp, Homo sapiens
aaaatgtatctaa

SEQ ID NO: 2246466 - DNA, 19 bp, Homo sapiens
aaaattactgtgaattgtt

SEQ ID NO: 2246467 - DNA, 13 bp, Homo sapiens
aaaattatttgta

SEQ ID NO: 2246468 - DNA, 19 bp, Homo sapiens
aaaattcatagtaagattg

SEQ ID NO: 2246469 - DNA, 14 bp, Homo sapiens
aaaattcatttcta

SEQ ID NO: 2246470 - DNA, 16 bp, Homo sapiens
aaaattggttggagaa

SEQ ID NO: 2246471 - DNA, 17 bp, Homo sapiens
aaaatttaaaagtaaaa

SEQ ID NO: 2246472 - DNA, 20 bp, Homo sapiens
aaaatttttaaaatacttgt

SEQ ID NO: 2246473 - DNA, 13 bp, Homo sapiens
aaacaaaatgaag

SEQ ID NO: 2246474 - DNA, 15 bp, Homo sapiens
aaacaaaatttgact

SEQ ID NO: 2246475 - DNA, 17 bp, Homo sapiens
aaacaaaatttgactaa

SEQ ID NO: 2246476 - DNA, 17 bp, Homo sapiens
aaacaaagttactaggt

SEQ ID NO: 2246477 - DNA, 19 bp, Homo sapiens
aaacacactactacctctt

SEQ ID NO: 2246478 - DNA, 18 bp, Homo sapiens
aaacacctcctcatgtac

SEQ ID NO: 2246479 - DNA, 22 bp, Homo sapiens
aaacactcaagttgattagaaa

SEQ ID NO: 2246480 - DNA, 17 bp, Homo sapiens
aaacagggccacataga

SEQ ID NO: 2246481 - DNA, 21 bp, Homo sapiens
aaacatagaaatggaaatttt

SEQ ID NO: 2246482 - DNA, 17 bp, Homo sapiens
aaacatccaatattttc

SEQ ID NO: 2246483 - DNA, 14 bp, Homo sapiens
aaacattaaaatat

SEQ ID NO: 2246484 - DNA, 18 bp, Homo sapiens
aaacatttcataatttgt

SEQ ID NO: 2246485 - DNA, 21 bp, Homo sapiens
aaacatttctggacagtacct

SEQ ID NO: 2246486 - DNA, 14 bp, Homo sapiens
aaaccctcagagcc

SEQ ID NO: 2246487 - DNA, 15 bp, Homo sapiens
aaaccctcagagcct

SEQ ID NO: 2246488 - DNA, 12 bp, Homo sapiens
aaaccttttatt

SEQ ID NO: 2246489 - DNA, 15 bp, Homo sapiens
aaaccttttattata

SEQ ID NO: 2246490 - DNA, 17 bp, Homo sapiens
aaactataaaacaaaaa

SEQ ID NO: 2246491 - DNA, 17 bp, Homo sapiens
aaactatgtgtttttct

SEQ ID NO: 2246492 - DNA, 16 bp, Homo sapiens
aaactcatctgaaatg

SEQ ID NO: 2246493 - DNA, 15 bp, Homo sapiens
aaactccagatgcca

SEQ ID NO: 2246494 - DNA, 13 bp, Homo sapiens
aaactgagaaatg

SEQ ID NO: 2246495 - DNA, 13 bp, Homo sapiens
aaactgatttctc

SEQ ID NO: 2246496 - DNA, 17 bp, Homo sapiens
aaactgatttctcacgg

SEQ ID NO: 2246497 - DNA, 17 bp, Homo sapiens
aaactgggaaactgggt

SEQ ID NO: 2246498 - DNA, 17 bp, Homo sapiens
aaactggggcctccaga

SEQ ID NO: 2246499 - DNA, 14 bp, Homo sapiens
aaactgtcactgtt

SEQ ID NO: 2246500 - DNA, 20 bp, Homo sapiens
aaactgttttagacctataa

SEQ ID NO: 2246501 - DNA, 16 bp, Homo sapiens
aaactttaggtttttt

SEQ ID NO: 2246502 - DNA, 12 bp, Homo sapiens
aaagaaatacag

SEQ ID NO: 2246503 - DNA, 15 bp, Homo sapiens
aaagaatatgacttt

SEQ ID NO: 2246504 - DNA, 20 bp, Homo sapiens
aaagaatatgactttttata

SEQ ID NO: 2246505 - DNA, 14 bp, Homo sapiens
aaagaatttagtat

SEQ ID NO: 2246506 - DNA, 14 bp, Homo sapiens
aaagacactgcaga

SEQ ID NO: 2246507 - DNA, 21 bp, Homo sapiens
aaagagaattgggggcttagg

SEQ ID NO: 2246508 - DNA, 18 bp, Homo sapiens
aaagaggctgcccctctc

SEQ ID NO: 2246509 - DNA, 23 bp, Homo sapiens
aaagatgtctctgcaaaccaaca

SEQ ID NO: 2246510 - DNA, 16 bp, Homo sapiens
aaagatgttctggata

SEQ ID NO: 2246511 - DNA, 15 bp, Homo sapiens
aaagattttaatcaa

SEQ ID NO: 2246512 - DNA, 18 bp, Homo sapiens
aaagcacaagtacttttg

SEQ ID NO: 2246513 - DNA, 14 bp, Homo sapiens
aaagcagaggccaa

SEQ ID NO: 2246514 - DNA, 16 bp, Homo sapiens
aaagcatgaaatgtga

SEQ ID NO: 2246515 - DNA, 22 bp, Homo sapiens
aaagccaaccttcaaagaaact

SEQ ID NO: 2246516 - DNA, 18 bp, Homo sapiens
aaagccatgccaataaag

SEQ ID NO: 2246517 - DNA, 15 bp, Homo sapiens
aaagcttttagaaat

SEQ ID NO: 2246518 - DNA, 14 bp, Homo sapiens
aaaggattttacca

SEQ ID NO: 2246519 - DNA, 19 bp, Homo sapiens
aaaggattttaccaaagca

SEQ ID NO: 2246520 - DNA, 15 bp, Homo sapiens
aaagggaaactggga

SEQ ID NO: 2246521 - DNA, 18 bp, Homo sapiens
aaagtattctttttcttt

SEQ ID NO: 2246522 - DNA, 21 bp, Homo sapiens
aaagtgatcttgagaaccttt

SEQ ID NO: 2246523 - DNA, 14 bp, Homo sapiens
aaagtgcaatgcgt

SEQ ID NO: 2246524 - DNA, 16 bp, Homo sapiens
aaagtgccttgctcat

SEQ ID NO: 2246525 - DNA, 23 bp, Homo sapiens
aaagtgtcagaaggagctacaaa

SEQ ID NO: 2246526 - DNA, 20 bp, Homo sapiens
aaagttactaggtaacttca

SEQ ID NO: 2246527 - DNA, 18 bp, Homo sapiens
aaagttggtattaataaa

SEQ ID NO: 2246528 - DNA, 15 bp, Homo sapiens
aaagtttaatcagag

SEQ ID NO: 2246529 - DNA, 15 bp, Homo sapiens
aaagtttgcttagaa

SEQ ID NO: 2246530 - DNA, 17 bp, Homo sapiens
aaagttttgttctgtat

SEQ ID NO: 2246531 - DNA, 22 bp, Homo sapiens
aaagttttgttctgtatatttt

SEQ ID NO: 2246532 - DNA, 16 bp, Homo sapiens
aaataaaagcacaagt

SEQ ID NO: 2246533 - DNA, 16 bp, Homo sapiens
aaataaacactacaga

SEQ ID NO: 2246534 - DNA, 21 bp, Homo sapiens
aaataaatggtttggtgcttt

SEQ ID NO: 2246535 - DNA, 14 bp, Homo sapiens
aaataactaaaatg

SEQ ID NO: 2246536 - DNA, 20 bp, Homo sapiens
aaataagcaaataaacagtg

SEQ ID NO: 2246537 - DNA, 13 bp, Homo sapiens
aaataattttgta

SEQ ID NO: 2246538 - DNA, 15 bp, Homo sapiens
aaatacaaaacttcc

SEQ ID NO: 2246539 - DNA, 20 bp, Homo sapiens
aaatacaatttttatttctt

SEQ ID NO: 2246540 - DNA, 15 bp, Homo sapiens
aaatacagactggat

SEQ ID NO: 2246541 - DNA, 15 bp, Homo sapiens
aaatacatagtgaaa

SEQ ID NO: 2246542 - DNA, 18 bp, Homo sapiens
aaatacttgtttcagctt

SEQ ID NO: 2246543 - DNA, 19 bp, Homo sapiens
aaatacttgtttcagcttc

SEQ ID NO: 2246544 - DNA, 21 bp, Homo sapiens
aaatacttttgctttcaggga

SEQ ID NO: 2246545 - DNA, 17 bp, Homo sapiens
aaatagacagcatgaga

SEQ ID NO: 2246546 - DNA, 16 bp, Homo sapiens
aaataggatttttaga

SEQ ID NO: 2246547 - DNA, 22 bp, Homo sapiens
aaatatatatctatctatttga

SEQ ID NO: 2246548 - DNA, 17 bp, Homo sapiens
aagtcagattgctggga

SEQ ID NO: 2246549 - DNA, 15 bp, Homo sapiens
aagtcccatcataga

SEQ ID NO: 2246550 - DNA, 15 bp, Homo sapiens
aagtctgtacctcaa

SEQ ID NO: 2246551 - DNA, 22 bp, Homo sapiens
aagtctgtacctcaaatgaatt

SEQ ID NO: 2246552 - DNA, 14 bp, Homo sapiens
aagtctttaataaa

SEQ ID NO: 2246553 - DNA, 16 bp, Homo sapiens
aagtctttaataaata

SEQ ID NO: 2246554 - DNA, 18 bp, Homo sapiens
aagtctttaataaataac

SEQ ID NO: 2246555 - DNA, 18 bp, Homo sapiens
aagtgcctcacatttttt

SEQ ID NO: 2246556 - DNA, 22 bp, Homo sapiens
aagtgctggcaaccactaagaa

SEQ ID NO: 2246557 - DNA, 14 bp, Homo sapiens
aagtgtataatata

SEQ ID NO: 2246558 - DNA, 21 bp, Homo sapiens
aagtgtctcactaaagcatga

SEQ ID NO: 2246559 - DNA, 14 bp, Homo sapiens
aagtgttggaaaaa

SEQ ID NO: 2246560 - DNA, 19 bp, Homo sapiens
aagttactaggtaacttca

SEQ ID NO: 2246561 - DNA, 20 bp, Homo sapiens
aagttactaggtaacttcat

SEQ ID NO: 2246562 - DNA, 22 bp, Homo sapiens
aagttagaactagccaaaccag

SEQ ID NO: 2246563 - DNA, 18 bp, Homo sapiens
aagttagttccactgaga

SEQ ID NO: 2246564 - DNA, 19 bp, Homo sapiens
aagttggtattaataaaaa

SEQ ID NO: 2246565 - DNA, 20 bp, Homo sapiens
aagttgtgcttgagccagga

SEQ ID NO: 2246566 - DNA, 20 bp, Homo sapiens
aagtttgaaaagcaatattg

SEQ ID NO: 2246567 - DNA, 15 bp, Homo sapiens
aagtttgcttagaaa

SEQ ID NO: 2246568 - DNA, 16 bp, Homo sapiens
aagtttgcttagaaaa

SEQ ID NO: 2246569 - DNA, 17 bp, Homo sapiens
aagttttgttctgtata

SEQ ID NO: 2246570 - DNA, 18 bp, Homo sapiens
aagttttgttctgtatat

SEQ ID NO: 2246571 - DNA, 11 bp, Homo sapiens
aataaaagcac

SEQ ID NO: 2246572 - DNA, 14 bp, Homo sapiens
aataaaatttgttg

SEQ ID NO: 2246573 - DNA, 16 bp, Homo sapiens
aataaaatttgttgca

SEQ ID NO: 2246574 - DNA, 16 bp, Homo sapiens
aataaataacacttgt

SEQ ID NO: 2246575 - DNA, 12 bp, Homo sapiens
aataaatatacc

SEQ ID NO: 2246576 - DNA, 13 bp, Homo sapiens
aataactaaaatg

SEQ ID NO: 2246577 - DNA, 15 bp, Homo sapiens
aataactaaaatgta

SEQ ID NO: 2246578 - DNA, 21 bp, Homo sapiens
aataactggaacaaattattt

SEQ ID NO: 2246579 - DNA, 18 bp, Homo sapiens
aataagttattgcagttt

SEQ ID NO: 2246580 - DNA, 15 bp, Homo sapiens
aataagtttgaaata

SEQ ID NO: 2246581 - DNA, 17 bp, Homo sapiens
aataatatattttctgt

SEQ ID NO: 2246582 - DNA, 23 bp, Homo sapiens
aataatcttattagggagaaaat

SEQ ID NO: 2246583 - DNA, 13 bp, Homo sapiens
aataatgtattta

SEQ ID NO: 2246584 - DNA, 15 bp, Homo sapiens
aataatgtatttact

SEQ ID NO: 2246585 - DNA, 16 bp, Homo sapiens
aataattatttattac

SEQ ID NO: 2246586 - DNA, 16 bp, Homo sapiens
aataattgttgtgtgt

SEQ ID NO: 2246587 - DNA, 13 bp, Homo sapiens
aataattttgtaa

SEQ ID NO: 2246588 - DNA, 15 bp, Homo sapiens
aatacagactggatg

SEQ ID NO: 2246589 - DNA, 13 bp, Homo sapiens
aatacagatttgt

SEQ ID NO: 2246590 - DNA, 17 bp, Homo sapiens
aatacagatttgtaaca

SEQ ID NO: 2246591 - DNA, 16 bp, Homo sapiens
aatacatagtgaaaat

SEQ ID NO: 2246592 - DNA, 14 bp, Homo sapiens
aatacatttaaaac

SEQ ID NO: 2246593 - DNA, 23 bp, Homo sapiens
aatacatttaaaacattaaaata

SEQ ID NO: 2246594 - DNA, 14 bp, Homo sapiens
aatactatttaaga

SEQ ID NO: 2246595 - DNA, 15 bp, Homo sapiens
aatactatttaagat

SEQ ID NO: 2246596 - DNA, 21 bp, Homo sapiens
aatactatttaagatgtgaaa

SEQ ID NO: 2246597 - DNA, 14 bp, Homo sapiens
aatactctttattt

SEQ ID NO: 2246598 - DNA, 16 bp, Homo sapiens
aatactgttctttcca

SEQ ID NO: 2246599 - DNA, 23 bp, Homo sapiens
aatactttgcagcacagctgaga

SEQ ID NO: 2246600 - DNA, 15 bp, Homo sapiens
aataggcaaattaat

SEQ ID NO: 2246601 - DNA, 23 bp, Homo sapiens
aataggcagggggccctgcccca

SEQ ID NO: 2246602 - DNA, 22 bp, Homo sapiens
aatagtttgttgatctgataag

SEQ ID NO: 2246603 - DNA, 12 bp, Homo sapiens
aatataagaaaa

SEQ ID NO: 2246604 - DNA, 14 bp, Homo sapiens
aatatagagatatt

SEQ ID NO: 2246605 - DNA, 16 bp, Homo sapiens
aatatattatttcctt

SEQ ID NO: 2246606 - DNA, 15 bp, Homo sapiens
aatatattttctgtt

SEQ ID NO: 2246607 - DNA, 21 bp, Homo sapiens
aatatattttctgttttcttt

SEQ ID NO: 2246608 - DNA, 15 bp, Homo sapiens
aatatcttggcctaa

SEQ ID NO: 2246609 - DNA, 13 bp, Homo sapiens
aatatgaaaactt

SEQ ID NO: 2246610 - DNA, 14 bp, Homo sapiens
aatatgaaaactta

SEQ ID NO: 2246611 - DNA, 14 bp, Homo sapiens
aatatgatgacaat

SEQ ID NO: 2246612 - DNA, 21 bp, Homo sapiens
aatatggaaccttccctccaa

SEQ ID NO: 2246613 - DNA, 14 bp, Homo sapiens
aatatggaacttac

SEQ ID NO: 2246614 - DNA, 16 bp, Homo sapiens
aatatggaacttacat

SEQ ID NO: 2246615 - DNA, 17 bp, Homo sapiens
aatatggaacttacatt

SEQ ID NO: 2246616 - DNA, 20 bp, Homo sapiens
aatatggaacttacattgtt

SEQ ID NO: 2246617 - DNA, 24 bp, Homo sapiens
aatatggaacttacattgttcaat

SEQ ID NO: 2246618 - DNA, 23 bp, Homo sapiens
aatattaggcttaaaaactgaaa

SEQ ID NO: 2246619 - DNA, 14 bp, Homo sapiens
aatattgtatattt

SEQ ID NO: 2246620 - DNA, 20 bp, Homo sapiens
aatattgtatatttttatct

SEQ ID NO: 2246621 - DNA, 18 bp, Homo sapiens
aatatttaagtttgttgc

SEQ ID NO: 2246622 - DNA, 17 bp, Homo sapiens
aatatttaccttgaaaa

SEQ ID NO: 2246623 - DNA, 13 bp, Homo sapiens
aatatttataaaa

SEQ ID NO: 2246624 - DNA, 12 bp, Homo sapiens
aatatttctcta

SEQ ID NO: 2246625 - DNA, 16 bp, Homo sapiens
aatattttctatttta

SEQ ID NO: 2246626 - DNA, 23 bp, Homo sapiens
aatattttctctgtacttttcat

SEQ ID NO: 2246627 - DNA, 21 bp, Homo sapiens
aatattttctttaatgctttt

SEQ ID NO: 2246628 - DNA, 14 bp, Homo sapiens
aatcaagtaatgaa

SEQ ID NO: 2246629 - DNA, 15 bp, Homo sapiens
aatcaagtaatgaat

SEQ ID NO: 2246630 - DNA, 12 bp, Homo sapiens
aatcaataatat

SEQ ID NO: 2246631 - DNA, 17 bp, Homo sapiens
aatcactgcactgcatg

SEQ ID NO: 2246632 - DNA, 21 bp, Homo sapiens
aatcactgcactgcatgcaaa

SEQ ID NO: 2246633 - DNA, 17 bp, Homo sapiens
aatcagtataaacaaag

SEQ ID NO: 2246634 - DNA, 22 bp, Homo sapiens
aatcatagttactgtgtaaact

SEQ ID NO: 2246635 - DNA, 20 bp, Homo sapiens
aatcatccatccttgccaat

SEQ ID NO: 2246636 - DNA, 23 bp, Homo sapiens
aatcatctgcagttctttttgta

SEQ ID NO: 2246637 - DNA, 22 bp, Homo sapiens
aatcatgttgatcatgtacttt

SEQ ID NO: 2246638 - DNA, 23 bp, Homo sapiens
aatcatgttgatcatgtactttt

SEQ ID NO: 2246639 - DNA, 18 bp, Homo sapiens
aatcattttcattcctaa

SEQ ID NO: 2246640 - DNA, 14 bp, Homo sapiens
aatccaaacttgga

SEQ ID NO: 2246641 - DNA, 23 bp, Homo sapiens
aatccctttattaccccctcctt

SEQ ID NO: 2246642 - DNA, 17 bp, Homo sapiens
aatcctacctgttttgt

SEQ ID NO: 2246643 - DNA, 17 bp, Homo sapiens
aatccttgataatatat

SEQ ID NO: 2246644 - DNA, 23 bp, Homo sapiens
aatctatttacataaaatgggtg

SEQ ID NO: 2246645 - DNA, 12 bp, Homo sapiens
aatctccttact

SEQ ID NO: 2246646 - DNA, 14 bp, Homo sapiens
aatctctaggaagt

SEQ ID NO: 2246647 - DNA, 14 bp, Homo sapiens
aatctggagaccag

SEQ ID NO: 2246648 - DNA, 15 bp, Homo sapiens
aatcttgtagacact

SEQ ID NO: 2246649 - DNA, 16 bp, Homo sapiens
aatcttgtagacactt

SEQ ID NO: 2246650 - DNA, 16 bp, Homo sapiens
aatctttgtgacagga

SEQ ID NO: 2246651 - DNA, 14 bp, Homo sapiens
aatgaaagggaaac

SEQ ID NO: 2246652 - DNA, 15 bp, Homo sapiens
aatgaaagggaaact

SEQ ID NO: 2246653 - DNA, 14 bp, Homo sapiens
aatgaacaaaatta

SEQ ID NO: 2246654 - DNA, 16 bp, Homo sapiens
aatgaacaaaattatt

SEQ ID NO: 2246655 - DNA, 16 bp, Homo sapiens
aatgaacttgttactt

SEQ ID NO: 2246656 - DNA, 17 bp, Homo sapiens
aatgaaggttttcattt

SEQ ID NO: 2246657 - DNA, 18 bp, Homo sapiens
acccccacccccagctca

SEQ ID NO: 2246658 - DNA, 12 bp, Homo sapiens
acccccagcccc

SEQ ID NO: 2246659 - DNA, 22 bp, Homo sapiens
acccccagccccgactccagcc

SEQ ID NO: 2246660 - DNA, 23 bp, Homo sapiens
acccccagccccgactccagcca

SEQ ID NO: 2246661 - DNA, 20 bp, Homo sapiens
acccccagctcaatggactg

SEQ ID NO: 2246662 - DNA, 21 bp, Homo sapiens
acccccagctcaatggactgg

SEQ ID NO: 2246663 - DNA, 17 bp, Homo sapiens
acccccatccagcctcc

SEQ ID NO: 2246664 - DNA, 14 bp, Homo sapiens
accccctcccaccc

SEQ ID NO: 2246665 - DNA, 17 bp, Homo sapiens
accccctcccaccccca

SEQ ID NO: 2246666 - DNA, 11 bp, Homo sapiens
accccctcctc

SEQ ID NO: 2246667 - DNA, 12 bp, Homo sapiens
accccctccttc

SEQ ID NO: 2246668 - DNA, 16 bp, Homo sapiens
accccctccttcagac

SEQ ID NO: 2246669 - DNA, 17 bp, Homo sapiens
accccctccttcagaca

SEQ ID NO: 2246670 - DNA, 14 bp, Homo sapiens
accccgtgttcaaa

SEQ ID NO: 2246671 - DNA, 14 bp, Homo sapiens
acccctcctggcct

SEQ ID NO: 2246672 - DNA, 14 bp, Homo sapiens
accctatgggtcta

SEQ ID NO: 2246673 - DNA, 16 bp, Homo sapiens
accctatgggtctagg

SEQ ID NO: 2246674 - DNA, 14 bp, Homo sapiens
accctcagagcctc

SEQ ID NO: 2246675 - DNA, 19 bp, Homo sapiens
accctcagtgagcatggta

SEQ ID NO: 2246676 - DNA, 15 bp, Homo sapiens
accctccagagacaa

SEQ ID NO: 2246677 - DNA, 13 bp, Homo sapiens
accctcccccgca

SEQ ID NO: 2246678 - DNA, 22 bp, Homo sapiens
accctctcctgggggtggcagg

SEQ ID NO: 2246679 - DNA, 23 bp, Homo sapiens
accctctggaggggtgtggctcc

SEQ ID NO: 2246680 - DNA, 13 bp, Homo sapiens
accctgcaagacc

SEQ ID NO: 2246681 - DNA, 20 bp, Homo sapiens
accctgcaagaccacggagg

SEQ ID NO: 2246682 - DNA, 19 bp, Homo sapiens
accctggccgccccctgcc

SEQ ID NO: 2246683 - DNA, 20 bp, Homo sapiens
accctgtactgttctgtgtc

SEQ ID NO: 2246684 - DNA, 15 bp, Homo sapiens
acccttattgctgtc

SEQ ID NO: 2246685 - DNA, 17 bp, Homo sapiens
acccttattgctgtcct

SEQ ID NO: 2246686 - DNA, 16 bp, Homo sapiens
acccttgctgtgaatt

SEQ ID NO: 2246687 - DNA, 14 bp, Homo sapiens
accctttatttgaa

SEQ ID NO: 2246688 - DNA, 17 bp, Homo sapiens
accgagtctctgtataa

SEQ ID NO: 2246689 - DNA, 19 bp, Homo sapiens
accgccccctcctctagct

SEQ ID NO: 2246690 - DNA, 18 bp, Homo sapiens
accgcccttttcccctac

SEQ ID NO: 2246691 - DNA, 15 bp, Homo sapiens
accgggagcctcccc

SEQ ID NO: 2246692 - DNA, 20 bp, Homo sapiens
accgggagcctccccctcag

SEQ ID NO: 2246693 - DNA, 20 bp, Homo sapiens
acctaacaacattgtagcct

SEQ ID NO: 2246694 - DNA, 17 bp, Homo sapiens
acctaccctcagtgagc

SEQ ID NO: 2246695 - DNA, 18 bp, Homo sapiens
acctaccttactatttaa

SEQ ID NO: 2246696 - DNA, 22 bp, Homo sapiens
acctagaaattgacacaagtgg

SEQ ID NO: 2246697 - DNA, 14 bp, Homo sapiens
acctcacctagaaa

SEQ ID NO: 2246698 - DNA, 16 bp, Homo sapiens
acctcactatggtatg

SEQ ID NO: 2246699 - DNA, 23 bp, Homo sapiens
acctcactatggtatgctggcca

SEQ ID NO: 2246700 - DNA, 16 bp, Homo sapiens
acctcaggcagctcaa

SEQ ID NO: 2246701 - DNA, 15 bp, Homo sapiens
acctcatttttcata

SEQ ID NO: 2246702 - DNA, 17 bp, Homo sapiens
acctcatttttcatact

SEQ ID NO: 2246703 - DNA, 15 bp, Homo sapiens
acctccagacttcaa

SEQ ID NO: 2246704 - DNA, 11 bp, Homo sapiens
acctccccctt

SEQ ID NO: 2246705 - DNA, 19 bp, Homo sapiens
acctcctatgggttgtcac

SEQ ID NO: 2246706 - DNA, 22 bp, Homo sapiens
acctcctgtgttgtgctgggag

SEQ ID NO: 2246707 - DNA, 14 bp, Homo sapiens
acctcgtcaagagc

SEQ ID NO: 2246708 - DNA, 13 bp, Homo sapiens
acctctcactgcc

SEQ ID NO: 2246709 - DNA, 14 bp, Homo sapiens
acctcttctggctc

SEQ ID NO: 2246710 - DNA, 22 bp, Homo sapiens
acctgaataccacttacctcaa

SEQ ID NO: 2246711 - DNA, 12 bp, Homo sapiens
acctgagctaaa

SEQ ID NO: 2246712 - DNA, 22 bp, Homo sapiens
acctgagctaaataaagatatt

SEQ ID NO: 2246713 - DNA, 14 bp, Homo sapiens
acctgattgtattt

SEQ ID NO: 2246714 - DNA, 15 bp, Homo sapiens
acctggcgtgctcag

SEQ ID NO: 2246715 - DNA, 18 bp, Homo sapiens
acctggtaccctcctggc

SEQ ID NO: 2246716 - DNA, 12 bp, Homo sapiens
acctggtggcac

SEQ ID NO: 2246717 - DNA, 20 bp, Homo sapiens
acctggtggcaccagatgca

SEQ ID NO: 2246718 - DNA, 23 bp, Homo sapiens
acctgtataagtggaggcacttt

SEQ ID NO: 2246719 - DNA, 19 bp, Homo sapiens
accttcaaagaaacttgaa

SEQ ID NO: 2246720 - DNA, 14 bp, Homo sapiens
accttcccaaacgc

SEQ ID NO: 2246721 - DNA, 13 bp, Homo sapiens
accttccctccaa

SEQ ID NO: 2246722 - DNA, 22 bp, Homo sapiens
accttctttgtaatcccttcac

SEQ ID NO: 2246723 - DNA, 22 bp, Homo sapiens
acctttccctcaccccctccca

SEQ ID NO: 2246724 - DNA, 19 bp, Homo sapiens
acctttccgctgtcgcccc

SEQ ID NO: 2246725 - DNA, 14 bp, Homo sapiens
accttttacagaat

SEQ ID NO: 2246726 - DNA, 15 bp, Homo sapiens
accttttacagaata

SEQ ID NO: 2246727 - DNA, 13 bp, Homo sapiens
accttttactgtg

SEQ ID NO: 2246728 - DNA, 14 bp, Homo sapiens
accttttactgtga

SEQ ID NO: 2246729 - DNA, 21 bp, Homo sapiens
accttttgaggagccccagct

SEQ ID NO: 2246730 - DNA, 16 bp, Homo sapiens
accttttgggaatgtt

SEQ ID NO: 2246731 - DNA, 22 bp, Homo sapiens
accttttgggaatgttttaaat

SEQ ID NO: 2246732 - DNA, 20 bp, Homo sapiens
acgaagcggagagagccaag

SEQ ID NO: 2246733 - DNA, 21 bp, Homo sapiens
acgaagcggagagagccaaga

SEQ ID NO: 2246734 - DNA, 17 bp, Homo sapiens
acgacttttttgagaca

SEQ ID NO: 2246735 - DNA, 11 bp, Homo sapiens
acgagaccccc

SEQ ID NO: 2246736 - DNA, 12 bp, Homo sapiens
acgagaccccca

SEQ ID NO: 2246737 - DNA, 21 bp, Homo sapiens
acgagacccccatccagcctc

SEQ ID NO: 2246738 - DNA, 12 bp, Homo sapiens
acgccactcatt

SEQ ID NO: 2246739 - DNA, 21 bp, Homo sapiens
acgccactcatttcatctcat

SEQ ID NO: 2246740 - DNA, 12 bp, Homo sapiens
acgcctcctggc

SEQ ID NO: 2246741 - DNA, 22 bp, Homo sapiens
acgctgaccatgcgtcaggggc

SEQ ID NO: 2246742 - DNA, 23 bp, Homo sapiens
acgctgccgctgccgctgcacca

SEQ ID NO: 2246743 - DNA, 14 bp, Homo sapiens
acgctgtcctctcg

SEQ ID NO: 2246744 - DNA, 20 bp, Homo sapiens
acggagatgaagaacatctg

SEQ ID NO: 2246745 - DNA, 20 bp, Homo sapiens
acggagcccagccctcccca

SEQ ID NO: 2246746 - DNA, 19 bp, Homo sapiens
acggatggtgcatgggctc

SEQ ID NO: 2246747 - DNA, 17 bp, Homo sapiens
acggcaacgtagcctgg

SEQ ID NO: 2246748 - DNA, 17 bp, Homo sapiens
acggtgttttgccatgt

SEQ ID NO: 2246749 - DNA, 15 bp, Homo sapiens
acgtgaatgtctcag

SEQ ID NO: 2246750 - DNA, 20 bp, Homo sapiens
acgtggccatgtatgaagcc

SEQ ID NO: 2246751 - DNA, 15 bp, Homo sapiens
acgttatatattgta

SEQ ID NO: 2246752 - DNA, 16 bp, Homo sapiens
acgttatatattgtat

SEQ ID NO: 2246753 - DNA, 19 bp, Homo sapiens
acgttatatattgtattaa

SEQ ID NO: 2246754 - DNA, 14 bp, Homo sapiens
acgttcgatttcta

SEQ ID NO: 2246755 - DNA, 15 bp, Homo sapiens
acgttcgatttctac

SEQ ID NO: 2246756 - DNA, 16 bp, Homo sapiens
acgttcgatttctacc

SEQ ID NO: 2246757 - DNA, 18 bp, Homo sapiens
acgttcgatttctacctc

SEQ ID NO: 2246758 - DNA, 22 bp, Homo sapiens
acgtttaactgcagttgacttt

SEQ ID NO: 2246759 - DNA, 12 bp, Homo sapiens
acgtttttacat

SEQ ID NO: 2246760 - DNA, 19 bp, Homo sapiens
actaaaataattttgtaat

SEQ ID NO: 2246761 - DNA, 20 bp, Homo sapiens
actaaaataattttgtaatg

SEQ ID NO: 2246762 - DNA, 13 bp, Homo sapiens
actaatagtttgt

SEQ ID NO: 2246763 - DNA, 21 bp, Homo sapiens
actaattatactactttgtta

SEQ ID NO: 2246764 - DNA, 15 bp, Homo sapiens
actaattttacatgt

SEQ ID NO: 2246765 - DNA, 19 bp, Homo sapiens
actaatttttgtattattt

SEQ ID NO: 2246766 - DNA, 18 bp, Homo sapiens
aaaaacagatttggaaag

SEQ ID NO: 2246767 - DNA, 13 bp, Homo sapiens
aaaaacataacat

SEQ ID NO: 2246768 - DNA, 13 bp, Homo sapiens
aaaaactgaaaaa

SEQ ID NO: 2246769 - DNA, 17 bp, Homo sapiens
aaaaactgctgtaaaca

SEQ ID NO: 2246770 - DNA, 17 bp, Homo sapiens
aaaaagggaagtaagca

SEQ ID NO: 2246771 - DNA, 12 bp, Homo sapiens
aaaaataaaata

SEQ ID NO: 2246772 - DNA, 17 bp, Homo sapiens
aaaaatacaatttttat

SEQ ID NO: 2246773 - DNA, 18 bp, Homo sapiens
aaaaatatatatctatct

SEQ ID NO: 2246774 - DNA, 13 bp, Homo sapiens
aaaaatattttct

SEQ ID NO: 2246775 - DNA, 22 bp, Homo sapiens
aaaaatattttctctgtacttt

SEQ ID NO: 2246776 - DNA, 19 bp, Homo sapiens
aaaaatggtatcaaaatta

SEQ ID NO: 2246777 - DNA, 11 bp, Homo sapiens
aaaaatttaaa

SEQ ID NO: 2246778 - DNA, 11 bp, Homo sapiens
aaaaattttta

SEQ ID NO: 2246779 - DNA, 18 bp, Homo sapiens
aaaacagggccacataga

SEQ ID NO: 2246780 - DNA, 15 bp, Homo sapiens
aaaaccatctctctt

SEQ ID NO: 2246781 - DNA, 21 bp, Homo sapiens
aaaaccatctctcttccagct

SEQ ID NO: 2246782 - DNA, 20 bp, Homo sapiens
aaaactaaggatttttcaag

SEQ ID NO: 2246783 - DNA, 14 bp, Homo sapiens
aaaactatttttgt

SEQ ID NO: 2246784 - DNA, 18 bp, Homo sapiens
aaaactcaacattactgt

SEQ ID NO: 2246785 - DNA, 13 bp, Homo sapiens
aaaactgctgtaa

SEQ ID NO: 2246786 - DNA, 14 bp, Homo sapiens
aaaactgctgtaaa

SEQ ID NO: 2246787 - DNA, 11 bp, Homo sapiens
aaaactttgga

SEQ ID NO: 2246788 - DNA, 14 bp, Homo sapiens
aaaagcaacattca

SEQ ID NO: 2246789 - DNA, 17 bp, Homo sapiens
aaaagcacaagtacttt

SEQ ID NO: 2246790 - DNA, 14 bp, Homo sapiens
aaaagcattttgta

SEQ ID NO: 2246791 - DNA, 14 bp, Homo sapiens
aaaaggaatgaact

SEQ ID NO: 2246792 - DNA, 12 bp, Homo sapiens
aaaagtaaaatg

SEQ ID NO: 2246793 - DNA, 20 bp, Homo sapiens
aaaagtccataccttatata

SEQ ID NO: 2246794 - DNA, 23 bp, Homo sapiens
aaaagtttgaaaagcaatattgt

SEQ ID NO: 2246795 - DNA, 17 bp, Homo sapiens
aaaataaaatactttga

SEQ ID NO: 2246796 - DNA, 14 bp, Homo sapiens
aagttgattagaaa

SEQ ID NO: 2246797 - DNA, 16 bp, Homo sapiens
aagttggtattaataa

SEQ ID NO: 2246798 - DNA, 20 bp, Homo sapiens
aagttggtattaataaaaag

SEQ ID NO: 2246799 - DNA, 17 bp, Homo sapiens
aagtttgaaatatatta

SEQ ID NO: 2246800 - DNA, 17 bp, Homo sapiens
aataaaagtattcttgt

SEQ ID NO: 2246801 - DNA, 15 bp, Homo sapiens
aataaaccctcagag

SEQ ID NO: 2246802 - DNA, 19 bp, Homo sapiens
aataaagtttgcttagaaa

SEQ ID NO: 2246803 - DNA, 11 bp, Homo sapiens
aataaatatat

SEQ ID NO: 2246804 - DNA, 24 bp, Homo sapiens
aataaatttactcacagcacttgt

SEQ ID NO: 2246805 - DNA, 18 bp, Homo sapiens
aataacccataattgaag

SEQ ID NO: 2246806 - DNA, 15 bp, Homo sapiens
aataagcaaataaac

SEQ ID NO: 2246807 - DNA, 14 bp, Homo sapiens
aataagttattgca

SEQ ID NO: 2246808 - DNA, 12 bp, Homo sapiens
aataataaagaa

SEQ ID NO: 2246809 - DNA, 13 bp, Homo sapiens
aataataaagcta

SEQ ID NO: 2246810 - DNA, 12 bp, Homo sapiens
aataataaataa

SEQ ID NO: 2246811 - DNA, 15 bp, Homo sapiens
aataatatattttct

SEQ ID NO: 2246812 - DNA, 19 bp, Homo sapiens
aataatatattttctgttt

SEQ ID NO: 2246813 - DNA, 16 bp, Homo sapiens
aataatatcaaaacaa

SEQ ID NO: 2246814 - DNA, 13 bp, Homo sapiens
aataatcttatta

SEQ ID NO: 2246815 - DNA, 14 bp, Homo sapiens
aataattttgtaat

SEQ ID NO: 2246816 - DNA, 15 bp, Homo sapiens
aataattttgtaatg

SEQ ID NO: 2246817 - DNA, 12 bp, Homo sapiens
aatacaaaactt

SEQ ID NO: 2246818 - DNA, 13 bp, Homo sapiens
aatacaaccagcc

SEQ ID NO: 2246819 - DNA, 20 bp, Homo sapiens
aatacatttaaaacattaaa

SEQ ID NO: 2246820 - DNA, 17 bp, Homo sapiens
aataccacttacctcaa

SEQ ID NO: 2246821 - DNA, 15 bp, Homo sapiens
aatacgttttgacat

SEQ ID NO: 2246822 - DNA, 12 bp, Homo sapiens
aatactacctct

SEQ ID NO: 2246823 - DNA, 19 bp, Homo sapiens
aatactatttaagatgtga

SEQ ID NO: 2246824 - DNA, 18 bp, Homo sapiens
aatactctatttttacat

SEQ ID NO: 2246825 - DNA, 16 bp, Homo sapiens
aatagacagcatgaga

SEQ ID NO: 2246826 - DNA, 16 bp, Homo sapiens
aatagcacttaaattc

SEQ ID NO: 2246827 - DNA, 16 bp, Homo sapiens
aataggcaaattaatc

SEQ ID NO: 2246828 - DNA, 19 bp, Homo sapiens
aataggtgcagtctttgag

SEQ ID NO: 2246829 - DNA, 17 bp, Homo sapiens
aatagttcaaactgcag

SEQ ID NO: 2246830 - DNA, 18 bp, Homo sapiens
aatatagagatatttttg

SEQ ID NO: 2246831 - DNA, 21 bp, Homo sapiens
aatatagagatatttttgtac

SEQ ID NO: 2246832 - DNA, 15 bp, Homo sapiens
aatatagctgagact

SEQ ID NO: 2246833 - DNA, 19 bp, Homo sapiens
aatatatttctaaatgttt

SEQ ID NO: 2246834 - DNA, 21 bp, Homo sapiens
aatatatttctaaatgtttgg

SEQ ID NO: 2246835 - DNA, 12 bp, Homo sapiens
aatatctttctg

SEQ ID NO: 2246836 - DNA, 16 bp, Homo sapiens
aatatgatgacaatca

SEQ ID NO: 2246837 - DNA, 15 bp, Homo sapiens
aatatggaacttaca

SEQ ID NO: 2246838 - DNA, 19 bp, Homo sapiens
aatatgtggaagcaaccaa

SEQ ID NO: 2246839 - DNA, 14 bp, Homo sapiens
aatattaagacaat

SEQ ID NO: 2246840 - DNA, 18 bp, Homo sapiens
aatattgttttacaatag

SEQ ID NO: 2246841 - DNA, 17 bp, Homo sapiens
aatatttataaaacttc

SEQ ID NO: 2246842 - DNA, 19 bp, Homo sapiens
aatatttataaaacttctc

SEQ ID NO: 2246843 - DNA, 13 bp, Homo sapiens
aatattttctatt

SEQ ID NO: 2246844 - DNA, 19 bp, Homo sapiens
aatattttctctgtacttt

SEQ ID NO: 2246845 - DNA, 22 bp, Homo sapiens
aatattttctctgtacttttca

SEQ ID NO: 2246846 - DNA, 14 bp, Homo sapiens
aatattttgaatca

SEQ ID NO: 2246847 - DNA, 16 bp, Homo sapiens
aatattttgaatcaat

SEQ ID NO: 2246848 - DNA, 14 bp, Homo sapiens
aatcaaaacacact

SEQ ID NO: 2246849 - DNA, 12 bp, Homo sapiens
aatcaaatgaat

SEQ ID NO: 2246850 - DNA, 16 bp, Homo sapiens
aatcaccctaccaact

SEQ ID NO: 2246851 - DNA, 17 bp, Homo sapiens
aatcacctcctgtgttg

SEQ ID NO: 2246852 - DNA, 13 bp, Homo sapiens
aatcattttcatt

SEQ ID NO: 2246853 - DNA, 16 bp, Homo sapiens
aatcccttcacagtcc

SEQ ID NO: 2246854 - DNA, 19 bp, Homo sapiens
aatccctttattaccccct

SEQ ID NO: 2246855 - DNA, 15 bp, Homo sapiens
aatcctacctcaaaa

SEQ ID NO: 2246856 - DNA, 15 bp, Homo sapiens
aatcctacctgtttt

SEQ ID NO: 2246857 - DNA, 13 bp, Homo sapiens
aatcctctgttta

SEQ ID NO: 2246858 - DNA, 20 bp, Homo sapiens
aatctaaatttcttttgcta

SEQ ID NO: 2246859 - DNA, 20 bp, Homo sapiens
aatctaagcagcttattgtt

SEQ ID NO: 2246860 - DNA, 15 bp, Homo sapiens
aatctacttcctaca

SEQ ID NO: 2246861 - DNA, 16 bp, Homo sapiens
aatctcagtgctttcc

SEQ ID NO: 2246862 - DNA, 15 bp, Homo sapiens
aatctccttactgtg

SEQ ID NO: 2246863 - DNA, 14 bp, Homo sapiens
aatctctctctgtg

SEQ ID NO: 2246864 - DNA, 23 bp, Homo sapiens
aatctctctctgtgtctttctct

SEQ ID NO: 2246865 - DNA, 22 bp, Homo sapiens
aatctttgtgacaggaaagccc

SEQ ID NO: 2246866 - DNA, 13 bp, Homo sapiens
aatgaaagggaaa

SEQ ID NO: 2246867 - DNA, 17 bp, Homo sapiens
aatgaacaaaattattt

SEQ ID NO: 2246868 - DNA, 19 bp, Homo sapiens
aatgaagttgaaaatcata

SEQ ID NO: 2246869 - DNA, 21 bp, Homo sapiens
aatgaatggaggaactttcca

SEQ ID NO: 2246870 - DNA, 15 bp, Homo sapiens
aatgacaggcctgtc

SEQ ID NO: 2246871 - DNA, 22 bp, Homo sapiens
aatgagacgaaatgctgatgta

SEQ ID NO: 2246872 - DNA, 21 bp, Homo sapiens
aatgagctcaaattgattttt

SEQ ID NO: 2246873 - DNA, 16 bp, Homo sapiens
aatgagtgaattgaat

SEQ ID NO: 2246874 - DNA, 21 bp, Homo sapiens
aatgatcagctatatactatt

SEQ ID NO: 2246875 - DNA, 17 bp, Homo sapiens
aatgatcgaaaaaataa

SEQ ID NO: 2246876 - DNA, 18 bp, Homo sapiens
aatgatcgaaaaaataat

SEQ ID NO: 2246877 - DNA, 19 bp, Homo sapiens
aatgatgacaaaaaatgtt

SEQ ID NO: 2246878 - DNA, 21 bp, Homo sapiens
aatgatgtgtacccaaacgtg

SEQ ID NO: 2246879 - DNA, 13 bp, Homo sapiens
aatgcaactttta

SEQ ID NO: 2246880 - DNA, 11 bp, Homo sapiens
aatgcactttc

SEQ ID NO: 2246881 - DNA, 17 bp, Homo sapiens
aatgcagattacactga

SEQ ID NO: 2246882 - DNA, 13 bp, Homo sapiens
aatgcagcaggaa

SEQ ID NO: 2246883 - DNA, 17 bp, Homo sapiens
aatgcatgattttgtaa

SEQ ID NO: 2246884 - DNA, 19 bp, Homo sapiens
aatgcatgattttgtaacc

SEQ ID NO: 2246885 - DNA, 22 bp, Homo sapiens
aatgccatttagcaataaataa

SEQ ID NO: 2246886 - DNA, 18 bp, Homo sapiens
aatgctgctgtcagacga

SEQ ID NO: 2246887 - DNA, 23 bp, Homo sapiens
aatggaagcaattgctcatgttg

SEQ ID NO: 2246888 - DNA, 14 bp, Homo sapiens
aatggacagaatgt

SEQ ID NO: 2246889 - DNA, 20 bp, Homo sapiens
aatggactatgcacactttt

SEQ ID NO: 2246890 - DNA, 23 bp, Homo sapiens
aatggactggaaggggaagggac

SEQ ID NO: 2246891 - DNA, 17 bp, Homo sapiens
aatggctgtaatcattt

SEQ ID NO: 2246892 - DNA, 14 bp, Homo sapiens
aatgggctcaaact

SEQ ID NO: 2246893 - DNA, 22 bp, Homo sapiens
aatggtcacgtttggtgcttct

SEQ ID NO: 2246894 - DNA, 19 bp, Homo sapiens
aatggtgcattgtatagat

SEQ ID NO: 2246895 - DNA, 13 bp, Homo sapiens
aatggttggtttt

SEQ ID NO: 2246896 - DNA, 18 bp, Homo sapiens
aatggtttttatttctcg

SEQ ID NO: 2246897 - DNA, 17 bp, Homo sapiens
aatgtacagttgaaata

SEQ ID NO: 2246898 - DNA, 15 bp, Homo sapiens
aatgtatataaaaat

SEQ ID NO: 2246899 - DNA, 13 bp, Homo sapiens
aatgtatgtctgg

SEQ ID NO: 2246900 - DNA, 19 bp, Homo sapiens
aatgtcattgaaaaactaa

SEQ ID NO: 2246901 - DNA, 20 bp, Homo sapiens
aatgtctcaaggcagttaat

SEQ ID NO: 2246902 - DNA, 20 bp, Homo sapiens
aatgtctcagcgaggtgtaa

SEQ ID NO: 2246903 - DNA, 23 bp, Homo sapiens
aatgtctttccaaattatttctt

SEQ ID NO: 2246904 - DNA, 15 bp, Homo sapiens
aatgtgaaaaatctg

SEQ ID NO: 2246905 - DNA, 21 bp, Homo sapiens
actgtcaaggctgcttagaat

SEQ ID NO: 2246906 - DNA, 14 bp, Homo sapiens
actgtcactcattg

SEQ ID NO: 2246907 - DNA, 23 bp, Homo sapiens
actgtcactcattgctgagcctc

SEQ ID NO: 2246908 - DNA, 13 bp, Homo sapiens
actgttctgtgtc

SEQ ID NO: 2246909 - DNA, 16 bp, Homo sapiens
actgttctgtgtcttt

SEQ ID NO: 2246910 - DNA, 14 bp, Homo sapiens
actgttctttgctg

SEQ ID NO: 2246911 - DNA, 20 bp, Homo sapiens
actgtttaatcatagttact

SEQ ID NO: 2246912 - DNA, 16 bp, Homo sapiens
actgtttcatctaagt

SEQ ID NO: 2246913 - DNA, 23 bp, Homo sapiens
actgttttctctcggctccccat

SEQ ID NO: 2246914 - DNA, 15 bp, Homo sapiens
acttaaattcctcaa

SEQ ID NO: 2246915 - DNA, 21 bp, Homo sapiens
acttactgggtaggtgattct

SEQ ID NO: 2246916 - DNA, 22 bp, Homo sapiens
acttactgggtaggtgattcta

SEQ ID NO: 2246917 - DNA, 18 bp, Homo sapiens
acttacttgatgattttt

SEQ ID NO: 2246918 - DNA, 15 bp, Homo sapiens
acttagccattgaaa

SEQ ID NO: 2246919 - DNA, 17 bp, Homo sapiens
acttagcgaacccttta

SEQ ID NO: 2246920 - DNA, 15 bp, Homo sapiens
acttatactcttgag

SEQ ID NO: 2246921 - DNA, 14 bp, Homo sapiens
acttcaaaaggaat

SEQ ID NO: 2246922 - DNA, 18 bp, Homo sapiens
acttcaaaaggaatgaac

SEQ ID NO: 2246923 - DNA, 19 bp, Homo sapiens
acttcaaaaggaatgaact

SEQ ID NO: 2246924 - DNA, 17 bp, Homo sapiens
acttcaaatatagagat

SEQ ID NO: 2246925 - DNA, 12 bp, Homo sapiens
acttcatgtaaa

SEQ ID NO: 2246926 - DNA, 13 bp, Homo sapiens
acttcatgtaaag

SEQ ID NO: 2246927 - DNA, 18 bp, Homo sapiens
acttcctcctccccactt

SEQ ID NO: 2246928 - DNA, 14 bp, Homo sapiens
acttccttgagaca

SEQ ID NO: 2246929 - DNA, 22 bp, Homo sapiens
acttccttgagacacggagccc

SEQ ID NO: 2246930 - DNA, 16 bp, Homo sapiens
acttctcactcaccac

SEQ ID NO: 2246931 - DNA, 17 bp, Homo sapiens
acttcttacgacttttt

SEQ ID NO: 2246932 - DNA, 18 bp, Homo sapiens
acttgaaaattttttaac

SEQ ID NO: 2246933 - DNA, 15 bp, Homo sapiens
acttgaactttccaa

SEQ ID NO: 2246934 - DNA, 16 bp, Homo sapiens
acttgaagctttgtag

SEQ ID NO: 2246935 - DNA, 13 bp, Homo sapiens
acttgatgatttt

SEQ ID NO: 2246936 - DNA, 23 bp, Homo sapiens
acttgatgatttttaacttttta

SEQ ID NO: 2246937 - DNA, 13 bp, Homo sapiens
acttgcctctgca

SEQ ID NO: 2246938 - DNA, 16 bp, Homo sapiens
acttgtgattatttat

SEQ ID NO: 2246939 - DNA, 13 bp, Homo sapiens
acttgttctgtat

SEQ ID NO: 2246940 - DNA, 22 bp, Homo sapiens
actttagggctgtaaaatgcat

SEQ ID NO: 2246941 - DNA, 17 bp, Homo sapiens
actttagtatttttact

SEQ ID NO: 2246942 - DNA, 18 bp, Homo sapiens
actttagtttgtgttatt

SEQ ID NO: 2246943 - DNA, 13 bp, Homo sapiens
actttataaattt

SEQ ID NO: 2246944 - DNA, 15 bp, Homo sapiens
actttattctttgtt

SEQ ID NO: 2246945 - DNA, 23 bp, Homo sapiens
actttgtaaataggatttttaga

SEQ ID NO: 2246946 - DNA, 12 bp, Homo sapiens
acttttaatggt

SEQ ID NO: 2246947 - DNA, 10 bp, Homo sapiens
acttttcatt

SEQ ID NO: 2246948 - DNA, 18 bp, Homo sapiens
acttttcattctctttta

SEQ ID NO: 2246949 - DNA, 21 bp, Homo sapiens
acttttcctgggtttcctgca

SEQ ID NO: 2246950 - DNA, 20 bp, Homo sapiens
acttttccttttcttaaaac

SEQ ID NO: 2246951 - DNA, 18 bp, Homo sapiens
acttttctaccatttctg

SEQ ID NO: 2246952 - DNA, 15 bp, Homo sapiens
actttttaacatggt

SEQ ID NO: 2246953 - DNA, 21 bp, Homo sapiens
actttttatttctaaatgaga

SEQ ID NO: 2246954 - DNA, 20 bp, Homo sapiens
acttttttgagacatgggat

SEQ ID NO: 2246955 - DNA, 16 bp, Homo sapiens
agaaaaaaatactatt

SEQ ID NO: 2246956 - DNA, 12 bp, Homo sapiens
agaaaaaaatcc

SEQ ID NO: 2246957 - DNA, 14 bp, Homo sapiens
agaaaactgtgatt

SEQ ID NO: 2246958 - DNA, 15 bp, Homo sapiens
agaaaagatgaattt

SEQ ID NO: 2246959 - DNA, 18 bp, Homo sapiens
agaaaagattttaatcaa

SEQ ID NO: 2246960 - DNA, 22 bp, Homo sapiens
agaaaaggttatgttcattttt

SEQ ID NO: 2246961 - DNA, 14 bp, Homo sapiens
agaaaatattctct

SEQ ID NO: 2246962 - DNA, 16 bp, Homo sapiens
agaaaatgttatttaa

SEQ ID NO: 2246963 - DNA, 15 bp, Homo sapiens
agaaaattcaattgt

SEQ ID NO: 2246964 - DNA, 13 bp, Homo sapiens
agaaacactcaag

SEQ ID NO: 2246965 - DNA, 20 bp, Homo sapiens
agaaacttgaagctttgtag

SEQ ID NO: 2246966 - DNA, 22 bp, Homo sapiens
agaaagaatttagtattatcaa

SEQ ID NO: 2246967 - DNA, 17 bp, Homo sapiens
agaaatacagtactgtt

SEQ ID NO: 2246968 - DNA, 17 bp, Homo sapiens
agaaatatggaacttac

SEQ ID NO: 2246969 - DNA, 20 bp, Homo sapiens
agaaatatggaacttacatt

SEQ ID NO: 2246970 - DNA, 19 bp, Homo sapiens
agaaatcaagtaatgaatc

SEQ ID NO: 2246971 - DNA, 20 bp, Homo sapiens
agaaatgggacttaactcct

SEQ ID NO: 2246972 - DNA, 13 bp, Homo sapiens
agaaattttcaag

SEQ ID NO: 2246973 - DNA, 13 bp, Homo sapiens
agaacattttaat

SEQ ID NO: 2246974 - DNA, 17 bp, Homo sapiens
agaaccagccgtatttt

SEQ ID NO: 2246975 - DNA, 18 bp, Homo sapiens
agaaccagccgtatttta

SEQ ID NO: 2246976 - DNA, 19 bp, Homo sapiens
agaaccagccgtattttac

SEQ ID NO: 2246977 - DNA, 21 bp, Homo sapiens
agaaccagccgtattttacat

SEQ ID NO: 2246978 - DNA, 22 bp, Homo sapiens
agaaccagccgtattttacatg

SEQ ID NO: 2246979 - DNA, 16 bp, Homo sapiens
agaacgctgatttaaa

SEQ ID NO: 2246980 - DNA, 16 bp, Homo sapiens
agaacgttttttcctc

SEQ ID NO: 2246981 - DNA, 18 bp, Homo sapiens
agaactcgcgctcagtaa

SEQ ID NO: 2246982 - DNA, 21 bp, Homo sapiens
agaactgtgtttcaagttcaa

SEQ ID NO: 2246983 - DNA, 19 bp, Homo sapiens
agaagaatccgagtgtttg

SEQ ID NO: 2246984 - DNA, 22 bp, Homo sapiens
agaagctgaggctagttccaga

SEQ ID NO: 2246985 - DNA, 16 bp, Homo sapiens
agaagctttatttcta

SEQ ID NO: 2246986 - DNA, 19 bp, Homo sapiens
agaaggccccagagagacc

SEQ ID NO: 2246987 - DNA, 22 bp, Homo sapiens
agaaggccccagagagaccctg

SEQ ID NO: 2246988 - DNA, 18 bp, Homo sapiens
agaagggaaatttcaata

SEQ ID NO: 2246989 - DNA, 22 bp, Homo sapiens
agaagtttggctgctgtcataa

SEQ ID NO: 2246990 - DNA, 14 bp, Homo sapiens
agaataagttattg

SEQ ID NO: 2246991 - DNA, 17 bp, Homo sapiens
agaataagttattgcag

SEQ ID NO: 2246992 - DNA, 22 bp, Homo sapiens
agaatatcctttaaaatttaaa

SEQ ID NO: 2246993 - DNA, 14 bp, Homo sapiens
agaatccaaacttg

SEQ ID NO: 2246994 - DNA, 16 bp, Homo sapiens
agaatccaaacttgga

SEQ ID NO: 2246995 - DNA, 15 bp, Homo sapiens
agaatttaggttttt

SEQ ID NO: 2246996 - DNA, 21 bp, Homo sapiens
agacaccctcaacctcttctg

SEQ ID NO: 2246997 - DNA, 18 bp, Homo sapiens
agacactgatctggctgc

SEQ ID NO: 2246998 - DNA, 16 bp, Homo sapiens
agacagatgttgggag

SEQ ID NO: 2246999 - DNA, 15 bp, Homo sapiens
agaccagattaaact

SEQ ID NO: 2247000 - DNA, 21 bp, Homo sapiens
agacccaacagcaaaggaact

SEQ ID NO: 2247001 - DNA, 12 bp, Homo sapiens
agacccccatcc

SEQ ID NO: 2247002 - DNA, 14 bp, Homo sapiens
agacccccatccag

SEQ ID NO: 2247003 - DNA, 16 bp, Homo sapiens
agacccccatccagcc

SEQ ID NO: 2247004 - DNA, 18 bp, Homo sapiens
agacccccatccagcctc

SEQ ID NO: 2247005 - DNA, 19 bp, Homo sapiens
agacccccatccagcctcc

SEQ ID NO: 2247006 - DNA, 23 bp, Homo sapiens
agacccccatccagcctccaggg

SEQ ID NO: 2247007 - DNA, 23 bp, Homo sapiens
agacctgaataccacttacctca

SEQ ID NO: 2247008 - DNA, 18 bp, Homo sapiens
agacggaggaggggaagg

SEQ ID NO: 2247009 - DNA, 21 bp, Homo sapiens
agacggaggaggggaaggggc

SEQ ID NO: 2247010 - DNA, 12 bp, Homo sapiens
agacgtgaatgt

SEQ ID NO: 2247011 - DNA, 22 bp, Homo sapiens
agacgtttttgtgctgtgggca

SEQ ID NO: 2247012 - DNA, 19 bp, Homo sapiens
agactctgtttgcttgtgt

SEQ ID NO: 2247013 - DNA, 23 bp, Homo sapiens
agtacccactctggagcatttct

SEQ ID NO: 2247014 - DNA, 17 bp, Homo sapiens
agtacctgattgtattt

SEQ ID NO: 2247015 - DNA, 13 bp, Homo sapiens
agtacttttttaa

SEQ ID NO: 2247016 - DNA, 16 bp, Homo sapiens
agtacttttttaaata

SEQ ID NO: 2247017 - DNA, 23 bp, Homo sapiens
agtacttttttaaatattttcta

SEQ ID NO: 2247018 - DNA, 17 bp, Homo sapiens
agtagacatgaatttta

SEQ ID NO: 2247019 - DNA, 17 bp, Homo sapiens
agtataaacaaagttac

SEQ ID NO: 2247020 - DNA, 19 bp, Homo sapiens
agtataaacaaagttacta

SEQ ID NO: 2247021 - DNA, 15 bp, Homo sapiens
agtatacctcatttt

SEQ ID NO: 2247022 - DNA, 21 bp, Homo sapiens
agtatgtggttttgtaatttg

SEQ ID NO: 2247023 - DNA, 17 bp, Homo sapiens
agtattatcaaagggat

SEQ ID NO: 2247024 - DNA, 14 bp, Homo sapiens
agtattcttctctt

SEQ ID NO: 2247025 - DNA, 12 bp, Homo sapiens
agtattcttttt

SEQ ID NO: 2247026 - DNA, 16 bp, Homo sapiens
agtattgtaatgagtg

SEQ ID NO: 2247027 - DNA, 21 bp, Homo sapiens
agtattttcctgttgtcaaga

SEQ ID NO: 2247028 - DNA, 21 bp, Homo sapiens
agtcaaaactatttttgtaaa

SEQ ID NO: 2247029 - DNA, 19 bp, Homo sapiens
agtcaaacaaaaaagaaaa

SEQ ID NO: 2247030 - DNA, 20 bp, Homo sapiens
agtcaaacaaaaaagaaaag

SEQ ID NO: 2247031 - DNA, 17 bp, Homo sapiens
agtcaaagttgaaaatt

SEQ ID NO: 2247032 - DNA, 12 bp, Homo sapiens
agtcaatcactg

SEQ ID NO: 2247033 - DNA, 13 bp, Homo sapiens
agtcaatcactgc

SEQ ID NO: 2247034 - DNA, 14 bp, Homo sapiens
agtcattaaactgg

SEQ ID NO: 2247035 - DNA, 13 bp, Homo sapiens
agtcattcagcag

SEQ ID NO: 2247036 - DNA, 22 bp, Homo sapiens
agtcattcagcagcaaattttc

SEQ ID NO: 2247037 - DNA, 23 bp, Homo sapiens
agtcattcagcagcaaattttca

SEQ ID NO: 2247038 - DNA, 13 bp, Homo sapiens
agtccacaggggc

SEQ ID NO: 2247039 - DNA, 15 bp, Homo sapiens
agtccataccttata

SEQ ID NO: 2247040 - DNA, 16 bp, Homo sapiens
agtcccctcacctcct

SEQ ID NO: 2247041 - DNA, 18 bp, Homo sapiens
agtcctcataaaaagcaa

SEQ ID NO: 2247042 - DNA, 21 bp, Homo sapiens
agtctcagtttgtgtgtctta

SEQ ID NO: 2247043 - DNA, 22 bp, Homo sapiens
agtctccaacatgtttctgttt

SEQ ID NO: 2247044 - DNA, 17 bp, Homo sapiens
agtcttcactaaccttt

SEQ ID NO: 2247045 - DNA, 14 bp, Homo sapiens
agtcttgaaatgaa

SEQ ID NO: 2247046 - DNA, 15 bp, Homo sapiens
agtgaaaaactgctg

SEQ ID NO: 2247047 - DNA, 15 bp, Homo sapiens
agtgaaaactttgta

SEQ ID NO: 2247048 - DNA, 15 bp, Homo sapiens
agtgaatcctctgtt

SEQ ID NO: 2247049 - DNA, 16 bp, Homo sapiens
agtgaatttgcactgt

SEQ ID NO: 2247050 - DNA, 15 bp, Homo sapiens
agtgaccacttattc

SEQ ID NO: 2247051 - DNA, 13 bp, Homo sapiens
agtgatcttgaga

SEQ ID NO: 2247052 - DNA, 19 bp, Homo sapiens
agtgcaatgcgtgttgtac

SEQ ID NO: 2247053 - DNA, 21 bp, Homo sapiens
agtgcatttgtgctagaaatt

SEQ ID NO: 2247054 - DNA, 21 bp, Homo sapiens
agtggaaaataggctttttaa

SEQ ID NO: 2247055 - DNA, 19 bp, Homo sapiens
agtggaccttaggccttcc

SEQ ID NO: 2247056 - DNA, 20 bp, Homo sapiens
agtggaccttaggccttcct

SEQ ID NO: 2247057 - DNA, 17 bp, Homo sapiens
agtggaggcactttagg

SEQ ID NO: 2247058 - DNA, 20 bp, Homo sapiens
agtggggttatctctgtgtt

SEQ ID NO: 2247059 - DNA, 16 bp, Homo sapiens
agtgtacagccagacc

SEQ ID NO: 2247060 - DNA, 15 bp, Homo sapiens
agtgtataatataaa

SEQ ID NO: 2247061 - DNA, 17 bp, Homo sapiens
agtgtataatataaaaa

SEQ ID NO: 2247062 - DNA, 21 bp, Homo sapiens
agtgtattatcactgtctgtt

SEQ ID NO: 2247063 - DNA, 16 bp, Homo sapiens
agtgtatttttcaata

SEQ ID NO: 2247064 - DNA, 14 bp, Homo sapiens
agtgtccttagaac

SEQ ID NO: 2247065 - DNA, 16 bp, Homo sapiens
agtgttttatgcatgt

SEQ ID NO: 2247066 - DNA, 18 bp, Homo sapiens
agttaatgtatataaaaa

SEQ ID NO: 2247067 - DNA, 17 bp, Homo sapiens
agttactaggtaacttc

SEQ ID NO: 2247068 - DNA, 17 bp, Homo sapiens
agttagttccactgaga

SEQ ID NO: 2247069 - DNA, 20 bp, Homo sapiens
agttataaaattaaaagttt

SEQ ID NO: 2247070 - DNA, 20 bp, Homo sapiens
agttatacagttataaaatt

SEQ ID NO: 2247071 - DNA, 17 bp, Homo sapiens
agttatctaaaagaaat

SEQ ID NO: 2247072 - DNA, 20 bp, Homo sapiens
agttattacatgtaatttga

SEQ ID NO: 2247073 - DNA, 20 bp, Homo sapiens
agttcaacctggtggcacca

SEQ ID NO: 2247074 - DNA, 21 bp, Homo sapiens
agttcaacctggtggcaccag

SEQ ID NO: 2247075 - DNA, 22 bp, Homo sapiens
agttcaacctggtggcaccaga

SEQ ID NO: 2247076 - DNA, 16 bp, Homo sapiens
agttccccaaatacaa

SEQ ID NO: 2247077 - DNA, 22 bp, Homo sapiens
agttctacctcaggcagctcaa

SEQ ID NO: 2247078 - DNA, 23 bp, Homo sapiens
agttctacctcaggcagctcaag

SEQ ID NO: 2247079 - DNA, 13 bp, Homo sapiens
agttctttttgta

SEQ ID NO: 2247080 - DNA, 19 bp, Homo sapiens
agttgaaaattcatagtaa

SEQ ID NO: 2247081 - DNA, 22 bp, Homo sapiens
agttgaatataagaaaatgctt

SEQ ID NO: 2247082 - DNA, 22 bp, Homo sapiens
agttgaatgttgcaatgtgaaa

SEQ ID NO: 2247083 - DNA, 13 bp, Homo sapiens
agttgtctaaaca

SEQ ID NO: 2247084 - DNA, 13 bp, Homo sapiens
agttgtttctcta

SEQ ID NO: 2247085 - DNA, 12 bp, Homo sapiens
agtttaaaaaaa

SEQ ID NO: 2247086 - DNA, 14 bp, Homo sapiens
agtttatcattcaa

SEQ ID NO: 2247087 - DNA, 17 bp, Homo sapiens
agtttatcattcaagtg

SEQ ID NO: 2247088 - DNA, 12 bp, Homo sapiens
agtttcaaaggc

SEQ ID NO: 2247089 - DNA, 20 bp, Homo sapiens
agtttgaggctgcagtgagc

SEQ ID NO: 2247090 - DNA, 14 bp, Homo sapiens
agtttgtgtgtctt

SEQ ID NO: 2247091 - DNA, 12 bp, Homo sapiens
agtttgttttag

SEQ ID NO: 2247092 - DNA, 21 bp, Homo sapiens
agttttcaagtcaaattaata

SEQ ID NO: 2247093 - DNA, 20 bp, Homo sapiens
agtttttatgcctttctctc

SEQ ID NO: 2247094 - DNA, 15 bp, Homo sapiens
agtttttcattttaa

SEQ ID NO: 2247095 - DNA, 18 bp, Homo sapiens
agttttttacttctctta

SEQ ID NO: 2247096 - DNA, 16 bp, Homo sapiens
ataaaaagcaaaacaa

SEQ ID NO: 2247097 - DNA, 23 bp, Homo sapiens
ataaaagccaaccttcaaagaaa

SEQ ID NO: 2247098 - DNA, 22 bp, Homo sapiens
ataaaatagatataaattttta

SEQ ID NO: 2247099 - DNA, 14 bp, Homo sapiens
ataaaatcctgtgc

SEQ ID NO: 2247100 - DNA, 16 bp, Homo sapiens
ataaaatcctgtgcaa

SEQ ID NO: 2247101 - DNA, 13 bp, Homo sapiens
ataaaatttgttg

SEQ ID NO: 2247102 - DNA, 15 bp, Homo sapiens
ataaacaaagttact

SEQ ID NO: 2247103 - DNA, 14 bp, Homo sapiens
ataaacactacaga

SEQ ID NO: 2247104 - DNA, 16 bp, Homo sapiens
ataaagatattgttca

SEQ ID NO: 2247105 - DNA, 15 bp, Homo sapiens
ataaatatatacatt

SEQ ID NO: 2247106 - DNA, 22 bp, Homo sapiens
ataaattgtctttaaaaactgt

SEQ ID NO: 2247107 - DNA, 17 bp, Homo sapiens
ataaatttcgcttctta

SEQ ID NO: 2247108 - DNA, 21 bp, Homo sapiens
ataacacttgtcagcctcaga

SEQ ID NO: 2247109 - DNA, 13 bp, Homo sapiens
ataagaaaatgct

SEQ ID NO: 2247110 - DNA, 14 bp, Homo sapiens
ataagatgactgtg

SEQ ID NO: 2247111 - DNA, 15 bp, Homo sapiens
ataagcaaataaaca

SEQ ID NO: 2247112 - DNA, 20 bp, Homo sapiens
ataagtggaggcactttagg

SEQ ID NO: 2247113 - DNA, 14 bp, Homo sapiens
ataagtgtattttt

SEQ ID NO: 2247114 - DNA, 20 bp, Homo sapiens
ataagttattgcagtttatc

SEQ ID NO: 2247115 - DNA, 24 bp, Homo sapiens
ataagttattgcagtttatcattc

SEQ ID NO: 2247116 - DNA, 12 bp, Homo sapiens
ataagttttaga

SEQ ID NO: 2247117 - DNA, 13 bp, Homo sapiens
ataataaaattat

SEQ ID NO: 2247118 - DNA, 13 bp, Homo sapiens
ataataaagaata

SEQ ID NO: 2247119 - DNA, 13 bp, Homo sapiens
ataatagaaatgt

SEQ ID NO: 2247120 - DNA, 11 bp, Homo sapiens
ataatataaaa

SEQ ID NO: 2247121 - DNA, 12 bp, Homo sapiens
ataatataaaaa

SEQ ID NO: 2247122 - DNA, 12 bp, Homo sapiens
attatttgtgtt

SEQ ID NO: 2247123 - DNA, 22 bp, Homo sapiens
attatttgtgttttaatttaaa

SEQ ID NO: 2247124 - DNA, 16 bp, Homo sapiens
attattttttaataag

SEQ ID NO: 2247125 - DNA, 19 bp, Homo sapiens
attcaaactgcacttttag

SEQ ID NO: 2247126 - DNA, 22 bp, Homo sapiens
attcaattgtaaattgaatcag

SEQ ID NO: 2247127 - DNA, 21 bp, Homo sapiens
attcaggaatgtgtggcctgc

SEQ ID NO: 2247128 - DNA, 17 bp, Homo sapiens
attcatagtaagattga

SEQ ID NO: 2247129 - DNA, 17 bp, Homo sapiens
attcatctgtctatatt

SEQ ID NO: 2247130 - DNA, 16 bp, Homo sapiens
attcattaagcttttt

SEQ ID NO: 2247131 - DNA, 12 bp, Homo sapiens
attcatttctaa

SEQ ID NO: 2247132 - DNA, 22 bp, Homo sapiens
attcccctctgctgctgtccct

SEQ ID NO: 2247133 - DNA, 18 bp, Homo sapiens
attcctaaagaaaaatat

SEQ ID NO: 2247134 - DNA, 13 bp, Homo sapiens
attcctgtgccct

SEQ ID NO: 2247135 - DNA, 23 bp, Homo sapiens
attcggtgtggtgcagtgtgaaa

SEQ ID NO: 2247136 - DNA, 17 bp, Homo sapiens
attctactaatgtgatg

SEQ ID NO: 2247137 - DNA, 17 bp, Homo sapiens
attctctatttgaatta

SEQ ID NO: 2247138 - DNA, 22 bp, Homo sapiens
attctctatttgaattatttct

SEQ ID NO: 2247139 - DNA, 12 bp, Homo sapiens
attctcttttaa

SEQ ID NO: 2247140 - DNA, 14 bp, Homo sapiens
attctggcaggacc

SEQ ID NO: 2247141 - DNA, 24 bp, Homo sapiens
attctgggcaccacaaaatataca

SEQ ID NO: 2247142 - DNA, 15 bp, Homo sapiens
attcttctcttcctt

SEQ ID NO: 2247143 - DNA, 20 bp, Homo sapiens
attctttcccagtctgtcga

SEQ ID NO: 2247144 - DNA, 14 bp, Homo sapiens
attcttttaaatta

SEQ ID NO: 2247145 - DNA, 19 bp, Homo sapiens
attcttttaaattagaaaa

SEQ ID NO: 2247146 - DNA, 23 bp, Homo sapiens
attcttttaaattagaaaatatt

SEQ ID NO: 2247147 - DNA, 16 bp, Homo sapiens
attctttttctttttt

SEQ ID NO: 2247148 - DNA, 22 bp, Homo sapiens
attctttttcttttttaaatta

SEQ ID NO: 2247149 - DNA, 15 bp, Homo sapiens
attgaaacacagagt

SEQ ID NO: 2247150 - DNA, 20 bp, Homo sapiens
attgaatcagtataaacaaa

SEQ ID NO: 2247151 - DNA, 14 bp, Homo sapiens
attgagcttgcatg

SEQ ID NO: 2247152 - DNA, 19 bp, Homo sapiens
attgagtctgaagcactct

SEQ ID NO: 2247153 - DNA, 15 bp, Homo sapiens
attgctcagcccgct

SEQ ID NO: 2247154 - DNA, 16 bp, Homo sapiens
attgctcagcccgctt

SEQ ID NO: 2247155 - DNA, 21 bp, Homo sapiens
attgctcagcccgcttggcca

SEQ ID NO: 2247156 - DNA, 18 bp, Homo sapiens
attgctcatgttggccaa

SEQ ID NO: 2247157 - DNA, 23 bp, Homo sapiens
attgctgagcctctgctccccag

SEQ ID NO: 2247158 - DNA, 14 bp, Homo sapiens
attgctgtcctgga

SEQ ID NO: 2247159 - DNA, 21 bp, Homo sapiens
attgctttgtattgtatatta

SEQ ID NO: 2247160 - DNA, 19 bp, Homo sapiens
attgtaaaagcattttgta

SEQ ID NO: 2247161 - DNA, 19 bp, Homo sapiens
attgtatattacaatgatc

SEQ ID NO: 2247162 - DNA, 22 bp, Homo sapiens
attgtcgtataggcatgtaaac

SEQ ID NO: 2247163 - DNA, 18 bp, Homo sapiens
attgtctcctatatattt

SEQ ID NO: 2247164 - DNA, 20 bp, Homo sapiens
attgtctttaaaaactgttt

SEQ ID NO: 2247165 - DNA, 20 bp, Homo sapiens
attgtggtcacaacttgatg

SEQ ID NO: 2247166 - DNA, 14 bp, Homo sapiens
attgtgtagacgat

SEQ ID NO: 2247167 - DNA, 18 bp, Homo sapiens
attgtgttgactttataa

SEQ ID NO: 2247168 - DNA, 19 bp, Homo sapiens
attgtgttgactttataaa

SEQ ID NO: 2247169 - DNA, 24 bp, Homo sapiens
attgttccagcagttttcaagtca

SEQ ID NO: 2247170 - DNA, 20 bp, Homo sapiens
atttaaaacattaaaatata

SEQ ID NO: 2247171 - DNA, 20 bp, Homo sapiens
atttaaaagtaaaatgtctt

SEQ ID NO: 2247172 - DNA, 21 bp, Homo sapiens
atttaaaagtaaaatgtcttt

SEQ ID NO: 2247173 - DNA, 21 bp, Homo sapiens
atttaaattacaattttatct

SEQ ID NO: 2247174 - DNA, 19 bp, Homo sapiens
atttaacaatttattctga

SEQ ID NO: 2247175 - DNA, 22 bp, Homo sapiens
atttaacagctgaattatctat

SEQ ID NO: 2247176 - DNA, 14 bp, Homo sapiens
atttaagatgtgaa

SEQ ID NO: 2247177 - DNA, 16 bp, Homo sapiens
atttaagggaaaaata

SEQ ID NO: 2247178 - DNA, 12 bp, Homo sapiens
atttaagtttgt

SEQ ID NO: 2247179 - DNA, 17 bp, Homo sapiens
atttaatggggaggaca

SEQ ID NO: 2247180 - DNA, 20 bp, Homo sapiens
atttaatggtttttatttct

SEQ ID NO: 2247181 - DNA, 18 bp, Homo sapiens
atttaatttgaaatatgg

SEQ ID NO: 2247182 - DNA, 22 bp, Homo sapiens
atttacagtctagtacttatta

SEQ ID NO: 2247183 - DNA, 15 bp, Homo sapiens
atttaccatgtgcta

SEQ ID NO: 2247184 - DNA, 14 bp, Homo sapiens
atttaccttgaaaa

SEQ ID NO: 2247185 - DNA, 18 bp, Homo sapiens
atttactttttatttgca

SEQ ID NO: 2247186 - DNA, 18 bp, Homo sapiens
atttaggtttttattagt

SEQ ID NO: 2247187 - DNA, 19 bp, Homo sapiens
atttagtaatagcctgggt

SEQ ID NO: 2247188 - DNA, 21 bp, Homo sapiens
atttataaaacttctcaagat

SEQ ID NO: 2247189 - DNA, 18 bp, Homo sapiens
atttatacaaattagaaa

SEQ ID NO: 2247190 - DNA, 16 bp, Homo sapiens
atttatccagaaaact

SEQ ID NO: 2247191 - DNA, 21 bp, Homo sapiens
atttatgcgtaatttaatggg

SEQ ID NO: 2247192 - DNA, 13 bp, Homo sapiens
atttatttacaga

SEQ ID NO: 2247193 - DNA, 14 bp, Homo sapiens
atttatttattatt

SEQ ID NO: 2247194 - DNA, 14 bp, Homo sapiens
atttcaatgtgtat

SEQ ID NO: 2247195 - DNA, 15 bp, Homo sapiens
atttcaatgtgtata

SEQ ID NO: 2247196 - DNA, 22 bp, Homo sapiens
atttcaatgtgtataaattgtc

SEQ ID NO: 2247197 - DNA, 21 bp, Homo sapiens
atttcatctcatttaagggaa

SEQ ID NO: 2247198 - DNA, 16 bp, Homo sapiens
atttcctgtatgttgt

SEQ ID NO: 2247199 - DNA, 20 bp, Homo sapiens
atttctgtcacagtaaaaat

SEQ ID NO: 2247200 - DNA, 23 bp, Homo sapiens
atttctgtcacagtaaaaataaa

SEQ ID NO: 2247201 - DNA, 23 bp, Homo sapiens
atttctttctttgcaccaaagac

SEQ ID NO: 2247202 - DNA, 17 bp, Homo sapiens
atttgaacaatgaagtt

SEQ ID NO: 2247203 - DNA, 18 bp, Homo sapiens
atttgaacaatgaagttg

SEQ ID NO: 2247204 - DNA, 20 bp, Homo sapiens
atttgaacaatgaagttgaa

SEQ ID NO: 2247205 - DNA, 23 bp, Homo sapiens
atttgagaatagacccttactag

SEQ ID NO: 2247206 - DNA, 15 bp, Homo sapiens
atttgagagaagcca

SEQ ID NO: 2247207 - DNA, 18 bp, Homo sapiens
atttgatagaaaggaaca

SEQ ID NO: 2247208 - DNA, 14 bp, Homo sapiens
atttgctttggaag

SEQ ID NO: 2247209 - DNA, 15 bp, Homo sapiens
atttgctttggaagt

SEQ ID NO: 2247210 - DNA, 13 bp, Homo sapiens
atttgtaagatat

SEQ ID NO: 2247211 - DNA, 14 bp, Homo sapiens
atttgtctttttgt

SEQ ID NO: 2247212 - DNA, 15 bp, Homo sapiens
atttgtgatagcact

SEQ ID NO: 2247213 - DNA, 16 bp, Homo sapiens
atttgtttccagcatg

SEQ ID NO: 2247214 - DNA, 18 bp, Homo sapiens
atttgtttctttctctga

SEQ ID NO: 2247215 - DNA, 20 bp, Homo sapiens
atttgtttctttctctgagg

SEQ ID NO: 2247216 - DNA, 17 bp, Homo sapiens
attttaaaaaatggtca

SEQ ID NO: 2247217 - DNA, 22 bp, Homo sapiens
attttaaaagcaattatattgt

SEQ ID NO: 2247218 - DNA, 15 bp, Homo sapiens
attttaaacagagga

SEQ ID NO: 2247219 - DNA, 13 bp, Homo sapiens
attttaaacgctt

SEQ ID NO: 2247220 - DNA, 15 bp, Homo sapiens
attttaaataatgta

SEQ ID NO: 2247221 - DNA, 16 bp, Homo sapiens
attttaaggatatgat

SEQ ID NO: 2247222 - DNA, 17 bp, Homo sapiens
attttaatattaacttt

SEQ ID NO: 2247223 - DNA, 14 bp, Homo sapiens
attttaatcaagtt

SEQ ID NO: 2247224 - DNA, 24 bp, Homo sapiens
attttaattcatcccaactgtctt

SEQ ID NO: 2247225 - DNA, 19 bp, Homo sapiens
attttaatttttgctttta

SEQ ID NO: 2247226 - DNA, 23 bp, Homo sapiens
attttacatgaagctgtataatt

SEQ ID NO: 2247227 - DNA, 16 bp, Homo sapiens
attttaccaaagcatc

SEQ ID NO: 2247228 - DNA, 21 bp, Homo sapiens
attttatataaagtattcttt

SEQ ID NO: 2247229 - DNA, 13 bp, Homo sapiens
cactggcccctca

SEQ ID NO: 2247230 - DNA, 24 bp, Homo sapiens
cactggcccctcaaatcgtccagc

SEQ ID NO: 2247231 - DNA, 22 bp, Homo sapiens
cactggggagcccgtctcagtg

SEQ ID NO: 2247232 - DNA, 16 bp, Homo sapiens
cactggggcctacagc

SEQ ID NO: 2247233 - DNA, 14 bp, Homo sapiens
cactgtgtacacct

SEQ ID NO: 2247234 - DNA, 23 bp, Homo sapiens
cactgttgtgaatcaccaaagga

SEQ ID NO: 2247235 - DNA, 22 bp, Homo sapiens
cacttaagttagttccactgag

SEQ ID NO: 2247236 - DNA, 14 bp, Homo sapiens
cacttaattacagt

SEQ ID NO: 2247237 - DNA, 16 bp, Homo sapiens
cacttagccattgaaa

SEQ ID NO: 2247238 - DNA, 12 bp, Homo sapiens
cacttcattttc

SEQ ID NO: 2247239 - DNA, 23 bp, Homo sapiens
cactttattgccttttaattttt

SEQ ID NO: 2247240 - DNA, 15 bp, Homo sapiens
cacttttatttcctg

SEQ ID NO: 2247241 - DNA, 17 bp, Homo sapiens
cacttttatttcctgta

SEQ ID NO: 2247242 - DNA, 22 bp, Homo sapiens
cagaaaacctctcctgacccct

SEQ ID NO: 2247243 - DNA, 18 bp, Homo sapiens
cagaaaccagaaaagcaa

SEQ ID NO: 2247244 - DNA, 18 bp, Homo sapiens
cagaaagctttattttga

SEQ ID NO: 2247245 - DNA, 12 bp, Homo sapiens
cagaaggcccca

SEQ ID NO: 2247246 - DNA, 18 bp, Homo sapiens
cagaaggccccagagaga

SEQ ID NO: 2247247 - DNA, 21 bp, Homo sapiens
cagaataagttattgcagttt

SEQ ID NO: 2247248 - DNA, 18 bp, Homo sapiens
cagacaataaaccctcag

SEQ ID NO: 2247249 - DNA, 19 bp, Homo sapiens
cagacagatgttgggagga

SEQ ID NO: 2247250 - DNA, 17 bp, Homo sapiens
cagacatgaaataaaag

SEQ ID NO: 2247251 - DNA, 13 bp, Homo sapiens
cagaccaccccgc

SEQ ID NO: 2247252 - DNA, 15 bp, Homo sapiens
cagaccaccccgcct

SEQ ID NO: 2247253 - DNA, 19 bp, Homo sapiens
cagaccaccccgcctgccc

SEQ ID NO: 2247254 - DNA, 22 bp, Homo sapiens
cagaccaccccgcctgccctca

SEQ ID NO: 2247255 - DNA, 17 bp, Homo sapiens
cagacgctgccgctgcc

SEQ ID NO: 2247256 - DNA, 17 bp, Homo sapiens
cagactaagaaggaaaa

SEQ ID NO: 2247257 - DNA, 17 bp, Homo sapiens
cagagactttagggggt

SEQ ID NO: 2247258 - DNA, 17 bp, Homo sapiens
cagagccagcctggctc

SEQ ID NO: 2247259 - DNA, 18 bp, Homo sapiens
cagagccagcctggctct

SEQ ID NO: 2247260 - DNA, 23 bp, Homo sapiens
cagagccagcctggctctgcccc

SEQ ID NO: 2247261 - DNA, 19 bp, Homo sapiens
cagagcccgtcagcgtggg

SEQ ID NO: 2247262 - DNA, 23 bp, Homo sapiens
cagagccgggaggaaaaggcccc

SEQ ID NO: 2247263 - DNA, 20 bp, Homo sapiens
cagagcgaggaaaggatttt

SEQ ID NO: 2247264 - DNA, 17 bp, Homo sapiens
cagaggacacagagaag

SEQ ID NO: 2247265 - DNA, 22 bp, Homo sapiens
cagaggtagtctcactgcttga

SEQ ID NO: 2247266 - DNA, 14 bp, Homo sapiens
cagagtctgtctct

SEQ ID NO: 2247267 - DNA, 20 bp, Homo sapiens
cagagtcttcactaaccttt

SEQ ID NO: 2247268 - DNA, 22 bp, Homo sapiens
cagatatagcattaataaaact

SEQ ID NO: 2247269 - DNA, 23 bp, Homo sapiens
cagatatagcattaataaaactg

SEQ ID NO: 2247270 - DNA, 20 bp, Homo sapiens
cagatcgctcactgttgtga

SEQ ID NO: 2247271 - DNA, 15 bp, Homo sapiens
cagatgaatgtattt

SEQ ID NO: 2247272 - DNA, 18 bp, Homo sapiens
cagatgatctctccacgg

SEQ ID NO: 2247273 - DNA, 13 bp, Homo sapiens
cagatgcaacctc

SEQ ID NO: 2247274 - DNA, 15 bp, Homo sapiens
cagatgttaaaataa

SEQ ID NO: 2247275 - DNA, 21 bp, Homo sapiens
cagatgttaaaataaatggtt

SEQ ID NO: 2247276 - DNA, 23 bp, Homo sapiens
cagatgttgggaggatacagagg

SEQ ID NO: 2247277 - DNA, 15 bp, Homo sapiens
cagatgtttccagac

SEQ ID NO: 2247278 - DNA, 23 bp, Homo sapiens
cagatgtttcgagtaaacttgaa

SEQ ID NO: 2247279 - DNA, 13 bp, Homo sapiens
cagattacactga

SEQ ID NO: 2247280 - DNA, 16 bp, Homo sapiens
cagattgctgggagga

SEQ ID NO: 2247281 - DNA, 16 bp, Homo sapiens
cagattttgctgtata

SEQ ID NO: 2247282 - DNA, 13 bp, Homo sapiens
cagcaaagctccc

SEQ ID NO: 2247283 - DNA, 14 bp, Homo sapiens
cagcaaattttcag

SEQ ID NO: 2247284 - DNA, 17 bp, Homo sapiens
cagcaagttcacatgga

SEQ ID NO: 2247285 - DNA, 20 bp, Homo sapiens
cagcacacacttacagagca

SEQ ID NO: 2247286 - DNA, 18 bp, Homo sapiens
cagcaccctcccccgcag

SEQ ID NO: 2247287 - DNA, 18 bp, Homo sapiens
cagcaccctctcctgggg

SEQ ID NO: 2247288 - DNA, 23 bp, Homo sapiens
cagcaccctctcctgggggtggc

SEQ ID NO: 2247289 - DNA, 18 bp, Homo sapiens
cagcactaaggccgtgtc

SEQ ID NO: 2247290 - DNA, 21 bp, Homo sapiens
cagcactaaggccgtgtctct

SEQ ID NO: 2247291 - DNA, 22 bp, Homo sapiens
cagcactaaggccgtgtctctg

SEQ ID NO: 2247292 - DNA, 15 bp, Homo sapiens
cagcagcaaattttc

SEQ ID NO: 2247293 - DNA, 15 bp, Homo sapiens
cagcagccccccagc

SEQ ID NO: 2247294 - DNA, 16 bp, Homo sapiens
cagcaggaactctgga

SEQ ID NO: 2247295 - DNA, 22 bp, Homo sapiens
cagcaggaaggaacaaagacag

SEQ ID NO: 2247296 - DNA, 14 bp, Homo sapiens
cagcaggctcaggc

SEQ ID NO: 2247297 - DNA, 17 bp, Homo sapiens
cagcaggctcaggcaca

SEQ ID NO: 2247298 - DNA, 24 bp, Homo sapiens
cagcattcatttgttttttcaatg

SEQ ID NO: 2247299 - DNA, 15 bp, Homo sapiens
cagccacccccaggc

SEQ ID NO: 2247300 - DNA, 17 bp, Homo sapiens
cagccacccccaggcat

SEQ ID NO: 2247301 - DNA, 22 bp, Homo sapiens
cagccagaccccacgctgacca

SEQ ID NO: 2247302 - DNA, 16 bp, Homo sapiens
cagccagccgccctgg

SEQ ID NO: 2247303 - DNA, 23 bp, Homo sapiens
cagccagccgccctgggctgtct

SEQ ID NO: 2247304 - DNA, 12 bp, Homo sapiens
cagccagcctca

SEQ ID NO: 2247305 - DNA, 22 bp, Homo sapiens
cagccagcctcagaaggcccca

SEQ ID NO: 2247306 - DNA, 17 bp, Homo sapiens
cagccagcgcctccctc

SEQ ID NO: 2247307 - DNA, 19 bp, Homo sapiens
cagccagcgcctccctcca

SEQ ID NO: 2247308 - DNA, 20 bp, Homo sapiens
cagccagcgcctccctccac

SEQ ID NO: 2247309 - DNA, 23 bp, Homo sapiens
cagccagcgcctccctccacccc

SEQ ID NO: 2247310 - DNA, 23 bp, Homo sapiens
cagccatccagggggcaagagga

SEQ ID NO: 2247311 - DNA, 22 bp, Homo sapiens
cagcccaggatactggcacaga

SEQ ID NO: 2247312 - DNA, 22 bp, Homo sapiens
cagcccccgggccgctggctgg

SEQ ID NO: 2247313 - DNA, 21 bp, Homo sapiens
cagccccgactccagccagcg

SEQ ID NO: 2247314 - DNA, 13 bp, Homo sapiens
cagcccgcttggc

SEQ ID NO: 2247315 - DNA, 20 bp, Homo sapiens
cagccctccccatggagcca

SEQ ID NO: 2247316 - DNA, 11 bp, Homo sapiens
cagccctgctg

SEQ ID NO: 2247317 - DNA, 12 bp, Homo sapiens
cagccctgctgg

SEQ ID NO: 2247318 - DNA, 15 bp, Homo sapiens
cagccctgctgggga

SEQ ID NO: 2247319 - DNA, 16 bp, Homo sapiens
cagccgtattttacat

SEQ ID NO: 2247320 - DNA, 18 bp, Homo sapiens
cagcctcagaaggcccca

SEQ ID NO: 2247321 - DNA, 19 bp, Homo sapiens
cagcctcagaaggccccag

SEQ ID NO: 2247322 - DNA, 23 bp, Homo sapiens
cagcctcagaaggccccagagag

SEQ ID NO: 2247323 - DNA, 12 bp, Homo sapiens
cagcctccaggg

SEQ ID NO: 2247324 - DNA, 13 bp, Homo sapiens
cagcctccagggc

SEQ ID NO: 2247325 - DNA, 15 bp, Homo sapiens
cagcctccagggcat

SEQ ID NO: 2247326 - DNA, 22 bp, Homo sapiens
cagcctggctctgccccctccc

SEQ ID NO: 2247327 - DNA, 12 bp, Homo sapiens
cagcgcctccct

SEQ ID NO: 2247328 - DNA, 14 bp, Homo sapiens
cagcgcctccctcc

SEQ ID NO: 2247329 - DNA, 18 bp, Homo sapiens
cagcgcctccctccaccc

SEQ ID NO: 2247330 - DNA, 23 bp, Homo sapiens
cagcgcctccctccaccccagga

SEQ ID NO: 2247331 - DNA, 21 bp, Homo sapiens
cagctaccctttttctccagc

SEQ ID NO: 2247332 - DNA, 15 bp, Homo sapiens
cagctacttcctcct

SEQ ID NO: 2247333 - DNA, 17 bp, Homo sapiens
cagctacttcctcctcc

SEQ ID NO: 2247334 - DNA, 18 bp, Homo sapiens
cagctagtagacatgaat

SEQ ID NO: 2247335 - DNA, 21 bp, Homo sapiens
cagctatatactatttatata

SEQ ID NO: 2247336 - DNA, 14 bp, Homo sapiens
ccagtcacttcctg

SEQ ID NO: 2247337 - DNA, 16 bp, Homo sapiens
ccagtgggacagagga

SEQ ID NO: 2247338 - DNA, 15 bp, Homo sapiens
ccagtgtcccctttc

SEQ ID NO: 2247339 - DNA, 18 bp, Homo sapiens
ccagttcattgcactttg

SEQ ID NO: 2247340 - DNA, 21 bp, Homo sapiens
ccagttgttagattaagaaat

SEQ ID NO: 2247341 - DNA, 14 bp, Homo sapiens
ccatccagcctcca

SEQ ID NO: 2247342 - DNA, 17 bp, Homo sapiens
ccatccctgggcccctc

SEQ ID NO: 2247343 - DNA, 17 bp, Homo sapiens
ccatccctttttttaca

SEQ ID NO: 2247344 - DNA, 22 bp, Homo sapiens
ccatctctggtaaagttacact

SEQ ID NO: 2247345 - DNA, 20 bp, Homo sapiens
ccatgagatagctattataa

SEQ ID NO: 2247346 - DNA, 15 bp, Homo sapiens
ccatgatctgtattt

SEQ ID NO: 2247347 - DNA, 13 bp, Homo sapiens
ccatgccaataaa

SEQ ID NO: 2247348 - DNA, 17 bp, Homo sapiens
ccatggagccagctccc

SEQ ID NO: 2247349 - DNA, 18 bp, Homo sapiens
ccatggagccagctccct

SEQ ID NO: 2247350 - DNA, 16 bp, Homo sapiens
ccatggtactgtagca

SEQ ID NO: 2247351 - DNA, 23 bp, Homo sapiens
ccatgtagccccctggcctctgt

SEQ ID NO: 2247352 - DNA, 20 bp, Homo sapiens
ccatgtccaaagaggctgcc

SEQ ID NO: 2247353 - DNA, 23 bp, Homo sapiens
ccatgtgcaggtggattccatgc

SEQ ID NO: 2247354 - DNA, 13 bp, Homo sapiens
ccatgtgtcccct

SEQ ID NO: 2247355 - DNA, 15 bp, Homo sapiens
ccatgtgtcccctca

SEQ ID NO: 2247356 - DNA, 17 bp, Homo sapiens
ccatgtgtcccctcact

SEQ ID NO: 2247357 - DNA, 20 bp, Homo sapiens
ccatgtgtcccctcactctg

SEQ ID NO: 2247358 - DNA, 20 bp, Homo sapiens
ccattcagtgattactgtca

SEQ ID NO: 2247359 - DNA, 19 bp, Homo sapiens
cccaaacaccttccagctc

SEQ ID NO: 2247360 - DNA, 21 bp, Homo sapiens
cccaaacaccttccagctcct

SEQ ID NO: 2247361 - DNA, 13 bp, Homo sapiens
cccaactgtcttt

SEQ ID NO: 2247362 - DNA, 24 bp, Homo sapiens
cccaagagaactcgcgctcagtaa

SEQ ID NO: 2247363 - DNA, 21 bp, Homo sapiens
cccaataaagccgcgtccttg

SEQ ID NO: 2247364 - DNA, 17 bp, Homo sapiens
cccaatccctttattac

SEQ ID NO: 2247365 - DNA, 23 bp, Homo sapiens
cccacaggaagcctgcagtcctg

SEQ ID NO: 2247366 - DNA, 13 bp, Homo sapiens
cccacaggagggc

SEQ ID NO: 2247367 - DNA, 22 bp, Homo sapiens
cccaccccatccagccagaccc

SEQ ID NO: 2247368 - DNA, 16 bp, Homo sapiens
cccacccccagccccg

SEQ ID NO: 2247369 - DNA, 16 bp, Homo sapiens
cccaccgggagcctcc

SEQ ID NO: 2247370 - DNA, 14 bp, Homo sapiens
cccacgctgaccat

SEQ ID NO: 2247371 - DNA, 19 bp, Homo sapiens
cccacgctgaccatgcgtc

SEQ ID NO: 2247372 - DNA, 16 bp, Homo sapiens
cccactcattccttct

SEQ ID NO: 2247373 - DNA, 19 bp, Homo sapiens
cccactcccttgctggccc

SEQ ID NO: 2247374 - DNA, 22 bp, Homo sapiens
cccactgctcgtggactgtgct

SEQ ID NO: 2247375 - DNA, 23 bp, Homo sapiens
cccactgctcgtggactgtgctg

SEQ ID NO: 2247376 - DNA, 19 bp, Homo sapiens
cccagaataagttattgca

SEQ ID NO: 2247377 - DNA, 22 bp, Homo sapiens
cccagagagaccctgcaagacc

SEQ ID NO: 2247378 - DNA, 21 bp, Homo sapiens
cccagagcccgtcagcgtggg

SEQ ID NO: 2247379 - DNA, 19 bp, Homo sapiens
cccagattttgctgtatat

SEQ ID NO: 2247380 - DNA, 14 bp, Homo sapiens
cccagccccagccc

SEQ ID NO: 2247381 - DNA, 17 bp, Homo sapiens
cccagccccgactccag

SEQ ID NO: 2247382 - DNA, 21 bp, Homo sapiens
cccagccccgactccagccag

SEQ ID NO: 2247383 - DNA, 12 bp, Homo sapiens
cccagccctgct

SEQ ID NO: 2247384 - DNA, 15 bp, Homo sapiens
cccagcctctggcat

SEQ ID NO: 2247385 - DNA, 11 bp, Homo sapiens
cccagctcaat

SEQ ID NO: 2247386 - DNA, 15 bp, Homo sapiens
cccaggaagcccagg

SEQ ID NO: 2247387 - DNA, 13 bp, Homo sapiens
cccaggacgccac

SEQ ID NO: 2247388 - DNA, 17 bp, Homo sapiens
cccaggatactggcaca

SEQ ID NO: 2247389 - DNA, 14 bp, Homo sapiens
cccaggccctccct

SEQ ID NO: 2247390 - DNA, 19 bp, Homo sapiens
cccaggctggagtgcagtg

SEQ ID NO: 2247391 - DNA, 21 bp, Homo sapiens
cccagtacctagctggctctg

SEQ ID NO: 2247392 - DNA, 18 bp, Homo sapiens
cccagtgggacagaggag

SEQ ID NO: 2247393 - DNA, 15 bp, Homo sapiens
cccagttcctttaga

SEQ ID NO: 2247394 - DNA, 14 bp, Homo sapiens
cccatccagccaga

SEQ ID NO: 2247395 - DNA, 16 bp, Homo sapiens
cccatccagccagacc

SEQ ID NO: 2247396 - DNA, 18 bp, Homo sapiens
cccatccagcctccaggg

SEQ ID NO: 2247397 - DNA, 16 bp, Homo sapiens
cccatccctccccagt

SEQ ID NO: 2247398 - DNA, 13 bp, Homo sapiens
cccatgccagaga

SEQ ID NO: 2247399 - DNA, 15 bp, Homo sapiens
cccatgccagagagg

SEQ ID NO: 2247400 - DNA, 20 bp, Homo sapiens
cccatgcttacgtgatcctc

SEQ ID NO: 2247401 - DNA, 13 bp, Homo sapiens
cccatggagccag

SEQ ID NO: 2247402 - DNA, 15 bp, Homo sapiens
cccatggcattttat

SEQ ID NO: 2247403 - DNA, 17 bp, Homo sapiens
cccatgtgtcccctcac

SEQ ID NO: 2247404 - DNA, 14 bp, Homo sapiens
cccatttcaatgtg

SEQ ID NO: 2247405 - DNA, 22 bp, Homo sapiens
ccccaaacaccttccagctcct

SEQ ID NO: 2247406 - DNA, 17 bp, Homo sapiens
ccccaaacaggacagca

SEQ ID NO: 2247407 - DNA, 21 bp, Homo sapiens
ccccaacctttccctcacccc

SEQ ID NO: 2247408 - DNA, 16 bp, Homo sapiens
ccccacgctgaccatg

SEQ ID NO: 2247409 - DNA, 22 bp, Homo sapiens
ccccagcactaaggccgtgtct

SEQ ID NO: 2247410 - DNA, 19 bp, Homo sapiens
ccccagccccgactccagc

SEQ ID NO: 2247411 - DNA, 23 bp, Homo sapiens
ccccagccccgactccagccagc

SEQ ID NO: 2247412 - DNA, 15 bp, Homo sapiens
ccccagccccttcca

SEQ ID NO: 2247413 - DNA, 20 bp, Homo sapiens
ccccagccctgctggggatc

SEQ ID NO: 2247414 - DNA, 15 bp, Homo sapiens
ccccagcctctggca

SEQ ID NO: 2247415 - DNA, 16 bp, Homo sapiens
ccccagcctctggcat

SEQ ID NO: 2247416 - DNA, 14 bp, Homo sapiens
ccccagctcaatgg

SEQ ID NO: 2247417 - DNA, 22 bp, Homo sapiens
ccccaggcatctgttagcagag

SEQ ID NO: 2247418 - DNA, 18 bp, Homo sapiens
ccccagtcacttcctgtc

SEQ ID NO: 2247419 - DNA, 17 bp, Homo sapiens
ccccatccagcctccag

SEQ ID NO: 2247420 - DNA, 21 bp, Homo sapiens
ccccatccagcctccagggca

SEQ ID NO: 2247421 - DNA, 23 bp, Homo sapiens
cccccagccccgactccagccag

SEQ ID NO: 2247422 - DNA, 13 bp, Homo sapiens
cccccatccagcc

SEQ ID NO: 2247423 - DNA, 20 bp, Homo sapiens
cccccatccagcctccaggg

SEQ ID NO: 2247424 - DNA, 13 bp, Homo sapiens
ccccccagcacta

SEQ ID NO: 2247425 - DNA, 13 bp, Homo sapiens
ccccccagcctct

SEQ ID NO: 2247426 - DNA, 16 bp, Homo sapiens
ccccctctgtcttgtg

SEQ ID NO: 2247427 - DNA, 16 bp, Homo sapiens
cccccttccccttctg

SEQ ID NO: 2247428 - DNA, 12 bp, Homo sapiens
ccccctttcctg

SEQ ID NO: 2247429 - DNA, 14 bp, Homo sapiens
ccccgactccagcc

SEQ ID NO: 2247430 - DNA, 15 bp, Homo sapiens
ccccgactccagcca

SEQ ID NO: 2247431 - DNA, 17 bp, Homo sapiens
ccccgcctggccaggag

SEQ ID NO: 2247432 - DNA, 18 bp, Homo sapiens
ccccgcgccccagtcact

SEQ ID NO: 2247433 - DNA, 16 bp, Homo sapiens
ccccgggaccgcgcta

SEQ ID NO: 2247434 - DNA, 22 bp, Homo sapiens
ccccgtgtgcacaccaccctcc

SEQ ID NO: 2247435 - DNA, 19 bp, Homo sapiens
cccctaaagcctcaaaaca

SEQ ID NO: 2247436 - DNA, 12 bp, Homo sapiens
cccctcacctcc

SEQ ID NO: 2247437 - DNA, 14 bp, Homo sapiens
cccctcacctcctc

SEQ ID NO: 2247438 - DNA, 21 bp, Homo sapiens
cccctcactctgtcagccagc

SEQ ID NO: 2247439 - DNA, 22 bp, Homo sapiens
cccctcactctgtcagccagcc

SEQ ID NO: 2247440 - DNA, 19 bp, Homo sapiens
cccctcagcgcccccagag

SEQ ID NO: 2247441 - DNA, 12 bp, Homo sapiens
cccctcccaccc

SEQ ID NO: 2247442 - DNA, 12 bp, Homo sapiens
cccctctcacca

SEQ ID NO: 2247443 - DNA, 13 bp, Homo sapiens
cccctctccccgg

SEQ ID NO: 2247444 - DNA, 19 bp, Homo sapiens
ctagcatttcccaacacaa

SEQ ID NO: 2247445 - DNA, 14 bp, Homo sapiens
ctagctttttaatt

SEQ ID NO: 2247446 - DNA, 15 bp, Homo sapiens
ctaggacacagttcc

SEQ ID NO: 2247447 - DNA, 14 bp, Homo sapiens
ctagtcaccagaga

SEQ ID NO: 2247448 - DNA, 23 bp, Homo sapiens
ctagtgagtgtgctgacttttta

SEQ ID NO: 2247449 - DNA, 20 bp, Homo sapiens
ctatacatatctttattaat

SEQ ID NO: 2247450 - DNA, 22 bp, Homo sapiens
ctatacatatctttattaatca

SEQ ID NO: 2247451 - DNA, 22 bp, Homo sapiens
ctatagttatacatcaatttaa

SEQ ID NO: 2247452 - DNA, 22 bp, Homo sapiens
ctatataaaataactaaaatgt

SEQ ID NO: 2247453 - DNA, 15 bp, Homo sapiens
ctatcaatatttaag

SEQ ID NO: 2247454 - DNA, 13 bp, Homo sapiens
ctatctatttgag

SEQ ID NO: 2247455 - DNA, 13 bp, Homo sapiens
ctatgcacacttt

SEQ ID NO: 2247456 - DNA, 19 bp, Homo sapiens
ctatggtatgctggccagc

SEQ ID NO: 2247457 - DNA, 21 bp, Homo sapiens
ctatggtatgctggccagcac

SEQ ID NO: 2247458 - DNA, 15 bp, Homo sapiens
ctatgtataaaatac

SEQ ID NO: 2247459 - DNA, 17 bp, Homo sapiens
ctatgtgccttatgttg

SEQ ID NO: 2247460 - DNA, 17 bp, Homo sapiens
ctattctagcctgcatt

SEQ ID NO: 2247461 - DNA, 10 bp, Homo sapiens
ctatttaaga

SEQ ID NO: 2247462 - DNA, 14 bp, Homo sapiens
ctatttaagatgtg

SEQ ID NO: 2247463 - DNA, 15 bp, Homo sapiens
ctatttaagatgtga

SEQ ID NO: 2247464 - DNA, 13 bp, Homo sapiens
ctcaaaacaaagg

SEQ ID NO: 2247465 - DNA, 17 bp, Homo sapiens
ctcaaaaccatctctct

SEQ ID NO: 2247466 - DNA, 17 bp, Homo sapiens
ctcaaagaagtcggaat

SEQ ID NO: 2247467 - DNA, 12 bp, Homo sapiens
ctcaacaagaaa

SEQ ID NO: 2247468 - DNA, 12 bp, Homo sapiens
ctcaacctcttc

SEQ ID NO: 2247469 - DNA, 13 bp, Homo sapiens
ctcaacctcttct

SEQ ID NO: 2247470 - DNA, 20 bp, Homo sapiens
ctcaacctcttctggctcaa

SEQ ID NO: 2247471 - DNA, 17 bp, Homo sapiens
ctcaagatactgctact

SEQ ID NO: 2247472 - DNA, 14 bp, Homo sapiens
ctcaaggattgatt

SEQ ID NO: 2247473 - DNA, 18 bp, Homo sapiens
ctcaatcacactacacat

SEQ ID NO: 2247474 - DNA, 13 bp, Homo sapiens
ctcaatggactgg

SEQ ID NO: 2247475 - DNA, 14 bp, Homo sapiens
ctcaatggactgga

SEQ ID NO: 2247476 - DNA, 15 bp, Homo sapiens
ctcacaagccagcca

SEQ ID NO: 2247477 - DNA, 16 bp, Homo sapiens
ctcacagcacttgttt

SEQ ID NO: 2247478 - DNA, 18 bp, Homo sapiens
ctcaccactaccagccag

SEQ ID NO: 2247479 - DNA, 20 bp, Homo sapiens
ctcaccactaccagccagcc

SEQ ID NO: 2247480 - DNA, 18 bp, Homo sapiens
ctcaccccctcccacccc

SEQ ID NO: 2247481 - DNA, 13 bp, Homo sapiens
ctcactaattttt

SEQ ID NO: 2247482 - DNA, 23 bp, Homo sapiens
ctcactaatttttgtattatttt

SEQ ID NO: 2247483 - DNA, 24 bp, Homo sapiens
ctcactatggtatgctggccagca

SEQ ID NO: 2247484 - DNA, 15 bp, Homo sapiens
ctcactctgtcagcc

SEQ ID NO: 2247485 - DNA, 16 bp, Homo sapiens
ctcactggggcctaca

SEQ ID NO: 2247486 - DNA, 18 bp, Homo sapiens
ctcagaaggccccagaga

SEQ ID NO: 2247487 - DNA, 21 bp, Homo sapiens
ctcagaaggccccagagagac

SEQ ID NO: 2247488 - DNA, 20 bp, Homo sapiens
ctcagagcatttaaggaaac

SEQ ID NO: 2247489 - DNA, 23 bp, Homo sapiens
ctcagagccctcaactattctgt

SEQ ID NO: 2247490 - DNA, 14 bp, Homo sapiens
ctcagatgttaaaa

SEQ ID NO: 2247491 - DNA, 16 bp, Homo sapiens
ctcagatttctgagga

SEQ ID NO: 2247492 - DNA, 20 bp, Homo sapiens
ctcagcatcaaaatatttca

SEQ ID NO: 2247493 - DNA, 19 bp, Homo sapiens
ctcagcccgcttggccacc

SEQ ID NO: 2247494 - DNA, 16 bp, Homo sapiens
ctcagccctcagaaca

SEQ ID NO: 2247495 - DNA, 14 bp, Homo sapiens
ctcagcctctgcca

SEQ ID NO: 2247496 - DNA, 21 bp, Homo sapiens
ctcagcgcccccagagcccgt

SEQ ID NO: 2247497 - DNA, 15 bp, Homo sapiens
ctcaggcagctcaag

SEQ ID NO: 2247498 - DNA, 18 bp, Homo sapiens
ctcagttcaacctggtgg

SEQ ID NO: 2247499 - DNA, 21 bp, Homo sapiens
ctcagttcaacctggtggcac

SEQ ID NO: 2247500 - DNA, 14 bp, Homo sapiens
ctcatagacactga

SEQ ID NO: 2247501 - DNA, 13 bp, Homo sapiens
ctcatccacccca

SEQ ID NO: 2247502 - DNA, 15 bp, Homo sapiens
ctcatccaccccatc

SEQ ID NO: 2247503 - DNA, 24 bp, Homo sapiens
ctcatccaccccatccctccccag

SEQ ID NO: 2247504 - DNA, 20 bp, Homo sapiens
ctcatgacggcttttgtcag

SEQ ID NO: 2247505 - DNA, 17 bp, Homo sapiens
ctcatggcccctctgac

SEQ ID NO: 2247506 - DNA, 19 bp, Homo sapiens
ctcatggcccctctgacct

SEQ ID NO: 2247507 - DNA, 21 bp, Homo sapiens
ctcattctactaatgtgatgc

SEQ ID NO: 2247508 - DNA, 16 bp, Homo sapiens
ctcattggccagctca

SEQ ID NO: 2247509 - DNA, 16 bp, Homo sapiens
ctcatttaagggaaaa

SEQ ID NO: 2247510 - DNA, 18 bp, Homo sapiens
ctcatttcatctcattta

SEQ ID NO: 2247511 - DNA, 20 bp, Homo sapiens
ctcatttttcatactgaaaa

SEQ ID NO: 2247512 - DNA, 23 bp, Homo sapiens
ctccaagtctgtacctcaaatga

SEQ ID NO: 2247513 - DNA, 20 bp, Homo sapiens
ctccacagagaggaggggac

SEQ ID NO: 2247514 - DNA, 16 bp, Homo sapiens
ctccacgcctcctggc

SEQ ID NO: 2247515 - DNA, 19 bp, Homo sapiens
ctccacgcctcctggccag

SEQ ID NO: 2247516 - DNA, 20 bp, Homo sapiens
ctccacgcctcctggccaga

SEQ ID NO: 2247517 - DNA, 13 bp, Homo sapiens
ctccagacttcaa

SEQ ID NO: 2247518 - DNA, 17 bp, Homo sapiens
ctccagatgtttccaga

SEQ ID NO: 2247519 - DNA, 14 bp, Homo sapiens
ctccagccagcgcc

SEQ ID NO: 2247520 - DNA, 17 bp, Homo sapiens
ctccagccagcgcctcc

SEQ ID NO: 2247521 - DNA, 19 bp, Homo sapiens
ctccagctgggctctgcaa

SEQ ID NO: 2247522 - DNA, 20 bp, Homo sapiens
ctccagctgggctctgcaat

SEQ ID NO: 2247523 - DNA, 21 bp, Homo sapiens
ctccagggcattgctcagccc

SEQ ID NO: 2247524 - DNA, 21 bp, Homo sapiens
ctccatagtttggcatttgca

SEQ ID NO: 2247525 - DNA, 18 bp, Homo sapiens
ctcccaccagagccggga

SEQ ID NO: 2247526 - DNA, 13 bp, Homo sapiens
ctcccacccccag

SEQ ID NO: 2247527 - DNA, 14 bp, Homo sapiens
ctcccacccccagc

SEQ ID NO: 2247528 - DNA, 15 bp, Homo sapiens
ctcccacccccagcc

SEQ ID NO: 2247529 - DNA, 16 bp, Homo sapiens
ctcccacccccagccc

SEQ ID NO: 2247530 - DNA, 22 bp, Homo sapiens
ctcccagagcttgttgtctcca

SEQ ID NO: 2247531 - DNA, 20 bp, Homo sapiens
ctccccatgtgtcctggttc

SEQ ID NO: 2247532 - DNA, 23 bp, Homo sapiens
ctcccccttccccttctgtgtca

SEQ ID NO: 2247533 - DNA, 19 bp, Homo sapiens
ctccccgcgccccagtcac

SEQ ID NO: 2247534 - DNA, 15 bp, Homo sapiens
ctcccctattttaag

SEQ ID NO: 2247535 - DNA, 23 bp, Homo sapiens
ctcccgctgcaagtcagattgct

SEQ ID NO: 2247536 - DNA, 20 bp, Homo sapiens
ctcccggaggttgggtgggc

SEQ ID NO: 2247537 - DNA, 13 bp, Homo sapiens
ctccctccacccc

SEQ ID NO: 2247538 - DNA, 16 bp, Homo sapiens
ctccctccaccccagg

SEQ ID NO: 2247539 - DNA, 11 bp, Homo sapiens
ctccctctctc

SEQ ID NO: 2247540 - DNA, 18 bp, Homo sapiens
ctccctctctcttttcat

SEQ ID NO: 2247541 - DNA, 18 bp, Homo sapiens
ctccctgactccctgtgg

SEQ ID NO: 2247542 - DNA, 22 bp, Homo sapiens
ctccctggcaggatgctgagct

SEQ ID NO: 2247543 - DNA, 24 bp, Homo sapiens
ctccctgtgggggtggccatccct

SEQ ID NO: 2247544 - DNA, 15 bp, Homo sapiens
ctccgggtgtggcct

SEQ ID NO: 2247545 - DNA, 17 bp, Homo sapiens
ctccgggtgtggcctca

SEQ ID NO: 2247546 - DNA, 19 bp, Homo sapiens
ctccgggtgtggcctcagc

SEQ ID NO: 2247547 - DNA, 22 bp, Homo sapiens
ctccgggtgtggcctcagccct

SEQ ID NO: 2247548 - DNA, 17 bp, Homo sapiens
ctccgtcctctccccag

SEQ ID NO: 2247549 - DNA, 17 bp, Homo sapiens
ctcctatatatttctat

SEQ ID NO: 2247550 - DNA, 22 bp, Homo sapiens
ctcctatgggttgtcaccaagc

SEQ ID NO: 2247551 - DNA, 19 bp, Homo sapiens
ctcctcacaccccagcacc

SEQ ID NO: 2247552 - DNA, 13 bp, Homo sapiens
gaaaggattttac

SEQ ID NO: 2247553 - DNA, 14 bp, Homo sapiens
gaaagggaaactgg

SEQ ID NO: 2247554 - DNA, 14 bp, Homo sapiens
gaaagttttgttct

SEQ ID NO: 2247555 - DNA, 17 bp, Homo sapiens
gaaagttttgttctgta

SEQ ID NO: 2247556 - DNA, 13 bp, Homo sapiens
gaaataaaagctt

SEQ ID NO: 2247557 - DNA, 15 bp, Homo sapiens
gaaatactatttaaa

SEQ ID NO: 2247558 - DNA, 16 bp, Homo sapiens
gaaatcacataacctt

SEQ ID NO: 2247559 - DNA, 17 bp, Homo sapiens
gaaatctaaatttcttt

SEQ ID NO: 2247560 - DNA, 15 bp, Homo sapiens
gaaatgaaagggaaa

SEQ ID NO: 2247561 - DNA, 18 bp, Homo sapiens
gaaatgaaagggaaactg

SEQ ID NO: 2247562 - DNA, 23 bp, Homo sapiens
gaaatgaaagggaaactgggaaa

SEQ ID NO: 2247563 - DNA, 14 bp, Homo sapiens
gaaatggaaatttt

SEQ ID NO: 2247564 - DNA, 17 bp, Homo sapiens
gaaatgggacttaactc

SEQ ID NO: 2247565 - DNA, 22 bp, Homo sapiens
gaaatttcaataacctttcact

SEQ ID NO: 2247566 - DNA, 21 bp, Homo sapiens
gaaattttcaagagtctaata

SEQ ID NO: 2247567 - DNA, 13 bp, Homo sapiens
gaaattttgctat

SEQ ID NO: 2247568 - DNA, 12 bp, Homo sapiens
gaacaatgaagt

SEQ ID NO: 2247569 - DNA, 14 bp, Homo sapiens
gaacacgtttttac

SEQ ID NO: 2247570 - DNA, 15 bp, Homo sapiens
gaacacgtttttaca

SEQ ID NO: 2247571 - DNA, 18 bp, Homo sapiens
gaacatccaaccttccca

SEQ ID NO: 2247572 - DNA, 17 bp, Homo sapiens
gaacattaattatatgt

SEQ ID NO: 2247573 - DNA, 20 bp, Homo sapiens
gaaccagccgtattttacat

SEQ ID NO: 2247574 - DNA, 15 bp, Homo sapiens
gaactaggctgagca

SEQ ID NO: 2247575 - DNA, 17 bp, Homo sapiens
gaactaggctgagcaat

SEQ ID NO: 2247576 - DNA, 18 bp, Homo sapiens
gaactcgcgctcagtaaa

SEQ ID NO: 2247577 - DNA, 20 bp, Homo sapiens
gaactgtgtttcaagttcaa

SEQ ID NO: 2247578 - DNA, 17 bp, Homo sapiens
gaacttacattgttcaa

SEQ ID NO: 2247579 - DNA, 18 bp, Homo sapiens
gaacttgttacttgcagc

SEQ ID NO: 2247580 - DNA, 14 bp, Homo sapiens
gaagaaaactatcc

SEQ ID NO: 2247581 - DNA, 22 bp, Homo sapiens
gaagaaaactatcctgcgggtt

SEQ ID NO: 2247582 - DNA, 21 bp, Homo sapiens
gaagaacgcggtgtgtaacac

SEQ ID NO: 2247583 - DNA, 23 bp, Homo sapiens
gaagacactgcagtgaccactta

SEQ ID NO: 2247584 - DNA, 22 bp, Homo sapiens
gaagagatgacaaaccataact

SEQ ID NO: 2247585 - DNA, 12 bp, Homo sapiens
gaagattctatt

SEQ ID NO: 2247586 - DNA, 12 bp, Homo sapiens
gaagcaatctcc

SEQ ID NO: 2247587 - DNA, 17 bp, Homo sapiens
gaagccacgctgtcctc

SEQ ID NO: 2247588 - DNA, 18 bp, Homo sapiens
gaagccacgctgtcctct

SEQ ID NO: 2247589 - DNA, 14 bp, Homo sapiens
gaagcccctgggcc

SEQ ID NO: 2247590 - DNA, 23 bp, Homo sapiens
gaagccctcaaagaagtcggaat

SEQ ID NO: 2247591 - DNA, 17 bp, Homo sapiens
gaagcggagagagccaa

SEQ ID NO: 2247592 - DNA, 20 bp, Homo sapiens
gaagcggagagagccaagac

SEQ ID NO: 2247593 - DNA, 22 bp, Homo sapiens
gaagctttatttgcatatttat

SEQ ID NO: 2247594 - DNA, 14 bp, Homo sapiens
gaaggaacaaagac

SEQ ID NO: 2247595 - DNA, 23 bp, Homo sapiens
gaaggatccatctttgtatattt

SEQ ID NO: 2247596 - DNA, 17 bp, Homo sapiens
gaaggccccagagagac

SEQ ID NO: 2247597 - DNA, 18 bp, Homo sapiens
gaaggccccagagagacc

SEQ ID NO: 2247598 - DNA, 22 bp, Homo sapiens
gaaggggcctcaccgagtgggg

SEQ ID NO: 2247599 - DNA, 22 bp, Homo sapiens
gaaggtttattgttaatacaag

SEQ ID NO: 2247600 - DNA, 17 bp, Homo sapiens
gaagtcattaaactggt

SEQ ID NO: 2247601 - DNA, 22 bp, Homo sapiens
gaagtcggaatgtcatagtctt

SEQ ID NO: 2247602 - DNA, 16 bp, Homo sapiens
gaagtgagcacagcct

SEQ ID NO: 2247603 - DNA, 13 bp, Homo sapiens
gaataaaagaatt

SEQ ID NO: 2247604 - DNA, 14 bp, Homo sapiens
gaataagttattgc

SEQ ID NO: 2247605 - DNA, 18 bp, Homo sapiens
gaataccacttacctcaa

SEQ ID NO: 2247606 - DNA, 24 bp, Homo sapiens
gaatactttgcagcacagctgaga

SEQ ID NO: 2247607 - DNA, 17 bp, Homo sapiens
gaatagaagctaaggtt

SEQ ID NO: 2247608 - DNA, 18 bp, Homo sapiens
gaatagaagctaaggttt

SEQ ID NO: 2247609 - DNA, 18 bp, Homo sapiens
gaatagtcgcgcaagcat

SEQ ID NO: 2247610 - DNA, 20 bp, Homo sapiens
gaatatatctctatttgaga

SEQ ID NO: 2247611 - DNA, 11 bp, Homo sapiens
gaatcaataat

SEQ ID NO: 2247612 - DNA, 12 bp, Homo sapiens
gaatctggagac

SEQ ID NO: 2247613 - DNA, 22 bp, Homo sapiens
gaatctggagaccagggagcct

SEQ ID NO: 2247614 - DNA, 12 bp, Homo sapiens
gaatcttttaaa

SEQ ID NO: 2247615 - DNA, 22 bp, Homo sapiens
gaatgtcatagtcttgaaatga

SEQ ID NO: 2247616 - DNA, 15 bp, Homo sapiens
gaatgtgtctcagga

SEQ ID NO: 2247617 - DNA, 16 bp, Homo sapiens
gaatgttttaaattct

SEQ ID NO: 2247618 - DNA, 17 bp, Homo sapiens
gaattacatatgaaaaa

SEQ ID NO: 2247619 - DNA, 19 bp, Homo sapiens
gaattaccaagaatatcct

SEQ ID NO: 2247620 - DNA, 22 bp, Homo sapiens
gaattatctatacatatcttta

SEQ ID NO: 2247621 - DNA, 21 bp, Homo sapiens
gaattatttctgtcacagtaa

SEQ ID NO: 2247622 - DNA, 21 bp, Homo sapiens
gaattcaaactggggcctcca

SEQ ID NO: 2247623 - DNA, 16 bp, Homo sapiens
gaattccctccccctc

SEQ ID NO: 2247624 - DNA, 18 bp, Homo sapiens
gaattgaggggattaata

SEQ ID NO: 2247625 - DNA, 17 bp, Homo sapiens
gaattgtttttgtacag

SEQ ID NO: 2247626 - DNA, 17 bp, Homo sapiens
gaatttagtattatcaa

SEQ ID NO: 2247627 - DNA, 18 bp, Homo sapiens
gaatttagtattatcaaa

SEQ ID NO: 2247628 - DNA, 18 bp, Homo sapiens
gaattttaaataatgtat

SEQ ID NO: 2247629 - DNA, 20 bp, Homo sapiens
gacaacaggtaaaacagggc

SEQ ID NO: 2247630 - DNA, 23 bp, Homo sapiens
gacactgcagaaaccctgagcag

SEQ ID NO: 2247631 - DNA, 12 bp, Homo sapiens
gacagcatgaga

SEQ ID NO: 2247632 - DNA, 19 bp, Homo sapiens
gacaggaaagccctccccc

SEQ ID NO: 2247633 - DNA, 20 bp, Homo sapiens
gacaggaaagccctccccct

SEQ ID NO: 2247634 - DNA, 17 bp, Homo sapiens
gacagtacctgattgta

SEQ ID NO: 2247635 - DNA, 23 bp, Homo sapiens
gacatgaattttaaataatgtat

SEQ ID NO: 2247636 - DNA, 18 bp, Homo sapiens
gacatgttcctttaaggt

SEQ ID NO: 2247637 - DNA, 16 bp, Homo sapiens
gacatttaacttttct

SEQ ID NO: 2247638 - DNA, 18 bp, Homo sapiens
gaccaataaacagctccc

SEQ ID NO: 2247639 - DNA, 15 bp, Homo sapiens
gaccaattctggaca

SEQ ID NO: 2247640 - DNA, 21 bp, Homo sapiens
gaccaattctggacagacaga

SEQ ID NO: 2247641 - DNA, 14 bp, Homo sapiens
gaccacggagggag

SEQ ID NO: 2247642 - DNA, 17 bp, Homo sapiens
gaccactgggtgagaga

SEQ ID NO: 2247643 - DNA, 14 bp, Homo sapiens
gaccagggagcctt

SEQ ID NO: 2247644 - DNA, 22 bp, Homo sapiens
gaccagggagcctttggttctg

SEQ ID NO: 2247645 - DNA, 15 bp, Homo sapiens
gaccccagccatcca

SEQ ID NO: 2247646 - DNA, 18 bp, Homo sapiens
gacccccatccagcctcc

SEQ ID NO: 2247647 - DNA, 19 bp, Homo sapiens
gacccccatccagcctcca

SEQ ID NO: 2247648 - DNA, 11 bp, Homo sapiens
gacccctgcct

SEQ ID NO: 2247649 - DNA, 18 bp, Homo sapiens
gaccctatgggtctagga

SEQ ID NO: 2247650 - DNA, 20 bp, Homo sapiens
gaccctgagtccgggaggca

SEQ ID NO: 2247651 - DNA, 17 bp, Homo sapiens
gacccttataaaatcct

SEQ ID NO: 2247652 - DNA, 16 bp, Homo sapiens
gacccttattgctgtc

SEQ ID NO: 2247653 - DNA, 16 bp, Homo sapiens
gaccgccccctcctct

SEQ ID NO: 2247654 - DNA, 21 bp, Homo sapiens
gaccgcgctagggctccgagg

SEQ ID NO: 2247655 - DNA, 16 bp, Homo sapiens
gacctccgtcctctcc

SEQ ID NO: 2247656 - DNA, 23 bp, Homo sapiens
gacctgaataccacttacctcaa

SEQ ID NO: 2247657 - DNA, 16 bp, Homo sapiens
gacctgcactggggag

SEQ ID NO: 2247658 - DNA, 16 bp, Homo sapiens
gacctggcgtgctcag

SEQ ID NO: 2247659 - DNA, 17 bp, Homo sapiens
gacctggcgtgctcaga

SEQ ID NO: 2247660 - DNA, 23 bp, Homo sapiens
gctctgcaattcccctctgctgc

SEQ ID NO: 2247661 - DNA, 19 bp, Homo sapiens
gctcttgatacccccctct

SEQ ID NO: 2247662 - DNA, 15 bp, Homo sapiens
gctctttattcatta

SEQ ID NO: 2247663 - DNA, 20 bp, Homo sapiens
gctgaccatgcgtcaggggc

SEQ ID NO: 2247664 - DNA, 19 bp, Homo sapiens
gctgagcctctgctcccca

SEQ ID NO: 2247665 - DNA, 23 bp, Homo sapiens
gctgaggacgagacccccatcca

SEQ ID NO: 2247666 - DNA, 16 bp, Homo sapiens
gctgatgtatcctttc

SEQ ID NO: 2247667 - DNA, 13 bp, Homo sapiens
gctgcccctctca

SEQ ID NO: 2247668 - DNA, 13 bp, Homo sapiens
gctgccgctgcac

SEQ ID NO: 2247669 - DNA, 15 bp, Homo sapiens
gctgccgctgcacca

SEQ ID NO: 2247670 - DNA, 16 bp, Homo sapiens
gctgccgctgcaccac

SEQ ID NO: 2247671 - DNA, 17 bp, Homo sapiens
gctgccgctgcaccacg

SEQ ID NO: 2247672 - DNA, 19 bp, Homo sapiens
gctgcgggctccctggcag

SEQ ID NO: 2247673 - DNA, 16 bp, Homo sapiens
gctgctatacacaagc

SEQ ID NO: 2247674 - DNA, 15 bp, Homo sapiens
gctgctccaccctcc

SEQ ID NO: 2247675 - DNA, 23 bp, Homo sapiens
gctgctgtccctcccccttgtcc

SEQ ID NO: 2247676 - DNA, 14 bp, Homo sapiens
gctggcagggtccc

SEQ ID NO: 2247677 - DNA, 19 bp, Homo sapiens
gctggcagggtccctccag

SEQ ID NO: 2247678 - DNA, 12 bp, Homo sapiens
gctggccagcac

SEQ ID NO: 2247679 - DNA, 15 bp, Homo sapiens
gctggccagcaccct

SEQ ID NO: 2247680 - DNA, 16 bp, Homo sapiens
gctggccagcaccctc

SEQ ID NO: 2247681 - DNA, 18 bp, Homo sapiens
gctggccagcaccctctc

SEQ ID NO: 2247682 - DNA, 21 bp, Homo sapiens
gctggccagcaccctctcctg

SEQ ID NO: 2247683 - DNA, 18 bp, Homo sapiens
gctggccccagccctgct

SEQ ID NO: 2247684 - DNA, 21 bp, Homo sapiens
gctggccccagccctgctggg

SEQ ID NO: 2247685 - DNA, 13 bp, Homo sapiens
gctgggcccctgg

SEQ ID NO: 2247686 - DNA, 14 bp, Homo sapiens
gctgggcccctggg

SEQ ID NO: 2247687 - DNA, 15 bp, Homo sapiens
gctgggcccctggga

SEQ ID NO: 2247688 - DNA, 16 bp, Homo sapiens
gctggggacctggtac

SEQ ID NO: 2247689 - DNA, 23 bp, Homo sapiens
gctggggatccccgcctggccag

SEQ ID NO: 2247690 - DNA, 17 bp, Homo sapiens
gctgggtggtaccctct

SEQ ID NO: 2247691 - DNA, 13 bp, Homo sapiens
gctggtagcagca

SEQ ID NO: 2247692 - DNA, 20 bp, Homo sapiens
gctggtagcagcaggctcag

SEQ ID NO: 2247693 - DNA, 22 bp, Homo sapiens
gctgtaatcatttgtttacatt

SEQ ID NO: 2247694 - DNA, 20 bp, Homo sapiens
gctgtagtcctcataaaaag

SEQ ID NO: 2247695 - DNA, 14 bp, Homo sapiens
gctgtcaaggctca

SEQ ID NO: 2247696 - DNA, 15 bp, Homo sapiens
gctgtcgccccaggc

SEQ ID NO: 2247697 - DNA, 20 bp, Homo sapiens
gctgtcgccccaggccctcc

SEQ ID NO: 2247698 - DNA, 21 bp, Homo sapiens
gctgtcgccccaggccctccc

SEQ ID NO: 2247699 - DNA, 19 bp, Homo sapiens
gctgtctatgattgtactt

SEQ ID NO: 2247700 - DNA, 15 bp, Homo sapiens
gctgtctggccctgg

SEQ ID NO: 2247701 - DNA, 16 bp, Homo sapiens
gctgtctgtcaccagc

SEQ ID NO: 2247702 - DNA, 23 bp, Homo sapiens
gctgtctgttgtattcattgtgg

SEQ ID NO: 2247703 - DNA, 19 bp, Homo sapiens
gctgtgcccccctcctccc

SEQ ID NO: 2247704 - DNA, 13 bp, Homo sapiens
gctgtgggcagca

SEQ ID NO: 2247705 - DNA, 15 bp, Homo sapiens
gcttaatcattttca

SEQ ID NO: 2247706 - DNA, 21 bp, Homo sapiens
gcttaatcattttcattccta

SEQ ID NO: 2247707 - DNA, 17 bp, Homo sapiens
gcttccttagccttgct

SEQ ID NO: 2247708 - DNA, 22 bp, Homo sapiens
gcttctcagatttctgaggaaa

SEQ ID NO: 2247709 - DNA, 18 bp, Homo sapiens
gcttcttcagagatcaag

SEQ ID NO: 2247710 - DNA, 19 bp, Homo sapiens
gcttgaactaggctgagca

SEQ ID NO: 2247711 - DNA, 17 bp, Homo sapiens
gcttgtaactaaaataa

SEQ ID NO: 2247712 - DNA, 19 bp, Homo sapiens
gctttacatactttatcaa

SEQ ID NO: 2247713 - DNA, 14 bp, Homo sapiens
gctttgatccctga

SEQ ID NO: 2247714 - DNA, 18 bp, Homo sapiens
gctttgcaaaatgagact

SEQ ID NO: 2247715 - DNA, 18 bp, Homo sapiens
gcttttgcataatgcaat

SEQ ID NO: 2247716 - DNA, 13 bp, Homo sapiens
gctttttataaaa

SEQ ID NO: 2247717 - DNA, 12 bp, Homo sapiens
ggaaaaggcccc

SEQ ID NO: 2247718 - DNA, 15 bp, Homo sapiens
ggaaacgtggcagga

SEQ ID NO: 2247719 - DNA, 16 bp, Homo sapiens
ggaaactaagattctt

SEQ ID NO: 2247720 - DNA, 21 bp, Homo sapiens
ggaaactagacaagtaaaatt

SEQ ID NO: 2247721 - DNA, 23 bp, Homo sapiens
ggaaactatgtgtttttctcata

SEQ ID NO: 2247722 - DNA, 13 bp, Homo sapiens
ggaaactgggaaa

SEQ ID NO: 2247723 - DNA, 14 bp, Homo sapiens
ggaaactgggaaac

SEQ ID NO: 2247724 - DNA, 17 bp, Homo sapiens
ggaaactgggaaactgg

SEQ ID NO: 2247725 - DNA, 12 bp, Homo sapiens
ggaaagccctcc

SEQ ID NO: 2247726 - DNA, 16 bp, Homo sapiens
ggaaagccctccccct

SEQ ID NO: 2247727 - DNA, 14 bp, Homo sapiens
ggaacaaagacagg

SEQ ID NO: 2247728 - DNA, 17 bp, Homo sapiens
ggaacaaagacaggcaa

SEQ ID NO: 2247729 - DNA, 13 bp, Homo sapiens
ggaagcccctggg

SEQ ID NO: 2247730 - DNA, 11 bp, Homo sapiens
ggaaggggctg

SEQ ID NO: 2247731 - DNA, 13 bp, Homo sapiens
ggaatgcagcagg

SEQ ID NO: 2247732 - DNA, 19 bp, Homo sapiens
ggaattacgtgctctgtgg

SEQ ID NO: 2247733 - DNA, 16 bp, Homo sapiens
ggaattccctccccct

SEQ ID NO: 2247734 - DNA, 18 bp, Homo sapiens
ggacacagttcctgggaa

SEQ ID NO: 2247735 - DNA, 19 bp, Homo sapiens
ggacacagttcctgggaac

SEQ ID NO: 2247736 - DNA, 19 bp, Homo sapiens
ggaccaagggcagaggggt

SEQ ID NO: 2247737 - DNA, 21 bp, Homo sapiens
ggaccactgggtgagagagga

SEQ ID NO: 2247738 - DNA, 21 bp, Homo sapiens
ggaccgtttccaagctgcggg

SEQ ID NO: 2247739 - DNA, 20 bp, Homo sapiens
ggacgaagcggagagagcca

SEQ ID NO: 2247740 - DNA, 23 bp, Homo sapiens
ggacgaagcggagagagccaaga

SEQ ID NO: 2247741 - DNA, 23 bp, Homo sapiens
ggacgatagcttggagggatgga

SEQ ID NO: 2247742 - DNA, 19 bp, Homo sapiens
ggacgccactcatttcatc

SEQ ID NO: 2247743 - DNA, 14 bp, Homo sapiens
ggacttctgcagct

SEQ ID NO: 2247744 - DNA, 14 bp, Homo sapiens
ggagaagacactgc

SEQ ID NO: 2247745 - DNA, 20 bp, Homo sapiens
ggagaccggggtatcctggg

SEQ ID NO: 2247746 - DNA, 13 bp, Homo sapiens
ggagaggcggcct

SEQ ID NO: 2247747 - DNA, 12 bp, Homo sapiens
ggagataaattt

SEQ ID NO: 2247748 - DNA, 16 bp, Homo sapiens
ggagcaggcacgggtg

SEQ ID NO: 2247749 - DNA, 15 bp, Homo sapiens
ggagcagtagtcatt

SEQ ID NO: 2247750 - DNA, 14 bp, Homo sapiens
ggagcctccccctc

SEQ ID NO: 2247751 - DNA, 16 bp, Homo sapiens
ggagcctccccctcag

SEQ ID NO: 2247752 - DNA, 22 bp, Homo sapiens
ggagccttcccaagttgtgctt

SEQ ID NO: 2247753 - DNA, 23 bp, Homo sapiens
ggagccttcccaagttgtgcttg

SEQ ID NO: 2247754 - DNA, 21 bp, Homo sapiens
ggagcgaagccttctgcagca

SEQ ID NO: 2247755 - DNA, 22 bp, Homo sapiens
ggagcgaagccttctgcagcag

SEQ ID NO: 2247756 - DNA, 21 bp, Homo sapiens
ggagcttttttccttaatcca

SEQ ID NO: 2247757 - DNA, 13 bp, Homo sapiens
ggaggactggacc

SEQ ID NO: 2247758 - DNA, 18 bp, Homo sapiens
ggaggagcgaaatctaaa

SEQ ID NO: 2247759 - DNA, 21 bp, Homo sapiens
ggaggagcgaaatctaaattt

SEQ ID NO: 2247760 - DNA, 14 bp, Homo sapiens
ggaggatacagagg

SEQ ID NO: 2247761 - DNA, 17 bp, Homo sapiens
ggaggctgggcccctgg

SEQ ID NO: 2247762 - DNA, 16 bp, Homo sapiens
ggagggatggagaggc

SEQ ID NO: 2247763 - DNA, 14 bp, Homo sapiens
ggagggccagcgct

SEQ ID NO: 2247764 - DNA, 12 bp, Homo sapiens
ggaggggaaggg

SEQ ID NO: 2247765 - DNA, 17 bp, Homo sapiens
ggaggggaaggggctga

SEQ ID NO: 2247766 - DNA, 19 bp, Homo sapiens
ggaggggaaggggctgagg

SEQ ID NO: 2247767 - DNA, 20 bp, Homo sapiens
ggaggtccttaggcctctga

SEQ ID NO: 2247768 - DNA, 23 bp, Homo sapiens
gtgataatacagatttgtaacat

SEQ ID NO: 2247769 - DNA, 14 bp, Homo sapiens
gtgatagcactttc

SEQ ID NO: 2247770 - DNA, 21 bp, Homo sapiens
gtgatcctctcacctcagcct

SEQ ID NO: 2247771 - DNA, 18 bp, Homo sapiens
gtgatgctttcattatgt

SEQ ID NO: 2247772 - DNA, 15 bp, Homo sapiens
gtgatttccatctct

SEQ ID NO: 2247773 - DNA, 21 bp, Homo sapiens
gtgcaatgcgtgttgtacata

SEQ ID NO: 2247774 - DNA, 15 bp, Homo sapiens
gtgcaattatttctt

SEQ ID NO: 2247775 - DNA, 16 bp, Homo sapiens
gtgcacaccaccctcc

SEQ ID NO: 2247776 - DNA, 22 bp, Homo sapiens
gtgcacatatccaggcaccagg

SEQ ID NO: 2247777 - DNA, 18 bp, Homo sapiens
gtgcatttgagagaagcc

SEQ ID NO: 2247778 - DNA, 16 bp, Homo sapiens
gtgcccagaataagtt

SEQ ID NO: 2247779 - DNA, 17 bp, Homo sapiens
gtgcccccctcctcccc

SEQ ID NO: 2247780 - DNA, 15 bp, Homo sapiens
gtgccctagatcaac

SEQ ID NO: 2247781 - DNA, 15 bp, Homo sapiens
gtgcctgtcccaccc

SEQ ID NO: 2247782 - DNA, 20 bp, Homo sapiens
gtgcctgtcccacccccacc

SEQ ID NO: 2247783 - DNA, 15 bp, Homo sapiens
gtgctggcaaccact

SEQ ID NO: 2247784 - DNA, 15 bp, Homo sapiens
gtgctggggcacggc

SEQ ID NO: 2247785 - DNA, 20 bp, Homo sapiens
gtgctgtgggcagcaccctc

SEQ ID NO: 2247786 - DNA, 14 bp, Homo sapiens
gtgcttgagccagg

SEQ ID NO: 2247787 - DNA, 20 bp, Homo sapiens
gtggaaaagcttaaaaaaat

SEQ ID NO: 2247788 - DNA, 18 bp, Homo sapiens
gtggactgtgctggtgca

SEQ ID NO: 2247789 - DNA, 16 bp, Homo sapiens
gtggcacaggccccct

SEQ ID NO: 2247790 - DNA, 14 bp, Homo sapiens
gtggcaccagatgc

SEQ ID NO: 2247791 - DNA, 20 bp, Homo sapiens
gtggcaccagatgcaacctc

SEQ ID NO: 2247792 - DNA, 13 bp, Homo sapiens
gtggcaggagggc

SEQ ID NO: 2247793 - DNA, 19 bp, Homo sapiens
gtggcaggcacacagcagc

SEQ ID NO: 2247794 - DNA, 21 bp, Homo sapiens
gtggcaggcacacagcagccc

SEQ ID NO: 2247795 - DNA, 22 bp, Homo sapiens
gtggcaggcacacagcagcccc

SEQ ID NO: 2247796 - DNA, 18 bp, Homo sapiens
gtggccatccctgggccc

SEQ ID NO: 2247797 - DNA, 20 bp, Homo sapiens
gtggccatccctgggcccct

SEQ ID NO: 2247798 - DNA, 22 bp, Homo sapiens
gtggccatccctgggcccctcc

SEQ ID NO: 2247799 - DNA, 15 bp, Homo sapiens
gtggcctcagccctc

SEQ ID NO: 2247800 - DNA, 18 bp, Homo sapiens
gtggcctcagccctcaga

SEQ ID NO: 2247801 - DNA, 23 bp, Homo sapiens
gtggctctgggaatgggagaggg

SEQ ID NO: 2247802 - DNA, 14 bp, Homo sapiens
gtgggcagcaccct

SEQ ID NO: 2247803 - DNA, 16 bp, Homo sapiens
gtgggcagcaccctcc

SEQ ID NO: 2247804 - DNA, 14 bp, Homo sapiens
gtggggcccactgc

SEQ ID NO: 2247805 - DNA, 14 bp, Homo sapiens
gtgggggtggccat

SEQ ID NO: 2247806 - DNA, 21 bp, Homo sapiens
gtgggggtggccatccctggg

SEQ ID NO: 2247807 - DNA, 11 bp, Homo sapiens
gtggggtgggg

SEQ ID NO: 2247808 - DNA, 19 bp, Homo sapiens
gtgtaaaatattttgaatc

SEQ ID NO: 2247809 - DNA, 16 bp, Homo sapiens
gtgtacagccagacca

SEQ ID NO: 2247810 - DNA, 10 bp, Homo sapiens
gtgtcacagt

SEQ ID NO: 2247811 - DNA, 23 bp, Homo sapiens
gtgtcacagttcttggtgactgt

SEQ ID NO: 2247812 - DNA, 20 bp, Homo sapiens
gtgtcccctcactctgtcag

SEQ ID NO: 2247813 - DNA, 23 bp, Homo sapiens
gtgtcccctcactctgtcagcca

SEQ ID NO: 2247814 - DNA, 16 bp, Homo sapiens
gtgtcggggctgacct

SEQ ID NO: 2247815 - DNA, 18 bp, Homo sapiens
gtgtctcagcctctgcca

SEQ ID NO: 2247816 - DNA, 15 bp, Homo sapiens
gtgtcttaattatta

SEQ ID NO: 2247817 - DNA, 21 bp, Homo sapiens
gtgtctttagtgctccaagtc

SEQ ID NO: 2247818 - DNA, 18 bp, Homo sapiens
gtgtctttcacagctcct

SEQ ID NO: 2247819 - DNA, 21 bp, Homo sapiens
gtgtctttctaagaaatcaag

SEQ ID NO: 2247820 - DNA, 17 bp, Homo sapiens
gtgtgcacaccaccctc

SEQ ID NO: 2247821 - DNA, 16 bp, Homo sapiens
gtgtggcctcagccct

SEQ ID NO: 2247822 - DNA, 18 bp, Homo sapiens
gtgtggtgcagtgtgaaa

SEQ ID NO: 2247823 - DNA, 14 bp, Homo sapiens
gtgttaagattgca

SEQ ID NO: 2247824 - DNA, 19 bp, Homo sapiens
gtgttcctggcagtttaaa

SEQ ID NO: 2247825 - DNA, 14 bp, Homo sapiens
gtgttttaatttaa

SEQ ID NO: 2247826 - DNA, 15 bp, Homo sapiens
gtgttttaatttaaa

SEQ ID NO: 2247827 - DNA, 12 bp, Homo sapiens
gtgtttttctca

SEQ ID NO: 2247828 - DNA, 20 bp, Homo sapiens
gttaaaaacagatttggaaa

SEQ ID NO: 2247829 - DNA, 16 bp, Homo sapiens
gttaacctctgctttt

SEQ ID NO: 2247830 - DNA, 19 bp, Homo sapiens
gttaaggacttctgcagct

SEQ ID NO: 2247831 - DNA, 18 bp, Homo sapiens
gttaatgtatataaaaat

SEQ ID NO: 2247832 - DNA, 13 bp, Homo sapiens
gttacacttttat

SEQ ID NO: 2247833 - DNA, 17 bp, Homo sapiens
gttacactttttggaag

SEQ ID NO: 2247834 - DNA, 21 bp, Homo sapiens
gttacagcctgttagtaacat

SEQ ID NO: 2247835 - DNA, 13 bp, Homo sapiens
gttacctgtagat

SEQ ID NO: 2247836 - DNA, 20 bp, Homo sapiens
gttactaggtaacttcatat

SEQ ID NO: 2247837 - DNA, 21 bp, Homo sapiens
gttactctcttccacatgtta

SEQ ID NO: 2247838 - DNA, 17 bp, Homo sapiens
gttactgtgtaaactca

SEQ ID NO: 2247839 - DNA, 16 bp, Homo sapiens
gttagattaagaaata

SEQ ID NO: 2247840 - DNA, 11 bp, Homo sapiens
gttataaaatt

SEQ ID NO: 2247841 - DNA, 20 bp, Homo sapiens
gttatacagttataaaatta

SEQ ID NO: 2247842 - DNA, 22 bp, Homo sapiens
gttatacagttataaaattaaa

SEQ ID NO: 2247843 - DNA, 21 bp, Homo sapiens
gttatatattgtattaagggc

SEQ ID NO: 2247844 - DNA, 23 bp, Homo sapiens
gttatatattgtattaagggcat

SEQ ID NO: 2247845 - DNA, 20 bp, Homo sapiens
gttatgaaattcaccccctt

SEQ ID NO: 2247846 - DNA, 23 bp, Homo sapiens
gttatttaacagctgaattatct

SEQ ID NO: 2247847 - DNA, 18 bp, Homo sapiens
gttattttgatgtaaaga

SEQ ID NO: 2247848 - DNA, 17 bp, Homo sapiens
gttcaagtgattctctt

SEQ ID NO: 2247849 - DNA, 13 bp, Homo sapiens
gttcatttttcaa

SEQ ID NO: 2247850 - DNA, 21 bp, Homo sapiens
gttccacacccaatgctgctc

SEQ ID NO: 2247851 - DNA, 14 bp, Homo sapiens
gttccacagaggac

SEQ ID NO: 2247852 - DNA, 21 bp, Homo sapiens
gttccaccccaagagaactcg

SEQ ID NO: 2247853 - DNA, 12 bp, Homo sapiens
gttccactgaga

SEQ ID NO: 2247854 - DNA, 13 bp, Homo sapiens
gttccactgagac

SEQ ID NO: 2247855 - DNA, 14 bp, Homo sapiens
gttccactgagacc

SEQ ID NO: 2247856 - DNA, 18 bp, Homo sapiens
gttcccatgtagccccct

SEQ ID NO: 2247857 - DNA, 18 bp, Homo sapiens
gttccccctgtttcagag

SEQ ID NO: 2247858 - DNA, 23 bp, Homo sapiens
gttccgcccactcattccttctc

SEQ ID NO: 2247859 - DNA, 23 bp, Homo sapiens
gttcctggcagtttaaaaaaatt

SEQ ID NO: 2247860 - DNA, 20 bp, Homo sapiens
gttcctgttcagtaataaaa

SEQ ID NO: 2247861 - DNA, 18 bp, Homo sapiens
gttcgatttctacctcag

SEQ ID NO: 2247862 - DNA, 21 bp, Homo sapiens
gttctacctcaggcagctcaa

SEQ ID NO: 2247863 - DNA, 13 bp, Homo sapiens
gttctccttttcc

SEQ ID NO: 2247864 - DNA, 13 bp, Homo sapiens
gttctgtgtcttt

SEQ ID NO: 2247865 - DNA, 22 bp, Homo sapiens
gttctttcatttgctttggaag

SEQ ID NO: 2247866 - DNA, 12 bp, Homo sapiens
gttgaaaaaatt

SEQ ID NO: 2247867 - DNA, 13 bp, Homo sapiens
gttgaatgttgca

SEQ ID NO: 2247868 - DNA, 13 bp, Homo sapiens
gttgactttctcc

SEQ ID NO: 2247869 - DNA, 14 bp, Homo sapiens
gttgattaaagatg

SEQ ID NO: 2247870 - DNA, 13 bp, Homo sapiens
gttggcaggccca

SEQ ID NO: 2247871 - DNA, 14 bp, Homo sapiens
gttggcaggcccac

SEQ ID NO: 2247872 - DNA, 15 bp, Homo sapiens
gttggcaggcccact

SEQ ID NO: 2247873 - DNA, 18 bp, Homo sapiens
gttgggaggatacagagg

SEQ ID NO: 2247874 - DNA, 14 bp, Homo sapiens
gttgggcagccaga

SEQ ID NO: 2247875 - DNA, 18 bp, Homo sapiens
gttggtattaataaaaag

SEQ ID NO: 2247876 - DNA, 16 bp, Homo sapiens
tcaaactgcactttta

SEQ ID NO: 2247877 - DNA, 16 bp, Homo sapiens
tcaaactggggcctcc

SEQ ID NO: 2247878 - DNA, 15 bp, Homo sapiens
tcaaagaaatattaa

SEQ ID NO: 2247879 - DNA, 18 bp, Homo sapiens
tcaaagaagtcggaatgt

SEQ ID NO: 2247880 - DNA, 22 bp, Homo sapiens
tcaaatacatttaaaacattaa

SEQ ID NO: 2247881 - DNA, 18 bp, Homo sapiens
tcaaatatagagatattt

SEQ ID NO: 2247882 - DNA, 14 bp, Homo sapiens
tcaaatgaattctt

SEQ ID NO: 2247883 - DNA, 12 bp, Homo sapiens
tcaaattaataa

SEQ ID NO: 2247884 - DNA, 13 bp, Homo sapiens
tcaaattcaaata

SEQ ID NO: 2247885 - DNA, 18 bp, Homo sapiens
tcaacaataaaatttttt

SEQ ID NO: 2247886 - DNA, 17 bp, Homo sapiens
tcaacctcttctggctc

SEQ ID NO: 2247887 - DNA, 17 bp, Homo sapiens
tcaacctggtggcacca

SEQ ID NO: 2247888 - DNA, 15 bp, Homo sapiens
tcaacttaataagat

SEQ ID NO: 2247889 - DNA, 21 bp, Homo sapiens
tcaactttagtatttttacta

SEQ ID NO: 2247890 - DNA, 19 bp, Homo sapiens
tcaagaatagcattgtaaa

SEQ ID NO: 2247891 - DNA, 21 bp, Homo sapiens
tcaagagatctttctttccaa

SEQ ID NO: 2247892 - DNA, 17 bp, Homo sapiens
tcaagagcatgcacatg

SEQ ID NO: 2247893 - DNA, 19 bp, Homo sapiens
tcaagattttttttgtaac

SEQ ID NO: 2247894 - DNA, 23 bp, Homo sapiens
tcaagcagcgaccgccccctcct

SEQ ID NO: 2247895 - DNA, 13 bp, Homo sapiens
tcaagtcctctgg

SEQ ID NO: 2247896 - DNA, 16 bp, Homo sapiens
tcaagttgattagaaa

SEQ ID NO: 2247897 - DNA, 19 bp, Homo sapiens
tcaataaagcatttataaa

SEQ ID NO: 2247898 - DNA, 19 bp, Homo sapiens
tcaataatatattttctgt

SEQ ID NO: 2247899 - DNA, 13 bp, Homo sapiens
tcaatactacctc

SEQ ID NO: 2247900 - DNA, 14 bp, Homo sapiens
tcaatactacctct

SEQ ID NO: 2247901 - DNA, 16 bp, Homo sapiens
tcaatactacctctga

SEQ ID NO: 2247902 - DNA, 13 bp, Homo sapiens
tcaatatttaagt

SEQ ID NO: 2247903 - DNA, 14 bp, Homo sapiens
tcaatcacactaca

SEQ ID NO: 2247904 - DNA, 23 bp, Homo sapiens
tcaatcactgcactgcatgcaaa

SEQ ID NO: 2247905 - DNA, 14 bp, Homo sapiens
tcaatgtgtataaa

SEQ ID NO: 2247906 - DNA, 17 bp, Homo sapiens
tcaatgtgtctttctaa

SEQ ID NO: 2247907 - DNA, 20 bp, Homo sapiens
tcaatgtgtctttctaagaa

SEQ ID NO: 2247908 - DNA, 19 bp, Homo sapiens
tcaattagaatagtgttct

SEQ ID NO: 2247909 - DNA, 14 bp, Homo sapiens
tcaatttaagtgtt

SEQ ID NO: 2247910 - DNA, 21 bp, Homo sapiens
tcaatttaagtgttggaaaaa

SEQ ID NO: 2247911 - DNA, 19 bp, Homo sapiens
tcacaacttgatggctgcg

SEQ ID NO: 2247912 - DNA, 11 bp, Homo sapiens
tcacacttgtg

SEQ ID NO: 2247913 - DNA, 16 bp, Homo sapiens
tcacagcaatatttaa

SEQ ID NO: 2247914 - DNA, 11 bp, Homo sapiens
tcacagctcct

SEQ ID NO: 2247915 - DNA, 18 bp, Homo sapiens
tcacagtaaaaataaaat

SEQ ID NO: 2247916 - DNA, 12 bp, Homo sapiens
tcacagtcccag

SEQ ID NO: 2247917 - DNA, 15 bp, Homo sapiens
tcacatttttttcta

SEQ ID NO: 2247918 - DNA, 15 bp, Homo sapiens
tcaccagagacttta

SEQ ID NO: 2247919 - DNA, 18 bp, Homo sapiens
tcaccagctatctgtcat

SEQ ID NO: 2247920 - DNA, 14 bp, Homo sapiens
tcaccatctcttca

SEQ ID NO: 2247921 - DNA, 17 bp, Homo sapiens
tcaccccctcccacccc

SEQ ID NO: 2247922 - DNA, 20 bp, Homo sapiens
tcaccccctcccacccccag

SEQ ID NO: 2247923 - DNA, 19 bp, Homo sapiens
tcaccctaccaactttact

SEQ ID NO: 2247924 - DNA, 22 bp, Homo sapiens
tcaccgactgaaaatattgttt

SEQ ID NO: 2247925 - DNA, 15 bp, Homo sapiens
tcacctagaaattga

SEQ ID NO: 2247926 - DNA, 19 bp, Homo sapiens
tcacctcctctgtgatttc

SEQ ID NO: 2247927 - DNA, 12 bp, Homo sapiens
tcaccttctttg

SEQ ID NO: 2247928 - DNA, 15 bp, Homo sapiens
tcaccttctttgtaa

SEQ ID NO: 2247929 - DNA, 16 bp, Homo sapiens
tcaccttctttgtaat

SEQ ID NO: 2247930 - DNA, 17 bp, Homo sapiens
tcacgtttggtgcttct

SEQ ID NO: 2247931 - DNA, 21 bp, Homo sapiens
tcactaaagcatgaaatgtga

SEQ ID NO: 2247932 - DNA, 23 bp, Homo sapiens
tcactaattggtacttttaaaaa

SEQ ID NO: 2247933 - DNA, 22 bp, Homo sapiens
tcactatggtatgctggccagc

SEQ ID NO: 2247934 - DNA, 23 bp, Homo sapiens
tcactatggtatgctggccagca

SEQ ID NO: 2247935 - DNA, 16 bp, Homo sapiens
tcactcaccactacca

SEQ ID NO: 2247936 - DNA, 22 bp, Homo sapiens
tcactcaccactaccagccagc

SEQ ID NO: 2247937 - DNA, 13 bp, Homo sapiens
tcactcattgctg

SEQ ID NO: 2247938 - DNA, 20 bp, Homo sapiens
tcactcattgctgagcctct

SEQ ID NO: 2247939 - DNA, 18 bp, Homo sapiens
tcactctgtcagccagcc

SEQ ID NO: 2247940 - DNA, 18 bp, Homo sapiens
tcactgcactgcatgcaa

SEQ ID NO: 2247941 - DNA, 14 bp, Homo sapiens
tcactggggcagac

SEQ ID NO: 2247942 - DNA, 17 bp, Homo sapiens
tcactggggcctacagc

SEQ ID NO: 2247943 - DNA, 11 bp, Homo sapiens
tcactgtgctg

SEQ ID NO: 2247944 - DNA, 11 bp, Homo sapiens
tcactgttgtg

SEQ ID NO: 2247945 - DNA, 23 bp, Homo sapiens
tcactgtttcatctaagtgcctc

SEQ ID NO: 2247946 - DNA, 11 bp, Homo sapiens
tcacttttcct

SEQ ID NO: 2247947 - DNA, 14 bp, Homo sapiens
tcagaaggccccag

SEQ ID NO: 2247948 - DNA, 20 bp, Homo sapiens
tcagaaggccccagagagac

SEQ ID NO: 2247949 - DNA, 15 bp, Homo sapiens
tcagacatgttttcc

SEQ ID NO: 2247950 - DNA, 20 bp, Homo sapiens
tcagacatgttttccgtgaa

SEQ ID NO: 2247951 - DNA, 17 bp, Homo sapiens
tcagagcatttaaggaa

SEQ ID NO: 2247952 - DNA, 14 bp, Homo sapiens
tcagagcgcacagg

SEQ ID NO: 2247953 - DNA, 17 bp, Homo sapiens
tcagatgatctctccac

SEQ ID NO: 2247954 - DNA, 20 bp, Homo sapiens
tcagatgttaaaataaatgg

SEQ ID NO: 2247955 - DNA, 15 bp, Homo sapiens
tcagatttctgagga

SEQ ID NO: 2247956 - DNA, 22 bp, Homo sapiens
tcagcaaaaatctcccagtgac

SEQ ID NO: 2247957 - DNA, 19 bp, Homo sapiens
tcagcatatgtgtaaagat

SEQ ID NO: 2247958 - DNA, 17 bp, Homo sapiens
tcagccagccgccctgg

SEQ ID NO: 2247959 - DNA, 16 bp, Homo sapiens
tcagcccgcttggcca

SEQ ID NO: 2247960 - DNA, 16 bp, Homo sapiens
tcagctgtagtcctca

SEQ ID NO: 2247961 - DNA, 17 bp, Homo sapiens
tcaggaaatctacttcc

SEQ ID NO: 2247962 - DNA, 20 bp, Homo sapiens
tcagggaggtagtttcaaag

SEQ ID NO: 2247963 - DNA, 15 bp, Homo sapiens
tcaggtaatacaaac

SEQ ID NO: 2247964 - DNA, 21 bp, Homo sapiens
tcagtaaacgggaacatgccc

SEQ ID NO: 2247965 - DNA, 14 bp, Homo sapiens
tcagtactttttta

SEQ ID NO: 2247966 - DNA, 23 bp, Homo sapiens
tcagtaggtgcccagaataagtt

SEQ ID NO: 2247967 - DNA, 15 bp, Homo sapiens
tcagtataaacaaag

SEQ ID NO: 2247968 - DNA, 16 bp, Homo sapiens
tcagtttgtgtgtctt

SEQ ID NO: 2247969 - DNA, 20 bp, Homo sapiens
tcataaggttttattcatat

SEQ ID NO: 2247970 - DNA, 23 bp, Homo sapiens
tcatactgaaaaaaaaagcttgt

SEQ ID NO: 2247971 - DNA, 21 bp, Homo sapiens
tcataggcaccttttactgtg

SEQ ID NO: 2247972 - DNA, 22 bp, Homo sapiens
tcataggcaccttttactgtga

SEQ ID NO: 2247973 - DNA, 17 bp, Homo sapiens
tcatagtcttgaaatga

SEQ ID NO: 2247974 - DNA, 22 bp, Homo sapiens
tcatagtcttgaaatgaaaggg

SEQ ID NO: 2247975 - DNA, 21 bp, Homo sapiens
tcatagttctgagctgccagt

SEQ ID NO: 2247976 - DNA, 16 bp, Homo sapiens
tcatatgtaatctcta

SEQ ID NO: 2247977 - DNA, 22 bp, Homo sapiens
tcatatgtaatctctaggaagt

SEQ ID NO: 2247978 - DNA, 12 bp, Homo sapiens
tcatccacccca

SEQ ID NO: 2247979 - DNA, 22 bp, Homo sapiens
tcatccagtttgttctccgggt

SEQ ID NO: 2247980 - DNA, 19 bp, Homo sapiens
tcatcggaggctgggcccc

SEQ ID NO: 2247981 - DNA, 22 bp, Homo sapiens
tcatctcatttaagggaaaaat

SEQ ID NO: 2247982 - DNA, 21 bp, Homo sapiens
tcatctctctggggccctggg

SEQ ID NO: 2247983 - DNA, 15 bp, Homo sapiens
tcatctgaaatgtta

SEQ ID NO: 2247984 - DNA, 17 bp, Homo sapiens
tggagcatttctcatca

SEQ ID NO: 2247985 - DNA, 21 bp, Homo sapiens
tggagcgaagccttctgcagc

SEQ ID NO: 2247986 - DNA, 23 bp, Homo sapiens
tggaggtggaaaagcaacattca

SEQ ID NO: 2247987 - DNA, 20 bp, Homo sapiens
tggagtcccctcacctcctc

SEQ ID NO: 2247988 - DNA, 21 bp, Homo sapiens
tggagtcccctcacctcctct

SEQ ID NO: 2247989 - DNA, 13 bp, Homo sapiens
tggatgtcattgt

SEQ ID NO: 2247990 - DNA, 21 bp, Homo sapiens
tggattaaattagtttgtgaa

SEQ ID NO: 2247991 - DNA, 16 bp, Homo sapiens
tggcaaagcttttaga

SEQ ID NO: 2247992 - DNA, 18 bp, Homo sapiens
tggcaaagcttttagaaa

SEQ ID NO: 2247993 - DNA, 13 bp, Homo sapiens
tggcacacagcag

SEQ ID NO: 2247994 - DNA, 19 bp, Homo sapiens
tggcaccagatgcaacctc

SEQ ID NO: 2247995 - DNA, 20 bp, Homo sapiens
tggcaccagatgcaacctca

SEQ ID NO: 2247996 - DNA, 11 bp, Homo sapiens
tggcactttga

SEQ ID NO: 2247997 - DNA, 19 bp, Homo sapiens
tggcaggcacacagcagcc

SEQ ID NO: 2247998 - DNA, 13 bp, Homo sapiens
tggcaggcccact

SEQ ID NO: 2247999 - DNA, 16 bp, Homo sapiens
tggcaggcccactccc

SEQ ID NO: 2248000 - DNA, 22 bp, Homo sapiens
tggcaggcccactccccagccc

SEQ ID NO: 2248001 - DNA, 16 bp, Homo sapiens
tggcagggtccctcca

SEQ ID NO: 2248002 - DNA, 19 bp, Homo sapiens
tggcatgtaaatgtaaact

SEQ ID NO: 2248003 - DNA, 12 bp, Homo sapiens
tggccagcaccc

SEQ ID NO: 2248004 - DNA, 15 bp, Homo sapiens
tggccagctcataaa

SEQ ID NO: 2248005 - DNA, 12 bp, Homo sapiens
tggccaggagca

SEQ ID NO: 2248006 - DNA, 14 bp, Homo sapiens
tggccaggagcagg

SEQ ID NO: 2248007 - DNA, 14 bp, Homo sapiens
tggccatccctggg

SEQ ID NO: 2248008 - DNA, 23 bp, Homo sapiens
tggccatccctgggcccctccac

SEQ ID NO: 2248009 - DNA, 13 bp, Homo sapiens
tggccccagccct

SEQ ID NO: 2248010 - DNA, 19 bp, Homo sapiens
tggccccagccctgctggg

SEQ ID NO: 2248011 - DNA, 12 bp, Homo sapiens
tggcccctctga

SEQ ID NO: 2248012 - DNA, 16 bp, Homo sapiens
tggcccctctgacctg

SEQ ID NO: 2248013 - DNA, 13 bp, Homo sapiens
tggccctggggat

SEQ ID NO: 2248014 - DNA, 23 bp, Homo sapiens
tggccctggggatcttcccacag

SEQ ID NO: 2248015 - DNA, 21 bp, Homo sapiens
tggccgccccctgccccccag

SEQ ID NO: 2248016 - DNA, 12 bp, Homo sapiens
tggcctcagccc

SEQ ID NO: 2248017 - DNA, 16 bp, Homo sapiens
tggcctcagccctcag

SEQ ID NO: 2248018 - DNA, 14 bp, Homo sapiens
tggctaaccaagag

SEQ ID NO: 2248019 - DNA, 20 bp, Homo sapiens
tggctctgaggtgcctgtcc

SEQ ID NO: 2248020 - DNA, 22 bp, Homo sapiens
tggctctgaggtgcctgtccca

SEQ ID NO: 2248021 - DNA, 18 bp, Homo sapiens
tggctctgccccctcccc

SEQ ID NO: 2248022 - DNA, 19 bp, Homo sapiens
tggctctgccccctccccc

SEQ ID NO: 2248023 - DNA, 21 bp, Homo sapiens
tggctcttgatacccccctct

SEQ ID NO: 2248024 - DNA, 13 bp, Homo sapiens
tggctgctaacaa

SEQ ID NO: 2248025 - DNA, 14 bp, Homo sapiens
tggctggtgggccc

SEQ ID NO: 2248026 - DNA, 16 bp, Homo sapiens
tggctgtaatcatttg

SEQ ID NO: 2248027 - DNA, 15 bp, Homo sapiens
tggcttaatcatttt

SEQ ID NO: 2248028 - DNA, 16 bp, Homo sapiens
tggcttcggacaaaat

SEQ ID NO: 2248029 - DNA, 21 bp, Homo sapiens
tggctttcagagccagcctgg

SEQ ID NO: 2248030 - DNA, 17 bp, Homo sapiens
tggcttttattaatgca

SEQ ID NO: 2248031 - DNA, 12 bp, Homo sapiens
tgggaatgggag

SEQ ID NO: 2248032 - DNA, 17 bp, Homo sapiens
tgggactgctaaataaa

SEQ ID NO: 2248033 - DNA, 18 bp, Homo sapiens
tgggactgctaaataaaa

SEQ ID NO: 2248034 - DNA, 15 bp, Homo sapiens
tgggatgggaccagg

SEQ ID NO: 2248035 - DNA, 15 bp, Homo sapiens
tgggcagcaccctcc

SEQ ID NO: 2248036 - DNA, 17 bp, Homo sapiens
tgggcagcaccctcccc

SEQ ID NO: 2248037 - DNA, 15 bp, Homo sapiens
tgggcatttggtgag

SEQ ID NO: 2248038 - DNA, 16 bp, Homo sapiens
tgggcatttggtgaga

SEQ ID NO: 2248039 - DNA, 17 bp, Homo sapiens
tgggcatttggtgagag

SEQ ID NO: 2248040 - DNA, 19 bp, Homo sapiens
tgggccaggatccccctct

SEQ ID NO: 2248041 - DNA, 24 bp, Homo sapiens
tgggccatgtccaaagaggctgcc

SEQ ID NO: 2248042 - DNA, 23 bp, Homo sapiens
tgggcccctccacgcctcctggc

SEQ ID NO: 2248043 - DNA, 13 bp, Homo sapiens
tgggcccctggga

SEQ ID NO: 2248044 - DNA, 16 bp, Homo sapiens
tgggctcactgtgctg

SEQ ID NO: 2248045 - DNA, 21 bp, Homo sapiens
tgggctcgccgtgtctcagcc

SEQ ID NO: 2248046 - DNA, 22 bp, Homo sapiens
tgggctctgcaattcccctctg

SEQ ID NO: 2248047 - DNA, 18 bp, Homo sapiens
tggggagcccgtctcagt

SEQ ID NO: 2248048 - DNA, 19 bp, Homo sapiens
tggggagcccgtctcagtg

SEQ ID NO: 2248049 - DNA, 18 bp, Homo sapiens
tggggatccccgcctggc

SEQ ID NO: 2248050 - DNA, 21 bp, Homo sapiens
tggggatcttcccacaggagg

SEQ ID NO: 2248051 - DNA, 15 bp, Homo sapiens
tggggcaggctgggc

SEQ ID NO: 2248052 - DNA, 16 bp, Homo sapiens
tggggcaggctgggcc

SEQ ID NO: 2248053 - DNA, 20 bp, Homo sapiens
tggggcaggctgggccatgt

SEQ ID NO: 2248054 - DNA, 19 bp, Homo sapiens
tggggccctgggcctcagt

SEQ ID NO: 2248055 - DNA, 14 bp, Homo sapiens
tggggcctccagaa

SEQ ID NO: 2248056 - DNA, 20 bp, Homo sapiens
tggggcctccagaactcact

SEQ ID NO: 2248057 - DNA, 16 bp, Homo sapiens
tgggggacgagggcca

SEQ ID NO: 2248058 - DNA, 21 bp, Homo sapiens
tgggggagtagatctttctag

SEQ ID NO: 2248059 - DNA, 14 bp, Homo sapiens
tggggggccgggca

SEQ ID NO: 2248060 - DNA, 16 bp, Homo sapiens
tgggggtggcaggcac

SEQ ID NO: 2248061 - DNA, 14 bp, Homo sapiens
tgggggtggccatc

SEQ ID NO: 2248062 - DNA, 19 bp, Homo sapiens
tgggggtggccatccctgg

SEQ ID NO: 2248063 - DNA, 14 bp, Homo sapiens
tggggtctgacccc

SEQ ID NO: 2248064 - DNA, 14 bp, Homo sapiens
tggggtggggtggg

SEQ ID NO: 2248065 - DNA, 22 bp, Homo sapiens
tgggtggtaccctctggagggg

SEQ ID NO: 2248066 - DNA, 15 bp, Homo sapiens
tgggtgttcctggca

SEQ ID NO: 2248067 - DNA, 15 bp, Homo sapiens
tgggttgtcaccaag

SEQ ID NO: 2248068 - DNA, 17 bp, Homo sapiens
tggtaaagactggcttt

SEQ ID NO: 2248069 - DNA, 13 bp, Homo sapiens
tggtaatatacaa

SEQ ID NO: 2248070 - DNA, 17 bp, Homo sapiens
tggtagcagcaggctca

SEQ ID NO: 2248071 - DNA, 14 bp, Homo sapiens
tggtatcaaaatta

SEQ ID NO: 2248072 - DNA, 16 bp, Homo sapiens
tggtatgctggccagc

SEQ ID NO: 2248073 - DNA, 17 bp, Homo sapiens
tggtatgctggccagca

SEQ ID NO: 2248074 - DNA, 18 bp, Homo sapiens
tggtatgctggccagcac

SEQ ID NO: 2248075 - DNA, 21 bp, Homo sapiens
tggtatgctggccagcaccct

SEQ ID NO: 2248076 - DNA, 16 bp, Homo sapiens
tggtattaataaaaag

SEQ ID NO: 2248077 - DNA, 20 bp, Homo sapiens
tggtcacgtttggtgcttct

SEQ ID NO: 2248078 - DNA, 13 bp, Homo sapiens
tggtgactgtccc

SEQ ID NO: 2248079 - DNA, 19 bp, Homo sapiens
tggtgactgtcccaccggg

SEQ ID NO: 2248080 - DNA, 19 bp, Homo sapiens
tggtgagagtcaaagctga

SEQ ID NO: 2248081 - DNA, 13 bp, Homo sapiens
tggtgcatgggct

SEQ ID NO: 2248082 - DNA, 15 bp, Homo sapiens
tggtggcacaggccc

SEQ ID NO: 2248083 - DNA, 17 bp, Homo sapiens
tggtggcagagtcctgg

SEQ ID NO: 2248084 - DNA, 22 bp, Homo sapiens
tggttgaccaaggtgcttttct

SEQ ID NO: 2248085 - DNA, 17 bp, Homo sapiens
tgtaaaagcattttgta

SEQ ID NO: 2248086 - DNA, 21 bp, Homo sapiens
tgtaaatcatgttgatcatgt

SEQ ID NO: 2248087 - DNA, 17 bp, Homo sapiens
tgtaaattgaatcagta

SEQ ID NO: 2248088 - DNA, 18 bp, Homo sapiens
tgtaacactgtgtacacc

SEQ ID NO: 2248089 - DNA, 21 bp, Homo sapiens
tgtaacactgtgtacacctca

SEQ ID NO: 2248090 - DNA, 23 bp, Homo sapiens
tgtaactaaaataattttgtaat

SEQ ID NO: 2248091 - DNA, 22 bp, Homo sapiens
tgtaagcatactttgtaaatag

SEQ ID NO: 2248092 - DNA, 17 bp, Homo sapiens
ttacatacttttgcaaa

SEQ ID NO: 2248093 - DNA, 19 bp, Homo sapiens
ttacatgctgctatacaca

SEQ ID NO: 2248094 - DNA, 16 bp, Homo sapiens
ttacatgtaatttgat

SEQ ID NO: 2248095 - DNA, 15 bp, Homo sapiens
ttacatgtatgcctg

SEQ ID NO: 2248096 - DNA, 16 bp, Homo sapiens
ttacatgtttataaat

SEQ ID NO: 2248097 - DNA, 16 bp, Homo sapiens
ttacattgttcaatta

SEQ ID NO: 2248098 - DNA, 10 bp, Homo sapiens
ttacatttca

SEQ ID NO: 2248099 - DNA, 20 bp, Homo sapiens
ttaccaaagcatcaatacaa

SEQ ID NO: 2248100 - DNA, 21 bp, Homo sapiens
ttacccagtgggacagaggag

SEQ ID NO: 2248101 - DNA, 21 bp, Homo sapiens
ttaccttgaaaaaaagaaaag

SEQ ID NO: 2248102 - DNA, 15 bp, Homo sapiens
ttacgtgctctgtgg

SEQ ID NO: 2248103 - DNA, 16 bp, Homo sapiens
ttactaggtaacttca

SEQ ID NO: 2248104 - DNA, 17 bp, Homo sapiens
ttactaggtaacttcat

SEQ ID NO: 2248105 - DNA, 16 bp, Homo sapiens
ttactggataaattgt

SEQ ID NO: 2248106 - DNA, 23 bp, Homo sapiens
ttactgtcaaggctgcttagaat

SEQ ID NO: 2248107 - DNA, 16 bp, Homo sapiens
ttactgtgtaaactca

SEQ ID NO: 2248108 - DNA, 15 bp, Homo sapiens
ttacttgaactttcc

SEQ ID NO: 2248109 - DNA, 17 bp, Homo sapiens
ttacttgaactttccaa

SEQ ID NO: 2248110 - DNA, 23 bp, Homo sapiens
ttagaaaagggagtttaaaaatg

SEQ ID NO: 2248111 - DNA, 20 bp, Homo sapiens
ttagaaacctcattggccag

SEQ ID NO: 2248112 - DNA, 12 bp, Homo sapiens
ttagaacatttt

SEQ ID NO: 2248113 - DNA, 20 bp, Homo sapiens
ttagaaccagccgtatttta

SEQ ID NO: 2248114 - DNA, 17 bp, Homo sapiens
ttagaatcttttaaata

SEQ ID NO: 2248115 - DNA, 13 bp, Homo sapiens
ttagaattaaaaa

SEQ ID NO: 2248116 - DNA, 17 bp, Homo sapiens
ttagaattaaaaaagca

SEQ ID NO: 2248117 - DNA, 19 bp, Homo sapiens
ttagaccagaggtctagat

SEQ ID NO: 2248118 - DNA, 19 bp, Homo sapiens
ttagattaagaaatagaca

SEQ ID NO: 2248119 - DNA, 12 bp, Homo sapiens
ttagcagagtct

SEQ ID NO: 2248120 - DNA, 18 bp, Homo sapiens
ttagcagagtctgtctct

SEQ ID NO: 2248121 - DNA, 17 bp, Homo sapiens
ttagccagatttgtctt

SEQ ID NO: 2248122 - DNA, 16 bp, Homo sapiens
ttaggccttcctctct

SEQ ID NO: 2248123 - DNA, 15 bp, Homo sapiens
ttaggcttaaaaact

SEQ ID NO: 2248124 - DNA, 17 bp, Homo sapiens
ttaggtagcaacaacag

SEQ ID NO: 2248125 - DNA, 24 bp, Homo sapiens
ttagtaacatgaggggacattttg

SEQ ID NO: 2248126 - DNA, 14 bp, Homo sapiens
ttagtatttttact

SEQ ID NO: 2248127 - DNA, 16 bp, Homo sapiens
ttagtcaatcactgca

SEQ ID NO: 2248128 - DNA, 12 bp, Homo sapiens
ttagtctcagtt

SEQ ID NO: 2248129 - DNA, 12 bp, Homo sapiens
ttataaaacttc

SEQ ID NO: 2248130 - DNA, 13 bp, Homo sapiens
ttataaaacttct

SEQ ID NO: 2248131 - DNA, 18 bp, Homo sapiens
ttataaaatcctgtgcaa

SEQ ID NO: 2248132 - DNA, 20 bp, Homo sapiens
ttataaaatggctgtaatca

SEQ ID NO: 2248133 - DNA, 21 bp, Homo sapiens
ttataatataatatggaacct

SEQ ID NO: 2248134 - DNA, 23 bp, Homo sapiens
ttatactactttgttaggatttt

SEQ ID NO: 2248135 - DNA, 16 bp, Homo sapiens
ttatataaagtattct

SEQ ID NO: 2248136 - DNA, 18 bp, Homo sapiens
ttatataaagtattcttt

SEQ ID NO: 2248137 - DNA, 15 bp, Homo sapiens
ttatatatatagttt

SEQ ID NO: 2248138 - DNA, 13 bp, Homo sapiens
ttatatattgtat

SEQ ID NO: 2248139 - DNA, 16 bp, Homo sapiens
ttatatgaagataagt

SEQ ID NO: 2248140 - DNA, 18 bp, Homo sapiens
ttatcattcaagtgtaaa

SEQ ID NO: 2248141 - DNA, 18 bp, Homo sapiens
ttatccagaaaactgtga

SEQ ID NO: 2248142 - DNA, 14 bp, Homo sapiens
ttatcctctttgta

SEQ ID NO: 2248143 - DNA, 15 bp, Homo sapiens
ttatcctctttgtaa

SEQ ID NO: 2248144 - DNA, 16 bp, Homo sapiens
ttatcctctttgtaat

SEQ ID NO: 2248145 - DNA, 21 bp, Homo sapiens
ttatctaaaagaaatgtctat

SEQ ID NO: 2248146 - DNA, 15 bp, Homo sapiens
ttatctatataaaat

SEQ ID NO: 2248147 - DNA, 22 bp, Homo sapiens
ttatctcagatgttaaaataaa

SEQ ID NO: 2248148 - DNA, 12 bp, Homo sapiens
ttatctctgtgt

SEQ ID NO: 2248149 - DNA, 19 bp, Homo sapiens
ttatgaaattcaccccctt

SEQ ID NO: 2248150 - DNA, 13 bp, Homo sapiens
ttatgtagagttt

SEQ ID NO: 2248151 - DNA, 22 bp, Homo sapiens
ttatgttttttaaaatatttat

SEQ ID NO: 2248152 - DNA, 15 bp, Homo sapiens
ttattacatgtaatt

SEQ ID NO: 2248153 - DNA, 22 bp, Homo sapiens
ttattaccccctccttcagaca

SEQ ID NO: 2248154 - DNA, 18 bp, Homo sapiens
ttattagggagaaaattc

SEQ ID NO: 2248155 - DNA, 22 bp, Homo sapiens
ttattagttccccaaatacaaa

SEQ ID NO: 2248156 - DNA, 20 bp, Homo sapiens
ttattccaaaccaaatttta

SEQ ID NO: 2248157 - DNA, 22 bp, Homo sapiens
ttattctgggcaccacaaaata

SEQ ID NO: 2248158 - DNA, 16 bp, Homo sapiens
ttattgcagtttatca

SEQ ID NO: 2248159 - DNA, 18 bp, Homo sapiens
ttattgcagtttatcatt

SEQ ID NO: 2248160 - DNA, 14 bp, Homo sapiens
ttattgttaataca

SEQ ID NO: 2248161 - DNA, 13 bp, Homo sapiens
ttatttaacagct

SEQ ID NO: 2248162 - DNA, 15 bp, Homo sapiens
ttatttacagatgaa

SEQ ID NO: 2248163 - DNA, 23 bp, Homo sapiens
ttatttatccagaaaactgtgat

SEQ ID NO: 2248164 - DNA, 22 bp, Homo sapiens
ttatttatgcgtaatttaatgg

SEQ ID NO: 2248165 - DNA, 14 bp, Homo sapiens
ttatttcatccagt

SEQ ID NO: 2248166 - DNA, 21 bp, Homo sapiens
ttatttctaaatgagacgaaa

SEQ ID NO: 2248167 - DNA, 20 bp, Homo sapiens
ttatttgaacaatgaagttg

SEQ ID NO: 2248168 - DNA, 22 bp, Homo sapiens
ttatttgtgttttaatttaaac

SEQ ID NO: 2248169 - DNA, 21 bp, Homo sapiens
ttattttgagatgtaaaaaga

SEQ ID NO: 2248170 - DNA, 13 bp, Homo sapiens
ttattttgatgta

SEQ ID NO: 2248171 - DNA, 16 bp, Homo sapiens
ttattttgatgtaaag

SEQ ID NO: 2248172 - DNA, 21 bp, Homo sapiens
ttattttggagattataataa

SEQ ID NO: 2248173 - DNA, 22 bp, Homo sapiens
ttcaaaaagggaagtaagcaaa

SEQ ID NO: 2248174 - DNA, 16 bp, Homo sapiens
ttcaaactgcactttt

SEQ ID NO: 2248175 - DNA, 15 bp, Homo sapiens
ttcaaactggggcct

SEQ ID NO: 2248176 - DNA, 23 bp, Homo sapiens
ttcaaaggccacatacctctctg

SEQ ID NO: 2248177 - DNA, 13 bp, Homo sapiens
ttcaaatgcattt

SEQ ID NO: 2248178 - DNA, 19 bp, Homo sapiens
ttcaacctggtggcaccag

SEQ ID NO: 2248179 - DNA, 14 bp, Homo sapiens
ttcaagttcaatcc

SEQ ID NO: 2248180 - DNA, 16 bp, Homo sapiens
ttcacaattattccaa

SEQ ID NO: 2248181 - DNA, 12 bp, Homo sapiens
ttcacacatgcc

SEQ ID NO: 2248182 - DNA, 13 bp, Homo sapiens
ttcacagctcctc

SEQ ID NO: 2248183 - DNA, 19 bp, Homo sapiens
ttcagcaagttagaactag

SEQ ID NO: 2248184 - DNA, 11 bp, Homo sapiens
ttcagcatttg

SEQ ID NO: 2248185 - DNA, 22 bp, Homo sapiens
ttcaggaagggatgcaggctcc

SEQ ID NO: 2248186 - DNA, 16 bp, Homo sapiens
ttcaggcatattttaa

SEQ ID NO: 2248187 - DNA, 22 bp, Homo sapiens
ttcaggtaaagggcaaataatg

SEQ ID NO: 2248188 - DNA, 23 bp, Homo sapiens
ttcaggtgtagtagttctgtgtt

SEQ ID NO: 2248189 - DNA, 11 bp, Homo sapiens
ttcataaacaa

SEQ ID NO: 2248190 - DNA, 15 bp, Homo sapiens
ttcataaacaagttc

SEQ ID NO: 2248191 - DNA, 17 bp, Homo sapiens
ttcatagtaagattgat

SEQ ID NO: 2248192 - DNA, 13 bp, Homo sapiens
ttcatatgtaatc

SEQ ID NO: 2248193 - DNA, 18 bp, Homo sapiens
ttcatattgctgagagaa

SEQ ID NO: 2248194 - DNA, 22 bp, Homo sapiens
ttcatattttaaacagaggata

SEQ ID NO: 2248195 - DNA, 12 bp, Homo sapiens
ttcatctcattt

SEQ ID NO: 2248196 - DNA, 16 bp, Homo sapiens
ttcatctgtctatatt

SEQ ID NO: 2248197 - DNA, 15 bp, Homo sapiens
ttcatgggctgtgtg

SEQ ID NO: 2248198 - DNA, 16 bp, Homo sapiens
ttcatgtaaagtgtca

SEQ ID NO: 2248199 - DNA, 15 bp, Homo sapiens
ttcatgtattttaca

SEQ ID NO: 2248200 - DNA, 16 bp, Homo sapiens
ttcattcctaaagaaa

SEQ ID NO: 2248201 - DNA, 13 bp, Homo sapiens
tttttatttctaa

SEQ ID NO: 2248202 - DNA, 17 bp, Homo sapiens
tttttcagtgttaaggt

SEQ ID NO: 2248203 - DNA, 18 bp, Homo sapiens
tttttcattttaaaaagt

SEQ ID NO: 2248204 - DNA, 15 bp, Homo sapiens
tttttccttaatcca

SEQ ID NO: 2248205 - DNA, 20 bp, Homo sapiens
tttttccttaatccagctga

SEQ ID NO: 2248206 - DNA, 12 bp, Homo sapiens
tttttgtacact

SEQ ID NO: 2248207 - DNA, 17 bp, Homo sapiens
tttttgtgggagataaa

SEQ ID NO: 2248208 - DNA, 12 bp, Homo sapiens
tttttttcagtg

SEQ ID NO: 2248209 - DNA, 14 bp, Homo sapiens
tttttttgttatta

SEQ ID NO: 2248210 - DNA, 21 bp, Homo sapiens
acttttgcaaaataagtaaat

SEQ ID NO: 2248211 - DNA, 15 bp, Homo sapiens
actttttagtaattt

SEQ ID NO: 2248212 - DNA, 16 bp, Homo sapiens
acttttttaaatattt

SEQ ID NO: 2248213 - DNA, 18 bp, Homo sapiens
acttttttaaatattttc

SEQ ID NO: 2248214 - DNA, 16 bp, Homo sapiens
agaaaaaaacttactg

SEQ ID NO: 2248215 - DNA, 20 bp, Homo sapiens
agaaaaaaagaaaagaaaaa

SEQ ID NO: 2248216 - DNA, 16 bp, Homo sapiens
agaaaactgtgatttc

SEQ ID NO: 2248217 - DNA, 15 bp, Homo sapiens
agaaaagattttaat

SEQ ID NO: 2248218 - DNA, 21 bp, Homo sapiens
agaaaaggttatgttcatttt

SEQ ID NO: 2248219 - DNA, 23 bp, Homo sapiens
agaaaatgcttgacaaatatttt

SEQ ID NO: 2248220 - DNA, 13 bp, Homo sapiens
agaaaatgttatt

SEQ ID NO: 2248221 - DNA, 19 bp, Homo sapiens
agaaaatgttatttaacag

SEQ ID NO: 2248222 - DNA, 13 bp, Homo sapiens
agaaaattcaatt

SEQ ID NO: 2248223 - DNA, 23 bp, Homo sapiens
agaaaggaaatgagatgacagta

SEQ ID NO: 2248224 - DNA, 18 bp, Homo sapiens
agaaataaagtttgctta

SEQ ID NO: 2248225 - DNA, 15 bp, Homo sapiens
agaaatgcttagaaa

SEQ ID NO: 2248226 - DNA, 16 bp, Homo sapiens
agaacattttaattca

SEQ ID NO: 2248227 - DNA, 19 bp, Homo sapiens
agaactagccaaaccagga

SEQ ID NO: 2248228 - DNA, 16 bp, Homo sapiens
agaactcactggggcc

SEQ ID NO: 2248229 - DNA, 19 bp, Homo sapiens
agaactcactggggcctac

SEQ ID NO: 2248230 - DNA, 17 bp, Homo sapiens
agaactcattcatagga

SEQ ID NO: 2248231 - DNA, 19 bp, Homo sapiens
agaactgtgtttcaagttc

SEQ ID NO: 2248232 - DNA, 14 bp, Homo sapiens
agaagaaataaata

SEQ ID NO: 2248233 - DNA, 23 bp, Homo sapiens
agaagcagttgtaccaagtgaaa

SEQ ID NO: 2248234 - DNA, 19 bp, Homo sapiens
agaagctctgaagaactct

SEQ ID NO: 2248235 - DNA, 15 bp, Homo sapiens
agaagctttatttct

SEQ ID NO: 2248236 - DNA, 17 bp, Homo sapiens
agaaggccccagagaga

SEQ ID NO: 2248237 - DNA, 16 bp, Homo sapiens
agaaggtttattgtta

SEQ ID NO: 2248238 - DNA, 18 bp, Homo sapiens
agaaggtttattgttaat

SEQ ID NO: 2248239 - DNA, 14 bp, Homo sapiens
agaagtcggaatgt

SEQ ID NO: 2248240 - DNA, 12 bp, Homo sapiens
agaataagttat

SEQ ID NO: 2248241 - DNA, 13 bp, Homo sapiens
agaataagttatt

SEQ ID NO: 2248242 - DNA, 19 bp, Homo sapiens
agaataagttattgcagtt

SEQ ID NO: 2248243 - DNA, 21 bp, Homo sapiens
agaataagttattgcagttta

SEQ ID NO: 2248244 - DNA, 20 bp, Homo sapiens
agaataggcagggggccctg

SEQ ID NO: 2248245 - DNA, 16 bp, Homo sapiens
agaatatgacttttta

SEQ ID NO: 2248246 - DNA, 12 bp, Homo sapiens
agaatcttttaa

SEQ ID NO: 2248247 - DNA, 13 bp, Homo sapiens
agaatcttttaaa

SEQ ID NO: 2248248 - DNA, 22 bp, Homo sapiens
agaatgctgcaggacttgagaa

SEQ ID NO: 2248249 - DNA, 16 bp, Homo sapiens
agaatgtgtctcagga

SEQ ID NO: 2248250 - DNA, 12 bp, Homo sapiens
agaattaaaact

SEQ ID NO: 2248251 - DNA, 19 bp, Homo sapiens
agacaacaggtaaaacagg

SEQ ID NO: 2248252 - DNA, 14 bp, Homo sapiens
agacaaccttgtcc

SEQ ID NO: 2248253 - DNA, 20 bp, Homo sapiens
agacaaccttgtcccaagga

SEQ ID NO: 2248254 - DNA, 12 bp, Homo sapiens
agacaataaacc

SEQ ID NO: 2248255 - DNA, 17 bp, Homo sapiens
agacaataaaccctcag

SEQ ID NO: 2248256 - DNA, 13 bp, Homo sapiens
agacactggcccc

SEQ ID NO: 2248257 - DNA, 15 bp, Homo sapiens
agacactggcccctc

SEQ ID NO: 2248258 - DNA, 14 bp, Homo sapiens
agacagactagaag

SEQ ID NO: 2248259 - DNA, 17 bp, Homo sapiens
agacagcccaggatact

SEQ ID NO: 2248260 - DNA, 16 bp, Homo sapiens
agacatgaaataaaag

SEQ ID NO: 2248261 - DNA, 19 bp, Homo sapiens
agacatgaattttaaataa

SEQ ID NO: 2248262 - DNA, 21 bp, Homo sapiens
agacatgggatccaattttaa

SEQ ID NO: 2248263 - DNA, 21 bp, Homo sapiens
agacatttgatagaaaggaac

SEQ ID NO: 2248264 - DNA, 19 bp, Homo sapiens
agacattttaaaaaatggt

SEQ ID NO: 2248265 - DNA, 20 bp, Homo sapiens
agacattttaaaaaatggtc

SEQ ID NO: 2248266 - DNA, 16 bp, Homo sapiens
agaccaccacttcgaa

SEQ ID NO: 2248267 - DNA, 18 bp, Homo sapiens
agaccagattaaacttca

SEQ ID NO: 2248268 - DNA, 13 bp, Homo sapiens
agacccccatcca

SEQ ID NO: 2248269 - DNA, 20 bp, Homo sapiens
agacccccatccagcctcca

SEQ ID NO: 2248270 - DNA, 21 bp, Homo sapiens
agacccccatccagcctccag

SEQ ID NO: 2248271 - DNA, 15 bp, Homo sapiens
agacctgaattcttt

SEQ ID NO: 2248272 - DNA, 13 bp, Homo sapiens
agacgatatactc

SEQ ID NO: 2248273 - DNA, 17 bp, Homo sapiens
agacggaggaggggaag

SEQ ID NO: 2248274 - DNA, 17 bp, Homo sapiens
agacgtgaatgtctcag

SEQ ID NO: 2248275 - DNA, 18 bp, Homo sapiens
agacgtgaatgtctcagc

SEQ ID NO: 2248276 - DNA, 19 bp, Homo sapiens
agacgtgaatgtctcagcg

SEQ ID NO: 2248277 - DNA, 16 bp, Homo sapiens
agacgtttaactgcag

SEQ ID NO: 2248278 - DNA, 11 bp, Homo sapiens
agactggcttt

SEQ ID NO: 2248279 - DNA, 22 bp, Homo sapiens
agactggcttttattaatgcac

SEQ ID NO: 2248280 - DNA, 16 bp, Homo sapiens
agacttcaaaaggaat

SEQ ID NO: 2248281 - DNA, 21 bp, Homo sapiens
agacttcaaaaggaatgaact

SEQ ID NO: 2248282 - DNA, 14 bp, Homo sapiens
agagaaaaaagcca

SEQ ID NO: 2248283 - DNA, 20 bp, Homo sapiens
agagaaaaagcagaggccaa

SEQ ID NO: 2248284 - DNA, 13 bp, Homo sapiens
agagaaccaggct

SEQ ID NO: 2248285 - DNA, 12 bp, Homo sapiens
agagaattaaaa

SEQ ID NO: 2248286 - DNA, 15 bp, Homo sapiens
agagacagcccagga

SEQ ID NO: 2248287 - DNA, 14 bp, Homo sapiens
agagagccaagacg

SEQ ID NO: 2248288 - DNA, 17 bp, Homo sapiens
agagagccaagacggag

SEQ ID NO: 2248289 - DNA, 21 bp, Homo sapiens
agagagccaagacggaggagg

SEQ ID NO: 2248290 - DNA, 21 bp, Homo sapiens
agagaggtggggatcctgcct

SEQ ID NO: 2248291 - DNA, 19 bp, Homo sapiens
agagcatctgcaacaaaaa

SEQ ID NO: 2248292 - DNA, 18 bp, Homo sapiens
agagcatttaaggaaact

SEQ ID NO: 2248293 - DNA, 18 bp, Homo sapiens
agagccaagacggaggag

SEQ ID NO: 2248294 - DNA, 21 bp, Homo sapiens
agagccaagacggaggagggg

SEQ ID NO: 2248295 - DNA, 14 bp, Homo sapiens
agagccagcctggc

SEQ ID NO: 2248296 - DNA, 21 bp, Homo sapiens
agagccagcctggctctgccc

SEQ ID NO: 2248297 - DNA, 20 bp, Homo sapiens
agagccctcaactattctgt

SEQ ID NO: 2248298 - DNA, 21 bp, Homo sapiens
agagcctcccaccagagccgg

SEQ ID NO: 2248299 - DNA, 23 bp, Homo sapiens
agagcctcccaccagagccggga

SEQ ID NO: 2248300 - DNA, 14 bp, Homo sapiens
agagcgcacaggga

SEQ ID NO: 2248301 - DNA, 23 bp, Homo sapiens
agagcttgttgtctccacttgta

SEQ ID NO: 2248302 - DNA, 21 bp, Homo sapiens
agaggaataaggcccagagcg

SEQ ID NO: 2248303 - DNA, 14 bp, Homo sapiens
agaggctgcccctc

SEQ ID NO: 2248304 - DNA, 20 bp, Homo sapiens
agaggctgcccctctcacca

SEQ ID NO: 2248305 - DNA, 14 bp, Homo sapiens
agagtctgtctctt

SEQ ID NO: 2248306 - DNA, 17 bp, Homo sapiens
agagtttttatgccttt

SEQ ID NO: 2248307 - DNA, 22 bp, Homo sapiens
agataaattttataggactgtt

SEQ ID NO: 2248308 - DNA, 18 bp, Homo sapiens
agataagtgtatttttca

SEQ ID NO: 2248309 - DNA, 20 bp, Homo sapiens
agataagtgtatttttcaat

SEQ ID NO: 2248310 - DNA, 16 bp, Homo sapiens
agatcattttgaaatt

SEQ ID NO: 2248311 - DNA, 15 bp, Homo sapiens
agatgatctctccac

SEQ ID NO: 2248312 - DNA, 22 bp, Homo sapiens
agatgccacttctcactcacca

SEQ ID NO: 2248313 - DNA, 22 bp, Homo sapiens
agatggactaattgacttgcaa

SEQ ID NO: 2248314 - DNA, 15 bp, Homo sapiens
agatgtaattttgtg

SEQ ID NO: 2248315 - DNA, 17 bp, Homo sapiens
agatgtaattttgtgta

SEQ ID NO: 2248316 - DNA, 14 bp, Homo sapiens
agatgttaaaataa

SEQ ID NO: 2248317 - DNA, 15 bp, Homo sapiens
agatgttagatattt

SEQ ID NO: 2248318 - DNA, 13 bp, Homo sapiens
atatcaaaacaag

SEQ ID NO: 2248319 - DNA, 23 bp, Homo sapiens
atatctataaaatagatataaat

SEQ ID NO: 2248320 - DNA, 14 bp, Homo sapiens
atatctatctattt

SEQ ID NO: 2248321 - DNA, 16 bp, Homo sapiens
atatctatctatttga

SEQ ID NO: 2248322 - DNA, 15 bp, Homo sapiens
atatgactttttata

SEQ ID NO: 2248323 - DNA, 16 bp, Homo sapiens
atatgatctgtctgtg

SEQ ID NO: 2248324 - DNA, 19 bp, Homo sapiens
atatgcttgtaactaaaat

SEQ ID NO: 2248325 - DNA, 16 bp, Homo sapiens
atatggaaccttccct

SEQ ID NO: 2248326 - DNA, 19 bp, Homo sapiens
atatggaaccttccctcca

SEQ ID NO: 2248327 - DNA, 14 bp, Homo sapiens
atatggatcagagg

SEQ ID NO: 2248328 - DNA, 17 bp, Homo sapiens
atatgtgttacttcaag

SEQ ID NO: 2248329 - DNA, 16 bp, Homo sapiens
atattacaatgatcac

SEQ ID NO: 2248330 - DNA, 15 bp, Homo sapiens
atatttatttcagat

SEQ ID NO: 2248331 - DNA, 23 bp, Homo sapiens
atatttgcagtttttcattttaa

SEQ ID NO: 2248332 - DNA, 15 bp, Homo sapiens
atattttatataaag

SEQ ID NO: 2248333 - DNA, 13 bp, Homo sapiens
atattttctattt

SEQ ID NO: 2248334 - DNA, 14 bp, Homo sapiens
atattttctatttt

SEQ ID NO: 2248335 - DNA, 14 bp, Homo sapiens
atattttgaatcaa

SEQ ID NO: 2248336 - DNA, 19 bp, Homo sapiens
atattttgaatcaataata

SEQ ID NO: 2248337 - DNA, 13 bp, Homo sapiens
atattttgttacc

SEQ ID NO: 2248338 - DNA, 22 bp, Homo sapiens
atatttttatctatataaaata

SEQ ID NO: 2248339 - DNA, 17 bp, Homo sapiens
atatttttcataaacaa

SEQ ID NO: 2248340 - DNA, 22 bp, Homo sapiens
atcaaaaatatgtgtttttaag

SEQ ID NO: 2248341 - DNA, 20 bp, Homo sapiens
atcaaaacacactactacct

SEQ ID NO: 2248342 - DNA, 20 bp, Homo sapiens
atcaaagggataaagaaaaa

SEQ ID NO: 2248343 - DNA, 17 bp, Homo sapiens
atcaagtaatacaaact

SEQ ID NO: 2248344 - DNA, 15 bp, Homo sapiens
atcaagttgaattga

SEQ ID NO: 2248345 - DNA, 12 bp, Homo sapiens
atcaatttaagt

SEQ ID NO: 2248346 - DNA, 22 bp, Homo sapiens
atcacacaagatttgactgtaa

SEQ ID NO: 2248347 - DNA, 15 bp, Homo sapiens
atcacacccatttaa

SEQ ID NO: 2248348 - DNA, 16 bp, Homo sapiens
atcacacccatttaaa

SEQ ID NO: 2248349 - DNA, 19 bp, Homo sapiens
atcacagcaatatttaaca

SEQ ID NO: 2248350 - DNA, 18 bp, Homo sapiens
atcacataaccttaaaaa

SEQ ID NO: 2248351 - DNA, 16 bp, Homo sapiens
atcaccgactgaaaat

SEQ ID NO: 2248352 - DNA, 22 bp, Homo sapiens
atcacggatggtgcatgggctc

SEQ ID NO: 2248353 - DNA, 23 bp, Homo sapiens
atcactacagtattactcttaca

SEQ ID NO: 2248354 - DNA, 16 bp, Homo sapiens
atcagaaagctttatt

SEQ ID NO: 2248355 - DNA, 19 bp, Homo sapiens
atcagaaagctttattttg

SEQ ID NO: 2248356 - DNA, 16 bp, Homo sapiens
atcagaggagtaaata

SEQ ID NO: 2248357 - DNA, 16 bp, Homo sapiens
atcagtagttcacata

SEQ ID NO: 2248358 - DNA, 22 bp, Homo sapiens
atcataaggttttattcatata

SEQ ID NO: 2248359 - DNA, 21 bp, Homo sapiens
atcataggcaccttttactgt

SEQ ID NO: 2248360 - DNA, 16 bp, Homo sapiens
atcatagttactgtgt

SEQ ID NO: 2248361 - DNA, 21 bp, Homo sapiens
atcatcaagtaatacaaacta

SEQ ID NO: 2248362 - DNA, 21 bp, Homo sapiens
atcatctgcagttctttttgt

SEQ ID NO: 2248363 - DNA, 22 bp, Homo sapiens
atcatctgcagttctttttgta

SEQ ID NO: 2248364 - DNA, 24 bp, Homo sapiens
atccaatattttctttaatgcttt

SEQ ID NO: 2248365 - DNA, 17 bp, Homo sapiens
atccagcctccagggca

SEQ ID NO: 2248366 - DNA, 19 bp, Homo sapiens
atccagcctggggctgagg

SEQ ID NO: 2248367 - DNA, 21 bp, Homo sapiens
atccagcctggggctgaggct

SEQ ID NO: 2248368 - DNA, 15 bp, Homo sapiens
atccaggcaccagga

SEQ ID NO: 2248369 - DNA, 16 bp, Homo sapiens
atccaggcaccaggac

SEQ ID NO: 2248370 - DNA, 20 bp, Homo sapiens
atccagtttgttctccgggt

SEQ ID NO: 2248371 - DNA, 11 bp, Homo sapiens
atccataaaga

SEQ ID NO: 2248372 - DNA, 19 bp, Homo sapiens
atcccaccccctcctcccc

SEQ ID NO: 2248373 - DNA, 18 bp, Homo sapiens
atccccgcctggccagga

SEQ ID NO: 2248374 - DNA, 16 bp, Homo sapiens
atccctccccagttca

SEQ ID NO: 2248375 - DNA, 15 bp, Homo sapiens
atccctgggcccctc

SEQ ID NO: 2248376 - DNA, 17 bp, Homo sapiens
atccctgggcccctcca

SEQ ID NO: 2248377 - DNA, 14 bp, Homo sapiens
atccctttattacc

SEQ ID NO: 2248378 - DNA, 20 bp, Homo sapiens
atccctttttttacatttca

SEQ ID NO: 2248379 - DNA, 15 bp, Homo sapiens
atcctgtgcaataga

SEQ ID NO: 2248380 - DNA, 13 bp, Homo sapiens
atcgaaaaaataa

SEQ ID NO: 2248381 - DNA, 16 bp, Homo sapiens
atcgctcactgttgtg

SEQ ID NO: 2248382 - DNA, 22 bp, Homo sapiens
atcggaggctgggcccctggga

SEQ ID NO: 2248383 - DNA, 15 bp, Homo sapiens
atcggcatttgtttc

SEQ ID NO: 2248384 - DNA, 19 bp, Homo sapiens
atcggctgcattgaagatc

SEQ ID NO: 2248385 - DNA, 18 bp, Homo sapiens
atctaagaataataaaat

SEQ ID NO: 2248386 - DNA, 21 bp, Homo sapiens
atctaagtgcctcacattttt

SEQ ID NO: 2248387 - DNA, 19 bp, Homo sapiens
atctagattatggagcttt

SEQ ID NO: 2248388 - DNA, 14 bp, Homo sapiens
atctagcttcttca

SEQ ID NO: 2248389 - DNA, 11 bp, Homo sapiens
atctataaaat

SEQ ID NO: 2248390 - DNA, 20 bp, Homo sapiens
atctataaaatagatataaa

SEQ ID NO: 2248391 - DNA, 21 bp, Homo sapiens
atctataggaagattgaacct

SEQ ID NO: 2248392 - DNA, 12 bp, Homo sapiens
atctatataaaa

SEQ ID NO: 2248393 - DNA, 14 bp, Homo sapiens
atctatctatttga

SEQ ID NO: 2248394 - DNA, 12 bp, Homo sapiens
atctatttacat

SEQ ID NO: 2248395 - DNA, 14 bp, Homo sapiens
atctatttacataa

SEQ ID NO: 2248396 - DNA, 19 bp, Homo sapiens
atctcagatgttaaaataa

SEQ ID NO: 2248397 - DNA, 23 bp, Homo sapiens
atctcagatgttaaaataaatgg

SEQ ID NO: 2248398 - DNA, 19 bp, Homo sapiens
atctcatttaagggaaaaa

SEQ ID NO: 2248399 - DNA, 20 bp, Homo sapiens
atctcatttaagggaaaaat

SEQ ID NO: 2248400 - DNA, 15 bp, Homo sapiens
atctccttactgtgt

SEQ ID NO: 2248401 - DNA, 14 bp, Homo sapiens
atctctaggaagtc

SEQ ID NO: 2248402 - DNA, 17 bp, Homo sapiens
atctctcagagccctca

SEQ ID NO: 2248403 - DNA, 20 bp, Homo sapiens
atctctccacggtagcactt

SEQ ID NO: 2248404 - DNA, 23 bp, Homo sapiens
atctctctggggccctgggcctc

SEQ ID NO: 2248405 - DNA, 13 bp, Homo sapiens
atctgaaatgtta

SEQ ID NO: 2248406 - DNA, 16 bp, Homo sapiens
atctgaaatgttacaa

SEQ ID NO: 2248407 - DNA, 13 bp, Homo sapiens
atctgataagcaa

SEQ ID NO: 2248408 - DNA, 20 bp, Homo sapiens
atctgcagttctttttgtac

SEQ ID NO: 2248409 - DNA, 20 bp, Homo sapiens
atctggagaccagggagcct

SEQ ID NO: 2248410 - DNA, 21 bp, Homo sapiens
atctggagaccagggagcctt

SEQ ID NO: 2248411 - DNA, 23 bp, Homo sapiens
atctggagttggagccgcacatc

SEQ ID NO: 2248412 - DNA, 21 bp, Homo sapiens
atctggctgcagttttgctat

SEQ ID NO: 2248413 - DNA, 18 bp, Homo sapiens
atctgttagcagagtctg

SEQ ID NO: 2248414 - DNA, 22 bp, Homo sapiens
atcttatatgggaaaccatgta

SEQ ID NO: 2248415 - DNA, 22 bp, Homo sapiens
atcttgagccacagtcactgga

SEQ ID NO: 2248416 - DNA, 20 bp, Homo sapiens
atcttggcctaaacctcagt

SEQ ID NO: 2248417 - DNA, 14 bp, Homo sapiens
atctttctgcacac

SEQ ID NO: 2248418 - DNA, 21 bp, Homo sapiens
atctttctgcacacaaatatt

SEQ ID NO: 2248419 - DNA, 13 bp, Homo sapiens
atcttttattctt

SEQ ID NO: 2248420 - DNA, 14 bp, Homo sapiens
atcttttattcttt

SEQ ID NO: 2248421 - DNA, 22 bp, Homo sapiens
atcttttgaagggagaagacac

SEQ ID NO: 2248422 - DNA, 21 bp, Homo sapiens
atgaaagggaaactgggaaac

SEQ ID NO: 2248423 - DNA, 18 bp, Homo sapiens
atgaaatgtgaattttta

SEQ ID NO: 2248424 - DNA, 16 bp, Homo sapiens
atgaacaaaattattt

SEQ ID NO: 2248425 - DNA, 21 bp, Homo sapiens
atgaacttgttacttgcagca

SEQ ID NO: 2248426 - DNA, 22 bp, Homo sapiens
attaagctgttcctgttcagta

SEQ ID NO: 2248427 - DNA, 19 bp, Homo sapiens
attaatatctttctgcaca

SEQ ID NO: 2248428 - DNA, 14 bp, Homo sapiens
attaatatgaaaac

SEQ ID NO: 2248429 - DNA, 15 bp, Homo sapiens
attaatcaccttctt

SEQ ID NO: 2248430 - DNA, 18 bp, Homo sapiens
attaatcaccttctttgt

SEQ ID NO: 2248431 - DNA, 21 bp, Homo sapiens
attaatcaccttctttgtaat

SEQ ID NO: 2248432 - DNA, 13 bp, Homo sapiens
attaatgcacttt

SEQ ID NO: 2248433 - DNA, 14 bp, Homo sapiens
attaatgcactttc

SEQ ID NO: 2248434 - DNA, 13 bp, Homo sapiens
attacaattttat

SEQ ID NO: 2248435 - DNA, 18 bp, Homo sapiens
attacaattttatctgtt

SEQ ID NO: 2248436 - DNA, 18 bp, Homo sapiens
attacagtccaaaatact

SEQ ID NO: 2248437 - DNA, 23 bp, Homo sapiens
attacatgctgctatacacaagc

SEQ ID NO: 2248438 - DNA, 16 bp, Homo sapiens
attacatgtaatttga

SEQ ID NO: 2248439 - DNA, 20 bp, Homo sapiens
attaccaataggcaaattaa

SEQ ID NO: 2248440 - DNA, 13 bp, Homo sapiens
attaccccctcct

SEQ ID NO: 2248441 - DNA, 19 bp, Homo sapiens
attacctcctgtgtggaag

SEQ ID NO: 2248442 - DNA, 18 bp, Homo sapiens
attacttgaactttccaa

SEQ ID NO: 2248443 - DNA, 17 bp, Homo sapiens
attagaaaatattctct

SEQ ID NO: 2248444 - DNA, 18 bp, Homo sapiens
attagaaaatgttattta

SEQ ID NO: 2248445 - DNA, 22 bp, Homo sapiens
attagaatagtgttctgcaaaa

SEQ ID NO: 2248446 - DNA, 21 bp, Homo sapiens
attagagagcatctgcaacaa

SEQ ID NO: 2248447 - DNA, 16 bp, Homo sapiens
attagggagaaaattc

SEQ ID NO: 2248448 - DNA, 23 bp, Homo sapiens
attagggagaaaattcaattgta

SEQ ID NO: 2248449 - DNA, 15 bp, Homo sapiens
attagggccctgtgt

SEQ ID NO: 2248450 - DNA, 21 bp, Homo sapiens
attagttgaatataagaaaat

SEQ ID NO: 2248451 - DNA, 11 bp, Homo sapiens
attataaaaat

SEQ ID NO: 2248452 - DNA, 20 bp, Homo sapiens
attatcaaagggataaagaa

SEQ ID NO: 2248453 - DNA, 22 bp, Homo sapiens
attatcaaagggataaagaaaa

SEQ ID NO: 2248454 - DNA, 11 bp, Homo sapiens
attatcactgt

SEQ ID NO: 2248455 - DNA, 15 bp, Homo sapiens
attatcctctttgta

SEQ ID NO: 2248456 - DNA, 16 bp, Homo sapiens
attatcctctttgtaa

SEQ ID NO: 2248457 - DNA, 20 bp, Homo sapiens
attatggaaaaataaaactg

SEQ ID NO: 2248458 - DNA, 22 bp, Homo sapiens
attatggaaaaataaaactgtc

SEQ ID NO: 2248459 - DNA, 13 bp, Homo sapiens
attattaattgca

SEQ ID NO: 2248460 - DNA, 13 bp, Homo sapiens
attatttattatt

SEQ ID NO: 2248461 - DNA, 15 bp, Homo sapiens
attatttctgtcaca

SEQ ID NO: 2248462 - DNA, 22 bp, Homo sapiens
attattttttaataagaacatt

SEQ ID NO: 2248463 - DNA, 12 bp, Homo sapiens
attcaaactgca

SEQ ID NO: 2248464 - DNA, 16 bp, Homo sapiens
attcaaactgcacttt

SEQ ID NO: 2248465 - DNA, 18 bp, Homo sapiens
attcaaactgcactttta

SEQ ID NO: 2248466 - DNA, 19 bp, Homo sapiens
attcaaactggggcctcca

SEQ ID NO: 2248467 - DNA, 18 bp, Homo sapiens
attcaattgtaaattgaa

SEQ ID NO: 2248468 - DNA, 14 bp, Homo sapiens
attcacaattattc

SEQ ID NO: 2248469 - DNA, 20 bp, Homo sapiens
attcagcagcaaattttcag

SEQ ID NO: 2248470 - DNA, 17 bp, Homo sapiens
attcaggtaatacaaac

SEQ ID NO: 2248471 - DNA, 15 bp, Homo sapiens
attcagtgattactg

SEQ ID NO: 2248472 - DNA, 21 bp, Homo sapiens
attcagtggaggctggcaggg

SEQ ID NO: 2248473 - DNA, 20 bp, Homo sapiens
attcatagtctttggagaaa

SEQ ID NO: 2248474 - DNA, 17 bp, Homo sapiens
attcatcccaactgtct

SEQ ID NO: 2248475 - DNA, 15 bp, Homo sapiens
attcccctctgctgc

SEQ ID NO: 2248476 - DNA, 12 bp, Homo sapiens
attccctccccc

SEQ ID NO: 2248477 - DNA, 13 bp, Homo sapiens
attccctccccct

SEQ ID NO: 2248478 - DNA, 15 bp, Homo sapiens
attcctttcagcaat

SEQ ID NO: 2248479 - DNA, 15 bp, Homo sapiens
attcgaaatgagctc

SEQ ID NO: 2248480 - DNA, 22 bp, Homo sapiens
attctgataaaaataatattaa

SEQ ID NO: 2248481 - DNA, 22 bp, Homo sapiens
attctgggcaccacaaaatata

SEQ ID NO: 2248482 - DNA, 17 bp, Homo sapiens
attcttgttagaatctg

SEQ ID NO: 2248483 - DNA, 22 bp, Homo sapiens
attgaagtgtataatataaaaa

SEQ ID NO: 2248484 - DNA, 20 bp, Homo sapiens
attgaatggtgcattgtata

SEQ ID NO: 2248485 - DNA, 17 bp, Homo sapiens
attgaggggattaatat

SEQ ID NO: 2248486 - DNA, 20 bp, Homo sapiens
attgatatctccatgatgat

SEQ ID NO: 2248487 - DNA, 23 bp, Homo sapiens
attgcaagaagctttatttctag

SEQ ID NO: 2248488 - DNA, 18 bp, Homo sapiens
attgcagtttatcattca

SEQ ID NO: 2248489 - DNA, 17 bp, Homo sapiens
attgccatggtctttcc

SEQ ID NO: 2248490 - DNA, 17 bp, Homo sapiens
attgccttttaattttt

SEQ ID NO: 2248491 - DNA, 23 bp, Homo sapiens
attgctcagcccgcttggccacc

SEQ ID NO: 2248492 - DNA, 14 bp, Homo sapiens
attgctgagcctct

SEQ ID NO: 2248493 - DNA, 22 bp, Homo sapiens
attgctgagcctctgctcccca

SEQ ID NO: 2248494 - DNA, 16 bp, Homo sapiens
attgggaaaaaagcaa

SEQ ID NO: 2248495 - DNA, 19 bp, Homo sapiens
attggtgtaaggtactttc

SEQ ID NO: 2248496 - DNA, 21 bp, Homo sapiens
attggttttatcgcagatttt

SEQ ID NO: 2248497 - DNA, 18 bp, Homo sapiens
attgtatagatataatga

SEQ ID NO: 2248498 - DNA, 15 bp, Homo sapiens
attgtatattacaat

SEQ ID NO: 2248499 - DNA, 20 bp, Homo sapiens
attgtatattacaatgatca

SEQ ID NO: 2248500 - DNA, 18 bp, Homo sapiens
attgtatatttttatcta

SEQ ID NO: 2248501 - DNA, 19 bp, Homo sapiens
attgtatatttttatctat

SEQ ID NO: 2248502 - DNA, 21 bp, Homo sapiens
attgtcctcccctattttaag

SEQ ID NO: 2248503 - DNA, 23 bp, Homo sapiens
attgtcctcccctattttaagac

SEQ ID NO: 2248504 - DNA, 19 bp, Homo sapiens
attgtctttaaaaactgtt

SEQ ID NO: 2248505 - DNA, 12 bp, Homo sapiens
attgtgtagacg

SEQ ID NO: 2248506 - DNA, 19 bp, Homo sapiens
attgttaatacaaggtata

SEQ ID NO: 2248507 - DNA, 22 bp, Homo sapiens
attgttccaggcatccatcttg

SEQ ID NO: 2248508 - DNA, 20 bp, Homo sapiens
attgttccttggagaaatga

SEQ ID NO: 2248509 - DNA, 16 bp, Homo sapiens
attgtttctctgaaag

SEQ ID NO: 2248510 - DNA, 19 bp, Homo sapiens
attgttttacaatagttct

SEQ ID NO: 2248511 - DNA, 23 bp, Homo sapiens
atttaaaaggatggcaagttgca

SEQ ID NO: 2248512 - DNA, 14 bp, Homo sapiens
atttaaacctttta

SEQ ID NO: 2248513 - DNA, 16 bp, Homo sapiens
atttaagctttcctgt

SEQ ID NO: 2248514 - DNA, 14 bp, Homo sapiens
atttaagggaaaaa

SEQ ID NO: 2248515 - DNA, 18 bp, Homo sapiens
atttaagggaaaaatata

SEQ ID NO: 2248516 - DNA, 18 bp, Homo sapiens
atttaagtgttggaaaaa

SEQ ID NO: 2248517 - DNA, 21 bp, Homo sapiens
atttaagtttgttgctgtcaa

SEQ ID NO: 2248518 - DNA, 13 bp, Homo sapiens
atttaattgaaac

SEQ ID NO: 2248519 - DNA, 19 bp, Homo sapiens
atttacagatgaatgtatt

SEQ ID NO: 2248520 - DNA, 13 bp, Homo sapiens
atttactcacagc

SEQ ID NO: 2248521 - DNA, 17 bp, Homo sapiens
atttaggtttttattag

SEQ ID NO: 2248522 - DNA, 14 bp, Homo sapiens
atttataaaacttc

SEQ ID NO: 2248523 - DNA, 14 bp, Homo sapiens
atttatcaagcatt

SEQ ID NO: 2248524 - DNA, 20 bp, Homo sapiens
atttatccagaaaactgtga

SEQ ID NO: 2248525 - DNA, 13 bp, Homo sapiens
atttattatttat

SEQ ID NO: 2248526 - DNA, 13 bp, Homo sapiens
atttatttattat

SEQ ID NO: 2248527 - DNA, 19 bp, Homo sapiens
atttcaataacctttcact

SEQ ID NO: 2248528 - DNA, 23 bp, Homo sapiens
atttcatccagtttgttctccgg

SEQ ID NO: 2248529 - DNA, 23 bp, Homo sapiens
atttcatctcatttaagggaaaa

SEQ ID NO: 2248530 - DNA, 16 bp, Homo sapiens
atttccatctctggta

SEQ ID NO: 2248531 - DNA, 19 bp, Homo sapiens
atttcccaacacaaagatt

SEQ ID NO: 2248532 - DNA, 15 bp, Homo sapiens
atttcgcttcttaga

SEQ ID NO: 2248533 - DNA, 12 bp, Homo sapiens
atttctacctca

SEQ ID NO: 2248534 - DNA, 19 bp, Homo sapiens
cagcaccctcccccgcagc

SEQ ID NO: 2248535 - DNA, 14 bp, Homo sapiens
cagcaccctctcct

SEQ ID NO: 2248536 - DNA, 16 bp, Homo sapiens
cagcaccctctcctgg

SEQ ID NO: 2248537 - DNA, 19 bp, Homo sapiens
cagcaccctctcctggggg

SEQ ID NO: 2248538 - DNA, 11 bp, Homo sapiens
cagcacttgtt

SEQ ID NO: 2248539 - DNA, 13 bp, Homo sapiens
cagcagcccccca

SEQ ID NO: 2248540 - DNA, 13 bp, Homo sapiens
cagcaggctcagg

SEQ ID NO: 2248541 - DNA, 22 bp, Homo sapiens
cagcatgactatgtatttttct

SEQ ID NO: 2248542 - DNA, 15 bp, Homo sapiens
cagcattcatttgtt

SEQ ID NO: 2248543 - DNA, 16 bp, Homo sapiens
cagccagaccagcagg

SEQ ID NO: 2248544 - DNA, 17 bp, Homo sapiens
cagccagccgccctggg

SEQ ID NO: 2248545 - DNA, 18 bp, Homo sapiens
cagccagccgccctgggc

SEQ ID NO: 2248546 - DNA, 13 bp, Homo sapiens
cagccagcctcag

SEQ ID NO: 2248547 - DNA, 14 bp, Homo sapiens
cagccagcctcaga

SEQ ID NO: 2248548 - DNA, 16 bp, Homo sapiens
cagccagcgcctccct

SEQ ID NO: 2248549 - DNA, 18 bp, Homo sapiens
cagccagcgcctccctcc

SEQ ID NO: 2248550 - DNA, 20 bp, Homo sapiens
cagcccaggatactggcaca

SEQ ID NO: 2248551 - DNA, 19 bp, Homo sapiens
cagccccgactccagccag

SEQ ID NO: 2248552 - DNA, 14 bp, Homo sapiens
cagcccgcttggcc

SEQ ID NO: 2248553 - DNA, 15 bp, Homo sapiens
cagcccgcttggcca

SEQ ID NO: 2248554 - DNA, 13 bp, Homo sapiens
cagccgccctggg

SEQ ID NO: 2248555 - DNA, 13 bp, Homo sapiens
cagccgtatttta

SEQ ID NO: 2248556 - DNA, 14 bp, Homo sapiens
cagccgtattttac

SEQ ID NO: 2248557 - DNA, 15 bp, Homo sapiens
cagccgtattttaca

SEQ ID NO: 2248558 - DNA, 14 bp, Homo sapiens
cagcctccagggca

SEQ ID NO: 2248559 - DNA, 13 bp, Homo sapiens
cagcctctggcat

SEQ ID NO: 2248560 - DNA, 18 bp, Homo sapiens
cagcctggctctgccccc

SEQ ID NO: 2248561 - DNA, 17 bp, Homo sapiens
cagccttagatgcctcg

SEQ ID NO: 2248562 - DNA, 16 bp, Homo sapiens
cagcgaccgccccctc

SEQ ID NO: 2248563 - DNA, 18 bp, Homo sapiens
cagcgaccttcctcatcc

SEQ ID NO: 2248564 - DNA, 23 bp, Homo sapiens
cagcgccaaaacaagccaaagag

SEQ ID NO: 2248565 - DNA, 12 bp, Homo sapiens
cagcgcccccag

SEQ ID NO: 2248566 - DNA, 16 bp, Homo sapiens
cagcgcccccagagcc

SEQ ID NO: 2248567 - DNA, 15 bp, Homo sapiens
cagcgcctccctcca

SEQ ID NO: 2248568 - DNA, 21 bp, Homo sapiens
cagctaagatgccatgtgcag

SEQ ID NO: 2248569 - DNA, 22 bp, Homo sapiens
cagctatctgtcatctctctgg

SEQ ID NO: 2248570 - DNA, 21 bp, Homo sapiens
cagctatgcgcaatgtggcat

SEQ ID NO: 2248571 - DNA, 16 bp, Homo sapiens
cagctgtcaaggctca

SEQ ID NO: 2248572 - DNA, 23 bp, Homo sapiens
cagcttctctgctagatttctac

SEQ ID NO: 2248573 - DNA, 12 bp, Homo sapiens
cagctttgagct

SEQ ID NO: 2248574 - DNA, 14 bp, Homo sapiens
caggaacaaacagg

SEQ ID NO: 2248575 - DNA, 22 bp, Homo sapiens
caggaacaaacagggctgcctt

SEQ ID NO: 2248576 - DNA, 22 bp, Homo sapiens
caggaactctggacccctgggc

SEQ ID NO: 2248577 - DNA, 14 bp, Homo sapiens
caggaactgtcatg

SEQ ID NO: 2248578 - DNA, 21 bp, Homo sapiens
caggacaacacttcattttca

SEQ ID NO: 2248579 - DNA, 16 bp, Homo sapiens
caggaccaagggcaga

SEQ ID NO: 2248580 - DNA, 20 bp, Homo sapiens
caggacgccactcatttcat

SEQ ID NO: 2248581 - DNA, 23 bp, Homo sapiens
caggactgcaaaaatccttctcc

SEQ ID NO: 2248582 - DNA, 18 bp, Homo sapiens
caggagggccagcgctgt

SEQ ID NO: 2248583 - DNA, 15 bp, Homo sapiens
caggatactggcaca

SEQ ID NO: 2248584 - DNA, 13 bp, Homo sapiens
caggatgctgagc

SEQ ID NO: 2248585 - DNA, 20 bp, Homo sapiens
caggatgtgtgggccaggat

SEQ ID NO: 2248586 - DNA, 15 bp, Homo sapiens
caggcacacagcagc

SEQ ID NO: 2248587 - DNA, 16 bp, Homo sapiens
caggcacacagcagcc

SEQ ID NO: 2248588 - DNA, 18 bp, Homo sapiens
caggcacacagcagcccc

SEQ ID NO: 2248589 - DNA, 20 bp, Homo sapiens
caggcacatacacctcgtca

SEQ ID NO: 2248590 - DNA, 22 bp, Homo sapiens
caggcacatacacctcgtcaag

SEQ ID NO: 2248591 - DNA, 20 bp, Homo sapiens
caggcacccacatccccaat

SEQ ID NO: 2248592 - DNA, 21 bp, Homo sapiens
caggccaggaccaagggcaga

SEQ ID NO: 2248593 - DNA, 13 bp, Homo sapiens
caggcccactccc

SEQ ID NO: 2248594 - DNA, 16 bp, Homo sapiens
caggccctccctgact

SEQ ID NO: 2248595 - DNA, 21 bp, Homo sapiens
caggctatgtataaaatacat

SEQ ID NO: 2248596 - DNA, 14 bp, Homo sapiens
caggctcccctgag

SEQ ID NO: 2248597 - DNA, 12 bp, Homo sapiens
caggctgggcca

SEQ ID NO: 2248598 - DNA, 17 bp, Homo sapiens
cagggaatgcagcagga

SEQ ID NO: 2248599 - DNA, 20 bp, Homo sapiens
cagggacatgccctgtgtgg

SEQ ID NO: 2248600 - DNA, 16 bp, Homo sapiens
cagggaccacaccctg

SEQ ID NO: 2248601 - DNA, 22 bp, Homo sapiens
cagggaccacaccctgtactgt

SEQ ID NO: 2248602 - DNA, 23 bp, Homo sapiens
cagggaccggcggaccccagcca

SEQ ID NO: 2248603 - DNA, 22 bp, Homo sapiens
cagggagcctttggttctggcc

SEQ ID NO: 2248604 - DNA, 13 bp, Homo sapiens
cagggatggggga

SEQ ID NO: 2248605 - DNA, 17 bp, Homo sapiens
cagggcattgctcagcc

SEQ ID NO: 2248606 - DNA, 19 bp, Homo sapiens
cagggcattgctcagcccg

SEQ ID NO: 2248607 - DNA, 21 bp, Homo sapiens
cagggcattgctcagcccgct

SEQ ID NO: 2248608 - DNA, 17 bp, Homo sapiens
caggggaattccctccc

SEQ ID NO: 2248609 - DNA, 22 bp, Homo sapiens
caggggaattccctccccctcc

SEQ ID NO: 2248610 - DNA, 13 bp, Homo sapiens
cagggggccctgc

SEQ ID NO: 2248611 - DNA, 17 bp, Homo sapiens
cagggggccctgcccca

SEQ ID NO: 2248612 - DNA, 23 bp, Homo sapiens
cagggggccctgccccaccccat

SEQ ID NO: 2248613 - DNA, 19 bp, Homo sapiens
cagggtttacccagtggga

SEQ ID NO: 2248614 - DNA, 14 bp, Homo sapiens
caggtaaaacaggg

SEQ ID NO: 2248615 - DNA, 23 bp, Homo sapiens
caggtaaaacagggccacataga

SEQ ID NO: 2248616 - DNA, 22 bp, Homo sapiens
caggtaaagggcaaataatgat

SEQ ID NO: 2248617 - DNA, 23 bp, Homo sapiens
caggtcctgcccatgtgtcccct

SEQ ID NO: 2248618 - DNA, 19 bp, Homo sapiens
caggtgctcaataaatgat

SEQ ID NO: 2248619 - DNA, 15 bp, Homo sapiens
caggttccacagagg

SEQ ID NO: 2248620 - DNA, 23 bp, Homo sapiens
caggtttagtgaaaaactgctgt

SEQ ID NO: 2248621 - DNA, 14 bp, Homo sapiens
cagtaccctctcag

SEQ ID NO: 2248622 - DNA, 14 bp, Homo sapiens
cagtagttcacata

SEQ ID NO: 2248623 - DNA, 16 bp, Homo sapiens
cagtatacctcatttt

SEQ ID NO: 2248624 - DNA, 22 bp, Homo sapiens
cagtcattcagcagcaaatttt

SEQ ID NO: 2248625 - DNA, 17 bp, Homo sapiens
cagtccacaggggccac

SEQ ID NO: 2248626 - DNA, 15 bp, Homo sapiens
cagtgaccacttatt

SEQ ID NO: 2248627 - DNA, 16 bp, Homo sapiens
cagtggcccatggcat

SEQ ID NO: 2248628 - DNA, 20 bp, Homo sapiens
cagtggcgcattctaggctc

SEQ ID NO: 2248629 - DNA, 14 bp, Homo sapiens
cagtggctcataaa

SEQ ID NO: 2248630 - DNA, 14 bp, Homo sapiens
cagtgtgtaaacaa

SEQ ID NO: 2248631 - DNA, 13 bp, Homo sapiens
cagtgttttcaga

SEQ ID NO: 2248632 - DNA, 17 bp, Homo sapiens
cagttataaaattaaaa

SEQ ID NO: 2248633 - DNA, 19 bp, Homo sapiens
cagttataaaattaaaagt

SEQ ID NO: 2248634 - DNA, 19 bp, Homo sapiens
cagttatacagttataaaa

SEQ ID NO: 2248635 - DNA, 18 bp, Homo sapiens
cagttattacatgtaatt

SEQ ID NO: 2248636 - DNA, 16 bp, Homo sapiens
cagttcaacctggtgg

SEQ ID NO: 2248637 - DNA, 18 bp, Homo sapiens
cagttcattgcactttga

SEQ ID NO: 2248638 - DNA, 22 bp, Homo sapiens
cagttcctcccaggaagcccag

SEQ ID NO: 2248639 - DNA, 15 bp, Homo sapiens
cagttcctgggaaca

SEQ ID NO: 2248640 - DNA, 19 bp, Homo sapiens
cagttcctttagaaagcag

SEQ ID NO: 2248641 - DNA, 15 bp, Homo sapiens
cagttctttttgtac

SEQ ID NO: 2248642 - DNA, 17 bp, Homo sapiens
ccaggaggtagtttctc

SEQ ID NO: 2248643 - DNA, 21 bp, Homo sapiens
ccaggatactggcacagaggt

SEQ ID NO: 2248644 - DNA, 15 bp, Homo sapiens
ccaggcacccacatc

SEQ ID NO: 2248645 - DNA, 20 bp, Homo sapiens
ccaggcacccacatccccaa

SEQ ID NO: 2248646 - DNA, 19 bp, Homo sapiens
ccaggctatgtataaaata

SEQ ID NO: 2248647 - DNA, 20 bp, Homo sapiens
ccaggctatgtataaaatac

SEQ ID NO: 2248648 - DNA, 19 bp, Homo sapiens
ccagggcattgctcagccc

SEQ ID NO: 2248649 - DNA, 22 bp, Homo sapiens
ccagggcattgctcagcccgct

SEQ ID NO: 2248650 - DNA, 18 bp, Homo sapiens
ccagtacctagctggctc

SEQ ID NO: 2248651 - DNA, 14 bp, Homo sapiens
ccagtatacctcat

SEQ ID NO: 2248652 - DNA, 18 bp, Homo sapiens
ccagtatacctcattttt

SEQ ID NO: 2248653 - DNA, 20 bp, Homo sapiens
ccagtatacctcatttttca

SEQ ID NO: 2248654 - DNA, 23 bp, Homo sapiens
ccagtatacctcatttttcatac

SEQ ID NO: 2248655 - DNA, 17 bp, Homo sapiens
ccataactgacaagaga

SEQ ID NO: 2248656 - DNA, 14 bp, Homo sapiens
ccatacttgttctg

SEQ ID NO: 2248657 - DNA, 13 bp, Homo sapiens
ccatccagccaga

SEQ ID NO: 2248658 - DNA, 11 bp, Homo sapiens
ccatccagcct

SEQ ID NO: 2248659 - DNA, 17 bp, Homo sapiens
ccatccagcctccaggg

SEQ ID NO: 2248660 - DNA, 13 bp, Homo sapiens
ccatccctgggcc

SEQ ID NO: 2248661 - DNA, 11 bp, Homo sapiens
ccatctctctt

SEQ ID NO: 2248662 - DNA, 22 bp, Homo sapiens
ccatctgtgccatacttgttct

SEQ ID NO: 2248663 - DNA, 20 bp, Homo sapiens
ccatgacaatgttgtagtgt

SEQ ID NO: 2248664 - DNA, 12 bp, Homo sapiens
ccatgatctgta

SEQ ID NO: 2248665 - DNA, 19 bp, Homo sapiens
ccatgatctgtatttaatg

SEQ ID NO: 2248666 - DNA, 18 bp, Homo sapiens
ccatgccaataaagtgat

SEQ ID NO: 2248667 - DNA, 13 bp, Homo sapiens
ccatgccagagag

SEQ ID NO: 2248668 - DNA, 14 bp, Homo sapiens
ccatggagccagct

SEQ ID NO: 2248669 - DNA, 17 bp, Homo sapiens
ccatggccttggcaggc

SEQ ID NO: 2248670 - DNA, 15 bp, Homo sapiens
ccatgggctgtgtcc

SEQ ID NO: 2248671 - DNA, 23 bp, Homo sapiens
ccatggtctttccactttcatct

SEQ ID NO: 2248672 - DNA, 20 bp, Homo sapiens
ccatgtagccccctggcctc

SEQ ID NO: 2248673 - DNA, 14 bp, Homo sapiens
ccatgtccaaagag

SEQ ID NO: 2248674 - DNA, 17 bp, Homo sapiens
ccatgtccaaagaggct

SEQ ID NO: 2248675 - DNA, 18 bp, Homo sapiens
ccatgtccaaagaggctg

SEQ ID NO: 2248676 - DNA, 23 bp, Homo sapiens
ccatgtccaaagaggctgcccct

SEQ ID NO: 2248677 - DNA, 17 bp, Homo sapiens
ccatgtggtggcacagg

SEQ ID NO: 2248678 - DNA, 12 bp, Homo sapiens
ccatgtgtcccc

SEQ ID NO: 2248679 - DNA, 18 bp, Homo sapiens
ccatgtgtcccctcactc

SEQ ID NO: 2248680 - DNA, 22 bp, Homo sapiens
ccatgtgtcccctcactctgtc

SEQ ID NO: 2248681 - DNA, 14 bp, Homo sapiens
ccatgtgtcctggt

SEQ ID NO: 2248682 - DNA, 17 bp, Homo sapiens
ccattagccagatttgt

SEQ ID NO: 2248683 - DNA, 15 bp, Homo sapiens
ccattcatgtcctgt

SEQ ID NO: 2248684 - DNA, 13 bp, Homo sapiens
cccaacacaaaga

SEQ ID NO: 2248685 - DNA, 17 bp, Homo sapiens
cccaacctttccctcac

SEQ ID NO: 2248686 - DNA, 20 bp, Homo sapiens
cccaacctttccctcacccc

SEQ ID NO: 2248687 - DNA, 14 bp, Homo sapiens
cccaagagaactcg

SEQ ID NO: 2248688 - DNA, 18 bp, Homo sapiens
cccaatgacacccatgcc

SEQ ID NO: 2248689 - DNA, 21 bp, Homo sapiens
cccaatgctgctccaccctcc

SEQ ID NO: 2248690 - DNA, 13 bp, Homo sapiens
cccacaaactgat

SEQ ID NO: 2248691 - DNA, 22 bp, Homo sapiens
cccacaggaagcctgcagtcct

SEQ ID NO: 2248692 - DNA, 16 bp, Homo sapiens
cccacatccccaataa

SEQ ID NO: 2248693 - DNA, 13 bp, Homo sapiens
cccacccccagcc

SEQ ID NO: 2248694 - DNA, 13 bp, Homo sapiens
cccacccccagct

SEQ ID NO: 2248695 - DNA, 23 bp, Homo sapiens
cccaccgggagcctccccctcag

SEQ ID NO: 2248696 - DNA, 14 bp, Homo sapiens
cccactactcaata

SEQ ID NO: 2248697 - DNA, 22 bp, Homo sapiens
cccactactcaatactacctct

SEQ ID NO: 2248698 - DNA, 17 bp, Homo sapiens
cccactcattccttctc

SEQ ID NO: 2248699 - DNA, 13 bp, Homo sapiens
cccactccccagc

SEQ ID NO: 2248700 - DNA, 16 bp, Homo sapiens
cccagagagaccctgc

SEQ ID NO: 2248701 - DNA, 18 bp, Homo sapiens
cccagagagaccctgcaa

SEQ ID NO: 2248702 - DNA, 21 bp, Homo sapiens
cccagattttgctgtatattt

SEQ ID NO: 2248703 - DNA, 20 bp, Homo sapiens
cccagcactaaggccgtgtc

SEQ ID NO: 2248704 - DNA, 17 bp, Homo sapiens
cccagcagcccctcagc

SEQ ID NO: 2248705 - DNA, 21 bp, Homo sapiens
cccagcagcccctcagcgccc

SEQ ID NO: 2248706 - DNA, 16 bp, Homo sapiens
cccagccccgactcca

SEQ ID NO: 2248707 - DNA, 22 bp, Homo sapiens
cccagctaccctttttctccag

SEQ ID NO: 2248708 - DNA, 14 bp, Homo sapiens
cccaggaagcccag

SEQ ID NO: 2248709 - DNA, 15 bp, Homo sapiens
cccagtatacctcat

SEQ ID NO: 2248710 - DNA, 16 bp, Homo sapiens
cccagtatacctcatt

SEQ ID NO: 2248711 - DNA, 15 bp, Homo sapiens
cccagtcacttcctg

SEQ ID NO: 2248712 - DNA, 18 bp, Homo sapiens
cccagtcacttcctgtcc

SEQ ID NO: 2248713 - DNA, 11 bp, Homo sapiens
cccagtctgtc

SEQ ID NO: 2248714 - DNA, 19 bp, Homo sapiens
cccagtgtcccctttcttc

SEQ ID NO: 2248715 - DNA, 14 bp, Homo sapiens
cccatccagcctcc

SEQ ID NO: 2248716 - DNA, 15 bp, Homo sapiens
cccatccagcctcca

SEQ ID NO: 2248717 - DNA, 16 bp, Homo sapiens
cccatccagcctccag

SEQ ID NO: 2248718 - DNA, 17 bp, Homo sapiens
cccatccagcctccagg

SEQ ID NO: 2248719 - DNA, 15 bp, Homo sapiens
cccatccctccccag

SEQ ID NO: 2248720 - DNA, 18 bp, Homo sapiens
cccatgacaatgttgtag

SEQ ID NO: 2248721 - DNA, 18 bp, Homo sapiens
cccatgaccccaaagcca

SEQ ID NO: 2248722 - DNA, 15 bp, Homo sapiens
cccatgtagccccct

SEQ ID NO: 2248723 - DNA, 23 bp, Homo sapiens
cccatgtagccccctggcctctg

SEQ ID NO: 2248724 - DNA, 20 bp, Homo sapiens
cccatgtgtcccctcactct

SEQ ID NO: 2248725 - DNA, 23 bp, Homo sapiens
cccatgtgtcccctcactctgtc

SEQ ID NO: 2248726 - DNA, 21 bp, Homo sapiens
cccattcggtgtggtgcagtg

SEQ ID NO: 2248727 - DNA, 21 bp, Homo sapiens
cccatttgagaagctgaggct

SEQ ID NO: 2248728 - DNA, 19 bp, Homo sapiens
ccccaacctttccctcacc

SEQ ID NO: 2248729 - DNA, 23 bp, Homo sapiens
ccccaatgacacccatgccagag

SEQ ID NO: 2248730 - DNA, 14 bp, Homo sapiens
ccccaccccatcca

SEQ ID NO: 2248731 - DNA, 13 bp, Homo sapiens
ccccacccccagc

SEQ ID NO: 2248732 - DNA, 16 bp, Homo sapiens
ccccacccccagctca

SEQ ID NO: 2248733 - DNA, 17 bp, Homo sapiens
ccccacccccagctcaa

SEQ ID NO: 2248734 - DNA, 20 bp, Homo sapiens
ccccacccccagctcaatgg

SEQ ID NO: 2248735 - DNA, 19 bp, Homo sapiens
ccccactcccttgctggcc

SEQ ID NO: 2248736 - DNA, 21 bp, Homo sapiens
ccccactcccttgctggcccc

SEQ ID NO: 2248737 - DNA, 16 bp, Homo sapiens
ccccagacacagccca

SEQ ID NO: 2248738 - DNA, 12 bp, Homo sapiens
ccccagagagac

SEQ ID NO: 2248739 - DNA, 16 bp, Homo sapiens
ccccagagagaccctg

SEQ ID NO: 2248740 - DNA, 17 bp, Homo sapiens
ccccagccccagcccct

SEQ ID NO: 2248741 - DNA, 18 bp, Homo sapiens
ccccagccccgactccag

SEQ ID NO: 2248742 - DNA, 12 bp, Homo sapiens
ccccagcctggc

SEQ ID NO: 2248743 - DNA, 22 bp, Homo sapiens
ccccagctaccctttttctcca

SEQ ID NO: 2248744 - DNA, 14 bp, Homo sapiens
ccccaggccctccc

SEQ ID NO: 2248745 - DNA, 15 bp, Homo sapiens
ccccaggccctccct

SEQ ID NO: 2248746 - DNA, 13 bp, Homo sapiens
ccccagtcacttc

SEQ ID NO: 2248747 - DNA, 20 bp, Homo sapiens
ccccagtcacttcctgtccg

SEQ ID NO: 2248748 - DNA, 21 bp, Homo sapiens
ccccagttcctcccaggaagc

SEQ ID NO: 2248749 - DNA, 14 bp, Homo sapiens
ccccatccagcctc

SEQ ID NO: 2248750 - DNA, 12 bp, Homo sapiens
ccccatgggctg

SEQ ID NO: 2248751 - DNA, 13 bp, Homo sapiens
cctaaagcctcaa

SEQ ID NO: 2248752 - DNA, 23 bp, Homo sapiens
cctaacatggtttaaaagaaaaa

SEQ ID NO: 2248753 - DNA, 17 bp, Homo sapiens
cctaattctatgcctgt

SEQ ID NO: 2248754 - DNA, 17 bp, Homo sapiens
cctacagctttgatccc

SEQ ID NO: 2248755 - DNA, 18 bp, Homo sapiens
cctaccttactatttaaa

SEQ ID NO: 2248756 - DNA, 20 bp, Homo sapiens
cctagatgcacgtggggccc

SEQ ID NO: 2248757 - DNA, 23 bp, Homo sapiens
cctagatgcacgtggggcccact

SEQ ID NO: 2248758 - DNA, 18 bp, Homo sapiens
cctataatccttgataat

SEQ ID NO: 2248759 - DNA, 15 bp, Homo sapiens
cctatatatttctat

SEQ ID NO: 2248760 - DNA, 14 bp, Homo sapiens
cctcaaaacaaagg

SEQ ID NO: 2248761 - DNA, 17 bp, Homo sapiens
cctcaacagtgttttca

SEQ ID NO: 2248762 - DNA, 20 bp, Homo sapiens
cctcaacctcttctggctca

SEQ ID NO: 2248763 - DNA, 13 bp, Homo sapiens
cctcacagtgaac

SEQ ID NO: 2248764 - DNA, 21 bp, Homo sapiens
cctcaccccctcccaccccca

SEQ ID NO: 2248765 - DNA, 20 bp, Homo sapiens
cctcactatggtatgctggc

SEQ ID NO: 2248766 - DNA, 22 bp, Homo sapiens
cctcactatggtatgctggcca

SEQ ID NO: 2248767 - DNA, 24 bp, Homo sapiens
cctcactatggtatgctggccagc

SEQ ID NO: 2248768 - DNA, 14 bp, Homo sapiens
cctcactctgtcag

SEQ ID NO: 2248769 - DNA, 16 bp, Homo sapiens
cctcactctgtcagcc

SEQ ID NO: 2248770 - DNA, 17 bp, Homo sapiens
cctcactctgtcagcca

SEQ ID NO: 2248771 - DNA, 16 bp, Homo sapiens
cctcagaaggccccag

SEQ ID NO: 2248772 - DNA, 11 bp, Homo sapiens
cctcagccctc

SEQ ID NO: 2248773 - DNA, 12 bp, Homo sapiens
cctcagccctca

SEQ ID NO: 2248774 - DNA, 14 bp, Homo sapiens
cctcagccctcaga

SEQ ID NO: 2248775 - DNA, 16 bp, Homo sapiens
cctcagccctcagaac

SEQ ID NO: 2248776 - DNA, 15 bp, Homo sapiens
cctcagttcaacctg

SEQ ID NO: 2248777 - DNA, 23 bp, Homo sapiens
cctcagttcaacctggtggcacc

SEQ ID NO: 2248778 - DNA, 20 bp, Homo sapiens
cctcatcccgtgttctcctt

SEQ ID NO: 2248779 - DNA, 14 bp, Homo sapiens
cctcattggccagc

SEQ ID NO: 2248780 - DNA, 19 bp, Homo sapiens
cctccaagtctgtacctca

SEQ ID NO: 2248781 - DNA, 14 bp, Homo sapiens
cctccacagagagg

SEQ ID NO: 2248782 - DNA, 13 bp, Homo sapiens
cctccacgcctcc

SEQ ID NO: 2248783 - DNA, 17 bp, Homo sapiens
cctccacgcctcctggc

SEQ ID NO: 2248784 - DNA, 20 bp, Homo sapiens
cctccacgcctcctggccag

SEQ ID NO: 2248785 - DNA, 21 bp, Homo sapiens
cctccacgcctcctggccaga

SEQ ID NO: 2248786 - DNA, 21 bp, Homo sapiens
cctccagaactcactggggcc

SEQ ID NO: 2248787 - DNA, 12 bp, Homo sapiens
cctccagggcat

SEQ ID NO: 2248788 - DNA, 15 bp, Homo sapiens
cctccagggcattgc

SEQ ID NO: 2248789 - DNA, 20 bp, Homo sapiens
cctccagggcattgctcagc

SEQ ID NO: 2248790 - DNA, 22 bp, Homo sapiens
cctccagggcattgctcagccc

SEQ ID NO: 2248791 - DNA, 12 bp, Homo sapiens
cctcccaccaga

SEQ ID NO: 2248792 - DNA, 13 bp, Homo sapiens
cctcccaccagag

SEQ ID NO: 2248793 - DNA, 14 bp, Homo sapiens
cctcccaccagagc

SEQ ID NO: 2248794 - DNA, 15 bp, Homo sapiens
cctcccaccagagcc

SEQ ID NO: 2248795 - DNA, 20 bp, Homo sapiens
cctcccaggaagcccaggag

SEQ ID NO: 2248796 - DNA, 20 bp, Homo sapiens
cctccccctttcacactgga

SEQ ID NO: 2248797 - DNA, 21 bp, Homo sapiens
cctccccgcgccccagtcact

SEQ ID NO: 2248798 - DNA, 11 bp, Homo sapiens
cctcccctctc

SEQ ID NO: 2248799 - DNA, 14 bp, Homo sapiens
cctcccgctgcaag

SEQ ID NO: 2248800 - DNA, 15 bp, Homo sapiens
cctccctccacccca

SEQ ID NO: 2248801 - DNA, 18 bp, Homo sapiens
cctccctgactccctgtg

SEQ ID NO: 2248802 - DNA, 14 bp, Homo sapiens
cctccgtcctctcc

SEQ ID NO: 2248803 - DNA, 14 bp, Homo sapiens
cctcctccccactt

SEQ ID NO: 2248804 - DNA, 13 bp, Homo sapiens
cctcctcccccag

SEQ ID NO: 2248805 - DNA, 23 bp, Homo sapiens
cctcctccccgcgccccagtcac

SEQ ID NO: 2248806 - DNA, 13 bp, Homo sapiens
cctcctggccaga

SEQ ID NO: 2248807 - DNA, 17 bp, Homo sapiens
cctcctggccagacgct

SEQ ID NO: 2248808 - DNA, 20 bp, Homo sapiens
cctcctgtgtggaagaagga

SEQ ID NO: 2248809 - DNA, 14 bp, Homo sapiens
cctccttcagacac

SEQ ID NO: 2248810 - DNA, 15 bp, Homo sapiens
cctccttcagacacc

SEQ ID NO: 2248811 - DNA, 22 bp, Homo sapiens
cctccttcagacaccctcaacc

SEQ ID NO: 2248812 - DNA, 13 bp, Homo sapiens
cctcgtcaagagc

SEQ ID NO: 2248813 - DNA, 22 bp, Homo sapiens
cctcgtcaagagcatgcacatg

SEQ ID NO: 2248814 - DNA, 19 bp, Homo sapiens
cctctaaggttgggcaggg

SEQ ID NO: 2248815 - DNA, 16 bp, Homo sapiens
cctctaccagaactaa

SEQ ID NO: 2248816 - DNA, 21 bp, Homo sapiens
cctctatttatgtttgcactt

SEQ ID NO: 2248817 - DNA, 13 bp, Homo sapiens
cctctcagctcca

SEQ ID NO: 2248818 - DNA, 18 bp, Homo sapiens
cctctcagctccaggtgg

SEQ ID NO: 2248819 - DNA, 18 bp, Homo sapiens
cctctccccagcctggca

SEQ ID NO: 2248820 - DNA, 15 bp, Homo sapiens
cctctccctctctct

SEQ ID NO: 2248821 - DNA, 12 bp, Homo sapiens
cctctcctgggg

SEQ ID NO: 2248822 - DNA, 14 bp, Homo sapiens
cctctcgagcccag

SEQ ID NO: 2248823 - DNA, 17 bp, Homo sapiens
cctctcggtgacctccg

SEQ ID NO: 2248824 - DNA, 23 bp, Homo sapiens
cctctctccttggccacagactg

SEQ ID NO: 2248825 - DNA, 15 bp, Homo sapiens
cctctgacagtccac

SEQ ID NO: 2248826 - DNA, 14 bp, Homo sapiens
cctctgacctgcac

SEQ ID NO: 2248827 - DNA, 16 bp, Homo sapiens
cctctgacctgcactg

SEQ ID NO: 2248828 - DNA, 20 bp, Homo sapiens
cctctgcacaccctccagag

SEQ ID NO: 2248829 - DNA, 15 bp, Homo sapiens
cctctgcccttcctg

SEQ ID NO: 2248830 - DNA, 14 bp, Homo sapiens
cctctgctccccag

SEQ ID NO: 2248831 - DNA, 15 bp, Homo sapiens
cctctgcttttatct

SEQ ID NO: 2248832 - DNA, 21 bp, Homo sapiens
cctctgtgccttcttttgatt

SEQ ID NO: 2248833 - DNA, 15 bp, Homo sapiens
cctcttctggctcaa

SEQ ID NO: 2248834 - DNA, 13 bp, Homo sapiens
cctgacattgtct

SEQ ID NO: 2248835 - DNA, 16 bp, Homo sapiens
cctgacccctgcctgt

SEQ ID NO: 2248836 - DNA, 15 bp, Homo sapiens
cctgactccctgtgg

SEQ ID NO: 2248837 - DNA, 17 bp, Homo sapiens
cctgcaagaccacggag

SEQ ID NO: 2248838 - DNA, 18 bp, Homo sapiens
cctgcaagaccacggagg

SEQ ID NO: 2248839 - DNA, 22 bp, Homo sapiens
cctgcaatgtggtgacacctcc

SEQ ID NO: 2248840 - DNA, 23 bp, Homo sapiens
cctgcaatgtggtgacacctccc

SEQ ID NO: 2248841 - DNA, 14 bp, Homo sapiens
cctgcactggggag

SEQ ID NO: 2248842 - DNA, 23 bp, Homo sapiens
cctgcaggcaggaacaaacaggg

SEQ ID NO: 2248843 - DNA, 21 bp, Homo sapiens
cctgcatctctgtgaagcctc

SEQ ID NO: 2248844 - DNA, 22 bp, Homo sapiens
cctgcccatgtgtcccctcact

SEQ ID NO: 2248845 - DNA, 13 bp, Homo sapiens
cctgccccacccc

SEQ ID NO: 2248846 - DNA, 21 bp, Homo sapiens
cctgccccaccccatccagcc

SEQ ID NO: 2248847 - DNA, 24 bp, Homo sapiens
cctgccccaccccatccagccaga

SEQ ID NO: 2248848 - DNA, 15 bp, Homo sapiens
cctgccccccagcct

SEQ ID NO: 2248849 - DNA, 21 bp, Homo sapiens
cctgcctgttggcaggcccac

SEQ ID NO: 2248850 - DNA, 17 bp, Homo sapiens
cctgctgattgattttt

SEQ ID NO: 2248851 - DNA, 20 bp, Homo sapiens
cctgcttttgcataatgcaa

SEQ ID NO: 2248852 - DNA, 16 bp, Homo sapiens
cctggacttgcctctg

SEQ ID NO: 2248853 - DNA, 22 bp, Homo sapiens
cctggaggcactgaagtgctta

SEQ ID NO: 2248854 - DNA, 17 bp, Homo sapiens
cctggcacaggccgagg

SEQ ID NO: 2248855 - DNA, 23 bp, Homo sapiens
cctggcactaacgttgagcccct

SEQ ID NO: 2248856 - DNA, 17 bp, Homo sapiens
cctggcaggatgctgag

SEQ ID NO: 2248857 - DNA, 21 bp, Homo sapiens
cctggcaggatgctgagcttg

SEQ ID NO: 2248858 - DNA, 13 bp, Homo sapiens
cctggccagacgc

SEQ ID NO: 2248859 - DNA, 16 bp, Homo sapiens
ctcccccagacacagc

SEQ ID NO: 2248860 - DNA, 14 bp, Homo sapiens
ctccccctcagatg

SEQ ID NO: 2248861 - DNA, 20 bp, Homo sapiens
ctccccctttcacactggat

SEQ ID NO: 2248862 - DNA, 22 bp, Homo sapiens
ctccccctttcacactggatcc

SEQ ID NO: 2248863 - DNA, 20 bp, Homo sapiens
ctccccgcgccccagtcact

SEQ ID NO: 2248864 - DNA, 22 bp, Homo sapiens
ctccccgggaccgcgctagggc

SEQ ID NO: 2248865 - DNA, 14 bp, Homo sapiens
ctcccctattttaa

SEQ ID NO: 2248866 - DNA, 19 bp, Homo sapiens
ctcccctattttaagacgt

SEQ ID NO: 2248867 - DNA, 14 bp, Homo sapiens
ctcccctgtacctt

SEQ ID NO: 2248868 - DNA, 12 bp, Homo sapiens
ctccctccaccc

SEQ ID NO: 2248869 - DNA, 14 bp, Homo sapiens
ctccctccacccca

SEQ ID NO: 2248870 - DNA, 18 bp, Homo sapiens
ctccctccaccccaggac

SEQ ID NO: 2248871 - DNA, 12 bp, Homo sapiens
ctccctctctct

SEQ ID NO: 2248872 - DNA, 16 bp, Homo sapiens
ctccctgactccctgt

SEQ ID NO: 2248873 - DNA, 17 bp, Homo sapiens
ctccctgactccctgtg

SEQ ID NO: 2248874 - DNA, 22 bp, Homo sapiens
ctccctgtagtgaatcctctgt

SEQ ID NO: 2248875 - DNA, 23 bp, Homo sapiens
ctccctgtgggggtggccatccc

SEQ ID NO: 2248876 - DNA, 12 bp, Homo sapiens
ctcccttgctgg

SEQ ID NO: 2248877 - DNA, 14 bp, Homo sapiens
ctcccttgctggcc

SEQ ID NO: 2248878 - DNA, 15 bp, Homo sapiens
ctcccttgctggccc

SEQ ID NO: 2248879 - DNA, 18 bp, Homo sapiens
ctccgggtgtggcctcag

SEQ ID NO: 2248880 - DNA, 20 bp, Homo sapiens
ctccgggtgtggcctcagcc

SEQ ID NO: 2248881 - DNA, 23 bp, Homo sapiens
ctccgggtgtggcctcagccctc

SEQ ID NO: 2248882 - DNA, 18 bp, Homo sapiens
ctccgtcctctccccagc

SEQ ID NO: 2248883 - DNA, 18 bp, Homo sapiens
ctcctaactttggaccta

SEQ ID NO: 2248884 - DNA, 17 bp, Homo sapiens
ctcctctagctgtgggg

SEQ ID NO: 2248885 - DNA, 17 bp, Homo sapiens
ctcctgctgtctacctc

SEQ ID NO: 2248886 - DNA, 20 bp, Homo sapiens
ctcctgtaacatactggcct

SEQ ID NO: 2248887 - DNA, 23 bp, Homo sapiens
ctcctgtaacatactggcctgga

SEQ ID NO: 2248888 - DNA, 15 bp, Homo sapiens
ctccttcactgtttc

SEQ ID NO: 2248889 - DNA, 16 bp, Homo sapiens
ctccttggccacagac

SEQ ID NO: 2248890 - DNA, 23 bp, Homo sapiens
ctcgagggcagggaccacaccct

SEQ ID NO: 2248891 - DNA, 20 bp, Homo sapiens
ctcgcagggaatgcagcagg

SEQ ID NO: 2248892 - DNA, 17 bp, Homo sapiens
ctcgccggatctgaggg

SEQ ID NO: 2248893 - DNA, 18 bp, Homo sapiens
ctcgccgtgtctcagcct

SEQ ID NO: 2248894 - DNA, 14 bp, Homo sapiens
ctcgggtgcatttg

SEQ ID NO: 2248895 - DNA, 15 bp, Homo sapiens
ctcggtttgccaaaa

SEQ ID NO: 2248896 - DNA, 16 bp, Homo sapiens
ctcggtttgccaaaat

SEQ ID NO: 2248897 - DNA, 18 bp, Homo sapiens
ctcgtcaagagcatgcac

SEQ ID NO: 2248898 - DNA, 24 bp, Homo sapiens
ctcgtcaagagcatgcacatgctg

SEQ ID NO: 2248899 - DNA, 19 bp, Homo sapiens
ctctaacagtggacaaagt

SEQ ID NO: 2248900 - DNA, 15 bp, Homo sapiens
ctctacactcttgta

SEQ ID NO: 2248901 - DNA, 17 bp, Homo sapiens
ctctacatcttctgcct

SEQ ID NO: 2248902 - DNA, 16 bp, Homo sapiens
ctctagctgtgggggt

SEQ ID NO: 2248903 - DNA, 16 bp, Homo sapiens
ctctataaggcagcct

SEQ ID NO: 2248904 - DNA, 14 bp, Homo sapiens
ctctcaagtaatat

SEQ ID NO: 2248905 - DNA, 13 bp, Homo sapiens
ctctcagagccct

SEQ ID NO: 2248906 - DNA, 13 bp, Homo sapiens
ctctcagctccag

SEQ ID NO: 2248907 - DNA, 18 bp, Homo sapiens
ctctccccagcctggcac

SEQ ID NO: 2248908 - DNA, 23 bp, Homo sapiens
ctctcccggaggttgggtgggcc

SEQ ID NO: 2248909 - DNA, 12 bp, Homo sapiens
ctctctccagat

SEQ ID NO: 2248910 - DNA, 12 bp, Homo sapiens
ctctctctctct

SEQ ID NO: 2248911 - DNA, 12 bp, Homo sapiens
ctctctcttcct

SEQ ID NO: 2248912 - DNA, 23 bp, Homo sapiens
ctctctgccatggccttggcagg

SEQ ID NO: 2248913 - DNA, 17 bp, Homo sapiens
ctctctggggccctggg

SEQ ID NO: 2248914 - DNA, 19 bp, Homo sapiens
ctctctggggccctgggcc

SEQ ID NO: 2248915 - DNA, 20 bp, Homo sapiens
ctctctggggccctgggcct

SEQ ID NO: 2248916 - DNA, 22 bp, Homo sapiens
ctctctggggccctgggcctca

SEQ ID NO: 2248917 - DNA, 15 bp, Homo sapiens
ctctctgtgtctttc

SEQ ID NO: 2248918 - DNA, 20 bp, Homo sapiens
ctctctgtgtctttctctct

SEQ ID NO: 2248919 - DNA, 10 bp, Homo sapiens
ctctcttttc

SEQ ID NO: 2248920 - DNA, 12 bp, Homo sapiens
ctctcttttcat

SEQ ID NO: 2248921 - DNA, 15 bp, Homo sapiens
ctctcttttcattgt

SEQ ID NO: 2248922 - DNA, 19 bp, Homo sapiens
ctctcttttcattgtgtat

SEQ ID NO: 2248923 - DNA, 19 bp, Homo sapiens
ctctgaagaactctctgga

SEQ ID NO: 2248924 - DNA, 16 bp, Homo sapiens
ctctgacagtccacag

SEQ ID NO: 2248925 - DNA, 17 bp, Homo sapiens
ctctgacagtccacagg

SEQ ID NO: 2248926 - DNA, 12 bp, Homo sapiens
ctctgaggacaa

SEQ ID NO: 2248927 - DNA, 16 bp, Homo sapiens
ctctgcaattcccctc

SEQ ID NO: 2248928 - DNA, 18 bp, Homo sapiens
ctctgcaattcccctctg

SEQ ID NO: 2248929 - DNA, 19 bp, Homo sapiens
ctctgcaattcccctctgc

SEQ ID NO: 2248930 - DNA, 21 bp, Homo sapiens
ctctgcaattcccctctgctg

SEQ ID NO: 2248931 - DNA, 22 bp, Homo sapiens
ctctgcaattcccctctgctgc

SEQ ID NO: 2248932 - DNA, 20 bp, Homo sapiens
ctctgcacaccctccagaga

SEQ ID NO: 2248933 - DNA, 20 bp, Homo sapiens
ctctgccatggccttggcag

SEQ ID NO: 2248934 - DNA, 19 bp, Homo sapiens
ctctgccccctcccccatg

SEQ ID NO: 2248935 - DNA, 22 bp, Homo sapiens
ctctgctgctgtccctccccct

SEQ ID NO: 2248936 - DNA, 14 bp, Homo sapiens
ctctggagcatttc

SEQ ID NO: 2248937 - DNA, 21 bp, Homo sapiens
ctctggaggggtgtggctcct

SEQ ID NO: 2248938 - DNA, 18 bp, Homo sapiens
ctctggcattagaattat

SEQ ID NO: 2248939 - DNA, 19 bp, Homo sapiens
ctctggcattagaattatt

SEQ ID NO: 2248940 - DNA, 14 bp, Homo sapiens
ctctgtcagccagc

SEQ ID NO: 2248941 - DNA, 21 bp, Homo sapiens
ctctgtcagccagccgccctg

SEQ ID NO: 2248942 - DNA, 15 bp, Homo sapiens
ctctgtgccttcttt

SEQ ID NO: 2248943 - DNA, 14 bp, Homo sapiens
ctctgtgtctttct

SEQ ID NO: 2248944 - DNA, 22 bp, Homo sapiens
ctctgttacactttttggaagt

SEQ ID NO: 2248945 - DNA, 19 bp, Homo sapiens
ctcttcattcaaactgcac

SEQ ID NO: 2248946 - DNA, 21 bp, Homo sapiens
ctcttccagctgcttcaggga

SEQ ID NO: 2248947 - DNA, 11 bp, Homo sapiens
ctcttctggct

SEQ ID NO: 2248948 - DNA, 21 bp, Homo sapiens
ctcttctggggcaggctgggc

SEQ ID NO: 2248949 - DNA, 19 bp, Homo sapiens
ctcttgatacccccctctg

SEQ ID NO: 2248950 - DNA, 15 bp, Homo sapiens
ctcttgtattaaact

SEQ ID NO: 2248951 - DNA, 23 bp, Homo sapiens
ctctttgaaatgacatgttcctt

SEQ ID NO: 2248952 - DNA, 15 bp, Homo sapiens
ctctttgtaatttaa

SEQ ID NO: 2248953 - DNA, 16 bp, Homo sapiens
ctcttttcattgtgta

SEQ ID NO: 2248954 - DNA, 22 bp, Homo sapiens
ctctttttcgtataatcttgta

SEQ ID NO: 2248955 - DNA, 24 bp, Homo sapiens
ctgaaaatattgttttacaatagt

SEQ ID NO: 2248956 - DNA, 21 bp, Homo sapiens
ctgaacaataggctgttccca

SEQ ID NO: 2248957 - DNA, 15 bp, Homo sapiens
ctgaagccaaatgaa

SEQ ID NO: 2248958 - DNA, 19 bp, Homo sapiens
ctgaagtgagcacagccta

SEQ ID NO: 2248959 - DNA, 16 bp, Homo sapiens
ctgaagtgcttagtgt

SEQ ID NO: 2248960 - DNA, 18 bp, Homo sapiens
ctgaagttgcagatgtta

SEQ ID NO: 2248961 - DNA, 22 bp, Homo sapiens
ctgaatgtcattgaaaaactaa

SEQ ID NO: 2248962 - DNA, 15 bp, Homo sapiens
ctgaatgttgggact

SEQ ID NO: 2248963 - DNA, 22 bp, Homo sapiens
ctgacaaggcacttcatgtaaa

SEQ ID NO: 2248964 - DNA, 17 bp, Homo sapiens
ctgacagtccacagggg

SEQ ID NO: 2248965 - DNA, 23 bp, Homo sapiens
ctgaccatgcgtcaggggcctag

SEQ ID NO: 2248966 - DNA, 13 bp, Homo sapiens
ctgacccctgcct

SEQ ID NO: 2248967 - DNA, 21 bp, Homo sapiens
ctttttatttctaaatgagac

SEQ ID NO: 2248968 - DNA, 18 bp, Homo sapiens
cttttttaaatattttct

SEQ ID NO: 2248969 - DNA, 22 bp, Homo sapiens
cttttttaaatattttctattt

SEQ ID NO: 2248970 - DNA, 15 bp, Homo sapiens
cttttttaaattaat

SEQ ID NO: 2248971 - DNA, 16 bp, Homo sapiens
ctttttttccttttta

SEQ ID NO: 2248972 - DNA, 13 bp, Homo sapiens
gaaaaaaagaaaa

SEQ ID NO: 2248973 - DNA, 11 bp, Homo sapiens
gaaaaactgct

SEQ ID NO: 2248974 - DNA, 21 bp, Homo sapiens
gaaaacagctagtagacatga

SEQ ID NO: 2248975 - DNA, 13 bp, Homo sapiens
gaaaacctctcct

SEQ ID NO: 2248976 - DNA, 15 bp, Homo sapiens
gaaaactgtgatttc

SEQ ID NO: 2248977 - DNA, 18 bp, Homo sapiens
gaaaagacctacagacta

SEQ ID NO: 2248978 - DNA, 22 bp, Homo sapiens
gaaaagggagtttaaaaatggt

SEQ ID NO: 2248979 - DNA, 13 bp, Homo sapiens
gaaaataggcttt

SEQ ID NO: 2248980 - DNA, 22 bp, Homo sapiens
gaaaatattgttttacaatagt

SEQ ID NO: 2248981 - DNA, 12 bp, Homo sapiens
gaaaatgcctgt

SEQ ID NO: 2248982 - DNA, 16 bp, Homo sapiens
gaaaatgttatttaac

SEQ ID NO: 2248983 - DNA, 22 bp, Homo sapiens
gaaaattacagtccaaaatact

SEQ ID NO: 2248984 - DNA, 22 bp, Homo sapiens
gaaaattctaacccaggtatcc

SEQ ID NO: 2248985 - DNA, 21 bp, Homo sapiens
gaaaattgtttagtgatatta

SEQ ID NO: 2248986 - DNA, 18 bp, Homo sapiens
gaaacaccgagtctctgt

SEQ ID NO: 2248987 - DNA, 18 bp, Homo sapiens
gaaacctcattggccagc

SEQ ID NO: 2248988 - DNA, 16 bp, Homo sapiens
gaaacctgggattcag

SEQ ID NO: 2248989 - DNA, 13 bp, Homo sapiens
gaaacgtggcagg

SEQ ID NO: 2248990 - DNA, 19 bp, Homo sapiens
gaaactatgtgtttttctc

SEQ ID NO: 2248991 - DNA, 20 bp, Homo sapiens
gaaactatgtgtttttctca

SEQ ID NO: 2248992 - DNA, 18 bp, Homo sapiens
gaaactcatagacactga

SEQ ID NO: 2248993 - DNA, 13 bp, Homo sapiens
gaaactgggaaac

SEQ ID NO: 2248994 - DNA, 15 bp, Homo sapiens
gaaactgggaaactg

SEQ ID NO: 2248995 - DNA, 14 bp, Homo sapiens
gaaagccctccccc

SEQ ID NO: 2248996 - DNA, 21 bp, Homo sapiens
gaaagccctcccccttcccct

SEQ ID NO: 2248997 - DNA, 19 bp, Homo sapiens
gaaagctggtggcagagtc

SEQ ID NO: 2248998 - DNA, 22 bp, Homo sapiens
gaaagctttattttgagatgta

SEQ ID NO: 2248999 - DNA, 18 bp, Homo sapiens
gaaaggaactgcaataat

SEQ ID NO: 2249000 - DNA, 19 bp, Homo sapiens
gaaaggattttaccaaagc

SEQ ID NO: 2249001 - DNA, 24 bp, Homo sapiens
gaaaggattttaccaaagcatcaa

SEQ ID NO: 2249002 - DNA, 15 bp, Homo sapiens
gaaagttttgttctg

SEQ ID NO: 2249003 - DNA, 22 bp, Homo sapiens
gaaatctaaatttcttttgcta

SEQ ID NO: 2249004 - DNA, 12 bp, Homo sapiens
gaaatgaaaggg

SEQ ID NO: 2249005 - DNA, 11 bp, Homo sapiens
gaaatgagctc

SEQ ID NO: 2249006 - DNA, 21 bp, Homo sapiens
gaaatgtgaatttttattgtt

SEQ ID NO: 2249007 - DNA, 22 bp, Homo sapiens
gaaattctttcccagtctgtcg

SEQ ID NO: 2249008 - DNA, 23 bp, Homo sapiens
gaaattctttcccagtctgtcga

SEQ ID NO: 2249009 - DNA, 21 bp, Homo sapiens
gaaattgacacaagtggacct

SEQ ID NO: 2249010 - DNA, 18 bp, Homo sapiens
gaaattgctttgtattgt

SEQ ID NO: 2249011 - DNA, 14 bp, Homo sapiens
gaacaaattatttt

SEQ ID NO: 2249012 - DNA, 17 bp, Homo sapiens
gaacatcacattcctct

SEQ ID NO: 2249013 - DNA, 15 bp, Homo sapiens
gaacattggttcttt

SEQ ID NO: 2249014 - DNA, 18 bp, Homo sapiens
gaacccttttaaagttga

SEQ ID NO: 2249015 - DNA, 17 bp, Homo sapiens
gaacctgctacttaaaa

SEQ ID NO: 2249016 - DNA, 10 bp, Homo sapiens
gaaccttccc

SEQ ID NO: 2249017 - DNA, 20 bp, Homo sapiens
gaacgcggtgtgtaacactg

SEQ ID NO: 2249018 - DNA, 19 bp, Homo sapiens
gaacgttttttcctcagtg

SEQ ID NO: 2249019 - DNA, 13 bp, Homo sapiens
gaactaaactagt

SEQ ID NO: 2249020 - DNA, 19 bp, Homo sapiens
gaactaaactagtttttcc

SEQ ID NO: 2249021 - DNA, 22 bp, Homo sapiens
gaactaaactagtttttcctat

SEQ ID NO: 2249022 - DNA, 16 bp, Homo sapiens
gaactctctgcctgta

SEQ ID NO: 2249023 - DNA, 22 bp, Homo sapiens
gaacttgttacttgcagcattc

SEQ ID NO: 2249024 - DNA, 17 bp, Homo sapiens
gaactttccaaaaccta

SEQ ID NO: 2249025 - DNA, 21 bp, Homo sapiens
gaagaaaactatcctgcgggt

SEQ ID NO: 2249026 - DNA, 22 bp, Homo sapiens
gaagaactgtgtttcaagttca

SEQ ID NO: 2249027 - DNA, 16 bp, Homo sapiens
gaagaagggcacccta

SEQ ID NO: 2249028 - DNA, 16 bp, Homo sapiens
gaagacactgcagtga

SEQ ID NO: 2249029 - DNA, 19 bp, Homo sapiens
gaagacctcacctagaaat

SEQ ID NO: 2249030 - DNA, 17 bp, Homo sapiens
gaagagatgacaaacca

SEQ ID NO: 2249031 - DNA, 21 bp, Homo sapiens
gaagataagtgtatttttcaa

SEQ ID NO: 2249032 - DNA, 21 bp, Homo sapiens
gaagatccagctgcctattga

SEQ ID NO: 2249033 - DNA, 15 bp, Homo sapiens
gaagccaaatgaaac

SEQ ID NO: 2249034 - DNA, 16 bp, Homo sapiens
gaagccacgctgtcct

SEQ ID NO: 2249035 - DNA, 19 bp, Homo sapiens
gaagccacgctgtcctctc

SEQ ID NO: 2249036 - DNA, 13 bp, Homo sapiens
gaagccttctgca

SEQ ID NO: 2249037 - DNA, 18 bp, Homo sapiens
gaagcggagagagccaag

SEQ ID NO: 2249038 - DNA, 22 bp, Homo sapiens
gaagctttgtaggtgagatgca

SEQ ID NO: 2249039 - DNA, 15 bp, Homo sapiens
gaaggaacaaagaca

SEQ ID NO: 2249040 - DNA, 22 bp, Homo sapiens
gaaggcagggggaaggtggggt

SEQ ID NO: 2249041 - DNA, 16 bp, Homo sapiens
gaaggccccagagaga

SEQ ID NO: 2249042 - DNA, 22 bp, Homo sapiens
gaaggccccagagagaccctgc

SEQ ID NO: 2249043 - DNA, 23 bp, Homo sapiens
gaagggagaagacactgcagtga

SEQ ID NO: 2249044 - DNA, 15 bp, Homo sapiens
gaaggggctgaggac

SEQ ID NO: 2249045 - DNA, 16 bp, Homo sapiens
gaagtcaatatgtgga

SEQ ID NO: 2249046 - DNA, 20 bp, Homo sapiens
gaagtgctggcaaccactaa

SEQ ID NO: 2249047 - DNA, 14 bp, Homo sapiens
gaagtttggctgct

SEQ ID NO: 2249048 - DNA, 12 bp, Homo sapiens
gaataagttatt

SEQ ID NO: 2249049 - DNA, 14 bp, Homo sapiens
gaataataaaatca

SEQ ID NO: 2249050 - DNA, 14 bp, Homo sapiens
gaatataagaaaat

SEQ ID NO: 2249051 - DNA, 12 bp, Homo sapiens
gaatccaaactt

SEQ ID NO: 2249052 - DNA, 13 bp, Homo sapiens
gaatccaaacttg

SEQ ID NO: 2249053 - DNA, 16 bp, Homo sapiens
gaatctggagaccagg

SEQ ID NO: 2249054 - DNA, 18 bp, Homo sapiens
gaatctggagaccaggga

SEQ ID NO: 2249055 - DNA, 23 bp, Homo sapiens
gaatcttttggattttaagcagt

SEQ ID NO: 2249056 - DNA, 21 bp, Homo sapiens
gaatgaacttgttacttgcag

SEQ ID NO: 2249057 - DNA, 16 bp, Homo sapiens
gaatgtatttatttgg

SEQ ID NO: 2249058 - DNA, 23 bp, Homo sapiens
gaatgtatttatttgggagaccg

SEQ ID NO: 2249059 - DNA, 11 bp, Homo sapiens
gaatgtctcag

SEQ ID NO: 2249060 - DNA, 14 bp, Homo sapiens
gaatgttgggactg

SEQ ID NO: 2249061 - DNA, 16 bp, Homo sapiens
gaattcaaactggggc

SEQ ID NO: 2249062 - DNA, 22 bp, Homo sapiens
gaattcaaactggggcctccag

SEQ ID NO: 2249063 - DNA, 23 bp, Homo sapiens
gaattcaaactggggcctccaga

SEQ ID NO: 2249064 - DNA, 15 bp, Homo sapiens
gaattccctccccct

SEQ ID NO: 2249065 - DNA, 16 bp, Homo sapiens
gaattgaactctctgc

SEQ ID NO: 2249066 - DNA, 14 bp, Homo sapiens
gaattgggtttctg

SEQ ID NO: 2249067 - DNA, 16 bp, Homo sapiens
gaatttaggtttttat

SEQ ID NO: 2249068 - DNA, 14 bp, Homo sapiens
gaatttgggcagat

SEQ ID NO: 2249069 - DNA, 19 bp, Homo sapiens
gaatttgtccaattgtgta

SEQ ID NO: 2249070 - DNA, 16 bp, Homo sapiens
gaattttaaataatgt

SEQ ID NO: 2249071 - DNA, 22 bp, Homo sapiens
gacaaaccataactgacaagag

SEQ ID NO: 2249072 - DNA, 20 bp, Homo sapiens
gacaacacttcattttcagg

SEQ ID NO: 2249073 - DNA, 19 bp, Homo sapiens
gacaaccttgtcccaagga

SEQ ID NO: 2249074 - DNA, 19 bp, Homo sapiens
gacaatgttgtagtgtccc

SEQ ID NO: 2249075 - DNA, 23 bp, Homo sapiens
gcccatgtgtcccctcactctgt

SEQ ID NO: 2249076 - DNA, 22 bp, Homo sapiens
gccccaccccatccagccagac

SEQ ID NO: 2249077 - DNA, 23 bp, Homo sapiens
gccccactcccttgctggcccca

SEQ ID NO: 2249078 - DNA, 14 bp, Homo sapiens
gccccagccctgct

SEQ ID NO: 2249079 - DNA, 11 bp, Homo sapiens
gccccaggccc

SEQ ID NO: 2249080 - DNA, 13 bp, Homo sapiens
gccccaggccctc

SEQ ID NO: 2249081 - DNA, 15 bp, Homo sapiens
gccccaggccctccc

SEQ ID NO: 2249082 - DNA, 17 bp, Homo sapiens
gccccaggccctccctg

SEQ ID NO: 2249083 - DNA, 16 bp, Homo sapiens
gccccctcctctagct

SEQ ID NO: 2249084 - DNA, 15 bp, Homo sapiens
gccccctggcctctg

SEQ ID NO: 2249085 - DNA, 16 bp, Homo sapiens
gccccctggcctctgt

SEQ ID NO: 2249086 - DNA, 16 bp, Homo sapiens
gccccgactccagcca

SEQ ID NO: 2249087 - DNA, 20 bp, Homo sapiens
gccccgactccagccagcgc

SEQ ID NO: 2249088 - DNA, 21 bp, Homo sapiens
gccccgactccagccagcgcc

SEQ ID NO: 2249089 - DNA, 16 bp, Homo sapiens
gccccgtgtgcacacc

SEQ ID NO: 2249090 - DNA, 17 bp, Homo sapiens
gcccctcagcgccccca

SEQ ID NO: 2249091 - DNA, 19 bp, Homo sapiens
gcccctcagcgcccccaga

SEQ ID NO: 2249092 - DNA, 16 bp, Homo sapiens
gcccctccacgcctcc

SEQ ID NO: 2249093 - DNA, 20 bp, Homo sapiens
gcccctccacgcctcctggc

SEQ ID NO: 2249094 - DNA, 14 bp, Homo sapiens
gcccctctcaccaa

SEQ ID NO: 2249095 - DNA, 16 bp, Homo sapiens
gcccctggacttctta

SEQ ID NO: 2249096 - DNA, 22 bp, Homo sapiens
gcccctgggatgggaccaggga

SEQ ID NO: 2249097 - DNA, 14 bp, Homo sapiens
gcccgcttggccac

SEQ ID NO: 2249098 - DNA, 14 bp, Homo sapiens
gcccgtcagcgtgg

SEQ ID NO: 2249099 - DNA, 17 bp, Homo sapiens
gccctcaactattctgt

SEQ ID NO: 2249100 - DNA, 22 bp, Homo sapiens
gccctcaactattctgttccac

SEQ ID NO: 2249101 - DNA, 12 bp, Homo sapiens
gccctcagaaca

SEQ ID NO: 2249102 - DNA, 19 bp, Homo sapiens
gccctccccatggagccag

SEQ ID NO: 2249103 - DNA, 23 bp, Homo sapiens
gccctccctgactccctgtgggg

SEQ ID NO: 2249104 - DNA, 15 bp, Homo sapiens
gccctgccccacccc

SEQ ID NO: 2249105 - DNA, 13 bp, Homo sapiens
gccctgctgggga

SEQ ID NO: 2249106 - DNA, 13 bp, Homo sapiens
gccctgggcctca

SEQ ID NO: 2249107 - DNA, 22 bp, Homo sapiens
gccctgggctgtctgtcaccag

SEQ ID NO: 2249108 - DNA, 23 bp, Homo sapiens
gccctgggctgtctgtcaccagc

SEQ ID NO: 2249109 - DNA, 19 bp, Homo sapiens
gccctggggatcttcccac

SEQ ID NO: 2249110 - DNA, 21 bp, Homo sapiens
gccctggggatcttcccacag

SEQ ID NO: 2249111 - DNA, 16 bp, Homo sapiens
gccctggtttgttttc

SEQ ID NO: 2249112 - DNA, 19 bp, Homo sapiens
gcccttttcccctaccaat

SEQ ID NO: 2249113 - DNA, 16 bp, Homo sapiens
gccgctgccgctgcac

SEQ ID NO: 2249114 - DNA, 17 bp, Homo sapiens
gccgctgccgctgcacc

SEQ ID NO: 2249115 - DNA, 22 bp, Homo sapiens
gccgctggctggtgggccccca

SEQ ID NO: 2249116 - DNA, 20 bp, Homo sapiens
gccgctgtgcccccctcctc

SEQ ID NO: 2249117 - DNA, 18 bp, Homo sapiens
gccgggcaggtcctgccc

SEQ ID NO: 2249118 - DNA, 15 bp, Homo sapiens
gccgtgtctcagcct

SEQ ID NO: 2249119 - DNA, 18 bp, Homo sapiens
gccgtgtctcagcctctg

SEQ ID NO: 2249120 - DNA, 21 bp, Homo sapiens
gccgtgtctcagcctctgcca

SEQ ID NO: 2249121 - DNA, 15 bp, Homo sapiens
gcctcaaaggcccgc

SEQ ID NO: 2249122 - DNA, 19 bp, Homo sapiens
gcctcacatttttttctac

SEQ ID NO: 2249123 - DNA, 13 bp, Homo sapiens
gcctcactggggc

SEQ ID NO: 2249124 - DNA, 17 bp, Homo sapiens
gcctcactggggcagac

SEQ ID NO: 2249125 - DNA, 20 bp, Homo sapiens
gcctcagaaggccccagaga

SEQ ID NO: 2249126 - DNA, 23 bp, Homo sapiens
gcctcagaaggccccagagagac

SEQ ID NO: 2249127 - DNA, 15 bp, Homo sapiens
gcctcagccctcaga

SEQ ID NO: 2249128 - DNA, 16 bp, Homo sapiens
gcctcagccctcagaa

SEQ ID NO: 2249129 - DNA, 22 bp, Homo sapiens
gcctcagttcaacctggtggca

SEQ ID NO: 2249130 - DNA, 11 bp, Homo sapiens
gcctccagggc

SEQ ID NO: 2249131 - DNA, 15 bp, Homo sapiens
gcctccagggcattg

SEQ ID NO: 2249132 - DNA, 12 bp, Homo sapiens
gcctcccaccag

SEQ ID NO: 2249133 - DNA, 17 bp, Homo sapiens
gcctcccaccagagccg

SEQ ID NO: 2249134 - DNA, 20 bp, Homo sapiens
gcctcccaccagagccggga

SEQ ID NO: 2249135 - DNA, 14 bp, Homo sapiens
gcctccccctcaga

SEQ ID NO: 2249136 - DNA, 19 bp, Homo sapiens
gcctccctccaccccagga

SEQ ID NO: 2249137 - DNA, 15 bp, Homo sapiens
gcctcctcatcccgt

SEQ ID NO: 2249138 - DNA, 19 bp, Homo sapiens
gcctcgtgccatgatctgt

SEQ ID NO: 2249139 - DNA, 22 bp, Homo sapiens
gcctctctccttggccacagac

SEQ ID NO: 2249140 - DNA, 23 bp, Homo sapiens
gcctctctccttggccacagact

SEQ ID NO: 2249141 - DNA, 19 bp, Homo sapiens
gcctctgagaagctctgaa

SEQ ID NO: 2249142 - DNA, 20 bp, Homo sapiens
gcctgatgagatttttaaaa

SEQ ID NO: 2249143 - DNA, 16 bp, Homo sapiens
gcctgcattgagcttg

SEQ ID NO: 2249144 - DNA, 21 bp, Homo sapiens
gcctgcattgagcttgcatgc

SEQ ID NO: 2249145 - DNA, 23 bp, Homo sapiens
gcctgctgattgatttttttctc

SEQ ID NO: 2249146 - DNA, 22 bp, Homo sapiens
gcctgctgcagtcacgtgtaaa

SEQ ID NO: 2249147 - DNA, 20 bp, Homo sapiens
gcctggcaatagaccgagac

SEQ ID NO: 2249148 - DNA, 22 bp, Homo sapiens
gcctggcacaggccgaggcagg

SEQ ID NO: 2249149 - DNA, 13 bp, Homo sapiens
gcctggctctgcc

SEQ ID NO: 2249150 - DNA, 22 bp, Homo sapiens
gcctggctctgccccctccccc

SEQ ID NO: 2249151 - DNA, 16 bp, Homo sapiens
gcctgtcttaattttc

SEQ ID NO: 2249152 - DNA, 19 bp, Homo sapiens
gcctgttggcaggcccact

SEQ ID NO: 2249153 - DNA, 18 bp, Homo sapiens
gccttagtctcagtttgt

SEQ ID NO: 2249154 - DNA, 20 bp, Homo sapiens
gccttcccaagttgtgcttg

SEQ ID NO: 2249155 - DNA, 21 bp, Homo sapiens
gccttcccaagttgtgcttga

SEQ ID NO: 2249156 - DNA, 11 bp, Homo sapiens
gccttctgcag

SEQ ID NO: 2249157 - DNA, 12 bp, Homo sapiens
gccttctgcagc

SEQ ID NO: 2249158 - DNA, 12 bp, Homo sapiens
gccttggctcag

SEQ ID NO: 2249159 - DNA, 15 bp, Homo sapiens
gccttggctcagaca

SEQ ID NO: 2249160 - DNA, 19 bp, Homo sapiens
gccttttagaaacctcatt

SEQ ID NO: 2249161 - DNA, 21 bp, Homo sapiens
gcgaagccttctgcagcagga

SEQ ID NO: 2249162 - DNA, 21 bp, Homo sapiens
gcgccaacgttcgatttctac

SEQ ID NO: 2249163 - DNA, 13 bp, Homo sapiens
gcgccccagtcac

SEQ ID NO: 2249164 - DNA, 12 bp, Homo sapiens
gcgcctccctcc

SEQ ID NO: 2249165 - DNA, 14 bp, Homo sapiens
gcgcctccctccac

SEQ ID NO: 2249166 - DNA, 19 bp, Homo sapiens
gcgcgtgcatgtgtgcgtg

SEQ ID NO: 2249167 - DNA, 12 bp, Homo sapiens
gcgctcagtaaa

SEQ ID NO: 2249168 - DNA, 14 bp, Homo sapiens
gcggagagagccaa

SEQ ID NO: 2249169 - DNA, 22 bp, Homo sapiens
gcggcggtggactgcgctggac

SEQ ID NO: 2249170 - DNA, 17 bp, Homo sapiens
gcgggatcctccacaga

SEQ ID NO: 2249171 - DNA, 19 bp, Homo sapiens
gcgggatcctccacagaga

SEQ ID NO: 2249172 - DNA, 23 bp, Homo sapiens
gcggggatcagagcgcacaggga

SEQ ID NO: 2249173 - DNA, 18 bp, Homo sapiens
gcggtggactgcgctgga

SEQ ID NO: 2249174 - DNA, 14 bp, Homo sapiens
gcgtaatttaatgg

SEQ ID NO: 2249175 - DNA, 14 bp, Homo sapiens
gcgtttttttacaa

SEQ ID NO: 2249176 - DNA, 15 bp, Homo sapiens
gctaacaaactagaa

SEQ ID NO: 2249177 - DNA, 20 bp, Homo sapiens
gctactatgatttaatttga

SEQ ID NO: 2249178 - DNA, 18 bp, Homo sapiens
gctacttcctcctcccca

SEQ ID NO: 2249179 - DNA, 20 bp, Homo sapiens
gctatacacaagcaatgcaa

SEQ ID NO: 2249180 - DNA, 23 bp, Homo sapiens
gctatccttggctttcagagcca

SEQ ID NO: 2249181 - DNA, 18 bp, Homo sapiens
gctatgcgcaatgtggca

SEQ ID NO: 2249182 - DNA, 15 bp, Homo sapiens
gctatgtataaaata

SEQ ID NO: 2249183 - DNA, 17 bp, Homo sapiens
gtaaaatgtctttccaa

SEQ ID NO: 2249184 - DNA, 20 bp, Homo sapiens
gtaaacagatggcactttga

SEQ ID NO: 2249185 - DNA, 14 bp, Homo sapiens
gtaaagactggctt

SEQ ID NO: 2249186 - DNA, 15 bp, Homo sapiens
gtaaagggcaaataa

SEQ ID NO: 2249187 - DNA, 14 bp, Homo sapiens
gtaaagtgtcagaa

SEQ ID NO: 2249188 - DNA, 17 bp, Homo sapiens
gtaaagttacactttta

SEQ ID NO: 2249189 - DNA, 18 bp, Homo sapiens
gtaaagttacacttttat

SEQ ID NO: 2249190 - DNA, 20 bp, Homo sapiens
gtaaataggatttttagaat

SEQ ID NO: 2249191 - DNA, 12 bp, Homo sapiens
gtaaatgtaaac

SEQ ID NO: 2249192 - DNA, 13 bp, Homo sapiens
gtaactaaaataa

SEQ ID NO: 2249193 - DNA, 19 bp, Homo sapiens
gtaactatcaatatttaag

SEQ ID NO: 2249194 - DNA, 14 bp, Homo sapiens
gtaatttaatgaaa

SEQ ID NO: 2249195 - DNA, 14 bp, Homo sapiens
gtaattttgtgtaa

SEQ ID NO: 2249196 - DNA, 16 bp, Homo sapiens
gtaattttgtgtaaga

SEQ ID NO: 2249197 - DNA, 19 bp, Homo sapiens
gtacaacagaataatgcat

SEQ ID NO: 2249198 - DNA, 19 bp, Homo sapiens
gtacataccctggccgccc

SEQ ID NO: 2249199 - DNA, 17 bp, Homo sapiens
gtacatacgatttaagg

SEQ ID NO: 2249200 - DNA, 19 bp, Homo sapiens
gtaccatttatacaaatta

SEQ ID NO: 2249201 - DNA, 17 bp, Homo sapiens
gtaccctctcagctcca

SEQ ID NO: 2249202 - DNA, 14 bp, Homo sapiens
gtacctcaaatgaa

SEQ ID NO: 2249203 - DNA, 15 bp, Homo sapiens
gtacctcaaatgaat

SEQ ID NO: 2249204 - DNA, 19 bp, Homo sapiens
gtactccacatatttcagt

SEQ ID NO: 2249205 - DNA, 21 bp, Homo sapiens
gtactctcatcactacagtat

SEQ ID NO: 2249206 - DNA, 17 bp, Homo sapiens
gtacttttaaaaacata

SEQ ID NO: 2249207 - DNA, 16 bp, Homo sapiens
gtacttttcattctct

SEQ ID NO: 2249208 - DNA, 22 bp, Homo sapiens
gtacttttcattctcttttaat

SEQ ID NO: 2249209 - DNA, 21 bp, Homo sapiens
gtacttttttaaatattttct

SEQ ID NO: 2249210 - DNA, 15 bp, Homo sapiens
gtagaataggcaggg

SEQ ID NO: 2249211 - DNA, 13 bp, Homo sapiens
gtagacgatatac

SEQ ID NO: 2249212 - DNA, 14 bp, Homo sapiens
gtagattcaggtaa

SEQ ID NO: 2249213 - DNA, 18 bp, Homo sapiens
gtagattcaggtaataca

SEQ ID NO: 2249214 - DNA, 12 bp, Homo sapiens
gtagcaggggaa

SEQ ID NO: 2249215 - DNA, 17 bp, Homo sapiens
gtagccccctggcctct

SEQ ID NO: 2249216 - DNA, 17 bp, Homo sapiens
gtagcctgggctcactg

SEQ ID NO: 2249217 - DNA, 20 bp, Homo sapiens
gtagcctgggctcactgtgc

SEQ ID NO: 2249218 - DNA, 17 bp, Homo sapiens
gtagtagttctgtgttg

SEQ ID NO: 2249219 - DNA, 12 bp, Homo sapiens
gtagttgtcttt

SEQ ID NO: 2249220 - DNA, 14 bp, Homo sapiens
gtataaacaaagtt

SEQ ID NO: 2249221 - DNA, 21 bp, Homo sapiens
gtataagtggaggcactttag

SEQ ID NO: 2249222 - DNA, 12 bp, Homo sapiens
gtataatataaa

SEQ ID NO: 2249223 - DNA, 14 bp, Homo sapiens
gtataatataaaaa

SEQ ID NO: 2249224 - DNA, 16 bp, Homo sapiens
gtatacctcatttttc

SEQ ID NO: 2249225 - DNA, 18 bp, Homo sapiens
gtatacctcatttttcat

SEQ ID NO: 2249226 - DNA, 14 bp, Homo sapiens
gtatataaaaatgg

SEQ ID NO: 2249227 - DNA, 13 bp, Homo sapiens
gtatattacaatg

SEQ ID NO: 2249228 - DNA, 14 bp, Homo sapiens
gtatattacaatga

SEQ ID NO: 2249229 - DNA, 17 bp, Homo sapiens
gtatattacaatgatca

SEQ ID NO: 2249230 - DNA, 20 bp, Homo sapiens
gtatatttgtgatagcactt

SEQ ID NO: 2249231 - DNA, 15 bp, Homo sapiens
gtatattttgttacc

SEQ ID NO: 2249232 - DNA, 22 bp, Homo sapiens
gtatatttttatctatataaaa

SEQ ID NO: 2249233 - DNA, 14 bp, Homo sapiens
gtatcaaatacatt

SEQ ID NO: 2249234 - DNA, 21 bp, Homo sapiens
gtatcaagacgtttaactgca

SEQ ID NO: 2249235 - DNA, 13 bp, Homo sapiens
gtatcagtttcca

SEQ ID NO: 2249236 - DNA, 21 bp, Homo sapiens
gtatctaagaataataaaatc

SEQ ID NO: 2249237 - DNA, 15 bp, Homo sapiens
gtattaataaaaaga

SEQ ID NO: 2249238 - DNA, 18 bp, Homo sapiens
gtattaataaaaagacaa

SEQ ID NO: 2249239 - DNA, 22 bp, Homo sapiens
gtattcttctcttccttttatc

SEQ ID NO: 2249240 - DNA, 16 bp, Homo sapiens
gtattttcttctctgt

SEQ ID NO: 2249241 - DNA, 22 bp, Homo sapiens
gtattttttttttaaataaaag

SEQ ID NO: 2249242 - DNA, 18 bp, Homo sapiens
gtcaagattttttttgta

SEQ ID NO: 2249243 - DNA, 18 bp, Homo sapiens
gtcaaggctgcttagaat

SEQ ID NO: 2249244 - DNA, 22 bp, Homo sapiens
gtcacagtaaaaataaaatact

SEQ ID NO: 2249245 - DNA, 19 bp, Homo sapiens
gtcacgtttggtgcttctc

SEQ ID NO: 2249246 - DNA, 14 bp, Homo sapiens
gtcactcattgctg

SEQ ID NO: 2249247 - DNA, 13 bp, Homo sapiens
gtcacttttcctt

SEQ ID NO: 2249248 - DNA, 17 bp, Homo sapiens
gtcacttttccttttct

SEQ ID NO: 2249249 - DNA, 18 bp, Homo sapiens
gtcacttttttctgcctt

SEQ ID NO: 2249250 - DNA, 13 bp, Homo sapiens
gtcagattcacac

SEQ ID NO: 2249251 - DNA, 22 bp, Homo sapiens
gtcatagtcttgaaatgaaagg

SEQ ID NO: 2249252 - DNA, 18 bp, Homo sapiens
gtcatcctcacagtgaac

SEQ ID NO: 2249253 - DNA, 17 bp, Homo sapiens
gtcatctctctggggcc

SEQ ID NO: 2249254 - DNA, 22 bp, Homo sapiens
gtcatctctctggggccctggg

SEQ ID NO: 2249255 - DNA, 12 bp, Homo sapiens
gtcattaaactg

SEQ ID NO: 2249256 - DNA, 13 bp, Homo sapiens
gtcattaaactgg

SEQ ID NO: 2249257 - DNA, 15 bp, Homo sapiens
gtcattaaactggtt

SEQ ID NO: 2249258 - DNA, 17 bp, Homo sapiens
gtcattatttttgttag

SEQ ID NO: 2249259 - DNA, 16 bp, Homo sapiens
gtccaaagaggctgcc

SEQ ID NO: 2249260 - DNA, 20 bp, Homo sapiens
gtccacaggggccaccacct

SEQ ID NO: 2249261 - DNA, 12 bp, Homo sapiens
gtccagccaccc

SEQ ID NO: 2249262 - DNA, 17 bp, Homo sapiens
gtccccaaacaggacag

SEQ ID NO: 2249263 - DNA, 20 bp, Homo sapiens
gtccctccgcggctggagcg

SEQ ID NO: 2249264 - DNA, 13 bp, Homo sapiens
gtcctaaaacacc

SEQ ID NO: 2249265 - DNA, 19 bp, Homo sapiens
gtcctccctgatcccaccc

SEQ ID NO: 2249266 - DNA, 13 bp, Homo sapiens
gtcctctcgagcc

SEQ ID NO: 2249267 - DNA, 17 bp, Homo sapiens
gtcctgcccatgtgtcc

SEQ ID NO: 2249268 - DNA, 14 bp, Homo sapiens
gtcctggaggggct

SEQ ID NO: 2249269 - DNA, 11 bp, Homo sapiens
gtcctttccct

SEQ ID NO: 2249270 - DNA, 15 bp, Homo sapiens
gtcgccccaggccct

SEQ ID NO: 2249271 - DNA, 18 bp, Homo sapiens
gtcgccccaggccctccc

SEQ ID NO: 2249272 - DNA, 21 bp, Homo sapiens
gtctaaacaatgctgatttgg

SEQ ID NO: 2249273 - DNA, 20 bp, Homo sapiens
gtctagtaattgggaaaaaa

SEQ ID NO: 2249274 - DNA, 17 bp, Homo sapiens
gtctcagcctctgccag

SEQ ID NO: 2249275 - DNA, 18 bp, Homo sapiens
gtctcagtttgtgtgtct

SEQ ID NO: 2249276 - DNA, 19 bp, Homo sapiens
gtctcagtttgtgtgtctt

SEQ ID NO: 2249277 - DNA, 20 bp, Homo sapiens
gtctccacttgtatatatgg

SEQ ID NO: 2249278 - DNA, 14 bp, Homo sapiens
gtctcgttcctgtt

SEQ ID NO: 2249279 - DNA, 21 bp, Homo sapiens
gtctctgaaggtaagatcatt

SEQ ID NO: 2249280 - DNA, 17 bp, Homo sapiens
gtctctgtataatctat

SEQ ID NO: 2249281 - DNA, 17 bp, Homo sapiens
gtctgaaacatttcata

SEQ ID NO: 2249282 - DNA, 14 bp, Homo sapiens
gtctgagtgaacct

SEQ ID NO: 2249283 - DNA, 19 bp, Homo sapiens
gtctgttctgcacaataaa

SEQ ID NO: 2249284 - DNA, 21 bp, Homo sapiens
gtctgttctgcacaataaaca

SEQ ID NO: 2249285 - DNA, 18 bp, Homo sapiens
gtcttctcacaagccagc

SEQ ID NO: 2249286 - DNA, 20 bp, Homo sapiens
gtcttctcacaagccagcca

SEQ ID NO: 2249287 - DNA, 15 bp, Homo sapiens
gtcttgaaatgaaag

SEQ ID NO: 2249288 - DNA, 16 bp, Homo sapiens
gtcttgaaatgaaagg

SEQ ID NO: 2249289 - DNA, 21 bp, Homo sapiens
gtcttgaaatgaaagggaaac

SEQ ID NO: 2249290 - DNA, 16 bp, Homo sapiens
gtctttcacagctcct

SEQ ID NO: 2249291 - DNA, 15 bp, Homo sapiens
gtctttcagtacttt

SEQ ID NO: 2249292 - DNA, 22 bp, Homo sapiens
taagacccttattgctgtcctg

SEQ ID NO: 2249293 - DNA, 21 bp, Homo sapiens
taagactggacatttaacttt

SEQ ID NO: 2249294 - DNA, 14 bp, Homo sapiens
taagagtgctgggc

SEQ ID NO: 2249295 - DNA, 15 bp, Homo sapiens
taagatatttgcagt

SEQ ID NO: 2249296 - DNA, 13 bp, Homo sapiens
taagatgtgaaaa

SEQ ID NO: 2249297 - DNA, 15 bp, Homo sapiens
taagattagttgaat

SEQ ID NO: 2249298 - DNA, 14 bp, Homo sapiens
taagattcttttaa

SEQ ID NO: 2249299 - DNA, 23 bp, Homo sapiens
taagattcttttaaattagaaaa

SEQ ID NO: 2249300 - DNA, 18 bp, Homo sapiens
taagcatactttgtaaat

SEQ ID NO: 2249301 - DNA, 16 bp, Homo sapiens
taaggaaactagacaa

SEQ ID NO: 2249302 - DNA, 15 bp, Homo sapiens
taaggataattttcc

SEQ ID NO: 2249303 - DNA, 19 bp, Homo sapiens
taaggatatgattaatatt

SEQ ID NO: 2249304 - DNA, 11 bp, Homo sapiens
taagggaaaaa

SEQ ID NO: 2249305 - DNA, 21 bp, Homo sapiens
taaggtctttcagtacttttt

SEQ ID NO: 2249306 - DNA, 20 bp, Homo sapiens
taagtcccagtatacctcat

SEQ ID NO: 2249307 - DNA, 15 bp, Homo sapiens
taagtgaaaatatag

SEQ ID NO: 2249308 - DNA, 19 bp, Homo sapiens
taagtgcctcacatttttt

SEQ ID NO: 2249309 - DNA, 16 bp, Homo sapiens
taagtggaggcacttt

SEQ ID NO: 2249310 - DNA, 13 bp, Homo sapiens
taagtggtatctg

SEQ ID NO: 2249311 - DNA, 13 bp, Homo sapiens
taagtgtattttt

SEQ ID NO: 2249312 - DNA, 20 bp, Homo sapiens
taagtgtatttttcaataaa

SEQ ID NO: 2249313 - DNA, 14 bp, Homo sapiens
taagtgttggaaaa

SEQ ID NO: 2249314 - DNA, 17 bp, Homo sapiens
taagtgttggaaaaaat

SEQ ID NO: 2249315 - DNA, 16 bp, Homo sapiens
taagttaatgtatata

SEQ ID NO: 2249316 - DNA, 21 bp, Homo sapiens
taagttaatgtatataaaaat

SEQ ID NO: 2249317 - DNA, 19 bp, Homo sapiens
taagttagttccactgaga

SEQ ID NO: 2249318 - DNA, 16 bp, Homo sapiens
taagttatgtgtgtgg

SEQ ID NO: 2249319 - DNA, 14 bp, Homo sapiens
taagttattgcagt

SEQ ID NO: 2249320 - DNA, 16 bp, Homo sapiens
taagttttagaatctt

SEQ ID NO: 2249321 - DNA, 17 bp, Homo sapiens
taagttttagaatcttt

SEQ ID NO: 2249322 - DNA, 12 bp, Homo sapiens
taataaaatcac

SEQ ID NO: 2249323 - DNA, 17 bp, Homo sapiens
taataagtgatgtgctg

SEQ ID NO: 2249324 - DNA, 23 bp, Homo sapiens
taataatcttattagggagaaaa

SEQ ID NO: 2249325 - DNA, 22 bp, Homo sapiens
taatacaaggtataataaaatt

SEQ ID NO: 2249326 - DNA, 19 bp, Homo sapiens
taatacagatttgtaacat

SEQ ID NO: 2249327 - DNA, 13 bp, Homo sapiens
taatactctattt

SEQ ID NO: 2249328 - DNA, 14 bp, Homo sapiens
taatactctatttt

SEQ ID NO: 2249329 - DNA, 15 bp, Homo sapiens
taatagggaatatat

SEQ ID NO: 2249330 - DNA, 12 bp, Homo sapiens
taatataaaaaa

SEQ ID NO: 2249331 - DNA, 13 bp, Homo sapiens
taatatattttct

SEQ ID NO: 2249332 - DNA, 17 bp, Homo sapiens
taatatattttctgttt

SEQ ID NO: 2249333 - DNA, 22 bp, Homo sapiens
taatatcaaaacaagtactggt

SEQ ID NO: 2249334 - DNA, 22 bp, Homo sapiens
taatatctttctgcacacaaat

SEQ ID NO: 2249335 - DNA, 22 bp, Homo sapiens
taatatggaaccttccctccaa

SEQ ID NO: 2249336 - DNA, 14 bp, Homo sapiens
taatcaagttgaat

SEQ ID NO: 2249337 - DNA, 23 bp, Homo sapiens
taatcaccctaccaactttactg

SEQ ID NO: 2249338 - DNA, 19 bp, Homo sapiens
taatcatctgcagttcttt

SEQ ID NO: 2249339 - DNA, 19 bp, Homo sapiens
taatcatttgtttacattt

SEQ ID NO: 2249340 - DNA, 14 bp, Homo sapiens
taatcattttcatt

SEQ ID NO: 2249341 - DNA, 16 bp, Homo sapiens
taatccttgataatat

SEQ ID NO: 2249342 - DNA, 17 bp, Homo sapiens
taatctctaggaagtca

SEQ ID NO: 2249343 - DNA, 16 bp, Homo sapiens
taatcttgtagacact

SEQ ID NO: 2249344 - DNA, 18 bp, Homo sapiens
taatcttgtagacactta

SEQ ID NO: 2249345 - DNA, 14 bp, Homo sapiens
taatgaacaaaatt

SEQ ID NO: 2249346 - DNA, 15 bp, Homo sapiens
taatgatatgcttgt

SEQ ID NO: 2249347 - DNA, 20 bp, Homo sapiens
taatgatcgaaaaaataatt

SEQ ID NO: 2249348 - DNA, 13 bp, Homo sapiens
taatgcactttct

SEQ ID NO: 2249349 - DNA, 13 bp, Homo sapiens
taatgtatataaa

SEQ ID NO: 2249350 - DNA, 22 bp, Homo sapiens
taattaaaaagaattcttccac

SEQ ID NO: 2249351 - DNA, 22 bp, Homo sapiens
taattactgttttcttttttct

SEQ ID NO: 2249352 - DNA, 16 bp, Homo sapiens
taattattataaaaat

SEQ ID NO: 2249353 - DNA, 18 bp, Homo sapiens
taattattataaaaatat

SEQ ID NO: 2249354 - DNA, 14 bp, Homo sapiens
taattattatttgt

SEQ ID NO: 2249355 - DNA, 17 bp, Homo sapiens
taattcaggcatatttt

SEQ ID NO: 2249356 - DNA, 21 bp, Homo sapiens
taattgcaaaaacatagaaat

SEQ ID NO: 2249357 - DNA, 13 bp, Homo sapiens
taattgttgtgtg

SEQ ID NO: 2249358 - DNA, 17 bp, Homo sapiens
taatttgatgaggtatt

SEQ ID NO: 2249359 - DNA, 20 bp, Homo sapiens
taatttgatgaggtattttt

SEQ ID NO: 2249360 - DNA, 17 bp, Homo sapiens
taatttggggaaaatga

SEQ ID NO: 2249361 - DNA, 19 bp, Homo sapiens
taattttgtaatgtatcaa

SEQ ID NO: 2249362 - DNA, 12 bp, Homo sapiens
tacaaaacttcc

SEQ ID NO: 2249363 - DNA, 12 bp, Homo sapiens
tacaaaacttta

SEQ ID NO: 2249364 - DNA, 16 bp, Homo sapiens
tacaaatgacactgca

SEQ ID NO: 2249365 - DNA, 13 bp, Homo sapiens
tacaaattagaaa

SEQ ID NO: 2249366 - DNA, 23 bp, Homo sapiens
tacaacagaaaccagaaaagcaa

SEQ ID NO: 2249367 - DNA, 17 bp, Homo sapiens
tacaaggtataataaaa

SEQ ID NO: 2249368 - DNA, 18 bp, Homo sapiens
tacaaggtataataaaat

SEQ ID NO: 2249369 - DNA, 20 bp, Homo sapiens
tacaaggtataataaaatta

SEQ ID NO: 2249370 - DNA, 22 bp, Homo sapiens
tacaatcaaaacacactactac

SEQ ID NO: 2249371 - DNA, 15 bp, Homo sapiens
tacaatgtgaacttt

SEQ ID NO: 2249372 - DNA, 16 bp, Homo sapiens
tacaatgtgaacttta

SEQ ID NO: 2249373 - DNA, 18 bp, Homo sapiens
tacaattttatctgtttc

SEQ ID NO: 2249374 - DNA, 18 bp, Homo sapiens
tacacatatttgaagggt

SEQ ID NO: 2249375 - DNA, 17 bp, Homo sapiens
tacacatcacacaagat

SEQ ID NO: 2249376 - DNA, 16 bp, Homo sapiens
tacactgagcagggag

SEQ ID NO: 2249377 - DNA, 11 bp, Homo sapiens
tacagaggaga

SEQ ID NO: 2249378 - DNA, 12 bp, Homo sapiens
tacagaggagat

SEQ ID NO: 2249379 - DNA, 18 bp, Homo sapiens
tacagatgaatgtattta

SEQ ID NO: 2249380 - DNA, 19 bp, Homo sapiens
tacagccagaccagattaa

SEQ ID NO: 2249381 - DNA, 19 bp, Homo sapiens
tacagttgaaataactgga

SEQ ID NO: 2249382 - DNA, 22 bp, Homo sapiens
tacataccctggccgccccctg

SEQ ID NO: 2249383 - DNA, 17 bp, Homo sapiens
tacatacgatttaaggt

SEQ ID NO: 2249384 - DNA, 19 bp, Homo sapiens
tacatactttatcaatgtg

SEQ ID NO: 2249385 - DNA, 23 bp, Homo sapiens
tacatactttatcaatgtgtctt

SEQ ID NO: 2249386 - DNA, 13 bp, Homo sapiens
tacatagtgaaaa

SEQ ID NO: 2249387 - DNA, 16 bp, Homo sapiens
tacatatctttattaa

SEQ ID NO: 2249388 - DNA, 14 bp, Homo sapiens
tacatcttctgcct

SEQ ID NO: 2249389 - DNA, 17 bp, Homo sapiens
tacatcttctgccttag

SEQ ID NO: 2249390 - DNA, 13 bp, Homo sapiens
tacatgtttataa

SEQ ID NO: 2249391 - DNA, 15 bp, Homo sapiens
tacattaacttgaaa

SEQ ID NO: 2249392 - DNA, 14 bp, Homo sapiens
tacatttatttatc

SEQ ID NO: 2249393 - DNA, 23 bp, Homo sapiens
tacatttatttatccagaaaact

SEQ ID NO: 2249394 - DNA, 15 bp, Homo sapiens
tacatttcatacaac

SEQ ID NO: 2249395 - DNA, 12 bp, Homo sapiens
taccagccagcc

SEQ ID NO: 2249396 - DNA, 14 bp, Homo sapiens
taccatttatacaa

SEQ ID NO: 2249397 - DNA, 18 bp, Homo sapiens
taccatttatacaaatta

SEQ ID NO: 2249398 - DNA, 18 bp, Homo sapiens
taccatttatcaagcatt

SEQ ID NO: 2249399 - DNA, 12 bp, Homo sapiens
taccctcctggc

SEQ ID NO: 2249400 - DNA, 15 bp, Homo sapiens
taccctcctggctct

SEQ ID NO: 2249401 - DNA, 22 bp, Homo sapiens
tcattatttttgttagcaaaga

SEQ ID NO: 2249402 - DNA, 16 bp, Homo sapiens
tcattgctgagcctct

SEQ ID NO: 2249403 - DNA, 14 bp, Homo sapiens
tcattgtatgtggt

SEQ ID NO: 2249404 - DNA, 16 bp, Homo sapiens
tcatttaagggaaaaa

SEQ ID NO: 2249405 - DNA, 17 bp, Homo sapiens
tcatttaagggaaaaat

SEQ ID NO: 2249406 - DNA, 23 bp, Homo sapiens
tcatttaagggaaaaatatatat

SEQ ID NO: 2249407 - DNA, 16 bp, Homo sapiens
tcattttgaaattgtt

SEQ ID NO: 2249408 - DNA, 12 bp, Homo sapiens
tcatttttcaaa

SEQ ID NO: 2249409 - DNA, 22 bp, Homo sapiens
tccaaaaaaaaaaaaaatacaa

SEQ ID NO: 2249410 - DNA, 23 bp, Homo sapiens
tccaaaaaaaaaaaaaatacaat

SEQ ID NO: 2249411 - DNA, 17 bp, Homo sapiens
tccaaaaatgtgtaaga

SEQ ID NO: 2249412 - DNA, 14 bp, Homo sapiens
tccaaaacatttct

SEQ ID NO: 2249413 - DNA, 13 bp, Homo sapiens
tccaaagaggctg

SEQ ID NO: 2249414 - DNA, 13 bp, Homo sapiens
tccaaccttccca

SEQ ID NO: 2249415 - DNA, 18 bp, Homo sapiens
tccacacccaatgctgct

SEQ ID NO: 2249416 - DNA, 18 bp, Homo sapiens
tccacaggggccaccacc

SEQ ID NO: 2249417 - DNA, 19 bp, Homo sapiens
tccaccccaagagaactcg

SEQ ID NO: 2249418 - DNA, 13 bp, Homo sapiens
tccaccccaggac

SEQ ID NO: 2249419 - DNA, 14 bp, Homo sapiens
tccacgcctcctgg

SEQ ID NO: 2249420 - DNA, 11 bp, Homo sapiens
tccacttgtat

SEQ ID NO: 2249421 - DNA, 22 bp, Homo sapiens
tccagaactcactggggcctac

SEQ ID NO: 2249422 - DNA, 13 bp, Homo sapiens
tccagacttcaaa

SEQ ID NO: 2249423 - DNA, 15 bp, Homo sapiens
tccagacttcaaaag

SEQ ID NO: 2249424 - DNA, 19 bp, Homo sapiens
tccagacttccttgagaca

SEQ ID NO: 2249425 - DNA, 15 bp, Homo sapiens
tccagagacaacagg

SEQ ID NO: 2249426 - DNA, 16 bp, Homo sapiens
tccagagacaacaggt

SEQ ID NO: 2249427 - DNA, 15 bp, Homo sapiens
tccagatgccacaat

SEQ ID NO: 2249428 - DNA, 12 bp, Homo sapiens
tccagccacccc

SEQ ID NO: 2249429 - DNA, 23 bp, Homo sapiens
tccagccagcgcctccctccacc

SEQ ID NO: 2249430 - DNA, 15 bp, Homo sapiens
tccagcctccagggc

SEQ ID NO: 2249431 - DNA, 13 bp, Homo sapiens
tccagctcctgta

SEQ ID NO: 2249432 - DNA, 20 bp, Homo sapiens
tccaggctatgtataaaata

SEQ ID NO: 2249433 - DNA, 19 bp, Homo sapiens
tccagggcattgctcagcc

SEQ ID NO: 2249434 - DNA, 22 bp, Homo sapiens
tccagggcattgctcagcccgc

SEQ ID NO: 2249435 - DNA, 21 bp, Homo sapiens
tccagtggtcattgggcagtg

SEQ ID NO: 2249436 - DNA, 20 bp, Homo sapiens
tccagtgtccttagaacatt

SEQ ID NO: 2249437 - DNA, 14 bp, Homo sapiens
tccagtttgttctc

SEQ ID NO: 2249438 - DNA, 19 bp, Homo sapiens
tccatctgtgccatacttg

SEQ ID NO: 2249439 - DNA, 15 bp, Homo sapiens
tccatctttgtatat

SEQ ID NO: 2249440 - DNA, 21 bp, Homo sapiens
tccatggtactgtagcagggg

SEQ ID NO: 2249441 - DNA, 17 bp, Homo sapiens
tcccacaggagggccag

SEQ ID NO: 2249442 - DNA, 20 bp, Homo sapiens
tcccacccccacccccagct

SEQ ID NO: 2249443 - DNA, 12 bp, Homo sapiens
tcccacccccag

SEQ ID NO: 2249444 - DNA, 14 bp, Homo sapiens
tcccacccccagcc

SEQ ID NO: 2249445 - DNA, 15 bp, Homo sapiens
tcccacccccagccc

SEQ ID NO: 2249446 - DNA, 17 bp, Homo sapiens
tcccacccccagccccg

SEQ ID NO: 2249447 - DNA, 20 bp, Homo sapiens
tcccaccccctcctccccca

SEQ ID NO: 2249448 - DNA, 12 bp, Homo sapiens
tcccaccgggag

SEQ ID NO: 2249449 - DNA, 21 bp, Homo sapiens
tcccaccgggagcctccccct

SEQ ID NO: 2249450 - DNA, 16 bp, Homo sapiens
tcccagtatacctcat

SEQ ID NO: 2249451 - DNA, 14 bp, Homo sapiens
tcccagtgacaaca

SEQ ID NO: 2249452 - DNA, 21 bp, Homo sapiens
tcccatgtagccccctggcct

SEQ ID NO: 2249453 - DNA, 16 bp, Homo sapiens
tccccaaacaggacag

SEQ ID NO: 2249454 - DNA, 18 bp, Homo sapiens
tccccaaacaggacagca

SEQ ID NO: 2249455 - DNA, 14 bp, Homo sapiens
tccccagcctggca

SEQ ID NO: 2249456 - DNA, 15 bp, Homo sapiens
tccccatggagccag

SEQ ID NO: 2249457 - DNA, 13 bp, Homo sapiens
tccccgcctggcc

SEQ ID NO: 2249458 - DNA, 18 bp, Homo sapiens
tccccgcctggccaggag

SEQ ID NO: 2249459 - DNA, 20 bp, Homo sapiens
tccccgcctggccaggagca

SEQ ID NO: 2249460 - DNA, 16 bp, Homo sapiens
tccccgcgccccagtc

SEQ ID NO: 2249461 - DNA, 22 bp, Homo sapiens
tcccctcactctgtcagccagc

SEQ ID NO: 2249462 - DNA, 17 bp, Homo sapiens
tcccctctgctgctgtc

SEQ ID NO: 2249463 - DNA, 20 bp, Homo sapiens
tcccgtttctccacctagac

SEQ ID NO: 2249464 - DNA, 17 bp, Homo sapiens
tcccgttttccccatga

SEQ ID NO: 2249465 - DNA, 10 bp, Homo sapiens
tccctcaccc

SEQ ID NO: 2249466 - DNA, 17 bp, Homo sapiens
tccctcaccccctccca

SEQ ID NO: 2249467 - DNA, 21 bp, Homo sapiens
tccctccagcaaagctcccgc

SEQ ID NO: 2249468 - DNA, 14 bp, Homo sapiens
tccctcccccttgt

SEQ ID NO: 2249469 - DNA, 18 bp, Homo sapiens
tccctccgcggctggagc

SEQ ID NO: 2249470 - DNA, 21 bp, Homo sapiens
tccctggcaggatgctgagct

SEQ ID NO: 2249471 - DNA, 18 bp, Homo sapiens
tccctgggcccctccacg

SEQ ID NO: 2249472 - DNA, 19 bp, Homo sapiens
tccctgggcccctccacgc

SEQ ID NO: 2249473 - DNA, 21 bp, Homo sapiens
tccctggggccaacggcaaca

SEQ ID NO: 2249474 - DNA, 16 bp, Homo sapiens
tccctgtgggggtggc

SEQ ID NO: 2249475 - DNA, 23 bp, Homo sapiens
tccctgtgggggtggccatccct

SEQ ID NO: 2249476 - DNA, 17 bp, Homo sapiens
tcccttcacagtcccag

SEQ ID NO: 2249477 - DNA, 15 bp, Homo sapiens
tcccttgctggcccc

SEQ ID NO: 2249478 - DNA, 19 bp, Homo sapiens
tcccttgctggccccagcc

SEQ ID NO: 2249479 - DNA, 23 bp, Homo sapiens
tcccttgctggccccagccctgc

SEQ ID NO: 2249480 - DNA, 19 bp, Homo sapiens
tccctttttttacatttca

SEQ ID NO: 2249481 - DNA, 20 bp, Homo sapiens
tccgggtgtggcctcagccc

SEQ ID NO: 2249482 - DNA, 13 bp, Homo sapiens
tccgtcctctccc

SEQ ID NO: 2249483 - DNA, 22 bp, Homo sapiens
tccgtcctctccccagcctggc

SEQ ID NO: 2249484 - DNA, 23 bp, Homo sapiens
tccgtcctctccccagcctggca

SEQ ID NO: 2249485 - DNA, 24 bp, Homo sapiens
tcctaactttggacctattatcag

SEQ ID NO: 2249486 - DNA, 19 bp, Homo sapiens
tcctaagagtgctgggcat

SEQ ID NO: 2249487 - DNA, 22 bp, Homo sapiens
tcctagtgagtgtgctgacttt

SEQ ID NO: 2249488 - DNA, 15 bp, Homo sapiens
tcctatatatttcta

SEQ ID NO: 2249489 - DNA, 15 bp, Homo sapiens
tcctccacagagagg

SEQ ID NO: 2249490 - DNA, 23 bp, Homo sapiens
tcctcccaggaagcccaggagcc

SEQ ID NO: 2249491 - DNA, 15 bp, Homo sapiens
tcctctcgagcccag

SEQ ID NO: 2249492 - DNA, 22 bp, Homo sapiens
tcctctttgtaatttaatgaaa

SEQ ID NO: 2249493 - DNA, 15 bp, Homo sapiens
tcctgacattgtctc

SEQ ID NO: 2249494 - DNA, 16 bp, Homo sapiens
tcctgcccatgtgtcc

SEQ ID NO: 2249495 - DNA, 18 bp, Homo sapiens
tcctgcccatgtgtcccc

SEQ ID NO: 2249496 - DNA, 19 bp, Homo sapiens
tcctgcccatgtgtcccct

SEQ ID NO: 2249497 - DNA, 15 bp, Homo sapiens
tcctgcgctctgcca

SEQ ID NO: 2249498 - DNA, 19 bp, Homo sapiens
tcctggagcagaccacccc

SEQ ID NO: 2249499 - DNA, 17 bp, Homo sapiens
tcctggcagtttaaaaa

SEQ ID NO: 2249500 - DNA, 20 bp, Homo sapiens
tcctggcagtttaaaaaaat

SEQ ID NO: 2249501 - DNA, 16 bp, Homo sapiens
tcctggggctcagcct

SEQ ID NO: 2249502 - DNA, 15 bp, Homo sapiens
tcctgggggtggcag

SEQ ID NO: 2249503 - DNA, 16 bp, Homo sapiens
tcctgggggtggcagg

SEQ ID NO: 2249504 - DNA, 19 bp, Homo sapiens
tcctgggggtggcaggcac

SEQ ID NO: 2249505 - DNA, 16 bp, Homo sapiens
tcctggtttttgccta

SEQ ID NO: 2249506 - DNA, 15 bp, Homo sapiens
tcctgttcacaccag

SEQ ID NO: 2249507 - DNA, 17 bp, Homo sapiens
tcctgtttgtctacata

SEQ ID NO: 2249508 - DNA, 20 bp, Homo sapiens
tccttactgtgtttcagcat

SEQ ID NO: 2249509 - DNA, 19 bp, Homo sapiens
tgccccccagcctctggca

SEQ ID NO: 2249510 - DNA, 15 bp, Homo sapiens
tgcccccctcctccc

SEQ ID NO: 2249511 - DNA, 20 bp, Homo sapiens
tgccccctcccccatgggct

SEQ ID NO: 2249512 - DNA, 13 bp, Homo sapiens
tgccctaataaaa

SEQ ID NO: 2249513 - DNA, 15 bp, Homo sapiens
tgccctaataaaaag

SEQ ID NO: 2249514 - DNA, 21 bp, Homo sapiens
tgccctcatggcccctctgac

SEQ ID NO: 2249515 - DNA, 16 bp, Homo sapiens
tgccctgtgtggctgg

SEQ ID NO: 2249516 - DNA, 12 bp, Homo sapiens
tgccgctgcacc

SEQ ID NO: 2249517 - DNA, 15 bp, Homo sapiens
tgccgctgcaccacg

SEQ ID NO: 2249518 - DNA, 18 bp, Homo sapiens
tgccgctgccgctgcacc

SEQ ID NO: 2249519 - DNA, 13 bp, Homo sapiens
tgcctctctttga

SEQ ID NO: 2249520 - DNA, 20 bp, Homo sapiens
tgcctgttggcaggcccact

SEQ ID NO: 2249521 - DNA, 20 bp, Homo sapiens
tgccttagtctcagtttgtg

SEQ ID NO: 2249522 - DNA, 16 bp, Homo sapiens
tgccttggctcagaca

SEQ ID NO: 2249523 - DNA, 17 bp, Homo sapiens
tgccttggctcagacat

SEQ ID NO: 2249524 - DNA, 13 bp, Homo sapiens
tgcgcaatgtggc

SEQ ID NO: 2249525 - DNA, 15 bp, Homo sapiens
tgctagatttctaca

SEQ ID NO: 2249526 - DNA, 20 bp, Homo sapiens
tgctagggttaggaggtcct

SEQ ID NO: 2249527 - DNA, 21 bp, Homo sapiens
tgctagggttaggaggtcctt

SEQ ID NO: 2249528 - DNA, 21 bp, Homo sapiens
tgctatacacaagcaatgcaa

SEQ ID NO: 2249529 - DNA, 17 bp, Homo sapiens
tgctcagcccgcttggc

SEQ ID NO: 2249530 - DNA, 19 bp, Homo sapiens
tgctcagcccgcttggcca

SEQ ID NO: 2249531 - DNA, 16 bp, Homo sapiens
tgctcagctgtcaagg

SEQ ID NO: 2249532 - DNA, 20 bp, Homo sapiens
tgctcagctgtcaaggctca

SEQ ID NO: 2249533 - DNA, 16 bp, Homo sapiens
tgctcatgttggccaa

SEQ ID NO: 2249534 - DNA, 18 bp, Homo sapiens
tgctcatttgaaaatgga

SEQ ID NO: 2249535 - DNA, 18 bp, Homo sapiens
tgctccatagtttggcat

SEQ ID NO: 2249536 - DNA, 16 bp, Homo sapiens
tgctcgtggactgtgc

SEQ ID NO: 2249537 - DNA, 18 bp, Homo sapiens
tgctgaatatacagcagg

SEQ ID NO: 2249538 - DNA, 18 bp, Homo sapiens
tgctgactggcttcagca

SEQ ID NO: 2249539 - DNA, 14 bp, Homo sapiens
tgctgagagaaata

SEQ ID NO: 2249540 - DNA, 16 bp, Homo sapiens
tgctgagcctctgctc

SEQ ID NO: 2249541 - DNA, 17 bp, Homo sapiens
tgctgagcctctgctcc

SEQ ID NO: 2249542 - DNA, 22 bp, Homo sapiens
tgctgagcttgtcttttctgct

SEQ ID NO: 2249543 - DNA, 23 bp, Homo sapiens
tgctgagcttgtcttttctgctg

SEQ ID NO: 2249544 - DNA, 15 bp, Homo sapiens
tgctgatggagcctt

SEQ ID NO: 2249545 - DNA, 19 bp, Homo sapiens
tgctgatgtatcctttcat

SEQ ID NO: 2249546 - DNA, 16 bp, Homo sapiens
tgctgctgtcagacga

SEQ ID NO: 2249547 - DNA, 16 bp, Homo sapiens
tgctggccagcaccct

SEQ ID NO: 2249548 - DNA, 17 bp, Homo sapiens
tgctggccagcaccctc

SEQ ID NO: 2249549 - DNA, 18 bp, Homo sapiens
tgctggccagcaccctct

SEQ ID NO: 2249550 - DNA, 20 bp, Homo sapiens
tgctggccagcaccctctcc

SEQ ID NO: 2249551 - DNA, 13 bp, Homo sapiens
tgctggccccagc

SEQ ID NO: 2249552 - DNA, 14 bp, Homo sapiens
tgctggccccagcc

SEQ ID NO: 2249553 - DNA, 19 bp, Homo sapiens
tgctggccccagccctgct

SEQ ID NO: 2249554 - DNA, 20 bp, Homo sapiens
tgctggccccagccctgctg

SEQ ID NO: 2249555 - DNA, 23 bp, Homo sapiens
tgctgtacacatatttgaagggt

SEQ ID NO: 2249556 - DNA, 17 bp, Homo sapiens
tgctgtctggccctggg

SEQ ID NO: 2249557 - DNA, 22 bp, Homo sapiens
tgctgttaactgcaaccttgtt

SEQ ID NO: 2249558 - DNA, 22 bp, Homo sapiens
tgcttaaagttggtattaataa

SEQ ID NO: 2249559 - DNA, 17 bp, Homo sapiens
tgcttacctactttctt

SEQ ID NO: 2249560 - DNA, 19 bp, Homo sapiens
tgcttacctactttcttca

SEQ ID NO: 2249561 - DNA, 14 bp, Homo sapiens
tgcttagaaaagaa

SEQ ID NO: 2249562 - DNA, 20 bp, Homo sapiens
tgcttagtgtacttggagta

SEQ ID NO: 2249563 - DNA, 22 bp, Homo sapiens
tgcttctcagatttctgaggaa

SEQ ID NO: 2249564 - DNA, 21 bp, Homo sapiens
tgcttgagccaggaggcctgc

SEQ ID NO: 2249565 - DNA, 14 bp, Homo sapiens
tgctttcattatgt

SEQ ID NO: 2249566 - DNA, 13 bp, Homo sapiens
tgcttttagaaaa

SEQ ID NO: 2249567 - DNA, 19 bp, Homo sapiens
tgcttttgcataatgcaat

SEQ ID NO: 2249568 - DNA, 12 bp, Homo sapiens
tggaaaaataaa

SEQ ID NO: 2249569 - DNA, 22 bp, Homo sapiens
tggaaaagcttaaaaaaattac

SEQ ID NO: 2249570 - DNA, 18 bp, Homo sapiens
tggaaactatgtgttttt

SEQ ID NO: 2249571 - DNA, 22 bp, Homo sapiens
tggaacccttttaaagttgata

SEQ ID NO: 2249572 - DNA, 17 bp, Homo sapiens
tggaagatcattttgaa

SEQ ID NO: 2249573 - DNA, 16 bp, Homo sapiens
tggaagcccctgggcc

SEQ ID NO: 2249574 - DNA, 17 bp, Homo sapiens
tggaatctggagaccag

SEQ ID NO: 2249575 - DNA, 18 bp, Homo sapiens
tggaatctggagaccagg

SEQ ID NO: 2249576 - DNA, 24 bp, Homo sapiens
tggacagacagatgttgggaggat

SEQ ID NO: 2249577 - DNA, 19 bp, Homo sapiens
tggacagtacctgattgta

SEQ ID NO: 2249578 - DNA, 21 bp, Homo sapiens
tggacatttaacttttctacc

SEQ ID NO: 2249579 - DNA, 17 bp, Homo sapiens
tggactatgcacacttt

SEQ ID NO: 2249580 - DNA, 14 bp, Homo sapiens
tggactctaaagtc

SEQ ID NO: 2249581 - DNA, 17 bp, Homo sapiens
tggactgtgctggtgca

SEQ ID NO: 2249582 - DNA, 22 bp, Homo sapiens
tggactgttttctctcggctcc

SEQ ID NO: 2249583 - DNA, 18 bp, Homo sapiens
tggagaccagggagcctt

SEQ ID NO: 2249584 - DNA, 19 bp, Homo sapiens
tggagaccagggagccttt

SEQ ID NO: 2249585 - DNA, 16 bp, Homo sapiens
tggagattataataaa

SEQ ID NO: 2249586 - DNA, 19 bp, Homo sapiens
tggagattataataaatat

SEQ ID NO: 2249587 - DNA, 19 bp, Homo sapiens
tggagatttggaattgaac

SEQ ID NO: 2249588 - DNA, 21 bp, Homo sapiens
tggagcatttctcatcagtag

SEQ ID NO: 2249589 - DNA, 14 bp, Homo sapiens
tggagcttttttcc

SEQ ID NO: 2249590 - DNA, 21 bp, Homo sapiens
tggaggaacaatcggctgcat

SEQ ID NO: 2249591 - DNA, 16 bp, Homo sapiens
tggaggggctggggac

SEQ ID NO: 2249592 - DNA, 14 bp, Homo sapiens
tggagtcccctcac

SEQ ID NO: 2249593 - DNA, 15 bp, Homo sapiens
tggataccattatat

SEQ ID NO: 2249594 - DNA, 23 bp, Homo sapiens
tggatccatcttgagccacagtc

SEQ ID NO: 2249595 - DNA, 21 bp, Homo sapiens
tggatcttttgaagggagaag

SEQ ID NO: 2249596 - DNA, 19 bp, Homo sapiens
tggatttttgactctggca

SEQ ID NO: 2249597 - DNA, 12 bp, Homo sapiens
tggcaatagacc

SEQ ID NO: 2249598 - DNA, 23 bp, Homo sapiens
tggcacagaggtagtctcactgc

SEQ ID NO: 2249599 - DNA, 19 bp, Homo sapiens
tggcacaggccgaggcagg

SEQ ID NO: 2249600 - DNA, 16 bp, Homo sapiens
tggcactttgaagggg

SEQ ID NO: 2249601 - DNA, 19 bp, Homo sapiens
tggcagagagcacagtgat

SEQ ID NO: 2249602 - DNA, 21 bp, Homo sapiens
tggcagatcgctcactgttgt

SEQ ID NO: 2249603 - DNA, 11 bp, Homo sapiens
tggcaggactt

SEQ ID NO: 2249604 - DNA, 17 bp, Homo sapiens
tggcaggagggcagtgg

SEQ ID NO: 2249605 - DNA, 21 bp, Homo sapiens
tggcaggcacacagcagcccc

SEQ ID NO: 2249606 - DNA, 22 bp, Homo sapiens
tggcaggcacacagcagccccc

SEQ ID NO: 2249607 - DNA, 12 bp, Homo sapiens
tggcaggcccac

SEQ ID NO: 2249608 - DNA, 19 bp, Homo sapiens
tggcaggcccactccccag

SEQ ID NO: 2249609 - DNA, 19 bp, Homo sapiens
tggcagggtccctccagca

SEQ ID NO: 2249610 - DNA, 17 bp, Homo sapiens
tggcattagaattattt

SEQ ID NO: 2249611 - DNA, 21 bp, Homo sapiens
tggccagcaccctctcctggg

SEQ ID NO: 2249612 - DNA, 16 bp, Homo sapiens
tggccatccctgggcc

SEQ ID NO: 2249613 - DNA, 22 bp, Homo sapiens
tggccatccctgggcccctcca

SEQ ID NO: 2249614 - DNA, 18 bp, Homo sapiens
tggccccagccctgctgg

SEQ ID NO: 2249615 - DNA, 20 bp, Homo sapiens
tggccccagccctgctgggg

SEQ ID NO: 2249616 - DNA, 10 bp, Homo sapiens
tggcccctct

SEQ ID NO: 2249617 - DNA, 20 bp, Homo sapiens
ttatcaatgtgtctttctaa

SEQ ID NO: 2249618 - DNA, 13 bp, Homo sapiens
ttatctatataaa

SEQ ID NO: 2249619 - DNA, 16 bp, Homo sapiens
ttatctcagatgttaa

SEQ ID NO: 2249620 - DNA, 22 bp, Homo sapiens
ttatctgtttcctgacattgtc

SEQ ID NO: 2249621 - DNA, 16 bp, Homo sapiens
ttatgagtttgccctc

SEQ ID NO: 2249622 - DNA, 17 bp, Homo sapiens
ttatgctctcactgttt

SEQ ID NO: 2249623 - DNA, 15 bp, Homo sapiens
ttatgttgaaaaaat

SEQ ID NO: 2249624 - DNA, 13 bp, Homo sapiens
ttattaaattgca

SEQ ID NO: 2249625 - DNA, 13 bp, Homo sapiens
ttattaatataat

SEQ ID NO: 2249626 - DNA, 13 bp, Homo sapiens
ttattaatgatca

SEQ ID NO: 2249627 - DNA, 11 bp, Homo sapiens
ttattaatgca

SEQ ID NO: 2249628 - DNA, 18 bp, Homo sapiens
ttattaatgcactttcta

SEQ ID NO: 2249629 - DNA, 13 bp, Homo sapiens
ttattacatgtaa

SEQ ID NO: 2249630 - DNA, 18 bp, Homo sapiens
ttattacatgtaatttga

SEQ ID NO: 2249631 - DNA, 17 bp, Homo sapiens
ttattagggagaaaatt

SEQ ID NO: 2249632 - DNA, 23 bp, Homo sapiens
ttattagggagaaaattcaattg

SEQ ID NO: 2249633 - DNA, 14 bp, Homo sapiens
ttattgcagtttat

SEQ ID NO: 2249634 - DNA, 21 bp, Homo sapiens
ttattgcagtttatcattcaa

SEQ ID NO: 2249635 - DNA, 12 bp, Homo sapiens
ttatttaaatta

SEQ ID NO: 2249636 - DNA, 15 bp, Homo sapiens
ttatttcagatgttt

SEQ ID NO: 2249637 - DNA, 18 bp, Homo sapiens
ttatttctagctttttaa

SEQ ID NO: 2249638 - DNA, 20 bp, Homo sapiens
ttcaaaagtttgtttgctta

SEQ ID NO: 2249639 - DNA, 14 bp, Homo sapiens
ttcaaactgcagct

SEQ ID NO: 2249640 - DNA, 16 bp, Homo sapiens
ttcaaactggggcctc

SEQ ID NO: 2249641 - DNA, 15 bp, Homo sapiens
ttcaaagaaacttga

SEQ ID NO: 2249642 - DNA, 16 bp, Homo sapiens
ttcaaagaaacttgaa

SEQ ID NO: 2249643 - DNA, 20 bp, Homo sapiens
ttcaaaggccacatacctct

SEQ ID NO: 2249644 - DNA, 22 bp, Homo sapiens
ttcaaatgggagactctttgaa

SEQ ID NO: 2249645 - DNA, 18 bp, Homo sapiens
ttcaataaagcatttata

SEQ ID NO: 2249646 - DNA, 12 bp, Homo sapiens
ttcaattgtaaa

SEQ ID NO: 2249647 - DNA, 15 bp, Homo sapiens
ttcacagctcctccc

SEQ ID NO: 2249648 - DNA, 13 bp, Homo sapiens
ttcacagtcccag

SEQ ID NO: 2249649 - DNA, 15 bp, Homo sapiens
ttcacattcttggct

SEQ ID NO: 2249650 - DNA, 16 bp, Homo sapiens
ttcacattcttggctt

SEQ ID NO: 2249651 - DNA, 16 bp, Homo sapiens
ttcaccccctttcctg

SEQ ID NO: 2249652 - DNA, 19 bp, Homo sapiens
ttcaccccctttcctggac

SEQ ID NO: 2249653 - DNA, 14 bp, Homo sapiens
ttcactaacctttt

SEQ ID NO: 2249654 - DNA, 19 bp, Homo sapiens
ttcactgtttcatctaagt

SEQ ID NO: 2249655 - DNA, 16 bp, Homo sapiens
ttcagagccagcctgg

SEQ ID NO: 2249656 - DNA, 13 bp, Homo sapiens
ttcagaggctcag

SEQ ID NO: 2249657 - DNA, 14 bp, Homo sapiens
ttcagatgtttcga

SEQ ID NO: 2249658 - DNA, 19 bp, Homo sapiens
ttcagcagcaaattttcag

SEQ ID NO: 2249659 - DNA, 20 bp, Homo sapiens
ttcagcatgactatgtattt

SEQ ID NO: 2249660 - DNA, 17 bp, Homo sapiens
ttcagcattaagctgtt

SEQ ID NO: 2249661 - DNA, 22 bp, Homo sapiens
ttcagcattaagctgttcctgt

SEQ ID NO: 2249662 - DNA, 19 bp, Homo sapiens
ttcaggaatgtgtggcctg

SEQ ID NO: 2249663 - DNA, 21 bp, Homo sapiens
ttcaggagaacctaacatgct

SEQ ID NO: 2249664 - DNA, 22 bp, Homo sapiens
ttcagggaggtagtttcaaagg

SEQ ID NO: 2249665 - DNA, 21 bp, Homo sapiens
ttcagtaccctctcagctcca

SEQ ID NO: 2249666 - DNA, 22 bp, Homo sapiens
ttcagtaccctctcagctccag

SEQ ID NO: 2249667 - DNA, 16 bp, Homo sapiens
ttcagtggaggctggc

SEQ ID NO: 2249668 - DNA, 19 bp, Homo sapiens
ttcatcccaactgtctttt

SEQ ID NO: 2249669 - DNA, 13 bp, Homo sapiens
ttcatctcattta

SEQ ID NO: 2249670 - DNA, 16 bp, Homo sapiens
ttcatctcatttaagg

SEQ ID NO: 2249671 - DNA, 23 bp, Homo sapiens
ttcatctcatttaagggaaaaat

SEQ ID NO: 2249672 - DNA, 17 bp, Homo sapiens
ttcatctggggtggggt

SEQ ID NO: 2249673 - DNA, 22 bp, Homo sapiens
ttcatgccagctacttcctcct

SEQ ID NO: 2249674 - DNA, 20 bp, Homo sapiens
ttcatgtaaagtgtcagaag

SEQ ID NO: 2249675 - DNA, 23 bp, Homo sapiens
ttcatgtattttacacaaatgtg

SEQ ID NO: 2249676 - DNA, 16 bp, Homo sapiens
ttcattaattcaggca

SEQ ID NO: 2249677 - DNA, 22 bp, Homo sapiens
ttccaaaacatttctggacagt

SEQ ID NO: 2249678 - DNA, 16 bp, Homo sapiens
ttccaaaacctaaaga

SEQ ID NO: 2249679 - DNA, 17 bp, Homo sapiens
ttccaccaaatgtgctt

SEQ ID NO: 2249680 - DNA, 13 bp, Homo sapiens
ttccactgagacc

SEQ ID NO: 2249681 - DNA, 24 bp, Homo sapiens
ttccagcatgaggtatctaaggat

SEQ ID NO: 2249682 - DNA, 21 bp, Homo sapiens
ttccatagtgttaactgtcag

SEQ ID NO: 2249683 - DNA, 13 bp, Homo sapiens
ttccatctctggt

SEQ ID NO: 2249684 - DNA, 13 bp, Homo sapiens
ttcccaacacaaa

SEQ ID NO: 2249685 - DNA, 21 bp, Homo sapiens
ttcccacaggagggccagcgc

SEQ ID NO: 2249686 - DNA, 14 bp, Homo sapiens
ttccccaaatacaa

SEQ ID NO: 2249687 - DNA, 12 bp, Homo sapiens
ttccccatgaca

SEQ ID NO: 2249688 - DNA, 14 bp, Homo sapiens
ttcccctctgctgc

SEQ ID NO: 2249689 - DNA, 12 bp, Homo sapiens
ttccctcacccc

SEQ ID NO: 2249690 - DNA, 18 bp, Homo sapiens
ttccctcaccccctccca

SEQ ID NO: 2249691 - DNA, 19 bp, Homo sapiens
ttccctcaccccctcccac

SEQ ID NO: 2249692 - DNA, 22 bp, Homo sapiens
ttccctcaccccctcccacccc

SEQ ID NO: 2249693 - DNA, 15 bp, Homo sapiens
ttccctttgtgcaca

SEQ ID NO: 2249694 - DNA, 22 bp, Homo sapiens
ttccgctgtcgccccaggccct

SEQ ID NO: 2249695 - DNA, 17 bp, Homo sapiens
ttccgtgaaaacggagc

SEQ ID NO: 2249696 - DNA, 22 bp, Homo sapiens
ttcctacagagccaaaatgcca

SEQ ID NO: 2249697 - DNA, 23 bp, Homo sapiens
ttcctacagagccaaaatgccat

SEQ ID NO: 2249698 - DNA, 14 bp, Homo sapiens
ttcctctctccaga

SEQ ID NO: 2249699 - DNA, 15 bp, Homo sapiens
ttcctctctccagat

SEQ ID NO: 2249700 - DNA, 20 bp, Homo sapiens
ttcctctgcccttcctgcag

SEQ ID NO: 2249701 - DNA, 15 bp, Homo sapiens
ttcctgtgccctaga

SEQ ID NO: 2249702 - DNA, 14 bp, Homo sapiens
ttcctgttcagtaa

SEQ ID NO: 2249703 - DNA, 17 bp, Homo sapiens
ttcctgttgtcaagaat

SEQ ID NO: 2249704 - DNA, 24 bp, Homo sapiens
ttccttgagacacggagcccagcc

SEQ ID NO: 2249705 - DNA, 15 bp, Homo sapiens
ttccttgaggacaga

SEQ ID NO: 2249706 - DNA, 12 bp, Homo sapiens
ttcgatttctac

SEQ ID NO: 2249707 - DNA, 15 bp, Homo sapiens
ttcgatttctacctc

SEQ ID NO: 2249708 - DNA, 20 bp, Homo sapiens
ttctaaatgtttggcatgta

SEQ ID NO: 2249709 - DNA, 19 bp, Homo sapiens
ttctaactttattctttgt

SEQ ID NO: 2249710 - DNA, 22 bp, Homo sapiens
ttctaattaaccttactaatta

SEQ ID NO: 2249711 - DNA, 15 bp, Homo sapiens
ttctacaatgtgaac

SEQ ID NO: 2249712 - DNA, 18 bp, Homo sapiens
ttctacaatgtgaacttt

SEQ ID NO: 2249713 - DNA, 11 bp, Homo sapiens
ttctacctcag

SEQ ID NO: 2249714 - DNA, 14 bp, Homo sapiens
ttctagactataaa

SEQ ID NO: 2249715 - DNA, 16 bp, Homo sapiens
ttctatgcaggcagca

SEQ ID NO: 2249716 - DNA, 22 bp, Homo sapiens
ttctattttaagactgatttta

SEQ ID NO: 2249717 - DNA, 15 bp, Homo sapiens
ttctcagatttctga

SEQ ID NO: 2249718 - DNA, 12 bp, Homo sapiens
ttctcatatttg

SEQ ID NO: 2249719 - DNA, 21 bp, Homo sapiens
ttctcattaaagttgtttccc

SEQ ID NO: 2249720 - DNA, 12 bp, Homo sapiens
ttctccagctgg

SEQ ID NO: 2249721 - DNA, 15 bp, Homo sapiens
ttctctagtgtatta

SEQ ID NO: 2249722 - DNA, 22 bp, Homo sapiens
ttctctagtgtattatcactgt

SEQ ID NO: 2249723 - DNA, 20 bp, Homo sapiens
ttctctgaggacaagagaaa

SEQ ID NO: 2249724 - DNA, 14 bp, Homo sapiens
ttctctgtactttt

SEQ ID NO: 2249725 - DNA, 18 bp, Homo sapiens
ttctctgtacttttcatt

SEQ ID NO: 2249726 - DNA, 16 bp, Homo sapiens
ttttaactttgaaagt

SEQ ID NO: 2249727 - DNA, 16 bp, Homo sapiens
ttttaatctttgtgac

SEQ ID NO: 2249728 - DNA, 12 bp, Homo sapiens
ttttaattttta

SEQ ID NO: 2249729 - DNA, 21 bp, Homo sapiens
ttttacatgaagctgtataat

SEQ ID NO: 2249730 - DNA, 12 bp, Homo sapiens
ttttacatttca

SEQ ID NO: 2249731 - DNA, 16 bp, Homo sapiens
ttttacatttcataca

SEQ ID NO: 2249732 - DNA, 11 bp, Homo sapiens
ttttaccaaag

SEQ ID NO: 2249733 - DNA, 12 bp, Homo sapiens
ttttactttttt

SEQ ID NO: 2249734 - DNA, 17 bp, Homo sapiens
ttttactttttttagta

SEQ ID NO: 2249735 - DNA, 22 bp, Homo sapiens
ttttagaatcttttaaatacat

SEQ ID NO: 2249736 - DNA, 23 bp, Homo sapiens
ttttaggaaacttgtagaaacga

SEQ ID NO: 2249737 - DNA, 18 bp, Homo sapiens
ttttagtaagttaatgta

SEQ ID NO: 2249738 - DNA, 22 bp, Homo sapiens
ttttataggactgttctttgct

SEQ ID NO: 2249739 - DNA, 19 bp, Homo sapiens
ttttattaatgcactttct

SEQ ID NO: 2249740 - DNA, 20 bp, Homo sapiens
ttttcagaagaaataaatat

SEQ ID NO: 2249741 - DNA, 21 bp, Homo sapiens
ttttcaggaaatctacttcct

SEQ ID NO: 2249742 - DNA, 14 bp, Homo sapiens
ttttcataaacaag

SEQ ID NO: 2249743 - DNA, 17 bp, Homo sapiens
ttttcctatcatgttaa

SEQ ID NO: 2249744 - DNA, 15 bp, Homo sapiens
ttttccttttcttaa

SEQ ID NO: 2249745 - DNA, 18 bp, Homo sapiens
ttttccttttcttaaaac

SEQ ID NO: 2249746 - DNA, 16 bp, Homo sapiens
ttttctaccatttctg

SEQ ID NO: 2249747 - DNA, 14 bp, Homo sapiens
ttttctctgtactt

SEQ ID NO: 2249748 - DNA, 20 bp, Homo sapiens
ttttgaaaagcagacatttt

SEQ ID NO: 2249749 - DNA, 13 bp, Homo sapiens
ttttgacataaga

SEQ ID NO: 2249750 - DNA, 14 bp, Homo sapiens
ttttgacataagat

SEQ ID NO: 2249751 - DNA, 14 bp, Homo sapiens
ttttgagatgtaaa

SEQ ID NO: 2249752 - DNA, 21 bp, Homo sapiens
ttttgagctactggattctta

SEQ ID NO: 2249753 - DNA, 18 bp, Homo sapiens
ttttgatgtaaagatgtt

SEQ ID NO: 2249754 - DNA, 15 bp, Homo sapiens
ttttgttattaaaca

SEQ ID NO: 2249755 - DNA, 14 bp, Homo sapiens
ttttgttctgtata

SEQ ID NO: 2249756 - DNA, 15 bp, Homo sapiens
ttttgttctgtatat

SEQ ID NO: 2249757 - DNA, 17 bp, Homo sapiens
tttttaaataaaagcac

SEQ ID NO: 2249758 - DNA, 23 bp, Homo sapiens
tttttaaccaagtcgctcctagg

SEQ ID NO: 2249759 - DNA, 15 bp, Homo sapiens
tttttaactttgaaa

SEQ ID NO: 2249760 - DNA, 13 bp, Homo sapiens
tttttaatgatat

SEQ ID NO: 2249761 - DNA, 12 bp, Homo sapiens
tttttataaaaa

SEQ ID NO: 2249762 - DNA, 18 bp, Homo sapiens
tttttataaaatggctgt

SEQ ID NO: 2249763 - DNA, 13 bp, Homo sapiens
tttttatttaaat

SEQ ID NO: 2249764 - DNA, 20 bp, Homo sapiens
tttttgaaaagcagacattt

SEQ ID NO: 2249765 - DNA, 15 bp, Homo sapiens
tttttgttagcaaag

SEQ ID NO: 2249766 - DNA, 13 bp, Homo sapiens
ttttttgtaactt

SEQ ID NO: 2249767 - DNA, 12 bp, Homo sapiens
tttttttctacc

SEQ ID NO: 2249768 - DNA, 14 bp, Homo sapiens
tttttttgtaactt

SEQ ID NO: 2249769 - DNA, 15 bp, Homo sapiens
aaatatctctgagtt

SEQ ID NO: 2249770 - DNA, 14 bp, Homo sapiens
aaatatcttggcct

SEQ ID NO: 2249771 - DNA, 19 bp, Homo sapiens
aaatatggtcttttggtta

SEQ ID NO: 2249772 - DNA, 12 bp, Homo sapiens
aaatattaagac

SEQ ID NO: 2249773 - DNA, 15 bp, Homo sapiens
aaatattctctattt

SEQ ID NO: 2249774 - DNA, 22 bp, Homo sapiens
aaatattgttttacaatagttc

SEQ ID NO: 2249775 - DNA, 16 bp, Homo sapiens
aaatatttaccttgaa

SEQ ID NO: 2249776 - DNA, 13 bp, Homo sapiens
aaatattttctat

SEQ ID NO: 2249777 - DNA, 17 bp, Homo sapiens
aaatattttctatttta

SEQ ID NO: 2249778 - DNA, 15 bp, Homo sapiens
aaatattttctctgt

SEQ ID NO: 2249779 - DNA, 15 bp, Homo sapiens
aaatctgctgttaac

SEQ ID NO: 2249780 - DNA, 15 bp, Homo sapiens
aaatgaaagggaaac

SEQ ID NO: 2249781 - DNA, 22 bp, Homo sapiens
aaatgacaccatcttttattct

SEQ ID NO: 2249782 - DNA, 16 bp, Homo sapiens
aaatgacatgttcctt

SEQ ID NO: 2249783 - DNA, 18 bp, Homo sapiens
aaatgatgtgtacccaaa

SEQ ID NO: 2249784 - DNA, 15 bp, Homo sapiens
aaatgattcttagtg

SEQ ID NO: 2249785 - DNA, 14 bp, Homo sapiens
aaatgcatgatttt

SEQ ID NO: 2249786 - DNA, 23 bp, Homo sapiens
aaatgggagactctttgaaatga

SEQ ID NO: 2249787 - DNA, 11 bp, Homo sapiens
aaatgtaaact

SEQ ID NO: 2249788 - DNA, 16 bp, Homo sapiens
aaatgtctattaaggt

SEQ ID NO: 2249789 - DNA, 18 bp, Homo sapiens
aaatgtgaatttttattg

SEQ ID NO: 2249790 - DNA, 21 bp, Homo sapiens
aaatgtgaatttttattgttg

SEQ ID NO: 2249791 - DNA, 17 bp, Homo sapiens
aaatgtgatttttgtaa

SEQ ID NO: 2249792 - DNA, 16 bp, Homo sapiens
aaatgtgctttgagaa

SEQ ID NO: 2249793 - DNA, 19 bp, Homo sapiens
aaatgtttggcatgtaaat

SEQ ID NO: 2249794 - DNA, 21 bp, Homo sapiens
aaattaaaagtttgaaaagca

SEQ ID NO: 2249795 - DNA, 13 bp, Homo sapiens
aaattacaatttt

SEQ ID NO: 2249796 - DNA, 12 bp, Homo sapiens
aaattagaaaat

SEQ ID NO: 2249797 - DNA, 14 bp, Homo sapiens
aaattatttcttaa

SEQ ID NO: 2249798 - DNA, 22 bp, Homo sapiens
aaattatttcttaattattata

SEQ ID NO: 2249799 - DNA, 16 bp, Homo sapiens
aaattatttgtaagat

SEQ ID NO: 2249800 - DNA, 21 bp, Homo sapiens
aaattatttgtaagatatttg

SEQ ID NO: 2249801 - DNA, 17 bp, Homo sapiens
aaattcaattgtaaatt

SEQ ID NO: 2249802 - DNA, 20 bp, Homo sapiens
aaattcaattgtaaattgaa

SEQ ID NO: 2249803 - DNA, 22 bp, Homo sapiens
aaattcaccccctttcctggac

SEQ ID NO: 2249804 - DNA, 15 bp, Homo sapiens
aaattcagcatttga

SEQ ID NO: 2249805 - DNA, 12 bp, Homo sapiens
aaattcatttct

SEQ ID NO: 2249806 - DNA, 18 bp, Homo sapiens
aaattgctttgtattgta

SEQ ID NO: 2249807 - DNA, 20 bp, Homo sapiens
aaattgtctttaaaaactgt

SEQ ID NO: 2249808 - DNA, 13 bp, Homo sapiens
aaattgtttagtg

SEQ ID NO: 2249809 - DNA, 19 bp, Homo sapiens
aaattgtttagtggaaaat

SEQ ID NO: 2249810 - DNA, 17 bp, Homo sapiens
aaatttaaaagtaaaat

SEQ ID NO: 2249811 - DNA, 22 bp, Homo sapiens
aaatttaaaagtaaaatgtctt

SEQ ID NO: 2249812 - DNA, 17 bp, Homo sapiens
aaatttgactaatttta

SEQ ID NO: 2249813 - DNA, 18 bp, Homo sapiens
aaatttgactaattttac

SEQ ID NO: 2249814 - DNA, 20 bp, Homo sapiens
aaatttgactaattttacat

SEQ ID NO: 2249815 - DNA, 15 bp, Homo sapiens
aaattttaaaaatct

SEQ ID NO: 2249816 - DNA, 21 bp, Homo sapiens
aaattttgctatcaacaataa

SEQ ID NO: 2249817 - DNA, 11 bp, Homo sapiens
aacaaaatttg

SEQ ID NO: 2249818 - DNA, 24 bp, Homo sapiens
aacaaaatttgactaattttacat

SEQ ID NO: 2249819 - DNA, 22 bp, Homo sapiens
aacaaaggcctaattctatgcc

SEQ ID NO: 2249820 - DNA, 12 bp, Homo sapiens
aacaatgaagtt

SEQ ID NO: 2249821 - DNA, 16 bp, Homo sapiens
aacaatgaagttgaaa

SEQ ID NO: 2249822 - DNA, 17 bp, Homo sapiens
aacaatgcaacttttaa

SEQ ID NO: 2249823 - DNA, 17 bp, Homo sapiens
aacacactactacctct

SEQ ID NO: 2249824 - DNA, 21 bp, Homo sapiens
aacacactactacctcttaag

SEQ ID NO: 2249825 - DNA, 17 bp, Homo sapiens
aacactcagtggcccat

SEQ ID NO: 2249826 - DNA, 15 bp, Homo sapiens
aacacttcattttca

SEQ ID NO: 2249827 - DNA, 14 bp, Homo sapiens
aacagaataatgca

SEQ ID NO: 2249828 - DNA, 14 bp, Homo sapiens
aacagatcagtaaa

SEQ ID NO: 2249829 - DNA, 14 bp, Homo sapiens
aacagatttggaaa

SEQ ID NO: 2249830 - DNA, 16 bp, Homo sapiens
aacagggccacataga

SEQ ID NO: 2249831 - DNA, 15 bp, Homo sapiens
aacagtgtgtaaaca

SEQ ID NO: 2249832 - DNA, 21 bp, Homo sapiens
aacagtgtgtaaacaaaatga

SEQ ID NO: 2249833 - DNA, 23 bp, Homo sapiens
aacagtgtgtaaacaaaatgaag

SEQ ID NO: 2249834 - DNA, 17 bp, Homo sapiens
aacagttttgtgtaact

SEQ ID NO: 2249835 - DNA, 23 bp, Homo sapiens
aacatagaaatggaaattttgct

SEQ ID NO: 2249836 - DNA, 15 bp, Homo sapiens
aacatccaatatttt

SEQ ID NO: 2249837 - DNA, 21 bp, Homo sapiens
aacatgaggggacattttggt

SEQ ID NO: 2249838 - DNA, 22 bp, Homo sapiens
aacatgccccctgcagacacgt

SEQ ID NO: 2249839 - DNA, 16 bp, Homo sapiens
aacatggtttaaaaga

SEQ ID NO: 2249840 - DNA, 17 bp, Homo sapiens
aacatgtgaaaagaata

SEQ ID NO: 2249841 - DNA, 14 bp, Homo sapiens
aacatgtttctgtt

SEQ ID NO: 2249842 - DNA, 18 bp, Homo sapiens
aacatgtttctgttttgt

SEQ ID NO: 2249843 - DNA, 14 bp, Homo sapiens
aacattagttttaa

SEQ ID NO: 2249844 - DNA, 16 bp, Homo sapiens
aacattgtagcctcaa

SEQ ID NO: 2249845 - DNA, 22 bp, Homo sapiens
aaccagaaaagcaatactgttt

SEQ ID NO: 2249846 - DNA, 20 bp, Homo sapiens
aaccagccgtattttacatg

SEQ ID NO: 2249847 - DNA, 21 bp, Homo sapiens
aaccagctaagaaaagatttt

SEQ ID NO: 2249848 - DNA, 22 bp, Homo sapiens
aaccatctctcttccagctgct

SEQ ID NO: 2249849 - DNA, 14 bp, Homo sapiens
aaccattttcatta

SEQ ID NO: 2249850 - DNA, 15 bp, Homo sapiens
aacccaagcttagaa

SEQ ID NO: 2249851 - DNA, 16 bp, Homo sapiens
aacccctcctggcctg

SEQ ID NO: 2249852 - DNA, 18 bp, Homo sapiens
aaccctttatttgaacaa

SEQ ID NO: 2249853 - DNA, 18 bp, Homo sapiens
aacccttttaaagttgat

SEQ ID NO: 2249854 - DNA, 23 bp, Homo sapiens
aacctcactatggtatgctggcc

SEQ ID NO: 2249855 - DNA, 16 bp, Homo sapiens
aacctcattggccagc

SEQ ID NO: 2249856 - DNA, 14 bp, Homo sapiens
aacctcccctctcc

SEQ ID NO: 2249857 - DNA, 14 bp, Homo sapiens
aacctctcctgacc

SEQ ID NO: 2249858 - DNA, 17 bp, Homo sapiens
aacctcttctggctcaa

SEQ ID NO: 2249859 - DNA, 20 bp, Homo sapiens
aacctgggattcaggaatgt

SEQ ID NO: 2249860 - DNA, 21 bp, Homo sapiens
aacctgggattcaggaatgtg

SEQ ID NO: 2249861 - DNA, 16 bp, Homo sapiens
aacctggtggcaccag

SEQ ID NO: 2249862 - DNA, 22 bp, Homo sapiens
aacctgtataagtggaggcact

SEQ ID NO: 2249863 - DNA, 20 bp, Homo sapiens
aacctttcacttaagtattg

SEQ ID NO: 2249864 - DNA, 13 bp, Homo sapiens
aacctttccctca

SEQ ID NO: 2249865 - DNA, 18 bp, Homo sapiens
aacctttccctcaccccc

SEQ ID NO: 2249866 - DNA, 20 bp, Homo sapiens
aacctttccctcaccccctc

SEQ ID NO: 2249867 - DNA, 18 bp, Homo sapiens
aacctttccgctgtcgcc

SEQ ID NO: 2249868 - DNA, 17 bp, Homo sapiens
aacgcctcccctgcccc

SEQ ID NO: 2249869 - DNA, 18 bp, Homo sapiens
aacgcctcccctgcccca

SEQ ID NO: 2249870 - DNA, 18 bp, Homo sapiens
aacggcaacgtagcctgg

SEQ ID NO: 2249871 - DNA, 19 bp, Homo sapiens
aacggcaacgtagcctggg

SEQ ID NO: 2249872 - DNA, 16 bp, Homo sapiens
aacgggaacatgcccc

SEQ ID NO: 2249873 - DNA, 13 bp, Homo sapiens
aactaaaatgtat

SEQ ID NO: 2249874 - DNA, 14 bp, Homo sapiens
aactaagattcttt

SEQ ID NO: 2249875 - DNA, 15 bp, Homo sapiens
aactaaggatttttc

SEQ ID NO: 2249876 - DNA, 18 bp, Homo sapiens
aactagccaaaccaggac

SEQ ID NO: 2249877 - DNA, 14 bp, Homo sapiens
aatgaagttgaaaa

SEQ ID NO: 2249878 - DNA, 16 bp, Homo sapiens
aatgacacccatgcca

SEQ ID NO: 2249879 - DNA, 22 bp, Homo sapiens
aatgacacccatgccagagagg

SEQ ID NO: 2249880 - DNA, 15 bp, Homo sapiens
aatgatatgcttgta

SEQ ID NO: 2249881 - DNA, 17 bp, Homo sapiens
aatgatatgcttgtaac

SEQ ID NO: 2249882 - DNA, 21 bp, Homo sapiens
aatgatcgaaaaaataattat

SEQ ID NO: 2249883 - DNA, 21 bp, Homo sapiens
aatgatgatgatgatgatgaa

SEQ ID NO: 2249884 - DNA, 19 bp, Homo sapiens
aatgcaacttttaattact

SEQ ID NO: 2249885 - DNA, 20 bp, Homo sapiens
aatgcaacttttaattactg

SEQ ID NO: 2249886 - DNA, 21 bp, Homo sapiens
aatgcaatgtaagcatacttt

SEQ ID NO: 2249887 - DNA, 15 bp, Homo sapiens
aatgcactttctatc

SEQ ID NO: 2249888 - DNA, 22 bp, Homo sapiens
aatgcactttctatcctctgta

SEQ ID NO: 2249889 - DNA, 15 bp, Homo sapiens
aatgcagcaggaagg

SEQ ID NO: 2249890 - DNA, 14 bp, Homo sapiens
aatgcagtatatag

SEQ ID NO: 2249891 - DNA, 16 bp, Homo sapiens
aatgcatctagattat

SEQ ID NO: 2249892 - DNA, 23 bp, Homo sapiens
aatgcgtgttgtacatacagagg

SEQ ID NO: 2249893 - DNA, 12 bp, Homo sapiens
aatgctgctcca

SEQ ID NO: 2249894 - DNA, 22 bp, Homo sapiens
aatgcttgacaaatattttcat

SEQ ID NO: 2249895 - DNA, 15 bp, Homo sapiens
aatggaaattttgct

SEQ ID NO: 2249896 - DNA, 16 bp, Homo sapiens
aatggaaattttgcta

SEQ ID NO: 2249897 - DNA, 18 bp, Homo sapiens
aatggtatcaaaattaca

SEQ ID NO: 2249898 - DNA, 21 bp, Homo sapiens
aatggtttggtgctttttata

SEQ ID NO: 2249899 - DNA, 23 bp, Homo sapiens
aatggtttggtgctttttataaa

SEQ ID NO: 2249900 - DNA, 16 bp, Homo sapiens
aatgtaatagggaaaa

SEQ ID NO: 2249901 - DNA, 16 bp, Homo sapiens
aatgtacagttgaaat

SEQ ID NO: 2249902 - DNA, 17 bp, Homo sapiens
aatgtagaataggcagg

SEQ ID NO: 2249903 - DNA, 17 bp, Homo sapiens
aatgtatataaaaatgg

SEQ ID NO: 2249904 - DNA, 14 bp, Homo sapiens
aatgtatctaagaa

SEQ ID NO: 2249905 - DNA, 16 bp, Homo sapiens
aatgtccagccacccc

SEQ ID NO: 2249906 - DNA, 14 bp, Homo sapiens
aatgtctattaagg

SEQ ID NO: 2249907 - DNA, 18 bp, Homo sapiens
aatgtgaaaaatctgctg

SEQ ID NO: 2249908 - DNA, 15 bp, Homo sapiens
aatgtgaactttatt

SEQ ID NO: 2249909 - DNA, 20 bp, Homo sapiens
aatgtgaactttattaaata

SEQ ID NO: 2249910 - DNA, 21 bp, Homo sapiens
aatgtgtaagaacaactacct

SEQ ID NO: 2249911 - DNA, 14 bp, Homo sapiens
aatgtgtcattgga

SEQ ID NO: 2249912 - DNA, 16 bp, Homo sapiens
aatgtgtggcctgcac

SEQ ID NO: 2249913 - DNA, 21 bp, Homo sapiens
aatgtttggcatgtaaatgta

SEQ ID NO: 2249914 - DNA, 15 bp, Homo sapiens
aatgttttaaattct

SEQ ID NO: 2249915 - DNA, 14 bp, Homo sapiens
aattaaagtacttt

SEQ ID NO: 2249916 - DNA, 21 bp, Homo sapiens
aattaagaggatgctgggctc

SEQ ID NO: 2249917 - DNA, 21 bp, Homo sapiens
aattacagttaaagaagcaat

SEQ ID NO: 2249918 - DNA, 13 bp, Homo sapiens
aattacatatact

SEQ ID NO: 2249919 - DNA, 16 bp, Homo sapiens
aattatatgtatattg

SEQ ID NO: 2249920 - DNA, 13 bp, Homo sapiens
aattattataaaa

SEQ ID NO: 2249921 - DNA, 12 bp, Homo sapiens
aattattatttg

SEQ ID NO: 2249922 - DNA, 16 bp, Homo sapiens
aattattatttgtgtt

SEQ ID NO: 2249923 - DNA, 11 bp, Homo sapiens
aattatttctg

SEQ ID NO: 2249924 - DNA, 23 bp, Homo sapiens
aattcaattgtaaattgaatcag

SEQ ID NO: 2249925 - DNA, 21 bp, Homo sapiens
aattcacatgatgcacttcaa

SEQ ID NO: 2249926 - DNA, 20 bp, Homo sapiens
aattcaggcatattttaact

SEQ ID NO: 2249927 - DNA, 16 bp, Homo sapiens
aattctggacagacag

SEQ ID NO: 2249928 - DNA, 19 bp, Homo sapiens
aattgctcatgttggccaa

SEQ ID NO: 2249929 - DNA, 17 bp, Homo sapiens
aattggagaagatttat

SEQ ID NO: 2249930 - DNA, 23 bp, Homo sapiens
aattgggtttagtcaatcactgc

SEQ ID NO: 2249931 - DNA, 23 bp, Homo sapiens
aattggtacttttaaaaacataa

SEQ ID NO: 2249932 - DNA, 20 bp, Homo sapiens
aattgtcattatttttgtta

SEQ ID NO: 2249933 - DNA, 23 bp, Homo sapiens
aattgttccttggagaaatgaaa

SEQ ID NO: 2249934 - DNA, 15 bp, Homo sapiens
aattgtttttgtaca

SEQ ID NO: 2249935 - DNA, 16 bp, Homo sapiens
aatttaaaagtaaaat

SEQ ID NO: 2249936 - DNA, 10 bp, Homo sapiens
aatttaaaca

SEQ ID NO: 2249937 - DNA, 18 bp, Homo sapiens
aatttaagtgttggaaaa

SEQ ID NO: 2249938 - DNA, 22 bp, Homo sapiens
aatttactcacagcacttgttt

SEQ ID NO: 2249939 - DNA, 20 bp, Homo sapiens
aatttaggtttttattagta

SEQ ID NO: 2249940 - DNA, 13 bp, Homo sapiens
aatttattctgat

SEQ ID NO: 2249941 - DNA, 14 bp, Homo sapiens
aatttattctgata

SEQ ID NO: 2249942 - DNA, 22 bp, Homo sapiens
aatttctttttttcctttttaa

SEQ ID NO: 2249943 - DNA, 16 bp, Homo sapiens
aatttgcactgtttaa

SEQ ID NO: 2249944 - DNA, 12 bp, Homo sapiens
aatttgttgcat

SEQ ID NO: 2249945 - DNA, 19 bp, Homo sapiens
aattttataggactgttct

SEQ ID NO: 2249946 - DNA, 18 bp, Homo sapiens
aattttcctcaatcacac

SEQ ID NO: 2249947 - DNA, 19 bp, Homo sapiens
aattttcctcaatcacact

SEQ ID NO: 2249948 - DNA, 17 bp, Homo sapiens
aattttgtgtaagaaat

SEQ ID NO: 2249949 - DNA, 20 bp, Homo sapiens
aatttttgcttttagaaaag

SEQ ID NO: 2249950 - DNA, 17 bp, Homo sapiens
aatttttgtattatttt

SEQ ID NO: 2249951 - DNA, 11 bp, Homo sapiens
acaaaacttcc

SEQ ID NO: 2249952 - DNA, 14 bp, Homo sapiens
acaaaatctgttta

SEQ ID NO: 2249953 - DNA, 16 bp, Homo sapiens
acaaaatgtatgtctg

SEQ ID NO: 2249954 - DNA, 13 bp, Homo sapiens
acaaaatttgact

SEQ ID NO: 2249955 - DNA, 20 bp, Homo sapiens
acaaacagggctgccttctg

SEQ ID NO: 2249956 - DNA, 17 bp, Homo sapiens
acaaactgatttctcac

SEQ ID NO: 2249957 - DNA, 14 bp, Homo sapiens
acaaataatttaga

SEQ ID NO: 2249958 - DNA, 15 bp, Homo sapiens
acaaatattatttgt

SEQ ID NO: 2249959 - DNA, 21 bp, Homo sapiens
acaaatattatttgtgtttcc

SEQ ID NO: 2249960 - DNA, 15 bp, Homo sapiens
acaaatgacactgca

SEQ ID NO: 2249961 - DNA, 19 bp, Homo sapiens
acaaatgtgatttttgtaa

SEQ ID NO: 2249962 - DNA, 22 bp, Homo sapiens
acaaattagaaaatgttattta

SEQ ID NO: 2249963 - DNA, 16 bp, Homo sapiens
acaacacttcattttc

SEQ ID NO: 2249964 - DNA, 18 bp, Homo sapiens
acaacacttcattttcag

SEQ ID NO: 2249965 - DNA, 19 bp, Homo sapiens
acaagaaacgtgtcacact

SEQ ID NO: 2249966 - DNA, 19 bp, Homo sapiens
acaagaccaccacttcgaa

SEQ ID NO: 2249967 - DNA, 19 bp, Homo sapiens
acaagccctgcttttgcat

SEQ ID NO: 2249968 - DNA, 18 bp, Homo sapiens
acaaggtataataaaatt

SEQ ID NO: 2249969 - DNA, 15 bp, Homo sapiens
acaataaacataaca

SEQ ID NO: 2249970 - DNA, 15 bp, Homo sapiens
acaataaaccctcag

SEQ ID NO: 2249971 - DNA, 20 bp, Homo sapiens
acaatgaagttgaaaatcat

SEQ ID NO: 2249972 - DNA, 21 bp, Homo sapiens
acaatgatcaccgactgaaaa

SEQ ID NO: 2249973 - DNA, 16 bp, Homo sapiens
acaatgcaacttttaa

SEQ ID NO: 2249974 - DNA, 12 bp, Homo sapiens
acaatgtgaact

SEQ ID NO: 2249975 - DNA, 20 bp, Homo sapiens
acaattattccaaaccaaat

SEQ ID NO: 2249976 - DNA, 22 bp, Homo sapiens
acaattattccaaaccaaattt

SEQ ID NO: 2249977 - DNA, 15 bp, Homo sapiens
acaattctgttttta

SEQ ID NO: 2249978 - DNA, 14 bp, Homo sapiens
acaatttattctga

SEQ ID NO: 2249979 - DNA, 22 bp, Homo sapiens
acacacagtgattccctcctcc

SEQ ID NO: 2249980 - DNA, 14 bp, Homo sapiens
acacactactacct

SEQ ID NO: 2249981 - DNA, 22 bp, Homo sapiens
acacagcagaggcccagatatt

SEQ ID NO: 2249982 - DNA, 19 bp, Homo sapiens
acacagtaccatttaatgg

SEQ ID NO: 2249983 - DNA, 16 bp, Homo sapiens
acacagttcctgggaa

SEQ ID NO: 2249984 - DNA, 18 bp, Homo sapiens
acacagttcctgggaaca

SEQ ID NO: 2249985 - DNA, 17 bp, Homo sapiens
actacagcttcagtgat

SEQ ID NO: 2249986 - DNA, 20 bp, Homo sapiens
actactcaatactacctctg

SEQ ID NO: 2249987 - DNA, 20 bp, Homo sapiens
actactgacagggagcagcc

SEQ ID NO: 2249988 - DNA, 15 bp, Homo sapiens
actactttctctttt

SEQ ID NO: 2249989 - DNA, 22 bp, Homo sapiens
actactttgttaggattttcac

SEQ ID NO: 2249990 - DNA, 23 bp, Homo sapiens
actagatactactttctcttttt

SEQ ID NO: 2249991 - DNA, 16 bp, Homo sapiens
actaggtaacttcata

SEQ ID NO: 2249992 - DNA, 16 bp, Homo sapiens
actatcaatatttaag

SEQ ID NO: 2249993 - DNA, 20 bp, Homo sapiens
actatgagctttcagactcc

SEQ ID NO: 2249994 - DNA, 16 bp, Homo sapiens
actatgtatttttcta

SEQ ID NO: 2249995 - DNA, 17 bp, Homo sapiens
actatgtatttttctat

SEQ ID NO: 2249996 - DNA, 16 bp, Homo sapiens
actattacttgaactt

SEQ ID NO: 2249997 - DNA, 20 bp, Homo sapiens
actatttaaagcctcctcat

SEQ ID NO: 2249998 - DNA, 20 bp, Homo sapiens
actatttttgtaaaagacat

SEQ ID NO: 2249999 - DNA, 18 bp, Homo sapiens
actcaagttgattagaaa

SEQ ID NO: 2250000 - DNA, 13 bp, Homo sapiens
actcatctgaaat

SEQ ID NO: 2250001 - DNA, 19 bp, Homo sapiens
actcatctgaaatgttaca

SEQ ID NO: 2250002 - DNA, 23 bp, Homo sapiens
actcatctgaaatgttacaaaaa

SEQ ID NO: 2250003 - DNA, 22 bp, Homo sapiens
actcattgctgagcctctgctc

SEQ ID NO: 2250004 - DNA, 12 bp, Homo sapiens
actcatttcatc

SEQ ID NO: 2250005 - DNA, 15 bp, Homo sapiens
actcatttcatctca

SEQ ID NO: 2250006 - DNA, 19 bp, Homo sapiens
actccaacagaagaactgt

SEQ ID NO: 2250007 - DNA, 20 bp, Homo sapiens
actccacgcagctggcagag

SEQ ID NO: 2250008 - DNA, 17 bp, Homo sapiens
actccccagccccagcc

SEQ ID NO: 2250009 - DNA, 22 bp, Homo sapiens
actccctcagatcccagttcct

SEQ ID NO: 2250010 - DNA, 22 bp, Homo sapiens
actccctgtgggggtggccatc

SEQ ID NO: 2250011 - DNA, 16 bp, Homo sapiens
actcgcgctcagtaaa

SEQ ID NO: 2250012 - DNA, 15 bp, Homo sapiens
actcgtgtgtttcta

SEQ ID NO: 2250013 - DNA, 18 bp, Homo sapiens
actctaggatgtatattt

SEQ ID NO: 2250014 - DNA, 20 bp, Homo sapiens
actctatttttacatttaaa

SEQ ID NO: 2250015 - DNA, 18 bp, Homo sapiens
actctcatcactacagta

SEQ ID NO: 2250016 - DNA, 21 bp, Homo sapiens
actctggacccctgggcctca

SEQ ID NO: 2250017 - DNA, 15 bp, Homo sapiens
actctggcaaagctt

SEQ ID NO: 2250018 - DNA, 16 bp, Homo sapiens
actctggcaaagcttt

SEQ ID NO: 2250019 - DNA, 12 bp, Homo sapiens
actcttgagaat

SEQ ID NO: 2250020 - DNA, 18 bp, Homo sapiens
actgaaaatattgtttta

SEQ ID NO: 2250021 - DNA, 20 bp, Homo sapiens
actgacagggagcagccccc

SEQ ID NO: 2250022 - DNA, 15 bp, Homo sapiens
actgacgtcctccct

SEQ ID NO: 2250023 - DNA, 15 bp, Homo sapiens
actgagaaatgaatg

SEQ ID NO: 2250024 - DNA, 13 bp, Homo sapiens
actgatttctcac

SEQ ID NO: 2250025 - DNA, 14 bp, Homo sapiens
actgcaaccttgtt

SEQ ID NO: 2250026 - DNA, 19 bp, Homo sapiens
actgcagttgactttctcc

SEQ ID NO: 2250027 - DNA, 14 bp, Homo sapiens
actgcatccagcct

SEQ ID NO: 2250028 - DNA, 21 bp, Homo sapiens
actgcatgcaaacaagaaacg

SEQ ID NO: 2250029 - DNA, 16 bp, Homo sapiens
actgcattcctgtgcc

SEQ ID NO: 2250030 - DNA, 14 bp, Homo sapiens
actgctaaataaaa

SEQ ID NO: 2250031 - DNA, 13 bp, Homo sapiens
actgctactgtaa

SEQ ID NO: 2250032 - DNA, 22 bp, Homo sapiens
actgctactgtaattttatatg

SEQ ID NO: 2250033 - DNA, 20 bp, Homo sapiens
actgctcgtggactgtgctg

SEQ ID NO: 2250034 - DNA, 22 bp, Homo sapiens
actggaacccttttaaagttga

SEQ ID NO: 2250035 - DNA, 18 bp, Homo sapiens
actggaaggggaagggac

SEQ ID NO: 2250036 - DNA, 21 bp, Homo sapiens
actggacatttaacttttcta

SEQ ID NO: 2250037 - DNA, 19 bp, Homo sapiens
actggcagatcgctcactg

SEQ ID NO: 2250038 - DNA, 15 bp, Homo sapiens
actggcttcagcaag

SEQ ID NO: 2250039 - DNA, 10 bp, Homo sapiens
actgggaaac

SEQ ID NO: 2250040 - DNA, 11 bp, Homo sapiens
actgggaaact

SEQ ID NO: 2250041 - DNA, 13 bp, Homo sapiens
actggggagcccg

SEQ ID NO: 2250042 - DNA, 17 bp, Homo sapiens
actggggagcccgtctc

SEQ ID NO: 2250043 - DNA, 16 bp, Homo sapiens
actggggcagacaata

SEQ ID NO: 2250044 - DNA, 12 bp, Homo sapiens
actggggcctcc

SEQ ID NO: 2250045 - DNA, 13 bp, Homo sapiens
actgggtgagaga

SEQ ID NO: 2250046 - DNA, 15 bp, Homo sapiens
actgtcactcattgc

SEQ ID NO: 2250047 - DNA, 15 bp, Homo sapiens
actgtcctaacatgg

SEQ ID NO: 2250048 - DNA, 22 bp, Homo sapiens
actgtctgttctgcacaataaa

SEQ ID NO: 2250049 - DNA, 12 bp, Homo sapiens
actgtgtaaact

SEQ ID NO: 2250050 - DNA, 13 bp, Homo sapiens
actgtgtacacct

SEQ ID NO: 2250051 - DNA, 21 bp, Homo sapiens
actgtgttgtaccaaaattca

SEQ ID NO: 2250052 - DNA, 14 bp, Homo sapiens
actgtgtttcaagt

SEQ ID NO: 2250053 - DNA, 18 bp, Homo sapiens
actgtgtttcaagttcaa

SEQ ID NO: 2250054 - DNA, 15 bp, Homo sapiens
actgttctttccagg

SEQ ID NO: 2250055 - DNA, 14 bp, Homo sapiens
actgtttaatcata

SEQ ID NO: 2250056 - DNA, 15 bp, Homo sapiens
acttaagtattgtca

SEQ ID NO: 2250057 - DNA, 23 bp, Homo sapiens
acttacattgttcaattagaata

SEQ ID NO: 2250058 - DNA, 17 bp, Homo sapiens
acttacctcaaattaag

SEQ ID NO: 2250059 - DNA, 16 bp, Homo sapiens
acttagccattgaaat

SEQ ID NO: 2250060 - DNA, 23 bp, Homo sapiens
acttatgacctcttcctttagga

SEQ ID NO: 2250061 - DNA, 22 bp, Homo sapiens
acttcattttcaggaaatctac

SEQ ID NO: 2250062 - DNA, 14 bp, Homo sapiens
acttcctacagagc

SEQ ID NO: 2250063 - DNA, 17 bp, Homo sapiens
acttcctcctccccact

SEQ ID NO: 2250064 - DNA, 13 bp, Homo sapiens
acttcctgtccgg

SEQ ID NO: 2250065 - DNA, 16 bp, Homo sapiens
acttcttacgactttt

SEQ ID NO: 2250066 - DNA, 22 bp, Homo sapiens
acttcttacgacttttttgaga

SEQ ID NO: 2250067 - DNA, 15 bp, Homo sapiens
acttgaagctttgta

SEQ ID NO: 2250068 - DNA, 17 bp, Homo sapiens
acttgatgatttttaac

SEQ ID NO: 2250069 - DNA, 23 bp, Homo sapiens
acttgatgtgatgtggcaggagg

SEQ ID NO: 2250070 - DNA, 19 bp, Homo sapiens
acttgcaaagacctacctc

SEQ ID NO: 2250071 - DNA, 20 bp, Homo sapiens
acttgcaaagacctacctcc

SEQ ID NO: 2250072 - DNA, 22 bp, Homo sapiens
acttgcaaagacctacctccag

SEQ ID NO: 2250073 - DNA, 16 bp, Homo sapiens
acttgtcagcctcaga

SEQ ID NO: 2250074 - DNA, 17 bp, Homo sapiens
acttgtgattatttatt

SEQ ID NO: 2250075 - DNA, 11 bp, Homo sapiens
acttgtgtctg

SEQ ID NO: 2250076 - DNA, 15 bp, Homo sapiens
actttagggctgtaa

SEQ ID NO: 2250077 - DNA, 14 bp, Homo sapiens
actttataaatttc

SEQ ID NO: 2250078 - DNA, 12 bp, Homo sapiens
actttattaaat

SEQ ID NO: 2250079 - DNA, 21 bp, Homo sapiens
actttattgccttttaatttt

SEQ ID NO: 2250080 - DNA, 22 bp, Homo sapiens
actttcatattttaaacagagg

SEQ ID NO: 2250081 - DNA, 14 bp, Homo sapiens
actttccaaaacct

SEQ ID NO: 2250082 - DNA, 17 bp, Homo sapiens
actttctacaatgtgaa

SEQ ID NO: 2250083 - DNA, 19 bp, Homo sapiens
actttctacaatgtgaact

SEQ ID NO: 2250084 - DNA, 17 bp, Homo sapiens
actttctatcctctgta

SEQ ID NO: 2250085 - DNA, 23 bp, Homo sapiens
actttgaaagttaactcttcaaa

SEQ ID NO: 2250086 - DNA, 23 bp, Homo sapiens
actttggagtcccctcacctcct

SEQ ID NO: 2250087 - DNA, 20 bp, Homo sapiens
actttgttaggattttcaca

SEQ ID NO: 2250088 - DNA, 22 bp, Homo sapiens
acttttagccagagatgcaata

SEQ ID NO: 2250089 - DNA, 20 bp, Homo sapiens
acttttatttcctgtatgtt

SEQ ID NO: 2250090 - DNA, 23 bp, Homo sapiens
acttttcctgggtttcctgcagg

SEQ ID NO: 2250091 - DNA, 13 bp, Homo sapiens
acttttccttttc

SEQ ID NO: 2250092 - DNA, 14 bp, Homo sapiens
acttttccttttct

SEQ ID NO: 2250093 - DNA, 12 bp, Homo sapiens
ttttaagaaaca

SEQ ID NO: 2250094 - DNA, 13 bp, Homo sapiens
ttttaagacgtga

SEQ ID NO: 2250095 - DNA, 13 bp, Homo sapiens
ttttaaggtcttt

SEQ ID NO: 2250096 - DNA, 21 bp, Homo sapiens
ttttaaggtctttcagtactt

SEQ ID NO: 2250097 - DNA, 21 bp, Homo sapiens
ttttaatattaacttttaatg

SEQ ID NO: 2250098 - DNA, 18 bp, Homo sapiens
aaacctctcctgacccct

SEQ ID NO: 2250099 - DNA, 20 bp, Homo sapiens
aaacggcaacgtagcctggg

SEQ ID NO: 2250100 - DNA, 21 bp, Homo sapiens
aaacggcaacgtagcctgggc

SEQ ID NO: 2250101 - DNA, 20 bp, Homo sapiens
aaacgggaacatgccccctg

SEQ ID NO: 2250102 - DNA, 16 bp, Homo sapiens
aaactaagattctttt

SEQ ID NO: 2250103 - DNA, 17 bp, Homo sapiens
aaactaaggatttttca

SEQ ID NO: 2250104 - DNA, 15 bp, Homo sapiens
aaactagtttttcct

SEQ ID NO: 2250105 - DNA, 16 bp, Homo sapiens
aaactagtttttccta

SEQ ID NO: 2250106 - DNA, 13 bp, Homo sapiens
aaactatgtgttt

SEQ ID NO: 2250107 - DNA, 19 bp, Homo sapiens
aaactatgtgtttttctca

SEQ ID NO: 2250108 - DNA, 21 bp, Homo sapiens
aaactatgtgtttttctcata

SEQ ID NO: 2250109 - DNA, 22 bp, Homo sapiens
aaactatttttgtaaaagacat

SEQ ID NO: 2250110 - DNA, 22 bp, Homo sapiens
aaactccagatgccacaatgga

SEQ ID NO: 2250111 - DNA, 20 bp, Homo sapiens
aaactgagaaatgaatgctg

SEQ ID NO: 2250112 - DNA, 15 bp, Homo sapiens
aaactgcacttttag

SEQ ID NO: 2250113 - DNA, 16 bp, Homo sapiens
aaactgggtttctcat

SEQ ID NO: 2250114 - DNA, 17 bp, Homo sapiens
aaacttgaagctttgta

SEQ ID NO: 2250115 - DNA, 15 bp, Homo sapiens
aaagaacgctgattt

SEQ ID NO: 2250116 - DNA, 14 bp, Homo sapiens
aaagaccaggccaa

SEQ ID NO: 2250117 - DNA, 13 bp, Homo sapiens
aaagactggcttt

SEQ ID NO: 2250118 - DNA, 21 bp, Homo sapiens
aaagactggcttttattaatg

SEQ ID NO: 2250119 - DNA, 20 bp, Homo sapiens
aaagaggctgcccctctcac

SEQ ID NO: 2250120 - DNA, 19 bp, Homo sapiens
aaagattaaatgtgtcatt

SEQ ID NO: 2250121 - DNA, 14 bp, Homo sapiens
aaagattttaatca

SEQ ID NO: 2250122 - DNA, 12 bp, Homo sapiens
aaagcaatattg

SEQ ID NO: 2250123 - DNA, 13 bp, Homo sapiens
aaagcaattatat

SEQ ID NO: 2250124 - DNA, 17 bp, Homo sapiens
aaagcatgaaatgtgaa

SEQ ID NO: 2250125 - DNA, 12 bp, Homo sapiens
aaagcatttata

SEQ ID NO: 2250126 - DNA, 19 bp, Homo sapiens
aaagccaaccttcaaagaa

SEQ ID NO: 2250127 - DNA, 21 bp, Homo sapiens
aaagccaaccttcaaagaaac

SEQ ID NO: 2250128 - DNA, 22 bp, Homo sapiens
aaagccatgccaataaagtgat

SEQ ID NO: 2250129 - DNA, 14 bp, Homo sapiens
aaagcttaaaaaaa

SEQ ID NO: 2250130 - DNA, 15 bp, Homo sapiens
aaagcttgtggccaa

SEQ ID NO: 2250131 - DNA, 20 bp, Homo sapiens
aaagcttgtggccaatggaa

SEQ ID NO: 2250132 - DNA, 15 bp, Homo sapiens
aaaggaaatcaaatg

SEQ ID NO: 2250133 - DNA, 17 bp, Homo sapiens
aaaggaaatcaaatgaa

SEQ ID NO: 2250134 - DNA, 12 bp, Homo sapiens
aaaggaactaga

SEQ ID NO: 2250135 - DNA, 16 bp, Homo sapiens
aaaggattttaccaaa

SEQ ID NO: 2250136 - DNA, 21 bp, Homo sapiens
aaaggcctaattctatgcctg

SEQ ID NO: 2250137 - DNA, 14 bp, Homo sapiens
aaaggttaggagag

SEQ ID NO: 2250138 - DNA, 14 bp, Homo sapiens
aaagtaaaatgtct

SEQ ID NO: 2250139 - DNA, 12 bp, Homo sapiens
aaagtattcttc

SEQ ID NO: 2250140 - DNA, 19 bp, Homo sapiens
aaagtctgttgattaaaga

SEQ ID NO: 2250141 - DNA, 15 bp, Homo sapiens
aaagtgcaatgcgtg

SEQ ID NO: 2250142 - DNA, 15 bp, Homo sapiens
aaagttactaggtaa

SEQ ID NO: 2250143 - DNA, 21 bp, Homo sapiens
aaagttactaggtaacttcat

SEQ ID NO: 2250144 - DNA, 17 bp, Homo sapiens
aaagttggtattaataa

SEQ ID NO: 2250145 - DNA, 15 bp, Homo sapiens
aaagttttgttctgt

SEQ ID NO: 2250146 - DNA, 12 bp, Homo sapiens
aaataaaactgt

SEQ ID NO: 2250147 - DNA, 12 bp, Homo sapiens
aaataaaagcac

SEQ ID NO: 2250148 - DNA, 14 bp, Homo sapiens
aaataaaagcacaa

SEQ ID NO: 2250149 - DNA, 16 bp, Homo sapiens
aaataaaatttgttgc

SEQ ID NO: 2250150 - DNA, 15 bp, Homo sapiens
aaataactaaaatgt

SEQ ID NO: 2250151 - DNA, 17 bp, Homo sapiens
aaataagcaaataaaca

SEQ ID NO: 2250152 - DNA, 12 bp, Homo sapiens
aaataattttgt

SEQ ID NO: 2250153 - DNA, 14 bp, Homo sapiens
aaataattttgtaa

SEQ ID NO: 2250154 - DNA, 21 bp, Homo sapiens
aaatacaatttttatttcttt

SEQ ID NO: 2250155 - DNA, 17 bp, Homo sapiens
aaatacatagtgaaaat

SEQ ID NO: 2250156 - DNA, 20 bp, Homo sapiens
aaatactatttaaagcctcc

SEQ ID NO: 2250157 - DNA, 21 bp, Homo sapiens
aaatactatttaagatgtgaa

SEQ ID NO: 2250158 - DNA, 15 bp, Homo sapiens
aaatagatataaatt

SEQ ID NO: 2250159 - DNA, 17 bp, Homo sapiens
aaatagttcaaactgca

SEQ ID NO: 2250160 - DNA, 13 bp, Homo sapiens
aaatatatacatt

SEQ ID NO: 2250161 - DNA, 19 bp, Homo sapiens
aaatatattcaaattatgt

SEQ ID NO: 2250162 - DNA, 13 bp, Homo sapiens
aaatatggaactt

SEQ ID NO: 2250163 - DNA, 14 bp, Homo sapiens
aaatattaagcatg

SEQ ID NO: 2250164 - DNA, 13 bp, Homo sapiens
aaatattatttgt

SEQ ID NO: 2250165 - DNA, 22 bp, Homo sapiens
aaatattgccaactcttctatt

SEQ ID NO: 2250166 - DNA, 19 bp, Homo sapiens
aaatatttataaaacttct

SEQ ID NO: 2250167 - DNA, 16 bp, Homo sapiens
aaatatttcagtgaat

SEQ ID NO: 2250168 - DNA, 15 bp, Homo sapiens
aaatattttctattt

SEQ ID NO: 2250169 - DNA, 12 bp, Homo sapiens
aaatattttctc

SEQ ID NO: 2250170 - DNA, 21 bp, Homo sapiens
aaatattttgaatcaataata

SEQ ID NO: 2250171 - DNA, 22 bp, Homo sapiens
aaatattttgaatcaataatat

SEQ ID NO: 2250172 - DNA, 12 bp, Homo sapiens
aaatatttttgg

SEQ ID NO: 2250173 - DNA, 23 bp, Homo sapiens
aaatcatgttgatcatgtacttt

SEQ ID NO: 2250174 - DNA, 15 bp, Homo sapiens
aaatctaaatttctt

SEQ ID NO: 2250175 - DNA, 21 bp, Homo sapiens
aaatctaagcagcttattgtt

SEQ ID NO: 2250176 - DNA, 13 bp, Homo sapiens
aaatgaaactcaa

SEQ ID NO: 2250177 - DNA, 11 bp, Homo sapiens
aaatgaaaggg

SEQ ID NO: 2250178 - DNA, 18 bp, Homo sapiens
aaatgaacctgctactta

SEQ ID NO: 2250179 - DNA, 23 bp, Homo sapiens
aaatgaatggaggaactttccaa

SEQ ID NO: 2250180 - DNA, 13 bp, Homo sapiens
aaatgaattcttt

SEQ ID NO: 2250181 - DNA, 17 bp, Homo sapiens
aaatgacatgttccttt

SEQ ID NO: 2250182 - DNA, 17 bp, Homo sapiens
aaatgagacgaaatgct

SEQ ID NO: 2250183 - DNA, 21 bp, Homo sapiens
aaatgagctcaaattgatttt

SEQ ID NO: 2250184 - DNA, 20 bp, Homo sapiens
aaatgcatgattttgtaacc

SEQ ID NO: 2250185 - DNA, 19 bp, Homo sapiens
aaatgcttagaaattcagc

SEQ ID NO: 2250186 - DNA, 21 bp, Homo sapiens
aaatggagatttggaattgaa

SEQ ID NO: 2250187 - DNA, 16 bp, Homo sapiens
aaatgggacttaactc

SEQ ID NO: 2250188 - DNA, 22 bp, Homo sapiens
aaatgtaaactcagcatcaaaa

SEQ ID NO: 2250189 - DNA, 15 bp, Homo sapiens
aaatgtatctaagaa

SEQ ID NO: 2250190 - DNA, 20 bp, Homo sapiens
aaatgtttggcatgtaaatg

SEQ ID NO: 2250191 - DNA, 19 bp, Homo sapiens
aaattaaacttatttacaa

SEQ ID NO: 2250192 - DNA, 11 bp, Homo sapiens
aaattaatatc

SEQ ID NO: 2250193 - DNA, 12 bp, Homo sapiens
aaattaatatct

SEQ ID NO: 2250194 - DNA, 16 bp, Homo sapiens
aaattacaattttatc

SEQ ID NO: 2250195 - DNA, 11 bp, Homo sapiens
aaattagaaaa

SEQ ID NO: 2250196 - DNA, 13 bp, Homo sapiens
aaattagaaaata

SEQ ID NO: 2250197 - DNA, 15 bp, Homo sapiens
aaattagaaaatatt

SEQ ID NO: 2250198 - DNA, 18 bp, Homo sapiens
aaattaggtattttgtcc

SEQ ID NO: 2250199 - DNA, 14 bp, Homo sapiens
aaattatcctcttt

SEQ ID NO: 2250200 - DNA, 18 bp, Homo sapiens
aaattatcctctttgtaa

SEQ ID NO: 2250201 - DNA, 21 bp, Homo sapiens
aaattatcctctttgtaattt

SEQ ID NO: 2250202 - DNA, 15 bp, Homo sapiens
aaattatttcttaat

SEQ ID NO: 2250203 - DNA, 20 bp, Homo sapiens
aaattatttcttaattatta

SEQ ID NO: 2250204 - DNA, 11 bp, Homo sapiens
aaattcaaata

SEQ ID NO: 2250205 - DNA, 19 bp, Homo sapiens
aaattcacatgatgcactt

SEQ ID NO: 2250206 - DNA, 21 bp, Homo sapiens
aaattcacatgatgcacttca

SEQ ID NO: 2250207 - DNA, 20 bp, Homo sapiens
aaattctttcccagtctgtc

SEQ ID NO: 2250208 - DNA, 12 bp, Homo sapiens
aaaaaataatta

SEQ ID NO: 2250209 - DNA, 18 bp, Homo sapiens
aaaaacataacataaatt

SEQ ID NO: 2250210 - DNA, 14 bp, Homo sapiens
aaaaactgaaaaat

SEQ ID NO: 2250211 - DNA, 22 bp, Homo sapiens
aaaaagcttgtggccaatggaa

SEQ ID NO: 2250212 - DNA, 10 bp, Homo sapiens
aaaaatatta

SEQ ID NO: 2250213 - DNA, 18 bp, Homo sapiens
aaaaatctgctgttaact

SEQ ID NO: 2250214 - DNA, 20 bp, Homo sapiens
aaaaatgagagctgtaactg

SEQ ID NO: 2250215 - DNA, 19 bp, Homo sapiens
aaaaatggaaaaataaaca

SEQ ID NO: 2250216 - DNA, 19 bp, Homo sapiens
aaaaatgtccagccacccc

SEQ ID NO: 2250217 - DNA, 22 bp, Homo sapiens
aaaacaaaatttgactaatttt

SEQ ID NO: 2250218 - DNA, 22 bp, Homo sapiens
aaaacaagtactggttgacttt

SEQ ID NO: 2250219 - DNA, 20 bp, Homo sapiens
aaaacagtgtgtaaacaaaa

SEQ ID NO: 2250220 - DNA, 23 bp, Homo sapiens
aaaacatagaaatggaaattttg

SEQ ID NO: 2250221 - DNA, 15 bp, Homo sapiens
aaaactttaaacctg

SEQ ID NO: 2250222 - DNA, 13 bp, Homo sapiens
aaaagatgaattt

SEQ ID NO: 2250223 - DNA, 20 bp, Homo sapiens
aaaagcaaaaaaaaaaaagg

SEQ ID NO: 2250224 - DNA, 18 bp, Homo sapiens
aaaagcaattatattgtc

SEQ ID NO: 2250225 - DNA, 14 bp, Homo sapiens
aaaaggagtataca

SEQ ID NO: 2250226 - DNA, 15 bp, Homo sapiens
aaaaggagtatacaa

SEQ ID NO: 2250227 - DNA, 13 bp, Homo sapiens
aaaagtgcaatgc

SEQ ID NO: 2250228 - DNA, 21 bp, Homo sapiens
aaaagtgcaatgcgtgttgta

SEQ ID NO: 2250229 - DNA, 17 bp, Homo sapiens
aaaagtttgaaaagcaa

SEQ ID NO: 2250230 - DNA, 12 bp, Homo sapiens
aaaataaaactg

SEQ ID NO: 2250231 - DNA, 14 bp, Homo sapiens
aaaataaaactgtc

SEQ ID NO: 2250232 - DNA, 14 bp, Homo sapiens
aaaataagtaaata

SEQ ID NO: 2250233 - DNA, 13 bp, Homo sapiens
aaaataattttgt

SEQ ID NO: 2250234 - DNA, 14 bp, Homo sapiens
aaaataattttgta

SEQ ID NO: 2250235 - DNA, 16 bp, Homo sapiens
aaaatacaatttttat

SEQ ID NO: 2250236 - DNA, 16 bp, Homo sapiens
aaaatacatagtgaaa

SEQ ID NO: 2250237 - DNA, 18 bp, Homo sapiens
aaaatactatttaagatg

SEQ ID NO: 2250238 - DNA, 15 bp, Homo sapiens
aaaatactttgagtt

SEQ ID NO: 2250239 - DNA, 18 bp, Homo sapiens
aaaatactttgagttttg

SEQ ID NO: 2250240 - DNA, 15 bp, Homo sapiens
aaaataggcttttta

SEQ ID NO: 2250241 - DNA, 14 bp, Homo sapiens
aaaatcacgttaaa

SEQ ID NO: 2250242 - DNA, 22 bp, Homo sapiens
aaaatctaagcagcttattgtt

SEQ ID NO: 2250243 - DNA, 13 bp, Homo sapiens
aaaatggtatcaa

SEQ ID NO: 2250244 - DNA, 20 bp, Homo sapiens
aaaatgtccagccaccccca

SEQ ID NO: 2250245 - DNA, 21 bp, Homo sapiens
aaaatgtctttccaaattatt

SEQ ID NO: 2250246 - DNA, 16 bp, Homo sapiens
aaaatgttatttaaca

SEQ ID NO: 2250247 - DNA, 18 bp, Homo sapiens
aaaattcatagtaagatt

SEQ ID NO: 2250248 - DNA, 15 bp, Homo sapiens
aaaattcatttctaa

SEQ ID NO: 2250249 - DNA, 17 bp, Homo sapiens
aaaattttaaaaatcta

SEQ ID NO: 2250250 - DNA, 21 bp, Homo sapiens
aaacaaaaattaggtattttg

SEQ ID NO: 2250251 - DNA, 12 bp, Homo sapiens
aaacaaaatttg

SEQ ID NO: 2250252 - DNA, 14 bp, Homo sapiens
aaacaaagccatgc

SEQ ID NO: 2250253 - DNA, 22 bp, Homo sapiens
aaacaaatattgccaactcttc

SEQ ID NO: 2250254 - DNA, 22 bp, Homo sapiens
aaacagggctgccttctggcct

SEQ ID NO: 2250255 - DNA, 17 bp, Homo sapiens
aaacataacataaattt

SEQ ID NO: 2250256 - DNA, 16 bp, Homo sapiens
aaacatttcataattt

SEQ ID NO: 2250257 - DNA, 23 bp, Homo sapiens
aaaccatttttgttactctcttc

SEQ ID NO: 2250258 - DNA, 16 bp, Homo sapiens
aaacctcattggccag

SEQ ID NO: 2250259 - DNA, 20 bp, Homo sapiens
aaacctcattggccagctca

SEQ ID NO: 2250260 - DNA, 17 bp, Homo sapiens
aaacctctcctgacccc

SEQ ID NO: 2250261 - DNA, 20 bp, Homo sapiens
aacaagccctgcttttgcat

SEQ ID NO: 2250262 - DNA, 22 bp, Homo sapiens
aacaagccctgcttttgcataa

SEQ ID NO: 2250263 - DNA, 18 bp, Homo sapiens
aacaataggctgttccca

SEQ ID NO: 2250264 - DNA, 15 bp, Homo sapiens
aacaatgaagttgaa

SEQ ID NO: 2250265 - DNA, 16 bp, Homo sapiens
aacaatttattctgat

SEQ ID NO: 2250266 - DNA, 16 bp, Homo sapiens
aacacctcctcatgta

SEQ ID NO: 2250267 - DNA, 17 bp, Homo sapiens
aacaccttccagctcct

SEQ ID NO: 2250268 - DNA, 15 bp, Homo sapiens
aacacgtttttacat

SEQ ID NO: 2250269 - DNA, 19 bp, Homo sapiens
aacacgtttttacatactt

SEQ ID NO: 2250270 - DNA, 16 bp, Homo sapiens
aacagaataatgcatg

SEQ ID NO: 2250271 - DNA, 13 bp, Homo sapiens
aacagaatggatt

SEQ ID NO: 2250272 - DNA, 15 bp, Homo sapiens
aacagatttggaaag

SEQ ID NO: 2250273 - DNA, 16 bp, Homo sapiens
aacagcctctttttga

SEQ ID NO: 2250274 - DNA, 13 bp, Homo sapiens
aacaggacagcac

SEQ ID NO: 2250275 - DNA, 20 bp, Homo sapiens
aacagggccacatagatgct

SEQ ID NO: 2250276 - DNA, 14 bp, Homo sapiens
aacagggctgcctt

SEQ ID NO: 2250277 - DNA, 21 bp, Homo sapiens
aacagggctgccttctggcct

SEQ ID NO: 2250278 - DNA, 21 bp, Homo sapiens
aacagtcttgctgaattaagc

SEQ ID NO: 2250279 - DNA, 21 bp, Homo sapiens
aacataaattttttgaagtct

SEQ ID NO: 2250280 - DNA, 18 bp, Homo sapiens
aacatcgcaatagttttt

SEQ ID NO: 2250281 - DNA, 18 bp, Homo sapiens
aacatgaggggacatttt

SEQ ID NO: 2250282 - DNA, 22 bp, Homo sapiens
aacatgctggtgaatattttca

SEQ ID NO: 2250283 - DNA, 14 bp, Homo sapiens
aacattgtagcctc

SEQ ID NO: 2250284 - DNA, 16 bp, Homo sapiens
aaccataactgacaag

SEQ ID NO: 2250285 - DNA, 11 bp, Homo sapiens
aaccatggcac

SEQ ID NO: 2250286 - DNA, 16 bp, Homo sapiens
aaccatggcacttgat

SEQ ID NO: 2250287 - DNA, 22 bp, Homo sapiens
aaccatgtagcagtgagtcata

SEQ ID NO: 2250288 - DNA, 19 bp, Homo sapiens
aaccatttgaaacccctgt

SEQ ID NO: 2250289 - DNA, 14 bp, Homo sapiens
aaccatttttgtta

SEQ ID NO: 2250290 - DNA, 21 bp, Homo sapiens
aacccagattttgctgtatat

SEQ ID NO: 2250291 - DNA, 12 bp, Homo sapiens
aacccctcctgg

SEQ ID NO: 2250292 - DNA, 22 bp, Homo sapiens
aaccctagtcaaaactattttt

SEQ ID NO: 2250293 - DNA, 18 bp, Homo sapiens
aacctaaagaggaaaagt

SEQ ID NO: 2250294 - DNA, 10 bp, Homo sapiens
aacctcccct

SEQ ID NO: 2250295 - DNA, 13 bp, Homo sapiens
aacctcccctctc

SEQ ID NO: 2250296 - DNA, 17 bp, Homo sapiens
aacctcccctctccccg

SEQ ID NO: 2250297 - DNA, 17 bp, Homo sapiens
aacctggtggcaccaga

SEQ ID NO: 2250298 - DNA, 21 bp, Homo sapiens
aacctggtggcaccagatgca

SEQ ID NO: 2250299 - DNA, 22 bp, Homo sapiens
aacctgtagaatcaatttaagt

SEQ ID NO: 2250300 - DNA, 13 bp, Homo sapiens
aaccttccctcca

SEQ ID NO: 2250301 - DNA, 14 bp, Homo sapiens
aaccttccctccaa

SEQ ID NO: 2250302 - DNA, 18 bp, Homo sapiens
aaccttgtttattaaatt

SEQ ID NO: 2250303 - DNA, 19 bp, Homo sapiens
aaccttgtttattaaattg

SEQ ID NO: 2250304 - DNA, 20 bp, Homo sapiens
aaccttgtttattaaattgc

SEQ ID NO: 2250305 - DNA, 15 bp, Homo sapiens
aacgctgatttaaag

SEQ ID NO: 2250306 - DNA, 14 bp, Homo sapiens
aacggcaacagcat

SEQ ID NO: 2250307 - DNA, 22 bp, Homo sapiens
aacggcttgctttcctgcatct

SEQ ID NO: 2250308 - DNA, 17 bp, Homo sapiens
aacgggaacatgccccc

SEQ ID NO: 2250309 - DNA, 15 bp, Homo sapiens
aactaaaataatttt

SEQ ID NO: 2250310 - DNA, 19 bp, Homo sapiens
aactaaaataattttgtaa

SEQ ID NO: 2250311 - DNA, 16 bp, Homo sapiens
aactaaactagttttt

SEQ ID NO: 2250312 - DNA, 19 bp, Homo sapiens
aactaaactagtttttcct

SEQ ID NO: 2250313 - DNA, 17 bp, Homo sapiens
aactactgacagggagc

SEQ ID NO: 2250314 - DNA, 16 bp, Homo sapiens
aactagaaagaaggac

SEQ ID NO: 2250315 - DNA, 16 bp, Homo sapiens
aactagacaagtaaaa

SEQ ID NO: 2250316 - DNA, 15 bp, Homo sapiens
aactaggctgagcaa

SEQ ID NO: 2250317 - DNA, 22 bp, Homo sapiens
aactatcaatatttaagtttgt

SEQ ID NO: 2250318 - DNA, 20 bp, Homo sapiens
aactatgtgtttttctcata

SEQ ID NO: 2250319 - DNA, 14 bp, Homo sapiens
aactatttttgtaa

SEQ ID NO: 2250320 - DNA, 14 bp, Homo sapiens
aactcatctgaaat

SEQ ID NO: 2250321 - DNA, 10 bp, Homo sapiens
aactctctgc

SEQ ID NO: 2250322 - DNA, 20 bp, Homo sapiens
aactctctggaagcccctgg

SEQ ID NO: 2250323 - DNA, 22 bp, Homo sapiens
aactctgttacactttttggaa

SEQ ID NO: 2250324 - DNA, 18 bp, Homo sapiens
aactgagaaatgaatgct

SEQ ID NO: 2250325 - DNA, 17 bp, Homo sapiens
aactgcaaccttgttta

SEQ ID NO: 2250326 - DNA, 18 bp, Homo sapiens
aactgcaaccttgtttat

SEQ ID NO: 2250327 - DNA, 16 bp, Homo sapiens
aactgctgtaaacaca

SEQ ID NO: 2250328 - DNA, 13 bp, Homo sapiens
aactggttaggta

SEQ ID NO: 2250329 - DNA, 16 bp, Homo sapiens
aactgtgatttcagga

SEQ ID NO: 2250330 - DNA, 17 bp, Homo sapiens
aactgtgcgttaaataa

SEQ ID NO: 2250331 - DNA, 22 bp, Homo sapiens
aactgtgtttcaagttcaatcc

SEQ ID NO: 2250332 - DNA, 16 bp, Homo sapiens
aacttgaagctttgta

SEQ ID NO: 2250333 - DNA, 21 bp, Homo sapiens
aactttaaacctgtagaatca

SEQ ID NO: 2250334 - DNA, 21 bp, Homo sapiens
aactttattaaatacaaaact

SEQ ID NO: 2250335 - DNA, 23 bp, Homo sapiens
aactttattaaatacaaaacttc

SEQ ID NO: 2250336 - DNA, 16 bp, Homo sapiens
aactttccaaacacca

SEQ ID NO: 2250337 - DNA, 13 bp, Homo sapiens
aactttgaaagtt

SEQ ID NO: 2250338 - DNA, 21 bp, Homo sapiens
aactttgtctcgttcctgttg

SEQ ID NO: 2250339 - DNA, 14 bp, Homo sapiens
aagaaaaaaagaaa

SEQ ID NO: 2250340 - DNA, 13 bp, Homo sapiens
aagaaaagaaaaa

SEQ ID NO: 2250341 - DNA, 14 bp, Homo sapiens
aagaaaagtgtgta

SEQ ID NO: 2250342 - DNA, 22 bp, Homo sapiens
aagaaacagtgcgttgagtgta

SEQ ID NO: 2250343 - DNA, 17 bp, Homo sapiens
aagaaacttgaagcttt

SEQ ID NO: 2250344 - DNA, 12 bp, Homo sapiens
aagaataataaa

SEQ ID NO: 2250345 - DNA, 14 bp, Homo sapiens
aagaataataaaat

SEQ ID NO: 2250346 - DNA, 15 bp, Homo sapiens
aagaataataaaatc

SEQ ID NO: 2250347 - DNA, 18 bp, Homo sapiens
aagaatatcctttaaaat

SEQ ID NO: 2250348 - DNA, 20 bp, Homo sapiens
aagaatatcctttaaaattt

SEQ ID NO: 2250349 - DNA, 21 bp, Homo sapiens
aagaatatcctttaaaattta

SEQ ID NO: 2250350 - DNA, 16 bp, Homo sapiens
aagacaaaataaatgt

SEQ ID NO: 2250351 - DNA, 17 bp, Homo sapiens
aagacatttgatagaaa

SEQ ID NO: 2250352 - DNA, 17 bp, Homo sapiens
aagacctgaataccact

SEQ ID NO: 2250353 - DNA, 22 bp, Homo sapiens
aagacggaggaggggaaggggc

SEQ ID NO: 2250354 - DNA, 12 bp, Homo sapiens
aagacgtttttg

SEQ ID NO: 2250355 - DNA, 24 bp, Homo sapiens
aagactggacatttaacttttcta

SEQ ID NO: 2250356 - DNA, 11 bp, Homo sapiens
aagactggctt

SEQ ID NO: 2250357 - DNA, 11 bp, Homo sapiens
aagagaactcg

SEQ ID NO: 2250358 - DNA, 15 bp, Homo sapiens
aagagacagcccagg

SEQ ID NO: 2250359 - DNA, 16 bp, Homo sapiens
aagagacagcccagga

SEQ ID NO: 2250360 - DNA, 13 bp, Homo sapiens
aagagcctcccac

SEQ ID NO: 2250361 - DNA, 19 bp, Homo sapiens
aagataaggactagatact

SEQ ID NO: 2250362 - DNA, 17 bp, Homo sapiens
aattcaaataaaaatcc

SEQ ID NO: 2250363 - DNA, 14 bp, Homo sapiens
aattcaattgtaaa

SEQ ID NO: 2250364 - DNA, 21 bp, Homo sapiens
aattcaccccctttcctggac

SEQ ID NO: 2250365 - DNA, 14 bp, Homo sapiens
aattcagcatttga

SEQ ID NO: 2250366 - DNA, 17 bp, Homo sapiens
aattcatgggctgtgtg

SEQ ID NO: 2250367 - DNA, 18 bp, Homo sapiens
aattcatgggctgtgtgt

SEQ ID NO: 2250368 - DNA, 13 bp, Homo sapiens
aattcatttctaa

SEQ ID NO: 2250369 - DNA, 11 bp, Homo sapiens
aattcatttgg

SEQ ID NO: 2250370 - DNA, 22 bp, Homo sapiens
aattctgtttttaatgctattt

SEQ ID NO: 2250371 - DNA, 15 bp, Homo sapiens
aattgaaacacagag

SEQ ID NO: 2250372 - DNA, 20 bp, Homo sapiens
aattgaagtgtataatataa

SEQ ID NO: 2250373 - DNA, 14 bp, Homo sapiens
aattgaattaataa

SEQ ID NO: 2250374 - DNA, 21 bp, Homo sapiens
aattgacataggcaataataa

SEQ ID NO: 2250375 - DNA, 20 bp, Homo sapiens
aattgcaaaaacatagaaat

SEQ ID NO: 2250376 - DNA, 19 bp, Homo sapiens
aattggtacttttaaaaac

SEQ ID NO: 2250377 - DNA, 17 bp, Homo sapiens
aattgtaaattgaatca

SEQ ID NO: 2250378 - DNA, 15 bp, Homo sapiens
aatttaaaaagcaaa

SEQ ID NO: 2250379 - DNA, 17 bp, Homo sapiens
aatttaaaaagcaaaaa

SEQ ID NO: 2250380 - DNA, 21 bp, Homo sapiens
aatttaaaagtaaaatgtctt

SEQ ID NO: 2250381 - DNA, 9 bp, Homo sapiens
aatttaaac

SEQ ID NO: 2250382 - DNA, 15 bp, Homo sapiens
aatttaaacacctcc

SEQ ID NO: 2250383 - DNA, 19 bp, Homo sapiens
aatttaaacacctcctcat

SEQ ID NO: 2250384 - DNA, 14 bp, Homo sapiens
aatttaatgaaaag

SEQ ID NO: 2250385 - DNA, 10 bp, Homo sapiens
aatttaatgg

SEQ ID NO: 2250386 - DNA, 14 bp, Homo sapiens
aatttaatggggtc

SEQ ID NO: 2250387 - DNA, 23 bp, Homo sapiens
aatttacagtctagtacttatta

SEQ ID NO: 2250388 - DNA, 18 bp, Homo sapiens
aatttaggtttttattag

SEQ ID NO: 2250389 - DNA, 19 bp, Homo sapiens
aatttcgcttcttagaaca

SEQ ID NO: 2250390 - DNA, 14 bp, Homo sapiens
aatttctatgaagg

SEQ ID NO: 2250391 - DNA, 11 bp, Homo sapiens
aatttgggcag

SEQ ID NO: 2250392 - DNA, 14 bp, Homo sapiens
aatttggggaaaat

SEQ ID NO: 2250393 - DNA, 14 bp, Homo sapiens
aattttgtgtaaga

SEQ ID NO: 2250394 - DNA, 15 bp, Homo sapiens
aattttgtgtaagaa

SEQ ID NO: 2250395 - DNA, 12 bp, Homo sapiens
aatttttattgt

SEQ ID NO: 2250396 - DNA, 13 bp, Homo sapiens
aatttttattgtt

SEQ ID NO: 2250397 - DNA, 15 bp, Homo sapiens
aatttttatttcttt

SEQ ID NO: 2250398 - DNA, 14 bp, Homo sapiens
acaaaaaatgtttt

SEQ ID NO: 2250399 - DNA, 14 bp, Homo sapiens
acaaaattatttgt

SEQ ID NO: 2250400 - DNA, 14 bp, Homo sapiens
acaaagacaggcaa

SEQ ID NO: 2250401 - DNA, 13 bp, Homo sapiens
acaaatattttca

SEQ ID NO: 2250402 - DNA, 14 bp, Homo sapiens
acaaatgtgatttt

SEQ ID NO: 2250403 - DNA, 14 bp, Homo sapiens
acaaattatttttg

SEQ ID NO: 2250404 - DNA, 15 bp, Homo sapiens
acaacacttcatttt

SEQ ID NO: 2250405 - DNA, 16 bp, Homo sapiens
acaacaggtaaaacag

SEQ ID NO: 2250406 - DNA, 14 bp, Homo sapiens
acaagaagaagggc

SEQ ID NO: 2250407 - DNA, 17 bp, Homo sapiens
acaagcaatgcaagaaa

SEQ ID NO: 2250408 - DNA, 21 bp, Homo sapiens
acaaggaatagtcgcgcaagc

SEQ ID NO: 2250409 - DNA, 20 bp, Homo sapiens
acaaggcacttcatgtaaag

SEQ ID NO: 2250410 - DNA, 20 bp, Homo sapiens
acaataaaccctcagagcct

SEQ ID NO: 2250411 - DNA, 14 bp, Homo sapiens
acaatacctttttt

SEQ ID NO: 2250412 - DNA, 16 bp, Homo sapiens
acaatcaaaacacact

SEQ ID NO: 2250413 - DNA, 17 bp, Homo sapiens
acaatgaagttgaaaat

SEQ ID NO: 2250414 - DNA, 17 bp, Homo sapiens
acaatgctgatttggtg

SEQ ID NO: 2250415 - DNA, 19 bp, Homo sapiens
acaatgtgaactttattaa

SEQ ID NO: 2250416 - DNA, 17 bp, Homo sapiens
acaattctgtttttaat

SEQ ID NO: 2250417 - DNA, 21 bp, Homo sapiens
acaattctgtttttaatgcta

SEQ ID NO: 2250418 - DNA, 21 bp, Homo sapiens
acacaaatgtgatttttgtaa

SEQ ID NO: 2250419 - DNA, 15 bp, Homo sapiens
acacaagcaatgcaa

SEQ ID NO: 2250420 - DNA, 16 bp, Homo sapiens
acacaagcaatgcaag

SEQ ID NO: 2250421 - DNA, 13 bp, Homo sapiens
acacagcagcccc

SEQ ID NO: 2250422 - DNA, 18 bp, Homo sapiens
acaccaaagataaggact

SEQ ID NO: 2250423 - DNA, 12 bp, Homo sapiens
acaccaccctcc

SEQ ID NO: 2250424 - DNA, 21 bp, Homo sapiens
acaccatcttttattcttttt

SEQ ID NO: 2250425 - DNA, 16 bp, Homo sapiens
acacccatgccagaga

SEQ ID NO: 2250426 - DNA, 17 bp, Homo sapiens
acaccctcaacctcttc

SEQ ID NO: 2250427 - DNA, 22 bp, Homo sapiens
acaccctgtactgttctgtgtc

SEQ ID NO: 2250428 - DNA, 18 bp, Homo sapiens
acacggagcccagccctc

SEQ ID NO: 2250429 - DNA, 17 bp, Homo sapiens
acactgtgtacacctca

SEQ ID NO: 2250430 - DNA, 23 bp, Homo sapiens
acacttgatggagtgtgagccac

SEQ ID NO: 2250431 - DNA, 14 bp, Homo sapiens
acacttggattttt

SEQ ID NO: 2250432 - DNA, 16 bp, Homo sapiens
acagaaaccagaaaag

SEQ ID NO: 2250433 - DNA, 17 bp, Homo sapiens
acagaaaccagaaaagc

SEQ ID NO: 2250434 - DNA, 12 bp, Homo sapiens
acagatcagtaa

SEQ ID NO: 2250435 - DNA, 14 bp, Homo sapiens
acagatgaatgtat

SEQ ID NO: 2250436 - DNA, 17 bp, Homo sapiens
acagatgaatgtattta

SEQ ID NO: 2250437 - DNA, 11 bp, Homo sapiens
acagattttat

SEQ ID NO: 2250438 - DNA, 12 bp, Homo sapiens
acagcacttgtt

SEQ ID NO: 2250439 - DNA, 19 bp, Homo sapiens
acagcagccccccagcact

SEQ ID NO: 2250440 - DNA, 13 bp, Homo sapiens
acagcctcttttt

SEQ ID NO: 2250441 - DNA, 15 bp, Homo sapiens
acaggaaagccctcc

SEQ ID NO: 2250442 - DNA, 18 bp, Homo sapiens
acaggaaagccctccccc

SEQ ID NO: 2250443 - DNA, 12 bp, Homo sapiens
acaggagggcca

SEQ ID NO: 2250444 - DNA, 13 bp, Homo sapiens
acaggagggccag

SEQ ID NO: 2250445 - DNA, 12 bp, Homo sapiens
acaggccccctt

SEQ ID NO: 2250446 - DNA, 15 bp, Homo sapiens
acagggccacataga

SEQ ID NO: 2250447 - DNA, 16 bp, Homo sapiens
acagggctgccttctg

SEQ ID NO: 2250448 - DNA, 16 bp, Homo sapiens
acagggtattaagaat

SEQ ID NO: 2250449 - DNA, 17 bp, Homo sapiens
acagtaagaacatcata

SEQ ID NO: 2250450 - DNA, 21 bp, Homo sapiens
acagtaagaacatcataaaat

SEQ ID NO: 2250451 - DNA, 18 bp, Homo sapiens
acagtacctgattgtatt

SEQ ID NO: 2250452 - DNA, 19 bp, Homo sapiens
acagtacctgattgtattt

SEQ ID NO: 2250453 - DNA, 16 bp, Homo sapiens
acagtccacaggggcc

SEQ ID NO: 2250454 - DNA, 17 bp, Homo sapiens
acagtccacaggggcca

SEQ ID NO: 2250455 - DNA, 22 bp, Homo sapiens
acagtccacaggggccaccacc

SEQ ID NO: 2250456 - DNA, 13 bp, Homo sapiens
acagtgtgtaaac

SEQ ID NO: 2250457 - DNA, 14 bp, Homo sapiens
acagtgtgtaaaca

SEQ ID NO: 2250458 - DNA, 12 bp, Homo sapiens
acagtgtgtgtg

SEQ ID NO: 2250459 - DNA, 14 bp, Homo sapiens
acagtgttttcaga

SEQ ID NO: 2250460 - DNA, 19 bp, Homo sapiens
acagttataaaattaaaag

SEQ ID NO: 2250461 - DNA, 21 bp, Homo sapiens
acagttcctgggaacatcaca

SEQ ID NO: 2250462 - DNA, 17 bp, Homo sapiens
acagttgaaaacttgta

SEQ ID NO: 2250463 - DNA, 22 bp, Homo sapiens
acataaaccatttttgttactc

SEQ ID NO: 2250464 - DNA, 16 bp, Homo sapiens
acataacataaatttt

SEQ ID NO: 2250465 - DNA, 18 bp, Homo sapiens
acataatttagttgtttc

SEQ ID NO: 2250466 - DNA, 21 bp, Homo sapiens
acataccctggccgccccctg

SEQ ID NO: 2250467 - DNA, 18 bp, Homo sapiens
acatacgatttaaggtat

SEQ ID NO: 2250468 - DNA, 16 bp, Homo sapiens
acatacttttgcaaaa

SEQ ID NO: 2250469 - DNA, 23 bp, Homo sapiens
acatagtgaaaattgtttagtga

SEQ ID NO: 2250470 - DNA, 14 bp, Homo sapiens
acatatagtgtaca

SEQ ID NO: 2250471 - DNA, 22 bp, Homo sapiens
acatatcagcaggagtaataaa

SEQ ID NO: 2250472 - DNA, 16 bp, Homo sapiens
acatatctttattaat

SEQ ID NO: 2250473 - DNA, 19 bp, Homo sapiens
acatatctttattaatcac

SEQ ID NO: 2250474 - DNA, 12 bp, Homo sapiens
acatatgaaaaa

SEQ ID NO: 2250475 - DNA, 16 bp, Homo sapiens
acatatgatctgtctg

SEQ ID NO: 2250476 - DNA, 17 bp, Homo sapiens
acatatgatctgtctgt

SEQ ID NO: 2250477 - DNA, 19 bp, Homo sapiens
acatcataaggttttattc

SEQ ID NO: 2250478 - DNA, 20 bp, Homo sapiens
acatcataaggttttattca

SEQ ID NO: 2250479 - DNA, 23 bp, Homo sapiens
acatctcccttttccatgactgt

SEQ ID NO: 2250480 - DNA, 17 bp, Homo sapiens
acatgaagctgtataat

SEQ ID NO: 2250481 - DNA, 16 bp, Homo sapiens
acatgaggggacattt

SEQ ID NO: 2250482 - DNA, 17 bp, Homo sapiens
acatgaggggacatttt

SEQ ID NO: 2250483 - DNA, 12 bp, Homo sapiens
acatgccccctg

SEQ ID NO: 2250484 - DNA, 14 bp, Homo sapiens
acatgccctgtgtg

SEQ ID NO: 2250485 - DNA, 21 bp, Homo sapiens
acatgctggtgaatattttca

SEQ ID NO: 2250486 - DNA, 14 bp, Homo sapiens
acatgctgtctggc

SEQ ID NO: 2250487 - DNA, 15 bp, Homo sapiens
acatgctgtctggcc

SEQ ID NO: 2250488 - DNA, 18 bp, Homo sapiens
acatgctgtctggccctg

SEQ ID NO: 2250489 - DNA, 21 bp, Homo sapiens
acatggtttaaaagaaaaaat

SEQ ID NO: 2250490 - DNA, 13 bp, Homo sapiens
acattagttttaa

SEQ ID NO: 2250491 - DNA, 20 bp, Homo sapiens
acattcttggcttaatcatt

SEQ ID NO: 2250492 - DNA, 22 bp, Homo sapiens
acattcttggcttaatcatttt

SEQ ID NO: 2250493 - DNA, 19 bp, Homo sapiens
acattgtctcctatatatt

SEQ ID NO: 2250494 - DNA, 22 bp, Homo sapiens
acattgtctcctatatatttct

SEQ ID NO: 2250495 - DNA, 16 bp, Homo sapiens
acatttaaacctttta

SEQ ID NO: 2250496 - DNA, 16 bp, Homo sapiens
acatttcacattattc

SEQ ID NO: 2250497 - DNA, 18 bp, Homo sapiens
acatttcatacaacagaa

SEQ ID NO: 2250498 - DNA, 14 bp, Homo sapiens
acatttctggacag

SEQ ID NO: 2250499 - DNA, 19 bp, Homo sapiens
acatttgatagaaaggaac

SEQ ID NO: 2250500 - DNA, 20 bp, Homo sapiens
acatttgatagaaaggaaca

SEQ ID NO: 2250501 - DNA, 20 bp, Homo sapiens
acattttaaaaaatggtcac

SEQ ID NO: 2250502 - DNA, 17 bp, Homo sapiens
acattttggtgagaaat

SEQ ID NO: 2250503 - DNA, 14 bp, Homo sapiens
accaaaagacactg

SEQ ID NO: 2250504 - DNA, 13 bp, Homo sapiens
accaaaattcatc

SEQ ID NO: 2250505 - DNA, 13 bp, Homo sapiens
accaaagacatca

SEQ ID NO: 2250506 - DNA, 13 bp, Homo sapiens
accaaattttaat

SEQ ID NO: 2250507 - DNA, 23 bp, Homo sapiens
accaactgtcactcattgctgag

SEQ ID NO: 2250508 - DNA, 15 bp, Homo sapiens
accaagggcagaggg

SEQ ID NO: 2250509 - DNA, 12 bp, Homo sapiens
accaagtgaaat

SEQ ID NO: 2250510 - DNA, 18 bp, Homo sapiens
accaattctggacagaca

SEQ ID NO: 2250511 - DNA, 15 bp, Homo sapiens
accacctttggctgg

SEQ ID NO: 2250512 - DNA, 16 bp, Homo sapiens
accactaccagccagc

SEQ ID NO: 2250513 - DNA, 14 bp, Homo sapiens
accacttacctcaa

SEQ ID NO: 2250514 - DNA, 13 bp, Homo sapiens
accagaaaagcaa

SEQ ID NO: 2250515 - DNA, 14 bp, Homo sapiens
accagaaaagcaat

SEQ ID NO: 2250516 - DNA, 14 bp, Homo sapiens
accagagccgggag

SEQ ID NO: 2250517 - DNA, 17 bp, Homo sapiens
accagagccgggaggaa

SEQ ID NO: 2250518 - DNA, 16 bp, Homo sapiens
accagccagcctcaga

SEQ ID NO: 2250519 - DNA, 15 bp, Homo sapiens
accagctatctgtca

SEQ ID NO: 2250520 - DNA, 19 bp, Homo sapiens
accagctatctgtcatctc

SEQ ID NO: 2250521 - DNA, 16 bp, Homo sapiens
accagggcgcaagcct

SEQ ID NO: 2250522 - DNA, 23 bp, Homo sapiens
accatagtaccatttatacaaat

SEQ ID NO: 2250523 - DNA, 14 bp, Homo sapiens
accatctctcttcc

SEQ ID NO: 2250524 - DNA, 15 bp, Homo sapiens
accatctctcttcca

SEQ ID NO: 2250525 - DNA, 13 bp, Homo sapiens
accatctcttcat

SEQ ID NO: 2250526 - DNA, 17 bp, Homo sapiens
accatgcctcactaatt

SEQ ID NO: 2250527 - DNA, 17 bp, Homo sapiens
accatgcgtcaggggcc

SEQ ID NO: 2250528 - DNA, 20 bp, Homo sapiens
accatgcgtcaggggcctag

SEQ ID NO: 2250529 - DNA, 18 bp, Homo sapiens
accattgatttaatgtaa

SEQ ID NO: 2250530 - DNA, 19 bp, Homo sapiens
accatttatacaaattaga

SEQ ID NO: 2250531 - DNA, 16 bp, Homo sapiens
accatttttgttactc

SEQ ID NO: 2250532 - DNA, 19 bp, Homo sapiens
acccagattttgctgtata

SEQ ID NO: 2250533 - DNA, 19 bp, Homo sapiens
accccaaacagtgactgta

SEQ ID NO: 2250534 - DNA, 21 bp, Homo sapiens
accccaggacgccactcattt

SEQ ID NO: 2250535 - DNA, 20 bp, Homo sapiens
acccccagccccgactccag

SEQ ID NO: 2250536 - DNA, 12 bp, Homo sapiens
acccccagctca

SEQ ID NO: 2250537 - DNA, 13 bp, Homo sapiens
acccccagctcaa

SEQ ID NO: 2250538 - DNA, 12 bp, Homo sapiens
acccccatccag

SEQ ID NO: 2250539 - DNA, 15 bp, Homo sapiens
acccccatccagcct

SEQ ID NO: 2250540 - DNA, 19 bp, Homo sapiens
acccccatccagcctccag

SEQ ID NO: 2250541 - DNA, 23 bp, Homo sapiens
acccccatccagcctccagggca

SEQ ID NO: 2250542 - DNA, 16 bp, Homo sapiens
accccctcccaccccc

SEQ ID NO: 2250543 - DNA, 19 bp, Homo sapiens
accccctcccacccccagc

SEQ ID NO: 2250544 - DNA, 13 bp, Homo sapiens
accccctcctccc

SEQ ID NO: 2250545 - DNA, 11 bp, Homo sapiens
accccctcctt

SEQ ID NO: 2250546 - DNA, 19 bp, Homo sapiens
accccctccttcagacacc

SEQ ID NO: 2250547 - DNA, 14 bp, Homo sapiens
accccgcctgccct

SEQ ID NO: 2250548 - DNA, 19 bp, Homo sapiens
accccgcctgccctcatgg

SEQ ID NO: 2250549 - DNA, 14 bp, Homo sapiens
acccctgggcctca

SEQ ID NO: 2250550 - DNA, 15 bp, Homo sapiens
acccctgtaggcctc

SEQ ID NO: 2250551 - DNA, 23 bp, Homo sapiens
acccgattccaccaaatgtgctt

SEQ ID NO: 2250552 - DNA, 15 bp, Homo sapiens
acccgcccctggact

SEQ ID NO: 2250553 - DNA, 21 bp, Homo sapiens
accctcaacctcttctggctc

SEQ ID NO: 2250554 - DNA, 22 bp, Homo sapiens
accctccaagtctgtacctcaa

SEQ ID NO: 2250555 - DNA, 14 bp, Homo sapiens
accctcccccgcag

SEQ ID NO: 2250556 - DNA, 17 bp, Homo sapiens
accctcccgctgcaagt

SEQ ID NO: 2250557 - DNA, 16 bp, Homo sapiens
accctctcagctccag

SEQ ID NO: 2250558 - DNA, 14 bp, Homo sapiens
accctctcctgggg

SEQ ID NO: 2250559 - DNA, 15 bp, Homo sapiens
accctctcctggggg

SEQ ID NO: 2250560 - DNA, 20 bp, Homo sapiens
accctctcctgggggtggca

SEQ ID NO: 2250561 - DNA, 22 bp, Homo sapiens
accctggccgccccctgccccc

SEQ ID NO: 2250562 - DNA, 15 bp, Homo sapiens
acccttataaaatcc

SEQ ID NO: 2250563 - DNA, 21 bp, Homo sapiens
acccttattgctgtcctggag

SEQ ID NO: 2250564 - DNA, 17 bp, Homo sapiens
acccttttaaagttgat

SEQ ID NO: 2250565 - DNA, 17 bp, Homo sapiens
accctttttctccagct

SEQ ID NO: 2250566 - DNA, 11 bp, Homo sapiens
accgccccctc

SEQ ID NO: 2250567 - DNA, 12 bp, Homo sapiens
accgccccctcc

SEQ ID NO: 2250568 - DNA, 14 bp, Homo sapiens
accgccccctcctc

SEQ ID NO: 2250569 - DNA, 16 bp, Homo sapiens
accgcccttttcccct

SEQ ID NO: 2250570 - DNA, 16 bp, Homo sapiens
accgcgctagggctcc

SEQ ID NO: 2250571 - DNA, 23 bp, Homo sapiens
accggcggaccccagccatccag

SEQ ID NO: 2250572 - DNA, 18 bp, Homo sapiens
accgtttccaagctgcgg

SEQ ID NO: 2250573 - DNA, 20 bp, Homo sapiens
acctaccttactatttaaag

SEQ ID NO: 2250574 - DNA, 13 bp, Homo sapiens
acctactttcttc

SEQ ID NO: 2250575 - DNA, 15 bp, Homo sapiens
acctagctacactga

SEQ ID NO: 2250576 - DNA, 14 bp, Homo sapiens
acctattatcagaa

SEQ ID NO: 2250577 - DNA, 15 bp, Homo sapiens
acctcacctagaaat

SEQ ID NO: 2250578 - DNA, 24 bp, Homo sapiens
acctcactatggtatgctggccag

SEQ ID NO: 2250579 - DNA, 15 bp, Homo sapiens
acctcaggcagctca

SEQ ID NO: 2250580 - DNA, 17 bp, Homo sapiens
acctcaggcagctcaag

SEQ ID NO: 2250581 - DNA, 18 bp, Homo sapiens
acctcattggccagctca

SEQ ID NO: 2250582 - DNA, 13 bp, Homo sapiens
acctcatttttca

SEQ ID NO: 2250583 - DNA, 21 bp, Homo sapiens
acctccccctttcacactgga

SEQ ID NO: 2250584 - DNA, 16 bp, Homo sapiens
acctccgtcctctccc

SEQ ID NO: 2250585 - DNA, 19 bp, Homo sapiens
acctccgtcctctccccag

SEQ ID NO: 2250586 - DNA, 14 bp, Homo sapiens
acctctcctgaccc

SEQ ID NO: 2250587 - DNA, 17 bp, Homo sapiens
acctctcctgacccctg

SEQ ID NO: 2250588 - DNA, 16 bp, Homo sapiens
acctgattgtattttt

SEQ ID NO: 2250589 - DNA, 23 bp, Homo sapiens
acctgattgtattttttttttaa

SEQ ID NO: 2250590 - DNA, 15 bp, Homo sapiens
acctgcctgctgcag

SEQ ID NO: 2250591 - DNA, 21 bp, Homo sapiens
acctgtataagtggaggcact

SEQ ID NO: 2250592 - DNA, 15 bp, Homo sapiens
accttaaaaaggact

SEQ ID NO: 2250593 - DNA, 14 bp, Homo sapiens
accttaggccttcc

SEQ ID NO: 2250594 - DNA, 15 bp, Homo sapiens
accttaggccttcct

SEQ ID NO: 2250595 - DNA, 20 bp, Homo sapiens
accttaggccttcctctctc

SEQ ID NO: 2250596 - DNA, 15 bp, Homo sapiens
accttcaaagaaact

SEQ ID NO: 2250597 - DNA, 22 bp, Homo sapiens
accttcccaaacgcctcccctg

SEQ ID NO: 2250598 - DNA, 18 bp, Homo sapiens
acctttccctcaccccct

SEQ ID NO: 2250599 - DNA, 19 bp, Homo sapiens
acctttccctcaccccctc

SEQ ID NO: 2250600 - DNA, 21 bp, Homo sapiens
acctttccgctgtcgccccag

SEQ ID NO: 2250601 - DNA, 19 bp, Homo sapiens
acgaagcaatttgttgctg

SEQ ID NO: 2250602 - DNA, 19 bp, Homo sapiens
acgaagcggagagagccaa

SEQ ID NO: 2250603 - DNA, 15 bp, Homo sapiens
acgagacccccatcc

SEQ ID NO: 2250604 - DNA, 17 bp, Homo sapiens
acgagacccccatccag

SEQ ID NO: 2250605 - DNA, 14 bp, Homo sapiens
acgagggccaggca

SEQ ID NO: 2250606 - DNA, 15 bp, Homo sapiens
acgagggccaggcac

SEQ ID NO: 2250607 - DNA, 12 bp, Homo sapiens
acgatttaaggt

SEQ ID NO: 2250608 - DNA, 15 bp, Homo sapiens
acgcagctggcagag

SEQ ID NO: 2250609 - DNA, 16 bp, Homo sapiens
acgcagctggcagaga

SEQ ID NO: 2250610 - DNA, 12 bp, Homo sapiens
acgccgagtgca

SEQ ID NO: 2250611 - DNA, 13 bp, Homo sapiens
acgcctcctggcc

SEQ ID NO: 2250612 - DNA, 15 bp, Homo sapiens
acgcctcctggccag

SEQ ID NO: 2250613 - DNA, 20 bp, Homo sapiens
acgctgtcctctcgagccca

SEQ ID NO: 2250614 - DNA, 21 bp, Homo sapiens
acgctgtcctctcgagcccag

SEQ ID NO: 2250615 - DNA, 20 bp, Homo sapiens
acgcttaacctttccgctgt

SEQ ID NO: 2250616 - DNA, 23 bp, Homo sapiens
acgcttgtgtctttagtgctcca

SEQ ID NO: 2250617 - DNA, 15 bp, Homo sapiens
acggagcccagccct

SEQ ID NO: 2250618 - DNA, 22 bp, Homo sapiens
acggaggaggggaaggggctga

SEQ ID NO: 2250619 - DNA, 14 bp, Homo sapiens
acggcaacagcatg

SEQ ID NO: 2250620 - DNA, 16 bp, Homo sapiens
acggcttgctttcctg

SEQ ID NO: 2250621 - DNA, 15 bp, Homo sapiens
acggtgttttgccat

SEQ ID NO: 2250622 - DNA, 20 bp, Homo sapiens
acgtgatcctctcacctcag

SEQ ID NO: 2250623 - DNA, 17 bp, Homo sapiens
acgttatatattgtatt

SEQ ID NO: 2250624 - DNA, 15 bp, Homo sapiens
actaaaataattttg

SEQ ID NO: 2250625 - DNA, 15 bp, Homo sapiens
actaaagcatgaaat

SEQ ID NO: 2250626 - DNA, 20 bp, Homo sapiens
actaaagcatgaaatgtgaa

SEQ ID NO: 2250627 - DNA, 22 bp, Homo sapiens
actaaagcatgaaatgtgaatt

SEQ ID NO: 2250628 - DNA, 17 bp, Homo sapiens
actaattatactacttt

SEQ ID NO: 2250629 - DNA, 18 bp, Homo sapiens
actaatttttgtattatt

SEQ ID NO: 2250630 - DNA, 20 bp, Homo sapiens
actacagtcaagatagaaag

SEQ ID NO: 2250631 - DNA, 14 bp, Homo sapiens
actaccagccagcc

SEQ ID NO: 2250632 - DNA, 22 bp, Homo sapiens
actacctgtaatgacaggcctg

SEQ ID NO: 2250633 - DNA, 22 bp, Homo sapiens
actactacctcttaagtcccag

SEQ ID NO: 2250634 - DNA, 23 bp, Homo sapiens
actactcaatactacctctgaat

SEQ ID NO: 2250635 - DNA, 13 bp, Homo sapiens
actactttctctt

SEQ ID NO: 2250636 - DNA, 19 bp, Homo sapiens
actactttgttaggatttt

SEQ ID NO: 2250637 - DNA, 18 bp, Homo sapiens
actagaaagaaggaccca

SEQ ID NO: 2250638 - DNA, 13 bp, Homo sapiens
actagatactact

SEQ ID NO: 2250639 - DNA, 14 bp, Homo sapiens
actagccaaaccag

SEQ ID NO: 2250640 - DNA, 14 bp, Homo sapiens
actaggctgagcaa

SEQ ID NO: 2250641 - DNA, 14 bp, Homo sapiens
actaggtaacttca

SEQ ID NO: 2250642 - DNA, 20 bp, Homo sapiens
actagtcaaacaaaaaagaa

SEQ ID NO: 2250643 - DNA, 17 bp, Homo sapiens
actatcaatatttaagt

SEQ ID NO: 2250644 - DNA, 18 bp, Homo sapiens
actatcaatatttaagtt

SEQ ID NO: 2250645 - DNA, 20 bp, Homo sapiens
actatctctactgaatgtca

SEQ ID NO: 2250646 - DNA, 18 bp, Homo sapiens
actatggtatgctggcca

SEQ ID NO: 2250647 - DNA, 19 bp, Homo sapiens
actatggtatgctggccag

SEQ ID NO: 2250648 - DNA, 21 bp, Homo sapiens
actatggtatgctggccagca

SEQ ID NO: 2250649 - DNA, 13 bp, Homo sapiens
actatgtattttt

SEQ ID NO: 2250650 - DNA, 13 bp, Homo sapiens
actattacttgaa

SEQ ID NO: 2250651 - DNA, 15 bp, Homo sapiens
actattacttgaact

SEQ ID NO: 2250652 - DNA, 14 bp, Homo sapiens
actatttaagatgt

SEQ ID NO: 2250653 - DNA, 20 bp, Homo sapiens
actatttaagatgtgaaaat

SEQ ID NO: 2250654 - DNA, 21 bp, Homo sapiens
actatttaagatgtgaaaatt

SEQ ID NO: 2250655 - DNA, 12 bp, Homo sapiens
actatttttgta

SEQ ID NO: 2250656 - DNA, 16 bp, Homo sapiens
actcaaaaccatctct

SEQ ID NO: 2250657 - DNA, 20 bp, Homo sapiens
actcaaaaccatctctcttc

SEQ ID NO: 2250658 - DNA, 16 bp, Homo sapiens
actcaacattactgtt

SEQ ID NO: 2250659 - DNA, 17 bp, Homo sapiens
actcaacattactgtta

SEQ ID NO: 2250660 - DNA, 17 bp, Homo sapiens
actcaatactacctctg

SEQ ID NO: 2250661 - DNA, 17 bp, Homo sapiens
actcacattagagaaca

SEQ ID NO: 2250662 - DNA, 15 bp, Homo sapiens
actcatctgaaatgt

SEQ ID NO: 2250663 - DNA, 17 bp, Homo sapiens
actcatctgaaatgtta

SEQ ID NO: 2250664 - DNA, 12 bp, Homo sapiens
actcatcttata

SEQ ID NO: 2250665 - DNA, 15 bp, Homo sapiens
actcattgctgagcc

SEQ ID NO: 2250666 - DNA, 18 bp, Homo sapiens
actcattgctgagcctct

SEQ ID NO: 2250667 - DNA, 21 bp, Homo sapiens
actcattgctgagcctctgct

SEQ ID NO: 2250668 - DNA, 17 bp, Homo sapiens
actcatttcatctcatt

SEQ ID NO: 2250669 - DNA, 18 bp, Homo sapiens
actccaacagaagaactg

SEQ ID NO: 2250670 - DNA, 18 bp, Homo sapiens
actccagccagcgcctcc

SEQ ID NO: 2250671 - DNA, 19 bp, Homo sapiens
actccagccagcgcctccc

SEQ ID NO: 2250672 - DNA, 20 bp, Homo sapiens
actccagccagcgcctccct

SEQ ID NO: 2250673 - DNA, 21 bp, Homo sapiens
actccagccagcgcctccctc

SEQ ID NO: 2250674 - DNA, 22 bp, Homo sapiens
actccagccagcgcctccctcc

SEQ ID NO: 2250675 - DNA, 23 bp, Homo sapiens
actccagccagcgcctccctcca

SEQ ID NO: 2250676 - DNA, 18 bp, Homo sapiens
actccctgcccttccccc

SEQ ID NO: 2250677 - DNA, 19 bp, Homo sapiens
actccctgcccttccccct

SEQ ID NO: 2250678 - DNA, 19 bp, Homo sapiens
actcccttgctggccccag

SEQ ID NO: 2250679 - DNA, 15 bp, Homo sapiens
actcgcgctcagtaa

SEQ ID NO: 2250680 - DNA, 23 bp, Homo sapiens
actcgtgtgtttctattttttga

SEQ ID NO: 2250681 - DNA, 14 bp, Homo sapiens
actctaaagtctgt

SEQ ID NO: 2250682 - DNA, 20 bp, Homo sapiens
actctaggatgtatatttta

SEQ ID NO: 2250683 - DNA, 17 bp, Homo sapiens
actctcatcactacagt

SEQ ID NO: 2250684 - DNA, 19 bp, Homo sapiens
actctcgcacacacagtga

SEQ ID NO: 2250685 - DNA, 17 bp, Homo sapiens
actctggacccctgggc

SEQ ID NO: 2250686 - DNA, 23 bp, Homo sapiens
actctggcaaagcttttagaaat

SEQ ID NO: 2250687 - DNA, 16 bp, Homo sapiens
actctgtcagccagcc

SEQ ID NO: 2250688 - DNA, 17 bp, Homo sapiens
actctgtcagccagccg

SEQ ID NO: 2250689 - DNA, 21 bp, Homo sapiens
actctgtcagccagccgccct

SEQ ID NO: 2250690 - DNA, 17 bp, Homo sapiens
actcttcacaaaatctg

SEQ ID NO: 2250691 - DNA, 13 bp, Homo sapiens
actgaagtgctta

SEQ ID NO: 2250692 - DNA, 13 bp, Homo sapiens
actgacagggagc

SEQ ID NO: 2250693 - DNA, 20 bp, Homo sapiens
actgcaaccttgtttattaa

SEQ ID NO: 2250694 - DNA, 17 bp, Homo sapiens
actgcactgcatgcaaa

SEQ ID NO: 2250695 - DNA, 13 bp, Homo sapiens
actgcacttttag

SEQ ID NO: 2250696 - DNA, 19 bp, Homo sapiens
actgcagaaaccctgagca

SEQ ID NO: 2250697 - DNA, 16 bp, Homo sapiens
actgcagttgactttc

SEQ ID NO: 2250698 - DNA, 17 bp, Homo sapiens
actgcattcctgtgccc

SEQ ID NO: 2250699 - DNA, 23 bp, Homo sapiens
actgcctctcggtgacctccgtc

SEQ ID NO: 2250700 - DNA, 23 bp, Homo sapiens
actgcgcccttaactgcatccag

SEQ ID NO: 2250701 - DNA, 13 bp, Homo sapiens
actgctaaataaa

SEQ ID NO: 2250702 - DNA, 15 bp, Homo sapiens
actgctaaataaaat

SEQ ID NO: 2250703 - DNA, 20 bp, Homo sapiens
actgctaaataaaatttgtt

SEQ ID NO: 2250704 - DNA, 22 bp, Homo sapiens
actgctcgtggactgtgctggt

SEQ ID NO: 2250705 - DNA, 20 bp, Homo sapiens
actgcttacctactttcttc

SEQ ID NO: 2250706 - DNA, 23 bp, Homo sapiens
actgcttgaactaggctgagcaa

SEQ ID NO: 2250707 - DNA, 16 bp, Homo sapiens
actggaacccttttaa

SEQ ID NO: 2250708 - DNA, 14 bp, Homo sapiens
actggataaattgt

SEQ ID NO: 2250709 - DNA, 18 bp, Homo sapiens
actggataaattgtttag

SEQ ID NO: 2250710 - DNA, 14 bp, Homo sapiens
actggattcttatt

SEQ ID NO: 2250711 - DNA, 14 bp, Homo sapiens
actggcttttatta

SEQ ID NO: 2250712 - DNA, 20 bp, Homo sapiens
actggcttttattaatgcac

SEQ ID NO: 2250713 - DNA, 17 bp, Homo sapiens
actggggcctccagaac

SEQ ID NO: 2250714 - DNA, 17 bp, Homo sapiens
actggtgcacttcttac

SEQ ID NO: 2250715 - DNA, 15 bp, Homo sapiens
actgtagcaggggaa

SEQ ID NO: 2250716 - DNA, 24 bp, Homo sapiens
actgtcactcattgctgagcctct

SEQ ID NO: 2250717 - DNA, 21 bp, Homo sapiens
actgtctttttttccctacca

SEQ ID NO: 2250718 - DNA, 21 bp, Homo sapiens
actgtgaattgtttttgtaca

SEQ ID NO: 2250719 - DNA, 14 bp, Homo sapiens
actgtgtaaactca

SEQ ID NO: 2250720 - DNA, 16 bp, Homo sapiens
actgtgtacacctcaa

SEQ ID NO: 2250721 - DNA, 17 bp, Homo sapiens
actgtgtacacctcaaa

SEQ ID NO: 2250722 - DNA, 15 bp, Homo sapiens
actgtgtttcaagtt

SEQ ID NO: 2250723 - DNA, 17 bp, Homo sapiens
actgttctgtgtctttc

SEQ ID NO: 2250724 - DNA, 12 bp, Homo sapiens
actgttctttgc

SEQ ID NO: 2250725 - DNA, 22 bp, Homo sapiens
actgtttgtttttatttaaatt

SEQ ID NO: 2250726 - DNA, 22 bp, Homo sapiens
actgttttctctcggctcccca

SEQ ID NO: 2250727 - DNA, 17 bp, Homo sapiens
acttacttgatgatttt

SEQ ID NO: 2250728 - DNA, 17 bp, Homo sapiens
acttagccattgaaatg

SEQ ID NO: 2250729 - DNA, 15 bp, Homo sapiens
acttcaaaagtttgt

SEQ ID NO: 2250730 - DNA, 15 bp, Homo sapiens
acttcaaatatagag

SEQ ID NO: 2250731 - DNA, 24 bp, Homo sapiens
acttcaagtaatacgttttgacat

SEQ ID NO: 2250732 - DNA, 14 bp, Homo sapiens
acttcattttcagg

SEQ ID NO: 2250733 - DNA, 12 bp, Homo sapiens
acttctgcagct

SEQ ID NO: 2250734 - DNA, 16 bp, Homo sapiens
acttgatggctgcgaa

SEQ ID NO: 2250735 - DNA, 14 bp, Homo sapiens
acttgcaaagacct

SEQ ID NO: 2250736 - DNA, 23 bp, Homo sapiens
acttgcaaagacctacctccaga

SEQ ID NO: 2250737 - DNA, 15 bp, Homo sapiens
acttggaggacctgg

SEQ ID NO: 2250738 - DNA, 22 bp, Homo sapiens
acttgtatatatggatcagagg

SEQ ID NO: 2250739 - DNA, 20 bp, Homo sapiens
acttgtatccaggcctggga

SEQ ID NO: 2250740 - DNA, 19 bp, Homo sapiens
actttagggggtgggattc

SEQ ID NO: 2250741 - DNA, 20 bp, Homo sapiens
actttaggtttttttaatga

SEQ ID NO: 2250742 - DNA, 19 bp, Homo sapiens
actttattctttgttcttt

SEQ ID NO: 2250743 - DNA, 18 bp, Homo sapiens
actttcatctggggtggg

SEQ ID NO: 2250744 - DNA, 21 bp, Homo sapiens
actttctacaatgtgaacttt

SEQ ID NO: 2250745 - DNA, 22 bp, Homo sapiens
actttgcagcacagctgagagg

SEQ ID NO: 2250746 - DNA, 15 bp, Homo sapiens
acttttaatggtgat

SEQ ID NO: 2250747 - DNA, 17 bp, Homo sapiens
acttttaattactgttt

SEQ ID NO: 2250748 - DNA, 20 bp, Homo sapiens
acttttcattctcttttaat

SEQ ID NO: 2250749 - DNA, 15 bp, Homo sapiens
acttttccttttctt

SEQ ID NO: 2250750 - DNA, 17 bp, Homo sapiens
acttttccttttcttaa

SEQ ID NO: 2250751 - DNA, 19 bp, Homo sapiens
acttttgcaaaataagtaa

SEQ ID NO: 2250752 - DNA, 17 bp, Homo sapiens
actttttagtaatttct

SEQ ID NO: 2250753 - DNA, 15 bp, Homo sapiens
actttttatttctaa

SEQ ID NO: 2250754 - DNA, 17 bp, Homo sapiens
actttttatttctaaat

SEQ ID NO: 2250755 - DNA, 19 bp, Homo sapiens
acttttttaaatattttct

SEQ ID NO: 2250756 - DNA, 14 bp, Homo sapiens
acttttttctgcct

SEQ ID NO: 2250757 - DNA, 21 bp, Homo sapiens
acttttttgagacatgggatc

SEQ ID NO: 2250758 - DNA, 12 bp, Homo sapiens
actttttttagt

SEQ ID NO: 2250759 - DNA, 13 bp, Homo sapiens
actttttttagta

SEQ ID NO: 2250760 - DNA, 19 bp, Homo sapiens
agaaaaaaaaattcacatg

SEQ ID NO: 2250761 - DNA, 10 bp, Homo sapiens
agaaaaagaa

SEQ ID NO: 2250762 - DNA, 19 bp, Homo sapiens
agaaaaataaaaatctctt

SEQ ID NO: 2250763 - DNA, 20 bp, Homo sapiens
agaaaagattttaatcaagt

SEQ ID NO: 2250764 - DNA, 17 bp, Homo sapiens
agaaaagcaatactgtt

SEQ ID NO: 2250765 - DNA, 18 bp, Homo sapiens
agaaaattcaattgtaaa

SEQ ID NO: 2250766 - DNA, 12 bp, Homo sapiens
agaaacctcatt

SEQ ID NO: 2250767 - DNA, 22 bp, Homo sapiens
agaaacctcattggccagctca

SEQ ID NO: 2250768 - DNA, 17 bp, Homo sapiens
agaaacgtgtcacactt

SEQ ID NO: 2250769 - DNA, 19 bp, Homo sapiens
agaaacttgaagctttgta

SEQ ID NO: 2250770 - DNA, 17 bp, Homo sapiens
agaaaggctctattcca

SEQ ID NO: 2250771 - DNA, 21 bp, Homo sapiens
agaaataaagtttgcttagaa

SEQ ID NO: 2250772 - DNA, 14 bp, Homo sapiens
agaaataaatatac

SEQ ID NO: 2250773 - DNA, 16 bp, Homo sapiens
agaaataatagaaatg

SEQ ID NO: 2250774 - DNA, 15 bp, Homo sapiens
agaaatagtcggtga

SEQ ID NO: 2250775 - DNA, 13 bp, Homo sapiens
agattaagaaata

SEQ ID NO: 2250776 - DNA, 14 bp, Homo sapiens
agattaagaaatag

SEQ ID NO: 2250777 - DNA, 20 bp, Homo sapiens
agattcaggtaatacaaact

SEQ ID NO: 2250778 - DNA, 17 bp, Homo sapiens
agattctatttaattga

SEQ ID NO: 2250779 - DNA, 17 bp, Homo sapiens
agattgatatctataaa

SEQ ID NO: 2250780 - DNA, 21 bp, Homo sapiens
agattgatatctataaaatag

SEQ ID NO: 2250781 - DNA, 19 bp, Homo sapiens
agattttaatcaagttgaa

SEQ ID NO: 2250782 - DNA, 19 bp, Homo sapiens
agatttttattttgaaaaa

SEQ ID NO: 2250783 - DNA, 21 bp, Homo sapiens
agcaaaaatctcccagtgaca

SEQ ID NO: 2250784 - DNA, 20 bp, Homo sapiens
agcaaatggcctcatgtcaa

SEQ ID NO: 2250785 - DNA, 21 bp, Homo sapiens
agcaatatttaacaatttatt

SEQ ID NO: 2250786 - DNA, 15 bp, Homo sapiens
agcaatctccttact

SEQ ID NO: 2250787 - DNA, 12 bp, Homo sapiens
agcaatgcaaga

SEQ ID NO: 2250788 - DNA, 18 bp, Homo sapiens
agcaccctcccccgcagc

SEQ ID NO: 2250789 - DNA, 13 bp, Homo sapiens
agcaccctctcct

SEQ ID NO: 2250790 - DNA, 18 bp, Homo sapiens
agcacttaaattcctcaa

SEQ ID NO: 2250791 - DNA, 22 bp, Homo sapiens
agcactttctacaatgtgaact

SEQ ID NO: 2250792 - DNA, 20 bp, Homo sapiens
agcagcaaattttcagcatt

SEQ ID NO: 2250793 - DNA, 17 bp, Homo sapiens
agcagccccccagcact

SEQ ID NO: 2250794 - DNA, 18 bp, Homo sapiens
agcagccccccagcacta

SEQ ID NO: 2250795 - DNA, 23 bp, Homo sapiens
agcagcgaccgccccctcctcta

SEQ ID NO: 2250796 - DNA, 15 bp, Homo sapiens
agcaggggtctgagc

SEQ ID NO: 2250797 - DNA, 18 bp, Homo sapiens
agcagttttcaagtcaaa

SEQ ID NO: 2250798 - DNA, 17 bp, Homo sapiens
agcatgaaatgtgaatt

SEQ ID NO: 2250799 - DNA, 17 bp, Homo sapiens
agcattaataaaactgt

SEQ ID NO: 2250800 - DNA, 18 bp, Homo sapiens
agcatttctcatcagtag

SEQ ID NO: 2250801 - DNA, 12 bp, Homo sapiens
agccaaaccagg

SEQ ID NO: 2250802 - DNA, 23 bp, Homo sapiens
agccaagggcaacagatcagtaa

SEQ ID NO: 2250803 - DNA, 16 bp, Homo sapiens
agccacagtcactgga

SEQ ID NO: 2250804 - DNA, 23 bp, Homo sapiens
agccaccttttgggaatgtttta

SEQ ID NO: 2250805 - DNA, 18 bp, Homo sapiens
agccacgctgtcctctcg

SEQ ID NO: 2250806 - DNA, 16 bp, Homo sapiens
agccagccgccctggg

SEQ ID NO: 2250807 - DNA, 17 bp, Homo sapiens
agccagccgccctgggc

SEQ ID NO: 2250808 - DNA, 21 bp, Homo sapiens
agccagccgccctgggctgtc

SEQ ID NO: 2250809 - DNA, 11 bp, Homo sapiens
agccagcctgg

SEQ ID NO: 2250810 - DNA, 16 bp, Homo sapiens
agccagcgcctccctc

SEQ ID NO: 2250811 - DNA, 17 bp, Homo sapiens
cttgaaatgaaagggaa

SEQ ID NO: 2250812 - DNA, 19 bp, Homo sapiens
cttgaaatgaaagggaaac

SEQ ID NO: 2250813 - DNA, 20 bp, Homo sapiens
cttgaaatgaaagggaaact

SEQ ID NO: 2250814 - DNA, 16 bp, Homo sapiens
cttgaactttccaaaa

SEQ ID NO: 2250815 - DNA, 14 bp, Homo sapiens
cttgaatcctggcc

SEQ ID NO: 2250816 - DNA, 19 bp, Homo sapiens
cttgacaaatattttcatg

SEQ ID NO: 2250817 - DNA, 21 bp, Homo sapiens
cttgacaaatattttcatgta

SEQ ID NO: 2250818 - DNA, 18 bp, Homo sapiens
cttgagccaggaggcctg

SEQ ID NO: 2250819 - DNA, 21 bp, Homo sapiens
cttgagtggggttatctctgt

SEQ ID NO: 2250820 - DNA, 23 bp, Homo sapiens
cttgagtggggttatctctgtgt

SEQ ID NO: 2250821 - DNA, 16 bp, Homo sapiens
cttgatacccccctct

SEQ ID NO: 2250822 - DNA, 12 bp, Homo sapiens
cttgctggcccc

SEQ ID NO: 2250823 - DNA, 15 bp, Homo sapiens
cttgctggccccagc

SEQ ID NO: 2250824 - DNA, 15 bp, Homo sapiens
cttgctttcctgcat

SEQ ID NO: 2250825 - DNA, 23 bp, Homo sapiens
cttggagggatggagaggcggcc

SEQ ID NO: 2250826 - DNA, 18 bp, Homo sapiens
cttggagtattggggtct

SEQ ID NO: 2250827 - DNA, 22 bp, Homo sapiens
cttggagtattggggtctgacc

SEQ ID NO: 2250828 - DNA, 20 bp, Homo sapiens
cttggcttggaagattctat

SEQ ID NO: 2250829 - DNA, 18 bp, Homo sapiens
cttggctttcagagccag

SEQ ID NO: 2250830 - DNA, 15 bp, Homo sapiens
cttggtgactgtccc

SEQ ID NO: 2250831 - DNA, 16 bp, Homo sapiens
cttggtgactgtccca

SEQ ID NO: 2250832 - DNA, 22 bp, Homo sapiens
cttgtaactaaaataattttgt

SEQ ID NO: 2250833 - DNA, 14 bp, Homo sapiens
cttgtaagaccctt

SEQ ID NO: 2250834 - DNA, 16 bp, Homo sapiens
cttgtagacacttact

SEQ ID NO: 2250835 - DNA, 13 bp, Homo sapiens
cttgtattaaact

SEQ ID NO: 2250836 - DNA, 15 bp, Homo sapiens
cttgtgattatttat

SEQ ID NO: 2250837 - DNA, 10 bp, Homo sapiens
cttgtgtctg

SEQ ID NO: 2250838 - DNA, 16 bp, Homo sapiens
cttgttacttgcagca

SEQ ID NO: 2250839 - DNA, 14 bp, Homo sapiens
cttgttagaatctg

SEQ ID NO: 2250840 - DNA, 23 bp, Homo sapiens
cttgttttcaggacaacacttca

SEQ ID NO: 2250841 - DNA, 22 bp, Homo sapiens
ctttaaacctgtagaatcaatt

SEQ ID NO: 2250842 - DNA, 12 bp, Homo sapiens
ctttaatgcatc

SEQ ID NO: 2250843 - DNA, 13 bp, Homo sapiens
ctttaggtttttt

SEQ ID NO: 2250844 - DNA, 20 bp, Homo sapiens
ctttagtttgtgttattatt

SEQ ID NO: 2250845 - DNA, 20 bp, Homo sapiens
ctttatcaatgtgtctttct

SEQ ID NO: 2250846 - DNA, 15 bp, Homo sapiens
ctttatgtagaattg

SEQ ID NO: 2250847 - DNA, 21 bp, Homo sapiens
ctttattaaatacaaaacttc

SEQ ID NO: 2250848 - DNA, 15 bp, Homo sapiens
ctttattaatcacta

SEQ ID NO: 2250849 - DNA, 20 bp, Homo sapiens
ctttattaccccctccttca

SEQ ID NO: 2250850 - DNA, 18 bp, Homo sapiens
ctttattcattaagcttt

SEQ ID NO: 2250851 - DNA, 13 bp, Homo sapiens
ctttcacagctcc

SEQ ID NO: 2250852 - DNA, 15 bp, Homo sapiens
ctttcagagccagcc

SEQ ID NO: 2250853 - DNA, 14 bp, Homo sapiens
ctttcagtactttt

SEQ ID NO: 2250854 - DNA, 15 bp, Homo sapiens
ctttcagtacttttt

SEQ ID NO: 2250855 - DNA, 21 bp, Homo sapiens
ctttcagtacttttttaaata

SEQ ID NO: 2250856 - DNA, 17 bp, Homo sapiens
ctttcatctggggtggg

SEQ ID NO: 2250857 - DNA, 14 bp, Homo sapiens
ctttccctcacccc

SEQ ID NO: 2250858 - DNA, 15 bp, Homo sapiens
ctttccgctgtcgcc

SEQ ID NO: 2250859 - DNA, 21 bp, Homo sapiens
ctttccgctgtcgccccaggc

SEQ ID NO: 2250860 - DNA, 13 bp, Homo sapiens
ctttcctgcatct

SEQ ID NO: 2250861 - DNA, 20 bp, Homo sapiens
ctttcctggacactcagacc

SEQ ID NO: 2250862 - DNA, 23 bp, Homo sapiens
ctttcctggacactcagacctga

SEQ ID NO: 2250863 - DNA, 13 bp, Homo sapiens
ctttctaagaaat

SEQ ID NO: 2250864 - DNA, 14 bp, Homo sapiens
ctttctaagaaatc

SEQ ID NO: 2250865 - DNA, 15 bp, Homo sapiens
ctttctacaatgtga

SEQ ID NO: 2250866 - DNA, 16 bp, Homo sapiens
ctttctatcctctgta

SEQ ID NO: 2250867 - DNA, 14 bp, Homo sapiens
ctttctctcctagt

SEQ ID NO: 2250868 - DNA, 19 bp, Homo sapiens
ctttctgcacacaaatatt

SEQ ID NO: 2250869 - DNA, 18 bp, Homo sapiens
ctttgaaggggcctcacc

SEQ ID NO: 2250870 - DNA, 18 bp, Homo sapiens
ctttgacaattgggagct

SEQ ID NO: 2250871 - DNA, 13 bp, Homo sapiens
ctttgcaccaaag

SEQ ID NO: 2250872 - DNA, 15 bp, Homo sapiens
ctttggacctattat

SEQ ID NO: 2250873 - DNA, 16 bp, Homo sapiens
ctttggagtcccctca

SEQ ID NO: 2250874 - DNA, 15 bp, Homo sapiens
ctttggctggtagca

SEQ ID NO: 2250875 - DNA, 18 bp, Homo sapiens
ctttggctggtagcagca

SEQ ID NO: 2250876 - DNA, 19 bp, Homo sapiens
ctttgtaatttaatgaaaa

SEQ ID NO: 2250877 - DNA, 22 bp, Homo sapiens
ctttgtactcctgctgtctacc

SEQ ID NO: 2250878 - DNA, 22 bp, Homo sapiens
ctttgtaggtgagatgcaacaa

SEQ ID NO: 2250879 - DNA, 22 bp, Homo sapiens
ctttgtattgtatattacaatg

SEQ ID NO: 2250880 - DNA, 17 bp, Homo sapiens
ctttgtcacttttcctt

SEQ ID NO: 2250881 - DNA, 17 bp, Homo sapiens
cttttaaattagaaaat

SEQ ID NO: 2250882 - DNA, 19 bp, Homo sapiens
cttttaaattagaaaatat

SEQ ID NO: 2250883 - DNA, 15 bp, Homo sapiens
gcacgggtggtcccc

SEQ ID NO: 2250884 - DNA, 14 bp, Homo sapiens
gcacgtggggccca

SEQ ID NO: 2250885 - DNA, 20 bp, Homo sapiens
gcactaacgttgagcccctg

SEQ ID NO: 2250886 - DNA, 14 bp, Homo sapiens
gcactaaggccgtg

SEQ ID NO: 2250887 - DNA, 21 bp, Homo sapiens
gcactctcgcacacacagtga

SEQ ID NO: 2250888 - DNA, 17 bp, Homo sapiens
gcactgaagtgcttagt

SEQ ID NO: 2250889 - DNA, 19 bp, Homo sapiens
gcactgcattcctgtgccc

SEQ ID NO: 2250890 - DNA, 16 bp, Homo sapiens
gcactggcgaggagag

SEQ ID NO: 2250891 - DNA, 22 bp, Homo sapiens
gcactggggagcccgtctcagt

SEQ ID NO: 2250892 - DNA, 21 bp, Homo sapiens
gcactttctacaatgtgaact

SEQ ID NO: 2250893 - DNA, 21 bp, Homo sapiens
gcacttttagccagagatgca

SEQ ID NO: 2250894 - DNA, 23 bp, Homo sapiens
gcagaaaagatgaatttgtccaa

SEQ ID NO: 2250895 - DNA, 17 bp, Homo sapiens
gcagaaagggccttgaa

SEQ ID NO: 2250896 - DNA, 20 bp, Homo sapiens
gcagacaataaaccctcaga

SEQ ID NO: 2250897 - DNA, 13 bp, Homo sapiens
gcagaccaccccg

SEQ ID NO: 2250898 - DNA, 21 bp, Homo sapiens
gcagaccaccccgcctgccct

SEQ ID NO: 2250899 - DNA, 15 bp, Homo sapiens
gcagattacactgat

SEQ ID NO: 2250900 - DNA, 14 bp, Homo sapiens
gcagcaaattttca

SEQ ID NO: 2250901 - DNA, 19 bp, Homo sapiens
gcagcaggaactctggacc

SEQ ID NO: 2250902 - DNA, 19 bp, Homo sapiens
gcagccagaccagcaggct

SEQ ID NO: 2250903 - DNA, 14 bp, Homo sapiens
gcagccccccagca

SEQ ID NO: 2250904 - DNA, 15 bp, Homo sapiens
gcagccccccagcac

SEQ ID NO: 2250905 - DNA, 17 bp, Homo sapiens
gcagcgaccgccccctc

SEQ ID NO: 2250906 - DNA, 22 bp, Homo sapiens
gcagcgaccgccccctcctcta

SEQ ID NO: 2250907 - DNA, 23 bp, Homo sapiens
gcagctcaagcagcgaccgcccc

SEQ ID NO: 2250908 - DNA, 14 bp, Homo sapiens
gcagctggcagaga

SEQ ID NO: 2250909 - DNA, 22 bp, Homo sapiens
gcaggaaggaacaaagacaggc

SEQ ID NO: 2250910 - DNA, 13 bp, Homo sapiens
gcaggaggagccc

SEQ ID NO: 2250911 - DNA, 18 bp, Homo sapiens
gcaggcccactccccagc

SEQ ID NO: 2250912 - DNA, 23 bp, Homo sapiens
gcaggcccactccccagccccag

SEQ ID NO: 2250913 - DNA, 14 bp, Homo sapiens
gcaggctcccctga

SEQ ID NO: 2250914 - DNA, 10 bp, Homo sapiens
gcaggctggg

SEQ ID NO: 2250915 - DNA, 12 bp, Homo sapiens
gcaggctgggcc

SEQ ID NO: 2250916 - DNA, 23 bp, Homo sapiens
gcaggctgggccatgtccaaaga

SEQ ID NO: 2250917 - DNA, 15 bp, Homo sapiens
gcagggaatgcagca

SEQ ID NO: 2250918 - DNA, 14 bp, Homo sapiens
gcaggggtctgagc

SEQ ID NO: 2250919 - DNA, 17 bp, Homo sapiens
gcaggggtctgagccac

SEQ ID NO: 2250920 - DNA, 17 bp, Homo sapiens
gcagggtccctccagca

SEQ ID NO: 2250921 - DNA, 12 bp, Homo sapiens
gcagtgtgaaaa

SEQ ID NO: 2250922 - DNA, 18 bp, Homo sapiens
gcagttacccaacagaaa

SEQ ID NO: 2250923 - DNA, 22 bp, Homo sapiens
gcagttacccaacagaaacatt

SEQ ID NO: 2250924 - DNA, 23 bp, Homo sapiens
gcataccaggttttacacttgca

SEQ ID NO: 2250925 - DNA, 13 bp, Homo sapiens
gcatcaatacaac

SEQ ID NO: 2250926 - DNA, 19 bp, Homo sapiens
gcatcaatacaaccagccc

SEQ ID NO: 2250927 - DNA, 23 bp, Homo sapiens
gcatcacggatggtgcatgggct

SEQ ID NO: 2250928 - DNA, 11 bp, Homo sapiens
gcatccagcct

SEQ ID NO: 2250929 - DNA, 17 bp, Homo sapiens
gcatctgcaacaaaaag

SEQ ID NO: 2250930 - DNA, 16 bp, Homo sapiens
gcatctggattgaaag

SEQ ID NO: 2250931 - DNA, 19 bp, Homo sapiens
gcatctgttagcagagtct

SEQ ID NO: 2250932 - DNA, 15 bp, Homo sapiens
gcatgaaagagaaag

SEQ ID NO: 2250933 - DNA, 19 bp, Homo sapiens
gcatgactatgtatttttc

SEQ ID NO: 2250934 - DNA, 17 bp, Homo sapiens
gcatgaggcaaaaatgt

SEQ ID NO: 2250935 - DNA, 15 bp, Homo sapiens
gcatgattttgtaac

SEQ ID NO: 2250936 - DNA, 19 bp, Homo sapiens
gcatgcacatgctgtctgg

SEQ ID NO: 2250937 - DNA, 13 bp, Homo sapiens
gcatgggctcgcc

SEQ ID NO: 2250938 - DNA, 15 bp, Homo sapiens
gcatgtaaatgtaaa

SEQ ID NO: 2250939 - DNA, 19 bp, Homo sapiens
gcatgtaaatgtaaactca

SEQ ID NO: 2250940 - DNA, 13 bp, Homo sapiens
gcattaataaaac

SEQ ID NO: 2250941 - DNA, 15 bp, Homo sapiens
gcattaataaaactg

SEQ ID NO: 2250942 - DNA, 16 bp, Homo sapiens
gcattaataaaactgt

SEQ ID NO: 2250943 - DNA, 18 bp, Homo sapiens
gcattagaattatttaaa

SEQ ID NO: 2250944 - DNA, 20 bp, Homo sapiens
gcattcatttgttttttcaa

SEQ ID NO: 2250945 - DNA, 16 bp, Homo sapiens
gcattgagcttgcatg

SEQ ID NO: 2250946 - DNA, 14 bp, Homo sapiens
gcattgctcagccc

SEQ ID NO: 2250947 - DNA, 16 bp, Homo sapiens
gcattggggggccggg

SEQ ID NO: 2250948 - DNA, 18 bp, Homo sapiens
gcattggggggccgggca

SEQ ID NO: 2250949 - DNA, 19 bp, Homo sapiens
gcattggggggccgggcag

SEQ ID NO: 2250950 - DNA, 14 bp, Homo sapiens
gcatttaccatgtg

SEQ ID NO: 2250951 - DNA, 21 bp, Homo sapiens
gcatttggtgagagtcaaagc

SEQ ID NO: 2250952 - DNA, 17 bp, Homo sapiens
gccaaaacaagccaaag

SEQ ID NO: 2250953 - DNA, 18 bp, Homo sapiens
gccaacggcaacagcatg

SEQ ID NO: 2250954 - DNA, 23 bp, Homo sapiens
gccaacgttcgatttctacctca

SEQ ID NO: 2250955 - DNA, 16 bp, Homo sapiens
gccaatagtgtcatcc

SEQ ID NO: 2250956 - DNA, 16 bp, Homo sapiens
gccacatacctctctg

SEQ ID NO: 2250957 - DNA, 19 bp, Homo sapiens
gccaccacctttggctggt

SEQ ID NO: 2250958 - DNA, 13 bp, Homo sapiens
gccacgctgtcct

SEQ ID NO: 2250959 - DNA, 19 bp, Homo sapiens
gccacgctgtcctctcgag

SEQ ID NO: 2250960 - DNA, 14 bp, Homo sapiens
gccactatgagctt

SEQ ID NO: 2250961 - DNA, 20 bp, Homo sapiens
gccactcatttcatctcatt

SEQ ID NO: 2250962 - DNA, 16 bp, Homo sapiens
gccagaccccacgctg

SEQ ID NO: 2250963 - DNA, 15 bp, Homo sapiens
gccagatttgtcttt

SEQ ID NO: 2250964 - DNA, 20 bp, Homo sapiens
gccagatttgtctttttgtt

SEQ ID NO: 2250965 - DNA, 14 bp, Homo sapiens
gccagcaccctctc

SEQ ID NO: 2250966 - DNA, 19 bp, Homo sapiens
gccagcaccctctcctggg

SEQ ID NO: 2250967 - DNA, 20 bp, Homo sapiens
gccagcaccctctcctgggg

SEQ ID NO: 2250968 - DNA, 21 bp, Homo sapiens
gccagcaccctctcctggggg

SEQ ID NO: 2250969 - DNA, 18 bp, Homo sapiens
gccagccgccctgggctg

SEQ ID NO: 2250970 - DNA, 19 bp, Homo sapiens
gccagccgccctgggctgt

SEQ ID NO: 2250971 - DNA, 16 bp, Homo sapiens
gccagcctcagaaggc

SEQ ID NO: 2250972 - DNA, 15 bp, Homo sapiens
gccagcctggctctg

SEQ ID NO: 2250973 - DNA, 22 bp, Homo sapiens
gccagcctggctctgccccctc

SEQ ID NO: 2250974 - DNA, 14 bp, Homo sapiens
gccagcgcctccct

SEQ ID NO: 2250975 - DNA, 16 bp, Homo sapiens
gccagcgcctccctcc

SEQ ID NO: 2250976 - DNA, 22 bp, Homo sapiens
gccagcgctgtggaccttacaa

SEQ ID NO: 2250977 - DNA, 13 bp, Homo sapiens
gccagctccctct

SEQ ID NO: 2250978 - DNA, 18 bp, Homo sapiens
gccaggaccaagggcaga

SEQ ID NO: 2250979 - DNA, 21 bp, Homo sapiens
gccaggagcaggcacgggtgg

SEQ ID NO: 2250980 - DNA, 17 bp, Homo sapiens
gccaggatccccctctt

SEQ ID NO: 2250981 - DNA, 19 bp, Homo sapiens
gccaggatccccctctttg

SEQ ID NO: 2250982 - DNA, 17 bp, Homo sapiens
gccaggcacccacatcc

SEQ ID NO: 2250983 - DNA, 19 bp, Homo sapiens
gccatgtccaaagaggctg

SEQ ID NO: 2250984 - DNA, 19 bp, Homo sapiens
gccatgttggccaggctgg

SEQ ID NO: 2250985 - DNA, 16 bp, Homo sapiens
gccatttagcaataaa

SEQ ID NO: 2250986 - DNA, 18 bp, Homo sapiens
gccatttagcaataaata

SEQ ID NO: 2250987 - DNA, 21 bp, Homo sapiens
gcccacaaactgatttctcac

SEQ ID NO: 2250988 - DNA, 15 bp, Homo sapiens
gcccactcattcctt

SEQ ID NO: 2250989 - DNA, 17 bp, Homo sapiens
gcccactcattccttct

SEQ ID NO: 2250990 - DNA, 13 bp, Homo sapiens
gcccactccccag

SEQ ID NO: 2250991 - DNA, 19 bp, Homo sapiens
gcccactccccagccccag

SEQ ID NO: 2250992 - DNA, 20 bp, Homo sapiens
gcccagaataagttattgca

SEQ ID NO: 2250993 - DNA, 23 bp, Homo sapiens
gcccagaataagttattgcagtt

SEQ ID NO: 2250994 - DNA, 12 bp, Homo sapiens
gcccagccctcc

SEQ ID NO: 2250995 - DNA, 15 bp, Homo sapiens
gcccaggatactggc

SEQ ID NO: 2250996 - DNA, 17 bp, Homo sapiens
gcccaggatactggcac

SEQ ID NO: 2250997 - DNA, 19 bp, Homo sapiens
gcccaggctggagtgcagt

SEQ ID NO: 2250998 - DNA, 14 bp, Homo sapiens
gcccaggtccctcc

SEQ ID NO: 2250999 - DNA, 14 bp, Homo sapiens
gcccatgtgtcccc

SEQ ID NO: 2251000 - DNA, 16 bp, Homo sapiens
gcccatgtgtcccctc

SEQ ID NO: 2251001 - DNA, 19 bp, Homo sapiens
gcccatgtgtcccctcact

SEQ ID NO: 2251002 - DNA, 18 bp, Homo sapiens
gccccaatccctttatta

SEQ ID NO: 2251003 - DNA, 15 bp, Homo sapiens
gccccagagagaccc

SEQ ID NO: 2251004 - DNA, 15 bp, Homo sapiens
gccccagccctgctg

SEQ ID NO: 2251005 - DNA, 20 bp, Homo sapiens
gccccagggggcggggtgca

SEQ ID NO: 2251006 - DNA, 13 bp, Homo sapiens
gcccccctcctcc

SEQ ID NO: 2251007 - DNA, 13 bp, Homo sapiens
gccccctccccca

SEQ ID NO: 2251008 - DNA, 20 bp, Homo sapiens
gccccctcccccatgggctg

SEQ ID NO: 2251009 - DNA, 19 bp, Homo sapiens
gccccctcctctagctgtg

SEQ ID NO: 2251010 - DNA, 21 bp, Homo sapiens
gccccctcctctagctgtggg

SEQ ID NO: 2251011 - DNA, 13 bp, Homo sapiens
gccccctgccccc

SEQ ID NO: 2251012 - DNA, 14 bp, Homo sapiens
gccccctgcccccc

SEQ ID NO: 2251013 - DNA, 18 bp, Homo sapiens
gccccctgccccccagcc

SEQ ID NO: 2251014 - DNA, 13 bp, Homo sapiens
gccccctggcctc

SEQ ID NO: 2251015 - DNA, 14 bp, Homo sapiens
gccccctggcctct

SEQ ID NO: 2251016 - DNA, 17 bp, Homo sapiens
gccccctggcctctgtg

SEQ ID NO: 2251017 - DNA, 14 bp, Homo sapiens
gccccgactccagc

SEQ ID NO: 2251018 - DNA, 15 bp, Homo sapiens
gccccgactccagcc

SEQ ID NO: 2251019 - DNA, 18 bp, Homo sapiens
gccccgactccagccagc

SEQ ID NO: 2251020 - DNA, 21 bp, Homo sapiens
gccccgccacgcttgtgtctt

SEQ ID NO: 2251021 - DNA, 15 bp, Homo sapiens
gcccctccacgcctc

SEQ ID NO: 2251022 - DNA, 21 bp, Homo sapiens
gcccctccacgcctcctggcc

SEQ ID NO: 2251023 - DNA, 12 bp, Homo sapiens
gcccgcttggcc

SEQ ID NO: 2251024 - DNA, 13 bp, Homo sapiens
gcccgcttggcca

SEQ ID NO: 2251025 - DNA, 15 bp, Homo sapiens
gcccgcttggccacc

SEQ ID NO: 2251026 - DNA, 13 bp, Homo sapiens
gcccgtcagcgtg

SEQ ID NO: 2251027 - DNA, 16 bp, Homo sapiens
gccctcatggcccctc

SEQ ID NO: 2251028 - DNA, 20 bp, Homo sapiens
gccctcccccttccccttct

SEQ ID NO: 2251029 - DNA, 23 bp, Homo sapiens
gccctcccccttccccttctgtg

SEQ ID NO: 2251030 - DNA, 22 bp, Homo sapiens
gccctccctgactccctgtggg

SEQ ID NO: 2251031 - DNA, 11 bp, Homo sapiens
gccctgcccca

SEQ ID NO: 2251032 - DNA, 15 bp, Homo sapiens
gccctgcttttgcat

SEQ ID NO: 2251033 - DNA, 12 bp, Homo sapiens
gccctgggcctc

SEQ ID NO: 2251034 - DNA, 23 bp, Homo sapiens
gccctggggatcttcccacagga

SEQ ID NO: 2251035 - DNA, 13 bp, Homo sapiens
gcccttccccctg

SEQ ID NO: 2251036 - DNA, 12 bp, Homo sapiens
gccgccctgggc

SEQ ID NO: 2251037 - DNA, 13 bp, Homo sapiens
gccgctggctggt

SEQ ID NO: 2251038 - DNA, 15 bp, Homo sapiens
gccggatctgaggga

SEQ ID NO: 2251039 - DNA, 17 bp, Homo sapiens
gccggatctgagggaga

SEQ ID NO: 2251040 - DNA, 14 bp, Homo sapiens
gccgggcaggtcct

SEQ ID NO: 2251041 - DNA, 23 bp, Homo sapiens
gcctaagggatcctgcctgcccc

SEQ ID NO: 2251042 - DNA, 22 bp, Homo sapiens
gcctaaggttgtctacgggggc

SEQ ID NO: 2251043 - DNA, 17 bp, Homo sapiens
gcctcagaaggccccag

SEQ ID NO: 2251044 - DNA, 13 bp, Homo sapiens
gcctcagccctca

SEQ ID NO: 2251045 - DNA, 14 bp, Homo sapiens
gcctcagccctcag

SEQ ID NO: 2251046 - DNA, 16 bp, Homo sapiens
gcctcagttcaacctg

SEQ ID NO: 2251047 - DNA, 22 bp, Homo sapiens
gcctccaattttttaagtgaaa

SEQ ID NO: 2251048 - DNA, 12 bp, Homo sapiens
gcctccagaact

SEQ ID NO: 2251049 - DNA, 13 bp, Homo sapiens
gcctccagggcat

SEQ ID NO: 2251050 - DNA, 19 bp, Homo sapiens
gcctccagggcattgctca

SEQ ID NO: 2251051 - DNA, 15 bp, Homo sapiens
gcctcccaccagagc

SEQ ID NO: 2251052 - DNA, 16 bp, Homo sapiens
gcctcccaccagagcc

SEQ ID NO: 2251053 - DNA, 22 bp, Homo sapiens
gcctccccctcagatgatctct

SEQ ID NO: 2251054 - DNA, 14 bp, Homo sapiens
gcctccctccaccc

SEQ ID NO: 2251055 - DNA, 15 bp, Homo sapiens
gcctccctccacccc

SEQ ID NO: 2251056 - DNA, 17 bp, Homo sapiens
gcctccctccaccccag

SEQ ID NO: 2251057 - DNA, 20 bp, Homo sapiens
gcctccctccaccccaggac

SEQ ID NO: 2251058 - DNA, 22 bp, Homo sapiens
gcctcctcatcccgtgttctcc

SEQ ID NO: 2251059 - DNA, 11 bp, Homo sapiens
gcctcctggcc

SEQ ID NO: 2251060 - DNA, 12 bp, Homo sapiens
gcctcctggcca

SEQ ID NO: 2251061 - DNA, 13 bp, Homo sapiens
gcctcctggccag

SEQ ID NO: 2251062 - DNA, 13 bp, Homo sapiens
gcctcgtgccatg

SEQ ID NO: 2251063 - DNA, 14 bp, Homo sapiens
gcctcgtgccatga

SEQ ID NO: 2251064 - DNA, 17 bp, Homo sapiens
gcctctcggtgacctcc

SEQ ID NO: 2251065 - DNA, 21 bp, Homo sapiens
gcctctctccttggccacaga

SEQ ID NO: 2251066 - DNA, 15 bp, Homo sapiens
gcctctgacagtcca

SEQ ID NO: 2251067 - DNA, 22 bp, Homo sapiens
gcctctgacagtccacaggggc

SEQ ID NO: 2251068 - DNA, 21 bp, Homo sapiens
gcctgcccctaccctggactt

SEQ ID NO: 2251069 - DNA, 21 bp, Homo sapiens
gcctgccctcatggcccctct

SEQ ID NO: 2251070 - DNA, 18 bp, Homo sapiens
gcctggaatttgggcaga

SEQ ID NO: 2251071 - DNA, 14 bp, Homo sapiens
gcctggccaggagc

SEQ ID NO: 2251072 - DNA, 17 bp, Homo sapiens
gcctggccaggagcagg

SEQ ID NO: 2251073 - DNA, 14 bp, Homo sapiens
gcctggctctgccc

SEQ ID NO: 2251074 - DNA, 23 bp, Homo sapiens
gcctggctctgccccctccccca

SEQ ID NO: 2251075 - DNA, 12 bp, Homo sapiens
gcctgggctcac

SEQ ID NO: 2251076 - DNA, 19 bp, Homo sapiens
gcctgggctcactgtgctg

SEQ ID NO: 2251077 - DNA, 20 bp, Homo sapiens
gcctgtcccacccccacccc

SEQ ID NO: 2251078 - DNA, 18 bp, Homo sapiens
gcctgttggcaggcccac

SEQ ID NO: 2251079 - DNA, 22 bp, Homo sapiens
gccttagtctcagtttgtgtgt

SEQ ID NO: 2251080 - DNA, 16 bp, Homo sapiens
gccttatgttgaaaaa

SEQ ID NO: 2251081 - DNA, 19 bp, Homo sapiens
gccttcccaagttgtgctt

SEQ ID NO: 2251082 - DNA, 13 bp, Homo sapiens
gccttcctctctc

SEQ ID NO: 2251083 - DNA, 13 bp, Homo sapiens
gccttctgcagca

SEQ ID NO: 2251084 - DNA, 14 bp, Homo sapiens
gccttctgcagcag

SEQ ID NO: 2251085 - DNA, 15 bp, Homo sapiens
gccttcttttgatta

SEQ ID NO: 2251086 - DNA, 22 bp, Homo sapiens
gcgaccaataaacagctcccag

SEQ ID NO: 2251087 - DNA, 23 bp, Homo sapiens
gcgaccttcctcatccaccccat

SEQ ID NO: 2251088 - DNA, 21 bp, Homo sapiens
aggatatcggcatttgtttct

SEQ ID NO: 2251089 - DNA, 22 bp, Homo sapiens
aggatccccctctttgcacagc

SEQ ID NO: 2251090 - DNA, 13 bp, Homo sapiens
aggatgctgagct

SEQ ID NO: 2251091 - DNA, 22 bp, Homo sapiens
aggatgctgggctctgttcttg

SEQ ID NO: 2251092 - DNA, 20 bp, Homo sapiens
aggatgtatattttatataa

SEQ ID NO: 2251093 - DNA, 20 bp, Homo sapiens
aggattcagtggaggctggc

SEQ ID NO: 2251094 - DNA, 17 bp, Homo sapiens
aggcacacagcagcccc

SEQ ID NO: 2251095 - DNA, 21 bp, Homo sapiens
aggcacacagcagccccccag

SEQ ID NO: 2251096 - DNA, 16 bp, Homo sapiens
aggcacccacatcccc

SEQ ID NO: 2251097 - DNA, 16 bp, Homo sapiens
aggcagacaaccttgt

SEQ ID NO: 2251098 - DNA, 19 bp, Homo sapiens
aggcaggaacaaacagggc

SEQ ID NO: 2251099 - DNA, 21 bp, Homo sapiens
aggcatctgttagcagagtct

SEQ ID NO: 2251100 - DNA, 23 bp, Homo sapiens
aggcatctgttagcagagtctgt

SEQ ID NO: 2251101 - DNA, 21 bp, Homo sapiens
aggccacatacctctctgaga

SEQ ID NO: 2251102 - DNA, 20 bp, Homo sapiens
aggccaggaccaagggcaga

SEQ ID NO: 2251103 - DNA, 16 bp, Homo sapiens
aggcccagagcgagga

SEQ ID NO: 2251104 - DNA, 17 bp, Homo sapiens
aggccctccctgactcc

SEQ ID NO: 2251105 - DNA, 23 bp, Homo sapiens
aggccctccctgactccctgtgg

SEQ ID NO: 2251106 - DNA, 13 bp, Homo sapiens
aggccgtgtctct

SEQ ID NO: 2251107 - DNA, 22 bp, Homo sapiens
aggcctaattctatgcctgtct

SEQ ID NO: 2251108 - DNA, 16 bp, Homo sapiens
aggccttcctctctcc

SEQ ID NO: 2251109 - DNA, 20 bp, Homo sapiens
aggcggaggttgcagtgagc

SEQ ID NO: 2251110 - DNA, 13 bp, Homo sapiens
aggctaaacatcc

SEQ ID NO: 2251111 - DNA, 23 bp, Homo sapiens
aggctaccaacttgtatccaggc

SEQ ID NO: 2251112 - DNA, 22 bp, Homo sapiens
aggctatggacagggcatgcca

SEQ ID NO: 2251113 - DNA, 15 bp, Homo sapiens
aggctcccctgagga

SEQ ID NO: 2251114 - DNA, 15 bp, Homo sapiens
aggctggcagggtcc

SEQ ID NO: 2251115 - DNA, 12 bp, Homo sapiens
aggctgggccat

SEQ ID NO: 2251116 - DNA, 20 bp, Homo sapiens
aggctgggccatgtccaaag

SEQ ID NO: 2251117 - DNA, 22 bp, Homo sapiens
aggctgggccatgtccaaagag

SEQ ID NO: 2251118 - DNA, 12 bp, Homo sapiens
aggctgggcccc

SEQ ID NO: 2251119 - DNA, 16 bp, Homo sapiens
aggctgggcccctggg

SEQ ID NO: 2251120 - DNA, 23 bp, Homo sapiens
aggcttaaggagaggagaaactg

SEQ ID NO: 2251121 - DNA, 13 bp, Homo sapiens
agggaaaaatata

SEQ ID NO: 2251122 - DNA, 14 bp, Homo sapiens
agggaaaaatatat

SEQ ID NO: 2251123 - DNA, 23 bp, Homo sapiens
agggaaagttttgttctgtatat

SEQ ID NO: 2251124 - DNA, 15 bp, Homo sapiens
agggaaggaacagga

SEQ ID NO: 2251125 - DNA, 16 bp, Homo sapiens
agggacatgccctgtg

SEQ ID NO: 2251126 - DNA, 22 bp, Homo sapiens
agggacatgccctgtgtggctg

SEQ ID NO: 2251127 - DNA, 18 bp, Homo sapiens
agggaccacaccctgtac

SEQ ID NO: 2251128 - DNA, 16 bp, Homo sapiens
agggaccactgggtga

SEQ ID NO: 2251129 - DNA, 21 bp, Homo sapiens
agggaccactgggtgagagag

SEQ ID NO: 2251130 - DNA, 22 bp, Homo sapiens
agggaccggcggaccccagcca

SEQ ID NO: 2251131 - DNA, 15 bp, Homo sapiens
agggagaagacactg

SEQ ID NO: 2251132 - DNA, 16 bp, Homo sapiens
agggagaagacactgc

SEQ ID NO: 2251133 - DNA, 19 bp, Homo sapiens
agggagaagacactgcagt

SEQ ID NO: 2251134 - DNA, 20 bp, Homo sapiens
agggagacactggcccctca

SEQ ID NO: 2251135 - DNA, 21 bp, Homo sapiens
agggagttatctaaaagaaat

SEQ ID NO: 2251136 - DNA, 18 bp, Homo sapiens
agggatgcaggctcccct

SEQ ID NO: 2251137 - DNA, 20 bp, Homo sapiens
agggatgcaggctcccctga

SEQ ID NO: 2251138 - DNA, 18 bp, Homo sapiens
agggatggagaggcggcc

SEQ ID NO: 2251139 - DNA, 19 bp, Homo sapiens
agggcattgctcagcccgc

SEQ ID NO: 2251140 - DNA, 13 bp, Homo sapiens
agggcattttaaa

SEQ ID NO: 2251141 - DNA, 17 bp, Homo sapiens
agggccaggcacccaca

SEQ ID NO: 2251142 - DNA, 15 bp, Homo sapiens
agggccctgtgtctg

SEQ ID NO: 2251143 - DNA, 20 bp, Homo sapiens
agggctgccttctggccttg

SEQ ID NO: 2251144 - DNA, 20 bp, Homo sapiens
aggggctgaggacgagaccc

SEQ ID NO: 2251145 - DNA, 14 bp, Homo sapiens
aggggctggggact

SEQ ID NO: 2251146 - DNA, 22 bp, Homo sapiens
agggggaaggtggggtcctgga

SEQ ID NO: 2251147 - DNA, 16 bp, Homo sapiens
agggggcaagaggaat

SEQ ID NO: 2251148 - DNA, 20 bp, Homo sapiens
agggggccctgccccacccc

SEQ ID NO: 2251149 - DNA, 19 bp, Homo sapiens
agggtacttttcctgggtt

SEQ ID NO: 2251150 - DNA, 22 bp, Homo sapiens
agggtcggaacccaagcttaga

SEQ ID NO: 2251151 - DNA, 14 bp, Homo sapiens
aggtaaaacagggc

SEQ ID NO: 2251152 - DNA, 14 bp, Homo sapiens
ctcttttcattgtg

SEQ ID NO: 2251153 - DNA, 23 bp, Homo sapiens
ctcttttccactccattgtcgta

SEQ ID NO: 2251154 - DNA, 22 bp, Homo sapiens
ctgaaaatattgttttacaata

SEQ ID NO: 2251155 - DNA, 13 bp, Homo sapiens
ctgaaacatttca

SEQ ID NO: 2251156 - DNA, 12 bp, Homo sapiens
ctgaaagtgtgt

SEQ ID NO: 2251157 - DNA, 21 bp, Homo sapiens
ctgaaagtgtgtgtagtttta

SEQ ID NO: 2251158 - DNA, 16 bp, Homo sapiens
ctgaactcgcagggaa

SEQ ID NO: 2251159 - DNA, 17 bp, Homo sapiens
ctgaagaactctctgga

SEQ ID NO: 2251160 - DNA, 14 bp, Homo sapiens
ctgaagccaaatga

SEQ ID NO: 2251161 - DNA, 18 bp, Homo sapiens
ctgaagtgagcacagcct

SEQ ID NO: 2251162 - DNA, 17 bp, Homo sapiens
ctgaagttgcagatgtt

SEQ ID NO: 2251163 - DNA, 18 bp, Homo sapiens
ctgaataccacttacctc

SEQ ID NO: 2251164 - DNA, 19 bp, Homo sapiens
ctgaataccacttacctca

SEQ ID NO: 2251165 - DNA, 17 bp, Homo sapiens
ctgaatatacagcaggt

SEQ ID NO: 2251166 - DNA, 21 bp, Homo sapiens
ctgaatattgccattatgctt

SEQ ID NO: 2251167 - DNA, 23 bp, Homo sapiens
ctgacaaggcacttcatgtaaag

SEQ ID NO: 2251168 - DNA, 21 bp, Homo sapiens
ctgacagggacatgccctgtg

SEQ ID NO: 2251169 - DNA, 22 bp, Homo sapiens
ctgacagggacatgccctgtgt

SEQ ID NO: 2251170 - DNA, 14 bp, Homo sapiens
ctgacagggagcag

SEQ ID NO: 2251171 - DNA, 16 bp, Homo sapiens
ctgacagggagcagcc

SEQ ID NO: 2251172 - DNA, 17 bp, Homo sapiens
ctgacagggagcagccc

SEQ ID NO: 2251173 - DNA, 13 bp, Homo sapiens
ctgacagtccaca

SEQ ID NO: 2251174 - DNA, 14 bp, Homo sapiens
ctgacagtccacag

SEQ ID NO: 2251175 - DNA, 22 bp, Homo sapiens
ctgaccccaaacaccttccagc

SEQ ID NO: 2251176 - DNA, 23 bp, Homo sapiens
ctgacccctgcctgttggcaggc

SEQ ID NO: 2251177 - DNA, 17 bp, Homo sapiens
ctgaccctatgggtcta

SEQ ID NO: 2251178 - DNA, 15 bp, Homo sapiens
ctgactccctgtggg

SEQ ID NO: 2251179 - DNA, 17 bp, Homo sapiens
ctgactccctgtggggg

SEQ ID NO: 2251180 - DNA, 17 bp, Homo sapiens
ctgagcagaaagaggcc

SEQ ID NO: 2251181 - DNA, 15 bp, Homo sapiens
ctgagcctctgctcc

SEQ ID NO: 2251182 - DNA, 18 bp, Homo sapiens
ctgagcctctgctcccca

SEQ ID NO: 2251183 - DNA, 13 bp, Homo sapiens
ctgagctgccagt

SEQ ID NO: 2251184 - DNA, 22 bp, Homo sapiens
ctgagcttgtcttttctgctga

SEQ ID NO: 2251185 - DNA, 23 bp, Homo sapiens
ctgaggacaagagaaaaaagcca

SEQ ID NO: 2251186 - DNA, 16 bp, Homo sapiens
ctgaggacgagacccc

SEQ ID NO: 2251187 - DNA, 22 bp, Homo sapiens
ctgaggacgagacccccatcca

SEQ ID NO: 2251188 - DNA, 12 bp, Homo sapiens
ctgaggctgagg

SEQ ID NO: 2251189 - DNA, 22 bp, Homo sapiens
ctgaggtgcctgtcccaccccc

SEQ ID NO: 2251190 - DNA, 16 bp, Homo sapiens
ctgagtccgggaggca

SEQ ID NO: 2251191 - DNA, 13 bp, Homo sapiens
ctgagtgaacctg

SEQ ID NO: 2251192 - DNA, 18 bp, Homo sapiens
ctgagtgaacctgtataa

SEQ ID NO: 2251193 - DNA, 15 bp, Homo sapiens
ctgcaaaaatattta

SEQ ID NO: 2251194 - DNA, 17 bp, Homo sapiens
ctgcaaaaatatttata

SEQ ID NO: 2251195 - DNA, 20 bp, Homo sapiens
ctgcaaaaatatttataaaa

SEQ ID NO: 2251196 - DNA, 13 bp, Homo sapiens
ctgtaggcctcag

SEQ ID NO: 2251197 - DNA, 22 bp, Homo sapiens
ctgtaggcctcaggtgaaactc

SEQ ID NO: 2251198 - DNA, 21 bp, Homo sapiens
ctgtataagtggaggcacttt

SEQ ID NO: 2251199 - DNA, 18 bp, Homo sapiens
ctgtataatctatttaca

SEQ ID NO: 2251200 - DNA, 17 bp, Homo sapiens
ctgtatattttgttacc

SEQ ID NO: 2251201 - DNA, 13 bp, Homo sapiens
ctgtatgttgtac

SEQ ID NO: 2251202 - DNA, 16 bp, Homo sapiens
ctgtatgttgtacaat

SEQ ID NO: 2251203 - DNA, 22 bp, Homo sapiens
ctgtcaaaactactgacaggga

SEQ ID NO: 2251204 - DNA, 19 bp, Homo sapiens
ctgtcaaggctgcttagaa

SEQ ID NO: 2251205 - DNA, 14 bp, Homo sapiens
ctgtcactcattgc

SEQ ID NO: 2251206 - DNA, 22 bp, Homo sapiens
ctgtcactcattgctgagcctc

SEQ ID NO: 2251207 - DNA, 21 bp, Homo sapiens
ctgtcactgttggacgtcagc

SEQ ID NO: 2251208 - DNA, 19 bp, Homo sapiens
ctgtcagccagccgccctg

SEQ ID NO: 2251209 - DNA, 22 bp, Homo sapiens
ctgtcagccagccgccctgggc

SEQ ID NO: 2251210 - DNA, 16 bp, Homo sapiens
ctgtcatctctctggg

SEQ ID NO: 2251211 - DNA, 17 bp, Homo sapiens
ctgtcatctctctgggg

SEQ ID NO: 2251212 - DNA, 14 bp, Homo sapiens
ctgtcccaccccca

SEQ ID NO: 2251213 - DNA, 16 bp, Homo sapiens
ctgtcccacccccacc

SEQ ID NO: 2251214 - DNA, 19 bp, Homo sapiens
ctgtcccaccgggagcctc

SEQ ID NO: 2251215 - DNA, 14 bp, Homo sapiens
ctgtccgggagcag

SEQ ID NO: 2251216 - DNA, 17 bp, Homo sapiens
ctgtctatgattgtact

SEQ ID NO: 2251217 - DNA, 15 bp, Homo sapiens
ctgtctggccctggg

SEQ ID NO: 2251218 - DNA, 13 bp, Homo sapiens
ctgtgcccccctc

SEQ ID NO: 2251219 - DNA, 16 bp, Homo sapiens
ctgtgcccccctcctc

SEQ ID NO: 2251220 - DNA, 17 bp, Homo sapiens
ctgtgcccccctcctcc

SEQ ID NO: 2251221 - DNA, 19 bp, Homo sapiens
ctgtgcccccctcctcccc

SEQ ID NO: 2251222 - DNA, 19 bp, Homo sapiens
ctgtgccttcttttgatta

SEQ ID NO: 2251223 - DNA, 16 bp, Homo sapiens
ctgtgggcagcaccct

SEQ ID NO: 2251224 - DNA, 21 bp, Homo sapiens
ctgtgggcagcaccctccccc

SEQ ID NO: 2251225 - DNA, 14 bp, Homo sapiens
ctgtgggggtggcc

SEQ ID NO: 2251226 - DNA, 17 bp, Homo sapiens
ctgtgggggtggccatc

SEQ ID NO: 2251227 - DNA, 14 bp, Homo sapiens
ctgtgtaaactcat

SEQ ID NO: 2251228 - DNA, 15 bp, Homo sapiens
ctgtgtctttctctc

SEQ ID NO: 2251229 - DNA, 21 bp, Homo sapiens
ctgtgttgtaccaaaattcat

SEQ ID NO: 2251230 - DNA, 18 bp, Homo sapiens
ctgttacactttttggaa

SEQ ID NO: 2251231 - DNA, 16 bp, Homo sapiens
ctgttcctgttcagta

SEQ ID NO: 2251232 - DNA, 11 bp, Homo sapiens
ctgttctgtgt

SEQ ID NO: 2251233 - DNA, 13 bp, Homo sapiens
ctgttctgtgtct

SEQ ID NO: 2251234 - DNA, 14 bp, Homo sapiens
ctgttctgtgtctt

SEQ ID NO: 2251235 - DNA, 16 bp, Homo sapiens
ctgttggcaggcccac

SEQ ID NO: 2251236 - DNA, 22 bp, Homo sapiens
ctgttggcaggcccactcccca

SEQ ID NO: 2251237 - DNA, 23 bp, Homo sapiens
ctgtttaatcatagttactgtgt

SEQ ID NO: 2251238 - DNA, 17 bp, Homo sapiens
ctgtttagaacaccaaa

SEQ ID NO: 2251239 - DNA, 17 bp, Homo sapiens
ctgtttagcagcagcct

SEQ ID NO: 2251240 - DNA, 20 bp, Homo sapiens
ctgtttagcagcagccttta

SEQ ID NO: 2251241 - DNA, 21 bp, Homo sapiens
ctgttttctctcggctcccca

SEQ ID NO: 2251242 - DNA, 20 bp, Homo sapiens
cttaaagttggtattaataa

SEQ ID NO: 2251243 - DNA, 22 bp, Homo sapiens
cttaaagttggtattaataaaa

SEQ ID NO: 2251244 - DNA, 22 bp, Homo sapiens
cttaaattcctcaacagtgttt

SEQ ID NO: 2251245 - DNA, 21 bp, Homo sapiens
cttaacctactaatagtttgt

SEQ ID NO: 2251246 - DNA, 18 bp, Homo sapiens
cttaacctttccgctgtc

SEQ ID NO: 2251247 - DNA, 12 bp, Homo sapiens
cttaagtcccag

SEQ ID NO: 2251248 - DNA, 21 bp, Homo sapiens
cttaagtcccagtatacctca

SEQ ID NO: 2251249 - DNA, 23 bp, Homo sapiens
cttaatatatttctaaatgtttg

SEQ ID NO: 2251250 - DNA, 20 bp, Homo sapiens
cttaatcattttcattccta

SEQ ID NO: 2251251 - DNA, 19 bp, Homo sapiens
cttaattattataaaaata

SEQ ID NO: 2251252 - DNA, 20 bp, Homo sapiens
cttaattattataaaaatat

SEQ ID NO: 2251253 - DNA, 15 bp, Homo sapiens
cttaattattatttg

SEQ ID NO: 2251254 - DNA, 20 bp, Homo sapiens
cttacattgttcaattagaa

SEQ ID NO: 2251255 - DNA, 23 bp, Homo sapiens
cttacgtgttagacaagaactat

SEQ ID NO: 2251256 - DNA, 12 bp, Homo sapiens
cttagaacattt

SEQ ID NO: 2251257 - DNA, 15 bp, Homo sapiens
cttagaacattttaa

SEQ ID NO: 2251258 - DNA, 16 bp, Homo sapiens
cttagaacattttaat

SEQ ID NO: 2251259 - DNA, 14 bp, Homo sapiens
cttagccattgaaa

SEQ ID NO: 2251260 - DNA, 17 bp, Homo sapiens
cttagctatccttggct

SEQ ID NO: 2251261 - DNA, 19 bp, Homo sapiens
cttagtctcagtttgtgtg

SEQ ID NO: 2251262 - DNA, 13 bp, Homo sapiens
ctcacaagccagc

SEQ ID NO: 2251263 - DNA, 20 bp, Homo sapiens
ctcacagcacttgttttcag

SEQ ID NO: 2251264 - DNA, 14 bp, Homo sapiens
ctcaccccctccca

SEQ ID NO: 2251265 - DNA, 15 bp, Homo sapiens
ctcactaatttttgt

SEQ ID NO: 2251266 - DNA, 20 bp, Homo sapiens
ctcactatggtatgctggcc

SEQ ID NO: 2251267 - DNA, 21 bp, Homo sapiens
ctcactatggtatgctggcca

SEQ ID NO: 2251268 - DNA, 20 bp, Homo sapiens
ctcactattacttgaacttt

SEQ ID NO: 2251269 - DNA, 12 bp, Homo sapiens
ctcactctgtca

SEQ ID NO: 2251270 - DNA, 13 bp, Homo sapiens
ctcactctgtcag

SEQ ID NO: 2251271 - DNA, 14 bp, Homo sapiens
ctcactctgtcagc

SEQ ID NO: 2251272 - DNA, 19 bp, Homo sapiens
ctcactctgtcagccagcc

SEQ ID NO: 2251273 - DNA, 20 bp, Homo sapiens
ctcactgcctctcggtgacc

SEQ ID NO: 2251274 - DNA, 16 bp, Homo sapiens
ctcactgcttgaacta

SEQ ID NO: 2251275 - DNA, 21 bp, Homo sapiens
ctcactgtttgtttttattta

SEQ ID NO: 2251276 - DNA, 16 bp, Homo sapiens
ctcagaaggccccaga

SEQ ID NO: 2251277 - DNA, 19 bp, Homo sapiens
ctcagacatgttttccgtg

SEQ ID NO: 2251278 - DNA, 11 bp, Homo sapiens
ctcagagccct

SEQ ID NO: 2251279 - DNA, 22 bp, Homo sapiens
ctcagagccctcaactattctg

SEQ ID NO: 2251280 - DNA, 20 bp, Homo sapiens
ctcagatgatctctccacgg

SEQ ID NO: 2251281 - DNA, 16 bp, Homo sapiens
ctcagatgttaaaata

SEQ ID NO: 2251282 - DNA, 23 bp, Homo sapiens
ctcagatgttaaaataaatggtt

SEQ ID NO: 2251283 - DNA, 16 bp, Homo sapiens
ctcagcccgcttggcc

SEQ ID NO: 2251284 - DNA, 17 bp, Homo sapiens
ctcagcccgcttggcca

SEQ ID NO: 2251285 - DNA, 17 bp, Homo sapiens
ctcagccctcagaacaa

SEQ ID NO: 2251286 - DNA, 20 bp, Homo sapiens
ctcagcctctgccagcgcca

SEQ ID NO: 2251287 - DNA, 14 bp, Homo sapiens
ctcagcgaggtgta

SEQ ID NO: 2251288 - DNA, 19 bp, Homo sapiens
ctcagctccaggtggctct

SEQ ID NO: 2251289 - DNA, 18 bp, Homo sapiens
ctcagctgtcaaggctca

SEQ ID NO: 2251290 - DNA, 16 bp, Homo sapiens
ctcaggaaaacagcta

SEQ ID NO: 2251291 - DNA, 14 bp, Homo sapiens
ctcagtgcatttgt

SEQ ID NO: 2251292 - DNA, 22 bp, Homo sapiens
ctcagtgcatttgtgctagaaa

SEQ ID NO: 2251293 - DNA, 22 bp, Homo sapiens
ctcagttcaacctggtggcacc

SEQ ID NO: 2251294 - DNA, 15 bp, Homo sapiens
ctcataaaaataaaa

SEQ ID NO: 2251295 - DNA, 15 bp, Homo sapiens
ctcataaaatggaag

SEQ ID NO: 2251296 - DNA, 16 bp, Homo sapiens
ctcatccaccccatcc

SEQ ID NO: 2251297 - DNA, 16 bp, Homo sapiens
ctcatcccgtgttctc

SEQ ID NO: 2251298 - DNA, 20 bp, Homo sapiens
ctcatggcccctctgacctg

SEQ ID NO: 2251299 - DNA, 14 bp, Homo sapiens
ctcatgttggccaa

SEQ ID NO: 2251300 - DNA, 19 bp, Homo sapiens
ctcattgctgagcctctgc

SEQ ID NO: 2251301 - DNA, 20 bp, Homo sapiens
ctcattgctgagcctctgct

SEQ ID NO: 2251302 - DNA, 13 bp, Homo sapiens
ctcattggccagc

SEQ ID NO: 2251303 - DNA, 22 bp, Homo sapiens
ctcatttaagggaaaaatatat

SEQ ID NO: 2251304 - DNA, 13 bp, Homo sapiens
ctcatttcatctc

SEQ ID NO: 2251305 - DNA, 19 bp, Homo sapiens
ctccaagtctgtacctcaa

SEQ ID NO: 2251306 - DNA, 15 bp, Homo sapiens
ctccaattttttaag

SEQ ID NO: 2251307 - DNA, 13 bp, Homo sapiens
ctccacagagagg

SEQ ID NO: 2251308 - DNA, 22 bp, Homo sapiens
ctccaccccaggacgccactca

SEQ ID NO: 2251309 - DNA, 16 bp, Homo sapiens
ctccaccctcccccag

SEQ ID NO: 2251310 - DNA, 22 bp, Homo sapiens
ctccaccctcccccagacacag

SEQ ID NO: 2251311 - DNA, 21 bp, Homo sapiens
ctccacgcctcctggccagac

SEQ ID NO: 2251312 - DNA, 21 bp, Homo sapiens
ctccacggtagcacttgacct

SEQ ID NO: 2251313 - DNA, 19 bp, Homo sapiens
ctccagatgtttccagact

SEQ ID NO: 2251314 - DNA, 13 bp, Homo sapiens
ctccagccagcgc

SEQ ID NO: 2251315 - DNA, 20 bp, Homo sapiens
ctccagccagcgcctccctc

SEQ ID NO: 2251316 - DNA, 15 bp, Homo sapiens
tgaagcctctctcct

SEQ ID NO: 2251317 - DNA, 15 bp, Homo sapiens
tgaagggaagagaca

SEQ ID NO: 2251318 - DNA, 17 bp, Homo sapiens
tgaagtgagcacagcct

SEQ ID NO: 2251319 - DNA, 18 bp, Homo sapiens
tgaagtgagcacagccta

SEQ ID NO: 2251320 - DNA, 16 bp, Homo sapiens
tgaagttgaaaatcat

SEQ ID NO: 2251321 - DNA, 17 bp, Homo sapiens
tgaagttttgatttatt

SEQ ID NO: 2251322 - DNA, 18 bp, Homo sapiens
tgaataccacttacctca

SEQ ID NO: 2251323 - DNA, 21 bp, Homo sapiens
tgaatatacagcaggtgctca

SEQ ID NO: 2251324 - DNA, 13 bp, Homo sapiens
tgaatattttcaa

SEQ ID NO: 2251325 - DNA, 19 bp, Homo sapiens
tgaatcagtataaacaaag

SEQ ID NO: 2251326 - DNA, 20 bp, Homo sapiens
tgaatcagtataaacaaagt

SEQ ID NO: 2251327 - DNA, 21 bp, Homo sapiens
tgaatcagtataaacaaagtt

SEQ ID NO: 2251328 - DNA, 18 bp, Homo sapiens
tgaatcattgtatgtggt

SEQ ID NO: 2251329 - DNA, 21 bp, Homo sapiens
tgaatcattgtatgtggtcat

SEQ ID NO: 2251330 - DNA, 13 bp, Homo sapiens
tgaatcctctgtt

SEQ ID NO: 2251331 - DNA, 12 bp, Homo sapiens
tgaatgacaaag

SEQ ID NO: 2251332 - DNA, 19 bp, Homo sapiens
tgaatgtagaataggcagg

SEQ ID NO: 2251333 - DNA, 12 bp, Homo sapiens
tgaatgttacaa

SEQ ID NO: 2251334 - DNA, 15 bp, Homo sapiens
tgaattttaaataat

SEQ ID NO: 2251335 - DNA, 15 bp, Homo sapiens
tgaatttttattgtt

SEQ ID NO: 2251336 - DNA, 21 bp, Homo sapiens
tgacaaaaaatgttttaaaga

SEQ ID NO: 2251337 - DNA, 16 bp, Homo sapiens
tgacaaaccataactg

SEQ ID NO: 2251338 - DNA, 16 bp, Homo sapiens
tgacacaagtggacct

SEQ ID NO: 2251339 - DNA, 21 bp, Homo sapiens
tgacaccatcttttattcttt

SEQ ID NO: 2251340 - DNA, 20 bp, Homo sapiens
tgacacccatgccagagagg

SEQ ID NO: 2251341 - DNA, 15 bp, Homo sapiens
tgacacctccccctt

SEQ ID NO: 2251342 - DNA, 15 bp, Homo sapiens
tgacagctagacacc

SEQ ID NO: 2251343 - DNA, 19 bp, Homo sapiens
tgacaggaaagccctcccc

SEQ ID NO: 2251344 - DNA, 21 bp, Homo sapiens
tgacaggaaagccctccccct

SEQ ID NO: 2251345 - DNA, 14 bp, Homo sapiens
tgacaggcctgtcc

SEQ ID NO: 2251346 - DNA, 19 bp, Homo sapiens
tgacatgttcctttaaggt

SEQ ID NO: 2251347 - DNA, 19 bp, Homo sapiens
tgaccatgcgtcaggggcc

SEQ ID NO: 2251348 - DNA, 20 bp, Homo sapiens
tgacccctgcctgttggcag

SEQ ID NO: 2251349 - DNA, 13 bp, Homo sapiens
tgacctccgtcct

SEQ ID NO: 2251350 - DNA, 18 bp, Homo sapiens
tgacctccgtcctctccc

SEQ ID NO: 2251351 - DNA, 14 bp, Homo sapiens
tgaccttaaatgca

SEQ ID NO: 2251352 - DNA, 18 bp, Homo sapiens
tcctgggttcaagtgatt

SEQ ID NO: 2251353 - DNA, 14 bp, Homo sapiens
tcctgggtttcctg

SEQ ID NO: 2251354 - DNA, 16 bp, Homo sapiens
tcctgggtttcctgca

SEQ ID NO: 2251355 - DNA, 19 bp, Homo sapiens
tcctgggtttcctgcaggc

SEQ ID NO: 2251356 - DNA, 15 bp, Homo sapiens
tcctggttcccgttt

SEQ ID NO: 2251357 - DNA, 22 bp, Homo sapiens
tcctgtatgttgtacaatcaaa

SEQ ID NO: 2251358 - DNA, 23 bp, Homo sapiens
tcctgtgccctagatgcacgtgg

SEQ ID NO: 2251359 - DNA, 24 bp, Homo sapiens
tcctgtgccctagatgcacgtggg

SEQ ID NO: 2251360 - DNA, 21 bp, Homo sapiens
tcctgtgtcggggctgacctc

SEQ ID NO: 2251361 - DNA, 18 bp, Homo sapiens
tcctgttcagtaataaaa

SEQ ID NO: 2251362 - DNA, 17 bp, Homo sapiens
tcctgttgtcaagaata

SEQ ID NO: 2251363 - DNA, 17 bp, Homo sapiens
tccttaatccagctgat

SEQ ID NO: 2251364 - DNA, 12 bp, Homo sapiens
tccttcactgtt

SEQ ID NO: 2251365 - DNA, 15 bp, Homo sapiens
tccttcactgtttca

SEQ ID NO: 2251366 - DNA, 23 bp, Homo sapiens
tccttcagacaccctcaacctct

SEQ ID NO: 2251367 - DNA, 15 bp, Homo sapiens
tccttctattctagc

SEQ ID NO: 2251368 - DNA, 14 bp, Homo sapiens
tccttgaggacaga

SEQ ID NO: 2251369 - DNA, 18 bp, Homo sapiens
tccttggctttcagagcc

SEQ ID NO: 2251370 - DNA, 22 bp, Homo sapiens
tccttggctttcagagccagcc

SEQ ID NO: 2251371 - DNA, 20 bp, Homo sapiens
tcctttaaggtactgaagct

SEQ ID NO: 2251372 - DNA, 23 bp, Homo sapiens
tcctttcagcaatccatgagata

SEQ ID NO: 2251373 - DNA, 23 bp, Homo sapiens
tcgagtgagacagactagaagtt

SEQ ID NO: 2251374 - DNA, 13 bp, Homo sapiens
tcgatttctacct

SEQ ID NO: 2251375 - DNA, 23 bp, Homo sapiens
tcgcaatagttttttacttctct

SEQ ID NO: 2251376 - DNA, 20 bp, Homo sapiens
tcgccccaggccctccctga

SEQ ID NO: 2251377 - DNA, 23 bp, Homo sapiens
tcgccgtgtctcagcctctgcca

SEQ ID NO: 2251378 - DNA, 15 bp, Homo sapiens
tcgcgctcagtaaac

SEQ ID NO: 2251379 - DNA, 22 bp, Homo sapiens
tcgcttcttagaacagtggaaa

SEQ ID NO: 2251380 - DNA, 20 bp, Homo sapiens
tcggaacccaagcttagaac

SEQ ID NO: 2251381 - DNA, 16 bp, Homo sapiens
tcggtgacctccgtcc

SEQ ID NO: 2251382 - DNA, 22 bp, Homo sapiens
tcggtttgccaaaattcatttc

SEQ ID NO: 2251383 - DNA, 18 bp, Homo sapiens
tcgtgccatgatctgtat

SEQ ID NO: 2251384 - DNA, 21 bp, Homo sapiens
tcgtgtgtttctattttttga

SEQ ID NO: 2251385 - DNA, 11 bp, Homo sapiens
tctaaaagaaa

SEQ ID NO: 2251386 - DNA, 18 bp, Homo sapiens
tctaactttattctttgt

SEQ ID NO: 2251387 - DNA, 23 bp, Homo sapiens
tctaattaaccttactaattata

SEQ ID NO: 2251388 - DNA, 17 bp, Homo sapiens
tctacaatgtgaacttt

SEQ ID NO: 2251389 - DNA, 19 bp, Homo sapiens
tctacaatgtgaactttat

SEQ ID NO: 2251390 - DNA, 16 bp, Homo sapiens
tctacatcttctgcct

SEQ ID NO: 2251391 - DNA, 17 bp, Homo sapiens
tctacatcttctgcctt

SEQ ID NO: 2251392 - DNA, 22 bp, Homo sapiens
tctacattaacttgaaaatttt

SEQ ID NO: 2251393 - DNA, 13 bp, Homo sapiens
tctacttcctaca

SEQ ID NO: 2251394 - DNA, 24 bp, Homo sapiens
tatgataggttattttgatgtaaa

SEQ ID NO: 2251395 - DNA, 15 bp, Homo sapiens
tatgattgtactttg

SEQ ID NO: 2251396 - DNA, 13 bp, Homo sapiens
tatgctggccagc

SEQ ID NO: 2251397 - DNA, 20 bp, Homo sapiens
tatgctggccagcaccctct

SEQ ID NO: 2251398 - DNA, 18 bp, Homo sapiens
tatgcttgtaactaaaat

SEQ ID NO: 2251399 - DNA, 17 bp, Homo sapiens
tatgtaatctctaggaa

SEQ ID NO: 2251400 - DNA, 16 bp, Homo sapiens
tatgtgttacttcaag

SEQ ID NO: 2251401 - DNA, 17 bp, Homo sapiens
tatgtgtttttctcata

SEQ ID NO: 2251402 - DNA, 16 bp, Homo sapiens
tatgttgtacaatcaa

SEQ ID NO: 2251403 - DNA, 17 bp, Homo sapiens
tatgttttttaaaatat

SEQ ID NO: 2251404 - DNA, 19 bp, Homo sapiens
tattaaatacaaaacttcc

SEQ ID NO: 2251405 - DNA, 16 bp, Homo sapiens
tattaacttttaatgg

SEQ ID NO: 2251406 - DNA, 13 bp, Homo sapiens
tattaataaaaag

SEQ ID NO: 2251407 - DNA, 20 bp, Homo sapiens
tattaatcaccttctttgta

SEQ ID NO: 2251408 - DNA, 13 bp, Homo sapiens
tattaatgcactt

SEQ ID NO: 2251409 - DNA, 17 bp, Homo sapiens
tattaatgcactttcta

SEQ ID NO: 2251410 - DNA, 11 bp, Homo sapiens
tattaatttat

SEQ ID NO: 2251411 - DNA, 15 bp, Homo sapiens
tattacaatgatcac

SEQ ID NO: 2251412 - DNA, 21 bp, Homo sapiens
tattacttgaactttccaaaa

SEQ ID NO: 2251413 - DNA, 15 bp, Homo sapiens
tattagaaaggctct

SEQ ID NO: 2251414 - DNA, 16 bp, Homo sapiens
tattagggagaaaatt

SEQ ID NO: 2251415 - DNA, 14 bp, Homo sapiens
tattagtaccatag

SEQ ID NO: 2251416 - DNA, 19 bp, Homo sapiens
tattataagtcttacataa

SEQ ID NO: 2251417 - DNA, 23 bp, Homo sapiens
tattataatataatatggaacct

SEQ ID NO: 2251418 - DNA, 22 bp, Homo sapiens
tattatcaaagggataaagaaa

SEQ ID NO: 2251419 - DNA, 13 bp, Homo sapiens
tattatcactgtc

SEQ ID NO: 2251420 - DNA, 14 bp, Homo sapiens
tattatttgtgttt

SEQ ID NO: 2251421 - DNA, 18 bp, Homo sapiens
tattcattgtggtcatag

SEQ ID NO: 2251422 - DNA, 16 bp, Homo sapiens
tattccaaaccaaatt

SEQ ID NO: 2251423 - DNA, 17 bp, Homo sapiens
tattccaaaccaaattt

SEQ ID NO: 2251424 - DNA, 20 bp, Homo sapiens
tattctgggcaccacaaaat

SEQ ID NO: 2251425 - DNA, 14 bp, Homo sapiens
tattgatttaagct

SEQ ID NO: 2251426 - DNA, 19 bp, Homo sapiens
tattgcagtttatcattca

SEQ ID NO: 2251427 - DNA, 19 bp, Homo sapiens
tattgctgagagaaatatg

SEQ ID NO: 2251428 - DNA, 16 bp, Homo sapiens
tattggggtctgaccc

SEQ ID NO: 2251429 - DNA, 21 bp, Homo sapiens
tattgtaatgagtgaattgaa

SEQ ID NO: 2251430 - DNA, 12 bp, Homo sapiens
tattgtattaag

SEQ ID NO: 2251431 - DNA, 16 bp, Homo sapiens
tattgtattaagggca

SEQ ID NO: 2251432 - DNA, 16 bp, Homo sapiens
tattgttaatacaagg

SEQ ID NO: 2251433 - DNA, 14 bp, Homo sapiens
tattgttttacaat

SEQ ID NO: 2251434 - DNA, 22 bp, Homo sapiens
tattgttttacaatagttctgt

SEQ ID NO: 2251435 - DNA, 23 bp, Homo sapiens
tatttaaatattaccctccaagt

SEQ ID NO: 2251436 - DNA, 14 bp, Homo sapiens
tatttaaattacaa

SEQ ID NO: 2251437 - DNA, 18 bp, Homo sapiens
tatttaaattacaatttt

SEQ ID NO: 2251438 - DNA, 15 bp, Homo sapiens
tatttaacagctgaa

SEQ ID NO: 2251439 - DNA, 23 bp, Homo sapiens
tatttaacagctgaattatctat

SEQ ID NO: 2251440 - DNA, 14 bp, Homo sapiens
tatttaagatgtga

SEQ ID NO: 2251441 - DNA, 13 bp, Homo sapiens
tatttaattgaaa

SEQ ID NO: 2251442 - DNA, 14 bp, Homo sapiens
tatttaccttgaaa

SEQ ID NO: 2251443 - DNA, 15 bp, Homo sapiens
tatttaccttgaaaa

SEQ ID NO: 2251444 - DNA, 15 bp, Homo sapiens
tatttatctgattaa

SEQ ID NO: 2251445 - DNA, 21 bp, Homo sapiens
tatttatctgattaagttgtc

SEQ ID NO: 2251446 - DNA, 13 bp, Homo sapiens
tatttctattatt

SEQ ID NO: 2251447 - DNA, 16 bp, Homo sapiens
tatttgcatatttatt

SEQ ID NO: 2251448 - DNA, 17 bp, Homo sapiens
tatttgtaagatatttg

SEQ ID NO: 2251449 - DNA, 12 bp, Homo sapiens
tatttgtgtttt

SEQ ID NO: 2251450 - DNA, 19 bp, Homo sapiens
tatttgtgttttaatttaa

SEQ ID NO: 2251451 - DNA, 14 bp, Homo sapiens
tattttctatttta

SEQ ID NO: 2251452 - DNA, 12 bp, Homo sapiens
tattttgaatca

SEQ ID NO: 2251453 - DNA, 15 bp, Homo sapiens
tattttgaatcaata

SEQ ID NO: 2251454 - DNA, 17 bp, Homo sapiens
tcacacatatcagcagg

SEQ ID NO: 2251455 - DNA, 24 bp, Homo sapiens
tcacactggatccatcttgagcca

SEQ ID NO: 2251456 - DNA, 14 bp, Homo sapiens
tcacagcacttgtt

SEQ ID NO: 2251457 - DNA, 14 bp, Homo sapiens
tcacagctcctccc

SEQ ID NO: 2251458 - DNA, 15 bp, Homo sapiens
tcacagtaaaaataa

SEQ ID NO: 2251459 - DNA, 16 bp, Homo sapiens
tcacagtaaaaataaa

SEQ ID NO: 2251460 - DNA, 22 bp, Homo sapiens
tcacagtcccaggtttagtgaa

SEQ ID NO: 2251461 - DNA, 14 bp, Homo sapiens
tcacatttttttct

SEQ ID NO: 2251462 - DNA, 15 bp, Homo sapiens
tcaccaaaagacact

SEQ ID NO: 2251463 - DNA, 16 bp, Homo sapiens
tcaccaaaagacactg

SEQ ID NO: 2251464 - DNA, 18 bp, Homo sapiens
tcaccaaaagacactgca

SEQ ID NO: 2251465 - DNA, 19 bp, Homo sapiens
tcaccactaccagccagcc

SEQ ID NO: 2251466 - DNA, 19 bp, Homo sapiens
tcaccagctatctgtcatc

SEQ ID NO: 2251467 - DNA, 22 bp, Homo sapiens
tcaccccctcccacccccagcc

SEQ ID NO: 2251468 - DNA, 16 bp, Homo sapiens
tcaccgagtgggggca

SEQ ID NO: 2251469 - DNA, 21 bp, Homo sapiens
tcacggatggtgcatgggctc

SEQ ID NO: 2251470 - DNA, 18 bp, Homo sapiens
tcactaaagcatgaaatg

SEQ ID NO: 2251471 - DNA, 15 bp, Homo sapiens
tcactaatttttgta

SEQ ID NO: 2251472 - DNA, 16 bp, Homo sapiens
tcactaatttttgtat

SEQ ID NO: 2251473 - DNA, 18 bp, Homo sapiens
tcactattacttgaactt

SEQ ID NO: 2251474 - DNA, 22 bp, Homo sapiens
tcactcattgctgagcctctgc

SEQ ID NO: 2251475 - DNA, 15 bp, Homo sapiens
tcactctgtcagcca

SEQ ID NO: 2251476 - DNA, 20 bp, Homo sapiens
tcactctgtcagccagccgc

SEQ ID NO: 2251477 - DNA, 13 bp, Homo sapiens
tcactggggcaga

SEQ ID NO: 2251478 - DNA, 16 bp, Homo sapiens
tcactgtgctggggca

SEQ ID NO: 2251479 - DNA, 14 bp, Homo sapiens
tcactgtttcatct

SEQ ID NO: 2251480 - DNA, 13 bp, Homo sapiens
tcacttaagtatt

SEQ ID NO: 2251481 - DNA, 19 bp, Homo sapiens
tcagaaagctttattttga

SEQ ID NO: 2251482 - DNA, 16 bp, Homo sapiens
tcagaacaatccgatt

SEQ ID NO: 2251483 - DNA, 14 bp, Homo sapiens
tcagaagaaataaa

SEQ ID NO: 2251484 - DNA, 16 bp, Homo sapiens
tcagaagaaataaata

SEQ ID NO: 2251485 - DNA, 15 bp, Homo sapiens
tcagaaggccccaga

SEQ ID NO: 2251486 - DNA, 13 bp, Homo sapiens
tcagaagggctat

SEQ ID NO: 2251487 - DNA, 15 bp, Homo sapiens
tcagacaccctcaac

SEQ ID NO: 2251488 - DNA, 22 bp, Homo sapiens
tcagacaccctcaacctcttct

SEQ ID NO: 2251489 - DNA, 13 bp, Homo sapiens
tcagagccagcct

SEQ ID NO: 2251490 - DNA, 16 bp, Homo sapiens
tcagagccagcctggc

SEQ ID NO: 2251491 - DNA, 16 bp, Homo sapiens
tcagagcgcacaggga

SEQ ID NO: 2251492 - DNA, 15 bp, Homo sapiens
tcagatgttaaaata

SEQ ID NO: 2251493 - DNA, 17 bp, Homo sapiens
tcagatgttaaaataaa

SEQ ID NO: 2251494 - DNA, 18 bp, Homo sapiens
tcagatgttaaaataaat

SEQ ID NO: 2251495 - DNA, 15 bp, Homo sapiens
tcagattcacacatg

SEQ ID NO: 2251496 - DNA, 16 bp, Homo sapiens
tcagatttctgaggaa

SEQ ID NO: 2251497 - DNA, 19 bp, Homo sapiens
tcagcaagttagaactagc

SEQ ID NO: 2251498 - DNA, 21 bp, Homo sapiens
tcagcaagttagaactagcca

SEQ ID NO: 2251499 - DNA, 18 bp, Homo sapiens
tcagcagcaaattttcag

SEQ ID NO: 2251500 - DNA, 15 bp, Homo sapiens
tcagccagccgccct

SEQ ID NO: 2251501 - DNA, 19 bp, Homo sapiens
tcagccagccgccctgggc

SEQ ID NO: 2251502 - DNA, 14 bp, Homo sapiens
tcaggaaaacagct

SEQ ID NO: 2251503 - DNA, 15 bp, Homo sapiens
tcaggaaaacagcta

SEQ ID NO: 2251504 - DNA, 20 bp, Homo sapiens
tcaggaaaacagctagtaga

SEQ ID NO: 2251505 - DNA, 16 bp, Homo sapiens
tcaggacaacacttca

SEQ ID NO: 2251506 - DNA, 13 bp, Homo sapiens
tcaggcagctcaa

SEQ ID NO: 2251507 - DNA, 21 bp, Homo sapiens
tcagggaaactaagattcttt

SEQ ID NO: 2251508 - DNA, 23 bp, Homo sapiens
tcaggtgtagtagttctgtgttg

SEQ ID NO: 2251509 - DNA, 22 bp, Homo sapiens
tcagtaaacgggaacatgcccc

SEQ ID NO: 2251510 - DNA, 16 bp, Homo sapiens
tcagtaagctgtgtgg

SEQ ID NO: 2251511 - DNA, 21 bp, Homo sapiens
tagttccccaaatacaaagtt

SEQ ID NO: 2251512 - DNA, 12 bp, Homo sapiens
tagtttctcatg

SEQ ID NO: 2251513 - DNA, 12 bp, Homo sapiens
tataaaataact

SEQ ID NO: 2251514 - DNA, 19 bp, Homo sapiens
tataaaataactaaaatgt

SEQ ID NO: 2251515 - DNA, 21 bp, Homo sapiens
tataaaatacatagtgaaaat

SEQ ID NO: 2251516 - DNA, 22 bp, Homo sapiens
tataaatttttaagagaaagaa

SEQ ID NO: 2251517 - DNA, 18 bp, Homo sapiens
tataagtggaggcacttt

SEQ ID NO: 2251518 - DNA, 22 bp, Homo sapiens
tataatcatcaagtaatacaaa

SEQ ID NO: 2251519 - DNA, 15 bp, Homo sapiens
tataatctatttaca

SEQ ID NO: 2251520 - DNA, 19 bp, Homo sapiens
tataatcttgtagacactt

SEQ ID NO: 2251521 - DNA, 16 bp, Homo sapiens
tataatgaacaaaatt

SEQ ID NO: 2251522 - DNA, 17 bp, Homo sapiens
tataatgaacaaaatta

SEQ ID NO: 2251523 - DNA, 12 bp, Homo sapiens
tataattctgga

SEQ ID NO: 2251524 - DNA, 13 bp, Homo sapiens
tatacaaaacttt

SEQ ID NO: 2251525 - DNA, 22 bp, Homo sapiens
tatacagttataaaattaaaag

SEQ ID NO: 2251526 - DNA, 19 bp, Homo sapiens
tatacagttgaaaacttgt

SEQ ID NO: 2251527 - DNA, 17 bp, Homo sapiens
tatacctcatttttcat

SEQ ID NO: 2251528 - DNA, 17 bp, Homo sapiens
tatactatttatataca

SEQ ID NO: 2251529 - DNA, 23 bp, Homo sapiens
tatagaaaaataaaaatctcttt

SEQ ID NO: 2251530 - DNA, 20 bp, Homo sapiens
tatagatataatgaacaaaa

SEQ ID NO: 2251531 - DNA, 10 bp, Homo sapiens
tatagcatta

SEQ ID NO: 2251532 - DNA, 19 bp, Homo sapiens
tataggcatacctcctatg

SEQ ID NO: 2251533 - DNA, 12 bp, Homo sapiens
tatataaaaatg

SEQ ID NO: 2251534 - DNA, 12 bp, Homo sapiens
tatatattgtat

SEQ ID NO: 2251535 - DNA, 16 bp, Homo sapiens
tatatattgtattaag

SEQ ID NO: 2251536 - DNA, 14 bp, Homo sapiens
tatatctatctatt

SEQ ID NO: 2251537 - DNA, 17 bp, Homo sapiens
tatatctatctatttga

SEQ ID NO: 2251538 - DNA, 15 bp, Homo sapiens
tatatctctatttga

SEQ ID NO: 2251539 - DNA, 20 bp, Homo sapiens
tatattaatcaccttctttg

SEQ ID NO: 2251540 - DNA, 15 bp, Homo sapiens
tatattgtattaagg

SEQ ID NO: 2251541 - DNA, 18 bp, Homo sapiens
tatattttatataaagta

SEQ ID NO: 2251542 - DNA, 12 bp, Homo sapiens
tatcaaaacaag

SEQ ID NO: 2251543 - DNA, 17 bp, Homo sapiens
tatcaagacgtttaact

SEQ ID NO: 2251544 - DNA, 20 bp, Homo sapiens
tatcaagacgtttaactgca

SEQ ID NO: 2251545 - DNA, 23 bp, Homo sapiens
tatcataagttatgcctctgaca

SEQ ID NO: 2251546 - DNA, 13 bp, Homo sapiens
tatcattcaagtg

SEQ ID NO: 2251547 - DNA, 14 bp, Homo sapiens
tatcattcaagtgt

SEQ ID NO: 2251548 - DNA, 18 bp, Homo sapiens
tatccaggcaccaggact

SEQ ID NO: 2251549 - DNA, 12 bp, Homo sapiens
tatcctctgtaa

SEQ ID NO: 2251550 - DNA, 21 bp, Homo sapiens
tatcctgcgggttttaattta

SEQ ID NO: 2251551 - DNA, 18 bp, Homo sapiens
tatctataaaatagatat

SEQ ID NO: 2251552 - DNA, 18 bp, Homo sapiens
tatctatacatatcttta

SEQ ID NO: 2251553 - DNA, 16 bp, Homo sapiens
tatctcagatgttaaa

SEQ ID NO: 2251554 - DNA, 19 bp, Homo sapiens
tatctcagatgttaaaata

SEQ ID NO: 2251555 - DNA, 20 bp, Homo sapiens
tatgaaggatccatctttgt

SEQ ID NO: 2251556 - DNA, 21 bp, Homo sapiens
tatgactaatttggggaaaat

SEQ ID NO: 2251557 - DNA, 22 bp, Homo sapiens
tatgactttttataaaatggct

SEQ ID NO: 2251558 - DNA, 16 bp, Homo sapiens
tgcacatgctgtctgg

SEQ ID NO: 2251559 - DNA, 18 bp, Homo sapiens
tgcaccgagtgatttcca

SEQ ID NO: 2251560 - DNA, 17 bp, Homo sapiens
tgcacttgtgattattt

SEQ ID NO: 2251561 - DNA, 16 bp, Homo sapiens
tgcacttttagccaga

SEQ ID NO: 2251562 - DNA, 23 bp, Homo sapiens
tgcagcacagctgagaggctgtc

SEQ ID NO: 2251563 - DNA, 20 bp, Homo sapiens
tgcagctatgcgcaatgtgg

SEQ ID NO: 2251564 - DNA, 15 bp, Homo sapiens
tgcaggacttgagaa

SEQ ID NO: 2251565 - DNA, 15 bp, Homo sapiens
tgcaggctcccctga

SEQ ID NO: 2251566 - DNA, 21 bp, Homo sapiens
tgcagtggcgcattctaggct

SEQ ID NO: 2251567 - DNA, 16 bp, Homo sapiens
tgcagttgactttctc

SEQ ID NO: 2251568 - DNA, 17 bp, Homo sapiens
tgcagtttatcattcaa

SEQ ID NO: 2251569 - DNA, 12 bp, Homo sapiens
tgcataatgcaa

SEQ ID NO: 2251570 - DNA, 21 bp, Homo sapiens
tgcatcacccgcccctggact

SEQ ID NO: 2251571 - DNA, 12 bp, Homo sapiens
tgcatctctgtg

SEQ ID NO: 2251572 - DNA, 13 bp, Homo sapiens
tgcatctctgtga

SEQ ID NO: 2251573 - DNA, 13 bp, Homo sapiens
tgcatgggctcgc

SEQ ID NO: 2251574 - DNA, 21 bp, Homo sapiens
tgcatttgagagaagccacgc

SEQ ID NO: 2251575 - DNA, 22 bp, Homo sapiens
tgcatttgagagaagccacgct

SEQ ID NO: 2251576 - DNA, 20 bp, Homo sapiens
tgccaataaagtgatctgtg

SEQ ID NO: 2251577 - DNA, 21 bp, Homo sapiens
tgccaataaagtgatctgtgt

SEQ ID NO: 2251578 - DNA, 16 bp, Homo sapiens
tgccacttctcactca

SEQ ID NO: 2251579 - DNA, 19 bp, Homo sapiens
tgccagctacttcctcctc

SEQ ID NO: 2251580 - DNA, 18 bp, Homo sapiens
tgccatacttgttctgta

SEQ ID NO: 2251581 - DNA, 17 bp, Homo sapiens
tgccatttagcaataaa

SEQ ID NO: 2251582 - DNA, 14 bp, Homo sapiens
tgcccatgtgtccc

SEQ ID NO: 2251583 - DNA, 14 bp, Homo sapiens
tgccccctgcagac

SEQ ID NO: 2251584 - DNA, 17 bp, Homo sapiens
tgcccctaccctggact

SEQ ID NO: 2251585 - DNA, 12 bp, Homo sapiens
tgcccctctcac

SEQ ID NO: 2251586 - DNA, 14 bp, Homo sapiens
tgcccctctcacca

SEQ ID NO: 2251587 - DNA, 23 bp, Homo sapiens
tgccctcatggcccctctgacct

SEQ ID NO: 2251588 - DNA, 14 bp, Homo sapiens
tgccctgtgtggct

SEQ ID NO: 2251589 - DNA, 14 bp, Homo sapiens
tgccgctgcaccac

SEQ ID NO: 2251590 - DNA, 17 bp, Homo sapiens
tgccgctgcaccacggc

SEQ ID NO: 2251591 - DNA, 23 bp, Homo sapiens
tgtcattcgctactatgatttaa

SEQ ID NO: 2251592 - DNA, 17 bp, Homo sapiens
tgtcattggaagccatc

SEQ ID NO: 2251593 - DNA, 19 bp, Homo sapiens
tgtccaaagaggctgcccc

SEQ ID NO: 2251594 - DNA, 23 bp, Homo sapiens
tgtcccacccccacccccagctc

SEQ ID NO: 2251595 - DNA, 22 bp, Homo sapiens
tgtcctaaaacacctggtagga

SEQ ID NO: 2251596 - DNA, 13 bp, Homo sapiens
tgtcctttccctt

SEQ ID NO: 2251597 - DNA, 21 bp, Homo sapiens
tgtcgccccaggccctccctg

SEQ ID NO: 2251598 - DNA, 22 bp, Homo sapiens
tgtcgtatttggcacacagcag

SEQ ID NO: 2251599 - DNA, 17 bp, Homo sapiens
tgtctaaacaatgctga

SEQ ID NO: 2251600 - DNA, 21 bp, Homo sapiens
tgtctaaacaatgctgatttg

SEQ ID NO: 2251601 - DNA, 18 bp, Homo sapiens
tgtctagtaattgggaaa

SEQ ID NO: 2251602 - DNA, 20 bp, Homo sapiens
tgtctcactaaagcatgaaa

SEQ ID NO: 2251603 - DNA, 23 bp, Homo sapiens
tgtctcactaaagcatgaaatgt

SEQ ID NO: 2251604 - DNA, 15 bp, Homo sapiens
tgtctcagcctctgc

SEQ ID NO: 2251605 - DNA, 19 bp, Homo sapiens
tgtctcaggaaaacagcta

SEQ ID NO: 2251606 - DNA, 19 bp, Homo sapiens
tgtctccacttgtatatat

SEQ ID NO: 2251607 - DNA, 15 bp, Homo sapiens
tgtctcgttcctgtt

SEQ ID NO: 2251608 - DNA, 17 bp, Homo sapiens
tgtctgagtgaacctgt

SEQ ID NO: 2251609 - DNA, 20 bp, Homo sapiens
tgtctgagtgaacctgtata

SEQ ID NO: 2251610 - DNA, 21 bp, Homo sapiens
tgtctgagtgaacctgtataa

SEQ ID NO: 2251611 - DNA, 20 bp, Homo sapiens
tgtctgttctgcacaataaa

SEQ ID NO: 2251612 - DNA, 22 bp, Homo sapiens
tgtctttaaaaactgttttaga

SEQ ID NO: 2251613 - DNA, 13 bp, Homo sapiens
tgtcttttctgct

SEQ ID NO: 2251614 - DNA, 13 bp, Homo sapiens
tgtgaaaaatctg

SEQ ID NO: 2251615 - DNA, 18 bp, Homo sapiens
tgtgaactttattaaata

SEQ ID NO: 2251616 - DNA, 19 bp, Homo sapiens
tgtgaattgtttttgtaca

SEQ ID NO: 2251617 - DNA, 15 bp, Homo sapiens
tgtgaatttttattg

SEQ ID NO: 2251618 - DNA, 16 bp, Homo sapiens
tgtgaatttttattgt

SEQ ID NO: 2251619 - DNA, 20 bp, Homo sapiens
tgtgaatttttattgttgta

SEQ ID NO: 2251620 - DNA, 18 bp, Homo sapiens
tgtgagaaggtttattgt

SEQ ID NO: 2251621 - DNA, 19 bp, Homo sapiens
tgtgagaaggtttattgtt

SEQ ID NO: 2251622 - DNA, 14 bp, Homo sapiens
tgtgatagcacttt

SEQ ID NO: 2251623 - DNA, 15 bp, Homo sapiens
tgtgatagcactttc

SEQ ID NO: 2251624 - DNA, 16 bp, Homo sapiens
tgtgcacaccaccctc

SEQ ID NO: 2251625 - DNA, 17 bp, Homo sapiens
tgtgccaccatgcctca

SEQ ID NO: 2251626 - DNA, 14 bp, Homo sapiens
tgtgcccccctcct

SEQ ID NO: 2251627 - DNA, 19 bp, Homo sapiens
tgtgccctagatgcacgtg

SEQ ID NO: 2251628 - DNA, 22 bp, Homo sapiens
tgtgctacaattcattgtgtta

SEQ ID NO: 2251629 - DNA, 19 bp, Homo sapiens
tgtgctgtgggcagcaccc

SEQ ID NO: 2251630 - DNA, 14 bp, Homo sapiens
tgtgctttgagaag

SEQ ID NO: 2251631 - DNA, 19 bp, Homo sapiens
tgtggcaggagggcagtgg

SEQ ID NO: 2251632 - DNA, 14 bp, Homo sapiens
tgtggcattggggg

SEQ ID NO: 2251633 - DNA, 16 bp, Homo sapiens
tgtggcctcagccctc

SEQ ID NO: 2251634 - DNA, 18 bp, Homo sapiens
tgtggcctcagccctcag

SEQ ID NO: 2251635 - DNA, 17 bp, Homo sapiens
tgtggcctgcacagtga

SEQ ID NO: 2251636 - DNA, 14 bp, Homo sapiens
tgtggctccttccc

SEQ ID NO: 2251637 - DNA, 15 bp, Homo sapiens
tgtgggcagcaccct

SEQ ID NO: 2251638 - DNA, 16 bp, Homo sapiens
tgtggtgcagtgtgaa

SEQ ID NO: 2251639 - DNA, 22 bp, Homo sapiens
tgtgtaaacaaaatgaagctgc

SEQ ID NO: 2251640 - DNA, 13 bp, Homo sapiens
tgtgtaacactgt

SEQ ID NO: 2251641 - DNA, 15 bp, Homo sapiens
tgtgtaacactgtgt

SEQ ID NO: 2251642 - DNA, 17 bp, Homo sapiens
tgtgtaagaaatacaga

SEQ ID NO: 2251643 - DNA, 18 bp, Homo sapiens
tgtgtagacgatatactc

SEQ ID NO: 2251644 - DNA, 15 bp, Homo sapiens
tgtgtattttcagtc

SEQ ID NO: 2251645 - DNA, 14 bp, Homo sapiens
tgtgtcccctcact

SEQ ID NO: 2251646 - DNA, 17 bp, Homo sapiens
tgtgtcccctcactctg

SEQ ID NO: 2251647 - DNA, 22 bp, Homo sapiens
tgtgtcccctcactctgtcagc

SEQ ID NO: 2251648 - DNA, 19 bp, Homo sapiens
tgtgtccgctaaatattta

SEQ ID NO: 2251649 - DNA, 17 bp, Homo sapiens
tgtgtcctaaggcccat

SEQ ID NO: 2251650 - DNA, 19 bp, Homo sapiens
tgtgtcggggctgacctct

SEQ ID NO: 2251651 - DNA, 20 bp, Homo sapiens
tgtgtctcaggaaaacagct

SEQ ID NO: 2251652 - DNA, 11 bp, Homo sapiens
tgtgtggcctg

SEQ ID NO: 2251653 - DNA, 16 bp, Homo sapiens
tgtgtgtcttaattat

SEQ ID NO: 2251654 - DNA, 15 bp, Homo sapiens
tgtgttgactttata

SEQ ID NO: 2251655 - DNA, 15 bp, Homo sapiens
tgtgtttcaagttca

SEQ ID NO: 2251656 - DNA, 23 bp, Homo sapiens
tgtgtttgtttgtttgcagtctc

SEQ ID NO: 2251657 - DNA, 19 bp, Homo sapiens
tgttaacctctgcttttat

SEQ ID NO: 2251658 - DNA, 14 bp, Homo sapiens
tgttacctgtagat

SEQ ID NO: 2251659 - DNA, 19 bp, Homo sapiens
tgttaccttttacagaata

SEQ ID NO: 2251660 - DNA, 20 bp, Homo sapiens
tgttactggataaattgttt

SEQ ID NO: 2251661 - DNA, 19 bp, Homo sapiens
tgttagatatttttcataa

SEQ ID NO: 2251662 - DNA, 23 bp, Homo sapiens
tgttagatatttttcataaacaa

SEQ ID NO: 2251663 - DNA, 17 bp, Homo sapiens
tgttagattaagaaata

SEQ ID NO: 2251664 - DNA, 14 bp, Homo sapiens
tgttagcagagtct

SEQ ID NO: 2251665 - DNA, 17 bp, Homo sapiens
tgttagcagagtctgtc

SEQ ID NO: 2251666 - DNA, 18 bp, Homo sapiens
tgttagcagagtctgtct

SEQ ID NO: 2251667 - DNA, 21 bp, Homo sapiens
tgttaggattttcacattctt

SEQ ID NO: 2251668 - DNA, 18 bp, Homo sapiens
tgttatttaacagctgaa

SEQ ID NO: 2251669 - DNA, 16 bp, Homo sapiens
tgttcaaatgcatttt

SEQ ID NO: 2251670 - DNA, 14 bp, Homo sapiens
tgttccagcagttt

SEQ ID NO: 2251671 - DNA, 18 bp, Homo sapiens
tgttccaggcatccatct

SEQ ID NO: 2251672 - DNA, 17 bp, Homo sapiens
tgttccccaaataattg

SEQ ID NO: 2251673 - DNA, 20 bp, Homo sapiens
tgttctccgggtgtggcctc

SEQ ID NO: 2251674 - DNA, 21 bp, Homo sapiens
ttaaaaaaattggttggagaa

SEQ ID NO: 2251675 - DNA, 19 bp, Homo sapiens
ttaaaaacataacataaat

SEQ ID NO: 2251676 - DNA, 14 bp, Homo sapiens
ttaaaagaaaaaat

SEQ ID NO: 2251677 - DNA, 16 bp, Homo sapiens
ttaaaagaaaaaatga

SEQ ID NO: 2251678 - DNA, 18 bp, Homo sapiens
ttaaaagaaaaaatgaca

SEQ ID NO: 2251679 - DNA, 15 bp, Homo sapiens
ttaaaatacttgttt

SEQ ID NO: 2251680 - DNA, 13 bp, Homo sapiens
ttaaacacctcct

SEQ ID NO: 2251681 - DNA, 16 bp, Homo sapiens
ttaaacacctcctcat

SEQ ID NO: 2251682 - DNA, 19 bp, Homo sapiens
ttaaactcttcacaaaatc

SEQ ID NO: 2251683 - DNA, 20 bp, Homo sapiens
ttaaagaatatgacttttta

SEQ ID NO: 2251684 - DNA, 13 bp, Homo sapiens
ttaaagtattctt

SEQ ID NO: 2251685 - DNA, 17 bp, Homo sapiens
ttaaagttgtttcccac

SEQ ID NO: 2251686 - DNA, 17 bp, Homo sapiens
ttaaattacaattttat

SEQ ID NO: 2251687 - DNA, 18 bp, Homo sapiens
ttaaattacaattttatc

SEQ ID NO: 2251688 - DNA, 14 bp, Homo sapiens
ttaaattagaaaat

SEQ ID NO: 2251689 - DNA, 17 bp, Homo sapiens
ttaaattagaaaatatt

SEQ ID NO: 2251690 - DNA, 23 bp, Homo sapiens
ttaacaatgcaacttttaattac

SEQ ID NO: 2251691 - DNA, 15 bp, Homo sapiens
ttaaccctttttcca

SEQ ID NO: 2251692 - DNA, 20 bp, Homo sapiens
ttaacctactaatagtttgt

SEQ ID NO: 2251693 - DNA, 21 bp, Homo sapiens
ttaactgcagttgactttctc

SEQ ID NO: 2251694 - DNA, 12 bp, Homo sapiens
ttaacttttaat

SEQ ID NO: 2251695 - DNA, 15 bp, Homo sapiens
ttaacttttaatggt

SEQ ID NO: 2251696 - DNA, 18 bp, Homo sapiens
ttaactttttatttctaa

SEQ ID NO: 2251697 - DNA, 20 bp, Homo sapiens
ttaactttttatttctaaat

SEQ ID NO: 2251698 - DNA, 16 bp, Homo sapiens
ttaagacgtgaatgtc

SEQ ID NO: 2251699 - DNA, 18 bp, Homo sapiens
ttaagactgattttaata

SEQ ID NO: 2251700 - DNA, 12 bp, Homo sapiens
ttaagatgtgaa

SEQ ID NO: 2251701 - DNA, 14 bp, Homo sapiens
ttaagatgtgaaaa

SEQ ID NO: 2251702 - DNA, 16 bp, Homo sapiens
ttaaggtctttcagta

SEQ ID NO: 2251703 - DNA, 17 bp, Homo sapiens
ttaagtgaaaatatagc

SEQ ID NO: 2251704 - DNA, 18 bp, Homo sapiens
ttaataaattggtaatat

SEQ ID NO: 2251705 - DNA, 18 bp, Homo sapiens
ttaataagatatttagta

SEQ ID NO: 2251706 - DNA, 16 bp, Homo sapiens
ttaataataaagctac

SEQ ID NO: 2251707 - DNA, 14 bp, Homo sapiens
ttaatatctttctg

SEQ ID NO: 2251708 - DNA, 16 bp, Homo sapiens
ttaatatctttctgca

SEQ ID NO: 2251709 - DNA, 14 bp, Homo sapiens
ttaatatgaaaact

SEQ ID NO: 2251710 - DNA, 16 bp, Homo sapiens
ttaatatgaaaactta

SEQ ID NO: 2251711 - DNA, 17 bp, Homo sapiens
ttaatcaagttgaattg

SEQ ID NO: 2251712 - DNA, 19 bp, Homo sapiens
ttaatcaccttctttgtaa

SEQ ID NO: 2251713 - DNA, 18 bp, Homo sapiens
ttaatcatagttactgtg

SEQ ID NO: 2251714 - DNA, 19 bp, Homo sapiens
ttaatcatagttactgtgt

SEQ ID NO: 2251715 - DNA, 15 bp, Homo sapiens
ttaatcattttcatt

SEQ ID NO: 2251716 - DNA, 21 bp, Homo sapiens
ttaatgatatgcttgtaacta

SEQ ID NO: 2251717 - DNA, 14 bp, Homo sapiens
ttaatgcactttct

SEQ ID NO: 2251718 - DNA, 14 bp, Homo sapiens
ttaatgctatttga

SEQ ID NO: 2251719 - DNA, 16 bp, Homo sapiens
ttaatgctatttgaac

SEQ ID NO: 2251720 - DNA, 21 bp, Homo sapiens
ttaatgctatttgaacaagtg

SEQ ID NO: 2251721 - DNA, 16 bp, Homo sapiens
ttaattatatgtatat

SEQ ID NO: 2251722 - DNA, 14 bp, Homo sapiens
ttaattattatttg

SEQ ID NO: 2251723 - DNA, 18 bp, Homo sapiens
ttaatttaaacacctcct

SEQ ID NO: 2251724 - DNA, 13 bp, Homo sapiens
ttaatttatttaa

SEQ ID NO: 2251725 - DNA, 14 bp, Homo sapiens
ttaatttatttaat

SEQ ID NO: 2251726 - DNA, 13 bp, Homo sapiens
ttaatttatttca

SEQ ID NO: 2251727 - DNA, 14 bp, Homo sapiens
ttaatttatttcat

SEQ ID NO: 2251728 - DNA, 17 bp, Homo sapiens
ttaatttttaatgatga

SEQ ID NO: 2251729 - DNA, 15 bp, Homo sapiens
ttaatttttgctttt

SEQ ID NO: 2251730 - DNA, 22 bp, Homo sapiens
ttaatttttgcttttagaaaag

SEQ ID NO: 2251731 - DNA, 21 bp, Homo sapiens
ttacataatttagttgtttct

SEQ ID NO: 2251732 - DNA, 23 bp, Homo sapiens
ttacatgctgctatacacaagca

SEQ ID NO: 2251733 - DNA, 15 bp, Homo sapiens
ttacatgtaatttga

SEQ ID NO: 2251734 - DNA, 17 bp, Homo sapiens
ttacatttaaacctttt

SEQ ID NO: 2251735 - DNA, 10 bp, Homo sapiens
ttaccaaagc

SEQ ID NO: 2251736 - DNA, 19 bp, Homo sapiens
ttaccaataggcaaattaa

SEQ ID NO: 2251737 - DNA, 17 bp, Homo sapiens
ttactaattatactact

SEQ ID NO: 2251738 - DNA, 14 bp, Homo sapiens
ttactatttaaaga

SEQ ID NO: 2251739 - DNA, 14 bp, Homo sapiens
ttactgtgtaaact

SEQ ID NO: 2251740 - DNA, 12 bp, Homo sapiens
ttacttgaactt

SEQ ID NO: 2251741 - DNA, 18 bp, Homo sapiens
ttacttgaactttccaaa

SEQ ID NO: 2251742 - DNA, 19 bp, Homo sapiens
ttagaaaatgttatttaac

SEQ ID NO: 2251743 - DNA, 18 bp, Homo sapiens
ttagaacattttaattca

SEQ ID NO: 2251744 - DNA, 22 bp, Homo sapiens
ttagaaccagccgtattttaca

SEQ ID NO: 2251745 - DNA, 19 bp, Homo sapiens
ttagcaataaataacactt

SEQ ID NO: 2251746 - DNA, 14 bp, Homo sapiens
ttagccttgctcag

SEQ ID NO: 2251747 - DNA, 19 bp, Homo sapiens
ttaggagggagttatctaa

SEQ ID NO: 2251748 - DNA, 16 bp, Homo sapiens
ttaggattttcacatt

SEQ ID NO: 2251749 - DNA, 14 bp, Homo sapiens
ttaggcctctgaga

SEQ ID NO: 2251750 - DNA, 17 bp, Homo sapiens
ttagggagaaaattcaa

SEQ ID NO: 2251751 - DNA, 21 bp, Homo sapiens
ttagtactgaagccaaatgaa

SEQ ID NO: 2251752 - DNA, 23 bp, Homo sapiens
ttagtactgaagccaaatgaaac

SEQ ID NO: 2251753 - DNA, 19 bp, Homo sapiens
ttagtcaatcactgcactg

SEQ ID NO: 2251754 - DNA, 14 bp, Homo sapiens
ttagtgaaaaactg

SEQ ID NO: 2251755 - DNA, 16 bp, Homo sapiens
ttagttccactgagac

SEQ ID NO: 2251756 - DNA, 23 bp, Homo sapiens
ttagttccccaaatacaaagtta

SEQ ID NO: 2251757 - DNA, 21 bp, Homo sapiens
ttagttgaatataagaaaatg

SEQ ID NO: 2251758 - DNA, 14 bp, Homo sapiens
ttataaaaagataa

SEQ ID NO: 2251759 - DNA, 13 bp, Homo sapiens
ttataaaaatatt

SEQ ID NO: 2251760 - DNA, 21 bp, Homo sapiens
ttataaaaatattaagacaat

SEQ ID NO: 2251761 - DNA, 20 bp, Homo sapiens
ttataaaatcctgtgcaata

SEQ ID NO: 2251762 - DNA, 20 bp, Homo sapiens
ttataataaatatatacatt

SEQ ID NO: 2251763 - DNA, 19 bp, Homo sapiens
ttatacaaattagaaaatg

SEQ ID NO: 2251764 - DNA, 21 bp, Homo sapiens
ttatacagttataaaattaaa

SEQ ID NO: 2251765 - DNA, 20 bp, Homo sapiens
ttatacagttgaaaacttgt

SEQ ID NO: 2251766 - DNA, 23 bp, Homo sapiens
ttatacatcaatttaaaaagcaa

SEQ ID NO: 2251767 - DNA, 21 bp, Homo sapiens
ttatatagggatcaaccagct

SEQ ID NO: 2251768 - DNA, 11 bp, Homo sapiens
ttatatattgt

SEQ ID NO: 2251769 - DNA, 13 bp, Homo sapiens
ttatatgtatatt

SEQ ID NO: 2251770 - DNA, 12 bp, Homo sapiens
ttatattgtcct

SEQ ID NO: 2251771 - DNA, 23 bp, Homo sapiens
ttatcaatgtgtctttctaagaa

SEQ ID NO: 2251772 - DNA, 13 bp, Homo sapiens
ttatcctctttgt

SEQ ID NO: 2251773 - DNA, 15 bp, Homo sapiens
ttatctaaaagaaat

SEQ ID NO: 2251774 - DNA, 17 bp, Homo sapiens
ttatctatacatatctt

SEQ ID NO: 2251775 - DNA, 19 bp, Homo sapiens
ttatctatacatatcttta

SEQ ID NO: 2251776 - DNA, 16 bp, Homo sapiens
ttatctatataaaata

SEQ ID NO: 2251777 - DNA, 12 bp, Homo sapiens
ttatctgtttcc

SEQ ID NO: 2251778 - DNA, 18 bp, Homo sapiens
ttatgacctcttccttta

SEQ ID NO: 2251779 - DNA, 22 bp, Homo sapiens
ttatgatagcaaatggcctcat

SEQ ID NO: 2251780 - DNA, 14 bp, Homo sapiens
ttatgcctttctct

SEQ ID NO: 2251781 - DNA, 17 bp, Homo sapiens
ttatgcctttctctcct

SEQ ID NO: 2251782 - DNA, 15 bp, Homo sapiens
ttatggaaaaataaa

SEQ ID NO: 2251783 - DNA, 16 bp, Homo sapiens
ttatggatgatttaag

SEQ ID NO: 2251784 - DNA, 17 bp, Homo sapiens
ttatgttcatttttcaa

SEQ ID NO: 2251785 - DNA, 13 bp, Homo sapiens
ttattaatcacta

SEQ ID NO: 2251786 - DNA, 22 bp, Homo sapiens
ttattaatgatcagctatatac

SEQ ID NO: 2251787 - DNA, 13 bp, Homo sapiens
ttattaatgcact

SEQ ID NO: 2251788 - DNA, 17 bp, Homo sapiens
ttattaatgcactttct

SEQ ID NO: 2251789 - DNA, 20 bp, Homo sapiens
ttattaccccctccttcaga

SEQ ID NO: 2251790 - DNA, 19 bp, Homo sapiens
ttattagggagaaaattca

SEQ ID NO: 2251791 - DNA, 20 bp, Homo sapiens
ttattagggagaaaattcaa

SEQ ID NO: 2251792 - DNA, 13 bp, Homo sapiens
ttattataaaaat

SEQ ID NO: 2251793 - DNA, 22 bp, Homo sapiens
ttattatttgtgttttaattta

SEQ ID NO: 2251794 - DNA, 22 bp, Homo sapiens
ttatttatccagaaaactgtga

SEQ ID NO: 2251795 - DNA, 21 bp, Homo sapiens
ttatttatgcgtaatttaatg

SEQ ID NO: 2251796 - DNA, 16 bp, Homo sapiens
ttatttctaaatgaga

SEQ ID NO: 2251797 - DNA, 15 bp, Homo sapiens
ttatttcttttactt

SEQ ID NO: 2251798 - DNA, 21 bp, Homo sapiens
ttatttttgttagcaaagatt

SEQ ID NO: 2251799 - DNA, 21 bp, Homo sapiens
ttcaaaccttggtatctgttg

SEQ ID NO: 2251800 - DNA, 13 bp, Homo sapiens
ttcaaagaaactt

SEQ ID NO: 2251801 - DNA, 19 bp, Homo sapiens
ttcaaaggccacatacctc

SEQ ID NO: 2251802 - DNA, 14 bp, Homo sapiens
ttcaaatgcatttt

SEQ ID NO: 2251803 - DNA, 23 bp, Homo sapiens
ttcaaatgggagactctttgaaa

SEQ ID NO: 2251804 - DNA, 20 bp, Homo sapiens
ttcaataaagcatttataaa

SEQ ID NO: 2251805 - DNA, 14 bp, Homo sapiens
ttcaatgtgtataa

SEQ ID NO: 2251806 - DNA, 21 bp, Homo sapiens
ttcaatgtgtataaattgtct

SEQ ID NO: 2251807 - DNA, 14 bp, Homo sapiens
ttcaattgtaaatt

SEQ ID NO: 2251808 - DNA, 17 bp, Homo sapiens
ttcacagtcccaggttt

SEQ ID NO: 2251809 - DNA, 14 bp, Homo sapiens
ttcacattattctg

SEQ ID NO: 2251810 - DNA, 16 bp, Homo sapiens
ttcagaagaaataaat

SEQ ID NO: 2251811 - DNA, 17 bp, Homo sapiens
ttcagagccagcctggc

SEQ ID NO: 2251812 - DNA, 12 bp, Homo sapiens
ttcagaggctca

SEQ ID NO: 2251813 - DNA, 20 bp, Homo sapiens
ttcagcagcaaattttcagc

SEQ ID NO: 2251814 - DNA, 22 bp, Homo sapiens
ttcaggaaatctacttcctaca

SEQ ID NO: 2251815 - DNA, 17 bp, Homo sapiens
ttcaggacaacacttca

SEQ ID NO: 2251816 - DNA, 14 bp, Homo sapiens
ttcagtactttttt

SEQ ID NO: 2251817 - DNA, 21 bp, Homo sapiens
ttcatattttaaacagaggat

SEQ ID NO: 2251818 - DNA, 19 bp, Homo sapiens
ttcatctcatttaagggaa

SEQ ID NO: 2251819 - DNA, 21 bp, Homo sapiens
ttcatgccagctacttcctcc

SEQ ID NO: 2251820 - DNA, 14 bp, Homo sapiens
ttcattcaaactgc

SEQ ID NO: 2251821 - DNA, 19 bp, Homo sapiens
ttcattgcactttgattag

SEQ ID NO: 2251822 - DNA, 18 bp, Homo sapiens
ttcatttgagaagtaaac

SEQ ID NO: 2251823 - DNA, 12 bp, Homo sapiens
ttcatttgcttt

SEQ ID NO: 2251824 - DNA, 16 bp, Homo sapiens
ttcatttgctttggaa

SEQ ID NO: 2251825 - DNA, 13 bp, Homo sapiens
ttccaaattattt

SEQ ID NO: 2251826 - DNA, 15 bp, Homo sapiens
ttccaataaactatg

SEQ ID NO: 2251827 - DNA, 18 bp, Homo sapiens
ttccaccccaagagaact

SEQ ID NO: 2251828 - DNA, 19 bp, Homo sapiens
ttccaccccaagagaactc

SEQ ID NO: 2251829 - DNA, 14 bp, Homo sapiens
ttccagctcctgta

SEQ ID NO: 2251830 - DNA, 18 bp, Homo sapiens
ttccagtgtccttagaac

SEQ ID NO: 2251831 - DNA, 14 bp, Homo sapiens
ttccatctctggta

SEQ ID NO: 2251832 - DNA, 15 bp, Homo sapiens
ttcccagtctgtcga

SEQ ID NO: 2251833 - DNA, 15 bp, Homo sapiens
ttcccctctgctgct

SEQ ID NO: 2251834 - DNA, 18 bp, Homo sapiens
ttcccctctgctgctgtc

SEQ ID NO: 2251835 - DNA, 14 bp, Homo sapiens
ttcccgtttctcca

SEQ ID NO: 2251836 - DNA, 15 bp, Homo sapiens
ttcccgtttctccac

SEQ ID NO: 2251837 - DNA, 17 bp, Homo sapiens
ttcccgtttctccacct

SEQ ID NO: 2251838 - DNA, 14 bp, Homo sapiens
ttccctctttggct

SEQ ID NO: 2251839 - DNA, 16 bp, Homo sapiens
ttccctctttggctcc

SEQ ID NO: 2251840 - DNA, 17 bp, Homo sapiens
ttccctgggccaacaga

SEQ ID NO: 2251841 - DNA, 22 bp, Homo sapiens
ttcccttcagtaccctctcagc

SEQ ID NO: 2251842 - DNA, 23 bp, Homo sapiens
ttcccttcagtaccctctcagct

SEQ ID NO: 2251843 - DNA, 15 bp, Homo sapiens
ttcctatcatgttaa

SEQ ID NO: 2251844 - DNA, 21 bp, Homo sapiens
ttcctcaacagtgttttcaga

SEQ ID NO: 2251845 - DNA, 18 bp, Homo sapiens
ttcctcaatcacactaca

SEQ ID NO: 2251846 - DNA, 19 bp, Homo sapiens
ttcctcatccaccccatcc

SEQ ID NO: 2251847 - DNA, 17 bp, Homo sapiens
ttcctctccctctctct

SEQ ID NO: 2251848 - DNA, 15 bp, Homo sapiens
ttcctgacattgtct

SEQ ID NO: 2251849 - DNA, 17 bp, Homo sapiens
ttcctgggtttcctgca

SEQ ID NO: 2251850 - DNA, 14 bp, Homo sapiens
ttcctgtatgttgt

SEQ ID NO: 2251851 - DNA, 23 bp, Homo sapiens
ttcctgtatgttgtacaatcaaa

SEQ ID NO: 2251852 - DNA, 15 bp, Homo sapiens
ttcgaagtcattaaa

SEQ ID NO: 2251853 - DNA, 18 bp, Homo sapiens
ttcgagtaaacttgaaaa

SEQ ID NO: 2251854 - DNA, 22 bp, Homo sapiens
ttcgtataatcttgtagacact

SEQ ID NO: 2251855 - DNA, 21 bp, Homo sapiens
ttctaaatgagacgaaatgct

SEQ ID NO: 2251856 - DNA, 16 bp, Homo sapiens
ttctacaatgtgaact

SEQ ID NO: 2251857 - DNA, 14 bp, Homo sapiens
ttctatcctctgta

SEQ ID NO: 2251858 - DNA, 15 bp, Homo sapiens
ttctatcctctgtaa

SEQ ID NO: 2251859 - DNA, 18 bp, Homo sapiens
ttctatgtttttttaatt

SEQ ID NO: 2251860 - DNA, 21 bp, Homo sapiens
ttctatgtttttttaattaaa

SEQ ID NO: 2251861 - DNA, 17 bp, Homo sapiens
ttctatttaattgaaac

SEQ ID NO: 2251862 - DNA, 13 bp, Homo sapiens
ttctcatcagtag

SEQ ID NO: 2251863 - DNA, 22 bp, Homo sapiens
ttctcatgacggcttttgtcag

SEQ ID NO: 2251864 - DNA, 18 bp, Homo sapiens
ttctccttttcctctctc

SEQ ID NO: 2251865 - DNA, 18 bp, Homo sapiens
ttctctctctctcttcct

SEQ ID NO: 2251866 - DNA, 13 bp, Homo sapiens
ttctctgaggaca

SEQ ID NO: 2251867 - DNA, 16 bp, Homo sapiens
ttctctgaggacaaga

SEQ ID NO: 2251868 - DNA, 15 bp, Homo sapiens
ttctctgctagattt

SEQ ID NO: 2251869 - DNA, 19 bp, Homo sapiens
ttctctgctagatttctac

SEQ ID NO: 2251870 - DNA, 16 bp, Homo sapiens
ttctgaattgtccttt

SEQ ID NO: 2251871 - DNA, 22 bp, Homo sapiens
ttctttgcaccaaagacatcag

SEQ ID NO: 2251872 - DNA, 18 bp, Homo sapiens
ttctttttttccttttta

SEQ ID NO: 2251873 - DNA, 19 bp, Homo sapiens
ttctttttttcctttttaa

SEQ ID NO: 2251874 - DNA, 17 bp, Homo sapiens
ttgaaaagcagacattt

SEQ ID NO: 2251875 - DNA, 16 bp, Homo sapiens
ttgaaataactggaac

SEQ ID NO: 2251876 - DNA, 21 bp, Homo sapiens
ttgaaataactggaacaaatt

SEQ ID NO: 2251877 - DNA, 19 bp, Homo sapiens
ttgaaatagttcaaactgc

SEQ ID NO: 2251878 - DNA, 17 bp, Homo sapiens
ttgaaatgaaagggaaa

SEQ ID NO: 2251879 - DNA, 21 bp, Homo sapiens
ttgaaatgacatgttccttta

SEQ ID NO: 2251880 - DNA, 15 bp, Homo sapiens
ttgaactttccaaaa

SEQ ID NO: 2251881 - DNA, 18 bp, Homo sapiens
ttgaactttccaaaacct

SEQ ID NO: 2251882 - DNA, 18 bp, Homo sapiens
ttgaagtctttaataaat

SEQ ID NO: 2251883 - DNA, 17 bp, Homo sapiens
ttgaatcgcttgcttgt

SEQ ID NO: 2251884 - DNA, 17 bp, Homo sapiens
ttgacacaagtggacct

SEQ ID NO: 2251885 - DNA, 22 bp, Homo sapiens
ttgagacacggagcccagccct

SEQ ID NO: 2251886 - DNA, 18 bp, Homo sapiens
ttgagagaagccacgctg

SEQ ID NO: 2251887 - DNA, 20 bp, Homo sapiens
ttgagctactggattcttat

SEQ ID NO: 2251888 - DNA, 16 bp, Homo sapiens
ttgaggagccccagct

SEQ ID NO: 2251889 - DNA, 15 bp, Homo sapiens
ttgaggggattaata

SEQ ID NO: 2251890 - DNA, 16 bp, Homo sapiens
ttgaggggattaatat

SEQ ID NO: 2251891 - DNA, 23 bp, Homo sapiens
ttgagtggggttatctctgtgtt

SEQ ID NO: 2251892 - DNA, 13 bp, Homo sapiens
ttgatacccccct

SEQ ID NO: 2251893 - DNA, 15 bp, Homo sapiens
ttgatacccccctct

SEQ ID NO: 2251894 - DNA, 21 bp, Homo sapiens
ttgatagaaaggaacacgttt

SEQ ID NO: 2251895 - DNA, 16 bp, Homo sapiens
ttgatcatgtactttt

SEQ ID NO: 2251896 - DNA, 16 bp, Homo sapiens
ttgatgcatgctattc

SEQ ID NO: 2251897 - DNA, 21 bp, Homo sapiens
ttgatggagtgtgagccacct

SEQ ID NO: 2251898 - DNA, 14 bp, Homo sapiens
ttgatgtaaagatg

SEQ ID NO: 2251899 - DNA, 13 bp, Homo sapiens
ttgattaaagatg

SEQ ID NO: 2251900 - DNA, 16 bp, Homo sapiens
ttgcactgtttaatca

SEQ ID NO: 2251901 - DNA, 20 bp, Homo sapiens
ttgcagtttatcattcaagt

SEQ ID NO: 2251902 - DNA, 23 bp, Homo sapiens
ttgcagtttatcattcaagtgta

SEQ ID NO: 2251903 - DNA, 14 bp, Homo sapiens
ttgcataatgcaat

SEQ ID NO: 2251904 - DNA, 19 bp, Homo sapiens
ttgcataatgcaatcaaaa

SEQ ID NO: 2251905 - DNA, 18 bp, Homo sapiens
ttgccaatagtgtcatcc

SEQ ID NO: 2251906 - DNA, 21 bp, Homo sapiens
ttgctatgtgccttatgttga

SEQ ID NO: 2251907 - DNA, 22 bp, Homo sapiens
ttgctgagcctctgctccccag

SEQ ID NO: 2251908 - DNA, 16 bp, Homo sapiens
ttgctgggaggactgg

SEQ ID NO: 2251909 - DNA, 11 bp, Homo sapiens
ttgctgtatat

SEQ ID NO: 2251910 - DNA, 17 bp, Homo sapiens
ttgctttggaagtttta

SEQ ID NO: 2251911 - DNA, 20 bp, Homo sapiens
ttgctttgtattgtatatta

SEQ ID NO: 2251912 - DNA, 13 bp, Homo sapiens
ttgcttttagaaa

SEQ ID NO: 2251913 - DNA, 16 bp, Homo sapiens
ttggatttttgactct

SEQ ID NO: 2251914 - DNA, 13 bp, Homo sapiens
ttggcaggcccac

SEQ ID NO: 2251915 - DNA, 14 bp, Homo sapiens
ttggcaggcccact

SEQ ID NO: 2251916 - DNA, 13 bp, Homo sapiens
ttggctcagacat

SEQ ID NO: 2251917 - DNA, 14 bp, Homo sapiens
ttggctcagacatg

SEQ ID NO: 2251918 - DNA, 16 bp, Homo sapiens
ttggctggtagcagca

SEQ ID NO: 2251919 - DNA, 16 bp, Homo sapiens
ttggcttaatcatttt

SEQ ID NO: 2251920 - DNA, 23 bp, Homo sapiens
ttgggcagccagaccagcaggct

SEQ ID NO: 2251921 - DNA, 20 bp, Homo sapiens
ttggggggccgggcaggtcc

SEQ ID NO: 2251922 - DNA, 15 bp, Homo sapiens
ttggtgactgtccca

SEQ ID NO: 2251923 - DNA, 21 bp, Homo sapiens
ttggtgctttttataaaaaga

SEQ ID NO: 2251924 - DNA, 20 bp, Homo sapiens
ttgtaaaagcattttgtaat

SEQ ID NO: 2251925 - DNA, 18 bp, Homo sapiens
ttgtaaataggattttta

SEQ ID NO: 2251926 - DNA, 23 bp, Homo sapiens
ttgtaactaaaataattttgtaa

SEQ ID NO: 2251927 - DNA, 15 bp, Homo sapiens
ttgtaacttcaaata

SEQ ID NO: 2251928 - DNA, 15 bp, Homo sapiens
ttgtaataataaaga

SEQ ID NO: 2251929 - DNA, 16 bp, Homo sapiens
ttgtaatttaatgaaa

SEQ ID NO: 2251930 - DNA, 15 bp, Homo sapiens
ttgtacgttatatat

SEQ ID NO: 2251931 - DNA, 15 bp, Homo sapiens
ttgtagacacttact

SEQ ID NO: 2251932 - DNA, 16 bp, Homo sapiens
ttgtagacacttactt

SEQ ID NO: 2251933 - DNA, 19 bp, Homo sapiens
ttgtaggtgagatgcaaca

SEQ ID NO: 2251934 - DNA, 17 bp, Homo sapiens
ttgtattatttttgtag

SEQ ID NO: 2251935 - DNA, 18 bp, Homo sapiens
ttgtattgtatattacaa

SEQ ID NO: 2251936 - DNA, 15 bp, Homo sapiens
ttgtcacttttcctt

SEQ ID NO: 2251937 - DNA, 16 bp, Homo sapiens
ttgtccgctgggtggt

SEQ ID NO: 2251938 - DNA, 15 bp, Homo sapiens
ttgtcctttcccttc

SEQ ID NO: 2251939 - DNA, 21 bp, Homo sapiens
ttgtgaaggattatggaaaaa

SEQ ID NO: 2251940 - DNA, 21 bp, Homo sapiens
ttgtgatagcactttctacaa

SEQ ID NO: 2251941 - DNA, 18 bp, Homo sapiens
ttgtgtaagaaatacaga

SEQ ID NO: 2251942 - DNA, 19 bp, Homo sapiens
ttgtgtgtcttaattatta

SEQ ID NO: 2251943 - DNA, 15 bp, Homo sapiens
ttgttaatacaaggt

SEQ ID NO: 2251944 - DNA, 18 bp, Homo sapiens
ttgttaatacaaggtata

SEQ ID NO: 2251945 - DNA, 15 bp, Homo sapiens
ttgttcaaatgcatt

SEQ ID NO: 2251946 - DNA, 23 bp, Homo sapiens
ttgttccttggagaaatgaaaac

SEQ ID NO: 2251947 - DNA, 22 bp, Homo sapiens
ttgttcgccgcgtggaatgtga

SEQ ID NO: 2251948 - DNA, 23 bp, Homo sapiens
ttgttctccgggtgtggcctcag

SEQ ID NO: 2251949 - DNA, 23 bp, Homo sapiens
ttgttctgtattcgaaatgagct

SEQ ID NO: 2251950 - DNA, 19 bp, Homo sapiens
ttgttttaacctcccctct

SEQ ID NO: 2251951 - DNA, 16 bp, Homo sapiens
ttgttttagaaccagc

SEQ ID NO: 2251952 - DNA, 14 bp, Homo sapiens
tttaaaaactgttt

SEQ ID NO: 2251953 - DNA, 14 bp, Homo sapiens
tttaaaatacttgt

SEQ ID NO: 2251954 - DNA, 15 bp, Homo sapiens
tttaaataaaagcac

SEQ ID NO: 2251955 - DNA, 19 bp, Homo sapiens
tttaaataaaagcacaagt

SEQ ID NO: 2251956 - DNA, 17 bp, Homo sapiens
tttaaatattttctatt

SEQ ID NO: 2251957 - DNA, 19 bp, Homo sapiens
tttaaatattttctatttt

SEQ ID NO: 2251958 - DNA, 13 bp, Homo sapiens
tttaaattacaat

SEQ ID NO: 2251959 - DNA, 19 bp, Homo sapiens
tttaacaatttattctgat

SEQ ID NO: 2251960 - DNA, 20 bp, Homo sapiens
tttaacagctgaattatcta

SEQ ID NO: 2251961 - DNA, 17 bp, Homo sapiens
tttaacctcccctctcc

SEQ ID NO: 2251962 - DNA, 22 bp, Homo sapiens
tttaactgcagttgactttctc

SEQ ID NO: 2251963 - DNA, 13 bp, Homo sapiens
tttaactttttat

SEQ ID NO: 2251964 - DNA, 13 bp, Homo sapiens
tttaagatgtgaa

SEQ ID NO: 2251965 - DNA, 12 bp, Homo sapiens
aaaaaaatacaa

SEQ ID NO: 2251966 - DNA, 13 bp, Homo sapiens
aaaaaatactatt

SEQ ID NO: 2251967 - DNA, 22 bp, Homo sapiens
aaaaaatctctcagagccctca

SEQ ID NO: 2251968 - DNA, 13 bp, Homo sapiens
aaaaactgctgta

SEQ ID NO: 2251969 - DNA, 15 bp, Homo sapiens
aaaaagaaaaaaaga

SEQ ID NO: 2251970 - DNA, 14 bp, Homo sapiens
aaaaataaaactgt

SEQ ID NO: 2251971 - DNA, 14 bp, Homo sapiens
aaaaataaacacta

SEQ ID NO: 2251972 - DNA, 18 bp, Homo sapiens
aaaaatactatttaagat

SEQ ID NO: 2251973 - DNA, 18 bp, Homo sapiens
aaaaatgtccagccaccc

SEQ ID NO: 2251974 - DNA, 16 bp, Homo sapiens
aaaaattactgtgaat

SEQ ID NO: 2251975 - DNA, 23 bp, Homo sapiens
aaaaatttgtctgaaacatttca

SEQ ID NO: 2251976 - DNA, 12 bp, Homo sapiens
aaaacaaaattt

SEQ ID NO: 2251977 - DNA, 18 bp, Homo sapiens
aaaacagctagtagacat

SEQ ID NO: 2251978 - DNA, 23 bp, Homo sapiens
aaaacagggccacatagatgctg

SEQ ID NO: 2251979 - DNA, 17 bp, Homo sapiens
aaaacagtgtgtaaaca

SEQ ID NO: 2251980 - DNA, 15 bp, Homo sapiens
aaaacataacataaa

SEQ ID NO: 2251981 - DNA, 15 bp, Homo sapiens
aaaactgtgcatctc

SEQ ID NO: 2251982 - DNA, 21 bp, Homo sapiens
aaaagaagaagagatgacaaa

SEQ ID NO: 2251983 - DNA, 21 bp, Homo sapiens
aaaagacatttgatagaaagg

SEQ ID NO: 2251984 - DNA, 14 bp, Homo sapiens
aaaagatgaatttg

SEQ ID NO: 2251985 - DNA, 14 bp, Homo sapiens
aaaagattttaatc

SEQ ID NO: 2251986 - DNA, 15 bp, Homo sapiens
aaaagattttaatca

SEQ ID NO: 2251987 - DNA, 15 bp, Homo sapiens
aaaagcaatattgta

SEQ ID NO: 2251988 - DNA, 19 bp, Homo sapiens
aaaagcacaagtacttttg

SEQ ID NO: 2251989 - DNA, 13 bp, Homo sapiens
aaaagcagacatt

SEQ ID NO: 2251990 - DNA, 15 bp, Homo sapiens
aaaagcattttgtaa

SEQ ID NO: 2251991 - DNA, 16 bp, Homo sapiens
aaaagcattttgtaat

SEQ ID NO: 2251992 - DNA, 14 bp, Homo sapiens
agggcattgctcag

SEQ ID NO: 2251993 - DNA, 22 bp, Homo sapiens
aggggaattccctccccctcct

SEQ ID NO: 2251994 - DNA, 21 bp, Homo sapiens
aggggaccaattctggacaga

SEQ ID NO: 2251995 - DNA, 16 bp, Homo sapiens
aggggagttgtgtctg

SEQ ID NO: 2251996 - DNA, 18 bp, Homo sapiens
aggggatttttatgtctg

SEQ ID NO: 2251997 - DNA, 21 bp, Homo sapiens
aggggctggggacttgtgtct

SEQ ID NO: 2251998 - DNA, 17 bp, Homo sapiens
agggggccctgccccac

SEQ ID NO: 2251999 - DNA, 13 bp, Homo sapiens
aggggggggtggg

SEQ ID NO: 2252000 - DNA, 14 bp, Homo sapiens
aggggggggtgggg

SEQ ID NO: 2252001 - DNA, 22 bp, Homo sapiens
agggtattaagaattaagagga

SEQ ID NO: 2252002 - DNA, 17 bp, Homo sapiens
agggtcggaacccaagc

SEQ ID NO: 2252003 - DNA, 21 bp, Homo sapiens
agggtctttctcaaagaaata

SEQ ID NO: 2252004 - DNA, 14 bp, Homo sapiens
agggtgctgactgg

SEQ ID NO: 2252005 - DNA, 19 bp, Homo sapiens
aggtaaagggcaaataatg

SEQ ID NO: 2252006 - DNA, 17 bp, Homo sapiens
aggtaactatcaatatt

SEQ ID NO: 2252007 - DNA, 16 bp, Homo sapiens
aggtcaagttgtcagg

SEQ ID NO: 2252008 - DNA, 17 bp, Homo sapiens
aggtcaagttgtcaggt

SEQ ID NO: 2252009 - DNA, 19 bp, Homo sapiens
aggtcaagttgtcaggtta

SEQ ID NO: 2252010 - DNA, 21 bp, Homo sapiens
aggtccctccgcggctggagc

SEQ ID NO: 2252011 - DNA, 15 bp, Homo sapiens
aggtcctgcccatgt

SEQ ID NO: 2252012 - DNA, 17 bp, Homo sapiens
aggtcctgcccatgtgt

SEQ ID NO: 2252013 - DNA, 20 bp, Homo sapiens
aggtcctgcccatgtgtccc

SEQ ID NO: 2252014 - DNA, 13 bp, Homo sapiens
aggtcttaggaat

SEQ ID NO: 2252015 - DNA, 18 bp, Homo sapiens
aggtctttcagtactttt

SEQ ID NO: 2252016 - DNA, 20 bp, Homo sapiens
aggtgaaactccagatgcca

SEQ ID NO: 2252017 - DNA, 23 bp, Homo sapiens
aggtgattctaatcatctgcagt

SEQ ID NO: 2252018 - DNA, 18 bp, Homo sapiens
aggtgcctgtcccacccc

SEQ ID NO: 2252019 - DNA, 16 bp, Homo sapiens
aggttatgttcatttt

SEQ ID NO: 2252020 - DNA, 20 bp, Homo sapiens
aggttatgttcatttttcaa

SEQ ID NO: 2252021 - DNA, 17 bp, Homo sapiens
aggtttagtgaaaaact

SEQ ID NO: 2252022 - DNA, 19 bp, Homo sapiens
aggtttattgttaatacaa

SEQ ID NO: 2252023 - DNA, 15 bp, Homo sapiens
aggtttttattagta

SEQ ID NO: 2252024 - DNA, 20 bp, Homo sapiens
agtaaaattatcctctttgt

SEQ ID NO: 2252025 - DNA, 19 bp, Homo sapiens
agtaaacgggaacatgccc

SEQ ID NO: 2252026 - DNA, 22 bp, Homo sapiens
agtaagattgatatctataaaa

SEQ ID NO: 2252027 - DNA, 13 bp, Homo sapiens
agtaatacaaact

SEQ ID NO: 2252028 - DNA, 19 bp, Homo sapiens
agtaattgggaaaaaagca

SEQ ID NO: 2252029 - DNA, 21 bp, Homo sapiens
agtaatttctttttttccttt

SEQ ID NO: 2252030 - DNA, 13 bp, Homo sapiens
agtacagtgtgtg

SEQ ID NO: 2252031 - DNA, 19 bp, Homo sapiens
agtaccatagtaccattta

SEQ ID NO: 2252032 - DNA, 21 bp, Homo sapiens
agtaccatagtaccatttata

SEQ ID NO: 2252033 - DNA, 12 bp, Homo sapiens
agtaccatttaa

SEQ ID NO: 2252034 - DNA, 14 bp, Homo sapiens
agtaccatttatac

SEQ ID NO: 2252035 - DNA, 16 bp, Homo sapiens
agtaccctctcagctc

SEQ ID NO: 2252036 - DNA, 19 bp, Homo sapiens
agtaccctctcagctccag

SEQ ID NO: 2252037 - DNA, 21 bp, Homo sapiens
agtacctagctggctctgtga

SEQ ID NO: 2252038 - DNA, 12 bp, Homo sapiens
agtatacctcat

SEQ ID NO: 2252039 - DNA, 16 bp, Homo sapiens
agtatacctcattttt

SEQ ID NO: 2252040 - DNA, 18 bp, Homo sapiens
agtattggggtctgaccc

SEQ ID NO: 2252041 - DNA, 16 bp, Homo sapiens
agtattgtcaccagga

SEQ ID NO: 2252042 - DNA, 18 bp, Homo sapiens
agtcaaaactatttttgt

SEQ ID NO: 2252043 - DNA, 20 bp, Homo sapiens
agtcaaaactatttttgtaa

SEQ ID NO: 2252044 - DNA, 13 bp, Homo sapiens
agtcaaaacttta

SEQ ID NO: 2252045 - DNA, 20 bp, Homo sapiens
agtcaaagttgaaaattcat

SEQ ID NO: 2252046 - DNA, 22 bp, Homo sapiens
agtcaaattaataatcttatta

SEQ ID NO: 2252047 - DNA, 14 bp, Homo sapiens
agtcaatcactgca

SEQ ID NO: 2252048 - DNA, 23 bp, Homo sapiens
agtcatatcttaatatatttcta

SEQ ID NO: 2252049 - DNA, 14 bp, Homo sapiens
agtccacaggggcc

SEQ ID NO: 2252050 - DNA, 17 bp, Homo sapiens
agtccacaggggccacc

SEQ ID NO: 2252051 - DNA, 20 bp, Homo sapiens
agtccacaggggccaccacc

SEQ ID NO: 2252052 - DNA, 19 bp, Homo sapiens
agtctagtacttattacat

SEQ ID NO: 2252053 - DNA, 20 bp, Homo sapiens
agtctcagtttgtgtgtctt

SEQ ID NO: 2252054 - DNA, 15 bp, Homo sapiens
agtctgagtaagaaa

SEQ ID NO: 2252055 - DNA, 19 bp, Homo sapiens
agtctgtacctcaaatgaa

SEQ ID NO: 2252056 - DNA, 19 bp, Homo sapiens
agtctgtctcttggctttg

SEQ ID NO: 2252057 - DNA, 22 bp, Homo sapiens
agtcttacataaaccatttttg

SEQ ID NO: 2252058 - DNA, 19 bp, Homo sapiens
agtcttgaaatgaaaggga

SEQ ID NO: 2252059 - DNA, 20 bp, Homo sapiens
agtcttgaaatgaaagggaa

SEQ ID NO: 2252060 - DNA, 13 bp, Homo sapiens
agtctttaataaa

SEQ ID NO: 2252061 - DNA, 14 bp, Homo sapiens
agtctttaataaat

SEQ ID NO: 2252062 - DNA, 17 bp, Homo sapiens
agtctttgccagtcatt

SEQ ID NO: 2252063 - DNA, 22 bp, Homo sapiens
agtctttgccagtcattcagca

SEQ ID NO: 2252064 - DNA, 14 bp, Homo sapiens
agtgaaaaactgct

SEQ ID NO: 2252065 - DNA, 16 bp, Homo sapiens
agtgaaaactttgtag

SEQ ID NO: 2252066 - DNA, 15 bp, Homo sapiens
agtgaacctgtataa

SEQ ID NO: 2252067 - DNA, 19 bp, Homo sapiens
agtgaccacttattctgta

SEQ ID NO: 2252068 - DNA, 18 bp, Homo sapiens
agtgagtgtgctgacttt

SEQ ID NO: 2252069 - DNA, 21 bp, Homo sapiens
agtgagtgtgctgacttttta

SEQ ID NO: 2252070 - DNA, 16 bp, Homo sapiens
agtgatcaagaagact

SEQ ID NO: 2252071 - DNA, 15 bp, Homo sapiens
agtgatgtcatttga

SEQ ID NO: 2252072 - DNA, 14 bp, Homo sapiens
agtgcaatgcgtgt

SEQ ID NO: 2252073 - DNA, 22 bp, Homo sapiens
agtgcactgcattcctgtgccc

SEQ ID NO: 2252074 - DNA, 19 bp, Homo sapiens
agtgcagtggcacaatctt

SEQ ID NO: 2252075 - DNA, 17 bp, Homo sapiens
agtggaccttaggcctt

SEQ ID NO: 2252076 - DNA, 13 bp, Homo sapiens
agtggaggctggc

SEQ ID NO: 2252077 - DNA, 21 bp, Homo sapiens
agtggaggctggcagggtccc

SEQ ID NO: 2252078 - DNA, 22 bp, Homo sapiens
agtggcatttctatgcaggcag

SEQ ID NO: 2252079 - DNA, 14 bp, Homo sapiens
agtgtaaaatattt

SEQ ID NO: 2252080 - DNA, 18 bp, Homo sapiens
agtgtaaaatattttgaa

SEQ ID NO: 2252081 - DNA, 21 bp, Homo sapiens
agtgtaaaatattttgaatca

SEQ ID NO: 2252082 - DNA, 16 bp, Homo sapiens
agtgtacagattttat

SEQ ID NO: 2252083 - DNA, 18 bp, Homo sapiens
agtgtacagccagaccag

SEQ ID NO: 2252084 - DNA, 16 bp, Homo sapiens
agtgtattatcactgt

SEQ ID NO: 2252085 - DNA, 23 bp, Homo sapiens
agtgtcagaaggagctacaaaac

SEQ ID NO: 2252086 - DNA, 18 bp, Homo sapiens
agtgtgctgactttttaa

SEQ ID NO: 2252087 - DNA, 12 bp, Homo sapiens
agtgtgtaaaca

SEQ ID NO: 2252088 - DNA, 17 bp, Homo sapiens
agtgttggaaaaaattt

SEQ ID NO: 2252089 - DNA, 17 bp, Homo sapiens
agtgttttcagaagaaa

SEQ ID NO: 2252090 - DNA, 18 bp, Homo sapiens
agtgttttcagaagaaat

SEQ ID NO: 2252091 - DNA, 15 bp, Homo sapiens
agtgtttttgtgaat

SEQ ID NO: 2252092 - DNA, 15 bp, Homo sapiens
agttaatgtatataa

SEQ ID NO: 2252093 - DNA, 19 bp, Homo sapiens
agttaatgtatataaaaat

SEQ ID NO: 2252094 - DNA, 13 bp, Homo sapiens
agttacactttta

SEQ ID NO: 2252095 - DNA, 16 bp, Homo sapiens
agttactaggtaactt

SEQ ID NO: 2252096 - DNA, 18 bp, Homo sapiens
agttactaggtaacttca

SEQ ID NO: 2252097 - DNA, 19 bp, Homo sapiens
agttactaggtaacttcat

SEQ ID NO: 2252098 - DNA, 16 bp, Homo sapiens
agttactgtgtaaact

SEQ ID NO: 2252099 - DNA, 14 bp, Homo sapiens
agttataaaattaa

SEQ ID NO: 2252100 - DNA, 12 bp, Homo sapiens
caacagtcttgc

SEQ ID NO: 2252101 - DNA, 17 bp, Homo sapiens
caaccagctaagaaaag

SEQ ID NO: 2252102 - DNA, 16 bp, Homo sapiens
caacctcttctggctc

SEQ ID NO: 2252103 - DNA, 15 bp, Homo sapiens
caacctggtggcacc

SEQ ID NO: 2252104 - DNA, 18 bp, Homo sapiens
caacctggtggcaccaga

SEQ ID NO: 2252105 - DNA, 22 bp, Homo sapiens
caacctggtggcaccagatgca

SEQ ID NO: 2252106 - DNA, 15 bp, Homo sapiens
caaccttcaaagaaa

SEQ ID NO: 2252107 - DNA, 16 bp, Homo sapiens
caaccttcaaagaaac

SEQ ID NO: 2252108 - DNA, 22 bp, Homo sapiens
caacttctgcctcccatgctta

SEQ ID NO: 2252109 - DNA, 20 bp, Homo sapiens
caacttgtatccaggcctgg

SEQ ID NO: 2252110 - DNA, 19 bp, Homo sapiens
caactttagtatttttact

SEQ ID NO: 2252111 - DNA, 19 bp, Homo sapiens
caagaagaagggcacccta

SEQ ID NO: 2252112 - DNA, 18 bp, Homo sapiens
caagaatatcctttaaaa

SEQ ID NO: 2252113 - DNA, 23 bp, Homo sapiens
caagacggaggaggggaaggggc

SEQ ID NO: 2252114 - DNA, 17 bp, Homo sapiens
caagacgtttaactgca

SEQ ID NO: 2252115 - DNA, 24 bp, Homo sapiens
caagagaactcgcgctcagtaaac

SEQ ID NO: 2252116 - DNA, 21 bp, Homo sapiens
caagagcatgcacatgctgtc

SEQ ID NO: 2252117 - DNA, 20 bp, Homo sapiens
caagagtctaatagtctttg

SEQ ID NO: 2252118 - DNA, 19 bp, Homo sapiens
caagattttttttgtaact

SEQ ID NO: 2252119 - DNA, 13 bp, Homo sapiens
caagcaatgcaag

SEQ ID NO: 2252120 - DNA, 16 bp, Homo sapiens
caagccaaagagcctc

SEQ ID NO: 2252121 - DNA, 13 bp, Homo sapiens
caagccagccaac

SEQ ID NO: 2252122 - DNA, 21 bp, Homo sapiens
caagctaggtgctatttgtca

SEQ ID NO: 2252123 - DNA, 21 bp, Homo sapiens
caagctgcgggctccctggca

SEQ ID NO: 2252124 - DNA, 16 bp, Homo sapiens
caaggaatcagcagga

SEQ ID NO: 2252125 - DNA, 24 bp, Homo sapiens
caaggcacttcatgtaaagtgtca

SEQ ID NO: 2252126 - DNA, 9 bp, Homo sapiens
caaggtata

SEQ ID NO: 2252127 - DNA, 15 bp, Homo sapiens
caagtaatacaaact

SEQ ID NO: 2252128 - DNA, 14 bp, Homo sapiens
caagtcaaattaat

SEQ ID NO: 2252129 - DNA, 15 bp, Homo sapiens
caagtcaaattaata

SEQ ID NO: 2252130 - DNA, 13 bp, Homo sapiens
caagtgaaattat

SEQ ID NO: 2252131 - DNA, 22 bp, Homo sapiens
caagtggaccttaggccttcct

SEQ ID NO: 2252132 - DNA, 21 bp, Homo sapiens
caagtgtaaaatattttgaat

SEQ ID NO: 2252133 - DNA, 22 bp, Homo sapiens
caagtgtgtgccaccatgcctc

SEQ ID NO: 2252134 - DNA, 15 bp, Homo sapiens
caataaacagctccc

SEQ ID NO: 2252135 - DNA, 15 bp, Homo sapiens
caataaaccctcaga

SEQ ID NO: 2252136 - DNA, 15 bp, Homo sapiens
caataaagcatttat

SEQ ID NO: 2252137 - DNA, 11 bp, Homo sapiens
caatactacct

SEQ ID NO: 2252138 - DNA, 23 bp, Homo sapiens
caatactacctctgaatgttaca

SEQ ID NO: 2252139 - DNA, 17 bp, Homo sapiens
caataggcaaattaatc

SEQ ID NO: 2252140 - DNA, 15 bp, Homo sapiens
caatcaaaacacact

SEQ ID NO: 2252141 - DNA, 13 bp, Homo sapiens
caatcacactaca

SEQ ID NO: 2252142 - DNA, 16 bp, Homo sapiens
caatcactgcactgca

SEQ ID NO: 2252143 - DNA, 20 bp, Homo sapiens
caatccctttattaccccct

SEQ ID NO: 2252144 - DNA, 12 bp, Homo sapiens
caatctctctct

SEQ ID NO: 2252145 - DNA, 16 bp, Homo sapiens
caatctctctctgtgt

SEQ ID NO: 2252146 - DNA, 23 bp, Homo sapiens
caatgacacccatgccagagagg

SEQ ID NO: 2252147 - DNA, 20 bp, Homo sapiens
caatgatcaccgactgaaaa

SEQ ID NO: 2252148 - DNA, 14 bp, Homo sapiens
caatgcaactttta

SEQ ID NO: 2252149 - DNA, 16 bp, Homo sapiens
caatgctgatttggtg

SEQ ID NO: 2252150 - DNA, 21 bp, Homo sapiens
caatgctgatttggtgaccaa

SEQ ID NO: 2252151 - DNA, 12 bp, Homo sapiens
caatgtgaaaaa

SEQ ID NO: 2252152 - DNA, 14 bp, Homo sapiens
caatgtgaacttta

SEQ ID NO: 2252153 - DNA, 18 bp, Homo sapiens
caatgtgaactttattaa

SEQ ID NO: 2252154 - DNA, 20 bp, Homo sapiens
caatgtggtgacacctcccc

SEQ ID NO: 2252155 - DNA, 20 bp, Homo sapiens
caattgggagctgccaagag

SEQ ID NO: 2252156 - DNA, 21 bp, Homo sapiens
caattgggagctgccaagagt

SEQ ID NO: 2252157 - DNA, 14 bp, Homo sapiens
caattgtaaattga

SEQ ID NO: 2252158 - DNA, 23 bp, Homo sapiens
caatttaagtgttggaaaaaatt

SEQ ID NO: 2252159 - DNA, 15 bp, Homo sapiens
caatttattctgata

SEQ ID NO: 2252160 - DNA, 18 bp, Homo sapiens
caatttttatttctttta

SEQ ID NO: 2252161 - DNA, 21 bp, Homo sapiens
caattttttaagtgaaaatat

SEQ ID NO: 2252162 - DNA, 14 bp, Homo sapiens
cacaaatattattt

SEQ ID NO: 2252163 - DNA, 17 bp, Homo sapiens
cacaaatgcagtatata

SEQ ID NO: 2252164 - DNA, 19 bp, Homo sapiens
cacaaatgtgatttttgta

SEQ ID NO: 2252165 - DNA, 16 bp, Homo sapiens
cacacaagaagaaggg

SEQ ID NO: 2252166 - DNA, 13 bp, Homo sapiens
cacacagcagccc

SEQ ID NO: 2252167 - DNA, 21 bp, Homo sapiens
cacacagcagccccccagcac

SEQ ID NO: 2252168 - DNA, 13 bp, Homo sapiens
cacaccagagaac

SEQ ID NO: 2252169 - DNA, 13 bp, Homo sapiens
cacacccaatgct

SEQ ID NO: 2252170 - DNA, 14 bp, Homo sapiens
cacacccatttaaa

SEQ ID NO: 2252171 - DNA, 15 bp, Homo sapiens
cacacctgggcattt

SEQ ID NO: 2252172 - DNA, 14 bp, Homo sapiens
cacactactacctc

SEQ ID NO: 2252173 - DNA, 19 bp, Homo sapiens
cacacttagccattgaaat

SEQ ID NO: 2252174 - DNA, 18 bp, Homo sapiens
cacagactgggaacccct

SEQ ID NO: 2252175 - DNA, 13 bp, Homo sapiens
cacagagaggagg

SEQ ID NO: 2252176 - DNA, 15 bp, Homo sapiens
cacagaggacacaga

SEQ ID NO: 2252177 - DNA, 23 bp, Homo sapiens
cacagaggtagtctcactgcttg

SEQ ID NO: 2252178 - DNA, 17 bp, Homo sapiens
cacagcaatatttaaca

SEQ ID NO: 2252179 - DNA, 12 bp, Homo sapiens
cacagcagcccc

SEQ ID NO: 2252180 - DNA, 20 bp, Homo sapiens
cacagcagccccccagcact

SEQ ID NO: 2252181 - DNA, 22 bp, Homo sapiens
cacagctaagatgccatgtgca

SEQ ID NO: 2252182 - DNA, 15 bp, Homo sapiens
cacagctcctcccac

SEQ ID NO: 2252183 - DNA, 14 bp, Homo sapiens
cacagctgagaggc

SEQ ID NO: 2252184 - DNA, 13 bp, Homo sapiens
cacaggccccctt

SEQ ID NO: 2252185 - DNA, 21 bp, Homo sapiens
cacaggcccccttgagtgggg

SEQ ID NO: 2252186 - DNA, 22 bp, Homo sapiens
cacaggcccccttgagtggggt

SEQ ID NO: 2252187 - DNA, 23 bp, Homo sapiens
cacaggggccaccacctttggct

SEQ ID NO: 2252188 - DNA, 15 bp, Homo sapiens
cacagtaaaaataaa

SEQ ID NO: 2252189 - DNA, 14 bp, Homo sapiens
cacatatcagcagg

SEQ ID NO: 2252190 - DNA, 15 bp, Homo sapiens
cacatatccaggcac

SEQ ID NO: 2252191 - DNA, 19 bp, Homo sapiens
cacatcacacccatttaaa

SEQ ID NO: 2252192 - DNA, 12 bp, Homo sapiens
cacatcttccct

SEQ ID NO: 2252193 - DNA, 15 bp, Homo sapiens
cacatgccactatga

SEQ ID NO: 2252194 - DNA, 22 bp, Homo sapiens
cacattcttggcttaatcattt

SEQ ID NO: 2252195 - DNA, 14 bp, Homo sapiens
cacatttttttcta

SEQ ID NO: 2252196 - DNA, 14 bp, Homo sapiens
caccaaagacatca

SEQ ID NO: 2252197 - DNA, 16 bp, Homo sapiens
caccactaccagccag

SEQ ID NO: 2252198 - DNA, 12 bp, Homo sapiens
caccatctcttc

SEQ ID NO: 2252199 - DNA, 13 bp, Homo sapiens
caccatctcttca

SEQ ID NO: 2252200 - DNA, 12 bp, Homo sapiens
caccatctttta

SEQ ID NO: 2252201 - DNA, 17 bp, Homo sapiens
cacccaatgctgctcca

SEQ ID NO: 2252202 - DNA, 14 bp, Homo sapiens
cacccatgccagag

SEQ ID NO: 2252203 - DNA, 12 bp, Homo sapiens
cacccatttaaa

SEQ ID NO: 2252204 - DNA, 13 bp, Homo sapiens
caccccaccaggg

SEQ ID NO: 2252205 - DNA, 12 bp, Homo sapiens
cacccccagccc

SEQ ID NO: 2252206 - DNA, 13 bp, Homo sapiens
cacccccagcccc

SEQ ID NO: 2252207 - DNA, 21 bp, Homo sapiens
cacccccagccccgactccag

SEQ ID NO: 2252208 - DNA, 15 bp, Homo sapiens
cacccccaggcatct

SEQ ID NO: 2252209 - DNA, 21 bp, Homo sapiens
cattgctgagcctctgctccc

SEQ ID NO: 2252210 - DNA, 15 bp, Homo sapiens
cattgtaaaagcatt

SEQ ID NO: 2252211 - DNA, 22 bp, Homo sapiens
cattgtaaaagcattttgtaat

SEQ ID NO: 2252212 - DNA, 23 bp, Homo sapiens
cattgtaaaagcattttgtaata

SEQ ID NO: 2252213 - DNA, 21 bp, Homo sapiens
catttaaaacattaaaatata

SEQ ID NO: 2252214 - DNA, 20 bp, Homo sapiens
catttaagctgtggtcaagg

SEQ ID NO: 2252215 - DNA, 17 bp, Homo sapiens
catttaaggaaactaga

SEQ ID NO: 2252216 - DNA, 18 bp, Homo sapiens
catttatacaaattagaa

SEQ ID NO: 2252217 - DNA, 17 bp, Homo sapiens
catttatttatccagaa

SEQ ID NO: 2252218 - DNA, 22 bp, Homo sapiens
catttcataatttgtttccagc

SEQ ID NO: 2252219 - DNA, 15 bp, Homo sapiens
catttcatacaacag

SEQ ID NO: 2252220 - DNA, 16 bp, Homo sapiens
catttcatacaacaga

SEQ ID NO: 2252221 - DNA, 15 bp, Homo sapiens
catttcatctcattt

SEQ ID NO: 2252222 - DNA, 19 bp, Homo sapiens
catttgacccttgctgtga

SEQ ID NO: 2252223 - DNA, 16 bp, Homo sapiens
catttgatgcatgtct

SEQ ID NO: 2252224 - DNA, 22 bp, Homo sapiens
catttgatgcatgtcttttaaa

SEQ ID NO: 2252225 - DNA, 14 bp, Homo sapiens
catttgctttggaa

SEQ ID NO: 2252226 - DNA, 15 bp, Homo sapiens
catttgctttggaag

SEQ ID NO: 2252227 - DNA, 21 bp, Homo sapiens
catttggtgagagtcaaagct

SEQ ID NO: 2252228 - DNA, 15 bp, Homo sapiens
catttgttttttcaa

SEQ ID NO: 2252229 - DNA, 23 bp, Homo sapiens
cattttaaaagcaattatattgt

SEQ ID NO: 2252230 - DNA, 14 bp, Homo sapiens
cattttaattcatc

SEQ ID NO: 2252231 - DNA, 17 bp, Homo sapiens
catttttcaaaaaggga

SEQ ID NO: 2252232 - DNA, 23 bp, Homo sapiens
catttttttctacctataacact

SEQ ID NO: 2252233 - DNA, 18 bp, Homo sapiens
ccaaaacaagccaaagag

SEQ ID NO: 2252234 - DNA, 19 bp, Homo sapiens
ccaaaacaagccaaagagc

SEQ ID NO: 2252235 - DNA, 19 bp, Homo sapiens
ccaaacaccttccagctcc

SEQ ID NO: 2252236 - DNA, 14 bp, Homo sapiens
ccaaacaggacagc

SEQ ID NO: 2252237 - DNA, 16 bp, Homo sapiens
ccaaaccaggaccctg

SEQ ID NO: 2252238 - DNA, 12 bp, Homo sapiens
ccaaagaggctg

SEQ ID NO: 2252239 - DNA, 17 bp, Homo sapiens
ccaaagaggctgcccct

SEQ ID NO: 2252240 - DNA, 21 bp, Homo sapiens
ccaaagaggctgcccctctca

SEQ ID NO: 2252241 - DNA, 22 bp, Homo sapiens
ccaaagaggctgcccctctcac

SEQ ID NO: 2252242 - DNA, 18 bp, Homo sapiens
ccaaaggagctatggaga

SEQ ID NO: 2252243 - DNA, 19 bp, Homo sapiens
ccaaattatttcttaatta

SEQ ID NO: 2252244 - DNA, 23 bp, Homo sapiens
ccaaattttaatttttgctttta

SEQ ID NO: 2252245 - DNA, 21 bp, Homo sapiens
ccaacatgtttctgttttgtt

SEQ ID NO: 2252246 - DNA, 14 bp, Homo sapiens
ccaaccttcaaaga

SEQ ID NO: 2252247 - DNA, 15 bp, Homo sapiens
ccaacctttccctca

SEQ ID NO: 2252248 - DNA, 20 bp, Homo sapiens
ccaacctttccctcaccccc

SEQ ID NO: 2252249 - DNA, 15 bp, Homo sapiens
ccaacggcaacagca

SEQ ID NO: 2252250 - DNA, 20 bp, Homo sapiens
ccaacgttcgatttctacct

SEQ ID NO: 2252251 - DNA, 17 bp, Homo sapiens
ccaagacggaggagggg

SEQ ID NO: 2252252 - DNA, 19 bp, Homo sapiens
ccaagacggaggaggggaa

SEQ ID NO: 2252253 - DNA, 20 bp, Homo sapiens
ccaagacggaggaggggaag

SEQ ID NO: 2252254 - DNA, 22 bp, Homo sapiens
ccaagacggaggaggggaaggg

SEQ ID NO: 2252255 - DNA, 17 bp, Homo sapiens
ccaagtctgtacctcaa

SEQ ID NO: 2252256 - DNA, 20 bp, Homo sapiens
ccaatattttctttaatgct

SEQ ID NO: 2252257 - DNA, 22 bp, Homo sapiens
ccaatattttctttaatgcttt

SEQ ID NO: 2252258 - DNA, 23 bp, Homo sapiens
ccaatgacacccatgccagagag

SEQ ID NO: 2252259 - DNA, 20 bp, Homo sapiens
ccaatgctgctccaccctcc

SEQ ID NO: 2252260 - DNA, 17 bp, Homo sapiens
ccaattctggacagaca

SEQ ID NO: 2252261 - DNA, 17 bp, Homo sapiens
ccacacccaatgctgct

SEQ ID NO: 2252262 - DNA, 19 bp, Homo sapiens
ccacaccctgtactgttct

SEQ ID NO: 2252263 - DNA, 23 bp, Homo sapiens
ccacaccctgtactgttctgtgt

SEQ ID NO: 2252264 - DNA, 18 bp, Homo sapiens
ccacaggagggccagcgc

SEQ ID NO: 2252265 - DNA, 22 bp, Homo sapiens
ccacatccccaataaagccgcg

SEQ ID NO: 2252266 - DNA, 12 bp, Homo sapiens
ccaccccaggac

SEQ ID NO: 2252267 - DNA, 16 bp, Homo sapiens
ccaccccatccagcca

SEQ ID NO: 2252268 - DNA, 13 bp, Homo sapiens
ccacccccagccc

SEQ ID NO: 2252269 - DNA, 16 bp, Homo sapiens
ccacccccagctcaat

SEQ ID NO: 2252270 - DNA, 15 bp, Homo sapiens
ccaccccctcctccc

SEQ ID NO: 2252271 - DNA, 16 bp, Homo sapiens
ccaccgggagcctccc

SEQ ID NO: 2252272 - DNA, 17 bp, Homo sapiens
ccaccgggagcctcccc

SEQ ID NO: 2252273 - DNA, 19 bp, Homo sapiens
ccacctgctagtgtgaatt

SEQ ID NO: 2252274 - DNA, 15 bp, Homo sapiens
ccacgcctcctggcc

SEQ ID NO: 2252275 - DNA, 17 bp, Homo sapiens
ccacgcctcctggccag

SEQ ID NO: 2252276 - DNA, 19 bp, Homo sapiens
ccacgcctcctggccagac

SEQ ID NO: 2252277 - DNA, 12 bp, Homo sapiens
ccactaccagcc

SEQ ID NO: 2252278 - DNA, 13 bp, Homo sapiens
ccactaccagcca

SEQ ID NO: 2252279 - DNA, 17 bp, Homo sapiens
ccactaccagccagcct

SEQ ID NO: 2252280 - DNA, 13 bp, Homo sapiens
ccactcatttcat

SEQ ID NO: 2252281 - DNA, 15 bp, Homo sapiens
ccactccccagcccc

SEQ ID NO: 2252282 - DNA, 15 bp, Homo sapiens
ccactggctgctaac

SEQ ID NO: 2252283 - DNA, 10 bp, Homo sapiens
ccacttgtat

SEQ ID NO: 2252284 - DNA, 19 bp, Homo sapiens
ccagaactcactggggcct

SEQ ID NO: 2252285 - DNA, 15 bp, Homo sapiens
ccagaataagttatt

SEQ ID NO: 2252286 - DNA, 22 bp, Homo sapiens
ccagaataagttattgcagttt

SEQ ID NO: 2252287 - DNA, 15 bp, Homo sapiens
ccagaccagattaaa

SEQ ID NO: 2252288 - DNA, 17 bp, Homo sapiens
ccagacttcaaaaggaa

SEQ ID NO: 2252289 - DNA, 16 bp, Homo sapiens
ccagagccgggaggaa

SEQ ID NO: 2252290 - DNA, 23 bp, Homo sapiens
ccagatgtttccagacttccttg

SEQ ID NO: 2252291 - DNA, 17 bp, Homo sapiens
ccagatttattttaaac

SEQ ID NO: 2252292 - DNA, 19 bp, Homo sapiens
ccagcaccctctcctgggg

SEQ ID NO: 2252293 - DNA, 14 bp, Homo sapiens
ccagccagcctcag

SEQ ID NO: 2252294 - DNA, 14 bp, Homo sapiens
ccagccccgactcc

SEQ ID NO: 2252295 - DNA, 22 bp, Homo sapiens
ccagccccgactccagccagcg

SEQ ID NO: 2252296 - DNA, 12 bp, Homo sapiens
ccagccccttcc

SEQ ID NO: 2252297 - DNA, 14 bp, Homo sapiens
ccagccctgctggg

SEQ ID NO: 2252298 - DNA, 22 bp, Homo sapiens
ccagccctgctggggatccccg

SEQ ID NO: 2252299 - DNA, 14 bp, Homo sapiens
ccagccgccctggg

SEQ ID NO: 2252300 - DNA, 16 bp, Homo sapiens
ccagccgccctgggct

SEQ ID NO: 2252301 - DNA, 17 bp, Homo sapiens
ccagccgccctgggctg

SEQ ID NO: 2252302 - DNA, 13 bp, Homo sapiens
ccagcctccaggg

SEQ ID NO: 2252303 - DNA, 21 bp, Homo sapiens
ccagcctggctctgccccctc

SEQ ID NO: 2252304 - DNA, 19 bp, Homo sapiens
ccagcgcctccctccaccc

SEQ ID NO: 2252305 - DNA, 21 bp, Homo sapiens
ccagcgcctccctccacccca

SEQ ID NO: 2252306 - DNA, 21 bp, Homo sapiens
ccagcgtgagtggtggaggag

SEQ ID NO: 2252307 - DNA, 22 bp, Homo sapiens
ccagctaccctttttctccagc

SEQ ID NO: 2252308 - DNA, 15 bp, Homo sapiens
ccagctacttcctcc

SEQ ID NO: 2252309 - DNA, 17 bp, Homo sapiens
ccagctacttcctcctc

SEQ ID NO: 2252310 - DNA, 15 bp, Homo sapiens
ccagctatctgtcat

SEQ ID NO: 2252311 - DNA, 17 bp, Homo sapiens
ccagctcaatggactgg

SEQ ID NO: 2252312 - DNA, 18 bp, Homo sapiens
ccagctgcttcagggagg

SEQ ID NO: 2252313 - DNA, 16 bp, Homo sapiens
ccagctgggctctgca

SEQ ID NO: 2252314 - DNA, 18 bp, Homo sapiens
ccagctgtgaagagactc

SEQ ID NO: 2252315 - DNA, 15 bp, Homo sapiens
ccaggacgccactca

SEQ ID NO: 2252316 - DNA, 13 bp, Homo sapiens
ccaggagcctcac

SEQ ID NO: 2252317 - DNA, 13 bp, Homo sapiens
ctaggagggagac

SEQ ID NO: 2252318 - DNA, 18 bp, Homo sapiens
ctaggagggagacactgg

SEQ ID NO: 2252319 - DNA, 22 bp, Homo sapiens
ctaggagggagacactggcccc

SEQ ID NO: 2252320 - DNA, 18 bp, Homo sapiens
ctagtaattgggaaaaaa

SEQ ID NO: 2252321 - DNA, 22 bp, Homo sapiens
ctagtgctccatagtttggcat

SEQ ID NO: 2252322 - DNA, 20 bp, Homo sapiens
ctagtgtattatcactgtct

SEQ ID NO: 2252323 - DNA, 21 bp, Homo sapiens
ctataaaatagatataaattt

SEQ ID NO: 2252324 - DNA, 16 bp, Homo sapiens
ctataaggcagccttg

SEQ ID NO: 2252325 - DNA, 14 bp, Homo sapiens
ctataagttttaga

SEQ ID NO: 2252326 - DNA, 19 bp, Homo sapiens
ctataagttttagaatctt

SEQ ID NO: 2252327 - DNA, 15 bp, Homo sapiens
ctatacatatcttta

SEQ ID NO: 2252328 - DNA, 16 bp, Homo sapiens
ctatagttatacatca

SEQ ID NO: 2252329 - DNA, 14 bp, Homo sapiens
ctatataaaataac

SEQ ID NO: 2252330 - DNA, 14 bp, Homo sapiens
ctatatatttctat

SEQ ID NO: 2252331 - DNA, 15 bp, Homo sapiens
ctatcaacaataaaa

SEQ ID NO: 2252332 - DNA, 13 bp, Homo sapiens
ctatcaatattta

SEQ ID NO: 2252333 - DNA, 12 bp, Homo sapiens
ctatcctctgta

SEQ ID NO: 2252334 - DNA, 17 bp, Homo sapiens
ctatcctgcgggtttta

SEQ ID NO: 2252335 - DNA, 12 bp, Homo sapiens
ctatccttggct

SEQ ID NO: 2252336 - DNA, 21 bp, Homo sapiens
ctatctcctaactttggacct

SEQ ID NO: 2252337 - DNA, 17 bp, Homo sapiens
ctatgattgtactttga

SEQ ID NO: 2252338 - DNA, 18 bp, Homo sapiens
ctatggagagaattaaaa

SEQ ID NO: 2252339 - DNA, 22 bp, Homo sapiens
ctatggtatgctggccagcacc

SEQ ID NO: 2252340 - DNA, 13 bp, Homo sapiens
ctatgtataaaat

SEQ ID NO: 2252341 - DNA, 14 bp, Homo sapiens
ctatgtatttttct

SEQ ID NO: 2252342 - DNA, 14 bp, Homo sapiens
ctatgtgtttttct

SEQ ID NO: 2252343 - DNA, 17 bp, Homo sapiens
ctatgtgtttttctcat

SEQ ID NO: 2252344 - DNA, 19 bp, Homo sapiens
ctattaaggtgatatattt

SEQ ID NO: 2252345 - DNA, 23 bp, Homo sapiens
ctattaaggtgatatatttaaaa

SEQ ID NO: 2252346 - DNA, 16 bp, Homo sapiens
ctattcacaattattc

SEQ ID NO: 2252347 - DNA, 17 bp, Homo sapiens
ctattcacaattattcc

SEQ ID NO: 2252348 - DNA, 19 bp, Homo sapiens
ctattcagtggcgagaaat

SEQ ID NO: 2252349 - DNA, 15 bp, Homo sapiens
ctatttaattgaaac

SEQ ID NO: 2252350 - DNA, 12 bp, Homo sapiens
ctatttatatac

SEQ ID NO: 2252351 - DNA, 14 bp, Homo sapiens
ctatttgaacaagt

SEQ ID NO: 2252352 - DNA, 11 bp, Homo sapiens
ctattttaaga

SEQ ID NO: 2252353 - DNA, 15 bp, Homo sapiens
ctcaaaaccatctct

SEQ ID NO: 2252354 - DNA, 18 bp, Homo sapiens
ctcaacctcttctggctc

SEQ ID NO: 2252355 - DNA, 20 bp, Homo sapiens
ctcaactattctgttccaca

SEQ ID NO: 2252356 - DNA, 21 bp, Homo sapiens
ctcaagatactgctactgtaa

SEQ ID NO: 2252357 - DNA, 22 bp, Homo sapiens
ctcaagcagcgaccgccccctc

SEQ ID NO: 2252358 - DNA, 19 bp, Homo sapiens
ctcaatactacctctgaat

SEQ ID NO: 2252359 - DNA, 20 bp, Homo sapiens
ctcaatggactggaagggga

SEQ ID NO: 2252360 - DNA, 22 bp, Homo sapiens
ctcacagtgaacactcagtggc

SEQ ID NO: 2252361 - DNA, 17 bp, Homo sapiens
ctcaccactaccagcca

SEQ ID NO: 2252362 - DNA, 19 bp, Homo sapiens
ctcaccactaccagccagc

SEQ ID NO: 2252363 - DNA, 23 bp, Homo sapiens
ctcaccccctcccacccccagcc

SEQ ID NO: 2252364 - DNA, 19 bp, Homo sapiens
ctcactaaagcatgaaatg

SEQ ID NO: 2252365 - DNA, 22 bp, Homo sapiens
ctcactatggtatgctggccag

SEQ ID NO: 2252366 - DNA, 18 bp, Homo sapiens
ctcactggggcctacagc

SEQ ID NO: 2252367 - DNA, 14 bp, Homo sapiens
ctcactgttgtgaa

SEQ ID NO: 2252368 - DNA, 19 bp, Homo sapiens
ctcactgtttgtttttatt

SEQ ID NO: 2252369 - DNA, 13 bp, Homo sapiens
ctcagagccctca

SEQ ID NO: 2252370 - DNA, 19 bp, Homo sapiens
ctcagatgttaaaataaat

SEQ ID NO: 2252371 - DNA, 15 bp, Homo sapiens
ctcagattgtaatat

SEQ ID NO: 2252372 - DNA, 17 bp, Homo sapiens
ctcagatttctgaggaa

SEQ ID NO: 2252373 - DNA, 13 bp, Homo sapiens
ctcagcccgcttg

SEQ ID NO: 2252374 - DNA, 13 bp, Homo sapiens
ctcagccctcaga

SEQ ID NO: 2252375 - DNA, 15 bp, Homo sapiens
ctcagcctctgccag

SEQ ID NO: 2252376 - DNA, 19 bp, Homo sapiens
ctcagctgtcaaggctcag

SEQ ID NO: 2252377 - DNA, 14 bp, Homo sapiens
ctcaggcagctcaa

SEQ ID NO: 2252378 - DNA, 20 bp, Homo sapiens
ctcagtaaacgggaacatgc

SEQ ID NO: 2252379 - DNA, 21 bp, Homo sapiens
ctcagtaaacgggaacatgcc

SEQ ID NO: 2252380 - DNA, 17 bp, Homo sapiens
ctcagtacccagaacag

SEQ ID NO: 2252381 - DNA, 16 bp, Homo sapiens
ctcagtgcatttgtgc

SEQ ID NO: 2252382 - DNA, 17 bp, Homo sapiens
ctcagtgcatttgtgct

SEQ ID NO: 2252383 - DNA, 22 bp, Homo sapiens
ctcagtgggttaacatcagttt

SEQ ID NO: 2252384 - DNA, 23 bp, Homo sapiens
ctcagttattacatgtaatttga

SEQ ID NO: 2252385 - DNA, 17 bp, Homo sapiens
ctcataaaaagcaaaac

SEQ ID NO: 2252386 - DNA, 18 bp, Homo sapiens
ctcatagacactgatctg

SEQ ID NO: 2252387 - DNA, 12 bp, Homo sapiens
ctcatcagtagt

SEQ ID NO: 2252388 - DNA, 19 bp, Homo sapiens
ctcatctgaaatgttacaa

SEQ ID NO: 2252389 - DNA, 21 bp, Homo sapiens
ctcatctgaaatgttacaaaa

SEQ ID NO: 2252390 - DNA, 14 bp, Homo sapiens
ctcatggcccctct

SEQ ID NO: 2252391 - DNA, 15 bp, Homo sapiens
ctcatggcccctctg

SEQ ID NO: 2252392 - DNA, 16 bp, Homo sapiens
ctcatgtacataccct

SEQ ID NO: 2252393 - DNA, 16 bp, Homo sapiens
ctcattgctgagcctc

SEQ ID NO: 2252394 - DNA, 12 bp, Homo sapiens
ctcattggccag

SEQ ID NO: 2252395 - DNA, 18 bp, Homo sapiens
ctcatttaagggaaaaat

SEQ ID NO: 2252396 - DNA, 15 bp, Homo sapiens
ctcatttcatctcat

SEQ ID NO: 2252397 - DNA, 14 bp, Homo sapiens
ctcatttttcatac

SEQ ID NO: 2252398 - DNA, 21 bp, Homo sapiens
ctccaaaaaaaaaaaaaatac

SEQ ID NO: 2252399 - DNA, 23 bp, Homo sapiens
ctccaaaaaaaaaaaaaatacaa

SEQ ID NO: 2252400 - DNA, 17 bp, Homo sapiens
ctccaagtctgtacctc

SEQ ID NO: 2252401 - DNA, 14 bp, Homo sapiens
ctccacagagagga

SEQ ID NO: 2252402 - DNA, 16 bp, Homo sapiens
ctccacagagaggagg

SEQ ID NO: 2252403 - DNA, 13 bp, Homo sapiens
ctccaccccagga

SEQ ID NO: 2252404 - DNA, 14 bp, Homo sapiens
ctccaccccaggac

SEQ ID NO: 2252405 - DNA, 15 bp, Homo sapiens
ctccacctagactgt

SEQ ID NO: 2252406 - DNA, 17 bp, Homo sapiens
ctccacgcagctggcag

SEQ ID NO: 2252407 - DNA, 20 bp, Homo sapiens
ctccacgcagctggcagaga

SEQ ID NO: 2252408 - DNA, 15 bp, Homo sapiens
ctccacgcctcctgg

SEQ ID NO: 2252409 - DNA, 15 bp, Homo sapiens
ctccacttgtatata

SEQ ID NO: 2252410 - DNA, 23 bp, Homo sapiens
ctccacttgtatatatggatcag

SEQ ID NO: 2252411 - DNA, 16 bp, Homo sapiens
ctccagcaaagctccc

SEQ ID NO: 2252412 - DNA, 17 bp, Homo sapiens
ctccagcaaagctcccg

SEQ ID NO: 2252413 - DNA, 11 bp, Homo sapiens
ctccagccagc

SEQ ID NO: 2252414 - DNA, 12 bp, Homo sapiens
ctccagccagcg

SEQ ID NO: 2252415 - DNA, 15 bp, Homo sapiens
ctccagccagcgcct

SEQ ID NO: 2252416 - DNA, 19 bp, Homo sapiens
ctccagccagcgcctccct

SEQ ID NO: 2252417 - DNA, 15 bp, Homo sapiens
ctccagctgggctct

SEQ ID NO: 2252418 - DNA, 15 bp, Homo sapiens
ctccagggcattgct

SEQ ID NO: 2252419 - DNA, 16 bp, Homo sapiens
ctccagggcattgctc

SEQ ID NO: 2252420 - DNA, 20 bp, Homo sapiens
ctccatagtttggcatttgc

SEQ ID NO: 2252421 - DNA, 13 bp, Homo sapiens
ctcccaccagagc

SEQ ID NO: 2252422 - DNA, 16 bp, Homo sapiens
ctcccaggaagcccag

SEQ ID NO: 2252423 - DNA, 15 bp, Homo sapiens
ctccccagcctggca

SEQ ID NO: 2252424 - DNA, 17 bp, Homo sapiens
ctccccagcctggcaca

SEQ ID NO: 2252425 - DNA, 21 bp, Homo sapiens
ctccccatgtgtcctggttcc

SEQ ID NO: 2252426 - DNA, 17 bp, Homo sapiens
cttcatgtaaagtgtca

SEQ ID NO: 2252427 - DNA, 12 bp, Homo sapiens
cttccagctcct

SEQ ID NO: 2252428 - DNA, 15 bp, Homo sapiens
cttcccatcgctgtc

SEQ ID NO: 2252429 - DNA, 13 bp, Homo sapiens
cttccccttctgt

SEQ ID NO: 2252430 - DNA, 11 bp, Homo sapiens
cttccctccaa

SEQ ID NO: 2252431 - DNA, 18 bp, Homo sapiens
cttcctcatccaccccat

SEQ ID NO: 2252432 - DNA, 18 bp, Homo sapiens
cttccttgagacacggag

SEQ ID NO: 2252433 - DNA, 23 bp, Homo sapiens
cttccttgagacacggagcccag

SEQ ID NO: 2252434 - DNA, 14 bp, Homo sapiens
cttcggacaaaata

SEQ ID NO: 2252435 - DNA, 15 bp, Homo sapiens
cttcggacaaaatat

SEQ ID NO: 2252436 - DNA, 20 bp, Homo sapiens
cttctatttatggatatcac

SEQ ID NO: 2252437 - DNA, 13 bp, Homo sapiens
cttctcacggcga

SEQ ID NO: 2252438 - DNA, 14 bp, Homo sapiens
cttctcagatttct

SEQ ID NO: 2252439 - DNA, 17 bp, Homo sapiens
cttctccaccgcacaga

SEQ ID NO: 2252440 - DNA, 18 bp, Homo sapiens
cttctgccttagtctcag

SEQ ID NO: 2252441 - DNA, 21 bp, Homo sapiens
cttctggggcaggctgggcca

SEQ ID NO: 2252442 - DNA, 12 bp, Homo sapiens
cttctttgtaat

SEQ ID NO: 2252443 - DNA, 14 bp, Homo sapiens
cttcttttgattat

SEQ ID NO: 2252444 - DNA, 13 bp, Homo sapiens
cttgaaatgaaag

SEQ ID NO: 2252445 - DNA, 13 bp, Homo sapiens
cttgaactttcca

SEQ ID NO: 2252446 - DNA, 14 bp, Homo sapiens
cttgaactttccaa

SEQ ID NO: 2252447 - DNA, 15 bp, Homo sapiens
cttgaactttccaaa

SEQ ID NO: 2252448 - DNA, 16 bp, Homo sapiens
cttgaagctttgtagg

SEQ ID NO: 2252449 - DNA, 13 bp, Homo sapiens
cttgagaaccttt

SEQ ID NO: 2252450 - DNA, 18 bp, Homo sapiens
cttgagaaccttttcaaa

SEQ ID NO: 2252451 - DNA, 21 bp, Homo sapiens
cttgagccacagtcactggat

SEQ ID NO: 2252452 - DNA, 22 bp, Homo sapiens
cttgagtggggttatctctgtg

SEQ ID NO: 2252453 - DNA, 19 bp, Homo sapiens
cttgagttcaccatctctt

SEQ ID NO: 2252454 - DNA, 18 bp, Homo sapiens
cttgatacccccctctgt

SEQ ID NO: 2252455 - DNA, 21 bp, Homo sapiens
cttgatgatttttaacttttt

SEQ ID NO: 2252456 - DNA, 20 bp, Homo sapiens
cttgcaaagacctacctcca

SEQ ID NO: 2252457 - DNA, 22 bp, Homo sapiens
cttgcaaagacctacctccaga

SEQ ID NO: 2252458 - DNA, 13 bp, Homo sapiens
cttgcatgcttgc

SEQ ID NO: 2252459 - DNA, 14 bp, Homo sapiens
cttgcctctgcaca

SEQ ID NO: 2252460 - DNA, 24 bp, Homo sapiens
cttgcctctgcacaccctccagag

SEQ ID NO: 2252461 - DNA, 13 bp, Homo sapiens
cttgctggcccca

SEQ ID NO: 2252462 - DNA, 14 bp, Homo sapiens
cttgctggccccag

SEQ ID NO: 2252463 - DNA, 16 bp, Homo sapiens
cttgctggccccagcc

SEQ ID NO: 2252464 - DNA, 21 bp, Homo sapiens
cttgctggccccagccctgct

SEQ ID NO: 2252465 - DNA, 22 bp, Homo sapiens
cttgctggccccagccctgctg

SEQ ID NO: 2252466 - DNA, 15 bp, Homo sapiens
cttgctgtgaattaa

SEQ ID NO: 2252467 - DNA, 23 bp, Homo sapiens
cttggctttcagagccagcctgg

SEQ ID NO: 2252468 - DNA, 17 bp, Homo sapiens
cttgtagaaacgaagcc

SEQ ID NO: 2252469 - DNA, 23 bp, Homo sapiens
cttgtattaaactcttcacaaaa

SEQ ID NO: 2252470 - DNA, 15 bp, Homo sapiens
cttgtcctttccctt

SEQ ID NO: 2252471 - DNA, 18 bp, Homo sapiens
cttgttgaaaatatttct

SEQ ID NO: 2252472 - DNA, 19 bp, Homo sapiens
cttgttgtctccacttgta

SEQ ID NO: 2252473 - DNA, 22 bp, Homo sapiens
cttgttgtctccacttgtatat

SEQ ID NO: 2252474 - DNA, 13 bp, Homo sapiens
cttgtttcagctt

SEQ ID NO: 2252475 - DNA, 13 bp, Homo sapiens
ctttaaaaactgt

SEQ ID NO: 2252476 - DNA, 17 bp, Homo sapiens
ctttaaggagatggact

SEQ ID NO: 2252477 - DNA, 21 bp, Homo sapiens
ctttaatgatatgcttgtaac

SEQ ID NO: 2252478 - DNA, 12 bp, Homo sapiens
ctttaatgcttt

SEQ ID NO: 2252479 - DNA, 21 bp, Homo sapiens
ctttaggagggagttatctaa

SEQ ID NO: 2252480 - DNA, 18 bp, Homo sapiens
ctttaggtttttttaatg

SEQ ID NO: 2252481 - DNA, 20 bp, Homo sapiens
ctttaggtttttttaatgat

SEQ ID NO: 2252482 - DNA, 14 bp, Homo sapiens
ctttatcaatgtgt

SEQ ID NO: 2252483 - DNA, 20 bp, Homo sapiens
ctttattaatcactattgtt

SEQ ID NO: 2252484 - DNA, 22 bp, Homo sapiens
ctttattaccccctccttcaga

SEQ ID NO: 2252485 - DNA, 20 bp, Homo sapiens
ctttatttgaacaatgaagt

SEQ ID NO: 2252486 - DNA, 22 bp, Homo sapiens
ctttattttgagatgtaaaaag

SEQ ID NO: 2252487 - DNA, 15 bp, Homo sapiens
ctttcacagctcctc

SEQ ID NO: 2252488 - DNA, 19 bp, Homo sapiens
ctttcagagccagcctggc

SEQ ID NO: 2252489 - DNA, 21 bp, Homo sapiens
ctttcagagccagcctggctc

SEQ ID NO: 2252490 - DNA, 22 bp, Homo sapiens
ctttcagagccagcctggctct

SEQ ID NO: 2252491 - DNA, 23 bp, Homo sapiens
ctttcatattttaaacagaggat

SEQ ID NO: 2252492 - DNA, 13 bp, Homo sapiens
ctttccaaattat

SEQ ID NO: 2252493 - DNA, 11 bp, Homo sapiens
ctttccctcac

SEQ ID NO: 2252494 - DNA, 18 bp, Homo sapiens
ctttccctcaccccctcc

SEQ ID NO: 2252495 - DNA, 19 bp, Homo sapiens
ctttccctcaccccctccc

SEQ ID NO: 2252496 - DNA, 19 bp, Homo sapiens
ctttcctgcatctctgtga

SEQ ID NO: 2252497 - DNA, 16 bp, Homo sapiens
ctttctaagaaatcaa

SEQ ID NO: 2252498 - DNA, 17 bp, Homo sapiens
ctttctagatgtctctg

SEQ ID NO: 2252499 - DNA, 17 bp, Homo sapiens
ctttctatcctctgtaa

SEQ ID NO: 2252500 - DNA, 17 bp, Homo sapiens
ctttctctctctctctt

SEQ ID NO: 2252501 - DNA, 16 bp, Homo sapiens
ctttctgcacacaaat

SEQ ID NO: 2252502 - DNA, 18 bp, Homo sapiens
ctttctttgcaccaaaga

SEQ ID NO: 2252503 - DNA, 16 bp, Homo sapiens
ctttgaaggggcctca

SEQ ID NO: 2252504 - DNA, 21 bp, Homo sapiens
ctttgacaattgggagctgcc

SEQ ID NO: 2252505 - DNA, 22 bp, Homo sapiens
ctttgacaattgggagctgcca

SEQ ID NO: 2252506 - DNA, 17 bp, Homo sapiens
ctttgcaccaaagacat

SEQ ID NO: 2252507 - DNA, 18 bp, Homo sapiens
ctttgcaccaaagacatc

SEQ ID NO: 2252508 - DNA, 14 bp, Homo sapiens
ctttggagtcccct

SEQ ID NO: 2252509 - DNA, 22 bp, Homo sapiens
ctttggagtcccctcacctcct

SEQ ID NO: 2252510 - DNA, 15 bp, Homo sapiens
ctttggctcccctgt

SEQ ID NO: 2252511 - DNA, 21 bp, Homo sapiens
ctttggctggtagcagcaggc

SEQ ID NO: 2252512 - DNA, 14 bp, Homo sapiens
ctttggttctggcc

SEQ ID NO: 2252513 - DNA, 21 bp, Homo sapiens
ctttggttctggccagaatgc

SEQ ID NO: 2252514 - DNA, 12 bp, Homo sapiens
ctttgtaaatag

SEQ ID NO: 2252515 - DNA, 18 bp, Homo sapiens
ctttgtctcgttcctgtt

SEQ ID NO: 2252516 - DNA, 23 bp, Homo sapiens
ctttgtgacaggaaagccctccc

SEQ ID NO: 2252517 - DNA, 13 bp, Homo sapiens
cttttaaaatgca

SEQ ID NO: 2252518 - DNA, 16 bp, Homo sapiens
cttttaaagttgatat

SEQ ID NO: 2252519 - DNA, 10 bp, Homo sapiens
cttttaaata

SEQ ID NO: 2252520 - DNA, 16 bp, Homo sapiens
cttttaattactgttt

SEQ ID NO: 2252521 - DNA, 17 bp, Homo sapiens
cttttaattactgtttt

SEQ ID NO: 2252522 - DNA, 23 bp, Homo sapiens
cttttagaaaagggagtttaaaa

SEQ ID NO: 2252523 - DNA, 14 bp, Homo sapiens
cttttattaatgca

SEQ ID NO: 2252524 - DNA, 15 bp, Homo sapiens
cttttatttcctgta

SEQ ID NO: 2252525 - DNA, 19 bp, Homo sapiens
cttttcattgtgtatcagt

SEQ ID NO: 2252526 - DNA, 14 bp, Homo sapiens
cttttctgctgagg

SEQ ID NO: 2252527 - DNA, 16 bp, Homo sapiens
cttttctgctgttgcc

SEQ ID NO: 2252528 - DNA, 20 bp, Homo sapiens
cttttctgctgttgcctctc

SEQ ID NO: 2252529 - DNA, 21 bp, Homo sapiens
cttttggtaaagactggcttt

SEQ ID NO: 2252530 - DNA, 20 bp, Homo sapiens
ctttttaaggtctttcagta

SEQ ID NO: 2252531 - DNA, 16 bp, Homo sapiens
ctttttagtaatttct

SEQ ID NO: 2252532 - DNA, 15 bp, Homo sapiens
ctttttataaaaaga

SEQ ID NO: 2252533 - DNA, 18 bp, Homo sapiens
ctttttataaaaagataa

SEQ ID NO: 2252534 - DNA, 15 bp, Homo sapiens
gcacacccaggtttg

SEQ ID NO: 2252535 - DNA, 16 bp, Homo sapiens
gcacatgctgtctggc

SEQ ID NO: 2252536 - DNA, 20 bp, Homo sapiens
gcacatgctgtctggccctg

SEQ ID NO: 2252537 - DNA, 22 bp, Homo sapiens
gcacatgctgtctggccctggg

SEQ ID NO: 2252538 - DNA, 10 bp, Homo sapiens
gcaccaaaga

SEQ ID NO: 2252539 - DNA, 16 bp, Homo sapiens
gcaccctctcctgggg

SEQ ID NO: 2252540 - DNA, 22 bp, Homo sapiens
gcaccctctcctgggggtggca

SEQ ID NO: 2252541 - DNA, 20 bp, Homo sapiens
gcacggcgggatcctccaca

SEQ ID NO: 2252542 - DNA, 13 bp, Homo sapiens
gcacgggtggtcc

SEQ ID NO: 2252543 - DNA, 14 bp, Homo sapiens
gcacgggtggtccc

SEQ ID NO: 2252544 - DNA, 17 bp, Homo sapiens
gcacgtggggcccactg

SEQ ID NO: 2252545 - DNA, 23 bp, Homo sapiens
gcactgcatgcaaacaagaaacg

SEQ ID NO: 2252546 - DNA, 17 bp, Homo sapiens
gcactgcattcctgtgc

SEQ ID NO: 2252547 - DNA, 22 bp, Homo sapiens
gcactgcattcctgtgccctag

SEQ ID NO: 2252548 - DNA, 15 bp, Homo sapiens
gcactggcgaggaga

SEQ ID NO: 2252549 - DNA, 15 bp, Homo sapiens
gcactggggagcccg

SEQ ID NO: 2252550 - DNA, 19 bp, Homo sapiens
gcactggggagcccgtctc

SEQ ID NO: 2252551 - DNA, 23 bp, Homo sapiens
gcactggggagcccgtctcagtg

SEQ ID NO: 2252552 - DNA, 15 bp, Homo sapiens
gcacttcatgtaaag

SEQ ID NO: 2252553 - DNA, 17 bp, Homo sapiens
gcacttgtgattattta

SEQ ID NO: 2252554 - DNA, 20 bp, Homo sapiens
gcactttagggctgtaaaat

SEQ ID NO: 2252555 - DNA, 20 bp, Homo sapiens
gcactttctatcctctgtaa

SEQ ID NO: 2252556 - DNA, 14 bp, Homo sapiens
gcagacaataaacc

SEQ ID NO: 2252557 - DNA, 17 bp, Homo sapiens
gcagaccaccccgcctg

SEQ ID NO: 2252558 - DNA, 16 bp, Homo sapiens
gcagagtctgtctctt

SEQ ID NO: 2252559 - DNA, 17 bp, Homo sapiens
gcagatatagcattaat

SEQ ID NO: 2252560 - DNA, 19 bp, Homo sapiens
gcagatatagcattaataa

SEQ ID NO: 2252561 - DNA, 18 bp, Homo sapiens
gcagatgttagatatttt

SEQ ID NO: 2252562 - DNA, 20 bp, Homo sapiens
gcagatgttagatatttttc

SEQ ID NO: 2252563 - DNA, 15 bp, Homo sapiens
gcagcaccctccccc

SEQ ID NO: 2252564 - DNA, 19 bp, Homo sapiens
gcagcaccctcccccgcag

SEQ ID NO: 2252565 - DNA, 16 bp, Homo sapiens
gcagcaggaaggaaca

SEQ ID NO: 2252566 - DNA, 21 bp, Homo sapiens
gcagcaggaaggaacaaagac

SEQ ID NO: 2252567 - DNA, 13 bp, Homo sapiens
gcagcaggctcag

SEQ ID NO: 2252568 - DNA, 16 bp, Homo sapiens
gcagcaggctcaggca

SEQ ID NO: 2252569 - DNA, 17 bp, Homo sapiens
gcagcaggctcaggcac

SEQ ID NO: 2252570 - DNA, 20 bp, Homo sapiens
gcagcagttggatcttttga

SEQ ID NO: 2252571 - DNA, 16 bp, Homo sapiens
gcagccccccagcact

SEQ ID NO: 2252572 - DNA, 21 bp, Homo sapiens
gcagcccctcagcgcccccag

SEQ ID NO: 2252573 - DNA, 15 bp, Homo sapiens
gcagcctttaatgca

SEQ ID NO: 2252574 - DNA, 16 bp, Homo sapiens
gcagcgaccgccccct

SEQ ID NO: 2252575 - DNA, 13 bp, Homo sapiens
gcagcttattgtt

SEQ ID NO: 2252576 - DNA, 14 bp, Homo sapiens
gcaggagggcagtg

SEQ ID NO: 2252577 - DNA, 19 bp, Homo sapiens
gcaggcacacagcagcccc

SEQ ID NO: 2252578 - DNA, 22 bp, Homo sapiens
gcaggcaggaacaaacagggct

SEQ ID NO: 2252579 - DNA, 16 bp, Homo sapiens
gcaggcccactcccca

SEQ ID NO: 2252580 - DNA, 17 bp, Homo sapiens
gcaggcccactccccag

SEQ ID NO: 2252581 - DNA, 20 bp, Homo sapiens
gcaggcccactccccagccc

SEQ ID NO: 2252582 - DNA, 14 bp, Homo sapiens
gcaggctgggccat

SEQ ID NO: 2252583 - DNA, 18 bp, Homo sapiens
gcagggaatgcagcagga

SEQ ID NO: 2252584 - DNA, 22 bp, Homo sapiens
gcagggaatgcagcaggaagga

SEQ ID NO: 2252585 - DNA, 20 bp, Homo sapiens
gcaggggaattccctccccc

SEQ ID NO: 2252586 - DNA, 13 bp, Homo sapiens
gcagggggccctg

SEQ ID NO: 2252587 - DNA, 18 bp, Homo sapiens
gcagggggccctgcccca

SEQ ID NO: 2252588 - DNA, 15 bp, Homo sapiens
gcaggggtctgagcc

SEQ ID NO: 2252589 - DNA, 14 bp, Homo sapiens
gcagggtccctcca

SEQ ID NO: 2252590 - DNA, 21 bp, Homo sapiens
gcagtagaggctatggacagg

SEQ ID NO: 2252591 - DNA, 19 bp, Homo sapiens
gcagtggcgcattctaggc

SEQ ID NO: 2252592 - DNA, 18 bp, Homo sapiens
gcatacctcctatgggtt

SEQ ID NO: 2252593 - DNA, 16 bp, Homo sapiens
gcatctgcaacaaaaa

SEQ ID NO: 2252594 - DNA, 16 bp, Homo sapiens
gcatctgttagcagag

SEQ ID NO: 2252595 - DNA, 14 bp, Homo sapiens
gcatgaaatgtgaa

SEQ ID NO: 2252596 - DNA, 20 bp, Homo sapiens
gcatgaaatgtgaattttta

SEQ ID NO: 2252597 - DNA, 17 bp, Homo sapiens
gcatgcaaacaagaaac

SEQ ID NO: 2252598 - DNA, 14 bp, Homo sapiens
gcatgtcttttaaa

SEQ ID NO: 2252599 - DNA, 15 bp, Homo sapiens
gcatgtcttttaaaa

SEQ ID NO: 2252600 - DNA, 17 bp, Homo sapiens
gcattcatttgtttttt

SEQ ID NO: 2252601 - DNA, 17 bp, Homo sapiens
gcattgctcagcccgct

SEQ ID NO: 2252602 - DNA, 23 bp, Homo sapiens
gcattgctcagcccgcttggcca

SEQ ID NO: 2252603 - DNA, 20 bp, Homo sapiens
gcattgtatagatataatga

SEQ ID NO: 2252604 - DNA, 21 bp, Homo sapiens
gcatttctatgcaggcagcac

SEQ ID NO: 2252605 - DNA, 21 bp, Homo sapiens
gcatttgtgctagaaattttc

SEQ ID NO: 2252606 - DNA, 19 bp, Homo sapiens
gccaaaacaagccaaagag

SEQ ID NO: 2252607 - DNA, 20 bp, Homo sapiens
gccaacgttcgatttctacc

SEQ ID NO: 2252608 - DNA, 18 bp, Homo sapiens
gccaataaagtgatctgt

SEQ ID NO: 2252609 - DNA, 22 bp, Homo sapiens
gccaccatgcctcactaatttt

SEQ ID NO: 2252610 - DNA, 18 bp, Homo sapiens
gccacgctgtcctctcga

SEQ ID NO: 2252611 - DNA, 12 bp, Homo sapiens
gccactcatttc

SEQ ID NO: 2252612 - DNA, 16 bp, Homo sapiens
gccactcatttcatct

SEQ ID NO: 2252613 - DNA, 21 bp, Homo sapiens
gccacttctcactcaccacta

SEQ ID NO: 2252614 - DNA, 23 bp, Homo sapiens
gccacttctcactcaccactacc

SEQ ID NO: 2252615 - DNA, 24 bp, Homo sapiens
gccacttctcactcaccactacca

SEQ ID NO: 2252616 - DNA, 15 bp, Homo sapiens
gccagagatgcaata

SEQ ID NO: 2252617 - DNA, 15 bp, Homo sapiens
gccagccgccctggg

SEQ ID NO: 2252618 - DNA, 16 bp, Homo sapiens
gccagccgccctgggc

SEQ ID NO: 2252619 - DNA, 17 bp, Homo sapiens
gccagcgcctccctcca

SEQ ID NO: 2252620 - DNA, 20 bp, Homo sapiens
gccagcgcctccctccaccc

SEQ ID NO: 2252621 - DNA, 21 bp, Homo sapiens
gccagcgcctccctccacccc

SEQ ID NO: 2252622 - DNA, 22 bp, Homo sapiens
gccagcgcctccctccacccca

SEQ ID NO: 2252623 - DNA, 23 bp, Homo sapiens
gccagcgcctccctccaccccag

SEQ ID NO: 2252624 - DNA, 17 bp, Homo sapiens
gccaggaggtagtttct

SEQ ID NO: 2252625 - DNA, 16 bp, Homo sapiens
gccaggatccccctct

SEQ ID NO: 2252626 - DNA, 21 bp, Homo sapiens
gccaggatccccctctttgca

SEQ ID NO: 2252627 - DNA, 15 bp, Homo sapiens
gccatacttgttctg

SEQ ID NO: 2252628 - DNA, 18 bp, Homo sapiens
gccatccctttttttaca

SEQ ID NO: 2252629 - DNA, 23 bp, Homo sapiens
gccatccctttttttacatttca

SEQ ID NO: 2252630 - DNA, 15 bp, Homo sapiens
gccatgtatgaagcc

SEQ ID NO: 2252631 - DNA, 14 bp, Homo sapiens
gccatgtccaaaga

SEQ ID NO: 2252632 - DNA, 15 bp, Homo sapiens
gccatgtccaaagag

SEQ ID NO: 2252633 - DNA, 18 bp, Homo sapiens
gccatgtccaaagaggct

SEQ ID NO: 2252634 - DNA, 23 bp, Homo sapiens
gccatgtgcaggtggattccatg

SEQ ID NO: 2252635 - DNA, 20 bp, Homo sapiens
gccattagccagatttgtct

SEQ ID NO: 2252636 - DNA, 16 bp, Homo sapiens
gcccactcattccttc

SEQ ID NO: 2252637 - DNA, 18 bp, Homo sapiens
gcccactccccagcccca

SEQ ID NO: 2252638 - DNA, 22 bp, Homo sapiens
gcccactgctcgtggactgtgc

SEQ ID NO: 2252639 - DNA, 20 bp, Homo sapiens
gcccaggctggagtgcagtg

SEQ ID NO: 2252640 - DNA, 22 bp, Homo sapiens
gcccagtacctagctggctctg

SEQ ID NO: 2252641 - DNA, 20 bp, Homo sapiens
ggctctgcaattcccctctg

SEQ ID NO: 2252642 - DNA, 14 bp, Homo sapiens
ggctctgccccctc

SEQ ID NO: 2252643 - DNA, 19 bp, Homo sapiens
ggctctgccccctccccca

SEQ ID NO: 2252644 - DNA, 20 bp, Homo sapiens
ggctctgccccctcccccat

SEQ ID NO: 2252645 - DNA, 19 bp, Homo sapiens
ggctgacctctcactgcct

SEQ ID NO: 2252646 - DNA, 16 bp, Homo sapiens
ggctgccttctggcct

SEQ ID NO: 2252647 - DNA, 18 bp, Homo sapiens
ggctgggaaccagggagg

SEQ ID NO: 2252648 - DNA, 21 bp, Homo sapiens
ggctgggccatgtccaaagag

SEQ ID NO: 2252649 - DNA, 21 bp, Homo sapiens
ggctgggcccctgggatggga

SEQ ID NO: 2252650 - DNA, 15 bp, Homo sapiens
ggctggtagcagcag

SEQ ID NO: 2252651 - DNA, 13 bp, Homo sapiens
ggctgtctgtcac

SEQ ID NO: 2252652 - DNA, 14 bp, Homo sapiens
ggctgtgggcaagc

SEQ ID NO: 2252653 - DNA, 17 bp, Homo sapiens
ggcttcggacaaaatat

SEQ ID NO: 2252654 - DNA, 20 bp, Homo sapiens
ggcttgagttcaccatctct

SEQ ID NO: 2252655 - DNA, 21 bp, Homo sapiens
ggctttcagagccagcctggc

SEQ ID NO: 2252656 - DNA, 14 bp, Homo sapiens
gggaacatgccccc

SEQ ID NO: 2252657 - DNA, 18 bp, Homo sapiens
gggaagagacagcccagg

SEQ ID NO: 2252658 - DNA, 14 bp, Homo sapiens
gggaatgcagcagg

SEQ ID NO: 2252659 - DNA, 16 bp, Homo sapiens
gggaattccctccccc

SEQ ID NO: 2252660 - DNA, 15 bp, Homo sapiens
gggacttgtgtctgc

SEQ ID NO: 2252661 - DNA, 14 bp, Homo sapiens
gggagacactggcc

SEQ ID NO: 2252662 - DNA, 21 bp, Homo sapiens
gggagcctttggttctggcca

SEQ ID NO: 2252663 - DNA, 15 bp, Homo sapiens
gggaggatacagagg

SEQ ID NO: 2252664 - DNA, 20 bp, Homo sapiens
gggatccccgcctggccagg

SEQ ID NO: 2252665 - DNA, 17 bp, Homo sapiens
gggatcctccacagaga

SEQ ID NO: 2252666 - DNA, 20 bp, Homo sapiens
gggatcctccacagagagga

SEQ ID NO: 2252667 - DNA, 16 bp, Homo sapiens
gggatcttcccacagg

SEQ ID NO: 2252668 - DNA, 19 bp, Homo sapiens
gggatcttcccacaggagg

SEQ ID NO: 2252669 - DNA, 20 bp, Homo sapiens
gggatgggggatgggccagg

SEQ ID NO: 2252670 - DNA, 15 bp, Homo sapiens
gggcaatctctctct

SEQ ID NO: 2252671 - DNA, 12 bp, Homo sapiens
gggcaggctggg

SEQ ID NO: 2252672 - DNA, 16 bp, Homo sapiens
gggcaggtcctgccca

SEQ ID NO: 2252673 - DNA, 17 bp, Homo sapiens
gggcaggtcctgcccat

SEQ ID NO: 2252674 - DNA, 23 bp, Homo sapiens
gggcattgctcagcccgcttggc

SEQ ID NO: 2252675 - DNA, 15 bp, Homo sapiens
gggcatttggtgaga

SEQ ID NO: 2252676 - DNA, 18 bp, Homo sapiens
gggccaccacctttggct

SEQ ID NO: 2252677 - DNA, 23 bp, Homo sapiens
gggccatgtccaaagaggctgcc

SEQ ID NO: 2252678 - DNA, 20 bp, Homo sapiens
gggcccccaatgacacccat

SEQ ID NO: 2252679 - DNA, 11 bp, Homo sapiens
gggccctgggc

SEQ ID NO: 2252680 - DNA, 13 bp, Homo sapiens
gggccctgggcct

SEQ ID NO: 2252681 - DNA, 14 bp, Homo sapiens
gggccctgggcctc

SEQ ID NO: 2252682 - DNA, 15 bp, Homo sapiens
gggccctgggcctca

SEQ ID NO: 2252683 - DNA, 17 bp, Homo sapiens
gggccctgggcctcagt

SEQ ID NO: 2252684 - DNA, 18 bp, Homo sapiens
gggccctgggcctcagtt

SEQ ID NO: 2252685 - DNA, 20 bp, Homo sapiens
gggccgggcaggtcctgccc

SEQ ID NO: 2252686 - DNA, 21 bp, Homo sapiens
gggccgggcaggtcctgccca

SEQ ID NO: 2252687 - DNA, 19 bp, Homo sapiens
gggcctcaaaggcccgctc

SEQ ID NO: 2252688 - DNA, 20 bp, Homo sapiens
gggcctcaccgagtgggggc

SEQ ID NO: 2252689 - DNA, 14 bp, Homo sapiens
gggctccctggcag

SEQ ID NO: 2252690 - DNA, 16 bp, Homo sapiens
gggctccctggcagga

SEQ ID NO: 2252691 - DNA, 23 bp, Homo sapiens
gggctctgacagccctgcggaga

SEQ ID NO: 2252692 - DNA, 21 bp, Homo sapiens
gggctctgcaattcccctctg

SEQ ID NO: 2252693 - DNA, 10 bp, Homo sapiens
gggctgagga

SEQ ID NO: 2252694 - DNA, 17 bp, Homo sapiens
gggctgccttctggcct

SEQ ID NO: 2252695 - DNA, 14 bp, Homo sapiens
gggctgtctgtcac

SEQ ID NO: 2252696 - DNA, 22 bp, Homo sapiens
ggggaaaaaaaatctctcagag

SEQ ID NO: 2252697 - DNA, 15 bp, Homo sapiens
ggggaattccctccc

SEQ ID NO: 2252698 - DNA, 16 bp, Homo sapiens
ggggacgagggccagg

SEQ ID NO: 2252699 - DNA, 23 bp, Homo sapiens
ggggatccccgcctggccaggag

SEQ ID NO: 2252700 - DNA, 14 bp, Homo sapiens
ggggatgggccagg

SEQ ID NO: 2252701 - DNA, 16 bp, Homo sapiens
ggggccctgccccacc

SEQ ID NO: 2252702 - DNA, 11 bp, Homo sapiens
ggggccctggg

SEQ ID NO: 2252703 - DNA, 17 bp, Homo sapiens
ggggccgggcaggtcct

SEQ ID NO: 2252704 - DNA, 13 bp, Homo sapiens
gggggcaatctct

SEQ ID NO: 2252705 - DNA, 22 bp, Homo sapiens
gggggcacttggaggacctggc

SEQ ID NO: 2252706 - DNA, 14 bp, Homo sapiens
gggggccgggcagg

SEQ ID NO: 2252707 - DNA, 17 bp, Homo sapiens
gggtaggacggagatga

SEQ ID NO: 2252708 - DNA, 12 bp, Homo sapiens
gggtgagagagg

SEQ ID NO: 2252709 - DNA, 12 bp, Homo sapiens
gggtggcaggca

SEQ ID NO: 2252710 - DNA, 23 bp, Homo sapiens
gggtggcaggcacacagcagccc

SEQ ID NO: 2252711 - DNA, 11 bp, Homo sapiens
gggtgtggcct

SEQ ID NO: 2252712 - DNA, 19 bp, Homo sapiens
gggtgtggcctcagccctc

SEQ ID NO: 2252713 - DNA, 13 bp, Homo sapiens
gggttatctctgt

SEQ ID NO: 2252714 - DNA, 14 bp, Homo sapiens
gggtttcctgcagg

SEQ ID NO: 2252715 - DNA, 15 bp, Homo sapiens
ggtaaagactggctt

SEQ ID NO: 2252716 - DNA, 18 bp, Homo sapiens
ggtaaagttacactttta

SEQ ID NO: 2252717 - DNA, 18 bp, Homo sapiens
ggtaccgtctacatttca

SEQ ID NO: 2252718 - DNA, 13 bp, Homo sapiens
ggtagcagcaggc

SEQ ID NO: 2252719 - DNA, 14 bp, Homo sapiens
ggtatgctggccag

SEQ ID NO: 2252720 - DNA, 14 bp, Homo sapiens
ggtatttaaagtat

SEQ ID NO: 2252721 - DNA, 19 bp, Homo sapiens
ggtatttaaagtattttct

SEQ ID NO: 2252722 - DNA, 13 bp, Homo sapiens
ggtcacaacttga

SEQ ID NO: 2252723 - DNA, 20 bp, Homo sapiens
ggtcacgtttggtgcttctc

SEQ ID NO: 2252724 - DNA, 22 bp, Homo sapiens
ggtccccgttccaccccaagag

SEQ ID NO: 2252725 - DNA, 17 bp, Homo sapiens
ggtccctccgcggctgg

SEQ ID NO: 2252726 - DNA, 19 bp, Homo sapiens
ggtccctccgcggctggag

SEQ ID NO: 2252727 - DNA, 20 bp, Homo sapiens
ggtccctccgcggctggagc

SEQ ID NO: 2252728 - DNA, 22 bp, Homo sapiens
ggtcctgcccatgtgtcccctc

SEQ ID NO: 2252729 - DNA, 15 bp, Homo sapiens
ggtctgagccacagc

SEQ ID NO: 2252730 - DNA, 21 bp, Homo sapiens
ggtcttgaactcctggactca

SEQ ID NO: 2252731 - DNA, 14 bp, Homo sapiens
ggtctttccacttt

SEQ ID NO: 2252732 - DNA, 19 bp, Homo sapiens
ggtgatcccgttttcccca

SEQ ID NO: 2252733 - DNA, 16 bp, Homo sapiens
ggtgcagtgtgaaaag

SEQ ID NO: 2252734 - DNA, 21 bp, Homo sapiens
ggtgcatttgagagaagccac

SEQ ID NO: 2252735 - DNA, 17 bp, Homo sapiens
ggtgcctgtcccacccc

SEQ ID NO: 2252736 - DNA, 17 bp, Homo sapiens
ggtggactgcgctggac

SEQ ID NO: 2252737 - DNA, 12 bp, Homo sapiens
ggtggcaccaga

SEQ ID NO: 2252738 - DNA, 20 bp, Homo sapiens
ggtggcaccagatgcaacct

SEQ ID NO: 2252739 - DNA, 21 bp, Homo sapiens
ggtggccatccctgggcccct

SEQ ID NO: 2252740 - DNA, 19 bp, Homo sapiens
ggtgtggcctcagccctca

SEQ ID NO: 2252741 - DNA, 21 bp, Homo sapiens
ggttgggcagccagaccagca

SEQ ID NO: 2252742 - DNA, 14 bp, Homo sapiens
ggtttacccagtgg

SEQ ID NO: 2252743 - DNA, 15 bp, Homo sapiens
ggtttacccagtggg

SEQ ID NO: 2252744 - DNA, 13 bp, Homo sapiens
ggtttcctgcagg

SEQ ID NO: 2252745 - DNA, 20 bp, Homo sapiens
ggttttgtaatttgtttgaa

SEQ ID NO: 2252746 - DNA, 16 bp, Homo sapiens
ggtttttatttctcgg

SEQ ID NO: 2252747 - DNA, 20 bp, Homo sapiens
gtaaaacagggccacataga

SEQ ID NO: 2252748 - DNA, 17 bp, Homo sapiens
gtaaaagacatttgata

SEQ ID NO: 2252749 - DNA, 15 bp, Homo sapiens
gtaaaatattttgaa

SEQ ID NO: 2252750 - DNA, 12 bp, Homo sapiens
taccctctggag

SEQ ID NO: 2252751 - DNA, 18 bp, Homo sapiens
taccctggccgccccctg

SEQ ID NO: 2252752 - DNA, 13 bp, Homo sapiens
taccgtctacatt

SEQ ID NO: 2252753 - DNA, 17 bp, Homo sapiens
taccgtctacatttcac

SEQ ID NO: 2252754 - DNA, 23 bp, Homo sapiens
tacctcagcagcagttggatctt

SEQ ID NO: 2252755 - DNA, 14 bp, Homo sapiens
tacctgattgtatt

SEQ ID NO: 2252756 - DNA, 15 bp, Homo sapiens
taccttactatttaa

SEQ ID NO: 2252757 - DNA, 15 bp, Homo sapiens
tacgggggcacttgg

SEQ ID NO: 2252758 - DNA, 18 bp, Homo sapiens
tacgtgctctgtgggtct

SEQ ID NO: 2252759 - DNA, 13 bp, Homo sapiens
tactacctctgaa

SEQ ID NO: 2252760 - DNA, 13 bp, Homo sapiens
tactactttctct

SEQ ID NO: 2252761 - DNA, 13 bp, Homo sapiens
tactaggtaactt

SEQ ID NO: 2252762 - DNA, 19 bp, Homo sapiens
tactaggtaacttcatatt

SEQ ID NO: 2252763 - DNA, 14 bp, Homo sapiens
tactagtcaaacaa

SEQ ID NO: 2252764 - DNA, 19 bp, Homo sapiens
tactatttaaagcctcctc

SEQ ID NO: 2252765 - DNA, 21 bp, Homo sapiens
tactatttaagatgtgaaaat

SEQ ID NO: 2252766 - DNA, 15 bp, Homo sapiens
tactcaatactacct

SEQ ID NO: 2252767 - DNA, 17 bp, Homo sapiens
tactcaatactacctct

SEQ ID NO: 2252768 - DNA, 15 bp, Homo sapiens
tactctcctgtttgg

SEQ ID NO: 2252769 - DNA, 17 bp, Homo sapiens
tactgaagccaaatgaa

SEQ ID NO: 2252770 - DNA, 23 bp, Homo sapiens
tactgacagggagcagcccccgg

SEQ ID NO: 2252771 - DNA, 20 bp, Homo sapiens
tactgctactgtaattttat

SEQ ID NO: 2252772 - DNA, 17 bp, Homo sapiens
tactggataaattgttt

SEQ ID NO: 2252773 - DNA, 13 bp, Homo sapiens
tactggattctta

SEQ ID NO: 2252774 - DNA, 22 bp, Homo sapiens
tactggtgtcaccctttgccta

SEQ ID NO: 2252775 - DNA, 14 bp, Homo sapiens
tactgtaattttat

SEQ ID NO: 2252776 - DNA, 13 bp, Homo sapiens
tactgtgtaaact

SEQ ID NO: 2252777 - DNA, 16 bp, Homo sapiens
tactgtgtaaactcat

SEQ ID NO: 2252778 - DNA, 23 bp, Homo sapiens
tactgtgtaaactcatctgaaat

SEQ ID NO: 2252779 - DNA, 16 bp, Homo sapiens
tactgttctgtgtctt

SEQ ID NO: 2252780 - DNA, 22 bp, Homo sapiens
tacttcaaaagtttgtttgctt

SEQ ID NO: 2252781 - DNA, 17 bp, Homo sapiens
tacttgaactttccaaa

SEQ ID NO: 2252782 - DNA, 15 bp, Homo sapiens
tacttgatgattttt

SEQ ID NO: 2252783 - DNA, 19 bp, Homo sapiens
tacttgcagcattcatttg

SEQ ID NO: 2252784 - DNA, 15 bp, Homo sapiens
tacttgttcatttgg

SEQ ID NO: 2252785 - DNA, 14 bp, Homo sapiens
tacttttaaaaaca

SEQ ID NO: 2252786 - DNA, 15 bp, Homo sapiens
tacttttaaaaacat

SEQ ID NO: 2252787 - DNA, 16 bp, Homo sapiens
tacttttcattctctt

SEQ ID NO: 2252788 - DNA, 20 bp, Homo sapiens
tagaacagtggaaactatgt

SEQ ID NO: 2252789 - DNA, 21 bp, Homo sapiens
tagaaccagccgtattttaca

SEQ ID NO: 2252790 - DNA, 22 bp, Homo sapiens
tagaatacattgtacttataca

SEQ ID NO: 2252791 - DNA, 21 bp, Homo sapiens
tagaattaaaaaagcatactt

SEQ ID NO: 2252792 - DNA, 22 bp, Homo sapiens
tagaattgctgtctatgattgt

SEQ ID NO: 2252793 - DNA, 16 bp, Homo sapiens
tagacacttacttgat

SEQ ID NO: 2252794 - DNA, 14 bp, Homo sapiens
tagacagcatgaga

SEQ ID NO: 2252795 - DNA, 15 bp, Homo sapiens
tagactataaatgtt

SEQ ID NO: 2252796 - DNA, 18 bp, Homo sapiens
tagagtttttatgccttt

SEQ ID NO: 2252797 - DNA, 23 bp, Homo sapiens
tagatataaatttttaagagaaa

SEQ ID NO: 2252798 - DNA, 21 bp, Homo sapiens
tagatatttttcataaacaag

SEQ ID NO: 2252799 - DNA, 23 bp, Homo sapiens
tagattaatactctatttttaca

SEQ ID NO: 2252800 - DNA, 16 bp, Homo sapiens
tagattatggagcttt

SEQ ID NO: 2252801 - DNA, 17 bp, Homo sapiens
tagattcaggtaataca

SEQ ID NO: 2252802 - DNA, 21 bp, Homo sapiens
tagcaaagattaaatgtgtca

SEQ ID NO: 2252803 - DNA, 23 bp, Homo sapiens
tagcaaggtttggtgcaaagtat

SEQ ID NO: 2252804 - DNA, 20 bp, Homo sapiens
tagcaataaataacacttgt

SEQ ID NO: 2252805 - DNA, 16 bp, Homo sapiens
tagcacttgacctttt

SEQ ID NO: 2252806 - DNA, 15 bp, Homo sapiens
tagcagagtctgtct

SEQ ID NO: 2252807 - DNA, 12 bp, Homo sapiens
tagcagcaggct

SEQ ID NO: 2252808 - DNA, 18 bp, Homo sapiens
tagcatctggaagatcat

SEQ ID NO: 2252809 - DNA, 17 bp, Homo sapiens
tagcattaataaaactg

SEQ ID NO: 2252810 - DNA, 23 bp, Homo sapiens
tagcattaataaaactgtgcatc

SEQ ID NO: 2252811 - DNA, 15 bp, Homo sapiens
tagccccctggcctc

SEQ ID NO: 2252812 - DNA, 16 bp, Homo sapiens
tagccccctggcctct

SEQ ID NO: 2252813 - DNA, 17 bp, Homo sapiens
tagccccctggcctctg

SEQ ID NO: 2252814 - DNA, 18 bp, Homo sapiens
tagccttgctcaggtgca

SEQ ID NO: 2252815 - DNA, 15 bp, Homo sapiens
tagctaactgtaaat

SEQ ID NO: 2252816 - DNA, 13 bp, Homo sapiens
tagctacactgag

SEQ ID NO: 2252817 - DNA, 15 bp, Homo sapiens
tagctcaattagtgt

SEQ ID NO: 2252818 - DNA, 13 bp, Homo sapiens
tagctgtgggggt

SEQ ID NO: 2252819 - DNA, 23 bp, Homo sapiens
tagctttaatgatatgcttgtaa

SEQ ID NO: 2252820 - DNA, 17 bp, Homo sapiens
taggagtgtgtgatttt

SEQ ID NO: 2252821 - DNA, 21 bp, Homo sapiens
taggatagctaactgtaaatc

SEQ ID NO: 2252822 - DNA, 14 bp, Homo sapiens
taggatttttagaa

SEQ ID NO: 2252823 - DNA, 17 bp, Homo sapiens
taggcaccttttactgt

SEQ ID NO: 2252824 - DNA, 14 bp, Homo sapiens
taggcagggggccc

SEQ ID NO: 2252825 - DNA, 17 bp, Homo sapiens
taggcagggggccctgc

SEQ ID NO: 2252826 - DNA, 23 bp, Homo sapiens
taggccttcctctctccagatgt

SEQ ID NO: 2252827 - DNA, 14 bp, Homo sapiens
tagggctgtaaaat

SEQ ID NO: 2252828 - DNA, 14 bp, Homo sapiens
taggtatgtttgca

SEQ ID NO: 2252829 - DNA, 23 bp, Homo sapiens
taggtgatcccgttttccccatg

SEQ ID NO: 2252830 - DNA, 15 bp, Homo sapiens
taggtttttattagt

SEQ ID NO: 2252831 - DNA, 21 bp, Homo sapiens
tagtaagattgatatctataa

SEQ ID NO: 2252832 - DNA, 22 bp, Homo sapiens
tagtaagattgatatctataaa

SEQ ID NO: 2252833 - DNA, 16 bp, Homo sapiens
tagtaagttaatgtat

SEQ ID NO: 2252834 - DNA, 21 bp, Homo sapiens
tagtaatttctttttttcctt

SEQ ID NO: 2252835 - DNA, 19 bp, Homo sapiens
tagtaccatttatacaaat

SEQ ID NO: 2252836 - DNA, 16 bp, Homo sapiens
tagtagacatgaattt

SEQ ID NO: 2252837 - DNA, 15 bp, Homo sapiens
tagtcaaaactattt

SEQ ID NO: 2252838 - DNA, 21 bp, Homo sapiens
tagtcaaaactatttttgtaa

SEQ ID NO: 2252839 - DNA, 17 bp, Homo sapiens
tagtcaaacaaaaaaga

SEQ ID NO: 2252840 - DNA, 11 bp, Homo sapiens
tagtctcagtt

SEQ ID NO: 2252841 - DNA, 22 bp, Homo sapiens
tagtctcagtttgtgtgtctta

SEQ ID NO: 2252842 - DNA, 16 bp, Homo sapiens
tagtcttgaaatgaaa

SEQ ID NO: 2252843 - DNA, 20 bp, Homo sapiens
tagtcttgaaatgaaaggga

SEQ ID NO: 2252844 - DNA, 19 bp, Homo sapiens
tagtgaaaaactgctgtaa

SEQ ID NO: 2252845 - DNA, 14 bp, Homo sapiens
tagttcaaactgca

SEQ ID NO: 2252846 - DNA, 14 bp, Homo sapiens
tagttccactgaga

SEQ ID NO: 2252847 - DNA, 21 bp, Homo sapiens
tagttgtttctagactataaa

SEQ ID NO: 2252848 - DNA, 23 bp, Homo sapiens
tagtttcaaaggccacatacctc

SEQ ID NO: 2252849 - DNA, 14 bp, Homo sapiens
tataaaaagataat

SEQ ID NO: 2252850 - DNA, 12 bp, Homo sapiens
tataaaatacat

SEQ ID NO: 2252851 - DNA, 15 bp, Homo sapiens
tataaaatacatagt

SEQ ID NO: 2252852 - DNA, 17 bp, Homo sapiens
tataaaatcctgtgcaa

SEQ ID NO: 2252853 - DNA, 21 bp, Homo sapiens
tataaaatcctgtgcaataga

SEQ ID NO: 2252854 - DNA, 18 bp, Homo sapiens
tataaagtattctttttc

SEQ ID NO: 2252855 - DNA, 22 bp, Homo sapiens
tataaattgtctttaaaaactg

SEQ ID NO: 2252856 - DNA, 23 bp, Homo sapiens
tataaattgtctttaaaaactgt

SEQ ID NO: 2252857 - DNA, 20 bp, Homo sapiens
tataaatttcgcttcttaga

SEQ ID NO: 2252858 - DNA, 18 bp, Homo sapiens
tctgggcaccacaaaata

SEQ ID NO: 2252859 - DNA, 20 bp, Homo sapiens
tctggggcaggctgggccat

SEQ ID NO: 2252860 - DNA, 16 bp, Homo sapiens
tctgtacctcaaatga

SEQ ID NO: 2252861 - DNA, 13 bp, Homo sapiens
tctgtattgccat

SEQ ID NO: 2252862 - DNA, 20 bp, Homo sapiens
tctgtattgccatggtcttt

SEQ ID NO: 2252863 - DNA, 20 bp, Homo sapiens
tctgtcagccagccgccctg

SEQ ID NO: 2252864 - DNA, 13 bp, Homo sapiens
tctgtcatctctc

SEQ ID NO: 2252865 - DNA, 16 bp, Homo sapiens
tctgtcatctctctgg

SEQ ID NO: 2252866 - DNA, 18 bp, Homo sapiens
tctgtcatctctctgggg

SEQ ID NO: 2252867 - DNA, 21 bp, Homo sapiens
tctgtcatctctctggggccc

SEQ ID NO: 2252868 - DNA, 23 bp, Homo sapiens
tctgtcatctctctggggccctg

SEQ ID NO: 2252869 - DNA, 22 bp, Homo sapiens
tctgtccctattatttgcccta

SEQ ID NO: 2252870 - DNA, 22 bp, Homo sapiens
tctgtctcttggctttgtcact

SEQ ID NO: 2252871 - DNA, 19 bp, Homo sapiens
tctgtgaatttcagaggtc

SEQ ID NO: 2252872 - DNA, 18 bp, Homo sapiens
tctgtgtattttcagtca

SEQ ID NO: 2252873 - DNA, 20 bp, Homo sapiens
tctgttagcagagtctgtct

SEQ ID NO: 2252874 - DNA, 16 bp, Homo sapiens
tctgttgtattcattg

SEQ ID NO: 2252875 - DNA, 16 bp, Homo sapiens
tctgtttcctgacatt

SEQ ID NO: 2252876 - DNA, 22 bp, Homo sapiens
tcttaaagtattcttctcttcc

SEQ ID NO: 2252877 - DNA, 23 bp, Homo sapiens
tcttaacctactaatagtttgtt

SEQ ID NO: 2252878 - DNA, 12 bp, Homo sapiens
tcttaattatta

SEQ ID NO: 2252879 - DNA, 22 bp, Homo sapiens
tcttagctatccttggctttca

SEQ ID NO: 2252880 - DNA, 20 bp, Homo sapiens
tcttatgtagagtttttatg

SEQ ID NO: 2252881 - DNA, 17 bp, Homo sapiens
tcttattagggagaaaa

SEQ ID NO: 2252882 - DNA, 21 bp, Homo sapiens
tcttccagctgcttcagggag

SEQ ID NO: 2252883 - DNA, 14 bp, Homo sapiens
tcttctctgtgaga

SEQ ID NO: 2252884 - DNA, 20 bp, Homo sapiens
tcttctggggcaggctgggc

SEQ ID NO: 2252885 - DNA, 22 bp, Homo sapiens
tcttctggggcaggctgggcca

SEQ ID NO: 2252886 - DNA, 16 bp, Homo sapiens
tcttgaaatgaaaggg

SEQ ID NO: 2252887 - DNA, 22 bp, Homo sapiens
tcttgaaatgaaagggaaactg

SEQ ID NO: 2252888 - DNA, 17 bp, Homo sapiens
tcttgagccacagtcac

SEQ ID NO: 2252889 - DNA, 16 bp, Homo sapiens
tcttggcttaatcatt

SEQ ID NO: 2252890 - DNA, 18 bp, Homo sapiens
tcttggcttaatcatttt

SEQ ID NO: 2252891 - DNA, 19 bp, Homo sapiens
tcttgtattaaactcttca

SEQ ID NO: 2252892 - DNA, 14 bp, Homo sapiens
tctttaaaaactgt

SEQ ID NO: 2252893 - DNA, 11 bp, Homo sapiens
tctttaatgct

SEQ ID NO: 2252894 - DNA, 18 bp, Homo sapiens
tctttacctttattgata

SEQ ID NO: 2252895 - DNA, 16 bp, Homo sapiens
tctttattaatcacta

SEQ ID NO: 2252896 - DNA, 15 bp, Homo sapiens
tctttcacagctcct

SEQ ID NO: 2252897 - DNA, 20 bp, Homo sapiens
tctttcacagctcctcccac

SEQ ID NO: 2252898 - DNA, 21 bp, Homo sapiens
tctttcatttgctttggaagt

SEQ ID NO: 2252899 - DNA, 14 bp, Homo sapiens
tctttccaaattat

SEQ ID NO: 2252900 - DNA, 14 bp, Homo sapiens
tctttctaagaaat

SEQ ID NO: 2252901 - DNA, 20 bp, Homo sapiens
tctttctgcacacaaatatt

SEQ ID NO: 2252902 - DNA, 18 bp, Homo sapiens
tctttctttgcaccaaag

SEQ ID NO: 2252903 - DNA, 21 bp, Homo sapiens
tctttgacaattgggagctgc

SEQ ID NO: 2252904 - DNA, 16 bp, Homo sapiens
tctttgcaccaaagac

SEQ ID NO: 2252905 - DNA, 19 bp, Homo sapiens
tctttgcaccaaagacatc

SEQ ID NO: 2252906 - DNA, 21 bp, Homo sapiens
tctttgtaatcccttcacagt

SEQ ID NO: 2252907 - DNA, 22 bp, Homo sapiens
tctttgtgacaggaaagccctc

SEQ ID NO: 2252908 - DNA, 20 bp, Homo sapiens
tcttttaaattagaaaatat

SEQ ID NO: 2252909 - DNA, 12 bp, Homo sapiens
tgaaaaactgct

SEQ ID NO: 2252910 - DNA, 20 bp, Homo sapiens
tgaaaacggagctgaacaat

SEQ ID NO: 2252911 - DNA, 13 bp, Homo sapiens
tgaaaactttgta

SEQ ID NO: 2252912 - DNA, 16 bp, Homo sapiens
tgaaaagcaatattgt

SEQ ID NO: 2252913 - DNA, 19 bp, Homo sapiens
tgaaaagcaatattgtata

SEQ ID NO: 2252914 - DNA, 16 bp, Homo sapiens
tgaaaagcagacattt

SEQ ID NO: 2252915 - DNA, 20 bp, Homo sapiens
tgaaaatatttctctagtgt

SEQ ID NO: 2252916 - DNA, 22 bp, Homo sapiens
tgaaaattgtttagtgatatta

SEQ ID NO: 2252917 - DNA, 20 bp, Homo sapiens
tgaaacccctgtaggcctca

SEQ ID NO: 2252918 - DNA, 20 bp, Homo sapiens
tgaaactcaaaaccatctct

SEQ ID NO: 2252919 - DNA, 21 bp, Homo sapiens
tgaaagacctgaataccactt

SEQ ID NO: 2252920 - DNA, 13 bp, Homo sapiens
tgaaagggaaact

SEQ ID NO: 2252921 - DNA, 14 bp, Homo sapiens
tgaaataactggaa

SEQ ID NO: 2252922 - DNA, 20 bp, Homo sapiens
tgaaataactggaacaaatt

SEQ ID NO: 2252923 - DNA, 16 bp, Homo sapiens
tgaaatagttcaaact

SEQ ID NO: 2252924 - DNA, 12 bp, Homo sapiens
tgaaatgaaagg

SEQ ID NO: 2252925 - DNA, 13 bp, Homo sapiens
tgaaatgaaaggg

SEQ ID NO: 2252926 - DNA, 17 bp, Homo sapiens
tgaaatgaaagggaaac

SEQ ID NO: 2252927 - DNA, 12 bp, Homo sapiens
tgaaatgtgaat

SEQ ID NO: 2252928 - DNA, 22 bp, Homo sapiens
tgaaatgtgaatttttattgtt

SEQ ID NO: 2252929 - DNA, 20 bp, Homo sapiens
tgaaatgttacaaaaataaa

SEQ ID NO: 2252930 - DNA, 13 bp, Homo sapiens
tgaacaaaattat

SEQ ID NO: 2252931 - DNA, 15 bp, Homo sapiens
tgaacaatgaagttg

SEQ ID NO: 2252932 - DNA, 15 bp, Homo sapiens
tgaacctgctactta

SEQ ID NO: 2252933 - DNA, 14 bp, Homo sapiens
tgaactcgcaggga

SEQ ID NO: 2252934 - DNA, 14 bp, Homo sapiens
tgaacttgttactt

SEQ ID NO: 2252935 - DNA, 16 bp, Homo sapiens
tgaagagactctgttt

SEQ ID NO: 2252936 - DNA, 21 bp, Homo sapiens
tgaagataagtgtatttttca

SEQ ID NO: 2252937 - DNA, 22 bp, Homo sapiens
tgaaggattatggaaaaataaa

SEQ ID NO: 2252938 - DNA, 12 bp, Homo sapiens
tgaagggagaag

SEQ ID NO: 2252939 - DNA, 17 bp, Homo sapiens
tgaagggagaagacact

SEQ ID NO: 2252940 - DNA, 21 bp, Homo sapiens
tgaagggagaagacactgcag

SEQ ID NO: 2252941 - DNA, 12 bp, Homo sapiens
tgaataccactt

SEQ ID NO: 2252942 - DNA, 19 bp, Homo sapiens
tgaataccacttacctcaa

SEQ ID NO: 2252943 - DNA, 15 bp, Homo sapiens
tgaatcaataatata

SEQ ID NO: 2252944 - DNA, 18 bp, Homo sapiens
tgaatccaactgcttaaa

SEQ ID NO: 2252945 - DNA, 18 bp, Homo sapiens
tgaatgtagaataggcag

SEQ ID NO: 2252946 - DNA, 15 bp, Homo sapiens
tgaatgtatttattt

SEQ ID NO: 2252947 - DNA, 19 bp, Homo sapiens
tgaatgtatttatttggga

SEQ ID NO: 2252948 - DNA, 20 bp, Homo sapiens
tgaatgttgcaatgtgaaaa

SEQ ID NO: 2252949 - DNA, 20 bp, Homo sapiens
tgaattgaggggattaatat

SEQ ID NO: 2252950 - DNA, 13 bp, Homo sapiens
tgaatttgtccaa

SEQ ID NO: 2252951 - DNA, 18 bp, Homo sapiens
tgaattttaaataatgta

SEQ ID NO: 2252952 - DNA, 16 bp, Homo sapiens
tgaatttttattgttg

SEQ ID NO: 2252953 - DNA, 18 bp, Homo sapiens
tgacaaaaaatgttttaa

SEQ ID NO: 2252954 - DNA, 15 bp, Homo sapiens
tgacaaatattttca

SEQ ID NO: 2252955 - DNA, 17 bp, Homo sapiens
tgacaaatattttcatg

SEQ ID NO: 2252956 - DNA, 22 bp, Homo sapiens
tgacaaatattttcatgtattt

SEQ ID NO: 2252957 - DNA, 21 bp, Homo sapiens
tgacaaggcacttcatgtaaa

SEQ ID NO: 2252958 - DNA, 13 bp, Homo sapiens
tgacaatgttgta

SEQ ID NO: 2252959 - DNA, 16 bp, Homo sapiens
tgacaattctgttttt

SEQ ID NO: 2252960 - DNA, 19 bp, Homo sapiens
tgacacaagtggaccttag

SEQ ID NO: 2252961 - DNA, 17 bp, Homo sapiens
tgacaccatcttttatt

SEQ ID NO: 2252962 - DNA, 16 bp, Homo sapiens
tgacaggaaagccctc

SEQ ID NO: 2252963 - DNA, 18 bp, Homo sapiens
tgacaggaaagccctccc

SEQ ID NO: 2252964 - DNA, 19 bp, Homo sapiens
tgacagggacatgccctgt

SEQ ID NO: 2252965 - DNA, 15 bp, Homo sapiens
tgacatgttccttta

SEQ ID NO: 2252966 - DNA, 20 bp, Homo sapiens
tgtatctaagaataataaaa

SEQ ID NO: 2252967 - DNA, 16 bp, Homo sapiens
tgtatgtcagaagtgc

SEQ ID NO: 2252968 - DNA, 15 bp, Homo sapiens
tgtattatcactgtc

SEQ ID NO: 2252969 - DNA, 18 bp, Homo sapiens
tgtattgtatattacaat

SEQ ID NO: 2252970 - DNA, 18 bp, Homo sapiens
tgtcaaggctgcttagaa

SEQ ID NO: 2252971 - DNA, 13 bp, Homo sapiens
tgtcacacttgtg

SEQ ID NO: 2252972 - DNA, 23 bp, Homo sapiens
tgtcacagtaaaaataaaatact

SEQ ID NO: 2252973 - DNA, 15 bp, Homo sapiens
tgtcaccagctatct

SEQ ID NO: 2252974 - DNA, 22 bp, Homo sapiens
tgtcacttttccttttcttaaa

SEQ ID NO: 2252975 - DNA, 14 bp, Homo sapiens
tgtcagattcacac

SEQ ID NO: 2252976 - DNA, 13 bp, Homo sapiens
tgtcagccagccg

SEQ ID NO: 2252977 - DNA, 21 bp, Homo sapiens
tgtcataacatccagagcttt

SEQ ID NO: 2252978 - DNA, 14 bp, Homo sapiens
tgtcatctctctgg

SEQ ID NO: 2252979 - DNA, 23 bp, Homo sapiens
tgtcattatttttgttagcaaag

SEQ ID NO: 2252980 - DNA, 13 bp, Homo sapiens
tgtcattggaagc

SEQ ID NO: 2252981 - DNA, 20 bp, Homo sapiens
tgtccaaagaggctgcccct

SEQ ID NO: 2252982 - DNA, 14 bp, Homo sapiens
tgtccagccacccc

SEQ ID NO: 2252983 - DNA, 18 bp, Homo sapiens
tgtcccacccccaccccc

SEQ ID NO: 2252984 - DNA, 16 bp, Homo sapiens
tgtcccaccgggagcc

SEQ ID NO: 2252985 - DNA, 16 bp, Homo sapiens
tgtcccctcactctgt

SEQ ID NO: 2252986 - DNA, 15 bp, Homo sapiens
tgtccgctgggtggt

SEQ ID NO: 2252987 - DNA, 22 bp, Homo sapiens
tgtccgctgggtggtaccctct

SEQ ID NO: 2252988 - DNA, 23 bp, Homo sapiens
tgtccgctgggtggtaccctctg

SEQ ID NO: 2252989 - DNA, 13 bp, Homo sapiens
tgtcctctcgagc

SEQ ID NO: 2252990 - DNA, 15 bp, Homo sapiens
tgtcctggttcccgt

SEQ ID NO: 2252991 - DNA, 19 bp, Homo sapiens
tgtcgccccaggccctccc

SEQ ID NO: 2252992 - DNA, 23 bp, Homo sapiens
tgtcgccccaggccctccctgac

SEQ ID NO: 2252993 - DNA, 20 bp, Homo sapiens
tgtcggggctgacctctcac

SEQ ID NO: 2252994 - DNA, 16 bp, Homo sapiens
tgtctaaacaatgctg

SEQ ID NO: 2252995 - DNA, 22 bp, Homo sapiens
tgtctaaacaatgctgatttgg

SEQ ID NO: 2252996 - DNA, 17 bp, Homo sapiens
tgtctatgattgtactt

SEQ ID NO: 2252997 - DNA, 20 bp, Homo sapiens
tgtctatgattgtactttga

SEQ ID NO: 2252998 - DNA, 18 bp, Homo sapiens
tgtctcctatatatttct

SEQ ID NO: 2252999 - DNA, 13 bp, Homo sapiens
tgtctctgaggac

SEQ ID NO: 2253000 - DNA, 22 bp, Homo sapiens
tgtctcttggctttgtcacttt

SEQ ID NO: 2253001 - DNA, 13 bp, Homo sapiens
tgtctgaaacatt

SEQ ID NO: 2253002 - DNA, 14 bp, Homo sapiens
tgtctgagtgaacc

SEQ ID NO: 2253003 - DNA, 14 bp, Homo sapiens
tgtctggggcagaa

SEQ ID NO: 2253004 - DNA, 11 bp, Homo sapiens
tgtctgtcacc

SEQ ID NO: 2253005 - DNA, 24 bp, Homo sapiens
tgtctgtcaccagctatctgtcat

SEQ ID NO: 2253006 - DNA, 16 bp, Homo sapiens
tgtctgttgtattcat

SEQ ID NO: 2253007 - DNA, 16 bp, Homo sapiens
tgtctttctaagaaat

SEQ ID NO: 2253008 - DNA, 20 bp, Homo sapiens
tgtcttttaaaatgcaatgt

SEQ ID NO: 2253009 - DNA, 18 bp, Homo sapiens
tgtcttttctgctgagga

SEQ ID NO: 2253010 - DNA, 22 bp, Homo sapiens
tgtgaaggattatggaaaaata

SEQ ID NO: 2253011 - DNA, 16 bp, Homo sapiens
tgtgaattaagcccaa

SEQ ID NO: 2253012 - DNA, 17 bp, Homo sapiens
tgtgaatttttattgtt

SEQ ID NO: 2253013 - DNA, 15 bp, Homo sapiens
tgtgacaattctgtt

SEQ ID NO: 2253014 - DNA, 19 bp, Homo sapiens
tgtgacaattctgttttta

SEQ ID NO: 2253015 - DNA, 22 bp, Homo sapiens
tgtgacaggaaagccctccccc

SEQ ID NO: 2253016 - DNA, 19 bp, Homo sapiens
tgtgacgtcgggcattcat

SEQ ID NO: 2253017 - DNA, 15 bp, Homo sapiens
tgtgagggtgctgac

SEQ ID NO: 2253018 - DNA, 14 bp, Homo sapiens
tgtgatgtggcagg

SEQ ID NO: 2253019 - DNA, 13 bp, Homo sapiens
tgtgcacatcttc

SEQ ID NO: 2253020 - DNA, 17 bp, Homo sapiens
tgtgcatgaaagagaaa

SEQ ID NO: 2253021 - DNA, 20 bp, Homo sapiens
tgtgccatacttgttctgta

SEQ ID NO: 2253022 - DNA, 13 bp, Homo sapiens
tgtgcccccctcc

SEQ ID NO: 2253023 - DNA, 22 bp, Homo sapiens
tgtgcccccctcctccccgcgc

SEQ ID NO: 2253024 - DNA, 19 bp, Homo sapiens
tgtgctgggagcaggactg

SEQ ID NO: 2253025 - DNA, 21 bp, Homo sapiens
tgtgctgtgggcagcaccctc

SEQ ID NO: 2253026 - DNA, 19 bp, Homo sapiens
tgtgcttgagccaggaggc

SEQ ID NO: 2253027 - DNA, 11 bp, Homo sapiens
tgtggcaggag

SEQ ID NO: 2253028 - DNA, 20 bp, Homo sapiens
tgtgggggtggccatccctg

SEQ ID NO: 2253029 - DNA, 21 bp, Homo sapiens
tgtgggggtggccatccctgg

SEQ ID NO: 2253030 - DNA, 15 bp, Homo sapiens
tgtgtaaagatttat

SEQ ID NO: 2253031 - DNA, 20 bp, Homo sapiens
tgtgtaacactgtgtacacc

SEQ ID NO: 2253032 - DNA, 16 bp, Homo sapiens
tgtgtataaattgtct

SEQ ID NO: 2253033 - DNA, 12 bp, Homo sapiens
tgtgtcccctca

SEQ ID NO: 2253034 - DNA, 18 bp, Homo sapiens
tgtgtcccctcactctgt

SEQ ID NO: 2253035 - DNA, 19 bp, Homo sapiens
tgtgtcccctcactctgtc

SEQ ID NO: 2253036 - DNA, 14 bp, Homo sapiens
tgtgtcctggttcc

SEQ ID NO: 2253037 - DNA, 22 bp, Homo sapiens
tgtgtctttcacagctcctccc

SEQ ID NO: 2253038 - DNA, 14 bp, Homo sapiens
tgtgtctttctctc

SEQ ID NO: 2253039 - DNA, 14 bp, Homo sapiens
tgtgtgacaattct

SEQ ID NO: 2253040 - DNA, 21 bp, Homo sapiens
tgtgttattattttttaataa

SEQ ID NO: 2253041 - DNA, 23 bp, Homo sapiens
tgtgttattattttttaataaga

SEQ ID NO: 2253042 - DNA, 13 bp, Homo sapiens
tgtgtttttctca

SEQ ID NO: 2253043 - DNA, 20 bp, Homo sapiens
tgttaaggacttctgcagct

SEQ ID NO: 2253044 - DNA, 18 bp, Homo sapiens
tgttacactttttggaag

SEQ ID NO: 2253045 - DNA, 18 bp, Homo sapiens
tgttaccttttacagaat

SEQ ID NO: 2253046 - DNA, 14 bp, Homo sapiens
tgttacttgcagca

SEQ ID NO: 2253047 - DNA, 20 bp, Homo sapiens
tgttagattaagaaatagac

SEQ ID NO: 2253048 - DNA, 15 bp, Homo sapiens
tgttagcaaagatta

SEQ ID NO: 2253049 - DNA, 12 bp, Homo sapiens
tgttagcagagt

SEQ ID NO: 2253050 - DNA, 14 bp, Homo sapiens
tgttattaaacaaa

SEQ ID NO: 2253051 - DNA, 15 bp, Homo sapiens
tgttcctggcagttt

SEQ ID NO: 2253052 - DNA, 23 bp, Homo sapiens
tgttctgcaaaaatatttataaa

SEQ ID NO: 2253053 - DNA, 13 bp, Homo sapiens
tgttctgtgtctt

SEQ ID NO: 2253054 - DNA, 23 bp, Homo sapiens
tgttcttggcttggaagattcta

SEQ ID NO: 2253055 - DNA, 17 bp, Homo sapiens
tgttgatcatgtacttt

SEQ ID NO: 2253056 - DNA, 23 bp, Homo sapiens
tgttgatcatgtactttttagta

SEQ ID NO: 2253057 - DNA, 22 bp, Homo sapiens
tgttggcttggggcaacagatt

SEQ ID NO: 2253058 - DNA, 22 bp, Homo sapiens
tgttggtcgcagctacataaga

SEQ ID NO: 2253059 - DNA, 13 bp, Homo sapiens
tgttgtaaaacaa

SEQ ID NO: 2253060 - DNA, 22 bp, Homo sapiens
tgttgtaaaacaaaatttgact

SEQ ID NO: 2253061 - DNA, 23 bp, Homo sapiens
tgttgtaaaacaaaatttgacta

SEQ ID NO: 2253062 - DNA, 15 bp, Homo sapiens
tgttgtacaatcaaa

SEQ ID NO: 2253063 - DNA, 22 bp, Homo sapiens
tgttgtacatacagaggtaact

SEQ ID NO: 2253064 - DNA, 16 bp, Homo sapiens
tgttgtcaagaatagc

SEQ ID NO: 2253065 - DNA, 21 bp, Homo sapiens
tgtttaatcatagttactgtg

SEQ ID NO: 2253066 - DNA, 17 bp, Homo sapiens
tgtttacatttgatgca

SEQ ID NO: 2253067 - DNA, 21 bp, Homo sapiens
tgtttcagaggctcagattgt

SEQ ID NO: 2253068 - DNA, 17 bp, Homo sapiens
tgtttcagcttctctgc

SEQ ID NO: 2253069 - DNA, 14 bp, Homo sapiens
tgtttcatctaagt

SEQ ID NO: 2253070 - DNA, 23 bp, Homo sapiens
tgtttccagacttccttgagaca

SEQ ID NO: 2253071 - DNA, 20 bp, Homo sapiens
tgtttccattttaaggatat

SEQ ID NO: 2253072 - DNA, 21 bp, Homo sapiens
tgtttcgagtaaacttgaaaa

SEQ ID NO: 2253073 - DNA, 22 bp, Homo sapiens
tgtttctattttttgaaaagca

SEQ ID NO: 2253074 - DNA, 23 bp, Homo sapiens
tttaatggggtctgtaaatactg

SEQ ID NO: 2253075 - DNA, 18 bp, Homo sapiens
tttaatggtgatggggta

SEQ ID NO: 2253076 - DNA, 19 bp, Homo sapiens
tttaattaaaaagaattct

SEQ ID NO: 2253077 - DNA, 16 bp, Homo sapiens
tttaattaaaaatttt

SEQ ID NO: 2253078 - DNA, 14 bp, Homo sapiens
tttaattaagcaaa

SEQ ID NO: 2253079 - DNA, 16 bp, Homo sapiens
tttaattactgttttc

SEQ ID NO: 2253080 - DNA, 23 bp, Homo sapiens
tttaattcatcccaactgtcttt

SEQ ID NO: 2253081 - DNA, 19 bp, Homo sapiens
tttaattttgtcagattca

SEQ ID NO: 2253082 - DNA, 22 bp, Homo sapiens
tttaatttttgcttttagaaaa

SEQ ID NO: 2253083 - DNA, 15 bp, Homo sapiens
tttacagaataaaag

SEQ ID NO: 2253084 - DNA, 14 bp, Homo sapiens
tttacatactttat

SEQ ID NO: 2253085 - DNA, 10 bp, Homo sapiens
tttacatttc

SEQ ID NO: 2253086 - DNA, 13 bp, Homo sapiens
tttaccaaagcat

SEQ ID NO: 2253087 - DNA, 22 bp, Homo sapiens
tttacccagtgggacagaggag

SEQ ID NO: 2253088 - DNA, 13 bp, Homo sapiens
tttaccttgaaaa

SEQ ID NO: 2253089 - DNA, 14 bp, Homo sapiens
tttactcacagcac

SEQ ID NO: 2253090 - DNA, 16 bp, Homo sapiens
tttactcacagcactt

SEQ ID NO: 2253091 - DNA, 22 bp, Homo sapiens
tttagaaatactgcaagaaaat

SEQ ID NO: 2253092 - DNA, 20 bp, Homo sapiens
tttaggagggagttatctaa

SEQ ID NO: 2253093 - DNA, 13 bp, Homo sapiens
tttagtaatttct

SEQ ID NO: 2253094 - DNA, 15 bp, Homo sapiens
tttagtattatcaaa

SEQ ID NO: 2253095 - DNA, 12 bp, Homo sapiens
tttagtgaaaaa

SEQ ID NO: 2253096 - DNA, 16 bp, Homo sapiens
tttataaaatggctgt

SEQ ID NO: 2253097 - DNA, 13 bp, Homo sapiens
tttatacaaatta

SEQ ID NO: 2253098 - DNA, 17 bp, Homo sapiens
tttatacaaattagaaa

SEQ ID NO: 2253099 - DNA, 19 bp, Homo sapiens
tttatacaaattagaaaat

SEQ ID NO: 2253100 - DNA, 21 bp, Homo sapiens
tttataggactgttctttgct

SEQ ID NO: 2253101 - DNA, 17 bp, Homo sapiens
tttatataaagtattct

SEQ ID NO: 2253102 - DNA, 19 bp, Homo sapiens
tttatatgaagataagtgt

SEQ ID NO: 2253103 - DNA, 14 bp, Homo sapiens
tttatcaagcattt

SEQ ID NO: 2253104 - DNA, 18 bp, Homo sapiens
tttatcaagcatttacca

SEQ ID NO: 2253105 - DNA, 12 bp, Homo sapiens
tttattaatgca

SEQ ID NO: 2253106 - DNA, 17 bp, Homo sapiens
tttattaccccctcctt

SEQ ID NO: 2253107 - DNA, 16 bp, Homo sapiens
tttattatttatttat

SEQ ID NO: 2253108 - DNA, 17 bp, Homo sapiens
tttattgttaatacaag

SEQ ID NO: 2253109 - DNA, 21 bp, Homo sapiens
tttatttatccagaaaactgt

SEQ ID NO: 2253110 - DNA, 13 bp, Homo sapiens
tttatttcctgta

SEQ ID NO: 2253111 - DNA, 13 bp, Homo sapiens
tttatttctttta

SEQ ID NO: 2253112 - DNA, 18 bp, Homo sapiens
tttattttgagatgtaaa

SEQ ID NO: 2253113 - DNA, 20 bp, Homo sapiens
tttcaataaagcatttataa

SEQ ID NO: 2253114 - DNA, 13 bp, Homo sapiens
tttcacactggat

SEQ ID NO: 2253115 - DNA, 18 bp, Homo sapiens
tttcagcattaagctgtt

SEQ ID NO: 2253116 - DNA, 15 bp, Homo sapiens
tttcagcttctctgc

SEQ ID NO: 2253117 - DNA, 20 bp, Homo sapiens
tttcaggaaatctacttcct

SEQ ID NO: 2253118 - DNA, 13 bp, Homo sapiens
tttcataatttgt

SEQ ID NO: 2253119 - DNA, 17 bp, Homo sapiens
tttcatattttaaacag

SEQ ID NO: 2253120 - DNA, 21 bp, Homo sapiens
tttcatccagtttgttctccg

SEQ ID NO: 2253121 - DNA, 16 bp, Homo sapiens
tttcattttaaaaagt

SEQ ID NO: 2253122 - DNA, 13 bp, Homo sapiens
tttccaaattatt

SEQ ID NO: 2253123 - DNA, 22 bp, Homo sapiens
tttccaaattatttcttaatta

SEQ ID NO: 2253124 - DNA, 13 bp, Homo sapiens
tttccaagctgcg

SEQ ID NO: 2253125 - DNA, 19 bp, Homo sapiens
tttccagacttccttgaga

SEQ ID NO: 2253126 - DNA, 19 bp, Homo sapiens
tttccatagtgttaactgt

SEQ ID NO: 2253127 - DNA, 15 bp, Homo sapiens
tttccctcaccccct

SEQ ID NO: 2253128 - DNA, 19 bp, Homo sapiens
tttccctcaccccctccca

SEQ ID NO: 2253129 - DNA, 16 bp, Homo sapiens
tttcccttcagtaccc

SEQ ID NO: 2253130 - DNA, 20 bp, Homo sapiens
tttcccttcagtaccctctc

SEQ ID NO: 2253131 - DNA, 17 bp, Homo sapiens
tttcctatcatgttaac

SEQ ID NO: 2253132 - DNA, 16 bp, Homo sapiens
tttcgaagtcattaaa

SEQ ID NO: 2253133 - DNA, 15 bp, Homo sapiens
tttcgagtaaacttg

SEQ ID NO: 2253134 - DNA, 22 bp, Homo sapiens
tttctacaatgtgaactttatt

SEQ ID NO: 2253135 - DNA, 17 bp, Homo sapiens
tttctacattaacttga

SEQ ID NO: 2253136 - DNA, 21 bp, Homo sapiens
tttctccctgttcctttgagt

SEQ ID NO: 2253137 - DNA, 21 bp, Homo sapiens
tttcttaattattataaaaat

SEQ ID NO: 2253138 - DNA, 21 bp, Homo sapiens
tttcttaattttcaccgagca

SEQ ID NO: 2253139 - DNA, 18 bp, Homo sapiens
tttctttaatgcttttat

SEQ ID NO: 2253140 - DNA, 23 bp, Homo sapiens
tttgaaaagcaatattgtatatt

SEQ ID NO: 2253141 - DNA, 16 bp, Homo sapiens
tttgaaaagcagacat

SEQ ID NO: 2253142 - DNA, 18 bp, Homo sapiens
tttgaaaagcagacattt

SEQ ID NO: 2253143 - DNA, 23 bp, Homo sapiens
tttgaaatgacatgttcctttaa

SEQ ID NO: 2253144 - DNA, 21 bp, Homo sapiens
tttgaacaatgaagttgaaaa

SEQ ID NO: 2253145 - DNA, 18 bp, Homo sapiens
tttgaagggagaagacac

SEQ ID NO: 2253146 - DNA, 20 bp, Homo sapiens
tttgaagggagaagacactg

SEQ ID NO: 2253147 - DNA, 20 bp, Homo sapiens
tttgactctggcaaagcttt

SEQ ID NO: 2253148 - DNA, 22 bp, Homo sapiens
tttgatagaaaggaacacgttt

SEQ ID NO: 2253149 - DNA, 21 bp, Homo sapiens
tttgatgaggtattttttcct

SEQ ID NO: 2253150 - DNA, 17 bp, Homo sapiens
tttgatgcatgtctttt

SEQ ID NO: 2253151 - DNA, 20 bp, Homo sapiens
tttgcaaaataagtaaataa

SEQ ID NO: 2253152 - DNA, 17 bp, Homo sapiens
tttgcaccaaagacatc

SEQ ID NO: 2253153 - DNA, 21 bp, Homo sapiens
tttgcataatgcaatcaaaaa

SEQ ID NO: 2253154 - DNA, 21 bp, Homo sapiens
tttgctatagttatacatcaa

SEQ ID NO: 2253155 - DNA, 18 bp, Homo sapiens
tttgctgtatatttgtga

SEQ ID NO: 2253156 - DNA, 16 bp, Homo sapiens
tttgcttagaaaagaa

SEQ ID NO: 2253157 - DNA, 14 bp, Homo sapiens
tttgctttggaaac

SEQ ID NO: 2253158 - DNA, 16 bp, Homo sapiens
tttggaaagactggac

SEQ ID NO: 2253159 - DNA, 19 bp, Homo sapiens
tttggctggtagcagcagg

SEQ ID NO: 2253160 - DNA, 21 bp, Homo sapiens
tttggtgcttctcagatttct

SEQ ID NO: 2253161 - DNA, 20 bp, Homo sapiens
tttggtgctttttataaaaa

SEQ ID NO: 2253162 - DNA, 14 bp, Homo sapiens
tttgtaaataggat

SEQ ID NO: 2253163 - DNA, 13 bp, Homo sapiens
tttgtaacattag

SEQ ID NO: 2253164 - DNA, 20 bp, Homo sapiens
tttgtaacccagattttgct

SEQ ID NO: 2253165 - DNA, 21 bp, Homo sapiens
tttgtaacccagattttgctg

SEQ ID NO: 2253166 - DNA, 19 bp, Homo sapiens
tttgtaagatatttgcagt

SEQ ID NO: 2253167 - DNA, 19 bp, Homo sapiens
tttgtatataggcttctca

SEQ ID NO: 2253168 - DNA, 14 bp, Homo sapiens
tttgtattgtatat

SEQ ID NO: 2253169 - DNA, 15 bp, Homo sapiens
tttgtcacttttcct

SEQ ID NO: 2253170 - DNA, 15 bp, Homo sapiens
tttgtcagtatggct

SEQ ID NO: 2253171 - DNA, 20 bp, Homo sapiens
tttgtccaattgtgtagacg

SEQ ID NO: 2253172 - DNA, 13 bp, Homo sapiens
tttgtgctgtggg

SEQ ID NO: 2253173 - DNA, 17 bp, Homo sapiens
tttgtgtccgctaaata

SEQ ID NO: 2253174 - DNA, 21 bp, Homo sapiens
tttgttactctcttccacatg

SEQ ID NO: 2253175 - DNA, 13 bp, Homo sapiens
tttgttctgtata

SEQ ID NO: 2253176 - DNA, 15 bp, Homo sapiens
tttgttgctgtcaag

SEQ ID NO: 2253177 - DNA, 18 bp, Homo sapiens
tttgtttttatttaaatt

SEQ ID NO: 2253178 - DNA, 18 bp, Homo sapiens
ttttaaaaaatattttct

SEQ ID NO: 2253179 - DNA, 21 bp, Homo sapiens
ttttaaataaaagcacaagta

SEQ ID NO: 2253180 - DNA, 15 bp, Homo sapiens
ttttaaatattttct

SEQ ID NO: 2253181 - DNA, 17 bp, Homo sapiens
ttttaaattaatatctt

SEQ ID NO: 2253182 - DNA, 21 bp, Homo sapiens
aaaatactatttaagatgtga

SEQ ID NO: 2253183 - DNA, 23 bp, Homo sapiens
aaaatagatataaatttttaaga

SEQ ID NO: 2253184 - DNA, 18 bp, Homo sapiens
aaaatagattttataaga

SEQ ID NO: 2253185 - DNA, 17 bp, Homo sapiens
aaaataggctttttaat

SEQ ID NO: 2253186 - DNA, 14 bp, Homo sapiens
aaaatattctctat

SEQ ID NO: 2253187 - DNA, 19 bp, Homo sapiens
aaaatattgttttacaata

SEQ ID NO: 2253188 - DNA, 12 bp, Homo sapiens
aaaatattttga

SEQ ID NO: 2253189 - DNA, 23 bp, Homo sapiens
aaaatctaagcagcttattgttt

SEQ ID NO: 2253190 - DNA, 22 bp, Homo sapiens
aaaatgagactttctaaatcaa

SEQ ID NO: 2253191 - DNA, 15 bp, Homo sapiens
aaaatgagagctgta

SEQ ID NO: 2253192 - DNA, 19 bp, Homo sapiens
aaaatgagagctgtaactg

SEQ ID NO: 2253193 - DNA, 23 bp, Homo sapiens
aaaatgatgtgtacccaaacgtg

SEQ ID NO: 2253194 - DNA, 15 bp, Homo sapiens
aaaatgtatgtctgg

SEQ ID NO: 2253195 - DNA, 17 bp, Homo sapiens
aaaattactgtgaattg

SEQ ID NO: 2253196 - DNA, 16 bp, Homo sapiens
aaaattatcctctttg

SEQ ID NO: 2253197 - DNA, 14 bp, Homo sapiens
aaaattcaattgta

SEQ ID NO: 2253198 - DNA, 17 bp, Homo sapiens
aaaattggttggagaat

SEQ ID NO: 2253199 - DNA, 16 bp, Homo sapiens
aaaattgtttagtgat

SEQ ID NO: 2253200 - DNA, 19 bp, Homo sapiens
aaaatttgactaattttac

SEQ ID NO: 2253201 - DNA, 22 bp, Homo sapiens
aaaatttgtctgaaacatttca

SEQ ID NO: 2253202 - DNA, 13 bp, Homo sapiens
aaaatttgttgca

SEQ ID NO: 2253203 - DNA, 14 bp, Homo sapiens
aaaatttgttgcat

SEQ ID NO: 2253204 - DNA, 20 bp, Homo sapiens
aaacaaaggcctaattctat

SEQ ID NO: 2253205 - DNA, 17 bp, Homo sapiens
aaacagatttggaaaga

SEQ ID NO: 2253206 - DNA, 15 bp, Homo sapiens
aaacagtgtgtaaac

SEQ ID NO: 2253207 - DNA, 14 bp, Homo sapiens
aaacatagaaatgg

SEQ ID NO: 2253208 - DNA, 14 bp, Homo sapiens
aaacatttcataat

SEQ ID NO: 2253209 - DNA, 21 bp, Homo sapiens
aaacatttcataatttgtttc

SEQ ID NO: 2253210 - DNA, 16 bp, Homo sapiens
aaaccagaaaagcaat

SEQ ID NO: 2253211 - DNA, 16 bp, Homo sapiens
aaaccaggaccctgtc

SEQ ID NO: 2253212 - DNA, 18 bp, Homo sapiens
aaacccacctgctagtgt

SEQ ID NO: 2253213 - DNA, 16 bp, Homo sapiens
aaacctaaagaggaaa

SEQ ID NO: 2253214 - DNA, 23 bp, Homo sapiens
aaacctaaagaggaaaagtgcaa

SEQ ID NO: 2253215 - DNA, 18 bp, Homo sapiens
aaacctgggattcaggaa

SEQ ID NO: 2253216 - DNA, 21 bp, Homo sapiens
aaacctgggattcaggaatgt

SEQ ID NO: 2253217 - DNA, 16 bp, Homo sapiens
aaacctgtagaatcaa

SEQ ID NO: 2253218 - DNA, 17 bp, Homo sapiens
aaacgggaacatgcccc

SEQ ID NO: 2253219 - DNA, 16 bp, Homo sapiens
aaacgtggttacatta

SEQ ID NO: 2253220 - DNA, 17 bp, Homo sapiens
aaactaaaaaattaaac

SEQ ID NO: 2253221 - DNA, 14 bp, Homo sapiens
aaactagtttttcc

SEQ ID NO: 2253222 - DNA, 16 bp, Homo sapiens
aaactatgtgtttttc

SEQ ID NO: 2253223 - DNA, 15 bp, Homo sapiens
aaactatttttgtaa

SEQ ID NO: 2253224 - DNA, 20 bp, Homo sapiens
aaactatttttgtaaaagac

SEQ ID NO: 2253225 - DNA, 22 bp, Homo sapiens
aaactctgttacactttttgga

SEQ ID NO: 2253226 - DNA, 14 bp, Homo sapiens
aaactgcatctgga

SEQ ID NO: 2253227 - DNA, 12 bp, Homo sapiens
aaactgggaaac

SEQ ID NO: 2253228 - DNA, 20 bp, Homo sapiens
aaactggggcctccagaact

SEQ ID NO: 2253229 - DNA, 11 bp, Homo sapiens
aaacttgaaaa

SEQ ID NO: 2253230 - DNA, 14 bp, Homo sapiens
aaactttaaacctg

SEQ ID NO: 2253231 - DNA, 22 bp, Homo sapiens
aaactttaaacctgtagaatca

SEQ ID NO: 2253232 - DNA, 11 bp, Homo sapiens
aaagaaatatt

SEQ ID NO: 2253233 - DNA, 18 bp, Homo sapiens
aaagaacgctgatttaaa

SEQ ID NO: 2253234 - DNA, 20 bp, Homo sapiens
aaagaacgctgatttaaaga

SEQ ID NO: 2253235 - DNA, 15 bp, Homo sapiens
aaagaaggacccaga

SEQ ID NO: 2253236 - DNA, 16 bp, Homo sapiens
aaagaatttagtatta

SEQ ID NO: 2253237 - DNA, 14 bp, Homo sapiens
aaagacctacctcc

SEQ ID NO: 2253238 - DNA, 23 bp, Homo sapiens
aaagactggcttttattaatgca

SEQ ID NO: 2253239 - DNA, 18 bp, Homo sapiens
aaagaggtcgcttgggaa

SEQ ID NO: 2253240 - DNA, 17 bp, Homo sapiens
aaagatgaatttgtcca

SEQ ID NO: 2253241 - DNA, 20 bp, Homo sapiens
aaagatgagctttgtctact

SEQ ID NO: 2253242 - DNA, 14 bp, Homo sapiens
aaagcaaaacaaaa

SEQ ID NO: 2253243 - DNA, 15 bp, Homo sapiens
aaagcaattatattg

SEQ ID NO: 2253244 - DNA, 16 bp, Homo sapiens
aaagcaattatattgt

SEQ ID NO: 2253245 - DNA, 18 bp, Homo sapiens
aaagcatgaaatgtgaat

SEQ ID NO: 2253246 - DNA, 20 bp, Homo sapiens
aaagccaaccttcaaagaaa

SEQ ID NO: 2253247 - DNA, 17 bp, Homo sapiens
aaagccctcccccttcc

SEQ ID NO: 2253248 - DNA, 21 bp, Homo sapiens
aaagctaccatttatcaagca

SEQ ID NO: 2253249 - DNA, 13 bp, Homo sapiens
aaagctcccgcgg

SEQ ID NO: 2253250 - DNA, 15 bp, Homo sapiens
aaagcttaaaaaaat

SEQ ID NO: 2253251 - DNA, 19 bp, Homo sapiens
aaaggaacacgtttttaca

SEQ ID NO: 2253252 - DNA, 20 bp, Homo sapiens
aaaggaatgaacttgttact

SEQ ID NO: 2253253 - DNA, 19 bp, Homo sapiens
aaaggaccagctttgagct

SEQ ID NO: 2253254 - DNA, 19 bp, Homo sapiens
aaagggaaagttttgttct

SEQ ID NO: 2253255 - DNA, 19 bp, Homo sapiens
aaaggttatgttcattttt

SEQ ID NO: 2253256 - DNA, 20 bp, Homo sapiens
aaagtaatcagcatatgtgt

SEQ ID NO: 2253257 - DNA, 22 bp, Homo sapiens
aaagtattcttctcttcctttt

SEQ ID NO: 2253258 - DNA, 15 bp, Homo sapiens
aaagtattctttttc

SEQ ID NO: 2253259 - DNA, 16 bp, Homo sapiens
aaagtattctttttct

SEQ ID NO: 2253260 - DNA, 21 bp, Homo sapiens
aaagtccataccttatatatg

SEQ ID NO: 2253261 - DNA, 20 bp, Homo sapiens
aaagtctgttgattaaagat

SEQ ID NO: 2253262 - DNA, 16 bp, Homo sapiens
aaagttaccagtgcct

SEQ ID NO: 2253263 - DNA, 12 bp, Homo sapiens
aaagttactagg

SEQ ID NO: 2253264 - DNA, 13 bp, Homo sapiens
aaataaaatactt

SEQ ID NO: 2253265 - DNA, 15 bp, Homo sapiens
aaataaaatttgttg

SEQ ID NO: 2253266 - DNA, 18 bp, Homo sapiens
aaataaaatttgttgcat

SEQ ID NO: 2253267 - DNA, 20 bp, Homo sapiens
aaataaagtttgcttagaaa

SEQ ID NO: 2253268 - DNA, 13 bp, Homo sapiens
aaataaatatacc

SEQ ID NO: 2253269 - DNA, 15 bp, Homo sapiens
aaataacccataatt

SEQ ID NO: 2253270 - DNA, 20 bp, Homo sapiens
aaataactggaacaaattat

SEQ ID NO: 2253271 - DNA, 19 bp, Homo sapiens
aaataagtaaataataaat

SEQ ID NO: 2253272 - DNA, 20 bp, Homo sapiens
aaataattatttattacata

SEQ ID NO: 2253273 - DNA, 13 bp, Homo sapiens
aaatacaaagtta

SEQ ID NO: 2253274 - DNA, 17 bp, Homo sapiens
aaatacatttaaaacat

SEQ ID NO: 2253275 - DNA, 14 bp, Homo sapiens
aaatacttgtttca

SEQ ID NO: 2253276 - DNA, 21 bp, Homo sapiens
aaatacttgtttcagcttctc

SEQ ID NO: 2253277 - DNA, 21 bp, Homo sapiens
aaatagattttataagatgac

SEQ ID NO: 2253278 - DNA, 14 bp, Homo sapiens
aaataggattttta

SEQ ID NO: 2253279 - DNA, 15 bp, Homo sapiens
aaatatacaaaactt

SEQ ID NO: 2253280 - DNA, 20 bp, Homo sapiens
aaatataccactctttacct

SEQ ID NO: 2253281 - DNA, 20 bp, Homo sapiens
aaatatagagatatttttgt

SEQ ID NO: 2253282 - DNA, 17 bp, Homo sapiens
aaatatggaacttacat

SEQ ID NO: 2253283 - DNA, 18 bp, Homo sapiens
aaatatggaacttacatt

SEQ ID NO: 2253284 - DNA, 19 bp, Homo sapiens
aaatattaggcttaaaaac

SEQ ID NO: 2253285 - DNA, 21 bp, Homo sapiens
aaatattatttgtgtttccta

SEQ ID NO: 2253286 - DNA, 17 bp, Homo sapiens
aaatatttaccttgaaa

SEQ ID NO: 2253287 - DNA, 22 bp, Homo sapiens
aaatatttagatgtaattttgt

SEQ ID NO: 2253288 - DNA, 12 bp, Homo sapiens
aaatatttatct

SEQ ID NO: 2253289 - DNA, 12 bp, Homo sapiens
aaatattttcat

SEQ ID NO: 2253290 - DNA, 18 bp, Homo sapiens
aatgtgaatttttattgt

SEQ ID NO: 2253291 - DNA, 17 bp, Homo sapiens
aatgtgagtgtgtttgt

SEQ ID NO: 2253292 - DNA, 21 bp, Homo sapiens
aatgtggtgacacctccccct

SEQ ID NO: 2253293 - DNA, 12 bp, Homo sapiens
aatgtgtcattg

SEQ ID NO: 2253294 - DNA, 22 bp, Homo sapiens
aatgttaaggacttctgcagct

SEQ ID NO: 2253295 - DNA, 14 bp, Homo sapiens
aatgttgtagtgtc

SEQ ID NO: 2253296 - DNA, 14 bp, Homo sapiens
aattaaaaattttt

SEQ ID NO: 2253297 - DNA, 17 bp, Homo sapiens
aattaatatctttctgc

SEQ ID NO: 2253298 - DNA, 15 bp, Homo sapiens
aattacaattttatc

SEQ ID NO: 2253299 - DNA, 19 bp, Homo sapiens
aattacaattttatctgtt

SEQ ID NO: 2253300 - DNA, 14 bp, Homo sapiens
aattaccttctatt

SEQ ID NO: 2253301 - DNA, 16 bp, Homo sapiens
aattagaaaatattct

SEQ ID NO: 2253302 - DNA, 14 bp, Homo sapiens
aattatactacttt

SEQ ID NO: 2253303 - DNA, 16 bp, Homo sapiens
aattatctatacatat

SEQ ID NO: 2253304 - DNA, 17 bp, Homo sapiens
aattatttcttaattat

SEQ ID NO: 2253305 - DNA, 20 bp, Homo sapiens
aattcaaactggggcctcca

SEQ ID NO: 2253306 - DNA, 17 bp, Homo sapiens
aattcaattgtaaattg

SEQ ID NO: 2253307 - DNA, 19 bp, Homo sapiens
aattcaattgtaaattgaa

SEQ ID NO: 2253308 - DNA, 18 bp, Homo sapiens
aattcatagtaagattga

SEQ ID NO: 2253309 - DNA, 18 bp, Homo sapiens
aattcatcccaactgtct

SEQ ID NO: 2253310 - DNA, 16 bp, Homo sapiens
aattcatctgtctata

SEQ ID NO: 2253311 - DNA, 16 bp, Homo sapiens
aattccctccccctcc

SEQ ID NO: 2253312 - DNA, 17 bp, Homo sapiens
aattccctccccctcct

SEQ ID NO: 2253313 - DNA, 17 bp, Homo sapiens
aattctaacccaggtat

SEQ ID NO: 2253314 - DNA, 13 bp, Homo sapiens
aattctatgcctg

SEQ ID NO: 2253315 - DNA, 19 bp, Homo sapiens
aattctgtttttaatgcta

SEQ ID NO: 2253316 - DNA, 17 bp, Homo sapiens
aattgaagtgtataata

SEQ ID NO: 2253317 - DNA, 22 bp, Homo sapiens
aattgaagtgtataatataaaa

SEQ ID NO: 2253318 - DNA, 21 bp, Homo sapiens
aattgaatcagtataaacaaa

SEQ ID NO: 2253319 - DNA, 17 bp, Homo sapiens
aattgaggggattaata

SEQ ID NO: 2253320 - DNA, 13 bp, Homo sapiens
aattggggcactt

SEQ ID NO: 2253321 - DNA, 24 bp, Homo sapiens
aattgtaaattgaatcagtataaa

SEQ ID NO: 2253322 - DNA, 19 bp, Homo sapiens
aattgtcattatttttgtt

SEQ ID NO: 2253323 - DNA, 15 bp, Homo sapiens
aattgtctttaaaaa

SEQ ID NO: 2253324 - DNA, 12 bp, Homo sapiens
aatttaatgaaa

SEQ ID NO: 2253325 - DNA, 11 bp, Homo sapiens
aatttaatggg

SEQ ID NO: 2253326 - DNA, 16 bp, Homo sapiens
aatttactcacagcac

SEQ ID NO: 2253327 - DNA, 21 bp, Homo sapiens
aatttactcacagcacttgtt

SEQ ID NO: 2253328 - DNA, 12 bp, Homo sapiens
aatttagtatta

SEQ ID NO: 2253329 - DNA, 23 bp, Homo sapiens
aatttctatgaaggatccatctt

SEQ ID NO: 2253330 - DNA, 17 bp, Homo sapiens
aatttgactaattttac

SEQ ID NO: 2253331 - DNA, 22 bp, Homo sapiens
aatttgtctgaaacatttcata

SEQ ID NO: 2253332 - DNA, 15 bp, Homo sapiens
aattttaaaaatcta

SEQ ID NO: 2253333 - DNA, 19 bp, Homo sapiens
aattttaaataatgtattt

SEQ ID NO: 2253334 - DNA, 23 bp, Homo sapiens
aattttaaataatgtatttactt

SEQ ID NO: 2253335 - DNA, 20 bp, Homo sapiens
aattttacatgtttataaat

SEQ ID NO: 2253336 - DNA, 23 bp, Homo sapiens
aattttcctcaatcacactacac

SEQ ID NO: 2253337 - DNA, 12 bp, Homo sapiens
aattttctttca

SEQ ID NO: 2253338 - DNA, 18 bp, Homo sapiens
aattttgtgtaagaaata

SEQ ID NO: 2253339 - DNA, 20 bp, Homo sapiens
aatttttaaaatacttgttt

SEQ ID NO: 2253340 - DNA, 14 bp, Homo sapiens
aatttttaagagaa

SEQ ID NO: 2253341 - DNA, 14 bp, Homo sapiens
aatttttaatgatg

SEQ ID NO: 2253342 - DNA, 12 bp, Homo sapiens
aatttttgtatt

SEQ ID NO: 2253343 - DNA, 12 bp, Homo sapiens
acaaaatataca

SEQ ID NO: 2253344 - DNA, 18 bp, Homo sapiens
acaaaccataactgacaa

SEQ ID NO: 2253345 - DNA, 14 bp, Homo sapiens
acaaactagaaaag

SEQ ID NO: 2253346 - DNA, 16 bp, Homo sapiens
acaaactgatttctca

SEQ ID NO: 2253347 - DNA, 21 bp, Homo sapiens
acaaagttactaggtaacttc

SEQ ID NO: 2253348 - DNA, 14 bp, Homo sapiens
acaaatattttcat

SEQ ID NO: 2253349 - DNA, 16 bp, Homo sapiens
acaaatattttcatgt

SEQ ID NO: 2253350 - DNA, 14 bp, Homo sapiens
acaacaatccttct

SEQ ID NO: 2253351 - DNA, 21 bp, Homo sapiens
acaacatcgcaatagtttttt

SEQ ID NO: 2253352 - DNA, 17 bp, Homo sapiens
acaagaaataatagaaa

SEQ ID NO: 2253353 - DNA, 14 bp, Homo sapiens
acaagcaatgcaag

SEQ ID NO: 2253354 - DNA, 19 bp, Homo sapiens
acaagcaatgcaagaaaaa

SEQ ID NO: 2253355 - DNA, 14 bp, Homo sapiens
acaagccaaagagc

SEQ ID NO: 2253356 - DNA, 23 bp, Homo sapiens
acaagccaaagagcctcccacca

SEQ ID NO: 2253357 - DNA, 12 bp, Homo sapiens
acaagccagcca

SEQ ID NO: 2253358 - DNA, 21 bp, Homo sapiens
acaagtactggctctttattc

SEQ ID NO: 2253359 - DNA, 13 bp, Homo sapiens
acaagtacttttg

SEQ ID NO: 2253360 - DNA, 14 bp, Homo sapiens
acaagtgataatac

SEQ ID NO: 2253361 - DNA, 18 bp, Homo sapiens
acaagtgataatacagat

SEQ ID NO: 2253362 - DNA, 14 bp, Homo sapiens
acaataaaattttt

SEQ ID NO: 2253363 - DNA, 22 bp, Homo sapiens
acaatgtgaactttattaaata

SEQ ID NO: 2253364 - DNA, 13 bp, Homo sapiens
acaattgggagct

SEQ ID NO: 2253365 - DNA, 20 bp, Homo sapiens
acaattgggagctgccaaga

SEQ ID NO: 2253366 - DNA, 21 bp, Homo sapiens
acaatttttatttcttttact

SEQ ID NO: 2253367 - DNA, 20 bp, Homo sapiens
acacaaatgtgatttttgta

SEQ ID NO: 2253368 - DNA, 22 bp, Homo sapiens
acacaagaagaagggcacccta

SEQ ID NO: 2253369 - DNA, 15 bp, Homo sapiens
acacacttacagagc

SEQ ID NO: 2253370 - DNA, 18 bp, Homo sapiens
acacagcttaacaatgca

SEQ ID NO: 2253371 - DNA, 16 bp, Homo sapiens
acacatgccactatga

SEQ ID NO: 2253372 - DNA, 18 bp, Homo sapiens
acaccatcttttattctt

SEQ ID NO: 2253373 - DNA, 15 bp, Homo sapiens
acacccaatgctgct

SEQ ID NO: 2253374 - DNA, 16 bp, Homo sapiens
acacccaatgctgctc

SEQ ID NO: 2253375 - DNA, 18 bp, Homo sapiens
acacccatgccagagagg

SEQ ID NO: 2253376 - DNA, 12 bp, Homo sapiens
acacctagaaag

SEQ ID NO: 2253377 - DNA, 13 bp, Homo sapiens
acacctccccctt

SEQ ID NO: 2253378 - DNA, 20 bp, Homo sapiens
acaccttccagctcctgtaa

SEQ ID NO: 2253379 - DNA, 22 bp, Homo sapiens
acactcagtggcccatggcatt

SEQ ID NO: 2253380 - DNA, 20 bp, Homo sapiens
acactgcagtgaccacttat

SEQ ID NO: 2253381 - DNA, 21 bp, Homo sapiens
acactggatccatcttgagcc

SEQ ID NO: 2253382 - DNA, 18 bp, Homo sapiens
acacttagccattgaaat

SEQ ID NO: 2253383 - DNA, 12 bp, Homo sapiens
acacttcatttt

SEQ ID NO: 2253384 - DNA, 15 bp, Homo sapiens
acacttgtcagcctc

SEQ ID NO: 2253385 - DNA, 13 bp, Homo sapiens
acagaataaaaga

SEQ ID NO: 2253386 - DNA, 21 bp, Homo sapiens
acagaatgtgtctcaggaaaa

SEQ ID NO: 2253387 - DNA, 16 bp, Homo sapiens
acagagccaaaatgcc

SEQ ID NO: 2253388 - DNA, 14 bp, Homo sapiens
acagaggtaactat

SEQ ID NO: 2253389 - DNA, 21 bp, Homo sapiens
acagatcaacaataccttttt

SEQ ID NO: 2253390 - DNA, 18 bp, Homo sapiens
acagattgaaaagaccta

SEQ ID NO: 2253391 - DNA, 21 bp, Homo sapiens
acagatttggaaagactggac

SEQ ID NO: 2253392 - DNA, 20 bp, Homo sapiens
acagcagccccccagcacta

SEQ ID NO: 2253393 - DNA, 21 bp, Homo sapiens
acagccagttttactgtgatt

SEQ ID NO: 2253394 - DNA, 21 bp, Homo sapiens
acagcccaggatactggcaca

SEQ ID NO: 2253395 - DNA, 13 bp, Homo sapiens
acagcctctgtga

SEQ ID NO: 2253396 - DNA, 19 bp, Homo sapiens
acaggaaagccctccccct

SEQ ID NO: 2253397 - DNA, 21 bp, Homo sapiens
acaggcccccttgagtggggt

SEQ ID NO: 2253398 - DNA, 14 bp, Homo sapiens
acaggtaaaacagg

SEQ ID NO: 2253399 - DNA, 14 bp, Homo sapiens
agactctttgaaat

SEQ ID NO: 2253400 - DNA, 18 bp, Homo sapiens
agactggcttttattaat

SEQ ID NO: 2253401 - DNA, 22 bp, Homo sapiens
agagaactcgcgctcagtaaac

SEQ ID NO: 2253402 - DNA, 16 bp, Homo sapiens
agagacagcccaggat

SEQ ID NO: 2253403 - DNA, 15 bp, Homo sapiens
agagacggtgttttg

SEQ ID NO: 2253404 - DNA, 12 bp, Homo sapiens
agagagccaaga

SEQ ID NO: 2253405 - DNA, 19 bp, Homo sapiens
agagatctttctttccaaa

SEQ ID NO: 2253406 - DNA, 19 bp, Homo sapiens
agagccaagacggaggagg

SEQ ID NO: 2253407 - DNA, 20 bp, Homo sapiens
agagccaagacggaggaggg

SEQ ID NO: 2253408 - DNA, 17 bp, Homo sapiens
agagccagcctggctct

SEQ ID NO: 2253409 - DNA, 19 bp, Homo sapiens
agagccagcctggctctgc

SEQ ID NO: 2253410 - DNA, 14 bp, Homo sapiens
agagccctgaggcc

SEQ ID NO: 2253411 - DNA, 22 bp, Homo sapiens
agagccctgaggcctagactct

SEQ ID NO: 2253412 - DNA, 16 bp, Homo sapiens
agagcgaggaaaggat

SEQ ID NO: 2253413 - DNA, 17 bp, Homo sapiens
agagctttgtcgtattt

SEQ ID NO: 2253414 - DNA, 14 bp, Homo sapiens
agaggagaaactga

SEQ ID NO: 2253415 - DNA, 17 bp, Homo sapiens
agaggatgctgggctct

SEQ ID NO: 2253416 - DNA, 20 bp, Homo sapiens
agaggcgtctgctgtctcat

SEQ ID NO: 2253417 - DNA, 10 bp, Homo sapiens
agaggctcag

SEQ ID NO: 2253418 - DNA, 16 bp, Homo sapiens
agaggctgcccctctc

SEQ ID NO: 2253419 - DNA, 18 bp, Homo sapiens
agaggctgcccctctcac

SEQ ID NO: 2253420 - DNA, 14 bp, Homo sapiens
agaggctgtctgtt

SEQ ID NO: 2253421 - DNA, 19 bp, Homo sapiens
agaggtggggatcctgcct

SEQ ID NO: 2253422 - DNA, 13 bp, Homo sapiens
agagtcaaagctg

SEQ ID NO: 2253423 - DNA, 22 bp, Homo sapiens
agagtttttatgcctttctctc

SEQ ID NO: 2253424 - DNA, 19 bp, Homo sapiens
agataatctcagtgctttc

SEQ ID NO: 2253425 - DNA, 16 bp, Homo sapiens
agatactactttctct

SEQ ID NO: 2253426 - DNA, 15 bp, Homo sapiens
agatataaattttta

SEQ ID NO: 2253427 - DNA, 23 bp, Homo sapiens
agatatagcattaataaaactgt

SEQ ID NO: 2253428 - DNA, 13 bp, Homo sapiens
agatcagtaaaga

SEQ ID NO: 2253429 - DNA, 16 bp, Homo sapiens
agatcgctcactgttg

SEQ ID NO: 2253430 - DNA, 17 bp, Homo sapiens
agatcgctcactgttgt

SEQ ID NO: 2253431 - DNA, 13 bp, Homo sapiens
agatgaatttgtc

SEQ ID NO: 2253432 - DNA, 14 bp, Homo sapiens
agatgaatttgtcc

SEQ ID NO: 2253433 - DNA, 16 bp, Homo sapiens
agatgaatttgtccaa

SEQ ID NO: 2253434 - DNA, 19 bp, Homo sapiens
agatgcaacctcactatgg

SEQ ID NO: 2253435 - DNA, 21 bp, Homo sapiens
agatgcacgtggggcccactg

SEQ ID NO: 2253436 - DNA, 17 bp, Homo sapiens
agatgccatgtgcaggt

SEQ ID NO: 2253437 - DNA, 20 bp, Homo sapiens
agatgctgatggagccttcc

SEQ ID NO: 2253438 - DNA, 14 bp, Homo sapiens
agatggtggcagta

SEQ ID NO: 2253439 - DNA, 13 bp, Homo sapiens
agatgtaaaaaga

SEQ ID NO: 2253440 - DNA, 13 bp, Homo sapiens
agatgtaattttg

SEQ ID NO: 2253441 - DNA, 13 bp, Homo sapiens
agatgtgaaaatt

SEQ ID NO: 2253442 - DNA, 15 bp, Homo sapiens
agatgtgaaaattac

SEQ ID NO: 2253443 - DNA, 15 bp, Homo sapiens
agatgtgctgacaag

SEQ ID NO: 2253444 - DNA, 22 bp, Homo sapiens
agatgtttcgagtaaacttgaa

SEQ ID NO: 2253445 - DNA, 16 bp, Homo sapiens
agattaaacttcatat

SEQ ID NO: 2253446 - DNA, 20 bp, Homo sapiens
agattaatactctattttta

SEQ ID NO: 2253447 - DNA, 12 bp, Homo sapiens
agattacactga

SEQ ID NO: 2253448 - DNA, 13 bp, Homo sapiens
agattcacacatg

SEQ ID NO: 2253449 - DNA, 19 bp, Homo sapiens
agattcacacatgccacta

SEQ ID NO: 2253450 - DNA, 16 bp, Homo sapiens
agattcaggtaataca

SEQ ID NO: 2253451 - DNA, 18 bp, Homo sapiens
agattcaggtaatacaaa

SEQ ID NO: 2253452 - DNA, 11 bp, Homo sapiens
agattctttta

SEQ ID NO: 2253453 - DNA, 21 bp, Homo sapiens
agattcttttaaattagaaaa

SEQ ID NO: 2253454 - DNA, 22 bp, Homo sapiens
agattcttttaaattagaaaat

SEQ ID NO: 2253455 - DNA, 22 bp, Homo sapiens
agattgatatctataaaataga

SEQ ID NO: 2253456 - DNA, 18 bp, Homo sapiens
agatttatacagttgaaa

SEQ ID NO: 2253457 - DNA, 10 bp, Homo sapiens
agatttctac

SEQ ID NO: 2253458 - DNA, 14 bp, Homo sapiens
agatttctgaggaa

SEQ ID NO: 2253459 - DNA, 15 bp, Homo sapiens
agatttctgaggaaa

SEQ ID NO: 2253460 - DNA, 14 bp, Homo sapiens
agatttgtaacatt

SEQ ID NO: 2253461 - DNA, 15 bp, Homo sapiens
agatttgtaacatta

SEQ ID NO: 2253462 - DNA, 16 bp, Homo sapiens
agattttatttatgcg

SEQ ID NO: 2253463 - DNA, 19 bp, Homo sapiens
agatttttaaaaaatattt

SEQ ID NO: 2253464 - DNA, 17 bp, Homo sapiens
agattttttttgtaact

SEQ ID NO: 2253465 - DNA, 23 bp, Homo sapiens
agcaaagattaaatgtgtcattg

SEQ ID NO: 2253466 - DNA, 22 bp, Homo sapiens
agcaaagcacccatttcaatgt

SEQ ID NO: 2253467 - DNA, 15 bp, Homo sapiens
agcaacctacccagc

SEQ ID NO: 2253468 - DNA, 19 bp, Homo sapiens
agcaactggttaggtagca

SEQ ID NO: 2253469 - DNA, 13 bp, Homo sapiens
agcaataaataac

SEQ ID NO: 2253470 - DNA, 21 bp, Homo sapiens
agcaatattgtatatttttat

SEQ ID NO: 2253471 - DNA, 14 bp, Homo sapiens
agcaatatttaaca

SEQ ID NO: 2253472 - DNA, 18 bp, Homo sapiens
agcaatctccttactgtg

SEQ ID NO: 2253473 - DNA, 16 bp, Homo sapiens
agcaatctgaccctat

SEQ ID NO: 2253474 - DNA, 23 bp, Homo sapiens
agcaatgcaagaaaaaaacttac

SEQ ID NO: 2253475 - DNA, 16 bp, Homo sapiens
agcacaagtacttttg

SEQ ID NO: 2253476 - DNA, 13 bp, Homo sapiens
agcaccctccccc

SEQ ID NO: 2253477 - DNA, 14 bp, Homo sapiens
agcaccctcccccg

SEQ ID NO: 2253478 - DNA, 12 bp, Homo sapiens
agcaccctctcc

SEQ ID NO: 2253479 - DNA, 18 bp, Homo sapiens
agcaccctctcctggggg

SEQ ID NO: 2253480 - DNA, 19 bp, Homo sapiens
agcaccctctcctgggggt

SEQ ID NO: 2253481 - DNA, 14 bp, Homo sapiens
agcacttgttttca

SEQ ID NO: 2253482 - DNA, 22 bp, Homo sapiens
agcagaaagggccttgaatcct

SEQ ID NO: 2253483 - DNA, 22 bp, Homo sapiens
agcagaccaccccgcctgccct

SEQ ID NO: 2253484 - DNA, 14 bp, Homo sapiens
agcagagtctgtct

SEQ ID NO: 2253485 - DNA, 15 bp, Homo sapiens
agcagagtctgtctc

SEQ ID NO: 2253486 - DNA, 16 bp, Homo sapiens
agcagagtctgtctct

SEQ ID NO: 2253487 - DNA, 15 bp, Homo sapiens
agcagcaaattttca

SEQ ID NO: 2253488 - DNA, 14 bp, Homo sapiens
agcagcaggctcag

SEQ ID NO: 2253489 - DNA, 15 bp, Homo sapiens
agcagcaggctcagg

SEQ ID NO: 2253490 - DNA, 13 bp, Homo sapiens
agcagccccccag

SEQ ID NO: 2253491 - DNA, 19 bp, Homo sapiens
agcagcccccgggccgctg

SEQ ID NO: 2253492 - DNA, 24 bp, Homo sapiens
agcaggaaggaacaaagacaggca

SEQ ID NO: 2253493 - DNA, 19 bp, Homo sapiens
agcaggcacgggtggtccc

SEQ ID NO: 2253494 - DNA, 20 bp, Homo sapiens
agcaggcacgggtggtcccc

SEQ ID NO: 2253495 - DNA, 23 bp, Homo sapiens
agcaggggaattccctccccctc

SEQ ID NO: 2253496 - DNA, 20 bp, Homo sapiens
agcagttacccaacagaaac

SEQ ID NO: 2253497 - DNA, 19 bp, Homo sapiens
agcagttggatcttttgaa

SEQ ID NO: 2253498 - DNA, 15 bp, Homo sapiens
agcatacttctagga

SEQ ID NO: 2253499 - DNA, 17 bp, Homo sapiens
agcatactttgtaaata

SEQ ID NO: 2253500 - DNA, 20 bp, Homo sapiens
agcatatgtgtaaagattta

SEQ ID NO: 2253501 - DNA, 17 bp, Homo sapiens
agcatcaaaatatttca

SEQ ID NO: 2253502 - DNA, 17 bp, Homo sapiens
agcatctgcaacaaaaa

SEQ ID NO: 2253503 - DNA, 20 bp, Homo sapiens
agcatgagagggatgaggca

SEQ ID NO: 2253504 - DNA, 13 bp, Homo sapiens
agcatgcacatgc

SEQ ID NO: 2253505 - DNA, 21 bp, Homo sapiens
agcatggtacttggcctttgg

SEQ ID NO: 2253506 - DNA, 18 bp, Homo sapiens
agcattaataaaactgtg

SEQ ID NO: 2253507 - DNA, 17 bp, Homo sapiens
agcattgtaaaagcatt

SEQ ID NO: 2253508 - DNA, 23 bp, Homo sapiens
ataatatggaaccttccctccaa

SEQ ID NO: 2253509 - DNA, 15 bp, Homo sapiens
ataatctatttacat

SEQ ID NO: 2253510 - DNA, 13 bp, Homo sapiens
ataatcttgtaga

SEQ ID NO: 2253511 - DNA, 17 bp, Homo sapiens
ataatcttgtagacact

SEQ ID NO: 2253512 - DNA, 18 bp, Homo sapiens
ataatcttgtagacactt

SEQ ID NO: 2253513 - DNA, 19 bp, Homo sapiens
ataatgatcgaaaaaataa

SEQ ID NO: 2253514 - DNA, 20 bp, Homo sapiens
ataatgatcgaaaaaataat

SEQ ID NO: 2253515 - DNA, 22 bp, Homo sapiens
ataattatttattacataattt

SEQ ID NO: 2253516 - DNA, 18 bp, Homo sapiens
ataatttagttgtttcta

SEQ ID NO: 2253517 - DNA, 13 bp, Homo sapiens
ataatttgtttcc

SEQ ID NO: 2253518 - DNA, 19 bp, Homo sapiens
atacaaagttagagaacta

SEQ ID NO: 2253519 - DNA, 18 bp, Homo sapiens
atacaaattagaaaatgt

SEQ ID NO: 2253520 - DNA, 15 bp, Homo sapiens
atacacatatagtgt

SEQ ID NO: 2253521 - DNA, 15 bp, Homo sapiens
atacagaggtaacta

SEQ ID NO: 2253522 - DNA, 15 bp, Homo sapiens
atacagttataaaat

SEQ ID NO: 2253523 - DNA, 13 bp, Homo sapiens
atacatatcttta

SEQ ID NO: 2253524 - DNA, 16 bp, Homo sapiens
atacatttaaaacatt

SEQ ID NO: 2253525 - DNA, 12 bp, Homo sapiens
ataccacttacc

SEQ ID NO: 2253526 - DNA, 23 bp, Homo sapiens
ataccattatatgttccccctgt

SEQ ID NO: 2253527 - DNA, 19 bp, Homo sapiens
ataccctggccgccccctg

SEQ ID NO: 2253528 - DNA, 14 bp, Homo sapiens
atactactttctct

SEQ ID NO: 2253529 - DNA, 19 bp, Homo sapiens
atactgaaaaaaaaagctt

SEQ ID NO: 2253530 - DNA, 16 bp, Homo sapiens
atactgcaagaaaatg

SEQ ID NO: 2253531 - DNA, 15 bp, Homo sapiens
atactgctactgtaa

SEQ ID NO: 2253532 - DNA, 16 bp, Homo sapiens
atactgctactgtaat

SEQ ID NO: 2253533 - DNA, 20 bp, Homo sapiens
atactgctactgtaatttta

SEQ ID NO: 2253534 - DNA, 22 bp, Homo sapiens
atactgctactgtaattttata

SEQ ID NO: 2253535 - DNA, 13 bp, Homo sapiens
atactggcacaga

SEQ ID NO: 2253536 - DNA, 21 bp, Homo sapiens
atactttatcaatgtgtcttt

SEQ ID NO: 2253537 - DNA, 13 bp, Homo sapiens
atagaaaggaaca

SEQ ID NO: 2253538 - DNA, 20 bp, Homo sapiens
atagaaatggaaattttgct

SEQ ID NO: 2253539 - DNA, 23 bp, Homo sapiens
atagaaatggaaattttgctatc

SEQ ID NO: 2253540 - DNA, 14 bp, Homo sapiens
atagacacatacat

SEQ ID NO: 2253541 - DNA, 18 bp, Homo sapiens
atagatataaatttttaa

SEQ ID NO: 2253542 - DNA, 14 bp, Homo sapiens
atagatataatgaa

SEQ ID NO: 2253543 - DNA, 14 bp, Homo sapiens
atagctaactgtaa

SEQ ID NO: 2253544 - DNA, 17 bp, Homo sapiens
atagctaactgtaaatc

SEQ ID NO: 2253545 - DNA, 16 bp, Homo sapiens
ataggatttttagaat

SEQ ID NO: 2253546 - DNA, 20 bp, Homo sapiens
ataggcagggggccctgccc

SEQ ID NO: 2253547 - DNA, 16 bp, Homo sapiens
atagggaaaattctaa

SEQ ID NO: 2253548 - DNA, 12 bp, Homo sapiens
ataggttatttt

SEQ ID NO: 2253549 - DNA, 14 bp, Homo sapiens
atagtaccatttat

SEQ ID NO: 2253550 - DNA, 16 bp, Homo sapiens
atagtcttgaaatgaa

SEQ ID NO: 2253551 - DNA, 18 bp, Homo sapiens
atagttactgtgtaaact

SEQ ID NO: 2253552 - DNA, 15 bp, Homo sapiens
atagttatacatcaa

SEQ ID NO: 2253553 - DNA, 17 bp, Homo sapiens
atagtttggcatttgca

SEQ ID NO: 2253554 - DNA, 15 bp, Homo sapiens
atataaaaatggctt

SEQ ID NO: 2253555 - DNA, 13 bp, Homo sapiens
atataaaataact

SEQ ID NO: 2253556 - DNA, 20 bp, Homo sapiens
atataaatttttaagagaaa

SEQ ID NO: 2253557 - DNA, 14 bp, Homo sapiens
atataagaaaatgc

SEQ ID NO: 2253558 - DNA, 15 bp, Homo sapiens
atataagaaaatgct

SEQ ID NO: 2253559 - DNA, 21 bp, Homo sapiens
atatagcattaataaaactgt

SEQ ID NO: 2253560 - DNA, 13 bp, Homo sapiens
atatagtgtacag

SEQ ID NO: 2253561 - DNA, 15 bp, Homo sapiens
atatatctatctatt

SEQ ID NO: 2253562 - DNA, 19 bp, Homo sapiens
atatatctatctatttgag

SEQ ID NO: 2253563 - DNA, 20 bp, Homo sapiens
atatatgcacttaatttgtt

SEQ ID NO: 2253564 - DNA, 16 bp, Homo sapiens
atatattgtgttgact

SEQ ID NO: 2253565 - DNA, 23 bp, Homo sapiens
atatattgtgttgactttataaa

SEQ ID NO: 2253566 - DNA, 17 bp, Homo sapiens
atatatttctattatta

SEQ ID NO: 2253567 - DNA, 15 bp, Homo sapiens
atatccccactactc

SEQ ID NO: 2253568 - DNA, 13 bp, Homo sapiens
atatctataaaat

SEQ ID NO: 2253569 - DNA, 17 bp, Homo sapiens
atatctataaaatagat

SEQ ID NO: 2253570 - DNA, 18 bp, Homo sapiens
atatctatctatttgagg

SEQ ID NO: 2253571 - DNA, 20 bp, Homo sapiens
atatggaaccttccctccaa

SEQ ID NO: 2253572 - DNA, 19 bp, Homo sapiens
atatggaacttacattgtt

SEQ ID NO: 2253573 - DNA, 20 bp, Homo sapiens
atatgtaatctctaggaagt

SEQ ID NO: 2253574 - DNA, 18 bp, Homo sapiens
atatgtgttacttcaagt

SEQ ID NO: 2253575 - DNA, 15 bp, Homo sapiens
atattaacttttaat

SEQ ID NO: 2253576 - DNA, 16 bp, Homo sapiens
atattaacttttaatg

SEQ ID NO: 2253577 - DNA, 12 bp, Homo sapiens
atattacaatga

SEQ ID NO: 2253578 - DNA, 12 bp, Homo sapiens
atattacattta

SEQ ID NO: 2253579 - DNA, 17 bp, Homo sapiens
atattatttgtgtttcc

SEQ ID NO: 2253580 - DNA, 18 bp, Homo sapiens
atattatttgtgtttcct

SEQ ID NO: 2253581 - DNA, 17 bp, Homo sapiens
atattgccattatgctt

SEQ ID NO: 2253582 - DNA, 20 bp, Homo sapiens
atattgtgttgactttataa

SEQ ID NO: 2253583 - DNA, 19 bp, Homo sapiens
atattgttttacaatagtt

SEQ ID NO: 2253584 - DNA, 22 bp, Homo sapiens
atatttaacaatttattctgat

SEQ ID NO: 2253585 - DNA, 15 bp, Homo sapiens
atatttaagtttgtt

SEQ ID NO: 2253586 - DNA, 16 bp, Homo sapiens
atatttaccttgaaaa

SEQ ID NO: 2253587 - DNA, 20 bp, Homo sapiens
atatttagatgtaattttgt

SEQ ID NO: 2253588 - DNA, 13 bp, Homo sapiens
atatttatttcag

SEQ ID NO: 2253589 - DNA, 22 bp, Homo sapiens
atatttgtgatagcactttcta

SEQ ID NO: 2253590 - DNA, 14 bp, Homo sapiens
atattttaaacaga

SEQ ID NO: 2253591 - DNA, 17 bp, Homo sapiens
atattttaactccactg

SEQ ID NO: 2253592 - DNA, 12 bp, Homo sapiens
atattttcatgt

SEQ ID NO: 2253593 - DNA, 13 bp, Homo sapiens
atattttcatgta

SEQ ID NO: 2253594 - DNA, 13 bp, Homo sapiens
atattttctgttt

SEQ ID NO: 2253595 - DNA, 15 bp, Homo sapiens
atattttgttacctt

SEQ ID NO: 2253596 - DNA, 15 bp, Homo sapiens
atatttttatctata

SEQ ID NO: 2253597 - DNA, 13 bp, Homo sapiens
atcaaaacacact

SEQ ID NO: 2253598 - DNA, 12 bp, Homo sapiens
atcaaaattaca

SEQ ID NO: 2253599 - DNA, 17 bp, Homo sapiens
atcaacaataaaatttt

SEQ ID NO: 2253600 - DNA, 16 bp, Homo sapiens
atcaataatatatttt

SEQ ID NO: 2253601 - DNA, 18 bp, Homo sapiens
atcaataatatattttct

SEQ ID NO: 2253602 - DNA, 20 bp, Homo sapiens
atcaataatatattttctgt

SEQ ID NO: 2253603 - DNA, 21 bp, Homo sapiens
atcaataatatattttctgtt

SEQ ID NO: 2253604 - DNA, 17 bp, Homo sapiens
atcaatgtgtctttcta

SEQ ID NO: 2253605 - DNA, 21 bp, Homo sapiens
atcacacaagatttgactgta

SEQ ID NO: 2253606 - DNA, 19 bp, Homo sapiens
atcacccgcccctggactt

SEQ ID NO: 2253607 - DNA, 14 bp, Homo sapiens
atcaccttctttgt

SEQ ID NO: 2253608 - DNA, 15 bp, Homo sapiens
atcaccttctttgta

SEQ ID NO: 2253609 - DNA, 19 bp, Homo sapiens
atcacttagcgaacccttt

SEQ ID NO: 2253610 - DNA, 23 bp, Homo sapiens
atcagtagttcacatacaaatca

SEQ ID NO: 2253611 - DNA, 18 bp, Homo sapiens
atcagtataaacaaagtt

SEQ ID NO: 2253612 - DNA, 18 bp, Homo sapiens
atcagtttccatgaaaga

SEQ ID NO: 2253613 - DNA, 21 bp, Homo sapiens
atcagtttccatgaaagacct

SEQ ID NO: 2253614 - DNA, 22 bp, Homo sapiens
atcataggcaccttttactgtg

SEQ ID NO: 2253615 - DNA, 23 bp, Homo sapiens
atcataggcaccttttactgtga

SEQ ID NO: 2253616 - DNA, 17 bp, Homo sapiens
atcatgtactttttagt

SEQ ID NO: 2253617 - DNA, 19 bp, Homo sapiens
attttcagcattaagctgt

SEQ ID NO: 2253618 - DNA, 13 bp, Homo sapiens
attttcctcaatc

SEQ ID NO: 2253619 - DNA, 19 bp, Homo sapiens
attttcctgttgtcaagaa

SEQ ID NO: 2253620 - DNA, 19 bp, Homo sapiens
attttctttaatgctttta

SEQ ID NO: 2253621 - DNA, 11 bp, Homo sapiens
attttgaatca

SEQ ID NO: 2253622 - DNA, 14 bp, Homo sapiens
attttgaatcaata

SEQ ID NO: 2253623 - DNA, 13 bp, Homo sapiens
attttgagatgta

SEQ ID NO: 2253624 - DNA, 18 bp, Homo sapiens
attttgatgtaaagatgt

SEQ ID NO: 2253625 - DNA, 19 bp, Homo sapiens
attttgctatcaacaataa

SEQ ID NO: 2253626 - DNA, 15 bp, Homo sapiens
attttggatgtcatt

SEQ ID NO: 2253627 - DNA, 14 bp, Homo sapiens
attttgtaataata

SEQ ID NO: 2253628 - DNA, 23 bp, Homo sapiens
attttgtaatgtatcaaatacat

SEQ ID NO: 2253629 - DNA, 17 bp, Homo sapiens
attttgtgtaagaaata

SEQ ID NO: 2253630 - DNA, 15 bp, Homo sapiens
atttttaaaaaatat

SEQ ID NO: 2253631 - DNA, 18 bp, Homo sapiens
atttttaaaaaatatttt

SEQ ID NO: 2253632 - DNA, 20 bp, Homo sapiens
atttttaaaaaatattttct

SEQ ID NO: 2253633 - DNA, 15 bp, Homo sapiens
atttttaaaatactt

SEQ ID NO: 2253634 - DNA, 15 bp, Homo sapiens
atttttatctatata

SEQ ID NO: 2253635 - DNA, 12 bp, Homo sapiens
atttttattgtt

SEQ ID NO: 2253636 - DNA, 14 bp, Homo sapiens
atttttatttcttt

SEQ ID NO: 2253637 - DNA, 11 bp, Homo sapiens
atttttcatac

SEQ ID NO: 2253638 - DNA, 20 bp, Homo sapiens
atttttgcttttagaaaagg

SEQ ID NO: 2253639 - DNA, 22 bp, Homo sapiens
atttttgtacgttatatattgt

SEQ ID NO: 2253640 - DNA, 16 bp, Homo sapiens
atttttgttactctct

SEQ ID NO: 2253641 - DNA, 20 bp, Homo sapiens
atttttgttactctcttcca

SEQ ID NO: 2253642 - DNA, 23 bp, Homo sapiens
attttttaatttctatgaaggat

SEQ ID NO: 2253643 - DNA, 16 bp, Homo sapiens
attttttgaaaagcag

SEQ ID NO: 2253644 - DNA, 19 bp, Homo sapiens
attttttgaaaagcagaca

SEQ ID NO: 2253645 - DNA, 20 bp, Homo sapiens
caaaaagaaaaaaagaaaag

SEQ ID NO: 2253646 - DNA, 17 bp, Homo sapiens
caaaaagtcatttttct

SEQ ID NO: 2253647 - DNA, 22 bp, Homo sapiens
caaaaatatttataaaacttct

SEQ ID NO: 2253648 - DNA, 19 bp, Homo sapiens
caaaaatctcccagtgaca

SEQ ID NO: 2253649 - DNA, 23 bp, Homo sapiens
caaaacaaaaattaggtattttg

SEQ ID NO: 2253650 - DNA, 15 bp, Homo sapiens
caaaacaagccaaag

SEQ ID NO: 2253651 - DNA, 12 bp, Homo sapiens
caaaacacacta

SEQ ID NO: 2253652 - DNA, 17 bp, Homo sapiens
caaaactttaaacctgt

SEQ ID NO: 2253653 - DNA, 23 bp, Homo sapiens
caaaactttatcagggaaactaa

SEQ ID NO: 2253654 - DNA, 14 bp, Homo sapiens
caaaaggaatgaac

SEQ ID NO: 2253655 - DNA, 16 bp, Homo sapiens
caaaatgtatgtctgg

SEQ ID NO: 2253656 - DNA, 15 bp, Homo sapiens
caaaattcatttcta

SEQ ID NO: 2253657 - DNA, 16 bp, Homo sapiens
caaacaaaaaagaaaa

SEQ ID NO: 2253658 - DNA, 13 bp, Homo sapiens
caaacaagaaacg

SEQ ID NO: 2253659 - DNA, 13 bp, Homo sapiens
caaacaggacagc

SEQ ID NO: 2253660 - DNA, 15 bp, Homo sapiens
caaacaggacagcac

SEQ ID NO: 2253661 - DNA, 16 bp, Homo sapiens
caaaccaggtgcaatt

SEQ ID NO: 2253662 - DNA, 21 bp, Homo sapiens
caaactggggcctccagaact

SEQ ID NO: 2253663 - DNA, 17 bp, Homo sapiens
caaacttggatttttga

SEQ ID NO: 2253664 - DNA, 18 bp, Homo sapiens
caaagaaacttgaagctt

SEQ ID NO: 2253665 - DNA, 14 bp, Homo sapiens
caaagaaatattaa

SEQ ID NO: 2253666 - DNA, 12 bp, Homo sapiens
caaagacaggca

SEQ ID NO: 2253667 - DNA, 13 bp, Homo sapiens
caaagaggctgcc

SEQ ID NO: 2253668 - DNA, 21 bp, Homo sapiens
caaagataaggactagatact

SEQ ID NO: 2253669 - DNA, 22 bp, Homo sapiens
caaagataaggactagatacta

SEQ ID NO: 2253670 - DNA, 21 bp, Homo sapiens
caaagattaaatgtgtcattg

SEQ ID NO: 2253671 - DNA, 23 bp, Homo sapiens
caaagtatgtggttttgtaattt

SEQ ID NO: 2253672 - DNA, 18 bp, Homo sapiens
caaagtgccttgctcatt

SEQ ID NO: 2253673 - DNA, 24 bp, Homo sapiens
caaagttagagaactaaactagtt

SEQ ID NO: 2253674 - DNA, 21 bp, Homo sapiens
caaatatttagatgtaatttt

SEQ ID NO: 2253675 - DNA, 19 bp, Homo sapiens
caaatcgtccagcgacctt

SEQ ID NO: 2253676 - DNA, 18 bp, Homo sapiens
caaatgtgatttttgtaa

SEQ ID NO: 2253677 - DNA, 12 bp, Homo sapiens
caaattagaaaa

SEQ ID NO: 2253678 - DNA, 14 bp, Homo sapiens
caaattcaaataaa

SEQ ID NO: 2253679 - DNA, 17 bp, Homo sapiens
caaattttaatttttgc

SEQ ID NO: 2253680 - DNA, 17 bp, Homo sapiens
caacaacagaagggaaa

SEQ ID NO: 2253681 - DNA, 16 bp, Homo sapiens
caacaataaaattttt

SEQ ID NO: 2253682 - DNA, 16 bp, Homo sapiens
caacacttcattttca

SEQ ID NO: 2253683 - DNA, 17 bp, Homo sapiens
caacagcaaaggaacta

SEQ ID NO: 2253684 - DNA, 17 bp, Homo sapiens
caacaggtaaaacaggg

SEQ ID NO: 2253685 - DNA, 13 bp, Homo sapiens
caacagtcttgct

SEQ ID NO: 2253686 - DNA, 14 bp, Homo sapiens
caaccatttgaaac

SEQ ID NO: 2253687 - DNA, 20 bp, Homo sapiens
caacctctacctcctgggtt

SEQ ID NO: 2253688 - DNA, 17 bp, Homo sapiens
caacctcttctggctca

SEQ ID NO: 2253689 - DNA, 17 bp, Homo sapiens
caacctggtggcaccag

SEQ ID NO: 2253690 - DNA, 14 bp, Homo sapiens
caaccttcaaagaa

SEQ ID NO: 2253691 - DNA, 13 bp, Homo sapiens
caaccttgtttat

SEQ ID NO: 2253692 - DNA, 18 bp, Homo sapiens
caacgccgagtgcactgc

SEQ ID NO: 2253693 - DNA, 16 bp, Homo sapiens
caacgttcgatttcta

SEQ ID NO: 2253694 - DNA, 21 bp, Homo sapiens
caacgttcgatttctacctca

SEQ ID NO: 2253695 - DNA, 22 bp, Homo sapiens
caacgttcgatttctacctcag

SEQ ID NO: 2253696 - DNA, 17 bp, Homo sapiens
caacttttaattactgt

SEQ ID NO: 2253697 - DNA, 19 bp, Homo sapiens
caagaaacgtgtcacactt

SEQ ID NO: 2253698 - DNA, 19 bp, Homo sapiens
caagaccaccacttcgaaa

SEQ ID NO: 2253699 - DNA, 18 bp, Homo sapiens
caagaccacggagggagc

SEQ ID NO: 2253700 - DNA, 16 bp, Homo sapiens
caagaccgatcggcgg

SEQ ID NO: 2253701 - DNA, 15 bp, Homo sapiens
caagacggaggaggg

SEQ ID NO: 2253702 - DNA, 23 bp, Homo sapiens
caagagaactcgcgctcagtaaa

SEQ ID NO: 2253703 - DNA, 13 bp, Homo sapiens
caagagataactg

SEQ ID NO: 2253704 - DNA, 17 bp, Homo sapiens
caagagcatgcacatgc

SEQ ID NO: 2253705 - DNA, 20 bp, Homo sapiens
caagattttttttgtaactt

SEQ ID NO: 2253706 - DNA, 21 bp, Homo sapiens
caagattttttttgtaacttc

SEQ ID NO: 2253707 - DNA, 22 bp, Homo sapiens
caagctgcgggctccctggcag

SEQ ID NO: 2253708 - DNA, 24 bp, Homo sapiens
caagctgcgggctccctggcagga

SEQ ID NO: 2253709 - DNA, 19 bp, Homo sapiens
caaggtataataaaattat

SEQ ID NO: 2253710 - DNA, 15 bp, Homo sapiens
caaggtgcttttctt

SEQ ID NO: 2253711 - DNA, 18 bp, Homo sapiens
caagtcagattgctggga

SEQ ID NO: 2253712 - DNA, 15 bp, Homo sapiens
caagtctgtacctca

SEQ ID NO: 2253713 - DNA, 22 bp, Homo sapiens
caagtctgtacctcaaatgaat

SEQ ID NO: 2253714 - DNA, 12 bp, Homo sapiens
caagtggacctt

SEQ ID NO: 2253715 - DNA, 19 bp, Homo sapiens
caagttaggtatgtttgca

SEQ ID NO: 2253716 - DNA, 15 bp, Homo sapiens
caagttgaattgagg

SEQ ID NO: 2253717 - DNA, 18 bp, Homo sapiens
caataaaatttttttaaa

SEQ ID NO: 2253718 - DNA, 19 bp, Homo sapiens
caataaaccctcagagcct

SEQ ID NO: 2253719 - DNA, 14 bp, Homo sapiens
caataaagcattta

SEQ ID NO: 2253720 - DNA, 13 bp, Homo sapiens
caataatatattt

SEQ ID NO: 2253721 - DNA, 14 bp, Homo sapiens
caataatatatttt

SEQ ID NO: 2253722 - DNA, 16 bp, Homo sapiens
caataatatattttct

SEQ ID NO: 2253723 - DNA, 13 bp, Homo sapiens
caatactacctct

SEQ ID NO: 2253724 - DNA, 14 bp, Homo sapiens
caatactacctctg

SEQ ID NO: 2253725 - DNA, 14 bp, Homo sapiens
caatagtgtcatcc

SEQ ID NO: 2253726 - DNA, 23 bp, Homo sapiens
catattgctgagagaaatatgga

SEQ ID NO: 2253727 - DNA, 14 bp, Homo sapiens
catatttatttcag

SEQ ID NO: 2253728 - DNA, 16 bp, Homo sapiens
catattttaaacagag

SEQ ID NO: 2253729 - DNA, 17 bp, Homo sapiens
catattttaaacagagg

SEQ ID NO: 2253730 - DNA, 18 bp, Homo sapiens
catcaaaaactttggagt

SEQ ID NO: 2253731 - DNA, 17 bp, Homo sapiens
catcaatacaaccagcc

SEQ ID NO: 2253732 - DNA, 15 bp, Homo sapiens
catcaatttaaaaag

SEQ ID NO: 2253733 - DNA, 13 bp, Homo sapiens
catcacacccatt

SEQ ID NO: 2253734 - DNA, 19 bp, Homo sapiens
catcacagcaatatttaac

SEQ ID NO: 2253735 - DNA, 22 bp, Homo sapiens
catcagaaagctttattttgag

SEQ ID NO: 2253736 - DNA, 14 bp, Homo sapiens
catcataaaatttt

SEQ ID NO: 2253737 - DNA, 14 bp, Homo sapiens
catccaaccttccc

SEQ ID NO: 2253738 - DNA, 22 bp, Homo sapiens
catccagccagaccccacgctg

SEQ ID NO: 2253739 - DNA, 14 bp, Homo sapiens
catccagcctccag

SEQ ID NO: 2253740 - DNA, 16 bp, Homo sapiens
catccagcctccaggg

SEQ ID NO: 2253741 - DNA, 17 bp, Homo sapiens
catccagcctccagggc

SEQ ID NO: 2253742 - DNA, 13 bp, Homo sapiens
catccagggggca

SEQ ID NO: 2253743 - DNA, 21 bp, Homo sapiens
catccagtttgttctccgggt

SEQ ID NO: 2253744 - DNA, 16 bp, Homo sapiens
catcccgtgttctcct

SEQ ID NO: 2253745 - DNA, 11 bp, Homo sapiens
catccctgggc

SEQ ID NO: 2253746 - DNA, 24 bp, Homo sapiens
catccctgggcccctccacgcctc

SEQ ID NO: 2253747 - DNA, 21 bp, Homo sapiens
catccctttttttacatttca

SEQ ID NO: 2253748 - DNA, 23 bp, Homo sapiens
catcggaggctgggcccctggga

SEQ ID NO: 2253749 - DNA, 18 bp, Homo sapiens
catctcatttaagggaaa

SEQ ID NO: 2253750 - DNA, 21 bp, Homo sapiens
catctcatttaagggaaaaat

SEQ ID NO: 2253751 - DNA, 17 bp, Homo sapiens
catctcccttttccatg

SEQ ID NO: 2253752 - DNA, 21 bp, Homo sapiens
catctctctggggccctgggc

SEQ ID NO: 2253753 - DNA, 18 bp, Homo sapiens
catctgcaacaaaaagtc

SEQ ID NO: 2253754 - DNA, 16 bp, Homo sapiens
catctggaatctggag

SEQ ID NO: 2253755 - DNA, 21 bp, Homo sapiens
catctggaatctggagaccag

SEQ ID NO: 2253756 - DNA, 23 bp, Homo sapiens
catctggagttggagccgcacat

SEQ ID NO: 2253757 - DNA, 18 bp, Homo sapiens
catctgtctatattttat

SEQ ID NO: 2253758 - DNA, 21 bp, Homo sapiens
catctgtgccatacttgttct

SEQ ID NO: 2253759 - DNA, 18 bp, Homo sapiens
catctgttagcagagtct

SEQ ID NO: 2253760 - DNA, 19 bp, Homo sapiens
catctgttagcagagtctg

SEQ ID NO: 2253761 - DNA, 16 bp, Homo sapiens
catcttgagccacagt

SEQ ID NO: 2253762 - DNA, 17 bp, Homo sapiens
catcttttattcttttt

SEQ ID NO: 2253763 - DNA, 16 bp, Homo sapiens
catgaaatgtgaattt

SEQ ID NO: 2253764 - DNA, 19 bp, Homo sapiens
catgaaatgtgaattttta

SEQ ID NO: 2253765 - DNA, 20 bp, Homo sapiens
catgaaatgtgaatttttat

SEQ ID NO: 2253766 - DNA, 15 bp, Homo sapiens
catgaattttaaata

SEQ ID NO: 2253767 - DNA, 18 bp, Homo sapiens
catgaattttaaataatg

SEQ ID NO: 2253768 - DNA, 22 bp, Homo sapiens
catgaattttaaataatgtatt

SEQ ID NO: 2253769 - DNA, 22 bp, Homo sapiens
catgactatgtatttttctatg

SEQ ID NO: 2253770 - DNA, 18 bp, Homo sapiens
catgcaaacaagaaacgt

SEQ ID NO: 2253771 - DNA, 21 bp, Homo sapiens
catgcacatgctgtctggccc

SEQ ID NO: 2253772 - DNA, 13 bp, Homo sapiens
catgccagagagg

SEQ ID NO: 2253773 - DNA, 16 bp, Homo sapiens
catgccccctgcagac

SEQ ID NO: 2253774 - DNA, 13 bp, Homo sapiens
catgccctgtgtg

SEQ ID NO: 2253775 - DNA, 15 bp, Homo sapiens
catgcgtcaggggcc

SEQ ID NO: 2253776 - DNA, 16 bp, Homo sapiens
catggcccctctgacc

SEQ ID NO: 2253777 - DNA, 17 bp, Homo sapiens
catggcccctctgacct

SEQ ID NO: 2253778 - DNA, 18 bp, Homo sapiens
catggcccctctgacctg

SEQ ID NO: 2253779 - DNA, 15 bp, Homo sapiens
catggtactgtagca

SEQ ID NO: 2253780 - DNA, 18 bp, Homo sapiens
catgtaaatgtaaactca

SEQ ID NO: 2253781 - DNA, 15 bp, Homo sapiens
catgtagcagtgagt

SEQ ID NO: 2253782 - DNA, 17 bp, Homo sapiens
catgtagccccctggcc

SEQ ID NO: 2253783 - DNA, 22 bp, Homo sapiens
catgtagccccctggcctctgt

SEQ ID NO: 2253784 - DNA, 14 bp, Homo sapiens
catgtccaaagagg

SEQ ID NO: 2253785 - DNA, 16 bp, Homo sapiens
catgtccaaagaggct

SEQ ID NO: 2253786 - DNA, 23 bp, Homo sapiens
catgtcttctcacaagccagcca

SEQ ID NO: 2253787 - DNA, 15 bp, Homo sapiens
catgtcttttaaaat

SEQ ID NO: 2253788 - DNA, 18 bp, Homo sapiens
catgtgctaataagtttg

SEQ ID NO: 2253789 - DNA, 23 bp, Homo sapiens
catgtggtggcacaggccccctt

SEQ ID NO: 2253790 - DNA, 24 bp, Homo sapiens
catgtgtcccctcactctgtcagc

SEQ ID NO: 2253791 - DNA, 11 bp, Homo sapiens
cattaaaatat

SEQ ID NO: 2253792 - DNA, 10 bp, Homo sapiens
cattaaactg

SEQ ID NO: 2253793 - DNA, 13 bp, Homo sapiens
cattaagcttttt

SEQ ID NO: 2253794 - DNA, 14 bp, Homo sapiens
cattaagctttttt

SEQ ID NO: 2253795 - DNA, 14 bp, Homo sapiens
cattaataaaactg

SEQ ID NO: 2253796 - DNA, 19 bp, Homo sapiens
cattagaattatttaaaca

SEQ ID NO: 2253797 - DNA, 17 bp, Homo sapiens
cattagttttaaaaagg

SEQ ID NO: 2253798 - DNA, 14 bp, Homo sapiens
cattcaaactgcac

SEQ ID NO: 2253799 - DNA, 23 bp, Homo sapiens
cattcaactttagtatttttact

SEQ ID NO: 2253800 - DNA, 17 bp, Homo sapiens
cattcaagtgtaaaata

SEQ ID NO: 2253801 - DNA, 18 bp, Homo sapiens
cattcaagtgtaaaatat

SEQ ID NO: 2253802 - DNA, 23 bp, Homo sapiens
cattcaagtgtaaaatattttga

SEQ ID NO: 2253803 - DNA, 19 bp, Homo sapiens
cattcagcagcaaattttc

SEQ ID NO: 2253804 - DNA, 17 bp, Homo sapiens
cattccttgaggacaga

SEQ ID NO: 2253805 - DNA, 12 bp, Homo sapiens
cattcttggctt

SEQ ID NO: 2253806 - DNA, 14 bp, Homo sapiens
cattctttccttct

SEQ ID NO: 2253807 - DNA, 15 bp, Homo sapiens
cattgctcagcccgc

SEQ ID NO: 2253808 - DNA, 17 bp, Homo sapiens
cattgctgagcctctgc

SEQ ID NO: 2253809 - DNA, 18 bp, Homo sapiens
cattggccagctcataaa

SEQ ID NO: 2253810 - DNA, 19 bp, Homo sapiens
cattggccagctcataaaa

SEQ ID NO: 2253811 - DNA, 19 bp, Homo sapiens
cattggggggccgggcagg

SEQ ID NO: 2253812 - DNA, 19 bp, Homo sapiens
cattgtatagatataatga

SEQ ID NO: 2253813 - DNA, 24 bp, Homo sapiens
cattgtatagatataatgaacaaa

SEQ ID NO: 2253814 - DNA, 21 bp, Homo sapiens
cattgttgttttaacctcccc

SEQ ID NO: 2253815 - DNA, 15 bp, Homo sapiens
catttaagggaaaaa

SEQ ID NO: 2253816 - DNA, 18 bp, Homo sapiens
catttaagggaaaaatat

SEQ ID NO: 2253817 - DNA, 22 bp, Homo sapiens
catttaagggaaaaatatatat

SEQ ID NO: 2253818 - DNA, 22 bp, Homo sapiens
catttaatggggaggacaaaat

SEQ ID NO: 2253819 - DNA, 13 bp, Homo sapiens
catttagcaataa

SEQ ID NO: 2253820 - DNA, 14 bp, Homo sapiens
catttagcaataaa

SEQ ID NO: 2253821 - DNA, 17 bp, Homo sapiens
catttatacaaattaga

SEQ ID NO: 2253822 - DNA, 14 bp, Homo sapiens
catttcatctcatt

SEQ ID NO: 2253823 - DNA, 18 bp, Homo sapiens
catttcccaacacaaaga

SEQ ID NO: 2253824 - DNA, 19 bp, Homo sapiens
catttgaaacccctgtagg

SEQ ID NO: 2253825 - DNA, 21 bp, Homo sapiens
catttgaaacccctgtaggcc

SEQ ID NO: 2253826 - DNA, 15 bp, Homo sapiens
catttgagagaagcc

SEQ ID NO: 2253827 - DNA, 16 bp, Homo sapiens
catttgagagaagcca

SEQ ID NO: 2253828 - DNA, 13 bp, Homo sapiens
catttgatagaaa

SEQ ID NO: 2253829 - DNA, 14 bp, Homo sapiens
catttgatagaaag

SEQ ID NO: 2253830 - DNA, 20 bp, Homo sapiens
catttgatgcatgtctttta

SEQ ID NO: 2253831 - DNA, 21 bp, Homo sapiens
catttgtttctttctctgagg

SEQ ID NO: 2253832 - DNA, 13 bp, Homo sapiens
cattttaaaaagt

SEQ ID NO: 2253833 - DNA, 16 bp, Homo sapiens
cattttaaaagcaatt

SEQ ID NO: 2253834 - DNA, 16 bp, Homo sapiens
cccctctttgcacagc

SEQ ID NO: 2253835 - DNA, 19 bp, Homo sapiens
cccctgggcctcatcacag

SEQ ID NO: 2253836 - DNA, 18 bp, Homo sapiens
ccccttgtcctttccctt

SEQ ID NO: 2253837 - DNA, 22 bp, Homo sapiens
cccctttcctggacactcagac

SEQ ID NO: 2253838 - DNA, 16 bp, Homo sapiens
cccgactccagccagc

SEQ ID NO: 2253839 - DNA, 17 bp, Homo sapiens
cccgactccagccagcg

SEQ ID NO: 2253840 - DNA, 13 bp, Homo sapiens
cccgtctcagtgt

SEQ ID NO: 2253841 - DNA, 12 bp, Homo sapiens
cccgtttctcca

SEQ ID NO: 2253842 - DNA, 16 bp, Homo sapiens
ccctcaacctcttctg

SEQ ID NO: 2253843 - DNA, 15 bp, Homo sapiens
ccctcactctgtcag

SEQ ID NO: 2253844 - DNA, 18 bp, Homo sapiens
ccctcactctgtcagcca

SEQ ID NO: 2253845 - DNA, 21 bp, Homo sapiens
ccctccaagtctgtacctcaa

SEQ ID NO: 2253846 - DNA, 15 bp, Homo sapiens
ccctccaccccagga

SEQ ID NO: 2253847 - DNA, 13 bp, Homo sapiens
ccctccctgactc

SEQ ID NO: 2253848 - DNA, 20 bp, Homo sapiens
ccctccctgactccctgtgg

SEQ ID NO: 2253849 - DNA, 21 bp, Homo sapiens
ccctccctgactccctgtggg

SEQ ID NO: 2253850 - DNA, 17 bp, Homo sapiens
ccctccgcggctggagc

SEQ ID NO: 2253851 - DNA, 15 bp, Homo sapiens
ccctccttctgctgt

SEQ ID NO: 2253852 - DNA, 13 bp, Homo sapiens
ccctctcaccaaa

SEQ ID NO: 2253853 - DNA, 16 bp, Homo sapiens
ccctctgacctgcact

SEQ ID NO: 2253854 - DNA, 17 bp, Homo sapiens
ccctctgacctgcactg

SEQ ID NO: 2253855 - DNA, 19 bp, Homo sapiens
ccctctgacctgcactggg

SEQ ID NO: 2253856 - DNA, 14 bp, Homo sapiens
ccctctgctgctgt

SEQ ID NO: 2253857 - DNA, 13 bp, Homo sapiens
ccctcttctgccc

SEQ ID NO: 2253858 - DNA, 16 bp, Homo sapiens
ccctctttgcacagca

SEQ ID NO: 2253859 - DNA, 20 bp, Homo sapiens
ccctctttggctcccctgta

SEQ ID NO: 2253860 - DNA, 20 bp, Homo sapiens
ccctgaagtgagcacagcct

SEQ ID NO: 2253861 - DNA, 16 bp, Homo sapiens
ccctgaggcctagact

SEQ ID NO: 2253862 - DNA, 19 bp, Homo sapiens
ccctgaggcctagactctg

SEQ ID NO: 2253863 - DNA, 18 bp, Homo sapiens
ccctgatcccaccccctc

SEQ ID NO: 2253864 - DNA, 14 bp, Homo sapiens
ccctgcaaaaagaa

SEQ ID NO: 2253865 - DNA, 22 bp, Homo sapiens
ccctgccccaccccatccagcc

SEQ ID NO: 2253866 - DNA, 18 bp, Homo sapiens
ccctgcctgttggcaggc

SEQ ID NO: 2253867 - DNA, 13 bp, Homo sapiens
ccctgcttttgca

SEQ ID NO: 2253868 - DNA, 16 bp, Homo sapiens
ccctgggcccctccac

SEQ ID NO: 2253869 - DNA, 17 bp, Homo sapiens
ccctgggcccctccacg

SEQ ID NO: 2253870 - DNA, 19 bp, Homo sapiens
ccctgggcccctccacgcc

SEQ ID NO: 2253871 - DNA, 14 bp, Homo sapiens
ccctgggcctcagt

SEQ ID NO: 2253872 - DNA, 23 bp, Homo sapiens
ccctgggcctcagttcaacctgg

SEQ ID NO: 2253873 - DNA, 20 bp, Homo sapiens
ccctggggatcttcccacag

SEQ ID NO: 2253874 - DNA, 23 bp, Homo sapiens
ccctggggatcttcccacaggag

SEQ ID NO: 2253875 - DNA, 12 bp, Homo sapiens
ccctgtgggggt

SEQ ID NO: 2253876 - DNA, 16 bp, Homo sapiens
ccctgtttcagaggct

SEQ ID NO: 2253877 - DNA, 19 bp, Homo sapiens
ccctgtttcagaggctcag

SEQ ID NO: 2253878 - DNA, 19 bp, Homo sapiens
cccttccccttctgtgtca

SEQ ID NO: 2253879 - DNA, 15 bp, Homo sapiens
cccttgctggcccca

SEQ ID NO: 2253880 - DNA, 16 bp, Homo sapiens
ccctttcacactggat

SEQ ID NO: 2253881 - DNA, 13 bp, Homo sapiens
cccttttccccta

SEQ ID NO: 2253882 - DNA, 15 bp, Homo sapiens
ccctttttctccagc

SEQ ID NO: 2253883 - DNA, 14 bp, Homo sapiens
ccgactccagccag

SEQ ID NO: 2253884 - DNA, 15 bp, Homo sapiens
ccgactccagccagc

SEQ ID NO: 2253885 - DNA, 19 bp, Homo sapiens
ccgagtgatttccatctct

SEQ ID NO: 2253886 - DNA, 18 bp, Homo sapiens
ccgccctgggctgtctgt

SEQ ID NO: 2253887 - DNA, 20 bp, Homo sapiens
ccgccctgggctgtctgtca

SEQ ID NO: 2253888 - DNA, 13 bp, Homo sapiens
ccgcctggccagg

SEQ ID NO: 2253889 - DNA, 16 bp, Homo sapiens
ccgcgccccagtcact

SEQ ID NO: 2253890 - DNA, 14 bp, Homo sapiens
ccgcggctggagcg

SEQ ID NO: 2253891 - DNA, 18 bp, Homo sapiens
ccgctctacatcttctgc

SEQ ID NO: 2253892 - DNA, 19 bp, Homo sapiens
ccgctctacatcttctgcc

SEQ ID NO: 2253893 - DNA, 16 bp, Homo sapiens
ccgctgccgctgcacc

SEQ ID NO: 2253894 - DNA, 20 bp, Homo sapiens
ccgctgtcgccccaggccct

SEQ ID NO: 2253895 - DNA, 21 bp, Homo sapiens
ccgctgtcgccccaggccctc

SEQ ID NO: 2253896 - DNA, 17 bp, Homo sapiens
ccgctgtgcccccctcc

SEQ ID NO: 2253897 - DNA, 18 bp, Homo sapiens
ccgggagcctccccctca

SEQ ID NO: 2253898 - DNA, 16 bp, Homo sapiens
ccgggtgtggcctcag

SEQ ID NO: 2253899 - DNA, 22 bp, Homo sapiens
ccgtcactccacgcagctggca

SEQ ID NO: 2253900 - DNA, 13 bp, Homo sapiens
ccgtcctctcccc

SEQ ID NO: 2253901 - DNA, 18 bp, Homo sapiens
ccgtcctctccccagcct

SEQ ID NO: 2253902 - DNA, 18 bp, Homo sapiens
ccgtgaaaacggagctga

SEQ ID NO: 2253903 - DNA, 20 bp, Homo sapiens
ccgtgtctcagcctctgcca

SEQ ID NO: 2253904 - DNA, 16 bp, Homo sapiens
ccgtgtctctgaggac

SEQ ID NO: 2253905 - DNA, 17 bp, Homo sapiens
ccgttccaccccaagag

SEQ ID NO: 2253906 - DNA, 21 bp, Homo sapiens
ccgttccaccccaagagaact

SEQ ID NO: 2253907 - DNA, 12 bp, Homo sapiens
ccgttttcccca

SEQ ID NO: 2253908 - DNA, 22 bp, Homo sapiens
cctaaagaggaaaagtgcaatg

SEQ ID NO: 2253909 - DNA, 19 bp, Homo sapiens
cctaaagcctcaaaacaaa

SEQ ID NO: 2253910 - DNA, 12 bp, Homo sapiens
cctaaggcccat

SEQ ID NO: 2253911 - DNA, 16 bp, Homo sapiens
cctaccaatattaggt

SEQ ID NO: 2253912 - DNA, 19 bp, Homo sapiens
cctagactgtaaacctctc

SEQ ID NO: 2253913 - DNA, 15 bp, Homo sapiens
cctagctacactgag

SEQ ID NO: 2253914 - DNA, 22 bp, Homo sapiens
cctagctacactgagcagggag

SEQ ID NO: 2253915 - DNA, 23 bp, Homo sapiens
cctagtcaaaactatttttgtaa

SEQ ID NO: 2253916 - DNA, 13 bp, Homo sapiens
cctatatatttct

SEQ ID NO: 2253917 - DNA, 14 bp, Homo sapiens
cctatcatgttaac

SEQ ID NO: 2253918 - DNA, 16 bp, Homo sapiens
cctcaaaggcccgctc

SEQ ID NO: 2253919 - DNA, 15 bp, Homo sapiens
cctcaaatcgtccag

SEQ ID NO: 2253920 - DNA, 13 bp, Homo sapiens
cctcaaatgaatt

SEQ ID NO: 2253921 - DNA, 17 bp, Homo sapiens
cctcaacctcttctggc

SEQ ID NO: 2253922 - DNA, 20 bp, Homo sapiens
cctcaccccctcccaccccc

SEQ ID NO: 2253923 - DNA, 13 bp, Homo sapiens
cctcacctcctct

SEQ ID NO: 2253924 - DNA, 14 bp, Homo sapiens
cctcactaattttt

SEQ ID NO: 2253925 - DNA, 20 bp, Homo sapiens
cctcactattacttgaactt

SEQ ID NO: 2253926 - DNA, 15 bp, Homo sapiens
cctcactctgtcagc

SEQ ID NO: 2253927 - DNA, 22 bp, Homo sapiens
cctcagagcatttaaggaaact

SEQ ID NO: 2253928 - DNA, 18 bp, Homo sapiens
cctcagccacttgcctgt

SEQ ID NO: 2253929 - DNA, 13 bp, Homo sapiens
cctcagccctcag

SEQ ID NO: 2253930 - DNA, 22 bp, Homo sapiens
cctcagttcaacctggtggcac

SEQ ID NO: 2253931 - DNA, 21 bp, Homo sapiens
cctcatcacagcaatatttaa

SEQ ID NO: 2253932 - DNA, 13 bp, Homo sapiens
cctcattggccag

SEQ ID NO: 2253933 - DNA, 13 bp, Homo sapiens
cctcatttttcat

SEQ ID NO: 2253934 - DNA, 15 bp, Homo sapiens
cctcatttttcatac

SEQ ID NO: 2253935 - DNA, 13 bp, Homo sapiens
cctccacagagag

SEQ ID NO: 2253936 - DNA, 21 bp, Homo sapiens
cctccacagagaggaggggac

SEQ ID NO: 2253937 - DNA, 14 bp, Homo sapiens
cctccaccccagga

SEQ ID NO: 2253938 - DNA, 15 bp, Homo sapiens
cctccaccccaggac

SEQ ID NO: 2253939 - DNA, 22 bp, Homo sapiens
cctccagaactcactggggcct

SEQ ID NO: 2253940 - DNA, 17 bp, Homo sapiens
cctccagagacaacagg

SEQ ID NO: 2253941 - DNA, 14 bp, Homo sapiens
cctcccacccccag

SEQ ID NO: 2253942 - DNA, 16 bp, Homo sapiens
cctcccacccccagcc

SEQ ID NO: 2253943 - DNA, 15 bp, Homo sapiens
ctcctcatcccgtgt

SEQ ID NO: 2253944 - DNA, 20 bp, Homo sapiens
ctcctcatgtacataccctg

SEQ ID NO: 2253945 - DNA, 21 bp, Homo sapiens
ctcctccccgcgccccagtca

SEQ ID NO: 2253946 - DNA, 15 bp, Homo sapiens
ctcctggccagacgc

SEQ ID NO: 2253947 - DNA, 15 bp, Homo sapiens
ctcctgggggtggca

SEQ ID NO: 2253948 - DNA, 16 bp, Homo sapiens
ctcctgggggtggcag

SEQ ID NO: 2253949 - DNA, 17 bp, Homo sapiens
ctcctgggggtggcagg

SEQ ID NO: 2253950 - DNA, 19 bp, Homo sapiens
ctcctgggggtggcaggca

SEQ ID NO: 2253951 - DNA, 20 bp, Homo sapiens
ctcctgggggtggcaggcac

SEQ ID NO: 2253952 - DNA, 17 bp, Homo sapiens
ctcctgtgtggaagaag

SEQ ID NO: 2253953 - DNA, 21 bp, Homo sapiens
ctccttactgtgtttcagcat

SEQ ID NO: 2253954 - DNA, 16 bp, Homo sapiens
ctccttcccatcgctg

SEQ ID NO: 2253955 - DNA, 15 bp, Homo sapiens
ctccttggccacaga

SEQ ID NO: 2253956 - DNA, 15 bp, Homo sapiens
ctcgagcccagatgg

SEQ ID NO: 2253957 - DNA, 18 bp, Homo sapiens
ctcgagggcagggaccac

SEQ ID NO: 2253958 - DNA, 19 bp, Homo sapiens
ctcgcagggaatgcagcag

SEQ ID NO: 2253959 - DNA, 21 bp, Homo sapiens
ctcgcagggaatgcagcagga

SEQ ID NO: 2253960 - DNA, 17 bp, Homo sapiens
ctcgcccacaaactgat

SEQ ID NO: 2253961 - DNA, 18 bp, Homo sapiens
ctcgccggatctgaggga

SEQ ID NO: 2253962 - DNA, 17 bp, Homo sapiens
ctcgtgccatgatctgt

SEQ ID NO: 2253963 - DNA, 19 bp, Homo sapiens
ctcgtgccatgatctgtat

SEQ ID NO: 2253964 - DNA, 21 bp, Homo sapiens
ctcgtggactgtgctggtgca

SEQ ID NO: 2253965 - DNA, 16 bp, Homo sapiens
ctctaaaccatggcac

SEQ ID NO: 2253966 - DNA, 15 bp, Homo sapiens
ctctaacagtggaca

SEQ ID NO: 2253967 - DNA, 14 bp, Homo sapiens
ctctaaggttgggc

SEQ ID NO: 2253968 - DNA, 22 bp, Homo sapiens
ctctaggatgtatattttatat

SEQ ID NO: 2253969 - DNA, 20 bp, Homo sapiens
ctctagtgtattatcactgt

SEQ ID NO: 2253970 - DNA, 22 bp, Homo sapiens
ctctagtgtattatcactgtct

SEQ ID NO: 2253971 - DNA, 17 bp, Homo sapiens
ctctatttgaattattt

SEQ ID NO: 2253972 - DNA, 11 bp, Homo sapiens
ctctcagagcc

SEQ ID NO: 2253973 - DNA, 15 bp, Homo sapiens
ctctcagctccaggt

SEQ ID NO: 2253974 - DNA, 23 bp, Homo sapiens
ctctccacggtagcacttgacct

SEQ ID NO: 2253975 - DNA, 20 bp, Homo sapiens
ctctccagatgtttccagac

SEQ ID NO: 2253976 - DNA, 16 bp, Homo sapiens
ctctccccagcctggc

SEQ ID NO: 2253977 - DNA, 17 bp, Homo sapiens
ctctccccagcctggca

SEQ ID NO: 2253978 - DNA, 12 bp, Homo sapiens
ctctcctgaccc

SEQ ID NO: 2253979 - DNA, 19 bp, Homo sapiens
ctctcctgggggtggcagg

SEQ ID NO: 2253980 - DNA, 12 bp, Homo sapiens
ctctcgagccca

SEQ ID NO: 2253981 - DNA, 14 bp, Homo sapiens
ctctcggctcccca

SEQ ID NO: 2253982 - DNA, 16 bp, Homo sapiens
ctctcggctccccatg

SEQ ID NO: 2253983 - DNA, 17 bp, Homo sapiens
ctctcggctccccatgt

SEQ ID NO: 2253984 - DNA, 18 bp, Homo sapiens
ctctcggctccccatgtg

SEQ ID NO: 2253985 - DNA, 15 bp, Homo sapiens
ctctcggtgacctcc

SEQ ID NO: 2253986 - DNA, 17 bp, Homo sapiens
ctctctgtgtctttctc

SEQ ID NO: 2253987 - DNA, 20 bp, Homo sapiens
ctctgacagtccacaggggc

SEQ ID NO: 2253988 - DNA, 14 bp, Homo sapiens
ctctgacctgcact

SEQ ID NO: 2253989 - DNA, 21 bp, Homo sapiens
ctctgagactggcagatcgct

SEQ ID NO: 2253990 - DNA, 15 bp, Homo sapiens
ctctgaggtgcctgt

SEQ ID NO: 2253991 - DNA, 19 bp, Homo sapiens
ctctgaggtgcctgtccca

SEQ ID NO: 2253992 - DNA, 22 bp, Homo sapiens
ctctgaggtgcctgtcccaccc

SEQ ID NO: 2253993 - DNA, 17 bp, Homo sapiens
ctctgcaattcccctct

SEQ ID NO: 2253994 - DNA, 20 bp, Homo sapiens
ctctgcaattcccctctgct

SEQ ID NO: 2253995 - DNA, 23 bp, Homo sapiens
ctctgcaattcccctctgctgct

SEQ ID NO: 2253996 - DNA, 22 bp, Homo sapiens
ctctgccatggccttggcaggc

SEQ ID NO: 2253997 - DNA, 14 bp, Homo sapiens
ctctgccccctccc

SEQ ID NO: 2253998 - DNA, 16 bp, Homo sapiens
ctctgctagatttcta

SEQ ID NO: 2253999 - DNA, 18 bp, Homo sapiens
ctctgctagatttctaca

SEQ ID NO: 2254000 - DNA, 13 bp, Homo sapiens
ctctgctccccag

SEQ ID NO: 2254001 - DNA, 16 bp, Homo sapiens
ctctgctgctgtccct

SEQ ID NO: 2254002 - DNA, 21 bp, Homo sapiens
ctctgctgctgtccctccccc

SEQ ID NO: 2254003 - DNA, 15 bp, Homo sapiens
ctctggagcatttct

SEQ ID NO: 2254004 - DNA, 21 bp, Homo sapiens
ctctggggccctgggcctcag

SEQ ID NO: 2254005 - DNA, 11 bp, Homo sapiens
ctctgtacttt

SEQ ID NO: 2254006 - DNA, 12 bp, Homo sapiens
ctctgtactttt

SEQ ID NO: 2254007 - DNA, 20 bp, Homo sapiens
ctctgtcagccagccgccct

SEQ ID NO: 2254008 - DNA, 19 bp, Homo sapiens
ctctgtgagaaggtttatt

SEQ ID NO: 2254009 - DNA, 21 bp, Homo sapiens
ctctgtgagaaggtttattgt

SEQ ID NO: 2254010 - DNA, 17 bp, Homo sapiens
ctctgtgagggtgctga

SEQ ID NO: 2254011 - DNA, 16 bp, Homo sapiens
ctctgtttagaacacc

SEQ ID NO: 2254012 - DNA, 13 bp, Homo sapiens
ctcttcattcaaa

SEQ ID NO: 2254013 - DNA, 19 bp, Homo sapiens
ctcttctggggcaggctgg

SEQ ID NO: 2254014 - DNA, 23 bp, Homo sapiens
ctcttctggggcaggctgggcca

SEQ ID NO: 2254015 - DNA, 18 bp, Homo sapiens
ctcttgatacccccctct

SEQ ID NO: 2254016 - DNA, 21 bp, Homo sapiens
ctcttgatacccccctctgtc

SEQ ID NO: 2254017 - DNA, 23 bp, Homo sapiens
ctcttggctttgtcacttttcct

SEQ ID NO: 2254018 - DNA, 18 bp, Homo sapiens
ctctttggctcccctgta

SEQ ID NO: 2254019 - DNA, 22 bp, Homo sapiens
ctctttgtaatttaatgaaaag

SEQ ID NO: 2254020 - DNA, 11 bp, Homo sapiens
ctcttttcatt

SEQ ID NO: 2254021 - DNA, 19 bp, Homo sapiens
ctgaaactcatagacactg

SEQ ID NO: 2254022 - DNA, 16 bp, Homo sapiens
ctgaagccaaatgaaa

SEQ ID NO: 2254023 - DNA, 17 bp, Homo sapiens
ctgaagccaaatgaaac

SEQ ID NO: 2254024 - DNA, 14 bp, Homo sapiens
ctgaataccactta

SEQ ID NO: 2254025 - DNA, 16 bp, Homo sapiens
ctgaatgttgggactg

SEQ ID NO: 2254026 - DNA, 19 bp, Homo sapiens
ctgaatgttgggactgcta

SEQ ID NO: 2254027 - DNA, 23 bp, Homo sapiens
ctgaattatctatacatatcttt

SEQ ID NO: 2254028 - DNA, 17 bp, Homo sapiens
ctgaattttataaataa

SEQ ID NO: 2254029 - DNA, 12 bp, Homo sapiens
ctgacagggagc

SEQ ID NO: 2254030 - DNA, 13 bp, Homo sapiens
ctgacagggagca

SEQ ID NO: 2254031 - DNA, 19 bp, Homo sapiens
ctgacagtccacaggggcc

SEQ ID NO: 2254032 - DNA, 15 bp, Homo sapiens
ctgaccatgcgtcag

SEQ ID NO: 2254033 - DNA, 19 bp, Homo sapiens
ctgaccatgcgtcaggggc

SEQ ID NO: 2254034 - DNA, 21 bp, Homo sapiens
ctgaccccaaacaccttccag

SEQ ID NO: 2254035 - DNA, 14 bp, Homo sapiens
ctgacccctgcctg

SEQ ID NO: 2254036 - DNA, 19 bp, Homo sapiens
ctgaccttaaatgcaacca

SEQ ID NO: 2254037 - DNA, 14 bp, Homo sapiens
ctgactccctgtgg

SEQ ID NO: 2254038 - DNA, 16 bp, Homo sapiens
ctgactccctgtgggg

SEQ ID NO: 2254039 - DNA, 13 bp, Homo sapiens
ctgactttttaac

SEQ ID NO: 2254040 - DNA, 22 bp, Homo sapiens
ctgagaaatgaatgctgagacc

SEQ ID NO: 2254041 - DNA, 17 bp, Homo sapiens
ctgagcaatctgaccct

SEQ ID NO: 2254042 - DNA, 18 bp, Homo sapiens
ctgagccacagccgtgct

SEQ ID NO: 2254043 - DNA, 12 bp, Homo sapiens
ctgagcctctgc

SEQ ID NO: 2254044 - DNA, 16 bp, Homo sapiens
ctgagcctctgctccc

SEQ ID NO: 2254045 - DNA, 14 bp, Homo sapiens
ctgagctgccagtg

SEQ ID NO: 2254046 - DNA, 14 bp, Homo sapiens
ctgagcttgtcttt

SEQ ID NO: 2254047 - DNA, 17 bp, Homo sapiens
ctgaggacgagaccccc

SEQ ID NO: 2254048 - DNA, 23 bp, Homo sapiens
ctgaggacgagacccccatccag

SEQ ID NO: 2254049 - DNA, 17 bp, Homo sapiens
ctgaggcctagactctg

SEQ ID NO: 2254050 - DNA, 16 bp, Homo sapiens
ctgaggcctgcagcac

SEQ ID NO: 2254051 - DNA, 15 bp, Homo sapiens
cttctctgtgagaag

SEQ ID NO: 2254052 - DNA, 18 bp, Homo sapiens
cttctctgtgagaaggtt

SEQ ID NO: 2254053 - DNA, 22 bp, Homo sapiens
cttctcttccttttatcagtag

SEQ ID NO: 2254054 - DNA, 17 bp, Homo sapiens
cttctgcagcaggaact

SEQ ID NO: 2254055 - DNA, 15 bp, Homo sapiens
cttctggggcaggct

SEQ ID NO: 2254056 - DNA, 20 bp, Homo sapiens
cttctggggcaggctgggcc

SEQ ID NO: 2254057 - DNA, 14 bp, Homo sapiens
cttcttaaagtatt

SEQ ID NO: 2254058 - DNA, 15 bp, Homo sapiens
cttcttatgtagagt

SEQ ID NO: 2254059 - DNA, 14 bp, Homo sapiens
cttgaaatgaaagg

SEQ ID NO: 2254060 - DNA, 15 bp, Homo sapiens
cttgacaaatatttt

SEQ ID NO: 2254061 - DNA, 17 bp, Homo sapiens
cttgagacacggagccc

SEQ ID NO: 2254062 - DNA, 17 bp, Homo sapiens
cttgatacccccctctg

SEQ ID NO: 2254063 - DNA, 19 bp, Homo sapiens
cttgatacccccctctgtc

SEQ ID NO: 2254064 - DNA, 20 bp, Homo sapiens
cttgatacccccctctgtct

SEQ ID NO: 2254065 - DNA, 21 bp, Homo sapiens
cttgatacccccctctgtctt

SEQ ID NO: 2254066 - DNA, 21 bp, Homo sapiens
cttgcaaagacctacctccag

SEQ ID NO: 2254067 - DNA, 16 bp, Homo sapiens
cttgctcaggtgcaag

SEQ ID NO: 2254068 - DNA, 18 bp, Homo sapiens
cttgctggccccagccct

SEQ ID NO: 2254069 - DNA, 22 bp, Homo sapiens
cttgcttgttgaaaatatttct

SEQ ID NO: 2254070 - DNA, 14 bp, Homo sapiens
cttgctttcctgca

SEQ ID NO: 2254071 - DNA, 13 bp, Homo sapiens
cttggccacagac

SEQ ID NO: 2254072 - DNA, 19 bp, Homo sapiens
cttggcctaaacctcagtt

SEQ ID NO: 2254073 - DNA, 12 bp, Homo sapiens
cttggctcagac

SEQ ID NO: 2254074 - DNA, 22 bp, Homo sapiens
cttggctttgtcacttttcctt

SEQ ID NO: 2254075 - DNA, 13 bp, Homo sapiens
cttgggaatttta

SEQ ID NO: 2254076 - DNA, 17 bp, Homo sapiens
cttgtaactaaaataat

SEQ ID NO: 2254077 - DNA, 15 bp, Homo sapiens
cttgtatccaggcct

SEQ ID NO: 2254078 - DNA, 14 bp, Homo sapiens
cttgtcctttccct

SEQ ID NO: 2254079 - DNA, 14 bp, Homo sapiens
cttgtcttttctgc

SEQ ID NO: 2254080 - DNA, 17 bp, Homo sapiens
cttgtcttttctgctga

SEQ ID NO: 2254081 - DNA, 22 bp, Homo sapiens
cttgtgacgtcgggcattcata

SEQ ID NO: 2254082 - DNA, 16 bp, Homo sapiens
cttgtggccaatggaa

SEQ ID NO: 2254083 - DNA, 13 bp, Homo sapiens
cttgttcatttgg

SEQ ID NO: 2254084 - DNA, 21 bp, Homo sapiens
cttgttttcaggacaacactt

SEQ ID NO: 2254085 - DNA, 23 bp, Homo sapiens
ctttaatgcatctagattatgga

SEQ ID NO: 2254086 - DNA, 22 bp, Homo sapiens
ctttaggtttttttaatgatat

SEQ ID NO: 2254087 - DNA, 13 bp, Homo sapiens
ctttattctttgt

SEQ ID NO: 2254088 - DNA, 19 bp, Homo sapiens
ctttattttgagatgtaaa

SEQ ID NO: 2254089 - DNA, 14 bp, Homo sapiens
ctttcacagctcct

SEQ ID NO: 2254090 - DNA, 15 bp, Homo sapiens
ctttcacttaagtat

SEQ ID NO: 2254091 - DNA, 19 bp, Homo sapiens
ctttcatattttaaacaga

SEQ ID NO: 2254092 - DNA, 14 bp, Homo sapiens
ctttcatttgcttt

SEQ ID NO: 2254093 - DNA, 18 bp, Homo sapiens
ctttcatttgctttggaa

SEQ ID NO: 2254094 - DNA, 17 bp, Homo sapiens
ctttccaaaacatttct

SEQ ID NO: 2254095 - DNA, 22 bp, Homo sapiens
ctttccaaaacctaaagaggaa

SEQ ID NO: 2254096 - DNA, 15 bp, Homo sapiens
ctttccaaattattt

SEQ ID NO: 2254097 - DNA, 20 bp, Homo sapiens
ctttccaaattatttcttaa

SEQ ID NO: 2254098 - DNA, 17 bp, Homo sapiens
ctttcccagtctgtcga

SEQ ID NO: 2254099 - DNA, 20 bp, Homo sapiens
ctttccgctgtcgccccagg

SEQ ID NO: 2254100 - DNA, 16 bp, Homo sapiens
ctttccttctctgaaa

SEQ ID NO: 2254101 - DNA, 18 bp, Homo sapiens
ctttctacaatgtgaact

SEQ ID NO: 2254102 - DNA, 12 bp, Homo sapiens
ctttctctgagg

SEQ ID NO: 2254103 - DNA, 14 bp, Homo sapiens
ctttctctgaggac

SEQ ID NO: 2254104 - DNA, 17 bp, Homo sapiens
ctttctttgcaccaaag

SEQ ID NO: 2254105 - DNA, 21 bp, Homo sapiens
ctttctttgcaccaaagacat

SEQ ID NO: 2254106 - DNA, 10 bp, Homo sapiens
ctttgaaagt

SEQ ID NO: 2254107 - DNA, 23 bp, Homo sapiens
ctttgacaattgggagctgccaa

SEQ ID NO: 2254108 - DNA, 14 bp, Homo sapiens
ctttgcaccaaaga

SEQ ID NO: 2254109 - DNA, 18 bp, Homo sapiens
ctttggagtcccctcacc

SEQ ID NO: 2254110 - DNA, 20 bp, Homo sapiens
ctttgtaggtgagatgcaac

SEQ ID NO: 2254111 - DNA, 15 bp, Homo sapiens
ctttgtatatttaca

SEQ ID NO: 2254112 - DNA, 22 bp, Homo sapiens
ctttgtcacttttccttttctt

SEQ ID NO: 2254113 - DNA, 23 bp, Homo sapiens
ctttgtctacttcaaaagtttgt

SEQ ID NO: 2254114 - DNA, 18 bp, Homo sapiens
cttttaaaaacataacat

SEQ ID NO: 2254115 - DNA, 19 bp, Homo sapiens
cttttaaaatgcaatgtaa

SEQ ID NO: 2254116 - DNA, 16 bp, Homo sapiens
cttttaaattagaaaa

SEQ ID NO: 2254117 - DNA, 20 bp, Homo sapiens
cttttaattactgttttctt

SEQ ID NO: 2254118 - DNA, 11 bp, Homo sapiens
cttttactgtg

SEQ ID NO: 2254119 - DNA, 23 bp, Homo sapiens
cttttagaaacctcattggccag

SEQ ID NO: 2254120 - DNA, 15 bp, Homo sapiens
cttttagaaatactg

SEQ ID NO: 2254121 - DNA, 23 bp, Homo sapiens
cttttagaaatactgcaagaaaa

SEQ ID NO: 2254122 - DNA, 21 bp, Homo sapiens
cttttagccagagatgcaata

SEQ ID NO: 2254123 - DNA, 13 bp, Homo sapiens
cttttatctcaga

SEQ ID NO: 2254124 - DNA, 16 bp, Homo sapiens
cttttattaatgcact

SEQ ID NO: 2254125 - DNA, 17 bp, Homo sapiens
cttttcattctctttta

SEQ ID NO: 2254126 - DNA, 16 bp, Homo sapiens
cttttccttttcttaa

SEQ ID NO: 2254127 - DNA, 19 bp, Homo sapiens
cttttctaaactgcatctg

SEQ ID NO: 2254128 - DNA, 13 bp, Homo sapiens
cttttctgctgag

SEQ ID NO: 2254129 - DNA, 17 bp, Homo sapiens
cttttgcataatgcaat

SEQ ID NO: 2254130 - DNA, 20 bp, Homo sapiens
cttttgcataatgcaatcaa

SEQ ID NO: 2254131 - DNA, 23 bp, Homo sapiens
cttttgctatagttatacatcaa

SEQ ID NO: 2254132 - DNA, 20 bp, Homo sapiens
cttttggtaaagactggctt

SEQ ID NO: 2254133 - DNA, 18 bp, Homo sapiens
ctttttaatcatgaatat

SEQ ID NO: 2254134 - DNA, 12 bp, Homo sapiens
ctttttatttct

SEQ ID NO: 2254135 - DNA, 21 bp, Homo sapiens
ctttttgttgtaaaacaaaat

SEQ ID NO: 2254136 - DNA, 14 bp, Homo sapiens
gaaaaaatttaaaa

SEQ ID NO: 2254137 - DNA, 18 bp, Homo sapiens
gaaaaactgctgtaaaca

SEQ ID NO: 2254138 - DNA, 16 bp, Homo sapiens
gaaaacccaaggccag

SEQ ID NO: 2254139 - DNA, 17 bp, Homo sapiens
gaaaacctctcctgacc

SEQ ID NO: 2254140 - DNA, 14 bp, Homo sapiens
gaaaacggagctga

SEQ ID NO: 2254141 - DNA, 18 bp, Homo sapiens
gaaaactaaggatttttc

SEQ ID NO: 2254142 - DNA, 23 bp, Homo sapiens
gaaaagattttaatcaagttgaa

SEQ ID NO: 2254143 - DNA, 15 bp, Homo sapiens
gaaaagcagacattt

SEQ ID NO: 2254144 - DNA, 16 bp, Homo sapiens
gaaaagcagacatttt

SEQ ID NO: 2254145 - DNA, 15 bp, Homo sapiens
gaaaagtagaaagga

SEQ ID NO: 2254146 - DNA, 14 bp, Homo sapiens
gaaaagtgcaatgc

SEQ ID NO: 2254147 - DNA, 15 bp, Homo sapiens
gaaaatattgtttta

SEQ ID NO: 2254148 - DNA, 23 bp, Homo sapiens
gaaaatgatgtgtacccaaacgt

SEQ ID NO: 2254149 - DNA, 21 bp, Homo sapiens
gaaaattcatagtaagattga

SEQ ID NO: 2254150 - DNA, 23 bp, Homo sapiens
gaaaccatgtagcagtgagtcat

SEQ ID NO: 2254151 - DNA, 17 bp, Homo sapiens
gaaacctcattggccag

SEQ ID NO: 2254152 - DNA, 18 bp, Homo sapiens
gaaacgtgtcacacttgt

SEQ ID NO: 2254153 - DNA, 19 bp, Homo sapiens
gaaactcaaaaccatctct

SEQ ID NO: 2254154 - DNA, 20 bp, Homo sapiens
gaaactcaaaaccatctctc

SEQ ID NO: 2254155 - DNA, 15 bp, Homo sapiens
gaaactccagatgcc

SEQ ID NO: 2254156 - DNA, 19 bp, Homo sapiens
gaaactgggaaactgggtt

SEQ ID NO: 2254157 - DNA, 20 bp, Homo sapiens
gaaagacgtttttgtgctgt

SEQ ID NO: 2254158 - DNA, 12 bp, Homo sapiens
gaaaggatttta

SEQ ID NO: 2254159 - DNA, 18 bp, Homo sapiens
gcagcaggctcaggcaca

SEQ ID NO: 2254160 - DNA, 18 bp, Homo sapiens
gcagcgaccgccccctcc

SEQ ID NO: 2254161 - DNA, 19 bp, Homo sapiens
gcagctatgcgcaatgtgg

SEQ ID NO: 2254162 - DNA, 18 bp, Homo sapiens
gcaggaaggaacaaagac

SEQ ID NO: 2254163 - DNA, 17 bp, Homo sapiens
gcaggagtaataaattt

SEQ ID NO: 2254164 - DNA, 21 bp, Homo sapiens
gcaggatgttggcttggggca

SEQ ID NO: 2254165 - DNA, 18 bp, Homo sapiens
gcaggcacgggtggtccc

SEQ ID NO: 2254166 - DNA, 19 bp, Homo sapiens
gcaggcacgggtggtcccc

SEQ ID NO: 2254167 - DNA, 22 bp, Homo sapiens
gcaggcccactccccagcccca

SEQ ID NO: 2254168 - DNA, 16 bp, Homo sapiens
gcaggctcccctgagg

SEQ ID NO: 2254169 - DNA, 13 bp, Homo sapiens
gcaggctgggcca

SEQ ID NO: 2254170 - DNA, 23 bp, Homo sapiens
gcagggtccctccagcaaagctc

SEQ ID NO: 2254171 - DNA, 14 bp, Homo sapiens
gcaggtcctgccca

SEQ ID NO: 2254172 - DNA, 16 bp, Homo sapiens
gcaggtcctgcccatg

SEQ ID NO: 2254173 - DNA, 21 bp, Homo sapiens
gcaggtcctgcccatgtgtcc

SEQ ID NO: 2254174 - DNA, 16 bp, Homo sapiens
gcagtacagtgtgtgt

SEQ ID NO: 2254175 - DNA, 14 bp, Homo sapiens
gcagtttatcattc

SEQ ID NO: 2254176 - DNA, 15 bp, Homo sapiens
gcagtttatcattca

SEQ ID NO: 2254177 - DNA, 20 bp, Homo sapiens
gcagtttatcattcaagtgt

SEQ ID NO: 2254178 - DNA, 17 bp, Homo sapiens
gcagttttcaagtcaaa

SEQ ID NO: 2254179 - DNA, 16 bp, Homo sapiens
gcataatgcaatcaaa

SEQ ID NO: 2254180 - DNA, 15 bp, Homo sapiens
gcatactttgtaaat

SEQ ID NO: 2254181 - DNA, 16 bp, Homo sapiens
gcatccatcttggaag

SEQ ID NO: 2254182 - DNA, 17 bp, Homo sapiens
gcatctgttagcagagt

SEQ ID NO: 2254183 - DNA, 23 bp, Homo sapiens
gcatctgttagcagagtctgtct

SEQ ID NO: 2254184 - DNA, 22 bp, Homo sapiens
gcatgaaatgtgaatttttatt

SEQ ID NO: 2254185 - DNA, 18 bp, Homo sapiens
gcatgaggcaaaaatgtc

SEQ ID NO: 2254186 - DNA, 22 bp, Homo sapiens
gcatgggctcgccgtgtctcag

SEQ ID NO: 2254187 - DNA, 17 bp, Homo sapiens
gcatgtaaatgtaaact

SEQ ID NO: 2254188 - DNA, 15 bp, Homo sapiens
gcatgttttgttgct

SEQ ID NO: 2254189 - DNA, 14 bp, Homo sapiens
gcattaataaaact

SEQ ID NO: 2254190 - DNA, 17 bp, Homo sapiens
gcattagaattatttaa

SEQ ID NO: 2254191 - DNA, 14 bp, Homo sapiens
gcattcctgtgccc

SEQ ID NO: 2254192 - DNA, 23 bp, Homo sapiens
gcattctgaatcagaatctcgca

SEQ ID NO: 2254193 - DNA, 16 bp, Homo sapiens
gcattgctcagcccgc

SEQ ID NO: 2254194 - DNA, 20 bp, Homo sapiens
gcattgtaaaagcattttgt

SEQ ID NO: 2254195 - DNA, 17 bp, Homo sapiens
gcatttgtgctagaaat

SEQ ID NO: 2254196 - DNA, 21 bp, Homo sapiens
gccaaaccaggaccctgtcca

SEQ ID NO: 2254197 - DNA, 23 bp, Homo sapiens
gccaaagagcctcccaccagagc

SEQ ID NO: 2254198 - DNA, 21 bp, Homo sapiens
gccaactttccccacgttaaa

SEQ ID NO: 2254199 - DNA, 14 bp, Homo sapiens
gccacatacctctc

SEQ ID NO: 2254200 - DNA, 18 bp, Homo sapiens
gccaccacctttggctgg

SEQ ID NO: 2254201 - DNA, 23 bp, Homo sapiens
gccaccacctttggctggtagca

SEQ ID NO: 2254202 - DNA, 22 bp, Homo sapiens
gccacgctgtcctctcgagccc

SEQ ID NO: 2254203 - DNA, 14 bp, Homo sapiens
gccactcatttcat

SEQ ID NO: 2254204 - DNA, 18 bp, Homo sapiens
gccactcatttcatctca

SEQ ID NO: 2254205 - DNA, 18 bp, Homo sapiens
gccagaccagcaggctgg

SEQ ID NO: 2254206 - DNA, 20 bp, Homo sapiens
gccagaccccacgctgacca

SEQ ID NO: 2254207 - DNA, 16 bp, Homo sapiens
gccagagatgcaatat

SEQ ID NO: 2254208 - DNA, 12 bp, Homo sapiens
gccagcaccctc

SEQ ID NO: 2254209 - DNA, 13 bp, Homo sapiens
gccagcaccctct

SEQ ID NO: 2254210 - DNA, 16 bp, Homo sapiens
gccagcaccctctcct

SEQ ID NO: 2254211 - DNA, 17 bp, Homo sapiens
gccagcaccctctcctg

SEQ ID NO: 2254212 - DNA, 18 bp, Homo sapiens
gccagcaccctctcctgg

SEQ ID NO: 2254213 - DNA, 17 bp, Homo sapiens
gccagccgccctgggct

SEQ ID NO: 2254214 - DNA, 20 bp, Homo sapiens
gccagccgccctgggctgtc

SEQ ID NO: 2254215 - DNA, 20 bp, Homo sapiens
gccagcctcagaaggcccca

SEQ ID NO: 2254216 - DNA, 23 bp, Homo sapiens
gccagcctcagaaggccccagag

SEQ ID NO: 2254217 - DNA, 11 bp, Homo sapiens
gccagcctggc

SEQ ID NO: 2254218 - DNA, 18 bp, Homo sapiens
gccagcctggctctgccc

SEQ ID NO: 2254219 - DNA, 19 bp, Homo sapiens
gccagcctggctctgcccc

SEQ ID NO: 2254220 - DNA, 13 bp, Homo sapiens
gccagcgctgtgg

SEQ ID NO: 2254221 - DNA, 20 bp, Homo sapiens
gccaggatccccctctttgc

SEQ ID NO: 2254222 - DNA, 19 bp, Homo sapiens
gccagggtttacccagtgg

SEQ ID NO: 2254223 - DNA, 13 bp, Homo sapiens
gccatccctgggc

SEQ ID NO: 2254224 - DNA, 14 bp, Homo sapiens
gccatccctgggcc

SEQ ID NO: 2254225 - DNA, 16 bp, Homo sapiens
gccatccctgggcccc

SEQ ID NO: 2254226 - DNA, 18 bp, Homo sapiens
gccatccctgggcccctc

SEQ ID NO: 2254227 - DNA, 19 bp, Homo sapiens
gccatccctgggcccctcc

SEQ ID NO: 2254228 - DNA, 20 bp, Homo sapiens
gccatccctgggcccctcca

SEQ ID NO: 2254229 - DNA, 21 bp, Homo sapiens
gccatccctgggcccctccac

SEQ ID NO: 2254230 - DNA, 15 bp, Homo sapiens
gccatgccaataaag

SEQ ID NO: 2254231 - DNA, 20 bp, Homo sapiens
gccatgccaataaagtgatc

SEQ ID NO: 2254232 - DNA, 18 bp, Homo sapiens
gccatggccttggcaggc

SEQ ID NO: 2254233 - DNA, 19 bp, Homo sapiens
gccattcatgtatgtcaga

SEQ ID NO: 2254234 - DNA, 19 bp, Homo sapiens
gcccaaccatcggtccaca

SEQ ID NO: 2254235 - DNA, 12 bp, Homo sapiens
gcccactcccca

SEQ ID NO: 2254236 - DNA, 14 bp, Homo sapiens
gcccaggagcctca

SEQ ID NO: 2254237 - DNA, 15 bp, Homo sapiens
gcccaggagcctcac

SEQ ID NO: 2254238 - DNA, 18 bp, Homo sapiens
gcccaggagcctcactgg

SEQ ID NO: 2254239 - DNA, 22 bp, Homo sapiens
gcccaggatactggcacagagg

SEQ ID NO: 2254240 - DNA, 15 bp, Homo sapiens
gcccaggtccctccg

SEQ ID NO: 2254241 - DNA, 17 bp, Homo sapiens
gcccatgtgtcccctca

SEQ ID NO: 2254242 - DNA, 22 bp, Homo sapiens
gcccatgtgtcccctcactctg

SEQ ID NO: 2254243 - DNA, 20 bp, Homo sapiens
gccccactcccttgctggcc

SEQ ID NO: 2254244 - DNA, 17 bp, Homo sapiens
gccccagccctgctggg

SEQ ID NO: 2254245 - DNA, 18 bp, Homo sapiens
gccccagccctgctgggg

SEQ ID NO: 2254246 - DNA, 16 bp, Homo sapiens
gccccaggccctccct

SEQ ID NO: 2254247 - DNA, 20 bp, Homo sapiens
gccccaggccctccctgact

SEQ ID NO: 2254248 - DNA, 15 bp, Homo sapiens
gccccagtcacttcc

SEQ ID NO: 2254249 - DNA, 23 bp, Homo sapiens
gcccccagagcccgtcagcgtgg

SEQ ID NO: 2254250 - DNA, 16 bp, Homo sapiens
gccccccagcctctgg

SEQ ID NO: 2254251 - DNA, 19 bp, Homo sapiens
gccccctggcctctgtgcc

SEQ ID NO: 2254252 - DNA, 12 bp, Homo sapiens
gccccgactcca

SEQ ID NO: 2254253 - DNA, 19 bp, Homo sapiens
gccccgactccagccagcg

SEQ ID NO: 2254254 - DNA, 18 bp, Homo sapiens
gcccctaccctggacttg

SEQ ID NO: 2254255 - DNA, 15 bp, Homo sapiens
gcccctctcaccaaa

SEQ ID NO: 2254256 - DNA, 15 bp, Homo sapiens
gcccctgggatggga

SEQ ID NO: 2254257 - DNA, 20 bp, Homo sapiens
gcccctgggatgggaccagg

SEQ ID NO: 2254258 - DNA, 22 bp, Homo sapiens
gccccttccatggtactgtagc

SEQ ID NO: 2254259 - DNA, 15 bp, Homo sapiens
gcccgtcagcgtggg

SEQ ID NO: 2254260 - DNA, 14 bp, Homo sapiens
gccctactattcag

SEQ ID NO: 2254261 - DNA, 20 bp, Homo sapiens
gccctagatgcacgtggggc

SEQ ID NO: 2254262 - DNA, 18 bp, Homo sapiens
gccctcatggcccctctg

SEQ ID NO: 2254263 - DNA, 22 bp, Homo sapiens
gccctcatggcccctctgacct

SEQ ID NO: 2254264 - DNA, 15 bp, Homo sapiens
gccctcccccttccc

SEQ ID NO: 2254265 - DNA, 20 bp, Homo sapiens
gccctgaggcctagactctg

SEQ ID NO: 2254266 - DNA, 14 bp, Homo sapiens
gccctgccccaccc

SEQ ID NO: 2254267 - DNA, 13 bp, Homo sapiens
gggacttgtgtct

SEQ ID NO: 2254268 - DNA, 13 bp, Homo sapiens
gggagaaaattca

SEQ ID NO: 2254269 - DNA, 15 bp, Homo sapiens
gggagaaaattcaat

SEQ ID NO: 2254270 - DNA, 20 bp, Homo sapiens
gggagcctccccctcagatg

SEQ ID NO: 2254271 - DNA, 22 bp, Homo sapiens
gggagcctttggttctggccag

SEQ ID NO: 2254272 - DNA, 13 bp, Homo sapiens
gggaggatacaga

SEQ ID NO: 2254273 - DNA, 18 bp, Homo sapiens
gggaggatacagaggaga

SEQ ID NO: 2254274 - DNA, 19 bp, Homo sapiens
gggatcctccacagagagg

SEQ ID NO: 2254275 - DNA, 14 bp, Homo sapiens
gggatgggccaggg

SEQ ID NO: 2254276 - DNA, 13 bp, Homo sapiens
gggcaagaggaat

SEQ ID NO: 2254277 - DNA, 17 bp, Homo sapiens
gggcaccacaaaatata

SEQ ID NO: 2254278 - DNA, 20 bp, Homo sapiens
gggcacggcgggatcctcca

SEQ ID NO: 2254279 - DNA, 14 bp, Homo sapiens
gggcagcaccctcc

SEQ ID NO: 2254280 - DNA, 17 bp, Homo sapiens
gggcagcaccctccccc

SEQ ID NO: 2254281 - DNA, 18 bp, Homo sapiens
gggcagcaccctcccccg

SEQ ID NO: 2254282 - DNA, 14 bp, Homo sapiens
gggccatgtccaaa

SEQ ID NO: 2254283 - DNA, 17 bp, Homo sapiens
gggccatgtccaaagag

SEQ ID NO: 2254284 - DNA, 12 bp, Homo sapiens
gggcccctccac

SEQ ID NO: 2254285 - DNA, 18 bp, Homo sapiens
gggcccctccacgcctcc

SEQ ID NO: 2254286 - DNA, 19 bp, Homo sapiens
gggccctgccccaccccat

SEQ ID NO: 2254287 - DNA, 21 bp, Homo sapiens
gggccctgccccaccccatcc

SEQ ID NO: 2254288 - DNA, 21 bp, Homo sapiens
gggccttttagaaacctcatt

SEQ ID NO: 2254289 - DNA, 21 bp, Homo sapiens
gggctcgccgtgtctcagcct

SEQ ID NO: 2254290 - DNA, 23 bp, Homo sapiens
gggctgagctggggacctggtac

SEQ ID NO: 2254291 - DNA, 18 bp, Homo sapiens
gggctgaggacgagaccc

SEQ ID NO: 2254292 - DNA, 21 bp, Homo sapiens
ggggatccccgcctggccagg

SEQ ID NO: 2254293 - DNA, 22 bp, Homo sapiens
ggggatccccgcctggccagga

SEQ ID NO: 2254294 - DNA, 20 bp, Homo sapiens
ggggatcttcccacaggagg

SEQ ID NO: 2254295 - DNA, 21 bp, Homo sapiens
ggggcagacaataaaccctca

SEQ ID NO: 2254296 - DNA, 14 bp, Homo sapiens
ggggcaggctgggc

SEQ ID NO: 2254297 - DNA, 13 bp, Homo sapiens
ggggccctgggcc

SEQ ID NO: 2254298 - DNA, 18 bp, Homo sapiens
ggggccctgggcctcagt

SEQ ID NO: 2254299 - DNA, 23 bp, Homo sapiens
ggggccgggcaggtcctgcccat

SEQ ID NO: 2254300 - DNA, 23 bp, Homo sapiens
ggggcctacagctttgatccctg

SEQ ID NO: 2254301 - DNA, 19 bp, Homo sapiens
gggggacgagggccaggca

SEQ ID NO: 2254302 - DNA, 17 bp, Homo sapiens
gggggcaatctctctct

SEQ ID NO: 2254303 - DNA, 12 bp, Homo sapiens
gggggccgggca

SEQ ID NO: 2254304 - DNA, 12 bp, Homo sapiens
gggggtggcagg

SEQ ID NO: 2254305 - DNA, 12 bp, Homo sapiens
gggggtggccat

SEQ ID NO: 2254306 - DNA, 19 bp, Homo sapiens
ggggtcctggagcagacca

SEQ ID NO: 2254307 - DNA, 19 bp, Homo sapiens
ggggtgtggctccttccca

SEQ ID NO: 2254308 - DNA, 23 bp, Homo sapiens
gggtcggaacccaagcttagaac

SEQ ID NO: 2254309 - DNA, 13 bp, Homo sapiens
gggtgagagagga

SEQ ID NO: 2254310 - DNA, 22 bp, Homo sapiens
gggtggcaggcacacagcagcc

SEQ ID NO: 2254311 - DNA, 12 bp, Homo sapiens
gggtggggtggg

SEQ ID NO: 2254312 - DNA, 18 bp, Homo sapiens
gggtgtggcctcagccct

SEQ ID NO: 2254313 - DNA, 20 bp, Homo sapiens
gggtttacccagtgggacag

SEQ ID NO: 2254314 - DNA, 15 bp, Homo sapiens
gggtttcctgcaggc

SEQ ID NO: 2254315 - DNA, 18 bp, Homo sapiens
ggtaatattgataagcta

SEQ ID NO: 2254316 - DNA, 13 bp, Homo sapiens
ggtaccctctgga

SEQ ID NO: 2254317 - DNA, 16 bp, Homo sapiens
ggtacttttaaaaaca

SEQ ID NO: 2254318 - DNA, 16 bp, Homo sapiens
ggtagcagcaggctca

SEQ ID NO: 2254319 - DNA, 15 bp, Homo sapiens
ggtagtctcactgct

SEQ ID NO: 2254320 - DNA, 20 bp, Homo sapiens
ggtagtctcactgcttgaac

SEQ ID NO: 2254321 - DNA, 14 bp, Homo sapiens
ggtatcaaaattac

SEQ ID NO: 2254322 - DNA, 15 bp, Homo sapiens
ggtatgctggccagc

SEQ ID NO: 2254323 - DNA, 16 bp, Homo sapiens
ggtatgctggccagca

SEQ ID NO: 2254324 - DNA, 20 bp, Homo sapiens
ggtatgctggccagcaccct

SEQ ID NO: 2254325 - DNA, 16 bp, Homo sapiens
ggtattaataaaaaga

SEQ ID NO: 2254326 - DNA, 18 bp, Homo sapiens
ggtccctccgcggctgga

SEQ ID NO: 2254327 - DNA, 21 bp, Homo sapiens
ggtccctccgcggctggagcg

SEQ ID NO: 2254328 - DNA, 14 bp, Homo sapiens
ggtctaggacacag

SEQ ID NO: 2254329 - DNA, 20 bp, Homo sapiens
ggtctcccttctctacactc

SEQ ID NO: 2254330 - DNA, 16 bp, Homo sapiens
ggtgacacctccccct

SEQ ID NO: 2254331 - DNA, 20 bp, Homo sapiens
ggtgacctccgtcctctccc

SEQ ID NO: 2254332 - DNA, 23 bp, Homo sapiens
ggtgactgtcccaccgggagcct

SEQ ID NO: 2254333 - DNA, 20 bp, Homo sapiens
ggtgattctaatcatctgca

SEQ ID NO: 2254334 - DNA, 13 bp, Homo sapiens
ggtgcctgtccca

SEQ ID NO: 2254335 - DNA, 16 bp, Homo sapiens
ggtgctcatagcgggc

SEQ ID NO: 2254336 - DNA, 18 bp, Homo sapiens
ggtgctttttataaaaag

SEQ ID NO: 2254337 - DNA, 18 bp, Homo sapiens
ggtggcacaggccccctt

SEQ ID NO: 2254338 - DNA, 23 bp, Homo sapiens
ggtggcaggcacacagcagcccc

SEQ ID NO: 2254339 - DNA, 14 bp, Homo sapiens
ggtggccatccctg

SEQ ID NO: 2254340 - DNA, 16 bp, Homo sapiens
ggtggccatccctggg

SEQ ID NO: 2254341 - DNA, 19 bp, Homo sapiens
ggtggccatccctgggccc

SEQ ID NO: 2254342 - DNA, 23 bp, Homo sapiens
ggtggccatccctgggcccctcc

SEQ ID NO: 2254343 - DNA, 17 bp, Homo sapiens
ggtgtaaagttgttcgc

SEQ ID NO: 2254344 - DNA, 18 bp, Homo sapiens
ggtgtggcctcagccctc

SEQ ID NO: 2254345 - DNA, 17 bp, Homo sapiens
ggtgtggtgcagtgtga

SEQ ID NO: 2254346 - DNA, 20 bp, Homo sapiens
ggttaggtcttaggaattga

SEQ ID NO: 2254347 - DNA, 17 bp, Homo sapiens
ggttcccgtttctccac

SEQ ID NO: 2254348 - DNA, 17 bp, Homo sapiens
ggtttcgaagtcattaa

SEQ ID NO: 2254349 - DNA, 14 bp, Homo sapiens
ggtttggtgctttt

SEQ ID NO: 2254350 - DNA, 21 bp, Homo sapiens
ggtttttaatctttgtgacag

SEQ ID NO: 2254351 - DNA, 15 bp, Homo sapiens
ggtttttattagtac

SEQ ID NO: 2254352 - DNA, 21 bp, Homo sapiens
ggtttttatttctcgggtgca

SEQ ID NO: 2254353 - DNA, 18 bp, Homo sapiens
gtaaaaataaaatacttt

SEQ ID NO: 2254354 - DNA, 20 bp, Homo sapiens
gtaaaaataaaatactttga

SEQ ID NO: 2254355 - DNA, 16 bp, Homo sapiens
gtaaaagcattttgta

SEQ ID NO: 2254356 - DNA, 21 bp, Homo sapiens
gtaaaatattttgaatcaata

SEQ ID NO: 2254357 - DNA, 15 bp, Homo sapiens
gtaaaatgtctttcc

SEQ ID NO: 2254358 - DNA, 18 bp, Homo sapiens
gtaaagggcaaataatga

SEQ ID NO: 2254359 - DNA, 15 bp, Homo sapiens
gtaaataataaataa

SEQ ID NO: 2254360 - DNA, 19 bp, Homo sapiens
gtaaattgaatcagtataa

SEQ ID NO: 2254361 - DNA, 23 bp, Homo sapiens
gtaacccagattttgctgtatat

SEQ ID NO: 2254362 - DNA, 22 bp, Homo sapiens
gtaactaaaataattttgtaat

SEQ ID NO: 2254363 - DNA, 12 bp, Homo sapiens
gtaagctgtgtg

SEQ ID NO: 2254364 - DNA, 12 bp, Homo sapiens
gtaataataaag

SEQ ID NO: 2254365 - DNA, 16 bp, Homo sapiens
gtaataataaagaata

SEQ ID NO: 2254366 - DNA, 16 bp, Homo sapiens
gtaatatttaaatatt

SEQ ID NO: 2254367 - DNA, 18 bp, Homo sapiens
gtaatattttactttgag

SEQ ID NO: 2254368 - DNA, 13 bp, Homo sapiens
gtaatttaatggg

SEQ ID NO: 2254369 - DNA, 13 bp, Homo sapiens
gtaccaagtgaaa

SEQ ID NO: 2254370 - DNA, 17 bp, Homo sapiens
gtaccctcctggctctt

SEQ ID NO: 2254371 - DNA, 15 bp, Homo sapiens
gtaccctctggaggg

SEQ ID NO: 2254372 - DNA, 15 bp, Homo sapiens
gtacctggggccaaa

SEQ ID NO: 2254373 - DNA, 16 bp, Homo sapiens
gtacgttatatattgt

SEQ ID NO: 2254374 - DNA, 18 bp, Homo sapiens
gtacgttatatattgtat

SEQ ID NO: 2254375 - DNA, 13 bp, Homo sapiens
taacttttctacc

SEQ ID NO: 2254376 - DNA, 19 bp, Homo sapiens
taacttttctaccatttct

SEQ ID NO: 2254377 - DNA, 14 bp, Homo sapiens
taagaaaatgcttg

SEQ ID NO: 2254378 - DNA, 15 bp, Homo sapiens
taagaaatcaagtaa

SEQ ID NO: 2254379 - DNA, 19 bp, Homo sapiens
taagaacattaattatatg

SEQ ID NO: 2254380 - DNA, 21 bp, Homo sapiens
taagaacattaattatatgta

SEQ ID NO: 2254381 - DNA, 22 bp, Homo sapiens
taagaattcaaactggggcctc

SEQ ID NO: 2254382 - DNA, 14 bp, Homo sapiens
taagacgtgaatgt

SEQ ID NO: 2254383 - DNA, 19 bp, Homo sapiens
taagacgtgaatgtctcag

SEQ ID NO: 2254384 - DNA, 16 bp, Homo sapiens
taagatggttgaccaa

SEQ ID NO: 2254385 - DNA, 21 bp, Homo sapiens
taagcaaacaaatattgccaa

SEQ ID NO: 2254386 - DNA, 19 bp, Homo sapiens
taagcatactttgtaaata

SEQ ID NO: 2254387 - DNA, 22 bp, Homo sapiens
taagctgttcctgttcagtaat

SEQ ID NO: 2254388 - DNA, 15 bp, Homo sapiens
taaggaaactagaca

SEQ ID NO: 2254389 - DNA, 16 bp, Homo sapiens
taaggactagatacta

SEQ ID NO: 2254390 - DNA, 12 bp, Homo sapiens
taagggaaaaat

SEQ ID NO: 2254391 - DNA, 17 bp, Homo sapiens
taagggaaaaatatata

SEQ ID NO: 2254392 - DNA, 13 bp, Homo sapiens
taagggcatttta

SEQ ID NO: 2254393 - DNA, 18 bp, Homo sapiens
taaggtctttcagtactt

SEQ ID NO: 2254394 - DNA, 20 bp, Homo sapiens
taaggtgatatatttaaaaa

SEQ ID NO: 2254395 - DNA, 19 bp, Homo sapiens
taagtgatgtgctgaattt

SEQ ID NO: 2254396 - DNA, 19 bp, Homo sapiens
taagtggaggcactttagg

SEQ ID NO: 2254397 - DNA, 23 bp, Homo sapiens
taagtgtatttttcaataaagca

SEQ ID NO: 2254398 - DNA, 23 bp, Homo sapiens
taagttatgcctctgacagtcca

SEQ ID NO: 2254399 - DNA, 20 bp, Homo sapiens
taagttttagaatcttttaa

SEQ ID NO: 2254400 - DNA, 14 bp, Homo sapiens
taataaatatatac

SEQ ID NO: 2254401 - DNA, 14 bp, Homo sapiens
taataagtttgaaa

SEQ ID NO: 2254402 - DNA, 16 bp, Homo sapiens
taataataaagaatag

SEQ ID NO: 2254403 - DNA, 19 bp, Homo sapiens
taatacaaggtataataaa

SEQ ID NO: 2254404 - DNA, 12 bp, Homo sapiens
taatacagattt

SEQ ID NO: 2254405 - DNA, 15 bp, Homo sapiens
taatagaaatgtctc

SEQ ID NO: 2254406 - DNA, 16 bp, Homo sapiens
taatagggaatatatc

SEQ ID NO: 2254407 - DNA, 18 bp, Homo sapiens
taatagtttgttgatctg

SEQ ID NO: 2254408 - DNA, 16 bp, Homo sapiens
taatatagctgagact

SEQ ID NO: 2254409 - DNA, 15 bp, Homo sapiens
taatatctttctgca

SEQ ID NO: 2254410 - DNA, 14 bp, Homo sapiens
taatatgaaaactt

SEQ ID NO: 2254411 - DNA, 16 bp, Homo sapiens
taatatgaaaacttat

SEQ ID NO: 2254412 - DNA, 20 bp, Homo sapiens
taatattaacttttaatggt

SEQ ID NO: 2254413 - DNA, 21 bp, Homo sapiens
taatcaccctaccaactttac

SEQ ID NO: 2254414 - DNA, 17 bp, Homo sapiens
taatcaccttctttgta

SEQ ID NO: 2254415 - DNA, 17 bp, Homo sapiens
taatcattttcattcct

SEQ ID NO: 2254416 - DNA, 22 bp, Homo sapiens
taatccattccttgaggacaga

SEQ ID NO: 2254417 - DNA, 15 bp, Homo sapiens
taatccttgataata

SEQ ID NO: 2254418 - DNA, 16 bp, Homo sapiens
taatctcagtgctttc

SEQ ID NO: 2254419 - DNA, 21 bp, Homo sapiens
taatcttattagggagaaaat

SEQ ID NO: 2254420 - DNA, 17 bp, Homo sapiens
taatcttgtagacactt

SEQ ID NO: 2254421 - DNA, 22 bp, Homo sapiens
taatcttgtagacacttacttg

SEQ ID NO: 2254422 - DNA, 20 bp, Homo sapiens
taatgaaggttttcatttgc

SEQ ID NO: 2254423 - DNA, 15 bp, Homo sapiens
taatgacaggcctgt

SEQ ID NO: 2254424 - DNA, 13 bp, Homo sapiens
taatgatatactg

SEQ ID NO: 2254425 - DNA, 16 bp, Homo sapiens
taatgatatgcttgta

SEQ ID NO: 2254426 - DNA, 18 bp, Homo sapiens
taatgatcgaaaaaataa

SEQ ID NO: 2254427 - DNA, 19 bp, Homo sapiens
taatgatcgaaaaaataat

SEQ ID NO: 2254428 - DNA, 17 bp, Homo sapiens
taatgctatttgaacaa

SEQ ID NO: 2254429 - DNA, 14 bp, Homo sapiens
taatgcttttatat

SEQ ID NO: 2254430 - DNA, 17 bp, Homo sapiens
taatggggtctgtaaat

SEQ ID NO: 2254431 - DNA, 19 bp, Homo sapiens
taatgtatcaaatacattt

SEQ ID NO: 2254432 - DNA, 15 bp, Homo sapiens
taattaattgtcatt

SEQ ID NO: 2254433 - DNA, 20 bp, Homo sapiens
taattatatgtatattgtct

SEQ ID NO: 2254434 - DNA, 21 bp, Homo sapiens
taattgacttgcaaagaccta

SEQ ID NO: 2254435 - DNA, 13 bp, Homo sapiens
taatttaatgggg

SEQ ID NO: 2254436 - DNA, 16 bp, Homo sapiens
taatttagttgtttct

SEQ ID NO: 2254437 - DNA, 17 bp, Homo sapiens
taatttagttgtttcta

SEQ ID NO: 2254438 - DNA, 19 bp, Homo sapiens
taatttagttgtttctaga

SEQ ID NO: 2254439 - DNA, 16 bp, Homo sapiens
taatttgtttccagca

SEQ ID NO: 2254440 - DNA, 21 bp, Homo sapiens
taattttacatgtttataaat

SEQ ID NO: 2254441 - DNA, 20 bp, Homo sapiens
taattttcctcaatcacact

SEQ ID NO: 2254442 - DNA, 17 bp, Homo sapiens
taatttttatactgaca

SEQ ID NO: 2254443 - DNA, 15 bp, Homo sapiens
taatttttgctttta

SEQ ID NO: 2254444 - DNA, 20 bp, Homo sapiens
taatttttgcttttagaaaa

SEQ ID NO: 2254445 - DNA, 21 bp, Homo sapiens
taatttttgtattatttttgt

SEQ ID NO: 2254446 - DNA, 14 bp, Homo sapiens
tacaatgtgaactt

SEQ ID NO: 2254447 - DNA, 17 bp, Homo sapiens
tacaatgtgaactttat

SEQ ID NO: 2254448 - DNA, 16 bp, Homo sapiens
tacaattcattgtgtt

SEQ ID NO: 2254449 - DNA, 12 bp, Homo sapiens
tacaattttatc

SEQ ID NO: 2254450 - DNA, 13 bp, Homo sapiens
tacaatttttatt

SEQ ID NO: 2254451 - DNA, 17 bp, Homo sapiens
tacaatttttatttctt

SEQ ID NO: 2254452 - DNA, 22 bp, Homo sapiens
tacaatttttatttcttttact

SEQ ID NO: 2254453 - DNA, 23 bp, Homo sapiens
tacacaaatgtgatttttgtaat

SEQ ID NO: 2254454 - DNA, 17 bp, Homo sapiens
tacacttaattacagtt

SEQ ID NO: 2254455 - DNA, 16 bp, Homo sapiens
tacacttttatttcct

SEQ ID NO: 2254456 - DNA, 14 bp, Homo sapiens
tacagaataaaaga

SEQ ID NO: 2254457 - DNA, 19 bp, Homo sapiens
tacagactggatgtaccac

SEQ ID NO: 2254458 - DNA, 19 bp, Homo sapiens
tacagctttgatccctgac

SEQ ID NO: 2254459 - DNA, 16 bp, Homo sapiens
tacagtctagtactta

SEQ ID NO: 2254460 - DNA, 17 bp, Homo sapiens
tacagttataaaattaa

SEQ ID NO: 2254461 - DNA, 17 bp, Homo sapiens
tacagttgaaataactg

SEQ ID NO: 2254462 - DNA, 15 bp, Homo sapiens
tacatacgatttaag

SEQ ID NO: 2254463 - DNA, 16 bp, Homo sapiens
tacatacgatttaagg

SEQ ID NO: 2254464 - DNA, 19 bp, Homo sapiens
tacatacgatttaaggtat

SEQ ID NO: 2254465 - DNA, 17 bp, Homo sapiens
tacatgcttagaggggt

SEQ ID NO: 2254466 - DNA, 13 bp, Homo sapiens
tacatgtaatttg

SEQ ID NO: 2254467 - DNA, 23 bp, Homo sapiens
tacatttaaaccttttattataa

SEQ ID NO: 2254468 - DNA, 20 bp, Homo sapiens
tacatttatttatccagaaa

SEQ ID NO: 2254469 - DNA, 14 bp, Homo sapiens
taccacttacctca

SEQ ID NO: 2254470 - DNA, 15 bp, Homo sapiens
taccacttacctcaa

SEQ ID NO: 2254471 - DNA, 11 bp, Homo sapiens
taccagccagc

SEQ ID NO: 2254472 - DNA, 23 bp, Homo sapiens
taccattcagtgattactgtcaa

SEQ ID NO: 2254473 - DNA, 13 bp, Homo sapiens
taccccctccttc

SEQ ID NO: 2254474 - DNA, 17 bp, Homo sapiens
taccccctccttcagac

SEQ ID NO: 2254475 - DNA, 18 bp, Homo sapiens
taccccctccttcagaca

SEQ ID NO: 2254476 - DNA, 20 bp, Homo sapiens
taccctctcagctccaggtg

SEQ ID NO: 2254477 - DNA, 22 bp, Homo sapiens
taccctctggaggggtgtggct

SEQ ID NO: 2254478 - DNA, 17 bp, Homo sapiens
taccctttttctccagc

SEQ ID NO: 2254479 - DNA, 14 bp, Homo sapiens
tacctcaggcagct

SEQ ID NO: 2254480 - DNA, 15 bp, Homo sapiens
tacctcatttttcat

SEQ ID NO: 2254481 - DNA, 16 bp, Homo sapiens
taccttttacagaata

SEQ ID NO: 2254482 - DNA, 21 bp, Homo sapiens
taccttttgaggagccccagc

SEQ ID NO: 2254483 - DNA, 14 bp, Homo sapiens
tatatggatcagag

SEQ ID NO: 2254484 - DNA, 13 bp, Homo sapiens
tatattacaatga

SEQ ID NO: 2254485 - DNA, 16 bp, Homo sapiens
tatatttctaaatgtt

SEQ ID NO: 2254486 - DNA, 23 bp, Homo sapiens
tatatttgtgatagcactttcta

SEQ ID NO: 2254487 - DNA, 11 bp, Homo sapiens
tatattttgtt

SEQ ID NO: 2254488 - DNA, 15 bp, Homo sapiens
tatattttgttacct

SEQ ID NO: 2254489 - DNA, 22 bp, Homo sapiens
tatatttttatctatataaaat

SEQ ID NO: 2254490 - DNA, 23 bp, Homo sapiens
tatcaaatacatttaaaacatta

SEQ ID NO: 2254491 - DNA, 12 bp, Homo sapiens
tatcaatgtgtc

SEQ ID NO: 2254492 - DNA, 18 bp, Homo sapiens
tatcaatgtgtctttcta

SEQ ID NO: 2254493 - DNA, 22 bp, Homo sapiens
tatcagggaaactaagattctt

SEQ ID NO: 2254494 - DNA, 13 bp, Homo sapiens
tatcatgttaacc

SEQ ID NO: 2254495 - DNA, 17 bp, Homo sapiens
tatccagaaaactgtga

SEQ ID NO: 2254496 - DNA, 15 bp, Homo sapiens
tatccaggcaccagg

SEQ ID NO: 2254497 - DNA, 22 bp, Homo sapiens
tatcctgggggacccaatgtag

SEQ ID NO: 2254498 - DNA, 14 bp, Homo sapiens
tatctaaaagaaat

SEQ ID NO: 2254499 - DNA, 13 bp, Homo sapiens
tatctaagaataa

SEQ ID NO: 2254500 - DNA, 15 bp, Homo sapiens
tatctaagaataata

SEQ ID NO: 2254501 - DNA, 19 bp, Homo sapiens
tatctaagaataataaaat

SEQ ID NO: 2254502 - DNA, 20 bp, Homo sapiens
tatctatacatatctttatt

SEQ ID NO: 2254503 - DNA, 14 bp, Homo sapiens
tatctatataaaat

SEQ ID NO: 2254504 - DNA, 15 bp, Homo sapiens
tatctatataaaata

SEQ ID NO: 2254505 - DNA, 16 bp, Homo sapiens
tatctatctatttgag

SEQ ID NO: 2254506 - DNA, 17 bp, Homo sapiens
tatctatctatttgagg

SEQ ID NO: 2254507 - DNA, 15 bp, Homo sapiens
tatctcagatgttaa

SEQ ID NO: 2254508 - DNA, 22 bp, Homo sapiens
tatctccatgatgatagttgaa

SEQ ID NO: 2254509 - DNA, 16 bp, Homo sapiens
tatctctatttgagaa

SEQ ID NO: 2254510 - DNA, 18 bp, Homo sapiens
tatctctgagttctgtgt

SEQ ID NO: 2254511 - DNA, 21 bp, Homo sapiens
tatctgtcatctctctggggc

SEQ ID NO: 2254512 - DNA, 20 bp, Homo sapiens
tatctgtttcctgacattgt

SEQ ID NO: 2254513 - DNA, 14 bp, Homo sapiens
tatctttattaatc

SEQ ID NO: 2254514 - DNA, 13 bp, Homo sapiens
tatgaatactttg

SEQ ID NO: 2254515 - DNA, 15 bp, Homo sapiens
tatgaatactttgca

SEQ ID NO: 2254516 - DNA, 18 bp, Homo sapiens
tatgagctttcagactcc

SEQ ID NO: 2254517 - DNA, 14 bp, Homo sapiens
tatgatctgtctgt

SEQ ID NO: 2254518 - DNA, 17 bp, Homo sapiens
tatgatttaatttgaaa

SEQ ID NO: 2254519 - DNA, 18 bp, Homo sapiens
tatgatttaatttgaaat

SEQ ID NO: 2254520 - DNA, 12 bp, Homo sapiens
tatgcacacttt

SEQ ID NO: 2254521 - DNA, 22 bp, Homo sapiens
tatgcacacttttaattttgtc

SEQ ID NO: 2254522 - DNA, 22 bp, Homo sapiens
tatgcctctgacagtccacagg

SEQ ID NO: 2254523 - DNA, 17 bp, Homo sapiens
tatgcgtaatttaatgg

SEQ ID NO: 2254524 - DNA, 18 bp, Homo sapiens
tatgctctcactgtttgt

SEQ ID NO: 2254525 - DNA, 14 bp, Homo sapiens
tatggaaaaataaa

SEQ ID NO: 2254526 - DNA, 20 bp, Homo sapiens
tatggaaccttccctccaaa

SEQ ID NO: 2254527 - DNA, 16 bp, Homo sapiens
tatggtatgctggcca

SEQ ID NO: 2254528 - DNA, 21 bp, Homo sapiens
tatgtaaatggtatgtcattc

SEQ ID NO: 2254529 - DNA, 12 bp, Homo sapiens
tatgtataaaat

SEQ ID NO: 2254530 - DNA, 12 bp, Homo sapiens
tatgtgtaaaga

SEQ ID NO: 2254531 - DNA, 16 bp, Homo sapiens
tattaaatacaaaact

SEQ ID NO: 2254532 - DNA, 21 bp, Homo sapiens
tattaagacaatagcacttaa

SEQ ID NO: 2254533 - DNA, 15 bp, Homo sapiens
tattaagggcatttt

SEQ ID NO: 2254534 - DNA, 16 bp, Homo sapiens
tattaataaaaagaca

SEQ ID NO: 2254535 - DNA, 21 bp, Homo sapiens
tattaatcaccttctttgtaa

SEQ ID NO: 2254536 - DNA, 14 bp, Homo sapiens
tattaatttattta

SEQ ID NO: 2254537 - DNA, 14 bp, Homo sapiens
tattacaatgatca

SEQ ID NO: 2254538 - DNA, 12 bp, Homo sapiens
tattacttgaac

SEQ ID NO: 2254539 - DNA, 14 bp, Homo sapiens
tattacttgaactt

SEQ ID NO: 2254540 - DNA, 15 bp, Homo sapiens
tattagggagaaaat

SEQ ID NO: 2254541 - DNA, 22 bp, Homo sapiens
tattagttccccaaatacaaag

SEQ ID NO: 2254542 - DNA, 13 bp, Homo sapiens
tattataaaaata

SEQ ID NO: 2254543 - DNA, 17 bp, Homo sapiens
tattataaaaatattaa

SEQ ID NO: 2254544 - DNA, 14 bp, Homo sapiens
tattatcactgtct

SEQ ID NO: 2254545 - DNA, 14 bp, Homo sapiens
tattatgttgttca

SEQ ID NO: 2254546 - DNA, 17 bp, Homo sapiens
tattattaatataataa

SEQ ID NO: 2254547 - DNA, 12 bp, Homo sapiens
tattattagggc

SEQ ID NO: 2254548 - DNA, 22 bp, Homo sapiens
tattctgggcaccacaaaatat

SEQ ID NO: 2254549 - DNA, 13 bp, Homo sapiens
tattcttctcttc

SEQ ID NO: 2254550 - DNA, 13 bp, Homo sapiens
tattgcagtttat

SEQ ID NO: 2254551 - DNA, 20 bp, Homo sapiens
tattgcagtttatcattcaa

SEQ ID NO: 2254552 - DNA, 17 bp, Homo sapiens
tattgccttttaatttt

SEQ ID NO: 2254553 - DNA, 21 bp, Homo sapiens
tattgccttttaatttttaat

SEQ ID NO: 2254554 - DNA, 16 bp, Homo sapiens
tattgctgagagaaat

SEQ ID NO: 2254555 - DNA, 18 bp, Homo sapiens
tattggggccatgagtaa

SEQ ID NO: 2254556 - DNA, 18 bp, Homo sapiens
tattgtaatgagtgaatt

SEQ ID NO: 2254557 - DNA, 16 bp, Homo sapiens
tattgtatattacaat

SEQ ID NO: 2254558 - DNA, 17 bp, Homo sapiens
tattgtatattacaatg

SEQ ID NO: 2254559 - DNA, 14 bp, Homo sapiens
tattgtcaccagga

SEQ ID NO: 2254560 - DNA, 20 bp, Homo sapiens
tattgtcctcccctatttta

SEQ ID NO: 2254561 - DNA, 14 bp, Homo sapiens
tattgtctagtaat

SEQ ID NO: 2254562 - DNA, 17 bp, Homo sapiens
tattgtgttgactttat

SEQ ID NO: 2254563 - DNA, 23 bp, Homo sapiens
tattgttccagcagttttcaagt

SEQ ID NO: 2254564 - DNA, 15 bp, Homo sapiens
tattgttttacaata

SEQ ID NO: 2254565 - DNA, 18 bp, Homo sapiens
tatttaagatgtgaaaat

SEQ ID NO: 2254566 - DNA, 15 bp, Homo sapiens
tatttaattgaaact

SEQ ID NO: 2254567 - DNA, 23 bp, Homo sapiens
tatttaattgaaactctctgttc

SEQ ID NO: 2254568 - DNA, 15 bp, Homo sapiens
tatttatatacaagt

SEQ ID NO: 2254569 - DNA, 20 bp, Homo sapiens
tatttatggatatcacacat

SEQ ID NO: 2254570 - DNA, 13 bp, Homo sapiens
tatttatgtttgc

SEQ ID NO: 2254571 - DNA, 16 bp, Homo sapiens
tatttattacataatt

SEQ ID NO: 2254572 - DNA, 20 bp, Homo sapiens
tatttattacataatttagt

SEQ ID NO: 2254573 - DNA, 11 bp, Homo sapiens
tatttatttac

SEQ ID NO: 2254574 - DNA, 14 bp, Homo sapiens
tatttctattatta

SEQ ID NO: 2254575 - DNA, 16 bp, Homo sapiens
tatttgaacaatgaag

SEQ ID NO: 2254576 - DNA, 12 bp, Homo sapiens
tatttgtaagat

SEQ ID NO: 2254577 - DNA, 18 bp, Homo sapiens
tattttaagactgatttt

SEQ ID NO: 2254578 - DNA, 21 bp, Homo sapiens
tattttcagtcaaaactttaa

SEQ ID NO: 2254579 - DNA, 19 bp, Homo sapiens
tattttctattttaagact

SEQ ID NO: 2254580 - DNA, 13 bp, Homo sapiens
tattttgaatcaa

SEQ ID NO: 2254581 - DNA, 19 bp, Homo sapiens
tattttggaaattgagtct

SEQ ID NO: 2254582 - DNA, 18 bp, Homo sapiens
tatttttatctatataaa

SEQ ID NO: 2254583 - DNA, 20 bp, Homo sapiens
tatttttcaataaagcattt

SEQ ID NO: 2254584 - DNA, 18 bp, Homo sapiens
tatttttcataaacaagt

SEQ ID NO: 2254585 - DNA, 11 bp, Homo sapiens
tattttttcct

SEQ ID NO: 2254586 - DNA, 13 bp, Homo sapiens
tcaaaacacacta

SEQ ID NO: 2254587 - DNA, 14 bp, Homo sapiens
tcaaaaccatctct

SEQ ID NO: 2254588 - DNA, 19 bp, Homo sapiens
tcaaaaccatctctcttcc

SEQ ID NO: 2254589 - DNA, 18 bp, Homo sapiens
tcaaaactttaaacctgt

SEQ ID NO: 2254590 - DNA, 15 bp, Homo sapiens
tcaaaattacatata

SEQ ID NO: 2254591 - DNA, 21 bp, Homo sapiens
tcaaaatttaacagttacctg

SEQ ID NO: 2254592 - DNA, 15 bp, Homo sapiens
tcatctgcagttctt

SEQ ID NO: 2254593 - DNA, 23 bp, Homo sapiens
tcatctgcagttctttttgtaca

SEQ ID NO: 2254594 - DNA, 15 bp, Homo sapiens
tcatctggggtgggg

SEQ ID NO: 2254595 - DNA, 18 bp, Homo sapiens
tcatgacggcttttgtca

SEQ ID NO: 2254596 - DNA, 21 bp, Homo sapiens
tcatgccagctacttcctcct

SEQ ID NO: 2254597 - DNA, 21 bp, Homo sapiens
tcatgctggcctgtgtgatac

SEQ ID NO: 2254598 - DNA, 15 bp, Homo sapiens
tcatgtactttttag

SEQ ID NO: 2254599 - DNA, 18 bp, Homo sapiens
tcatgtattttacacaaa

SEQ ID NO: 2254600 - DNA, 20 bp, Homo sapiens
tcattatttttgttagcaaa

SEQ ID NO: 2254601 - DNA, 20 bp, Homo sapiens
tcattcaaactgcactttta

SEQ ID NO: 2254602 - DNA, 21 bp, Homo sapiens
tcattcagcagcaaattttca

SEQ ID NO: 2254603 - DNA, 23 bp, Homo sapiens
tcattcgctactatgatttaatt

SEQ ID NO: 2254604 - DNA, 22 bp, Homo sapiens
tcattgctgagcctctgctccc

SEQ ID NO: 2254605 - DNA, 23 bp, Homo sapiens
tcattgctgagcctctgctcccc

SEQ ID NO: 2254606 - DNA, 22 bp, Homo sapiens
tcattgtgtatcagtttccatg

SEQ ID NO: 2254607 - DNA, 15 bp, Homo sapiens
tcatttaagggaaaa

SEQ ID NO: 2254608 - DNA, 11 bp, Homo sapiens
tcatttcatct

SEQ ID NO: 2254609 - DNA, 14 bp, Homo sapiens
tcatttcatctcat

SEQ ID NO: 2254610 - DNA, 15 bp, Homo sapiens
tcatttgctttggaa

SEQ ID NO: 2254611 - DNA, 18 bp, Homo sapiens
tcatttgtttacatttga

SEQ ID NO: 2254612 - DNA, 17 bp, Homo sapiens
tcatttgttttttcaat

SEQ ID NO: 2254613 - DNA, 11 bp, Homo sapiens
tcatttttcaa

SEQ ID NO: 2254614 - DNA, 21 bp, Homo sapiens
tccaaaaaaaaaaaaaataca

SEQ ID NO: 2254615 - DNA, 22 bp, Homo sapiens
tccaaacttggatttttgactc

SEQ ID NO: 2254616 - DNA, 16 bp, Homo sapiens
tccaaagaggctgccc

SEQ ID NO: 2254617 - DNA, 18 bp, Homo sapiens
tccaaagaggctgcccct

SEQ ID NO: 2254618 - DNA, 15 bp, Homo sapiens
tccaaattatttctt

SEQ ID NO: 2254619 - DNA, 16 bp, Homo sapiens
tccaaccattttcatt

SEQ ID NO: 2254620 - DNA, 14 bp, Homo sapiens
tccaaccttcccaa

SEQ ID NO: 2254621 - DNA, 23 bp, Homo sapiens
tccaagctgcgggctccctggca

SEQ ID NO: 2254622 - DNA, 18 bp, Homo sapiens
tccaagtctgtacctcaa

SEQ ID NO: 2254623 - DNA, 19 bp, Homo sapiens
tccaagtctgtacctcaaa

SEQ ID NO: 2254624 - DNA, 21 bp, Homo sapiens
tccacacccaatgctgctcca

SEQ ID NO: 2254625 - DNA, 15 bp, Homo sapiens
tccacagaggacaca

SEQ ID NO: 2254626 - DNA, 17 bp, Homo sapiens
tccacagaggacacaga

SEQ ID NO: 2254627 - DNA, 19 bp, Homo sapiens
tccacagaggacacagaga

SEQ ID NO: 2254628 - DNA, 14 bp, Homo sapiens
tccacaggggccac

SEQ ID NO: 2254629 - DNA, 14 bp, Homo sapiens
tccacatgttactg

SEQ ID NO: 2254630 - DNA, 12 bp, Homo sapiens
tccaccccagga

SEQ ID NO: 2254631 - DNA, 22 bp, Homo sapiens
tccaccccatccctccccagtt

SEQ ID NO: 2254632 - DNA, 18 bp, Homo sapiens
tccaccctcccccagaca

SEQ ID NO: 2254633 - DNA, 15 bp, Homo sapiens
tccacgcctcctggc

SEQ ID NO: 2254634 - DNA, 17 bp, Homo sapiens
tccacgcctcctggcca

SEQ ID NO: 2254635 - DNA, 15 bp, Homo sapiens
tccactccattgtcg

SEQ ID NO: 2254636 - DNA, 16 bp, Homo sapiens
tccactcgtgtgtttc

SEQ ID NO: 2254637 - DNA, 22 bp, Homo sapiens
tccacttgtatatatggatcag

SEQ ID NO: 2254638 - DNA, 14 bp, Homo sapiens
tccactttcatctg

SEQ ID NO: 2254639 - DNA, 18 bp, Homo sapiens
tccagacttcaaaaggaa

SEQ ID NO: 2254640 - DNA, 14 bp, Homo sapiens
tccagacttccttg

SEQ ID NO: 2254641 - DNA, 20 bp, Homo sapiens
tccagacttccttgagacac

SEQ ID NO: 2254642 - DNA, 18 bp, Homo sapiens
tccagatgtttccagact

SEQ ID NO: 2254643 - DNA, 14 bp, Homo sapiens
tccagcagttttca

SEQ ID NO: 2254644 - DNA, 20 bp, Homo sapiens
tccagccactggctgctaac

SEQ ID NO: 2254645 - DNA, 18 bp, Homo sapiens
tccagccagcgcctccct

SEQ ID NO: 2254646 - DNA, 19 bp, Homo sapiens
tccagccagcgcctccctc

SEQ ID NO: 2254647 - DNA, 21 bp, Homo sapiens
tccagccagcgcctccctcca

SEQ ID NO: 2254648 - DNA, 12 bp, Homo sapiens
tccagcctccag

SEQ ID NO: 2254649 - DNA, 13 bp, Homo sapiens
tccagcctccagg

SEQ ID NO: 2254650 - DNA, 16 bp, Homo sapiens
tccagcctccagggca

SEQ ID NO: 2254651 - DNA, 19 bp, Homo sapiens
tccagcctggggctgaggc

SEQ ID NO: 2254652 - DNA, 17 bp, Homo sapiens
tccagctgcctattgat

SEQ ID NO: 2254653 - DNA, 21 bp, Homo sapiens
tccaggcaccaggactagggc

SEQ ID NO: 2254654 - DNA, 20 bp, Homo sapiens
tccagggcattgctcagccc

SEQ ID NO: 2254655 - DNA, 18 bp, Homo sapiens
tccagtgtccttagaaca

SEQ ID NO: 2254656 - DNA, 18 bp, Homo sapiens
tccagtttgttctccggg

SEQ ID NO: 2254657 - DNA, 19 bp, Homo sapiens
tccagtttgttctccgggt

SEQ ID NO: 2254658 - DNA, 20 bp, Homo sapiens
tccatagtttggcatttgca

SEQ ID NO: 2254659 - DNA, 23 bp, Homo sapiens
tccatgaaagacctgaataccac

SEQ ID NO: 2254660 - DNA, 17 bp, Homo sapiens
tccatgagatagctatt

SEQ ID NO: 2254661 - DNA, 15 bp, Homo sapiens
tcccaaacgcctccc

SEQ ID NO: 2254662 - DNA, 23 bp, Homo sapiens
tcccaaagtgctgggattacaga

SEQ ID NO: 2254663 - DNA, 12 bp, Homo sapiens
tcccacaggagg

SEQ ID NO: 2254664 - DNA, 19 bp, Homo sapiens
tcccaccagagccgggagg

SEQ ID NO: 2254665 - DNA, 18 bp, Homo sapiens
tcccacccccacccccag

SEQ ID NO: 2254666 - DNA, 22 bp, Homo sapiens
tcccacccccacccccagctca

SEQ ID NO: 2254667 - DNA, 13 bp, Homo sapiens
tcccacccccagc

SEQ ID NO: 2254668 - DNA, 19 bp, Homo sapiens
tcccaccccctcctccccc

SEQ ID NO: 2254669 - DNA, 22 bp, Homo sapiens
tcccaccccctcctcccccagt

SEQ ID NO: 2254670 - DNA, 18 bp, Homo sapiens
tcccaccgggagcctccc

SEQ ID NO: 2254671 - DNA, 12 bp, Homo sapiens
tcccagtgacaa

SEQ ID NO: 2254672 - DNA, 13 bp, Homo sapiens
tcccatcgctgtc

SEQ ID NO: 2254673 - DNA, 15 bp, Homo sapiens
tcccatgtagccccc

SEQ ID NO: 2254674 - DNA, 10 bp, Homo sapiens
tcccatgtgg

SEQ ID NO: 2254675 - DNA, 19 bp, Homo sapiens
tccccacttgtccgctggg

SEQ ID NO: 2254676 - DNA, 24 bp, Homo sapiens
tccccagccccagccccttccatg

SEQ ID NO: 2254677 - DNA, 16 bp, Homo sapiens
tccccatggagccagc

SEQ ID NO: 2254678 - DNA, 18 bp, Homo sapiens
tccccccccaacctttcc

SEQ ID NO: 2254679 - DNA, 21 bp, Homo sapiens
tccccctgtttcagaggctca

SEQ ID NO: 2254680 - DNA, 19 bp, Homo sapiens
tccccctttcacactggat

SEQ ID NO: 2254681 - DNA, 16 bp, Homo sapiens
tccccgcctggccagg

SEQ ID NO: 2254682 - DNA, 17 bp, Homo sapiens
tccccgcctggccagga

SEQ ID NO: 2254683 - DNA, 21 bp, Homo sapiens
tccccgggaccgcgctagggc

SEQ ID NO: 2254684 - DNA, 16 bp, Homo sapiens
tcccctcactctgtca

SEQ ID NO: 2254685 - DNA, 21 bp, Homo sapiens
tcccctcactctgtcagccag

SEQ ID NO: 2254686 - DNA, 13 bp, Homo sapiens
tcccctctgctgc

SEQ ID NO: 2254687 - DNA, 14 bp, Homo sapiens
tcccctctgctgct

SEQ ID NO: 2254688 - DNA, 15 bp, Homo sapiens
tcccgtgttctcctt

SEQ ID NO: 2254689 - DNA, 14 bp, Homo sapiens
tccctccaccccag

SEQ ID NO: 2254690 - DNA, 15 bp, Homo sapiens
tccctccaccccagg

SEQ ID NO: 2254691 - DNA, 16 bp, Homo sapiens
tccctccaccccagga

SEQ ID NO: 2254692 - DNA, 17 bp, Homo sapiens
tccctccaccccaggac

SEQ ID NO: 2254693 - DNA, 18 bp, Homo sapiens
tccctccaccccaggacg

SEQ ID NO: 2254694 - DNA, 16 bp, Homo sapiens
tccctccccctccttg

SEQ ID NO: 2254695 - DNA, 12 bp, Homo sapiens
tccctccccctt

SEQ ID NO: 2254696 - DNA, 19 bp, Homo sapiens
tccctccgcggctggagcg

SEQ ID NO: 2254697 - DNA, 13 bp, Homo sapiens
tccctctatttat

SEQ ID NO: 2254698 - DNA, 11 bp, Homo sapiens
tccctctctct

SEQ ID NO: 2254699 - DNA, 17 bp, Homo sapiens
tccctgactccctgtgg

SEQ ID NO: 2254700 - DNA, 15 bp, Homo sapiens
tgcacaccaccctcc

SEQ ID NO: 2254701 - DNA, 19 bp, Homo sapiens
tgcacatgctgtctggccc

SEQ ID NO: 2254702 - DNA, 23 bp, Homo sapiens
tgcacatgctgtctggccctggg

SEQ ID NO: 2254703 - DNA, 23 bp, Homo sapiens
tgcacggtttcgaagtcattaaa

SEQ ID NO: 2254704 - DNA, 17 bp, Homo sapiens
tgcacgtggggcccact

SEQ ID NO: 2254705 - DNA, 22 bp, Homo sapiens
tgcactgcatgcaaacaagaaa

SEQ ID NO: 2254706 - DNA, 20 bp, Homo sapiens
tgcactggggagcccgtctc

SEQ ID NO: 2254707 - DNA, 23 bp, Homo sapiens
tgcacttttagccagagatgcaa

SEQ ID NO: 2254708 - DNA, 17 bp, Homo sapiens
tgcagatgttagatatt

SEQ ID NO: 2254709 - DNA, 22 bp, Homo sapiens
tgcagcaggaaggaacaaagac

SEQ ID NO: 2254710 - DNA, 14 bp, Homo sapiens
tgcaggcaggaaca

SEQ ID NO: 2254711 - DNA, 17 bp, Homo sapiens
tgcaggctcccctgagg

SEQ ID NO: 2254712 - DNA, 18 bp, Homo sapiens
tgcaggctcccctgagga

SEQ ID NO: 2254713 - DNA, 21 bp, Homo sapiens
tgcaggtcaagttgtcaggtt

SEQ ID NO: 2254714 - DNA, 18 bp, Homo sapiens
tgcagtctctctctgcca

SEQ ID NO: 2254715 - DNA, 12 bp, Homo sapiens
tgcagtttatca

SEQ ID NO: 2254716 - DNA, 16 bp, Homo sapiens
tgcagtttatcattca

SEQ ID NO: 2254717 - DNA, 18 bp, Homo sapiens
tgcagtttttcattttaa

SEQ ID NO: 2254718 - DNA, 17 bp, Homo sapiens
tgcataatgcaatcaaa

SEQ ID NO: 2254719 - DNA, 13 bp, Homo sapiens
tgcatatttattt

SEQ ID NO: 2254720 - DNA, 13 bp, Homo sapiens
tgcatcagaaagc

SEQ ID NO: 2254721 - DNA, 14 bp, Homo sapiens
tgcatgtcttttaa

SEQ ID NO: 2254722 - DNA, 23 bp, Homo sapiens
tgcattcctgtgccctagatgca

SEQ ID NO: 2254723 - DNA, 12 bp, Homo sapiens
tgcattgaagat

SEQ ID NO: 2254724 - DNA, 17 bp, Homo sapiens
tgcatttgagagaagcc

SEQ ID NO: 2254725 - DNA, 23 bp, Homo sapiens
tgcatttgagagaagccacgctg

SEQ ID NO: 2254726 - DNA, 18 bp, Homo sapiens
tgcatttgtgctagaaat

SEQ ID NO: 2254727 - DNA, 19 bp, Homo sapiens
tgccaaaattcatttctaa

SEQ ID NO: 2254728 - DNA, 17 bp, Homo sapiens
tgccaagagtgaaggga

SEQ ID NO: 2254729 - DNA, 14 bp, Homo sapiens
tgccaataaagtga

SEQ ID NO: 2254730 - DNA, 17 bp, Homo sapiens
tgccaataaagtgatct

SEQ ID NO: 2254731 - DNA, 11 bp, Homo sapiens
tgccagagagg

SEQ ID NO: 2254732 - DNA, 21 bp, Homo sapiens
tgccagcgccaaaacaagcca

SEQ ID NO: 2254733 - DNA, 17 bp, Homo sapiens
tgccatgatctgtattt

SEQ ID NO: 2254734 - DNA, 15 bp, Homo sapiens
tgccatgttggccag

SEQ ID NO: 2254735 - DNA, 22 bp, Homo sapiens
tgcccatgtgtcccctcactct

SEQ ID NO: 2254736 - DNA, 19 bp, Homo sapiens
tgccccaccccatccagcc

SEQ ID NO: 2254737 - DNA, 21 bp, Homo sapiens
tgccccaccccatccagccag

SEQ ID NO: 2254738 - DNA, 22 bp, Homo sapiens
tgccccaccccatccagccaga

SEQ ID NO: 2254739 - DNA, 15 bp, Homo sapiens
tgccccccagcctct

SEQ ID NO: 2254740 - DNA, 13 bp, Homo sapiens
tgcccccctcctc

SEQ ID NO: 2254741 - DNA, 16 bp, Homo sapiens
tgcccccctcctcccc

SEQ ID NO: 2254742 - DNA, 21 bp, Homo sapiens
tgccccctcccccatgggctg

SEQ ID NO: 2254743 - DNA, 15 bp, Homo sapiens
tgcccctctcaccaa

SEQ ID NO: 2254744 - DNA, 17 bp, Homo sapiens
tgccctagatcaacaga

SEQ ID NO: 2254745 - DNA, 17 bp, Homo sapiens
tgccctcatggcccctc

SEQ ID NO: 2254746 - DNA, 15 bp, Homo sapiens
tgccctgtgtggctg

SEQ ID NO: 2254747 - DNA, 16 bp, Homo sapiens
tgccgctgccgctgca

SEQ ID NO: 2254748 - DNA, 21 bp, Homo sapiens
tgcctgcccctaccctggact

SEQ ID NO: 2254749 - DNA, 16 bp, Homo sapiens
tgcctgtcccaccccc

SEQ ID NO: 2254750 - DNA, 19 bp, Homo sapiens
tgcctgtcccacccccacc

SEQ ID NO: 2254751 - DNA, 18 bp, Homo sapiens
tgcctgttggcaggccca

SEQ ID NO: 2254752 - DNA, 22 bp, Homo sapiens
tgcctgttggcaggcccactcc

SEQ ID NO: 2254753 - DNA, 23 bp, Homo sapiens
tgcctgttggcaggcccactccc

SEQ ID NO: 2254754 - DNA, 13 bp, Homo sapiens
tgccttggctcag

SEQ ID NO: 2254755 - DNA, 11 bp, Homo sapiens
tgcctttctct

SEQ ID NO: 2254756 - DNA, 17 bp, Homo sapiens
tgctaaataaaatttgt

SEQ ID NO: 2254757 - DNA, 14 bp, Homo sapiens
tgctagaaattttc

SEQ ID NO: 2254758 - DNA, 21 bp, Homo sapiens
tgctagcctgttcttttacca

SEQ ID NO: 2254759 - DNA, 17 bp, Homo sapiens
tgctatttgaacaagtg

SEQ ID NO: 2254760 - DNA, 13 bp, Homo sapiens
tgctccaccctcc

SEQ ID NO: 2254761 - DNA, 18 bp, Homo sapiens
tgctcgtggactgtgctg

SEQ ID NO: 2254762 - DNA, 14 bp, Homo sapiens
tgctctcactgttt

SEQ ID NO: 2254763 - DNA, 22 bp, Homo sapiens
tgctctcactgtttgtttttat

SEQ ID NO: 2254764 - DNA, 13 bp, Homo sapiens
tgctgacttttta

SEQ ID NO: 2254765 - DNA, 23 bp, Homo sapiens
tgctgagagaaatatggaactta

SEQ ID NO: 2254766 - DNA, 12 bp, Homo sapiens
tgctgagcctct

SEQ ID NO: 2254767 - DNA, 20 bp, Homo sapiens
tgctgagcctctgctcccca

SEQ ID NO: 2254768 - DNA, 20 bp, Homo sapiens
tgctgagcttgtcttttctg

SEQ ID NO: 2254769 - DNA, 23 bp, Homo sapiens
tgctgattgatttttttctcctt

SEQ ID NO: 2254770 - DNA, 21 bp, Homo sapiens
tgctgcaggacttgagaagac

SEQ ID NO: 2254771 - DNA, 15 bp, Homo sapiens
tgctgctccaccctc

SEQ ID NO: 2254772 - DNA, 13 bp, Homo sapiens
tgctggccagcac

SEQ ID NO: 2254773 - DNA, 22 bp, Homo sapiens
tgctggccagcaccctctcctg

SEQ ID NO: 2254774 - DNA, 22 bp, Homo sapiens
tgctggccccagccctgctggg

SEQ ID NO: 2254775 - DNA, 16 bp, Homo sapiens
tgctgggagcaggact

SEQ ID NO: 2254776 - DNA, 20 bp, Homo sapiens
tgctgtacacatatttgaag

SEQ ID NO: 2254777 - DNA, 13 bp, Homo sapiens
tgctgtccctccc

SEQ ID NO: 2254778 - DNA, 14 bp, Homo sapiens
tgctgtctggccct

SEQ ID NO: 2254779 - DNA, 16 bp, Homo sapiens
tgctgtctggccctgg

SEQ ID NO: 2254780 - DNA, 13 bp, Homo sapiens
tgctgtgggcagc

SEQ ID NO: 2254781 - DNA, 14 bp, Homo sapiens
tgctgtgggcagca

SEQ ID NO: 2254782 - DNA, 19 bp, Homo sapiens
tgcttagaatccaaacttg

SEQ ID NO: 2254783 - DNA, 22 bp, Homo sapiens
tgcttagaggggtgaaaattat

SEQ ID NO: 2254784 - DNA, 20 bp, Homo sapiens
tgcttgacaaatattttcat

SEQ ID NO: 2254785 - DNA, 15 bp, Homo sapiens
tgcttgtaactaaaa

SEQ ID NO: 2254786 - DNA, 15 bp, Homo sapiens
tgcttgtgtttgttt

SEQ ID NO: 2254787 - DNA, 20 bp, Homo sapiens
tgcttgttgaaaatatttct

SEQ ID NO: 2254788 - DNA, 15 bp, Homo sapiens
tgctttctccttcac

SEQ ID NO: 2254789 - DNA, 12 bp, Homo sapiens
tgctttgtattg

SEQ ID NO: 2254790 - DNA, 23 bp, Homo sapiens
tgctttttaaagagattatttgt

SEQ ID NO: 2254791 - DNA, 13 bp, Homo sapiens
tggaaccttccct

SEQ ID NO: 2254792 - DNA, 14 bp, Homo sapiens
tggaaccttccctc

SEQ ID NO: 2254793 - DNA, 16 bp, Homo sapiens
tggaacttacattgtt

SEQ ID NO: 2254794 - DNA, 20 bp, Homo sapiens
tggaagccctcaaagaagtc

SEQ ID NO: 2254795 - DNA, 18 bp, Homo sapiens
tggaagtgaaaactttgt

SEQ ID NO: 2254796 - DNA, 19 bp, Homo sapiens
tggaagtgaaaactttgta

SEQ ID NO: 2254797 - DNA, 15 bp, Homo sapiens
tggaatgtgagtgtg

SEQ ID NO: 2254798 - DNA, 18 bp, Homo sapiens
tggaattgaactctctgc

SEQ ID NO: 2254799 - DNA, 15 bp, Homo sapiens
tggaatttgggcaga

SEQ ID NO: 2254800 - DNA, 16 bp, Homo sapiens
tggaatttgggcagat

SEQ ID NO: 2254801 - DNA, 17 bp, Homo sapiens
tggaatttgggcagata

SEQ ID NO: 2254802 - DNA, 15 bp, Homo sapiens
tggacactcagacct

SEQ ID NO: 2254803 - DNA, 17 bp, Homo sapiens
tggaccttaggccttcc

SEQ ID NO: 2254804 - DNA, 16 bp, Homo sapiens
tggactgcgctggacg

SEQ ID NO: 2254805 - DNA, 20 bp, Homo sapiens
tggactgttttctctcggct

SEQ ID NO: 2254806 - DNA, 13 bp, Homo sapiens
tggagaggcggcc

SEQ ID NO: 2254807 - DNA, 14 bp, Homo sapiens
tggagaggcggcct

SEQ ID NO: 2254808 - DNA, 16 bp, Homo sapiens
ttcattcttcagatat

SEQ ID NO: 2254809 - DNA, 12 bp, Homo sapiens
ttcattgtgtat

SEQ ID NO: 2254810 - DNA, 15 bp, Homo sapiens
ttcatttctaattaa

SEQ ID NO: 2254811 - DNA, 15 bp, Homo sapiens
ttcattttaaaaagt

SEQ ID NO: 2254812 - DNA, 16 bp, Homo sapiens
ttcattttaaaaagtc

SEQ ID NO: 2254813 - DNA, 16 bp, Homo sapiens
ttccaaattatttctt

SEQ ID NO: 2254814 - DNA, 14 bp, Homo sapiens
ttccacagaggaca

SEQ ID NO: 2254815 - DNA, 15 bp, Homo sapiens
ttccacatgttactg

SEQ ID NO: 2254816 - DNA, 20 bp, Homo sapiens
ttccaccccaagagaactcg

SEQ ID NO: 2254817 - DNA, 16 bp, Homo sapiens
ttccactccattgtcg

SEQ ID NO: 2254818 - DNA, 21 bp, Homo sapiens
ttccaggctaaacatccaata

SEQ ID NO: 2254819 - DNA, 20 bp, Homo sapiens
ttccaggctatgtataaaat

SEQ ID NO: 2254820 - DNA, 17 bp, Homo sapiens
ttccagtataaccagct

SEQ ID NO: 2254821 - DNA, 20 bp, Homo sapiens
ttccattgtagtggcctgtg

SEQ ID NO: 2254822 - DNA, 17 bp, Homo sapiens
ttcccatgtagccccct

SEQ ID NO: 2254823 - DNA, 16 bp, Homo sapiens
ttccccctgcaaaaag

SEQ ID NO: 2254824 - DNA, 22 bp, Homo sapiens
ttccccctgtttcagaggctca

SEQ ID NO: 2254825 - DNA, 22 bp, Homo sapiens
ttccctccccctccttgtgcct

SEQ ID NO: 2254826 - DNA, 18 bp, Homo sapiens
ttcctcatccaccccatc

SEQ ID NO: 2254827 - DNA, 21 bp, Homo sapiens
ttcctccttcactgtttcatc

SEQ ID NO: 2254828 - DNA, 11 bp, Homo sapiens
ttcctctgccc

SEQ ID NO: 2254829 - DNA, 15 bp, Homo sapiens
ttcctggacactcag

SEQ ID NO: 2254830 - DNA, 19 bp, Homo sapiens
ttcctggacactcagacct

SEQ ID NO: 2254831 - DNA, 16 bp, Homo sapiens
ttcctgggaacatcac

SEQ ID NO: 2254832 - DNA, 16 bp, Homo sapiens
ttccttctctgaaagt

SEQ ID NO: 2254833 - DNA, 22 bp, Homo sapiens
ttccttgagacacggagcccag

SEQ ID NO: 2254834 - DNA, 13 bp, Homo sapiens
ttccttgaggaca

SEQ ID NO: 2254835 - DNA, 22 bp, Homo sapiens
ttcctttgagtgtcttctaact

SEQ ID NO: 2254836 - DNA, 12 bp, Homo sapiens
ttccttttatca

SEQ ID NO: 2254837 - DNA, 15 bp, Homo sapiens
ttccttttcttaaaa

SEQ ID NO: 2254838 - DNA, 22 bp, Homo sapiens
ttcgaaacctgggattcaggaa

SEQ ID NO: 2254839 - DNA, 13 bp, Homo sapiens
ttcgatttctacc

SEQ ID NO: 2254840 - DNA, 17 bp, Homo sapiens
ttcgatttctacctcag

SEQ ID NO: 2254841 - DNA, 15 bp, Homo sapiens
ttcgtataatcttgt

SEQ ID NO: 2254842 - DNA, 18 bp, Homo sapiens
ttctaagaaatcaagtaa

SEQ ID NO: 2254843 - DNA, 19 bp, Homo sapiens
ttctacaatgtgaacttta

SEQ ID NO: 2254844 - DNA, 17 bp, Homo sapiens
ttctacctcagcagcag

SEQ ID NO: 2254845 - DNA, 20 bp, Homo sapiens
ttctatctgcttagcaacta

SEQ ID NO: 2254846 - DNA, 22 bp, Homo sapiens
ttctatgtttttttaattaaaa

SEQ ID NO: 2254847 - DNA, 16 bp, Homo sapiens
ttctatttaattgaaa

SEQ ID NO: 2254848 - DNA, 14 bp, Homo sapiens
ttctcactcaccac

SEQ ID NO: 2254849 - DNA, 12 bp, Homo sapiens
ttctcatcagta

SEQ ID NO: 2254850 - DNA, 21 bp, Homo sapiens
ttctccacctagactgtaaac

SEQ ID NO: 2254851 - DNA, 15 bp, Homo sapiens
ttctccagctgggct

SEQ ID NO: 2254852 - DNA, 17 bp, Homo sapiens
ttctccgggtgtggcct

SEQ ID NO: 2254853 - DNA, 17 bp, Homo sapiens
ttctctcggctccccat

SEQ ID NO: 2254854 - DNA, 13 bp, Homo sapiens
ttctctgtacttt

SEQ ID NO: 2254855 - DNA, 21 bp, Homo sapiens
ttctcttaggtggctctggga

SEQ ID NO: 2254856 - DNA, 10 bp, Homo sapiens
ttctggctca

SEQ ID NO: 2254857 - DNA, 18 bp, Homo sapiens
ttctggggcaggctgggc

SEQ ID NO: 2254858 - DNA, 14 bp, Homo sapiens
ttctggttttagga

SEQ ID NO: 2254859 - DNA, 12 bp, Homo sapiens
ttctgtgtattt

SEQ ID NO: 2254860 - DNA, 23 bp, Homo sapiens
ttctgtgtctttcacagctcctc

SEQ ID NO: 2254861 - DNA, 13 bp, Homo sapiens
ttctgtttttaat

SEQ ID NO: 2254862 - DNA, 19 bp, Homo sapiens
ttcttaattattataaaaa

SEQ ID NO: 2254863 - DNA, 22 bp, Homo sapiens
ttcttaattattataaaaatat

SEQ ID NO: 2254864 - DNA, 18 bp, Homo sapiens
ttcttcagatatactgga

SEQ ID NO: 2254865 - DNA, 22 bp, Homo sapiens
ttcttctctgtgagaaggttta

SEQ ID NO: 2254866 - DNA, 16 bp, Homo sapiens
ttctttcccagtctgt

SEQ ID NO: 2254867 - DNA, 12 bp, Homo sapiens
ttctttgctgtt

SEQ ID NO: 2254868 - DNA, 12 bp, Homo sapiens
ttctttgttctt

SEQ ID NO: 2254869 - DNA, 23 bp, Homo sapiens
ttcttttggtaaagactggcttt

SEQ ID NO: 2254870 - DNA, 15 bp, Homo sapiens
ttctttttgtacact

SEQ ID NO: 2254871 - DNA, 19 bp, Homo sapiens
ttgaaaaaatttaaaagta

SEQ ID NO: 2254872 - DNA, 15 bp, Homo sapiens
ttgaaaagcagacat

SEQ ID NO: 2254873 - DNA, 16 bp, Homo sapiens
ttgaaatgaaagggaa

SEQ ID NO: 2254874 - DNA, 23 bp, Homo sapiens
ttgaacaatgaagttgaaaatca

SEQ ID NO: 2254875 - DNA, 14 bp, Homo sapiens
ttgaagctttgtag

SEQ ID NO: 2254876 - DNA, 13 bp, Homo sapiens
ttgaagggagaag

SEQ ID NO: 2254877 - DNA, 19 bp, Homo sapiens
ttgaagggagaagacactg

SEQ ID NO: 2254878 - DNA, 20 bp, Homo sapiens
ttgaagtctttaataaataa

SEQ ID NO: 2254879 - DNA, 14 bp, Homo sapiens
ttgaatcaataata

SEQ ID NO: 2254880 - DNA, 22 bp, Homo sapiens
ttgaatcaataatatattttct

SEQ ID NO: 2254881 - DNA, 23 bp, Homo sapiens
ttgaatcaataatatattttctg

SEQ ID NO: 2254882 - DNA, 20 bp, Homo sapiens
ttgaattgaggggattaata

SEQ ID NO: 2254883 - DNA, 14 bp, Homo sapiens
ttgacacaagtgga

SEQ ID NO: 2254884 - DNA, 22 bp, Homo sapiens
ttgacataagatggttgaccaa

SEQ ID NO: 2254885 - DNA, 18 bp, Homo sapiens
ttgaccaaggtgcttttc

SEQ ID NO: 2254886 - DNA, 14 bp, Homo sapiens
ttgactaattttac

SEQ ID NO: 2254887 - DNA, 15 bp, Homo sapiens
ttgactaattttaca

SEQ ID NO: 2254888 - DNA, 15 bp, Homo sapiens
ttgactcatcttata

SEQ ID NO: 2254889 - DNA, 20 bp, Homo sapiens
ttgacttgcaaagacctacc

SEQ ID NO: 2254890 - DNA, 13 bp, Homo sapiens
ttgactttataaa

SEQ ID NO: 2254891 - DNA, 13 bp, Homo sapiens
ttgagagaagcca

SEQ ID NO: 2254892 - DNA, 19 bp, Homo sapiens
ttgagctactggattctta

SEQ ID NO: 2254893 - DNA, 12 bp, Homo sapiens
ttgaggagcccc

SEQ ID NO: 2254894 - DNA, 15 bp, Homo sapiens
ttgagttgctctgtc

SEQ ID NO: 2254895 - DNA, 22 bp, Homo sapiens
ttgataagctattgtctgtaat

SEQ ID NO: 2254896 - DNA, 16 bp, Homo sapiens
ttgatatctataaaat

SEQ ID NO: 2254897 - DNA, 17 bp, Homo sapiens
ttgatatctataaaata

SEQ ID NO: 2254898 - DNA, 17 bp, Homo sapiens
ttgatcatgtacttttt

SEQ ID NO: 2254899 - DNA, 19 bp, Homo sapiens
ttgatgatttttaactttt

SEQ ID NO: 2254900 - DNA, 12 bp, Homo sapiens
ttgatggctgcg

SEQ ID NO: 2254901 - DNA, 23 bp, Homo sapiens
ttgatgtaaagatgttctggata

SEQ ID NO: 2254902 - DNA, 17 bp, Homo sapiens
ttgattcagcaaaaatc

SEQ ID NO: 2254903 - DNA, 12 bp, Homo sapiens
ttgcaccaaaga

SEQ ID NO: 2254904 - DNA, 17 bp, Homo sapiens
ttgcacttgtgattatt

SEQ ID NO: 2254905 - DNA, 19 bp, Homo sapiens
ttgcagtttatcattcaag

SEQ ID NO: 2254906 - DNA, 15 bp, Homo sapiens
ttgcataatgcaatc

SEQ ID NO: 2254907 - DNA, 18 bp, Homo sapiens
ttgcataatgcaatcaaa

SEQ ID NO: 2254908 - DNA, 15 bp, Homo sapiens
ttgccttttaatttt

SEQ ID NO: 2254909 - DNA, 19 bp, Homo sapiens
ttgccttttaatttttaat

SEQ ID NO: 2254910 - DNA, 14 bp, Homo sapiens
ttgctcagcccgct

SEQ ID NO: 2254911 - DNA, 13 bp, Homo sapiens
ttgctggccccag

SEQ ID NO: 2254912 - DNA, 11 bp, Homo sapiens
ttgctgggagg

SEQ ID NO: 2254913 - DNA, 15 bp, Homo sapiens
ttggaaaaaatttgt

SEQ ID NO: 2254914 - DNA, 17 bp, Homo sapiens
ttggaattcgctttcta

SEQ ID NO: 2254915 - DNA, 18 bp, Homo sapiens
ttggagaatttaggtttt

SEQ ID NO: 2254916 - DNA, 12 bp, Homo sapiens
ttggagggatgg

SEQ ID NO: 2254917 - DNA, 14 bp, Homo sapiens
atcttcccacagga

SEQ ID NO: 2254918 - DNA, 21 bp, Homo sapiens
atcttctgccttagtctcagt

SEQ ID NO: 2254919 - DNA, 15 bp, Homo sapiens
atcttgtagacactt

SEQ ID NO: 2254920 - DNA, 14 bp, Homo sapiens
atctttgtgacagg

SEQ ID NO: 2254921 - DNA, 18 bp, Homo sapiens
atgaaaacagtgtgtaaa

SEQ ID NO: 2254922 - DNA, 13 bp, Homo sapiens
atgaaagggaaac

SEQ ID NO: 2254923 - DNA, 23 bp, Homo sapiens
atgaaatgtgaatttttattgtt

SEQ ID NO: 2254924 - DNA, 14 bp, Homo sapiens
atgaacaaaattat

SEQ ID NO: 2254925 - DNA, 17 bp, Homo sapiens
atgaacaaaattatttg

SEQ ID NO: 2254926 - DNA, 14 bp, Homo sapiens
atgaagctgtataa

SEQ ID NO: 2254927 - DNA, 20 bp, Homo sapiens
atgaaggtaatattgataag

SEQ ID NO: 2254928 - DNA, 18 bp, Homo sapiens
atgaaggttttcatttgc

SEQ ID NO: 2254929 - DNA, 14 bp, Homo sapiens
atgaagttgaaaat

SEQ ID NO: 2254930 - DNA, 16 bp, Homo sapiens
atgaagttgaaaatca

SEQ ID NO: 2254931 - DNA, 18 bp, Homo sapiens
atgaatgcagattacact

SEQ ID NO: 2254932 - DNA, 14 bp, Homo sapiens
atgaatttgtccaa

SEQ ID NO: 2254933 - DNA, 14 bp, Homo sapiens
atgacaaaaaatgt

SEQ ID NO: 2254934 - DNA, 22 bp, Homo sapiens
atgacaccatcttttattcttt

SEQ ID NO: 2254935 - DNA, 18 bp, Homo sapiens
atgacctcttcctttagg

SEQ ID NO: 2254936 - DNA, 19 bp, Homo sapiens
atgactatgtatttttcta

SEQ ID NO: 2254937 - DNA, 23 bp, Homo sapiens
atgactgtgtctgcctgtcccca

SEQ ID NO: 2254938 - DNA, 15 bp, Homo sapiens
atgaggcaaaaatgt

SEQ ID NO: 2254939 - DNA, 19 bp, Homo sapiens
atgaggggacattttggtg

SEQ ID NO: 2254940 - DNA, 22 bp, Homo sapiens
atgatctgtatttaatggtttt

SEQ ID NO: 2254941 - DNA, 15 bp, Homo sapiens
atgcaaacaagaaac

SEQ ID NO: 2254942 - DNA, 18 bp, Homo sapiens
atgcaatatatccccact

SEQ ID NO: 2254943 - DNA, 21 bp, Homo sapiens
atgcacatgctgtctggccct

SEQ ID NO: 2254944 - DNA, 17 bp, Homo sapiens
atgcacgtggggcccac

SEQ ID NO: 2254945 - DNA, 22 bp, Homo sapiens
atgcagcaggaaggaacaaaga

SEQ ID NO: 2254946 - DNA, 17 bp, Homo sapiens
atgcaggctcccctgag

SEQ ID NO: 2254947 - DNA, 18 bp, Homo sapiens
atgcatgtcttttaaaat

SEQ ID NO: 2254948 - DNA, 19 bp, Homo sapiens
atgccacttctcactcacc

SEQ ID NO: 2254949 - DNA, 16 bp, Homo sapiens
atgccagctacttcct

SEQ ID NO: 2254950 - DNA, 19 bp, Homo sapiens
atgcctgtcttaattttct

SEQ ID NO: 2254951 - DNA, 18 bp, Homo sapiens
atgcctttctctcctagt

SEQ ID NO: 2254952 - DNA, 16 bp, Homo sapiens
atgcgcaatgtggcat

SEQ ID NO: 2254953 - DNA, 22 bp, Homo sapiens
atgctaatagtgatcaagaaga

SEQ ID NO: 2254954 - DNA, 19 bp, Homo sapiens
atgctaccccactatgaca

SEQ ID NO: 2254955 - DNA, 22 bp, Homo sapiens
atgctctcactgtttgttttta

SEQ ID NO: 2254956 - DNA, 16 bp, Homo sapiens
atgctgctccaccctc

SEQ ID NO: 2254957 - DNA, 15 bp, Homo sapiens
atgctggccagcacc

SEQ ID NO: 2254958 - DNA, 21 bp, Homo sapiens
atgctggccagcaccctctcc

SEQ ID NO: 2254959 - DNA, 16 bp, Homo sapiens
atgctgtctggccctg

SEQ ID NO: 2254960 - DNA, 23 bp, Homo sapiens
atgcttacgtgatcctctcacct

SEQ ID NO: 2254961 - DNA, 21 bp, Homo sapiens
atgcttgacaaatattttcat

SEQ ID NO: 2254962 - DNA, 18 bp, Homo sapiens
atgcttgcataagagctt

SEQ ID NO: 2254963 - DNA, 17 bp, Homo sapiens
atggaaaaataaaactg

SEQ ID NO: 2254964 - DNA, 18 bp, Homo sapiens
atggacagggcatgccac

SEQ ID NO: 2254965 - DNA, 16 bp, Homo sapiens
atggagaggcggcctc

SEQ ID NO: 2254966 - DNA, 11 bp, Homo sapiens
atggagccagc

SEQ ID NO: 2254967 - DNA, 11 bp, Homo sapiens
atggcccctct

SEQ ID NO: 2254968 - DNA, 20 bp, Homo sapiens
atggcttcggacaaaatatc

SEQ ID NO: 2254969 - DNA, 13 bp, Homo sapiens
atgggaccaggga

SEQ ID NO: 2254970 - DNA, 11 bp, Homo sapiens
atgggccaggg

SEQ ID NO: 2254971 - DNA, 13 bp, Homo sapiens
atggggaggacaa

SEQ ID NO: 2254972 - DNA, 17 bp, Homo sapiens
atggggaggacaaaatg

SEQ ID NO: 2254973 - DNA, 18 bp, Homo sapiens
atgggggatgggccaggg

SEQ ID NO: 2254974 - DNA, 18 bp, Homo sapiens
atggtatcaaaattacat

SEQ ID NO: 2254975 - DNA, 22 bp, Homo sapiens
atggtatgctggccagcaccct

SEQ ID NO: 2254976 - DNA, 21 bp, Homo sapiens
atggtcacgtttggtgcttct

SEQ ID NO: 2254977 - DNA, 14 bp, Homo sapiens
atggtttaaaagaa

SEQ ID NO: 2254978 - DNA, 15 bp, Homo sapiens
atgtaagcatacttt

SEQ ID NO: 2254979 - DNA, 19 bp, Homo sapiens
caaattagaaaatgttatt

SEQ ID NO: 2254980 - DNA, 22 bp, Homo sapiens
caaattagaaaatgttatttaa

SEQ ID NO: 2254981 - DNA, 18 bp, Homo sapiens
caacaagccctgcttttg

SEQ ID NO: 2254982 - DNA, 13 bp, Homo sapiens
caacacaaagatt

SEQ ID NO: 2254983 - DNA, 15 bp, Homo sapiens
caacacttcattttc

SEQ ID NO: 2254984 - DNA, 16 bp, Homo sapiens
caacagaataatgcat

SEQ ID NO: 2254985 - DNA, 14 bp, Homo sapiens
caacagatcagtaa

SEQ ID NO: 2254986 - DNA, 13 bp, Homo sapiens
caacatgtttctg

SEQ ID NO: 2254987 - DNA, 16 bp, Homo sapiens
caacattgtagcctca

SEQ ID NO: 2254988 - DNA, 18 bp, Homo sapiens
caaccagatttattttaa

SEQ ID NO: 2254989 - DNA, 15 bp, Homo sapiens
caaccagctaagaaa

SEQ ID NO: 2254990 - DNA, 22 bp, Homo sapiens
caaccagctaagaaaagatttt

SEQ ID NO: 2254991 - DNA, 14 bp, Homo sapiens
caacccaatgggct

SEQ ID NO: 2254992 - DNA, 18 bp, Homo sapiens
caacctcttctggctcaa

SEQ ID NO: 2254993 - DNA, 14 bp, Homo sapiens
caacctggtggcac

SEQ ID NO: 2254994 - DNA, 17 bp, Homo sapiens
caaccttgtcccaagga

SEQ ID NO: 2254995 - DNA, 21 bp, Homo sapiens
caaccttgtttattaaattgc

SEQ ID NO: 2254996 - DNA, 15 bp, Homo sapiens
caacctttccctcac

SEQ ID NO: 2254997 - DNA, 18 bp, Homo sapiens
caacctttccctcacccc

SEQ ID NO: 2254998 - DNA, 19 bp, Homo sapiens
caacctttccctcaccccc

SEQ ID NO: 2254999 - DNA, 15 bp, Homo sapiens
caacgtagcctgggc

SEQ ID NO: 2255000 - DNA, 17 bp, Homo sapiens
caacgttcgatttctac

SEQ ID NO: 2255001 - DNA, 23 bp, Homo sapiens
caacgttcgatttctacctcagc

SEQ ID NO: 2255002 - DNA, 11 bp, Homo sapiens
caactacctga

SEQ ID NO: 2255003 - DNA, 15 bp, Homo sapiens
caactacctgagcta

SEQ ID NO: 2255004 - DNA, 21 bp, Homo sapiens
caactacctgagctaaataaa

SEQ ID NO: 2255005 - DNA, 17 bp, Homo sapiens
caactgggccaggaggt

SEQ ID NO: 2255006 - DNA, 19 bp, Homo sapiens
caagaatagcattgtaaaa

SEQ ID NO: 2255007 - DNA, 21 bp, Homo sapiens
caagagatctttctttccaaa

SEQ ID NO: 2255008 - DNA, 12 bp, Homo sapiens
caagatagaaag

SEQ ID NO: 2255009 - DNA, 16 bp, Homo sapiens
caagcaatgcaagaaa

SEQ ID NO: 2255010 - DNA, 20 bp, Homo sapiens
caagccaaagagcctcccac

SEQ ID NO: 2255011 - DNA, 21 bp, Homo sapiens
caagccaaagagcctcccacc

SEQ ID NO: 2255012 - DNA, 23 bp, Homo sapiens
caagctgcgggctccctggcagg

SEQ ID NO: 2255013 - DNA, 16 bp, Homo sapiens
caaggctgcttagaat

SEQ ID NO: 2255014 - DNA, 12 bp, Homo sapiens
caagggcagagg

SEQ ID NO: 2255015 - DNA, 21 bp, Homo sapiens
caaggggatttttatgtctgg

SEQ ID NO: 2255016 - DNA, 20 bp, Homo sapiens
caagtaatacgttttgacat

SEQ ID NO: 2255017 - DNA, 21 bp, Homo sapiens
caagtactggctctttattca

SEQ ID NO: 2255018 - DNA, 16 bp, Homo sapiens
caagtcaaattaataa

SEQ ID NO: 2255019 - DNA, 20 bp, Homo sapiens
caagtcaccaaaagacactg

SEQ ID NO: 2255020 - DNA, 20 bp, Homo sapiens
caagtcagattgctgggagg

SEQ ID NO: 2255021 - DNA, 21 bp, Homo sapiens
caagtggaccttaggccttcc

SEQ ID NO: 2255022 - DNA, 23 bp, Homo sapiens
caagtggaccttaggccttcctc

SEQ ID NO: 2255023 - DNA, 14 bp, Homo sapiens
caataaacagctcc

SEQ ID NO: 2255024 - DNA, 20 bp, Homo sapiens
caataaaccctcagagcctc

SEQ ID NO: 2255025 - DNA, 19 bp, Homo sapiens
caataaagcatttataaat

SEQ ID NO: 2255026 - DNA, 16 bp, Homo sapiens
caataaagtgatctgt

SEQ ID NO: 2255027 - DNA, 22 bp, Homo sapiens
caataaagtgatctgtgttcaa

SEQ ID NO: 2255028 - DNA, 15 bp, Homo sapiens
caataaataacactt

SEQ ID NO: 2255029 - DNA, 21 bp, Homo sapiens
caataataagtgatgtgctga

SEQ ID NO: 2255030 - DNA, 18 bp, Homo sapiens
caataatatattttctgt

SEQ ID NO: 2255031 - DNA, 20 bp, Homo sapiens
caataatatattttctgttt

SEQ ID NO: 2255032 - DNA, 17 bp, Homo sapiens
caataatatcaaaacaa

SEQ ID NO: 2255033 - DNA, 16 bp, Homo sapiens
caatagacacatacat

SEQ ID NO: 2255034 - DNA, 22 bp, Homo sapiens
caatatagaaaaataaaaatct

SEQ ID NO: 2255035 - DNA, 12 bp, Homo sapiens
caatattgtata

SEQ ID NO: 2255036 - DNA, 14 bp, Homo sapiens
caatattgtatatt

SEQ ID NO: 2255037 - DNA, 19 bp, Homo sapiens
caatattttctttaatgct

SEQ ID NO: 2255038 - DNA, 17 bp, Homo sapiens
caatcacactacacatc

SEQ ID NO: 2255039 - DNA, 11 bp, Homo sapiens
caatctctctc

SEQ ID NO: 2255040 - DNA, 15 bp, Homo sapiens
caatctctctctgtg

SEQ ID NO: 2255041 - DNA, 15 bp, Homo sapiens
caatgcaacttttaa

SEQ ID NO: 2255042 - DNA, 14 bp, Homo sapiens
caatgctgatttgg

SEQ ID NO: 2255043 - DNA, 20 bp, Homo sapiens
caatgctgctccaccctccc

SEQ ID NO: 2255044 - DNA, 17 bp, Homo sapiens
caatgtaagcatacttt

SEQ ID NO: 2255045 - DNA, 20 bp, Homo sapiens
caatgtctgagtgaacctgt

SEQ ID NO: 2255046 - DNA, 14 bp, Homo sapiens
caatgtgaaaaatc

SEQ ID NO: 2255047 - DNA, 21 bp, Homo sapiens
caatgtgaactttattaaata

SEQ ID NO: 2255048 - DNA, 18 bp, Homo sapiens
caatgtggtgacacctcc

SEQ ID NO: 2255049 - DNA, 12 bp, Homo sapiens
caattcccctct

SEQ ID NO: 2255050 - DNA, 14 bp, Homo sapiens
caattctgttttta

SEQ ID NO: 2255051 - DNA, 20 bp, Homo sapiens
caattgctcatgttggccaa

SEQ ID NO: 2255052 - DNA, 14 bp, Homo sapiens
caatttattctgat

SEQ ID NO: 2255053 - DNA, 15 bp, Homo sapiens
cacaaaatatacaaa

SEQ ID NO: 2255054 - DNA, 11 bp, Homo sapiens
cacaataaaca

SEQ ID NO: 2255055 - DNA, 21 bp, Homo sapiens
cacacacttagccattgaaat

SEQ ID NO: 2255056 - DNA, 12 bp, Homo sapiens
cacacagcagcc

SEQ ID NO: 2255057 - DNA, 23 bp, Homo sapiens
cacacagcagccccccagcacta

SEQ ID NO: 2255058 - DNA, 12 bp, Homo sapiens
cacaccaccctc

SEQ ID NO: 2255059 - DNA, 14 bp, Homo sapiens
cacaccaccctccc

SEQ ID NO: 2255060 - DNA, 10 bp, Homo sapiens
caccatctct

SEQ ID NO: 2255061 - DNA, 19 bp, Homo sapiens
caccatctcttcattcaaa

SEQ ID NO: 2255062 - DNA, 14 bp, Homo sapiens
cacccccaccccca

SEQ ID NO: 2255063 - DNA, 17 bp, Homo sapiens
cacccccacccccagct

SEQ ID NO: 2255064 - DNA, 12 bp, Homo sapiens
cacccccagctc

SEQ ID NO: 2255065 - DNA, 13 bp, Homo sapiens
cacccccagctca

SEQ ID NO: 2255066 - DNA, 12 bp, Homo sapiens
caccccccaggc

SEQ ID NO: 2255067 - DNA, 14 bp, Homo sapiens
caccccctcccacc

SEQ ID NO: 2255068 - DNA, 19 bp, Homo sapiens
caccccctcccacccccag

SEQ ID NO: 2255069 - DNA, 12 bp, Homo sapiens
caccccctttcc

SEQ ID NO: 2255070 - DNA, 16 bp, Homo sapiens
cacccgcccctggact

SEQ ID NO: 2255071 - DNA, 18 bp, Homo sapiens
cacccgcccctggacttc

SEQ ID NO: 2255072 - DNA, 16 bp, Homo sapiens
caccctgtactgttct

SEQ ID NO: 2255073 - DNA, 23 bp, Homo sapiens
caccctgtactgttctgtgtctt

SEQ ID NO: 2255074 - DNA, 19 bp, Homo sapiens
caccgggagcctccccctc

SEQ ID NO: 2255075 - DNA, 12 bp, Homo sapiens
cacctccccctt

SEQ ID NO: 2255076 - DNA, 15 bp, Homo sapiens
cacctccccctttca

SEQ ID NO: 2255077 - DNA, 21 bp, Homo sapiens
cacctccccctttcacactgg

SEQ ID NO: 2255078 - DNA, 20 bp, Homo sapiens
cacctcgtcaagagcatgca

SEQ ID NO: 2255079 - DNA, 15 bp, Homo sapiens
caccttccagctcct

SEQ ID NO: 2255080 - DNA, 16 bp, Homo sapiens
caccttccagctcctg

SEQ ID NO: 2255081 - DNA, 20 bp, Homo sapiens
caccttttgggaatgtttta

SEQ ID NO: 2255082 - DNA, 12 bp, Homo sapiens
cacgaagcaatt

SEQ ID NO: 2255083 - DNA, 13 bp, Homo sapiens
cacgcctcctggc

SEQ ID NO: 2255084 - DNA, 14 bp, Homo sapiens
cacgcctcctggcc

SEQ ID NO: 2255085 - DNA, 16 bp, Homo sapiens
cacgcctcctggccag

SEQ ID NO: 2255086 - DNA, 16 bp, Homo sapiens
cacggagggagcgaca

SEQ ID NO: 2255087 - DNA, 23 bp, Homo sapiens
cacggcgggatcctccacagaga

SEQ ID NO: 2255088 - DNA, 13 bp, Homo sapiens
cacgggtggtccc

SEQ ID NO: 2255089 - DNA, 21 bp, Homo sapiens
cacggtttcgaagtcattaaa

SEQ ID NO: 2255090 - DNA, 16 bp, Homo sapiens
cactaaagcatgaaat

SEQ ID NO: 2255091 - DNA, 21 bp, Homo sapiens
cactaaagcatgaaatgtgaa

SEQ ID NO: 2255092 - DNA, 17 bp, Homo sapiens
cactaattggtactttt

SEQ ID NO: 2255093 - DNA, 18 bp, Homo sapiens
cactaatttttgtattat

SEQ ID NO: 2255094 - DNA, 20 bp, Homo sapiens
cactaatttttgtattattt

SEQ ID NO: 2255095 - DNA, 23 bp, Homo sapiens
cactaatttttgtattatttttg

SEQ ID NO: 2255096 - DNA, 18 bp, Homo sapiens
cactacagtattactctt

SEQ ID NO: 2255097 - DNA, 14 bp, Homo sapiens
cactaccagccagc

SEQ ID NO: 2255098 - DNA, 17 bp, Homo sapiens
cactaccagccagcctc

SEQ ID NO: 2255099 - DNA, 18 bp, Homo sapiens
cactaccagccagcctca

SEQ ID NO: 2255100 - DNA, 16 bp, Homo sapiens
cactcattgctgagcc

SEQ ID NO: 2255101 - DNA, 21 bp, Homo sapiens
cactcattgctgagcctctgc

SEQ ID NO: 2255102 - DNA, 18 bp, Homo sapiens
cactcatttcatctcatt

SEQ ID NO: 2255103 - DNA, 22 bp, Homo sapiens
cactcatttcatctcatttaag

SEQ ID NO: 2255104 - DNA, 18 bp, Homo sapiens
cactccacgcagctggca

SEQ ID NO: 2255105 - DNA, 22 bp, Homo sapiens
cactccacgcagctggcagaga

SEQ ID NO: 2255106 - DNA, 18 bp, Homo sapiens
cactccccagccccagcc

SEQ ID NO: 2255107 - DNA, 14 bp, Homo sapiens
cactcccttgctgg

SEQ ID NO: 2255108 - DNA, 19 bp, Homo sapiens
cactcccttgctggcccca

SEQ ID NO: 2255109 - DNA, 22 bp, Homo sapiens
cactcccttgctggccccagcc

SEQ ID NO: 2255110 - DNA, 21 bp, Homo sapiens
cactctgtcagccagccgccc

SEQ ID NO: 2255111 - DNA, 12 bp, Homo sapiens
cactgagcaggg

SEQ ID NO: 2255112 - DNA, 17 bp, Homo sapiens
cactgcagaaaccctga

SEQ ID NO: 2255113 - DNA, 22 bp, Homo sapiens
cactgcctctcggtgacctccg

SEQ ID NO: 2255114 - DNA, 21 bp, Homo sapiens
cactggggagcccgtctcagt

SEQ ID NO: 2255115 - DNA, 21 bp, Homo sapiens
cactgtacaaatgacactgca

SEQ ID NO: 2255116 - DNA, 14 bp, Homo sapiens
cactgtctgttctg

SEQ ID NO: 2255117 - DNA, 18 bp, Homo sapiens
cactgtctgttctgcaca

SEQ ID NO: 2255118 - DNA, 15 bp, Homo sapiens
cactgtgctggggca

SEQ ID NO: 2255119 - DNA, 15 bp, Homo sapiens
cactgtttgttttta

SEQ ID NO: 2255120 - DNA, 20 bp, Homo sapiens
cacttaagttagttccactg

SEQ ID NO: 2255121 - DNA, 23 bp, Homo sapiens
cacttaattacagttaaagaagc

SEQ ID NO: 2255122 - DNA, 19 bp, Homo sapiens
cacttacttgatgattttt

SEQ ID NO: 2255123 - DNA, 17 bp, Homo sapiens
cacttagccattgaaat

SEQ ID NO: 2255124 - DNA, 17 bp, Homo sapiens
cacttagcgaacccttt

SEQ ID NO: 2255125 - DNA, 18 bp, Homo sapiens
cacttcaaattcaaataa

SEQ ID NO: 2255126 - DNA, 19 bp, Homo sapiens
cacttcatgtaaagtgtca

SEQ ID NO: 2255127 - DNA, 19 bp, Homo sapiens
cacttgatgtgatgtggca

SEQ ID NO: 2255128 - DNA, 21 bp, Homo sapiens
cacttgatgtgatgtggcagg

SEQ ID NO: 2255129 - DNA, 15 bp, Homo sapiens
cactttagggctgta

SEQ ID NO: 2255130 - DNA, 14 bp, Homo sapiens
cacttttatttcct

SEQ ID NO: 2255131 - DNA, 17 bp, Homo sapiens
cacttttttctgccttg

SEQ ID NO: 2255132 - DNA, 21 bp, Homo sapiens
cagaaaacctctcctgacccc

SEQ ID NO: 2255133 - DNA, 16 bp, Homo sapiens
cagaaaccctgagcag

SEQ ID NO: 2255134 - DNA, 18 bp, Homo sapiens
cagaactcactggggcct

SEQ ID NO: 2255135 - DNA, 17 bp, Homo sapiens
cagaaggccccagagag

SEQ ID NO: 2255136 - DNA, 20 bp, Homo sapiens
cagaaggccccagagagacc

SEQ ID NO: 2255137 - DNA, 20 bp, Homo sapiens
cagaataagttattgcagtt

SEQ ID NO: 2255138 - DNA, 14 bp, Homo sapiens
cagacaccctcaac

SEQ ID NO: 2255139 - DNA, 18 bp, Homo sapiens
cagacatgttttccgtga

SEQ ID NO: 2255140 - DNA, 22 bp, Homo sapiens
cagacatgttttccgtgaaaac

SEQ ID NO: 2255141 - DNA, 15 bp, Homo sapiens
cagaccagattaaac

SEQ ID NO: 2255142 - DNA, 19 bp, Homo sapiens
cagactgaactcgcaggga

SEQ ID NO: 2255143 - DNA, 21 bp, Homo sapiens
cagacttcaaaaggaatgaac

SEQ ID NO: 2255144 - DNA, 14 bp, Homo sapiens
cagagacaacaggt

SEQ ID NO: 2255145 - DNA, 22 bp, Homo sapiens
cagagacaacaggtaaaacagg

SEQ ID NO: 2255146 - DNA, 15 bp, Homo sapiens
ccctcccacccccag

SEQ ID NO: 2255147 - DNA, 17 bp, Homo sapiens
ccctcccacccccagcc

SEQ ID NO: 2255148 - DNA, 14 bp, Homo sapiens
ccctccccatggag

SEQ ID NO: 2255149 - DNA, 13 bp, Homo sapiens
ccctccccctcct

SEQ ID NO: 2255150 - DNA, 15 bp, Homo sapiens
ccctcccccttcccc

SEQ ID NO: 2255151 - DNA, 12 bp, Homo sapiens
ccctcccccttg

SEQ ID NO: 2255152 - DNA, 16 bp, Homo sapiens
ccctcctcccccagtg

SEQ ID NO: 2255153 - DNA, 21 bp, Homo sapiens
ccctcctccccgcgccccagt

SEQ ID NO: 2255154 - DNA, 19 bp, Homo sapiens
ccctcctctagctgtgggg

SEQ ID NO: 2255155 - DNA, 18 bp, Homo sapiens
ccctccttgtgccttctt

SEQ ID NO: 2255156 - DNA, 14 bp, Homo sapiens
ccctctcagctcca

SEQ ID NO: 2255157 - DNA, 12 bp, Homo sapiens
ccctctcctggg

SEQ ID NO: 2255158 - DNA, 15 bp, Homo sapiens
ccctctgacctgcac

SEQ ID NO: 2255159 - DNA, 12 bp, Homo sapiens
ccctctggaggg

SEQ ID NO: 2255160 - DNA, 21 bp, Homo sapiens
ccctctggaggggtgtggctc

SEQ ID NO: 2255161 - DNA, 20 bp, Homo sapiens
ccctgatcccaccccctcct

SEQ ID NO: 2255162 - DNA, 9 bp, Homo sapiens
ccctgcaat

SEQ ID NO: 2255163 - DNA, 17 bp, Homo sapiens
ccctgccccaccccatc

SEQ ID NO: 2255164 - DNA, 19 bp, Homo sapiens
ccctgccccccagcctctg

SEQ ID NO: 2255165 - DNA, 13 bp, Homo sapiens
ccctgcggagacc

SEQ ID NO: 2255166 - DNA, 17 bp, Homo sapiens
ccctggacttgcctctg

SEQ ID NO: 2255167 - DNA, 19 bp, Homo sapiens
ccctggcaggatgctgagc

SEQ ID NO: 2255168 - DNA, 15 bp, Homo sapiens
ccctggcctctgtgc

SEQ ID NO: 2255169 - DNA, 18 bp, Homo sapiens
ccctggcctctgtgcctt

SEQ ID NO: 2255170 - DNA, 21 bp, Homo sapiens
ccctggcctctgtgccttctt

SEQ ID NO: 2255171 - DNA, 20 bp, Homo sapiens
ccctgggatgggaccaggga

SEQ ID NO: 2255172 - DNA, 14 bp, Homo sapiens
ccctgggcccctcc

SEQ ID NO: 2255173 - DNA, 16 bp, Homo sapiens
ccctgggctgtctgtc

SEQ ID NO: 2255174 - DNA, 19 bp, Homo sapiens
ccctgggctgtctgtcacc

SEQ ID NO: 2255175 - DNA, 20 bp, Homo sapiens
ccctgggctgtctgtcacca

SEQ ID NO: 2255176 - DNA, 21 bp, Homo sapiens
ccctggggatcttcccacagg

SEQ ID NO: 2255177 - DNA, 19 bp, Homo sapiens
cccttattgctgtcctgga

SEQ ID NO: 2255178 - DNA, 17 bp, Homo sapiens
cccttcagtaccctctc

SEQ ID NO: 2255179 - DNA, 20 bp, Homo sapiens
cccttcagtaccctctcagc

SEQ ID NO: 2255180 - DNA, 15 bp, Homo sapiens
cccttgctgtgaatt

SEQ ID NO: 2255181 - DNA, 18 bp, Homo sapiens
ccctttttttacatttca

SEQ ID NO: 2255182 - DNA, 12 bp, Homo sapiens
ccgactccagcc

SEQ ID NO: 2255183 - DNA, 20 bp, Homo sapiens
ccgactgaaaatattgtttt

SEQ ID NO: 2255184 - DNA, 13 bp, Homo sapiens
ccgaggagctggg

SEQ ID NO: 2255185 - DNA, 14 bp, Homo sapiens
ccgagtgatttcca

SEQ ID NO: 2255186 - DNA, 23 bp, Homo sapiens
ccgcccacaggaagcctgcagtc

SEQ ID NO: 2255187 - DNA, 14 bp, Homo sapiens
ccgcctgccctcat

SEQ ID NO: 2255188 - DNA, 16 bp, Homo sapiens
ccgcctgccctcatgg

SEQ ID NO: 2255189 - DNA, 21 bp, Homo sapiens
ccgcctggccaggagcaggca

SEQ ID NO: 2255190 - DNA, 21 bp, Homo sapiens
ccgcggaaaactgctcctgtg

SEQ ID NO: 2255191 - DNA, 13 bp, Homo sapiens
ccgcggctggagc

SEQ ID NO: 2255192 - DNA, 23 bp, Homo sapiens
ccgctaaatatttaccttgaaaa

SEQ ID NO: 2255193 - DNA, 13 bp, Homo sapiens
ccgctgcaccacg

SEQ ID NO: 2255194 - DNA, 17 bp, Homo sapiens
ccgctgccgctgcacca

SEQ ID NO: 2255195 - DNA, 18 bp, Homo sapiens
ccgctggctggtgggccc

SEQ ID NO: 2255196 - DNA, 15 bp, Homo sapiens
ccgctgtcgccccag

SEQ ID NO: 2255197 - DNA, 16 bp, Homo sapiens
ccgctgtcgccccagg

SEQ ID NO: 2255198 - DNA, 18 bp, Homo sapiens
ccgctgtcgccccaggcc

SEQ ID NO: 2255199 - DNA, 18 bp, Homo sapiens
ccgctgtgcccccctcct

SEQ ID NO: 2255200 - DNA, 13 bp, Homo sapiens
ccgcttggccacc

SEQ ID NO: 2255201 - DNA, 19 bp, Homo sapiens
ccggagcaggggtctgagc

SEQ ID NO: 2255202 - DNA, 20 bp, Homo sapiens
ccgggaccgcgctagggctc

SEQ ID NO: 2255203 - DNA, 22 bp, Homo sapiens
ccgggaccgcgctagggctccg

SEQ ID NO: 2255204 - DNA, 19 bp, Homo sapiens
ccgggagcctccccctcag

SEQ ID NO: 2255205 - DNA, 20 bp, Homo sapiens
ccgggagcctccccctcaga

SEQ ID NO: 2255206 - DNA, 22 bp, Homo sapiens
ccgggagcctccccctcagatg

SEQ ID NO: 2255207 - DNA, 22 bp, Homo sapiens
ccgggaggaaaaggcccctgca

SEQ ID NO: 2255208 - DNA, 21 bp, Homo sapiens
ccgggcaggtcctgcccatgt

SEQ ID NO: 2255209 - DNA, 12 bp, Homo sapiens
ccgggctctgac

SEQ ID NO: 2255210 - DNA, 13 bp, Homo sapiens
ccgggtgtggcct

SEQ ID NO: 2255211 - DNA, 15 bp, Homo sapiens
ccgggtgtggcctca

SEQ ID NO: 2255212 - DNA, 18 bp, Homo sapiens
ccgggtgtggcctcagcc

SEQ ID NO: 2255213 - DNA, 21 bp, Homo sapiens
ccgggtgtggcctcagccctc

SEQ ID NO: 2255214 - DNA, 22 bp, Homo sapiens
ccgtcctctccccagcctggca

SEQ ID NO: 2255215 - DNA, 11 bp, Homo sapiens
ccgtctacatt

SEQ ID NO: 2255216 - DNA, 14 bp, Homo sapiens
ccgtctacatttca

SEQ ID NO: 2255217 - DNA, 19 bp, Homo sapiens
ccgtgtctcagcctctgcc

SEQ ID NO: 2255218 - DNA, 18 bp, Homo sapiens
ccgttccaccccaagaga

SEQ ID NO: 2255219 - DNA, 22 bp, Homo sapiens
ccgttccaccccaagagaactc

SEQ ID NO: 2255220 - DNA, 15 bp, Homo sapiens
ccgttttccccatga

SEQ ID NO: 2255221 - DNA, 20 bp, Homo sapiens
cctaaagaaaaatatcttgg

SEQ ID NO: 2255222 - DNA, 22 bp, Homo sapiens
cctaaagaaaaatatcttggcc

SEQ ID NO: 2255223 - DNA, 22 bp, Homo sapiens
cctaacaacattgtagcctcaa

SEQ ID NO: 2255224 - DNA, 18 bp, Homo sapiens
cctaagggatcctgcctg

SEQ ID NO: 2255225 - DNA, 21 bp, Homo sapiens
cctacagctttgatccctgac

SEQ ID NO: 2255226 - DNA, 19 bp, Homo sapiens
cctaccacttttctgctgt

SEQ ID NO: 2255227 - DNA, 20 bp, Homo sapiens
cctagactctgtctacctgg

SEQ ID NO: 2255228 - DNA, 18 bp, Homo sapiens
cctagctacactgagcag

SEQ ID NO: 2255229 - DNA, 13 bp, Homo sapiens
cctagctggctct

SEQ ID NO: 2255230 - DNA, 17 bp, Homo sapiens
cctagctggctctgtga

SEQ ID NO: 2255231 - DNA, 23 bp, Homo sapiens
cctcaaaatttaacagttacctg

SEQ ID NO: 2255232 - DNA, 16 bp, Homo sapiens
cctcaaatgaattctt

SEQ ID NO: 2255233 - DNA, 12 bp, Homo sapiens
cctcaacctctt

SEQ ID NO: 2255234 - DNA, 15 bp, Homo sapiens
cctcaactattctgt

SEQ ID NO: 2255235 - DNA, 16 bp, Homo sapiens
cctcaccccctcccac

SEQ ID NO: 2255236 - DNA, 18 bp, Homo sapiens
cctcaccgagtgggggca

SEQ ID NO: 2255237 - DNA, 14 bp, Homo sapiens
cctcacctcctcta

SEQ ID NO: 2255238 - DNA, 21 bp, Homo sapiens
cctcactatggtatgctggcc

SEQ ID NO: 2255239 - DNA, 18 bp, Homo sapiens
cctcactctgtcagccag

SEQ ID NO: 2255240 - DNA, 19 bp, Homo sapiens
cctcactctgtcagccagc

SEQ ID NO: 2255241 - DNA, 14 bp, Homo sapiens
cctcagaaggcccc

SEQ ID NO: 2255242 - DNA, 15 bp, Homo sapiens
cctcagaaggcccca

SEQ ID NO: 2255243 - DNA, 19 bp, Homo sapiens
cctcagaaggccccagaga

SEQ ID NO: 2255244 - DNA, 21 bp, Homo sapiens
cctcagaaggccccagagaga

SEQ ID NO: 2255245 - DNA, 21 bp, Homo sapiens
cctcagagcatttaaggaaac

SEQ ID NO: 2255246 - DNA, 14 bp, Homo sapiens
cctcagatgatctc

SEQ ID NO: 2255247 - DNA, 21 bp, Homo sapiens
cctcagatgatctctccacgg

SEQ ID NO: 2255248 - DNA, 15 bp, Homo sapiens
cctcatggcccctct

SEQ ID NO: 2255249 - DNA, 22 bp, Homo sapiens
cctcatggcccctctgacctgc

SEQ ID NO: 2255250 - DNA, 21 bp, Homo sapiens
cctcatgtacataccctggcc

SEQ ID NO: 2255251 - DNA, 12 bp, Homo sapiens
cctccacagaga

SEQ ID NO: 2255252 - DNA, 13 bp, Homo sapiens
cctccaccccagg

SEQ ID NO: 2255253 - DNA, 14 bp, Homo sapiens
cctccacgcctcct

SEQ ID NO: 2255254 - DNA, 19 bp, Homo sapiens
cctccacgcctcctggcca

SEQ ID NO: 2255255 - DNA, 13 bp, Homo sapiens
cctcccaccccca

SEQ ID NO: 2255256 - DNA, 19 bp, Homo sapiens
caggtaaagggcaaataat

SEQ ID NO: 2255257 - DNA, 23 bp, Homo sapiens
caggtccctccgcggctggagcg

SEQ ID NO: 2255258 - DNA, 24 bp, Homo sapiens
caggtccctccgcggctggagcga

SEQ ID NO: 2255259 - DNA, 12 bp, Homo sapiens
caggtcctgccc

SEQ ID NO: 2255260 - DNA, 18 bp, Homo sapiens
caggtcctgcccatgtgt

SEQ ID NO: 2255261 - DNA, 22 bp, Homo sapiens
caggtggctctgaggtgcctgt

SEQ ID NO: 2255262 - DNA, 16 bp, Homo sapiens
cagtacctgattgtat

SEQ ID NO: 2255263 - DNA, 20 bp, Homo sapiens
cagtacctgattgtattttt

SEQ ID NO: 2255264 - DNA, 15 bp, Homo sapiens
cagtacttttttaaa

SEQ ID NO: 2255265 - DNA, 23 bp, Homo sapiens
cagtacttttttaaatattttct

SEQ ID NO: 2255266 - DNA, 22 bp, Homo sapiens
cagtaggtgcccagaataagtt

SEQ ID NO: 2255267 - DNA, 14 bp, Homo sapiens
cagtccaaaatact

SEQ ID NO: 2255268 - DNA, 18 bp, Homo sapiens
cagtccacaggggccacc

SEQ ID NO: 2255269 - DNA, 20 bp, Homo sapiens
cagtccacaggggccaccac

SEQ ID NO: 2255270 - DNA, 18 bp, Homo sapiens
cagtcccaggtttagtga

SEQ ID NO: 2255271 - DNA, 16 bp, Homo sapiens
cagtggctcataaaaa

SEQ ID NO: 2255272 - DNA, 21 bp, Homo sapiens
cagtgggttaacatcagtttt

SEQ ID NO: 2255273 - DNA, 16 bp, Homo sapiens
cagtgtccttagaaca

SEQ ID NO: 2255274 - DNA, 16 bp, Homo sapiens
cagtgtgtaaacaaaa

SEQ ID NO: 2255275 - DNA, 16 bp, Homo sapiens
cagtgttaatgctgaa

SEQ ID NO: 2255276 - DNA, 18 bp, Homo sapiens
cagtgttgagccttttcc

SEQ ID NO: 2255277 - DNA, 15 bp, Homo sapiens
cagttattacatgta

SEQ ID NO: 2255278 - DNA, 17 bp, Homo sapiens
cagttcaacctggtggc

SEQ ID NO: 2255279 - DNA, 23 bp, Homo sapiens
cagttcaacctggtggcaccaga

SEQ ID NO: 2255280 - DNA, 16 bp, Homo sapiens
cagttcctcccaggaa

SEQ ID NO: 2255281 - DNA, 16 bp, Homo sapiens
cagttcttggtgactg

SEQ ID NO: 2255282 - DNA, 16 bp, Homo sapiens
cagttgaaaacttgta

SEQ ID NO: 2255283 - DNA, 14 bp, Homo sapiens
cagttgactttctc

SEQ ID NO: 2255284 - DNA, 18 bp, Homo sapiens
cagtttaaaaaaattggt

SEQ ID NO: 2255285 - DNA, 13 bp, Homo sapiens
cagtttatcattc

SEQ ID NO: 2255286 - DNA, 15 bp, Homo sapiens
cagtttatcattcaa

SEQ ID NO: 2255287 - DNA, 14 bp, Homo sapiens
cagtttccatgaaa

SEQ ID NO: 2255288 - DNA, 16 bp, Homo sapiens
cagtttgtgtgtctta

SEQ ID NO: 2255289 - DNA, 20 bp, Homo sapiens
cagtttttcattttaaaaag

SEQ ID NO: 2255290 - DNA, 20 bp, Homo sapiens
cataaccttaaaaaggacta

SEQ ID NO: 2255291 - DNA, 12 bp, Homo sapiens
cataatgcaatc

SEQ ID NO: 2255292 - DNA, 14 bp, Homo sapiens
catacacctcgtca

SEQ ID NO: 2255293 - DNA, 14 bp, Homo sapiens
catacgatttaagg

SEQ ID NO: 2255294 - DNA, 15 bp, Homo sapiens
catactggcctggac

SEQ ID NO: 2255295 - DNA, 18 bp, Homo sapiens
catactggcctggactgt

SEQ ID NO: 2255296 - DNA, 13 bp, Homo sapiens
catacttgttctg

SEQ ID NO: 2255297 - DNA, 20 bp, Homo sapiens
catagaaatggaaattttgc

SEQ ID NO: 2255298 - DNA, 17 bp, Homo sapiens
cataggaggcttctgtt

SEQ ID NO: 2255299 - DNA, 20 bp, Homo sapiens
cataggcaccttttactgtg

SEQ ID NO: 2255300 - DNA, 14 bp, Homo sapiens
catagtaagattga

SEQ ID NO: 2255301 - DNA, 20 bp, Homo sapiens
catagtaccatttatacaaa

SEQ ID NO: 2255302 - DNA, 18 bp, Homo sapiens
catagtcttgaaatgaaa

SEQ ID NO: 2255303 - DNA, 13 bp, Homo sapiens
catagttactgtg

SEQ ID NO: 2255304 - DNA, 21 bp, Homo sapiens
catagttctgagctgccagtg

SEQ ID NO: 2255305 - DNA, 16 bp, Homo sapiens
catagtttggcatttg

SEQ ID NO: 2255306 - DNA, 20 bp, Homo sapiens
catatcttaatatatttcta

SEQ ID NO: 2255307 - DNA, 14 bp, Homo sapiens
catatctttattaa

SEQ ID NO: 2255308 - DNA, 14 bp, Homo sapiens
catatgtgtaaaga

SEQ ID NO: 2255309 - DNA, 17 bp, Homo sapiens
catatgtgttacttcaa

SEQ ID NO: 2255310 - DNA, 18 bp, Homo sapiens
catatgtgttacttcaag

SEQ ID NO: 2255311 - DNA, 21 bp, Homo sapiens
catattgctgagagaaatatg

SEQ ID NO: 2255312 - DNA, 13 bp, Homo sapiens
catatttatttca

SEQ ID NO: 2255313 - DNA, 10 bp, Homo sapiens
catatttgag

SEQ ID NO: 2255314 - DNA, 14 bp, Homo sapiens
catcaagtaataca

SEQ ID NO: 2255315 - DNA, 17 bp, Homo sapiens
catcacacccatttaaa

SEQ ID NO: 2255316 - DNA, 19 bp, Homo sapiens
catcacccgcccctggact

SEQ ID NO: 2255317 - DNA, 15 bp, Homo sapiens
catcataaaattttt

SEQ ID NO: 2255318 - DNA, 17 bp, Homo sapiens
catcataaaatttttat

SEQ ID NO: 2255319 - DNA, 12 bp, Homo sapiens
catccaccccat

SEQ ID NO: 2255320 - DNA, 16 bp, Homo sapiens
catccagccagacccc

SEQ ID NO: 2255321 - DNA, 15 bp, Homo sapiens
catccagcctccagg

SEQ ID NO: 2255322 - DNA, 19 bp, Homo sapiens
catccagcctccagggcat

SEQ ID NO: 2255323 - DNA, 15 bp, Homo sapiens
catccagtttgttct

SEQ ID NO: 2255324 - DNA, 13 bp, Homo sapiens
catcccaactgtc

SEQ ID NO: 2255325 - DNA, 22 bp, Homo sapiens
catcccgctggtgcctcccggg

SEQ ID NO: 2255326 - DNA, 21 bp, Homo sapiens
catcccgtgttctccttttcc

SEQ ID NO: 2255327 - DNA, 13 bp, Homo sapiens
catccctccccag

SEQ ID NO: 2255328 - DNA, 14 bp, Homo sapiens
catccctccccagt

SEQ ID NO: 2255329 - DNA, 16 bp, Homo sapiens
catccctttttttaca

SEQ ID NO: 2255330 - DNA, 17 bp, Homo sapiens
catcggaggctgggccc

SEQ ID NO: 2255331 - DNA, 21 bp, Homo sapiens
catcggaggctgggcccctgg

SEQ ID NO: 2255332 - DNA, 20 bp, Homo sapiens
catctcatttaagggaaaaa

SEQ ID NO: 2255333 - DNA, 22 bp, Homo sapiens
catctcatttaagggaaaaata

SEQ ID NO: 2255334 - DNA, 23 bp, Homo sapiens
catctcatttaagggaaaaatat

SEQ ID NO: 2255335 - DNA, 13 bp, Homo sapiens
catctctctgggg

SEQ ID NO: 2255336 - DNA, 20 bp, Homo sapiens
catctctctggggccctggg

SEQ ID NO: 2255337 - DNA, 21 bp, Homo sapiens
catctcttcattcaaactgca

SEQ ID NO: 2255338 - DNA, 15 bp, Homo sapiens
catctgcaacaaaaa

SEQ ID NO: 2255339 - DNA, 15 bp, Homo sapiens
catctgttagcagag

SEQ ID NO: 2255340 - DNA, 18 bp, Homo sapiens
catctttgtatatttaca

SEQ ID NO: 2255341 - DNA, 12 bp, Homo sapiens
catcttttattc

SEQ ID NO: 2255342 - DNA, 14 bp, Homo sapiens
catgaaatgtgaat

SEQ ID NO: 2255343 - DNA, 23 bp, Homo sapiens
catgaaatgtgaatttttattgt

SEQ ID NO: 2255344 - DNA, 21 bp, Homo sapiens
catgagtaaaatagattttat

SEQ ID NO: 2255345 - DNA, 14 bp, Homo sapiens
catgatgatagttg

SEQ ID NO: 2255346 - DNA, 19 bp, Homo sapiens
catgatgatagttgaatgt

SEQ ID NO: 2255347 - DNA, 15 bp, Homo sapiens
catgcaaacaagaaa

SEQ ID NO: 2255348 - DNA, 21 bp, Homo sapiens
catgccaataaagtgatctgt

SEQ ID NO: 2255349 - DNA, 21 bp, Homo sapiens
catgccagctacttcctcctc

SEQ ID NO: 2255350 - DNA, 16 bp, Homo sapiens
cctcccccatgggctg

SEQ ID NO: 2255351 - DNA, 19 bp, Homo sapiens
cctccccctttcacactgg

SEQ ID NO: 2255352 - DNA, 20 bp, Homo sapiens
cctccccgcgccccagtcac

SEQ ID NO: 2255353 - DNA, 13 bp, Homo sapiens
cctcccctctccc

SEQ ID NO: 2255354 - DNA, 13 bp, Homo sapiens
cctccctccaccc

SEQ ID NO: 2255355 - DNA, 19 bp, Homo sapiens
cctccctccaccccaggac

SEQ ID NO: 2255356 - DNA, 13 bp, Homo sapiens
cctccgtttttct

SEQ ID NO: 2255357 - DNA, 20 bp, Homo sapiens
cctcctcatcccgtgttctc

SEQ ID NO: 2255358 - DNA, 23 bp, Homo sapiens
cctcctcatcccgtgttctcctt

SEQ ID NO: 2255359 - DNA, 12 bp, Homo sapiens
cctcctcatgta

SEQ ID NO: 2255360 - DNA, 20 bp, Homo sapiens
cctcctcatgtacataccct

SEQ ID NO: 2255361 - DNA, 15 bp, Homo sapiens
cctcctcccccagtg

SEQ ID NO: 2255362 - DNA, 19 bp, Homo sapiens
cctcctctaaggttgggca

SEQ ID NO: 2255363 - DNA, 11 bp, Homo sapiens
cctcctggcca

SEQ ID NO: 2255364 - DNA, 12 bp, Homo sapiens
cctcctggccag

SEQ ID NO: 2255365 - DNA, 20 bp, Homo sapiens
cctcctgtgttgtgctggga

SEQ ID NO: 2255366 - DNA, 12 bp, Homo sapiens
cctccttcagac

SEQ ID NO: 2255367 - DNA, 19 bp, Homo sapiens
cctcgccggatctgaggga

SEQ ID NO: 2255368 - DNA, 18 bp, Homo sapiens
cctcgtcaagagcatgca

SEQ ID NO: 2255369 - DNA, 20 bp, Homo sapiens
cctctcacctgccgtgcgta

SEQ ID NO: 2255370 - DNA, 14 bp, Homo sapiens
cctctccccagcct

SEQ ID NO: 2255371 - DNA, 19 bp, Homo sapiens
cctctccccagcctggcac

SEQ ID NO: 2255372 - DNA, 19 bp, Homo sapiens
cctctccccattcggtgtg

SEQ ID NO: 2255373 - DNA, 14 bp, Homo sapiens
cctctcctgggggt

SEQ ID NO: 2255374 - DNA, 16 bp, Homo sapiens
cctctcgagggcaggg

SEQ ID NO: 2255375 - DNA, 15 bp, Homo sapiens
cctctcggtgacctc

SEQ ID NO: 2255376 - DNA, 21 bp, Homo sapiens
cctctcggtgacctccgtcct

SEQ ID NO: 2255377 - DNA, 10 bp, Homo sapiens
cctctctctt

SEQ ID NO: 2255378 - DNA, 12 bp, Homo sapiens
cctctctctttt

SEQ ID NO: 2255379 - DNA, 18 bp, Homo sapiens
cctctgacagtccacagg

SEQ ID NO: 2255380 - DNA, 17 bp, Homo sapiens
cctctgacctgcactgg

SEQ ID NO: 2255381 - DNA, 14 bp, Homo sapiens
cctctgccagcgcc

SEQ ID NO: 2255382 - DNA, 20 bp, Homo sapiens
cctctgctgctgtccctccc

SEQ ID NO: 2255383 - DNA, 17 bp, Homo sapiens
cctctggaggggtgtgg

SEQ ID NO: 2255384 - DNA, 21 bp, Homo sapiens
cctctggcattagaattattt

SEQ ID NO: 2255385 - DNA, 15 bp, Homo sapiens
cctcttaagtcccag

SEQ ID NO: 2255386 - DNA, 14 bp, Homo sapiens
cctctttggctccc

SEQ ID NO: 2255387 - DNA, 18 bp, Homo sapiens
cctctttggctcccctgt

SEQ ID NO: 2255388 - DNA, 13 bp, Homo sapiens
cctgacccctgcc

SEQ ID NO: 2255389 - DNA, 16 bp, Homo sapiens
cctgactccctgtggg

SEQ ID NO: 2255390 - DNA, 17 bp, Homo sapiens
cctgactccctgtgggg

SEQ ID NO: 2255391 - DNA, 13 bp, Homo sapiens
cctgaggcctaga

SEQ ID NO: 2255392 - DNA, 15 bp, Homo sapiens
cctgatcccaccccc

SEQ ID NO: 2255393 - DNA, 15 bp, Homo sapiens
cctgattgtattttt

SEQ ID NO: 2255394 - DNA, 12 bp, Homo sapiens
cctgcaaaaaga

SEQ ID NO: 2255395 - DNA, 21 bp, Homo sapiens
cctgcactggggagcccgtct

SEQ ID NO: 2255396 - DNA, 20 bp, Homo sapiens
cctgccccaatccctttatt

SEQ ID NO: 2255397 - DNA, 23 bp, Homo sapiens
cctgccccaccccatccagccag

SEQ ID NO: 2255398 - DNA, 17 bp, Homo sapiens
cctgccccccagcctct

SEQ ID NO: 2255399 - DNA, 20 bp, Homo sapiens
cctgcggagaccctgagtcc

SEQ ID NO: 2255400 - DNA, 21 bp, Homo sapiens
cctgctgattgatttttttct

SEQ ID NO: 2255401 - DNA, 17 bp, Homo sapiens
cctggaatttgggcaga

SEQ ID NO: 2255402 - DNA, 21 bp, Homo sapiens
cctggaatttgggcagatata

SEQ ID NO: 2255403 - DNA, 16 bp, Homo sapiens
cctggacactcagacc

SEQ ID NO: 2255404 - DNA, 18 bp, Homo sapiens
cctggagcagaccacccc

SEQ ID NO: 2255405 - DNA, 19 bp, Homo sapiens
cctggaggggctggggact

SEQ ID NO: 2255406 - DNA, 11 bp, Homo sapiens
cctggccagga

SEQ ID NO: 2255407 - DNA, 12 bp, Homo sapiens
cctggccaggag

SEQ ID NO: 2255408 - DNA, 14 bp, Homo sapiens
cctggccgccccct

SEQ ID NO: 2255409 - DNA, 20 bp, Homo sapiens
cctggccgccccctgccccc

SEQ ID NO: 2255410 - DNA, 22 bp, Homo sapiens
cctggccgccccctgcccccca

SEQ ID NO: 2255411 - DNA, 13 bp, Homo sapiens
cctggcctctgtg

SEQ ID NO: 2255412 - DNA, 13 bp, Homo sapiens
cctggctctgccc

SEQ ID NO: 2255413 - DNA, 15 bp, Homo sapiens
cctggctctgccccc

SEQ ID NO: 2255414 - DNA, 16 bp, Homo sapiens
cctgggatgggaccag

SEQ ID NO: 2255415 - DNA, 18 bp, Homo sapiens
cctgggatgggaccaggg

SEQ ID NO: 2255416 - DNA, 22 bp, Homo sapiens
cctgggcctcagttcaacctgg

SEQ ID NO: 2255417 - DNA, 17 bp, Homo sapiens
cctgggctcactgtgct

SEQ ID NO: 2255418 - DNA, 22 bp, Homo sapiens
cctgggctcactgtgctggggc

SEQ ID NO: 2255419 - DNA, 17 bp, Homo sapiens
cctgggctgtctgtcac

SEQ ID NO: 2255420 - DNA, 17 bp, Homo sapiens
cctgggggtggcaggca

SEQ ID NO: 2255421 - DNA, 18 bp, Homo sapiens
cctgggggtggcaggcac

SEQ ID NO: 2255422 - DNA, 16 bp, Homo sapiens
cctgggttaagtatta

SEQ ID NO: 2255423 - DNA, 14 bp, Homo sapiens
cctgggtttcctgc

SEQ ID NO: 2255424 - DNA, 18 bp, Homo sapiens
cctgggtttcctgcaggc

SEQ ID NO: 2255425 - DNA, 19 bp, Homo sapiens
cctgggtttcctgcaggca

SEQ ID NO: 2255426 - DNA, 23 bp, Homo sapiens
cctggtggcaccagatgcaacct

SEQ ID NO: 2255427 - DNA, 14 bp, Homo sapiens
cctggtttttgcct

SEQ ID NO: 2255428 - DNA, 19 bp, Homo sapiens
cctgtagtgaatcctctgt

SEQ ID NO: 2255429 - DNA, 20 bp, Homo sapiens
cctgtagtgaatcctctgtt

SEQ ID NO: 2255430 - DNA, 20 bp, Homo sapiens
cctgtatgttgtacaatcaa

SEQ ID NO: 2255431 - DNA, 19 bp, Homo sapiens
cctgtcttcagagaaccca

SEQ ID NO: 2255432 - DNA, 15 bp, Homo sapiens
cctgtgggggtggcc

SEQ ID NO: 2255433 - DNA, 17 bp, Homo sapiens
cctgtgggggtggccat

SEQ ID NO: 2255434 - DNA, 18 bp, Homo sapiens
cctgtgggggtggccatc

SEQ ID NO: 2255435 - DNA, 21 bp, Homo sapiens
cctgtgggggtggccatccct

SEQ ID NO: 2255436 - DNA, 18 bp, Homo sapiens
cctgtttcagaggctcag

SEQ ID NO: 2255437 - DNA, 14 bp, Homo sapiens
ccttaaaaaggact

SEQ ID NO: 2255438 - DNA, 19 bp, Homo sapiens
cgtttttgtgctgtgggca

SEQ ID NO: 2255439 - DNA, 18 bp, Homo sapiens
ctaaaataattttgtaat

SEQ ID NO: 2255440 - DNA, 18 bp, Homo sapiens
ctaaacatccaatatttt

SEQ ID NO: 2255441 - DNA, 18 bp, Homo sapiens
ctaaaccatggcacttga

SEQ ID NO: 2255442 - DNA, 19 bp, Homo sapiens
ctaaagcatgaaatgtgaa

SEQ ID NO: 2255443 - DNA, 16 bp, Homo sapiens
ctaaataaagatattg

SEQ ID NO: 2255444 - DNA, 19 bp, Homo sapiens
ctaaatatttaccttgaaa

SEQ ID NO: 2255445 - DNA, 20 bp, Homo sapiens
ctaaatatttaccttgaaaa

SEQ ID NO: 2255446 - DNA, 17 bp, Homo sapiens
ctaacgttgagcccctg

SEQ ID NO: 2255447 - DNA, 13 bp, Homo sapiens
ctaactgtaaatc

SEQ ID NO: 2255448 - DNA, 14 bp, Homo sapiens
ctaagaaaagattt

SEQ ID NO: 2255449 - DNA, 20 bp, Homo sapiens
ctaagaaaagattttaatca

SEQ ID NO: 2255450 - DNA, 21 bp, Homo sapiens
ctaagaaatcaagtaatgaat

SEQ ID NO: 2255451 - DNA, 15 bp, Homo sapiens
ctaagaataataaaa

SEQ ID NO: 2255452 - DNA, 18 bp, Homo sapiens
ctaagaataataaaatca

SEQ ID NO: 2255453 - DNA, 21 bp, Homo sapiens
ctaagattcttttaaattaga

SEQ ID NO: 2255454 - DNA, 22 bp, Homo sapiens
ctaaggccgtgtctctgaggac

SEQ ID NO: 2255455 - DNA, 15 bp, Homo sapiens
ctaatagtttgttga

SEQ ID NO: 2255456 - DNA, 15 bp, Homo sapiens
ctaatcatctgcagt

SEQ ID NO: 2255457 - DNA, 18 bp, Homo sapiens
ctaattaaccttactaat

SEQ ID NO: 2255458 - DNA, 16 bp, Homo sapiens
ctaattatactacttt

SEQ ID NO: 2255459 - DNA, 19 bp, Homo sapiens
ctaattttacatgtttata

SEQ ID NO: 2255460 - DNA, 22 bp, Homo sapiens
ctacagtattactcttacaaga

SEQ ID NO: 2255461 - DNA, 16 bp, Homo sapiens
ctacatcttctgcctt

SEQ ID NO: 2255462 - DNA, 16 bp, Homo sapiens
ctaccaactttactgt

SEQ ID NO: 2255463 - DNA, 12 bp, Homo sapiens
ctaccagccagc

SEQ ID NO: 2255464 - DNA, 16 bp, Homo sapiens
ctaccctttttctcca

SEQ ID NO: 2255465 - DNA, 14 bp, Homo sapiens
ctacctgagctaaa

SEQ ID NO: 2255466 - DNA, 18 bp, Homo sapiens
aggtaaagggcaaataat

SEQ ID NO: 2255467 - DNA, 16 bp, Homo sapiens
aggtaccgtctacatt

SEQ ID NO: 2255468 - DNA, 15 bp, Homo sapiens
aggtagtctcactgc

SEQ ID NO: 2255469 - DNA, 15 bp, Homo sapiens
aggtataataaaatt

SEQ ID NO: 2255470 - DNA, 13 bp, Homo sapiens
aggtcctgcccat

SEQ ID NO: 2255471 - DNA, 23 bp, Homo sapiens
aggtcctgcccatgtgtcccctc

SEQ ID NO: 2255472 - DNA, 20 bp, Homo sapiens
aggtccttaggcctctgaga

SEQ ID NO: 2255473 - DNA, 15 bp, Homo sapiens
aggtcttaggaattg

SEQ ID NO: 2255474 - DNA, 19 bp, Homo sapiens
aggtgaaactccagatgcc

SEQ ID NO: 2255475 - DNA, 22 bp, Homo sapiens
aggtgaaactccagatgccaca

SEQ ID NO: 2255476 - DNA, 16 bp, Homo sapiens
aggtgatatatttaaa

SEQ ID NO: 2255477 - DNA, 23 bp, Homo sapiens
aggtgatcccgttttccccatga

SEQ ID NO: 2255478 - DNA, 16 bp, Homo sapiens
aggtgatgggggacga

SEQ ID NO: 2255479 - DNA, 17 bp, Homo sapiens
aggtgcctgtcccaccc

SEQ ID NO: 2255480 - DNA, 17 bp, Homo sapiens
aggtggggatcctgcct

SEQ ID NO: 2255481 - DNA, 17 bp, Homo sapiens
aggttgagctcttctta

SEQ ID NO: 2255482 - DNA, 12 bp, Homo sapiens
aggtttattgtt

SEQ ID NO: 2255483 - DNA, 15 bp, Homo sapiens
aggtttctggagcag

SEQ ID NO: 2255484 - DNA, 15 bp, Homo sapiens
aggttttattcatat

SEQ ID NO: 2255485 - DNA, 13 bp, Homo sapiens
aggtttttattag

SEQ ID NO: 2255486 - DNA, 20 bp, Homo sapiens
aggtttttattagtaccata

SEQ ID NO: 2255487 - DNA, 14 bp, Homo sapiens
aggtttttttaatg

SEQ ID NO: 2255488 - DNA, 18 bp, Homo sapiens
agtaaaattatcctcttt

SEQ ID NO: 2255489 - DNA, 16 bp, Homo sapiens
agtaaacgggaacatg

SEQ ID NO: 2255490 - DNA, 12 bp, Homo sapiens
agtaaacttgaa

SEQ ID NO: 2255491 - DNA, 13 bp, Homo sapiens
agtaaacttgaaa

SEQ ID NO: 2255492 - DNA, 17 bp, Homo sapiens
agtaacatgaggggaca

SEQ ID NO: 2255493 - DNA, 14 bp, Homo sapiens
agtaatagcctggg

SEQ ID NO: 2255494 - DNA, 14 bp, Homo sapiens
agtaatttcttttt

SEQ ID NO: 2255495 - DNA, 15 bp, Homo sapiens
agtacagtgtgtgtg

SEQ ID NO: 2255496 - DNA, 18 bp, Homo sapiens
agtaccctctcagctcca

SEQ ID NO: 2255497 - DNA, 18 bp, Homo sapiens
agtacctgattgtatttt

SEQ ID NO: 2255498 - DNA, 16 bp, Homo sapiens
agtactggctctttat

SEQ ID NO: 2255499 - DNA, 16 bp, Homo sapiens
agtataaacaaagtta

SEQ ID NO: 2255500 - DNA, 15 bp, Homo sapiens
agtatacaaacattt

SEQ ID NO: 2255501 - DNA, 14 bp, Homo sapiens
agtatacctcattt

SEQ ID NO: 2255502 - DNA, 19 bp, Homo sapiens
agtatacctcatttttcat

SEQ ID NO: 2255503 - DNA, 23 bp, Homo sapiens
agtattttcttctctgtgagaag

SEQ ID NO: 2255504 - DNA, 15 bp, Homo sapiens
agtcaaaactatttt

SEQ ID NO: 2255505 - DNA, 19 bp, Homo sapiens
agtcaaaactatttttgta

SEQ ID NO: 2255506 - DNA, 18 bp, Homo sapiens
agtcaaacaaaaaagaaa

SEQ ID NO: 2255507 - DNA, 20 bp, Homo sapiens
agtcaaattaataatcttat

SEQ ID NO: 2255508 - DNA, 22 bp, Homo sapiens
agtcaccaaaagacactgcaga

SEQ ID NO: 2255509 - DNA, 14 bp, Homo sapiens
agtcaccagagact

SEQ ID NO: 2255510 - DNA, 18 bp, Homo sapiens
agtcagattgctgggagg

SEQ ID NO: 2255511 - DNA, 13 bp, Homo sapiens
agtccaaaatact

SEQ ID NO: 2255512 - DNA, 16 bp, Homo sapiens
agtcccagtatacctc

SEQ ID NO: 2255513 - DNA, 19 bp, Homo sapiens
agtcccagtatacctcatt

SEQ ID NO: 2255514 - DNA, 17 bp, Homo sapiens
agtcctcataaaaagca

SEQ ID NO: 2255515 - DNA, 18 bp, Homo sapiens
agtctcactgcttgaact

SEQ ID NO: 2255516 - DNA, 10 bp, Homo sapiens
agtctcagtt

SEQ ID NO: 2255517 - DNA, 18 bp, Homo sapiens
agtctcagtttgtgtgtc

SEQ ID NO: 2255518 - DNA, 13 bp, Homo sapiens
agtctgaagcact

SEQ ID NO: 2255519 - DNA, 21 bp, Homo sapiens
agtctgtacctcaaatgaatt

SEQ ID NO: 2255520 - DNA, 23 bp, Homo sapiens
agtctgtctcttggctttgtcac

SEQ ID NO: 2255521 - DNA, 17 bp, Homo sapiens
agtcttgaaatgaaagg

SEQ ID NO: 2255522 - DNA, 18 bp, Homo sapiens
agtcttgaaatgaaaggg

SEQ ID NO: 2255523 - DNA, 21 bp, Homo sapiens
agtcttgaaatgaaagggaaa

SEQ ID NO: 2255524 - DNA, 22 bp, Homo sapiens
agtcttgaaatgaaagggaaac

SEQ ID NO: 2255525 - DNA, 23 bp, Homo sapiens
agtcttgaaatgaaagggaaact

SEQ ID NO: 2255526 - DNA, 14 bp, Homo sapiens
agtgaaaatatagc

SEQ ID NO: 2255527 - DNA, 17 bp, Homo sapiens
agtgaaattattttgga

SEQ ID NO: 2255528 - DNA, 17 bp, Homo sapiens
agtgaatcctctgttta

SEQ ID NO: 2255529 - DNA, 22 bp, Homo sapiens
agtgagtgtgctgactttttaa

SEQ ID NO: 2255530 - DNA, 23 bp, Homo sapiens
agtgagtgtgctgactttttaac

SEQ ID NO: 2255531 - DNA, 15 bp, Homo sapiens
agtgatattacattt

SEQ ID NO: 2255532 - DNA, 12 bp, Homo sapiens
agtgatttccat

SEQ ID NO: 2255533 - DNA, 13 bp, Homo sapiens
agtgcactgcatt

SEQ ID NO: 2255534 - DNA, 21 bp, Homo sapiens
agtgcactgcattcctgtgcc

SEQ ID NO: 2255535 - DNA, 23 bp, Homo sapiens
agtgcactgcattcctgtgccct

SEQ ID NO: 2255536 - DNA, 21 bp, Homo sapiens
agtgcagtggcacaatcttgg

SEQ ID NO: 2255537 - DNA, 13 bp, Homo sapiens
agtgccaagcagg

SEQ ID NO: 2255538 - DNA, 20 bp, Homo sapiens
agtgctccatagtttggcat

SEQ ID NO: 2255539 - DNA, 20 bp, Homo sapiens
agtggaaactatgtgttttt

SEQ ID NO: 2255540 - DNA, 16 bp, Homo sapiens
agtggaccgccctttt

SEQ ID NO: 2255541 - DNA, 23 bp, Homo sapiens
agtggaccttaggccttcctctc

SEQ ID NO: 2255542 - DNA, 16 bp, Homo sapiens
agtggactcagtgggt

SEQ ID NO: 2255543 - DNA, 14 bp, Homo sapiens
agtggaggcacttt

SEQ ID NO: 2255544 - DNA, 19 bp, Homo sapiens
agtggcccatggcatttta

SEQ ID NO: 2255545 - DNA, 19 bp, Homo sapiens
agtggggttatctctgtgt

SEQ ID NO: 2255546 - DNA, 21 bp, Homo sapiens
agtggggttatctctgtgtta

SEQ ID NO: 2255547 - DNA, 19 bp, Homo sapiens
agtggtgctataagtttta

SEQ ID NO: 2255548 - DNA, 15 bp, Homo sapiens
agtgtattatcactg

SEQ ID NO: 2255549 - DNA, 21 bp, Homo sapiens
agtgtatttttcaataaagca

SEQ ID NO: 2255550 - DNA, 14 bp, Homo sapiens
agtgtgctgacttt

SEQ ID NO: 2255551 - DNA, 21 bp, Homo sapiens
agtgtgtgtgggtgaaatgga

SEQ ID NO: 2255552 - DNA, 14 bp, Homo sapiens
agtgtttctgtgaa

SEQ ID NO: 2255553 - DNA, 16 bp, Homo sapiens
agtgtttttgtgaatt

SEQ ID NO: 2255554 - DNA, 20 bp, Homo sapiens
agttacagcctgttagtaac

SEQ ID NO: 2255555 - DNA, 15 bp, Homo sapiens
agttaccagtgcctt

SEQ ID NO: 2255556 - DNA, 22 bp, Homo sapiens
agttactaggtaacttcatatt

SEQ ID NO: 2255557 - DNA, 18 bp, Homo sapiens
agttatacagttataaaa

SEQ ID NO: 2255558 - DNA, 19 bp, Homo sapiens
agttatacagttataaaat

SEQ ID NO: 2255559 - DNA, 16 bp, Homo sapiens
agttattgcagtttat

SEQ ID NO: 2255560 - DNA, 18 bp, Homo sapiens
agttattgcagtttatca

SEQ ID NO: 2255561 - DNA, 19 bp, Homo sapiens
agttattgcagtttatcat

SEQ ID NO: 2255562 - DNA, 15 bp, Homo sapiens
agttcaccatctctt

SEQ ID NO: 2255563 - DNA, 13 bp, Homo sapiens
agttccactgaga

SEQ ID NO: 2255564 - DNA, 21 bp, Homo sapiens
agttcctttagaaagcagtta

SEQ ID NO: 2255565 - DNA, 22 bp, Homo sapiens
agttcttagctatccttggctt

SEQ ID NO: 2255566 - DNA, 14 bp, Homo sapiens
agttcttagttata

SEQ ID NO: 2255567 - DNA, 20 bp, Homo sapiens
agttcttggtgactgtccca

SEQ ID NO: 2255568 - DNA, 21 bp, Homo sapiens
agttctttttgtacacttaat

SEQ ID NO: 2255569 - DNA, 14 bp, Homo sapiens
agttgactttctcc

SEQ ID NO: 2255570 - DNA, 16 bp, Homo sapiens
atatatccccactact

SEQ ID NO: 2255571 - DNA, 18 bp, Homo sapiens
atatatctatctatttga

SEQ ID NO: 2255572 - DNA, 13 bp, Homo sapiens
atatatggatcag

SEQ ID NO: 2255573 - DNA, 17 bp, Homo sapiens
atatatggatcagagga

SEQ ID NO: 2255574 - DNA, 19 bp, Homo sapiens
atatatttctaaatgtttg

SEQ ID NO: 2255575 - DNA, 13 bp, Homo sapiens
atatatttctatt

SEQ ID NO: 2255576 - DNA, 23 bp, Homo sapiens
atatatttctattattaattgca

SEQ ID NO: 2255577 - DNA, 17 bp, Homo sapiens
atatccccactactcaa

SEQ ID NO: 2255578 - DNA, 17 bp, Homo sapiens
atatctatctatttgag

SEQ ID NO: 2255579 - DNA, 17 bp, Homo sapiens
atatcttaatatatttc

SEQ ID NO: 2255580 - DNA, 23 bp, Homo sapiens
atatcttggcctaaacctcagtt

SEQ ID NO: 2255581 - DNA, 13 bp, Homo sapiens
atatctttattaa

SEQ ID NO: 2255582 - DNA, 16 bp, Homo sapiens
atatctttattaatca

SEQ ID NO: 2255583 - DNA, 12 bp, Homo sapiens
atatctttctgc

SEQ ID NO: 2255584 - DNA, 15 bp, Homo sapiens
atatgatctgtctgt

SEQ ID NO: 2255585 - DNA, 17 bp, Homo sapiens
atatgatctgtctgtgg

SEQ ID NO: 2255586 - DNA, 12 bp, Homo sapiens
atatggaacctt

SEQ ID NO: 2255587 - DNA, 18 bp, Homo sapiens
atattaacttttaatggt

SEQ ID NO: 2255588 - DNA, 21 bp, Homo sapiens
atattaatcaccttctttgta

SEQ ID NO: 2255589 - DNA, 22 bp, Homo sapiens
atattaatcaccttctttgtaa

SEQ ID NO: 2255590 - DNA, 22 bp, Homo sapiens
atattacatttatttatccaga

SEQ ID NO: 2255591 - DNA, 15 bp, Homo sapiens
atatttaccttgaaa

SEQ ID NO: 2255592 - DNA, 14 bp, Homo sapiens
atatttataaaact

SEQ ID NO: 2255593 - DNA, 21 bp, Homo sapiens
atatttgtgatagcactttct

SEQ ID NO: 2255594 - DNA, 22 bp, Homo sapiens
atattttatataaagtattctt

SEQ ID NO: 2255595 - DNA, 18 bp, Homo sapiens
atatttttcataaacaag

SEQ ID NO: 2255596 - DNA, 23 bp, Homo sapiens
atatttttgtacgttatatattg

SEQ ID NO: 2255597 - DNA, 14 bp, Homo sapiens
atcaaaacaagtac

SEQ ID NO: 2255598 - DNA, 18 bp, Homo sapiens
atcaaaacaagtactggt

SEQ ID NO: 2255599 - DNA, 14 bp, Homo sapiens
atcaaaacacacta

SEQ ID NO: 2255600 - DNA, 14 bp, Homo sapiens
atcaaatacattta

SEQ ID NO: 2255601 - DNA, 22 bp, Homo sapiens
atcaacaataaaatttttttaa

SEQ ID NO: 2255602 - DNA, 23 bp, Homo sapiens
atcaacaataccttttttttcag

SEQ ID NO: 2255603 - DNA, 13 bp, Homo sapiens
atcaagtaatgaa

SEQ ID NO: 2255604 - DNA, 14 bp, Homo sapiens
atcaatgtgtcttt

SEQ ID NO: 2255605 - DNA, 22 bp, Homo sapiens
atcaatgtgtctttctaagaaa

SEQ ID NO: 2255606 - DNA, 15 bp, Homo sapiens
atcaatttaaaaagc

SEQ ID NO: 2255607 - DNA, 19 bp, Homo sapiens
atcagcaggagtaataaat

SEQ ID NO: 2255608 - DNA, 20 bp, Homo sapiens
atcagcaggatgtgtgggcc

SEQ ID NO: 2255609 - DNA, 14 bp, Homo sapiens
atcagctatatact

SEQ ID NO: 2255610 - DNA, 16 bp, Homo sapiens
atcagtataaacaaag

SEQ ID NO: 2255611 - DNA, 22 bp, Homo sapiens
atcagttatacagttataaaat

SEQ ID NO: 2255612 - DNA, 22 bp, Homo sapiens
atcataagttatgcctctgaca

SEQ ID NO: 2255613 - DNA, 19 bp, Homo sapiens
atcatagttactgtgtaaa

SEQ ID NO: 2255614 - DNA, 16 bp, Homo sapiens
atcatcaagtaataca

SEQ ID NO: 2255615 - DNA, 17 bp, Homo sapiens
atcatctgcagttcttt

SEQ ID NO: 2255616 - DNA, 16 bp, Homo sapiens
atcatgttgatcatgt

SEQ ID NO: 2255617 - DNA, 13 bp, Homo sapiens
atcattaaaggaa

SEQ ID NO: 2255618 - DNA, 12 bp, Homo sapiens
atcattcaagtg

SEQ ID NO: 2255619 - DNA, 22 bp, Homo sapiens
atccaatattttctttaatgct

SEQ ID NO: 2255620 - DNA, 15 bp, Homo sapiens
atccagaaaactgtg

SEQ ID NO: 2255621 - DNA, 17 bp, Homo sapiens
atccagaaaactgtgat

SEQ ID NO: 2255622 - DNA, 18 bp, Homo sapiens
atccagaaaactgtgatt

SEQ ID NO: 2255623 - DNA, 22 bp, Homo sapiens
atccagcctccagggcattgct

SEQ ID NO: 2255624 - DNA, 17 bp, Homo sapiens
atccagggggcaagagg

SEQ ID NO: 2255625 - DNA, 18 bp, Homo sapiens
atccatcttgagccacag

SEQ ID NO: 2255626 - DNA, 21 bp, Homo sapiens
tgtatatttgtgatagcactt

SEQ ID NO: 2255627 - DNA, 15 bp, Homo sapiens
tgtatattttatata

SEQ ID NO: 2255628 - DNA, 17 bp, Homo sapiens
tgtatattttatataaa

SEQ ID NO: 2255629 - DNA, 22 bp, Homo sapiens
tgtatatttttatctatataaa

SEQ ID NO: 2255630 - DNA, 15 bp, Homo sapiens
tgtatctaagaataa

SEQ ID NO: 2255631 - DNA, 15 bp, Homo sapiens
tgtatctagcttctt

SEQ ID NO: 2255632 - DNA, 20 bp, Homo sapiens
tgtatgttgtacaatcaaaa

SEQ ID NO: 2255633 - DNA, 17 bp, Homo sapiens
tgtattaagggcatttt

SEQ ID NO: 2255634 - DNA, 16 bp, Homo sapiens
tgtattgtatattaca

SEQ ID NO: 2255635 - DNA, 19 bp, Homo sapiens
tgtcaaaactactgacagg

SEQ ID NO: 2255636 - DNA, 19 bp, Homo sapiens
tgtcaaggctgcttagaat

SEQ ID NO: 2255637 - DNA, 12 bp, Homo sapiens
tgtcacagttct

SEQ ID NO: 2255638 - DNA, 16 bp, Homo sapiens
tgtcactcattgctga

SEQ ID NO: 2255639 - DNA, 21 bp, Homo sapiens
tgtcactcattgctgagcctc

SEQ ID NO: 2255640 - DNA, 17 bp, Homo sapiens
tgtcacttttccttttc

SEQ ID NO: 2255641 - DNA, 23 bp, Homo sapiens
tgtcagcacacacttacagagca

SEQ ID NO: 2255642 - DNA, 11 bp, Homo sapiens
tgtcagccagc

SEQ ID NO: 2255643 - DNA, 15 bp, Homo sapiens
tgtcagccagccgcc

SEQ ID NO: 2255644 - DNA, 16 bp, Homo sapiens
tgtcagccagccgccc

SEQ ID NO: 2255645 - DNA, 17 bp, Homo sapiens
tgtcagccagccgccct

SEQ ID NO: 2255646 - DNA, 19 bp, Homo sapiens
tgtcagccagccgccctgg

SEQ ID NO: 2255647 - DNA, 20 bp, Homo sapiens
tgtcagccagccgccctggg

SEQ ID NO: 2255648 - DNA, 15 bp, Homo sapiens
tgtcaggttatttat

SEQ ID NO: 2255649 - DNA, 23 bp, Homo sapiens
tgtcataacatccagagctttgt

SEQ ID NO: 2255650 - DNA, 20 bp, Homo sapiens
tgtcatagtcttgaaatgaa

SEQ ID NO: 2255651 - DNA, 22 bp, Homo sapiens
tgtcatctctctggggccctgg

SEQ ID NO: 2255652 - DNA, 21 bp, Homo sapiens
tgttctccttttcctctctcc

SEQ ID NO: 2255653 - DNA, 14 bp, Homo sapiens
tgttctgtgtcttt

SEQ ID NO: 2255654 - DNA, 16 bp, Homo sapiens
tgttcttttaccactg

SEQ ID NO: 2255655 - DNA, 15 bp, Homo sapiens
tgttgaaaaaattta

SEQ ID NO: 2255656 - DNA, 21 bp, Homo sapiens
tgttgaaaaaatttaaaagta

SEQ ID NO: 2255657 - DNA, 21 bp, Homo sapiens
tgttgaaaatatttctctagt

SEQ ID NO: 2255658 - DNA, 19 bp, Homo sapiens
tgttgatcatgtacttttt

SEQ ID NO: 2255659 - DNA, 20 bp, Homo sapiens
tgttgatcatgtacttttta

SEQ ID NO: 2255660 - DNA, 15 bp, Homo sapiens
tgttgattaaagatg

SEQ ID NO: 2255661 - DNA, 16 bp, Homo sapiens
tgttgcctctctttga

SEQ ID NO: 2255662 - DNA, 13 bp, Homo sapiens
tgttgctgtcaag

SEQ ID NO: 2255663 - DNA, 13 bp, Homo sapiens
tgttggcaggccc

SEQ ID NO: 2255664 - DNA, 14 bp, Homo sapiens
tgttgtattcattg

SEQ ID NO: 2255665 - DNA, 20 bp, Homo sapiens
tgttgtcaagaatagcattg

SEQ ID NO: 2255666 - DNA, 11 bp, Homo sapiens
tgtttagatgt

SEQ ID NO: 2255667 - DNA, 17 bp, Homo sapiens
tgtttagcagcagcctt

SEQ ID NO: 2255668 - DNA, 19 bp, Homo sapiens
tgtttataaatcttatgct

SEQ ID NO: 2255669 - DNA, 21 bp, Homo sapiens
tgtttcctgacattgtctcct

SEQ ID NO: 2255670 - DNA, 20 bp, Homo sapiens
tgtttctttctctgaggaca

SEQ ID NO: 2255671 - DNA, 20 bp, Homo sapiens
tgtttgtgtgcatgaaagag

SEQ ID NO: 2255672 - DNA, 22 bp, Homo sapiens
tgttttaaagaatatgactttt

SEQ ID NO: 2255673 - DNA, 16 bp, Homo sapiens
tgttttagaaccagcc

SEQ ID NO: 2255674 - DNA, 16 bp, Homo sapiens
tgttttccgtgaaaac

SEQ ID NO: 2255675 - DNA, 17 bp, Homo sapiens
tctacttgttcatttgg

SEQ ID NO: 2255676 - DNA, 16 bp, Homo sapiens
tctagattaatactct

SEQ ID NO: 2255677 - DNA, 19 bp, Homo sapiens
tctaggagggagacactgg

SEQ ID NO: 2255678 - DNA, 16 bp, Homo sapiens
tctagtacttattaca

SEQ ID NO: 2255679 - DNA, 14 bp, Homo sapiens
tctagttcattgaa

SEQ ID NO: 2255680 - DNA, 19 bp, Homo sapiens
tctataaaatagatataaa

SEQ ID NO: 2255681 - DNA, 12 bp, Homo sapiens
tctatataaaat

SEQ ID NO: 2255682 - DNA, 23 bp, Homo sapiens
tctatataaaataactaaaatgt

SEQ ID NO: 2255683 - DNA, 15 bp, Homo sapiens
tctatctatttgagg

SEQ ID NO: 2255684 - DNA, 18 bp, Homo sapiens
tctatgattgtactttga

SEQ ID NO: 2255685 - DNA, 20 bp, Homo sapiens
tctatgattgtactttgaat

SEQ ID NO: 2255686 - DNA, 15 bp, Homo sapiens
tctatttaattgaaa

SEQ ID NO: 2255687 - DNA, 13 bp, Homo sapiens
tctatttatgttt

SEQ ID NO: 2255688 - DNA, 15 bp, Homo sapiens
tctatttatgtttgc

SEQ ID NO: 2255689 - DNA, 12 bp, Homo sapiens
tctattttaaga

SEQ ID NO: 2255690 - DNA, 12 bp, Homo sapiens
tctcacctcagc

SEQ ID NO: 2255691 - DNA, 18 bp, Homo sapiens
tctcactaaagcatgaaa

SEQ ID NO: 2255692 - DNA, 12 bp, Homo sapiens
tctcactcacca

SEQ ID NO: 2255693 - DNA, 14 bp, Homo sapiens
tctcactgcttgaa

SEQ ID NO: 2255694 - DNA, 18 bp, Homo sapiens
tctcactgcttgaactag

SEQ ID NO: 2255695 - DNA, 19 bp, Homo sapiens
tctcagatgttaaaataaa

SEQ ID NO: 2255696 - DNA, 14 bp, Homo sapiens
tctcagatttctga

SEQ ID NO: 2255697 - DNA, 18 bp, Homo sapiens
tctcagatttctgaggaa

SEQ ID NO: 2255698 - DNA, 15 bp, Homo sapiens
tctcagcctctgcca

SEQ ID NO: 2255699 - DNA, 19 bp, Homo sapiens
tctcagcctctgccagcgc

SEQ ID NO: 2255700 - DNA, 15 bp, Homo sapiens
tctcagtggtgcagg

SEQ ID NO: 2255701 - DNA, 18 bp, Homo sapiens
tctcagtgttgagccttt

SEQ ID NO: 2255702 - DNA, 17 bp, Homo sapiens
tctcagtttgtgtgtct

SEQ ID NO: 2255703 - DNA, 23 bp, Homo sapiens
tctcattaatactctttatttat

SEQ ID NO: 2255704 - DNA, 16 bp, Homo sapiens
tctcatttaagggaaa

SEQ ID NO: 2255705 - DNA, 21 bp, Homo sapiens
tctccaaaaaaaaaaaaaata

SEQ ID NO: 2255706 - DNA, 15 bp, Homo sapiens
tctccagatgtttcc

SEQ ID NO: 2255707 - DNA, 19 bp, Homo sapiens
tctccagctgggctctgca

SEQ ID NO: 2255708 - DNA, 20 bp, Homo sapiens
tctcccggaggttgggtggg

SEQ ID NO: 2255709 - DNA, 15 bp, Homo sapiens
tctccgggtgtggcc

SEQ ID NO: 2255710 - DNA, 19 bp, Homo sapiens
tctcctatatatttctatt

SEQ ID NO: 2255711 - DNA, 23 bp, Homo sapiens
tctcctatatatttctattatta

SEQ ID NO: 2255712 - DNA, 15 bp, Homo sapiens
tctcctgacccctgc

SEQ ID NO: 2255713 - DNA, 16 bp, Homo sapiens
tctccttggccacaga

SEQ ID NO: 2255714 - DNA, 17 bp, Homo sapiens
tctccttttcctctctc

SEQ ID NO: 2255715 - DNA, 19 bp, Homo sapiens
tctccttttcctctctccc

SEQ ID NO: 2255716 - DNA, 21 bp, Homo sapiens
tctcggctccccatgtgtcct

SEQ ID NO: 2255717 - DNA, 21 bp, Homo sapiens
tctcgggtgcatttgagagaa

SEQ ID NO: 2255718 - DNA, 14 bp, Homo sapiens
tctcggtgacctcc

SEQ ID NO: 2255719 - DNA, 15 bp, Homo sapiens
tctctcggctcccca

SEQ ID NO: 2255720 - DNA, 13 bp, Homo sapiens
tctctctctctct

SEQ ID NO: 2255721 - DNA, 18 bp, Homo sapiens
tctctctggggccctggg

SEQ ID NO: 2255722 - DNA, 19 bp, Homo sapiens
tctctctggggccctgggc

SEQ ID NO: 2255723 - DNA, 19 bp, Homo sapiens
tctctctgtgtctttctct

SEQ ID NO: 2255724 - DNA, 18 bp, Homo sapiens
tctctgctagatttctac

SEQ ID NO: 2255725 - DNA, 23 bp, Homo sapiens
tctctgctagatttctacattaa

SEQ ID NO: 2255726 - DNA, 20 bp, Homo sapiens
tctctggggccctgggcctc

SEQ ID NO: 2255727 - DNA, 13 bp, Homo sapiens
tctctgtgagaag

SEQ ID NO: 2255728 - DNA, 19 bp, Homo sapiens
tctctgtgagaaggtttat

SEQ ID NO: 2255729 - DNA, 17 bp, Homo sapiens
tctctgtgtctttctct

SEQ ID NO: 2255730 - DNA, 16 bp, Homo sapiens
tctcttcattcaaact

SEQ ID NO: 2255731 - DNA, 20 bp, Homo sapiens
tctcttccttttatcagtag

SEQ ID NO: 2255732 - DNA, 12 bp, Homo sapiens
tctcttttcatt

SEQ ID NO: 2255733 - DNA, 22 bp, Homo sapiens
tctcttttccactccattgtcg

SEQ ID NO: 2255734 - DNA, 20 bp, Homo sapiens
tctgaaatgttacaaaaata

SEQ ID NO: 2255735 - DNA, 20 bp, Homo sapiens
tctgacagtccacaggggcc

SEQ ID NO: 2255736 - DNA, 15 bp, Homo sapiens
tctgagcctgatatt

SEQ ID NO: 2255737 - DNA, 14 bp, Homo sapiens
tctgaggacaagag

SEQ ID NO: 2255738 - DNA, 18 bp, Homo sapiens
tctgaggacaagagaaaa

SEQ ID NO: 2255739 - DNA, 21 bp, Homo sapiens
tctgaggtgcctgtcccaccc

SEQ ID NO: 2255740 - DNA, 19 bp, Homo sapiens
tctgcaaaaatatttataa

SEQ ID NO: 2255741 - DNA, 16 bp, Homo sapiens
tctgcaattcccctct

SEQ ID NO: 2255742 - DNA, 21 bp, Homo sapiens
taaacacaggggacacagctt

SEQ ID NO: 2255743 - DNA, 19 bp, Homo sapiens
taaacagtggctcataaaa

SEQ ID NO: 2255744 - DNA, 18 bp, Homo sapiens
taaaccatttttgttact

SEQ ID NO: 2255745 - DNA, 16 bp, Homo sapiens
taaaccctcagagcct

SEQ ID NO: 2255746 - DNA, 19 bp, Homo sapiens
taaacctgtagaatcaatt

SEQ ID NO: 2255747 - DNA, 22 bp, Homo sapiens
taaactataaaacaaaaatttg

SEQ ID NO: 2255748 - DNA, 20 bp, Homo sapiens
taaagactggcttttattaa

SEQ ID NO: 2255749 - DNA, 20 bp, Homo sapiens
taaagaggaaaagtgcaatg

SEQ ID NO: 2255750 - DNA, 23 bp, Homo sapiens
taaagatttatacagttgaaaac

SEQ ID NO: 2255751 - DNA, 20 bp, Homo sapiens
taaagcatgaaatgtgaatt

SEQ ID NO: 2255752 - DNA, 21 bp, Homo sapiens
taaagcatgaaatgtgaattt

SEQ ID NO: 2255753 - DNA, 14 bp, Homo sapiens
taaagtattcttct

SEQ ID NO: 2255754 - DNA, 21 bp, Homo sapiens
taaagtctgttgattaaagat

SEQ ID NO: 2255755 - DNA, 16 bp, Homo sapiens
taaagttacactttta

SEQ ID NO: 2255756 - DNA, 20 bp, Homo sapiens
taaagttggtattaataaaa

SEQ ID NO: 2255757 - DNA, 16 bp, Homo sapiens
taaagttgtttcccac

SEQ ID NO: 2255758 - DNA, 14 bp, Homo sapiens
taaagtttgcttag

SEQ ID NO: 2255759 - DNA, 17 bp, Homo sapiens
taaagtttgcttagaaa

SEQ ID NO: 2255760 - DNA, 20 bp, Homo sapiens
taaataaaatttgttgcata

SEQ ID NO: 2255761 - DNA, 12 bp, Homo sapiens
taaataacactt

SEQ ID NO: 2255762 - DNA, 14 bp, Homo sapiens
taaataacacttgt

SEQ ID NO: 2255763 - DNA, 15 bp, Homo sapiens
taaataagcaaataa

SEQ ID NO: 2255764 - DNA, 18 bp, Homo sapiens
taaataagcaaataaaca

SEQ ID NO: 2255765 - DNA, 18 bp, Homo sapiens
taaataatgtatttactt

SEQ ID NO: 2255766 - DNA, 14 bp, Homo sapiens
taaatattttctat

SEQ ID NO: 2255767 - DNA, 19 bp, Homo sapiens
taaatgcaaccatttgaaa

SEQ ID NO: 2255768 - DNA, 18 bp, Homo sapiens
taaatgcaatattcttga

SEQ ID NO: 2255769 - DNA, 19 bp, Homo sapiens
taaatgctgttcttacaca

SEQ ID NO: 2255770 - DNA, 14 bp, Homo sapiens
taaatgtaaactca

SEQ ID NO: 2255771 - DNA, 15 bp, Homo sapiens
taaatgtaaactcag

SEQ ID NO: 2255772 - DNA, 16 bp, Homo sapiens
taaatgtaaactcagc

SEQ ID NO: 2255773 - DNA, 14 bp, Homo sapiens
taaattaatatctt

SEQ ID NO: 2255774 - DNA, 17 bp, Homo sapiens
taaattaatatctttct

SEQ ID NO: 2255775 - DNA, 17 bp, Homo sapiens
taaattacaattttatc

SEQ ID NO: 2255776 - DNA, 20 bp, Homo sapiens
taaattcctcaacagtgttt

SEQ ID NO: 2255777 - DNA, 22 bp, Homo sapiens
taaattcctcaacagtgttttc

SEQ ID NO: 2255778 - DNA, 13 bp, Homo sapiens
taaatttttaaga

SEQ ID NO: 2255779 - DNA, 15 bp, Homo sapiens
taacaaaatgtatgt

SEQ ID NO: 2255780 - DNA, 20 bp, Homo sapiens
taacaaaatgtatgtctggt

SEQ ID NO: 2255781 - DNA, 15 bp, Homo sapiens
taacaatgcaacttt

SEQ ID NO: 2255782 - DNA, 16 bp, Homo sapiens
taacaatttattctga

SEQ ID NO: 2255783 - DNA, 22 bp, Homo sapiens
taacactctaggatgtatattt

SEQ ID NO: 2255784 - DNA, 16 bp, Homo sapiens
taacactgtgtacacc

SEQ ID NO: 2255785 - DNA, 15 bp, Homo sapiens
taacagcctctgtga

SEQ ID NO: 2255786 - DNA, 12 bp, Homo sapiens
taacagttttag

SEQ ID NO: 2255787 - DNA, 12 bp, Homo sapiens
taacataaattt

SEQ ID NO: 2255788 - DNA, 18 bp, Homo sapiens
taacatgaggggacattt

SEQ ID NO: 2255789 - DNA, 17 bp, Homo sapiens
taacctctgcttttatc

SEQ ID NO: 2255790 - DNA, 12 bp, Homo sapiens
taactaaaataa

SEQ ID NO: 2255791 - DNA, 16 bp, Homo sapiens
taactaaaatgtatct

SEQ ID NO: 2255792 - DNA, 17 bp, Homo sapiens
taactaaaatgtatcta

SEQ ID NO: 2255793 - DNA, 14 bp, Homo sapiens
taactgtaaatcat

SEQ ID NO: 2255794 - DNA, 18 bp, Homo sapiens
taactgtgcgttaaataa

SEQ ID NO: 2255795 - DNA, 18 bp, Homo sapiens
taacttcaaatatagaga

SEQ ID NO: 2255796 - DNA, 17 bp, Homo sapiens
taactttattctttgtt

SEQ ID NO: 2255797 - DNA, 11 bp, Homo sapiens
taacttttaat

SEQ ID NO: 2255798 - DNA, 17 bp, Homo sapiens
taacttttaatggtgat

SEQ ID NO: 2255799 - DNA, 15 bp, Homo sapiens
taactttttatttct

SEQ ID NO: 2255800 - DNA, 12 bp, Homo sapiens
taagaaaagatt

SEQ ID NO: 2255801 - DNA, 13 bp, Homo sapiens
taagaataataaa

SEQ ID NO: 2255802 - DNA, 14 bp, Homo sapiens
taagaataataaaa

SEQ ID NO: 2255803 - DNA, 14 bp, Homo sapiens
taagaattcaaact

SEQ ID NO: 2255804 - DNA, 13 bp, Homo sapiens
taagacgtgaatg

SEQ ID NO: 2255805 - DNA, 22 bp, Homo sapiens
taagatatttgcagtttttcat

SEQ ID NO: 2255806 - DNA, 12 bp, Homo sapiens
taagatgtgaaa

SEQ ID NO: 2255807 - DNA, 14 bp, Homo sapiens
taagatgtgaaaat

SEQ ID NO: 2255808 - DNA, 16 bp, Homo sapiens
taagatgtgaaaatta

SEQ ID NO: 2255809 - DNA, 23 bp, Homo sapiens
taagattgatatctataaaatag

SEQ ID NO: 2255810 - DNA, 17 bp, Homo sapiens
taagcagcttattgttt

SEQ ID NO: 2255811 - DNA, 16 bp, Homo sapiens
tcagtaccctctcagc

SEQ ID NO: 2255812 - DNA, 19 bp, Homo sapiens
tcagtaccctctcagctcc

SEQ ID NO: 2255813 - DNA, 17 bp, Homo sapiens
tcagtataaacaaagtt

SEQ ID NO: 2255814 - DNA, 16 bp, Homo sapiens
tcagtgcatttgtgct

SEQ ID NO: 2255815 - DNA, 17 bp, Homo sapiens
tcagtgggttaacatca

SEQ ID NO: 2255816 - DNA, 20 bp, Homo sapiens
tcagtgggttaacatcagtt

SEQ ID NO: 2255817 - DNA, 20 bp, Homo sapiens
tcagttatacagttataaaa

SEQ ID NO: 2255818 - DNA, 15 bp, Homo sapiens
tcagtttgtgtgtct

SEQ ID NO: 2255819 - DNA, 16 bp, Homo sapiens
tcataatttgtttcca

SEQ ID NO: 2255820 - DNA, 19 bp, Homo sapiens
tcataatttgtttccagca

SEQ ID NO: 2255821 - DNA, 17 bp, Homo sapiens
tcatagaaaattgaaac

SEQ ID NO: 2255822 - DNA, 14 bp, Homo sapiens
tcatagttactgtg

SEQ ID NO: 2255823 - DNA, 20 bp, Homo sapiens
tcatagttactgtgtaaact

SEQ ID NO: 2255824 - DNA, 19 bp, Homo sapiens
tcatatcttaatatatttc

SEQ ID NO: 2255825 - DNA, 20 bp, Homo sapiens
tcatattttaaacagaggat

SEQ ID NO: 2255826 - DNA, 20 bp, Homo sapiens
tcatccaccccatccctccc

SEQ ID NO: 2255827 - DNA, 21 bp, Homo sapiens
tcatccagtttgttctccggg

SEQ ID NO: 2255828 - DNA, 23 bp, Homo sapiens
tcatcggaggctgggcccctggg

SEQ ID NO: 2255829 - DNA, 14 bp, Homo sapiens
tcatctcatttaag

SEQ ID NO: 2255830 - DNA, 20 bp, Homo sapiens
tcatctcatttaagggaaaa

SEQ ID NO: 2255831 - DNA, 21 bp, Homo sapiens
tcatctcatttaagggaaaaa

SEQ ID NO: 2255832 - DNA, 18 bp, Homo sapiens
tcatctgcagttcttttt

SEQ ID NO: 2255833 - DNA, 14 bp, Homo sapiens
tcatggcccctctg

SEQ ID NO: 2255834 - DNA, 13 bp, Homo sapiens
tcatgtacttttt

SEQ ID NO: 2255835 - DNA, 22 bp, Homo sapiens
tcatgtactttttagtaatttc

SEQ ID NO: 2255836 - DNA, 21 bp, Homo sapiens
tcatgttaacctctgctttta

SEQ ID NO: 2255837 - DNA, 19 bp, Homo sapiens
tcatgttgatcatgtactt

SEQ ID NO: 2255838 - DNA, 21 bp, Homo sapiens
tcatgttgatcatgtactttt

SEQ ID NO: 2255839 - DNA, 14 bp, Homo sapiens
tcattcaaactgca

SEQ ID NO: 2255840 - DNA, 22 bp, Homo sapiens
tcattcaagtgtaaaatatttt

SEQ ID NO: 2255841 - DNA, 19 bp, Homo sapiens
tcattcagcagcaaatttt

SEQ ID NO: 2255842 - DNA, 23 bp, Homo sapiens
tcattcagcagcaaattttcagc

SEQ ID NO: 2255843 - DNA, 18 bp, Homo sapiens
tcattctactaatgtgat

SEQ ID NO: 2255844 - DNA, 20 bp, Homo sapiens
tcattgtgtatcagtttcca

SEQ ID NO: 2255845 - DNA, 20 bp, Homo sapiens
tcattgtgttacctgtagat

SEQ ID NO: 2255846 - DNA, 14 bp, Homo sapiens
tcatttaagggaaa

SEQ ID NO: 2255847 - DNA, 15 bp, Homo sapiens
tcatttcatctcatt

SEQ ID NO: 2255848 - DNA, 20 bp, Homo sapiens
tcatttcatctcatttaagg

SEQ ID NO: 2255849 - DNA, 14 bp, Homo sapiens
tcatttgctttgga

SEQ ID NO: 2255850 - DNA, 12 bp, Homo sapiens
tcatttgtttac

SEQ ID NO: 2255851 - DNA, 16 bp, Homo sapiens
tcatttgttttttcaa

SEQ ID NO: 2255852 - DNA, 14 bp, Homo sapiens
tcattttgaaattg

SEQ ID NO: 2255853 - DNA, 13 bp, Homo sapiens
tcatttttcaaaa

SEQ ID NO: 2255854 - DNA, 19 bp, Homo sapiens
tcatttttcatactgaaaa

SEQ ID NO: 2255855 - DNA, 18 bp, Homo sapiens
tccaaaaaaaaaaaaaat

SEQ ID NO: 2255856 - DNA, 17 bp, Homo sapiens
tccaaaccaaattttaa

SEQ ID NO: 2255857 - DNA, 18 bp, Homo sapiens
tccaaacttggatttttg

SEQ ID NO: 2255858 - DNA, 15 bp, Homo sapiens
tccaaagaggctgcc

SEQ ID NO: 2255859 - DNA, 19 bp, Homo sapiens
tccaaagaggctgcccctc

SEQ ID NO: 2255860 - DNA, 17 bp, Homo sapiens
tccaaattatttcttaa

SEQ ID NO: 2255861 - DNA, 17 bp, Homo sapiens
tccaacagaagaactgt

SEQ ID NO: 2255862 - DNA, 12 bp, Homo sapiens
tccacagagagg

SEQ ID NO: 2255863 - DNA, 19 bp, Homo sapiens
tccaccaaatgtgctttga

SEQ ID NO: 2255864 - DNA, 16 bp, Homo sapiens
tgaccttaaatgcaac

SEQ ID NO: 2255865 - DNA, 18 bp, Homo sapiens
tgactaattttacatgtt

SEQ ID NO: 2255866 - DNA, 15 bp, Homo sapiens
tgactatgtattttt

SEQ ID NO: 2255867 - DNA, 14 bp, Homo sapiens
tgactgtaatattt

SEQ ID NO: 2255868 - DNA, 16 bp, Homo sapiens
tgactgtcccaccggg

SEQ ID NO: 2255869 - DNA, 21 bp, Homo sapiens
tgacttgcaaagacctacctc

SEQ ID NO: 2255870 - DNA, 20 bp, Homo sapiens
tgactttctccctgttcctt

SEQ ID NO: 2255871 - DNA, 16 bp, Homo sapiens
tgagaaccttttcaaa

SEQ ID NO: 2255872 - DNA, 17 bp, Homo sapiens
tgagaaccttttcaaac

SEQ ID NO: 2255873 - DNA, 12 bp, Homo sapiens
tgagaagctctg

SEQ ID NO: 2255874 - DNA, 14 bp, Homo sapiens
tgagaagctgaggc

SEQ ID NO: 2255875 - DNA, 17 bp, Homo sapiens
tgagaaggtttattgtt

SEQ ID NO: 2255876 - DNA, 17 bp, Homo sapiens
tgagagaagccacgctg

SEQ ID NO: 2255877 - DNA, 16 bp, Homo sapiens
tgagcctctgctcccc

SEQ ID NO: 2255878 - DNA, 24 bp, Homo sapiens
tgagcttgtcttttctgctgagga

SEQ ID NO: 2255879 - DNA, 17 bp, Homo sapiens
tgaggacgagaccccca

SEQ ID NO: 2255880 - DNA, 20 bp, Homo sapiens
tgaggacgagacccccatcc

SEQ ID NO: 2255881 - DNA, 11 bp, Homo sapiens
tgaggagcccc

SEQ ID NO: 2255882 - DNA, 14 bp, Homo sapiens
tgaggagccccagc

SEQ ID NO: 2255883 - DNA, 16 bp, Homo sapiens
tgaggtattttttcct

SEQ ID NO: 2255884 - DNA, 17 bp, Homo sapiens
tgagtgaacctgtataa

SEQ ID NO: 2255885 - DNA, 16 bp, Homo sapiens
tgagtgtacagatttt

SEQ ID NO: 2255886 - DNA, 20 bp, Homo sapiens
tgagtgtcttctaactttat

SEQ ID NO: 2255887 - DNA, 17 bp, Homo sapiens
tgagttcaccatctctt

SEQ ID NO: 2255888 - DNA, 20 bp, Homo sapiens
tgatacaagagtcagcatca

SEQ ID NO: 2255889 - DNA, 14 bp, Homo sapiens
tgataccagctgga

SEQ ID NO: 2255890 - DNA, 14 bp, Homo sapiens
tgatagttgaatgt

SEQ ID NO: 2255891 - DNA, 17 bp, Homo sapiens
tgatattacatttattt

SEQ ID NO: 2255892 - DNA, 22 bp, Homo sapiens
tgatattacatttatttatcca

SEQ ID NO: 2255893 - DNA, 19 bp, Homo sapiens
tgatcaccgactgaaaata

SEQ ID NO: 2255894 - DNA, 17 bp, Homo sapiens
tgatcatgtacttttta

SEQ ID NO: 2255895 - DNA, 19 bp, Homo sapiens
tgatcatgtactttttagt

SEQ ID NO: 2255896 - DNA, 13 bp, Homo sapiens
tgatcccaccccc

SEQ ID NO: 2255897 - DNA, 14 bp, Homo sapiens
tgatcccaccccct

SEQ ID NO: 2255898 - DNA, 22 bp, Homo sapiens
tgatcccaccccctcctccccc

SEQ ID NO: 2255899 - DNA, 15 bp, Homo sapiens
tgatcgaaaaaataa

SEQ ID NO: 2255900 - DNA, 14 bp, Homo sapiens
tgatctctccacgg

SEQ ID NO: 2255901 - DNA, 22 bp, Homo sapiens
tgatctgtatttaatggttttt

SEQ ID NO: 2255902 - DNA, 14 bp, Homo sapiens
tgatctgtctgtgg

SEQ ID NO: 2255903 - DNA, 19 bp, Homo sapiens
tgatgaaaactaaggattt

SEQ ID NO: 2255904 - DNA, 20 bp, Homo sapiens
tgatgaaaactaaggatttt

SEQ ID NO: 2255905 - DNA, 18 bp, Homo sapiens
tgatgacaaaaaatgttt

SEQ ID NO: 2255906 - DNA, 15 bp, Homo sapiens
tgatgatgaaaacta

SEQ ID NO: 2255907 - DNA, 13 bp, Homo sapiens
tgatgcatgtctt

SEQ ID NO: 2255908 - DNA, 19 bp, Homo sapiens
tgatgggggacgagggcca

SEQ ID NO: 2255909 - DNA, 23 bp, Homo sapiens
tgatgggggacgagggccaggca

SEQ ID NO: 2255910 - DNA, 22 bp, Homo sapiens
tgattaaagatgagctttgtct

SEQ ID NO: 2255911 - DNA, 13 bp, Homo sapiens
tgattactgtcaa

SEQ ID NO: 2255912 - DNA, 16 bp, Homo sapiens
tgattatttattattt

SEQ ID NO: 2255913 - DNA, 19 bp, Homo sapiens
tgattctaatcatctgcag

SEQ ID NO: 2255914 - DNA, 15 bp, Homo sapiens
tgattgtactttgaa

SEQ ID NO: 2255915 - DNA, 15 bp, Homo sapiens
tgatttccatctctg

SEQ ID NO: 2255916 - DNA, 13 bp, Homo sapiens
tgatttggtgacc

SEQ ID NO: 2255917 - DNA, 15 bp, Homo sapiens
tgcaaaaagaaaaaa

SEQ ID NO: 2255918 - DNA, 17 bp, Homo sapiens
tgcaaaaagaaaaaaag

SEQ ID NO: 2255919 - DNA, 19 bp, Homo sapiens
tgcaaaaagaaaaaaagaa

SEQ ID NO: 2255920 - DNA, 23 bp, Homo sapiens
tgcaaaaatatttataaaacttc

SEQ ID NO: 2255921 - DNA, 22 bp, Homo sapiens
tgcaaacaagaaacgtgtcaca

SEQ ID NO: 2255922 - DNA, 23 bp, Homo sapiens
tgcaaacaagaaacgtgtcacac

SEQ ID NO: 2255923 - DNA, 17 bp, Homo sapiens
tgcaaagacctacctcc

SEQ ID NO: 2255924 - DNA, 20 bp, Homo sapiens
tgcaaagacctacctccaga

SEQ ID NO: 2255925 - DNA, 19 bp, Homo sapiens
tgcaaagtgccttgctcat

SEQ ID NO: 2255926 - DNA, 22 bp, Homo sapiens
tgcaactttagtttgtgttatt

SEQ ID NO: 2255927 - DNA, 18 bp, Homo sapiens
tgcaagaccacggaggga

SEQ ID NO: 2255928 - DNA, 23 bp, Homo sapiens
tgcaatcaaaaatatgtgttttt

SEQ ID NO: 2255929 - DNA, 15 bp, Homo sapiens
tgcaatgtgaaaaat

SEQ ID NO: 2255930 - DNA, 23 bp, Homo sapiens
tgcaatgtggtgacacctccccc

SEQ ID NO: 2255931 - DNA, 13 bp, Homo sapiens
tgcaattcccctc

SEQ ID NO: 2255932 - DNA, 14 bp, Homo sapiens
tgcaattcccctct

SEQ ID NO: 2255933 - DNA, 16 bp, Homo sapiens
tgcacaccaccctccc

SEQ ID NO: 2255934 - DNA, 22 bp, Homo sapiens
tgcacaccaccctcccgctgca

SEQ ID NO: 2255935 - DNA, 20 bp, Homo sapiens
tgcacaccctccagagacaa

SEQ ID NO: 2255936 - DNA, 20 bp, Homo sapiens
tgcacacctactagtcacca

SEQ ID NO: 2255937 - DNA, 14 bp, Homo sapiens
tggcaccagatgca

SEQ ID NO: 2255938 - DNA, 15 bp, Homo sapiens
tggcaggagggcagt

SEQ ID NO: 2255939 - DNA, 14 bp, Homo sapiens
tggcaggatgctga

SEQ ID NO: 2255940 - DNA, 20 bp, Homo sapiens
tggcaggcacacagcagccc

SEQ ID NO: 2255941 - DNA, 23 bp, Homo sapiens
tggcaggcacacagcagcccccc

SEQ ID NO: 2255942 - DNA, 19 bp, Homo sapiens
tggccagacgctgccgctg

SEQ ID NO: 2255943 - DNA, 14 bp, Homo sapiens
tggccagcaccctc

SEQ ID NO: 2255944 - DNA, 18 bp, Homo sapiens
tggccagcaccctctcct

SEQ ID NO: 2255945 - DNA, 16 bp, Homo sapiens
tggccagctcataaaa

SEQ ID NO: 2255946 - DNA, 18 bp, Homo sapiens
tggccagctcataaaatg

SEQ ID NO: 2255947 - DNA, 11 bp, Homo sapiens
tggccaggagc

SEQ ID NO: 2255948 - DNA, 13 bp, Homo sapiens
tggccatccctgg

SEQ ID NO: 2255949 - DNA, 15 bp, Homo sapiens
tggccatccctgggc

SEQ ID NO: 2255950 - DNA, 17 bp, Homo sapiens
tggccatccctgggccc

SEQ ID NO: 2255951 - DNA, 21 bp, Homo sapiens
tggccatccctgggcccctcc

SEQ ID NO: 2255952 - DNA, 21 bp, Homo sapiens
tggccccagccctgctgggga

SEQ ID NO: 2255953 - DNA, 14 bp, Homo sapiens
tggcccctctgacc

SEQ ID NO: 2255954 - DNA, 19 bp, Homo sapiens
tggccctggggatcttccc

SEQ ID NO: 2255955 - DNA, 13 bp, Homo sapiens
tggccgccccctg

SEQ ID NO: 2255956 - DNA, 17 bp, Homo sapiens
tggccgccccctgcccc

SEQ ID NO: 2255957 - DNA, 19 bp, Homo sapiens
tggcctatgtggtctaagg

SEQ ID NO: 2255958 - DNA, 17 bp, Homo sapiens
tggcctcagccctcaga

SEQ ID NO: 2255959 - DNA, 18 bp, Homo sapiens
tggccttgtaagaccctt

SEQ ID NO: 2255960 - DNA, 23 bp, Homo sapiens
tggccttgtaagacccttattgc

SEQ ID NO: 2255961 - DNA, 11 bp, Homo sapiens
tggctcataaa

SEQ ID NO: 2255962 - DNA, 16 bp, Homo sapiens
tggctctgccccctcc

SEQ ID NO: 2255963 - DNA, 23 bp, Homo sapiens
tggctcttgatacccccctctgt

SEQ ID NO: 2255964 - DNA, 18 bp, Homo sapiens
tggctggtagcagcaggc

SEQ ID NO: 2255965 - DNA, 20 bp, Homo sapiens
tggcttcggacaaaatatct

SEQ ID NO: 2255966 - DNA, 22 bp, Homo sapiens
tggctttcagagccagcctggc

SEQ ID NO: 2255967 - DNA, 14 bp, Homo sapiens
tggctttgtcactt

SEQ ID NO: 2255968 - DNA, 14 bp, Homo sapiens
tgggaatgggagag

SEQ ID NO: 2255969 - DNA, 15 bp, Homo sapiens
tgggaatgggagagg

SEQ ID NO: 2255970 - DNA, 11 bp, Homo sapiens
tgggacagagg

SEQ ID NO: 2255971 - DNA, 18 bp, Homo sapiens
tgggacagaggagcaagg

SEQ ID NO: 2255972 - DNA, 18 bp, Homo sapiens
tgggaccagggatggggg

SEQ ID NO: 2255973 - DNA, 17 bp, Homo sapiens
tgggattcaggaatgtg

SEQ ID NO: 2255974 - DNA, 22 bp, Homo sapiens
tgggcagcaccctcccccgcag

SEQ ID NO: 2255975 - DNA, 21 bp, Homo sapiens
tgggcagccagaccagcaggc

SEQ ID NO: 2255976 - DNA, 23 bp, Homo sapiens
tgggcatttggtgagagtcaaag

SEQ ID NO: 2255977 - DNA, 18 bp, Homo sapiens
tgggcccctccacgcctc

SEQ ID NO: 2255978 - DNA, 14 bp, Homo sapiens
tgggctgtctgtca

SEQ ID NO: 2255979 - DNA, 19 bp, Homo sapiens
tgggctgtctgtcaccagc

SEQ ID NO: 2255980 - DNA, 22 bp, Homo sapiens
tgggctgtgtcctaaggcccat

SEQ ID NO: 2255981 - DNA, 21 bp, Homo sapiens
tggggagcccgtctcagtgtt

SEQ ID NO: 2255982 - DNA, 12 bp, Homo sapiens
tggggaggacaa

SEQ ID NO: 2255983 - DNA, 14 bp, Homo sapiens
tggggcaggctggg

SEQ ID NO: 2255984 - DNA, 18 bp, Homo sapiens
tggggccctgggcctcag

SEQ ID NO: 2255985 - DNA, 14 bp, Homo sapiens
tgggggtggcaggc

SEQ ID NO: 2255986 - DNA, 23 bp, Homo sapiens
tgggggtggccatccctgggccc

SEQ ID NO: 2255987 - DNA, 20 bp, Homo sapiens
tggggtcctggagcagacca

SEQ ID NO: 2255988 - DNA, 9 bp, Homo sapiens
tggggtggg

SEQ ID NO: 2255989 - DNA, 15 bp, Homo sapiens
tggggtggggagaaa

SEQ ID NO: 2255990 - DNA, 19 bp, Homo sapiens
tggggttatctctgtgtta

SEQ ID NO: 2255991 - DNA, 12 bp, Homo sapiens
tgggtgagagag

SEQ ID NO: 2255992 - DNA, 15 bp, Homo sapiens
tgggtgagagaggaa

SEQ ID NO: 2255993 - DNA, 14 bp, Homo sapiens
tgggtggtaccctc

SEQ ID NO: 2255994 - DNA, 18 bp, Homo sapiens
tgggtggtaccctctgga

SEQ ID NO: 2255995 - DNA, 14 bp, Homo sapiens
tgggttaagtatta

SEQ ID NO: 2255996 - DNA, 17 bp, Homo sapiens
tggtaaagttacacttt

SEQ ID NO: 2255997 - DNA, 16 bp, Homo sapiens
tggtatcaaaattaca

SEQ ID NO: 2255998 - DNA, 22 bp, Homo sapiens
tggtatgctggccagcaccctc

SEQ ID NO: 2255999 - DNA, 22 bp, Homo sapiens
tggtcacaacttgatggctgcg

SEQ ID NO: 2256000 - DNA, 15 bp, Homo sapiens
tggtctcccttctct

SEQ ID NO: 2256001 - DNA, 14 bp, Homo sapiens
tggtcttttggtta

SEQ ID NO: 2256002 - DNA, 15 bp, Homo sapiens
tggtgactgtcccac

SEQ ID NO: 2256003 - DNA, 17 bp, Homo sapiens
tggtgagagtcaaagct

SEQ ID NO: 2256004 - DNA, 14 bp, Homo sapiens
tggtgcatgggctc

SEQ ID NO: 2256005 - DNA, 23 bp, Homo sapiens
tggtgcttctcagatttctgagg

SEQ ID NO: 2256006 - DNA, 17 bp, Homo sapiens
tggtgctttttataaaa

SEQ ID NO: 2256007 - DNA, 16 bp, Homo sapiens
tggtggcaccagatgc

SEQ ID NO: 2256008 - DNA, 18 bp, Homo sapiens
tggtgtaaggtactttca

SEQ ID NO: 2256009 - DNA, 17 bp, Homo sapiens
tggttatgaatactttg

SEQ ID NO: 2256010 - DNA, 21 bp, Homo sapiens
tggttccgcccactcattcct

SEQ ID NO: 2256011 - DNA, 12 bp, Homo sapiens
tggttctggcca

SEQ ID NO: 2256012 - DNA, 22 bp, Homo sapiens
tggtttggtgctttttataaaa

SEQ ID NO: 2256013 - DNA, 12 bp, Homo sapiens
tgtaaaagacat

SEQ ID NO: 2256014 - DNA, 22 bp, Homo sapiens
tgtaaatactggtgcacttctt

SEQ ID NO: 2256015 - DNA, 18 bp, Homo sapiens
tgtaaataggatttttag

SEQ ID NO: 2256016 - DNA, 14 bp, Homo sapiens
tgtaaatgtaaact

SEQ ID NO: 2256017 - DNA, 15 bp, Homo sapiens
tgtaaatgtaaactc

SEQ ID NO: 2256018 - DNA, 22 bp, Homo sapiens
tgtaaattgaatcagtataaac

SEQ ID NO: 2256019 - DNA, 13 bp, Homo sapiens
tgtaacactgtgt

SEQ ID NO: 2256020 - DNA, 19 bp, Homo sapiens
tgtaacactgtgtacacct

SEQ ID NO: 2256021 - DNA, 13 bp, Homo sapiens
tgtaacttcaaat

SEQ ID NO: 2256022 - DNA, 15 bp, Homo sapiens
tgtaagaaatacaga

SEQ ID NO: 2256023 - DNA, 20 bp, Homo sapiens
tgtaagcatactttgtaaat

SEQ ID NO: 2256024 - DNA, 23 bp, Homo sapiens
tgtaatgtatcaaatacatttaa

SEQ ID NO: 2256025 - DNA, 16 bp, Homo sapiens
tgtaattttatatgaa

SEQ ID NO: 2256026 - DNA, 15 bp, Homo sapiens
tgtaattttgtgtaa

SEQ ID NO: 2256027 - DNA, 16 bp, Homo sapiens
tgtaattttgtgtaag

SEQ ID NO: 2256028 - DNA, 12 bp, Homo sapiens
tgtacaatcaaa

SEQ ID NO: 2256029 - DNA, 19 bp, Homo sapiens
tgtacaatcaaaacacact

SEQ ID NO: 2256030 - DNA, 17 bp, Homo sapiens
tgtacacatatttgaag

SEQ ID NO: 2256031 - DNA, 16 bp, Homo sapiens
tgtacacctcaaatac

SEQ ID NO: 2256032 - DNA, 19 bp, Homo sapiens
tgtacatacgatttaaggt

SEQ ID NO: 2256033 - DNA, 21 bp, Homo sapiens
tgtacatacgatttaaggtat

SEQ ID NO: 2256034 - DNA, 16 bp, Homo sapiens
tgtaccaagtgaaatt

SEQ ID NO: 2256035 - DNA, 21 bp, Homo sapiens
tgtaccttttgaggagcccca

SEQ ID NO: 2256036 - DNA, 15 bp, Homo sapiens
tgtacgttatatatt

SEQ ID NO: 2256037 - DNA, 17 bp, Homo sapiens
tgtacgttatatattgt

SEQ ID NO: 2256038 - DNA, 21 bp, Homo sapiens
tgtactttttagtaatttctt

SEQ ID NO: 2256039 - DNA, 16 bp, Homo sapiens
tgtagaataggcaggg

SEQ ID NO: 2256040 - DNA, 16 bp, Homo sapiens
tgtagccccctggcct

SEQ ID NO: 2256041 - DNA, 17 bp, Homo sapiens
tgtagccccctggcctc

SEQ ID NO: 2256042 - DNA, 18 bp, Homo sapiens
tgtagtgaatcctctgtt

SEQ ID NO: 2256043 - DNA, 14 bp, Homo sapiens
tgtataaaatacat

SEQ ID NO: 2256044 - DNA, 15 bp, Homo sapiens
tgtataaattgtctt

SEQ ID NO: 2256045 - DNA, 16 bp, Homo sapiens
tgtataatataaaaaa

SEQ ID NO: 2256046 - DNA, 14 bp, Homo sapiens
tgtatataaaaatg

SEQ ID NO: 2256047 - DNA, 22 bp, Homo sapiens
gcgccaaaacaagccaaagagc

SEQ ID NO: 2256048 - DNA, 15 bp, Homo sapiens
gcgccccagtcactt

SEQ ID NO: 2256049 - DNA, 18 bp, Homo sapiens
gcgccccagtcacttcct

SEQ ID NO: 2256050 - DNA, 17 bp, Homo sapiens
gcgcctccctccacccc

SEQ ID NO: 2256051 - DNA, 23 bp, Homo sapiens
gcgcctccctccaccccaggacg

SEQ ID NO: 2256052 - DNA, 20 bp, Homo sapiens
gcgcgagggcctcaaaggcc

SEQ ID NO: 2256053 - DNA, 14 bp, Homo sapiens
gcgctcagtaaacg

SEQ ID NO: 2256054 - DNA, 15 bp, Homo sapiens
gcgctcagtaaacgg

SEQ ID NO: 2256055 - DNA, 12 bp, Homo sapiens
gcggctggagcg

SEQ ID NO: 2256056 - DNA, 20 bp, Homo sapiens
gcgggatcctccacagagag

SEQ ID NO: 2256057 - DNA, 21 bp, Homo sapiens
gcgggctccctggcaggatgc

SEQ ID NO: 2256058 - DNA, 20 bp, Homo sapiens
gctaaataaaatttgttgca

SEQ ID NO: 2256059 - DNA, 21 bp, Homo sapiens
gctaaataaaatttgttgcat

SEQ ID NO: 2256060 - DNA, 14 bp, Homo sapiens
gctaactgtaaatc

SEQ ID NO: 2256061 - DNA, 18 bp, Homo sapiens
gctacactgagcagggag

SEQ ID NO: 2256062 - DNA, 21 bp, Homo sapiens
gctaccaacttgtatccaggc

SEQ ID NO: 2256063 - DNA, 16 bp, Homo sapiens
gctaccctttttctcc

SEQ ID NO: 2256064 - DNA, 18 bp, Homo sapiens
gctaccctttttctccag

SEQ ID NO: 2256065 - DNA, 21 bp, Homo sapiens
gctaccctttttctccagctg

SEQ ID NO: 2256066 - DNA, 15 bp, Homo sapiens
gctactggattctta

SEQ ID NO: 2256067 - DNA, 22 bp, Homo sapiens
gctactgtaattttatatgaag

SEQ ID NO: 2256068 - DNA, 21 bp, Homo sapiens
gctatctgtcatctctctggg

SEQ ID NO: 2256069 - DNA, 19 bp, Homo sapiens
gctatgcgcaatgtggcat

SEQ ID NO: 2256070 - DNA, 21 bp, Homo sapiens
gctcaagcagcgaccgccccc

SEQ ID NO: 2256071 - DNA, 12 bp, Homo sapiens
gctcagcccgct

SEQ ID NO: 2256072 - DNA, 17 bp, Homo sapiens
gctcagcccgcttggcc

SEQ ID NO: 2256073 - DNA, 18 bp, Homo sapiens
gctcagcccgcttggcca

SEQ ID NO: 2256074 - DNA, 19 bp, Homo sapiens
gctcagctgtcaaggctca

SEQ ID NO: 2256075 - DNA, 18 bp, Homo sapiens
gctcagtaaacgggaaca

SEQ ID NO: 2256076 - DNA, 21 bp, Homo sapiens
gctcataaaatggaagcaatt

SEQ ID NO: 2256077 - DNA, 15 bp, Homo sapiens
gctcatgttggccaa

SEQ ID NO: 2256078 - DNA, 19 bp, Homo sapiens
gctccatagtttggcattt

SEQ ID NO: 2256079 - DNA, 19 bp, Homo sapiens
gctcctgtgtcggggctga

SEQ ID NO: 2256080 - DNA, 16 bp, Homo sapiens
gctcgccgtgtctcag

SEQ ID NO: 2256081 - DNA, 16 bp, Homo sapiens
gctctacatcttctgc

SEQ ID NO: 2256082 - DNA, 17 bp, Homo sapiens
gctctacatcttctgcc

SEQ ID NO: 2256083 - DNA, 19 bp, Homo sapiens
gctctacatcttctgcctt

SEQ ID NO: 2256084 - DNA, 17 bp, Homo sapiens
gctctgcaattcccctc

SEQ ID NO: 2256085 - DNA, 18 bp, Homo sapiens
gctctgcaattcccctct

SEQ ID NO: 2256086 - DNA, 18 bp, Homo sapiens
gctctgccccctccccca

SEQ ID NO: 2256087 - DNA, 22 bp, Homo sapiens
gctctgctcccctaaagcctca

SEQ ID NO: 2256088 - DNA, 17 bp, Homo sapiens
gctgaatgttgggactg

SEQ ID NO: 2256089 - DNA, 12 bp, Homo sapiens
gctgacttttta

SEQ ID NO: 2256090 - DNA, 13 bp, Homo sapiens
gctgagcctctgc

SEQ ID NO: 2256091 - DNA, 20 bp, Homo sapiens
gctgagcttgtcttttctgc

SEQ ID NO: 2256092 - DNA, 17 bp, Homo sapiens
gctgatttggtgaccaa

SEQ ID NO: 2256093 - DNA, 20 bp, Homo sapiens
gctgcaccacggcgtttttt

SEQ ID NO: 2256094 - DNA, 14 bp, Homo sapiens
gctgcccctctcac

SEQ ID NO: 2256095 - DNA, 16 bp, Homo sapiens
gctgccttggctcaga

SEQ ID NO: 2256096 - DNA, 20 bp, Homo sapiens
gctgcgggctccctggcagg

SEQ ID NO: 2256097 - DNA, 15 bp, Homo sapiens
gctgctgtccctccc

SEQ ID NO: 2256098 - DNA, 18 bp, Homo sapiens
gctggcagagagcacagt

SEQ ID NO: 2256099 - DNA, 20 bp, Homo sapiens
gctggcagagagcacagtga

SEQ ID NO: 2256100 - DNA, 21 bp, Homo sapiens
gctggcagggtccctccagca

SEQ ID NO: 2256101 - DNA, 14 bp, Homo sapiens
gctggccagcaccc

SEQ ID NO: 2256102 - DNA, 14 bp, Homo sapiens
gctggccccagccc

SEQ ID NO: 2256103 - DNA, 15 bp, Homo sapiens
gctggccccagccct

SEQ ID NO: 2256104 - DNA, 19 bp, Homo sapiens
gctggccccagccctgctg

SEQ ID NO: 2256105 - DNA, 19 bp, Homo sapiens
gctggctctgtgagggtgc

SEQ ID NO: 2256106 - DNA, 14 bp, Homo sapiens
gctgggaggactgg

SEQ ID NO: 2256107 - DNA, 17 bp, Homo sapiens
gctgggaggactggacc

SEQ ID NO: 2256108 - DNA, 19 bp, Homo sapiens
gctgggccatgtccaaaga

SEQ ID NO: 2256109 - DNA, 13 bp, Homo sapiens
gctgggctctgca

SEQ ID NO: 2256110 - DNA, 16 bp, Homo sapiens
gctggggcgggctagg

SEQ ID NO: 2256111 - DNA, 20 bp, Homo sapiens
gctgtaaaatgcatgatttt

SEQ ID NO: 2256112 - DNA, 15 bp, Homo sapiens
gctgtaatcatttgt

SEQ ID NO: 2256113 - DNA, 13 bp, Homo sapiens
gctgtagaaaaaa

SEQ ID NO: 2256114 - DNA, 21 bp, Homo sapiens
gctgtcaaaactactgacagg

SEQ ID NO: 2256115 - DNA, 17 bp, Homo sapiens
gctgtcctctcgagccc

SEQ ID NO: 2256116 - DNA, 19 bp, Homo sapiens
gctgtcctctcgagcccag

SEQ ID NO: 2256117 - DNA, 20 bp, Homo sapiens
gctgtcctctcgagcccaga

SEQ ID NO: 2256118 - DNA, 23 bp, Homo sapiens
gctgtcctggaggggctggggac

SEQ ID NO: 2256119 - DNA, 19 bp, Homo sapiens
gctgtcgccccaggccctc

SEQ ID NO: 2256120 - DNA, 20 bp, Homo sapiens
gctgtctatgattgtacttt

SEQ ID NO: 2256121 - DNA, 18 bp, Homo sapiens
gctgtgggcaagcctaag

SEQ ID NO: 2256122 - DNA, 18 bp, Homo sapiens
gctgtgggcagcaccctc

SEQ ID NO: 2256123 - DNA, 19 bp, Homo sapiens
gctgtggtcaaggctacag

SEQ ID NO: 2256124 - DNA, 21 bp, Homo sapiens
gctgttcctgttcagtaataa

SEQ ID NO: 2256125 - DNA, 13 bp, Homo sapiens
gctgtttttttgt

SEQ ID NO: 2256126 - DNA, 20 bp, Homo sapiens
gcttaaaaaaattactgtga

SEQ ID NO: 2256127 - DNA, 21 bp, Homo sapiens
gcttaaggagaggagaaactg

SEQ ID NO: 2256128 - DNA, 23 bp, Homo sapiens
gcttatgatagcaaatggcctca

SEQ ID NO: 2256129 - DNA, 21 bp, Homo sapiens
gcttcttatgtagagttttta

SEQ ID NO: 2256130 - DNA, 16 bp, Homo sapiens
gcttggagggatggag

SEQ ID NO: 2256131 - DNA, 15 bp, Homo sapiens
gcttgggaattttat

SEQ ID NO: 2256132 - DNA, 14 bp, Homo sapiens
gcttgtcttttctg

SEQ ID NO: 2256133 - DNA, 23 bp, Homo sapiens
gcttgtcttttctgctgaggagg

SEQ ID NO: 2256134 - DNA, 13 bp, Homo sapiens
gctttcagagcca

SEQ ID NO: 2256135 - DNA, 20 bp, Homo sapiens
gctttgtaggtgagatgcaa

SEQ ID NO: 2256136 - DNA, 20 bp, Homo sapiens
gctttgtcacttttcctttt

SEQ ID NO: 2256137 - DNA, 22 bp, Homo sapiens
gcttttatctcagatgttaaaa

SEQ ID NO: 2256138 - DNA, 13 bp, Homo sapiens
ggaaaaataaaca

SEQ ID NO: 2256139 - DNA, 16 bp, Homo sapiens
ggaaaaggcccctgca

SEQ ID NO: 2256140 - DNA, 17 bp, Homo sapiens
ggaaaaggcccctgcaa

SEQ ID NO: 2256141 - DNA, 19 bp, Homo sapiens
ggaaactaagattctttta

SEQ ID NO: 2256142 - DNA, 19 bp, Homo sapiens
ggaaactatgtgtttttct

SEQ ID NO: 2256143 - DNA, 22 bp, Homo sapiens
ggaaactgggtttctcattaaa

SEQ ID NO: 2256144 - DNA, 16 bp, Homo sapiens
ggaaagacgtttttgt

SEQ ID NO: 2256145 - DNA, 16 bp, Homo sapiens
ggaaatctacttccta

SEQ ID NO: 2256146 - DNA, 14 bp, Homo sapiens
ggaacaaacagggc

SEQ ID NO: 2256147 - DNA, 15 bp, Homo sapiens
ggaacaaattatttt

SEQ ID NO: 2256148 - DNA, 15 bp, Homo sapiens
ggaacatgccccctg

SEQ ID NO: 2256149 - DNA, 22 bp, Homo sapiens
ggaactagaaagaaggacccag

SEQ ID NO: 2256150 - DNA, 19 bp, Homo sapiens
ggaactctggacccctggg

SEQ ID NO: 2256151 - DNA, 16 bp, Homo sapiens
ggaagagacagcccag

SEQ ID NO: 2256152 - DNA, 17 bp, Homo sapiens
ggaagagacagcccagg

SEQ ID NO: 2256153 - DNA, 15 bp, Homo sapiens
ggaagatcattttga

SEQ ID NO: 2256154 - DNA, 23 bp, Homo sapiens
ggaagccatccctttttttacat

SEQ ID NO: 2256155 - DNA, 19 bp, Homo sapiens
ggaagcccaggagcctcac

SEQ ID NO: 2256156 - DNA, 22 bp, Homo sapiens
cccaaacaccttccagctcctg

SEQ ID NO: 2256157 - DNA, 21 bp, Homo sapiens
cccaaataattgttgtgtgta

SEQ ID NO: 2256158 - DNA, 15 bp, Homo sapiens
cccaacctttccctc

SEQ ID NO: 2256159 - DNA, 15 bp, Homo sapiens
cccaactgtcttttt

SEQ ID NO: 2256160 - DNA, 14 bp, Homo sapiens
cccaagcttagaac

SEQ ID NO: 2256161 - DNA, 18 bp, Homo sapiens
cccaaggaatcagcagga

SEQ ID NO: 2256162 - DNA, 21 bp, Homo sapiens
cccaatccctttattaccccc

SEQ ID NO: 2256163 - DNA, 16 bp, Homo sapiens
cccaatgctgctccac

SEQ ID NO: 2256164 - DNA, 16 bp, Homo sapiens
cccaatgtaggagctg

SEQ ID NO: 2256165 - DNA, 14 bp, Homo sapiens
cccacatccccaat

SEQ ID NO: 2256166 - DNA, 20 bp, Homo sapiens
cccaccagagccgggaggaa

SEQ ID NO: 2256167 - DNA, 18 bp, Homo sapiens
cccaccccatccagccag

SEQ ID NO: 2256168 - DNA, 13 bp, Homo sapiens
cccaccccctcct

SEQ ID NO: 2256169 - DNA, 21 bp, Homo sapiens
cccactactcaatactacctc

SEQ ID NO: 2256170 - DNA, 15 bp, Homo sapiens
cccactcattccttc

SEQ ID NO: 2256171 - DNA, 22 bp, Homo sapiens
cccagaataagttattgcagtt

SEQ ID NO: 2256172 - DNA, 19 bp, Homo sapiens
cccagagcccgtcagcgtg

SEQ ID NO: 2256173 - DNA, 13 bp, Homo sapiens
cccagccatccag

SEQ ID NO: 2256174 - DNA, 20 bp, Homo sapiens
cccagccccgactccagcca

SEQ ID NO: 2256175 - DNA, 22 bp, Homo sapiens
cccagccccgactccagccagc

SEQ ID NO: 2256176 - DNA, 14 bp, Homo sapiens
cccagccctgctgg

SEQ ID NO: 2256177 - DNA, 15 bp, Homo sapiens
cccagccctgctggg

SEQ ID NO: 2256178 - DNA, 15 bp, Homo sapiens
cccagcgtggcctcc

SEQ ID NO: 2256179 - DNA, 19 bp, Homo sapiens
cccaggacgccactcattt

SEQ ID NO: 2256180 - DNA, 23 bp, Homo sapiens
cccaggacgccactcatttcatc

SEQ ID NO: 2256181 - DNA, 14 bp, Homo sapiens
cccaggagcctcac

SEQ ID NO: 2256182 - DNA, 19 bp, Homo sapiens
cccaggatactggcacaga

SEQ ID NO: 2256183 - DNA, 18 bp, Homo sapiens
cccaggcagacaaccttg

SEQ ID NO: 2256184 - DNA, 19 bp, Homo sapiens
cccaggcagacaaccttgt

SEQ ID NO: 2256185 - DNA, 20 bp, Homo sapiens
cccaggcagacaaccttgtc

SEQ ID NO: 2256186 - DNA, 14 bp, Homo sapiens
cccaggcatctgtt

SEQ ID NO: 2256187 - DNA, 13 bp, Homo sapiens
cccaggccctccc

SEQ ID NO: 2256188 - DNA, 15 bp, Homo sapiens
cccaggccctccctg

SEQ ID NO: 2256189 - DNA, 22 bp, Homo sapiens
cccaggtttagtgaaaaactgc

SEQ ID NO: 2256190 - DNA, 19 bp, Homo sapiens
cccagtatacctcattttt

SEQ ID NO: 2256191 - DNA, 14 bp, Homo sapiens
cccagtgggacaga

SEQ ID NO: 2256192 - DNA, 16 bp, Homo sapiens
cccagtgggacagagg

SEQ ID NO: 2256193 - DNA, 13 bp, Homo sapiens
cccatccagccag

SEQ ID NO: 2256194 - DNA, 13 bp, Homo sapiens
cccatccagcctc

SEQ ID NO: 2256195 - DNA, 11 bp, Homo sapiens
cccatgggctg

SEQ ID NO: 2256196 - DNA, 15 bp, Homo sapiens
cccatgggctgtgtc

SEQ ID NO: 2256197 - DNA, 21 bp, Homo sapiens
cccatgtagccccctggcctc

SEQ ID NO: 2256198 - DNA, 22 bp, Homo sapiens
cccatgtagccccctggcctct

SEQ ID NO: 2256199 - DNA, 15 bp, Homo sapiens
ccccaaacaggacag

SEQ ID NO: 2256200 - DNA, 12 bp, Homo sapiens
ccccaccccatc

SEQ ID NO: 2256201 - DNA, 18 bp, Homo sapiens
ccccactactcaatacta

SEQ ID NO: 2256202 - DNA, 22 bp, Homo sapiens
ccccactactcaatactacctc

SEQ ID NO: 2256203 - DNA, 14 bp, Homo sapiens
ccccagacacagcc

SEQ ID NO: 2256204 - DNA, 23 bp, Homo sapiens
ccccagagagaccctgcaagacc

SEQ ID NO: 2256205 - DNA, 16 bp, Homo sapiens
ccccagagcccgtcag

SEQ ID NO: 2256206 - DNA, 21 bp, Homo sapiens
ccccagagcccgtcagcgtgg

SEQ ID NO: 2256207 - DNA, 22 bp, Homo sapiens
ccccagcagcccctcagcgccc

SEQ ID NO: 2256208 - DNA, 17 bp, Homo sapiens
ccccagccccgactcca

SEQ ID NO: 2256209 - DNA, 14 bp, Homo sapiens
ccccagccctgctg

SEQ ID NO: 2256210 - DNA, 16 bp, Homo sapiens
ccccagccctgctggg

SEQ ID NO: 2256211 - DNA, 14 bp, Homo sapiens
ccccagcctggcac

SEQ ID NO: 2256212 - DNA, 11 bp, Homo sapiens
ccccagctacc

SEQ ID NO: 2256213 - DNA, 12 bp, Homo sapiens
ccccaggacgcc

SEQ ID NO: 2256214 - DNA, 23 bp, Homo sapiens
ccccaggacgccactcatttcat

SEQ ID NO: 2256215 - DNA, 23 bp, Homo sapiens
ccccaggcatctgttagcagagt

SEQ ID NO: 2256216 - DNA, 23 bp, Homo sapiens
ccccagggggcggggtgcagaag

SEQ ID NO: 2256217 - DNA, 12 bp, Homo sapiens
ccccatccagcc

SEQ ID NO: 2256218 - DNA, 13 bp, Homo sapiens
ccccatccagcca

SEQ ID NO: 2256219 - DNA, 19 bp, Homo sapiens
ccccatccagcctccaggg

SEQ ID NO: 2256220 - DNA, 15 bp, Homo sapiens
cccccacccccagct

SEQ ID NO: 2256221 - DNA, 23 bp, Homo sapiens
cccccagcactaaggccgtgtct

SEQ ID NO: 2256222 - DNA, 15 bp, Homo sapiens
cccccagcctctggc

SEQ ID NO: 2256223 - DNA, 18 bp, Homo sapiens
cccccatgggctgtgtcc

SEQ ID NO: 2256224 - DNA, 15 bp, Homo sapiens
ccccctcctccccgc

SEQ ID NO: 2256225 - DNA, 15 bp, Homo sapiens
ccccctggcctctgt

SEQ ID NO: 2256226 - DNA, 18 bp, Homo sapiens
ccccctttcacactggat

SEQ ID NO: 2256227 - DNA, 13 bp, Homo sapiens
ccccgactccagc

SEQ ID NO: 2256228 - DNA, 17 bp, Homo sapiens
ccccgactccagccagc

SEQ ID NO: 2256229 - DNA, 13 bp, Homo sapiens
ccccgcctggcca

SEQ ID NO: 2256230 - DNA, 17 bp, Homo sapiens
cccctaccaatattagg

SEQ ID NO: 2256231 - DNA, 13 bp, Homo sapiens
cccctcacctcct

SEQ ID NO: 2256232 - DNA, 20 bp, Homo sapiens
cccctcagatgatctctcca

SEQ ID NO: 2256233 - DNA, 21 bp, Homo sapiens
cccctcagatgatctctccac

SEQ ID NO: 2256234 - DNA, 19 bp, Homo sapiens
cccctccacgcctcctggc

SEQ ID NO: 2256235 - DNA, 17 bp, Homo sapiens
cccctcccacccccagc

SEQ ID NO: 2256236 - DNA, 17 bp, Homo sapiens
cccctccctcttctgcc

SEQ ID NO: 2256237 - DNA, 17 bp, Homo sapiens
cccctcctctagctgtg

SEQ ID NO: 2256238 - DNA, 13 bp, Homo sapiens
cccctccttcaga

SEQ ID NO: 2256239 - DNA, 12 bp, Homo sapiens
cccctctgtctt

SEQ ID NO: 2256240 - DNA, 21 bp, Homo sapiens
cccctgcaaaaagaaaaaaag

SEQ ID NO: 2256241 - DNA, 17 bp, Homo sapiens
cccctgccccccagcct

SEQ ID NO: 2256242 - DNA, 14 bp, Homo sapiens
cccctggacttctt

SEQ ID NO: 2256243 - DNA, 14 bp, Homo sapiens
cccctggcctctgt

SEQ ID NO: 2256244 - DNA, 15 bp, Homo sapiens
cccctgtaggcctca

SEQ ID NO: 2256245 - DNA, 23 bp, Homo sapiens
ccccttccatggtactgtagcag

SEQ ID NO: 2256246 - DNA, 14 bp, Homo sapiens
ccccttctgtgtca

SEQ ID NO: 2256247 - DNA, 14 bp, Homo sapiens
cccctttcacactg

SEQ ID NO: 2256248 - DNA, 10 bp, Homo sapiens
cccctttcct

SEQ ID NO: 2256249 - DNA, 22 bp, Homo sapiens
cccgctgcaagtcagattgctg

SEQ ID NO: 2256250 - DNA, 18 bp, Homo sapiens
cccggagcaggggtctga

SEQ ID NO: 2256251 - DNA, 18 bp, Homo sapiens
cccggaggttgggtgggc

SEQ ID NO: 2256252 - DNA, 16 bp, Homo sapiens
cccgtttctccaccta

SEQ ID NO: 2256253 - DNA, 16 bp, Homo sapiens
cccgttttccccatga

SEQ ID NO: 2256254 - DNA, 18 bp, Homo sapiens
cccgttttccccatgaca

SEQ ID NO: 2256255 - DNA, 23 bp, Homo sapiens
ccctactattcagtggcgagaaa

SEQ ID NO: 2256256 - DNA, 12 bp, Homo sapiens
ccctattttaag

SEQ ID NO: 2256257 - DNA, 20 bp, Homo sapiens
ccctcaaagaagtcggaatg

SEQ ID NO: 2256258 - DNA, 23 bp, Homo sapiens
ccctcaaagaagtcggaatgtca

SEQ ID NO: 2256259 - DNA, 18 bp, Homo sapiens
ccctcaccccctcccacc

SEQ ID NO: 2256260 - DNA, 14 bp, Homo sapiens
ccctcacctcctct

SEQ ID NO: 2256261 - DNA, 23 bp, Homo sapiens
ccctcactctgtcagccagccgc

SEQ ID NO: 2256262 - DNA, 11 bp, Homo sapiens
ctactacctct

SEQ ID NO: 2256263 - DNA, 18 bp, Homo sapiens
ctactcaatactacctct

SEQ ID NO: 2256264 - DNA, 14 bp, Homo sapiens
ctactgacagggag

SEQ ID NO: 2256265 - DNA, 16 bp, Homo sapiens
ctactgtaattttata

SEQ ID NO: 2256266 - DNA, 19 bp, Homo sapiens
ctactgtaattttatatga

SEQ ID NO: 2256267 - DNA, 20 bp, Homo sapiens
ctacttcctcctccccactt

SEQ ID NO: 2256268 - DNA, 13 bp, Homo sapiens
ctagaaattttca

SEQ ID NO: 2256269 - DNA, 16 bp, Homo sapiens
ctagataggaggatgg

SEQ ID NO: 2256270 - DNA, 22 bp, Homo sapiens
ctagatgcacgtggggcccact

SEQ ID NO: 2256271 - DNA, 11 bp, Homo sapiens
ctagatttcta

SEQ ID NO: 2256272 - DNA, 20 bp, Homo sapiens
ctagccaaaccaggaccctg

SEQ ID NO: 2256273 - DNA, 14 bp, Homo sapiens
ctagctgtgggggt

SEQ ID NO: 2256274 - DNA, 20 bp, Homo sapiens
ctaggacacagttcctggga

SEQ ID NO: 2256275 - DNA, 23 bp, Homo sapiens
ctaggagggagacactggcccct

SEQ ID NO: 2256276 - DNA, 22 bp, Homo sapiens
ctaggatagctaactgtaaatc

SEQ ID NO: 2256277 - DNA, 15 bp, Homo sapiens
ctagtacttattaca

SEQ ID NO: 2256278 - DNA, 15 bp, Homo sapiens
ctagtcaaacaaaaa

SEQ ID NO: 2256279 - DNA, 20 bp, Homo sapiens
ctagtgagtgtgctgacttt

SEQ ID NO: 2256280 - DNA, 14 bp, Homo sapiens
ctagtgtgaattaa

SEQ ID NO: 2256281 - DNA, 22 bp, Homo sapiens
ctagttccagaaaacctctcct

SEQ ID NO: 2256282 - DNA, 11 bp, Homo sapiens
ctataaaatag

SEQ ID NO: 2256283 - DNA, 14 bp, Homo sapiens
ctataaatgttgct

SEQ ID NO: 2256284 - DNA, 20 bp, Homo sapiens
ctatacacaagcaatgcaag

SEQ ID NO: 2256285 - DNA, 14 bp, Homo sapiens
ctatacatatcttt

SEQ ID NO: 2256286 - DNA, 12 bp, Homo sapiens
ctatataaaata

SEQ ID NO: 2256287 - DNA, 17 bp, Homo sapiens
ctatataaaataactaa

SEQ ID NO: 2256288 - DNA, 12 bp, Homo sapiens
ctatatatttct

SEQ ID NO: 2256289 - DNA, 18 bp, Homo sapiens
ctatcaatatttaagttt

SEQ ID NO: 2256290 - DNA, 13 bp, Homo sapiens
ctatcctctgtaa

SEQ ID NO: 2256291 - DNA, 21 bp, Homo sapiens
ctatctgtcatctctctgggg

SEQ ID NO: 2256292 - DNA, 15 bp, Homo sapiens
ctatgcaggcagcac

SEQ ID NO: 2256293 - DNA, 19 bp, Homo sapiens
ctatgggtctaggacacag

SEQ ID NO: 2256294 - DNA, 18 bp, Homo sapiens
ctatggtatgctggccag

SEQ ID NO: 2256295 - DNA, 20 bp, Homo sapiens
ctatggtatgctggccagca

SEQ ID NO: 2256296 - DNA, 17 bp, Homo sapiens
ctatgtataaaatacat

SEQ ID NO: 2256297 - DNA, 22 bp, Homo sapiens
ctatgtgtttttctcatatttg

SEQ ID NO: 2256298 - DNA, 20 bp, Homo sapiens
ctatgtttttttaattaaaa

SEQ ID NO: 2256299 - DNA, 18 bp, Homo sapiens
ctattacttgaactttcc

SEQ ID NO: 2256300 - DNA, 20 bp, Homo sapiens
ctattacttgaactttccaa

SEQ ID NO: 2256301 - DNA, 23 bp, Homo sapiens
ctattctagcctgcattgagctt

SEQ ID NO: 2256302 - DNA, 17 bp, Homo sapiens
ctattgatttaagcttt

SEQ ID NO: 2256303 - DNA, 15 bp, Homo sapiens
ctatttaaagcctcc

SEQ ID NO: 2256304 - DNA, 11 bp, Homo sapiens
ctatttaagat

SEQ ID NO: 2256305 - DNA, 22 bp, Homo sapiens
ctatttaattgaaactctctgt

SEQ ID NO: 2256306 - DNA, 19 bp, Homo sapiens
ctattttaagacgtgaatg

SEQ ID NO: 2256307 - DNA, 14 bp, Homo sapiens
ctattttaatcttg

SEQ ID NO: 2256308 - DNA, 19 bp, Homo sapiens
ctatttttaatgtttgtac

SEQ ID NO: 2256309 - DNA, 14 bp, Homo sapiens
ctcaaaacaaaggc

SEQ ID NO: 2256310 - DNA, 19 bp, Homo sapiens
ctcaaatcgtccagcgacc

SEQ ID NO: 2256311 - DNA, 21 bp, Homo sapiens
ctcaacctcttctggctcaaa

SEQ ID NO: 2256312 - DNA, 14 bp, Homo sapiens
ctcaactattctgt

SEQ ID NO: 2256313 - DNA, 22 bp, Homo sapiens
ctcaagttgattagaaagacca

SEQ ID NO: 2256314 - DNA, 14 bp, Homo sapiens
ctcaatactacctc

SEQ ID NO: 2256315 - DNA, 15 bp, Homo sapiens
ctcaatactacctct

SEQ ID NO: 2256316 - DNA, 15 bp, Homo sapiens
ctcaatcacactaca

SEQ ID NO: 2256317 - DNA, 17 bp, Homo sapiens
ctcaatggactggaagg

SEQ ID NO: 2256318 - DNA, 20 bp, Homo sapiens
ggccctggggatcttcccac

SEQ ID NO: 2256319 - DNA, 12 bp, Homo sapiens
ggccgccccctg

SEQ ID NO: 2256320 - DNA, 16 bp, Homo sapiens
ggccgccccctgcccc

SEQ ID NO: 2256321 - DNA, 22 bp, Homo sapiens
ggccgccccctgccccccagcc

SEQ ID NO: 2256322 - DNA, 15 bp, Homo sapiens
ggccgggcaggtcct

SEQ ID NO: 2256323 - DNA, 13 bp, Homo sapiens
ggccgtgtctctg

SEQ ID NO: 2256324 - DNA, 18 bp, Homo sapiens
ggcctagactctgtctac

SEQ ID NO: 2256325 - DNA, 18 bp, Homo sapiens
ggcctcaaaggcccgctc

SEQ ID NO: 2256326 - DNA, 19 bp, Homo sapiens
ggcctcaccgagtgggggc

SEQ ID NO: 2256327 - DNA, 12 bp, Homo sapiens
ggcctcagccct

SEQ ID NO: 2256328 - DNA, 15 bp, Homo sapiens
ggcctcagccctcag

SEQ ID NO: 2256329 - DNA, 21 bp, Homo sapiens
ggcctcatcacagcaatattt

SEQ ID NO: 2256330 - DNA, 14 bp, Homo sapiens
ggcctgcacagtga

SEQ ID NO: 2256331 - DNA, 19 bp, Homo sapiens
ggcctggaatttgggcaga

SEQ ID NO: 2256332 - DNA, 18 bp, Homo sapiens
ggcctgtccaacacatct

SEQ ID NO: 2256333 - DNA, 20 bp, Homo sapiens
ggccttttagaaacctcatt

SEQ ID NO: 2256334 - DNA, 22 bp, Homo sapiens
ggccttttagaaacctcattgg

SEQ ID NO: 2256335 - DNA, 15 bp, Homo sapiens
ggcgggatcctccac

SEQ ID NO: 2256336 - DNA, 16 bp, Homo sapiens
ggctatgaagttacct

SEQ ID NO: 2256337 - DNA, 16 bp, Homo sapiens
ggctcagattgtaata

SEQ ID NO: 2256338 - DNA, 21 bp, Homo sapiens
ggctccccatgtgtcctggtt

SEQ ID NO: 2256339 - DNA, 17 bp, Homo sapiens
ggctccctggcaggatg

SEQ ID NO: 2256340 - DNA, 20 bp, Homo sapiens
ggctccttcccatcgctgtc

SEQ ID NO: 2256341 - DNA, 20 bp, Homo sapiens
ggctcgccgtgtctcagcct

SEQ ID NO: 2256342 - DNA, 20 bp, Homo sapiens
ggctctgaggtgcctgtccc

SEQ ID NO: 2256343 - DNA, 19 bp, Homo sapiens
ggctctgcaattcccctct

SEQ ID NO: 2256344 - DNA, 15 bp, Homo sapiens
ggctctgccccctcc

SEQ ID NO: 2256345 - DNA, 23 bp, Homo sapiens
ggctgaggacgagacccccatcc

SEQ ID NO: 2256346 - DNA, 15 bp, Homo sapiens
ggctgcccctctcac

SEQ ID NO: 2256347 - DNA, 23 bp, Homo sapiens
ggctgggagtagttgtctttcct

SEQ ID NO: 2256348 - DNA, 20 bp, Homo sapiens
ggctgggccatgtccaaaga

SEQ ID NO: 2256349 - DNA, 13 bp, Homo sapiens
ggctgggcccctg

SEQ ID NO: 2256350 - DNA, 17 bp, Homo sapiens
ggctgggcccctgggat

SEQ ID NO: 2256351 - DNA, 17 bp, Homo sapiens
ggctggtagcagcaggc

SEQ ID NO: 2256352 - DNA, 21 bp, Homo sapiens
ggctggtagcagcaggctcag

SEQ ID NO: 2256353 - DNA, 23 bp, Homo sapiens
ggctggtagcagcaggctcaggc

SEQ ID NO: 2256354 - DNA, 16 bp, Homo sapiens
ggctgtaaaatgcatg

SEQ ID NO: 2256355 - DNA, 14 bp, Homo sapiens
ggctgtctgtcacc

SEQ ID NO: 2256356 - DNA, 19 bp, Homo sapiens
ggctgtgtcctaaggccca

SEQ ID NO: 2256357 - DNA, 15 bp, Homo sapiens
ggcttcatgccagct

SEQ ID NO: 2256358 - DNA, 23 bp, Homo sapiens
gggaaaaaaaatctctcagagcc

SEQ ID NO: 2256359 - DNA, 18 bp, Homo sapiens
gggaaactaagattcttt

SEQ ID NO: 2256360 - DNA, 15 bp, Homo sapiens
gggaacatgccccct

SEQ ID NO: 2256361 - DNA, 13 bp, Homo sapiens
gggaatgggagag

SEQ ID NO: 2256362 - DNA, 14 bp, Homo sapiens
gggaatgggagagg

SEQ ID NO: 2256363 - DNA, 18 bp, Homo sapiens
gggaattccctccccctc

SEQ ID NO: 2256364 - DNA, 18 bp, Homo sapiens
gggaccaattctggacag

SEQ ID NO: 2256365 - DNA, 16 bp, Homo sapiens
gggaccactgggtgag

SEQ ID NO: 2256366 - DNA, 22 bp, Homo sapiens
gggaccactgggtgagagagga

SEQ ID NO: 2256367 - DNA, 20 bp, Homo sapiens
gggaccggcggaccccagcc

SEQ ID NO: 2256368 - DNA, 21 bp, Homo sapiens
gggacctggtaccctcctggc

SEQ ID NO: 2256369 - DNA, 14 bp, Homo sapiens
gggacttgtgtctg

SEQ ID NO: 2256370 - DNA, 19 bp, Homo sapiens
gggagacactggcccctca

SEQ ID NO: 2256371 - DNA, 13 bp, Homo sapiens
gggagcctccccc

SEQ ID NO: 2256372 - DNA, 14 bp, Homo sapiens
gggatcctccacag

SEQ ID NO: 2256373 - DNA, 14 bp, Homo sapiens
gggatcctgcctgc

SEQ ID NO: 2256374 - DNA, 23 bp, Homo sapiens
gggatcttcccacaggagggcca

SEQ ID NO: 2256375 - DNA, 19 bp, Homo sapiens
gggatggagaggcggcctc

SEQ ID NO: 2256376 - DNA, 22 bp, Homo sapiens
gggcaccacaaaatatacaaaa

SEQ ID NO: 2256377 - DNA, 12 bp, Homo sapiens
gggcagcaccct

SEQ ID NO: 2256378 - DNA, 13 bp, Homo sapiens
gggcagcaccctc

SEQ ID NO: 2256379 - DNA, 15 bp, Homo sapiens
gggcagcaccctccc

SEQ ID NO: 2256380 - DNA, 13 bp, Homo sapiens
gggcaggctgggc

SEQ ID NO: 2256381 - DNA, 15 bp, Homo sapiens
gggcaggctgggcca

SEQ ID NO: 2256382 - DNA, 16 bp, Homo sapiens
gggcaggctgggccat

SEQ ID NO: 2256383 - DNA, 18 bp, Homo sapiens
gggcaggtcctgcccatg

SEQ ID NO: 2256384 - DNA, 14 bp, Homo sapiens
gggcattgctcagc

SEQ ID NO: 2256385 - DNA, 19 bp, Homo sapiens
gggcattgctcagcccgct

SEQ ID NO: 2256386 - DNA, 19 bp, Homo sapiens
gggccacatagatgctgat

SEQ ID NO: 2256387 - DNA, 13 bp, Homo sapiens
gggcccctccacg

SEQ ID NO: 2256388 - DNA, 17 bp, Homo sapiens
gggcccctccacgcctc

SEQ ID NO: 2256389 - DNA, 14 bp, Homo sapiens
gggcccctgggatg

SEQ ID NO: 2256390 - DNA, 12 bp, Homo sapiens
gggccctgggcc

SEQ ID NO: 2256391 - DNA, 12 bp, Homo sapiens
gggcctcatcac

SEQ ID NO: 2256392 - DNA, 20 bp, Homo sapiens
gggccttttagaaacctcat

SEQ ID NO: 2256393 - DNA, 22 bp, Homo sapiens
gggctatcaacttaataagata

SEQ ID NO: 2256394 - DNA, 20 bp, Homo sapiens
gggctcactgtgctggggca

SEQ ID NO: 2256395 - DNA, 18 bp, Homo sapiens
gggctccgaggagctggg

SEQ ID NO: 2256396 - DNA, 20 bp, Homo sapiens
gggctctgcaattcccctct

SEQ ID NO: 2256397 - DNA, 12 bp, Homo sapiens
gggctgaaccct

SEQ ID NO: 2256398 - DNA, 18 bp, Homo sapiens
gggctgtaaaatgcatga

SEQ ID NO: 2256399 - DNA, 21 bp, Homo sapiens
gggctgtgtcctaaggcccat

SEQ ID NO: 2256400 - DNA, 18 bp, Homo sapiens
gggcttcgcttccttagc

SEQ ID NO: 2256401 - DNA, 20 bp, Homo sapiens
ggggaaaaaaaatctctcag

SEQ ID NO: 2256402 - DNA, 18 bp, Homo sapiens
ggggaattccctccccct

SEQ ID NO: 2256403 - DNA, 21 bp, Homo sapiens
ggggacccaatgtaggagctg

SEQ ID NO: 2256404 - DNA, 13 bp, Homo sapiens
ggggatccccgcc

SEQ ID NO: 2256405 - DNA, 13 bp, Homo sapiens
ggggcaggctggg

SEQ ID NO: 2256406 - DNA, 16 bp, Homo sapiens
ggggcaggctgggcca

SEQ ID NO: 2256407 - DNA, 12 bp, Homo sapiens
ggggccctgccc

SEQ ID NO: 2256408 - DNA, 14 bp, Homo sapiens
ggggccctgcccca

SEQ ID NO: 2256409 - DNA, 19 bp, Homo sapiens
ggggccctgccccacccca

SEQ ID NO: 2256410 - DNA, 14 bp, Homo sapiens
ggggccctgggcct

SEQ ID NO: 2256411 - DNA, 16 bp, Homo sapiens
ggggccgggcaggtcc

SEQ ID NO: 2256412 - DNA, 20 bp, Homo sapiens
ggggctgaggacgagacccc

SEQ ID NO: 2256413 - DNA, 15 bp, Homo sapiens
gggggatgggccagg

SEQ ID NO: 2256414 - DNA, 18 bp, Homo sapiens
gggggccgggcaggtcct

SEQ ID NO: 2256415 - DNA, 20 bp, Homo sapiens
gggggccgggcaggtcctgc

SEQ ID NO: 2256416 - DNA, 23 bp, Homo sapiens
gggggccgggcaggtcctgccca

SEQ ID NO: 2256417 - DNA, 20 bp, Homo sapiens
ggggtatttcaattaccttc

SEQ ID NO: 2256418 - DNA, 14 bp, Homo sapiens
gggtccctccagca

SEQ ID NO: 2256419 - DNA, 17 bp, Homo sapiens
gggtgagggtcccatgt

SEQ ID NO: 2256420 - DNA, 20 bp, Homo sapiens
gggtgcatttgagagaagcc

SEQ ID NO: 2256421 - DNA, 13 bp, Homo sapiens
gggtggccatccc

SEQ ID NO: 2256422 - DNA, 21 bp, Homo sapiens
gggtgtgcaatgtctgagtga

SEQ ID NO: 2256423 - DNA, 12 bp, Homo sapiens
gggtgtggcctc

SEQ ID NO: 2256424 - DNA, 16 bp, Homo sapiens
gggttaattcatttgg

SEQ ID NO: 2256425 - DNA, 16 bp, Homo sapiens
ggtaaagttacacttt

SEQ ID NO: 2256426 - DNA, 13 bp, Homo sapiens
ggtagtttctcat

SEQ ID NO: 2256427 - DNA, 18 bp, Homo sapiens
ggtatgctggccagcacc

SEQ ID NO: 2256428 - DNA, 16 bp, Homo sapiens
ggtattttttcctttt

SEQ ID NO: 2256429 - DNA, 21 bp, Homo sapiens
ggtcagtagtttaaaagttct

SEQ ID NO: 2256430 - DNA, 17 bp, Homo sapiens
ggtcctaaccagtgagc

SEQ ID NO: 2256431 - DNA, 18 bp, Homo sapiens
ggtcgcttgggaatttta

SEQ ID NO: 2256432 - DNA, 13 bp, Homo sapiens
ggtgaatattttc

SEQ ID NO: 2256433 - DNA, 15 bp, Homo sapiens
ggtgacacctccccc

SEQ ID NO: 2256434 - DNA, 17 bp, Homo sapiens
ggtgacacctccccctt

SEQ ID NO: 2256435 - DNA, 22 bp, Homo sapiens
ggtgacctccgtcctctcccca

SEQ ID NO: 2256436 - DNA, 13 bp, Homo sapiens
ggtgactgtccca

SEQ ID NO: 2256437 - DNA, 17 bp, Homo sapiens
ggtgcaaagtattgtaa

SEQ ID NO: 2256438 - DNA, 13 bp, Homo sapiens
ggtgcatgggctc

SEQ ID NO: 2256439 - DNA, 19 bp, Homo sapiens
ggtgcatttgagagaagcc

SEQ ID NO: 2256440 - DNA, 19 bp, Homo sapiens
ggtgctgactggcttcagc

SEQ ID NO: 2256441 - DNA, 17 bp, Homo sapiens
ggtggcacaggccccct

SEQ ID NO: 2256442 - DNA, 20 bp, Homo sapiens
ggtggcaggcacacagcagc

SEQ ID NO: 2256443 - DNA, 21 bp, Homo sapiens
ggtggcaggcacacagcagcc

SEQ ID NO: 2256444 - DNA, 22 bp, Homo sapiens
ggtggcaggcacacagcagccc

SEQ ID NO: 2256445 - DNA, 23 bp, Homo sapiens
ggtggctctgggaatgggagagg

SEQ ID NO: 2256446 - DNA, 14 bp, Homo sapiens
ggtggggtcctgga

SEQ ID NO: 2256447 - DNA, 12 bp, Homo sapiens
ggtgtggcctca

SEQ ID NO: 2256448 - DNA, 13 bp, Homo sapiens
ggtgtggcctcag

SEQ ID NO: 2256449 - DNA, 12 bp, Homo sapiens
ggtgtggctcct

SEQ ID NO: 2256450 - DNA, 15 bp, Homo sapiens
ggttaggtcttagga

SEQ ID NO: 2256451 - DNA, 14 bp, Homo sapiens
ggttatctctgtgt

SEQ ID NO: 2256452 - DNA, 19 bp, Homo sapiens
ggttcaagtgattctcttg

SEQ ID NO: 2256453 - DNA, 18 bp, Homo sapiens
ggttctttcatttgcttt

SEQ ID NO: 2256454 - DNA, 16 bp, Homo sapiens
ggtttaaaagaaaaaa

SEQ ID NO: 2256455 - DNA, 11 bp, Homo sapiens
ggtttcctgca

SEQ ID NO: 2256456 - DNA, 14 bp, Homo sapiens
ggtttcctgcaggc

SEQ ID NO: 2256457 - DNA, 15 bp, Homo sapiens
ggtttctcattaaag

SEQ ID NO: 2256458 - DNA, 16 bp, Homo sapiens
ggtttctcattaaagt

SEQ ID NO: 2256459 - DNA, 18 bp, Homo sapiens
ggttttaggaaacttgta

SEQ ID NO: 2256460 - DNA, 18 bp, Homo sapiens
gtaaaatattttgaatca

SEQ ID NO: 2256461 - DNA, 15 bp, Homo sapiens
gtaaacaaaatgaag

SEQ ID NO: 2256462 - DNA, 22 bp, Homo sapiens
gtaaacgggaacatgccccctg

SEQ ID NO: 2256463 - DNA, 19 bp, Homo sapiens
gtaaactcatctgaaatgt

SEQ ID NO: 2256464 - DNA, 16 bp, Homo sapiens
gtaaactttttgtgct

SEQ ID NO: 2256465 - DNA, 15 bp, Homo sapiens
gtaaagactggcttt

SEQ ID NO: 2256466 - DNA, 19 bp, Homo sapiens
gtaaagactggcttttatt

SEQ ID NO: 2256467 - DNA, 13 bp, Homo sapiens
gtaaatgtaaact

SEQ ID NO: 2256468 - DNA, 21 bp, Homo sapiens
gtaacactgtgtacacctcaa

SEQ ID NO: 2256469 - DNA, 16 bp, Homo sapiens
gtaacattagttttaa

SEQ ID NO: 2256470 - DNA, 13 bp, Homo sapiens
gtaagaaatacag

SEQ ID NO: 2256471 - DNA, 16 bp, Homo sapiens
gtaagaaatacagact

SEQ ID NO: 2256472 - DNA, 18 bp, Homo sapiens
gtaagaacaactacctga

SEQ ID NO: 2256473 - DNA, 13 bp, Homo sapiens
gtaagatatttgc

SEQ ID NO: 2256474 - DNA, 18 bp, Homo sapiens
gtaatcatttgtttacat

SEQ ID NO: 2256475 - DNA, 21 bp, Homo sapiens
gtaatcccttcacagtcccag

SEQ ID NO: 2256476 - DNA, 19 bp, Homo sapiens
gtaatgtatcaaatacatt

SEQ ID NO: 2256477 - DNA, 15 bp, Homo sapiens
gtaatttaatgaaaa

SEQ ID NO: 2256478 - DNA, 15 bp, Homo sapiens
gtaattttatatgaa

SEQ ID NO: 2256479 - DNA, 18 bp, Homo sapiens
gtaattttatatgaagat

SEQ ID NO: 2256480 - DNA, 20 bp, Homo sapiens
gtaattttgtgtaagaaata

SEQ ID NO: 2256481 - DNA, 16 bp, Homo sapiens
gtacaatcaaaacaca

SEQ ID NO: 2256482 - DNA, 21 bp, Homo sapiens
gtacaatcaaaacacactact

SEQ ID NO: 2256483 - DNA, 14 bp, Homo sapiens
gtacacctcaaata

SEQ ID NO: 2256484 - DNA, 19 bp, Homo sapiens
gtacacttaattacagtta

SEQ ID NO: 2256485 - DNA, 14 bp, Homo sapiens
gtacagattttatt

SEQ ID NO: 2256486 - DNA, 20 bp, Homo sapiens
gtaccatagtaccatttata

SEQ ID NO: 2256487 - DNA, 21 bp, Homo sapiens
gtaccatttatacaaattaga

SEQ ID NO: 2256488 - DNA, 19 bp, Homo sapiens
gtaccctctcagctccagg

SEQ ID NO: 2256489 - DNA, 17 bp, Homo sapiens
gtacctagctggctctg

SEQ ID NO: 2256490 - DNA, 15 bp, Homo sapiens
gtacctgattgtatt

SEQ ID NO: 2256491 - DNA, 15 bp, Homo sapiens
gtacgttatatattg

SEQ ID NO: 2256492 - DNA, 19 bp, Homo sapiens
gtactgaagccaaatgaaa

SEQ ID NO: 2256493 - DNA, 20 bp, Homo sapiens
gtactggctctttattcatt

SEQ ID NO: 2256494 - DNA, 15 bp, Homo sapiens
gtactgttctgtgtc

SEQ ID NO: 2256495 - DNA, 18 bp, Homo sapiens
gtactgttctgtgtcttt

SEQ ID NO: 2256496 - DNA, 23 bp, Homo sapiens
gtagagtttttatgcctttctct

SEQ ID NO: 2256497 - DNA, 13 bp, Homo sapiens
gtagcaacaacag

SEQ ID NO: 2256498 - DNA, 12 bp, Homo sapiens
gtagcagcaggc

SEQ ID NO: 2256499 - DNA, 16 bp, Homo sapiens
gtagccccctggcctc

SEQ ID NO: 2256500 - DNA, 19 bp, Homo sapiens
gtagccccctggcctctgt

SEQ ID NO: 2256501 - DNA, 23 bp, Homo sapiens
gtagccccctggcctctgtgcct

SEQ ID NO: 2256502 - DNA, 19 bp, Homo sapiens
gtagcctgggctcactgtg

SEQ ID NO: 2256503 - DNA, 21 bp, Homo sapiens
gtagggaagaaaactatcctg

SEQ ID NO: 2256504 - DNA, 18 bp, Homo sapiens
gtaggtgatgggggacga

SEQ ID NO: 2256505 - DNA, 22 bp, Homo sapiens
gtagtatgataggttattttga

SEQ ID NO: 2256506 - DNA, 22 bp, Homo sapiens
gtagtcctcataaaaagcaaaa

SEQ ID NO: 2256507 - DNA, 20 bp, Homo sapiens
gtagtctcactgcttgaact

SEQ ID NO: 2256508 - DNA, 22 bp, Homo sapiens
gtataaattgtctttaaaaact

SEQ ID NO: 2256509 - DNA, 19 bp, Homo sapiens
gtataagtggaggcacttt

SEQ ID NO: 2256510 - DNA, 20 bp, Homo sapiens
gtataagtggaggcacttta

SEQ ID NO: 2256511 - DNA, 13 bp, Homo sapiens
gtataataaaatt

SEQ ID NO: 2256512 - DNA, 14 bp, Homo sapiens
gtataataaaatta

SEQ ID NO: 2256513 - DNA, 13 bp, Homo sapiens
gtataatcttgta

SEQ ID NO: 2256514 - DNA, 17 bp, Homo sapiens
gtataatcttgtagaca

SEQ ID NO: 2256515 - DNA, 11 bp, Homo sapiens
gtatacctcat

SEQ ID NO: 2256516 - DNA, 12 bp, Homo sapiens
gtatacctcatt

SEQ ID NO: 2256517 - DNA, 20 bp, Homo sapiens
gtatagatataatgaacaaa

SEQ ID NO: 2256518 - DNA, 20 bp, Homo sapiens
gtatatatggatcagaggag

SEQ ID NO: 2256519 - DNA, 18 bp, Homo sapiens
gtatcctgggggacccaa

SEQ ID NO: 2256520 - DNA, 24 bp, Homo sapiens
gtatgataggttattttgatgtaa

SEQ ID NO: 2256521 - DNA, 16 bp, Homo sapiens
gtatgtggttttgtaa

SEQ ID NO: 2256522 - DNA, 13 bp, Homo sapiens
gtatttaatcgca

SEQ ID NO: 2256523 - DNA, 11 bp, Homo sapiens
gtattttacac

SEQ ID NO: 2256524 - DNA, 12 bp, Homo sapiens
gtattttcagtc

SEQ ID NO: 2256525 - DNA, 19 bp, Homo sapiens
gtattttcttctctgtgag

SEQ ID NO: 2256526 - DNA, 18 bp, Homo sapiens
gtatttttcaataaagca

SEQ ID NO: 2256527 - DNA, 21 bp, Homo sapiens
gtatttttcaataaagcattt

SEQ ID NO: 2256528 - DNA, 14 bp, Homo sapiens
gtattttttccttt

SEQ ID NO: 2256529 - DNA, 23 bp, Homo sapiens
gtattttttttttaaataaaagc

SEQ ID NO: 2256530 - DNA, 15 bp, Homo sapiens
gtcaaagttgaaaat

SEQ ID NO: 2256531 - DNA, 16 bp, Homo sapiens
gtcaagagcatgcaca

SEQ ID NO: 2256532 - DNA, 22 bp, Homo sapiens
gtcaagattttttttgtaactt

SEQ ID NO: 2256533 - DNA, 15 bp, Homo sapiens
gtcaagttgtcaggt

SEQ ID NO: 2256534 - DNA, 19 bp, Homo sapiens
gtcaccaaaagacactgca

SEQ ID NO: 2256535 - DNA, 13 bp, Homo sapiens
gtcaccagagact

SEQ ID NO: 2256536 - DNA, 18 bp, Homo sapiens
gtcaccagctatctgtca

SEQ ID NO: 2256537 - DNA, 19 bp, Homo sapiens
gtcaccagctatctgtcat

SEQ ID NO: 2256538 - DNA, 20 bp, Homo sapiens
ggaagcgcgagggcctcaaa

SEQ ID NO: 2256539 - DNA, 18 bp, Homo sapiens
ggaataaggcccagagcg

SEQ ID NO: 2256540 - DNA, 14 bp, Homo sapiens
ggaatgcagcagga

SEQ ID NO: 2256541 - DNA, 15 bp, Homo sapiens
ggaattccctccccc

SEQ ID NO: 2256542 - DNA, 18 bp, Homo sapiens
ggaattccctccccctcc

SEQ ID NO: 2256543 - DNA, 13 bp, Homo sapiens
ggaatttgggcag

SEQ ID NO: 2256544 - DNA, 16 bp, Homo sapiens
ggacacagttcctggg

SEQ ID NO: 2256545 - DNA, 21 bp, Homo sapiens
ggacacagttcctgggaacat

SEQ ID NO: 2256546 - DNA, 14 bp, Homo sapiens
ggacactcagacct

SEQ ID NO: 2256547 - DNA, 22 bp, Homo sapiens
ggacagacagatgttgggagga

SEQ ID NO: 2256548 - DNA, 20 bp, Homo sapiens
ggacagaggagcaaggttta

SEQ ID NO: 2256549 - DNA, 19 bp, Homo sapiens
ggacagtacctgattgtat

SEQ ID NO: 2256550 - DNA, 15 bp, Homo sapiens
ggaccaagggcagag

SEQ ID NO: 2256551 - DNA, 22 bp, Homo sapiens
ggaccaattctggacagacaga

SEQ ID NO: 2256552 - DNA, 17 bp, Homo sapiens
ggacctggtaccctcct

SEQ ID NO: 2256553 - DNA, 19 bp, Homo sapiens
ggacgagacccccatccag

SEQ ID NO: 2256554 - DNA, 22 bp, Homo sapiens
ggacgagacccccatccagcct

SEQ ID NO: 2256555 - DNA, 23 bp, Homo sapiens
ggacgagacccccatccagcctc

SEQ ID NO: 2256556 - DNA, 14 bp, Homo sapiens
ggacgagggccagg

SEQ ID NO: 2256557 - DNA, 21 bp, Homo sapiens
ggacgtcatcggaggctgggc

SEQ ID NO: 2256558 - DNA, 19 bp, Homo sapiens
ggactgctaaataaaattt

SEQ ID NO: 2256559 - DNA, 13 bp, Homo sapiens
ggactgtgctggt

SEQ ID NO: 2256560 - DNA, 12 bp, Homo sapiens
ggacttgtgtct

SEQ ID NO: 2256561 - DNA, 20 bp, Homo sapiens
ggagaaaattcaattgtaaa

SEQ ID NO: 2256562 - DNA, 19 bp, Homo sapiens
ggagaagacactgcagtga

SEQ ID NO: 2256563 - DNA, 17 bp, Homo sapiens
ggagacactggcccctc

SEQ ID NO: 2256564 - DNA, 20 bp, Homo sapiens
ggagacactggcccctcaaa

SEQ ID NO: 2256565 - DNA, 16 bp, Homo sapiens
ggagaccctgagtccg

SEQ ID NO: 2256566 - DNA, 14 bp, Homo sapiens
ggagaggcggcctc

SEQ ID NO: 2256567 - DNA, 16 bp, Homo sapiens
ggagaggcggcctcgt

SEQ ID NO: 2256568 - DNA, 17 bp, Homo sapiens
ggagaggcggcctcgtg

SEQ ID NO: 2256569 - DNA, 12 bp, Homo sapiens
ggagattataat

SEQ ID NO: 2256570 - DNA, 13 bp, Homo sapiens
ggagcaaggttta

SEQ ID NO: 2256571 - DNA, 17 bp, Homo sapiens
ggagccccagctaccct

SEQ ID NO: 2256572 - DNA, 16 bp, Homo sapiens
ggagcccgtctcagtg

SEQ ID NO: 2256573 - DNA, 21 bp, Homo sapiens
ggagccttcccaagttgtgct

SEQ ID NO: 2256574 - DNA, 17 bp, Homo sapiens
ggaggaaaaggcccctg

SEQ ID NO: 2256575 - DNA, 22 bp, Homo sapiens
ggaggcactttagggctgtaaa

SEQ ID NO: 2256576 - DNA, 13 bp, Homo sapiens
ggaggctgggccc

SEQ ID NO: 2256577 - DNA, 14 bp, Homo sapiens
ggaggctgggcccc

SEQ ID NO: 2256578 - DNA, 16 bp, Homo sapiens
ggaggggggggtgggg

SEQ ID NO: 2256579 - DNA, 14 bp, Homo sapiens
ggaggttgcagtga

SEQ ID NO: 2256580 - DNA, 15 bp, Homo sapiens
ggagtcccctcacct

SEQ ID NO: 2256581 - DNA, 18 bp, Homo sapiens
ggatagctaactgtaaat

SEQ ID NO: 2256582 - DNA, 21 bp, Homo sapiens
ggatccatcttgagccacagt

SEQ ID NO: 2256583 - DNA, 23 bp, Homo sapiens
ggatccccgcctggccaggagca

SEQ ID NO: 2256584 - DNA, 13 bp, Homo sapiens
ggatcctccacag

SEQ ID NO: 2256585 - DNA, 17 bp, Homo sapiens
ggatcctccacagagag

SEQ ID NO: 2256586 - DNA, 18 bp, Homo sapiens
ggatcttcccacaggagg

SEQ ID NO: 2256587 - DNA, 13 bp, Homo sapiens
ggatgatttaagt

SEQ ID NO: 2256588 - DNA, 17 bp, Homo sapiens
ggatgggggatgggcca

SEQ ID NO: 2256589 - DNA, 19 bp, Homo sapiens
ggatgggggatgggccagg

SEQ ID NO: 2256590 - DNA, 17 bp, Homo sapiens
ggatgtgtgggccagga

SEQ ID NO: 2256591 - DNA, 13 bp, Homo sapiens
ggattttaccaaa

SEQ ID NO: 2256592 - DNA, 16 bp, Homo sapiens
ggattttaccaaagca

SEQ ID NO: 2256593 - DNA, 23 bp, Homo sapiens
ggcaaaaatgtccagccaccccc

SEQ ID NO: 2256594 - DNA, 18 bp, Homo sapiens
ggcaacagatcagtaaag

SEQ ID NO: 2256595 - DNA, 16 bp, Homo sapiens
ggcaaccactaagaat

SEQ ID NO: 2256596 - DNA, 19 bp, Homo sapiens
ggcaaccactaagaattca

SEQ ID NO: 2256597 - DNA, 15 bp, Homo sapiens
ggcaacgtagcctgg

SEQ ID NO: 2256598 - DNA, 19 bp, Homo sapiens
ggcaacgtagcctgggctc

SEQ ID NO: 2256599 - DNA, 14 bp, Homo sapiens
ggcaatctctctct

SEQ ID NO: 2256600 - DNA, 14 bp, Homo sapiens
ggcacacagcagcc

SEQ ID NO: 2256601 - DNA, 16 bp, Homo sapiens
ggcacacagcagcccc

SEQ ID NO: 2256602 - DNA, 16 bp, Homo sapiens
ggcacccacatcccca

SEQ ID NO: 2256603 - DNA, 21 bp, Homo sapiens
ggcagatatagcattaataaa

SEQ ID NO: 2256604 - DNA, 22 bp, Homo sapiens
ggcagatatagcattaataaaa

SEQ ID NO: 2256605 - DNA, 16 bp, Homo sapiens
ggcagcaccctccccc

SEQ ID NO: 2256606 - DNA, 17 bp, Homo sapiens
ggcaggaggagcccgga

SEQ ID NO: 2256607 - DNA, 16 bp, Homo sapiens
ggcaggatgctgagct

SEQ ID NO: 2256608 - DNA, 20 bp, Homo sapiens
ggcaggcacacagcagcccc

SEQ ID NO: 2256609 - DNA, 13 bp, Homo sapiens
ggcaggcccactc

SEQ ID NO: 2256610 - DNA, 18 bp, Homo sapiens
ggcaggcccactccccag

SEQ ID NO: 2256611 - DNA, 10 bp, Homo sapiens
ggcaggctgg

SEQ ID NO: 2256612 - DNA, 15 bp, Homo sapiens
ggcaggctgggccat

SEQ ID NO: 2256613 - DNA, 13 bp, Homo sapiens
ggcagggggccct

SEQ ID NO: 2256614 - DNA, 15 bp, Homo sapiens
ggcagggggccctgc

SEQ ID NO: 2256615 - DNA, 21 bp, Homo sapiens
ggcagggggccctgccccacc

SEQ ID NO: 2256616 - DNA, 15 bp, Homo sapiens
ggcagggtccctcca

SEQ ID NO: 2256617 - DNA, 14 bp, Homo sapiens
ggcagggtgaccct

SEQ ID NO: 2256618 - DNA, 16 bp, Homo sapiens
ggcaggtcctgcccat

SEQ ID NO: 2256619 - DNA, 16 bp, Homo sapiens
ggcatctgttagcaga

SEQ ID NO: 2256620 - DNA, 21 bp, Homo sapiens
ggcatctgttagcagagtctg

SEQ ID NO: 2256621 - DNA, 11 bp, Homo sapiens
ggcatgtaaat

SEQ ID NO: 2256622 - DNA, 20 bp, Homo sapiens
ggcattagaattatttaaac

SEQ ID NO: 2256623 - DNA, 16 bp, Homo sapiens
ggcattgctcagcccg

SEQ ID NO: 2256624 - DNA, 18 bp, Homo sapiens
ggcattgctcagcccgct

SEQ ID NO: 2256625 - DNA, 21 bp, Homo sapiens
ggcatttggtgagagtcaaag

SEQ ID NO: 2256626 - DNA, 22 bp, Homo sapiens
ggcatttggtgagagtcaaagc

SEQ ID NO: 2256627 - DNA, 15 bp, Homo sapiens
ggcatttttatttta

SEQ ID NO: 2256628 - DNA, 17 bp, Homo sapiens
ggccagcaccctctcct

SEQ ID NO: 2256629 - DNA, 21 bp, Homo sapiens
ggccaggaccaagggcagagg

SEQ ID NO: 2256630 - DNA, 17 bp, Homo sapiens
ggccaggaggtagtttc

SEQ ID NO: 2256631 - DNA, 14 bp, Homo sapiens
ggccatccctgggc

SEQ ID NO: 2256632 - DNA, 19 bp, Homo sapiens
ggccatccctgggcccctc

SEQ ID NO: 2256633 - DNA, 15 bp, Homo sapiens
ggccatgtccaaaga

SEQ ID NO: 2256634 - DNA, 13 bp, Homo sapiens
ggcccactcccca

SEQ ID NO: 2256635 - DNA, 13 bp, Homo sapiens
ggcccactgctcg

SEQ ID NO: 2256636 - DNA, 20 bp, Homo sapiens
ggcccagagcgaggaaagga

SEQ ID NO: 2256637 - DNA, 22 bp, Homo sapiens
ggcccaggcagacaaccttgtc

SEQ ID NO: 2256638 - DNA, 23 bp, Homo sapiens
ggcccctccacgcctcctggcca

SEQ ID NO: 2256639 - DNA, 14 bp, Homo sapiens
ggcccctctgacct

SEQ ID NO: 2256640 - DNA, 20 bp, Homo sapiens
ggcccctgggatgggaccag

SEQ ID NO: 2256641 - DNA, 11 bp, Homo sapiens
ggccctccctg

SEQ ID NO: 2256642 - DNA, 13 bp, Homo sapiens
ggccctccctgac

SEQ ID NO: 2256643 - DNA, 21 bp, Homo sapiens
ggccctccctgactccctgtg

SEQ ID NO: 2256644 - DNA, 16 bp, Homo sapiens
ggccctgccccacccc

SEQ ID NO: 2256645 - DNA, 17 bp, Homo sapiens
ggccctgccccacccca

SEQ ID NO: 2256646 - DNA, 13 bp, Homo sapiens
ggccctgggcctc

SEQ ID NO: 2256647 - DNA, 15 bp, Homo sapiens
ggccctgggcctcag

SEQ ID NO: 2256648 - DNA, 23 bp, Homo sapiens
gtcaccagctatctgtcatctct

SEQ ID NO: 2256649 - DNA, 18 bp, Homo sapiens
gtcactcattgctgagcc

SEQ ID NO: 2256650 - DNA, 23 bp, Homo sapiens
gtcactcattgctgagcctctgc

SEQ ID NO: 2256651 - DNA, 17 bp, Homo sapiens
gtcacttttttctgcct

SEQ ID NO: 2256652 - DNA, 17 bp, Homo sapiens
gtcagattgctgggagg

SEQ ID NO: 2256653 - DNA, 11 bp, Homo sapiens
gtcagccagcc

SEQ ID NO: 2256654 - DNA, 21 bp, Homo sapiens
gtcatagtcttgaaatgaaag

SEQ ID NO: 2256655 - DNA, 19 bp, Homo sapiens
gtcatcggaggctgggccc

SEQ ID NO: 2256656 - DNA, 22 bp, Homo sapiens
gtcatcggaggctgggcccctg

SEQ ID NO: 2256657 - DNA, 15 bp, Homo sapiens
gtcatctctctgggg

SEQ ID NO: 2256658 - DNA, 23 bp, Homo sapiens
gtcattatttttgttagcaaaga

SEQ ID NO: 2256659 - DNA, 21 bp, Homo sapiens
gtcattcgctactatgattta

SEQ ID NO: 2256660 - DNA, 18 bp, Homo sapiens
gtccagccacccccaggc

SEQ ID NO: 2256661 - DNA, 20 bp, Homo sapiens
gtcccaaggaatcagcagga

SEQ ID NO: 2256662 - DNA, 19 bp, Homo sapiens
gtcccacccccacccccag

SEQ ID NO: 2256663 - DNA, 23 bp, Homo sapiens
gtcccacccccacccccagctca

SEQ ID NO: 2256664 - DNA, 17 bp, Homo sapiens
gtcccagtatacctcat

SEQ ID NO: 2256665 - DNA, 13 bp, Homo sapiens
gtcccatgtggtg

SEQ ID NO: 2256666 - DNA, 19 bp, Homo sapiens
gtcccctcactctgtcagc

SEQ ID NO: 2256667 - DNA, 17 bp, Homo sapiens
gtccgctaaatatttac

SEQ ID NO: 2256668 - DNA, 14 bp, Homo sapiens
gtcctaaggcccat

SEQ ID NO: 2256669 - DNA, 16 bp, Homo sapiens
gtcctcccctatttta

SEQ ID NO: 2256670 - DNA, 16 bp, Homo sapiens
gtcctctccccagcct

SEQ ID NO: 2256671 - DNA, 17 bp, Homo sapiens
gtcctctcgagcccaga

SEQ ID NO: 2256672 - DNA, 21 bp, Homo sapiens
gtcctgcccatgtgtcccctc

SEQ ID NO: 2256673 - DNA, 23 bp, Homo sapiens
gtcctgcccatgtgtcccctcac

SEQ ID NO: 2256674 - DNA, 19 bp, Homo sapiens
gtcctggagcagaccaccc

SEQ ID NO: 2256675 - DNA, 20 bp, Homo sapiens
gtcctggaggggctggggac

SEQ ID NO: 2256676 - DNA, 15 bp, Homo sapiens
gtccttagaacattt

SEQ ID NO: 2256677 - DNA, 17 bp, Homo sapiens
gtccttaggcctctgag

SEQ ID NO: 2256678 - DNA, 13 bp, Homo sapiens
gtcgccccaggcc

SEQ ID NO: 2256679 - DNA, 14 bp, Homo sapiens
gtcgccccaggccc

SEQ ID NO: 2256680 - DNA, 22 bp, Homo sapiens
gtcgccccaggccctccctgac

SEQ ID NO: 2256681 - DNA, 16 bp, Homo sapiens
gtctaaacaatgctga

SEQ ID NO: 2256682 - DNA, 12 bp, Homo sapiens
gtctacatttca

SEQ ID NO: 2256683 - DNA, 19 bp, Homo sapiens
gtctaggaactccctcaga

SEQ ID NO: 2256684 - DNA, 14 bp, Homo sapiens
gtctaggacacagt

SEQ ID NO: 2256685 - DNA, 17 bp, Homo sapiens
gtctatgattgtacttt

SEQ ID NO: 2256686 - DNA, 15 bp, Homo sapiens
gtctcactgcttgaa

SEQ ID NO: 2256687 - DNA, 14 bp, Homo sapiens
gtctcagcctctgc

SEQ ID NO: 2256688 - DNA, 16 bp, Homo sapiens
gtctcagcctctgcca

SEQ ID NO: 2256689 - DNA, 18 bp, Homo sapiens
gtctcagcctctgccagc

SEQ ID NO: 2256690 - DNA, 20 bp, Homo sapiens
gtctcagcctctgccagcgc

SEQ ID NO: 2256691 - DNA, 15 bp, Homo sapiens
gtctgaaacatttca

SEQ ID NO: 2256692 - DNA, 16 bp, Homo sapiens
gtctgaaacatttcat

SEQ ID NO: 2256693 - DNA, 14 bp, Homo sapiens
gtctgagtaagaaa

SEQ ID NO: 2256694 - DNA, 14 bp, Homo sapiens
gtctggccctgggg

SEQ ID NO: 2256695 - DNA, 15 bp, Homo sapiens
gtctgtctcttggct

SEQ ID NO: 2256696 - DNA, 13 bp, Homo sapiens
gtctgttgattaa

SEQ ID NO: 2256697 - DNA, 16 bp, Homo sapiens
gtctgttgattaaaga

SEQ ID NO: 2256698 - DNA, 19 bp, Homo sapiens
gtcttaattattatttgtg

SEQ ID NO: 2256699 - DNA, 18 bp, Homo sapiens
gtcttacataaaccattt

SEQ ID NO: 2256700 - DNA, 15 bp, Homo sapiens
gtcttctaactttat

SEQ ID NO: 2256701 - DNA, 13 bp, Homo sapiens
gtcttgaaatgaa

SEQ ID NO: 2256702 - DNA, 19 bp, Homo sapiens
gtcttgaaatgaaagggaa

SEQ ID NO: 2256703 - DNA, 20 bp, Homo sapiens
gtcttgaaatgaaagggaaa

SEQ ID NO: 2256704 - DNA, 15 bp, Homo sapiens
gtctttcacagctcc

SEQ ID NO: 2256705 - DNA, 11 bp, Homo sapiens
gtctttcagta

SEQ ID NO: 2256706 - DNA, 22 bp, Homo sapiens
gtctttccaaattatttcttaa

SEQ ID NO: 2256707 - DNA, 16 bp, Homo sapiens
gtctttccactttcat

SEQ ID NO: 2256708 - DNA, 16 bp, Homo sapiens
gtctttcctggcacta

SEQ ID NO: 2256709 - DNA, 20 bp, Homo sapiens
gtgaaaaactgctgtaaaca

SEQ ID NO: 2256710 - DNA, 15 bp, Homo sapiens
gtgaaaacggagctg

SEQ ID NO: 2256711 - DNA, 14 bp, Homo sapiens
gtgaacctgtataa

SEQ ID NO: 2256712 - DNA, 21 bp, Homo sapiens
gtgaaggattatggaaaaata

SEQ ID NO: 2256713 - DNA, 18 bp, Homo sapiens
gtgaattgtttttgtaca

SEQ ID NO: 2256714 - DNA, 19 bp, Homo sapiens
gtgaatttttattgttgta

SEQ ID NO: 2256715 - DNA, 19 bp, Homo sapiens
gtgacaattctgtttttaa

SEQ ID NO: 2256716 - DNA, 14 bp, Homo sapiens
gtgacacctccccc

SEQ ID NO: 2256717 - DNA, 15 bp, Homo sapiens
gtgacaggaaagccc

SEQ ID NO: 2256718 - DNA, 19 bp, Homo sapiens
gtgacaggaaagccctccc

SEQ ID NO: 2256719 - DNA, 18 bp, Homo sapiens
gtgacctccgtcctctcc

SEQ ID NO: 2256720 - DNA, 22 bp, Homo sapiens
gtgactgtcccaccgggagcct

SEQ ID NO: 2256721 - DNA, 23 bp, Homo sapiens
gtgactgtcccaccgggagcctc

SEQ ID NO: 2256722 - DNA, 16 bp, Homo sapiens
gtgagggtcccatgtg

SEQ ID NO: 2256723 - DNA, 14 bp, Homo sapiens
gtgtcttaattatt

SEQ ID NO: 2256724 - DNA, 16 bp, Homo sapiens
gtgtctttctaagaaa

SEQ ID NO: 2256725 - DNA, 12 bp, Homo sapiens
gtgtctttctct

SEQ ID NO: 2256726 - DNA, 19 bp, Homo sapiens
gtgtgcaatgtctgagtga

SEQ ID NO: 2256727 - DNA, 15 bp, Homo sapiens
gtgtggcctcagccc

SEQ ID NO: 2256728 - DNA, 17 bp, Homo sapiens
gtgtggcctcagccctc

SEQ ID NO: 2256729 - DNA, 13 bp, Homo sapiens
gtgtggtgcagtg

SEQ ID NO: 2256730 - DNA, 14 bp, Homo sapiens
gtgtggtgcagtgt

SEQ ID NO: 2256731 - DNA, 11 bp, Homo sapiens
gtgtgtaaaca

SEQ ID NO: 2256732 - DNA, 19 bp, Homo sapiens
gtgtgtaacactgtgtaca

SEQ ID NO: 2256733 - DNA, 16 bp, Homo sapiens
gtgtgtgggtgaaatg

SEQ ID NO: 2256734 - DNA, 13 bp, Homo sapiens
gtgttattatttt

SEQ ID NO: 2256735 - DNA, 19 bp, Homo sapiens
gtgtttttctcatatttga

SEQ ID NO: 2256736 - DNA, 18 bp, Homo sapiens
gttaaaggtgaacattgg

SEQ ID NO: 2256737 - DNA, 15 bp, Homo sapiens
gttaatacaaggtat

SEQ ID NO: 2256738 - DNA, 16 bp, Homo sapiens
gttaatacaaggtata

SEQ ID NO: 2256739 - DNA, 17 bp, Homo sapiens
gttaatgtatataaaaa

SEQ ID NO: 2256740 - DNA, 16 bp, Homo sapiens
gttactaggtaacttc

SEQ ID NO: 2256741 - DNA, 18 bp, Homo sapiens
gttactggataaattgtt

SEQ ID NO: 2256742 - DNA, 20 bp, Homo sapiens
gttagagaactaaactagtt

SEQ ID NO: 2256743 - DNA, 23 bp, Homo sapiens
gttagagaactaaactagttttt

SEQ ID NO: 2256744 - DNA, 13 bp, Homo sapiens
gttagattaagaa

SEQ ID NO: 2256745 - DNA, 11 bp, Homo sapiens
gttagcaaaga

SEQ ID NO: 2256746 - DNA, 13 bp, Homo sapiens
gttagcagagtct

SEQ ID NO: 2256747 - DNA, 18 bp, Homo sapiens
gttagcagagtctgtctc

SEQ ID NO: 2256748 - DNA, 23 bp, Homo sapiens
gttagtaacatgaggggacattt

SEQ ID NO: 2256749 - DNA, 16 bp, Homo sapiens
gttatatattgtatta

SEQ ID NO: 2256750 - DNA, 13 bp, Homo sapiens
gttatctctgtgt

SEQ ID NO: 2256751 - DNA, 19 bp, Homo sapiens
gttatgcctctgacagtcc

SEQ ID NO: 2256752 - DNA, 20 bp, Homo sapiens
gttattttgatgtaaagatg

SEQ ID NO: 2256753 - DNA, 22 bp, Homo sapiens
gttcaccatctcttcattcaaa

SEQ ID NO: 2256754 - DNA, 15 bp, Homo sapiens
gttcattcttcagat

SEQ ID NO: 2256755 - DNA, 16 bp, Homo sapiens
gttcattgcactttga

SEQ ID NO: 2256756 - DNA, 20 bp, Homo sapiens
gttccacacccaatgctgct

SEQ ID NO: 2256757 - DNA, 15 bp, Homo sapiens
gttccaccccaagag

SEQ ID NO: 2256758 - DNA, 14 bp, Homo sapiens
gttcccgtttctcc

SEQ ID NO: 2256759 - DNA, 16 bp, Homo sapiens
gttcccgtttctccac

SEQ ID NO: 2256760 - DNA, 18 bp, Homo sapiens
gttcccgtttctccacct

SEQ ID NO: 2256761 - DNA, 12 bp, Homo sapiens
gttcgatttcta

SEQ ID NO: 2256762 - DNA, 17 bp, Homo sapiens
gttcgatttctacctca

SEQ ID NO: 2256763 - DNA, 16 bp, Homo sapiens
gttcgccgcgtggaat

SEQ ID NO: 2256764 - DNA, 20 bp, Homo sapiens
gttctacctcaggcagctca

SEQ ID NO: 2256765 - DNA, 18 bp, Homo sapiens
gttctccgggtgtggcct

SEQ ID NO: 2256766 - DNA, 22 bp, Homo sapiens
gttctccttttcctctctcccg

SEQ ID NO: 2256767 - DNA, 20 bp, Homo sapiens
gttctctcaacaagaaataa

SEQ ID NO: 2256768 - DNA, 16 bp, Homo sapiens
gttctgcaaaaatatt

SEQ ID NO: 2256769 - DNA, 13 bp, Homo sapiens
gttctggccagaa

SEQ ID NO: 2256770 - DNA, 17 bp, Homo sapiens
gttctgtatattttgtt

SEQ ID NO: 2256771 - DNA, 21 bp, Homo sapiens
gttctgtatattttgttacct

SEQ ID NO: 2256772 - DNA, 23 bp, Homo sapiens
gttctgtgtctttcacagctcct

SEQ ID NO: 2256773 - DNA, 21 bp, Homo sapiens
gttgaaaaaatttaaaagtaa

SEQ ID NO: 2256774 - DNA, 19 bp, Homo sapiens
gttgaatgttgcaatgtga

SEQ ID NO: 2256775 - DNA, 15 bp, Homo sapiens
gttggaaaaaatttg

SEQ ID NO: 2256776 - DNA, 21 bp, Homo sapiens
gttgggaggatacagaggaga

SEQ ID NO: 2256777 - DNA, 22 bp, Homo sapiens
gttgggcagggtgaccctgaag

SEQ ID NO: 2256778 - DNA, 18 bp, Homo sapiens
gttgtcaggttatttatt

SEQ ID NO: 2256779 - DNA, 18 bp, Homo sapiens
gttgttttaacctcccct

SEQ ID NO: 2256780 - DNA, 17 bp, Homo sapiens
gtttagcagcagccttt

SEQ ID NO: 2256781 - DNA, 14 bp, Homo sapiens
gtttatcattcaag

SEQ ID NO: 2256782 - DNA, 17 bp, Homo sapiens
gtttatcattcaagtgt

SEQ ID NO: 2256783 - DNA, 19 bp, Homo sapiens
gtttccagacttccttgag

SEQ ID NO: 2256784 - DNA, 17 bp, Homo sapiens
gtttcctgacattgtct

SEQ ID NO: 2256785 - DNA, 18 bp, Homo sapiens
gtttcgagtaaacttgaa

SEQ ID NO: 2256786 - DNA, 14 bp, Homo sapiens
gtttctggtgtctg

SEQ ID NO: 2256787 - DNA, 17 bp, Homo sapiens
gtttctgtcgttaaaaa

SEQ ID NO: 2256788 - DNA, 19 bp, Homo sapiens
gtttctttctctgaggaca

SEQ ID NO: 2256789 - DNA, 15 bp, Homo sapiens
gtttgaaaagcaata

SEQ ID NO: 2256790 - DNA, 22 bp, Homo sapiens
gtttgaaatagttcaaactgca

SEQ ID NO: 2256791 - DNA, 16 bp, Homo sapiens
gtttggtgcaaagtat

SEQ ID NO: 2256792 - DNA, 14 bp, Homo sapiens
gtttgtgtgcatga

SEQ ID NO: 2256793 - DNA, 13 bp, Homo sapiens
gtttgtgtgtctt

SEQ ID NO: 2256794 - DNA, 14 bp, Homo sapiens
gtttgtgtgtctta

SEQ ID NO: 2256795 - DNA, 15 bp, Homo sapiens
ttctgagctgccagt

SEQ ID NO: 2256796 - DNA, 19 bp, Homo sapiens
ttctgcaaaaatatttata

SEQ ID NO: 2256797 - DNA, 19 bp, Homo sapiens
ttctggacccttataaaat

SEQ ID NO: 2256798 - DNA, 14 bp, Homo sapiens
ttctgggctgggaa

SEQ ID NO: 2256799 - DNA, 17 bp, Homo sapiens
ttctggggcaggctggg

SEQ ID NO: 2256800 - DNA, 20 bp, Homo sapiens
ttctggggcaggctgggcca

SEQ ID NO: 2256801 - DNA, 15 bp, Homo sapiens
ttctgtattttaaga

SEQ ID NO: 2256802 - DNA, 19 bp, Homo sapiens
ttctgtcacagtaaaaata

SEQ ID NO: 2256803 - DNA, 12 bp, Homo sapiens
ttctgtgtcttt

SEQ ID NO: 2256804 - DNA, 22 bp, Homo sapiens
ttctgtgtctttcacagctcct

SEQ ID NO: 2256805 - DNA, 15 bp, Homo sapiens
ttcttagaacagtgg

SEQ ID NO: 2256806 - DNA, 13 bp, Homo sapiens
ttcttagtgactt

SEQ ID NO: 2256807 - DNA, 15 bp, Homo sapiens
ttcttctctgtgaga

SEQ ID NO: 2256808 - DNA, 19 bp, Homo sapiens
ttctttccaaaacatttct

SEQ ID NO: 2256809 - DNA, 21 bp, Homo sapiens
ttctttgcaccaaagacatca

SEQ ID NO: 2256810 - DNA, 15 bp, Homo sapiens
tttactgtgatgttt

SEQ ID NO: 2256811 - DNA, 17 bp, Homo sapiens
tttactttttatttgca

SEQ ID NO: 2256812 - DNA, 23 bp, Homo sapiens
tttactttttttagtaagttaat

SEQ ID NO: 2256813 - DNA, 22 bp, Homo sapiens
tttagaaaagggagtttaaaaa

SEQ ID NO: 2256814 - DNA, 21 bp, Homo sapiens
tttagaaacctcattggccag

SEQ ID NO: 2256815 - DNA, 15 bp, Homo sapiens
tttagcaataaataa

SEQ ID NO: 2256816 - DNA, 18 bp, Homo sapiens
tttagtaatattttactt

SEQ ID NO: 2256817 - DNA, 22 bp, Homo sapiens
tttagtactgaagccaaatgaa

SEQ ID NO: 2256818 - DNA, 16 bp, Homo sapiens
tttagtgaaaaactgc

SEQ ID NO: 2256819 - DNA, 20 bp, Homo sapiens
tttagtgaaaaactgctgta

SEQ ID NO: 2256820 - DNA, 20 bp, Homo sapiens
tttataaataaaatcatgta

SEQ ID NO: 2256821 - DNA, 23 bp, Homo sapiens
tttataggactgttctttgctgt

SEQ ID NO: 2256822 - DNA, 16 bp, Homo sapiens
tttatcaatgtgtctt

SEQ ID NO: 2256823 - DNA, 20 bp, Homo sapiens
tttatcaatgtgtctttcta

SEQ ID NO: 2256824 - DNA, 14 bp, Homo sapiens
tttatcattcaagt

SEQ ID NO: 2256825 - DNA, 15 bp, Homo sapiens
tttatcattcaagtg

SEQ ID NO: 2256826 - DNA, 18 bp, Homo sapiens
tttatccagaaaactgtg

SEQ ID NO: 2256827 - DNA, 19 bp, Homo sapiens
tttatccagaaaactgtga

SEQ ID NO: 2256828 - DNA, 18 bp, Homo sapiens
tttatctcagatgttaaa

SEQ ID NO: 2256829 - DNA, 21 bp, Homo sapiens
tttatctcagatgttaaaata

SEQ ID NO: 2256830 - DNA, 17 bp, Homo sapiens
tttatgcctttctctcc

SEQ ID NO: 2256831 - DNA, 21 bp, Homo sapiens
tttattaaatacaaaacttcc

SEQ ID NO: 2256832 - DNA, 19 bp, Homo sapiens
tttatttaaattacaattt

SEQ ID NO: 2256833 - DNA, 20 bp, Homo sapiens
tttatttacagatgaatgta

SEQ ID NO: 2256834 - DNA, 22 bp, Homo sapiens
tttatttatccagaaaactgtg

SEQ ID NO: 2256835 - DNA, 14 bp, Homo sapiens
tttatttatttaca

SEQ ID NO: 2256836 - DNA, 19 bp, Homo sapiens
tttcaaacaatcaagttga

SEQ ID NO: 2256837 - DNA, 22 bp, Homo sapiens
tttcaagagtctaatagtcttt

SEQ ID NO: 2256838 - DNA, 23 bp, Homo sapiens
tttcaagtcaaattaataatctt

SEQ ID NO: 2256839 - DNA, 19 bp, Homo sapiens
tttcaataaagcatttata

SEQ ID NO: 2256840 - DNA, 14 bp, Homo sapiens
tttcaatgtgtata

SEQ ID NO: 2256841 - DNA, 15 bp, Homo sapiens
tttcaatgtttgaaa

SEQ ID NO: 2256842 - DNA, 18 bp, Homo sapiens
tttcacttaagtattgtc

SEQ ID NO: 2256843 - DNA, 16 bp, Homo sapiens
tttcagaagaaataaa

SEQ ID NO: 2256844 - DNA, 22 bp, Homo sapiens
tttcagagccagcctggctctg

SEQ ID NO: 2256845 - DNA, 23 bp, Homo sapiens
tttcaggaaatctacttcctaca

SEQ ID NO: 2256846 - DNA, 16 bp, Homo sapiens
tttcagtactttttta

SEQ ID NO: 2256847 - DNA, 16 bp, Homo sapiens
tttcagtcaaaacttt

SEQ ID NO: 2256848 - DNA, 11 bp, Homo sapiens
tttcagtgagg

SEQ ID NO: 2256849 - DNA, 17 bp, Homo sapiens
tttcatccagtttgttc

SEQ ID NO: 2256850 - DNA, 22 bp, Homo sapiens
tttcatctcatttaagggaaaa

SEQ ID NO: 2256851 - DNA, 17 bp, Homo sapiens
tttcatctggggtgggg

SEQ ID NO: 2256852 - DNA, 17 bp, Homo sapiens
tttcattgtgtatcagt

SEQ ID NO: 2256853 - DNA, 12 bp, Homo sapiens
tttccaaaacat

SEQ ID NO: 2256854 - DNA, 21 bp, Homo sapiens
tttccaaaacatttctggaca

SEQ ID NO: 2256855 - DNA, 22 bp, Homo sapiens
tttccaggctatgtataaaata

SEQ ID NO: 2256856 - DNA, 23 bp, Homo sapiens
tttccaggctatgtataaaatac

SEQ ID NO: 2256857 - DNA, 11 bp, Homo sapiens
tttcctcagtg

SEQ ID NO: 2256858 - DNA, 16 bp, Homo sapiens
tttcctggacactcag

SEQ ID NO: 2256859 - DNA, 20 bp, Homo sapiens
tttcctgtatgttgtacaat

SEQ ID NO: 2256860 - DNA, 13 bp, Homo sapiens
tttccttaatcca

SEQ ID NO: 2256861 - DNA, 15 bp, Homo sapiens
tttccttttcttaaa

SEQ ID NO: 2256862 - DNA, 18 bp, Homo sapiens
tttccttttcttaaaaca

SEQ ID NO: 2256863 - DNA, 20 bp, Homo sapiens
tttcgaagtcattaaactgg

SEQ ID NO: 2256864 - DNA, 20 bp, Homo sapiens
tttcgacgcttaacctttcc

SEQ ID NO: 2256865 - DNA, 17 bp, Homo sapiens
tttcgtataatcttgta

SEQ ID NO: 2256866 - DNA, 15 bp, Homo sapiens
tttctaattaacctt

SEQ ID NO: 2256867 - DNA, 21 bp, Homo sapiens
tttctacaatgtgaactttat

SEQ ID NO: 2256868 - DNA, 14 bp, Homo sapiens
tttctacctcagca

SEQ ID NO: 2256869 - DNA, 15 bp, Homo sapiens
tttctatcctctgta

SEQ ID NO: 2256870 - DNA, 15 bp, Homo sapiens
tttctcatatttgag

SEQ ID NO: 2256871 - DNA, 20 bp, Homo sapiens
tttctcatgacggcttttgt

SEQ ID NO: 2256872 - DNA, 15 bp, Homo sapiens
tttctccctgttcct

SEQ ID NO: 2256873 - DNA, 18 bp, Homo sapiens
tttctccctgttcctttg

SEQ ID NO: 2256874 - DNA, 15 bp, Homo sapiens
tttctctgaaagtgt

SEQ ID NO: 2256875 - DNA, 15 bp, Homo sapiens
tttctctgtactttt

SEQ ID NO: 2256876 - DNA, 12 bp, Homo sapiens
tttctgttttct

SEQ ID NO: 2256877 - DNA, 15 bp, Homo sapiens
tttcttctctgtgag

SEQ ID NO: 2256878 - DNA, 18 bp, Homo sapiens
tttcttttttaaattaat

SEQ ID NO: 2256879 - DNA, 16 bp, Homo sapiens
tttgaaatatggtctt

SEQ ID NO: 2256880 - DNA, 20 bp, Homo sapiens
tttgaaatgacatgttcctt

SEQ ID NO: 2256881 - DNA, 23 bp, Homo sapiens
tttgaatcgcttgcttgttgaaa

SEQ ID NO: 2256882 - DNA, 22 bp, Homo sapiens
tttgagagagagtcttactctg

SEQ ID NO: 2256883 - DNA, 16 bp, Homo sapiens
tttgcaaaatgagact

SEQ ID NO: 2256884 - DNA, 17 bp, Homo sapiens
tttgcaactttagtttg

SEQ ID NO: 2256885 - DNA, 15 bp, Homo sapiens
tttgcaccaaagaca

SEQ ID NO: 2256886 - DNA, 21 bp, Homo sapiens
tttgcacttgtgattatttat

SEQ ID NO: 2256887 - DNA, 16 bp, Homo sapiens
tttgcataatgcaatc

SEQ ID NO: 2256888 - DNA, 13 bp, Homo sapiens
tttgcatatttat

SEQ ID NO: 2256889 - DNA, 23 bp, Homo sapiens
tttgccaaaattcatttctaatt

SEQ ID NO: 2256890 - DNA, 12 bp, Homo sapiens
tttgcttagaaa

SEQ ID NO: 2256891 - DNA, 14 bp, Homo sapiens
tttggattaaatta

SEQ ID NO: 2256892 - DNA, 19 bp, Homo sapiens
tttggtgagagtcaaagct

SEQ ID NO: 2256893 - DNA, 12 bp, Homo sapiens
tttggtgctttt

SEQ ID NO: 2256894 - DNA, 20 bp, Homo sapiens
tttgtaaataggatttttag

SEQ ID NO: 2256895 - DNA, 11 bp, Homo sapiens
tttgtaacttc

SEQ ID NO: 2256896 - DNA, 14 bp, Homo sapiens
tttgtaacttcaaa

SEQ ID NO: 2256897 - DNA, 15 bp, Homo sapiens
tttgtaacttcaaat

SEQ ID NO: 2256898 - DNA, 20 bp, Homo sapiens
tttgtgctagaaattttcaa

SEQ ID NO: 2256899 - DNA, 14 bp, Homo sapiens
tttgtgctgtgggc

SEQ ID NO: 2256900 - DNA, 22 bp, Homo sapiens
tttgtgctgtgggcagcaccct

SEQ ID NO: 2256901 - DNA, 16 bp, Homo sapiens
tttgttaccttttaca

SEQ ID NO: 2256902 - DNA, 17 bp, Homo sapiens
tttgttaggattttcac

SEQ ID NO: 2256903 - DNA, 19 bp, Homo sapiens
tttgttctttatgtagaat

SEQ ID NO: 2256904 - DNA, 15 bp, Homo sapiens
tttgttgtaaaacaa

SEQ ID NO: 2256905 - DNA, 15 bp, Homo sapiens
tttgttttttcaatg

SEQ ID NO: 2256906 - DNA, 18 bp, Homo sapiens
tttgttttttcaatgttt

SEQ ID NO: 2256907 - DNA, 11 bp, Homo sapiens
ttttaaagaat

SEQ ID NO: 2256908 - DNA, 15 bp, Homo sapiens
ttttaaataaaagca

SEQ ID NO: 2256909 - DNA, 14 bp, Homo sapiens
ccaccagagccggg

SEQ ID NO: 2256910 - DNA, 16 bp, Homo sapiens
ccaccatgcctcacta

SEQ ID NO: 2256911 - DNA, 13 bp, Homo sapiens
ccaccccaagaga

SEQ ID NO: 2256912 - DNA, 19 bp, Homo sapiens
aactagttaataagtggta

SEQ ID NO: 2256913 - DNA, 22 bp, Homo sapiens
aactatgtgtttttctcatatt

SEQ ID NO: 2256914 - DNA, 15 bp, Homo sapiens
aactattctgttcca

SEQ ID NO: 2256915 - DNA, 17 bp, Homo sapiens
aactcatctgaaatgtt

SEQ ID NO: 2256916 - DNA, 19 bp, Homo sapiens
aactcatctgaaatgttac

SEQ ID NO: 2256917 - DNA, 19 bp, Homo sapiens
aactctggacccctgggcc

SEQ ID NO: 2256918 - DNA, 17 bp, Homo sapiens
aactcttcaaatgggag

SEQ ID NO: 2256919 - DNA, 19 bp, Homo sapiens
aactgcaataatatcaaaa

SEQ ID NO: 2256920 - DNA, 13 bp, Homo sapiens
aactgcactttta

SEQ ID NO: 2256921 - DNA, 15 bp, Homo sapiens
aactgggaaactggg

SEQ ID NO: 2256922 - DNA, 15 bp, Homo sapiens
aactgggtttctcat

SEQ ID NO: 2256923 - DNA, 12 bp, Homo sapiens
aactgtaaatca

SEQ ID NO: 2256924 - DNA, 17 bp, Homo sapiens
aacttcatatgtaatct

SEQ ID NO: 2256925 - DNA, 15 bp, Homo sapiens
aacttgttacttgca

SEQ ID NO: 2256926 - DNA, 13 bp, Homo sapiens
aactttaaacctg

SEQ ID NO: 2256927 - DNA, 22 bp, Homo sapiens
aactttatcagggaaactaaga

SEQ ID NO: 2256928 - DNA, 20 bp, Homo sapiens
aactttattctttgttcttt

SEQ ID NO: 2256929 - DNA, 15 bp, Homo sapiens
aacttttaattactg

SEQ ID NO: 2256930 - DNA, 15 bp, Homo sapiens
aactttttatttcta

SEQ ID NO: 2256931 - DNA, 21 bp, Homo sapiens
aactttttatttctaaatgag

SEQ ID NO: 2256932 - DNA, 12 bp, Homo sapiens
aagaaaagattt

SEQ ID NO: 2256933 - DNA, 13 bp, Homo sapiens
aagaaacttgaag

SEQ ID NO: 2256934 - DNA, 20 bp, Homo sapiens
aagaacatcataaaattttt

SEQ ID NO: 2256935 - DNA, 14 bp, Homo sapiens
aagaactctctgga

SEQ ID NO: 2256936 - DNA, 20 bp, Homo sapiens
aagaactgtgtttcaagttc

SEQ ID NO: 2256937 - DNA, 16 bp, Homo sapiens
aagaagcaatctcctt

SEQ ID NO: 2256938 - DNA, 16 bp, Homo sapiens
aagaataataaaatca

SEQ ID NO: 2256939 - DNA, 18 bp, Homo sapiens
aagaatagcattgtaaaa

SEQ ID NO: 2256940 - DNA, 23 bp, Homo sapiens
aagaatagcattgtaaaagcatt

SEQ ID NO: 2256941 - DNA, 17 bp, Homo sapiens
aagaatagctttaatga

SEQ ID NO: 2256942 - DNA, 14 bp, Homo sapiens
aagaattgaaacca

SEQ ID NO: 2256943 - DNA, 22 bp, Homo sapiens
aagacaatagcacttaaattcc

SEQ ID NO: 2256944 - DNA, 11 bp, Homo sapiens
aagacactgca

SEQ ID NO: 2256945 - DNA, 16 bp, Homo sapiens
aagacatcagtctcca

SEQ ID NO: 2256946 - DNA, 16 bp, Homo sapiens
aagacatttgatagaa

SEQ ID NO: 2256947 - DNA, 12 bp, Homo sapiens
aagacggaggag

SEQ ID NO: 2256948 - DNA, 19 bp, Homo sapiens
aagacggaggaggggaagg

SEQ ID NO: 2256949 - DNA, 22 bp, Homo sapiens
aagactggcttttattaatgca

SEQ ID NO: 2256950 - DNA, 11 bp, Homo sapiens
aagagaaaaag

SEQ ID NO: 2256951 - DNA, 14 bp, Homo sapiens
aagagatctttctt

SEQ ID NO: 2256952 - DNA, 21 bp, Homo sapiens
aagaggctgcccctctcacca

SEQ ID NO: 2256953 - DNA, 23 bp, Homo sapiens
aagaggctgcccctctcaccaaa

SEQ ID NO: 2256954 - DNA, 21 bp, Homo sapiens
aagataagtgtatttttcaat

SEQ ID NO: 2256955 - DNA, 23 bp, Homo sapiens
aagataatctcagtgctttcctc

SEQ ID NO: 2256956 - DNA, 12 bp, Homo sapiens
aagatgaatttg

SEQ ID NO: 2256957 - DNA, 16 bp, Homo sapiens
aagatgaatttgtcca

SEQ ID NO: 2256958 - DNA, 11 bp, Homo sapiens
aagatgtgaaa

SEQ ID NO: 2256959 - DNA, 22 bp, Homo sapiens
aagattagttgaatataagaaa

SEQ ID NO: 2256960 - DNA, 16 bp, Homo sapiens
aagattctatttaatt

SEQ ID NO: 2256961 - DNA, 14 bp, Homo sapiens
aagattcttttaaa

SEQ ID NO: 2256962 - DNA, 17 bp, Homo sapiens
aagattcttttaaatta

SEQ ID NO: 2256963 - DNA, 16 bp, Homo sapiens
aagattgatatctata

SEQ ID NO: 2256964 - DNA, 15 bp, Homo sapiens
aagattttttttgta

SEQ ID NO: 2256965 - DNA, 16 bp, Homo sapiens
aagattttttttgtaa

SEQ ID NO: 2256966 - DNA, 19 bp, Homo sapiens
aagattttttttgtaactt

SEQ ID NO: 2256967 - DNA, 20 bp, Homo sapiens
aagattttttttgtaacttc

SEQ ID NO: 2256968 - DNA, 21 bp, Homo sapiens
aagcaaagcacccatttcaat

SEQ ID NO: 2256969 - DNA, 17 bp, Homo sapiens
aagcaatattgtatatt

SEQ ID NO: 2256970 - DNA, 12 bp, Homo sapiens
aagcaatgcaag

SEQ ID NO: 2256971 - DNA, 13 bp, Homo sapiens
aagcaattatatt

SEQ ID NO: 2256972 - DNA, 17 bp, Homo sapiens
aagcaattgctcatgtt

SEQ ID NO: 2256973 - DNA, 23 bp, Homo sapiens
aagcaattgctcatgttggccaa

SEQ ID NO: 2256974 - DNA, 17 bp, Homo sapiens
aagcatactttgtaaat

SEQ ID NO: 2256975 - DNA, 18 bp, Homo sapiens
aagcatactttgtaaata

SEQ ID NO: 2256976 - DNA, 14 bp, Homo sapiens
aagcatgaaatgtg

SEQ ID NO: 2256977 - DNA, 17 bp, Homo sapiens
aagcatgaaatgtgaat

SEQ ID NO: 2256978 - DNA, 12 bp, Homo sapiens
aagcatttataa

SEQ ID NO: 2256979 - DNA, 14 bp, Homo sapiens
aagcattttgtaat

SEQ ID NO: 2256980 - DNA, 14 bp, Homo sapiens
aagccaaatgaaac

SEQ ID NO: 2256981 - DNA, 22 bp, Homo sapiens
aagccacgctgtcctctcgagc

SEQ ID NO: 2256982 - DNA, 17 bp, Homo sapiens
aagccctgcttttgcat

SEQ ID NO: 2256983 - DNA, 14 bp, Homo sapiens
aagcctctctcctt

SEQ ID NO: 2256984 - DNA, 17 bp, Homo sapiens
aagcctctctccttggc

SEQ ID NO: 2256985 - DNA, 14 bp, Homo sapiens
aagccttctgcagc

SEQ ID NO: 2256986 - DNA, 15 bp, Homo sapiens
aagcggagagagcca

SEQ ID NO: 2256987 - DNA, 19 bp, Homo sapiens
aagcttgtggccaatggaa

SEQ ID NO: 2256988 - DNA, 20 bp, Homo sapiens
aagctttatttctagctttt

SEQ ID NO: 2256989 - DNA, 21 bp, Homo sapiens
aagctttttttttttgaaccc

SEQ ID NO: 2256990 - DNA, 22 bp, Homo sapiens
aagctttttttttttgaacccc

SEQ ID NO: 2256991 - DNA, 18 bp, Homo sapiens
aaggaacacgtttttaca

SEQ ID NO: 2256992 - DNA, 17 bp, Homo sapiens
aaggactagatactact

SEQ ID NO: 2256993 - DNA, 16 bp, Homo sapiens
aaggacttctgcagct

SEQ ID NO: 2256994 - DNA, 20 bp, Homo sapiens
aaggaggttaggtcttagga

SEQ ID NO: 2256995 - DNA, 16 bp, Homo sapiens
aaggattatggaaaaa

SEQ ID NO: 2256996 - DNA, 21 bp, Homo sapiens
aaggattcagtggaggctggc

SEQ ID NO: 2256997 - DNA, 19 bp, Homo sapiens
aaggccacatacctctctg

SEQ ID NO: 2256998 - DNA, 22 bp, Homo sapiens
aaggccacatacctctctgaga

SEQ ID NO: 2256999 - DNA, 14 bp, Homo sapiens
aaggcccctgcaat

SEQ ID NO: 2257000 - DNA, 16 bp, Homo sapiens
aaggccgtgtctctga

SEQ ID NO: 2257001 - DNA, 11 bp, Homo sapiens
aagggaaaaat

SEQ ID NO: 2257002 - DNA, 12 bp, Homo sapiens
aagggaaaaata

SEQ ID NO: 2257003 - DNA, 17 bp, Homo sapiens
aagggaagtaagcaaac

SEQ ID NO: 2257004 - DNA, 16 bp, Homo sapiens
aagggatgcaggctcc

SEQ ID NO: 2257005 - DNA, 15 bp, Homo sapiens
aagggcaaataatga

SEQ ID NO: 2257006 - DNA, 22 bp, Homo sapiens
aagggcaacagatcagtaaaga

SEQ ID NO: 2257007 - DNA, 14 bp, Homo sapiens
aaggggatttttat

SEQ ID NO: 2257008 - DNA, 17 bp, Homo sapiens
aaggtactgaagcttta

SEQ ID NO: 2257009 - DNA, 15 bp, Homo sapiens
aaggtataataaaat

SEQ ID NO: 2257010 - DNA, 12 bp, Homo sapiens
aaggtctttcag

SEQ ID NO: 2257011 - DNA, 17 bp, Homo sapiens
aaggtgatatatttaaa

SEQ ID NO: 2257012 - DNA, 17 bp, Homo sapiens
aaggttatgttcatttt

SEQ ID NO: 2257013 - DNA, 21 bp, Homo sapiens
aaggttatgttcatttttcaa

SEQ ID NO: 2257014 - DNA, 20 bp, Homo sapiens
aaggtttattgttaatacaa

SEQ ID NO: 2257015 - DNA, 22 bp, Homo sapiens
aagtaaaattatcctctttgta

SEQ ID NO: 2257016 - DNA, 16 bp, Homo sapiens
aagtaatacaaactaa

SEQ ID NO: 2257017 - DNA, 12 bp, Homo sapiens
aagtattattag

SEQ ID NO: 2257018 - DNA, 14 bp, Homo sapiens
aagtattcttgtta

SEQ ID NO: 2257019 - DNA, 14 bp, Homo sapiens
aagtattctttttc

SEQ ID NO: 2257020 - DNA, 11 bp, Homo sapiens
aagtattttct

SEQ ID NO: 2257021 - DNA, 15 bp, Homo sapiens
acaccatcttttatt

SEQ ID NO: 2257022 - DNA, 13 bp, Homo sapiens
acacccatttaaa

SEQ ID NO: 2257023 - DNA, 14 bp, Homo sapiens
acaccctccagaga

SEQ ID NO: 2257024 - DNA, 13 bp, Homo sapiens
acaccctgtactg

SEQ ID NO: 2257025 - DNA, 22 bp, Homo sapiens
acacctagaaaggaactgcaat

SEQ ID NO: 2257026 - DNA, 21 bp, Homo sapiens
acacctcgtcaagagcatgca

SEQ ID NO: 2257027 - DNA, 14 bp, Homo sapiens
acaccttccagctc

SEQ ID NO: 2257028 - DNA, 14 bp, Homo sapiens
acacgtttttacat

SEQ ID NO: 2257029 - DNA, 14 bp, Homo sapiens
acactactacctct

SEQ ID NO: 2257030 - DNA, 14 bp, Homo sapiens
acactcagacctga

SEQ ID NO: 2257031 - DNA, 19 bp, Homo sapiens
acactcagacctgaattct

SEQ ID NO: 2257032 - DNA, 23 bp, Homo sapiens
acactcagtggcccatggcattt

SEQ ID NO: 2257033 - DNA, 13 bp, Homo sapiens
acactggcccctc

SEQ ID NO: 2257034 - DNA, 14 bp, Homo sapiens
acactggcccctca

SEQ ID NO: 2257035 - DNA, 18 bp, Homo sapiens
acactgtgtacacctcaa

SEQ ID NO: 2257036 - DNA, 14 bp, Homo sapiens
acacttacagagca

SEQ ID NO: 2257037 - DNA, 17 bp, Homo sapiens
acacttagccattgaaa

SEQ ID NO: 2257038 - DNA, 16 bp, Homo sapiens
acacttcattttcagg

SEQ ID NO: 2257039 - DNA, 16 bp, Homo sapiens
acacttttaattttgt

SEQ ID NO: 2257040 - DNA, 22 bp, Homo sapiens
acagaatgtgtctcaggaaaac

SEQ ID NO: 2257041 - DNA, 20 bp, Homo sapiens
acagacacgagccacctcac

SEQ ID NO: 2257042 - DNA, 20 bp, Homo sapiens
acagactggatgtaccacca

SEQ ID NO: 2257043 - DNA, 16 bp, Homo sapiens
acagaggacacagaga

SEQ ID NO: 2257044 - DNA, 13 bp, Homo sapiens
acagaggtaacta

SEQ ID NO: 2257045 - DNA, 21 bp, Homo sapiens
acagagtcttcactaaccttt

SEQ ID NO: 2257046 - DNA, 22 bp, Homo sapiens
acagatggcactttgaaggggc

SEQ ID NO: 2257047 - DNA, 17 bp, Homo sapiens
acagatgtgctgacaag

SEQ ID NO: 2257048 - DNA, 18 bp, Homo sapiens
acagcacttgttttcagg

SEQ ID NO: 2257049 - DNA, 20 bp, Homo sapiens
acagcccaggatactggcac

SEQ ID NO: 2257050 - DNA, 14 bp, Homo sapiens
acagctagtagaca

SEQ ID NO: 2257051 - DNA, 12 bp, Homo sapiens
acagctcctccc

SEQ ID NO: 2257052 - DNA, 14 bp, Homo sapiens
acagctcctcccac

SEQ ID NO: 2257053 - DNA, 16 bp, Homo sapiens
acagctgaattatcta

SEQ ID NO: 2257054 - DNA, 16 bp, Homo sapiens
acagcttaacaatgca

SEQ ID NO: 2257055 - DNA, 17 bp, Homo sapiens
acagcttaacaatgcaa

SEQ ID NO: 2257056 - DNA, 18 bp, Homo sapiens
acagcttaacaatgcaac

SEQ ID NO: 2257057 - DNA, 19 bp, Homo sapiens
acagcttaacaatgcaact

SEQ ID NO: 2257058 - DNA, 16 bp, Homo sapiens
acaggaaagccctccc

SEQ ID NO: 2257059 - DNA, 15 bp, Homo sapiens
acaggccgaggcagg

SEQ ID NO: 2257060 - DNA, 18 bp, Homo sapiens
acaggccgaggcaggagg

SEQ ID NO: 2257061 - DNA, 20 bp, Homo sapiens
acagggacatgccctgtgtg

SEQ ID NO: 2257062 - DNA, 13 bp, Homo sapiens
acagtaaaaataa

SEQ ID NO: 2257063 - DNA, 14 bp, Homo sapiens
acagtaaaaataaa

SEQ ID NO: 2257064 - DNA, 16 bp, Homo sapiens
acagtaaaaataaaat

SEQ ID NO: 2257065 - DNA, 13 bp, Homo sapiens
acagtccacaggg

SEQ ID NO: 2257066 - DNA, 23 bp, Homo sapiens
acagtgcgttgagtgtacagatt

SEQ ID NO: 2257067 - DNA, 18 bp, Homo sapiens
acagtggctcataaaaat

SEQ ID NO: 2257068 - DNA, 14 bp, Homo sapiens
acagttataaaatt

SEQ ID NO: 2257069 - DNA, 17 bp, Homo sapiens
acagttcttggtgactg

SEQ ID NO: 2257070 - DNA, 18 bp, Homo sapiens
acagttgaaaacttgtaa

SEQ ID NO: 2257071 - DNA, 16 bp, Homo sapiens
acataaaccatttttg

SEQ ID NO: 2257072 - DNA, 21 bp, Homo sapiens
acataaaccatttttgttact

SEQ ID NO: 2257073 - DNA, 13 bp, Homo sapiens
acatacctctctg

SEQ ID NO: 2257074 - DNA, 15 bp, Homo sapiens
acatacgatttaagg

SEQ ID NO: 2257075 - DNA, 19 bp, Homo sapiens
acatacgatttaaggtatt

SEQ ID NO: 2257076 - DNA, 17 bp, Homo sapiens
acatagttcgtttacct

SEQ ID NO: 2257077 - DNA, 19 bp, Homo sapiens
acatatgatctgtctgtgg

SEQ ID NO: 2257078 - DNA, 18 bp, Homo sapiens
acatcaatttaaaaagca

SEQ ID NO: 2257079 - DNA, 16 bp, Homo sapiens
acatcataaggtttta

SEQ ID NO: 2257080 - DNA, 20 bp, Homo sapiens
acatccaatattttctttaa

SEQ ID NO: 2257081 - DNA, 21 bp, Homo sapiens
acatcgcaatagttttttact

SEQ ID NO: 2257082 - DNA, 17 bp, Homo sapiens
acatgaaataaaagctt

SEQ ID NO: 2257083 - DNA, 17 bp, Homo sapiens
acatgctgtctggccct

SEQ ID NO: 2257084 - DNA, 23 bp, Homo sapiens
acatggtgcaccgagtgatttcc

SEQ ID NO: 2257085 - DNA, 14 bp, Homo sapiens
acatggtttaaaag

SEQ ID NO: 2257086 - DNA, 13 bp, Homo sapiens
acatgtaatttga

SEQ ID NO: 2257087 - DNA, 17 bp, Homo sapiens
acatgtgaaaagaatag

SEQ ID NO: 2257088 - DNA, 11 bp, Homo sapiens
acatgttactg

SEQ ID NO: 2257089 - DNA, 17 bp, Homo sapiens
acatgtttctgttttgt

SEQ ID NO: 2257090 - DNA, 22 bp, Homo sapiens
acatgtttctgttttgttgttt

SEQ ID NO: 2257091 - DNA, 16 bp, Homo sapiens
acattgttcaattaga

SEQ ID NO: 2257092 - DNA, 18 bp, Homo sapiens
acatttaaaacattaaaa

SEQ ID NO: 2257093 - DNA, 18 bp, Homo sapiens
acatttatttatccagaa

SEQ ID NO: 2257094 - DNA, 23 bp, Homo sapiens
acatttcataatttgtttccagc

SEQ ID NO: 2257095 - DNA, 18 bp, Homo sapiens
acatttgatagaaaggaa

SEQ ID NO: 2257096 - DNA, 17 bp, Homo sapiens
acatttgatgcatgtct

SEQ ID NO: 2257097 - DNA, 22 bp, Homo sapiens
acatttgatgcatgtcttttaa

SEQ ID NO: 2257098 - DNA, 18 bp, Homo sapiens
acattttggtgagaaatg

SEQ ID NO: 2257099 - DNA, 13 bp, Homo sapiens
acatttttttcta

SEQ ID NO: 2257100 - DNA, 20 bp, Homo sapiens
acatttttttctacctataa

SEQ ID NO: 2257101 - DNA, 24 bp, Homo sapiens
accaaagcatcaatacaaccagcc

SEQ ID NO: 2257102 - DNA, 14 bp, Homo sapiens
accaaattttaatt

SEQ ID NO: 2257103 - DNA, 23 bp, Homo sapiens
accaagggcagaggggtgctcat

SEQ ID NO: 2257104 - DNA, 14 bp, Homo sapiens
accacaaaatatac

SEQ ID NO: 2257105 - DNA, 18 bp, Homo sapiens
accacagggccttgaatc

SEQ ID NO: 2257106 - DNA, 18 bp, Homo sapiens
accaccccgcctgccctc

SEQ ID NO: 2257107 - DNA, 18 bp, Homo sapiens
accacggcgtttttttac

SEQ ID NO: 2257108 - DNA, 13 bp, Homo sapiens
accacttacctca

SEQ ID NO: 2257109 - DNA, 16 bp, Homo sapiens
accagagccgggagga

SEQ ID NO: 2257110 - DNA, 14 bp, Homo sapiens
accagccagcctca

SEQ ID NO: 2257111 - DNA, 22 bp, Homo sapiens
accagctaagaaaagattttaa

SEQ ID NO: 2257112 - DNA, 23 bp, Homo sapiens
accagctgaagttgcagatgtta

SEQ ID NO: 2257113 - DNA, 21 bp, Homo sapiens
accatagtaccatttatacaa

SEQ ID NO: 2257114 - DNA, 23 bp, Homo sapiens
accatctcttcattcaaactgca

SEQ ID NO: 2257115 - DNA, 17 bp, Homo sapiens
accatcttttattcttt

SEQ ID NO: 2257116 - DNA, 17 bp, Homo sapiens
accatgcctcccagagc

SEQ ID NO: 2257117 - DNA, 21 bp, Homo sapiens
accattcagtgattactgtca

SEQ ID NO: 2257118 - DNA, 13 bp, Homo sapiens
accatttatacaa

SEQ ID NO: 2257119 - DNA, 16 bp, Homo sapiens
accatttatacaaatt

SEQ ID NO: 2257120 - DNA, 15 bp, Homo sapiens
acccaagcttagaac

SEQ ID NO: 2257121 - DNA, 14 bp, Homo sapiens
acccaatgctgctc

SEQ ID NO: 2257122 - DNA, 20 bp, Homo sapiens
acccagattttgctgtatat

SEQ ID NO: 2257123 - DNA, 15 bp, Homo sapiens
acccagcgtggcctc

SEQ ID NO: 2257124 - DNA, 15 bp, Homo sapiens
acccagtgggacaga

SEQ ID NO: 2257125 - DNA, 16 bp, Homo sapiens
accccaagagaactcg

SEQ ID NO: 2257126 - DNA, 11 bp, Homo sapiens
accccaggacg

SEQ ID NO: 2257127 - DNA, 23 bp, Homo sapiens
accccaggacgccactcatttca

SEQ ID NO: 2257128 - DNA, 16 bp, Homo sapiens
accccatccagccaga

SEQ ID NO: 2257129 - DNA, 17 bp, Homo sapiens
accccatccctccccag

SEQ ID NO: 2257130 - DNA, 20 bp, Homo sapiens
agaacattaattatatgtat

SEQ ID NO: 2257131 - DNA, 20 bp, Homo sapiens
agaacgcggtgtgtaacact

SEQ ID NO: 2257132 - DNA, 13 bp, Homo sapiens
agaacgtggtcag

SEQ ID NO: 2257133 - DNA, 14 bp, Homo sapiens
agaactcactgggg

SEQ ID NO: 2257134 - DNA, 15 bp, Homo sapiens
agctttgtcgtattt

SEQ ID NO: 2257135 - DNA, 17 bp, Homo sapiens
agctttttaattaagca

SEQ ID NO: 2257136 - DNA, 21 bp, Homo sapiens
agcttttttccttaatccagc

SEQ ID NO: 2257137 - DNA, 13 bp, Homo sapiens
aggaaaacagcta

SEQ ID NO: 2257138 - DNA, 21 bp, Homo sapiens
aggaaaaggcccctgcaatgt

SEQ ID NO: 2257139 - DNA, 15 bp, Homo sapiens
aggaaacgtggcagg

SEQ ID NO: 2257140 - DNA, 12 bp, Homo sapiens
aggaaaggattt

SEQ ID NO: 2257141 - DNA, 23 bp, Homo sapiens
aggaaaggattttaccaaagcat

SEQ ID NO: 2257142 - DNA, 14 bp, Homo sapiens
aggaacaaagacag

SEQ ID NO: 2257143 - DNA, 21 bp, Homo sapiens
aggaacacgtttttacatact

SEQ ID NO: 2257144 - DNA, 21 bp, Homo sapiens
aggaagaacgcggtgtgtaac

SEQ ID NO: 2257145 - DNA, 13 bp, Homo sapiens
aggaatgaacttg

SEQ ID NO: 2257146 - DNA, 16 bp, Homo sapiens
aggaatgaacttgtta

SEQ ID NO: 2257147 - DNA, 23 bp, Homo sapiens
aggaatgaacttgttacttgcag

SEQ ID NO: 2257148 - DNA, 16 bp, Homo sapiens
aggaattacgtgctct

SEQ ID NO: 2257149 - DNA, 17 bp, Homo sapiens
aggaccaagggcagagg

SEQ ID NO: 2257150 - DNA, 20 bp, Homo sapiens
aggacgaacatccaaccttc

SEQ ID NO: 2257151 - DNA, 17 bp, Homo sapiens
aggacgccactcatttc

SEQ ID NO: 2257152 - DNA, 21 bp, Homo sapiens
aggacgtcatcggaggctggg

SEQ ID NO: 2257153 - DNA, 17 bp, Homo sapiens
aggactagatactactt

SEQ ID NO: 2257154 - DNA, 18 bp, Homo sapiens
aggactagatactacttt

SEQ ID NO: 2257155 - DNA, 22 bp, Homo sapiens
aggactagatactactttctct

SEQ ID NO: 2257156 - DNA, 13 bp, Homo sapiens
aggacttctgcag

SEQ ID NO: 2257157 - DNA, 14 bp, Homo sapiens
aggacttctgcagc

SEQ ID NO: 2257158 - DNA, 15 bp, Homo sapiens
aggacttctgcagct

SEQ ID NO: 2257159 - DNA, 13 bp, Homo sapiens
aggagaaactgag

SEQ ID NO: 2257160 - DNA, 20 bp, Homo sapiens
aggagaatagcctgaacctg

SEQ ID NO: 2257161 - DNA, 18 bp, Homo sapiens
aggagctgccttggctca

SEQ ID NO: 2257162 - DNA, 21 bp, Homo sapiens
aggagctgccttggctcagac

SEQ ID NO: 2257163 - DNA, 23 bp, Homo sapiens
aggagctgccttggctcagacat

SEQ ID NO: 2257164 - DNA, 19 bp, Homo sapiens
aggaggacacttggatttt

SEQ ID NO: 2257165 - DNA, 23 bp, Homo sapiens
aggagggagacactggcccctca

SEQ ID NO: 2257166 - DNA, 17 bp, Homo sapiens
aggaggggaaggggctg

SEQ ID NO: 2257167 - DNA, 14 bp, Homo sapiens
aggaggtagtttct

SEQ ID NO: 2257168 - DNA, 18 bp, Homo sapiens
aggaggtccttaggcctc

SEQ ID NO: 2257169 - DNA, 17 bp, Homo sapiens
aggatagctaactgtaa

SEQ ID NO: 2257170 - DNA, 13 bp, Homo sapiens
aggatatgattaa

SEQ ID NO: 2257171 - DNA, 16 bp, Homo sapiens
aggatgtatattttat

SEQ ID NO: 2257172 - DNA, 15 bp, Homo sapiens
aggatgtgtgggcca

SEQ ID NO: 2257173 - DNA, 15 bp, Homo sapiens
aggattatggaaaaa

SEQ ID NO: 2257174 - DNA, 13 bp, Homo sapiens
aggattttaccaa

SEQ ID NO: 2257175 - DNA, 12 bp, Homo sapiens
aggatttttaga

SEQ ID NO: 2257176 - DNA, 22 bp, Homo sapiens
aggcaaaaatgtccagccaccc

SEQ ID NO: 2257177 - DNA, 14 bp, Homo sapiens
aggcacacagcagc

SEQ ID NO: 2257178 - DNA, 15 bp, Homo sapiens
aggcacacagcagcc

SEQ ID NO: 2257179 - DNA, 18 bp, Homo sapiens
aggcacacagcagccccc

SEQ ID NO: 2257180 - DNA, 20 bp, Homo sapiens
aggcacacagcagcccccca

SEQ ID NO: 2257181 - DNA, 17 bp, Homo sapiens
aggcaccttttactgtg

SEQ ID NO: 2257182 - DNA, 15 bp, Homo sapiens
aggcacgaagcaatt

SEQ ID NO: 2257183 - DNA, 17 bp, Homo sapiens
aggcacgggtggtcccc

SEQ ID NO: 2257184 - DNA, 22 bp, Homo sapiens
aggcactttagggctgtaaaat

SEQ ID NO: 2257185 - DNA, 23 bp, Homo sapiens
aggcagggggaaggtggggtcct

SEQ ID NO: 2257186 - DNA, 16 bp, Homo sapiens
aggcagggggccctgc

SEQ ID NO: 2257187 - DNA, 19 bp, Homo sapiens
aggcatctgttagcagagt

SEQ ID NO: 2257188 - DNA, 21 bp, Homo sapiens
aggccaggaccaagggcagag

SEQ ID NO: 2257189 - DNA, 16 bp, Homo sapiens
aggcccactccccagc

SEQ ID NO: 2257190 - DNA, 18 bp, Homo sapiens
aggcccactccccagccc

SEQ ID NO: 2257191 - DNA, 20 bp, Homo sapiens
aggcccgctctacatcttct

SEQ ID NO: 2257192 - DNA, 10 bp, Homo sapiens
aggccctccc

SEQ ID NO: 2257193 - DNA, 16 bp, Homo sapiens
aggccgtgtctctgag

SEQ ID NO: 2257194 - DNA, 18 bp, Homo sapiens
aggccgtgtctctgagga

SEQ ID NO: 2257195 - DNA, 14 bp, Homo sapiens
aggcctagactctg

SEQ ID NO: 2257196 - DNA, 21 bp, Homo sapiens
aggcctagactctgtctacct

SEQ ID NO: 2257197 - DNA, 21 bp, Homo sapiens
aggctaaacatccaatatttt

SEQ ID NO: 2257198 - DNA, 18 bp, Homo sapiens
aggctatgtataaaatac

SEQ ID NO: 2257199 - DNA, 22 bp, Homo sapiens
aggctcactgcaacttctgcct

SEQ ID NO: 2257200 - DNA, 19 bp, Homo sapiens
aggctcaggcacatacacc

SEQ ID NO: 2257201 - DNA, 23 bp, Homo sapiens
aggctctattccaataaactatg

SEQ ID NO: 2257202 - DNA, 10 bp, Homo sapiens
aggctgggcc

SEQ ID NO: 2257203 - DNA, 21 bp, Homo sapiens
aggctgggccatgtccaaaga

SEQ ID NO: 2257204 - DNA, 15 bp, Homo sapiens
agggaaactgggaaa

SEQ ID NO: 2257205 - DNA, 21 bp, Homo sapiens
agggaaagttttgttctgtat

SEQ ID NO: 2257206 - DNA, 22 bp, Homo sapiens
agggaaagttttgttctgtata

SEQ ID NO: 2257207 - DNA, 23 bp, Homo sapiens
agggaagaaaactatcctgcggg

SEQ ID NO: 2257208 - DNA, 14 bp, Homo sapiens
agggaagagacagc

SEQ ID NO: 2257209 - DNA, 19 bp, Homo sapiens
agggacatgccctgtgtgg

SEQ ID NO: 2257210 - DNA, 14 bp, Homo sapiens
agggaccggcggac

SEQ ID NO: 2257211 - DNA, 14 bp, Homo sapiens
agggagaagacact

SEQ ID NO: 2257212 - DNA, 20 bp, Homo sapiens
agggataaagaaaaaaatac

SEQ ID NO: 2257213 - DNA, 21 bp, Homo sapiens
agggataaagaaaaaaatact

SEQ ID NO: 2257214 - DNA, 17 bp, Homo sapiens
agggatggagaggcggc

SEQ ID NO: 2257215 - DNA, 21 bp, Homo sapiens
agggcaccctagttctacctc

SEQ ID NO: 2257216 - DNA, 22 bp, Homo sapiens
agggcagggaccacaccctgta

SEQ ID NO: 2257217 - DNA, 22 bp, Homo sapiens
agggcatgccacgtgggctcat

SEQ ID NO: 2257218 - DNA, 13 bp, Homo sapiens
agggcattgctca

SEQ ID NO: 2257219 - DNA, 18 bp, Homo sapiens
agggccacatagatgctg

SEQ ID NO: 2257220 - DNA, 13 bp, Homo sapiens
agggccaggcacc

SEQ ID NO: 2257221 - DNA, 20 bp, Homo sapiens
agggcctcaaaggcccgctc

SEQ ID NO: 2257222 - DNA, 15 bp, Homo sapiens
agggccttgaatcct

SEQ ID NO: 2257223 - DNA, 19 bp, Homo sapiens
agggctccgaggagctggg

SEQ ID NO: 2257224 - DNA, 13 bp, Homo sapiens
aggggaaggggct

SEQ ID NO: 2257225 - DNA, 16 bp, Homo sapiens
aggggaaggggctgag

SEQ ID NO: 2257226 - DNA, 24 bp, Homo sapiens
aggggaccaattctggacagacag

SEQ ID NO: 2257227 - DNA, 18 bp, Homo sapiens
aggggattaatatgaaaa

SEQ ID NO: 2257228 - DNA, 20 bp, Homo sapiens
aggggccaccacctttggct

SEQ ID NO: 2257229 - DNA, 16 bp, Homo sapiens
agggggccctgcccca

SEQ ID NO: 2257230 - DNA, 21 bp, Homo sapiens
aggggggggcaatctctctct

SEQ ID NO: 2257231 - DNA, 23 bp, Homo sapiens
aggggggggtatttcaattacct

SEQ ID NO: 2257232 - DNA, 18 bp, Homo sapiens
agggtttacccagtggga

SEQ ID NO: 2257233 - DNA, 22 bp, Homo sapiens
aggtaactatcaatatttaagt

SEQ ID NO: 2257234 - DNA, 20 bp, Homo sapiens
aggtaatggttggtttttgt

SEQ ID NO: 2257235 - DNA, 23 bp, Homo sapiens
aggtactttcatattttaaacag

SEQ ID NO: 2257236 - DNA, 22 bp, Homo sapiens
aggtccctccgcggctggagcg

SEQ ID NO: 2257237 - DNA, 21 bp, Homo sapiens
aggtgaaactccagatgccac

SEQ ID NO: 2257238 - DNA, 19 bp, Homo sapiens
aggtgattctaatcatctg

SEQ ID NO: 2257239 - DNA, 14 bp, Homo sapiens
aggtgtaaagttgt

SEQ ID NO: 2257240 - DNA, 17 bp, Homo sapiens
aggttaggtcttaggaa

SEQ ID NO: 2257241 - DNA, 22 bp, Homo sapiens
atatttttgtacgttatatatt

SEQ ID NO: 2257242 - DNA, 21 bp, Homo sapiens
atatttttttaaaatgttaaa

SEQ ID NO: 2257243 - DNA, 21 bp, Homo sapiens
atcaaaacacactactacctc

SEQ ID NO: 2257244 - DNA, 14 bp, Homo sapiens
atcaaaattacata

SEQ ID NO: 2257245 - DNA, 13 bp, Homo sapiens
atcaaatacattt

SEQ ID NO: 2257246 - DNA, 17 bp, Homo sapiens
atcaagaagactttagg

SEQ ID NO: 2257247 - DNA, 21 bp, Homo sapiens
atcaagaagactttaggaatg

SEQ ID NO: 2257248 - DNA, 14 bp, Homo sapiens
atcaagtaatacaa

SEQ ID NO: 2257249 - DNA, 15 bp, Homo sapiens
atcaagtaatacaaa

SEQ ID NO: 2257250 - DNA, 16 bp, Homo sapiens
atcaagtaatacaaac

SEQ ID NO: 2257251 - DNA, 18 bp, Homo sapiens
atcaatttaaaaagcaaa

SEQ ID NO: 2257252 - DNA, 19 bp, Homo sapiens
atcaatttaaaaagcaaaa

SEQ ID NO: 2257253 - DNA, 17 bp, Homo sapiens
atcaatttaagtgttgg

SEQ ID NO: 2257254 - DNA, 17 bp, Homo sapiens
atcagagcgcacaggga

SEQ ID NO: 2257255 - DNA, 14 bp, Homo sapiens
atcagtataaacaa

SEQ ID NO: 2257256 - DNA, 18 bp, Homo sapiens
atcatagaaaattgaaac

SEQ ID NO: 2257257 - DNA, 15 bp, Homo sapiens
atcatagttactgtg

SEQ ID NO: 2257258 - DNA, 18 bp, Homo sapiens
atcatcaagtaatacaaa

SEQ ID NO: 2257259 - DNA, 11 bp, Homo sapiens
atcattttcat

SEQ ID NO: 2257260 - DNA, 14 bp, Homo sapiens
atcattttgaaatt

SEQ ID NO: 2257261 - DNA, 15 bp, Homo sapiens
atcattttgaaattg

SEQ ID NO: 2257262 - DNA, 15 bp, Homo sapiens
atccaaccattttca

SEQ ID NO: 2257263 - DNA, 19 bp, Homo sapiens
atccaatattttctttaat

SEQ ID NO: 2257264 - DNA, 15 bp, Homo sapiens
atccaattttaatat

SEQ ID NO: 2257265 - DNA, 12 bp, Homo sapiens
atccagaaaact

SEQ ID NO: 2257266 - DNA, 14 bp, Homo sapiens
atccagcctccagg

SEQ ID NO: 2257267 - DNA, 16 bp, Homo sapiens
atccagcctccagggc

SEQ ID NO: 2257268 - DNA, 17 bp, Homo sapiens
atccagctgcctattga

SEQ ID NO: 2257269 - DNA, 15 bp, Homo sapiens
atccagtttgttctc

SEQ ID NO: 2257270 - DNA, 15 bp, Homo sapiens
atcccaccccctcct

SEQ ID NO: 2257271 - DNA, 21 bp, Homo sapiens
atcccaccccctcctccccca

SEQ ID NO: 2257272 - DNA, 20 bp, Homo sapiens
atccccctctttgcacagca

SEQ ID NO: 2257273 - DNA, 20 bp, Homo sapiens
atccccgcctggccaggagc

SEQ ID NO: 2257274 - DNA, 13 bp, Homo sapiens
atcccgtgttctc

SEQ ID NO: 2257275 - DNA, 16 bp, Homo sapiens
atcccgtgttctcctt

SEQ ID NO: 2257276 - DNA, 16 bp, Homo sapiens
atcccgttttccccat

SEQ ID NO: 2257277 - DNA, 15 bp, Homo sapiens
atccctccccagttc

SEQ ID NO: 2257278 - DNA, 13 bp, Homo sapiens
atccctgggcccc

SEQ ID NO: 2257279 - DNA, 21 bp, Homo sapiens
atccctgggcccctccacgcc

SEQ ID NO: 2257280 - DNA, 16 bp, Homo sapiens
atcctacctgttttgt

SEQ ID NO: 2257281 - DNA, 16 bp, Homo sapiens
atcctcacagtgaaca

SEQ ID NO: 2257282 - DNA, 16 bp, Homo sapiens
atcctccacagagagg

SEQ ID NO: 2257283 - DNA, 16 bp, Homo sapiens
atcctctcacctcagc

SEQ ID NO: 2257284 - DNA, 12 bp, Homo sapiens
atcctgcctgcc

SEQ ID NO: 2257285 - DNA, 14 bp, Homo sapiens
atcgctcactgttg

SEQ ID NO: 2257286 - DNA, 19 bp, Homo sapiens
atctaaaagaaatgtctat

SEQ ID NO: 2257287 - DNA, 17 bp, Homo sapiens
atctaagaataataaaa

SEQ ID NO: 2257288 - DNA, 14 bp, Homo sapiens
atctataaaataga

SEQ ID NO: 2257289 - DNA, 14 bp, Homo sapiens
atctatataaaata

SEQ ID NO: 2257290 - DNA, 16 bp, Homo sapiens
atctatataaaataac

SEQ ID NO: 2257291 - DNA, 15 bp, Homo sapiens
atctatctatttgag

SEQ ID NO: 2257292 - DNA, 16 bp, Homo sapiens
atctatctatttgagg

SEQ ID NO: 2257293 - DNA, 21 bp, Homo sapiens
atctattgcttggacttaact

SEQ ID NO: 2257294 - DNA, 18 bp, Homo sapiens
atctcagatgttaaaata

SEQ ID NO: 2257295 - DNA, 14 bp, Homo sapiens
atctcagtgctttc

SEQ ID NO: 2257296 - DNA, 15 bp, Homo sapiens
atctcagtgctttcc

SEQ ID NO: 2257297 - DNA, 16 bp, Homo sapiens
atctcatttaagggaa

SEQ ID NO: 2257298 - DNA, 18 bp, Homo sapiens
atctcatttaagggaaaa

SEQ ID NO: 2257299 - DNA, 18 bp, Homo sapiens
atctccttactgtgtttc

SEQ ID NO: 2257300 - DNA, 16 bp, Homo sapiens
atctctcagagccctc

SEQ ID NO: 2257301 - DNA, 12 bp, Homo sapiens
atctctcttcca

SEQ ID NO: 2257302 - DNA, 20 bp, Homo sapiens
atctctgagttctgtgtatt

SEQ ID NO: 2257303 - DNA, 15 bp, Homo sapiens
atctcttcattcaaa

SEQ ID NO: 2257304 - DNA, 20 bp, Homo sapiens
atctcttcattcaaactgca

SEQ ID NO: 2257305 - DNA, 24 bp, Homo sapiens
atctcttcattcaaactgcacttt

SEQ ID NO: 2257306 - DNA, 15 bp, Homo sapiens
atctgataagcaaga

SEQ ID NO: 2257307 - DNA, 14 bp, Homo sapiens
atctgcaacaaaaa

SEQ ID NO: 2257308 - DNA, 21 bp, Homo sapiens
atctggaatctggagaccagg

SEQ ID NO: 2257309 - DNA, 22 bp, Homo sapiens
atctggctgcagttttgctatc

SEQ ID NO: 2257310 - DNA, 18 bp, Homo sapiens
atctgtctatattttatt

SEQ ID NO: 2257311 - DNA, 14 bp, Homo sapiens
atctgttagcagag

SEQ ID NO: 2257312 - DNA, 15 bp, Homo sapiens
atctgttagcagagt

SEQ ID NO: 2257313 - DNA, 17 bp, Homo sapiens
atctgttagcagagtct

SEQ ID NO: 2257314 - DNA, 15 bp, Homo sapiens
atcttatatgggaaa

SEQ ID NO: 2257315 - DNA, 23 bp, Homo sapiens
atcttgagccacagtcactggat

SEQ ID NO: 2257316 - DNA, 21 bp, Homo sapiens
atcttggcctaaacctcagtt

SEQ ID NO: 2257317 - DNA, 13 bp, Homo sapiens
atctttattaatc

SEQ ID NO: 2257318 - DNA, 22 bp, Homo sapiens
atctttctttccaaaacatttc

SEQ ID NO: 2257319 - DNA, 23 bp, Homo sapiens
atctttctttccaaaacatttct

SEQ ID NO: 2257320 - DNA, 21 bp, Homo sapiens
atctttgtgacaggaaagccc

SEQ ID NO: 2257321 - DNA, 13 bp, Homo sapiens
atcttttaaatac

SEQ ID NO: 2257322 - DNA, 20 bp, Homo sapiens
atgaaaacagtgtgtaaaca

SEQ ID NO: 2257323 - DNA, 14 bp, Homo sapiens
atgaaagggaaact

SEQ ID NO: 2257324 - DNA, 17 bp, Homo sapiens
atgaaatactatttaaa

SEQ ID NO: 2257325 - DNA, 12 bp, Homo sapiens
atgaaatgtgaa

SEQ ID NO: 2257326 - DNA, 19 bp, Homo sapiens
atgaacaaaattatttgta

SEQ ID NO: 2257327 - DNA, 22 bp, Homo sapiens
atgaagctgtataattaattgt

SEQ ID NO: 2257328 - DNA, 12 bp, Homo sapiens
atgaatgcagat

SEQ ID NO: 2257329 - DNA, 20 bp, Homo sapiens
atgaatgtatttatttggga

SEQ ID NO: 2257330 - DNA, 12 bp, Homo sapiens
atgaattcttta

SEQ ID NO: 2257331 - DNA, 15 bp, Homo sapiens
atgacaccatctttt

SEQ ID NO: 2257332 - DNA, 23 bp, Homo sapiens
atgacaccatcttttattctttt

SEQ ID NO: 2257333 - DNA, 15 bp, Homo sapiens
atgacacccatgcca

SEQ ID NO: 2257334 - DNA, 17 bp, Homo sapiens
atgacacccatgccaga

SEQ ID NO: 2257335 - DNA, 21 bp, Homo sapiens
atgacacccatgccagagagg

SEQ ID NO: 2257336 - DNA, 20 bp, Homo sapiens
atgacatgttcctttaaggt

SEQ ID NO: 2257337 - DNA, 21 bp, Homo sapiens
atgcaatatatccccactact

SEQ ID NO: 2257338 - DNA, 24 bp, Homo sapiens
atgcaatgtaagcatactttgtaa

SEQ ID NO: 2257339 - DNA, 21 bp, Homo sapiens
atgcacacttttaattttgtc

SEQ ID NO: 2257340 - DNA, 23 bp, Homo sapiens
atgcacacttttaattttgtcag

SEQ ID NO: 2257341 - DNA, 22 bp, Homo sapiens
atgcacatgctgtctggccctg

SEQ ID NO: 2257342 - DNA, 23 bp, Homo sapiens
atgcacatgctgtctggccctgg

SEQ ID NO: 2257343 - DNA, 19 bp, Homo sapiens
atgcacgtggggcccactg

SEQ ID NO: 2257344 - DNA, 22 bp, Homo sapiens
atgcactttctatcctctgtaa

SEQ ID NO: 2257345 - DNA, 16 bp, Homo sapiens
atgcagattacactga

SEQ ID NO: 2257346 - DNA, 23 bp, Homo sapiens
atgcagcaggaaggaacaaagac

SEQ ID NO: 2257347 - DNA, 10 bp, Homo sapiens
atgccccctg

SEQ ID NO: 2257348 - DNA, 20 bp, Homo sapiens
atgcctcactaatttttgta

SEQ ID NO: 2257349 - DNA, 23 bp, Homo sapiens
atgcctcactaatttttgtatta

SEQ ID NO: 2257350 - DNA, 20 bp, Homo sapiens
atgcctctgacagtccacag

SEQ ID NO: 2257351 - DNA, 21 bp, Homo sapiens
atgcctctgacagtccacagg

SEQ ID NO: 2257352 - DNA, 14 bp, Homo sapiens
atgcctttctctcc

SEQ ID NO: 2257353 - DNA, 23 bp, Homo sapiens
atgctgaatatacagcaggtgct

SEQ ID NO: 2257354 - DNA, 13 bp, Homo sapiens
atgctgatggagc

SEQ ID NO: 2257355 - DNA, 18 bp, Homo sapiens
atgctgcaggacttgaga

SEQ ID NO: 2257356 - DNA, 14 bp, Homo sapiens
atgctggccagcac

SEQ ID NO: 2257357 - DNA, 16 bp, Homo sapiens
atgctggccagcaccc

SEQ ID NO: 2257358 - DNA, 17 bp, Homo sapiens
atgctggccagcaccct

SEQ ID NO: 2257359 - DNA, 18 bp, Homo sapiens
atgctggccagcaccctc

SEQ ID NO: 2257360 - DNA, 16 bp, Homo sapiens
atgctggcctgtgtga

SEQ ID NO: 2257361 - DNA, 22 bp, Homo sapiens
atgcttgacaaatattttcatg

SEQ ID NO: 2257362 - DNA, 17 bp, Homo sapiens
atgcttgcataagagct

SEQ ID NO: 2257363 - DNA, 13 bp, Homo sapiens
atggaaaaataaa

SEQ ID NO: 2257364 - DNA, 13 bp, Homo sapiens
atggaaccttccc

SEQ ID NO: 2257365 - DNA, 14 bp, Homo sapiens
atggaaccttccct

SEQ ID NO: 2257366 - DNA, 15 bp, Homo sapiens
atggaaccttccctc

SEQ ID NO: 2257367 - DNA, 18 bp, Homo sapiens
atggagaggcggcctcgt

SEQ ID NO: 2257368 - DNA, 19 bp, Homo sapiens
atggatcagaggagtaaat

SEQ ID NO: 2257369 - DNA, 20 bp, Homo sapiens
atggcaagttgcatcagaaa

SEQ ID NO: 2257370 - DNA, 18 bp, Homo sapiens
atgggaaaactgccaata

SEQ ID NO: 2257371 - DNA, 11 bp, Homo sapiens
atgggaccagg

SEQ ID NO: 2257372 - DNA, 20 bp, Homo sapiens
atgggagactctttgaaatg

SEQ ID NO: 2257373 - DNA, 17 bp, Homo sapiens
atgggatccaattttaa

SEQ ID NO: 2257374 - DNA, 23 bp, Homo sapiens
atgggccagggtttacccagtgg

SEQ ID NO: 2257375 - DNA, 21 bp, Homo sapiens
atgggctcgccgtgtctcagc

SEQ ID NO: 2257376 - DNA, 17 bp, Homo sapiens
atgggctgtgtcctaag

SEQ ID NO: 2257377 - DNA, 23 bp, Homo sapiens
atgggctgtgtcctaaggcccat

SEQ ID NO: 2257378 - DNA, 17 bp, Homo sapiens
atggtatgctggccagc

SEQ ID NO: 2257379 - DNA, 15 bp, Homo sapiens
atggtgcattgtata

SEQ ID NO: 2257380 - DNA, 19 bp, Homo sapiens
atggttgaccaaggtgctt

SEQ ID NO: 2257381 - DNA, 15 bp, Homo sapiens
atgtaaatgtaaact

SEQ ID NO: 2257382 - DNA, 19 bp, Homo sapiens
atgtaagcatactttgtaa

SEQ ID NO: 2257383 - DNA, 23 bp, Homo sapiens
atgtaattttgtgtaagaaatac

SEQ ID NO: 2257384 - DNA, 14 bp, Homo sapiens
atgtactttttagt

SEQ ID NO: 2257385 - DNA, 13 bp, Homo sapiens
atgtagaattgct

SEQ ID NO: 2257386 - DNA, 19 bp, Homo sapiens
atgtagccccctggcctct

SEQ ID NO: 2257387 - DNA, 21 bp, Homo sapiens
atgtagccccctggcctctgt

SEQ ID NO: 2257388 - DNA, 23 bp, Homo sapiens
atgtagccccctggcctctgtgc

SEQ ID NO: 2257389 - DNA, 15 bp, Homo sapiens
atgtataaaatacat

SEQ ID NO: 2257390 - DNA, 13 bp, Homo sapiens
atgtatataaaaa

SEQ ID NO: 2257391 - DNA, 15 bp, Homo sapiens
atgtatataaaaatg

SEQ ID NO: 2257392 - DNA, 17 bp, Homo sapiens
atgtatcaaatacattt

SEQ ID NO: 2257393 - DNA, 13 bp, Homo sapiens
atgtattttacac

SEQ ID NO: 2257394 - DNA, 19 bp, Homo sapiens
atgtcaaatatttagatgt

SEQ ID NO: 2257395 - DNA, 18 bp, Homo sapiens
atgtcatagtcttgaaat

SEQ ID NO: 2257396 - DNA, 16 bp, Homo sapiens
atgtccaaagaggctg

SEQ ID NO: 2257397 - DNA, 19 bp, Homo sapiens
atgtccaaagaggctgccc

SEQ ID NO: 2257398 - DNA, 20 bp, Homo sapiens
atgtccaaagaggctgcccc

SEQ ID NO: 2257399 - DNA, 21 bp, Homo sapiens
atgtccaaagaggctgcccct

SEQ ID NO: 2257400 - DNA, 22 bp, Homo sapiens
atgtccaaagaggctgcccctc

SEQ ID NO: 2257401 - DNA, 19 bp, Homo sapiens
atgtccagccacccccagg

SEQ ID NO: 2257402 - DNA, 17 bp, Homo sapiens
atgtctattaaggtgat

SEQ ID NO: 2257403 - DNA, 22 bp, Homo sapiens
atgtcttctcacaagccagcca

SEQ ID NO: 2257404 - DNA, 14 bp, Homo sapiens
atgtcttttaaaat

SEQ ID NO: 2257405 - DNA, 20 bp, Homo sapiens
atgtgatttttgtaatatgt

SEQ ID NO: 2257406 - DNA, 17 bp, Homo sapiens
atgtgccttatgttgaa

SEQ ID NO: 2257407 - DNA, 15 bp, Homo sapiens
atgtggcaggagggc

SEQ ID NO: 2257408 - DNA, 22 bp, Homo sapiens
atgtggtggcacaggccccctt

SEQ ID NO: 2257409 - DNA, 11 bp, Homo sapiens
atgtgtcccct

SEQ ID NO: 2257410 - DNA, 15 bp, Homo sapiens
atgtgtcccctcact

SEQ ID NO: 2257411 - DNA, 18 bp, Homo sapiens
atgtgtcccctcactctg

SEQ ID NO: 2257412 - DNA, 19 bp, Homo sapiens
atgtgtcccctcactctgt

SEQ ID NO: 2257413 - DNA, 22 bp, Homo sapiens
atgtgtcccctcactctgtcag

SEQ ID NO: 2257414 - DNA, 19 bp, Homo sapiens
atgttaacctctgctttta

SEQ ID NO: 2257415 - DNA, 13 bp, Homo sapiens
atgttatttaaca

SEQ ID NO: 2257416 - DNA, 12 bp, Homo sapiens
atgttcattttt

SEQ ID NO: 2257417 - DNA, 15 bp, Homo sapiens
atgttcctttaaggt

SEQ ID NO: 2257418 - DNA, 18 bp, Homo sapiens
atgttgatcatgtacttt

SEQ ID NO: 2257419 - DNA, 12 bp, Homo sapiens
atgttgtagtgt

SEQ ID NO: 2257420 - DNA, 15 bp, Homo sapiens
atgtttccagacttc

SEQ ID NO: 2257421 - DNA, 18 bp, Homo sapiens
atgtttttttaattaaaa

SEQ ID NO: 2257422 - DNA, 20 bp, Homo sapiens
attaaaaagaattcttccac

SEQ ID NO: 2257423 - DNA, 23 bp, Homo sapiens
attaaaagatgtctctgcaaacc

SEQ ID NO: 2257424 - DNA, 13 bp, Homo sapiens
attaaaatataat

SEQ ID NO: 2257425 - DNA, 18 bp, Homo sapiens
attaaacttcatatgtaa

SEQ ID NO: 2257426 - DNA, 19 bp, Homo sapiens
attaacaaaatgtatgtct

SEQ ID NO: 2257427 - DNA, 18 bp, Homo sapiens
attaacttgaaaattttt

SEQ ID NO: 2257428 - DNA, 15 bp, Homo sapiens
attaacttttaatgg

SEQ ID NO: 2257429 - DNA, 12 bp, Homo sapiens
attaagaaatag

SEQ ID NO: 2257430 - DNA, 16 bp, Homo sapiens
attaagcatatgtgtt

SEQ ID NO: 2257431 - DNA, 12 bp, Homo sapiens
attaataatctt

SEQ ID NO: 2257432 - DNA, 15 bp, Homo sapiens
attaatatgaaaact

SEQ ID NO: 2257433 - DNA, 22 bp, Homo sapiens
attaatcaccctaccaacttta

SEQ ID NO: 2257434 - DNA, 19 bp, Homo sapiens
attaatcaccttctttgta

SEQ ID NO: 2257435 - DNA, 15 bp, Homo sapiens
attaatgcactttct

SEQ ID NO: 2257436 - DNA, 16 bp, Homo sapiens
attaatgcactttcta

SEQ ID NO: 2257437 - DNA, 18 bp, Homo sapiens
attaattcctgtttgtct

SEQ ID NO: 2257438 - DNA, 22 bp, Homo sapiens
attacataatttagttgtttct

SEQ ID NO: 2257439 - DNA, 22 bp, Homo sapiens
attaccaataggcaaattaatc

SEQ ID NO: 2257440 - DNA, 13 bp, Homo sapiens
attacgtgctctg

SEQ ID NO: 2257441 - DNA, 13 bp, Homo sapiens
attagaaaatatt

SEQ ID NO: 2257442 - DNA, 15 bp, Homo sapiens
attagaaaatattct

SEQ ID NO: 2257443 - DNA, 13 bp, Homo sapiens
attagaattattt

SEQ ID NO: 2257444 - DNA, 14 bp, Homo sapiens
attagagaacatcc

SEQ ID NO: 2257445 - DNA, 20 bp, Homo sapiens
attagggagaaaattcaatt

SEQ ID NO: 2257446 - DNA, 20 bp, Homo sapiens
actatggtatgctggccagc

SEQ ID NO: 2257447 - DNA, 14 bp, Homo sapiens
actatgtgtttttc

SEQ ID NO: 2257448 - DNA, 16 bp, Homo sapiens
actatttaagatgtga

SEQ ID NO: 2257449 - DNA, 17 bp, Homo sapiens
actatttaagatgtgaa

SEQ ID NO: 2257450 - DNA, 13 bp, Homo sapiens
actatttttgtaa

SEQ ID NO: 2257451 - DNA, 19 bp, Homo sapiens
actatttttgtaaaagaca

SEQ ID NO: 2257452 - DNA, 19 bp, Homo sapiens
actcaaaaccatctctctt

SEQ ID NO: 2257453 - DNA, 14 bp, Homo sapiens
actcaatactacct

SEQ ID NO: 2257454 - DNA, 15 bp, Homo sapiens
actcaatactacctc

SEQ ID NO: 2257455 - DNA, 19 bp, Homo sapiens
actcaccactaccagccag

SEQ ID NO: 2257456 - DNA, 19 bp, Homo sapiens
actcacgtgggtcctgagg

SEQ ID NO: 2257457 - DNA, 16 bp, Homo sapiens
actcatctgaaatgtt

SEQ ID NO: 2257458 - DNA, 19 bp, Homo sapiens
actcatcttatatgggaaa

SEQ ID NO: 2257459 - DNA, 20 bp, Homo sapiens
actcattgctgagcctctgc

SEQ ID NO: 2257460 - DNA, 23 bp, Homo sapiens
actcattgctgagcctctgctcc

SEQ ID NO: 2257461 - DNA, 14 bp, Homo sapiens
actcatttcatctc

SEQ ID NO: 2257462 - DNA, 18 bp, Homo sapiens
actccacgcagctggcag

SEQ ID NO: 2257463 - DNA, 13 bp, Homo sapiens
actccagccagcg

SEQ ID NO: 2257464 - DNA, 14 bp, Homo sapiens
actccagccagcgc

SEQ ID NO: 2257465 - DNA, 15 bp, Homo sapiens
actccagccagcgcc

SEQ ID NO: 2257466 - DNA, 16 bp, Homo sapiens
actccagccagcgcct

SEQ ID NO: 2257467 - DNA, 17 bp, Homo sapiens
actccagccagcgcctc

SEQ ID NO: 2257468 - DNA, 21 bp, Homo sapiens
actcccttgctggccccagcc

SEQ ID NO: 2257469 - DNA, 16 bp, Homo sapiens
actctatttttacatt

SEQ ID NO: 2257470 - DNA, 15 bp, Homo sapiens
actctctgttcagaa

SEQ ID NO: 2257471 - DNA, 15 bp, Homo sapiens
actctgtttgcttgt

SEQ ID NO: 2257472 - DNA, 23 bp, Homo sapiens
actcttcaaatgggagactcttt

SEQ ID NO: 2257473 - DNA, 16 bp, Homo sapiens
actgaagccaaatgaa

SEQ ID NO: 2257474 - DNA, 17 bp, Homo sapiens
actgaagccaaatgaaa

SEQ ID NO: 2257475 - DNA, 18 bp, Homo sapiens
actgaagccaaatgaaac

SEQ ID NO: 2257476 - DNA, 14 bp, Homo sapiens
actgaatgtcattg

SEQ ID NO: 2257477 - DNA, 16 bp, Homo sapiens
actgagaaatgaatgc

SEQ ID NO: 2257478 - DNA, 16 bp, Homo sapiens
actgcaagaaaatgat

SEQ ID NO: 2257479 - DNA, 17 bp, Homo sapiens
actgcaggtcaagttgt

SEQ ID NO: 2257480 - DNA, 17 bp, Homo sapiens
actgcagtgaccactta

SEQ ID NO: 2257481 - DNA, 15 bp, Homo sapiens
actgcatccagcctg

SEQ ID NO: 2257482 - DNA, 14 bp, Homo sapiens
actgcatctggatt

SEQ ID NO: 2257483 - DNA, 16 bp, Homo sapiens
actgctaaataaaatt

SEQ ID NO: 2257484 - DNA, 19 bp, Homo sapiens
actgctaaataaaatttgt

SEQ ID NO: 2257485 - DNA, 19 bp, Homo sapiens
actgctcgtggactgtgct

SEQ ID NO: 2257486 - DNA, 14 bp, Homo sapiens
actggaaccctttt

SEQ ID NO: 2257487 - DNA, 21 bp, Homo sapiens
actggacttcccaagataaat

SEQ ID NO: 2257488 - DNA, 13 bp, Homo sapiens
actggataaattg

SEQ ID NO: 2257489 - DNA, 19 bp, Homo sapiens
actggataaattgtttagt

SEQ ID NO: 2257490 - DNA, 14 bp, Homo sapiens
actggcacagaggt

SEQ ID NO: 2257491 - DNA, 13 bp, Homo sapiens
actggcttcagca

SEQ ID NO: 2257492 - DNA, 18 bp, Homo sapiens
actggcttttattaatgc

SEQ ID NO: 2257493 - DNA, 19 bp, Homo sapiens
actggcttttattaatgca

SEQ ID NO: 2257494 - DNA, 21 bp, Homo sapiens
actggcttttattaatgcact

SEQ ID NO: 2257495 - DNA, 21 bp, Homo sapiens
actggggcctacagctttgat

SEQ ID NO: 2257496 - DNA, 11 bp, Homo sapiens
actgtaaatca

SEQ ID NO: 2257497 - DNA, 12 bp, Homo sapiens
actgtaaatcat

SEQ ID NO: 2257498 - DNA, 22 bp, Homo sapiens
actgtcaaggctgcttagaatc

SEQ ID NO: 2257499 - DNA, 16 bp, Homo sapiens
actgtctgttctgcac

SEQ ID NO: 2257500 - DNA, 11 bp, Homo sapiens
actgtgctggg

SEQ ID NO: 2257501 - DNA, 15 bp, Homo sapiens
actgttctgtgtctt

SEQ ID NO: 2257502 - DNA, 19 bp, Homo sapiens
actgttctttgctgttgtt

SEQ ID NO: 2257503 - DNA, 22 bp, Homo sapiens
actgtttaatcatagttactgt

SEQ ID NO: 2257504 - DNA, 21 bp, Homo sapiens
actgtttgtttttatttaaat

SEQ ID NO: 2257505 - DNA, 12 bp, Homo sapiens
acttacctcaaa

SEQ ID NO: 2257506 - DNA, 19 bp, Homo sapiens
acttacttgatgattttta

SEQ ID NO: 2257507 - DNA, 13 bp, Homo sapiens
acttattctgtat

SEQ ID NO: 2257508 - DNA, 14 bp, Homo sapiens
acttcatattgctg

SEQ ID NO: 2257509 - DNA, 22 bp, Homo sapiens
acttcatattgctgagagaaat

SEQ ID NO: 2257510 - DNA, 24 bp, Homo sapiens
acttcatattgctgagagaaatat

SEQ ID NO: 2257511 - DNA, 16 bp, Homo sapiens
acttcatgtaaagtgt

SEQ ID NO: 2257512 - DNA, 15 bp, Homo sapiens
acttcctcctcccca

SEQ ID NO: 2257513 - DNA, 20 bp, Homo sapiens
acttgaactttccaaaacct

SEQ ID NO: 2257514 - DNA, 16 bp, Homo sapiens
acttggaggacctggc

SEQ ID NO: 2257515 - DNA, 14 bp, Homo sapiens
acttgtatatatgg

SEQ ID NO: 2257516 - DNA, 23 bp, Homo sapiens
acttgtatatatggatcagagga

SEQ ID NO: 2257517 - DNA, 20 bp, Homo sapiens
acttgtgattatttattatt

SEQ ID NO: 2257518 - DNA, 14 bp, Homo sapiens
acttgttctgtatt

SEQ ID NO: 2257519 - DNA, 23 bp, Homo sapiens
actttagggctgtaaaatgcatg

SEQ ID NO: 2257520 - DNA, 12 bp, Homo sapiens
actttataaatt

SEQ ID NO: 2257521 - DNA, 19 bp, Homo sapiens
actttatcaatgtgtcttt

SEQ ID NO: 2257522 - DNA, 15 bp, Homo sapiens
actttattaaataca

SEQ ID NO: 2257523 - DNA, 20 bp, Homo sapiens
actttattaaatacaaaact

SEQ ID NO: 2257524 - DNA, 19 bp, Homo sapiens
actttcatctggggtgggg

SEQ ID NO: 2257525 - DNA, 19 bp, Homo sapiens
actttctattttaatcttg

SEQ ID NO: 2257526 - DNA, 14 bp, Homo sapiens
actttcttcaggta

SEQ ID NO: 2257527 - DNA, 18 bp, Homo sapiens
actttggagtcccctcac

SEQ ID NO: 2257528 - DNA, 22 bp, Homo sapiens
actttggagtcccctcacctcc

SEQ ID NO: 2257529 - DNA, 12 bp, Homo sapiens
actttgtaaata

SEQ ID NO: 2257530 - DNA, 13 bp, Homo sapiens
actttgtaaatag

SEQ ID NO: 2257531 - DNA, 18 bp, Homo sapiens
acttttaattactgtttt

SEQ ID NO: 2257532 - DNA, 14 bp, Homo sapiens
acttttatttcctg

SEQ ID NO: 2257533 - DNA, 22 bp, Homo sapiens
acttttatttcctgtatgttgt

SEQ ID NO: 2257534 - DNA, 14 bp, Homo sapiens
acttttcattctct

SEQ ID NO: 2257535 - DNA, 12 bp, Homo sapiens
actttttataaa

SEQ ID NO: 2257536 - DNA, 14 bp, Homo sapiens
agaaaagaaaaaga

SEQ ID NO: 2257537 - DNA, 19 bp, Homo sapiens
agaaaagatgaatttgtcc

SEQ ID NO: 2257538 - DNA, 22 bp, Homo sapiens
agaaaagatgaatttgtccaat

SEQ ID NO: 2257539 - DNA, 12 bp, Homo sapiens
agaaaagatttt

SEQ ID NO: 2257540 - DNA, 18 bp, Homo sapiens
agaaaagcaatactgttt

SEQ ID NO: 2257541 - DNA, 13 bp, Homo sapiens
agaaaagtgtgta

SEQ ID NO: 2257542 - DNA, 11 bp, Homo sapiens
agaaaatattc

SEQ ID NO: 2257543 - DNA, 19 bp, Homo sapiens
agaaaatgcttgacaaata

SEQ ID NO: 2257544 - DNA, 18 bp, Homo sapiens
agaaaatgttatttaaca

SEQ ID NO: 2257545 - DNA, 12 bp, Homo sapiens
agaaaattcaat

SEQ ID NO: 2257546 - DNA, 17 bp, Homo sapiens
agaaaattcaattgtaa

SEQ ID NO: 2257547 - DNA, 14 bp, Homo sapiens
agaaaattgaaaca

SEQ ID NO: 2257548 - DNA, 15 bp, Homo sapiens
agaaaccagaaaagc

SEQ ID NO: 2257549 - DNA, 18 bp, Homo sapiens
agaaacctcattggccag

SEQ ID NO: 2257550 - DNA, 12 bp, Homo sapiens
agaaacttgaag

SEQ ID NO: 2257551 - DNA, 11 bp, Homo sapiens
agaaagcaata

SEQ ID NO: 2257552 - DNA, 16 bp, Homo sapiens
agaaatatggaactta

SEQ ID NO: 2257553 - DNA, 22 bp, Homo sapiens
agaaatatggaacttacattgt

SEQ ID NO: 2257554 - DNA, 11 bp, Homo sapiens
agaaattttca

SEQ ID NO: 2257555 - DNA, 22 bp, Homo sapiens
agaacagtggaaactatgtgtt

SEQ ID NO: 2257556 - DNA, 16 bp, Homo sapiens
agaacattaattatat

SEQ ID NO: 2257557 - DNA, 10 bp, Homo sapiens
aaaaaataca

SEQ ID NO: 2257558 - DNA, 11 bp, Homo sapiens
aaaaaattggt

SEQ ID NO: 2257559 - DNA, 12 bp, Homo sapiens
aaaaaatttgtc

SEQ ID NO: 2257560 - DNA, 17 bp, Homo sapiens
aaaaagcttgtggccaa

SEQ ID NO: 2257561 - DNA, 17 bp, Homo sapiens
aaaaagggaaagttttg

SEQ ID NO: 2257562 - DNA, 18 bp, Homo sapiens
aaaaatcccttgttctca

SEQ ID NO: 2257563 - DNA, 15 bp, Homo sapiens
aaaaatttaaaagta

SEQ ID NO: 2257564 - DNA, 19 bp, Homo sapiens
aaaacacactactacctct

SEQ ID NO: 2257565 - DNA, 17 bp, Homo sapiens
aaaacataacataaatt

SEQ ID NO: 2257566 - DNA, 11 bp, Homo sapiens
aaaacatttct

SEQ ID NO: 2257567 - DNA, 13 bp, Homo sapiens
aaaactgaaaaat

SEQ ID NO: 2257568 - DNA, 9 bp, Homo sapiens
aaaagaaaa

SEQ ID NO: 2257569 - DNA, 17 bp, Homo sapiens
aaaagaaaaaaagaaaa

SEQ ID NO: 2257570 - DNA, 15 bp, Homo sapiens
aaaagacactgcaga

SEQ ID NO: 2257571 - DNA, 14 bp, Homo sapiens
aaaagcagacattt

SEQ ID NO: 2257572 - DNA, 22 bp, Homo sapiens
aaaagggaaagttttgttctgt

SEQ ID NO: 2257573 - DNA, 19 bp, Homo sapiens
aaaagggagtttaaaaatg

SEQ ID NO: 2257574 - DNA, 18 bp, Homo sapiens
aaaagtttgaaaagcaat

SEQ ID NO: 2257575 - DNA, 17 bp, Homo sapiens
aaaataactaaaatgta

SEQ ID NO: 2257576 - DNA, 23 bp, Homo sapiens
aaaataatattaatttatttaat

SEQ ID NO: 2257577 - DNA, 14 bp, Homo sapiens
aaaataattattta

SEQ ID NO: 2257578 - DNA, 15 bp, Homo sapiens
aaaatacaattttta

SEQ ID NO: 2257579 - DNA, 21 bp, Homo sapiens
aaaatagattttataagatga

SEQ ID NO: 2257580 - DNA, 13 bp, Homo sapiens
aaaatatacaaaa

SEQ ID NO: 2257581 - DNA, 13 bp, Homo sapiens
aaaatatagctaa

SEQ ID NO: 2257582 - DNA, 13 bp, Homo sapiens
aaaatatatatct

SEQ ID NO: 2257583 - DNA, 13 bp, Homo sapiens
aaaatatttataa

SEQ ID NO: 2257584 - DNA, 21 bp, Homo sapiens
aaaatatttataaaacttctc

SEQ ID NO: 2257585 - DNA, 13 bp, Homo sapiens
aaaatattttgaa

SEQ ID NO: 2257586 - DNA, 13 bp, Homo sapiens
aaaatctctcaga

SEQ ID NO: 2257587 - DNA, 18 bp, Homo sapiens
aaaatggtatcaaaatta

SEQ ID NO: 2257588 - DNA, 12 bp, Homo sapiens
aaaatgttttaa

SEQ ID NO: 2257589 - DNA, 18 bp, Homo sapiens
aaaattactgtgaattgt

SEQ ID NO: 2257590 - DNA, 17 bp, Homo sapiens
aaaattcaattgtaaat

SEQ ID NO: 2257591 - DNA, 20 bp, Homo sapiens
aaaattcatagtaagattga

SEQ ID NO: 2257592 - DNA, 13 bp, Homo sapiens
aaaattcatttct

SEQ ID NO: 2257593 - DNA, 19 bp, Homo sapiens
aaaatttaaaagtaaaatg

SEQ ID NO: 2257594 - DNA, 10 bp, Homo sapiens
aaaattttta

SEQ ID NO: 2257595 - DNA, 13 bp, Homo sapiens
aaacaaaatttga

SEQ ID NO: 2257596 - DNA, 22 bp, Homo sapiens
aaacaccttccagctcctgtaa

SEQ ID NO: 2257597 - DNA, 15 bp, Homo sapiens
aaacagggctgcctt

SEQ ID NO: 2257598 - DNA, 13 bp, Homo sapiens
aaacagtgactgt

SEQ ID NO: 2257599 - DNA, 17 bp, Homo sapiens
aaacagtgtgtaaacaa

SEQ ID NO: 2257600 - DNA, 19 bp, Homo sapiens
aaacatccaatattttctt

SEQ ID NO: 2257601 - DNA, 22 bp, Homo sapiens
aaacatttcataatttgtttcc

SEQ ID NO: 2257602 - DNA, 23 bp, Homo sapiens
aaacatttcataatttgtttcca

SEQ ID NO: 2257603 - DNA, 22 bp, Homo sapiens
aaaccatgtagcagtgagtcat

SEQ ID NO: 2257604 - DNA, 16 bp, Homo sapiens
aaaccatttttgttac

SEQ ID NO: 2257605 - DNA, 18 bp, Homo sapiens
aaaccatttttgttactc

SEQ ID NO: 2257606 - DNA, 19 bp, Homo sapiens
aaacccaagattattaaaa

SEQ ID NO: 2257607 - DNA, 17 bp, Homo sapiens
aaaccccaaacagtgac

SEQ ID NO: 2257608 - DNA, 18 bp, Homo sapiens
aaacccctgtaggcctca

SEQ ID NO: 2257609 - DNA, 18 bp, Homo sapiens
aaacctaccctcagtgag

SEQ ID NO: 2257610 - DNA, 19 bp, Homo sapiens
aaacgggaacatgccccct

SEQ ID NO: 2257611 - DNA, 17 bp, Homo sapiens
aaacgtgtcacacttgt

SEQ ID NO: 2257612 - DNA, 15 bp, Homo sapiens
aaactaagattcttt

SEQ ID NO: 2257613 - DNA, 13 bp, Homo sapiens
aaactataaaaca

SEQ ID NO: 2257614 - DNA, 20 bp, Homo sapiens
aaactatgtgtttttctcat

SEQ ID NO: 2257615 - DNA, 14 bp, Homo sapiens
aaactatttttgta

SEQ ID NO: 2257616 - DNA, 18 bp, Homo sapiens
aaactcaaaaccatctct

SEQ ID NO: 2257617 - DNA, 17 bp, Homo sapiens
aaactcatctgaaatgt

SEQ ID NO: 2257618 - DNA, 18 bp, Homo sapiens
aaactctgttacactttt

SEQ ID NO: 2257619 - DNA, 18 bp, Homo sapiens
aaactggggcctccagaa

SEQ ID NO: 2257620 - DNA, 15 bp, Homo sapiens
aaactgtcactgttg

SEQ ID NO: 2257621 - DNA, 14 bp, Homo sapiens
aaactgtgcatctc

SEQ ID NO: 2257622 - DNA, 24 bp, Homo sapiens
aaactttaggtttttttaatgata

SEQ ID NO: 2257623 - DNA, 12 bp, Homo sapiens
aaactttgtagt

SEQ ID NO: 2257624 - DNA, 9 bp, Homo sapiens
aaagaaaaa

SEQ ID NO: 2257625 - DNA, 21 bp, Homo sapiens
aaagaaacttgaagctttgta

SEQ ID NO: 2257626 - DNA, 19 bp, Homo sapiens
aaagaaatgtctattaagg

SEQ ID NO: 2257627 - DNA, 23 bp, Homo sapiens
aaagaacgtggtcagagtagaac

SEQ ID NO: 2257628 - DNA, 19 bp, Homo sapiens
aaagaactcattcatagga

SEQ ID NO: 2257629 - DNA, 16 bp, Homo sapiens
aaagaatagaagctaa

SEQ ID NO: 2257630 - DNA, 21 bp, Homo sapiens
aaagacatcagtctccaacat

SEQ ID NO: 2257631 - DNA, 12 bp, Homo sapiens
aaagactggctt

SEQ ID NO: 2257632 - DNA, 20 bp, Homo sapiens
aaagagccttcactggttct

SEQ ID NO: 2257633 - DNA, 14 bp, Homo sapiens
aaagaggctgcccc

SEQ ID NO: 2257634 - DNA, 22 bp, Homo sapiens
aaagaggctgcccctctcacca

SEQ ID NO: 2257635 - DNA, 23 bp, Homo sapiens
aaagaggctgcccctctcaccaa

SEQ ID NO: 2257636 - DNA, 19 bp, Homo sapiens
aaagataatctcagtgctt

SEQ ID NO: 2257637 - DNA, 23 bp, Homo sapiens
aaagataatctcagtgctttcct

SEQ ID NO: 2257638 - DNA, 22 bp, Homo sapiens
aaagattctgaccttaaatgca

SEQ ID NO: 2257639 - DNA, 18 bp, Homo sapiens
aaagattttaatcaagtt

SEQ ID NO: 2257640 - DNA, 14 bp, Homo sapiens
aaagcaatattgta

SEQ ID NO: 2257641 - DNA, 15 bp, Homo sapiens
aaagcatttataaat

SEQ ID NO: 2257642 - DNA, 13 bp, Homo sapiens
aaagcattttgta

SEQ ID NO: 2257643 - DNA, 14 bp, Homo sapiens
aaagcattttgtaa

SEQ ID NO: 2257644 - DNA, 15 bp, Homo sapiens
aaagcattttgtaat

SEQ ID NO: 2257645 - DNA, 21 bp, Homo sapiens
aaagcattttgtaataataaa

SEQ ID NO: 2257646 - DNA, 14 bp, Homo sapiens
aaagccaagggcaa

SEQ ID NO: 2257647 - DNA, 20 bp, Homo sapiens
aaagctggtggcagagtcct

SEQ ID NO: 2257648 - DNA, 23 bp, Homo sapiens
aaaggattcagtggaggctggca

SEQ ID NO: 2257649 - DNA, 18 bp, Homo sapiens
aaaggattttaccaaagc

SEQ ID NO: 2257650 - DNA, 20 bp, Homo sapiens
aaaggattttaccaaagcat

SEQ ID NO: 2257651 - DNA, 15 bp, Homo sapiens
aaagggagtttaaaa

SEQ ID NO: 2257652 - DNA, 23 bp, Homo sapiens
aaaggggggggcaatctctctct

SEQ ID NO: 2257653 - DNA, 20 bp, Homo sapiens
aaagtattgtaatgagtgaa

SEQ ID NO: 2257654 - DNA, 12 bp, Homo sapiens
aaagtattttct

SEQ ID NO: 2257655 - DNA, 18 bp, Homo sapiens
aaagtctgttgattaaag

SEQ ID NO: 2257656 - DNA, 22 bp, Homo sapiens
aaagttaccagtgccttaaact

SEQ ID NO: 2257657 - DNA, 16 bp, Homo sapiens
aaagtttgcttagaaa

SEQ ID NO: 2257658 - DNA, 14 bp, Homo sapiens
aaagtttgtttgct

SEQ ID NO: 2257659 - DNA, 13 bp, Homo sapiens
aaataaaagcaca

SEQ ID NO: 2257660 - DNA, 17 bp, Homo sapiens
aaataaaatttgttgca

SEQ ID NO: 2257661 - DNA, 19 bp, Homo sapiens
aaataaaatttgttgcata

SEQ ID NO: 2257662 - DNA, 16 bp, Homo sapiens
aaataatgtatttact

SEQ ID NO: 2257663 - DNA, 12 bp, Homo sapiens
aaataattattt

SEQ ID NO: 2257664 - DNA, 18 bp, Homo sapiens
aaataattgttgtgtgta

SEQ ID NO: 2257665 - DNA, 15 bp, Homo sapiens
aaatacagtactgtt

SEQ ID NO: 2257666 - DNA, 15 bp, Homo sapiens
aaatactatttaaga

SEQ ID NO: 2257667 - DNA, 16 bp, Homo sapiens
aaatactatttaagat

SEQ ID NO: 2257668 - DNA, 18 bp, Homo sapiens
aaatactatttaagatgt

SEQ ID NO: 2257669 - DNA, 22 bp, Homo sapiens
aaatactatttaagatgtgaaa

SEQ ID NO: 2257670 - DNA, 17 bp, Homo sapiens
aaatactgcaagaaaat

SEQ ID NO: 2257671 - DNA, 14 bp, Homo sapiens
aaatagatataaat

SEQ ID NO: 2257672 - DNA, 14 bp, Homo sapiens
aaataggcttttta

SEQ ID NO: 2257673 - DNA, 16 bp, Homo sapiens
aaatataccactcttt

SEQ ID NO: 2257674 - DNA, 18 bp, Homo sapiens
aaatatatattatatatt

SEQ ID NO: 2257675 - DNA, 16 bp, Homo sapiens
aaatatggaacttaca

SEQ ID NO: 2257676 - DNA, 21 bp, Homo sapiens
aaatatggaacttacattgtt

SEQ ID NO: 2257677 - DNA, 15 bp, Homo sapiens
aaatattaagcatgt

SEQ ID NO: 2257678 - DNA, 16 bp, Homo sapiens
aaatattatttgtgtt

SEQ ID NO: 2257679 - DNA, 18 bp, Homo sapiens
aaatatttaccttgaaaa

SEQ ID NO: 2257680 - DNA, 11 bp, Homo sapiens
aaatattttct

SEQ ID NO: 2257681 - DNA, 14 bp, Homo sapiens
aaatattttctatt

SEQ ID NO: 2257682 - DNA, 21 bp, Homo sapiens
aaatattttctctgtactttt

SEQ ID NO: 2257683 - DNA, 15 bp, Homo sapiens
aaatattttgaatca

SEQ ID NO: 2257684 - DNA, 14 bp, Homo sapiens
aaatctacttccta

SEQ ID NO: 2257685 - DNA, 21 bp, Homo sapiens
aaatgaaaacagtgtgtaaac

SEQ ID NO: 2257686 - DNA, 12 bp, Homo sapiens
aaatgaaaggga

SEQ ID NO: 2257687 - DNA, 18 bp, Homo sapiens
aaatgacatgttccttta

SEQ ID NO: 2257688 - DNA, 17 bp, Homo sapiens
aaatgcagtatataggt

SEQ ID NO: 2257689 - DNA, 21 bp, Homo sapiens
aaatgcatgattttgtaaccc

SEQ ID NO: 2257690 - DNA, 20 bp, Homo sapiens
aaatgccatttagcaataaa

SEQ ID NO: 2257691 - DNA, 17 bp, Homo sapiens
aaatgcttgacaaatat

SEQ ID NO: 2257692 - DNA, 21 bp, Homo sapiens
aaatggcttcggacaaaatat

SEQ ID NO: 2257693 - DNA, 23 bp, Homo sapiens
aaatggcttcggacaaaatatct

SEQ ID NO: 2257694 - DNA, 21 bp, Homo sapiens
aaatggtatcaaaattacata

SEQ ID NO: 2257695 - DNA, 20 bp, Homo sapiens
aaatggtttggtgcttttta

SEQ ID NO: 2257696 - DNA, 20 bp, Homo sapiens
aaatgtatctaagaataata

SEQ ID NO: 2257697 - DNA, 15 bp, Homo sapiens
aaatgtcaaattgat

SEQ ID NO: 2257698 - DNA, 22 bp, Homo sapiens
aaatgtccagccacccccaggc

SEQ ID NO: 2257699 - DNA, 21 bp, Homo sapiens
aaatgtctttccaaattattt

SEQ ID NO: 2257700 - DNA, 20 bp, Homo sapiens
aaatgtgaatttttattgtt

SEQ ID NO: 2257701 - DNA, 13 bp, Homo sapiens
aaattaataatct

SEQ ID NO: 2257702 - DNA, 17 bp, Homo sapiens
aaattaatatctttctg

SEQ ID NO: 2257703 - DNA, 17 bp, Homo sapiens
aaattagaaaatattct

SEQ ID NO: 2257704 - DNA, 19 bp, Homo sapiens
aaattagaaaatattctct

SEQ ID NO: 2257705 - DNA, 20 bp, Homo sapiens
aaattagaaaatgttattta

SEQ ID NO: 2257706 - DNA, 17 bp, Homo sapiens
aaattatcctctttgta

SEQ ID NO: 2257707 - DNA, 12 bp, Homo sapiens
aaattatttctt

SEQ ID NO: 2257708 - DNA, 13 bp, Homo sapiens
aaattatttctta

SEQ ID NO: 2257709 - DNA, 23 bp, Homo sapiens
aaattcaattgtaaattgaatca

SEQ ID NO: 2257710 - DNA, 23 bp, Homo sapiens
aaattgaatcagtataaacaaag

SEQ ID NO: 2257711 - DNA, 20 bp, Homo sapiens
aaattgacacaagtggacct

SEQ ID NO: 2257712 - DNA, 22 bp, Homo sapiens
aaattggttggagaatttaggt

SEQ ID NO: 2257713 - DNA, 19 bp, Homo sapiens
aaatttaaaagtaaaatgt

SEQ ID NO: 2257714 - DNA, 20 bp, Homo sapiens
aaatttcgcttcttagaaca

SEQ ID NO: 2257715 - DNA, 18 bp, Homo sapiens
aaatttgtctgaaacatt

SEQ ID NO: 2257716 - DNA, 13 bp, Homo sapiens
aaatttgttgcat

SEQ ID NO: 2257717 - DNA, 15 bp, Homo sapiens
aacaaaaaagaaaag

SEQ ID NO: 2257718 - DNA, 14 bp, Homo sapiens
aacaaaatgaagct

SEQ ID NO: 2257719 - DNA, 14 bp, Homo sapiens
aacaaaatgtatgt

SEQ ID NO: 2257720 - DNA, 17 bp, Homo sapiens
aacaaaatgtatgtctg

SEQ ID NO: 2257721 - DNA, 22 bp, Homo sapiens
aacaagaaataatagaaatgtc

SEQ ID NO: 2257722 - DNA, 18 bp, Homo sapiens
aacaatgaagttgaaaat

SEQ ID NO: 2257723 - DNA, 16 bp, Homo sapiens
aacaatgcaactttta

SEQ ID NO: 2257724 - DNA, 15 bp, Homo sapiens
aacaatttattctga

SEQ ID NO: 2257725 - DNA, 20 bp, Homo sapiens
aacacatcataaggttttat

SEQ ID NO: 2257726 - DNA, 21 bp, Homo sapiens
aacacgtttttacatactttt

SEQ ID NO: 2257727 - DNA, 21 bp, Homo sapiens
aacagatcaacaatacctttt

SEQ ID NO: 2257728 - DNA, 12 bp, Homo sapiens
aacagctcccag

SEQ ID NO: 2257729 - DNA, 11 bp, Homo sapiens
aacagttttag

SEQ ID NO: 2257730 - DNA, 12 bp, Homo sapiens
aacagttttgtg

SEQ ID NO: 2257731 - DNA, 23 bp, Homo sapiens
aacatggtttgactcatcttata

SEQ ID NO: 2257732 - DNA, 19 bp, Homo sapiens
aacattagttttaaaaagg

SEQ ID NO: 2257733 - DNA, 14 bp, Homo sapiens
aacatttcataatt

SEQ ID NO: 2257734 - DNA, 14 bp, Homo sapiens
aacattttaattca

SEQ ID NO: 2257735 - DNA, 15 bp, Homo sapiens
aaccagaaaagcaat

SEQ ID NO: 2257736 - DNA, 19 bp, Homo sapiens
aaccaggtcagtctgtctc

SEQ ID NO: 2257737 - DNA, 19 bp, Homo sapiens
aaccataactgacaagaga

SEQ ID NO: 2257738 - DNA, 16 bp, Homo sapiens
aacccaagcttagaac

SEQ ID NO: 2257739 - DNA, 20 bp, Homo sapiens
aacccctccctcttctgccc

SEQ ID NO: 2257740 - DNA, 17 bp, Homo sapiens
aacccctgtaggcctca

SEQ ID NO: 2257741 - DNA, 17 bp, Homo sapiens
aacctagctacactgag

SEQ ID NO: 2257742 - DNA, 19 bp, Homo sapiens
aacctcattggccagctca

SEQ ID NO: 2257743 - DNA, 21 bp, Homo sapiens
aacctctcctgacccctgcct

SEQ ID NO: 2257744 - DNA, 18 bp, Homo sapiens
aacctgtagaatcaattt

SEQ ID NO: 2257745 - DNA, 13 bp, Homo sapiens
aaccttcaaagaa

SEQ ID NO: 2257746 - DNA, 21 bp, Homo sapiens
aaccttcaaagaaacttgaag

SEQ ID NO: 2257747 - DNA, 17 bp, Homo sapiens
aacctttccctcacccc

SEQ ID NO: 2257748 - DNA, 19 bp, Homo sapiens
aacctttccctcaccccct

SEQ ID NO: 2257749 - DNA, 22 bp, Homo sapiens
aacctttccgctgtcgccccag

SEQ ID NO: 2257750 - DNA, 23 bp, Homo sapiens
aacctttccgctgtcgccccagg

SEQ ID NO: 2257751 - DNA, 19 bp, Homo sapiens
aacgggaacatgccccctg

SEQ ID NO: 2257752 - DNA, 20 bp, Homo sapiens
aacgggggccttctggtttt

SEQ ID NO: 2257753 - DNA, 13 bp, Homo sapiens
aacgtagcctggg

SEQ ID NO: 2257754 - DNA, 18 bp, Homo sapiens
aacgtgtcacacttgtga

SEQ ID NO: 2257755 - DNA, 16 bp, Homo sapiens
aacgttcgatttctac

SEQ ID NO: 2257756 - DNA, 21 bp, Homo sapiens
aacgttcgatttctacctcag

SEQ ID NO: 2257757 - DNA, 17 bp, Homo sapiens
aactaaaataattttgt

SEQ ID NO: 2257758 - DNA, 12 bp, Homo sapiens
aactaaaatgta

SEQ ID NO: 2257759 - DNA, 16 bp, Homo sapiens
aactaagattctttta

SEQ ID NO: 2257760 - DNA, 15 bp, Homo sapiens
aactaatttagtaat

SEQ ID NO: 2257761 - DNA, 15 bp, Homo sapiens
aactacctgagctaa

SEQ ID NO: 2257762 - DNA, 21 bp, Homo sapiens
aactagccaaaccaggaccct

SEQ ID NO: 2257763 - DNA, 24 bp, Homo sapiens
aactatatataatcatcaagtaat

SEQ ID NO: 2257764 - DNA, 16 bp, Homo sapiens
aactatcaatatttaa

SEQ ID NO: 2257765 - DNA, 18 bp, Homo sapiens
aactatcaatatttaagt

SEQ ID NO: 2257766 - DNA, 11 bp, Homo sapiens
aactattctgt

SEQ ID NO: 2257767 - DNA, 15 bp, Homo sapiens
aactcaacattactg

SEQ ID NO: 2257768 - DNA, 22 bp, Homo sapiens
aactctggacccctgggcctca

SEQ ID NO: 2257769 - DNA, 16 bp, Homo sapiens
aactctgttacacttt

SEQ ID NO: 2257770 - DNA, 23 bp, Homo sapiens
aactgcaataatatcaaaacaag

SEQ ID NO: 2257771 - DNA, 14 bp, Homo sapiens
aactgctgtaaaca

SEQ ID NO: 2257772 - DNA, 21 bp, Homo sapiens
aactgggtttctcattaaagt

SEQ ID NO: 2257773 - DNA, 19 bp, Homo sapiens
aactgtgtttcaagttcaa

SEQ ID NO: 2257774 - DNA, 20 bp, Homo sapiens
aacttacattgttcaattag

SEQ ID NO: 2257775 - DNA, 21 bp, Homo sapiens
aacttacattgttcaattaga

SEQ ID NO: 2257776 - DNA, 21 bp, Homo sapiens
aacttatgacctcttccttta

SEQ ID NO: 2257777 - DNA, 17 bp, Homo sapiens
aacttcaaatatagaga

SEQ ID NO: 2257778 - DNA, 18 bp, Homo sapiens
aacttgtaatcttcccca

SEQ ID NO: 2257779 - DNA, 17 bp, Homo sapiens
aactttattaaatacaa

SEQ ID NO: 2257780 - DNA, 11 bp, Homo sapiens
aactttgaaag

SEQ ID NO: 2257781 - DNA, 12 bp, Homo sapiens
aactttgaaagt

SEQ ID NO: 2257782 - DNA, 18 bp, Homo sapiens
aactttggagtcccctca

SEQ ID NO: 2257783 - DNA, 12 bp, Homo sapiens
aacttttaatgg

SEQ ID NO: 2257784 - DNA, 13 bp, Homo sapiens
aacttttaatggt

SEQ ID NO: 2257785 - DNA, 14 bp, Homo sapiens
aagaaaaaaatact

SEQ ID NO: 2257786 - DNA, 15 bp, Homo sapiens
aagaaaaaaatacta

SEQ ID NO: 2257787 - DNA, 22 bp, Homo sapiens
aagaaaagattttaatcaagtt

SEQ ID NO: 2257788 - DNA, 12 bp, Homo sapiens
aagaaaagtgtg

SEQ ID NO: 2257789 - DNA, 23 bp, Homo sapiens
aagaacgcggtgtgtaacactgt

SEQ ID NO: 2257790 - DNA, 21 bp, Homo sapiens
aagaacgttttttcctcagtg

SEQ ID NO: 2257791 - DNA, 18 bp, Homo sapiens
aagaagtcggaatgtcat

SEQ ID NO: 2257792 - DNA, 17 bp, Homo sapiens
aagaatagcattgtaaa

SEQ ID NO: 2257793 - DNA, 19 bp, Homo sapiens
aagaatatcctttaaaatt

SEQ ID NO: 2257794 - DNA, 14 bp, Homo sapiens
aagaatatgacttt

SEQ ID NO: 2257795 - DNA, 16 bp, Homo sapiens
aagaatttagtattat

SEQ ID NO: 2257796 - DNA, 19 bp, Homo sapiens
aagacactgcagaaaccct

SEQ ID NO: 2257797 - DNA, 18 bp, Homo sapiens
aagacatttgatagaaag

SEQ ID NO: 2257798 - DNA, 22 bp, Homo sapiens
aagacatttgatagaaaggaac

SEQ ID NO: 2257799 - DNA, 18 bp, Homo sapiens
aagaccaccacttcgaaa

SEQ ID NO: 2257800 - DNA, 17 bp, Homo sapiens
aagacctcacctagaaa

SEQ ID NO: 2257801 - DNA, 14 bp, Homo sapiens
aagacctgaatccc

SEQ ID NO: 2257802 - DNA, 18 bp, Homo sapiens
aagacgtgaatgtctcag

SEQ ID NO: 2257803 - DNA, 21 bp, Homo sapiens
aagacgtttttgtgctgtggg

SEQ ID NO: 2257804 - DNA, 22 bp, Homo sapiens
aagacgtttttgtgctgtgggc

SEQ ID NO: 2257805 - DNA, 23 bp, Homo sapiens
aagagaatatttacaatatatga

SEQ ID NO: 2257806 - DNA, 20 bp, Homo sapiens
aagagatctttctttccaaa

SEQ ID NO: 2257807 - DNA, 14 bp, Homo sapiens
aagagcttaagaac

SEQ ID NO: 2257808 - DNA, 19 bp, Homo sapiens
aagaggaattacgtgctct

SEQ ID NO: 2257809 - DNA, 17 bp, Homo sapiens
aagaggctgcccctctc

SEQ ID NO: 2257810 - DNA, 22 bp, Homo sapiens
aagaggctgcccctctcaccaa

SEQ ID NO: 2257811 - DNA, 21 bp, Homo sapiens
aagattgatatctataaaata

SEQ ID NO: 2257812 - DNA, 14 bp, Homo sapiens
aagcaatattgtat

SEQ ID NO: 2257813 - DNA, 17 bp, Homo sapiens
aagcacaagtacttttg

SEQ ID NO: 2257814 - DNA, 19 bp, Homo sapiens
aagcagcgaccgccccctc

SEQ ID NO: 2257815 - DNA, 21 bp, Homo sapiens
aagcatatgtgttacttcaag

SEQ ID NO: 2257816 - DNA, 12 bp, Homo sapiens
aagcattttgta

SEQ ID NO: 2257817 - DNA, 17 bp, Homo sapiens
aagcattttgtaataat

SEQ ID NO: 2257818 - DNA, 19 bp, Homo sapiens
aagccaaagagcctcccac

SEQ ID NO: 2257819 - DNA, 13 bp, Homo sapiens
aagccaaatgaaa

SEQ ID NO: 2257820 - DNA, 22 bp, Homo sapiens
aagccaaccttcaaagaaactt

SEQ ID NO: 2257821 - DNA, 21 bp, Homo sapiens
aagccctcaaagaagtcggaa

SEQ ID NO: 2257822 - DNA, 22 bp, Homo sapiens
aagcctaagggatcctgcctgc

SEQ ID NO: 2257823 - DNA, 15 bp, Homo sapiens
aagcctcaaaacaaa

SEQ ID NO: 2257824 - DNA, 18 bp, Homo sapiens
aagcctcaaaacaaaggc

SEQ ID NO: 2257825 - DNA, 15 bp, Homo sapiens
aagcctgctgtcttg

SEQ ID NO: 2257826 - DNA, 13 bp, Homo sapiens
aagccttctgcag

SEQ ID NO: 2257827 - DNA, 16 bp, Homo sapiens
aagcggagagagccaa

SEQ ID NO: 2257828 - DNA, 17 bp, Homo sapiens
aagcggagagagccaag

SEQ ID NO: 2257829 - DNA, 17 bp, Homo sapiens
aagctaaggtttagata

SEQ ID NO: 2257830 - DNA, 15 bp, Homo sapiens
aagctctgaagaact

SEQ ID NO: 2257831 - DNA, 22 bp, Homo sapiens
aagctgtataattaattgtcat

SEQ ID NO: 2257832 - DNA, 20 bp, Homo sapiens
aagcttgtggccaatggaac

SEQ ID NO: 2257833 - DNA, 17 bp, Homo sapiens
aagctttcctgttgaat

SEQ ID NO: 2257834 - DNA, 21 bp, Homo sapiens
aaggaaactagacaagtaaaa

SEQ ID NO: 2257835 - DNA, 13 bp, Homo sapiens
aaggaacaaagac

SEQ ID NO: 2257836 - DNA, 21 bp, Homo sapiens
aaggaattaccaagaatatcc

SEQ ID NO: 2257837 - DNA, 13 bp, Homo sapiens
aaggaccagcttt

SEQ ID NO: 2257838 - DNA, 22 bp, Homo sapiens
aaggactagatactactttctc

SEQ ID NO: 2257839 - DNA, 20 bp, Homo sapiens
aaggagtcagacattttaag

SEQ ID NO: 2257840 - DNA, 22 bp, Homo sapiens
aaggataggccttcattaacaa

SEQ ID NO: 2257841 - DNA, 14 bp, Homo sapiens
aaggatatgattaa

SEQ ID NO: 2257842 - DNA, 17 bp, Homo sapiens
aaggattttaccaaagc

SEQ ID NO: 2257843 - DNA, 18 bp, Homo sapiens
aaggattttaccaaagca

SEQ ID NO: 2257844 - DNA, 19 bp, Homo sapiens
aaggattttaccaaagcat

SEQ ID NO: 2257845 - DNA, 20 bp, Homo sapiens
aaggattttaccaaagcatc

SEQ ID NO: 2257846 - DNA, 20 bp, Homo sapiens
aaggccacatacctctctga

SEQ ID NO: 2257847 - DNA, 16 bp, Homo sapiens
aaggcccctgcaatgt

SEQ ID NO: 2257848 - DNA, 15 bp, Homo sapiens
aagggaaaaatatat

SEQ ID NO: 2257849 - DNA, 22 bp, Homo sapiens
aagggagaagacactgcagtga

SEQ ID NO: 2257850 - DNA, 13 bp, Homo sapiens
aagggataaagaa

SEQ ID NO: 2257851 - DNA, 16 bp, Homo sapiens
aagggatcctgcctgc

SEQ ID NO: 2257852 - DNA, 15 bp, Homo sapiens
aagggcagaggggtg

SEQ ID NO: 2257853 - DNA, 14 bp, Homo sapiens
aagggcattttaaa

SEQ ID NO: 2257854 - DNA, 23 bp, Homo sapiens
aaggggcctcaccgagtgggggc

SEQ ID NO: 2257855 - DNA, 18 bp, Homo sapiens
aaggtactttcatatttt

SEQ ID NO: 2257856 - DNA, 19 bp, Homo sapiens
aaggtactttcatatttta

SEQ ID NO: 2257857 - DNA, 19 bp, Homo sapiens
aaggtctttcagtactttt

SEQ ID NO: 2257858 - DNA, 16 bp, Homo sapiens
aaggtttctggagcag

SEQ ID NO: 2257859 - DNA, 12 bp, Homo sapiens
aagtaaaatgtc

SEQ ID NO: 2257860 - DNA, 23 bp, Homo sapiens
aagtaaaattatcctctttgtaa

SEQ ID NO: 2257861 - DNA, 18 bp, Homo sapiens
aagtaatacgttttgaca

SEQ ID NO: 2257862 - DNA, 17 bp, Homo sapiens
aagtactggttgacttt

SEQ ID NO: 2257863 - DNA, 15 bp, Homo sapiens
aagtcagattgctgg

SEQ ID NO: 2257864 - DNA, 14 bp, Homo sapiens
aagtcattaaactg

SEQ ID NO: 2257865 - DNA, 16 bp, Homo sapiens
aagtcattaaactggt

SEQ ID NO: 2257866 - DNA, 17 bp, Homo sapiens
aagtcattaaactggtt

SEQ ID NO: 2257867 - DNA, 18 bp, Homo sapiens
aagtcccagtatacctca

SEQ ID NO: 2257868 - DNA, 18 bp, Homo sapiens
aagtctgtacctcaaatg

SEQ ID NO: 2257869 - DNA, 20 bp, Homo sapiens
aagtctgtacctcaaatgaa

SEQ ID NO: 2257870 - DNA, 21 bp, Homo sapiens
aagtctgtacctcaaatgaat

SEQ ID NO: 2257871 - DNA, 20 bp, Homo sapiens
aagtctgttgattaaagatg

SEQ ID NO: 2257872 - DNA, 12 bp, Homo sapiens
aagtgaaaatat

SEQ ID NO: 2257873 - DNA, 14 bp, Homo sapiens
aagtgaaaatatag

SEQ ID NO: 2257874 - DNA, 17 bp, Homo sapiens
aagtgatctgtgttcaa

SEQ ID NO: 2257875 - DNA, 16 bp, Homo sapiens
aagtgatgtcatttga

SEQ ID NO: 2257876 - DNA, 19 bp, Homo sapiens
aagtgatgtcatttgagca

SEQ ID NO: 2257877 - DNA, 22 bp, Homo sapiens
aagtgccttgctcatttgaaaa

SEQ ID NO: 2257878 - DNA, 16 bp, Homo sapiens
aagtggaggcacttta

SEQ ID NO: 2257879 - DNA, 21 bp, Homo sapiens
aagtgtataatataaaaaatt

SEQ ID NO: 2257880 - DNA, 16 bp, Homo sapiens
aagtgtgtgtagtttt

SEQ ID NO: 2257881 - DNA, 16 bp, Homo sapiens
aagtgttggaaaaaat

SEQ ID NO: 2257882 - DNA, 20 bp, Homo sapiens
aagtgttggaaaaaatttgt

SEQ ID NO: 2257883 - DNA, 17 bp, Homo sapiens
aagttaactcttcaaat

SEQ ID NO: 2257884 - DNA, 14 bp, Homo sapiens
aagttacactttta

SEQ ID NO: 2257885 - DNA, 21 bp, Homo sapiens
aagttacacttttatttcctg

SEQ ID NO: 2257886 - DNA, 14 bp, Homo sapiens
aagttattgcagtt

SEQ ID NO: 2257887 - DNA, 23 bp, Homo sapiens
aagttgaattgaggggattaata

SEQ ID NO: 2257888 - DNA, 22 bp, Homo sapiens
aagttgcagatgttagatattt

SEQ ID NO: 2257889 - DNA, 21 bp, Homo sapiens
aagttggtattaataaaaaga

SEQ ID NO: 2257890 - DNA, 18 bp, Homo sapiens
aagtttgaaaagcaatat

SEQ ID NO: 2257891 - DNA, 13 bp, Homo sapiens
aagtttgcttaga

SEQ ID NO: 2257892 - DNA, 14 bp, Homo sapiens
aagttttgttctgt

SEQ ID NO: 2257893 - DNA, 12 bp, Homo sapiens
aataaaactgtc

SEQ ID NO: 2257894 - DNA, 12 bp, Homo sapiens
aataaaagcaca

SEQ ID NO: 2257895 - DNA, 22 bp, Homo sapiens
aataaaagtattcttgttagaa

SEQ ID NO: 2257896 - DNA, 20 bp, Homo sapiens
aataaaatcatgtagtttgt

SEQ ID NO: 2257897 - DNA, 13 bp, Homo sapiens
aataaaatttgtt

SEQ ID NO: 2257898 - DNA, 11 bp, Homo sapiens
aataaagtgat

SEQ ID NO: 2257899 - DNA, 14 bp, Homo sapiens
aataaataacactt

SEQ ID NO: 2257900 - DNA, 13 bp, Homo sapiens
aataacacttgtc

SEQ ID NO: 2257901 - DNA, 22 bp, Homo sapiens
aataagaacattaattatatgt

SEQ ID NO: 2257902 - DNA, 18 bp, Homo sapiens
aataagcaaataaacagt

SEQ ID NO: 2257903 - DNA, 16 bp, Homo sapiens
aataaggcccagagcg

SEQ ID NO: 2257904 - DNA, 11 bp, Homo sapiens
aataagttatt

SEQ ID NO: 2257905 - DNA, 13 bp, Homo sapiens
aataagtttgaaa

SEQ ID NO: 2257906 - DNA, 13 bp, Homo sapiens
aataataaaatca

SEQ ID NO: 2257907 - DNA, 19 bp, Homo sapiens
aataatcttattagggaga

SEQ ID NO: 2257908 - DNA, 19 bp, Homo sapiens
aataattggagaagattta

SEQ ID NO: 2257909 - DNA, 17 bp, Homo sapiens
aataattgttgtgtgta

SEQ ID NO: 2257910 - DNA, 20 bp, Homo sapiens
aatacaaccagcccaaccat

SEQ ID NO: 2257911 - DNA, 17 bp, Homo sapiens
aatacaaggtataataa

SEQ ID NO: 2257912 - DNA, 19 bp, Homo sapiens
aatacaaggtataataaaa

SEQ ID NO: 2257913 - DNA, 13 bp, Homo sapiens
aatacattgtact

SEQ ID NO: 2257914 - DNA, 17 bp, Homo sapiens
aatacatttaaaacatt

SEQ ID NO: 2257915 - DNA, 22 bp, Homo sapiens
aatacatttaaaacattaaaat

SEQ ID NO: 2257916 - DNA, 18 bp, Homo sapiens
aataccacttacctcaaa

SEQ ID NO: 2257917 - DNA, 20 bp, Homo sapiens
aatactatttaagatgtgaa

SEQ ID NO: 2257918 - DNA, 22 bp, Homo sapiens
aatagatataaatttttaagag

SEQ ID NO: 2257919 - DNA, 21 bp, Homo sapiens
aatagattttataagatgact

SEQ ID NO: 2257920 - DNA, 15 bp, Homo sapiens
aatagctttaatgat

SEQ ID NO: 2257921 - DNA, 16 bp, Homo sapiens
aatagtctttgccagt

SEQ ID NO: 2257922 - DNA, 23 bp, Homo sapiens
aatagtgtcatcctcacagtgaa

SEQ ID NO: 2257923 - DNA, 11 bp, Homo sapiens
aatataaaaaa

SEQ ID NO: 2257924 - DNA, 14 bp, Homo sapiens
aatataataatgat

SEQ ID NO: 2257925 - DNA, 11 bp, Homo sapiens
aatatagagat

SEQ ID NO: 2257926 - DNA, 16 bp, Homo sapiens
aatatagagatatttt

SEQ ID NO: 2257927 - DNA, 20 bp, Homo sapiens
aatatagagatatttttgta

SEQ ID NO: 2257928 - DNA, 22 bp, Homo sapiens
aatatatatctatctatttgag

SEQ ID NO: 2257929 - DNA, 14 bp, Homo sapiens
aatatatctctatt

SEQ ID NO: 2257930 - DNA, 15 bp, Homo sapiens
aatatattatttcct

SEQ ID NO: 2257931 - DNA, 18 bp, Homo sapiens
aatatggtcttttggtta

SEQ ID NO: 2257932 - DNA, 19 bp, Homo sapiens
aatattaacttttaatggt

SEQ ID NO: 2257933 - DNA, 20 bp, Homo sapiens
aatattatttgtgtttccta

SEQ ID NO: 2257934 - DNA, 18 bp, Homo sapiens
aatattctctatttgaat

SEQ ID NO: 2257935 - DNA, 18 bp, Homo sapiens
aatattttctttaatgct

SEQ ID NO: 2257936 - DNA, 15 bp, Homo sapiens
aatattttgaatcaa

SEQ ID NO: 2257937 - DNA, 20 bp, Homo sapiens
aatattttgaatcaataata

SEQ ID NO: 2257938 - DNA, 13 bp, Homo sapiens
aatcaaaacacac

SEQ ID NO: 2257939 - DNA, 12 bp, Homo sapiens
aatcaatttaag

SEQ ID NO: 2257940 - DNA, 16 bp, Homo sapiens
aatcaccaaaggagct

SEQ ID NO: 2257941 - DNA, 15 bp, Homo sapiens
aatcaccttctttgt

SEQ ID NO: 2257942 - DNA, 16 bp, Homo sapiens
aatcaccttctttgta

SEQ ID NO: 2257943 - DNA, 17 bp, Homo sapiens
aatcaccttctttgtaa

SEQ ID NO: 2257944 - DNA, 22 bp, Homo sapiens
aatcactgcactgcatgcaaac

SEQ ID NO: 2257945 - DNA, 19 bp, Homo sapiens
aatcagcatatgtgtaaag

SEQ ID NO: 2257946 - DNA, 15 bp, Homo sapiens
aatcatagttactgt

SEQ ID NO: 2257947 - DNA, 19 bp, Homo sapiens
aatcatagttactgtgtaa

SEQ ID NO: 2257948 - DNA, 12 bp, Homo sapiens
aatcatcaagta

SEQ ID NO: 2257949 - DNA, 13 bp, Homo sapiens
aatcatgtagttt

SEQ ID NO: 2257950 - DNA, 16 bp, Homo sapiens
aatcatttgtttacat

SEQ ID NO: 2257951 - DNA, 22 bp, Homo sapiens
aatcatttgtttacatttgatg

SEQ ID NO: 2257952 - DNA, 17 bp, Homo sapiens
aatcattttcattccta

SEQ ID NO: 2257953 - DNA, 21 bp, Homo sapiens
aatccaaacttggatttttga

SEQ ID NO: 2257954 - DNA, 18 bp, Homo sapiens
aatccaaccattttcatt

SEQ ID NO: 2257955 - DNA, 19 bp, Homo sapiens
aatcccttcacagtcccag

SEQ ID NO: 2257956 - DNA, 17 bp, Homo sapiens
aatcctacctcaaaatt

SEQ ID NO: 2257957 - DNA, 19 bp, Homo sapiens
aatccttctattctagcct

SEQ ID NO: 2257958 - DNA, 22 bp, Homo sapiens
aatccttctattctagcctgca

SEQ ID NO: 2257959 - DNA, 19 bp, Homo sapiens
aatccttgataatatattg

SEQ ID NO: 2257960 - DNA, 17 bp, Homo sapiens
aatctaaatttcttttg

SEQ ID NO: 2257961 - DNA, 19 bp, Homo sapiens
aatctaaatttcttttgct

SEQ ID NO: 2257962 - DNA, 23 bp, Homo sapiens
aatctacttcctacagagccaaa

SEQ ID NO: 2257963 - DNA, 14 bp, Homo sapiens
aatctcagtgcttt

SEQ ID NO: 2257964 - DNA, 18 bp, Homo sapiens
aatctctcagagccctca

SEQ ID NO: 2257965 - DNA, 11 bp, Homo sapiens
aatctctctct

SEQ ID NO: 2257966 - DNA, 20 bp, Homo sapiens
aatcttattagggagaaaat

SEQ ID NO: 2257967 - DNA, 22 bp, Homo sapiens
aatgaaagggaaactgggaaac

SEQ ID NO: 2257968 - DNA, 13 bp, Homo sapiens
aatgaacttgtta

SEQ ID NO: 2257969 - DNA, 15 bp, Homo sapiens
aatgaacttgttact

SEQ ID NO: 2257970 - DNA, 18 bp, Homo sapiens
aatgacatgttcctttaa

SEQ ID NO: 2257971 - DNA, 21 bp, Homo sapiens
aatgagactttctaaatcaaa

SEQ ID NO: 2257972 - DNA, 18 bp, Homo sapiens
aatgatatgcttgtaact

SEQ ID NO: 2257973 - DNA, 17 bp, Homo sapiens
aatgatcagctatatac

SEQ ID NO: 2257974 - DNA, 23 bp, Homo sapiens
aatgatcgaaaaaataattattt

SEQ ID NO: 2257975 - DNA, 13 bp, Homo sapiens
aatgcaaccattt

SEQ ID NO: 2257976 - DNA, 17 bp, Homo sapiens
aatgcaaccatttgaaa

SEQ ID NO: 2257977 - DNA, 13 bp, Homo sapiens
aatgcactttcta

SEQ ID NO: 2257978 - DNA, 19 bp, Homo sapiens
aatgcagcaggaaggaaca

SEQ ID NO: 2257979 - DNA, 19 bp, Homo sapiens
aatgcatctagattatgga

SEQ ID NO: 2257980 - DNA, 16 bp, Homo sapiens
aatgctatttgaacaa

SEQ ID NO: 2257981 - DNA, 15 bp, Homo sapiens
aatgcttagaaattc

SEQ ID NO: 2257982 - DNA, 16 bp, Homo sapiens
aatggaagcaattgct

SEQ ID NO: 2257983 - DNA, 17 bp, Homo sapiens
aatggactggaagggga

SEQ ID NO: 2257984 - DNA, 21 bp, Homo sapiens
aatggaggaactttccaaaca

SEQ ID NO: 2257985 - DNA, 16 bp, Homo sapiens
aatggtatcaaaatta

SEQ ID NO: 2257986 - DNA, 16 bp, Homo sapiens
aatgtaagcatacttt

SEQ ID NO: 2257987 - DNA, 14 bp, Homo sapiens
aatgtatataaaaa

SEQ ID NO: 2257988 - DNA, 18 bp, Homo sapiens
aatgtatcaaatacattt

SEQ ID NO: 2257989 - DNA, 13 bp, Homo sapiens
aatgtatctaaga

SEQ ID NO: 2257990 - DNA, 14 bp, Homo sapiens
aatgtcattgaaaa

SEQ ID NO: 2257991 - DNA, 12 bp, Homo sapiens
aatgtctgtgaa

SEQ ID NO: 2257992 - DNA, 20 bp, Homo sapiens
aatgtgaatttttattgttg

SEQ ID NO: 2257993 - DNA, 18 bp, Homo sapiens
aatgtgtataaattgtct

SEQ ID NO: 2257994 - DNA, 14 bp, Homo sapiens
aatgtgtctcagga

SEQ ID NO: 2257995 - DNA, 15 bp, Homo sapiens
aatgtgtctttctaa

SEQ ID NO: 2257996 - DNA, 18 bp, Homo sapiens
aatgtgtctttctaagaa

SEQ ID NO: 2257997 - DNA, 13 bp, Homo sapiens
aatgttgggactg

SEQ ID NO: 2257998 - DNA, 22 bp, Homo sapiens
aatgttgggactgctaaataaa

SEQ ID NO: 2257999 - DNA, 14 bp, Homo sapiens
aatgttttaaattc

SEQ ID NO: 2258000 - DNA, 16 bp, Homo sapiens
aattaaaactcaacat

SEQ ID NO: 2258001 - DNA, 20 bp, Homo sapiens
aattaaaactcaacattact

SEQ ID NO: 2258002 - DNA, 16 bp, Homo sapiens
aattaaagtactttaa

SEQ ID NO: 2258003 - DNA, 15 bp, Homo sapiens
aattaattgtcatta

SEQ ID NO: 2258004 - DNA, 14 bp, Homo sapiens
aattacaattttat

SEQ ID NO: 2258005 - DNA, 14 bp, Homo sapiens
aattacgtgctctg

SEQ ID NO: 2258006 - DNA, 19 bp, Homo sapiens
aattagaaaatattctcta

SEQ ID NO: 2258007 - DNA, 21 bp, Homo sapiens
aattagagagcatctgcaaca

SEQ ID NO: 2258008 - DNA, 20 bp, Homo sapiens
aattatatgtatattgtcta

SEQ ID NO: 2258009 - DNA, 22 bp, Homo sapiens
aattatctatacatatctttat

SEQ ID NO: 2258010 - DNA, 17 bp, Homo sapiens
aattattccaaaccaaa

SEQ ID NO: 2258011 - DNA, 12 bp, Homo sapiens
aattcatttcta

SEQ ID NO: 2258012 - DNA, 13 bp, Homo sapiens
aattccctccccc

SEQ ID NO: 2258013 - DNA, 15 bp, Homo sapiens
aattctatgcctgtc

SEQ ID NO: 2258014 - DNA, 21 bp, Homo sapiens
aattctgtttttaatgctatt

SEQ ID NO: 2258015 - DNA, 18 bp, Homo sapiens
aattgaaactctctgttc

SEQ ID NO: 2258016 - DNA, 23 bp, Homo sapiens
aattgaactctctgcctgtaaat

SEQ ID NO: 2258017 - DNA, 21 bp, Homo sapiens
aattgaagtgtataatataaa

SEQ ID NO: 2258018 - DNA, 20 bp, Homo sapiens
aattgcacaccttggaattc

SEQ ID NO: 2258019 - DNA, 23 bp, Homo sapiens
aattgcttggttgtaattaaatt

SEQ ID NO: 2258020 - DNA, 12 bp, Homo sapiens
aattggtaatat

SEQ ID NO: 2258021 - DNA, 21 bp, Homo sapiens
aattggttggagaatttaggt

SEQ ID NO: 2258022 - DNA, 15 bp, Homo sapiens
aatttaaaagtaaaa

SEQ ID NO: 2258023 - DNA, 23 bp, Homo sapiens
aatttaatggggtctgtaaatac

SEQ ID NO: 2258024 - DNA, 18 bp, Homo sapiens
aatttactcacagcactt

SEQ ID NO: 2258025 - DNA, 13 bp, Homo sapiens
aatttagttgttt

SEQ ID NO: 2258026 - DNA, 12 bp, Homo sapiens
aatttatttaat

SEQ ID NO: 2258027 - DNA, 16 bp, Homo sapiens
aatttatttcatccag

SEQ ID NO: 2258028 - DNA, 17 bp, Homo sapiens
aatttatttcatccagt

SEQ ID NO: 2258029 - DNA, 21 bp, Homo sapiens
aatttcaataacctttcactt

SEQ ID NO: 2258030 - DNA, 13 bp, Homo sapiens
aatttcttttgct

SEQ ID NO: 2258031 - DNA, 16 bp, Homo sapiens
aatttgactaatttta

SEQ ID NO: 2258032 - DNA, 12 bp, Homo sapiens
aatttgggcaga

SEQ ID NO: 2258033 - DNA, 13 bp, Homo sapiens
aatttgggcagat

SEQ ID NO: 2258034 - DNA, 20 bp, Homo sapiens
aatttgtctgaaacatttca

SEQ ID NO: 2258035 - DNA, 21 bp, Homo sapiens
aatttgttggggctttacata

SEQ ID NO: 2258036 - DNA, 19 bp, Homo sapiens
aattttatctgtttcctga

SEQ ID NO: 2258037 - DNA, 12 bp, Homo sapiens
aattttcagcat

SEQ ID NO: 2258038 - DNA, 18 bp, Homo sapiens
aattttgtaatgtatcaa

SEQ ID NO: 2258039 - DNA, 22 bp, Homo sapiens
aattttgtgtaagaaatacaga

SEQ ID NO: 2258040 - DNA, 14 bp, Homo sapiens
aatttttatttctt

SEQ ID NO: 2258041 - DNA, 18 bp, Homo sapiens
aatttttgcttttagaaa

SEQ ID NO: 2258042 - DNA, 19 bp, Homo sapiens
aatttttgcttttagaaaa

SEQ ID NO: 2258043 - DNA, 21 bp, Homo sapiens
aattttttaagtgaaaatata

SEQ ID NO: 2258044 - DNA, 20 bp, Homo sapiens
acaaaaaagaaaagtagaaa

SEQ ID NO: 2258045 - DNA, 14 bp, Homo sapiens
acaaaaattaggta

SEQ ID NO: 2258046 - DNA, 13 bp, Homo sapiens
acaaaatgaagct

SEQ ID NO: 2258047 - DNA, 16 bp, Homo sapiens
acaaaattatttgtaa

SEQ ID NO: 2258048 - DNA, 20 bp, Homo sapiens
acaaaatttgactaatttta

SEQ ID NO: 2258049 - DNA, 23 bp, Homo sapiens
acaaagttactaggtaacttcat

SEQ ID NO: 2258050 - DNA, 13 bp, Homo sapiens
acaaataatttag

SEQ ID NO: 2258051 - DNA, 15 bp, Homo sapiens
acaaatattttcatg

SEQ ID NO: 2258052 - DNA, 18 bp, Homo sapiens
acaaatgtgatttttgta

SEQ ID NO: 2258053 - DNA, 14 bp, Homo sapiens
acaagagaaaaagc

SEQ ID NO: 2258054 - DNA, 18 bp, Homo sapiens
acaagccctgcttttgca

SEQ ID NO: 2258055 - DNA, 20 bp, Homo sapiens
acaagccctgcttttgcata

SEQ ID NO: 2258056 - DNA, 22 bp, Homo sapiens
acaagtactggctctttattca

SEQ ID NO: 2258057 - DNA, 22 bp, Homo sapiens
acaagttcgagtcaaagttgaa

SEQ ID NO: 2258058 - DNA, 20 bp, Homo sapiens
acaatcaaaacacactacta

SEQ ID NO: 2258059 - DNA, 17 bp, Homo sapiens
acaatcagttatacagt

SEQ ID NO: 2258060 - DNA, 21 bp, Homo sapiens
acaatgaagttgaaaatcata

SEQ ID NO: 2258061 - DNA, 17 bp, Homo sapiens
acaatgcaacttttaat

SEQ ID NO: 2258062 - DNA, 17 bp, Homo sapiens
acaatgtgaactttatt

SEQ ID NO: 2258063 - DNA, 22 bp, Homo sapiens
acaatgttgtagtgtcccccac

SEQ ID NO: 2258064 - DNA, 21 bp, Homo sapiens
acaattattccaaaccaaatt

SEQ ID NO: 2258065 - DNA, 19 bp, Homo sapiens
acaatttttatttctttta

SEQ ID NO: 2258066 - DNA, 17 bp, Homo sapiens
acacagtgattccctcc

SEQ ID NO: 2258067 - DNA, 15 bp, Homo sapiens
acacagttcctggga

SEQ ID NO: 2258068 - DNA, 16 bp, Homo sapiens
acacatacatgtcaca

SEQ ID NO: 2258069 - DNA, 14 bp, Homo sapiens
acacccatgccaga

SEQ ID NO: 2258070 - DNA, 18 bp, Homo sapiens
acaccctcaacctcttct

SEQ ID NO: 2258071 - DNA, 24 bp, Homo sapiens
acaccgagtctctgtataatctat

SEQ ID NO: 2258072 - DNA, 21 bp, Homo sapiens
acacctactagtcaccagaga

SEQ ID NO: 2258073 - DNA, 12 bp, Homo sapiens
acacctccccct

SEQ ID NO: 2258074 - DNA, 22 bp, Homo sapiens
acacctccccctttcacactgg

SEQ ID NO: 2258075 - DNA, 20 bp, Homo sapiens
acacctgggcatttggtgag

SEQ ID NO: 2258076 - DNA, 16 bp, Homo sapiens
acaccttccagctcct

SEQ ID NO: 2258077 - DNA, 22 bp, Homo sapiens
acacggagcccagccctcccca

SEQ ID NO: 2258078 - DNA, 18 bp, Homo sapiens
acacttgtcagcctcaga

SEQ ID NO: 2258079 - DNA, 12 bp, Homo sapiens
acagaaacattc

SEQ ID NO: 2258080 - DNA, 22 bp, Homo sapiens
acagactaagaaggaaaagaag

SEQ ID NO: 2258081 - DNA, 24 bp, Homo sapiens
acagaggtagtctcactgcttgaa

SEQ ID NO: 2258082 - DNA, 14 bp, Homo sapiens
acagatttggaaag

SEQ ID NO: 2258083 - DNA, 15 bp, Homo sapiens
acagatttggaaaga

SEQ ID NO: 2258084 - DNA, 17 bp, Homo sapiens
acagattttatttatgc

SEQ ID NO: 2258085 - DNA, 18 bp, Homo sapiens
acagattttatttatgcg

SEQ ID NO: 2258086 - DNA, 16 bp, Homo sapiens
acagcaatatttaaca

SEQ ID NO: 2258087 - DNA, 20 bp, Homo sapiens
acagcaatatttaacaattt

SEQ ID NO: 2258088 - DNA, 15 bp, Homo sapiens
acagcccaggatact

SEQ ID NO: 2258089 - DNA, 18 bp, Homo sapiens
acagcccaggtccctccg

SEQ ID NO: 2258090 - DNA, 15 bp, Homo sapiens
acagctagacaccta

SEQ ID NO: 2258091 - DNA, 17 bp, Homo sapiens
acaggaaagccctcccc

SEQ ID NO: 2258092 - DNA, 14 bp, Homo sapiens
acaggagggccagc

SEQ ID NO: 2258093 - DNA, 13 bp, Homo sapiens
acagggacatgcc

SEQ ID NO: 2258094 - DNA, 17 bp, Homo sapiens
acaggggtagtttgttt

SEQ ID NO: 2258095 - DNA, 17 bp, Homo sapiens
acagtacctgattgtat

SEQ ID NO: 2258096 - DNA, 21 bp, Homo sapiens
acagtacctgattgtattttt

SEQ ID NO: 2258097 - DNA, 12 bp, Homo sapiens
acagtccacagg

SEQ ID NO: 2258098 - DNA, 18 bp, Homo sapiens
acagtccacaggggccac

SEQ ID NO: 2258099 - DNA, 17 bp, Homo sapiens
acagtgtgtaaacaaaa

SEQ ID NO: 2258100 - DNA, 18 bp, Homo sapiens
acagtgtgtaaacaaaat

SEQ ID NO: 2258101 - DNA, 16 bp, Homo sapiens
acagtgttttcagaag

SEQ ID NO: 2258102 - DNA, 17 bp, Homo sapiens
acagttataaaattaaa

SEQ ID NO: 2258103 - DNA, 19 bp, Homo sapiens
acagttcttggtgactgtc

SEQ ID NO: 2258104 - DNA, 22 bp, Homo sapiens
acagttcttggtgactgtccca

SEQ ID NO: 2258105 - DNA, 15 bp, Homo sapiens
acatacatgtcacat

SEQ ID NO: 2258106 - DNA, 20 bp, Homo sapiens
acataccctggccgccccct

SEQ ID NO: 2258107 - DNA, 19 bp, Homo sapiens
acatactggcctggactgt

SEQ ID NO: 2258108 - DNA, 15 bp, Homo sapiens
acatactttatcaat

SEQ ID NO: 2258109 - DNA, 13 bp, Homo sapiens
acatacttttgca

SEQ ID NO: 2258110 - DNA, 15 bp, Homo sapiens
acatacttttgcaaa

SEQ ID NO: 2258111 - DNA, 12 bp, Homo sapiens
acatagaaatgg

SEQ ID NO: 2258112 - DNA, 23 bp, Homo sapiens
acatatcagcaggagtaataaat

SEQ ID NO: 2258113 - DNA, 15 bp, Homo sapiens
acatatctttattaa

SEQ ID NO: 2258114 - DNA, 18 bp, Homo sapiens
acatatctttattaatca

SEQ ID NO: 2258115 - DNA, 18 bp, Homo sapiens
acatatgatctgtctgtg

SEQ ID NO: 2258116 - DNA, 20 bp, Homo sapiens
acatcagtctccaacatgtt

SEQ ID NO: 2258117 - DNA, 20 bp, Homo sapiens
acatcataaaatttttatat

SEQ ID NO: 2258118 - DNA, 19 bp, Homo sapiens
acatcattacagattctgc

SEQ ID NO: 2258119 - DNA, 21 bp, Homo sapiens
acatccagagctttgtcgtat

SEQ ID NO: 2258120 - DNA, 22 bp, Homo sapiens
acatcgcaatagttttttactt

SEQ ID NO: 2258121 - DNA, 21 bp, Homo sapiens
acatgaattttaaataatgta

SEQ ID NO: 2258122 - DNA, 17 bp, Homo sapiens
acatgccctgtgtggct

SEQ ID NO: 2258123 - DNA, 18 bp, Homo sapiens
acatgctgctatacacaa

SEQ ID NO: 2258124 - DNA, 19 bp, Homo sapiens
acatgggatccaattttaa

SEQ ID NO: 2258125 - DNA, 14 bp, Homo sapiens
acatgtgaaaagaa

SEQ ID NO: 2258126 - DNA, 18 bp, Homo sapiens
acatgtgaaaagaataga

SEQ ID NO: 2258127 - DNA, 21 bp, Homo sapiens
acatgttactggataaattgt

SEQ ID NO: 2258128 - DNA, 13 bp, Homo sapiens
acattaacttgaa

SEQ ID NO: 2258129 - DNA, 14 bp, Homo sapiens
acattaacttgaaa

SEQ ID NO: 2258130 - DNA, 23 bp, Homo sapiens
acattcttggcttaatcattttc

SEQ ID NO: 2258131 - DNA, 22 bp, Homo sapiens
acatttaaaacattaaaatata

SEQ ID NO: 2258132 - DNA, 16 bp, Homo sapiens
acatttaacttttcta

SEQ ID NO: 2258133 - DNA, 16 bp, Homo sapiens
acatttcatacaacag

SEQ ID NO: 2258134 - DNA, 15 bp, Homo sapiens
acatttctggacagt

SEQ ID NO: 2258135 - DNA, 20 bp, Homo sapiens
acatttgatgcatgtctttt

SEQ ID NO: 2258136 - DNA, 13 bp, Homo sapiens
acattttaattca

SEQ ID NO: 2258137 - DNA, 16 bp, Homo sapiens
accaaagataaggact

SEQ ID NO: 2258138 - DNA, 20 bp, Homo sapiens
accaacttgtatccaggcct

SEQ ID NO: 2258139 - DNA, 14 bp, Homo sapiens
accaagggcagagg

SEQ ID NO: 2258140 - DNA, 13 bp, Homo sapiens
accacaccctgta

SEQ ID NO: 2258141 - DNA, 19 bp, Homo sapiens
accaccaactactacctgt

SEQ ID NO: 2258142 - DNA, 22 bp, Homo sapiens
accaccccgcctgccctcatgg

SEQ ID NO: 2258143 - DNA, 18 bp, Homo sapiens
accacctttggctggtag

SEQ ID NO: 2258144 - DNA, 22 bp, Homo sapiens
accactaccagccagcctcaga

SEQ ID NO: 2258145 - DNA, 17 bp, Homo sapiens
accacttacctcaaatt

SEQ ID NO: 2258146 - DNA, 13 bp, Homo sapiens
accacttcgaaac

SEQ ID NO: 2258147 - DNA, 16 bp, Homo sapiens
accacttttctgctgt

SEQ ID NO: 2258148 - DNA, 16 bp, Homo sapiens
accagccgtattttac

SEQ ID NO: 2258149 - DNA, 23 bp, Homo sapiens
accagctaagaaaagattttaat

SEQ ID NO: 2258150 - DNA, 17 bp, Homo sapiens
accagctatctgtcatc

SEQ ID NO: 2258151 - DNA, 23 bp, Homo sapiens
accagctatctgtcatctctctg

SEQ ID NO: 2258152 - DNA, 20 bp, Homo sapiens
accatagtaccatttataca

SEQ ID NO: 2258153 - DNA, 19 bp, Homo sapiens
accatcttttattcttttt

SEQ ID NO: 2258154 - DNA, 23 bp, Homo sapiens
accatttatacaaattagaaaat

SEQ ID NO: 2258155 - DNA, 19 bp, Homo sapiens
accattttggatgtcattg

SEQ ID NO: 2258156 - DNA, 15 bp, Homo sapiens
accatttttgttact

SEQ ID NO: 2258157 - DNA, 23 bp, Homo sapiens
acccaaggggatttttatgtctg

SEQ ID NO: 2258158 - DNA, 16 bp, Homo sapiens
acccaatgctgctcca

SEQ ID NO: 2258159 - DNA, 21 bp, Homo sapiens
acccacctgctagtgtgaatt

SEQ ID NO: 2258160 - DNA, 20 bp, Homo sapiens
acccactccctgtagtgaat

SEQ ID NO: 2258161 - DNA, 16 bp, Homo sapiens
acccatgccagagagg

SEQ ID NO: 2258162 - DNA, 16 bp, Homo sapiens
accccaaacaccttcc

SEQ ID NO: 2258163 - DNA, 18 bp, Homo sapiens
accccaaacaccttccag

SEQ ID NO: 2258164 - DNA, 20 bp, Homo sapiens
accccaaacaccttccagct

SEQ ID NO: 2258165 - DNA, 23 bp, Homo sapiens
accccaaacaccttccagctcct

SEQ ID NO: 2258166 - DNA, 13 bp, Homo sapiens
accccaagagaac

SEQ ID NO: 2258167 - DNA, 17 bp, Homo sapiens
accccaggacgccactc

SEQ ID NO: 2258168 - DNA, 19 bp, Homo sapiens
acccccacccccagctcaa

SEQ ID NO: 2258169 - DNA, 14 bp, Homo sapiens
acccccagccccga

SEQ ID NO: 2258170 - DNA, 21 bp, Homo sapiens
acccccagccccgactccagc

SEQ ID NO: 2258171 - DNA, 14 bp, Homo sapiens
acccccatccagcc

SEQ ID NO: 2258172 - DNA, 16 bp, Homo sapiens
acccccatccagcctc

SEQ ID NO: 2258173 - DNA, 20 bp, Homo sapiens
acccccatccagcctccagg

SEQ ID NO: 2258174 - DNA, 11 bp, Homo sapiens
acccccctctg

SEQ ID NO: 2258175 - DNA, 16 bp, Homo sapiens
accccctcctccccca

SEQ ID NO: 2258176 - DNA, 15 bp, Homo sapiens
accccctccttcaga

SEQ ID NO: 2258177 - DNA, 20 bp, Homo sapiens
acccctgggcctcatcacag

SEQ ID NO: 2258178 - DNA, 16 bp, Homo sapiens
acccctgtaggcctca

SEQ ID NO: 2258179 - DNA, 17 bp, Homo sapiens
acccctgtaggcctcag

SEQ ID NO: 2258180 - DNA, 19 bp, Homo sapiens
accctatgggtctaggaca

SEQ ID NO: 2258181 - DNA, 23 bp, Homo sapiens
accctccaagtctgtacctcaaa

SEQ ID NO: 2258182 - DNA, 18 bp, Homo sapiens
accctcccccagacacag

SEQ ID NO: 2258183 - DNA, 15 bp, Homo sapiens
accctcccccgcagc

SEQ ID NO: 2258184 - DNA, 13 bp, Homo sapiens
accctcctggctc

SEQ ID NO: 2258185 - DNA, 23 bp, Homo sapiens
accctctcctgggggtggcaggc

SEQ ID NO: 2258186 - DNA, 15 bp, Homo sapiens
accgagtgatttcca

SEQ ID NO: 2258187 - DNA, 19 bp, Homo sapiens
accgggagcctccccctca

SEQ ID NO: 2258188 - DNA, 16 bp, Homo sapiens
acctacagactaagaa

SEQ ID NO: 2258189 - DNA, 17 bp, Homo sapiens
acctactaatagtttgt

SEQ ID NO: 2258190 - DNA, 17 bp, Homo sapiens
acctagctacactgagc

SEQ ID NO: 2258191 - DNA, 14 bp, Homo sapiens
acctcaaataccac

SEQ ID NO: 2258192 - DNA, 22 bp, Homo sapiens
acctcagttattacatgtaatt

SEQ ID NO: 2258193 - DNA, 14 bp, Homo sapiens
acctcattggccag

SEQ ID NO: 2258194 - DNA, 14 bp, Homo sapiens
acctcatttttcat

SEQ ID NO: 2258195 - DNA, 22 bp, Homo sapiens
acctccccctttcacactggat

SEQ ID NO: 2258196 - DNA, 14 bp, Homo sapiens
acctcccctctccc

SEQ ID NO: 2258197 - DNA, 15 bp, Homo sapiens
acctcccctctcccc

SEQ ID NO: 2258198 - DNA, 16 bp, Homo sapiens
acctcccctctccccg

SEQ ID NO: 2258199 - DNA, 17 bp, Homo sapiens
acctcctaaatgcccca

SEQ ID NO: 2258200 - DNA, 20 bp, Homo sapiens
acctcctctgtgatttcttt

SEQ ID NO: 2258201 - DNA, 15 bp, Homo sapiens
acctctcctgacccc

SEQ ID NO: 2258202 - DNA, 21 bp, Homo sapiens
acctctcctgacccctgcctg

SEQ ID NO: 2258203 - DNA, 24 bp, Homo sapiens
acctctgcttttatctcagatgtt

SEQ ID NO: 2258204 - DNA, 16 bp, Homo sapiens
acctcttctggctcaa

SEQ ID NO: 2258205 - DNA, 15 bp, Homo sapiens
acctgattgtatttt

SEQ ID NO: 2258206 - DNA, 23 bp, Homo sapiens
acctgcactggggagcccgtctc

SEQ ID NO: 2258207 - DNA, 18 bp, Homo sapiens
acctgggattcaggaatg

SEQ ID NO: 2258208 - DNA, 19 bp, Homo sapiens
acctgggcatttggtgaga

SEQ ID NO: 2258209 - DNA, 16 bp, Homo sapiens
acctggtaccctcctg

SEQ ID NO: 2258210 - DNA, 20 bp, Homo sapiens
acctgtaatgacaggcctgt

SEQ ID NO: 2258211 - DNA, 19 bp, Homo sapiens
acctgttaatttttatact

SEQ ID NO: 2258212 - DNA, 20 bp, Homo sapiens
accttacaacgccgagtgca

SEQ ID NO: 2258213 - DNA, 13 bp, Homo sapiens
accttaggccttc

SEQ ID NO: 2258214 - DNA, 16 bp, Homo sapiens
accttaggccttcctc

SEQ ID NO: 2258215 - DNA, 17 bp, Homo sapiens
accttaggccttcctct

SEQ ID NO: 2258216 - DNA, 21 bp, Homo sapiens
accttaggccttcctctctcc

SEQ ID NO: 2258217 - DNA, 13 bp, Homo sapiens
accttccagctcc

SEQ ID NO: 2258218 - DNA, 19 bp, Homo sapiens
accttcccaaacgcctccc

SEQ ID NO: 2258219 - DNA, 13 bp, Homo sapiens
accttctttgtaa

SEQ ID NO: 2258220 - DNA, 14 bp, Homo sapiens
accttctttgtaat

SEQ ID NO: 2258221 - DNA, 10 bp, Homo sapiens
accttgaaaa

SEQ ID NO: 2258222 - DNA, 20 bp, Homo sapiens
accttgtttattaaattgca

SEQ ID NO: 2258223 - DNA, 13 bp, Homo sapiens
acctttccctcac

SEQ ID NO: 2258224 - DNA, 14 bp, Homo sapiens
acctttccctcacc

SEQ ID NO: 2258225 - DNA, 17 bp, Homo sapiens
acctttccctcaccccc

SEQ ID NO: 2258226 - DNA, 13 bp, Homo sapiens
acctttggctggt

SEQ ID NO: 2258227 - DNA, 16 bp, Homo sapiens
accttttactgtgatg

SEQ ID NO: 2258228 - DNA, 20 bp, Homo sapiens
acgagacccccatccagcct

SEQ ID NO: 2258229 - DNA, 22 bp, Homo sapiens
acgagacccccatccagcctcc

SEQ ID NO: 2258230 - DNA, 16 bp, Homo sapiens
acgagggccaggcacc

SEQ ID NO: 2258231 - DNA, 15 bp, Homo sapiens
acgccactcatttca

SEQ ID NO: 2258232 - DNA, 17 bp, Homo sapiens
acgccactcatttcatc

SEQ ID NO: 2258233 - DNA, 20 bp, Homo sapiens
acgccactcatttcatctca

SEQ ID NO: 2258234 - DNA, 23 bp, Homo sapiens
acgcgcctcgccggatctgaggg

SEQ ID NO: 2258235 - DNA, 23 bp, Homo sapiens
acgctgaccatgcgtcaggggcc

SEQ ID NO: 2258236 - DNA, 22 bp, Homo sapiens
acgctgccgctgccgctgcacc

SEQ ID NO: 2258237 - DNA, 15 bp, Homo sapiens
acggaggaggggaag

SEQ ID NO: 2258238 - DNA, 18 bp, Homo sapiens
acggcaacgtagcctggg

SEQ ID NO: 2258239 - DNA, 20 bp, Homo sapiens
acggcaacgtagcctgggct

SEQ ID NO: 2258240 - DNA, 22 bp, Homo sapiens
acggcaacgtagcctgggctca

SEQ ID NO: 2258241 - DNA, 18 bp, Homo sapiens
acggcgggatcctccaca

SEQ ID NO: 2258242 - DNA, 13 bp, Homo sapiens
acgggtggtcccc

SEQ ID NO: 2258243 - DNA, 18 bp, Homo sapiens
acggtttcgaagtcatta

SEQ ID NO: 2258244 - DNA, 12 bp, Homo sapiens
acgtagcctggg

SEQ ID NO: 2258245 - DNA, 14 bp, Homo sapiens
acgtgaatgtctca

SEQ ID NO: 2258246 - DNA, 21 bp, Homo sapiens
acgtggcaggacttccatctg

SEQ ID NO: 2258247 - DNA, 14 bp, Homo sapiens
acgtggggcccact

SEQ ID NO: 2258248 - DNA, 21 bp, Homo sapiens
acgttcgatttctacctcagc

SEQ ID NO: 2258249 - DNA, 16 bp, Homo sapiens
acgttgagcccctgga

SEQ ID NO: 2258250 - DNA, 18 bp, Homo sapiens
acgttttttcctcagtgc

SEQ ID NO: 2258251 - DNA, 16 bp, Homo sapiens
actaaaataattttgt

SEQ ID NO: 2258252 - DNA, 16 bp, Homo sapiens
actaaaatgtatctaa

SEQ ID NO: 2258253 - DNA, 16 bp, Homo sapiens
actaagaattcaaact

SEQ ID NO: 2258254 - DNA, 18 bp, Homo sapiens
actaagaattcaaactgg

SEQ ID NO: 2258255 - DNA, 13 bp, Homo sapiens
actaagattcttt

SEQ ID NO: 2258256 - DNA, 21 bp, Homo sapiens
actaaggatttttcaagagat

SEQ ID NO: 2258257 - DNA, 12 bp, Homo sapiens
actaatgtgatg

SEQ ID NO: 2258258 - DNA, 14 bp, Homo sapiens
actaattgacttgc

SEQ ID NO: 2258259 - DNA, 17 bp, Homo sapiens
actaattgacttgcaaa

SEQ ID NO: 2258260 - DNA, 21 bp, Homo sapiens
actaattttacatgtttataa

SEQ ID NO: 2258261 - DNA, 17 bp, Homo sapiens
actacagtattactctt

SEQ ID NO: 2258262 - DNA, 13 bp, Homo sapiens
actaccagccagc

SEQ ID NO: 2258263 - DNA, 13 bp, Homo sapiens
actactacctctt

SEQ ID NO: 2258264 - DNA, 14 bp, Homo sapiens
actataaaacaaaa

SEQ ID NO: 2258265 - DNA, 15 bp, Homo sapiens
actataaaacaaaaa

SEQ ID NO: 2258266 - DNA, 15 bp, Homo sapiens
actatgcacactttt

SEQ ID NO: 2258267 - DNA, 17 bp, Homo sapiens
tttgtgctgtgggcagc

SEQ ID NO: 2258268 - DNA, 14 bp, Homo sapiens
tttgttagcaaaga

SEQ ID NO: 2258269 - DNA, 15 bp, Homo sapiens
tttgttagcaaagat

SEQ ID NO: 2258270 - DNA, 22 bp, Homo sapiens
tttgttaggattttcacattct

SEQ ID NO: 2258271 - DNA, 14 bp, Homo sapiens
tttgttgctgtcaa

SEQ ID NO: 2258272 - DNA, 17 bp, Homo sapiens
tttgtttctttctctga

SEQ ID NO: 2258273 - DNA, 14 bp, Homo sapiens
tttgtttgtttgca

SEQ ID NO: 2258274 - DNA, 15 bp, Homo sapiens
tttgttttagaacca

SEQ ID NO: 2258275 - DNA, 20 bp, Homo sapiens
ttttaaaaacataacataaa

SEQ ID NO: 2258276 - DNA, 18 bp, Homo sapiens
ttttaaaagcaattatat

SEQ ID NO: 2258277 - DNA, 16 bp, Homo sapiens
ttttaaaatgcaatgt

SEQ ID NO: 2258278 - DNA, 23 bp, Homo sapiens
ttttaaagaatatgactttttat

SEQ ID NO: 2258279 - DNA, 14 bp, Homo sapiens
ttttaaagttgata

SEQ ID NO: 2258280 - DNA, 16 bp, Homo sapiens
ttttaaataaaagcac

SEQ ID NO: 2258281 - DNA, 12 bp, Homo sapiens
ttttaaataatg

SEQ ID NO: 2258282 - DNA, 16 bp, Homo sapiens
ttttaaataatgtatt

SEQ ID NO: 2258283 - DNA, 17 bp, Homo sapiens
ttttaaatattttctat

SEQ ID NO: 2258284 - DNA, 19 bp, Homo sapiens
ttttaaattagaaaatatt

SEQ ID NO: 2258285 - DNA, 11 bp, Homo sapiens
ttttaactttg

SEQ ID NO: 2258286 - DNA, 14 bp, Homo sapiens
ttttaactttgaaa

SEQ ID NO: 2258287 - DNA, 18 bp, Homo sapiens
ttttaaggtctttcagta

SEQ ID NO: 2258288 - DNA, 23 bp, Homo sapiens
ttttaaggtctttcagtactttt

SEQ ID NO: 2258289 - DNA, 20 bp, Homo sapiens
ttttaatgctatttgaacaa

SEQ ID NO: 2258290 - DNA, 15 bp, Homo sapiens
ttttaattactgttt

SEQ ID NO: 2258291 - DNA, 22 bp, Homo sapiens
ttttaattttgtcagattcaca

SEQ ID NO: 2258292 - DNA, 23 bp, Homo sapiens
ttttacagaataaaagaattaca

SEQ ID NO: 2258293 - DNA, 17 bp, Homo sapiens
ttttacatacttttgca

SEQ ID NO: 2258294 - DNA, 20 bp, Homo sapiens
ttttacatacttttgcaaaa

SEQ ID NO: 2258295 - DNA, 18 bp, Homo sapiens
ttttacatgtttataaat

SEQ ID NO: 2258296 - DNA, 16 bp, Homo sapiens
ttttaccaaagcatca

SEQ ID NO: 2258297 - DNA, 17 bp, Homo sapiens
ttttaccaaagcatcaa

SEQ ID NO: 2258298 - DNA, 20 bp, Homo sapiens
ttttagaatacattgtactt

SEQ ID NO: 2258299 - DNA, 18 bp, Homo sapiens
ttttagccagagatgcaa

SEQ ID NO: 2258300 - DNA, 14 bp, Homo sapiens
ttttagtaagttaa

SEQ ID NO: 2258301 - DNA, 14 bp, Homo sapiens
ttttagtaatttct

SEQ ID NO: 2258302 - DNA, 22 bp, Homo sapiens
ttttataaaatggctgtaatca

SEQ ID NO: 2258303 - DNA, 22 bp, Homo sapiens
ttttatatgaagataagtgtat

SEQ ID NO: 2258304 - DNA, 16 bp, Homo sapiens
ttttatcgcagatttt

SEQ ID NO: 2258305 - DNA, 13 bp, Homo sapiens
ttttatctcagat

SEQ ID NO: 2258306 - DNA, 15 bp, Homo sapiens
ttttatttcctgtat

SEQ ID NO: 2258307 - DNA, 13 bp, Homo sapiens
ttttatttctcgg

SEQ ID NO: 2258308 - DNA, 21 bp, Homo sapiens
ttttatttctcgggtgcattt

SEQ ID NO: 2258309 - DNA, 20 bp, Homo sapiens
ttttcccctaccaatattag

SEQ ID NO: 2258310 - DNA, 15 bp, Homo sapiens
ttttgagacatggga

SEQ ID NO: 2258311 - DNA, 17 bp, Homo sapiens
ttttgagacatgggatc

SEQ ID NO: 2258312 - DNA, 16 bp, Homo sapiens
ttttgatgtaaagatg

SEQ ID NO: 2258313 - DNA, 16 bp, Homo sapiens
ttttgcataatgcaat

SEQ ID NO: 2258314 - DNA, 18 bp, Homo sapiens
ttttggagattataataa

SEQ ID NO: 2258315 - DNA, 19 bp, Homo sapiens
ttttgtaataataaagaat

SEQ ID NO: 2258316 - DNA, 11 bp, Homo sapiens
ttttgttctgt

SEQ ID NO: 2258317 - DNA, 19 bp, Homo sapiens
tttttaaaaaatattttct

SEQ ID NO: 2258318 - DNA, 16 bp, Homo sapiens
tttttaaaatatttat

SEQ ID NO: 2258319 - DNA, 18 bp, Homo sapiens
tttttaaataaaagcaca

SEQ ID NO: 2258320 - DNA, 16 bp, Homo sapiens
tttttaaatattttct

SEQ ID NO: 2258321 - DNA, 17 bp, Homo sapiens
tttttaatcatgaatat

SEQ ID NO: 2258322 - DNA, 13 bp, Homo sapiens
tttttaatgctat

SEQ ID NO: 2258323 - DNA, 13 bp, Homo sapiens
tttttacatttca

SEQ ID NO: 2258324 - DNA, 16 bp, Homo sapiens
tttttatgttttgaaa

SEQ ID NO: 2258325 - DNA, 12 bp, Homo sapiens
tttttattgttg

SEQ ID NO: 2258326 - DNA, 12 bp, Homo sapiens
tttttatttcta

SEQ ID NO: 2258327 - DNA, 18 bp, Homo sapiens
tttttatttctaaatgag

SEQ ID NO: 2258328 - DNA, 18 bp, Homo sapiens
tttttcataaacaagttc

SEQ ID NO: 2258329 - DNA, 14 bp, Homo sapiens
tttttgtaacttca

SEQ ID NO: 2258330 - DNA, 18 bp, Homo sapiens
tttttgtaacttcaaata

SEQ ID NO: 2258331 - DNA, 21 bp, Homo sapiens
tttttgtacgttatatattgt

SEQ ID NO: 2258332 - DNA, 23 bp, Homo sapiens
tttttgtacgttatatattgtat

SEQ ID NO: 2258333 - DNA, 16 bp, Homo sapiens
tttttgttattaaaca

SEQ ID NO: 2258334 - DNA, 23 bp, Homo sapiens
ttttttagtaagttaatgtatat

SEQ ID NO: 2258335 - DNA, 15 bp, Homo sapiens
ttttttgagacatgg

SEQ ID NO: 2258336 - DNA, 11 bp, Homo sapiens
ttttttgtaac

SEQ ID NO: 2258337 - DNA, 12 bp, Homo sapiens
ttttttgttatt

SEQ ID NO: 2258338 - DNA, 20 bp, Homo sapiens
ttgtttctttctctgaggac

SEQ ID NO: 2258339 - DNA, 16 bp, Homo sapiens
tttaaaaaatattttc

SEQ ID NO: 2258340 - DNA, 22 bp, Homo sapiens
tttaaaaatggtatcaaaatta

SEQ ID NO: 2258341 - DNA, 23 bp, Homo sapiens
tttaaaagtaaaatgtctttcca

SEQ ID NO: 2258342 - DNA, 14 bp, Homo sapiens
tttaaacacctcct

SEQ ID NO: 2258343 - DNA, 17 bp, Homo sapiens
tttaaacgcttcttatg

SEQ ID NO: 2258344 - DNA, 17 bp, Homo sapiens
tttaaataaaagcacaa

SEQ ID NO: 2258345 - DNA, 13 bp, Homo sapiens
tttaaatattttc

SEQ ID NO: 2258346 - DNA, 15 bp, Homo sapiens
tttaaatattttcta

SEQ ID NO: 2258347 - DNA, 16 bp, Homo sapiens
tttaaattaatatctt

SEQ ID NO: 2258348 - DNA, 22 bp, Homo sapiens
tttaaattagaaaatattctct

SEQ ID NO: 2258349 - DNA, 14 bp, Homo sapiens
tttaaatttgttat

SEQ ID NO: 2258350 - DNA, 17 bp, Homo sapiens
tttaacagctgaattat

SEQ ID NO: 2258351 - DNA, 19 bp, Homo sapiens
tttaactgcagttgacttt

SEQ ID NO: 2258352 - DNA, 13 bp, Homo sapiens
tttaactttgaaa

SEQ ID NO: 2258353 - DNA, 21 bp, Homo sapiens
tttaagacgtgaatgtctcag

SEQ ID NO: 2258354 - DNA, 22 bp, Homo sapiens
tttaagctgtggtcaaggctac

SEQ ID NO: 2258355 - DNA, 23 bp, Homo sapiens
tttaatcatagttactgtgtaaa

SEQ ID NO: 2258356 - DNA, 20 bp, Homo sapiens
tttaatcatgaatatgatga

SEQ ID NO: 2258357 - DNA, 17 bp, Homo sapiens
tttaatctttgtgacag

SEQ ID NO: 2258358 - DNA, 15 bp, Homo sapiens
tttaatgctatttga

SEQ ID NO: 2258359 - DNA, 21 bp, Homo sapiens
tttaatgtaatagggaaaatt

SEQ ID NO: 2258360 - DNA, 13 bp, Homo sapiens
tttaattgaaact

SEQ ID NO: 2258361 - DNA, 16 bp, Homo sapiens
tttaatttgaaatatg

SEQ ID NO: 2258362 - DNA, 12 bp, Homo sapiens
tttaccaaagca

SEQ ID NO: 2258363 - DNA, 15 bp, Homo sapiens
tttaccaaagcatca

SEQ ID NO: 2258364 - DNA, 17 bp, Homo sapiens
tttacccagtgggacag

SEQ ID NO: 2258365 - DNA, 16 bp, Homo sapiens
tttaccttcaaacttt

SEQ ID NO: 2258366 - DNA, 19 bp, Homo sapiens
tttactcatcctccaggaa

SEQ ID NO: 2258367 - DNA, 13 bp, Homo sapiens
tttagaattaaaa

SEQ ID NO: 2258368 - DNA, 20 bp, Homo sapiens
tttagcaataaataacactt

SEQ ID NO: 2258369 - DNA, 20 bp, Homo sapiens
tttagggctgtaaaatgcat

SEQ ID NO: 2258370 - DNA, 16 bp, Homo sapiens
tttagtcaatcactgc

SEQ ID NO: 2258371 - DNA, 13 bp, Homo sapiens
tttagtggaaaat

SEQ ID NO: 2258372 - DNA, 15 bp, Homo sapiens
tttagtggaaaatag

SEQ ID NO: 2258373 - DNA, 14 bp, Homo sapiens
tttataaaaagata

SEQ ID NO: 2258374 - DNA, 17 bp, Homo sapiens
tttatatgaagataagt

SEQ ID NO: 2258375 - DNA, 20 bp, Homo sapiens
tttatcagggaaactaagat

SEQ ID NO: 2258376 - DNA, 17 bp, Homo sapiens
tttatcattcaagtgta

SEQ ID NO: 2258377 - DNA, 20 bp, Homo sapiens
tttatctatataaaataact

SEQ ID NO: 2258378 - DNA, 19 bp, Homo sapiens
tttatctcagatgttaaaa

SEQ ID NO: 2258379 - DNA, 13 bp, Homo sapiens
tttatctgattaa

SEQ ID NO: 2258380 - DNA, 11 bp, Homo sapiens
tttatgtctgg

SEQ ID NO: 2258381 - DNA, 15 bp, Homo sapiens
tttattaaatacaaa

SEQ ID NO: 2258382 - DNA, 15 bp, Homo sapiens
tttattgttaataca

SEQ ID NO: 2258383 - DNA, 19 bp, Homo sapiens
tttattgttaatacaaggt

SEQ ID NO: 2258384 - DNA, 15 bp, Homo sapiens
tttatttagggaaca

SEQ ID NO: 2258385 - DNA, 23 bp, Homo sapiens
tttatttgaacaatgaagttgaa

SEQ ID NO: 2258386 - DNA, 18 bp, Homo sapiens
tttcaagtcaaattaata

SEQ ID NO: 2258387 - DNA, 20 bp, Homo sapiens
tttcaagtcaaattaataat

SEQ ID NO: 2258388 - DNA, 13 bp, Homo sapiens
tttcacagctcct

SEQ ID NO: 2258389 - DNA, 16 bp, Homo sapiens
tttcacattcttggct

SEQ ID NO: 2258390 - DNA, 13 bp, Homo sapiens
tttcagaagaaat

SEQ ID NO: 2258391 - DNA, 21 bp, Homo sapiens
tttcagaagaaataaatatac

SEQ ID NO: 2258392 - DNA, 18 bp, Homo sapiens
tttcagactccagctgtg

SEQ ID NO: 2258393 - DNA, 18 bp, Homo sapiens
tttcagagccagcctggc

SEQ ID NO: 2258394 - DNA, 15 bp, Homo sapiens
tttcagcaatccatg

SEQ ID NO: 2258395 - DNA, 14 bp, Homo sapiens
tttcagcttctctg

SEQ ID NO: 2258396 - DNA, 19 bp, Homo sapiens
tttcagtacttttttaaat

SEQ ID NO: 2258397 - DNA, 15 bp, Homo sapiens
tttcagtcaaaactt

SEQ ID NO: 2258398 - DNA, 14 bp, Homo sapiens
tttcataaacaagt

SEQ ID NO: 2258399 - DNA, 22 bp, Homo sapiens
tttcatccagtttgttctccgg

SEQ ID NO: 2258400 - DNA, 23 bp, Homo sapiens
tttcatctcatttaagggaaaaa

SEQ ID NO: 2258401 - DNA, 14 bp, Homo sapiens
tttcattttaaaaa

SEQ ID NO: 2258402 - DNA, 17 bp, Homo sapiens
tttcattttaaaaagtc

SEQ ID NO: 2258403 - DNA, 14 bp, Homo sapiens
tttccaaattattt

SEQ ID NO: 2258404 - DNA, 19 bp, Homo sapiens
tttcccttcagtaccctct

SEQ ID NO: 2258405 - DNA, 24 bp, Homo sapiens
tttccgctgtcgccccaggccctc

SEQ ID NO: 2258406 - DNA, 19 bp, Homo sapiens
tttcctgcaggcatccgtg

SEQ ID NO: 2258407 - DNA, 12 bp, Homo sapiens
tttcctgttgaa

SEQ ID NO: 2258408 - DNA, 16 bp, Homo sapiens
tttccttaatccagct

SEQ ID NO: 2258409 - DNA, 19 bp, Homo sapiens
tttcgagtaaacttgaaaa

SEQ ID NO: 2258410 - DNA, 17 bp, Homo sapiens
tttctacaatgtgaact

SEQ ID NO: 2258411 - DNA, 21 bp, Homo sapiens
tttctagactataaatgttgc

SEQ ID NO: 2258412 - DNA, 18 bp, Homo sapiens
tttctagctttttaatta

SEQ ID NO: 2258413 - DNA, 12 bp, Homo sapiens
tttctccagctg

SEQ ID NO: 2258414 - DNA, 16 bp, Homo sapiens
tttctccttcacagct

SEQ ID NO: 2258415 - DNA, 23 bp, Homo sapiens
tttctcgggtgcatttgagagaa

SEQ ID NO: 2258416 - DNA, 16 bp, Homo sapiens
tttctctgtacttttc

SEQ ID NO: 2258417 - DNA, 23 bp, Homo sapiens
tttcttaattattataaaaatat

SEQ ID NO: 2258418 - DNA, 20 bp, Homo sapiens
tttcttctctgtgagaaggt

SEQ ID NO: 2258419 - DNA, 20 bp, Homo sapiens
tttctttccaaaacatttct

SEQ ID NO: 2258420 - DNA, 18 bp, Homo sapiens
tttctttgcaccaaagac

SEQ ID NO: 2258421 - DNA, 20 bp, Homo sapiens
tttctttgcaccaaagacat

SEQ ID NO: 2258422 - DNA, 14 bp, Homo sapiens
tttctttttttcct

SEQ ID NO: 2258423 - DNA, 20 bp, Homo sapiens
tttgaaagacagagtcttca

SEQ ID NO: 2258424 - DNA, 23 bp, Homo sapiens
tttgaagggagaagacactgcag

SEQ ID NO: 2258425 - DNA, 16 bp, Homo sapiens
tttgactaattttaca

SEQ ID NO: 2258426 - DNA, 21 bp, Homo sapiens
tttgactaattttacatgttt

SEQ ID NO: 2258427 - DNA, 18 bp, Homo sapiens
tttgagagaagccacgct

SEQ ID NO: 2258428 - DNA, 15 bp, Homo sapiens
tttgagatgtaaaaa

SEQ ID NO: 2258429 - DNA, 20 bp, Homo sapiens
tttgagctactggattctta

SEQ ID NO: 2258430 - DNA, 18 bp, Homo sapiens
tttgatagaaaggaacac

SEQ ID NO: 2258431 - DNA, 20 bp, Homo sapiens
tttgatgtaaagatgttctg

SEQ ID NO: 2258432 - DNA, 16 bp, Homo sapiens
tttgcaccaaagacat

SEQ ID NO: 2258433 - DNA, 19 bp, Homo sapiens
tttggaattgaactctctg

SEQ ID NO: 2258434 - DNA, 20 bp, Homo sapiens
tttggaattgaactctctgc

SEQ ID NO: 2258435 - DNA, 21 bp, Homo sapiens
tttggatgggccttttagaaa

SEQ ID NO: 2258436 - DNA, 21 bp, Homo sapiens
tttggtgagagtcaaagctga

SEQ ID NO: 2258437 - DNA, 15 bp, Homo sapiens
tttggtgcaaagtat

SEQ ID NO: 2258438 - DNA, 20 bp, Homo sapiens
tttggttatgaatactttgc

SEQ ID NO: 2258439 - DNA, 19 bp, Homo sapiens
tttgtaataataaagaata

SEQ ID NO: 2258440 - DNA, 21 bp, Homo sapiens
tttgtaataataaagaatagc

SEQ ID NO: 2258441 - DNA, 18 bp, Homo sapiens
tttgtacgttatatattg

SEQ ID NO: 2258442 - DNA, 17 bp, Homo sapiens
tttgtcagattcacaca

SEQ ID NO: 2258443 - DNA, 18 bp, Homo sapiens
tttgtccaattgtgtaga

SEQ ID NO: 2258444 - DNA, 13 bp, Homo sapiens
tttgtctttttgt

SEQ ID NO: 2258445 - DNA, 14 bp, Homo sapiens
tttgtgctagaaat

SEQ ID NO: 2258446 - DNA, 21 bp, Homo sapiens
tttgtgctagaaattttcaag

SEQ ID NO: 2258447 - DNA, 18 bp, Homo sapiens
ttcgaagtcattaaactg

SEQ ID NO: 2258448 - DNA, 17 bp, Homo sapiens
ttcgggtgtgcaatgtc

SEQ ID NO: 2258449 - DNA, 21 bp, Homo sapiens
ttcgggtgtgcaatgtctgag

SEQ ID NO: 2258450 - DNA, 17 bp, Homo sapiens
ttctacattaacttgaa

SEQ ID NO: 2258451 - DNA, 23 bp, Homo sapiens
ttctacctataacactctaggat

SEQ ID NO: 2258452 - DNA, 18 bp, Homo sapiens
ttctatttaattgaaact

SEQ ID NO: 2258453 - DNA, 16 bp, Homo sapiens
ttctcagatttctgag

SEQ ID NO: 2258454 - DNA, 20 bp, Homo sapiens
ttctcagatttctgaggaaa

SEQ ID NO: 2258455 - DNA, 23 bp, Homo sapiens
ttctcattaaagttgtttcccac

SEQ ID NO: 2258456 - DNA, 20 bp, Homo sapiens
ttctccagctgggctctgca

SEQ ID NO: 2258457 - DNA, 21 bp, Homo sapiens
ttctccgggtgtggcctcagc

SEQ ID NO: 2258458 - DNA, 13 bp, Homo sapiens
ttctccttttcct

SEQ ID NO: 2258459 - DNA, 21 bp, Homo sapiens
ttctctgtacttttcattctc

SEQ ID NO: 2258460 - DNA, 22 bp, Homo sapiens
ttctcttaggtggctctgggaa

SEQ ID NO: 2258461 - DNA, 20 bp, Homo sapiens
ttctcttccttttatcagta

SEQ ID NO: 2258462 - DNA, 20 bp, Homo sapiens
ttctgggcaccacaaaatat

SEQ ID NO: 2258463 - DNA, 23 bp, Homo sapiens
ttctgggcaccacaaaatataca

SEQ ID NO: 2258464 - DNA, 21 bp, Homo sapiens
ttctggggcaggctgggccat

SEQ ID NO: 2258465 - DNA, 14 bp, Homo sapiens
ttctggtgtctgct

SEQ ID NO: 2258466 - DNA, 13 bp, Homo sapiens
ttctgtattttaa

SEQ ID NO: 2258467 - DNA, 22 bp, Homo sapiens
ttctgtgtcacagttcttggtg

SEQ ID NO: 2258468 - DNA, 18 bp, Homo sapiens
ttcttaattattataaaa

SEQ ID NO: 2258469 - DNA, 16 bp, Homo sapiens
ttcttcagagatcaag

SEQ ID NO: 2258470 - DNA, 18 bp, Homo sapiens
ttcttggtgactgtccca

SEQ ID NO: 2258471 - DNA, 14 bp, Homo sapiens
ttctttgcaccaaa

SEQ ID NO: 2258472 - DNA, 16 bp, Homo sapiens
ttctttgcaccaaaga

SEQ ID NO: 2258473 - DNA, 18 bp, Homo sapiens
ttcttttaaattagaaaa

SEQ ID NO: 2258474 - DNA, 21 bp, Homo sapiens
ttcttttttttttttttgaga

SEQ ID NO: 2258475 - DNA, 21 bp, Homo sapiens
ttgaaaaaatttaaaagtaaa

SEQ ID NO: 2258476 - DNA, 21 bp, Homo sapiens
ttgaaaatatttctctagtgt

SEQ ID NO: 2258477 - DNA, 14 bp, Homo sapiens
ttgaaactctctgt

SEQ ID NO: 2258478 - DNA, 19 bp, Homo sapiens
ttgaaactctctgttcaga

SEQ ID NO: 2258479 - DNA, 21 bp, Homo sapiens
ttgaaatatggtcttttggtt

SEQ ID NO: 2258480 - DNA, 21 bp, Homo sapiens
ttgaagggagaagacactgca

SEQ ID NO: 2258481 - DNA, 19 bp, Homo sapiens
ttgaagggtctttctcaaa

SEQ ID NO: 2258482 - DNA, 16 bp, Homo sapiens
ttgaagtgtataatat

SEQ ID NO: 2258483 - DNA, 21 bp, Homo sapiens
ttgaagtgtataatataaaaa

SEQ ID NO: 2258484 - DNA, 22 bp, Homo sapiens
ttgaatataagaaaatgcttga

SEQ ID NO: 2258485 - DNA, 10 bp, Homo sapiens
ttgaatcaat

SEQ ID NO: 2258486 - DNA, 13 bp, Homo sapiens
ttgactcatctta

SEQ ID NO: 2258487 - DNA, 19 bp, Homo sapiens
ttgactctggcaaagcttt

SEQ ID NO: 2258488 - DNA, 23 bp, Homo sapiens
ttgagagaagccacgctgtcctc

SEQ ID NO: 2258489 - DNA, 20 bp, Homo sapiens
ttgaggggattaatatgaaa

SEQ ID NO: 2258490 - DNA, 22 bp, Homo sapiens
ttgaggggattaatatgaaaac

SEQ ID NO: 2258491 - DNA, 17 bp, Homo sapiens
ttgagtgtacagatttt

SEQ ID NO: 2258492 - DNA, 21 bp, Homo sapiens
ttgataagctattgtctgtaa

SEQ ID NO: 2258493 - DNA, 15 bp, Homo sapiens
ttgatcatgtacttt

SEQ ID NO: 2258494 - DNA, 16 bp, Homo sapiens
ttgatctgataagcaa

SEQ ID NO: 2258495 - DNA, 16 bp, Homo sapiens
ttgatggagtgtgagc

SEQ ID NO: 2258496 - DNA, 14 bp, Homo sapiens
ttgattaaagatga

SEQ ID NO: 2258497 - DNA, 14 bp, Homo sapiens
ttgattcagcaaaa

SEQ ID NO: 2258498 - DNA, 19 bp, Homo sapiens
ttgcaaagacctacctcca

SEQ ID NO: 2258499 - DNA, 17 bp, Homo sapiens
ttgcagcacagctgaga

SEQ ID NO: 2258500 - DNA, 18 bp, Homo sapiens
ttgcagtttatcattcaa

SEQ ID NO: 2258501 - DNA, 13 bp, Homo sapiens
ttgcataagagct

SEQ ID NO: 2258502 - DNA, 13 bp, Homo sapiens
ttgccaaaattca

SEQ ID NO: 2258503 - DNA, 19 bp, Homo sapiens
ttgccaaaattcatttcta

SEQ ID NO: 2258504 - DNA, 16 bp, Homo sapiens
ttgccaggcttaagga

SEQ ID NO: 2258505 - DNA, 20 bp, Homo sapiens
ttgctatagttatacatcaa

SEQ ID NO: 2258506 - DNA, 21 bp, Homo sapiens
ttgctcagcccgcttggccac

SEQ ID NO: 2258507 - DNA, 19 bp, Homo sapiens
ttgctcaggtgcaagtgcc

SEQ ID NO: 2258508 - DNA, 17 bp, Homo sapiens
ttgctcatgttggccaa

SEQ ID NO: 2258509 - DNA, 14 bp, Homo sapiens
ttgctgagcctctg

SEQ ID NO: 2258510 - DNA, 14 bp, Homo sapiens
ttgctggccccagc

SEQ ID NO: 2258511 - DNA, 17 bp, Homo sapiens
ttgctggccccagccct

SEQ ID NO: 2258512 - DNA, 23 bp, Homo sapiens
ttgctggccccagccctgctggg

SEQ ID NO: 2258513 - DNA, 15 bp, Homo sapiens
ttgctttggaaacac

SEQ ID NO: 2258514 - DNA, 14 bp, Homo sapiens
ttgcttttagaaaa

SEQ ID NO: 2258515 - DNA, 20 bp, Homo sapiens
ttggaagtgaaaactttgta

SEQ ID NO: 2258516 - DNA, 16 bp, Homo sapiens
ttggagaagatttatg

SEQ ID NO: 2258517 - DNA, 13 bp, Homo sapiens
ttggagaatttag

SEQ ID NO: 2258518 - DNA, 12 bp, Homo sapiens
ttggcatttgca

SEQ ID NO: 2258519 - DNA, 23 bp, Homo sapiens
ttggctggtagcagcaggctcag

SEQ ID NO: 2258520 - DNA, 23 bp, Homo sapiens
ttggctttcagagccagcctggc

SEQ ID NO: 2258521 - DNA, 21 bp, Homo sapiens
ttggggctttacatactttat

SEQ ID NO: 2258522 - DNA, 14 bp, Homo sapiens
ttggggtctgaccc

SEQ ID NO: 2258523 - DNA, 22 bp, Homo sapiens
ttggtctcccttctctacactc

SEQ ID NO: 2258524 - DNA, 19 bp, Homo sapiens
ttggtgctttttataaaaa

SEQ ID NO: 2258525 - DNA, 18 bp, Homo sapiens
ttgtaaaagcattttgta

SEQ ID NO: 2258526 - DNA, 21 bp, Homo sapiens
ttgtaactaaaataattttgt

SEQ ID NO: 2258527 - DNA, 22 bp, Homo sapiens
ttgtaactaaaataattttgta

SEQ ID NO: 2258528 - DNA, 13 bp, Homo sapiens
ttgtaacttcaaa

SEQ ID NO: 2258529 - DNA, 14 bp, Homo sapiens
ttgtaacttcaaat

SEQ ID NO: 2258530 - DNA, 16 bp, Homo sapiens
ttgtaacttcaaatat

SEQ ID NO: 2258531 - DNA, 20 bp, Homo sapiens
ttgtaatttaatgaaaaggt

SEQ ID NO: 2258532 - DNA, 19 bp, Homo sapiens
ttgtacatacgatttaagg

SEQ ID NO: 2258533 - DNA, 22 bp, Homo sapiens
ttgtacatacgatttaaggtat

SEQ ID NO: 2258534 - DNA, 16 bp, Homo sapiens
ttgtacgttatatatt

SEQ ID NO: 2258535 - DNA, 14 bp, Homo sapiens
ttgtatattacaat

SEQ ID NO: 2258536 - DNA, 15 bp, Homo sapiens
ttgtatattacaatg

SEQ ID NO: 2258537 - DNA, 16 bp, Homo sapiens
ttgtatattacaatga

SEQ ID NO: 2258538 - DNA, 16 bp, Homo sapiens
ttgtattaaactcttc

SEQ ID NO: 2258539 - DNA, 19 bp, Homo sapiens
ttgtattgtatattacaat

SEQ ID NO: 2258540 - DNA, 23 bp, Homo sapiens
ttgtcacttttccttttcttaaa

SEQ ID NO: 2258541 - DNA, 20 bp, Homo sapiens
ttgtcccaaggaatcagcag

SEQ ID NO: 2258542 - DNA, 16 bp, Homo sapiens
ttgtctccacttgtat

SEQ ID NO: 2258543 - DNA, 17 bp, Homo sapiens
ttgtctgaaacatttca

SEQ ID NO: 2258544 - DNA, 14 bp, Homo sapiens
ttgtcttttctgct

SEQ ID NO: 2258545 - DNA, 23 bp, Homo sapiens
ttgtgacaggaaagccctccccc

SEQ ID NO: 2258546 - DNA, 19 bp, Homo sapiens
ttgtgatagcactttctac

SEQ ID NO: 2258547 - DNA, 14 bp, Homo sapiens
ttgtgctgtgggca

SEQ ID NO: 2258548 - DNA, 14 bp, Homo sapiens
ttgtgtaagaaata

SEQ ID NO: 2258549 - DNA, 19 bp, Homo sapiens
ttgttaccttttacagaat

SEQ ID NO: 2258550 - DNA, 17 bp, Homo sapiens
ttgttcgggtgtgcaat

SEQ ID NO: 2258551 - DNA, 22 bp, Homo sapiens
ttgttctccgggtgtggcctca

SEQ ID NO: 2258552 - DNA, 22 bp, Homo sapiens
ttgtttctagactataaatgtt

SEQ ID NO: 2258553 - DNA, 23 bp, Homo sapiens
ttgtttctctagcgctgagctat

SEQ ID NO: 2258554 - DNA, 19 bp, Homo sapiens
ttgtttctttctctgagga

SEQ ID NO: 2258555 - DNA, 12 bp, Homo sapiens
ttagaattattt

SEQ ID NO: 2258556 - DNA, 13 bp, Homo sapiens
ttagaattattta

SEQ ID NO: 2258557 - DNA, 16 bp, Homo sapiens
ttagaattatttaaac

SEQ ID NO: 2258558 - DNA, 13 bp, Homo sapiens
ttagagaactaaa

SEQ ID NO: 2258559 - DNA, 14 bp, Homo sapiens
ttagcaataaataa

SEQ ID NO: 2258560 - DNA, 20 bp, Homo sapiens
ttagcaataaataacacttg

SEQ ID NO: 2258561 - DNA, 16 bp, Homo sapiens
ttagcagagtctgtct

SEQ ID NO: 2258562 - DNA, 14 bp, Homo sapiens
ttagccattgaaat

SEQ ID NO: 2258563 - DNA, 15 bp, Homo sapiens
ttagccattgaaatg

SEQ ID NO: 2258564 - DNA, 17 bp, Homo sapiens
ttaggaaacttgtagaa

SEQ ID NO: 2258565 - DNA, 16 bp, Homo sapiens
ttaggaattgaattaa

SEQ ID NO: 2258566 - DNA, 22 bp, Homo sapiens
ttaggcgcccatggtacaagga

SEQ ID NO: 2258567 - DNA, 13 bp, Homo sapiens
ttagggagaaaat

SEQ ID NO: 2258568 - DNA, 22 bp, Homo sapiens
ttagtactgaagccaaatgaaa

SEQ ID NO: 2258569 - DNA, 21 bp, Homo sapiens
ttagtctcagtttgtgtgtct

SEQ ID NO: 2258570 - DNA, 22 bp, Homo sapiens
ttagtctcagtttgtgtgtctt

SEQ ID NO: 2258571 - DNA, 15 bp, Homo sapiens
ttagttccactgaga

SEQ ID NO: 2258572 - DNA, 12 bp, Homo sapiens
ttataaaaagat

SEQ ID NO: 2258573 - DNA, 16 bp, Homo sapiens
ttataaaaatattaag

SEQ ID NO: 2258574 - DNA, 13 bp, Homo sapiens
ttataaaatggct

SEQ ID NO: 2258575 - DNA, 18 bp, Homo sapiens
ttataaataaaatcatgt

SEQ ID NO: 2258576 - DNA, 18 bp, Homo sapiens
ttataaatcttatgctct

SEQ ID NO: 2258577 - DNA, 17 bp, Homo sapiens
ttatacagttataaaat

SEQ ID NO: 2258578 - DNA, 19 bp, Homo sapiens
ttatatatatagtttattt

SEQ ID NO: 2258579 - DNA, 22 bp, Homo sapiens
ttatcactgtctgttctgcaca

SEQ ID NO: 2258580 - DNA, 17 bp, Homo sapiens
ttatctcagatgttaaa

SEQ ID NO: 2258581 - DNA, 19 bp, Homo sapiens
ttatgctctcactgtttgt

SEQ ID NO: 2258582 - DNA, 17 bp, Homo sapiens
ttatggaaaaataaaac

SEQ ID NO: 2258583 - DNA, 17 bp, Homo sapiens
ttatggatgatttaagt

SEQ ID NO: 2258584 - DNA, 21 bp, Homo sapiens
ttatgtcagcacacacttaca

SEQ ID NO: 2258585 - DNA, 22 bp, Homo sapiens
ttatgtcagcacacacttacag

SEQ ID NO: 2258586 - DNA, 11 bp, Homo sapiens
ttatgtctggg

SEQ ID NO: 2258587 - DNA, 18 bp, Homo sapiens
ttatgttgaaaaaattta

SEQ ID NO: 2258588 - DNA, 21 bp, Homo sapiens
ttatgttgttcaaatgcattt

SEQ ID NO: 2258589 - DNA, 16 bp, Homo sapiens
ttattaaacaaataat

SEQ ID NO: 2258590 - DNA, 18 bp, Homo sapiens
ttattaaatacaaaactt

SEQ ID NO: 2258591 - DNA, 20 bp, Homo sapiens
ttattaaatacaaaacttcc

SEQ ID NO: 2258592 - DNA, 19 bp, Homo sapiens
ttattaccccctccttcag

SEQ ID NO: 2258593 - DNA, 16 bp, Homo sapiens
ttattagggagaaaat

SEQ ID NO: 2258594 - DNA, 24 bp, Homo sapiens
ttattagtaccatagtaccattta

SEQ ID NO: 2258595 - DNA, 23 bp, Homo sapiens
ttattctgggcaccacaaaatat

SEQ ID NO: 2258596 - DNA, 22 bp, Homo sapiens
ttattgcagtttatcattcaag

SEQ ID NO: 2258597 - DNA, 23 bp, Homo sapiens
ttatttaacagctgaattatcta

SEQ ID NO: 2258598 - DNA, 20 bp, Homo sapiens
ttatttacagatgaatgtat

SEQ ID NO: 2258599 - DNA, 23 bp, Homo sapiens
ttatttatgcgtaatttaatggg

SEQ ID NO: 2258600 - DNA, 19 bp, Homo sapiens
ttatttctcgggtgcattt

SEQ ID NO: 2258601 - DNA, 21 bp, Homo sapiens
ttcaaactggggcctccagaa

SEQ ID NO: 2258602 - DNA, 22 bp, Homo sapiens
ttcaacctggtggcaccagatg

SEQ ID NO: 2258603 - DNA, 19 bp, Homo sapiens
ttcaagtgtaaaatatttt

SEQ ID NO: 2258604 - DNA, 16 bp, Homo sapiens
ttcaataaagcattta

SEQ ID NO: 2258605 - DNA, 19 bp, Homo sapiens
ttcaatgtgtataaattgt

SEQ ID NO: 2258606 - DNA, 14 bp, Homo sapiens
ttcaatgtttgaaa

SEQ ID NO: 2258607 - DNA, 15 bp, Homo sapiens
ttcaatgtttgaaat

SEQ ID NO: 2258608 - DNA, 17 bp, Homo sapiens
ttcacagctaagatgcc

SEQ ID NO: 2258609 - DNA, 12 bp, Homo sapiens
ttcacagctcct

SEQ ID NO: 2258610 - DNA, 17 bp, Homo sapiens
ttcacagctcctcccac

SEQ ID NO: 2258611 - DNA, 23 bp, Homo sapiens
ttcactgtttcatctaagtgcct

SEQ ID NO: 2258612 - DNA, 22 bp, Homo sapiens
ttcacttaagttagttccactg

SEQ ID NO: 2258613 - DNA, 13 bp, Homo sapiens
ttcagagatcaag

SEQ ID NO: 2258614 - DNA, 22 bp, Homo sapiens
ttcagaggctcagattgtaata

SEQ ID NO: 2258615 - DNA, 17 bp, Homo sapiens
ttcagcagcaaattttc

SEQ ID NO: 2258616 - DNA, 17 bp, Homo sapiens
ttcaggaagggatgcag

SEQ ID NO: 2258617 - DNA, 21 bp, Homo sapiens
ttcaggtgtagtagttctgtg

SEQ ID NO: 2258618 - DNA, 16 bp, Homo sapiens
ttcagtaagctgtgtg

SEQ ID NO: 2258619 - DNA, 19 bp, Homo sapiens
ttcagtacttttttaaata

SEQ ID NO: 2258620 - DNA, 21 bp, Homo sapiens
ttcagtacttttttaaatatt

SEQ ID NO: 2258621 - DNA, 17 bp, Homo sapiens
ttcagtggaggctggca

SEQ ID NO: 2258622 - DNA, 18 bp, Homo sapiens
ttcagtggaggctggcag

SEQ ID NO: 2258623 - DNA, 17 bp, Homo sapiens
ttcatattttaaacaga

SEQ ID NO: 2258624 - DNA, 23 bp, Homo sapiens
ttcatccagtttgttctccgggt

SEQ ID NO: 2258625 - DNA, 15 bp, Homo sapiens
ttcatctggggtggg

SEQ ID NO: 2258626 - DNA, 16 bp, Homo sapiens
ttcattaacaaaatgt

SEQ ID NO: 2258627 - DNA, 18 bp, Homo sapiens
ttcattcaaactgcactt

SEQ ID NO: 2258628 - DNA, 14 bp, Homo sapiens
ttcattctctttta

SEQ ID NO: 2258629 - DNA, 17 bp, Homo sapiens
ttcatttgttttttcaa

SEQ ID NO: 2258630 - DNA, 12 bp, Homo sapiens
ttcatttttcaa

SEQ ID NO: 2258631 - DNA, 18 bp, Homo sapiens
ttccaaattatttcttaa

SEQ ID NO: 2258632 - DNA, 19 bp, Homo sapiens
ttccaaattatttcttaat

SEQ ID NO: 2258633 - DNA, 23 bp, Homo sapiens
ttccaaattatttcttaattatt

SEQ ID NO: 2258634 - DNA, 14 bp, Homo sapiens
ttccaagctgcggg

SEQ ID NO: 2258635 - DNA, 20 bp, Homo sapiens
ttccacacccaatgctgctc

SEQ ID NO: 2258636 - DNA, 13 bp, Homo sapiens
ttccacagaggac

SEQ ID NO: 2258637 - DNA, 22 bp, Homo sapiens
ttccacagaggacacagagaag

SEQ ID NO: 2258638 - DNA, 15 bp, Homo sapiens
ttccaccccaagaga

SEQ ID NO: 2258639 - DNA, 19 bp, Homo sapiens
ttccactcgtgtgtttcta

SEQ ID NO: 2258640 - DNA, 20 bp, Homo sapiens
ttccagacttccttgagaca

SEQ ID NO: 2258641 - DNA, 11 bp, Homo sapiens
ttccagctcct

SEQ ID NO: 2258642 - DNA, 12 bp, Homo sapiens
ttccatctctgg

SEQ ID NO: 2258643 - DNA, 11 bp, Homo sapiens
ttccatctgtg

SEQ ID NO: 2258644 - DNA, 16 bp, Homo sapiens
ttcccaaacgcctccc

SEQ ID NO: 2258645 - DNA, 15 bp, Homo sapiens
ttcccaacacaaaga

SEQ ID NO: 2258646 - DNA, 14 bp, Homo sapiens
ttcccatcgctgtc

SEQ ID NO: 2258647 - DNA, 15 bp, Homo sapiens
ttcccatcgctgtca

SEQ ID NO: 2258648 - DNA, 19 bp, Homo sapiens
ttccccttctgtgtcacag

SEQ ID NO: 2258649 - DNA, 13 bp, Homo sapiens
ttccctcaccccc

SEQ ID NO: 2258650 - DNA, 14 bp, Homo sapiens
ttccctcaccccct

SEQ ID NO: 2258651 - DNA, 11 bp, Homo sapiens
ttccctccccc

SEQ ID NO: 2258652 - DNA, 13 bp, Homo sapiens
ttccctccccctc

SEQ ID NO: 2258653 - DNA, 15 bp, Homo sapiens
ttccctccccctcct

SEQ ID NO: 2258654 - DNA, 20 bp, Homo sapiens
ttccctctttggctcccctg

SEQ ID NO: 2258655 - DNA, 19 bp, Homo sapiens
ttcccttcagtaccctctc

SEQ ID NO: 2258656 - DNA, 13 bp, Homo sapiens
ttcctaaagaaaa

SEQ ID NO: 2258657 - DNA, 22 bp, Homo sapiens
ttcctcaacagtgttttcagaa

SEQ ID NO: 2258658 - DNA, 14 bp, Homo sapiens
ttcctcctccccac

SEQ ID NO: 2258659 - DNA, 16 bp, Homo sapiens
ttcctcctccccactt

SEQ ID NO: 2258660 - DNA, 21 bp, Homo sapiens
ttcctgcaggcaggaacaaac

SEQ ID NO: 2258661 - DNA, 19 bp, Homo sapiens
ttcctgttcagtaataaaa

SEQ ID NO: 2258662 - DNA, 14 bp, Homo sapiens
ttccttttcttaaa

SEQ ID NO: 2258663 - DNA, 13 bp, Homo sapiens
ttcgaagtcatta

SEQ ID NO: 2258664 - DNA, 14 bp, Homo sapiens
ttcgaagtcattaa

SEQ ID NO: 2258665 - DNA, 15 bp, Homo sapiens
tgtgtgacaattctg

SEQ ID NO: 2258666 - DNA, 20 bp, Homo sapiens
tgtgtgacaattctgttttt

SEQ ID NO: 2258667 - DNA, 15 bp, Homo sapiens
tgtgttacttcaagt

SEQ ID NO: 2258668 - DNA, 16 bp, Homo sapiens
tgttaatacaaggtat

SEQ ID NO: 2258669 - DNA, 17 bp, Homo sapiens
tgttaatacaaggtata

SEQ ID NO: 2258670 - DNA, 20 bp, Homo sapiens
tgttagatatttttcataaa

SEQ ID NO: 2258671 - DNA, 12 bp, Homo sapiens
tgttagcaaaga

SEQ ID NO: 2258672 - DNA, 13 bp, Homo sapiens
tgttagcaaagat

SEQ ID NO: 2258673 - DNA, 13 bp, Homo sapiens
tgttagtaacatg

SEQ ID NO: 2258674 - DNA, 21 bp, Homo sapiens
tgttcagaaagcaataacttt

SEQ ID NO: 2258675 - DNA, 21 bp, Homo sapiens
tgttccacacccaatgctgct

SEQ ID NO: 2258676 - DNA, 19 bp, Homo sapiens
tgttcctggcagtttaaaa

SEQ ID NO: 2258677 - DNA, 21 bp, Homo sapiens
tgttctccgggtgtggcctca

SEQ ID NO: 2258678 - DNA, 12 bp, Homo sapiens
tgttgaaaaaat

SEQ ID NO: 2258679 - DNA, 16 bp, Homo sapiens
tgttgattaaagatga

SEQ ID NO: 2258680 - DNA, 21 bp, Homo sapiens
tgttgcaatgtgaaaaatctg

SEQ ID NO: 2258681 - DNA, 17 bp, Homo sapiens
tgttgctatgtgcctta

SEQ ID NO: 2258682 - DNA, 23 bp, Homo sapiens
tgttgctcagtgtttttgtgaat

SEQ ID NO: 2258683 - DNA, 14 bp, Homo sapiens
tgttggaaaaaatt

SEQ ID NO: 2258684 - DNA, 15 bp, Homo sapiens
tgttggaaaaaattt

SEQ ID NO: 2258685 - DNA, 15 bp, Homo sapiens
tgttggcaggcccac

SEQ ID NO: 2258686 - DNA, 20 bp, Homo sapiens
tgttggcttggggcaacaga

SEQ ID NO: 2258687 - DNA, 14 bp, Homo sapiens
tgttgggactgcta

SEQ ID NO: 2258688 - DNA, 19 bp, Homo sapiens
tgttgggactgctaaataa

SEQ ID NO: 2258689 - DNA, 17 bp, Homo sapiens
tgttgtaaaacaaaatt

SEQ ID NO: 2258690 - DNA, 18 bp, Homo sapiens
tgttgtacaatcaaaaca

SEQ ID NO: 2258691 - DNA, 23 bp, Homo sapiens
tgttgtacatacagaggtaacta

SEQ ID NO: 2258692 - DNA, 21 bp, Homo sapiens
tgttgtacatacgatttaagg

SEQ ID NO: 2258693 - DNA, 22 bp, Homo sapiens
tgttgtgctgggagcaggactg

SEQ ID NO: 2258694 - DNA, 23 bp, Homo sapiens
tgttgttcaaatgcattttgggg

SEQ ID NO: 2258695 - DNA, 22 bp, Homo sapiens
tgttgttttaacctcccctctc

SEQ ID NO: 2258696 - DNA, 19 bp, Homo sapiens
tgtttcagcttctctgcta

SEQ ID NO: 2258697 - DNA, 20 bp, Homo sapiens
tgtttccagacttccttgag

SEQ ID NO: 2258698 - DNA, 15 bp, Homo sapiens
tgtttggcatgtaaa

SEQ ID NO: 2258699 - DNA, 21 bp, Homo sapiens
tgttttacaatagttctgtgg

SEQ ID NO: 2258700 - DNA, 19 bp, Homo sapiens
tgttttccgtgaaaacgga

SEQ ID NO: 2258701 - DNA, 11 bp, Homo sapiens
tgttttgaaag

SEQ ID NO: 2258702 - DNA, 16 bp, Homo sapiens
tgttttgttgtttgat

SEQ ID NO: 2258703 - DNA, 12 bp, Homo sapiens
tgtttttgtgaa

SEQ ID NO: 2258704 - DNA, 16 bp, Homo sapiens
tgtttttttgttatta

SEQ ID NO: 2258705 - DNA, 18 bp, Homo sapiens
tgtttttttgttattaaa

SEQ ID NO: 2258706 - DNA, 14 bp, Homo sapiens
ttaaaaaatatttt

SEQ ID NO: 2258707 - DNA, 20 bp, Homo sapiens
ttaaaaaatattttctctgt

SEQ ID NO: 2258708 - DNA, 23 bp, Homo sapiens
ttaaaaagtccataccttatata

SEQ ID NO: 2258709 - DNA, 19 bp, Homo sapiens
ttaaaaatggtatcaaaat

SEQ ID NO: 2258710 - DNA, 20 bp, Homo sapiens
ttaaaaatggtatcaaaatt

SEQ ID NO: 2258711 - DNA, 22 bp, Homo sapiens
ttaaaactcaacattactgtta

SEQ ID NO: 2258712 - DNA, 15 bp, Homo sapiens
ttaaaagtaaaatgt

SEQ ID NO: 2258713 - DNA, 17 bp, Homo sapiens
ttaaaagtaaaatgtct

SEQ ID NO: 2258714 - DNA, 12 bp, Homo sapiens
ttaaaatataat

SEQ ID NO: 2258715 - DNA, 13 bp, Homo sapiens
ttaaaccttttat

SEQ ID NO: 2258716 - DNA, 17 bp, Homo sapiens
ttaaacgcttcttatgt

SEQ ID NO: 2258717 - DNA, 13 bp, Homo sapiens
ttaaagcctcctc

SEQ ID NO: 2258718 - DNA, 20 bp, Homo sapiens
ttaaaggaaacgtggcagga

SEQ ID NO: 2258719 - DNA, 23 bp, Homo sapiens
ttaaaggaaacgtggcaggactt

SEQ ID NO: 2258720 - DNA, 16 bp, Homo sapiens
ttaaagttgtttccca

SEQ ID NO: 2258721 - DNA, 19 bp, Homo sapiens
ttaaataaaagcacaagta

SEQ ID NO: 2258722 - DNA, 16 bp, Homo sapiens
ttaaataatgtattta

SEQ ID NO: 2258723 - DNA, 21 bp, Homo sapiens
ttaaataatgtatttactttt

SEQ ID NO: 2258724 - DNA, 20 bp, Homo sapiens
ttaaatgcaaccatttgaaa

SEQ ID NO: 2258725 - DNA, 16 bp, Homo sapiens
ttaaattaatatcttt

SEQ ID NO: 2258726 - DNA, 12 bp, Homo sapiens
ttaaattacaat

SEQ ID NO: 2258727 - DNA, 15 bp, Homo sapiens
ttaaattacaatttt

SEQ ID NO: 2258728 - DNA, 12 bp, Homo sapiens
ttaacaatgcaa

SEQ ID NO: 2258729 - DNA, 13 bp, Homo sapiens
ttaacaatgcaac

SEQ ID NO: 2258730 - DNA, 17 bp, Homo sapiens
ttaacaatgcaactttt

SEQ ID NO: 2258731 - DNA, 21 bp, Homo sapiens
ttaaccttactaattatacta

SEQ ID NO: 2258732 - DNA, 17 bp, Homo sapiens
ttaacctttccgctgtc

SEQ ID NO: 2258733 - DNA, 21 bp, Homo sapiens
ttaacttgaaaattttttaac

SEQ ID NO: 2258734 - DNA, 22 bp, Homo sapiens
ttaagaaatagacagcatgaga

SEQ ID NO: 2258735 - DNA, 22 bp, Homo sapiens
ttaagcatatgtgttacttcaa

SEQ ID NO: 2258736 - DNA, 13 bp, Homo sapiens
ttaagggaaaaat

SEQ ID NO: 2258737 - DNA, 18 bp, Homo sapiens
ttaaggtgatatatttaa

SEQ ID NO: 2258738 - DNA, 11 bp, Homo sapiens
ttaagtcccag

SEQ ID NO: 2258739 - DNA, 19 bp, Homo sapiens
ttaagtcccagtatacctc

SEQ ID NO: 2258740 - DNA, 22 bp, Homo sapiens
ttaagtcccagtatacctcatt

SEQ ID NO: 2258741 - DNA, 14 bp, Homo sapiens
ttaataaaacctgt

SEQ ID NO: 2258742 - DNA, 13 bp, Homo sapiens
ttaataaaactgt

SEQ ID NO: 2258743 - DNA, 23 bp, Homo sapiens
ttaatacaaggtataataaaatt

SEQ ID NO: 2258744 - DNA, 15 bp, Homo sapiens
ttaatatgaaaactt

SEQ ID NO: 2258745 - DNA, 14 bp, Homo sapiens
ttaatcaagttgaa

SEQ ID NO: 2258746 - DNA, 14 bp, Homo sapiens
ttaatcaccttctt

SEQ ID NO: 2258747 - DNA, 20 bp, Homo sapiens
ttaatcaccttctttgtaat

SEQ ID NO: 2258748 - DNA, 17 bp, Homo sapiens
ttaatcactattgttcc

SEQ ID NO: 2258749 - DNA, 23 bp, Homo sapiens
ttaatcatagttactgtgtaaac

SEQ ID NO: 2258750 - DNA, 18 bp, Homo sapiens
ttaatctctaacagtgga

SEQ ID NO: 2258751 - DNA, 18 bp, Homo sapiens
ttaatctttgtgacagga

SEQ ID NO: 2258752 - DNA, 19 bp, Homo sapiens
ttaatgatatactgatctt

SEQ ID NO: 2258753 - DNA, 12 bp, Homo sapiens
ttaatgcacttt

SEQ ID NO: 2258754 - DNA, 13 bp, Homo sapiens
ttaatgcactttc

SEQ ID NO: 2258755 - DNA, 18 bp, Homo sapiens
ttaatgcttttatatttt

SEQ ID NO: 2258756 - DNA, 21 bp, Homo sapiens
ttaatgtatataaaaatggct

SEQ ID NO: 2258757 - DNA, 22 bp, Homo sapiens
ttaattaagcaaagcacccatt

SEQ ID NO: 2258758 - DNA, 15 bp, Homo sapiens
ttaatttctatgaag

SEQ ID NO: 2258759 - DNA, 20 bp, Homo sapiens
ttacaacgaatttacagtct

SEQ ID NO: 2258760 - DNA, 15 bp, Homo sapiens
ttacaatagttctgt

SEQ ID NO: 2258761 - DNA, 17 bp, Homo sapiens
ttacaatagttctgtgg

SEQ ID NO: 2258762 - DNA, 13 bp, Homo sapiens
ttacaattttatc

SEQ ID NO: 2258763 - DNA, 14 bp, Homo sapiens
ttacagaataaaag

SEQ ID NO: 2258764 - DNA, 19 bp, Homo sapiens
ttacagaataaaagaatta

SEQ ID NO: 2258765 - DNA, 20 bp, Homo sapiens
ttacagatgaatgtatttat

SEQ ID NO: 2258766 - DNA, 18 bp, Homo sapiens
ttaccagtgccttaaact

SEQ ID NO: 2258767 - DNA, 22 bp, Homo sapiens
ttacctaccttactatttaaag

SEQ ID NO: 2258768 - DNA, 15 bp, Homo sapiens
ttactcacagcactt

SEQ ID NO: 2258769 - DNA, 18 bp, Homo sapiens
ttactgtgtttcagcatg

SEQ ID NO: 2258770 - DNA, 11 bp, Homo sapiens
ttacttctctt

SEQ ID NO: 2258771 - DNA, 15 bp, Homo sapiens
ttacttgatgatttt

SEQ ID NO: 2258772 - DNA, 22 bp, Homo sapiens
ttagaatccaaacttggatttt

SEQ ID NO: 2258773 - DNA, 15 bp, Homo sapiens
ttagaatcttttaaa

SEQ ID NO: 2258774 - DNA, 13 bp, Homo sapiens
tggaggcacttta

SEQ ID NO: 2258775 - DNA, 14 bp, Homo sapiens
tggaggcactttag

SEQ ID NO: 2258776 - DNA, 20 bp, Homo sapiens
tggaggcattgatgcatgct

SEQ ID NO: 2258777 - DNA, 14 bp, Homo sapiens
tggaggggtgtggc

SEQ ID NO: 2258778 - DNA, 19 bp, Homo sapiens
tggagtcccctcacctcct

SEQ ID NO: 2258779 - DNA, 19 bp, Homo sapiens
tggagttcttagctatcct

SEQ ID NO: 2258780 - DNA, 14 bp, Homo sapiens
tggagttggagccg

SEQ ID NO: 2258781 - DNA, 15 bp, Homo sapiens
tggataaattgttta

SEQ ID NO: 2258782 - DNA, 14 bp, Homo sapiens
tggattaaattagt

SEQ ID NO: 2258783 - DNA, 20 bp, Homo sapiens
tggatttttgactctggcaa

SEQ ID NO: 2258784 - DNA, 17 bp, Homo sapiens
tggcaaagcttttagaa

SEQ ID NO: 2258785 - DNA, 22 bp, Homo sapiens
tggcactaacgttgagcccctg

SEQ ID NO: 2258786 - DNA, 18 bp, Homo sapiens
tggcagagagcacagtga

SEQ ID NO: 2258787 - DNA, 15 bp, Homo sapiens
tggcagagtcctgga

SEQ ID NO: 2258788 - DNA, 18 bp, Homo sapiens
tggcaggcccactcccca

SEQ ID NO: 2258789 - DNA, 15 bp, Homo sapiens
tggcagggtccctcc

SEQ ID NO: 2258790 - DNA, 17 bp, Homo sapiens
tggcatgtaaatgtaaa

SEQ ID NO: 2258791 - DNA, 15 bp, Homo sapiens
tggccagacgctgcc

SEQ ID NO: 2258792 - DNA, 13 bp, Homo sapiens
tggccagcaccct

SEQ ID NO: 2258793 - DNA, 15 bp, Homo sapiens
tggccagcaccctct

SEQ ID NO: 2258794 - DNA, 20 bp, Homo sapiens
tggccagcaccctctcctgg

SEQ ID NO: 2258795 - DNA, 22 bp, Homo sapiens
tggccaggagcaggcacgggtg

SEQ ID NO: 2258796 - DNA, 20 bp, Homo sapiens
tggccaggctggtcttgaac

SEQ ID NO: 2258797 - DNA, 12 bp, Homo sapiens
tggccatccctg

SEQ ID NO: 2258798 - DNA, 19 bp, Homo sapiens
tggccatccctgggcccct

SEQ ID NO: 2258799 - DNA, 20 bp, Homo sapiens
tggccatccctgggcccctc

SEQ ID NO: 2258800 - DNA, 14 bp, Homo sapiens
tggccatgtatgaa

SEQ ID NO: 2258801 - DNA, 16 bp, Homo sapiens
tggccccagccctgct

SEQ ID NO: 2258802 - DNA, 21 bp, Homo sapiens
tggcccctcaaatcgtccagc

SEQ ID NO: 2258803 - DNA, 16 bp, Homo sapiens
tggcctatgtggtcta

SEQ ID NO: 2258804 - DNA, 13 bp, Homo sapiens
tggcctcagccct

SEQ ID NO: 2258805 - DNA, 15 bp, Homo sapiens
tggcctcagccctca

SEQ ID NO: 2258806 - DNA, 20 bp, Homo sapiens
tggcctggaatttgggcaga

SEQ ID NO: 2258807 - DNA, 13 bp, Homo sapiens
tggcctggactgt

SEQ ID NO: 2258808 - DNA, 18 bp, Homo sapiens
tggctcagacatgttttc

SEQ ID NO: 2258809 - DNA, 17 bp, Homo sapiens
tggctccttcccatcgc

SEQ ID NO: 2258810 - DNA, 19 bp, Homo sapiens
tggctcttgatacccccct

SEQ ID NO: 2258811 - DNA, 20 bp, Homo sapiens
tggctcttgatacccccctc

SEQ ID NO: 2258812 - DNA, 22 bp, Homo sapiens
tggctgtaatcatttgtttaca

SEQ ID NO: 2258813 - DNA, 16 bp, Homo sapiens
tggcttggaagattct

SEQ ID NO: 2258814 - DNA, 20 bp, Homo sapiens
tggctttgtcacttttcctt

SEQ ID NO: 2258815 - DNA, 20 bp, Homo sapiens
tggcttttattaatgcactt

SEQ ID NO: 2258816 - DNA, 22 bp, Homo sapiens
tggcttttattaatgcactttc

SEQ ID NO: 2258817 - DNA, 13 bp, Homo sapiens
tgggaaaaaagca

SEQ ID NO: 2258818 - DNA, 22 bp, Homo sapiens
tgggaacctagctacactgagc

SEQ ID NO: 2258819 - DNA, 23 bp, Homo sapiens
tgggaacctagctacactgagca

SEQ ID NO: 2258820 - DNA, 13 bp, Homo sapiens
tgggaatgggaga

SEQ ID NO: 2258821 - DNA, 22 bp, Homo sapiens
tgggacagaggagcaaggttta

SEQ ID NO: 2258822 - DNA, 14 bp, Homo sapiens
tgggacttaactcc

SEQ ID NO: 2258823 - DNA, 18 bp, Homo sapiens
tgggaggagcgaaatcta

SEQ ID NO: 2258824 - DNA, 20 bp, Homo sapiens
tgggagtactctcatcacta

SEQ ID NO: 2258825 - DNA, 16 bp, Homo sapiens
tgggcaccacaaaata

SEQ ID NO: 2258826 - DNA, 13 bp, Homo sapiens
tgggcagcaccct

SEQ ID NO: 2258827 - DNA, 14 bp, Homo sapiens
tgggcagcaccctc

SEQ ID NO: 2258828 - DNA, 18 bp, Homo sapiens
tgggcagcaccctccccc

SEQ ID NO: 2258829 - DNA, 13 bp, Homo sapiens
tgggcagccagac

SEQ ID NO: 2258830 - DNA, 10 bp, Homo sapiens
tgggccaggg

SEQ ID NO: 2258831 - DNA, 19 bp, Homo sapiens
tgggccatgtccaaagagg

SEQ ID NO: 2258832 - DNA, 17 bp, Homo sapiens
tgggcccctccacgcct

SEQ ID NO: 2258833 - DNA, 22 bp, Homo sapiens
tgggcccctccacgcctcctgg

SEQ ID NO: 2258834 - DNA, 21 bp, Homo sapiens
tgggccggcttcatgccagct

SEQ ID NO: 2258835 - DNA, 20 bp, Homo sapiens
tgggcctcagttcaacctgg

SEQ ID NO: 2258836 - DNA, 21 bp, Homo sapiens
tgggctcactgtgctggggca

SEQ ID NO: 2258837 - DNA, 15 bp, Homo sapiens
tgggctgtctgtcac

SEQ ID NO: 2258838 - DNA, 18 bp, Homo sapiens
tgggctgtctgtcaccag

SEQ ID NO: 2258839 - DNA, 16 bp, Homo sapiens
tggggacttgtgtctg

SEQ ID NO: 2258840 - DNA, 22 bp, Homo sapiens
tggggatccccgcctggccagg

SEQ ID NO: 2258841 - DNA, 23 bp, Homo sapiens
tggggatccccgcctggccagga

SEQ ID NO: 2258842 - DNA, 22 bp, Homo sapiens
tggggatcttcccacaggaggg

SEQ ID NO: 2258843 - DNA, 17 bp, Homo sapiens
tggggcaggctgggcca

SEQ ID NO: 2258844 - DNA, 18 bp, Homo sapiens
tggggcaggctgggccat

SEQ ID NO: 2258845 - DNA, 17 bp, Homo sapiens
tgggggacgagggccag

SEQ ID NO: 2258846 - DNA, 21 bp, Homo sapiens
tgggggaggggggggtggggt

SEQ ID NO: 2258847 - DNA, 18 bp, Homo sapiens
tgggggatgggccagggt

SEQ ID NO: 2258848 - DNA, 21 bp, Homo sapiens
tgggggatgggccagggttta

SEQ ID NO: 2258849 - DNA, 17 bp, Homo sapiens
tggggggccgggcaggt

SEQ ID NO: 2258850 - DNA, 20 bp, Homo sapiens
tggggggccgggcaggtcct

SEQ ID NO: 2258851 - DNA, 15 bp, Homo sapiens
tgggggtgagggtcc

SEQ ID NO: 2258852 - DNA, 12 bp, Homo sapiens
tgggggttttta

SEQ ID NO: 2258853 - DNA, 10 bp, Homo sapiens
tggggtgggg

SEQ ID NO: 2258854 - DNA, 18 bp, Homo sapiens
tggggttatctctgtgtt

SEQ ID NO: 2258855 - DNA, 21 bp, Homo sapiens
tgggtctaggacacagttcct

SEQ ID NO: 2258856 - DNA, 19 bp, Homo sapiens
tgggtgttcctggcagttt

SEQ ID NO: 2258857 - DNA, 20 bp, Homo sapiens
tgggtgttcctggcagttta

SEQ ID NO: 2258858 - DNA, 14 bp, Homo sapiens
tgggtttcctgcag

SEQ ID NO: 2258859 - DNA, 15 bp, Homo sapiens
tgggtttcctgcagg

SEQ ID NO: 2258860 - DNA, 16 bp, Homo sapiens
tgggtttcctgcaggc

SEQ ID NO: 2258861 - DNA, 17 bp, Homo sapiens
tgggtttcctgcaggca

SEQ ID NO: 2258862 - DNA, 16 bp, Homo sapiens
tggtaccctcctggct

SEQ ID NO: 2258863 - DNA, 18 bp, Homo sapiens
tggtactgtagcagggga

SEQ ID NO: 2258864 - DNA, 19 bp, Homo sapiens
tggtagaagtttggctgct

SEQ ID NO: 2258865 - DNA, 14 bp, Homo sapiens
tggtagcagcaggc

SEQ ID NO: 2258866 - DNA, 15 bp, Homo sapiens
tggtagcagcaggct

SEQ ID NO: 2258867 - DNA, 18 bp, Homo sapiens
tggtatcaaaattacata

SEQ ID NO: 2258868 - DNA, 14 bp, Homo sapiens
tggtatgctggcca

SEQ ID NO: 2258869 - DNA, 15 bp, Homo sapiens
tggtatgctggccag

SEQ ID NO: 2258870 - DNA, 17 bp, Homo sapiens
tggtctggttgggcagc

SEQ ID NO: 2258871 - DNA, 14 bp, Homo sapiens
tggtgactgtccca

SEQ ID NO: 2258872 - DNA, 16 bp, Homo sapiens
tggtgagagtcaaagc

SEQ ID NO: 2258873 - DNA, 18 bp, Homo sapiens
tggtgagagtcaaagctg

SEQ ID NO: 2258874 - DNA, 21 bp, Homo sapiens
tggtggcaccagatgcaacct

SEQ ID NO: 2258875 - DNA, 16 bp, Homo sapiens
tggttccccagtagag

SEQ ID NO: 2258876 - DNA, 18 bp, Homo sapiens
tggttcccgtttctccac

SEQ ID NO: 2258877 - DNA, 20 bp, Homo sapiens
tggttcccgtttctccacct

SEQ ID NO: 2258878 - DNA, 18 bp, Homo sapiens
tggtttaaaagaaaaaat

SEQ ID NO: 2258879 - DNA, 12 bp, Homo sapiens
tggttttaagaa

SEQ ID NO: 2258880 - DNA, 14 bp, Homo sapiens
tgtaaaacaaaatt

SEQ ID NO: 2258881 - DNA, 18 bp, Homo sapiens
tgtaaaagcattttgtaa

SEQ ID NO: 2258882 - DNA, 19 bp, Homo sapiens
tgtaaaagcattttgtaat

SEQ ID NO: 2258883 - DNA, 21 bp, Homo sapiens
tgtaaaatattttgaatcaat

SEQ ID NO: 2258884 - DNA, 18 bp, Homo sapiens
tgtaaacagcctcttttt

SEQ ID NO: 2258885 - DNA, 13 bp, Homo sapiens
tgtaaactttttg

SEQ ID NO: 2258886 - DNA, 17 bp, Homo sapiens
tgtaaataggattttta

SEQ ID NO: 2258887 - DNA, 16 bp, Homo sapiens
tgtaaatgtaaactca

SEQ ID NO: 2258888 - DNA, 22 bp, Homo sapiens
tgtaacactgtgtacacctcaa

SEQ ID NO: 2258889 - DNA, 17 bp, Homo sapiens
tgtaacatactggcctg

SEQ ID NO: 2258890 - DNA, 15 bp, Homo sapiens
tgtaactaaaataat

SEQ ID NO: 2258891 - DNA, 22 bp, Homo sapiens
tgtaagatatttgcagtttttc

SEQ ID NO: 2258892 - DNA, 20 bp, Homo sapiens
tgtaatagggaaaattctaa

SEQ ID NO: 2258893 - DNA, 19 bp, Homo sapiens
tgtaatcatttgtttacat

SEQ ID NO: 2258894 - DNA, 14 bp, Homo sapiens
tgtaatcttcccca

SEQ ID NO: 2258895 - DNA, 17 bp, Homo sapiens
tgtaatggactatgcac

SEQ ID NO: 2258896 - DNA, 15 bp, Homo sapiens
tgtaatttaatgaaa

SEQ ID NO: 2258897 - DNA, 20 bp, Homo sapiens
tgtaattttgtgtaagaaat

SEQ ID NO: 2258898 - DNA, 15 bp, Homo sapiens
tgtacacttaattac

SEQ ID NO: 2258899 - DNA, 14 bp, Homo sapiens
tgtacagattttat

SEQ ID NO: 2258900 - DNA, 21 bp, Homo sapiens
tgtacataccctggccgcccc

SEQ ID NO: 2258901 - DNA, 14 bp, Homo sapiens
tgtaccaaaattca

SEQ ID NO: 2258902 - DNA, 23 bp, Homo sapiens
tgtaccaaaattcatctgtctat

SEQ ID NO: 2258903 - DNA, 15 bp, Homo sapiens
tgtacctcaaatgaa

SEQ ID NO: 2258904 - DNA, 21 bp, Homo sapiens
tgtacctcaaatgaattcttt

SEQ ID NO: 2258905 - DNA, 22 bp, Homo sapiens
tgtaccttttgaggagccccag

SEQ ID NO: 2258906 - DNA, 13 bp, Homo sapiens
tgtacttttcatt

SEQ ID NO: 2258907 - DNA, 22 bp, Homo sapiens
tgtacttttcattctcttttaa

SEQ ID NO: 2258908 - DNA, 22 bp, Homo sapiens
tgtagcagtgagtcatatctta

SEQ ID NO: 2258909 - DNA, 17 bp, Homo sapiens
tgtagtcctcataaaaa

SEQ ID NO: 2258910 - DNA, 13 bp, Homo sapiens
tgtataaaataca

SEQ ID NO: 2258911 - DNA, 19 bp, Homo sapiens
tgtataaaatacatagtga

SEQ ID NO: 2258912 - DNA, 16 bp, Homo sapiens
tgtataagtggaggca

SEQ ID NO: 2258913 - DNA, 21 bp, Homo sapiens
tgtataagtggaggcacttta

SEQ ID NO: 2258914 - DNA, 20 bp, Homo sapiens
tgtatatatggatcagagga

SEQ ID NO: 2258915 - DNA, 22 bp, Homo sapiens
tgtatatttgtgatagcacttt

SEQ ID NO: 2258916 - DNA, 17 bp, Homo sapiens
tgtatattttgttacct

SEQ ID NO: 2258917 - DNA, 14 bp, Homo sapiens
tgtatcaaatacat

SEQ ID NO: 2258918 - DNA, 23 bp, Homo sapiens
tgtatcaaatacatttaaaacat

SEQ ID NO: 2258919 - DNA, 21 bp, Homo sapiens
tgtatctaagaataataaaat

SEQ ID NO: 2258920 - DNA, 19 bp, Homo sapiens
tgtatctagcttcttcaga

SEQ ID NO: 2258921 - DNA, 12 bp, Homo sapiens
tgtatgttgtac

SEQ ID NO: 2258922 - DNA, 13 bp, Homo sapiens
tgtattttacaca

SEQ ID NO: 2258923 - DNA, 19 bp, Homo sapiens
tgtcaaatatttagatgta

SEQ ID NO: 2258924 - DNA, 21 bp, Homo sapiens
tgtcaagaatagcattgtaaa

SEQ ID NO: 2258925 - DNA, 13 bp, Homo sapiens
tgtcaagattttt

SEQ ID NO: 2258926 - DNA, 18 bp, Homo sapiens
tgtcacagtaaaaataaa

SEQ ID NO: 2258927 - DNA, 15 bp, Homo sapiens
tgtcactcattgctg

SEQ ID NO: 2258928 - DNA, 22 bp, Homo sapiens
tgtcactcattgctgagcctct

SEQ ID NO: 2258929 - DNA, 22 bp, Homo sapiens
tgtcagccagccgccctgggct

SEQ ID NO: 2258930 - DNA, 16 bp, Homo sapiens
tgtcatagtcttgaaa

SEQ ID NO: 2258931 - DNA, 23 bp, Homo sapiens
tgtcatagtcttgaaatgaaagg

SEQ ID NO: 2258932 - DNA, 23 bp, Homo sapiens
tgtcatagttctgagctgccagt

SEQ ID NO: 2258933 - DNA, 16 bp, Homo sapiens
tgtcattgaaaaacta

SEQ ID NO: 2258934 - DNA, 11 bp, Homo sapiens
tgtccaaagag

SEQ ID NO: 2258935 - DNA, 17 bp, Homo sapiens
tgtccaaagaggctgcc

SEQ ID NO: 2258936 - DNA, 18 bp, Homo sapiens
tgtcccaccgggagcctc

SEQ ID NO: 2258937 - DNA, 22 bp, Homo sapiens
tgtcccaccgggagcctccccc

SEQ ID NO: 2258938 - DNA, 15 bp, Homo sapiens
tgtcccctcactctg

SEQ ID NO: 2258939 - DNA, 14 bp, Homo sapiens
tgtccctccccctt

SEQ ID NO: 2258940 - DNA, 18 bp, Homo sapiens
tgtccttagaacatttta

SEQ ID NO: 2258941 - DNA, 14 bp, Homo sapiens
tgtcctttcccttc

SEQ ID NO: 2258942 - DNA, 16 bp, Homo sapiens
tgtcgccccaggccct

SEQ ID NO: 2258943 - DNA, 17 bp, Homo sapiens
tgtcggggctgacctct

SEQ ID NO: 2258944 - DNA, 20 bp, Homo sapiens
tgtctacatatgatctgtct

SEQ ID NO: 2258945 - DNA, 22 bp, Homo sapiens
tgtctagtaattgggaaaaaag

SEQ ID NO: 2258946 - DNA, 21 bp, Homo sapiens
tgtctatgattgtactttgaa

SEQ ID NO: 2258947 - DNA, 20 bp, Homo sapiens
tgtctatttttaatgtttgt

SEQ ID NO: 2258948 - DNA, 17 bp, Homo sapiens
tgtctcactaaagcatg

SEQ ID NO: 2258949 - DNA, 13 bp, Homo sapiens
tgtctcagcctct

SEQ ID NO: 2258950 - DNA, 17 bp, Homo sapiens
tgtctcagcctctgcca

SEQ ID NO: 2258951 - DNA, 20 bp, Homo sapiens
tgtctcagcgaggtgtaaag

SEQ ID NO: 2258952 - DNA, 15 bp, Homo sapiens
tgtctcaggaaaaca

SEQ ID NO: 2258953 - DNA, 19 bp, Homo sapiens
tgtctgaaacatttcataa

SEQ ID NO: 2258954 - DNA, 19 bp, Homo sapiens
tgtctgtggcaaaagttta

SEQ ID NO: 2258955 - DNA, 15 bp, Homo sapiens
tgtcttaattattat

SEQ ID NO: 2258956 - DNA, 16 bp, Homo sapiens
tgtcttctaactttat

SEQ ID NO: 2258957 - DNA, 23 bp, Homo sapiens
tgtcttctaactttattctttgt

SEQ ID NO: 2258958 - DNA, 14 bp, Homo sapiens
tgtctttaaaaact

SEQ ID NO: 2258959 - DNA, 15 bp, Homo sapiens
tgtcttttaaaatgc

SEQ ID NO: 2258960 - DNA, 15 bp, Homo sapiens
tgtgaagagactctg

SEQ ID NO: 2258961 - DNA, 19 bp, Homo sapiens
tgtgacaggaaagccctcc

SEQ ID NO: 2258962 - DNA, 21 bp, Homo sapiens
tgtgagaaggtttattgttaa

SEQ ID NO: 2258963 - DNA, 15 bp, Homo sapiens
tgtgatttctttctt

SEQ ID NO: 2258964 - DNA, 15 bp, Homo sapiens
tgtgatttttgtaat

SEQ ID NO: 2258965 - DNA, 11 bp, Homo sapiens
tgtgatttttt

SEQ ID NO: 2258966 - DNA, 20 bp, Homo sapiens
tgtgcaatagacacatacat

SEQ ID NO: 2258967 - DNA, 15 bp, Homo sapiens
tgtgccttctttgta

SEQ ID NO: 2258968 - DNA, 16 bp, Homo sapiens
tgtgccttcttttgat

SEQ ID NO: 2258969 - DNA, 14 bp, Homo sapiens
tgtgcgttaaataa

SEQ ID NO: 2258970 - DNA, 18 bp, Homo sapiens
tgtgcgttaaataagcaa

SEQ ID NO: 2258971 - DNA, 17 bp, Homo sapiens
tgtgctagaaattttca

SEQ ID NO: 2258972 - DNA, 20 bp, Homo sapiens
tgtgctagaaattttcaaga

SEQ ID NO: 2258973 - DNA, 15 bp, Homo sapiens
tgtgctcagaagggc

SEQ ID NO: 2258974 - DNA, 12 bp, Homo sapiens
tgtgctgtgggc

SEQ ID NO: 2258975 - DNA, 13 bp, Homo sapiens
tgtgctgtgggca

SEQ ID NO: 2258976 - DNA, 14 bp, Homo sapiens
tgtgctgtgggcag

SEQ ID NO: 2258977 - DNA, 15 bp, Homo sapiens
tgtgctgtgggcagc

SEQ ID NO: 2258978 - DNA, 17 bp, Homo sapiens
tgtggcaggagggcagt

SEQ ID NO: 2258979 - DNA, 12 bp, Homo sapiens
tgtggcctcagc

SEQ ID NO: 2258980 - DNA, 17 bp, Homo sapiens
tgtggcctcagccctca

SEQ ID NO: 2258981 - DNA, 11 bp, Homo sapiens
tgtggcctgca

SEQ ID NO: 2258982 - DNA, 15 bp, Homo sapiens
tgtggctccttccca

SEQ ID NO: 2258983 - DNA, 14 bp, Homo sapiens
tgtgggcagcaccc

SEQ ID NO: 2258984 - DNA, 14 bp, Homo sapiens
tgtgtaaacaaaat

SEQ ID NO: 2258985 - DNA, 20 bp, Homo sapiens
tgtgtaaacaaaatgaagct

SEQ ID NO: 2258986 - DNA, 14 bp, Homo sapiens
tgtgtaaagattta

SEQ ID NO: 2258987 - DNA, 19 bp, Homo sapiens
tgtgtaaagatttatacag

SEQ ID NO: 2258988 - DNA, 15 bp, Homo sapiens
tgtgtacccaaacgt

SEQ ID NO: 2258989 - DNA, 17 bp, Homo sapiens
tgtgtcacagttcttgg

SEQ ID NO: 2258990 - DNA, 16 bp, Homo sapiens
tgtgtcttaattatta

SEQ ID NO: 2258991 - DNA, 18 bp, Homo sapiens
tgtgtctttcacagctcc

SEQ ID NO: 2258992 - DNA, 12 bp, Homo sapiens
tgtgtctttcta

SEQ ID NO: 2258993 - DNA, 13 bp, Homo sapiens
tgtgtctttctct

SEQ ID NO: 2258994 - DNA, 22 bp, Homo sapiens
tgcacacctactagtcaccaga

SEQ ID NO: 2258995 - DNA, 12 bp, Homo sapiens
tgcaccaaagac

SEQ ID NO: 2258996 - DNA, 13 bp, Homo sapiens
tgcaccaaagaca

SEQ ID NO: 2258997 - DNA, 22 bp, Homo sapiens
tgcaccacggcgtttttttaca

SEQ ID NO: 2258998 - DNA, 23 bp, Homo sapiens
tgcaccgagtgatttccatctct

SEQ ID NO: 2258999 - DNA, 15 bp, Homo sapiens
tgcacgtggggccca

SEQ ID NO: 2259000 - DNA, 16 bp, Homo sapiens
tgcactgcatgcaaac

SEQ ID NO: 2259001 - DNA, 12 bp, Homo sapiens
tgcactgtttaa

SEQ ID NO: 2259002 - DNA, 20 bp, Homo sapiens
tgcacttgtgattatttatt

SEQ ID NO: 2259003 - DNA, 21 bp, Homo sapiens
tgcacttgtgattatttatta

SEQ ID NO: 2259004 - DNA, 17 bp, Homo sapiens
tgcagattacactgatc

SEQ ID NO: 2259005 - DNA, 14 bp, Homo sapiens
tgcaggagaaaagt

SEQ ID NO: 2259006 - DNA, 14 bp, Homo sapiens
tgcaggcagcacag

SEQ ID NO: 2259007 - DNA, 15 bp, Homo sapiens
tgcaggcagcacagc

SEQ ID NO: 2259008 - DNA, 19 bp, Homo sapiens
tgcaggcaggaacaaacag

SEQ ID NO: 2259009 - DNA, 20 bp, Homo sapiens
tgcaggcaggaacaaacagg

SEQ ID NO: 2259010 - DNA, 10 bp, Homo sapiens
tgcagtttat

SEQ ID NO: 2259011 - DNA, 15 bp, Homo sapiens
tgcagtttttcattt

SEQ ID NO: 2259012 - DNA, 18 bp, Homo sapiens
tgcataatgcaatcaaaa

SEQ ID NO: 2259013 - DNA, 19 bp, Homo sapiens
tgcatcagaaagctttatt

SEQ ID NO: 2259014 - DNA, 14 bp, Homo sapiens
tgcatgattttgta

SEQ ID NO: 2259015 - DNA, 18 bp, Homo sapiens
tgcatgattttgtaaccc

SEQ ID NO: 2259016 - DNA, 15 bp, Homo sapiens
tgcatgcaaacaaga

SEQ ID NO: 2259017 - DNA, 17 bp, Homo sapiens
tgcatgcaaacaagaaa

SEQ ID NO: 2259018 - DNA, 19 bp, Homo sapiens
tgcattcctgtgccctaga

SEQ ID NO: 2259019 - DNA, 18 bp, Homo sapiens
tgcatttgagagaagcca

SEQ ID NO: 2259020 - DNA, 17 bp, Homo sapiens
tgccaaaattcatttct

SEQ ID NO: 2259021 - DNA, 14 bp, Homo sapiens
tgccaagcaggcct

SEQ ID NO: 2259022 - DNA, 16 bp, Homo sapiens
tgccaataaagtgatc

SEQ ID NO: 2259023 - DNA, 22 bp, Homo sapiens
tgccagagaggtggggatcctg

SEQ ID NO: 2259024 - DNA, 20 bp, Homo sapiens
tgccatacttgttctgtatt

SEQ ID NO: 2259025 - DNA, 14 bp, Homo sapiens
tgccatgatctgta

SEQ ID NO: 2259026 - DNA, 21 bp, Homo sapiens
tgccatgttggccaggctggt

SEQ ID NO: 2259027 - DNA, 16 bp, Homo sapiens
tgccatttagcaataa

SEQ ID NO: 2259028 - DNA, 19 bp, Homo sapiens
tgccatttagcaataaata

SEQ ID NO: 2259029 - DNA, 17 bp, Homo sapiens
tgcccagaataagttat

SEQ ID NO: 2259030 - DNA, 19 bp, Homo sapiens
tgcccagaataagttattg

SEQ ID NO: 2259031 - DNA, 18 bp, Homo sapiens
tgcccatgtgtcccctca

SEQ ID NO: 2259032 - DNA, 12 bp, Homo sapiens
tgccccacccca

SEQ ID NO: 2259033 - DNA, 14 bp, Homo sapiens
tgccccccagcctc

SEQ ID NO: 2259034 - DNA, 17 bp, Homo sapiens
tgcccccctcctccccg

SEQ ID NO: 2259035 - DNA, 14 bp, Homo sapiens
tgccccctccccca

SEQ ID NO: 2259036 - DNA, 19 bp, Homo sapiens
tgccctcatggcccctctg

SEQ ID NO: 2259037 - DNA, 21 bp, Homo sapiens
tgcccttccccctgcaaaaag

SEQ ID NO: 2259038 - DNA, 22 bp, Homo sapiens
tgcccttccccctgcaaaaaga

SEQ ID NO: 2259039 - DNA, 22 bp, Homo sapiens
tgcctcactaatttttgtatta

SEQ ID NO: 2259040 - DNA, 20 bp, Homo sapiens
tgcctctgacagtccacagg

SEQ ID NO: 2259041 - DNA, 22 bp, Homo sapiens
tgcctctgacagtccacagggg

SEQ ID NO: 2259042 - DNA, 23 bp, Homo sapiens
tgcctgtccccaaacaggacagc

SEQ ID NO: 2259043 - DNA, 15 bp, Homo sapiens
tgcctgttggcaggc

SEQ ID NO: 2259044 - DNA, 16 bp, Homo sapiens
tgccttagtctcagtt

SEQ ID NO: 2259045 - DNA, 16 bp, Homo sapiens
tgccttcttttgatta

SEQ ID NO: 2259046 - DNA, 15 bp, Homo sapiens
tgccttgctcatttg

SEQ ID NO: 2259047 - DNA, 21 bp, Homo sapiens
tgcgcccttaactgcatccag

SEQ ID NO: 2259048 - DNA, 23 bp, Homo sapiens
tgcgtccccccccaacctttccc

SEQ ID NO: 2259049 - DNA, 21 bp, Homo sapiens
tgctaaataaaatttgttgca

SEQ ID NO: 2259050 - DNA, 22 bp, Homo sapiens
tgctaaataaaatttgttgcat

SEQ ID NO: 2259051 - DNA, 23 bp, Homo sapiens
tgctaaataaaatttgttgcata

SEQ ID NO: 2259052 - DNA, 19 bp, Homo sapiens
tgctaataagtttgaaata

SEQ ID NO: 2259053 - DNA, 22 bp, Homo sapiens
tgctaataagtttgaaatatat

SEQ ID NO: 2259054 - DNA, 15 bp, Homo sapiens
tgctagaaattttca

SEQ ID NO: 2259055 - DNA, 11 bp, Homo sapiens
tgctagtgtga

SEQ ID NO: 2259056 - DNA, 19 bp, Homo sapiens
tgctatcaacaataaaatt

SEQ ID NO: 2259057 - DNA, 17 bp, Homo sapiens
tgctcagacccaacagc

SEQ ID NO: 2259058 - DNA, 17 bp, Homo sapiens
tgctcaggtgcaagtgc

SEQ ID NO: 2259059 - DNA, 21 bp, Homo sapiens
tgctcatagcgggcgctgcca

SEQ ID NO: 2259060 - DNA, 18 bp, Homo sapiens
tgctccaccctcccccag

SEQ ID NO: 2259061 - DNA, 23 bp, Homo sapiens
tgctccatagtttggcatttgca

SEQ ID NO: 2259062 - DNA, 19 bp, Homo sapiens
tgctcgcccacaaactgat

SEQ ID NO: 2259063 - DNA, 18 bp, Homo sapiens
tgctgaatgttgggactg

SEQ ID NO: 2259064 - DNA, 14 bp, Homo sapiens
tgctgagcctctgc

SEQ ID NO: 2259065 - DNA, 16 bp, Homo sapiens
tgctgatggagccttc

SEQ ID NO: 2259066 - DNA, 17 bp, Homo sapiens
tgctgatggagccttcc

SEQ ID NO: 2259067 - DNA, 18 bp, Homo sapiens
tgctgatttggtgaccaa

SEQ ID NO: 2259068 - DNA, 13 bp, Homo sapiens
tgctgctgtccct

SEQ ID NO: 2259069 - DNA, 12 bp, Homo sapiens
tgctggccagca

SEQ ID NO: 2259070 - DNA, 14 bp, Homo sapiens
tgctggccagcacc

SEQ ID NO: 2259071 - DNA, 19 bp, Homo sapiens
tgctggccagcaccctctc

SEQ ID NO: 2259072 - DNA, 18 bp, Homo sapiens
tgctggccccagccctgc

SEQ ID NO: 2259073 - DNA, 16 bp, Homo sapiens
tgctgggattacagac

SEQ ID NO: 2259074 - DNA, 21 bp, Homo sapiens
tgctgtatatttgtgatagca

SEQ ID NO: 2259075 - DNA, 12 bp, Homo sapiens
tgctgtccctcc

SEQ ID NO: 2259076 - DNA, 10 bp, Homo sapiens
tgctgtgggc

SEQ ID NO: 2259077 - DNA, 11 bp, Homo sapiens
tgctgtgggca

SEQ ID NO: 2259078 - DNA, 22 bp, Homo sapiens
tgcttaacagttttagaataca

SEQ ID NO: 2259079 - DNA, 21 bp, Homo sapiens
tgcttcagggaggtagtttca

SEQ ID NO: 2259080 - DNA, 16 bp, Homo sapiens
tgcttgcataagagct

SEQ ID NO: 2259081 - DNA, 17 bp, Homo sapiens
tgcttgcataagagctt

SEQ ID NO: 2259082 - DNA, 12 bp, Homo sapiens
tgctttggaaac

SEQ ID NO: 2259083 - DNA, 15 bp, Homo sapiens
tgctttttataaaaa

SEQ ID NO: 2259084 - DNA, 16 bp, Homo sapiens
tgctttttataaaaag

SEQ ID NO: 2259085 - DNA, 18 bp, Homo sapiens
tggaaattgagtctgaag

SEQ ID NO: 2259086 - DNA, 17 bp, Homo sapiens
tggaacagtaagaacat

SEQ ID NO: 2259087 - DNA, 23 bp, Homo sapiens
tggaagattctatttaattgaaa

SEQ ID NO: 2259088 - DNA, 20 bp, Homo sapiens
tggaagcccctgggcccagt

SEQ ID NO: 2259089 - DNA, 19 bp, Homo sapiens
tggacagaatgtgtctcag

SEQ ID NO: 2259090 - DNA, 12 bp, Homo sapiens
tggacagacaga

SEQ ID NO: 2259091 - DNA, 18 bp, Homo sapiens
tggacagtacctgattgt

SEQ ID NO: 2259092 - DNA, 18 bp, Homo sapiens
tggacatttaacttttct

SEQ ID NO: 2259093 - DNA, 16 bp, Homo sapiens
tggacccttataaaat

SEQ ID NO: 2259094 - DNA, 19 bp, Homo sapiens
tggaccgcccttttcccct

SEQ ID NO: 2259095 - DNA, 14 bp, Homo sapiens
tggaccgtttccaa

SEQ ID NO: 2259096 - DNA, 21 bp, Homo sapiens
tggaccttaggccttcctctc

SEQ ID NO: 2259097 - DNA, 19 bp, Homo sapiens
tggactaattgacttgcaa

SEQ ID NO: 2259098 - DNA, 16 bp, Homo sapiens
tggactatgcacactt

SEQ ID NO: 2259099 - DNA, 15 bp, Homo sapiens
tggactgcgctggac

SEQ ID NO: 2259100 - DNA, 15 bp, Homo sapiens
tggagaaatgaaaac

SEQ ID NO: 2259101 - DNA, 13 bp, Homo sapiens
tggagaagattta

SEQ ID NO: 2259102 - DNA, 13 bp, Homo sapiens
tggagcagaccac

SEQ ID NO: 2259103 - DNA, 17 bp, Homo sapiens
tggagcagaccaccccg

SEQ ID NO: 2259104 - DNA, 19 bp, Homo sapiens
tgaaactccagatgccaca

SEQ ID NO: 2259105 - DNA, 18 bp, Homo sapiens
tgaaagagaaagactgat

SEQ ID NO: 2259106 - DNA, 18 bp, Homo sapiens
tgaaagttaactcttcaa

SEQ ID NO: 2259107 - DNA, 18 bp, Homo sapiens
tgaaatgaaagggaaact

SEQ ID NO: 2259108 - DNA, 15 bp, Homo sapiens
tgaacaaaattattt

SEQ ID NO: 2259109 - DNA, 18 bp, Homo sapiens
tgaacaatgaagttgaaa

SEQ ID NO: 2259110 - DNA, 23 bp, Homo sapiens
tgaacaatgaagttgaaaatcat

SEQ ID NO: 2259111 - DNA, 14 bp, Homo sapiens
tgaactttccaaaa

SEQ ID NO: 2259112 - DNA, 16 bp, Homo sapiens
tgaagatccagctgcc

SEQ ID NO: 2259113 - DNA, 14 bp, Homo sapiens
tgaagccaaatgaa

SEQ ID NO: 2259114 - DNA, 18 bp, Homo sapiens
tgaagctgccctaataaa

SEQ ID NO: 2259115 - DNA, 23 bp, Homo sapiens
tgaagctttatttgcatatttat

SEQ ID NO: 2259116 - DNA, 15 bp, Homo sapiens
tgaaggatccatctt

SEQ ID NO: 2259117 - DNA, 19 bp, Homo sapiens
tgaagtctttaataaataa

SEQ ID NO: 2259118 - DNA, 18 bp, Homo sapiens
tgaagtgtataatataaa

SEQ ID NO: 2259119 - DNA, 15 bp, Homo sapiens
tgaatataagaaaat

SEQ ID NO: 2259120 - DNA, 21 bp, Homo sapiens
tgaatataagaaaatgcttga

SEQ ID NO: 2259121 - DNA, 12 bp, Homo sapiens
tgaatattttca

SEQ ID NO: 2259122 - DNA, 13 bp, Homo sapiens
tgaatcaataata

SEQ ID NO: 2259123 - DNA, 16 bp, Homo sapiens
tgaatcaataatatat

SEQ ID NO: 2259124 - DNA, 19 bp, Homo sapiens
tgaatcaataatatatttt

SEQ ID NO: 2259125 - DNA, 20 bp, Homo sapiens
tgaatcaataatatattttc

SEQ ID NO: 2259126 - DNA, 16 bp, Homo sapiens
tgaatcagtataaaca

SEQ ID NO: 2259127 - DNA, 22 bp, Homo sapiens
tgaatcagtataaacaaagtta

SEQ ID NO: 2259128 - DNA, 20 bp, Homo sapiens
tgaatcgcttgcttgttgaa

SEQ ID NO: 2259129 - DNA, 14 bp, Homo sapiens
tgaatgctgagacc

SEQ ID NO: 2259130 - DNA, 11 bp, Homo sapiens
tgaatgtattt

SEQ ID NO: 2259131 - DNA, 17 bp, Homo sapiens
tgaatgtatttatttgg

SEQ ID NO: 2259132 - DNA, 23 bp, Homo sapiens
tgaatgtatttatttgggagacc

SEQ ID NO: 2259133 - DNA, 22 bp, Homo sapiens
tgaattaataataaagctacca

SEQ ID NO: 2259134 - DNA, 15 bp, Homo sapiens
tgaattatctataca

SEQ ID NO: 2259135 - DNA, 16 bp, Homo sapiens
tgaattctttaaggag

SEQ ID NO: 2259136 - DNA, 14 bp, Homo sapiens
tgaatttttattgt

SEQ ID NO: 2259137 - DNA, 17 bp, Homo sapiens
tgacaaggcacttcatg

SEQ ID NO: 2259138 - DNA, 14 bp, Homo sapiens
tgacaatgttgtag

SEQ ID NO: 2259139 - DNA, 13 bp, Homo sapiens
tgacacctccccc

SEQ ID NO: 2259140 - DNA, 17 bp, Homo sapiens
tgacaggaaagccctcc

SEQ ID NO: 2259141 - DNA, 17 bp, Homo sapiens
tgacagggacatgccct

SEQ ID NO: 2259142 - DNA, 22 bp, Homo sapiens
tgacagggacatgccctgtgtg

SEQ ID NO: 2259143 - DNA, 12 bp, Homo sapiens
tgacattgtctc

SEQ ID NO: 2259144 - DNA, 14 bp, Homo sapiens
tgacattgtctcct

SEQ ID NO: 2259145 - DNA, 16 bp, Homo sapiens
tgaccacttattctgt

SEQ ID NO: 2259146 - DNA, 17 bp, Homo sapiens
tgaccacttattctgta

SEQ ID NO: 2259147 - DNA, 21 bp, Homo sapiens
tgaccctatgggtctaggaca

SEQ ID NO: 2259148 - DNA, 17 bp, Homo sapiens
tgactctggcaaagctt

SEQ ID NO: 2259149 - DNA, 21 bp, Homo sapiens
tgactgagggcagctttgcaa

SEQ ID NO: 2259150 - DNA, 22 bp, Homo sapiens
tgacttgcaaagacctacctcc

SEQ ID NO: 2259151 - DNA, 24 bp, Homo sapiens
tgacttgcaaagacctacctccag

SEQ ID NO: 2259152 - DNA, 15 bp, Homo sapiens
tgagaaggtttattg

SEQ ID NO: 2259153 - DNA, 18 bp, Homo sapiens
tgagaaggtttattgtta

SEQ ID NO: 2259154 - DNA, 17 bp, Homo sapiens
tgagacacggagcccag

SEQ ID NO: 2259155 - DNA, 21 bp, Homo sapiens
tgagacacggagcccagccct

SEQ ID NO: 2259156 - DNA, 19 bp, Homo sapiens
tgagactacaagtgtgtgc

SEQ ID NO: 2259157 - DNA, 13 bp, Homo sapiens
tgagactggcaga

SEQ ID NO: 2259158 - DNA, 17 bp, Homo sapiens
tgagactttctaaatca

SEQ ID NO: 2259159 - DNA, 22 bp, Homo sapiens
tgagagaaatatggaacttaca

SEQ ID NO: 2259160 - DNA, 13 bp, Homo sapiens
tgagatgtaaaaa

SEQ ID NO: 2259161 - DNA, 14 bp, Homo sapiens
tgagcctctgctcc

SEQ ID NO: 2259162 - DNA, 18 bp, Homo sapiens
tgagcctctgctccccag

SEQ ID NO: 2259163 - DNA, 18 bp, Homo sapiens
tgagctactggattctta

SEQ ID NO: 2259164 - DNA, 12 bp, Homo sapiens
tgagctgccagt

SEQ ID NO: 2259165 - DNA, 21 bp, Homo sapiens
tgagctgtgactgctttgctg

SEQ ID NO: 2259166 - DNA, 18 bp, Homo sapiens
tgagcttgtcttttctgc

SEQ ID NO: 2259167 - DNA, 13 bp, Homo sapiens
tgaggacaagaga

SEQ ID NO: 2259168 - DNA, 16 bp, Homo sapiens
tgaggagccccagcta

SEQ ID NO: 2259169 - DNA, 15 bp, Homo sapiens
tgaggcactggcgag

SEQ ID NO: 2259170 - DNA, 15 bp, Homo sapiens
tgaggtgcctgtccc

SEQ ID NO: 2259171 - DNA, 21 bp, Homo sapiens
tgagtggggttatctctgtgt

SEQ ID NO: 2259172 - DNA, 22 bp, Homo sapiens
tgagtggggttatctctgtgtt

SEQ ID NO: 2259173 - DNA, 16 bp, Homo sapiens
tgagttacagcctgtt

SEQ ID NO: 2259174 - DNA, 16 bp, Homo sapiens
tgagttcaccatctct

SEQ ID NO: 2259175 - DNA, 21 bp, Homo sapiens
tgataatacagatttgtaaca

SEQ ID NO: 2259176 - DNA, 22 bp, Homo sapiens
tgataatacagatttgtaacat

SEQ ID NO: 2259177 - DNA, 21 bp, Homo sapiens
tgataatatattgtgttgact

SEQ ID NO: 2259178 - DNA, 15 bp, Homo sapiens
tgatacccccctctg

SEQ ID NO: 2259179 - DNA, 19 bp, Homo sapiens
tgatacccccctctgtctt

SEQ ID NO: 2259180 - DNA, 22 bp, Homo sapiens
tgataggttattttgatgtaaa

SEQ ID NO: 2259181 - DNA, 17 bp, Homo sapiens
tgatatctataaaatag

SEQ ID NO: 2259182 - DNA, 18 bp, Homo sapiens
tgatatctataaaataga

SEQ ID NO: 2259183 - DNA, 23 bp, Homo sapiens
tgatatctataaaatagatataa

SEQ ID NO: 2259184 - DNA, 14 bp, Homo sapiens
tgatcatgtacttt

SEQ ID NO: 2259185 - DNA, 17 bp, Homo sapiens
tgatcccaccccctcct

SEQ ID NO: 2259186 - DNA, 21 bp, Homo sapiens
tgatcccgttttccccatgac

SEQ ID NO: 2259187 - DNA, 14 bp, Homo sapiens
tgatcctctcacct

SEQ ID NO: 2259188 - DNA, 12 bp, Homo sapiens
tgatctctccac

SEQ ID NO: 2259189 - DNA, 23 bp, Homo sapiens
tgatctgtatttaatggttttta

SEQ ID NO: 2259190 - DNA, 13 bp, Homo sapiens
tgatgaggtattt

SEQ ID NO: 2259191 - DNA, 19 bp, Homo sapiens
tgatgaggtattttttcct

SEQ ID NO: 2259192 - DNA, 22 bp, Homo sapiens
tgatgaggtattttttcctttt

SEQ ID NO: 2259193 - DNA, 13 bp, Homo sapiens
tgatgatgatgaa

SEQ ID NO: 2259194 - DNA, 16 bp, Homo sapiens
tgatgcatgtctttta

SEQ ID NO: 2259195 - DNA, 13 bp, Homo sapiens
tgatgggaaaact

SEQ ID NO: 2259196 - DNA, 24 bp, Homo sapiens
tgattactgtcaaggctgcttaga

SEQ ID NO: 2259197 - DNA, 15 bp, Homo sapiens
tgattcagcaaaaat

SEQ ID NO: 2259198 - DNA, 16 bp, Homo sapiens
tgattgtactttgaat

SEQ ID NO: 2259199 - DNA, 19 bp, Homo sapiens
tgatttccatctctggtaa

SEQ ID NO: 2259200 - DNA, 11 bp, Homo sapiens
tgatttctcac

SEQ ID NO: 2259201 - DNA, 20 bp, Homo sapiens
tgatttggtgaccaactgtc

SEQ ID NO: 2259202 - DNA, 18 bp, Homo sapiens
tgcaaaaagaaaaaaaga

SEQ ID NO: 2259203 - DNA, 17 bp, Homo sapiens
tgcaaaaatccttctcc

SEQ ID NO: 2259204 - DNA, 15 bp, Homo sapiens
tgcaaagtattgtaa

SEQ ID NO: 2259205 - DNA, 16 bp, Homo sapiens
tgcaaccatttgaaac

SEQ ID NO: 2259206 - DNA, 20 bp, Homo sapiens
tgcaagaaaatgatgtgtac

SEQ ID NO: 2259207 - DNA, 23 bp, Homo sapiens
tgcaataatatcaaaacaagtac

SEQ ID NO: 2259208 - DNA, 17 bp, Homo sapiens
tgcaatgtgaaaaatct

SEQ ID NO: 2259209 - DNA, 18 bp, Homo sapiens
tgcaattcccctctgctg

SEQ ID NO: 2259210 - DNA, 14 bp, Homo sapiens
tgcacaataaacat

SEQ ID NO: 2259211 - DNA, 18 bp, Homo sapiens
tgcacacaaatattattt

SEQ ID NO: 2259212 - DNA, 17 bp, Homo sapiens
tgcacaccaccctcccg

SEQ ID NO: 2259213 - DNA, 18 bp, Homo sapiens
tctcatttaagggaaaaa

SEQ ID NO: 2259214 - DNA, 23 bp, Homo sapiens
tctccaaaaaaaaaaaaaataca

SEQ ID NO: 2259215 - DNA, 14 bp, Homo sapiens
tctccagatgtttc

SEQ ID NO: 2259216 - DNA, 17 bp, Homo sapiens
tctccagctgggctctg

SEQ ID NO: 2259217 - DNA, 15 bp, Homo sapiens
tctcccttttccatg

SEQ ID NO: 2259218 - DNA, 19 bp, Homo sapiens
tctccgggtgtggcctcag

SEQ ID NO: 2259219 - DNA, 18 bp, Homo sapiens
tctcctatatatttctat

SEQ ID NO: 2259220 - DNA, 16 bp, Homo sapiens
tctcctgacccctgcc

SEQ ID NO: 2259221 - DNA, 17 bp, Homo sapiens
tctcctgacccctgcct

SEQ ID NO: 2259222 - DNA, 18 bp, Homo sapiens
tctcctgggggtggcagg

SEQ ID NO: 2259223 - DNA, 22 bp, Homo sapiens
tctcctgggggtggcaggcaca

SEQ ID NO: 2259224 - DNA, 17 bp, Homo sapiens
tctccttactgtgtttc

SEQ ID NO: 2259225 - DNA, 14 bp, Homo sapiens
tctccttggccaca

SEQ ID NO: 2259226 - DNA, 18 bp, Homo sapiens
tctcgagcccagatggaa

SEQ ID NO: 2259227 - DNA, 12 bp, Homo sapiens
tctcggtgacct

SEQ ID NO: 2259228 - DNA, 14 bp, Homo sapiens
tctctaacagtgga

SEQ ID NO: 2259229 - DNA, 13 bp, Homo sapiens
tctctaggaagtc

SEQ ID NO: 2259230 - DNA, 13 bp, Homo sapiens
tctctatttgaga

SEQ ID NO: 2259231 - DNA, 20 bp, Homo sapiens
tctctcggctccccatgtgt

SEQ ID NO: 2259232 - DNA, 13 bp, Homo sapiens
tctctctctgtgt

SEQ ID NO: 2259233 - DNA, 21 bp, Homo sapiens
tctctctggggccctgggcct

SEQ ID NO: 2259234 - DNA, 17 bp, Homo sapiens
tctctctgtgtctttct

SEQ ID NO: 2259235 - DNA, 14 bp, Homo sapiens
tctctcttttcatt

SEQ ID NO: 2259236 - DNA, 15 bp, Homo sapiens
tctctcttttcattg

SEQ ID NO: 2259237 - DNA, 14 bp, Homo sapiens
tctctgaaagtgtg

SEQ ID NO: 2259238 - DNA, 22 bp, Homo sapiens
tctctgaaggtaagatcattta

SEQ ID NO: 2259239 - DNA, 17 bp, Homo sapiens
tctctggcagctggcct

SEQ ID NO: 2259240 - DNA, 22 bp, Homo sapiens
tctctggtaaagttacactttt

SEQ ID NO: 2259241 - DNA, 16 bp, Homo sapiens
tctctgtacttttcat

SEQ ID NO: 2259242 - DNA, 15 bp, Homo sapiens
tctctgtgagaaggt

SEQ ID NO: 2259243 - DNA, 16 bp, Homo sapiens
tctcttccacatgtta

SEQ ID NO: 2259244 - DNA, 16 bp, Homo sapiens
tctcttgcctcagcct

SEQ ID NO: 2259245 - DNA, 16 bp, Homo sapiens
tctcttggctttgtca

SEQ ID NO: 2259246 - DNA, 11 bp, Homo sapiens
tctcttttcat

SEQ ID NO: 2259247 - DNA, 19 bp, Homo sapiens
tctcttttcattgtgtatc

SEQ ID NO: 2259248 - DNA, 20 bp, Homo sapiens
tctgaaacatttcataattt

SEQ ID NO: 2259249 - DNA, 15 bp, Homo sapiens
tctgaaatgttacaa

SEQ ID NO: 2259250 - DNA, 13 bp, Homo sapiens
tctgaatgttaca

SEQ ID NO: 2259251 - DNA, 16 bp, Homo sapiens
tctgagaagctctgaa

SEQ ID NO: 2259252 - DNA, 22 bp, Homo sapiens
tctgcaattcccctctgctgct

SEQ ID NO: 2259253 - DNA, 16 bp, Homo sapiens
tctgcacacaaatatt

SEQ ID NO: 2259254 - DNA, 17 bp, Homo sapiens
tctgcacacaaatatta

SEQ ID NO: 2259255 - DNA, 22 bp, Homo sapiens
tctgcacaccctccagagacaa

SEQ ID NO: 2259256 - DNA, 23 bp, Homo sapiens
tctgccccctcccccatgggctg

SEQ ID NO: 2259257 - DNA, 16 bp, Homo sapiens
tctgctccccagggga

SEQ ID NO: 2259258 - DNA, 11 bp, Homo sapiens
tctgctgagga

SEQ ID NO: 2259259 - DNA, 20 bp, Homo sapiens
tctggagaccagggagcctt

SEQ ID NO: 2259260 - DNA, 21 bp, Homo sapiens
tctggcaaagcttttagaaat

SEQ ID NO: 2259261 - DNA, 12 bp, Homo sapiens
tctggccctggg

SEQ ID NO: 2259262 - DNA, 20 bp, Homo sapiens
tctgggcaccacaaaatata

SEQ ID NO: 2259263 - DNA, 19 bp, Homo sapiens
tctggggcaggctgggcca

SEQ ID NO: 2259264 - DNA, 14 bp, Homo sapiens
tctggggccctggg

SEQ ID NO: 2259265 - DNA, 18 bp, Homo sapiens
tctggggccctgggcctc

SEQ ID NO: 2259266 - DNA, 19 bp, Homo sapiens
tctggggccctgggcctca

SEQ ID NO: 2259267 - DNA, 20 bp, Homo sapiens
tctggggccctgggcctcag

SEQ ID NO: 2259268 - DNA, 18 bp, Homo sapiens
tctgtatttaatggtttt

SEQ ID NO: 2259269 - DNA, 15 bp, Homo sapiens
tctgtattttaagaa

SEQ ID NO: 2259270 - DNA, 19 bp, Homo sapiens
tctgtcaccagctatctgt

SEQ ID NO: 2259271 - DNA, 21 bp, Homo sapiens
tctgtcagccagccgccctgg

SEQ ID NO: 2259272 - DNA, 18 bp, Homo sapiens
tctgtgaagcctctctcc

SEQ ID NO: 2259273 - DNA, 23 bp, Homo sapiens
tctgtgagaaggtttattgttaa

SEQ ID NO: 2259274 - DNA, 21 bp, Homo sapiens
tctgtgagggtgctgactggc

SEQ ID NO: 2259275 - DNA, 11 bp, Homo sapiens
tctgtgtcttt

SEQ ID NO: 2259276 - DNA, 21 bp, Homo sapiens
tctgtgtctttcacagctcct

SEQ ID NO: 2259277 - DNA, 14 bp, Homo sapiens
tctgttagcagagt

SEQ ID NO: 2259278 - DNA, 23 bp, Homo sapiens
tctgttccacacccaatgctgct

SEQ ID NO: 2259279 - DNA, 15 bp, Homo sapiens
tcttaaaacaaagcc

SEQ ID NO: 2259280 - DNA, 18 bp, Homo sapiens
tcttaattattataaaaa

SEQ ID NO: 2259281 - DNA, 16 bp, Homo sapiens
tcttacataaaccatt

SEQ ID NO: 2259282 - DNA, 19 bp, Homo sapiens
tcttacataaaccattttt

SEQ ID NO: 2259283 - DNA, 20 bp, Homo sapiens
tcttaggaattgaattaata

SEQ ID NO: 2259284 - DNA, 14 bp, Homo sapiens
tcttagttatatag

SEQ ID NO: 2259285 - DNA, 18 bp, Homo sapiens
tcttatgtagagttttta

SEQ ID NO: 2259286 - DNA, 22 bp, Homo sapiens
tcttattagttccccaaataca

SEQ ID NO: 2259287 - DNA, 12 bp, Homo sapiens
tcttcccacagg

SEQ ID NO: 2259288 - DNA, 15 bp, Homo sapiens
tcttcccacaggagg

SEQ ID NO: 2259289 - DNA, 21 bp, Homo sapiens
tcttctcttccttttatcagt

SEQ ID NO: 2259290 - DNA, 13 bp, Homo sapiens
tcttctggctcaa

SEQ ID NO: 2259291 - DNA, 21 bp, Homo sapiens
tcttctggctcaaaaagagaa

SEQ ID NO: 2259292 - DNA, 15 bp, Homo sapiens
tcttgaaatgaaagg

SEQ ID NO: 2259293 - DNA, 17 bp, Homo sapiens
tcttgaaatgaaaggga

SEQ ID NO: 2259294 - DNA, 21 bp, Homo sapiens
tcttgaaatgaaagggaaact

SEQ ID NO: 2259295 - DNA, 12 bp, Homo sapiens
tcttgagccaca

SEQ ID NO: 2259296 - DNA, 17 bp, Homo sapiens
tcttgatacccccctct

SEQ ID NO: 2259297 - DNA, 15 bp, Homo sapiens
tctttaaaaactgtt

SEQ ID NO: 2259298 - DNA, 16 bp, Homo sapiens
tctttaatgcttttat

SEQ ID NO: 2259299 - DNA, 16 bp, Homo sapiens
tctttcagtacttttt

SEQ ID NO: 2259300 - DNA, 23 bp, Homo sapiens
tctttcagtacttttttaaatat

SEQ ID NO: 2259301 - DNA, 15 bp, Homo sapiens
tctttccaaaacatt

SEQ ID NO: 2259302 - DNA, 18 bp, Homo sapiens
tctttccaaaacatttct

SEQ ID NO: 2259303 - DNA, 15 bp, Homo sapiens
tctttccactttcat

SEQ ID NO: 2259304 - DNA, 13 bp, Homo sapiens
tctttctctgagg

SEQ ID NO: 2259305 - DNA, 15 bp, Homo sapiens
tctttctctgaggac

SEQ ID NO: 2259306 - DNA, 22 bp, Homo sapiens
tctttctttccaaaacatttct

SEQ ID NO: 2259307 - DNA, 22 bp, Homo sapiens
tctttgaaatgacatgttcctt

SEQ ID NO: 2259308 - DNA, 21 bp, Homo sapiens
tctttgccagtcattcagcag

SEQ ID NO: 2259309 - DNA, 14 bp, Homo sapiens
tctttggctcccct

SEQ ID NO: 2259310 - DNA, 21 bp, Homo sapiens
tcttttaaattagaaaatatt

SEQ ID NO: 2259311 - DNA, 13 bp, Homo sapiens
tcttttctgctga

SEQ ID NO: 2259312 - DNA, 16 bp, Homo sapiens
tctttttgtacactta

SEQ ID NO: 2259313 - DNA, 15 bp, Homo sapiens
tctttttgttgtaaa

SEQ ID NO: 2259314 - DNA, 16 bp, Homo sapiens
tctttttgttgtaaaa

SEQ ID NO: 2259315 - DNA, 20 bp, Homo sapiens
tgaaaaatctgctgttaact

SEQ ID NO: 2259316 - DNA, 16 bp, Homo sapiens
tgaaaacccaaggcca

SEQ ID NO: 2259317 - DNA, 16 bp, Homo sapiens
tgaaaactttgtagta

SEQ ID NO: 2259318 - DNA, 23 bp, Homo sapiens
tgaaaatattgttttacaatagt

SEQ ID NO: 2259319 - DNA, 19 bp, Homo sapiens
tgaaacatcattacagatt

SEQ ID NO: 2259320 - DNA, 19 bp, Homo sapiens
tgaaaccccaaacagtgac

SEQ ID NO: 2259321 - DNA, 19 bp, Homo sapiens
tgaaactcatagacactga

SEQ ID NO: 2259322 - DNA, 18 bp, Homo sapiens
tgaaactccagatgccac

SEQ ID NO: 2259323 - DNA, 20 bp, Homo sapiens
tcccctctgctgctgtccct

SEQ ID NO: 2259324 - DNA, 15 bp, Homo sapiens
tccctcaccccctcc

SEQ ID NO: 2259325 - DNA, 20 bp, Homo sapiens
tccctcaccccctcccaccc

SEQ ID NO: 2259326 - DNA, 23 bp, Homo sapiens
tccctcaccccctcccaccccca

SEQ ID NO: 2259327 - DNA, 11 bp, Homo sapiens
tccctccaccc

SEQ ID NO: 2259328 - DNA, 19 bp, Homo sapiens
tccctctatttatgtttgc

SEQ ID NO: 2259329 - DNA, 18 bp, Homo sapiens
tccctctttggctcccct

SEQ ID NO: 2259330 - DNA, 23 bp, Homo sapiens
tccctctttggctcccctgtacc

SEQ ID NO: 2259331 - DNA, 19 bp, Homo sapiens
tccctgactccctgtgggg

SEQ ID NO: 2259332 - DNA, 16 bp, Homo sapiens
tccctgatcccacccc

SEQ ID NO: 2259333 - DNA, 17 bp, Homo sapiens
tccctgatcccaccccc

SEQ ID NO: 2259334 - DNA, 22 bp, Homo sapiens
tccctgtgggggtggccatccc

SEQ ID NO: 2259335 - DNA, 20 bp, Homo sapiens
tcccttcagtaccctctcag

SEQ ID NO: 2259336 - DNA, 23 bp, Homo sapiens
tcccttcagtaccctctcagctc

SEQ ID NO: 2259337 - DNA, 14 bp, Homo sapiens
tcccttttccatga

SEQ ID NO: 2259338 - DNA, 19 bp, Homo sapiens
tccggcggcgagctctggc

SEQ ID NO: 2259339 - DNA, 16 bp, Homo sapiens
tccgggtgtggcctca

SEQ ID NO: 2259340 - DNA, 23 bp, Homo sapiens
tcctaaagaaaaatatcttggcc

SEQ ID NO: 2259341 - DNA, 16 bp, Homo sapiens
tcctaagagtgctggg

SEQ ID NO: 2259342 - DNA, 23 bp, Homo sapiens
tcctaatgaaggttttcatttgc

SEQ ID NO: 2259343 - DNA, 15 bp, Homo sapiens
tcctacctcaaaatt

SEQ ID NO: 2259344 - DNA, 20 bp, Homo sapiens
tcctatatatttctattatt

SEQ ID NO: 2259345 - DNA, 14 bp, Homo sapiens
tcctcatccacccc

SEQ ID NO: 2259346 - DNA, 18 bp, Homo sapiens
tcctcatccaccccatcc

SEQ ID NO: 2259347 - DNA, 22 bp, Homo sapiens
tcctcatcccgtgttctccttt

SEQ ID NO: 2259348 - DNA, 17 bp, Homo sapiens
tcctcccctattttaag

SEQ ID NO: 2259349 - DNA, 16 bp, Homo sapiens
tcctcccgtcactcca

SEQ ID NO: 2259350 - DNA, 14 bp, Homo sapiens
tcctctccccagcc

SEQ ID NO: 2259351 - DNA, 16 bp, Homo sapiens
tcctctccctctctct

SEQ ID NO: 2259352 - DNA, 18 bp, Homo sapiens
tcctctcgagcccagatg

SEQ ID NO: 2259353 - DNA, 14 bp, Homo sapiens
tcctgcatctctgt

SEQ ID NO: 2259354 - DNA, 20 bp, Homo sapiens
tcctgcccatgtgtcccctc

SEQ ID NO: 2259355 - DNA, 21 bp, Homo sapiens
tcctgcgggttttaatttatt

SEQ ID NO: 2259356 - DNA, 22 bp, Homo sapiens
tcctggaagcgcgagggcctca

SEQ ID NO: 2259357 - DNA, 17 bp, Homo sapiens
tcctggacactcagacc

SEQ ID NO: 2259358 - DNA, 19 bp, Homo sapiens
tcctggacactcagacctg

SEQ ID NO: 2259359 - DNA, 10 bp, Homo sapiens
tcctggccag

SEQ ID NO: 2259360 - DNA, 18 bp, Homo sapiens
tcctggccagacgctgcc

SEQ ID NO: 2259361 - DNA, 23 bp, Homo sapiens
tcctggctcttgatacccccctc

SEQ ID NO: 2259362 - DNA, 17 bp, Homo sapiens
tcctgggtttcctgcag

SEQ ID NO: 2259363 - DNA, 21 bp, Homo sapiens
tcctggttcccgtttctccac

SEQ ID NO: 2259364 - DNA, 23 bp, Homo sapiens
tcctggttcccgtttctccacct

SEQ ID NO: 2259365 - DNA, 18 bp, Homo sapiens
tcctgtatgttgtacaat

SEQ ID NO: 2259366 - DNA, 16 bp, Homo sapiens
tcctgtcgtcctgcct

SEQ ID NO: 2259367 - DNA, 14 bp, Homo sapiens
tcctgtgccctaga

SEQ ID NO: 2259368 - DNA, 20 bp, Homo sapiens
tcctgtgttgtgctgggagc

SEQ ID NO: 2259369 - DNA, 13 bp, Homo sapiens
tcctgtttgtcta

SEQ ID NO: 2259370 - DNA, 12 bp, Homo sapiens
tccttcagacac

SEQ ID NO: 2259371 - DNA, 18 bp, Homo sapiens
tccttccagtataaccag

SEQ ID NO: 2259372 - DNA, 21 bp, Homo sapiens
tccttccagtgtccttagaac

SEQ ID NO: 2259373 - DNA, 23 bp, Homo sapiens
tccttgagacacggagcccagcc

SEQ ID NO: 2259374 - DNA, 17 bp, Homo sapiens
tccttgataatatattg

SEQ ID NO: 2259375 - DNA, 18 bp, Homo sapiens
tccttggagaaatgaaaa

SEQ ID NO: 2259376 - DNA, 19 bp, Homo sapiens
tccttggagaaatgaaaac

SEQ ID NO: 2259377 - DNA, 15 bp, Homo sapiens
tccttggccacagac

SEQ ID NO: 2259378 - DNA, 15 bp, Homo sapiens
tcctttgagtgtctt

SEQ ID NO: 2259379 - DNA, 15 bp, Homo sapiens
tccttttcctctctc

SEQ ID NO: 2259380 - DNA, 12 bp, Homo sapiens
tcgaagtcatta

SEQ ID NO: 2259381 - DNA, 17 bp, Homo sapiens
tcgaagtcattaaactg

SEQ ID NO: 2259382 - DNA, 20 bp, Homo sapiens
tcgaagtcattaaactggtt

SEQ ID NO: 2259383 - DNA, 14 bp, Homo sapiens
tcgagtgagacaga

SEQ ID NO: 2259384 - DNA, 20 bp, Homo sapiens
tcgatttctacctcagcagc

SEQ ID NO: 2259385 - DNA, 13 bp, Homo sapiens
tcgcacacacagt

SEQ ID NO: 2259386 - DNA, 15 bp, Homo sapiens
tcgcacacacagtga

SEQ ID NO: 2259387 - DNA, 16 bp, Homo sapiens
tcgcacacacagtgat

SEQ ID NO: 2259388 - DNA, 13 bp, Homo sapiens
tcgccccaggccc

SEQ ID NO: 2259389 - DNA, 16 bp, Homo sapiens
tcgccggatctgaggg

SEQ ID NO: 2259390 - DNA, 17 bp, Homo sapiens
tcgccggatctgaggga

SEQ ID NO: 2259391 - DNA, 18 bp, Homo sapiens
tcgcctgcgccgctgtgc

SEQ ID NO: 2259392 - DNA, 23 bp, Homo sapiens
tcgctagcatttcccaacacaaa

SEQ ID NO: 2259393 - DNA, 12 bp, Homo sapiens
tcgctcactgtt

SEQ ID NO: 2259394 - DNA, 14 bp, Homo sapiens
tcggagctcgcctg

SEQ ID NO: 2259395 - DNA, 13 bp, Homo sapiens
tcggaggctgggc

SEQ ID NO: 2259396 - DNA, 19 bp, Homo sapiens
tcggctccccatgtgtcct

SEQ ID NO: 2259397 - DNA, 17 bp, Homo sapiens
tcgtgccatgatctgta

SEQ ID NO: 2259398 - DNA, 22 bp, Homo sapiens
tcgtttaccttcaaactttagg

SEQ ID NO: 2259399 - DNA, 17 bp, Homo sapiens
tctaaatttcttttgct

SEQ ID NO: 2259400 - DNA, 14 bp, Homo sapiens
tctaagaataataa

SEQ ID NO: 2259401 - DNA, 17 bp, Homo sapiens
tctaagaataataaaat

SEQ ID NO: 2259402 - DNA, 19 bp, Homo sapiens
tctaagaataataaaatca

SEQ ID NO: 2259403 - DNA, 18 bp, Homo sapiens
tctaagtgcctcacattt

SEQ ID NO: 2259404 - DNA, 18 bp, Homo sapiens
tctaattaaccttactaa

SEQ ID NO: 2259405 - DNA, 11 bp, Homo sapiens
tctacatttca

SEQ ID NO: 2259406 - DNA, 15 bp, Homo sapiens
tctacctcaggcagc

SEQ ID NO: 2259407 - DNA, 19 bp, Homo sapiens
tctacctcaggcagctcaa

SEQ ID NO: 2259408 - DNA, 16 bp, Homo sapiens
tctagactataaatgt

SEQ ID NO: 2259409 - DNA, 20 bp, Homo sapiens
tctagattaatactctattt

SEQ ID NO: 2259410 - DNA, 22 bp, Homo sapiens
tctagctttttaattaagcaaa

SEQ ID NO: 2259411 - DNA, 13 bp, Homo sapiens
tctaggacacagt

SEQ ID NO: 2259412 - DNA, 23 bp, Homo sapiens
tctaggatagctaactgtaaatc

SEQ ID NO: 2259413 - DNA, 23 bp, Homo sapiens
tctagtaattgggaaaaaagcaa

SEQ ID NO: 2259414 - DNA, 14 bp, Homo sapiens
tctataaaatagat

SEQ ID NO: 2259415 - DNA, 18 bp, Homo sapiens
tctatacatatctttatt

SEQ ID NO: 2259416 - DNA, 14 bp, Homo sapiens
tctatcctctgtaa

SEQ ID NO: 2259417 - DNA, 19 bp, Homo sapiens
tctatgattgtactttgaa

SEQ ID NO: 2259418 - DNA, 13 bp, Homo sapiens
tctatgcaggcag

SEQ ID NO: 2259419 - DNA, 14 bp, Homo sapiens
tctattccaataaa

SEQ ID NO: 2259420 - DNA, 15 bp, Homo sapiens
tctattccaataaac

SEQ ID NO: 2259421 - DNA, 12 bp, Homo sapiens
tctattggtctc

SEQ ID NO: 2259422 - DNA, 12 bp, Homo sapiens
tctattttaatc

SEQ ID NO: 2259423 - DNA, 17 bp, Homo sapiens
tctatttttacatttaa

SEQ ID NO: 2259424 - DNA, 14 bp, Homo sapiens
tctcaagtaatata

SEQ ID NO: 2259425 - DNA, 14 bp, Homo sapiens
tctcactgcctctc

SEQ ID NO: 2259426 - DNA, 16 bp, Homo sapiens
tctcactgcttgaact

SEQ ID NO: 2259427 - DNA, 15 bp, Homo sapiens
tctcactgtttgttt

SEQ ID NO: 2259428 - DNA, 18 bp, Homo sapiens
tctcagatgttaaaataa

SEQ ID NO: 2259429 - DNA, 16 bp, Homo sapiens
tctcagctccaggtgg

SEQ ID NO: 2259430 - DNA, 21 bp, Homo sapiens
tctcagctccaggtggctctg

SEQ ID NO: 2259431 - DNA, 15 bp, Homo sapiens
tctcagtgctttcct

SEQ ID NO: 2259432 - DNA, 18 bp, Homo sapiens
tctcagtttgtgtgtctt

SEQ ID NO: 2259433 - DNA, 10 bp, Homo sapiens
tcagagccct

SEQ ID NO: 2259434 - DNA, 14 bp, Homo sapiens
tcagaggagtaaat

SEQ ID NO: 2259435 - DNA, 14 bp, Homo sapiens
tcagattgctggga

SEQ ID NO: 2259436 - DNA, 16 bp, Homo sapiens
tcagattgctgggagg

SEQ ID NO: 2259437 - DNA, 20 bp, Homo sapiens
tcagcagcagttggatcttt

SEQ ID NO: 2259438 - DNA, 16 bp, Homo sapiens
tcagcatcattaaagg

SEQ ID NO: 2259439 - DNA, 11 bp, Homo sapiens
tcagcatttga

SEQ ID NO: 2259440 - DNA, 12 bp, Homo sapiens
tcagcatttgac

SEQ ID NO: 2259441 - DNA, 23 bp, Homo sapiens
tcagccagccgccctgggctgtc

SEQ ID NO: 2259442 - DNA, 17 bp, Homo sapiens
tcagcgcccccagagcc

SEQ ID NO: 2259443 - DNA, 14 bp, Homo sapiens
tcagctaacaaact

SEQ ID NO: 2259444 - DNA, 14 bp, Homo sapiens
tcagctccaggtgg

SEQ ID NO: 2259445 - DNA, 19 bp, Homo sapiens
tcagctccaggtggctctg

SEQ ID NO: 2259446 - DNA, 12 bp, Homo sapiens
tcaggaaaacag

SEQ ID NO: 2259447 - DNA, 16 bp, Homo sapiens
tcaggaaaacagctag

SEQ ID NO: 2259448 - DNA, 19 bp, Homo sapiens
tcagggaaactaagattct

SEQ ID NO: 2259449 - DNA, 15 bp, Homo sapiens
tcagtaagctgtgtg

SEQ ID NO: 2259450 - DNA, 19 bp, Homo sapiens
tcagtagtttaaaagttct

SEQ ID NO: 2259451 - DNA, 14 bp, Homo sapiens
tcagtcaaaacttt

SEQ ID NO: 2259452 - DNA, 16 bp, Homo sapiens
tcagtcaaaactttaa

SEQ ID NO: 2259453 - DNA, 23 bp, Homo sapiens
tcagtgggttaacatcagttttg

SEQ ID NO: 2259454 - DNA, 21 bp, Homo sapiens
tcagttatacagttataaaat

SEQ ID NO: 2259455 - DNA, 17 bp, Homo sapiens
tcagttcaacctggtgg

SEQ ID NO: 2259456 - DNA, 22 bp, Homo sapiens
tcagttcaacctggtggcacca

SEQ ID NO: 2259457 - DNA, 18 bp, Homo sapiens
tcatagtcttgaaatgaa

SEQ ID NO: 2259458 - DNA, 15 bp, Homo sapiens
tcatagttactgtgt

SEQ ID NO: 2259459 - DNA, 21 bp, Homo sapiens
tcatagttactgtgtaaactc

SEQ ID NO: 2259460 - DNA, 22 bp, Homo sapiens
tcatagttactgtgtaaactca

SEQ ID NO: 2259461 - DNA, 18 bp, Homo sapiens
tcatcactacagtattac

SEQ ID NO: 2259462 - DNA, 14 bp, Homo sapiens
tcatccaccccatc

SEQ ID NO: 2259463 - DNA, 23 bp, Homo sapiens
tcatcctcacagtgaacactcag

SEQ ID NO: 2259464 - DNA, 21 bp, Homo sapiens
tcatctaattctggcaggacc

SEQ ID NO: 2259465 - DNA, 16 bp, Homo sapiens
tcatctcatttaaggg

SEQ ID NO: 2259466 - DNA, 13 bp, Homo sapiens
tcatctctctggg

SEQ ID NO: 2259467 - DNA, 15 bp, Homo sapiens
tcatctctctggggc

SEQ ID NO: 2259468 - DNA, 12 bp, Homo sapiens
tcatgccagcta

SEQ ID NO: 2259469 - DNA, 14 bp, Homo sapiens
tcatgtattttaca

SEQ ID NO: 2259470 - DNA, 13 bp, Homo sapiens
tcatgttggccaa

SEQ ID NO: 2259471 - DNA, 22 bp, Homo sapiens
tcattaagctttttttttttga

SEQ ID NO: 2259472 - DNA, 23 bp, Homo sapiens
tcattacagattctgctagcctg

SEQ ID NO: 2259473 - DNA, 18 bp, Homo sapiens
tcattcaaactgcacttt

SEQ ID NO: 2259474 - DNA, 16 bp, Homo sapiens
tcattcagctaacaaa

SEQ ID NO: 2259475 - DNA, 15 bp, Homo sapiens
tcattgctgagcctc

SEQ ID NO: 2259476 - DNA, 17 bp, Homo sapiens
tcattgctgagcctctg

SEQ ID NO: 2259477 - DNA, 11 bp, Homo sapiens
tcattggccag

SEQ ID NO: 2259478 - DNA, 19 bp, Homo sapiens
tcattggccagctcataaa

SEQ ID NO: 2259479 - DNA, 23 bp, Homo sapiens
tcattgttgttttaacctcccct

SEQ ID NO: 2259480 - DNA, 16 bp, Homo sapiens
tcatttcatctcattt

SEQ ID NO: 2259481 - DNA, 17 bp, Homo sapiens
tcatttcatctcattta

SEQ ID NO: 2259482 - DNA, 18 bp, Homo sapiens
tcatttcatctcatttaa

SEQ ID NO: 2259483 - DNA, 16 bp, Homo sapiens
tcatttgctttggaag

SEQ ID NO: 2259484 - DNA, 15 bp, Homo sapiens
tcatttgtttacatt

SEQ ID NO: 2259485 - DNA, 13 bp, Homo sapiens
tcattttaaaaag

SEQ ID NO: 2259486 - DNA, 14 bp, Homo sapiens
tcatttttcaaaaa

SEQ ID NO: 2259487 - DNA, 19 bp, Homo sapiens
tccaaaaaaaaaaaaaata

SEQ ID NO: 2259488 - DNA, 21 bp, Homo sapiens
tccaaaaatgtgtaagaacaa

SEQ ID NO: 2259489 - DNA, 20 bp, Homo sapiens
tccaaaacatttctggacag

SEQ ID NO: 2259490 - DNA, 22 bp, Homo sapiens
tccaaaacatttctggacagta

SEQ ID NO: 2259491 - DNA, 14 bp, Homo sapiens
tccaaaccaaattt

SEQ ID NO: 2259492 - DNA, 14 bp, Homo sapiens
tccaaagaggctgc

SEQ ID NO: 2259493 - DNA, 17 bp, Homo sapiens
tccaaccattttcatta

SEQ ID NO: 2259494 - DNA, 15 bp, Homo sapiens
tccaagtctgtacct

SEQ ID NO: 2259495 - DNA, 17 bp, Homo sapiens
tccaagtctgtacctca

SEQ ID NO: 2259496 - DNA, 16 bp, Homo sapiens
tccacacccaatgctg

SEQ ID NO: 2259497 - DNA, 18 bp, Homo sapiens
tccaccccaagagaactc

SEQ ID NO: 2259498 - DNA, 19 bp, Homo sapiens
tccaccccaggacgccact

SEQ ID NO: 2259499 - DNA, 12 bp, Homo sapiens
tccaccccatcc

SEQ ID NO: 2259500 - DNA, 20 bp, Homo sapiens
tccaccccatccctccccag

SEQ ID NO: 2259501 - DNA, 19 bp, Homo sapiens
tccacgcctcctggccaga

SEQ ID NO: 2259502 - DNA, 20 bp, Homo sapiens
tccacgcctcctggccagac

SEQ ID NO: 2259503 - DNA, 18 bp, Homo sapiens
tccactcgtgtgtttcta

SEQ ID NO: 2259504 - DNA, 21 bp, Homo sapiens
tccagaaaacctctcctgacc

SEQ ID NO: 2259505 - DNA, 14 bp, Homo sapiens
tccagaaaactgtg

SEQ ID NO: 2259506 - DNA, 23 bp, Homo sapiens
tccagaaaactgtgatttcagga

SEQ ID NO: 2259507 - DNA, 14 bp, Homo sapiens
tccagagacaacag

SEQ ID NO: 2259508 - DNA, 19 bp, Homo sapiens
tccagatgtttccagactt

SEQ ID NO: 2259509 - DNA, 11 bp, Homo sapiens
tccagccagcg

SEQ ID NO: 2259510 - DNA, 13 bp, Homo sapiens
tccagccagcgcc

SEQ ID NO: 2259511 - DNA, 14 bp, Homo sapiens
tccagccagcgcct

SEQ ID NO: 2259512 - DNA, 20 bp, Homo sapiens
tccagccagcgcctccctcc

SEQ ID NO: 2259513 - DNA, 22 bp, Homo sapiens
tccagccagcgcctccctccac

SEQ ID NO: 2259514 - DNA, 18 bp, Homo sapiens
tccagcctccagggcatt

SEQ ID NO: 2259515 - DNA, 22 bp, Homo sapiens
tccagggaccactgggtgagag

SEQ ID NO: 2259516 - DNA, 18 bp, Homo sapiens
tccagggcattgctcagc

SEQ ID NO: 2259517 - DNA, 14 bp, Homo sapiens
tccagtataaccag

SEQ ID NO: 2259518 - DNA, 21 bp, Homo sapiens
tccagtgtccttagaacattt

SEQ ID NO: 2259519 - DNA, 17 bp, Homo sapiens
tccagtttgttctccgg

SEQ ID NO: 2259520 - DNA, 20 bp, Homo sapiens
tccagttttttgttatatag

SEQ ID NO: 2259521 - DNA, 19 bp, Homo sapiens
tccatagtttggcatttgc

SEQ ID NO: 2259522 - DNA, 22 bp, Homo sapiens
tccattgtagtggcctgtgctt

SEQ ID NO: 2259523 - DNA, 21 bp, Homo sapiens
tcccaaacgcctcccctgccc

SEQ ID NO: 2259524 - DNA, 16 bp, Homo sapiens
tcccacaggagggcca

SEQ ID NO: 2259525 - DNA, 16 bp, Homo sapiens
tcccaccagagccggg

SEQ ID NO: 2259526 - DNA, 23 bp, Homo sapiens
tcccacccccacccccagctcaa

SEQ ID NO: 2259527 - DNA, 23 bp, Homo sapiens
tcccacccccagccccgactcca

SEQ ID NO: 2259528 - DNA, 15 bp, Homo sapiens
tcccaggaagcccag

SEQ ID NO: 2259529 - DNA, 13 bp, Homo sapiens
tcccatgtagccc

SEQ ID NO: 2259530 - DNA, 21 bp, Homo sapiens
tccccacttgtccgctgggtg

SEQ ID NO: 2259531 - DNA, 20 bp, Homo sapiens
tccccagccccagccccttc

SEQ ID NO: 2259532 - DNA, 15 bp, Homo sapiens
tccccaggggagttg

SEQ ID NO: 2259533 - DNA, 14 bp, Homo sapiens
tcccccatgggctg

SEQ ID NO: 2259534 - DNA, 23 bp, Homo sapiens
tccccctgcaaaaagaaaaaaag

SEQ ID NO: 2259535 - DNA, 15 bp, Homo sapiens
tccccgcctggccag

SEQ ID NO: 2259536 - DNA, 14 bp, Homo sapiens
tccccgcgccccag

SEQ ID NO: 2259537 - DNA, 15 bp, Homo sapiens
tccccgcgccccagt

SEQ ID NO: 2259538 - DNA, 19 bp, Homo sapiens
tccccgcgccccagtcact

SEQ ID NO: 2259539 - DNA, 17 bp, Homo sapiens
tcccctcacctcctcta

SEQ ID NO: 2259540 - DNA, 17 bp, Homo sapiens
tcccctcactctgtcag

SEQ ID NO: 2259541 - DNA, 18 bp, Homo sapiens
tcccctcactctgtcagc

SEQ ID NO: 2259542 - DNA, 15 bp, Homo sapiens
tcccctctgctgctg

SEQ ID NO: 2259543 - DNA, 18 bp, Homo sapiens
tattacatgtaatttgat

SEQ ID NO: 2259544 - DNA, 21 bp, Homo sapiens
tattaccccctccttcagaca

SEQ ID NO: 2259545 - DNA, 22 bp, Homo sapiens
tattaccccctccttcagacac

SEQ ID NO: 2259546 - DNA, 18 bp, Homo sapiens
tattataagtcttacata

SEQ ID NO: 2259547 - DNA, 20 bp, Homo sapiens
tattatcaaagggataaaga

SEQ ID NO: 2259548 - DNA, 23 bp, Homo sapiens
tattattttttaataagaacatt

SEQ ID NO: 2259549 - DNA, 16 bp, Homo sapiens
tattcattaagctttt

SEQ ID NO: 2259550 - DNA, 21 bp, Homo sapiens
tattccaaaccaaattttaat

SEQ ID NO: 2259551 - DNA, 15 bp, Homo sapiens
tattcgaaatgagct

SEQ ID NO: 2259552 - DNA, 21 bp, Homo sapiens
tattctagcctgcattgagct

SEQ ID NO: 2259553 - DNA, 15 bp, Homo sapiens
tattctcgaatcacc

SEQ ID NO: 2259554 - DNA, 14 bp, Homo sapiens
tattctgttccaca

SEQ ID NO: 2259555 - DNA, 22 bp, Homo sapiens
tattcttctcttccttttatca

SEQ ID NO: 2259556 - DNA, 11 bp, Homo sapiens
tattgcagttt

SEQ ID NO: 2259557 - DNA, 16 bp, Homo sapiens
tattgccaactcttct

SEQ ID NO: 2259558 - DNA, 15 bp, Homo sapiens
tattgctgagagaaa

SEQ ID NO: 2259559 - DNA, 23 bp, Homo sapiens
tattggggccatgagtaaaatag

SEQ ID NO: 2259560 - DNA, 17 bp, Homo sapiens
tattggggtctgacccc

SEQ ID NO: 2259561 - DNA, 17 bp, Homo sapiens
tattggtgtaaggtact

SEQ ID NO: 2259562 - DNA, 19 bp, Homo sapiens
tattgtatattacaatgat

SEQ ID NO: 2259563 - DNA, 22 bp, Homo sapiens
tattgtgttgactttataaatt

SEQ ID NO: 2259564 - DNA, 17 bp, Homo sapiens
tattgttccagcagttt

SEQ ID NO: 2259565 - DNA, 18 bp, Homo sapiens
tatttaaaaatatttttg

SEQ ID NO: 2259566 - DNA, 13 bp, Homo sapiens
tatttaattaaaa

SEQ ID NO: 2259567 - DNA, 15 bp, Homo sapiens
tatttataaaacttc

SEQ ID NO: 2259568 - DNA, 17 bp, Homo sapiens
tatttataaaacttctc

SEQ ID NO: 2259569 - DNA, 16 bp, Homo sapiens
tatttatctgattaag

SEQ ID NO: 2259570 - DNA, 13 bp, Homo sapiens
tatttattacata

SEQ ID NO: 2259571 - DNA, 14 bp, Homo sapiens
tatttcagatgttt

SEQ ID NO: 2259572 - DNA, 21 bp, Homo sapiens
tatttctattattaattgcaa

SEQ ID NO: 2259573 - DNA, 15 bp, Homo sapiens
tatttgaacaagtgg

SEQ ID NO: 2259574 - DNA, 17 bp, Homo sapiens
tatttgaggagtgttaa

SEQ ID NO: 2259575 - DNA, 18 bp, Homo sapiens
tatttgtgatagcacttt

SEQ ID NO: 2259576 - DNA, 21 bp, Homo sapiens
tatttgtgttttaatttaaac

SEQ ID NO: 2259577 - DNA, 17 bp, Homo sapiens
tattttaagacgtgaat

SEQ ID NO: 2259578 - DNA, 23 bp, Homo sapiens
tattttaagactgattttaatag

SEQ ID NO: 2259579 - DNA, 22 bp, Homo sapiens
tattttacatgaagctgtataa

SEQ ID NO: 2259580 - DNA, 19 bp, Homo sapiens
tattttcagtcaaaacttt

SEQ ID NO: 2259581 - DNA, 16 bp, Homo sapiens
tattttgaatcaataa

SEQ ID NO: 2259582 - DNA, 19 bp, Homo sapiens
tattttgttaccttttaca

SEQ ID NO: 2259583 - DNA, 12 bp, Homo sapiens
tatttttatcta

SEQ ID NO: 2259584 - DNA, 16 bp, Homo sapiens
tatttttcataaacaa

SEQ ID NO: 2259585 - DNA, 11 bp, Homo sapiens
tatttttgtac

SEQ ID NO: 2259586 - DNA, 16 bp, Homo sapiens
tatttttgtacgttat

SEQ ID NO: 2259587 - DNA, 14 bp, Homo sapiens
tattttttcctttt

SEQ ID NO: 2259588 - DNA, 13 bp, Homo sapiens
tattttttgaaaa

SEQ ID NO: 2259589 - DNA, 17 bp, Homo sapiens
tcaaaaactttggagtc

SEQ ID NO: 2259590 - DNA, 21 bp, Homo sapiens
tcaaaaagggaagtaagcaaa

SEQ ID NO: 2259591 - DNA, 23 bp, Homo sapiens
tcaaaaagggaagtaagcaaaca

SEQ ID NO: 2259592 - DNA, 21 bp, Homo sapiens
tcaaaaatatgtgtttttaag

SEQ ID NO: 2259593 - DNA, 23 bp, Homo sapiens
tcaaaaggaatgaacttgttact

SEQ ID NO: 2259594 - DNA, 13 bp, Homo sapiens
tcaaaagtttgtt

SEQ ID NO: 2259595 - DNA, 23 bp, Homo sapiens
tcaaacaaaaaagaaaagtagaa

SEQ ID NO: 2259596 - DNA, 19 bp, Homo sapiens
tcaaacgggggccttctgg

SEQ ID NO: 2259597 - DNA, 20 bp, Homo sapiens
tcaaagaaacttgaagcttt

SEQ ID NO: 2259598 - DNA, 16 bp, Homo sapiens
tcaaagaagtcggaat

SEQ ID NO: 2259599 - DNA, 23 bp, Homo sapiens
tcaaagaagtcggaatgtcatag

SEQ ID NO: 2259600 - DNA, 15 bp, Homo sapiens
tcaaagttgaaaatt

SEQ ID NO: 2259601 - DNA, 17 bp, Homo sapiens
tcaaagttgaaaattca

SEQ ID NO: 2259602 - DNA, 18 bp, Homo sapiens
tcaaagttgaaaattcat

SEQ ID NO: 2259603 - DNA, 23 bp, Homo sapiens
tcaaatgaatggaggaactttcc

SEQ ID NO: 2259604 - DNA, 17 bp, Homo sapiens
tcaaattaataatctta

SEQ ID NO: 2259605 - DNA, 21 bp, Homo sapiens
tcaacctggtggcaccagatg

SEQ ID NO: 2259606 - DNA, 14 bp, Homo sapiens
tcaactattctgtt

SEQ ID NO: 2259607 - DNA, 21 bp, Homo sapiens
tcaactccaaggcacactgtt

SEQ ID NO: 2259608 - DNA, 21 bp, Homo sapiens
tcaagattttttttgtaactt

SEQ ID NO: 2259609 - DNA, 17 bp, Homo sapiens
tcaaggctgcttagaat

SEQ ID NO: 2259610 - DNA, 18 bp, Homo sapiens
tcaaggctgcttagaatc

SEQ ID NO: 2259611 - DNA, 21 bp, Homo sapiens
tcaagttgattagaaagacca

SEQ ID NO: 2259612 - DNA, 18 bp, Homo sapiens
tcacacatgccactatga

SEQ ID NO: 2259613 - DNA, 16 bp, Homo sapiens
tcacacccatttaaaa

SEQ ID NO: 2259614 - DNA, 21 bp, Homo sapiens
tcacagtaaaaataaaatact

SEQ ID NO: 2259615 - DNA, 21 bp, Homo sapiens
tcacatgatgcacttcaaatt

SEQ ID NO: 2259616 - DNA, 22 bp, Homo sapiens
tcacattcctctgcccttcctg

SEQ ID NO: 2259617 - DNA, 21 bp, Homo sapiens
tcacattcttggcttaatcat

SEQ ID NO: 2259618 - DNA, 17 bp, Homo sapiens
tcaccactaccagccag

SEQ ID NO: 2259619 - DNA, 18 bp, Homo sapiens
tcaccactaccagccagc

SEQ ID NO: 2259620 - DNA, 20 bp, Homo sapiens
tcaccactaccagccagcct

SEQ ID NO: 2259621 - DNA, 17 bp, Homo sapiens
tcaccagctatctgtca

SEQ ID NO: 2259622 - DNA, 11 bp, Homo sapiens
tcaccatctct

SEQ ID NO: 2259623 - DNA, 20 bp, Homo sapiens
tcaccatctcttcattcaaa

SEQ ID NO: 2259624 - DNA, 22 bp, Homo sapiens
tcaccatctcttcattcaaact

SEQ ID NO: 2259625 - DNA, 15 bp, Homo sapiens
tcaccccctcccacc

SEQ ID NO: 2259626 - DNA, 19 bp, Homo sapiens
tcaccccctcccaccccca

SEQ ID NO: 2259627 - DNA, 15 bp, Homo sapiens
tcacccgcccctgga

SEQ ID NO: 2259628 - DNA, 14 bp, Homo sapiens
tcaccgagcagagg

SEQ ID NO: 2259629 - DNA, 12 bp, Homo sapiens
tcacctcctcta

SEQ ID NO: 2259630 - DNA, 22 bp, Homo sapiens
tcacctcctctaaggttgggca

SEQ ID NO: 2259631 - DNA, 19 bp, Homo sapiens
tcacgtgtaaacaggatta

SEQ ID NO: 2259632 - DNA, 15 bp, Homo sapiens
tcactaaagcatgaa

SEQ ID NO: 2259633 - DNA, 16 bp, Homo sapiens
tcactaaagcatgaaa

SEQ ID NO: 2259634 - DNA, 22 bp, Homo sapiens
tcactaaagcatgaaatgtgaa

SEQ ID NO: 2259635 - DNA, 17 bp, Homo sapiens
tcactatggtatgctgg

SEQ ID NO: 2259636 - DNA, 16 bp, Homo sapiens
tcactattacttgaac

SEQ ID NO: 2259637 - DNA, 21 bp, Homo sapiens
tcactcaccactaccagccag

SEQ ID NO: 2259638 - DNA, 15 bp, Homo sapiens
tcactcattgctgag

SEQ ID NO: 2259639 - DNA, 18 bp, Homo sapiens
tcactcattgctgagcct

SEQ ID NO: 2259640 - DNA, 13 bp, Homo sapiens
tcactctgtcagc

SEQ ID NO: 2259641 - DNA, 17 bp, Homo sapiens
tcactctgtcagccagc

SEQ ID NO: 2259642 - DNA, 16 bp, Homo sapiens
tcactgatgggaaaac

SEQ ID NO: 2259643 - DNA, 18 bp, Homo sapiens
tcactgatgggaaaactg

SEQ ID NO: 2259644 - DNA, 19 bp, Homo sapiens
tcactgcttgaactaggct

SEQ ID NO: 2259645 - DNA, 22 bp, Homo sapiens
tcacttaagttagttccactga

SEQ ID NO: 2259646 - DNA, 17 bp, Homo sapiens
tcacttttttctgcctt

SEQ ID NO: 2259647 - DNA, 23 bp, Homo sapiens
tcagacaccctcaacctcttctg

SEQ ID NO: 2259648 - DNA, 14 bp, Homo sapiens
tcagacatgttttc

SEQ ID NO: 2259649 - DNA, 17 bp, Homo sapiens
tcagactccagctgtga

SEQ ID NO: 2259650 - DNA, 23 bp, Homo sapiens
tcagagccagcctggctctgccc

SEQ ID NO: 2259651 - DNA, 15 bp, Homo sapiens
taggcagggggccct

SEQ ID NO: 2259652 - DNA, 19 bp, Homo sapiens
taggcagggggccctgccc

SEQ ID NO: 2259653 - DNA, 21 bp, Homo sapiens
taggcagggggccctgcccca

SEQ ID NO: 2259654 - DNA, 14 bp, Homo sapiens
taggcatgtaaaca

SEQ ID NO: 2259655 - DNA, 19 bp, Homo sapiens
taggcctcaggtgaaactc

SEQ ID NO: 2259656 - DNA, 14 bp, Homo sapiens
taggctttttaatc

SEQ ID NO: 2259657 - DNA, 15 bp, Homo sapiens
tagggtcggaaccca

SEQ ID NO: 2259658 - DNA, 18 bp, Homo sapiens
taggtagcaacaacagaa

SEQ ID NO: 2259659 - DNA, 19 bp, Homo sapiens
taggtgctatttgtcatct

SEQ ID NO: 2259660 - DNA, 15 bp, Homo sapiens
taggttcttaaggat

SEQ ID NO: 2259661 - DNA, 20 bp, Homo sapiens
tagtaatttctttttttcct

SEQ ID NO: 2259662 - DNA, 16 bp, Homo sapiens
tagtaccatttataca

SEQ ID NO: 2259663 - DNA, 22 bp, Homo sapiens
tagtagacatgaattttaaata

SEQ ID NO: 2259664 - DNA, 23 bp, Homo sapiens
tagtattatcaaagggataaaga

SEQ ID NO: 2259665 - DNA, 21 bp, Homo sapiens
tagtatttttactattataat

SEQ ID NO: 2259666 - DNA, 14 bp, Homo sapiens
tagtcaaacaaaaa

SEQ ID NO: 2259667 - DNA, 22 bp, Homo sapiens
tagtcaaacaaaaaagaaaagt

SEQ ID NO: 2259668 - DNA, 24 bp, Homo sapiens
tagtcaatcactgcactgcatgca

SEQ ID NO: 2259669 - DNA, 19 bp, Homo sapiens
tagtctcagtttgtgtgtc

SEQ ID NO: 2259670 - DNA, 19 bp, Homo sapiens
tagtcttgaaatgaaaggg

SEQ ID NO: 2259671 - DNA, 22 bp, Homo sapiens
tagtgctccatagtttggcatt

SEQ ID NO: 2259672 - DNA, 15 bp, Homo sapiens
tagttactgtgtaaa

SEQ ID NO: 2259673 - DNA, 16 bp, Homo sapiens
tagttactgtgtaaac

SEQ ID NO: 2259674 - DNA, 19 bp, Homo sapiens
tagttactgtgtaaactca

SEQ ID NO: 2259675 - DNA, 17 bp, Homo sapiens
tagttcaaactgcagct

SEQ ID NO: 2259676 - DNA, 17 bp, Homo sapiens
tagttgtctttcctggc

SEQ ID NO: 2259677 - DNA, 16 bp, Homo sapiens
tagtttggcatttgca

SEQ ID NO: 2259678 - DNA, 21 bp, Homo sapiens
tagtttttcctatcatgttaa

SEQ ID NO: 2259679 - DNA, 14 bp, Homo sapiens
tataaaaatggctt

SEQ ID NO: 2259680 - DNA, 10 bp, Homo sapiens
tataaaacaa

SEQ ID NO: 2259681 - DNA, 15 bp, Homo sapiens
tataaaataactaaa

SEQ ID NO: 2259682 - DNA, 14 bp, Homo sapiens
tataaagtattctt

SEQ ID NO: 2259683 - DNA, 15 bp, Homo sapiens
tataaagtattcttt

SEQ ID NO: 2259684 - DNA, 14 bp, Homo sapiens
tataaattgtcttt

SEQ ID NO: 2259685 - DNA, 16 bp, Homo sapiens
tataaggcagccttga

SEQ ID NO: 2259686 - DNA, 19 bp, Homo sapiens
tataagtggaggcacttta

SEQ ID NO: 2259687 - DNA, 14 bp, Homo sapiens
tataataaatatat

SEQ ID NO: 2259688 - DNA, 14 bp, Homo sapiens
tataatatggaacc

SEQ ID NO: 2259689 - DNA, 16 bp, Homo sapiens
tataatcatcaagtaa

SEQ ID NO: 2259690 - DNA, 17 bp, Homo sapiens
tataatcatcaagtaat

SEQ ID NO: 2259691 - DNA, 14 bp, Homo sapiens
tataatctatttac

SEQ ID NO: 2259692 - DNA, 18 bp, Homo sapiens
tataatctatttacataa

SEQ ID NO: 2259693 - DNA, 17 bp, Homo sapiens
tatacaaaactttatca

SEQ ID NO: 2259694 - DNA, 21 bp, Homo sapiens
tatacaccttattaatgatca

SEQ ID NO: 2259695 - DNA, 17 bp, Homo sapiens
tatacagggtattaaga

SEQ ID NO: 2259696 - DNA, 15 bp, Homo sapiens
tatacatatctttat

SEQ ID NO: 2259697 - DNA, 21 bp, Homo sapiens
tatacatatctttattaatca

SEQ ID NO: 2259698 - DNA, 19 bp, Homo sapiens
tatacatcaatttaaaaag

SEQ ID NO: 2259699 - DNA, 21 bp, Homo sapiens
tatactactttgttaggattt

SEQ ID NO: 2259700 - DNA, 22 bp, Homo sapiens
tatagaaaaataaaaatctctt

SEQ ID NO: 2259701 - DNA, 17 bp, Homo sapiens
tatagcattaataaaac

SEQ ID NO: 2259702 - DNA, 19 bp, Homo sapiens
tatagcattaataaaactg

SEQ ID NO: 2259703 - DNA, 14 bp, Homo sapiens
tatagccaatataa

SEQ ID NO: 2259704 - DNA, 17 bp, Homo sapiens
tatagccaatataacta

SEQ ID NO: 2259705 - DNA, 14 bp, Homo sapiens
tatataaaataact

SEQ ID NO: 2259706 - DNA, 16 bp, Homo sapiens
tatataaagtattctt

SEQ ID NO: 2259707 - DNA, 16 bp, Homo sapiens
tatataatcatcaagt

SEQ ID NO: 2259708 - DNA, 21 bp, Homo sapiens
tatatagccaatataactatc

SEQ ID NO: 2259709 - DNA, 15 bp, Homo sapiens
tatatatagtttatt

SEQ ID NO: 2259710 - DNA, 19 bp, Homo sapiens
tatatatggatcagaggag

SEQ ID NO: 2259711 - DNA, 17 bp, Homo sapiens
tatatatttctattatt

SEQ ID NO: 2259712 - DNA, 17 bp, Homo sapiens
tatatccccactactca

SEQ ID NO: 2259713 - DNA, 14 bp, Homo sapiens
tatatctctatttg

SEQ ID NO: 2259714 - DNA, 12 bp, Homo sapiens
tatattacaatg

SEQ ID NO: 2259715 - DNA, 17 bp, Homo sapiens
tatattacaatgatcac

SEQ ID NO: 2259716 - DNA, 19 bp, Homo sapiens
tatattcaaattatgtata

SEQ ID NO: 2259717 - DNA, 22 bp, Homo sapiens
tatattcaaattatgtataaat

SEQ ID NO: 2259718 - DNA, 22 bp, Homo sapiens
tatattgtcctcccctatttta

SEQ ID NO: 2259719 - DNA, 21 bp, Homo sapiens
tatatttgtgatagcactttc

SEQ ID NO: 2259720 - DNA, 22 bp, Homo sapiens
tatatttgtgatagcactttct

SEQ ID NO: 2259721 - DNA, 14 bp, Homo sapiens
tatattttctgttt

SEQ ID NO: 2259722 - DNA, 22 bp, Homo sapiens
tatcaatgtgtctttctaagaa

SEQ ID NO: 2259723 - DNA, 22 bp, Homo sapiens
tatcattcaagtgtaaaatatt

SEQ ID NO: 2259724 - DNA, 17 bp, Homo sapiens
tatccaggcaccaggac

SEQ ID NO: 2259725 - DNA, 14 bp, Homo sapiens
tatctagcttcttc

SEQ ID NO: 2259726 - DNA, 12 bp, Homo sapiens
tatctataaaat

SEQ ID NO: 2259727 - DNA, 22 bp, Homo sapiens
tatctataaaatagatataaat

SEQ ID NO: 2259728 - DNA, 13 bp, Homo sapiens
tatctatataaaa

SEQ ID NO: 2259729 - DNA, 20 bp, Homo sapiens
tatctctactgaatgtcatt

SEQ ID NO: 2259730 - DNA, 12 bp, Homo sapiens
tatctctgtgtt

SEQ ID NO: 2259731 - DNA, 15 bp, Homo sapiens
tatctgtcatctctc

SEQ ID NO: 2259732 - DNA, 22 bp, Homo sapiens
tatctgtttcctgacattgtct

SEQ ID NO: 2259733 - DNA, 11 bp, Homo sapiens
tatcttggcct

SEQ ID NO: 2259734 - DNA, 19 bp, Homo sapiens
tatgaagataagtgtattt

SEQ ID NO: 2259735 - DNA, 16 bp, Homo sapiens
tatgagctttcagact

SEQ ID NO: 2259736 - DNA, 16 bp, Homo sapiens
tatgatctgtctgtgg

SEQ ID NO: 2259737 - DNA, 21 bp, Homo sapiens
tatgcacacttttaattttgt

SEQ ID NO: 2259738 - DNA, 17 bp, Homo sapiens
tatgcaggcagcacagc

SEQ ID NO: 2259739 - DNA, 13 bp, Homo sapiens
tatgcctttctct

SEQ ID NO: 2259740 - DNA, 12 bp, Homo sapiens
tatgctggccag

SEQ ID NO: 2259741 - DNA, 18 bp, Homo sapiens
tatgctggccagcaccct

SEQ ID NO: 2259742 - DNA, 19 bp, Homo sapiens
tatgctggccagcaccctc

SEQ ID NO: 2259743 - DNA, 22 bp, Homo sapiens
tatgctggccagcaccctctcc

SEQ ID NO: 2259744 - DNA, 15 bp, Homo sapiens
tatggaaaaataaaa

SEQ ID NO: 2259745 - DNA, 20 bp, Homo sapiens
tatggaaaaataaaactgtc

SEQ ID NO: 2259746 - DNA, 21 bp, Homo sapiens
tatggatcagaggagtaaata

SEQ ID NO: 2259747 - DNA, 14 bp, Homo sapiens
tatgggtctaggac

SEQ ID NO: 2259748 - DNA, 17 bp, Homo sapiens
tatggtatgctggccag

SEQ ID NO: 2259749 - DNA, 18 bp, Homo sapiens
tatggtatgctggccagc

SEQ ID NO: 2259750 - DNA, 20 bp, Homo sapiens
tatgtaaatggtatgtcatt

SEQ ID NO: 2259751 - DNA, 18 bp, Homo sapiens
tatgtagaattgctgtct

SEQ ID NO: 2259752 - DNA, 16 bp, Homo sapiens
tatgtatttttctatg

SEQ ID NO: 2259753 - DNA, 15 bp, Homo sapiens
tatgtggttttgtaa

SEQ ID NO: 2259754 - DNA, 15 bp, Homo sapiens
tatgtgtaaagattt

SEQ ID NO: 2259755 - DNA, 15 bp, Homo sapiens
tatgtgttacttcaa

SEQ ID NO: 2259756 - DNA, 12 bp, Homo sapiens
tatgttcatttt

SEQ ID NO: 2259757 - DNA, 16 bp, Homo sapiens
tatgttgaaaaaattt

SEQ ID NO: 2259758 - DNA, 21 bp, Homo sapiens
tattaatataataatgatgat

SEQ ID NO: 2259759 - DNA, 19 bp, Homo sapiens
tattaatcaccttctttgt

SEQ ID NO: 2259760 - DNA, 20 bp, Homo sapiens
tattaatgcactttctatcc

SEQ ID NO: 2259761 - DNA, 16 bp, Homo sapiens
tacacctcaaatacca

SEQ ID NO: 2259762 - DNA, 17 bp, Homo sapiens
tacagaataaaagaatt

SEQ ID NO: 2259763 - DNA, 18 bp, Homo sapiens
tacagagccaaaatgcca

SEQ ID NO: 2259764 - DNA, 18 bp, Homo sapiens
tacagtcaagatagaaag

SEQ ID NO: 2259765 - DNA, 19 bp, Homo sapiens
tacagtccaaaatactgtt

SEQ ID NO: 2259766 - DNA, 13 bp, Homo sapiens
tacagttataaaa

SEQ ID NO: 2259767 - DNA, 19 bp, Homo sapiens
tacagttgaaaacttgtaa

SEQ ID NO: 2259768 - DNA, 23 bp, Homo sapiens
tacataaaccatttttgttactc

SEQ ID NO: 2259769 - DNA, 18 bp, Homo sapiens
tacatacagaggtaacta

SEQ ID NO: 2259770 - DNA, 21 bp, Homo sapiens
tacatacagaggtaactatca

SEQ ID NO: 2259771 - DNA, 15 bp, Homo sapiens
tacatactttatcaa

SEQ ID NO: 2259772 - DNA, 13 bp, Homo sapiens
tacatacttttgc

SEQ ID NO: 2259773 - DNA, 14 bp, Homo sapiens
tacatacttttgca

SEQ ID NO: 2259774 - DNA, 15 bp, Homo sapiens
tacatacttttgcaa

SEQ ID NO: 2259775 - DNA, 17 bp, Homo sapiens
tacatacttttgcaaaa

SEQ ID NO: 2259776 - DNA, 22 bp, Homo sapiens
tacatatctttattaatcacta

SEQ ID NO: 2259777 - DNA, 17 bp, Homo sapiens
tacatatgatctgtctg

SEQ ID NO: 2259778 - DNA, 15 bp, Homo sapiens
tacatgtttataaat

SEQ ID NO: 2259779 - DNA, 17 bp, Homo sapiens
tacatgtttataaatct

SEQ ID NO: 2259780 - DNA, 20 bp, Homo sapiens
tacatttaaaacattaaaat

SEQ ID NO: 2259781 - DNA, 14 bp, Homo sapiens
taccaagtgaaatt

SEQ ID NO: 2259782 - DNA, 20 bp, Homo sapiens
taccacttacctcaaattaa

SEQ ID NO: 2259783 - DNA, 15 bp, Homo sapiens
taccagccagcctca

SEQ ID NO: 2259784 - DNA, 14 bp, Homo sapiens
taccattcagtgat

SEQ ID NO: 2259785 - DNA, 15 bp, Homo sapiens
taccatttatacaaa

SEQ ID NO: 2259786 - DNA, 21 bp, Homo sapiens
taccatttatacaaattagaa

SEQ ID NO: 2259787 - DNA, 16 bp, Homo sapiens
taccccctccttcaga

SEQ ID NO: 2259788 - DNA, 23 bp, Homo sapiens
taccctccaagtctgtacctcaa

SEQ ID NO: 2259789 - DNA, 15 bp, Homo sapiens
taccctctcagctcc

SEQ ID NO: 2259790 - DNA, 16 bp, Homo sapiens
taccctctcagctcca

SEQ ID NO: 2259791 - DNA, 14 bp, Homo sapiens
taccctctggaggg

SEQ ID NO: 2259792 - DNA, 18 bp, Homo sapiens
taccctttttctccagct

SEQ ID NO: 2259793 - DNA, 16 bp, Homo sapiens
tacctactttcttcag

SEQ ID NO: 2259794 - DNA, 15 bp, Homo sapiens
tacctagctggctct

SEQ ID NO: 2259795 - DNA, 13 bp, Homo sapiens
tacctcaaatgaa

SEQ ID NO: 2259796 - DNA, 19 bp, Homo sapiens
tacctcaaatgaattcttt

SEQ ID NO: 2259797 - DNA, 17 bp, Homo sapiens
tacctcaggcagctcaa

SEQ ID NO: 2259798 - DNA, 16 bp, Homo sapiens
tacctcatttttcata

SEQ ID NO: 2259799 - DNA, 22 bp, Homo sapiens
tacctgttttgtggtcagctgt

SEQ ID NO: 2259800 - DNA, 15 bp, Homo sapiens
taccttcaaacttta

SEQ ID NO: 2259801 - DNA, 15 bp, Homo sapiens
tactacagtcaagat

SEQ ID NO: 2259802 - DNA, 20 bp, Homo sapiens
tactactttctctttttcgt

SEQ ID NO: 2259803 - DNA, 23 bp, Homo sapiens
tactaggaagaacgttttttcct

SEQ ID NO: 2259804 - DNA, 20 bp, Homo sapiens
tactagtcaccagagacttt

SEQ ID NO: 2259805 - DNA, 12 bp, Homo sapiens
tactatttaaag

SEQ ID NO: 2259806 - DNA, 12 bp, Homo sapiens
tactatttaaga

SEQ ID NO: 2259807 - DNA, 15 bp, Homo sapiens
tactatttaagatgt

SEQ ID NO: 2259808 - DNA, 18 bp, Homo sapiens
tactatttaagatgtgaa

SEQ ID NO: 2259809 - DNA, 19 bp, Homo sapiens
tactatttaagatgtgaaa

SEQ ID NO: 2259810 - DNA, 21 bp, Homo sapiens
tactcacagcacttgttttca

SEQ ID NO: 2259811 - DNA, 19 bp, Homo sapiens
tactgaagccaaatgaaac

SEQ ID NO: 2259812 - DNA, 18 bp, Homo sapiens
tactgacaataaaaatgt

SEQ ID NO: 2259813 - DNA, 18 bp, Homo sapiens
tactgacagggagcagcc

SEQ ID NO: 2259814 - DNA, 21 bp, Homo sapiens
tactgacagggagcagccccc

SEQ ID NO: 2259815 - DNA, 13 bp, Homo sapiens
tactgcattctga

SEQ ID NO: 2259816 - DNA, 21 bp, Homo sapiens
tactggaacccttttaaagtt

SEQ ID NO: 2259817 - DNA, 14 bp, Homo sapiens
tactggataaattg

SEQ ID NO: 2259818 - DNA, 16 bp, Homo sapiens
tactggataaattgtt

SEQ ID NO: 2259819 - DNA, 18 bp, Homo sapiens
tactggctctttattcat

SEQ ID NO: 2259820 - DNA, 14 bp, Homo sapiens
tactgttctgtgtc

SEQ ID NO: 2259821 - DNA, 14 bp, Homo sapiens
tacttcctcctccc

SEQ ID NO: 2259822 - DNA, 16 bp, Homo sapiens
tacttcctcctcccca

SEQ ID NO: 2259823 - DNA, 22 bp, Homo sapiens
tacttgaactttccaaaaccta

SEQ ID NO: 2259824 - DNA, 15 bp, Homo sapiens
tacttgttctgtatt

SEQ ID NO: 2259825 - DNA, 13 bp, Homo sapiens
tactttgtaaata

SEQ ID NO: 2259826 - DNA, 22 bp, Homo sapiens
tacttttcctgggtttcctgca

SEQ ID NO: 2259827 - DNA, 19 bp, Homo sapiens
tagaaacctcattggccag

SEQ ID NO: 2259828 - DNA, 13 bp, Homo sapiens
tagaaaggaacac

SEQ ID NO: 2259829 - DNA, 21 bp, Homo sapiens
tagaaatggaaattttgctat

SEQ ID NO: 2259830 - DNA, 13 bp, Homo sapiens
tagaaattttcaa

SEQ ID NO: 2259831 - DNA, 18 bp, Homo sapiens
tagaacagtggaaactat

SEQ ID NO: 2259832 - DNA, 16 bp, Homo sapiens
tagaatacattgtact

SEQ ID NO: 2259833 - DNA, 15 bp, Homo sapiens
tagaataggcagggg

SEQ ID NO: 2259834 - DNA, 14 bp, Homo sapiens
tagaatccaaactt

SEQ ID NO: 2259835 - DNA, 14 bp, Homo sapiens
tagaattaaaaaag

SEQ ID NO: 2259836 - DNA, 12 bp, Homo sapiens
tagaattattta

SEQ ID NO: 2259837 - DNA, 17 bp, Homo sapiens
tagactctgtctacctg

SEQ ID NO: 2259838 - DNA, 22 bp, Homo sapiens
tagagtttttatgcctttctct

SEQ ID NO: 2259839 - DNA, 14 bp, Homo sapiens
tagatataatgaac

SEQ ID NO: 2259840 - DNA, 23 bp, Homo sapiens
tagatataatgaacaaaattatt

SEQ ID NO: 2259841 - DNA, 13 bp, Homo sapiens
tagatatttttca

SEQ ID NO: 2259842 - DNA, 15 bp, Homo sapiens
tagatatttttcata

SEQ ID NO: 2259843 - DNA, 20 bp, Homo sapiens
tagatatttttcataaacaa

SEQ ID NO: 2259844 - DNA, 16 bp, Homo sapiens
tagatgtaattttgtg

SEQ ID NO: 2259845 - DNA, 19 bp, Homo sapiens
tagattcaggtaatacaaa

SEQ ID NO: 2259846 - DNA, 15 bp, Homo sapiens
tagcaataaataaca

SEQ ID NO: 2259847 - DNA, 19 bp, Homo sapiens
tagcacttaaattcctcaa

SEQ ID NO: 2259848 - DNA, 16 bp, Homo sapiens
tagcagagtctgtctc

SEQ ID NO: 2259849 - DNA, 14 bp, Homo sapiens
tagcagcaggctca

SEQ ID NO: 2259850 - DNA, 22 bp, Homo sapiens
tagcagcggaacaaggagtcag

SEQ ID NO: 2259851 - DNA, 19 bp, Homo sapiens
tagcattgtaaaagcattt

SEQ ID NO: 2259852 - DNA, 15 bp, Homo sapiens
tagccagatttgtct

SEQ ID NO: 2259853 - DNA, 13 bp, Homo sapiens
tagccattgaaat

SEQ ID NO: 2259854 - DNA, 13 bp, Homo sapiens
tagcctgatgaga

SEQ ID NO: 2259855 - DNA, 20 bp, Homo sapiens
tagcctgggctcactgtgct

SEQ ID NO: 2259856 - DNA, 17 bp, Homo sapiens
tagctaactgtaaatca

SEQ ID NO: 2259857 - DNA, 12 bp, Homo sapiens
tagctacactga

SEQ ID NO: 2259858 - DNA, 10 bp, Homo sapiens
tagctgtggg

SEQ ID NO: 2259859 - DNA, 20 bp, Homo sapiens
taggaaacttgtagaaacga

SEQ ID NO: 2259860 - DNA, 21 bp, Homo sapiens
taggaagaacgcggtgtgtaa

SEQ ID NO: 2259861 - DNA, 23 bp, Homo sapiens
taggaagaacgttttttcctcag

SEQ ID NO: 2259862 - DNA, 20 bp, Homo sapiens
taggaagtcaatatgtggaa

SEQ ID NO: 2259863 - DNA, 14 bp, Homo sapiens
taggaattgaatta

SEQ ID NO: 2259864 - DNA, 19 bp, Homo sapiens
taggacacagttcctggga

SEQ ID NO: 2259865 - DNA, 23 bp, Homo sapiens
taggagctgccttggctcagaca

SEQ ID NO: 2259866 - DNA, 21 bp, Homo sapiens
taggagggagttatctaaaag

SEQ ID NO: 2259867 - DNA, 19 bp, Homo sapiens
taggatagctaactgtaaa

SEQ ID NO: 2259868 - DNA, 13 bp, Homo sapiens
taggattttcaca

SEQ ID NO: 2259869 - DNA, 18 bp, Homo sapiens
taggcaccttttactgtg

SEQ ID NO: 2259870 - DNA, 16 bp, Homo sapiens
taggcacgaagcaatt

SEQ ID NO: 2259871 - DNA, 22 bp, Homo sapiens
taaattgaatcagtataaacaa

SEQ ID NO: 2259872 - DNA, 13 bp, Homo sapiens
taaattgcaagaa

SEQ ID NO: 2259873 - DNA, 22 bp, Homo sapiens
taaattgtctttaaaaactgtt

SEQ ID NO: 2259874 - DNA, 20 bp, Homo sapiens
taaattgtttagtggaaaat

SEQ ID NO: 2259875 - DNA, 22 bp, Homo sapiens
taaattttataggactgttctt

SEQ ID NO: 2259876 - DNA, 12 bp, Homo sapiens
taacaatgcaac

SEQ ID NO: 2259877 - DNA, 23 bp, Homo sapiens
taacaatgcaacttttaattact

SEQ ID NO: 2259878 - DNA, 19 bp, Homo sapiens
taacagttttgtgtaactc

SEQ ID NO: 2259879 - DNA, 20 bp, Homo sapiens
taacatgaggggacattttg

SEQ ID NO: 2259880 - DNA, 22 bp, Homo sapiens
taacatgctggtgaatattttc

SEQ ID NO: 2259881 - DNA, 20 bp, Homo sapiens
taacattagttttaaaaagg

SEQ ID NO: 2259882 - DNA, 19 bp, Homo sapiens
taactaaaataattttgta

SEQ ID NO: 2259883 - DNA, 21 bp, Homo sapiens
taactaaaataattttgtaat

SEQ ID NO: 2259884 - DNA, 14 bp, Homo sapiens
taactccactgctt

SEQ ID NO: 2259885 - DNA, 23 bp, Homo sapiens
taactgcaaccttgtttattaaa

SEQ ID NO: 2259886 - DNA, 20 bp, Homo sapiens
taactgcagttgactttctc

SEQ ID NO: 2259887 - DNA, 19 bp, Homo sapiens
taactggaacaaattattt

SEQ ID NO: 2259888 - DNA, 12 bp, Homo sapiens
taactgtaaatc

SEQ ID NO: 2259889 - DNA, 21 bp, Homo sapiens
taactgtgcgttaaataagca

SEQ ID NO: 2259890 - DNA, 13 bp, Homo sapiens
taactttgaaagt

SEQ ID NO: 2259891 - DNA, 13 bp, Homo sapiens
taacttttaatgg

SEQ ID NO: 2259892 - DNA, 16 bp, Homo sapiens
taactttttatttcta

SEQ ID NO: 2259893 - DNA, 14 bp, Homo sapiens
taagaaaagatttt

SEQ ID NO: 2259894 - DNA, 14 bp, Homo sapiens
taagaaatcaagta

SEQ ID NO: 2259895 - DNA, 16 bp, Homo sapiens
taagaacatcataaaa

SEQ ID NO: 2259896 - DNA, 18 bp, Homo sapiens
taagaaccattgatttaa

SEQ ID NO: 2259897 - DNA, 17 bp, Homo sapiens
taagaataataaaatca

SEQ ID NO: 2259898 - DNA, 20 bp, Homo sapiens
taagacgtgaatgtctcagc

SEQ ID NO: 2259899 - DNA, 15 bp, Homo sapiens
taagattcttttaaa

SEQ ID NO: 2259900 - DNA, 21 bp, Homo sapiens
taagattgatatctataaaat

SEQ ID NO: 2259901 - DNA, 22 bp, Homo sapiens
taagattgatatctataaaata

SEQ ID NO: 2259902 - DNA, 21 bp, Homo sapiens
taagcaaagcacccatttcaa

SEQ ID NO: 2259903 - DNA, 13 bp, Homo sapiens
taagcaaataaac

SEQ ID NO: 2259904 - DNA, 15 bp, Homo sapiens
taagcaaataaacag

SEQ ID NO: 2259905 - DNA, 13 bp, Homo sapiens
taaggaaactaga

SEQ ID NO: 2259906 - DNA, 17 bp, Homo sapiens
taaggacttctgcagct

SEQ ID NO: 2259907 - DNA, 20 bp, Homo sapiens
taaggagaggagaaactgag

SEQ ID NO: 2259908 - DNA, 20 bp, Homo sapiens
taagtattttcctgttgtca

SEQ ID NO: 2259909 - DNA, 21 bp, Homo sapiens
taagtattttcctgttgtcaa

SEQ ID NO: 2259910 - DNA, 22 bp, Homo sapiens
taagtgatgtgctgaattttat

SEQ ID NO: 2259911 - DNA, 18 bp, Homo sapiens
taagtgtatttttcaata

SEQ ID NO: 2259912 - DNA, 16 bp, Homo sapiens
taagttattgcagttt

SEQ ID NO: 2259913 - DNA, 16 bp, Homo sapiens
taagtttgaaatatat

SEQ ID NO: 2259914 - DNA, 21 bp, Homo sapiens
taataaaaaggagtatacaaa

SEQ ID NO: 2259915 - DNA, 12 bp, Homo sapiens
taataaaactgt

SEQ ID NO: 2259916 - DNA, 13 bp, Homo sapiens
taataaaactgtg

SEQ ID NO: 2259917 - DNA, 16 bp, Homo sapiens
taataaaagtattctt

SEQ ID NO: 2259918 - DNA, 16 bp, Homo sapiens
taataaatttactcac

SEQ ID NO: 2259919 - DNA, 23 bp, Homo sapiens
taataaatttactcacagcactt

SEQ ID NO: 2259920 - DNA, 19 bp, Homo sapiens
taataagtttgaaatatat

SEQ ID NO: 2259921 - DNA, 15 bp, Homo sapiens
taatacaaactatat

SEQ ID NO: 2259922 - DNA, 13 bp, Homo sapiens
taatacaaggtat

SEQ ID NO: 2259923 - DNA, 20 bp, Homo sapiens
taatacaaggtataataaaa

SEQ ID NO: 2259924 - DNA, 21 bp, Homo sapiens
taatacaaggtataataaaat

SEQ ID NO: 2259925 - DNA, 15 bp, Homo sapiens
taatataaaaaattt

SEQ ID NO: 2259926 - DNA, 21 bp, Homo sapiens
taatatattttctgttttctt

SEQ ID NO: 2259927 - DNA, 19 bp, Homo sapiens
taatatctttctgcacaca

SEQ ID NO: 2259928 - DNA, 15 bp, Homo sapiens
taatatgaaaactta

SEQ ID NO: 2259929 - DNA, 13 bp, Homo sapiens
taatatggaacct

SEQ ID NO: 2259930 - DNA, 17 bp, Homo sapiens
taatattaacttttaat

SEQ ID NO: 2259931 - DNA, 19 bp, Homo sapiens
taatattaatttatttaat

SEQ ID NO: 2259932 - DNA, 17 bp, Homo sapiens
taatatttaaatattac

SEQ ID NO: 2259933 - DNA, 18 bp, Homo sapiens
taatcaccttctttgtaa

SEQ ID NO: 2259934 - DNA, 13 bp, Homo sapiens
taatcatttgttt

SEQ ID NO: 2259935 - DNA, 14 bp, Homo sapiens
taatcatttgttta

SEQ ID NO: 2259936 - DNA, 13 bp, Homo sapiens
taatcattttcat

SEQ ID NO: 2259937 - DNA, 13 bp, Homo sapiens
taatccagctgat

SEQ ID NO: 2259938 - DNA, 14 bp, Homo sapiens
taatctatttacat

SEQ ID NO: 2259939 - DNA, 13 bp, Homo sapiens
taatcttattagg

SEQ ID NO: 2259940 - DNA, 16 bp, Homo sapiens
taatctttgtgacagg

SEQ ID NO: 2259941 - DNA, 20 bp, Homo sapiens
taatgacaggcctgtccaac

SEQ ID NO: 2259942 - DNA, 12 bp, Homo sapiens
taatgcactttc

SEQ ID NO: 2259943 - DNA, 14 bp, Homo sapiens
taatgcactttcta

SEQ ID NO: 2259944 - DNA, 19 bp, Homo sapiens
taatggtttttatttctcg

SEQ ID NO: 2259945 - DNA, 22 bp, Homo sapiens
taatggtttttatttctcgggt

SEQ ID NO: 2259946 - DNA, 15 bp, Homo sapiens
taatgtatataaaaa

SEQ ID NO: 2259947 - DNA, 16 bp, Homo sapiens
taatgtatataaaaat

SEQ ID NO: 2259948 - DNA, 18 bp, Homo sapiens
taattaaccttactaatt

SEQ ID NO: 2259949 - DNA, 17 bp, Homo sapiens
taattactgttttcttt

SEQ ID NO: 2259950 - DNA, 19 bp, Homo sapiens
taattactgttttcttttt

SEQ ID NO: 2259951 - DNA, 17 bp, Homo sapiens
taattattatttgtgtt

SEQ ID NO: 2259952 - DNA, 17 bp, Homo sapiens
taattatttattacata

SEQ ID NO: 2259953 - DNA, 19 bp, Homo sapiens
taattcaggcatattttaa

SEQ ID NO: 2259954 - DNA, 22 bp, Homo sapiens
taattgaagtgtataatataaa

SEQ ID NO: 2259955 - DNA, 18 bp, Homo sapiens
taattgggaaaaaagcaa

SEQ ID NO: 2259956 - DNA, 23 bp, Homo sapiens
taattggtacttttaaaaacata

SEQ ID NO: 2259957 - DNA, 12 bp, Homo sapiens
taattgtcatta

SEQ ID NO: 2259958 - DNA, 11 bp, Homo sapiens
taatttaaaca

SEQ ID NO: 2259959 - DNA, 13 bp, Homo sapiens
taatttaatgaaa

SEQ ID NO: 2259960 - DNA, 12 bp, Homo sapiens
taatttaatggg

SEQ ID NO: 2259961 - DNA, 15 bp, Homo sapiens
taatttatttcatcc

SEQ ID NO: 2259962 - DNA, 17 bp, Homo sapiens
taatttctttttttcct

SEQ ID NO: 2259963 - DNA, 21 bp, Homo sapiens
taatttgttggggctttacat

SEQ ID NO: 2259964 - DNA, 22 bp, Homo sapiens
taatttgttggggctttacata

SEQ ID NO: 2259965 - DNA, 22 bp, Homo sapiens
taattttacatgtttataaatc

SEQ ID NO: 2259966 - DNA, 15 bp, Homo sapiens
taattttcaccgagc

SEQ ID NO: 2259967 - DNA, 12 bp, Homo sapiens
taattttgtaat

SEQ ID NO: 2259968 - DNA, 19 bp, Homo sapiens
taattttgtgtaagaaata

SEQ ID NO: 2259969 - DNA, 19 bp, Homo sapiens
taatttttaatgatgacaa

SEQ ID NO: 2259970 - DNA, 15 bp, Homo sapiens
tacaaattagaaaat

SEQ ID NO: 2259971 - DNA, 16 bp, Homo sapiens
tacaaggtataataaa

SEQ ID NO: 2259972 - DNA, 21 bp, Homo sapiens
tacaatcaaaacacactacta

SEQ ID NO: 2259973 - DNA, 20 bp, Homo sapiens
tacaatgtgaactttattaa

SEQ ID NO: 2259974 - DNA, 21 bp, Homo sapiens
tacaatgtgaactttattaaa

SEQ ID NO: 2259975 - DNA, 22 bp, Homo sapiens
tacaatgtgaactttattaaat

SEQ ID NO: 2259976 - DNA, 21 bp, Homo sapiens
tacaattcattgtgttacctg

SEQ ID NO: 2259977 - DNA, 20 bp, Homo sapiens
tacacaaatgtgatttttgt

SEQ ID NO: 2259978 - DNA, 16 bp, Homo sapiens
tacacaagcaatgcaa

SEQ ID NO: 2259979 - DNA, 20 bp, Homo sapiens
tacacatatttgaagggtct

SEQ ID NO: 2259980 - DNA, 21 bp, Homo sapiens
gctgaggacgagacccccatc

SEQ ID NO: 2259981 - DNA, 17 bp, Homo sapiens
gctgatggagccttccc

SEQ ID NO: 2259982 - DNA, 19 bp, Homo sapiens
gctgcaagtcagattgctg

SEQ ID NO: 2259983 - DNA, 22 bp, Homo sapiens
gctgcaagtcagattgctggga

SEQ ID NO: 2259984 - DNA, 17 bp, Homo sapiens
gctgcaggacttgagaa

SEQ ID NO: 2259985 - DNA, 22 bp, Homo sapiens
gctgcagtcacgtgtaaacagg

SEQ ID NO: 2259986 - DNA, 17 bp, Homo sapiens
gctgcagttttgctatc

SEQ ID NO: 2259987 - DNA, 21 bp, Homo sapiens
gctgcagttttgctatctggg

SEQ ID NO: 2259988 - DNA, 20 bp, Homo sapiens
gctgccaagagtgaagggaa

SEQ ID NO: 2259989 - DNA, 18 bp, Homo sapiens
gctgcccctctcaccaaa

SEQ ID NO: 2259990 - DNA, 17 bp, Homo sapiens
gctgccgctgccgctgc

SEQ ID NO: 2259991 - DNA, 18 bp, Homo sapiens
gctgcctattgatttaag

SEQ ID NO: 2259992 - DNA, 17 bp, Homo sapiens
gctgccttggctcagac

SEQ ID NO: 2259993 - DNA, 22 bp, Homo sapiens
gctgctatacacaagcaatgca

SEQ ID NO: 2259994 - DNA, 17 bp, Homo sapiens
gctggcagagagcacag

SEQ ID NO: 2259995 - DNA, 13 bp, Homo sapiens
gctggccagcacc

SEQ ID NO: 2259996 - DNA, 23 bp, Homo sapiens
gctggccagcaccctctcctggg

SEQ ID NO: 2259997 - DNA, 16 bp, Homo sapiens
gctggccccagccctg

SEQ ID NO: 2259998 - DNA, 17 bp, Homo sapiens
gctggccccagccctgc

SEQ ID NO: 2259999 - DNA, 22 bp, Homo sapiens
gctggccccagccctgctgggg

SEQ ID NO: 2260000 - DNA, 21 bp, Homo sapiens
gctggctctataaggcagcct

SEQ ID NO: 2260001 - DNA, 17 bp, Homo sapiens
gctgggaaccagggagg

SEQ ID NO: 2260002 - DNA, 16 bp, Homo sapiens
gctgggagcaggactg

SEQ ID NO: 2260003 - DNA, 18 bp, Homo sapiens
gctgggagtagttgtctt

SEQ ID NO: 2260004 - DNA, 12 bp, Homo sapiens
gctgggcccctg

SEQ ID NO: 2260005 - DNA, 17 bp, Homo sapiens
gctgggcccctgggatg

SEQ ID NO: 2260006 - DNA, 21 bp, Homo sapiens
gctggggatccccgcctggcc

SEQ ID NO: 2260007 - DNA, 22 bp, Homo sapiens
gctggggatccccgcctggcca

SEQ ID NO: 2260008 - DNA, 16 bp, Homo sapiens
gctggtagcagcaggc

SEQ ID NO: 2260009 - DNA, 18 bp, Homo sapiens
gctggtagcagcaggctc

SEQ ID NO: 2260010 - DNA, 14 bp, Homo sapiens
gctggtggcagagt

SEQ ID NO: 2260011 - DNA, 16 bp, Homo sapiens
gctgtaaaatgcatga

SEQ ID NO: 2260012 - DNA, 16 bp, Homo sapiens
gctgtccctccccctt

SEQ ID NO: 2260013 - DNA, 15 bp, Homo sapiens
gctgtcctggagggg

SEQ ID NO: 2260014 - DNA, 16 bp, Homo sapiens
gctgtcctggaggggc

SEQ ID NO: 2260015 - DNA, 14 bp, Homo sapiens
gctgtcgccccagg

SEQ ID NO: 2260016 - DNA, 12 bp, Homo sapiens
gctgtctgtcac

SEQ ID NO: 2260017 - DNA, 21 bp, Homo sapiens
gctgtgcccccctcctccccg

SEQ ID NO: 2260018 - DNA, 16 bp, Homo sapiens
gctgtgggcagcaccc

SEQ ID NO: 2260019 - DNA, 22 bp, Homo sapiens
gctgttcccatgtagccccctg

SEQ ID NO: 2260020 - DNA, 15 bp, Homo sapiens
gcttaacaatgcaac

SEQ ID NO: 2260021 - DNA, 22 bp, Homo sapiens
gcttaacaatgcaacttttaat

SEQ ID NO: 2260022 - DNA, 15 bp, Homo sapiens
gcttaacagttttag

SEQ ID NO: 2260023 - DNA, 20 bp, Homo sapiens
gcttagctcaattagtgtgg

SEQ ID NO: 2260024 - DNA, 16 bp, Homo sapiens
gcttattgtttctctg

SEQ ID NO: 2260025 - DNA, 20 bp, Homo sapiens
gcttcagggaggtagtttca

SEQ ID NO: 2260026 - DNA, 20 bp, Homo sapiens
gcttctctgctagatttcta

SEQ ID NO: 2260027 - DNA, 18 bp, Homo sapiens
gcttcttatgtagagttt

SEQ ID NO: 2260028 - DNA, 20 bp, Homo sapiens
gcttgaactaggctgagcaa

SEQ ID NO: 2260029 - DNA, 19 bp, Homo sapiens
gcttgacaaatattttcat

SEQ ID NO: 2260030 - DNA, 19 bp, Homo sapiens
gctttcagagccagcctgg

SEQ ID NO: 2260031 - DNA, 20 bp, Homo sapiens
gctttcagagccagcctggc

SEQ ID NO: 2260032 - DNA, 14 bp, Homo sapiens
gctttctccttcac

SEQ ID NO: 2260033 - DNA, 15 bp, Homo sapiens
gctttgatccctgac

SEQ ID NO: 2260034 - DNA, 12 bp, Homo sapiens
gctttggaaaca

SEQ ID NO: 2260035 - DNA, 19 bp, Homo sapiens
gctttgtcgtatttggcac

SEQ ID NO: 2260036 - DNA, 19 bp, Homo sapiens
gcttttattaatgcacttt

SEQ ID NO: 2260037 - DNA, 22 bp, Homo sapiens
gcttttattaatgcactttcta

SEQ ID NO: 2260038 - DNA, 12 bp, Homo sapiens
gctttttataaa

SEQ ID NO: 2260039 - DNA, 14 bp, Homo sapiens
ggaaaaggcccctg

SEQ ID NO: 2260040 - DNA, 15 bp, Homo sapiens
ggaaaaggcccctgc

SEQ ID NO: 2260041 - DNA, 14 bp, Homo sapiens
ggaaaagtgcaatg

SEQ ID NO: 2260042 - DNA, 19 bp, Homo sapiens
ggaaaataggctttttaat

SEQ ID NO: 2260043 - DNA, 18 bp, Homo sapiens
ggaaaattctaacccagg

SEQ ID NO: 2260044 - DNA, 22 bp, Homo sapiens
ggaaacaccgagtctctgtata

SEQ ID NO: 2260045 - DNA, 19 bp, Homo sapiens
ggaaaggattttaccaaag

SEQ ID NO: 2260046 - DNA, 17 bp, Homo sapiens
ggaaagttttgttctgt

SEQ ID NO: 2260047 - DNA, 18 bp, Homo sapiens
ggaaattgagtctgaagc

SEQ ID NO: 2260048 - DNA, 15 bp, Homo sapiens
ggaacagtaagaaca

SEQ ID NO: 2260049 - DNA, 19 bp, Homo sapiens
ggaacctagctacactgag

SEQ ID NO: 2260050 - DNA, 15 bp, Homo sapiens
ggaaccttccctcca

SEQ ID NO: 2260051 - DNA, 16 bp, Homo sapiens
ggaaccttccctccaa

SEQ ID NO: 2260052 - DNA, 16 bp, Homo sapiens
ggaagaaaactatcct

SEQ ID NO: 2260053 - DNA, 18 bp, Homo sapiens
ggaagcccctgggcccag

SEQ ID NO: 2260054 - DNA, 19 bp, Homo sapiens
ggaagcccctgggcccagt

SEQ ID NO: 2260055 - DNA, 20 bp, Homo sapiens
ggaaggaacaaagacaggca

SEQ ID NO: 2260056 - DNA, 23 bp, Homo sapiens
ggaaggggctgaggacgagaccc

SEQ ID NO: 2260057 - DNA, 21 bp, Homo sapiens
ggaagtaagcaaacaaatatt

SEQ ID NO: 2260058 - DNA, 16 bp, Homo sapiens
ggaatgggagaggggt

SEQ ID NO: 2260059 - DNA, 15 bp, Homo sapiens
ggaatttgggcagat

SEQ ID NO: 2260060 - DNA, 14 bp, Homo sapiens
ggacacagttcctg

SEQ ID NO: 2260061 - DNA, 17 bp, Homo sapiens
ggacacagttcctggga

SEQ ID NO: 2260062 - DNA, 20 bp, Homo sapiens
ggacagaatgtgtctcagga

SEQ ID NO: 2260063 - DNA, 16 bp, Homo sapiens
ggaccaagggcagagg

SEQ ID NO: 2260064 - DNA, 16 bp, Homo sapiens
ggaccaattctggaca

SEQ ID NO: 2260065 - DNA, 21 bp, Homo sapiens
ggaccaattctggacagacag

SEQ ID NO: 2260066 - DNA, 24 bp, Homo sapiens
ggaccaattctggacagacagatg

SEQ ID NO: 2260067 - DNA, 13 bp, Homo sapiens
ggaccctgtccaa

SEQ ID NO: 2260068 - DNA, 16 bp, Homo sapiens
ggacccttataaaatc

SEQ ID NO: 2260069 - DNA, 18 bp, Homo sapiens
ggaccgcccttttcccct

SEQ ID NO: 2260070 - DNA, 19 bp, Homo sapiens
ggacctattatcagaaggt

SEQ ID NO: 2260071 - DNA, 21 bp, Homo sapiens
ggaccttaggccttcctctct

SEQ ID NO: 2260072 - DNA, 17 bp, Homo sapiens
ggacgagacccccatcc

SEQ ID NO: 2260073 - DNA, 21 bp, Homo sapiens
ggacgagacccccatccagcc

SEQ ID NO: 2260074 - DNA, 24 bp, Homo sapiens
ggacgagacccccatccagcctcc

SEQ ID NO: 2260075 - DNA, 20 bp, Homo sapiens
ggacgccactcatttcatct

SEQ ID NO: 2260076 - DNA, 22 bp, Homo sapiens
ggacgtcatcggaggctgggcc

SEQ ID NO: 2260077 - DNA, 22 bp, Homo sapiens
ggactatattaatcaccttctt

SEQ ID NO: 2260078 - DNA, 13 bp, Homo sapiens
ggactctaaagtc

SEQ ID NO: 2260079 - DNA, 18 bp, Homo sapiens
ggactgctaaataaaatt

SEQ ID NO: 2260080 - DNA, 16 bp, Homo sapiens
ggactgtgctggtgca

SEQ ID NO: 2260081 - DNA, 22 bp, Homo sapiens
ggagaatttaggtttttattag

SEQ ID NO: 2260082 - DNA, 14 bp, Homo sapiens
ggagagagccaaga

SEQ ID NO: 2260083 - DNA, 21 bp, Homo sapiens
ggagaggcggcctcgtgccat

SEQ ID NO: 2260084 - DNA, 14 bp, Homo sapiens
ggagattataataa

SEQ ID NO: 2260085 - DNA, 15 bp, Homo sapiens
ggagcagaccacccc

SEQ ID NO: 2260086 - DNA, 21 bp, Homo sapiens
ggagccagctccctctattta

SEQ ID NO: 2260087 - DNA, 16 bp, Homo sapiens
ggagcccagccctccc

SEQ ID NO: 2260088 - DNA, 18 bp, Homo sapiens
ggagccccagctaccctt

SEQ ID NO: 2260089 - DNA, 22 bp, Homo sapiens
gtgaaggattatggaaaaataa

SEQ ID NO: 2260090 - DNA, 18 bp, Homo sapiens
gtgaagggaagagacagc

SEQ ID NO: 2260091 - DNA, 13 bp, Homo sapiens
gtgaatattttca

SEQ ID NO: 2260092 - DNA, 13 bp, Homo sapiens
gtgaatgtctcag

SEQ ID NO: 2260093 - DNA, 15 bp, Homo sapiens
gtgaatttttattgt

SEQ ID NO: 2260094 - DNA, 16 bp, Homo sapiens
gtgaatttttattgtt

SEQ ID NO: 2260095 - DNA, 17 bp, Homo sapiens
gtgacaggaaagccctc

SEQ ID NO: 2260096 - DNA, 22 bp, Homo sapiens
gtgacctccgtcctctccccag

SEQ ID NO: 2260097 - DNA, 21 bp, Homo sapiens
gtgactgtcccaccgggagcc

SEQ ID NO: 2260098 - DNA, 17 bp, Homo sapiens
gtgagaaggtttattgt

SEQ ID NO: 2260099 - DNA, 12 bp, Homo sapiens
gtgagacagact

SEQ ID NO: 2260100 - DNA, 11 bp, Homo sapiens
gtgagagagga

SEQ ID NO: 2260101 - DNA, 14 bp, Homo sapiens
gtgagttttgttca

SEQ ID NO: 2260102 - DNA, 13 bp, Homo sapiens
gtgatagcacttt

SEQ ID NO: 2260103 - DNA, 18 bp, Homo sapiens
gtgatcccgttttcccca

SEQ ID NO: 2260104 - DNA, 15 bp, Homo sapiens
gtgcatgaaagagaa

SEQ ID NO: 2260105 - DNA, 22 bp, Homo sapiens
gtgcattgtatagatataatga

SEQ ID NO: 2260106 - DNA, 19 bp, Homo sapiens
gtgcatttgagagaagcca

SEQ ID NO: 2260107 - DNA, 22 bp, Homo sapiens
gtgcatttgagagaagccacgc

SEQ ID NO: 2260108 - DNA, 16 bp, Homo sapiens
gtgcccccctcctccc

SEQ ID NO: 2260109 - DNA, 18 bp, Homo sapiens
gtgcccccctcctccccg

SEQ ID NO: 2260110 - DNA, 19 bp, Homo sapiens
gtgccttgctcatttgaaa

SEQ ID NO: 2260111 - DNA, 16 bp, Homo sapiens
gtgctatttgtcatct

SEQ ID NO: 2260112 - DNA, 12 bp, Homo sapiens
gtgctgtgggca

SEQ ID NO: 2260113 - DNA, 13 bp, Homo sapiens
gtgctgtgggcag

SEQ ID NO: 2260114 - DNA, 17 bp, Homo sapiens
gtgctgtgggcagcacc

SEQ ID NO: 2260115 - DNA, 18 bp, Homo sapiens
gtgctgtgggcagcaccc

SEQ ID NO: 2260116 - DNA, 12 bp, Homo sapiens
gtggaagcaacc

SEQ ID NO: 2260117 - DNA, 18 bp, Homo sapiens
gtggaccttaggccttcc

SEQ ID NO: 2260118 - DNA, 13 bp, Homo sapiens
gtggaggcacttt

SEQ ID NO: 2260119 - DNA, 22 bp, Homo sapiens
gtggaggttctgtattttaaga

SEQ ID NO: 2260120 - DNA, 13 bp, Homo sapiens
gtggcaagctgca

SEQ ID NO: 2260121 - DNA, 16 bp, Homo sapiens
gtggcaggagggcagt

SEQ ID NO: 2260122 - DNA, 20 bp, Homo sapiens
gtggcaggcacacagcagcc

SEQ ID NO: 2260123 - DNA, 23 bp, Homo sapiens
gtggcaggcacacagcagccccc

SEQ ID NO: 2260124 - DNA, 16 bp, Homo sapiens
gtggccatccctgggc

SEQ ID NO: 2260125 - DNA, 13 bp, Homo sapiens
gtggctccttccc

SEQ ID NO: 2260126 - DNA, 21 bp, Homo sapiens
gtggctctgaggtgcctgtcc

SEQ ID NO: 2260127 - DNA, 17 bp, Homo sapiens
gtgggacagaggagcaa

SEQ ID NO: 2260128 - DNA, 15 bp, Homo sapiens
gtgggcagcaccctc

SEQ ID NO: 2260129 - DNA, 16 bp, Homo sapiens
gtggtggcacaggccc

SEQ ID NO: 2260130 - DNA, 18 bp, Homo sapiens
gtgtaaaatattttgaat

SEQ ID NO: 2260131 - DNA, 16 bp, Homo sapiens
gtgtaactcccagtga

SEQ ID NO: 2260132 - DNA, 14 bp, Homo sapiens
gtgtataatataaa

SEQ ID NO: 2260133 - DNA, 16 bp, Homo sapiens
gtgtatcagtttccat

SEQ ID NO: 2260134 - DNA, 20 bp, Homo sapiens
gtgtatcagtttccatgaaa

SEQ ID NO: 2260135 - DNA, 14 bp, Homo sapiens
gtgtattttcagtc

SEQ ID NO: 2260136 - DNA, 23 bp, Homo sapiens
gtgtatttttcaataaagcattt

SEQ ID NO: 2260137 - DNA, 20 bp, Homo sapiens
gtgtcatcctcacagtgaac

SEQ ID NO: 2260138 - DNA, 13 bp, Homo sapiens
gtgtcccctcact

SEQ ID NO: 2260139 - DNA, 20 bp, Homo sapiens
gtgtcctcctggggttcttt

SEQ ID NO: 2260140 - DNA, 14 bp, Homo sapiens
gtgtctcagcctct

SEQ ID NO: 2260141 - DNA, 13 bp, Homo sapiens
gtgtctcaggaaa

SEQ ID NO: 2260142 - DNA, 19 bp, Homo sapiens
gtgtcttaattattatttg

SEQ ID NO: 2260143 - DNA, 16 bp, Homo sapiens
gtgtctttctctctct

SEQ ID NO: 2260144 - DNA, 22 bp, Homo sapiens
gtgtgacaattctgtttttaat

SEQ ID NO: 2260145 - DNA, 16 bp, Homo sapiens
gtgtgctgacttttta

SEQ ID NO: 2260146 - DNA, 14 bp, Homo sapiens
gtgtggctccttcc

SEQ ID NO: 2260147 - DNA, 19 bp, Homo sapiens
gtgtggtgcagtgtgaaaa

SEQ ID NO: 2260148 - DNA, 12 bp, Homo sapiens
gtgtgtaaacaa

SEQ ID NO: 2260149 - DNA, 16 bp, Homo sapiens
gtgtgtaacactgtgt

SEQ ID NO: 2260150 - DNA, 21 bp, Homo sapiens
gtgtgtaacactgtgtacacc

SEQ ID NO: 2260151 - DNA, 14 bp, Homo sapiens
gtgtgtcttaatta

SEQ ID NO: 2260152 - DNA, 21 bp, Homo sapiens
gtgtgtcttaattattatttg

SEQ ID NO: 2260153 - DNA, 17 bp, Homo sapiens
gtgtgtgacaattctgt

SEQ ID NO: 2260154 - DNA, 12 bp, Homo sapiens
gtgttacctgta

SEQ ID NO: 2260155 - DNA, 19 bp, Homo sapiens
gtgttacttcaagtaatac

SEQ ID NO: 2260156 - DNA, 11 bp, Homo sapiens
gtgttctcctt

SEQ ID NO: 2260157 - DNA, 16 bp, Homo sapiens
gtgttctccttttcct

SEQ ID NO: 2260158 - DNA, 18 bp, Homo sapiens
gtgttgactttataaatt

SEQ ID NO: 2260159 - DNA, 19 bp, Homo sapiens
gtgttgagccttttccctc

SEQ ID NO: 2260160 - DNA, 13 bp, Homo sapiens
gttaactcttcaa

SEQ ID NO: 2260161 - DNA, 12 bp, Homo sapiens
gttaaggacttc

SEQ ID NO: 2260162 - DNA, 14 bp, Homo sapiens
gttaatacaaggta

SEQ ID NO: 2260163 - DNA, 22 bp, Homo sapiens
gttaatgctgaaacatcattac

SEQ ID NO: 2260164 - DNA, 14 bp, Homo sapiens
gttaattcatttgg

SEQ ID NO: 2260165 - DNA, 18 bp, Homo sapiens
gttacagcctgttagtaa

SEQ ID NO: 2260166 - DNA, 13 bp, Homo sapiens
gttacccaacaga

SEQ ID NO: 2260167 - DNA, 23 bp, Homo sapiens
gttaccttttacagaataaaaga

SEQ ID NO: 2260168 - DNA, 11 bp, Homo sapiens
gttactctctt

SEQ ID NO: 2260169 - DNA, 15 bp, Homo sapiens
gttactgtgtaaact

SEQ ID NO: 2260170 - DNA, 18 bp, Homo sapiens
gttactgtgtaaactcat

SEQ ID NO: 2260171 - DNA, 14 bp, Homo sapiens
gttacttcaagtaa

SEQ ID NO: 2260172 - DNA, 16 bp, Homo sapiens
gttagcagagtctgtc

SEQ ID NO: 2260173 - DNA, 13 bp, Homo sapiens
gttaggaggtcct

SEQ ID NO: 2260174 - DNA, 13 bp, Homo sapiens
gttatatattgta

SEQ ID NO: 2260175 - DNA, 14 bp, Homo sapiens
gttatatattgtat

SEQ ID NO: 2260176 - DNA, 17 bp, Homo sapiens
gttatatattgtattaa

SEQ ID NO: 2260177 - DNA, 15 bp, Homo sapiens
gttatctaaaagaaa

SEQ ID NO: 2260178 - DNA, 16 bp, Homo sapiens
gttatctaaaagaaat

SEQ ID NO: 2260179 - DNA, 12 bp, Homo sapiens
gttatctctgtg

SEQ ID NO: 2260180 - DNA, 14 bp, Homo sapiens
gttatctctgtgtt

SEQ ID NO: 2260181 - DNA, 16 bp, Homo sapiens
gttatgttcatttttc

SEQ ID NO: 2260182 - DNA, 18 bp, Homo sapiens
gttattattttttaataa

SEQ ID NO: 2260183 - DNA, 13 bp, Homo sapiens
gttattgcagttt

SEQ ID NO: 2260184 - DNA, 14 bp, Homo sapiens
gttattgcagttta

SEQ ID NO: 2260185 - DNA, 16 bp, Homo sapiens
gttattgcagtttatc

SEQ ID NO: 2260186 - DNA, 22 bp, Homo sapiens
gttattggtgtaaggtactttc

SEQ ID NO: 2260187 - DNA, 22 bp, Homo sapiens
gttcaaatgcattttgggggtt

SEQ ID NO: 2260188 - DNA, 13 bp, Homo sapiens
gttcaattagaat

SEQ ID NO: 2260189 - DNA, 17 bp, Homo sapiens
gttcccatgtagccccc

SEQ ID NO: 2260190 - DNA, 19 bp, Homo sapiens
gttcccgtttctccaccta

SEQ ID NO: 2260191 - DNA, 22 bp, Homo sapiens
gttcctcccccagttcctccca

SEQ ID NO: 2260192 - DNA, 23 bp, Homo sapiens
gttcctttagaaagcagttaccc

SEQ ID NO: 2260193 - DNA, 16 bp, Homo sapiens
gttcgggtgtgcaatg

SEQ ID NO: 2260194 - DNA, 23 bp, Homo sapiens
gttctccgggtgtggcctcagcc

SEQ ID NO: 2260195 - DNA, 16 bp, Homo sapiens
gttctgagctgccagt

SEQ ID NO: 2260196 - DNA, 22 bp, Homo sapiens
gttctgcaaaaatatttataaa

SEQ ID NO: 2260197 - DNA, 22 bp, Homo sapiens
gttctgcatcacccgcccctgg

SEQ ID NO: 2260198 - DNA, 12 bp, Homo sapiens
gttctggccaga

SEQ ID NO: 2260199 - DNA, 16 bp, Homo sapiens
gttctggccagaatgc

SEQ ID NO: 2260200 - DNA, 16 bp, Homo sapiens
gttctgtattttaaga

SEQ ID NO: 2260201 - DNA, 14 bp, Homo sapiens
gttcttggtgactg

SEQ ID NO: 2260202 - DNA, 20 bp, Homo sapiens
gttctttcatttgctttgga

SEQ ID NO: 2260203 - DNA, 14 bp, Homo sapiens
gttcttttaccact

SEQ ID NO: 2260204 - DNA, 15 bp, Homo sapiens
gttgaaaacttgtaa

SEQ ID NO: 2260205 - DNA, 18 bp, Homo sapiens
gttgactttataaatttc

SEQ ID NO: 2260206 - DNA, 12 bp, Homo sapiens
gttgactttctc

SEQ ID NO: 2260207 - DNA, 22 bp, Homo sapiens
gttgatcatgtactttttagta

SEQ ID NO: 2260208 - DNA, 13 bp, Homo sapiens
gttggaaaaaatt

SEQ ID NO: 2260209 - DNA, 21 bp, Homo sapiens
gttgtacaatcaaaacacact

SEQ ID NO: 2260210 - DNA, 14 bp, Homo sapiens
gttgtaccaagtga

SEQ ID NO: 2260211 - DNA, 15 bp, Homo sapiens
gttgtagtgtccccc

SEQ ID NO: 2260212 - DNA, 12 bp, Homo sapiens
gttgtattcatt

SEQ ID NO: 2260213 - DNA, 18 bp, Homo sapiens
gttgtcaagaatagcatt

SEQ ID NO: 2260214 - DNA, 13 bp, Homo sapiens
gtttaaaagaaaa

SEQ ID NO: 2260215 - DNA, 20 bp, Homo sapiens
gtttaactgcagttgacttt

SEQ ID NO: 2260216 - DNA, 16 bp, Homo sapiens
gtttatcattcaagtg

SEQ ID NO: 2260217 - DNA, 20 bp, Homo sapiens
gtttatcattcaagtgtaaa

SEQ ID NO: 2260218 - DNA, 15 bp, Homo sapiens
gtttattaaattgca

SEQ ID NO: 2260219 - DNA, 21 bp, Homo sapiens
gtttcctaaatccaaccattt

SEQ ID NO: 2260220 - DNA, 12 bp, Homo sapiens
gtttcctgcagg

SEQ ID NO: 2260221 - DNA, 17 bp, Homo sapiens
gtttctattttttgaaa

SEQ ID NO: 2260222 - DNA, 15 bp, Homo sapiens
gtttctcattaaagt

SEQ ID NO: 2260223 - DNA, 20 bp, Homo sapiens
gtttgaaaagcaatattgta

SEQ ID NO: 2260224 - DNA, 23 bp, Homo sapiens
gtttgaaatagttcaaactgcag

SEQ ID NO: 2260225 - DNA, 22 bp, Homo sapiens
gtttggcatgtaaatgtaaact

SEQ ID NO: 2260226 - DNA, 13 bp, Homo sapiens
gtttggtgctttt

SEQ ID NO: 2260227 - DNA, 20 bp, Homo sapiens
gtttgttttagaaccagccg

SEQ ID NO: 2260228 - DNA, 12 bp, Homo sapiens
gttttaaattct

SEQ ID NO: 2260229 - DNA, 18 bp, Homo sapiens
gttttaacctcccctctc

SEQ ID NO: 2260230 - DNA, 20 bp, Homo sapiens
gttttacaatagttctgtgg

SEQ ID NO: 2260231 - DNA, 13 bp, Homo sapiens
gttttcaagtcaa

SEQ ID NO: 2260232 - DNA, 16 bp, Homo sapiens
gttttcagaagaaata

SEQ ID NO: 2260233 - DNA, 18 bp, Homo sapiens
gttttcaggacaacactt

SEQ ID NO: 2260234 - DNA, 12 bp, Homo sapiens
gttttcatttgc

SEQ ID NO: 2260235 - DNA, 18 bp, Homo sapiens
gttttgctttggaaacac

SEQ ID NO: 2260236 - DNA, 18 bp, Homo sapiens
gttttgttctgtatattt

SEQ ID NO: 2260237 - DNA, 14 bp, Homo sapiens
gtttttattagtac

SEQ ID NO: 2260238 - DNA, 16 bp, Homo sapiens
gtttttcattttaaaa

SEQ ID NO: 2260239 - DNA, 12 bp, Homo sapiens
gtttttgtgctg

SEQ ID NO: 2260240 - DNA, 17 bp, Homo sapiens
gtttttgtgctgtgggc

SEQ ID NO: 2260241 - DNA, 17 bp, Homo sapiens
gtttttttgttattaaa

SEQ ID NO: 2260242 - DNA, 13 bp, Homo sapiens
taaaaaatatttt

SEQ ID NO: 2260243 - DNA, 16 bp, Homo sapiens
taaaaaatattttctc

SEQ ID NO: 2260244 - DNA, 18 bp, Homo sapiens
taaaaaatattttctctg

SEQ ID NO: 2260245 - DNA, 12 bp, Homo sapiens
taaaaagataat

SEQ ID NO: 2260246 - DNA, 16 bp, Homo sapiens
taaaaagataatctca

SEQ ID NO: 2260247 - DNA, 23 bp, Homo sapiens
taaaaagataatctcagtgcttt

SEQ ID NO: 2260248 - DNA, 20 bp, Homo sapiens
taaaaaggagtatacaaaca

SEQ ID NO: 2260249 - DNA, 20 bp, Homo sapiens
taaaaatggtatcaaaatta

SEQ ID NO: 2260250 - DNA, 14 bp, Homo sapiens
taaaaatttttaaa

SEQ ID NO: 2260251 - DNA, 14 bp, Homo sapiens
taaaacaaaatttg

SEQ ID NO: 2260252 - DNA, 23 bp, Homo sapiens
taaaacaaagccatgccaataaa

SEQ ID NO: 2260253 - DNA, 19 bp, Homo sapiens
taaaacattaaaatataat

SEQ ID NO: 2260254 - DNA, 15 bp, Homo sapiens
taaaagaaaaaatga

SEQ ID NO: 2260255 - DNA, 19 bp, Homo sapiens
taaaagcaattatattgtc

SEQ ID NO: 2260256 - DNA, 15 bp, Homo sapiens
taaaagcattttgta

SEQ ID NO: 2260257 - DNA, 17 bp, Homo sapiens
taaaagcattttgtaat

SEQ ID NO: 2260258 - DNA, 18 bp, Homo sapiens
taaaagcattttgtaata

SEQ ID NO: 2260259 - DNA, 21 bp, Homo sapiens
taaaagccaaccttcaaagaa

SEQ ID NO: 2260260 - DNA, 23 bp, Homo sapiens
taaaagccaaccttcaaagaaac

SEQ ID NO: 2260261 - DNA, 14 bp, Homo sapiens
taaaagtaaaatgt

SEQ ID NO: 2260262 - DNA, 23 bp, Homo sapiens
taaaagtcgcattccatatcttt

SEQ ID NO: 2260263 - DNA, 18 bp, Homo sapiens
taaaagtttgaaaagcaa

SEQ ID NO: 2260264 - DNA, 12 bp, Homo sapiens
taaaataaatgg

SEQ ID NO: 2260265 - DNA, 13 bp, Homo sapiens
taaaataaatggt

SEQ ID NO: 2260266 - DNA, 18 bp, Homo sapiens
taaaataactaaaatgta

SEQ ID NO: 2260267 - DNA, 19 bp, Homo sapiens
taaaataactaaaatgtat

SEQ ID NO: 2260268 - DNA, 21 bp, Homo sapiens
taaaataactaaaatgtatct

SEQ ID NO: 2260269 - DNA, 19 bp, Homo sapiens
taaaatgaacctgctactt

SEQ ID NO: 2260270 - DNA, 15 bp, Homo sapiens
taaaatgcaatgtaa

SEQ ID NO: 2260271 - DNA, 14 bp, Homo sapiens
taaaatggaagcaa

SEQ ID NO: 2260272 - DNA, 19 bp, Homo sapiens
taaaattatcctctttgta

SEQ ID NO: 2260273 - DNA, 20 bp, Homo sapiens
taaaattatcctctttgtaa

SEQ ID NO: 2260274 - DNA, 16 bp, Homo sapiens
taaacaaaatgaagct

SEQ ID NO: 2260275 - DNA, 11 bp, Homo sapiens
taaacactaca

SEQ ID NO: 2260276 - DNA, 13 bp, Homo sapiens
taaaccctcagag

SEQ ID NO: 2260277 - DNA, 14 bp, Homo sapiens
taaactataaaaca

SEQ ID NO: 2260278 - DNA, 20 bp, Homo sapiens
taaactcttcacaaaatctg

SEQ ID NO: 2260279 - DNA, 18 bp, Homo sapiens
taaacttcatatgtaatc

SEQ ID NO: 2260280 - DNA, 12 bp, Homo sapiens
taaacttgaaaa

SEQ ID NO: 2260281 - DNA, 19 bp, Homo sapiens
taaagaatatgacttttta

SEQ ID NO: 2260282 - DNA, 14 bp, Homo sapiens
taaagcatgaaatg

SEQ ID NO: 2260283 - DNA, 16 bp, Homo sapiens
taaagcatgaaatgtg

SEQ ID NO: 2260284 - DNA, 12 bp, Homo sapiens
taaagcatttat

SEQ ID NO: 2260285 - DNA, 13 bp, Homo sapiens
taaagcatttata

SEQ ID NO: 2260286 - DNA, 13 bp, Homo sapiens
taaagtattcttt

SEQ ID NO: 2260287 - DNA, 23 bp, Homo sapiens
taaagtattctttttctttttta

SEQ ID NO: 2260288 - DNA, 17 bp, Homo sapiens
taaagttggtattaata

SEQ ID NO: 2260289 - DNA, 14 bp, Homo sapiens
taaataaaagcaca

SEQ ID NO: 2260290 - DNA, 22 bp, Homo sapiens
taaataaaagcacaagtacttt

SEQ ID NO: 2260291 - DNA, 14 bp, Homo sapiens
taaataaaatttgt

SEQ ID NO: 2260292 - DNA, 15 bp, Homo sapiens
taaataacacttgtc

SEQ ID NO: 2260293 - DNA, 15 bp, Homo sapiens
taaataataaataaa

SEQ ID NO: 2260294 - DNA, 13 bp, Homo sapiens
taaataattggaa

SEQ ID NO: 2260295 - DNA, 20 bp, Homo sapiens
taaatactggtgcacttctt

SEQ ID NO: 2260296 - DNA, 12 bp, Homo sapiens
taaataggattt

SEQ ID NO: 2260297 - DNA, 16 bp, Homo sapiens
taaatattttctattt

SEQ ID NO: 2260298 - DNA, 17 bp, Homo sapiens
taaatgattcttagtga

SEQ ID NO: 2260299 - DNA, 20 bp, Homo sapiens
taaatggtttggtgcttttt

SEQ ID NO: 2260300 - DNA, 22 bp, Homo sapiens
taaatggtttggtgctttttat

SEQ ID NO: 2260301 - DNA, 12 bp, Homo sapiens
taaatgtaaact

SEQ ID NO: 2260302 - DNA, 20 bp, Homo sapiens
taaatgtttggcatgtaaat

SEQ ID NO: 2260303 - DNA, 12 bp, Homo sapiens
taaattaatatc

SEQ ID NO: 2260304 - DNA, 13 bp, Homo sapiens
taaattacaattt

SEQ ID NO: 2260305 - DNA, 23 bp, Homo sapiens
taaattacaattttatctgtttc

SEQ ID NO: 2260306 - DNA, 12 bp, Homo sapiens
taaattagaaaa

SEQ ID NO: 2260307 - DNA, 16 bp, Homo sapiens
taaattagaaaatatt

SEQ ID NO: 2260308 - DNA, 20 bp, Homo sapiens
taaattagaaaatattctct

SEQ ID NO: 2260309 - DNA, 17 bp, Homo sapiens
taaattctgagcctgat

SEQ ID NO: 2260310 - DNA, 19 bp, Homo sapiens
taaattgaatcagtataaa

SEQ ID NO: 2260311 - DNA, 17 bp, Homo sapiens
gtaagattgatatctat

SEQ ID NO: 2260312 - DNA, 18 bp, Homo sapiens
gtaagttaatgtatataa

SEQ ID NO: 2260313 - DNA, 22 bp, Homo sapiens
gtaatacaaactaatttagtaa

SEQ ID NO: 2260314 - DNA, 15 bp, Homo sapiens
gtaatcatttgttta

SEQ ID NO: 2260315 - DNA, 18 bp, Homo sapiens
gtaatggactatgcacac

SEQ ID NO: 2260316 - DNA, 21 bp, Homo sapiens
gtaatttctttttttcctttt

SEQ ID NO: 2260317 - DNA, 18 bp, Homo sapiens
gtacaatcaaaacacact

SEQ ID NO: 2260318 - DNA, 13 bp, Homo sapiens
gtacagattttat

SEQ ID NO: 2260319 - DNA, 16 bp, Homo sapiens
gtacagtgtgtgtggg

SEQ ID NO: 2260320 - DNA, 22 bp, Homo sapiens
gtacataccctggccgccccct

SEQ ID NO: 2260321 - DNA, 22 bp, Homo sapiens
gtaccatttaatggggaggaca

SEQ ID NO: 2260322 - DNA, 23 bp, Homo sapiens
gtaccatttaatggggaggacaa

SEQ ID NO: 2260323 - DNA, 18 bp, Homo sapiens
gtaccctctcagctccag

SEQ ID NO: 2260324 - DNA, 13 bp, Homo sapiens
gtacctcaaatga

SEQ ID NO: 2260325 - DNA, 21 bp, Homo sapiens
gtaccttttgaggagccccag

SEQ ID NO: 2260326 - DNA, 23 bp, Homo sapiens
gtaccttttgaggagccccagct

SEQ ID NO: 2260327 - DNA, 18 bp, Homo sapiens
gtactgaagccaaatgaa

SEQ ID NO: 2260328 - DNA, 14 bp, Homo sapiens
gtactgttctgtgt

SEQ ID NO: 2260329 - DNA, 15 bp, Homo sapiens
gtacttggcctttgg

SEQ ID NO: 2260330 - DNA, 22 bp, Homo sapiens
gtactttcatattttaaacaga

SEQ ID NO: 2260331 - DNA, 17 bp, Homo sapiens
gtactttctattttaat

SEQ ID NO: 2260332 - DNA, 16 bp, Homo sapiens
gtacttttaaaaacat

SEQ ID NO: 2260333 - DNA, 20 bp, Homo sapiens
gtacttttcattctctttta

SEQ ID NO: 2260334 - DNA, 20 bp, Homo sapiens
gtagaaaaaaaaattcacat

SEQ ID NO: 2260335 - DNA, 14 bp, Homo sapiens
gtagacacttactt

SEQ ID NO: 2260336 - DNA, 15 bp, Homo sapiens
gtagcagcaggctca

SEQ ID NO: 2260337 - DNA, 16 bp, Homo sapiens
gtagcagcaggctcag

SEQ ID NO: 2260338 - DNA, 17 bp, Homo sapiens
gtagcagcaggctcagg

SEQ ID NO: 2260339 - DNA, 14 bp, Homo sapiens
gtaggagctgcctt

SEQ ID NO: 2260340 - DNA, 22 bp, Homo sapiens
gtaggtcacaacaactcatttt

SEQ ID NO: 2260341 - DNA, 19 bp, Homo sapiens
gtagtctcactgcttgaac

SEQ ID NO: 2260342 - DNA, 16 bp, Homo sapiens
gtagttgtctttcctg

SEQ ID NO: 2260343 - DNA, 12 bp, Homo sapiens
gtataaaataca

SEQ ID NO: 2260344 - DNA, 14 bp, Homo sapiens
gtataaaatacata

SEQ ID NO: 2260345 - DNA, 20 bp, Homo sapiens
gtataaaatacatagtgaaa

SEQ ID NO: 2260346 - DNA, 22 bp, Homo sapiens
gtataaaatacatagtgaaaat

SEQ ID NO: 2260347 - DNA, 20 bp, Homo sapiens
gtataatcttgtagacactt

SEQ ID NO: 2260348 - DNA, 18 bp, Homo sapiens
gtataattaattgtcatt

SEQ ID NO: 2260349 - DNA, 17 bp, Homo sapiens
gtatacctcatttttca

SEQ ID NO: 2260350 - DNA, 18 bp, Homo sapiens
gtatattacaatgatcac

SEQ ID NO: 2260351 - DNA, 21 bp, Homo sapiens
gtatatttgtgatagcacttt

SEQ ID NO: 2260352 - DNA, 22 bp, Homo sapiens
gtatcaagacgtttaactgcag

SEQ ID NO: 2260353 - DNA, 13 bp, Homo sapiens
gtatgctggccag

SEQ ID NO: 2260354 - DNA, 18 bp, Homo sapiens
gtatgctggccagcaccc

SEQ ID NO: 2260355 - DNA, 23 bp, Homo sapiens
gtatgctggccagcaccctctcc

SEQ ID NO: 2260356 - DNA, 12 bp, Homo sapiens
gtattaataaaa

SEQ ID NO: 2260357 - DNA, 13 bp, Homo sapiens
gtattaataaaaa

SEQ ID NO: 2260358 - DNA, 11 bp, Homo sapiens
gtattcttttt

SEQ ID NO: 2260359 - DNA, 20 bp, Homo sapiens
gtattttaagtgatgtcatt

SEQ ID NO: 2260360 - DNA, 15 bp, Homo sapiens
gtattttcttctctg

SEQ ID NO: 2260361 - DNA, 14 bp, Homo sapiens
gtcaaaactttaaa

SEQ ID NO: 2260362 - DNA, 11 bp, Homo sapiens
gtcaaacaaaa

SEQ ID NO: 2260363 - DNA, 18 bp, Homo sapiens
gtcaagttgtcaggttat

SEQ ID NO: 2260364 - DNA, 16 bp, Homo sapiens
gtcacagtaaaaataa

SEQ ID NO: 2260365 - DNA, 20 bp, Homo sapiens
gtcacagtaaaaataaaata

SEQ ID NO: 2260366 - DNA, 22 bp, Homo sapiens
gtcacagttcttggtgactgtc

SEQ ID NO: 2260367 - DNA, 22 bp, Homo sapiens
gtcaccaaaagacactgcagaa

SEQ ID NO: 2260368 - DNA, 21 bp, Homo sapiens
gtcactcattgctgagcctct

SEQ ID NO: 2260369 - DNA, 22 bp, Homo sapiens
gtcactcattgctgagcctctg

SEQ ID NO: 2260370 - DNA, 24 bp, Homo sapiens
gtcactcattgctgagcctctgct

SEQ ID NO: 2260371 - DNA, 14 bp, Homo sapiens
gtcacttttccttt

SEQ ID NO: 2260372 - DNA, 18 bp, Homo sapiens
gtcacttttccttttctt

SEQ ID NO: 2260373 - DNA, 18 bp, Homo sapiens
gtcagccagccgccctgg

SEQ ID NO: 2260374 - DNA, 20 bp, Homo sapiens
gtcagtagtttaaaagttct

SEQ ID NO: 2260375 - DNA, 15 bp, Homo sapiens
gtccacaggggccac

SEQ ID NO: 2260376 - DNA, 19 bp, Homo sapiens
gtccacaggggccaccacc

SEQ ID NO: 2260377 - DNA, 13 bp, Homo sapiens
gtccagccacccc

SEQ ID NO: 2260378 - DNA, 21 bp, Homo sapiens
gtccagccacccccaggcatc

SEQ ID NO: 2260379 - DNA, 14 bp, Homo sapiens
gtcccacccccacc

SEQ ID NO: 2260380 - DNA, 22 bp, Homo sapiens
gtcccacccccacccccagctc

SEQ ID NO: 2260381 - DNA, 21 bp, Homo sapiens
gtccccccccaacctttccct

SEQ ID NO: 2260382 - DNA, 12 bp, Homo sapiens
gtcccctcacct

SEQ ID NO: 2260383 - DNA, 13 bp, Homo sapiens
gtcccctcactct

SEQ ID NO: 2260384 - DNA, 15 bp, Homo sapiens
gtcccctcactctgt

SEQ ID NO: 2260385 - DNA, 17 bp, Homo sapiens
gtcccctcactctgtca

SEQ ID NO: 2260386 - DNA, 18 bp, Homo sapiens
gtcccctcactctgtcag

SEQ ID NO: 2260387 - DNA, 20 bp, Homo sapiens
gtcccctcactctgtcagcc

SEQ ID NO: 2260388 - DNA, 23 bp, Homo sapiens
gtcccctcactctgtcagccagc

SEQ ID NO: 2260389 - DNA, 16 bp, Homo sapiens
gtccctcccccttgtc

SEQ ID NO: 2260390 - DNA, 18 bp, Homo sapiens
gtcctcccctattttaag

SEQ ID NO: 2260391 - DNA, 20 bp, Homo sapiens
gtcctccctgatcccacccc

SEQ ID NO: 2260392 - DNA, 15 bp, Homo sapiens
gtcctctccccagcc

SEQ ID NO: 2260393 - DNA, 19 bp, Homo sapiens
gtcctctccccagcctggc

SEQ ID NO: 2260394 - DNA, 21 bp, Homo sapiens
gtcctggaagcgcgagggcct

SEQ ID NO: 2260395 - DNA, 23 bp, Homo sapiens
gtcgccccaggccctccctgact

SEQ ID NO: 2260396 - DNA, 20 bp, Homo sapiens
gtctagattaatactctatt

SEQ ID NO: 2260397 - DNA, 14 bp, Homo sapiens
gtctcactgcttga

SEQ ID NO: 2260398 - DNA, 13 bp, Homo sapiens
gtctcagcctctg

SEQ ID NO: 2260399 - DNA, 22 bp, Homo sapiens
gtctcagcctctgccagcgcca

SEQ ID NO: 2260400 - DNA, 15 bp, Homo sapiens
gtctcaggaaaacag

SEQ ID NO: 2260401 - DNA, 21 bp, Homo sapiens
gtctcagtttgtgtgtcttaa

SEQ ID NO: 2260402 - DNA, 22 bp, Homo sapiens
gtctccaaaaaaaaaaaaaata

SEQ ID NO: 2260403 - DNA, 23 bp, Homo sapiens
gtctccaaaaaaaaaaaaaatac

SEQ ID NO: 2260404 - DNA, 22 bp, Homo sapiens
gtctcctatatatttctattat

SEQ ID NO: 2260405 - DNA, 20 bp, Homo sapiens
gtctctgtataatctattta

SEQ ID NO: 2260406 - DNA, 20 bp, Homo sapiens
gtctcttggctttgtcactt

SEQ ID NO: 2260407 - DNA, 19 bp, Homo sapiens
gtctcttgtattaaactct

SEQ ID NO: 2260408 - DNA, 13 bp, Homo sapiens
gtctgctgtagaa

SEQ ID NO: 2260409 - DNA, 14 bp, Homo sapiens
gtctgctgtagaaa

SEQ ID NO: 2260410 - DNA, 17 bp, Homo sapiens
gtctgctgtctcatcac

SEQ ID NO: 2260411 - DNA, 18 bp, Homo sapiens
gtctggttgggcagccag

SEQ ID NO: 2260412 - DNA, 13 bp, Homo sapiens
gtctgtacctcaa

SEQ ID NO: 2260413 - DNA, 22 bp, Homo sapiens
gtcttaggaattgaattaataa

SEQ ID NO: 2260414 - DNA, 17 bp, Homo sapiens
gtcttgaaatgaaaggg

SEQ ID NO: 2260415 - DNA, 22 bp, Homo sapiens
gtctttcagtacttttttaaat

SEQ ID NO: 2260416 - DNA, 16 bp, Homo sapiens
gtctttctcaaagaaa

SEQ ID NO: 2260417 - DNA, 23 bp, Homo sapiens
gtctttctcaaagaaatattaag

SEQ ID NO: 2260418 - DNA, 13 bp, Homo sapiens
gtgaaaaactgct

SEQ ID NO: 2260419 - DNA, 19 bp, Homo sapiens
ggagcctccccctcagatg

SEQ ID NO: 2260420 - DNA, 13 bp, Homo sapiens
ggagccttcccaa

SEQ ID NO: 2260421 - DNA, 20 bp, Homo sapiens
ggagcctttggttctggcca

SEQ ID NO: 2260422 - DNA, 18 bp, Homo sapiens
ggagctgccttggctcag

SEQ ID NO: 2260423 - DNA, 21 bp, Homo sapiens
ggaggacctggcgtgctcaga

SEQ ID NO: 2260424 - DNA, 20 bp, Homo sapiens
ggaggaggggaaggggctga

SEQ ID NO: 2260425 - DNA, 17 bp, Homo sapiens
ggaggatacagaggaga

SEQ ID NO: 2260426 - DNA, 16 bp, Homo sapiens
ggaggctgggcccctg

SEQ ID NO: 2260427 - DNA, 23 bp, Homo sapiens
ggaggctgggcccctgggatggg

SEQ ID NO: 2260428 - DNA, 22 bp, Homo sapiens
ggagggatggagaggcggcctc

SEQ ID NO: 2260429 - DNA, 15 bp, Homo sapiens
ggaggggaaggggct

SEQ ID NO: 2260430 - DNA, 18 bp, Homo sapiens
ggagggggtaggtgatgg

SEQ ID NO: 2260431 - DNA, 15 bp, Homo sapiens
ggatacagaggagat

SEQ ID NO: 2260432 - DNA, 15 bp, Homo sapiens
ggatactggcacaga

SEQ ID NO: 2260433 - DNA, 18 bp, Homo sapiens
ggatactggcacagaggt

SEQ ID NO: 2260434 - DNA, 19 bp, Homo sapiens
ggatagctaactgtaaatc

SEQ ID NO: 2260435 - DNA, 13 bp, Homo sapiens
ggatccccctctt

SEQ ID NO: 2260436 - DNA, 16 bp, Homo sapiens
ggatccccgcctggcc

SEQ ID NO: 2260437 - DNA, 14 bp, Homo sapiens
ggatcctccacaga

SEQ ID NO: 2260438 - DNA, 15 bp, Homo sapiens
ggatcttcccacagg

SEQ ID NO: 2260439 - DNA, 19 bp, Homo sapiens
ggatcttcccacaggaggg

SEQ ID NO: 2260440 - DNA, 17 bp, Homo sapiens
ggatggagaggcggcct

SEQ ID NO: 2260441 - DNA, 17 bp, Homo sapiens
ggatgggccagggttta

SEQ ID NO: 2260442 - DNA, 17 bp, Homo sapiens
ggatggtgcatgggctc

SEQ ID NO: 2260443 - DNA, 16 bp, Homo sapiens
ggattaatatgaaaac

SEQ ID NO: 2260444 - DNA, 22 bp, Homo sapiens
ggattccactcgtgtgtttcta

SEQ ID NO: 2260445 - DNA, 14 bp, Homo sapiens
ggattttaccaaag

SEQ ID NO: 2260446 - DNA, 18 bp, Homo sapiens
ggcaaagcttttagaaat

SEQ ID NO: 2260447 - DNA, 20 bp, Homo sapiens
ggcaatagaccgagactccg

SEQ ID NO: 2260448 - DNA, 13 bp, Homo sapiens
ggcacacagcagc

SEQ ID NO: 2260449 - DNA, 14 bp, Homo sapiens
ggcacaggccccct

SEQ ID NO: 2260450 - DNA, 15 bp, Homo sapiens
ggcacaggccccctt

SEQ ID NO: 2260451 - DNA, 15 bp, Homo sapiens
ggcacccacatcccc

SEQ ID NO: 2260452 - DNA, 16 bp, Homo sapiens
ggcaccttttactgtg

SEQ ID NO: 2260453 - DNA, 21 bp, Homo sapiens
ggcacggcgggatcctccaca

SEQ ID NO: 2260454 - DNA, 15 bp, Homo sapiens
ggcacgggtggtccc

SEQ ID NO: 2260455 - DNA, 23 bp, Homo sapiens
ggcactaacgttgagcccctgga

SEQ ID NO: 2260456 - DNA, 16 bp, Homo sapiens
ggcactggcgaggaga

SEQ ID NO: 2260457 - DNA, 22 bp, Homo sapiens
ggcactttgaaggggcctcacc

SEQ ID NO: 2260458 - DNA, 16 bp, Homo sapiens
ggcagacaaccttgtc

SEQ ID NO: 2260459 - DNA, 13 bp, Homo sapiens
ggcagcaccctcc

SEQ ID NO: 2260460 - DNA, 15 bp, Homo sapiens
ggcagcaccctcccc

SEQ ID NO: 2260461 - DNA, 19 bp, Homo sapiens
ggcagcaccctcccccgca

SEQ ID NO: 2260462 - DNA, 11 bp, Homo sapiens
ggcagccagac

SEQ ID NO: 2260463 - DNA, 16 bp, Homo sapiens
ggcaggagggcagtgg

SEQ ID NO: 2260464 - DNA, 18 bp, Homo sapiens
ggcaggcacacagcagcc

SEQ ID NO: 2260465 - DNA, 19 bp, Homo sapiens
ggcaggcacacagcagccc

SEQ ID NO: 2260466 - DNA, 21 bp, Homo sapiens
ggcaggcccactccccagccc

SEQ ID NO: 2260467 - DNA, 14 bp, Homo sapiens
ggcaggctgggcca

SEQ ID NO: 2260468 - DNA, 18 bp, Homo sapiens
ggcagggggccctgcccc

SEQ ID NO: 2260469 - DNA, 23 bp, Homo sapiens
ggcagggggccctgccccacccc

SEQ ID NO: 2260470 - DNA, 21 bp, Homo sapiens
ggcatgtaaatgtaaactcag

SEQ ID NO: 2260471 - DNA, 17 bp, Homo sapiens
ggcatttgtttctttct

SEQ ID NO: 2260472 - DNA, 14 bp, Homo sapiens
ggccacatacctct

SEQ ID NO: 2260473 - DNA, 18 bp, Homo sapiens
ggccacatacctctctga

SEQ ID NO: 2260474 - DNA, 20 bp, Homo sapiens
ggccaccacctttggctggt

SEQ ID NO: 2260475 - DNA, 24 bp, Homo sapiens
ggccaccacctttggctggtagca

SEQ ID NO: 2260476 - DNA, 17 bp, Homo sapiens
ggccagacgctgccgct

SEQ ID NO: 2260477 - DNA, 12 bp, Homo sapiens
ggccagcaccct

SEQ ID NO: 2260478 - DNA, 19 bp, Homo sapiens
ggccagcaccctctcctgg

SEQ ID NO: 2260479 - DNA, 23 bp, Homo sapiens
ggccagcaccctctcctgggggt

SEQ ID NO: 2260480 - DNA, 21 bp, Homo sapiens
ggccagctcataaaatggaag

SEQ ID NO: 2260481 - DNA, 19 bp, Homo sapiens
ggccaggaccaagggcaga

SEQ ID NO: 2260482 - DNA, 13 bp, Homo sapiens
ggccaggagcagg

SEQ ID NO: 2260483 - DNA, 21 bp, Homo sapiens
ggccaggatccccctctttgc

SEQ ID NO: 2260484 - DNA, 16 bp, Homo sapiens
ggccatccctgggccc

SEQ ID NO: 2260485 - DNA, 17 bp, Homo sapiens
ggccatccctgggcccc

SEQ ID NO: 2260486 - DNA, 13 bp, Homo sapiens
ggccatgtccaaa

SEQ ID NO: 2260487 - DNA, 22 bp, Homo sapiens
ggccatgtccaaagaggctgcc

SEQ ID NO: 2260488 - DNA, 22 bp, Homo sapiens
ggcccagtacctagctggctct

SEQ ID NO: 2260489 - DNA, 14 bp, Homo sapiens
ggccccagccctgc

SEQ ID NO: 2260490 - DNA, 18 bp, Homo sapiens
ggccccagccctgctggg

SEQ ID NO: 2260491 - DNA, 18 bp, Homo sapiens
ggcccctccacgcctcct

SEQ ID NO: 2260492 - DNA, 12 bp, Homo sapiens
ggcccctgggat

SEQ ID NO: 2260493 - DNA, 13 bp, Homo sapiens
ggcccctgggatg

SEQ ID NO: 2260494 - DNA, 22 bp, Homo sapiens
ggccctggggatcttcccacag

SEQ ID NO: 2260495 - DNA, 14 bp, Homo sapiens
ggccgctggctggt

SEQ ID NO: 2260496 - DNA, 20 bp, Homo sapiens
ggccgggcaggtcctgccca

SEQ ID NO: 2260497 - DNA, 18 bp, Homo sapiens
ggccgtgtctctgaggac

SEQ ID NO: 2260498 - DNA, 13 bp, Homo sapiens
ggcctagactctg

SEQ ID NO: 2260499 - DNA, 20 bp, Homo sapiens
ggcctcaaaggcccgctcta

SEQ ID NO: 2260500 - DNA, 15 bp, Homo sapiens
ggcctccagaactca

SEQ ID NO: 2260501 - DNA, 20 bp, Homo sapiens
ggcctccagaactcactggg

SEQ ID NO: 2260502 - DNA, 20 bp, Homo sapiens
ggcctcgtgccatgatctgt

SEQ ID NO: 2260503 - DNA, 20 bp, Homo sapiens
ggcctggaatttgggcagat

SEQ ID NO: 2260504 - DNA, 21 bp, Homo sapiens
ggcgccaacgttcgatttcta

SEQ ID NO: 2260505 - DNA, 16 bp, Homo sapiens
ggcgtgctcagaccca

SEQ ID NO: 2260506 - DNA, 22 bp, Homo sapiens
ggctaccaacttgtatccaggc

SEQ ID NO: 2260507 - DNA, 17 bp, Homo sapiens
ggctccccatgtgtcct

SEQ ID NO: 2260508 - DNA, 18 bp, Homo sapiens
ggctctataaggcagcct

SEQ ID NO: 2260509 - DNA, 17 bp, Homo sapiens
ggctctgaggtgcctgt

SEQ ID NO: 2260510 - DNA, 18 bp, Homo sapiens
ggctctgccccctccccc

SEQ ID NO: 2260511 - DNA, 15 bp, Homo sapiens
ggctctgggaatggg

SEQ ID NO: 2260512 - DNA, 19 bp, Homo sapiens
ggctcttgatacccccctc

SEQ ID NO: 2260513 - DNA, 20 bp, Homo sapiens
ggctcttgatacccccctct

SEQ ID NO: 2260514 - DNA, 21 bp, Homo sapiens
ggctcttgatacccccctctg

SEQ ID NO: 2260515 - DNA, 16 bp, Homo sapiens
ggctgaggacgagacc

SEQ ID NO: 2260516 - DNA, 20 bp, Homo sapiens
ggctgaggacgagaccccca

SEQ ID NO: 2260517 - DNA, 14 bp, Homo sapiens
ggctgcttagaatc

SEQ ID NO: 2260518 - DNA, 20 bp, Homo sapiens
ggctggagtgcagtggcgca

SEQ ID NO: 2260519 - DNA, 11 bp, Homo sapiens
ggctgggccat

SEQ ID NO: 2260520 - DNA, 17 bp, Homo sapiens
ggctgggccatgtccaa

SEQ ID NO: 2260521 - DNA, 20 bp, Homo sapiens
ggctggtagcagcaggctca

SEQ ID NO: 2260522 - DNA, 13 bp, Homo sapiens
ggctggtgggccc

SEQ ID NO: 2260523 - DNA, 17 bp, Homo sapiens
ggctgtctgttgtattc

SEQ ID NO: 2260524 - DNA, 14 bp, Homo sapiens
ggcttaatcatttt

SEQ ID NO: 2260525 - DNA, 19 bp, Homo sapiens
ggcttttattaatgcactt

SEQ ID NO: 2260526 - DNA, 22 bp, Homo sapiens
gggaaaactgccaatatagaaa

SEQ ID NO: 2260527 - DNA, 15 bp, Homo sapiens
gggaaactgggaaac

SEQ ID NO: 2260528 - DNA, 19 bp, Homo sapiens
gggaacctagctacactga

SEQ ID NO: 2260529 - DNA, 14 bp, Homo sapiens
gggaagggacacac

SEQ ID NO: 2260530 - DNA, 13 bp, Homo sapiens
gggaaggggctga

SEQ ID NO: 2260531 - DNA, 15 bp, Homo sapiens
gggaatgcagcagga

SEQ ID NO: 2260532 - DNA, 17 bp, Homo sapiens
gggaattccctccccct

SEQ ID NO: 2260533 - DNA, 17 bp, Homo sapiens
gggaccactgggtgaga

SEQ ID NO: 2260534 - DNA, 21 bp, Homo sapiens
gggacccaatgtaggagctgc

SEQ ID NO: 2260535 - DNA, 17 bp, Homo sapiens
gggacgagggccaggca

SEQ ID NO: 2260536 - DNA, 23 bp, Homo sapiens
gggagaaatagtcggtgaagaaa

SEQ ID NO: 2260537 - DNA, 12 bp, Homo sapiens
gggagctgccaa

SEQ ID NO: 2260538 - DNA, 22 bp, Homo sapiens
gggatcaaccagctaagaaaag

SEQ ID NO: 2260539 - DNA, 17 bp, Homo sapiens
gggatccccgcctggcc

SEQ ID NO: 2260540 - DNA, 19 bp, Homo sapiens
gggatccccgcctggccag

SEQ ID NO: 2260541 - DNA, 22 bp, Homo sapiens
gggatccccgcctggccaggag

SEQ ID NO: 2260542 - DNA, 23 bp, Homo sapiens
gggatccccgcctggccaggagc

SEQ ID NO: 2260543 - DNA, 18 bp, Homo sapiens
gggatcctccacagagag

SEQ ID NO: 2260544 - DNA, 22 bp, Homo sapiens
gggatcctccacagagaggagg

SEQ ID NO: 2260545 - DNA, 13 bp, Homo sapiens
gggatcttcccac

SEQ ID NO: 2260546 - DNA, 20 bp, Homo sapiens
gggattaatatgaaaactta

SEQ ID NO: 2260547 - DNA, 13 bp, Homo sapiens
gggcaaataatga

SEQ ID NO: 2260548 - DNA, 21 bp, Homo sapiens
gggcaagcctaagggatcctg

SEQ ID NO: 2260549 - DNA, 23 bp, Homo sapiens
gggcacggcgggatcctccacag

SEQ ID NO: 2260550 - DNA, 14 bp, Homo sapiens
gggcaggctgggcc

SEQ ID NO: 2260551 - DNA, 14 bp, Homo sapiens
gggcagggtgaccc

SEQ ID NO: 2260552 - DNA, 16 bp, Homo sapiens
gggcattgctcagccc

SEQ ID NO: 2260553 - DNA, 19 bp, Homo sapiens
gggcatttggtgagagtca

SEQ ID NO: 2260554 - DNA, 12 bp, Homo sapiens
gggccaccacct

SEQ ID NO: 2260555 - DNA, 15 bp, Homo sapiens
gggccatgtccaaag

SEQ ID NO: 2260556 - DNA, 16 bp, Homo sapiens
gggccatgtccaaaga

SEQ ID NO: 2260557 - DNA, 21 bp, Homo sapiens
gggccatgtccaaagaggctg

SEQ ID NO: 2260558 - DNA, 22 bp, Homo sapiens
gggccatgtccaaagaggctgc

SEQ ID NO: 2260559 - DNA, 14 bp, Homo sapiens
gggcccctccacgc

SEQ ID NO: 2260560 - DNA, 12 bp, Homo sapiens
gggcccctggga

SEQ ID NO: 2260561 - DNA, 13 bp, Homo sapiens
gggccctgcccca

SEQ ID NO: 2260562 - DNA, 13 bp, Homo sapiens
gggccgggcaggt

SEQ ID NO: 2260563 - DNA, 23 bp, Homo sapiens
gggccgggcaggtcctgcccatg

SEQ ID NO: 2260564 - DNA, 20 bp, Homo sapiens
gggcctcaaaggcccgctct

SEQ ID NO: 2260565 - DNA, 16 bp, Homo sapiens
gggcctcatcacagca

SEQ ID NO: 2260566 - DNA, 14 bp, Homo sapiens
gggcctccagaact

SEQ ID NO: 2260567 - DNA, 20 bp, Homo sapiens
gggctccctggcaggatgct

SEQ ID NO: 2260568 - DNA, 23 bp, Homo sapiens
gggctcgccgtgtctcagcctct

SEQ ID NO: 2260569 - DNA, 23 bp, Homo sapiens
gggctctgcaattcccctctgct

SEQ ID NO: 2260570 - DNA, 19 bp, Homo sapiens
gggctgaggacgagacccc

SEQ ID NO: 2260571 - DNA, 18 bp, Homo sapiens
ggggaccaattctggaca

SEQ ID NO: 2260572 - DNA, 22 bp, Homo sapiens
ggggatcttcccacaggagggc

SEQ ID NO: 2260573 - DNA, 13 bp, Homo sapiens
ggggatgggccag

SEQ ID NO: 2260574 - DNA, 15 bp, Homo sapiens
ggggcaggctgggcc

SEQ ID NO: 2260575 - DNA, 21 bp, Homo sapiens
ggggccgggcaggtcctgccc

SEQ ID NO: 2260576 - DNA, 22 bp, Homo sapiens
ggggcttagggtcggaacccaa

SEQ ID NO: 2260577 - DNA, 21 bp, Homo sapiens
gggggccttctggttttagga

SEQ ID NO: 2260578 - DNA, 10 bp, Homo sapiens
gggggtggca

SEQ ID NO: 2260579 - DNA, 15 bp, Homo sapiens
ggggttatctctgtg

SEQ ID NO: 2260580 - DNA, 16 bp, Homo sapiens
gggtacttttcctggg

SEQ ID NO: 2260581 - DNA, 21 bp, Homo sapiens
gggtcctgaggcctgcagcac

SEQ ID NO: 2260582 - DNA, 21 bp, Homo sapiens
gggtgcatttgagagaagcca

SEQ ID NO: 2260583 - DNA, 13 bp, Homo sapiens
gggtgtggcctca

SEQ ID NO: 2260584 - DNA, 15 bp, Homo sapiens
gggtgtggcctcagc

SEQ ID NO: 2260585 - DNA, 23 bp, Homo sapiens
gggtttttaatctttgtgacagg

SEQ ID NO: 2260586 - DNA, 18 bp, Homo sapiens
ggtaaaacagggccacat

SEQ ID NO: 2260587 - DNA, 16 bp, Homo sapiens
ggtaaagactggcttt

SEQ ID NO: 2260588 - DNA, 14 bp, Homo sapiens
ggtaccctcctggc

SEQ ID NO: 2260589 - DNA, 14 bp, Homo sapiens
ggtactgtagcagg

SEQ ID NO: 2260590 - DNA, 16 bp, Homo sapiens
ggtaggaggcaaaggt

SEQ ID NO: 2260591 - DNA, 13 bp, Homo sapiens
ggtatgctggcca

SEQ ID NO: 2260592 - DNA, 17 bp, Homo sapiens
ggtatgctggccagcac

SEQ ID NO: 2260593 - DNA, 21 bp, Homo sapiens
ggtatgctggccagcaccctc

SEQ ID NO: 2260594 - DNA, 22 bp, Homo sapiens
ggtcaagttgtcaggttattta

SEQ ID NO: 2260595 - DNA, 17 bp, Homo sapiens
ggtccacacctgggcat

SEQ ID NO: 2260596 - DNA, 20 bp, Homo sapiens
ggtcctgcccatgtgtcccc

SEQ ID NO: 2260597 - DNA, 17 bp, Homo sapiens
ggtcctggagcagacca

SEQ ID NO: 2260598 - DNA, 21 bp, Homo sapiens
ggtcctggagcagaccacccc

SEQ ID NO: 2260599 - DNA, 15 bp, Homo sapiens
ggtcggaacccaagc

SEQ ID NO: 2260600 - DNA, 21 bp, Homo sapiens
ggtctcccttctctacactct

SEQ ID NO: 2260601 - DNA, 15 bp, Homo sapiens
ggtctggttgggcag

SEQ ID NO: 2260602 - DNA, 20 bp, Homo sapiens
ggtctttcagtactttttta

SEQ ID NO: 2260603 - DNA, 16 bp, Homo sapiens
ggtgacctccgtcctc

SEQ ID NO: 2260604 - DNA, 12 bp, Homo sapiens
ggtgactgtccc

SEQ ID NO: 2260605 - DNA, 16 bp, Homo sapiens
ggtgactgtcccaccg

SEQ ID NO: 2260606 - DNA, 17 bp, Homo sapiens
ggtgagagtcaaagctg

SEQ ID NO: 2260607 - DNA, 23 bp, Homo sapiens
ggtgcccagaataagttattgca

SEQ ID NO: 2260608 - DNA, 21 bp, Homo sapiens
ggtgctttttataaaaagata

SEQ ID NO: 2260609 - DNA, 21 bp, Homo sapiens
ggtggcaccagatgcaacctc

SEQ ID NO: 2260610 - DNA, 18 bp, Homo sapiens
ggtggccatccctgggcc

SEQ ID NO: 2260611 - DNA, 22 bp, Homo sapiens
ggtggccatccctgggcccctc

SEQ ID NO: 2260612 - DNA, 20 bp, Homo sapiens
ggtggcgtgagcctgtagtc

SEQ ID NO: 2260613 - DNA, 12 bp, Homo sapiens
ggtggggagaaa

SEQ ID NO: 2260614 - DNA, 14 bp, Homo sapiens
ggtggggatcctgc

SEQ ID NO: 2260615 - DNA, 23 bp, Homo sapiens
ggtggggtcctggagcagaccac

SEQ ID NO: 2260616 - DNA, 16 bp, Homo sapiens
ggtggtaccctctgga

SEQ ID NO: 2260617 - DNA, 20 bp, Homo sapiens
ggtgtgcaatgtctgagtga

SEQ ID NO: 2260618 - DNA, 14 bp, Homo sapiens
ggtgtggcctcagc

SEQ ID NO: 2260619 - DNA, 15 bp, Homo sapiens
ggtgtggtgcagtgt

SEQ ID NO: 2260620 - DNA, 23 bp, Homo sapiens
ggttattttgatgtaaagatgtt

SEQ ID NO: 2260621 - DNA, 20 bp, Homo sapiens
ggttctatctgcttagcaac

SEQ ID NO: 2260622 - DNA, 19 bp, Homo sapiens
ggttgtaattaaattctga

SEQ ID NO: 2260623 - DNA, 16 bp, Homo sapiens
ggtttagtcaatcact

SEQ ID NO: 2260624 - DNA, 21 bp, Homo sapiens
ggtttgccaaaattcatttct

SEQ ID NO: 2260625 - DNA, 13 bp, Homo sapiens
ggttttcatttgc

SEQ ID NO: 2260626 - DNA, 14 bp, Homo sapiens
gtaaaacaaaattt

SEQ ID NO: 2260627 - DNA, 17 bp, Homo sapiens
gtaaaacagggccacat

SEQ ID NO: 2260628 - DNA, 19 bp, Homo sapiens
gtaaaatattttgaatcaa

SEQ ID NO: 2260629 - DNA, 19 bp, Homo sapiens
gtaaacagatggcactttg

SEQ ID NO: 2260630 - DNA, 19 bp, Homo sapiens
gtaaacagcctctttttga

SEQ ID NO: 2260631 - DNA, 16 bp, Homo sapiens
gtaaatggtatgtcat

SEQ ID NO: 2260632 - DNA, 15 bp, Homo sapiens
gtaactaaaataatt

SEQ ID NO: 2260633 - DNA, 20 bp, Homo sapiens
gtaactaaaataattttgta

SEQ ID NO: 2260634 - DNA, 11 bp, Homo sapiens
gtaacttcaaa

SEQ ID NO: 2260635 - DNA, 23 bp, Homo sapiens
gtaagaacaactacctgagctaa

SEQ ID NO: 2260636 - DNA, 19 bp, Homo sapiens
gtaagaacatcataaaatt

SEQ ID NO: 2260637 - DNA, 13 bp, Homo sapiens
gcccttttcccct

SEQ ID NO: 2260638 - DNA, 23 bp, Homo sapiens
gccgccccctgccccccagcctc

SEQ ID NO: 2260639 - DNA, 14 bp, Homo sapiens
gccgctgcaccacg

SEQ ID NO: 2260640 - DNA, 15 bp, Homo sapiens
gccgctgccgctgca

SEQ ID NO: 2260641 - DNA, 17 bp, Homo sapiens
gccgctggctggtgggc

SEQ ID NO: 2260642 - DNA, 22 bp, Homo sapiens
gccgctgtgcccccctcctccc

SEQ ID NO: 2260643 - DNA, 19 bp, Homo sapiens
gccggcttcatgccagcta

SEQ ID NO: 2260644 - DNA, 19 bp, Homo sapiens
gccgggcaggtcctgccca

SEQ ID NO: 2260645 - DNA, 23 bp, Homo sapiens
gccgtattttacatgaagctgta

SEQ ID NO: 2260646 - DNA, 23 bp, Homo sapiens
gccgtgctcgcccacaaactgat

SEQ ID NO: 2260647 - DNA, 22 bp, Homo sapiens
gcctacagctttgatccctgac

SEQ ID NO: 2260648 - DNA, 13 bp, Homo sapiens
gcctagactctgt

SEQ ID NO: 2260649 - DNA, 18 bp, Homo sapiens
gcctatgtggtctaaggt

SEQ ID NO: 2260650 - DNA, 19 bp, Homo sapiens
gcctcactattacttgaac

SEQ ID NO: 2260651 - DNA, 14 bp, Homo sapiens
gcctcactggggca

SEQ ID NO: 2260652 - DNA, 15 bp, Homo sapiens
gcctcagaaggcccc

SEQ ID NO: 2260653 - DNA, 12 bp, Homo sapiens
gcctcagccctc

SEQ ID NO: 2260654 - DNA, 19 bp, Homo sapiens
gcctcatgtcaaatattta

SEQ ID NO: 2260655 - DNA, 19 bp, Homo sapiens
gcctccagaactcactggg

SEQ ID NO: 2260656 - DNA, 18 bp, Homo sapiens
gcctccagggcattgctc

SEQ ID NO: 2260657 - DNA, 22 bp, Homo sapiens
gcctccagggcattgctcagcc

SEQ ID NO: 2260658 - DNA, 13 bp, Homo sapiens
gcctcccaccaga

SEQ ID NO: 2260659 - DNA, 13 bp, Homo sapiens
gcctccccctcag

SEQ ID NO: 2260660 - DNA, 18 bp, Homo sapiens
gcctccctccaccccagg

SEQ ID NO: 2260661 - DNA, 12 bp, Homo sapiens
gcctcctcatcc

SEQ ID NO: 2260662 - DNA, 17 bp, Homo sapiens
gcctcctcatcccgtgt

SEQ ID NO: 2260663 - DNA, 16 bp, Homo sapiens
gcctcctggccagacg

SEQ ID NO: 2260664 - DNA, 14 bp, Homo sapiens
gcctctctccttgg

SEQ ID NO: 2260665 - DNA, 18 bp, Homo sapiens
gcctctgacagtccacag

SEQ ID NO: 2260666 - DNA, 21 bp, Homo sapiens
gcctctgcacaccctccagag

SEQ ID NO: 2260667 - DNA, 16 bp, Homo sapiens
gcctctgccagcgcca

SEQ ID NO: 2260668 - DNA, 12 bp, Homo sapiens
gcctctgtgcct

SEQ ID NO: 2260669 - DNA, 19 bp, Homo sapiens
gcctgatgagatttttaaa

SEQ ID NO: 2260670 - DNA, 23 bp, Homo sapiens
gcctgattctcgcgattattctc

SEQ ID NO: 2260671 - DNA, 17 bp, Homo sapiens
gcctgcagtcctggaag

SEQ ID NO: 2260672 - DNA, 22 bp, Homo sapiens
gcctgcccctaccctggacttg

SEQ ID NO: 2260673 - DNA, 20 bp, Homo sapiens
gcctgccctcatggcccctc

SEQ ID NO: 2260674 - DNA, 22 bp, Homo sapiens
gcctgccctcatggcccctctg

SEQ ID NO: 2260675 - DNA, 19 bp, Homo sapiens
gcctggcacaggccgaggc

SEQ ID NO: 2260676 - DNA, 16 bp, Homo sapiens
gcctggctctgccccc

SEQ ID NO: 2260677 - DNA, 15 bp, Homo sapiens
gcctgggctcactgt

SEQ ID NO: 2260678 - DNA, 17 bp, Homo sapiens
gcctgtcttaattttct

SEQ ID NO: 2260679 - DNA, 14 bp, Homo sapiens
gcctgttggcaggc

SEQ ID NO: 2260680 - DNA, 16 bp, Homo sapiens
gcctgttggcaggccc

SEQ ID NO: 2260681 - DNA, 22 bp, Homo sapiens
gcctgttggcaggcccactccc

SEQ ID NO: 2260682 - DNA, 16 bp, Homo sapiens
gccttcctctctccag

SEQ ID NO: 2260683 - DNA, 17 bp, Homo sapiens
gccttcctctctccaga

SEQ ID NO: 2260684 - DNA, 14 bp, Homo sapiens
gccttctggccttg

SEQ ID NO: 2260685 - DNA, 17 bp, Homo sapiens
gccttctggttttagga

SEQ ID NO: 2260686 - DNA, 22 bp, Homo sapiens
gccttcttttgattatgttttt

SEQ ID NO: 2260687 - DNA, 22 bp, Homo sapiens
gccttggcaggctgctggaagg

SEQ ID NO: 2260688 - DNA, 14 bp, Homo sapiens
gccttggctcagac

SEQ ID NO: 2260689 - DNA, 16 bp, Homo sapiens
gccttggctcagacat

SEQ ID NO: 2260690 - DNA, 16 bp, Homo sapiens
gccttggtatcatttt

SEQ ID NO: 2260691 - DNA, 17 bp, Homo sapiens
gcgaaccctttatttga

SEQ ID NO: 2260692 - DNA, 15 bp, Homo sapiens
gcgaagccttctgca

SEQ ID NO: 2260693 - DNA, 15 bp, Homo sapiens
gcgaccttcctcatc

SEQ ID NO: 2260694 - DNA, 21 bp, Homo sapiens
gcgccaaaacaagccaaagag

SEQ ID NO: 2260695 - DNA, 18 bp, Homo sapiens
gcgcctccctccacccca

SEQ ID NO: 2260696 - DNA, 19 bp, Homo sapiens
gcgcctccctccaccccag

SEQ ID NO: 2260697 - DNA, 17 bp, Homo sapiens
gcgctcagtaaacggga

SEQ ID NO: 2260698 - DNA, 20 bp, Homo sapiens
gcggaacaaggagtcagaca

SEQ ID NO: 2260699 - DNA, 16 bp, Homo sapiens
gcggagagagccaaga

SEQ ID NO: 2260700 - DNA, 21 bp, Homo sapiens
gcgggatcctccacagagagg

SEQ ID NO: 2260701 - DNA, 15 bp, Homo sapiens
gcgggcgcgtgagtg

SEQ ID NO: 2260702 - DNA, 16 bp, Homo sapiens
gcgggctccctggcag

SEQ ID NO: 2260703 - DNA, 13 bp, Homo sapiens
gcggggtgcagaa

SEQ ID NO: 2260704 - DNA, 15 bp, Homo sapiens
gcgtgctcagaccca

SEQ ID NO: 2260705 - DNA, 19 bp, Homo sapiens
gctaaatatttaccttgaa

SEQ ID NO: 2260706 - DNA, 13 bp, Homo sapiens
gctaactgtaaat

SEQ ID NO: 2260707 - DNA, 16 bp, Homo sapiens
gctaactgtaaatcat

SEQ ID NO: 2260708 - DNA, 14 bp, Homo sapiens
gctaagaaaagatt

SEQ ID NO: 2260709 - DNA, 21 bp, Homo sapiens
gctaataagtttgaaatatat

SEQ ID NO: 2260710 - DNA, 12 bp, Homo sapiens
gctacactgagc

SEQ ID NO: 2260711 - DNA, 20 bp, Homo sapiens
gctaccctttttctccagct

SEQ ID NO: 2260712 - DNA, 22 bp, Homo sapiens
gctactatgatttaatttgaaa

SEQ ID NO: 2260713 - DNA, 19 bp, Homo sapiens
gctacttcctcctccccac

SEQ ID NO: 2260714 - DNA, 15 bp, Homo sapiens
gctagatttctacat

SEQ ID NO: 2260715 - DNA, 23 bp, Homo sapiens
gctagcctgttcttttaccactg

SEQ ID NO: 2260716 - DNA, 17 bp, Homo sapiens
gctaggaggagggggta

SEQ ID NO: 2260717 - DNA, 18 bp, Homo sapiens
gctagtagacatgaattt

SEQ ID NO: 2260718 - DNA, 16 bp, Homo sapiens
gctatctgtcatctct

SEQ ID NO: 2260719 - DNA, 19 bp, Homo sapiens
gctatggagagaattaaaa

SEQ ID NO: 2260720 - DNA, 22 bp, Homo sapiens
gctcaagcagcgaccgccccct

SEQ ID NO: 2260721 - DNA, 23 bp, Homo sapiens
gctcaagcagcgaccgccccctc

SEQ ID NO: 2260722 - DNA, 18 bp, Homo sapiens
gctcactgtgctggggca

SEQ ID NO: 2260723 - DNA, 12 bp, Homo sapiens
gctcagtaaacg

SEQ ID NO: 2260724 - DNA, 19 bp, Homo sapiens
gctcatatggggctgggag

SEQ ID NO: 2260725 - DNA, 17 bp, Homo sapiens
gctccaccctcccccag

SEQ ID NO: 2260726 - DNA, 21 bp, Homo sapiens
gctccaggtggctctgaggtg

SEQ ID NO: 2260727 - DNA, 12 bp, Homo sapiens
gctcccctgagg

SEQ ID NO: 2260728 - DNA, 16 bp, Homo sapiens
gctcgtggactgtgct

SEQ ID NO: 2260729 - DNA, 18 bp, Homo sapiens
gctctacatcttctgcct

SEQ ID NO: 2260730 - DNA, 20 bp, Homo sapiens
gctctacatcttctgcctta

SEQ ID NO: 2260731 - DNA, 19 bp, Homo sapiens
gctctatcgcccaggctgg

SEQ ID NO: 2260732 - DNA, 17 bp, Homo sapiens
gctctgccccctccccc

SEQ ID NO: 2260733 - DNA, 22 bp, Homo sapiens
gctctgtgagggtgctgactgg

SEQ ID NO: 2260734 - DNA, 17 bp, Homo sapiens
gctcttgatacccccct

SEQ ID NO: 2260735 - DNA, 22 bp, Homo sapiens
gctcttgatacccccctctgtc

SEQ ID NO: 2260736 - DNA, 23 bp, Homo sapiens
gctcttgatacccccctctgtct

SEQ ID NO: 2260737 - DNA, 19 bp, Homo sapiens
gctgaaagctggtggcaga

SEQ ID NO: 2260738 - DNA, 19 bp, Homo sapiens
gctgaagttgcagatgtta

SEQ ID NO: 2260739 - DNA, 23 bp, Homo sapiens
gctgaatgttgggactgctaaat

SEQ ID NO: 2260740 - DNA, 18 bp, Homo sapiens
gctgacctctcactgcct

SEQ ID NO: 2260741 - DNA, 20 bp, Homo sapiens
gctgagcctctgctccccag

SEQ ID NO: 2260742 - DNA, 22 bp, Homo sapiens
gctgagcttgtcttttctgctg

SEQ ID NO: 2260743 - DNA, 13 bp, Homo sapiens
gctgaggacgaga

SEQ ID NO: 2260744 - DNA, 14 bp, Homo sapiens
gctgaggacgagac

SEQ ID NO: 2260745 - DNA, 19 bp, Homo sapiens
gctgaggacgagaccccca

SEQ ID NO: 2260746 - DNA, 13 bp, Homo sapiens
ctgccccacccca

SEQ ID NO: 2260747 - DNA, 23 bp, Homo sapiens
ctgccccaccccatccagccaga

SEQ ID NO: 2260748 - DNA, 21 bp, Homo sapiens
ctgccccccagcctctggcat

SEQ ID NO: 2260749 - DNA, 21 bp, Homo sapiens
ctgcccctaccctggacttgc

SEQ ID NO: 2260750 - DNA, 12 bp, Homo sapiens
ctgccctcatgg

SEQ ID NO: 2260751 - DNA, 16 bp, Homo sapiens
ctgccgctgcaccacg

SEQ ID NO: 2260752 - DNA, 13 bp, Homo sapiens
ctgcctcccatgc

SEQ ID NO: 2260753 - DNA, 23 bp, Homo sapiens
ctgcctgtccccaaacaggacag

SEQ ID NO: 2260754 - DNA, 23 bp, Homo sapiens
ctgccttagtctcagtttgtgtg

SEQ ID NO: 2260755 - DNA, 17 bp, Homo sapiens
ctgccttggctcagaca

SEQ ID NO: 2260756 - DNA, 20 bp, Homo sapiens
ctgcgctggacgatagcttg

SEQ ID NO: 2260757 - DNA, 20 bp, Homo sapiens
ctgcgggctccctggcagga

SEQ ID NO: 2260758 - DNA, 14 bp, Homo sapiens
ctgctaacaagtca

SEQ ID NO: 2260759 - DNA, 14 bp, Homo sapiens
ctgctagatttcta

SEQ ID NO: 2260760 - DNA, 16 bp, Homo sapiens
ctgctagatttctaca

SEQ ID NO: 2260761 - DNA, 17 bp, Homo sapiens
ctgctagatttctacat

SEQ ID NO: 2260762 - DNA, 13 bp, Homo sapiens
ctgctatacacaa

SEQ ID NO: 2260763 - DNA, 14 bp, Homo sapiens
ctgctccaccctcc

SEQ ID NO: 2260764 - DNA, 19 bp, Homo sapiens
ctgctcgtggactgtgctg

SEQ ID NO: 2260765 - DNA, 15 bp, Homo sapiens
ctgctgtcataacat

SEQ ID NO: 2260766 - DNA, 21 bp, Homo sapiens
ctgcttacctactttcttcag

SEQ ID NO: 2260767 - DNA, 19 bp, Homo sapiens
ctgcttttgcataatgcaa

SEQ ID NO: 2260768 - DNA, 17 bp, Homo sapiens
ctggaacaaattatttt

SEQ ID NO: 2260769 - DNA, 20 bp, Homo sapiens
ctggaagcccctgggcccag

SEQ ID NO: 2260770 - DNA, 14 bp, Homo sapiens
ctggaatttgggca

SEQ ID NO: 2260771 - DNA, 17 bp, Homo sapiens
ctggacactcagacctg

SEQ ID NO: 2260772 - DNA, 18 bp, Homo sapiens
ctggacactcagacctga

SEQ ID NO: 2260773 - DNA, 13 bp, Homo sapiens
ctggacagacaga

SEQ ID NO: 2260774 - DNA, 18 bp, Homo sapiens
ctggacagtacctgattg

SEQ ID NO: 2260775 - DNA, 20 bp, Homo sapiens
ctggacagtacctgattgta

SEQ ID NO: 2260776 - DNA, 16 bp, Homo sapiens
ctggacccctgggcct

SEQ ID NO: 2260777 - DNA, 18 bp, Homo sapiens
ctggacccttataaaatc

SEQ ID NO: 2260778 - DNA, 18 bp, Homo sapiens
ctggagaccagggagcct

SEQ ID NO: 2260779 - DNA, 19 bp, Homo sapiens
ctggagaccagggagcctt

SEQ ID NO: 2260780 - DNA, 13 bp, Homo sapiens
ctggagcagacca

SEQ ID NO: 2260781 - DNA, 22 bp, Homo sapiens
ctggagcgaagccttctgcagc

SEQ ID NO: 2260782 - DNA, 18 bp, Homo sapiens
ctggaggaacacttgatg

SEQ ID NO: 2260783 - DNA, 21 bp, Homo sapiens
ctggatccatcttgagccaca

SEQ ID NO: 2260784 - DNA, 22 bp, Homo sapiens
ctggatccatcttgagccacag

SEQ ID NO: 2260785 - DNA, 15 bp, Homo sapiens
ctggatgtaccacca

SEQ ID NO: 2260786 - DNA, 12 bp, Homo sapiens
ctggcacagagg

SEQ ID NO: 2260787 - DNA, 14 bp, Homo sapiens
ctggcagagagcac

SEQ ID NO: 2260788 - DNA, 19 bp, Homo sapiens
ctggcagtttaaaaaaatt

SEQ ID NO: 2260789 - DNA, 22 bp, Homo sapiens
ctggcattagaattatttaaac

SEQ ID NO: 2260790 - DNA, 14 bp, Homo sapiens
ctggccagcaccct

SEQ ID NO: 2260791 - DNA, 20 bp, Homo sapiens
ctggccagcaccctctcctg

SEQ ID NO: 2260792 - DNA, 21 bp, Homo sapiens
ctggccagcaccctctcctgg

SEQ ID NO: 2260793 - DNA, 23 bp, Homo sapiens
ctggccagcaccctctcctgggg

SEQ ID NO: 2260794 - DNA, 12 bp, Homo sapiens
ctggccaggagc

SEQ ID NO: 2260795 - DNA, 15 bp, Homo sapiens
ctggccaggagcagg

SEQ ID NO: 2260796 - DNA, 16 bp, Homo sapiens
ctggccccagccctgc

SEQ ID NO: 2260797 - DNA, 18 bp, Homo sapiens
ctggccccagccctgctg

SEQ ID NO: 2260798 - DNA, 14 bp, Homo sapiens
ctggccctggggat

SEQ ID NO: 2260799 - DNA, 20 bp, Homo sapiens
ctggccctggggatcttccc

SEQ ID NO: 2260800 - DNA, 14 bp, Homo sapiens
ctggcctggactgt

SEQ ID NO: 2260801 - DNA, 18 bp, Homo sapiens
ctggcctggactgttttc

SEQ ID NO: 2260802 - DNA, 16 bp, Homo sapiens
ctggcgtgctcagacc

SEQ ID NO: 2260803 - DNA, 14 bp, Homo sapiens
ctggctctgccccc

SEQ ID NO: 2260804 - DNA, 23 bp, Homo sapiens
ctggctcttgatacccccctctg

SEQ ID NO: 2260805 - DNA, 19 bp, Homo sapiens
ctggctggtgggcccccaa

SEQ ID NO: 2260806 - DNA, 15 bp, Homo sapiens
ctggcttttgagcac

SEQ ID NO: 2260807 - DNA, 18 bp, Homo sapiens
ctgggaacccctcctggc

SEQ ID NO: 2260808 - DNA, 18 bp, Homo sapiens
ctgggaatgggagagggg

SEQ ID NO: 2260809 - DNA, 23 bp, Homo sapiens
ctgggagtagttgtctttcctgg

SEQ ID NO: 2260810 - DNA, 17 bp, Homo sapiens
ctgggatgggaccaggg

SEQ ID NO: 2260811 - DNA, 19 bp, Homo sapiens
ctgggatgggaccagggat

SEQ ID NO: 2260812 - DNA, 20 bp, Homo sapiens
ctgggatgggaccagggatg

SEQ ID NO: 2260813 - DNA, 22 bp, Homo sapiens
ctgggccaggaggtagtttctc

SEQ ID NO: 2260814 - DNA, 17 bp, Homo sapiens
ctgggccatgtccaaag

SEQ ID NO: 2260815 - DNA, 17 bp, Homo sapiens
ctgggctgtctgtcacc

SEQ ID NO: 2260816 - DNA, 18 bp, Homo sapiens
ctgggctgtctgtcacca

SEQ ID NO: 2260817 - DNA, 15 bp, Homo sapiens
ctgggctgtgggcaa

SEQ ID NO: 2260818 - DNA, 22 bp, Homo sapiens
ctggggacctggtaccctcctg

SEQ ID NO: 2260819 - DNA, 23 bp, Homo sapiens
ctggggatccccgcctggccagg

SEQ ID NO: 2260820 - DNA, 20 bp, Homo sapiens
ctggggatcttcccacagga

SEQ ID NO: 2260821 - DNA, 15 bp, Homo sapiens
ctggggcaggctggg

SEQ ID NO: 2260822 - DNA, 16 bp, Homo sapiens
ctggggccctgggcct

SEQ ID NO: 2260823 - DNA, 20 bp, Homo sapiens
ctggggctgaggctgaggca

SEQ ID NO: 2260824 - DNA, 20 bp, Homo sapiens
ctgggggacccaatgtagga

SEQ ID NO: 2260825 - DNA, 23 bp, Homo sapiens
ctgggggcttcgcttccttagcc

SEQ ID NO: 2260826 - DNA, 16 bp, Homo sapiens
ctgggggtggcaggca

SEQ ID NO: 2260827 - DNA, 20 bp, Homo sapiens
ctggtaaagttacactttta

SEQ ID NO: 2260828 - DNA, 20 bp, Homo sapiens
ctggtagcagcaggctcagg

SEQ ID NO: 2260829 - DNA, 21 bp, Homo sapiens
ctggtctggttgggcagccag

SEQ ID NO: 2260830 - DNA, 13 bp, Homo sapiens
ctggtggcaccag

SEQ ID NO: 2260831 - DNA, 14 bp, Homo sapiens
ctggtggcaccaga

SEQ ID NO: 2260832 - DNA, 18 bp, Homo sapiens
ctggtggcaccagatgca

SEQ ID NO: 2260833 - DNA, 14 bp, Homo sapiens
ctggtgggccccca

SEQ ID NO: 2260834 - DNA, 17 bp, Homo sapiens
ctggttgggcagccaga

SEQ ID NO: 2260835 - DNA, 20 bp, Homo sapiens
ctggtttttggattaaatta

SEQ ID NO: 2260836 - DNA, 24 bp, Homo sapiens
ctgtaaacacaggggacacagctt

SEQ ID NO: 2260837 - DNA, 11 bp, Homo sapiens
ctgtaaatcat

SEQ ID NO: 2260838 - DNA, 18 bp, Homo sapiens
ctgtacttttcattctct

SEQ ID NO: 2260839 - DNA, 16 bp, Homo sapiens
ctgtagaatcaattta

SEQ ID NO: 2260840 - DNA, 12 bp, Homo sapiens
ctgtaggcctca

SEQ ID NO: 2260841 - DNA, 19 bp, Homo sapiens
ctgtagtgaatcctctgtt

SEQ ID NO: 2260842 - DNA, 22 bp, Homo sapiens
ctgtataagtggaggcacttta

SEQ ID NO: 2260843 - DNA, 14 bp, Homo sapiens
ctgtataatctatt

SEQ ID NO: 2260844 - DNA, 18 bp, Homo sapiens
ctgtatgttgtacaatca

SEQ ID NO: 2260845 - DNA, 20 bp, Homo sapiens
ctgtatgttgtacaatcaaa

SEQ ID NO: 2260846 - DNA, 20 bp, Homo sapiens
ctgtatttaatggtttttat

SEQ ID NO: 2260847 - DNA, 14 bp, Homo sapiens
ctgtcaaggctcag

SEQ ID NO: 2260848 - DNA, 21 bp, Homo sapiens
ctgtcacagtaaaaataaaat

SEQ ID NO: 2260849 - DNA, 23 bp, Homo sapiens
ctgtcactcattgctgagcctct

SEQ ID NO: 2260850 - DNA, 16 bp, Homo sapiens
ctgtcagccagccgcc

SEQ ID NO: 2260851 - DNA, 23 bp, Homo sapiens
ctgtcagccagccgccctgggct

SEQ ID NO: 2260852 - DNA, 13 bp, Homo sapiens
ctgtcatctctct

SEQ ID NO: 2260853 - DNA, 18 bp, Homo sapiens
ctgtcatctctctggggc

SEQ ID NO: 2260854 - DNA, 15 bp, Homo sapiens
ctgtcccaccgggag

SEQ ID NO: 2260855 - DNA, 22 bp, Homo sapiens
ctgtcccaccgggagcctcccc

SEQ ID NO: 2260856 - DNA, 16 bp, Homo sapiens
ctgtccccaaacagga

SEQ ID NO: 2260857 - DNA, 19 bp, Homo sapiens
ctgtccccaaacaggacag

SEQ ID NO: 2260858 - DNA, 13 bp, Homo sapiens
ctgtcctctcgag

SEQ ID NO: 2260859 - DNA, 15 bp, Homo sapiens
ctgtcgccccaggcc

SEQ ID NO: 2260860 - DNA, 20 bp, Homo sapiens
ctgtcgccccaggccctccc

SEQ ID NO: 2260861 - DNA, 22 bp, Homo sapiens
ctgtcgccccaggccctccctg

SEQ ID NO: 2260862 - DNA, 14 bp, Homo sapiens
ctgtctacctggtc

SEQ ID NO: 2260863 - DNA, 14 bp, Homo sapiens
ctgtctggccctgg

SEQ ID NO: 2260864 - DNA, 14 bp, Homo sapiens
ctgtcttaattttc

SEQ ID NO: 2260865 - DNA, 13 bp, Homo sapiens
ctgtgaattaagc

SEQ ID NO: 2260866 - DNA, 21 bp, Homo sapiens
ctgtgaattgtttttgtacag

SEQ ID NO: 2260867 - DNA, 22 bp, Homo sapiens
ctgtgagaaggtttattgttaa

SEQ ID NO: 2260868 - DNA, 23 bp, Homo sapiens
ctgtgatgtttgtgtatgtggga

SEQ ID NO: 2260869 - DNA, 13 bp, Homo sapiens
ctgtgctcagaag

SEQ ID NO: 2260870 - DNA, 17 bp, Homo sapiens
ctgtgctcagaagggct

SEQ ID NO: 2260871 - DNA, 17 bp, Homo sapiens
ctgtgctggggcacggc

SEQ ID NO: 2260872 - DNA, 11 bp, Homo sapiens
ctgtgggcagc

SEQ ID NO: 2260873 - DNA, 12 bp, Homo sapiens
ctgtgggcagca

SEQ ID NO: 2260874 - DNA, 13 bp, Homo sapiens
ctgtgggcagcac

SEQ ID NO: 2260875 - DNA, 17 bp, Homo sapiens
ctgtgggcagcaccctc

SEQ ID NO: 2260876 - DNA, 20 bp, Homo sapiens
ctgtgggggtggccatccct

SEQ ID NO: 2260877 - DNA, 20 bp, Homo sapiens
ctgtggtcaaggctacagat

SEQ ID NO: 2260878 - DNA, 16 bp, Homo sapiens
ctgtgtattttcagtc

SEQ ID NO: 2260879 - DNA, 16 bp, Homo sapiens
ctgtgtcctaaggccc

SEQ ID NO: 2260880 - DNA, 18 bp, Homo sapiens
ctgtgtcctaaggcccat

SEQ ID NO: 2260881 - DNA, 19 bp, Homo sapiens
ctgtgtctgcctgtcccca

SEQ ID NO: 2260882 - DNA, 20 bp, Homo sapiens
ctgtgtctttcacagctcct

SEQ ID NO: 2260883 - DNA, 23 bp, Homo sapiens
ctgtgtctttctctctctctctt

SEQ ID NO: 2260884 - DNA, 20 bp, Homo sapiens
ctgtgttgtgctgggagcag

SEQ ID NO: 2260885 - DNA, 22 bp, Homo sapiens
ctgttaactgtgcgttaaataa

SEQ ID NO: 2260886 - DNA, 19 bp, Homo sapiens
ctgttacactttttggaag

SEQ ID NO: 2260887 - DNA, 22 bp, Homo sapiens
ctgttagcagagtctgtctctt

SEQ ID NO: 2260888 - DNA, 23 bp, Homo sapiens
ctgttagcagagtctgtctcttg

SEQ ID NO: 2260889 - DNA, 16 bp, Homo sapiens
ctgttcagtaataaaa

SEQ ID NO: 2260890 - DNA, 21 bp, Homo sapiens
ctgttccacacccaatgctgc

SEQ ID NO: 2260891 - DNA, 22 bp, Homo sapiens
ctgttccacacccaatgctgct

SEQ ID NO: 2260892 - DNA, 19 bp, Homo sapiens
ctgttcttggcttggaaga

SEQ ID NO: 2260893 - DNA, 17 bp, Homo sapiens
ctgttggcaggcccact

SEQ ID NO: 2260894 - DNA, 23 bp, Homo sapiens
ctgttggcaggcccactccccag

SEQ ID NO: 2260895 - DNA, 16 bp, Homo sapiens
ctgtttcagaggctca

SEQ ID NO: 2260896 - DNA, 20 bp, Homo sapiens
ctgtttcctgacattgtctc

SEQ ID NO: 2260897 - DNA, 23 bp, Homo sapiens
ctgtttctggacccttataaaat

SEQ ID NO: 2260898 - DNA, 22 bp, Homo sapiens
cttaaatgcaaccatttgaaac

SEQ ID NO: 2260899 - DNA, 14 bp, Homo sapiens
cttaaattcctcaa

SEQ ID NO: 2260900 - DNA, 14 bp, Homo sapiens
cttaacaatgcaac

SEQ ID NO: 2260901 - DNA, 19 bp, Homo sapiens
cttaacaatgcaactttta

SEQ ID NO: 2260902 - DNA, 22 bp, Homo sapiens
cttaaggagaggagaaactgag

SEQ ID NO: 2260903 - DNA, 23 bp, Homo sapiens
cttaattacagttaaagaagcaa

SEQ ID NO: 2260904 - DNA, 11 bp, Homo sapiens
cttaattatta

SEQ ID NO: 2260905 - DNA, 14 bp, Homo sapiens
cttaattattataa

SEQ ID NO: 2260906 - DNA, 19 bp, Homo sapiens
cttaattattatttgtgtt

SEQ ID NO: 2260907 - DNA, 20 bp, Homo sapiens
cttacataaaccatttttgt

SEQ ID NO: 2260908 - DNA, 12 bp, Homo sapiens
cttactatttaa

SEQ ID NO: 2260909 - DNA, 17 bp, Homo sapiens
cttactgtgtttcagca

SEQ ID NO: 2260910 - DNA, 12 bp, Homo sapiens
cttagaatccaa

SEQ ID NO: 2260911 - DNA, 17 bp, Homo sapiens
cttagaatccaaacttg

SEQ ID NO: 2260912 - DNA, 15 bp, Homo sapiens
cttagccattgaaat

SEQ ID NO: 2260913 - DNA, 15 bp, Homo sapiens
cttaggccttcctct

SEQ ID NO: 2260914 - DNA, 20 bp, Homo sapiens
cttaggtggctctgggaatg

SEQ ID NO: 2260915 - DNA, 12 bp, Homo sapiens
cttagtctcagt

SEQ ID NO: 2260916 - DNA, 18 bp, Homo sapiens
cttataaaatcctgtgca

SEQ ID NO: 2260917 - DNA, 17 bp, Homo sapiens
cttatatatgcacttaa

SEQ ID NO: 2260918 - DNA, 22 bp, Homo sapiens
cttatatatgcacttaatttgt

SEQ ID NO: 2260919 - DNA, 23 bp, Homo sapiens
cttatgatagcaaatggcctcat

SEQ ID NO: 2260920 - DNA, 14 bp, Homo sapiens
cttatgtagagttt

SEQ ID NO: 2260921 - DNA, 16 bp, Homo sapiens
cttatgttgaaaaaat

SEQ ID NO: 2260922 - DNA, 13 bp, Homo sapiens
cttcaaagaaact

SEQ ID NO: 2260923 - DNA, 17 bp, Homo sapiens
cttcaaagaaacttgaa

SEQ ID NO: 2260924 - DNA, 21 bp, Homo sapiens
cttcagggaggtagtttcaaa

SEQ ID NO: 2260925 - DNA, 19 bp, Homo sapiens
cttcagtaccctctcagct

SEQ ID NO: 2260926 - DNA, 21 bp, Homo sapiens
cttcattcaaactgcactttt

SEQ ID NO: 2260927 - DNA, 21 bp, Homo sapiens
cttcattttcaggaaatctac

SEQ ID NO: 2260928 - DNA, 18 bp, Homo sapiens
cttccagtgtccttagaa

SEQ ID NO: 2260929 - DNA, 14 bp, Homo sapiens
cttcccacaggagg

SEQ ID NO: 2260930 - DNA, 22 bp, Homo sapiens
cttcctcatccaccccatccct

SEQ ID NO: 2260931 - DNA, 23 bp, Homo sapiens
cttcctcatccaccccatccctc

SEQ ID NO: 2260932 - DNA, 16 bp, Homo sapiens
cttcctcctccccact

SEQ ID NO: 2260933 - DNA, 15 bp, Homo sapiens
cttcctctctccaga

SEQ ID NO: 2260934 - DNA, 16 bp, Homo sapiens
cttcctctctccagat

SEQ ID NO: 2260935 - DNA, 21 bp, Homo sapiens
cttcctgcaggcaggaacaaa

SEQ ID NO: 2260936 - DNA, 17 bp, Homo sapiens
cttccttttatcagtag

SEQ ID NO: 2260937 - DNA, 22 bp, Homo sapiens
cttctaggatagctaactgtaa

SEQ ID NO: 2260938 - DNA, 18 bp, Homo sapiens
cttctctgctagatttct

SEQ ID NO: 2260939 - DNA, 20 bp, Homo sapiens
cttctgaaaacccaaggcca

SEQ ID NO: 2260940 - DNA, 19 bp, Homo sapiens
cttctgccttagtctcagt

SEQ ID NO: 2260941 - DNA, 20 bp, Homo sapiens
cttctgccttagtctcagtt

SEQ ID NO: 2260942 - DNA, 16 bp, Homo sapiens
cttctggggcaggctg

SEQ ID NO: 2260943 - DNA, 22 bp, Homo sapiens
cttctggggcaggctgggccat

SEQ ID NO: 2260944 - DNA, 19 bp, Homo sapiens
cttcttaaagtattcttct

SEQ ID NO: 2260945 - DNA, 16 bp, Homo sapiens
cttcttttgattatgt

SEQ ID NO: 2260946 - DNA, 15 bp, Homo sapiens
cttgaaatgaaaggg

SEQ ID NO: 2260947 - DNA, 18 bp, Homo sapiens
cttgaaatgaaagggaaa

SEQ ID NO: 2260948 - DNA, 21 bp, Homo sapiens
cttgaaatgaaagggaaactg

SEQ ID NO: 2260949 - DNA, 18 bp, Homo sapiens
cttgaactcctggactca

SEQ ID NO: 2260950 - DNA, 18 bp, Homo sapiens
cttgaccttttcgacgct

SEQ ID NO: 2260951 - DNA, 23 bp, Homo sapiens
cttgagaagacctcacctagaaa

SEQ ID NO: 2260952 - DNA, 22 bp, Homo sapiens
cttgagacacggagcccagccc

SEQ ID NO: 2260953 - DNA, 13 bp, Homo sapiens
cttgaggacagac

SEQ ID NO: 2260954 - DNA, 18 bp, Homo sapiens
cttgagttcaccatctct

SEQ ID NO: 2260955 - DNA, 21 bp, Homo sapiens
cttgagttcaccatctcttca

SEQ ID NO: 2260956 - DNA, 20 bp, Homo sapiens
cttgatgtgatgtggcagga

SEQ ID NO: 2260957 - DNA, 15 bp, Homo sapiens
cttgcctctgcacac

SEQ ID NO: 2260958 - DNA, 17 bp, Homo sapiens
cttgctcatttgaaaat

SEQ ID NO: 2260959 - DNA, 20 bp, Homo sapiens
cttgctggccccagccctgc

SEQ ID NO: 2260960 - DNA, 17 bp, Homo sapiens
cttgctttcctgcatct

SEQ ID NO: 2260961 - DNA, 19 bp, Homo sapiens
cttggaagattctatttaa

SEQ ID NO: 2260962 - DNA, 21 bp, Homo sapiens
cttggaagattctatttaatt

SEQ ID NO: 2260963 - DNA, 13 bp, Homo sapiens
cttggagaaatga

SEQ ID NO: 2260964 - DNA, 15 bp, Homo sapiens
cttggagaaatgaaa

SEQ ID NO: 2260965 - DNA, 21 bp, Homo sapiens
cttggaggacctggcgtgctc

SEQ ID NO: 2260966 - DNA, 13 bp, Homo sapiens
cttggagggatgg

SEQ ID NO: 2260967 - DNA, 14 bp, Homo sapiens
cttggccacagact

SEQ ID NO: 2260968 - DNA, 19 bp, Homo sapiens
cttggccacagactgaact

SEQ ID NO: 2260969 - DNA, 14 bp, Homo sapiens
cttggctcagacat

SEQ ID NO: 2260970 - DNA, 16 bp, Homo sapiens
cttggctcagacatgt

SEQ ID NO: 2260971 - DNA, 14 bp, Homo sapiens
cttggcttaatcat

SEQ ID NO: 2260972 - DNA, 19 bp, Homo sapiens
cttggcttaatcattttca

SEQ ID NO: 2260973 - DNA, 20 bp, Homo sapiens
cttggctttcagagccagcc

SEQ ID NO: 2260974 - DNA, 14 bp, Homo sapiens
cttggggcaacaga

SEQ ID NO: 2260975 - DNA, 14 bp, Homo sapiens
cttgtaactaaaat

SEQ ID NO: 2260976 - DNA, 16 bp, Homo sapiens
cttgtaactaaaataa

SEQ ID NO: 2260977 - DNA, 23 bp, Homo sapiens
cttgtatatatggatcagaggag

SEQ ID NO: 2260978 - DNA, 17 bp, Homo sapiens
cttgtatccaggcctgg

SEQ ID NO: 2260979 - DNA, 16 bp, Homo sapiens
cttgtcttttctgctg

SEQ ID NO: 2260980 - DNA, 20 bp, Homo sapiens
cttgtcttttctgctgagga

SEQ ID NO: 2260981 - DNA, 17 bp, Homo sapiens
cttgtgattatttatta

SEQ ID NO: 2260982 - DNA, 14 bp, Homo sapiens
cttgtttattaaat

SEQ ID NO: 2260983 - DNA, 14 bp, Homo sapiens
ctttaaaaactgtt

SEQ ID NO: 2260984 - DNA, 20 bp, Homo sapiens
ctttaaggtactgaagcttt

SEQ ID NO: 2260985 - DNA, 16 bp, Homo sapiens
ctttaatgatatgctt

SEQ ID NO: 2260986 - DNA, 22 bp, Homo sapiens
ctttaatgatatgcttgtaact

SEQ ID NO: 2260987 - DNA, 13 bp, Homo sapiens
ctttaatgcatct

SEQ ID NO: 2260988 - DNA, 14 bp, Homo sapiens
ctttaatgcatcta

SEQ ID NO: 2260989 - DNA, 18 bp, Homo sapiens
ctttacatactttatcaa

SEQ ID NO: 2260990 - DNA, 22 bp, Homo sapiens
ctttatcagggaaactaagatt

SEQ ID NO: 2260991 - DNA, 14 bp, Homo sapiens
ctttattaccccct

SEQ ID NO: 2260992 - DNA, 17 bp, Homo sapiens
ctttattgatatctcca

SEQ ID NO: 2260993 - DNA, 18 bp, Homo sapiens
ctttatttgcatatttat

SEQ ID NO: 2260994 - DNA, 18 bp, Homo sapiens
ctttattttcttctccag

SEQ ID NO: 2260995 - DNA, 17 bp, Homo sapiens
ctttattttgagatgta

SEQ ID NO: 2260996 - DNA, 18 bp, Homo sapiens
ctttcacagctcctccca

SEQ ID NO: 2260997 - DNA, 18 bp, Homo sapiens
ctttcagagccagcctgg

SEQ ID NO: 2260998 - DNA, 16 bp, Homo sapiens
ctttcatattttaaac

SEQ ID NO: 2260999 - DNA, 18 bp, Homo sapiens
ctttcatctggggtgggg

SEQ ID NO: 2261000 - DNA, 15 bp, Homo sapiens
ctttcattcagctaa

SEQ ID NO: 2261001 - DNA, 21 bp, Homo sapiens
ctttcattcagctaacaaact

SEQ ID NO: 2261002 - DNA, 13 bp, Homo sapiens
ctttccactttca

SEQ ID NO: 2261003 - DNA, 22 bp, Homo sapiens
ctttccaggctatgtataaaat

SEQ ID NO: 2261004 - DNA, 23 bp, Homo sapiens
ctttccaggctatgtataaaata

SEQ ID NO: 2261005 - DNA, 15 bp, Homo sapiens
ctttcccagtctgtc

SEQ ID NO: 2261006 - DNA, 16 bp, Homo sapiens
ctttccctcaccccct

SEQ ID NO: 2261007 - DNA, 19 bp, Homo sapiens
ctttccgctgtcgccccag

SEQ ID NO: 2261008 - DNA, 18 bp, Homo sapiens
ctttcctccttcactgtt

SEQ ID NO: 2261009 - DNA, 19 bp, Homo sapiens
ctttcctccttcactgttt

SEQ ID NO: 2261010 - DNA, 20 bp, Homo sapiens
ctttctacaatgtgaacttt

SEQ ID NO: 2261011 - DNA, 18 bp, Homo sapiens
ctttctcaaagaaatatt

SEQ ID NO: 2261012 - DNA, 20 bp, Homo sapiens
ctttctcaaagaaatattaa

SEQ ID NO: 2261013 - DNA, 15 bp, Homo sapiens
ctttctctgaggaca

SEQ ID NO: 2261014 - DNA, 21 bp, Homo sapiens
ctttctttccaaaacatttct

SEQ ID NO: 2261015 - DNA, 22 bp, Homo sapiens
ctttgagtgtcttctaacttta

SEQ ID NO: 2261016 - DNA, 22 bp, Homo sapiens
ctttgcaaaatgagactttcta

SEQ ID NO: 2261017 - DNA, 15 bp, Homo sapiens
ctttgcaccaaagac

SEQ ID NO: 2261018 - DNA, 16 bp, Homo sapiens
ctttgcaccaaagaca

SEQ ID NO: 2261019 - DNA, 19 bp, Homo sapiens
ctttgccagtcattcagca

SEQ ID NO: 2261020 - DNA, 16 bp, Homo sapiens
ctttggcgttggagac

SEQ ID NO: 2261021 - DNA, 13 bp, Homo sapiens
ctttggctcccct

SEQ ID NO: 2261022 - DNA, 20 bp, Homo sapiens
ctttggctggtagcagcagg

SEQ ID NO: 2261023 - DNA, 19 bp, Homo sapiens
ctttggttctggccagaat

SEQ ID NO: 2261024 - DNA, 18 bp, Homo sapiens
ctttgtaggtgagatgca

SEQ ID NO: 2261025 - DNA, 18 bp, Homo sapiens
ctttgtatataggcttct

SEQ ID NO: 2261026 - DNA, 19 bp, Homo sapiens
ctttgtatataggcttctc

SEQ ID NO: 2261027 - DNA, 21 bp, Homo sapiens
ctttgtatataggcttctcac

SEQ ID NO: 2261028 - DNA, 14 bp, Homo sapiens
ctttgtgacaggaa

SEQ ID NO: 2261029 - DNA, 22 bp, Homo sapiens
ctttgtgacaggaaagccctcc

SEQ ID NO: 2261030 - DNA, 11 bp, Homo sapiens
cttttaatggt

SEQ ID NO: 2261031 - DNA, 18 bp, Homo sapiens
cttttacagaataaaaga

SEQ ID NO: 2261032 - DNA, 12 bp, Homo sapiens
cttttactgtga

SEQ ID NO: 2261033 - DNA, 21 bp, Homo sapiens
cttttagaaatactgcaagaa

SEQ ID NO: 2261034 - DNA, 18 bp, Homo sapiens
cttttagccagagatgca

SEQ ID NO: 2261035 - DNA, 20 bp, Homo sapiens
cttttagccagagatgcaat

SEQ ID NO: 2261036 - DNA, 19 bp, Homo sapiens
cttttattaatgcactttc

SEQ ID NO: 2261037 - DNA, 20 bp, Homo sapiens
cttttccctctttggctccc

SEQ ID NO: 2261038 - DNA, 18 bp, Homo sapiens
cttttcctctctcccgga

SEQ ID NO: 2261039 - DNA, 22 bp, Homo sapiens
cttttcctgggtttcctgcagg

SEQ ID NO: 2261040 - DNA, 19 bp, Homo sapiens
cttttgcataatgcaatca

SEQ ID NO: 2261041 - DNA, 21 bp, Homo sapiens
cttttgcataatgcaatcaaa

SEQ ID NO: 2261042 - DNA, 22 bp, Homo sapiens
cttttgcataatgcaatcaaaa

SEQ ID NO: 2261043 - DNA, 23 bp, Homo sapiens
cttttgtgtcacttttttctgcc

SEQ ID NO: 2261044 - DNA, 14 bp, Homo sapiens
ctttttaagggatt

SEQ ID NO: 2261045 - DNA, 16 bp, Homo sapiens
ctttttaatcatgaat

SEQ ID NO: 2261046 - DNA, 21 bp, Homo sapiens
ctttttaatcatgaatatgat

SEQ ID NO: 2261047 - DNA, 11 bp, Homo sapiens
ctttttataaa

SEQ ID NO: 2261048 - DNA, 14 bp, Homo sapiens
ctttttataaaaag

SEQ ID NO: 2261049 - DNA, 17 bp, Homo sapiens
ctttttgttgtaaaaca

SEQ ID NO: 2261050 - DNA, 17 bp, Homo sapiens
cttttttaaatattttc

SEQ ID NO: 2261051 - DNA, 16 bp, Homo sapiens
cttttttaaattaata

SEQ ID NO: 2261052 - DNA, 16 bp, Homo sapiens
ctttttttacatttca

SEQ ID NO: 2261053 - DNA, 13 bp, Homo sapiens
gaaaaagaaaaaa

SEQ ID NO: 2261054 - DNA, 15 bp, Homo sapiens
gaaaacagctagtag

SEQ ID NO: 2261055 - DNA, 18 bp, Homo sapiens
gaaaacagtgtgtaaaca

SEQ ID NO: 2261056 - DNA, 16 bp, Homo sapiens
gaaaactaaggatttt

SEQ ID NO: 2261057 - DNA, 22 bp, Homo sapiens
gaaaactatcctgcgggtttta

SEQ ID NO: 2261058 - DNA, 9 bp, Homo sapiens
gaaaagaaa

SEQ ID NO: 2261059 - DNA, 14 bp, Homo sapiens
gaaaagaatagaag

SEQ ID NO: 2261060 - DNA, 13 bp, Homo sapiens
gaaaagattttaa

SEQ ID NO: 2261061 - DNA, 17 bp, Homo sapiens
gaaaagattttaatcaa

SEQ ID NO: 2261062 - DNA, 21 bp, Homo sapiens
gaaaaggttatgttcattttt

SEQ ID NO: 2261063 - DNA, 19 bp, Homo sapiens
gaaaatattctctatttga

SEQ ID NO: 2261064 - DNA, 20 bp, Homo sapiens
gaaaatattctctatttgaa

SEQ ID NO: 2261065 - DNA, 14 bp, Homo sapiens
gaaaattgtttagt

SEQ ID NO: 2261066 - DNA, 16 bp, Homo sapiens
gaaacatcattacaga

SEQ ID NO: 2261067 - DNA, 14 bp, Homo sapiens
gaaaccctgagcag

SEQ ID NO: 2261068 - DNA, 13 bp, Homo sapiens
gaaactatgtgtt

SEQ ID NO: 2261069 - DNA, 14 bp, Homo sapiens
gaaactatgtgttt

SEQ ID NO: 2261070 - DNA, 18 bp, Homo sapiens
gaaagccctcccccttcc

SEQ ID NO: 2261071 - DNA, 18 bp, Homo sapiens
gaaaggattcagtggagg

SEQ ID NO: 2261072 - DNA, 14 bp, Homo sapiens
gaaaggattttacc

SEQ ID NO: 2261073 - DNA, 17 bp, Homo sapiens
gaaaggattttaccaaa

SEQ ID NO: 2261074 - DNA, 21 bp, Homo sapiens
gaaaggattttaccaaagcat

SEQ ID NO: 2261075 - DNA, 13 bp, Homo sapiens
gaaagggaaactg

SEQ ID NO: 2261076 - DNA, 10 bp, Homo sapiens
gaaagtggtg

SEQ ID NO: 2261077 - DNA, 16 bp, Homo sapiens
gaaagttttgttctgt

SEQ ID NO: 2261078 - DNA, 17 bp, Homo sapiens
gaaataaagtttgctta

SEQ ID NO: 2261079 - DNA, 16 bp, Homo sapiens
gaaataatagaaatgt

SEQ ID NO: 2261080 - DNA, 14 bp, Homo sapiens
gaaatactatttaa

SEQ ID NO: 2261081 - DNA, 18 bp, Homo sapiens
gaaatactgcaagaaaat

SEQ ID NO: 2261082 - DNA, 22 bp, Homo sapiens
gaaatatattatttcctttatt

SEQ ID NO: 2261083 - DNA, 19 bp, Homo sapiens
gaaatgtgaatttttattg

SEQ ID NO: 2261084 - DNA, 23 bp, Homo sapiens
gaaatgttacaaaaataaactat

SEQ ID NO: 2261085 - DNA, 17 bp, Homo sapiens
gaacacgtttttacata

SEQ ID NO: 2261086 - DNA, 17 bp, Homo sapiens
gaacatccaaccttccc

SEQ ID NO: 2261087 - DNA, 13 bp, Homo sapiens
gaacatgccccct

SEQ ID NO: 2261088 - DNA, 18 bp, Homo sapiens
gaacatggtttgactcat

SEQ ID NO: 2261089 - DNA, 23 bp, Homo sapiens
gaactaaactagtttttcctatc

SEQ ID NO: 2261090 - DNA, 12 bp, Homo sapiens
gaactaagcact

SEQ ID NO: 2261091 - DNA, 18 bp, Homo sapiens
gaactagccaaaccagga

SEQ ID NO: 2261092 - DNA, 23 bp, Homo sapiens
gaactcgcagggaatgcagcagg

SEQ ID NO: 2261093 - DNA, 19 bp, Homo sapiens
gaactcgcgctcagtaaac

SEQ ID NO: 2261094 - DNA, 20 bp, Homo sapiens
gaagacctcacctagaaatt

SEQ ID NO: 2261095 - DNA, 19 bp, Homo sapiens
gaagatcattttgaaattg

SEQ ID NO: 2261096 - DNA, 22 bp, Homo sapiens
gaagcagttgtaccaagtgaaa

SEQ ID NO: 2261097 - DNA, 13 bp, Homo sapiens
gaagccaaatgaa

SEQ ID NO: 2261098 - DNA, 15 bp, Homo sapiens
gaagccacgctgtcc

SEQ ID NO: 2261099 - DNA, 18 bp, Homo sapiens
gaagcccctgggcccagt

SEQ ID NO: 2261100 - DNA, 22 bp, Homo sapiens
gaagcctctctccttggccaca

SEQ ID NO: 2261101 - DNA, 14 bp, Homo sapiens
gaagccttctgcag

SEQ ID NO: 2261102 - DNA, 15 bp, Homo sapiens
gaagccttctgcagc

SEQ ID NO: 2261103 - DNA, 20 bp, Homo sapiens
gaagccttctgcagcaggaa

SEQ ID NO: 2261104 - DNA, 22 bp, Homo sapiens
gaagccttctgcagcaggaact

SEQ ID NO: 2261105 - DNA, 17 bp, Homo sapiens
gaaggattatggaaaaa

SEQ ID NO: 2261106 - DNA, 21 bp, Homo sapiens
gaaggcagggggaaggtgggg

SEQ ID NO: 2261107 - DNA, 21 bp, Homo sapiens
gaaggccccagagagaccctg

SEQ ID NO: 2261108 - DNA, 22 bp, Homo sapiens
gaagggagaagacactgcagtg

SEQ ID NO: 2261109 - DNA, 17 bp, Homo sapiens
gaaggggctgaggacga

SEQ ID NO: 2261110 - DNA, 14 bp, Homo sapiens
gaaggtttattgtt

SEQ ID NO: 2261111 - DNA, 15 bp, Homo sapiens
gaagtcattaaactg

SEQ ID NO: 2261112 - DNA, 17 bp, Homo sapiens
gaagtgtataatataaa

SEQ ID NO: 2261113 - DNA, 21 bp, Homo sapiens
gaagtgtataatataaaaaat

SEQ ID NO: 2261114 - DNA, 13 bp, Homo sapiens
gaataagttattg

SEQ ID NO: 2261115 - DNA, 16 bp, Homo sapiens
gaataagttattgcag

SEQ ID NO: 2261116 - DNA, 19 bp, Homo sapiens
gaataagttattgcagttt

SEQ ID NO: 2261117 - DNA, 22 bp, Homo sapiens
gaatagctttaatgatatgctt

SEQ ID NO: 2261118 - DNA, 13 bp, Homo sapiens
gaatataagaaaa

SEQ ID NO: 2261119 - DNA, 22 bp, Homo sapiens
gaatatacagcaggtgctcaat

SEQ ID NO: 2261120 - DNA, 19 bp, Homo sapiens
gaatatcctttaaaattta

SEQ ID NO: 2261121 - DNA, 21 bp, Homo sapiens
gaatcaataatatattttctg

SEQ ID NO: 2261122 - DNA, 19 bp, Homo sapiens
gaatcagtataaacaaagt

SEQ ID NO: 2261123 - DNA, 21 bp, Homo sapiens
gaatcagtataaacaaagtta

SEQ ID NO: 2261124 - DNA, 20 bp, Homo sapiens
gaatcattgtatgtggtcat

SEQ ID NO: 2261125 - DNA, 16 bp, Homo sapiens
gaatgcagcaggaagg

SEQ ID NO: 2261126 - DNA, 21 bp, Homo sapiens
gaatgctgagacccccggagc

SEQ ID NO: 2261127 - DNA, 17 bp, Homo sapiens
gaatggtgcattgtata

SEQ ID NO: 2261128 - DNA, 13 bp, Homo sapiens
gaatgtatttatt

SEQ ID NO: 2261129 - DNA, 22 bp, Homo sapiens
gaatgtgagtgtgtttgtgtgc

SEQ ID NO: 2261130 - DNA, 20 bp, Homo sapiens
gaatgttgcaatgtgaaaaa

SEQ ID NO: 2261131 - DNA, 15 bp, Homo sapiens
gaatgttttaaattc

SEQ ID NO: 2261132 - DNA, 13 bp, Homo sapiens
gaattaaaactca

SEQ ID NO: 2261133 - DNA, 14 bp, Homo sapiens
gaattaaagtactt

SEQ ID NO: 2261134 - DNA, 14 bp, Homo sapiens
gaattacatatgaa

SEQ ID NO: 2261135 - DNA, 19 bp, Homo sapiens
gaattacgtgctctgtggg

SEQ ID NO: 2261136 - DNA, 18 bp, Homo sapiens
gaattcaaactggggcct

SEQ ID NO: 2261137 - DNA, 22 bp, Homo sapiens
gaattgaggggattaatatgaa

SEQ ID NO: 2261138 - DNA, 15 bp, Homo sapiens
gaattggtgattctg

SEQ ID NO: 2261139 - DNA, 15 bp, Homo sapiens
gaattgtttttgtac

SEQ ID NO: 2261140 - DNA, 19 bp, Homo sapiens
gaatttaggtttttattag

SEQ ID NO: 2261141 - DNA, 18 bp, Homo sapiens
gaattttattgacacagt

SEQ ID NO: 2261142 - DNA, 13 bp, Homo sapiens
gaatttttattgt

SEQ ID NO: 2261143 - DNA, 15 bp, Homo sapiens
gaatttttattgttg

SEQ ID NO: 2261144 - DNA, 19 bp, Homo sapiens
gacaaaccataactgacaa

SEQ ID NO: 2261145 - DNA, 16 bp, Homo sapiens
gacaataaaccctcag

SEQ ID NO: 2261146 - DNA, 13 bp, Homo sapiens
gacaattctgttt

SEQ ID NO: 2261147 - DNA, 13 bp, Homo sapiens
gacacagttcctg

SEQ ID NO: 2261148 - DNA, 15 bp, Homo sapiens
gacacagttcctggg

SEQ ID NO: 2261149 - DNA, 13 bp, Homo sapiens
gacacccatgcca

SEQ ID NO: 2261150 - DNA, 20 bp, Homo sapiens
gacacccatgccagagaggt

SEQ ID NO: 2261151 - DNA, 15 bp, Homo sapiens
gacacctcccccttt

SEQ ID NO: 2261152 - DNA, 15 bp, Homo sapiens
gacacggagcccagc

SEQ ID NO: 2261153 - DNA, 13 bp, Homo sapiens
gacactcagacct

SEQ ID NO: 2261154 - DNA, 15 bp, Homo sapiens
gacactcagacctga

SEQ ID NO: 2261155 - DNA, 14 bp, Homo sapiens
gacactggcccctc

SEQ ID NO: 2261156 - DNA, 23 bp, Homo sapiens
gacagcccaggatactggcacag

SEQ ID NO: 2261157 - DNA, 19 bp, Homo sapiens
gacagtccacaggggccac

SEQ ID NO: 2261158 - DNA, 18 bp, Homo sapiens
gacatctggaatctggag

SEQ ID NO: 2261159 - DNA, 20 bp, Homo sapiens
gacatctggaatctggagac

SEQ ID NO: 2261160 - DNA, 22 bp, Homo sapiens
gacatctggaatctggagacca

SEQ ID NO: 2261161 - DNA, 17 bp, Homo sapiens
gacatggagtgttactg

SEQ ID NO: 2261162 - DNA, 18 bp, Homo sapiens
gacatttaacttttctac

SEQ ID NO: 2261163 - DNA, 21 bp, Homo sapiens
gacatttgatagaaaggaaca

SEQ ID NO: 2261164 - DNA, 15 bp, Homo sapiens
gaccagggagccttt

SEQ ID NO: 2261165 - DNA, 22 bp, Homo sapiens
gaccagggatgggggatgggcc

SEQ ID NO: 2261166 - DNA, 18 bp, Homo sapiens
gaccatgcgtcaggggcc

SEQ ID NO: 2261167 - DNA, 19 bp, Homo sapiens
gacccaatgtaggagctgc

SEQ ID NO: 2261168 - DNA, 23 bp, Homo sapiens
gacccccatccagcctccagggc

SEQ ID NO: 2261169 - DNA, 18 bp, Homo sapiens
gacccctgggcctcatca

SEQ ID NO: 2261170 - DNA, 19 bp, Homo sapiens
gaccctgagtccgggaggc

SEQ ID NO: 2261171 - DNA, 18 bp, Homo sapiens
gaccctgcaagaccacgg

SEQ ID NO: 2261172 - DNA, 21 bp, Homo sapiens
gaccctgcaagaccacggagg

SEQ ID NO: 2261173 - DNA, 14 bp, Homo sapiens
gaccgccccctcct

SEQ ID NO: 2261174 - DNA, 17 bp, Homo sapiens
gaccgcccttttcccct

SEQ ID NO: 2261175 - DNA, 18 bp, Homo sapiens
gaccgcccttttccccta

SEQ ID NO: 2261176 - DNA, 20 bp, Homo sapiens
gaccggcggaccccagccat

SEQ ID NO: 2261177 - DNA, 16 bp, Homo sapiens
gacctacagactaaga

SEQ ID NO: 2261178 - DNA, 17 bp, Homo sapiens
gacctccgtcctctccc

SEQ ID NO: 2261179 - DNA, 15 bp, Homo sapiens
gacctctcactgcct

SEQ ID NO: 2261180 - DNA, 17 bp, Homo sapiens
gacctggtaccctcctg

SEQ ID NO: 2261181 - DNA, 19 bp, Homo sapiens
gacctggtaccctcctggc

SEQ ID NO: 2261182 - DNA, 23 bp, Homo sapiens
gacctggtaccctcctggctctt

SEQ ID NO: 2261183 - DNA, 14 bp, Homo sapiens
gaccttaaatgcaa

SEQ ID NO: 2261184 - DNA, 23 bp, Homo sapiens
gaccttcctcatccaccccatcc

SEQ ID NO: 2261185 - DNA, 22 bp, Homo sapiens
gacgaagcggagagagccaaga

SEQ ID NO: 2261186 - DNA, 11 bp, Homo sapiens
gacgagacccc

SEQ ID NO: 2261187 - DNA, 18 bp, Homo sapiens
gacgccactcatttcatc

SEQ ID NO: 2261188 - DNA, 19 bp, Homo sapiens
gacgccactcatttcatct

SEQ ID NO: 2261189 - DNA, 18 bp, Homo sapiens
gacgctgccgctgccgct

SEQ ID NO: 2261190 - DNA, 21 bp, Homo sapiens
gacggaggaggggaaggggct

SEQ ID NO: 2261191 - DNA, 23 bp, Homo sapiens
gacgtcatcggaggctgggcccc

SEQ ID NO: 2261192 - DNA, 12 bp, Homo sapiens
gactaattgact

SEQ ID NO: 2261193 - DNA, 18 bp, Homo sapiens
gactaattgacttgcaaa

SEQ ID NO: 2261194 - DNA, 21 bp, Homo sapiens
gactagatactactttctctt

SEQ ID NO: 2261195 - DNA, 21 bp, Homo sapiens
gactcaaggtggacgtgcgtt

SEQ ID NO: 2261196 - DNA, 10 bp, Homo sapiens
gactccagcc

SEQ ID NO: 2261197 - DNA, 13 bp, Homo sapiens
gactccagccagc

SEQ ID NO: 2261198 - DNA, 15 bp, Homo sapiens
gactccagccagcgc

SEQ ID NO: 2261199 - DNA, 22 bp, Homo sapiens
gactccagccagcgcctccctc

SEQ ID NO: 2261200 - DNA, 23 bp, Homo sapiens
gactccagccagcgcctccctcc

SEQ ID NO: 2261201 - DNA, 14 bp, Homo sapiens
gactccctgtgggg

SEQ ID NO: 2261202 - DNA, 23 bp, Homo sapiens
gactccctgtgggggtggccatc

SEQ ID NO: 2261203 - DNA, 24 bp, Homo sapiens
gactccctgtgggggtggccatcc

SEQ ID NO: 2261204 - DNA, 13 bp, Homo sapiens
gactctttgaaat

SEQ ID NO: 2261205 - DNA, 14 bp, Homo sapiens
gactctttgaaatg

SEQ ID NO: 2261206 - DNA, 14 bp, Homo sapiens
gactgcgctggacg

SEQ ID NO: 2261207 - DNA, 14 bp, Homo sapiens
gactgctaaataaa

SEQ ID NO: 2261208 - DNA, 17 bp, Homo sapiens
gactgctaaataaaatt

SEQ ID NO: 2261209 - DNA, 21 bp, Homo sapiens
gactggcttttattaatgcac

SEQ ID NO: 2261210 - DNA, 21 bp, Homo sapiens
gactgttttctctcggctccc

SEQ ID NO: 2261211 - DNA, 21 bp, Homo sapiens
gacttgcaaagacctacctcc

SEQ ID NO: 2261212 - DNA, 16 bp, Homo sapiens
gactttttataaaatg

SEQ ID NO: 2261213 - DNA, 23 bp, Homo sapiens
gagaaataaagtttgcttagaaa

SEQ ID NO: 2261214 - DNA, 13 bp, Homo sapiens
gagaaatgaaaac

SEQ ID NO: 2261215 - DNA, 20 bp, Homo sapiens
gagaaatgaatgctgagacc

SEQ ID NO: 2261216 - DNA, 15 bp, Homo sapiens
gagaaccttttcaaa

SEQ ID NO: 2261217 - DNA, 22 bp, Homo sapiens
gagaactcgcgctcagtaaacg

SEQ ID NO: 2261218 - DNA, 12 bp, Homo sapiens
gagaagacactg

SEQ ID NO: 2261219 - DNA, 18 bp, Homo sapiens
gagaagacactgcagtga

SEQ ID NO: 2261220 - DNA, 17 bp, Homo sapiens
gagaaggtttattgtta

SEQ ID NO: 2261221 - DNA, 15 bp, Homo sapiens
gagacactggcccct

SEQ ID NO: 2261222 - DNA, 22 bp, Homo sapiens
gagacatgggatccaattttaa

SEQ ID NO: 2261223 - DNA, 18 bp, Homo sapiens
gagacccccatccagcct

SEQ ID NO: 2261224 - DNA, 22 bp, Homo sapiens
gagacccccatccagcctccag

SEQ ID NO: 2261225 - DNA, 23 bp, Homo sapiens
gagaccctgcaagaccacggagg

SEQ ID NO: 2261226 - DNA, 20 bp, Homo sapiens
gagagaagccacgctgtcct

SEQ ID NO: 2261227 - DNA, 14 bp, Homo sapiens
gagagaccctgcaa

SEQ ID NO: 2261228 - DNA, 19 bp, Homo sapiens
gagagccctgaggcctaga

SEQ ID NO: 2261229 - DNA, 12 bp, Homo sapiens
gagaggcggcct

SEQ ID NO: 2261230 - DNA, 17 bp, Homo sapiens
gagatctttctttccaa

SEQ ID NO: 2261231 - DNA, 18 bp, Homo sapiens
gagatctttctttccaaa

SEQ ID NO: 2261232 - DNA, 22 bp, Homo sapiens
gagatggactaattgacttgca

SEQ ID NO: 2261233 - DNA, 23 bp, Homo sapiens
gagcaccttttaaacccctccct

SEQ ID NO: 2261234 - DNA, 23 bp, Homo sapiens
gagcagcccccgggccgctggct

SEQ ID NO: 2261235 - DNA, 22 bp, Homo sapiens
gagcaggcacgggtggtccccg

SEQ ID NO: 2261236 - DNA, 16 bp, Homo sapiens
gagcaggggtctgagc

SEQ ID NO: 2261237 - DNA, 18 bp, Homo sapiens
gagccaagacggaggagg

SEQ ID NO: 2261238 - DNA, 15 bp, Homo sapiens
gagccacagtcactg

SEQ ID NO: 2261239 - DNA, 16 bp, Homo sapiens
gagccagcctggctct

SEQ ID NO: 2261240 - DNA, 13 bp, Homo sapiens
gagccagctccct

SEQ ID NO: 2261241 - DNA, 18 bp, Homo sapiens
gagcccagccctccccat

SEQ ID NO: 2261242 - DNA, 19 bp, Homo sapiens
gagcccgtcagcgtggggg

SEQ ID NO: 2261243 - DNA, 16 bp, Homo sapiens
gagccctcaactattc

SEQ ID NO: 2261244 - DNA, 14 bp, Homo sapiens
gagcctcactgggg

SEQ ID NO: 2261245 - DNA, 12 bp, Homo sapiens
gagcctccccct

SEQ ID NO: 2261246 - DNA, 14 bp, Homo sapiens
gagcctccccctca

SEQ ID NO: 2261247 - DNA, 16 bp, Homo sapiens
gagcctccccctcaga

SEQ ID NO: 2261248 - DNA, 17 bp, Homo sapiens
gagcctccccctcagat

SEQ ID NO: 2261249 - DNA, 16 bp, Homo sapiens
gagcctctgctcccca

SEQ ID NO: 2261250 - DNA, 21 bp, Homo sapiens
gagcgcacagggagtgcacat

SEQ ID NO: 2261251 - DNA, 15 bp, Homo sapiens
gagctgccttggctc

SEQ ID NO: 2261252 - DNA, 23 bp, Homo sapiens
gagctggctctataaggcagcct

SEQ ID NO: 2261253 - DNA, 13 bp, Homo sapiens
gagctggggacct

SEQ ID NO: 2261254 - DNA, 15 bp, Homo sapiens
gagctggggacctgg

SEQ ID NO: 2261255 - DNA, 17 bp, Homo sapiens
gagcttgtcttttctgc

SEQ ID NO: 2261256 - DNA, 18 bp, Homo sapiens
gaggaaaaggcccctgca

SEQ ID NO: 2261257 - DNA, 19 bp, Homo sapiens
gaggacctggcgtgctcag

SEQ ID NO: 2261258 - DNA, 22 bp, Homo sapiens
gaggacctggcgtgctcagacc

SEQ ID NO: 2261259 - DNA, 15 bp, Homo sapiens
gaggacgagaccccc

SEQ ID NO: 2261260 - DNA, 22 bp, Homo sapiens
gaggacgtcatcggaggctggg

SEQ ID NO: 2261261 - DNA, 16 bp, Homo sapiens
gaggaggggaaggggc

SEQ ID NO: 2261262 - DNA, 14 bp, Homo sapiens
gaggcaaaaatgtc

SEQ ID NO: 2261263 - DNA, 21 bp, Homo sapiens
gaggcaaaggttctatctgct

SEQ ID NO: 2261264 - DNA, 17 bp, Homo sapiens
gaggcaggaggagcccg

SEQ ID NO: 2261265 - DNA, 14 bp, Homo sapiens
gaggctgcccctct

SEQ ID NO: 2261266 - DNA, 21 bp, Homo sapiens
gaggctggcagggtccctcca

SEQ ID NO: 2261267 - DNA, 16 bp, Homo sapiens
gagggagaacaagacc

SEQ ID NO: 2261268 - DNA, 13 bp, Homo sapiens
gagggagcgacac

SEQ ID NO: 2261269 - DNA, 22 bp, Homo sapiens
gagggagcgacacttgaatgta

SEQ ID NO: 2261270 - DNA, 22 bp, Homo sapiens
gagggcctcaaaggcccgctct

SEQ ID NO: 2261271 - DNA, 14 bp, Homo sapiens
gaggggaaggggct

SEQ ID NO: 2261272 - DNA, 14 bp, Homo sapiens
gaggggggggtggg

SEQ ID NO: 2261273 - DNA, 15 bp, Homo sapiens
gaggggggggtgggg

SEQ ID NO: 2261274 - DNA, 20 bp, Homo sapiens
gaggttctgtattttaagaa

SEQ ID NO: 2261275 - DNA, 14 bp, Homo sapiens
gagtaaacttgaaa

SEQ ID NO: 2261276 - DNA, 15 bp, Homo sapiens
gagtaagaaacttca

SEQ ID NO: 2261277 - DNA, 22 bp, Homo sapiens
gagtcagacattttaagatggt

SEQ ID NO: 2261278 - DNA, 16 bp, Homo sapiens
gagtcccctcacctcc

SEQ ID NO: 2261279 - DNA, 18 bp, Homo sapiens
gagtctaatagtctttgc

SEQ ID NO: 2261280 - DNA, 13 bp, Homo sapiens
gagtctgtctctt

SEQ ID NO: 2261281 - DNA, 21 bp, Homo sapiens
gagtggggttatctctgtgtt

SEQ ID NO: 2261282 - DNA, 19 bp, Homo sapiens
gagtggtggaggaggacac

SEQ ID NO: 2261283 - DNA, 18 bp, Homo sapiens
gagtgtgagccacctaag

SEQ ID NO: 2261284 - DNA, 23 bp, Homo sapiens
gagtgtgagccacctaagatctc

SEQ ID NO: 2261285 - DNA, 15 bp, Homo sapiens
gagtgtgctgacttt

SEQ ID NO: 2261286 - DNA, 16 bp, Homo sapiens
gagttatctaaaagaa

SEQ ID NO: 2261287 - DNA, 18 bp, Homo sapiens
gagttatctaaaagaaat

SEQ ID NO: 2261288 - DNA, 16 bp, Homo sapiens
gagttcaccatctctt

SEQ ID NO: 2261289 - DNA, 20 bp, Homo sapiens
gagtttttatgcctttctct

SEQ ID NO: 2261290 - DNA, 18 bp, Homo sapiens
gataaagaaaaaaatact

SEQ ID NO: 2261291 - DNA, 24 bp, Homo sapiens
aggttgagctcttcttaaagtatt

SEQ ID NO: 2261292 - DNA, 19 bp, Homo sapiens
aggtttggtgcaaagtatt

SEQ ID NO: 2261293 - DNA, 17 bp, Homo sapiens
agtaaaaataaaatact

SEQ ID NO: 2261294 - DNA, 21 bp, Homo sapiens
agtaaaattatcctctttgta

SEQ ID NO: 2261295 - DNA, 22 bp, Homo sapiens
agtaaaattatcctctttgtaa

SEQ ID NO: 2261296 - DNA, 21 bp, Homo sapiens
agtaaacgggaacatgccccc

SEQ ID NO: 2261297 - DNA, 14 bp, Homo sapiens
agtaaacttgaaaa

SEQ ID NO: 2261298 - DNA, 22 bp, Homo sapiens
agtaaagaacgtggtcagagta

SEQ ID NO: 2261299 - DNA, 15 bp, Homo sapiens
agtaaataattggaa

SEQ ID NO: 2261300 - DNA, 14 bp, Homo sapiens
agtaagcaaacaaa

SEQ ID NO: 2261301 - DNA, 23 bp, Homo sapiens
agtaccatagtaccatttataca

SEQ ID NO: 2261302 - DNA, 21 bp, Homo sapiens
agtaccatttatacaaattag

SEQ ID NO: 2261303 - DNA, 19 bp, Homo sapiens
agtactgaagccaaatgaa

SEQ ID NO: 2261304 - DNA, 20 bp, Homo sapiens
agtactgaagccaaatgaaa

SEQ ID NO: 2261305 - DNA, 22 bp, Homo sapiens
agtactgaagccaaatgaaact

SEQ ID NO: 2261306 - DNA, 15 bp, Homo sapiens
agtacttttttaaat

SEQ ID NO: 2261307 - DNA, 19 bp, Homo sapiens
agtagacatgaattttaaa

SEQ ID NO: 2261308 - DNA, 12 bp, Homo sapiens
agtagttcacat

SEQ ID NO: 2261309 - DNA, 13 bp, Homo sapiens
agtataaacaaag

SEQ ID NO: 2261310 - DNA, 12 bp, Homo sapiens
agtattcttctc

SEQ ID NO: 2261311 - DNA, 14 bp, Homo sapiens
agtattctttttct

SEQ ID NO: 2261312 - DNA, 21 bp, Homo sapiens
agtcaaacaaaaaagaaaagt

SEQ ID NO: 2261313 - DNA, 23 bp, Homo sapiens
agtcaaacaaaaaagaaaagtag

SEQ ID NO: 2261314 - DNA, 14 bp, Homo sapiens
agtcaaattaataa

SEQ ID NO: 2261315 - DNA, 15 bp, Homo sapiens
agtcaaattaataat

SEQ ID NO: 2261316 - DNA, 18 bp, Homo sapiens
agtcaaattaataatctt

SEQ ID NO: 2261317 - DNA, 17 bp, Homo sapiens
agtcaagatagaaaggg

SEQ ID NO: 2261318 - DNA, 16 bp, Homo sapiens
agtcaatatgtggaag

SEQ ID NO: 2261319 - DNA, 18 bp, Homo sapiens
agtcccagtatacctcat

SEQ ID NO: 2261320 - DNA, 21 bp, Homo sapiens
agtcccagtatacctcatttt

SEQ ID NO: 2261321 - DNA, 23 bp, Homo sapiens
agtctctgtataatctatttaca

SEQ ID NO: 2261322 - DNA, 17 bp, Homo sapiens
agtctcttgtattaaac

SEQ ID NO: 2261323 - DNA, 14 bp, Homo sapiens
agtctgtacctcaa

SEQ ID NO: 2261324 - DNA, 20 bp, Homo sapiens
agtctgtacctcaaatgaat

SEQ ID NO: 2261325 - DNA, 16 bp, Homo sapiens
agtctgttgattaaag

SEQ ID NO: 2261326 - DNA, 15 bp, Homo sapiens
agtcttgaaatgaaa

SEQ ID NO: 2261327 - DNA, 16 bp, Homo sapiens
agtgaaaaactgctgt

SEQ ID NO: 2261328 - DNA, 17 bp, Homo sapiens
agtgaaaaactgctgta

SEQ ID NO: 2261329 - DNA, 23 bp, Homo sapiens
agtgaagggaagagacagcccag

SEQ ID NO: 2261330 - DNA, 13 bp, Homo sapiens
agtgaccacttat

SEQ ID NO: 2261331 - DNA, 13 bp, Homo sapiens
agtgagacagact

SEQ ID NO: 2261332 - DNA, 17 bp, Homo sapiens
agtgatcaccagcgtga

SEQ ID NO: 2261333 - DNA, 13 bp, Homo sapiens
agtgatgtgctga

SEQ ID NO: 2261334 - DNA, 14 bp, Homo sapiens
agtgattactgtca

SEQ ID NO: 2261335 - DNA, 16 bp, Homo sapiens
agtgatttccatctct

SEQ ID NO: 2261336 - DNA, 19 bp, Homo sapiens
agtgatttccatctctggt

SEQ ID NO: 2261337 - DNA, 20 bp, Homo sapiens
agtgcactgcattcctgtgc

SEQ ID NO: 2261338 - DNA, 23 bp, Homo sapiens
agtggaaaataggctttttaatc

SEQ ID NO: 2261339 - DNA, 21 bp, Homo sapiens
agtggaccgcccttttcccct

SEQ ID NO: 2261340 - DNA, 22 bp, Homo sapiens
agtggaccgcccttttccccta

SEQ ID NO: 2261341 - DNA, 18 bp, Homo sapiens
agtggggttatctctgtg

SEQ ID NO: 2261342 - DNA, 16 bp, Homo sapiens
agtgtataatataaaa

SEQ ID NO: 2261343 - DNA, 14 bp, Homo sapiens
agtgtattatcact

SEQ ID NO: 2261344 - DNA, 18 bp, Homo sapiens
agtgtcccccacccccac

SEQ ID NO: 2261345 - DNA, 16 bp, Homo sapiens
agtgtcttctaacttt

SEQ ID NO: 2261346 - DNA, 15 bp, Homo sapiens
agtgtgctgactttt

SEQ ID NO: 2261347 - DNA, 21 bp, Homo sapiens
agtgtgtgattttttgcattc

SEQ ID NO: 2261348 - DNA, 17 bp, Homo sapiens
agtgttctgcaaaaata

SEQ ID NO: 2261349 - DNA, 17 bp, Homo sapiens
agtgttgagccttttcc

SEQ ID NO: 2261350 - DNA, 16 bp, Homo sapiens
agttaactcttcaaat

SEQ ID NO: 2261351 - DNA, 17 bp, Homo sapiens
agttaatgtatataaaa

SEQ ID NO: 2261352 - DNA, 20 bp, Homo sapiens
agttaatgtatataaaaatg

SEQ ID NO: 2261353 - DNA, 22 bp, Homo sapiens
agttacagcctgttagtaacat

SEQ ID NO: 2261354 - DNA, 16 bp, Homo sapiens
agttaccagtgcctta

SEQ ID NO: 2261355 - DNA, 22 bp, Homo sapiens
agttacccaacagaaacattct

SEQ ID NO: 2261356 - DNA, 23 bp, Homo sapiens
agttacctgagagatttaacatt

SEQ ID NO: 2261357 - DNA, 14 bp, Homo sapiens
agttactgtgtaaa

SEQ ID NO: 2261358 - DNA, 15 bp, Homo sapiens
agttactgtgtaaac

SEQ ID NO: 2261359 - DNA, 21 bp, Homo sapiens
agttagagaactaaactagtt

SEQ ID NO: 2261360 - DNA, 15 bp, Homo sapiens
agttagttccactga

SEQ ID NO: 2261361 - DNA, 19 bp, Homo sapiens
agttagttccactgagacc

SEQ ID NO: 2261362 - DNA, 18 bp, Homo sapiens
agttataaaattaaaagt

SEQ ID NO: 2261363 - DNA, 21 bp, Homo sapiens
agttatacagttataaaatta

SEQ ID NO: 2261364 - DNA, 13 bp, Homo sapiens
agttattgcagtt

SEQ ID NO: 2261365 - DNA, 15 bp, Homo sapiens
agttcaaactgcagc

SEQ ID NO: 2261366 - DNA, 13 bp, Homo sapiens
agttcaatcctac

SEQ ID NO: 2261367 - DNA, 15 bp, Homo sapiens
agttccactgagacc

SEQ ID NO: 2261368 - DNA, 13 bp, Homo sapiens
agttcctgggaac

SEQ ID NO: 2261369 - DNA, 19 bp, Homo sapiens
agttcctttagaaagcagt

SEQ ID NO: 2261370 - DNA, 21 bp, Homo sapiens
agttcttggtgactgtcccac

SEQ ID NO: 2261371 - DNA, 17 bp, Homo sapiens
agttctttttgtacact

SEQ ID NO: 2261372 - DNA, 20 bp, Homo sapiens
agttctttttgtacacttaa

SEQ ID NO: 2261373 - DNA, 23 bp, Homo sapiens
agttgaattgaggggattaatat

SEQ ID NO: 2261374 - DNA, 14 bp, Homo sapiens
agttgcatcagaaa

SEQ ID NO: 2261375 - DNA, 16 bp, Homo sapiens
agttgtaccaagtgaa

SEQ ID NO: 2261376 - DNA, 13 bp, Homo sapiens
agttgtcaggtta

SEQ ID NO: 2261377 - DNA, 21 bp, Homo sapiens
agttgttcgccgcgtggaatg

SEQ ID NO: 2261378 - DNA, 23 bp, Homo sapiens
agttgtttctagactataaatgt

SEQ ID NO: 2261379 - DNA, 16 bp, Homo sapiens
agtttaatcagaggaa

SEQ ID NO: 2261380 - DNA, 15 bp, Homo sapiens
agtttatcattcaag

SEQ ID NO: 2261381 - DNA, 11 bp, Homo sapiens
agtttgcttag

SEQ ID NO: 2261382 - DNA, 23 bp, Homo sapiens
agtttggctgctgtcataacatc

SEQ ID NO: 2261383 - DNA, 18 bp, Homo sapiens
agtttgttacctacctta

SEQ ID NO: 2261384 - DNA, 21 bp, Homo sapiens
agtttgttctccgggtgtggc

SEQ ID NO: 2261385 - DNA, 17 bp, Homo sapiens
agtttgttgctgtcaag

SEQ ID NO: 2261386 - DNA, 19 bp, Homo sapiens
agttttagaatcttttaaa

SEQ ID NO: 2261387 - DNA, 11 bp, Homo sapiens
agttttgttct

SEQ ID NO: 2261388 - DNA, 13 bp, Homo sapiens
ataaaataactaa

SEQ ID NO: 2261389 - DNA, 18 bp, Homo sapiens
ataaaatacatagtgaaa

SEQ ID NO: 2261390 - DNA, 16 bp, Homo sapiens
ataaaatttgttgcat

SEQ ID NO: 2261391 - DNA, 20 bp, Homo sapiens
ataaaccatttttgttactc

SEQ ID NO: 2261392 - DNA, 16 bp, Homo sapiens
ataaactataaaacaa

SEQ ID NO: 2261393 - DNA, 18 bp, Homo sapiens
ataaagaaaaaaatacta

SEQ ID NO: 2261394 - DNA, 17 bp, Homo sapiens
atatttgaggagtgtta

SEQ ID NO: 2261395 - DNA, 19 bp, Homo sapiens
atatttgcagtttttcatt

SEQ ID NO: 2261396 - DNA, 20 bp, Homo sapiens
atatttgtgatagcactttc

SEQ ID NO: 2261397 - DNA, 13 bp, Homo sapiens
atattttctctgt

SEQ ID NO: 2261398 - DNA, 18 bp, Homo sapiens
atattttctctgtacttt

SEQ ID NO: 2261399 - DNA, 12 bp, Homo sapiens
atattttctgtt

SEQ ID NO: 2261400 - DNA, 18 bp, Homo sapiens
atattttctttaatgctt

SEQ ID NO: 2261401 - DNA, 12 bp, Homo sapiens
atattttgaatc

SEQ ID NO: 2261402 - DNA, 13 bp, Homo sapiens
atattttgaatca

SEQ ID NO: 2261403 - DNA, 22 bp, Homo sapiens
atattttgttaccttttacaga

SEQ ID NO: 2261404 - DNA, 16 bp, Homo sapiens
atatttttatctatat

SEQ ID NO: 2261405 - DNA, 18 bp, Homo sapiens
ctcctatatatttctatt

SEQ ID NO: 2261406 - DNA, 11 bp, Homo sapiens
ctcctcatgta

SEQ ID NO: 2261407 - DNA, 11 bp, Homo sapiens
ctcctccccca

SEQ ID NO: 2261408 - DNA, 14 bp, Homo sapiens
ctcctcccccagtg

SEQ ID NO: 2261409 - DNA, 18 bp, Homo sapiens
ctcctctagctgtggggg

SEQ ID NO: 2261410 - DNA, 19 bp, Homo sapiens
ctcctctagctgtgggggt

SEQ ID NO: 2261411 - DNA, 12 bp, Homo sapiens
ctcctggccaga

SEQ ID NO: 2261412 - DNA, 22 bp, Homo sapiens
ctcctggctcttgatacccccc

SEQ ID NO: 2261413 - DNA, 18 bp, Homo sapiens
ctcctgggggtggcaggc

SEQ ID NO: 2261414 - DNA, 21 bp, Homo sapiens
ctcctgggggtggcaggcaca

SEQ ID NO: 2261415 - DNA, 14 bp, Homo sapiens
ctccttactgtgtt

SEQ ID NO: 2261416 - DNA, 18 bp, Homo sapiens
ctccttactgtgtttcag

SEQ ID NO: 2261417 - DNA, 12 bp, Homo sapiens
ctccttcagaca

SEQ ID NO: 2261418 - DNA, 13 bp, Homo sapiens
ctccttcagacac

SEQ ID NO: 2261419 - DNA, 14 bp, Homo sapiens
ctccttcagacacc

SEQ ID NO: 2261420 - DNA, 14 bp, Homo sapiens
ctccttccagtgtc

SEQ ID NO: 2261421 - DNA, 22 bp, Homo sapiens
ctccttctgctgtgtatcatgg

SEQ ID NO: 2261422 - DNA, 17 bp, Homo sapiens
ctcgagcccagatggaa

SEQ ID NO: 2261423 - DNA, 19 bp, Homo sapiens
ctcgcctgcgccgctgtgc

SEQ ID NO: 2261424 - DNA, 22 bp, Homo sapiens
ctcggctccccatgtgtcctgg

SEQ ID NO: 2261425 - DNA, 15 bp, Homo sapiens
ctcgtggactgtgct

SEQ ID NO: 2261426 - DNA, 22 bp, Homo sapiens
ctctaaagtctgttgattaaag

SEQ ID NO: 2261427 - DNA, 15 bp, Homo sapiens
ctctacatcttctgc

SEQ ID NO: 2261428 - DNA, 16 bp, Homo sapiens
ctctaggatgtatatt

SEQ ID NO: 2261429 - DNA, 17 bp, Homo sapiens
ctctagtgtattatcac

SEQ ID NO: 2261430 - DNA, 17 bp, Homo sapiens
ctctatttatgtttgca

SEQ ID NO: 2261431 - DNA, 14 bp, Homo sapiens
ctctatttgagaat

SEQ ID NO: 2261432 - DNA, 17 bp, Homo sapiens
ctctccccgggaccgcg

SEQ ID NO: 2261433 - DNA, 14 bp, Homo sapiens
ctctccctctctct

SEQ ID NO: 2261434 - DNA, 18 bp, Homo sapiens
ctctccttggccacagac

SEQ ID NO: 2261435 - DNA, 20 bp, Homo sapiens
ctctccttggccacagactg

SEQ ID NO: 2261436 - DNA, 17 bp, Homo sapiens
ctctctccagatgtttc

SEQ ID NO: 2261437 - DNA, 16 bp, Homo sapiens
ctctctccttggccac

SEQ ID NO: 2261438 - DNA, 15 bp, Homo sapiens
ctctctctcttcctc

SEQ ID NO: 2261439 - DNA, 11 bp, Homo sapiens
ctctctcttcc

SEQ ID NO: 2261440 - DNA, 20 bp, Homo sapiens
ctctctggaagcccctgggc

SEQ ID NO: 2261441 - DNA, 18 bp, Homo sapiens
ctctctggggccctgggc

SEQ ID NO: 2261442 - DNA, 23 bp, Homo sapiens
ctctctggggccctgggcctcag

SEQ ID NO: 2261443 - DNA, 18 bp, Homo sapiens
ctctctgtgtctttctct

SEQ ID NO: 2261444 - DNA, 13 bp, Homo sapiens
ctctcttttcatt

SEQ ID NO: 2261445 - DNA, 18 bp, Homo sapiens
ctctcttttcattgtgta

SEQ ID NO: 2261446 - DNA, 22 bp, Homo sapiens
ctctgacagccctgcggagacc

SEQ ID NO: 2261447 - DNA, 14 bp, Homo sapiens
ctctgacagtccac

SEQ ID NO: 2261448 - DNA, 22 bp, Homo sapiens
ctctgacagtccacaggggcca

SEQ ID NO: 2261449 - DNA, 12 bp, Homo sapiens
ctctgacctgca

SEQ ID NO: 2261450 - DNA, 15 bp, Homo sapiens
ctctgacctgcactg

SEQ ID NO: 2261451 - DNA, 16 bp, Homo sapiens
ctctgagactggcaga

SEQ ID NO: 2261452 - DNA, 19 bp, Homo sapiens
ctctggaggggtgtggctc

SEQ ID NO: 2261453 - DNA, 20 bp, Homo sapiens
ctctggaggggtgtggctcc

SEQ ID NO: 2261454 - DNA, 17 bp, Homo sapiens
ctctggggccctgggcc

SEQ ID NO: 2261455 - DNA, 18 bp, Homo sapiens
ctctggggccctgggcct

SEQ ID NO: 2261456 - DNA, 21 bp, Homo sapiens
ctctggtaaagttacactttt

SEQ ID NO: 2261457 - DNA, 22 bp, Homo sapiens
ctctgtataatctatttacata

SEQ ID NO: 2261458 - DNA, 15 bp, Homo sapiens
ctctgtcagccagcc

SEQ ID NO: 2261459 - DNA, 17 bp, Homo sapiens
ctctgtcagccagccgc

SEQ ID NO: 2261460 - DNA, 23 bp, Homo sapiens
ctctgtcagccagccgccctggg

SEQ ID NO: 2261461 - DNA, 16 bp, Homo sapiens
ctctgtctacctggtc

SEQ ID NO: 2261462 - DNA, 22 bp, Homo sapiens
ctctgtgagaaggtttattgtt

SEQ ID NO: 2261463 - DNA, 23 bp, Homo sapiens
ctctgtgagaaggtttattgtta

SEQ ID NO: 2261464 - DNA, 18 bp, Homo sapiens
ctcttcattcaaactgca

SEQ ID NO: 2261465 - DNA, 14 bp, Homo sapiens
ctcttctggctcaa

SEQ ID NO: 2261466 - DNA, 23 bp, Homo sapiens
ctcttgatacccccctctgtctt

SEQ ID NO: 2261467 - DNA, 21 bp, Homo sapiens
ctcttgtatccctagtgctcc

SEQ ID NO: 2261468 - DNA, 16 bp, Homo sapiens
ctctttgtaatttaat

SEQ ID NO: 2261469 - DNA, 18 bp, Homo sapiens
ctctttgtaatttaatga

SEQ ID NO: 2261470 - DNA, 17 bp, Homo sapiens
ctgaaaatattgtttta

SEQ ID NO: 2261471 - DNA, 20 bp, Homo sapiens
ctgaaaatattgttttacaa

SEQ ID NO: 2261472 - DNA, 18 bp, Homo sapiens
ctgaaagctggtggcaga

SEQ ID NO: 2261473 - DNA, 19 bp, Homo sapiens
ctgaacaataggctgttcc

SEQ ID NO: 2261474 - DNA, 21 bp, Homo sapiens
ctgaagtgagcacagcctagg

SEQ ID NO: 2261475 - DNA, 13 bp, Homo sapiens
ctgaataccactt

SEQ ID NO: 2261476 - DNA, 20 bp, Homo sapiens
ctgaataccacttacctcaa

SEQ ID NO: 2261477 - DNA, 20 bp, Homo sapiens
ctgacagccctgcggagacc

SEQ ID NO: 2261478 - DNA, 19 bp, Homo sapiens
ctgacagggacatgccctg

SEQ ID NO: 2261479 - DNA, 16 bp, Homo sapiens
ctgacatctggaatct

SEQ ID NO: 2261480 - DNA, 21 bp, Homo sapiens
ctgaccattttggatgtcatt

SEQ ID NO: 2261481 - DNA, 20 bp, Homo sapiens
ctgaccccaaacaccttcca

SEQ ID NO: 2261482 - DNA, 19 bp, Homo sapiens
ctgacccctgcctgttggc

SEQ ID NO: 2261483 - DNA, 22 bp, Homo sapiens
ctgacccctgcctgttggcagg

SEQ ID NO: 2261484 - DNA, 21 bp, Homo sapiens
ctgactccctgtgggggtggc

SEQ ID NO: 2261485 - DNA, 12 bp, Homo sapiens
ctgagagaaata

SEQ ID NO: 2261486 - DNA, 21 bp, Homo sapiens
ctgaggaaattgctttgtatt

SEQ ID NO: 2261487 - DNA, 18 bp, Homo sapiens
ctgaggacgagaccccca

SEQ ID NO: 2261488 - DNA, 15 bp, Homo sapiens
ctgaggcctagactc

SEQ ID NO: 2261489 - DNA, 19 bp, Homo sapiens
ctgaggcctagactctgtc

SEQ ID NO: 2261490 - DNA, 17 bp, Homo sapiens
ctgaggtgcctgtccca

SEQ ID NO: 2261491 - DNA, 19 bp, Homo sapiens
ctgaggtgcctgtcccacc

SEQ ID NO: 2261492 - DNA, 15 bp, Homo sapiens
ctgagtgaacctgta

SEQ ID NO: 2261493 - DNA, 14 bp, Homo sapiens
ctgatcccaccccc

SEQ ID NO: 2261494 - DNA, 20 bp, Homo sapiens
ctgatcccaccccctcctcc

SEQ ID NO: 2261495 - DNA, 15 bp, Homo sapiens
ctgatctggctgcag

SEQ ID NO: 2261496 - DNA, 15 bp, Homo sapiens
ctgatggagccttcc

SEQ ID NO: 2261497 - DNA, 22 bp, Homo sapiens
ctgatgggaaaactgccaatat

SEQ ID NO: 2261498 - DNA, 21 bp, Homo sapiens
ctgattaagttgtctaaacaa

SEQ ID NO: 2261499 - DNA, 20 bp, Homo sapiens
ctgcaaaaagaaaaaaagaa

SEQ ID NO: 2261500 - DNA, 21 bp, Homo sapiens
ctgcaagaaaatgatgtgtac

SEQ ID NO: 2261501 - DNA, 13 bp, Homo sapiens
ctgcaagaccacg

SEQ ID NO: 2261502 - DNA, 19 bp, Homo sapiens
ctgcaagaccacggaggga

SEQ ID NO: 2261503 - DNA, 17 bp, Homo sapiens
ctgcaattcccctctgc

SEQ ID NO: 2261504 - DNA, 20 bp, Homo sapiens
ctgcaattcccctctgctgc

SEQ ID NO: 2261505 - DNA, 16 bp, Homo sapiens
ctgcactgcatgcaaa

SEQ ID NO: 2261506 - DNA, 21 bp, Homo sapiens
ctgcacttttagccagagatg

SEQ ID NO: 2261507 - DNA, 13 bp, Homo sapiens
ctgcagctaaccc

SEQ ID NO: 2261508 - DNA, 19 bp, Homo sapiens
ctgcaggacttgagaagac

SEQ ID NO: 2261509 - DNA, 23 bp, Homo sapiens
ctgcaggacttgagaagacctca

SEQ ID NO: 2261510 - DNA, 20 bp, Homo sapiens
ctgcagttctttttgtacac

SEQ ID NO: 2261511 - DNA, 21 bp, Homo sapiens
ctgcagttctttttgtacact

SEQ ID NO: 2261512 - DNA, 17 bp, Homo sapiens
ctgcagttgactttctc

SEQ ID NO: 2261513 - DNA, 16 bp, Homo sapiens
ctgcattcctgtgccc

SEQ ID NO: 2261514 - DNA, 16 bp, Homo sapiens
gcaggcacacagcagc

SEQ ID NO: 2261515 - DNA, 17 bp, Homo sapiens
gcaggcacacagcagcc

SEQ ID NO: 2261516 - DNA, 18 bp, Homo sapiens
gcaggcacacagcagccc

SEQ ID NO: 2261517 - DNA, 20 bp, Homo sapiens
gcaggcacgggtggtccccg

SEQ ID NO: 2261518 - DNA, 18 bp, Homo sapiens
gcaggcaggaacaaacag

SEQ ID NO: 2261519 - DNA, 17 bp, Homo sapiens
gcaggctggcctatgtg

SEQ ID NO: 2261520 - DNA, 11 bp, Homo sapiens
gcaggctgggc

SEQ ID NO: 2261521 - DNA, 15 bp, Homo sapiens
gcaggctgggccatg

SEQ ID NO: 2261522 - DNA, 16 bp, Homo sapiens
gcagggaatgcagcag

SEQ ID NO: 2261523 - DNA, 17 bp, Homo sapiens
gcagggaatgcagcagg

SEQ ID NO: 2261524 - DNA, 16 bp, Homo sapiens
gcaggggtctgagcca

SEQ ID NO: 2261525 - DNA, 15 bp, Homo sapiens
gcaggtcctgcccat

SEQ ID NO: 2261526 - DNA, 16 bp, Homo sapiens
gcagttgactttctcc

SEQ ID NO: 2261527 - DNA, 16 bp, Homo sapiens
gcagtttatcattcaa

SEQ ID NO: 2261528 - DNA, 13 bp, Homo sapiens
gcataatgcaatc

SEQ ID NO: 2261529 - DNA, 17 bp, Homo sapiens
gcataatgcaatcaaaa

SEQ ID NO: 2261530 - DNA, 14 bp, Homo sapiens
gcatactttgtaaa

SEQ ID NO: 2261531 - DNA, 16 bp, Homo sapiens
gcatactttgtaaata

SEQ ID NO: 2261532 - DNA, 15 bp, Homo sapiens
gcatatgtgttactt

SEQ ID NO: 2261533 - DNA, 18 bp, Homo sapiens
gcatctgttagcagagtc

SEQ ID NO: 2261534 - DNA, 15 bp, Homo sapiens
gcatgaaatgtgaat

SEQ ID NO: 2261535 - DNA, 17 bp, Homo sapiens
gcatgtcttttaaaatg

SEQ ID NO: 2261536 - DNA, 15 bp, Homo sapiens
gcattagaattattt

SEQ ID NO: 2261537 - DNA, 18 bp, Homo sapiens
gcattcctgtgccctaga

SEQ ID NO: 2261538 - DNA, 15 bp, Homo sapiens
gcattgctcagcccg

SEQ ID NO: 2261539 - DNA, 21 bp, Homo sapiens
gcattgtatagatataatgaa

SEQ ID NO: 2261540 - DNA, 14 bp, Homo sapiens
gcatttaaggaaac

SEQ ID NO: 2261541 - DNA, 15 bp, Homo sapiens
gcatttggtgagagt

SEQ ID NO: 2261542 - DNA, 22 bp, Homo sapiens
gcatttggtgagagtcaaagct

SEQ ID NO: 2261543 - DNA, 22 bp, Homo sapiens
gcatttgtttctttctctgagg

SEQ ID NO: 2261544 - DNA, 15 bp, Homo sapiens
gcattttaaaagcaa

SEQ ID NO: 2261545 - DNA, 22 bp, Homo sapiens
gcattttaaaagcaattatatt

SEQ ID NO: 2261546 - DNA, 22 bp, Homo sapiens
gcattttgggggtttttaatct

SEQ ID NO: 2261547 - DNA, 12 bp, Homo sapiens
gcattttgtaat

SEQ ID NO: 2261548 - DNA, 17 bp, Homo sapiens
gccaaaattcatttcta

SEQ ID NO: 2261549 - DNA, 18 bp, Homo sapiens
gccaaaccaggaccctgt

SEQ ID NO: 2261550 - DNA, 19 bp, Homo sapiens
gccaaagagcctcccacca

SEQ ID NO: 2261551 - DNA, 12 bp, Homo sapiens
gccaaatgaaac

SEQ ID NO: 2261552 - DNA, 18 bp, Homo sapiens
gccaaccttcaaagaaac

SEQ ID NO: 2261553 - DNA, 19 bp, Homo sapiens
gccaaccttcaaagaaact

SEQ ID NO: 2261554 - DNA, 15 bp, Homo sapiens
gccaagacggaggag

SEQ ID NO: 2261555 - DNA, 22 bp, Homo sapiens
gccaagggcaacagatcagtaa

SEQ ID NO: 2261556 - DNA, 16 bp, Homo sapiens
gccacagtcactggat

SEQ ID NO: 2261557 - DNA, 13 bp, Homo sapiens
gccacccccaggc

SEQ ID NO: 2261558 - DNA, 15 bp, Homo sapiens
gccacgctgtcctct

SEQ ID NO: 2261559 - DNA, 21 bp, Homo sapiens
gccacgctgtcctctcgagcc

SEQ ID NO: 2261560 - DNA, 13 bp, Homo sapiens
gccactcatttca

SEQ ID NO: 2261561 - DNA, 15 bp, Homo sapiens
gccactcatttcatc

SEQ ID NO: 2261562 - DNA, 18 bp, Homo sapiens
gccacttctcactcacca

SEQ ID NO: 2261563 - DNA, 16 bp, Homo sapiens
gccagaccagcaggct

SEQ ID NO: 2261564 - DNA, 18 bp, Homo sapiens
gccagacgctgccgctgc

SEQ ID NO: 2261565 - DNA, 19 bp, Homo sapiens
gccagacgctgccgctgcc

SEQ ID NO: 2261566 - DNA, 14 bp, Homo sapiens
gccagatttgtctt

SEQ ID NO: 2261567 - DNA, 16 bp, Homo sapiens
gccagatttgtctttt

SEQ ID NO: 2261568 - DNA, 15 bp, Homo sapiens
gccagcaccctctcc

SEQ ID NO: 2261569 - DNA, 13 bp, Homo sapiens
gccagcctcagaa

SEQ ID NO: 2261570 - DNA, 19 bp, Homo sapiens
gccagcctcagaaggcccc

SEQ ID NO: 2261571 - DNA, 15 bp, Homo sapiens
gccagcgcctccctc

SEQ ID NO: 2261572 - DNA, 18 bp, Homo sapiens
gccagcgcctccctccac

SEQ ID NO: 2261573 - DNA, 23 bp, Homo sapiens
gccagctacttcctcctccccac

SEQ ID NO: 2261574 - DNA, 18 bp, Homo sapiens
gccaggcacccacatccc

SEQ ID NO: 2261575 - DNA, 16 bp, Homo sapiens
gccatacttgttctgt

SEQ ID NO: 2261576 - DNA, 12 bp, Homo sapiens
gccatccctggg

SEQ ID NO: 2261577 - DNA, 22 bp, Homo sapiens
gccatgatctgtatttaatggt

SEQ ID NO: 2261578 - DNA, 14 bp, Homo sapiens
gccatgccaataaa

SEQ ID NO: 2261579 - DNA, 22 bp, Homo sapiens
gccatgtccaaagaggctgccc

SEQ ID NO: 2261580 - DNA, 14 bp, Homo sapiens
gcccacaaactgat

SEQ ID NO: 2261581 - DNA, 15 bp, Homo sapiens
gcccactccccagcc

SEQ ID NO: 2261582 - DNA, 20 bp, Homo sapiens
gcccactccccagccccagc

SEQ ID NO: 2261583 - DNA, 16 bp, Homo sapiens
gcccagaataagttat

SEQ ID NO: 2261584 - DNA, 16 bp, Homo sapiens
gcccagccctccccat

SEQ ID NO: 2261585 - DNA, 20 bp, Homo sapiens
gcccaggatactggcacaga

SEQ ID NO: 2261586 - DNA, 23 bp, Homo sapiens
gcccaggatactggcacagaggt

SEQ ID NO: 2261587 - DNA, 21 bp, Homo sapiens
gcccaggcagacaaccttgtc

SEQ ID NO: 2261588 - DNA, 18 bp, Homo sapiens
gcccatgtgtcccctcac

SEQ ID NO: 2261589 - DNA, 19 bp, Homo sapiens
gccccaatccctttattac

SEQ ID NO: 2261590 - DNA, 20 bp, Homo sapiens
gccccaccccatccagccag

SEQ ID NO: 2261591 - DNA, 21 bp, Homo sapiens
gccccaccccatccagccaga

SEQ ID NO: 2261592 - DNA, 22 bp, Homo sapiens
gccccactcccttgctggcccc

SEQ ID NO: 2261593 - DNA, 12 bp, Homo sapiens
gccccagagaga

SEQ ID NO: 2261594 - DNA, 19 bp, Homo sapiens
gccccagagagaccctgca

SEQ ID NO: 2261595 - DNA, 16 bp, Homo sapiens
gccccagccctgctgg

SEQ ID NO: 2261596 - DNA, 20 bp, Homo sapiens
gccccagccctgctggggat

SEQ ID NO: 2261597 - DNA, 14 bp, Homo sapiens
gccccaggccctcc

SEQ ID NO: 2261598 - DNA, 12 bp, Homo sapiens
gccccccagcac

SEQ ID NO: 2261599 - DNA, 12 bp, Homo sapiens
gcccccctcctc

SEQ ID NO: 2261600 - DNA, 14 bp, Homo sapiens
gcccccctcctccc

SEQ ID NO: 2261601 - DNA, 20 bp, Homo sapiens
gcccccgggccgctggctgg

SEQ ID NO: 2261602 - DNA, 16 bp, Homo sapiens
gccccctcccccatgg

SEQ ID NO: 2261603 - DNA, 18 bp, Homo sapiens
gccccctcccccatgggc

SEQ ID NO: 2261604 - DNA, 20 bp, Homo sapiens
gccccctcctctagctgtgg

SEQ ID NO: 2261605 - DNA, 13 bp, Homo sapiens
gccccgactccag

SEQ ID NO: 2261606 - DNA, 17 bp, Homo sapiens
gccccgactccagccag

SEQ ID NO: 2261607 - DNA, 17 bp, Homo sapiens
gcccctccacgcctcct

SEQ ID NO: 2261608 - DNA, 23 bp, Homo sapiens
gcccctccacgcctcctggccag

SEQ ID NO: 2261609 - DNA, 15 bp, Homo sapiens
gcccctgcaatgtgg

SEQ ID NO: 2261610 - DNA, 13 bp, Homo sapiens
gcccgtctcagtg

SEQ ID NO: 2261611 - DNA, 14 bp, Homo sapiens
gcccgtctcagtgt

SEQ ID NO: 2261612 - DNA, 19 bp, Homo sapiens
gccctcaaagaagtcggaa

SEQ ID NO: 2261613 - DNA, 21 bp, Homo sapiens
gccctcaactattctgttcca

SEQ ID NO: 2261614 - DNA, 18 bp, Homo sapiens
gccctccccatggagcca

SEQ ID NO: 2261615 - DNA, 17 bp, Homo sapiens
gccctccctgactccct

SEQ ID NO: 2261616 - DNA, 19 bp, Homo sapiens
gccctccctgactccctgt

SEQ ID NO: 2261617 - DNA, 20 bp, Homo sapiens
gccctccctgactccctgtg

SEQ ID NO: 2261618 - DNA, 21 bp, Homo sapiens
gccctccctgactccctgtgg

SEQ ID NO: 2261619 - DNA, 14 bp, Homo sapiens
gccctgcggagacc

SEQ ID NO: 2261620 - DNA, 14 bp, Homo sapiens
gccctgggcctcag

SEQ ID NO: 2261621 - DNA, 15 bp, Homo sapiens
gccctgggcctcagt

SEQ ID NO: 2261622 - DNA, 20 bp, Homo sapiens
gccctgggctgtctgtcacc

SEQ ID NO: 2261623 - DNA, 14 bp, Homo sapiens
gccctggtttgttt

SEQ ID NO: 2261624 - DNA, 16 bp, Homo sapiens
gataagtgtatttttc

SEQ ID NO: 2261625 - DNA, 15 bp, Homo sapiens
gataatacagatttg

SEQ ID NO: 2261626 - DNA, 22 bp, Homo sapiens
gataatacagatttgtaacatt

SEQ ID NO: 2261627 - DNA, 19 bp, Homo sapiens
gataatctcagtgctttcc

SEQ ID NO: 2261628 - DNA, 23 bp, Homo sapiens
gatactgctactgtaattttata

SEQ ID NO: 2261629 - DNA, 13 bp, Homo sapiens
gatactggcacag

SEQ ID NO: 2261630 - DNA, 16 bp, Homo sapiens
gatagctaactgtaaa

SEQ ID NO: 2261631 - DNA, 14 bp, Homo sapiens
gatataatgaacaa

SEQ ID NO: 2261632 - DNA, 20 bp, Homo sapiens
gatatagcattaataaaact

SEQ ID NO: 2261633 - DNA, 22 bp, Homo sapiens
gatatagcattaataaaactgt

SEQ ID NO: 2261634 - DNA, 22 bp, Homo sapiens
gatatttttcataaacaagttc

SEQ ID NO: 2261635 - DNA, 23 bp, Homo sapiens
gatcaccgactgaaaatattgtt

SEQ ID NO: 2261636 - DNA, 16 bp, Homo sapiens
gatcagaggagtaaat

SEQ ID NO: 2261637 - DNA, 17 bp, Homo sapiens
gatcccaccccctcctc

SEQ ID NO: 2261638 - DNA, 18 bp, Homo sapiens
gatccccgcctggccagg

SEQ ID NO: 2261639 - DNA, 19 bp, Homo sapiens
gatccccgcctggccagga

SEQ ID NO: 2261640 - DNA, 20 bp, Homo sapiens
gatccccgcctggccaggag

SEQ ID NO: 2261641 - DNA, 13 bp, Homo sapiens
gatctgtctgtgg

SEQ ID NO: 2261642 - DNA, 18 bp, Homo sapiens
gatcttcattaccaatag

SEQ ID NO: 2261643 - DNA, 17 bp, Homo sapiens
gatcttcccacaggagg

SEQ ID NO: 2261644 - DNA, 23 bp, Homo sapiens
gatcttcccacaggagggccagc

SEQ ID NO: 2261645 - DNA, 18 bp, Homo sapiens
gatctttctttccaaaac

SEQ ID NO: 2261646 - DNA, 19 bp, Homo sapiens
gatctttctttccaaaaca

SEQ ID NO: 2261647 - DNA, 18 bp, Homo sapiens
gatgaaaactaaggattt

SEQ ID NO: 2261648 - DNA, 23 bp, Homo sapiens
gatgcacgtggggcccactgctc

SEQ ID NO: 2261649 - DNA, 22 bp, Homo sapiens
gatgcacttcaaattcaaataa

SEQ ID NO: 2261650 - DNA, 16 bp, Homo sapiens
gatgcaggctcccctg

SEQ ID NO: 2261651 - DNA, 20 bp, Homo sapiens
gatgcaggctcccctgagga

SEQ ID NO: 2261652 - DNA, 14 bp, Homo sapiens
gatgcatgtctttt

SEQ ID NO: 2261653 - DNA, 17 bp, Homo sapiens
gatgcatgtcttttaaa

SEQ ID NO: 2261654 - DNA, 18 bp, Homo sapiens
gatgccacttctcactca

SEQ ID NO: 2261655 - DNA, 21 bp, Homo sapiens
gatggagaggcggcctcgtgc

SEQ ID NO: 2261656 - DNA, 12 bp, Homo sapiens
gatgggccaggg

SEQ ID NO: 2261657 - DNA, 20 bp, Homo sapiens
gatgggggacgagggccagg

SEQ ID NO: 2261658 - DNA, 14 bp, Homo sapiens
gatgtaaagatgtt

SEQ ID NO: 2261659 - DNA, 15 bp, Homo sapiens
gatgtatgtaaatat

SEQ ID NO: 2261660 - DNA, 18 bp, Homo sapiens
gatgtggcaggagggcag

SEQ ID NO: 2261661 - DNA, 19 bp, Homo sapiens
gatgtggcaggagggcagt

SEQ ID NO: 2261662 - DNA, 14 bp, Homo sapiens
gattaatatgaaaa

SEQ ID NO: 2261663 - DNA, 21 bp, Homo sapiens
gattactagtcaaacaaaaaa

SEQ ID NO: 2261664 - DNA, 19 bp, Homo sapiens
gattaggtttcagcagagc

SEQ ID NO: 2261665 - DNA, 20 bp, Homo sapiens
gattatggaaaaataaaact

SEQ ID NO: 2261666 - DNA, 12 bp, Homo sapiens
gattcacacatg

SEQ ID NO: 2261667 - DNA, 21 bp, Homo sapiens
gattcacacatgccactatga

SEQ ID NO: 2261668 - DNA, 18 bp, Homo sapiens
gattcagtggaggctggc

SEQ ID NO: 2261669 - DNA, 20 bp, Homo sapiens
gattcttttaaattagaaaa

SEQ ID NO: 2261670 - DNA, 23 bp, Homo sapiens
gattgtaatatgtaaatggtatg

SEQ ID NO: 2261671 - DNA, 18 bp, Homo sapiens
gattgttcgggtgtgcaa

SEQ ID NO: 2261672 - DNA, 13 bp, Homo sapiens
gatttctacctca

SEQ ID NO: 2261673 - DNA, 17 bp, Homo sapiens
gatttgtaacattagtt

SEQ ID NO: 2261674 - DNA, 22 bp, Homo sapiens
gattttaatagggaatatatct

SEQ ID NO: 2261675 - DNA, 19 bp, Homo sapiens
gattttcacattcttggct

SEQ ID NO: 2261676 - DNA, 15 bp, Homo sapiens
gattttgctgtatat

SEQ ID NO: 2261677 - DNA, 16 bp, Homo sapiens
gattttgtaacccaga

SEQ ID NO: 2261678 - DNA, 19 bp, Homo sapiens
gcaaaaagaaaaaaagaaa

SEQ ID NO: 2261679 - DNA, 14 bp, Homo sapiens
gcaaaaatatttat

SEQ ID NO: 2261680 - DNA, 23 bp, Homo sapiens
gcaacaagccctgcttttgcata

SEQ ID NO: 2261681 - DNA, 18 bp, Homo sapiens
gcaacagattgaaaagac

SEQ ID NO: 2261682 - DNA, 14 bp, Homo sapiens
gcaaccactaagaa

SEQ ID NO: 2261683 - DNA, 18 bp, Homo sapiens
gcaagaaaaaaacttact

SEQ ID NO: 2261684 - DNA, 12 bp, Homo sapiens
gcaagaccacgg

SEQ ID NO: 2261685 - DNA, 19 bp, Homo sapiens
gcaagcctaagggatcctg

SEQ ID NO: 2261686 - DNA, 14 bp, Homo sapiens
gcaataaataacac

SEQ ID NO: 2261687 - DNA, 18 bp, Homo sapiens
gcaataatatcaaaacaa

SEQ ID NO: 2261688 - DNA, 13 bp, Homo sapiens
gcaatcaaaaata

SEQ ID NO: 2261689 - DNA, 13 bp, Homo sapiens
gcaatctctctct

SEQ ID NO: 2261690 - DNA, 22 bp, Homo sapiens
gcaatgtggtgacacctccccc

SEQ ID NO: 2261691 - DNA, 14 bp, Homo sapiens
gcacacaaatatta

SEQ ID NO: 2261692 - DNA, 14 bp, Homo sapiens
gcacacagcagccc

SEQ ID NO: 2261693 - DNA, 15 bp, Homo sapiens
gcacacagcagcccc

SEQ ID NO: 2261694 - DNA, 15 bp, Homo sapiens
gcacaccaccctccc

SEQ ID NO: 2261695 - DNA, 14 bp, Homo sapiens
gcacaggccccctt

SEQ ID NO: 2261696 - DNA, 16 bp, Homo sapiens
gcacagtgaagtgctg

SEQ ID NO: 2261697 - DNA, 21 bp, Homo sapiens
gcacatctggtctcggagctc

SEQ ID NO: 2261698 - DNA, 12 bp, Homo sapiens
gcaccaaagaca

SEQ ID NO: 2261699 - DNA, 22 bp, Homo sapiens
gcaccaaagacatcagtctcca

SEQ ID NO: 2261700 - DNA, 21 bp, Homo sapiens
gcaccacggcgtttttttaca

SEQ ID NO: 2261701 - DNA, 17 bp, Homo sapiens
gcaccagatgcaacctc

SEQ ID NO: 2261702 - DNA, 16 bp, Homo sapiens
gcaccctcccccgcag

SEQ ID NO: 2261703 - DNA, 15 bp, Homo sapiens
gcaccctctcctggg

SEQ ID NO: 2261704 - DNA, 16 bp, Homo sapiens
gcacgggtggtccccg

SEQ ID NO: 2261705 - DNA, 16 bp, Homo sapiens
gcacgtggggcccact

SEQ ID NO: 2261706 - DNA, 18 bp, Homo sapiens
gcacgtggggcccactgc

SEQ ID NO: 2261707 - DNA, 19 bp, Homo sapiens
gcactaacgttgagcccct

SEQ ID NO: 2261708 - DNA, 19 bp, Homo sapiens
gcactaaggccgtgtctct

SEQ ID NO: 2261709 - DNA, 13 bp, Homo sapiens
gcactgcatgcaa

SEQ ID NO: 2261710 - DNA, 17 bp, Homo sapiens
gcactgctttctccttc

SEQ ID NO: 2261711 - DNA, 18 bp, Homo sapiens
gcacttcatgtaaagtgt

SEQ ID NO: 2261712 - DNA, 22 bp, Homo sapiens
gcacttgatgtgatgtggcagg

SEQ ID NO: 2261713 - DNA, 21 bp, Homo sapiens
gcacttgtgattatttattat

SEQ ID NO: 2261714 - DNA, 18 bp, Homo sapiens
gcagaaaccctgagcaga

SEQ ID NO: 2261715 - DNA, 17 bp, Homo sapiens
gcagacaataaaccctc

SEQ ID NO: 2261716 - DNA, 17 bp, Homo sapiens
gcagacattttaaaaaa

SEQ ID NO: 2261717 - DNA, 13 bp, Homo sapiens
gcagagtctgtct

SEQ ID NO: 2261718 - DNA, 14 bp, Homo sapiens
gcagagtctgtctc

SEQ ID NO: 2261719 - DNA, 20 bp, Homo sapiens
gcagatatagcattaataaa

SEQ ID NO: 2261720 - DNA, 23 bp, Homo sapiens
gcagatatagcattaataaaact

SEQ ID NO: 2261721 - DNA, 21 bp, Homo sapiens
gcagatcgctcactgttgtga

SEQ ID NO: 2261722 - DNA, 15 bp, Homo sapiens
gcagcacagctgaga

SEQ ID NO: 2261723 - DNA, 13 bp, Homo sapiens
gcagcaccctccc

SEQ ID NO: 2261724 - DNA, 14 bp, Homo sapiens
gcagcaggctcagg

SEQ ID NO: 2261725 - DNA, 14 bp, Homo sapiens
gcagcgaccgcccc

SEQ ID NO: 2261726 - DNA, 21 bp, Homo sapiens
gcagctatgcgcaatgtggca

SEQ ID NO: 2261727 - DNA, 22 bp, Homo sapiens
gcagctatgcgcaatgtggcat

SEQ ID NO: 2261728 - DNA, 12 bp, Homo sapiens
gcagctggcaga

SEQ ID NO: 2261729 - DNA, 16 bp, Homo sapiens
gcaggaacaaacaggg

SEQ ID NO: 2261730 - DNA, 18 bp, Homo sapiens
gcaggaacaaacagggct

SEQ ID NO: 2261731 - DNA, 16 bp, Homo sapiens
gcaggaactctggacc

SEQ ID NO: 2261732 - DNA, 15 bp, Homo sapiens
gcaggaggagcccgg

SEQ ID NO: 2261733 - DNA, 14 bp, Homo sapiens
agatgtttccagac

SEQ ID NO: 2261734 - DNA, 15 bp, Homo sapiens
agattaagaaataga

SEQ ID NO: 2261735 - DNA, 18 bp, Homo sapiens
agattataataaatatat

SEQ ID NO: 2261736 - DNA, 12 bp, Homo sapiens
agattcttttaa

SEQ ID NO: 2261737 - DNA, 20 bp, Homo sapiens
agattgaacctgaatattgc

SEQ ID NO: 2261738 - DNA, 19 bp, Homo sapiens
agattgatatctataaaat

SEQ ID NO: 2261739 - DNA, 20 bp, Homo sapiens
agattgatatctataaaata

SEQ ID NO: 2261740 - DNA, 21 bp, Homo sapiens
agatttttaaaaaatattttc

SEQ ID NO: 2261741 - DNA, 18 bp, Homo sapiens
agattttttttgtaactt

SEQ ID NO: 2261742 - DNA, 19 bp, Homo sapiens
agattttttttgtaacttc

SEQ ID NO: 2261743 - DNA, 19 bp, Homo sapiens
agcaaagcacccatttcaa

SEQ ID NO: 2261744 - DNA, 20 bp, Homo sapiens
agcaaagcacccatttcaat

SEQ ID NO: 2261745 - DNA, 12 bp, Homo sapiens
agcaaataaaca

SEQ ID NO: 2261746 - DNA, 21 bp, Homo sapiens
agcaaggtttaaatttgttat

SEQ ID NO: 2261747 - DNA, 14 bp, Homo sapiens
agcaataaataaca

SEQ ID NO: 2261748 - DNA, 21 bp, Homo sapiens
agcaataaataacacttgtca

SEQ ID NO: 2261749 - DNA, 18 bp, Homo sapiens
agcaatactgtttccatt

SEQ ID NO: 2261750 - DNA, 20 bp, Homo sapiens
agcaatactgtttccatttt

SEQ ID NO: 2261751 - DNA, 13 bp, Homo sapiens
agcaatattgtat

SEQ ID NO: 2261752 - DNA, 23 bp, Homo sapiens
agcaatccatgagatagctatta

SEQ ID NO: 2261753 - DNA, 17 bp, Homo sapiens
agcaatctccttactgt

SEQ ID NO: 2261754 - DNA, 19 bp, Homo sapiens
agcaatctccttactgtgt

SEQ ID NO: 2261755 - DNA, 14 bp, Homo sapiens
agcaattatattgt

SEQ ID NO: 2261756 - DNA, 21 bp, Homo sapiens
agcacccatttcaatgtgtat

SEQ ID NO: 2261757 - DNA, 14 bp, Homo sapiens
agcaccctctcctg

SEQ ID NO: 2261758 - DNA, 16 bp, Homo sapiens
agcaccctctcctggg

SEQ ID NO: 2261759 - DNA, 17 bp, Homo sapiens
agcactaaggccgtgtc

SEQ ID NO: 2261760 - DNA, 13 bp, Homo sapiens
agcacttttcaaa

SEQ ID NO: 2261761 - DNA, 11 bp, Homo sapiens
agcagacattt

SEQ ID NO: 2261762 - DNA, 21 bp, Homo sapiens
agcagcccctcagcgccccca

SEQ ID NO: 2261763 - DNA, 15 bp, Homo sapiens
agcagcttattgttt

SEQ ID NO: 2261764 - DNA, 13 bp, Homo sapiens
agcagttttcaag

SEQ ID NO: 2261765 - DNA, 17 bp, Homo sapiens
agcagttttcaagtcaa

SEQ ID NO: 2261766 - DNA, 22 bp, Homo sapiens
agcagttttcaagtcaaattaa

SEQ ID NO: 2261767 - DNA, 14 bp, Homo sapiens
agcatactttgtaa

SEQ ID NO: 2261768 - DNA, 22 bp, Homo sapiens
agcatactttgtaaataggatt

SEQ ID NO: 2261769 - DNA, 20 bp, Homo sapiens
agcatatgtgttacttcaag

SEQ ID NO: 2261770 - DNA, 14 bp, Homo sapiens
agcatctgcaacaa

SEQ ID NO: 2261771 - DNA, 23 bp, Homo sapiens
agcatctggaagatcattttgaa

SEQ ID NO: 2261772 - DNA, 16 bp, Homo sapiens
agcatgaaatgtgaat

SEQ ID NO: 2261773 - DNA, 22 bp, Homo sapiens
agcatgaaatgtgaatttttat

SEQ ID NO: 2261774 - DNA, 14 bp, Homo sapiens
agcatgactatgta

SEQ ID NO: 2261775 - DNA, 20 bp, Homo sapiens
agcattaagctgttcctgtt

SEQ ID NO: 2261776 - DNA, 23 bp, Homo sapiens
agcattaataaaactgtgcatct

SEQ ID NO: 2261777 - DNA, 22 bp, Homo sapiens
agcattcatttgttttttcaat

SEQ ID NO: 2261778 - DNA, 23 bp, Homo sapiens
agccaaccttcaaagaaacttga

SEQ ID NO: 2261779 - DNA, 18 bp, Homo sapiens
agccaagacggaggaggg

SEQ ID NO: 2261780 - DNA, 12 bp, Homo sapiens
agccaatataac

SEQ ID NO: 2261781 - DNA, 15 bp, Homo sapiens
agccacagccgtgct

SEQ ID NO: 2261782 - DNA, 14 bp, Homo sapiens
agccacccccaggc

SEQ ID NO: 2261783 - DNA, 14 bp, Homo sapiens
agccacgctgtcct

SEQ ID NO: 2261784 - DNA, 15 bp, Homo sapiens
agccacgctgtcctc

SEQ ID NO: 2261785 - DNA, 20 bp, Homo sapiens
agccactggctgctaacaag

SEQ ID NO: 2261786 - DNA, 15 bp, Homo sapiens
agccacttgcctgtg

SEQ ID NO: 2261787 - DNA, 15 bp, Homo sapiens
agccagaccagatta

SEQ ID NO: 2261788 - DNA, 14 bp, Homo sapiens
agccagcatcggaa

SEQ ID NO: 2261789 - DNA, 10 bp, Homo sapiens
agccagcctc

SEQ ID NO: 2261790 - DNA, 12 bp, Homo sapiens
agccagcctggc

SEQ ID NO: 2261791 - DNA, 19 bp, Homo sapiens
agccagcctggctctgccc

SEQ ID NO: 2261792 - DNA, 12 bp, Homo sapiens
agccagcgcctc

SEQ ID NO: 2261793 - DNA, 14 bp, Homo sapiens
agccagcgcctccc

SEQ ID NO: 2261794 - DNA, 21 bp, Homo sapiens
agccagcgcctccctccaccc

SEQ ID NO: 2261795 - DNA, 14 bp, Homo sapiens
agccagctccctct

SEQ ID NO: 2261796 - DNA, 15 bp, Homo sapiens
agccagctccctcta

SEQ ID NO: 2261797 - DNA, 17 bp, Homo sapiens
agccagctccctctatt

SEQ ID NO: 2261798 - DNA, 22 bp, Homo sapiens
agccagctccctctatttatgt

SEQ ID NO: 2261799 - DNA, 21 bp, Homo sapiens
agccatccctttttttacatt

SEQ ID NO: 2261800 - DNA, 20 bp, Homo sapiens
agccatgccaataaagtgat

SEQ ID NO: 2261801 - DNA, 17 bp, Homo sapiens
agcccaggagcctcact

SEQ ID NO: 2261802 - DNA, 21 bp, Homo sapiens
agcccaggatactggcacaga

SEQ ID NO: 2261803 - DNA, 16 bp, Homo sapiens
agccccagccccttcc

SEQ ID NO: 2261804 - DNA, 14 bp, Homo sapiens
agccccgactccag

SEQ ID NO: 2261805 - DNA, 15 bp, Homo sapiens
agccccgactccagc

SEQ ID NO: 2261806 - DNA, 20 bp, Homo sapiens
agccccgactccagccagcg

SEQ ID NO: 2261807 - DNA, 20 bp, Homo sapiens
agcccctcagcgcccccaga

SEQ ID NO: 2261808 - DNA, 14 bp, Homo sapiens
agcccctgggccca

SEQ ID NO: 2261809 - DNA, 16 bp, Homo sapiens
agcccgcttggccacc

SEQ ID NO: 2261810 - DNA, 16 bp, Homo sapiens
agcccggacggcgggt

SEQ ID NO: 2261811 - DNA, 20 bp, Homo sapiens
agcccggacggcgggtagga

SEQ ID NO: 2261812 - DNA, 20 bp, Homo sapiens
agccctcaaagaagtcggaa

SEQ ID NO: 2261813 - DNA, 18 bp, Homo sapiens
agccctcaactattctgt

SEQ ID NO: 2261814 - DNA, 22 bp, Homo sapiens
agccctcccccttccccttctg

SEQ ID NO: 2261815 - DNA, 13 bp, Homo sapiens
agccgcacatctg

SEQ ID NO: 2261816 - DNA, 24 bp, Homo sapiens
agccgccctgggctgtctgtcacc

SEQ ID NO: 2261817 - DNA, 23 bp, Homo sapiens
agccgggaggaaaaggcccctgc

SEQ ID NO: 2261818 - DNA, 21 bp, Homo sapiens
agcctaagggatcctgcctgc

SEQ ID NO: 2261819 - DNA, 23 bp, Homo sapiens
agcctcagaaggccccagagaga

SEQ ID NO: 2261820 - DNA, 24 bp, Homo sapiens
agcctcagagcatttaaggaaact

SEQ ID NO: 2261821 - DNA, 18 bp, Homo sapiens
agcctccagggcattgct

SEQ ID NO: 2261822 - DNA, 20 bp, Homo sapiens
agcctccagggcattgctca

SEQ ID NO: 2261823 - DNA, 13 bp, Homo sapiens
agcctccccctca

SEQ ID NO: 2261824 - DNA, 15 bp, Homo sapiens
agcctccccctcaga

SEQ ID NO: 2261825 - DNA, 23 bp, Homo sapiens
agcctccccctcagatgatctct

SEQ ID NO: 2261826 - DNA, 20 bp, Homo sapiens
agcctcctcatcccgtgttc

SEQ ID NO: 2261827 - DNA, 20 bp, Homo sapiens
agcctctctccttggccaca

SEQ ID NO: 2261828 - DNA, 15 bp, Homo sapiens
agcctctgctcccca

SEQ ID NO: 2261829 - DNA, 15 bp, Homo sapiens
agcctgcattgagct

SEQ ID NO: 2261830 - DNA, 12 bp, Homo sapiens
agccttctgcag

SEQ ID NO: 2261831 - DNA, 14 bp, Homo sapiens
agccttctgcagca

SEQ ID NO: 2261832 - DNA, 15 bp, Homo sapiens
agccttctgcagcag

SEQ ID NO: 2261833 - DNA, 16 bp, Homo sapiens
agccttctgcagcagg

SEQ ID NO: 2261834 - DNA, 20 bp, Homo sapiens
agccttctgcagcaggaact

SEQ ID NO: 2261835 - DNA, 16 bp, Homo sapiens
agccttgctcaggtgc

SEQ ID NO: 2261836 - DNA, 23 bp, Homo sapiens
agccttttccctctttggctccc

SEQ ID NO: 2261837 - DNA, 19 bp, Homo sapiens
agcgaaatctaaatttctt

SEQ ID NO: 2261838 - DNA, 16 bp, Homo sapiens
agcgaagccttctgca

SEQ ID NO: 2261839 - DNA, 13 bp, Homo sapiens
agcgaggaaagga

SEQ ID NO: 2261840 - DNA, 19 bp, Homo sapiens
agcgaggaaaggattttac

SEQ ID NO: 2261841 - DNA, 15 bp, Homo sapiens
agttataaaattaaa

SEQ ID NO: 2261842 - DNA, 19 bp, Homo sapiens
agttataaaattaaaagtt

SEQ ID NO: 2261843 - DNA, 16 bp, Homo sapiens
agttatctaaaagaaa

SEQ ID NO: 2261844 - DNA, 14 bp, Homo sapiens
agttcaccatctct

SEQ ID NO: 2261845 - DNA, 20 bp, Homo sapiens
agttctacctcaggcagctc

SEQ ID NO: 2261846 - DNA, 17 bp, Homo sapiens
agttctgagctgccagt

SEQ ID NO: 2261847 - DNA, 18 bp, Homo sapiens
agttctgagctgccagtg

SEQ ID NO: 2261848 - DNA, 19 bp, Homo sapiens
agttcttggtgactgtccc

SEQ ID NO: 2261849 - DNA, 15 bp, Homo sapiens
agttctttttgtaca

SEQ ID NO: 2261850 - DNA, 16 bp, Homo sapiens
agttgaatataagaaa

SEQ ID NO: 2261851 - DNA, 17 bp, Homo sapiens
agttgaatataagaaaa

SEQ ID NO: 2261852 - DNA, 13 bp, Homo sapiens
agttgattagaaa

SEQ ID NO: 2261853 - DNA, 15 bp, Homo sapiens
agttggagccgcaca

SEQ ID NO: 2261854 - DNA, 20 bp, Homo sapiens
agttggagccgcacatctgg

SEQ ID NO: 2261855 - DNA, 19 bp, Homo sapiens
agttggtattaataaaaag

SEQ ID NO: 2261856 - DNA, 14 bp, Homo sapiens
agttgtgcttgagc

SEQ ID NO: 2261857 - DNA, 15 bp, Homo sapiens
agttgttagattaag

SEQ ID NO: 2261858 - DNA, 20 bp, Homo sapiens
agttgttagattaagaaata

SEQ ID NO: 2261859 - DNA, 14 bp, Homo sapiens
agtttaaaaaaatt

SEQ ID NO: 2261860 - DNA, 15 bp, Homo sapiens
agtttaaaaaaattg

SEQ ID NO: 2261861 - DNA, 22 bp, Homo sapiens
agtttaaaagttcttagttata

SEQ ID NO: 2261862 - DNA, 13 bp, Homo sapiens
agtttatttttgt

SEQ ID NO: 2261863 - DNA, 20 bp, Homo sapiens
agtttctgtcgttaaaaaca

SEQ ID NO: 2261864 - DNA, 22 bp, Homo sapiens
agtttctgtcgttaaaaacaga

SEQ ID NO: 2261865 - DNA, 23 bp, Homo sapiens
agtttctgtcgttaaaaacagat

SEQ ID NO: 2261866 - DNA, 18 bp, Homo sapiens
agtttgaaatatattatt

SEQ ID NO: 2261867 - DNA, 22 bp, Homo sapiens
agtttgaaatatattatttcct

SEQ ID NO: 2261868 - DNA, 15 bp, Homo sapiens
agtttggcatttgca

SEQ ID NO: 2261869 - DNA, 15 bp, Homo sapiens
agtttgttctccggg

SEQ ID NO: 2261870 - DNA, 21 bp, Homo sapiens
agtttgttgatctgataagca

SEQ ID NO: 2261871 - DNA, 22 bp, Homo sapiens
agttttcaagtcaaattaataa

SEQ ID NO: 2261872 - DNA, 13 bp, Homo sapiens
agttttgttctgt

SEQ ID NO: 2261873 - DNA, 12 bp, Homo sapiens
ataaaaagcaaa

SEQ ID NO: 2261874 - DNA, 13 bp, Homo sapiens
ataaaaagcaaaa

SEQ ID NO: 2261875 - DNA, 17 bp, Homo sapiens
ataaaataactaaaatg

SEQ ID NO: 2261876 - DNA, 18 bp, Homo sapiens
ataaaataactaaaatgt

SEQ ID NO: 2261877 - DNA, 19 bp, Homo sapiens
ataaaccatttttgttact

SEQ ID NO: 2261878 - DNA, 18 bp, Homo sapiens
ataaagcatttataaatt

SEQ ID NO: 2261879 - DNA, 15 bp, Homo sapiens
ataaagtattctttt

SEQ ID NO: 2261880 - DNA, 17 bp, Homo sapiens
ataaagtgatctgtgtt

SEQ ID NO: 2261881 - DNA, 20 bp, Homo sapiens
ataaagtgatctgtgttcaa

SEQ ID NO: 2261882 - DNA, 12 bp, Homo sapiens
ataaagtttgct

SEQ ID NO: 2261883 - DNA, 20 bp, Homo sapiens
ataaataaaatcatgtagtt

SEQ ID NO: 2261884 - DNA, 20 bp, Homo sapiens
ataaataacccataattgaa

SEQ ID NO: 2261885 - DNA, 16 bp, Homo sapiens
ataaatgattcttagt

SEQ ID NO: 2261886 - DNA, 21 bp, Homo sapiens
ataaatggtttggtgcttttt

SEQ ID NO: 2261887 - DNA, 21 bp, Homo sapiens
ataaattgtctttaaaaactg

SEQ ID NO: 2261888 - DNA, 23 bp, Homo sapiens
ataacactctaggatgtatattt

SEQ ID NO: 2261889 - DNA, 14 bp, Homo sapiens
ataacacttgtcag

SEQ ID NO: 2261890 - DNA, 16 bp, Homo sapiens
ataacataaatttttt

SEQ ID NO: 2261891 - DNA, 17 bp, Homo sapiens
ataacatccagagcttt

SEQ ID NO: 2261892 - DNA, 15 bp, Homo sapiens
ataactaaaatgtat

SEQ ID NO: 2261893 - DNA, 20 bp, Homo sapiens
ataactttgtctcgttcctg

SEQ ID NO: 2261894 - DNA, 15 bp, Homo sapiens
ataaggttttattca

SEQ ID NO: 2261895 - DNA, 18 bp, Homo sapiens
ataagtggaggcacttta

SEQ ID NO: 2261896 - DNA, 16 bp, Homo sapiens
ataagttattgcagtt

SEQ ID NO: 2261897 - DNA, 12 bp, Homo sapiens
ataataaaatca

SEQ ID NO: 2261898 - DNA, 23 bp, Homo sapiens
ataataaagaatagctttaatga

SEQ ID NO: 2261899 - DNA, 20 bp, Homo sapiens
ataatacagatttgtaacat

SEQ ID NO: 2261900 - DNA, 13 bp, Homo sapiens
ataatataaaaaa

SEQ ID NO: 2261901 - DNA, 15 bp, Homo sapiens
ataatatattgtgtt

SEQ ID NO: 2261902 - DNA, 19 bp, Homo sapiens
ataatccttgataatatat

SEQ ID NO: 2261903 - DNA, 14 bp, Homo sapiens
ataatctatttaca

SEQ ID NO: 2261904 - DNA, 15 bp, Homo sapiens
ataatcttattaggg

SEQ ID NO: 2261905 - DNA, 16 bp, Homo sapiens
ataatgatgatgatga

SEQ ID NO: 2261906 - DNA, 17 bp, Homo sapiens
ataatgtccatatgcta

SEQ ID NO: 2261907 - DNA, 14 bp, Homo sapiens
ataattaattgtca

SEQ ID NO: 2261908 - DNA, 14 bp, Homo sapiens
ataattttcctcaa

SEQ ID NO: 2261909 - DNA, 13 bp, Homo sapiens
ataattttgtaat

SEQ ID NO: 2261910 - DNA, 17 bp, Homo sapiens
atacaaattagaaaatg

SEQ ID NO: 2261911 - DNA, 22 bp, Homo sapiens
atacaagtgataatacagattt

SEQ ID NO: 2261912 - DNA, 18 bp, Homo sapiens
atacacaagcaatgcaag

SEQ ID NO: 2261913 - DNA, 13 bp, Homo sapiens
atacagaggagat

SEQ ID NO: 2261914 - DNA, 16 bp, Homo sapiens
atacagaggtaactat

SEQ ID NO: 2261915 - DNA, 14 bp, Homo sapiens
atacagatttgtaa

SEQ ID NO: 2261916 - DNA, 19 bp, Homo sapiens
atacagatttgtaacatta

SEQ ID NO: 2261917 - DNA, 17 bp, Homo sapiens
atacagttataaaatta

SEQ ID NO: 2261918 - DNA, 18 bp, Homo sapiens
atacatagtgaaaattgt

SEQ ID NO: 2261919 - DNA, 16 bp, Homo sapiens
atacatatctttatta

SEQ ID NO: 2261920 - DNA, 21 bp, Homo sapiens
atacatttaaaacattaaaat

SEQ ID NO: 2261921 - DNA, 13 bp, Homo sapiens
atacccccctctg

SEQ ID NO: 2261922 - DNA, 13 bp, Homo sapiens
atacgttttgaca

SEQ ID NO: 2261923 - DNA, 15 bp, Homo sapiens
atactactttctctt

SEQ ID NO: 2261924 - DNA, 16 bp, Homo sapiens
atactatttaagatgt

SEQ ID NO: 2261925 - DNA, 15 bp, Homo sapiens
atactggcctggact

SEQ ID NO: 2261926 - DNA, 13 bp, Homo sapiens
atacttgttctgt

SEQ ID NO: 2261927 - DNA, 17 bp, Homo sapiens
atacttgtttcagcttc

SEQ ID NO: 2261928 - DNA, 22 bp, Homo sapiens
atacttgtttcagcttctctgc

SEQ ID NO: 2261929 - DNA, 22 bp, Homo sapiens
atactttgcagcacagctgaga

SEQ ID NO: 2261930 - DNA, 12 bp, Homo sapiens
atacttttgcaa

SEQ ID NO: 2261931 - DNA, 12 bp, Homo sapiens
atagaaatgtct

SEQ ID NO: 2261932 - DNA, 22 bp, Homo sapiens
atagaaatgtctcaaggcagtt

SEQ ID NO: 2261933 - DNA, 15 bp, Homo sapiens
atagctaactgtaaa

SEQ ID NO: 2261934 - DNA, 14 bp, Homo sapiens
ataggcaaattaat

SEQ ID NO: 2261935 - DNA, 20 bp, Homo sapiens
ataggcaccttttactgtga

SEQ ID NO: 2261936 - DNA, 11 bp, Homo sapiens
ataggcagggg

SEQ ID NO: 2261937 - DNA, 17 bp, Homo sapiens
atagggaatatatctct

SEQ ID NO: 2261938 - DNA, 19 bp, Homo sapiens
atagtaccatttatacaaa

SEQ ID NO: 2261939 - DNA, 16 bp, Homo sapiens
atagttactgtgtaaa

SEQ ID NO: 2261940 - DNA, 17 bp, Homo sapiens
atagttatacatcaatt

SEQ ID NO: 2261941 - DNA, 15 bp, Homo sapiens
atataaagtattctt

SEQ ID NO: 2261942 - DNA, 20 bp, Homo sapiens
atataaagtattctttttct

SEQ ID NO: 2261943 - DNA, 16 bp, Homo sapiens
atataagaaaatgctt

SEQ ID NO: 2261944 - DNA, 20 bp, Homo sapiens
atataccactctttaccttt

SEQ ID NO: 2261945 - DNA, 19 bp, Homo sapiens
atatatccccactactcaa

SEQ ID NO: 2261946 - DNA, 16 bp, Homo sapiens
atatatctatctattt

SEQ ID NO: 2261947 - DNA, 20 bp, Homo sapiens
atatatctatctatttgagg

SEQ ID NO: 2261948 - DNA, 12 bp, Homo sapiens
atatatttaaaa

SEQ ID NO: 2261949 - DNA, 15 bp, Homo sapiens
atatattttctgttt

SEQ ID NO: 2261950 - DNA, 16 bp, Homo sapiens
atgaaggatccatctt

SEQ ID NO: 2261951 - DNA, 12 bp, Homo sapiens
atgaatactttg

SEQ ID NO: 2261952 - DNA, 16 bp, Homo sapiens
atgaatccaactgctt

SEQ ID NO: 2261953 - DNA, 17 bp, Homo sapiens
atgaatgtatttatttg

SEQ ID NO: 2261954 - DNA, 15 bp, Homo sapiens
atgaattttaaataa

SEQ ID NO: 2261955 - DNA, 17 bp, Homo sapiens
atgaattttaaataatg

SEQ ID NO: 2261956 - DNA, 20 bp, Homo sapiens
atgacaccatcttttattct

SEQ ID NO: 2261957 - DNA, 20 bp, Homo sapiens
atgacacccatgccagagag

SEQ ID NO: 2261958 - DNA, 15 bp, Homo sapiens
atgacaggcctgtcc

SEQ ID NO: 2261959 - DNA, 13 bp, Homo sapiens
atgactttttata

SEQ ID NO: 2261960 - DNA, 15 bp, Homo sapiens
atgactttttataaa

SEQ ID NO: 2261961 - DNA, 16 bp, Homo sapiens
atgagatttttaaaaa

SEQ ID NO: 2261962 - DNA, 20 bp, Homo sapiens
atgagatttttaaaaaatat

SEQ ID NO: 2261963 - DNA, 14 bp, Homo sapiens
atgatgatgaaaac

SEQ ID NO: 2261964 - DNA, 17 bp, Homo sapiens
atgattgtactttgaat

SEQ ID NO: 2261965 - DNA, 17 bp, Homo sapiens
atgatttaatttgaaat

SEQ ID NO: 2261966 - DNA, 15 bp, Homo sapiens
atgcaaccatttgaa

SEQ ID NO: 2261967 - DNA, 17 bp, Homo sapiens
atgcaacttttaattac

SEQ ID NO: 2261968 - DNA, 21 bp, Homo sapiens
atgcaatcaaaaatatgtgtt

SEQ ID NO: 2261969 - DNA, 14 bp, Homo sapiens
atgcatctagatta

SEQ ID NO: 2261970 - DNA, 15 bp, Homo sapiens
atgcatgtcttttaa

SEQ ID NO: 2261971 - DNA, 18 bp, Homo sapiens
atgccaataaagtgatct

SEQ ID NO: 2261972 - DNA, 19 bp, Homo sapiens
atgccatttagcaataaat

SEQ ID NO: 2261973 - DNA, 21 bp, Homo sapiens
atgcctcactaatttttgtat

SEQ ID NO: 2261974 - DNA, 23 bp, Homo sapiens
atgcctcagccacttgcctgtgc

SEQ ID NO: 2261975 - DNA, 16 bp, Homo sapiens
atgcctgtaaagtctg

SEQ ID NO: 2261976 - DNA, 12 bp, Homo sapiens
atgcctttctct

SEQ ID NO: 2261977 - DNA, 13 bp, Homo sapiens
atgctatttgaac

SEQ ID NO: 2261978 - DNA, 15 bp, Homo sapiens
atgctatttgaacaa

SEQ ID NO: 2261979 - DNA, 19 bp, Homo sapiens
atgctgcaggacttgagaa

SEQ ID NO: 2261980 - DNA, 12 bp, Homo sapiens
atgctggccagc

SEQ ID NO: 2261981 - DNA, 22 bp, Homo sapiens
atgctggccagcaccctctcct

SEQ ID NO: 2261982 - DNA, 19 bp, Homo sapiens
atgctgggctctgttcttg

SEQ ID NO: 2261983 - DNA, 17 bp, Homo sapiens
atggaaccttccctcca

SEQ ID NO: 2261984 - DNA, 18 bp, Homo sapiens
atggaagcaattgctcat

SEQ ID NO: 2261985 - DNA, 19 bp, Homo sapiens
atggactaattgacttgca

SEQ ID NO: 2261986 - DNA, 16 bp, Homo sapiens
atggagagaattaaaa

SEQ ID NO: 2261987 - DNA, 19 bp, Homo sapiens
atggagatttggaattgaa

SEQ ID NO: 2261988 - DNA, 15 bp, Homo sapiens
atggagccagctccc

SEQ ID NO: 2261989 - DNA, 18 bp, Homo sapiens
atggagccagctccctct

SEQ ID NO: 2261990 - DNA, 16 bp, Homo sapiens
atggatatcacacata

SEQ ID NO: 2261991 - DNA, 13 bp, Homo sapiens
atggatcagagga

SEQ ID NO: 2261992 - DNA, 14 bp, Homo sapiens
atggccaaacccaa

SEQ ID NO: 2261993 - DNA, 18 bp, Homo sapiens
atggcccctctgacctgc

SEQ ID NO: 2261994 - DNA, 23 bp, Homo sapiens
atggcccctctgacctgcactgg

SEQ ID NO: 2261995 - DNA, 20 bp, Homo sapiens
atgggatccaattttaatat

SEQ ID NO: 2261996 - DNA, 18 bp, Homo sapiens
atgggccttttagaaacc

SEQ ID NO: 2261997 - DNA, 23 bp, Homo sapiens
atgggctcgccgtgtctcagcct

SEQ ID NO: 2261998 - DNA, 14 bp, Homo sapiens
atgggctgtgtcct

SEQ ID NO: 2261999 - DNA, 21 bp, Homo sapiens
atgggggacgagggccaggca

SEQ ID NO: 2262000 - DNA, 21 bp, Homo sapiens
atggtatcaaaattacatata

SEQ ID NO: 2262001 - DNA, 16 bp, Homo sapiens
atggtatgctggccag

SEQ ID NO: 2262002 - DNA, 23 bp, Homo sapiens
atggtatgctggccagcaccctc

SEQ ID NO: 2262003 - DNA, 23 bp, Homo sapiens
atggtttgactcatcttatatgg

SEQ ID NO: 2262004 - DNA, 22 bp, Homo sapiens
atggtttggtgctttttataaa

SEQ ID NO: 2262005 - DNA, 13 bp, Homo sapiens
atggttttaagaa

SEQ ID NO: 2262006 - DNA, 20 bp, Homo sapiens
atggtttttatttctcgggt

SEQ ID NO: 2262007 - DNA, 16 bp, Homo sapiens
atgtaaagtgtcagaa

SEQ ID NO: 2262008 - DNA, 22 bp, Homo sapiens
atgtaatggactatgcacactt

SEQ ID NO: 2262009 - DNA, 12 bp, Homo sapiens
atgtaattttgt

SEQ ID NO: 2262010 - DNA, 15 bp, Homo sapiens
atgtaattttgtgta

SEQ ID NO: 2262011 - DNA, 16 bp, Homo sapiens
atgtaattttgtgtaa

SEQ ID NO: 2262012 - DNA, 15 bp, Homo sapiens
atgtagaataggcag

SEQ ID NO: 2262013 - DNA, 18 bp, Homo sapiens
atgtagccccctggcctc

SEQ ID NO: 2262014 - DNA, 20 bp, Homo sapiens
atgtataaaatacatagtga

SEQ ID NO: 2262015 - DNA, 14 bp, Homo sapiens
atgtatctaagaat

SEQ ID NO: 2262016 - DNA, 16 bp, Homo sapiens
atgtatctaagaataa

SEQ ID NO: 2262017 - DNA, 23 bp, Homo sapiens
atgtattttacacaaatgtgatt

SEQ ID NO: 2262018 - DNA, 16 bp, Homo sapiens
atgtatttttctatgt

SEQ ID NO: 2262019 - DNA, 19 bp, Homo sapiens
atgtcatagtcttgaaatg

SEQ ID NO: 2262020 - DNA, 14 bp, Homo sapiens
atgtcatttgagca

SEQ ID NO: 2262021 - DNA, 12 bp, Homo sapiens
atgtccaaagag

SEQ ID NO: 2262022 - DNA, 15 bp, Homo sapiens
atgtctgagtgaacc

SEQ ID NO: 2262023 - DNA, 14 bp, Homo sapiens
atgtcttctcacaa

SEQ ID NO: 2262024 - DNA, 20 bp, Homo sapiens
atgtcttctcacaagccagc

SEQ ID NO: 2262025 - DNA, 19 bp, Homo sapiens
atgtctttccaaattattt

SEQ ID NO: 2262026 - DNA, 13 bp, Homo sapiens
atgtcttttaaaa

SEQ ID NO: 2262027 - DNA, 14 bp, Homo sapiens
atgtgaaaaatctg

SEQ ID NO: 2262028 - DNA, 15 bp, Homo sapiens
atgtgaactttatta

SEQ ID NO: 2262029 - DNA, 17 bp, Homo sapiens
atgtgaactttattaaa

SEQ ID NO: 2262030 - DNA, 16 bp, Homo sapiens
atgtgatgtggcagga

SEQ ID NO: 2262031 - DNA, 23 bp, Homo sapiens
atgtgatgtggcaggagggcagt

SEQ ID NO: 2262032 - DNA, 13 bp, Homo sapiens
atgtgatttttgt

SEQ ID NO: 2262033 - DNA, 16 bp, Homo sapiens
atgtgatttttgtaat

SEQ ID NO: 2262034 - DNA, 18 bp, Homo sapiens
atgtggcaggagggcagt

SEQ ID NO: 2262035 - DNA, 15 bp, Homo sapiens
atgtgtaaagattta

SEQ ID NO: 2262036 - DNA, 13 bp, Homo sapiens
atgtgtataaatt

SEQ ID NO: 2262037 - DNA, 14 bp, Homo sapiens
atgtgtcccctcac

SEQ ID NO: 2262038 - DNA, 14 bp, Homo sapiens
atgtgtctttctaa

SEQ ID NO: 2262039 - DNA, 19 bp, Homo sapiens
atgtgtctttctaagaaat

SEQ ID NO: 2262040 - DNA, 14 bp, Homo sapiens
atgtgtggcctgca

SEQ ID NO: 2262041 - DNA, 16 bp, Homo sapiens
atgttaacctctgctt

SEQ ID NO: 2262042 - DNA, 22 bp, Homo sapiens
atgttgctatgtgccttatgtt

SEQ ID NO: 2262043 - DNA, 22 bp, Homo sapiens
atgttggcttggggcaacagat

SEQ ID NO: 2262044 - DNA, 12 bp, Homo sapiens
atgttgggactg

SEQ ID NO: 2262045 - DNA, 14 bp, Homo sapiens
atgttgtacaatca

SEQ ID NO: 2262046 - DNA, 18 bp, Homo sapiens
atgttgtacaatcaaaac

SEQ ID NO: 2262047 - DNA, 19 bp, Homo sapiens
atgttgtagtgtcccccac

SEQ ID NO: 2262048 - DNA, 15 bp, Homo sapiens
atgttgttcaaatgc

SEQ ID NO: 2262049 - DNA, 22 bp, Homo sapiens
atgtttcgagtaaacttgaaaa

SEQ ID NO: 2262050 - DNA, 16 bp, Homo sapiens
atgtttggcatgtaaa

SEQ ID NO: 2262051 - DNA, 13 bp, Homo sapiens
atgttttaaagaa

SEQ ID NO: 2262052 - DNA, 16 bp, Homo sapiens
atgttttgaaagacag

SEQ ID NO: 2262053 - DNA, 19 bp, Homo sapiens
attaaaaaagcatacttct

SEQ ID NO: 2262054 - DNA, 18 bp, Homo sapiens
attaaaatataatctcta

SEQ ID NO: 2262055 - DNA, 23 bp, Homo sapiens
attaaactcttcacaaaatctgt

SEQ ID NO: 2262056 - DNA, 21 bp, Homo sapiens
attaaagttgtttcccactct

SEQ ID NO: 2262057 - DNA, 19 bp, Homo sapiens
attaaatacaaaacttcca

SEQ ID NO: 2262058 - DNA, 16 bp, Homo sapiens
attaaatgtgtcattg

SEQ ID NO: 2262059 - DNA, 11 bp, Homo sapiens
caccccctcct

SEQ ID NO: 2262060 - DNA, 15 bp, Homo sapiens
caccccctcctcccc

SEQ ID NO: 2262061 - DNA, 14 bp, Homo sapiens
caccccctttcctg

SEQ ID NO: 2262062 - DNA, 18 bp, Homo sapiens
caccctcaacctcttctg

SEQ ID NO: 2262063 - DNA, 17 bp, Homo sapiens
caccctgtactgttctg

SEQ ID NO: 2262064 - DNA, 21 bp, Homo sapiens
caccctgtactgttctgtgtc

SEQ ID NO: 2262065 - DNA, 15 bp, Homo sapiens
caccgactgaaaata

SEQ ID NO: 2262066 - DNA, 22 bp, Homo sapiens
caccgagtgatttccatctctg

SEQ ID NO: 2262067 - DNA, 13 bp, Homo sapiens
caccgggagcctc

SEQ ID NO: 2262068 - DNA, 21 bp, Homo sapiens
caccgggagcctccccctcag

SEQ ID NO: 2262069 - DNA, 22 bp, Homo sapiens
cacctccccctttcacactgga

SEQ ID NO: 2262070 - DNA, 23 bp, Homo sapiens
cacctccccctttcacactggat

SEQ ID NO: 2262071 - DNA, 14 bp, Homo sapiens
cacctcctcatgta

SEQ ID NO: 2262072 - DNA, 22 bp, Homo sapiens
cacctcctgtgttgtgctggga

SEQ ID NO: 2262073 - DNA, 14 bp, Homo sapiens
caccttccagctcc

SEQ ID NO: 2262074 - DNA, 13 bp, Homo sapiens
caccttctttgta

SEQ ID NO: 2262075 - DNA, 23 bp, Homo sapiens
cacctttggctggtagcagcagg

SEQ ID NO: 2262076 - DNA, 15 bp, Homo sapiens
cacgcctcctggcca

SEQ ID NO: 2262077 - DNA, 17 bp, Homo sapiens
cacgcctcctggccaga

SEQ ID NO: 2262078 - DNA, 13 bp, Homo sapiens
cacgctgtcctct

SEQ ID NO: 2262079 - DNA, 18 bp, Homo sapiens
cacgctgtcctctcgagc

SEQ ID NO: 2262080 - DNA, 22 bp, Homo sapiens
cacgctgtcctctcgagcccag

SEQ ID NO: 2262081 - DNA, 19 bp, Homo sapiens
cacggagcccagccctccc

SEQ ID NO: 2262082 - DNA, 17 bp, Homo sapiens
cacggcgggatcctcca

SEQ ID NO: 2262083 - DNA, 22 bp, Homo sapiens
cacggcgggatcctccacagag

SEQ ID NO: 2262084 - DNA, 17 bp, Homo sapiens
cacggcgtttttttaca

SEQ ID NO: 2262085 - DNA, 15 bp, Homo sapiens
cacgggtggtccccg

SEQ ID NO: 2262086 - DNA, 23 bp, Homo sapiens
cacggtttcgaagtcattaaact

SEQ ID NO: 2262087 - DNA, 21 bp, Homo sapiens
cactaaggccgtgtctctgag

SEQ ID NO: 2262088 - DNA, 12 bp, Homo sapiens
cactactacctc

SEQ ID NO: 2262089 - DNA, 19 bp, Homo sapiens
cactactcaatactacctc

SEQ ID NO: 2262090 - DNA, 19 bp, Homo sapiens
cactatggtatgctggcca

SEQ ID NO: 2262091 - DNA, 20 bp, Homo sapiens
cactcaccactaccagccag

SEQ ID NO: 2262092 - DNA, 12 bp, Homo sapiens
cactcagacctg

SEQ ID NO: 2262093 - DNA, 17 bp, Homo sapiens
cactcatttcatctcat

SEQ ID NO: 2262094 - DNA, 17 bp, Homo sapiens
cactccccagccccagc

SEQ ID NO: 2262095 - DNA, 17 bp, Homo sapiens
cactcccttgctggccc

SEQ ID NO: 2262096 - DNA, 16 bp, Homo sapiens
cactctgtcagccagc

SEQ ID NO: 2262097 - DNA, 23 bp, Homo sapiens
cactctgtcagccagccgccctg

SEQ ID NO: 2262098 - DNA, 15 bp, Homo sapiens
cactctttaccttta

SEQ ID NO: 2262099 - DNA, 18 bp, Homo sapiens
cactgcattcctgtgccc

SEQ ID NO: 2262100 - DNA, 21 bp, Homo sapiens
cactgctcgtggactgtgctg

SEQ ID NO: 2262101 - DNA, 20 bp, Homo sapiens
cactgcttgaactaggctga

SEQ ID NO: 2262102 - DNA, 21 bp, Homo sapiens
cactggggcagacaataaacc

SEQ ID NO: 2262103 - DNA, 14 bp, Homo sapiens
cactggggcctaca

SEQ ID NO: 2262104 - DNA, 13 bp, Homo sapiens
cactgggtgagag

SEQ ID NO: 2262105 - DNA, 15 bp, Homo sapiens
cactgttgtgaatca

SEQ ID NO: 2262106 - DNA, 16 bp, Homo sapiens
cactgtttaatcatag

SEQ ID NO: 2262107 - DNA, 18 bp, Homo sapiens
cactgtttgtttttattt

SEQ ID NO: 2262108 - DNA, 12 bp, Homo sapiens
cacttacctcaa

SEQ ID NO: 2262109 - DNA, 13 bp, Homo sapiens
cacttattctgta

SEQ ID NO: 2262110 - DNA, 15 bp, Homo sapiens
cacttcatgtaaagt

SEQ ID NO: 2262111 - DNA, 17 bp, Homo sapiens
cacttgtgattatttat

SEQ ID NO: 2262112 - DNA, 18 bp, Homo sapiens
cactttagggctgtaaaa

SEQ ID NO: 2262113 - DNA, 23 bp, Homo sapiens
cactttagggctgtaaaatgcat

SEQ ID NO: 2262114 - DNA, 23 bp, Homo sapiens
cactttctacaatgtgaacttta

SEQ ID NO: 2262115 - DNA, 20 bp, Homo sapiens
cactttctatcctctgtaaa

SEQ ID NO: 2262116 - DNA, 13 bp, Homo sapiens
cacttttcctttt

SEQ ID NO: 2262117 - DNA, 14 bp, Homo sapiens
cacttttccttttc

SEQ ID NO: 2262118 - DNA, 20 bp, Homo sapiens
cacttttccttttcttaaaa

SEQ ID NO: 2262119 - DNA, 16 bp, Homo sapiens
cagaaaagatgaattt

SEQ ID NO: 2262120 - DNA, 15 bp, Homo sapiens
cagaactcactgggg

SEQ ID NO: 2262121 - DNA, 15 bp, Homo sapiens
cagaagaaataaata

SEQ ID NO: 2262122 - DNA, 15 bp, Homo sapiens
cagaagctgtgagtt

SEQ ID NO: 2262123 - DNA, 19 bp, Homo sapiens
cagaagggaaatttcaata

SEQ ID NO: 2262124 - DNA, 15 bp, Homo sapiens
cagaataagttattg

SEQ ID NO: 2262125 - DNA, 17 bp, Homo sapiens
cagaataagttattgca

SEQ ID NO: 2262126 - DNA, 18 bp, Homo sapiens
cagaataagttattgcag

SEQ ID NO: 2262127 - DNA, 23 bp, Homo sapiens
cagaataagttattgcagtttat

SEQ ID NO: 2262128 - DNA, 17 bp, Homo sapiens
cagaatctcgcagtgtt

SEQ ID NO: 2262129 - DNA, 18 bp, Homo sapiens
cagaatgctgcaggactt

SEQ ID NO: 2262130 - DNA, 21 bp, Homo sapiens
cagacaaccttgtcccaagga

SEQ ID NO: 2262131 - DNA, 20 bp, Homo sapiens
cagacaataaaccctcagag

SEQ ID NO: 2262132 - DNA, 23 bp, Homo sapiens
cagacaataaaccctcagagcct

SEQ ID NO: 2262133 - DNA, 15 bp, Homo sapiens
cagacaccctcaacc

SEQ ID NO: 2262134 - DNA, 21 bp, Homo sapiens
cagacaccctcaacctcttct

SEQ ID NO: 2262135 - DNA, 13 bp, Homo sapiens
cagacattttaaa

SEQ ID NO: 2262136 - DNA, 16 bp, Homo sapiens
cagactccagctgtga

SEQ ID NO: 2262137 - DNA, 18 bp, Homo sapiens
cagactccagctgtgaag

SEQ ID NO: 2262138 - DNA, 18 bp, Homo sapiens
cagactgggaacccctcc

SEQ ID NO: 2262139 - DNA, 14 bp, Homo sapiens
cagagaaccaggct

SEQ ID NO: 2262140 - DNA, 23 bp, Homo sapiens
cagagacaacaggtaaaacaggg

SEQ ID NO: 2262141 - DNA, 15 bp, Homo sapiens
cagagagaccctgca

SEQ ID NO: 2262142 - DNA, 15 bp, Homo sapiens
cagagcatttaagga

SEQ ID NO: 2262143 - DNA, 22 bp, Homo sapiens
cagagcatttaaggaaactaga

SEQ ID NO: 2262144 - DNA, 14 bp, Homo sapiens
cagagccagcctgg

SEQ ID NO: 2262145 - DNA, 21 bp, Homo sapiens
cagagccagcctggctctgcc

SEQ ID NO: 2262146 - DNA, 22 bp, Homo sapiens
cagagccagcctggctctgccc

SEQ ID NO: 2262147 - DNA, 21 bp, Homo sapiens
cagagccctcaactattctgt

SEQ ID NO: 2262148 - DNA, 18 bp, Homo sapiens
cagagcttgttgtctcca

SEQ ID NO: 2262149 - DNA, 23 bp, Homo sapiens
cagaggagtaaataattggaaaa

SEQ ID NO: 2262150 - DNA, 21 bp, Homo sapiens
cagaggctcagattgtaatat

SEQ ID NO: 2262151 - DNA, 12 bp, Homo sapiens
cagagtctgtct

SEQ ID NO: 2262152 - DNA, 15 bp, Homo sapiens
cagatgatctctcca

SEQ ID NO: 2262153 - DNA, 16 bp, Homo sapiens
cagatgttaaaataaa

SEQ ID NO: 2262154 - DNA, 17 bp, Homo sapiens
cagatgttaaaataaat

SEQ ID NO: 2262155 - DNA, 17 bp, Homo sapiens
cagatgttagatatttt

SEQ ID NO: 2262156 - DNA, 16 bp, Homo sapiens
cagatgtttccagact

SEQ ID NO: 2262157 - DNA, 15 bp, Homo sapiens
cagattgctgggagg

SEQ ID NO: 2262158 - DNA, 17 bp, Homo sapiens
cagattttatttatgcg

SEQ ID NO: 2262159 - DNA, 19 bp, Homo sapiens
cagattttgctgtatattt

SEQ ID NO: 2262160 - DNA, 23 bp, Homo sapiens
cagattttgctgtatatttgtga

SEQ ID NO: 2262161 - DNA, 20 bp, Homo sapiens
cagatttttatgttttgaaa

SEQ ID NO: 2262162 - DNA, 13 bp, Homo sapiens
cagcaaaggaact

SEQ ID NO: 2262163 - DNA, 13 bp, Homo sapiens
cagcaaattttca

SEQ ID NO: 2262164 - DNA, 23 bp, Homo sapiens
cagcaagttagaactagccaaac

SEQ ID NO: 2262165 - DNA, 11 bp, Homo sapiens
cagcaccctcc

SEQ ID NO: 2262166 - DNA, 14 bp, Homo sapiens
cagcaccctccccc

SEQ ID NO: 2262167 - DNA, 17 bp, Homo sapiens
ccccatgggctgtgtcc

SEQ ID NO: 2262168 - DNA, 16 bp, Homo sapiens
ccccatgtgtcctggt

SEQ ID NO: 2262169 - DNA, 18 bp, Homo sapiens
ccccatgtgtcctggttc

SEQ ID NO: 2262170 - DNA, 15 bp, Homo sapiens
cccccaacctttccc

SEQ ID NO: 2262171 - DNA, 14 bp, Homo sapiens
cccccacccccagc

SEQ ID NO: 2262172 - DNA, 24 bp, Homo sapiens
cccccagccccgactccagccagc

SEQ ID NO: 2262173 - DNA, 19 bp, Homo sapiens
cccccatccagcctccagg

SEQ ID NO: 2262174 - DNA, 12 bp, Homo sapiens
ccccccagcact

SEQ ID NO: 2262175 - DNA, 12 bp, Homo sapiens
ccccccagcctc

SEQ ID NO: 2262176 - DNA, 12 bp, Homo sapiens
cccccctctgtc

SEQ ID NO: 2262177 - DNA, 16 bp, Homo sapiens
ccccctcccaccccca

SEQ ID NO: 2262178 - DNA, 21 bp, Homo sapiens
ccccctgccccccagcctctg

SEQ ID NO: 2262179 - DNA, 22 bp, Homo sapiens
ccccctggcctctgtgccttct

SEQ ID NO: 2262180 - DNA, 14 bp, Homo sapiens
cccccttgagtggg

SEQ ID NO: 2262181 - DNA, 14 bp, Homo sapiens
ccccgcctggccag

SEQ ID NO: 2262182 - DNA, 15 bp, Homo sapiens
cccctcactctgtca

SEQ ID NO: 2262183 - DNA, 21 bp, Homo sapiens
cccctcagcgcccccagagcc

SEQ ID NO: 2262184 - DNA, 15 bp, Homo sapiens
cccctcctccccgcg

SEQ ID NO: 2262185 - DNA, 21 bp, Homo sapiens
cccctcctctagctgtggggg

SEQ ID NO: 2262186 - DNA, 11 bp, Homo sapiens
cccctcctggc

SEQ ID NO: 2262187 - DNA, 15 bp, Homo sapiens
cccctctgacctgca

SEQ ID NO: 2262188 - DNA, 22 bp, Homo sapiens
cccctgcctgttggcaggccca

SEQ ID NO: 2262189 - DNA, 15 bp, Homo sapiens
ccccttgtcctttcc

SEQ ID NO: 2262190 - DNA, 17 bp, Homo sapiens
cccctttcacactggat

SEQ ID NO: 2262191 - DNA, 15 bp, Homo sapiens
cccgactccagccag

SEQ ID NO: 2262192 - DNA, 13 bp, Homo sapiens
cccgcctgccctc

SEQ ID NO: 2262193 - DNA, 12 bp, Homo sapiens
cccgcctggcca

SEQ ID NO: 2262194 - DNA, 14 bp, Homo sapiens
cccgcctggccagg

SEQ ID NO: 2262195 - DNA, 15 bp, Homo sapiens
cccgcctggccagga

SEQ ID NO: 2262196 - DNA, 16 bp, Homo sapiens
cccgcctggccaggag

SEQ ID NO: 2262197 - DNA, 17 bp, Homo sapiens
cccgcctggccaggagc

SEQ ID NO: 2262198 - DNA, 21 bp, Homo sapiens
cccgctctacatcttctgcct

SEQ ID NO: 2262199 - DNA, 14 bp, Homo sapiens
cccgcttggccacc

SEQ ID NO: 2262200 - DNA, 11 bp, Homo sapiens
cccggacggcg

SEQ ID NO: 2262201 - DNA, 12 bp, Homo sapiens
cccgtctcagtg

SEQ ID NO: 2262202 - DNA, 21 bp, Homo sapiens
cccgtgtgcacaccaccctcc

SEQ ID NO: 2262203 - DNA, 12 bp, Homo sapiens
cccgttttcccc

SEQ ID NO: 2262204 - DNA, 14 bp, Homo sapiens
ccctaccctggact

SEQ ID NO: 2262205 - DNA, 16 bp, Homo sapiens
ccctaggctttctcct

SEQ ID NO: 2262206 - DNA, 19 bp, Homo sapiens
ccctagttctacctcaggc

SEQ ID NO: 2262207 - DNA, 18 bp, Homo sapiens
ccctcagatgatctctcc

SEQ ID NO: 2262208 - DNA, 17 bp, Homo sapiens
ccctcagcgcccccaga

SEQ ID NO: 2262209 - DNA, 17 bp, Homo sapiens
ccctcatggcccctctg

SEQ ID NO: 2262210 - DNA, 13 bp, Homo sapiens
ccctccaccccag

SEQ ID NO: 2262211 - DNA, 17 bp, Homo sapiens
ccctccacgcctcctgg

SEQ ID NO: 2262212 - DNA, 18 bp, Homo sapiens
ccctccacgcctcctggc

SEQ ID NO: 2262213 - DNA, 13 bp, Homo sapiens
ccctccagagaca

SEQ ID NO: 2262214 - DNA, 16 bp, Homo sapiens
ccctcccacccccagc

SEQ ID NO: 2262215 - DNA, 20 bp, Homo sapiens
ccctcccacccccagccccg

SEQ ID NO: 2262216 - DNA, 17 bp, Homo sapiens
ccctcccccagacacag

SEQ ID NO: 2262217 - DNA, 13 bp, Homo sapiens
ccctcccccttgt

SEQ ID NO: 2262218 - DNA, 14 bp, Homo sapiens
ccctcctcccccag

SEQ ID NO: 2262219 - DNA, 18 bp, Homo sapiens
ccctcctctagctgtggg

SEQ ID NO: 2262220 - DNA, 13 bp, Homo sapiens
ccctcctggctct

SEQ ID NO: 2262221 - DNA, 17 bp, Homo sapiens
ccctctcagctccaggt

SEQ ID NO: 2262222 - DNA, 13 bp, Homo sapiens
ccctctcctgggg

SEQ ID NO: 2262223 - DNA, 15 bp, Homo sapiens
ccctctgctgctgtc

SEQ ID NO: 2262224 - DNA, 18 bp, Homo sapiens
ccctgcaaaaagaaaaaa

SEQ ID NO: 2262225 - DNA, 20 bp, Homo sapiens
ccctgcaaaaagaaaaaaag

SEQ ID NO: 2262226 - DNA, 18 bp, Homo sapiens
ccctgcaagaccacggag

SEQ ID NO: 2262227 - DNA, 23 bp, Homo sapiens
ccctgcctgttggcaggcccact

SEQ ID NO: 2262228 - DNA, 19 bp, Homo sapiens
ccctggaggcactgaagtg

SEQ ID NO: 2262229 - DNA, 13 bp, Homo sapiens
ccctggcctctgt

SEQ ID NO: 2262230 - DNA, 19 bp, Homo sapiens
ccctggcctctgtgccttc

SEQ ID NO: 2262231 - DNA, 18 bp, Homo sapiens
ccctgggcccctccacgc

SEQ ID NO: 2262232 - DNA, 22 bp, Homo sapiens
ccctgggcccctccacgcctcc

SEQ ID NO: 2262233 - DNA, 13 bp, Homo sapiens
ccctgggcctcag

SEQ ID NO: 2262234 - DNA, 18 bp, Homo sapiens
ccctgggcctcatcacag

SEQ ID NO: 2262235 - DNA, 19 bp, Homo sapiens
ccctgtaccttttgaggag

SEQ ID NO: 2262236 - DNA, 18 bp, Homo sapiens
ccctgtactgttctgtgt

SEQ ID NO: 2262237 - DNA, 15 bp, Homo sapiens
ccctgtaggcctcag

SEQ ID NO: 2262238 - DNA, 22 bp, Homo sapiens
ccctgtagtgaatcctctgttt

SEQ ID NO: 2262239 - DNA, 18 bp, Homo sapiens
ccctgtgggggtggccat

SEQ ID NO: 2262240 - DNA, 19 bp, Homo sapiens
ccctgtgggggtggccatc

SEQ ID NO: 2262241 - DNA, 24 bp, Homo sapiens
ccctgtgggggtggccatccctgg

SEQ ID NO: 2262242 - DNA, 13 bp, Homo sapiens
cccttataaaatc

SEQ ID NO: 2262243 - DNA, 19 bp, Homo sapiens
cccttcagtaccctctcag

SEQ ID NO: 2262244 - DNA, 13 bp, Homo sapiens
cccttgctggccc

SEQ ID NO: 2262245 - DNA, 21 bp, Homo sapiens
cccttgctggccccagccctg

SEQ ID NO: 2262246 - DNA, 16 bp, Homo sapiens
cccttttaaagttgat

SEQ ID NO: 2262247 - DNA, 12 bp, Homo sapiens
cccttttcccct

SEQ ID NO: 2262248 - DNA, 10 bp, Homo sapiens
ccgactccag

SEQ ID NO: 2262249 - DNA, 13 bp, Homo sapiens
ccgactccagcca

SEQ ID NO: 2262250 - DNA, 16 bp, Homo sapiens
ccgactccagccagcg

SEQ ID NO: 2262251 - DNA, 18 bp, Homo sapiens
ccgagcggtgtggggacc

SEQ ID NO: 2262252 - DNA, 13 bp, Homo sapiens
ccgagtgcactgc

SEQ ID NO: 2262253 - DNA, 12 bp, Homo sapiens
ccgccccctcct

SEQ ID NO: 2262254 - DNA, 24 bp, Homo sapiens
ccgccctgggctgtctgtcaccag

SEQ ID NO: 2262255 - DNA, 14 bp, Homo sapiens
ccgcctggccagga

SEQ ID NO: 2262256 - DNA, 17 bp, Homo sapiens
ccgcctggccaggagca

SEQ ID NO: 2262257 - DNA, 20 bp, Homo sapiens
ccgcctggccaggagcaggc

SEQ ID NO: 2262258 - DNA, 23 bp, Homo sapiens
ccgcctggccaggagcaggcacg

SEQ ID NO: 2262259 - DNA, 20 bp, Homo sapiens
ccgctctacatcttctgcct

SEQ ID NO: 2262260 - DNA, 21 bp, Homo sapiens
ccgctgcaagtcagattgctg

SEQ ID NO: 2262261 - DNA, 15 bp, Homo sapiens
ccgctgcaccacggc

SEQ ID NO: 2262262 - DNA, 18 bp, Homo sapiens
ccgctgccgctgcaccac

SEQ ID NO: 2262263 - DNA, 16 bp, Homo sapiens
ccggatctgagggaga

SEQ ID NO: 2262264 - DNA, 21 bp, Homo sapiens
ccgggaccgcgctagggctcc

SEQ ID NO: 2262265 - DNA, 16 bp, Homo sapiens
ccgggagcctccccct

SEQ ID NO: 2262266 - DNA, 23 bp, Homo sapiens
ccgggaggaaaaggcccctgcaa

SEQ ID NO: 2262267 - DNA, 15 bp, Homo sapiens
ccgggcaggtcctgc

SEQ ID NO: 2262268 - DNA, 16 bp, Homo sapiens
ccgggcaggtcctgcc

SEQ ID NO: 2262269 - DNA, 20 bp, Homo sapiens
ccgggtgtggcctcagccct

SEQ ID NO: 2262270 - DNA, 17 bp, Homo sapiens
ccgtgaaaacggagctg

SEQ ID NO: 2262271 - DNA, 17 bp, Homo sapiens
ccgtgtctcagcctctg

SEQ ID NO: 2262272 - DNA, 17 bp, Homo sapiens
ccgttttccccatgaca

SEQ ID NO: 2262273 - DNA, 13 bp, Homo sapiens
cctaaacctcagt

SEQ ID NO: 2262274 - DNA, 15 bp, Homo sapiens
cctaaagaggaaaag

SEQ ID NO: 2262275 - DNA, 20 bp, Homo sapiens
cctaaagaggaaaagtgcaa

SEQ ID NO: 2262276 - DNA, 21 bp, Homo sapiens
cgctaaatatttaccttgaaa

SEQ ID NO: 2262277 - DNA, 18 bp, Homo sapiens
cgctgccgctgcaccacg

SEQ ID NO: 2262278 - DNA, 14 bp, Homo sapiens
cgctgggtggtacc

SEQ ID NO: 2262279 - DNA, 19 bp, Homo sapiens
cgctgggtggtaccctctg

SEQ ID NO: 2262280 - DNA, 13 bp, Homo sapiens
cgctgtcacaggc

SEQ ID NO: 2262281 - DNA, 19 bp, Homo sapiens
cgctgtcctctcgagccca

SEQ ID NO: 2262282 - DNA, 16 bp, Homo sapiens
cgctgtcgccccaggc

SEQ ID NO: 2262283 - DNA, 23 bp, Homo sapiens
cgctgtcgccccaggccctccct

SEQ ID NO: 2262284 - DNA, 17 bp, Homo sapiens
cgctgtgcccccctcct

SEQ ID NO: 2262285 - DNA, 21 bp, Homo sapiens
cgcttccttagccttgctcag

SEQ ID NO: 2262286 - DNA, 17 bp, Homo sapiens
cggaacccaagcttaga

SEQ ID NO: 2262287 - DNA, 12 bp, Homo sapiens
cggacaaaatat

SEQ ID NO: 2262288 - DNA, 15 bp, Homo sapiens
cggagagagccaaga

SEQ ID NO: 2262289 - DNA, 17 bp, Homo sapiens
cggaggaggggaagggg

SEQ ID NO: 2262290 - DNA, 18 bp, Homo sapiens
cggaggaggggaaggggc

SEQ ID NO: 2262291 - DNA, 19 bp, Homo sapiens
cggaggaggggaaggggct

SEQ ID NO: 2262292 - DNA, 13 bp, Homo sapiens
cggaggctgggcc

SEQ ID NO: 2262293 - DNA, 23 bp, Homo sapiens
cggcaacgtagcctgggctcact

SEQ ID NO: 2262294 - DNA, 17 bp, Homo sapiens
cggcgggatcctccaca

SEQ ID NO: 2262295 - DNA, 17 bp, Homo sapiens
cggctccccatgtgtcc

SEQ ID NO: 2262296 - DNA, 18 bp, Homo sapiens
cgggatcctccacagaga

SEQ ID NO: 2262297 - DNA, 19 bp, Homo sapiens
cgggatcctccacagagag

SEQ ID NO: 2262298 - DNA, 20 bp, Homo sapiens
cgggatcctccacagagagg

SEQ ID NO: 2262299 - DNA, 13 bp, Homo sapiens
cgggctccctggc

SEQ ID NO: 2262300 - DNA, 15 bp, Homo sapiens
cgggctccctggcag

SEQ ID NO: 2262301 - DNA, 16 bp, Homo sapiens
cgggctccctggcagg

SEQ ID NO: 2262302 - DNA, 15 bp, Homo sapiens
cggggtatcctgggg

SEQ ID NO: 2262303 - DNA, 12 bp, Homo sapiens
cgggtggtcccc

SEQ ID NO: 2262304 - DNA, 14 bp, Homo sapiens
cgggtggtccccgt

SEQ ID NO: 2262305 - DNA, 15 bp, Homo sapiens
cgggtgtggcctcag

SEQ ID NO: 2262306 - DNA, 16 bp, Homo sapiens
cgggtgtggcctcagc

SEQ ID NO: 2262307 - DNA, 17 bp, Homo sapiens
cgggtgtggcctcagcc

SEQ ID NO: 2262308 - DNA, 18 bp, Homo sapiens
cgggtgtggcctcagccc

SEQ ID NO: 2262309 - DNA, 22 bp, Homo sapiens
cgggtgtggcctcagccctcag

SEQ ID NO: 2262310 - DNA, 12 bp, Homo sapiens
cggtcactgatg

SEQ ID NO: 2262311 - DNA, 21 bp, Homo sapiens
cggtgacctccgtcctctccc

SEQ ID NO: 2262312 - DNA, 20 bp, Homo sapiens
cggtgtggtgcagtgtgaaa

SEQ ID NO: 2262313 - DNA, 19 bp, Homo sapiens
cggtgtgtaacactgtgta

SEQ ID NO: 2262314 - DNA, 20 bp, Homo sapiens
cggttatgaaattcaccccc

SEQ ID NO: 2262315 - DNA, 15 bp, Homo sapiens
cgtagcctgggctca

SEQ ID NO: 2262316 - DNA, 22 bp, Homo sapiens
cgtagcctgggctcactgtgct

SEQ ID NO: 2262317 - DNA, 17 bp, Homo sapiens
cgtcaagagcatgcaca

SEQ ID NO: 2262318 - DNA, 13 bp, Homo sapiens
cgtcctctcccca

SEQ ID NO: 2262319 - DNA, 14 bp, Homo sapiens
cgtcctctccccag

SEQ ID NO: 2262320 - DNA, 16 bp, Homo sapiens
cgtcctctccccagcc

SEQ ID NO: 2262321 - DNA, 20 bp, Homo sapiens
cgtcctctccccagcctggc

SEQ ID NO: 2262322 - DNA, 15 bp, Homo sapiens
cgtgaaaacggagct

SEQ ID NO: 2262323 - DNA, 17 bp, Homo sapiens
cgtgaaaacggagctga

SEQ ID NO: 2262324 - DNA, 16 bp, Homo sapiens
cgtgaatgtctcagcg

SEQ ID NO: 2262325 - DNA, 19 bp, Homo sapiens
cgtggactgtgctggtgca

SEQ ID NO: 2262326 - DNA, 23 bp, Homo sapiens
cgtggaggttctgtattttaaga

SEQ ID NO: 2262327 - DNA, 13 bp, Homo sapiens
cgtggggcccact

SEQ ID NO: 2262328 - DNA, 17 bp, Homo sapiens
cgtgtcacacttgtgac

SEQ ID NO: 2262329 - DNA, 15 bp, Homo sapiens
cgtgtctcagcctct

SEQ ID NO: 2262330 - DNA, 14 bp, Homo sapiens
cgtgtctctgagga

SEQ ID NO: 2262331 - DNA, 19 bp, Homo sapiens
cgttcgatttctacctcag

SEQ ID NO: 2262332 - DNA, 19 bp, Homo sapiens
cgttctgccttccttgtta

SEQ ID NO: 2262333 - DNA, 16 bp, Homo sapiens
cgttttttcctcagtg

SEQ ID NO: 2262334 - DNA, 15 bp, Homo sapiens
ctaaaataattttgt

SEQ ID NO: 2262335 - DNA, 17 bp, Homo sapiens
ctaaaataattttgtaa

SEQ ID NO: 2262336 - DNA, 12 bp, Homo sapiens
ctaaacctcagt

SEQ ID NO: 2262337 - DNA, 13 bp, Homo sapiens
ctaaacctcagtt

SEQ ID NO: 2262338 - DNA, 21 bp, Homo sapiens
ctaaagaaaaatatcttggcc

SEQ ID NO: 2262339 - DNA, 23 bp, Homo sapiens
ctaaagaaaaatatcttggccta

SEQ ID NO: 2262340 - DNA, 14 bp, Homo sapiens
ctaaagcatgaaat

SEQ ID NO: 2262341 - DNA, 22 bp, Homo sapiens
ctaaagcatgaaatgtgaattt

SEQ ID NO: 2262342 - DNA, 20 bp, Homo sapiens
ctaaataaaatttgttgcat

SEQ ID NO: 2262343 - DNA, 14 bp, Homo sapiens
ctaaatttcttttg

SEQ ID NO: 2262344 - DNA, 13 bp, Homo sapiens
ctaacaaactaga

SEQ ID NO: 2262345 - DNA, 16 bp, Homo sapiens
ctaacatggtttaaaa

SEQ ID NO: 2262346 - DNA, 14 bp, Homo sapiens
ctaactgtaaatca

SEQ ID NO: 2262347 - DNA, 15 bp, Homo sapiens
ctaactgtaaatcat

SEQ ID NO: 2262348 - DNA, 17 bp, Homo sapiens
ctaactgtaaatcatgt

SEQ ID NO: 2262349 - DNA, 18 bp, Homo sapiens
ctaactgtaaatcatgtt

SEQ ID NO: 2262350 - DNA, 21 bp, Homo sapiens
ctaagaaaagattttaatcaa

SEQ ID NO: 2262351 - DNA, 20 bp, Homo sapiens
ctaagaaggaaaagaagaag

SEQ ID NO: 2262352 - DNA, 18 bp, Homo sapiens
ctaagatgccatgtgcag

SEQ ID NO: 2262353 - DNA, 12 bp, Homo sapiens
ctaagattcttt

SEQ ID NO: 2262354 - DNA, 23 bp, Homo sapiens
ctaagattcttttaaattagaaa

SEQ ID NO: 2262355 - DNA, 11 bp, Homo sapiens
ctaaggatttt

SEQ ID NO: 2262356 - DNA, 20 bp, Homo sapiens
ctaaggatttttcaagagat

SEQ ID NO: 2262357 - DNA, 21 bp, Homo sapiens
ctaaggttgtctacgggggca

SEQ ID NO: 2262358 - DNA, 18 bp, Homo sapiens
ctaatagtgatcaagaag

SEQ ID NO: 2262359 - DNA, 15 bp, Homo sapiens
ctaattctatgcctg

SEQ ID NO: 2262360 - DNA, 15 bp, Homo sapiens
ctaattgacttgcaa

SEQ ID NO: 2262361 - DNA, 18 bp, Homo sapiens
ctaattgacttgcaaaga

SEQ ID NO: 2262362 - DNA, 15 bp, Homo sapiens
ctaattggtactttt

SEQ ID NO: 2262363 - DNA, 21 bp, Homo sapiens
ctaattggtacttttaaaaac

SEQ ID NO: 2262364 - DNA, 18 bp, Homo sapiens
ctaatttttgtattattt

SEQ ID NO: 2262365 - DNA, 13 bp, Homo sapiens
ctacaatgtgaac

SEQ ID NO: 2262366 - DNA, 18 bp, Homo sapiens
ctacaatgtgaactttat

SEQ ID NO: 2262367 - DNA, 19 bp, Homo sapiens
ctacaatgtgaactttatt

SEQ ID NO: 2262368 - DNA, 23 bp, Homo sapiens
ctacactcttgtaataaaatgtc

SEQ ID NO: 2262369 - DNA, 19 bp, Homo sapiens
ctacagctttgatccctga

SEQ ID NO: 2262370 - DNA, 16 bp, Homo sapiens
ctaccagccagcctca

SEQ ID NO: 2262371 - DNA, 17 bp, Homo sapiens
ctaccagccagcctcag

SEQ ID NO: 2262372 - DNA, 18 bp, Homo sapiens
ctaccagccagcctcaga

SEQ ID NO: 2262373 - DNA, 17 bp, Homo sapiens
ctaccctccgtttttct

SEQ ID NO: 2262374 - DNA, 13 bp, Homo sapiens
ctacctcagcagc

SEQ ID NO: 2262375 - DNA, 14 bp, Homo sapiens
ctactaatagtttg

SEQ ID NO: 2262376 - DNA, 22 bp, Homo sapiens
ctactaatgtgatgctttcatt

SEQ ID NO: 2262377 - DNA, 16 bp, Homo sapiens
ctactgacagggagca

SEQ ID NO: 2262378 - DNA, 14 bp, Homo sapiens
ctactggattctta

SEQ ID NO: 2262379 - DNA, 17 bp, Homo sapiens
ctacttcctcctcccca

SEQ ID NO: 2262380 - DNA, 18 bp, Homo sapiens
ctactttctctttttcgt

SEQ ID NO: 2262381 - DNA, 16 bp, Homo sapiens
ctagatactactttct

SEQ ID NO: 2262382 - DNA, 17 bp, Homo sapiens
ctagatttctacattaa

SEQ ID NO: 2262383 - DNA, 19 bp, Homo sapiens
ctagcctgcattgagcttg

SEQ ID NO: 2262384 - DNA, 19 bp, Homo sapiens
ctaggacacagttcctggg

SEQ ID NO: 2262385 - DNA, 19 bp, Homo sapiens
ctggggatcttcccacagg

SEQ ID NO: 2262386 - DNA, 14 bp, Homo sapiens
ctggggcacggcgg

SEQ ID NO: 2262387 - DNA, 16 bp, Homo sapiens
ctggggcaggctgggc

SEQ ID NO: 2262388 - DNA, 19 bp, Homo sapiens
ctggggccctgggcctcag

SEQ ID NO: 2262389 - DNA, 20 bp, Homo sapiens
ctggggccctgggcctcagt

SEQ ID NO: 2262390 - DNA, 13 bp, Homo sapiens
ctgggggtggcag

SEQ ID NO: 2262391 - DNA, 14 bp, Homo sapiens
ctgggggtggcagg

SEQ ID NO: 2262392 - DNA, 16 bp, Homo sapiens
ctgggtggtaccctct

SEQ ID NO: 2262393 - DNA, 16 bp, Homo sapiens
ctgggtttcctgcagg

SEQ ID NO: 2262394 - DNA, 17 bp, Homo sapiens
ctgggtttcctgcaggc

SEQ ID NO: 2262395 - DNA, 19 bp, Homo sapiens
ctggtaaagttacactttt

SEQ ID NO: 2262396 - DNA, 14 bp, Homo sapiens
ctggtaccctcctg

SEQ ID NO: 2262397 - DNA, 13 bp, Homo sapiens
ctggtagcagcag

SEQ ID NO: 2262398 - DNA, 14 bp, Homo sapiens
ctggtagcagcagg

SEQ ID NO: 2262399 - DNA, 15 bp, Homo sapiens
ctggtagcagcaggc

SEQ ID NO: 2262400 - DNA, 16 bp, Homo sapiens
ctggtagcagcaggct

SEQ ID NO: 2262401 - DNA, 18 bp, Homo sapiens
ctggtagcagcaggctca

SEQ ID NO: 2262402 - DNA, 19 bp, Homo sapiens
ctggtagcagcaggctcag

SEQ ID NO: 2262403 - DNA, 18 bp, Homo sapiens
ctggtcttgaactcctgg

SEQ ID NO: 2262404 - DNA, 16 bp, Homo sapiens
ctggtgaatattttca

SEQ ID NO: 2262405 - DNA, 16 bp, Homo sapiens
ctggtggcagagtcct

SEQ ID NO: 2262406 - DNA, 15 bp, Homo sapiens
ctggttgactttcta

SEQ ID NO: 2262407 - DNA, 13 bp, Homo sapiens
ctggttgggcagc

SEQ ID NO: 2262408 - DNA, 22 bp, Homo sapiens
ctgtaaaatgcatgattttgta

SEQ ID NO: 2262409 - DNA, 18 bp, Homo sapiens
ctgtaatcatttgtttac

SEQ ID NO: 2262410 - DNA, 20 bp, Homo sapiens
ctgtaatcatttgtttacat

SEQ ID NO: 2262411 - DNA, 17 bp, Homo sapiens
ctgtacctcaaatgaat

SEQ ID NO: 2262412 - DNA, 20 bp, Homo sapiens
ctgtaccttttgaggagccc

SEQ ID NO: 2262413 - DNA, 22 bp, Homo sapiens
ctgtaccttttgaggagcccca

SEQ ID NO: 2262414 - DNA, 23 bp, Homo sapiens
ctgtaccttttgaggagccccag

SEQ ID NO: 2262415 - DNA, 23 bp, Homo sapiens
ctgtagaaaaaaaaattcacatg

SEQ ID NO: 2262416 - DNA, 14 bp, Homo sapiens
ctgtaggaaaccca

SEQ ID NO: 2262417 - DNA, 18 bp, Homo sapiens
ctgtagtgaatcctctgt

SEQ ID NO: 2262418 - DNA, 20 bp, Homo sapiens
ctgtataattaattgtcatt

SEQ ID NO: 2262419 - DNA, 23 bp, Homo sapiens
ctgtatatttgtgatagcacttt

SEQ ID NO: 2262420 - DNA, 15 bp, Homo sapiens
ctgtatattttgtta

SEQ ID NO: 2262421 - DNA, 13 bp, Homo sapiens
ctgtattgccctt

SEQ ID NO: 2262422 - DNA, 17 bp, Homo sapiens
ctgtcaaggctgcttag

SEQ ID NO: 2262423 - DNA, 22 bp, Homo sapiens
ctgtcacagtaaaaataaaata

SEQ ID NO: 2262424 - DNA, 18 bp, Homo sapiens
ctgtcagccagccgccct

SEQ ID NO: 2262425 - DNA, 20 bp, Homo sapiens
ctgtcagccagccgccctgg

SEQ ID NO: 2262426 - DNA, 21 bp, Homo sapiens
ctgtcagccagccgccctggg

SEQ ID NO: 2262427 - DNA, 21 bp, Homo sapiens
ctgtcccaccgggagcctccc

SEQ ID NO: 2262428 - DNA, 22 bp, Homo sapiens
ctgtccccaaacaggacagcac

SEQ ID NO: 2262429 - DNA, 15 bp, Homo sapiens
ctgtccctccccctt

SEQ ID NO: 2262430 - DNA, 17 bp, Homo sapiens
ctgtcctctcgagccca

SEQ ID NO: 2262431 - DNA, 19 bp, Homo sapiens
ctgtcctctcgagcccaga

SEQ ID NO: 2262432 - DNA, 13 bp, Homo sapiens
ctgtcgccccagg

SEQ ID NO: 2262433 - DNA, 16 bp, Homo sapiens
ctgtcgccccaggccc

SEQ ID NO: 2262434 - DNA, 17 bp, Homo sapiens
ctgtcgccccaggccct

SEQ ID NO: 2262435 - DNA, 15 bp, Homo sapiens
ctgtcgttaaaaaca

SEQ ID NO: 2262436 - DNA, 19 bp, Homo sapiens
ctgtctatgattgtacttt

SEQ ID NO: 2262437 - DNA, 18 bp, Homo sapiens
ctgtctcatcacataaaa

SEQ ID NO: 2262438 - DNA, 19 bp, Homo sapiens
ctgtctcatcacataaaag

SEQ ID NO: 2262439 - DNA, 16 bp, Homo sapiens
ctgtctgtcaccagct

SEQ ID NO: 2262440 - DNA, 22 bp, Homo sapiens
ctgtctgtcaccagctatctgt

SEQ ID NO: 2262441 - DNA, 16 bp, Homo sapiens
ctgtgaagagactctg

SEQ ID NO: 2262442 - DNA, 14 bp, Homo sapiens
ctgtgaagcctctc

SEQ ID NO: 2262443 - DNA, 19 bp, Homo sapiens
ctgtgagaaggtttattgt

SEQ ID NO: 2262444 - DNA, 20 bp, Homo sapiens
ctgtgagaaggtttattgtt

SEQ ID NO: 2262445 - DNA, 13 bp, Homo sapiens
ctgtgatgtttgt

SEQ ID NO: 2262446 - DNA, 22 bp, Homo sapiens
ctgtgccatacttgttctgtat

SEQ ID NO: 2262447 - DNA, 20 bp, Homo sapiens
ctgtgcccccctcctccccg

SEQ ID NO: 2262448 - DNA, 14 bp, Homo sapiens
ctgtgggcagcacc

SEQ ID NO: 2262449 - DNA, 15 bp, Homo sapiens
ctgtgggcagcaccc

SEQ ID NO: 2262450 - DNA, 23 bp, Homo sapiens
ctgtgggggtgagggtcccatgt

SEQ ID NO: 2262451 - DNA, 16 bp, Homo sapiens
ctgtgggggtggccat

SEQ ID NO: 2262452 - DNA, 21 bp, Homo sapiens
ctgtgggggtggccatccctg

SEQ ID NO: 2262453 - DNA, 23 bp, Homo sapiens
ctgtgggggtggccatccctggg

SEQ ID NO: 2262454 - DNA, 13 bp, Homo sapiens
ctgtgtacacctc

SEQ ID NO: 2262455 - DNA, 13 bp, Homo sapiens
ctgttagcagagt

SEQ ID NO: 2262456 - DNA, 15 bp, Homo sapiens
ctgttagcagagtct

SEQ ID NO: 2262457 - DNA, 20 bp, Homo sapiens
ctgttagcagagtctgtctc

SEQ ID NO: 2262458 - DNA, 17 bp, Homo sapiens
ctgttcagaaagcaata

SEQ ID NO: 2262459 - DNA, 23 bp, Homo sapiens
ctgttccacacccaatgctgctc

SEQ ID NO: 2262460 - DNA, 12 bp, Homo sapiens
ctgttgggctga

SEQ ID NO: 2262461 - DNA, 16 bp, Homo sapiens
ctgttgggctgaaccc

SEQ ID NO: 2262462 - DNA, 19 bp, Homo sapiens
ctgtttcctgacattgtct

SEQ ID NO: 2262463 - DNA, 16 bp, Homo sapiens
ctgttttcttttttct

SEQ ID NO: 2262464 - DNA, 18 bp, Homo sapiens
cttaaaaaggactatatt

SEQ ID NO: 2262465 - DNA, 20 bp, Homo sapiens
cttaaattcctcaacagtgt

SEQ ID NO: 2262466 - DNA, 12 bp, Homo sapiens
cttaacaatgca

SEQ ID NO: 2262467 - DNA, 17 bp, Homo sapiens
cttaacaatgcaacttt

SEQ ID NO: 2262468 - DNA, 12 bp, Homo sapiens
cttaacagtttt

SEQ ID NO: 2262469 - DNA, 17 bp, Homo sapiens
cttaactccttccagtg

SEQ ID NO: 2262470 - DNA, 19 bp, Homo sapiens
cttaaggagaggagaaact

SEQ ID NO: 2262471 - DNA, 20 bp, Homo sapiens
cttaagtcccagtatacctc

SEQ ID NO: 2262472 - DNA, 22 bp, Homo sapiens
cttaagtcccagtatacctcat

SEQ ID NO: 2262473 - DNA, 19 bp, Homo sapiens
cttaagttagttccactga

SEQ ID NO: 2262474 - DNA, 14 bp, Homo sapiens
cttaatcattttca

SEQ ID NO: 2262475 - DNA, 21 bp, Homo sapiens
cttaattattataaaaatatt

SEQ ID NO: 2262476 - DNA, 20 bp, Homo sapiens
cttagaacagtggaaactat

SEQ ID NO: 2262477 - DNA, 19 bp, Homo sapiens
cttagaacattttaattca

SEQ ID NO: 2262478 - DNA, 16 bp, Homo sapiens
cttagaatccaaactt

SEQ ID NO: 2262479 - DNA, 22 bp, Homo sapiens
cttagacctcctaaatgcccca

SEQ ID NO: 2262480 - DNA, 20 bp, Homo sapiens
cttagctatccttggctttc

SEQ ID NO: 2262481 - DNA, 17 bp, Homo sapiens
cttaggaattgaattaa

SEQ ID NO: 2262482 - DNA, 13 bp, Homo sapiens
cttaggccttcct

SEQ ID NO: 2262483 - DNA, 17 bp, Homo sapiens
cttaggccttcctctct

SEQ ID NO: 2262484 - DNA, 20 bp, Homo sapiens
cttagtctcagtttgtgtgt

SEQ ID NO: 2262485 - DNA, 19 bp, Homo sapiens
cttataaaatcctgtgcaa

SEQ ID NO: 2262486 - DNA, 23 bp, Homo sapiens
cttatgtagagtttttatgcctt

SEQ ID NO: 2262487 - DNA, 18 bp, Homo sapiens
cttatgttgaaaaaattt

SEQ ID NO: 2262488 - DNA, 20 bp, Homo sapiens
cttcaaaaggaatgaacttg

SEQ ID NO: 2262489 - DNA, 22 bp, Homo sapiens
cttcaggtaaagggcaaataat

SEQ ID NO: 2262490 - DNA, 22 bp, Homo sapiens
cttcagtaccctctcagctcca

SEQ ID NO: 2262491 - DNA, 23 bp, Homo sapiens
cttcagtaccctctcagctccag

SEQ ID NO: 2262492 - DNA, 15 bp, Homo sapiens
cttcatattgctgag

SEQ ID NO: 2262493 - DNA, 21 bp, Homo sapiens
gagcttgtcttttctgctgag

SEQ ID NO: 2262494 - DNA, 23 bp, Homo sapiens
gagcttgttgtctccacttgtat

SEQ ID NO: 2262495 - DNA, 23 bp, Homo sapiens
gaggaaaaggcccctgcaatgtg

SEQ ID NO: 2262496 - DNA, 20 bp, Homo sapiens
gaggaaaagtgcaatgcgtg

SEQ ID NO: 2262497 - DNA, 13 bp, Homo sapiens
gaggacgagaccc

SEQ ID NO: 2262498 - DNA, 23 bp, Homo sapiens
gaggacgtcatcggaggctgggc

SEQ ID NO: 2262499 - DNA, 15 bp, Homo sapiens
gaggagccccagcta

SEQ ID NO: 2262500 - DNA, 15 bp, Homo sapiens
gaggagctggggcgg

SEQ ID NO: 2262501 - DNA, 22 bp, Homo sapiens
gaggagggggtaggtgatgggg

SEQ ID NO: 2262502 - DNA, 21 bp, Homo sapiens
gaggagtaaataattggaaaa

SEQ ID NO: 2262503 - DNA, 13 bp, Homo sapiens
gaggatacagagg

SEQ ID NO: 2262504 - DNA, 14 bp, Homo sapiens
gaggatacagagga

SEQ ID NO: 2262505 - DNA, 18 bp, Homo sapiens
gaggcactgaagtgctta

SEQ ID NO: 2262506 - DNA, 15 bp, Homo sapiens
gaggctgcccctctc

SEQ ID NO: 2262507 - DNA, 18 bp, Homo sapiens
gaggctgcccctctcacc

SEQ ID NO: 2262508 - DNA, 19 bp, Homo sapiens
gaggctgcccctctcacca

SEQ ID NO: 2262509 - DNA, 23 bp, Homo sapiens
gaggggctggggacttgtgtctg

SEQ ID NO: 2262510 - DNA, 13 bp, Homo sapiens
gaggtgcctgtcc

SEQ ID NO: 2262511 - DNA, 15 bp, Homo sapiens
gaggtgcctgtccca

SEQ ID NO: 2262512 - DNA, 15 bp, Homo sapiens
gagtaaacttgaaaa

SEQ ID NO: 2262513 - DNA, 21 bp, Homo sapiens
gagtcaaagctgaccatggat

SEQ ID NO: 2262514 - DNA, 17 bp, Homo sapiens
gagtctgtctcttggct

SEQ ID NO: 2262515 - DNA, 22 bp, Homo sapiens
gagtgatttccatctctggtaa

SEQ ID NO: 2262516 - DNA, 15 bp, Homo sapiens
gagttcaccatctct

SEQ ID NO: 2262517 - DNA, 21 bp, Homo sapiens
gagtttaaaaatggtatcaaa

SEQ ID NO: 2262518 - DNA, 17 bp, Homo sapiens
gataaagaaaaaaatac

SEQ ID NO: 2262519 - DNA, 19 bp, Homo sapiens
gataatacagatttgtaac

SEQ ID NO: 2262520 - DNA, 16 bp, Homo sapiens
gataatctcagtgctt

SEQ ID NO: 2262521 - DNA, 14 bp, Homo sapiens
gatacaagagtcag

SEQ ID NO: 2262522 - DNA, 12 bp, Homo sapiens
gatagcactttc

SEQ ID NO: 2262523 - DNA, 20 bp, Homo sapiens
gatagcactttctacaatgt

SEQ ID NO: 2262524 - DNA, 21 bp, Homo sapiens
gatagttgaatgttgcaatgt

SEQ ID NO: 2262525 - DNA, 18 bp, Homo sapiens
gatataaatttttaagag

SEQ ID NO: 2262526 - DNA, 22 bp, Homo sapiens
gatatgcttgtaactaaaataa

SEQ ID NO: 2262527 - DNA, 18 bp, Homo sapiens
gatatttgcagtttttca

SEQ ID NO: 2262528 - DNA, 17 bp, Homo sapiens
gatatttttcataaaca

SEQ ID NO: 2262529 - DNA, 18 bp, Homo sapiens
gatatttttcataaacaa

SEQ ID NO: 2262530 - DNA, 15 bp, Homo sapiens
gatcatgtacttttt

SEQ ID NO: 2262531 - DNA, 15 bp, Homo sapiens
gatccatcttgagcc

SEQ ID NO: 2262532 - DNA, 14 bp, Homo sapiens
gatccccgcctggc

SEQ ID NO: 2262533 - DNA, 21 bp, Homo sapiens
gatccccgcctggccaggagc

SEQ ID NO: 2262534 - DNA, 22 bp, Homo sapiens
gatccccgcctggccaggagca

SEQ ID NO: 2262535 - DNA, 17 bp, Homo sapiens
gatcccgttttccccat

SEQ ID NO: 2262536 - DNA, 13 bp, Homo sapiens
gatcctccacaga

SEQ ID NO: 2262537 - DNA, 15 bp, Homo sapiens
gatcctccacagaga

SEQ ID NO: 2262538 - DNA, 16 bp, Homo sapiens
gatcctccacagagag

SEQ ID NO: 2262539 - DNA, 16 bp, Homo sapiens
gatcctctcacctcag

SEQ ID NO: 2262540 - DNA, 14 bp, Homo sapiens
gatctcggtttgcc

SEQ ID NO: 2262541 - DNA, 20 bp, Homo sapiens
gatctcggtttgccaaaatt

SEQ ID NO: 2262542 - DNA, 20 bp, Homo sapiens
gatctgtatttaatggtttt

SEQ ID NO: 2262543 - DNA, 20 bp, Homo sapiens
gatctttctttccaaaacat

SEQ ID NO: 2262544 - DNA, 16 bp, Homo sapiens
gatgaggtattttttc

SEQ ID NO: 2262545 - DNA, 22 bp, Homo sapiens
gatgatctctccacggtagcac

SEQ ID NO: 2262546 - DNA, 20 bp, Homo sapiens
gatgcaacaagccctgcttt

SEQ ID NO: 2262547 - DNA, 18 bp, Homo sapiens
gatgcaatatatccccac

SEQ ID NO: 2262548 - DNA, 21 bp, Homo sapiens
gatgcacgtggggcccactgc

SEQ ID NO: 2262549 - DNA, 15 bp, Homo sapiens
gatgcacttcaaatt

SEQ ID NO: 2262550 - DNA, 12 bp, Homo sapiens
gatgcaggctcc

SEQ ID NO: 2262551 - DNA, 19 bp, Homo sapiens
gatgcaggctcccctgagg

SEQ ID NO: 2262552 - DNA, 20 bp, Homo sapiens
gatgggaccagggatggggg

SEQ ID NO: 2262553 - DNA, 18 bp, Homo sapiens
gatgggggacgagggcca

SEQ ID NO: 2262554 - DNA, 13 bp, Homo sapiens
gatgtaaagatgt

SEQ ID NO: 2262555 - DNA, 19 bp, Homo sapiens
gatgtaattttgtgtaaga

SEQ ID NO: 2262556 - DNA, 15 bp, Homo sapiens
gatgtgatgtggcag

SEQ ID NO: 2262557 - DNA, 14 bp, Homo sapiens
gatgtggcaggagg

SEQ ID NO: 2262558 - DNA, 12 bp, Homo sapiens
gatgtttccaga

SEQ ID NO: 2262559 - DNA, 19 bp, Homo sapiens
gatgtttccagacttcctt

SEQ ID NO: 2262560 - DNA, 20 bp, Homo sapiens
gattaaagatgagctttgtc

SEQ ID NO: 2262561 - DNA, 20 bp, Homo sapiens
gattaaatgtgtcattggaa

SEQ ID NO: 2262562 - DNA, 14 bp, Homo sapiens
gattatggagcttt

SEQ ID NO: 2262563 - DNA, 13 bp, Homo sapiens
gattcaggaatgt

SEQ ID NO: 2262564 - DNA, 17 bp, Homo sapiens
gattctatttaattgaa

SEQ ID NO: 2262565 - DNA, 20 bp, Homo sapiens
gattctatttaattgaaact

SEQ ID NO: 2262566 - DNA, 23 bp, Homo sapiens
gattctgaccttaaatgcaacca

SEQ ID NO: 2262567 - DNA, 19 bp, Homo sapiens
gattgatatctataaaata

SEQ ID NO: 2262568 - DNA, 15 bp, Homo sapiens
gatttaaggtattta

SEQ ID NO: 2262569 - DNA, 14 bp, Homo sapiens
gatttctacctcag

SEQ ID NO: 2262570 - DNA, 18 bp, Homo sapiens
gatttctacctcagcagc

SEQ ID NO: 2262571 - DNA, 14 bp, Homo sapiens
gatttctgaggaaa

SEQ ID NO: 2262572 - DNA, 15 bp, Homo sapiens
gatttggaattgaac

SEQ ID NO: 2262573 - DNA, 23 bp, Homo sapiens
gattttaatagggaatatatctc

SEQ ID NO: 2262574 - DNA, 14 bp, Homo sapiens
gattttaccaaagc

SEQ ID NO: 2262575 - DNA, 13 bp, Homo sapiens
gattttgtaaccc

SEQ ID NO: 2262576 - DNA, 15 bp, Homo sapiens
gatttttagaattaa

SEQ ID NO: 2262577 - DNA, 12 bp, Homo sapiens
gcaaacacttaa

SEQ ID NO: 2262578 - DNA, 19 bp, Homo sapiens
gcaaagacctacctccaga

SEQ ID NO: 2262579 - DNA, 14 bp, Homo sapiens
gcaaatggcctcat

SEQ ID NO: 2262580 - DNA, 16 bp, Homo sapiens
gcaacagatcagtaaa

SEQ ID NO: 2262581 - DNA, 14 bp, Homo sapiens
gcaacctacccagc

SEQ ID NO: 2262582 - DNA, 18 bp, Homo sapiens
gcaacctacccagcgtgg

SEQ ID NO: 2262583 - DNA, 15 bp, Homo sapiens
gcaataaataacact

SEQ ID NO: 2262584 - DNA, 18 bp, Homo sapiens
gcaataaataacacttgt

SEQ ID NO: 2262585 - DNA, 23 bp, Homo sapiens
gcaatatttaacaatttattctg

SEQ ID NO: 2262586 - DNA, 14 bp, Homo sapiens
gcaatctctctctg

SEQ ID NO: 2262587 - DNA, 17 bp, Homo sapiens
gcaatctctctctgtgt

SEQ ID NO: 2262588 - DNA, 21 bp, Homo sapiens
gcaatctctctctgtgtcttt

SEQ ID NO: 2262589 - DNA, 22 bp, Homo sapiens
gcaatctgaccctatgggtcta

SEQ ID NO: 2262590 - DNA, 15 bp, Homo sapiens
gcaatgcaagaaaaa

SEQ ID NO: 2262591 - DNA, 17 bp, Homo sapiens
gcaatgtaagcatactt

SEQ ID NO: 2262592 - DNA, 14 bp, Homo sapiens
gcaattatattgtc

SEQ ID NO: 2262593 - DNA, 16 bp, Homo sapiens
gcaattatattgtcct

SEQ ID NO: 2262594 - DNA, 21 bp, Homo sapiens
gcaattgctcatgttggccaa

SEQ ID NO: 2262595 - DNA, 12 bp, Homo sapiens
gcacaataaaca

SEQ ID NO: 2262596 - DNA, 12 bp, Homo sapiens
gcacacagcagc

SEQ ID NO: 2262597 - DNA, 13 bp, Homo sapiens
gcacacagcagcc

SEQ ID NO: 2262598 - DNA, 16 bp, Homo sapiens
gcacacagcagccccc

SEQ ID NO: 2262599 - DNA, 19 bp, Homo sapiens
gcacacagcagccccccag

SEQ ID NO: 2262600 - DNA, 20 bp, Homo sapiens
gcacacagcagccccccagc

SEQ ID NO: 2262601 - DNA, 16 bp, Homo sapiens
gctatgtataaaatac

SEQ ID NO: 2262602 - DNA, 15 bp, Homo sapiens
gctcactgtgctggg

SEQ ID NO: 2262603 - DNA, 16 bp, Homo sapiens
gctcagacatgttttc

SEQ ID NO: 2262604 - DNA, 21 bp, Homo sapiens
gctcagacatgttttccgtga

SEQ ID NO: 2262605 - DNA, 19 bp, Homo sapiens
gctcagcccgcttggccac

SEQ ID NO: 2262606 - DNA, 15 bp, Homo sapiens
gctcaggtgcaagtg

SEQ ID NO: 2262607 - DNA, 19 bp, Homo sapiens
gctcagtgtttttgtgaat

SEQ ID NO: 2262608 - DNA, 16 bp, Homo sapiens
gctcataaaaataaaa

SEQ ID NO: 2262609 - DNA, 12 bp, Homo sapiens
gctccccatgtg

SEQ ID NO: 2262610 - DNA, 14 bp, Homo sapiens
gctccccatgtgtc

SEQ ID NO: 2262611 - DNA, 13 bp, Homo sapiens
gctccctggcagg

SEQ ID NO: 2262612 - DNA, 18 bp, Homo sapiens
gctccgaggagctggggc

SEQ ID NO: 2262613 - DNA, 11 bp, Homo sapiens
gctcctcccac

SEQ ID NO: 2262614 - DNA, 18 bp, Homo sapiens
gctccttcccatcgctgt

SEQ ID NO: 2262615 - DNA, 21 bp, Homo sapiens
gctcgtggactgtgctggtgc

SEQ ID NO: 2262616 - DNA, 16 bp, Homo sapiens
gctctgacagccctgc

SEQ ID NO: 2262617 - DNA, 12 bp, Homo sapiens
gctcttcttaaa

SEQ ID NO: 2262618 - DNA, 20 bp, Homo sapiens
gctcttgatacccccctctg

SEQ ID NO: 2262619 - DNA, 10 bp, Homo sapiens
gctgaatcca

SEQ ID NO: 2262620 - DNA, 20 bp, Homo sapiens
gctgaatgttgggactgcta

SEQ ID NO: 2262621 - DNA, 14 bp, Homo sapiens
gctgaattatctat

SEQ ID NO: 2262622 - DNA, 17 bp, Homo sapiens
gctgaccatgcgtcagg

SEQ ID NO: 2262623 - DNA, 15 bp, Homo sapiens
gctgaggacgagacc

SEQ ID NO: 2262624 - DNA, 15 bp, Homo sapiens
gctgcccctctcacc

SEQ ID NO: 2262625 - DNA, 16 bp, Homo sapiens
gctgcccctctcacca

SEQ ID NO: 2262626 - DNA, 14 bp, Homo sapiens
gctgccgctgcacc

SEQ ID NO: 2262627 - DNA, 14 bp, Homo sapiens
gctgccttggctca

SEQ ID NO: 2262628 - DNA, 19 bp, Homo sapiens
gctgccttggctcagacat

SEQ ID NO: 2262629 - DNA, 21 bp, Homo sapiens
gctgccttggctcagacatgt

SEQ ID NO: 2262630 - DNA, 23 bp, Homo sapiens
gctgccttggctcagacatgttt

SEQ ID NO: 2262631 - DNA, 16 bp, Homo sapiens
gctgctgtccctcccc

SEQ ID NO: 2262632 - DNA, 18 bp, Homo sapiens
gctgctgtccctccccct

SEQ ID NO: 2262633 - DNA, 22 bp, Homo sapiens
gctgctgtccctcccccttgtc

SEQ ID NO: 2262634 - DNA, 20 bp, Homo sapiens
gctgcttagaatccaaactt

SEQ ID NO: 2262635 - DNA, 11 bp, Homo sapiens
gctggcagaga

SEQ ID NO: 2262636 - DNA, 17 bp, Homo sapiens
gctggccagcaccctct

SEQ ID NO: 2262637 - DNA, 19 bp, Homo sapiens
gctggccagcaccctctcc

SEQ ID NO: 2262638 - DNA, 12 bp, Homo sapiens
gctggccccagc

SEQ ID NO: 2262639 - DNA, 10 bp, Homo sapiens
gctggctggt

SEQ ID NO: 2262640 - DNA, 14 bp, Homo sapiens
gctgggagcaggac

SEQ ID NO: 2262641 - DNA, 17 bp, Homo sapiens
gctgggccatgtccaaa

SEQ ID NO: 2262642 - DNA, 20 bp, Homo sapiens
gctgggccatgtccaaagag

SEQ ID NO: 2262643 - DNA, 18 bp, Homo sapiens
gctgggcccctgggatgg

SEQ ID NO: 2262644 - DNA, 23 bp, Homo sapiens
gctgggcccctgggatgggacca

SEQ ID NO: 2262645 - DNA, 23 bp, Homo sapiens
gctggggacctggtaccctcctg

SEQ ID NO: 2262646 - DNA, 15 bp, Homo sapiens
gctggtagcagcagg

SEQ ID NO: 2262647 - DNA, 13 bp, Homo sapiens
gctgtcacaggcg

SEQ ID NO: 2262648 - DNA, 15 bp, Homo sapiens
gctgtccctccccct

SEQ ID NO: 2262649 - DNA, 16 bp, Homo sapiens
gctgtcgccccaggcc

SEQ ID NO: 2262650 - DNA, 17 bp, Homo sapiens
gctgtcgccccaggccc

SEQ ID NO: 2262651 - DNA, 18 bp, Homo sapiens
gctgtcgccccaggccct

SEQ ID NO: 2262652 - DNA, 23 bp, Homo sapiens
gctgtcgccccaggccctccctg

SEQ ID NO: 2262653 - DNA, 19 bp, Homo sapiens
gctgtctcatcacataaaa

SEQ ID NO: 2262654 - DNA, 13 bp, Homo sapiens
gctgtctgtcacc

SEQ ID NO: 2262655 - DNA, 21 bp, Homo sapiens
gctgtctgtcaccagctatct

SEQ ID NO: 2262656 - DNA, 18 bp, Homo sapiens
gctgtgcccccctcctcc

SEQ ID NO: 2262657 - DNA, 14 bp, Homo sapiens
gctgtgggcagcac

SEQ ID NO: 2262658 - DNA, 15 bp, Homo sapiens
gctgtgggcagcacc

SEQ ID NO: 2262659 - DNA, 20 bp, Homo sapiens
gctgtgggcagcaccctccc

SEQ ID NO: 2262660 - DNA, 19 bp, Homo sapiens
gctgtgtcctaaggcccat

SEQ ID NO: 2262661 - DNA, 23 bp, Homo sapiens
gctgttaggggttattggtgtaa

SEQ ID NO: 2262662 - DNA, 21 bp, Homo sapiens
gcttaaagttggtattaataa

SEQ ID NO: 2262663 - DNA, 18 bp, Homo sapiens
gcttaacaatgcaacttt

SEQ ID NO: 2262664 - DNA, 21 bp, Homo sapiens
gcttaacaatgcaacttttaa

SEQ ID NO: 2262665 - DNA, 22 bp, Homo sapiens
gcttaacctttccgctgtcgcc

SEQ ID NO: 2262666 - DNA, 23 bp, Homo sapiens
gcttaaggagaggagaaactgag

SEQ ID NO: 2262667 - DNA, 16 bp, Homo sapiens
gcttaatcattttcat

SEQ ID NO: 2262668 - DNA, 14 bp, Homo sapiens
gcttcatgccagct

SEQ ID NO: 2262669 - DNA, 22 bp, Homo sapiens
gcttcgcttccttagccttgct

SEQ ID NO: 2262670 - DNA, 21 bp, Homo sapiens
gcttctcagatttctgaggaa

SEQ ID NO: 2262671 - DNA, 20 bp, Homo sapiens
gcttgacaaatattttcatg

SEQ ID NO: 2262672 - DNA, 21 bp, Homo sapiens
gcttgagagccctgaggccta

SEQ ID NO: 2262673 - DNA, 15 bp, Homo sapiens
gcttgagccaggagg

SEQ ID NO: 2262674 - DNA, 19 bp, Homo sapiens
gcttgagttcaccatctct

SEQ ID NO: 2262675 - DNA, 22 bp, Homo sapiens
gcttgtaactaaaataattttg

SEQ ID NO: 2262676 - DNA, 23 bp, Homo sapiens
gcttgtaactaaaataattttgt

SEQ ID NO: 2262677 - DNA, 16 bp, Homo sapiens
gcttgtcttttctgct

SEQ ID NO: 2262678 - DNA, 21 bp, Homo sapiens
gcttgtcttttctgctgagga

SEQ ID NO: 2262679 - DNA, 21 bp, Homo sapiens
gcttgttgaaaatatttctct

SEQ ID NO: 2262680 - DNA, 22 bp, Homo sapiens
gcttgttgaaaatatttctcta

SEQ ID NO: 2262681 - DNA, 18 bp, Homo sapiens
gctttattttgagatgta

SEQ ID NO: 2262682 - DNA, 20 bp, Homo sapiens
gctttattttgagatgtaaa

SEQ ID NO: 2262683 - DNA, 16 bp, Homo sapiens
gctttcagactccagc

SEQ ID NO: 2262684 - DNA, 23 bp, Homo sapiens
gctttcagagccagcctggctct

SEQ ID NO: 2262685 - DNA, 14 bp, Homo sapiens
gctttggaagtttt

SEQ ID NO: 2262686 - DNA, 18 bp, Homo sapiens
gctttgtctacttcaaaa

SEQ ID NO: 2262687 - DNA, 12 bp, Homo sapiens
gcttttagaaaa

SEQ ID NO: 2262688 - DNA, 13 bp, Homo sapiens
gcttttagaaaag

SEQ ID NO: 2262689 - DNA, 15 bp, Homo sapiens
gcttttattaatgca

SEQ ID NO: 2262690 - DNA, 18 bp, Homo sapiens
gcttttattaatgcactt

SEQ ID NO: 2262691 - DNA, 13 bp, Homo sapiens
gctttttaattaa

SEQ ID NO: 2262692 - DNA, 17 bp, Homo sapiens
ggaaactaagattcttt

SEQ ID NO: 2262693 - DNA, 19 bp, Homo sapiens
ggaaactgggtttctcatt

SEQ ID NO: 2262694 - DNA, 20 bp, Homo sapiens
ggaaactgggtttctcatta

SEQ ID NO: 2262695 - DNA, 15 bp, Homo sapiens
ggaaatgagatgaca

SEQ ID NO: 2262696 - DNA, 15 bp, Homo sapiens
ggaacaaacagggct

SEQ ID NO: 2262697 - DNA, 18 bp, Homo sapiens
ggaacaaggagtcagaca

SEQ ID NO: 2262698 - DNA, 14 bp, Homo sapiens
ggaacatgccccct

SEQ ID NO: 2262699 - DNA, 12 bp, Homo sapiens
ggaaccttccct

SEQ ID NO: 2262700 - DNA, 23 bp, Homo sapiens
ggaagattctatttaattgaaac

SEQ ID NO: 2262701 - DNA, 20 bp, Homo sapiens
ggaagccatcccttttttta

SEQ ID NO: 2262702 - DNA, 14 bp, Homo sapiens
ggaagcccaggagc

SEQ ID NO: 2262703 - DNA, 14 bp, Homo sapiens
ggaagcccctgggc

SEQ ID NO: 2262704 - DNA, 15 bp, Homo sapiens
ggaagcccctgggcc

SEQ ID NO: 2262705 - DNA, 14 bp, Homo sapiens
ggaagcctgcagtc

SEQ ID NO: 2262706 - DNA, 15 bp, Homo sapiens
ggaaggaacaaagac

SEQ ID NO: 2262707 - DNA, 21 bp, Homo sapiens
ggaatgaacttgttacttgca

SEQ ID NO: 2262708 - DNA, 15 bp, Homo sapiens
ggaatgtgtggcctg

SEQ ID NO: 2262709 - DNA, 14 bp, Homo sapiens
gtttcctgcaggca

SEQ ID NO: 2262710 - DNA, 15 bp, Homo sapiens
gtttcctgcaggcat

SEQ ID NO: 2262711 - DNA, 17 bp, Homo sapiens
gtttcgaagtcattaaa

SEQ ID NO: 2262712 - DNA, 22 bp, Homo sapiens
gtttctggacccttataaaatc

SEQ ID NO: 2262713 - DNA, 13 bp, Homo sapiens
gtttggtgcttct

SEQ ID NO: 2262714 - DNA, 15 bp, Homo sapiens
gtttgtgtgtcttaa

SEQ ID NO: 2262715 - DNA, 16 bp, Homo sapiens
gtttgtgttattattt

SEQ ID NO: 2262716 - DNA, 14 bp, Homo sapiens
gttttaatttaaac

SEQ ID NO: 2262717 - DNA, 21 bp, Homo sapiens
gttttaatttaaacacctcct

SEQ ID NO: 2262718 - DNA, 13 bp, Homo sapiens
gttttacaatagt

SEQ ID NO: 2262719 - DNA, 17 bp, Homo sapiens
gttttcaagtcaaatta

SEQ ID NO: 2262720 - DNA, 15 bp, Homo sapiens
gttttccccatgaca

SEQ ID NO: 2262721 - DNA, 17 bp, Homo sapiens
gttttctctcggctccc

SEQ ID NO: 2262722 - DNA, 20 bp, Homo sapiens
gtttttacatacttttgcaa

SEQ ID NO: 2262723 - DNA, 21 bp, Homo sapiens
gtttttacatacttttgcaaa

SEQ ID NO: 2262724 - DNA, 18 bp, Homo sapiens
gtttttcctatcatgtta

SEQ ID NO: 2262725 - DNA, 12 bp, Homo sapiens
gtttttctacta

SEQ ID NO: 2262726 - DNA, 20 bp, Homo sapiens
gttttttcctcagtgcattt

SEQ ID NO: 2262727 - DNA, 14 bp, Homo sapiens
taaaaaatattttc

SEQ ID NO: 2262728 - DNA, 14 bp, Homo sapiens
taaaaaatggtcac

SEQ ID NO: 2262729 - DNA, 14 bp, Homo sapiens
taaaaaattttaaa

SEQ ID NO: 2262730 - DNA, 19 bp, Homo sapiens
taaaaaattttaaaaatct

SEQ ID NO: 2262731 - DNA, 22 bp, Homo sapiens
taaaaacagatttggaaagact

SEQ ID NO: 2262732 - DNA, 15 bp, Homo sapiens
taaaaacataacata

SEQ ID NO: 2262733 - DNA, 17 bp, Homo sapiens
taaaaacataacataaa

SEQ ID NO: 2262734 - DNA, 23 bp, Homo sapiens
taaaaaggactatattaatcacc

SEQ ID NO: 2262735 - DNA, 23 bp, Homo sapiens
taaaaagggaaagttttgttctg

SEQ ID NO: 2262736 - DNA, 18 bp, Homo sapiens
taaaaatttttaaaatac

SEQ ID NO: 2262737 - DNA, 12 bp, Homo sapiens
taaaacattaaa

SEQ ID NO: 2262738 - DNA, 14 bp, Homo sapiens
taaaactcaacatt

SEQ ID NO: 2262739 - DNA, 22 bp, Homo sapiens
taaaactcaacattactgttaa

SEQ ID NO: 2262740 - DNA, 17 bp, Homo sapiens
taaaagaaaaaatgaca

SEQ ID NO: 2262741 - DNA, 14 bp, Homo sapiens
taaaagcattttgt

SEQ ID NO: 2262742 - DNA, 16 bp, Homo sapiens
taaaagtaaaatgtct

SEQ ID NO: 2262743 - DNA, 20 bp, Homo sapiens
taaaagtttgaaaagcaata

SEQ ID NO: 2262744 - DNA, 17 bp, Homo sapiens
taaaataactaaaatgt

SEQ ID NO: 2262745 - DNA, 14 bp, Homo sapiens
taaaataattttgt

SEQ ID NO: 2262746 - DNA, 15 bp, Homo sapiens
taaaataattttgta

SEQ ID NO: 2262747 - DNA, 19 bp, Homo sapiens
taaaatacatagtgaaaat

SEQ ID NO: 2262748 - DNA, 17 bp, Homo sapiens
taaaatacttgtttcag

SEQ ID NO: 2262749 - DNA, 18 bp, Homo sapiens
taaaatagatataaattt

SEQ ID NO: 2262750 - DNA, 16 bp, Homo sapiens
taaaatattttgaatc

SEQ ID NO: 2262751 - DNA, 15 bp, Homo sapiens
taaaatcctgtgcaa

SEQ ID NO: 2262752 - DNA, 19 bp, Homo sapiens
taaaatgcatgattttgta

SEQ ID NO: 2262753 - DNA, 15 bp, Homo sapiens
taaaatggaagcaat

SEQ ID NO: 2262754 - DNA, 22 bp, Homo sapiens
taaaatgtctttccaaattatt

SEQ ID NO: 2262755 - DNA, 14 bp, Homo sapiens
taaaatttgttgca

SEQ ID NO: 2262756 - DNA, 15 bp, Homo sapiens
taaacaaagttacta

SEQ ID NO: 2262757 - DNA, 17 bp, Homo sapiens
taaacatccaatatttt

SEQ ID NO: 2262758 - DNA, 15 bp, Homo sapiens
taaacctcagttatt

SEQ ID NO: 2262759 - DNA, 17 bp, Homo sapiens
taaacgcttcttatgta

SEQ ID NO: 2262760 - DNA, 23 bp, Homo sapiens
taaactcagcatcaaaatatttc

SEQ ID NO: 2262761 - DNA, 11 bp, Homo sapiens
taaacttgaaa

SEQ ID NO: 2262762 - DNA, 14 bp, Homo sapiens
taaagaaaaaaata

SEQ ID NO: 2262763 - DNA, 19 bp, Homo sapiens
taaagatgagctttgtcta

SEQ ID NO: 2262764 - DNA, 20 bp, Homo sapiens
taaagatttatacagttgaa

SEQ ID NO: 2262765 - DNA, 18 bp, Homo sapiens
taaagcatgaaatgtgaa

SEQ ID NO: 2262766 - DNA, 19 bp, Homo sapiens
taaagcatgaaatgtgaat

SEQ ID NO: 2262767 - DNA, 11 bp, Homo sapiens
taaagcctcaa

SEQ ID NO: 2262768 - DNA, 12 bp, Homo sapiens
taaagcctcctc

SEQ ID NO: 2262769 - DNA, 20 bp, Homo sapiens
taaagctaccatttatcaag

SEQ ID NO: 2262770 - DNA, 17 bp, Homo sapiens
taaagggcaaataatga

SEQ ID NO: 2262771 - DNA, 22 bp, Homo sapiens
taaagtctgttgattaaagatg

SEQ ID NO: 2262772 - DNA, 15 bp, Homo sapiens
taaagttacactttt

SEQ ID NO: 2262773 - DNA, 13 bp, Homo sapiens
taaataaaagcac

SEQ ID NO: 2262774 - DNA, 15 bp, Homo sapiens
taaataaaataaaag

SEQ ID NO: 2262775 - DNA, 13 bp, Homo sapiens
taaataaaatttg

SEQ ID NO: 2262776 - DNA, 16 bp, Homo sapiens
taaataacacttgtca

SEQ ID NO: 2262777 - DNA, 17 bp, Homo sapiens
taaataagcaaataaac

SEQ ID NO: 2262778 - DNA, 17 bp, Homo sapiens
taaatacaaaacttcca

SEQ ID NO: 2262779 - DNA, 19 bp, Homo sapiens
taaatataccactctttac

SEQ ID NO: 2262780 - DNA, 18 bp, Homo sapiens
taaatatttaccttgaaa

SEQ ID NO: 2262781 - DNA, 13 bp, Homo sapiens
taaatattttcta

SEQ ID NO: 2262782 - DNA, 17 bp, Homo sapiens
taaatattttctatttt

SEQ ID NO: 2262783 - DNA, 11 bp, Homo sapiens
taaattaatat

SEQ ID NO: 2262784 - DNA, 15 bp, Homo sapiens
taaattaatatcttt

SEQ ID NO: 2262785 - DNA, 16 bp, Homo sapiens
taaattacaattttat

SEQ ID NO: 2262786 - DNA, 16 bp, Homo sapiens
taaattgtctttaaaa

SEQ ID NO: 2262787 - DNA, 23 bp, Homo sapiens
taaattgtctttaaaaactgttt

SEQ ID NO: 2262788 - DNA, 16 bp, Homo sapiens
taacaaaatgtatgtc

SEQ ID NO: 2262789 - DNA, 19 bp, Homo sapiens
taacaaaatgtatgtctgg

SEQ ID NO: 2262790 - DNA, 14 bp, Homo sapiens
taacaaactagaaa

SEQ ID NO: 2262791 - DNA, 17 bp, Homo sapiens
taacaatgcaactttta

SEQ ID NO: 2262792 - DNA, 12 bp, Homo sapiens
taacagctgaat

SEQ ID NO: 2262793 - DNA, 15 bp, Homo sapiens
taacagctgaattat

SEQ ID NO: 2262794 - DNA, 19 bp, Homo sapiens
taacagctgaattatctat

SEQ ID NO: 2262795 - DNA, 19 bp, Homo sapiens
taacatgaggggacatttt

SEQ ID NO: 2262796 - DNA, 23 bp, Homo sapiens
taacatgaggggacattttggtg

SEQ ID NO: 2262797 - DNA, 18 bp, Homo sapiens
taacatggtttaaaagaa

SEQ ID NO: 2262798 - DNA, 21 bp, Homo sapiens
taaccaagagataactgtaaa

SEQ ID NO: 2262799 - DNA, 13 bp, Homo sapiens
taacccagatttt

SEQ ID NO: 2262800 - DNA, 11 bp, Homo sapiens
taacctcccct

SEQ ID NO: 2262801 - DNA, 14 bp, Homo sapiens
taacctcccctctc

SEQ ID NO: 2262802 - DNA, 20 bp, Homo sapiens
taacctctgcttttatctca

SEQ ID NO: 2262803 - DNA, 16 bp, Homo sapiens
taacgttgagcccctg

SEQ ID NO: 2262804 - DNA, 20 bp, Homo sapiens
taactaaaataattttgtaa

SEQ ID NO: 2262805 - DNA, 23 bp, Homo sapiens
taactaaaatgtatctaagaata

SEQ ID NO: 2262806 - DNA, 16 bp, Homo sapiens
taactatcaatattta

SEQ ID NO: 2262807 - DNA, 18 bp, Homo sapiens
taactatcaatatttaag

SEQ ID NO: 2262808 - DNA, 18 bp, Homo sapiens
taactgtaaatgtgacat

SEQ ID NO: 2262809 - DNA, 16 bp, Homo sapiens
taacttgaaaattttt

SEQ ID NO: 2262810 - DNA, 14 bp, Homo sapiens
taactttattcttt

SEQ ID NO: 2262811 - DNA, 20 bp, Homo sapiens
taactttattctttgttctt

SEQ ID NO: 2262812 - DNA, 21 bp, Homo sapiens
taactttgtctcgttcctgtt

SEQ ID NO: 2262813 - DNA, 17 bp, Homo sapiens
taactttttatttctaa

SEQ ID NO: 2262814 - DNA, 19 bp, Homo sapiens
taagaaaagattttaatca

SEQ ID NO: 2262815 - DNA, 15 bp, Homo sapiens
taagaaatacagact

SEQ ID NO: 2262816 - DNA, 16 bp, Homo sapiens
taagaacaactacctg

SEQ ID NO: 2262817 - DNA, 18 bp, Homo sapiens
taagaattcaaactgggg

SEQ ID NO: 2262818 - DNA, 13 bp, Homo sapiens
tataagttttaga

SEQ ID NO: 2262819 - DNA, 18 bp, Homo sapiens
tataatcttgtagacact

SEQ ID NO: 2262820 - DNA, 15 bp, Homo sapiens
tatacaaaactttat

SEQ ID NO: 2262821 - DNA, 18 bp, Homo sapiens
tatacaaattagaaaatg

SEQ ID NO: 2262822 - DNA, 16 bp, Homo sapiens
tatacagttataaaat

SEQ ID NO: 2262823 - DNA, 19 bp, Homo sapiens
tatacagttataaaattaa

SEQ ID NO: 2262824 - DNA, 20 bp, Homo sapiens
tatacagttataaaattaaa

SEQ ID NO: 2262825 - DNA, 23 bp, Homo sapiens
tatacagttataaaattaaaagt

SEQ ID NO: 2262826 - DNA, 18 bp, Homo sapiens
tatacatatctttattaa

SEQ ID NO: 2262827 - DNA, 23 bp, Homo sapiens
tatacatcaatttaaaaagcaaa

SEQ ID NO: 2262828 - DNA, 23 bp, Homo sapiens
tatactccctgcccttccccctg

SEQ ID NO: 2262829 - DNA, 23 bp, Homo sapiens
tatactgatcttcattaccaata

SEQ ID NO: 2262830 - DNA, 19 bp, Homo sapiens
tatagagatatttttgtac

SEQ ID NO: 2262831 - DNA, 15 bp, Homo sapiens
tatagatataatgaa

SEQ ID NO: 2262832 - DNA, 21 bp, Homo sapiens
tatagatataatgaacaaaat

SEQ ID NO: 2262833 - DNA, 23 bp, Homo sapiens
tatagatataatgaacaaaatta

SEQ ID NO: 2262834 - DNA, 20 bp, Homo sapiens
tatagcattaataaaactgt

SEQ ID NO: 2262835 - DNA, 21 bp, Homo sapiens
tatagcattaataaaactgtg

SEQ ID NO: 2262836 - DNA, 21 bp, Homo sapiens
tatagctgagactacaagtgt

SEQ ID NO: 2262837 - DNA, 11 bp, Homo sapiens
tatataaaaat

SEQ ID NO: 2262838 - DNA, 20 bp, Homo sapiens
tatatatctatctatttgag

SEQ ID NO: 2262839 - DNA, 17 bp, Homo sapiens
tatatatttacaaggag

SEQ ID NO: 2262840 - DNA, 13 bp, Homo sapiens
tatatatttctat

SEQ ID NO: 2262841 - DNA, 13 bp, Homo sapiens
tatatgatggggg

SEQ ID NO: 2262842 - DNA, 15 bp, Homo sapiens
tatatgtatattgtc

SEQ ID NO: 2262843 - DNA, 22 bp, Homo sapiens
tatattaatcaccttctttgta

SEQ ID NO: 2262844 - DNA, 21 bp, Homo sapiens
tatattgtcctcccctatttt

SEQ ID NO: 2262845 - DNA, 13 bp, Homo sapiens
tatatttctaaat

SEQ ID NO: 2262846 - DNA, 13 bp, Homo sapiens
tatatttctatta

SEQ ID NO: 2262847 - DNA, 13 bp, Homo sapiens
tatattttatata

SEQ ID NO: 2262848 - DNA, 13 bp, Homo sapiens
tatatttttatct

SEQ ID NO: 2262849 - DNA, 15 bp, Homo sapiens
tatcaatgtgtcttt

SEQ ID NO: 2262850 - DNA, 16 bp, Homo sapiens
tatcaatgtgtctttc

SEQ ID NO: 2262851 - DNA, 9 bp, Homo sapiens
tatcagtag

SEQ ID NO: 2262852 - DNA, 14 bp, Homo sapiens
tatccagaaaactg

SEQ ID NO: 2262853 - DNA, 13 bp, Homo sapiens
tatcctctttgta

SEQ ID NO: 2262854 - DNA, 13 bp, Homo sapiens
tatctataaaata

SEQ ID NO: 2262855 - DNA, 18 bp, Homo sapiens
tatctatataaaataact

SEQ ID NO: 2262856 - DNA, 12 bp, Homo sapiens
tatctatttgag

SEQ ID NO: 2262857 - DNA, 20 bp, Homo sapiens
tatctcctaactttggacct

SEQ ID NO: 2262858 - DNA, 17 bp, Homo sapiens
tatctctatttgagaat

SEQ ID NO: 2262859 - DNA, 11 bp, Homo sapiens
tatctctgtgt

SEQ ID NO: 2262860 - DNA, 18 bp, Homo sapiens
tatctgggctgtgggcaa

SEQ ID NO: 2262861 - DNA, 15 bp, Homo sapiens
tatctttattaatca

SEQ ID NO: 2262862 - DNA, 13 bp, Homo sapiens
tatgaaaacttat

SEQ ID NO: 2262863 - DNA, 15 bp, Homo sapiens
tatgaaaacttatga

SEQ ID NO: 2262864 - DNA, 13 bp, Homo sapiens
tatgactttttat

SEQ ID NO: 2262865 - DNA, 19 bp, Homo sapiens
tatgactttttataaaatg

SEQ ID NO: 2262866 - DNA, 14 bp, Homo sapiens
tatgattgtacttt

SEQ ID NO: 2262867 - DNA, 14 bp, Homo sapiens
tatgcctttctctc

SEQ ID NO: 2262868 - DNA, 20 bp, Homo sapiens
tatgcttgtaactaaaataa

SEQ ID NO: 2262869 - DNA, 16 bp, Homo sapiens
tatggatgatttaagt

SEQ ID NO: 2262870 - DNA, 18 bp, Homo sapiens
tatggatgatttaagtgt

SEQ ID NO: 2262871 - DNA, 19 bp, Homo sapiens
tatggtatgctggccagca

SEQ ID NO: 2262872 - DNA, 22 bp, Homo sapiens
tatggtatgctggccagcaccc

SEQ ID NO: 2262873 - DNA, 23 bp, Homo sapiens
tatggtatgctggccagcaccct

SEQ ID NO: 2262874 - DNA, 17 bp, Homo sapiens
tatgtggttttgtaatt

SEQ ID NO: 2262875 - DNA, 14 bp, Homo sapiens
tatgtgtttttctc

SEQ ID NO: 2262876 - DNA, 21 bp, Homo sapiens
tatgtgtttttctcatatttg

SEQ ID NO: 2262877 - DNA, 17 bp, Homo sapiens
tatgttgtacaatcaaa

SEQ ID NO: 2262878 - DNA, 18 bp, Homo sapiens
tattaaatacaaaacttc

SEQ ID NO: 2262879 - DNA, 13 bp, Homo sapiens
tattaacttttaa

SEQ ID NO: 2262880 - DNA, 18 bp, Homo sapiens
tattaagacaatagcact

SEQ ID NO: 2262881 - DNA, 12 bp, Homo sapiens
tattaatgcact

SEQ ID NO: 2262882 - DNA, 14 bp, Homo sapiens
tattaatgcacttt

SEQ ID NO: 2262883 - DNA, 21 bp, Homo sapiens
tattagggagaaaattcaatt

SEQ ID NO: 2262884 - DNA, 17 bp, Homo sapiens
tattcgaaatgagctca

SEQ ID NO: 2262885 - DNA, 16 bp, Homo sapiens
tattctagcctgcatt

SEQ ID NO: 2262886 - DNA, 19 bp, Homo sapiens
tattctcgaatcacctcct

SEQ ID NO: 2262887 - DNA, 15 bp, Homo sapiens
tattctctatttgaa

SEQ ID NO: 2262888 - DNA, 18 bp, Homo sapiens
tattcttgttagaatctg

SEQ ID NO: 2262889 - DNA, 17 bp, Homo sapiens
tattgccaactcttcta

SEQ ID NO: 2262890 - DNA, 22 bp, Homo sapiens
tattgtgttttgctttggaaac

SEQ ID NO: 2262891 - DNA, 16 bp, Homo sapiens
tattgtttctctgaaa

SEQ ID NO: 2262892 - DNA, 17 bp, Homo sapiens
tattgttttacaatagt

SEQ ID NO: 2262893 - DNA, 20 bp, Homo sapiens
tattgttttacaatagttct

SEQ ID NO: 2262894 - DNA, 21 bp, Homo sapiens
tatttaacagctgaattatct

SEQ ID NO: 2262895 - DNA, 13 bp, Homo sapiens
tatttaagatgtg

SEQ ID NO: 2262896 - DNA, 16 bp, Homo sapiens
tatttaagatgtgaaa

SEQ ID NO: 2262897 - DNA, 22 bp, Homo sapiens
tatttaagtttgttgctgtcaa

SEQ ID NO: 2262898 - DNA, 14 bp, Homo sapiens
tatttataaaactt

SEQ ID NO: 2262899 - DNA, 20 bp, Homo sapiens
tatttatccagaaaactgtg

SEQ ID NO: 2262900 - DNA, 21 bp, Homo sapiens
tatttatccagaaaactgtga

SEQ ID NO: 2262901 - DNA, 23 bp, Homo sapiens
tatttatccagaaaactgtgatt

SEQ ID NO: 2262902 - DNA, 18 bp, Homo sapiens
tatttatgcgtaatttaa

SEQ ID NO: 2262903 - DNA, 19 bp, Homo sapiens
tatttatgcgtaatttaat

SEQ ID NO: 2262904 - DNA, 20 bp, Homo sapiens
tatttatgcgtaatttaatg

SEQ ID NO: 2262905 - DNA, 21 bp, Homo sapiens
tatttatgcgtaatttaatgg

SEQ ID NO: 2262906 - DNA, 14 bp, Homo sapiens
tatttattacataa

SEQ ID NO: 2262907 - DNA, 14 bp, Homo sapiens
tatttattatttat

SEQ ID NO: 2262908 - DNA, 13 bp, Homo sapiens
tatttatttcaga

SEQ ID NO: 2262909 - DNA, 18 bp, Homo sapiens
tatttatttcagatgttt

SEQ ID NO: 2262910 - DNA, 13 bp, Homo sapiens
tatttcagtgaat

SEQ ID NO: 2262911 - DNA, 17 bp, Homo sapiens
tatttctagctttttaa

SEQ ID NO: 2262912 - DNA, 19 bp, Homo sapiens
tatttctcgggtgcatttg

SEQ ID NO: 2262913 - DNA, 14 bp, Homo sapiens
tatttctctagtgt

SEQ ID NO: 2262914 - DNA, 18 bp, Homo sapiens
tatttcttaattattata

SEQ ID NO: 2262915 - DNA, 23 bp, Homo sapiens
tatttcttaattattataaaaat

SEQ ID NO: 2262916 - DNA, 18 bp, Homo sapiens
tatttgaacaatgaagtt

SEQ ID NO: 2262917 - DNA, 20 bp, Homo sapiens
tatttgaacaatgaagttga

SEQ ID NO: 2262918 - DNA, 17 bp, Homo sapiens
tatttgaattatttctg

SEQ ID NO: 2262919 - DNA, 16 bp, Homo sapiens
tattttataatgtcca

SEQ ID NO: 2262920 - DNA, 13 bp, Homo sapiens
tattttatataaa

SEQ ID NO: 2262921 - DNA, 19 bp, Homo sapiens
tattttcatgtattttaca

SEQ ID NO: 2262922 - DNA, 20 bp, Homo sapiens
tattttctctgtacttttca

SEQ ID NO: 2262923 - DNA, 14 bp, Homo sapiens
tattttctttaatg

SEQ ID NO: 2262924 - DNA, 16 bp, Homo sapiens
tatttttacatttaaa

SEQ ID NO: 2262925 - DNA, 22 bp, Homo sapiens
tcaaaaactttggagtcccctc

SEQ ID NO: 2262926 - DNA, 20 bp, Homo sapiens
tcaaaaagggaagtaagcaa

SEQ ID NO: 2262927 - DNA, 13 bp, Homo sapiens
tccttcactgttt

SEQ ID NO: 2262928 - DNA, 13 bp, Homo sapiens
tccttcagacacc

SEQ ID NO: 2262929 - DNA, 19 bp, Homo sapiens
tccttctccaccgcacaga

SEQ ID NO: 2262930 - DNA, 17 bp, Homo sapiens
tccttgagacacggagc

SEQ ID NO: 2262931 - DNA, 23 bp, Homo sapiens
tcctttaggagggagttatctaa

SEQ ID NO: 2262932 - DNA, 12 bp, Homo sapiens
tcgaaaaaataa

SEQ ID NO: 2262933 - DNA, 13 bp, Homo sapiens
tcgaaaaaataat

SEQ ID NO: 2262934 - DNA, 17 bp, Homo sapiens
tcgaaaaaataattatt

SEQ ID NO: 2262935 - DNA, 16 bp, Homo sapiens
tcgaagtcattaaact

SEQ ID NO: 2262936 - DNA, 16 bp, Homo sapiens
tcgagcccagatggaa

SEQ ID NO: 2262937 - DNA, 17 bp, Homo sapiens
tcgagtaaacttgaaaa

SEQ ID NO: 2262938 - DNA, 11 bp, Homo sapiens
tcgatttctac

SEQ ID NO: 2262939 - DNA, 14 bp, Homo sapiens
tcgatttctacctc

SEQ ID NO: 2262940 - DNA, 15 bp, Homo sapiens
tcgatttctacctca

SEQ ID NO: 2262941 - DNA, 20 bp, Homo sapiens
tcgcagggaatgcagcagga

SEQ ID NO: 2262942 - DNA, 17 bp, Homo sapiens
tcgcattccatatcttt

SEQ ID NO: 2262943 - DNA, 19 bp, Homo sapiens
tcgcccaggctggagtgca

SEQ ID NO: 2262944 - DNA, 16 bp, Homo sapiens
tcgccgtgtctcagcc

SEQ ID NO: 2262945 - DNA, 14 bp, Homo sapiens
tcgcgctcagtaaa

SEQ ID NO: 2262946 - DNA, 11 bp, Homo sapiens
tcgctcctagg

SEQ ID NO: 2262947 - DNA, 16 bp, Homo sapiens
tcgctgtcacaggcgg

SEQ ID NO: 2262948 - DNA, 13 bp, Homo sapiens
tcggaatgtcata

SEQ ID NO: 2262949 - DNA, 14 bp, Homo sapiens
tcggaggctgggcc

SEQ ID NO: 2262950 - DNA, 15 bp, Homo sapiens
tcggaggctgggccc

SEQ ID NO: 2262951 - DNA, 19 bp, Homo sapiens
tctaaaccatggcacttga

SEQ ID NO: 2262952 - DNA, 22 bp, Homo sapiens
tctaaatgtttggcatgtaaat

SEQ ID NO: 2262953 - DNA, 15 bp, Homo sapiens
tctaactttattctt

SEQ ID NO: 2262954 - DNA, 17 bp, Homo sapiens
tctaactttattctttg

SEQ ID NO: 2262955 - DNA, 13 bp, Homo sapiens
tctaagaaatcaa

SEQ ID NO: 2262956 - DNA, 18 bp, Homo sapiens
tctaagcagcttattgtt

SEQ ID NO: 2262957 - DNA, 20 bp, Homo sapiens
tctaatcatctgcagttctt

SEQ ID NO: 2262958 - DNA, 15 bp, Homo sapiens
tctacaatgtgaact

SEQ ID NO: 2262959 - DNA, 21 bp, Homo sapiens
tctacatatgatctgtctgtg

SEQ ID NO: 2262960 - DNA, 17 bp, Homo sapiens
tctacattaacttgaaa

SEQ ID NO: 2262961 - DNA, 22 bp, Homo sapiens
tctacatttcacattattctgg

SEQ ID NO: 2262962 - DNA, 15 bp, Homo sapiens
tctacctggtctggt

SEQ ID NO: 2262963 - DNA, 21 bp, Homo sapiens
tctaggacacagttcctggga

SEQ ID NO: 2262964 - DNA, 16 bp, Homo sapiens
tctagtaattgggaaa

SEQ ID NO: 2262965 - DNA, 15 bp, Homo sapiens
tctatacatatcttt

SEQ ID NO: 2262966 - DNA, 15 bp, Homo sapiens
tctatataaaataac

SEQ ID NO: 2262967 - DNA, 14 bp, Homo sapiens
tctatctatttgag

SEQ ID NO: 2262968 - DNA, 16 bp, Homo sapiens
tctatgattgtacttt

SEQ ID NO: 2262969 - DNA, 15 bp, Homo sapiens
tctattgcttggact

SEQ ID NO: 2262970 - DNA, 18 bp, Homo sapiens
tctatttgaattatttct

SEQ ID NO: 2262971 - DNA, 13 bp, Homo sapiens
tctatttttacat

SEQ ID NO: 2262972 - DNA, 20 bp, Homo sapiens
tctattttttgaaaagcaga

SEQ ID NO: 2262973 - DNA, 23 bp, Homo sapiens
tctcactaaagcatgaaatgtga

SEQ ID NO: 2262974 - DNA, 14 bp, Homo sapiens
tctcagatgttaaa

SEQ ID NO: 2262975 - DNA, 17 bp, Homo sapiens
tctcagatttctgagga

SEQ ID NO: 2262976 - DNA, 22 bp, Homo sapiens
tctcagcgaggtgtaaagttgt

SEQ ID NO: 2262977 - DNA, 18 bp, Homo sapiens
tctcaggaaaacagctag

SEQ ID NO: 2262978 - DNA, 13 bp, Homo sapiens
tctcagtgctttc

SEQ ID NO: 2262979 - DNA, 22 bp, Homo sapiens
tctcagtgttgagccttttccc

SEQ ID NO: 2262980 - DNA, 19 bp, Homo sapiens
tctcagtttgtgtgtctta

SEQ ID NO: 2262981 - DNA, 22 bp, Homo sapiens
tctcatgacggcttttgtcagt

SEQ ID NO: 2262982 - DNA, 12 bp, Homo sapiens
tctcattaaagt

SEQ ID NO: 2262983 - DNA, 19 bp, Homo sapiens
tctcattaatactctttat

SEQ ID NO: 2262984 - DNA, 15 bp, Homo sapiens
tctcatttaagggaa

SEQ ID NO: 2262985 - DNA, 17 bp, Homo sapiens
tctcatttaagggaaaa

SEQ ID NO: 2262986 - DNA, 19 bp, Homo sapiens
tctcatttaagggaaaaat

SEQ ID NO: 2262987 - DNA, 13 bp, Homo sapiens
tctccacttgtat

SEQ ID NO: 2262988 - DNA, 18 bp, Homo sapiens
tctccagatgtttccaga

SEQ ID NO: 2262989 - DNA, 19 bp, Homo sapiens
tctccagatgtttccagac

SEQ ID NO: 2262990 - DNA, 21 bp, Homo sapiens
tctccagctgggctctgcaat

SEQ ID NO: 2262991 - DNA, 13 bp, Homo sapiens
tctccccagcctg

SEQ ID NO: 2262992 - DNA, 16 bp, Homo sapiens
tctccccagcctggca

SEQ ID NO: 2262993 - DNA, 12 bp, Homo sapiens
tctccctctctc

SEQ ID NO: 2262994 - DNA, 17 bp, Homo sapiens
tctccgggtgtggcctc

SEQ ID NO: 2262995 - DNA, 18 bp, Homo sapiens
tctccgggtgtggcctca

SEQ ID NO: 2262996 - DNA, 21 bp, Homo sapiens
tctccgggtgtggcctcagcc

SEQ ID NO: 2262997 - DNA, 15 bp, Homo sapiens
tctcctatatatttc

SEQ ID NO: 2262998 - DNA, 13 bp, Homo sapiens
tctcgagcccaga

SEQ ID NO: 2262999 - DNA, 14 bp, Homo sapiens
tctcgggtgcattt

SEQ ID NO: 2263000 - DNA, 22 bp, Homo sapiens
tctctactgaatgtcattgaaa

SEQ ID NO: 2263001 - DNA, 18 bp, Homo sapiens
tctctatttgaattattt

SEQ ID NO: 2263002 - DNA, 23 bp, Homo sapiens
tctctcggctccccatgtgtcct

SEQ ID NO: 2263003 - DNA, 14 bp, Homo sapiens
tctctctctcttcc

SEQ ID NO: 2263004 - DNA, 15 bp, Homo sapiens
tctctctggggccct

SEQ ID NO: 2263005 - DNA, 14 bp, Homo sapiens
tctctgcctgtaaa

SEQ ID NO: 2263006 - DNA, 19 bp, Homo sapiens
tctctggaagcccctgggc

SEQ ID NO: 2263007 - DNA, 21 bp, Homo sapiens
tctctgtacttttcattctct

SEQ ID NO: 2263008 - DNA, 16 bp, Homo sapiens
tctctgtataatctat

SEQ ID NO: 2263009 - DNA, 22 bp, Homo sapiens
tctcttccagctgcttcaggga

SEQ ID NO: 2263010 - DNA, 12 bp, Homo sapiens
tctcttttccac

SEQ ID NO: 2263011 - DNA, 19 bp, Homo sapiens
tctgaaaacccaaggccag

SEQ ID NO: 2263012 - DNA, 14 bp, Homo sapiens
tctgaccttaaatg

SEQ ID NO: 2263013 - DNA, 15 bp, Homo sapiens
tctgagactggcaga

SEQ ID NO: 2263014 - DNA, 14 bp, Homo sapiens
tctgagctgccagt

SEQ ID NO: 2263015 - DNA, 18 bp, Homo sapiens
tctgagtgaacctgtata

SEQ ID NO: 2263016 - DNA, 20 bp, Homo sapiens
tctgagtgaacctgtataag

SEQ ID NO: 2263017 - DNA, 14 bp, Homo sapiens
tctgcaaaaatatt

SEQ ID NO: 2263018 - DNA, 13 bp, Homo sapiens
tctgcaacaaaaa

SEQ ID NO: 2263019 - DNA, 20 bp, Homo sapiens
tctgcaattcccctctgctg

SEQ ID NO: 2263020 - DNA, 14 bp, Homo sapiens
tctgcacacaaata

SEQ ID NO: 2263021 - DNA, 17 bp, Homo sapiens
tctgcagttctttttgt

SEQ ID NO: 2263022 - DNA, 12 bp, Homo sapiens
tctgccagcgcc

SEQ ID NO: 2263023 - DNA, 13 bp, Homo sapiens
tctgcctgtaaat

SEQ ID NO: 2263024 - DNA, 19 bp, Homo sapiens
tctgccttagtctcagttt

SEQ ID NO: 2263025 - DNA, 16 bp, Homo sapiens
tctgctagatttctac

SEQ ID NO: 2263026 - DNA, 17 bp, Homo sapiens
tctgctagatttctaca

SEQ ID NO: 2263027 - DNA, 22 bp, Homo sapiens
tctgctcccctaaagcctcaaa

SEQ ID NO: 2263028 - DNA, 18 bp, Homo sapiens
tctgctgctgtccctccc

SEQ ID NO: 2263029 - DNA, 12 bp, Homo sapiens
tctgctgtagaa

SEQ ID NO: 2263030 - DNA, 19 bp, Homo sapiens
tctggaatctggagaccag

SEQ ID NO: 2263031 - DNA, 15 bp, Homo sapiens
tctggacagtacctg

SEQ ID NO: 2263032 - DNA, 23 bp, Homo sapiens
tctggacagtacctgattgtatt

SEQ ID NO: 2263033 - DNA, 17 bp, Homo sapiens
tctggacccctgggcct

SEQ ID NO: 2263034 - DNA, 21 bp, Homo sapiens
tctggagaccagggagccttt

SEQ ID NO: 2263035 - DNA, 18 bp, Homo sapiens
tctgggaatgggagaggg

SEQ ID NO: 2263036 - DNA, 18 bp, Homo sapiens
tggcccctctgacctgca

SEQ ID NO: 2263037 - DNA, 23 bp, Homo sapiens
tggccgccccctgccccccagcc

SEQ ID NO: 2263038 - DNA, 21 bp, Homo sapiens
tggcctaaacctcagttatta

SEQ ID NO: 2263039 - DNA, 14 bp, Homo sapiens
tggcctcagccctc

SEQ ID NO: 2263040 - DNA, 21 bp, Homo sapiens
tggcctggaatttgggcagat

SEQ ID NO: 2263041 - DNA, 15 bp, Homo sapiens
tggcgtgctcagacc

SEQ ID NO: 2263042 - DNA, 21 bp, Homo sapiens
tggcgtgctcagacccaacag

SEQ ID NO: 2263043 - DNA, 19 bp, Homo sapiens
tggctccttcccatcgctg

SEQ ID NO: 2263044 - DNA, 21 bp, Homo sapiens
tggctctgaggtgcctgtccc

SEQ ID NO: 2263045 - DNA, 13 bp, Homo sapiens
tggctctgccccc

SEQ ID NO: 2263046 - DNA, 17 bp, Homo sapiens
tggctctgccccctccc

SEQ ID NO: 2263047 - DNA, 17 bp, Homo sapiens
tggctggtagcagcagg

SEQ ID NO: 2263048 - DNA, 21 bp, Homo sapiens
tggctggtagcagcaggctca

SEQ ID NO: 2263049 - DNA, 23 bp, Homo sapiens
tggctggtagcagcaggctcagg

SEQ ID NO: 2263050 - DNA, 13 bp, Homo sapiens
tggctgtaatcat

SEQ ID NO: 2263051 - DNA, 18 bp, Homo sapiens
tggcttcggacaaaatat

SEQ ID NO: 2263052 - DNA, 14 bp, Homo sapiens
tggctttcagagcc

SEQ ID NO: 2263053 - DNA, 21 bp, Homo sapiens
tggcttttattaatgcacttt

SEQ ID NO: 2263054 - DNA, 17 bp, Homo sapiens
tgggaaaccatgtagca

SEQ ID NO: 2263055 - DNA, 20 bp, Homo sapiens
tgggaaactgggtttctcat

SEQ ID NO: 2263056 - DNA, 18 bp, Homo sapiens
tgggagactctttgaaat

SEQ ID NO: 2263057 - DNA, 20 bp, Homo sapiens
tgggagactctttgaaatga

SEQ ID NO: 2263058 - DNA, 16 bp, Homo sapiens
tgggagctgccaagag

SEQ ID NO: 2263059 - DNA, 18 bp, Homo sapiens
tgggaggatacagaggag

SEQ ID NO: 2263060 - DNA, 18 bp, Homo sapiens
tgggcaccacaaaatata

SEQ ID NO: 2263061 - DNA, 12 bp, Homo sapiens
tgggcagcaccc

SEQ ID NO: 2263062 - DNA, 16 bp, Homo sapiens
tgggcagcaccctccc

SEQ ID NO: 2263063 - DNA, 12 bp, Homo sapiens
tgggcagccaga

SEQ ID NO: 2263064 - DNA, 23 bp, Homo sapiens
tgggccaggaggtagtttctcat

SEQ ID NO: 2263065 - DNA, 14 bp, Homo sapiens
tgggccatgtccaa

SEQ ID NO: 2263066 - DNA, 17 bp, Homo sapiens
tgggccatgtccaaaga

SEQ ID NO: 2263067 - DNA, 18 bp, Homo sapiens
tgggccatgtccaaagag

SEQ ID NO: 2263068 - DNA, 23 bp, Homo sapiens
tgggccatgtccaaagaggctgc

SEQ ID NO: 2263069 - DNA, 13 bp, Homo sapiens
tgggcccctccac

SEQ ID NO: 2263070 - DNA, 17 bp, Homo sapiens
tgggcctcatcacagca

SEQ ID NO: 2263071 - DNA, 20 bp, Homo sapiens
tgggctctgcaattcccctc

SEQ ID NO: 2263072 - DNA, 18 bp, Homo sapiens
tgggctctgttcttggct

SEQ ID NO: 2263073 - DNA, 12 bp, Homo sapiens
tgggctgtctgt

SEQ ID NO: 2263074 - DNA, 16 bp, Homo sapiens
tgggctgtctgtcacc

SEQ ID NO: 2263075 - DNA, 21 bp, Homo sapiens
tgggctgtgtcctaaggccca

SEQ ID NO: 2263076 - DNA, 18 bp, Homo sapiens
tggggacctggtaccctc

SEQ ID NO: 2263077 - DNA, 21 bp, Homo sapiens
tggggatccccgcctggccag

SEQ ID NO: 2263078 - DNA, 12 bp, Homo sapiens
tggggccctggg

SEQ ID NO: 2263079 - DNA, 15 bp, Homo sapiens
tggggccctgggcct

SEQ ID NO: 2263080 - DNA, 16 bp, Homo sapiens
tggggccctgggcctc

SEQ ID NO: 2263081 - DNA, 17 bp, Homo sapiens
tggggccctgggcctca

SEQ ID NO: 2263082 - DNA, 18 bp, Homo sapiens
tggggcctacagctttga

SEQ ID NO: 2263083 - DNA, 18 bp, Homo sapiens
tgggggacgagggccagg

SEQ ID NO: 2263084 - DNA, 19 bp, Homo sapiens
tgggggaggggggggtggg

SEQ ID NO: 2263085 - DNA, 20 bp, Homo sapiens
tgggggaggggggggtgggg

SEQ ID NO: 2263086 - DNA, 15 bp, Homo sapiens
tgggggtggcaggca

SEQ ID NO: 2263087 - DNA, 21 bp, Homo sapiens
tgggggtggccatccctgggc

SEQ ID NO: 2263088 - DNA, 22 bp, Homo sapiens
tgggtctaggacacagttcctg

SEQ ID NO: 2263089 - DNA, 13 bp, Homo sapiens
tgggtgagagagg

SEQ ID NO: 2263090 - DNA, 13 bp, Homo sapiens
tgggtggtaccct

SEQ ID NO: 2263091 - DNA, 17 bp, Homo sapiens
tgggttaattcatttgg

SEQ ID NO: 2263092 - DNA, 18 bp, Homo sapiens
tgggtttctcattaaagt

SEQ ID NO: 2263093 - DNA, 16 bp, Homo sapiens
tggtaaagactggctt

SEQ ID NO: 2263094 - DNA, 15 bp, Homo sapiens
tggtaccctcctggc

SEQ ID NO: 2263095 - DNA, 21 bp, Homo sapiens
tggtaccctcctggctcttga

SEQ ID NO: 2263096 - DNA, 14 bp, Homo sapiens
tggtaccctctgga

SEQ ID NO: 2263097 - DNA, 19 bp, Homo sapiens
tggtatgctggccagcacc

SEQ ID NO: 2263098 - DNA, 19 bp, Homo sapiens
tggtcacgtttggtgcttc

SEQ ID NO: 2263099 - DNA, 17 bp, Homo sapiens
tggtccccgttccaccc

SEQ ID NO: 2263100 - DNA, 18 bp, Homo sapiens
tggtctaaggttcagcct

SEQ ID NO: 2263101 - DNA, 16 bp, Homo sapiens
tggtctggttgggcag

SEQ ID NO: 2263102 - DNA, 14 bp, Homo sapiens
tggtgacacctccc

SEQ ID NO: 2263103 - DNA, 17 bp, Homo sapiens
tggtgacacctccccct

SEQ ID NO: 2263104 - DNA, 18 bp, Homo sapiens
tggtgacacctccccctt

SEQ ID NO: 2263105 - DNA, 15 bp, Homo sapiens
tggtgcagtgtgaaa

SEQ ID NO: 2263106 - DNA, 16 bp, Homo sapiens
tggttggagaatttag

SEQ ID NO: 2263107 - DNA, 15 bp, Homo sapiens
tggtttaaaagaaaa

SEQ ID NO: 2263108 - DNA, 13 bp, Homo sapiens
tgtaaaagacatt

SEQ ID NO: 2263109 - DNA, 19 bp, Homo sapiens
tgtaaaatattttgaatca

SEQ ID NO: 2263110 - DNA, 20 bp, Homo sapiens
tgtaaaatattttgaatcaa

SEQ ID NO: 2263111 - DNA, 22 bp, Homo sapiens
tgtaaactcatctgaaatgtta

SEQ ID NO: 2263112 - DNA, 14 bp, Homo sapiens
tgtaaagatttata

SEQ ID NO: 2263113 - DNA, 14 bp, Homo sapiens
tgtaactaaaataa

SEQ ID NO: 2263114 - DNA, 21 bp, Homo sapiens
tgtaactgaggactgtttgca

SEQ ID NO: 2263115 - DNA, 12 bp, Homo sapiens
tgtaacttcaaa

SEQ ID NO: 2263116 - DNA, 14 bp, Homo sapiens
tgtaacttcaaata

SEQ ID NO: 2263117 - DNA, 17 bp, Homo sapiens
tgtaagaaatacagact

SEQ ID NO: 2263118 - DNA, 21 bp, Homo sapiens
tgtaagaacaactacctgagc

SEQ ID NO: 2263119 - DNA, 18 bp, Homo sapiens
tgtaagacccttattgct

SEQ ID NO: 2263120 - DNA, 22 bp, Homo sapiens
tgtaagacccttattgctgtcc

SEQ ID NO: 2263121 - DNA, 19 bp, Homo sapiens
tgtaataataaagaatagc

SEQ ID NO: 2263122 - DNA, 15 bp, Homo sapiens
tgtaattaaattctg

SEQ ID NO: 2263123 - DNA, 14 bp, Homo sapiens
tgtaatttgtttga

SEQ ID NO: 2263124 - DNA, 23 bp, Homo sapiens
tgtacatacgatttaaggtattt

SEQ ID NO: 2263125 - DNA, 14 bp, Homo sapiens
tgtacctcaaatga

SEQ ID NO: 2263126 - DNA, 16 bp, Homo sapiens
tgtactgttctgtgtc

SEQ ID NO: 2263127 - DNA, 19 bp, Homo sapiens
tgtactgttctgtgtcttt

SEQ ID NO: 2263128 - DNA, 18 bp, Homo sapiens
tgtacttttcattctctt

SEQ ID NO: 2263129 - DNA, 15 bp, Homo sapiens
tgtactttttagtaa

SEQ ID NO: 2263130 - DNA, 20 bp, Homo sapiens
tgtactttttagtaatttct

SEQ ID NO: 2263131 - DNA, 17 bp, Homo sapiens
tgtagacgatatactcc

SEQ ID NO: 2263132 - DNA, 16 bp, Homo sapiens
tgtagattcaggtaat

SEQ ID NO: 2263133 - DNA, 18 bp, Homo sapiens
tgtagccccctggcctct

SEQ ID NO: 2263134 - DNA, 20 bp, Homo sapiens
tgtagccccctggcctctgt

SEQ ID NO: 2263135 - DNA, 12 bp, Homo sapiens
tgtaggagctgc

SEQ ID NO: 2263136 - DNA, 20 bp, Homo sapiens
tgtagtcctagctactcagg

SEQ ID NO: 2263137 - DNA, 16 bp, Homo sapiens
tgtataaaatacatag

SEQ ID NO: 2263138 - DNA, 19 bp, Homo sapiens
tgtataagtggaggcactt

SEQ ID NO: 2263139 - DNA, 14 bp, Homo sapiens
tgtataatctattt

SEQ ID NO: 2263140 - DNA, 12 bp, Homo sapiens
tgtatataaaaa

SEQ ID NO: 2263141 - DNA, 15 bp, Homo sapiens
tgtatattacaatga

SEQ ID NO: 2263142 - DNA, 12 bp, Homo sapiens
tgtatattttat

SEQ ID NO: 2263143 - DNA, 19 bp, Homo sapiens
tgtatctaagaataataaa

SEQ ID NO: 2263144 - DNA, 17 bp, Homo sapiens
ttctggccttgtaagac

SEQ ID NO: 2263145 - DNA, 19 bp, Homo sapiens
ttctggggcaggctgggcc

SEQ ID NO: 2263146 - DNA, 16 bp, Homo sapiens
ttctgtattttaagaa

SEQ ID NO: 2263147 - DNA, 20 bp, Homo sapiens
ttcttaattattataaaaat

SEQ ID NO: 2263148 - DNA, 21 bp, Homo sapiens
ttcttaattattataaaaata

SEQ ID NO: 2263149 - DNA, 20 bp, Homo sapiens
ttcttagaacagtggaaact

SEQ ID NO: 2263150 - DNA, 22 bp, Homo sapiens
ttcttagaacagtggaaactat

SEQ ID NO: 2263151 - DNA, 22 bp, Homo sapiens
ttcttggcttaatcattttcat

SEQ ID NO: 2263152 - DNA, 12 bp, Homo sapiens
ttctttaatgct

SEQ ID NO: 2263153 - DNA, 18 bp, Homo sapiens
ttctttaatgcttttata

SEQ ID NO: 2263154 - DNA, 13 bp, Homo sapiens
ttcttttggtaaa

SEQ ID NO: 2263155 - DNA, 22 bp, Homo sapiens
ttcttttggtaaagactggctt

SEQ ID NO: 2263156 - DNA, 13 bp, Homo sapiens
ttctttttgtaca

SEQ ID NO: 2263157 - DNA, 17 bp, Homo sapiens
ttcttttttaaattaat

SEQ ID NO: 2263158 - DNA, 22 bp, Homo sapiens
ttcttttttttttttttgagac

SEQ ID NO: 2263159 - DNA, 19 bp, Homo sapiens
ttgaaaatggacagaatgt

SEQ ID NO: 2263160 - DNA, 13 bp, Homo sapiens
ttgaaatgaaagg

SEQ ID NO: 2263161 - DNA, 14 bp, Homo sapiens
ttgaaatgaaaggg

SEQ ID NO: 2263162 - DNA, 18 bp, Homo sapiens
ttgaagggagaagacact

SEQ ID NO: 2263163 - DNA, 18 bp, Homo sapiens
ttgaatataagaaaatgc

SEQ ID NO: 2263164 - DNA, 20 bp, Homo sapiens
ttgaatataagaaaatgctt

SEQ ID NO: 2263165 - DNA, 17 bp, Homo sapiens
ttgaatcagtataaaca

SEQ ID NO: 2263166 - DNA, 16 bp, Homo sapiens
ttgacaattgggagct

SEQ ID NO: 2263167 - DNA, 18 bp, Homo sapiens
ttgacacaagtggacctt

SEQ ID NO: 2263168 - DNA, 16 bp, Homo sapiens
ttgacccttgctgtga

SEQ ID NO: 2263169 - DNA, 22 bp, Homo sapiens
ttgagaagacctcacctagaaa

SEQ ID NO: 2263170 - DNA, 22 bp, Homo sapiens
ttgagcacttttcaaacaatca

SEQ ID NO: 2263171 - DNA, 12 bp, Homo sapiens
ttgagccacagt

SEQ ID NO: 2263172 - DNA, 15 bp, Homo sapiens
ttgagtgtcttctaa

SEQ ID NO: 2263173 - DNA, 16 bp, Homo sapiens
ttgatagaaaggaaca

SEQ ID NO: 2263174 - DNA, 20 bp, Homo sapiens
ttgattgttcgggtgtgcaa

SEQ ID NO: 2263175 - DNA, 21 bp, Homo sapiens
ttgcaaagacctacctccaga

SEQ ID NO: 2263176 - DNA, 16 bp, Homo sapiens
ttgcaactttagtttg

SEQ ID NO: 2263177 - DNA, 20 bp, Homo sapiens
ttgcacttgtgattatttat

SEQ ID NO: 2263178 - DNA, 13 bp, Homo sapiens
ttgcagtttatca

SEQ ID NO: 2263179 - DNA, 15 bp, Homo sapiens
ttgcagtttttcatt

SEQ ID NO: 2263180 - DNA, 19 bp, Homo sapiens
ttgcatcagaaagctttat

SEQ ID NO: 2263181 - DNA, 14 bp, Homo sapiens
ttgccaactcttct

SEQ ID NO: 2263182 - DNA, 19 bp, Homo sapiens
ttgctatagttatacatca

SEQ ID NO: 2263183 - DNA, 18 bp, Homo sapiens
ttgctatcaacaataaaa

SEQ ID NO: 2263184 - DNA, 22 bp, Homo sapiens
ttgctatcaacaataaaatttt

SEQ ID NO: 2263185 - DNA, 15 bp, Homo sapiens
ttgctcagcccgctt

SEQ ID NO: 2263186 - DNA, 20 bp, Homo sapiens
ttgctcagcccgcttggcca

SEQ ID NO: 2263187 - DNA, 22 bp, Homo sapiens
ttgctcagcccgcttggccacc

SEQ ID NO: 2263188 - DNA, 15 bp, Homo sapiens
ttgctgagcctctgc

SEQ ID NO: 2263189 - DNA, 17 bp, Homo sapiens
ttgctgggaggactgga

SEQ ID NO: 2263190 - DNA, 17 bp, Homo sapiens
ttgctgtctatgattgt

SEQ ID NO: 2263191 - DNA, 21 bp, Homo sapiens
ttggaagattctatttaattg

SEQ ID NO: 2263192 - DNA, 15 bp, Homo sapiens
ttggaagttttaatc

SEQ ID NO: 2263193 - DNA, 18 bp, Homo sapiens
ttggagaaatgaaaacag

SEQ ID NO: 2263194 - DNA, 15 bp, Homo sapiens
ttggattaaattagt

SEQ ID NO: 2263195 - DNA, 20 bp, Homo sapiens
ttggcaggcccactccccag

SEQ ID NO: 2263196 - DNA, 20 bp, Homo sapiens
ttggcatgtaaatgtaaact

SEQ ID NO: 2263197 - DNA, 19 bp, Homo sapiens
ttggctttcagagccagcc

SEQ ID NO: 2263198 - DNA, 14 bp, Homo sapiens
ttgggaattttatt

SEQ ID NO: 2263199 - DNA, 13 bp, Homo sapiens
ttggggggccggg

SEQ ID NO: 2263200 - DNA, 15 bp, Homo sapiens
ttgggggtttttaat

SEQ ID NO: 2263201 - DNA, 15 bp, Homo sapiens
ttggggtctgacccc

SEQ ID NO: 2263202 - DNA, 16 bp, Homo sapiens
ttggtaaagactggct

SEQ ID NO: 2263203 - DNA, 19 bp, Homo sapiens
ttggtaaagactggctttt

SEQ ID NO: 2263204 - DNA, 14 bp, Homo sapiens
ttggtgactgtccc

SEQ ID NO: 2263205 - DNA, 17 bp, Homo sapiens
ttgtaaaagcattttgt

SEQ ID NO: 2263206 - DNA, 19 bp, Homo sapiens
ttgtaaaagcattttgtaa

SEQ ID NO: 2263207 - DNA, 17 bp, Homo sapiens
ttgtaactaaaataatt

SEQ ID NO: 2263208 - DNA, 18 bp, Homo sapiens
ttgtaactaaaataattt

SEQ ID NO: 2263209 - DNA, 14 bp, Homo sapiens
ttgtaatatgtaaa

SEQ ID NO: 2263210 - DNA, 15 bp, Homo sapiens
ttgtaatatgtaaat

SEQ ID NO: 2263211 - DNA, 18 bp, Homo sapiens
ttgtacgttatatattgt

SEQ ID NO: 2263212 - DNA, 13 bp, Homo sapiens
ttgtatattacaa

SEQ ID NO: 2263213 - DNA, 22 bp, Homo sapiens
ttgtcaagaatagcattgtaaa

SEQ ID NO: 2263214 - DNA, 16 bp, Homo sapiens
ttgtcacttttccttt

SEQ ID NO: 2263215 - DNA, 19 bp, Homo sapiens
ttgtccaattgtgtagacg

SEQ ID NO: 2263216 - DNA, 19 bp, Homo sapiens
ttgtcctcccctattttaa

SEQ ID NO: 2263217 - DNA, 17 bp, Homo sapiens
ttgtcctttcccttcag

SEQ ID NO: 2263218 - DNA, 22 bp, Homo sapiens
ttgtctacgggggcacttggag

SEQ ID NO: 2263219 - DNA, 15 bp, Homo sapiens
ttgtctgaaacattt

SEQ ID NO: 2263220 - DNA, 16 bp, Homo sapiens
ttgtcttttctgctga

SEQ ID NO: 2263221 - DNA, 13 bp, Homo sapiens
ttgtgaaggcagg

SEQ ID NO: 2263222 - DNA, 15 bp, Homo sapiens
ttgtgatagcacttt

SEQ ID NO: 2263223 - DNA, 16 bp, Homo sapiens
ttgtgatagcactttc

SEQ ID NO: 2263224 - DNA, 20 bp, Homo sapiens
ttgtgctgggagcaggactg

SEQ ID NO: 2263225 - DNA, 17 bp, Homo sapiens
ttgtgctgtgggcagca

SEQ ID NO: 2263226 - DNA, 19 bp, Homo sapiens
ttgtgctgtgggcagcacc

SEQ ID NO: 2263227 - DNA, 21 bp, Homo sapiens
ttgtgctgtgggcagcaccct

SEQ ID NO: 2263228 - DNA, 22 bp, Homo sapiens
ttgtgctgtgggcagcaccctc

SEQ ID NO: 2263229 - DNA, 13 bp, Homo sapiens
ttgtgtgtcttaa

SEQ ID NO: 2263230 - DNA, 22 bp, Homo sapiens
ttgtgttgactttataaatttc

SEQ ID NO: 2263231 - DNA, 15 bp, Homo sapiens
ttgttattaaacaaa

SEQ ID NO: 2263232 - DNA, 12 bp, Homo sapiens
ttgttcatttgg

SEQ ID NO: 2263233 - DNA, 16 bp, Homo sapiens
ttgttcgggtgtgcaa

SEQ ID NO: 2263234 - DNA, 12 bp, Homo sapiens
ttgttctgtata

SEQ ID NO: 2263235 - DNA, 20 bp, Homo sapiens
ttgttgttttaacctcccct

SEQ ID NO: 2263236 - DNA, 13 bp, Homo sapiens
ttgttttacaata

SEQ ID NO: 2263237 - DNA, 17 bp, Homo sapiens
tttaaaaaatattttct

SEQ ID NO: 2263238 - DNA, 20 bp, Homo sapiens
tttaaaaatggtatcaaaat

SEQ ID NO: 2263239 - DNA, 20 bp, Homo sapiens
tttaaaagcaattatattgt

SEQ ID NO: 2263240 - DNA, 18 bp, Homo sapiens
tttaaagaatatgacttt

SEQ ID NO: 2263241 - DNA, 19 bp, Homo sapiens
tttaaataatgtatttact

SEQ ID NO: 2263242 - DNA, 14 bp, Homo sapiens
tttaaatattttct

SEQ ID NO: 2263243 - DNA, 20 bp, Homo sapiens
tttaaattaatatctttctg

SEQ ID NO: 2263244 - DNA, 14 bp, Homo sapiens
tttaaattagaaaa

SEQ ID NO: 2263245 - DNA, 18 bp, Homo sapiens
tttaacaatttattctga

SEQ ID NO: 2263246 - DNA, 12 bp, Homo sapiens
tttaacttttct

SEQ ID NO: 2263247 - DNA, 15 bp, Homo sapiens
tttaacttttctacc

SEQ ID NO: 2263248 - DNA, 12 bp, Homo sapiens
tttaagatgtga

SEQ ID NO: 2263249 - DNA, 17 bp, Homo sapiens
tttaagtgttggaaaaa

SEQ ID NO: 2263250 - DNA, 22 bp, Homo sapiens
tttaatcatagttactgtgtaa

SEQ ID NO: 2263251 - DNA, 15 bp, Homo sapiens
tttaatcatgaatat

SEQ ID NO: 2263252 - DNA, 11 bp, Homo sapiens
aactgtaaatc

SEQ ID NO: 2263253 - DNA, 18 bp, Homo sapiens
aactgtgcgttaaataag

SEQ ID NO: 2263254 - DNA, 19 bp, Homo sapiens
aacttacattgttcaatta

SEQ ID NO: 2263255 - DNA, 22 bp, Homo sapiens
aacttacattgttcaattagaa

SEQ ID NO: 2263256 - DNA, 16 bp, Homo sapiens
aacttcaaatatagag

SEQ ID NO: 2263257 - DNA, 15 bp, Homo sapiens
aacttggatttttga

SEQ ID NO: 2263258 - DNA, 14 bp, Homo sapiens
aactttattaaata

SEQ ID NO: 2263259 - DNA, 19 bp, Homo sapiens
aactttattaaatacaaaa

SEQ ID NO: 2263260 - DNA, 12 bp, Homo sapiens
aacttttctacc

SEQ ID NO: 2263261 - DNA, 16 bp, Homo sapiens
aactttttatttctaa

SEQ ID NO: 2263262 - DNA, 23 bp, Homo sapiens
aactttttatttctaaatgagac

SEQ ID NO: 2263263 - DNA, 22 bp, Homo sapiens
aagaaaaaaatactatttaaga

SEQ ID NO: 2263264 - DNA, 14 bp, Homo sapiens
aagaaataatagaa

SEQ ID NO: 2263265 - DNA, 22 bp, Homo sapiens
aagaacgcggtgtgtaacactg

SEQ ID NO: 2263266 - DNA, 13 bp, Homo sapiens
aagaactctctgg

SEQ ID NO: 2263267 - DNA, 13 bp, Homo sapiens
aagaagaagggca

SEQ ID NO: 2263268 - DNA, 16 bp, Homo sapiens
aagaagctttatttct

SEQ ID NO: 2263269 - DNA, 13 bp, Homo sapiens
aagaataataaaa

SEQ ID NO: 2263270 - DNA, 19 bp, Homo sapiens
aagaattcaaactggggcc

SEQ ID NO: 2263271 - DNA, 16 bp, Homo sapiens
aagacctcacctagaa

SEQ ID NO: 2263272 - DNA, 18 bp, Homo sapiens
aagacgtttaactgcagt

SEQ ID NO: 2263273 - DNA, 23 bp, Homo sapiens
aagactggcttttattaatgcac

SEQ ID NO: 2263274 - DNA, 20 bp, Homo sapiens
aagagaactcgcgctcagta

SEQ ID NO: 2263275 - DNA, 16 bp, Homo sapiens
aagagataactgtaaa

SEQ ID NO: 2263276 - DNA, 16 bp, Homo sapiens
aagagatgacaaacca

SEQ ID NO: 2263277 - DNA, 19 bp, Homo sapiens
aagaggaaaagtgcaatgc

SEQ ID NO: 2263278 - DNA, 22 bp, Homo sapiens
aagaggatgctgggctctgttc

SEQ ID NO: 2263279 - DNA, 15 bp, Homo sapiens
aagataatctcagtg

SEQ ID NO: 2263280 - DNA, 22 bp, Homo sapiens
aagataatctcagtgctttcct

SEQ ID NO: 2263281 - DNA, 19 bp, Homo sapiens
aagatatttgcagtttttc

SEQ ID NO: 2263282 - DNA, 14 bp, Homo sapiens
aagatccagctgcc

SEQ ID NO: 2263283 - DNA, 22 bp, Homo sapiens
aagatgaatttgtccaattgtg

SEQ ID NO: 2263284 - DNA, 17 bp, Homo sapiens
aagatgactgtgttgta

SEQ ID NO: 2263285 - DNA, 14 bp, Homo sapiens
aagatgtgaaaatt

SEQ ID NO: 2263286 - DNA, 20 bp, Homo sapiens
aagatgttctggataccatt

SEQ ID NO: 2263287 - DNA, 20 bp, Homo sapiens
aagattcttttaaattagaa

SEQ ID NO: 2263288 - DNA, 14 bp, Homo sapiens
aagattgatatcta

SEQ ID NO: 2263289 - DNA, 20 bp, Homo sapiens
aagattgatatctataaaat

SEQ ID NO: 2263290 - DNA, 17 bp, Homo sapiens
aagattttaatcaagtt

SEQ ID NO: 2263291 - DNA, 20 bp, Homo sapiens
aagcaacattcatagtcttt

SEQ ID NO: 2263292 - DNA, 17 bp, Homo sapiens
aagcaatactgtttcca

SEQ ID NO: 2263293 - DNA, 23 bp, Homo sapiens
aagcactctcgcacacacagtga

SEQ ID NO: 2263294 - DNA, 16 bp, Homo sapiens
aagcagacattttaaa

SEQ ID NO: 2263295 - DNA, 21 bp, Homo sapiens
aagccaaccttcaaagaaact

SEQ ID NO: 2263296 - DNA, 14 bp, Homo sapiens
aagcccctgggccc

SEQ ID NO: 2263297 - DNA, 20 bp, Homo sapiens
aagcctgctgattgattttt

SEQ ID NO: 2263298 - DNA, 21 bp, Homo sapiens
aagccttctgcagcaggaact

SEQ ID NO: 2263299 - DNA, 18 bp, Homo sapiens
aagcggagagagccaaga

SEQ ID NO: 2263300 - DNA, 21 bp, Homo sapiens
aagctaggtgctatttgtcat

SEQ ID NO: 2263301 - DNA, 15 bp, Homo sapiens
aagctattgtctgta

SEQ ID NO: 2263302 - DNA, 19 bp, Homo sapiens
aagctggtggcagagtcct

SEQ ID NO: 2263303 - DNA, 10 bp, Homo sapiens
aagcttagaa

SEQ ID NO: 2263304 - DNA, 11 bp, Homo sapiens
aagcttagaac

SEQ ID NO: 2263305 - DNA, 16 bp, Homo sapiens
aagctttatttctagc

SEQ ID NO: 2263306 - DNA, 17 bp, Homo sapiens
aagctttatttgcatat

SEQ ID NO: 2263307 - DNA, 20 bp, Homo sapiens
aagctttattttgagatgta

SEQ ID NO: 2263308 - DNA, 14 bp, Homo sapiens
aagcttttagaaat

SEQ ID NO: 2263309 - DNA, 18 bp, Homo sapiens
aagcttttagaaatactg

SEQ ID NO: 2263310 - DNA, 23 bp, Homo sapiens
aagctttttttttttgaacccca

SEQ ID NO: 2263311 - DNA, 13 bp, Homo sapiens
aaggaaactagac

SEQ ID NO: 2263312 - DNA, 21 bp, Homo sapiens
aaggaatagtcgcgcaagcat

SEQ ID NO: 2263313 - DNA, 23 bp, Homo sapiens
aaggactagatactactttctct

SEQ ID NO: 2263314 - DNA, 13 bp, Homo sapiens
aaggacttctgca

SEQ ID NO: 2263315 - DNA, 20 bp, Homo sapiens
aaggattatggaaaaataaa

SEQ ID NO: 2263316 - DNA, 13 bp, Homo sapiens
aaggattttacca

SEQ ID NO: 2263317 - DNA, 14 bp, Homo sapiens
aaggattttaccaa

SEQ ID NO: 2263318 - DNA, 18 bp, Homo sapiens
aaggatttttcaagagat

SEQ ID NO: 2263319 - DNA, 17 bp, Homo sapiens
aaggccccagagagacc

SEQ ID NO: 2263320 - DNA, 16 bp, Homo sapiens
aagggagaagacactg

SEQ ID NO: 2263321 - DNA, 18 bp, Homo sapiens
aagggagtttaaaaatgg

SEQ ID NO: 2263322 - DNA, 11 bp, Homo sapiens
aagggcagagg

SEQ ID NO: 2263323 - DNA, 22 bp, Homo sapiens
aaggggctgaggacgagacccc

SEQ ID NO: 2263324 - DNA, 22 bp, Homo sapiens
aaggggggggcaatctctctct

SEQ ID NO: 2263325 - DNA, 14 bp, Homo sapiens
aaggtacaacagaa

SEQ ID NO: 2263326 - DNA, 16 bp, Homo sapiens
aaggtataataaaatt

SEQ ID NO: 2263327 - DNA, 18 bp, Homo sapiens
aaggtctttcagtacttt

SEQ ID NO: 2263328 - DNA, 16 bp, Homo sapiens
aaggttgggcagggtg

SEQ ID NO: 2263329 - DNA, 13 bp, Homo sapiens
aaggtttattgtt

SEQ ID NO: 2263330 - DNA, 14 bp, Homo sapiens
aaggtttattgtta

SEQ ID NO: 2263331 - DNA, 15 bp, Homo sapiens
aaggttttcatttgc

SEQ ID NO: 2263332 - DNA, 14 bp, Homo sapiens
aagtaaaatgtctt

SEQ ID NO: 2263333 - DNA, 18 bp, Homo sapiens
aagtaagcaaacaaatat

SEQ ID NO: 2263334 - DNA, 17 bp, Homo sapiens
aagtaatacgttttgac

SEQ ID NO: 2263335 - DNA, 19 bp, Homo sapiens
aagtaatacgttttgacat

SEQ ID NO: 2263336 - DNA, 17 bp, Homo sapiens
aagtactggctctttat

SEQ ID NO: 2263337 - DNA, 19 bp, Homo sapiens
aagtcaaattaataatctt

SEQ ID NO: 2263338 - DNA, 13 bp, Homo sapiens
aagtcattaaact

SEQ ID NO: 2263339 - DNA, 19 bp, Homo sapiens
aagtcccagtatacctcat

SEQ ID NO: 2263340 - DNA, 15 bp, Homo sapiens
aagtcggaatgtcat

SEQ ID NO: 2263341 - DNA, 12 bp, Homo sapiens
aagtgaaaactt

SEQ ID NO: 2263342 - DNA, 10 bp, Homo sapiens
aagtgatctt

SEQ ID NO: 2263343 - DNA, 13 bp, Homo sapiens
aagtgatgtcatt

SEQ ID NO: 2263344 - DNA, 20 bp, Homo sapiens
aagtgcaatgcgtgttgtac

SEQ ID NO: 2263345 - DNA, 23 bp, Homo sapiens
aagtgcctcacatttttttctac

SEQ ID NO: 2263346 - DNA, 24 bp, Homo sapiens
aagtgccttgctcatttgaaaatg

SEQ ID NO: 2263347 - DNA, 22 bp, Homo sapiens
aagtggaccttaggccttcctc

SEQ ID NO: 2263348 - DNA, 19 bp, Homo sapiens
aagtgtataatataaaaaa

SEQ ID NO: 2263349 - DNA, 13 bp, Homo sapiens
aagtgtatttttc

SEQ ID NO: 2263350 - DNA, 15 bp, Homo sapiens
aagtgtatttttcaa

SEQ ID NO: 2263351 - DNA, 17 bp, Homo sapiens
aagttaatgtatataaa

SEQ ID NO: 2263352 - DNA, 19 bp, Homo sapiens
aagttaatgtatataaaaa

SEQ ID NO: 2263353 - DNA, 22 bp, Homo sapiens
aagttaatgtatataaaaatgg

SEQ ID NO: 2263354 - DNA, 22 bp, Homo sapiens
aagttagagaactaaactagtt

SEQ ID NO: 2263355 - DNA, 19 bp, Homo sapiens
aagttagttccactgagac

SEQ ID NO: 2263356 - DNA, 15 bp, Homo sapiens
aagttattgcagttt

SEQ ID NO: 2263357 - DNA, 17 bp, Homo sapiens
aagttattgcagtttat

SEQ ID NO: 2263358 - DNA, 23 bp, Homo sapiens
aagttattgcagtttatcattca

SEQ ID NO: 2263359 - DNA, 15 bp, Homo sapiens
aagttgaaaatcata

SEQ ID NO: 2263360 - DNA, 14 bp, Homo sapiens
accttccagctcct

SEQ ID NO: 2263361 - DNA, 17 bp, Homo sapiens
accttccagctcctgta

SEQ ID NO: 2263362 - DNA, 21 bp, Homo sapiens
accttcccaaacgcctcccct

SEQ ID NO: 2263363 - DNA, 13 bp, Homo sapiens
accttttattata

SEQ ID NO: 2263364 - DNA, 17 bp, Homo sapiens
accttttgaggagcccc

SEQ ID NO: 2263365 - DNA, 19 bp, Homo sapiens
accttttgggaatgtttta

SEQ ID NO: 2263366 - DNA, 23 bp, Homo sapiens
acgagacccccatccagcctcca

SEQ ID NO: 2263367 - DNA, 24 bp, Homo sapiens
acgagacccccatccagcctccag

SEQ ID NO: 2263368 - DNA, 17 bp, Homo sapiens
acgagtaagtgaatcct

SEQ ID NO: 2263369 - DNA, 16 bp, Homo sapiens
acgccactcatttcat

SEQ ID NO: 2263370 - DNA, 14 bp, Homo sapiens
acgcctcctggcca

SEQ ID NO: 2263371 - DNA, 16 bp, Homo sapiens
acgcctcctggccaga

SEQ ID NO: 2263372 - DNA, 20 bp, Homo sapiens
acgcttcttatgtagagttt

SEQ ID NO: 2263373 - DNA, 22 bp, Homo sapiens
acggagatgaagaacatctgga

SEQ ID NO: 2263374 - DNA, 22 bp, Homo sapiens
acggatggtgcatgggctcgcc

SEQ ID NO: 2263375 - DNA, 22 bp, Homo sapiens
acggcgaccaataaacagctcc

SEQ ID NO: 2263376 - DNA, 23 bp, Homo sapiens
acggcgggatcctccacagagag

SEQ ID NO: 2263377 - DNA, 13 bp, Homo sapiens
acggcgttttttt

SEQ ID NO: 2263378 - DNA, 18 bp, Homo sapiens
acgggaacatgccccctg

SEQ ID NO: 2263379 - DNA, 14 bp, Homo sapiens
acgggtggtccccg

SEQ ID NO: 2263380 - DNA, 18 bp, Homo sapiens
acgtcatcggaggctggg

SEQ ID NO: 2263381 - DNA, 21 bp, Homo sapiens
acgtcatcggaggctgggccc

SEQ ID NO: 2263382 - DNA, 18 bp, Homo sapiens
acgtgctctgtgggtctc

SEQ ID NO: 2263383 - DNA, 11 bp, Homo sapiens
acgtggcagga

SEQ ID NO: 2263384 - DNA, 14 bp, Homo sapiens
acgttatatattgt

SEQ ID NO: 2263385 - DNA, 20 bp, Homo sapiens
acgttcgatttctacctcag

SEQ ID NO: 2263386 - DNA, 13 bp, Homo sapiens
acgtttaactgca

SEQ ID NO: 2263387 - DNA, 24 bp, Homo sapiens
acgtttaactgcagttgactttct

SEQ ID NO: 2263388 - DNA, 19 bp, Homo sapiens
acgtttttgtgctgtgggc

SEQ ID NO: 2263389 - DNA, 17 bp, Homo sapiens
acgttttttcctcagtg

SEQ ID NO: 2263390 - DNA, 14 bp, Homo sapiens
actaaaataatttt

SEQ ID NO: 2263391 - DNA, 17 bp, Homo sapiens
actaaaataattttgta

SEQ ID NO: 2263392 - DNA, 12 bp, Homo sapiens
actaaagcatga

SEQ ID NO: 2263393 - DNA, 18 bp, Homo sapiens
actaacgttgagcccctg

SEQ ID NO: 2263394 - DNA, 17 bp, Homo sapiens
actaagaaggaaaagaa

SEQ ID NO: 2263395 - DNA, 17 bp, Homo sapiens
actaagattcttttaaa

SEQ ID NO: 2263396 - DNA, 21 bp, Homo sapiens
actaagattcttttaaattag

SEQ ID NO: 2263397 - DNA, 16 bp, Homo sapiens
actaaggatttttcaa

SEQ ID NO: 2263398 - DNA, 16 bp, Homo sapiens
actaatagtttgttga

SEQ ID NO: 2263399 - DNA, 19 bp, Homo sapiens
actacctcttaagtcccag

SEQ ID NO: 2263400 - DNA, 12 bp, Homo sapiens
actactacctct

SEQ ID NO: 2263401 - DNA, 18 bp, Homo sapiens
actactcaatactacctc

SEQ ID NO: 2263402 - DNA, 19 bp, Homo sapiens
actactcaatactacctct

SEQ ID NO: 2263403 - DNA, 15 bp, Homo sapiens
actactgacagggag

SEQ ID NO: 2263404 - DNA, 15 bp, Homo sapiens
actagatactacttt

SEQ ID NO: 2263405 - DNA, 17 bp, Homo sapiens
actagatactactttct

SEQ ID NO: 2263406 - DNA, 18 bp, Homo sapiens
actagccaaaccaggacc

SEQ ID NO: 2263407 - DNA, 23 bp, Homo sapiens
actaggctgagcaatctgaccct

SEQ ID NO: 2263408 - DNA, 15 bp, Homo sapiens
actaggtaacttcat

SEQ ID NO: 2263409 - DNA, 18 bp, Homo sapiens
actaggtaacttcatatt

SEQ ID NO: 2263410 - DNA, 21 bp, Homo sapiens
actagtttttcctatcatgtt

SEQ ID NO: 2263411 - DNA, 19 bp, Homo sapiens
actatgatttaatttgaaa

SEQ ID NO: 2263412 - DNA, 22 bp, Homo sapiens
actatggtatgctggccagcac

SEQ ID NO: 2263413 - DNA, 18 bp, Homo sapiens
actatgtatttttctatg

SEQ ID NO: 2263414 - DNA, 11 bp, Homo sapiens
actatttaaag

SEQ ID NO: 2263415 - DNA, 18 bp, Homo sapiens
actatttaagatgtgaaa

SEQ ID NO: 2263416 - DNA, 14 bp, Homo sapiens
actatttatataca

SEQ ID NO: 2263417 - DNA, 14 bp, Homo sapiens
actatttttgtaaa

SEQ ID NO: 2263418 - DNA, 18 bp, Homo sapiens
actcaatactacctctga

SEQ ID NO: 2263419 - DNA, 21 bp, Homo sapiens
actcacagcacttgttttcag

SEQ ID NO: 2263420 - DNA, 22 bp, Homo sapiens
actcacagcacttgttttcagg

SEQ ID NO: 2263421 - DNA, 22 bp, Homo sapiens
actcactggggcctacagcttt

SEQ ID NO: 2263422 - DNA, 12 bp, Homo sapiens
actcagacctga

SEQ ID NO: 2263423 - DNA, 20 bp, Homo sapiens
actcagtgggttaacatcag

SEQ ID NO: 2263424 - DNA, 18 bp, Homo sapiens
actcatagacactgatct

SEQ ID NO: 2263425 - DNA, 13 bp, Homo sapiens
actcattccttct

SEQ ID NO: 2263426 - DNA, 13 bp, Homo sapiens
actcatttcatct

SEQ ID NO: 2263427 - DNA, 11 bp, Homo sapiens
actccagccag

SEQ ID NO: 2263428 - DNA, 12 bp, Homo sapiens
actccagccagc

SEQ ID NO: 2263429 - DNA, 12 bp, Homo sapiens
actccattgtcg

SEQ ID NO: 2263430 - DNA, 22 bp, Homo sapiens
actccctgtagtgaatcctctg

SEQ ID NO: 2263431 - DNA, 23 bp, Homo sapiens
actccctgtagtgaatcctctgt

SEQ ID NO: 2263432 - DNA, 16 bp, Homo sapiens
actcccttgctggccc

SEQ ID NO: 2263433 - DNA, 17 bp, Homo sapiens
actcccttgctggcccc

SEQ ID NO: 2263434 - DNA, 18 bp, Homo sapiens
actcccttgctggcccca

SEQ ID NO: 2263435 - DNA, 22 bp, Homo sapiens
actcccttgctggccccagccc

SEQ ID NO: 2263436 - DNA, 23 bp, Homo sapiens
actcccttgctggccccagccct

SEQ ID NO: 2263437 - DNA, 23 bp, Homo sapiens
actccttccagtgtccttagaac

SEQ ID NO: 2263438 - DNA, 21 bp, Homo sapiens
actctaggatgtatattttat

SEQ ID NO: 2263439 - DNA, 22 bp, Homo sapiens
actctaggatgtatattttata

SEQ ID NO: 2263440 - DNA, 14 bp, Homo sapiens
actctatttttaca

SEQ ID NO: 2263441 - DNA, 16 bp, Homo sapiens
actctcatcactacag

SEQ ID NO: 2263442 - DNA, 22 bp, Homo sapiens
actctctggaagcccctgggcc

SEQ ID NO: 2263443 - DNA, 14 bp, Homo sapiens
actctggcaaagct

SEQ ID NO: 2263444 - DNA, 17 bp, Homo sapiens
actctggcaaagctttt

SEQ ID NO: 2263445 - DNA, 15 bp, Homo sapiens
actctgtcagccagc

SEQ ID NO: 2263446 - DNA, 15 bp, Homo sapiens
actcttcaaatggga

SEQ ID NO: 2263447 - DNA, 12 bp, Homo sapiens
actctttgaaat

SEQ ID NO: 2263448 - DNA, 14 bp, Homo sapiens
actctttgaaatga

SEQ ID NO: 2263449 - DNA, 19 bp, Homo sapiens
actgaagccaaatgaaact

SEQ ID NO: 2263450 - DNA, 17 bp, Homo sapiens
actgaagtgcttagtgt

SEQ ID NO: 2263451 - DNA, 17 bp, Homo sapiens
actgcaaccttgtttat

SEQ ID NO: 2263452 - DNA, 23 bp, Homo sapiens
actgccaatatagaaaaataaaa

SEQ ID NO: 2263453 - DNA, 12 bp, Homo sapiens
actgccacaagc

SEQ ID NO: 2263454 - DNA, 17 bp, Homo sapiens
actgctaaataaaattt

SEQ ID NO: 2263455 - DNA, 18 bp, Homo sapiens
actgctactgtaatttta

SEQ ID NO: 2263456 - DNA, 17 bp, Homo sapiens
actgctcctgtgtcggg

SEQ ID NO: 2263457 - DNA, 21 bp, Homo sapiens
actgcttacctactttcttca

SEQ ID NO: 2263458 - DNA, 13 bp, Homo sapiens
actggaacccttt

SEQ ID NO: 2263459 - DNA, 12 bp, Homo sapiens
actggcacagag

SEQ ID NO: 2263460 - DNA, 23 bp, Homo sapiens
actggcttttattaatgcacttt

SEQ ID NO: 2263461 - DNA, 21 bp, Homo sapiens
actggggagcccgtctcagtg

SEQ ID NO: 2263462 - DNA, 13 bp, Homo sapiens
actggggcctcca

SEQ ID NO: 2263463 - DNA, 16 bp, Homo sapiens
actggggcctccagaa

SEQ ID NO: 2263464 - DNA, 20 bp, Homo sapiens
actggtgtcaccctttgcct

SEQ ID NO: 2263465 - DNA, 16 bp, Homo sapiens
actgtaatatttaaat

SEQ ID NO: 2263466 - DNA, 17 bp, Homo sapiens
actgtaattttatatga

SEQ ID NO: 2263467 - DNA, 20 bp, Homo sapiens
actgtcaaggctgcttagaa

SEQ ID NO: 2263468 - DNA, 14 bp, Homo sapiens
aggacttcccgagc

SEQ ID NO: 2263469 - DNA, 16 bp, Homo sapiens
aggagcaggcacgggt

SEQ ID NO: 2263470 - DNA, 16 bp, Homo sapiens
aggagggagacactgg

SEQ ID NO: 2263471 - DNA, 18 bp, Homo sapiens
aggaggggaaggggctga

SEQ ID NO: 2263472 - DNA, 21 bp, Homo sapiens
aggaggggaaggggctgagga

SEQ ID NO: 2263473 - DNA, 22 bp, Homo sapiens
aggataattttcctcaatcaca

SEQ ID NO: 2263474 - DNA, 20 bp, Homo sapiens
aggatagctaactgtaaatc

SEQ ID NO: 2263475 - DNA, 23 bp, Homo sapiens
aggatagctaactgtaaatcatg

SEQ ID NO: 2263476 - DNA, 19 bp, Homo sapiens
aggatatgattaatattat

SEQ ID NO: 2263477 - DNA, 21 bp, Homo sapiens
aggatgtatattttatataaa

SEQ ID NO: 2263478 - DNA, 18 bp, Homo sapiens
aggattttaccaaagcat

SEQ ID NO: 2263479 - DNA, 19 bp, Homo sapiens
aggattttaccaaagcatc

SEQ ID NO: 2263480 - DNA, 12 bp, Homo sapiens
aggcaaaaatgt

SEQ ID NO: 2263481 - DNA, 20 bp, Homo sapiens
aggcaaggaaagaaatacag

SEQ ID NO: 2263482 - DNA, 16 bp, Homo sapiens
aggcacacagcagccc

SEQ ID NO: 2263483 - DNA, 16 bp, Homo sapiens
aggcaccttttactgt

SEQ ID NO: 2263484 - DNA, 16 bp, Homo sapiens
aggcacgggtggtccc

SEQ ID NO: 2263485 - DNA, 17 bp, Homo sapiens
aggcacttcatgtaaag

SEQ ID NO: 2263486 - DNA, 21 bp, Homo sapiens
aggcagacaaccttgtcccaa

SEQ ID NO: 2263487 - DNA, 15 bp, Homo sapiens
aggcagggggccctg

SEQ ID NO: 2263488 - DNA, 18 bp, Homo sapiens
aggcagggggccctgccc

SEQ ID NO: 2263489 - DNA, 20 bp, Homo sapiens
aggcagggggccctgcccca

SEQ ID NO: 2263490 - DNA, 20 bp, Homo sapiens
aggcatctgttagcagagtc

SEQ ID NO: 2263491 - DNA, 18 bp, Homo sapiens
aggccacatacctctctg

SEQ ID NO: 2263492 - DNA, 14 bp, Homo sapiens
aggccctccctgac

SEQ ID NO: 2263493 - DNA, 19 bp, Homo sapiens
aggcctaattctatgcctg

SEQ ID NO: 2263494 - DNA, 17 bp, Homo sapiens
aggcctagactctgtct

SEQ ID NO: 2263495 - DNA, 15 bp, Homo sapiens
aggccttcctctctc

SEQ ID NO: 2263496 - DNA, 18 bp, Homo sapiens
aggccttcctctctccag

SEQ ID NO: 2263497 - DNA, 19 bp, Homo sapiens
aggccttcctctctccaga

SEQ ID NO: 2263498 - DNA, 17 bp, Homo sapiens
aggctatgtataaaata

SEQ ID NO: 2263499 - DNA, 21 bp, Homo sapiens
aggctatgtataaaatacata

SEQ ID NO: 2263500 - DNA, 14 bp, Homo sapiens
aggctcccctgagg

SEQ ID NO: 2263501 - DNA, 14 bp, Homo sapiens
aggctgcttagaat

SEQ ID NO: 2263502 - DNA, 22 bp, Homo sapiens
aggctgcttagaatccaaactt

SEQ ID NO: 2263503 - DNA, 14 bp, Homo sapiens
aggctgggcccctg

SEQ ID NO: 2263504 - DNA, 16 bp, Homo sapiens
aggctgtctgttgtat

SEQ ID NO: 2263505 - DNA, 20 bp, Homo sapiens
aggctgttcccatgtagccc

SEQ ID NO: 2263506 - DNA, 14 bp, Homo sapiens
aggcttaaaaactg

SEQ ID NO: 2263507 - DNA, 22 bp, Homo sapiens
aggcttaaggagaggagaaact

SEQ ID NO: 2263508 - DNA, 16 bp, Homo sapiens
aggcttctcacggcga

SEQ ID NO: 2263509 - DNA, 15 bp, Homo sapiens
agggaaactaagatt

SEQ ID NO: 2263510 - DNA, 19 bp, Homo sapiens
agggaaactaagattcttt

SEQ ID NO: 2263511 - DNA, 13 bp, Homo sapiens
agggaaactggga

SEQ ID NO: 2263512 - DNA, 16 bp, Homo sapiens
agggaaactgggaaac

SEQ ID NO: 2263513 - DNA, 17 bp, Homo sapiens
agggaaagttttgttct

SEQ ID NO: 2263514 - DNA, 19 bp, Homo sapiens
agggaaagttttgttctgt

SEQ ID NO: 2263515 - DNA, 17 bp, Homo sapiens
agggaaatttcaataac

SEQ ID NO: 2263516 - DNA, 19 bp, Homo sapiens
agggaagagacagcccagg

SEQ ID NO: 2263517 - DNA, 14 bp, Homo sapiens
agggaatgcagcag

SEQ ID NO: 2263518 - DNA, 18 bp, Homo sapiens
agggaccactgggtgaga

SEQ ID NO: 2263519 - DNA, 20 bp, Homo sapiens
agggagaagacactgcagtg

SEQ ID NO: 2263520 - DNA, 17 bp, Homo sapiens
agggagcaccctgccca

SEQ ID NO: 2263521 - DNA, 14 bp, Homo sapiens
agggagcagccccc

SEQ ID NO: 2263522 - DNA, 18 bp, Homo sapiens
agggagcctttggttctg

SEQ ID NO: 2263523 - DNA, 23 bp, Homo sapiens
agggataaagaaaaaaatactat

SEQ ID NO: 2263524 - DNA, 21 bp, Homo sapiens
agggatcaaccagctaagaaa

SEQ ID NO: 2263525 - DNA, 22 bp, Homo sapiens
agggatcaaccagctaagaaaa

SEQ ID NO: 2263526 - DNA, 16 bp, Homo sapiens
agggatgggggatggg

SEQ ID NO: 2263527 - DNA, 15 bp, Homo sapiens
agggcattgctcagc

SEQ ID NO: 2263528 - DNA, 16 bp, Homo sapiens
agggcattgctcagcc

SEQ ID NO: 2263529 - DNA, 17 bp, Homo sapiens
agggcattgctcagccc

SEQ ID NO: 2263530 - DNA, 18 bp, Homo sapiens
agggcattgctcagcccg

SEQ ID NO: 2263531 - DNA, 20 bp, Homo sapiens
agggcattgctcagcccgct

SEQ ID NO: 2263532 - DNA, 14 bp, Homo sapiens
agggccaggcaccc

SEQ ID NO: 2263533 - DNA, 16 bp, Homo sapiens
agggctgagctgggga

SEQ ID NO: 2263534 - DNA, 12 bp, Homo sapiens
aggggaaggggc

SEQ ID NO: 2263535 - DNA, 14 bp, Homo sapiens
aggggaaggggctg

SEQ ID NO: 2263536 - DNA, 17 bp, Homo sapiens
aggggaaggggctgagg

SEQ ID NO: 2263537 - DNA, 21 bp, Homo sapiens
aggggaattccctccccctcc

SEQ ID NO: 2263538 - DNA, 18 bp, Homo sapiens
aggggctggggacttgtg

SEQ ID NO: 2263539 - DNA, 15 bp, Homo sapiens
agggggccctgcccc

SEQ ID NO: 2263540 - DNA, 19 bp, Homo sapiens
agggggccctgccccaccc

SEQ ID NO: 2263541 - DNA, 21 bp, Homo sapiens
agggggccctgccccacccca

SEQ ID NO: 2263542 - DNA, 18 bp, Homo sapiens
aggggtaggatgtacagg

SEQ ID NO: 2263543 - DNA, 14 bp, Homo sapiens
aggggtctgagcca

SEQ ID NO: 2263544 - DNA, 15 bp, Homo sapiens
aggggtgtggctcct

SEQ ID NO: 2263545 - DNA, 12 bp, Homo sapiens
agggtaagtatt

SEQ ID NO: 2263546 - DNA, 20 bp, Homo sapiens
aggtaactatcaatatttaa

SEQ ID NO: 2263547 - DNA, 20 bp, Homo sapiens
aggtacaacagaataatgca

SEQ ID NO: 2263548 - DNA, 22 bp, Homo sapiens
aggtacaacagaataatgcatg

SEQ ID NO: 2263549 - DNA, 15 bp, Homo sapiens
aggtagcaacaacag

SEQ ID NO: 2263550 - DNA, 15 bp, Homo sapiens
aggtagtttcaaagg

SEQ ID NO: 2263551 - DNA, 19 bp, Homo sapiens
aggtagtttcaaaggccac

SEQ ID NO: 2263552 - DNA, 14 bp, Homo sapiens
aggtagtttctcat

SEQ ID NO: 2263553 - DNA, 20 bp, Homo sapiens
aggtatttaaagtattttct

SEQ ID NO: 2263554 - DNA, 20 bp, Homo sapiens
aggtcgcttgggaattttat

SEQ ID NO: 2263555 - DNA, 14 bp, Homo sapiens
aggtgaacattggt

SEQ ID NO: 2263556 - DNA, 21 bp, Homo sapiens
aggtgaacattggttctttca

SEQ ID NO: 2263557 - DNA, 18 bp, Homo sapiens
aggtgatatatttaaaaa

SEQ ID NO: 2263558 - DNA, 15 bp, Homo sapiens
aggtgatcccgtttt

SEQ ID NO: 2263559 - DNA, 16 bp, Homo sapiens
aggtgattctaatcat

SEQ ID NO: 2263560 - DNA, 21 bp, Homo sapiens
aggtgattctaatcatctgca

SEQ ID NO: 2263561 - DNA, 17 bp, Homo sapiens
aggtgcaagtgccccag

SEQ ID NO: 2263562 - DNA, 15 bp, Homo sapiens
aggtgcaattatttc

SEQ ID NO: 2263563 - DNA, 21 bp, Homo sapiens
aggtgcccagaataagttatt

SEQ ID NO: 2263564 - DNA, 22 bp, Homo sapiens
aggttatgttcatttttcaaaa

SEQ ID NO: 2263565 - DNA, 19 bp, Homo sapiens
aggttctgtattttaagaa

SEQ ID NO: 2263566 - DNA, 23 bp, Homo sapiens
agtaaaattatcctctttgtaat

SEQ ID NO: 2263567 - DNA, 14 bp, Homo sapiens
agtaaacgggaaca

SEQ ID NO: 2263568 - DNA, 23 bp, Homo sapiens
agtaaacgggaacatgccccctg

SEQ ID NO: 2263569 - DNA, 15 bp, Homo sapiens
agtaaataataaata

SEQ ID NO: 2263570 - DNA, 12 bp, Homo sapiens
agtaagattgat

SEQ ID NO: 2263571 - DNA, 15 bp, Homo sapiens
agtaagttaatgtat

SEQ ID NO: 2263572 - DNA, 19 bp, Homo sapiens
agtaagttaatgtatataa

SEQ ID NO: 2263573 - DNA, 19 bp, Homo sapiens
agtaatattttactttgag

SEQ ID NO: 2263574 - DNA, 17 bp, Homo sapiens
agtaattgggaaaaaag

SEQ ID NO: 2263575 - DNA, 23 bp, Homo sapiens
agtaccatttaatggggaggaca

SEQ ID NO: 2263576 - DNA, 20 bp, Homo sapiens
atgctggccagcaccctctc

SEQ ID NO: 2263577 - DNA, 17 bp, Homo sapiens
atgctgtctggccctgg

SEQ ID NO: 2263578 - DNA, 15 bp, Homo sapiens
atgcttagaggggtg

SEQ ID NO: 2263579 - DNA, 22 bp, Homo sapiens
atgcttagaggggtgaaaatta

SEQ ID NO: 2263580 - DNA, 22 bp, Homo sapiens
atgcttttatatttttttaaaa

SEQ ID NO: 2263581 - DNA, 16 bp, Homo sapiens
atggaaattttgctat

SEQ ID NO: 2263582 - DNA, 18 bp, Homo sapiens
atggaaccttccctccaa

SEQ ID NO: 2263583 - DNA, 19 bp, Homo sapiens
atggaaccttccctccaaa

SEQ ID NO: 2263584 - DNA, 21 bp, Homo sapiens
atggaaccttccctccaaatt

SEQ ID NO: 2263585 - DNA, 21 bp, Homo sapiens
atggactatgcacacttttaa

SEQ ID NO: 2263586 - DNA, 20 bp, Homo sapiens
atggagaggcggcctcgtgc

SEQ ID NO: 2263587 - DNA, 23 bp, Homo sapiens
atggagccagctccctctattta

SEQ ID NO: 2263588 - DNA, 15 bp, Homo sapiens
atggatgatttaagt

SEQ ID NO: 2263589 - DNA, 19 bp, Homo sapiens
atgggatccaattttaata

SEQ ID NO: 2263590 - DNA, 16 bp, Homo sapiens
atgggggatgggccag

SEQ ID NO: 2263591 - DNA, 16 bp, Homo sapiens
atggggtctgtaaata

SEQ ID NO: 2263592 - DNA, 15 bp, Homo sapiens
atggtatgctggcca

SEQ ID NO: 2263593 - DNA, 20 bp, Homo sapiens
atggtcacgtttggtgcttc

SEQ ID NO: 2263594 - DNA, 24 bp, Homo sapiens
atggtcacgtttggtgcttctcag

SEQ ID NO: 2263595 - DNA, 18 bp, Homo sapiens
atggtgcattgtatagat

SEQ ID NO: 2263596 - DNA, 20 bp, Homo sapiens
atggttctctcaacaagaaa

SEQ ID NO: 2263597 - DNA, 22 bp, Homo sapiens
atgtaagcatactttgtaaata

SEQ ID NO: 2263598 - DNA, 17 bp, Homo sapiens
atgtaattttgtgtaag

SEQ ID NO: 2263599 - DNA, 22 bp, Homo sapiens
atgtaattttgtgtaagaaata

SEQ ID NO: 2263600 - DNA, 16 bp, Homo sapiens
atgtacagttgaaata

SEQ ID NO: 2263601 - DNA, 15 bp, Homo sapiens
atgtactttttagta

SEQ ID NO: 2263602 - DNA, 23 bp, Homo sapiens
atgtaggagctgccttggctcag

SEQ ID NO: 2263603 - DNA, 14 bp, Homo sapiens
atgtataaaataca

SEQ ID NO: 2263604 - DNA, 22 bp, Homo sapiens
atgtataaaatacatagtgaaa

SEQ ID NO: 2263605 - DNA, 18 bp, Homo sapiens
atgtatattttatataaa

SEQ ID NO: 2263606 - DNA, 23 bp, Homo sapiens
atgtcaaatatttagatgtaatt

SEQ ID NO: 2263607 - DNA, 20 bp, Homo sapiens
atgtcatagtcttgaaatga

SEQ ID NO: 2263608 - DNA, 15 bp, Homo sapiens
atgtccaaagaggct

SEQ ID NO: 2263609 - DNA, 20 bp, Homo sapiens
atgtccagccacccccaggc

SEQ ID NO: 2263610 - DNA, 12 bp, Homo sapiens
atgtctggggca

SEQ ID NO: 2263611 - DNA, 18 bp, Homo sapiens
atgtctttccaaattatt

SEQ ID NO: 2263612 - DNA, 21 bp, Homo sapiens
atgtctttccaaattatttct

SEQ ID NO: 2263613 - DNA, 13 bp, Homo sapiens
atgtgaaaaatct

SEQ ID NO: 2263614 - DNA, 19 bp, Homo sapiens
atgtgaaaaatctgctgtt

SEQ ID NO: 2263615 - DNA, 17 bp, Homo sapiens
atgtgaatttttattgt

SEQ ID NO: 2263616 - DNA, 22 bp, Homo sapiens
atgtgctaataagtttgaaata

SEQ ID NO: 2263617 - DNA, 17 bp, Homo sapiens
atgtggcattggggggc

SEQ ID NO: 2263618 - DNA, 22 bp, Homo sapiens
atgtggcattggggggccgggc

SEQ ID NO: 2263619 - DNA, 18 bp, Homo sapiens
atgtggtgacacctcccc

SEQ ID NO: 2263620 - DNA, 20 bp, Homo sapiens
atgtggtgacacctccccct

SEQ ID NO: 2263621 - DNA, 18 bp, Homo sapiens
atgtggtggcacaggccc

SEQ ID NO: 2263622 - DNA, 19 bp, Homo sapiens
atgtgtataaattgtcttt

SEQ ID NO: 2263623 - DNA, 24 bp, Homo sapiens
atgtgtcccctcactctgtcagcc

SEQ ID NO: 2263624 - DNA, 13 bp, Homo sapiens
atgtgtcctggtt

SEQ ID NO: 2263625 - DNA, 15 bp, Homo sapiens
atgtgtctcaggaaa

SEQ ID NO: 2263626 - DNA, 19 bp, Homo sapiens
atgtgtctcaggaaaacag

SEQ ID NO: 2263627 - DNA, 19 bp, Homo sapiens
atgttacaaaaataaacta

SEQ ID NO: 2263628 - DNA, 23 bp, Homo sapiens
atgttatttaacagctgaattat

SEQ ID NO: 2263629 - DNA, 11 bp, Homo sapiens
atgttcatttt

SEQ ID NO: 2263630 - DNA, 21 bp, Homo sapiens
atgttgaaaaaatttaaaagt

SEQ ID NO: 2263631 - DNA, 22 bp, Homo sapiens
atgttgcaatgtgaaaaatctg

SEQ ID NO: 2263632 - DNA, 19 bp, Homo sapiens
atgttgctatgtgccttat

SEQ ID NO: 2263633 - DNA, 20 bp, Homo sapiens
atgttgttcaaatgcatttt

SEQ ID NO: 2263634 - DNA, 16 bp, Homo sapiens
atgtttgcacttgtga

SEQ ID NO: 2263635 - DNA, 22 bp, Homo sapiens
atgtttggcatgtaaatgtaaa

SEQ ID NO: 2263636 - DNA, 22 bp, Homo sapiens
atgttttttaaaatatttatct

SEQ ID NO: 2263637 - DNA, 13 bp, Homo sapiens
atgtttttttaat

SEQ ID NO: 2263638 - DNA, 16 bp, Homo sapiens
atgtttttttaattaa

SEQ ID NO: 2263639 - DNA, 18 bp, Homo sapiens
attaaaaaagcatacttc

SEQ ID NO: 2263640 - DNA, 22 bp, Homo sapiens
attaaaactcaacattactgtt

SEQ ID NO: 2263641 - DNA, 15 bp, Homo sapiens
attaaaagtttgaaa

SEQ ID NO: 2263642 - DNA, 13 bp, Homo sapiens
attaaacttcata

SEQ ID NO: 2263643 - DNA, 17 bp, Homo sapiens
attaaatacaaaacttc

SEQ ID NO: 2263644 - DNA, 18 bp, Homo sapiens
attaaattagtttgtgaa

SEQ ID NO: 2263645 - DNA, 14 bp, Homo sapiens
attaaattctgagc

SEQ ID NO: 2263646 - DNA, 18 bp, Homo sapiens
attaacaaaatgtatgtc

SEQ ID NO: 2263647 - DNA, 13 bp, Homo sapiens
attaacttttaat

SEQ ID NO: 2263648 - DNA, 14 bp, Homo sapiens
attaacttttaatg

SEQ ID NO: 2263649 - DNA, 20 bp, Homo sapiens
attaagctttttttttttga

SEQ ID NO: 2263650 - DNA, 12 bp, Homo sapiens
attaataaaact

SEQ ID NO: 2263651 - DNA, 13 bp, Homo sapiens
attaataaaactg

SEQ ID NO: 2263652 - DNA, 16 bp, Homo sapiens
attaataaaactgtgc

SEQ ID NO: 2263653 - DNA, 13 bp, Homo sapiens
attaatattatta

SEQ ID NO: 2263654 - DNA, 20 bp, Homo sapiens
attaatcaccttctttgtaa

SEQ ID NO: 2263655 - DNA, 11 bp, Homo sapiens
attaatgcact

SEQ ID NO: 2263656 - DNA, 14 bp, Homo sapiens
attaattatatgta

SEQ ID NO: 2263657 - DNA, 16 bp, Homo sapiens
attaattatatgtata

SEQ ID NO: 2263658 - DNA, 15 bp, Homo sapiens
attacaattttatct

SEQ ID NO: 2263659 - DNA, 15 bp, Homo sapiens
attacataatttagt

SEQ ID NO: 2263660 - DNA, 23 bp, Homo sapiens
attacataatttagttgtttcta

SEQ ID NO: 2263661 - DNA, 18 bp, Homo sapiens
attacatttatttatcca

SEQ ID NO: 2263662 - DNA, 19 bp, Homo sapiens
attaccaataggcaaatta

SEQ ID NO: 2263663 - DNA, 20 bp, Homo sapiens
attaccccctccttcagaca

SEQ ID NO: 2263664 - DNA, 13 bp, Homo sapiens
attacttgaactt

SEQ ID NO: 2263665 - DNA, 14 bp, Homo sapiens
attacttgaacttt

SEQ ID NO: 2263666 - DNA, 21 bp, Homo sapiens
attagaaaatattctctattt

SEQ ID NO: 2263667 - DNA, 13 bp, Homo sapiens
attagaaaatgtt

SEQ ID NO: 2263668 - DNA, 14 bp, Homo sapiens
attagaattattta

SEQ ID NO: 2263669 - DNA, 18 bp, Homo sapiens
attagttccccaaataca

SEQ ID NO: 2263670 - DNA, 19 bp, Homo sapiens
attagttccccaaatacaa

SEQ ID NO: 2263671 - DNA, 20 bp, Homo sapiens
attagttccccaaatacaaa

SEQ ID NO: 2263672 - DNA, 15 bp, Homo sapiens
attataataaatata

SEQ ID NO: 2263673 - DNA, 14 bp, Homo sapiens
attatcctctttgt

SEQ ID NO: 2263674 - DNA, 17 bp, Homo sapiens
attatcctctttgtaat

SEQ ID NO: 2263675 - DNA, 14 bp, Homo sapiens
attatctatacata

SEQ ID NO: 2263676 - DNA, 13 bp, Homo sapiens
attatgttgttca

SEQ ID NO: 2263677 - DNA, 20 bp, Homo sapiens
attatgttttttaaaatatt

SEQ ID NO: 2263678 - DNA, 14 bp, Homo sapiens
attattataaaaat

SEQ ID NO: 2263679 - DNA, 12 bp, Homo sapiens
attatttaaaca

SEQ ID NO: 2263680 - DNA, 13 bp, Homo sapiens
attatttattaca

SEQ ID NO: 2263681 - DNA, 15 bp, Homo sapiens
attatttatttattt

SEQ ID NO: 2263682 - DNA, 22 bp, Homo sapiens
attatttctgtcacagtaaaaa

SEQ ID NO: 2263683 - DNA, 15 bp, Homo sapiens
attatttgtaagata

SEQ ID NO: 2263684 - DNA, 16 bp, Homo sapiens
cagctcaatggactgg

SEQ ID NO: 2263685 - DNA, 17 bp, Homo sapiens
cagctcataaaatggaa

SEQ ID NO: 2263686 - DNA, 15 bp, Homo sapiens
cagctcctgtaacat

SEQ ID NO: 2263687 - DNA, 16 bp, Homo sapiens
cagctgaattatctat

SEQ ID NO: 2263688 - DNA, 13 bp, Homo sapiens
cagctggcagaga

SEQ ID NO: 2263689 - DNA, 12 bp, Homo sapiens
cagcttattgtt

SEQ ID NO: 2263690 - DNA, 15 bp, Homo sapiens
caggaaagccctccc

SEQ ID NO: 2263691 - DNA, 20 bp, Homo sapiens
caggaaagccctcccccttc

SEQ ID NO: 2263692 - DNA, 15 bp, Homo sapiens
caggaacaaacaggg

SEQ ID NO: 2263693 - DNA, 16 bp, Homo sapiens
caggaagcccaggagc

SEQ ID NO: 2263694 - DNA, 20 bp, Homo sapiens
caggaagcccaggagcctca

SEQ ID NO: 2263695 - DNA, 13 bp, Homo sapiens
caggaagcctgca

SEQ ID NO: 2263696 - DNA, 19 bp, Homo sapiens
caggaatgtgtggcctgca

SEQ ID NO: 2263697 - DNA, 21 bp, Homo sapiens
caggaatgtgtggcctgcaca

SEQ ID NO: 2263698 - DNA, 18 bp, Homo sapiens
caggaccaagggcagagg

SEQ ID NO: 2263699 - DNA, 19 bp, Homo sapiens
caggaccaagggcagaggg

SEQ ID NO: 2263700 - DNA, 12 bp, Homo sapiens
caggacgccact

SEQ ID NO: 2263701 - DNA, 17 bp, Homo sapiens
caggacgccactcattt

SEQ ID NO: 2263702 - DNA, 16 bp, Homo sapiens
caggagaacctaacat

SEQ ID NO: 2263703 - DNA, 15 bp, Homo sapiens
caggagcaggcacgg

SEQ ID NO: 2263704 - DNA, 18 bp, Homo sapiens
caggagcaggcacgggtg

SEQ ID NO: 2263705 - DNA, 12 bp, Homo sapiens
caggagggcagt

SEQ ID NO: 2263706 - DNA, 13 bp, Homo sapiens
caggagggcagtg

SEQ ID NO: 2263707 - DNA, 21 bp, Homo sapiens
caggagggcagtggtggagct

SEQ ID NO: 2263708 - DNA, 19 bp, Homo sapiens
caggagggccagcgctgtg

SEQ ID NO: 2263709 - DNA, 16 bp, Homo sapiens
caggaggtagtttctc

SEQ ID NO: 2263710 - DNA, 19 bp, Homo sapiens
caggatactggcacagagg

SEQ ID NO: 2263711 - DNA, 22 bp, Homo sapiens
caggatgtgtgggccaggatcc

SEQ ID NO: 2263712 - DNA, 15 bp, Homo sapiens
caggcacccacatcc

SEQ ID NO: 2263713 - DNA, 16 bp, Homo sapiens
caggcatccgtggggg

SEQ ID NO: 2263714 - DNA, 20 bp, Homo sapiens
caggcatctgttagcagagt

SEQ ID NO: 2263715 - DNA, 22 bp, Homo sapiens
caggccaggaccaagggcagag

SEQ ID NO: 2263716 - DNA, 23 bp, Homo sapiens
caggccaggaccaagggcagagg

SEQ ID NO: 2263717 - DNA, 16 bp, Homo sapiens
caggcccactccccag

SEQ ID NO: 2263718 - DNA, 18 bp, Homo sapiens
caggcccactccccagcc

SEQ ID NO: 2263719 - DNA, 19 bp, Homo sapiens
caggcccactccccagccc

SEQ ID NO: 2263720 - DNA, 23 bp, Homo sapiens
caggcccactccccagccccagc

SEQ ID NO: 2263721 - DNA, 19 bp, Homo sapiens
caggccctccctgactccc

SEQ ID NO: 2263722 - DNA, 23 bp, Homo sapiens
caggccctccctgactccctgtg

SEQ ID NO: 2263723 - DNA, 18 bp, Homo sapiens
caggctgctggaaggcag

SEQ ID NO: 2263724 - DNA, 18 bp, Homo sapiens
caggctgggccatgtcca

SEQ ID NO: 2263725 - DNA, 17 bp, Homo sapiens
cagggacatgccctgtg

SEQ ID NO: 2263726 - DNA, 22 bp, Homo sapiens
cagggacatgccctgtgtggct

SEQ ID NO: 2263727 - DNA, 23 bp, Homo sapiens
cagggacatgccctgtgtggctg

SEQ ID NO: 2263728 - DNA, 20 bp, Homo sapiens
cagggaccactgggtgagag

SEQ ID NO: 2263729 - DNA, 22 bp, Homo sapiens
cagggatgggggatgggccagg

SEQ ID NO: 2263730 - DNA, 23 bp, Homo sapiens
cagggatgggggatgggccaggg

SEQ ID NO: 2263731 - DNA, 16 bp, Homo sapiens
cagggcattgctcagc

SEQ ID NO: 2263732 - DNA, 11 bp, Homo sapiens
cagggggccct

SEQ ID NO: 2263733 - DNA, 14 bp, Homo sapiens
cagggggccctgcc

SEQ ID NO: 2263734 - DNA, 15 bp, Homo sapiens
caggtaatacaaact

SEQ ID NO: 2263735 - DNA, 13 bp, Homo sapiens
caggtactgcatt

SEQ ID NO: 2263736 - DNA, 20 bp, Homo sapiens
caggtccctccgcggctgga

SEQ ID NO: 2263737 - DNA, 22 bp, Homo sapiens
caggtccctccgcggctggagc

SEQ ID NO: 2263738 - DNA, 19 bp, Homo sapiens
caggttccacagaggacac

SEQ ID NO: 2263739 - DNA, 23 bp, Homo sapiens
cagtaaacgggaacatgccccct

SEQ ID NO: 2263740 - DNA, 23 bp, Homo sapiens
cagtaccatttaatggggaggac

SEQ ID NO: 2263741 - DNA, 15 bp, Homo sapiens
cagtaccctctcagc

SEQ ID NO: 2263742 - DNA, 16 bp, Homo sapiens
cagtaccctctcagct

SEQ ID NO: 2263743 - DNA, 19 bp, Homo sapiens
cagtaccctctcagctcca

SEQ ID NO: 2263744 - DNA, 20 bp, Homo sapiens
cagtaccctctcagctccag

SEQ ID NO: 2263745 - DNA, 22 bp, Homo sapiens
cagtaccctctcagctccaggt

SEQ ID NO: 2263746 - DNA, 20 bp, Homo sapiens
cagtacctagctggctctgt

SEQ ID NO: 2263747 - DNA, 21 bp, Homo sapiens
cagtacttttttaaatatttt

SEQ ID NO: 2263748 - DNA, 18 bp, Homo sapiens
cagtagtttaaaagttct

SEQ ID NO: 2263749 - DNA, 19 bp, Homo sapiens
cagtataaacaaagttact

SEQ ID NO: 2263750 - DNA, 20 bp, Homo sapiens
cagtataaccagctgaagtt

SEQ ID NO: 2263751 - DNA, 12 bp, Homo sapiens
cagtcacttcct

SEQ ID NO: 2263752 - DNA, 21 bp, Homo sapiens
cagtccacaggggccaccacc

SEQ ID NO: 2263753 - DNA, 16 bp, Homo sapiens
cagtctagtacttatt

SEQ ID NO: 2263754 - DNA, 21 bp, Homo sapiens
cagtggaccgcccttttcccc

SEQ ID NO: 2263755 - DNA, 15 bp, Homo sapiens
cagtggaggctggca

SEQ ID NO: 2263756 - DNA, 18 bp, Homo sapiens
cagtggaggctggcaggg

SEQ ID NO: 2263757 - DNA, 21 bp, Homo sapiens
cagtggctcataaaaataaaa

SEQ ID NO: 2263758 - DNA, 13 bp, Homo sapiens
cagtgggacagag

SEQ ID NO: 2263759 - DNA, 20 bp, Homo sapiens
cagtgtccttagaacatttt

SEQ ID NO: 2263760 - DNA, 12 bp, Homo sapiens
cagtgtgtaaac

SEQ ID NO: 2263761 - DNA, 12 bp, Homo sapiens
cagttaaagaag

SEQ ID NO: 2263762 - DNA, 16 bp, Homo sapiens
cagttaaagaagcaat

SEQ ID NO: 2263763 - DNA, 17 bp, Homo sapiens
cagttaaagaagcaatc

SEQ ID NO: 2263764 - DNA, 20 bp, Homo sapiens
cagttatacagttataaaat

SEQ ID NO: 2263765 - DNA, 21 bp, Homo sapiens
cagttcaacctggtggcacca

SEQ ID NO: 2263766 - DNA, 15 bp, Homo sapiens
cagttcattgcactt

SEQ ID NO: 2263767 - DNA, 15 bp, Homo sapiens
cagttgactttctcc

SEQ ID NO: 2263768 - DNA, 18 bp, Homo sapiens
cagttggatcttttgaag

SEQ ID NO: 2263769 - DNA, 18 bp, Homo sapiens
cagtttatcattcaagtg

SEQ ID NO: 2263770 - DNA, 13 bp, Homo sapiens
cagttttagaata

SEQ ID NO: 2263771 - DNA, 19 bp, Homo sapiens
cataaaatgggtgatatgc

SEQ ID NO: 2263772 - DNA, 14 bp, Homo sapiens
cataacatccagag

SEQ ID NO: 2263773 - DNA, 15 bp, Homo sapiens
cataacatccagagc

SEQ ID NO: 2263774 - DNA, 23 bp, Homo sapiens
cataagactggacatttaacttt

SEQ ID NO: 2263775 - DNA, 19 bp, Homo sapiens
cataagttatgcctctgac

SEQ ID NO: 2263776 - DNA, 20 bp, Homo sapiens
cataagttatgcctctgaca

SEQ ID NO: 2263777 - DNA, 11 bp, Homo sapiens
cataatgcaat

SEQ ID NO: 2263778 - DNA, 20 bp, Homo sapiens
cataatttagttgtttctag

SEQ ID NO: 2263779 - DNA, 17 bp, Homo sapiens
catactgaaaaaaaaag

SEQ ID NO: 2263780 - DNA, 15 bp, Homo sapiens
catacttgttctgta

SEQ ID NO: 2263781 - DNA, 14 bp, Homo sapiens
catactttgtaaat

SEQ ID NO: 2263782 - DNA, 15 bp, Homo sapiens
catactttgtaaata

SEQ ID NO: 2263783 - DNA, 22 bp, Homo sapiens
catagaaaattgaaacacagag

SEQ ID NO: 2263784 - DNA, 22 bp, Homo sapiens
catagcacctaacaacattgta

SEQ ID NO: 2263785 - DNA, 16 bp, Homo sapiens
catagtaccatttata

SEQ ID NO: 2263786 - DNA, 11 bp, Homo sapiens
catagtcttga

SEQ ID NO: 2263787 - DNA, 22 bp, Homo sapiens
catagtcttgaaatgaaaggga

SEQ ID NO: 2263788 - DNA, 19 bp, Homo sapiens
catagtgaaaattgtttag

SEQ ID NO: 2263789 - DNA, 16 bp, Homo sapiens
catagttactgtgtaa

SEQ ID NO: 2263790 - DNA, 15 bp, Homo sapiens
catatctttattaat

SEQ ID NO: 2263791 - DNA, 16 bp, Homo sapiens
catattgctgagagaa

SEQ ID NO: 2263792 - DNA, 22 bp, Homo sapiens
cgcagatttttatgttttgaaa

SEQ ID NO: 2263793 - DNA, 23 bp, Homo sapiens
cgcagatttttatgttttgaaag

SEQ ID NO: 2263794 - DNA, 14 bp, Homo sapiens
cgcagcggggtagg

SEQ ID NO: 2263795 - DNA, 18 bp, Homo sapiens
cgccctgggctgtctgtc

SEQ ID NO: 2263796 - DNA, 16 bp, Homo sapiens
cgcctcccctgcccca

SEQ ID NO: 2263797 - DNA, 20 bp, Homo sapiens
cgcctccctccaccccagga

SEQ ID NO: 2263798 - DNA, 12 bp, Homo sapiens
cgcctcctggcc

SEQ ID NO: 2263799 - DNA, 16 bp, Homo sapiens
cgcctcctggccagac

SEQ ID NO: 2263800 - DNA, 13 bp, Homo sapiens
cgcctggccagga

SEQ ID NO: 2263801 - DNA, 14 bp, Homo sapiens
cgcctggccaggag

SEQ ID NO: 2263802 - DNA, 16 bp, Homo sapiens
cgcctggccaggagca

SEQ ID NO: 2263803 - DNA, 15 bp, Homo sapiens
cgcgccccagtcact

SEQ ID NO: 2263804 - DNA, 14 bp, Homo sapiens
cgctaaatatttac

SEQ ID NO: 2263805 - DNA, 15 bp, Homo sapiens
cgctcagtaaacggg

SEQ ID NO: 2263806 - DNA, 14 bp, Homo sapiens
cgctgcaccacggc

SEQ ID NO: 2263807 - DNA, 15 bp, Homo sapiens
cgctgccgctgcacc

SEQ ID NO: 2263808 - DNA, 16 bp, Homo sapiens
cgctgccgctgcacca

SEQ ID NO: 2263809 - DNA, 15 bp, Homo sapiens
cgctgccgctgccgc

SEQ ID NO: 2263810 - DNA, 18 bp, Homo sapiens
cgctgtcgccccaggccc

SEQ ID NO: 2263811 - DNA, 15 bp, Homo sapiens
cggagaccctgagtc

SEQ ID NO: 2263812 - DNA, 13 bp, Homo sapiens
cggagagagccaa

SEQ ID NO: 2263813 - DNA, 14 bp, Homo sapiens
cggagagagccaag

SEQ ID NO: 2263814 - DNA, 17 bp, Homo sapiens
cggagagagccaagacg

SEQ ID NO: 2263815 - DNA, 19 bp, Homo sapiens
cggagcaggggtctgagcc

SEQ ID NO: 2263816 - DNA, 21 bp, Homo sapiens
cggaggaggggaaggggctga

SEQ ID NO: 2263817 - DNA, 14 bp, Homo sapiens
cggaggctgggccc

SEQ ID NO: 2263818 - DNA, 22 bp, Homo sapiens
cggaggttgggtgggccggctt

SEQ ID NO: 2263819 - DNA, 19 bp, Homo sapiens
cggcaacgtagcctgggct

SEQ ID NO: 2263820 - DNA, 20 bp, Homo sapiens
cggcaacgtagcctgggctc

SEQ ID NO: 2263821 - DNA, 13 bp, Homo sapiens
cggcatttgtttc

SEQ ID NO: 2263822 - DNA, 19 bp, Homo sapiens
cggcctcgtgccatgatct

SEQ ID NO: 2263823 - DNA, 19 bp, Homo sapiens
cggcgggatcctccacaga

SEQ ID NO: 2263824 - DNA, 20 bp, Homo sapiens
cggcgggatcctccacagag

SEQ ID NO: 2263825 - DNA, 20 bp, Homo sapiens
cggctccccatgtgtcctgg

SEQ ID NO: 2263826 - DNA, 15 bp, Homo sapiens
cggcttcatgccagc

SEQ ID NO: 2263827 - DNA, 19 bp, Homo sapiens
cggcttcatgccagctact

SEQ ID NO: 2263828 - DNA, 12 bp, Homo sapiens
cgggagcctccc

SEQ ID NO: 2263829 - DNA, 19 bp, Homo sapiens
cgggagcctccccctcaga

SEQ ID NO: 2263830 - DNA, 21 bp, Homo sapiens
cgggaggaaaaggcccctgca

SEQ ID NO: 2263831 - DNA, 17 bp, Homo sapiens
cgggcaggtcctgccca

SEQ ID NO: 2263832 - DNA, 21 bp, Homo sapiens
cgggcaggtcctgcccatgtg

SEQ ID NO: 2263833 - DNA, 21 bp, Homo sapiens
cggggtatcctgggggaccca

SEQ ID NO: 2263834 - DNA, 12 bp, Homo sapiens
cggggtgcagaa

SEQ ID NO: 2263835 - DNA, 22 bp, Homo sapiens
cgggtgcatttgagagaagcca

SEQ ID NO: 2263836 - DNA, 23 bp, Homo sapiens
cgggtgcatttgagagaagccac

SEQ ID NO: 2263837 - DNA, 20 bp, Homo sapiens
cggtgtgtaacactgtgtac

SEQ ID NO: 2263838 - DNA, 18 bp, Homo sapiens
cggtttcgaagtcattaa

SEQ ID NO: 2263839 - DNA, 14 bp, Homo sapiens
cgtaatttaatggg

SEQ ID NO: 2263840 - DNA, 11 bp, Homo sapiens
cgtagcctggg

SEQ ID NO: 2263841 - DNA, 23 bp, Homo sapiens
cgtagcctgggctcactgtgctg

SEQ ID NO: 2263842 - DNA, 22 bp, Homo sapiens
cgtcactccacgcagctggcag

SEQ ID NO: 2263843 - DNA, 18 bp, Homo sapiens
cgtcatcggaggctgggc

SEQ ID NO: 2263844 - DNA, 20 bp, Homo sapiens
cgtcatcggaggctgggccc

SEQ ID NO: 2263845 - DNA, 17 bp, Homo sapiens
cgtccccccccaacctt

SEQ ID NO: 2263846 - DNA, 15 bp, Homo sapiens
cgtcctctccccagc

SEQ ID NO: 2263847 - DNA, 18 bp, Homo sapiens
cgtgaaaacggagctgaa

SEQ ID NO: 2263848 - DNA, 13 bp, Homo sapiens
cgtggactgtgct

SEQ ID NO: 2263849 - DNA, 14 bp, Homo sapiens
cgtggactgtgctg

SEQ ID NO: 2263850 - DNA, 11 bp, Homo sapiens
cgtggcaggac

SEQ ID NO: 2263851 - DNA, 13 bp, Homo sapiens
cgtggcaggactt

SEQ ID NO: 2263852 - DNA, 19 bp, Homo sapiens
cgtgggtcctgaggcctgc

SEQ ID NO: 2263853 - DNA, 15 bp, Homo sapiens
cgtgtcacacttgtg

SEQ ID NO: 2263854 - DNA, 14 bp, Homo sapiens
cgtgtctcagcctc

SEQ ID NO: 2263855 - DNA, 16 bp, Homo sapiens
cgtgttctccttttcc

SEQ ID NO: 2263856 - DNA, 14 bp, Homo sapiens
cgttaaaaacagat

SEQ ID NO: 2263857 - DNA, 21 bp, Homo sapiens
cgttaaaaacagatttggaaa

SEQ ID NO: 2263858 - DNA, 13 bp, Homo sapiens
cgttatatattgt

SEQ ID NO: 2263859 - DNA, 15 bp, Homo sapiens
cgtttccaagctgcg

SEQ ID NO: 2263860 - DNA, 16 bp, Homo sapiens
cgtttccaagctgcgg

SEQ ID NO: 2263861 - DNA, 15 bp, Homo sapiens
cgtttttgtgctgtg

SEQ ID NO: 2263862 - DNA, 13 bp, Homo sapiens
ctaaaatgtatct

SEQ ID NO: 2263863 - DNA, 17 bp, Homo sapiens
ctaaacctcagttatta

SEQ ID NO: 2263864 - DNA, 16 bp, Homo sapiens
ctaaagcctcaaaaca

SEQ ID NO: 2263865 - DNA, 15 bp, Homo sapiens
ctaaataaaatttgt

SEQ ID NO: 2263866 - DNA, 22 bp, Homo sapiens
ctaacgttgagcccctggaggc

SEQ ID NO: 2263867 - DNA, 15 bp, Homo sapiens
ctaagaaaagatttt

SEQ ID NO: 2263868 - DNA, 22 bp, Homo sapiens
ctaagaaatcaagtaatgaatc

SEQ ID NO: 2263869 - DNA, 17 bp, Homo sapiens
ctaagaattcaaactgg

SEQ ID NO: 2263870 - DNA, 14 bp, Homo sapiens
ctaagattctttta

SEQ ID NO: 2263871 - DNA, 17 bp, Homo sapiens
ctaagcagcttattgtt

SEQ ID NO: 2263872 - DNA, 22 bp, Homo sapiens
ctaaggttgtctacgggggcac

SEQ ID NO: 2263873 - DNA, 18 bp, Homo sapiens
ctaataagtttgaaatat

SEQ ID NO: 2263874 - DNA, 21 bp, Homo sapiens
ctaatgaaggttttcatttgc

SEQ ID NO: 2263875 - DNA, 19 bp, Homo sapiens
ctaatttttgtattatttt

SEQ ID NO: 2263876 - DNA, 22 bp, Homo sapiens
ctacaaaacctaccctcagtga

SEQ ID NO: 2263877 - DNA, 22 bp, Homo sapiens
ctacataagactggacatttaa

SEQ ID NO: 2263878 - DNA, 15 bp, Homo sapiens
ctacatcttctgcct

SEQ ID NO: 2263879 - DNA, 14 bp, Homo sapiens
ctacattaacttga

SEQ ID NO: 2263880 - DNA, 22 bp, Homo sapiens
ctacattaacttgaaaattttt

SEQ ID NO: 2263881 - DNA, 20 bp, Homo sapiens
ctaccaacttgtatccaggc

SEQ ID NO: 2263882 - DNA, 13 bp, Homo sapiens
ctaccaatattag

SEQ ID NO: 2263883 - DNA, 11 bp, Homo sapiens
ctaccagccag

SEQ ID NO: 2263884 - DNA, 20 bp, Homo sapiens
ctaccagccagcctcagaag

SEQ ID NO: 2263885 - DNA, 22 bp, Homo sapiens
ctaccagccagcctcagaaggc

SEQ ID NO: 2263886 - DNA, 18 bp, Homo sapiens
ctacccagcgtggcctcc

SEQ ID NO: 2263887 - DNA, 15 bp, Homo sapiens
ctaccctcagtgagc

SEQ ID NO: 2263888 - DNA, 13 bp, Homo sapiens
ctaccctggactt

SEQ ID NO: 2263889 - DNA, 18 bp, Homo sapiens
ctacctcaggcagctcaa

SEQ ID NO: 2263890 - DNA, 10 bp, Homo sapiens
ctactacctc

SEQ ID NO: 2263891 - DNA, 17 bp, Homo sapiens
ctactacctgtaatgac

SEQ ID NO: 2263892 - DNA, 15 bp, Homo sapiens
ctactgaatgtcatt

SEQ ID NO: 2263893 - DNA, 15 bp, Homo sapiens
ctactggattcttat

SEQ ID NO: 2263894 - DNA, 17 bp, Homo sapiens
ctactgtaattttatat

SEQ ID NO: 2263895 - DNA, 15 bp, Homo sapiens
ctacttaaaaaaaat

SEQ ID NO: 2263896 - DNA, 19 bp, Homo sapiens
ctacttcctcctccccact

SEQ ID NO: 2263897 - DNA, 20 bp, Homo sapiens
ctactttgttaggattttca

SEQ ID NO: 2263898 - DNA, 20 bp, Homo sapiens
ctagaaattgacacaagtgg

SEQ ID NO: 2263899 - DNA, 12 bp, Homo sapiens
ctagaaattttc

SEQ ID NO: 2263900 - DNA, 22 bp, Homo sapiens
ctagatactactttctcttttt

SEQ ID NO: 2263901 - DNA, 18 bp, Homo sapiens
ctggggcaggctgggcca

SEQ ID NO: 2263902 - DNA, 19 bp, Homo sapiens
ctggggcaggctgggccat

SEQ ID NO: 2263903 - DNA, 21 bp, Homo sapiens
ctggggcaggctgggccatgt

SEQ ID NO: 2263904 - DNA, 15 bp, Homo sapiens
ctggggccctgggcc

SEQ ID NO: 2263905 - DNA, 11 bp, Homo sapiens
ctggggcctcc

SEQ ID NO: 2263906 - DNA, 12 bp, Homo sapiens
ctggggcctcca

SEQ ID NO: 2263907 - DNA, 18 bp, Homo sapiens
ctgggtgagagaggaata

SEQ ID NO: 2263908 - DNA, 19 bp, Homo sapiens
ctgggtggtaccctctgga

SEQ ID NO: 2263909 - DNA, 15 bp, Homo sapiens
ctgggtttcctgcag

SEQ ID NO: 2263910 - DNA, 18 bp, Homo sapiens
ctgggtttcctgcaggca

SEQ ID NO: 2263911 - DNA, 21 bp, Homo sapiens
ctggtaaagttacacttttat

SEQ ID NO: 2263912 - DNA, 22 bp, Homo sapiens
ctggtaaagttacacttttatt

SEQ ID NO: 2263913 - DNA, 16 bp, Homo sapiens
ctggtaccctcctggc

SEQ ID NO: 2263914 - DNA, 21 bp, Homo sapiens
ctggtagcagcaggctcaggc

SEQ ID NO: 2263915 - DNA, 12 bp, Homo sapiens
ctggtggcacca

SEQ ID NO: 2263916 - DNA, 22 bp, Homo sapiens
ctggtggcaccagatgcaacct

SEQ ID NO: 2263917 - DNA, 18 bp, Homo sapiens
ctggttcccgtttctcca

SEQ ID NO: 2263918 - DNA, 21 bp, Homo sapiens
ctggttcccgtttctccacct

SEQ ID NO: 2263919 - DNA, 22 bp, Homo sapiens
ctgtaaacacaggggacacagc

SEQ ID NO: 2263920 - DNA, 20 bp, Homo sapiens
ctgtaaacctctcgagggca

SEQ ID NO: 2263921 - DNA, 17 bp, Homo sapiens
ctgtactgttctgtgtc

SEQ ID NO: 2263922 - DNA, 14 bp, Homo sapiens
ctgtagaatcaatt

SEQ ID NO: 2263923 - DNA, 19 bp, Homo sapiens
ctgtataatctatttacat

SEQ ID NO: 2263924 - DNA, 22 bp, Homo sapiens
ctgtatatttgtgatagcactt

SEQ ID NO: 2263925 - DNA, 14 bp, Homo sapiens
ctgtatgttgtaca

SEQ ID NO: 2263926 - DNA, 15 bp, Homo sapiens
ctgtatgttgtacaa

SEQ ID NO: 2263927 - DNA, 19 bp, Homo sapiens
ctgtatgttgtacaatcaa

SEQ ID NO: 2263928 - DNA, 14 bp, Homo sapiens
ctgtcaaaactact

SEQ ID NO: 2263929 - DNA, 13 bp, Homo sapiens
ctgtcaaggctca

SEQ ID NO: 2263930 - DNA, 20 bp, Homo sapiens
ctgtcaaggctgcttagaat

SEQ ID NO: 2263931 - DNA, 19 bp, Homo sapiens
ctgtcacagtaaaaataaa

SEQ ID NO: 2263932 - DNA, 21 bp, Homo sapiens
ctgtcactcattgctgagcct

SEQ ID NO: 2263933 - DNA, 11 bp, Homo sapiens
ctgtcactgtt

SEQ ID NO: 2263934 - DNA, 12 bp, Homo sapiens
ctgtcagccagc

SEQ ID NO: 2263935 - DNA, 17 bp, Homo sapiens
ctgtcagccagccgccc

SEQ ID NO: 2263936 - DNA, 14 bp, Homo sapiens
ctgtcatctctctg

SEQ ID NO: 2263937 - DNA, 18 bp, Homo sapiens
ctgtcctctcgagcccag

SEQ ID NO: 2263938 - DNA, 18 bp, Homo sapiens
ctgtcgccccaggccctc

SEQ ID NO: 2263939 - DNA, 14 bp, Homo sapiens
ctgtctcttggctt

SEQ ID NO: 2263940 - DNA, 16 bp, Homo sapiens
ctgtctcttggctttg

SEQ ID NO: 2263941 - DNA, 13 bp, Homo sapiens
ctgtctgtcacca

SEQ ID NO: 2263942 - DNA, 19 bp, Homo sapiens
ctgtctgtcaccagctatc

SEQ ID NO: 2263943 - DNA, 21 bp, Homo sapiens
ctgtctgttctgcacaataaa

SEQ ID NO: 2263944 - DNA, 18 bp, Homo sapiens
ctgtctgttgtattcatt

SEQ ID NO: 2263945 - DNA, 19 bp, Homo sapiens
ctgtctgttgtattcattg

SEQ ID NO: 2263946 - DNA, 17 bp, Homo sapiens
ctgtgagaaggtttatt

SEQ ID NO: 2263947 - DNA, 21 bp, Homo sapiens
ctgtgcaatagacacatacat

SEQ ID NO: 2263948 - DNA, 13 bp, Homo sapiens
ctgtgctggggca

SEQ ID NO: 2263949 - DNA, 19 bp, Homo sapiens
ctgtgggcagcaccctccc

SEQ ID NO: 2263950 - DNA, 23 bp, Homo sapiens
ctgtgggcagcaccctcccccgc

SEQ ID NO: 2263951 - DNA, 24 bp, Homo sapiens
ctgtgggggtgagggtcccatgtg

SEQ ID NO: 2263952 - DNA, 11 bp, Homo sapiens
ctgtgtaaact

SEQ ID NO: 2263953 - DNA, 21 bp, Homo sapiens
ctgtgtaaactcatctgaaat

SEQ ID NO: 2263954 - DNA, 14 bp, Homo sapiens
ctgtgtttcagcat

SEQ ID NO: 2263955 - DNA, 18 bp, Homo sapiens
ctgttaatttttatactg

SEQ ID NO: 2263956 - DNA, 14 bp, Homo sapiens
ctgttagcagagtc

SEQ ID NO: 2263957 - DNA, 19 bp, Homo sapiens
ctgttagcagagtctgtct

SEQ ID NO: 2263958 - DNA, 20 bp, Homo sapiens
ctgttccacacccaatgctg

SEQ ID NO: 2263959 - DNA, 20 bp, Homo sapiens
ctgttcccatgtagccccct

SEQ ID NO: 2263960 - DNA, 21 bp, Homo sapiens
ctgttctgcacaataaacata

SEQ ID NO: 2263961 - DNA, 20 bp, Homo sapiens
ctgttggcaggcccactccc

SEQ ID NO: 2263962 - DNA, 22 bp, Homo sapiens
ctgtttaatcatagttactgtg

SEQ ID NO: 2263963 - DNA, 20 bp, Homo sapiens
ctgttttgtggtcagctgta

SEQ ID NO: 2263964 - DNA, 14 bp, Homo sapiens
ctgtttttttgtta

SEQ ID NO: 2263965 - DNA, 15 bp, Homo sapiens
cttaaaaactgaaaa

SEQ ID NO: 2263966 - DNA, 14 bp, Homo sapiens
cttaaaaaggacta

SEQ ID NO: 2263967 - DNA, 17 bp, Homo sapiens
cttaagtattgtcacca

SEQ ID NO: 2263968 - DNA, 21 bp, Homo sapiens
cttaagttagttccactgaga

SEQ ID NO: 2263969 - DNA, 18 bp, Homo sapiens
cttaatccagctgatgag

SEQ ID NO: 2263970 - DNA, 13 bp, Homo sapiens
cttaattacagtt

SEQ ID NO: 2263971 - DNA, 22 bp, Homo sapiens
cttaattacagttaaagaagca

SEQ ID NO: 2263972 - DNA, 17 bp, Homo sapiens
cttaattattataaaaa

SEQ ID NO: 2263973 - DNA, 18 bp, Homo sapiens
cttaattattatttgtgt

SEQ ID NO: 2263974 - DNA, 16 bp, Homo sapiens
cttacctactttcttc

SEQ ID NO: 2263975 - DNA, 12 bp, Homo sapiens
cttactaggaag

SEQ ID NO: 2263976 - DNA, 20 bp, Homo sapiens
cttactgggtaggtgattct

SEQ ID NO: 2263977 - DNA, 16 bp, Homo sapiens
cttagctatccttggc

SEQ ID NO: 2263978 - DNA, 12 bp, Homo sapiens
cttaggccttcc

SEQ ID NO: 2263979 - DNA, 23 bp, Homo sapiens
cttaggccttcctctctccagat

SEQ ID NO: 2263980 - DNA, 13 bp, Homo sapiens
cttagtctcagtt

SEQ ID NO: 2263981 - DNA, 18 bp, Homo sapiens
cttagtctcagtttgtgt

SEQ ID NO: 2263982 - DNA, 23 bp, Homo sapiens
cttagtctcagtttgtgtgtctt

SEQ ID NO: 2263983 - DNA, 23 bp, Homo sapiens
cttatatatgcacttaatttgtt

SEQ ID NO: 2263984 - DNA, 17 bp, Homo sapiens
cttatatgggaaaccat

SEQ ID NO: 2263985 - DNA, 22 bp, Homo sapiens
cttcaaaaggaatgaacttgtt

SEQ ID NO: 2263986 - DNA, 21 bp, Homo sapiens
cttcaaaagtttgtttgctta

SEQ ID NO: 2263987 - DNA, 16 bp, Homo sapiens
cttcaaagaaacttga

SEQ ID NO: 2263988 - DNA, 19 bp, Homo sapiens
cttcaaatatagagatatt

SEQ ID NO: 2263989 - DNA, 14 bp, Homo sapiens
cttcacagtcccag

SEQ ID NO: 2263990 - DNA, 16 bp, Homo sapiens
cttcacagtcccaggt

SEQ ID NO: 2263991 - DNA, 19 bp, Homo sapiens
cttcagggaggtagtttca

SEQ ID NO: 2263992 - DNA, 23 bp, Homo sapiens
cttcaggtaaagggcaaataatg

SEQ ID NO: 2263993 - DNA, 14 bp, Homo sapiens
cttcatgccagcta

SEQ ID NO: 2263994 - DNA, 16 bp, Homo sapiens
cttccacatgttactg

SEQ ID NO: 2263995 - DNA, 15 bp, Homo sapiens
cttccagctcctgta

SEQ ID NO: 2263996 - DNA, 16 bp, Homo sapiens
cttccagtataaccag

SEQ ID NO: 2263997 - DNA, 19 bp, Homo sapiens
cttccagtgtccttagaac

SEQ ID NO: 2263998 - DNA, 12 bp, Homo sapiens
cttcccacagga

SEQ ID NO: 2263999 - DNA, 22 bp, Homo sapiens
cttcccacaggagggccagcgc

SEQ ID NO: 2264000 - DNA, 18 bp, Homo sapiens
cttccccttctgtgtcac

SEQ ID NO: 2264001 - DNA, 13 bp, Homo sapiens
cttcctctccctc

SEQ ID NO: 2264002 - DNA, 20 bp, Homo sapiens
cttcctgcaggcaggaacaa

SEQ ID NO: 2264003 - DNA, 20 bp, Homo sapiens
cttccttgagacacggagcc

SEQ ID NO: 2264004 - DNA, 13 bp, Homo sapiens
cttctattctagc

SEQ ID NO: 2264005 - DNA, 20 bp, Homo sapiens
cttctattctagcctgcatt

SEQ ID NO: 2264006 - DNA, 19 bp, Homo sapiens
cttctcagatttctgagga

SEQ ID NO: 2264007 - DNA, 22 bp, Homo sapiens
cttctcagatttctgaggaaat

SEQ ID NO: 2264008 - DNA, 13 bp, Homo sapiens
cttctctgctaga

SEQ ID NO: 2264009 - DNA, 21 bp, Homo sapiens
gaccttaggccttcctctctc

SEQ ID NO: 2264010 - DNA, 14 bp, Homo sapiens
gacgagacccccat

SEQ ID NO: 2264011 - DNA, 22 bp, Homo sapiens
gacgagacccccatccagcctc

SEQ ID NO: 2264012 - DNA, 14 bp, Homo sapiens
gacgccactcattt

SEQ ID NO: 2264013 - DNA, 19 bp, Homo sapiens
gacggagatgaagaacatc

SEQ ID NO: 2264014 - DNA, 12 bp, Homo sapiens
gacggaggaggg

SEQ ID NO: 2264015 - DNA, 19 bp, Homo sapiens
gacgtcatcggaggctggg

SEQ ID NO: 2264016 - DNA, 21 bp, Homo sapiens
gacgtcatcggaggctgggcc

SEQ ID NO: 2264017 - DNA, 19 bp, Homo sapiens
gacgtgaatgtctcagcga

SEQ ID NO: 2264018 - DNA, 20 bp, Homo sapiens
gacgtttttgtgctgtgggc

SEQ ID NO: 2264019 - DNA, 21 bp, Homo sapiens
gacgtttttgtgctgtgggca

SEQ ID NO: 2264020 - DNA, 23 bp, Homo sapiens
gacgtttttgtgctgtgggcagc

SEQ ID NO: 2264021 - DNA, 16 bp, Homo sapiens
gactcatcttatatgg

SEQ ID NO: 2264022 - DNA, 16 bp, Homo sapiens
gactccagccagcgcc

SEQ ID NO: 2264023 - DNA, 19 bp, Homo sapiens
gactccagccagcgcctcc

SEQ ID NO: 2264024 - DNA, 21 bp, Homo sapiens
gactccagccagcgcctccct

SEQ ID NO: 2264025 - DNA, 14 bp, Homo sapiens
gactccagctgtga

SEQ ID NO: 2264026 - DNA, 16 bp, Homo sapiens
gactctggcaaagctt

SEQ ID NO: 2264027 - DNA, 19 bp, Homo sapiens
gactctgtctacctggtct

SEQ ID NO: 2264028 - DNA, 19 bp, Homo sapiens
gactgaaaatattgtttta

SEQ ID NO: 2264029 - DNA, 12 bp, Homo sapiens
gactgctaaata

SEQ ID NO: 2264030 - DNA, 18 bp, Homo sapiens
gactgctaaataaaattt

SEQ ID NO: 2264031 - DNA, 17 bp, Homo sapiens
gactggatgtaccacca

SEQ ID NO: 2264032 - DNA, 10 bp, Homo sapiens
gactggcttt

SEQ ID NO: 2264033 - DNA, 23 bp, Homo sapiens
gactggcttttattaatgcactt

SEQ ID NO: 2264034 - DNA, 23 bp, Homo sapiens
gactgtcccaccgggagcctccc

SEQ ID NO: 2264035 - DNA, 15 bp, Homo sapiens
gactgtgctggtgca

SEQ ID NO: 2264036 - DNA, 11 bp, Homo sapiens
gactgttcttt

SEQ ID NO: 2264037 - DNA, 19 bp, Homo sapiens
gactgttttctctcggctc

SEQ ID NO: 2264038 - DNA, 15 bp, Homo sapiens
gacttccttgagaca

SEQ ID NO: 2264039 - DNA, 16 bp, Homo sapiens
gacttccttgagacac

SEQ ID NO: 2264040 - DNA, 11 bp, Homo sapiens
gactttataaa

SEQ ID NO: 2264041 - DNA, 14 bp, Homo sapiens
gagaaatgaaaaca

SEQ ID NO: 2264042 - DNA, 20 bp, Homo sapiens
gagaactcgcgctcagtaaa

SEQ ID NO: 2264043 - DNA, 14 bp, Homo sapiens
gagaagacactgca

SEQ ID NO: 2264044 - DNA, 15 bp, Homo sapiens
gagaagacactgcag

SEQ ID NO: 2264045 - DNA, 15 bp, Homo sapiens
gagaaggtttattgt

SEQ ID NO: 2264046 - DNA, 14 bp, Homo sapiens
gagaattgggggct

SEQ ID NO: 2264047 - DNA, 13 bp, Homo sapiens
gagacagcccagg

SEQ ID NO: 2264048 - DNA, 15 bp, Homo sapiens
gagacccccatccag

SEQ ID NO: 2264049 - DNA, 17 bp, Homo sapiens
gagacccccatccagcc

SEQ ID NO: 2264050 - DNA, 20 bp, Homo sapiens
gagacccccatccagcctcc

SEQ ID NO: 2264051 - DNA, 18 bp, Homo sapiens
gagacggtgttttgccat

SEQ ID NO: 2264052 - DNA, 18 bp, Homo sapiens
gagactctgtttgcttgt

SEQ ID NO: 2264053 - DNA, 17 bp, Homo sapiens
gagagaattaaaactca

SEQ ID NO: 2264054 - DNA, 20 bp, Homo sapiens
gagagcacagtgatcaccag

SEQ ID NO: 2264055 - DNA, 19 bp, Homo sapiens
gagaggagaaactgagaaa

SEQ ID NO: 2264056 - DNA, 21 bp, Homo sapiens
gagatctttctttccaaaaca

SEQ ID NO: 2264057 - DNA, 19 bp, Homo sapiens
gagatttttaaaaaatatt

SEQ ID NO: 2264058 - DNA, 15 bp, Homo sapiens
gagcagaggtggaaa

SEQ ID NO: 2264059 - DNA, 18 bp, Homo sapiens
gagcaggggtctgagcca

SEQ ID NO: 2264060 - DNA, 18 bp, Homo sapiens
gagcatctgcaacaaaaa

SEQ ID NO: 2264061 - DNA, 19 bp, Homo sapiens
gagcatttctcatcagtag

SEQ ID NO: 2264062 - DNA, 11 bp, Homo sapiens
gagccaagacg

SEQ ID NO: 2264063 - DNA, 13 bp, Homo sapiens
gagccaagacgga

SEQ ID NO: 2264064 - DNA, 15 bp, Homo sapiens
gagccaagacggagg

SEQ ID NO: 2264065 - DNA, 22 bp, Homo sapiens
gagccaagacggaggaggggaa

SEQ ID NO: 2264066 - DNA, 17 bp, Homo sapiens
gagccacagtcactgga

SEQ ID NO: 2264067 - DNA, 12 bp, Homo sapiens
gagccacctcac

SEQ ID NO: 2264068 - DNA, 11 bp, Homo sapiens
gagccagcctg

SEQ ID NO: 2264069 - DNA, 22 bp, Homo sapiens
gagccagcctggctctgccccc

SEQ ID NO: 2264070 - DNA, 15 bp, Homo sapiens
gagcccgtcagcgtg

SEQ ID NO: 2264071 - DNA, 19 bp, Homo sapiens
gagccctcaactattctgt

SEQ ID NO: 2264072 - DNA, 19 bp, Homo sapiens
gagcctcccaccagagccg

SEQ ID NO: 2264073 - DNA, 21 bp, Homo sapiens
gagcctcccaccagagccggg

SEQ ID NO: 2264074 - DNA, 15 bp, Homo sapiens
gagcctccccctcag

SEQ ID NO: 2264075 - DNA, 17 bp, Homo sapiens
gagcctctgctccccag

SEQ ID NO: 2264076 - DNA, 18 bp, Homo sapiens
gagcctttggttctggcc

SEQ ID NO: 2264077 - DNA, 21 bp, Homo sapiens
gagctgaaagctggtggcaga

SEQ ID NO: 2264078 - DNA, 21 bp, Homo sapiens
gagctgccttggctcagacat

SEQ ID NO: 2264079 - DNA, 22 bp, Homo sapiens
gagctgccttggctcagacatg

SEQ ID NO: 2264080 - DNA, 23 bp, Homo sapiens
gagctttgtctacttcaaaagtt

SEQ ID NO: 2264081 - DNA, 14 bp, Homo sapiens
gaggaaaagtgcaa

SEQ ID NO: 2264082 - DNA, 13 bp, Homo sapiens
gaggacacagaga

SEQ ID NO: 2264083 - DNA, 21 bp, Homo sapiens
gaggacgagacccccatccag

SEQ ID NO: 2264084 - DNA, 16 bp, Homo sapiens
gaggagaaactgagaa

SEQ ID NO: 2264085 - DNA, 14 bp, Homo sapiens
gaggagccccagct

SEQ ID NO: 2264086 - DNA, 13 bp, Homo sapiens
gaggagctggggc

SEQ ID NO: 2264087 - DNA, 14 bp, Homo sapiens
gaggaggggaaggg

SEQ ID NO: 2264088 - DNA, 21 bp, Homo sapiens
gaggaggggaaggggctgagg

SEQ ID NO: 2264089 - DNA, 22 bp, Homo sapiens
gaggatggtagaagtttggctg

SEQ ID NO: 2264090 - DNA, 23 bp, Homo sapiens
gaggcaaaaatgtccagccaccc

SEQ ID NO: 2264091 - DNA, 15 bp, Homo sapiens
gaggcaaaggttcta

SEQ ID NO: 2264092 - DNA, 15 bp, Homo sapiens
gaggcctagactctg

SEQ ID NO: 2264093 - DNA, 16 bp, Homo sapiens
gaggctgggcccctgg

SEQ ID NO: 2264094 - DNA, 21 bp, Homo sapiens
gagggagacactggcccctca

SEQ ID NO: 2264095 - DNA, 13 bp, Homo sapiens
gagggatggagag

SEQ ID NO: 2264096 - DNA, 21 bp, Homo sapiens
gaggggaccaattctggacag

SEQ ID NO: 2264097 - DNA, 21 bp, Homo sapiens
gaggggtgtggctccttccca

SEQ ID NO: 2264098 - DNA, 18 bp, Homo sapiens
gaggtaactatcaatatt

SEQ ID NO: 2264099 - DNA, 19 bp, Homo sapiens
gaggtccttaggcctctga

SEQ ID NO: 2264100 - DNA, 21 bp, Homo sapiens
gaggtccttaggcctctgaga

SEQ ID NO: 2264101 - DNA, 21 bp, Homo sapiens
gaggtgcctgtcccaccccca

SEQ ID NO: 2264102 - DNA, 11 bp, Homo sapiens
gagtcccctca

SEQ ID NO: 2264103 - DNA, 17 bp, Homo sapiens
gagtcccctcacctcct

SEQ ID NO: 2264104 - DNA, 19 bp, Homo sapiens
gagtctaatagtctttgcc

SEQ ID NO: 2264105 - DNA, 18 bp, Homo sapiens
gagtgatttccatctctg

SEQ ID NO: 2264106 - DNA, 17 bp, Homo sapiens
gagttattttttgtatt

SEQ ID NO: 2264107 - DNA, 22 bp, Homo sapiens
gagttcttagctatccttggct

SEQ ID NO: 2264108 - DNA, 16 bp, Homo sapiens
gagtttttatgccttt

SEQ ID NO: 2264109 - DNA, 18 bp, Homo sapiens
gagtttttatgcctttct

SEQ ID NO: 2264110 - DNA, 21 bp, Homo sapiens
gataaatattgagcagatcta

SEQ ID NO: 2264111 - DNA, 20 bp, Homo sapiens
gataaggactagatactact

SEQ ID NO: 2264112 - DNA, 20 bp, Homo sapiens
gataatctcagtgctttcct

SEQ ID NO: 2264113 - DNA, 13 bp, Homo sapiens
gataccagctgga

SEQ ID NO: 2264114 - DNA, 13 bp, Homo sapiens
gatacccccctct

SEQ ID NO: 2264115 - DNA, 21 bp, Homo sapiens
gatacccccctctgtcttgtg

SEQ ID NO: 2264116 - DNA, 14 bp, Homo sapiens
gatactactttctc

SEQ ID NO: 2264117 - DNA, 16 bp, Homo sapiens
gccctgccccacccca

SEQ ID NO: 2264118 - DNA, 23 bp, Homo sapiens
gccctgccccaccccatccagcc

SEQ ID NO: 2264119 - DNA, 21 bp, Homo sapiens
gccctgctggggatccccgcc

SEQ ID NO: 2264120 - DNA, 22 bp, Homo sapiens
gccctgcttttgcataatgcaa

SEQ ID NO: 2264121 - DNA, 23 bp, Homo sapiens
gccctgggcctcagttcaacctg

SEQ ID NO: 2264122 - DNA, 21 bp, Homo sapiens
gccctgggctgtctgtcacca

SEQ ID NO: 2264123 - DNA, 20 bp, Homo sapiens
gccctggggatcttcccaca

SEQ ID NO: 2264124 - DNA, 22 bp, Homo sapiens
gccctggggatcttcccacagg

SEQ ID NO: 2264125 - DNA, 23 bp, Homo sapiens
gcccttccccctgcaaaaagaaa

SEQ ID NO: 2264126 - DNA, 20 bp, Homo sapiens
gccgaccacagggccttgaa

SEQ ID NO: 2264127 - DNA, 13 bp, Homo sapiens
gccgcacatctgg

SEQ ID NO: 2264128 - DNA, 17 bp, Homo sapiens
gccgccccctgcccccc

SEQ ID NO: 2264129 - DNA, 13 bp, Homo sapiens
gccgccctgggct

SEQ ID NO: 2264130 - DNA, 15 bp, Homo sapiens
gccgccctgggctgt

SEQ ID NO: 2264131 - DNA, 23 bp, Homo sapiens
gccgccctgggctgtctgtcacc

SEQ ID NO: 2264132 - DNA, 24 bp, Homo sapiens
gccgccctgggctgtctgtcacca

SEQ ID NO: 2264133 - DNA, 19 bp, Homo sapiens
gccgcgtggaatgtgagtg

SEQ ID NO: 2264134 - DNA, 17 bp, Homo sapiens
gccgctgtgcccccctc

SEQ ID NO: 2264135 - DNA, 17 bp, Homo sapiens
gccgggcaggtcctgcc

SEQ ID NO: 2264136 - DNA, 15 bp, Homo sapiens
gccgtgtctctgagg

SEQ ID NO: 2264137 - DNA, 15 bp, Homo sapiens
gcctaaacctcagtt

SEQ ID NO: 2264138 - DNA, 23 bp, Homo sapiens
gcctacagctttgatccctgaca

SEQ ID NO: 2264139 - DNA, 17 bp, Homo sapiens
gcctcaaaggcccgctc

SEQ ID NO: 2264140 - DNA, 19 bp, Homo sapiens
gcctcactaatttttgtat

SEQ ID NO: 2264141 - DNA, 21 bp, Homo sapiens
gcctcagaaggccccagagag

SEQ ID NO: 2264142 - DNA, 22 bp, Homo sapiens
gcctcagaaggccccagagaga

SEQ ID NO: 2264143 - DNA, 17 bp, Homo sapiens
gcctccagaactcactg

SEQ ID NO: 2264144 - DNA, 12 bp, Homo sapiens
gcctccagggca

SEQ ID NO: 2264145 - DNA, 23 bp, Homo sapiens
gcctccagggcattgctcagccc

SEQ ID NO: 2264146 - DNA, 22 bp, Homo sapiens
gcctcccaccagagccgggagg

SEQ ID NO: 2264147 - DNA, 15 bp, Homo sapiens
gcctccccctcagat

SEQ ID NO: 2264148 - DNA, 16 bp, Homo sapiens
gcctccctccacccca

SEQ ID NO: 2264149 - DNA, 21 bp, Homo sapiens
gcctccctccaccccaggacg

SEQ ID NO: 2264150 - DNA, 14 bp, Homo sapiens
gcctcctggccaga

SEQ ID NO: 2264151 - DNA, 15 bp, Homo sapiens
gcctcctggccagac

SEQ ID NO: 2264152 - DNA, 19 bp, Homo sapiens
gcctcctggccagacgctg

SEQ ID NO: 2264153 - DNA, 21 bp, Homo sapiens
gcctctcggtgacctccgtcc

SEQ ID NO: 2264154 - DNA, 19 bp, Homo sapiens
gcctctgacagtccacagg

SEQ ID NO: 2264155 - DNA, 20 bp, Homo sapiens
gcctctgacagtccacaggg

SEQ ID NO: 2264156 - DNA, 23 bp, Homo sapiens
gcctctgacagtccacaggggcc

SEQ ID NO: 2264157 - DNA, 23 bp, Homo sapiens
gcctcttgtatccctagtgctcc

SEQ ID NO: 2264158 - DNA, 19 bp, Homo sapiens
gcctggaatttgggcagat

SEQ ID NO: 2264159 - DNA, 18 bp, Homo sapiens
gcctggcacaggccgagg

SEQ ID NO: 2264160 - DNA, 23 bp, Homo sapiens
gcctggcacaggccgaggcagga

SEQ ID NO: 2264161 - DNA, 15 bp, Homo sapiens
gcctggccaggagca

SEQ ID NO: 2264162 - DNA, 22 bp, Homo sapiens
gcctgggctcactgtgctgggg

SEQ ID NO: 2264163 - DNA, 22 bp, Homo sapiens
gcctggggctgaggctgaggca

SEQ ID NO: 2264164 - DNA, 17 bp, Homo sapiens
gcctgttggcaggccca

SEQ ID NO: 2264165 - DNA, 15 bp, Homo sapiens
gccttagtctcagtt

SEQ ID NO: 2264166 - DNA, 17 bp, Homo sapiens
gccttatgttgaaaaaa

SEQ ID NO: 2264167 - DNA, 18 bp, Homo sapiens
gccttcctctctccagat

SEQ ID NO: 2264168 - DNA, 18 bp, Homo sapiens
gccttctgcagcaggaac

SEQ ID NO: 2264169 - DNA, 14 bp, Homo sapiens
gccttttaattttt

SEQ ID NO: 2264170 - DNA, 13 bp, Homo sapiens
gccttttccctct

SEQ ID NO: 2264171 - DNA, 20 bp, Homo sapiens
gccttttccctctttggctc

SEQ ID NO: 2264172 - DNA, 18 bp, Homo sapiens
gcgaagccttctgcagca

SEQ ID NO: 2264173 - DNA, 13 bp, Homo sapiens
gcgaccgccccct

SEQ ID NO: 2264174 - DNA, 14 bp, Homo sapiens
gcgaccgccccctc

SEQ ID NO: 2264175 - DNA, 15 bp, Homo sapiens
gcgaccgccccctcc

SEQ ID NO: 2264176 - DNA, 22 bp, Homo sapiens
gcgaccttcctcatccacccca

SEQ ID NO: 2264177 - DNA, 13 bp, Homo sapiens
gcgaggtgtaaag

SEQ ID NO: 2264178 - DNA, 14 bp, Homo sapiens
gcgaggtgtaaagt

SEQ ID NO: 2264179 - DNA, 22 bp, Homo sapiens
gcgcccttaactgcatccagcc

SEQ ID NO: 2264180 - DNA, 16 bp, Homo sapiens
gcgcctccctccaccc

SEQ ID NO: 2264181 - DNA, 21 bp, Homo sapiens
gcgcctccctccaccccagga

SEQ ID NO: 2264182 - DNA, 22 bp, Homo sapiens
gcgcctccctccaccccaggac

SEQ ID NO: 2264183 - DNA, 21 bp, Homo sapiens
gcgcctcgccggatctgaggg

SEQ ID NO: 2264184 - DNA, 22 bp, Homo sapiens
gcgctggacgatagcttggagg

SEQ ID NO: 2264185 - DNA, 18 bp, Homo sapiens
gcggagaccctgagtccg

SEQ ID NO: 2264186 - DNA, 13 bp, Homo sapiens
gcggagagagcca

SEQ ID NO: 2264187 - DNA, 22 bp, Homo sapiens
gcggcctcgtgccatgatctgt

SEQ ID NO: 2264188 - DNA, 18 bp, Homo sapiens
gcgggatcctccacagag

SEQ ID NO: 2264189 - DNA, 17 bp, Homo sapiens
gcgggctccctggcagg

SEQ ID NO: 2264190 - DNA, 18 bp, Homo sapiens
gcgggctccctggcagga

SEQ ID NO: 2264191 - DNA, 23 bp, Homo sapiens
gcggttatgaaattcaccccctt

SEQ ID NO: 2264192 - DNA, 15 bp, Homo sapiens
gcgtaatttaatggg

SEQ ID NO: 2264193 - DNA, 15 bp, Homo sapiens
gcgtgggggaaagga

SEQ ID NO: 2264194 - DNA, 20 bp, Homo sapiens
gcgtttttttacaacattca

SEQ ID NO: 2264195 - DNA, 19 bp, Homo sapiens
gctaaataaaatttgttgc

SEQ ID NO: 2264196 - DNA, 13 bp, Homo sapiens
gctaaatatttac

SEQ ID NO: 2264197 - DNA, 16 bp, Homo sapiens
gctaataagtttgaaa

SEQ ID NO: 2264198 - DNA, 19 bp, Homo sapiens
gctaataagtttgaaatat

SEQ ID NO: 2264199 - DNA, 19 bp, Homo sapiens
gctaccctttttctccagc

SEQ ID NO: 2264200 - DNA, 22 bp, Homo sapiens
gctaccctttttctccagctgg

SEQ ID NO: 2264201 - DNA, 18 bp, Homo sapiens
gctactgtaattttatat

SEQ ID NO: 2264202 - DNA, 13 bp, Homo sapiens
gctagatttctac

SEQ ID NO: 2264203 - DNA, 16 bp, Homo sapiens
gctataagttttagaa

SEQ ID NO: 2264204 - DNA, 13 bp, Homo sapiens
gctatccttggct

SEQ ID NO: 2264205 - DNA, 14 bp, Homo sapiens
gctatttgtcatct

SEQ ID NO: 2264206 - DNA, 15 bp, Homo sapiens
gctcaagcagcgacc

SEQ ID NO: 2264207 - DNA, 17 bp, Homo sapiens
gctcaatggactggaag

SEQ ID NO: 2264208 - DNA, 13 bp, Homo sapiens
gctcactgttgtg

SEQ ID NO: 2264209 - DNA, 20 bp, Homo sapiens
gctcagcccgcttggccacc

SEQ ID NO: 2264210 - DNA, 13 bp, Homo sapiens
gctcaggtgcaag

SEQ ID NO: 2264211 - DNA, 22 bp, Homo sapiens
gctcagtaaacgggaacatgcc

SEQ ID NO: 2264212 - DNA, 13 bp, Homo sapiens
gctccaccctccc

SEQ ID NO: 2264213 - DNA, 21 bp, Homo sapiens
gctccaccctcccccagacac

SEQ ID NO: 2264214 - DNA, 15 bp, Homo sapiens
gctccaggtggctct

SEQ ID NO: 2264215 - DNA, 16 bp, Homo sapiens
gctccaggtggctctg

SEQ ID NO: 2264216 - DNA, 18 bp, Homo sapiens
gctccaggtggctctgag

SEQ ID NO: 2264217 - DNA, 19 bp, Homo sapiens
gctcccctaaagcctcaaa

SEQ ID NO: 2264218 - DNA, 13 bp, Homo sapiens
gctcccctgagga

SEQ ID NO: 2264219 - DNA, 18 bp, Homo sapiens
gctccctggcaggatgct

SEQ ID NO: 2264220 - DNA, 19 bp, Homo sapiens
gctccctggcaggatgctg

SEQ ID NO: 2264221 - DNA, 13 bp, Homo sapiens
gctccttcccatc

SEQ ID NO: 2264222 - DNA, 16 bp, Homo sapiens
gctcgcccacaaactg

SEQ ID NO: 2264223 - DNA, 18 bp, Homo sapiens
gctcgccgtgtctcagcc

SEQ ID NO: 2264224 - DNA, 21 bp, Homo sapiens
gtactgaagccaaatgaaact

SEQ ID NO: 2264225 - DNA, 14 bp, Homo sapiens
gtactgtagcaggg

SEQ ID NO: 2264226 - DNA, 17 bp, Homo sapiens
gtactgttctgtgtctt

SEQ ID NO: 2264227 - DNA, 21 bp, Homo sapiens
gtacttggagtattggggtct

SEQ ID NO: 2264228 - DNA, 17 bp, Homo sapiens
gtacttttcattctctt

SEQ ID NO: 2264229 - DNA, 18 bp, Homo sapiens
gtacttttcattctcttt

SEQ ID NO: 2264230 - DNA, 21 bp, Homo sapiens
gtacttttcattctcttttaa

SEQ ID NO: 2264231 - DNA, 23 bp, Homo sapiens
gtactttttagtaatttcttttt

SEQ ID NO: 2264232 - DNA, 20 bp, Homo sapiens
gtacttttttaaatattttc

SEQ ID NO: 2264233 - DNA, 13 bp, Homo sapiens
gtagacacttact

SEQ ID NO: 2264234 - DNA, 22 bp, Homo sapiens
gtagcagtgagtcatatcttaa

SEQ ID NO: 2264235 - DNA, 18 bp, Homo sapiens
gtagccccctggcctctg

SEQ ID NO: 2264236 - DNA, 21 bp, Homo sapiens
gtagcctcaatcgagtgagac

SEQ ID NO: 2264237 - DNA, 22 bp, Homo sapiens
gtagcctcaatcgagtgagaca

SEQ ID NO: 2264238 - DNA, 14 bp, Homo sapiens
gtaggacggagatg

SEQ ID NO: 2264239 - DNA, 22 bp, Homo sapiens
gtaggagctgccttggctcaga

SEQ ID NO: 2264240 - DNA, 23 bp, Homo sapiens
gtaggagctgccttggctcagac

SEQ ID NO: 2264241 - DNA, 18 bp, Homo sapiens
gtataaaatacatagtga

SEQ ID NO: 2264242 - DNA, 13 bp, Homo sapiens
gtataatataaaa

SEQ ID NO: 2264243 - DNA, 14 bp, Homo sapiens
gtataatctattta

SEQ ID NO: 2264244 - DNA, 18 bp, Homo sapiens
gtataatcttgtagacac

SEQ ID NO: 2264245 - DNA, 22 bp, Homo sapiens
gtataatcttgtagacacttac

SEQ ID NO: 2264246 - DNA, 15 bp, Homo sapiens
gtatattacaatgat

SEQ ID NO: 2264247 - DNA, 23 bp, Homo sapiens
gtatatttgtgatagcactttct

SEQ ID NO: 2264248 - DNA, 14 bp, Homo sapiens
gtatattttgttac

SEQ ID NO: 2264249 - DNA, 15 bp, Homo sapiens
gtatcaaaattacat

SEQ ID NO: 2264250 - DNA, 13 bp, Homo sapiens
gtatcaaatacat

SEQ ID NO: 2264251 - DNA, 19 bp, Homo sapiens
gtatcaaatacatttaaaa

SEQ ID NO: 2264252 - DNA, 16 bp, Homo sapiens
gtatcaagacgtttaa

SEQ ID NO: 2264253 - DNA, 18 bp, Homo sapiens
gtatctaagaataataaa

SEQ ID NO: 2264254 - DNA, 14 bp, Homo sapiens
gtatgctggccagc

SEQ ID NO: 2264255 - DNA, 15 bp, Homo sapiens
gtatgctggccagca

SEQ ID NO: 2264256 - DNA, 19 bp, Homo sapiens
gtatgctggccagcaccct

SEQ ID NO: 2264257 - DNA, 20 bp, Homo sapiens
gtatgctggccagcaccctc

SEQ ID NO: 2264258 - DNA, 14 bp, Homo sapiens
gtatgttgtacaat

SEQ ID NO: 2264259 - DNA, 18 bp, Homo sapiens
gtatgttgtacaatcaaa

SEQ ID NO: 2264260 - DNA, 19 bp, Homo sapiens
gtattaagggcattttaaa

SEQ ID NO: 2264261 - DNA, 14 bp, Homo sapiens
gtattaataaaaag

SEQ ID NO: 2264262 - DNA, 16 bp, Homo sapiens
gtattatcaaagggat

SEQ ID NO: 2264263 - DNA, 22 bp, Homo sapiens
gtattatcaaagggataaagaa

SEQ ID NO: 2264264 - DNA, 16 bp, Homo sapiens
gtattcttctcttcct

SEQ ID NO: 2264265 - DNA, 23 bp, Homo sapiens
gtattgtgttttgctttggaaac

SEQ ID NO: 2264266 - DNA, 21 bp, Homo sapiens
gtatttactttttatttgcaa

SEQ ID NO: 2264267 - DNA, 15 bp, Homo sapiens
gtatttttactatta

SEQ ID NO: 2264268 - DNA, 21 bp, Homo sapiens
gtcaagaatagcattgtaaaa

SEQ ID NO: 2264269 - DNA, 16 bp, Homo sapiens
gtcaccagagacttta

SEQ ID NO: 2264270 - DNA, 19 bp, Homo sapiens
gtcactcattgctgagcct

SEQ ID NO: 2264271 - DNA, 20 bp, Homo sapiens
gtcactcattgctgagcctc

SEQ ID NO: 2264272 - DNA, 22 bp, Homo sapiens
gtcacttttccttttcttaaaa

SEQ ID NO: 2264273 - DNA, 12 bp, Homo sapiens
gtcagccagccg

SEQ ID NO: 2264274 - DNA, 21 bp, Homo sapiens
gtcagccagccgccctgggct

SEQ ID NO: 2264275 - DNA, 15 bp, Homo sapiens
gtcagcctcagagca

SEQ ID NO: 2264276 - DNA, 17 bp, Homo sapiens
gtcatagtcttgaaatg

SEQ ID NO: 2264277 - DNA, 18 bp, Homo sapiens
gtcatcggaggctgggcc

SEQ ID NO: 2264278 - DNA, 14 bp, Homo sapiens
gtcatctctctggg

SEQ ID NO: 2264279 - DNA, 23 bp, Homo sapiens
gtcatctctctggggccctgggc

SEQ ID NO: 2264280 - DNA, 19 bp, Homo sapiens
gtccaaagaggctgcccct

SEQ ID NO: 2264281 - DNA, 17 bp, Homo sapiens
gtccaattgtgtagacg

SEQ ID NO: 2264282 - DNA, 15 bp, Homo sapiens
gtcccacccccaccc

SEQ ID NO: 2264283 - DNA, 21 bp, Homo sapiens
gtcccacccccacccccagct

SEQ ID NO: 2264284 - DNA, 18 bp, Homo sapiens
gtcccaccgggagcctcc

SEQ ID NO: 2264285 - DNA, 19 bp, Homo sapiens
gtcccaccgggagcctccc

SEQ ID NO: 2264286 - DNA, 16 bp, Homo sapiens
gtcccctcactctgtc

SEQ ID NO: 2264287 - DNA, 22 bp, Homo sapiens
gtccgctgggtggtaccctctg

SEQ ID NO: 2264288 - DNA, 15 bp, Homo sapiens
gtcctcccctatttt

SEQ ID NO: 2264289 - DNA, 22 bp, Homo sapiens
gtcctccctgatcccaccccct

SEQ ID NO: 2264290 - DNA, 17 bp, Homo sapiens
gtcctctccccagcctg

SEQ ID NO: 2264291 - DNA, 20 bp, Homo sapiens
gtcctctccccagcctggca

SEQ ID NO: 2264292 - DNA, 21 bp, Homo sapiens
gtcctctccccagcctggcac

SEQ ID NO: 2264293 - DNA, 16 bp, Homo sapiens
gtcctctcgagcccag

SEQ ID NO: 2264294 - DNA, 13 bp, Homo sapiens
gtcctgcccatgt

SEQ ID NO: 2264295 - DNA, 14 bp, Homo sapiens
gtcctgcccatgtg

SEQ ID NO: 2264296 - DNA, 16 bp, Homo sapiens
gtcctgcccatgtgtc

SEQ ID NO: 2264297 - DNA, 13 bp, Homo sapiens
gtcctggaggggc

SEQ ID NO: 2264298 - DNA, 17 bp, Homo sapiens
gtccttagaacatttta

SEQ ID NO: 2264299 - DNA, 18 bp, Homo sapiens
gtccttaggcctctgaga

SEQ ID NO: 2264300 - DNA, 16 bp, Homo sapiens
gtcgccccaggccctc

SEQ ID NO: 2264301 - DNA, 23 bp, Homo sapiens
gtcgttaaaaacagatttggaaa

SEQ ID NO: 2264302 - DNA, 21 bp, Homo sapiens
gtctacgggggcacttggagg

SEQ ID NO: 2264303 - DNA, 16 bp, Homo sapiens
gtctatgattgtactt

SEQ ID NO: 2264304 - DNA, 15 bp, Homo sapiens
gtctcagcctctgcc

SEQ ID NO: 2264305 - DNA, 14 bp, Homo sapiens
gtctccacttgtat

SEQ ID NO: 2264306 - DNA, 12 bp, Homo sapiens
gtctctgcaaac

SEQ ID NO: 2264307 - DNA, 16 bp, Homo sapiens
gtctcttgtattaaac

SEQ ID NO: 2264308 - DNA, 15 bp, Homo sapiens
gtctgcctgtcccca

SEQ ID NO: 2264309 - DNA, 18 bp, Homo sapiens
gtctgtacctcaaatgaa

SEQ ID NO: 2264310 - DNA, 20 bp, Homo sapiens
gtctgtcaccagctatctgt

SEQ ID NO: 2264311 - DNA, 19 bp, Homo sapiens
gtctgttgattaaagatga

SEQ ID NO: 2264312 - DNA, 13 bp, Homo sapiens
gtcttaattatta

SEQ ID NO: 2264313 - DNA, 18 bp, Homo sapiens
gtcttaattattatttgt

SEQ ID NO: 2264314 - DNA, 21 bp, Homo sapiens
gtcttaattattatttgtgtt

SEQ ID NO: 2264315 - DNA, 14 bp, Homo sapiens
gtcttgaaatgaaa

SEQ ID NO: 2264316 - DNA, 18 bp, Homo sapiens
gtcttgaaatgaaaggga

SEQ ID NO: 2264317 - DNA, 19 bp, Homo sapiens
gtctttaaaaactgtttta

SEQ ID NO: 2264318 - DNA, 21 bp, Homo sapiens
gtctttccaaattatttctta

SEQ ID NO: 2264319 - DNA, 17 bp, Homo sapiens
gtctttccactttcatc

SEQ ID NO: 2264320 - DNA, 19 bp, Homo sapiens
gtctttctaagaaatcaag

SEQ ID NO: 2264321 - DNA, 11 bp, Homo sapiens
gtctttctctc

SEQ ID NO: 2264322 - DNA, 22 bp, Homo sapiens
gtctttggagaaatgcttagaa

SEQ ID NO: 2264323 - DNA, 13 bp, Homo sapiens
gtcttttaaaatg

SEQ ID NO: 2264324 - DNA, 16 bp, Homo sapiens
gtcttttctgctgagg

SEQ ID NO: 2264325 - DNA, 16 bp, Homo sapiens
gtcttttggttatgaa

SEQ ID NO: 2264326 - DNA, 19 bp, Homo sapiens
gtgaaaaactgctgtaaac

SEQ ID NO: 2264327 - DNA, 16 bp, Homo sapiens
gtgacaggaaagccct

SEQ ID NO: 2264328 - DNA, 12 bp, Homo sapiens
gtgactgtccca

SEQ ID NO: 2264329 - DNA, 13 bp, Homo sapiens
gtgactgtcccac

SEQ ID NO: 2264330 - DNA, 14 bp, Homo sapiens
gtgagcacagccta

SEQ ID NO: 2264331 - DNA, 15 bp, Homo sapiens
gtgagggtcccatgt

SEQ ID NO: 2264332 - DNA, 14 bp, Homo sapiens
tacgttatatattg

SEQ ID NO: 2264333 - DNA, 12 bp, Homo sapiens
tactactttgtt

SEQ ID NO: 2264334 - DNA, 19 bp, Homo sapiens
tactactttgttaggattt

SEQ ID NO: 2264335 - DNA, 22 bp, Homo sapiens
tactactttgttaggattttca

SEQ ID NO: 2264336 - DNA, 16 bp, Homo sapiens
tactaggtaacttcat

SEQ ID NO: 2264337 - DNA, 23 bp, Homo sapiens
tactcacagcacttgttttcagg

SEQ ID NO: 2264338 - DNA, 13 bp, Homo sapiens
tactgaagccaaa

SEQ ID NO: 2264339 - DNA, 14 bp, Homo sapiens
tactgcaagaaaat

SEQ ID NO: 2264340 - DNA, 21 bp, Homo sapiens
tactggctctttattcattaa

SEQ ID NO: 2264341 - DNA, 20 bp, Homo sapiens
tactgtaattttatatgaag

SEQ ID NO: 2264342 - DNA, 17 bp, Homo sapiens
tactgttctgtgtcttt

SEQ ID NO: 2264343 - DNA, 13 bp, Homo sapiens
tacttatacacct

SEQ ID NO: 2264344 - DNA, 16 bp, Homo sapiens
tacttgaactttccaa

SEQ ID NO: 2264345 - DNA, 12 bp, Homo sapiens
tacttgttctgt

SEQ ID NO: 2264346 - DNA, 14 bp, Homo sapiens
tacttgtttcagct

SEQ ID NO: 2264347 - DNA, 17 bp, Homo sapiens
tactttcttcaggtaaa

SEQ ID NO: 2264348 - DNA, 21 bp, Homo sapiens
tacttttcctgggtttcctgc

SEQ ID NO: 2264349 - DNA, 19 bp, Homo sapiens
tactttttagtaatttctt

SEQ ID NO: 2264350 - DNA, 13 bp, Homo sapiens
tacttttttaaat

SEQ ID NO: 2264351 - DNA, 15 bp, Homo sapiens
tagaaagaccaggcc

SEQ ID NO: 2264352 - DNA, 20 bp, Homo sapiens
tagaaaggaactgcaataat

SEQ ID NO: 2264353 - DNA, 14 bp, Homo sapiens
tagaactagccaaa

SEQ ID NO: 2264354 - DNA, 19 bp, Homo sapiens
tagaactttaagcaacaag

SEQ ID NO: 2264355 - DNA, 22 bp, Homo sapiens
tagaataggcagggggccctgc

SEQ ID NO: 2264356 - DNA, 16 bp, Homo sapiens
tagaatcaatttaagt

SEQ ID NO: 2264357 - DNA, 15 bp, Homo sapiens
tagaatccaaacttg

SEQ ID NO: 2264358 - DNA, 13 bp, Homo sapiens
tagaatcttttaa

SEQ ID NO: 2264359 - DNA, 14 bp, Homo sapiens
tagaatcttttaaa

SEQ ID NO: 2264360 - DNA, 17 bp, Homo sapiens
tagagaactaaactagt

SEQ ID NO: 2264361 - DNA, 20 bp, Homo sapiens
tagagagcatctgcaacaaa

SEQ ID NO: 2264362 - DNA, 17 bp, Homo sapiens
tagagatatttttgtac

SEQ ID NO: 2264363 - DNA, 16 bp, Homo sapiens
tagatactactttctc

SEQ ID NO: 2264364 - DNA, 20 bp, Homo sapiens
tagatgcacgtggggcccac

SEQ ID NO: 2264365 - DNA, 11 bp, Homo sapiens
tagcaaagatt

SEQ ID NO: 2264366 - DNA, 21 bp, Homo sapiens
tagcaataaataacacttgtc

SEQ ID NO: 2264367 - DNA, 21 bp, Homo sapiens
tagcaattcatgggctgtgtg

SEQ ID NO: 2264368 - DNA, 17 bp, Homo sapiens
tagcagagtctgtctct

SEQ ID NO: 2264369 - DNA, 20 bp, Homo sapiens
tagcagcagcctttaatgca

SEQ ID NO: 2264370 - DNA, 15 bp, Homo sapiens
tagcagcaggctcag

SEQ ID NO: 2264371 - DNA, 17 bp, Homo sapiens
tagcagcaggctcaggc

SEQ ID NO: 2264372 - DNA, 22 bp, Homo sapiens
tagcaggggaattccctccccc

SEQ ID NO: 2264373 - DNA, 17 bp, Homo sapiens
tagcagtgagtcatatc

SEQ ID NO: 2264374 - DNA, 15 bp, Homo sapiens
tagcattaataaaac

SEQ ID NO: 2264375 - DNA, 16 bp, Homo sapiens
tagcattaataaaact

SEQ ID NO: 2264376 - DNA, 18 bp, Homo sapiens
tagcattgtaaaagcatt

SEQ ID NO: 2264377 - DNA, 18 bp, Homo sapiens
tagccccctggcctctgt

SEQ ID NO: 2264378 - DNA, 20 bp, Homo sapiens
tagcgaaccctttatttgaa

SEQ ID NO: 2264379 - DNA, 19 bp, Homo sapiens
tagctaataacatgtgaaa

SEQ ID NO: 2264380 - DNA, 14 bp, Homo sapiens
tagctgtgggggtg

SEQ ID NO: 2264381 - DNA, 18 bp, Homo sapiens
taggaattgaattaataa

SEQ ID NO: 2264382 - DNA, 22 bp, Homo sapiens
taggaattgaattaataataaa

SEQ ID NO: 2264383 - DNA, 18 bp, Homo sapiens
taggagctgccttggctc

SEQ ID NO: 2264384 - DNA, 16 bp, Homo sapiens
taggagggagttatct

SEQ ID NO: 2264385 - DNA, 18 bp, Homo sapiens
taggagggagttatctaa

SEQ ID NO: 2264386 - DNA, 22 bp, Homo sapiens
taggattttcacattcttggct

SEQ ID NO: 2264387 - DNA, 21 bp, Homo sapiens
taggccttcctctctccagat

SEQ ID NO: 2264388 - DNA, 20 bp, Homo sapiens
tagggaagaaaactatcctg

SEQ ID NO: 2264389 - DNA, 13 bp, Homo sapiens
taggtaacttcat

SEQ ID NO: 2264390 - DNA, 16 bp, Homo sapiens
taggtagcaacaacag

SEQ ID NO: 2264391 - DNA, 20 bp, Homo sapiens
taggtggctctgggaatggg

SEQ ID NO: 2264392 - DNA, 22 bp, Homo sapiens
taggttattttgatgtaaagat

SEQ ID NO: 2264393 - DNA, 23 bp, Homo sapiens
tagtaagttaatgtatataaaaa

SEQ ID NO: 2264394 - DNA, 14 bp, Homo sapiens
tagtaatagcctgg

SEQ ID NO: 2264395 - DNA, 14 bp, Homo sapiens
tagtaatttctttt

SEQ ID NO: 2264396 - DNA, 18 bp, Homo sapiens
tagtaccatttatacaaa

SEQ ID NO: 2264397 - DNA, 20 bp, Homo sapiens
tagtactgaagccaaatgaa

SEQ ID NO: 2264398 - DNA, 19 bp, Homo sapiens
tagtcaaaactatttttgt

SEQ ID NO: 2264399 - DNA, 14 bp, Homo sapiens
tagtcaatcactgc

SEQ ID NO: 2264400 - DNA, 15 bp, Homo sapiens
tagtcaccagagact

SEQ ID NO: 2264401 - DNA, 18 bp, Homo sapiens
tagtcaccagagacttta

SEQ ID NO: 2264402 - DNA, 21 bp, Homo sapiens
tagtcttgaaatgaaagggaa

SEQ ID NO: 2264403 - DNA, 15 bp, Homo sapiens
tagtctttggagaaa

SEQ ID NO: 2264404 - DNA, 17 bp, Homo sapiens
tagtgtattatcactgt

SEQ ID NO: 2264405 - DNA, 11 bp, Homo sapiens
tagttactgtg

SEQ ID NO: 2264406 - DNA, 15 bp, Homo sapiens
tagttccactgagac

SEQ ID NO: 2264407 - DNA, 18 bp, Homo sapiens
tagttctgagctgccagt

SEQ ID NO: 2264408 - DNA, 12 bp, Homo sapiens
tagttgaaatga

SEQ ID NO: 2264409 - DNA, 12 bp, Homo sapiens
tataaaacttct

SEQ ID NO: 2264410 - DNA, 21 bp, Homo sapiens
tataaataaaatcatgtagtt

SEQ ID NO: 2264411 - DNA, 17 bp, Homo sapiens
tataaccagctgaagtt

SEQ ID NO: 2264412 - DNA, 12 bp, Homo sapiens
tataataaatat

SEQ ID NO: 2264413 - DNA, 13 bp, Homo sapiens
tataatataaaaa

SEQ ID NO: 2264414 - DNA, 22 bp, Homo sapiens
tataatataaaaaattttaaaa

SEQ ID NO: 2264415 - DNA, 22 bp, Homo sapiens
tataatccttgataatatattg

SEQ ID NO: 2264416 - DNA, 13 bp, Homo sapiens
tataatctattta

SEQ ID NO: 2264417 - DNA, 16 bp, Homo sapiens
tataatcttgtagaca

SEQ ID NO: 2264418 - DNA, 22 bp, Homo sapiens
tataatcttgtagacacttact

SEQ ID NO: 2264419 - DNA, 13 bp, Homo sapiens
tatacaaattaga

SEQ ID NO: 2264420 - DNA, 14 bp, Homo sapiens
tatacaaattagaa

SEQ ID NO: 2264421 - DNA, 16 bp, Homo sapiens
tatacaaattagaaaa

SEQ ID NO: 2264422 - DNA, 17 bp, Homo sapiens
tatacaaattagaaaat

SEQ ID NO: 2264423 - DNA, 18 bp, Homo sapiens
tatacacaagcaatgcaa

SEQ ID NO: 2264424 - DNA, 19 bp, Homo sapiens
tatacacaagcaatgcaag

SEQ ID NO: 2264425 - DNA, 18 bp, Homo sapiens
tatacagttataaaatta

SEQ ID NO: 2264426 - DNA, 19 bp, Homo sapiens
tatactatttatatacaag

SEQ ID NO: 2264427 - DNA, 22 bp, Homo sapiens
tatactggaacccttttaaagt

SEQ ID NO: 2264428 - DNA, 21 bp, Homo sapiens
tatagagatatttttgtacgt

SEQ ID NO: 2264429 - DNA, 18 bp, Homo sapiens
tatagcattaataaaact

SEQ ID NO: 2264430 - DNA, 16 bp, Homo sapiens
tatagttatacatcaa

SEQ ID NO: 2264431 - DNA, 15 bp, Homo sapiens
tatataaaaatggct

SEQ ID NO: 2264432 - DNA, 13 bp, Homo sapiens
tatataaaataac

SEQ ID NO: 2264433 - DNA, 19 bp, Homo sapiens
tatataaagtattcttttt

SEQ ID NO: 2264434 - DNA, 20 bp, Homo sapiens
tatatacagggtattaagaa

SEQ ID NO: 2264435 - DNA, 21 bp, Homo sapiens
tatatagcatctggaagatca

SEQ ID NO: 2264436 - DNA, 20 bp, Homo sapiens
tatatataatcatcaagtaa

SEQ ID NO: 2264437 - DNA, 21 bp, Homo sapiens
tatatatgcacttaatttgtt

SEQ ID NO: 2264438 - DNA, 15 bp, Homo sapiens
tatatatggatcaga

SEQ ID NO: 2264439 - DNA, 19 bp, Homo sapiens
tatatctatctatttgagg

SEQ ID NO: 2264440 - DNA, 13 bp, Homo sapiens
tctctccttggcc

SEQ ID NO: 2264441 - DNA, 14 bp, Homo sapiens
tctctccttggcca

SEQ ID NO: 2264442 - DNA, 17 bp, Homo sapiens
tctctccttggccacag

SEQ ID NO: 2264443 - DNA, 22 bp, Homo sapiens
tctctgagttctgtgtattttc

SEQ ID NO: 2264444 - DNA, 16 bp, Homo sapiens
tctctgctagatttct

SEQ ID NO: 2264445 - DNA, 20 bp, Homo sapiens
tctctggaagcccctgggcc

SEQ ID NO: 2264446 - DNA, 14 bp, Homo sapiens
tctctggggccctg

SEQ ID NO: 2264447 - DNA, 18 bp, Homo sapiens
tctctggggccctgggcc

SEQ ID NO: 2264448 - DNA, 22 bp, Homo sapiens
tctctggggccctgggcctcag

SEQ ID NO: 2264449 - DNA, 23 bp, Homo sapiens
tctctggggccctgggcctcagt

SEQ ID NO: 2264450 - DNA, 22 bp, Homo sapiens
tctctgtataatctatttacat

SEQ ID NO: 2264451 - DNA, 21 bp, Homo sapiens
tctctgtgaagcctctctcct

SEQ ID NO: 2264452 - DNA, 10 bp, Homo sapiens
tctctgtgtt

SEQ ID NO: 2264453 - DNA, 18 bp, Homo sapiens
tctcttttcattgtgtat

SEQ ID NO: 2264454 - DNA, 24 bp, Homo sapiens
tctcttttcattgtgtatcagttt

SEQ ID NO: 2264455 - DNA, 18 bp, Homo sapiens
tctgaaatgttacaaaaa

SEQ ID NO: 2264456 - DNA, 22 bp, Homo sapiens
tctgaaatgttacaaaaataaa

SEQ ID NO: 2264457 - DNA, 21 bp, Homo sapiens
tctgacagccctgcggagacc

SEQ ID NO: 2264458 - DNA, 18 bp, Homo sapiens
tctgacagtccacagggg

SEQ ID NO: 2264459 - DNA, 18 bp, Homo sapiens
tctgacctgcactgggga

SEQ ID NO: 2264460 - DNA, 24 bp, Homo sapiens
tctgagaagctctgaagaactctc

SEQ ID NO: 2264461 - DNA, 17 bp, Homo sapiens
tctgaggacaagagaaa

SEQ ID NO: 2264462 - DNA, 13 bp, Homo sapiens
tctgagtgaacct

SEQ ID NO: 2264463 - DNA, 19 bp, Homo sapiens
tctgagttctgtgtatttt

SEQ ID NO: 2264464 - DNA, 20 bp, Homo sapiens
tctgcaaaaatatttataaa

SEQ ID NO: 2264465 - DNA, 22 bp, Homo sapiens
tctgcagctatgcgcaatgtgg

SEQ ID NO: 2264466 - DNA, 20 bp, Homo sapiens
tctgcagttctttttgtaca

SEQ ID NO: 2264467 - DNA, 21 bp, Homo sapiens
tctgccatggccttggcaggc

SEQ ID NO: 2264468 - DNA, 13 bp, Homo sapiens
tctgccccctccc

SEQ ID NO: 2264469 - DNA, 16 bp, Homo sapiens
tctgccccctccccca

SEQ ID NO: 2264470 - DNA, 23 bp, Homo sapiens
tctgcctgtccccaaacaggaca

SEQ ID NO: 2264471 - DNA, 15 bp, Homo sapiens
tctgccttagtctca

SEQ ID NO: 2264472 - DNA, 21 bp, Homo sapiens
tctgctagatttctacattaa

SEQ ID NO: 2264473 - DNA, 16 bp, Homo sapiens
tctgcttcccttgcct

SEQ ID NO: 2264474 - DNA, 22 bp, Homo sapiens
tctgcttttatctcagatgtta

SEQ ID NO: 2264475 - DNA, 17 bp, Homo sapiens
tctggaagcccctgggc

SEQ ID NO: 2264476 - DNA, 18 bp, Homo sapiens
tctggaagcccctgggcc

SEQ ID NO: 2264477 - DNA, 19 bp, Homo sapiens
tctggagaccagggagcct

SEQ ID NO: 2264478 - DNA, 18 bp, Homo sapiens
tctggcattagaattatt

SEQ ID NO: 2264479 - DNA, 21 bp, Homo sapiens
tctgggcaccacaaaatatac

SEQ ID NO: 2264480 - DNA, 14 bp, Homo sapiens
tctgggctgtgggc

SEQ ID NO: 2264481 - DNA, 17 bp, Homo sapiens
tctggggcaggctgggc

SEQ ID NO: 2264482 - DNA, 16 bp, Homo sapiens
tctggggccctgggcc

SEQ ID NO: 2264483 - DNA, 17 bp, Homo sapiens
tctggtaaagttacact

SEQ ID NO: 2264484 - DNA, 19 bp, Homo sapiens
tctggtaaagttacacttt

SEQ ID NO: 2264485 - DNA, 17 bp, Homo sapiens
tctgtacctcaaatgaa

SEQ ID NO: 2264486 - DNA, 14 bp, Homo sapiens
tctgtacttttcat

SEQ ID NO: 2264487 - DNA, 14 bp, Homo sapiens
tctgtataatctat

SEQ ID NO: 2264488 - DNA, 22 bp, Homo sapiens
tctgtcacagtaaaaataaaat

SEQ ID NO: 2264489 - DNA, 20 bp, Homo sapiens
tctgtcaccagctatctgtc

SEQ ID NO: 2264490 - DNA, 13 bp, Homo sapiens
tctgtcagccagc

SEQ ID NO: 2264491 - DNA, 19 bp, Homo sapiens
tctgtgagaaggtttattg

SEQ ID NO: 2264492 - DNA, 20 bp, Homo sapiens
tctgtgagaaggtttattgt

SEQ ID NO: 2264493 - DNA, 18 bp, Homo sapiens
tctgtgccttcttttgat

SEQ ID NO: 2264494 - DNA, 14 bp, Homo sapiens
tctgtgtctttctc

SEQ ID NO: 2264495 - DNA, 14 bp, Homo sapiens
tctgtttagaacac

SEQ ID NO: 2264496 - DNA, 19 bp, Homo sapiens
tctgtttttaatgctattt

SEQ ID NO: 2264497 - DNA, 18 bp, Homo sapiens
tcttaaagtattcttctc

SEQ ID NO: 2264498 - DNA, 17 bp, Homo sapiens
tcttaattattataaaa

SEQ ID NO: 2264499 - DNA, 13 bp, Homo sapiens
tcttactctgccg

SEQ ID NO: 2264500 - DNA, 21 bp, Homo sapiens
tcttagaacagtggaaactat

SEQ ID NO: 2264501 - DNA, 14 bp, Homo sapiens
tcttcaaatgggag

SEQ ID NO: 2264502 - DNA, 13 bp, Homo sapiens
tcttcacaaaatc

SEQ ID NO: 2264503 - DNA, 17 bp, Homo sapiens
tcttcattcaaactgca

SEQ ID NO: 2264504 - DNA, 13 bp, Homo sapiens
tcttcccacagga

SEQ ID NO: 2264505 - DNA, 18 bp, Homo sapiens
tcttctggctcaaaaaga

SEQ ID NO: 2264506 - DNA, 18 bp, Homo sapiens
tcttctggggcaggctgg

SEQ ID NO: 2264507 - DNA, 19 bp, Homo sapiens
tcttgaaatgaaagggaaa

SEQ ID NO: 2264508 - DNA, 20 bp, Homo sapiens
tcttgaaatgaaagggaaac

SEQ ID NO: 2264509 - DNA, 20 bp, Homo sapiens
tcttgatacccccctctgtc

SEQ ID NO: 2264510 - DNA, 21 bp, Homo sapiens
tcttgatacccccctctgtct

SEQ ID NO: 2264511 - DNA, 22 bp, Homo sapiens
tcttgatacccccctctgtctt

SEQ ID NO: 2264512 - DNA, 19 bp, Homo sapiens
tcttggcttaatcattttc

SEQ ID NO: 2264513 - DNA, 20 bp, Homo sapiens
tcttggcttaatcattttca

SEQ ID NO: 2264514 - DNA, 21 bp, Homo sapiens
tcttggcttaatcattttcat

SEQ ID NO: 2264515 - DNA, 16 bp, Homo sapiens
tcttgtattaaactct

SEQ ID NO: 2264516 - DNA, 15 bp, Homo sapiens
tcttgtgaaggcagg

SEQ ID NO: 2264517 - DNA, 12 bp, Homo sapiens
tctttaaaaact

SEQ ID NO: 2264518 - DNA, 13 bp, Homo sapiens
tctttaatgcttt

SEQ ID NO: 2264519 - DNA, 18 bp, Homo sapiens
tctttcacagctcctccc

SEQ ID NO: 2264520 - DNA, 19 bp, Homo sapiens
tctttccaaattatttctt

SEQ ID NO: 2264521 - DNA, 20 bp, Homo sapiens
tctttctctctctctcttcc

SEQ ID NO: 2264522 - DNA, 19 bp, Homo sapiens
tctttctttgcaccaaaga

SEQ ID NO: 2264523 - DNA, 18 bp, Homo sapiens
tctttgaaatgacatgtt

SEQ ID NO: 2264524 - DNA, 18 bp, Homo sapiens
tctttgcaccaaagacat

SEQ ID NO: 2264525 - DNA, 14 bp, Homo sapiens
tctttgctgttgtt

SEQ ID NO: 2264526 - DNA, 22 bp, Homo sapiens
tctttggagaaatgcttagaaa

SEQ ID NO: 2264527 - DNA, 18 bp, Homo sapiens
tctttgtaatttaatgaa

SEQ ID NO: 2264528 - DNA, 19 bp, Homo sapiens
tctttgtaatttaatgaaa

SEQ ID NO: 2264529 - DNA, 21 bp, Homo sapiens
tctttgtatataggcttctca

SEQ ID NO: 2264530 - DNA, 14 bp, Homo sapiens
tctttgtgacagga

SEQ ID NO: 2264531 - DNA, 16 bp, Homo sapiens
tctttgtgacaggaaa

SEQ ID NO: 2264532 - DNA, 20 bp, Homo sapiens
tctttgtgacaggaaagccc

SEQ ID NO: 2264533 - DNA, 17 bp, Homo sapiens
tcttttaaattagaaaa

SEQ ID NO: 2264534 - DNA, 19 bp, Homo sapiens
tcttttaaattagaaaata

SEQ ID NO: 2264535 - DNA, 23 bp, Homo sapiens
tcttttactttttttagtaagtt

SEQ ID NO: 2264536 - DNA, 20 bp, Homo sapiens
tcttttggttatgaatactt

SEQ ID NO: 2264537 - DNA, 20 bp, Homo sapiens
tctttttcgtataatcttgt

SEQ ID NO: 2264538 - DNA, 14 bp, Homo sapiens
tctttttgtacact

SEQ ID NO: 2264539 - DNA, 20 bp, Homo sapiens
tgaaaacagtgtgtaaacaa

SEQ ID NO: 2264540 - DNA, 14 bp, Homo sapiens
tgaaaagcaatatt

SEQ ID NO: 2264541 - DNA, 21 bp, Homo sapiens
tgaaaattacagtccaaaata

SEQ ID NO: 2264542 - DNA, 22 bp, Homo sapiens
tgaaaattcatagtaagattga

SEQ ID NO: 2264543 - DNA, 17 bp, Homo sapiens
tgaaaccccaaacagtg

SEQ ID NO: 2264544 - DNA, 11 bp, Homo sapiens
tgaaactctct

SEQ ID NO: 2264545 - DNA, 13 bp, Homo sapiens
tgaaactctctgt

SEQ ID NO: 2264546 - DNA, 22 bp, Homo sapiens
tgaaagacctgaataccactta

SEQ ID NO: 2264547 - DNA, 17 bp, Homo sapiens
tgaaagctggtggcaga

SEQ ID NO: 2264548 - DNA, 14 bp, Homo sapiens
tgaaagggaaactg

SEQ ID NO: 2264549 - DNA, 19 bp, Homo sapiens
tgaaatagttcaaactgca

SEQ ID NO: 2264550 - DNA, 16 bp, Homo sapiens
tgaaatatattatttc

SEQ ID NO: 2264551 - DNA, 21 bp, Homo sapiens
tgaaatgacatgttcctttaa

SEQ ID NO: 2264552 - DNA, 21 bp, Homo sapiens
tgaaatgtcaaattgatgtgc

SEQ ID NO: 2264553 - DNA, 21 bp, Homo sapiens
tgaaatgtgaatttttattgt

SEQ ID NO: 2264554 - DNA, 22 bp, Homo sapiens
tgaaatgttacaaaaataaact

SEQ ID NO: 2264555 - DNA, 23 bp, Homo sapiens
tgaacaagtgggccattagccag

SEQ ID NO: 2264556 - DNA, 14 bp, Homo sapiens
tgaacaatgaagtt

SEQ ID NO: 2264557 - DNA, 12 bp, Homo sapiens
tgaacctgaata

SEQ ID NO: 2264558 - DNA, 18 bp, Homo sapiens
tgaactaggctgagcaat

SEQ ID NO: 2264559 - DNA, 18 bp, Homo sapiens
tgaacttgttacttgcag

SEQ ID NO: 2264560 - DNA, 20 bp, Homo sapiens
tgaacttgttacttgcagca

SEQ ID NO: 2264561 - DNA, 15 bp, Homo sapiens
tgaagccaaatgaaa

SEQ ID NO: 2264562 - DNA, 19 bp, Homo sapiens
tgaagcctctctccttggc

SEQ ID NO: 2264563 - DNA, 13 bp, Homo sapiens
tgaagctttgtag

SEQ ID NO: 2264564 - DNA, 21 bp, Homo sapiens
tgaaggattatggaaaaataa

SEQ ID NO: 2264565 - DNA, 18 bp, Homo sapiens
tgaagggagaagacactg

SEQ ID NO: 2264566 - DNA, 20 bp, Homo sapiens
tgaagtgtataatataaaaa

SEQ ID NO: 2264567 - DNA, 14 bp, Homo sapiens
tgaatataagaaaa

SEQ ID NO: 2264568 - DNA, 16 bp, Homo sapiens
tgaatattgccattat

SEQ ID NO: 2264569 - DNA, 18 bp, Homo sapiens
tgaatattgccattatgc

SEQ ID NO: 2264570 - DNA, 17 bp, Homo sapiens
tgaatcaataatatatt

SEQ ID NO: 2264571 - DNA, 22 bp, Homo sapiens
tgaatcaataatatattttctg

SEQ ID NO: 2264572 - DNA, 16 bp, Homo sapiens
tgaatgacaaagtatg

SEQ ID NO: 2264573 - DNA, 18 bp, Homo sapiens
tgaatgtctcagcgaggt

SEQ ID NO: 2264574 - DNA, 17 bp, Homo sapiens
tgaatgttacaacgaat

SEQ ID NO: 2264575 - DNA, 18 bp, Homo sapiens
tgaattaagcccaattaa

SEQ ID NO: 2264576 - DNA, 19 bp, Homo sapiens
tgaattttataaataaaat

SEQ ID NO: 2264577 - DNA, 17 bp, Homo sapiens
tgacaattctgttttta

SEQ ID NO: 2264578 - DNA, 14 bp, Homo sapiens
tgacaattgggagc

SEQ ID NO: 2264579 - DNA, 17 bp, Homo sapiens
tgacacaagtggacctt

SEQ ID NO: 2264580 - DNA, 14 bp, Homo sapiens
tgacagtccacagg

SEQ ID NO: 2264581 - DNA, 15 bp, Homo sapiens
tgacagtccacaggg

SEQ ID NO: 2264582 - DNA, 18 bp, Homo sapiens
tgacagtccacaggggcc

SEQ ID NO: 2264583 - DNA, 21 bp, Homo sapiens
tgacataagatggttgaccaa

SEQ ID NO: 2264584 - DNA, 14 bp, Homo sapiens
tgacatctggaatc

SEQ ID NO: 2264585 - DNA, 11 bp, Homo sapiens
tgacattgtct

SEQ ID NO: 2264586 - DNA, 15 bp, Homo sapiens
tgaccctgaagtgag

SEQ ID NO: 2264587 - DNA, 17 bp, Homo sapiens
tgacctccgtcctctcc

SEQ ID NO: 2264588 - DNA, 23 bp, Homo sapiens
tgacctccgtcctctccccagcc

SEQ ID NO: 2264589 - DNA, 22 bp, Homo sapiens
tgactaattttacatgtttata

SEQ ID NO: 2264590 - DNA, 19 bp, Homo sapiens
tgactatgtatttttctat

SEQ ID NO: 2264591 - DNA, 13 bp, Homo sapiens
tgactccctgtgg

SEQ ID NO: 2264592 - DNA, 15 bp, Homo sapiens
tgactccctgtgggg

SEQ ID NO: 2264593 - DNA, 23 bp, Homo sapiens
tgactccctgtgggggtggccat

SEQ ID NO: 2264594 - DNA, 22 bp, Homo sapiens
tgactctggcaaagcttttaga

SEQ ID NO: 2264595 - DNA, 22 bp, Homo sapiens
tgactgagggcagctttgcaaa

SEQ ID NO: 2264596 - DNA, 21 bp, Homo sapiens
tgactgtggtagccagcatcg

SEQ ID NO: 2264597 - DNA, 16 bp, Homo sapiens
tgacttgcaaagacct

SEQ ID NO: 2264598 - DNA, 12 bp, Homo sapiens
tgactttataaa

SEQ ID NO: 2264599 - DNA, 14 bp, Homo sapiens
tgactttataaatt

SEQ ID NO: 2264600 - DNA, 15 bp, Homo sapiens
tgactttataaattt

SEQ ID NO: 2264601 - DNA, 13 bp, Homo sapiens
tgactttttataa

SEQ ID NO: 2264602 - DNA, 15 bp, Homo sapiens
tgagacagtcttgct

SEQ ID NO: 2264603 - DNA, 19 bp, Homo sapiens
tgagactttctaaatcaaa

SEQ ID NO: 2264604 - DNA, 19 bp, Homo sapiens
tgagaggctgtctgttgta

SEQ ID NO: 2264605 - DNA, 14 bp, Homo sapiens
tgagagtcaaagct

SEQ ID NO: 2264606 - DNA, 16 bp, Homo sapiens
tgagagtcaaagctga

SEQ ID NO: 2264607 - DNA, 17 bp, Homo sapiens
tgagcacagcctagggc

SEQ ID NO: 2264608 - DNA, 14 bp, Homo sapiens
tgagcacttttcaa

SEQ ID NO: 2264609 - DNA, 15 bp, Homo sapiens
tgagcccctggaggc

SEQ ID NO: 2264610 - DNA, 12 bp, Homo sapiens
tgagcctctgct

SEQ ID NO: 2264611 - DNA, 19 bp, Homo sapiens
tgagctactggattcttat

SEQ ID NO: 2264612 - DNA, 14 bp, Homo sapiens
tgagctgccagtgg

SEQ ID NO: 2264613 - DNA, 22 bp, Homo sapiens
tgagcttgtcttttctgctgag

SEQ ID NO: 2264614 - DNA, 22 bp, Homo sapiens
tgaggacaagagaaaaaagcca

SEQ ID NO: 2264615 - DNA, 19 bp, Homo sapiens
tgaggacgagacccccatc

SEQ ID NO: 2264616 - DNA, 14 bp, Homo sapiens
tgagggtaagtatt

SEQ ID NO: 2264617 - DNA, 14 bp, Homo sapiens
tgaggtgcctgtcc

SEQ ID NO: 2264618 - DNA, 16 bp, Homo sapiens
tgaggtgcctgtccca

SEQ ID NO: 2264619 - DNA, 21 bp, Homo sapiens
tgagtaaaatagattttataa

SEQ ID NO: 2264620 - DNA, 18 bp, Homo sapiens
tgagtcatatcttaatat

SEQ ID NO: 2264621 - DNA, 21 bp, Homo sapiens
tgagtgtacagattttattta

SEQ ID NO: 2264622 - DNA, 18 bp, Homo sapiens
tgatacccccctctgtct

SEQ ID NO: 2264623 - DNA, 18 bp, Homo sapiens
tgatactggaggaacact

SEQ ID NO: 2264624 - DNA, 15 bp, Homo sapiens
tgatagcactttcta

SEQ ID NO: 2264625 - DNA, 21 bp, Homo sapiens
tgatagcactttctacaatgt

SEQ ID NO: 2264626 - DNA, 17 bp, Homo sapiens
tgatagttgaatgttgc

SEQ ID NO: 2264627 - DNA, 14 bp, Homo sapiens
tgatatatttaaaa

SEQ ID NO: 2264628 - DNA, 19 bp, Homo sapiens
tgatatatttaaaaatatt

SEQ ID NO: 2264629 - DNA, 16 bp, Homo sapiens
tgatatctataaaata

SEQ ID NO: 2264630 - DNA, 17 bp, Homo sapiens
tgatcaccgactgaaaa

SEQ ID NO: 2264631 - DNA, 16 bp, Homo sapiens
tgatcccaccccctcc

SEQ ID NO: 2264632 - DNA, 23 bp, Homo sapiens
tgatcccaccccctcctccccca

SEQ ID NO: 2264633 - DNA, 17 bp, Homo sapiens
tgatctgtctgtggcaa

SEQ ID NO: 2264634 - DNA, 19 bp, Homo sapiens
tgatctgtctgtggcaaaa

SEQ ID NO: 2264635 - DNA, 22 bp, Homo sapiens
tgatcttgagaaccttttcaaa

SEQ ID NO: 2264636 - DNA, 14 bp, Homo sapiens
tgatgagattttta

SEQ ID NO: 2264637 - DNA, 16 bp, Homo sapiens
tgatgaggtatttttt

SEQ ID NO: 2264638 - DNA, 15 bp, Homo sapiens
tgatgatgatgaaaa

SEQ ID NO: 2264639 - DNA, 16 bp, Homo sapiens
tgatgatgatgatgaa

SEQ ID NO: 2264640 - DNA, 17 bp, Homo sapiens
tgatggcttatgatagc

SEQ ID NO: 2264641 - DNA, 13 bp, Homo sapiens
tgatgtcatttga

SEQ ID NO: 2264642 - DNA, 19 bp, Homo sapiens
tgattgttcgggtgtgcaa

SEQ ID NO: 2264643 - DNA, 20 bp, Homo sapiens
tgatttaagtgtctcactaa

SEQ ID NO: 2264644 - DNA, 14 bp, Homo sapiens
tgatttccatctct

SEQ ID NO: 2264645 - DNA, 16 bp, Homo sapiens
tgatttccatctctgg

SEQ ID NO: 2264646 - DNA, 19 bp, Homo sapiens
tgatttggtgaccaactgt

SEQ ID NO: 2264647 - DNA, 13 bp, Homo sapiens
tgattttttgcat

SEQ ID NO: 2264648 - DNA, 18 bp, Homo sapiens
tgcaaaaatatttataaa

SEQ ID NO: 2264649 - DNA, 22 bp, Homo sapiens
tgcaacaagccctgcttttgca

SEQ ID NO: 2264650 - DNA, 19 bp, Homo sapiens
tgcaaccttgtttattaaa

SEQ ID NO: 2264651 - DNA, 16 bp, Homo sapiens
tgcaagaccacggagg

SEQ ID NO: 2264652 - DNA, 18 bp, Homo sapiens
tgcaataatatcaaaaca

SEQ ID NO: 2264653 - DNA, 19 bp, Homo sapiens
tgcaataatatcaaaacaa

SEQ ID NO: 2264654 - DNA, 14 bp, Homo sapiens
tgcacacaaatatt

SEQ ID NO: 2264655 - DNA, 15 bp, Homo sapiens
tgtgtcccctcactc

SEQ ID NO: 2264656 - DNA, 22 bp, Homo sapiens
tgtgtctcaggaaaacagctag

SEQ ID NO: 2264657 - DNA, 14 bp, Homo sapiens
tgtgtcttaattat

SEQ ID NO: 2264658 - DNA, 17 bp, Homo sapiens
tgtgtggaagaaggaaa

SEQ ID NO: 2264659 - DNA, 22 bp, Homo sapiens
tgtgtgtatgatacgtgtataa

SEQ ID NO: 2264660 - DNA, 16 bp, Homo sapiens
tgtgtgtgacaattct

SEQ ID NO: 2264661 - DNA, 13 bp, Homo sapiens
tgttaaaataaat

SEQ ID NO: 2264662 - DNA, 14 bp, Homo sapiens
tgttaatacaaggt

SEQ ID NO: 2264663 - DNA, 22 bp, Homo sapiens
tgttaatacaaggtataataaa

SEQ ID NO: 2264664 - DNA, 19 bp, Homo sapiens
tgttacttgcagcattcat

SEQ ID NO: 2264665 - DNA, 21 bp, Homo sapiens
tgttagcagagtctgtctctt

SEQ ID NO: 2264666 - DNA, 15 bp, Homo sapiens
tgttcaaatgcattt

SEQ ID NO: 2264667 - DNA, 16 bp, Homo sapiens
tgttcacaccagagaa

SEQ ID NO: 2264668 - DNA, 16 bp, Homo sapiens
tgttcagaaagcaata

SEQ ID NO: 2264669 - DNA, 22 bp, Homo sapiens
tgttcagaaagcaataactttg

SEQ ID NO: 2264670 - DNA, 13 bp, Homo sapiens
tgttcagtaataa

SEQ ID NO: 2264671 - DNA, 15 bp, Homo sapiens
tgttcatttttcaaa

SEQ ID NO: 2264672 - DNA, 20 bp, Homo sapiens
tgttcccatgtagccccctg

SEQ ID NO: 2264673 - DNA, 22 bp, Homo sapiens
tgttctccgggtgtggcctcag

SEQ ID NO: 2264674 - DNA, 23 bp, Homo sapiens
tgttctccgggtgtggcctcagc

SEQ ID NO: 2264675 - DNA, 13 bp, Homo sapiens
tgttgaaaaaatt

SEQ ID NO: 2264676 - DNA, 18 bp, Homo sapiens
tgttgaaaatatttctct

SEQ ID NO: 2264677 - DNA, 23 bp, Homo sapiens
tgttgaaaatatttctctagtgt

SEQ ID NO: 2264678 - DNA, 16 bp, Homo sapiens
tgttgagccttttccc

SEQ ID NO: 2264679 - DNA, 18 bp, Homo sapiens
tgttgagccttttccctc

SEQ ID NO: 2264680 - DNA, 22 bp, Homo sapiens
tgttgatcatgtactttttagt

SEQ ID NO: 2264681 - DNA, 13 bp, Homo sapiens
tgttggaaaaaat

SEQ ID NO: 2264682 - DNA, 11 bp, Homo sapiens
tgttgtagtgt

SEQ ID NO: 2264683 - DNA, 11 bp, Homo sapiens
tgttgtcaaga

SEQ ID NO: 2264684 - DNA, 14 bp, Homo sapiens
tgttgtctccactt

SEQ ID NO: 2264685 - DNA, 22 bp, Homo sapiens
tgtttacatttgatgcatgtct

SEQ ID NO: 2264686 - DNA, 22 bp, Homo sapiens
tgtttagcagcagcctttaatg

SEQ ID NO: 2264687 - DNA, 17 bp, Homo sapiens
tgtttagtgatattaca

SEQ ID NO: 2264688 - DNA, 13 bp, Homo sapiens
tgtttagtggaaa

SEQ ID NO: 2264689 - DNA, 18 bp, Homo sapiens
tgtttcgagtaaacttga

SEQ ID NO: 2264690 - DNA, 22 bp, Homo sapiens
tgtttcgagtaaacttgaaaag

SEQ ID NO: 2264691 - DNA, 16 bp, Homo sapiens
tgtttctattttttga

SEQ ID NO: 2264692 - DNA, 19 bp, Homo sapiens
tgttttaaagaatatgact

SEQ ID NO: 2264693 - DNA, 22 bp, Homo sapiens
tgttttaacctcccctctcccc

SEQ ID NO: 2264694 - DNA, 22 bp, Homo sapiens
tgttttaatttaaacacctcct

SEQ ID NO: 2264695 - DNA, 23 bp, Homo sapiens
tgttttaatttaaacacctcctc

SEQ ID NO: 2264696 - DNA, 21 bp, Homo sapiens
tgttttttttttttttgctta

SEQ ID NO: 2264697 - DNA, 20 bp, Homo sapiens
ttaaaaaaattggttggaga

SEQ ID NO: 2264698 - DNA, 18 bp, Homo sapiens
ttaaaaaggactatatta

SEQ ID NO: 2264699 - DNA, 17 bp, Homo sapiens
ttaaaaatggtatcaaa

SEQ ID NO: 2264700 - DNA, 23 bp, Homo sapiens
ttaaaaatggtatcaaaattaca

SEQ ID NO: 2264701 - DNA, 18 bp, Homo sapiens
ttaaaagtaaaatgtctt

SEQ ID NO: 2264702 - DNA, 23 bp, Homo sapiens
ttaaaatacttgtttcagcttct

SEQ ID NO: 2264703 - DNA, 14 bp, Homo sapiens
ttaaaccttttatt

SEQ ID NO: 2264704 - DNA, 14 bp, Homo sapiens
ttaaagtattttct

SEQ ID NO: 2264705 - DNA, 12 bp, Homo sapiens
ttaaataagcaa

SEQ ID NO: 2264706 - DNA, 16 bp, Homo sapiens
ttaaataagcaaataa

SEQ ID NO: 2264707 - DNA, 15 bp, Homo sapiens
ttaaataatgtattt

SEQ ID NO: 2264708 - DNA, 15 bp, Homo sapiens
ttaaatacaaaactt

SEQ ID NO: 2264709 - DNA, 13 bp, Homo sapiens
ttaaatattttct

SEQ ID NO: 2264710 - DNA, 22 bp, Homo sapiens
ttaaatattttctattttaaga

SEQ ID NO: 2264711 - DNA, 11 bp, Homo sapiens
ttaaattaata

SEQ ID NO: 2264712 - DNA, 22 bp, Homo sapiens
ttaaattaatatctttctgcac

SEQ ID NO: 2264713 - DNA, 15 bp, Homo sapiens
ttaaattagaaaata

SEQ ID NO: 2264714 - DNA, 23 bp, Homo sapiens
ttaaattctccagttttttgtta

SEQ ID NO: 2264715 - DNA, 14 bp, Homo sapiens
ttaacaatgcaact

SEQ ID NO: 2264716 - DNA, 13 bp, Homo sapiens
ttaacatcagttt

SEQ ID NO: 2264717 - DNA, 20 bp, Homo sapiens
ttaaccaagtcgctcctagg

SEQ ID NO: 2264718 - DNA, 17 bp, Homo sapiens
ttaacctcccctctccc

SEQ ID NO: 2264719 - DNA, 15 bp, Homo sapiens
ttaacctctgctttt

SEQ ID NO: 2264720 - DNA, 19 bp, Homo sapiens
ttaacctttccgctgtcgc

SEQ ID NO: 2264721 - DNA, 20 bp, Homo sapiens
ttaactccactgcttaccta

SEQ ID NO: 2264722 - DNA, 14 bp, Homo sapiens
ttaacttttaatgg

SEQ ID NO: 2264723 - DNA, 19 bp, Homo sapiens
ttaacttttaatggtgatg

SEQ ID NO: 2264724 - DNA, 14 bp, Homo sapiens
ttaacttttctacc

SEQ ID NO: 2264725 - DNA, 17 bp, Homo sapiens
ttaactttttatttcta

SEQ ID NO: 2264726 - DNA, 20 bp, Homo sapiens
ttaagacgtgaatgtctcag

SEQ ID NO: 2264727 - DNA, 11 bp, Homo sapiens
ttaagatgtga

SEQ ID NO: 2264728 - DNA, 13 bp, Homo sapiens
ttaagatgtgaaa

SEQ ID NO: 2264729 - DNA, 17 bp, Homo sapiens
ttaagatgtgaaaatta

SEQ ID NO: 2264730 - DNA, 21 bp, Homo sapiens
ttaagctgttcctgttcagta

SEQ ID NO: 2264731 - DNA, 19 bp, Homo sapiens
ttaagctttttttttttga

SEQ ID NO: 2264732 - DNA, 17 bp, Homo sapiens
ttaaggacttctgcagc

SEQ ID NO: 2264733 - DNA, 21 bp, Homo sapiens
ttaaggagaggagaaactgag

SEQ ID NO: 2264734 - DNA, 15 bp, Homo sapiens
ttaagggaaaaatat

SEQ ID NO: 2264735 - DNA, 16 bp, Homo sapiens
ttaagggaaaaatata

SEQ ID NO: 2264736 - DNA, 15 bp, Homo sapiens
ttaagggcattttaa

SEQ ID NO: 2264737 - DNA, 21 bp, Homo sapiens
ttaagtcccagtatacctcat

SEQ ID NO: 2264738 - DNA, 20 bp, Homo sapiens
ttaagtgttggaaaaaattt

SEQ ID NO: 2264739 - DNA, 20 bp, Homo sapiens
ttaagttagttccactgaga

SEQ ID NO: 2264740 - DNA, 18 bp, Homo sapiens
ttaataaaactgtgcatc

SEQ ID NO: 2264741 - DNA, 13 bp, Homo sapiens
ttaatacaaggta

SEQ ID NO: 2264742 - DNA, 19 bp, Homo sapiens
ttaatacaaggtataataa

SEQ ID NO: 2264743 - DNA, 17 bp, Homo sapiens
ttaatattaacttttaa

SEQ ID NO: 2264744 - DNA, 18 bp, Homo sapiens
ttaatcatgaatatgatg

SEQ ID NO: 2264745 - DNA, 19 bp, Homo sapiens
ttaatcattttcattccta

SEQ ID NO: 2264746 - DNA, 17 bp, Homo sapiens
ttaatctctaacagtgg

SEQ ID NO: 2264747 - DNA, 11 bp, Homo sapiens
ttaatgcactt

SEQ ID NO: 2264748 - DNA, 18 bp, Homo sapiens
ttaatgcatctagattat

SEQ ID NO: 2264749 - DNA, 12 bp, Homo sapiens
ttaatggttttt

SEQ ID NO: 2264750 - DNA, 21 bp, Homo sapiens
ttaattattatttgtgtttta

SEQ ID NO: 2264751 - DNA, 13 bp, Homo sapiens
ttaattcatttgg

SEQ ID NO: 2264752 - DNA, 13 bp, Homo sapiens
ttaatttgaaata

SEQ ID NO: 2264753 - DNA, 15 bp, Homo sapiens
ttaatttgaaatatg

SEQ ID NO: 2264754 - DNA, 15 bp, Homo sapiens
ttacaacattcaact

SEQ ID NO: 2264755 - DNA, 18 bp, Homo sapiens
ttacaattttatctgttt

SEQ ID NO: 2264756 - DNA, 17 bp, Homo sapiens
ttacacaaatgtgattt

SEQ ID NO: 2264757 - DNA, 18 bp, Homo sapiens
ttacacaaatgtgatttt

SEQ ID NO: 2264758 - DNA, 23 bp, Homo sapiens
ttacacaaatgtgatttttgtaa

SEQ ID NO: 2264759 - DNA, 16 bp, Homo sapiens
ttacactttttggaag

SEQ ID NO: 2264760 - DNA, 22 bp, Homo sapiens
ttacataatttagttgtttcta

SEQ ID NO: 2264761 - DNA, 16 bp, Homo sapiens
ttacatactttatcaa

SEQ ID NO: 2264762 - DNA, 21 bp, Homo sapiens
ttacatactttatcaatgtgt

SEQ ID NO: 2264763 - DNA, 14 bp, Homo sapiens
tttcctgcatctct

SEQ ID NO: 2264764 - DNA, 20 bp, Homo sapiens
tttcctggacactcagacct

SEQ ID NO: 2264765 - DNA, 17 bp, Homo sapiens
tttccttctctgaaagt

SEQ ID NO: 2264766 - DNA, 16 bp, Homo sapiens
tttccttttcttaaaa

SEQ ID NO: 2264767 - DNA, 21 bp, Homo sapiens
tttcctttttaaggtctttca

SEQ ID NO: 2264768 - DNA, 18 bp, Homo sapiens
tttctacaatgtgaactt

SEQ ID NO: 2264769 - DNA, 12 bp, Homo sapiens
tttctacctcag

SEQ ID NO: 2264770 - DNA, 23 bp, Homo sapiens
tttctatgaaggatccatctttg

SEQ ID NO: 2264771 - DNA, 14 bp, Homo sapiens
tttctatgcaggca

SEQ ID NO: 2264772 - DNA, 15 bp, Homo sapiens
tttctattttaagac

SEQ ID NO: 2264773 - DNA, 11 bp, Homo sapiens
tttctccagct

SEQ ID NO: 2264774 - DNA, 18 bp, Homo sapiens
tttctctgtacttttcat

SEQ ID NO: 2264775 - DNA, 13 bp, Homo sapiens
tttctgctgagga

SEQ ID NO: 2264776 - DNA, 19 bp, Homo sapiens
tttctgtcacagtaaaaat

SEQ ID NO: 2264777 - DNA, 13 bp, Homo sapiens
tttctttaatgct

SEQ ID NO: 2264778 - DNA, 14 bp, Homo sapiens
tttctttccaaaac

SEQ ID NO: 2264779 - DNA, 23 bp, Homo sapiens
tttcttttggtaaagactggctt

SEQ ID NO: 2264780 - DNA, 16 bp, Homo sapiens
tttcttttttaaatta

SEQ ID NO: 2264781 - DNA, 13 bp, Homo sapiens
tttgaaaagcaga

SEQ ID NO: 2264782 - DNA, 22 bp, Homo sapiens
tttgaaacccctgtaggcctca

SEQ ID NO: 2264783 - DNA, 21 bp, Homo sapiens
tttgaaatagttcaaactgca

SEQ ID NO: 2264784 - DNA, 22 bp, Homo sapiens
tttgaaattgttccttggagaa

SEQ ID NO: 2264785 - DNA, 21 bp, Homo sapiens
tttgaagggagaagacactgc

SEQ ID NO: 2264786 - DNA, 22 bp, Homo sapiens
tttgaagggagaagacactgca

SEQ ID NO: 2264787 - DNA, 19 bp, Homo sapiens
tttgaatcaataatatatt

SEQ ID NO: 2264788 - DNA, 16 bp, Homo sapiens
tttgacataagatggt

SEQ ID NO: 2264789 - DNA, 14 bp, Homo sapiens
tttgactaatttta

SEQ ID NO: 2264790 - DNA, 17 bp, Homo sapiens
tttgactaattttacat

SEQ ID NO: 2264791 - DNA, 19 bp, Homo sapiens
tttgactctggcaaagctt

SEQ ID NO: 2264792 - DNA, 21 bp, Homo sapiens
tttgactctggcaaagctttt

SEQ ID NO: 2264793 - DNA, 18 bp, Homo sapiens
tttgagctactggattct

SEQ ID NO: 2264794 - DNA, 16 bp, Homo sapiens
tttgatgcatgtcttt

SEQ ID NO: 2264795 - DNA, 22 bp, Homo sapiens
tttgatgcatgtcttttaaaat

SEQ ID NO: 2264796 - DNA, 13 bp, Homo sapiens
tttgcaccaaaga

SEQ ID NO: 2264797 - DNA, 14 bp, Homo sapiens
tttgcaccaaagac

SEQ ID NO: 2264798 - DNA, 14 bp, Homo sapiens
tttgcactgtttaa

SEQ ID NO: 2264799 - DNA, 14 bp, Homo sapiens
tttgcataatgcaa

SEQ ID NO: 2264800 - DNA, 16 bp, Homo sapiens
tttgctatctgggctg

SEQ ID NO: 2264801 - DNA, 17 bp, Homo sapiens
tttggagtcccctcacc

SEQ ID NO: 2264802 - DNA, 20 bp, Homo sapiens
tttggagtcccctcacctcc

SEQ ID NO: 2264803 - DNA, 23 bp, Homo sapiens
tttggcatgtaaatgtaaactca

SEQ ID NO: 2264804 - DNA, 13 bp, Homo sapiens
tttggcatttgca

SEQ ID NO: 2264805 - DNA, 15 bp, Homo sapiens
tttgtaaaagacatt

SEQ ID NO: 2264806 - DNA, 22 bp, Homo sapiens
tttgtaacattagttttaaaaa

SEQ ID NO: 2264807 - DNA, 13 bp, Homo sapiens
tttgtaacttcaa

SEQ ID NO: 2264808 - DNA, 19 bp, Homo sapiens
tttgtacgttatatattgt

SEQ ID NO: 2264809 - DNA, 17 bp, Homo sapiens
tttgtcctaaaacacct

SEQ ID NO: 2264810 - DNA, 22 bp, Homo sapiens
tttgtgctgaatgttgggactg

SEQ ID NO: 2264811 - DNA, 21 bp, Homo sapiens
tttgtgtaactcccagtgatg

SEQ ID NO: 2264812 - DNA, 18 bp, Homo sapiens
tttgtgtccgctaaatat

SEQ ID NO: 2264813 - DNA, 13 bp, Homo sapiens
tttgtgtgtctta

SEQ ID NO: 2264814 - DNA, 19 bp, Homo sapiens
tttgttaccttttacagaa

SEQ ID NO: 2264815 - DNA, 20 bp, Homo sapiens
tttgttagcaaagattaaat

SEQ ID NO: 2264816 - DNA, 21 bp, Homo sapiens
tttgttctccgggtgtggcct

SEQ ID NO: 2264817 - DNA, 12 bp, Homo sapiens
tttgttctgtat

SEQ ID NO: 2264818 - DNA, 14 bp, Homo sapiens
tttgttctttatgt

SEQ ID NO: 2264819 - DNA, 16 bp, Homo sapiens
ttttaaaaaatggtca

SEQ ID NO: 2264820 - DNA, 17 bp, Homo sapiens
ttttaaaaaatggtcac

SEQ ID NO: 2264821 - DNA, 21 bp, Homo sapiens
ttttaaaaatctaagcagctt

SEQ ID NO: 2264822 - DNA, 21 bp, Homo sapiens
ttttaaaagcaattatattgt

SEQ ID NO: 2264823 - DNA, 17 bp, Homo sapiens
ttttaaaatacttgttt

SEQ ID NO: 2264824 - DNA, 17 bp, Homo sapiens
ttttaaataaaagcaca

SEQ ID NO: 2264825 - DNA, 18 bp, Homo sapiens
ttttaaattagaaaatat

SEQ ID NO: 2264826 - DNA, 13 bp, Homo sapiens
ttttaacttttta

SEQ ID NO: 2264827 - DNA, 22 bp, Homo sapiens
ttttaagacgtgaatgtctcag

SEQ ID NO: 2264828 - DNA, 17 bp, Homo sapiens
ttttaaggtctttcagt

SEQ ID NO: 2264829 - DNA, 22 bp, Homo sapiens
ttttaatattaacttttaatgg

SEQ ID NO: 2264830 - DNA, 23 bp, Homo sapiens
ttttaatattaacttttaatggt

SEQ ID NO: 2264831 - DNA, 21 bp, Homo sapiens
ttttaatctctaacagtggac

SEQ ID NO: 2264832 - DNA, 15 bp, Homo sapiens
ttttaatgatgacaa

SEQ ID NO: 2264833 - DNA, 17 bp, Homo sapiens
ttttaatgatgacaaaa

SEQ ID NO: 2264834 - DNA, 16 bp, Homo sapiens
ttttacatacttttgc

SEQ ID NO: 2264835 - DNA, 18 bp, Homo sapiens
ttttacatacttttgcaa

SEQ ID NO: 2264836 - DNA, 13 bp, Homo sapiens
ttttaccaaagca

SEQ ID NO: 2264837 - DNA, 16 bp, Homo sapiens
ttttactttttttagt

SEQ ID NO: 2264838 - DNA, 16 bp, Homo sapiens
ttttagaaacctcatt

SEQ ID NO: 2264839 - DNA, 12 bp, Homo sapiens
ttttagaataca

SEQ ID NO: 2264840 - DNA, 14 bp, Homo sapiens
ttttataaaaagat

SEQ ID NO: 2264841 - DNA, 15 bp, Homo sapiens
ttttatctgtttcct

SEQ ID NO: 2264842 - DNA, 11 bp, Homo sapiens
ttttattaatg

SEQ ID NO: 2264843 - DNA, 13 bp, Homo sapiens
ttttattaatgca

SEQ ID NO: 2264844 - DNA, 14 bp, Homo sapiens
ttttattaatgcac

SEQ ID NO: 2264845 - DNA, 13 bp, Homo sapiens
ttttattcttttt

SEQ ID NO: 2264846 - DNA, 10 bp, Homo sapiens
ttttattgtt

SEQ ID NO: 2264847 - DNA, 17 bp, Homo sapiens
ttttatttagggaacat

SEQ ID NO: 2264848 - DNA, 18 bp, Homo sapiens
ttttcaccgagcagaggt

SEQ ID NO: 2264849 - DNA, 17 bp, Homo sapiens
ttttcattcctaaagaa

SEQ ID NO: 2264850 - DNA, 18 bp, Homo sapiens
ttttccactccattgtcg

SEQ ID NO: 2264851 - DNA, 16 bp, Homo sapiens
ttttccttttcttaaa

SEQ ID NO: 2264852 - DNA, 18 bp, Homo sapiens
ttttctctgtacttttca

SEQ ID NO: 2264853 - DNA, 21 bp, Homo sapiens
ttttcttttttaaattaatat

SEQ ID NO: 2264854 - DNA, 21 bp, Homo sapiens
ttttgaagggagaagacactg

SEQ ID NO: 2264855 - DNA, 15 bp, Homo sapiens
ttttgagacagtctt

SEQ ID NO: 2264856 - DNA, 13 bp, Homo sapiens
ttttgagcacttt

SEQ ID NO: 2264857 - DNA, 15 bp, Homo sapiens
ttttgaggagcccca

SEQ ID NO: 2264858 - DNA, 15 bp, Homo sapiens
ttttgcataatgcaa

SEQ ID NO: 2264859 - DNA, 12 bp, Homo sapiens
ttttgctgtata

SEQ ID NO: 2264860 - DNA, 16 bp, Homo sapiens
ttttgcttaacagttt

SEQ ID NO: 2264861 - DNA, 19 bp, Homo sapiens
ttttgggggtttttaatct

SEQ ID NO: 2264862 - DNA, 15 bp, Homo sapiens
ttttgtaacttcaaa

SEQ ID NO: 2264863 - DNA, 16 bp, Homo sapiens
ttttgtaacttcaaat

SEQ ID NO: 2264864 - DNA, 17 bp, Homo sapiens
ttttgtaacttcaaata

SEQ ID NO: 2264865 - DNA, 15 bp, Homo sapiens
ttttgttagcaaaga

SEQ ID NO: 2264866 - DNA, 16 bp, Homo sapiens
ttttgttagcaaagat

SEQ ID NO: 2264867 - DNA, 12 bp, Homo sapiens
ttttgttctgta

SEQ ID NO: 2264868 - DNA, 20 bp, Homo sapiens
tttttaagtgaaaatatagc

SEQ ID NO: 2264869 - DNA, 22 bp, Homo sapiens
tttttagtaagttaatgtatat

SEQ ID NO: 2264870 - DNA, 22 bp, Homo sapiens
tttttatctatataaaataact

SEQ ID NO: 2264871 - DNA, 23 bp, Homo sapiens
tttttatgcctttctctcctagt

SEQ ID NO: 2264872 - DNA, 18 bp, Homo sapiens
aaaattggggattcttaa

SEQ ID NO: 2264873 - DNA, 21 bp, Homo sapiens
aaaattggggattcttaaagt

SEQ ID NO: 2264874 - DNA, 15 bp, Homo sapiens
aaacttgtgtaaata

SEQ ID NO: 2264875 - DNA, 16 bp, Homo sapiens
aaagccatgtttatta

SEQ ID NO: 2264876 - DNA, 23 bp, Homo sapiens
aaagccatgtttattacagtata

SEQ ID NO: 2264877 - DNA, 13 bp, Homo sapiens
aaagtattaagca

SEQ ID NO: 2264878 - DNA, 16 bp, Homo sapiens
aaagtttaatattaaa

SEQ ID NO: 2264879 - DNA, 17 bp, Homo sapiens
aaatacaattttgtttc

SEQ ID NO: 2264880 - DNA, 20 bp, Homo sapiens
aaatacaattttgtttctgt

SEQ ID NO: 2264881 - DNA, 21 bp, Homo sapiens
aaatacaattttgtttctgta

SEQ ID NO: 2264882 - DNA, 18 bp, Homo sapiens
aaatagctagactggtga

SEQ ID NO: 2264883 - DNA, 14 bp, Homo sapiens
aaatattttatgat

SEQ ID NO: 2264884 - DNA, 19 bp, Homo sapiens
aaatattttatgatccagc

SEQ ID NO: 2264885 - DNA, 18 bp, Homo sapiens
aaatccatttggaaatct

SEQ ID NO: 2264886 - DNA, 21 bp, Homo sapiens
aaatcccattattcaaagttg

SEQ ID NO: 2264887 - DNA, 19 bp, Homo sapiens
aaatctgtgaacttgaaat

SEQ ID NO: 2264888 - DNA, 21 bp, Homo sapiens
aaatctgtgaacttgaaattt

SEQ ID NO: 2264889 - DNA, 15 bp, Homo sapiens
aaattgtaattatat

SEQ ID NO: 2264890 - DNA, 15 bp, Homo sapiens
aaatttgaattttgt

SEQ ID NO: 2264891 - DNA, 21 bp, Homo sapiens
aacagctggtgccctgctttc

SEQ ID NO: 2264892 - DNA, 16 bp, Homo sapiens
aacatgttaaaccatg

SEQ ID NO: 2264893 - DNA, 11 bp, Homo sapiens
aaccagtattg

SEQ ID NO: 2264894 - DNA, 13 bp, Homo sapiens
aaccagtattgta

SEQ ID NO: 2264895 - DNA, 14 bp, Homo sapiens
aaccagtattgtac

SEQ ID NO: 2264896 - DNA, 20 bp, Homo sapiens
aaccagtattgtacaaagta

SEQ ID NO: 2264897 - DNA, 15 bp, Homo sapiens
aaccatgggataaat

SEQ ID NO: 2264898 - DNA, 17 bp, Homo sapiens
aaccatgggataaatgc

SEQ ID NO: 2264899 - DNA, 16 bp, Homo sapiens
aacctctttgtctaca

SEQ ID NO: 2264900 - DNA, 14 bp, Homo sapiens
aacggatgatttct

SEQ ID NO: 2264901 - DNA, 18 bp, Homo sapiens
aacttgaaatttgaattt

SEQ ID NO: 2264902 - DNA, 15 bp, Homo sapiens
aacttgtgtaaatac

SEQ ID NO: 2264903 - DNA, 14 bp, Homo sapiens
aacttttctgatag

SEQ ID NO: 2264904 - DNA, 13 bp, Homo sapiens
aagccatgtttat

SEQ ID NO: 2264905 - DNA, 17 bp, Homo sapiens
aagccatgtttattaca

SEQ ID NO: 2264906 - DNA, 20 bp, Homo sapiens
aagccatgtttattacagta

SEQ ID NO: 2264907 - DNA, 23 bp, Homo sapiens
aagccatgtttattacagtataa

SEQ ID NO: 2264908 - DNA, 12 bp, Homo sapiens
aaggaaaagttt

SEQ ID NO: 2264909 - DNA, 21 bp, Homo sapiens
aaggacttctttaattttgga

SEQ ID NO: 2264910 - DNA, 22 bp, Homo sapiens
aagtcagatctgcctaaggact

SEQ ID NO: 2264911 - DNA, 16 bp, Homo sapiens
aagttgcctaaatcca

SEQ ID NO: 2264912 - DNA, 17 bp, Homo sapiens
aagttgcctaaatccat

SEQ ID NO: 2264913 - DNA, 15 bp, Homo sapiens
aagtttaatattaaa

SEQ ID NO: 2264914 - DNA, 14 bp, Homo sapiens
aataaaaaattatg

SEQ ID NO: 2264915 - DNA, 16 bp, Homo sapiens
aataaaaaattatgac

SEQ ID NO: 2264916 - DNA, 13 bp, Homo sapiens
aataaggaaaagt

SEQ ID NO: 2264917 - DNA, 19 bp, Homo sapiens
aataaggaaaagtttaata

SEQ ID NO: 2264918 - DNA, 15 bp, Homo sapiens
aataattatatgcta

SEQ ID NO: 2264919 - DNA, 20 bp, Homo sapiens
aataattatatgctatttct

SEQ ID NO: 2264920 - DNA, 21 bp, Homo sapiens
aataattatatgctatttcta

SEQ ID NO: 2264921 - DNA, 13 bp, Homo sapiens
aatacaattttgt

SEQ ID NO: 2264922 - DNA, 23 bp, Homo sapiens
aatacaattttgtttctgtactt

SEQ ID NO: 2264923 - DNA, 14 bp, Homo sapiens
aatattaaagccat

SEQ ID NO: 2264924 - DNA, 18 bp, Homo sapiens
aatattaaagccatgttt

SEQ ID NO: 2264925 - DNA, 15 bp, Homo sapiens
aatccatttggaaat

SEQ ID NO: 2264926 - DNA, 18 bp, Homo sapiens
aatccatttggaaatctt

SEQ ID NO: 2264927 - DNA, 22 bp, Homo sapiens
aatccatttggaaatctttaaa

SEQ ID NO: 2264928 - DNA, 15 bp, Homo sapiens
aatctgtgaacttga

SEQ ID NO: 2264929 - DNA, 18 bp, Homo sapiens
aatctgtgaacttgaaat

SEQ ID NO: 2264930 - DNA, 22 bp, Homo sapiens
aatctgtgaacttgaaatttga

SEQ ID NO: 2264931 - DNA, 20 bp, Homo sapiens
aatctttaaaaaaaaaattg

SEQ ID NO: 2264932 - DNA, 13 bp, Homo sapiens
aatggctttgtat

SEQ ID NO: 2264933 - DNA, 20 bp, Homo sapiens
aatggtccgtgctaaggact

SEQ ID NO: 2264934 - DNA, 22 bp, Homo sapiens
aatggtccgtgctaaggacttg

SEQ ID NO: 2264935 - DNA, 13 bp, Homo sapiens
aattaacatgtta

SEQ ID NO: 2264936 - DNA, 20 bp, Homo sapiens
aattatatctgaggaattct

SEQ ID NO: 2264937 - DNA, 22 bp, Homo sapiens
aattatatctgaggaattctgt

SEQ ID NO: 2264938 - DNA, 21 bp, Homo sapiens
aattatatgctatttctatat

SEQ ID NO: 2264939 - DNA, 20 bp, Homo sapiens
aattctgtatagattagaga

SEQ ID NO: 2264940 - DNA, 15 bp, Homo sapiens
aattggggattctta

SEQ ID NO: 2264941 - DNA, 16 bp, Homo sapiens
aattggggattcttaa

SEQ ID NO: 2264942 - DNA, 15 bp, Homo sapiens
aattgtaattatatc

SEQ ID NO: 2264943 - DNA, 19 bp, Homo sapiens
aatttattggcttttctga

SEQ ID NO: 2264944 - DNA, 23 bp, Homo sapiens
aatttattggcttttctgatcca

SEQ ID NO: 2264945 - DNA, 11 bp, Homo sapiens
aattttggaat

SEQ ID NO: 2264946 - DNA, 12 bp, Homo sapiens
aattttggaatt

SEQ ID NO: 2264947 - DNA, 13 bp, Homo sapiens
aattttgtttctg

SEQ ID NO: 2264948 - DNA, 16 bp, Homo sapiens
aattttgtttctgtac

SEQ ID NO: 2264949 - DNA, 14 bp, Homo sapiens
acaattttgtttct

SEQ ID NO: 2264950 - DNA, 21 bp, Homo sapiens
acaccattatgtgcgctgata

SEQ ID NO: 2264951 - DNA, 17 bp, Homo sapiens
acagctggtgccctgct

SEQ ID NO: 2264952 - DNA, 20 bp, Homo sapiens
acagctggtgccctgctttc

SEQ ID NO: 2264953 - DNA, 21 bp, Homo sapiens
acagtataattaacatgttaa

SEQ ID NO: 2264954 - DNA, 14 bp, Homo sapiens
acataaatctgtga

SEQ ID NO: 2264955 - DNA, 14 bp, Homo sapiens
acatagtctggctg

SEQ ID NO: 2264956 - DNA, 15 bp, Homo sapiens
acatagtctggctgt

SEQ ID NO: 2264957 - DNA, 16 bp, Homo sapiens
acatgttaaaccatgg

SEQ ID NO: 2264958 - DNA, 21 bp, Homo sapiens
acatgttaaaccatgggataa

SEQ ID NO: 2264959 - DNA, 13 bp, Homo sapiens
accaaaaaccagt

SEQ ID NO: 2264960 - DNA, 19 bp, Homo sapiens
accatgggataaatgccat

SEQ ID NO: 2264961 - DNA, 21 bp, Homo sapiens
acctgtcttgcctttttcatt

SEQ ID NO: 2264962 - DNA, 14 bp, Homo sapiens
acgcgttgaaattg

SEQ ID NO: 2264963 - DNA, 18 bp, Homo sapiens
acgcgttgaaattgtaat

SEQ ID NO: 2264964 - DNA, 15 bp, Homo sapiens
acggatgatttctat

SEQ ID NO: 2264965 - DNA, 12 bp, Homo sapiens
actcaattttaa

SEQ ID NO: 2264966 - DNA, 12 bp, Homo sapiens
actgattcttca

SEQ ID NO: 2264967 - DNA, 14 bp, Homo sapiens
actggtgactgatt

SEQ ID NO: 2264968 - DNA, 16 bp, Homo sapiens
actggtgactgattct

SEQ ID NO: 2264969 - DNA, 18 bp, Homo sapiens
actggtgactgattcttc

SEQ ID NO: 2264970 - DNA, 14 bp, Homo sapiens
actgtggtgacttt

SEQ ID NO: 2264971 - DNA, 20 bp, Homo sapiens
actgtggtgactttggataa

SEQ ID NO: 2264972 - DNA, 16 bp, Homo sapiens
acttgaaatttgaatt

SEQ ID NO: 2264973 - DNA, 21 bp, Homo sapiens
acttgtgtaaatacaattttg

SEQ ID NO: 2264974 - DNA, 15 bp, Homo sapiens
acttgttagatctag

SEQ ID NO: 2264975 - DNA, 22 bp, Homo sapiens
actttgtgctggggttatctga

SEQ ID NO: 2264976 - DNA, 22 bp, Homo sapiens
agaacctctttgtctacaccat

SEQ ID NO: 2264977 - DNA, 12 bp, Homo sapiens
agaattctgtat

SEQ ID NO: 2264978 - DNA, 14 bp, Homo sapiens
agaattctgtatag

SEQ ID NO: 2264979 - DNA, 14 bp, Homo sapiens
agactggtgactga

SEQ ID NO: 2264980 - DNA, 16 bp, Homo sapiens
agactggtgactgatt

SEQ ID NO: 2264981 - DNA, 20 bp, Homo sapiens
agactggtgactgattcttc

SEQ ID NO: 2264982 - DNA, 15 bp, Homo sapiens
agagagtgttgaaac

SEQ ID NO: 2264983 - DNA, 22 bp, Homo sapiens
agagatttttttgttgtttgtt

SEQ ID NO: 2264984 - DNA, 13 bp, Homo sapiens
agagtgttgaaac

SEQ ID NO: 2264985 - DNA, 17 bp, Homo sapiens
agatactggattgtact

SEQ ID NO: 2264986 - DNA, 19 bp, Homo sapiens
agatctgcctaaggacttc

SEQ ID NO: 2264987 - DNA, 15 bp, Homo sapiens
agatttttttgttgt

SEQ ID NO: 2264988 - DNA, 16 bp, Homo sapiens
agatttttttgttgtt

SEQ ID NO: 2264989 - DNA, 19 bp, Homo sapiens
agatttttttgttgtttgt

SEQ ID NO: 2264990 - DNA, 19 bp, Homo sapiens
agcaaaaatattttatgat

SEQ ID NO: 2264991 - DNA, 14 bp, Homo sapiens
agcagattattcac

SEQ ID NO: 2264992 - DNA, 19 bp, Homo sapiens
agcagattattcactgatt

SEQ ID NO: 2264993 - DNA, 15 bp, Homo sapiens
agcatatatttttat

SEQ ID NO: 2264994 - DNA, 14 bp, Homo sapiens
agcctgattaaaga

SEQ ID NO: 2264995 - DNA, 16 bp, Homo sapiens
agcctgcacggtgaat

SEQ ID NO: 2264996 - DNA, 17 bp, Homo sapiens
agctagactggtgactg

SEQ ID NO: 2264997 - DNA, 14 bp, Homo sapiens
agctggtgccctgc

SEQ ID NO: 2264998 - DNA, 21 bp, Homo sapiens
aggaaaagtttaatattaaag

SEQ ID NO: 2264999 - DNA, 21 bp, Homo sapiens
aggaagcctgattaaagaatg

SEQ ID NO: 2265000 - DNA, 13 bp, Homo sapiens
aggaattctgtat

SEQ ID NO: 2265001 - DNA, 23 bp, Homo sapiens
aggaattctgtatagattagaat

SEQ ID NO: 2265002 - DNA, 17 bp, Homo sapiens
aggacttgttagatcta

SEQ ID NO: 2265003 - DNA, 23 bp, Homo sapiens
agtataattaacatgttaaacca

SEQ ID NO: 2265004 - DNA, 21 bp, Homo sapiens
agtgttgaaacggatgatttc

SEQ ID NO: 2265005 - DNA, 20 bp, Homo sapiens
agttgaatttattggctttt

SEQ ID NO: 2265006 - DNA, 11 bp, Homo sapiens
agttgcctaaa

SEQ ID NO: 2265007 - DNA, 23 bp, Homo sapiens
agttgcctaaatccatttggaaa

SEQ ID NO: 2265008 - DNA, 19 bp, Homo sapiens
agtttaatattaaagccat

SEQ ID NO: 2265009 - DNA, 19 bp, Homo sapiens
agtttgtgctggtgtatgt

SEQ ID NO: 2265010 - DNA, 12 bp, Homo sapiens
agttttgtttgg

SEQ ID NO: 2265011 - DNA, 16 bp, Homo sapiens
agttttgtttggacca

SEQ ID NO: 2265012 - DNA, 16 bp, Homo sapiens
ataaatctgtgaactt

SEQ ID NO: 2265013 - DNA, 19 bp, Homo sapiens
ataaatctgtgaacttgaa

SEQ ID NO: 2265014 - DNA, 22 bp, Homo sapiens
ataaatctgtgaacttgaaatt

SEQ ID NO: 2265015 - DNA, 18 bp, Homo sapiens
ataaatgccatcaataaa

SEQ ID NO: 2265016 - DNA, 14 bp, Homo sapiens
ataacataaatctg

SEQ ID NO: 2265017 - DNA, 15 bp, Homo sapiens
ataaggaaaagttta

SEQ ID NO: 2265018 - DNA, 18 bp, Homo sapiens
ataataaggaaaagttta

SEQ ID NO: 2265019 - DNA, 22 bp, Homo sapiens
ataataaggaaaagtttaatat

SEQ ID NO: 2265020 - DNA, 20 bp, Homo sapiens
ataattaacatgttaaacca

SEQ ID NO: 2265021 - DNA, 17 bp, Homo sapiens
ataattatatgctattt

SEQ ID NO: 2265022 - DNA, 23 bp, Homo sapiens
ataattatatgctatttctatat

SEQ ID NO: 2265023 - DNA, 15 bp, Homo sapiens
atactggattgtact

SEQ ID NO: 2265024 - DNA, 14 bp, Homo sapiens
atagaacctctttg

SEQ ID NO: 2265025 - DNA, 16 bp, Homo sapiens
atagctagactggtga

SEQ ID NO: 2265026 - DNA, 23 bp, Homo sapiens
atagctagactggtgactgattc

SEQ ID NO: 2265027 - DNA, 17 bp, Homo sapiens
atatctgaggaattctg

SEQ ID NO: 2265028 - DNA, 18 bp, Homo sapiens
atatctgaggaattctgt

SEQ ID NO: 2265029 - DNA, 14 bp, Homo sapiens
atatgctatttcta

SEQ ID NO: 2265030 - DNA, 21 bp, Homo sapiens
atatgctatttctatattttc

SEQ ID NO: 2265031 - DNA, 12 bp, Homo sapiens
atattaaagcca

SEQ ID NO: 2265032 - DNA, 23 bp, Homo sapiens
atattaaagccatgtttattaca

SEQ ID NO: 2265033 - DNA, 22 bp, Homo sapiens
atattttatgatccagcagatt

SEQ ID NO: 2265034 - DNA, 16 bp, Homo sapiens
atatttttatatttac

SEQ ID NO: 2265035 - DNA, 12 bp, Homo sapiens
atcacctgtctt

SEQ ID NO: 2265036 - DNA, 22 bp, Homo sapiens
atcacctgtcttgcctttttca

SEQ ID NO: 2265037 - DNA, 23 bp, Homo sapiens
atcacctgtcttgcctttttcat

SEQ ID NO: 2265038 - DNA, 18 bp, Homo sapiens
atccagcagattattcac

SEQ ID NO: 2265039 - DNA, 17 bp, Homo sapiens
atccagttttgtttgga

SEQ ID NO: 2265040 - DNA, 18 bp, Homo sapiens
atccagttttgtttggac

SEQ ID NO: 2265041 - DNA, 20 bp, Homo sapiens
atccagttttgtttggacca

SEQ ID NO: 2265042 - DNA, 17 bp, Homo sapiens
atccatttggaaatctt

SEQ ID NO: 2265043 - DNA, 21 bp, Homo sapiens
atccatttggaaatctttaaa

SEQ ID NO: 2265044 - DNA, 19 bp, Homo sapiens
atctgcctaaggacttctt

SEQ ID NO: 2265045 - DNA, 21 bp, Homo sapiens
atctgcctaaggacttcttta

SEQ ID NO: 2265046 - DNA, 22 bp, Homo sapiens
atctgcctaaggacttctttaa

SEQ ID NO: 2265047 - DNA, 23 bp, Homo sapiens
atctgcctaaggacttctttaat

SEQ ID NO: 2265048 - DNA, 13 bp, Homo sapiens
atctgtgaacttg

SEQ ID NO: 2265049 - DNA, 18 bp, Homo sapiens
atctgtgaacttgaaatt

SEQ ID NO: 2265050 - DNA, 18 bp, Homo sapiens
atgaaacttgtgtaaata

SEQ ID NO: 2265051 - DNA, 10 bp, Homo sapiens
atgatccagc

SEQ ID NO: 2265052 - DNA, 20 bp, Homo sapiens
atgatccagcagattattca

SEQ ID NO: 2265053 - DNA, 22 bp, Homo sapiens
atgatccagcagattattcact

SEQ ID NO: 2265054 - DNA, 11 bp, Homo sapiens
atgctatttct

SEQ ID NO: 2265055 - DNA, 14 bp, Homo sapiens
atgctatttctata

SEQ ID NO: 2265056 - DNA, 20 bp, Homo sapiens
atgctatttctatattttca

SEQ ID NO: 2265057 - DNA, 23 bp, Homo sapiens
atgctatttctatattttcattc

SEQ ID NO: 2265058 - DNA, 16 bp, Homo sapiens
atggaacgcgttgaaa

SEQ ID NO: 2265059 - DNA, 19 bp, Homo sapiens
atggaacgcgttgaaattg

SEQ ID NO: 2265060 - DNA, 22 bp, Homo sapiens
atggactgtggtgactttggat

SEQ ID NO: 2265061 - DNA, 15 bp, Homo sapiens
atggctttgtataga

SEQ ID NO: 2265062 - DNA, 14 bp, Homo sapiens
atgggataaatgcc

SEQ ID NO: 2265063 - DNA, 20 bp, Homo sapiens
atgggataaatgccatcaat

SEQ ID NO: 2265064 - DNA, 15 bp, Homo sapiens
atggtccgtgctaag

SEQ ID NO: 2265065 - DNA, 21 bp, Homo sapiens
atggtccgtgctaaggacttg

SEQ ID NO: 2265066 - DNA, 12 bp, Homo sapiens
atgttaaaccat

SEQ ID NO: 2265067 - DNA, 20 bp, Homo sapiens
atgttaaaccatgggataaa

SEQ ID NO: 2265068 - DNA, 18 bp, Homo sapiens
atgtttattacagtataa

SEQ ID NO: 2265069 - DNA, 22 bp, Homo sapiens
atgtttattacagtataattaa

SEQ ID NO: 2265070 - DNA, 12 bp, Homo sapiens
attaaagccatg

SEQ ID NO: 2265071 - DNA, 17 bp, Homo sapiens
attaaagccatgtttat

SEQ ID NO: 2265072 - DNA, 14 bp, Homo sapiens
attaacatgttaaa

SEQ ID NO: 2265073 - DNA, 15 bp, Homo sapiens
attaacatgttaaac

SEQ ID NO: 2265074 - DNA, 21 bp, Homo sapiens
attagaattctgtatagatta

SEQ ID NO: 2265075 - DNA, 16 bp, Homo sapiens
attagagagtgttgaa

SEQ ID NO: 2265076 - DNA, 18 bp, Homo sapiens
attagagagtgttgaaac

SEQ ID NO: 2265077 - DNA, 19 bp, Homo sapiens
attagagagtgttgaaacg

SEQ ID NO: 2265078 - DNA, 22 bp, Homo sapiens
attatatctgaggaattctgta

SEQ ID NO: 2265079 - DNA, 16 bp, Homo sapiens
attatatgctatttct

SEQ ID NO: 2265080 - DNA, 17 bp, Homo sapiens
attatatgctatttcta

SEQ ID NO: 2265081 - DNA, 18 bp, Homo sapiens
attatatgctatttctat

SEQ ID NO: 2265082 - DNA, 14 bp, Homo sapiens
attattcaaagttg

SEQ ID NO: 2265083 - DNA, 17 bp, Homo sapiens
attattcaaagttgcct

SEQ ID NO: 2265084 - DNA, 24 bp, Homo sapiens
attattcaaagttgcctaaatcca

SEQ ID NO: 2265085 - DNA, 19 bp, Homo sapiens
attattcactgatttgaca

SEQ ID NO: 2265086 - DNA, 22 bp, Homo sapiens
attattttattatgaaacttgt

SEQ ID NO: 2265087 - DNA, 21 bp, Homo sapiens
attcaaagttgcctaaatcca

SEQ ID NO: 2265088 - DNA, 21 bp, Homo sapiens
attctcctatcacctgtcttg

SEQ ID NO: 2265089 - DNA, 15 bp, Homo sapiens
attctgtatagatta

SEQ ID NO: 2265090 - DNA, 21 bp, Homo sapiens
attctgtatagattagaattc

SEQ ID NO: 2265091 - DNA, 14 bp, Homo sapiens
attcttaaagttga

SEQ ID NO: 2265092 - DNA, 23 bp, Homo sapiens
attcttcagcaaaaatattttat

SEQ ID NO: 2265093 - DNA, 16 bp, Homo sapiens
attggcttttctgatc

SEQ ID NO: 2265094 - DNA, 20 bp, Homo sapiens
attggcttttctgatccagt

SEQ ID NO: 2265095 - DNA, 15 bp, Homo sapiens
attggggattcttaa

SEQ ID NO: 2265096 - DNA, 20 bp, Homo sapiens
attggggattcttaaagttg

SEQ ID NO: 2265097 - DNA, 22 bp, Homo sapiens
attggtgttgtactcaatttta

SEQ ID NO: 2265098 - DNA, 13 bp, Homo sapiens
attgtaattatat

SEQ ID NO: 2265099 - DNA, 16 bp, Homo sapiens
attgtacaaagtatta

SEQ ID NO: 2265100 - DNA, 23 bp, Homo sapiens
attgtacaaagtattaagcatat

SEQ ID NO: 2265101 - DNA, 23 bp, Homo sapiens
attgtgcgctaaacttttctgat

SEQ ID NO: 2265102 - DNA, 18 bp, Homo sapiens
atttaataattatatgct

SEQ ID NO: 2265103 - DNA, 15 bp, Homo sapiens
atttactaaaatgga

SEQ ID NO: 2265104 - DNA, 14 bp, Homo sapiens
atttattggctttt

SEQ ID NO: 2265105 - DNA, 18 bp, Homo sapiens
atttattggcttttctga

SEQ ID NO: 2265106 - DNA, 17 bp, Homo sapiens
atttctatattttcatt

SEQ ID NO: 2265107 - DNA, 19 bp, Homo sapiens
atttctatattttcattct

SEQ ID NO: 2265108 - DNA, 13 bp, Homo sapiens
atttgaattttgt

SEQ ID NO: 2265109 - DNA, 16 bp, Homo sapiens
atttgacatagtctgg

SEQ ID NO: 2265110 - DNA, 21 bp, Homo sapiens
atttgacatagtctggctgta

SEQ ID NO: 2265111 - DNA, 17 bp, Homo sapiens
atttggaaatctttaaa

SEQ ID NO: 2265112 - DNA, 14 bp, Homo sapiens
attttatgatccag

SEQ ID NO: 2265113 - DNA, 15 bp, Homo sapiens
attttatgatccagc

SEQ ID NO: 2265114 - DNA, 16 bp, Homo sapiens
attttatgatccagca

SEQ ID NO: 2265115 - DNA, 17 bp, Homo sapiens
attttattatgtaaatc

SEQ ID NO: 2265116 - DNA, 21 bp, Homo sapiens
attttattatgtaaatcccat

SEQ ID NO: 2265117 - DNA, 17 bp, Homo sapiens
attttcctcctttctct

SEQ ID NO: 2265118 - DNA, 15 bp, Homo sapiens
atttttatatttact

SEQ ID NO: 2265119 - DNA, 18 bp, Homo sapiens
caaaaaccagtattgtac

SEQ ID NO: 2265120 - DNA, 14 bp, Homo sapiens
caaaaatattttat

SEQ ID NO: 2265121 - DNA, 16 bp, Homo sapiens
caaagtattaagcata

SEQ ID NO: 2265122 - DNA, 17 bp, Homo sapiens
caaagtattaagcatat

SEQ ID NO: 2265123 - DNA, 21 bp, Homo sapiens
caaagtattaagcatatattt

SEQ ID NO: 2265124 - DNA, 19 bp, Homo sapiens
caaagttgcctaaatccat

SEQ ID NO: 2265125 - DNA, 16 bp, Homo sapiens
caattttgtttctgta

SEQ ID NO: 2265126 - DNA, 23 bp, Homo sapiens
cacggtgaatggctttgtataga

SEQ ID NO: 2265127 - DNA, 14 bp, Homo sapiens
cagatctgcctaag

SEQ ID NO: 2265128 - DNA, 16 bp, Homo sapiens
cagatctgcctaagga

SEQ ID NO: 2265129 - DNA, 23 bp, Homo sapiens
cagatctgcctaaggacttcttt

SEQ ID NO: 2265130 - DNA, 18 bp, Homo sapiens
cagattattcactgattt

SEQ ID NO: 2265131 - DNA, 18 bp, Homo sapiens
cagattttattatgtaaa

SEQ ID NO: 2265132 - DNA, 19 bp, Homo sapiens
cagctggtgccctgctttc

SEQ ID NO: 2265133 - DNA, 14 bp, Homo sapiens
cagtataattaaca

SEQ ID NO: 2265134 - DNA, 17 bp, Homo sapiens
cagtataattaacatgt

SEQ ID NO: 2265135 - DNA, 16 bp, Homo sapiens
cagtattgtacaaagt

SEQ ID NO: 2265136 - DNA, 18 bp, Homo sapiens
cagtattgtacaaagtat

SEQ ID NO: 2265137 - DNA, 21 bp, Homo sapiens
cagttttgtttggaccaaaaa

SEQ ID NO: 2265138 - DNA, 22 bp, Homo sapiens
cataaatctgtgaacttgaaat

SEQ ID NO: 2265139 - DNA, 20 bp, Homo sapiens
catatatttttatatttact

SEQ ID NO: 2265140 - DNA, 19 bp, Homo sapiens
catggaacgcgttgaaatt

SEQ ID NO: 2265141 - DNA, 13 bp, Homo sapiens
catgtttattaca

SEQ ID NO: 2265142 - DNA, 20 bp, Homo sapiens
catgtttattacagtataat

SEQ ID NO: 2265143 - DNA, 23 bp, Homo sapiens
catgtttattacagtataattaa

SEQ ID NO: 2265144 - DNA, 18 bp, Homo sapiens
cattattcaaagttgcct

SEQ ID NO: 2265145 - DNA, 14 bp, Homo sapiens
cattattttattat

SEQ ID NO: 2265146 - DNA, 16 bp, Homo sapiens
cattattttattatga

SEQ ID NO: 2265147 - DNA, 21 bp, Homo sapiens
cattctcctatcacctgtctt

SEQ ID NO: 2265148 - DNA, 14 bp, Homo sapiens
catttaataattat

SEQ ID NO: 2265149 - DNA, 22 bp, Homo sapiens
catttggaaatctttaaaaaaa

SEQ ID NO: 2265150 - DNA, 22 bp, Homo sapiens
ccagtattgtacaaagtattaa

SEQ ID NO: 2265151 - DNA, 19 bp, Homo sapiens
ccatcaataaaaaattatg

SEQ ID NO: 2265152 - DNA, 13 bp, Homo sapiens
ccatgtttattac

SEQ ID NO: 2265153 - DNA, 20 bp, Homo sapiens
ccatgtttattacagtataa

SEQ ID NO: 2265154 - DNA, 14 bp, Homo sapiens
ccattattcaaagt

SEQ ID NO: 2265155 - DNA, 17 bp, Homo sapiens
ccattattcaaagttgc

SEQ ID NO: 2265156 - DNA, 13 bp, Homo sapiens
ccatttggaaatc

SEQ ID NO: 2265157 - DNA, 18 bp, Homo sapiens
cccattattcaaagttgc

SEQ ID NO: 2265158 - DNA, 23 bp, Homo sapiens
cccattattcaaagttgcctaaa

SEQ ID NO: 2265159 - DNA, 16 bp, Homo sapiens
ccgtgctaaggacttg

SEQ ID NO: 2265160 - DNA, 12 bp, Homo sapiens
cctaaatccatt

SEQ ID NO: 2265161 - DNA, 20 bp, Homo sapiens
cctaaatccatttggaaatc

SEQ ID NO: 2265162 - DNA, 21 bp, Homo sapiens
cctcacccacccttttttaaa

SEQ ID NO: 2265163 - DNA, 13 bp, Homo sapiens
cctgattaaagaa

SEQ ID NO: 2265164 - DNA, 20 bp, Homo sapiens
cctgcacggtgaatggcttt

SEQ ID NO: 2265165 - DNA, 21 bp, Homo sapiens
cctgcacggtgaatggctttg

SEQ ID NO: 2265166 - DNA, 16 bp, Homo sapiens
cctgctttcagatact

SEQ ID NO: 2265167 - DNA, 20 bp, Homo sapiens
cctgtcttgcctttttcatt

SEQ ID NO: 2265168 - DNA, 16 bp, Homo sapiens
cctttctctttcgtta

SEQ ID NO: 2265169 - DNA, 21 bp, Homo sapiens
cgcgttgaaattgtaattata

SEQ ID NO: 2265170 - DNA, 18 bp, Homo sapiens
cgctaaacttttctgata

SEQ ID NO: 2265171 - DNA, 13 bp, Homo sapiens
cggtgaatggctt

SEQ ID NO: 2265172 - DNA, 14 bp, Homo sapiens
cggtgaatggcttt

SEQ ID NO: 2265173 - DNA, 16 bp, Homo sapiens
cggtgaatggctttgt

SEQ ID NO: 2265174 - DNA, 22 bp, Homo sapiens
cggtgaatggctttgtatagaa

SEQ ID NO: 2265175 - DNA, 12 bp, Homo sapiens
cgtgctaaggac

SEQ ID NO: 2265176 - DNA, 21 bp, Homo sapiens
cgttcatggaacgcgttgaaa

SEQ ID NO: 2265177 - DNA, 22 bp, Homo sapiens
cgttcatggaacgcgttgaaat

SEQ ID NO: 2265178 - DNA, 23 bp, Homo sapiens
cgttcatggaacgcgttgaaatt

SEQ ID NO: 2265179 - DNA, 13 bp, Homo sapiens
cgttgaaattgta

SEQ ID NO: 2265180 - DNA, 16 bp, Homo sapiens
ctaaacttttctgata

SEQ ID NO: 2265181 - DNA, 16 bp, Homo sapiens
ctaaatccatttggaa

SEQ ID NO: 2265182 - DNA, 15 bp, Homo sapiens
ctagactggtgactg

SEQ ID NO: 2265183 - DNA, 23 bp, Homo sapiens
ctagactggtgactgattcttca

SEQ ID NO: 2265184 - DNA, 15 bp, Homo sapiens
ctatattttcattct

SEQ ID NO: 2265185 - DNA, 19 bp, Homo sapiens
ctatattttcattctccta

SEQ ID NO: 2265186 - DNA, 15 bp, Homo sapiens
ctatgctgagtttgt

SEQ ID NO: 2265187 - DNA, 13 bp, Homo sapiens
ctcagattttatt

SEQ ID NO: 2265188 - DNA, 20 bp, Homo sapiens
ctccatttaataattatatg

SEQ ID NO: 2265189 - DNA, 18 bp, Homo sapiens
ctcctatcacctgtcttg

SEQ ID NO: 2265190 - DNA, 13 bp, Homo sapiens
ctcctttctcttt

SEQ ID NO: 2265191 - DNA, 13 bp, Homo sapiens
ctctccatttaat

SEQ ID NO: 2265192 - DNA, 23 bp, Homo sapiens
ctctttgtctacaccattatgtg

SEQ ID NO: 2265193 - DNA, 14 bp, Homo sapiens
ctgaagtcagatct

SEQ ID NO: 2265194 - DNA, 13 bp, Homo sapiens
ctgagtttgtgct

SEQ ID NO: 2265195 - DNA, 18 bp, Homo sapiens
ctgagtttgtgctggtgt

SEQ ID NO: 2265196 - DNA, 20 bp, Homo sapiens
ctgatagaggaagcctgatt

SEQ ID NO: 2265197 - DNA, 20 bp, Homo sapiens
ctgatccagttttgtttgga

SEQ ID NO: 2265198 - DNA, 14 bp, Homo sapiens
ctgcacggtgaatg

SEQ ID NO: 2265199 - DNA, 13 bp, Homo sapiens
ctgcctaaggact

SEQ ID NO: 2265200 - DNA, 15 bp, Homo sapiens
ctggtgactgattct

SEQ ID NO: 2265201 - DNA, 17 bp, Homo sapiens
ctggtgactgattcttc

SEQ ID NO: 2265202 - DNA, 15 bp, Homo sapiens
ctggtgccctgcttt

SEQ ID NO: 2265203 - DNA, 16 bp, Homo sapiens
ctggtgccctgctttc

SEQ ID NO: 2265204 - DNA, 19 bp, Homo sapiens
ctggtgccctgctttcaga

SEQ ID NO: 2265205 - DNA, 23 bp, Homo sapiens
ctggtgccctgctttcagatact

SEQ ID NO: 2265206 - DNA, 14 bp, Homo sapiens
ctgtactttttggc

SEQ ID NO: 2265207 - DNA, 16 bp, Homo sapiens
ctgtatagattagaat

SEQ ID NO: 2265208 - DNA, 21 bp, Homo sapiens
ctgtcttgcctttttcattat

SEQ ID NO: 2265209 - DNA, 18 bp, Homo sapiens
ctgtgaacttgaaatttg

SEQ ID NO: 2265210 - DNA, 13 bp, Homo sapiens
ctgtggtgacttt

SEQ ID NO: 2265211 - DNA, 14 bp, Homo sapiens
ctgtggtgactttg

SEQ ID NO: 2265212 - DNA, 20 bp, Homo sapiens
ctgtggtgactttggataat

SEQ ID NO: 2265213 - DNA, 15 bp, Homo sapiens
cttaaagttgaattt

SEQ ID NO: 2265214 - DNA, 23 bp, Homo sapiens
cttcagcaaaaatattttatgat

SEQ ID NO: 2265215 - DNA, 15 bp, Homo sapiens
cttgcctttttcatt

SEQ ID NO: 2265216 - DNA, 23 bp, Homo sapiens
cttgcctttttcattattttatt

SEQ ID NO: 2265217 - DNA, 13 bp, Homo sapiens
cttgtctcagatt

SEQ ID NO: 2265218 - DNA, 22 bp, Homo sapiens
cttgttagatctagttcactct

SEQ ID NO: 2265219 - DNA, 17 bp, Homo sapiens
ctttaaaaaaaaaattg

SEQ ID NO: 2265220 - DNA, 14 bp, Homo sapiens
ctttaattttggaa

SEQ ID NO: 2265221 - DNA, 11 bp, Homo sapiens
ctttgtataga

SEQ ID NO: 2265222 - DNA, 20 bp, Homo sapiens
ctttgtatagaacctctttg

SEQ ID NO: 2265223 - DNA, 22 bp, Homo sapiens
ctttgtgctggggttatctgaa

SEQ ID NO: 2265224 - DNA, 16 bp, Homo sapiens
cttttctgatccagtt

SEQ ID NO: 2265225 - DNA, 18 bp, Homo sapiens
cttttctgatccagtttt

SEQ ID NO: 2265226 - DNA, 13 bp, Homo sapiens
ctttttcattatt

SEQ ID NO: 2265227 - DNA, 22 bp, Homo sapiens
gaaaagtttaatattaaagcca

SEQ ID NO: 2265228 - DNA, 16 bp, Homo sapiens
gaaacggatgatttct

SEQ ID NO: 2265229 - DNA, 17 bp, Homo sapiens
gaaacggatgatttcta

SEQ ID NO: 2265230 - DNA, 14 bp, Homo sapiens
gaaacttgtgtaaa

SEQ ID NO: 2265231 - DNA, 17 bp, Homo sapiens
gaaattgtaattatatc

SEQ ID NO: 2265232 - DNA, 13 bp, Homo sapiens
gaaatttgaattt

SEQ ID NO: 2265233 - DNA, 16 bp, Homo sapiens
gaacgcgttgaaattg

SEQ ID NO: 2265234 - DNA, 22 bp, Homo sapiens
gaacttgaaatttgaattttgt

SEQ ID NO: 2265235 - DNA, 14 bp, Homo sapiens
gaagtcagatctgc

SEQ ID NO: 2265236 - DNA, 22 bp, Homo sapiens
gaagtcagatctgcctaaggac

SEQ ID NO: 2265237 - DNA, 23 bp, Homo sapiens
gaagtcagatctgcctaaggact

SEQ ID NO: 2265238 - DNA, 21 bp, Homo sapiens
gaatggctttgtatagaacct

SEQ ID NO: 2265239 - DNA, 14 bp, Homo sapiens
gaattctgtataga

SEQ ID NO: 2265240 - DNA, 16 bp, Homo sapiens
gaatttattggctttt

SEQ ID NO: 2265241 - DNA, 20 bp, Homo sapiens
gaatttattggcttttctga

SEQ ID NO: 2265242 - DNA, 13 bp, Homo sapiens
gaccaaaaaccag

SEQ ID NO: 2265243 - DNA, 12 bp, Homo sapiens
gactggtgactg

SEQ ID NO: 2265244 - DNA, 17 bp, Homo sapiens
gactgtggtgactttgg

SEQ ID NO: 2265245 - DNA, 16 bp, Homo sapiens
gacttctttaattttg

SEQ ID NO: 2265246 - DNA, 18 bp, Homo sapiens
gacttctttaattttgga

SEQ ID NO: 2265247 - DNA, 21 bp, Homo sapiens
gacttctttaattttggaatt

SEQ ID NO: 2265248 - DNA, 22 bp, Homo sapiens
gagcctgcacggtgaatggctt

SEQ ID NO: 2265249 - DNA, 18 bp, Homo sapiens
gaggaagcctgattaaag

SEQ ID NO: 2265250 - DNA, 19 bp, Homo sapiens
gaggaagcctgattaaaga

SEQ ID NO: 2265251 - DNA, 11 bp, Homo sapiens
gataaatgcca

SEQ ID NO: 2265252 - DNA, 20 bp, Homo sapiens
gatactggattgtactttgt

SEQ ID NO: 2265253 - DNA, 15 bp, Homo sapiens
gatagaggaagcctg

SEQ ID NO: 2265254 - DNA, 18 bp, Homo sapiens
gatccagcagattattca

SEQ ID NO: 2265255 - DNA, 15 bp, Homo sapiens
gatctgcctaaggac

SEQ ID NO: 2265256 - DNA, 21 bp, Homo sapiens
gatctgcctaaggacttcttt

SEQ ID NO: 2265257 - DNA, 23 bp, Homo sapiens
gatctgcctaaggacttctttaa

SEQ ID NO: 2265258 - DNA, 12 bp, Homo sapiens
gatgatttctat

SEQ ID NO: 2265259 - DNA, 14 bp, Homo sapiens
gattagaattctgt

SEQ ID NO: 2265260 - DNA, 15 bp, Homo sapiens
gattattcactgatt

SEQ ID NO: 2265261 - DNA, 16 bp, Homo sapiens
gattattcactgattt

SEQ ID NO: 2265262 - DNA, 15 bp, Homo sapiens
gattcttaaagttga

SEQ ID NO: 2265263 - DNA, 13 bp, Homo sapiens
gattttattatgt

SEQ ID NO: 2265264 - DNA, 18 bp, Homo sapiens
gattttattatgtaaatc

SEQ ID NO: 2265265 - DNA, 20 bp, Homo sapiens
gattttattatgtaaatccc

SEQ ID NO: 2265266 - DNA, 17 bp, Homo sapiens
gcaaaaatattttatga

SEQ ID NO: 2265267 - DNA, 16 bp, Homo sapiens
gcagattattcactga

SEQ ID NO: 2265268 - DNA, 13 bp, Homo sapiens
gcataacataaat

SEQ ID NO: 2265269 - DNA, 11 bp, Homo sapiens
gcatatatttt

SEQ ID NO: 2265270 - DNA, 14 bp, Homo sapiens
gccctgctttcaga

SEQ ID NO: 2265271 - DNA, 12 bp, Homo sapiens
gcctaaggactt

SEQ ID NO: 2265272 - DNA, 13 bp, Homo sapiens
gcctaaggacttc

SEQ ID NO: 2265273 - DNA, 14 bp, Homo sapiens
gcctaaggacttct

SEQ ID NO: 2265274 - DNA, 15 bp, Homo sapiens
gcctaaggacttctt

SEQ ID NO: 2265275 - DNA, 13 bp, Homo sapiens
gcctgattaaaga

SEQ ID NO: 2265276 - DNA, 12 bp, Homo sapiens
gcctttttcatt

SEQ ID NO: 2265277 - DNA, 16 bp, Homo sapiens
gcctttttcattattt

SEQ ID NO: 2265278 - DNA, 23 bp, Homo sapiens
gcgttgaaattgtaattatatct

SEQ ID NO: 2265279 - DNA, 15 bp, Homo sapiens
gctaaacttttctga

SEQ ID NO: 2265280 - DNA, 11 bp, Homo sapiens
gctaaggactt

SEQ ID NO: 2265281 - DNA, 12 bp, Homo sapiens
gctaaggacttg

SEQ ID NO: 2265282 - DNA, 19 bp, Homo sapiens
gctagactggtgactgatt

SEQ ID NO: 2265283 - DNA, 11 bp, Homo sapiens
gctatttctat

SEQ ID NO: 2265284 - DNA, 14 bp, Homo sapiens
gctggggttatctg

SEQ ID NO: 2265285 - DNA, 23 bp, Homo sapiens
gctggggttatctgaagtcagat

SEQ ID NO: 2265286 - DNA, 12 bp, Homo sapiens
gctttgtataga

SEQ ID NO: 2265287 - DNA, 13 bp, Homo sapiens
gctttgtatagaa

SEQ ID NO: 2265288 - DNA, 16 bp, Homo sapiens
gcttttctgatccagt

SEQ ID NO: 2265289 - DNA, 19 bp, Homo sapiens
ggaaaagtttaatattaaa

SEQ ID NO: 2265290 - DNA, 17 bp, Homo sapiens
ggaacgcgttgaaattg

SEQ ID NO: 2265291 - DNA, 17 bp, Homo sapiens
ggaattctgtatagatt

SEQ ID NO: 2265292 - DNA, 21 bp, Homo sapiens
ggactgtggtgactttggata

SEQ ID NO: 2265293 - DNA, 22 bp, Homo sapiens
ggactgtggtgactttggataa

SEQ ID NO: 2265294 - DNA, 12 bp, Homo sapiens
ggacttgttaga

SEQ ID NO: 2265295 - DNA, 15 bp, Homo sapiens
ggacttgttagatct

SEQ ID NO: 2265296 - DNA, 19 bp, Homo sapiens
ggattcttaaagttgaatt

SEQ ID NO: 2265297 - DNA, 16 bp, Homo sapiens
ggcttttctgatccag

SEQ ID NO: 2265298 - DNA, 11 bp, Homo sapiens
ggggattctta

SEQ ID NO: 2265299 - DNA, 15 bp, Homo sapiens
ggggattcttaaagt

SEQ ID NO: 2265300 - DNA, 16 bp, Homo sapiens
ggtccgtgctaaggac

SEQ ID NO: 2265301 - DNA, 18 bp, Homo sapiens
ggtgactttggataataa

SEQ ID NO: 2265302 - DNA, 21 bp, Homo sapiens
ggtgactttggataataagga

SEQ ID NO: 2265303 - DNA, 16 bp, Homo sapiens
ggtgtatgtgtgaagt

SEQ ID NO: 2265304 - DNA, 19 bp, Homo sapiens
ggtgttgtactcaatttta

SEQ ID NO: 2265305 - DNA, 15 bp, Homo sapiens
gtaaatcccattatt

SEQ ID NO: 2265306 - DNA, 22 bp, Homo sapiens
tcttaaagttgaatttattggc

SEQ ID NO: 2265307 - DNA, 21 bp, Homo sapiens
tcttcagcaaaaatattttat

SEQ ID NO: 2265308 - DNA, 19 bp, Homo sapiens
tcttgcctttttcattatt

SEQ ID NO: 2265309 - DNA, 14 bp, Homo sapiens
tcttgtctcagatt

SEQ ID NO: 2265310 - DNA, 17 bp, Homo sapiens
tcttgtctcagatttta

SEQ ID NO: 2265311 - DNA, 19 bp, Homo sapiens
tcttgtctcagattttatt

SEQ ID NO: 2265312 - DNA, 18 bp, Homo sapiens
tctttaaaaaaaaaattg

SEQ ID NO: 2265313 - DNA, 19 bp, Homo sapiens
tctttaaaaaaaaaattgg

SEQ ID NO: 2265314 - DNA, 13 bp, Homo sapiens
tctttaattttgg

SEQ ID NO: 2265315 - DNA, 18 bp, Homo sapiens
tctttaattttggaattt

SEQ ID NO: 2265316 - DNA, 17 bp, Homo sapiens
tctttgtctacaccatt

SEQ ID NO: 2265317 - DNA, 17 bp, Homo sapiens
tgaaacttgtgtaaata

SEQ ID NO: 2265318 - DNA, 14 bp, Homo sapiens
tgaaattgtaatta

SEQ ID NO: 2265319 - DNA, 16 bp, Homo sapiens
tgaaattgtaattata

SEQ ID NO: 2265320 - DNA, 15 bp, Homo sapiens
tgaatggctttgtat

SEQ ID NO: 2265321 - DNA, 19 bp, Homo sapiens
tgaatggctttgtatagaa

SEQ ID NO: 2265322 - DNA, 15 bp, Homo sapiens
tgaatttattggctt

SEQ ID NO: 2265323 - DNA, 23 bp, Homo sapiens
tgaatttattggcttttctgatc

SEQ ID NO: 2265324 - DNA, 17 bp, Homo sapiens
tgacatagtctggctgt

SEQ ID NO: 2265325 - DNA, 16 bp, Homo sapiens
tgactgattcttcagc

SEQ ID NO: 2265326 - DNA, 14 bp, Homo sapiens
tgactttggataat

SEQ ID NO: 2265327 - DNA, 16 bp, Homo sapiens
tgactttggataataa

SEQ ID NO: 2265328 - DNA, 14 bp, Homo sapiens
tgaggaattctgta

SEQ ID NO: 2265329 - DNA, 15 bp, Homo sapiens
tgaggaattctgtat

SEQ ID NO: 2265330 - DNA, 16 bp, Homo sapiens
tgaggaattctgtata

SEQ ID NO: 2265331 - DNA, 22 bp, Homo sapiens
tgatccagcagattattcactg

SEQ ID NO: 2265332 - DNA, 16 bp, Homo sapiens
tgatttctatgctgag

SEQ ID NO: 2265333 - DNA, 22 bp, Homo sapiens
tgccatcaataaaaaattatga

SEQ ID NO: 2265334 - DNA, 17 bp, Homo sapiens
tgccctgctttcagata

SEQ ID NO: 2265335 - DNA, 13 bp, Homo sapiens
tgcctaaatccat

SEQ ID NO: 2265336 - DNA, 12 bp, Homo sapiens
tgcctaaggact

SEQ ID NO: 2265337 - DNA, 14 bp, Homo sapiens
tgcctaaggacttc

SEQ ID NO: 2265338 - DNA, 21 bp, Homo sapiens
tgcctaaggacttctttaatt

SEQ ID NO: 2265339 - DNA, 23 bp, Homo sapiens
tgcctcacccacccttttttaaa

SEQ ID NO: 2265340 - DNA, 13 bp, Homo sapiens
tgctaaggacttg

SEQ ID NO: 2265341 - DNA, 18 bp, Homo sapiens
tgctaaggacttgttaga

SEQ ID NO: 2265342 - DNA, 15 bp, Homo sapiens
tgctgagtttgtgct

SEQ ID NO: 2265343 - DNA, 20 bp, Homo sapiens
tgctggggttatctgaagtc

SEQ ID NO: 2265344 - DNA, 22 bp, Homo sapiens
tgctggtgtatgtgtgaagtga

SEQ ID NO: 2265345 - DNA, 14 bp, Homo sapiens
tggaaatctttaaa

SEQ ID NO: 2265346 - DNA, 14 bp, Homo sapiens
tggaacgcgttgaa

SEQ ID NO: 2265347 - DNA, 15 bp, Homo sapiens
tggaacgcgttgaaa

SEQ ID NO: 2265348 - DNA, 17 bp, Homo sapiens
tggaacgcgttgaaatt

SEQ ID NO: 2265349 - DNA, 18 bp, Homo sapiens
tggaacgcgttgaaattg

SEQ ID NO: 2265350 - DNA, 17 bp, Homo sapiens
tggaccaaaaaccagta

SEQ ID NO: 2265351 - DNA, 22 bp, Homo sapiens
tggactgtggtgactttggata

SEQ ID NO: 2265352 - DNA, 23 bp, Homo sapiens
tggagcctgcacggtgaatggct

SEQ ID NO: 2265353 - DNA, 15 bp, Homo sapiens
tggctgtacccagga

SEQ ID NO: 2265354 - DNA, 22 bp, Homo sapiens
tggctttgtatagaacctcttt

SEQ ID NO: 2265355 - DNA, 14 bp, Homo sapiens
tggcttttctgatc

SEQ ID NO: 2265356 - DNA, 12 bp, Homo sapiens
tgggataaatgc

SEQ ID NO: 2265357 - DNA, 18 bp, Homo sapiens
tggggattcttaaagttg

SEQ ID NO: 2265358 - DNA, 17 bp, Homo sapiens
tggtccgtgctaaggac

SEQ ID NO: 2265359 - DNA, 18 bp, Homo sapiens
tggtccgtgctaaggact

SEQ ID NO: 2265360 - DNA, 19 bp, Homo sapiens
tggtccgtgctaaggactt

SEQ ID NO: 2265361 - DNA, 15 bp, Homo sapiens
tggtgactttggata

SEQ ID NO: 2265362 - DNA, 16 bp, Homo sapiens
tggtgactttggataa

SEQ ID NO: 2265363 - DNA, 18 bp, Homo sapiens
tggtgactttggataata

SEQ ID NO: 2265364 - DNA, 23 bp, Homo sapiens
tggtgactttggataataaggaa

SEQ ID NO: 2265365 - DNA, 14 bp, Homo sapiens
tggtgccctgcttt

SEQ ID NO: 2265366 - DNA, 15 bp, Homo sapiens
tgtaaatacaatttt

SEQ ID NO: 2265367 - DNA, 21 bp, Homo sapiens
tgtaaatacaattttgtttct

SEQ ID NO: 2265368 - DNA, 13 bp, Homo sapiens
tgtaaatcccatt

SEQ ID NO: 2265369 - DNA, 22 bp, Homo sapiens
tgtaaatcccattattcaaagt

SEQ ID NO: 2265370 - DNA, 15 bp, Homo sapiens
tgtaattatatctga

SEQ ID NO: 2265371 - DNA, 14 bp, Homo sapiens
tgtacaaagtatta

SEQ ID NO: 2265372 - DNA, 15 bp, Homo sapiens
tgtacaaagtattaa

SEQ ID NO: 2265373 - DNA, 12 bp, Homo sapiens
tgtactttttgg

SEQ ID NO: 2265374 - DNA, 13 bp, Homo sapiens
tgtatgtgtgaag

SEQ ID NO: 2265375 - DNA, 21 bp, Homo sapiens
tgtattgtgcgctaaactttt

SEQ ID NO: 2265376 - DNA, 20 bp, Homo sapiens
tgtctcagattttattatgt

SEQ ID NO: 2265377 - DNA, 22 bp, Homo sapiens
tgtctcagattttattatgtaa

SEQ ID NO: 2265378 - DNA, 16 bp, Homo sapiens
tgtcttgcctttttca

SEQ ID NO: 2265379 - DNA, 19 bp, Homo sapiens
tgtgctggggttatctgaa

SEQ ID NO: 2265380 - DNA, 20 bp, Homo sapiens
tgtgctggtgtatgtgtgaa

SEQ ID NO: 2265381 - DNA, 23 bp, Homo sapiens
tgttaaaccatgggataaatgcc

SEQ ID NO: 2265382 - DNA, 16 bp, Homo sapiens
tgttagatctagttca

SEQ ID NO: 2265383 - DNA, 17 bp, Homo sapiens
tgtttagtcttgtctca

SEQ ID NO: 2265384 - DNA, 20 bp, Homo sapiens
tgtttagtcttgtctcagat

SEQ ID NO: 2265385 - DNA, 18 bp, Homo sapiens
tgtttattacagtataat

SEQ ID NO: 2265386 - DNA, 11 bp, Homo sapiens
tgtttctgtac

SEQ ID NO: 2265387 - DNA, 22 bp, Homo sapiens
tgtttctgtactttttggcata

SEQ ID NO: 2265388 - DNA, 17 bp, Homo sapiens
ttaaaccatgggataaa

SEQ ID NO: 2265389 - DNA, 21 bp, Homo sapiens
ttaaaccatgggataaatgcc

SEQ ID NO: 2265390 - DNA, 22 bp, Homo sapiens
ttaaagttgaatttattggctt

SEQ ID NO: 2265391 - DNA, 14 bp, Homo sapiens
ttaacaacagctgg

SEQ ID NO: 2265392 - DNA, 13 bp, Homo sapiens
ttaagcatatatt

SEQ ID NO: 2265393 - DNA, 15 bp, Homo sapiens
ttaagcatatatttt

SEQ ID NO: 2265394 - DNA, 23 bp, Homo sapiens
ttaagcatatatttttatattta

SEQ ID NO: 2265395 - DNA, 13 bp, Homo sapiens
ttaatattaaagc

SEQ ID NO: 2265396 - DNA, 18 bp, Homo sapiens
ttaatattaaagccatgt

SEQ ID NO: 2265397 - DNA, 19 bp, Homo sapiens
ttaatattaaagccatgtt

SEQ ID NO: 2265398 - DNA, 20 bp, Homo sapiens
ttaatattaaagccatgttt

SEQ ID NO: 2265399 - DNA, 17 bp, Homo sapiens
ttacagtataattaaca

SEQ ID NO: 2265400 - DNA, 15 bp, Homo sapiens
ttactaaaatggact

SEQ ID NO: 2265401 - DNA, 17 bp, Homo sapiens
ttactaaaatggactgt

SEQ ID NO: 2265402 - DNA, 18 bp, Homo sapiens
ttactaaaatggactgtg

SEQ ID NO: 2265403 - DNA, 13 bp, Homo sapiens
ttagatctagttc

SEQ ID NO: 2265404 - DNA, 14 bp, Homo sapiens
ttatatctgaggaa

SEQ ID NO: 2265405 - DNA, 20 bp, Homo sapiens
ttatatctgaggaattctgt

SEQ ID NO: 2265406 - DNA, 21 bp, Homo sapiens
ttatatctgaggaattctgta

SEQ ID NO: 2265407 - DNA, 18 bp, Homo sapiens
ttatatgctatttctata

SEQ ID NO: 2265408 - DNA, 17 bp, Homo sapiens
ttatctgaagtcagatc

SEQ ID NO: 2265409 - DNA, 13 bp, Homo sapiens
ttatgaaacttgt

SEQ ID NO: 2265410 - DNA, 23 bp, Homo sapiens
ttatgtaaatcccattattcaaa

SEQ ID NO: 2265411 - DNA, 17 bp, Homo sapiens
ttattatgaaacttgtg

SEQ ID NO: 2265412 - DNA, 22 bp, Homo sapiens
ttattatgaaacttgtgtaaat

SEQ ID NO: 2265413 - DNA, 13 bp, Homo sapiens
ttattatgtaaat

SEQ ID NO: 2265414 - DNA, 20 bp, Homo sapiens
ttattttattatgaaacttg

SEQ ID NO: 2265415 - DNA, 23 bp, Homo sapiens
ttcaaagttgcctaaatccattt

SEQ ID NO: 2265416 - DNA, 16 bp, Homo sapiens
ttcagatactggattg

SEQ ID NO: 2265417 - DNA, 21 bp, Homo sapiens
ttcagcaaaaatattttatga

SEQ ID NO: 2265418 - DNA, 21 bp, Homo sapiens
ttcatggaacgcgttgaaatt

SEQ ID NO: 2265419 - DNA, 22 bp, Homo sapiens
ttcatggaacgcgttgaaattg

SEQ ID NO: 2265420 - DNA, 22 bp, Homo sapiens
ttcattattttattatgaaact

SEQ ID NO: 2265421 - DNA, 15 bp, Homo sapiens
ttctatattttcatt

SEQ ID NO: 2265422 - DNA, 13 bp, Homo sapiens
ttctgtacttttt

SEQ ID NO: 2265423 - DNA, 18 bp, Homo sapiens
ttctgtactttttggcat

SEQ ID NO: 2265424 - DNA, 17 bp, Homo sapiens
ttctttaattttggaat

SEQ ID NO: 2265425 - DNA, 19 bp, Homo sapiens
ttgaaacggatgatttcta

SEQ ID NO: 2265426 - DNA, 20 bp, Homo sapiens
ttgaaacggatgatttctat

SEQ ID NO: 2265427 - DNA, 21 bp, Homo sapiens
ttgaaacggatgatttctatg

SEQ ID NO: 2265428 - DNA, 15 bp, Homo sapiens
ttgaaattgtaatta

SEQ ID NO: 2265429 - DNA, 22 bp, Homo sapiens
ttgcctaaatccatttggaaat

SEQ ID NO: 2265430 - DNA, 13 bp, Homo sapiens
ttgcctttttcat

SEQ ID NO: 2265431 - DNA, 14 bp, Homo sapiens
ttgcctttttcatt

SEQ ID NO: 2265432 - DNA, 21 bp, Homo sapiens
ttggaccaaaaaccagtattg

SEQ ID NO: 2265433 - DNA, 19 bp, Homo sapiens
ttggataataaggaaaagt

SEQ ID NO: 2265434 - DNA, 21 bp, Homo sapiens
ttggataataaggaaaagttt

SEQ ID NO: 2265435 - DNA, 16 bp, Homo sapiens
gtaaatcccattattc

SEQ ID NO: 2265436 - DNA, 21 bp, Homo sapiens
gtaaatcccattattcaaagt

SEQ ID NO: 2265437 - DNA, 15 bp, Homo sapiens
gtattaagcatatat

SEQ ID NO: 2265438 - DNA, 17 bp, Homo sapiens
gtattaagcatatattt

SEQ ID NO: 2265439 - DNA, 21 bp, Homo sapiens
gtattaagcatatatttttat

SEQ ID NO: 2265440 - DNA, 22 bp, Homo sapiens
gtattgtacaaagtattaagca

SEQ ID NO: 2265441 - DNA, 14 bp, Homo sapiens
gtctcagattttat

SEQ ID NO: 2265442 - DNA, 15 bp, Homo sapiens
gtctcagattttatt

SEQ ID NO: 2265443 - DNA, 17 bp, Homo sapiens
gtctcagattttattat

SEQ ID NO: 2265444 - DNA, 16 bp, Homo sapiens
gtcttgcctttttcat

SEQ ID NO: 2265445 - DNA, 22 bp, Homo sapiens
gtcttgtctcagattttattat

SEQ ID NO: 2265446 - DNA, 13 bp, Homo sapiens
gtgaatggctttg

SEQ ID NO: 2265447 - DNA, 21 bp, Homo sapiens
gtgcgctaaacttttctgata

SEQ ID NO: 2265448 - DNA, 14 bp, Homo sapiens
gtgctaaggacttg

SEQ ID NO: 2265449 - DNA, 19 bp, Homo sapiens
gtgttgtactcaattttaa

SEQ ID NO: 2265450 - DNA, 21 bp, Homo sapiens
gttaaaccatgggataaatgc

SEQ ID NO: 2265451 - DNA, 16 bp, Homo sapiens
gttgcctaaatccatt

SEQ ID NO: 2265452 - DNA, 13 bp, Homo sapiens
gtttaatattaaa

SEQ ID NO: 2265453 - DNA, 14 bp, Homo sapiens
gtttaatattaaag

SEQ ID NO: 2265454 - DNA, 18 bp, Homo sapiens
gtttaatattaaagccat

SEQ ID NO: 2265455 - DNA, 20 bp, Homo sapiens
gtttaatattaaagccatgt

SEQ ID NO: 2265456 - DNA, 18 bp, Homo sapiens
gtttggaccaaaaaccag

SEQ ID NO: 2265457 - DNA, 23 bp, Homo sapiens
gtttgtgctggtgtatgtgtgaa

SEQ ID NO: 2265458 - DNA, 12 bp, Homo sapiens
gtttgtttagtc

SEQ ID NO: 2265459 - DNA, 18 bp, Homo sapiens
taaaaaaaaaattgggga

SEQ ID NO: 2265460 - DNA, 18 bp, Homo sapiens
taaaccatgggataaatg

SEQ ID NO: 2265461 - DNA, 20 bp, Homo sapiens
taaaccatgggataaatgcc

SEQ ID NO: 2265462 - DNA, 21 bp, Homo sapiens
taaaccatgggataaatgcca

SEQ ID NO: 2265463 - DNA, 15 bp, Homo sapiens
taaagttgaatttat

SEQ ID NO: 2265464 - DNA, 21 bp, Homo sapiens
taaagttgaatttattggctt

SEQ ID NO: 2265465 - DNA, 15 bp, Homo sapiens
taaatacaattttgt

SEQ ID NO: 2265466 - DNA, 22 bp, Homo sapiens
taaatacaattttgtttctgta

SEQ ID NO: 2265467 - DNA, 18 bp, Homo sapiens
taaatccatttggaaatc

SEQ ID NO: 2265468 - DNA, 23 bp, Homo sapiens
taaatcccattattcaaagttgc

SEQ ID NO: 2265469 - DNA, 17 bp, Homo sapiens
taaatctgtgaacttga

SEQ ID NO: 2265470 - DNA, 22 bp, Homo sapiens
taaatctgtgaacttgaaattt

SEQ ID NO: 2265471 - DNA, 23 bp, Homo sapiens
taaatgccatcaataaaaaatta

SEQ ID NO: 2265472 - DNA, 15 bp, Homo sapiens
taacataaatctgtg

SEQ ID NO: 2265473 - DNA, 16 bp, Homo sapiens
taacataaatctgtga

SEQ ID NO: 2265474 - DNA, 12 bp, Homo sapiens
taacatgttaaa

SEQ ID NO: 2265475 - DNA, 18 bp, Homo sapiens
taacatgttaaaccatgg

SEQ ID NO: 2265476 - DNA, 13 bp, Homo sapiens
taagcatatattt

SEQ ID NO: 2265477 - DNA, 16 bp, Homo sapiens
taagcatatattttta

SEQ ID NO: 2265478 - DNA, 19 bp, Homo sapiens
taagcatatatttttatat

SEQ ID NO: 2265479 - DNA, 23 bp, Homo sapiens
taagcatatatttttatatttac

SEQ ID NO: 2265480 - DNA, 16 bp, Homo sapiens
taaggaaaagtttaat

SEQ ID NO: 2265481 - DNA, 15 bp, Homo sapiens
taaggacttgttaga

SEQ ID NO: 2265482 - DNA, 16 bp, Homo sapiens
taaggacttgttagat

SEQ ID NO: 2265483 - DNA, 15 bp, Homo sapiens
taataattatatgct

SEQ ID NO: 2265484 - DNA, 12 bp, Homo sapiens
taatattaaagc

SEQ ID NO: 2265485 - DNA, 20 bp, Homo sapiens
taatattaaagccatgttta

SEQ ID NO: 2265486 - DNA, 12 bp, Homo sapiens
taattaacatgt

SEQ ID NO: 2265487 - DNA, 14 bp, Homo sapiens
taattaacatgtta

SEQ ID NO: 2265488 - DNA, 21 bp, Homo sapiens
taattatatctgaggaattct

SEQ ID NO: 2265489 - DNA, 21 bp, Homo sapiens
taattatatgctatttctata

SEQ ID NO: 2265490 - DNA, 13 bp, Homo sapiens
taattttggaatt

SEQ ID NO: 2265491 - DNA, 15 bp, Homo sapiens
tacaaagtattaagc

SEQ ID NO: 2265492 - DNA, 19 bp, Homo sapiens
tacaaagtattaagcatat

SEQ ID NO: 2265493 - DNA, 16 bp, Homo sapiens
tacaattttgtttctg

SEQ ID NO: 2265494 - DNA, 17 bp, Homo sapiens
tacaattttgtttctgt

SEQ ID NO: 2265495 - DNA, 18 bp, Homo sapiens
tacaattttgtttctgta

SEQ ID NO: 2265496 - DNA, 17 bp, Homo sapiens
tacagtataattaacat

SEQ ID NO: 2265497 - DNA, 23 bp, Homo sapiens
tacagtataattaacatgttaaa

SEQ ID NO: 2265498 - DNA, 17 bp, Homo sapiens
tactaaaatggactgtg

SEQ ID NO: 2265499 - DNA, 14 bp, Homo sapiens
tactcaattttaac

SEQ ID NO: 2265500 - DNA, 22 bp, Homo sapiens
tactttgtgctggggttatctg

SEQ ID NO: 2265501 - DNA, 13 bp, Homo sapiens
tagactggtgact

SEQ ID NO: 2265502 - DNA, 20 bp, Homo sapiens
tagactggtgactgattctt

SEQ ID NO: 2265503 - DNA, 23 bp, Homo sapiens
tagactggtgactgattcttcag

SEQ ID NO: 2265504 - DNA, 15 bp, Homo sapiens
tagagagtgttgaaa

SEQ ID NO: 2265505 - DNA, 15 bp, Homo sapiens
tagctagactggtga

SEQ ID NO: 2265506 - DNA, 18 bp, Homo sapiens
tagctagactggtgactg

SEQ ID NO: 2265507 - DNA, 22 bp, Homo sapiens
tagtcttgtctcagattttatt

SEQ ID NO: 2265508 - DNA, 14 bp, Homo sapiens
tataattaacatgt

SEQ ID NO: 2265509 - DNA, 16 bp, Homo sapiens
tataattaacatgtta

SEQ ID NO: 2265510 - DNA, 20 bp, Homo sapiens
tatagaacctctttgtctac

SEQ ID NO: 2265511 - DNA, 20 bp, Homo sapiens
tatagattagaattctgtat

SEQ ID NO: 2265512 - DNA, 22 bp, Homo sapiens
tatagattagagagtgttgaaa

SEQ ID NO: 2265513 - DNA, 18 bp, Homo sapiens
tatatctgaggaattctg

SEQ ID NO: 2265514 - DNA, 17 bp, Homo sapiens
tatctgaagtcagatct

SEQ ID NO: 2265515 - DNA, 18 bp, Homo sapiens
tatgctatttctatattt

SEQ ID NO: 2265516 - DNA, 15 bp, Homo sapiens
tatgctgagtttgtg

SEQ ID NO: 2265517 - DNA, 20 bp, Homo sapiens
tatgtaaatcccattattca

SEQ ID NO: 2265518 - DNA, 21 bp, Homo sapiens
tatgtaaatcccattattcaa

SEQ ID NO: 2265519 - DNA, 13 bp, Homo sapiens
tattacagtataa

SEQ ID NO: 2265520 - DNA, 20 bp, Homo sapiens
tattacagtataattaacat

SEQ ID NO: 2265521 - DNA, 21 bp, Homo sapiens
tattatgaaacttgtgtaaat

SEQ ID NO: 2265522 - DNA, 22 bp, Homo sapiens
tattatgtaaatcccattattc

SEQ ID NO: 2265523 - DNA, 22 bp, Homo sapiens
tattcaaagttgcctaaatcca

SEQ ID NO: 2265524 - DNA, 23 bp, Homo sapiens
tattcaaagttgcctaaatccat

SEQ ID NO: 2265525 - DNA, 19 bp, Homo sapiens
tattcactgatttgacata

SEQ ID NO: 2265526 - DNA, 16 bp, Homo sapiens
tattggcttttctgat

SEQ ID NO: 2265527 - DNA, 16 bp, Homo sapiens
tattgtacaaagtatt

SEQ ID NO: 2265528 - DNA, 22 bp, Homo sapiens
tattgtacaaagtattaagcat

SEQ ID NO: 2265529 - DNA, 22 bp, Homo sapiens
tattgtgcgctaaacttttctg

SEQ ID NO: 2265530 - DNA, 23 bp, Homo sapiens
tattgtgcgctaaacttttctga

SEQ ID NO: 2265531 - DNA, 18 bp, Homo sapiens
tatttactaaaatggact

SEQ ID NO: 2265532 - DNA, 13 bp, Homo sapiens
tattttattatga

SEQ ID NO: 2265533 - DNA, 16 bp, Homo sapiens
tcaataaaaaattatg

SEQ ID NO: 2265534 - DNA, 14 bp, Homo sapiens
tcagatactggatt

SEQ ID NO: 2265535 - DNA, 15 bp, Homo sapiens
tcagatctgcctaag

SEQ ID NO: 2265536 - DNA, 21 bp, Homo sapiens
tcagatctgcctaaggacttc

SEQ ID NO: 2265537 - DNA, 16 bp, Homo sapiens
tcagattttattatgt

SEQ ID NO: 2265538 - DNA, 19 bp, Homo sapiens
tcagattttattatgtaaa

SEQ ID NO: 2265539 - DNA, 21 bp, Homo sapiens
tcatggaacgcgttgaaattg

SEQ ID NO: 2265540 - DNA, 22 bp, Homo sapiens
tcatggaacgcgttgaaattgt

SEQ ID NO: 2265541 - DNA, 13 bp, Homo sapiens
tcattattttatt

SEQ ID NO: 2265542 - DNA, 22 bp, Homo sapiens
tcattattttattatgaaactt

SEQ ID NO: 2265543 - DNA, 17 bp, Homo sapiens
tccagttttgtttggac

SEQ ID NO: 2265544 - DNA, 20 bp, Homo sapiens
tccagttttgtttggaccaa

SEQ ID NO: 2265545 - DNA, 20 bp, Homo sapiens
tccatttggaaatctttaaa

SEQ ID NO: 2265546 - DNA, 14 bp, Homo sapiens
tcccattattcaaa

SEQ ID NO: 2265547 - DNA, 16 bp, Homo sapiens
tcccattattcaaagt

SEQ ID NO: 2265548 - DNA, 19 bp, Homo sapiens
tcccattattcaaagttgc

SEQ ID NO: 2265549 - DNA, 17 bp, Homo sapiens
tccgtgctaaggacttg

SEQ ID NO: 2265550 - DNA, 12 bp, Homo sapiens
tctagttcactc

SEQ ID NO: 2265551 - DNA, 19 bp, Homo sapiens
tctagttcactctccattt

SEQ ID NO: 2265552 - DNA, 15 bp, Homo sapiens
tctcagattttatta

SEQ ID NO: 2265553 - DNA, 17 bp, Homo sapiens
tctgaggaattctgtat

SEQ ID NO: 2265554 - DNA, 21 bp, Homo sapiens
tctgatccagttttgtttgga

SEQ ID NO: 2265555 - DNA, 13 bp, Homo sapiens
tctgcctaaggac

SEQ ID NO: 2265556 - DNA, 16 bp, Homo sapiens
tctgcctaaggacttc

SEQ ID NO: 2265557 - DNA, 14 bp, Homo sapiens
tctgtactttttgg

SEQ ID NO: 2265558 - DNA, 17 bp, Homo sapiens
tctgtactttttggcat

SEQ ID NO: 2265559 - DNA, 17 bp, Homo sapiens
tctgtgaacttgaaatt

SEQ ID NO: 2265560 - DNA, 14 bp, Homo sapiens
tcttaaagttgaat

SEQ ID NO: 2265561 - DNA, 19 bp, Homo sapiens
tcttaaagttgaatttatt

SEQ ID NO: 2265562 - DNA, 20 bp, Homo sapiens
tcttaaagttgaatttattg

SEQ ID NO: 2265563 - DNA, 15 bp, Homo sapiens
ttgtacaaagtatta

SEQ ID NO: 2265564 - DNA, 16 bp, Homo sapiens
ttgtctcagattttat

SEQ ID NO: 2265565 - DNA, 22 bp, Homo sapiens
ttgtctcagattttattatgta

SEQ ID NO: 2265566 - DNA, 19 bp, Homo sapiens
ttgtgtaaatacaattttg

SEQ ID NO: 2265567 - DNA, 17 bp, Homo sapiens
ttgttgtttgtttagtc

SEQ ID NO: 2265568 - DNA, 21 bp, Homo sapiens
tttaaataaataaatagctag

SEQ ID NO: 2265569 - DNA, 21 bp, Homo sapiens
tttaataattatatgctattt

SEQ ID NO: 2265570 - DNA, 14 bp, Homo sapiens
tttaatattaaagc

SEQ ID NO: 2265571 - DNA, 15 bp, Homo sapiens
tttaatattaaagcc

SEQ ID NO: 2265572 - DNA, 17 bp, Homo sapiens
tttaatattaaagccat

SEQ ID NO: 2265573 - DNA, 14 bp, Homo sapiens
tttaattttggaat

SEQ ID NO: 2265574 - DNA, 15 bp, Homo sapiens
tttaattttggaatt

SEQ ID NO: 2265575 - DNA, 15 bp, Homo sapiens
tttagtcttgtctca

SEQ ID NO: 2265576 - DNA, 13 bp, Homo sapiens
tttattatgaaac

SEQ ID NO: 2265577 - DNA, 14 bp, Homo sapiens
tttattatgtaaat

SEQ ID NO: 2265578 - DNA, 17 bp, Homo sapiens
tttattggcttttctga

SEQ ID NO: 2265579 - DNA, 21 bp, Homo sapiens
tttcagatactggattgtact

SEQ ID NO: 2265580 - DNA, 13 bp, Homo sapiens
tttcattatttta

SEQ ID NO: 2265581 - DNA, 15 bp, Homo sapiens
tttcattattttatt

SEQ ID NO: 2265582 - DNA, 15 bp, Homo sapiens
tttctatattttcat

SEQ ID NO: 2265583 - DNA, 20 bp, Homo sapiens
tttctgatccagttttgttt

SEQ ID NO: 2265584 - DNA, 20 bp, Homo sapiens
tttggcataacataaatctg

SEQ ID NO: 2265585 - DNA, 12 bp, Homo sapiens
tttgtttctgta

SEQ ID NO: 2265586 - DNA, 12 bp, Homo sapiens
ttttattatgta

SEQ ID NO: 2265587 - DNA, 13 bp, Homo sapiens
ttttgtttctgta

SEQ ID NO: 2265588 - DNA, 20 bp, Homo sapiens
tttttatatttactaaaatg

SEQ ID NO: 2265589 - DNA, 13 bp, Homo sapiens
tttttcattattt

SEQ ID NO: 2265590 - DNA, 24 bp, Homo sapiens
tttttggcataacataaatctgtg

SEQ ID NO: 2265591 - DNA, 18 bp, Homo sapiens
attcaaagttgcctaaat

SEQ ID NO: 2265592 - DNA, 11 bp, Homo sapiens
attctgtatag

SEQ ID NO: 2265593 - DNA, 12 bp, Homo sapiens
attctgtataga

SEQ ID NO: 2265594 - DNA, 13 bp, Homo sapiens
attcttaaagttg

SEQ ID NO: 2265595 - DNA, 18 bp, Homo sapiens
attcttaaagttgaattt

SEQ ID NO: 2265596 - DNA, 20 bp, Homo sapiens
attcttaaagttgaatttat

SEQ ID NO: 2265597 - DNA, 21 bp, Homo sapiens
attcttaaagttgaatttatt

SEQ ID NO: 2265598 - DNA, 19 bp, Homo sapiens
attggcttttctgatccag

SEQ ID NO: 2265599 - DNA, 16 bp, Homo sapiens
attggggattcttaaa

SEQ ID NO: 2265600 - DNA, 21 bp, Homo sapiens
attggggattcttaaagttga

SEQ ID NO: 2265601 - DNA, 15 bp, Homo sapiens
attgtaattatatct

SEQ ID NO: 2265602 - DNA, 17 bp, Homo sapiens
attgtacaaagtattaa

SEQ ID NO: 2265603 - DNA, 15 bp, Homo sapiens
attgtactttgtgct

SEQ ID NO: 2265604 - DNA, 13 bp, Homo sapiens
atttaataattat

SEQ ID NO: 2265605 - DNA, 20 bp, Homo sapiens
atttactaaaatggactgtg

SEQ ID NO: 2265606 - DNA, 23 bp, Homo sapiens
atttattggcttttctgatccag

SEQ ID NO: 2265607 - DNA, 16 bp, Homo sapiens
atttctatattttcat

SEQ ID NO: 2265608 - DNA, 11 bp, Homo sapiens
atttggaaatc

SEQ ID NO: 2265609 - DNA, 12 bp, Homo sapiens
atttggaaatct

SEQ ID NO: 2265610 - DNA, 13 bp, Homo sapiens
attttattatgaa

SEQ ID NO: 2265611 - DNA, 21 bp, Homo sapiens
attttattatgaaacttgtgt

SEQ ID NO: 2265612 - DNA, 19 bp, Homo sapiens
attttattatgtaaatccc

SEQ ID NO: 2265613 - DNA, 14 bp, Homo sapiens
attttgtttctgta

SEQ ID NO: 2265614 - DNA, 16 bp, Homo sapiens
atttttatatttacta

SEQ ID NO: 2265615 - DNA, 13 bp, Homo sapiens
atttttttgttgt

SEQ ID NO: 2265616 - DNA, 18 bp, Homo sapiens
atttttttgttgtttgtt

SEQ ID NO: 2265617 - DNA, 22 bp, Homo sapiens
caaaaatattttatgatccagc

SEQ ID NO: 2265618 - DNA, 23 bp, Homo sapiens
caaaaatattttatgatccagca

SEQ ID NO: 2265619 - DNA, 15 bp, Homo sapiens
caaagtattaagcat

SEQ ID NO: 2265620 - DNA, 14 bp, Homo sapiens
caaagttgcctaaa

SEQ ID NO: 2265621 - DNA, 17 bp, Homo sapiens
caaagttgcctaaatcc

SEQ ID NO: 2265622 - DNA, 23 bp, Homo sapiens
caacagctggtgccctgctttca

SEQ ID NO: 2265623 - DNA, 17 bp, Homo sapiens
caataaaaaattatgac

SEQ ID NO: 2265624 - DNA, 13 bp, Homo sapiens
caattttgtttct

SEQ ID NO: 2265625 - DNA, 14 bp, Homo sapiens
caattttgtttctg

SEQ ID NO: 2265626 - DNA, 17 bp, Homo sapiens
caattttgtttctgtac

SEQ ID NO: 2265627 - DNA, 20 bp, Homo sapiens
cacctgtcttgcctttttca

SEQ ID NO: 2265628 - DNA, 20 bp, Homo sapiens
cacggtgaatggctttgtat

SEQ ID NO: 2265629 - DNA, 21 bp, Homo sapiens
cactgatttgacatagtctgg

SEQ ID NO: 2265630 - DNA, 23 bp, Homo sapiens
cactgatttgacatagtctggct

SEQ ID NO: 2265631 - DNA, 14 bp, Homo sapiens
cagatactggattg

SEQ ID NO: 2265632 - DNA, 18 bp, Homo sapiens
cagatactggattgtact

SEQ ID NO: 2265633 - DNA, 17 bp, Homo sapiens
cagatctgcctaaggac

SEQ ID NO: 2265634 - DNA, 23 bp, Homo sapiens
cagattattcactgatttgacat

SEQ ID NO: 2265635 - DNA, 13 bp, Homo sapiens
cagattttattat

SEQ ID NO: 2265636 - DNA, 15 bp, Homo sapiens
cagattttattatgt

SEQ ID NO: 2265637 - DNA, 15 bp, Homo sapiens
cagcagattattcac

SEQ ID NO: 2265638 - DNA, 20 bp, Homo sapiens
cagctggtgccctgctttca

SEQ ID NO: 2265639 - DNA, 17 bp, Homo sapiens
cagtattgtacaaagta

SEQ ID NO: 2265640 - DNA, 21 bp, Homo sapiens
cagtattgtacaaagtattaa

SEQ ID NO: 2265641 - DNA, 22 bp, Homo sapiens
cagtattgtacaaagtattaag

SEQ ID NO: 2265642 - DNA, 16 bp, Homo sapiens
cataaatctgtgaact

SEQ ID NO: 2265643 - DNA, 18 bp, Homo sapiens
catgggataaatgccatc

SEQ ID NO: 2265644 - DNA, 13 bp, Homo sapiens
catgttaaaccat

SEQ ID NO: 2265645 - DNA, 22 bp, Homo sapiens
catgttaaaccatgggataaat

SEQ ID NO: 2265646 - DNA, 12 bp, Homo sapiens
catgtttattac

SEQ ID NO: 2265647 - DNA, 18 bp, Homo sapiens
catgtttattacagtata

SEQ ID NO: 2265648 - DNA, 19 bp, Homo sapiens
catgtttattacagtataa

SEQ ID NO: 2265649 - DNA, 16 bp, Homo sapiens
cattattcaaagttgc

SEQ ID NO: 2265650 - DNA, 15 bp, Homo sapiens
catttaataattata

SEQ ID NO: 2265651 - DNA, 17 bp, Homo sapiens
catttaataattatatg

SEQ ID NO: 2265652 - DNA, 20 bp, Homo sapiens
ccaaaaaccagtattgtaca

SEQ ID NO: 2265653 - DNA, 15 bp, Homo sapiens
ccagcagattattca

SEQ ID NO: 2265654 - DNA, 16 bp, Homo sapiens
ccagcagattattcac

SEQ ID NO: 2265655 - DNA, 22 bp, Homo sapiens
ccagcagattattcactgattt

SEQ ID NO: 2265656 - DNA, 20 bp, Homo sapiens
ccagtattgtacaaagtatt

SEQ ID NO: 2265657 - DNA, 17 bp, Homo sapiens
ccatgggataaatgcca

SEQ ID NO: 2265658 - DNA, 18 bp, Homo sapiens
cccaggaatggagcctgc

SEQ ID NO: 2265659 - DNA, 19 bp, Homo sapiens
cccaggaatggagcctgca

SEQ ID NO: 2265660 - DNA, 12 bp, Homo sapiens
cccattattcaa

SEQ ID NO: 2265661 - DNA, 14 bp, Homo sapiens
ccctgctttcagat

SEQ ID NO: 2265662 - DNA, 17 bp, Homo sapiens
ccctgctttcagatact

SEQ ID NO: 2265663 - DNA, 15 bp, Homo sapiens
ccgtgctaaggactt

SEQ ID NO: 2265664 - DNA, 17 bp, Homo sapiens
cctaaatccatttggaa

SEQ ID NO: 2265665 - DNA, 11 bp, Homo sapiens
cctaaggactt

SEQ ID NO: 2265666 - DNA, 16 bp, Homo sapiens
cctaaggacttcttta

SEQ ID NO: 2265667 - DNA, 17 bp, Homo sapiens
cctaaggacttctttaa

SEQ ID NO: 2265668 - DNA, 18 bp, Homo sapiens
cctaaggacttctttaat

SEQ ID NO: 2265669 - DNA, 17 bp, Homo sapiens
cctgtcttgcctttttc

SEQ ID NO: 2265670 - DNA, 17 bp, Homo sapiens
cctttttcattatttta

SEQ ID NO: 2265671 - DNA, 16 bp, Homo sapiens
ccttttttaaataaat

SEQ ID NO: 2265672 - DNA, 24 bp, Homo sapiens
cgcgttgaaattgtaattatatct

SEQ ID NO: 2265673 - DNA, 19 bp, Homo sapiens
cgctaaacttttctgatag

SEQ ID NO: 2265674 - DNA, 19 bp, Homo sapiens
cgctgataagcgttcatgg

SEQ ID NO: 2265675 - DNA, 14 bp, Homo sapiens
cggatgatttctat

SEQ ID NO: 2265676 - DNA, 20 bp, Homo sapiens
cggtgaatggctttgtatag

SEQ ID NO: 2265677 - DNA, 15 bp, Homo sapiens
cgtgctaaggacttg

SEQ ID NO: 2265678 - DNA, 17 bp, Homo sapiens
ctaaatccatttggaaa

SEQ ID NO: 2265679 - DNA, 20 bp, Homo sapiens
ctaaatccatttggaaatct

SEQ ID NO: 2265680 - DNA, 15 bp, Homo sapiens
ctaaggacttcttta

SEQ ID NO: 2265681 - DNA, 22 bp, Homo sapiens
ctaaggacttctttaattttgg

SEQ ID NO: 2265682 - DNA, 18 bp, Homo sapiens
ctatgctgagtttgtgct

SEQ ID NO: 2265683 - DNA, 16 bp, Homo sapiens
ctatttctatattttc

SEQ ID NO: 2265684 - DNA, 18 bp, Homo sapiens
ctatttctatattttcat

SEQ ID NO: 2265685 - DNA, 17 bp, Homo sapiens
ctcagattttattatgt

SEQ ID NO: 2265686 - DNA, 23 bp, Homo sapiens
ctcagattttattatgtaaatcc

SEQ ID NO: 2265687 - DNA, 13 bp, Homo sapiens
ctccatttaataa

SEQ ID NO: 2265688 - DNA, 18 bp, Homo sapiens
ctgaggaattctgtatag

SEQ ID NO: 2265689 - DNA, 22 bp, Homo sapiens
ctgatttgacatagtctggctg

SEQ ID NO: 2265690 - DNA, 14 bp, Homo sapiens
ctgcctaaggactt

SEQ ID NO: 2265691 - DNA, 19 bp, Homo sapiens
ctgcctaaggacttcttta

SEQ ID NO: 2265692 - DNA, 21 bp, Homo sapiens
ctgcctaaggacttctttaat

SEQ ID NO: 2265693 - DNA, 13 bp, Homo sapiens
ctggtgactgatt

SEQ ID NO: 2265694 - DNA, 15 bp, Homo sapiens
attagaattctgtat

SEQ ID NO: 2265695 - DNA, 15 bp, Homo sapiens
attagagagtgttga

SEQ ID NO: 2265696 - DNA, 20 bp, Homo sapiens
attatatctgaggaattctg

SEQ ID NO: 2265697 - DNA, 19 bp, Homo sapiens
attatatgctatttctata

SEQ ID NO: 2265698 - DNA, 15 bp, Homo sapiens
attatgaaacttgtg

SEQ ID NO: 2265699 - DNA, 18 bp, Homo sapiens
attatgaaacttgtgtaa

SEQ ID NO: 2265700 - DNA, 20 bp, Homo sapiens
attatgaaacttgtgtaaat

SEQ ID NO: 2265701 - DNA, 21 bp, Homo sapiens
attatgaaacttgtgtaaata

SEQ ID NO: 2265702 - DNA, 13 bp, Homo sapiens
attatgtaaatcc

SEQ ID NO: 2265703 - DNA, 14 bp, Homo sapiens
attatgtaaatccc

SEQ ID NO: 2265704 - DNA, 15 bp, Homo sapiens
attatgtaaatccca

SEQ ID NO: 2265705 - DNA, 23 bp, Homo sapiens
attatgtaaatcccattattcaa

SEQ ID NO: 2265706 - DNA, 15 bp, Homo sapiens
attattcaaagttgc

SEQ ID NO: 2265707 - DNA, 23 bp, Homo sapiens
gcctgcacggtgaatggctttgt

SEQ ID NO: 2265708 - DNA, 22 bp, Homo sapiens
gcctttttcattattttattat

SEQ ID NO: 2265709 - DNA, 22 bp, Homo sapiens
gcgttcatggaacgcgttgaaa

SEQ ID NO: 2265710 - DNA, 12 bp, Homo sapiens
gcgttgaaattg

SEQ ID NO: 2265711 - DNA, 18 bp, Homo sapiens
gcgttgaaattgtaatta

SEQ ID NO: 2265712 - DNA, 15 bp, Homo sapiens
gctagactggtgact

SEQ ID NO: 2265713 - DNA, 16 bp, Homo sapiens
gctagactggtgactg

SEQ ID NO: 2265714 - DNA, 20 bp, Homo sapiens
gctagactggtgactgattc

SEQ ID NO: 2265715 - DNA, 22 bp, Homo sapiens
gctagactggtgactgattctt

SEQ ID NO: 2265716 - DNA, 18 bp, Homo sapiens
gctatttctatattttca

SEQ ID NO: 2265717 - DNA, 19 bp, Homo sapiens
gctatttctatattttcat

SEQ ID NO: 2265718 - DNA, 22 bp, Homo sapiens
gctatttctatattttcattct

SEQ ID NO: 2265719 - DNA, 22 bp, Homo sapiens
gctggtgccctgctttcagata

SEQ ID NO: 2265720 - DNA, 21 bp, Homo sapiens
gctggtgtatgtgtgaagtga

SEQ ID NO: 2265721 - DNA, 14 bp, Homo sapiens
gctttcagatactg

SEQ ID NO: 2265722 - DNA, 14 bp, Homo sapiens
ggaaaagtttaata

SEQ ID NO: 2265723 - DNA, 13 bp, Homo sapiens
ggaaatctttaaa

SEQ ID NO: 2265724 - DNA, 15 bp, Homo sapiens
ggaagcctgattaaa

SEQ ID NO: 2265725 - DNA, 15 bp, Homo sapiens
ggaattctgtataga

SEQ ID NO: 2265726 - DNA, 16 bp, Homo sapiens
ggaccaaaaaccagta

SEQ ID NO: 2265727 - DNA, 14 bp, Homo sapiens
ggactgtggtgact

SEQ ID NO: 2265728 - DNA, 18 bp, Homo sapiens
ggacttctttaattttgg

SEQ ID NO: 2265729 - DNA, 21 bp, Homo sapiens
ggacttctttaattttggaat

SEQ ID NO: 2265730 - DNA, 22 bp, Homo sapiens
ggataataaggaaaagtttaat

SEQ ID NO: 2265731 - DNA, 20 bp, Homo sapiens
ggattcttaaagttgaattt

SEQ ID NO: 2265732 - DNA, 16 bp, Homo sapiens
ggcataacataaatct

SEQ ID NO: 2265733 - DNA, 13 bp, Homo sapiens
ggcttttctgatc

SEQ ID NO: 2265734 - DNA, 20 bp, Homo sapiens
gggattcttaaagttgaatt

SEQ ID NO: 2265735 - DNA, 17 bp, Homo sapiens
ggtccgtgctaaggact

SEQ ID NO: 2265736 - DNA, 14 bp, Homo sapiens
ggtgaatggctttg

SEQ ID NO: 2265737 - DNA, 17 bp, Homo sapiens
ggtgaatggctttgtat

SEQ ID NO: 2265738 - DNA, 14 bp, Homo sapiens
ggtgactttggata

SEQ ID NO: 2265739 - DNA, 20 bp, Homo sapiens
ggtgactttggataataagg

SEQ ID NO: 2265740 - DNA, 20 bp, Homo sapiens
ggtgttgtactcaattttaa

SEQ ID NO: 2265741 - DNA, 20 bp, Homo sapiens
ggttatctgaagtcagatct

SEQ ID NO: 2265742 - DNA, 19 bp, Homo sapiens
gtaaatcccattattcaaa

SEQ ID NO: 2265743 - DNA, 20 bp, Homo sapiens
gtaaatcccattattcaaag

SEQ ID NO: 2265744 - DNA, 20 bp, Homo sapiens
gtacaaagtattaagcatat

SEQ ID NO: 2265745 - DNA, 21 bp, Homo sapiens
gtacaaagtattaagcatata

SEQ ID NO: 2265746 - DNA, 21 bp, Homo sapiens
gtactttttggcataacataa

SEQ ID NO: 2265747 - DNA, 19 bp, Homo sapiens
gtataattaacatgttaaa

SEQ ID NO: 2265748 - DNA, 22 bp, Homo sapiens
gtataattaacatgttaaacca

SEQ ID NO: 2265749 - DNA, 19 bp, Homo sapiens
gtatagaacctctttgtct

SEQ ID NO: 2265750 - DNA, 14 bp, Homo sapiens
gtatagattagaat

SEQ ID NO: 2265751 - DNA, 17 bp, Homo sapiens
gtatgtgtgaagtgagt

SEQ ID NO: 2265752 - DNA, 21 bp, Homo sapiens
gtatgtgtgaagtgagtgagt

SEQ ID NO: 2265753 - DNA, 16 bp, Homo sapiens
gtattaagcatatatt

SEQ ID NO: 2265754 - DNA, 18 bp, Homo sapiens
gtattaagcatatatttt

SEQ ID NO: 2265755 - DNA, 21 bp, Homo sapiens
gtattgtacaaagtattaagc

SEQ ID NO: 2265756 - DNA, 19 bp, Homo sapiens
gtcagatctgcctaaggac

SEQ ID NO: 2265757 - DNA, 13 bp, Homo sapiens
gtctcagatttta

SEQ ID NO: 2265758 - DNA, 20 bp, Homo sapiens
gtcttgcctttttcattatt

SEQ ID NO: 2265759 - DNA, 15 bp, Homo sapiens
gtcttgtctcagatt

SEQ ID NO: 2265760 - DNA, 14 bp, Homo sapiens
gtgaacttgaaatt

SEQ ID NO: 2265761 - DNA, 14 bp, Homo sapiens
gtgaatggctttgt

SEQ ID NO: 2265762 - DNA, 17 bp, Homo sapiens
gtgaatggctttgtata

SEQ ID NO: 2265763 - DNA, 15 bp, Homo sapiens
gtgactttggataat

SEQ ID NO: 2265764 - DNA, 20 bp, Homo sapiens
gtgctaaggacttgttagat

SEQ ID NO: 2265765 - DNA, 21 bp, Homo sapiens
gtgttgaaacggatgatttct

SEQ ID NO: 2265766 - DNA, 18 bp, Homo sapiens
gttagagatttttttgtt

SEQ ID NO: 2265767 - DNA, 12 bp, Homo sapiens
gttagatctagt

SEQ ID NO: 2265768 - DNA, 19 bp, Homo sapiens
gttatctgaagtcagatct

SEQ ID NO: 2265769 - DNA, 22 bp, Homo sapiens
gttcatggaacgcgttgaaatt

SEQ ID NO: 2265770 - DNA, 23 bp, Homo sapiens
gttcatggaacgcgttgaaattg

SEQ ID NO: 2265771 - DNA, 16 bp, Homo sapiens
gttgaaattgtaatta

SEQ ID NO: 2265772 - DNA, 21 bp, Homo sapiens
gttgaatttattggcttttct

SEQ ID NO: 2265773 - DNA, 12 bp, Homo sapiens
gttgtttgttta

SEQ ID NO: 2265774 - DNA, 19 bp, Homo sapiens
gtttaatattaaagccatg

SEQ ID NO: 2265775 - DNA, 14 bp, Homo sapiens
gtttagtcttgtct

SEQ ID NO: 2265776 - DNA, 10 bp, Homo sapiens
gtttctgtac

SEQ ID NO: 2265777 - DNA, 20 bp, Homo sapiens
gtttctgtactttttggcat

SEQ ID NO: 2265778 - DNA, 22 bp, Homo sapiens
taaaccatgggataaatgccat

SEQ ID NO: 2265779 - DNA, 13 bp, Homo sapiens
taaacttttctga

SEQ ID NO: 2265780 - DNA, 14 bp, Homo sapiens
taaacttttctgat

SEQ ID NO: 2265781 - DNA, 11 bp, Homo sapiens
taaagccatgt

SEQ ID NO: 2265782 - DNA, 19 bp, Homo sapiens
taaagttgaatttattggc

SEQ ID NO: 2265783 - DNA, 14 bp, Homo sapiens
taaataaatagcta

SEQ ID NO: 2265784 - DNA, 13 bp, Homo sapiens
taaatacaatttt

SEQ ID NO: 2265785 - DNA, 23 bp, Homo sapiens
taaatacaattttgtttctgtac

SEQ ID NO: 2265786 - DNA, 18 bp, Homo sapiens
taaatagctagactggtg

SEQ ID NO: 2265787 - DNA, 19 bp, Homo sapiens
taaatccatttggaaatct

SEQ ID NO: 2265788 - DNA, 18 bp, Homo sapiens
taaatctgtgaacttgaa

SEQ ID NO: 2265789 - DNA, 19 bp, Homo sapiens
taaatctgtgaacttgaaa

SEQ ID NO: 2265790 - DNA, 14 bp, Homo sapiens
taacataaatctgt

SEQ ID NO: 2265791 - DNA, 15 bp, Homo sapiens
taacatgttaaacca

SEQ ID NO: 2265792 - DNA, 21 bp, Homo sapiens
taaggaaaagtttaatattaa

SEQ ID NO: 2265793 - DNA, 14 bp, Homo sapiens
taaggacttcttta

SEQ ID NO: 2265794 - DNA, 15 bp, Homo sapiens
taaggacttctttaa

SEQ ID NO: 2265795 - DNA, 16 bp, Homo sapiens
taataaggaaaagttt

SEQ ID NO: 2265796 - DNA, 18 bp, Homo sapiens
taataaggaaaagtttaa

SEQ ID NO: 2265797 - DNA, 22 bp, Homo sapiens
taataattatatgctatttcta

SEQ ID NO: 2265798 - DNA, 23 bp, Homo sapiens
taataattatatgctatttctat

SEQ ID NO: 2265799 - DNA, 18 bp, Homo sapiens
taattatatgctatttct

SEQ ID NO: 2265800 - DNA, 20 bp, Homo sapiens
taattatatgctatttctat

SEQ ID NO: 2265801 - DNA, 12 bp, Homo sapiens
tacaaagtatta

SEQ ID NO: 2265802 - DNA, 13 bp, Homo sapiens
tacaaagtattaa

SEQ ID NO: 2265803 - DNA, 16 bp, Homo sapiens
tacaaagtattaagca

SEQ ID NO: 2265804 - DNA, 18 bp, Homo sapiens
tacaaagtattaagcata

SEQ ID NO: 2265805 - DNA, 12 bp, Homo sapiens
tacaattttgtt

SEQ ID NO: 2265806 - DNA, 21 bp, Homo sapiens
tacaattttgtttctgtactt

SEQ ID NO: 2265807 - DNA, 16 bp, Homo sapiens
tacagtataattaaca

SEQ ID NO: 2265808 - DNA, 13 bp, Homo sapiens
tactcaattttaa

SEQ ID NO: 2265809 - DNA, 16 bp, Homo sapiens
tactttgtgctggggt

SEQ ID NO: 2265810 - DNA, 19 bp, Homo sapiens
tactttttggcataacata

SEQ ID NO: 2265811 - DNA, 11 bp, Homo sapiens
tagaattctgt

SEQ ID NO: 2265812 - DNA, 14 bp, Homo sapiens
tagaattctgtata

SEQ ID NO: 2265813 - DNA, 21 bp, Homo sapiens
tagaattctgtatagattaga

SEQ ID NO: 2265814 - DNA, 14 bp, Homo sapiens
tagactggtgactg

SEQ ID NO: 2265815 - DNA, 18 bp, Homo sapiens
tagactggtgactgattc

SEQ ID NO: 2265816 - DNA, 21 bp, Homo sapiens
tagaggaagcctgattaaaga

SEQ ID NO: 2265817 - DNA, 14 bp, Homo sapiens
tagattagaattct

SEQ ID NO: 2265818 - DNA, 19 bp, Homo sapiens
tagattagaattctgtata

SEQ ID NO: 2265819 - DNA, 15 bp, Homo sapiens
tataattaacatgtt

SEQ ID NO: 2265820 - DNA, 18 bp, Homo sapiens
tatagattagaattctgt

SEQ ID NO: 2265821 - DNA, 19 bp, Homo sapiens
tatatctgaggaattctgt

SEQ ID NO: 2265822 - DNA, 20 bp, Homo sapiens
tatatctgaggaattctgta

SEQ ID NO: 2265823 - DNA, 21 bp, Homo sapiens
tatatctgaggaattctgtat

SEQ ID NO: 2265824 - DNA, 22 bp, Homo sapiens
tatatctgaggaattctgtata

SEQ ID NO: 2265825 - DNA, 23 bp, Homo sapiens
tatatctgaggaattctgtatag

SEQ ID NO: 2265826 - DNA, 19 bp, Homo sapiens
tatatttactaaaatggac

SEQ ID NO: 2265827 - DNA, 16 bp, Homo sapiens
tatattttcattctcc

SEQ ID NO: 2265828 - DNA, 20 bp, Homo sapiens
tatcacctgtcttgcctttt

SEQ ID NO: 2265829 - DNA, 15 bp, Homo sapiens
tatctgaggaattct

SEQ ID NO: 2265830 - DNA, 19 bp, Homo sapiens
tatgaaacttgtgtaaata

SEQ ID NO: 2265831 - DNA, 21 bp, Homo sapiens
tatgaaacttgtgtaaataca

SEQ ID NO: 2265832 - DNA, 18 bp, Homo sapiens
caaagttgcctaaatcca

SEQ ID NO: 2265833 - DNA, 13 bp, Homo sapiens
caataaaaaatta

SEQ ID NO: 2265834 - DNA, 17 bp, Homo sapiens
cactctccatttaataa

SEQ ID NO: 2265835 - DNA, 19 bp, Homo sapiens
cagatctgcctaaggactt

SEQ ID NO: 2265836 - DNA, 20 bp, Homo sapiens
cagatctgcctaaggacttc

SEQ ID NO: 2265837 - DNA, 12 bp, Homo sapiens
cagattattcac

SEQ ID NO: 2265838 - DNA, 22 bp, Homo sapiens
cagattttattatgtaaatccc

SEQ ID NO: 2265839 - DNA, 17 bp, Homo sapiens
cagcaaaaatattttat

SEQ ID NO: 2265840 - DNA, 14 bp, Homo sapiens
cagcagattattca

SEQ ID NO: 2265841 - DNA, 21 bp, Homo sapiens
cagctggtgccctgctttcag

SEQ ID NO: 2265842 - DNA, 23 bp, Homo sapiens
cagctggtgccctgctttcagat

SEQ ID NO: 2265843 - DNA, 15 bp, Homo sapiens
cagtataattaacat

SEQ ID NO: 2265844 - DNA, 21 bp, Homo sapiens
cagtataattaacatgttaaa

SEQ ID NO: 2265845 - DNA, 13 bp, Homo sapiens
cagtattgtacaa

SEQ ID NO: 2265846 - DNA, 19 bp, Homo sapiens
cagtattgtacaaagtatt

SEQ ID NO: 2265847 - DNA, 14 bp, Homo sapiens
cataaatctgtgaa

SEQ ID NO: 2265848 - DNA, 18 bp, Homo sapiens
cataaatctgtgaacttg

SEQ ID NO: 2265849 - DNA, 19 bp, Homo sapiens
cataacataaatctgtgaa

SEQ ID NO: 2265850 - DNA, 19 bp, Homo sapiens
catagtctggctgtaccca

SEQ ID NO: 2265851 - DNA, 18 bp, Homo sapiens
catatatttttatattta

SEQ ID NO: 2265852 - DNA, 23 bp, Homo sapiens
catggaacgcgttgaaattgtaa

SEQ ID NO: 2265853 - DNA, 14 bp, Homo sapiens
cattattcaaagtt

SEQ ID NO: 2265854 - DNA, 15 bp, Homo sapiens
cattattcaaagttg

SEQ ID NO: 2265855 - DNA, 21 bp, Homo sapiens
cattattcaaagttgcctaaa

SEQ ID NO: 2265856 - DNA, 22 bp, Homo sapiens
cattattcaaagttgcctaaat

SEQ ID NO: 2265857 - DNA, 11 bp, Homo sapiens
cattattttat

SEQ ID NO: 2265858 - DNA, 12 bp, Homo sapiens
cattattttatt

SEQ ID NO: 2265859 - DNA, 17 bp, Homo sapiens
cattattttattatgaa

SEQ ID NO: 2265860 - DNA, 19 bp, Homo sapiens
catttaataattatatgct

SEQ ID NO: 2265861 - DNA, 23 bp, Homo sapiens
catttaataattatatgctattt

SEQ ID NO: 2265862 - DNA, 16 bp, Homo sapiens
ccaaaaaccagtattg

SEQ ID NO: 2265863 - DNA, 19 bp, Homo sapiens
ccaaaaaccagtattgtac

SEQ ID NO: 2265864 - DNA, 21 bp, Homo sapiens
ccagcagattattcactgatt

SEQ ID NO: 2265865 - DNA, 14 bp, Homo sapiens
ccagtattgtacaa

SEQ ID NO: 2265866 - DNA, 16 bp, Homo sapiens
ccagttttgtttggac

SEQ ID NO: 2265867 - DNA, 19 bp, Homo sapiens
ccagttttgtttggaccaa

SEQ ID NO: 2265868 - DNA, 20 bp, Homo sapiens
ccatcaataaaaaattatga

SEQ ID NO: 2265869 - DNA, 19 bp, Homo sapiens
ccatgggataaatgccatc

SEQ ID NO: 2265870 - DNA, 11 bp, Homo sapiens
ccattattcaa

SEQ ID NO: 2265871 - DNA, 22 bp, Homo sapiens
ccattattcaaagttgcctaaa

SEQ ID NO: 2265872 - DNA, 20 bp, Homo sapiens
cccaggaatggagcctgcac

SEQ ID NO: 2265873 - DNA, 16 bp, Homo sapiens
ccccaccctgcctcac

SEQ ID NO: 2265874 - DNA, 18 bp, Homo sapiens
cctaaatccatttggaaa

SEQ ID NO: 2265875 - DNA, 21 bp, Homo sapiens
cctaaatccatttggaaatct

SEQ ID NO: 2265876 - DNA, 15 bp, Homo sapiens
cctgctttcagatac

SEQ ID NO: 2265877 - DNA, 21 bp, Homo sapiens
cctgctttcagatactggatt

SEQ ID NO: 2265878 - DNA, 19 bp, Homo sapiens
cctgtcttgcctttttcat

SEQ ID NO: 2265879 - DNA, 13 bp, Homo sapiens
cgcgttgaaattg

SEQ ID NO: 2265880 - DNA, 22 bp, Homo sapiens
cgcgttgaaattgtaattatat

SEQ ID NO: 2265881 - DNA, 13 bp, Homo sapiens
cggatgatttcta

SEQ ID NO: 2265882 - DNA, 15 bp, Homo sapiens
cggtgaatggctttg

SEQ ID NO: 2265883 - DNA, 13 bp, Homo sapiens
cgtgctaaggact

SEQ ID NO: 2265884 - DNA, 14 bp, Homo sapiens
cgtgctaaggactt

SEQ ID NO: 2265885 - DNA, 18 bp, Homo sapiens
cgttgaaattgtaattat

SEQ ID NO: 2265886 - DNA, 14 bp, Homo sapiens
ctaaggacttcttt

SEQ ID NO: 2265887 - DNA, 16 bp, Homo sapiens
ctaaggacttctttaa

SEQ ID NO: 2265888 - DNA, 16 bp, Homo sapiens
ctaaggacttgttaga

SEQ ID NO: 2265889 - DNA, 17 bp, Homo sapiens
ctagactggtgactgat

SEQ ID NO: 2265890 - DNA, 18 bp, Homo sapiens
ctagactggtgactgatt

SEQ ID NO: 2265891 - DNA, 19 bp, Homo sapiens
ctagactggtgactgattc

SEQ ID NO: 2265892 - DNA, 22 bp, Homo sapiens
ctagactggtgactgattcttc

SEQ ID NO: 2265893 - DNA, 12 bp, Homo sapiens
ctagttcactct

SEQ ID NO: 2265894 - DNA, 13 bp, Homo sapiens
ctatgctgagttt

SEQ ID NO: 2265895 - DNA, 19 bp, Homo sapiens
ctatttctatattttcatt

SEQ ID NO: 2265896 - DNA, 18 bp, Homo sapiens
ctcagattttattatgta

SEQ ID NO: 2265897 - DNA, 16 bp, Homo sapiens
ctgaagtcagatctgc

SEQ ID NO: 2265898 - DNA, 21 bp, Homo sapiens
ctgaagtcagatctgcctaag

SEQ ID NO: 2265899 - DNA, 16 bp, Homo sapiens
ctgaggaattctgtat

SEQ ID NO: 2265900 - DNA, 15 bp, Homo sapiens
ctgattcttcagcaa

SEQ ID NO: 2265901 - DNA, 17 bp, Homo sapiens
ctgcacggtgaatggct

SEQ ID NO: 2265902 - DNA, 15 bp, Homo sapiens
ctgcctaaggacttc

SEQ ID NO: 2265903 - DNA, 12 bp, Homo sapiens
ctgctttcagat

SEQ ID NO: 2265904 - DNA, 15 bp, Homo sapiens
ctgctttcagatact

SEQ ID NO: 2265905 - DNA, 18 bp, Homo sapiens
ctggtgactgattcttca

SEQ ID NO: 2265906 - DNA, 15 bp, Homo sapiens
ctgtactttttggca

SEQ ID NO: 2265907 - DNA, 20 bp, Homo sapiens
ctgtatagattagaattctg

SEQ ID NO: 2265908 - DNA, 16 bp, Homo sapiens
ctgtatagattagaga

SEQ ID NO: 2265909 - DNA, 12 bp, Homo sapiens
ctgtggtgactt

SEQ ID NO: 2265910 - DNA, 13 bp, Homo sapiens
cttaaagttgaat

SEQ ID NO: 2265911 - DNA, 17 bp, Homo sapiens
cttcagcaaaaatattt

SEQ ID NO: 2265912 - DNA, 15 bp, Homo sapiens
cttctttaattttgg

SEQ ID NO: 2265913 - DNA, 19 bp, Homo sapiens
cttctttaattttggaatt

SEQ ID NO: 2265914 - DNA, 20 bp, Homo sapiens
cttgaaatttgaattttgtg

SEQ ID NO: 2265915 - DNA, 20 bp, Homo sapiens
cttgcctttttcattatttt

SEQ ID NO: 2265916 - DNA, 21 bp, Homo sapiens
cttgtctcagattttattatg

SEQ ID NO: 2265917 - DNA, 21 bp, Homo sapiens
cttgtgtaaatacaattttgt

SEQ ID NO: 2265918 - DNA, 13 bp, Homo sapiens
cttgttagatcta

SEQ ID NO: 2265919 - DNA, 16 bp, Homo sapiens
cttgttagatctagtt

SEQ ID NO: 2265920 - DNA, 16 bp, Homo sapiens
ctttaattttggaatt

SEQ ID NO: 2265921 - DNA, 15 bp, Homo sapiens
ctttcagatactgga

SEQ ID NO: 2265922 - DNA, 17 bp, Homo sapiens
ctttcagatactggatt

SEQ ID NO: 2265923 - DNA, 22 bp, Homo sapiens
ctttcagatactggattgtact

SEQ ID NO: 2265924 - DNA, 16 bp, Homo sapiens
ctttctctttcgttac

SEQ ID NO: 2265925 - DNA, 14 bp, Homo sapiens
ctttggataataag

SEQ ID NO: 2265926 - DNA, 20 bp, Homo sapiens
ctttgtctacaccattatgt

SEQ ID NO: 2265927 - DNA, 20 bp, Homo sapiens
ctttgtgctggggttatctg

SEQ ID NO: 2265928 - DNA, 11 bp, Homo sapiens
cttttctgata

SEQ ID NO: 2265929 - DNA, 14 bp, Homo sapiens
cttttctgatagag

SEQ ID NO: 2265930 - DNA, 14 bp, Homo sapiens
cttttctgatccag

SEQ ID NO: 2265931 - DNA, 23 bp, Homo sapiens
gaaaagtttaatattaaagccat

SEQ ID NO: 2265932 - DNA, 18 bp, Homo sapiens
gaaacggatgatttctat

SEQ ID NO: 2265933 - DNA, 20 bp, Homo sapiens
gaaacttgtgtaaatacaat

SEQ ID NO: 2265934 - DNA, 12 bp, Homo sapiens
gaaatctttaaa

SEQ ID NO: 2265935 - DNA, 12 bp, Homo sapiens
gaacttgaaatt

SEQ ID NO: 2265936 - DNA, 13 bp, Homo sapiens
gaacttgaaattt

SEQ ID NO: 2265937 - DNA, 15 bp, Homo sapiens
gaacttgaaatttga

SEQ ID NO: 2265938 - DNA, 16 bp, Homo sapiens
gacatagtctggctgt

SEQ ID NO: 2265939 - DNA, 20 bp, Homo sapiens
gaccaaaaaccagtattgta

SEQ ID NO: 2265940 - DNA, 13 bp, Homo sapiens
gactgattcttca

SEQ ID NO: 2265941 - DNA, 18 bp, Homo sapiens
gactggtgactgattctt

SEQ ID NO: 2265942 - DNA, 19 bp, Homo sapiens
gactttggataataaggaa

SEQ ID NO: 2265943 - DNA, 13 bp, Homo sapiens
gagagtgttgaaa

SEQ ID NO: 2265944 - DNA, 17 bp, Homo sapiens
gagcctgcacggtgaat

SEQ ID NO: 2265945 - DNA, 14 bp, Homo sapiens
gaggaattctgtat

SEQ ID NO: 2265946 - DNA, 16 bp, Homo sapiens
gaggaattctgtatag

SEQ ID NO: 2265947 - DNA, 21 bp, Homo sapiens
gagtgagttgggtgtattgtg

SEQ ID NO: 2265948 - DNA, 12 bp, Homo sapiens
gagtgttgaaac

SEQ ID NO: 2265949 - DNA, 20 bp, Homo sapiens
gataaatgccatcaataaaa

SEQ ID NO: 2265950 - DNA, 21 bp, Homo sapiens
gatagaggaagcctgattaaa

SEQ ID NO: 2265951 - DNA, 11 bp, Homo sapiens
gatccagtttt

SEQ ID NO: 2265952 - DNA, 17 bp, Homo sapiens
gatccagttttgtttgg

SEQ ID NO: 2265953 - DNA, 22 bp, Homo sapiens
gatccagttttgtttggaccaa

SEQ ID NO: 2265954 - DNA, 17 bp, Homo sapiens
gatctagttcactctcc

SEQ ID NO: 2265955 - DNA, 12 bp, Homo sapiens
gatctgcctaag

SEQ ID NO: 2265956 - DNA, 16 bp, Homo sapiens
gatctgcctaaggact

SEQ ID NO: 2265957 - DNA, 23 bp, Homo sapiens
gatgatttctatgctgagtttgt

SEQ ID NO: 2265958 - DNA, 18 bp, Homo sapiens
gattagagagtgttgaaa

SEQ ID NO: 2265959 - DNA, 22 bp, Homo sapiens
tgtgcgctaaacttttctgata

SEQ ID NO: 2265960 - DNA, 23 bp, Homo sapiens
tgtgcgctaaacttttctgatag

SEQ ID NO: 2265961 - DNA, 16 bp, Homo sapiens
tgtggtgactttggat

SEQ ID NO: 2265962 - DNA, 17 bp, Homo sapiens
tgtggtgactttggata

SEQ ID NO: 2265963 - DNA, 20 bp, Homo sapiens
tgttgaaacggatgatttct

SEQ ID NO: 2265964 - DNA, 13 bp, Homo sapiens
tgtttagtcttgt

SEQ ID NO: 2265965 - DNA, 18 bp, Homo sapiens
tgtttagtcttgtctcag

SEQ ID NO: 2265966 - DNA, 19 bp, Homo sapiens
tgtttagtcttgtctcaga

SEQ ID NO: 2265967 - DNA, 14 bp, Homo sapiens
tgtttattacagta

SEQ ID NO: 2265968 - DNA, 12 bp, Homo sapiens
tgtttgtttagt

SEQ ID NO: 2265969 - DNA, 12 bp, Homo sapiens
ttaaagccatgt

SEQ ID NO: 2265970 - DNA, 18 bp, Homo sapiens
ttaaagccatgtttatta

SEQ ID NO: 2265971 - DNA, 18 bp, Homo sapiens
ttaacatgttaaaccatg

SEQ ID NO: 2265972 - DNA, 20 bp, Homo sapiens
ttaataattatatgctattt

SEQ ID NO: 2265973 - DNA, 11 bp, Homo sapiens
ttaatattaaa

SEQ ID NO: 2265974 - DNA, 17 bp, Homo sapiens
ttaatattaaagccatg

SEQ ID NO: 2265975 - DNA, 22 bp, Homo sapiens
ttaatattaaagccatgtttat

SEQ ID NO: 2265976 - DNA, 12 bp, Homo sapiens
ttacagaagccc

SEQ ID NO: 2265977 - DNA, 14 bp, Homo sapiens
ttagagagtgttga

SEQ ID NO: 2265978 - DNA, 17 bp, Homo sapiens
ttagagagtgttgaaac

SEQ ID NO: 2265979 - DNA, 18 bp, Homo sapiens
ttagagagtgttgaaacg

SEQ ID NO: 2265980 - DNA, 12 bp, Homo sapiens
ttagagattttt

SEQ ID NO: 2265981 - DNA, 14 bp, Homo sapiens
ttagatctagttca

SEQ ID NO: 2265982 - DNA, 23 bp, Homo sapiens
ttatatctgaggaattctgtata

SEQ ID NO: 2265983 - DNA, 16 bp, Homo sapiens
ttatatgctatttcta

SEQ ID NO: 2265984 - DNA, 13 bp, Homo sapiens
ttatgatccagca

SEQ ID NO: 2265985 - DNA, 21 bp, Homo sapiens
ttatgtaaatcccattattca

SEQ ID NO: 2265986 - DNA, 22 bp, Homo sapiens
ttatgtaaatcccattattcaa

SEQ ID NO: 2265987 - DNA, 11 bp, Homo sapiens
ttattatgaaa

SEQ ID NO: 2265988 - DNA, 21 bp, Homo sapiens
ttattatgaaacttgtgtaaa

SEQ ID NO: 2265989 - DNA, 23 bp, Homo sapiens
ttattatgaaacttgtgtaaata

SEQ ID NO: 2265990 - DNA, 16 bp, Homo sapiens
ttattatgtaaatccc

SEQ ID NO: 2265991 - DNA, 13 bp, Homo sapiens
ttattcaaagttg

SEQ ID NO: 2265992 - DNA, 19 bp, Homo sapiens
ttattcaaagttgcctaaa

SEQ ID NO: 2265993 - DNA, 14 bp, Homo sapiens
ttattcactgattt

SEQ ID NO: 2265994 - DNA, 12 bp, Homo sapiens
ttattggctttt

SEQ ID NO: 2265995 - DNA, 18 bp, Homo sapiens
ttattggcttttctgatc

SEQ ID NO: 2265996 - DNA, 13 bp, Homo sapiens
ttattttattatg

SEQ ID NO: 2265997 - DNA, 11 bp, Homo sapiens
ttcaaagttgc

SEQ ID NO: 2265998 - DNA, 15 bp, Homo sapiens
ttcaaagttgcctaa

SEQ ID NO: 2265999 - DNA, 11 bp, Homo sapiens
ttcactgattt

SEQ ID NO: 2266000 - DNA, 20 bp, Homo sapiens
ttcagatactggattgtact

SEQ ID NO: 2266001 - DNA, 17 bp, Homo sapiens
ttcagcaaaaatatttt

SEQ ID NO: 2266002 - DNA, 19 bp, Homo sapiens
ttcagcaaaaatattttat

SEQ ID NO: 2266003 - DNA, 20 bp, Homo sapiens
ttcatggaacgcgttgaaat

SEQ ID NO: 2266004 - DNA, 18 bp, Homo sapiens
ttctatattttcattctc

SEQ ID NO: 2266005 - DNA, 21 bp, Homo sapiens
ttctgatagaggaagcctgat

SEQ ID NO: 2266006 - DNA, 19 bp, Homo sapiens
ttctgtactttttggcata

SEQ ID NO: 2266007 - DNA, 13 bp, Homo sapiens
ttctgtatagatt

SEQ ID NO: 2266008 - DNA, 14 bp, Homo sapiens
ttctgtatagatta

SEQ ID NO: 2266009 - DNA, 12 bp, Homo sapiens
ttctttaatttt

SEQ ID NO: 2266010 - DNA, 13 bp, Homo sapiens
ttgaaattgtaat

SEQ ID NO: 2266011 - DNA, 14 bp, Homo sapiens
ttgaaattgtaatt

SEQ ID NO: 2266012 - DNA, 15 bp, Homo sapiens
ttgaatttattggct

SEQ ID NO: 2266013 - DNA, 22 bp, Homo sapiens
ttgaatttattggcttttctga

SEQ ID NO: 2266014 - DNA, 14 bp, Homo sapiens
ttgacatagtctgg

SEQ ID NO: 2266015 - DNA, 17 bp, Homo sapiens
ttgacatagtctggctg

SEQ ID NO: 2266016 - DNA, 15 bp, Homo sapiens
ttgcctttttcatta

SEQ ID NO: 2266017 - DNA, 16 bp, Homo sapiens
ttgcctttttcattat

SEQ ID NO: 2266018 - DNA, 18 bp, Homo sapiens
ttggcataacataaatct

SEQ ID NO: 2266019 - DNA, 22 bp, Homo sapiens
ttggcttttctgatccagtttt

SEQ ID NO: 2266020 - DNA, 15 bp, Homo sapiens
ttggggattcttaaa

SEQ ID NO: 2266021 - DNA, 13 bp, Homo sapiens
ttgggtgtattgt

SEQ ID NO: 2266022 - DNA, 15 bp, Homo sapiens
ttgggtgtattgtgc

SEQ ID NO: 2266023 - DNA, 16 bp, Homo sapiens
ttgggtgtattgtgcg

SEQ ID NO: 2266024 - DNA, 14 bp, Homo sapiens
ttgtacaaagtatt

SEQ ID NO: 2266025 - DNA, 20 bp, Homo sapiens
ttgtacaaagtattaagcat

SEQ ID NO: 2266026 - DNA, 22 bp, Homo sapiens
ttgtacaaagtattaagcatat

SEQ ID NO: 2266027 - DNA, 19 bp, Homo sapiens
ttgtctacaccattatgtg

SEQ ID NO: 2266028 - DNA, 13 bp, Homo sapiens
ttgtctcagattt

SEQ ID NO: 2266029 - DNA, 20 bp, Homo sapiens
ttgtctcagattttattatg

SEQ ID NO: 2266030 - DNA, 19 bp, Homo sapiens
ttgtgctggggttatctga

SEQ ID NO: 2266031 - DNA, 14 bp, Homo sapiens
ttgtttctgtactt

SEQ ID NO: 2266032 - DNA, 16 bp, Homo sapiens
tttaacaacagctggt

SEQ ID NO: 2266033 - DNA, 17 bp, Homo sapiens
tttaattttggaatttt

SEQ ID NO: 2266034 - DNA, 17 bp, Homo sapiens
tttactaaaatggactg

SEQ ID NO: 2266035 - DNA, 14 bp, Homo sapiens
tttagtcttgtctc

SEQ ID NO: 2266036 - DNA, 16 bp, Homo sapiens
tttatatttactaaaa

SEQ ID NO: 2266037 - DNA, 13 bp, Homo sapiens
tttatgatccagc

SEQ ID NO: 2266038 - DNA, 14 bp, Homo sapiens
tttattacagtata

SEQ ID NO: 2266039 - DNA, 18 bp, Homo sapiens
tttattacagtataatta

SEQ ID NO: 2266040 - DNA, 22 bp, Homo sapiens
tttattacagtataattaacat

SEQ ID NO: 2266041 - DNA, 23 bp, Homo sapiens
tttattacagtataattaacatg

SEQ ID NO: 2266042 - DNA, 21 bp, Homo sapiens
tttattatgaaacttgtgtaa

SEQ ID NO: 2266043 - DNA, 13 bp, Homo sapiens
tttcagatactgg

SEQ ID NO: 2266044 - DNA, 21 bp, Homo sapiens
tttctatgctgagtttgtgct

SEQ ID NO: 2266045 - DNA, 15 bp, Homo sapiens
tttctgatccagttt

SEQ ID NO: 2266046 - DNA, 20 bp, Homo sapiens
tttctgtactttttggcata

SEQ ID NO: 2266047 - DNA, 12 bp, Homo sapiens
tttgaattttgt

SEQ ID NO: 2266048 - DNA, 14 bp, Homo sapiens
tttgaattttgtgt

SEQ ID NO: 2266049 - DNA, 16 bp, Homo sapiens
tttggataataaggaa

SEQ ID NO: 2266050 - DNA, 11 bp, Homo sapiens
tttgtatagaa

SEQ ID NO: 2266051 - DNA, 19 bp, Homo sapiens
tttgtgctggtgtatgtgt

SEQ ID NO: 2266052 - DNA, 13 bp, Homo sapiens
ttttatatttact

SEQ ID NO: 2266053 - DNA, 21 bp, Homo sapiens
ttttattatgaaacttgtgta

SEQ ID NO: 2266054 - DNA, 14 bp, Homo sapiens
ttttattatgtaaa

SEQ ID NO: 2266055 - DNA, 21 bp, Homo sapiens
ttttcattattttattatgaa

SEQ ID NO: 2266056 - DNA, 15 bp, Homo sapiens
ttttctgatccagtt

SEQ ID NO: 2266057 - DNA, 15 bp, Homo sapiens
ttttggaattttcct

SEQ ID NO: 2266058 - DNA, 12 bp, Homo sapiens
ttttgtttggac

SEQ ID NO: 2266059 - DNA, 22 bp, Homo sapiens
ttttgtttggaccaaaaaccag

SEQ ID NO: 2266060 - DNA, 23 bp, Homo sapiens
ttttgtttggaccaaaaaccagt

SEQ ID NO: 2266061 - DNA, 22 bp, Homo sapiens
tttttcattattttattatgaa

SEQ ID NO: 2266062 - DNA, 23 bp, Homo sapiens
tttttggcataacataaatctgt

SEQ ID NO: 2266063 - DNA, 13 bp, Homo sapiens
gttacagaagccc

SEQ ID NO: 2266064 - DNA, 19 bp, Homo sapiens
gttcactctccatttaata

SEQ ID NO: 2266065 - DNA, 21 bp, Homo sapiens
gttgaaacggatgatttctat

SEQ ID NO: 2266066 - DNA, 22 bp, Homo sapiens
gttgaaacggatgatttctatg

SEQ ID NO: 2266067 - DNA, 15 bp, Homo sapiens
gttgcctaaatccat

SEQ ID NO: 2266068 - DNA, 17 bp, Homo sapiens
gttgcctaaatccattt

SEQ ID NO: 2266069 - DNA, 15 bp, Homo sapiens
gtttaatattaaagc

SEQ ID NO: 2266070 - DNA, 17 bp, Homo sapiens
gtttattacagtataat

SEQ ID NO: 2266071 - DNA, 14 bp, Homo sapiens
taaaaaaaaaattg

SEQ ID NO: 2266072 - DNA, 15 bp, Homo sapiens
taaagccatgtttat

SEQ ID NO: 2266073 - DNA, 13 bp, Homo sapiens
taaagttgaattt

SEQ ID NO: 2266074 - DNA, 14 bp, Homo sapiens
taaagttgaattta

SEQ ID NO: 2266075 - DNA, 17 bp, Homo sapiens
taaagttgaatttattg

SEQ ID NO: 2266076 - DNA, 23 bp, Homo sapiens
taaagttgaatttattggctttt

SEQ ID NO: 2266077 - DNA, 19 bp, Homo sapiens
taaatagctagactggtga

SEQ ID NO: 2266078 - DNA, 22 bp, Homo sapiens
taaatccatttggaaatcttta

SEQ ID NO: 2266079 - DNA, 23 bp, Homo sapiens
taaatccatttggaaatctttaa

SEQ ID NO: 2266080 - DNA, 15 bp, Homo sapiens
taaatctgtgaactt

SEQ ID NO: 2266081 - DNA, 16 bp, Homo sapiens
taaatctgtgaacttg

SEQ ID NO: 2266082 - DNA, 12 bp, Homo sapiens
taacataaatct

SEQ ID NO: 2266083 - DNA, 17 bp, Homo sapiens
taacataaatctgtgaa

SEQ ID NO: 2266084 - DNA, 18 bp, Homo sapiens
taacataaatctgtgaac

SEQ ID NO: 2266085 - DNA, 20 bp, Homo sapiens
taacataaatctgtgaactt

SEQ ID NO: 2266086 - DNA, 16 bp, Homo sapiens
taacatgttaaaccat

SEQ ID NO: 2266087 - DNA, 21 bp, Homo sapiens
taagcatatatttttatattt

SEQ ID NO: 2266088 - DNA, 22 bp, Homo sapiens
taagcatatatttttatattta

SEQ ID NO: 2266089 - DNA, 19 bp, Homo sapiens
taaggaaaagtttaatatt

SEQ ID NO: 2266090 - DNA, 16 bp, Homo sapiens
taaggacttctttaat

SEQ ID NO: 2266091 - DNA, 20 bp, Homo sapiens
taataaggaaaagtttaata

SEQ ID NO: 2266092 - DNA, 16 bp, Homo sapiens
taataattatatgcta

SEQ ID NO: 2266093 - DNA, 19 bp, Homo sapiens
taataattatatgctattt

SEQ ID NO: 2266094 - DNA, 20 bp, Homo sapiens
taataattatatgctatttc

SEQ ID NO: 2266095 - DNA, 21 bp, Homo sapiens
ctggtgccctgctttcagata

SEQ ID NO: 2266096 - DNA, 16 bp, Homo sapiens
ctgtgaacttgaaatt

SEQ ID NO: 2266097 - DNA, 17 bp, Homo sapiens
ctgtggtgactttggat

SEQ ID NO: 2266098 - DNA, 18 bp, Homo sapiens
ctgtggtgactttggata

SEQ ID NO: 2266099 - DNA, 23 bp, Homo sapiens
ctgtggtgactttggataataag

SEQ ID NO: 2266100 - DNA, 11 bp, Homo sapiens
cttaaagttga

SEQ ID NO: 2266101 - DNA, 14 bp, Homo sapiens
cttaaagttgaatt

SEQ ID NO: 2266102 - DNA, 16 bp, Homo sapiens
cttctttaattttgga

SEQ ID NO: 2266103 - DNA, 18 bp, Homo sapiens
cttctttaattttggaat

SEQ ID NO: 2266104 - DNA, 19 bp, Homo sapiens
cttgaaatttgaattttgt

SEQ ID NO: 2266105 - DNA, 12 bp, Homo sapiens
cttgtgtaaata

SEQ ID NO: 2266106 - DNA, 16 bp, Homo sapiens
cttgtgtaaatacaat

SEQ ID NO: 2266107 - DNA, 13 bp, Homo sapiens
ctttaattttgga

SEQ ID NO: 2266108 - DNA, 15 bp, Homo sapiens
ctttaattttggaat

SEQ ID NO: 2266109 - DNA, 13 bp, Homo sapiens
ctttcagatactg

SEQ ID NO: 2266110 - DNA, 11 bp, Homo sapiens
cttttctgatc

SEQ ID NO: 2266111 - DNA, 15 bp, Homo sapiens
cttttctgatccagt

SEQ ID NO: 2266112 - DNA, 12 bp, Homo sapiens
ctttttcattat

SEQ ID NO: 2266113 - DNA, 14 bp, Homo sapiens
ctttttcattattt

SEQ ID NO: 2266114 - DNA, 21 bp, Homo sapiens
ctttttcattattttattatg

SEQ ID NO: 2266115 - DNA, 20 bp, Homo sapiens
ctttttggcataacataaat

SEQ ID NO: 2266116 - DNA, 22 bp, Homo sapiens
ctttttggcataacataaatct

SEQ ID NO: 2266117 - DNA, 15 bp, Homo sapiens
cttttttaaataaat

SEQ ID NO: 2266118 - DNA, 20 bp, Homo sapiens
gaaaagtttaatattaaagc

SEQ ID NO: 2266119 - DNA, 21 bp, Homo sapiens
gaaaagtttaatattaaagcc

SEQ ID NO: 2266120 - DNA, 16 bp, Homo sapiens
gaaacttgtgtaaata

SEQ ID NO: 2266121 - DNA, 15 bp, Homo sapiens
gaaatctttaaaaaa

SEQ ID NO: 2266122 - DNA, 21 bp, Homo sapiens
tttggaccaaaaaccagtatt

SEQ ID NO: 2266123 - DNA, 22 bp, Homo sapiens
tttggaccaaaaaccagtattg

SEQ ID NO: 2266124 - DNA, 24 bp, Homo sapiens
tttggaccaaaaaccagtattgta

SEQ ID NO: 2266125 - DNA, 15 bp, Homo sapiens
tttgtctacaccatt

SEQ ID NO: 2266126 - DNA, 14 bp, Homo sapiens
tttgttgtttgttt

SEQ ID NO: 2266127 - DNA, 19 bp, Homo sapiens
tttgttgtttgtttagtct

SEQ ID NO: 2266128 - DNA, 13 bp, Homo sapiens
tttgtttctgtac

SEQ ID NO: 2266129 - DNA, 18 bp, Homo sapiens
tttgtttctgtacttttt

SEQ ID NO: 2266130 - DNA, 12 bp, Homo sapiens
ttttattatgaa

SEQ ID NO: 2266131 - DNA, 22 bp, Homo sapiens
ttttattatgaaacttgtgtaa

SEQ ID NO: 2266132 - DNA, 13 bp, Homo sapiens
ttttattatgtaa

SEQ ID NO: 2266133 - DNA, 22 bp, Homo sapiens
ttttcattctcctatcacctgt

SEQ ID NO: 2266134 - DNA, 18 bp, Homo sapiens
ttttgttgtttgtttagt

SEQ ID NO: 2266135 - DNA, 19 bp, Homo sapiens
tgaaacggatgatttctat

SEQ ID NO: 2266136 - DNA, 23 bp, Homo sapiens
tgaaacttgtgtaaatacaattt

SEQ ID NO: 2266137 - DNA, 15 bp, Homo sapiens
tgaaattgtaattat

SEQ ID NO: 2266138 - DNA, 19 bp, Homo sapiens
tgaaattgtaattatatct

SEQ ID NO: 2266139 - DNA, 17 bp, Homo sapiens
tgaaatttgaattttgt

SEQ ID NO: 2266140 - DNA, 13 bp, Homo sapiens
tgaacttgaaatt

SEQ ID NO: 2266141 - DNA, 17 bp, Homo sapiens
tgaatggctttgtatag

SEQ ID NO: 2266142 - DNA, 18 bp, Homo sapiens
tgaatggctttgtataga

SEQ ID NO: 2266143 - DNA, 22 bp, Homo sapiens
tgaatggctttgtatagaacct

SEQ ID NO: 2266144 - DNA, 21 bp, Homo sapiens
tgaatttattggcttttctga

SEQ ID NO: 2266145 - DNA, 13 bp, Homo sapiens
tgactgattcttc

SEQ ID NO: 2266146 - DNA, 22 bp, Homo sapiens
tgactttggataataaggaaaa

SEQ ID NO: 2266147 - DNA, 19 bp, Homo sapiens
tgaggaattctgtatagat

SEQ ID NO: 2266148 - DNA, 22 bp, Homo sapiens
tgatccagttttgtttggacca

SEQ ID NO: 2266149 - DNA, 12 bp, Homo sapiens
tgatttctatgc

SEQ ID NO: 2266150 - DNA, 14 bp, Homo sapiens
tgcacggtgaatgg

SEQ ID NO: 2266151 - DNA, 19 bp, Homo sapiens
tgcacggtgaatggctttg

SEQ ID NO: 2266152 - DNA, 15 bp, Homo sapiens
tgcctaaatccattt

SEQ ID NO: 2266153 - DNA, 22 bp, Homo sapiens
tgcctaaatccatttggaaatc

SEQ ID NO: 2266154 - DNA, 13 bp, Homo sapiens
tgcctaaggactt

SEQ ID NO: 2266155 - DNA, 20 bp, Homo sapiens
tgcctaaggacttctttaat

SEQ ID NO: 2266156 - DNA, 14 bp, Homo sapiens
tgcctttttcatta

SEQ ID NO: 2266157 - DNA, 15 bp, Homo sapiens
tgcctttttcattat

SEQ ID NO: 2266158 - DNA, 16 bp, Homo sapiens
tgcctttttcattatt

SEQ ID NO: 2266159 - DNA, 21 bp, Homo sapiens
tgcctttttcattattttatt

SEQ ID NO: 2266160 - DNA, 12 bp, Homo sapiens
tgctaaggactt

SEQ ID NO: 2266161 - DNA, 12 bp, Homo sapiens
tgctatttctat

SEQ ID NO: 2266162 - DNA, 14 bp, Homo sapiens
tgctatttctatat

SEQ ID NO: 2266163 - DNA, 20 bp, Homo sapiens
tgctatttctatattttcat

SEQ ID NO: 2266164 - DNA, 12 bp, Homo sapiens
tgctttcagata

SEQ ID NO: 2266165 - DNA, 16 bp, Homo sapiens
tggaacgcgttgaaat

SEQ ID NO: 2266166 - DNA, 15 bp, Homo sapiens
tggaccaaaaaccag

SEQ ID NO: 2266167 - DNA, 17 bp, Homo sapiens
tggactgtggtgacttt

SEQ ID NO: 2266168 - DNA, 19 bp, Homo sapiens
tggactgtggtgactttgg

SEQ ID NO: 2266169 - DNA, 13 bp, Homo sapiens
tggggattcttaa

SEQ ID NO: 2266170 - DNA, 20 bp, Homo sapiens
tggtccgtgctaaggacttg

SEQ ID NO: 2266171 - DNA, 21 bp, Homo sapiens
gattattcactgatttgacat

SEQ ID NO: 2266172 - DNA, 22 bp, Homo sapiens
gattattcactgatttgacata

SEQ ID NO: 2266173 - DNA, 21 bp, Homo sapiens
gattcttaaagttgaatttat

SEQ ID NO: 2266174 - DNA, 15 bp, Homo sapiens
gattttattatgtaa

SEQ ID NO: 2266175 - DNA, 19 bp, Homo sapiens
gattttattatgtaaatcc

SEQ ID NO: 2266176 - DNA, 23 bp, Homo sapiens
gattttattatgtaaatcccatt

SEQ ID NO: 2266177 - DNA, 18 bp, Homo sapiens
gatttttttgttgtttgt

SEQ ID NO: 2266178 - DNA, 16 bp, Homo sapiens
gcaaaaatattttatg

SEQ ID NO: 2266179 - DNA, 23 bp, Homo sapiens
gcaaaaatattttatgatccagc

SEQ ID NO: 2266180 - DNA, 15 bp, Homo sapiens
gcataacataaatct

SEQ ID NO: 2266181 - DNA, 21 bp, Homo sapiens
gcataacataaatctgtgaac

SEQ ID NO: 2266182 - DNA, 23 bp, Homo sapiens
gcataacataaatctgtgaactt

SEQ ID NO: 2266183 - DNA, 14 bp, Homo sapiens
gcatatatttttat

SEQ ID NO: 2266184 - DNA, 24 bp, Homo sapiens
gccatcaataaaaaattatgacat

SEQ ID NO: 2266185 - DNA, 16 bp, Homo sapiens
gccctgctttcagata

SEQ ID NO: 2266186 - DNA, 13 bp, Homo sapiens
gcctaaatccatt

SEQ ID NO: 2266187 - DNA, 19 bp, Homo sapiens
gcctaaatccatttggaaa

SEQ ID NO: 2266188 - DNA, 16 bp, Homo sapiens
gcctgattaaagaatg

SEQ ID NO: 2266189 - DNA, 20 bp, Homo sapiens
gcctttttcattattttatt

SEQ ID NO: 2266190 - DNA, 23 bp, Homo sapiens
gcctttttcattattttattatg

SEQ ID NO: 2266191 - DNA, 24 bp, Homo sapiens
gcgttgaaattgtaattatatctg

SEQ ID NO: 2266192 - DNA, 13 bp, Homo sapiens
gctaaacttttct

SEQ ID NO: 2266193 - DNA, 23 bp, Homo sapiens
gctaaggacttgttagatctagt

SEQ ID NO: 2266194 - DNA, 13 bp, Homo sapiens
gctagactggtga

SEQ ID NO: 2266195 - DNA, 20 bp, Homo sapiens
gctatttctatattttcatt

SEQ ID NO: 2266196 - DNA, 18 bp, Homo sapiens
gctttcagatactggatt

SEQ ID NO: 2266197 - DNA, 15 bp, Homo sapiens
gcttttctgatccag

SEQ ID NO: 2266198 - DNA, 18 bp, Homo sapiens
ggaaaagtttaatattaa

SEQ ID NO: 2266199 - DNA, 16 bp, Homo sapiens
ggaacgcgttgaaatt

SEQ ID NO: 2266200 - DNA, 21 bp, Homo sapiens
ggaacgcgttgaaattgtaat

SEQ ID NO: 2266201 - DNA, 12 bp, Homo sapiens
ggaattctgtat

SEQ ID NO: 2266202 - DNA, 15 bp, Homo sapiens
ggactgtggtgactt

SEQ ID NO: 2266203 - DNA, 22 bp, Homo sapiens
ggacttctttaattttggaatt

SEQ ID NO: 2266204 - DNA, 15 bp, Homo sapiens
ggctgtacccaggaa

SEQ ID NO: 2266205 - DNA, 15 bp, Homo sapiens
ggctttgtatagaac

SEQ ID NO: 2266206 - DNA, 17 bp, Homo sapiens
ggcttttctgatccagt

SEQ ID NO: 2266207 - DNA, 15 bp, Homo sapiens
gggattcttaaagtt

SEQ ID NO: 2266208 - DNA, 19 bp, Homo sapiens
ggtgactttggataataag

SEQ ID NO: 2266209 - DNA, 19 bp, Homo sapiens
ggtgccctgctttcagata

SEQ ID NO: 2266210 - DNA, 21 bp, Homo sapiens
gtaaatacaattttgtttctg

SEQ ID NO: 2266211 - DNA, 22 bp, Homo sapiens
gtaaatacaattttgtttctgt

SEQ ID NO: 2266212 - DNA, 17 bp, Homo sapiens
gtaaatcccattattca

SEQ ID NO: 2266213 - DNA, 10 bp, Homo sapiens
gtataattaa

SEQ ID NO: 2266214 - DNA, 14 bp, Homo sapiens
gtataattaacatg

SEQ ID NO: 2266215 - DNA, 15 bp, Homo sapiens
gtataattaacatgt

SEQ ID NO: 2266216 - DNA, 17 bp, Homo sapiens
gtataattaacatgtta

SEQ ID NO: 2266217 - DNA, 23 bp, Homo sapiens
gtataattaacatgttaaaccat

SEQ ID NO: 2266218 - DNA, 15 bp, Homo sapiens
gtccgtgctaaggac

SEQ ID NO: 2266219 - DNA, 18 bp, Homo sapiens
gtcttgcctttttcatta

SEQ ID NO: 2266220 - DNA, 23 bp, Homo sapiens
gtcttgtctcagattttattatg

SEQ ID NO: 2266221 - DNA, 12 bp, Homo sapiens
gtgctaaggact

SEQ ID NO: 2266222 - DNA, 13 bp, Homo sapiens
gtgctaaggactt

SEQ ID NO: 2266223 - DNA, 22 bp, Homo sapiens
gtgctggggttatctgaagtca

SEQ ID NO: 2266224 - DNA, 22 bp, Homo sapiens
gtgtaaatacaattttgtttct

SEQ ID NO: 2266225 - DNA, 18 bp, Homo sapiens
gttaaaccatgggataaa

SEQ ID NO: 2266226 - DNA, 15 bp, Homo sapiens
gttgaaattgtaatt

SEQ ID NO: 2266227 - DNA, 20 bp, Homo sapiens
gttgaaattgtaattatatc

SEQ ID NO: 2266228 - DNA, 14 bp, Homo sapiens
gttgaatttattgg

SEQ ID NO: 2266229 - DNA, 22 bp, Homo sapiens
gttgaatttattggcttttctg

SEQ ID NO: 2266230 - DNA, 14 bp, Homo sapiens
gttgcctaaatcca

SEQ ID NO: 2266231 - DNA, 22 bp, Homo sapiens
gttgcctaaatccatttggaaa

SEQ ID NO: 2266232 - DNA, 18 bp, Homo sapiens
gtttagtcttgtctcaga

SEQ ID NO: 2266233 - DNA, 13 bp, Homo sapiens
gtttattacagta

SEQ ID NO: 2266234 - DNA, 15 bp, Homo sapiens
gtttctgtacttttt

SEQ ID NO: 2266235 - DNA, 15 bp, Homo sapiens
taaacttttctgata

SEQ ID NO: 2266236 - DNA, 13 bp, Homo sapiens
taaagccatgttt

SEQ ID NO: 2266237 - DNA, 20 bp, Homo sapiens
taaagccatgtttattacag

SEQ ID NO: 2266238 - DNA, 17 bp, Homo sapiens
taaataaataaatagct

SEQ ID NO: 2266239 - DNA, 23 bp, Homo sapiens
taaatagctagactggtgactga

SEQ ID NO: 2266240 - DNA, 14 bp, Homo sapiens
taaatccatttgga

SEQ ID NO: 2266241 - DNA, 15 bp, Homo sapiens
taaatccatttggaa

SEQ ID NO: 2266242 - DNA, 16 bp, Homo sapiens
taaatccatttggaaa

SEQ ID NO: 2266243 - DNA, 16 bp, Homo sapiens
taaatcccattattca

SEQ ID NO: 2266244 - DNA, 17 bp, Homo sapiens
taaatcccattattcaa

SEQ ID NO: 2266245 - DNA, 19 bp, Homo sapiens
taaatcccattattcaaag

SEQ ID NO: 2266246 - DNA, 21 bp, Homo sapiens
taaatctgtgaacttgaaatt

SEQ ID NO: 2266247 - DNA, 16 bp, Homo sapiens
taaatgccatcaataa

SEQ ID NO: 2266248 - DNA, 16 bp, Homo sapiens
taacaacagctggtgc

SEQ ID NO: 2266249 - DNA, 17 bp, Homo sapiens
taacatgttaaaccatg

SEQ ID NO: 2266250 - DNA, 17 bp, Homo sapiens
taaggaaaagtttaata

SEQ ID NO: 2266251 - DNA, 22 bp, Homo sapiens
taaggacttctttaattttgga

SEQ ID NO: 2266252 - DNA, 13 bp, Homo sapiens
taaggacttgtta

SEQ ID NO: 2266253 - DNA, 19 bp, Homo sapiens
taaggacttgttagatcta

SEQ ID NO: 2266254 - DNA, 14 bp, Homo sapiens
taatattaaagcca

SEQ ID NO: 2266255 - DNA, 15 bp, Homo sapiens
taatattaaagccat

SEQ ID NO: 2266256 - DNA, 21 bp, Homo sapiens
taatattaaagccatgtttat

SEQ ID NO: 2266257 - DNA, 15 bp, Homo sapiens
taattaacatgttaa

SEQ ID NO: 2266258 - DNA, 17 bp, Homo sapiens
taattaacatgttaaac

SEQ ID NO: 2266259 - DNA, 20 bp, Homo sapiens
taattaacatgttaaaccat

SEQ ID NO: 2266260 - DNA, 21 bp, Homo sapiens
taattaacatgttaaaccatg

SEQ ID NO: 2266261 - DNA, 17 bp, Homo sapiens
taattatatctgaggaa

SEQ ID NO: 2266262 - DNA, 19 bp, Homo sapiens
taattatatctgaggaatt

SEQ ID NO: 2266263 - DNA, 23 bp, Homo sapiens
taattatatctgaggaattctgt

SEQ ID NO: 2266264 - DNA, 14 bp, Homo sapiens
taattatatgctat

SEQ ID NO: 2266265 - DNA, 19 bp, Homo sapiens
taattatatgctatttcta

SEQ ID NO: 2266266 - DNA, 12 bp, Homo sapiens
taattttggaat

SEQ ID NO: 2266267 - DNA, 19 bp, Homo sapiens
tacaattttgtttctgtac

SEQ ID NO: 2266268 - DNA, 14 bp, Homo sapiens
tacagtataattaa

SEQ ID NO: 2266269 - DNA, 18 bp, Homo sapiens
tacagtataattaacatg

SEQ ID NO: 2266270 - DNA, 12 bp, Homo sapiens
tactcaatttta

SEQ ID NO: 2266271 - DNA, 14 bp, Homo sapiens
tactttttggcata

SEQ ID NO: 2266272 - DNA, 13 bp, Homo sapiens
tagaattctgtat

SEQ ID NO: 2266273 - DNA, 16 bp, Homo sapiens
tagaattctgtataga

SEQ ID NO: 2266274 - DNA, 14 bp, Homo sapiens
tagagagtgttgaa

SEQ ID NO: 2266275 - DNA, 16 bp, Homo sapiens
tagattagaattctgt

SEQ ID NO: 2266276 - DNA, 17 bp, Homo sapiens
tagattagaattctgta

SEQ ID NO: 2266277 - DNA, 20 bp, Homo sapiens
tagattagagagtgttgaaa

SEQ ID NO: 2266278 - DNA, 21 bp, Homo sapiens
tagctagactggtgactgatt

SEQ ID NO: 2266279 - DNA, 22 bp, Homo sapiens
tagctagactggtgactgattc

SEQ ID NO: 2266280 - DNA, 17 bp, Homo sapiens
tagtcttgtctcagatt

SEQ ID NO: 2266281 - DNA, 12 bp, Homo sapiens
tataattaacat

SEQ ID NO: 2266282 - DNA, 13 bp, Homo sapiens
tataattaacatg

SEQ ID NO: 2266283 - DNA, 19 bp, Homo sapiens
tataattaacatgttaaac

SEQ ID NO: 2266284 - DNA, 21 bp, Homo sapiens
tatagaacctctttgtctaca

SEQ ID NO: 2266285 - DNA, 19 bp, Homo sapiens
tatagattagagagtgttg

SEQ ID NO: 2266286 - DNA, 18 bp, Homo sapiens
tatatgctatttctatat

SEQ ID NO: 2266287 - DNA, 18 bp, Homo sapiens
tatctgaagtcagatctg

SEQ ID NO: 2266288 - DNA, 16 bp, Homo sapiens
tatctgaggaattctg

SEQ ID NO: 2266289 - DNA, 19 bp, Homo sapiens
tatctgaggaattctgtat

SEQ ID NO: 2266290 - DNA, 22 bp, Homo sapiens
tatctgaggaattctgtataga

SEQ ID NO: 2266291 - DNA, 14 bp, Homo sapiens
tatgaaacttgtgt

SEQ ID NO: 2266292 - DNA, 20 bp, Homo sapiens
tatgatccagcagattattc

SEQ ID NO: 2266293 - DNA, 21 bp, Homo sapiens
tatgatccagcagattattca

SEQ ID NO: 2266294 - DNA, 16 bp, Homo sapiens
tatgctatttctatat

SEQ ID NO: 2266295 - DNA, 19 bp, Homo sapiens
tatgtaaatcccattattc

SEQ ID NO: 2266296 - DNA, 23 bp, Homo sapiens
acttgttagatctagttcactct

SEQ ID NO: 2266297 - DNA, 12 bp, Homo sapiens
actttggataat

SEQ ID NO: 2266298 - DNA, 12 bp, Homo sapiens
acttttctgata

SEQ ID NO: 2266299 - DNA, 21 bp, Homo sapiens
agaatggtccgtgctaaggac

SEQ ID NO: 2266300 - DNA, 17 bp, Homo sapiens
agactggtgactgattc

SEQ ID NO: 2266301 - DNA, 19 bp, Homo sapiens
agactggtgactgattctt

SEQ ID NO: 2266302 - DNA, 21 bp, Homo sapiens
agactggtgactgattcttca

SEQ ID NO: 2266303 - DNA, 13 bp, Homo sapiens
agatctgcctaag

SEQ ID NO: 2266304 - DNA, 21 bp, Homo sapiens
agattagagagtgttgaaacg

SEQ ID NO: 2266305 - DNA, 15 bp, Homo sapiens
agattttattatgta

SEQ ID NO: 2266306 - DNA, 17 bp, Homo sapiens
agattttattatgtaaa

SEQ ID NO: 2266307 - DNA, 21 bp, Homo sapiens
agattttattatgtaaatccc

SEQ ID NO: 2266308 - DNA, 23 bp, Homo sapiens
agatttttttgttgtttgtttag

SEQ ID NO: 2266309 - DNA, 17 bp, Homo sapiens
agcaaaaatattttatg

SEQ ID NO: 2266310 - DNA, 18 bp, Homo sapiens
agcaaaaatattttatga

SEQ ID NO: 2266311 - DNA, 23 bp, Homo sapiens
agcaaaaatattttatgatccag

SEQ ID NO: 2266312 - DNA, 22 bp, Homo sapiens
agcatatatttttatatttact

SEQ ID NO: 2266313 - DNA, 16 bp, Homo sapiens
agccatgtttattaca

SEQ ID NO: 2266314 - DNA, 22 bp, Homo sapiens
agccatgtttattacagtataa

SEQ ID NO: 2266315 - DNA, 21 bp, Homo sapiens
agctagactggtgactgattc

SEQ ID NO: 2266316 - DNA, 23 bp, Homo sapiens
aggaatggagcctgcacggtgaa

SEQ ID NO: 2266317 - DNA, 14 bp, Homo sapiens
aggaattctgtata

SEQ ID NO: 2266318 - DNA, 15 bp, Homo sapiens
aggaattctgtatag

SEQ ID NO: 2266319 - DNA, 22 bp, Homo sapiens
aggacttctttaattttggaat

SEQ ID NO: 2266320 - DNA, 14 bp, Homo sapiens
aggacttgttagat

SEQ ID NO: 2266321 - DNA, 13 bp, Homo sapiens
agtataattaaca

SEQ ID NO: 2266322 - DNA, 22 bp, Homo sapiens
agtattgtacaaagtattaagc

SEQ ID NO: 2266323 - DNA, 20 bp, Homo sapiens
agtcagatctgcctaaggac

SEQ ID NO: 2266324 - DNA, 19 bp, Homo sapiens
agtctggctgtacccagga

SEQ ID NO: 2266325 - DNA, 21 bp, Homo sapiens
agtctggctgtacccaggaat

SEQ ID NO: 2266326 - DNA, 16 bp, Homo sapiens
agtcttgtctcagatt

SEQ ID NO: 2266327 - DNA, 19 bp, Homo sapiens
agtgagttgggtgtattgt

SEQ ID NO: 2266328 - DNA, 21 bp, Homo sapiens
agtgagttgggtgtattgtgc

SEQ ID NO: 2266329 - DNA, 11 bp, Homo sapiens
agttgaattta

SEQ ID NO: 2266330 - DNA, 17 bp, Homo sapiens
agttgaatttattggct

SEQ ID NO: 2266331 - DNA, 19 bp, Homo sapiens
agttgcctaaatccatttg

SEQ ID NO: 2266332 - DNA, 22 bp, Homo sapiens
agttgcctaaatccatttggaa

SEQ ID NO: 2266333 - DNA, 20 bp, Homo sapiens
agtttaatattaaagccatg

SEQ ID NO: 2266334 - DNA, 18 bp, Homo sapiens
agttttgtttggaccaaa

SEQ ID NO: 2266335 - DNA, 22 bp, Homo sapiens
ataaatagctagactggtgact

SEQ ID NO: 2266336 - DNA, 21 bp, Homo sapiens
ataaatctgtgaacttgaaat

SEQ ID NO: 2266337 - DNA, 15 bp, Homo sapiens
ataacataaatctgt

SEQ ID NO: 2266338 - DNA, 19 bp, Homo sapiens
ataataaggaaaagtttaa

SEQ ID NO: 2266339 - DNA, 21 bp, Homo sapiens
ataattaacatgttaaaccat

SEQ ID NO: 2266340 - DNA, 19 bp, Homo sapiens
ataattatatgctatttct

SEQ ID NO: 2266341 - DNA, 14 bp, Homo sapiens
atacaattttgttt

SEQ ID NO: 2266342 - DNA, 16 bp, Homo sapiens
atacaattttgtttct

SEQ ID NO: 2266343 - DNA, 19 bp, Homo sapiens
atacaattttgtttctgta

SEQ ID NO: 2266344 - DNA, 20 bp, Homo sapiens
atacaattttgtttctgtac

SEQ ID NO: 2266345 - DNA, 20 bp, Homo sapiens
atagaacctctttgtctaca

SEQ ID NO: 2266346 - DNA, 22 bp, Homo sapiens
atagaggaagcctgattaaaga

SEQ ID NO: 2266347 - DNA, 15 bp, Homo sapiens
atagattagaattct

SEQ ID NO: 2266348 - DNA, 21 bp, Homo sapiens
atagattagagagtgttgaaa

SEQ ID NO: 2266349 - DNA, 15 bp, Homo sapiens
atagctagactggtg

SEQ ID NO: 2266350 - DNA, 13 bp, Homo sapiens
atagtctggctgt

SEQ ID NO: 2266351 - DNA, 15 bp, Homo sapiens
atatctgaggaattc

SEQ ID NO: 2266352 - DNA, 20 bp, Homo sapiens
atatctgaggaattctgtat

SEQ ID NO: 2266353 - DNA, 21 bp, Homo sapiens
atatctgaggaattctgtata

SEQ ID NO: 2266354 - DNA, 22 bp, Homo sapiens
atatctgaggaattctgtatag

SEQ ID NO: 2266355 - DNA, 18 bp, Homo sapiens
atatgctatttctatatt

SEQ ID NO: 2266356 - DNA, 23 bp, Homo sapiens
atatgctatttctatattttcat

SEQ ID NO: 2266357 - DNA, 20 bp, Homo sapiens
atatttactaaaatggactg

SEQ ID NO: 2266358 - DNA, 13 bp, Homo sapiens
atattttcattct

SEQ ID NO: 2266359 - DNA, 19 bp, Homo sapiens
atccatttggaaatcttta

SEQ ID NO: 2266360 - DNA, 14 bp, Homo sapiens
atcccattattcaa

SEQ ID NO: 2266361 - DNA, 23 bp, Homo sapiens
atctgaagtcagatctgcctaag

SEQ ID NO: 2266362 - DNA, 13 bp, Homo sapiens
atctgcctaagga

SEQ ID NO: 2266363 - DNA, 16 bp, Homo sapiens
atctgcctaaggactt

SEQ ID NO: 2266364 - DNA, 17 bp, Homo sapiens
atctgcctaaggacttc

SEQ ID NO: 2266365 - DNA, 17 bp, Homo sapiens
atctgtgaacttgaaat

SEQ ID NO: 2266366 - DNA, 19 bp, Homo sapiens
atctgtgaacttgaaattt

SEQ ID NO: 2266367 - DNA, 16 bp, Homo sapiens
atgatttctatgctga
